United States Patent 7,655,785 (BIOINFORMATICALLY DETECTABLE GROUP OF NOVEL REGULATORY OLIGONUCLEOTIDES AND USES THEREOF) - sequence listing, part 45

SEQ ID NO: 1861034 - RNA, 16 nt, Homo sapiens
uucucauuuuucuaaa

SEQ ID NO: 1861035 - RNA, 17 nt, Homo sapiens
cucuucggaagaccucg

SEQ ID NO: 1861036 - RNA, 16 nt, Homo sapiens
auuauuuuucucucuc

SEQ ID NO: 1861037 - RNA, 17 nt, Homo sapiens
gcagaaguuaggcacga

SEQ ID NO: 1861038 - RNA, 9 nt, Homo sapiens
aacugucau

SEQ ID NO: 1861039 - RNA, 13 nt, Homo sapiens
uaguuagcuuucu

SEQ ID NO: 1861040 - RNA, 18 nt, Homo sapiens
ggccagaagagcuuguca

SEQ ID NO: 1861041 - RNA, 22 nt, Homo sapiens
auuuuccuguccucuuucagcu

SEQ ID NO: 1861042 - RNA, 13 nt, Homo sapiens
acuguguacugug

SEQ ID NO: 1861043 - RNA, 16 nt, Homo sapiens
cuaaaggaugagauuu

SEQ ID NO: 1861044 - RNA, 14 nt, Homo sapiens
gagagaauacaaua

SEQ ID NO: 1861045 - RNA, 12 nt, Homo sapiens
uggaaaaugcau

SEQ ID NO: 1861046 - RNA, 14 nt, Homo sapiens
gacccagaaaggac

SEQ ID NO: 1861047 - RNA, 15 nt, Homo sapiens
cucugcagucucuau

SEQ ID NO: 1861048 - RNA, 21 nt, Homo sapiens
agaggcaggaccagaaggcaa

SEQ ID NO: 1861049 - RNA, 16 nt, Homo sapiens
caggagaagaacaaga

SEQ ID NO: 1861050 - RNA, 15 nt, Homo sapiens
aacuuuuuauucuca

SEQ ID NO: 1861051 - RNA, 23 nt, Homo sapiens
uaaccuucaaguaugugcuacuu

SEQ ID NO: 1861052 - RNA, 23 nt, Homo sapiens
uauuccgggugccauucccacua

SEQ ID NO: 1861053 - RNA, 14 nt, Homo sapiens
aaaauuaugccaua

SEQ ID NO: 1861054 - RNA, 17 nt, Homo sapiens
agaaaauugcugugccu

SEQ ID NO: 1861055 - RNA, 13 nt, Homo sapiens
ccaguaucgcuca

SEQ ID NO: 1861056 - RNA, 22 nt, Homo sapiens
uuacuaaagguuuuaaccgcac

SEQ ID NO: 1861057 - RNA, 15 nt, Homo sapiens
ggaugcagugccuuu

SEQ ID NO: 1861058 - RNA, 21 nt, Homo sapiens
gagugucuuaaaauguuucaa

SEQ ID NO: 1861059 - RNA, 19 nt, Homo sapiens
aggccucuccaguuugcac

SEQ ID NO: 1861060 - RNA, 14 nt, Homo sapiens
uucucauucuugcc

SEQ ID NO: 1861061 - RNA, 20 nt, Homo sapiens
augggaaaacuucacuccaa

SEQ ID NO: 1861062 - RNA, 16 nt, Homo sapiens
gcucuaccaagacaua

SEQ ID NO: 1861063 - RNA, 18 nt, Homo sapiens
cugggacuacaggcaccc

SEQ ID NO: 1861064 - RNA, 13 nt, Homo sapiens
ucacaaagaucau

SEQ ID NO: 1861065 - RNA, 22 nt, Homo sapiens
uaugcagugcugcuuugccaaa

SEQ ID NO: 1861066 - RNA, 17 nt, Homo sapiens
ugaaagaguagugcauu

SEQ ID NO: 1861067 - RNA, 23 nt, Homo sapiens
acagagugcuaauuuaguucuca

SEQ ID NO: 1861068 - RNA, 17 nt, Homo sapiens
gggguccccagggcugu

SEQ ID NO: 1861069 - RNA, 20 nt, Homo sapiens
aauguaaaguaagacaucuc

SEQ ID NO: 1861070 - RNA, 18 nt, Homo sapiens
uggaauuugaaacacuuu

SEQ ID NO: 1861071 - RNA, 16 nt, Homo sapiens
gcuuuacagcacugua

SEQ ID NO: 1861072 - RNA, 16 nt, Homo sapiens
gaaaacaucuauucuc

SEQ ID NO: 1861073 - RNA, 12 nt, Homo sapiens
uaacucuuaccu

SEQ ID NO: 1861074 - RNA, 12 nt, Homo sapiens
aacuucuuucac

SEQ ID NO: 1861075 - RNA, 19 nt, Homo sapiens
uucuuccuauuuccuugua

SEQ ID NO: 1861076 - RNA, 17 nt, Homo sapiens
cugugccaggacuguga

SEQ ID NO: 1861077 - RNA, 19 nt, Homo sapiens
acggcaaccucugagccau

SEQ ID NO: 1861078 - RNA, 16 nt, Homo sapiens
uaauuggcaugaaggu

SEQ ID NO: 1861079 - RNA, 21 nt, Homo sapiens
uguuaacuuuuguaccaaaua

SEQ ID NO: 1861080 - RNA, 23 nt, Homo sapiens
ugccucugacagcagccugugag

SEQ ID NO: 1861081 - RNA, 20 nt, Homo sapiens
agaaggggcuuugugaccag

SEQ ID NO: 1861082 - RNA, 22 nt, Homo sapiens
uuuuugggaccuugcgugaaga

SEQ ID NO: 1861083 - RNA, 20 nt, Homo sapiens
aucuggacauucgaggaauu

SEQ ID NO: 1861084 - RNA, 17 nt, Homo sapiens
ugcuuuucuaaucugca

SEQ ID NO: 1861085 - RNA, 19 nt, Homo sapiens
uggaauuuucagucaucuc

SEQ ID NO: 1861086 - RNA, 22 nt, Homo sapiens
gccaagcuuguuaucagcuuuc

SEQ ID NO: 1861087 - RNA, 22 nt, Homo sapiens
cuuaugaguauaaugaacacuc

SEQ ID NO: 1861088 - RNA, 15 nt, Homo sapiens
ucucggaguccaaag

SEQ ID NO: 1861089 - RNA, 20 nt, Homo sapiens
cuugaagacaucgauauaca

SEQ ID NO: 1861090 - RNA, 17 nt, Homo sapiens
aauuuucaagagaagaa

SEQ ID NO: 1861091 - RNA, 14 nt, Homo sapiens
uccagcugauccag

SEQ ID NO: 1861092 - RNA, 22 nt, Homo sapiens
uucauaugaggggacccagcgc

SEQ ID NO: 1861093 - RNA, 12 nt, Homo sapiens
accuuaccaaaa

SEQ ID NO: 1861094 - RNA, 22 nt, Homo sapiens
auuaaucucuaguaaaacauug

SEQ ID NO: 1861095 - RNA, 14 nt, Homo sapiens
gaagaaagacuccu

SEQ ID NO: 1861096 - RNA, 12 nt, Homo sapiens
aaccucauuaau

SEQ ID NO: 1861097 - RNA, 16 nt, Homo sapiens
ugaaggaucuugccug

SEQ ID NO: 1861098 - RNA, 15 nt, Homo sapiens
gcauaauaugcauau

SEQ ID NO: 1861099 - RNA, 19 nt, Homo sapiens
auucuccuuugcacuguuu

SEQ ID NO: 1861100 - RNA, 11 nt, Homo sapiens
ccuugucuccc

SEQ ID NO: 1861101 - RNA, 14 nt, Homo sapiens
caaaguacucuuua

SEQ ID NO: 1861102 - RNA, 13 nt, Homo sapiens
acguuaggccagg

SEQ ID NO: 1861103 - RNA, 21 nt, Homo sapiens
ucagucucugaauacacagua

SEQ ID NO: 1861104 - RNA, 14 nt, Homo sapiens
aaugggcagguggc

SEQ ID NO: 1861105 - RNA, 14 nt, Homo sapiens
ggacucuugcucuu

SEQ ID NO: 1861106 - RNA, 19 nt, Homo sapiens
uuauauaguauaccauaca

SEQ ID NO: 1861107 - RNA, 14 nt, Homo sapiens
caagccccugccca

SEQ ID NO: 1861108 - RNA, 20 nt, Homo sapiens
cacaucccuauagaccacug

SEQ ID NO: 1861109 - RNA, 23 nt, Homo sapiens
agccaacuuuugcauguuuugua

SEQ ID NO: 1861110 - RNA, 15 nt, Homo sapiens
auuacugaaagggag

SEQ ID NO: 1861111 - RNA, 17 nt, Homo sapiens
accccuuacacaaaugu

SEQ ID NO: 1861112 - RNA, 18 nt, Homo sapiens
gaugaaaaauugcugacu

SEQ ID NO: 1861113 - RNA, 14 nt, Homo sapiens
caaccuugucaguu

SEQ ID NO: 1861114 - RNA, 16 nt, Homo sapiens
ucaauaacuauugcug

SEQ ID NO: 1861115 - RNA, 13 nt, Homo sapiens
cagggccaugcag

SEQ ID NO: 1861116 - RNA, 21 nt, Homo sapiens
uagacucggggugcuuccuug

SEQ ID NO: 1861117 - RNA, 16 nt, Homo sapiens
gggaaagagauccagg

SEQ ID NO: 1861118 - RNA, 17 nt, Homo sapiens
cuuccgcaguguggcca

SEQ ID NO: 1861119 - RNA, 17 nt, Homo sapiens
auaaggggucaaaauuu

SEQ ID NO: 1861120 - RNA, 14 nt, Homo sapiens
augcuaugucauuu

SEQ ID NO: 1861121 - RNA, 15 nt, Homo sapiens
cuuccccaacuuccc

SEQ ID NO: 1861122 - RNA, 17 nt, Homo sapiens
auuaaugcauuuugcug

SEQ ID NO: 1861123 - RNA, 20 nt, Homo sapiens
acuccaccaucacucacuca

SEQ ID NO: 1861124 - RNA, 19 nt, Homo sapiens
aggagaaggaugguucaua

SEQ ID NO: 1861125 - RNA, 14 nt, Homo sapiens
ccagugagacugug

SEQ ID NO: 1861126 - RNA, 14 nt, Homo sapiens
auccugcccagugu

SEQ ID NO: 1861127 - RNA, 19 nt, Homo sapiens
ucucuuguuaaaugagcuu

SEQ ID NO: 1861128 - RNA, 21 nt, Homo sapiens
acguuucccguuagucucuga

SEQ ID NO: 1861129 - RNA, 14 nt, Homo sapiens
aucacuuaccacuu

SEQ ID NO: 1861130 - RNA, 19 nt, Homo sapiens
agaaagaaguuauuuucca

SEQ ID NO: 1861131 - RNA, 20 nt, Homo sapiens
cuggucaaccccacaagcac

SEQ ID NO: 1861132 - RNA, 17 nt, Homo sapiens
ucuggcuuagugccacc

SEQ ID NO: 1861133 - RNA, 16 nt, Homo sapiens
uucucacccugugaaa

SEQ ID NO: 1861134 - RNA, 20 nt, Homo sapiens
auucauauaggccagaguug

SEQ ID NO: 1861135 - RNA, 15 nt, Homo sapiens
auuugaucacuacaa

SEQ ID NO: 1861136 - RNA, 16 nt, Homo sapiens
caggugugaaccacca

SEQ ID NO: 1861137 - RNA, 21 nt, Homo sapiens
gagcuuggaagcuucugguga

SEQ ID NO: 1861138 - RNA, 20 nt, Homo sapiens
uucccuaacuuaacauugca

SEQ ID NO: 1861139 - RNA, 20 nt, Homo sapiens
augcacucgugugagacaag

SEQ ID NO: 1861140 - RNA, 16 nt, Homo sapiens
aggagggacagucuca

SEQ ID NO: 1861141 - RNA, 19 nt, Homo sapiens
gccuccucuaacaggggcu

SEQ ID NO: 1861142 - RNA, 15 nt, Homo sapiens
auaaaguuccuguca

SEQ ID NO: 1861143 - RNA, 14 nt, Homo sapiens
cugcagcccacaga

SEQ ID NO: 1861144 - RNA, 16 nt, Homo sapiens
uucccuggcguccucu

SEQ ID NO: 1861145 - RNA, 12 nt, Homo sapiens
uggaaucaaauc

SEQ ID NO: 1861146 - RNA, 22 nt, Homo sapiens
ugacugggacccugaagaggca

SEQ ID NO: 1861147 - RNA, 17 nt, Homo sapiens
ccagacuggaagacacu

SEQ ID NO: 1861148 - RNA, 20 nt, Homo sapiens
auaaaagcuagauacuggaa

SEQ ID NO: 1861149 - RNA, 12 nt, Homo sapiens
uguuucuauacu

SEQ ID NO: 1861150 - RNA, 23 nt, Homo sapiens
agcugagauugcgccacugcacu

SEQ ID NO: 1861151 - RNA, 19 nt, Homo sapiens
uagauuaaaauauuugccu

SEQ ID NO: 1861152 - RNA, 21 nt, Homo sapiens
cagguuagaagacgacugugg

SEQ ID NO: 1861153 - RNA, 17 nt, Homo sapiens
cucugucacaaagggac

SEQ ID NO: 1861154 - RNA, 23 nt, Homo sapiens
aaaagcauuauccuuuuaucuca

SEQ ID NO: 1861155 - RNA, 16 nt, Homo sapiens
cgcauccuaugcuuaa

SEQ ID NO: 1861156 - RNA, 21 nt, Homo sapiens
acaaaucguccaaagaucuca

SEQ ID NO: 1861157 - RNA, 15 nt, Homo sapiens
caggcucaugccauc

SEQ ID NO: 1861158 - RNA, 19 nt, Homo sapiens
cagaagaugcuuagcugua

SEQ ID NO: 1861159 - RNA, 16 nt, Homo sapiens
ugcucugcucuaccau

SEQ ID NO: 1861160 - RNA, 21 nt, Homo sapiens
auugcuccauuuucuugucaa

SEQ ID NO: 1861161 - RNA, 14 nt, Homo sapiens
uuucucuuccuaaa

SEQ ID NO: 1861162 - RNA, 14 nt, Homo sapiens
uccucccccaguuc

SEQ ID NO: 1861163 - RNA, 15 nt, Homo sapiens
cucacaugugacaaa

SEQ ID NO: 1861164 - RNA, 15 nt, Homo sapiens
ccuauuuucaugauu

SEQ ID NO: 1861165 - RNA, 19 nt, Homo sapiens
aggggccccugauccucac

SEQ ID NO: 1861166 - RNA, 22 nt, Homo sapiens
cucagagcagggccaaagcaca

SEQ ID NO: 1861167 - RNA, 21 nt, Homo sapiens
cgcugcugucacaaccaagaa

SEQ ID NO: 1861168 - RNA, 12 nt, Homo sapiens
cuccuaaccuag

SEQ ID NO: 1861169 - RNA, 16 nt, Homo sapiens
gaugcaccaaguacag

SEQ ID NO: 1861170 - RNA, 21 nt, Homo sapiens
auuucaagaaguguaguucaa

SEQ ID NO: 1861171 - RNA, 22 nt, Homo sapiens
ccugucauccucaugcugcuca

SEQ ID NO: 1861172 - RNA, 20 nt, Homo sapiens
ucugaacguggaauucaccu

SEQ ID NO: 1861173 - RNA, 20 nt, Homo sapiens
cuauucuaacuaaugacaag

SEQ ID NO: 1861174 - RNA, 23 nt, Homo sapiens
cccccagccuggacaccucucau

SEQ ID NO: 1861175 - RNA, 22 nt, Homo sapiens
uuccauuucuuaacagucucca

SEQ ID NO: 1861176 - RNA, 20 nt, Homo sapiens
aacaaaaauuaaaauccuca

SEQ ID NO: 1861177 - RNA, 20 nt, Homo sapiens
gugccuccuuccaccucccu

SEQ ID NO: 1861178 - RNA, 23 nt, Homo sapiens
auaugauccagagcagaguuuac

SEQ ID NO: 1861179 - RNA, 17 nt, Homo sapiens
gugcagcccaaucugcc

SEQ ID NO: 1861180 - RNA, 17 nt, Homo sapiens
cauguugauuaaacucg

SEQ ID NO: 1861181 - RNA, 11 nt, Homo sapiens
uugacauagcc

SEQ ID NO: 1861182 - RNA, 22 nt, Homo sapiens
cuguucuguuuggcacuuguau

SEQ ID NO: 1861183 - RNA, 18 nt, Homo sapiens
aaaguucuuuuugcucua

SEQ ID NO: 1861184 - RNA, 21 nt, Homo sapiens
ugcauaagguuuuuaugcaug

SEQ ID NO: 1861185 - RNA, 23 nt, Homo sapiens
ccucucuuucacacaaugcccaa

SEQ ID NO: 1861186 - RNA, 21 nt, Homo sapiens
aagacuucucuuuugcacauc

SEQ ID NO: 1861187 - RNA, 23 nt, Homo sapiens
agaaugugucucaggaaaacagc

SEQ ID NO: 1861188 - RNA, 21 nt, Homo sapiens
augcuuugggucauaaaucag

SEQ ID NO: 1861189 - RNA, 18 nt, Homo sapiens
ggugugggaagaccaaag

SEQ ID NO: 1861190 - RNA, 15 nt, Homo sapiens
cagucuagugcaaaa

SEQ ID NO: 1861191 - RNA, 22 nt, Homo sapiens
aaucucggcucacugcauccuc

SEQ ID NO: 1861192 - RNA, 23 nt, Homo sapiens
aaauauccacuggacacugugaa

SEQ ID NO: 1861193 - RNA, 19 nt, Homo sapiens
uuauguggauuucaucacu

SEQ ID NO: 1861194 - RNA, 18 nt, Homo sapiens
caucuggaauuccagucu

SEQ ID NO: 1861195 - RNA, 17 nt, Homo sapiens
cucaacacgacugcaag

SEQ ID NO: 1861196 - RNA, 19 nt, Homo sapiens
gucuacguaugcaugcuaa

SEQ ID NO: 1861197 - RNA, 17 nt, Homo sapiens
ccgacuagacacacaaa

SEQ ID NO: 1861198 - RNA, 22 nt, Homo sapiens
agcccacaucccacaugcggcu

SEQ ID NO: 1861199 - RNA, 12 nt, Homo sapiens
aacuagugaaau

SEQ ID NO: 1861200 - RNA, 12 nt, Homo sapiens
cccaagugccaa

SEQ ID NO: 1861201 - RNA, 21 nt, Homo sapiens
aggagaaccacuacaugcagc

SEQ ID NO: 1861202 - RNA, 20 nt, Homo sapiens
gagugcucugaugcaauagu

SEQ ID NO: 1861203 - RNA, 22 nt, Homo sapiens
guaucuucguaacuucauauua

SEQ ID NO: 1861204 - RNA, 18 nt, Homo sapiens
cucugccugaaccuucca

SEQ ID NO: 1861205 - RNA, 15 nt, Homo sapiens
gucugcaucuuaggg

SEQ ID NO: 1861206 - RNA, 18 nt, Homo sapiens
agcagauuaccucuugcc

SEQ ID NO: 1861207 - RNA, 23 nt, Homo sapiens
accuggacggugcgcacaccgcc

SEQ ID NO: 1861208 - RNA, 15 nt, Homo sapiens
cucucaggcccagug

SEQ ID NO: 1861209 - RNA, 21 nt, Homo sapiens
auccuaaacccuuaaccuaaa

SEQ ID NO: 1861210 - RNA, 13 nt, Homo sapiens
acgcagccugaga

SEQ ID NO: 1861211 - RNA, 21 nt, Homo sapiens
cuagucacuuguuucuacuca

SEQ ID NO: 1861212 - RNA, 16 nt, Homo sapiens
uaugagucaaugugca

SEQ ID NO: 1861213 - RNA, 15 nt, Homo sapiens
ucuuauuaagacugg

SEQ ID NO: 1861214 - RNA, 16 nt, Homo sapiens
uaaauggcaugacaua

SEQ ID NO: 1861215 - RNA, 17 nt, Homo sapiens
gaaauguaccuucuuuc

SEQ ID NO: 1861216 - RNA, 22 nt, Homo sapiens
ucuuaacuuaaaagaacauagg

SEQ ID NO: 1861217 - RNA, 15 nt, Homo sapiens
uugugauuauuucac

SEQ ID NO: 1861218 - RNA, 22 nt, Homo sapiens
guaucgcauauuaguuaaucuc

SEQ ID NO: 1861219 - RNA, 13 nt, Homo sapiens
ugcuuccuuccag

SEQ ID NO: 1861220 - RNA, 17 nt, Homo sapiens
ucuaucauuuuugagca

SEQ ID NO: 1861221 - RNA, 18 nt, Homo sapiens
cagggcaggcuugccacc

SEQ ID NO: 1861222 - RNA, 21 nt, Homo sapiens
agaggacaccuguacuggaga

SEQ ID NO: 1861223 - RNA, 16 nt, Homo sapiens
uacacagcugagcaau

SEQ ID NO: 1861224 - RNA, 15 nt, Homo sapiens
aaauuucuucugggc

SEQ ID NO: 1861225 - RNA, 19 nt, Homo sapiens
auuuuugaauacaggcaua

SEQ ID NO: 1861226 - RNA, 16 nt, Homo sapiens
gaaacuguuaucacuu

SEQ ID NO: 1861227 - RNA, 16 nt, Homo sapiens
gagauccugagucaug

SEQ ID NO: 1861228 - RNA, 17 nt, Homo sapiens
auuacaaauccaaugaa

SEQ ID NO: 1861229 - RNA, 17 nt, Homo sapiens
guucuauuuguauauau

SEQ ID NO: 1861230 - RNA, 19 nt, Homo sapiens
gcagggcgccccugggaga

SEQ ID NO: 1861231 - RNA, 19 nt, Homo sapiens
aauuguauuuuuuguugaa

SEQ ID NO: 1861232 - RNA, 23 nt, Homo sapiens
cuguccacgcgugccguggcacc

SEQ ID NO: 1861233 - RNA, 19 nt, Homo sapiens
gaacaugccugccaaagac

SEQ ID NO: 1861234 - RNA, 19 nt, Homo sapiens
uucgagaccagccugacca

SEQ ID NO: 1861235 - RNA, 14 nt, Homo sapiens
uucugcauuacuau

SEQ ID NO: 1861236 - RNA, 20 nt, Homo sapiens
aacauccagaagguuugcac

SEQ ID NO: 1861237 - RNA, 19 nt, Homo sapiens
agcgaaugauugcuuuuaa

SEQ ID NO: 1861238 - RNA, 16 nt, Homo sapiens
aaugagacuugcucuc

SEQ ID NO: 1861239 - RNA, 18 nt, Homo sapiens
cagcugcuucugugcauu

SEQ ID NO: 1861240 - RNA, 10 nt, Homo sapiens
uaugugaaaa

SEQ ID NO: 1861241 - RNA, 10 nt, Homo sapiens
ugugugaaag

SEQ ID NO: 1861242 - RNA, 14 nt, Homo sapiens
cuggagaugaugau

SEQ ID NO: 1861243 - RNA, 14 nt, Homo sapiens
aagucuaagcaaga

SEQ ID NO: 1861244 - RNA, 21 nt, Homo sapiens
gaggacuacuuuccagaauuu

SEQ ID NO: 1861245 - RNA, 17 nt, Homo sapiens
agugaaagaguagugca

SEQ ID NO: 1861246 - RNA, 14 nt, Homo sapiens
uaauauuacauuuc

SEQ ID NO: 1861247 - RNA, 20 nt, Homo sapiens
gagcgagugcucucacugua

SEQ ID NO: 1861248 - RNA, 17 nt, Homo sapiens
cacuguggcacugccac

SEQ ID NO: 1861249 - RNA, 20 nt, Homo sapiens
gcaaauuaaaacauauuuca

SEQ ID NO: 1861250 - RNA, 19 nt, Homo sapiens
cugaacaaaaccuacacac

SEQ ID NO: 1861251 - RNA, 22 nt, Homo sapiens
ucacaauuauagauuagaucaa

SEQ ID NO: 1861252 - RNA, 17 nt, Homo sapiens
cacacccccuuuccauc

SEQ ID NO: 1861253 - RNA, 17 nt, Homo sapiens
gccaugaagaagugcuu

SEQ ID NO: 1861254 - RNA, 17 nt, Homo sapiens
ccuauugccuccauucu

SEQ ID NO: 1861255 - RNA, 12 nt, Homo sapiens
cauuccaugaag

SEQ ID NO: 1861256 - RNA, 17 nt, Homo sapiens
agaguuguucucagggg

SEQ ID NO: 1861257 - RNA, 12 nt, Homo sapiens
gcuuucuucuac

SEQ ID NO: 1861258 - RNA, 21 nt, Homo sapiens
gguccucuacuuaaugagaua

SEQ ID NO: 1861259 - RNA, 14 nt, Homo sapiens
agguagcuuaccug

SEQ ID NO: 1861260 - RNA, 18 nt, Homo sapiens
accaaaauagucuucuca

SEQ ID NO: 1861261 - RNA, 16 nt, Homo sapiens
cacacccgugagaaau

SEQ ID NO: 1861262 - RNA, 16 nt, Homo sapiens
ccuucugccaacgccu

SEQ ID NO: 1861263 - RNA, 18 nt, Homo sapiens
aaagcaaaauaacaaaaa

SEQ ID NO: 1861264 - RNA, 19 nt, Homo sapiens
acaccauuauaaaaacacu

SEQ ID NO: 1861265 - RNA, 21 nt, Homo sapiens
uccuugcaggcagaaggcagu

SEQ ID NO: 1861266 - RNA, 20 nt, Homo sapiens
ggcaggggcuuccuggugcu

SEQ ID NO: 1861267 - RNA, 23 nt, Homo sapiens
cagagaugcaccaccaagccaag

SEQ ID NO: 1861268 - RNA, 17 nt, Homo sapiens
agacuagccacuccugc

SEQ ID NO: 1861269 - RNA, 21 nt, Homo sapiens
cagagagagagaauggauccu

SEQ ID NO: 1861270 - RNA, 22 nt, Homo sapiens
cuccuaccuggggacuccucaa

SEQ ID NO: 1861271 - RNA, 21 nt, Homo sapiens
ugccaggcccggcaugaggcc

SEQ ID NO: 1861272 - RNA, 17 nt, Homo sapiens
agauguuuaugauguaa

SEQ ID NO: 1861273 - RNA, 15 nt, Homo sapiens
ucucgugcauuucaa

SEQ ID NO: 1861274 - RNA, 19 nt, Homo sapiens
aucauacuccuaugcuuua

SEQ ID NO: 1861275 - RNA, 22 nt, Homo sapiens
aggugcccaggaaccucagggc

SEQ ID NO: 1861276 - RNA, 17 nt, Homo sapiens
uggucagggcagggcuc

SEQ ID NO: 1861277 - RNA, 17 nt, Homo sapiens
ccugugcuacaauucau

SEQ ID NO: 1861278 - RNA, 17 nt, Homo sapiens
gcucauccucacugccg

SEQ ID NO: 1861279 - RNA, 16 nt, Homo sapiens
cuggugggucuuuaau

SEQ ID NO: 1861280 - RNA, 20 nt, Homo sapiens
uaguuuaucauuuacugugu

SEQ ID NO: 1861281 - RNA, 19 nt, Homo sapiens
gccuuuccaaugaaggaaa

SEQ ID NO: 1861282 - RNA, 15 nt, Homo sapiens
ugcaguaauuugcaa

SEQ ID NO: 1861283 - RNA, 14 nt, Homo sapiens
ccugggcugugagg

SEQ ID NO: 1861284 - RNA, 14 nt, Homo sapiens
auauguauggaucu

SEQ ID NO: 1861285 - RNA, 17 nt, Homo sapiens
cccuagcuuagagccuc

SEQ ID NO: 1861286 - RNA, 13 nt, Homo sapiens
cuggauaaaccac

SEQ ID NO: 1861287 - RNA, 22 nt, Homo sapiens
uaagugccauuacuacuguaca

SEQ ID NO: 1861288 - RNA, 23 nt, Homo sapiens
cuuaguccgcaaguucagggaag

SEQ ID NO: 1861289 - RNA, 15 nt, Homo sapiens
ugcaacauaacaauu

SEQ ID NO: 1861290 - RNA, 17 nt, Homo sapiens
uccaaaucccuuucaug

SEQ ID NO: 1861291 - RNA, 13 nt, Homo sapiens
agugacgcugcug

SEQ ID NO: 1861292 - RNA, 19 nt, Homo sapiens
ucugauauagaauugcaau

SEQ ID NO: 1861293 - RNA, 17 nt, Homo sapiens
acagggcacaggccaug

SEQ ID NO: 1861294 - RNA, 18 nt, Homo sapiens
ugucagacgagcagugac

SEQ ID NO: 1861295 - RNA, 11 nt, Homo sapiens
cccuugccuua

SEQ ID NO: 1861296 - RNA, 23 nt, Homo sapiens
ucagaaacccggcuuccugugcu

SEQ ID NO: 1861297 - RNA, 15 nt, Homo sapiens
cuugauaugaccugu

SEQ ID NO: 1861298 - RNA, 20 nt, Homo sapiens
gugcaacgcuuuuugggaga

SEQ ID NO: 1861299 - RNA, 21 nt, Homo sapiens
uaaauaacccugggcugucca

SEQ ID NO: 1861300 - RNA, 23 nt, Homo sapiens
guguacaccagcaggacacugau

SEQ ID NO: 1861301 - RNA, 22 nt, Homo sapiens
uugcuauaauguauaaugggaa

SEQ ID NO: 1861302 - RNA, 16 nt, Homo sapiens
uucuguauaacagccu

SEQ ID NO: 1861303 - RNA, 19 nt, Homo sapiens
ccuauuuagaaauggauuu

SEQ ID NO: 1861304 - RNA, 18 nt, Homo sapiens
acacuccaacucuacaca

SEQ ID NO: 1861305 - RNA, 22 nt, Homo sapiens
ccaggaggggaacacugcccuc

SEQ ID NO: 1861306 - RNA, 20 nt, Homo sapiens
gacacaucuauugcagagac

SEQ ID NO: 1861307 - RNA, 18 nt, Homo sapiens
uuaaagcuaaggaccuua

SEQ ID NO: 1861308 - RNA, 19 nt, Homo sapiens
uuucuauauuauugcccau

SEQ ID NO: 1861309 - RNA, 21 nt, Homo sapiens
cauaagccuaccaauguagac

SEQ ID NO: 1861310 - RNA, 20 nt, Homo sapiens
uguaccacuacuuagagaua

SEQ ID NO: 1861311 - RNA, 23 nt, Homo sapiens
aaguuuuguuuguucacacuccu

SEQ ID NO: 1861312 - RNA, 13 nt, Homo sapiens
uuuacgacaagga

SEQ ID NO: 1861313 - RNA, 12 nt, Homo sapiens
aguuauugcaca

SEQ ID NO: 1861314 - RNA, 21 nt, Homo sapiens
cccucgagcucuguagccugg

SEQ ID NO: 1861315 - RNA, 15 nt, Homo sapiens
agaaggcacugggaa

SEQ ID NO: 1861316 - RNA, 18 nt, Homo sapiens
auauugcagucaaucucu

SEQ ID NO: 1861317 - RNA, 16 nt, Homo sapiens
gaaaaggcagccagau

SEQ ID NO: 1861318 - RNA, 12 nt, Homo sapiens
agaagacuguau

SEQ ID NO: 1861319 - RNA, 16 nt, Homo sapiens
ggcccugagccacuga

SEQ ID NO: 1861320 - RNA, 15 nt, Homo sapiens
acaccuuuaucucaa

SEQ ID NO: 1861321 - RNA, 15 nt, Homo sapiens
aggugaauagcacag

SEQ ID NO: 1861322 - RNA, 18 nt, Homo sapiens
acccaacuacugagcuga

SEQ ID NO: 1861323 - RNA, 17 nt, Homo sapiens
ugugucuagugccacac

SEQ ID NO: 1861324 - RNA, 14 nt, Homo sapiens
auuuuuugugauca

SEQ ID NO: 1861325 - RNA, 19 nt, Homo sapiens
cggcggcuaccugagcuga

SEQ ID NO: 1861326 - RNA, 15 nt, Homo sapiens
uuucacauucaugca

SEQ ID NO: 1861327 - RNA, 12 nt, Homo sapiens
aauaauucuucc

SEQ ID NO: 1861328 - RNA, 15 nt, Homo sapiens
cugagcaccguguca

SEQ ID NO: 1861329 - RNA, 15 nt, Homo sapiens
ugcucccucuguguu

SEQ ID NO: 1861330 - RNA, 23 nt, Homo sapiens
cucucgcaagggaaguccuugca

SEQ ID NO: 1861331 - RNA, 18 nt, Homo sapiens
uauuuugaaaaaccaucu

SEQ ID NO: 1861332 - RNA, 17 nt, Homo sapiens
ucacuucugcuguacag

SEQ ID NO: 1861333 - RNA, 12 nt, Homo sapiens
uaaauaccucuu

SEQ ID NO: 1861334 - RNA, 18 nt, Homo sapiens
ucgcagcuuuuagaccaa

SEQ ID NO: 1861335 - RNA, 16 nt, Homo sapiens
gacugaugucaucuug

SEQ ID NO: 1861336 - RNA, 15 nt, Homo sapiens
guuugaagcugcugu

SEQ ID NO: 1861337 - RNA, 16 nt, Homo sapiens
ucuuaguucuuaccuu

SEQ ID NO: 1861338 - RNA, 17 nt, Homo sapiens
ggauggcacccuggaac

SEQ ID NO: 1861339 - RNA, 21 nt, Homo sapiens
uacuucaaccagccuacaagc

SEQ ID NO: 1861340 - RNA, 18 nt, Homo sapiens
aaaaauacucugcuauuu

SEQ ID NO: 1861341 - RNA, 15 nt, Homo sapiens
aauauuaaauauaug

SEQ ID NO: 1861342 - RNA, 21 nt, Homo sapiens
ugcaggugggguucgagggga

SEQ ID NO: 1861343 - RNA, 21 nt, Homo sapiens
cagacugggaguugcuagcaa

SEQ ID NO: 1861344 - RNA, 16 nt, Homo sapiens
gcccuaugucucagga

SEQ ID NO: 1861345 - RNA, 16 nt, Homo sapiens
uucaggccgcaagcag

SEQ ID NO: 1861346 - RNA, 17 nt, Homo sapiens
agauuuaacaauuccaa

SEQ ID NO: 1861347 - RNA, 15 nt, Homo sapiens
aagauuuuauucuua

SEQ ID NO: 1861348 - RNA, 21 nt, Homo sapiens
aagauuuagcacccuucugcu

SEQ ID NO: 1861349 - RNA, 12 nt, Homo sapiens
uaucaauucaca

SEQ ID NO: 1861350 - RNA, 19 nt, Homo sapiens
gccuggcacauuucaggga

SEQ ID NO: 1861351 - RNA, 22 nt, Homo sapiens
aacaucauuccaaaaagaacaa

SEQ ID NO: 1861352 - RNA, 12 nt, Homo sapiens
gcaggaccaagg

SEQ ID NO: 1861353 - RNA, 17 nt, Homo sapiens
auuguaauugucucaaa

SEQ ID NO: 1861354 - RNA, 15 nt, Homo sapiens
auuuagcaccaggga

SEQ ID NO: 1861355 - RNA, 21 nt, Homo sapiens
uuccuucaagaggaccaaaug

SEQ ID NO: 1861356 - RNA, 22 nt, Homo sapiens
aauagcugcuaggguaggaaag

SEQ ID NO: 1861357 - RNA, 18 nt, Homo sapiens
ucuaaauguacaaauucu

SEQ ID NO: 1861358 - RNA, 22 nt, Homo sapiens
uaggaauauagauuaaaucaua

SEQ ID NO: 1861359 - RNA, 14 nt, Homo sapiens
aagagaaucacaga

SEQ ID NO: 1861360 - RNA, 21 nt, Homo sapiens
gccucggccucccaaaguguu

SEQ ID NO: 1861361 - RNA, 15 nt, Homo sapiens
ucuagugcuacugcu

SEQ ID NO: 1861362 - RNA, 19 nt, Homo sapiens
ccuggggccccauuugcca

SEQ ID NO: 1861363 - RNA, 23 nt, Homo sapiens
guggcaaagguuuauuccagaga

SEQ ID NO: 1861364 - RNA, 21 nt, Homo sapiens
gagucaugauccuugcugaua

SEQ ID NO: 1861365 - RNA, 20 nt, Homo sapiens
guucucagguguugccaaau

SEQ ID NO: 1861366 - RNA, 17 nt, Homo sapiens
gaaguucuuuuacugua

SEQ ID NO: 1861367 - RNA, 14 nt, Homo sapiens
gaggcaugugauga

SEQ ID NO: 1861368 - RNA, 15 nt, Homo sapiens
ucagaaccacuccug

SEQ ID NO: 1861369 - RNA, 15 nt, Homo sapiens
gaaauggaacagauu

SEQ ID NO: 1861370 - RNA, 18 nt, Homo sapiens
aagguauuagcaaagcaa

SEQ ID NO: 1861371 - RNA, 15 nt, Homo sapiens
gagcaggagccugca

SEQ ID NO: 1861372 - RNA, 11 nt, Homo sapiens
cgcgcuccaug

SEQ ID NO: 1861373 - RNA, 13 nt, Homo sapiens
ggcccugcugagu

SEQ ID NO: 1861374 - RNA, 20 nt, Homo sapiens
acaaagcugugaaaugugca

SEQ ID NO: 1861375 - RNA, 15 nt, Homo sapiens
guggcagggcucagg

SEQ ID NO: 1861376 - RNA, 21 nt, Homo sapiens
uccccaguagagaaacauuug

SEQ ID NO: 1861377 - RNA, 16 nt, Homo sapiens
ccuaauguguuuagau

SEQ ID NO: 1861378 - RNA, 19 nt, Homo sapiens
gagugcaguggcgugaucu

SEQ ID NO: 1861379 - RNA, 16 nt, Homo sapiens
acuaauccucucugca

SEQ ID NO: 1861380 - RNA, 21 nt, Homo sapiens
gagcucuuguuccgugccagg

SEQ ID NO: 1861381 - RNA, 16 nt, Homo sapiens
acuuuaaaagacugaa

SEQ ID NO: 1861382 - RNA, 19 nt, Homo sapiens
ugcccagccuguggugcuu

SEQ ID NO: 1861383 - RNA, 11 nt, Homo sapiens
acuugaacuca

SEQ ID NO: 1861384 - RNA, 15 nt, Homo sapiens
aauuucccccuaaac

SEQ ID NO: 1861385 - RNA, 15 nt, Homo sapiens
aacacaaaacauuca

SEQ ID NO: 1861386 - RNA, 20 nt, Homo sapiens
aacccuucuggaaacuguga

SEQ ID NO: 1861387 - RNA, 19 nt, Homo sapiens
cacaggccacggaccaaug

SEQ ID NO: 1861388 - RNA, 12 nt, Homo sapiens
agauggaguucu

SEQ ID NO: 1861389 - RNA, 14 nt, Homo sapiens
gagaguuucuguua

SEQ ID NO: 1861390 - RNA, 22 nt, Homo sapiens
cuuggucugugagaugcuagaa

SEQ ID NO: 1861391 - RNA, 14 nt, Homo sapiens
aggauauugcuaau

SEQ ID NO: 1861392 - RNA, 22 nt, Homo sapiens
acauucauguucuagucugcuu

SEQ ID NO: 1861393 - RNA, 14 nt, Homo sapiens
uauguuauuuucag

SEQ ID NO: 1861394 - RNA, 17 nt, Homo sapiens
agauagaagaacugcaa

SEQ ID NO: 1861395 - RNA, 13 nt, Homo sapiens
auaccucauucac

SEQ ID NO: 1861396 - RNA, 14 nt, Homo sapiens
ccaagggucuuccu

SEQ ID NO: 1861397 - RNA, 12 nt, Homo sapiens
gaaaaccccgcc

SEQ ID NO: 1861398 - RNA, 20 nt, Homo sapiens
uugacagauugaauuugccu

SEQ ID NO: 1861399 - RNA, 20 nt, Homo sapiens
ugggcucaagcuucccaagu

SEQ ID NO: 1861400 - RNA, 15 nt, Homo sapiens
caguauacacacuuu

SEQ ID NO: 1861401 - RNA, 16 nt, Homo sapiens
caugaauaacauuuaa

SEQ ID NO: 1861402 - RNA, 23 nt, Homo sapiens
cucccauaauugcuuugccaaaa

SEQ ID NO: 1861403 - RNA, 12 nt, Homo sapiens
cugcuccaugca

SEQ ID NO: 1861404 - RNA, 22 nt, Homo sapiens
aucucuaacauaugauacugau

SEQ ID NO: 1861405 - RNA, 20 nt, Homo sapiens
acucugcauccagagauuca

SEQ ID NO: 1861406 - RNA, 18 nt, Homo sapiens
cucucccaacucuugcac

SEQ ID NO: 1861407 - RNA, 22 nt, Homo sapiens
aaaauguuaccacuacuuuaau

SEQ ID NO: 1861408 - RNA, 16 nt, Homo sapiens
cuuggaacauuggaau

SEQ ID NO: 1861409 - RNA, 18 nt, Homo sapiens
uggccacggccacggcca

SEQ ID NO: 1861410 - RNA, 21 nt, Homo sapiens
gacaaacuaacaggaacaaaa

SEQ ID NO: 1861411 - RNA, 17 nt, Homo sapiens
cugagaaauagguauca

SEQ ID NO: 1861412 - RNA, 19 nt, Homo sapiens
cgaauucggguggcauccu

SEQ ID NO: 1861413 - RNA, 14 nt, Homo sapiens
uacugagcacugaa

SEQ ID NO: 1861414 - RNA, 21 nt, Homo sapiens
gguucccaaaucccucucaca

SEQ ID NO: 1861415 - RNA, 20 nt, Homo sapiens
uuuguucuucuaccacccac

SEQ ID NO: 1861416 - RNA, 12 nt, Homo sapiens
gucucucauggg

SEQ ID NO: 1861417 - RNA, 21 nt, Homo sapiens
gaaaaguuaacacaaguacua

SEQ ID NO: 1861418 - RNA, 18 nt, Homo sapiens
accaucucccuggugcuu

SEQ ID NO: 1861419 - RNA, 22 nt, Homo sapiens
ccugauugcugagugucaucuc

SEQ ID NO: 1861420 - RNA, 23 nt, Homo sapiens
gccccaauucaauccugccaaua

SEQ ID NO: 1861421 - RNA, 20 nt, Homo sapiens
augcccagcuuggagugcca

SEQ ID NO: 1861422 - RNA, 22 nt, Homo sapiens
agcuaagaucacaucacugcac

SEQ ID NO: 1861423 - RNA, 21 nt, Homo sapiens
aaaucuuuuucuauauucuca

SEQ ID NO: 1861424 - RNA, 19 nt, Homo sapiens
uaaagccuagcgauaauuu

SEQ ID NO: 1861425 - RNA, 11 nt, Homo sapiens
aucagacacaa

SEQ ID NO: 1861426 - RNA, 18 nt, Homo sapiens
auauguauaucacauucc

SEQ ID NO: 1861427 - RNA, 16 nt, Homo sapiens
caaagaugacugugga

SEQ ID NO: 1861428 - RNA, 23 nt, Homo sapiens
cugugugaagaaagccucaguga

SEQ ID NO: 1861429 - RNA, 23 nt, Homo sapiens
gagucgcucucaugaagcccuua

SEQ ID NO: 1861430 - RNA, 17 nt, Homo sapiens
auauaugaaauaaguaa

SEQ ID NO: 1861431 - RNA, 15 nt, Homo sapiens
uuuaggauuacuuag

SEQ ID NO: 1861432 - RNA, 16 nt, Homo sapiens
uuuaauucugucuugu

SEQ ID NO: 1861433 - RNA, 22 nt, Homo sapiens
ugagcgcccccgagcccugacu

SEQ ID NO: 1861434 - RNA, 18 nt, Homo sapiens
acagcacccaggcuccau

SEQ ID NO: 1861435 - RNA, 16 nt, Homo sapiens
aaugagcuuguaaaua

SEQ ID NO: 1861436 - RNA, 13 nt, Homo sapiens
aaugagaugacca

SEQ ID NO: 1861437 - RNA, 16 nt, Homo sapiens
acauuugucuucauga

SEQ ID NO: 1861438 - RNA, 20 nt, Homo sapiens
ccgaagcccaggcugaagag

SEQ ID NO: 1861439 - RNA, 21 nt, Homo sapiens
aagguccacucccugcuccac

SEQ ID NO: 1861440 - RNA, 15 nt, Homo sapiens
cacagucaguggagc

SEQ ID NO: 1861441 - RNA, 23 nt, Homo sapiens
aggcaggaggaucacagugaccu

SEQ ID NO: 1861442 - RNA, 21 nt, Homo sapiens
acaaccaugcaaauugugaaa

SEQ ID NO: 1861443 - RNA, 13 nt, Homo sapiens
cccucaucauagc

SEQ ID NO: 1861444 - RNA, 20 nt, Homo sapiens
cugggaugaaggcuugucag

SEQ ID NO: 1861445 - RNA, 12 nt, Homo sapiens
uucaccauguaa

SEQ ID NO: 1861446 - RNA, 18 nt, Homo sapiens
acuguuugaagauugccu

SEQ ID NO: 1861447 - RNA, 14 nt, Homo sapiens
ugcaaaguaaggag

SEQ ID NO: 1861448 - RNA, 17 nt, Homo sapiens
gagaaacgcucaugaca

SEQ ID NO: 1861449 - RNA, 14 nt, Homo sapiens
agaaugucucgguc

SEQ ID NO: 1861450 - RNA, 22 nt, Homo sapiens
uaccacuucgccuucuugccag

SEQ ID NO: 1861451 - RNA, 18 nt, Homo sapiens
cucuuugggccuggcucc

SEQ ID NO: 1861452 - RNA, 22 nt, Homo sapiens
accugauggaaguaaagccuca

SEQ ID NO: 1861453 - RNA, 23 nt, Homo sapiens
ugguguucuguuucaauguauaa

SEQ ID NO: 1861454 - RNA, 17 nt, Homo sapiens
ugucacuguacaguuuu

SEQ ID NO: 1861455 - RNA, 15 nt, Homo sapiens
gauuuggcugcacuu

SEQ ID NO: 1861456 - RNA, 16 nt, Homo sapiens
agcauccugucuggca

SEQ ID NO: 1861457 - RNA, 13 nt, Homo sapiens
aauuuacagagcc

SEQ ID NO: 1861458 - RNA, 23 nt, Homo sapiens
ccuugcccacccccaccaugcag

SEQ ID NO: 1861459 - RNA, 14 nt, Homo sapiens
cuccucacugaaaa

SEQ ID NO: 1861460 - RNA, 20 nt, Homo sapiens
acgccuaaaacucaaaacac

SEQ ID NO: 1861461 - RNA, 14 nt, Homo sapiens
aaugaagaugaugc

SEQ ID NO: 1861462 - RNA, 14 nt, Homo sapiens
aagauaaaaaucac

SEQ ID NO: 1861463 - RNA, 16 nt, Homo sapiens
guucuaugauauacaa

SEQ ID NO: 1861464 - RNA, 17 nt, Homo sapiens
acaguugucaaauugau

SEQ ID NO: 1861465 - RNA, 21 nt, Homo sapiens
cauucuuucccaacaccucuu

SEQ ID NO: 1861466 - RNA, 20 nt, Homo sapiens
caagggaggggagcagccua

SEQ ID NO: 1861467 - RNA, 15 nt, Homo sapiens
uucaauaaaguacug

SEQ ID NO: 1861468 - RNA, 20 nt, Homo sapiens
gcaacaucuuacuuguccuu

SEQ ID NO: 1861469 - RNA, 22 nt, Homo sapiens
agucuuuguaaguaaacugccc

SEQ ID NO: 1861470 - RNA, 17 nt, Homo sapiens
uuacugcuuaaauucca

SEQ ID NO: 1861471 - RNA, 19 nt, Homo sapiens
agcuccuuguuuuugccaa

SEQ ID NO: 1861472 - RNA, 14 nt, Homo sapiens
cuuccaaaccugac

SEQ ID NO: 1861473 - RNA, 19 nt, Homo sapiens
aacauaaaacaaugaagga

SEQ ID NO: 1861474 - RNA, 16 nt, Homo sapiens
ugggaguaacagggca

SEQ ID NO: 1861475 - RNA, 23 nt, Homo sapiens
gagccuccugcccuuaccugcca

SEQ ID NO: 1861476 - RNA, 13 nt, Homo sapiens
ccaugguuuuacu

SEQ ID NO: 1861477 - RNA, 20 nt, Homo sapiens
aaauucacaagcuaacuucc

SEQ ID NO: 1861478 - RNA, 13 nt, Homo sapiens
aggugugccagaa

SEQ ID NO: 1861479 - RNA, 15 nt, Homo sapiens
acaggcugguucuga

SEQ ID NO: 1861480 - RNA, 23 nt, Homo sapiens
caucccaggaucgcaagagccau

SEQ ID NO: 1861481 - RNA, 14 nt, Homo sapiens
cucacugcuaucug

SEQ ID NO: 1861482 - RNA, 15 nt, Homo sapiens
caaaaauauauucau

SEQ ID NO: 1861483 - RNA, 22 nt, Homo sapiens
gggcacuuuaagucagugacag

SEQ ID NO: 1861484 - RNA, 14 nt, Homo sapiens
agcagagugauuca

SEQ ID NO: 1861485 - RNA, 21 nt, Homo sapiens
ccagaagaacaguaggugaca

SEQ ID NO: 1861486 - RNA, 21 nt, Homo sapiens
ugacaaaaaauuaaagcauuu

SEQ ID NO: 1861487 - RNA, 21 nt, Homo sapiens
uuccaaaauaauuuuaagaaa

SEQ ID NO: 1861488 - RNA, 23 nt, Homo sapiens
gagugauugacacacagcacucu

SEQ ID NO: 1861489 - RNA, 21 nt, Homo sapiens
cugacccaugcugcccuguga

SEQ ID NO: 1861490 - RNA, 17 nt, Homo sapiens
cuuuuaaaagcacguau

SEQ ID NO: 1861491 - RNA, 21 nt, Homo sapiens
uucaggugaagcuggagcuca

SEQ ID NO: 1861492 - RNA, 11 nt, Homo sapiens
gucuugccagg

SEQ ID NO: 1861493 - RNA, 19 nt, Homo sapiens
uccaugguuaucugagaua

SEQ ID NO: 1861494 - RNA, 16 nt, Homo sapiens
aacccgaggcugagaa

SEQ ID NO: 1861495 - RNA, 20 nt, Homo sapiens
cuuccuagggaucugaaauc

SEQ ID NO: 1861496 - RNA, 22 nt, Homo sapiens
auucugacauccacaugcucug

SEQ ID NO: 1861497 - RNA, 19 nt, Homo sapiens
cuggauccagcacugguga

SEQ ID NO: 1861498 - RNA, 23 nt, Homo sapiens
cugagaaaggugaggagggcagu

SEQ ID NO: 1861499 - RNA, 17 nt, Homo sapiens
ucgaaaagaagguauuu

SEQ ID NO: 1861500 - RNA, 16 nt, Homo sapiens
augugaaagacaauaa

SEQ ID NO: 1861501 - RNA, 12 nt, Homo sapiens
ugcgaaagggac

SEQ ID NO: 1861502 - RNA, 20 nt, Homo sapiens
cucacaccuguaaucccagc

SEQ ID NO: 1861503 - RNA, 12 nt, Homo sapiens
acucaccuugug

SEQ ID NO: 1861504 - RNA, 20 nt, Homo sapiens
aaucaaguucuugucuuuag

SEQ ID NO: 1861505 - RNA, 15 nt, Homo sapiens
ucugcuaaauaucac

SEQ ID NO: 1861506 - RNA, 14 nt, Homo sapiens
cacaaaguggcaua

SEQ ID NO: 1861507 - RNA, 15 nt, Homo sapiens
uagcucuauuuacuu

SEQ ID NO: 1861508 - RNA, 21 nt, Homo sapiens
uaucuacccagucauguacug

SEQ ID NO: 1861509 - RNA, 19 nt, Homo sapiens
guuucuaagcauguagcca

SEQ ID NO: 1861510 - RNA, 20 nt, Homo sapiens
ucaaaaaaaaaaaaauguga

SEQ ID NO: 1861511 - RNA, 21 nt, Homo sapiens
uguacacgaagaccauccauc

SEQ ID NO: 1861512 - RNA, 22 nt, Homo sapiens
cauaacagcaggguaccugaaa

SEQ ID NO: 1861513 - RNA, 16 nt, Homo sapiens
ccuguaauaaauauga

SEQ ID NO: 1861514 - RNA, 18 nt, Homo sapiens
uucauggugcacugagcu

SEQ ID NO: 1861515 - RNA, 18 nt, Homo sapiens
uaaugccccaaggacaag

SEQ ID NO: 1861516 - RNA, 17 nt, Homo sapiens
accaccauuuaauuuca

SEQ ID NO: 1861517 - RNA, 20 nt, Homo sapiens
uacaacaucaccagugccac

SEQ ID NO: 1861518 - RNA, 17 nt, Homo sapiens
aagaaguucacaucaga

SEQ ID NO: 1861519 - RNA, 16 nt, Homo sapiens
aauuaucuauccuuga

SEQ ID NO: 1861520 - RNA, 17 nt, Homo sapiens
aacuuuaaaaaagcaaa

SEQ ID NO: 1861521 - RNA, 15 nt, Homo sapiens
cguucuugccagcuu

SEQ ID NO: 1861522 - RNA, 20 nt, Homo sapiens
ugagacaggaaaaaccaaca

SEQ ID NO: 1861523 - RNA, 12 nt, Homo sapiens
ccgagcaaagau

SEQ ID NO: 1861524 - RNA, 12 nt, Homo sapiens
ccaugcaaagga

SEQ ID NO: 1861525 - RNA, 23 nt, Homo sapiens
aucuuaugagcccuauauauuca

SEQ ID NO: 1861526 - RNA, 21 nt, Homo sapiens
cuauuuauuugugagacugua

SEQ ID NO: 1861527 - RNA, 17 nt, Homo sapiens
cuggucagguauuucag

SEQ ID NO: 1861528 - RNA, 17 nt, Homo sapiens
guuuagauuucaagaaa

SEQ ID NO: 1861529 - RNA, 17 nt, Homo sapiens
gccauguuuuugccaaa

SEQ ID NO: 1861530 - RNA, 14 nt, Homo sapiens
ccucacucauuccc

SEQ ID NO: 1861531 - RNA, 15 nt, Homo sapiens
uauugucugccuuaa

SEQ ID NO: 1861532 - RNA, 12 nt, Homo sapiens
gccacuccucaa

SEQ ID NO: 1861533 - RNA, 16 nt, Homo sapiens
cauauuuuuacaaaua

SEQ ID NO: 1861534 - RNA, 14 nt, Homo sapiens
gaaucaacagcucc

SEQ ID NO: 1861535 - RNA, 21 nt, Homo sapiens
gccuucagaguacguccugcc

SEQ ID NO: 1861536 - RNA, 18 nt, Homo sapiens
ggagugucggauccugug

SEQ ID NO: 1861537 - RNA, 22 nt, Homo sapiens
aaauauuuagucugcauugcug

SEQ ID NO: 1861538 - RNA, 20 nt, Homo sapiens
gcaacucgugacagccucug

SEQ ID NO: 1861539 - RNA, 22 nt, Homo sapiens
gcaacagcaaaucacgaccacu

SEQ ID NO: 1861540 - RNA, 19 nt, Homo sapiens
ugagagugagcaaccagcu

SEQ ID NO: 1861541 - RNA, 12 nt, Homo sapiens
acagagggccac

SEQ ID NO: 1861542 - RNA, 14 nt, Homo sapiens
auacaaaggugcua

SEQ ID NO: 1861543 - RNA, 18 nt, Homo sapiens
uugcauugucuaaugaca

SEQ ID NO: 1861544 - RNA, 17 nt, Homo sapiens
uccuccccuauugcgcu

SEQ ID NO: 1861545 - RNA, 20 nt, Homo sapiens
uggucugcugaguaacaggu

SEQ ID NO: 1861546 - RNA, 23 nt, Homo sapiens
ucuaaguguugugaaacuguaaa

SEQ ID NO: 1861547 - RNA, 11 nt, Homo sapiens
aauaaagggac

SEQ ID NO: 1861548 - RNA, 23 nt, Homo sapiens
cuuugcucaguggaucacacaca

SEQ ID NO: 1861549 - RNA, 19 nt, Homo sapiens
aaaaaccacccacaaagaa

SEQ ID NO: 1861550 - RNA, 15 nt, Homo sapiens
cuaaaaagcaaaaau

SEQ ID NO: 1861551 - RNA, 15 nt, Homo sapiens
gcuucuauuagccag

SEQ ID NO: 1861552 - RNA, 22 nt, Homo sapiens
guucugauauuggacaguaaaa

SEQ ID NO: 1861553 - RNA, 14 nt, Homo sapiens
aucccuccaucuca

SEQ ID NO: 1861554 - RNA, 12 nt, Homo sapiens
accucuguacag

SEQ ID NO: 1861555 - RNA, 22 nt, Homo sapiens
ucuguggcaaaaguuuaaucag

SEQ ID NO: 1861556 - RNA, 16 nt, Homo sapiens
aggccgacccaaggga

SEQ ID NO: 1861557 - RNA, 15 nt, Homo sapiens
uuuaaaagcuucuca

SEQ ID NO: 1861558 - RNA, 12 nt, Homo sapiens
gugugauuugcu

SEQ ID NO: 1861559 - RNA, 20 nt, Homo sapiens
uaacaagucgaugaacuauu

SEQ ID NO: 1861560 - RNA, 14 nt, Homo sapiens
guaaaccauucuug

SEQ ID NO: 1861561 - RNA, 15 nt, Homo sapiens
uaaaggagcauauaa

SEQ ID NO: 1861562 - RNA, 18 nt, Homo sapiens
caaguugacaaaugccaa

SEQ ID NO: 1861563 - RNA, 19 nt, Homo sapiens
ccuuuaauauuuccaaugu

SEQ ID NO: 1861564 - RNA, 15 nt, Homo sapiens
cuuaaacagugucca

SEQ ID NO: 1861565 - RNA, 22 nt, Homo sapiens
cucauacccaugcacaguacaa

SEQ ID NO: 1861566 - RNA, 12 nt, Homo sapiens
agauacucucag

SEQ ID NO: 1861567 - RNA, 19 nt, Homo sapiens
gguuguagaaggagccuug

SEQ ID NO: 1861568 - RNA, 21 nt, Homo sapiens
ggccuggggagcccacugagg

SEQ ID NO: 1861569 - RNA, 19 nt, Homo sapiens
acagaagaaggaaauugaa

SEQ ID NO: 1861570 - RNA, 23 nt, Homo sapiens
gagugcaguggugcaaucuuggc

SEQ ID NO: 1861571 - RNA, 16 nt, Homo sapiens
cacagcaaugacauuu

SEQ ID NO: 1861572 - RNA, 22 nt, Homo sapiens
cuuaguccugauguacuuuaaa

SEQ ID NO: 1861573 - RNA, 22 nt, Homo sapiens
ggauaauaaagauacuagagaa

SEQ ID NO: 1861574 - RNA, 18 nt, Homo sapiens
ugaauaaugcuguuuuau

SEQ ID NO: 1861575 - RNA, 13 nt, Homo sapiens
ucuugccaucacu

SEQ ID NO: 1861576 - RNA, 20 nt, Homo sapiens
cuggaucuugugacccucca

SEQ ID NO: 1861577 - RNA, 19 nt, Homo sapiens
uugcccugaguggaucucc

SEQ ID NO: 1861578 - RNA, 13 nt, Homo sapiens
gugccaucaucuc

SEQ ID NO: 1861579 - RNA, 15 nt, Homo sapiens
caagaaacuguccaa

SEQ ID NO: 1861580 - RNA, 21 nt, Homo sapiens
agcagugaaauaugauaauaa

SEQ ID NO: 1861581 - RNA, 18 nt, Homo sapiens
uuccugaucacuaugcau

SEQ ID NO: 1861582 - RNA, 12 nt, Homo sapiens
ggcugacaaugc

SEQ ID NO: 1861583 - RNA, 22 nt, Homo sapiens
aaccguccagcaagugucauca

SEQ ID NO: 1861584 - RNA, 17 nt, Homo sapiens
ugccacauugcuucauu

SEQ ID NO: 1861585 - RNA, 20 nt, Homo sapiens
ugaagcccagccacauuuca

SEQ ID NO: 1861586 - RNA, 19 nt, Homo sapiens
cgauugaaagaaccagaga

SEQ ID NO: 1861587 - RNA, 21 nt, Homo sapiens
aguaauguaaaauccauccaa

SEQ ID NO: 1861588 - RNA, 21 nt, Homo sapiens
uugcagugaaccuagauugca

SEQ ID NO: 1861589 - RNA, 12 nt, Homo sapiens
ugagagcccuuu

SEQ ID NO: 1861590 - RNA, 18 nt, Homo sapiens
gagucgaccccaagcgac

SEQ ID NO: 1861591 - RNA, 21 nt, Homo sapiens
cugguuguugccaaacagcca

SEQ ID NO: 1861592 - RNA, 20 nt, Homo sapiens
caggcgauccaccugucuca

SEQ ID NO: 1861593 - RNA, 15 nt, Homo sapiens
ugguauuuuuuacug

SEQ ID NO: 1861594 - RNA, 14 nt, Homo sapiens
uugcuaaagcacuu

SEQ ID NO: 1861595 - RNA, 20 nt, Homo sapiens
auugauucacuuacugacuu

SEQ ID NO: 1861596 - RNA, 17 nt, Homo sapiens
agauaucagagcucuua

SEQ ID NO: 1861597 - RNA, 19 nt, Homo sapiens
agaauuaguggcacuugcu

SEQ ID NO: 1861598 - RNA, 21 nt, Homo sapiens
ugaggcauccacuucuuucag

SEQ ID NO: 1861599 - RNA, 12 nt, Homo sapiens
cuaaaacugcuc

SEQ ID NO: 1861600 - RNA, 15 nt, Homo sapiens
agccaaaugcaggga

SEQ ID NO: 1861601 - RNA, 16 nt, Homo sapiens
ccaccuuugccacaaa

SEQ ID NO: 1861602 - RNA, 16 nt, Homo sapiens
uguuucuuuauggcca

SEQ ID NO: 1861603 - RNA, 15 nt, Homo sapiens
cacugagagggcaau

SEQ ID NO: 1861604 - RNA, 19 nt, Homo sapiens
acucaguggacagugcugu

SEQ ID NO: 1861605 - RNA, 20 nt, Homo sapiens
cagccugguuuucacauaca

SEQ ID NO: 1861606 - RNA, 19 nt, Homo sapiens
uucccuucaaggucauuua

SEQ ID NO: 1861607 - RNA, 15 nt, Homo sapiens
ccaucugcugcaguu

SEQ ID NO: 1861608 - RNA, 22 nt, Homo sapiens
aaaaguaauuguagauggaaau

SEQ ID NO: 1861609 - RNA, 23 nt, Homo sapiens
ucagccacaugggaaacuuccaa

SEQ ID NO: 1861610 - RNA, 12 nt, Homo sapiens
uguaaaaugcaa

SEQ ID NO: 1861611 - RNA, 13 nt, Homo sapiens
gccuuauccaggu

SEQ ID NO: 1861612 - RNA, 15 nt, Homo sapiens
aacgugugugucuua

SEQ ID NO: 1861613 - RNA, 20 nt, Homo sapiens
ccugccacuguguacugugg

SEQ ID NO: 1861614 - RNA, 20 nt, Homo sapiens
uccaggagccucauccagcc

SEQ ID NO: 1861615 - RNA, 21 nt, Homo sapiens
uuuauaucacugucuagcugu

SEQ ID NO: 1861616 - RNA, 20 nt, Homo sapiens
ucacgcaucucuacuccucu

SEQ ID NO: 1861617 - RNA, 18 nt, Homo sapiens
uauaaaccagcuacuuga

SEQ ID NO: 1861618 - RNA, 19 nt, Homo sapiens
aacauguaagcauaacuua

SEQ ID NO: 1861619 - RNA, 15 nt, Homo sapiens
agggagggcugucau

SEQ ID NO: 1861620 - RNA, 23 nt, Homo sapiens
ugaaguaaugaauuuuuaugaua

SEQ ID NO: 1861621 - RNA, 19 nt, Homo sapiens
uuuauaaagauacuaaacc

SEQ ID NO: 1861622 - RNA, 20 nt, Homo sapiens
aaccccuuugcugguugcug

SEQ ID NO: 1861623 - RNA, 15 nt, Homo sapiens
auggccuggauucac

SEQ ID NO: 1861624 - RNA, 14 nt, Homo sapiens
cuggcuguggagca

SEQ ID NO: 1861625 - RNA, 14 nt, Homo sapiens
uauauucucuuugg

SEQ ID NO: 1861626 - RNA, 19 nt, Homo sapiens
agaacccucaggucacaag

SEQ ID NO: 1861627 - RNA, 17 nt, Homo sapiens
caaagagguaacugagg

SEQ ID NO: 1861628 - RNA, 16 nt, Homo sapiens
caguucuaguuugcau

SEQ ID NO: 1861629 - RNA, 15 nt, Homo sapiens
ggauaaggaggcacu

SEQ ID NO: 1861630 - RNA, 16 nt, Homo sapiens
agcaacuugaacuuca

SEQ ID NO: 1861631 - RNA, 16 nt, Homo sapiens
ugcaacuuagcucaca

SEQ ID NO: 1861632 - RNA, 18 nt, Homo sapiens
auguagcagugagucaua

SEQ ID NO: 1861633 - RNA, 17 nt, Homo sapiens
uaaaugcaaacuuaaga

SEQ ID NO: 1861634 - RNA, 15 nt, Homo sapiens
aagaauacacuguga

SEQ ID NO: 1861635 - RNA, 14 nt, Homo sapiens
caggugaaaaucca

SEQ ID NO: 1861636 - RNA, 16 nt, Homo sapiens
agcuccuugaguaaaa

SEQ ID NO: 1861637 - RNA, 15 nt, Homo sapiens
caauaaacuguuaca

SEQ ID NO: 1861638 - RNA, 18 nt, Homo sapiens
ccuguuguaacugcccaa

SEQ ID NO: 1861639 - RNA, 12 nt, Homo sapiens
caaucuugcccu

SEQ ID NO: 1861640 - RNA, 22 nt, Homo sapiens
uuuccuuucuuagcugaugucu

SEQ ID NO: 1861641 - RNA, 15 nt, Homo sapiens
gccaaacacacagaa

SEQ ID NO: 1861642 - RNA, 18 nt, Homo sapiens
gauaaauccaucacuaua

SEQ ID NO: 1861643 - RNA, 17 nt, Homo sapiens
agcgagagucugucuca

SEQ ID NO: 1861644 - RNA, 19 nt, Homo sapiens
ugauuauuuuuuaaagucu

SEQ ID NO: 1861645 - RNA, 15 nt, Homo sapiens
gaacugaacauucca

SEQ ID NO: 1861646 - RNA, 19 nt, Homo sapiens
cuguguuuucaaugcacaa

SEQ ID NO: 1861647 - RNA, 14 nt, Homo sapiens
auucugcaauggca

SEQ ID NO: 1861648 - RNA, 22 nt, Homo sapiens
gccagguaggauacguacaccu

SEQ ID NO: 1861649 - RNA, 16 nt, Homo sapiens
cucaguuucuucaccu

SEQ ID NO: 1861650 - RNA, 20 nt, Homo sapiens
auaccauuauuaucaaguag

SEQ ID NO: 1861651 - RNA, 15 nt, Homo sapiens
aaaucguuuauuuca

SEQ ID NO: 1861652 - RNA, 21 nt, Homo sapiens
ugucagccauuccuguuccca

SEQ ID NO: 1861653 - RNA, 20 nt, Homo sapiens
gagucgcaucucagugcagg

SEQ ID NO: 1861654 - RNA, 12 nt, Homo sapiens
ucuguucacuuu

SEQ ID NO: 1861655 - RNA, 15 nt, Homo sapiens
augguggguacaaaa

SEQ ID NO: 1861656 - RNA, 13 nt, Homo sapiens
ugaaggagccagu

SEQ ID NO: 1861657 - RNA, 22 nt, Homo sapiens
augggcagacugaaccagucca

SEQ ID NO: 1861658 - RNA, 21 nt, Homo sapiens
cccacaggccacggaccaaug

SEQ ID NO: 1861659 - RNA, 15 nt, Homo sapiens
gucugaaucucccaa

SEQ ID NO: 1861660 - RNA, 15 nt, Homo sapiens
gccagacauggaccu

SEQ ID NO: 1861661 - RNA, 15 nt, Homo sapiens
gaauucauugucuca

SEQ ID NO: 1861662 - RNA, 22 nt, Homo sapiens
ugcuugugaccuugacuugcca

SEQ ID NO: 1861663 - RNA, 21 nt, Homo sapiens
aauagucuagauggcuccucu

SEQ ID NO: 1861664 - RNA, 20 nt, Homo sapiens
aauaacuauauaagacauua

SEQ ID NO: 1861665 - RNA, 15 nt, Homo sapiens
aucucccagcaagac

SEQ ID NO: 1861666 - RNA, 20 nt, Homo sapiens
gugaaugccagugugcugau

SEQ ID NO: 1861667 - RNA, 17 nt, Homo sapiens
gacucuguaauugaaua

SEQ ID NO: 1861668 - RNA, 15 nt, Homo sapiens
acaaacgauuuggau

SEQ ID NO: 1861669 - RNA, 18 nt, Homo sapiens
agguugagcucuucuuaa

SEQ ID NO: 1861670 - RNA, 17 nt, Homo sapiens
acugcuucccacugggg

SEQ ID NO: 1861671 - RNA, 15 nt, Homo sapiens
cccuuugaagccuca

SEQ ID NO: 1861672 - RNA, 18 nt, Homo sapiens
ugcgcccaguccuuccac

SEQ ID NO: 1861673 - RNA, 22 nt, Homo sapiens
agaaaguggcagagccaggauu

SEQ ID NO: 1861674 - RNA, 22 nt, Homo sapiens
uuugaggacaagauaccaaggc

SEQ ID NO: 1861675 - RNA, 16 nt, Homo sapiens
ccuacaugacacaguu

SEQ ID NO: 1861676 - RNA, 13 nt, Homo sapiens
cacugugaagggu

SEQ ID NO: 1861677 - RNA, 14 nt, Homo sapiens
auauuacaacacuu

SEQ ID NO: 1861678 - RNA, 13 nt, Homo sapiens
cauuugugcaaga

SEQ ID NO: 1861679 - RNA, 20 nt, Homo sapiens
ccauauuuuaaaaaaucaaa

SEQ ID NO: 1861680 - RNA, 14 nt, Homo sapiens
gaauaaagcaucca

SEQ ID NO: 1861681 - RNA, 19 nt, Homo sapiens
ugaaaggggacaccuguac

SEQ ID NO: 1861682 - RNA, 18 nt, Homo sapiens
uauucuaaacagacucau

SEQ ID NO: 1861683 - RNA, 21 nt, Homo sapiens
gcuucuagcugacuugcacag

SEQ ID NO: 1861684 - RNA, 22 nt, Homo sapiens
cagauuauguauuaacuuguag

SEQ ID NO: 1861685 - RNA, 20 nt, Homo sapiens
agaacaagaccccgucucaa

SEQ ID NO: 1861686 - RNA, 21 nt, Homo sapiens
gacggguuggggccgggcaca

SEQ ID NO: 1861687 - RNA, 21 nt, Homo sapiens
ucucaagcacugacacucauu

SEQ ID NO: 1861688 - RNA, 17 nt, Homo sapiens
guauguaugagacagaa

SEQ ID NO: 1861689 - RNA, 21 nt, Homo sapiens
gauuguaaaaaaaaaugccuu

SEQ ID NO: 1861690 - RNA, 14 nt, Homo sapiens
gaccaugcugauga

SEQ ID NO: 1861691 - RNA, 20 nt, Homo sapiens
uaaauuacuuuuucauucuu

SEQ ID NO: 1861692 - RNA, 14 nt, Homo sapiens
ggcuucugggacag

SEQ ID NO: 1861693 - RNA, 16 nt, Homo sapiens
gaugaaagcugauuac

SEQ ID NO: 1861694 - RNA, 21 nt, Homo sapiens
ccauaaaggggagggacucau

SEQ ID NO: 1861695 - RNA, 22 nt, Homo sapiens
caccugccugcaucugugaaaa

SEQ ID NO: 1861696 - RNA, 21 nt, Homo sapiens
uuauagugcccuccauuguaa

SEQ ID NO: 1861697 - RNA, 19 nt, Homo sapiens
aggccacacucagcacaag

SEQ ID NO: 1861698 - RNA, 20 nt, Homo sapiens
uugaaucuacaacucugaaa

SEQ ID NO: 1861699 - RNA, 16 nt, Homo sapiens
aucagaccauaauguu

SEQ ID NO: 1861700 - RNA, 21 nt, Homo sapiens
agaauaauauugugucauaga

SEQ ID NO: 1861701 - RNA, 17 nt, Homo sapiens
gcuggagaguggcauca

SEQ ID NO: 1861702 - RNA, 17 nt, Homo sapiens
gugugugguccaugccc

SEQ ID NO: 1861703 - RNA, 22 nt, Homo sapiens
gauaaaagagaagccaaacagc

SEQ ID NO: 1861704 - RNA, 15 nt, Homo sapiens
ucccuugcuguaugc

SEQ ID NO: 1861705 - RNA, 18 nt, Homo sapiens
ggcuguacugccaaggua

SEQ ID NO: 1861706 - RNA, 17 nt, Homo sapiens
aaguugaugguauucau

SEQ ID NO: 1861707 - RNA, 22 nt, Homo sapiens
ccuggaggaggcuuugggacca

SEQ ID NO: 1861708 - RNA, 12 nt, Homo sapiens
gaggagcucaag

SEQ ID NO: 1861709 - RNA, 18 nt, Homo sapiens
gcagaggcaacacuggaa

SEQ ID NO: 1861710 - RNA, 20 nt, Homo sapiens
uucggacaugcuuuucugcc

SEQ ID NO: 1861711 - RNA, 15 nt, Homo sapiens
auuauuuuucaggaa

SEQ ID NO: 1861712 - RNA, 20 nt, Homo sapiens
acuagacaccuucugugcuc

SEQ ID NO: 1861713 - RNA, 20 nt, Homo sapiens
ccuucucccaugaggcacga

SEQ ID NO: 1861714 - RNA, 13 nt, Homo sapiens
aggacaccacuag

SEQ ID NO: 1861715 - RNA, 23 nt, Homo sapiens
ugccauccucccaaggggcccaa

SEQ ID NO: 1861716 - RNA, 17 nt, Homo sapiens
uaaccacuuaaggaccu

SEQ ID NO: 1861717 - RNA, 16 nt, Homo sapiens
cugaaugaacaaccuc

SEQ ID NO: 1861718 - RNA, 11 nt, Homo sapiens
uucuugcaaua

SEQ ID NO: 1861719 - RNA, 13 nt, Homo sapiens
aaagcagcucauu

SEQ ID NO: 1861720 - RNA, 13 nt, Homo sapiens
aagagccaaagaa

SEQ ID NO: 1861721 - RNA, 17 nt, Homo sapiens
cagagucaagcugauga

SEQ ID NO: 1861722 - RNA, 13 nt, Homo sapiens
caugcugagcaaa

SEQ ID NO: 1861723 - RNA, 17 nt, Homo sapiens
auccccaaaaaacaaga

SEQ ID NO: 1861724 - RNA, 23 nt, Homo sapiens
ugcaguacaugggugacuaucuc

SEQ ID NO: 1861725 - RNA, 17 nt, Homo sapiens
agauacccucugagaca

SEQ ID NO: 1861726 - RNA, 24 nt, Homo sapiens
uucuggacugcacacuuccaccau

SEQ ID NO: 1861727 - RNA, 14 nt, Homo sapiens
aauuaccuguggau

SEQ ID NO: 1861728 - RNA, 12 nt, Homo sapiens
uaaauagcuaag

SEQ ID NO: 1861729 - RNA, 14 nt, Homo sapiens
auuacauacagauu

SEQ ID NO: 1861730 - RNA, 23 nt, Homo sapiens
cugagccccugggacugcugcuu

SEQ ID NO: 1861731 - RNA, 13 nt, Homo sapiens
augaucgucauca

SEQ ID NO: 1861732 - RNA, 18 nt, Homo sapiens
gacagggcugcuccccaa

SEQ ID NO: 1861733 - RNA, 16 nt, Homo sapiens
gccagggccaugucag

SEQ ID NO: 1861734 - RNA, 18 nt, Homo sapiens
aaguacugcaaaaugcuu

SEQ ID NO: 1861735 - RNA, 15 nt, Homo sapiens
gagaccacacauuuu

SEQ ID NO: 1861736 - RNA, 23 nt, Homo sapiens
uuaccuuaaaacuaggcauuugu

SEQ ID NO: 1861737 - RNA, 21 nt, Homo sapiens
aaccccaagcugccucugggc

SEQ ID NO: 1861738 - RNA, 17 nt, Homo sapiens
agcccuugguuccuccc

SEQ ID NO: 1861739 - RNA, 20 nt, Homo sapiens
uggaacuauacccgggacca

SEQ ID NO: 1861740 - RNA, 17 nt, Homo sapiens
acaagauuaaauuccuu

SEQ ID NO: 1861741 - RNA, 23 nt, Homo sapiens
ccacuggggaggaauccuggacc

SEQ ID NO: 1861742 - RNA, 18 nt, Homo sapiens
gcacacacaagugcacag

SEQ ID NO: 1861743 - RNA, 11 nt, Homo sapiens
cuacaagccaa

SEQ ID NO: 1861744 - RNA, 22 nt, Homo sapiens
gaucucugcuuuggaaaucaca

SEQ ID NO: 1861745 - RNA, 12 nt, Homo sapiens
uuagauauugcu

SEQ ID NO: 1861746 - RNA, 21 nt, Homo sapiens
cucauaauagucguaagugga

SEQ ID NO: 1861747 - RNA, 15 nt, Homo sapiens
cuagagaacaugccc

SEQ ID NO: 1861748 - RNA, 15 nt, Homo sapiens
agcaggugcugagca

SEQ ID NO: 1861749 - RNA, 15 nt, Homo sapiens
caagucccccaagac

SEQ ID NO: 1861750 - RNA, 22 nt, Homo sapiens
uucauccagggaacugagcaca

SEQ ID NO: 1861751 - RNA, 15 nt, Homo sapiens
ucucagccacaacca

SEQ ID NO: 1861752 - RNA, 20 nt, Homo sapiens
cagagguugcagugagcuga

SEQ ID NO: 1861753 - RNA, 20 nt, Homo sapiens
cagaggaggggaaaguccag

SEQ ID NO: 1861754 - RNA, 11 nt, Homo sapiens
gucuugcccaa

SEQ ID NO: 1861755 - RNA, 23 nt, Homo sapiens
agcuuugcuccgcucccaccgcc

SEQ ID NO: 1861756 - RNA, 15 nt, Homo sapiens
aucacuucaggucag

SEQ ID NO: 1861757 - RNA, 21 nt, Homo sapiens
gaccgcguuggaaggugcaga

SEQ ID NO: 1861758 - RNA, 21 nt, Homo sapiens
gauguguccuagacuccgggu

SEQ ID NO: 1861759 - RNA, 21 nt, Homo sapiens
caccuccuuuucuucuagcuu

SEQ ID NO: 1861760 - RNA, 17 nt, Homo sapiens
uguaugugugaguguau

SEQ ID NO: 1861761 - RNA, 19 nt, Homo sapiens
caggaaaauuuaaaauuca

SEQ ID NO: 1861762 - RNA, 19 nt, Homo sapiens
uccaucugacaaauucaaa

SEQ ID NO: 1861763 - RNA, 15 nt, Homo sapiens
uacauacuguauaua

SEQ ID NO: 1861764 - RNA, 15 nt, Homo sapiens
cacauggcaugaaau

SEQ ID NO: 1861765 - RNA, 16 nt, Homo sapiens
cuaaacguauuucacu

SEQ ID NO: 1861766 - RNA, 16 nt, Homo sapiens
ucuucugaucacugaa

SEQ ID NO: 1861767 - RNA, 22 nt, Homo sapiens
acuauuuagauauaacacuaug

SEQ ID NO: 1861768 - RNA, 22 nt, Homo sapiens
uagucccauugauguacuuuac

SEQ ID NO: 1861769 - RNA, 16 nt, Homo sapiens
ccugggaaccaugaag

SEQ ID NO: 1861770 - RNA, 14 nt, Homo sapiens
uaaaaagagacugu

SEQ ID NO: 1861771 - RNA, 20 nt, Homo sapiens
aagcauaaaaauuagccaag

SEQ ID NO: 1861772 - RNA, 19 nt, Homo sapiens
uuacaaggcccuuuccuuu

SEQ ID NO: 1861773 - RNA, 12 nt, Homo sapiens
uccagucucucc

SEQ ID NO: 1861774 - RNA, 18 nt, Homo sapiens
ugcuguguaacagaacac

SEQ ID NO: 1861775 - RNA, 18 nt, Homo sapiens
cccauaauugcuuugcca

SEQ ID NO: 1861776 - RNA, 14 nt, Homo sapiens
cuccagaauaugga

SEQ ID NO: 1861777 - RNA, 16 nt, Homo sapiens
guucagagacuggcag

SEQ ID NO: 1861778 - RNA, 18 nt, Homo sapiens
gcaagagcugaaaaacuu

SEQ ID NO: 1861779 - RNA, 19 nt, Homo sapiens
ucauuaggcaaaguacaaa

SEQ ID NO: 1861780 - RNA, 21 nt, Homo sapiens
uuauauuaaagaauucuguac

SEQ ID NO: 1861781 - RNA, 18 nt, Homo sapiens
cauaaauaaaguuucagc

SEQ ID NO: 1861782 - RNA, 13 nt, Homo sapiens
ucuuaacuauccu

SEQ ID NO: 1861783 - RNA, 14 nt, Homo sapiens
uagcacuggucaca

SEQ ID NO: 1861784 - RNA, 15 nt, Homo sapiens
uccuagaaguucagu

SEQ ID NO: 1861785 - RNA, 17 nt, Homo sapiens
auaguuugcuguugcau

SEQ ID NO: 1861786 - RNA, 22 nt, Homo sapiens
ccauauugugcuucacaguaga

SEQ ID NO: 1861787 - RNA, 15 nt, Homo sapiens
gaaugcuggcaaagg

SEQ ID NO: 1861788 - RNA, 20 nt, Homo sapiens
agucucucuaagacaaaugc

SEQ ID NO: 1861789 - RNA, 16 nt, Homo sapiens
aagcccccacuacuaa

SEQ ID NO: 1861790 - RNA, 12 nt, Homo sapiens
cucaagcuuucc

SEQ ID NO: 1861791 - RNA, 12 nt, Homo sapiens
uucaagcucucc

SEQ ID NO: 1861792 - RNA, 18 nt, Homo sapiens
acuuccuacguauccugc

SEQ ID NO: 1861793 - RNA, 17 nt, Homo sapiens
gacaggugaggucuguu

SEQ ID NO: 1861794 - RNA, 13 nt, Homo sapiens
cacccagccuguc

SEQ ID NO: 1861795 - RNA, 23 nt, Homo sapiens
uugagaguauauuauguauuuau

SEQ ID NO: 1861796 - RNA, 18 nt, Homo sapiens
auuucuauauuccuccag

SEQ ID NO: 1861797 - RNA, 22 nt, Homo sapiens
gcccucccuaccuaccaagaua

SEQ ID NO: 1861798 - RNA, 13 nt, Homo sapiens
cuuucccagugug

SEQ ID NO: 1861799 - RNA, 14 nt, Homo sapiens
agcugcucccaaug

SEQ ID NO: 1861800 - RNA, 20 nt, Homo sapiens
auauuaaauuuauaucuuau

SEQ ID NO: 1861801 - RNA, 13 nt, Homo sapiens
ucccaguguccua

SEQ ID NO: 1861802 - RNA, 13 nt, Homo sapiens
auacagugauaua

SEQ ID NO: 1861803 - RNA, 17 nt, Homo sapiens
gcuggauaaaaugucag

SEQ ID NO: 1861804 - RNA, 14 nt, Homo sapiens
ccugauguguccuc

SEQ ID NO: 1861805 - RNA, 17 nt, Homo sapiens
uucuguucucauuugau

SEQ ID NO: 1861806 - RNA, 14 nt, Homo sapiens
uuuccagaccaaua

SEQ ID NO: 1861807 - RNA, 19 nt, Homo sapiens
cuaacuauauuugcuuuuu

SEQ ID NO: 1861808 - RNA, 23 nt, Homo sapiens
cuguaaacuauaaacuacuguaa

SEQ ID NO: 1861809 - RNA, 18 nt, Homo sapiens
caacuaccauuaucuuca

SEQ ID NO: 1861810 - RNA, 23 nt, Homo sapiens
gcucaauauuccugaaugaaaua

SEQ ID NO: 1861811 - RNA, 13 nt, Homo sapiens
uuucauuugccua

SEQ ID NO: 1861812 - RNA, 21 nt, Homo sapiens
aagaugguaccaccagucuga

SEQ ID NO: 1861813 - RNA, 19 nt, Homo sapiens
ucugucagaaugcuauuga

SEQ ID NO: 1861814 - RNA, 11 nt, Homo sapiens
augauguuuca

SEQ ID NO: 1861815 - RNA, 17 nt, Homo sapiens
acagcucuuacuuuuaa

SEQ ID NO: 1861816 - RNA, 21 nt, Homo sapiens
ggaaaaaucuuggauuaugaa

SEQ ID NO: 1861817 - RNA, 13 nt, Homo sapiens
acuugccugcuag

SEQ ID NO: 1861818 - RNA, 16 nt, Homo sapiens
aacccagccugagugc

SEQ ID NO: 1861819 - RNA, 18 nt, Homo sapiens
gcugugaugguaccuggg

SEQ ID NO: 1861820 - RNA, 16 nt, Homo sapiens
cuccuaaagcuuuuau

SEQ ID NO: 1861821 - RNA, 21 nt, Homo sapiens
cacugauuacccaaugcaccu

SEQ ID NO: 1861822 - RNA, 16 nt, Homo sapiens
accgauaaugcaugaa

SEQ ID NO: 1861823 - RNA, 24 nt, Homo sapiens
ccaagcuauguauuuaaauuauca

SEQ ID NO: 1861824 - RNA, 18 nt, Homo sapiens
cuuccaacccacuggccc

SEQ ID NO: 1861825 - RNA, 20 nt, Homo sapiens
ugcaagaaguacaugaagag

SEQ ID NO: 1861826 - RNA, 20 nt, Homo sapiens
ccaaugagggaauccauuga

SEQ ID NO: 1861827 - RNA, 13 nt, Homo sapiens
cagacaccagccu

SEQ ID NO: 1861828 - RNA, 16 nt, Homo sapiens
uguucaucaccagucu

SEQ ID NO: 1861829 - RNA, 19 nt, Homo sapiens
acugggcaaugauggcaau

SEQ ID NO: 1861830 - RNA, 15 nt, Homo sapiens
aaugagaacauuuac

SEQ ID NO: 1861831 - RNA, 19 nt, Homo sapiens
uugccucaaugccaguaac

SEQ ID NO: 1861832 - RNA, 17 nt, Homo sapiens
aaauuccucaacagugu

SEQ ID NO: 1861833 - RNA, 19 nt, Homo sapiens
ucuuggcuuucagaguuug

SEQ ID NO: 1861834 - RNA, 15 nt, Homo sapiens
cagcuuucuuauuca

SEQ ID NO: 1861835 - RNA, 23 nt, Homo sapiens
ugcuguauuuuuauuuuugcaca

SEQ ID NO: 1861836 - RNA, 17 nt, Homo sapiens
gaauauguuaaugcaaa

SEQ ID NO: 1861837 - RNA, 19 nt, Homo sapiens
aaaccuggggugaauacuu

SEQ ID NO: 1861838 - RNA, 12 nt, Homo sapiens
aauuaaguuaca

SEQ ID NO: 1861839 - RNA, 15 nt, Homo sapiens
gcucaauaaauaugg

SEQ ID NO: 1861840 - RNA, 18 nt, Homo sapiens
gauuauccuguuacugaa

SEQ ID NO: 1861841 - RNA, 17 nt, Homo sapiens
ucauuagcauuuugcua

SEQ ID NO: 1861842 - RNA, 17 nt, Homo sapiens
cagaaacagggggaaaa

SEQ ID NO: 1861843 - RNA, 17 nt, Homo sapiens
aggaauuuugugugauu

SEQ ID NO: 1861844 - RNA, 22 nt, Homo sapiens
gggaacgaggggaaaguucuca

SEQ ID NO: 1861845 - RNA, 22 nt, Homo sapiens
gaggacgcacgcucgcugccau

SEQ ID NO: 1861846 - RNA, 16 nt, Homo sapiens
uuguucacaccacagg

SEQ ID NO: 1861847 - RNA, 23 nt, Homo sapiens
ucacaguaugagaagaaaaaugg

SEQ ID NO: 1861848 - RNA, 18 nt, Homo sapiens
cuauucuuaagcacuuug

SEQ ID NO: 1861849 - RNA, 22 nt, Homo sapiens
ugaccugcugugcaccuuacau

SEQ ID NO: 1861850 - RNA, 18 nt, Homo sapiens
gguauuuuuuacugcuug

SEQ ID NO: 1861851 - RNA, 19 nt, Homo sapiens
accagcccagcccgucucc

SEQ ID NO: 1861852 - RNA, 20 nt, Homo sapiens
gcucccaugcucauaccucu

SEQ ID NO: 1861853 - RNA, 16 nt, Homo sapiens
cucuguuuugugccag

SEQ ID NO: 1861854 - RNA, 16 nt, Homo sapiens
gccggugcucuggaag

SEQ ID NO: 1861855 - RNA, 22 nt, Homo sapiens
gccaggagcccacagugccugu

SEQ ID NO: 1861856 - RNA, 12 nt, Homo sapiens
guuguuggcaag

SEQ ID NO: 1861857 - RNA, 17 nt, Homo sapiens
auggaauuucauaucua

SEQ ID NO: 1861858 - RNA, 19 nt, Homo sapiens
cagccaucaugugccugga

SEQ ID NO: 1861859 - RNA, 14 nt, Homo sapiens
aaugagccaugaga

SEQ ID NO: 1861860 - RNA, 15 nt, Homo sapiens
guugucgaacaguag

SEQ ID NO: 1861861 - RNA, 21 nt, Homo sapiens
ggcuaaagcucgaugugguca

SEQ ID NO: 1861862 - RNA, 13 nt, Homo sapiens
augcaccaaucag

SEQ ID NO: 1861863 - RNA, 18 nt, Homo sapiens
cucagaggcugggagcau

SEQ ID NO: 1861864 - RNA, 19 nt, Homo sapiens
agugccuccuguggucuca

SEQ ID NO: 1861865 - RNA, 20 nt, Homo sapiens
gccaucucagcucacugcaa

SEQ ID NO: 1861866 - RNA, 15 nt, Homo sapiens
cucuuucuacucuga

SEQ ID NO: 1861867 - RNA, 14 nt, Homo sapiens
gguuuucauuauuu

SEQ ID NO: 1861868 - RNA, 12 nt, Homo sapiens
ucgagagccaaa

SEQ ID NO: 1861869 - RNA, 23 nt, Homo sapiens
acagaacuaucucagcaucagaa

SEQ ID NO: 1861870 - RNA, 13 nt, Homo sapiens
cuaccgugccagc

SEQ ID NO: 1861871 - RNA, 18 nt, Homo sapiens
gucuuagacugcuagcuu

SEQ ID NO: 1861872 - RNA, 12 nt, Homo sapiens
gcccucaccugc

SEQ ID NO: 1861873 - RNA, 22 nt, Homo sapiens
cauauugacuuaauugcagcuu

SEQ ID NO: 1861874 - RNA, 15 nt, Homo sapiens
gaauuccaaguguau

SEQ ID NO: 1861875 - RNA, 14 nt, Homo sapiens
ccuugccagggcag

SEQ ID NO: 1861876 - RNA, 20 nt, Homo sapiens
gcccuuguccaaaccugggc

SEQ ID NO: 1861877 - RNA, 21 nt, Homo sapiens
cauaaagccuuggauguauau

SEQ ID NO: 1861878 - RNA, 19 nt, Homo sapiens
ccuucaaacaaauaauauu

SEQ ID NO: 1861879 - RNA, 15 nt, Homo sapiens
auaaaacucuuugaa

SEQ ID NO: 1861880 - RNA, 23 nt, Homo sapiens
ucacuaaagcaguagaaauaaua

SEQ ID NO: 1861881 - RNA, 22 nt, Homo sapiens
caccuggaaacacuaggugccu

SEQ ID NO: 1861882 - RNA, 22 nt, Homo sapiens
cuuccaaagugcugggauuaca

SEQ ID NO: 1861883 - RNA, 16 nt, Homo sapiens
uccccacccccaauuc

SEQ ID NO: 1861884 - RNA, 17 nt, Homo sapiens
cauggcaguaauucucg

SEQ ID NO: 1861885 - RNA, 20 nt, Homo sapiens
caccuccucauguacauacc

SEQ ID NO: 1861886 - RNA, 13 nt, Homo sapiens
uaaggaaauauua

SEQ ID NO: 1861887 - RNA, 19 nt, Homo sapiens
caauuauuacaguccuuca

SEQ ID NO: 1861888 - RNA, 19 nt, Homo sapiens
ucaagauaaaucaaaguaa

SEQ ID NO: 1861889 - RNA, 20 nt, Homo sapiens
gccaggggugucccaguccc

SEQ ID NO: 1861890 - RNA, 22 nt, Homo sapiens
caagaguacagaagcuuuagca

SEQ ID NO: 1861891 - RNA, 22 nt, Homo sapiens
uaaaaugcugcuuuguccaggu

SEQ ID NO: 1861892 - RNA, 20 nt, Homo sapiens
gagguggcuaagggggacca

SEQ ID NO: 1861893 - RNA, 17 nt, Homo sapiens
ccaccaaagcugcccac

SEQ ID NO: 1861894 - RNA, 15 nt, Homo sapiens
guccucuuugugaua

SEQ ID NO: 1861895 - RNA, 20 nt, Homo sapiens
ccuuuccggcacacugccaa

SEQ ID NO: 1861896 - RNA, 13 nt, Homo sapiens
augaaaaaauuag

SEQ ID NO: 1861897 - RNA, 13 nt, Homo sapiens
cuugaaaacuggg

SEQ ID NO: 1861898 - RNA, 23 nt, Homo sapiens
cugcucuuucucugccagugaca

SEQ ID NO: 1861899 - RNA, 14 nt, Homo sapiens
aagauccucuugcc

SEQ ID NO: 1861900 - RNA, 20 nt, Homo sapiens
caccauacacacuguuguca

SEQ ID NO: 1861901 - RNA, 11 nt, Homo sapiens
aaaacaaagag

SEQ ID NO: 1861902 - RNA, 19 nt, Homo sapiens
uccccucucgcgcccagca

SEQ ID NO: 1861903 - RNA, 18 nt, Homo sapiens
ucuucccgggaucacuua

SEQ ID NO: 1861904 - RNA, 16 nt, Homo sapiens
auuugugaauuaucca

SEQ ID NO: 1861905 - RNA, 15 nt, Homo sapiens
caacaguucugagcu

SEQ ID NO: 1861906 - RNA, 14 nt, Homo sapiens
cugaccuacauacg

SEQ ID NO: 1861907 - RNA, 16 nt, Homo sapiens
ccucccauagcacugc

SEQ ID NO: 1861908 - RNA, 23 nt, Homo sapiens
ggcaacaauacaugcugcuaauu

SEQ ID NO: 1861909 - RNA, 17 nt, Homo sapiens
gguuccuacacaggaca

SEQ ID NO: 1861910 - RNA, 15 nt, Homo sapiens
cuuaugauacuugag

SEQ ID NO: 1861911 - RNA, 18 nt, Homo sapiens
ccaggccuguugcuauag

SEQ ID NO: 1861912 - RNA, 21 nt, Homo sapiens
aacuguuaguauuaacuauua

SEQ ID NO: 1861913 - RNA, 23 nt, Homo sapiens
guacccuaaggucauuaccacag

SEQ ID NO: 1861914 - RNA, 12 nt, Homo sapiens
ucccacucaugu

SEQ ID NO: 1861915 - RNA, 18 nt, Homo sapiens
gcaagcucuucauugcac

SEQ ID NO: 1861916 - RNA, 16 nt, Homo sapiens
cccacggagcaucuca

SEQ ID NO: 1861917 - RNA, 16 nt, Homo sapiens
aggaugcugugugaga

SEQ ID NO: 1861918 - RNA, 11 nt, Homo sapiens
augacuuucaa

SEQ ID NO: 1861919 - RNA, 22 nt, Homo sapiens
gaaccacagcagacaccauuca

SEQ ID NO: 1861920 - RNA, 21 nt, Homo sapiens
gaagaaguuuaaaaaaccaug

SEQ ID NO: 1861921 - RNA, 20 nt, Homo sapiens
caguuuuccagaacacucuu

SEQ ID NO: 1861922 - RNA, 19 nt, Homo sapiens
cuggacucccacucuuuga

SEQ ID NO: 1861923 - RNA, 19 nt, Homo sapiens
uggaaucuuuguaccaaaa

SEQ ID NO: 1861924 - RNA, 20 nt, Homo sapiens
uuauagaaaaggaacaguug

SEQ ID NO: 1861925 - RNA, 18 nt, Homo sapiens
gugcagauaucacagagg

SEQ ID NO: 1861926 - RNA, 15 nt, Homo sapiens
cacauugcacuucug

SEQ ID NO: 1861927 - RNA, 18 nt, Homo sapiens
gcugccagcucuguauca

SEQ ID NO: 1861928 - RNA, 19 nt, Homo sapiens
uuaacacgugacacugugg

SEQ ID NO: 1861929 - RNA, 23 nt, Homo sapiens
ggaggggucagcucuggccacaa

SEQ ID NO: 1861930 - RNA, 16 nt, Homo sapiens
ggggucugcucugugc

SEQ ID NO: 1861931 - RNA, 19 nt, Homo sapiens
uuccccacaggugaaaguu

SEQ ID NO: 1861932 - RNA, 11 nt, Homo sapiens
uaaaugugauu

SEQ ID NO: 1861933 - RNA, 22 nt, Homo sapiens
cuuggcugcauuugccugucau

SEQ ID NO: 1861934 - RNA, 22 nt, Homo sapiens
ccaaaccuuuuguucuguaaaa

SEQ ID NO: 1861935 - RNA, 19 nt, Homo sapiens
guaggugggauuacaggug

SEQ ID NO: 1861936 - RNA, 19 nt, Homo sapiens
accagacagacaacacugg

SEQ ID NO: 1861937 - RNA, 20 nt, Homo sapiens
aaaagcgacccauucagaga

SEQ ID NO: 1861938 - RNA, 17 nt, Homo sapiens
acacagacccaaaccau

SEQ ID NO: 1861939 - RNA, 17 nt, Homo sapiens
gguuuuuuccuuucauu

SEQ ID NO: 1861940 - RNA, 16 nt, Homo sapiens
cagggaccucaggggc

SEQ ID NO: 1861941 - RNA, 15 nt, Homo sapiens
aaucaauacaauccu

SEQ ID NO: 1861942 - RNA, 15 nt, Homo sapiens
uaggucgccagugaa

SEQ ID NO: 1861943 - RNA, 15 nt, Homo sapiens
agggacugaaaaccu

SEQ ID NO: 1861944 - RNA, 13 nt, Homo sapiens
uugcuugagcuca

SEQ ID NO: 1861945 - RNA, 11 nt, Homo sapiens
aaagcugccag

SEQ ID NO: 1861946 - RNA, 16 nt, Homo sapiens
acccccaccacuaaga

SEQ ID NO: 1861947 - RNA, 22 nt, Homo sapiens
auuugggcuagacuaccggaca

SEQ ID NO: 1861948 - RNA, 17 nt, Homo sapiens
auaugugaaauggccaa

SEQ ID NO: 1861949 - RNA, 21 nt, Homo sapiens
agggaagaugaccugccccaa

SEQ ID NO: 1861950 - RNA, 17 nt, Homo sapiens
ugagugaauacuuugau

SEQ ID NO: 1861951 - RNA, 19 nt, Homo sapiens
aagagaggaguucaaugau

SEQ ID NO: 1861952 - RNA, 12 nt, Homo sapiens
ggaaauguuucu

SEQ ID NO: 1861953 - RNA, 11 nt, Homo sapiens
accauaaugua

SEQ ID NO: 1861954 - RNA, 18 nt, Homo sapiens
aaaugugucaccccagag

SEQ ID NO: 1861955 - RNA, 20 nt, Homo sapiens
aacauguacuguuacugugu

SEQ ID NO: 1861956 - RNA, 20 nt, Homo sapiens
gacaaguucaacaacaaaac

SEQ ID NO: 1861957 - RNA, 18 nt, Homo sapiens
caccucugccucaaugug

SEQ ID NO: 1861958 - RNA, 17 nt, Homo sapiens
agcuuucuaauguucua

SEQ ID NO: 1861959 - RNA, 19 nt, Homo sapiens
aggcucaucuaacucuguc

SEQ ID NO: 1861960 - RNA, 13 nt, Homo sapiens
gggcugcauucuu

SEQ ID NO: 1861961 - RNA, 22 nt, Homo sapiens
aagucugguaauaaaugugacu

SEQ ID NO: 1861962 - RNA, 20 nt, Homo sapiens
cgcaugcccucaaucccagc

SEQ ID NO: 1861963 - RNA, 22 nt, Homo sapiens
auuuccuccucccagugccuuc

SEQ ID NO: 1861964 - RNA, 14 nt, Homo sapiens
uagcaaagaacucu

SEQ ID NO: 1861965 - RNA, 15 nt, Homo sapiens
uccugaucaggaaac

SEQ ID NO: 1861966 - RNA, 20 nt, Homo sapiens
gaggaaugcuggacuggagg

SEQ ID NO: 1861967 - RNA, 22 nt, Homo sapiens
auuccugguggauacuguagaa

SEQ ID NO: 1861968 - RNA, 20 nt, Homo sapiens
cggcacggccggcgacuccc

SEQ ID NO: 1861969 - RNA, 11 nt, Homo sapiens
accacagcagu

SEQ ID NO: 1861970 - RNA, 17 nt, Homo sapiens
ugggagcugcugggcua

SEQ ID NO: 1861971 - RNA, 16 nt, Homo sapiens
uuccaucucauuacag

SEQ ID NO: 1861972 - RNA, 13 nt, Homo sapiens
ugaaagaaaccac

SEQ ID NO: 1861973 - RNA, 23 nt, Homo sapiens
cugaaucuuccuuuguugcacaa

SEQ ID NO: 1861974 - RNA, 15 nt, Homo sapiens
aucaaucuggugaau

SEQ ID NO: 1861975 - RNA, 15 nt, Homo sapiens
uggcauaugguccua

SEQ ID NO: 1861976 - RNA, 20 nt, Homo sapiens
cacagacauuuugugugaga

SEQ ID NO: 1861977 - RNA, 16 nt, Homo sapiens
caaggcacugccugau

SEQ ID NO: 1861978 - RNA, 17 nt, Homo sapiens
aagacuauugugccuua

SEQ ID NO: 1861979 - RNA, 18 nt, Homo sapiens
ugacaaaaaugguuuuga

SEQ ID NO: 1861980 - RNA, 17 nt, Homo sapiens
uugaaaugccacgugcc

SEQ ID NO: 1861981 - RNA, 15 nt, Homo sapiens
uaguuccuuacuguu

SEQ ID NO: 1861982 - RNA, 19 nt, Homo sapiens
aguaaucuaauauggccac

SEQ ID NO: 1861983 - RNA, 21 nt, Homo sapiens
aacaaggacccuguuuuccac

SEQ ID NO: 1861984 - RNA, 21 nt, Homo sapiens
caauaaagcuuguugacucag

SEQ ID NO: 1861985 - RNA, 20 nt, Homo sapiens
ggagacuuucaugcagccua

SEQ ID NO: 1861986 - RNA, 17 nt, Homo sapiens
ccaugcauucaccugcc

SEQ ID NO: 1861987 - RNA, 15 nt, Homo sapiens
gccgccgaccuguga

SEQ ID NO: 1861988 - RNA, 15 nt, Homo sapiens
aauaauuuccuccac

SEQ ID NO: 1861989 - RNA, 22 nt, Homo sapiens
gcacaaacaccuuaagcaauau

SEQ ID NO: 1861990 - RNA, 13 nt, Homo sapiens
ugugaacacuuuu

SEQ ID NO: 1861991 - RNA, 14 nt, Homo sapiens
aguuacugaagucu

SEQ ID NO: 1861992 - RNA, 19 nt, Homo sapiens
caguucuuugguaagcauu

SEQ ID NO: 1861993 - RNA, 23 nt, Homo sapiens
cucuguccuucccccagcacaaa

SEQ ID NO: 1861994 - RNA, 22 nt, Homo sapiens
gcagauucugagcaaaggcccu

SEQ ID NO: 1861995 - RNA, 14 nt, Homo sapiens
aggagaacugugcu

SEQ ID NO: 1861996 - RNA, 23 nt, Homo sapiens
ccacaucugccuuaaaaccaaag

SEQ ID NO: 1861997 - RNA, 22 nt, Homo sapiens
ugcugaguaacaggugccuucc

SEQ ID NO: 1861998 - RNA, 17 nt, Homo sapiens
aagaaggguguuuaaua

SEQ ID NO: 1861999 - RNA, 15 nt, Homo sapiens
uguauuccugucauu

SEQ ID NO: 1862000 - RNA, 15 nt, Homo sapiens
guguccccugcccca

SEQ ID NO: 1862001 - RNA, 22 nt, Homo sapiens
auguagugugucagaguaacau

SEQ ID NO: 1862002 - RNA, 13 nt, Homo sapiens
agaaaauugccaa

SEQ ID NO: 1862003 - RNA, 15 nt, Homo sapiens
gaauacuugaacucu

SEQ ID NO: 1862004 - RNA, 15 nt, Homo sapiens
auauauauauacuua

SEQ ID NO: 1862005 - RNA, 17 nt, Homo sapiens
uccuauucuauugcagu

SEQ ID NO: 1862006 - RNA, 13 nt, Homo sapiens
cuuaauguaguua

SEQ ID NO: 1862007 - RNA, 16 nt, Homo sapiens
gaugucuagaggcaga

SEQ ID NO: 1862008 - RNA, 14 nt, Homo sapiens
caucugcacagugg

SEQ ID NO: 1862009 - RNA, 18 nt, Homo sapiens
acuucuuugcaacaauaa

SEQ ID NO: 1862010 - RNA, 18 nt, Homo sapiens
aaaugauguguacccaaa

SEQ ID NO: 1862011 - RNA, 16 nt, Homo sapiens
cguauaccuuauuaac

SEQ ID NO: 1862012 - RNA, 20 nt, Homo sapiens
aaggaacauaccccuuacaa

SEQ ID NO: 1862013 - RNA, 19 nt, Homo sapiens
cugagguuugccagcauuu

SEQ ID NO: 1862014 - RNA, 15 nt, Homo sapiens
acauuaugugugcau

SEQ ID NO: 1862015 - RNA, 16 nt, Homo sapiens
caaaggcgacaauaaa

SEQ ID NO: 1862016 - RNA, 16 nt, Homo sapiens
uuuuccacugccuggg

SEQ ID NO: 1862017 - RNA, 12 nt, Homo sapiens
aaagaugcauuu

SEQ ID NO: 1862018 - RNA, 20 nt, Homo sapiens
cccagaggccuuggccaagc

SEQ ID NO: 1862019 - RNA, 17 nt, Homo sapiens
aauguaccgaugauacu

SEQ ID NO: 1862020 - RNA, 23 nt, Homo sapiens
uuucccaucacuguauccauucu

SEQ ID NO: 1862021 - RNA, 13 nt, Homo sapiens
gugcuaaaccaag

SEQ ID NO: 1862022 - RNA, 15 nt, Homo sapiens
cucugggaguaauac

SEQ ID NO: 1862023 - RNA, 16 nt, Homo sapiens
aaagcgugugugaaca

SEQ ID NO: 1862024 - RNA, 16 nt, Homo sapiens
caggagaguacauggc

SEQ ID NO: 1862025 - RNA, 15 nt, Homo sapiens
agcaacaucucggga

SEQ ID NO: 1862026 - RNA, 18 nt, Homo sapiens
uuccagcugccaagugcu

SEQ ID NO: 1862027 - RNA, 21 nt, Homo sapiens
uuuguugagugcacugacugu

SEQ ID NO: 1862028 - RNA, 23 nt, Homo sapiens
gauaaaagaaaaaccugugauuc

SEQ ID NO: 1862029 - RNA, 16 nt, Homo sapiens
cuugguggagcagcca

SEQ ID NO: 1862030 - RNA, 14 nt, Homo sapiens
cuugucauccaccu

SEQ ID NO: 1862031 - RNA, 20 nt, Homo sapiens
auggagucucccacugcaac

SEQ ID NO: 1862032 - RNA, 18 nt, Homo sapiens
cccccaauaaaccagugu

SEQ ID NO: 1862033 - RNA, 20 nt, Homo sapiens
ugggacugagaaggcucacg

SEQ ID NO: 1862034 - RNA, 22 nt, Homo sapiens
acugcuccuuccaucugccuga

SEQ ID NO: 1862035 - RNA, 20 nt, Homo sapiens
uuagggguccucuuagucca

SEQ ID NO: 1862036 - RNA, 22 nt, Homo sapiens
gucuuccagaccugcuuccuga

SEQ ID NO: 1862037 - RNA, 15 nt, Homo sapiens
gccagucacugcugc

SEQ ID NO: 1862038 - RNA, 12 nt, Homo sapiens
agaaagugaucc

SEQ ID NO: 1862039 - RNA, 15 nt, Homo sapiens
ccagagaguccugug

SEQ ID NO: 1862040 - RNA, 13 nt, Homo sapiens
uacaaaagcaauu

SEQ ID NO: 1862041 - RNA, 19 nt, Homo sapiens
gcugauuuugucacugucu

SEQ ID NO: 1862042 - RNA, 23 nt, Homo sapiens
uaaaauuaugaaucugauuuuua

SEQ ID NO: 1862043 - RNA, 22 nt, Homo sapiens
cugacauuaagacacaccucug

SEQ ID NO: 1862044 - RNA, 15 nt, Homo sapiens
ggauccuccacagag

SEQ ID NO: 1862045 - RNA, 17 nt, Homo sapiens
aaaacucuuauuacugu

SEQ ID NO: 1862046 - RNA, 21 nt, Homo sapiens
caaacuccugaccucaaguga

SEQ ID NO: 1862047 - RNA, 14 nt, Homo sapiens
cuuuuuucuuguca

SEQ ID NO: 1862048 - RNA, 19 nt, Homo sapiens
auugcuaccaaaaacuaga

SEQ ID NO: 1862049 - RNA, 21 nt, Homo sapiens
agaaauuuaaaagcagagcau

SEQ ID NO: 1862050 - RNA, 14 nt, Homo sapiens
ugggagaaaaucaa

SEQ ID NO: 1862051 - RNA, 12 nt, Homo sapiens
aucagucuuaau

SEQ ID NO: 1862052 - RNA, 13 nt, Homo sapiens
ucucagcaaucca

SEQ ID NO: 1862053 - RNA, 20 nt, Homo sapiens
gaacccaacagucaugaccc

SEQ ID NO: 1862054 - RNA, 18 nt, Homo sapiens
ccuucugcuuuaaucuga

SEQ ID NO: 1862055 - RNA, 23 nt, Homo sapiens
ugacugcugugggcugcucacug

SEQ ID NO: 1862056 - RNA, 13 nt, Homo sapiens
gcuucuuaaucuu

SEQ ID NO: 1862057 - RNA, 13 nt, Homo sapiens
uaaacaaguauaa

SEQ ID NO: 1862058 - RNA, 17 nt, Homo sapiens
ccugaagcugaccaaca

SEQ ID NO: 1862059 - RNA, 20 nt, Homo sapiens
aucaccagcauauuguguuc

SEQ ID NO: 1862060 - RNA, 12 nt, Homo sapiens
uggggaaagggg

SEQ ID NO: 1862061 - RNA, 20 nt, Homo sapiens
ccaacauuaaaacucauaau

SEQ ID NO: 1862062 - RNA, 20 nt, Homo sapiens
uguuuuucucauuguagaca

SEQ ID NO: 1862063 - RNA, 18 nt, Homo sapiens
auguggccaagggcucca

SEQ ID NO: 1862064 - RNA, 23 nt, Homo sapiens
ccugcuuauacuuuucucaauau

SEQ ID NO: 1862065 - RNA, 19 nt, Homo sapiens
uugaggccuuuuuugccag

SEQ ID NO: 1862066 - RNA, 13 nt, Homo sapiens
aaccugcuuuacu

SEQ ID NO: 1862067 - RNA, 13 nt, Homo sapiens
aacaugcuuuaau

SEQ ID NO: 1862068 - RNA, 13 nt, Homo sapiens
auuaauguuaauu

SEQ ID NO: 1862069 - RNA, 15 nt, Homo sapiens
gaauucccuugaauu

SEQ ID NO: 1862070 - RNA, 15 nt, Homo sapiens
ugagccuccaugccu

SEQ ID NO: 1862071 - RNA, 18 nt, Homo sapiens
cauuuuuccucucugcaa

SEQ ID NO: 1862072 - RNA, 17 nt, Homo sapiens
gagggggacuaaacuca

SEQ ID NO: 1862073 - RNA, 23 nt, Homo sapiens
auuaguuaaugagccaucacuag

SEQ ID NO: 1862074 - RNA, 17 nt, Homo sapiens
acaggaaaauguaucca

SEQ ID NO: 1862075 - RNA, 15 nt, Homo sapiens
augaaauaucuguau

SEQ ID NO: 1862076 - RNA, 14 nt, Homo sapiens
gcuucucaucccca

SEQ ID NO: 1862077 - RNA, 18 nt, Homo sapiens
uagagaaaauaaauucca

SEQ ID NO: 1862078 - RNA, 15 nt, Homo sapiens
aguacaauaaucucu

SEQ ID NO: 1862079 - RNA, 19 nt, Homo sapiens
caaaccuguagaugcagaa

SEQ ID NO: 1862080 - RNA, 16 nt, Homo sapiens
uguugcacaucauuca

SEQ ID NO: 1862081 - RNA, 19 nt, Homo sapiens
guauaaacaguuuuuggca

SEQ ID NO: 1862082 - RNA, 13 nt, Homo sapiens
caggcuccgcccu

SEQ ID NO: 1862083 - RNA, 11 nt, Homo sapiens
ucucugugcau

SEQ ID NO: 1862084 - RNA, 22 nt, Homo sapiens
auacuguaugccggcuccuuca

SEQ ID NO: 1862085 - RNA, 18 nt, Homo sapiens
uccacacagccaauacaa

SEQ ID NO: 1862086 - RNA, 20 nt, Homo sapiens
agcuuugaugauaaacacug

SEQ ID NO: 1862087 - RNA, 21 nt, Homo sapiens
cagccccucucccugugcugu

SEQ ID NO: 1862088 - RNA, 24 nt, Homo sapiens
cagagcuugaagaaaagcuuauuu

SEQ ID NO: 1862089 - RNA, 20 nt, Homo sapiens
agaaagucauagauuucuga

SEQ ID NO: 1862090 - RNA, 18 nt, Homo sapiens
cucaccuggacuccagua

SEQ ID NO: 1862091 - RNA, 21 nt, Homo sapiens
ugagaccugggauuugagaua

SEQ ID NO: 1862092 - RNA, 15 nt, Homo sapiens
acugcuccagaguug

SEQ ID NO: 1862093 - RNA, 23 nt, Homo sapiens
cugggcucgccacaucccaugag

SEQ ID NO: 1862094 - RNA, 20 nt, Homo sapiens
agccggugccuggguggcca

SEQ ID NO: 1862095 - RNA, 22 nt, Homo sapiens
acccaguggcagggcacagggc

SEQ ID NO: 1862096 - RNA, 19 nt, Homo sapiens
acaaaagaaggcucacaga

SEQ ID NO: 1862097 - RNA, 21 nt, Homo sapiens
gaguagccagaugaaauucaa

SEQ ID NO: 1862098 - RNA, 21 nt, Homo sapiens
ggagcagcuauuuuaagccau

SEQ ID NO: 1862099 - RNA, 19 nt, Homo sapiens
cacaaaggcugacauucac

SEQ ID NO: 1862100 - RNA, 13 nt, Homo sapiens
aaucugcuuucau

SEQ ID NO: 1862101 - RNA, 18 nt, Homo sapiens
cagaagccccauguguac

SEQ ID NO: 1862102 - RNA, 21 nt, Homo sapiens
ugagguaaauuaaauucccac

SEQ ID NO: 1862103 - RNA, 15 nt, Homo sapiens
uaccuuguauaucau

SEQ ID NO: 1862104 - RNA, 15 nt, Homo sapiens
ucaggcagugcagua

SEQ ID NO: 1862105 - RNA, 13 nt, Homo sapiens
gcugcacugaccu

SEQ ID NO: 1862106 - RNA, 14 nt, Homo sapiens
gauuucaguucacu

SEQ ID NO: 1862107 - RNA, 14 nt, Homo sapiens
aaagggacuugaag

SEQ ID NO: 1862108 - RNA, 14 nt, Homo sapiens
cccuugcaagccau

SEQ ID NO: 1862109 - RNA, 13 nt, Homo sapiens
aagaaacagucca

SEQ ID NO: 1862110 - RNA, 19 nt, Homo sapiens
acuuacagaucuaucuccu

SEQ ID NO: 1862111 - RNA, 14 nt, Homo sapiens
aaucaggccuugcu

SEQ ID NO: 1862112 - RNA, 20 nt, Homo sapiens
caugcugaacaucacagcuu

SEQ ID NO: 1862113 - RNA, 18 nt, Homo sapiens
uaaauauauauucaccua

SEQ ID NO: 1862114 - RNA, 14 nt, Homo sapiens
uucuuauucacuuu

SEQ ID NO: 1862115 - RNA, 14 nt, Homo sapiens
uucaguuucacaga

SEQ ID NO: 1862116 - RNA, 15 nt, Homo sapiens
acuuaugaugaugaa

SEQ ID NO: 1862117 - RNA, 14 nt, Homo sapiens
ugggccugccaaac

SEQ ID NO: 1862118 - RNA, 17 nt, Homo sapiens
ccaaaggcaugcaguca

SEQ ID NO: 1862119 - RNA, 21 nt, Homo sapiens
gacauaaauuguaauuuggga

SEQ ID NO: 1862120 - RNA, 22 nt, Homo sapiens
cacuggcagccugcaccuggug

SEQ ID NO: 1862121 - RNA, 17 nt, Homo sapiens
uguuugguuuacauuua

SEQ ID NO: 1862122 - RNA, 18 nt, Homo sapiens
agcuuuuuguugccuuau

SEQ ID NO: 1862123 - RNA, 12 nt, Homo sapiens
cacaauccucca

SEQ ID NO: 1862124 - RNA, 23 nt, Homo sapiens
accauagccuguuucguagccau

SEQ ID NO: 1862125 - RNA, 22 nt, Homo sapiens
cccagauccaggaacacaugca

SEQ ID NO: 1862126 - RNA, 17 nt, Homo sapiens
aauaaaucacuugcucu

SEQ ID NO: 1862127 - RNA, 17 nt, Homo sapiens
ugaaggagaaaaugcau

SEQ ID NO: 1862128 - RNA, 17 nt, Homo sapiens
caaugcacauuaguuuu

SEQ ID NO: 1862129 - RNA, 17 nt, Homo sapiens
caacagggcaaccaaua

SEQ ID NO: 1862130 - RNA, 13 nt, Homo sapiens
cagugacaauaca

SEQ ID NO: 1862131 - RNA, 21 nt, Homo sapiens
aguucuguauauagggcacaa

SEQ ID NO: 1862132 - RNA, 17 nt, Homo sapiens
uauagacuggaaaaaau

SEQ ID NO: 1862133 - RNA, 15 nt, Homo sapiens
ccagucccaaugcac

SEQ ID NO: 1862134 - RNA, 14 nt, Homo sapiens
cuuugcugcacaaa

SEQ ID NO: 1862135 - RNA, 19 nt, Homo sapiens
agggaaggucucaggagaa

SEQ ID NO: 1862136 - RNA, 21 nt, Homo sapiens
guccuaaaaguucucaaugua

SEQ ID NO: 1862137 - RNA, 23 nt, Homo sapiens
accucugugaccaacuguuggau

SEQ ID NO: 1862138 - RNA, 17 nt, Homo sapiens
acagaauuugucagaaa

SEQ ID NO: 1862139 - RNA, 19 nt, Homo sapiens
aaagcaacgacuacuuugc

SEQ ID NO: 1862140 - RNA, 13 nt, Homo sapiens
uaaguaaaaccac

SEQ ID NO: 1862141 - RNA, 14 nt, Homo sapiens
cgagugaggccaua

SEQ ID NO: 1862142 - RNA, 22 nt, Homo sapiens
cacaacuuguaccaaguuuccc

SEQ ID NO: 1862143 - RNA, 20 nt, Homo sapiens
acgggauggagacacggggc

SEQ ID NO: 1862144 - RNA, 21 nt, Homo sapiens
cuucaaauuagaagacauuua

SEQ ID NO: 1862145 - RNA, 21 nt, Homo sapiens
ucaucagccuugggauagcaa

SEQ ID NO: 1862146 - RNA, 14 nt, Homo sapiens
uccaacucccuuaa

SEQ ID NO: 1862147 - RNA, 18 nt, Homo sapiens
gaauuuguuuugguacuc

SEQ ID NO: 1862148 - RNA, 20 nt, Homo sapiens
cuaaagccaggcucaggaga

SEQ ID NO: 1862149 - RNA, 22 nt, Homo sapiens
auuucacuagaaaagcugauca

SEQ ID NO: 1862150 - RNA, 15 nt, Homo sapiens
cuggaaugugccaca

SEQ ID NO: 1862151 - RNA, 14 nt, Homo sapiens
caacagcuuugcag

SEQ ID NO: 1862152 - RNA, 12 nt, Homo sapiens
ggcaugggagac

SEQ ID NO: 1862153 - RNA, 19 nt, Homo sapiens
aaaauaggagagagaucau

SEQ ID NO: 1862154 - RNA, 19 nt, Homo sapiens
uugggcuguaaagcaaacu

SEQ ID NO: 1862155 - RNA, 13 nt, Homo sapiens
auggacaacacua

SEQ ID NO: 1862156 - RNA, 13 nt, Homo sapiens
gagauucugccuu

SEQ ID NO: 1862157 - RNA, 17 nt, Homo sapiens
aguaaaucagugcagua

SEQ ID NO: 1862158 - RNA, 19 nt, Homo sapiens
ucagggcccaagucccugu

SEQ ID NO: 1862159 - RNA, 19 nt, Homo sapiens
gaaacugagucacucacau

SEQ ID NO: 1862160 - RNA, 17 nt, Homo sapiens
ggacuguccccaugccc

SEQ ID NO: 1862161 - RNA, 20 nt, Homo sapiens
gcugacccagugugugcuca

SEQ ID NO: 1862162 - RNA, 19 nt, Homo sapiens
cugcuggggaagacagugg

SEQ ID NO: 1862163 - RNA, 15 nt, Homo sapiens
gaauguaaaugucuc

SEQ ID NO: 1862164 - RNA, 23 nt, Homo sapiens
cucugcuccaaaggaaauccaaa

SEQ ID NO: 1862165 - RNA, 14 nt, Homo sapiens
aaaugaaucuuacu

SEQ ID NO: 1862166 - RNA, 16 nt, Homo sapiens
cucugaauuuauuucc

SEQ ID NO: 1862167 - RNA, 14 nt, Homo sapiens
cuguaguggcaaaa

SEQ ID NO: 1862168 - RNA, 14 nt, Homo sapiens
aacuguagauggaa

SEQ ID NO: 1862169 - RNA, 19 nt, Homo sapiens
cccaaaugaccaaauccau

SEQ ID NO: 1862170 - RNA, 15 nt, Homo sapiens
uaaacacuagacugu

SEQ ID NO: 1862171 - RNA, 15 nt, Homo sapiens
cucagaacaaugaaa

SEQ ID NO: 1862172 - RNA, 15 nt, Homo sapiens
gccuucuccaggaca

SEQ ID NO: 1862173 - RNA, 17 nt, Homo sapiens
caucuuuuaaucaugag

SEQ ID NO: 1862174 - RNA, 15 nt, Homo sapiens
aaauuuaauuacaaa

SEQ ID NO: 1862175 - RNA, 21 nt, Homo sapiens
ccagggggcugaaacuugaac

SEQ ID NO: 1862176 - RNA, 21 nt, Homo sapiens
aaugaggagacacaccugagg

SEQ ID NO: 1862177 - RNA, 22 nt, Homo sapiens
gcacagugucaguugagcugac

SEQ ID NO: 1862178 - RNA, 14 nt, Homo sapiens
cugggcuugggcac

SEQ ID NO: 1862179 - RNA, 22 nt, Homo sapiens
augucuggggcagaaacacuca

SEQ ID NO: 1862180 - RNA, 16 nt, Homo sapiens
aacaacaacuuuggau

SEQ ID NO: 1862181 - RNA, 19 nt, Homo sapiens
cucauagaacauugaucug

SEQ ID NO: 1862182 - RNA, 16 nt, Homo sapiens
gaaaugcacuaagaca

SEQ ID NO: 1862183 - RNA, 17 nt, Homo sapiens
cauaguuauguaaaaag

SEQ ID NO: 1862184 - RNA, 19 nt, Homo sapiens
gagaucgugcuacugcacu

SEQ ID NO: 1862185 - RNA, 15 nt, Homo sapiens
ucaagcuagccagag

SEQ ID NO: 1862186 - RNA, 23 nt, Homo sapiens
aagcaaugcuucugccucagcuu

SEQ ID NO: 1862187 - RNA, 14 nt, Homo sapiens
ugguguagcacuua

SEQ ID NO: 1862188 - RNA, 22 nt, Homo sapiens
guagaaacugaggcccagagag

SEQ ID NO: 1862189 - RNA, 14 nt, Homo sapiens
uuggugagucugug

SEQ ID NO: 1862190 - RNA, 13 nt, Homo sapiens
caccaucuggaau

SEQ ID NO: 1862191 - RNA, 18 nt, Homo sapiens
cacagccccaaccuccca

SEQ ID NO: 1862192 - RNA, 17 nt, Homo sapiens
agggaaagccucuggca

SEQ ID NO: 1862193 - RNA, 20 nt, Homo sapiens
accaauauuaacacgcugcc

SEQ ID NO: 1862194 - RNA, 17 nt, Homo sapiens
cuucuccguacacccca

SEQ ID NO: 1862195 - RNA, 19 nt, Homo sapiens
cgucauugcuggugacuca

SEQ ID NO: 1862196 - RNA, 17 nt, Homo sapiens
cagcccaggcacaacuu

SEQ ID NO: 1862197 - RNA, 15 nt, Homo sapiens
agccccaucugucua

SEQ ID NO: 1862198 - RNA, 15 nt, Homo sapiens
ccuucaaauaguaua

SEQ ID NO: 1862199 - RNA, 21 nt, Homo sapiens
aacuuccagugcaacacugaa

SEQ ID NO: 1862200 - RNA, 17 nt, Homo sapiens
agcauauuguuauuaua

SEQ ID NO: 1862201 - RNA, 20 nt, Homo sapiens
agaagauucaaucacuguau

SEQ ID NO: 1862202 - RNA, 18 nt, Homo sapiens
cgauuaauaacaggcaaa

SEQ ID NO: 1862203 - RNA, 16 nt, Homo sapiens
cucacucacucugggu

SEQ ID NO: 1862204 - RNA, 14 nt, Homo sapiens
cgggccuccccggg

SEQ ID NO: 1862205 - RNA, 21 nt, Homo sapiens
uuuauuuacacucuugauucu

SEQ ID NO: 1862206 - RNA, 18 nt, Homo sapiens
cccaguggacucuuccac

SEQ ID NO: 1862207 - RNA, 12 nt, Homo sapiens
auuacacugugc

SEQ ID NO: 1862208 - RNA, 15 nt, Homo sapiens
auaucugaaccaaga

SEQ ID NO: 1862209 - RNA, 14 nt, Homo sapiens
aggcuggaguugcu

SEQ ID NO: 1862210 - RNA, 17 nt, Homo sapiens
ccuggacacaacaccaa

SEQ ID NO: 1862211 - RNA, 17 nt, Homo sapiens
cuggaacagaagacagc

SEQ ID NO: 1862212 - RNA, 18 nt, Homo sapiens
agccauuccugaagccca

SEQ ID NO: 1862213 - RNA, 15 nt, Homo sapiens
uacaucauuccacac

SEQ ID NO: 1862214 - RNA, 20 nt, Homo sapiens
aguguugggaacuaauuuca

SEQ ID NO: 1862215 - RNA, 17 nt, Homo sapiens
acauaauuccagucaca

SEQ ID NO: 1862216 - RNA, 18 nt, Homo sapiens
uuaacuuuccuuccucau

SEQ ID NO: 1862217 - RNA, 23 nt, Homo sapiens
gcuucuccuucuccuucccauuu

SEQ ID NO: 1862218 - RNA, 16 nt, Homo sapiens
agggcccccaucucau

SEQ ID NO: 1862219 - RNA, 16 nt, Homo sapiens
uacaaaaauaccuacu

SEQ ID NO: 1862220 - RNA, 13 nt, Homo sapiens
gcugggauuacag

SEQ ID NO: 1862221 - RNA, 17 nt, Homo sapiens
acuggcgcagacuucac

SEQ ID NO: 1862222 - RNA, 22 nt, Homo sapiens
agacuccccugccuccccaggg

SEQ ID NO: 1862223 - RNA, 19 nt, Homo sapiens
aaucugagagucauucagg

SEQ ID NO: 1862224 - RNA, 15 nt, Homo sapiens
agcucacugcugauc

SEQ ID NO: 1862225 - RNA, 21 nt, Homo sapiens
uaaagguugaguaugugaaga

SEQ ID NO: 1862226 - RNA, 20 nt, Homo sapiens
gcaguuauuucaaccagcac

SEQ ID NO: 1862227 - RNA, 19 nt, Homo sapiens
ccugaugggccaagggaag

SEQ ID NO: 1862228 - RNA, 18 nt, Homo sapiens
gaagcauuugauuuucaa

SEQ ID NO: 1862229 - RNA, 15 nt, Homo sapiens
auagcucaggguaag

SEQ ID NO: 1862230 - RNA, 16 nt, Homo sapiens
accuugagcaaauuag

SEQ ID NO: 1862231 - RNA, 23 nt, Homo sapiens
acgcugcucuccugacagccaca

SEQ ID NO: 1862232 - RNA, 20 nt, Homo sapiens
cuaaugauuagcacuuaaua

SEQ ID NO: 1862233 - RNA, 20 nt, Homo sapiens
augcugauuuaaacuucuua

SEQ ID NO: 1862234 - RNA, 13 nt, Homo sapiens
uguggcaccucaa

SEQ ID NO: 1862235 - RNA, 13 nt, Homo sapiens
auacaaagggaua

SEQ ID NO: 1862236 - RNA, 21 nt, Homo sapiens
acauaauuuaauuccuucuac

SEQ ID NO: 1862237 - RNA, 16 nt, Homo sapiens
aucuauuucugagaag

SEQ ID NO: 1862238 - RNA, 19 nt, Homo sapiens
uaaauggccagugcugcuu

SEQ ID NO: 1862239 - RNA, 21 nt, Homo sapiens
ccaaaugauuucagaauuuag

SEQ ID NO: 1862240 - RNA, 11 nt, Homo sapiens
cccccaaagcc

SEQ ID NO: 1862241 - RNA, 14 nt, Homo sapiens
cgugccaugaucug

SEQ ID NO: 1862242 - RNA, 23 nt, Homo sapiens
uugauaucuuuccucccucuuuu

SEQ ID NO: 1862243 - RNA, 16 nt, Homo sapiens
auauagcaagauccca

SEQ ID NO: 1862244 - RNA, 19 nt, Homo sapiens
ccuguugccuugagcucuu

SEQ ID NO: 1862245 - RNA, 13 nt, Homo sapiens
ggcccccacagga

SEQ ID NO: 1862246 - RNA, 20 nt, Homo sapiens
cuaauucacaggcaaaccaa

SEQ ID NO: 1862247 - RNA, 23 nt, Homo sapiens
aggaaagacaggcugagcuuucu

SEQ ID NO: 1862248 - RNA, 16 nt, Homo sapiens
guaacacagugcagua

SEQ ID NO: 1862249 - RNA, 17 nt, Homo sapiens
uucccuccaccagugug

SEQ ID NO: 1862250 - RNA, 17 nt, Homo sapiens
uauuaaaauguaugcau

SEQ ID NO: 1862251 - RNA, 17 nt, Homo sapiens
aagcgauucuccugccu

SEQ ID NO: 1862252 - RNA, 22 nt, Homo sapiens
agccugucagccaacauugccu

SEQ ID NO: 1862253 - RNA, 19 nt, Homo sapiens
aagcauuuuuuaaccuccu

SEQ ID NO: 1862254 - RNA, 16 nt, Homo sapiens
agcaaaggcugagaac

SEQ ID NO: 1862255 - RNA, 16 nt, Homo sapiens
gacauuguuggccaaa

SEQ ID NO: 1862256 - RNA, 14 nt, Homo sapiens
accguccuggagcu

SEQ ID NO: 1862257 - RNA, 14 nt, Homo sapiens
gauucauuuuaaca

SEQ ID NO: 1862258 - RNA, 17 nt, Homo sapiens
uuaacguauauugcugu

SEQ ID NO: 1862259 - RNA, 11 nt, Homo sapiens
caucuuaccuc

SEQ ID NO: 1862260 - RNA, 16 nt, Homo sapiens
uacaucauuauuguag

SEQ ID NO: 1862261 - RNA, 13 nt, Homo sapiens
gcugagccaguca

SEQ ID NO: 1862262 - RNA, 12 nt, Homo sapiens
gcaaaaaaauca

SEQ ID NO: 1862263 - RNA, 17 nt, Homo sapiens
aauauuuaucugauuaa

SEQ ID NO: 1862264 - RNA, 22 nt, Homo sapiens
uccucauuuauaaaauaaugaa

SEQ ID NO: 1862265 - RNA, 13 nt, Homo sapiens
uaccugcuaugcg

SEQ ID NO: 1862266 - RNA, 21 nt, Homo sapiens
cagccugggcaacauggugaa

SEQ ID NO: 1862267 - RNA, 16 nt, Homo sapiens
ucuuugagucaaguca

SEQ ID NO: 1862268 - RNA, 13 nt, Homo sapiens
cuccuuggcuuua

SEQ ID NO: 1862269 - RNA, 18 nt, Homo sapiens
uauuacucuacacugaaa

SEQ ID NO: 1862270 - RNA, 21 nt, Homo sapiens
aaauucuguuuuucuaggccu

SEQ ID NO: 1862271 - RNA, 21 nt, Homo sapiens
gccaugugcagccaccagucc

SEQ ID NO: 1862272 - RNA, 16 nt, Homo sapiens
aaaccaaaagugcauu

SEQ ID NO: 1862273 - RNA, 17 nt, Homo sapiens
cuguaaaaaucauggaa

SEQ ID NO: 1862274 - RNA, 23 nt, Homo sapiens
uuuaaagaaaaugugucugcaac

SEQ ID NO: 1862275 - RNA, 22 nt, Homo sapiens
gcacaaaucuugggucuugggg

SEQ ID NO: 1862276 - RNA, 24 nt, Homo sapiens
cagcucuugcuaaucagugucuca

SEQ ID NO: 1862277 - RNA, 22 nt, Homo sapiens
augcuggaaaauaauacugcug

SEQ ID NO: 1862278 - RNA, 17 nt, Homo sapiens
accacugaaaaaauaua

SEQ ID NO: 1862279 - RNA, 21 nt, Homo sapiens
uuucuaaacuaggauugacau

SEQ ID NO: 1862280 - RNA, 11 nt, Homo sapiens
gcaucuuccag

SEQ ID NO: 1862281 - RNA, 14 nt, Homo sapiens
ggguggggccauaa

SEQ ID NO: 1862282 - RNA, 17 nt, Homo sapiens
uaaacugaaaaauguca

SEQ ID NO: 1862283 - RNA, 14 nt, Homo sapiens
acccguuugcuaca

SEQ ID NO: 1862284 - RNA, 22 nt, Homo sapiens
gggucucucucccuaccucccu

SEQ ID NO: 1862285 - RNA, 22 nt, Homo sapiens
gaaauaccagugaaccaaagag

SEQ ID NO: 1862286 - RNA, 12 nt, Homo sapiens
uaaguacuguaa

SEQ ID NO: 1862287 - RNA, 18 nt, Homo sapiens
aauucuuagaauaucuaa

SEQ ID NO: 1862288 - RNA, 21 nt, Homo sapiens
aaccuuaaagaaccaucagca

SEQ ID NO: 1862289 - RNA, 17 nt, Homo sapiens
ccuggagaguucaaugg

SEQ ID NO: 1862290 - RNA, 17 nt, Homo sapiens
acaguacagaaggcaaa

SEQ ID NO: 1862291 - RNA, 23 nt, Homo sapiens
uugaagcucuggugacaccagcc

SEQ ID NO: 1862292 - RNA, 20 nt, Homo sapiens
ucuggaccccaucugugaau

SEQ ID NO: 1862293 - RNA, 17 nt, Homo sapiens
uaaaauuguguucuuaa

SEQ ID NO: 1862294 - RNA, 21 nt, Homo sapiens
gaaucugugugaaacuuucau

SEQ ID NO: 1862295 - RNA, 15 nt, Homo sapiens
auuuugcaggauuug

SEQ ID NO: 1862296 - RNA, 21 nt, Homo sapiens
gaggaaauucggagcuauaca

SEQ ID NO: 1862297 - RNA, 22 nt, Homo sapiens
cgagcuaugaucgcgccacuac

SEQ ID NO: 1862298 - RNA, 21 nt, Homo sapiens
gccauccucacaugugacaaa

SEQ ID NO: 1862299 - RNA, 17 nt, Homo sapiens
ccugacuacagaaauua

SEQ ID NO: 1862300 - RNA, 16 nt, Homo sapiens
augacaacaccugguu

SEQ ID NO: 1862301 - RNA, 17 nt, Homo sapiens
caugcuuuggcaauuuu

SEQ ID NO: 1862302 - RNA, 20 nt, Homo sapiens
auggaccuagcuugaggcaa

SEQ ID NO: 1862303 - RNA, 12 nt, Homo sapiens
uuccagauagca

SEQ ID NO: 1862304 - RNA, 19 nt, Homo sapiens
acccuuggagccaauggag

SEQ ID NO: 1862305 - RNA, 19 nt, Homo sapiens
auccuuuagugcacccagu

SEQ ID NO: 1862306 - RNA, 17 nt, Homo sapiens
caucccccacuccuugg

SEQ ID NO: 1862307 - RNA, 19 nt, Homo sapiens
acuucaaaugugguauaca

SEQ ID NO: 1862308 - RNA, 14 nt, Homo sapiens
gaggauaaaaccuc

SEQ ID NO: 1862309 - RNA, 15 nt, Homo sapiens
augaagagacucucu

SEQ ID NO: 1862310 - RNA, 21 nt, Homo sapiens
gcaauauggaagcaaccagca

SEQ ID NO: 1862311 - RNA, 21 nt, Homo sapiens
aaaaaaugauaaggcucugaa

SEQ ID NO: 1862312 - RNA, 18 nt, Homo sapiens
caucuugagccacaguca

SEQ ID NO: 1862313 - RNA, 15 nt, Homo sapiens
aggaacacaugcaca

SEQ ID NO: 1862314 - RNA, 17 nt, Homo sapiens
gaaggucuauuggccaa

SEQ ID NO: 1862315 - RNA, 17 nt, Homo sapiens
guuaccuuucccaugcu

SEQ ID NO: 1862316 - RNA, 22 nt, Homo sapiens
cagaaauuccaguaaauccuca

SEQ ID NO: 1862317 - RNA, 18 nt, Homo sapiens
gcaaugagguagauuuca

SEQ ID NO: 1862318 - RNA, 13 nt, Homo sapiens
ccagggucucacu

SEQ ID NO: 1862319 - RNA, 17 nt, Homo sapiens
uauagcuacuaauuuua

SEQ ID NO: 1862320 - RNA, 20 nt, Homo sapiens
cuaauccugucagcugagga

SEQ ID NO: 1862321 - RNA, 16 nt, Homo sapiens
gucaucuguaccucug

SEQ ID NO: 1862322 - RNA, 20 nt, Homo sapiens
cgauguccuccucugugaaa

SEQ ID NO: 1862323 - RNA, 22 nt, Homo sapiens
uagcacugaggguggcacucaa

SEQ ID NO: 1862324 - RNA, 13 nt, Homo sapiens
cccaccugucaac

SEQ ID NO: 1862325 - RNA, 20 nt, Homo sapiens
aaucaaggugauugugauua

SEQ ID NO: 1862326 - RNA, 15 nt, Homo sapiens
cugcaaugagccaug

SEQ ID NO: 1862327 - RNA, 19 nt, Homo sapiens
ccauucagaaagcuucaaa

SEQ ID NO: 1862328 - RNA, 23 nt, Homo sapiens
ccuguggagaugagucagugcca

SEQ ID NO: 1862329 - RNA, 23 nt, Homo sapiens
cguugcagucuguauuuuccacc

SEQ ID NO: 1862330 - RNA, 12 nt, Homo sapiens
uaggaucuccac

SEQ ID NO: 1862331 - RNA, 14 nt, Homo sapiens
agcccaaaccacca

SEQ ID NO: 1862332 - RNA, 17 nt, Homo sapiens
gcagccuucuuuucaaa

SEQ ID NO: 1862333 - RNA, 16 nt, Homo sapiens
aggagguggguggaaa

SEQ ID NO: 1862334 - RNA, 18 nt, Homo sapiens
gaagcucgcauccagaca

SEQ ID NO: 1862335 - RNA, 15 nt, Homo sapiens
ccacuccacuauguu

SEQ ID NO: 1862336 - RNA, 15 nt, Homo sapiens
cuuuucccugaagca

SEQ ID NO: 1862337 - RNA, 20 nt, Homo sapiens
ggcauagguaagcugugccu

SEQ ID NO: 1862338 - RNA, 23 nt, Homo sapiens
uguggaacuuuuauuagauaaca

SEQ ID NO: 1862339 - RNA, 14 nt, Homo sapiens
ugaugguugcaaaa

SEQ ID NO: 1862340 - RNA, 16 nt, Homo sapiens
gccucccuggggacca

SEQ ID NO: 1862341 - RNA, 14 nt, Homo sapiens
gauuuccacaguga

SEQ ID NO: 1862342 - RNA, 13 nt, Homo sapiens
auguacuauccaa

SEQ ID NO: 1862343 - RNA, 20 nt, Homo sapiens
aauuuuuugauccuguaauc

SEQ ID NO: 1862344 - RNA, 12 nt, Homo sapiens
cacacccacuaa

SEQ ID NO: 1862345 - RNA, 17 nt, Homo sapiens
aauuuuuaagcugcaaa

SEQ ID NO: 1862346 - RNA, 19 nt, Homo sapiens
aacaaagacuugcuuuaaa

SEQ ID NO: 1862347 - RNA, 21 nt, Homo sapiens
gccaggugggcggacaaaagg

SEQ ID NO: 1862348 - RNA, 13 nt, Homo sapiens
auauaggggcaau

SEQ ID NO: 1862349 - RNA, 15 nt, Homo sapiens
gaaaugguuuccauc

SEQ ID NO: 1862350 - RNA, 15 nt, Homo sapiens
gcguggcggagcugc

SEQ ID NO: 1862351 - RNA, 13 nt, Homo sapiens
uuguuaaugucau

SEQ ID NO: 1862352 - RNA, 13 nt, Homo sapiens
guguuugcugagg

SEQ ID NO: 1862353 - RNA, 18 nt, Homo sapiens
aaccuauaaaaaggauuc

SEQ ID NO: 1862354 - RNA, 21 nt, Homo sapiens
ccacgagggucaggacuguga

SEQ ID NO: 1862355 - RNA, 21 nt, Homo sapiens
caugugcguccauauuuaaca

SEQ ID NO: 1862356 - RNA, 21 nt, Homo sapiens
uuauuuggauaucaaaagcaa

SEQ ID NO: 1862357 - RNA, 20 nt, Homo sapiens
aagcccacccugcaccucau

SEQ ID NO: 1862358 - RNA, 15 nt, Homo sapiens
ccacauucuacuuca

SEQ ID NO: 1862359 - RNA, 14 nt, Homo sapiens
aguucaacuguaua

SEQ ID NO: 1862360 - RNA, 14 nt, Homo sapiens
cagcaacaugauac

SEQ ID NO: 1862361 - RNA, 22 nt, Homo sapiens
uucucccaccaccucaccaguu

SEQ ID NO: 1862362 - RNA, 18 nt, Homo sapiens
cagagcagugccaacucu

SEQ ID NO: 1862363 - RNA, 15 nt, Homo sapiens
acacugcaggcauca

SEQ ID NO: 1862364 - RNA, 20 nt, Homo sapiens
cauauucgauguacuuuaag

SEQ ID NO: 1862365 - RNA, 20 nt, Homo sapiens
aggaaauauaucuuaaugca

SEQ ID NO: 1862366 - RNA, 15 nt, Homo sapiens
ucuuuuccugucccu

SEQ ID NO: 1862367 - RNA, 13 nt, Homo sapiens
cagcaauugucua

SEQ ID NO: 1862368 - RNA, 14 nt, Homo sapiens
ccucaccaccgaga

SEQ ID NO: 1862369 - RNA, 11 nt, Homo sapiens
auagcacuugc

SEQ ID NO: 1862370 - RNA, 14 nt, Homo sapiens
ggcccacugugcag

SEQ ID NO: 1862371 - RNA, 18 nt, Homo sapiens
cuggagaaaaaacacacu

SEQ ID NO: 1862372 - RNA, 15 nt, Homo sapiens
cucaguuuccucauc

SEQ ID NO: 1862373 - RNA, 19 nt, Homo sapiens
uaaagcaaaauaguauugc

SEQ ID NO: 1862374 - RNA, 14 nt, Homo sapiens
cacacacagagaua

SEQ ID NO: 1862375 - RNA, 14 nt, Homo sapiens
cugaugcagucacg

SEQ ID NO: 1862376 - RNA, 19 nt, Homo sapiens
ugaggccuccagcuucagg

SEQ ID NO: 1862377 - RNA, 23 nt, Homo sapiens
ugucuguuaaguuacauuuacca

SEQ ID NO: 1862378 - RNA, 22 nt, Homo sapiens
cauauauuaucaucaaaugcau

SEQ ID NO: 1862379 - RNA, 16 nt, Homo sapiens
gcggggaccccagaaa

SEQ ID NO: 1862380 - RNA, 17 nt, Homo sapiens
agcaagcagacauuuau

SEQ ID NO: 1862381 - RNA, 16 nt, Homo sapiens
caauugcagaugccaa

SEQ ID NO: 1862382 - RNA, 19 nt, Homo sapiens
uuuaaugacauugauuucu

SEQ ID NO: 1862383 - RNA, 20 nt, Homo sapiens
ggcacuccuggagauaugaa

SEQ ID NO: 1862384 - RNA, 22 nt, Homo sapiens
guggcccugucccucccaccuc

SEQ ID NO: 1862385 - RNA, 17 nt, Homo sapiens
cccaaaggauggucaca

SEQ ID NO: 1862386 - RNA, 15 nt, Homo sapiens
gccugcaucugugaa

SEQ ID NO: 1862387 - RNA, 23 nt, Homo sapiens
agccaguuggcuucuaagccaaa

SEQ ID NO: 1862388 - RNA, 23 nt, Homo sapiens
uucuacuggaaaaaaauacaaaa

SEQ ID NO: 1862389 - RNA, 21 nt, Homo sapiens
cucaagcuuuccugcugucuu

SEQ ID NO: 1862390 - RNA, 22 nt, Homo sapiens
uaauaggaagaacaguacauuu

SEQ ID NO: 1862391 - RNA, 16 nt, Homo sapiens
cagcuacaagugcagc

SEQ ID NO: 1862392 - RNA, 13 nt, Homo sapiens
auauacucaaaac

SEQ ID NO: 1862393 - RNA, 20 nt, Homo sapiens
gacagaaggcaaaguuucca

SEQ ID NO: 1862394 - RNA, 18 nt, Homo sapiens
cagcauucuuagccugug

SEQ ID NO: 1862395 - RNA, 15 nt, Homo sapiens
guauugaaaacacuu

SEQ ID NO: 1862396 - RNA, 20 nt, Homo sapiens
auauugugucauagaauuaa

SEQ ID NO: 1862397 - RNA, 21 nt, Homo sapiens
auugagauaauaucugugagg

SEQ ID NO: 1862398 - RNA, 15 nt, Homo sapiens
cacugagaagacauu

SEQ ID NO: 1862399 - RNA, 15 nt, Homo sapiens
cacugugaagacaau

SEQ ID NO: 1862400 - RNA, 17 nt, Homo sapiens
gugauacuuuugcccuc

SEQ ID NO: 1862401 - RNA, 19 nt, Homo sapiens
cuagccagaggcucuaaug

SEQ ID NO: 1862402 - RNA, 14 nt, Homo sapiens
gacgcagccugaga

SEQ ID NO: 1862403 - RNA, 21 nt, Homo sapiens
agagcucugucugaauccucg

SEQ ID NO: 1862404 - RNA, 23 nt, Homo sapiens
acggggcugacuccugcucucug

SEQ ID NO: 1862405 - RNA, 13 nt, Homo sapiens
auccuagcacuuu

SEQ ID NO: 1862406 - RNA, 15 nt, Homo sapiens
aaaagaaaccacuuc

SEQ ID NO: 1862407 - RNA, 18 nt, Homo sapiens
aaugugguaguacccagg

SEQ ID NO: 1862408 - RNA, 18 nt, Homo sapiens
cuaagcccccacuacaag

SEQ ID NO: 1862409 - RNA, 13 nt, Homo sapiens
gcacccaucugca

SEQ ID NO: 1862410 - RNA, 21 nt, Homo sapiens
ggugucaguauccaggcuuug

SEQ ID NO: 1862411 - RNA, 20 nt, Homo sapiens
ucagggggauaacuaccaga

SEQ ID NO: 1862412 - RNA, 15 nt, Homo sapiens
uuuaaaaaagauauc

SEQ ID NO: 1862413 - RNA, 19 nt, Homo sapiens
cuggggucccucugaagag

SEQ ID NO: 1862414 - RNA, 18 nt, Homo sapiens
auuucuuuuuugccaaau

SEQ ID NO: 1862415 - RNA, 22 nt, Homo sapiens
uccccaaugagacuugccuucc

SEQ ID NO: 1862416 - RNA, 18 nt, Homo sapiens
uuacucucaggcauggau

SEQ ID NO: 1862417 - RNA, 23 nt, Homo sapiens
cagacauuuuccucacacccacc

SEQ ID NO: 1862418 - RNA, 22 nt, Homo sapiens
auaacaauaaaagacaaggaaa

SEQ ID NO: 1862419 - RNA, 16 nt, Homo sapiens
cacacgaguuccagac

SEQ ID NO: 1862420 - RNA, 15 nt, Homo sapiens
uaguugacaguauua

SEQ ID NO: 1862421 - RNA, 23 nt, Homo sapiens
gguggagucagggcugugcuuuc

SEQ ID NO: 1862422 - RNA, 11 nt, Homo sapiens
aaacugcauuu

SEQ ID NO: 1862423 - RNA, 17 nt, Homo sapiens
cauagcucuucacuucc

SEQ ID NO: 1862424 - RNA, 22 nt, Homo sapiens
agacauaaaggaaaagacacau

SEQ ID NO: 1862425 - RNA, 21 nt, Homo sapiens
aaaguguggucucuggaagag

SEQ ID NO: 1862426 - RNA, 16 nt, Homo sapiens
aaauccucaggugauu

SEQ ID NO: 1862427 - RNA, 16 nt, Homo sapiens
uugccucguguaacau

SEQ ID NO: 1862428 - RNA, 16 nt, Homo sapiens
ccaccaggcugcucag

SEQ ID NO: 1862429 - RNA, 14 nt, Homo sapiens
uccacaugugccag

SEQ ID NO: 1862430 - RNA, 14 nt, Homo sapiens
augagcaccuccag

SEQ ID NO: 1862431 - RNA, 21 nt, Homo sapiens
gcuucccguucagcgucacau

SEQ ID NO: 1862432 - RNA, 11 nt, Homo sapiens
gggaagcaaaa

SEQ ID NO: 1862433 - RNA, 12 nt, Homo sapiens
caaaccucaaua

SEQ ID NO: 1862434 - RNA, 15 nt, Homo sapiens
ccuguccccaccucc

SEQ ID NO: 1862435 - RNA, 14 nt, Homo sapiens
agggacagccaaaa

SEQ ID NO: 1862436 - RNA, 22 nt, Homo sapiens
gagcugguuccucucucccacc

SEQ ID NO: 1862437 - RNA, 21 nt, Homo sapiens
uuaaagcucguagaaacaaga

SEQ ID NO: 1862438 - RNA, 22 nt, Homo sapiens
agacaccagagcagaugcagag

SEQ ID NO: 1862439 - RNA, 16 nt, Homo sapiens
ugccuuuguaccauau

SEQ ID NO: 1862440 - RNA, 14 nt, Homo sapiens
agccaguggugcua

SEQ ID NO: 1862441 - RNA, 22 nt, Homo sapiens
uucccagcuaccagcuaugcca

SEQ ID NO: 1862442 - RNA, 14 nt, Homo sapiens
acuuaaacuuccac

SEQ ID NO: 1862443 - RNA, 15 nt, Homo sapiens
auuuagauucacuua

SEQ ID NO: 1862444 - RNA, 21 nt, Homo sapiens
auaucuuuuguaagacauuuc

SEQ ID NO: 1862445 - RNA, 22 nt, Homo sapiens
aaccaaacccagguucaugaau

SEQ ID NO: 1862446 - RNA, 20 nt, Homo sapiens
caccuccacccccaagaaac

SEQ ID NO: 1862447 - RNA, 16 nt, Homo sapiens
cuacuacuaugugcag

SEQ ID NO: 1862448 - RNA, 22 nt, Homo sapiens
gauaugcggcuaugccugccuc

SEQ ID NO: 1862449 - RNA, 13 nt, Homo sapiens
gaagcugaucuga

SEQ ID NO: 1862450 - RNA, 17 nt, Homo sapiens
uggacuccagaucugca

SEQ ID NO: 1862451 - RNA, 14 nt, Homo sapiens
ggguggcauccucc

SEQ ID NO: 1862452 - RNA, 20 nt, Homo sapiens
uacuuguauguagcagcauu

SEQ ID NO: 1862453 - RNA, 16 nt, Homo sapiens
cacucucuucccuuuc

SEQ ID NO: 1862454 - RNA, 21 nt, Homo sapiens
accuauuuuugaaggcauaaa

SEQ ID NO: 1862455 - RNA, 22 nt, Homo sapiens
ccuccuacucugagacaaaaga

SEQ ID NO: 1862456 - RNA, 21 nt, Homo sapiens
gagucgcacauguauugcugu

SEQ ID NO: 1862457 - RNA, 13 nt, Homo sapiens
acacaaauccaac

SEQ ID NO: 1862458 - RNA, 19 nt, Homo sapiens
ccauuuagcacacugcuug

SEQ ID NO: 1862459 - RNA, 13 nt, Homo sapiens
gaccuugaacucc

SEQ ID NO: 1862460 - RNA, 13 nt, Homo sapiens
aauacugagccau

SEQ ID NO: 1862461 - RNA, 12 nt, Homo sapiens
acacuccaggcc

SEQ ID NO: 1862462 - RNA, 14 nt, Homo sapiens
agggagcugcucag

SEQ ID NO: 1862463 - RNA, 17 nt, Homo sapiens
uuuggaauuacaaccau

SEQ ID NO: 1862464 - RNA, 23 nt, Homo sapiens
ucaaacugcaaauauugucauaa

SEQ ID NO: 1862465 - RNA, 21 nt, Homo sapiens
ccucuucacccaccccaugga

SEQ ID NO: 1862466 - RNA, 20 nt, Homo sapiens
aggggugggauccacacuga

SEQ ID NO: 1862467 - RNA, 16 nt, Homo sapiens
gccucugcuguagcuu

SEQ ID NO: 1862468 - RNA, 21 nt, Homo sapiens
agcuguucaguugcacuucua

SEQ ID NO: 1862469 - RNA, 14 nt, Homo sapiens
ggucauuuucuauu

SEQ ID NO: 1862470 - RNA, 18 nt, Homo sapiens
uucucuuucuuacucccu

SEQ ID NO: 1862471 - RNA, 22 nt, Homo sapiens
augugacccuccaaauggagaa

SEQ ID NO: 1862472 - RNA, 14 nt, Homo sapiens
uagcuuagaccuca

SEQ ID NO: 1862473 - RNA, 15 nt, Homo sapiens
guuaaaauugcucau

SEQ ID NO: 1862474 - RNA, 15 nt, Homo sapiens
ggcacuauuuuuauu

SEQ ID NO: 1862475 - RNA, 20 nt, Homo sapiens
accauuaggucacuuaagaa

SEQ ID NO: 1862476 - RNA, 15 nt, Homo sapiens
ucuaugaacuugcaa

SEQ ID NO: 1862477 - RNA, 23 nt, Homo sapiens
uauuaauuuguuuuucuuaucca

SEQ ID NO: 1862478 - RNA, 13 nt, Homo sapiens
aaagacucugagc

SEQ ID NO: 1862479 - RNA, 17 nt, Homo sapiens
aauuauuugaacauugu

SEQ ID NO: 1862480 - RNA, 16 nt, Homo sapiens
aaaggccgucauuuca

SEQ ID NO: 1862481 - RNA, 19 nt, Homo sapiens
cauuuccugacagaaggac

SEQ ID NO: 1862482 - RNA, 21 nt, Homo sapiens
gucauguggaaacuauuuaaa

SEQ ID NO: 1862483 - RNA, 13 nt, Homo sapiens
ucauagcauuaac

SEQ ID NO: 1862484 - RNA, 18 nt, Homo sapiens
cuuagaaauugcauuucc

SEQ ID NO: 1862485 - RNA, 11 nt, Homo sapiens
gggcacggugg

SEQ ID NO: 1862486 - RNA, 20 nt, Homo sapiens
gcccaacagggcaaccaaua

SEQ ID NO: 1862487 - RNA, 17 nt, Homo sapiens
aaaugaaugccuuucaa

SEQ ID NO: 1862488 - RNA, 21 nt, Homo sapiens
uggcccccucccuggaugaca

SEQ ID NO: 1862489 - RNA, 16 nt, Homo sapiens
cucccgggagcacaga

SEQ ID NO: 1862490 - RNA, 19 nt, Homo sapiens
uaaaccgauauuuacguaa

SEQ ID NO: 1862491 - RNA, 17 nt, Homo sapiens
aucuggacacacuguua

SEQ ID NO: 1862492 - RNA, 19 nt, Homo sapiens
uagcucucacagacauaua

SEQ ID NO: 1862493 - RNA, 22 nt, Homo sapiens
guucuauaacaacaacaacaaa

SEQ ID NO: 1862494 - RNA, 23 nt, Homo sapiens
auuuuauuuuuucccuccugaca

SEQ ID NO: 1862495 - RNA, 23 nt, Homo sapiens
gacuuauuuuaauuccacuuuaa

SEQ ID NO: 1862496 - RNA, 22 nt, Homo sapiens
aacaggaugauggcacugagaa

SEQ ID NO: 1862497 - RNA, 20 nt, Homo sapiens
uuaaguugauggugaugaaa

SEQ ID NO: 1862498 - RNA, 12 nt, Homo sapiens
ggcacugugccu

SEQ ID NO: 1862499 - RNA, 19 nt, Homo sapiens
agaauucucucuucuggaa

SEQ ID NO: 1862500 - RNA, 17 nt, Homo sapiens
cagcuaagacauauuca

SEQ ID NO: 1862501 - RNA, 17 nt, Homo sapiens
aaucuuucuccacuguu

SEQ ID NO: 1862502 - RNA, 16 nt, Homo sapiens
gaugaaagggacagau

SEQ ID NO: 1862503 - RNA, 21 nt, Homo sapiens
aauaacaacaacuuaaugugc

SEQ ID NO: 1862504 - RNA, 13 nt, Homo sapiens
acagagugcaacc

SEQ ID NO: 1862505 - RNA, 17 nt, Homo sapiens
gcacagcugcucuguga

SEQ ID NO: 1862506 - RNA, 17 nt, Homo sapiens
aaauaauguauuuacuu

SEQ ID NO: 1862507 - RNA, 13 nt, Homo sapiens
gggcuuggcugcc

SEQ ID NO: 1862508 - RNA, 14 nt, Homo sapiens
aagucuuccauaga

SEQ ID NO: 1862509 - RNA, 18 nt, Homo sapiens
ccaaacucugugucagca

SEQ ID NO: 1862510 - RNA, 20 nt, Homo sapiens
agaccucccagagagugaau

SEQ ID NO: 1862511 - RNA, 18 nt, Homo sapiens
ugccggggguucaggguu

SEQ ID NO: 1862512 - RNA, 19 nt, Homo sapiens
ucugagcaccuacuuacau

SEQ ID NO: 1862513 - RNA, 17 nt, Homo sapiens
aaauaucacaucacuua

SEQ ID NO: 1862514 - RNA, 19 nt, Homo sapiens
aaugcauuuuauucuuuaa

SEQ ID NO: 1862515 - RNA, 20 nt, Homo sapiens
auagauggucacgcaccugg

SEQ ID NO: 1862516 - RNA, 16 nt, Homo sapiens
agugacaugcauucac

SEQ ID NO: 1862517 - RNA, 13 nt, Homo sapiens
cugagcaucacua

SEQ ID NO: 1862518 - RNA, 12 nt, Homo sapiens
agagagcaccug

SEQ ID NO: 1862519 - RNA, 14 nt, Homo sapiens
gaauaauccagaaa

SEQ ID NO: 1862520 - RNA, 18 nt, Homo sapiens
acugauguuacuagccuc

SEQ ID NO: 1862521 - RNA, 23 nt, Homo sapiens
agguuuaagcgauucucaugccu

SEQ ID NO: 1862522 - RNA, 20 nt, Homo sapiens
gccaggugugguggugcaca

SEQ ID NO: 1862523 - RNA, 18 nt, Homo sapiens
uccaaaccaucagcugcu

SEQ ID NO: 1862524 - RNA, 16 nt, Homo sapiens
acacucaauagucacg

SEQ ID NO: 1862525 - RNA, 15 nt, Homo sapiens
cuuuuuuugaugaaa

SEQ ID NO: 1862526 - RNA, 16 nt, Homo sapiens
ggcuuccauccuguca

SEQ ID NO: 1862527 - RNA, 18 nt, Homo sapiens
augcauuguuauaauuac

SEQ ID NO: 1862528 - RNA, 15 nt, Homo sapiens
uucuuagucucagca

SEQ ID NO: 1862529 - RNA, 23 nt, Homo sapiens
ugaccucaaugccuuuguucacc

SEQ ID NO: 1862530 - RNA, 19 nt, Homo sapiens
gggagccucuccuugccug

SEQ ID NO: 1862531 - RNA, 17 nt, Homo sapiens
auugcagauugaauaua

SEQ ID NO: 1862532 - RNA, 13 nt, Homo sapiens
gccagcacagccu

SEQ ID NO: 1862533 - RNA, 19 nt, Homo sapiens
ugcaugauuuuauacauag

SEQ ID NO: 1862534 - RNA, 17 nt, Homo sapiens
acauuuuuuguuugcug

SEQ ID NO: 1862535 - RNA, 21 nt, Homo sapiens
cauaauaaauagacacuugag

SEQ ID NO: 1862536 - RNA, 23 nt, Homo sapiens
aacagaagccugaugcugacauu

SEQ ID NO: 1862537 - RNA, 13 nt, Homo sapiens
gggacuuggauag

SEQ ID NO: 1862538 - RNA, 21 nt, Homo sapiens
gcugguuucuuucaugcuccu

SEQ ID NO: 1862539 - RNA, 18 nt, Homo sapiens
auggaauggcagguguca

SEQ ID NO: 1862540 - RNA, 21 nt, Homo sapiens
ugggacccuagcuauaugcau

SEQ ID NO: 1862541 - RNA, 12 nt, Homo sapiens
aaaaaguguuua

SEQ ID NO: 1862542 - RNA, 18 nt, Homo sapiens
accauuacaaaaucuuaa

SEQ ID NO: 1862543 - RNA, 18 nt, Homo sapiens
ugcauuuuuuaccacaau

SEQ ID NO: 1862544 - RNA, 22 nt, Homo sapiens
guccugaaagccacagacaaua

SEQ ID NO: 1862545 - RNA, 17 nt, Homo sapiens
agguagcacucucagag

SEQ ID NO: 1862546 - RNA, 15 nt, Homo sapiens
auaucacaucagugg

SEQ ID NO: 1862547 - RNA, 18 nt, Homo sapiens
ccaggguggaugaucuca

SEQ ID NO: 1862548 - RNA, 13 nt, Homo sapiens
cauagagcuuuuu

SEQ ID NO: 1862549 - RNA, 16 nt, Homo sapiens
gagccggcauccuugc

SEQ ID NO: 1862550 - RNA, 17 nt, Homo sapiens
uucauuuuuuucacugg

SEQ ID NO: 1862551 - RNA, 17 nt, Homo sapiens
gucaacuuauucuuuga

SEQ ID NO: 1862552 - RNA, 19 nt, Homo sapiens
gcagagaaacuuaagcaaa

SEQ ID NO: 1862553 - RNA, 21 nt, Homo sapiens
uaugggccaagcccagcuuaa

SEQ ID NO: 1862554 - RNA, 15 nt, Homo sapiens
ucaccuuggacggaa

SEQ ID NO: 1862555 - RNA, 15 nt, Homo sapiens
cuuguuuaccaaaga

SEQ ID NO: 1862556 - RNA, 18 nt, Homo sapiens
augagccuuaccaauaau

SEQ ID NO: 1862557 - RNA, 21 nt, Homo sapiens
aaccuuguugcuuuaggugag

SEQ ID NO: 1862558 - RNA, 15 nt, Homo sapiens
gaaagucaugcaauc

SEQ ID NO: 1862559 - RNA, 16 nt, Homo sapiens
uaccuaaacuauaugc

SEQ ID NO: 1862560 - RNA, 15 nt, Homo sapiens
cuguuauguacugua

SEQ ID NO: 1862561 - RNA, 13 nt, Homo sapiens
cuccuggugcagg

SEQ ID NO: 1862562 - RNA, 16 nt, Homo sapiens
gggcaauaugaaguua

SEQ ID NO: 1862563 - RNA, 19 nt, Homo sapiens
uacagugccaacuccucac

SEQ ID NO: 1862564 - RNA, 21 nt, Homo sapiens
cuuucagggguggcccaauga

SEQ ID NO: 1862565 - RNA, 12 nt, Homo sapiens
auuacaggugug

SEQ ID NO: 1862566 - RNA, 14 nt, Homo sapiens
uguacuaacaaagc

SEQ ID NO: 1862567 - RNA, 16 nt, Homo sapiens
cuuuucaccaggggug

SEQ ID NO: 1862568 - RNA, 20 nt, Homo sapiens
uauaaggacagaccaaaaau

SEQ ID NO: 1862569 - RNA, 18 nt, Homo sapiens
uuucuaugacacaugcaa

SEQ ID NO: 1862570 - RNA, 22 nt, Homo sapiens
agugaccccugccuacuuccuu

SEQ ID NO: 1862571 - RNA, 22 nt, Homo sapiens
uaaccaaagcccaaagugguau

SEQ ID NO: 1862572 - RNA, 18 nt, Homo sapiens
gcuaugccuccauuucag

SEQ ID NO: 1862573 - RNA, 16 nt, Homo sapiens
cuagaaaaacaggcac

SEQ ID NO: 1862574 - RNA, 22 nt, Homo sapiens
guuuuuccucauugagaauuca

SEQ ID NO: 1862575 - RNA, 18 nt, Homo sapiens
ugcagugagcugagauca

SEQ ID NO: 1862576 - RNA, 20 nt, Homo sapiens
ggcuaugccuugcacacagg

SEQ ID NO: 1862577 - RNA, 23 nt, Homo sapiens
gcauagagugugauguaugugua

SEQ ID NO: 1862578 - RNA, 22 nt, Homo sapiens
cccagaggcagcagagcauuca

SEQ ID NO: 1862579 - RNA, 22 nt, Homo sapiens
agugacauuucuaucacaauca

SEQ ID NO: 1862580 - RNA, 13 nt, Homo sapiens
agauuugaccucc

SEQ ID NO: 1862581 - RNA, 21 nt, Homo sapiens
aacagccuuaaauccuuuaca

SEQ ID NO: 1862582 - RNA, 16 nt, Homo sapiens
cagaguguucccugac

SEQ ID NO: 1862583 - RNA, 20 nt, Homo sapiens
cauguaaaauaugucuuucu

SEQ ID NO: 1862584 - RNA, 16 nt, Homo sapiens
gagccggacaccaagc

SEQ ID NO: 1862585 - RNA, 21 nt, Homo sapiens
acaaguuucugauaccacugc

SEQ ID NO: 1862586 - RNA, 22 nt, Homo sapiens
ugcggagucuccucucuuggca

SEQ ID NO: 1862587 - RNA, 21 nt, Homo sapiens
gagagucucccagggagcaug

SEQ ID NO: 1862588 - RNA, 12 nt, Homo sapiens
acugcugugaau

SEQ ID NO: 1862589 - RNA, 20 nt, Homo sapiens
aaaucuguauugcuaagaua

SEQ ID NO: 1862590 - RNA, 16 nt, Homo sapiens
cuuuccccucccucag

SEQ ID NO: 1862591 - RNA, 16 nt, Homo sapiens
aaacuuacuagcuuua

SEQ ID NO: 1862592 - RNA, 20 nt, Homo sapiens
uacaugagaaagaugucuau

SEQ ID NO: 1862593 - RNA, 13 nt, Homo sapiens
ugaccauacuaau

SEQ ID NO: 1862594 - RNA, 21 nt, Homo sapiens
cacuauuguuccagcaguuuu

SEQ ID NO: 1862595 - RNA, 14 nt, Homo sapiens
aucagucuuuauua

SEQ ID NO: 1862596 - RNA, 17 nt, Homo sapiens
ugugaagaaaggguguu

SEQ ID NO: 1862597 - RNA, 13 nt, Homo sapiens
auacaagugauaa

SEQ ID NO: 1862598 - RNA, 15 nt, Homo sapiens
gaaaacugcaacuug

SEQ ID NO: 1862599 - RNA, 23 nt, Homo sapiens
cauauguauuuugucauauguau

SEQ ID NO: 1862600 - RNA, 23 nt, Homo sapiens
uuacucuauaaccaaaugaaaua

SEQ ID NO: 1862601 - RNA, 20 nt, Homo sapiens
cauaaguuaugccucugaca

SEQ ID NO: 1862602 - RNA, 21 nt, Homo sapiens
ccuggaaagaggcagucuucu

SEQ ID NO: 1862603 - RNA, 15 nt, Homo sapiens
auaaaaaagcaaaaa

SEQ ID NO: 1862604 - RNA, 13 nt, Homo sapiens
ccagauaguuaua

SEQ ID NO: 1862605 - RNA, 12 nt, Homo sapiens
auacugugcaua

SEQ ID NO: 1862606 - RNA, 13 nt, Homo sapiens
cucuugaaucucu

SEQ ID NO: 1862607 - RNA, 14 nt, Homo sapiens
cccccugccagucu

SEQ ID NO: 1862608 - RNA, 20 nt, Homo sapiens
uaucuaugcaguuccaauca

SEQ ID NO: 1862609 - RNA, 15 nt, Homo sapiens
cuggagccuguguaa

SEQ ID NO: 1862610 - RNA, 14 nt, Homo sapiens
cccacuggccaguc

SEQ ID NO: 1862611 - RNA, 23 nt, Homo sapiens
gagaaccccucugggaaaaucua

SEQ ID NO: 1862612 - RNA, 16 nt, Homo sapiens
ucuuuggacaaccaug

SEQ ID NO: 1862613 - RNA, 17 nt, Homo sapiens
caaaccaggauuuccuu

SEQ ID NO: 1862614 - RNA, 18 nt, Homo sapiens
cgugagccaggcaaagga

SEQ ID NO: 1862615 - RNA, 22 nt, Homo sapiens
agagcuguuaugcuguuuccua

SEQ ID NO: 1862616 - RNA, 16 nt, Homo sapiens
acaauuugacauacaa

SEQ ID NO: 1862617 - RNA, 17 nt, Homo sapiens
cccuaccucuaguaaau

SEQ ID NO: 1862618 - RNA, 16 nt, Homo sapiens
aucuuuucacaaauaa

SEQ ID NO: 1862619 - RNA, 14 nt, Homo sapiens
uaaguuauuuacuu

SEQ ID NO: 1862620 - RNA, 22 nt, Homo sapiens
uguuucucugccgcuaccuccc

SEQ ID NO: 1862621 - RNA, 17 nt, Homo sapiens
aggaaacacugauuaac

SEQ ID NO: 1862622 - RNA, 21 nt, Homo sapiens
gggagauucuggguuugccca

SEQ ID NO: 1862623 - RNA, 20 nt, Homo sapiens
acugaaaaaaugcugagcca

SEQ ID NO: 1862624 - RNA, 19 nt, Homo sapiens
cugcuguucauguuacuca

SEQ ID NO: 1862625 - RNA, 17 nt, Homo sapiens
gauucuucuagaucuca

SEQ ID NO: 1862626 - RNA, 15 nt, Homo sapiens
augcgucuacccaga

SEQ ID NO: 1862627 - RNA, 21 nt, Homo sapiens
gauuuggggcuaaagacugau

SEQ ID NO: 1862628 - RNA, 17 nt, Homo sapiens
auaucuguacaaugaca

SEQ ID NO: 1862629 - RNA, 14 nt, Homo sapiens
uaucuguugccuua

SEQ ID NO: 1862630 - RNA, 22 nt, Homo sapiens
cuuuggaagugaggcauugcac

SEQ ID NO: 1862631 - RNA, 21 nt, Homo sapiens
ucacacuuccaccagccugca

SEQ ID NO: 1862632 - RNA, 13 nt, Homo sapiens
gauagaaugucaa

SEQ ID NO: 1862633 - RNA, 16 nt, Homo sapiens
gauugguaagagccaa

SEQ ID NO: 1862634 - RNA, 18 nt, Homo sapiens
auccaaaucuugaauuuc

SEQ ID NO: 1862635 - RNA, 24 nt, Homo sapiens
ugggauaggaaaaaaagauuucca

SEQ ID NO: 1862636 - RNA, 16 nt, Homo sapiens
cccacuuaugcugcug

SEQ ID NO: 1862637 - RNA, 16 nt, Homo sapiens
augcagcaaaauguga

SEQ ID NO: 1862638 - RNA, 16 nt, Homo sapiens
cccuguggucacuuau

SEQ ID NO: 1862639 - RNA, 14 nt, Homo sapiens
aaaauguucauucu

SEQ ID NO: 1862640 - RNA, 15 nt, Homo sapiens
caagaaacacugccu

SEQ ID NO: 1862641 - RNA, 17 nt, Homo sapiens
ggcaaauguuuacauuu

SEQ ID NO: 1862642 - RNA, 17 nt, Homo sapiens
cuuccuaauuccacagc

SEQ ID NO: 1862643 - RNA, 19 nt, Homo sapiens
auaaaagaucuugaauagu

SEQ ID NO: 1862644 - RNA, 15 nt, Homo sapiens
aauucugcugucuca

SEQ ID NO: 1862645 - RNA, 13 nt, Homo sapiens
uuaugaaugugca

SEQ ID NO: 1862646 - RNA, 21 nt, Homo sapiens
acaacuucauauaacugagau

SEQ ID NO: 1862647 - RNA, 20 nt, Homo sapiens
gaaaaauuccuauugugauu

SEQ ID NO: 1862648 - RNA, 20 nt, Homo sapiens
accggaaggaggccaaccag

SEQ ID NO: 1862649 - RNA, 18 nt, Homo sapiens
uggccucccaaucuugcc

SEQ ID NO: 1862650 - RNA, 14 nt, Homo sapiens
acuggaaaacagaa

SEQ ID NO: 1862651 - RNA, 20 nt, Homo sapiens
acucaguuaggcagugcagu

SEQ ID NO: 1862652 - RNA, 15 nt, Homo sapiens
ggcagucaucaguca

SEQ ID NO: 1862653 - RNA, 18 nt, Homo sapiens
ucuuuccuggcuacucca

SEQ ID NO: 1862654 - RNA, 22 nt, Homo sapiens
cuccccuugggcccacaccucc

SEQ ID NO: 1862655 - RNA, 20 nt, Homo sapiens
auuuuuuucuuuacuuaucu

SEQ ID NO: 1862656 - RNA, 18 nt, Homo sapiens
cauuugagauaaagucaa

SEQ ID NO: 1862657 - RNA, 16 nt, Homo sapiens
ugaaggucacucuucc

SEQ ID NO: 1862658 - RNA, 14 nt, Homo sapiens
uuuaugacauuuua

SEQ ID NO: 1862659 - RNA, 21 nt, Homo sapiens
ugcugagugagugaugaauca

SEQ ID NO: 1862660 - RNA, 13 nt, Homo sapiens
auaggcuuaugau

SEQ ID NO: 1862661 - RNA, 16 nt, Homo sapiens
augcacagagauaugc

SEQ ID NO: 1862662 - RNA, 13 nt, Homo sapiens
aucauguacccca

SEQ ID NO: 1862663 - RNA, 23 nt, Homo sapiens
accucuuggccacagaggacuca

SEQ ID NO: 1862664 - RNA, 14 nt, Homo sapiens
uaaaugugaacuua

SEQ ID NO: 1862665 - RNA, 23 nt, Homo sapiens
gcucccacacccaccucugccac

SEQ ID NO: 1862666 - RNA, 13 nt, Homo sapiens
ugcaaaugcucaa

SEQ ID NO: 1862667 - RNA, 19 nt, Homo sapiens
aagccagguccgaggccaa

SEQ ID NO: 1862668 - RNA, 16 nt, Homo sapiens
acucuaaauauuucau

SEQ ID NO: 1862669 - RNA, 11 nt, Homo sapiens
caacagcauuu

SEQ ID NO: 1862670 - RNA, 14 nt, Homo sapiens
uauauuuaucuuuc

SEQ ID NO: 1862671 - RNA, 14 nt, Homo sapiens
auuucucuccuuaa

SEQ ID NO: 1862672 - RNA, 14 nt, Homo sapiens
cuaacuaauucugu

SEQ ID NO: 1862673 - RNA, 14 nt, Homo sapiens
agacggaugcccau

SEQ ID NO: 1862674 - RNA, 16 nt, Homo sapiens
ucacaauuccauuucc

SEQ ID NO: 1862675 - RNA, 19 nt, Homo sapiens
agacaggaagguggugcuu

SEQ ID NO: 1862676 - RNA, 15 nt, Homo sapiens
uuuggccagugacau

SEQ ID NO: 1862677 - RNA, 18 nt, Homo sapiens
cagcucucaguugcagcc

SEQ ID NO: 1862678 - RNA, 15 nt, Homo sapiens
agcugacaucuugca

SEQ ID NO: 1862679 - RNA, 23 nt, Homo sapiens
agugugaguggcagccaugccuc

SEQ ID NO: 1862680 - RNA, 23 nt, Homo sapiens
cgguggcucccaagccacauuca

SEQ ID NO: 1862681 - RNA, 23 nt, Homo sapiens
uauuuuuuuuuuuccaagacaga

SEQ ID NO: 1862682 - RNA, 21 nt, Homo sapiens
uggauuuuguggaggugagaa

SEQ ID NO: 1862683 - RNA, 14 nt, Homo sapiens
ucagccuuaggaag

SEQ ID NO: 1862684 - RNA, 13 nt, Homo sapiens
gauccugcacucu

SEQ ID NO: 1862685 - RNA, 20 nt, Homo sapiens
gucaggguauaaaaugacau

SEQ ID NO: 1862686 - RNA, 16 nt, Homo sapiens
caccccccuucugaau

SEQ ID NO: 1862687 - RNA, 20 nt, Homo sapiens
gcucagcucgguacccgggg

SEQ ID NO: 1862688 - RNA, 20 nt, Homo sapiens
uauaugccgcuacaaaaagg

SEQ ID NO: 1862689 - RNA, 18 nt, Homo sapiens
uuaguggauuacugccau

SEQ ID NO: 1862690 - RNA, 13 nt, Homo sapiens
aucugacaagacu

SEQ ID NO: 1862691 - RNA, 13 nt, Homo sapiens
auaugacaagccu

SEQ ID NO: 1862692 - RNA, 23 nt, Homo sapiens
ggucauuucucaaaaaccacagu

SEQ ID NO: 1862693 - RNA, 13 nt, Homo sapiens
agaagaugaauga

SEQ ID NO: 1862694 - RNA, 14 nt, Homo sapiens
gcauuuccuuucag

SEQ ID NO: 1862695 - RNA, 21 nt, Homo sapiens
ugcagguuuguaaugcaaaag

SEQ ID NO: 1862696 - RNA, 16 nt, Homo sapiens
auugcaggagucccug

SEQ ID NO: 1862697 - RNA, 17 nt, Homo sapiens
cuaagcuguuucuugau

SEQ ID NO: 1862698 - RNA, 22 nt, Homo sapiens
gcaauucuucuucucaagcacu

SEQ ID NO: 1862699 - RNA, 12 nt, Homo sapiens
aacucaccaggg

SEQ ID NO: 1862700 - RNA, 19 nt, Homo sapiens
cuguccuaaggaaccuucc

SEQ ID NO: 1862701 - RNA, 12 nt, Homo sapiens
agaagagccuga

SEQ ID NO: 1862702 - RNA, 19 nt, Homo sapiens
cagaacaaacaaggcauuc

SEQ ID NO: 1862703 - RNA, 23 nt, Homo sapiens
uguauacuuccuuaugcuucuuu

SEQ ID NO: 1862704 - RNA, 17 nt, Homo sapiens
cccagaaaacacauuuc

SEQ ID NO: 1862705 - RNA, 20 nt, Homo sapiens
gccgggcagaggggcagaug

SEQ ID NO: 1862706 - RNA, 23 nt, Homo sapiens
uaccaaaacaagauuaauuucau

SEQ ID NO: 1862707 - RNA, 16 nt, Homo sapiens
acaagaaugcauuccc

SEQ ID NO: 1862708 - RNA, 21 nt, Homo sapiens
aaaaucugcauguuugauuau

SEQ ID NO: 1862709 - RNA, 17 nt, Homo sapiens
gaaggacacuagccugu

SEQ ID NO: 1862710 - RNA, 23 nt, Homo sapiens
gaaagguuuuauucuauauugcu

SEQ ID NO: 1862711 - RNA, 22 nt, Homo sapiens
agacauuuuaaaaaauggucac

SEQ ID NO: 1862712 - RNA, 20 nt, Homo sapiens
caggggugcuccugugcuca

SEQ ID NO: 1862713 - RNA, 15 nt, Homo sapiens
agcagaggcacuggg

SEQ ID NO: 1862714 - RNA, 22 nt, Homo sapiens
uauguagcaaaauacaugacau

SEQ ID NO: 1862715 - RNA, 19 nt, Homo sapiens
uaaaguuuucuaaauuuau

SEQ ID NO: 1862716 - RNA, 22 nt, Homo sapiens
aaaugcugagcagcauggauuc

SEQ ID NO: 1862717 - RNA, 15 nt, Homo sapiens
augauacaguugcau

SEQ ID NO: 1862718 - RNA, 14 nt, Homo sapiens
aagcaaauggggga

SEQ ID NO: 1862719 - RNA, 16 nt, Homo sapiens
uugagagccaguggcg

SEQ ID NO: 1862720 - RNA, 17 nt, Homo sapiens
uuggacucugagcucau

SEQ ID NO: 1862721 - RNA, 16 nt, Homo sapiens
uggggcuuccugggca

SEQ ID NO: 1862722 - RNA, 19 nt, Homo sapiens
ugccaucccugagagacca

SEQ ID NO: 1862723 - RNA, 20 nt, Homo sapiens
gcaggaaaaggcugcagcua

SEQ ID NO: 1862724 - RNA, 18 nt, Homo sapiens
cugggagaaccaaaaaga

SEQ ID NO: 1862725 - RNA, 17 nt, Homo sapiens
gcuuuagagaagccaua

SEQ ID NO: 1862726 - RNA, 16 nt, Homo sapiens
caagugugugcaugug

SEQ ID NO: 1862727 - RNA, 23 nt, Homo sapiens
uuuauugaagaaaugaaagguga

SEQ ID NO: 1862728 - RNA, 13 nt, Homo sapiens
uauuaccuauuca

SEQ ID NO: 1862729 - RNA, 16 nt, Homo sapiens
aaauauuuacuauuua

SEQ ID NO: 1862730 - RNA, 21 nt, Homo sapiens
agcauuuggugccuauuugaa

SEQ ID NO: 1862731 - RNA, 20 nt, Homo sapiens
cucuuucuaaaauauuucau

SEQ ID NO: 1862732 - RNA, 16 nt, Homo sapiens
cuaaagucacauauaa

SEQ ID NO: 1862733 - RNA, 14 nt, Homo sapiens
agauaaaccaauaa

SEQ ID NO: 1862734 - RNA, 14 nt, Homo sapiens
agaggcaccaggaa

SEQ ID NO: 1862735 - RNA, 17 nt, Homo sapiens
uaucauuuugcacgugc

SEQ ID NO: 1862736 - RNA, 15 nt, Homo sapiens
cuucagaucugaggu

SEQ ID NO: 1862737 - RNA, 21 nt, Homo sapiens
cauggcccccaauaaaggcag

SEQ ID NO: 1862738 - RNA, 19 nt, Homo sapiens
acaagcaucaguagcugag

SEQ ID NO: 1862739 - RNA, 20 nt, Homo sapiens
agagcaaaacucagucucaa

SEQ ID NO: 1862740 - RNA, 17 nt, Homo sapiens
auucaaacugccuauau

SEQ ID NO: 1862741 - RNA, 20 nt, Homo sapiens
aaagagagaccccagucaag

SEQ ID NO: 1862742 - RNA, 17 nt, Homo sapiens
gacugcaaugagguaga

SEQ ID NO: 1862743 - RNA, 17 nt, Homo sapiens
caagauacauuucaucu

SEQ ID NO: 1862744 - RNA, 13 nt, Homo sapiens
uugguuuuacaca

SEQ ID NO: 1862745 - RNA, 11 nt, Homo sapiens
ggaacccggcg

SEQ ID NO: 1862746 - RNA, 20 nt, Homo sapiens
cuccuggacucaaaguaucc

SEQ ID NO: 1862747 - RNA, 16 nt, Homo sapiens
agaacuugauuugcau

SEQ ID NO: 1862748 - RNA, 20 nt, Homo sapiens
gccugcccguaaacacgccu

SEQ ID NO: 1862749 - RNA, 15 nt, Homo sapiens
ccuugcggaagccau

SEQ ID NO: 1862750 - RNA, 22 nt, Homo sapiens
cauaaauuagaggucuccaaaa

SEQ ID NO: 1862751 - RNA, 12 nt, Homo sapiens
cugcuguaaaau

SEQ ID NO: 1862752 - RNA, 19 nt, Homo sapiens
ugccauuucugaacuguua

SEQ ID NO: 1862753 - RNA, 19 nt, Homo sapiens
uucauaccuaaguacugua

SEQ ID NO: 1862754 - RNA, 22 nt, Homo sapiens
uguugcccacauuaagcacugu

SEQ ID NO: 1862755 - RNA, 21 nt, Homo sapiens
cuguucuguagcuuucuggaa

SEQ ID NO: 1862756 - RNA, 15 nt, Homo sapiens
cccugucccaugcag

SEQ ID NO: 1862757 - RNA, 11 nt, Homo sapiens
ucaccaccacc

SEQ ID NO: 1862758 - RNA, 19 nt, Homo sapiens
ucuggacuauauugggacu

SEQ ID NO: 1862759 - RNA, 17 nt, Homo sapiens
ugccacucccugagcuu

SEQ ID NO: 1862760 - RNA, 11 nt, Homo sapiens
cgauguuaaac

SEQ ID NO: 1862761 - RNA, 14 nt, Homo sapiens
ugcccugaggcacu

SEQ ID NO: 1862762 - RNA, 21 nt, Homo sapiens
auauucagagauguaccaugu

SEQ ID NO: 1862763 - RNA, 14 nt, Homo sapiens
cccacucagggauc

SEQ ID NO: 1862764 - RNA, 17 nt, Homo sapiens
uccuauuccagugucca

SEQ ID NO: 1862765 - RNA, 13 nt, Homo sapiens
gcccugggugacc

SEQ ID NO: 1862766 - RNA, 17 nt, Homo sapiens
acccccgcuuugguucu

SEQ ID NO: 1862767 - RNA, 12 nt, Homo sapiens
uguaguggcaca

SEQ ID NO: 1862768 - RNA, 20 nt, Homo sapiens
gauacaugguugugaccuga

SEQ ID NO: 1862769 - RNA, 20 nt, Homo sapiens
uaauguaagaagcuuuggug

SEQ ID NO: 1862770 - RNA, 23 nt, Homo sapiens
uuuauauguagauuagugaucua

SEQ ID NO: 1862771 - RNA, 14 nt, Homo sapiens
agcugcaacagugg

SEQ ID NO: 1862772 - RNA, 23 nt, Homo sapiens
aacaugacauccagagaugacua

SEQ ID NO: 1862773 - RNA, 18 nt, Homo sapiens
agagucagacugauagac

SEQ ID NO: 1862774 - RNA, 15 nt, Homo sapiens
aucuuuaacacaacu

SEQ ID NO: 1862775 - RNA, 15 nt, Homo sapiens
ugcagucagugucaa

SEQ ID NO: 1862776 - RNA, 16 nt, Homo sapiens
ggcuguaaagcaaacu

SEQ ID NO: 1862777 - RNA, 19 nt, Homo sapiens
cuauugacaagucauuuua

SEQ ID NO: 1862778 - RNA, 20 nt, Homo sapiens
ugugaacucucagacaucuc

SEQ ID NO: 1862779 - RNA, 23 nt, Homo sapiens
ccuggaguguaugacugcacaug

SEQ ID NO: 1862780 - RNA, 22 nt, Homo sapiens
uguucacugcagcaugcccagu

SEQ ID NO: 1862781 - RNA, 20 nt, Homo sapiens
ggccacuugaguuggggcca

SEQ ID NO: 1862782 - RNA, 15 nt, Homo sapiens
cucuaaaacuagaaa

SEQ ID NO: 1862783 - RNA, 19 nt, Homo sapiens
cugggaaaugagaugacca

SEQ ID NO: 1862784 - RNA, 19 nt, Homo sapiens
acuugagucacaaagaaca

SEQ ID NO: 1862785 - RNA, 17 nt, Homo sapiens
acaucaccagugccacg

SEQ ID NO: 1862786 - RNA, 17 nt, Homo sapiens
caugugaauucuggcau

SEQ ID NO: 1862787 - RNA, 16 nt, Homo sapiens
agaacuucaagcucuc

SEQ ID NO: 1862788 - RNA, 19 nt, Homo sapiens
gauucccccagucauucug

SEQ ID NO: 1862789 - RNA, 21 nt, Homo sapiens
cagacuuucuacaugcaaauc

SEQ ID NO: 1862790 - RNA, 18 nt, Homo sapiens
auguguauauaugugugc

SEQ ID NO: 1862791 - RNA, 18 nt, Homo sapiens
ccagaguuggugacacag

SEQ ID NO: 1862792 - RNA, 14 nt, Homo sapiens
aacuguguugcuga

SEQ ID NO: 1862793 - RNA, 19 nt, Homo sapiens
guauuauaauuguugauau

SEQ ID NO: 1862794 - RNA, 15 nt, Homo sapiens
cuuucaaagccauuu

SEQ ID NO: 1862795 - RNA, 14 nt, Homo sapiens
cugccgucagcucc

SEQ ID NO: 1862796 - RNA, 21 nt, Homo sapiens
ggaugcuccauuucaauugcu

SEQ ID NO: 1862797 - RNA, 19 nt, Homo sapiens
cccucugucauccucagga

SEQ ID NO: 1862798 - RNA, 13 nt, Homo sapiens
cuuacuguuaaaa

SEQ ID NO: 1862799 - RNA, 20 nt, Homo sapiens
auacaugccuuuccagugcu

SEQ ID NO: 1862800 - RNA, 13 nt, Homo sapiens
cucggacuuggca

SEQ ID NO: 1862801 - RNA, 16 nt, Homo sapiens
aacacuuacuaccugg

SEQ ID NO: 1862802 - RNA, 14 nt, Homo sapiens
uacaguagcugcua

SEQ ID NO: 1862803 - RNA, 15 nt, Homo sapiens
gacaaaccagagaaa

SEQ ID NO: 1862804 - RNA, 14 nt, Homo sapiens
cagaacuacuucuu

SEQ ID NO: 1862805 - RNA, 16 nt, Homo sapiens
auuuaacuuugcaaaa

SEQ ID NO: 1862806 - RNA, 14 nt, Homo sapiens
ucaaaaacuguauu

SEQ ID NO: 1862807 - RNA, 14 nt, Homo sapiens
agucagugcaaaug

SEQ ID NO: 1862808 - RNA, 15 nt, Homo sapiens
cugcccuucaacaau

SEQ ID NO: 1862809 - RNA, 17 nt, Homo sapiens
gucauaaucucuuucca

SEQ ID NO: 1862810 - RNA, 15 nt, Homo sapiens
gugcauucaaccuua

SEQ ID NO: 1862811 - RNA, 20 nt, Homo sapiens
agccaaauauuaggcuuaaa

SEQ ID NO: 1862812 - RNA, 14 nt, Homo sapiens
aagcccagcacuug

SEQ ID NO: 1862813 - RNA, 19 nt, Homo sapiens
acagacccaaaccauacca

SEQ ID NO: 1862814 - RNA, 16 nt, Homo sapiens
uccaaacccaggcuau

SEQ ID NO: 1862815 - RNA, 13 nt, Homo sapiens
ugucaaagcuuug

SEQ ID NO: 1862816 - RNA, 19 nt, Homo sapiens
ggucaucucggcuguuccu

SEQ ID NO: 1862817 - RNA, 12 nt, Homo sapiens
gaauagcacaaa

SEQ ID NO: 1862818 - RNA, 15 nt, Homo sapiens
ugcucacugucacau

SEQ ID NO: 1862819 - RNA, 19 nt, Homo sapiens
ucacagguagacaguauau

SEQ ID NO: 1862820 - RNA, 12 nt, Homo sapiens
gucucaggacag

SEQ ID NO: 1862821 - RNA, 20 nt, Homo sapiens
caucuagaugaggugcuuug

SEQ ID NO: 1862822 - RNA, 19 nt, Homo sapiens
uagcauuuggaaaccacua

SEQ ID NO: 1862823 - RNA, 16 nt, Homo sapiens
cugggagccuacccac

SEQ ID NO: 1862824 - RNA, 20 nt, Homo sapiens
cucuggaugaaggcaaaaac

SEQ ID NO: 1862825 - RNA, 20 nt, Homo sapiens
acggagcacugcaccugccu

SEQ ID NO: 1862826 - RNA, 14 nt, Homo sapiens
ugauacagagggau

SEQ ID NO: 1862827 - RNA, 14 nt, Homo sapiens
agugaaucuguauu

SEQ ID NO: 1862828 - RNA, 15 nt, Homo sapiens
aaaccuuguucuauu

SEQ ID NO: 1862829 - RNA, 15 nt, Homo sapiens
uuacaaggaugaaac

SEQ ID NO: 1862830 - RNA, 15 nt, Homo sapiens
gcccucacugcaggg

SEQ ID NO: 1862831 - RNA, 21 nt, Homo sapiens
acugggaaacuggguuucuca

SEQ ID NO: 1862832 - RNA, 14 nt, Homo sapiens
ugaugaauuacuuc

SEQ ID NO: 1862833 - RNA, 23 nt, Homo sapiens
aaauuaaguguguguauacugua

SEQ ID NO: 1862834 - RNA, 20 nt, Homo sapiens
acuugugccucuugggagac

SEQ ID NO: 1862835 - RNA, 23 nt, Homo sapiens
gccagucuuuacagcugagcaca

SEQ ID NO: 1862836 - RNA, 21 nt, Homo sapiens
cacauaauuuuuguacauccc

SEQ ID NO: 1862837 - RNA, 22 nt, Homo sapiens
ccgcaucguggccuugaccucc

SEQ ID NO: 1862838 - RNA, 20 nt, Homo sapiens
cugguaccgagccccugaac

SEQ ID NO: 1862839 - RNA, 14 nt, Homo sapiens
aaagaccaggccaa

SEQ ID NO: 1862840 - RNA, 22 nt, Homo sapiens
cugguggaggcuucuugcccag

SEQ ID NO: 1862841 - RNA, 19 nt, Homo sapiens
auggaauaucaucugucau

SEQ ID NO: 1862842 - RNA, 21 nt, Homo sapiens
aauccucugggagcuucuucc

SEQ ID NO: 1862843 - RNA, 16 nt, Homo sapiens
agagggcugcugacca

SEQ ID NO: 1862844 - RNA, 19 nt, Homo sapiens
uaaaugagugccacaaaag

SEQ ID NO: 1862845 - RNA, 23 nt, Homo sapiens
ugaaguuaacccugucugagaug

SEQ ID NO: 1862846 - RNA, 15 nt, Homo sapiens
cuucgaggacaggaa

SEQ ID NO: 1862847 - RNA, 22 nt, Homo sapiens
ucugcccugaacccacugcugc

SEQ ID NO: 1862848 - RNA, 12 nt, Homo sapiens
uaaagugcugcg

SEQ ID NO: 1862849 - RNA, 17 nt, Homo sapiens
auuggaacugcaaugaa

SEQ ID NO: 1862850 - RNA, 22 nt, Homo sapiens
guacaguugaugucgaugcuca

SEQ ID NO: 1862851 - RNA, 12 nt, Homo sapiens
cacacacaguga

SEQ ID NO: 1862852 - RNA, 22 nt, Homo sapiens
agccaucgcuuuugacccaaau

SEQ ID NO: 1862853 - RNA, 16 nt, Homo sapiens
cagcaugccugaacua

SEQ ID NO: 1862854 - RNA, 13 nt, Homo sapiens
auugcuagugauu

SEQ ID NO: 1862855 - RNA, 22 nt, Homo sapiens
ccccaauuacagggugacucac

SEQ ID NO: 1862856 - RNA, 19 nt, Homo sapiens
uucuaaggaaugcacaaau

SEQ ID NO: 1862857 - RNA, 16 nt, Homo sapiens
uguuuaagaaaaguau

SEQ ID NO: 1862858 - RNA, 15 nt, Homo sapiens
cccauagauacucuc

SEQ ID NO: 1862859 - RNA, 15 nt, Homo sapiens
ggaggaccagagcua

SEQ ID NO: 1862860 - RNA, 11 nt, Homo sapiens
ugugaccucac

SEQ ID NO: 1862861 - RNA, 16 nt, Homo sapiens
cugcacaaaagcagau

SEQ ID NO: 1862862 - RNA, 18 nt, Homo sapiens
ucaggccucugugccgca

SEQ ID NO: 1862863 - RNA, 17 nt, Homo sapiens
ccuuuagugcuuuguga

SEQ ID NO: 1862864 - RNA, 12 nt, Homo sapiens
aggugagccaag

SEQ ID NO: 1862865 - RNA, 22 nt, Homo sapiens
gacaaaccagaagcaacagaaa

SEQ ID NO: 1862866 - RNA, 13 nt, Homo sapiens
agagauacuguug

SEQ ID NO: 1862867 - RNA, 20 nt, Homo sapiens
ugcacagaaacuugaacucc

SEQ ID NO: 1862868 - RNA, 14 nt, Homo sapiens
caaccaagucacac

SEQ ID NO: 1862869 - RNA, 18 nt, Homo sapiens
aggacccugguuacucug

SEQ ID NO: 1862870 - RNA, 18 nt, Homo sapiens
ucuuaccugggaccucac

SEQ ID NO: 1862871 - RNA, 23 nt, Homo sapiens
acucugcuucauuuuugggagaa

SEQ ID NO: 1862872 - RNA, 24 nt, Homo sapiens
gcauaaaauggaauaacauaucaa

SEQ ID NO: 1862873 - RNA, 22 nt, Homo sapiens
uuacagcccucagcaaugugcc

SEQ ID NO: 1862874 - RNA, 12 nt, Homo sapiens
acugugcauuac

SEQ ID NO: 1862875 - RNA, 18 nt, Homo sapiens
ggcagccacaacugcagu

SEQ ID NO: 1862876 - RNA, 10 nt, Homo sapiens
agucagagac

SEQ ID NO: 1862877 - RNA, 20 nt, Homo sapiens
cacuauaguuuaaaacacau

SEQ ID NO: 1862878 - RNA, 21 nt, Homo sapiens
caaucugccuuugaaucugga

SEQ ID NO: 1862879 - RNA, 12 nt, Homo sapiens
ugcgaaccaccc

SEQ ID NO: 1862880 - RNA, 14 nt, Homo sapiens
gaaaaaaaccaaag

SEQ ID NO: 1862881 - RNA, 15 nt, Homo sapiens
ggauguccucacucu

SEQ ID NO: 1862882 - RNA, 21 nt, Homo sapiens
gaacguaucaauacaguuuau

SEQ ID NO: 1862883 - RNA, 13 nt, Homo sapiens
cugccucugggag

SEQ ID NO: 1862884 - RNA, 13 nt, Homo sapiens
caaagaugcccca

SEQ ID NO: 1862885 - RNA, 17 nt, Homo sapiens
cagaaacugaacuggcc

SEQ ID NO: 1862886 - RNA, 16 nt, Homo sapiens
aggccaacugcccaga

SEQ ID NO: 1862887 - RNA, 14 nt, Homo sapiens
gacccaugugcaag

SEQ ID NO: 1862888 - RNA, 19 nt, Homo sapiens
ggacaugcuuuucugccac

SEQ ID NO: 1862889 - RNA, 15 nt, Homo sapiens
aauaugauuacuuua

SEQ ID NO: 1862890 - RNA, 20 nt, Homo sapiens
aagauucuauaguucuagac

SEQ ID NO: 1862891 - RNA, 20 nt, Homo sapiens
gguccugaguggcugaaaua

SEQ ID NO: 1862892 - RNA, 20 nt, Homo sapiens
uaguguaccauucucaggug

SEQ ID NO: 1862893 - RNA, 15 nt, Homo sapiens
gaccaucaugcccuc

SEQ ID NO: 1862894 - RNA, 22 nt, Homo sapiens
auuugggauauguuacauuaga

SEQ ID NO: 1862895 - RNA, 23 nt, Homo sapiens
ccacuuuccccgugggccauggc

SEQ ID NO: 1862896 - RNA, 16 nt, Homo sapiens
cuguuggggacagugc

SEQ ID NO: 1862897 - RNA, 12 nt, Homo sapiens
cuuuacauauau

SEQ ID NO: 1862898 - RNA, 13 nt, Homo sapiens
cucuauuguaucc

SEQ ID NO: 1862899 - RNA, 20 nt, Homo sapiens
uugaaguauauucaaccaaa

SEQ ID NO: 1862900 - RNA, 14 nt, Homo sapiens
uugaucucugcuua

SEQ ID NO: 1862901 - RNA, 19 nt, Homo sapiens
augggcacaugaggagggu

SEQ ID NO: 1862902 - RNA, 15 nt, Homo sapiens
acacggccagcaccg

SEQ ID NO: 1862903 - RNA, 22 nt, Homo sapiens
aggugugugggccaccgugccu

SEQ ID NO: 1862904 - RNA, 17 nt, Homo sapiens
ccacaacccuguugcua

SEQ ID NO: 1862905 - RNA, 22 nt, Homo sapiens
acuguguguuuucccaaagcac

SEQ ID NO: 1862906 - RNA, 18 nt, Homo sapiens
cucuuaaugucucaaaau

SEQ ID NO: 1862907 - RNA, 11 nt, Homo sapiens
augcacugagg

SEQ ID NO: 1862908 - RNA, 11 nt, Homo sapiens
uugcacugugg

SEQ ID NO: 1862909 - RNA, 19 nt, Homo sapiens
agcaguagcgcuggcgcca

SEQ ID NO: 1862910 - RNA, 17 nt, Homo sapiens
augcuguggguuuccaa

SEQ ID NO: 1862911 - RNA, 23 nt, Homo sapiens
uaagugcacaccgugugccauag

SEQ ID NO: 1862912 - RNA, 14 nt, Homo sapiens
agagaauauacaug

SEQ ID NO: 1862913 - RNA, 23 nt, Homo sapiens
gauuuggcaggaucggcuuccuc

SEQ ID NO: 1862914 - RNA, 21 nt, Homo sapiens
aaggaggggguucuuccucac

SEQ ID NO: 1862915 - RNA, 21 nt, Homo sapiens
auugucugcccagcaaucaaa

SEQ ID NO: 1862916 - RNA, 16 nt, Homo sapiens
acaaugcaacuuuuaa

SEQ ID NO: 1862917 - RNA, 20 nt, Homo sapiens
gggaaguugucuccuuccau

SEQ ID NO: 1862918 - RNA, 15 nt, Homo sapiens
acucagaaaauuccc

SEQ ID NO: 1862919 - RNA, 18 nt, Homo sapiens
aaguuccaaaagcacaga

SEQ ID NO: 1862920 - RNA, 16 nt, Homo sapiens
acccuacacccagacc

SEQ ID NO: 1862921 - RNA, 21 nt, Homo sapiens
uauauguguauauauacauac

SEQ ID NO: 1862922 - RNA, 22 nt, Homo sapiens
cugugcuaccucuaacaccaca

SEQ ID NO: 1862923 - RNA, 18 nt, Homo sapiens
auuguuguugccaaagag

SEQ ID NO: 1862924 - RNA, 22 nt, Homo sapiens
guucacaguagaguaggguaga

SEQ ID NO: 1862925 - RNA, 13 nt, Homo sapiens
cacagcugcauua

SEQ ID NO: 1862926 - RNA, 19 nt, Homo sapiens
gaucuccaaggaccagguu

SEQ ID NO: 1862927 - RNA, 19 nt, Homo sapiens
gucagagagggaagcugag

SEQ ID NO: 1862928 - RNA, 13 nt, Homo sapiens
acuaaugaccaca

SEQ ID NO: 1862929 - RNA, 18 nt, Homo sapiens
ccuauauugcauuaauuu

SEQ ID NO: 1862930 - RNA, 13 nt, Homo sapiens
uagcaaacacugg

SEQ ID NO: 1862931 - RNA, 24 nt, Homo sapiens
caucuuauuugucaguguagauca

SEQ ID NO: 1862932 - RNA, 14 nt, Homo sapiens
uaaauacugcugua

SEQ ID NO: 1862933 - RNA, 20 nt, Homo sapiens
auaacuuuuuaaagugacau

SEQ ID NO: 1862934 - RNA, 17 nt, Homo sapiens
uuuccugcugguuucuu

SEQ ID NO: 1862935 - RNA, 16 nt, Homo sapiens
acagcaauuguagaca

SEQ ID NO: 1862936 - RNA, 12 nt, Homo sapiens
accaaagcagaa

SEQ ID NO: 1862937 - RNA, 22 nt, Homo sapiens
gccacccugugggccgggcaau

SEQ ID NO: 1862938 - RNA, 15 nt, Homo sapiens
ccugcccuacauauc

SEQ ID NO: 1862939 - RNA, 15 nt, Homo sapiens
gcacauguacccuaa

SEQ ID NO: 1862940 - RNA, 17 nt, Homo sapiens
cauugcagucacuuuga

SEQ ID NO: 1862941 - RNA, 22 nt, Homo sapiens
ggccuguccaccugugcugcug

SEQ ID NO: 1862942 - RNA, 14 nt, Homo sapiens
uuuauucaacaacu

SEQ ID NO: 1862943 - RNA, 12 nt, Homo sapiens
cagcaucugacc

SEQ ID NO: 1862944 - RNA, 16 nt, Homo sapiens
gggagaguccuuagcc

SEQ ID NO: 1862945 - RNA, 13 nt, Homo sapiens
gcucuucacugaa

SEQ ID NO: 1862946 - RNA, 20 nt, Homo sapiens
cacuucaucuucucagcucc

SEQ ID NO: 1862947 - RNA, 18 nt, Homo sapiens
accgcuucucagccacaa

SEQ ID NO: 1862948 - RNA, 14 nt, Homo sapiens
accaggucagggag

SEQ ID NO: 1862949 - RNA, 23 nt, Homo sapiens
uucacacaacaccucacuuuuga

SEQ ID NO: 1862950 - RNA, 19 nt, Homo sapiens
cgcccggccucagugccuu

SEQ ID NO: 1862951 - RNA, 23 nt, Homo sapiens
cagauggacuucuucaguguccu

SEQ ID NO: 1862952 - RNA, 12 nt, Homo sapiens
agccuaccuuca

SEQ ID NO: 1862953 - RNA, 22 nt, Homo sapiens
ccauccugcccuucugacccaa

SEQ ID NO: 1862954 - RNA, 23 nt, Homo sapiens
cgauuucucucucucccccucag

SEQ ID NO: 1862955 - RNA, 15 nt, Homo sapiens
aauuuaauacauuua

SEQ ID NO: 1862956 - RNA, 15 nt, Homo sapiens
acuuuuauaaauuaa

SEQ ID NO: 1862957 - RNA, 12 nt, Homo sapiens
gcuaccugaugg

SEQ ID NO: 1862958 - RNA, 20 nt, Homo sapiens
aaagaaauccauaucuuaaa

SEQ ID NO: 1862959 - RNA, 12 nt, Homo sapiens
guggguaaucca

SEQ ID NO: 1862960 - RNA, 17 nt, Homo sapiens
gaauguauuaguacaaa

SEQ ID NO: 1862961 - RNA, 15 nt, Homo sapiens
uuuucagauccugaa

SEQ ID NO: 1862962 - RNA, 13 nt, Homo sapiens
gaauauaauuuca

SEQ ID NO: 1862963 - RNA, 13 nt, Homo sapiens
agaauauaaucuu

SEQ ID NO: 1862964 - RNA, 21 nt, Homo sapiens
ugcgacgcagguguaccuccc

SEQ ID NO: 1862965 - RNA, 21 nt, Homo sapiens
gcaauaaaagauaagugcagu

SEQ ID NO: 1862966 - RNA, 14 nt, Homo sapiens
guguucaugcgaau

SEQ ID NO: 1862967 - RNA, 23 nt, Homo sapiens
cucugcaaugggcacugggauga

SEQ ID NO: 1862968 - RNA, 21 nt, Homo sapiens
uuuuguaaauauucuugucca

SEQ ID NO: 1862969 - RNA, 19 nt, Homo sapiens
gaaaauuuuuaaauauuca

SEQ ID NO: 1862970 - RNA, 19 nt, Homo sapiens
uaaugauuguuugucaaua

SEQ ID NO: 1862971 - RNA, 22 nt, Homo sapiens
uuaagaguuagguuuaacauaa

SEQ ID NO: 1862972 - RNA, 19 nt, Homo sapiens
cuguagucccagcuacucg

SEQ ID NO: 1862973 - RNA, 22 nt, Homo sapiens
gacucagcuggaagucuaccug

SEQ ID NO: 1862974 - RNA, 18 nt, Homo sapiens
ggcccagcauaauuccuc

SEQ ID NO: 1862975 - RNA, 21 nt, Homo sapiens
caucacuggggaggacgugau

SEQ ID NO: 1862976 - RNA, 19 nt, Homo sapiens
uggucuaccaaucugggaa

SEQ ID NO: 1862977 - RNA, 17 nt, Homo sapiens
uaccacacauauugcac

SEQ ID NO: 1862978 - RNA, 20 nt, Homo sapiens
agagucuugcucuguugccc

SEQ ID NO: 1862979 - RNA, 16 nt, Homo sapiens
agaaaauguaaaggag

SEQ ID NO: 1862980 - RNA, 20 nt, Homo sapiens
augauggcagccauagugca

SEQ ID NO: 1862981 - RNA, 19 nt, Homo sapiens
ucuuugauuuaacugacuu

SEQ ID NO: 1862982 - RNA, 13 nt, Homo sapiens
uugugcagugugc

SEQ ID NO: 1862983 - RNA, 18 nt, Homo sapiens
ugaucuauuacucugaca

SEQ ID NO: 1862984 - RNA, 14 nt, Homo sapiens
cagggaaugcugag

SEQ ID NO: 1862985 - RNA, 21 nt, Homo sapiens
ugaccacgcccccagcuguga

SEQ ID NO: 1862986 - RNA, 23 nt, Homo sapiens
aacauggugaaaccucaucucua

SEQ ID NO: 1862987 - RNA, 13 nt, Homo sapiens
cucacgccacaaa

SEQ ID NO: 1862988 - RNA, 21 nt, Homo sapiens
gggaggcagagguugugguga

SEQ ID NO: 1862989 - RNA, 16 nt, Homo sapiens
ugauuauauucacaga

SEQ ID NO: 1862990 - RNA, 14 nt, Homo sapiens
ugccuauuuaugaa

SEQ ID NO: 1862991 - RNA, 13 nt, Homo sapiens
acagagugcuaau

SEQ ID NO: 1862992 - RNA, 15 nt, Homo sapiens
uuaucuugacauuca

SEQ ID NO: 1862993 - RNA, 12 nt, Homo sapiens
uaugcaaaucag

SEQ ID NO: 1862994 - RNA, 18 nt, Homo sapiens
aucaaguguguguguguu

SEQ ID NO: 1862995 - RNA, 18 nt, Homo sapiens
cuguccaaccagacuuug

SEQ ID NO: 1862996 - RNA, 14 nt, Homo sapiens
cuagauacagaaua

SEQ ID NO: 1862997 - RNA, 16 nt, Homo sapiens
uuaaaguucuagugac

SEQ ID NO: 1862998 - RNA, 19 nt, Homo sapiens
ugcucaauaaaguacaaga

SEQ ID NO: 1862999 - RNA, 14 nt, Homo sapiens
uuggguuuucucca

SEQ ID NO: 1863000 - RNA, 15 nt, Homo sapiens
gcuaauucaauuuau

SEQ ID NO: 1863001 - RNA, 15 nt, Homo sapiens
uuugugcagcacagu

SEQ ID NO: 1863002 - RNA, 21 nt, Homo sapiens
ucuaaacaagaaucagucuau

SEQ ID NO: 1863003 - RNA, 15 nt, Homo sapiens
gauacacagauauau

SEQ ID NO: 1863004 - RNA, 16 nt, Homo sapiens
gacacacuaaacucug

SEQ ID NO: 1863005 - RNA, 22 nt, Homo sapiens
cggacuccucucguacuugaac

SEQ ID NO: 1863006 - RNA, 22 nt, Homo sapiens
uggugccuucucacaucugucc

SEQ ID NO: 1863007 - RNA, 13 nt, Homo sapiens
ugaugaugucucu

SEQ ID NO: 1863008 - RNA, 16 nt, Homo sapiens
ggacugguccaggcau

SEQ ID NO: 1863009 - RNA, 21 nt, Homo sapiens
ucaaaacccaacaugacuguu

SEQ ID NO: 1863010 - RNA, 22 nt, Homo sapiens
guaaagcauuccaacaaagggu

SEQ ID NO: 1863011 - RNA, 21 nt, Homo sapiens
aacuuuagcaacaguuaucac

SEQ ID NO: 1863012 - RNA, 19 nt, Homo sapiens
uguuuaaaaauugaaaaaa

SEQ ID NO: 1863013 - RNA, 17 nt, Homo sapiens
cugcuagggaccucgcc

SEQ ID NO: 1863014 - RNA, 14 nt, Homo sapiens
cgacucugaccucu

SEQ ID NO: 1863015 - RNA, 13 nt, Homo sapiens
guaauuauguaac

SEQ ID NO: 1863016 - RNA, 15 nt, Homo sapiens
agguuucaccaugau

SEQ ID NO: 1863017 - RNA, 20 nt, Homo sapiens
accuuccagagaacacaggg

SEQ ID NO: 1863018 - RNA, 22 nt, Homo sapiens
uuguaaaauaaaaccaccaaag

SEQ ID NO: 1863019 - RNA, 12 nt, Homo sapiens
ggugcucacucc

SEQ ID NO: 1863020 - RNA, 21 nt, Homo sapiens
cuacugauuuuaaaaugaaua

SEQ ID NO: 1863021 - RNA, 13 nt, Homo sapiens
uacccaugaccug

SEQ ID NO: 1863022 - RNA, 20 nt, Homo sapiens
aaggcuuuguauaaucccac

SEQ ID NO: 1863023 - RNA, 19 nt, Homo sapiens
guauucccaccccuggacu

SEQ ID NO: 1863024 - RNA, 20 nt, Homo sapiens
ucucuggaaaggggggagcu

SEQ ID NO: 1863025 - RNA, 17 nt, Homo sapiens
caggaguaaguuucuca

SEQ ID NO: 1863026 - RNA, 20 nt, Homo sapiens
ggccuagggguccacgggaa

SEQ ID NO: 1863027 - RNA, 15 nt, Homo sapiens
gccacauauugagau

SEQ ID NO: 1863028 - RNA, 15 nt, Homo sapiens
uuguguuagccucuu

SEQ ID NO: 1863029 - RNA, 13 nt, Homo sapiens
aaaauacaugaca

SEQ ID NO: 1863030 - RNA, 16 nt, Homo sapiens
gaaggaagaagccaga

SEQ ID NO: 1863031 - RNA, 13 nt, Homo sapiens
cagaaauacauau

SEQ ID NO: 1863032 - RNA, 17 nt, Homo sapiens
auuuccugcugaaaaua

SEQ ID NO: 1863033 - RNA, 23 nt, Homo sapiens
ccaugaggccuuuccccagugug

SEQ ID NO: 1863034 - RNA, 22 nt, Homo sapiens
gaaguaguucuguuuggugugu

SEQ ID NO: 1863035 - RNA, 15 nt, Homo sapiens
agugauuccaucaaa

SEQ ID NO: 1863036 - RNA, 19 nt, Homo sapiens
aauuauaaguaacuuguca

SEQ ID NO: 1863037 - RNA, 16 nt, Homo sapiens
aacaacucgaaucacu

SEQ ID NO: 1863038 - RNA, 23 nt, Homo sapiens
gucucagaaacugcgaggccagu

SEQ ID NO: 1863039 - RNA, 14 nt, Homo sapiens
cucccaauacaggc

SEQ ID NO: 1863040 - RNA, 18 nt, Homo sapiens
aggaaucugugcagauga

SEQ ID NO: 1863041 - RNA, 14 nt, Homo sapiens
uaguugacuaauga

SEQ ID NO: 1863042 - RNA, 12 nt, Homo sapiens
agaacuggguaa

SEQ ID NO: 1863043 - RNA, 12 nt, Homo sapiens
cuuaaaucaaaa

SEQ ID NO: 1863044 - RNA, 21 nt, Homo sapiens
caaaauuuuguuucacauuca

SEQ ID NO: 1863045 - RNA, 23 nt, Homo sapiens
ucauuaauucaauuaaaaccauu

SEQ ID NO: 1863046 - RNA, 17 nt, Homo sapiens
cagaaaacaacaaaaga

SEQ ID NO: 1863047 - RNA, 16 nt, Homo sapiens
uugugaugaacauauu

SEQ ID NO: 1863048 - RNA, 13 nt, Homo sapiens
aucacaguacuuu

SEQ ID NO: 1863049 - RNA, 19 nt, Homo sapiens
cugggggaccugggguucu

SEQ ID NO: 1863050 - RNA, 20 nt, Homo sapiens
gugcccuuggaggccagcca

SEQ ID NO: 1863051 - RNA, 20 nt, Homo sapiens
uccuugucuuguaauugugg

SEQ ID NO: 1863052 - RNA, 13 nt, Homo sapiens
auugcuggcugcc

SEQ ID NO: 1863053 - RNA, 18 nt, Homo sapiens
cacuugccaauguacaua

SEQ ID NO: 1863054 - RNA, 20 nt, Homo sapiens
aaucuuuuugauaagcacau

SEQ ID NO: 1863055 - RNA, 17 nt, Homo sapiens
aauauuugcacauggga

SEQ ID NO: 1863056 - RNA, 17 nt, Homo sapiens
uuccuuuccuucuggcu

SEQ ID NO: 1863057 - RNA, 19 nt, Homo sapiens
ucugaaucaagcacacugu

SEQ ID NO: 1863058 - RNA, 18 nt, Homo sapiens
caugguuaccugaccuaa

SEQ ID NO: 1863059 - RNA, 18 nt, Homo sapiens
gcaucccggaggaaaucu

SEQ ID NO: 1863060 - RNA, 17 nt, Homo sapiens
cacgccugcaggcugga

SEQ ID NO: 1863061 - RNA, 15 nt, Homo sapiens
cgacaacuugcacgu

SEQ ID NO: 1863062 - RNA, 20 nt, Homo sapiens
uaguauuuucuacuagccau

SEQ ID NO: 1863063 - RNA, 22 nt, Homo sapiens
cauuaggggguuuguugcacag

SEQ ID NO: 1863064 - RNA, 16 nt, Homo sapiens
gaaucagauuuuaaca

SEQ ID NO: 1863065 - RNA, 16 nt, Homo sapiens
agguuugccagcauuu

SEQ ID NO: 1863066 - RNA, 13 nt, Homo sapiens
ucucaaaauaucc

SEQ ID NO: 1863067 - RNA, 22 nt, Homo sapiens
gccaguauaaagggacuugaag

SEQ ID NO: 1863068 - RNA, 13 nt, Homo sapiens
acuggaugggaga

SEQ ID NO: 1863069 - RNA, 13 nt, Homo sapiens
ccugguuccacau

SEQ ID NO: 1863070 - RNA, 17 nt, Homo sapiens
gaagccccaacugugau

SEQ ID NO: 1863071 - RNA, 18 nt, Homo sapiens
caguuauuuauuuccaaa

SEQ ID NO: 1863072 - RNA, 19 nt, Homo sapiens
uccauuucuacaaugcaca

SEQ ID NO: 1863073 - RNA, 14 nt, Homo sapiens
auuuacacugacug

SEQ ID NO: 1863074 - RNA, 15 nt, Homo sapiens
uggcuuuuugucaaa

SEQ ID NO: 1863075 - RNA, 13 nt, Homo sapiens
cauucuagguagg

SEQ ID NO: 1863076 - RNA, 21 nt, Homo sapiens
agugauggcuuaugauagcaa

SEQ ID NO: 1863077 - RNA, 22 nt, Homo sapiens
aagugaugauuguaagucccau

SEQ ID NO: 1863078 - RNA, 14 nt, Homo sapiens
caucuagcuccaua

SEQ ID NO: 1863079 - RNA, 22 nt, Homo sapiens
acggcagcugcuggcugugaca

SEQ ID NO: 1863080 - RNA, 19 nt, Homo sapiens
gcacacacacacaucucau

SEQ ID NO: 1863081 - RNA, 13 nt, Homo sapiens
ugguaugagacag

SEQ ID NO: 1863082 - RNA, 22 nt, Homo sapiens
gcaauggguuuauagacauuau

SEQ ID NO: 1863083 - RNA, 19 nt, Homo sapiens
cuuuuagcaugugaaguuu

SEQ ID NO: 1863084 - RNA, 23 nt, Homo sapiens
uugcccuaauuaaaaacugugau

SEQ ID NO: 1863085 - RNA, 20 nt, Homo sapiens
accucuuuucauggaguaga

SEQ ID NO: 1863086 - RNA, 13 nt, Homo sapiens
aagucccaucuca

SEQ ID NO: 1863087 - RNA, 22 nt, Homo sapiens
ccauacuguuugcccauuuuca

SEQ ID NO: 1863088 - RNA, 15 nt, Homo sapiens
gccagcugcacugau

SEQ ID NO: 1863089 - RNA, 15 nt, Homo sapiens
gcuaucugcauuuau

SEQ ID NO: 1863090 - RNA, 16 nt, Homo sapiens
agcuuaaaacaagcaa

SEQ ID NO: 1863091 - RNA, 21 nt, Homo sapiens
agcuggaggaacauugggaag

SEQ ID NO: 1863092 - RNA, 18 nt, Homo sapiens
aucaguugguuuggauuu

SEQ ID NO: 1863093 - RNA, 19 nt, Homo sapiens
caaccaccauucagucaag

SEQ ID NO: 1863094 - RNA, 16 nt, Homo sapiens
uaaagccaaauuucca

SEQ ID NO: 1863095 - RNA, 22 nt, Homo sapiens
gguggcccuaaaggacucucca

SEQ ID NO: 1863096 - RNA, 20 nt, Homo sapiens
aaaaagaugaggacucagaa

SEQ ID NO: 1863097 - RNA, 12 nt, Homo sapiens
augaacauccaa

SEQ ID NO: 1863098 - RNA, 12 nt, Homo sapiens
cuguacauacau

SEQ ID NO: 1863099 - RNA, 15 nt, Homo sapiens
gaacacauaccuuug

SEQ ID NO: 1863100 - RNA, 13 nt, Homo sapiens
aaaaacugcucau

SEQ ID NO: 1863101 - RNA, 22 nt, Homo sapiens
uaauauauguauaugcaauaua

SEQ ID NO: 1863102 - RNA, 16 nt, Homo sapiens
gggcucaggccaucca

SEQ ID NO: 1863103 - RNA, 23 nt, Homo sapiens
gccuuugcuccucccauguuaug

SEQ ID NO: 1863104 - RNA, 21 nt, Homo sapiens
gccgagauagccaaggccaaa

SEQ ID NO: 1863105 - RNA, 14 nt, Homo sapiens
aacacaagcaaaac

SEQ ID NO: 1863106 - RNA, 20 nt, Homo sapiens
cucagaauccaaagaucaca

SEQ ID NO: 1863107 - RNA, 22 nt, Homo sapiens
ccaaaugaucuggugguuauuu

SEQ ID NO: 1863108 - RNA, 22 nt, Homo sapiens
caaaugcaugauauuguaugua

SEQ ID NO: 1863109 - RNA, 18 nt, Homo sapiens
agucugaaugcugccaca

SEQ ID NO: 1863110 - RNA, 20 nt, Homo sapiens
gaaaauuguugggaggacag

SEQ ID NO: 1863111 - RNA, 17 nt, Homo sapiens
agucgagauugcacugc

SEQ ID NO: 1863112 - RNA, 21 nt, Homo sapiens
ggcuuucucccucacccaagu

SEQ ID NO: 1863113 - RNA, 14 nt, Homo sapiens
acaaauaaauaaga

SEQ ID NO: 1863114 - RNA, 22 nt, Homo sapiens
auguaauuuagcaguccaaaga

SEQ ID NO: 1863115 - RNA, 20 nt, Homo sapiens
ucuucauuaccucagugaga

SEQ ID NO: 1863116 - RNA, 23 nt, Homo sapiens
guagaaaaagcaguaacugacaa

SEQ ID NO: 1863117 - RNA, 12 nt, Homo sapiens
uccuccaucacc

SEQ ID NO: 1863118 - RNA, 15 nt, Homo sapiens
uuuaaaucugugaug

SEQ ID NO: 1863119 - RNA, 13 nt, Homo sapiens
acuggugugcucu

SEQ ID NO: 1863120 - RNA, 14 nt, Homo sapiens
auuuuuaauggaaa

SEQ ID NO: 1863121 - RNA, 14 nt, Homo sapiens
gaagucuacuuuag

SEQ ID NO: 1863122 - RNA, 18 nt, Homo sapiens
cacuuuuuaaaaucucaa

SEQ ID NO: 1863123 - RNA, 16 nt, Homo sapiens
gcaccguucugugcac

SEQ ID NO: 1863124 - RNA, 15 nt, Homo sapiens
uguauuuugugccac

SEQ ID NO: 1863125 - RNA, 14 nt, Homo sapiens
caccucacagccag

SEQ ID NO: 1863126 - RNA, 20 nt, Homo sapiens
agauguugagaauguucauc

SEQ ID NO: 1863127 - RNA, 16 nt, Homo sapiens
gcauuuggcacugaga

SEQ ID NO: 1863128 - RNA, 12 nt, Homo sapiens
augcacauguaa

SEQ ID NO: 1863129 - RNA, 15 nt, Homo sapiens
aaggaagaagccaga

SEQ ID NO: 1863130 - RNA, 16 nt, Homo sapiens
auuuauacaggucaua

SEQ ID NO: 1863131 - RNA, 23 nt, Homo sapiens
ugccucacuucagguauaccuca

SEQ ID NO: 1863132 - RNA, 19 nt, Homo sapiens
ugggggacccaucuuccac

SEQ ID NO: 1863133 - RNA, 18 nt, Homo sapiens
caugccagacccacugaa

SEQ ID NO: 1863134 - RNA, 16 nt, Homo sapiens
ccagucuggaagaaga

SEQ ID NO: 1863135 - RNA, 20 nt, Homo sapiens
aauuggccucuguaugcagu

SEQ ID NO: 1863136 - RNA, 23 nt, Homo sapiens
ccuaagccaugggagacacugau

SEQ ID NO: 1863137 - RNA, 18 nt, Homo sapiens
cccuugcugaacacacac

SEQ ID NO: 1863138 - RNA, 19 nt, Homo sapiens
guagccuuagagcaucucu

SEQ ID NO: 1863139 - RNA, 19 nt, Homo sapiens
caauaaaaccaagugcuua

SEQ ID NO: 1863140 - RNA, 19 nt, Homo sapiens
ggcaagaaugaaauacucu

SEQ ID NO: 1863141 - RNA, 14 nt, Homo sapiens
auucuuuaucacau

SEQ ID NO: 1863142 - RNA, 13 nt, Homo sapiens
aaucacaugugcu

SEQ ID NO: 1863143 - RNA, 15 nt, Homo sapiens
aucacuuggagccag

SEQ ID NO: 1863144 - RNA, 22 nt, Homo sapiens
ccuugcagggugggugagcucu

SEQ ID NO: 1863145 - RNA, 21 nt, Homo sapiens
agcgguuguaaauacaauuca

SEQ ID NO: 1863146 - RNA, 14 nt, Homo sapiens
uugcugacagguga

SEQ ID NO: 1863147 - RNA, 21 nt, Homo sapiens
cuucagccuagccgaccucag

SEQ ID NO: 1863148 - RNA, 20 nt, Homo sapiens
auaaauggcccggacauguc

SEQ ID NO: 1863149 - RNA, 17 nt, Homo sapiens
cccucaacuaccauuau

SEQ ID NO: 1863150 - RNA, 14 nt, Homo sapiens
aguggaaaacaaag

SEQ ID NO: 1863151 - RNA, 12 nt, Homo sapiens
ugucucaaaaaa

SEQ ID NO: 1863152 - RNA, 14 nt, Homo sapiens
ugaauaaaacaaua

SEQ ID NO: 1863153 - RNA, 15 nt, Homo sapiens
cuguuccuuguguaa

SEQ ID NO: 1863154 - RNA, 15 nt, Homo sapiens
cuguacauugugaac

SEQ ID NO: 1863155 - RNA, 24 nt, Homo sapiens
aaguaagccuuuuugucaccucaa

SEQ ID NO: 1863156 - RNA, 17 nt, Homo sapiens
ugucccucacugccuuc

SEQ ID NO: 1863157 - RNA, 20 nt, Homo sapiens
gagcaaagacguggggcccc

SEQ ID NO: 1863158 - RNA, 17 nt, Homo sapiens
uuuaaauucucagucau

SEQ ID NO: 1863159 - RNA, 16 nt, Homo sapiens
auuuaacuuguuucca

SEQ ID NO: 1863160 - RNA, 20 nt, Homo sapiens
ugcuguuuuaaauugcauuu

SEQ ID NO: 1863161 - RNA, 14 nt, Homo sapiens
aauugcacauaguu

SEQ ID NO: 1863162 - RNA, 22 nt, Homo sapiens
caauucguuggauuuuuguuua

SEQ ID NO: 1863163 - RNA, 14 nt, Homo sapiens
uaauaagcacuugc

SEQ ID NO: 1863164 - RNA, 19 nt, Homo sapiens
ugggaggcgggaguggagu

SEQ ID NO: 1863165 - RNA, 19 nt, Homo sapiens
aaucugauguauaauguaa

SEQ ID NO: 1863166 - RNA, 15 nt, Homo sapiens
aaugucagggccagg

SEQ ID NO: 1863167 - RNA, 13 nt, Homo sapiens
cuucuucauugca

SEQ ID NO: 1863168 - RNA, 19 nt, Homo sapiens
gcugaguuccggggugcaa

SEQ ID NO: 1863169 - RNA, 13 nt, Homo sapiens
caccacuuccucu

SEQ ID NO: 1863170 - RNA, 20 nt, Homo sapiens
ugggcucugaugcagaacuu

SEQ ID NO: 1863171 - RNA, 17 nt, Homo sapiens
uaugaauacauuucuac

SEQ ID NO: 1863172 - RNA, 23 nt, Homo sapiens
uucagucaaagauacacaaucug

SEQ ID NO: 1863173 - RNA, 17 nt, Homo sapiens
ccggugcggugcacugg

SEQ ID NO: 1863174 - RNA, 17 nt, Homo sapiens
ggugaaacaaaauccaa

SEQ ID NO: 1863175 - RNA, 23 nt, Homo sapiens
aggggugcggcggucccagcucc

SEQ ID NO: 1863176 - RNA, 16 nt, Homo sapiens
guuuugucaaacugua

SEQ ID NO: 1863177 - RNA, 20 nt, Homo sapiens
cugcaggcguucucucucua

SEQ ID NO: 1863178 - RNA, 20 nt, Homo sapiens
ucaucaaaaacacuacuccu

SEQ ID NO: 1863179 - RNA, 23 nt, Homo sapiens
acucagauugagcccuacauugu

SEQ ID NO: 1863180 - RNA, 20 nt, Homo sapiens
guucucccccugaaugugua

SEQ ID NO: 1863181 - RNA, 18 nt, Homo sapiens
ccuggaaagaggcagucu

SEQ ID NO: 1863182 - RNA, 16 nt, Homo sapiens
augggucaugacaaga

SEQ ID NO: 1863183 - RNA, 19 nt, Homo sapiens
gaguuaacaggacaguuga

SEQ ID NO: 1863184 - RNA, 22 nt, Homo sapiens
auggccuggcugcugcugugca

SEQ ID NO: 1863185 - RNA, 19 nt, Homo sapiens
gcccaggaccaucauccua

SEQ ID NO: 1863186 - RNA, 21 nt, Homo sapiens
agacucugguauggccaaaga

SEQ ID NO: 1863187 - RNA, 15 nt, Homo sapiens
aaaguauagagaaaa

SEQ ID NO: 1863188 - RNA, 12 nt, Homo sapiens
cauuguauccuc

SEQ ID NO: 1863189 - RNA, 18 nt, Homo sapiens
aacucuccccagugccug

SEQ ID NO: 1863190 - RNA, 15 nt, Homo sapiens
auguuucuacagaua

SEQ ID NO: 1863191 - RNA, 23 nt, Homo sapiens
uucauguguauggaauauauucu

SEQ ID NO: 1863192 - RNA, 11 nt, Homo sapiens
cauugucuccc

SEQ ID NO: 1863193 - RNA, 16 nt, Homo sapiens
ggccgugagggguccc

SEQ ID NO: 1863194 - RNA, 20 nt, Homo sapiens
caccuaugccagugcucaag

SEQ ID NO: 1863195 - RNA, 19 nt, Homo sapiens
uaagaccaccuucccuucc

SEQ ID NO: 1863196 - RNA, 23 nt, Homo sapiens
ugagucaaaagccugggugagaa

SEQ ID NO: 1863197 - RNA, 16 nt, Homo sapiens
guuuuguaugagcgaa

SEQ ID NO: 1863198 - RNA, 16 nt, Homo sapiens
accaaaguuaguucag

SEQ ID NO: 1863199 - RNA, 13 nt, Homo sapiens
caacauccugcca

SEQ ID NO: 1863200 - RNA, 18 nt, Homo sapiens
ggugccgcugucucugag

SEQ ID NO: 1863201 - RNA, 18 nt, Homo sapiens
acugucuauguugugauc

SEQ ID NO: 1863202 - RNA, 12 nt, Homo sapiens
ccaaggugggca

SEQ ID NO: 1863203 - RNA, 14 nt, Homo sapiens
cuacugccauuuca

SEQ ID NO: 1863204 - RNA, 20 nt, Homo sapiens
acugugcagacccaguccca

SEQ ID NO: 1863205 - RNA, 19 nt, Homo sapiens
ugagcuuuccauguugcug

SEQ ID NO: 1863206 - RNA, 22 nt, Homo sapiens
uuguuugaaaaagcagacagaa

SEQ ID NO: 1863207 - RNA, 17 nt, Homo sapiens
agacaucucuggagcca

SEQ ID NO: 1863208 - RNA, 22 nt, Homo sapiens
auacauuuggcuccacuguaaa

SEQ ID NO: 1863209 - RNA, 14 nt, Homo sapiens
cccaguccaagacc

SEQ ID NO: 1863210 - RNA, 16 nt, Homo sapiens
guuauauccaauagua

SEQ ID NO: 1863211 - RNA, 13 nt, Homo sapiens
cuccaaaagcacu

SEQ ID NO: 1863212 - RNA, 19 nt, Homo sapiens
gaaaauagaaacuugcuua

SEQ ID NO: 1863213 - RNA, 18 nt, Homo sapiens
cugacagagccauaugua

SEQ ID NO: 1863214 - RNA, 13 nt, Homo sapiens
uccuggcugauca

SEQ ID NO: 1863215 - RNA, 11 nt, Homo sapiens
cacuccagugc

SEQ ID NO: 1863216 - RNA, 22 nt, Homo sapiens
ugcaagccccucuuucuguccc

SEQ ID NO: 1863217 - RNA, 14 nt, Homo sapiens
auucaaaguauuuu

SEQ ID NO: 1863218 - RNA, 19 nt, Homo sapiens
auuucaggaagacugacag

SEQ ID NO: 1863219 - RNA, 23 nt, Homo sapiens
cuguacaaugacuuuauugcauc

SEQ ID NO: 1863220 - RNA, 14 nt, Homo sapiens
cacccacaacaucu

SEQ ID NO: 1863221 - RNA, 18 nt, Homo sapiens
gaaacacugggcuucuag

SEQ ID NO: 1863222 - RNA, 13 nt, Homo sapiens
ucuauuuaccucc

SEQ ID NO: 1863223 - RNA, 18 nt, Homo sapiens
aaaacagagaaagcagaa

SEQ ID NO: 1863224 - RNA, 17 nt, Homo sapiens
gaggcgagccuggccaa

SEQ ID NO: 1863225 - RNA, 19 nt, Homo sapiens
ugugacccuugucaucucu

SEQ ID NO: 1863226 - RNA, 16 nt, Homo sapiens
agaggggccugggaaa

SEQ ID NO: 1863227 - RNA, 18 nt, Homo sapiens
caucugacucacaagaag

SEQ ID NO: 1863228 - RNA, 13 nt, Homo sapiens
uuguccaggaaag

SEQ ID NO: 1863229 - RNA, 14 nt, Homo sapiens
ucacaccaacagug

SEQ ID NO: 1863230 - RNA, 18 nt, Homo sapiens
gcuucaaggacaccugcc

SEQ ID NO: 1863231 - RNA, 18 nt, Homo sapiens
aacaggccuugagcacaa

SEQ ID NO: 1863232 - RNA, 13 nt, Homo sapiens
cggcuugaucaca

SEQ ID NO: 1863233 - RNA, 16 nt, Homo sapiens
ugggcagaucacuuga

SEQ ID NO: 1863234 - RNA, 22 nt, Homo sapiens
aacccacuagaagcaacuagga

SEQ ID NO: 1863235 - RNA, 15 nt, Homo sapiens
ucaccucuuccacuc

SEQ ID NO: 1863236 - RNA, 15 nt, Homo sapiens
ggacugcuggcaugc

SEQ ID NO: 1863237 - RNA, 15 nt, Homo sapiens
ugcccguuuccauac

SEQ ID NO: 1863238 - RNA, 14 nt, Homo sapiens
uaauaauaccucaa

SEQ ID NO: 1863239 - RNA, 21 nt, Homo sapiens
uguuuaacauaaauuguacug

SEQ ID NO: 1863240 - RNA, 21 nt, Homo sapiens
ucgugauccacccaccuuggc

SEQ ID NO: 1863241 - RNA, 19 nt, Homo sapiens
cuccucuuccagagucacc

SEQ ID NO: 1863242 - RNA, 17 nt, Homo sapiens
cgaguaguugggauuac

SEQ ID NO: 1863243 - RNA, 18 nt, Homo sapiens
uggaggaaaauccaugga

SEQ ID NO: 1863244 - RNA, 20 nt, Homo sapiens
aucaugccacugcacuccag

SEQ ID NO: 1863245 - RNA, 19 nt, Homo sapiens
cugaugacagaacacagau

SEQ ID NO: 1863246 - RNA, 19 nt, Homo sapiens
uguacucuggggugcugcc

SEQ ID NO: 1863247 - RNA, 11 nt, Homo sapiens
gaagcuuuauu

SEQ ID NO: 1863248 - RNA, 24 nt, Homo sapiens
gguuaguagcccuucagucuuaau

SEQ ID NO: 1863249 - RNA, 21 nt, Homo sapiens
guacccacucuggagcauuuc

SEQ ID NO: 1863250 - RNA, 15 nt, Homo sapiens
auuacaaaacucaga

SEQ ID NO: 1863251 - RNA, 12 nt, Homo sapiens
ccugggugacaa

SEQ ID NO: 1863252 - RNA, 14 nt, Homo sapiens
cuaugacacagaag

SEQ ID NO: 1863253 - RNA, 14 nt, Homo sapiens
caguggcacuaaaa

SEQ ID NO: 1863254 - RNA, 14 nt, Homo sapiens
cuguagcacaaaga

SEQ ID NO: 1863255 - RNA, 17 nt, Homo sapiens
cagcuucucuacagacu

SEQ ID NO: 1863256 - RNA, 14 nt, Homo sapiens
cuuagaccucuuca

SEQ ID NO: 1863257 - RNA, 18 nt, Homo sapiens
ugaucaaagccacacucu

SEQ ID NO: 1863258 - RNA, 18 nt, Homo sapiens
acuccuaagacuuaugua

SEQ ID NO: 1863259 - RNA, 21 nt, Homo sapiens
aagaacugaaaggcuuuucaa

SEQ ID NO: 1863260 - RNA, 20 nt, Homo sapiens
cgacuucaugacaagcauuu

SEQ ID NO: 1863261 - RNA, 15 nt, Homo sapiens
gagcaauacuuucug

SEQ ID NO: 1863262 - RNA, 21 nt, Homo sapiens
gauacugucucuccagugaaa

SEQ ID NO: 1863263 - RNA, 21 nt, Homo sapiens
aucagccucgcucuugucucu

SEQ ID NO: 1863264 - RNA, 13 nt, Homo sapiens
uugcagguugcuu

SEQ ID NO: 1863265 - RNA, 12 nt, Homo sapiens
agcccacugggc

SEQ ID NO: 1863266 - RNA, 17 nt, Homo sapiens
uuuuauuuugucucuga

SEQ ID NO: 1863267 - RNA, 13 nt, Homo sapiens
aguugcugugaau

SEQ ID NO: 1863268 - RNA, 23 nt, Homo sapiens
uuuguagcgucugccguguaaca

SEQ ID NO: 1863269 - RNA, 13 nt, Homo sapiens
gauaugggacuga

SEQ ID NO: 1863270 - RNA, 20 nt, Homo sapiens
gaagaaugaauccauucuuu

SEQ ID NO: 1863271 - RNA, 21 nt, Homo sapiens
agucacauaggaaacuugaaa

SEQ ID NO: 1863272 - RNA, 20 nt, Homo sapiens
ugcccccuggggaucacagc

SEQ ID NO: 1863273 - RNA, 19 nt, Homo sapiens
gugcuccugcugaccuucu

SEQ ID NO: 1863274 - RNA, 14 nt, Homo sapiens
agcgugcucacuga

SEQ ID NO: 1863275 - RNA, 12 nt, Homo sapiens
cuaaugggacac

SEQ ID NO: 1863276 - RNA, 15 nt, Homo sapiens
ugcuaucgcaccacu

SEQ ID NO: 1863277 - RNA, 19 nt, Homo sapiens
guggcugcaccacuuccag

SEQ ID NO: 1863278 - RNA, 20 nt, Homo sapiens
aauugcacuuuuaaaccucu

SEQ ID NO: 1863279 - RNA, 18 nt, Homo sapiens
gaaaaagacuaagccaga

SEQ ID NO: 1863280 - RNA, 18 nt, Homo sapiens
cuggggcucuaacgccug

SEQ ID NO: 1863281 - RNA, 20 nt, Homo sapiens
cucuugcuuuguucuuuauu

SEQ ID NO: 1863282 - RNA, 19 nt, Homo sapiens
aggaaggauggcaagcacg

SEQ ID NO: 1863283 - RNA, 21 nt, Homo sapiens
aaaugcuucuucccacaaaga

SEQ ID NO: 1863284 - RNA, 16 nt, Homo sapiens
gcucagaacuugcugc

SEQ ID NO: 1863285 - RNA, 23 nt, Homo sapiens
uccccaugcugggcucacuacau

SEQ ID NO: 1863286 - RNA, 21 nt, Homo sapiens
ggaacucccaagaacagcagg

SEQ ID NO: 1863287 - RNA, 15 nt, Homo sapiens
agaaaaaggugccau

SEQ ID NO: 1863288 - RNA, 19 nt, Homo sapiens
auguaauggaacuuagcca

SEQ ID NO: 1863289 - RNA, 13 nt, Homo sapiens
ccguuucuugcaa

SEQ ID NO: 1863290 - RNA, 14 nt, Homo sapiens
ucucucuugcccca

SEQ ID NO: 1863291 - RNA, 14 nt, Homo sapiens
ggaguccacugccu

SEQ ID NO: 1863292 - RNA, 16 nt, Homo sapiens
uucacccaugaaauua

SEQ ID NO: 1863293 - RNA, 13 nt, Homo sapiens
uuuaaaaacaaag

SEQ ID NO: 1863294 - RNA, 19 nt, Homo sapiens
agaagggaagccuuuugca

SEQ ID NO: 1863295 - RNA, 16 nt, Homo sapiens
uaauucaacccagcca

SEQ ID NO: 1863296 - RNA, 16 nt, Homo sapiens
cuggguuccugcaaug

SEQ ID NO: 1863297 - RNA, 17 nt, Homo sapiens
cuaccauuucuagccuc

SEQ ID NO: 1863298 - RNA, 14 nt, Homo sapiens
auuuauaucuaagu

SEQ ID NO: 1863299 - RNA, 22 nt, Homo sapiens
gcgcgugcuggugggcauguga

SEQ ID NO: 1863300 - RNA, 21 nt, Homo sapiens
cccagaucggaucuguugcaa

SEQ ID NO: 1863301 - RNA, 18 nt, Homo sapiens
cugcgugugcccacugaa

SEQ ID NO: 1863302 - RNA, 23 nt, Homo sapiens
ucugcacagccuagacauccagg

SEQ ID NO: 1863303 - RNA, 15 nt, Homo sapiens
accucuacauugaaa

SEQ ID NO: 1863304 - RNA, 16 nt, Homo sapiens
ggcuucaaaaagccac

SEQ ID NO: 1863305 - RNA, 22 nt, Homo sapiens
cccauucucccagucucugucg

SEQ ID NO: 1863306 - RNA, 13 nt, Homo sapiens
aaugagccuuagu

SEQ ID NO: 1863307 - RNA, 14 nt, Homo sapiens
gcaaguuucaguga

SEQ ID NO: 1863308 - RNA, 15 nt, Homo sapiens
gcuggacaccuacag

SEQ ID NO: 1863309 - RNA, 14 nt, Homo sapiens
uaaaagagccugga

SEQ ID NO: 1863310 - RNA, 16 nt, Homo sapiens
ucuaucugaaauccca

SEQ ID NO: 1863311 - RNA, 21 nt, Homo sapiens
caagcauggucccacaucccu

SEQ ID NO: 1863312 - RNA, 18 nt, Homo sapiens
guauuaugucucuucuga

SEQ ID NO: 1863313 - RNA, 21 nt, Homo sapiens
aacucaucugcugguaccuau

SEQ ID NO: 1863314 - RNA, 20 nt, Homo sapiens
cacucuuuugcuuuauucca

SEQ ID NO: 1863315 - RNA, 21 nt, Homo sapiens
guccuuuuuuauacaggaaaa

SEQ ID NO: 1863316 - RNA, 13 nt, Homo sapiens
acuuaauacucau

SEQ ID NO: 1863317 - RNA, 13 nt, Homo sapiens
auuuuauacccaa

SEQ ID NO: 1863318 - RNA, 20 nt, Homo sapiens
acaguaccuuguugcagaug

SEQ ID NO: 1863319 - RNA, 23 nt, Homo sapiens
cagggcaaaugacaugcacugac

SEQ ID NO: 1863320 - RNA, 22 nt, Homo sapiens
gucauugaaggguguucaccca

SEQ ID NO: 1863321 - RNA, 13 nt, Homo sapiens
auacaauuugccc

SEQ ID NO: 1863322 - RNA, 15 nt, Homo sapiens
guauaauagagauaa

SEQ ID NO: 1863323 - RNA, 18 nt, Homo sapiens
ugauuugcucuuugacaa

SEQ ID NO: 1863324 - RNA, 18 nt, Homo sapiens
cuuucugccaacuuuguu

SEQ ID NO: 1863325 - RNA, 16 nt, Homo sapiens
gccacuugacauuccu

SEQ ID NO: 1863326 - RNA, 22 nt, Homo sapiens
uuuuucugauagaaaugguuuc

SEQ ID NO: 1863327 - RNA, 15 nt, Homo sapiens
uaccuccacccugca

SEQ ID NO: 1863328 - RNA, 11 nt, Homo sapiens
uggagcacgug

SEQ ID NO: 1863329 - RNA, 11 nt, Homo sapiens
gguagcacuuu

SEQ ID NO: 1863330 - RNA, 16 nt, Homo sapiens
gaaugugcaacauucu

SEQ ID NO: 1863331 - RNA, 23 nt, Homo sapiens
agccuacuagggaccuggggaag

SEQ ID NO: 1863332 - RNA, 16 nt, Homo sapiens
aaagccaaacaagccu

SEQ ID NO: 1863333 - RNA, 17 nt, Homo sapiens
gugaugucaucugucac

SEQ ID NO: 1863334 - RNA, 21 nt, Homo sapiens
cgccagccacaggaccaccuc

SEQ ID NO: 1863335 - RNA, 20 nt, Homo sapiens
acgcuuccagaccaccugcc

SEQ ID NO: 1863336 - RNA, 21 nt, Homo sapiens
gaaggcagcuagacaccaaug

SEQ ID NO: 1863337 - RNA, 16 nt, Homo sapiens
caaggaggaguuccac

SEQ ID NO: 1863338 - RNA, 20 nt, Homo sapiens
cuugagacaaaucuaugcca

SEQ ID NO: 1863339 - RNA, 17 nt, Homo sapiens
uacaucaaaaucuggca

SEQ ID NO: 1863340 - RNA, 16 nt, Homo sapiens
ggcagcaaggucaugg

SEQ ID NO: 1863341 - RNA, 15 nt, Homo sapiens
aguucugaacauuuu

SEQ ID NO: 1863342 - RNA, 23 nt, Homo sapiens
uacaaaugaaguauuucauguaa

SEQ ID NO: 1863343 - RNA, 17 nt, Homo sapiens
uaugaggaaacugaguc

SEQ ID NO: 1863344 - RNA, 23 nt, Homo sapiens
caucccaagaaaaucacaucacu

SEQ ID NO: 1863345 - RNA, 21 nt, Homo sapiens
cuguguccccccaaaauucau

SEQ ID NO: 1863346 - RNA, 23 nt, Homo sapiens
gggcagggaggcaacacugcugu

SEQ ID NO: 1863347 - RNA, 16 nt, Homo sapiens
ccaugcucauaccucu

SEQ ID NO: 1863348 - RNA, 14 nt, Homo sapiens
aggguggccuguuc

SEQ ID NO: 1863349 - RNA, 21 nt, Homo sapiens
uaaauuaugaaugaguuuuac

SEQ ID NO: 1863350 - RNA, 22 nt, Homo sapiens
ccugagcaggaaaguuuaccca

SEQ ID NO: 1863351 - RNA, 22 nt, Homo sapiens
aaauguccuccaacaauaaaga

SEQ ID NO: 1863352 - RNA, 12 nt, Homo sapiens
aaggcaggugga

SEQ ID NO: 1863353 - RNA, 21 nt, Homo sapiens
agugaagguucccaaggacau

SEQ ID NO: 1863354 - RNA, 10 nt, Homo sapiens
gcgugcauug

SEQ ID NO: 1863355 - RNA, 14 nt, Homo sapiens
auucacagugcaag

SEQ ID NO: 1863356 - RNA, 23 nt, Homo sapiens
cauggcaccuuuugcacauaaca

SEQ ID NO: 1863357 - RNA, 22 nt, Homo sapiens
uuauauauacaguaacuuuaug

SEQ ID NO: 1863358 - RNA, 21 nt, Homo sapiens
cuuuguuuagcccaaaaccaa

SEQ ID NO: 1863359 - RNA, 15 nt, Homo sapiens
ugguccccuccuucc

SEQ ID NO: 1863360 - RNA, 22 nt, Homo sapiens
gcucaaaguacuacagcaaagc

SEQ ID NO: 1863361 - RNA, 15 nt, Homo sapiens
acccugcaagaccac

SEQ ID NO: 1863362 - RNA, 23 nt, Homo sapiens
guggagucugauuaaggauuuau

SEQ ID NO: 1863363 - RNA, 20 nt, Homo sapiens
ugucauauaguaaacacuca

SEQ ID NO: 1863364 - RNA, 16 nt, Homo sapiens
aaaaagccacaaugaa

SEQ ID NO: 1863365 - RNA, 22 nt, Homo sapiens
cucucaauaaaauuauagcucu

SEQ ID NO: 1863366 - RNA, 15 nt, Homo sapiens
gacuguaaauuccaa

SEQ ID NO: 1863367 - RNA, 16 nt, Homo sapiens
cacuguuucaucucag

SEQ ID NO: 1863368 - RNA, 12 nt, Homo sapiens
ugacuguuacag

SEQ ID NO: 1863369 - RNA, 21 nt, Homo sapiens
caaauguuauucaauaacuau

SEQ ID NO: 1863370 - RNA, 21 nt, Homo sapiens
uauagaacuaaaguaucugag

SEQ ID NO: 1863371 - RNA, 13 nt, Homo sapiens
uucucugcaaugc

SEQ ID NO: 1863372 - RNA, 12 nt, Homo sapiens
auccuccauugc

SEQ ID NO: 1863373 - RNA, 14 nt, Homo sapiens
cauaacauggguac

SEQ ID NO: 1863374 - RNA, 20 nt, Homo sapiens
aggugguauguuugggagac

SEQ ID NO: 1863375 - RNA, 17 nt, Homo sapiens
ugcaugacaaguacugu

SEQ ID NO: 1863376 - RNA, 15 nt, Homo sapiens
ggucucccaauacag

SEQ ID NO: 1863377 - RNA, 12 nt, Homo sapiens
ugggggucccuu

SEQ ID NO: 1863378 - RNA, 16 nt, Homo sapiens
accuaaauuugguucu

SEQ ID NO: 1863379 - RNA, 21 nt, Homo sapiens
aauuugugggcuuggggacag

SEQ ID NO: 1863380 - RNA, 19 nt, Homo sapiens
uacaugcaaggcacuguac

SEQ ID NO: 1863381 - RNA, 16 nt, Homo sapiens
ccauuguauugucuga

SEQ ID NO: 1863382 - RNA, 22 nt, Homo sapiens
ucacugaagaaaccuucagauu

SEQ ID NO: 1863383 - RNA, 20 nt, Homo sapiens
ccauacacacacaaaccauu

SEQ ID NO: 1863384 - RNA, 15 nt, Homo sapiens
auuucauagccaaac

SEQ ID NO: 1863385 - RNA, 21 nt, Homo sapiens
agccgagacucgacucugugc

SEQ ID NO: 1863386 - RNA, 22 nt, Homo sapiens
gccccacugacacccagugucc

SEQ ID NO: 1863387 - RNA, 21 nt, Homo sapiens
aguauagcuugcauagucaau

SEQ ID NO: 1863388 - RNA, 17 nt, Homo sapiens
ggagaggaaaauguuuc

SEQ ID NO: 1863389 - RNA, 19 nt, Homo sapiens
uuccucuguucuaucccac

SEQ ID NO: 1863390 - RNA, 22 nt, Homo sapiens
ugcugugcguggaaugcccuuc

SEQ ID NO: 1863391 - RNA, 16 nt, Homo sapiens
uagaguuucaaccaug

SEQ ID NO: 1863392 - RNA, 21 nt, Homo sapiens
ugacugccucugccugucgca

SEQ ID NO: 1863393 - RNA, 17 nt, Homo sapiens
cuuaugacuugcuacuu

SEQ ID NO: 1863394 - RNA, 17 nt, Homo sapiens
guccauagcacuguaua

SEQ ID NO: 1863395 - RNA, 13 nt, Homo sapiens
cuuuugugaacaa

SEQ ID NO: 1863396 - RNA, 16 nt, Homo sapiens
uauuacugaugugugc

SEQ ID NO: 1863397 - RNA, 14 nt, Homo sapiens
ugagauuacaggug

SEQ ID NO: 1863398 - RNA, 22 nt, Homo sapiens
ccaggaauguuucagcugcagu

SEQ ID NO: 1863399 - RNA, 14 nt, Homo sapiens
acaagguauaccuc

SEQ ID NO: 1863400 - RNA, 17 nt, Homo sapiens
gucuuguugauuuccuc

SEQ ID NO: 1863401 - RNA, 18 nt, Homo sapiens
caaaggacaugaacagac

SEQ ID NO: 1863402 - RNA, 18 nt, Homo sapiens
cguccuuagaauacugua

SEQ ID NO: 1863403 - RNA, 19 nt, Homo sapiens
acuuggggcaccuugcucc

SEQ ID NO: 1863404 - RNA, 13 nt, Homo sapiens
cuuugaaucaaaa

SEQ ID NO: 1863405 - RNA, 14 nt, Homo sapiens
guuaaucauuucau

SEQ ID NO: 1863406 - RNA, 23 nt, Homo sapiens
ucccacccuccccaacaccccac

SEQ ID NO: 1863407 - RNA, 14 nt, Homo sapiens
cugaggaguccaaa

SEQ ID NO: 1863408 - RNA, 16 nt, Homo sapiens
uaauaagucgcuguca

SEQ ID NO: 1863409 - RNA, 23 nt, Homo sapiens
agcacuaaggugugcucugauca

SEQ ID NO: 1863410 - RNA, 12 nt, Homo sapiens
aaguucagggaa

SEQ ID NO: 1863411 - RNA, 16 nt, Homo sapiens
agguaucuacuuuaga

SEQ ID NO: 1863412 - RNA, 23 nt, Homo sapiens
ugauaagaucuuuuauuuugcca

SEQ ID NO: 1863413 - RNA, 19 nt, Homo sapiens
gaaagggcacagugucagu

SEQ ID NO: 1863414 - RNA, 14 nt, Homo sapiens
ggucauaucagcuu

SEQ ID NO: 1863415 - RNA, 16 nt, Homo sapiens
uggaauugacugccua

SEQ ID NO: 1863416 - RNA, 23 nt, Homo sapiens
ugagcgggccgaggcgcucauca

SEQ ID NO: 1863417 - RNA, 21 nt, Homo sapiens
cuccaggguggcagcaacaau

SEQ ID NO: 1863418 - RNA, 20 nt, Homo sapiens
acagccugagucaccugcag

SEQ ID NO: 1863419 - RNA, 14 nt, Homo sapiens
ggugaccacaccuu

SEQ ID NO: 1863420 - RNA, 20 nt, Homo sapiens
acgccacucauuucaucuca

SEQ ID NO: 1863421 - RNA, 21 nt, Homo sapiens
uugaaaguuuauaugcuucua

SEQ ID NO: 1863422 - RNA, 23 nt, Homo sapiens
uccuccucuucacuuggccaguu

SEQ ID NO: 1863423 - RNA, 13 nt, Homo sapiens
augaaggaaucau

SEQ ID NO: 1863424 - RNA, 17 nt, Homo sapiens
auaauugacugguggaa

SEQ ID NO: 1863425 - RNA, 17 nt, Homo sapiens
auuuuucacugccccag

SEQ ID NO: 1863426 - RNA, 15 nt, Homo sapiens
aaaagcaagggcaaa

SEQ ID NO: 1863427 - RNA, 21 nt, Homo sapiens
ucuggggaagaccuuguccca

SEQ ID NO: 1863428 - RNA, 21 nt, Homo sapiens
gcugcccacaacuugccaaaa

SEQ ID NO: 1863429 - RNA, 22 nt, Homo sapiens
gaaacagcaggacuuguuuaca

SEQ ID NO: 1863430 - RNA, 21 nt, Homo sapiens
acacugggacuugcaaaaagg

SEQ ID NO: 1863431 - RNA, 20 nt, Homo sapiens
acaaaaugggccucauggaa

SEQ ID NO: 1863432 - RNA, 17 nt, Homo sapiens
auaugaucaaacuucca

SEQ ID NO: 1863433 - RNA, 19 nt, Homo sapiens
ccuugugguugaaaaccac

SEQ ID NO: 1863434 - RNA, 16 nt, Homo sapiens
aauucuccuguaacuc

SEQ ID NO: 1863435 - RNA, 17 nt, Homo sapiens
gaacauugucuggauac

SEQ ID NO: 1863436 - RNA, 20 nt, Homo sapiens
auggaucccaaucugagaaa

SEQ ID NO: 1863437 - RNA, 23 nt, Homo sapiens
agauggggcgggggugugucugu

SEQ ID NO: 1863438 - RNA, 17 nt, Homo sapiens
aacagagugauuuguaa

SEQ ID NO: 1863439 - RNA, 19 nt, Homo sapiens
uccugaggcagaaccuggu

SEQ ID NO: 1863440 - RNA, 23 nt, Homo sapiens
caaaaaauguaauuaacuguaaa

SEQ ID NO: 1863441 - RNA, 15 nt, Homo sapiens
auccagcccaggacu

SEQ ID NO: 1863442 - RNA, 23 nt, Homo sapiens
ucacuuggagccaggaguuugag

SEQ ID NO: 1863443 - RNA, 21 nt, Homo sapiens
uuaugaaaauuauacugagaa

SEQ ID NO: 1863444 - RNA, 12 nt, Homo sapiens
auauagacacac

SEQ ID NO: 1863445 - RNA, 12 nt, Homo sapiens
auucagacacuu

SEQ ID NO: 1863446 - RNA, 15 nt, Homo sapiens
acaacaaaaaccaaa

SEQ ID NO: 1863447 - RNA, 22 nt, Homo sapiens
auuaaaacauauuucauuuuaa

SEQ ID NO: 1863448 - RNA, 21 nt, Homo sapiens
acuuuguauagacaucugccc

SEQ ID NO: 1863449 - RNA, 16 nt, Homo sapiens
aauauguauuuauguc

SEQ ID NO: 1863450 - RNA, 23 nt, Homo sapiens
auauuaccagcuagccagucacu

SEQ ID NO: 1863451 - RNA, 22 nt, Homo sapiens
gucuuagagauacccucugaga

SEQ ID NO: 1863452 - RNA, 18 nt, Homo sapiens
aaucucacacuucauccu

SEQ ID NO: 1863453 - RNA, 21 nt, Homo sapiens
gcaaucugagagauuugaaua

SEQ ID NO: 1863454 - RNA, 23 nt, Homo sapiens
aggacaugcgguagccagcacac

SEQ ID NO: 1863455 - RNA, 22 nt, Homo sapiens
ccucugagggaaagcccagaaa

SEQ ID NO: 1863456 - RNA, 19 nt, Homo sapiens
cauccucugacuccacuca

SEQ ID NO: 1863457 - RNA, 14 nt, Homo sapiens
aaauacuacaauag

SEQ ID NO: 1863458 - RNA, 15 nt, Homo sapiens
ucaacaacaugucaa

SEQ ID NO: 1863459 - RNA, 13 nt, Homo sapiens
uggagucaaggau

SEQ ID NO: 1863460 - RNA, 19 nt, Homo sapiens
uaaaaaagaaaacauucca

SEQ ID NO: 1863461 - RNA, 17 nt, Homo sapiens
cuccacccacaguggag

SEQ ID NO: 1863462 - RNA, 20 nt, Homo sapiens
aacuuaccuuguuaagacaa

SEQ ID NO: 1863463 - RNA, 17 nt, Homo sapiens
uaagcagcuuacuuagu

SEQ ID NO: 1863464 - RNA, 13 nt, Homo sapiens
augugggcucaga

SEQ ID NO: 1863465 - RNA, 19 nt, Homo sapiens
uucuugaagcaguagccua

SEQ ID NO: 1863466 - RNA, 17 nt, Homo sapiens
accuccaccucccgggu

SEQ ID NO: 1863467 - RNA, 10 nt, Homo sapiens
uucacagcca

SEQ ID NO: 1863468 - RNA, 18 nt, Homo sapiens
aaacuacugcaccauuua

SEQ ID NO: 1863469 - RNA, 13 nt, Homo sapiens
cuccuuuuugccc

SEQ ID NO: 1863470 - RNA, 15 nt, Homo sapiens
cuauuugccaugggc

SEQ ID NO: 1863471 - RNA, 13 nt, Homo sapiens
aacuucagugugg

SEQ ID NO: 1863472 - RNA, 20 nt, Homo sapiens
agauccaagcaaaacuuuac

SEQ ID NO: 1863473 - RNA, 13 nt, Homo sapiens
gggugagacucca

SEQ ID NO: 1863474 - RNA, 21 nt, Homo sapiens
ucagugagauauuugguacca

SEQ ID NO: 1863475 - RNA, 13 nt, Homo sapiens
ugaaaaugauuag

SEQ ID NO: 1863476 - RNA, 12 nt, Homo sapiens
ccuggagcugcu

SEQ ID NO: 1863477 - RNA, 22 nt, Homo sapiens
ugagaacagaucuccaaagcuu

SEQ ID NO: 1863478 - RNA, 19 nt, Homo sapiens
cugguccuagguccucuga

SEQ ID NO: 1863479 - RNA, 18 nt, Homo sapiens
aaggcuuugccaugggcc

SEQ ID NO: 1863480 - RNA, 17 nt, Homo sapiens
ucaagcgauucucaugc

SEQ ID NO: 1863481 - RNA, 21 nt, Homo sapiens
uagcagcagauguaguuucag

SEQ ID NO: 1863482 - RNA, 22 nt, Homo sapiens
gaaaaaaagacaaggcugauuu

SEQ ID NO: 1863483 - RNA, 18 nt, Homo sapiens
cuuaagaauacacaggau

SEQ ID NO: 1863484 - RNA, 21 nt, Homo sapiens
gguaaaaugccaugaugccuc

SEQ ID NO: 1863485 - RNA, 14 nt, Homo sapiens
aauucuagucauau

SEQ ID NO: 1863486 - RNA, 14 nt, Homo sapiens
accucaagugccuu

SEQ ID NO: 1863487 - RNA, 22 nt, Homo sapiens
cucagcaccccacuccucagua

SEQ ID NO: 1863488 - RNA, 18 nt, Homo sapiens
cuuagaucugguguccag

SEQ ID NO: 1863489 - RNA, 21 nt, Homo sapiens
cccagcugcauuucuuuugca

SEQ ID NO: 1863490 - RNA, 20 nt, Homo sapiens
agccugaugcugacauucac

SEQ ID NO: 1863491 - RNA, 22 nt, Homo sapiens
cccaguucugaauaacuugaag

SEQ ID NO: 1863492 - RNA, 20 nt, Homo sapiens
gaugccccugacaucaucau

SEQ ID NO: 1863493 - RNA, 21 nt, Homo sapiens
cacugcgcauguuugacuuua

SEQ ID NO: 1863494 - RNA, 21 nt, Homo sapiens
aaggcaauccuaagcaaaaag

SEQ ID NO: 1863495 - RNA, 16 nt, Homo sapiens
cucucaguguuuugga

SEQ ID NO: 1863496 - RNA, 15 nt, Homo sapiens
uaaagaaacacuuuc

SEQ ID NO: 1863497 - RNA, 17 nt, Homo sapiens
aaaaugugguaacuuua

SEQ ID NO: 1863498 - RNA, 15 nt, Homo sapiens
ucugauauguaucca

SEQ ID NO: 1863499 - RNA, 19 nt, Homo sapiens
uaaaaauggcaaaugcacu

SEQ ID NO: 1863500 - RNA, 17 nt, Homo sapiens
cucuacgucccagggag

SEQ ID NO: 1863501 - RNA, 20 nt, Homo sapiens
aguccuaucgacuuuauaca

SEQ ID NO: 1863502 - RNA, 23 nt, Homo sapiens
ucugggauauuuccauauggcaa

SEQ ID NO: 1863503 - RNA, 13 nt, Homo sapiens
uuaaaaaaucuca

SEQ ID NO: 1863504 - RNA, 22 nt, Homo sapiens
uaacagcuuucuuauucaguga

SEQ ID NO: 1863505 - RNA, 16 nt, Homo sapiens
gccaaggccucaggag

SEQ ID NO: 1863506 - RNA, 20 nt, Homo sapiens
uacagaaucaaaugcaauuu

SEQ ID NO: 1863507 - RNA, 17 nt, Homo sapiens
gucagacuuuucuuugc

SEQ ID NO: 1863508 - RNA, 19 nt, Homo sapiens
uugaaggguggucaguagu

SEQ ID NO: 1863509 - RNA, 21 nt, Homo sapiens
uuuaauuuuguacaauaaccu

SEQ ID NO: 1863510 - RNA, 12 nt, Homo sapiens
accugauggaga

SEQ ID NO: 1863511 - RNA, 16 nt, Homo sapiens
gcucaguaauuccugu

SEQ ID NO: 1863512 - RNA, 18 nt, Homo sapiens
ugugaggguggugggugg

SEQ ID NO: 1863513 - RNA, 12 nt, Homo sapiens
aaaaacauuugu

SEQ ID NO: 1863514 - RNA, 20 nt, Homo sapiens
ggcucaaaugauccucccac

SEQ ID NO: 1863515 - RNA, 18 nt, Homo sapiens
ggucaaaaaauagaugca

SEQ ID NO: 1863516 - RNA, 20 nt, Homo sapiens
uuuaacggaugguugaauga

SEQ ID NO: 1863517 - RNA, 19 nt, Homo sapiens
agguuggaacuaugcagug

SEQ ID NO: 1863518 - RNA, 15 nt, Homo sapiens
auuuuaaccaguuau

SEQ ID NO: 1863519 - RNA, 16 nt, Homo sapiens
aucuggcuuagugcca

SEQ ID NO: 1863520 - RNA, 13 nt, Homo sapiens
cucaaaguuaaaa

SEQ ID NO: 1863521 - RNA, 12 nt, Homo sapiens
gaacaauaucaa

SEQ ID NO: 1863522 - RNA, 18 nt, Homo sapiens
aagcaacgacuacuuugc

SEQ ID NO: 1863523 - RNA, 17 nt, Homo sapiens
gguuuaacucagaucac

SEQ ID NO: 1863524 - RNA, 18 nt, Homo sapiens
uuuuaaaaaaauucauca

SEQ ID NO: 1863525 - RNA, 12 nt, Homo sapiens
gccuguggugcu

SEQ ID NO: 1863526 - RNA, 20 nt, Homo sapiens
ucugaaaagaacaacccuga

SEQ ID NO: 1863527 - RNA, 16 nt, Homo sapiens
ccagccuccucuggau

SEQ ID NO: 1863528 - RNA, 16 nt, Homo sapiens
uacagagguccugcca

SEQ ID NO: 1863529 - RNA, 10 nt, Homo sapiens
ugugggaccg

SEQ ID NO: 1863530 - RNA, 22 nt, Homo sapiens
guaauuauauaguuacccaaau

SEQ ID NO: 1863531 - RNA, 12 nt, Homo sapiens
cugccauaacau

SEQ ID NO: 1863532 - RNA, 13 nt, Homo sapiens
agcauaguggcaa

SEQ ID NO: 1863533 - RNA, 16 nt, Homo sapiens
cauggcaccaaagcca

SEQ ID NO: 1863534 - RNA, 14 nt, Homo sapiens
gcagaucucccaca

SEQ ID NO: 1863535 - RNA, 17 nt, Homo sapiens
cagcucacucaucaaug

SEQ ID NO: 1863536 - RNA, 14 nt, Homo sapiens
uuccugugaucucg

SEQ ID NO: 1863537 - RNA, 14 nt, Homo sapiens
ggauuucucuagag

SEQ ID NO: 1863538 - RNA, 21 nt, Homo sapiens
cacauauaaauguacuuuucc

SEQ ID NO: 1863539 - RNA, 21 nt, Homo sapiens
aaaguuagucaauccugucau

SEQ ID NO: 1863540 - RNA, 18 nt, Homo sapiens
gaaaaugcgagacucuga

SEQ ID NO: 1863541 - RNA, 12 nt, Homo sapiens
ggcucuccuagg

SEQ ID NO: 1863542 - RNA, 17 nt, Homo sapiens
uacaaguuucaguaaua

SEQ ID NO: 1863543 - RNA, 12 nt, Homo sapiens
aaaauaaagcug

SEQ ID NO: 1863544 - RNA, 18 nt, Homo sapiens
caggcccggcuccaggcu

SEQ ID NO: 1863545 - RNA, 12 nt, Homo sapiens
guuugcacuuaa

SEQ ID NO: 1863546 - RNA, 17 nt, Homo sapiens
aagagagugaacauauc

SEQ ID NO: 1863547 - RNA, 13 nt, Homo sapiens
guaugcuggccag

SEQ ID NO: 1863548 - RNA, 13 nt, Homo sapiens
cuaagcugcccug

SEQ ID NO: 1863549 - RNA, 22 nt, Homo sapiens
ggccccuccuugcaaccaggca

SEQ ID NO: 1863550 - RNA, 23 nt, Homo sapiens
guugauaguuuacaaacaagaua

SEQ ID NO: 1863551 - RNA, 14 nt, Homo sapiens
aauuugaaccaaaa

SEQ ID NO: 1863552 - RNA, 13 nt, Homo sapiens
uguucuugcuacc

SEQ ID NO: 1863553 - RNA, 16 nt, Homo sapiens
gguguugccagcgugg

SEQ ID NO: 1863554 - RNA, 13 nt, Homo sapiens
accaggcacugcc

SEQ ID NO: 1863555 - RNA, 18 nt, Homo sapiens
ucugguguuacacauaca

SEQ ID NO: 1863556 - RNA, 17 nt, Homo sapiens
agauggcgauguguuau

SEQ ID NO: 1863557 - RNA, 21 nt, Homo sapiens
acgaacagcugacauggaguu

SEQ ID NO: 1863558 - RNA, 15 nt, Homo sapiens
uucauuccucacaau

SEQ ID NO: 1863559 - RNA, 15 nt, Homo sapiens
acucagccacgacca

SEQ ID NO: 1863560 - RNA, 14 nt, Homo sapiens
ccaaacaagccuua

SEQ ID NO: 1863561 - RNA, 20 nt, Homo sapiens
uaccaguuguuagaucugua

SEQ ID NO: 1863562 - RNA, 16 nt, Homo sapiens
auuuuauuuuacuauu

SEQ ID NO: 1863563 - RNA, 11 nt, Homo sapiens
acuugcacuug

SEQ ID NO: 1863564 - RNA, 22 nt, Homo sapiens
caauuugagccagagagcaucu

SEQ ID NO: 1863565 - RNA, 22 nt, Homo sapiens
aacaguuuuuuaugcuaaucag

SEQ ID NO: 1863566 - RNA, 18 nt, Homo sapiens
caguuguaccaagugaaa

SEQ ID NO: 1863567 - RNA, 15 nt, Homo sapiens
auaaaaguaaacuca

SEQ ID NO: 1863568 - RNA, 12 nt, Homo sapiens
gaccacuacagu

SEQ ID NO: 1863569 - RNA, 23 nt, Homo sapiens
aaggcaguaguuuucaaaacaca

SEQ ID NO: 1863570 - RNA, 16 nt, Homo sapiens
ucugguuuauuuccua

SEQ ID NO: 1863571 - RNA, 22 nt, Homo sapiens
ccagguucucuuagagccauau

SEQ ID NO: 1863572 - RNA, 20 nt, Homo sapiens
cugaagaacaguaacugcca

SEQ ID NO: 1863573 - RNA, 13 nt, Homo sapiens
aaguacuacauca

SEQ ID NO: 1863574 - RNA, 12 nt, Homo sapiens
uaaacucggggg

SEQ ID NO: 1863575 - RNA, 18 nt, Homo sapiens
ugaauuuacauauagcug

SEQ ID NO: 1863576 - RNA, 22 nt, Homo sapiens
cauuuuccucucccgaaggaga

SEQ ID NO: 1863577 - RNA, 17 nt, Homo sapiens
cuucaaaaucagugaug

SEQ ID NO: 1863578 - RNA, 19 nt, Homo sapiens
cacacggucuucacaaaga

SEQ ID NO: 1863579 - RNA, 17 nt, Homo sapiens
uccaagaacaagucacc

SEQ ID NO: 1863580 - RNA, 13 nt, Homo sapiens
aggaccacuccug

SEQ ID NO: 1863581 - RNA, 16 nt, Homo sapiens
aucgccagcugaugac

SEQ ID NO: 1863582 - RNA, 20 nt, Homo sapiens
ugucagcagggacuguaaac

SEQ ID NO: 1863583 - RNA, 16 nt, Homo sapiens
uguggccccaacacaa

SEQ ID NO: 1863584 - RNA, 12 nt, Homo sapiens
aguugaacaugg

SEQ ID NO: 1863585 - RNA, 23 nt, Homo sapiens
ggaugaggaaccucaaacugggu

SEQ ID NO: 1863586 - RNA, 19 nt, Homo sapiens
cccucacuauugaugcauu

SEQ ID NO: 1863587 - RNA, 16 nt, Homo sapiens
gucuccucugcagcuc

SEQ ID NO: 1863588 - RNA, 15 nt, Homo sapiens
gaaaacauugcuuug

SEQ ID NO: 1863589 - RNA, 15 nt, Homo sapiens
gggccugcaggugag

SEQ ID NO: 1863590 - RNA, 16 nt, Homo sapiens
accuaugcaaagauga

SEQ ID NO: 1863591 - RNA, 23 nt, Homo sapiens
uuaaaaaaaacaaaaagaacaaa

SEQ ID NO: 1863592 - RNA, 20 nt, Homo sapiens
agugauguuguuugggagag

SEQ ID NO: 1863593 - RNA, 19 nt, Homo sapiens
acaugcgugaccagcagua

SEQ ID NO: 1863594 - RNA, 22 nt, Homo sapiens
agagauuccugagccaguguca

SEQ ID NO: 1863595 - RNA, 21 nt, Homo sapiens
caaaucuuaagagaauccaca

SEQ ID NO: 1863596 - RNA, 20 nt, Homo sapiens
ucuaagauaguaacaaugaa

SEQ ID NO: 1863597 - RNA, 16 nt, Homo sapiens
acccugggaccacaga

SEQ ID NO: 1863598 - RNA, 17 nt, Homo sapiens
gauuuuuagcuuuacaa

SEQ ID NO: 1863599 - RNA, 19 nt, Homo sapiens
acuaaaauuaggacuguau

SEQ ID NO: 1863600 - RNA, 21 nt, Homo sapiens
caccugugagaaaggaaaaau

SEQ ID NO: 1863601 - RNA, 19 nt, Homo sapiens
gcaauucauaacuaaugaa

SEQ ID NO: 1863602 - RNA, 23 nt, Homo sapiens
agaaaaguguauuagaugugguu

SEQ ID NO: 1863603 - RNA, 19 nt, Homo sapiens
cugucccucaaaugaccca

SEQ ID NO: 1863604 - RNA, 19 nt, Homo sapiens
aguauacugcccaaacuaa

SEQ ID NO: 1863605 - RNA, 21 nt, Homo sapiens
augaugcgggccagugcucca

SEQ ID NO: 1863606 - RNA, 17 nt, Homo sapiens
acucuucucauuacuug

SEQ ID NO: 1863607 - RNA, 19 nt, Homo sapiens
uggcuagugguggguacuc

SEQ ID NO: 1863608 - RNA, 21 nt, Homo sapiens
cucagugcauagcgaagacca

SEQ ID NO: 1863609 - RNA, 16 nt, Homo sapiens
uauuaugcaaauuccc

SEQ ID NO: 1863610 - RNA, 22 nt, Homo sapiens
caguuuuguaaauguacuggua

SEQ ID NO: 1863611 - RNA, 21 nt, Homo sapiens
cauaccuuguuuuuaaucucc

SEQ ID NO: 1863612 - RNA, 15 nt, Homo sapiens
uauagaguguuugua

SEQ ID NO: 1863613 - RNA, 12 nt, Homo sapiens
guauacauaugu

SEQ ID NO: 1863614 - RNA, 21 nt, Homo sapiens
ugacacuguuaauaguacuau

SEQ ID NO: 1863615 - RNA, 11 nt, Homo sapiens
uacccacuucc

SEQ ID NO: 1863616 - RNA, 14 nt, Homo sapiens
ccaggcacagggcc

SEQ ID NO: 1863617 - RNA, 22 nt, Homo sapiens
cucuugccaaaaaauagcacac

SEQ ID NO: 1863618 - RNA, 23 nt, Homo sapiens
agcucugcggcuugccacucuga

SEQ ID NO: 1863619 - RNA, 19 nt, Homo sapiens
auggacaguggagaugaag

SEQ ID NO: 1863620 - RNA, 17 nt, Homo sapiens
aaaucauuucaguauca

SEQ ID NO: 1863621 - RNA, 13 nt, Homo sapiens
gcauaguuuagau

SEQ ID NO: 1863622 - RNA, 18 nt, Homo sapiens
cuuauggaauugauuugc

SEQ ID NO: 1863623 - RNA, 14 nt, Homo sapiens
uuaauaaauguaua

SEQ ID NO: 1863624 - RNA, 23 nt, Homo sapiens
cggcacgguuuccagauguaaua

SEQ ID NO: 1863625 - RNA, 23 nt, Homo sapiens
agagcguuuguucccccaugaaa

SEQ ID NO: 1863626 - RNA, 18 nt, Homo sapiens
caaugguccuagaacuuu

SEQ ID NO: 1863627 - RNA, 24 nt, Homo sapiens
acuaaaaaugcaucuggcuacuuu

SEQ ID NO: 1863628 - RNA, 17 nt, Homo sapiens
caaacacauugugaaua

SEQ ID NO: 1863629 - RNA, 12 nt, Homo sapiens
caagaggccacu

SEQ ID NO: 1863630 - RNA, 22 nt, Homo sapiens
aacaugauguuuuaagcugcua

SEQ ID NO: 1863631 - RNA, 12 nt, Homo sapiens
gaagcugugaaa

SEQ ID NO: 1863632 - RNA, 19 nt, Homo sapiens
acggaaaauccgacaagcc

SEQ ID NO: 1863633 - RNA, 22 nt, Homo sapiens
gcuggacugaccaaagacugca

SEQ ID NO: 1863634 - RNA, 16 nt, Homo sapiens
agugccagguggcuca

SEQ ID NO: 1863635 - RNA, 20 nt, Homo sapiens
cuccuaccugcugcugcuau

SEQ ID NO: 1863636 - RNA, 18 nt, Homo sapiens
uggggcuccugcuucccc

SEQ ID NO: 1863637 - RNA, 14 nt, Homo sapiens
uauuauguguuucc

SEQ ID NO: 1863638 - RNA, 13 nt, Homo sapiens
cucauaguauggu

SEQ ID NO: 1863639 - RNA, 19 nt, Homo sapiens
ugcaagaaaucagccauaa

SEQ ID NO: 1863640 - RNA, 15 nt, Homo sapiens
agugucccuuaccug

SEQ ID NO: 1863641 - RNA, 21 nt, Homo sapiens
gauuucaggucaacucugaag

SEQ ID NO: 1863642 - RNA, 20 nt, Homo sapiens
aauugcucuuggcugugaaa

SEQ ID NO: 1863643 - RNA, 19 nt, Homo sapiens
cagaucaguuuuccuaguc

SEQ ID NO: 1863644 - RNA, 20 nt, Homo sapiens
uucuggggaaagacacugcc

SEQ ID NO: 1863645 - RNA, 18 nt, Homo sapiens
uguuaggccaacugccuc

SEQ ID NO: 1863646 - RNA, 18 nt, Homo sapiens
ggacuccaucuccugacc

SEQ ID NO: 1863647 - RNA, 18 nt, Homo sapiens
gacuaacccaaugccugu

SEQ ID NO: 1863648 - RNA, 21 nt, Homo sapiens
aggaaacaaaaaggaaaugag

SEQ ID NO: 1863649 - RNA, 19 nt, Homo sapiens
uaugugaacauuccuauca

SEQ ID NO: 1863650 - RNA, 23 nt, Homo sapiens
uugcaaauccacuagcaccgacc

SEQ ID NO: 1863651 - RNA, 14 nt, Homo sapiens
uucugccugagauu

SEQ ID NO: 1863652 - RNA, 14 nt, Homo sapiens
uaauugagauuauu

SEQ ID NO: 1863653 - RNA, 21 nt, Homo sapiens
gguguguauguaaaguuaaaa

SEQ ID NO: 1863654 - RNA, 14 nt, Homo sapiens
aucuagaagacugu

SEQ ID NO: 1863655 - RNA, 22 nt, Homo sapiens
acuggcucuuuuaccaguauga

SEQ ID NO: 1863656 - RNA, 12 nt, Homo sapiens
caaacgcuuauu

SEQ ID NO: 1863657 - RNA, 23 nt, Homo sapiens
ucuuaguacauccucacuuuuau

SEQ ID NO: 1863658 - RNA, 17 nt, Homo sapiens
gggcacggucacacggc

SEQ ID NO: 1863659 - RNA, 15 nt, Homo sapiens
gagaggcugcuguca

SEQ ID NO: 1863660 - RNA, 22 nt, Homo sapiens
gacagagugaauuucaguauaa

SEQ ID NO: 1863661 - RNA, 19 nt, Homo sapiens
aagcugaugguuggaagac

SEQ ID NO: 1863662 - RNA, 18 nt, Homo sapiens
gcaauagcccugauuaac

SEQ ID NO: 1863663 - RNA, 18 nt, Homo sapiens
aauauuuaaaaaugucuu

SEQ ID NO: 1863664 - RNA, 18 nt, Homo sapiens
uuuauucaagaaugccag

SEQ ID NO: 1863665 - RNA, 17 nt, Homo sapiens
gauuguugucaggccau

SEQ ID NO: 1863666 - RNA, 17 nt, Homo sapiens
uuaauagcuauggaauc

SEQ ID NO: 1863667 - RNA, 20 nt, Homo sapiens
ugugcaguccugggaugugg

SEQ ID NO: 1863668 - RNA, 12 nt, Homo sapiens
acccuuuuccau

SEQ ID NO: 1863669 - RNA, 22 nt, Homo sapiens
cucuuccaguuugcuuugcccu

SEQ ID NO: 1863670 - RNA, 15 nt, Homo sapiens
cugcuuacuugguga

SEQ ID NO: 1863671 - RNA, 18 nt, Homo sapiens
aaauuaaacaaauaugca

SEQ ID NO: 1863672 - RNA, 16 nt, Homo sapiens
caccucacccggccuc

SEQ ID NO: 1863673 - RNA, 20 nt, Homo sapiens
cagaacaucgauauguauau

SEQ ID NO: 1863674 - RNA, 18 nt, Homo sapiens
gcaggaucacagcucacg

SEQ ID NO: 1863675 - RNA, 17 nt, Homo sapiens
uccuacuuuuccuuccc

SEQ ID NO: 1863676 - RNA, 18 nt, Homo sapiens
ccagcuggggcgugggga

SEQ ID NO: 1863677 - RNA, 22 nt, Homo sapiens
gcauacacacacacacacagcc

SEQ ID NO: 1863678 - RNA, 18 nt, Homo sapiens
acuucacuuuaauucuca

SEQ ID NO: 1863679 - RNA, 23 nt, Homo sapiens
cuuacugcuugguccuugauuua

SEQ ID NO: 1863680 - RNA, 12 nt, Homo sapiens
gcaugugcaaua

SEQ ID NO: 1863681 - RNA, 23 nt, Homo sapiens
cugcaugcuggguucugcacagc

SEQ ID NO: 1863682 - RNA, 19 nt, Homo sapiens
ugccccaacuccuuccagc

SEQ ID NO: 1863683 - RNA, 22 nt, Homo sapiens
aagcuauuugauguaauacuuc

SEQ ID NO: 1863684 - RNA, 16 nt, Homo sapiens
uaaauuaugguauuaa

SEQ ID NO: 1863685 - RNA, 20 nt, Homo sapiens
cuucugggaguuagugaacu

SEQ ID NO: 1863686 - RNA, 22 nt, Homo sapiens
aauguauaaaaauuaucaaaaa

SEQ ID NO: 1863687 - RNA, 21 nt, Homo sapiens
gccacucuuagcuaaaucccu

SEQ ID NO: 1863688 - RNA, 14 nt, Homo sapiens
cuucuccacaggga

SEQ ID NO: 1863689 - RNA, 17 nt, Homo sapiens
aacuuuguaguaugaua

SEQ ID NO: 1863690 - RNA, 21 nt, Homo sapiens
aguggaaaacaaagccaaaca

SEQ ID NO: 1863691 - RNA, 22 nt, Homo sapiens
gcuucauuuccucugagcuguu

SEQ ID NO: 1863692 - RNA, 19 nt, Homo sapiens
ugcuuauuguuccaagaca

SEQ ID NO: 1863693 - RNA, 20 nt, Homo sapiens
aagauuucuccugacuccag

SEQ ID NO: 1863694 - RNA, 18 nt, Homo sapiens
aaucaggaguucugccag

SEQ ID NO: 1863695 - RNA, 17 nt, Homo sapiens
cagaucuaucuugucaa

SEQ ID NO: 1863696 - RNA, 19 nt, Homo sapiens
aggagaggcugcugucacu

SEQ ID NO: 1863697 - RNA, 22 nt, Homo sapiens
aaaccuguuccugacuguucuc

SEQ ID NO: 1863698 - RNA, 18 nt, Homo sapiens
gagcaaaggcccaugccc

SEQ ID NO: 1863699 - RNA, 16 nt, Homo sapiens
aaccauguugguugca

SEQ ID NO: 1863700 - RNA, 22 nt, Homo sapiens
uccagguuuaugaaugacagua

SEQ ID NO: 1863701 - RNA, 14 nt, Homo sapiens
gaaaaaaugaacuu

SEQ ID NO: 1863702 - RNA, 14 nt, Homo sapiens
uuacaaauuuaauu

SEQ ID NO: 1863703 - RNA, 14 nt, Homo sapiens
uucauaauuuccau

SEQ ID NO: 1863704 - RNA, 22 nt, Homo sapiens
ucagcgugacaauauacuucac

SEQ ID NO: 1863705 - RNA, 20 nt, Homo sapiens
cuacuugggaggcugaggca

SEQ ID NO: 1863706 - RNA, 15 nt, Homo sapiens
aggagcucugcgcca

SEQ ID NO: 1863707 - RNA, 19 nt, Homo sapiens
gcccucaggggacuugaau

SEQ ID NO: 1863708 - RNA, 13 nt, Homo sapiens
uguguuacuucaa

SEQ ID NO: 1863709 - RNA, 16 nt, Homo sapiens
cuugcggaagccauag

SEQ ID NO: 1863710 - RNA, 20 nt, Homo sapiens
aaaguaaaggccucaucucc

SEQ ID NO: 1863711 - RNA, 18 nt, Homo sapiens
ucccggcugacccugugc

SEQ ID NO: 1863712 - RNA, 16 nt, Homo sapiens
cccuaguucucuuauc

SEQ ID NO: 1863713 - RNA, 22 nt, Homo sapiens
uuuaaccagucugaaguuucau

SEQ ID NO: 1863714 - RNA, 21 nt, Homo sapiens
guaacauuuugacaacugaaa

SEQ ID NO: 1863715 - RNA, 17 nt, Homo sapiens
cugucccuguagcucag

SEQ ID NO: 1863716 - RNA, 18 nt, Homo sapiens
uacaguauauguugcaaa

SEQ ID NO: 1863717 - RNA, 20 nt, Homo sapiens
aagcagucgugccugugucc

SEQ ID NO: 1863718 - RNA, 19 nt, Homo sapiens
uaugauuguuucucaaauc

SEQ ID NO: 1863719 - RNA, 14 nt, Homo sapiens
acaguccacccacc

SEQ ID NO: 1863720 - RNA, 18 nt, Homo sapiens
uccucugugaaacuggga

SEQ ID NO: 1863721 - RNA, 18 nt, Homo sapiens
aaauuuuguccauuuuaa

SEQ ID NO: 1863722 - RNA, 14 nt, Homo sapiens
uuuagaagcaaaga

SEQ ID NO: 1863723 - RNA, 14 nt, Homo sapiens
ugugccaugugcca

SEQ ID NO: 1863724 - RNA, 16 nt, Homo sapiens
ugacaugcauucacau

SEQ ID NO: 1863725 - RNA, 15 nt, Homo sapiens
aucuagauacuguau

SEQ ID NO: 1863726 - RNA, 15 nt, Homo sapiens
uauauucucagugua

SEQ ID NO: 1863727 - RNA, 16 nt, Homo sapiens
auguguauauggugau

SEQ ID NO: 1863728 - RNA, 10 nt, Homo sapiens
cucacugugu

SEQ ID NO: 1863729 - RNA, 22 nt, Homo sapiens
ucuuacccgaaagcaucacugc

SEQ ID NO: 1863730 - RNA, 17 nt, Homo sapiens
gccagaggaacugucca

SEQ ID NO: 1863731 - RNA, 18 nt, Homo sapiens
gcaaaugcagaaccacaa

SEQ ID NO: 1863732 - RNA, 13 nt, Homo sapiens
gaucuggcccaag

SEQ ID NO: 1863733 - RNA, 15 nt, Homo sapiens
ugaggaaaauuaaua

SEQ ID NO: 1863734 - RNA, 13 nt, Homo sapiens
ugaaccaaagaga

SEQ ID NO: 1863735 - RNA, 18 nt, Homo sapiens
gugauccuuccaccucag

SEQ ID NO: 1863736 - RNA, 19 nt, Homo sapiens
augcucuuucaaugcagca

SEQ ID NO: 1863737 - RNA, 15 nt, Homo sapiens
aaauauauuuccuca

SEQ ID NO: 1863738 - RNA, 23 nt, Homo sapiens
gaaucaagguaagcucaggauau

SEQ ID NO: 1863739 - RNA, 23 nt, Homo sapiens
ugaagucuuucccuggugauggu

SEQ ID NO: 1863740 - RNA, 16 nt, Homo sapiens
gaaagauuacuuagag

SEQ ID NO: 1863741 - RNA, 22 nt, Homo sapiens
aucuggaaguaaccauuugcac

SEQ ID NO: 1863742 - RNA, 18 nt, Homo sapiens
ucaugguaagagucacaa

SEQ ID NO: 1863743 - RNA, 17 nt, Homo sapiens
ggaagaauccaguauua

SEQ ID NO: 1863744 - RNA, 22 nt, Homo sapiens
cuuccugcuuaaacuugaccca

SEQ ID NO: 1863745 - RNA, 12 nt, Homo sapiens
aagcugcacaug

SEQ ID NO: 1863746 - RNA, 18 nt, Homo sapiens
cuccuagccccucucuca

SEQ ID NO: 1863747 - RNA, 14 nt, Homo sapiens
cuauugucuguaau

SEQ ID NO: 1863748 - RNA, 12 nt, Homo sapiens
aucacuacugua

SEQ ID NO: 1863749 - RNA, 23 nt, Homo sapiens
uuucagaaacaaagcauuugacu

SEQ ID NO: 1863750 - RNA, 20 nt, Homo sapiens
gcagauccugucccaugggc

SEQ ID NO: 1863751 - RNA, 16 nt, Homo sapiens
cugacaguuuguggca

SEQ ID NO: 1863752 - RNA, 21 nt, Homo sapiens
acauucugcauacuaaccuau

SEQ ID NO: 1863753 - RNA, 14 nt, Homo sapiens
aaaucagugcagua

SEQ ID NO: 1863754 - RNA, 18 nt, Homo sapiens
ccucccaaguagcuggaa

SEQ ID NO: 1863755 - RNA, 19 nt, Homo sapiens
ugaagauuucucugagauc

SEQ ID NO: 1863756 - RNA, 14 nt, Homo sapiens
cuacugaccaaauu

SEQ ID NO: 1863757 - RNA, 16 nt, Homo sapiens
caaucucucucugugu

SEQ ID NO: 1863758 - RNA, 17 nt, Homo sapiens
uucucccaccaccucac

SEQ ID NO: 1863759 - RNA, 21 nt, Homo sapiens
gagcuagcuucugcaauguuu

SEQ ID NO: 1863760 - RNA, 19 nt, Homo sapiens
cacaccuggaaagcauaua

SEQ ID NO: 1863761 - RNA, 19 nt, Homo sapiens
auuuucaaaaucaaauucc

SEQ ID NO: 1863762 - RNA, 17 nt, Homo sapiens
gcccaagcuggagugaa

SEQ ID NO: 1863763 - RNA, 14 nt, Homo sapiens
uggaugugcucacu

SEQ ID NO: 1863764 - RNA, 11 nt, Homo sapiens
uaggcucuguc

SEQ ID NO: 1863765 - RNA, 22 nt, Homo sapiens
agcauaucugccuuuauugugu

SEQ ID NO: 1863766 - RNA, 18 nt, Homo sapiens
aggcucuucuuucccaaa

SEQ ID NO: 1863767 - RNA, 13 nt, Homo sapiens
cacacaccugccu

SEQ ID NO: 1863768 - RNA, 15 nt, Homo sapiens
uuaacacucaugaag

SEQ ID NO: 1863769 - RNA, 14 nt, Homo sapiens
aggcauuugccuaa

SEQ ID NO: 1863770 - RNA, 19 nt, Homo sapiens
uaaucccaguacuugggag

SEQ ID NO: 1863771 - RNA, 19 nt, Homo sapiens
gguagugaccuaaccacuu

SEQ ID NO: 1863772 - RNA, 19 nt, Homo sapiens
aauugaugaaaugcaaaag

SEQ ID NO: 1863773 - RNA, 15 nt, Homo sapiens
ucacuauuacuugaa

SEQ ID NO: 1863774 - RNA, 14 nt, Homo sapiens
uggccgugaggaca

SEQ ID NO: 1863775 - RNA, 23 nt, Homo sapiens
ucucuuuuuagagaaauuugcca

SEQ ID NO: 1863776 - RNA, 15 nt, Homo sapiens
uauccaaagacugua

SEQ ID NO: 1863777 - RNA, 13 nt, Homo sapiens
uucuucaccucac

SEQ ID NO: 1863778 - RNA, 15 nt, Homo sapiens
uuagaccgcucucuu

SEQ ID NO: 1863779 - RNA, 17 nt, Homo sapiens
acuaauuuaaaccagca

SEQ ID NO: 1863780 - RNA, 16 nt, Homo sapiens
uuagggaaaccuuugc

SEQ ID NO: 1863781 - RNA, 16 nt, Homo sapiens
gugaauuaggcuguaa

SEQ ID NO: 1863782 - RNA, 23 nt, Homo sapiens
aauugcaaauaaaccacuuucua

SEQ ID NO: 1863783 - RNA, 12 nt, Homo sapiens
cauuaauacugu

SEQ ID NO: 1863784 - RNA, 14 nt, Homo sapiens
auggccacacugug

SEQ ID NO: 1863785 - RNA, 20 nt, Homo sapiens
uuauaguuauucaaauccau

SEQ ID NO: 1863786 - RNA, 18 nt, Homo sapiens
acuaugagggccuuguaa

SEQ ID NO: 1863787 - RNA, 18 nt, Homo sapiens
auugcagaaauacaguau

SEQ ID NO: 1863788 - RNA, 22 nt, Homo sapiens
uacaaacaggugcuaacacugu

SEQ ID NO: 1863789 - RNA, 22 nt, Homo sapiens
cugagaucgcgccauugcacuc

SEQ ID NO: 1863790 - RNA, 17 nt, Homo sapiens
uaagaacaucauaaaau

SEQ ID NO: 1863791 - RNA, 15 nt, Homo sapiens
auuacuuuucaucua

SEQ ID NO: 1863792 - RNA, 23 nt, Homo sapiens
uuuccuaacaugcaccuugcucc

SEQ ID NO: 1863793 - RNA, 16 nt, Homo sapiens
agccccuggagccuca

SEQ ID NO: 1863794 - RNA, 18 nt, Homo sapiens
ucuaaaauaagucaaaau

SEQ ID NO: 1863795 - RNA, 18 nt, Homo sapiens
acauuuagcuuguucaca

SEQ ID NO: 1863796 - RNA, 12 nt, Homo sapiens
ugccgcugccau

SEQ ID NO: 1863797 - RNA, 16 nt, Homo sapiens
ccgcacugggcuuggg

SEQ ID NO: 1863798 - RNA, 20 nt, Homo sapiens
ucccugaagagaagggcagg

SEQ ID NO: 1863799 - RNA, 22 nt, Homo sapiens
ggaaggugaccgcccagcucuc

SEQ ID NO: 1863800 - RNA, 15 nt, Homo sapiens
uccucgguucaaggu

SEQ ID NO: 1863801 - RNA, 14 nt, Homo sapiens
ccuuuauagcuuug

SEQ ID NO: 1863802 - RNA, 14 nt, Homo sapiens
gagguguacaggua

SEQ ID NO: 1863803 - RNA, 18 nt, Homo sapiens
accagcaacauugaccca

SEQ ID NO: 1863804 - RNA, 18 nt, Homo sapiens
gccucugcccucauccuc

SEQ ID NO: 1863805 - RNA, 18 nt, Homo sapiens
uaaaacacaaaaugaaua

SEQ ID NO: 1863806 - RNA, 23 nt, Homo sapiens
uaguaugcuggcuuguacauagu

SEQ ID NO: 1863807 - RNA, 21 nt, Homo sapiens
acccuguuccugcugcugucu

SEQ ID NO: 1863808 - RNA, 16 nt, Homo sapiens
ccccuaguaacugcug

SEQ ID NO: 1863809 - RNA, 19 nt, Homo sapiens
aaagaugucuauguagcug

SEQ ID NO: 1863810 - RNA, 14 nt, Homo sapiens
gguuuacagucuau

SEQ ID NO: 1863811 - RNA, 19 nt, Homo sapiens
ugaaaagagaaaaauaagc

SEQ ID NO: 1863812 - RNA, 15 nt, Homo sapiens
aaauauauauugcau

SEQ ID NO: 1863813 - RNA, 15 nt, Homo sapiens
ccaagccauggugac

SEQ ID NO: 1863814 - RNA, 21 nt, Homo sapiens
aacaccaggauuuaaguuuca

SEQ ID NO: 1863815 - RNA, 15 nt, Homo sapiens
aaccugccacaaugu

SEQ ID NO: 1863816 - RNA, 13 nt, Homo sapiens
auccuucaucaca

SEQ ID NO: 1863817 - RNA, 16 nt, Homo sapiens
aggaggaacuggucca

SEQ ID NO: 1863818 - RNA, 15 nt, Homo sapiens
gagccaaaaucucaa

SEQ ID NO: 1863819 - RNA, 16 nt, Homo sapiens
caccauccuauugcaa

SEQ ID NO: 1863820 - RNA, 19 nt, Homo sapiens
auuuuuaucuauccuaugu

SEQ ID NO: 1863821 - RNA, 15 nt, Homo sapiens
uauuguaaauacugg

SEQ ID NO: 1863822 - RNA, 13 nt, Homo sapiens
cugagcugugaug

SEQ ID NO: 1863823 - RNA, 15 nt, Homo sapiens
aggguuggagugcuc

SEQ ID NO: 1863824 - RNA, 19 nt, Homo sapiens
uaaaccauugugcauucua

SEQ ID NO: 1863825 - RNA, 13 nt, Homo sapiens
auagacaccaaaa

SEQ ID NO: 1863826 - RNA, 21 nt, Homo sapiens
caacccucucucuuaccuggg

SEQ ID NO: 1863827 - RNA, 18 nt, Homo sapiens
gguauuuuguaauauucu

SEQ ID NO: 1863828 - RNA, 17 nt, Homo sapiens
ggaaaugaauccaucau

SEQ ID NO: 1863829 - RNA, 17 nt, Homo sapiens
auuugcacacugcacug

SEQ ID NO: 1863830 - RNA, 21 nt, Homo sapiens
auaggacaggaaggaaugcaa

SEQ ID NO: 1863831 - RNA, 17 nt, Homo sapiens
cauaaaacaaaaccaag

SEQ ID NO: 1863832 - RNA, 12 nt, Homo sapiens
agaacaaaaaca

SEQ ID NO: 1863833 - RNA, 14 nt, Homo sapiens
acaauuauguuuuc

SEQ ID NO: 1863834 - RNA, 16 nt, Homo sapiens
uccaagauauccaaau

SEQ ID NO: 1863835 - RNA, 13 nt, Homo sapiens
augaaucacuuaa

SEQ ID NO: 1863836 - RNA, 22 nt, Homo sapiens
uuugguguaagccuucaaagaa

SEQ ID NO: 1863837 - RNA, 12 nt, Homo sapiens
caccaccccuua

SEQ ID NO: 1863838 - RNA, 20 nt, Homo sapiens
aaugcccuuacacuuacugu

SEQ ID NO: 1863839 - RNA, 19 nt, Homo sapiens
auuggucuaauuuauucaa

SEQ ID NO: 1863840 - RNA, 21 nt, Homo sapiens
gcagugagcugauaucaugcc

SEQ ID NO: 1863841 - RNA, 23 nt, Homo sapiens
aaugccaguuccagcuucaucua

SEQ ID NO: 1863842 - RNA, 18 nt, Homo sapiens
ucagauggagguucucag

SEQ ID NO: 1863843 - RNA, 15 nt, Homo sapiens
cugcuucccuguuga

SEQ ID NO: 1863844 - RNA, 18 nt, Homo sapiens
gaauuacuuguguuacuu

SEQ ID NO: 1863845 - RNA, 21 nt, Homo sapiens
acaaucuguuuuggcuuuaug

SEQ ID NO: 1863846 - RNA, 17 nt, Homo sapiens
uaauuccuguugcucug

SEQ ID NO: 1863847 - RNA, 13 nt, Homo sapiens
aucaacuuuagcu

SEQ ID NO: 1863848 - RNA, 18 nt, Homo sapiens
gguauuucuuauuugaaa

SEQ ID NO: 1863849 - RNA, 20 nt, Homo sapiens
uccucaagaucauucagugu

SEQ ID NO: 1863850 - RNA, 13 nt, Homo sapiens
uuguucacacaca

SEQ ID NO: 1863851 - RNA, 11 nt, Homo sapiens
gucacucagcc

SEQ ID NO: 1863852 - RNA, 23 nt, Homo sapiens
gcuuggcugugcccucagauucc

SEQ ID NO: 1863853 - RNA, 18 nt, Homo sapiens
gcugaacacccuccuuca

SEQ ID NO: 1863854 - RNA, 20 nt, Homo sapiens
cuccagggacagaagcagga

SEQ ID NO: 1863855 - RNA, 16 nt, Homo sapiens
cuguguuuugugaggu

SEQ ID NO: 1863856 - RNA, 21 nt, Homo sapiens
uuuaaacuacugauugaaugu

SEQ ID NO: 1863857 - RNA, 15 nt, Homo sapiens
caacuuaauucuguu

SEQ ID NO: 1863858 - RNA, 16 nt, Homo sapiens
cagggggcugcugcug

SEQ ID NO: 1863859 - RNA, 21 nt, Homo sapiens
cccagggcuugugugcacaua

SEQ ID NO: 1863860 - RNA, 20 nt, Homo sapiens
accgccaacugcagcucucc

SEQ ID NO: 1863861 - RNA, 18 nt, Homo sapiens
aacggcccaccaaggaca

SEQ ID NO: 1863862 - RNA, 17 nt, Homo sapiens
caaaaauauuuacacuu

SEQ ID NO: 1863863 - RNA, 21 nt, Homo sapiens
acaagcugacuuggcacuuaa

SEQ ID NO: 1863864 - RNA, 18 nt, Homo sapiens
auuuuucugcaccuuccu

SEQ ID NO: 1863865 - RNA, 21 nt, Homo sapiens
uccuguaugaaagauuguggg

SEQ ID NO: 1863866 - RNA, 20 nt, Homo sapiens
uccacuuagaaauugcauuu

SEQ ID NO: 1863867 - RNA, 16 nt, Homo sapiens
aagaaacaugugagua

SEQ ID NO: 1863868 - RNA, 14 nt, Homo sapiens
cacccacguggaga

SEQ ID NO: 1863869 - RNA, 13 nt, Homo sapiens
augacagugcuaa

SEQ ID NO: 1863870 - RNA, 19 nt, Homo sapiens
guacaaaaugaauugccuu

SEQ ID NO: 1863871 - RNA, 21 nt, Homo sapiens
aggugcucaaagauguacuga

SEQ ID NO: 1863872 - RNA, 20 nt, Homo sapiens
ggacuacuauuugaagcaau

SEQ ID NO: 1863873 - RNA, 22 nt, Homo sapiens
cacagaaccuuugucaacuuca

SEQ ID NO: 1863874 - RNA, 16 nt, Homo sapiens
caaauaacaguggcaa

SEQ ID NO: 1863875 - RNA, 21 nt, Homo sapiens
ucccaagcguuucuuuccacc

SEQ ID NO: 1863876 - RNA, 22 nt, Homo sapiens
aaagaauaauaugcugccaaau

SEQ ID NO: 1863877 - RNA, 23 nt, Homo sapiens
acauuuuguacaaagauaugcua

SEQ ID NO: 1863878 - RNA, 13 nt, Homo sapiens
uauauacauagca

SEQ ID NO: 1863879 - RNA, 14 nt, Homo sapiens
uucugguuggugua

SEQ ID NO: 1863880 - RNA, 19 nt, Homo sapiens
cuauauauuuuaugaucuu

SEQ ID NO: 1863881 - RNA, 17 nt, Homo sapiens
auucaggcaacgcacaa

SEQ ID NO: 1863882 - RNA, 16 nt, Homo sapiens
ucccucacccaggcac

SEQ ID NO: 1863883 - RNA, 13 nt, Homo sapiens
cccugugcaguag

SEQ ID NO: 1863884 - RNA, 23 nt, Homo sapiens
agacuguguaugucuauuugcac

SEQ ID NO: 1863885 - RNA, 16 nt, Homo sapiens
gucaaugccugucuua

SEQ ID NO: 1863886 - RNA, 16 nt, Homo sapiens
augaaauuucacuuca

SEQ ID NO: 1863887 - RNA, 18 nt, Homo sapiens
cauguauugcucuuuauc

SEQ ID NO: 1863888 - RNA, 11 nt, Homo sapiens
agcuacuuucc

SEQ ID NO: 1863889 - RNA, 21 nt, Homo sapiens
aaugaagaaggucucauuauc

SEQ ID NO: 1863890 - RNA, 19 nt, Homo sapiens
cugaacugacaaugaaggg

SEQ ID NO: 1863891 - RNA, 14 nt, Homo sapiens
caagcaaugggcaa

SEQ ID NO: 1863892 - RNA, 19 nt, Homo sapiens
cugagagacauggcuuuca

SEQ ID NO: 1863893 - RNA, 15 nt, Homo sapiens
cagucaauugcuuga

SEQ ID NO: 1863894 - RNA, 15 nt, Homo sapiens
caggucggagugccu

SEQ ID NO: 1863895 - RNA, 23 nt, Homo sapiens
uaugacuguuuuuauaugcacau

SEQ ID NO: 1863896 - RNA, 16 nt, Homo sapiens
aucauagacgagacag

SEQ ID NO: 1863897 - RNA, 22 nt, Homo sapiens
cuggagugcagugagcuauuac

SEQ ID NO: 1863898 - RNA, 19 nt, Homo sapiens
auacuauauuuauacugua

SEQ ID NO: 1863899 - RNA, 23 nt, Homo sapiens
cuguuuuuuuugcugcuaaagaa

SEQ ID NO: 1863900 - RNA, 15 nt, Homo sapiens
ccucagauuuccauu

SEQ ID NO: 1863901 - RNA, 23 nt, Homo sapiens
ccagcaccggccccauuuaccca

SEQ ID NO: 1863902 - RNA, 19 nt, Homo sapiens
cagcuauuuucugaccaaa

SEQ ID NO: 1863903 - RNA, 16 nt, Homo sapiens
gugcugcccaguagca

SEQ ID NO: 1863904 - RNA, 15 nt, Homo sapiens
agggggaaggcuugg

SEQ ID NO: 1863905 - RNA, 23 nt, Homo sapiens
ugcccggggcagcugccagagaa

SEQ ID NO: 1863906 - RNA, 14 nt, Homo sapiens
aaggcauaugcaca

SEQ ID NO: 1863907 - RNA, 18 nt, Homo sapiens
acacugugauuuugcccu

SEQ ID NO: 1863908 - RNA, 20 nt, Homo sapiens
gaauuaaaacagcugcgaca

SEQ ID NO: 1863909 - RNA, 17 nt, Homo sapiens
aguggguaaaucaggga

SEQ ID NO: 1863910 - RNA, 17 nt, Homo sapiens
cuuuauaguggcacaaa

SEQ ID NO: 1863911 - RNA, 24 nt, Homo sapiens
caacacucacauuuauucugcuca

SEQ ID NO: 1863912 - RNA, 20 nt, Homo sapiens
aagaacugucuauuuucuca

SEQ ID NO: 1863913 - RNA, 20 nt, Homo sapiens
uauaaucccuuuacaucugu

SEQ ID NO: 1863914 - RNA, 22 nt, Homo sapiens
cagcuacucaggagacugaguu

SEQ ID NO: 1863915 - RNA, 18 nt, Homo sapiens
agagaaacuugaaugcuc

SEQ ID NO: 1863916 - RNA, 19 nt, Homo sapiens
aaugguuuucuaauaucuu

SEQ ID NO: 1863917 - RNA, 19 nt, Homo sapiens
ugcagaagugguaggucag

SEQ ID NO: 1863918 - RNA, 14 nt, Homo sapiens
aacccagcauguac

SEQ ID NO: 1863919 - RNA, 22 nt, Homo sapiens
uguaugcaaaucaaacauauuc

SEQ ID NO: 1863920 - RNA, 16 nt, Homo sapiens
cugugaacccacugaa

SEQ ID NO: 1863921 - RNA, 20 nt, Homo sapiens
uggccgcuucagaugacaga

SEQ ID NO: 1863922 - RNA, 19 nt, Homo sapiens
cauacauggaaccauuuua

SEQ ID NO: 1863923 - RNA, 19 nt, Homo sapiens
cuagaugauggaugccaau

SEQ ID NO: 1863924 - RNA, 16 nt, Homo sapiens
uuguucagucuuucau

SEQ ID NO: 1863925 - RNA, 23 nt, Homo sapiens
acaguguucuguuuaauacucau

SEQ ID NO: 1863926 - RNA, 14 nt, Homo sapiens
agccucaucucuuu

SEQ ID NO: 1863927 - RNA, 20 nt, Homo sapiens
ccuugagugcucuugcuauu

SEQ ID NO: 1863928 - RNA, 15 nt, Homo sapiens
ucucugugcacugau

SEQ ID NO: 1863929 - RNA, 21 nt, Homo sapiens
agaaaugugauuugucuuccc

SEQ ID NO: 1863930 - RNA, 18 nt, Homo sapiens
agccaggccaacagcacc

SEQ ID NO: 1863931 - RNA, 20 nt, Homo sapiens
uggaagcugccucccaucuc

SEQ ID NO: 1863932 - RNA, 20 nt, Homo sapiens
aauuuuuuaaauaaauggaa

SEQ ID NO: 1863933 - RNA, 15 nt, Homo sapiens
uaaaucagacuauga

SEQ ID NO: 1863934 - RNA, 19 nt, Homo sapiens
guaaucuguauaauacuuu

SEQ ID NO: 1863935 - RNA, 12 nt, Homo sapiens
guccgagucuca

SEQ ID NO: 1863936 - RNA, 14 nt, Homo sapiens
agaccugugcuagu

SEQ ID NO: 1863937 - RNA, 14 nt, Homo sapiens
aauaaacauguuuc

SEQ ID NO: 1863938 - RNA, 23 nt, Homo sapiens
gcuacugaugaaaucugcuagaa

SEQ ID NO: 1863939 - RNA, 20 nt, Homo sapiens
aaaugaaggaauagcccgag

SEQ ID NO: 1863940 - RNA, 16 nt, Homo sapiens
cauacagcuucauaaa

SEQ ID NO: 1863941 - RNA, 20 nt, Homo sapiens
agagaaaccucuuuauccaa

SEQ ID NO: 1863942 - RNA, 22 nt, Homo sapiens
acacugccuggaggauagcaga

SEQ ID NO: 1863943 - RNA, 15 nt, Homo sapiens
caaacuugcuuuaug

SEQ ID NO: 1863944 - RNA, 18 nt, Homo sapiens
agucggaucuagccaugg

SEQ ID NO: 1863945 - RNA, 19 nt, Homo sapiens
aauauugauuaagccuccu

SEQ ID NO: 1863946 - RNA, 20 nt, Homo sapiens
gaaaggguuugauauggaga

SEQ ID NO: 1863947 - RNA, 18 nt, Homo sapiens
gucuuggguuccuguaug

SEQ ID NO: 1863948 - RNA, 17 nt, Homo sapiens
gucaccuucccuugcca

SEQ ID NO: 1863949 - RNA, 16 nt, Homo sapiens
uuaucuuugcuguuau

SEQ ID NO: 1863950 - RNA, 19 nt, Homo sapiens
aacaauaaaaguguccauu

SEQ ID NO: 1863951 - RNA, 17 nt, Homo sapiens
cuagugaauguaaaaug

SEQ ID NO: 1863952 - RNA, 16 nt, Homo sapiens
ugaauuguuugaaccu

SEQ ID NO: 1863953 - RNA, 18 nt, Homo sapiens
caccaggccgugccuugu

SEQ ID NO: 1863954 - RNA, 20 nt, Homo sapiens
cugaggccacacucagcaca

SEQ ID NO: 1863955 - RNA, 20 nt, Homo sapiens
cauuggaauucuacuggaaa

SEQ ID NO: 1863956 - RNA, 14 nt, Homo sapiens
uccauuauuuauau

SEQ ID NO: 1863957 - RNA, 13 nt, Homo sapiens
cagccacccugag

SEQ ID NO: 1863958 - RNA, 16 nt, Homo sapiens
uggauaucauacuucc

SEQ ID NO: 1863959 - RNA, 16 nt, Homo sapiens
ugaccuggcaucuugg

SEQ ID NO: 1863960 - RNA, 15 nt, Homo sapiens
ugggcagauccucaa

SEQ ID NO: 1863961 - RNA, 12 nt, Homo sapiens
acucugcacaug

SEQ ID NO: 1863962 - RNA, 20 nt, Homo sapiens
cuauaggugacaaacaucuc

SEQ ID NO: 1863963 - RNA, 14 nt, Homo sapiens
gacuugauuuacaa

SEQ ID NO: 1863964 - RNA, 21 nt, Homo sapiens
uauucucucuaugcaaaaugu

SEQ ID NO: 1863965 - RNA, 20 nt, Homo sapiens
cuuggggcaggcagugaugc

SEQ ID NO: 1863966 - RNA, 19 nt, Homo sapiens
acuucucccaaaguguccu

SEQ ID NO: 1863967 - RNA, 13 nt, Homo sapiens
cccagcaggguga

SEQ ID NO: 1863968 - RNA, 19 nt, Homo sapiens
uuuauauguauauaacaaa

SEQ ID NO: 1863969 - RNA, 12 nt, Homo sapiens
cauuggcuuaaa

SEQ ID NO: 1863970 - RNA, 18 nt, Homo sapiens
gcuggcuugccucuugca

SEQ ID NO: 1863971 - RNA, 16 nt, Homo sapiens
uccuauaguuuuacuc

SEQ ID NO: 1863972 - RNA, 13 nt, Homo sapiens
augugcuggucac

SEQ ID NO: 1863973 - RNA, 18 nt, Homo sapiens
cugcauaaccuuuacacu

SEQ ID NO: 1863974 - RNA, 16 nt, Homo sapiens
ggcaggcagauguucc

SEQ ID NO: 1863975 - RNA, 18 nt, Homo sapiens
acacacgccuucaugcca

SEQ ID NO: 1863976 - RNA, 15 nt, Homo sapiens
caccuggauugcaga

SEQ ID NO: 1863977 - RNA, 13 nt, Homo sapiens
ucuguuucuaguu

SEQ ID NO: 1863978 - RNA, 17 nt, Homo sapiens
ucacuggugguuuuccg

SEQ ID NO: 1863979 - RNA, 19 nt, Homo sapiens
accuaggucgccagugaaa

SEQ ID NO: 1863980 - RNA, 18 nt, Homo sapiens
auuaccggcgugagccac

SEQ ID NO: 1863981 - RNA, 20 nt, Homo sapiens
aggagguggagguugcagug

SEQ ID NO: 1863982 - RNA, 21 nt, Homo sapiens
aggcucccucuuccucuccau

SEQ ID NO: 1863983 - RNA, 16 nt, Homo sapiens
ucucagcucaccucaa

SEQ ID NO: 1863984 - RNA, 20 nt, Homo sapiens
ugauauugcaguaaugauau

SEQ ID NO: 1863985 - RNA, 23 nt, Homo sapiens
ccuaaagggcagggcccacgugu

SEQ ID NO: 1863986 - RNA, 17 nt, Homo sapiens
caaccuaggagcagugg

SEQ ID NO: 1863987 - RNA, 12 nt, Homo sapiens
ccagacccagug

SEQ ID NO: 1863988 - RNA, 19 nt, Homo sapiens
ugaaagaagacagcuuaau

SEQ ID NO: 1863989 - RNA, 22 nt, Homo sapiens
gcacaaacacaaggucauggcc

SEQ ID NO: 1863990 - RNA, 16 nt, Homo sapiens
gcucccaagagcuucc

SEQ ID NO: 1863991 - RNA, 22 nt, Homo sapiens
uccugaaaucaagucaucuaua

SEQ ID NO: 1863992 - RNA, 19 nt, Homo sapiens
ucaagagaaaaguugacac

SEQ ID NO: 1863993 - RNA, 15 nt, Homo sapiens
uuagacagucccugc

SEQ ID NO: 1863994 - RNA, 21 nt, Homo sapiens
guaaauuuuggaaacaguaca

SEQ ID NO: 1863995 - RNA, 15 nt, Homo sapiens
aaguguacuggauuu

SEQ ID NO: 1863996 - RNA, 20 nt, Homo sapiens
auguguaguuauaaaccaau

SEQ ID NO: 1863997 - RNA, 21 nt, Homo sapiens
caccacaggcccuuuccucag

SEQ ID NO: 1863998 - RNA, 16 nt, Homo sapiens
uucucuaggaaagugc

SEQ ID NO: 1863999 - RNA, 12 nt, Homo sapiens
aaaaucuuauca

SEQ ID NO: 1864000 - RNA, 15 nt, Homo sapiens
uguucaguucauucc

SEQ ID NO: 1864001 - RNA, 17 nt, Homo sapiens
ucuaccaggucaaaaua

SEQ ID NO: 1864002 - RNA, 16 nt, Homo sapiens
agucccacacugugca

SEQ ID NO: 1864003 - RNA, 19 nt, Homo sapiens
gcucugcccccucccccau

SEQ ID NO: 1864004 - RNA, 17 nt, Homo sapiens
aauugcuacauagucca

SEQ ID NO: 1864005 - RNA, 13 nt, Homo sapiens
acacaaaaauuag

SEQ ID NO: 1864006 - RNA, 18 nt, Homo sapiens
ugauuuguaacauucaca

SEQ ID NO: 1864007 - RNA, 13 nt, Homo sapiens
cuccagggcuuug

SEQ ID NO: 1864008 - RNA, 14 nt, Homo sapiens
cuaauuauuuacuc

SEQ ID NO: 1864009 - RNA, 20 nt, Homo sapiens
aauguugguuacaugaauga

SEQ ID NO: 1864010 - RNA, 17 nt, Homo sapiens
gucuaucagcaucugac

SEQ ID NO: 1864011 - RNA, 15 nt, Homo sapiens
cauggaguugcuaag

SEQ ID NO: 1864012 - RNA, 17 nt, Homo sapiens
gauaguggggucagggc

SEQ ID NO: 1864013 - RNA, 20 nt, Homo sapiens
caaaucaucucucaucacuu

SEQ ID NO: 1864014 - RNA, 19 nt, Homo sapiens
uacagauagaguuccauau

SEQ ID NO: 1864015 - RNA, 22 nt, Homo sapiens
uaugcccugcagagcaauaaca

SEQ ID NO: 1864016 - RNA, 17 nt, Homo sapiens
aagagaggccccggcug

SEQ ID NO: 1864017 - RNA, 22 nt, Homo sapiens
gccaaggggugggccugugaau

SEQ ID NO: 1864018 - RNA, 14 nt, Homo sapiens
auuaaaagccauga

SEQ ID NO: 1864019 - RNA, 12 nt, Homo sapiens
uuuaugugaaca

SEQ ID NO: 1864020 - RNA, 17 nt, Homo sapiens
acuauaaacuacuguaa

SEQ ID NO: 1864021 - RNA, 17 nt, Homo sapiens
auaaaaagccucaguga

SEQ ID NO: 1864022 - RNA, 18 nt, Homo sapiens
acaccugaugaccuguua

SEQ ID NO: 1864023 - RNA, 20 nt, Homo sapiens
uaaauuguuucauaucuggu

SEQ ID NO: 1864024 - RNA, 19 nt, Homo sapiens
gaauacuggggauuaccau

SEQ ID NO: 1864025 - RNA, 17 nt, Homo sapiens
gcccuaggggagcaccg

SEQ ID NO: 1864026 - RNA, 13 nt, Homo sapiens
acagaucauuuca

SEQ ID NO: 1864027 - RNA, 21 nt, Homo sapiens
caugugugugguggugacuca

SEQ ID NO: 1864028 - RNA, 16 nt, Homo sapiens
auucuguuguguucac

SEQ ID NO: 1864029 - RNA, 21 nt, Homo sapiens
caggaguguccuggcugugaa

SEQ ID NO: 1864030 - RNA, 22 nt, Homo sapiens
uccuugaacugaggcccuguga

SEQ ID NO: 1864031 - RNA, 19 nt, Homo sapiens
aacucuaauuguccauucu

SEQ ID NO: 1864032 - RNA, 23 nt, Homo sapiens
agcuaugaaaacagcuaucucac

SEQ ID NO: 1864033 - RNA, 19 nt, Homo sapiens
aaguaagggagucauugcc

SEQ ID NO: 1864034 - RNA, 20 nt, Homo sapiens
gcccagaaagaggcagugau

SEQ ID NO: 1864035 - RNA, 14 nt, Homo sapiens
ccaggcacugcugc

SEQ ID NO: 1864036 - RNA, 18 nt, Homo sapiens
uuacugcuugaccaaaga

SEQ ID NO: 1864037 - RNA, 23 nt, Homo sapiens
aauagaacuguuucaacuguaua

SEQ ID NO: 1864038 - RNA, 22 nt, Homo sapiens
uagucaacugcuguuuuauguc

SEQ ID NO: 1864039 - RNA, 19 nt, Homo sapiens
ucgugguaggacuguagaa

SEQ ID NO: 1864040 - RNA, 13 nt, Homo sapiens
aucuucuuugcag

SEQ ID NO: 1864041 - RNA, 16 nt, Homo sapiens
uggcaccccuuucuag

SEQ ID NO: 1864042 - RNA, 15 nt, Homo sapiens
auucuuuuuuaugca

SEQ ID NO: 1864043 - RNA, 15 nt, Homo sapiens
uuacuuuuauuugca

SEQ ID NO: 1864044 - RNA, 19 nt, Homo sapiens
gcaagacccauaaccauua

SEQ ID NO: 1864045 - RNA, 12 nt, Homo sapiens
cugcacauuuca

SEQ ID NO: 1864046 - RNA, 16 nt, Homo sapiens
uaaugguugacugggu

SEQ ID NO: 1864047 - RNA, 22 nt, Homo sapiens
aaacuaaacuuuacuggguaua

SEQ ID NO: 1864048 - RNA, 15 nt, Homo sapiens
guucuauccaaacau

SEQ ID NO: 1864049 - RNA, 11 nt, Homo sapiens
cuacagcuuuc

SEQ ID NO: 1864050 - RNA, 17 nt, Homo sapiens
gaccuuauggucaccca

SEQ ID NO: 1864051 - RNA, 23 nt, Homo sapiens
gaauuguuauacuagguuaacau

SEQ ID NO: 1864052 - RNA, 11 nt, Homo sapiens
uucucugggcc

SEQ ID NO: 1864053 - RNA, 15 nt, Homo sapiens
caggaacagaaggau

SEQ ID NO: 1864054 - RNA, 20 nt, Homo sapiens
agcuuacccaagcuguggca

SEQ ID NO: 1864055 - RNA, 15 nt, Homo sapiens
aacguuccacaacag

SEQ ID NO: 1864056 - RNA, 18 nt, Homo sapiens
augugugagugugugcaa

SEQ ID NO: 1864057 - RNA, 12 nt, Homo sapiens
cucuaacuucaa

SEQ ID NO: 1864058 - RNA, 20 nt, Homo sapiens
ccagcuguacugaguucuca

SEQ ID NO: 1864059 - RNA, 15 nt, Homo sapiens
caaagguuacaugug

SEQ ID NO: 1864060 - RNA, 19 nt, Homo sapiens
cugguguuuuaugggccac

SEQ ID NO: 1864061 - RNA, 13 nt, Homo sapiens
ucgguaauaucau

SEQ ID NO: 1864062 - RNA, 22 nt, Homo sapiens
ccuaagcacuuuauaaauauca

SEQ ID NO: 1864063 - RNA, 23 nt, Homo sapiens
ucaugaagugcacaggagccaaa

SEQ ID NO: 1864064 - RNA, 20 nt, Homo sapiens
cccugcagccggagaucuga

SEQ ID NO: 1864065 - RNA, 14 nt, Homo sapiens
aauaaauagcaucu

SEQ ID NO: 1864066 - RNA, 12 nt, Homo sapiens
cccuucugcuuu

SEQ ID NO: 1864067 - RNA, 23 nt, Homo sapiens
guaagaucacuguuuagauuugc

SEQ ID NO: 1864068 - RNA, 14 nt, Homo sapiens
aggaaaaccaggga

SEQ ID NO: 1864069 - RNA, 22 nt, Homo sapiens
ugaacaaaaauugagacauuua

SEQ ID NO: 1864070 - RNA, 13 nt, Homo sapiens
uucaugaaacugu

SEQ ID NO: 1864071 - RNA, 13 nt, Homo sapiens
uucaagaaacuga

SEQ ID NO: 1864072 - RNA, 13 nt, Homo sapiens
accgugaauuuau

SEQ ID NO: 1864073 - RNA, 17 nt, Homo sapiens
aaucuguaaaugaacac

SEQ ID NO: 1864074 - RNA, 13 nt, Homo sapiens
acaaaaaugagcu

SEQ ID NO: 1864075 - RNA, 15 nt, Homo sapiens
aaugaaaauaagcau

SEQ ID NO: 1864076 - RNA, 15 nt, Homo sapiens
uuuaaaaaauaacau

SEQ ID NO: 1864077 - RNA, 23 nt, Homo sapiens
uggguucacagaagcacagcacc

SEQ ID NO: 1864078 - RNA, 13 nt, Homo sapiens
aguuccucugcag

SEQ ID NO: 1864079 - RNA, 16 nt, Homo sapiens
gggcuuucuggggccu

SEQ ID NO: 1864080 - RNA, 19 nt, Homo sapiens
cugcgccggguaccaugga

SEQ ID NO: 1864081 - RNA, 13 nt, Homo sapiens
aacaugaauuuca

SEQ ID NO: 1864082 - RNA, 13 nt, Homo sapiens
uuucagaaaacau

SEQ ID NO: 1864083 - RNA, 23 nt, Homo sapiens
guucagagacuggcagccaggga

SEQ ID NO: 1864084 - RNA, 19 nt, Homo sapiens
ugcauuucacucuggguac

SEQ ID NO: 1864085 - RNA, 19 nt, Homo sapiens
cuuggaucagauccuggaa

SEQ ID NO: 1864086 - RNA, 15 nt, Homo sapiens
accagagcucuggag

SEQ ID NO: 1864087 - RNA, 20 nt, Homo sapiens
ugaagguuuuaagugguuug

SEQ ID NO: 1864088 - RNA, 14 nt, Homo sapiens
uggcggaaccuggc

SEQ ID NO: 1864089 - RNA, 14 nt, Homo sapiens
ccugacaauggcag

SEQ ID NO: 1864090 - RNA, 20 nt, Homo sapiens
cagggaugauggcagagcca

SEQ ID NO: 1864091 - RNA, 17 nt, Homo sapiens
caucuucccacaguggc

SEQ ID NO: 1864092 - RNA, 15 nt, Homo sapiens
acagccuuagagcuc

SEQ ID NO: 1864093 - RNA, 23 nt, Homo sapiens
ccgccauggugcuggggagccaa

SEQ ID NO: 1864094 - RNA, 16 nt, Homo sapiens
agacaggacagaaugu

SEQ ID NO: 1864095 - RNA, 22 nt, Homo sapiens
aguuaagaugcuuugacacuga

SEQ ID NO: 1864096 - RNA, 16 nt, Homo sapiens
caucugauaugacccc

SEQ ID NO: 1864097 - RNA, 14 nt, Homo sapiens
cuugcacuguauca

SEQ ID NO: 1864098 - RNA, 19 nt, Homo sapiens
ucaauuucuaauguuuacu

SEQ ID NO: 1864099 - RNA, 11 nt, Homo sapiens
cacuccaugag

SEQ ID NO: 1864100 - RNA, 22 nt, Homo sapiens
gagacuugguacccacugggac

SEQ ID NO: 1864101 - RNA, 20 nt, Homo sapiens
ccaaggcaguucuguguccu

SEQ ID NO: 1864102 - RNA, 15 nt, Homo sapiens
aauuccuugcacaua

SEQ ID NO: 1864103 - RNA, 17 nt, Homo sapiens
aggcccugcccaaugag

SEQ ID NO: 1864104 - RNA, 23 nt, Homo sapiens
aacuuacugucuucuucauguca

SEQ ID NO: 1864105 - RNA, 17 nt, Homo sapiens
cuaggcauacuuuucaa

SEQ ID NO: 1864106 - RNA, 21 nt, Homo sapiens
gacuucuuuacuaacacuggc

SEQ ID NO: 1864107 - RNA, 14 nt, Homo sapiens
acauuuggccacaa

SEQ ID NO: 1864108 - RNA, 19 nt, Homo sapiens
uuugggccccucagagccc

SEQ ID NO: 1864109 - RNA, 21 nt, Homo sapiens
auugcuaagacuaacucaaga

SEQ ID NO: 1864110 - RNA, 15 nt, Homo sapiens
auuucagagcagagg

SEQ ID NO: 1864111 - RNA, 20 nt, Homo sapiens
acaauguccaaacccacuca

SEQ ID NO: 1864112 - RNA, 18 nt, Homo sapiens
acacgcgugcaugcacac

SEQ ID NO: 1864113 - RNA, 16 nt, Homo sapiens
cuguuugcucacguga

SEQ ID NO: 1864114 - RNA, 13 nt, Homo sapiens
gugauggggcaag

SEQ ID NO: 1864115 - RNA, 14 nt, Homo sapiens
gcaauuacagcaaa

SEQ ID NO: 1864116 - RNA, 19 nt, Homo sapiens
uaacuucaauguaguuuuc

SEQ ID NO: 1864117 - RNA, 17 nt, Homo sapiens
gucuucagggaagguca

SEQ ID NO: 1864118 - RNA, 24 nt, Homo sapiens
gccagcaccugcgggagcugcacu

SEQ ID NO: 1864119 - RNA, 14 nt, Homo sapiens
aucugaaugcugau

SEQ ID NO: 1864120 - RNA, 14 nt, Homo sapiens
auagaaagcaauaa

SEQ ID NO: 1864121 - RNA, 15 nt, Homo sapiens
acgucacagcaguac

SEQ ID NO: 1864122 - RNA, 19 nt, Homo sapiens
acaaaguaagccauguauc

SEQ ID NO: 1864123 - RNA, 13 nt, Homo sapiens
gagaucaccagug

SEQ ID NO: 1864124 - RNA, 21 nt, Homo sapiens
agaaauacauuaugcuugaga

SEQ ID NO: 1864125 - RNA, 22 nt, Homo sapiens
acaaaagggguaauugcauucu

SEQ ID NO: 1864126 - RNA, 15 nt, Homo sapiens
ugccaggccaaagau

SEQ ID NO: 1864127 - RNA, 20 nt, Homo sapiens
ggcauuuaguacauccagaa

SEQ ID NO: 1864128 - RNA, 18 nt, Homo sapiens
cccacuuaccuugcaucu

SEQ ID NO: 1864129 - RNA, 21 nt, Homo sapiens
caggcucucaggccagcugcu

SEQ ID NO: 1864130 - RNA, 16 nt, Homo sapiens
auauacaagugauaau

SEQ ID NO: 1864131 - RNA, 16 nt, Homo sapiens
ucauauuucauuucca

SEQ ID NO: 1864132 - RNA, 20 nt, Homo sapiens
gcaggaggccauuccaggag

SEQ ID NO: 1864133 - RNA, 16 nt, Homo sapiens
augagccgcugugagc

SEQ ID NO: 1864134 - RNA, 13 nt, Homo sapiens
agucuuugccagu

SEQ ID NO: 1864135 - RNA, 18 nt, Homo sapiens
ugaauugcaugacuugua

SEQ ID NO: 1864136 - RNA, 13 nt, Homo sapiens
caagagcaauuua

SEQ ID NO: 1864137 - RNA, 16 nt, Homo sapiens
caacucguauagcaug

SEQ ID NO: 1864138 - RNA, 15 nt, Homo sapiens
aaacccccagcauua

SEQ ID NO: 1864139 - RNA, 13 nt, Homo sapiens
cucgggaaacaca

SEQ ID NO: 1864140 - RNA, 19 nt, Homo sapiens
cacacacucccugcuugca

SEQ ID NO: 1864141 - RNA, 22 nt, Homo sapiens
cagagccacccaggccacugac

SEQ ID NO: 1864142 - RNA, 14 nt, Homo sapiens
aacuuaucaucaca

SEQ ID NO: 1864143 - RNA, 15 nt, Homo sapiens
cuuugugaggacaaa

SEQ ID NO: 1864144 - RNA, 12 nt, Homo sapiens
agaaaugaucau

SEQ ID NO: 1864145 - RNA, 21 nt, Homo sapiens
agagcggcuuccccauugccu

SEQ ID NO: 1864146 - RNA, 15 nt, Homo sapiens
ccaaggccuucucag

SEQ ID NO: 1864147 - RNA, 17 nt, Homo sapiens
aucaacaacauccacug

SEQ ID NO: 1864148 - RNA, 16 nt, Homo sapiens
uucuugggucugcccu

SEQ ID NO: 1864149 - RNA, 22 nt, Homo sapiens
ugaacucaccauagagacccau

SEQ ID NO: 1864150 - RNA, 20 nt, Homo sapiens
uauuacuuagguuauuuugc

SEQ ID NO: 1864151 - RNA, 16 nt, Homo sapiens
cacugccugcccagug

SEQ ID NO: 1864152 - RNA, 15 nt, Homo sapiens
cucaggaaaacagcu

SEQ ID NO: 1864153 - RNA, 13 nt, Homo sapiens
agauuuuugcaau

SEQ ID NO: 1864154 - RNA, 16 nt, Homo sapiens
cccuguuucucuugaa

SEQ ID NO: 1864155 - RNA, 23 nt, Homo sapiens
uaacauuuggaguguguauucaa

SEQ ID NO: 1864156 - RNA, 21 nt, Homo sapiens
aggccauuugcugcccugggg

SEQ ID NO: 1864157 - RNA, 22 nt, Homo sapiens
cucaacugggaaaccccugaaa

SEQ ID NO: 1864158 - RNA, 19 nt, Homo sapiens
ucacacuuccaccagccug

SEQ ID NO: 1864159 - RNA, 20 nt, Homo sapiens
uaauaacuuugaagccauaa

SEQ ID NO: 1864160 - RNA, 16 nt, Homo sapiens
uagucaucaaugcaau

SEQ ID NO: 1864161 - RNA, 16 nt, Homo sapiens
auaaacacauuuccau

SEQ ID NO: 1864162 - RNA, 13 nt, Homo sapiens
aggagaucaucug

SEQ ID NO: 1864163 - RNA, 14 nt, Homo sapiens
ugcuaaaacagcuu

SEQ ID NO: 1864164 - RNA, 20 nt, Homo sapiens
auuccuaggcaacuauuaau

SEQ ID NO: 1864165 - RNA, 12 nt, Homo sapiens
cuucuucuaguu

SEQ ID NO: 1864166 - RNA, 19 nt, Homo sapiens
caugaguuuguuuacacuu

SEQ ID NO: 1864167 - RNA, 18 nt, Homo sapiens
ccugaccucugaagagcu

SEQ ID NO: 1864168 - RNA, 20 nt, Homo sapiens
caaccagccuuuggguccug

SEQ ID NO: 1864169 - RNA, 23 nt, Homo sapiens
gcaucucacagguagacaguaua

SEQ ID NO: 1864170 - RNA, 14 nt, Homo sapiens
auucccugcacaca

SEQ ID NO: 1864171 - RNA, 17 nt, Homo sapiens
aacuggaaaacagaaca

SEQ ID NO: 1864172 - RNA, 17 nt, Homo sapiens
acuuuaccacuaugcaa

SEQ ID NO: 1864173 - RNA, 19 nt, Homo sapiens
agggacagccugcacagug

SEQ ID NO: 1864174 - RNA, 21 nt, Homo sapiens
auacaaugaguaaaaucacag

SEQ ID NO: 1864175 - RNA, 21 nt, Homo sapiens
ugaggcacgagcaaagugaag

SEQ ID NO: 1864176 - RNA, 23 nt, Homo sapiens
ugaguuucugaggaucagcacug

SEQ ID NO: 1864177 - RNA, 22 nt, Homo sapiens
uaauguguacauuagucauuca

SEQ ID NO: 1864178 - RNA, 16 nt, Homo sapiens
agcuguuuucccugac

SEQ ID NO: 1864179 - RNA, 14 nt, Homo sapiens
uacguucuuuucaa

SEQ ID NO: 1864180 - RNA, 14 nt, Homo sapiens
cuccaucucaugua

SEQ ID NO: 1864181 - RNA, 14 nt, Homo sapiens
aggccuuuugcccg

SEQ ID NO: 1864182 - RNA, 13 nt, Homo sapiens
cgauguaugcagc

SEQ ID NO: 1864183 - RNA, 12 nt, Homo sapiens
acccuucugccu

SEQ ID NO: 1864184 - RNA, 13 nt, Homo sapiens
gggauagaaagga

SEQ ID NO: 1864185 - RNA, 16 nt, Homo sapiens
aacaugcauacuuuau

SEQ ID NO: 1864186 - RNA, 19 nt, Homo sapiens
ugaggugguggaguggagu

SEQ ID NO: 1864187 - RNA, 15 nt, Homo sapiens
gcuaagggugggugc

SEQ ID NO: 1864188 - RNA, 19 nt, Homo sapiens
uuuuguaauaaacucucua

SEQ ID NO: 1864189 - RNA, 16 nt, Homo sapiens
acccauuaucuggaau

SEQ ID NO: 1864190 - RNA, 19 nt, Homo sapiens
aagacggaaugaccagaaa

SEQ ID NO: 1864191 - RNA, 22 nt, Homo sapiens
acuuuguuauuguaccuaagua

SEQ ID NO: 1864192 - RNA, 15 nt, Homo sapiens
auuuuuucucaagau

SEQ ID NO: 1864193 - RNA, 18 nt, Homo sapiens
cuugggaaggaaggcagu

SEQ ID NO: 1864194 - RNA, 19 nt, Homo sapiens
ugaucuuaacaaagccuuu

SEQ ID NO: 1864195 - RNA, 19 nt, Homo sapiens
aacucacccccuacacaca

SEQ ID NO: 1864196 - RNA, 16 nt, Homo sapiens
ccggcaacucaucuca

SEQ ID NO: 1864197 - RNA, 16 nt, Homo sapiens
uuucaccugaaacacu

SEQ ID NO: 1864198 - RNA, 11 nt, Homo sapiens
caucuguggag

SEQ ID NO: 1864199 - RNA, 14 nt, Homo sapiens
cugugauacauuuc

SEQ ID NO: 1864200 - RNA, 14 nt, Homo sapiens
cauuucuacuguga

SEQ ID NO: 1864201 - RNA, 12 nt, Homo sapiens
aaggagugacuu

SEQ ID NO: 1864202 - RNA, 17 nt, Homo sapiens
cuccuggaucuaugugu

SEQ ID NO: 1864203 - RNA, 11 nt, Homo sapiens
gaccccagugu

SEQ ID NO: 1864204 - RNA, 13 nt, Homo sapiens
auuugagcacaaa

SEQ ID NO: 1864205 - RNA, 22 nt, Homo sapiens
agcgccuccccaccacugagcc

SEQ ID NO: 1864206 - RNA, 15 nt, Homo sapiens
ucuuauuuucucaau

SEQ ID NO: 1864207 - RNA, 15 nt, Homo sapiens
gugcaaguguguaug

SEQ ID NO: 1864208 - RNA, 13 nt, Homo sapiens
guaaaaugaaauu

SEQ ID NO: 1864209 - RNA, 19 nt, Homo sapiens
cuucccacuuugccacugg

SEQ ID NO: 1864210 - RNA, 17 nt, Homo sapiens
gagauggaggaaaguga

SEQ ID NO: 1864211 - RNA, 18 nt, Homo sapiens
uguccucuuugugauaau

SEQ ID NO: 1864212 - RNA, 12 nt, Homo sapiens
aagauagacuuc

SEQ ID NO: 1864213 - RNA, 15 nt, Homo sapiens
cccaacucuugcaca

SEQ ID NO: 1864214 - RNA, 13 nt, Homo sapiens
gggaacugugcaa

SEQ ID NO: 1864215 - RNA, 13 nt, Homo sapiens
uuguucuggucuu

SEQ ID NO: 1864216 - RNA, 17 nt, Homo sapiens
cauucgcgcucugcuca

SEQ ID NO: 1864217 - RNA, 19 nt, Homo sapiens
uucccuccucaugccuucc

SEQ ID NO: 1864218 - RNA, 16 nt, Homo sapiens
ugaacagggcaguuua

SEQ ID NO: 1864219 - RNA, 17 nt, Homo sapiens
uaaauuuuaauugcacc

SEQ ID NO: 1864220 - RNA, 23 nt, Homo sapiens
aagcaugcucaguauugagacac

SEQ ID NO: 1864221 - RNA, 21 nt, Homo sapiens
uuaauaaaaugguucaugaau

SEQ ID NO: 1864222 - RNA, 21 nt, Homo sapiens
agacuuauguggaacuguaca

SEQ ID NO: 1864223 - RNA, 19 nt, Homo sapiens
aggcucucccucucugcac

SEQ ID NO: 1864224 - RNA, 23 nt, Homo sapiens
aaugguuauaucuaaaacaugua

SEQ ID NO: 1864225 - RNA, 20 nt, Homo sapiens
acugauuacguuuacauucu

SEQ ID NO: 1864226 - RNA, 19 nt, Homo sapiens
gacuaaagaccugcuguaa

SEQ ID NO: 1864227 - RNA, 18 nt, Homo sapiens
guuucuggggacaccagc

SEQ ID NO: 1864228 - RNA, 20 nt, Homo sapiens
uaagccaaagguucagaaaa

SEQ ID NO: 1864229 - RNA, 17 nt, Homo sapiens
cugugcuucgacuacug

SEQ ID NO: 1864230 - RNA, 21 nt, Homo sapiens
uggagggauaagccagcugca

SEQ ID NO: 1864231 - RNA, 14 nt, Homo sapiens
cuggcugagguucc

SEQ ID NO: 1864232 - RNA, 17 nt, Homo sapiens
cacuuccuguccagaga

SEQ ID NO: 1864233 - RNA, 12 nt, Homo sapiens
auuuacuacuua

SEQ ID NO: 1864234 - RNA, 22 nt, Homo sapiens
aagaccaagacuuuugucugau

SEQ ID NO: 1864235 - RNA, 14 nt, Homo sapiens
uuguuacucaggaa

SEQ ID NO: 1864236 - RNA, 21 nt, Homo sapiens
uccugccuucucuucuauccu

SEQ ID NO: 1864237 - RNA, 19 nt, Homo sapiens
agaaaaggacuccucagaa

SEQ ID NO: 1864238 - RNA, 15 nt, Homo sapiens
gacccccagcacuug

SEQ ID NO: 1864239 - RNA, 24 nt, Homo sapiens
ccuccccuucuucuccaucuccau

SEQ ID NO: 1864240 - RNA, 13 nt, Homo sapiens
uuuguucagagag

SEQ ID NO: 1864241 - RNA, 23 nt, Homo sapiens
aaauaucuaccugcccucucuca

SEQ ID NO: 1864242 - RNA, 20 nt, Homo sapiens
aguggcuucccagcucugac

SEQ ID NO: 1864243 - RNA, 15 nt, Homo sapiens
uaaacuacaaaguaa

SEQ ID NO: 1864244 - RNA, 14 nt, Homo sapiens
aaugcaacaguuuu

SEQ ID NO: 1864245 - RNA, 21 nt, Homo sapiens
auaaacuagaauaauaaugcc

SEQ ID NO: 1864246 - RNA, 19 nt, Homo sapiens
agcucccagauuucagucu

SEQ ID NO: 1864247 - RNA, 20 nt, Homo sapiens
aaucaagguaagcucaggau

SEQ ID NO: 1864248 - RNA, 20 nt, Homo sapiens
ccaagaggaaaaacagggaa

SEQ ID NO: 1864249 - RNA, 22 nt, Homo sapiens
agccaauguuuuccacccauaa

SEQ ID NO: 1864250 - RNA, 17 nt, Homo sapiens
cacuuugagaagcugag

SEQ ID NO: 1864251 - RNA, 14 nt, Homo sapiens
aagcaaaacagacu

SEQ ID NO: 1864252 - RNA, 23 nt, Homo sapiens
cuggaacagauucacacugucug

SEQ ID NO: 1864253 - RNA, 22 nt, Homo sapiens
aggccaggggaccccugccagu

SEQ ID NO: 1864254 - RNA, 20 nt, Homo sapiens
ugccaggcuguaagcauucu

SEQ ID NO: 1864255 - RNA, 20 nt, Homo sapiens
gcuacugaaaaaaauggagu

SEQ ID NO: 1864256 - RNA, 16 nt, Homo sapiens
ucagauuuaaccuguu

SEQ ID NO: 1864257 - RNA, 17 nt, Homo sapiens
ucacaaauaaaagccaa

SEQ ID NO: 1864258 - RNA, 17 nt, Homo sapiens
acaacaaagugcuuccu

SEQ ID NO: 1864259 - RNA, 17 nt, Homo sapiens
aagguucucauuucuca

SEQ ID NO: 1864260 - RNA, 18 nt, Homo sapiens
ccugagaagccucauggg

SEQ ID NO: 1864261 - RNA, 15 nt, Homo sapiens
auuuuguuacacuaa

SEQ ID NO: 1864262 - RNA, 19 nt, Homo sapiens
cuggagccuccacugccuc

SEQ ID NO: 1864263 - RNA, 22 nt, Homo sapiens
cuucuguggaccacugcaugag

SEQ ID NO: 1864264 - RNA, 18 nt, Homo sapiens
cuuucaauauuuauuucc

SEQ ID NO: 1864265 - RNA, 15 nt, Homo sapiens
agcaggacauggaca

SEQ ID NO: 1864266 - RNA, 17 nt, Homo sapiens
gccagagaugcuggacu

SEQ ID NO: 1864267 - RNA, 22 nt, Homo sapiens
augauccaagcaagacugaggg

SEQ ID NO: 1864268 - RNA, 17 nt, Homo sapiens
ucuaaaguuacuacuga

SEQ ID NO: 1864269 - RNA, 18 nt, Homo sapiens
guacauccugcagcuuau

SEQ ID NO: 1864270 - RNA, 11 nt, Homo sapiens
ggcaguacugu

SEQ ID NO: 1864271 - RNA, 13 nt, Homo sapiens
aguguuuaccugg

SEQ ID NO: 1864272 - RNA, 22 nt, Homo sapiens
aauuccuuagcuuagaccucag

SEQ ID NO: 1864273 - RNA, 20 nt, Homo sapiens
cauaaccaaacacaaugaug

SEQ ID NO: 1864274 - RNA, 21 nt, Homo sapiens
ccuuaagcaaauuuuguauua

SEQ ID NO: 1864275 - RNA, 15 nt, Homo sapiens
ccauccaacacugga

SEQ ID NO: 1864276 - RNA, 16 nt, Homo sapiens
ugcuccuguacuuguc

SEQ ID NO: 1864277 - RNA, 19 nt, Homo sapiens
uuggaauacacaugcagga

SEQ ID NO: 1864278 - RNA, 19 nt, Homo sapiens
aucugagagauuugaauag

SEQ ID NO: 1864279 - RNA, 15 nt, Homo sapiens
ccaacucacugugcu

SEQ ID NO: 1864280 - RNA, 14 nt, Homo sapiens
guuuucaaugugaa

SEQ ID NO: 1864281 - RNA, 19 nt, Homo sapiens
uauccaaguguuauaccaa

SEQ ID NO: 1864282 - RNA, 21 nt, Homo sapiens
aaaacauuguccccaaugaau

SEQ ID NO: 1864283 - RNA, 20 nt, Homo sapiens
gugcccuccugggagcucau

SEQ ID NO: 1864284 - RNA, 13 nt, Homo sapiens
aggcccaagagau

SEQ ID NO: 1864285 - RNA, 16 nt, Homo sapiens
ugaccuuggguccuga

SEQ ID NO: 1864286 - RNA, 18 nt, Homo sapiens
uuacauaacugccuugaa

SEQ ID NO: 1864287 - RNA, 24 nt, Homo sapiens
auaucagaauuguucaacuuuuca

SEQ ID NO: 1864288 - RNA, 12 nt, Homo sapiens
cugcaccuguca

SEQ ID NO: 1864289 - RNA, 12 nt, Homo sapiens
auguuccaguga

SEQ ID NO: 1864290 - RNA, 13 nt, Homo sapiens
acugguugcacuu

SEQ ID NO: 1864291 - RNA, 20 nt, Homo sapiens
caagauugcgccauugcacu

SEQ ID NO: 1864292 - RNA, 13 nt, Homo sapiens
gaccacgagcccu

SEQ ID NO: 1864293 - RNA, 14 nt, Homo sapiens
gcauuuuacuguac

SEQ ID NO: 1864294 - RNA, 14 nt, Homo sapiens
cacacuuccugucc

SEQ ID NO: 1864295 - RNA, 14 nt, Homo sapiens
cuggugcauugcug

SEQ ID NO: 1864296 - RNA, 14 nt, Homo sapiens
ucagcccaccaccc

SEQ ID NO: 1864297 - RNA, 16 nt, Homo sapiens
aaccuccaaauggaau

SEQ ID NO: 1864298 - RNA, 18 nt, Homo sapiens
gaucuuugagcccauucu

SEQ ID NO: 1864299 - RNA, 16 nt, Homo sapiens
agugaccaucauuuca

SEQ ID NO: 1864300 - RNA, 23 nt, Homo sapiens
ggaagauggagcaaaccuagccc

SEQ ID NO: 1864301 - RNA, 15 nt, Homo sapiens
ggcgugcagcaucag

SEQ ID NO: 1864302 - RNA, 20 nt, Homo sapiens
uagcccguuuucacacugcu

SEQ ID NO: 1864303 - RNA, 21 nt, Homo sapiens
ugacuucuuuacuaacacugg

SEQ ID NO: 1864304 - RNA, 20 nt, Homo sapiens
caaaacuauccugauuccaa

SEQ ID NO: 1864305 - RNA, 14 nt, Homo sapiens
acuccuacuuuuca

SEQ ID NO: 1864306 - RNA, 18 nt, Homo sapiens
caauuucaaaaugcaugu

SEQ ID NO: 1864307 - RNA, 21 nt, Homo sapiens
gaccuggauggggcaggccac

SEQ ID NO: 1864308 - RNA, 15 nt, Homo sapiens
cuggcaauauuuguu

SEQ ID NO: 1864309 - RNA, 12 nt, Homo sapiens
gcuaaaugucaa

SEQ ID NO: 1864310 - RNA, 12 nt, Homo sapiens
uuaaaaugguua

SEQ ID NO: 1864311 - RNA, 18 nt, Homo sapiens
aaaggacuaacaucuccu

SEQ ID NO: 1864312 - RNA, 16 nt, Homo sapiens
gcagccuccuccugac

SEQ ID NO: 1864313 - RNA, 13 nt, Homo sapiens
accuaguacuuua

SEQ ID NO: 1864314 - RNA, 18 nt, Homo sapiens
agguacugcuguguaaug

SEQ ID NO: 1864315 - RNA, 15 nt, Homo sapiens
uagggccacuuggau

SEQ ID NO: 1864316 - RNA, 15 nt, Homo sapiens
ggcgacuccaucuca

SEQ ID NO: 1864317 - RNA, 19 nt, Homo sapiens
auuuacaagcaucauggau

SEQ ID NO: 1864318 - RNA, 23 nt, Homo sapiens
caucuagcaagcacuugaugcca

SEQ ID NO: 1864319 - RNA, 14 nt, Homo sapiens
ugggauaaucacau

SEQ ID NO: 1864320 - RNA, 19 nt, Homo sapiens
gcagcuaaaggaagugaau

SEQ ID NO: 1864321 - RNA, 18 nt, Homo sapiens
cugaacuuucucccucau

SEQ ID NO: 1864322 - RNA, 17 nt, Homo sapiens
ccugguuggccgugguc

SEQ ID NO: 1864323 - RNA, 21 nt, Homo sapiens
gaaauaaacacuggugccaac

SEQ ID NO: 1864324 - RNA, 19 nt, Homo sapiens
ugacuuccucugccacucc

SEQ ID NO: 1864325 - RNA, 15 nt, Homo sapiens
cccucucaagugccc

SEQ ID NO: 1864326 - RNA, 13 nt, Homo sapiens
guguggccugggu

SEQ ID NO: 1864327 - RNA, 21 nt, Homo sapiens
agaccacaaaaauugacucaa

SEQ ID NO: 1864328 - RNA, 20 nt, Homo sapiens
auguuuacuuuucagggcau

SEQ ID NO: 1864329 - RNA, 23 nt, Homo sapiens
augaccuguuauuaccauuagca

SEQ ID NO: 1864330 - RNA, 21 nt, Homo sapiens
cuaaagaggaaggaccaagga

SEQ ID NO: 1864331 - RNA, 24 nt, Homo sapiens
auuucugcacaugguucaccaugc

SEQ ID NO: 1864332 - RNA, 20 nt, Homo sapiens
aacaucgucuaaacuuuaga

SEQ ID NO: 1864333 - RNA, 22 nt, Homo sapiens
ucugauggaacuguguauuuau

SEQ ID NO: 1864334 - RNA, 22 nt, Homo sapiens
auauucuuuaaauuucaucuca

SEQ ID NO: 1864335 - RNA, 14 nt, Homo sapiens
caaaaucacacagc

SEQ ID NO: 1864336 - RNA, 17 nt, Homo sapiens
aauuguucaaacuuucu

SEQ ID NO: 1864337 - RNA, 12 nt, Homo sapiens
auuauuccugca

SEQ ID NO: 1864338 - RNA, 21 nt, Homo sapiens
aucugaacugcucuacuuuga

SEQ ID NO: 1864339 - RNA, 18 nt, Homo sapiens
gaaaucaaugaagcaagu

SEQ ID NO: 1864340 - RNA, 12 nt, Homo sapiens
uagcuccccaau

SEQ ID NO: 1864341 - RNA, 13 nt, Homo sapiens
aaauguacauguu

SEQ ID NO: 1864342 - RNA, 17 nt, Homo sapiens
ugaaucuguaucuugcc

SEQ ID NO: 1864343 - RNA, 21 nt, Homo sapiens
guucccccucccugugugaaa

SEQ ID NO: 1864344 - RNA, 19 nt, Homo sapiens
aacuggcaguugucaucaa

SEQ ID NO: 1864345 - RNA, 19 nt, Homo sapiens
uaaaauggcaaguuuucca

SEQ ID NO: 1864346 - RNA, 20 nt, Homo sapiens
auuuguaauugaacuuaucc

SEQ ID NO: 1864347 - RNA, 20 nt, Homo sapiens
accaucccagcacugcaccc

SEQ ID NO: 1864348 - RNA, 13 nt, Homo sapiens
agggaagggagca

SEQ ID NO: 1864349 - RNA, 17 nt, Homo sapiens
gcugagacuacagguga

SEQ ID NO: 1864350 - RNA, 16 nt, Homo sapiens
cuaagccuguugcuga

SEQ ID NO: 1864351 - RNA, 15 nt, Homo sapiens
ugcagucacuuugac

SEQ ID NO: 1864352 - RNA, 17 nt, Homo sapiens
gcccuuguucgccuccc

SEQ ID NO: 1864353 - RNA, 23 nt, Homo sapiens
auaccaccgacauuuuucaauaa

SEQ ID NO: 1864354 - RNA, 18 nt, Homo sapiens
ccaggccugggugaucug

SEQ ID NO: 1864355 - RNA, 16 nt, Homo sapiens
augucuuuggcucagu

SEQ ID NO: 1864356 - RNA, 17 nt, Homo sapiens
auuaaaacacagcuuua

SEQ ID NO: 1864357 - RNA, 14 nt, Homo sapiens
ucuaauauggagau

SEQ ID NO: 1864358 - RNA, 21 nt, Homo sapiens
uacuaauuccacaccuuuuau

SEQ ID NO: 1864359 - RNA, 16 nt, Homo sapiens
uuaugcagugcugcuu

SEQ ID NO: 1864360 - RNA, 16 nt, Homo sapiens
acggcgcccccagugu

SEQ ID NO: 1864361 - RNA, 15 nt, Homo sapiens
ugcuucgugccacac

SEQ ID NO: 1864362 - RNA, 23 nt, Homo sapiens
ggaccaucacccagaugaugucc

SEQ ID NO: 1864363 - RNA, 12 nt, Homo sapiens
ugucacagccug

SEQ ID NO: 1864364 - RNA, 20 nt, Homo sapiens
uguaaaugcucgugugauuu

SEQ ID NO: 1864365 - RNA, 14 nt, Homo sapiens
auauuuaaucuuaa

SEQ ID NO: 1864366 - RNA, 20 nt, Homo sapiens
aaagguaacuaacugcuuca

SEQ ID NO: 1864367 - RNA, 21 nt, Homo sapiens
cuggcagagcccccaaggacu

SEQ ID NO: 1864368 - RNA, 19 nt, Homo sapiens
accuugucacccaggcuag

SEQ ID NO: 1864369 - RNA, 16 nt, Homo sapiens
cuuguuuacagcacua

SEQ ID NO: 1864370 - RNA, 13 nt, Homo sapiens
gcuggcugcagug

SEQ ID NO: 1864371 - RNA, 15 nt, Homo sapiens
agggagaagacugug

SEQ ID NO: 1864372 - RNA, 18 nt, Homo sapiens
gauucugagccauucaca

SEQ ID NO: 1864373 - RNA, 12 nt, Homo sapiens
gcugguccugag

SEQ ID NO: 1864374 - RNA, 18 nt, Homo sapiens
gacugacaaccucaucca

SEQ ID NO: 1864375 - RNA, 17 nt, Homo sapiens
ccugaggacuaugccau

SEQ ID NO: 1864376 - RNA, 13 nt, Homo sapiens
gggcuacacagca

SEQ ID NO: 1864377 - RNA, 16 nt, Homo sapiens
augaacacuacagaua

SEQ ID NO: 1864378 - RNA, 14 nt, Homo sapiens
aaagaagaggagaa

SEQ ID NO: 1864379 - RNA, 21 nt, Homo sapiens
gagcaucagauuuuaccuaau

SEQ ID NO: 1864380 - RNA, 18 nt, Homo sapiens
acagcuacacagaucaca

SEQ ID NO: 1864381 - RNA, 20 nt, Homo sapiens
ucuccuuugcucucuggcca

SEQ ID NO: 1864382 - RNA, 17 nt, Homo sapiens
cucccggguucaaguga

SEQ ID NO: 1864383 - RNA, 20 nt, Homo sapiens
ucaaaaccuacccuguccua

SEQ ID NO: 1864384 - RNA, 18 nt, Homo sapiens
aaagauauaagugcugua

SEQ ID NO: 1864385 - RNA, 17 nt, Homo sapiens
cagucccccaacuaccc

SEQ ID NO: 1864386 - RNA, 13 nt, Homo sapiens
caguuguaaaauu

SEQ ID NO: 1864387 - RNA, 23 nt, Homo sapiens
cccugacuaacagccucagcaca

SEQ ID NO: 1864388 - RNA, 15 nt, Homo sapiens
aucaacucauguuaa

SEQ ID NO: 1864389 - RNA, 20 nt, Homo sapiens
auuuuuaguagagacagggu

SEQ ID NO: 1864390 - RNA, 13 nt, Homo sapiens
gcaauccaaguga

SEQ ID NO: 1864391 - RNA, 15 nt, Homo sapiens
guaaauuauuucaua

SEQ ID NO: 1864392 - RNA, 24 nt, Homo sapiens
uaucaaagagaaguuacauauuag

SEQ ID NO: 1864393 - RNA, 18 nt, Homo sapiens
uccccacccauaccacag

SEQ ID NO: 1864394 - RNA, 13 nt, Homo sapiens
auauuuucacaug

SEQ ID NO: 1864395 - RNA, 16 nt, Homo sapiens
cagaggcacucaggua

SEQ ID NO: 1864396 - RNA, 15 nt, Homo sapiens
uuugcucuuacuaca

SEQ ID NO: 1864397 - RNA, 20 nt, Homo sapiens
caaacugugcuucucuauga

SEQ ID NO: 1864398 - RNA, 18 nt, Homo sapiens
ugccuuuaucucagccau

SEQ ID NO: 1864399 - RNA, 14 nt, Homo sapiens
ccuggucugugcau

SEQ ID NO: 1864400 - RNA, 16 nt, Homo sapiens
cgagcacgagcuggaa

SEQ ID NO: 1864401 - RNA, 20 nt, Homo sapiens
ugcccuacccccucccauuu

SEQ ID NO: 1864402 - RNA, 18 nt, Homo sapiens
cauccugauuuuuacuau

SEQ ID NO: 1864403 - RNA, 13 nt, Homo sapiens
gcacgguggugcc

SEQ ID NO: 1864404 - RNA, 14 nt, Homo sapiens
gacacuucucagga

SEQ ID NO: 1864405 - RNA, 19 nt, Homo sapiens
acuuugaaaauauauaccg

SEQ ID NO: 1864406 - RNA, 21 nt, Homo sapiens
agccagugcggcagguucaca

SEQ ID NO: 1864407 - RNA, 14 nt, Homo sapiens
aaugcagcuuucaa

SEQ ID NO: 1864408 - RNA, 15 nt, Homo sapiens
acuguguaaccagca

SEQ ID NO: 1864409 - RNA, 15 nt, Homo sapiens
gaauccuagcacuug

SEQ ID NO: 1864410 - RNA, 19 nt, Homo sapiens
gaagaaaccuggaaccaga

SEQ ID NO: 1864411 - RNA, 18 nt, Homo sapiens
cuuggccucccaaagugu

SEQ ID NO: 1864412 - RNA, 17 nt, Homo sapiens
aggaagggaaagccaga

SEQ ID NO: 1864413 - RNA, 20 nt, Homo sapiens
aaagauuugugguaacugaa

SEQ ID NO: 1864414 - RNA, 13 nt, Homo sapiens
ucacaagcaugaa

SEQ ID NO: 1864415 - RNA, 21 nt, Homo sapiens
ucuguuuuuuaaaugaucaug

SEQ ID NO: 1864416 - RNA, 22 nt, Homo sapiens
uccagaagauagcuucacccca

SEQ ID NO: 1864417 - RNA, 17 nt, Homo sapiens
gucccaagucuccagag

SEQ ID NO: 1864418 - RNA, 16 nt, Homo sapiens
cgaauagccacugcau

SEQ ID NO: 1864419 - RNA, 19 nt, Homo sapiens
acugcuggagucuggcuuu

SEQ ID NO: 1864420 - RNA, 20 nt, Homo sapiens
augaaaaccacccuaucauc

SEQ ID NO: 1864421 - RNA, 17 nt, Homo sapiens
uguuagacucuggucau

SEQ ID NO: 1864422 - RNA, 18 nt, Homo sapiens
ggaacacauaagaacugu

SEQ ID NO: 1864423 - RNA, 20 nt, Homo sapiens
ucugaauuguucuaaaugga

SEQ ID NO: 1864424 - RNA, 22 nt, Homo sapiens
uuacaguguagaguaacacaua

SEQ ID NO: 1864425 - RNA, 12 nt, Homo sapiens
ucucacuccagg

SEQ ID NO: 1864426 - RNA, 20 nt, Homo sapiens
uacuugauauaauuacuuaa

SEQ ID NO: 1864427 - RNA, 13 nt, Homo sapiens
gcucuuauuauau

SEQ ID NO: 1864428 - RNA, 20 nt, Homo sapiens
uggcaaguuugcagauguca

SEQ ID NO: 1864429 - RNA, 21 nt, Homo sapiens
aggcuacagagaagccuucaa

SEQ ID NO: 1864430 - RNA, 22 nt, Homo sapiens
cucacucuuuagauauuuacau

SEQ ID NO: 1864431 - RNA, 20 nt, Homo sapiens
ugccucccggguucaagcaa

SEQ ID NO: 1864432 - RNA, 20 nt, Homo sapiens
acuccucuccuggaucaaaa

SEQ ID NO: 1864433 - RNA, 10 nt, Homo sapiens
agauagucac

SEQ ID NO: 1864434 - RNA, 17 nt, Homo sapiens
ccacagcuucugcagca

SEQ ID NO: 1864435 - RNA, 22 nt, Homo sapiens
gaaaguuucagauuugccauuc

SEQ ID NO: 1864436 - RNA, 22 nt, Homo sapiens
uaccauagcuacaucaguuuga

SEQ ID NO: 1864437 - RNA, 15 nt, Homo sapiens
cucccuuguccuccu

SEQ ID NO: 1864438 - RNA, 15 nt, Homo sapiens
augcucugugacaag

SEQ ID NO: 1864439 - RNA, 17 nt, Homo sapiens
cacccaucacgugugau

SEQ ID NO: 1864440 - RNA, 19 nt, Homo sapiens
acgcuugcuuuagcacagg

SEQ ID NO: 1864441 - RNA, 16 nt, Homo sapiens
cuuccucaaauacaug

SEQ ID NO: 1864442 - RNA, 19 nt, Homo sapiens
uggggacugcauuggacug

SEQ ID NO: 1864443 - RNA, 23 nt, Homo sapiens
ucacucaacaaaagugcuuugga

SEQ ID NO: 1864444 - RNA, 20 nt, Homo sapiens
aucaaaacagagaaagcaga

SEQ ID NO: 1864445 - RNA, 22 nt, Homo sapiens
aacuguguaacugcccaaagca

SEQ ID NO: 1864446 - RNA, 15 nt, Homo sapiens
caacugauugcaaca

SEQ ID NO: 1864447 - RNA, 17 nt, Homo sapiens
gaaggcccacugaggca

SEQ ID NO: 1864448 - RNA, 22 nt, Homo sapiens
uuauuuccccagccacaggcca

SEQ ID NO: 1864449 - RNA, 16 nt, Homo sapiens
cuuccuggucuuugaa

SEQ ID NO: 1864450 - RNA, 17 nt, Homo sapiens
ugcucauugcuuucuaa

SEQ ID NO: 1864451 - RNA, 16 nt, Homo sapiens
gaauagaaccaaccca

SEQ ID NO: 1864452 - RNA, 21 nt, Homo sapiens
gccaugagguucggcacccag

SEQ ID NO: 1864453 - RNA, 21 nt, Homo sapiens
auaagaauuuuucagcacuua

SEQ ID NO: 1864454 - RNA, 20 nt, Homo sapiens
uaaaaacaguuuuccaaaua

SEQ ID NO: 1864455 - RNA, 22 nt, Homo sapiens
aaacaauuugacuuuuguucca

SEQ ID NO: 1864456 - RNA, 17 nt, Homo sapiens
acuuccuguguacucuu

SEQ ID NO: 1864457 - RNA, 16 nt, Homo sapiens
cuucucggcucaggcu

SEQ ID NO: 1864458 - RNA, 21 nt, Homo sapiens
cucggcacacacugugcccca

SEQ ID NO: 1864459 - RNA, 16 nt, Homo sapiens
aguggagagaagcucu

SEQ ID NO: 1864460 - RNA, 19 nt, Homo sapiens
guccucucuguugccuuuu

SEQ ID NO: 1864461 - RNA, 21 nt, Homo sapiens
auccuagcacuugucucagga

SEQ ID NO: 1864462 - RNA, 16 nt, Homo sapiens
aagagugauugcagcu

SEQ ID NO: 1864463 - RNA, 18 nt, Homo sapiens
aggccaggccagcugccu

SEQ ID NO: 1864464 - RNA, 17 nt, Homo sapiens
aaauauccaaagacugu

SEQ ID NO: 1864465 - RNA, 14 nt, Homo sapiens
acugauucucuaca

SEQ ID NO: 1864466 - RNA, 18 nt, Homo sapiens
ugcccagaauaaguuauu

SEQ ID NO: 1864467 - RNA, 21 nt, Homo sapiens
aaaucuuguuuguuacuguca

SEQ ID NO: 1864468 - RNA, 18 nt, Homo sapiens
ccaaguauauaugaauga

SEQ ID NO: 1864469 - RNA, 14 nt, Homo sapiens
gucugcgugugauu

SEQ ID NO: 1864470 - RNA, 21 nt, Homo sapiens
gucugaaaagugaagacagaa

SEQ ID NO: 1864471 - RNA, 18 nt, Homo sapiens
uauugcauuuauauguac

SEQ ID NO: 1864472 - RNA, 20 nt, Homo sapiens
gcauuuuuguaaugagccau

SEQ ID NO: 1864473 - RNA, 16 nt, Homo sapiens
agcugaauugagcuag

SEQ ID NO: 1864474 - RNA, 17 nt, Homo sapiens
uguaagguacuuucaua

SEQ ID NO: 1864475 - RNA, 15 nt, Homo sapiens
guaccaaagcuguuu

SEQ ID NO: 1864476 - RNA, 16 nt, Homo sapiens
cuuagcagcuaucucu

SEQ ID NO: 1864477 - RNA, 20 nt, Homo sapiens
augguauaaacaggagacag

SEQ ID NO: 1864478 - RNA, 21 nt, Homo sapiens
aagggagaacuugaaacagau

SEQ ID NO: 1864479 - RNA, 14 nt, Homo sapiens
uuuucagacugcuu

SEQ ID NO: 1864480 - RNA, 22 nt, Homo sapiens
acuuuaccaaaugaaaugccaa

SEQ ID NO: 1864481 - RNA, 21 nt, Homo sapiens
gaaguuagccuuuaucuacca

SEQ ID NO: 1864482 - RNA, 21 nt, Homo sapiens
caacuugccaaaauguuggcu

SEQ ID NO: 1864483 - RNA, 22 nt, Homo sapiens
cgauuucacaguguguuuguga

SEQ ID NO: 1864484 - RNA, 20 nt, Homo sapiens
uuggauucagaaccaagacc

SEQ ID NO: 1864485 - RNA, 14 nt, Homo sapiens
gcaggcacaugagg

SEQ ID NO: 1864486 - RNA, 14 nt, Homo sapiens
caugcccagcugcu

SEQ ID NO: 1864487 - RNA, 21 nt, Homo sapiens
ggcugucaaugggaccugugg

SEQ ID NO: 1864488 - RNA, 12 nt, Homo sapiens
cuggaagccauc

SEQ ID NO: 1864489 - RNA, 13 nt, Homo sapiens
ucucccuccaugg

SEQ ID NO: 1864490 - RNA, 18 nt, Homo sapiens
cagacacaugcuauguuc

SEQ ID NO: 1864491 - RNA, 21 nt, Homo sapiens
cgaauggggcgaucaagucca

SEQ ID NO: 1864492 - RNA, 15 nt, Homo sapiens
gaaauuagggcucua

SEQ ID NO: 1864493 - RNA, 12 nt, Homo sapiens
gagugacaccca

SEQ ID NO: 1864494 - RNA, 17 nt, Homo sapiens
ugagaaguuacuuucca

SEQ ID NO: 1864495 - RNA, 18 nt, Homo sapiens
cacucauuccuucacuca

SEQ ID NO: 1864496 - RNA, 22 nt, Homo sapiens
cuguguccucgcacugcccagg

SEQ ID NO: 1864497 - RNA, 15 nt, Homo sapiens
ucuugagggaguuca

SEQ ID NO: 1864498 - RNA, 19 nt, Homo sapiens
acuacucccucaaagcaca

SEQ ID NO: 1864499 - RNA, 14 nt, Homo sapiens
aucuaagacauuca

SEQ ID NO: 1864500 - RNA, 15 nt, Homo sapiens
ggccuccauccucau

SEQ ID NO: 1864501 - RNA, 15 nt, Homo sapiens
gaaugacacuguuca

SEQ ID NO: 1864502 - RNA, 18 nt, Homo sapiens
cuucuuccugggucuuca

SEQ ID NO: 1864503 - RNA, 21 nt, Homo sapiens
auucugugccuccaggaccag

SEQ ID NO: 1864504 - RNA, 22 nt, Homo sapiens
gaccuugcugauggugacauug

SEQ ID NO: 1864505 - RNA, 16 nt, Homo sapiens
cagguccccagacucc

SEQ ID NO: 1864506 - RNA, 22 nt, Homo sapiens
uucccaggacccaggucugcug

SEQ ID NO: 1864507 - RNA, 16 nt, Homo sapiens
gccggccggaccucug

SEQ ID NO: 1864508 - RNA, 21 nt, Homo sapiens
uaaacaugucugcccccaugg

SEQ ID NO: 1864509 - RNA, 16 nt, Homo sapiens
ccacacccucacugcu

SEQ ID NO: 1864510 - RNA, 18 nt, Homo sapiens
cuugaccgugaggccaga

SEQ ID NO: 1864511 - RNA, 21 nt, Homo sapiens
caaggggaagccuccugucuc

SEQ ID NO: 1864512 - RNA, 19 nt, Homo sapiens
ccaccccaugaggcucacu

SEQ ID NO: 1864513 - RNA, 23 nt, Homo sapiens
ggaaagaguauuaagagcaauuc

SEQ ID NO: 1864514 - RNA, 18 nt, Homo sapiens
gcuaucccuucucagaaa

SEQ ID NO: 1864515 - RNA, 23 nt, Homo sapiens
ucugugggccccucaacagccaa

SEQ ID NO: 1864516 - RNA, 19 nt, Homo sapiens
cuaguauucgcuguguuca

SEQ ID NO: 1864517 - RNA, 21 nt, Homo sapiens
auggagaaugcaccauacuca

SEQ ID NO: 1864518 - RNA, 17 nt, Homo sapiens
ucuuugccuuuaucucu

SEQ ID NO: 1864519 - RNA, 23 nt, Homo sapiens
aucaucucuuuucccacucccuu

SEQ ID NO: 1864520 - RNA, 21 nt, Homo sapiens
guccaguccuuuguugcuguu

SEQ ID NO: 1864521 - RNA, 19 nt, Homo sapiens
cagugcugccaguuuccca

SEQ ID NO: 1864522 - RNA, 16 nt, Homo sapiens
augacauuacaauccu

SEQ ID NO: 1864523 - RNA, 22 nt, Homo sapiens
cuagaaugcaaguauccugcga

SEQ ID NO: 1864524 - RNA, 19 nt, Homo sapiens
cugagggacaggaucuaua

SEQ ID NO: 1864525 - RNA, 20 nt, Homo sapiens
uugaaauagugucugaugaa

SEQ ID NO: 1864526 - RNA, 19 nt, Homo sapiens
aguuucccauaacaaccug

SEQ ID NO: 1864527 - RNA, 16 nt, Homo sapiens
ccaugaagccuuuuga

SEQ ID NO: 1864528 - RNA, 18 nt, Homo sapiens
aauauuaucuaacagaca

SEQ ID NO: 1864529 - RNA, 14 nt, Homo sapiens
agcccucauuuuua

SEQ ID NO: 1864530 - RNA, 18 nt, Homo sapiens
auuguagaaaagcuauaa

SEQ ID NO: 1864531 - RNA, 16 nt, Homo sapiens
uugcaaauacauggau

SEQ ID NO: 1864532 - RNA, 20 nt, Homo sapiens
cuguacuguucugugucuuu

SEQ ID NO: 1864533 - RNA, 13 nt, Homo sapiens
ggcauccugugug

SEQ ID NO: 1864534 - RNA, 19 nt, Homo sapiens
cauggugaaacccugucuc

SEQ ID NO: 1864535 - RNA, 16 nt, Homo sapiens
agcuuucuccuucaga

SEQ ID NO: 1864536 - RNA, 19 nt, Homo sapiens
aauaagauuaaugaccuga

SEQ ID NO: 1864537 - RNA, 15 nt, Homo sapiens
gucgcgcgucuccca

SEQ ID NO: 1864538 - RNA, 15 nt, Homo sapiens
gugacagggccagug

SEQ ID NO: 1864539 - RNA, 20 nt, Homo sapiens
agcaagcaccugggugugcu

SEQ ID NO: 1864540 - RNA, 12 nt, Homo sapiens
cucuaagcugug

SEQ ID NO: 1864541 - RNA, 15 nt, Homo sapiens
cuuugacacucugca

SEQ ID NO: 1864542 - RNA, 15 nt, Homo sapiens
aaucaacaaaccaca

SEQ ID NO: 1864543 - RNA, 14 nt, Homo sapiens
guauuuugccagac

SEQ ID NO: 1864544 - RNA, 22 nt, Homo sapiens
gcccagcauggaaucugaugaa

SEQ ID NO: 1864545 - RNA, 15 nt, Homo sapiens
uaaaauuguaugaaa

SEQ ID NO: 1864546 - RNA, 23 nt, Homo sapiens
uuuuacagaagugaaagugaggu

SEQ ID NO: 1864547 - RNA, 22 nt, Homo sapiens
uccaaaaggcccuuuucagggc

SEQ ID NO: 1864548 - RNA, 20 nt, Homo sapiens
ucucuuaccugggaccucac

SEQ ID NO: 1864549 - RNA, 19 nt, Homo sapiens
ucuaggcuggaagagccaa

SEQ ID NO: 1864550 - RNA, 23 nt, Homo sapiens
gccccacccuggaaugccaaugu

SEQ ID NO: 1864551 - RNA, 10 nt, Homo sapiens
ugcuaaaaaa

SEQ ID NO: 1864552 - RNA, 13 nt, Homo sapiens
ccagcauccagcu

SEQ ID NO: 1864553 - RNA, 17 nt, Homo sapiens
ccggggugguccaaugg

SEQ ID NO: 1864554 - RNA, 19 nt, Homo sapiens
ucaggugaaaauccaucuc

SEQ ID NO: 1864555 - RNA, 12 nt, Homo sapiens
uaaaacugaugu

SEQ ID NO: 1864556 - RNA, 11 nt, Homo sapiens
ucacacaaagg

SEQ ID NO: 1864557 - RNA, 18 nt, Homo sapiens
uuucauaaacuucaggga

SEQ ID NO: 1864558 - RNA, 20 nt, Homo sapiens
uaaugguaucuguuacucca

SEQ ID NO: 1864559 - RNA, 16 nt, Homo sapiens
ggccugagccaagcua

SEQ ID NO: 1864560 - RNA, 13 nt, Homo sapiens
gguccuccugucc

SEQ ID NO: 1864561 - RNA, 19 nt, Homo sapiens
ccaaugaaaacagucccau

SEQ ID NO: 1864562 - RNA, 16 nt, Homo sapiens
uugaaauaccagugaa

SEQ ID NO: 1864563 - RNA, 19 nt, Homo sapiens
ggaugcuccgacagcgucu

SEQ ID NO: 1864564 - RNA, 21 nt, Homo sapiens
ugacucugaguccacugcucc

SEQ ID NO: 1864565 - RNA, 12 nt, Homo sapiens
guugacugcugc

SEQ ID NO: 1864566 - RNA, 17 nt, Homo sapiens
ugugauguuuggacaca

SEQ ID NO: 1864567 - RNA, 13 nt, Homo sapiens
ucaaucuuuucau

SEQ ID NO: 1864568 - RNA, 14 nt, Homo sapiens
aaucugacuuuuuc

SEQ ID NO: 1864569 - RNA, 12 nt, Homo sapiens
ucaguaccccau

SEQ ID NO: 1864570 - RNA, 18 nt, Homo sapiens
aucuaucccagaguacaa

SEQ ID NO: 1864571 - RNA, 22 nt, Homo sapiens
gucuuucggggugcuccugugg

SEQ ID NO: 1864572 - RNA, 15 nt, Homo sapiens
cagggugcaguguga

SEQ ID NO: 1864573 - RNA, 22 nt, Homo sapiens
cacucuuauugcccacgcugga

SEQ ID NO: 1864574 - RNA, 17 nt, Homo sapiens
uccuacagauagucaaa

SEQ ID NO: 1864575 - RNA, 17 nt, Homo sapiens
aggaaauugaauuucca

SEQ ID NO: 1864576 - RNA, 22 nt, Homo sapiens
agaacugcccagccucagcuga

SEQ ID NO: 1864577 - RNA, 17 nt, Homo sapiens
gaggaaaauaguggcag

SEQ ID NO: 1864578 - RNA, 16 nt, Homo sapiens
auggagaacaacccaa

SEQ ID NO: 1864579 - RNA, 16 nt, Homo sapiens
gacagauucuucacug

SEQ ID NO: 1864580 - RNA, 23 nt, Homo sapiens
ggauacgcaucagacagauggaa

SEQ ID NO: 1864581 - RNA, 22 nt, Homo sapiens
cugaucccccauagguggcuga

SEQ ID NO: 1864582 - RNA, 14 nt, Homo sapiens
uucaacauauaccu

SEQ ID NO: 1864583 - RNA, 19 nt, Homo sapiens
uaaaccagguuugcaccua

SEQ ID NO: 1864584 - RNA, 13 nt, Homo sapiens
cauagcuuucaca

SEQ ID NO: 1864585 - RNA, 14 nt, Homo sapiens
acaugccaauuuca

SEQ ID NO: 1864586 - RNA, 13 nt, Homo sapiens
augcagagaagaa

SEQ ID NO: 1864587 - RNA, 20 nt, Homo sapiens
auagauauaugcucugcaug

SEQ ID NO: 1864588 - RNA, 21 nt, Homo sapiens
uacauucgaaggaaccugugu

SEQ ID NO: 1864589 - RNA, 14 nt, Homo sapiens
uaaaguagcuguaa

SEQ ID NO: 1864590 - RNA, 20 nt, Homo sapiens
cucuauugagccaagaccaa

SEQ ID NO: 1864591 - RNA, 23 nt, Homo sapiens
accugucuuggccucccaaagug

SEQ ID NO: 1864592 - RNA, 19 nt, Homo sapiens
uuaagccuugacacacugu

SEQ ID NO: 1864593 - RNA, 19 nt, Homo sapiens
uccuggcuggccgcaugac

SEQ ID NO: 1864594 - RNA, 15 nt, Homo sapiens
uaucuuggcuuugcc

SEQ ID NO: 1864595 - RNA, 18 nt, Homo sapiens
gauuuccuuucuguggug

SEQ ID NO: 1864596 - RNA, 17 nt, Homo sapiens
ugugcaaaccuguucau

SEQ ID NO: 1864597 - RNA, 13 nt, Homo sapiens
uguuuuaucauua

SEQ ID NO: 1864598 - RNA, 19 nt, Homo sapiens
auuuuugaauugacugaga

SEQ ID NO: 1864599 - RNA, 13 nt, Homo sapiens
ccacauaagcacu

SEQ ID NO: 1864600 - RNA, 10 nt, Homo sapiens
gaugaccuca

SEQ ID NO: 1864601 - RNA, 16 nt, Homo sapiens
agacccaugucagcaa

SEQ ID NO: 1864602 - RNA, 18 nt, Homo sapiens
cauucaacuggaacauuu

SEQ ID NO: 1864603 - RNA, 15 nt, Homo sapiens
agcucgguggaccca

SEQ ID NO: 1864604 - RNA, 18 nt, Homo sapiens
aucuguauaauacuuugu

SEQ ID NO: 1864605 - RNA, 15 nt, Homo sapiens
gucucgaacuccugg

SEQ ID NO: 1864606 - RNA, 15 nt, Homo sapiens
aaguaaggcaugguu

SEQ ID NO: 1864607 - RNA, 23 nt, Homo sapiens
gaauccaguccagauauuucaca

SEQ ID NO: 1864608 - RNA, 22 nt, Homo sapiens
gaaggggcaaagaaaagccaga

SEQ ID NO: 1864609 - RNA, 14 nt, Homo sapiens
ugcgugugugcaag

SEQ ID NO: 1864610 - RNA, 22 nt, Homo sapiens
uuuagagugaaauauaugcuau

SEQ ID NO: 1864611 - RNA, 15 nt, Homo sapiens
uucuugggucugccc

SEQ ID NO: 1864612 - RNA, 19 nt, Homo sapiens
uccauuuacccuucuuuuc

SEQ ID NO: 1864613 - RNA, 11 nt, Homo sapiens
agagacucaga

SEQ ID NO: 1864614 - RNA, 16 nt, Homo sapiens
gagcaggaagcauuca

SEQ ID NO: 1864615 - RNA, 23 nt, Homo sapiens
gagguuugucaacacaaagacau

SEQ ID NO: 1864616 - RNA, 14 nt, Homo sapiens
gaaaauagaacaac

SEQ ID NO: 1864617 - RNA, 17 nt, Homo sapiens
gcugagggagacccccc

SEQ ID NO: 1864618 - RNA, 22 nt, Homo sapiens
ccccgggaaugcgcccaccaag

SEQ ID NO: 1864619 - RNA, 13 nt, Homo sapiens
uaccguuuccuua

SEQ ID NO: 1864620 - RNA, 22 nt, Homo sapiens
caagagagggccaugcaauuca

SEQ ID NO: 1864621 - RNA, 16 nt, Homo sapiens
uauauaaccacauuuc

SEQ ID NO: 1864622 - RNA, 17 nt, Homo sapiens
acagaacauauguugca

SEQ ID NO: 1864623 - RNA, 19 nt, Homo sapiens
ugacaaauagcauacacca

SEQ ID NO: 1864624 - RNA, 19 nt, Homo sapiens
ccaucacccucagcaguuc

SEQ ID NO: 1864625 - RNA, 22 nt, Homo sapiens
aagcaguuucuauuucuuuaaa

SEQ ID NO: 1864626 - RNA, 13 nt, Homo sapiens
aaagcagugcagu

SEQ ID NO: 1864627 - RNA, 22 nt, Homo sapiens
ccucguuauuguuguugccaaa

SEQ ID NO: 1864628 - RNA, 14 nt, Homo sapiens
agcauugcuuucug

SEQ ID NO: 1864629 - RNA, 23 nt, Homo sapiens
gacaccugccuucaaagccacug

SEQ ID NO: 1864630 - RNA, 19 nt, Homo sapiens
cuucucuacagacuccaaa

SEQ ID NO: 1864631 - RNA, 13 nt, Homo sapiens
uaucuguacugaa

SEQ ID NO: 1864632 - RNA, 14 nt, Homo sapiens
cccuuucagggcca

SEQ ID NO: 1864633 - RNA, 22 nt, Homo sapiens
cuuugcuacgaagaaagacucc

SEQ ID NO: 1864634 - RNA, 17 nt, Homo sapiens
augcuuaaucugaggau

SEQ ID NO: 1864635 - RNA, 14 nt, Homo sapiens
cugauggugacauu

SEQ ID NO: 1864636 - RNA, 14 nt, Homo sapiens
caguaugugucuag

SEQ ID NO: 1864637 - RNA, 16 nt, Homo sapiens
gccugcccgcacccug

SEQ ID NO: 1864638 - RNA, 17 nt, Homo sapiens
auugcagcaagcaauaa

SEQ ID NO: 1864639 - RNA, 23 nt, Homo sapiens
caggagcucuccacccacucaca

SEQ ID NO: 1864640 - RNA, 18 nt, Homo sapiens
cagauauuugaaucuuuc

SEQ ID NO: 1864641 - RNA, 22 nt, Homo sapiens
ucaagcccugcagucacagcua

SEQ ID NO: 1864642 - RNA, 19 nt, Homo sapiens
gggaaagcccagaaaagga

SEQ ID NO: 1864643 - RNA, 19 nt, Homo sapiens
aguauacauuuaguuaaca

SEQ ID NO: 1864644 - RNA, 17 nt, Homo sapiens
ugugugguauucaacua

SEQ ID NO: 1864645 - RNA, 19 nt, Homo sapiens
uuuguauuaauaaagcauu

SEQ ID NO: 1864646 - RNA, 15 nt, Homo sapiens
ugggcuuggggacag

SEQ ID NO: 1864647 - RNA, 18 nt, Homo sapiens
gacuauguuucuauucua

SEQ ID NO: 1864648 - RNA, 20 nt, Homo sapiens
cccagcuacucaggagguug

SEQ ID NO: 1864649 - RNA, 20 nt, Homo sapiens
gaauuuucagcaaaguacaa

SEQ ID NO: 1864650 - RNA, 21 nt, Homo sapiens
ucccagaggagccaccaguuc

SEQ ID NO: 1864651 - RNA, 14 nt, Homo sapiens
caaaacccuuaaaa

SEQ ID NO: 1864652 - RNA, 20 nt, Homo sapiens
ggcagcuggugcugugugac

SEQ ID NO: 1864653 - RNA, 13 nt, Homo sapiens
aauucagcuugag

SEQ ID NO: 1864654 - RNA, 15 nt, Homo sapiens
ugaugcagacacaga

SEQ ID NO: 1864655 - RNA, 21 nt, Homo sapiens
auuucuucaagugaguggcau

SEQ ID NO: 1864656 - RNA, 16 nt, Homo sapiens
gaccuggauguuauau

SEQ ID NO: 1864657 - RNA, 21 nt, Homo sapiens
uggccuccucccuuagcuccc

SEQ ID NO: 1864658 - RNA, 20 nt, Homo sapiens
auggaccaauuagcauucca

SEQ ID NO: 1864659 - RNA, 16 nt, Homo sapiens
cuggguuggugcacag

SEQ ID NO: 1864660 - RNA, 22 nt, Homo sapiens
cuccaggaugaguuacuugaaa

SEQ ID NO: 1864661 - RNA, 13 nt, Homo sapiens
aguaagugcuuuu

SEQ ID NO: 1864662 - RNA, 18 nt, Homo sapiens
cugugggauaucacauca

SEQ ID NO: 1864663 - RNA, 23 nt, Homo sapiens
gugauugaaccagcucaucucca

SEQ ID NO: 1864664 - RNA, 15 nt, Homo sapiens
agauauucuuuacaa

SEQ ID NO: 1864665 - RNA, 15 nt, Homo sapiens
gcuuuaugcaaauac

SEQ ID NO: 1864666 - RNA, 21 nt, Homo sapiens
uauaaucccagcuacuuggga

SEQ ID NO: 1864667 - RNA, 16 nt, Homo sapiens
aguugugacagucacu

SEQ ID NO: 1864668 - RNA, 14 nt, Homo sapiens
uccaaauaagugca

SEQ ID NO: 1864669 - RNA, 16 nt, Homo sapiens
agcagguaggaggcaa

SEQ ID NO: 1864670 - RNA, 24 nt, Homo sapiens
gguacagguauauuuugacgucac

SEQ ID NO: 1864671 - RNA, 22 nt, Homo sapiens
ccuucuuucaagcuucuugcca

SEQ ID NO: 1864672 - RNA, 19 nt, Homo sapiens
acuugauguuuguuugcau

SEQ ID NO: 1864673 - RNA, 20 nt, Homo sapiens
cuggggcccaggaagcccac

SEQ ID NO: 1864674 - RNA, 16 nt, Homo sapiens
auuuuaugaucuuggc

SEQ ID NO: 1864675 - RNA, 18 nt, Homo sapiens
acaauaacgauaaaagac

SEQ ID NO: 1864676 - RNA, 21 nt, Homo sapiens
uggucuguugcugccacucua

SEQ ID NO: 1864677 - RNA, 23 nt, Homo sapiens
aagacuuugauccaggugccaag

SEQ ID NO: 1864678 - RNA, 14 nt, Homo sapiens
cuuguuuucuugcc

SEQ ID NO: 1864679 - RNA, 18 nt, Homo sapiens
guaccccugauaagcaaa

SEQ ID NO: 1864680 - RNA, 19 nt, Homo sapiens
gugcaguggcgugaucucg

SEQ ID NO: 1864681 - RNA, 22 nt, Homo sapiens
cuuucauuucguauuucucaua

SEQ ID NO: 1864682 - RNA, 14 nt, Homo sapiens
auaucuggcacugu

SEQ ID NO: 1864683 - RNA, 16 nt, Homo sapiens
auacacugcauuugcu

SEQ ID NO: 1864684 - RNA, 20 nt, Homo sapiens
ugcauacuuucccucaucca

SEQ ID NO: 1864685 - RNA, 18 nt, Homo sapiens
ggacuugggcgggacaca

SEQ ID NO: 1864686 - RNA, 20 nt, Homo sapiens
guggccgugccugagcugca

SEQ ID NO: 1864687 - RNA, 20 nt, Homo sapiens
cagaagucuugucucaagaa

SEQ ID NO: 1864688 - RNA, 15 nt, Homo sapiens
agaaccaagaugcca

SEQ ID NO: 1864689 - RNA, 19 nt, Homo sapiens
ugauguaguaacacagauu

SEQ ID NO: 1864690 - RNA, 16 nt, Homo sapiens
aucccacccuggggac

SEQ ID NO: 1864691 - RNA, 22 nt, Homo sapiens
uccuaguuguucagcauggcau

SEQ ID NO: 1864692 - RNA, 21 nt, Homo sapiens
uuacucaugugcagguuuuga

SEQ ID NO: 1864693 - RNA, 15 nt, Homo sapiens
cuguagggugccauu

SEQ ID NO: 1864694 - RNA, 20 nt, Homo sapiens
cuugcacgcccaugugugag

SEQ ID NO: 1864695 - RNA, 14 nt, Homo sapiens
uccugacagcaaua

SEQ ID NO: 1864696 - RNA, 14 nt, Homo sapiens
uugcauugauucag

SEQ ID NO: 1864697 - RNA, 19 nt, Homo sapiens
gaaggcaaggcccugcccu

SEQ ID NO: 1864698 - RNA, 23 nt, Homo sapiens
ugcacugaauaaagcacgugcaa

SEQ ID NO: 1864699 - RNA, 14 nt, Homo sapiens
cuccucugugcucc

SEQ ID NO: 1864700 - RNA, 18 nt, Homo sapiens
ccuggagacaaggugcua

SEQ ID NO: 1864701 - RNA, 13 nt, Homo sapiens
ggggagugugagu

SEQ ID NO: 1864702 - RNA, 12 nt, Homo sapiens
gagacacuuuac

SEQ ID NO: 1864703 - RNA, 12 nt, Homo sapiens
uugacacugaac

SEQ ID NO: 1864704 - RNA, 15 nt, Homo sapiens
ucucuuauaauucca

SEQ ID NO: 1864705 - RNA, 18 nt, Homo sapiens
ccuguaaucccaacacuu

SEQ ID NO: 1864706 - RNA, 21 nt, Homo sapiens
ccaaaaauuuugugacauucc

SEQ ID NO: 1864707 - RNA, 15 nt, Homo sapiens
cagcggaggagacca

SEQ ID NO: 1864708 - RNA, 19 nt, Homo sapiens
cuaaaaaaaaugcaaggaa

SEQ ID NO: 1864709 - RNA, 20 nt, Homo sapiens
uugauauguaaguacuucca

SEQ ID NO: 1864710 - RNA, 23 nt, Homo sapiens
acuauuaacaacuugucuauuac

SEQ ID NO: 1864711 - RNA, 17 nt, Homo sapiens
uuaagaaugacaggcuu

SEQ ID NO: 1864712 - RNA, 16 nt, Homo sapiens
cccugaguuccuagcc

SEQ ID NO: 1864713 - RNA, 16 nt, Homo sapiens
ccucuggauucucugg

SEQ ID NO: 1864714 - RNA, 21 nt, Homo sapiens
ggaaaauggagccaugacaag

SEQ ID NO: 1864715 - RNA, 20 nt, Homo sapiens
aacucucacuccugaauuca

SEQ ID NO: 1864716 - RNA, 13 nt, Homo sapiens
auagcuugcacaa

SEQ ID NO: 1864717 - RNA, 22 nt, Homo sapiens
uaagcccuaagguccuaaggca

SEQ ID NO: 1864718 - RNA, 22 nt, Homo sapiens
gaaauuugugggcuuggggaca

SEQ ID NO: 1864719 - RNA, 22 nt, Homo sapiens
auccgcuguccagcagcugcca

SEQ ID NO: 1864720 - RNA, 13 nt, Homo sapiens
guugcacuuugua

SEQ ID NO: 1864721 - RNA, 17 nt, Homo sapiens
uggaaccaaaacccauc

SEQ ID NO: 1864722 - RNA, 19 nt, Homo sapiens
cagaguggcugcaguuaaa

SEQ ID NO: 1864723 - RNA, 20 nt, Homo sapiens
gcggcucugcccaccucucu

SEQ ID NO: 1864724 - RNA, 19 nt, Homo sapiens
aucauguccauacacuuug

SEQ ID NO: 1864725 - RNA, 14 nt, Homo sapiens
cuauacacuagaca

SEQ ID NO: 1864726 - RNA, 17 nt, Homo sapiens
ggacugcaaguggccau

SEQ ID NO: 1864727 - RNA, 18 nt, Homo sapiens
ugcuugcaauguagucaa

SEQ ID NO: 1864728 - RNA, 17 nt, Homo sapiens
auuaagaaucauugugc

SEQ ID NO: 1864729 - RNA, 13 nt, Homo sapiens
auucuuagaauau

SEQ ID NO: 1864730 - RNA, 16 nt, Homo sapiens
auucuguaagaaucaa

SEQ ID NO: 1864731 - RNA, 14 nt, Homo sapiens
gcaagagggggacc

SEQ ID NO: 1864732 - RNA, 12 nt, Homo sapiens
ucagaucacugc

SEQ ID NO: 1864733 - RNA, 21 nt, Homo sapiens
uuaugcagaauccaaaguaaa

SEQ ID NO: 1864734 - RNA, 22 nt, Homo sapiens
cucaaacuccugaccucaggca

SEQ ID NO: 1864735 - RNA, 15 nt, Homo sapiens
cugcauguuacauaa

SEQ ID NO: 1864736 - RNA, 12 nt, Homo sapiens
uaauauguauau

SEQ ID NO: 1864737 - RNA, 12 nt, Homo sapiens
uacaauguauca

SEQ ID NO: 1864738 - RNA, 22 nt, Homo sapiens
aacaaagggcacagcaucugua

SEQ ID NO: 1864739 - RNA, 13 nt, Homo sapiens
aggagaaccuguc

SEQ ID NO: 1864740 - RNA, 16 nt, Homo sapiens
gaagaggagaaaaaga

SEQ ID NO: 1864741 - RNA, 13 nt, Homo sapiens
ccauuacuacugu

SEQ ID NO: 1864742 - RNA, 13 nt, Homo sapiens
acucuaucaaaug

SEQ ID NO: 1864743 - RNA, 18 nt, Homo sapiens
gaaaaagcccuaauagca

SEQ ID NO: 1864744 - RNA, 19 nt, Homo sapiens
gaauucugaauguacacuu

SEQ ID NO: 1864745 - RNA, 19 nt, Homo sapiens
aagagcgaaacuccaucuc

SEQ ID NO: 1864746 - RNA, 19 nt, Homo sapiens
aagagcaaaacuccgucuc

SEQ ID NO: 1864747 - RNA, 12 nt, Homo sapiens
cucaagauccug

SEQ ID NO: 1864748 - RNA, 11 nt, Homo sapiens
aaaugcuuguc

SEQ ID NO: 1864749 - RNA, 20 nt, Homo sapiens
ugaaguuugccccagugcua

SEQ ID NO: 1864750 - RNA, 23 nt, Homo sapiens
ucaccauuuacgcuacaugugau

SEQ ID NO: 1864751 - RNA, 22 nt, Homo sapiens
aaaucccaguucauguugcuca

SEQ ID NO: 1864752 - RNA, 17 nt, Homo sapiens
ccaggugagaacaucca

SEQ ID NO: 1864753 - RNA, 22 nt, Homo sapiens
uauaggcuucucacggcgacca

SEQ ID NO: 1864754 - RNA, 14 nt, Homo sapiens
caccauugcugcuc

SEQ ID NO: 1864755 - RNA, 18 nt, Homo sapiens
gcaguggaacaugcaagg

SEQ ID NO: 1864756 - RNA, 23 nt, Homo sapiens
agagaccauaagagaaaccugcc

SEQ ID NO: 1864757 - RNA, 20 nt, Homo sapiens
uaguucacccccugagaucc

SEQ ID NO: 1864758 - RNA, 14 nt, Homo sapiens
aaggcuuugaguua

SEQ ID NO: 1864759 - RNA, 14 nt, Homo sapiens
ccagugagcucuuu

SEQ ID NO: 1864760 - RNA, 14 nt, Homo sapiens
cucgggagccaugu

SEQ ID NO: 1864761 - RNA, 20 nt, Homo sapiens
auaguccgucucugcuuauc

SEQ ID NO: 1864762 - RNA, 14 nt, Homo sapiens
ucacagcagccucc

SEQ ID NO: 1864763 - RNA, 19 nt, Homo sapiens
uggccucacuugauucauc

SEQ ID NO: 1864764 - RNA, 16 nt, Homo sapiens
agaagcaagaaacuuc

SEQ ID NO: 1864765 - RNA, 17 nt, Homo sapiens
cuggagcaucugacuca

SEQ ID NO: 1864766 - RNA, 20 nt, Homo sapiens
caaugcacaauuuauaauua

SEQ ID NO: 1864767 - RNA, 16 nt, Homo sapiens
ugcccucugcucuaau

SEQ ID NO: 1864768 - RNA, 12 nt, Homo sapiens
uugcacagcagc

SEQ ID NO: 1864769 - RNA, 12 nt, Homo sapiens
ucccauuuuccg

SEQ ID NO: 1864770 - RNA, 16 nt, Homo sapiens
ugaaguucaaaugccc

SEQ ID NO: 1864771 - RNA, 16 nt, Homo sapiens
cugcucagcagagccu

SEQ ID NO: 1864772 - RNA, 20 nt, Homo sapiens
cgcacaaggcugaccaagag

SEQ ID NO: 1864773 - RNA, 17 nt, Homo sapiens
auaaaaaacauauacaa

SEQ ID NO: 1864774 - RNA, 19 nt, Homo sapiens
uaccaacugggccucugau

SEQ ID NO: 1864775 - RNA, 12 nt, Homo sapiens
agaggagcucuc

SEQ ID NO: 1864776 - RNA, 18 nt, Homo sapiens
cagguggugggacacugg

SEQ ID NO: 1864777 - RNA, 14 nt, Homo sapiens
cuauaugcacuuau

SEQ ID NO: 1864778 - RNA, 16 nt, Homo sapiens
gaagcuccuccaguga

SEQ ID NO: 1864779 - RNA, 15 nt, Homo sapiens
uugugccuauauuaa

SEQ ID NO: 1864780 - RNA, 14 nt, Homo sapiens
ggggaaauggugcc

SEQ ID NO: 1864781 - RNA, 16 nt, Homo sapiens
uguuuuauaguauuaa

SEQ ID NO: 1864782 - RNA, 16 nt, Homo sapiens
guggcugugacaucua

SEQ ID NO: 1864783 - RNA, 21 nt, Homo sapiens
aaucuuggagucaaaaggcaa

SEQ ID NO: 1864784 - RNA, 17 nt, Homo sapiens
cugcaggccacuuaccu

SEQ ID NO: 1864785 - RNA, 12 nt, Homo sapiens
ggauaugagaug

SEQ ID NO: 1864786 - RNA, 21 nt, Homo sapiens
uaaagauauggagaauugcug

SEQ ID NO: 1864787 - RNA, 13 nt, Homo sapiens
aauaguuccauuu

SEQ ID NO: 1864788 - RNA, 12 nt, Homo sapiens
uaaaugugccua

SEQ ID NO: 1864789 - RNA, 23 nt, Homo sapiens
uucugacugauccugaacaagaa

SEQ ID NO: 1864790 - RNA, 13 nt, Homo sapiens
ucucuccccucaa

SEQ ID NO: 1864791 - RNA, 17 nt, Homo sapiens
uuaucaaauuugccaug

SEQ ID NO: 1864792 - RNA, 17 nt, Homo sapiens
gccaagaacuugcaaua

SEQ ID NO: 1864793 - RNA, 20 nt, Homo sapiens
aaucccuccccgugacugca

SEQ ID NO: 1864794 - RNA, 20 nt, Homo sapiens
auuuuaauagagaacuucua

SEQ ID NO: 1864795 - RNA, 14 nt, Homo sapiens
ccuacucagacugu

SEQ ID NO: 1864796 - RNA, 18 nt, Homo sapiens
uguauaucuuugcacuga

SEQ ID NO: 1864797 - RNA, 12 nt, Homo sapiens
gaauguguuuca

SEQ ID NO: 1864798 - RNA, 14 nt, Homo sapiens
auguauaugcacuu

SEQ ID NO: 1864799 - RNA, 22 nt, Homo sapiens
gaaggagagcucuuugugaaug

SEQ ID NO: 1864800 - RNA, 22 nt, Homo sapiens
ggucccuggagggcaagcccug

SEQ ID NO: 1864801 - RNA, 18 nt, Homo sapiens
caauaaacuccuacuaaa

SEQ ID NO: 1864802 - RNA, 17 nt, Homo sapiens
uggguucuccuguucuc

SEQ ID NO: 1864803 - RNA, 12 nt, Homo sapiens
acaaaaauuuca

SEQ ID NO: 1864804 - RNA, 21 nt, Homo sapiens
aacuaagccaacuugauguga

SEQ ID NO: 1864805 - RNA, 23 nt, Homo sapiens
ccggcgaaauaaaaucagaguug

SEQ ID NO: 1864806 - RNA, 11 nt, Homo sapiens
gaaaugaacuu

SEQ ID NO: 1864807 - RNA, 15 nt, Homo sapiens
cagaccauucaggac

SEQ ID NO: 1864808 - RNA, 16 nt, Homo sapiens
acaggagaaacacuug

SEQ ID NO: 1864809 - RNA, 18 nt, Homo sapiens
ccgagaaggcggaaaccc

SEQ ID NO: 1864810 - RNA, 19 nt, Homo sapiens
guuccuguuugaugugaca

SEQ ID NO: 1864811 - RNA, 13 nt, Homo sapiens
aaccccuuuccac

SEQ ID NO: 1864812 - RNA, 21 nt, Homo sapiens
cagcagagccuggaagacacc

SEQ ID NO: 1864813 - RNA, 23 nt, Homo sapiens
guugauucccagcauucaguggu

SEQ ID NO: 1864814 - RNA, 19 nt, Homo sapiens
cugccaguucccucccuca

SEQ ID NO: 1864815 - RNA, 14 nt, Homo sapiens
agacuagugccgua

SEQ ID NO: 1864816 - RNA, 17 nt, Homo sapiens
gcaggggucucaugugg

SEQ ID NO: 1864817 - RNA, 19 nt, Homo sapiens
aaacaagacugccucccuc

SEQ ID NO: 1864818 - RNA, 19 nt, Homo sapiens
gagggauuucuuugcugua

SEQ ID NO: 1864819 - RNA, 19 nt, Homo sapiens
gauaugaagaaucugcucu

SEQ ID NO: 1864820 - RNA, 15 nt, Homo sapiens
cauccuuucuuuuaa

SEQ ID NO: 1864821 - RNA, 12 nt, Homo sapiens
gaagcuacccaa

SEQ ID NO: 1864822 - RNA, 23 nt, Homo sapiens
gaccaccaccccaacaaaccauc

SEQ ID NO: 1864823 - RNA, 18 nt, Homo sapiens
aggaugauaaaagcacuu

SEQ ID NO: 1864824 - RNA, 18 nt, Homo sapiens
aguaaaaaauauaugugg

SEQ ID NO: 1864825 - RNA, 20 nt, Homo sapiens
cgcuccuauugaaagaccag

SEQ ID NO: 1864826 - RNA, 19 nt, Homo sapiens
acuuuccccaguacugagg

SEQ ID NO: 1864827 - RNA, 17 nt, Homo sapiens
ugaguguugcucucuag

SEQ ID NO: 1864828 - RNA, 19 nt, Homo sapiens
uuccuuaguuuucuaguaa

SEQ ID NO: 1864829 - RNA, 14 nt, Homo sapiens
ugccagauccucuu

SEQ ID NO: 1864830 - RNA, 14 nt, Homo sapiens
augaguaugugcac

SEQ ID NO: 1864831 - RNA, 13 nt, Homo sapiens
caggcauugccaa

SEQ ID NO: 1864832 - RNA, 18 nt, Homo sapiens
auaugaaagaaaaaugga

SEQ ID NO: 1864833 - RNA, 18 nt, Homo sapiens
cuauucuugcugaugaaa

SEQ ID NO: 1864834 - RNA, 15 nt, Homo sapiens
auuguagugcaaaau

SEQ ID NO: 1864835 - RNA, 14 nt, Homo sapiens
aagaggacugagac

SEQ ID NO: 1864836 - RNA, 13 nt, Homo sapiens
aaccuuaguuuca

SEQ ID NO: 1864837 - RNA, 15 nt, Homo sapiens
agaccugcaugguca

SEQ ID NO: 1864838 - RNA, 13 nt, Homo sapiens
uuuuaaauuguca

SEQ ID NO: 1864839 - RNA, 14 nt, Homo sapiens
aaauaaaagaaaca

SEQ ID NO: 1864840 - RNA, 18 nt, Homo sapiens
aagcaacccaaauguuca

SEQ ID NO: 1864841 - RNA, 19 nt, Homo sapiens
cuacccaucuuaaaaacaa

SEQ ID NO: 1864842 - RNA, 18 nt, Homo sapiens
gcugagccuucugaugag

SEQ ID NO: 1864843 - RNA, 20 nt, Homo sapiens
gccuucuuacaacagagaug

SEQ ID NO: 1864844 - RNA, 21 nt, Homo sapiens
gucacuuuguuuuacugucuu

SEQ ID NO: 1864845 - RNA, 14 nt, Homo sapiens
aacagaacuaugga

SEQ ID NO: 1864846 - RNA, 15 nt, Homo sapiens
acuauuaccaugaga

SEQ ID NO: 1864847 - RNA, 18 nt, Homo sapiens
uaaaauuaauuugugcau

SEQ ID NO: 1864848 - RNA, 19 nt, Homo sapiens
ccauauuagaaaacuuugu

SEQ ID NO: 1864849 - RNA, 18 nt, Homo sapiens
aagugauucccugcacac

SEQ ID NO: 1864850 - RNA, 14 nt, Homo sapiens
auaucaugaaagaa

SEQ ID NO: 1864851 - RNA, 22 nt, Homo sapiens
gguuuauuccagagaagccagg

SEQ ID NO: 1864852 - RNA, 16 nt, Homo sapiens
cagugaucucgacucc

SEQ ID NO: 1864853 - RNA, 23 nt, Homo sapiens
aggauagaagcugcagugguauu

SEQ ID NO: 1864854 - RNA, 21 nt, Homo sapiens
uuuguguucuguuuguuaaaa

SEQ ID NO: 1864855 - RNA, 13 nt, Homo sapiens
uguuagauuugaa

SEQ ID NO: 1864856 - RNA, 19 nt, Homo sapiens
agacccugucucaaaaaau

SEQ ID NO: 1864857 - RNA, 17 nt, Homo sapiens
guuuauacacacaggag

SEQ ID NO: 1864858 - RNA, 21 nt, Homo sapiens
agggaguagugcggugguggu

SEQ ID NO: 1864859 - RNA, 14 nt, Homo sapiens
agcaaauccuuugu

SEQ ID NO: 1864860 - RNA, 19 nt, Homo sapiens
uuguuaauuuggaccauuu

SEQ ID NO: 1864861 - RNA, 20 nt, Homo sapiens
acaaaauggucauccaaacu

SEQ ID NO: 1864862 - RNA, 20 nt, Homo sapiens
uucuaauggccuuccauaau

SEQ ID NO: 1864863 - RNA, 17 nt, Homo sapiens
aggaaagaagcauuucu

SEQ ID NO: 1864864 - RNA, 14 nt, Homo sapiens
aaacaaaaugagcu

SEQ ID NO: 1864865 - RNA, 22 nt, Homo sapiens
uaaacuaggauugacauucuac

SEQ ID NO: 1864866 - RNA, 17 nt, Homo sapiens
agaacuuucugauucac

SEQ ID NO: 1864867 - RNA, 13 nt, Homo sapiens
acucacugugauc

SEQ ID NO: 1864868 - RNA, 22 nt, Homo sapiens
ugcuauuuaaggugugcaauuu

SEQ ID NO: 1864869 - RNA, 21 nt, Homo sapiens
ucccaggacccaggucugcug

SEQ ID NO: 1864870 - RNA, 12 nt, Homo sapiens
aaagugucucaa

SEQ ID NO: 1864871 - RNA, 12 nt, Homo sapiens
aaaaugucucag

SEQ ID NO: 1864872 - RNA, 12 nt, Homo sapiens
cuuugcuacuuu

SEQ ID NO: 1864873 - RNA, 23 nt, Homo sapiens
acacaauuucauuuccagcauuu

SEQ ID NO: 1864874 - RNA, 20 nt, Homo sapiens
uggacacucagaccagcucc

SEQ ID NO: 1864875 - RNA, 16 nt, Homo sapiens
aagaagacauggagac

SEQ ID NO: 1864876 - RNA, 22 nt, Homo sapiens
acguuggucuugaacuccugac

SEQ ID NO: 1864877 - RNA, 13 nt, Homo sapiens
acugaaccaaauu

SEQ ID NO: 1864878 - RNA, 16 nt, Homo sapiens
aggcuuucucuacuga

SEQ ID NO: 1864879 - RNA, 18 nt, Homo sapiens
cuguaugccaagugaaaa

SEQ ID NO: 1864880 - RNA, 22 nt, Homo sapiens
cccuagggcucuccaagcacua

SEQ ID NO: 1864881 - RNA, 23 nt, Homo sapiens
uugauuauucugauuccacuuuu

SEQ ID NO: 1864882 - RNA, 13 nt, Homo sapiens
aggcuaugugagc

SEQ ID NO: 1864883 - RNA, 18 nt, Homo sapiens
ucucagacuguggaacca

SEQ ID NO: 1864884 - RNA, 21 nt, Homo sapiens
cacgaucucggcucacugcac

SEQ ID NO: 1864885 - RNA, 10 nt, Homo sapiens
uaguuccuuc

SEQ ID NO: 1864886 - RNA, 14 nt, Homo sapiens
auaaagcagcucag

SEQ ID NO: 1864887 - RNA, 15 nt, Homo sapiens
gcacccucuccagau

SEQ ID NO: 1864888 - RNA, 21 nt, Homo sapiens
acccuccuagccugcucugcc

SEQ ID NO: 1864889 - RNA, 20 nt, Homo sapiens
uggaaguuauuaacuuuaau

SEQ ID NO: 1864890 - RNA, 23 nt, Homo sapiens
ccacaaguauugcccuuuaacaa

SEQ ID NO: 1864891 - RNA, 13 nt, Homo sapiens
ugcaacaaaaagu

SEQ ID NO: 1864892 - RNA, 13 nt, Homo sapiens
acacuaggaugaa

SEQ ID NO: 1864893 - RNA, 19 nt, Homo sapiens
caggaaggacugucccaga

SEQ ID NO: 1864894 - RNA, 11 nt, Homo sapiens
guaacuacuuu

SEQ ID NO: 1864895 - RNA, 18 nt, Homo sapiens
accaugugacacacuggc

SEQ ID NO: 1864896 - RNA, 22 nt, Homo sapiens
guguuccauugccauagcugac

SEQ ID NO: 1864897 - RNA, 21 nt, Homo sapiens
aaaauguacaaaaagaacaau

SEQ ID NO: 1864898 - RNA, 15 nt, Homo sapiens
uugaccagcucuggg

SEQ ID NO: 1864899 - RNA, 21 nt, Homo sapiens
acguuugcucauuuaagaauu

SEQ ID NO: 1864900 - RNA, 14 nt, Homo sapiens
aaauccacagugag

SEQ ID NO: 1864901 - RNA, 16 nt, Homo sapiens
uguaucuuauucacau

SEQ ID NO: 1864902 - RNA, 20 nt, Homo sapiens
cuucccaugcaacacccucu

SEQ ID NO: 1864903 - RNA, 17 nt, Homo sapiens
cucccuaccguccuccu

SEQ ID NO: 1864904 - RNA, 15 nt, Homo sapiens
cuauguucauaaaaa

SEQ ID NO: 1864905 - RNA, 16 nt, Homo sapiens
auuuccaguugcccau

SEQ ID NO: 1864906 - RNA, 21 nt, Homo sapiens
ggguaucccagaccccucuca

SEQ ID NO: 1864907 - RNA, 23 nt, Homo sapiens
cagugacuuucaggaauugccca

SEQ ID NO: 1864908 - RNA, 16 nt, Homo sapiens
ggaguacgugaaauga

SEQ ID NO: 1864909 - RNA, 15 nt, Homo sapiens
cuaccguuguuugca

SEQ ID NO: 1864910 - RNA, 23 nt, Homo sapiens
acccuccggccagcgagugguca

SEQ ID NO: 1864911 - RNA, 17 nt, Homo sapiens
cauaaaaaggaacaaga

SEQ ID NO: 1864912 - RNA, 16 nt, Homo sapiens
uuccuuaucacugaca

SEQ ID NO: 1864913 - RNA, 22 nt, Homo sapiens
cuguauaauaaacaaucuuaga

SEQ ID NO: 1864914 - RNA, 20 nt, Homo sapiens
uguaacggaugaccauaugc

SEQ ID NO: 1864915 - RNA, 14 nt, Homo sapiens
agcugauccauagg

SEQ ID NO: 1864916 - RNA, 15 nt, Homo sapiens
uuugaaacugaaugu

SEQ ID NO: 1864917 - RNA, 16 nt, Homo sapiens
uuccugucaauauaua

SEQ ID NO: 1864918 - RNA, 18 nt, Homo sapiens
aggagaagaaacagcggc

SEQ ID NO: 1864919 - RNA, 22 nt, Homo sapiens
cugaugauuuuaaagaaagcca

SEQ ID NO: 1864920 - RNA, 13 nt, Homo sapiens
ucggcuccugcug

SEQ ID NO: 1864921 - RNA, 13 nt, Homo sapiens
ccaggcugucacc

SEQ ID NO: 1864922 - RNA, 20 nt, Homo sapiens
ccaggcuggaaugcaguggu

SEQ ID NO: 1864923 - RNA, 23 nt, Homo sapiens
uccggaacagccaaagaaacuca

SEQ ID NO: 1864924 - RNA, 16 nt, Homo sapiens
ccacgggaacuuggag

SEQ ID NO: 1864925 - RNA, 19 nt, Homo sapiens
cgcuccacguuucaggcag

SEQ ID NO: 1864926 - RNA, 22 nt, Homo sapiens
aaucuguuuauuuacaagggaa

SEQ ID NO: 1864927 - RNA, 22 nt, Homo sapiens
cuguccagcaggggucucccaa

SEQ ID NO: 1864928 - RNA, 17 nt, Homo sapiens
aguauuguuuguaauca

SEQ ID NO: 1864929 - RNA, 19 nt, Homo sapiens
ugucacgccagacuuccca

SEQ ID NO: 1864930 - RNA, 18 nt, Homo sapiens
auuuuccccuagcuuucc

SEQ ID NO: 1864931 - RNA, 19 nt, Homo sapiens
uauauuguauuaagggcau

SEQ ID NO: 1864932 - RNA, 20 nt, Homo sapiens
agaguuucuccuuuugacca

SEQ ID NO: 1864933 - RNA, 14 nt, Homo sapiens
caaguaacaaugca

SEQ ID NO: 1864934 - RNA, 21 nt, Homo sapiens
cuaguuucucucaaugaauaa

SEQ ID NO: 1864935 - RNA, 13 nt, Homo sapiens
cauuaauacugug

SEQ ID NO: 1864936 - RNA, 14 nt, Homo sapiens
cuucucugcuccuu

SEQ ID NO: 1864937 - RNA, 23 nt, Homo sapiens
gagauagaagaacugcaaaggua

SEQ ID NO: 1864938 - RNA, 21 nt, Homo sapiens
cugggggccucuuucugugcu

SEQ ID NO: 1864939 - RNA, 17 nt, Homo sapiens
acuacuguguuaugcaa

SEQ ID NO: 1864940 - RNA, 19 nt, Homo sapiens
cauuguauuccuccugaga

SEQ ID NO: 1864941 - RNA, 20 nt, Homo sapiens
cagaaagggacagggaaaua

SEQ ID NO: 1864942 - RNA, 13 nt, Homo sapiens
cacacgcacucuc

SEQ ID NO: 1864943 - RNA, 19 nt, Homo sapiens
uggagcagggacagaucau

SEQ ID NO: 1864944 - RNA, 16 nt, Homo sapiens
caagcugaguauuaaa

SEQ ID NO: 1864945 - RNA, 12 nt, Homo sapiens
gaggggugcugc

SEQ ID NO: 1864946 - RNA, 22 nt, Homo sapiens
ccugcauucgcagcagcuccgc

SEQ ID NO: 1864947 - RNA, 13 nt, Homo sapiens
aaacgguucaguu

SEQ ID NO: 1864948 - RNA, 23 nt, Homo sapiens
gccuguaaacuuuaucacuuaaa

SEQ ID NO: 1864949 - RNA, 18 nt, Homo sapiens
gagaauugcuugaaccug

SEQ ID NO: 1864950 - RNA, 16 nt, Homo sapiens
aacccugucugagaug

SEQ ID NO: 1864951 - RNA, 17 nt, Homo sapiens
gcaaaauuuuacaguaa

SEQ ID NO: 1864952 - RNA, 18 nt, Homo sapiens
caaaaugacaaugaugau

SEQ ID NO: 1864953 - RNA, 16 nt, Homo sapiens
guauaaguccuugcaa

SEQ ID NO: 1864954 - RNA, 22 nt, Homo sapiens
uuugcuaagaauagauggaaga

SEQ ID NO: 1864955 - RNA, 22 nt, Homo sapiens
gccucugguucugacacuuucu

SEQ ID NO: 1864956 - RNA, 23 nt, Homo sapiens
aaaccagcccuugagucugucac

SEQ ID NO: 1864957 - RNA, 22 nt, Homo sapiens
gcuucagcucuucuugacauca

SEQ ID NO: 1864958 - RNA, 18 nt, Homo sapiens
agccgagaucacaccacu

SEQ ID NO: 1864959 - RNA, 15 nt, Homo sapiens
ggaauaaggccuuaa

SEQ ID NO: 1864960 - RNA, 18 nt, Homo sapiens
aaugcaugcuucuucuca

SEQ ID NO: 1864961 - RNA, 16 nt, Homo sapiens
acuuguccaguucaaa

SEQ ID NO: 1864962 - RNA, 21 nt, Homo sapiens
gcagccagaggcaccucaaga

SEQ ID NO: 1864963 - RNA, 20 nt, Homo sapiens
accugaaaaaaaguuuacaa

SEQ ID NO: 1864964 - RNA, 16 nt, Homo sapiens
uggggagaaaagacau

SEQ ID NO: 1864965 - RNA, 16 nt, Homo sapiens
gagaaacagccugugu

SEQ ID NO: 1864966 - RNA, 13 nt, Homo sapiens
uaaguguacaauu

SEQ ID NO: 1864967 - RNA, 18 nt, Homo sapiens
gacaugccuuggugccgg

SEQ ID NO: 1864968 - RNA, 16 nt, Homo sapiens
uaaaagauagacauca

SEQ ID NO: 1864969 - RNA, 15 nt, Homo sapiens
ccugaacucauucuc

SEQ ID NO: 1864970 - RNA, 18 nt, Homo sapiens
uucugagccuucuacuua

SEQ ID NO: 1864971 - RNA, 14 nt, Homo sapiens
aguuuaauauaaag

SEQ ID NO: 1864972 - RNA, 24 nt, Homo sapiens
ugaaccucaguuuccucaucugca

SEQ ID NO: 1864973 - RNA, 22 nt, Homo sapiens
acauuggcaccuaauccaggca

SEQ ID NO: 1864974 - RNA, 16 nt, Homo sapiens
gccggcuuuccucuau

SEQ ID NO: 1864975 - RNA, 21 nt, Homo sapiens
agcaugaaacuguguauuauu

SEQ ID NO: 1864976 - RNA, 23 nt, Homo sapiens
aacaacauccacuguuagcacau

SEQ ID NO: 1864977 - RNA, 16 nt, Homo sapiens
gauccuuuuuccauca

SEQ ID NO: 1864978 - RNA, 21 nt, Homo sapiens
ccacuggauccugcugcuuug

SEQ ID NO: 1864979 - RNA, 18 nt, Homo sapiens
aaacaaauagucuaucaa

SEQ ID NO: 1864980 - RNA, 12 nt, Homo sapiens
aauuauuugacu

SEQ ID NO: 1864981 - RNA, 16 nt, Homo sapiens
auuuccaaacauccaa

SEQ ID NO: 1864982 - RNA, 12 nt, Homo sapiens
augucugagcua

SEQ ID NO: 1864983 - RNA, 15 nt, Homo sapiens
agagaauaccagugu

SEQ ID NO: 1864984 - RNA, 13 nt, Homo sapiens
cacugaaaugcua

SEQ ID NO: 1864985 - RNA, 11 nt, Homo sapiens
ggauagcacug

SEQ ID NO: 1864986 - RNA, 14 nt, Homo sapiens
gguuucaucauguu

SEQ ID NO: 1864987 - RNA, 17 nt, Homo sapiens
auccugccucuccccaa

SEQ ID NO: 1864988 - RNA, 22 nt, Homo sapiens
cagugguggugcccaccuguga

SEQ ID NO: 1864989 - RNA, 15 nt, Homo sapiens
gcacauaacaugcuu

SEQ ID NO: 1864990 - RNA, 16 nt, Homo sapiens
aaauaagccaugagaa

SEQ ID NO: 1864991 - RNA, 18 nt, Homo sapiens
aagacauagucucuaccu

SEQ ID NO: 1864992 - RNA, 19 nt, Homo sapiens
cagcugaugcucaagucca

SEQ ID NO: 1864993 - RNA, 14 nt, Homo sapiens
augacccacugucc

SEQ ID NO: 1864994 - RNA, 14 nt, Homo sapiens
aagucacacagaca

SEQ ID NO: 1864995 - RNA, 17 nt, Homo sapiens
guccugagccccaggga

SEQ ID NO: 1864996 - RNA, 23 nt, Homo sapiens
aauagcuuuuuaaaaaaaucucc

SEQ ID NO: 1864997 - RNA, 16 nt, Homo sapiens
ugcccucaccaccaca

SEQ ID NO: 1864998 - RNA, 17 nt, Homo sapiens
aauacuguaggaacaag

SEQ ID NO: 1864999 - RNA, 21 nt, Homo sapiens
cuuugagaagccuucagcucc

SEQ ID NO: 1865000 - RNA, 16 nt, Homo sapiens
cauaagugaaaaucuu

SEQ ID NO: 1865001 - RNA, 16 nt, Homo sapiens
ucuuggcugaccccuc

SEQ ID NO: 1865002 - RNA, 18 nt, Homo sapiens
uggaggaucucacuuaau

SEQ ID NO: 1865003 - RNA, 16 nt, Homo sapiens
agggaaaggggugcuu

SEQ ID NO: 1865004 - RNA, 17 nt, Homo sapiens
cagccccggcaagccac

SEQ ID NO: 1865005 - RNA, 17 nt, Homo sapiens
gaauuaggaagaccaag

SEQ ID NO: 1865006 - RNA, 22 nt, Homo sapiens
ccaagccauguuccccaguuca

SEQ ID NO: 1865007 - RNA, 20 nt, Homo sapiens
aaucagucuauccacagaga

SEQ ID NO: 1865008 - RNA, 22 nt, Homo sapiens
aaaauggcuuuaaucaauucua

SEQ ID NO: 1865009 - RNA, 13 nt, Homo sapiens
aaugugacucagc

SEQ ID NO: 1865010 - RNA, 20 nt, Homo sapiens
uagacugcaguggacagucc

SEQ ID NO: 1865011 - RNA, 21 nt, Homo sapiens
cggaaaccucccuuuacagca

SEQ ID NO: 1865012 - RNA, 18 nt, Homo sapiens
ucagugaaguugcugcuu

SEQ ID NO: 1865013 - RNA, 21 nt, Homo sapiens
ggacuucaagccccaccacau

SEQ ID NO: 1865014 - RNA, 13 nt, Homo sapiens
ccucccaccagag

SEQ ID NO: 1865015 - RNA, 13 nt, Homo sapiens
guugaagcacugu

SEQ ID NO: 1865016 - RNA, 16 nt, Homo sapiens
agucaccaaguguauu

SEQ ID NO: 1865017 - RNA, 17 nt, Homo sapiens
ugcugcuggaucacagc

SEQ ID NO: 1865018 - RNA, 20 nt, Homo sapiens
ucggacuaaacuaucuguau

SEQ ID NO: 1865019 - RNA, 15 nt, Homo sapiens
ucugccuauugcagc

SEQ ID NO: 1865020 - RNA, 18 nt, Homo sapiens
augaguauaaugaacacu

SEQ ID NO: 1865021 - RNA, 15 nt, Homo sapiens
guauguuugggagac

SEQ ID NO: 1865022 - RNA, 23 nt, Homo sapiens
ucagaauaggaaaacauugcaau

SEQ ID NO: 1865023 - RNA, 20 nt, Homo sapiens
agucucacccacuaggauag

SEQ ID NO: 1865024 - RNA, 14 nt, Homo sapiens
gauccaagcugguc

SEQ ID NO: 1865025 - RNA, 23 nt, Homo sapiens
cugucacuugcuggcugugaaac

SEQ ID NO: 1865026 - RNA, 18 nt, Homo sapiens
uucuuggggucccaggga

SEQ ID NO: 1865027 - RNA, 14 nt, Homo sapiens
uaacagaguuuucu

SEQ ID NO: 1865028 - RNA, 14 nt, Homo sapiens
aagaauacaucaga

SEQ ID NO: 1865029 - RNA, 20 nt, Homo sapiens
uguaauuugugauacaaugc

SEQ ID NO: 1865030 - RNA, 13 nt, Homo sapiens
gagugugcugcua

SEQ ID NO: 1865031 - RNA, 20 nt, Homo sapiens
gaaaccccgggccaucccac

SEQ ID NO: 1865032 - RNA, 14 nt, Homo sapiens
gcauaccugcuggu

SEQ ID NO: 1865033 - RNA, 16 nt, Homo sapiens
ugcccagagcucucua

SEQ ID NO: 1865034 - RNA, 16 nt, Homo sapiens
aaaauguuuucuucau

SEQ ID NO: 1865035 - RNA, 23 nt, Homo sapiens
aggagccgaccgggaauaaccuu

SEQ ID NO: 1865036 - RNA, 15 nt, Homo sapiens
ugcaauguggugaca

SEQ ID NO: 1865037 - RNA, 18 nt, Homo sapiens
gacagaacaccuaugcaa

SEQ ID NO: 1865038 - RNA, 20 nt, Homo sapiens
aaguccuaguuguucagcau

SEQ ID NO: 1865039 - RNA, 15 nt, Homo sapiens
agcacuauuaauacu

SEQ ID NO: 1865040 - RNA, 20 nt, Homo sapiens
gcaaccugugcaaaauaaaa

SEQ ID NO: 1865041 - RNA, 20 nt, Homo sapiens
uaauccagagauaauugcca

SEQ ID NO: 1865042 - RNA, 19 nt, Homo sapiens
uguuggagguuaaggcaua

SEQ ID NO: 1865043 - RNA, 18 nt, Homo sapiens
gacuuaggggaguucagu

SEQ ID NO: 1865044 - RNA, 15 nt, Homo sapiens
ugauguauuuagcuu

SEQ ID NO: 1865045 - RNA, 12 nt, Homo sapiens
uccagacauuug

SEQ ID NO: 1865046 - RNA, 23 nt, Homo sapiens
gauucauauguccccacuggcau

SEQ ID NO: 1865047 - RNA, 15 nt, Homo sapiens
cauccuaacaaugug

SEQ ID NO: 1865048 - RNA, 11 nt, Homo sapiens
uccugucauau

SEQ ID NO: 1865049 - RNA, 14 nt, Homo sapiens
aagcaaguuuucuu

SEQ ID NO: 1865050 - RNA, 16 nt, Homo sapiens
aacacaagccacagaa

SEQ ID NO: 1865051 - RNA, 16 nt, Homo sapiens
cuguccuacaauauca

SEQ ID NO: 1865052 - RNA, 15 nt, Homo sapiens
auuuucuuucaacau

SEQ ID NO: 1865053 - RNA, 21 nt, Homo sapiens
cuuuuuaucuucuuagcucau

SEQ ID NO: 1865054 - RNA, 14 nt, Homo sapiens
cagagugggaccaa

SEQ ID NO: 1865055 - RNA, 23 nt, Homo sapiens
aaagaagacagcuuaauaguagu

SEQ ID NO: 1865056 - RNA, 13 nt, Homo sapiens
uucacagccuuuc

SEQ ID NO: 1865057 - RNA, 13 nt, Homo sapiens
agccaagggaugg

SEQ ID NO: 1865058 - RNA, 23 nt, Homo sapiens
aaaagcgcucccccgucgugcuu

SEQ ID NO: 1865059 - RNA, 20 nt, Homo sapiens
gugacaugauacaaacacua

SEQ ID NO: 1865060 - RNA, 22 nt, Homo sapiens
aagacaaggcuggcaaacccuc

SEQ ID NO: 1865061 - RNA, 18 nt, Homo sapiens
cuugaaggaacacaaaga

SEQ ID NO: 1865062 - RNA, 14 nt, Homo sapiens
auuaacaugcaaua

SEQ ID NO: 1865063 - RNA, 15 nt, Homo sapiens
uggcaucuagccaga

SEQ ID NO: 1865064 - RNA, 22 nt, Homo sapiens
guccuggcugugcacauucucc

SEQ ID NO: 1865065 - RNA, 21 nt, Homo sapiens
aaacucaagcuucuucacuca

SEQ ID NO: 1865066 - RNA, 18 nt, Homo sapiens
cuuucccucauccaugcu

SEQ ID NO: 1865067 - RNA, 14 nt, Homo sapiens
gcguggagacuggc

SEQ ID NO: 1865068 - RNA, 20 nt, Homo sapiens
ugucaagaauagcauuguaa

SEQ ID NO: 1865069 - RNA, 19 nt, Homo sapiens
guggcuuuuuguacuguag

SEQ ID NO: 1865070 - RNA, 21 nt, Homo sapiens
cgggcaaaauaaagugacaga

SEQ ID NO: 1865071 - RNA, 11 nt, Homo sapiens
guuacauauac

SEQ ID NO: 1865072 - RNA, 16 nt, Homo sapiens
cgaaguggcucucagg

SEQ ID NO: 1865073 - RNA, 15 nt, Homo sapiens
ugaggacccucccag

SEQ ID NO: 1865074 - RNA, 23 nt, Homo sapiens
acucgcuucucugugacugaugu

SEQ ID NO: 1865075 - RNA, 12 nt, Homo sapiens
aggccaacagca

SEQ ID NO: 1865076 - RNA, 21 nt, Homo sapiens
ugggugaacaccaacuuuuau

SEQ ID NO: 1865077 - RNA, 16 nt, Homo sapiens
caagaaccgguuucca

SEQ ID NO: 1865078 - RNA, 18 nt, Homo sapiens
agagcgucauguccuugg

SEQ ID NO: 1865079 - RNA, 23 nt, Homo sapiens
uuucauuuuugauuagaggaacu

SEQ ID NO: 1865080 - RNA, 17 nt, Homo sapiens
aaggcaguucugugucc

SEQ ID NO: 1865081 - RNA, 20 nt, Homo sapiens
guuaccgaggacccugguua

SEQ ID NO: 1865082 - RNA, 21 nt, Homo sapiens
caucugaagugucuaaugcau

SEQ ID NO: 1865083 - RNA, 15 nt, Homo sapiens
gagcuuuucuggaau

SEQ ID NO: 1865084 - RNA, 18 nt, Homo sapiens
cacgcaugugugcugcag

SEQ ID NO: 1865085 - RNA, 20 nt, Homo sapiens
aggucuuuuacauacaguga

SEQ ID NO: 1865086 - RNA, 16 nt, Homo sapiens
caguccuuaaugucac

SEQ ID NO: 1865087 - RNA, 22 nt, Homo sapiens
ugcgcacagccccagcuaauuu

SEQ ID NO: 1865088 - RNA, 21 nt, Homo sapiens
acccuucugcuguauacugua

SEQ ID NO: 1865089 - RNA, 15 nt, Homo sapiens
ucccuaaaaauucca

SEQ ID NO: 1865090 - RNA, 23 nt, Homo sapiens
cuccuggacucaaaguauccucc

SEQ ID NO: 1865091 - RNA, 22 nt, Homo sapiens
ggcaggagcugcugugguguuc

SEQ ID NO: 1865092 - RNA, 21 nt, Homo sapiens
gaauugcgucauguaagggaa

SEQ ID NO: 1865093 - RNA, 18 nt, Homo sapiens
uuccacuuugaguaccaa

SEQ ID NO: 1865094 - RNA, 13 nt, Homo sapiens
uucuuauuucccc

SEQ ID NO: 1865095 - RNA, 19 nt, Homo sapiens
acaccagagccucagugag

SEQ ID NO: 1865096 - RNA, 20 nt, Homo sapiens
uccaugccucagaagugcau

SEQ ID NO: 1865097 - RNA, 15 nt, Homo sapiens
acagagaugcaugcg

SEQ ID NO: 1865098 - RNA, 17 nt, Homo sapiens
uaaaccaauguggcaag

SEQ ID NO: 1865099 - RNA, 18 nt, Homo sapiens
cuuggggucagagacugc

SEQ ID NO: 1865100 - RNA, 16 nt, Homo sapiens
gccucagccuccugag

SEQ ID NO: 1865101 - RNA, 13 nt, Homo sapiens
ucuccuuuggcca

SEQ ID NO: 1865102 - RNA, 21 nt, Homo sapiens
gcuuuuccuauuuguuuucau

SEQ ID NO: 1865103 - RNA, 20 nt, Homo sapiens
ugacaugugaagcuauuuga

SEQ ID NO: 1865104 - RNA, 15 nt, Homo sapiens
cccugacucaucauu

SEQ ID NO: 1865105 - RNA, 18 nt, Homo sapiens
augaagaaaaucacuuag

SEQ ID NO: 1865106 - RNA, 15 nt, Homo sapiens
ugggcacacgcugcu

SEQ ID NO: 1865107 - RNA, 13 nt, Homo sapiens
uuucauucaucca

SEQ ID NO: 1865108 - RNA, 21 nt, Homo sapiens
guaauaaaacccagcauguac

SEQ ID NO: 1865109 - RNA, 20 nt, Homo sapiens
ggcuucccucuucugugguc

SEQ ID NO: 1865110 - RNA, 18 nt, Homo sapiens
cuuaaccuggaacuggag

SEQ ID NO: 1865111 - RNA, 16 nt, Homo sapiens
guauuugccagcuuua

SEQ ID NO: 1865112 - RNA, 19 nt, Homo sapiens
auaccuaaguacuguaaua

SEQ ID NO: 1865113 - RNA, 20 nt, Homo sapiens
acacuaccaauuucccauuu

SEQ ID NO: 1865114 - RNA, 17 nt, Homo sapiens
agcaaauguuuacugua

SEQ ID NO: 1865115 - RNA, 16 nt, Homo sapiens
uuguuuuaaacccauu

SEQ ID NO: 1865116 - RNA, 17 nt, Homo sapiens
uggaauugcagcuguac

SEQ ID NO: 1865117 - RNA, 17 nt, Homo sapiens
aucaaagaaagaugaaa

SEQ ID NO: 1865118 - RNA, 16 nt, Homo sapiens
ucaggacacaaaccag

SEQ ID NO: 1865119 - RNA, 22 nt, Homo sapiens
aaaauguacccgagcacauaga

SEQ ID NO: 1865120 - RNA, 20 nt, Homo sapiens
uguccuagcacagauggcca

SEQ ID NO: 1865121 - RNA, 20 nt, Homo sapiens
augcugugcucaaucagccu

SEQ ID NO: 1865122 - RNA, 23 nt, Homo sapiens
gccucucuucacugcuacaugug

SEQ ID NO: 1865123 - RNA, 23 nt, Homo sapiens
aacauguauguggauacagucau

SEQ ID NO: 1865124 - RNA, 22 nt, Homo sapiens
ccauugcaaaagguuaagccau

SEQ ID NO: 1865125 - RNA, 19 nt, Homo sapiens
uucgacguuugacuagcca

SEQ ID NO: 1865126 - RNA, 23 nt, Homo sapiens
cagaauauuaaauuagacuuccu

SEQ ID NO: 1865127 - RNA, 15 nt, Homo sapiens
acucacagucucuuu

SEQ ID NO: 1865128 - RNA, 16 nt, Homo sapiens
ugaagccaugucuaca

SEQ ID NO: 1865129 - RNA, 12 nt, Homo sapiens
aacuccuaccug

SEQ ID NO: 1865130 - RNA, 14 nt, Homo sapiens
aggcauccaugaaa

SEQ ID NO: 1865131 - RNA, 14 nt, Homo sapiens
ugcaauccuuccaa

SEQ ID NO: 1865132 - RNA, 14 nt, Homo sapiens
agaacuccauacca

SEQ ID NO: 1865133 - RNA, 20 nt, Homo sapiens
uauguugaauuccauugccu

SEQ ID NO: 1865134 - RNA, 14 nt, Homo sapiens
uucauuuucuuucc

SEQ ID NO: 1865135 - RNA, 21 nt, Homo sapiens
uccauaguucugaggucccug

SEQ ID NO: 1865136 - RNA, 18 nt, Homo sapiens
uuuagaauuuaccucuua

SEQ ID NO: 1865137 - RNA, 15 nt, Homo sapiens
uaggacuguggcaaa

SEQ ID NO: 1865138 - RNA, 16 nt, Homo sapiens
uaaaguccguauuucu

SEQ ID NO: 1865139 - RNA, 20 nt, Homo sapiens
uccaauaauuuuccugugac

SEQ ID NO: 1865140 - RNA, 22 nt, Homo sapiens
ccuaugcaugguuucagcacua

SEQ ID NO: 1865141 - RNA, 17 nt, Homo sapiens
aauacuuuuccuuaccu

SEQ ID NO: 1865142 - RNA, 14 nt, Homo sapiens
augggguuucacaa

SEQ ID NO: 1865143 - RNA, 14 nt, Homo sapiens
ugcagcaaccagaa

SEQ ID NO: 1865144 - RNA, 16 nt, Homo sapiens
cccaggacgcaugcag

SEQ ID NO: 1865145 - RNA, 23 nt, Homo sapiens
uccauuuggauaaaaggaaccaa

SEQ ID NO: 1865146 - RNA, 19 nt, Homo sapiens
accaucucugugauuaccu

SEQ ID NO: 1865147 - RNA, 12 nt, Homo sapiens
uuauaccuguac

SEQ ID NO: 1865148 - RNA, 12 nt, Homo sapiens
ugacaccuggau

SEQ ID NO: 1865149 - RNA, 17 nt, Homo sapiens
aaagacuaugaggaaua

SEQ ID NO: 1865150 - RNA, 18 nt, Homo sapiens
uaaguucuuugauuugua

SEQ ID NO: 1865151 - RNA, 12 nt, Homo sapiens
ugacgcuucccu

SEQ ID NO: 1865152 - RNA, 16 nt, Homo sapiens
ucacagagugcauugu

SEQ ID NO: 1865153 - RNA, 18 nt, Homo sapiens
ugggcauuuucccagaug

SEQ ID NO: 1865154 - RNA, 12 nt, Homo sapiens
ucuaaagcugcc

SEQ ID NO: 1865155 - RNA, 22 nt, Homo sapiens
ucugaaaggguuuuuaaucucc

SEQ ID NO: 1865156 - RNA, 14 nt, Homo sapiens
aagaacuaagccaa

SEQ ID NO: 1865157 - RNA, 18 nt, Homo sapiens
aauggacaagcagugucu

SEQ ID NO: 1865158 - RNA, 21 nt, Homo sapiens
agaagcaguggccuuauugca

SEQ ID NO: 1865159 - RNA, 22 nt, Homo sapiens
auugcugccuaaagaaacucag

SEQ ID NO: 1865160 - RNA, 18 nt, Homo sapiens
accgccacgucccagcau

SEQ ID NO: 1865161 - RNA, 18 nt, Homo sapiens
uacuaaaagucagcuuua

SEQ ID NO: 1865162 - RNA, 19 nt, Homo sapiens
ucaccaacgucugugccau

SEQ ID NO: 1865163 - RNA, 13 nt, Homo sapiens
guacuuacaucag

SEQ ID NO: 1865164 - RNA, 16 nt, Homo sapiens
cacugcugccucuuga

SEQ ID NO: 1865165 - RNA, 20 nt, Homo sapiens
uuguagaacagagcaguaga

SEQ ID NO: 1865166 - RNA, 19 nt, Homo sapiens
aggaaaagcggacaucagc

SEQ ID NO: 1865167 - RNA, 17 nt, Homo sapiens
cuggugcuccaagcaca

SEQ ID NO: 1865168 - RNA, 15 nt, Homo sapiens
uguuacuaucuacaa

SEQ ID NO: 1865169 - RNA, 18 nt, Homo sapiens
cagguguugggaccugcu

SEQ ID NO: 1865170 - RNA, 15 nt, Homo sapiens
aaaauugcacuuuua

SEQ ID NO: 1865171 - RNA, 14 nt, Homo sapiens
auaccugagacugg

SEQ ID NO: 1865172 - RNA, 20 nt, Homo sapiens
aucucagguguguugcagug

SEQ ID NO: 1865173 - RNA, 12 nt, Homo sapiens
cacauacauugc

SEQ ID NO: 1865174 - RNA, 15 nt, Homo sapiens
ccuaccuucauuuca

SEQ ID NO: 1865175 - RNA, 17 nt, Homo sapiens
gaaaaaaaaaacacuug

SEQ ID NO: 1865176 - RNA, 14 nt, Homo sapiens
auucccaccagcug

SEQ ID NO: 1865177 - RNA, 20 nt, Homo sapiens
cugaagcugccugcuuuuca

SEQ ID NO: 1865178 - RNA, 23 nt, Homo sapiens
acuccaauucauaaaucuauuca

SEQ ID NO: 1865179 - RNA, 17 nt, Homo sapiens
acaaugguugaaugaau

SEQ ID NO: 1865180 - RNA, 22 nt, Homo sapiens
gacccuggugaccuccugucac

SEQ ID NO: 1865181 - RNA, 18 nt, Homo sapiens
agccuugcucaggugcaa

SEQ ID NO: 1865182 - RNA, 17 nt, Homo sapiens
augcucaaccacugugg

SEQ ID NO: 1865183 - RNA, 14 nt, Homo sapiens
aguuaaaaggcuga

SEQ ID NO: 1865184 - RNA, 22 nt, Homo sapiens
auguucauuaaguucugaaugu

SEQ ID NO: 1865185 - RNA, 19 nt, Homo sapiens
uucugcuuuaucuuuucau

SEQ ID NO: 1865186 - RNA, 13 nt, Homo sapiens
uacuggaauuuau

SEQ ID NO: 1865187 - RNA, 20 nt, Homo sapiens
cuuccaucuuuggguccuua

SEQ ID NO: 1865188 - RNA, 21 nt, Homo sapiens
aaucuaccaguggugcucaau

SEQ ID NO: 1865189 - RNA, 22 nt, Homo sapiens
ggcaugaugaucugccucucaa

SEQ ID NO: 1865190 - RNA, 22 nt, Homo sapiens
uaacuggcuucugcuugucauc

SEQ ID NO: 1865191 - RNA, 19 nt, Homo sapiens
aguccacugccuccaugau

SEQ ID NO: 1865192 - RNA, 19 nt, Homo sapiens
cacugcuucucggaggcca

SEQ ID NO: 1865193 - RNA, 19 nt, Homo sapiens
gaguacucuugaacacaag

SEQ ID NO: 1865194 - RNA, 17 nt, Homo sapiens
gccucaaucaguauuca

SEQ ID NO: 1865195 - RNA, 14 nt, Homo sapiens
agaggaugaaugua

SEQ ID NO: 1865196 - RNA, 13 nt, Homo sapiens
guagaaaaugagg

SEQ ID NO: 1865197 - RNA, 20 nt, Homo sapiens
auccacagcuauauccugau

SEQ ID NO: 1865198 - RNA, 17 nt, Homo sapiens
agggagaggucucagug

SEQ ID NO: 1865199 - RNA, 13 nt, Homo sapiens
gagccaagcugca

SEQ ID NO: 1865200 - RNA, 17 nt, Homo sapiens
gucucuucuaagcaaaa

SEQ ID NO: 1865201 - RNA, 22 nt, Homo sapiens
gcgaagccaucgcgcuccuugc

SEQ ID NO: 1865202 - RNA, 19 nt, Homo sapiens
agauugguaguuaucugag

SEQ ID NO: 1865203 - RNA, 19 nt, Homo sapiens
ugguggugcacaccuguaa

SEQ ID NO: 1865204 - RNA, 15 nt, Homo sapiens
ggacaggaugaccug

SEQ ID NO: 1865205 - RNA, 18 nt, Homo sapiens
cuggagcucaucugcaaa

SEQ ID NO: 1865206 - RNA, 16 nt, Homo sapiens
agcacaagaaguggga

SEQ ID NO: 1865207 - RNA, 15 nt, Homo sapiens
cagccccaagcuggg

SEQ ID NO: 1865208 - RNA, 16 nt, Homo sapiens
gcaacucugagaucua

SEQ ID NO: 1865209 - RNA, 19 nt, Homo sapiens
acuugacaacaucccacag

SEQ ID NO: 1865210 - RNA, 17 nt, Homo sapiens
aaacuugaagucuugaa

SEQ ID NO: 1865211 - RNA, 15 nt, Homo sapiens
gcaaagugcuagcca

SEQ ID NO: 1865212 - RNA, 14 nt, Homo sapiens
auuuuaugugaccu

SEQ ID NO: 1865213 - RNA, 21 nt, Homo sapiens
ucucuacaauuuugaaauaaa

SEQ ID NO: 1865214 - RNA, 20 nt, Homo sapiens
caaccaauuccaaguuuuaa

SEQ ID NO: 1865215 - RNA, 23 nt, Homo sapiens
uccccugcagacggaugcccauu

SEQ ID NO: 1865216 - RNA, 17 nt, Homo sapiens
auucccaagaugccuga

SEQ ID NO: 1865217 - RNA, 19 nt, Homo sapiens
cuguccugcuccacagugu

SEQ ID NO: 1865218 - RNA, 14 nt, Homo sapiens
aacucuuacucuua

SEQ ID NO: 1865219 - RNA, 22 nt, Homo sapiens
aaagagauuuucacccauccau

SEQ ID NO: 1865220 - RNA, 14 nt, Homo sapiens
ccagcaagucccag

SEQ ID NO: 1865221 - RNA, 15 nt, Homo sapiens
uccaacacauuucac

SEQ ID NO: 1865222 - RNA, 21 nt, Homo sapiens
ggcuucuguugucaccuucac

SEQ ID NO: 1865223 - RNA, 19 nt, Homo sapiens
gacucaccucauccuuacc

SEQ ID NO: 1865224 - RNA, 13 nt, Homo sapiens
uauaagcauuuaa

SEQ ID NO: 1865225 - RNA, 13 nt, Homo sapiens
uaugggcauuugg

SEQ ID NO: 1865226 - RNA, 16 nt, Homo sapiens
gcaggcgcugugcuau

SEQ ID NO: 1865227 - RNA, 20 nt, Homo sapiens
uacuaggggcccggauccag

SEQ ID NO: 1865228 - RNA, 16 nt, Homo sapiens
gcaaaccaaugcuauu

SEQ ID NO: 1865229 - RNA, 15 nt, Homo sapiens
acuuaaagcacugau

SEQ ID NO: 1865230 - RNA, 16 nt, Homo sapiens
uugccgccccgugccu

SEQ ID NO: 1865231 - RNA, 18 nt, Homo sapiens
cccacaccaacgagguga

SEQ ID NO: 1865232 - RNA, 13 nt, Homo sapiens
uccugcuuauuca

SEQ ID NO: 1865233 - RNA, 22 nt, Homo sapiens
ccagggggcagcccaguggaau

SEQ ID NO: 1865234 - RNA, 22 nt, Homo sapiens
ggcaguggcccuccaccuuguu

SEQ ID NO: 1865235 - RNA, 16 nt, Homo sapiens
ugcagucacugugauu

SEQ ID NO: 1865236 - RNA, 15 nt, Homo sapiens
guugccucucuuuga

SEQ ID NO: 1865237 - RNA, 18 nt, Homo sapiens
uagaugugcaaccugugg

SEQ ID NO: 1865238 - RNA, 17 nt, Homo sapiens
gcccaccacaacuaaca

SEQ ID NO: 1865239 - RNA, 11 nt, Homo sapiens
uccaaaccaca

SEQ ID NO: 1865240 - RNA, 19 nt, Homo sapiens
gccugaucugcacauuuca

SEQ ID NO: 1865241 - RNA, 15 nt, Homo sapiens
agaagguuaccaaga

SEQ ID NO: 1865242 - RNA, 22 nt, Homo sapiens
uucaagugauauauguauuuau

SEQ ID NO: 1865243 - RNA, 13 nt, Homo sapiens
uaaaauucaggua

SEQ ID NO: 1865244 - RNA, 16 nt, Homo sapiens
aaaacugacauagaga

SEQ ID NO: 1865245 - RNA, 15 nt, Homo sapiens
cuggggcggugcugg

SEQ ID NO: 1865246 - RNA, 15 nt, Homo sapiens
uguccucucuuuaug

SEQ ID NO: 1865247 - RNA, 13 nt, Homo sapiens
cuuaucaauggca

SEQ ID NO: 1865248 - RNA, 18 nt, Homo sapiens
cuagccugggccagagaa

SEQ ID NO: 1865249 - RNA, 23 nt, Homo sapiens
ugugacuaaaaaugcaucuggcu

SEQ ID NO: 1865250 - RNA, 16 nt, Homo sapiens
gaaggugaacuuugug

SEQ ID NO: 1865251 - RNA, 22 nt, Homo sapiens
auuucuccaaagaagauaugca

SEQ ID NO: 1865252 - RNA, 21 nt, Homo sapiens
aagccaacaucuggaucaaug

SEQ ID NO: 1865253 - RNA, 15 nt, Homo sapiens
ugccugcuaauauga

SEQ ID NO: 1865254 - RNA, 14 nt, Homo sapiens
auuuacgcuuugau

SEQ ID NO: 1865255 - RNA, 22 nt, Homo sapiens
aacugguagaaaaacaucugaa

SEQ ID NO: 1865256 - RNA, 14 nt, Homo sapiens
gagcuggccucacc

SEQ ID NO: 1865257 - RNA, 13 nt, Homo sapiens
gauggacuacucu

SEQ ID NO: 1865258 - RNA, 19 nt, Homo sapiens
ucacaagcaugaagugcug

SEQ ID NO: 1865259 - RNA, 16 nt, Homo sapiens
uugggaggcugaggca

SEQ ID NO: 1865260 - RNA, 20 nt, Homo sapiens
aaucaugugaggaaaugaug

SEQ ID NO: 1865261 - RNA, 23 nt, Homo sapiens
gcuccugugucggggcugaccuc

SEQ ID NO: 1865262 - RNA, 19 nt, Homo sapiens
acauuuguuguucuguuaa

SEQ ID NO: 1865263 - RNA, 20 nt, Homo sapiens
caauauaggggaaaaaacuc

SEQ ID NO: 1865264 - RNA, 13 nt, Homo sapiens
aucuugugcucag

SEQ ID NO: 1865265 - RNA, 13 nt, Homo sapiens
acuaggugccuuu

SEQ ID NO: 1865266 - RNA, 20 nt, Homo sapiens
ugcagagaaagaaagggaaa

SEQ ID NO: 1865267 - RNA, 15 nt, Homo sapiens
aacaaauaauaucuc

SEQ ID NO: 1865268 - RNA, 12 nt, Homo sapiens
uuuacagaauuu

SEQ ID NO: 1865269 - RNA, 17 nt, Homo sapiens
ugugguuuuaccugcag

SEQ ID NO: 1865270 - RNA, 18 nt, Homo sapiens
aaaaaguuuguuacuuug

SEQ ID NO: 1865271 - RNA, 14 nt, Homo sapiens
uauuuuugugcaca

SEQ ID NO: 1865272 - RNA, 17 nt, Homo sapiens
auuaaaaaaucagagaa

SEQ ID NO: 1865273 - RNA, 19 nt, Homo sapiens
uuggaggcagggcugggaa

SEQ ID NO: 1865274 - RNA, 15 nt, Homo sapiens
agccucagugccacu

SEQ ID NO: 1865275 - RNA, 15 nt, Homo sapiens
ugagagagagagugu

SEQ ID NO: 1865276 - RNA, 16 nt, Homo sapiens
aucaaccaaacaaaga

SEQ ID NO: 1865277 - RNA, 14 nt, Homo sapiens
uagaaagcuucuga

SEQ ID NO: 1865278 - RNA, 21 nt, Homo sapiens
ucuuuuaaaaagugugcuuaa

SEQ ID NO: 1865279 - RNA, 21 nt, Homo sapiens
ucucagcuggaucuccauucu

SEQ ID NO: 1865280 - RNA, 21 nt, Homo sapiens
ccccucuuugcacagcaugag

SEQ ID NO: 1865281 - RNA, 21 nt, Homo sapiens
uauauuagauaaccauauuca

SEQ ID NO: 1865282 - RNA, 18 nt, Homo sapiens
aaaacuuuucuaauacuc

SEQ ID NO: 1865283 - RNA, 18 nt, Homo sapiens
aauccuuuaaacauacaa

SEQ ID NO: 1865284 - RNA, 22 nt, Homo sapiens
ugccuggggcccaaguugcagu

SEQ ID NO: 1865285 - RNA, 23 nt, Homo sapiens
ugaaauuguuuuaccagcuccca

SEQ ID NO: 1865286 - RNA, 19 nt, Homo sapiens
gaaccucagccuggccaga

SEQ ID NO: 1865287 - RNA, 16 nt, Homo sapiens
uuugggccccauucag

SEQ ID NO: 1865288 - RNA, 21 nt, Homo sapiens
guagagaaaagcacacuugua

SEQ ID NO: 1865289 - RNA, 22 nt, Homo sapiens
aaagcuacaacaaauacuacag

SEQ ID NO: 1865290 - RNA, 23 nt, Homo sapiens
aauuuagacucugguauggccaa

SEQ ID NO: 1865291 - RNA, 22 nt, Homo sapiens
cccagcccgucuccucuucccu

SEQ ID NO: 1865292 - RNA, 15 nt, Homo sapiens
cuaacacaugcacac

SEQ ID NO: 1865293 - RNA, 19 nt, Homo sapiens
acaaaucauuuugauguau

SEQ ID NO: 1865294 - RNA, 18 nt, Homo sapiens
guuugcucagcuucucca

SEQ ID NO: 1865295 - RNA, 22 nt, Homo sapiens
uguaaagaauaaaugaaucuua

SEQ ID NO: 1865296 - RNA, 14 nt, Homo sapiens
cauaauaaagcaau

SEQ ID NO: 1865297 - RNA, 16 nt, Homo sapiens
aggccaaggcuaugaa

SEQ ID NO: 1865298 - RNA, 19 nt, Homo sapiens
aaacaaauaaaaugaaaua

SEQ ID NO: 1865299 - RNA, 21 nt, Homo sapiens
uaacagccucauugaugucaa

SEQ ID NO: 1865300 - RNA, 22 nt, Homo sapiens
auuucuguucuuacaaauguga

SEQ ID NO: 1865301 - RNA, 22 nt, Homo sapiens
cuuuguucccuaaguccaacua

SEQ ID NO: 1865302 - RNA, 14 nt, Homo sapiens
augucauagccaaa

SEQ ID NO: 1865303 - RNA, 19 nt, Homo sapiens
cacaagaggaauaagaaug

SEQ ID NO: 1865304 - RNA, 21 nt, Homo sapiens
caagcugaguuuggaugucug

SEQ ID NO: 1865305 - RNA, 13 nt, Homo sapiens
ugcgugggggcca

SEQ ID NO: 1865306 - RNA, 13 nt, Homo sapiens
uucgagggguccu

SEQ ID NO: 1865307 - RNA, 20 nt, Homo sapiens
agaccuugucuccacaaaaa

SEQ ID NO: 1865308 - RNA, 23 nt, Homo sapiens
auaauaugaaaaucuccaucuca

SEQ ID NO: 1865309 - RNA, 18 nt, Homo sapiens
gcugucuggggccuuuau

SEQ ID NO: 1865310 - RNA, 15 nt, Homo sapiens
cucuugucauucuca

SEQ ID NO: 1865311 - RNA, 22 nt, Homo sapiens
caagcaaauguuuaaaauccaa

SEQ ID NO: 1865312 - RNA, 17 nt, Homo sapiens
uccugucuaacugcugu

SEQ ID NO: 1865313 - RNA, 17 nt, Homo sapiens
ugcaguggcgugaucuc

SEQ ID NO: 1865314 - RNA, 14 nt, Homo sapiens
uuuuccccagacuu

SEQ ID NO: 1865315 - RNA, 13 nt, Homo sapiens
cuuauguguugca

SEQ ID NO: 1865316 - RNA, 14 nt, Homo sapiens
cugaguggggaaaa

SEQ ID NO: 1865317 - RNA, 15 nt, Homo sapiens
gcuuaccaaguccug

SEQ ID NO: 1865318 - RNA, 21 nt, Homo sapiens
uauuuuuuuccuuugcauuca

SEQ ID NO: 1865319 - RNA, 13 nt, Homo sapiens
guccaaugagcuu

SEQ ID NO: 1865320 - RNA, 18 nt, Homo sapiens
guggggaaggaggccaag

SEQ ID NO: 1865321 - RNA, 21 nt, Homo sapiens
uaagguacaucauuauuguag

SEQ ID NO: 1865322 - RNA, 23 nt, Homo sapiens
aacguggguucaauuugccauug

SEQ ID NO: 1865323 - RNA, 15 nt, Homo sapiens
caagccugcagcgag

SEQ ID NO: 1865324 - RNA, 16 nt, Homo sapiens
acaccacacacaacag

SEQ ID NO: 1865325 - RNA, 17 nt, Homo sapiens
ucugggaaaaagugcac

SEQ ID NO: 1865326 - RNA, 20 nt, Homo sapiens
ggucuguggccaguugacau

SEQ ID NO: 1865327 - RNA, 18 nt, Homo sapiens
ucugccauuaaaacauua

SEQ ID NO: 1865328 - RNA, 19 nt, Homo sapiens
uacuuacaaguuucuagcu

SEQ ID NO: 1865329 - RNA, 19 nt, Homo sapiens
acauucuaugcuuacagaa

SEQ ID NO: 1865330 - RNA, 15 nt, Homo sapiens
cuugagcuucugggg

SEQ ID NO: 1865331 - RNA, 21 nt, Homo sapiens
auaaaacaucuuuccaguccu

SEQ ID NO: 1865332 - RNA, 16 nt, Homo sapiens
ugccauugguuccuug

SEQ ID NO: 1865333 - RNA, 22 nt, Homo sapiens
caagucacacagcuagugaaga

SEQ ID NO: 1865334 - RNA, 16 nt, Homo sapiens
ugcuagccacuggaaa

SEQ ID NO: 1865335 - RNA, 22 nt, Homo sapiens
gcugaggccucucauuccagag

SEQ ID NO: 1865336 - RNA, 18 nt, Homo sapiens
cucagaaggaauggugcg

SEQ ID NO: 1865337 - RNA, 15 nt, Homo sapiens
gucaucaaugcaaua

SEQ ID NO: 1865338 - RNA, 19 nt, Homo sapiens
auuuucaagaaacugagga

SEQ ID NO: 1865339 - RNA, 16 nt, Homo sapiens
uccacuuauaaaggaa

SEQ ID NO: 1865340 - RNA, 15 nt, Homo sapiens
ugcaagucauggcug

SEQ ID NO: 1865341 - RNA, 21 nt, Homo sapiens
auauacgcccuugagcuacuu

SEQ ID NO: 1865342 - RNA, 20 nt, Homo sapiens
aguauugucgguuaccucug

SEQ ID NO: 1865343 - RNA, 22 nt, Homo sapiens
acucuugaacuucuuacuggaa

SEQ ID NO: 1865344 - RNA, 17 nt, Homo sapiens
ugagccugagccuuaga

SEQ ID NO: 1865345 - RNA, 16 nt, Homo sapiens
caaaguauauguucag

SEQ ID NO: 1865346 - RNA, 14 nt, Homo sapiens
agagcucaggagaa

SEQ ID NO: 1865347 - RNA, 14 nt, Homo sapiens
cugaauaaauaccu

SEQ ID NO: 1865348 - RNA, 19 nt, Homo sapiens
caggagauuugcuugaacc

SEQ ID NO: 1865349 - RNA, 17 nt, Homo sapiens
caggaguucaagaccag

SEQ ID NO: 1865350 - RNA, 14 nt, Homo sapiens
cucaaugcccagua

SEQ ID NO: 1865351 - RNA, 22 nt, Homo sapiens
cuuaaauuuuauaucauuuuaa

SEQ ID NO: 1865352 - RNA, 14 nt, Homo sapiens
cuuaaaaguaucag

SEQ ID NO: 1865353 - RNA, 18 nt, Homo sapiens
acgcacuuggaguaauuu

SEQ ID NO: 1865354 - RNA, 18 nt, Homo sapiens
aagacaacagcauaacua

SEQ ID NO: 1865355 - RNA, 17 nt, Homo sapiens
cauguuugcacuuggca

SEQ ID NO: 1865356 - RNA, 23 nt, Homo sapiens
ccuuagagcuuggacagucugag

SEQ ID NO: 1865357 - RNA, 15 nt, Homo sapiens
cauaauagucaauuu

SEQ ID NO: 1865358 - RNA, 19 nt, Homo sapiens
aagagaggggccaagugua

SEQ ID NO: 1865359 - RNA, 12 nt, Homo sapiens
ugggugggauaa

SEQ ID NO: 1865360 - RNA, 17 nt, Homo sapiens
gccuccaccgagccagc

SEQ ID NO: 1865361 - RNA, 18 nt, Homo sapiens
uuuuauuuacauucuugc

SEQ ID NO: 1865362 - RNA, 11 nt, Homo sapiens
uuaacaguguu

SEQ ID NO: 1865363 - RNA, 16 nt, Homo sapiens
aagccucauacguuua

SEQ ID NO: 1865364 - RNA, 13 nt, Homo sapiens
cagcauuuuugca

SEQ ID NO: 1865365 - RNA, 15 nt, Homo sapiens
aggccaacagcaccu

SEQ ID NO: 1865366 - RNA, 15 nt, Homo sapiens
cuccuaaacugaaca

SEQ ID NO: 1865367 - RNA, 13 nt, Homo sapiens
ugcccccaacagc

SEQ ID NO: 1865368 - RNA, 17 nt, Homo sapiens
aagucucagcagcucuu

SEQ ID NO: 1865369 - RNA, 19 nt, Homo sapiens
aaucagauguguguucuca

SEQ ID NO: 1865370 - RNA, 18 nt, Homo sapiens
cuagaccuauuacaaaga

SEQ ID NO: 1865371 - RNA, 22 nt, Homo sapiens
auuuaacucuuugaaacuguau

SEQ ID NO: 1865372 - RNA, 18 nt, Homo sapiens
cagaaaaagcuagcacua

SEQ ID NO: 1865373 - RNA, 21 nt, Homo sapiens
accuucaaaugcgaacacuau

SEQ ID NO: 1865374 - RNA, 13 nt, Homo sapiens
uagccaccccaga

SEQ ID NO: 1865375 - RNA, 17 nt, Homo sapiens
ugaaggaaaaacaugcu

SEQ ID NO: 1865376 - RNA, 11 nt, Homo sapiens
uuccaaagaca

SEQ ID NO: 1865377 - RNA, 13 nt, Homo sapiens
gucucucuuggac

SEQ ID NO: 1865378 - RNA, 18 nt, Homo sapiens
accaaagcugcccacugu

SEQ ID NO: 1865379 - RNA, 12 nt, Homo sapiens
aaugcugcacuu

SEQ ID NO: 1865380 - RNA, 15 nt, Homo sapiens
aaugcugcuacuuaa

SEQ ID NO: 1865381 - RNA, 16 nt, Homo sapiens
agaagguugugaugaa

SEQ ID NO: 1865382 - RNA, 23 nt, Homo sapiens
uugcucgcccagacaccaugugc

SEQ ID NO: 1865383 - RNA, 17 nt, Homo sapiens
ggucccugaacgcccug

SEQ ID NO: 1865384 - RNA, 14 nt, Homo sapiens
auuuucuacacagc

SEQ ID NO: 1865385 - RNA, 15 nt, Homo sapiens
cuuucuggacuccca

SEQ ID NO: 1865386 - RNA, 13 nt, Homo sapiens
ucuucaagcagau

SEQ ID NO: 1865387 - RNA, 22 nt, Homo sapiens
caaagaaggcacagguguaaau

SEQ ID NO: 1865388 - RNA, 16 nt, Homo sapiens
aaagggauaguccaaa

SEQ ID NO: 1865389 - RNA, 21 nt, Homo sapiens
ucauguaaauaaauacauucu

SEQ ID NO: 1865390 - RNA, 18 nt, Homo sapiens
acacacaaaugcagacac

SEQ ID NO: 1865391 - RNA, 22 nt, Homo sapiens
guuuggguauugugugagugca

SEQ ID NO: 1865392 - RNA, 14 nt, Homo sapiens
ugugcuuguuuaca

SEQ ID NO: 1865393 - RNA, 17 nt, Homo sapiens
uguaaugcacuccugcc

SEQ ID NO: 1865394 - RNA, 12 nt, Homo sapiens
uauugcugugaa

SEQ ID NO: 1865395 - RNA, 20 nt, Homo sapiens
uugcaaaucacucugcaaug

SEQ ID NO: 1865396 - RNA, 19 nt, Homo sapiens
uuaaauaaugcuucagaua

SEQ ID NO: 1865397 - RNA, 20 nt, Homo sapiens
gaacuuuccagggauccagg

SEQ ID NO: 1865398 - RNA, 20 nt, Homo sapiens
aauaaaauagugacauaaaa

SEQ ID NO: 1865399 - RNA, 16 nt, Homo sapiens
cuagacucuagacaag

SEQ ID NO: 1865400 - RNA, 19 nt, Homo sapiens
uugggacauuugcauucaa

SEQ ID NO: 1865401 - RNA, 23 nt, Homo sapiens
uaauaaacagcucuaacacggcc

SEQ ID NO: 1865402 - RNA, 20 nt, Homo sapiens
cuagcaaauguuaugcauaa

SEQ ID NO: 1865403 - RNA, 18 nt, Homo sapiens
ggaaaaaauaacaaugaa

SEQ ID NO: 1865404 - RNA, 20 nt, Homo sapiens
augaacuaacugccauguag

SEQ ID NO: 1865405 - RNA, 21 nt, Homo sapiens
cggaccccuuguuacucagga

SEQ ID NO: 1865406 - RNA, 20 nt, Homo sapiens
uccugugggugugucucucg

SEQ ID NO: 1865407 - RNA, 19 nt, Homo sapiens
aacuucuuuaaaaaaacac

SEQ ID NO: 1865408 - RNA, 14 nt, Homo sapiens
ccaaaguagggaug

SEQ ID NO: 1865409 - RNA, 20 nt, Homo sapiens
caagaccaccaacguguccu

SEQ ID NO: 1865410 - RNA, 12 nt, Homo sapiens
ccucucuugccg

SEQ ID NO: 1865411 - RNA, 15 nt, Homo sapiens
cuaagggaaaaagcc

SEQ ID NO: 1865412 - RNA, 16 nt, Homo sapiens
aaucaaaaccagugaa

SEQ ID NO: 1865413 - RNA, 13 nt, Homo sapiens
ccacccggcccau

SEQ ID NO: 1865414 - RNA, 12 nt, Homo sapiens
gggcacugccug

SEQ ID NO: 1865415 - RNA, 13 nt, Homo sapiens
ucucaaaauggaa

SEQ ID NO: 1865416 - RNA, 22 nt, Homo sapiens
ccuugagaagauucuucccauu

SEQ ID NO: 1865417 - RNA, 23 nt, Homo sapiens
accucugagaggggagaguccag

SEQ ID NO: 1865418 - RNA, 21 nt, Homo sapiens
augcuguucugaaagggaugg

SEQ ID NO: 1865419 - RNA, 13 nt, Homo sapiens
guuccccagagaa

SEQ ID NO: 1865420 - RNA, 13 nt, Homo sapiens
gauccccagugaa

SEQ ID NO: 1865421 - RNA, 13 nt, Homo sapiens
cuuccccacagaa

SEQ ID NO: 1865422 - RNA, 19 nt, Homo sapiens
ucaccaggaucgcuuugua

SEQ ID NO: 1865423 - RNA, 16 nt, Homo sapiens
acagaaguguucacau

SEQ ID NO: 1865424 - RNA, 13 nt, Homo sapiens
cagacacaccagg

SEQ ID NO: 1865425 - RNA, 21 nt, Homo sapiens
ugguuugccugaggcuguaac

SEQ ID NO: 1865426 - RNA, 21 nt, Homo sapiens
gccacuagcccuccucuccca

SEQ ID NO: 1865427 - RNA, 17 nt, Homo sapiens
ggacccugccaggcaca

SEQ ID NO: 1865428 - RNA, 23 nt, Homo sapiens
aaucuccagcuucaacaguacuu

SEQ ID NO: 1865429 - RNA, 18 nt, Homo sapiens
ugcuggcaugaagcuguu

SEQ ID NO: 1865430 - RNA, 16 nt, Homo sapiens
agacaugguaaacuuu

SEQ ID NO: 1865431 - RNA, 15 nt, Homo sapiens
cauuucacacaguga

SEQ ID NO: 1865432 - RNA, 22 nt, Homo sapiens
cuauagugucucgaguacuaau

SEQ ID NO: 1865433 - RNA, 17 nt, Homo sapiens
caggagccucugcaguc

SEQ ID NO: 1865434 - RNA, 16 nt, Homo sapiens
ucucuuccuucagaag

SEQ ID NO: 1865435 - RNA, 12 nt, Homo sapiens
agacuuugacuc

SEQ ID NO: 1865436 - RNA, 14 nt, Homo sapiens
ccuaaaauuugccc

SEQ ID NO: 1865437 - RNA, 15 nt, Homo sapiens
cucuggcgacaguuu

SEQ ID NO: 1865438 - RNA, 14 nt, Homo sapiens
agguuaugccaaaa

SEQ ID NO: 1865439 - RNA, 13 nt, Homo sapiens
caggagaaucgcu

SEQ ID NO: 1865440 - RNA, 12 nt, Homo sapiens
ucauuugaacaa

SEQ ID NO: 1865441 - RNA, 17 nt, Homo sapiens
gcaaaauggaagcaaag

SEQ ID NO: 1865442 - RNA, 19 nt, Homo sapiens
ugacagguucccagcagcu

SEQ ID NO: 1865443 - RNA, 19 nt, Homo sapiens
uuauuugacucagcacugu

SEQ ID NO: 1865444 - RNA, 12 nt, Homo sapiens
agcaugaagucu

SEQ ID NO: 1865445 - RNA, 19 nt, Homo sapiens
cugaggagccugcaacaug

SEQ ID NO: 1865446 - RNA, 16 nt, Homo sapiens
ggccuuuaagaaccuu

SEQ ID NO: 1865447 - RNA, 21 nt, Homo sapiens
caggagguaaagaaauagcca

SEQ ID NO: 1865448 - RNA, 14 nt, Homo sapiens
ucauagcauucacu

SEQ ID NO: 1865449 - RNA, 19 nt, Homo sapiens
auaucaugcacacaauuag

SEQ ID NO: 1865450 - RNA, 20 nt, Homo sapiens
cuguauuuuuuuuuuccauu

SEQ ID NO: 1865451 - RNA, 14 nt, Homo sapiens
gccuggugcagugg

SEQ ID NO: 1865452 - RNA, 19 nt, Homo sapiens
gaacauaaguaaucacuaa

SEQ ID NO: 1865453 - RNA, 17 nt, Homo sapiens
uugccacacccagguga

SEQ ID NO: 1865454 - RNA, 20 nt, Homo sapiens
ugccaccacccaccccaaac

SEQ ID NO: 1865455 - RNA, 21 nt, Homo sapiens
gaggccccuucuagguggcaa

SEQ ID NO: 1865456 - RNA, 14 nt, Homo sapiens
augguuaaaaucac

SEQ ID NO: 1865457 - RNA, 23 nt, Homo sapiens
aauuuaaguuggcuagagcuucu

SEQ ID NO: 1865458 - RNA, 14 nt, Homo sapiens
ggcucugccagugg

SEQ ID NO: 1865459 - RNA, 23 nt, Homo sapiens
cuggcuucuguugcgccacugag

SEQ ID NO: 1865460 - RNA, 16 nt, Homo sapiens
cccucaggcccaggag

SEQ ID NO: 1865461 - RNA, 19 nt, Homo sapiens
aaagcuaaacguaauuucc

SEQ ID NO: 1865462 - RNA, 18 nt, Homo sapiens
caacagcucagagaugaa

SEQ ID NO: 1865463 - RNA, 14 nt, Homo sapiens
ucuucccauguccc

SEQ ID NO: 1865464 - RNA, 18 nt, Homo sapiens
cugaccaucgcacaccgg

SEQ ID NO: 1865465 - RNA, 14 nt, Homo sapiens
aggagcacuacaga

SEQ ID NO: 1865466 - RNA, 19 nt, Homo sapiens
ccuuccgacccucugggaa

SEQ ID NO: 1865467 - RNA, 21 nt, Homo sapiens
uuggcgagaccagagcagucu

SEQ ID NO: 1865468 - RNA, 14 nt, Homo sapiens
ggucccugcucccc

SEQ ID NO: 1865469 - RNA, 19 nt, Homo sapiens
aaacguuaguuaaucccuu

SEQ ID NO: 1865470 - RNA, 19 nt, Homo sapiens
uaaugauggcccauucuac

SEQ ID NO: 1865471 - RNA, 22 nt, Homo sapiens
aauauguucaccaggagauuac

SEQ ID NO: 1865472 - RNA, 17 nt, Homo sapiens
acagaccucggcugugu

SEQ ID NO: 1865473 - RNA, 17 nt, Homo sapiens
aaaaguccccauccuua

SEQ ID NO: 1865474 - RNA, 21 nt, Homo sapiens
gcucucaugaugcuacccgag

SEQ ID NO: 1865475 - RNA, 17 nt, Homo sapiens
uauuuuuuuaaccuaau

SEQ ID NO: 1865476 - RNA, 17 nt, Homo sapiens
uuauuccugguuuaauu

SEQ ID NO: 1865477 - RNA, 19 nt, Homo sapiens
ggacauggccccugugagu

SEQ ID NO: 1865478 - RNA, 19 nt, Homo sapiens
gauuccaggcgaugugcaa

SEQ ID NO: 1865479 - RNA, 13 nt, Homo sapiens
auaauuaaugugu

SEQ ID NO: 1865480 - RNA, 18 nt, Homo sapiens
guuuaaaucuuuguuaaa

SEQ ID NO: 1865481 - RNA, 18 nt, Homo sapiens
gggcuugugguggcugcu

SEQ ID NO: 1865482 - RNA, 11 nt, Homo sapiens
ucucacuuugg

SEQ ID NO: 1865483 - RNA, 21 nt, Homo sapiens
aacuggaaaaguguuccuugc

SEQ ID NO: 1865484 - RNA, 19 nt, Homo sapiens
cugcaggcagccugccuuu

SEQ ID NO: 1865485 - RNA, 17 nt, Homo sapiens
uucaccaagugaucaaa

SEQ ID NO: 1865486 - RNA, 20 nt, Homo sapiens
uacuuaugaaaagaauuuga

SEQ ID NO: 1865487 - RNA, 18 nt, Homo sapiens
cuucccuucuuugcacuu

SEQ ID NO: 1865488 - RNA, 12 nt, Homo sapiens
cugcuaaaugca

SEQ ID NO: 1865489 - RNA, 23 nt, Homo sapiens
gacccacggagcccuuaugacau

SEQ ID NO: 1865490 - RNA, 14 nt, Homo sapiens
uuucugcgugugua

SEQ ID NO: 1865491 - RNA, 17 nt, Homo sapiens
acgaucucagcucacca

SEQ ID NO: 1865492 - RNA, 18 nt, Homo sapiens
auaaacggcaguguuaaa

SEQ ID NO: 1865493 - RNA, 14 nt, Homo sapiens
auauauaacauaua

SEQ ID NO: 1865494 - RNA, 21 nt, Homo sapiens
gacauacugcauguaagccaa

SEQ ID NO: 1865495 - RNA, 12 nt, Homo sapiens
agaagacugugc

SEQ ID NO: 1865496 - RNA, 15 nt, Homo sapiens
agcaagggcugugcu

SEQ ID NO: 1865497 - RNA, 11 nt, Homo sapiens
caugcucccuc

SEQ ID NO: 1865498 - RNA, 15 nt, Homo sapiens
cuucuccucccagcg

SEQ ID NO: 1865499 - RNA, 16 nt, Homo sapiens
ugggggcugugauauu

SEQ ID NO: 1865500 - RNA, 18 nt, Homo sapiens
auugguaauuaaggcauc

SEQ ID NO: 1865501 - RNA, 18 nt, Homo sapiens
auucagcaaaaaucuccc

SEQ ID NO: 1865502 - RNA, 22 nt, Homo sapiens
gagacucccggagucuucucga

SEQ ID NO: 1865503 - RNA, 18 nt, Homo sapiens
ccaccgagccccugaccc

SEQ ID NO: 1865504 - RNA, 20 nt, Homo sapiens
acuggcuuugucccacagcu

SEQ ID NO: 1865505 - RNA, 23 nt, Homo sapiens
uccaaaacuuuaaugaacuaacu

SEQ ID NO: 1865506 - RNA, 18 nt, Homo sapiens
uuaauuugugaauuugca

SEQ ID NO: 1865507 - RNA, 18 nt, Homo sapiens
cuguguguggguguguga

SEQ ID NO: 1865508 - RNA, 15 nt, Homo sapiens
ugacuuccccuuauu

SEQ ID NO: 1865509 - RNA, 17 nt, Homo sapiens
cucccgccucagggcca

SEQ ID NO: 1865510 - RNA, 21 nt, Homo sapiens
guguauauauaguagcauuuc

SEQ ID NO: 1865511 - RNA, 21 nt, Homo sapiens
ccagaaagaaggacacuugua

SEQ ID NO: 1865512 - RNA, 20 nt, Homo sapiens
cuugaguguuaugugaauuu

SEQ ID NO: 1865513 - RNA, 13 nt, Homo sapiens
auguguaccucag

SEQ ID NO: 1865514 - RNA, 14 nt, Homo sapiens
aauaugcagugaua

SEQ ID NO: 1865515 - RNA, 13 nt, Homo sapiens
ccauaaugcauuc

SEQ ID NO: 1865516 - RNA, 21 nt, Homo sapiens
agcucugcaacagggggcaaa

SEQ ID NO: 1865517 - RNA, 18 nt, Homo sapiens
cuguccuuccaugcaaag

SEQ ID NO: 1865518 - RNA, 16 nt, Homo sapiens
aacagaagcauuugua

SEQ ID NO: 1865519 - RNA, 18 nt, Homo sapiens
aauuuaaagggaaaaccc

SEQ ID NO: 1865520 - RNA, 23 nt, Homo sapiens
aacuucaucaguguggcuucuau

SEQ ID NO: 1865521 - RNA, 11 nt, Homo sapiens
agcugucauca

SEQ ID NO: 1865522 - RNA, 18 nt, Homo sapiens
uaucuuggaaucaugcaa

SEQ ID NO: 1865523 - RNA, 21 nt, Homo sapiens
agcauugggaggaagcacaga

SEQ ID NO: 1865524 - RNA, 17 nt, Homo sapiens
uugcuacugguucagca

SEQ ID NO: 1865525 - RNA, 17 nt, Homo sapiens
acagguguuggugacaa

SEQ ID NO: 1865526 - RNA, 23 nt, Homo sapiens
aggaggggucuggguacuucuug

SEQ ID NO: 1865527 - RNA, 14 nt, Homo sapiens
ucaacaugagucaa

SEQ ID NO: 1865528 - RNA, 23 nt, Homo sapiens
uuucauauucucuuugugaggac

SEQ ID NO: 1865529 - RNA, 20 nt, Homo sapiens
aauuugucuucagauuauua

SEQ ID NO: 1865530 - RNA, 15 nt, Homo sapiens
augucagucucucac

SEQ ID NO: 1865531 - RNA, 22 nt, Homo sapiens
gccaggguggguguccaugugc

SEQ ID NO: 1865532 - RNA, 12 nt, Homo sapiens
gaugcacuacca

SEQ ID NO: 1865533 - RNA, 16 nt, Homo sapiens
ccaaggaugucugcca

SEQ ID NO: 1865534 - RNA, 19 nt, Homo sapiens
guuugcauugucuuuaaua

SEQ ID NO: 1865535 - RNA, 12 nt, Homo sapiens
uaacaaguuuaa

SEQ ID NO: 1865536 - RNA, 13 nt, Homo sapiens
uuuccuacagaca

SEQ ID NO: 1865537 - RNA, 19 nt, Homo sapiens
aaggcuauauuucugggau

SEQ ID NO: 1865538 - RNA, 14 nt, Homo sapiens
gccauugcugcuaa

SEQ ID NO: 1865539 - RNA, 23 nt, Homo sapiens
acucuccccuuucuuugcaacuu

SEQ ID NO: 1865540 - RNA, 18 nt, Homo sapiens
agcaaaaaaguacuuaaa

SEQ ID NO: 1865541 - RNA, 13 nt, Homo sapiens
uuguccacccacc

SEQ ID NO: 1865542 - RNA, 13 nt, Homo sapiens
aucacccagcuca

SEQ ID NO: 1865543 - RNA, 14 nt, Homo sapiens
ccagggaugcugcc

SEQ ID NO: 1865544 - RNA, 21 nt, Homo sapiens
uaguaccuuguuuugccaugu

SEQ ID NO: 1865545 - RNA, 13 nt, Homo sapiens
agaccccuuggcc

SEQ ID NO: 1865546 - RNA, 23 nt, Homo sapiens
agaaccauccauaguaguaugau

SEQ ID NO: 1865547 - RNA, 19 nt, Homo sapiens
ucuguagcuuguucccugu

SEQ ID NO: 1865548 - RNA, 22 nt, Homo sapiens
acagacauuuucaauaauguga

SEQ ID NO: 1865549 - RNA, 21 nt, Homo sapiens
gaauuuucacaugaacauacu

SEQ ID NO: 1865550 - RNA, 15 nt, Homo sapiens
ucuaggguuuuccaa

SEQ ID NO: 1865551 - RNA, 17 nt, Homo sapiens
agaacagaaagaaccuu

SEQ ID NO: 1865552 - RNA, 15 nt, Homo sapiens
uuuacuuuucugcca

SEQ ID NO: 1865553 - RNA, 19 nt, Homo sapiens
cagcugcuggcugugacaa

SEQ ID NO: 1865554 - RNA, 19 nt, Homo sapiens
gugaggcuccggauguuuc

SEQ ID NO: 1865555 - RNA, 11 nt, Homo sapiens
ggcucagagau

SEQ ID NO: 1865556 - RNA, 20 nt, Homo sapiens
gagaggugccagcaacugaa

SEQ ID NO: 1865557 - RNA, 21 nt, Homo sapiens
cacaacuccacugucuuuaaa

SEQ ID NO: 1865558 - RNA, 20 nt, Homo sapiens
accuagaaugucagauuucu

SEQ ID NO: 1865559 - RNA, 18 nt, Homo sapiens
aguggcaugugcugugac

SEQ ID NO: 1865560 - RNA, 15 nt, Homo sapiens
uggagggaaggacag

SEQ ID NO: 1865561 - RNA, 21 nt, Homo sapiens
gugauucacccugauuuuaca

SEQ ID NO: 1865562 - RNA, 23 nt, Homo sapiens
acaaagcugaagaaaaugaagcc

SEQ ID NO: 1865563 - RNA, 21 nt, Homo sapiens
cccucuguaacaacucuaguc

SEQ ID NO: 1865564 - RNA, 16 nt, Homo sapiens
uaccaugagugaauuu

SEQ ID NO: 1865565 - RNA, 14 nt, Homo sapiens
acuugcaucacuua

SEQ ID NO: 1865566 - RNA, 15 nt, Homo sapiens
auaauaaauacucag

SEQ ID NO: 1865567 - RNA, 15 nt, Homo sapiens
cacaguccucauuua

SEQ ID NO: 1865568 - RNA, 17 nt, Homo sapiens
gaagagggacagaugaa

SEQ ID NO: 1865569 - RNA, 14 nt, Homo sapiens
cuaaaccaaguuau

SEQ ID NO: 1865570 - RNA, 16 nt, Homo sapiens
uguuucuuuuugccag

SEQ ID NO: 1865571 - RNA, 14 nt, Homo sapiens
uaacugaugaagga

SEQ ID NO: 1865572 - RNA, 24 nt, Homo sapiens
cuggaauguaaguaagugacaaug

SEQ ID NO: 1865573 - RNA, 20 nt, Homo sapiens
ggccuggcccaaagcagugu

SEQ ID NO: 1865574 - RNA, 15 nt, Homo sapiens
auuaagaagcaauaa

SEQ ID NO: 1865575 - RNA, 15 nt, Homo sapiens
cacgcaaauacaugc

SEQ ID NO: 1865576 - RNA, 16 nt, Homo sapiens
agaggcugcacuugug

SEQ ID NO: 1865577 - RNA, 23 nt, Homo sapiens
uggacaguuggaccuuacuuugg

SEQ ID NO: 1865578 - RNA, 19 nt, Homo sapiens
uauaauuccgaaacauaca

SEQ ID NO: 1865579 - RNA, 18 nt, Homo sapiens
aguguggagucauucuca

SEQ ID NO: 1865580 - RNA, 15 nt, Homo sapiens
ccagucucaucuccu

SEQ ID NO: 1865581 - RNA, 22 nt, Homo sapiens
aaaugucauuguucuugugaac

SEQ ID NO: 1865582 - RNA, 20 nt, Homo sapiens
aggaaggcucuucuccccag

SEQ ID NO: 1865583 - RNA, 15 nt, Homo sapiens
cuuuaaaaagauauu

SEQ ID NO: 1865584 - RNA, 21 nt, Homo sapiens
auucuuguccacauucuacuu

SEQ ID NO: 1865585 - RNA, 15 nt, Homo sapiens
aagaaaaauaaucuu

SEQ ID NO: 1865586 - RNA, 18 nt, Homo sapiens
gaggacgugaagccuccc

SEQ ID NO: 1865587 - RNA, 15 nt, Homo sapiens
uaaaguaccuugacu

SEQ ID NO: 1865588 - RNA, 23 nt, Homo sapiens
cugcugaauuuggggcuacuuau

SEQ ID NO: 1865589 - RNA, 19 nt, Homo sapiens
gauacugcgacuuucugcc

SEQ ID NO: 1865590 - RNA, 22 nt, Homo sapiens
gcugugggccaaaaucaugcca

SEQ ID NO: 1865591 - RNA, 20 nt, Homo sapiens
acaccuuagguugacauuca

SEQ ID NO: 1865592 - RNA, 17 nt, Homo sapiens
uccggccucugccuuug

SEQ ID NO: 1865593 - RNA, 23 nt, Homo sapiens
aauggucucagccuaggcccuca

SEQ ID NO: 1865594 - RNA, 18 nt, Homo sapiens
gcuauaaaugauuauuua

SEQ ID NO: 1865595 - RNA, 21 nt, Homo sapiens
uucuggagauggaagcuuguu

SEQ ID NO: 1865596 - RNA, 13 nt, Homo sapiens
acagagucuugcu

SEQ ID NO: 1865597 - RNA, 19 nt, Homo sapiens
aucccuaccauuucuagcc

SEQ ID NO: 1865598 - RNA, 16 nt, Homo sapiens
acuucuggcagggaag

SEQ ID NO: 1865599 - RNA, 20 nt, Homo sapiens
ccucaguuucuucaccugua

SEQ ID NO: 1865600 - RNA, 10 nt, Homo sapiens
uuauguguuu

SEQ ID NO: 1865601 - RNA, 21 nt, Homo sapiens
auauaaaucguaaccuaugaa

SEQ ID NO: 1865602 - RNA, 19 nt, Homo sapiens
cuggagcaaccuacugucu

SEQ ID NO: 1865603 - RNA, 17 nt, Homo sapiens
cuggucgcuuugccauc

SEQ ID NO: 1865604 - RNA, 15 nt, Homo sapiens
cagccaccuaguccc

SEQ ID NO: 1865605 - RNA, 13 nt, Homo sapiens
uuuacuugagcaa

SEQ ID NO: 1865606 - RNA, 22 nt, Homo sapiens
acacguaaaagaaauguauuaa

SEQ ID NO: 1865607 - RNA, 15 nt, Homo sapiens
gcuacucuaguauuc

SEQ ID NO: 1865608 - RNA, 17 nt, Homo sapiens
ugaucauuuuagacacu

SEQ ID NO: 1865609 - RNA, 16 nt, Homo sapiens
ccucucaacauuacca

SEQ ID NO: 1865610 - RNA, 22 nt, Homo sapiens
ggcauuucacaaaacagccuuu

SEQ ID NO: 1865611 - RNA, 12 nt, Homo sapiens
uaaugugcagca

SEQ ID NO: 1865612 - RNA, 11 nt, Homo sapiens
aauaaaaccaa

SEQ ID NO: 1865613 - RNA, 22 nt, Homo sapiens
accccgccugccuccuggcuca

SEQ ID NO: 1865614 - RNA, 14 nt, Homo sapiens
uaauauuuacucua

SEQ ID NO: 1865615 - RNA, 14 nt, Homo sapiens
aaaggacucuugag

SEQ ID NO: 1865616 - RNA, 22 nt, Homo sapiens
aaguuggucuuacuuugugcaa

SEQ ID NO: 1865617 - RNA, 17 nt, Homo sapiens
acagccucuuacuugcc

SEQ ID NO: 1865618 - RNA, 14 nt, Homo sapiens
uaugcuacuacaaa

SEQ ID NO: 1865619 - RNA, 20 nt, Homo sapiens
ugguacacaccaaaugaguc

SEQ ID NO: 1865620 - RNA, 21 nt, Homo sapiens
aaucucuuugaagguuuauac

SEQ ID NO: 1865621 - RNA, 18 nt, Homo sapiens
cuaauguaugcauucauc

SEQ ID NO: 1865622 - RNA, 20 nt, Homo sapiens
aggaacauuccuuagucuca

SEQ ID NO: 1865623 - RNA, 22 nt, Homo sapiens
cuucuguucauccugaacauuu

SEQ ID NO: 1865624 - RNA, 18 nt, Homo sapiens
agugaugaaaauuugccu

SEQ ID NO: 1865625 - RNA, 14 nt, Homo sapiens
gcauaaaaccuaaa

SEQ ID NO: 1865626 - RNA, 22 nt, Homo sapiens
gagccuacuccaagaauggagg

SEQ ID NO: 1865627 - RNA, 14 nt, Homo sapiens
cuaugguugccacc

SEQ ID NO: 1865628 - RNA, 14 nt, Homo sapiens
ucuugcugccaggc

SEQ ID NO: 1865629 - RNA, 19 nt, Homo sapiens
uggagagggugucaucuag

SEQ ID NO: 1865630 - RNA, 12 nt, Homo sapiens
cuacaggcacac

SEQ ID NO: 1865631 - RNA, 14 nt, Homo sapiens
uagcugagugcacu

SEQ ID NO: 1865632 - RNA, 23 nt, Homo sapiens
uccuaacaggaugaaaguucccc

SEQ ID NO: 1865633 - RNA, 18 nt, Homo sapiens
auauuaauaaaaguguua

SEQ ID NO: 1865634 - RNA, 20 nt, Homo sapiens
gccagcccuucccaggccag

SEQ ID NO: 1865635 - RNA, 21 nt, Homo sapiens
agacggggccucacuauguug

SEQ ID NO: 1865636 - RNA, 19 nt, Homo sapiens
uuuauccugagucccuuaa

SEQ ID NO: 1865637 - RNA, 18 nt, Homo sapiens
acacagccaagccaguca

SEQ ID NO: 1865638 - RNA, 14 nt, Homo sapiens
ggagugagaucuua

SEQ ID NO: 1865639 - RNA, 17 nt, Homo sapiens
ucugucagaagacacua

SEQ ID NO: 1865640 - RNA, 14 nt, Homo sapiens
ccacagcaaaaagu

SEQ ID NO: 1865641 - RNA, 18 nt, Homo sapiens
ggacgcaauugugggaug

SEQ ID NO: 1865642 - RNA, 12 nt, Homo sapiens
gaagacacugaa

SEQ ID NO: 1865643 - RNA, 18 nt, Homo sapiens
acaaauauaaaacuauaa

SEQ ID NO: 1865644 - RNA, 18 nt, Homo sapiens
ucaacaucuaaaaaucaa

SEQ ID NO: 1865645 - RNA, 15 nt, Homo sapiens
uacacacgugagcaa

SEQ ID NO: 1865646 - RNA, 17 nt, Homo sapiens
ugaaacuaaaauuuucu

SEQ ID NO: 1865647 - RNA, 20 nt, Homo sapiens
gggaacauauuuaaggaaca

SEQ ID NO: 1865648 - RNA, 13 nt, Homo sapiens
aucaacucugucu

SEQ ID NO: 1865649 - RNA, 17 nt, Homo sapiens
uucaggagaugauguga

SEQ ID NO: 1865650 - RNA, 15 nt, Homo sapiens
ucccucuaaguggaa

SEQ ID NO: 1865651 - RNA, 20 nt, Homo sapiens
ugaagaagaguuugcaaaug

SEQ ID NO: 1865652 - RNA, 20 nt, Homo sapiens
ggcagaccugacucucuuaa

SEQ ID NO: 1865653 - RNA, 23 nt, Homo sapiens
cugcaaaaaagaaguaugucagu

SEQ ID NO: 1865654 - RNA, 22 nt, Homo sapiens
aguagcugggacuauaggcaug

SEQ ID NO: 1865655 - RNA, 18 nt, Homo sapiens
gaaggacccugugcccuc

SEQ ID NO: 1865656 - RNA, 20 nt, Homo sapiens
aaauugcacuuuuaaaccuc

SEQ ID NO: 1865657 - RNA, 15 nt, Homo sapiens
aacacgugaugugau

SEQ ID NO: 1865658 - RNA, 19 nt, Homo sapiens
acuagcuaaaaccaaagga

SEQ ID NO: 1865659 - RNA, 18 nt, Homo sapiens
aaagaauaaaugaaucuu

SEQ ID NO: 1865660 - RNA, 15 nt, Homo sapiens
aaaccuaguacugcc

SEQ ID NO: 1865661 - RNA, 19 nt, Homo sapiens
gaaauguaccggcuuccau

SEQ ID NO: 1865662 - RNA, 16 nt, Homo sapiens
ucucugcccuccaaga

SEQ ID NO: 1865663 - RNA, 17 nt, Homo sapiens
auaauguuacauuauua

SEQ ID NO: 1865664 - RNA, 15 nt, Homo sapiens
gguggcccugugccu

SEQ ID NO: 1865665 - RNA, 12 nt, Homo sapiens
aggcuuacaacu

SEQ ID NO: 1865666 - RNA, 14 nt, Homo sapiens
uggcugaaaaugca

SEQ ID NO: 1865667 - RNA, 13 nt, Homo sapiens
aggaaucaaagua

SEQ ID NO: 1865668 - RNA, 13 nt, Homo sapiens
aauuuugugguuc

SEQ ID NO: 1865669 - RNA, 23 nt, Homo sapiens
ugacaagcaagggcugugcugag

SEQ ID NO: 1865670 - RNA, 13 nt, Homo sapiens
aacagacaauauu

SEQ ID NO: 1865671 - RNA, 14 nt, Homo sapiens
auuagacaaugugg

SEQ ID NO: 1865672 - RNA, 21 nt, Homo sapiens
cagcaccuccgucauucacag

SEQ ID NO: 1865673 - RNA, 22 nt, Homo sapiens
uuacuauaauugagaacuacag

SEQ ID NO: 1865674 - RNA, 13 nt, Homo sapiens
uggaccaaaugga

SEQ ID NO: 1865675 - RNA, 13 nt, Homo sapiens
auggacaauggac

SEQ ID NO: 1865676 - RNA, 19 nt, Homo sapiens
acuuaacgaaaauaguauu

SEQ ID NO: 1865677 - RNA, 23 nt, Homo sapiens
ugguggaguggagugagagcaau

SEQ ID NO: 1865678 - RNA, 17 nt, Homo sapiens
gugagcaagggggccca

SEQ ID NO: 1865679 - RNA, 12 nt, Homo sapiens
uucuucaacucc

SEQ ID NO: 1865680 - RNA, 20 nt, Homo sapiens
aacugcuuuaucccacggaa

SEQ ID NO: 1865681 - RNA, 14 nt, Homo sapiens
cugagccagggucu

SEQ ID NO: 1865682 - RNA, 20 nt, Homo sapiens
augauccucaugguucccaa

SEQ ID NO: 1865683 - RNA, 13 nt, Homo sapiens
auuagcauuccau

SEQ ID NO: 1865684 - RNA, 14 nt, Homo sapiens
ugucuucacucuuc

SEQ ID NO: 1865685 - RNA, 14 nt, Homo sapiens
uguucccacucccu

SEQ ID NO: 1865686 - RNA, 20 nt, Homo sapiens
acacauuugguuucugaaua

SEQ ID NO: 1865687 - RNA, 21 nt, Homo sapiens
agggagcuucuaccuggaaaa

SEQ ID NO: 1865688 - RNA, 17 nt, Homo sapiens
caacaaaaaccaaaaaa

SEQ ID NO: 1865689 - RNA, 18 nt, Homo sapiens
agcacaaagguagcuuuu

SEQ ID NO: 1865690 - RNA, 12 nt, Homo sapiens
uggcaagagccc

SEQ ID NO: 1865691 - RNA, 21 nt, Homo sapiens
gacccuaagaccggcggccau

SEQ ID NO: 1865692 - RNA, 15 nt, Homo sapiens
aacugcucauaugau

SEQ ID NO: 1865693 - RNA, 21 nt, Homo sapiens
cugagaaaaucccucccugac

SEQ ID NO: 1865694 - RNA, 17 nt, Homo sapiens
cugccuauuaucuguca

SEQ ID NO: 1865695 - RNA, 13 nt, Homo sapiens
ugugaaagcccag

SEQ ID NO: 1865696 - RNA, 23 nt, Homo sapiens
agugcagaaaggacguggaugaa

SEQ ID NO: 1865697 - RNA, 11 nt, Homo sapiens
cuucuugccca

SEQ ID NO: 1865698 - RNA, 13 nt, Homo sapiens
aauuuccaggaaa

SEQ ID NO: 1865699 - RNA, 14 nt, Homo sapiens
ggaaaacuacaggu

SEQ ID NO: 1865700 - RNA, 19 nt, Homo sapiens
aaacccuacgaaagcacag

SEQ ID NO: 1865701 - RNA, 14 nt, Homo sapiens
gcagcugugucuga

SEQ ID NO: 1865702 - RNA, 14 nt, Homo sapiens
gcagcagugucugu

SEQ ID NO: 1865703 - RNA, 12 nt, Homo sapiens
agaguugaaccu

SEQ ID NO: 1865704 - RNA, 22 nt, Homo sapiens
ggcaagcuggaguuaauaaucu

SEQ ID NO: 1865705 - RNA, 14 nt, Homo sapiens
cuguuuucuggaag

SEQ ID NO: 1865706 - RNA, 14 nt, Homo sapiens
uugccaacagguag

SEQ ID NO: 1865707 - RNA, 19 nt, Homo sapiens
aaugcaucacguaccccac

SEQ ID NO: 1865708 - RNA, 20 nt, Homo sapiens
agaacuuccccucccuuccc

SEQ ID NO: 1865709 - RNA, 21 nt, Homo sapiens
aagucuugcucugccacccag

SEQ ID NO: 1865710 - RNA, 23 nt, Homo sapiens
cccgagccacgaacuugcugggu

SEQ ID NO: 1865711 - RNA, 19 nt, Homo sapiens
aaaauuguguccacauaau

SEQ ID NO: 1865712 - RNA, 19 nt, Homo sapiens
acuugcugugucugaggua

SEQ ID NO: 1865713 - RNA, 17 nt, Homo sapiens
aaaacaucccaaacuuu

SEQ ID NO: 1865714 - RNA, 13 nt, Homo sapiens
gacgauaugggga

SEQ ID NO: 1865715 - RNA, 13 nt, Homo sapiens
uggaauauuacaa

SEQ ID NO: 1865716 - RNA, 14 nt, Homo sapiens
acucucaccucgug

SEQ ID NO: 1865717 - RNA, 18 nt, Homo sapiens
cugagcccuccacgucag

SEQ ID NO: 1865718 - RNA, 17 nt, Homo sapiens
ucccauuggaugcauuu

SEQ ID NO: 1865719 - RNA, 18 nt, Homo sapiens
augucuguagcuccucaa

SEQ ID NO: 1865720 - RNA, 19 nt, Homo sapiens
gugcaaauugucacaggac

SEQ ID NO: 1865721 - RNA, 22 nt, Homo sapiens
auccucuuucuuaguauaugaa

SEQ ID NO: 1865722 - RNA, 22 nt, Homo sapiens
cacagcccagaaccacagaugu

SEQ ID NO: 1865723 - RNA, 14 nt, Homo sapiens
acagucccacugug

SEQ ID NO: 1865724 - RNA, 11 nt, Homo sapiens
cuucaccaucu

SEQ ID NO: 1865725 - RNA, 14 nt, Homo sapiens
uugcagaugacaaa

SEQ ID NO: 1865726 - RNA, 22 nt, Homo sapiens
aacuaucucuacugaaugucau

SEQ ID NO: 1865727 - RNA, 14 nt, Homo sapiens
cccucugggaaccu

SEQ ID NO: 1865728 - RNA, 21 nt, Homo sapiens
cuuggccagaagggggccaug

SEQ ID NO: 1865729 - RNA, 16 nt, Homo sapiens
auuucaaccagcacau

SEQ ID NO: 1865730 - RNA, 16 nt, Homo sapiens
uguuacucuugggaca

SEQ ID NO: 1865731 - RNA, 20 nt, Homo sapiens
cacgcacacaucuuaccucu

SEQ ID NO: 1865732 - RNA, 16 nt, Homo sapiens
acugucuugaagacaa

SEQ ID NO: 1865733 - RNA, 23 nt, Homo sapiens
ugcucaaaaugccacagcccaga

SEQ ID NO: 1865734 - RNA, 12 nt, Homo sapiens
ccaguugcagac

SEQ ID NO: 1865735 - RNA, 22 nt, Homo sapiens
uggaagggaguuggugugcuau

SEQ ID NO: 1865736 - RNA, 18 nt, Homo sapiens
ccauuugugugugugcaa

SEQ ID NO: 1865737 - RNA, 22 nt, Homo sapiens
uuauauugccuaagaauaaaca

SEQ ID NO: 1865738 - RNA, 18 nt, Homo sapiens
cugaaccauuacuguaau

SEQ ID NO: 1865739 - RNA, 18 nt, Homo sapiens
uggaugacuaacuaucaa

SEQ ID NO: 1865740 - RNA, 21 nt, Homo sapiens
aagaccagcuguguuucuuaa

SEQ ID NO: 1865741 - RNA, 16 nt, Homo sapiens
uaggcugggcccagag

SEQ ID NO: 1865742 - RNA, 17 nt, Homo sapiens
cuuaaucuuuucacaaa

SEQ ID NO: 1865743 - RNA, 15 nt, Homo sapiens
augggugcagacccu

SEQ ID NO: 1865744 - RNA, 12 nt, Homo sapiens
gggacucuccaa

SEQ ID NO: 1865745 - RNA, 11 nt, Homo sapiens
gggcugcucac

SEQ ID NO: 1865746 - RNA, 16 nt, Homo sapiens
caggauggagugcagu

SEQ ID NO: 1865747 - RNA, 15 nt, Homo sapiens
ccugccaggcacacu

SEQ ID NO: 1865748 - RNA, 13 nt, Homo sapiens
aacaguaaugacu

SEQ ID NO: 1865749 - RNA, 21 nt, Homo sapiens
caggcaaucguggaugucucu

SEQ ID NO: 1865750 - RNA, 18 nt, Homo sapiens
ccgagaagggggugacag

SEQ ID NO: 1865751 - RNA, 19 nt, Homo sapiens
ugggaucuuucugggagcu

SEQ ID NO: 1865752 - RNA, 14 nt, Homo sapiens
gccauaccaggugc

SEQ ID NO: 1865753 - RNA, 15 nt, Homo sapiens
aguuuuacauuuuaa

SEQ ID NO: 1865754 - RNA, 21 nt, Homo sapiens
gcccagcagcuccuguggcca

SEQ ID NO: 1865755 - RNA, 12 nt, Homo sapiens
aucauguuugcu

SEQ ID NO: 1865756 - RNA, 16 nt, Homo sapiens
acuugugccagcagaa

SEQ ID NO: 1865757 - RNA, 22 nt, Homo sapiens
uaaaacaauaaaugaaugaaua

SEQ ID NO: 1865758 - RNA, 22 nt, Homo sapiens
uacaaaaaauuagcugggcaug

SEQ ID NO: 1865759 - RNA, 22 nt, Homo sapiens
uucagauccugaauuccagcaa

SEQ ID NO: 1865760 - RNA, 12 nt, Homo sapiens
ugcugaagccaa

SEQ ID NO: 1865761 - RNA, 18 nt, Homo sapiens
uggccuugaaacaguucc

SEQ ID NO: 1865762 - RNA, 19 nt, Homo sapiens
ccgaaguagcugggauuac

SEQ ID NO: 1865763 - RNA, 15 nt, Homo sapiens
aucuucaaagcuuuu

SEQ ID NO: 1865764 - RNA, 15 nt, Homo sapiens
uuauuccuuugcaua

SEQ ID NO: 1865765 - RNA, 12 nt, Homo sapiens
uuggaguuuucu

SEQ ID NO: 1865766 - RNA, 19 nt, Homo sapiens
ucgaacuccugacaucagg

SEQ ID NO: 1865767 - RNA, 23 nt, Homo sapiens
uauccaagacuuagagcugggaa

SEQ ID NO: 1865768 - RNA, 19 nt, Homo sapiens
uuauuugaguauugcugau

SEQ ID NO: 1865769 - RNA, 17 nt, Homo sapiens
ggcugcaguucuacuca

SEQ ID NO: 1865770 - RNA, 21 nt, Homo sapiens
gguccuagacuucccagggca

SEQ ID NO: 1865771 - RNA, 21 nt, Homo sapiens
agaagcccuguccuccacuca

SEQ ID NO: 1865772 - RNA, 15 nt, Homo sapiens
uccugcuccaugacu

SEQ ID NO: 1865773 - RNA, 23 nt, Homo sapiens
augauccuuuuuugucauuuuau

SEQ ID NO: 1865774 - RNA, 15 nt, Homo sapiens
gugucccaugaccca

SEQ ID NO: 1865775 - RNA, 17 nt, Homo sapiens
caggacagcuccuggac

SEQ ID NO: 1865776 - RNA, 18 nt, Homo sapiens
guaugaauaauugcauca

SEQ ID NO: 1865777 - RNA, 12 nt, Homo sapiens
cuugcugauaaa

SEQ ID NO: 1865778 - RNA, 16 nt, Homo sapiens
gaacuacagcucuuaa

SEQ ID NO: 1865779 - RNA, 12 nt, Homo sapiens
cucaucaaugug

SEQ ID NO: 1865780 - RNA, 16 nt, Homo sapiens
cauauaccagcaauau

SEQ ID NO: 1865781 - RNA, 22 nt, Homo sapiens
cccagcgugggaccccaaguga

SEQ ID NO: 1865782 - RNA, 23 nt, Homo sapiens
cacuggaugucaaacaguaauaa

SEQ ID NO: 1865783 - RNA, 13 nt, Homo sapiens
ccuuaaacucagg

SEQ ID NO: 1865784 - RNA, 13 nt, Homo sapiens
aaaauguccauga

SEQ ID NO: 1865785 - RNA, 16 nt, Homo sapiens
ucuuccagaugugaug

SEQ ID NO: 1865786 - RNA, 22 nt, Homo sapiens
cuggauagaaaaaugcuguuca

SEQ ID NO: 1865787 - RNA, 17 nt, Homo sapiens
agucagaugaggcccug

SEQ ID NO: 1865788 - RNA, 13 nt, Homo sapiens
uacccuuguccac

SEQ ID NO: 1865789 - RNA, 17 nt, Homo sapiens
gacugugcccaguacuu

SEQ ID NO: 1865790 - RNA, 19 nt, Homo sapiens
auuucucauugacuuuuau

SEQ ID NO: 1865791 - RNA, 13 nt, Homo sapiens
gcuucugaugaau

SEQ ID NO: 1865792 - RNA, 18 nt, Homo sapiens
gauauauguaaauauaca

SEQ ID NO: 1865793 - RNA, 22 nt, Homo sapiens
cccuggcccugccucauccacc

SEQ ID NO: 1865794 - RNA, 16 nt, Homo sapiens
gaguguaaaucuugcc

SEQ ID NO: 1865795 - RNA, 17 nt, Homo sapiens
caaaaagcugcuaucca

SEQ ID NO: 1865796 - RNA, 15 nt, Homo sapiens
agggacugagccaga

SEQ ID NO: 1865797 - RNA, 17 nt, Homo sapiens
ugauggggcaugugcca

SEQ ID NO: 1865798 - RNA, 17 nt, Homo sapiens
cuccuggcaaucaauac

SEQ ID NO: 1865799 - RNA, 13 nt, Homo sapiens
ugcugaacagugg

SEQ ID NO: 1865800 - RNA, 11 nt, Homo sapiens
agagugcagug

SEQ ID NO: 1865801 - RNA, 20 nt, Homo sapiens
accaaaaaaauaaagcauua

SEQ ID NO: 1865802 - RNA, 17 nt, Homo sapiens
agugaugaaaacauuca

SEQ ID NO: 1865803 - RNA, 17 nt, Homo sapiens
aaaccuuaagugcugca

SEQ ID NO: 1865804 - RNA, 15 nt, Homo sapiens
gaagauucuauguua

SEQ ID NO: 1865805 - RNA, 22 nt, Homo sapiens
aggaaaggauuuuaccaaagca

SEQ ID NO: 1865806 - RNA, 13 nt, Homo sapiens
ugccugccagcuu

SEQ ID NO: 1865807 - RNA, 22 nt, Homo sapiens
cucaugcuguugcugcuacugu

SEQ ID NO: 1865808 - RNA, 15 nt, Homo sapiens
cuuacaucaggaaau

SEQ ID NO: 1865809 - RNA, 22 nt, Homo sapiens
caguucuuuucaaccuacuuuc

SEQ ID NO: 1865810 - RNA, 14 nt, Homo sapiens
agagguguggcuuc

SEQ ID NO: 1865811 - RNA, 20 nt, Homo sapiens
uacaacaaacacugugaugu

SEQ ID NO: 1865812 - RNA, 21 nt, Homo sapiens
aguuuuaacuuuuauaccuau

SEQ ID NO: 1865813 - RNA, 19 nt, Homo sapiens
acacaauguggacgugcac

SEQ ID NO: 1865814 - RNA, 20 nt, Homo sapiens
augcauuaaaccaaguccau

SEQ ID NO: 1865815 - RNA, 13 nt, Homo sapiens
aacgcaaauauua

SEQ ID NO: 1865816 - RNA, 12 nt, Homo sapiens
ggccaagcagaa

SEQ ID NO: 1865817 - RNA, 19 nt, Homo sapiens
ccagguguggacgggacag

SEQ ID NO: 1865818 - RNA, 18 nt, Homo sapiens
ccuggguaacuagggaag

SEQ ID NO: 1865819 - RNA, 23 nt, Homo sapiens
gacauuucucaagggccaugugg

SEQ ID NO: 1865820 - RNA, 21 nt, Homo sapiens
ugaguagcugggauuacaggc

SEQ ID NO: 1865821 - RNA, 21 nt, Homo sapiens
ugagcagcugggauuacaggu

SEQ ID NO: 1865822 - RNA, 12 nt, Homo sapiens
ccccucaugccu

SEQ ID NO: 1865823 - RNA, 12 nt, Homo sapiens
guccucaucucu

SEQ ID NO: 1865824 - RNA, 12 nt, Homo sapiens
caauucaugaac

SEQ ID NO: 1865825 - RNA, 19 nt, Homo sapiens
agguccucugucagucaca

SEQ ID NO: 1865826 - RNA, 23 nt, Homo sapiens
acaagauggcuaggccaucacca

SEQ ID NO: 1865827 - RNA, 18 nt, Homo sapiens
ccccagagcuggaccuga

SEQ ID NO: 1865828 - RNA, 16 nt, Homo sapiens
gaaauugaugccagug

SEQ ID NO: 1865829 - RNA, 16 nt, Homo sapiens
cuuaaacuguguaaaa

SEQ ID NO: 1865830 - RNA, 20 nt, Homo sapiens
caaaccaaaucauacuuucu

SEQ ID NO: 1865831 - RNA, 21 nt, Homo sapiens
cacuauucuuuguauuaccaa

SEQ ID NO: 1865832 - RNA, 17 nt, Homo sapiens
uucaugugcagauugca

SEQ ID NO: 1865833 - RNA, 20 nt, Homo sapiens
aaggggagaaauaaacauaa

SEQ ID NO: 1865834 - RNA, 14 nt, Homo sapiens
gcuugauacaggaa

SEQ ID NO: 1865835 - RNA, 11 nt, Homo sapiens
ucauacuuugc

SEQ ID NO: 1865836 - RNA, 11 nt, Homo sapiens
cgcuacuucca

SEQ ID NO: 1865837 - RNA, 16 nt, Homo sapiens
ggcugcugcacugccc

SEQ ID NO: 1865838 - RNA, 13 nt, Homo sapiens
uauucuugguucu

SEQ ID NO: 1865839 - RNA, 19 nt, Homo sapiens
gggcuuugauuccaucucc

SEQ ID NO: 1865840 - RNA, 15 nt, Homo sapiens
gcuauguauuugcaa

SEQ ID NO: 1865841 - RNA, 16 nt, Homo sapiens
gaaaaguguaauagca

SEQ ID NO: 1865842 - RNA, 18 nt, Homo sapiens
uggauuuuucuuuaacug

SEQ ID NO: 1865843 - RNA, 18 nt, Homo sapiens
ugaagguugacacaggaa

SEQ ID NO: 1865844 - RNA, 12 nt, Homo sapiens
uacuuccuccua

SEQ ID NO: 1865845 - RNA, 18 nt, Homo sapiens
ggacacuaauacaccagg

SEQ ID NO: 1865846 - RNA, 18 nt, Homo sapiens
uacaugucuacaugccau

SEQ ID NO: 1865847 - RNA, 18 nt, Homo sapiens
cuccugcccaccugucaa

SEQ ID NO: 1865848 - RNA, 16 nt, Homo sapiens
aaugguuuacagagag

SEQ ID NO: 1865849 - RNA, 22 nt, Homo sapiens
cagacccauaccuuuccagggu

SEQ ID NO: 1865850 - RNA, 18 nt, Homo sapiens
gcuauagaaaacaauaca

SEQ ID NO: 1865851 - RNA, 19 nt, Homo sapiens
ggaucucggucacagggag

SEQ ID NO: 1865852 - RNA, 22 nt, Homo sapiens
acccugauaguuucccauaaca

SEQ ID NO: 1865853 - RNA, 17 nt, Homo sapiens
uccucuagaagaagcca

SEQ ID NO: 1865854 - RNA, 18 nt, Homo sapiens
cugaguuagguuccagca

SEQ ID NO: 1865855 - RNA, 19 nt, Homo sapiens
uucuaguauguacuuugaa

SEQ ID NO: 1865856 - RNA, 21 nt, Homo sapiens
auauuaagaaagacuaucuaa

SEQ ID NO: 1865857 - RNA, 16 nt, Homo sapiens
gaaccucacucuugcc

SEQ ID NO: 1865858 - RNA, 13 nt, Homo sapiens
uucaugccuuuca

SEQ ID NO: 1865859 - RNA, 18 nt, Homo sapiens
uuuccgugagcuaugaua

SEQ ID NO: 1865860 - RNA, 21 nt, Homo sapiens
ccagucacugcugcaaggugg

SEQ ID NO: 1865861 - RNA, 11 nt, Homo sapiens
ggcuucagugu

SEQ ID NO: 1865862 - RNA, 20 nt, Homo sapiens
gaacuuuauuggagcauuga

SEQ ID NO: 1865863 - RNA, 13 nt, Homo sapiens
uucaguaccaaag

SEQ ID NO: 1865864 - RNA, 22 nt, Homo sapiens
auaauaauuaaagaaugcaaua

SEQ ID NO: 1865865 - RNA, 14 nt, Homo sapiens
aauuuaaugcacua

SEQ ID NO: 1865866 - RNA, 14 nt, Homo sapiens
acuuuaaugaacua

SEQ ID NO: 1865867 - RNA, 16 nt, Homo sapiens
uacacguggaggaaug

SEQ ID NO: 1865868 - RNA, 15 nt, Homo sapiens
gaacauauguugcaa

SEQ ID NO: 1865869 - RNA, 14 nt, Homo sapiens
ccugacacuauuca

SEQ ID NO: 1865870 - RNA, 19 nt, Homo sapiens
guacucuuaggauauuuga

SEQ ID NO: 1865871 - RNA, 18 nt, Homo sapiens
agucauuuccuacccuuu

SEQ ID NO: 1865872 - RNA, 23 nt, Homo sapiens
ucuuuccuggacuuaacucuaau

SEQ ID NO: 1865873 - RNA, 17 nt, Homo sapiens
ugagucccuccaaaggg

SEQ ID NO: 1865874 - RNA, 22 nt, Homo sapiens
cugaggaaagauucaacugccu

SEQ ID NO: 1865875 - RNA, 21 nt, Homo sapiens
auuucacccagacagccuguu

SEQ ID NO: 1865876 - RNA, 15 nt, Homo sapiens
aagcaaaccuucuca

SEQ ID NO: 1865877 - RNA, 19 nt, Homo sapiens
ggcccgacagccuggcaca

SEQ ID NO: 1865878 - RNA, 20 nt, Homo sapiens
agaaaaauauauacuaaaca

SEQ ID NO: 1865879 - RNA, 14 nt, Homo sapiens
cucaaaaguauugu

SEQ ID NO: 1865880 - RNA, 22 nt, Homo sapiens
agcacaaacuuuaggguaaaaa

SEQ ID NO: 1865881 - RNA, 21 nt, Homo sapiens
ccacgcggccccacauugcac

SEQ ID NO: 1865882 - RNA, 17 nt, Homo sapiens
ccugugcccagcaugcc

SEQ ID NO: 1865883 - RNA, 19 nt, Homo sapiens
gaauucuagaaagagccuu

SEQ ID NO: 1865884 - RNA, 19 nt, Homo sapiens
aucccgucuucuccaacac

SEQ ID NO: 1865885 - RNA, 22 nt, Homo sapiens
uaaauccauauacuuuaaugca

SEQ ID NO: 1865886 - RNA, 23 nt, Homo sapiens
uguguuccacggaaaaugcuauc

SEQ ID NO: 1865887 - RNA, 17 nt, Homo sapiens
ucaucucugccuuugag

SEQ ID NO: 1865888 - RNA, 21 nt, Homo sapiens
auauauaauuuccucacugcc

SEQ ID NO: 1865889 - RNA, 15 nt, Homo sapiens
ucagaagcucuucua

SEQ ID NO: 1865890 - RNA, 24 nt, Homo sapiens
ugauuuuguaaaaauaaccaguag

SEQ ID NO: 1865891 - RNA, 13 nt, Homo sapiens
agaggagccagac

SEQ ID NO: 1865892 - RNA, 14 nt, Homo sapiens
accugugcacccca

SEQ ID NO: 1865893 - RNA, 15 nt, Homo sapiens
ugucaauaaaccugu

SEQ ID NO: 1865894 - RNA, 22 nt, Homo sapiens
gugcccuguuuccaaugccaau

SEQ ID NO: 1865895 - RNA, 22 nt, Homo sapiens
ucucaucuguaaaaccaggcug

SEQ ID NO: 1865896 - RNA, 22 nt, Homo sapiens
gaaagugugaagacccaaaaca

SEQ ID NO: 1865897 - RNA, 17 nt, Homo sapiens
ugaagccucagcuaccc

SEQ ID NO: 1865898 - RNA, 16 nt, Homo sapiens
agugaugaacgggcug

SEQ ID NO: 1865899 - RNA, 14 nt, Homo sapiens
caggcucucgcaca

SEQ ID NO: 1865900 - RNA, 12 nt, Homo sapiens
auguguuuacuu

SEQ ID NO: 1865901 - RNA, 20 nt, Homo sapiens
aggcgcacuuuccuccuggc

SEQ ID NO: 1865902 - RNA, 16 nt, Homo sapiens
uggaauagaugucuca

SEQ ID NO: 1865903 - RNA, 20 nt, Homo sapiens
agcaauuagauuaguauuuu

SEQ ID NO: 1865904 - RNA, 22 nt, Homo sapiens
uaagugcagcuugaauuucaaa

SEQ ID NO: 1865905 - RNA, 23 nt, Homo sapiens
aguaaucuuguugguucaccauu

SEQ ID NO: 1865906 - RNA, 18 nt, Homo sapiens
cugcaccccugguguccc

SEQ ID NO: 1865907 - RNA, 17 nt, Homo sapiens
gggcuggaaucucauga

SEQ ID NO: 1865908 - RNA, 20 nt, Homo sapiens
uaacagaguaucagaucuau

SEQ ID NO: 1865909 - RNA, 17 nt, Homo sapiens
gaaacuucggggcugca

SEQ ID NO: 1865910 - RNA, 19 nt, Homo sapiens
agagccagggcuguccuua

SEQ ID NO: 1865911 - RNA, 23 nt, Homo sapiens
auauuguucuuguaagcuuuaac

SEQ ID NO: 1865912 - RNA, 14 nt, Homo sapiens
uaaaagcaaaagag

SEQ ID NO: 1865913 - RNA, 17 nt, Homo sapiens
uggaggauagcagagaa

SEQ ID NO: 1865914 - RNA, 22 nt, Homo sapiens
aaccuggaggggcuagaaccua

SEQ ID NO: 1865915 - RNA, 15 nt, Homo sapiens
gugaggcccauucuu

SEQ ID NO: 1865916 - RNA, 16 nt, Homo sapiens
gagucuuguguucacc

SEQ ID NO: 1865917 - RNA, 17 nt, Homo sapiens
uucuuuacuggugauuu

SEQ ID NO: 1865918 - RNA, 17 nt, Homo sapiens
acauucauucaacagcu

SEQ ID NO: 1865919 - RNA, 13 nt, Homo sapiens
auaaauuucugcu

SEQ ID NO: 1865920 - RNA, 14 nt, Homo sapiens
auuuaacuugaugu

SEQ ID NO: 1865921 - RNA, 19 nt, Homo sapiens
caugacucagcauaccugc

SEQ ID NO: 1865922 - RNA, 17 nt, Homo sapiens
ucaaguaaaacaaauga

SEQ ID NO: 1865923 - RNA, 16 nt, Homo sapiens
aaucuaagcagcuuau

SEQ ID NO: 1865924 - RNA, 19 nt, Homo sapiens
cauuuguuuccucaucuuu

SEQ ID NO: 1865925 - RNA, 13 nt, Homo sapiens
uauuaccaugaga

SEQ ID NO: 1865926 - RNA, 16 nt, Homo sapiens
gaagggaaagcagucu

SEQ ID NO: 1865927 - RNA, 12 nt, Homo sapiens
gagccugaggca

SEQ ID NO: 1865928 - RNA, 17 nt, Homo sapiens
ugcccugacaugcacac

SEQ ID NO: 1865929 - RNA, 17 nt, Homo sapiens
gccugacagcauccucu

SEQ ID NO: 1865930 - RNA, 18 nt, Homo sapiens
acagaagucuugucucaa

SEQ ID NO: 1865931 - RNA, 15 nt, Homo sapiens
ugaggacugauuuca

SEQ ID NO: 1865932 - RNA, 10 nt, Homo sapiens
agcacuucaa

SEQ ID NO: 1865933 - RNA, 16 nt, Homo sapiens
acagaugccuccuucc

SEQ ID NO: 1865934 - RNA, 12 nt, Homo sapiens
guaauucagugu

SEQ ID NO: 1865935 - RNA, 18 nt, Homo sapiens
gagaacccaaacuuccca

SEQ ID NO: 1865936 - RNA, 15 nt, Homo sapiens
gcccccuccugcaag

SEQ ID NO: 1865937 - RNA, 18 nt, Homo sapiens
caucuuuuacauucugca

SEQ ID NO: 1865938 - RNA, 22 nt, Homo sapiens
gacaaauauuccuuugcauauu

SEQ ID NO: 1865939 - RNA, 11 nt, Homo sapiens
agcgcucuccu

SEQ ID NO: 1865940 - RNA, 14 nt, Homo sapiens
aggaucaggcugcu

SEQ ID NO: 1865941 - RNA, 21 nt, Homo sapiens
uuguacaacucuuacacaaau

SEQ ID NO: 1865942 - RNA, 19 nt, Homo sapiens
uuaaaggaaaaucacaucu

SEQ ID NO: 1865943 - RNA, 14 nt, Homo sapiens
ucgugaaaacacau

SEQ ID NO: 1865944 - RNA, 20 nt, Homo sapiens
cucuguaacaucacuaucca

SEQ ID NO: 1865945 - RNA, 14 nt, Homo sapiens
cgaggaaaagaaca

SEQ ID NO: 1865946 - RNA, 23 nt, Homo sapiens
gcauuaaccacucuacagacucc

SEQ ID NO: 1865947 - RNA, 15 nt, Homo sapiens
aggaaugugggcuau

SEQ ID NO: 1865948 - RNA, 17 nt, Homo sapiens
gcucacugguccauuuc

SEQ ID NO: 1865949 - RNA, 17 nt, Homo sapiens
ccuggucgccaauccau

SEQ ID NO: 1865950 - RNA, 15 nt, Homo sapiens
acucugauguggaau

SEQ ID NO: 1865951 - RNA, 16 nt, Homo sapiens
caagcuccucgugaua

SEQ ID NO: 1865952 - RNA, 21 nt, Homo sapiens
aagccauguauaaaugugaua

SEQ ID NO: 1865953 - RNA, 21 nt, Homo sapiens
uuguauuaauguagggcagaa

SEQ ID NO: 1865954 - RNA, 15 nt, Homo sapiens
ucccaggagaaucac

SEQ ID NO: 1865955 - RNA, 12 nt, Homo sapiens
gaccuuacuuug

SEQ ID NO: 1865956 - RNA, 13 nt, Homo sapiens
gcacacacaugca

SEQ ID NO: 1865957 - RNA, 22 nt, Homo sapiens
acaauaaaugcugaaugaaucc

SEQ ID NO: 1865958 - RNA, 17 nt, Homo sapiens
aaacugccugaaagcaa

SEQ ID NO: 1865959 - RNA, 21 nt, Homo sapiens
guuucaucauguuggccaggc

SEQ ID NO: 1865960 - RNA, 15 nt, Homo sapiens
uggggcucucucuuc

SEQ ID NO: 1865961 - RNA, 17 nt, Homo sapiens
uauucgguaauaucauu

SEQ ID NO: 1865962 - RNA, 13 nt, Homo sapiens
gaaguugugcaac

SEQ ID NO: 1865963 - RNA, 16 nt, Homo sapiens
guaacuuucugcugau

SEQ ID NO: 1865964 - RNA, 12 nt, Homo sapiens
cucaagcugucc

SEQ ID NO: 1865965 - RNA, 14 nt, Homo sapiens
acuugcacugugcu

SEQ ID NO: 1865966 - RNA, 14 nt, Homo sapiens
ugugcuacacuugc

SEQ ID NO: 1865967 - RNA, 19 nt, Homo sapiens
cucuguauuccgauacaaa

SEQ ID NO: 1865968 - RNA, 23 nt, Homo sapiens
auagcugggaacccgacugugaa

SEQ ID NO: 1865969 - RNA, 17 nt, Homo sapiens
auaauaaaaaauauucu

SEQ ID NO: 1865970 - RNA, 16 nt, Homo sapiens
aggggcucagcaaggu

SEQ ID NO: 1865971 - RNA, 17 nt, Homo sapiens
gaaauuuuguaagaagg

SEQ ID NO: 1865972 - RNA, 20 nt, Homo sapiens
acuuaaacucaucuauccag

SEQ ID NO: 1865973 - RNA, 21 nt, Homo sapiens
cugcccagcaaucaaaggcaa

SEQ ID NO: 1865974 - RNA, 16 nt, Homo sapiens
agaaguaggcucugau

SEQ ID NO: 1865975 - RNA, 14 nt, Homo sapiens
gugauaauuguaaa

SEQ ID NO: 1865976 - RNA, 20 nt, Homo sapiens
aucugucuugccagccagaa

SEQ ID NO: 1865977 - RNA, 21 nt, Homo sapiens
ccauauccgggugcucaauaa

SEQ ID NO: 1865978 - RNA, 17 nt, Homo sapiens
ugaaaaaaaguacaugu

SEQ ID NO: 1865979 - RNA, 15 nt, Homo sapiens
auagaugucagcaau

SEQ ID NO: 1865980 - RNA, 15 nt, Homo sapiens
uucauaagucuuugg

SEQ ID NO: 1865981 - RNA, 23 nt, Homo sapiens
aaccuggccuuauaucauuucau

SEQ ID NO: 1865982 - RNA, 19 nt, Homo sapiens
uuuaauauuuuauucucau

SEQ ID NO: 1865983 - RNA, 18 nt, Homo sapiens
cugaccugcggguccuca

SEQ ID NO: 1865984 - RNA, 19 nt, Homo sapiens
caugacaagaacaaagcca

SEQ ID NO: 1865985 - RNA, 22 nt, Homo sapiens
ucccaaccccaguggauucuca

SEQ ID NO: 1865986 - RNA, 23 nt, Homo sapiens
auuugucacaaauaaacauaaua

SEQ ID NO: 1865987 - RNA, 21 nt, Homo sapiens
uggaaaugaaacugcugugaa

SEQ ID NO: 1865988 - RNA, 15 nt, Homo sapiens
cggcucagccuugca

SEQ ID NO: 1865989 - RNA, 12 nt, Homo sapiens
agauacauuuca

SEQ ID NO: 1865990 - RNA, 12 nt, Homo sapiens
ugaaacauaucu

SEQ ID NO: 1865991 - RNA, 15 nt, Homo sapiens
aggucucacacuccu

SEQ ID NO: 1865992 - RNA, 18 nt, Homo sapiens
gacucugguauggccaaa

SEQ ID NO: 1865993 - RNA, 16 nt, Homo sapiens
gccgcagccaacccgg

SEQ ID NO: 1865994 - RNA, 18 nt, Homo sapiens
caggcacacagcuacucu

SEQ ID NO: 1865995 - RNA, 18 nt, Homo sapiens
uggucccagcggaugcug

SEQ ID NO: 1865996 - RNA, 23 nt, Homo sapiens
uccuuuuguagaaugaaccacug

SEQ ID NO: 1865997 - RNA, 12 nt, Homo sapiens
cugguccugacc

SEQ ID NO: 1865998 - RNA, 17 nt, Homo sapiens
gcacccacacacaaaga

SEQ ID NO: 1865999 - RNA, 21 nt, Homo sapiens
gggagaagaaggcaacccaaa

SEQ ID NO: 1866000 - RNA, 23 nt, Homo sapiens
gaggccuggcccgcuaaggugaa

SEQ ID NO: 1866001 - RNA, 22 nt, Homo sapiens
gacauugaggaccucauccaaa

SEQ ID NO: 1866002 - RNA, 16 nt, Homo sapiens
aggacccagcacugac

SEQ ID NO: 1866003 - RNA, 24 nt, Homo sapiens
uaaccaaggaaauauauuuuacca

SEQ ID NO: 1866004 - RNA, 18 nt, Homo sapiens
ugugguacuggcaauaag

SEQ ID NO: 1866005 - RNA, 18 nt, Homo sapiens
gaaaguccagcacuggaa

SEQ ID NO: 1866006 - RNA, 14 nt, Homo sapiens
gaacaccaauauua

SEQ ID NO: 1866007 - RNA, 16 nt, Homo sapiens
agaagcugucagggac

SEQ ID NO: 1866008 - RNA, 16 nt, Homo sapiens
ggccuaaaacaguauu

SEQ ID NO: 1866009 - RNA, 21 nt, Homo sapiens
uccaggguuguuagaucuucu

SEQ ID NO: 1866010 - RNA, 17 nt, Homo sapiens
auggcaauuucacugau

SEQ ID NO: 1866011 - RNA, 14 nt, Homo sapiens
caaaagugaucugu

SEQ ID NO: 1866012 - RNA, 13 nt, Homo sapiens
agugcuugauaug

SEQ ID NO: 1866013 - RNA, 17 nt, Homo sapiens
ccaagagagacauugcc

SEQ ID NO: 1866014 - RNA, 23 nt, Homo sapiens
accuuacugaaaaaaaaaaaaga

SEQ ID NO: 1866015 - RNA, 13 nt, Homo sapiens
cgcauuucaucaa

SEQ ID NO: 1866016 - RNA, 13 nt, Homo sapiens
agaauccuuggcu

SEQ ID NO: 1866017 - RNA, 22 nt, Homo sapiens
agcuucucuacagacuccaaaa

SEQ ID NO: 1866018 - RNA, 14 nt, Homo sapiens
ccugcccagucuuu

SEQ ID NO: 1866019 - RNA, 13 nt, Homo sapiens
ucuugaccuggag

SEQ ID NO: 1866020 - RNA, 13 nt, Homo sapiens
uccuccuuucucc

SEQ ID NO: 1866021 - RNA, 16 nt, Homo sapiens
uagauuuucaccuauc

SEQ ID NO: 1866022 - RNA, 21 nt, Homo sapiens
ccuugugccagagaacccagc

SEQ ID NO: 1866023 - RNA, 13 nt, Homo sapiens
cuauucugccaug

SEQ ID NO: 1866024 - RNA, 12 nt, Homo sapiens
cugaaagccaca

SEQ ID NO: 1866025 - RNA, 23 nt, Homo sapiens
uuaucaacuggggggaccaaaua

SEQ ID NO: 1866026 - RNA, 18 nt, Homo sapiens
cugaauccaccugcaguu

SEQ ID NO: 1866027 - RNA, 15 nt, Homo sapiens
ccagauguuggacca

SEQ ID NO: 1866028 - RNA, 15 nt, Homo sapiens
uagacauugcaauuu

SEQ ID NO: 1866029 - RNA, 19 nt, Homo sapiens
auauaguguuguguuacaa

SEQ ID NO: 1866030 - RNA, 21 nt, Homo sapiens
gcauaccaaguugauacuuga

SEQ ID NO: 1866031 - RNA, 18 nt, Homo sapiens
aaauaauuugaguuguau

SEQ ID NO: 1866032 - RNA, 16 nt, Homo sapiens
gaaauuguagugcaaa

SEQ ID NO: 1866033 - RNA, 12 nt, Homo sapiens
aaguucuaucag

SEQ ID NO: 1866034 - RNA, 15 nt, Homo sapiens
aauauuugagaauaa

SEQ ID NO: 1866035 - RNA, 18 nt, Homo sapiens
caaauggcuacaucucca

SEQ ID NO: 1866036 - RNA, 18 nt, Homo sapiens
acugagaacagcauauga

SEQ ID NO: 1866037 - RNA, 18 nt, Homo sapiens
auacugucucuccaguga

SEQ ID NO: 1866038 - RNA, 19 nt, Homo sapiens
aagucacaggacuauggac

SEQ ID NO: 1866039 - RNA, 14 nt, Homo sapiens
ggagucugucucug

SEQ ID NO: 1866040 - RNA, 15 nt, Homo sapiens
cauuuacguaaaaag

SEQ ID NO: 1866041 - RNA, 17 nt, Homo sapiens
agcugcuguggccauca

SEQ ID NO: 1866042 - RNA, 15 nt, Homo sapiens
cacauucauccucac

SEQ ID NO: 1866043 - RNA, 22 nt, Homo sapiens
cuuuuucugcacuauaugcaaa

SEQ ID NO: 1866044 - RNA, 20 nt, Homo sapiens
uucaccaucuguauauacaa

SEQ ID NO: 1866045 - RNA, 16 nt, Homo sapiens
auugucugccauuaca

SEQ ID NO: 1866046 - RNA, 14 nt, Homo sapiens
cuccgcaucaccuc

SEQ ID NO: 1866047 - RNA, 16 nt, Homo sapiens
uaucuuacaaagugua

SEQ ID NO: 1866048 - RNA, 20 nt, Homo sapiens
uaagcacuuuaacacagugu

SEQ ID NO: 1866049 - RNA, 15 nt, Homo sapiens
agcagcgagugcaug

SEQ ID NO: 1866050 - RNA, 12 nt, Homo sapiens
uuccuaucccau

SEQ ID NO: 1866051 - RNA, 16 nt, Homo sapiens
acugauuugauaccau

SEQ ID NO: 1866052 - RNA, 13 nt, Homo sapiens
ugauaguagauau

SEQ ID NO: 1866053 - RNA, 18 nt, Homo sapiens
ccuccuccaugcucccuu

SEQ ID NO: 1866054 - RNA, 17 nt, Homo sapiens
uccaugauucucugagu

SEQ ID NO: 1866055 - RNA, 17 nt, Homo sapiens
uaaaagcuauuagugaa

SEQ ID NO: 1866056 - RNA, 19 nt, Homo sapiens
caaccccccauuucuuccc

SEQ ID NO: 1866057 - RNA, 16 nt, Homo sapiens
uucccuuccacugccu

SEQ ID NO: 1866058 - RNA, 23 nt, Homo sapiens
acucaagguggacgugcguucug

SEQ ID NO: 1866059 - RNA, 14 nt, Homo sapiens
uauaaaagcugcau

SEQ ID NO: 1866060 - RNA, 15 nt, Homo sapiens
agcuccuguguuaca

SEQ ID NO: 1866061 - RNA, 15 nt, Homo sapiens
cuuuuuggccuguga

SEQ ID NO: 1866062 - RNA, 14 nt, Homo sapiens
gcugcugacccagc

SEQ ID NO: 1866063 - RNA, 20 nt, Homo sapiens
aguugggcucgcacugccca

SEQ ID NO: 1866064 - RNA, 15 nt, Homo sapiens
acaucuguauacccu

SEQ ID NO: 1866065 - RNA, 17 nt, Homo sapiens
ugagcaauucauuucac

SEQ ID NO: 1866066 - RNA, 20 nt, Homo sapiens
uguucaaaguuuaagcaauu

SEQ ID NO: 1866067 - RNA, 12 nt, Homo sapiens
uugccaaaguga

SEQ ID NO: 1866068 - RNA, 20 nt, Homo sapiens
ggccauuucacauuccugac

SEQ ID NO: 1866069 - RNA, 15 nt, Homo sapiens
auaauccacccccag

SEQ ID NO: 1866070 - RNA, 13 nt, Homo sapiens
uuuuuacauauag

SEQ ID NO: 1866071 - RNA, 13 nt, Homo sapiens
cagauacacugug

SEQ ID NO: 1866072 - RNA, 16 nt, Homo sapiens
caugaagcgaaacaca

SEQ ID NO: 1866073 - RNA, 21 nt, Homo sapiens
cuguuaacgucaucucagggu

SEQ ID NO: 1866074 - RNA, 13 nt, Homo sapiens
uaauuagcaguau

SEQ ID NO: 1866075 - RNA, 14 nt, Homo sapiens
gucugcaucuggcg

SEQ ID NO: 1866076 - RNA, 15 nt, Homo sapiens
gagagugaaaccaug

SEQ ID NO: 1866077 - RNA, 20 nt, Homo sapiens
uuacuuaugaugaugaaggg

SEQ ID NO: 1866078 - RNA, 13 nt, Homo sapiens
aacacccaugccc

SEQ ID NO: 1866079 - RNA, 13 nt, Homo sapiens
aacaaccaugcca

SEQ ID NO: 1866080 - RNA, 20 nt, Homo sapiens
guuauaaaucaaugucacuu

SEQ ID NO: 1866081 - RNA, 16 nt, Homo sapiens
aucucugcuuucacuc

SEQ ID NO: 1866082 - RNA, 19 nt, Homo sapiens
aucugggcaaaugaaaaug

SEQ ID NO: 1866083 - RNA, 13 nt, Homo sapiens
gccauguccaaag

SEQ ID NO: 1866084 - RNA, 21 nt, Homo sapiens
gcucgcuuccgcauccuaguc

SEQ ID NO: 1866085 - RNA, 15 nt, Homo sapiens
ugcccuucacuguca

SEQ ID NO: 1866086 - RNA, 21 nt, Homo sapiens
uguuuuucucuauaaaggguc

SEQ ID NO: 1866087 - RNA, 16 nt, Homo sapiens
aaccuuauauuuacaa

SEQ ID NO: 1866088 - RNA, 16 nt, Homo sapiens
uacuucuuuuucauua

SEQ ID NO: 1866089 - RNA, 16 nt, Homo sapiens
auucaccuaacuuuca

SEQ ID NO: 1866090 - RNA, 19 nt, Homo sapiens
cauuaaacaugaauuuaau

SEQ ID NO: 1866091 - RNA, 17 nt, Homo sapiens
acaccgaugugcgcaca

SEQ ID NO: 1866092 - RNA, 21 nt, Homo sapiens
uucugucauauuaagaaacac

SEQ ID NO: 1866093 - RNA, 22 nt, Homo sapiens
uggucaccuuccucugccuuug

SEQ ID NO: 1866094 - RNA, 14 nt, Homo sapiens
aaagaaguauauaa

SEQ ID NO: 1866095 - RNA, 15 nt, Homo sapiens
gaucccuacugccaa

SEQ ID NO: 1866096 - RNA, 16 nt, Homo sapiens
cagacaucuccucacc

SEQ ID NO: 1866097 - RNA, 16 nt, Homo sapiens
cagugcuuuccagccu

SEQ ID NO: 1866098 - RNA, 24 nt, Homo sapiens
uaaauucucuccuaaugaugacuu

SEQ ID NO: 1866099 - RNA, 15 nt, Homo sapiens
auaguggugugauuu

SEQ ID NO: 1866100 - RNA, 21 nt, Homo sapiens
ggcacagcgagggcagcaucu

SEQ ID NO: 1866101 - RNA, 16 nt, Homo sapiens
uguaaauuccaaagau

SEQ ID NO: 1866102 - RNA, 22 nt, Homo sapiens
ggcgccccuccgagggcccaac

SEQ ID NO: 1866103 - RNA, 18 nt, Homo sapiens
uccggaauccuguccuca

SEQ ID NO: 1866104 - RNA, 22 nt, Homo sapiens
uagacuuggacccaaaaaauca

SEQ ID NO: 1866105 - RNA, 16 nt, Homo sapiens
uauauuguguugcaaa

SEQ ID NO: 1866106 - RNA, 17 nt, Homo sapiens
acacuugggagcaaaag

SEQ ID NO: 1866107 - RNA, 23 nt, Homo sapiens
ggccuuacucauauauugccuuc

SEQ ID NO: 1866108 - RNA, 23 nt, Homo sapiens
gaaagacgccuucaucugggaca

SEQ ID NO: 1866109 - RNA, 23 nt, Homo sapiens
uugcugaccucagcgguugccag

SEQ ID NO: 1866110 - RNA, 17 nt, Homo sapiens
aagugacccugcucuca

SEQ ID NO: 1866111 - RNA, 16 nt, Homo sapiens
aacauuuaucaaucag

SEQ ID NO: 1866112 - RNA, 16 nt, Homo sapiens
uuaaaggaaaaucaca

SEQ ID NO: 1866113 - RNA, 20 nt, Homo sapiens
ggagccaacagaugugucag

SEQ ID NO: 1866114 - RNA, 17 nt, Homo sapiens
cuggaggccuuccagcu

SEQ ID NO: 1866115 - RNA, 21 nt, Homo sapiens
agcaugacauuggcaucagcu

SEQ ID NO: 1866116 - RNA, 22 nt, Homo sapiens
ccagcacuucauacgauuugag

SEQ ID NO: 1866117 - RNA, 15 nt, Homo sapiens
uugcgauagagucuc

SEQ ID NO: 1866118 - RNA, 22 nt, Homo sapiens
uaguccgugcugacagcugcuc

SEQ ID NO: 1866119 - RNA, 18 nt, Homo sapiens
uugauguuuuacgugcaa

SEQ ID NO: 1866120 - RNA, 14 nt, Homo sapiens
cagaaaauuugcaa

SEQ ID NO: 1866121 - RNA, 14 nt, Homo sapiens
cagauuauuugcuu

SEQ ID NO: 1866122 - RNA, 14 nt, Homo sapiens
uaaaauaucuacau

SEQ ID NO: 1866123 - RNA, 12 nt, Homo sapiens
uacaacagcugc

SEQ ID NO: 1866124 - RNA, 14 nt, Homo sapiens
augggagugggcac

SEQ ID NO: 1866125 - RNA, 20 nt, Homo sapiens
caauacaguuuauaaagcca

SEQ ID NO: 1866126 - RNA, 17 nt, Homo sapiens
ucagcaauacucaucag

SEQ ID NO: 1866127 - RNA, 21 nt, Homo sapiens
gauaaaggaagucaccaaaau

SEQ ID NO: 1866128 - RNA, 15 nt, Homo sapiens
caacucuauacucaa

SEQ ID NO: 1866129 - RNA, 16 nt, Homo sapiens
gcgugaccagcaguac

SEQ ID NO: 1866130 - RNA, 18 nt, Homo sapiens
caaugggaccugcucuua

SEQ ID NO: 1866131 - RNA, 14 nt, Homo sapiens
aaaauuccacucaa

SEQ ID NO: 1866132 - RNA, 12 nt, Homo sapiens
uuauacagugau

SEQ ID NO: 1866133 - RNA, 22 nt, Homo sapiens
acugaauagauaugaaagcuga

SEQ ID NO: 1866134 - RNA, 18 nt, Homo sapiens
uauauagugaugugcuag

SEQ ID NO: 1866135 - RNA, 16 nt, Homo sapiens
uuuagagauacuguug

SEQ ID NO: 1866136 - RNA, 18 nt, Homo sapiens
gcaacuucuagcauauag

SEQ ID NO: 1866137 - RNA, 17 nt, Homo sapiens
guacucauaaaggacac

SEQ ID NO: 1866138 - RNA, 16 nt, Homo sapiens
ugaccuuuuucacugu

SEQ ID NO: 1866139 - RNA, 22 nt, Homo sapiens
caauuugagauucuacaguaag

SEQ ID NO: 1866140 - RNA, 23 nt, Homo sapiens
uuccaauguagcucaguaauucc

SEQ ID NO: 1866141 - RNA, 21 nt, Homo sapiens
uagaucucccauguguaggua

SEQ ID NO: 1866142 - RNA, 24 nt, Homo sapiens
ugguggaguguagccuccaccuga

SEQ ID NO: 1866143 - RNA, 13 nt, Homo sapiens
cauuuccauacca

SEQ ID NO: 1866144 - RNA, 19 nt, Homo sapiens
uauugcuuaccugaucuca

SEQ ID NO: 1866145 - RNA, 13 nt, Homo sapiens
cugucagauccag

SEQ ID NO: 1866146 - RNA, 19 nt, Homo sapiens
uuaaaacacagcuuuacaa

SEQ ID NO: 1866147 - RNA, 13 nt, Homo sapiens
gauuuggggcuuu

SEQ ID NO: 1866148 - RNA, 19 nt, Homo sapiens
agaaagucagauucuugca

SEQ ID NO: 1866149 - RNA, 15 nt, Homo sapiens
cucuguuaacaucua

SEQ ID NO: 1866150 - RNA, 15 nt, Homo sapiens
ugcuucuugccauca

SEQ ID NO: 1866151 - RNA, 16 nt, Homo sapiens
uccugagcaaacaaaa

SEQ ID NO: 1866152 - RNA, 19 nt, Homo sapiens
cuagccuggcuauguccua

SEQ ID NO: 1866153 - RNA, 22 nt, Homo sapiens
agggggagccccuucugcucag

SEQ ID NO: 1866154 - RNA, 20 nt, Homo sapiens
uccccucuguuuacaucucc

SEQ ID NO: 1866155 - RNA, 23 nt, Homo sapiens
auauuuuuuaugaaacauuacag

SEQ ID NO: 1866156 - RNA, 14 nt, Homo sapiens
ucaagcuucauuau

SEQ ID NO: 1866157 - RNA, 16 nt, Homo sapiens
agccaagggacacagg

SEQ ID NO: 1866158 - RNA, 14 nt, Homo sapiens
uauagguuuccacu

SEQ ID NO: 1866159 - RNA, 19 nt, Homo sapiens
ugagccgagaucaugccau

SEQ ID NO: 1866160 - RNA, 17 nt, Homo sapiens
gcugcuggcugugacaa

SEQ ID NO: 1866161 - RNA, 14 nt, Homo sapiens
aucugcgugacaau

SEQ ID NO: 1866162 - RNA, 21 nt, Homo sapiens
aaaagugcuacuugagagugg

SEQ ID NO: 1866163 - RNA, 18 nt, Homo sapiens
cugcagcgaguacuuccc

SEQ ID NO: 1866164 - RNA, 17 nt, Homo sapiens
uaacauuaacuuuggaa

SEQ ID NO: 1866165 - RNA, 19 nt, Homo sapiens
ugcuauuuauuuuccuaaa

SEQ ID NO: 1866166 - RNA, 18 nt, Homo sapiens
agggguucuugagccagc

SEQ ID NO: 1866167 - RNA, 14 nt, Homo sapiens
agacauccugugau

SEQ ID NO: 1866168 - RNA, 15 nt, Homo sapiens
gagauauuaaugccc

SEQ ID NO: 1866169 - RNA, 23 nt, Homo sapiens
auuucauuuccauuuaagcaauu

SEQ ID NO: 1866170 - RNA, 14 nt, Homo sapiens
gauagcugguguua

SEQ ID NO: 1866171 - RNA, 14 nt, Homo sapiens
cuguuaugcauagc

SEQ ID NO: 1866172 - RNA, 15 nt, Homo sapiens
gguuaauucauuugg

SEQ ID NO: 1866173 - RNA, 14 nt, Homo sapiens
uccuggcugugcac

SEQ ID NO: 1866174 - RNA, 20 nt, Homo sapiens
acuguauaguuuaaagggag

SEQ ID NO: 1866175 - RNA, 19 nt, Homo sapiens
caaaggaggguuggccuga

SEQ ID NO: 1866176 - RNA, 18 nt, Homo sapiens
auaacuguucuucaauaa

SEQ ID NO: 1866177 - RNA, 19 nt, Homo sapiens
ugauuccauuuuacuucca

SEQ ID NO: 1866178 - RNA, 20 nt, Homo sapiens
gcucuguaggucauuggcca

SEQ ID NO: 1866179 - RNA, 12 nt, Homo sapiens
cuucauuucagg

SEQ ID NO: 1866180 - RNA, 13 nt, Homo sapiens
aaaugugaugaau

SEQ ID NO: 1866181 - RNA, 22 nt, Homo sapiens
ggacacuuuugaggacaaguua

SEQ ID NO: 1866182 - RNA, 18 nt, Homo sapiens
uaaaggucacauaaacuu

SEQ ID NO: 1866183 - RNA, 18 nt, Homo sapiens
uauuucauaucagucuug

SEQ ID NO: 1866184 - RNA, 20 nt, Homo sapiens
aaaggcaaauuuuauacaaa

SEQ ID NO: 1866185 - RNA, 16 nt, Homo sapiens
cacaauugaacuucca

SEQ ID NO: 1866186 - RNA, 18 nt, Homo sapiens
agggaugauucaagccau

SEQ ID NO: 1866187 - RNA, 16 nt, Homo sapiens
ucuguggagguggaaa

SEQ ID NO: 1866188 - RNA, 13 nt, Homo sapiens
acuggucagggca

SEQ ID NO: 1866189 - RNA, 20 nt, Homo sapiens
gcaaauaaaugaacugacuu

SEQ ID NO: 1866190 - RNA, 17 nt, Homo sapiens
cuucugaauauuggaca

SEQ ID NO: 1866191 - RNA, 20 nt, Homo sapiens
cuguagaccaccuaauauca

SEQ ID NO: 1866192 - RNA, 14 nt, Homo sapiens
gagggggaagugag

SEQ ID NO: 1866193 - RNA, 19 nt, Homo sapiens
aacuuguccuuccucaaga

SEQ ID NO: 1866194 - RNA, 18 nt, Homo sapiens
agaggugcugucagcuca

SEQ ID NO: 1866195 - RNA, 17 nt, Homo sapiens
ucuauuucagugccaau

SEQ ID NO: 1866196 - RNA, 16 nt, Homo sapiens
uuuccagauaagugua

SEQ ID NO: 1866197 - RNA, 20 nt, Homo sapiens
cuucacuuggccaguuucag

SEQ ID NO: 1866198 - RNA, 21 nt, Homo sapiens
cuacaaauuuaugcauuucau

SEQ ID NO: 1866199 - RNA, 14 nt, Homo sapiens
cugcugauuuucug

SEQ ID NO: 1866200 - RNA, 17 nt, Homo sapiens
aagauuacaaaagcaau

SEQ ID NO: 1866201 - RNA, 12 nt, Homo sapiens
ccaccacaggcc

SEQ ID NO: 1866202 - RNA, 20 nt, Homo sapiens
acaaucugaaucccuugcaa

SEQ ID NO: 1866203 - RNA, 23 nt, Homo sapiens
aucaagcauuuaccaugugcuaa

SEQ ID NO: 1866204 - RNA, 19 nt, Homo sapiens
augagugcgggaccacuau

SEQ ID NO: 1866205 - RNA, 22 nt, Homo sapiens
cagacccagaggauaagccacu

SEQ ID NO: 1866206 - RNA, 22 nt, Homo sapiens
gcuaaauucacagcgcuaugca

SEQ ID NO: 1866207 - RNA, 22 nt, Homo sapiens
ucucauccacugugcuucuuaa

SEQ ID NO: 1866208 - RNA, 21 nt, Homo sapiens
acagaaaauaaucugguguuc

SEQ ID NO: 1866209 - RNA, 23 nt, Homo sapiens
aagauucuucccauucuccauuu

SEQ ID NO: 1866210 - RNA, 23 nt, Homo sapiens
cacccuggaaucaagaugucaga

SEQ ID NO: 1866211 - RNA, 16 nt, Homo sapiens
aacaggcacaggcuca

SEQ ID NO: 1866212 - RNA, 13 nt, Homo sapiens
agcccagacuuua

SEQ ID NO: 1866213 - RNA, 22 nt, Homo sapiens
gugccuggaaauuaaacccugc

SEQ ID NO: 1866214 - RNA, 23 nt, Homo sapiens
aggcuauuuuucagaacuguuaa

SEQ ID NO: 1866215 - RNA, 19 nt, Homo sapiens
agaaguguuccuucauuaa

SEQ ID NO: 1866216 - RNA, 16 nt, Homo sapiens
guucaauggcugcuga

SEQ ID NO: 1866217 - RNA, 11 nt, Homo sapiens
acagaggcaua

SEQ ID NO: 1866218 - RNA, 21 nt, Homo sapiens
gaagaugauggcucauuuaca

SEQ ID NO: 1866219 - RNA, 17 nt, Homo sapiens
uuacagggugacucaca

SEQ ID NO: 1866220 - RNA, 17 nt, Homo sapiens
uguuucacuuuuaggga

SEQ ID NO: 1866221 - RNA, 19 nt, Homo sapiens
gguuuauucccaaguaugc

SEQ ID NO: 1866222 - RNA, 15 nt, Homo sapiens
cagaguucugcucua

SEQ ID NO: 1866223 - RNA, 16 nt, Homo sapiens
ucaaugaagauuaaca

SEQ ID NO: 1866224 - RNA, 22 nt, Homo sapiens
gcugcagguugcauaggugagg

SEQ ID NO: 1866225 - RNA, 14 nt, Homo sapiens
uagaaaugagccag

SEQ ID NO: 1866226 - RNA, 14 nt, Homo sapiens
gccagccaucaaau

SEQ ID NO: 1866227 - RNA, 14 nt, Homo sapiens
gcauugcagucaua

SEQ ID NO: 1866228 - RNA, 22 nt, Homo sapiens
acuugugcugaucgugcuaaau

SEQ ID NO: 1866229 - RNA, 17 nt, Homo sapiens
ucucauuuccaaaccau

SEQ ID NO: 1866230 - RNA, 14 nt, Homo sapiens
aacagauaagucca

SEQ ID NO: 1866231 - RNA, 18 nt, Homo sapiens
ccugacaccaccaucuau

SEQ ID NO: 1866232 - RNA, 13 nt, Homo sapiens
agacaaauacuua

SEQ ID NO: 1866233 - RNA, 15 nt, Homo sapiens
cacucaaugccaacu

SEQ ID NO: 1866234 - RNA, 17 nt, Homo sapiens
ucaaguagaucauggca

SEQ ID NO: 1866235 - RNA, 14 nt, Homo sapiens
augugcaugggagc

SEQ ID NO: 1866236 - RNA, 17 nt, Homo sapiens
ggaagugucugccagcu

SEQ ID NO: 1866237 - RNA, 21 nt, Homo sapiens
gaguugggggcggcuugucuu

SEQ ID NO: 1866238 - RNA, 14 nt, Homo sapiens
uugugauuguggaa

SEQ ID NO: 1866239 - RNA, 20 nt, Homo sapiens
aagauucauauuuacuucuu

SEQ ID NO: 1866240 - RNA, 18 nt, Homo sapiens
ugcuuuccagacuuugaa

SEQ ID NO: 1866241 - RNA, 19 nt, Homo sapiens
gaacucaaccucuacaggg

SEQ ID NO: 1866242 - RNA, 16 nt, Homo sapiens
aauuaaaauuuauucu

SEQ ID NO: 1866243 - RNA, 18 nt, Homo sapiens
auauaguuggugcucaau

SEQ ID NO: 1866244 - RNA, 14 nt, Homo sapiens
uuaucuugcugcac

SEQ ID NO: 1866245 - RNA, 18 nt, Homo sapiens
caagucauggucacagua

SEQ ID NO: 1866246 - RNA, 23 nt, Homo sapiens
ccaggcccagaaggaaccagcca

SEQ ID NO: 1866247 - RNA, 16 nt, Homo sapiens
acaccacagguucuca

SEQ ID NO: 1866248 - RNA, 18 nt, Homo sapiens
ugauccuaaugaaugcau

SEQ ID NO: 1866249 - RNA, 16 nt, Homo sapiens
gguccaguaauagcaa

SEQ ID NO: 1866250 - RNA, 12 nt, Homo sapiens
aaguucugggug

SEQ ID NO: 1866251 - RNA, 19 nt, Homo sapiens
ccucuugccuccuggaaaa

SEQ ID NO: 1866252 - RNA, 21 nt, Homo sapiens
cacauuuuuuaaacaguuaca

SEQ ID NO: 1866253 - RNA, 13 nt, Homo sapiens
cagaccagcacuu

SEQ ID NO: 1866254 - RNA, 23 nt, Homo sapiens
ccugaauuaaagucuacacugcc

SEQ ID NO: 1866255 - RNA, 16 nt, Homo sapiens
ugcugcuuccacucag

SEQ ID NO: 1866256 - RNA, 15 nt, Homo sapiens
uuauuaaaguuucaa

SEQ ID NO: 1866257 - RNA, 17 nt, Homo sapiens
ugaggaaacaggccuca

SEQ ID NO: 1866258 - RNA, 11 nt, Homo sapiens
caucucagugc

SEQ ID NO: 1866259 - RNA, 15 nt, Homo sapiens
uguuaucagucaaua

SEQ ID NO: 1866260 - RNA, 23 nt, Homo sapiens
cucucugagucaaauccaguggu

SEQ ID NO: 1866261 - RNA, 20 nt, Homo sapiens
caauaaaaaguucagaguuc

SEQ ID NO: 1866262 - RNA, 15 nt, Homo sapiens
acaauaaaugccacu

SEQ ID NO: 1866263 - RNA, 15 nt, Homo sapiens
uuuucuauccaaaua

SEQ ID NO: 1866264 - RNA, 21 nt, Homo sapiens
uuucaagugauggucauucau

SEQ ID NO: 1866265 - RNA, 22 nt, Homo sapiens
cagcgucacuccagugcucagc

SEQ ID NO: 1866266 - RNA, 13 nt, Homo sapiens
uaauagugccaag

SEQ ID NO: 1866267 - RNA, 17 nt, Homo sapiens
agcacuucucucuucaa

SEQ ID NO: 1866268 - RNA, 18 nt, Homo sapiens
ccuccuugcuuguuacau

SEQ ID NO: 1866269 - RNA, 23 nt, Homo sapiens
aucccaaacuuuaaaaugcgaaa

SEQ ID NO: 1866270 - RNA, 21 nt, Homo sapiens
cguccgcgcgccagcacagaa

SEQ ID NO: 1866271 - RNA, 21 nt, Homo sapiens
ccuauagaaacaccaguaccu

SEQ ID NO: 1866272 - RNA, 21 nt, Homo sapiens
ccauguuuauccauguacuuu

SEQ ID NO: 1866273 - RNA, 19 nt, Homo sapiens
augucaaauugaugugccc

SEQ ID NO: 1866274 - RNA, 20 nt, Homo sapiens
caccaccucuuucuacagcc

SEQ ID NO: 1866275 - RNA, 19 nt, Homo sapiens
guggccucagcccucagaa

SEQ ID NO: 1866276 - RNA, 18 nt, Homo sapiens
aagcucaacucucuuauu

SEQ ID NO: 1866277 - RNA, 17 nt, Homo sapiens
uggcggacggcucugac

SEQ ID NO: 1866278 - RNA, 22 nt, Homo sapiens
ggauauuaguuaaugagccauc

SEQ ID NO: 1866279 - RNA, 18 nt, Homo sapiens
gacucuuuccaaccggcu

SEQ ID NO: 1866280 - RNA, 15 nt, Homo sapiens
gccaauguacauacc

SEQ ID NO: 1866281 - RNA, 16 nt, Homo sapiens
ucuuacaauugcacug

SEQ ID NO: 1866282 - RNA, 14 nt, Homo sapiens
gucucguugcucau

SEQ ID NO: 1866283 - RNA, 19 nt, Homo sapiens
ugagugcaccugccuccac

SEQ ID NO: 1866284 - RNA, 15 nt, Homo sapiens
ggaaacaaaugugua

SEQ ID NO: 1866285 - RNA, 23 nt, Homo sapiens
uacuugaaggucuaggugcuuua

SEQ ID NO: 1866286 - RNA, 19 nt, Homo sapiens
cgggacacagaacuaguga

SEQ ID NO: 1866287 - RNA, 15 nt, Homo sapiens
ggcgaccaccaaagu

SEQ ID NO: 1866288 - RNA, 23 nt, Homo sapiens
cgaugugcaaguguaugcacgug

SEQ ID NO: 1866289 - RNA, 12 nt, Homo sapiens
acaacugugacu

SEQ ID NO: 1866290 - RNA, 19 nt, Homo sapiens
ugcaucacucauggaacac

SEQ ID NO: 1866291 - RNA, 19 nt, Homo sapiens
uccucuagcugugggggug

SEQ ID NO: 1866292 - RNA, 22 nt, Homo sapiens
guaaaccuugaagggcuuuauu

SEQ ID NO: 1866293 - RNA, 23 nt, Homo sapiens
aaaugucuugcuguugacauauu

SEQ ID NO: 1866294 - RNA, 19 nt, Homo sapiens
cauguuccugccccacagg

SEQ ID NO: 1866295 - RNA, 21 nt, Homo sapiens
aagcauguacuguacuuccca

SEQ ID NO: 1866296 - RNA, 14 nt, Homo sapiens
ugucuccagaguug

SEQ ID NO: 1866297 - RNA, 21 nt, Homo sapiens
acucuggaagauuuucauuga

SEQ ID NO: 1866298 - RNA, 17 nt, Homo sapiens
aauucaauuugaacuca

SEQ ID NO: 1866299 - RNA, 15 nt, Homo sapiens
gaaauguacauggcg

SEQ ID NO: 1866300 - RNA, 18 nt, Homo sapiens
ucgccagcccugggccug

SEQ ID NO: 1866301 - RNA, 19 nt, Homo sapiens
aaauccuauaagauuuaaa

SEQ ID NO: 1866302 - RNA, 15 nt, Homo sapiens
ugcacuagugcaauu

SEQ ID NO: 1866303 - RNA, 18 nt, Homo sapiens
aacagcgaagccagucca

SEQ ID NO: 1866304 - RNA, 14 nt, Homo sapiens
cucuuagcaaaaac

SEQ ID NO: 1866305 - RNA, 14 nt, Homo sapiens
gcuuuugugcauua

SEQ ID NO: 1866306 - RNA, 14 nt, Homo sapiens
uuuaaaguuuaaau

SEQ ID NO: 1866307 - RNA, 14 nt, Homo sapiens
gcagcugugcugca

SEQ ID NO: 1866308 - RNA, 21 nt, Homo sapiens
ugcauacuuagaugaucuuca

SEQ ID NO: 1866309 - RNA, 20 nt, Homo sapiens
ucugcaaaguguaugugacc

SEQ ID NO: 1866310 - RNA, 19 nt, Homo sapiens
gugggggccucuuuaccau

SEQ ID NO: 1866311 - RNA, 13 nt, Homo sapiens
agaguauguguau

SEQ ID NO: 1866312 - RNA, 23 nt, Homo sapiens
ccagaagagggguccgcugggag

SEQ ID NO: 1866313 - RNA, 15 nt, Homo sapiens
gccuggcacauuuca

SEQ ID NO: 1866314 - RNA, 12 nt, Homo sapiens
ucuuauugccuc

SEQ ID NO: 1866315 - RNA, 16 nt, Homo sapiens
gagucaggaaagacag

SEQ ID NO: 1866316 - RNA, 19 nt, Homo sapiens
gauaaaccaaugucauaac

SEQ ID NO: 1866317 - RNA, 13 nt, Homo sapiens
uaagcagccagac

SEQ ID NO: 1866318 - RNA, 19 nt, Homo sapiens
ccugauuugcugggcaguu

SEQ ID NO: 1866319 - RNA, 17 nt, Homo sapiens
ugaugaaagcugauuac

SEQ ID NO: 1866320 - RNA, 15 nt, Homo sapiens
uugucaccucuguga

SEQ ID NO: 1866321 - RNA, 22 nt, Homo sapiens
agagcaacaauccaucucucaa

SEQ ID NO: 1866322 - RNA, 13 nt, Homo sapiens
agccacaguaugg

SEQ ID NO: 1866323 - RNA, 21 nt, Homo sapiens
ccuucacauuuacuagcugug

SEQ ID NO: 1866324 - RNA, 20 nt, Homo sapiens
gcagucucuauaccaauaaa

SEQ ID NO: 1866325 - RNA, 15 nt, Homo sapiens
aauuacugauaucag

SEQ ID NO: 1866326 - RNA, 12 nt, Homo sapiens
acuuuuccugcu

SEQ ID NO: 1866327 - RNA, 17 nt, Homo sapiens
guuaugcagugaacuau

SEQ ID NO: 1866328 - RNA, 21 nt, Homo sapiens
agccaucaauuuuaacauuug

SEQ ID NO: 1866329 - RNA, 18 nt, Homo sapiens
agccucuucuuacuucac

SEQ ID NO: 1866330 - RNA, 13 nt, Homo sapiens
cuauucuccauac

SEQ ID NO: 1866331 - RNA, 19 nt, Homo sapiens
agaugauucagaaggggag

SEQ ID NO: 1866332 - RNA, 21 nt, Homo sapiens
cuaaaagcguuggauguagca

SEQ ID NO: 1866333 - RNA, 17 nt, Homo sapiens
uagcgucaagacauuug

SEQ ID NO: 1866334 - RNA, 17 nt, Homo sapiens
ccccugugcccacccag

SEQ ID NO: 1866335 - RNA, 22 nt, Homo sapiens
caaucacaaaggcugacauuca

SEQ ID NO: 1866336 - RNA, 16 nt, Homo sapiens
gacccuggaaauggac

SEQ ID NO: 1866337 - RNA, 17 nt, Homo sapiens
guuacaaagcuguguug

SEQ ID NO: 1866338 - RNA, 23 nt, Homo sapiens
gugaaauuauagaaauuuacuau

SEQ ID NO: 1866339 - RNA, 21 nt, Homo sapiens
aagccuccuguaccucagugg

SEQ ID NO: 1866340 - RNA, 22 nt, Homo sapiens
auggcuguaaaucuauuggcca

SEQ ID NO: 1866341 - RNA, 17 nt, Homo sapiens
cuuuuacucugccuaca

SEQ ID NO: 1866342 - RNA, 16 nt, Homo sapiens
ccugacuggcaaagga

SEQ ID NO: 1866343 - RNA, 21 nt, Homo sapiens
aaccaaguaucacacuuuaau

SEQ ID NO: 1866344 - RNA, 14 nt, Homo sapiens
aauucugauguuuc

SEQ ID NO: 1866345 - RNA, 14 nt, Homo sapiens
ugaaggauaagaga

SEQ ID NO: 1866346 - RNA, 18 nt, Homo sapiens
auaguaaacacagggaag

SEQ ID NO: 1866347 - RNA, 14 nt, Homo sapiens
caugugcuacaggg

SEQ ID NO: 1866348 - RNA, 19 nt, Homo sapiens
cagaccuagugcucccuuc

SEQ ID NO: 1866349 - RNA, 16 nt, Homo sapiens
uuuauuuccucaaaac

SEQ ID NO: 1866350 - RNA, 22 nt, Homo sapiens
uccagguuccauccaccaccuu

SEQ ID NO: 1866351 - RNA, 20 nt, Homo sapiens
guaauaacuucucugugaac

SEQ ID NO: 1866352 - RNA, 13 nt, Homo sapiens
gcccccucaguga

SEQ ID NO: 1866353 - RNA, 15 nt, Homo sapiens
cccuuugagucugaa

SEQ ID NO: 1866354 - RNA, 18 nt, Homo sapiens
aggaucaccagugcaucc

SEQ ID NO: 1866355 - RNA, 22 nt, Homo sapiens
aagccaucaaacacaaugccuc

SEQ ID NO: 1866356 - RNA, 16 nt, Homo sapiens
auuuauuuuuugccau

SEQ ID NO: 1866357 - RNA, 19 nt, Homo sapiens
ccuccaacgauuagcuuuu

SEQ ID NO: 1866358 - RNA, 21 nt, Homo sapiens
accagaaagugaggaagccua

SEQ ID NO: 1866359 - RNA, 17 nt, Homo sapiens
auguuauuauucuugag

SEQ ID NO: 1866360 - RNA, 14 nt, Homo sapiens
gccuaugugcaugc

SEQ ID NO: 1866361 - RNA, 15 nt, Homo sapiens
uuacugagguuuuua

SEQ ID NO: 1866362 - RNA, 15 nt, Homo sapiens
cgcacuucagaauuc

SEQ ID NO: 1866363 - RNA, 21 nt, Homo sapiens
auuguggaaagaugaaugcaa

SEQ ID NO: 1866364 - RNA, 22 nt, Homo sapiens
ccugaugucuugguuuccauca

SEQ ID NO: 1866365 - RNA, 15 nt, Homo sapiens
uucagaaaggggcau

SEQ ID NO: 1866366 - RNA, 16 nt, Homo sapiens
ccagaggaacaagcau

SEQ ID NO: 1866367 - RNA, 22 nt, Homo sapiens
cuuauauuucuguguacacauc

SEQ ID NO: 1866368 - RNA, 15 nt, Homo sapiens
aagaaggccacuggu

SEQ ID NO: 1866369 - RNA, 19 nt, Homo sapiens
agaugcauggcuggcacau

SEQ ID NO: 1866370 - RNA, 15 nt, Homo sapiens
gccaggccaggacca

SEQ ID NO: 1866371 - RNA, 17 nt, Homo sapiens
uccagaugaacugagaa

SEQ ID NO: 1866372 - RNA, 17 nt, Homo sapiens
uccuaagacacaaaugc

SEQ ID NO: 1866373 - RNA, 20 nt, Homo sapiens
ggaggcggaccuuguaguga

SEQ ID NO: 1866374 - RNA, 14 nt, Homo sapiens
acauguugccuugc

SEQ ID NO: 1866375 - RNA, 20 nt, Homo sapiens
agaaggcugugagccaagga

SEQ ID NO: 1866376 - RNA, 15 nt, Homo sapiens
aggccucuguggcac

SEQ ID NO: 1866377 - RNA, 14 nt, Homo sapiens
uuucuucuagguuu

SEQ ID NO: 1866378 - RNA, 23 nt, Homo sapiens
aaacugcaauagagacuguagau

SEQ ID NO: 1866379 - RNA, 16 nt, Homo sapiens
cagggcgagcacuuuc

SEQ ID NO: 1866380 - RNA, 18 nt, Homo sapiens
aacaggaauucugaauua

SEQ ID NO: 1866381 - RNA, 17 nt, Homo sapiens
gucacagguuaaugugg

SEQ ID NO: 1866382 - RNA, 13 nt, Homo sapiens
auuuucuaagaca

SEQ ID NO: 1866383 - RNA, 22 nt, Homo sapiens
uuguauuuuaacucauaccuuu

SEQ ID NO: 1866384 - RNA, 16 nt, Homo sapiens
agcugccuuggcucag

SEQ ID NO: 1866385 - RNA, 18 nt, Homo sapiens
ucagcaauacucaucaga

SEQ ID NO: 1866386 - RNA, 21 nt, Homo sapiens
aggagucccugguucauugau

SEQ ID NO: 1866387 - RNA, 15 nt, Homo sapiens
gaaauuuuuacuuua

SEQ ID NO: 1866388 - RNA, 22 nt, Homo sapiens
caagcaccuguuaauaaagguc

SEQ ID NO: 1866389 - RNA, 14 nt, Homo sapiens
cuuccugauucauu

SEQ ID NO: 1866390 - RNA, 17 nt, Homo sapiens
caucuccagugugccag

SEQ ID NO: 1866391 - RNA, 17 nt, Homo sapiens
cugcuaauagcugcuag

SEQ ID NO: 1866392 - RNA, 11 nt, Homo sapiens
uucacacagca

SEQ ID NO: 1866393 - RNA, 19 nt, Homo sapiens
uauauaauuuauuuccacu

SEQ ID NO: 1866394 - RNA, 14 nt, Homo sapiens
accacacacagcua

SEQ ID NO: 1866395 - RNA, 16 nt, Homo sapiens
cauggggcugauugua

SEQ ID NO: 1866396 - RNA, 21 nt, Homo sapiens
agcuaggacuuaaccuugaaa

SEQ ID NO: 1866397 - RNA, 12 nt, Homo sapiens
caagaaaaucag

SEQ ID NO: 1866398 - RNA, 21 nt, Homo sapiens
cugaugagaguggccccggcu

SEQ ID NO: 1866399 - RNA, 17 nt, Homo sapiens
aggcaucaccaugaaca

SEQ ID NO: 1866400 - RNA, 20 nt, Homo sapiens
acauuucaccccaggcucaa

SEQ ID NO: 1866401 - RNA, 16 nt, Homo sapiens
uaaacccagugcugcu

SEQ ID NO: 1866402 - RNA, 21 nt, Homo sapiens
uuuagugcuuucuugucagug

SEQ ID NO: 1866403 - RNA, 10 nt, Homo sapiens
aaagugcaua

SEQ ID NO: 1866404 - RNA, 16 nt, Homo sapiens
aacaauaacgauacaa

SEQ ID NO: 1866405 - RNA, 21 nt, Homo sapiens
cucaugcagauaguauacaca

SEQ ID NO: 1866406 - RNA, 21 nt, Homo sapiens
cugcgcccagcuauacuguau

SEQ ID NO: 1866407 - RNA, 19 nt, Homo sapiens
aaucaaugcaagagugauu

SEQ ID NO: 1866408 - RNA, 22 nt, Homo sapiens
guuaaacuaaggcccucuugaa

SEQ ID NO: 1866409 - RNA, 22 nt, Homo sapiens
uucuucaccucuuccacuccuu

SEQ ID NO: 1866410 - RNA, 18 nt, Homo sapiens
ugcacagaccucagagau

SEQ ID NO: 1866411 - RNA, 16 nt, Homo sapiens
ggaauaauuauuacau

SEQ ID NO: 1866412 - RNA, 15 nt, Homo sapiens
uccuuggccuaguca

SEQ ID NO: 1866413 - RNA, 15 nt, Homo sapiens
ucagcagacaaguga

SEQ ID NO: 1866414 - RNA, 16 nt, Homo sapiens
cuucagugugguacaa

SEQ ID NO: 1866415 - RNA, 13 nt, Homo sapiens
ugauacuuacuca

SEQ ID NO: 1866416 - RNA, 22 nt, Homo sapiens
uuagcacugcccuggugauuac

SEQ ID NO: 1866417 - RNA, 23 nt, Homo sapiens
cgcauauacauaaaguauccaug

SEQ ID NO: 1866418 - RNA, 21 nt, Homo sapiens
uguucagaacuucaucugcca

SEQ ID NO: 1866419 - RNA, 22 nt, Homo sapiens
gggccuggccugagcugggaug

SEQ ID NO: 1866420 - RNA, 20 nt, Homo sapiens
ugauucucuuuaacugugug

SEQ ID NO: 1866421 - RNA, 17 nt, Homo sapiens
auuccucaccaagcuca

SEQ ID NO: 1866422 - RNA, 22 nt, Homo sapiens
gcaugguuugcaugacuuuaca

SEQ ID NO: 1866423 - RNA, 20 nt, Homo sapiens
ugcaaaaaugacccaagaga

SEQ ID NO: 1866424 - RNA, 21 nt, Homo sapiens
cuggccaaccaaagacacugu

SEQ ID NO: 1866425 - RNA, 15 nt, Homo sapiens
cugcauuccugauga

SEQ ID NO: 1866426 - RNA, 20 nt, Homo sapiens
auauuggaaagugauuuuau

SEQ ID NO: 1866427 - RNA, 23 nt, Homo sapiens
uccagcaaaagagcuauugccaa

SEQ ID NO: 1866428 - RNA, 14 nt, Homo sapiens
uuuuaauagaguau

SEQ ID NO: 1866429 - RNA, 14 nt, Homo sapiens
cacauuuuuugcca

SEQ ID NO: 1866430 - RNA, 14 nt, Homo sapiens
auucuguggaacaa

SEQ ID NO: 1866431 - RNA, 12 nt, Homo sapiens
gugcuucugcuu

SEQ ID NO: 1866432 - RNA, 17 nt, Homo sapiens
ucccaaagugcuggaac

SEQ ID NO: 1866433 - RNA, 17 nt, Homo sapiens
ucauuggcuauaaccuc

SEQ ID NO: 1866434 - RNA, 17 nt, Homo sapiens
agacucuggaacccugg

SEQ ID NO: 1866435 - RNA, 17 nt, Homo sapiens
uaugcuacuguguuaca

SEQ ID NO: 1866436 - RNA, 15 nt, Homo sapiens
ucaugguacauuuau

SEQ ID NO: 1866437 - RNA, 15 nt, Homo sapiens
gcccaggucucucaa

SEQ ID NO: 1866438 - RNA, 15 nt, Homo sapiens
ucaaaaagauaucaa

SEQ ID NO: 1866439 - RNA, 22 nt, Homo sapiens
agucccuuacagaggaccaugc

SEQ ID NO: 1866440 - RNA, 18 nt, Homo sapiens
ccagaaggggauggacuu

SEQ ID NO: 1866441 - RNA, 22 nt, Homo sapiens
uucuagaacaauuacauguaaa

SEQ ID NO: 1866442 - RNA, 21 nt, Homo sapiens
aaccguccuucaucaccgaag

SEQ ID NO: 1866443 - RNA, 23 nt, Homo sapiens
uaguuaaugaaggugugcuacag

SEQ ID NO: 1866444 - RNA, 17 nt, Homo sapiens
cuugcccucaagcaaua

SEQ ID NO: 1866445 - RNA, 15 nt, Homo sapiens
aaaaagcuagcacua

SEQ ID NO: 1866446 - RNA, 18 nt, Homo sapiens
ugaagucagccacacugg

SEQ ID NO: 1866447 - RNA, 15 nt, Homo sapiens
ccagaucguacuuga

SEQ ID NO: 1866448 - RNA, 20 nt, Homo sapiens
cuaaacagacuauuuaacuu

SEQ ID NO: 1866449 - RNA, 19 nt, Homo sapiens
ugaauaagcuuucucucag

SEQ ID NO: 1866450 - RNA, 23 nt, Homo sapiens
gcucugccccucagggggccagc

SEQ ID NO: 1866451 - RNA, 21 nt, Homo sapiens
gagcagcaugauuauaagcca

SEQ ID NO: 1866452 - RNA, 21 nt, Homo sapiens
ucacuuccuucagcaucucac

SEQ ID NO: 1866453 - RNA, 22 nt, Homo sapiens
accaugcacuauauuuguauau

SEQ ID NO: 1866454 - RNA, 15 nt, Homo sapiens
gaaucuucaccucag

SEQ ID NO: 1866455 - RNA, 15 nt, Homo sapiens
gaaaaugcaccaaau

SEQ ID NO: 1866456 - RNA, 12 nt, Homo sapiens
gcuuuccuccca

SEQ ID NO: 1866457 - RNA, 18 nt, Homo sapiens
cucugacucagggcuccu

SEQ ID NO: 1866458 - RNA, 12 nt, Homo sapiens
ugcugccaaaca

SEQ ID NO: 1866459 - RNA, 21 nt, Homo sapiens
aaauaaguuuuuuuucugggu

SEQ ID NO: 1866460 - RNA, 23 nt, Homo sapiens
gaauacauuguauuaauaccaaa

SEQ ID NO: 1866461 - RNA, 15 nt, Homo sapiens
agaagcggcggguca

SEQ ID NO: 1866462 - RNA, 19 nt, Homo sapiens
ugccgaaaacaggagcaaa

SEQ ID NO: 1866463 - RNA, 14 nt, Homo sapiens
ggaugcccaaagau

SEQ ID NO: 1866464 - RNA, 23 nt, Homo sapiens
gaggcauuccagccccuauguua

SEQ ID NO: 1866465 - RNA, 15 nt, Homo sapiens
caggugaaaauccau

SEQ ID NO: 1866466 - RNA, 19 nt, Homo sapiens
cagaugcuuuccugcacau

SEQ ID NO: 1866467 - RNA, 15 nt, Homo sapiens
uaagaucagacucug

SEQ ID NO: 1866468 - RNA, 18 nt, Homo sapiens
cuguugaauuucccacau

SEQ ID NO: 1866469 - RNA, 19 nt, Homo sapiens
cgaccacuuccaggggaac

SEQ ID NO: 1866470 - RNA, 14 nt, Homo sapiens
acauacacacacac

SEQ ID NO: 1866471 - RNA, 14 nt, Homo sapiens
auacacacauauac

SEQ ID NO: 1866472 - RNA, 14 nt, Homo sapiens
auacauacauauau

SEQ ID NO: 1866473 - RNA, 23 nt, Homo sapiens
cacugauuugauaccauggcacu

SEQ ID NO: 1866474 - RNA, 14 nt, Homo sapiens
aaauauacaaacau

SEQ ID NO: 1866475 - RNA, 14 nt, Homo sapiens
ucuccaacucuuca

SEQ ID NO: 1866476 - RNA, 22 nt, Homo sapiens
ucuccuuuaauauacuccuuaa

SEQ ID NO: 1866477 - RNA, 17 nt, Homo sapiens
acuuugaagaguacaaa

SEQ ID NO: 1866478 - RNA, 18 nt, Homo sapiens
uccugaccucaaguaauc

SEQ ID NO: 1866479 - RNA, 17 nt, Homo sapiens
cuaagaacaccugcauu

SEQ ID NO: 1866480 - RNA, 20 nt, Homo sapiens
gagaauugugcuuucaccag

SEQ ID NO: 1866481 - RNA, 21 nt, Homo sapiens
ucaaggcccauaucugugaaa

SEQ ID NO: 1866482 - RNA, 18 nt, Homo sapiens
caagcucacaccuguccu

SEQ ID NO: 1866483 - RNA, 13 nt, Homo sapiens
gagcuuucugaua

SEQ ID NO: 1866484 - RNA, 21 nt, Homo sapiens
ugacagucauaaauacuguca

SEQ ID NO: 1866485 - RNA, 15 nt, Homo sapiens
gccugggaugcagug

SEQ ID NO: 1866486 - RNA, 23 nt, Homo sapiens
agaaacuaccuuuuuauaaugca

SEQ ID NO: 1866487 - RNA, 18 nt, Homo sapiens
agaucacaccacuguacu

SEQ ID NO: 1866488 - RNA, 17 nt, Homo sapiens
uuucauaucauucucac

SEQ ID NO: 1866489 - RNA, 19 nt, Homo sapiens
aacauuuuuucccagugag

SEQ ID NO: 1866490 - RNA, 16 nt, Homo sapiens
gacauaaauguucacu

SEQ ID NO: 1866491 - RNA, 20 nt, Homo sapiens
caagugagucugguggagga

SEQ ID NO: 1866492 - RNA, 23 nt, Homo sapiens
aaacugcagagagacaacagauu

SEQ ID NO: 1866493 - RNA, 23 nt, Homo sapiens
gaaaugcugguuuuucaguuuuc

SEQ ID NO: 1866494 - RNA, 13 nt, Homo sapiens
uaagccccuguga

SEQ ID NO: 1866495 - RNA, 12 nt, Homo sapiens
cuuuucugccaa

SEQ ID NO: 1866496 - RNA, 22 nt, Homo sapiens
ggccugagaagagagaucaaau

SEQ ID NO: 1866497 - RNA, 20 nt, Homo sapiens
cucaaccccuccccuccauc

SEQ ID NO: 1866498 - RNA, 17 nt, Homo sapiens
aaauguauuuuucacaa

SEQ ID NO: 1866499 - RNA, 23 nt, Homo sapiens
ggcauagaacuccggaaugacca

SEQ ID NO: 1866500 - RNA, 20 nt, Homo sapiens
gcaauaugggaggaacaaag

SEQ ID NO: 1866501 - RNA, 17 nt, Homo sapiens
cuugcagcuaguuuucu

SEQ ID NO: 1866502 - RNA, 12 nt, Homo sapiens
gagucucugaac

SEQ ID NO: 1866503 - RNA, 21 nt, Homo sapiens
ucugaauggggcuuuccugau

SEQ ID NO: 1866504 - RNA, 16 nt, Homo sapiens
acucugaaacugagaa

SEQ ID NO: 1866505 - RNA, 21 nt, Homo sapiens
aaggaugggaaaaacugcagu

SEQ ID NO: 1866506 - RNA, 15 nt, Homo sapiens
guggaagcuucuaaa

SEQ ID NO: 1866507 - RNA, 15 nt, Homo sapiens
aguuugauaaaaaga

SEQ ID NO: 1866508 - RNA, 16 nt, Homo sapiens
cugugaccuuugucua

SEQ ID NO: 1866509 - RNA, 16 nt, Homo sapiens
uggggagcacuugucc

SEQ ID NO: 1866510 - RNA, 17 nt, Homo sapiens
ucucaauguuccauuca

SEQ ID NO: 1866511 - RNA, 14 nt, Homo sapiens
gaagcaacccaaau

SEQ ID NO: 1866512 - RNA, 16 nt, Homo sapiens
ugcaggagugacucaa

SEQ ID NO: 1866513 - RNA, 15 nt, Homo sapiens
ccuaggaaaauguag

SEQ ID NO: 1866514 - RNA, 20 nt, Homo sapiens
agagaccccaggaacaauaa

SEQ ID NO: 1866515 - RNA, 14 nt, Homo sapiens
aaugccugcugcug

SEQ ID NO: 1866516 - RNA, 14 nt, Homo sapiens
cugagccaguuucc

SEQ ID NO: 1866517 - RNA, 18 nt, Homo sapiens
cucaauaaagaagcccau

SEQ ID NO: 1866518 - RNA, 13 nt, Homo sapiens
ucucacaaaucag

SEQ ID NO: 1866519 - RNA, 17 nt, Homo sapiens
agggccccugaccuccc

SEQ ID NO: 1866520 - RNA, 14 nt, Homo sapiens
cauauaugcaaaag

SEQ ID NO: 1866521 - RNA, 20 nt, Homo sapiens
caaaguucuuaucucuagcu

SEQ ID NO: 1866522 - RNA, 23 nt, Homo sapiens
uugggaucaauaggaaagcauau

SEQ ID NO: 1866523 - RNA, 22 nt, Homo sapiens
caaacucuaucugaaaucccaa

SEQ ID NO: 1866524 - RNA, 12 nt, Homo sapiens
aucucuaugugg

SEQ ID NO: 1866525 - RNA, 15 nt, Homo sapiens
gcagacauccucauc

SEQ ID NO: 1866526 - RNA, 21 nt, Homo sapiens
augaauucuuaagacuugcau

SEQ ID NO: 1866527 - RNA, 13 nt, Homo sapiens
gcucacaccaaau

SEQ ID NO: 1866528 - RNA, 13 nt, Homo sapiens
ugaugcuaugguu

SEQ ID NO: 1866529 - RNA, 15 nt, Homo sapiens
aagccggcucuucaa

SEQ ID NO: 1866530 - RNA, 19 nt, Homo sapiens
uguuugcacuuggcaaaaa

SEQ ID NO: 1866531 - RNA, 18 nt, Homo sapiens
caaggagcauccuuggca

SEQ ID NO: 1866532 - RNA, 16 nt, Homo sapiens
ugcuuuaaaaaugcaa

SEQ ID NO: 1866533 - RNA, 21 nt, Homo sapiens
ccucagcuucucaaaguacug

SEQ ID NO: 1866534 - RNA, 18 nt, Homo sapiens
uaucuguuuccuguucuc

SEQ ID NO: 1866535 - RNA, 17 nt, Homo sapiens
cagacacugcugcugcc

SEQ ID NO: 1866536 - RNA, 20 nt, Homo sapiens
caucagcuugcccuguuaaa

SEQ ID NO: 1866537 - RNA, 17 nt, Homo sapiens
guccagauauuucacau

SEQ ID NO: 1866538 - RNA, 20 nt, Homo sapiens
agcccugaacaaagcaccuc

SEQ ID NO: 1866539 - RNA, 15 nt, Homo sapiens
cccugugucauuuca

SEQ ID NO: 1866540 - RNA, 16 nt, Homo sapiens
ccucugcuauuugcug

SEQ ID NO: 1866541 - RNA, 13 nt, Homo sapiens
aaaauucaaagca

SEQ ID NO: 1866542 - RNA, 11 nt, Homo sapiens
ccuuuccuguc

SEQ ID NO: 1866543 - RNA, 15 nt, Homo sapiens
aaaaacaauuuugac

SEQ ID NO: 1866544 - RNA, 19 nt, Homo sapiens
aagauucacaccugacucu

SEQ ID NO: 1866545 - RNA, 21 nt, Homo sapiens
auuuucuagauuuucuacuuu

SEQ ID NO: 1866546 - RNA, 13 nt, Homo sapiens
gaaacuccauuga

SEQ ID NO: 1866547 - RNA, 14 nt, Homo sapiens
uauaccuagcacuu

SEQ ID NO: 1866548 - RNA, 20 nt, Homo sapiens
augaaauuauaaucugugga

SEQ ID NO: 1866549 - RNA, 12 nt, Homo sapiens
aaagcagccacg

SEQ ID NO: 1866550 - RNA, 16 nt, Homo sapiens
agguggagugucacau

SEQ ID NO: 1866551 - RNA, 15 nt, Homo sapiens
ccauuuagggcagca

SEQ ID NO: 1866552 - RNA, 15 nt, Homo sapiens
uaaaugauuaucucc

SEQ ID NO: 1866553 - RNA, 13 nt, Homo sapiens
acugagacuugaa

SEQ ID NO: 1866554 - RNA, 13 nt, Homo sapiens
gggaggccacguc

SEQ ID NO: 1866555 - RNA, 19 nt, Homo sapiens
aguagacaaagagccagaa

SEQ ID NO: 1866556 - RNA, 23 nt, Homo sapiens
cuuugcccuuggaggauccccag

SEQ ID NO: 1866557 - RNA, 12 nt, Homo sapiens
auguggauuugg

SEQ ID NO: 1866558 - RNA, 22 nt, Homo sapiens
aacacuagagaccaaaaagggg

SEQ ID NO: 1866559 - RNA, 11 nt, Homo sapiens
uuuuccaaaug

SEQ ID NO: 1866560 - RNA, 15 nt, Homo sapiens
guuugcuucuugcca

SEQ ID NO: 1866561 - RNA, 18 nt, Homo sapiens
agccauaggcccaggaua

SEQ ID NO: 1866562 - RNA, 22 nt, Homo sapiens
ugaaaaaccugggcaccuaagc

SEQ ID NO: 1866563 - RNA, 21 nt, Homo sapiens
agacuagagagauauuaaguc

SEQ ID NO: 1866564 - RNA, 16 nt, Homo sapiens
acucuggccuccaaaa

SEQ ID NO: 1866565 - RNA, 21 nt, Homo sapiens
aguagcugggauuacaggugu

SEQ ID NO: 1866566 - RNA, 18 nt, Homo sapiens
aaaugacaccacuaaaga

SEQ ID NO: 1866567 - RNA, 18 nt, Homo sapiens
cccagccccuuggaugug

SEQ ID NO: 1866568 - RNA, 20 nt, Homo sapiens
caagacucuuuggacacuca

SEQ ID NO: 1866569 - RNA, 20 nt, Homo sapiens
guucaaucucccgcugcugc

SEQ ID NO: 1866570 - RNA, 18 nt, Homo sapiens
aauuccccuacaucaaau

SEQ ID NO: 1866571 - RNA, 15 nt, Homo sapiens
aaugcaugaguaugu

SEQ ID NO: 1866572 - RNA, 17 nt, Homo sapiens
ccuuaaugguguucucu

SEQ ID NO: 1866573 - RNA, 13 nt, Homo sapiens
ugguguagacugu

SEQ ID NO: 1866574 - RNA, 23 nt, Homo sapiens
uacuucauucucucucauuauug

SEQ ID NO: 1866575 - RNA, 19 nt, Homo sapiens
ucccgaguaacugagauua

SEQ ID NO: 1866576 - RNA, 13 nt, Homo sapiens
ucagagacaucag

SEQ ID NO: 1866577 - RNA, 21 nt, Homo sapiens
acugccaucuuuaucaugaag

SEQ ID NO: 1866578 - RNA, 22 nt, Homo sapiens
caacacgagcaggcuacuguca

SEQ ID NO: 1866579 - RNA, 22 nt, Homo sapiens
ucauacugaaugaccacuugau

SEQ ID NO: 1866580 - RNA, 21 nt, Homo sapiens
cuugagguggugccuucucac

SEQ ID NO: 1866581 - RNA, 23 nt, Homo sapiens
cccaucuuuuguuacucuuggga

SEQ ID NO: 1866582 - RNA, 19 nt, Homo sapiens
cucguguucacucagcacu

SEQ ID NO: 1866583 - RNA, 18 nt, Homo sapiens
cacaaaacaacaaaaacc

SEQ ID NO: 1866584 - RNA, 17 nt, Homo sapiens
uugcaaauaaaauacua

SEQ ID NO: 1866585 - RNA, 13 nt, Homo sapiens
cugaacuguggaa

SEQ ID NO: 1866586 - RNA, 12 nt, Homo sapiens
aauggccuucca

SEQ ID NO: 1866587 - RNA, 15 nt, Homo sapiens
cagcgucccagucuc

SEQ ID NO: 1866588 - RNA, 14 nt, Homo sapiens
cacuacacuccagc

SEQ ID NO: 1866589 - RNA, 17 nt, Homo sapiens
uggcucugaacugcaca

SEQ ID NO: 1866590 - RNA, 22 nt, Homo sapiens
acugcaucguuucaucuuccaa

SEQ ID NO: 1866591 - RNA, 13 nt, Homo sapiens
acuguuacuuugg

SEQ ID NO: 1866592 - RNA, 21 nt, Homo sapiens
ugaguagcugggacuacaggc

SEQ ID NO: 1866593 - RNA, 18 nt, Homo sapiens
uaaauaaaaaguauacuu

SEQ ID NO: 1866594 - RNA, 18 nt, Homo sapiens
gguugguccucuugccuc

SEQ ID NO: 1866595 - RNA, 20 nt, Homo sapiens
cauuuaaaaagauauuguac

SEQ ID NO: 1866596 - RNA, 17 nt, Homo sapiens
aauagcaggacauuuac

SEQ ID NO: 1866597 - RNA, 17 nt, Homo sapiens
uauggagagaaaacaga

SEQ ID NO: 1866598 - RNA, 22 nt, Homo sapiens
gauggagagcagccagcaccca

SEQ ID NO: 1866599 - RNA, 14 nt, Homo sapiens
guugacugcugcuc

SEQ ID NO: 1866600 - RNA, 14 nt, Homo sapiens
gagcacugcauguc

SEQ ID NO: 1866601 - RNA, 18 nt, Homo sapiens
auggauugggggggccaa

SEQ ID NO: 1866602 - RNA, 13 nt, Homo sapiens
aauuguuaggaag

SEQ ID NO: 1866603 - RNA, 17 nt, Homo sapiens
aaugguguuguaugccu

SEQ ID NO: 1866604 - RNA, 19 nt, Homo sapiens
uuucccuucuuacaaugca

SEQ ID NO: 1866605 - RNA, 22 nt, Homo sapiens
acucaguuugucagacuuuaaa

SEQ ID NO: 1866606 - RNA, 15 nt, Homo sapiens
caucugcauugccca

SEQ ID NO: 1866607 - RNA, 16 nt, Homo sapiens
aggagauuucaugccu

SEQ ID NO: 1866608 - RNA, 16 nt, Homo sapiens
uuuguaggcauugcau

SEQ ID NO: 1866609 - RNA, 12 nt, Homo sapiens
uagcagugcuag

SEQ ID NO: 1866610 - RNA, 19 nt, Homo sapiens
auauuuuaaccugcauaaa

SEQ ID NO: 1866611 - RNA, 17 nt, Homo sapiens
ucacaagaaaacuauaa

SEQ ID NO: 1866612 - RNA, 14 nt, Homo sapiens
acagugcacaugaa

SEQ ID NO: 1866613 - RNA, 17 nt, Homo sapiens
auccaugaucacacagc

SEQ ID NO: 1866614 - RNA, 17 nt, Homo sapiens
ucccagaaggcauauca

SEQ ID NO: 1866615 - RNA, 23 nt, Homo sapiens
gaaaucaguuucucaaacugagc

SEQ ID NO: 1866616 - RNA, 13 nt, Homo sapiens
cugccacuucugc

SEQ ID NO: 1866617 - RNA, 18 nt, Homo sapiens
gacccagagagcuagggc

SEQ ID NO: 1866618 - RNA, 19 nt, Homo sapiens
acugcauucacacauggca

SEQ ID NO: 1866619 - RNA, 22 nt, Homo sapiens
caaauuauagaaacaauacugu

SEQ ID NO: 1866620 - RNA, 22 nt, Homo sapiens
auguuauagaacuucauggauc

SEQ ID NO: 1866621 - RNA, 21 nt, Homo sapiens
accaguuucugcggccuucca

SEQ ID NO: 1866622 - RNA, 14 nt, Homo sapiens
cugucaaccugaau

SEQ ID NO: 1866623 - RNA, 23 nt, Homo sapiens
cagugccccagggaguccagggu

SEQ ID NO: 1866624 - RNA, 14 nt, Homo sapiens
cacuaaacucuggg

SEQ ID NO: 1866625 - RNA, 15 nt, Homo sapiens
cagcgaguacuuccc

SEQ ID NO: 1866626 - RNA, 20 nt, Homo sapiens
caaauuuaauuaaagccuua

SEQ ID NO: 1866627 - RNA, 12 nt, Homo sapiens
cccucagcacug

SEQ ID NO: 1866628 - RNA, 14 nt, Homo sapiens
accucccugcaaua

SEQ ID NO: 1866629 - RNA, 22 nt, Homo sapiens
gaauuuaccucuuaugagcucc

SEQ ID NO: 1866630 - RNA, 16 nt, Homo sapiens
guaccacguauuccag

SEQ ID NO: 1866631 - RNA, 22 nt, Homo sapiens
gcuccaguauaaauuacaugca

SEQ ID NO: 1866632 - RNA, 23 nt, Homo sapiens
ccaucccucgugguccccaacag

SEQ ID NO: 1866633 - RNA, 16 nt, Homo sapiens
uccaaccccuuuccac

SEQ ID NO: 1866634 - RNA, 16 nt, Homo sapiens
ucaacaaagucaccca

SEQ ID NO: 1866635 - RNA, 15 nt, Homo sapiens
uugcuguaugguaua

SEQ ID NO: 1866636 - RNA, 13 nt, Homo sapiens
cacugccugaugg

SEQ ID NO: 1866637 - RNA, 17 nt, Homo sapiens
aggccaguaaucccagu

SEQ ID NO: 1866638 - RNA, 16 nt, Homo sapiens
gcuaguuugaccucau

SEQ ID NO: 1866639 - RNA, 17 nt, Homo sapiens
cagggaggcugguccua

SEQ ID NO: 1866640 - RNA, 15 nt, Homo sapiens
aauauucaugcugcc

SEQ ID NO: 1866641 - RNA, 22 nt, Homo sapiens
uucuuuuccuuuauaaaugucu

SEQ ID NO: 1866642 - RNA, 12 nt, Homo sapiens
auacagugucuu

SEQ ID NO: 1866643 - RNA, 22 nt, Homo sapiens
agaaaccuucauccuagcacua

SEQ ID NO: 1866644 - RNA, 23 nt, Homo sapiens
guggccaaggagcugcuauagcc

SEQ ID NO: 1866645 - RNA, 11 nt, Homo sapiens
ugcuucauuaa

SEQ ID NO: 1866646 - RNA, 22 nt, Homo sapiens
ggcccucccaucuccccgcuga

SEQ ID NO: 1866647 - RNA, 19 nt, Homo sapiens
caagaauggggaucacaga

SEQ ID NO: 1866648 - RNA, 16 nt, Homo sapiens
uuaaaacaucaauuga

SEQ ID NO: 1866649 - RNA, 12 nt, Homo sapiens
aaggcugcagga

SEQ ID NO: 1866650 - RNA, 12 nt, Homo sapiens
aauuuagucauu

SEQ ID NO: 1866651 - RNA, 20 nt, Homo sapiens
ccauguugcccagaauuuca

SEQ ID NO: 1866652 - RNA, 18 nt, Homo sapiens
aaaugcuaugacuguauc

SEQ ID NO: 1866653 - RNA, 13 nt, Homo sapiens
agucuucccugau

SEQ ID NO: 1866654 - RNA, 15 nt, Homo sapiens
aaagaugucucacag

SEQ ID NO: 1866655 - RNA, 15 nt, Homo sapiens
cuaaucagcucccuu

SEQ ID NO: 1866656 - RNA, 20 nt, Homo sapiens
caacucuaccccugcuccca

SEQ ID NO: 1866657 - RNA, 18 nt, Homo sapiens
guaccuccucucaguguu

SEQ ID NO: 1866658 - RNA, 19 nt, Homo sapiens
agauguucuaagucuuucc

SEQ ID NO: 1866659 - RNA, 20 nt, Homo sapiens
ucggauuugccauagccuug

SEQ ID NO: 1866660 - RNA, 19 nt, Homo sapiens
cagauccuuuuauucucca

SEQ ID NO: 1866661 - RNA, 17 nt, Homo sapiens
aaugcaauuagcauuau

SEQ ID NO: 1866662 - RNA, 21 nt, Homo sapiens
agcuuaacaaugcaacuuuua

SEQ ID NO: 1866663 - RNA, 17 nt, Homo sapiens
cauaaaaucgcuuucaa

SEQ ID NO: 1866664 - RNA, 22 nt, Homo sapiens
auaugcaggacggcaguacuca

SEQ ID NO: 1866665 - RNA, 17 nt, Homo sapiens
uaaggauagugugaaga

SEQ ID NO: 1866666 - RNA, 12 nt, Homo sapiens
cucuagacuuga

SEQ ID NO: 1866667 - RNA, 20 nt, Homo sapiens
acaacgagauaccaucucac

SEQ ID NO: 1866668 - RNA, 13 nt, Homo sapiens
uuuacauaugcuu

SEQ ID NO: 1866669 - RNA, 13 nt, Homo sapiens
aguacauaaucuu

SEQ ID NO: 1866670 - RNA, 15 nt, Homo sapiens
auuugcauauguaug

SEQ ID NO: 1866671 - RNA, 17 nt, Homo sapiens
cuuaaacuacaaacaca

SEQ ID NO: 1866672 - RNA, 21 nt, Homo sapiens
cagucaccuucugggcaaggg

SEQ ID NO: 1866673 - RNA, 20 nt, Homo sapiens
ugauugucaacacaaacugg

SEQ ID NO: 1866674 - RNA, 16 nt, Homo sapiens
aaucauucauuucgac

SEQ ID NO: 1866675 - RNA, 12 nt, Homo sapiens
cauucaucucau

SEQ ID NO: 1866676 - RNA, 16 nt, Homo sapiens
auaauacaacuaucau

SEQ ID NO: 1866677 - RNA, 23 nt, Homo sapiens
augcuuugugcgcagcguccagu

SEQ ID NO: 1866678 - RNA, 19 nt, Homo sapiens
auaccugguaagcaaaaac

SEQ ID NO: 1866679 - RNA, 12 nt, Homo sapiens
cuugugcacugg

SEQ ID NO: 1866680 - RNA, 12 nt, Homo sapiens
uuuaugcauuga

SEQ ID NO: 1866681 - RNA, 15 nt, Homo sapiens
ccuccuccacuugga

SEQ ID NO: 1866682 - RNA, 18 nt, Homo sapiens
caugaagcccaagugaaa

SEQ ID NO: 1866683 - RNA, 13 nt, Homo sapiens
gggaccgccagau

SEQ ID NO: 1866684 - RNA, 22 nt, Homo sapiens
gaccacucugucuuguguuucc

SEQ ID NO: 1866685 - RNA, 16 nt, Homo sapiens
ccuggagggcaagccc

SEQ ID NO: 1866686 - RNA, 21 nt, Homo sapiens
uggacaagugcuguugggaua

SEQ ID NO: 1866687 - RNA, 14 nt, Homo sapiens
agagccagcucucu

SEQ ID NO: 1866688 - RNA, 22 nt, Homo sapiens
ccaggggaaccugccaugccag

SEQ ID NO: 1866689 - RNA, 16 nt, Homo sapiens
acucagccccuacccc

SEQ ID NO: 1866690 - RNA, 19 nt, Homo sapiens
augcugagguacagaagcc

SEQ ID NO: 1866691 - RNA, 15 nt, Homo sapiens
agguuauacuccucc

SEQ ID NO: 1866692 - RNA, 19 nt, Homo sapiens
ccaaaggacuugacuugca

SEQ ID NO: 1866693 - RNA, 16 nt, Homo sapiens
caccucuccagcuccu

SEQ ID NO: 1866694 - RNA, 19 nt, Homo sapiens
uggaacacuuucaguuuca

SEQ ID NO: 1866695 - RNA, 22 nt, Homo sapiens
caauauugauuaagccuccucc

SEQ ID NO: 1866696 - RNA, 22 nt, Homo sapiens
ccaaacugucgugcaaacccag

SEQ ID NO: 1866697 - RNA, 17 nt, Homo sapiens
augucucagaccacuau

SEQ ID NO: 1866698 - RNA, 12 nt, Homo sapiens
ucugaguuugaa

SEQ ID NO: 1866699 - RNA, 21 nt, Homo sapiens
uucaaggcauuucuaucacau

SEQ ID NO: 1866700 - RNA, 19 nt, Homo sapiens
uucuuacccucucuuucaa

SEQ ID NO: 1866701 - RNA, 12 nt, Homo sapiens
uauaacuugucu

SEQ ID NO: 1866702 - RNA, 11 nt, Homo sapiens
uguaacugccc

SEQ ID NO: 1866703 - RNA, 20 nt, Homo sapiens
aguccacuuuccucucucuc

SEQ ID NO: 1866704 - RNA, 14 nt, Homo sapiens
cucuuaaaucauuu

SEQ ID NO: 1866705 - RNA, 23 nt, Homo sapiens
aggauacguacaccucuugccuc

SEQ ID NO: 1866706 - RNA, 18 nt, Homo sapiens
ugccacccauuccaucuc

SEQ ID NO: 1866707 - RNA, 18 nt, Homo sapiens
uugcugaaugucauuauu

SEQ ID NO: 1866708 - RNA, 16 nt, Homo sapiens
auaaauauauauucac

SEQ ID NO: 1866709 - RNA, 11 nt, Homo sapiens
aguaagccaug

SEQ ID NO: 1866710 - RNA, 13 nt, Homo sapiens
uaaaaugaagcuu

SEQ ID NO: 1866711 - RNA, 15 nt, Homo sapiens
cauuuucaaugugau

SEQ ID NO: 1866712 - RNA, 21 nt, Homo sapiens
auagacauuuuuuuguuccaa

SEQ ID NO: 1866713 - RNA, 23 nt, Homo sapiens
cauuucucuaacuccugccauuc

SEQ ID NO: 1866714 - RNA, 14 nt, Homo sapiens
cuggagaugcugcc

SEQ ID NO: 1866715 - RNA, 20 nt, Homo sapiens
ugguugaaaaccacagucag

SEQ ID NO: 1866716 - RNA, 13 nt, Homo sapiens
auggaagcaaaga

SEQ ID NO: 1866717 - RNA, 21 nt, Homo sapiens
gagaagcacuaagacugcuuc

SEQ ID NO: 1866718 - RNA, 12 nt, Homo sapiens
aaaucagcauuu

SEQ ID NO: 1866719 - RNA, 20 nt, Homo sapiens
uuauuaagagguaagacuua

SEQ ID NO: 1866720 - RNA, 19 nt, Homo sapiens
aggaaaaaugcugcuucuc

SEQ ID NO: 1866721 - RNA, 18 nt, Homo sapiens
uuucacuuuuaauuugcu

SEQ ID NO: 1866722 - RNA, 17 nt, Homo sapiens
guggaccugugcuguga

SEQ ID NO: 1866723 - RNA, 18 nt, Homo sapiens
cucccagagcaccugcug

SEQ ID NO: 1866724 - RNA, 19 nt, Homo sapiens
cauaaccccggaagccaaa

SEQ ID NO: 1866725 - RNA, 21 nt, Homo sapiens
aacauacauuaucaacauguu

SEQ ID NO: 1866726 - RNA, 15 nt, Homo sapiens
gcacuuauugaauau

SEQ ID NO: 1866727 - RNA, 11 nt, Homo sapiens
cuucuguccac

SEQ ID NO: 1866728 - RNA, 22 nt, Homo sapiens
ucugcagauagaaagcauuaca

SEQ ID NO: 1866729 - RNA, 20 nt, Homo sapiens
ucagcaguccuuaucaccag

SEQ ID NO: 1866730 - RNA, 19 nt, Homo sapiens
auuuucagaccaugaauga

SEQ ID NO: 1866731 - RNA, 12 nt, Homo sapiens
guaaacugccau

SEQ ID NO: 1866732 - RNA, 17 nt, Homo sapiens
caccuguggcugacgaa

SEQ ID NO: 1866733 - RNA, 11 nt, Homo sapiens
uuuuucaugau

SEQ ID NO: 1866734 - RNA, 14 nt, Homo sapiens
aucugcuuaucagu

SEQ ID NO: 1866735 - RNA, 14 nt, Homo sapiens
cccucuuucccacc

SEQ ID NO: 1866736 - RNA, 14 nt, Homo sapiens
uccuccugccucag

SEQ ID NO: 1866737 - RNA, 13 nt, Homo sapiens
cuuggacuaguga

SEQ ID NO: 1866738 - RNA, 19 nt, Homo sapiens
gaggcgggggagccuggag

SEQ ID NO: 1866739 - RNA, 23 nt, Homo sapiens
gagcaucaaucuuguuacugcug

SEQ ID NO: 1866740 - RNA, 18 nt, Homo sapiens
uccacaucaaguguucca

SEQ ID NO: 1866741 - RNA, 20 nt, Homo sapiens
ugugauauauuagggacacu

SEQ ID NO: 1866742 - RNA, 14 nt, Homo sapiens
cauggcacccugca

SEQ ID NO: 1866743 - RNA, 18 nt, Homo sapiens
uuauuccagagaagccag

SEQ ID NO: 1866744 - RNA, 19 nt, Homo sapiens
gauaacagcaauuguucag

SEQ ID NO: 1866745 - RNA, 21 nt, Homo sapiens
cuacguuaugaaaacagaugc

SEQ ID NO: 1866746 - RNA, 11 nt, Homo sapiens
acuucucacca

SEQ ID NO: 1866747 - RNA, 19 nt, Homo sapiens
cgucuucuguauacugugg

SEQ ID NO: 1866748 - RNA, 12 nt, Homo sapiens
gcacaucaggag

SEQ ID NO: 1866749 - RNA, 16 nt, Homo sapiens
auuucaccaccaaaug

SEQ ID NO: 1866750 - RNA, 14 nt, Homo sapiens
ugaaaccacuggaa

SEQ ID NO: 1866751 - RNA, 14 nt, Homo sapiens
agauggaacaauaa

SEQ ID NO: 1866752 - RNA, 13 nt, Homo sapiens
gaggaaguuuugu

SEQ ID NO: 1866753 - RNA, 23 nt, Homo sapiens
uugauccuuaccuuguauaucau

SEQ ID NO: 1866754 - RNA, 16 nt, Homo sapiens
gggguuggacaucucu

SEQ ID NO: 1866755 - RNA, 12 nt, Homo sapiens
agacauggccaa

SEQ ID NO: 1866756 - RNA, 20 nt, Homo sapiens
agcaugaaccuuguuuaaau

SEQ ID NO: 1866757 - RNA, 14 nt, Homo sapiens
uauugguagguuac

SEQ ID NO: 1866758 - RNA, 14 nt, Homo sapiens
auauucacuaagga

SEQ ID NO: 1866759 - RNA, 15 nt, Homo sapiens
agaaugaagacuguu

SEQ ID NO: 1866760 - RNA, 11 nt, Homo sapiens
caaucuuggcu

SEQ ID NO: 1866761 - RNA, 16 nt, Homo sapiens
uuaauaaagacagggu

SEQ ID NO: 1866762 - RNA, 22 nt, Homo sapiens
ccuuuggggagcaggaggccaa

SEQ ID NO: 1866763 - RNA, 12 nt, Homo sapiens
aaacacugaugg

SEQ ID NO: 1866764 - RNA, 11 nt, Homo sapiens
ggacuguguuu

SEQ ID NO: 1866765 - RNA, 15 nt, Homo sapiens
gaaaaaaaucaucua

SEQ ID NO: 1866766 - RNA, 19 nt, Homo sapiens
ccuucagucuucuucacuu

SEQ ID NO: 1866767 - RNA, 17 nt, Homo sapiens
ccaugccagacccacug

SEQ ID NO: 1866768 - RNA, 19 nt, Homo sapiens
aagccuuaagcacaauuaa

SEQ ID NO: 1866769 - RNA, 17 nt, Homo sapiens
augcaaagaacucacca

SEQ ID NO: 1866770 - RNA, 12 nt, Homo sapiens
ugaagaacugac

SEQ ID NO: 1866771 - RNA, 15 nt, Homo sapiens
ccaggugcugcucag

SEQ ID NO: 1866772 - RNA, 17 nt, Homo sapiens
aacaauccaaaugcauu

SEQ ID NO: 1866773 - RNA, 18 nt, Homo sapiens
acagaccacaucuuuauc

SEQ ID NO: 1866774 - RNA, 19 nt, Homo sapiens
uaaaaacaguugccaguga

SEQ ID NO: 1866775 - RNA, 15 nt, Homo sapiens
auaaugugcuuuauu

SEQ ID NO: 1866776 - RNA, 18 nt, Homo sapiens
uccuaaauguaaucacga

SEQ ID NO: 1866777 - RNA, 18 nt, Homo sapiens
ugauggugagcugggaag

SEQ ID NO: 1866778 - RNA, 17 nt, Homo sapiens
ugcauugagcucucuca

SEQ ID NO: 1866779 - RNA, 11 nt, Homo sapiens
agccagugugu

SEQ ID NO: 1866780 - RNA, 20 nt, Homo sapiens
gaagauauaacuauugccca

SEQ ID NO: 1866781 - RNA, 15 nt, Homo sapiens
aagagguuuucacaa

SEQ ID NO: 1866782 - RNA, 18 nt, Homo sapiens
ggcccaucucuucuggcc

SEQ ID NO: 1866783 - RNA, 23 nt, Homo sapiens
ugguguaagccaguuccagcaca

SEQ ID NO: 1866784 - RNA, 23 nt, Homo sapiens
acuauucuuuguauuaccaaagc

SEQ ID NO: 1866785 - RNA, 18 nt, Homo sapiens
caaaauaaugcaccacuu

SEQ ID NO: 1866786 - RNA, 16 nt, Homo sapiens
aaacagaugaugagaa

SEQ ID NO: 1866787 - RNA, 16 nt, Homo sapiens
gcugugauacacugaa

SEQ ID NO: 1866788 - RNA, 14 nt, Homo sapiens
ggaagucaccaaaa

SEQ ID NO: 1866789 - RNA, 13 nt, Homo sapiens
caguguacaugga

SEQ ID NO: 1866790 - RNA, 17 nt, Homo sapiens
uggaacagcagauuuca

SEQ ID NO: 1866791 - RNA, 23 nt, Homo sapiens
ugggguuucaccauguuggccag

SEQ ID NO: 1866792 - RNA, 21 nt, Homo sapiens
gagcacgggguagccggagaa

SEQ ID NO: 1866793 - RNA, 23 nt, Homo sapiens
ucauuagggcaaagaucucagca

SEQ ID NO: 1866794 - RNA, 13 nt, Homo sapiens
gcuaauucuuugc

SEQ ID NO: 1866795 - RNA, 18 nt, Homo sapiens
auuguucagacauuccau

SEQ ID NO: 1866796 - RNA, 21 nt, Homo sapiens
ugaugugaguugagccuucag

SEQ ID NO: 1866797 - RNA, 20 nt, Homo sapiens
aauguguguagauacuuccu

SEQ ID NO: 1866798 - RNA, 21 nt, Homo sapiens
cgagaucacgccacugcacuc

SEQ ID NO: 1866799 - RNA, 17 nt, Homo sapiens
uaaaucuccaguacuug

SEQ ID NO: 1866800 - RNA, 22 nt, Homo sapiens
acacugucagcagggacuguaa

SEQ ID NO: 1866801 - RNA, 15 nt, Homo sapiens
uaauuuacaugcaau

SEQ ID NO: 1866802 - RNA, 19 nt, Homo sapiens
aaguuuugccuauccuaag

SEQ ID NO: 1866803 - RNA, 21 nt, Homo sapiens
gcuguuggauuucagugauuu

SEQ ID NO: 1866804 - RNA, 16 nt, Homo sapiens
gcguuuuucucaaagg

SEQ ID NO: 1866805 - RNA, 19 nt, Homo sapiens
cguaucccgagucugggac

SEQ ID NO: 1866806 - RNA, 16 nt, Homo sapiens
cuugacuaucacauac

SEQ ID NO: 1866807 - RNA, 17 nt, Homo sapiens
ucuccguagaauuuugc

SEQ ID NO: 1866808 - RNA, 19 nt, Homo sapiens
gucucgcucuguugcccag

SEQ ID NO: 1866809 - RNA, 14 nt, Homo sapiens
gaagaaaaauaucu

SEQ ID NO: 1866810 - RNA, 17 nt, Homo sapiens
guuugccgucugugaca

SEQ ID NO: 1866811 - RNA, 23 nt, Homo sapiens
cggcugguuuuguaagaugcugg

SEQ ID NO: 1866812 - RNA, 19 nt, Homo sapiens
gcuccuuucuccugugaau

SEQ ID NO: 1866813 - RNA, 22 nt, Homo sapiens
aaugaagaacacuguagcuaca

SEQ ID NO: 1866814 - RNA, 21 nt, Homo sapiens
aaaucuuuuuuguucaaagau

SEQ ID NO: 1866815 - RNA, 22 nt, Homo sapiens
gaaauaaauguaccugauguac

SEQ ID NO: 1866816 - RNA, 23 nt, Homo sapiens
ucaaguaagaucaagaaucuuuu

SEQ ID NO: 1866817 - RNA, 23 nt, Homo sapiens
uugaugccuuuuuuuucaugaca

SEQ ID NO: 1866818 - RNA, 23 nt, Homo sapiens
cagguaggaaacaauucuuucaa

SEQ ID NO: 1866819 - RNA, 10 nt, Homo sapiens
auuucaggga

SEQ ID NO: 1866820 - RNA, 15 nt, Homo sapiens
cucaggcccaugcua

SEQ ID NO: 1866821 - RNA, 21 nt, Homo sapiens
aauugccauggcccugagcca

SEQ ID NO: 1866822 - RNA, 16 nt, Homo sapiens
aaaacacugucugcau

SEQ ID NO: 1866823 - RNA, 15 nt, Homo sapiens
ccaauccagguggga

SEQ ID NO: 1866824 - RNA, 16 nt, Homo sapiens
acauacacacauuaga

SEQ ID NO: 1866825 - RNA, 22 nt, Homo sapiens
ugugaaagaguucuggauucaa

SEQ ID NO: 1866826 - RNA, 18 nt, Homo sapiens
cuaauucccagaguguga

SEQ ID NO: 1866827 - RNA, 21 nt, Homo sapiens
uacacacagccacgcugauaa

SEQ ID NO: 1866828 - RNA, 14 nt, Homo sapiens
cuuugucaguguug

SEQ ID NO: 1866829 - RNA, 16 nt, Homo sapiens
aaaauaugccauuuau

SEQ ID NO: 1866830 - RNA, 13 nt, Homo sapiens
guucccaccauuc

SEQ ID NO: 1866831 - RNA, 16 nt, Homo sapiens
acuggagccaucucuu

SEQ ID NO: 1866832 - RNA, 17 nt, Homo sapiens
ucaccuauuaccagugu

SEQ ID NO: 1866833 - RNA, 13 nt, Homo sapiens
acgucuugcuauu

SEQ ID NO: 1866834 - RNA, 23 nt, Homo sapiens
gagagagcccccacccaguuccu

SEQ ID NO: 1866835 - RNA, 20 nt, Homo sapiens
ugaacuacuaaaguuuuaca

SEQ ID NO: 1866836 - RNA, 21 nt, Homo sapiens
agagcccggcgccccugccac

SEQ ID NO: 1866837 - RNA, 20 nt, Homo sapiens
caagugggucaauuccuuag

SEQ ID NO: 1866838 - RNA, 18 nt, Homo sapiens
ugcugcaccaaugcacug

SEQ ID NO: 1866839 - RNA, 18 nt, Homo sapiens
cacugcacacaugcacac

SEQ ID NO: 1866840 - RNA, 19 nt, Homo sapiens
cagacuauugacaucagca

SEQ ID NO: 1866841 - RNA, 22 nt, Homo sapiens
cucccaacacucuuggggacca

SEQ ID NO: 1866842 - RNA, 17 nt, Homo sapiens
ucuuuacaaagaaaaaa

SEQ ID NO: 1866843 - RNA, 22 nt, Homo sapiens
uuguuuauacuccaguguacau

SEQ ID NO: 1866844 - RNA, 18 nt, Homo sapiens
uuaacuuacacugaucaa

SEQ ID NO: 1866845 - RNA, 18 nt, Homo sapiens
cugccauuggacuaugga

SEQ ID NO: 1866846 - RNA, 24 nt, Homo sapiens
gagacaggguuuggcugugucuaa

SEQ ID NO: 1866847 - RNA, 13 nt, Homo sapiens
cucugacucccaa

SEQ ID NO: 1866848 - RNA, 14 nt, Homo sapiens
auugcacuccaguc

SEQ ID NO: 1866849 - RNA, 14 nt, Homo sapiens
auuccacuccacuc

SEQ ID NO: 1866850 - RNA, 21 nt, Homo sapiens
auguucagucacaugugcucu

SEQ ID NO: 1866851 - RNA, 14 nt, Homo sapiens
uaacuuacgaucuc

SEQ ID NO: 1866852 - RNA, 18 nt, Homo sapiens
gccucccacccuucucag

SEQ ID NO: 1866853 - RNA, 20 nt, Homo sapiens
guaaauacugguaccuuccc

SEQ ID NO: 1866854 - RNA, 20 nt, Homo sapiens
caagagaugggaaugaggug

SEQ ID NO: 1866855 - RNA, 16 nt, Homo sapiens
uuuaaucaccaaggcu

SEQ ID NO: 1866856 - RNA, 18 nt, Homo sapiens
acaggguauuaauaugcu

SEQ ID NO: 1866857 - RNA, 16 nt, Homo sapiens
ggaauauccagucaaa

SEQ ID NO: 1866858 - RNA, 22 nt, Homo sapiens
ggccucccagagugcugggauu

SEQ ID NO: 1866859 - RNA, 16 nt, Homo sapiens
aggccuuuuuugccag

SEQ ID NO: 1866860 - RNA, 10 nt, Homo sapiens
uuccacugag

SEQ ID NO: 1866861 - RNA, 21 nt, Homo sapiens
uuugaauauuuguauacacau

SEQ ID NO: 1866862 - RNA, 21 nt, Homo sapiens
caacauuacuccauuacuaaa

SEQ ID NO: 1866863 - RNA, 17 nt, Homo sapiens
uuccaagcaaguauuag

SEQ ID NO: 1866864 - RNA, 15 nt, Homo sapiens
aucucuccagccgaa

SEQ ID NO: 1866865 - RNA, 14 nt, Homo sapiens
aggcggugcuugau

SEQ ID NO: 1866866 - RNA, 21 nt, Homo sapiens
gcaguagugcaccaucucacu

SEQ ID NO: 1866867 - RNA, 21 nt, Homo sapiens
gaugcuuuaugcaacuaacug

SEQ ID NO: 1866868 - RNA, 22 nt, Homo sapiens
aaaucacacagccaagccaguc

SEQ ID NO: 1866869 - RNA, 20 nt, Homo sapiens
gaagaacggggcucuucuca

SEQ ID NO: 1866870 - RNA, 17 nt, Homo sapiens
aaaauaaaauggacaga

SEQ ID NO: 1866871 - RNA, 21 nt, Homo sapiens
ucuuucagccaagaauucuua

SEQ ID NO: 1866872 - RNA, 14 nt, Homo sapiens
ugcaucccccagca

SEQ ID NO: 1866873 - RNA, 23 nt, Homo sapiens
auagucugaacacaagcauuuca

SEQ ID NO: 1866874 - RNA, 23 nt, Homo sapiens
acuacacauucaauaagcaucaa

SEQ ID NO: 1866875 - RNA, 13 nt, Homo sapiens
gccugcacucccc

SEQ ID NO: 1866876 - RNA, 17 nt, Homo sapiens
uccaaguauauaugaau

SEQ ID NO: 1866877 - RNA, 13 nt, Homo sapiens
accuuuccagcca

SEQ ID NO: 1866878 - RNA, 18 nt, Homo sapiens
aagaugcaacuaggaaga

SEQ ID NO: 1866879 - RNA, 21 nt, Homo sapiens
gaguggcaucuucuuugcauc

SEQ ID NO: 1866880 - RNA, 13 nt, Homo sapiens
cuagaagggcuag

SEQ ID NO: 1866881 - RNA, 23 nt, Homo sapiens
uuacucacaccuguaaucccagc

SEQ ID NO: 1866882 - RNA, 21 nt, Homo sapiens
uccccaguucauugcacuuug

SEQ ID NO: 1866883 - RNA, 18 nt, Homo sapiens
auaccaggauagcuuuau

SEQ ID NO: 1866884 - RNA, 16 nt, Homo sapiens
cauguugagaccucag

SEQ ID NO: 1866885 - RNA, 22 nt, Homo sapiens
ucaguaauuccgacuuucucag

SEQ ID NO: 1866886 - RNA, 22 nt, Homo sapiens
ugaccauagggcucugcuuuua

SEQ ID NO: 1866887 - RNA, 15 nt, Homo sapiens
guaaauguccugcua

SEQ ID NO: 1866888 - RNA, 21 nt, Homo sapiens
auaaucugucaaaacacugug

SEQ ID NO: 1866889 - RNA, 14 nt, Homo sapiens
cugcuuauucaguc

SEQ ID NO: 1866890 - RNA, 14 nt, Homo sapiens
aaaaaaugaagaca

SEQ ID NO: 1866891 - RNA, 14 nt, Homo sapiens
ugaaaauguggaca

SEQ ID NO: 1866892 - RNA, 16 nt, Homo sapiens
gcaagcuuauaaugua

SEQ ID NO: 1866893 - RNA, 16 nt, Homo sapiens
aaauaaaaauauuaaa

SEQ ID NO: 1866894 - RNA, 19 nt, Homo sapiens
auggauaaaauaaugcugc

SEQ ID NO: 1866895 - RNA, 15 nt, Homo sapiens
aaaugcaaacacugu

SEQ ID NO: 1866896 - RNA, 14 nt, Homo sapiens
cuuuauucugcaag

SEQ ID NO: 1866897 - RNA, 20 nt, Homo sapiens
uggaagugugugccaagagc

SEQ ID NO: 1866898 - RNA, 20 nt, Homo sapiens
agcauaaagaauuugucaca

SEQ ID NO: 1866899 - RNA, 12 nt, Homo sapiens
cagagugccauc

SEQ ID NO: 1866900 - RNA, 20 nt, Homo sapiens
caccacugagccauccucag

SEQ ID NO: 1866901 - RNA, 16 nt, Homo sapiens
gaaagugacuaccaga

SEQ ID NO: 1866902 - RNA, 23 nt, Homo sapiens
ccccacgagggucaggacuguga

SEQ ID NO: 1866903 - RNA, 16 nt, Homo sapiens
gaacugaacauuccag

SEQ ID NO: 1866904 - RNA, 18 nt, Homo sapiens
cgaccuggagacugacaa

SEQ ID NO: 1866905 - RNA, 21 nt, Homo sapiens
gauccaauaugacucagagaa

SEQ ID NO: 1866906 - RNA, 13 nt, Homo sapiens
gcuaggcagggag

SEQ ID NO: 1866907 - RNA, 16 nt, Homo sapiens
aaagcuaccauuuauc

SEQ ID NO: 1866908 - RNA, 22 nt, Homo sapiens
ugguaccaggcccgcacugggg

SEQ ID NO: 1866909 - RNA, 19 nt, Homo sapiens
gcacucaccuucuggccag

SEQ ID NO: 1866910 - RNA, 19 nt, Homo sapiens
ccacugaaaugaccaagac

SEQ ID NO: 1866911 - RNA, 20 nt, Homo sapiens
acuccuauaaggagaguuca

SEQ ID NO: 1866912 - RNA, 21 nt, Homo sapiens
acuauaaagcaguagacaauc

SEQ ID NO: 1866913 - RNA, 11 nt, Homo sapiens
aacuccugacc

SEQ ID NO: 1866914 - RNA, 16 nt, Homo sapiens
gcagccacugugcuga

SEQ ID NO: 1866915 - RNA, 22 nt, Homo sapiens
acaaauacuuagacaguaugca

SEQ ID NO: 1866916 - RNA, 16 nt, Homo sapiens
ugauacaguacuuuga

SEQ ID NO: 1866917 - RNA, 14 nt, Homo sapiens
agaacugucuguga

SEQ ID NO: 1866918 - RNA, 21 nt, Homo sapiens
ucacuugucaauaaaauccau

SEQ ID NO: 1866919 - RNA, 20 nt, Homo sapiens
gugcucuuugcugcacuauu

SEQ ID NO: 1866920 - RNA, 16 nt, Homo sapiens
acgauugacaccaaaa

SEQ ID NO: 1866921 - RNA, 20 nt, Homo sapiens
guuuaaugucugccagguga

SEQ ID NO: 1866922 - RNA, 16 nt, Homo sapiens
cugugaaaauugacca

SEQ ID NO: 1866923 - RNA, 20 nt, Homo sapiens
auugucagucagcaaacucc

SEQ ID NO: 1866924 - RNA, 23 nt, Homo sapiens
auauuugaaaaaauuaaaaucuu

SEQ ID NO: 1866925 - RNA, 13 nt, Homo sapiens
aacagaagugcau

SEQ ID NO: 1866926 - RNA, 16 nt, Homo sapiens
uuuggcaacaggagag

SEQ ID NO: 1866927 - RNA, 20 nt, Homo sapiens
uccugaaaaaaaaccugaga

SEQ ID NO: 1866928 - RNA, 17 nt, Homo sapiens
cuaaagucauccauccu

SEQ ID NO: 1866929 - RNA, 16 nt, Homo sapiens
cagucaggaagacaca

SEQ ID NO: 1866930 - RNA, 22 nt, Homo sapiens
gcuuuagaguagauguuuggaa

SEQ ID NO: 1866931 - RNA, 21 nt, Homo sapiens
caguaucuauauauguguaug

SEQ ID NO: 1866932 - RNA, 21 nt, Homo sapiens
aagaugguguuuggcucuuau

SEQ ID NO: 1866933 - RNA, 13 nt, Homo sapiens
cuggcaggggauc

SEQ ID NO: 1866934 - RNA, 23 nt, Homo sapiens
uaacgcaggccuuuuauuuucua

SEQ ID NO: 1866935 - RNA, 19 nt, Homo sapiens
uucuccuuuaaauucuuuc

SEQ ID NO: 1866936 - RNA, 14 nt, Homo sapiens
uggggucuguaaau

SEQ ID NO: 1866937 - RNA, 20 nt, Homo sapiens
aaaagacguucauuauguau

SEQ ID NO: 1866938 - RNA, 22 nt, Homo sapiens
ggcacugaccggugcuuuuauu

SEQ ID NO: 1866939 - RNA, 20 nt, Homo sapiens
cuugggggucugcucugugc

SEQ ID NO: 1866940 - RNA, 18 nt, Homo sapiens
uucaugcuucuacuguga

SEQ ID NO: 1866941 - RNA, 19 nt, Homo sapiens
uguaccucauggaugcuuu

SEQ ID NO: 1866942 - RNA, 13 nt, Homo sapiens
cucuuccugugau

SEQ ID NO: 1866943 - RNA, 13 nt, Homo sapiens
aauuuggaguaaa

SEQ ID NO: 1866944 - RNA, 16 nt, Homo sapiens
cccaccacugauauca

SEQ ID NO: 1866945 - RNA, 14 nt, Homo sapiens
gagaguccaucagc

SEQ ID NO: 1866946 - RNA, 20 nt, Homo sapiens
caccagaagacaaacaauau

SEQ ID NO: 1866947 - RNA, 13 nt, Homo sapiens
acccacuccucac

SEQ ID NO: 1866948 - RNA, 12 nt, Homo sapiens
cuguacugccaa

SEQ ID NO: 1866949 - RNA, 23 nt, Homo sapiens
ugacuucuuuacuaacacuggcu

SEQ ID NO: 1866950 - RNA, 18 nt, Homo sapiens
ugugucgcuuaugucuau

SEQ ID NO: 1866951 - RNA, 21 nt, Homo sapiens
caaggauggaugcagauccag

SEQ ID NO: 1866952 - RNA, 15 nt, Homo sapiens
agcaaugacugugcu

SEQ ID NO: 1866953 - RNA, 23 nt, Homo sapiens
aagccaauaccguguggcccaag

SEQ ID NO: 1866954 - RNA, 20 nt, Homo sapiens
agagugagaccccaucucua

SEQ ID NO: 1866955 - RNA, 18 nt, Homo sapiens
uccuccuagacucuguga

SEQ ID NO: 1866956 - RNA, 13 nt, Homo sapiens
cucuguccaacaa

SEQ ID NO: 1866957 - RNA, 20 nt, Homo sapiens
cagucugauccauccaucuc

SEQ ID NO: 1866958 - RNA, 19 nt, Homo sapiens
aaacaaaacuugcaugcag

SEQ ID NO: 1866959 - RNA, 15 nt, Homo sapiens
gaauguuuuagcaca

SEQ ID NO: 1866960 - RNA, 11 nt, Homo sapiens
acacacacucc

SEQ ID NO: 1866961 - RNA, 22 nt, Homo sapiens
acccuaaaaagcagagcuuugc

SEQ ID NO: 1866962 - RNA, 19 nt, Homo sapiens
guaugucuuggacacugua

SEQ ID NO: 1866963 - RNA, 19 nt, Homo sapiens
cuaugaucuggacuuccua

SEQ ID NO: 1866964 - RNA, 12 nt, Homo sapiens
ggagugcaguuu

SEQ ID NO: 1866965 - RNA, 21 nt, Homo sapiens
augauaaucccauacucucaa

SEQ ID NO: 1866966 - RNA, 12 nt, Homo sapiens
uuuucugguuuc

SEQ ID NO: 1866967 - RNA, 20 nt, Homo sapiens
cagggcucuguauucugcaa

SEQ ID NO: 1866968 - RNA, 20 nt, Homo sapiens
ugcuacaguuauuaaucugg

SEQ ID NO: 1866969 - RNA, 14 nt, Homo sapiens
accuugcaauguuc

SEQ ID NO: 1866970 - RNA, 16 nt, Homo sapiens
ucagugaaguugcugc

SEQ ID NO: 1866971 - RNA, 23 nt, Homo sapiens
cugaccguggagcuuaagccacu

SEQ ID NO: 1866972 - RNA, 23 nt, Homo sapiens
aguucuuuaaaauguaaagccau

SEQ ID NO: 1866973 - RNA, 16 nt, Homo sapiens
cugggccccgccucaa

SEQ ID NO: 1866974 - RNA, 14 nt, Homo sapiens
cuaguaaguauuua

SEQ ID NO: 1866975 - RNA, 15 nt, Homo sapiens
caguugcauucauua

SEQ ID NO: 1866976 - RNA, 16 nt, Homo sapiens
gagccuagaacauccc

SEQ ID NO: 1866977 - RNA, 23 nt, Homo sapiens
agggcacaaacugcagcugugag

SEQ ID NO: 1866978 - RNA, 15 nt, Homo sapiens
guguguguguguaua

SEQ ID NO: 1866979 - RNA, 15 nt, Homo sapiens
auauguauauauaug

SEQ ID NO: 1866980 - RNA, 13 nt, Homo sapiens
aaugaaugacuca

SEQ ID NO: 1866981 - RNA, 20 nt, Homo sapiens
ucagcacuuaacuacuuugu

SEQ ID NO: 1866982 - RNA, 17 nt, Homo sapiens
gcucugcuggucacugg

SEQ ID NO: 1866983 - RNA, 20 nt, Homo sapiens
cucugugcuucgacuacugc

SEQ ID NO: 1866984 - RNA, 14 nt, Homo sapiens
aaaucuccagauuu

SEQ ID NO: 1866985 - RNA, 14 nt, Homo sapiens
ugucaaauaucuca

SEQ ID NO: 1866986 - RNA, 20 nt, Homo sapiens
aucacaguguuugcaauggu

SEQ ID NO: 1866987 - RNA, 13 nt, Homo sapiens
uuggcaaauacua

SEQ ID NO: 1866988 - RNA, 23 nt, Homo sapiens
cugccucccguguucaagcgauu

SEQ ID NO: 1866989 - RNA, 14 nt, Homo sapiens
uguucaccagugcu

SEQ ID NO: 1866990 - RNA, 16 nt, Homo sapiens
aaaugggcagugccuc

SEQ ID NO: 1866991 - RNA, 20 nt, Homo sapiens
gcugauuuccccucuucccu

SEQ ID NO: 1866992 - RNA, 18 nt, Homo sapiens
guucacuggacacuucac

SEQ ID NO: 1866993 - RNA, 22 nt, Homo sapiens
gcuugagucucaaggguggcag

SEQ ID NO: 1866994 - RNA, 17 nt, Homo sapiens
uaaaagaauuugugaca

SEQ ID NO: 1866995 - RNA, 20 nt, Homo sapiens
ggaagcuguccuggaggucc

SEQ ID NO: 1866996 - RNA, 20 nt, Homo sapiens
gcuggagugcaguagcacga

SEQ ID NO: 1866997 - RNA, 21 nt, Homo sapiens
cagggucucacucuguugccc

SEQ ID NO: 1866998 - RNA, 13 nt, Homo sapiens
aauauaauacugu

SEQ ID NO: 1866999 - RNA, 20 nt, Homo sapiens
gugcaguuguaggcauguag

SEQ ID NO: 1867000 - RNA, 16 nt, Homo sapiens
cccugaggcucagucu

SEQ ID NO: 1867001 - RNA, 15 nt, Homo sapiens
cuuuuaguucauguc

SEQ ID NO: 1867002 - RNA, 13 nt, Homo sapiens
ccagcagggugaa

SEQ ID NO: 1867003 - RNA, 19 nt, Homo sapiens
auaggcuuuauucugcaag

SEQ ID NO: 1867004 - RNA, 20 nt, Homo sapiens
auugcaccuaucucagccau

SEQ ID NO: 1867005 - RNA, 23 nt, Homo sapiens
ggacucaucuugggaagggccau

SEQ ID NO: 1867006 - RNA, 21 nt, Homo sapiens
ggucacguuuggugcuucuca

SEQ ID NO: 1867007 - RNA, 17 nt, Homo sapiens
auccaaucucaaggaau

SEQ ID NO: 1867008 - RNA, 13 nt, Homo sapiens
uucgaacuccagg

SEQ ID NO: 1867009 - RNA, 14 nt, Homo sapiens
uacugcggaccaag

SEQ ID NO: 1867010 - RNA, 16 nt, Homo sapiens
guagucauucuuacaa

SEQ ID NO: 1867011 - RNA, 21 nt, Homo sapiens
ccugucccacccacacagcug

SEQ ID NO: 1867012 - RNA, 22 nt, Homo sapiens
cccaacagcacccucuccagau

SEQ ID NO: 1867013 - RNA, 16 nt, Homo sapiens
aaaguuuaaauaccag

SEQ ID NO: 1867014 - RNA, 14 nt, Homo sapiens
uugagcucuauuau

SEQ ID NO: 1867015 - RNA, 12 nt, Homo sapiens
acacuguacaag

SEQ ID NO: 1867016 - RNA, 22 nt, Homo sapiens
ggcuggagugugaggguccugc

SEQ ID NO: 1867017 - RNA, 21 nt, Homo sapiens
uccaaaaagacaagugcucaa

SEQ ID NO: 1867018 - RNA, 17 nt, Homo sapiens
auauaggagcaauacua

SEQ ID NO: 1867019 - RNA, 21 nt, Homo sapiens
acugauuugauaccauggcac

SEQ ID NO: 1867020 - RNA, 22 nt, Homo sapiens
ggcagcaccuccgggacugacc

SEQ ID NO: 1867021 - RNA, 22 nt, Homo sapiens
uugacccucacaggagcaucuc

SEQ ID NO: 1867022 - RNA, 17 nt, Homo sapiens
acacaacuguucccgau

SEQ ID NO: 1867023 - RNA, 18 nt, Homo sapiens
cuuccaggcacucaaaag

SEQ ID NO: 1867024 - RNA, 13 nt, Homo sapiens
aaagaaccaaaag

SEQ ID NO: 1867025 - RNA, 15 nt, Homo sapiens
aacauaucaauucaa

SEQ ID NO: 1867026 - RNA, 15 nt, Homo sapiens
aaaaugauccugcca

SEQ ID NO: 1867027 - RNA, 19 nt, Homo sapiens
uuuuaacaaaugauuuaca

SEQ ID NO: 1867028 - RNA, 11 nt, Homo sapiens
auucaaaguga

SEQ ID NO: 1867029 - RNA, 20 nt, Homo sapiens
aaagugcuuccuuuucagca

SEQ ID NO: 1867030 - RNA, 14 nt, Homo sapiens
auuaaacauuacug

SEQ ID NO: 1867031 - RNA, 17 nt, Homo sapiens
aaagcaagcaccugggu

SEQ ID NO: 1867032 - RNA, 15 nt, Homo sapiens
gcucucauagcucau

SEQ ID NO: 1867033 - RNA, 13 nt, Homo sapiens
agguccugcacau

SEQ ID NO: 1867034 - RNA, 22 nt, Homo sapiens
cauuucauuauuucugcuuccu

SEQ ID NO: 1867035 - RNA, 19 nt, Homo sapiens
gguagccuuagggugcuga

SEQ ID NO: 1867036 - RNA, 15 nt, Homo sapiens
agcugauuugauacc

SEQ ID NO: 1867037 - RNA, 16 nt, Homo sapiens
uaaucuuuuucaucau

SEQ ID NO: 1867038 - RNA, 18 nt, Homo sapiens
cggucaggagggugcagu

SEQ ID NO: 1867039 - RNA, 22 nt, Homo sapiens
cuaaccauagcugaccuuugua

SEQ ID NO: 1867040 - RNA, 22 nt, Homo sapiens
uaauagcccauaaagucugaga

SEQ ID NO: 1867041 - RNA, 13 nt, Homo sapiens
gcuguccauugcc

SEQ ID NO: 1867042 - RNA, 22 nt, Homo sapiens
acauaacacuauaaagguugac

SEQ ID NO: 1867043 - RNA, 19 nt, Homo sapiens
caauaaaagugacucucag

SEQ ID NO: 1867044 - RNA, 15 nt, Homo sapiens
uuccaucuguacuuu

SEQ ID NO: 1867045 - RNA, 23 nt, Homo sapiens
aucacagaugugcccagaguagc

SEQ ID NO: 1867046 - RNA, 23 nt, Homo sapiens
ugccucagagcagccucauccca

SEQ ID NO: 1867047 - RNA, 22 nt, Homo sapiens
agggaaaaggacuuguuuuccu

SEQ ID NO: 1867048 - RNA, 12 nt, Homo sapiens
uucagagauuua

SEQ ID NO: 1867049 - RNA, 16 nt, Homo sapiens
cugaggcaugcccagg

SEQ ID NO: 1867050 - RNA, 13 nt, Homo sapiens
cgccuucccucac

SEQ ID NO: 1867051 - RNA, 22 nt, Homo sapiens
agaagucccaagacccuaguga

SEQ ID NO: 1867052 - RNA, 13 nt, Homo sapiens
agucaugugcugg

SEQ ID NO: 1867053 - RNA, 17 nt, Homo sapiens
cucuugcuugucauuga

SEQ ID NO: 1867054 - RNA, 15 nt, Homo sapiens
aauucuuucaguggc

SEQ ID NO: 1867055 - RNA, 15 nt, Homo sapiens
gucccaggacccugg

SEQ ID NO: 1867056 - RNA, 17 nt, Homo sapiens
uuaaauaagguaauaca

SEQ ID NO: 1867057 - RNA, 17 nt, Homo sapiens
uguguucaguaguucca

SEQ ID NO: 1867058 - RNA, 21 nt, Homo sapiens
acccauagagggcuccucuca

SEQ ID NO: 1867059 - RNA, 14 nt, Homo sapiens
ugaguauauguaac

SEQ ID NO: 1867060 - RNA, 15 nt, Homo sapiens
cagacucuucauuca

SEQ ID NO: 1867061 - RNA, 18 nt, Homo sapiens
cuggaagggaaaggggag

SEQ ID NO: 1867062 - RNA, 12 nt, Homo sapiens
acgguguugcag

SEQ ID NO: 1867063 - RNA, 15 nt, Homo sapiens
auuuuaaacuacuga

SEQ ID NO: 1867064 - RNA, 15 nt, Homo sapiens
ccccagcccagagcc

SEQ ID NO: 1867065 - RNA, 19 nt, Homo sapiens
aaggaggaaucaagaagcu

SEQ ID NO: 1867066 - RNA, 16 nt, Homo sapiens
gggucccuucaccucc

SEQ ID NO: 1867067 - RNA, 17 nt, Homo sapiens
cagauuugggcuggaac

SEQ ID NO: 1867068 - RNA, 17 nt, Homo sapiens
uggagaguacauuugcu

SEQ ID NO: 1867069 - RNA, 19 nt, Homo sapiens
guggccaugguccccaaga

SEQ ID NO: 1867070 - RNA, 13 nt, Homo sapiens
cuuuaccuagcug

SEQ ID NO: 1867071 - RNA, 13 nt, Homo sapiens
ucaaugcuauucu

SEQ ID NO: 1867072 - RNA, 23 nt, Homo sapiens
ccuucuuuuaugagcagaaggaa

SEQ ID NO: 1867073 - RNA, 20 nt, Homo sapiens
ucauugcuggugacucaugc

SEQ ID NO: 1867074 - RNA, 14 nt, Homo sapiens
gcaacuucccacag

SEQ ID NO: 1867075 - RNA, 14 nt, Homo sapiens
ucucuucucaccuu

SEQ ID NO: 1867076 - RNA, 15 nt, Homo sapiens
uuggcaaacuuugua

SEQ ID NO: 1867077 - RNA, 23 nt, Homo sapiens
acucuggcuguugcguuuuccag

SEQ ID NO: 1867078 - RNA, 15 nt, Homo sapiens
cagccaaugccuuug

SEQ ID NO: 1867079 - RNA, 15 nt, Homo sapiens
caagacuccauuuca

SEQ ID NO: 1867080 - RNA, 23 nt, Homo sapiens
acacagauuuuugggcuccacuc

SEQ ID NO: 1867081 - RNA, 21 nt, Homo sapiens
aaagacccugaugcaggucag

SEQ ID NO: 1867082 - RNA, 16 nt, Homo sapiens
uauaaaagcaaaagga

SEQ ID NO: 1867083 - RNA, 19 nt, Homo sapiens
agcccugcgccaccucacu

SEQ ID NO: 1867084 - RNA, 23 nt, Homo sapiens
ucugaggggaugcaacaaaauga

SEQ ID NO: 1867085 - RNA, 20 nt, Homo sapiens
acgguuucuuuguuacuuua

SEQ ID NO: 1867086 - RNA, 16 nt, Homo sapiens
cccccagcuucugcca

SEQ ID NO: 1867087 - RNA, 17 nt, Homo sapiens
cuggaauguacaguauu

SEQ ID NO: 1867088 - RNA, 21 nt, Homo sapiens
aguccuucaccucacugaaaa

SEQ ID NO: 1867089 - RNA, 21 nt, Homo sapiens
gaaccaagaacuuuccaggaa

SEQ ID NO: 1867090 - RNA, 16 nt, Homo sapiens
gacauuuuugugccau

SEQ ID NO: 1867091 - RNA, 21 nt, Homo sapiens
aaguaugggaugauaguugaa

SEQ ID NO: 1867092 - RNA, 23 nt, Homo sapiens
uggccacagccuucccucugcau

SEQ ID NO: 1867093 - RNA, 19 nt, Homo sapiens
ggacccugcccagagcuga

SEQ ID NO: 1867094 - RNA, 17 nt, Homo sapiens
ccaaaaucguagguguu

SEQ ID NO: 1867095 - RNA, 13 nt, Homo sapiens
ccagcugcuccca

SEQ ID NO: 1867096 - RNA, 23 nt, Homo sapiens
ucugcuuuucuucccagcaaagg

SEQ ID NO: 1867097 - RNA, 13 nt, Homo sapiens
gaauagcuuccaa

SEQ ID NO: 1867098 - RNA, 16 nt, Homo sapiens
aaggaguaaugggaua

SEQ ID NO: 1867099 - RNA, 16 nt, Homo sapiens
cagaaaaacugaggaa

SEQ ID NO: 1867100 - RNA, 17 nt, Homo sapiens
aaacugcacugccaugu

SEQ ID NO: 1867101 - RNA, 17 nt, Homo sapiens
ucauaaaggacacugga

SEQ ID NO: 1867102 - RNA, 16 nt, Homo sapiens
ucaguaugaagacacu

SEQ ID NO: 1867103 - RNA, 13 nt, Homo sapiens
ugccucaaccucc

SEQ ID NO: 1867104 - RNA, 23 nt, Homo sapiens
ucauucaagucagcucuucucca

SEQ ID NO: 1867105 - RNA, 23 nt, Homo sapiens
uaccuauucugaaaaagacauaa

SEQ ID NO: 1867106 - RNA, 14 nt, Homo sapiens
cgcggcuaacuuau

SEQ ID NO: 1867107 - RNA, 18 nt, Homo sapiens
gaaaacuagcauuacauu

SEQ ID NO: 1867108 - RNA, 17 nt, Homo sapiens
aucuaaugaauguucca

SEQ ID NO: 1867109 - RNA, 23 nt, Homo sapiens
aaucauuuuucacuguacauuau

SEQ ID NO: 1867110 - RNA, 17 nt, Homo sapiens
gcagcugccucugcucc

SEQ ID NO: 1867111 - RNA, 16 nt, Homo sapiens
cugaaugcauucaggg

SEQ ID NO: 1867112 - RNA, 15 nt, Homo sapiens
auucaguaguaacag

SEQ ID NO: 1867113 - RNA, 17 nt, Homo sapiens
cugccugcauggcauca

SEQ ID NO: 1867114 - RNA, 17 nt, Homo sapiens
gcaccagccugagccac

SEQ ID NO: 1867115 - RNA, 22 nt, Homo sapiens
ucccccacaagagccccaaaga

SEQ ID NO: 1867116 - RNA, 20 nt, Homo sapiens
aguguaacggccaacacuuu

SEQ ID NO: 1867117 - RNA, 16 nt, Homo sapiens
gagaacaugcauacua

SEQ ID NO: 1867118 - RNA, 12 nt, Homo sapiens
gacccuuuucau

SEQ ID NO: 1867119 - RNA, 14 nt, Homo sapiens
agagcuauguuccc

SEQ ID NO: 1867120 - RNA, 19 nt, Homo sapiens
uuacuuccauuauacauca

SEQ ID NO: 1867121 - RNA, 13 nt, Homo sapiens
aggggaauggagg

SEQ ID NO: 1867122 - RNA, 19 nt, Homo sapiens
acccugcaccucauuccaa

SEQ ID NO: 1867123 - RNA, 15 nt, Homo sapiens
uguccauaugcaucu

SEQ ID NO: 1867124 - RNA, 13 nt, Homo sapiens
ccauauaaaugaa

SEQ ID NO: 1867125 - RNA, 14 nt, Homo sapiens
uuauuaacauugau

SEQ ID NO: 1867126 - RNA, 19 nt, Homo sapiens
acucccugcugugugacuu

SEQ ID NO: 1867127 - RNA, 19 nt, Homo sapiens
augucugcaaaggagggcc

SEQ ID NO: 1867128 - RNA, 18 nt, Homo sapiens
acuuccaguauccugaaa

SEQ ID NO: 1867129 - RNA, 14 nt, Homo sapiens
cauggagaaguuau

SEQ ID NO: 1867130 - RNA, 16 nt, Homo sapiens
caugcuacaguuauua

SEQ ID NO: 1867131 - RNA, 21 nt, Homo sapiens
ccuacccccuaagagccauuu

SEQ ID NO: 1867132 - RNA, 16 nt, Homo sapiens
ccagaaggauauuuac

SEQ ID NO: 1867133 - RNA, 20 nt, Homo sapiens
uaaaagaaguuuuccagugg

SEQ ID NO: 1867134 - RNA, 15 nt, Homo sapiens
cauaauucagcacuu

SEQ ID NO: 1867135 - RNA, 22 nt, Homo sapiens
uucuggugucuaauaaacacag

SEQ ID NO: 1867136 - RNA, 22 nt, Homo sapiens
ugagguacagcagaaaggagaa

SEQ ID NO: 1867137 - RNA, 12 nt, Homo sapiens
agaaagacugga

SEQ ID NO: 1867138 - RNA, 20 nt, Homo sapiens
uucaggagaacucauguuau

SEQ ID NO: 1867139 - RNA, 23 nt, Homo sapiens
gggaacaguccauaacuuaccuc

SEQ ID NO: 1867140 - RNA, 20 nt, Homo sapiens
cuacagugccaacuccucac

SEQ ID NO: 1867141 - RNA, 21 nt, Homo sapiens
guaugcucaauuauuuugcau

SEQ ID NO: 1867142 - RNA, 18 nt, Homo sapiens
auuuuaacaacacacaau

SEQ ID NO: 1867143 - RNA, 10 nt, Homo sapiens
cgucugugaa

SEQ ID NO: 1867144 - RNA, 12 nt, Homo sapiens
auaugcccucau

SEQ ID NO: 1867145 - RNA, 20 nt, Homo sapiens
aacauuugagauauguugaa

SEQ ID NO: 1867146 - RNA, 19 nt, Homo sapiens
ugacucaaaaaugagguac

SEQ ID NO: 1867147 - RNA, 21 nt, Homo sapiens
agcaggacgacuguuuuccca

SEQ ID NO: 1867148 - RNA, 13 nt, Homo sapiens
cugaagucccugc

SEQ ID NO: 1867149 - RNA, 12 nt, Homo sapiens
cucuuuucacag

SEQ ID NO: 1867150 - RNA, 19 nt, Homo sapiens
ggcugcccuugggugacac

SEQ ID NO: 1867151 - RNA, 23 nt, Homo sapiens
auuuaagccaucaucagcuuaau

SEQ ID NO: 1867152 - RNA, 19 nt, Homo sapiens
auuuucugaaacuaaugaa

SEQ ID NO: 1867153 - RNA, 17 nt, Homo sapiens
caaggcacugacugagc

SEQ ID NO: 1867154 - RNA, 17 nt, Homo sapiens
uaaagguagagaugugu

SEQ ID NO: 1867155 - RNA, 12 nt, Homo sapiens
ucacagccauag

SEQ ID NO: 1867156 - RNA, 18 nt, Homo sapiens
gagcugacacaaaccugc

SEQ ID NO: 1867157 - RNA, 18 nt, Homo sapiens
aaauagucuagacuaaaa

SEQ ID NO: 1867158 - RNA, 19 nt, Homo sapiens
gaaggaggagucagggaga

SEQ ID NO: 1867159 - RNA, 22 nt, Homo sapiens
uucucacuagcugucucaggag

SEQ ID NO: 1867160 - RNA, 18 nt, Homo sapiens
ugggauguccaccacagu

SEQ ID NO: 1867161 - RNA, 14 nt, Homo sapiens
ccgguugcagucac

SEQ ID NO: 1867162 - RNA, 13 nt, Homo sapiens
uggcacugcauac

SEQ ID NO: 1867163 - RNA, 17 nt, Homo sapiens
cugcggcccugaucucc

SEQ ID NO: 1867164 - RNA, 19 nt, Homo sapiens
agggucgggggagcaaaag

SEQ ID NO: 1867165 - RNA, 20 nt, Homo sapiens
agagccagccggcuaugaaa

SEQ ID NO: 1867166 - RNA, 23 nt, Homo sapiens
aaugcauuagauuaucaaaaagu

SEQ ID NO: 1867167 - RNA, 22 nt, Homo sapiens
cccagcccgcugcucacuuucc

SEQ ID NO: 1867168 - RNA, 18 nt, Homo sapiens
uuuagacccugcauuuau

SEQ ID NO: 1867169 - RNA, 21 nt, Homo sapiens
uucuauugaaaaaucaccaca

SEQ ID NO: 1867170 - RNA, 15 nt, Homo sapiens
agaccccagucguga

SEQ ID NO: 1867171 - RNA, 17 nt, Homo sapiens
gacuggguuacauaugc

SEQ ID NO: 1867172 - RNA, 16 nt, Homo sapiens
gugugaccuccuguga

SEQ ID NO: 1867173 - RNA, 15 nt, Homo sapiens
cauggccuucccucc

SEQ ID NO: 1867174 - RNA, 15 nt, Homo sapiens
caucuuaaugucuuu

SEQ ID NO: 1867175 - RNA, 15 nt, Homo sapiens
uguaaauacauaaaa

SEQ ID NO: 1867176 - RNA, 20 nt, Homo sapiens
ucugcuuccccaucuguuaa

SEQ ID NO: 1867177 - RNA, 21 nt, Homo sapiens
agaagaguuggagugagauga

SEQ ID NO: 1867178 - RNA, 17 nt, Homo sapiens
ugggagagcugauugca

SEQ ID NO: 1867179 - RNA, 17 nt, Homo sapiens
uguguauugagauuuac

SEQ ID NO: 1867180 - RNA, 19 nt, Homo sapiens
gaccccuccuggggccagg

SEQ ID NO: 1867181 - RNA, 16 nt, Homo sapiens
auuccaacauuucuca

SEQ ID NO: 1867182 - RNA, 23 nt, Homo sapiens
aacacauuguuauuuucagugau

SEQ ID NO: 1867183 - RNA, 12 nt, Homo sapiens
accuacauucaa

SEQ ID NO: 1867184 - RNA, 12 nt, Homo sapiens
uuauacauauca

SEQ ID NO: 1867185 - RNA, 20 nt, Homo sapiens
uaaaccaaacccagccacug

SEQ ID NO: 1867186 - RNA, 13 nt, Homo sapiens
caguuaaggggag

SEQ ID NO: 1867187 - RNA, 18 nt, Homo sapiens
ucacucuuguugugcucu

SEQ ID NO: 1867188 - RNA, 12 nt, Homo sapiens
ugccuucugacg

SEQ ID NO: 1867189 - RNA, 13 nt, Homo sapiens
agauucccacucc

SEQ ID NO: 1867190 - RNA, 17 nt, Homo sapiens
caaagcgagcaagagaa

SEQ ID NO: 1867191 - RNA, 16 nt, Homo sapiens
gacaaaauucauuugc

SEQ ID NO: 1867192 - RNA, 15 nt, Homo sapiens
gugcucugaggucaa

SEQ ID NO: 1867193 - RNA, 13 nt, Homo sapiens
aggaaucaccaau

SEQ ID NO: 1867194 - RNA, 15 nt, Homo sapiens
cuuauacauuugaua

SEQ ID NO: 1867195 - RNA, 16 nt, Homo sapiens
cacuuguagauuugau

SEQ ID NO: 1867196 - RNA, 20 nt, Homo sapiens
aauaauaaaaagacuauuaa

SEQ ID NO: 1867197 - RNA, 21 nt, Homo sapiens
agugcaauggcaggaucucag

SEQ ID NO: 1867198 - RNA, 19 nt, Homo sapiens
agggguggaaacauaggga

SEQ ID NO: 1867199 - RNA, 15 nt, Homo sapiens
caagugcccccucac

SEQ ID NO: 1867200 - RNA, 23 nt, Homo sapiens
cagcuguguucacacuguaaaca

SEQ ID NO: 1867201 - RNA, 20 nt, Homo sapiens
agacuggguuacauaugccu

SEQ ID NO: 1867202 - RNA, 14 nt, Homo sapiens
agcauggccuccag

SEQ ID NO: 1867203 - RNA, 19 nt, Homo sapiens
caaacucaccuugucucau

SEQ ID NO: 1867204 - RNA, 16 nt, Homo sapiens
cucaugccauuccagc

SEQ ID NO: 1867205 - RNA, 13 nt, Homo sapiens
uaauuaucugauc

SEQ ID NO: 1867206 - RNA, 22 nt, Homo sapiens
ucaaaauauccuaagacuaaca

SEQ ID NO: 1867207 - RNA, 21 nt, Homo sapiens
uucuaauaaucauaaacuaua

SEQ ID NO: 1867208 - RNA, 12 nt, Homo sapiens
cacaaauuguac

SEQ ID NO: 1867209 - RNA, 22 nt, Homo sapiens
aggcugaugggcaaaaaaccaa

SEQ ID NO: 1867210 - RNA, 20 nt, Homo sapiens
caaacaagggagaagagugu

SEQ ID NO: 1867211 - RNA, 17 nt, Homo sapiens
acccgcuccacuacccg

SEQ ID NO: 1867212 - RNA, 18 nt, Homo sapiens
cagugccagcaccugccc

SEQ ID NO: 1867213 - RNA, 17 nt, Homo sapiens
cuggccucagagcuucc

SEQ ID NO: 1867214 - RNA, 19 nt, Homo sapiens
acuaaaccgauaaugcaug

SEQ ID NO: 1867215 - RNA, 18 nt, Homo sapiens
cagucuuccuuguggaau

SEQ ID NO: 1867216 - RNA, 22 nt, Homo sapiens
uggugaggguccucuuccucaa

SEQ ID NO: 1867217 - RNA, 17 nt, Homo sapiens
cauuuucaaugcacauu

SEQ ID NO: 1867218 - RNA, 19 nt, Homo sapiens
augaaucccauaauugaca

SEQ ID NO: 1867219 - RNA, 22 nt, Homo sapiens
cuaaagagagugagcaugagcu

SEQ ID NO: 1867220 - RNA, 17 nt, Homo sapiens
uaacaucauuguauuaa

SEQ ID NO: 1867221 - RNA, 17 nt, Homo sapiens
ugacugucaguugccaa

SEQ ID NO: 1867222 - RNA, 15 nt, Homo sapiens
cacacuuugcacuga

SEQ ID NO: 1867223 - RNA, 22 nt, Homo sapiens
uuuaaaacccaacucuuacucu

SEQ ID NO: 1867224 - RNA, 18 nt, Homo sapiens
gaaacuugugaaguggaa

SEQ ID NO: 1867225 - RNA, 21 nt, Homo sapiens
uauuacaauuuuugaacaacu

SEQ ID NO: 1867226 - RNA, 16 nt, Homo sapiens
agagaugggguuucac

SEQ ID NO: 1867227 - RNA, 17 nt, Homo sapiens
ucauuucuuucaagaca

SEQ ID NO: 1867228 - RNA, 18 nt, Homo sapiens
acuuugaguuagugccau

SEQ ID NO: 1867229 - RNA, 15 nt, Homo sapiens
agaaagaccaggcca

SEQ ID NO: 1867230 - RNA, 22 nt, Homo sapiens
uuugacuuugccaaaguguaga

SEQ ID NO: 1867231 - RNA, 19 nt, Homo sapiens
uacuuuuuauuugcaacuu

SEQ ID NO: 1867232 - RNA, 20 nt, Homo sapiens
ugaaaugucuggucugucca

SEQ ID NO: 1867233 - RNA, 23 nt, Homo sapiens
gaauaagcaaaauucauaccuga

SEQ ID NO: 1867234 - RNA, 15 nt, Homo sapiens
aucguaaccuaugaa

SEQ ID NO: 1867235 - RNA, 17 nt, Homo sapiens
ucucuaaaauucuaguc

SEQ ID NO: 1867236 - RNA, 13 nt, Homo sapiens
gucuuagacuuug

SEQ ID NO: 1867237 - RNA, 16 nt, Homo sapiens
aguugaacagagcuag

SEQ ID NO: 1867238 - RNA, 23 nt, Homo sapiens
gacugauggcgauucccucucac

SEQ ID NO: 1867239 - RNA, 19 nt, Homo sapiens
acugauguuacuagccucu

SEQ ID NO: 1867240 - RNA, 21 nt, Homo sapiens
aauaaaccuggagaugaugau

SEQ ID NO: 1867241 - RNA, 13 nt, Homo sapiens
acuaggaccucau

SEQ ID NO: 1867242 - RNA, 23 nt, Homo sapiens
ccagguguggcggcguaauccca

SEQ ID NO: 1867243 - RNA, 13 nt, Homo sapiens
acuuugaccucug

SEQ ID NO: 1867244 - RNA, 21 nt, Homo sapiens
guacacucagccacugucaca

SEQ ID NO: 1867245 - RNA, 15 nt, Homo sapiens
cagccguauuuuaca

SEQ ID NO: 1867246 - RNA, 21 nt, Homo sapiens
uauauucgguuggaaccuaau

SEQ ID NO: 1867247 - RNA, 17 nt, Homo sapiens
aauuaggauaacuaaaa

SEQ ID NO: 1867248 - RNA, 19 nt, Homo sapiens
ccuuuacucauagcacuuc

SEQ ID NO: 1867249 - RNA, 12 nt, Homo sapiens
cucaaagcacac

SEQ ID NO: 1867250 - RNA, 23 nt, Homo sapiens
aguuuuucagguauauaccucca

SEQ ID NO: 1867251 - RNA, 18 nt, Homo sapiens
uacucauggcagaaggca

SEQ ID NO: 1867252 - RNA, 13 nt, Homo sapiens
ugcugaaaccaua

SEQ ID NO: 1867253 - RNA, 20 nt, Homo sapiens
cccaucagcacucuguaaaa

SEQ ID NO: 1867254 - RNA, 20 nt, Homo sapiens
caaggagagagugagugcau

SEQ ID NO: 1867255 - RNA, 20 nt, Homo sapiens
accucugccugaagucacac

SEQ ID NO: 1867256 - RNA, 15 nt, Homo sapiens
aacuuggcacacucu

SEQ ID NO: 1867257 - RNA, 14 nt, Homo sapiens
uucagcugcuuuga

SEQ ID NO: 1867258 - RNA, 20 nt, Homo sapiens
uccuugugguuuaugucauc

SEQ ID NO: 1867259 - RNA, 14 nt, Homo sapiens
ugaguccaguuccc

SEQ ID NO: 1867260 - RNA, 22 nt, Homo sapiens
uucuuccucacaaaaccauauc

SEQ ID NO: 1867261 - RNA, 19 nt, Homo sapiens
aaauuaacugggcauggua

SEQ ID NO: 1867262 - RNA, 23 nt, Homo sapiens
cuuuauucuuccuugagcuaagc

SEQ ID NO: 1867263 - RNA, 15 nt, Homo sapiens
guuuuccacugugcu

SEQ ID NO: 1867264 - RNA, 13 nt, Homo sapiens
ggcucagccagca

SEQ ID NO: 1867265 - RNA, 13 nt, Homo sapiens
guacauguuacag

SEQ ID NO: 1867266 - RNA, 20 nt, Homo sapiens
gacuuucucuucuacacagc

SEQ ID NO: 1867267 - RNA, 16 nt, Homo sapiens
cucggcucagugcaac

SEQ ID NO: 1867268 - RNA, 20 nt, Homo sapiens
uccccacaccucccuacucc

SEQ ID NO: 1867269 - RNA, 12 nt, Homo sapiens
ucgcacuuauca

SEQ ID NO: 1867270 - RNA, 17 nt, Homo sapiens
aggacuaauccaauacc

SEQ ID NO: 1867271 - RNA, 18 nt, Homo sapiens
ccagggcaacacagugag

SEQ ID NO: 1867272 - RNA, 20 nt, Homo sapiens
aggcuuucugggcucuggac

SEQ ID NO: 1867273 - RNA, 17 nt, Homo sapiens
aaauacuguguggaacu

SEQ ID NO: 1867274 - RNA, 15 nt, Homo sapiens
uacuuuauuguacag

SEQ ID NO: 1867275 - RNA, 23 nt, Homo sapiens
gacuggcaguaaccuagugaauu

SEQ ID NO: 1867276 - RNA, 15 nt, Homo sapiens
cucuuugcugcacua

SEQ ID NO: 1867277 - RNA, 12 nt, Homo sapiens
cacagugucugg

SEQ ID NO: 1867278 - RNA, 17 nt, Homo sapiens
gguuguugcaguucaga

SEQ ID NO: 1867279 - RNA, 22 nt, Homo sapiens
ugacuaaaaauaucacacugaa

SEQ ID NO: 1867280 - RNA, 15 nt, Homo sapiens
acagcugucccuguc

SEQ ID NO: 1867281 - RNA, 13 nt, Homo sapiens
ucugucugaauua

SEQ ID NO: 1867282 - RNA, 17 nt, Homo sapiens
uccugaccucaggugau

SEQ ID NO: 1867283 - RNA, 15 nt, Homo sapiens
cgcaguuuggaguca

SEQ ID NO: 1867284 - RNA, 21 nt, Homo sapiens
ugacagcccugaacgugagca

SEQ ID NO: 1867285 - RNA, 20 nt, Homo sapiens
cacggaggaugaugccaguu

SEQ ID NO: 1867286 - RNA, 20 nt, Homo sapiens
acaagaccaccaacgugucc

SEQ ID NO: 1867287 - RNA, 12 nt, Homo sapiens
auagaauggcac

SEQ ID NO: 1867288 - RNA, 16 nt, Homo sapiens
cucccaaagugcuagu

SEQ ID NO: 1867289 - RNA, 13 nt, Homo sapiens
gacuaaguucuca

SEQ ID NO: 1867290 - RNA, 17 nt, Homo sapiens
caaauaguaaucuguaa

SEQ ID NO: 1867291 - RNA, 15 nt, Homo sapiens
ccuugccacauuaaa

SEQ ID NO: 1867292 - RNA, 23 nt, Homo sapiens
accuccugaccugucaccgugag

SEQ ID NO: 1867293 - RNA, 19 nt, Homo sapiens
acuguccaugaagcacuga

SEQ ID NO: 1867294 - RNA, 15 nt, Homo sapiens
gaauaauauucaaua

SEQ ID NO: 1867295 - RNA, 21 nt, Homo sapiens
acaccuggaggugaaggcaga

SEQ ID NO: 1867296 - RNA, 18 nt, Homo sapiens
ugcaucccccagcacuga

SEQ ID NO: 1867297 - RNA, 22 nt, Homo sapiens
uguuacugaaaugagccucgug

SEQ ID NO: 1867298 - RNA, 15 nt, Homo sapiens
uauuuacaugugauu

SEQ ID NO: 1867299 - RNA, 19 nt, Homo sapiens
cuggguacugacugagaua

SEQ ID NO: 1867300 - RNA, 22 nt, Homo sapiens
gcaucuacuacucugucuucac

SEQ ID NO: 1867301 - RNA, 20 nt, Homo sapiens
uccugggaccauggacacau

SEQ ID NO: 1867302 - RNA, 21 nt, Homo sapiens
acagcugcuucugugcauuug

SEQ ID NO: 1867303 - RNA, 13 nt, Homo sapiens
agcaaacacuggg

SEQ ID NO: 1867304 - RNA, 18 nt, Homo sapiens
cuuucuugcacuauucca

SEQ ID NO: 1867305 - RNA, 15 nt, Homo sapiens
uagaaacaugacacu

SEQ ID NO: 1867306 - RNA, 21 nt, Homo sapiens
aaguuaacauucaguacuuua

SEQ ID NO: 1867307 - RNA, 15 nt, Homo sapiens
caggacugugccuga

SEQ ID NO: 1867308 - RNA, 20 nt, Homo sapiens
ugguagcugggauuacaggu

SEQ ID NO: 1867309 - RNA, 14 nt, Homo sapiens
auuaacuccuccug

SEQ ID NO: 1867310 - RNA, 15 nt, Homo sapiens
guuccuggugacucc

SEQ ID NO: 1867311 - RNA, 19 nt, Homo sapiens
acagcuucuccaagcauca

SEQ ID NO: 1867312 - RNA, 19 nt, Homo sapiens
gugaacuucagauugaacc

SEQ ID NO: 1867313 - RNA, 20 nt, Homo sapiens
uaugggcuaccaggaagaag

SEQ ID NO: 1867314 - RNA, 14 nt, Homo sapiens
acaaaaaugacucu

SEQ ID NO: 1867315 - RNA, 13 nt, Homo sapiens
ugaaaagcaauac

SEQ ID NO: 1867316 - RNA, 22 nt, Homo sapiens
uguauuuucagcucaauuguua

SEQ ID NO: 1867317 - RNA, 18 nt, Homo sapiens
gccuaaaugugaccaaac

SEQ ID NO: 1867318 - RNA, 15 nt, Homo sapiens
cugcacuggggccac

SEQ ID NO: 1867319 - RNA, 20 nt, Homo sapiens
uccaccucgcagguucaagc

SEQ ID NO: 1867320 - RNA, 23 nt, Homo sapiens
ucugacagaaagcagauaccuca

SEQ ID NO: 1867321 - RNA, 14 nt, Homo sapiens
cauaaccgcacaga

SEQ ID NO: 1867322 - RNA, 14 nt, Homo sapiens
acaucuugucauuu

SEQ ID NO: 1867323 - RNA, 14 nt, Homo sapiens
aaaacguguaaaug

SEQ ID NO: 1867324 - RNA, 23 nt, Homo sapiens
gcauuguuuuugucauguagcug

SEQ ID NO: 1867325 - RNA, 22 nt, Homo sapiens
ggcuggggccaccuuugugcag

SEQ ID NO: 1867326 - RNA, 13 nt, Homo sapiens
gcagccucuucaa

SEQ ID NO: 1867327 - RNA, 17 nt, Homo sapiens
cugaaauguuagauuaa

SEQ ID NO: 1867328 - RNA, 16 nt, Homo sapiens
acuuccgguuucuuca

SEQ ID NO: 1867329 - RNA, 14 nt, Homo sapiens
ccuccucugugcuc

SEQ ID NO: 1867330 - RNA, 18 nt, Homo sapiens
caggagcccuacugaagg

SEQ ID NO: 1867331 - RNA, 17 nt, Homo sapiens
acaucagauccugggca

SEQ ID NO: 1867332 - RNA, 18 nt, Homo sapiens
acauaagcagcauuucau

SEQ ID NO: 1867333 - RNA, 17 nt, Homo sapiens
cugccaucaccgcuggg

SEQ ID NO: 1867334 - RNA, 22 nt, Homo sapiens
uccugccucacaguuguuaaag

SEQ ID NO: 1867335 - RNA, 18 nt, Homo sapiens
acggcggggcccgguggc

SEQ ID NO: 1867336 - RNA, 13 nt, Homo sapiens
aacagaaauccuu

SEQ ID NO: 1867337 - RNA, 18 nt, Homo sapiens
cugacagccuccuaggcu

SEQ ID NO: 1867338 - RNA, 21 nt, Homo sapiens
gugaggcaucucucugggaug

SEQ ID NO: 1867339 - RNA, 21 nt, Homo sapiens
acaguguugccagagccuuaa

SEQ ID NO: 1867340 - RNA, 13 nt, Homo sapiens
aaaaagaaaugca

SEQ ID NO: 1867341 - RNA, 16 nt, Homo sapiens
uuaguuuuugaucaag

SEQ ID NO: 1867342 - RNA, 11 nt, Homo sapiens
ccacacuugaa

SEQ ID NO: 1867343 - RNA, 12 nt, Homo sapiens
gucucaccagcc

SEQ ID NO: 1867344 - RNA, 22 nt, Homo sapiens
guggggggaacgcccacuuccc

SEQ ID NO: 1867345 - RNA, 18 nt, Homo sapiens
uguuucgaguaaacuuga

SEQ ID NO: 1867346 - RNA, 19 nt, Homo sapiens
caaugaugugugcaaguac

SEQ ID NO: 1867347 - RNA, 13 nt, Homo sapiens
aauggugaaggaa

SEQ ID NO: 1867348 - RNA, 23 nt, Homo sapiens
ggcaugcuggcucccagggccau

SEQ ID NO: 1867349 - RNA, 16 nt, Homo sapiens
uaauauuaaagccaug

SEQ ID NO: 1867350 - RNA, 19 nt, Homo sapiens
cgcacugggcauuggguaa

SEQ ID NO: 1867351 - RNA, 19 nt, Homo sapiens
guuaaaggaaaagcacaag

SEQ ID NO: 1867352 - RNA, 13 nt, Homo sapiens
ugcuuaaucauau

SEQ ID NO: 1867353 - RNA, 22 nt, Homo sapiens
uucugguagcauauucaugguu

SEQ ID NO: 1867354 - RNA, 13 nt, Homo sapiens
uccaccugucuca

SEQ ID NO: 1867355 - RNA, 15 nt, Homo sapiens
agggucugcuucccc

SEQ ID NO: 1867356 - RNA, 15 nt, Homo sapiens
auucuguacuuguau

SEQ ID NO: 1867357 - RNA, 20 nt, Homo sapiens
gcucaguugagaaacaguuc

SEQ ID NO: 1867358 - RNA, 12 nt, Homo sapiens
gaaaauugagag

SEQ ID NO: 1867359 - RNA, 18 nt, Homo sapiens
ugaguacuccacacugca

SEQ ID NO: 1867360 - RNA, 17 nt, Homo sapiens
caaugguuaacaucuuc

SEQ ID NO: 1867361 - RNA, 19 nt, Homo sapiens
aguagaauauggacuugga

SEQ ID NO: 1867362 - RNA, 20 nt, Homo sapiens
aaggcagaaugaaaaguccu

SEQ ID NO: 1867363 - RNA, 15 nt, Homo sapiens
ugggaucaaauaacu

SEQ ID NO: 1867364 - RNA, 20 nt, Homo sapiens
ucaggcucagagggaccuca

SEQ ID NO: 1867365 - RNA, 21 nt, Homo sapiens
cugacugcacguggcuucuga

SEQ ID NO: 1867366 - RNA, 23 nt, Homo sapiens
auauggggggagugagcucucuc

SEQ ID NO: 1867367 - RNA, 16 nt, Homo sapiens
cuaagacacaaaugca

SEQ ID NO: 1867368 - RNA, 18 nt, Homo sapiens
guuauugauaaguucaua

SEQ ID NO: 1867369 - RNA, 12 nt, Homo sapiens
cgaauccugaca

SEQ ID NO: 1867370 - RNA, 14 nt, Homo sapiens
cucauuacugugag

SEQ ID NO: 1867371 - RNA, 17 nt, Homo sapiens
ccagcuuugcagugaca

SEQ ID NO: 1867372 - RNA, 19 nt, Homo sapiens
cucucuacuagcaccauca

SEQ ID NO: 1867373 - RNA, 13 nt, Homo sapiens
ucccaauaaaguc

SEQ ID NO: 1867374 - RNA, 22 nt, Homo sapiens
caaaaagaagaguuugugacua

SEQ ID NO: 1867375 - RNA, 17 nt, Homo sapiens
caacccgaggcaauaaa

SEQ ID NO: 1867376 - RNA, 19 nt, Homo sapiens
ugggcccagcaggggcccu

SEQ ID NO: 1867377 - RNA, 20 nt, Homo sapiens
gagaucacuacucagugcau

SEQ ID NO: 1867378 - RNA, 15 nt, Homo sapiens
gauacuguaauacuu

SEQ ID NO: 1867379 - RNA, 22 nt, Homo sapiens
acaguguuuuuggaaaccugga

SEQ ID NO: 1867380 - RNA, 20 nt, Homo sapiens
caccuuuuuaaauccuaaaa

SEQ ID NO: 1867381 - RNA, 15 nt, Homo sapiens
caacaguaugcacaa

SEQ ID NO: 1867382 - RNA, 22 nt, Homo sapiens
accccaccuugccaagcuuucu

SEQ ID NO: 1867383 - RNA, 22 nt, Homo sapiens
acuacauuaccuguucuugccu

SEQ ID NO: 1867384 - RNA, 16 nt, Homo sapiens
gcugcaucuuacagaa

SEQ ID NO: 1867385 - RNA, 14 nt, Homo sapiens
cacugacugugaaa

SEQ ID NO: 1867386 - RNA, 14 nt, Homo sapiens
ccucccuacaggcc

SEQ ID NO: 1867387 - RNA, 17 nt, Homo sapiens
gcugggggcaggacaac

SEQ ID NO: 1867388 - RNA, 13 nt, Homo sapiens
uauucacugaugc

SEQ ID NO: 1867389 - RNA, 20 nt, Homo sapiens
acagcaaaacuccaucucaa

SEQ ID NO: 1867390 - RNA, 18 nt, Homo sapiens
cccagcaugcugagauua

SEQ ID NO: 1867391 - RNA, 14 nt, Homo sapiens
aauaaagugaacuu

SEQ ID NO: 1867392 - RNA, 15 nt, Homo sapiens
gacuuccagugcuca

SEQ ID NO: 1867393 - RNA, 17 nt, Homo sapiens
aguuuguagguaaaaug

SEQ ID NO: 1867394 - RNA, 23 nt, Homo sapiens
acuuccucuggcuccccaaggcu

SEQ ID NO: 1867395 - RNA, 11 nt, Homo sapiens
ccugacacuga

SEQ ID NO: 1867396 - RNA, 14 nt, Homo sapiens
ugauaccacugcac

SEQ ID NO: 1867397 - RNA, 13 nt, Homo sapiens
auucucaugccuc

SEQ ID NO: 1867398 - RNA, 15 nt, Homo sapiens
aggagccuaggccag

SEQ ID NO: 1867399 - RNA, 16 nt, Homo sapiens
gccaugcgaggggcca

SEQ ID NO: 1867400 - RNA, 17 nt, Homo sapiens
caauucuccugccucag

SEQ ID NO: 1867401 - RNA, 20 nt, Homo sapiens
accagaugucgcccuacuca

SEQ ID NO: 1867402 - RNA, 16 nt, Homo sapiens
ccuccuuugccuucca

SEQ ID NO: 1867403 - RNA, 18 nt, Homo sapiens
caucauuguccccaugca

SEQ ID NO: 1867404 - RNA, 13 nt, Homo sapiens
acacgacuuguaa

SEQ ID NO: 1867405 - RNA, 15 nt, Homo sapiens
cuucaauacccaaau

SEQ ID NO: 1867406 - RNA, 14 nt, Homo sapiens
agugcuacaggguc

SEQ ID NO: 1867407 - RNA, 17 nt, Homo sapiens
auaauuuagauauucau

SEQ ID NO: 1867408 - RNA, 21 nt, Homo sapiens
gugccacguggccgcugccca

SEQ ID NO: 1867409 - RNA, 21 nt, Homo sapiens
cagcacauucacugacaugau

SEQ ID NO: 1867410 - RNA, 21 nt, Homo sapiens
aacaaaaaaaccucuaugcaa

SEQ ID NO: 1867411 - RNA, 14 nt, Homo sapiens
auggaggccagcua

SEQ ID NO: 1867412 - RNA, 12 nt, Homo sapiens
ccaggucuucca

SEQ ID NO: 1867413 - RNA, 23 nt, Homo sapiens
gcugagcagguguucuucauuac

SEQ ID NO: 1867414 - RNA, 17 nt, Homo sapiens
accccuccccagucucu

SEQ ID NO: 1867415 - RNA, 22 nt, Homo sapiens
uucccagcaccuaguaugcuca

SEQ ID NO: 1867416 - RNA, 18 nt, Homo sapiens
agccacgugcucucugga

SEQ ID NO: 1867417 - RNA, 23 nt, Homo sapiens
agaauuugccuucucccugggaa

SEQ ID NO: 1867418 - RNA, 22 nt, Homo sapiens
caaaacucuccuacacuuccau

SEQ ID NO: 1867419 - RNA, 13 nt, Homo sapiens
aaaaguggggcag

SEQ ID NO: 1867420 - RNA, 23 nt, Homo sapiens
ugaaggguucaccaggucaggga

SEQ ID NO: 1867421 - RNA, 16 nt, Homo sapiens
caauaaaaauggcuca

SEQ ID NO: 1867422 - RNA, 23 nt, Homo sapiens
gccagcccucccuggcugugagc

SEQ ID NO: 1867423 - RNA, 22 nt, Homo sapiens
ucacaacaaaaggaagacugga

SEQ ID NO: 1867424 - RNA, 18 nt, Homo sapiens
auagugcuucuuguaaua

SEQ ID NO: 1867425 - RNA, 12 nt, Homo sapiens
uuaagaacuuca

SEQ ID NO: 1867426 - RNA, 13 nt, Homo sapiens
ccugaaggugcug

SEQ ID NO: 1867427 - RNA, 15 nt, Homo sapiens
ucccucacagcacag

SEQ ID NO: 1867428 - RNA, 18 nt, Homo sapiens
cuacauuuugcucuguga

SEQ ID NO: 1867429 - RNA, 21 nt, Homo sapiens
acagauuccuggcagagccau

SEQ ID NO: 1867430 - RNA, 16 nt, Homo sapiens
cagaguaugagugcaa

SEQ ID NO: 1867431 - RNA, 20 nt, Homo sapiens
auuaauguguuaagugcagg

SEQ ID NO: 1867432 - RNA, 15 nt, Homo sapiens
ugaaauaaaauaaca

SEQ ID NO: 1867433 - RNA, 12 nt, Homo sapiens
guugguguuccu

SEQ ID NO: 1867434 - RNA, 18 nt, Homo sapiens
ccuguggguuuccauggc

SEQ ID NO: 1867435 - RNA, 23 nt, Homo sapiens
aagauuaaauaugaucacuucau

SEQ ID NO: 1867436 - RNA, 14 nt, Homo sapiens
aacccugugcauga

SEQ ID NO: 1867437 - RNA, 22 nt, Homo sapiens
aagggccagcuggaggugaaga

SEQ ID NO: 1867438 - RNA, 19 nt, Homo sapiens
aggccugagccacugugcc

SEQ ID NO: 1867439 - RNA, 15 nt, Homo sapiens
cggagguacccaggc

SEQ ID NO: 1867440 - RNA, 14 nt, Homo sapiens
cucuuguacaaaag

SEQ ID NO: 1867441 - RNA, 18 nt, Homo sapiens
acucuacccccaacacca

SEQ ID NO: 1867442 - RNA, 19 nt, Homo sapiens
cuccauuaaauuugguaca

SEQ ID NO: 1867443 - RNA, 11 nt, Homo sapiens
uguuuacaaag

SEQ ID NO: 1867444 - RNA, 19 nt, Homo sapiens
agacuuaagcccagugcac

SEQ ID NO: 1867445 - RNA, 19 nt, Homo sapiens
uguuguuccuucauauaau

SEQ ID NO: 1867446 - RNA, 20 nt, Homo sapiens
aguggcaucaucucagcuca

SEQ ID NO: 1867447 - RNA, 20 nt, Homo sapiens
ucuggcaacccuagucugcu

SEQ ID NO: 1867448 - RNA, 12 nt, Homo sapiens
accaguggaccu

SEQ ID NO: 1867449 - RNA, 12 nt, Homo sapiens
cagaguggcagu

SEQ ID NO: 1867450 - RNA, 12 nt, Homo sapiens
cacaguggcacu

SEQ ID NO: 1867451 - RNA, 21 nt, Homo sapiens
cagcuccuuagacaccuauca

SEQ ID NO: 1867452 - RNA, 17 nt, Homo sapiens
cugagucccuggcaaga

SEQ ID NO: 1867453 - RNA, 15 nt, Homo sapiens
cagaaccccaacucc

SEQ ID NO: 1867454 - RNA, 15 nt, Homo sapiens
agacugucaggaagu

SEQ ID NO: 1867455 - RNA, 13 nt, Homo sapiens
uaacuauucauaa

SEQ ID NO: 1867456 - RNA, 20 nt, Homo sapiens
caaaucuaaaguugcuccau

SEQ ID NO: 1867457 - RNA, 20 nt, Homo sapiens
aaggaucaccccagccccca

SEQ ID NO: 1867458 - RNA, 18 nt, Homo sapiens
guaaaucuagaguuuaua

SEQ ID NO: 1867459 - RNA, 21 nt, Homo sapiens
auuuccaaaacuuuaaugaac

SEQ ID NO: 1867460 - RNA, 22 nt, Homo sapiens
agagagcuuaagugacuuccuc

SEQ ID NO: 1867461 - RNA, 15 nt, Homo sapiens
cugucucccuaggga

SEQ ID NO: 1867462 - RNA, 23 nt, Homo sapiens
cgggucucucacuguugcagugg

SEQ ID NO: 1867463 - RNA, 20 nt, Homo sapiens
cacagcccugcucauuccuc

SEQ ID NO: 1867464 - RNA, 12 nt, Homo sapiens
uuuuaggcaaag

SEQ ID NO: 1867465 - RNA, 18 nt, Homo sapiens
gccuccaucagcuaaaca

SEQ ID NO: 1867466 - RNA, 14 nt, Homo sapiens
cucucaaacuucac

SEQ ID NO: 1867467 - RNA, 19 nt, Homo sapiens
uaauaaaaaggaguauaca

SEQ ID NO: 1867468 - RNA, 22 nt, Homo sapiens
cacuucuaccugcccccaucau

SEQ ID NO: 1867469 - RNA, 14 nt, Homo sapiens
gccagccgugagug

SEQ ID NO: 1867470 - RNA, 12 nt, Homo sapiens
uuuuauucacau

SEQ ID NO: 1867471 - RNA, 16 nt, Homo sapiens
agggauucccacccca

SEQ ID NO: 1867472 - RNA, 13 nt, Homo sapiens
ucaucaccccaga

SEQ ID NO: 1867473 - RNA, 21 nt, Homo sapiens
gagggcagcccccucccuaga

SEQ ID NO: 1867474 - RNA, 14 nt, Homo sapiens
caauaggugcaaaa

SEQ ID NO: 1867475 - RNA, 12 nt, Homo sapiens
auguuugcacac

SEQ ID NO: 1867476 - RNA, 17 nt, Homo sapiens
aauuucuguccagaaaa

SEQ ID NO: 1867477 - RNA, 18 nt, Homo sapiens
gcucaauuuggugcucac

SEQ ID NO: 1867478 - RNA, 22 nt, Homo sapiens
agagaccucaucagccuuggga

SEQ ID NO: 1867479 - RNA, 22 nt, Homo sapiens
gcugcaguuuuuuuccuucaag

SEQ ID NO: 1867480 - RNA, 11 nt, Homo sapiens
uccauccugac

SEQ ID NO: 1867481 - RNA, 18 nt, Homo sapiens
cuuuaaauaaauccaaaa

SEQ ID NO: 1867482 - RNA, 14 nt, Homo sapiens
ucccugggguacua

SEQ ID NO: 1867483 - RNA, 17 nt, Homo sapiens
aaaucagaaaacccacg

SEQ ID NO: 1867484 - RNA, 17 nt, Homo sapiens
accucugggagcucaag

SEQ ID NO: 1867485 - RNA, 16 nt, Homo sapiens
acuauuuguuccacau

SEQ ID NO: 1867486 - RNA, 15 nt, Homo sapiens
auuuaaauuccacag

SEQ ID NO: 1867487 - RNA, 16 nt, Homo sapiens
uccugguucaguggga

SEQ ID NO: 1867488 - RNA, 23 nt, Homo sapiens
aauggcauaggcugacuuuugca

SEQ ID NO: 1867489 - RNA, 21 nt, Homo sapiens
uaagccaauccucacucccca

SEQ ID NO: 1867490 - RNA, 15 nt, Homo sapiens
ccaaaauguguuuca

SEQ ID NO: 1867491 - RNA, 17 nt, Homo sapiens
cggagaacaaaugugaa

SEQ ID NO: 1867492 - RNA, 19 nt, Homo sapiens
ucuuuuucucccccuccca

SEQ ID NO: 1867493 - RNA, 22 nt, Homo sapiens
uccugaucaggaaaccagaaau

SEQ ID NO: 1867494 - RNA, 17 nt, Homo sapiens
gcgauggacaauuauga

SEQ ID NO: 1867495 - RNA, 19 nt, Homo sapiens
gugcaguggcgugaucuug

SEQ ID NO: 1867496 - RNA, 18 nt, Homo sapiens
agcaacccuaacaguaag

SEQ ID NO: 1867497 - RNA, 13 nt, Homo sapiens
auaugauuuagca

SEQ ID NO: 1867498 - RNA, 22 nt, Homo sapiens
agagucuaauagucuuugccag

SEQ ID NO: 1867499 - RNA, 21 nt, Homo sapiens
gucauuugacaggggcucagg

SEQ ID NO: 1867500 - RNA, 22 nt, Homo sapiens
uaguuacuaaacauguauguaa

SEQ ID NO: 1867501 - RNA, 13 nt, Homo sapiens
aaugaacccuccu

SEQ ID NO: 1867502 - RNA, 21 nt, Homo sapiens
gaccagaaugaaaacuguaaa

SEQ ID NO: 1867503 - RNA, 21 nt, Homo sapiens
caagauaggaagaaaauuucc

SEQ ID NO: 1867504 - RNA, 18 nt, Homo sapiens
auggguuauuuaugcuug

SEQ ID NO: 1867505 - RNA, 15 nt, Homo sapiens
gccaugcaacuccau

SEQ ID NO: 1867506 - RNA, 18 nt, Homo sapiens
acacaauacaguacucag

SEQ ID NO: 1867507 - RNA, 21 nt, Homo sapiens
aagcaaguuucaucagucaau

SEQ ID NO: 1867508 - RNA, 23 nt, Homo sapiens
cugcuuaaaagaaaauguucacu

SEQ ID NO: 1867509 - RNA, 13 nt, Homo sapiens
agguggugccuuc

SEQ ID NO: 1867510 - RNA, 18 nt, Homo sapiens
ucaauuauuuaugaacug

SEQ ID NO: 1867511 - RNA, 16 nt, Homo sapiens
gcacaguccagaccca

SEQ ID NO: 1867512 - RNA, 14 nt, Homo sapiens
gguauuuucuagac

SEQ ID NO: 1867513 - RNA, 17 nt, Homo sapiens
aaaguaaauucauguaa

SEQ ID NO: 1867514 - RNA, 22 nt, Homo sapiens
agucuuuauuauuuacuuugca

SEQ ID NO: 1867515 - RNA, 23 nt, Homo sapiens
cccugccuuuaaaaacaaacaga

SEQ ID NO: 1867516 - RNA, 23 nt, Homo sapiens
cagucacuuugacagguuccuuu

SEQ ID NO: 1867517 - RNA, 17 nt, Homo sapiens
agauauuaaauucucaa

SEQ ID NO: 1867518 - RNA, 22 nt, Homo sapiens
guuuggaaucccacuaaugcaa

SEQ ID NO: 1867519 - RNA, 13 nt, Homo sapiens
ggaauaaaauccu

SEQ ID NO: 1867520 - RNA, 15 nt, Homo sapiens
ugaaugaacaaccuc

SEQ ID NO: 1867521 - RNA, 12 nt, Homo sapiens
gaagggccaguc

SEQ ID NO: 1867522 - RNA, 16 nt, Homo sapiens
ccugucuugcugucau

SEQ ID NO: 1867523 - RNA, 22 nt, Homo sapiens
auuucuucccgcacaaauucca

SEQ ID NO: 1867524 - RNA, 17 nt, Homo sapiens
gaagaauugaaaaacca

SEQ ID NO: 1867525 - RNA, 16 nt, Homo sapiens
ucugcugggugugacc

SEQ ID NO: 1867526 - RNA, 17 nt, Homo sapiens
aucccuaaugcugcaga

SEQ ID NO: 1867527 - RNA, 15 nt, Homo sapiens
cacaaacucauccau

SEQ ID NO: 1867528 - RNA, 15 nt, Homo sapiens
gcuuaguauuucuca

SEQ ID NO: 1867529 - RNA, 22 nt, Homo sapiens
uguaaagaguggagcaaaugcu

SEQ ID NO: 1867530 - RNA, 23 nt, Homo sapiens
ugucccuuccauuucuacuguau

SEQ ID NO: 1867531 - RNA, 19 nt, Homo sapiens
cugaggggcuaccaggaaa

SEQ ID NO: 1867532 - RNA, 16 nt, Homo sapiens
uaacuugauauagaaa

SEQ ID NO: 1867533 - RNA, 16 nt, Homo sapiens
auauuaaaucugggau

SEQ ID NO: 1867534 - RNA, 19 nt, Homo sapiens
uauguuacuacaugcacuu

SEQ ID NO: 1867535 - RNA, 17 nt, Homo sapiens
ccuuuuauaauacuuuu

SEQ ID NO: 1867536 - RNA, 15 nt, Homo sapiens
gccacagacaacuca

SEQ ID NO: 1867537 - RNA, 20 nt, Homo sapiens
guuuagcugacaaaauacuu

SEQ ID NO: 1867538 - RNA, 13 nt, Homo sapiens
acccuaaagggag

SEQ ID NO: 1867539 - RNA, 14 nt, Homo sapiens
aaggaaaugcuccu

SEQ ID NO: 1867540 - RNA, 21 nt, Homo sapiens
ucccccaugcucugaugcagu

SEQ ID NO: 1867541 - RNA, 22 nt, Homo sapiens
aagagcuaaguucuaaguucau

SEQ ID NO: 1867542 - RNA, 23 nt, Homo sapiens
ugccacagccuccccugccaggg

SEQ ID NO: 1867543 - RNA, 15 nt, Homo sapiens
ugacaagucacagac

SEQ ID NO: 1867544 - RNA, 22 nt, Homo sapiens
cgcuuggcuccaugcuccucac

SEQ ID NO: 1867545 - RNA, 14 nt, Homo sapiens
uuaauauugaggcu

SEQ ID NO: 1867546 - RNA, 18 nt, Homo sapiens
aacuaccauguggccauu

SEQ ID NO: 1867547 - RNA, 17 nt, Homo sapiens
ugggaaacccucuccau

SEQ ID NO: 1867548 - RNA, 17 nt, Homo sapiens
ugccucugcacgugcac

SEQ ID NO: 1867549 - RNA, 17 nt, Homo sapiens
cccauggguuaagagcu

SEQ ID NO: 1867550 - RNA, 21 nt, Homo sapiens
uauagugacccacccuagauc

SEQ ID NO: 1867551 - RNA, 17 nt, Homo sapiens
uucucaagaccaacaga

SEQ ID NO: 1867552 - RNA, 14 nt, Homo sapiens
aauauuucagauaa

SEQ ID NO: 1867553 - RNA, 19 nt, Homo sapiens
gccucucuuggacccuggg

SEQ ID NO: 1867554 - RNA, 19 nt, Homo sapiens
cacucuugccaaccuguaa

SEQ ID NO: 1867555 - RNA, 20 nt, Homo sapiens
ccucuuuuaaugucaucucu

SEQ ID NO: 1867556 - RNA, 21 nt, Homo sapiens
aguggggacauacacuugcau

SEQ ID NO: 1867557 - RNA, 18 nt, Homo sapiens
cagauuauuuuuccucug

SEQ ID NO: 1867558 - RNA, 15 nt, Homo sapiens
gaagcuacugcauga

SEQ ID NO: 1867559 - RNA, 18 nt, Homo sapiens
cucccaaagugcagggau

SEQ ID NO: 1867560 - RNA, 15 nt, Homo sapiens
gaucucauguccucu

SEQ ID NO: 1867561 - RNA, 16 nt, Homo sapiens
ugucuagggcagagua

SEQ ID NO: 1867562 - RNA, 17 nt, Homo sapiens
agagcagagaagggcag

SEQ ID NO: 1867563 - RNA, 13 nt, Homo sapiens
auaaucacuuuuu

SEQ ID NO: 1867564 - RNA, 16 nt, Homo sapiens
cugccagcucucagga

SEQ ID NO: 1867565 - RNA, 18 nt, Homo sapiens
uuagccugggccucuacc

SEQ ID NO: 1867566 - RNA, 13 nt, Homo sapiens
aauaugucuucau

SEQ ID NO: 1867567 - RNA, 22 nt, Homo sapiens
auuaaacugaaucacaauguaa

SEQ ID NO: 1867568 - RNA, 21 nt, Homo sapiens
cucagacuccuggcuucaugu

SEQ ID NO: 1867569 - RNA, 15 nt, Homo sapiens
ccccucucugcucca

SEQ ID NO: 1867570 - RNA, 16 nt, Homo sapiens
agggccagugaugaug

SEQ ID NO: 1867571 - RNA, 14 nt, Homo sapiens
gaaaaaaauggagu

SEQ ID NO: 1867572 - RNA, 14 nt, Homo sapiens
cuggaagaagcagc

SEQ ID NO: 1867573 - RNA, 19 nt, Homo sapiens
cgaggugguagcucugagc

SEQ ID NO: 1867574 - RNA, 18 nt, Homo sapiens
gaaaauuuuaaaaauaca

SEQ ID NO: 1867575 - RNA, 15 nt, Homo sapiens
ucucuaauaaaaaca

SEQ ID NO: 1867576 - RNA, 16 nt, Homo sapiens
uuaauguucugugaua

SEQ ID NO: 1867577 - RNA, 17 nt, Homo sapiens
ugaaaauuagagaucau

SEQ ID NO: 1867578 - RNA, 22 nt, Homo sapiens
acauacuuucauccugacucug

SEQ ID NO: 1867579 - RNA, 15 nt, Homo sapiens
aagccugugcaaugc

SEQ ID NO: 1867580 - RNA, 21 nt, Homo sapiens
cccgccagccuacacugccag

SEQ ID NO: 1867581 - RNA, 13 nt, Homo sapiens
guagcaauggcca

SEQ ID NO: 1867582 - RNA, 21 nt, Homo sapiens
uacuuaucucucaaaacaaua

SEQ ID NO: 1867583 - RNA, 16 nt, Homo sapiens
uuggcagccucugaaa

SEQ ID NO: 1867584 - RNA, 17 nt, Homo sapiens
ugaucuuuuucugccau

SEQ ID NO: 1867585 - RNA, 22 nt, Homo sapiens
gggaaagggauuuucagcccuc

SEQ ID NO: 1867586 - RNA, 14 nt, Homo sapiens
caugaaaacagaaa

SEQ ID NO: 1867587 - RNA, 15 nt, Homo sapiens
cugacauuagauuga

SEQ ID NO: 1867588 - RNA, 22 nt, Homo sapiens
acacagacuggcaauaaacucc

SEQ ID NO: 1867589 - RNA, 19 nt, Homo sapiens
cucacugccucucggugac

SEQ ID NO: 1867590 - RNA, 23 nt, Homo sapiens
ggaugaaucauauucauaugcag

SEQ ID NO: 1867591 - RNA, 12 nt, Homo sapiens
cccaaacauguu

SEQ ID NO: 1867592 - RNA, 19 nt, Homo sapiens
gggccuccaccucugugca

SEQ ID NO: 1867593 - RNA, 17 nt, Homo sapiens
aagcauauauaacuauu

SEQ ID NO: 1867594 - RNA, 17 nt, Homo sapiens
cuccaggaugaguuacu

SEQ ID NO: 1867595 - RNA, 20 nt, Homo sapiens
gacugccacccacacgcccu

SEQ ID NO: 1867596 - RNA, 22 nt, Homo sapiens
acgcagccugcagacucacugu

SEQ ID NO: 1867597 - RNA, 16 nt, Homo sapiens
ugaaaacaaacuucuc

SEQ ID NO: 1867598 - RNA, 17 nt, Homo sapiens
uauucaagugauaggau

SEQ ID NO: 1867599 - RNA, 16 nt, Homo sapiens
ccagccccgugccagg

SEQ ID NO: 1867600 - RNA, 21 nt, Homo sapiens
uuaaacuaguguuauacuuga

SEQ ID NO: 1867601 - RNA, 10 nt, Homo sapiens
guaguuugca

SEQ ID NO: 1867602 - RNA, 17 nt, Homo sapiens
auaccacacacauuauc

SEQ ID NO: 1867603 - RNA, 19 nt, Homo sapiens
aaacuggguaaugcaacuc

SEQ ID NO: 1867604 - RNA, 17 nt, Homo sapiens
accucaagguguucucu

SEQ ID NO: 1867605 - RNA, 16 nt, Homo sapiens
aauauacucauuugga

SEQ ID NO: 1867606 - RNA, 13 nt, Homo sapiens
gcacagaggucag

SEQ ID NO: 1867607 - RNA, 16 nt, Homo sapiens
ugucccagaaugccuc

SEQ ID NO: 1867608 - RNA, 18 nt, Homo sapiens
caccauguuugagcucag

SEQ ID NO: 1867609 - RNA, 23 nt, Homo sapiens
ucucagaauucggugugcugcca

SEQ ID NO: 1867610 - RNA, 17 nt, Homo sapiens
ccaggacucuggcacuu

SEQ ID NO: 1867611 - RNA, 16 nt, Homo sapiens
cuaucuugaaucuucu

SEQ ID NO: 1867612 - RNA, 18 nt, Homo sapiens
uuucagguuccaaucaga

SEQ ID NO: 1867613 - RNA, 18 nt, Homo sapiens
uuccuagucauaauguca

SEQ ID NO: 1867614 - RNA, 22 nt, Homo sapiens
aaagcaguuacuaauaugccua

SEQ ID NO: 1867615 - RNA, 17 nt, Homo sapiens
ggacugagcgaggaaaa

SEQ ID NO: 1867616 - RNA, 22 nt, Homo sapiens
cugaggcaggagagucacuuga

SEQ ID NO: 1867617 - RNA, 23 nt, Homo sapiens
ucaauguuuguaauaauugcuca

SEQ ID NO: 1867618 - RNA, 17 nt, Homo sapiens
gggcugagcaccucuca

SEQ ID NO: 1867619 - RNA, 16 nt, Homo sapiens
cugacauccccacuca

SEQ ID NO: 1867620 - RNA, 13 nt, Homo sapiens
auuuucacuuuug

SEQ ID NO: 1867621 - RNA, 14 nt, Homo sapiens
uccacccaccucag

SEQ ID NO: 1867622 - RNA, 23 nt, Homo sapiens
ggacuuaagacuuaucaugccaa

SEQ ID NO: 1867623 - RNA, 14 nt, Homo sapiens
auaaaagcuagaua

SEQ ID NO: 1867624 - RNA, 17 nt, Homo sapiens
aucuccccucagauucc

SEQ ID NO: 1867625 - RNA, 17 nt, Homo sapiens
uaaaauuagugagauua

SEQ ID NO: 1867626 - RNA, 18 nt, Homo sapiens
aaacuaauguacuguaca

SEQ ID NO: 1867627 - RNA, 18 nt, Homo sapiens
acuguguuuuuccuccau

SEQ ID NO: 1867628 - RNA, 14 nt, Homo sapiens
caccucuuccuuga

SEQ ID NO: 1867629 - RNA, 23 nt, Homo sapiens
caucucaauugugcuuuguauca

SEQ ID NO: 1867630 - RNA, 23 nt, Homo sapiens
acagccguggggggaagcacaua

SEQ ID NO: 1867631 - RNA, 14 nt, Homo sapiens
uaaaauuauuccuu

SEQ ID NO: 1867632 - RNA, 19 nt, Homo sapiens
cuguggugccucucuuggc

SEQ ID NO: 1867633 - RNA, 22 nt, Homo sapiens
acuucugagcaguuuuccagga

SEQ ID NO: 1867634 - RNA, 17 nt, Homo sapiens
guuuuuuaaaaauaagc

SEQ ID NO: 1867635 - RNA, 17 nt, Homo sapiens
accuucuaaaagccauu

SEQ ID NO: 1867636 - RNA, 17 nt, Homo sapiens
gggcuuuagggaccugc

SEQ ID NO: 1867637 - RNA, 21 nt, Homo sapiens
cagaaagcuuugaauacuaaa

SEQ ID NO: 1867638 - RNA, 21 nt, Homo sapiens
agaggucucagguucuuucca

SEQ ID NO: 1867639 - RNA, 19 nt, Homo sapiens
ugcaaaaggguaagaugaa

SEQ ID NO: 1867640 - RNA, 15 nt, Homo sapiens
uuguagcucucugac

SEQ ID NO: 1867641 - RNA, 15 nt, Homo sapiens
cuacuaucucagaga

SEQ ID NO: 1867642 - RNA, 22 nt, Homo sapiens
cagaugugagccaccgugccug

SEQ ID NO: 1867643 - RNA, 12 nt, Homo sapiens
cagccuagccua

SEQ ID NO: 1867644 - RNA, 12 nt, Homo sapiens
accagggacuga

SEQ ID NO: 1867645 - RNA, 22 nt, Homo sapiens
uagcuaaggcuuggaaacagaa

SEQ ID NO: 1867646 - RNA, 23 nt, Homo sapiens
cuagcuauuggccucccaaaaga

SEQ ID NO: 1867647 - RNA, 14 nt, Homo sapiens
ucucucucuugccu

SEQ ID NO: 1867648 - RNA, 14 nt, Homo sapiens
ucugucucuuggcu

SEQ ID NO: 1867649 - RNA, 13 nt, Homo sapiens
gccauaaaacuua

SEQ ID NO: 1867650 - RNA, 19 nt, Homo sapiens
agacucguuuuuaaggugg

SEQ ID NO: 1867651 - RNA, 21 nt, Homo sapiens
agagaagccagcuuguuuaca

SEQ ID NO: 1867652 - RNA, 16 nt, Homo sapiens
ucccauuuguguuuca

SEQ ID NO: 1867653 - RNA, 19 nt, Homo sapiens
agaaauuccuguagcaucu

SEQ ID NO: 1867654 - RNA, 15 nt, Homo sapiens
ugagagaaagccaca

SEQ ID NO: 1867655 - RNA, 16 nt, Homo sapiens
cuuccauaucuuccag

SEQ ID NO: 1867656 - RNA, 18 nt, Homo sapiens
agcagaagcugguaaaaa

SEQ ID NO: 1867657 - RNA, 12 nt, Homo sapiens
ggcucuucucau

SEQ ID NO: 1867658 - RNA, 14 nt, Homo sapiens
gaaggacauuuucu

SEQ ID NO: 1867659 - RNA, 22 nt, Homo sapiens
aaaaucuaccaagaacagaguc

SEQ ID NO: 1867660 - RNA, 15 nt, Homo sapiens
cauuuuacugucugu

SEQ ID NO: 1867661 - RNA, 16 nt, Homo sapiens
cugaaaaaaugauacg

SEQ ID NO: 1867662 - RNA, 22 nt, Homo sapiens
uuuggaaguuuagcucugagaa

SEQ ID NO: 1867663 - RNA, 12 nt, Homo sapiens
ucagauugcuga

SEQ ID NO: 1867664 - RNA, 14 nt, Homo sapiens
caaaucccacaggg

SEQ ID NO: 1867665 - RNA, 15 nt, Homo sapiens
agacugugcugagaa

SEQ ID NO: 1867666 - RNA, 23 nt, Homo sapiens
gaagcacuuucucuuaacuuaau

SEQ ID NO: 1867667 - RNA, 17 nt, Homo sapiens
uuaggaauuacuuuauu

SEQ ID NO: 1867668 - RNA, 21 nt, Homo sapiens
cuacauugacgagcaugagcu

SEQ ID NO: 1867669 - RNA, 22 nt, Homo sapiens
ucacagcacagagaagacaaaa

SEQ ID NO: 1867670 - RNA, 15 nt, Homo sapiens
uuacaccucaguauu

SEQ ID NO: 1867671 - RNA, 15 nt, Homo sapiens
cucaugugugaaaua

SEQ ID NO: 1867672 - RNA, 19 nt, Homo sapiens
uaaauggaacaaacaauga

SEQ ID NO: 1867673 - RNA, 16 nt, Homo sapiens
aauuguuuguacagua

SEQ ID NO: 1867674 - RNA, 21 nt, Homo sapiens
uucccccagcccaauaaaggu

SEQ ID NO: 1867675 - RNA, 19 nt, Homo sapiens
cauccacuuuaugugcauc

SEQ ID NO: 1867676 - RNA, 14 nt, Homo sapiens
ggaucucacauuuc

SEQ ID NO: 1867677 - RNA, 21 nt, Homo sapiens
uggguacugaaagccuuaggg

SEQ ID NO: 1867678 - RNA, 20 nt, Homo sapiens
guguagaaaagaacuggaaa

SEQ ID NO: 1867679 - RNA, 20 nt, Homo sapiens
uguagcaauagguagcugac

SEQ ID NO: 1867680 - RNA, 15 nt, Homo sapiens
cuuggaacccggugc

SEQ ID NO: 1867681 - RNA, 16 nt, Homo sapiens
guuacagccauaugca

SEQ ID NO: 1867682 - RNA, 20 nt, Homo sapiens
auuauauugucgaauuccua

SEQ ID NO: 1867683 - RNA, 20 nt, Homo sapiens
accaagauauaccugauaua

SEQ ID NO: 1867684 - RNA, 16 nt, Homo sapiens
acauucauacuguaga

SEQ ID NO: 1867685 - RNA, 17 nt, Homo sapiens
caaaugcacucaucaca

SEQ ID NO: 1867686 - RNA, 18 nt, Homo sapiens
aauccuucuaguuuccca

SEQ ID NO: 1867687 - RNA, 11 nt, Homo sapiens
gacuauguaau

SEQ ID NO: 1867688 - RNA, 14 nt, Homo sapiens
ucccugaagccagc

SEQ ID NO: 1867689 - RNA, 16 nt, Homo sapiens
agcccagcagacauca

SEQ ID NO: 1867690 - RNA, 15 nt, Homo sapiens
cccccgagcugcucc

SEQ ID NO: 1867691 - RNA, 20 nt, Homo sapiens
ugcucugaggcuuccagaga

SEQ ID NO: 1867692 - RNA, 21 nt, Homo sapiens
ucugcuauuaaccuugccuua

SEQ ID NO: 1867693 - RNA, 19 nt, Homo sapiens
accuauugcacuccauccu

SEQ ID NO: 1867694 - RNA, 15 nt, Homo sapiens
uuaacaucaaagacu

SEQ ID NO: 1867695 - RNA, 22 nt, Homo sapiens
aaggaaggcuccaucuccagug

SEQ ID NO: 1867696 - RNA, 16 nt, Homo sapiens
cuucaaaaaugugcug

SEQ ID NO: 1867697 - RNA, 12 nt, Homo sapiens
uucgaccaaacu

SEQ ID NO: 1867698 - RNA, 14 nt, Homo sapiens
gaccagacaauguu

SEQ ID NO: 1867699 - RNA, 15 nt, Homo sapiens
cuccugaucaggaaa

SEQ ID NO: 1867700 - RNA, 14 nt, Homo sapiens
aaacagauauacuc

SEQ ID NO: 1867701 - RNA, 17 nt, Homo sapiens
uauucuggagucugcca

SEQ ID NO: 1867702 - RNA, 18 nt, Homo sapiens
auaaugcucccaucuccu

SEQ ID NO: 1867703 - RNA, 21 nt, Homo sapiens
gcagaggcuguggugagccaa

SEQ ID NO: 1867704 - RNA, 12 nt, Homo sapiens
uuuucucuaaaa

SEQ ID NO: 1867705 - RNA, 18 nt, Homo sapiens
agcucuaucccaaccucu

SEQ ID NO: 1867706 - RNA, 10 nt, Homo sapiens
ucccaugagc

SEQ ID NO: 1867707 - RNA, 20 nt, Homo sapiens
cuugcaccacuuccguccca

SEQ ID NO: 1867708 - RNA, 12 nt, Homo sapiens
caccgucuuucu

SEQ ID NO: 1867709 - RNA, 15 nt, Homo sapiens
cggcagccuggaugu

SEQ ID NO: 1867710 - RNA, 17 nt, Homo sapiens
uacuacauuccaaagaa

SEQ ID NO: 1867711 - RNA, 18 nt, Homo sapiens
gcacuacugggugucauu

SEQ ID NO: 1867712 - RNA, 15 nt, Homo sapiens
cuucccauacuugca

SEQ ID NO: 1867713 - RNA, 16 nt, Homo sapiens
uguagcaacaugagaa

SEQ ID NO: 1867714 - RNA, 19 nt, Homo sapiens
agucuuuucuggcaaauaa

SEQ ID NO: 1867715 - RNA, 14 nt, Homo sapiens
auaguaaaugcuuu

SEQ ID NO: 1867716 - RNA, 18 nt, Homo sapiens
gcaagagcucaaggucaa

SEQ ID NO: 1867717 - RNA, 12 nt, Homo sapiens
aaaaccucaaac

SEQ ID NO: 1867718 - RNA, 21 nt, Homo sapiens
auccaucaucugcugcacaua

SEQ ID NO: 1867719 - RNA, 14 nt, Homo sapiens
gcaaaauacuguac

SEQ ID NO: 1867720 - RNA, 15 nt, Homo sapiens
uccacgcacucagcu

SEQ ID NO: 1867721 - RNA, 18 nt, Homo sapiens
ggacauugcggacagcca

SEQ ID NO: 1867722 - RNA, 19 nt, Homo sapiens
ugauucacaacuaggaccu

SEQ ID NO: 1867723 - RNA, 17 nt, Homo sapiens
ucucauacucaccucac

SEQ ID NO: 1867724 - RNA, 19 nt, Homo sapiens
aacgcaccagacacucaca

SEQ ID NO: 1867725 - RNA, 21 nt, Homo sapiens
acauaaaaaauaaaguaccac

SEQ ID NO: 1867726 - RNA, 13 nt, Homo sapiens
ggccucccagcca

SEQ ID NO: 1867727 - RNA, 21 nt, Homo sapiens
auacuuuugugaacaaaaauu

SEQ ID NO: 1867728 - RNA, 20 nt, Homo sapiens
acgcuuuuugggagaaugau

SEQ ID NO: 1867729 - RNA, 16 nt, Homo sapiens
caguagagucaucucc

SEQ ID NO: 1867730 - RNA, 20 nt, Homo sapiens
cuaaucaauacuuugaacac

SEQ ID NO: 1867731 - RNA, 13 nt, Homo sapiens
caaaauacuucuu

SEQ ID NO: 1867732 - RNA, 22 nt, Homo sapiens
gugcccacccgucuucaaucuc

SEQ ID NO: 1867733 - RNA, 12 nt, Homo sapiens
aggugaauaauu

SEQ ID NO: 1867734 - RNA, 14 nt, Homo sapiens
cuugccugcaggca

SEQ ID NO: 1867735 - RNA, 14 nt, Homo sapiens
ccauccagccagac

SEQ ID NO: 1867736 - RNA, 13 nt, Homo sapiens
aacccccaucucc

SEQ ID NO: 1867737 - RNA, 20 nt, Homo sapiens
cugcaccagagcaaccucuc

SEQ ID NO: 1867738 - RNA, 17 nt, Homo sapiens
cugccugggacagccac

SEQ ID NO: 1867739 - RNA, 16 nt, Homo sapiens
cgcaugugugcugcag

SEQ ID NO: 1867740 - RNA, 17 nt, Homo sapiens
uaaagucuguugauuaa

SEQ ID NO: 1867741 - RNA, 18 nt, Homo sapiens
cauuggcucccaagucac

SEQ ID NO: 1867742 - RNA, 22 nt, Homo sapiens
accaaagacgauacagcuuggc

SEQ ID NO: 1867743 - RNA, 15 nt, Homo sapiens
agacacuggucucag

SEQ ID NO: 1867744 - RNA, 14 nt, Homo sapiens
augcucacuuuauu

SEQ ID NO: 1867745 - RNA, 16 nt, Homo sapiens
uauccccacuacucaa

SEQ ID NO: 1867746 - RNA, 19 nt, Homo sapiens
agguaucuguuuaacauuu

SEQ ID NO: 1867747 - RNA, 19 nt, Homo sapiens
ucacaaaaaggcauaugca

SEQ ID NO: 1867748 - RNA, 20 nt, Homo sapiens
uuucaugcuuuuucagccau

SEQ ID NO: 1867749 - RNA, 22 nt, Homo sapiens
acacagcuauuagaacuaauaa

SEQ ID NO: 1867750 - RNA, 18 nt, Homo sapiens
cccugcucacucuuccac

SEQ ID NO: 1867751 - RNA, 19 nt, Homo sapiens
gauugaccuauaaaacaaa

SEQ ID NO: 1867752 - RNA, 19 nt, Homo sapiens
ugcagagagggaacagcau

SEQ ID NO: 1867753 - RNA, 18 nt, Homo sapiens
ucuggagaguaaucuggg

SEQ ID NO: 1867754 - RNA, 14 nt, Homo sapiens
ccgugcuuccucag

SEQ ID NO: 1867755 - RNA, 16 nt, Homo sapiens
ugccugugaucccagc

SEQ ID NO: 1867756 - RNA, 16 nt, Homo sapiens
ggccuccugccaugua

SEQ ID NO: 1867757 - RNA, 12 nt, Homo sapiens
ucuuuuugacug

SEQ ID NO: 1867758 - RNA, 23 nt, Homo sapiens
aauuaaacuguuaacuuauucaa

SEQ ID NO: 1867759 - RNA, 19 nt, Homo sapiens
caauguuucaaacaaaaag

SEQ ID NO: 1867760 - RNA, 14 nt, Homo sapiens
gucugucaccagcu

SEQ ID NO: 1867761 - RNA, 12 nt, Homo sapiens
cauguacugcau

SEQ ID NO: 1867762 - RNA, 20 nt, Homo sapiens
agcaaaauacaugacauuua

SEQ ID NO: 1867763 - RNA, 21 nt, Homo sapiens
aggaugcauccagggguucau

SEQ ID NO: 1867764 - RNA, 23 nt, Homo sapiens
cuuuaaacuacugaacuguuacc

SEQ ID NO: 1867765 - RNA, 16 nt, Homo sapiens
ggucacccaaccugac

SEQ ID NO: 1867766 - RNA, 20 nt, Homo sapiens
agcagaguugcucuucacca

SEQ ID NO: 1867767 - RNA, 13 nt, Homo sapiens
gccuuuaucucaa

SEQ ID NO: 1867768 - RNA, 16 nt, Homo sapiens
gugccaggacugugac

SEQ ID NO: 1867769 - RNA, 18 nt, Homo sapiens
gggcucagggagcugaga

SEQ ID NO: 1867770 - RNA, 19 nt, Homo sapiens
uacuaacauuuucauugau

SEQ ID NO: 1867771 - RNA, 16 nt, Homo sapiens
aaucucaucucaguga

SEQ ID NO: 1867772 - RNA, 17 nt, Homo sapiens
cucaagagguuugugaa

SEQ ID NO: 1867773 - RNA, 17 nt, Homo sapiens
acuuacuucucugcuau

SEQ ID NO: 1867774 - RNA, 15 nt, Homo sapiens
gccucauuacuguga

SEQ ID NO: 1867775 - RNA, 13 nt, Homo sapiens
uguacugccuuaa

SEQ ID NO: 1867776 - RNA, 13 nt, Homo sapiens
ugcucugccucua

SEQ ID NO: 1867777 - RNA, 21 nt, Homo sapiens
guacauuugagccaugucaca

SEQ ID NO: 1867778 - RNA, 19 nt, Homo sapiens
ugcuccccacccgccuccc

SEQ ID NO: 1867779 - RNA, 16 nt, Homo sapiens
cuguaaauaugucacu

SEQ ID NO: 1867780 - RNA, 19 nt, Homo sapiens
ucaaagcuuccucuggcca

SEQ ID NO: 1867781 - RNA, 22 nt, Homo sapiens
guuucugagagagugccaugau

SEQ ID NO: 1867782 - RNA, 16 nt, Homo sapiens
auuaguuugacacugc

SEQ ID NO: 1867783 - RNA, 14 nt, Homo sapiens
cucaccugaagcau

SEQ ID NO: 1867784 - RNA, 23 nt, Homo sapiens
gcugaaguguuuuugugcagcug

SEQ ID NO: 1867785 - RNA, 16 nt, Homo sapiens
acccucacucugccag

SEQ ID NO: 1867786 - RNA, 19 nt, Homo sapiens
uagacacguguuguuccac

SEQ ID NO: 1867787 - RNA, 20 nt, Homo sapiens
gaauguugguuuacuuucaa

SEQ ID NO: 1867788 - RNA, 14 nt, Homo sapiens
aucaagccaauacc

SEQ ID NO: 1867789 - RNA, 22 nt, Homo sapiens
gucccuccuaacaaguguaucu

SEQ ID NO: 1867790 - RNA, 19 nt, Homo sapiens
uucggcagcuacucagagg

SEQ ID NO: 1867791 - RNA, 14 nt, Homo sapiens
agaagaaggccaga

SEQ ID NO: 1867792 - RNA, 14 nt, Homo sapiens
gcauuuagagcuuu

SEQ ID NO: 1867793 - RNA, 19 nt, Homo sapiens
ggcaauuuuuguauccaag

SEQ ID NO: 1867794 - RNA, 23 nt, Homo sapiens
ucaccgugccugaucugcacauu

SEQ ID NO: 1867795 - RNA, 20 nt, Homo sapiens
uccuaggaggaaaauuccau

SEQ ID NO: 1867796 - RNA, 13 nt, Homo sapiens
auuauuuuuacag

SEQ ID NO: 1867797 - RNA, 18 nt, Homo sapiens
guuggaaaacacuuucau

SEQ ID NO: 1867798 - RNA, 13 nt, Homo sapiens
agguggacagucc

SEQ ID NO: 1867799 - RNA, 20 nt, Homo sapiens
uccagguuugguuauuauga

SEQ ID NO: 1867800 - RNA, 15 nt, Homo sapiens
uacauaaaaguuucu

SEQ ID NO: 1867801 - RNA, 16 nt, Homo sapiens
uaaucccagugacuua

SEQ ID NO: 1867802 - RNA, 23 nt, Homo sapiens
ugucucuucuuaacccugaacaa

SEQ ID NO: 1867803 - RNA, 22 nt, Homo sapiens
gucauuucuuuuugguuugcaa

SEQ ID NO: 1867804 - RNA, 20 nt, Homo sapiens
auuuucauuguaauguucau

SEQ ID NO: 1867805 - RNA, 15 nt, Homo sapiens
agaaacuuauuucuc

SEQ ID NO: 1867806 - RNA, 17 nt, Homo sapiens
caaaacugaaaaucaau

SEQ ID NO: 1867807 - RNA, 18 nt, Homo sapiens
aguauuguuagacauuuu

SEQ ID NO: 1867808 - RNA, 21 nt, Homo sapiens
cuaauaaaccuguaagcccag

SEQ ID NO: 1867809 - RNA, 23 nt, Homo sapiens
uaaguauauuuaauucacuuaac

SEQ ID NO: 1867810 - RNA, 19 nt, Homo sapiens
uucuuacccuguacauaug

SEQ ID NO: 1867811 - RNA, 21 nt, Homo sapiens
ccuuucguucugcugaccaaa

SEQ ID NO: 1867812 - RNA, 17 nt, Homo sapiens
gcguaaacgacacucuc

SEQ ID NO: 1867813 - RNA, 21 nt, Homo sapiens
agggagguuaagugacuugcc

SEQ ID NO: 1867814 - RNA, 13 nt, Homo sapiens
ccaguucaugcag

SEQ ID NO: 1867815 - RNA, 14 nt, Homo sapiens
guuaaggugugcaa

SEQ ID NO: 1867816 - RNA, 14 nt, Homo sapiens
uagaaugacaggaa

SEQ ID NO: 1867817 - RNA, 20 nt, Homo sapiens
agugaggacucggccacugu

SEQ ID NO: 1867818 - RNA, 16 nt, Homo sapiens
auuaagagcaauucaa

SEQ ID NO: 1867819 - RNA, 14 nt, Homo sapiens
agugcccucaucca

SEQ ID NO: 1867820 - RNA, 21 nt, Homo sapiens
ucacuuaauaauguguacauu

SEQ ID NO: 1867821 - RNA, 16 nt, Homo sapiens
cauccugaacagcaug

SEQ ID NO: 1867822 - RNA, 17 nt, Homo sapiens
uuuauaggcauaccucc

SEQ ID NO: 1867823 - RNA, 17 nt, Homo sapiens
acgauggugcaguguaa

SEQ ID NO: 1867824 - RNA, 23 nt, Homo sapiens
cggugcugggggcacagcugucu

SEQ ID NO: 1867825 - RNA, 18 nt, Homo sapiens
acucucugcaguccuccg

SEQ ID NO: 1867826 - RNA, 13 nt, Homo sapiens
gaaucagacugaa

SEQ ID NO: 1867827 - RNA, 15 nt, Homo sapiens
uaugcauuugcauuu

SEQ ID NO: 1867828 - RNA, 14 nt, Homo sapiens
gacagugcugcccu

SEQ ID NO: 1867829 - RNA, 23 nt, Homo sapiens
auccugggccucagcaagccaug

SEQ ID NO: 1867830 - RNA, 19 nt, Homo sapiens
cgcagaguauuugaaguca

SEQ ID NO: 1867831 - RNA, 17 nt, Homo sapiens
guuuaaauaugaaugaa

SEQ ID NO: 1867832 - RNA, 17 nt, Homo sapiens
ucucugaauuugagaua

SEQ ID NO: 1867833 - RNA, 13 nt, Homo sapiens
gauguaacauucc

SEQ ID NO: 1867834 - RNA, 12 nt, Homo sapiens
gguccugucacc

SEQ ID NO: 1867835 - RNA, 13 nt, Homo sapiens
agcuuucugccau

SEQ ID NO: 1867836 - RNA, 18 nt, Homo sapiens
cuuaccaguauuuaacuu

SEQ ID NO: 1867837 - RNA, 15 nt, Homo sapiens
ccuuguuucuacugu

SEQ ID NO: 1867838 - RNA, 11 nt, Homo sapiens
acagucacuga

SEQ ID NO: 1867839 - RNA, 13 nt, Homo sapiens
caucucacuuuau

SEQ ID NO: 1867840 - RNA, 19 nt, Homo sapiens
gggucucguuuuguugcca

SEQ ID NO: 1867841 - RNA, 15 nt, Homo sapiens
uauuugaucacuuaa

SEQ ID NO: 1867842 - RNA, 16 nt, Homo sapiens
uuacuaucacacauga

SEQ ID NO: 1867843 - RNA, 23 nt, Homo sapiens
ucaugcucagcccugacuggugc

SEQ ID NO: 1867844 - RNA, 23 nt, Homo sapiens
ggagcaaaccaaagaccaucuga

SEQ ID NO: 1867845 - RNA, 17 nt, Homo sapiens
cacugcucguggccaaa

SEQ ID NO: 1867846 - RNA, 13 nt, Homo sapiens
ugaagacccagug

SEQ ID NO: 1867847 - RNA, 13 nt, Homo sapiens
aagacgcuuccuu

SEQ ID NO: 1867848 - RNA, 18 nt, Homo sapiens
cuccucugugaagcauuc

SEQ ID NO: 1867849 - RNA, 18 nt, Homo sapiens
caggauuggcaacucuuc

SEQ ID NO: 1867850 - RNA, 16 nt, Homo sapiens
ggagaugucucugcaa

SEQ ID NO: 1867851 - RNA, 19 nt, Homo sapiens
acaguggcaggacaggaaa

SEQ ID NO: 1867852 - RNA, 13 nt, Homo sapiens
ucugcccauuccc

SEQ ID NO: 1867853 - RNA, 18 nt, Homo sapiens
uucaagucaacaugcaua

SEQ ID NO: 1867854 - RNA, 23 nt, Homo sapiens
auuuucaaauauguaaacuuuaa

SEQ ID NO: 1867855 - RNA, 19 nt, Homo sapiens
guauguaccaaaacauuga

SEQ ID NO: 1867856 - RNA, 15 nt, Homo sapiens
cuaagaugggugggg

SEQ ID NO: 1867857 - RNA, 22 nt, Homo sapiens
gagaggcccucuggaguggcca

SEQ ID NO: 1867858 - RNA, 14 nt, Homo sapiens
uuaccucauuugca

SEQ ID NO: 1867859 - RNA, 17 nt, Homo sapiens
agcaaaaugcuucugca

SEQ ID NO: 1867860 - RNA, 13 nt, Homo sapiens
aaauuaacaugau

SEQ ID NO: 1867861 - RNA, 13 nt, Homo sapiens
aaaucaacaugac

SEQ ID NO: 1867862 - RNA, 13 nt, Homo sapiens
aagaaaacauaua

SEQ ID NO: 1867863 - RNA, 13 nt, Homo sapiens
augaaaacaaaua

SEQ ID NO: 1867864 - RNA, 14 nt, Homo sapiens
caucaaagauuagg

SEQ ID NO: 1867865 - RNA, 14 nt, Homo sapiens
aaaaucuaccaaga

SEQ ID NO: 1867866 - RNA, 19 nt, Homo sapiens
agggccaagagaucugugu

SEQ ID NO: 1867867 - RNA, 22 nt, Homo sapiens
aagaugggacagcaacaaaauc

SEQ ID NO: 1867868 - RNA, 11 nt, Homo sapiens
aaaugugaacu

SEQ ID NO: 1867869 - RNA, 16 nt, Homo sapiens
ggcuaacgagggauua

SEQ ID NO: 1867870 - RNA, 18 nt, Homo sapiens
cuuaaaaugauucucuac

SEQ ID NO: 1867871 - RNA, 17 nt, Homo sapiens
uccgucugucucgaugc

SEQ ID NO: 1867872 - RNA, 22 nt, Homo sapiens
acacuucaauaauuguccauga

SEQ ID NO: 1867873 - RNA, 14 nt, Homo sapiens
ugacuucacuguau

SEQ ID NO: 1867874 - RNA, 16 nt, Homo sapiens
uccuucugaccacagc

SEQ ID NO: 1867875 - RNA, 17 nt, Homo sapiens
uuugcaaagaccaccuc

SEQ ID NO: 1867876 - RNA, 15 nt, Homo sapiens
agggacaagggauuc

SEQ ID NO: 1867877 - RNA, 20 nt, Homo sapiens
auacauggaaacgcaaauga

SEQ ID NO: 1867878 - RNA, 14 nt, Homo sapiens
guuuuaauuccaau

SEQ ID NO: 1867879 - RNA, 22 nt, Homo sapiens
uuaguuuauauuacucucauuc

SEQ ID NO: 1867880 - RNA, 23 nt, Homo sapiens
cuuacuuggcuuuuuacuauuaa

SEQ ID NO: 1867881 - RNA, 21 nt, Homo sapiens
gcugcucagccucauccugag

SEQ ID NO: 1867882 - RNA, 18 nt, Homo sapiens
caguuccugagaccagcc

SEQ ID NO: 1867883 - RNA, 20 nt, Homo sapiens
auuucacaguuggcacuucu

SEQ ID NO: 1867884 - RNA, 16 nt, Homo sapiens
gauuagaaagacuuuc

SEQ ID NO: 1867885 - RNA, 15 nt, Homo sapiens
uaccauuaucuuauc

SEQ ID NO: 1867886 - RNA, 16 nt, Homo sapiens
acaauacagugguaua

SEQ ID NO: 1867887 - RNA, 14 nt, Homo sapiens
gguagagaggacaa

SEQ ID NO: 1867888 - RNA, 13 nt, Homo sapiens
ggaggccacgucc

SEQ ID NO: 1867889 - RNA, 16 nt, Homo sapiens
caacugacuaaccauu

SEQ ID NO: 1867890 - RNA, 17 nt, Homo sapiens
gauaccagauagcucaa

SEQ ID NO: 1867891 - RNA, 22 nt, Homo sapiens
cacaaauucagucucugaauac

SEQ ID NO: 1867892 - RNA, 12 nt, Homo sapiens
acagcuacucuc

SEQ ID NO: 1867893 - RNA, 16 nt, Homo sapiens
uuagaacuccaguuuu

SEQ ID NO: 1867894 - RNA, 15 nt, Homo sapiens
gaauagacaguauga

SEQ ID NO: 1867895 - RNA, 19 nt, Homo sapiens
cauguggcuaccuguaacu

SEQ ID NO: 1867896 - RNA, 21 nt, Homo sapiens
ccaaauauuuagcaucuuccu

SEQ ID NO: 1867897 - RNA, 20 nt, Homo sapiens
uauuuugauucucauugcca

SEQ ID NO: 1867898 - RNA, 17 nt, Homo sapiens
aagcauuuugccuaccu

SEQ ID NO: 1867899 - RNA, 23 nt, Homo sapiens
cccugucuccucucuguuacuca

SEQ ID NO: 1867900 - RNA, 14 nt, Homo sapiens
auccccucaaaauc

SEQ ID NO: 1867901 - RNA, 20 nt, Homo sapiens
uauauuuugugcuaucagac

SEQ ID NO: 1867902 - RNA, 14 nt, Homo sapiens
caacuucagcagua

SEQ ID NO: 1867903 - RNA, 21 nt, Homo sapiens
augcaaggggaaaaucucagc

SEQ ID NO: 1867904 - RNA, 18 nt, Homo sapiens
gcauuaaaaaugcauaua

SEQ ID NO: 1867905 - RNA, 17 nt, Homo sapiens
auguauuagccagucau

SEQ ID NO: 1867906 - RNA, 22 nt, Homo sapiens
agauguauuaaccuaccuguga

SEQ ID NO: 1867907 - RNA, 19 nt, Homo sapiens
cugaaauaaacacuggugc

SEQ ID NO: 1867908 - RNA, 14 nt, Homo sapiens
gggagaaaugccag

SEQ ID NO: 1867909 - RNA, 18 nt, Homo sapiens
gucccacuacaucuggga

SEQ ID NO: 1867910 - RNA, 23 nt, Homo sapiens
uggaaugggcacagcacagccag

SEQ ID NO: 1867911 - RNA, 17 nt, Homo sapiens
aacugcccaaggcaugu

SEQ ID NO: 1867912 - RNA, 15 nt, Homo sapiens
gaaagaaaaggcaaa

SEQ ID NO: 1867913 - RNA, 21 nt, Homo sapiens
gccgccucccaccacuccacu

SEQ ID NO: 1867914 - RNA, 23 nt, Homo sapiens
cucuuaucaaucccaaccauccu

SEQ ID NO: 1867915 - RNA, 16 nt, Homo sapiens
ccaagagguacuguaa

SEQ ID NO: 1867916 - RNA, 22 nt, Homo sapiens
gguuggaaaacaguauuuucca

SEQ ID NO: 1867917 - RNA, 16 nt, Homo sapiens
augugguuuuuugcca

SEQ ID NO: 1867918 - RNA, 12 nt, Homo sapiens
uccuaacuuauu

SEQ ID NO: 1867919 - RNA, 20 nt, Homo sapiens
auaauacguguguaccuaaa

SEQ ID NO: 1867920 - RNA, 20 nt, Homo sapiens
uggagaguaagaauauagua

SEQ ID NO: 1867921 - RNA, 13 nt, Homo sapiens
acauaucugucau

SEQ ID NO: 1867922 - RNA, 14 nt, Homo sapiens
aauccgaaguauga

SEQ ID NO: 1867923 - RNA, 18 nt, Homo sapiens
gagcccagcuacauuccu

SEQ ID NO: 1867924 - RNA, 19 nt, Homo sapiens
caccucaggaccaugugau

SEQ ID NO: 1867925 - RNA, 19 nt, Homo sapiens
agcaugaagauaaauccaa

SEQ ID NO: 1867926 - RNA, 15 nt, Homo sapiens
caguguugacauagc

SEQ ID NO: 1867927 - RNA, 18 nt, Homo sapiens
ugccauagucagacuuca

SEQ ID NO: 1867928 - RNA, 21 nt, Homo sapiens
gaaauggcaugcaaaagcaau

SEQ ID NO: 1867929 - RNA, 20 nt, Homo sapiens
guggaggcggaauugcucuc

SEQ ID NO: 1867930 - RNA, 14 nt, Homo sapiens
guguguauugcaau

SEQ ID NO: 1867931 - RNA, 23 nt, Homo sapiens
aauuuuguaaaaagaaauuguga

SEQ ID NO: 1867932 - RNA, 15 nt, Homo sapiens
uucauuauaaucuca

SEQ ID NO: 1867933 - RNA, 14 nt, Homo sapiens
aacauucuguguuc

SEQ ID NO: 1867934 - RNA, 14 nt, Homo sapiens
ucuuccccauaauc

SEQ ID NO: 1867935 - RNA, 12 nt, Homo sapiens
aaucugugagaa

SEQ ID NO: 1867936 - RNA, 21 nt, Homo sapiens
uuguguaaugaaaaugaauau

SEQ ID NO: 1867937 - RNA, 15 nt, Homo sapiens
ccuuuagugaucaca

SEQ ID NO: 1867938 - RNA, 21 nt, Homo sapiens
gccuugcuggaugcugcugua

SEQ ID NO: 1867939 - RNA, 18 nt, Homo sapiens
aggggacgccugugucac

SEQ ID NO: 1867940 - RNA, 18 nt, Homo sapiens
uugaaauaaaacauucag

SEQ ID NO: 1867941 - RNA, 14 nt, Homo sapiens
ccccucuaccuccu

SEQ ID NO: 1867942 - RNA, 16 nt, Homo sapiens
agcaguuaggcaccuu

SEQ ID NO: 1867943 - RNA, 17 nt, Homo sapiens
ucggcuccuggacucau

SEQ ID NO: 1867944 - RNA, 22 nt, Homo sapiens
agucugucucuuggcuuuguca

SEQ ID NO: 1867945 - RNA, 21 nt, Homo sapiens
cuaauuucuauuugaucugau

SEQ ID NO: 1867946 - RNA, 21 nt, Homo sapiens
agcauaaugcucccaucuccu

SEQ ID NO: 1867947 - RNA, 21 nt, Homo sapiens
cauacaccacugcaaaauguc

SEQ ID NO: 1867948 - RNA, 16 nt, Homo sapiens
augagaucggagacaa

SEQ ID NO: 1867949 - RNA, 19 nt, Homo sapiens
acugaggauguaaagauca

SEQ ID NO: 1867950 - RNA, 19 nt, Homo sapiens
gaagaggagaaaaagaaga

SEQ ID NO: 1867951 - RNA, 21 nt, Homo sapiens
cuaucucaucuugaugaugau

SEQ ID NO: 1867952 - RNA, 16 nt, Homo sapiens
cccugcccagagcuga

SEQ ID NO: 1867953 - RNA, 19 nt, Homo sapiens
caaaacauuuuugauuuca

SEQ ID NO: 1867954 - RNA, 17 nt, Homo sapiens
cucugccucccaaagug

SEQ ID NO: 1867955 - RNA, 15 nt, Homo sapiens
ugcauguaaaagccu

SEQ ID NO: 1867956 - RNA, 11 nt, Homo sapiens
gcucaugccug

SEQ ID NO: 1867957 - RNA, 19 nt, Homo sapiens
cucacugugguaaaugcca

SEQ ID NO: 1867958 - RNA, 16 nt, Homo sapiens
uacaguuugcuguacu

SEQ ID NO: 1867959 - RNA, 19 nt, Homo sapiens
ggugaaguuaaaacaccuu

SEQ ID NO: 1867960 - RNA, 14 nt, Homo sapiens
aggauguguuuuca

SEQ ID NO: 1867961 - RNA, 20 nt, Homo sapiens
cacaggagcccugcuaugaa

SEQ ID NO: 1867962 - RNA, 15 nt, Homo sapiens
ccaggcuagagugca

SEQ ID NO: 1867963 - RNA, 16 nt, Homo sapiens
gcagcagcucagccuc

SEQ ID NO: 1867964 - RNA, 16 nt, Homo sapiens
ucuuuagugcuuucuu

SEQ ID NO: 1867965 - RNA, 17 nt, Homo sapiens
aaucccaagaaauggaa

SEQ ID NO: 1867966 - RNA, 19 nt, Homo sapiens
cuccuggugaagugugacu

SEQ ID NO: 1867967 - RNA, 13 nt, Homo sapiens
cacacacauacac

SEQ ID NO: 1867968 - RNA, 13 nt, Homo sapiens
uuccaacacucca

SEQ ID NO: 1867969 - RNA, 13 nt, Homo sapiens
cauauacauauau

SEQ ID NO: 1867970 - RNA, 15 nt, Homo sapiens
acccagcuacucugu

SEQ ID NO: 1867971 - RNA, 13 nt, Homo sapiens
aaauguacaccag

SEQ ID NO: 1867972 - RNA, 23 nt, Homo sapiens
aaauaguugucugugcuuccuug

SEQ ID NO: 1867973 - RNA, 19 nt, Homo sapiens
acuuuuuaguuguucagca

SEQ ID NO: 1867974 - RNA, 16 nt, Homo sapiens
augauggugacuuaga

SEQ ID NO: 1867975 - RNA, 15 nt, Homo sapiens
ugcacaaacaugaaa

SEQ ID NO: 1867976 - RNA, 23 nt, Homo sapiens
gccgcaaaucaaccccagacuca

SEQ ID NO: 1867977 - RNA, 17 nt, Homo sapiens
uuguaacuaggcucaga

SEQ ID NO: 1867978 - RNA, 15 nt, Homo sapiens
aaaaauuuauuauuu

SEQ ID NO: 1867979 - RNA, 20 nt, Homo sapiens
acucuuaaguuucucagcuc

SEQ ID NO: 1867980 - RNA, 18 nt, Homo sapiens
aucgcaaggccugugcug

SEQ ID NO: 1867981 - RNA, 16 nt, Homo sapiens
uagugauuugccucaa

SEQ ID NO: 1867982 - RNA, 14 nt, Homo sapiens
ugccuucagccaag

SEQ ID NO: 1867983 - RNA, 16 nt, Homo sapiens
uguuuauuugcacuau

SEQ ID NO: 1867984 - RNA, 21 nt, Homo sapiens
cauagaggacagcaacuggug

SEQ ID NO: 1867985 - RNA, 20 nt, Homo sapiens
cauuucauugagggaaaaca

SEQ ID NO: 1867986 - RNA, 16 nt, Homo sapiens
gaaacuaucucaugcc

SEQ ID NO: 1867987 - RNA, 19 nt, Homo sapiens
acuuggggauuucugguca

SEQ ID NO: 1867988 - RNA, 14 nt, Homo sapiens
uuucaaagcuaaaa

SEQ ID NO: 1867989 - RNA, 14 nt, Homo sapiens
uuccgccacuccag

SEQ ID NO: 1867990 - RNA, 19 nt, Homo sapiens
uacaaguuucuagcucuca

SEQ ID NO: 1867991 - RNA, 16 nt, Homo sapiens
cuacucuaguucuguu

SEQ ID NO: 1867992 - RNA, 21 nt, Homo sapiens
ugggcgacagaagucuugucu

SEQ ID NO: 1867993 - RNA, 18 nt, Homo sapiens
caguaguuccaggacuca

SEQ ID NO: 1867994 - RNA, 20 nt, Homo sapiens
gaggcaaauggcacugcagg

SEQ ID NO: 1867995 - RNA, 14 nt, Homo sapiens
uaauucugcaucug

SEQ ID NO: 1867996 - RNA, 21 nt, Homo sapiens
ccuuccucuuuuccuucccaa

SEQ ID NO: 1867997 - RNA, 23 nt, Homo sapiens
gacaagucuuucuccucuuugag

SEQ ID NO: 1867998 - RNA, 15 nt, Homo sapiens
cugggugacagagug

SEQ ID NO: 1867999 - RNA, 23 nt, Homo sapiens
aaugucuuuauuaaauguagaaa

SEQ ID NO: 1868000 - RNA, 20 nt, Homo sapiens
aaaauguuugguuucaggua

SEQ ID NO: 1868001 - RNA, 19 nt, Homo sapiens
uggagaccaucuaccccuu

SEQ ID NO: 1868002 - RNA, 17 nt, Homo sapiens
caucauuuugcauucaa

SEQ ID NO: 1868003 - RNA, 15 nt, Homo sapiens
ggaucuugaaugugg

SEQ ID NO: 1868004 - RNA, 19 nt, Homo sapiens
cccaguuucuugagaucug

SEQ ID NO: 1868005 - RNA, 17 nt, Homo sapiens
agaucagcgacugccac

SEQ ID NO: 1868006 - RNA, 21 nt, Homo sapiens
ggacaacucagucccuaaaaa

SEQ ID NO: 1868007 - RNA, 23 nt, Homo sapiens
gacagccccuuaagcaugcuucu

SEQ ID NO: 1868008 - RNA, 21 nt, Homo sapiens
aaacaguccuucaaacuucca

SEQ ID NO: 1868009 - RNA, 15 nt, Homo sapiens
uccguacaccccagc

SEQ ID NO: 1868010 - RNA, 17 nt, Homo sapiens
ccacugggagggggacc

SEQ ID NO: 1868011 - RNA, 19 nt, Homo sapiens
ggccagacgugguggcuca

SEQ ID NO: 1868012 - RNA, 21 nt, Homo sapiens
gcagccacuaccccugaugag

SEQ ID NO: 1868013 - RNA, 14 nt, Homo sapiens
aacuaccaugucuu

SEQ ID NO: 1868014 - RNA, 18 nt, Homo sapiens
cuguguuuuuuucuaaaa

SEQ ID NO: 1868015 - RNA, 14 nt, Homo sapiens
aagucgaugaacua

SEQ ID NO: 1868016 - RNA, 16 nt, Homo sapiens
cuuagaagugcuauaa

SEQ ID NO: 1868017 - RNA, 17 nt, Homo sapiens
cguaccuugcuuuagag

SEQ ID NO: 1868018 - RNA, 17 nt, Homo sapiens
ggagagcaacacaggau

SEQ ID NO: 1868019 - RNA, 15 nt, Homo sapiens
guucagucaucucca

SEQ ID NO: 1868020 - RNA, 22 nt, Homo sapiens
cugaaaagaucugaagguccca

SEQ ID NO: 1868021 - RNA, 13 nt, Homo sapiens
cccuccacuucaa

SEQ ID NO: 1868022 - RNA, 12 nt, Homo sapiens
aggccugccugu

SEQ ID NO: 1868023 - RNA, 21 nt, Homo sapiens
ugagccaagagugcacuacug

SEQ ID NO: 1868024 - RNA, 16 nt, Homo sapiens
uuguguauccaugcac

SEQ ID NO: 1868025 - RNA, 15 nt, Homo sapiens
agcccaacaucucca

SEQ ID NO: 1868026 - RNA, 17 nt, Homo sapiens
aggcuuuccucagcacc

SEQ ID NO: 1868027 - RNA, 20 nt, Homo sapiens
cucaaggaccaagagcaauu

SEQ ID NO: 1868028 - RNA, 16 nt, Homo sapiens
cuuccucuagaagcca

SEQ ID NO: 1868029 - RNA, 20 nt, Homo sapiens
cuuuucuuugcuagcacaau

SEQ ID NO: 1868030 - RNA, 14 nt, Homo sapiens
auuuccaucuguau

SEQ ID NO: 1868031 - RNA, 15 nt, Homo sapiens
aaauaauauugccuu

SEQ ID NO: 1868032 - RNA, 17 nt, Homo sapiens
gcccccuguacauuugu

SEQ ID NO: 1868033 - RNA, 21 nt, Homo sapiens
ucuccccugggggccugagag

SEQ ID NO: 1868034 - RNA, 19 nt, Homo sapiens
ugugauaagaaaagccagu

SEQ ID NO: 1868035 - RNA, 12 nt, Homo sapiens
uggccucugaua

SEQ ID NO: 1868036 - RNA, 13 nt, Homo sapiens
uuuaagguacuga

SEQ ID NO: 1868037 - RNA, 15 nt, Homo sapiens
caguuguuccaggga

SEQ ID NO: 1868038 - RNA, 22 nt, Homo sapiens
cagcuuuugauugaaaguccua

SEQ ID NO: 1868039 - RNA, 21 nt, Homo sapiens
gaucuaaaaggaggacaggga

SEQ ID NO: 1868040 - RNA, 19 nt, Homo sapiens
auuugauaccauggcacug

SEQ ID NO: 1868041 - RNA, 23 nt, Homo sapiens
aaucagccauaagaaagcacuau

SEQ ID NO: 1868042 - RNA, 20 nt, Homo sapiens
ucccaccucagcuucucaaa

SEQ ID NO: 1868043 - RNA, 12 nt, Homo sapiens
cagacacauuca

SEQ ID NO: 1868044 - RNA, 16 nt, Homo sapiens
gacuguucaagcaaaa

SEQ ID NO: 1868045 - RNA, 12 nt, Homo sapiens
uucaucaggggc

SEQ ID NO: 1868046 - RNA, 21 nt, Homo sapiens
gcacaagcagggcacucuguu

SEQ ID NO: 1868047 - RNA, 14 nt, Homo sapiens
ucuccaaugugcuu

SEQ ID NO: 1868048 - RNA, 19 nt, Homo sapiens
caacaucagcucugugcca

SEQ ID NO: 1868049 - RNA, 18 nt, Homo sapiens
uuuugccagccuguucuc

SEQ ID NO: 1868050 - RNA, 16 nt, Homo sapiens
aaugcuugaaaccaga

SEQ ID NO: 1868051 - RNA, 24 nt, Homo sapiens
aauaggagaggaugagagcccaga

SEQ ID NO: 1868052 - RNA, 21 nt, Homo sapiens
cuuuaaugauaaaaucccauu

SEQ ID NO: 1868053 - RNA, 13 nt, Homo sapiens
gaagcuguugcua

SEQ ID NO: 1868054 - RNA, 14 nt, Homo sapiens
agaagaguuugcaa

SEQ ID NO: 1868055 - RNA, 15 nt, Homo sapiens
aauauuuaaugaugu

SEQ ID NO: 1868056 - RNA, 18 nt, Homo sapiens
gaggaugggucagagcua

SEQ ID NO: 1868057 - RNA, 13 nt, Homo sapiens
ccuguguugacac

SEQ ID NO: 1868058 - RNA, 18 nt, Homo sapiens
aauguuugucucauccca

SEQ ID NO: 1868059 - RNA, 19 nt, Homo sapiens
ugcuuuucggaacacuaaa

SEQ ID NO: 1868060 - RNA, 16 nt, Homo sapiens
uuuagccagaauguuu

SEQ ID NO: 1868061 - RNA, 16 nt, Homo sapiens
acaagccugaguccag

SEQ ID NO: 1868062 - RNA, 19 nt, Homo sapiens
aaugccuuucaaacauuga

SEQ ID NO: 1868063 - RNA, 19 nt, Homo sapiens
uggccaggcuggucucaaa

SEQ ID NO: 1868064 - RNA, 12 nt, Homo sapiens
gauauaauacua

SEQ ID NO: 1868065 - RNA, 13 nt, Homo sapiens
guuccaugcagcc

SEQ ID NO: 1868066 - RNA, 22 nt, Homo sapiens
augucuugcuguugacauauuu

SEQ ID NO: 1868067 - RNA, 14 nt, Homo sapiens
agccugggugacaa

SEQ ID NO: 1868068 - RNA, 17 nt, Homo sapiens
acugggcgucugacucc

SEQ ID NO: 1868069 - RNA, 16 nt, Homo sapiens
ggcaucuggaaagggg

SEQ ID NO: 1868070 - RNA, 21 nt, Homo sapiens
gaaagauugauuaaugaacua

SEQ ID NO: 1868071 - RNA, 14 nt, Homo sapiens
uaaauaaauaucuc

SEQ ID NO: 1868072 - RNA, 15 nt, Homo sapiens
ggagcucacaccgca

SEQ ID NO: 1868073 - RNA, 16 nt, Homo sapiens
uacuauuaacucugca

SEQ ID NO: 1868074 - RNA, 21 nt, Homo sapiens
uccuuuguauucugucuucau

SEQ ID NO: 1868075 - RNA, 13 nt, Homo sapiens
ucagagcacuccc

SEQ ID NO: 1868076 - RNA, 14 nt, Homo sapiens
aguuccucccagga

SEQ ID NO: 1868077 - RNA, 21 nt, Homo sapiens
gagugacagagcgagacucca

SEQ ID NO: 1868078 - RNA, 20 nt, Homo sapiens
uccagcaauuccugagccaa

SEQ ID NO: 1868079 - RNA, 15 nt, Homo sapiens
agauaauuguuucau

SEQ ID NO: 1868080 - RNA, 13 nt, Homo sapiens
gagccaccguguc

SEQ ID NO: 1868081 - RNA, 19 nt, Homo sapiens
uacauuagucauucaauaa

SEQ ID NO: 1868082 - RNA, 20 nt, Homo sapiens
uguucucauggagaagacuu

SEQ ID NO: 1868083 - RNA, 12 nt, Homo sapiens
aacucuucucau

SEQ ID NO: 1868084 - RNA, 17 nt, Homo sapiens
gggaaugggacugugag

SEQ ID NO: 1868085 - RNA, 20 nt, Homo sapiens
gagacacagcccccacggac

SEQ ID NO: 1868086 - RNA, 19 nt, Homo sapiens
cugaguaagcccucaggag

SEQ ID NO: 1868087 - RNA, 18 nt, Homo sapiens
auaaagccaaauuuccag

SEQ ID NO: 1868088 - RNA, 13 nt, Homo sapiens
uaaagcuacugua

SEQ ID NO: 1868089 - RNA, 15 nt, Homo sapiens
ucaagagacugaguc

SEQ ID NO: 1868090 - RNA, 21 nt, Homo sapiens
ucuaacagaucagaacaugaa

SEQ ID NO: 1868091 - RNA, 21 nt, Homo sapiens
accacacacacaaggugcuca

SEQ ID NO: 1868092 - RNA, 21 nt, Homo sapiens
cccggacucaccaacuugcca

SEQ ID NO: 1868093 - RNA, 19 nt, Homo sapiens
uaacacuggcuucaggcaa

SEQ ID NO: 1868094 - RNA, 21 nt, Homo sapiens
cagaauaaauggguaacacug

SEQ ID NO: 1868095 - RNA, 16 nt, Homo sapiens
ugcggaagccaaaggc

SEQ ID NO: 1868096 - RNA, 16 nt, Homo sapiens
ucuauaaacaugaagg

SEQ ID NO: 1868097 - RNA, 22 nt, Homo sapiens
aagaaacuuauuucucauauca

SEQ ID NO: 1868098 - RNA, 17 nt, Homo sapiens
caguuaggcagugcagu

SEQ ID NO: 1868099 - RNA, 20 nt, Homo sapiens
guaaguaccacucaggccaa

SEQ ID NO: 1868100 - RNA, 12 nt, Homo sapiens
cauggagcucuu

SEQ ID NO: 1868101 - RNA, 13 nt, Homo sapiens
gccauuugugaua

SEQ ID NO: 1868102 - RNA, 19 nt, Homo sapiens
cuccuaccugucuucuggc

SEQ ID NO: 1868103 - RNA, 14 nt, Homo sapiens
agacggagucucag

SEQ ID NO: 1868104 - RNA, 15 nt, Homo sapiens
aucuaugcagaacag

SEQ ID NO: 1868105 - RNA, 16 nt, Homo sapiens
ugcacucuuguacaaa

SEQ ID NO: 1868106 - RNA, 15 nt, Homo sapiens
ucucuggcuggucuu

SEQ ID NO: 1868107 - RNA, 11 nt, Homo sapiens
cgcaucucaau

SEQ ID NO: 1868108 - RNA, 23 nt, Homo sapiens
cuagggcccuuucuugcacuguc

SEQ ID NO: 1868109 - RNA, 21 nt, Homo sapiens
caguuucagguagaggugcau

SEQ ID NO: 1868110 - RNA, 19 nt, Homo sapiens
gucuugacucauggcagcu

SEQ ID NO: 1868111 - RNA, 21 nt, Homo sapiens
ugggaaagacccuaggugcuc

SEQ ID NO: 1868112 - RNA, 17 nt, Homo sapiens
gaucuugccacauuucu

SEQ ID NO: 1868113 - RNA, 15 nt, Homo sapiens
uguggucccagauac

SEQ ID NO: 1868114 - RNA, 15 nt, Homo sapiens
guagucccagcacuu

SEQ ID NO: 1868115 - RNA, 20 nt, Homo sapiens
uccaccuagagcuagaugug

SEQ ID NO: 1868116 - RNA, 18 nt, Homo sapiens
ccaagagcagcugccauu

SEQ ID NO: 1868117 - RNA, 15 nt, Homo sapiens
ggccagugcugugag

SEQ ID NO: 1868118 - RNA, 15 nt, Homo sapiens
caaagcuuuccugcc

SEQ ID NO: 1868119 - RNA, 16 nt, Homo sapiens
auuuacuaugccacag

SEQ ID NO: 1868120 - RNA, 15 nt, Homo sapiens
caauuauuggcaaag

SEQ ID NO: 1868121 - RNA, 19 nt, Homo sapiens
uaacucuccuccauguugc

SEQ ID NO: 1868122 - RNA, 13 nt, Homo sapiens
agccacaaaauac

SEQ ID NO: 1868123 - RNA, 16 nt, Homo sapiens
gcagagaccaccacau

SEQ ID NO: 1868124 - RNA, 20 nt, Homo sapiens
cccgcugcgcugcccugcaa

SEQ ID NO: 1868125 - RNA, 16 nt, Homo sapiens
gaaauauaauucuguu

SEQ ID NO: 1868126 - RNA, 16 nt, Homo sapiens
aaaugcuuacagggcu

SEQ ID NO: 1868127 - RNA, 17 nt, Homo sapiens
uaguguauaccaccugu

SEQ ID NO: 1868128 - RNA, 16 nt, Homo sapiens
acuuacacaucuucca

SEQ ID NO: 1868129 - RNA, 16 nt, Homo sapiens
ccagauguuggaccaa

SEQ ID NO: 1868130 - RNA, 22 nt, Homo sapiens
aacuugcagaauugagagugau

SEQ ID NO: 1868131 - RNA, 22 nt, Homo sapiens
caacuuaaaucacugaggcauu

SEQ ID NO: 1868132 - RNA, 11 nt, Homo sapiens
aaaguauuuac

SEQ ID NO: 1868133 - RNA, 12 nt, Homo sapiens
uuuucuaauaau

SEQ ID NO: 1868134 - RNA, 21 nt, Homo sapiens
cguauuuggcacacagcagag

SEQ ID NO: 1868135 - RNA, 21 nt, Homo sapiens
cuugcugacaauaaagauauu

SEQ ID NO: 1868136 - RNA, 13 nt, Homo sapiens
cguuuaagacugu

SEQ ID NO: 1868137 - RNA, 18 nt, Homo sapiens
ugaaaaauuccacucaaa

SEQ ID NO: 1868138 - RNA, 14 nt, Homo sapiens
gccgggacuggggg

SEQ ID NO: 1868139 - RNA, 22 nt, Homo sapiens
cagaucaagaaaaaaagggaga

SEQ ID NO: 1868140 - RNA, 16 nt, Homo sapiens
auuccucuaauguugu

SEQ ID NO: 1868141 - RNA, 18 nt, Homo sapiens
auggaagcaaagacaaaa

SEQ ID NO: 1868142 - RNA, 12 nt, Homo sapiens
gagauguccaaa

SEQ ID NO: 1868143 - RNA, 16 nt, Homo sapiens
ucaagaggcagaguuc

SEQ ID NO: 1868144 - RNA, 19 nt, Homo sapiens
acuuaaagcuacuguagaa

SEQ ID NO: 1868145 - RNA, 20 nt, Homo sapiens
uguguacugaguauugauaa

SEQ ID NO: 1868146 - RNA, 19 nt, Homo sapiens
agcuuuccucaucaggcca

SEQ ID NO: 1868147 - RNA, 16 nt, Homo sapiens
aacuaaugaguaugaa

SEQ ID NO: 1868148 - RNA, 15 nt, Homo sapiens
uuaucaaaaaacaga

SEQ ID NO: 1868149 - RNA, 12 nt, Homo sapiens
agcugucuugga

SEQ ID NO: 1868150 - RNA, 19 nt, Homo sapiens
aguucuuugggccagacau

SEQ ID NO: 1868151 - RNA, 21 nt, Homo sapiens
uggugacagccuugggccuuu

SEQ ID NO: 1868152 - RNA, 11 nt, Homo sapiens
uaaacaggguc

SEQ ID NO: 1868153 - RNA, 15 nt, Homo sapiens
uauuuuuucuacaca

SEQ ID NO: 1868154 - RNA, 17 nt, Homo sapiens
uccuuccaauauaacua

SEQ ID NO: 1868155 - RNA, 18 nt, Homo sapiens
cagccccuccucccucaa

SEQ ID NO: 1868156 - RNA, 16 nt, Homo sapiens
agacagagcagaucag

SEQ ID NO: 1868157 - RNA, 15 nt, Homo sapiens
auauuaaaccuucag

SEQ ID NO: 1868158 - RNA, 21 nt, Homo sapiens
aaauuugggggacuuacauga

SEQ ID NO: 1868159 - RNA, 16 nt, Homo sapiens
cucagcccuuccccau

SEQ ID NO: 1868160 - RNA, 20 nt, Homo sapiens
gaacuugcaauaccaauguu

SEQ ID NO: 1868161 - RNA, 15 nt, Homo sapiens
aaugucauugcuaaa

SEQ ID NO: 1868162 - RNA, 13 nt, Homo sapiens
caccccugcaguu

SEQ ID NO: 1868163 - RNA, 14 nt, Homo sapiens
cuuguagaugcauu

SEQ ID NO: 1868164 - RNA, 20 nt, Homo sapiens
cuugcacaggccacuugcuc

SEQ ID NO: 1868165 - RNA, 23 nt, Homo sapiens
acuuaaauauuguaauaugacag

SEQ ID NO: 1868166 - RNA, 17 nt, Homo sapiens
acuucauauguaaucuc

SEQ ID NO: 1868167 - RNA, 13 nt, Homo sapiens
uggcgaagcucag

SEQ ID NO: 1868168 - RNA, 17 nt, Homo sapiens
ugucacuagucucacca

SEQ ID NO: 1868169 - RNA, 17 nt, Homo sapiens
uuguuuaacauugcuga

SEQ ID NO: 1868170 - RNA, 14 nt, Homo sapiens
cuguuaccaaaucu

SEQ ID NO: 1868171 - RNA, 15 nt, Homo sapiens
aaaacuucuugucag

SEQ ID NO: 1868172 - RNA, 22 nt, Homo sapiens
ucuggugguguuaaucauuuca

SEQ ID NO: 1868173 - RNA, 16 nt, Homo sapiens
cguuuggccagugaca

SEQ ID NO: 1868174 - RNA, 21 nt, Homo sapiens
cuaaauaauguuaucugugua

SEQ ID NO: 1868175 - RNA, 12 nt, Homo sapiens
gaaacucaccac

SEQ ID NO: 1868176 - RNA, 20 nt, Homo sapiens
agcagcccuggcauguuccu

SEQ ID NO: 1868177 - RNA, 17 nt, Homo sapiens
cuuaaaauauauuucag

SEQ ID NO: 1868178 - RNA, 23 nt, Homo sapiens
uuaggaaagcagugcaguacuca

SEQ ID NO: 1868179 - RNA, 22 nt, Homo sapiens
ucgucuuucccuuuaccacugu

SEQ ID NO: 1868180 - RNA, 19 nt, Homo sapiens
cacgauggagagagccuua

SEQ ID NO: 1868181 - RNA, 22 nt, Homo sapiens
uaauacuccagagacagggaaa

SEQ ID NO: 1868182 - RNA, 13 nt, Homo sapiens
cuuuuaacagugu

SEQ ID NO: 1868183 - RNA, 16 nt, Homo sapiens
agacuuuaucaugugu

SEQ ID NO: 1868184 - RNA, 16 nt, Homo sapiens
guccugaccugucuca

SEQ ID NO: 1868185 - RNA, 17 nt, Homo sapiens
agccaagaaacacuuuc

SEQ ID NO: 1868186 - RNA, 21 nt, Homo sapiens
cguauucuaauucuucauuau

SEQ ID NO: 1868187 - RNA, 15 nt, Homo sapiens
gaagucguuucagga

SEQ ID NO: 1868188 - RNA, 10 nt, Homo sapiens
gcugccaaau

SEQ ID NO: 1868189 - RNA, 17 nt, Homo sapiens
uggagcccgaagcucuu

SEQ ID NO: 1868190 - RNA, 19 nt, Homo sapiens
acucgcccgcccacugucc

SEQ ID NO: 1868191 - RNA, 16 nt, Homo sapiens
cuuggaaucgucccua

SEQ ID NO: 1868192 - RNA, 13 nt, Homo sapiens
gacugcugcugaa

SEQ ID NO: 1868193 - RNA, 19 nt, Homo sapiens
uaugcaccaaaucaucucu

SEQ ID NO: 1868194 - RNA, 15 nt, Homo sapiens
ggauauuuucuucca

SEQ ID NO: 1868195 - RNA, 23 nt, Homo sapiens
gucuguauauaacuuauuugccc

SEQ ID NO: 1868196 - RNA, 21 nt, Homo sapiens
caguacuuguuucuaugcaga

SEQ ID NO: 1868197 - RNA, 13 nt, Homo sapiens
uaguuaacuauga

SEQ ID NO: 1868198 - RNA, 13 nt, Homo sapiens
uguucuguucugg

SEQ ID NO: 1868199 - RNA, 13 nt, Homo sapiens
uauauaguccugu

SEQ ID NO: 1868200 - RNA, 22 nt, Homo sapiens
ugccucagccucccaaagugcu

SEQ ID NO: 1868201 - RNA, 20 nt, Homo sapiens
aaauacauguguauauuccu

SEQ ID NO: 1868202 - RNA, 22 nt, Homo sapiens
caguaacggaacaguauccagu

SEQ ID NO: 1868203 - RNA, 12 nt, Homo sapiens
gcaaaugaauca

SEQ ID NO: 1868204 - RNA, 17 nt, Homo sapiens
caagcccuguugacaca

SEQ ID NO: 1868205 - RNA, 15 nt, Homo sapiens
caggggcaugggaag

SEQ ID NO: 1868206 - RNA, 23 nt, Homo sapiens
ugcuucagaguuuguguguauuu

SEQ ID NO: 1868207 - RNA, 15 nt, Homo sapiens
gcccuaauucaucuu

SEQ ID NO: 1868208 - RNA, 23 nt, Homo sapiens
aauuccaguggaacagucuuccc

SEQ ID NO: 1868209 - RNA, 19 nt, Homo sapiens
ggaggagggcucagggagc

SEQ ID NO: 1868210 - RNA, 18 nt, Homo sapiens
guauucagagucucugau

SEQ ID NO: 1868211 - RNA, 16 nt, Homo sapiens
ccucaucuuucuucca

SEQ ID NO: 1868212 - RNA, 18 nt, Homo sapiens
gagcuguucgcuccuccc

SEQ ID NO: 1868213 - RNA, 18 nt, Homo sapiens
gacaagggcugcuuccag

SEQ ID NO: 1868214 - RNA, 14 nt, Homo sapiens
cauuaacucaggca

SEQ ID NO: 1868215 - RNA, 15 nt, Homo sapiens
uggggagagcuggca

SEQ ID NO: 1868216 - RNA, 13 nt, Homo sapiens
uccucacuuuuau

SEQ ID NO: 1868217 - RNA, 17 nt, Homo sapiens
gccaguggagcuggucu

SEQ ID NO: 1868218 - RNA, 19 nt, Homo sapiens
cgugugcccacugaacaug

SEQ ID NO: 1868219 - RNA, 19 nt, Homo sapiens
uugaauuugccuuccucau

SEQ ID NO: 1868220 - RNA, 14 nt, Homo sapiens
ccaugaaggcaccu

SEQ ID NO: 1868221 - RNA, 20 nt, Homo sapiens
cauugcacucuagccuggca

SEQ ID NO: 1868222 - RNA, 21 nt, Homo sapiens
uuuaugucaucauacaugacu

SEQ ID NO: 1868223 - RNA, 18 nt, Homo sapiens
aucaggaauauuuuccaa

SEQ ID NO: 1868224 - RNA, 15 nt, Homo sapiens
caggacaguauuccu

SEQ ID NO: 1868225 - RNA, 15 nt, Homo sapiens
aggagaggguggcau

SEQ ID NO: 1868226 - RNA, 13 nt, Homo sapiens
gcccugauuugcu

SEQ ID NO: 1868227 - RNA, 13 nt, Homo sapiens
uaucaaaugaaua

SEQ ID NO: 1868228 - RNA, 15 nt, Homo sapiens
caaauuuuagauuua

SEQ ID NO: 1868229 - RNA, 21 nt, Homo sapiens
cccagccaggcuaugguugcc

SEQ ID NO: 1868230 - RNA, 13 nt, Homo sapiens
acagcugcuucuc

SEQ ID NO: 1868231 - RNA, 17 nt, Homo sapiens
ccuuguuuagcauauaa

SEQ ID NO: 1868232 - RNA, 21 nt, Homo sapiens
uucugaauuuguagacauacu

SEQ ID NO: 1868233 - RNA, 16 nt, Homo sapiens
ggaaagaugaugcaag

SEQ ID NO: 1868234 - RNA, 18 nt, Homo sapiens
aagugcauuuguaauuca

SEQ ID NO: 1868235 - RNA, 15 nt, Homo sapiens
acccaggaguccagc

SEQ ID NO: 1868236 - RNA, 17 nt, Homo sapiens
ccuugugguuuauguca

SEQ ID NO: 1868237 - RNA, 22 nt, Homo sapiens
uguaacuuuauuggucuugccc

SEQ ID NO: 1868238 - RNA, 13 nt, Homo sapiens
uucguuccaggcc

SEQ ID NO: 1868239 - RNA, 19 nt, Homo sapiens
ccuacucugagacaaaaga

SEQ ID NO: 1868240 - RNA, 22 nt, Homo sapiens
ggagacacccucuggggguccu

SEQ ID NO: 1868241 - RNA, 17 nt, Homo sapiens
uccuuaggccucugaga

SEQ ID NO: 1868242 - RNA, 23 nt, Homo sapiens
aucauuuuacucuuaugaucaau

SEQ ID NO: 1868243 - RNA, 23 nt, Homo sapiens
cucaggccucucuacaagcagca

SEQ ID NO: 1868244 - RNA, 18 nt, Homo sapiens
cgugggauugaauuaaaa

SEQ ID NO: 1868245 - RNA, 12 nt, Homo sapiens
uuguuguucaga

SEQ ID NO: 1868246 - RNA, 12 nt, Homo sapiens
uucauguucacu

SEQ ID NO: 1868247 - RNA, 22 nt, Homo sapiens
auggaagcaccuaaaugaugcc

SEQ ID NO: 1868248 - RNA, 17 nt, Homo sapiens
cuccacagucaauauua

SEQ ID NO: 1868249 - RNA, 23 nt, Homo sapiens
uuggaaagcaucaccucaggcca

SEQ ID NO: 1868250 - RNA, 17 nt, Homo sapiens
uuccccuuuuucuuucc

SEQ ID NO: 1868251 - RNA, 17 nt, Homo sapiens
gugcuguggccugggca

SEQ ID NO: 1868252 - RNA, 16 nt, Homo sapiens
auaugcacacacagau

SEQ ID NO: 1868253 - RNA, 23 nt, Homo sapiens
gcguaaugcgccaauaaaccaau

SEQ ID NO: 1868254 - RNA, 22 nt, Homo sapiens
caggcaagcccggguucuaccc

SEQ ID NO: 1868255 - RNA, 15 nt, Homo sapiens
acugucaguuguacu

SEQ ID NO: 1868256 - RNA, 14 nt, Homo sapiens
aaaguucugggacu

SEQ ID NO: 1868257 - RNA, 18 nt, Homo sapiens
caagucaccaugcugaau

SEQ ID NO: 1868258 - RNA, 14 nt, Homo sapiens
cuugcaaucuaauc

SEQ ID NO: 1868259 - RNA, 15 nt, Homo sapiens
uuccugccacugugu

SEQ ID NO: 1868260 - RNA, 24 nt, Homo sapiens
cccagccacaguggccaaagaggc

SEQ ID NO: 1868261 - RNA, 21 nt, Homo sapiens
acgacuggucaccuugcacuc

SEQ ID NO: 1868262 - RNA, 15 nt, Homo sapiens
cuccugccgcaguga

SEQ ID NO: 1868263 - RNA, 20 nt, Homo sapiens
cuauuugaaacacacaguga

SEQ ID NO: 1868264 - RNA, 18 nt, Homo sapiens
cauuaacaaaaauauuag

SEQ ID NO: 1868265 - RNA, 23 nt, Homo sapiens
acuagaacgcuucgggaaaauau

SEQ ID NO: 1868266 - RNA, 20 nt, Homo sapiens
cgggucuugauucagucaca

SEQ ID NO: 1868267 - RNA, 15 nt, Homo sapiens
uuauucccccaaagc

SEQ ID NO: 1868268 - RNA, 19 nt, Homo sapiens
caguuguacuucugcucca

SEQ ID NO: 1868269 - RNA, 18 nt, Homo sapiens
acucaguggacacucaga

SEQ ID NO: 1868270 - RNA, 23 nt, Homo sapiens
aaaauacuguuucacuaauacuu

SEQ ID NO: 1868271 - RNA, 21 nt, Homo sapiens
uucccauguugacugucuuga

SEQ ID NO: 1868272 - RNA, 17 nt, Homo sapiens
uucccauuugugccaga

SEQ ID NO: 1868273 - RNA, 13 nt, Homo sapiens
agcuccccuagac

SEQ ID NO: 1868274 - RNA, 22 nt, Homo sapiens
cguccauguuuauccauguacu

SEQ ID NO: 1868275 - RNA, 22 nt, Homo sapiens
auguugauucuagguugaaaau

SEQ ID NO: 1868276 - RNA, 18 nt, Homo sapiens
aacuuugcuuaaacuaca

SEQ ID NO: 1868277 - RNA, 19 nt, Homo sapiens
auuuugcuaacugguuaaa

SEQ ID NO: 1868278 - RNA, 15 nt, Homo sapiens
uuacaaccacagaaa

SEQ ID NO: 1868279 - RNA, 23 nt, Homo sapiens
uaaaagauggugaacugugagua

SEQ ID NO: 1868280 - RNA, 13 nt, Homo sapiens
gaaauacuuaaca

SEQ ID NO: 1868281 - RNA, 15 nt, Homo sapiens
uuagcugcucacuua

SEQ ID NO: 1868282 - RNA, 22 nt, Homo sapiens
gcaggcaguucuagaagccaca

SEQ ID NO: 1868283 - RNA, 22 nt, Homo sapiens
uggcccaagugguuugugcuaa

SEQ ID NO: 1868284 - RNA, 18 nt, Homo sapiens
cuaucaaucaccuugcau

SEQ ID NO: 1868285 - RNA, 23 nt, Homo sapiens
ccaugauacuuuaauuuuuauaa

SEQ ID NO: 1868286 - RNA, 21 nt, Homo sapiens
aggggacugcaugcaagcuca

SEQ ID NO: 1868287 - RNA, 22 nt, Homo sapiens
aggagcaaauguuucugcagua

SEQ ID NO: 1868288 - RNA, 17 nt, Homo sapiens
caugaccacauagcaug

SEQ ID NO: 1868289 - RNA, 19 nt, Homo sapiens
aagagaugucaaaauguga

SEQ ID NO: 1868290 - RNA, 19 nt, Homo sapiens
acauacacaagugcacaga

SEQ ID NO: 1868291 - RNA, 19 nt, Homo sapiens
aguguuuuggaggccugac

SEQ ID NO: 1868292 - RNA, 15 nt, Homo sapiens
accgagggaagggcu

SEQ ID NO: 1868293 - RNA, 22 nt, Homo sapiens
uacagugagggcuauacauggu

SEQ ID NO: 1868294 - RNA, 21 nt, Homo sapiens
aucaggugcauagcaagugaa

SEQ ID NO: 1868295 - RNA, 22 nt, Homo sapiens
cagugaguuggggcgacuguga

SEQ ID NO: 1868296 - RNA, 22 nt, Homo sapiens
cuccuaaccucaagugauccuc

SEQ ID NO: 1868297 - RNA, 17 nt, Homo sapiens
ccauccucccaaucuca

SEQ ID NO: 1868298 - RNA, 22 nt, Homo sapiens
auuaauuuuccaaugcacaguu

SEQ ID NO: 1868299 - RNA, 20 nt, Homo sapiens
caauuauagugucaugcaga

SEQ ID NO: 1868300 - RNA, 18 nt, Homo sapiens
gaagaauuuaucucuuua

SEQ ID NO: 1868301 - RNA, 18 nt, Homo sapiens
cugauauuggacaguaaa

SEQ ID NO: 1868302 - RNA, 19 nt, Homo sapiens
ugggcauuuuucuuacuuu

SEQ ID NO: 1868303 - RNA, 19 nt, Homo sapiens
uuuagcuuugacaguucuu

SEQ ID NO: 1868304 - RNA, 13 nt, Homo sapiens
ugaggugguacua

SEQ ID NO: 1868305 - RNA, 15 nt, Homo sapiens
agugaagacuucuug

SEQ ID NO: 1868306 - RNA, 16 nt, Homo sapiens
gccugucuagcucaua

SEQ ID NO: 1868307 - RNA, 19 nt, Homo sapiens
aguuaagacaacaggcauu

SEQ ID NO: 1868308 - RNA, 13 nt, Homo sapiens
auuguaagcauuc

SEQ ID NO: 1868309 - RNA, 21 nt, Homo sapiens
augauuuuguaaaaguggcau

SEQ ID NO: 1868310 - RNA, 14 nt, Homo sapiens
uggaauacucuuau

SEQ ID NO: 1868311 - RNA, 17 nt, Homo sapiens
ucucgaagcaguauucu

SEQ ID NO: 1868312 - RNA, 22 nt, Homo sapiens
gcucuacuaccuacguuugcac

SEQ ID NO: 1868313 - RNA, 18 nt, Homo sapiens
ucagccuggcugauuauc

SEQ ID NO: 1868314 - RNA, 20 nt, Homo sapiens
gauugcaaagggacauugaa

SEQ ID NO: 1868315 - RNA, 15 nt, Homo sapiens
cuauucaguuuucag

SEQ ID NO: 1868316 - RNA, 17 nt, Homo sapiens
cugaaguuugcauuaau

SEQ ID NO: 1868317 - RNA, 18 nt, Homo sapiens
acgugauuuugcuguaga

SEQ ID NO: 1868318 - RNA, 12 nt, Homo sapiens
caaaugagccac

SEQ ID NO: 1868319 - RNA, 20 nt, Homo sapiens
uccuuugguuaguguacuuu

SEQ ID NO: 1868320 - RNA, 15 nt, Homo sapiens
aaauaacaggcauuu

SEQ ID NO: 1868321 - RNA, 14 nt, Homo sapiens
acuccuggccucac

SEQ ID NO: 1868322 - RNA, 12 nt, Homo sapiens
gcacugucaugc

SEQ ID NO: 1868323 - RNA, 14 nt, Homo sapiens
agcugagaugagcc

SEQ ID NO: 1868324 - RNA, 18 nt, Homo sapiens
cuaaacuccuuuccugca

SEQ ID NO: 1868325 - RNA, 23 nt, Homo sapiens
aguaacagugaaguacucaguaa

SEQ ID NO: 1868326 - RNA, 17 nt, Homo sapiens
caccugaaugugucugc

SEQ ID NO: 1868327 - RNA, 21 nt, Homo sapiens
acucaucuuuauccuaaaaau

SEQ ID NO: 1868328 - RNA, 15 nt, Homo sapiens
agagcuuagauuucc

SEQ ID NO: 1868329 - RNA, 19 nt, Homo sapiens
aguaauugucaauaccccu

SEQ ID NO: 1868330 - RNA, 20 nt, Homo sapiens
uggcaauauaaggggaugag

SEQ ID NO: 1868331 - RNA, 22 nt, Homo sapiens
aagaauacacugugacuuaaga

SEQ ID NO: 1868332 - RNA, 23 nt, Homo sapiens
cugccccaucuccccucagcucg

SEQ ID NO: 1868333 - RNA, 21 nt, Homo sapiens
aaauaguaccuucaauacuua

SEQ ID NO: 1868334 - RNA, 17 nt, Homo sapiens
uuacacacaugagggcu

SEQ ID NO: 1868335 - RNA, 15 nt, Homo sapiens
ucauccugauacugu

SEQ ID NO: 1868336 - RNA, 14 nt, Homo sapiens
ugggucccagcuaa

SEQ ID NO: 1868337 - RNA, 20 nt, Homo sapiens
caugugcggcugaacugaga

SEQ ID NO: 1868338 - RNA, 18 nt, Homo sapiens
agcugagccuucugauga

SEQ ID NO: 1868339 - RNA, 22 nt, Homo sapiens
caaccuccccugguccugcacu

SEQ ID NO: 1868340 - RNA, 19 nt, Homo sapiens
agaaugguguuugcaagug

SEQ ID NO: 1868341 - RNA, 15 nt, Homo sapiens
uaggaaccuaugaaa

SEQ ID NO: 1868342 - RNA, 21 nt, Homo sapiens
guuucuuccagcagaacagag

SEQ ID NO: 1868343 - RNA, 23 nt, Homo sapiens
cagggagggagggcgguggacaa

SEQ ID NO: 1868344 - RNA, 14 nt, Homo sapiens
ugcagcaugugccu

SEQ ID NO: 1868345 - RNA, 22 nt, Homo sapiens
ugccaaaauaccagagccuuca

SEQ ID NO: 1868346 - RNA, 21 nt, Homo sapiens
aggaauucgagaccagccuga

SEQ ID NO: 1868347 - RNA, 15 nt, Homo sapiens
auugugcaguacuuu

SEQ ID NO: 1868348 - RNA, 21 nt, Homo sapiens
guauauauucuacacauauau

SEQ ID NO: 1868349 - RNA, 17 nt, Homo sapiens
uccugaaguugcugcug

SEQ ID NO: 1868350 - RNA, 15 nt, Homo sapiens
caccuggggcugcug

SEQ ID NO: 1868351 - RNA, 17 nt, Homo sapiens
uuaaaucaggaaauaca

SEQ ID NO: 1868352 - RNA, 14 nt, Homo sapiens
uccccaaggacucu

SEQ ID NO: 1868353 - RNA, 16 nt, Homo sapiens
caauggcgugaucuca

SEQ ID NO: 1868354 - RNA, 21 nt, Homo sapiens
uuuugaccaaaaaaauugugc

SEQ ID NO: 1868355 - RNA, 20 nt, Homo sapiens
ccugguuugacucaguucca

SEQ ID NO: 1868356 - RNA, 18 nt, Homo sapiens
agccccuagaaacccaag

SEQ ID NO: 1868357 - RNA, 22 nt, Homo sapiens
accacgaagcugugaacucaga

SEQ ID NO: 1868358 - RNA, 19 nt, Homo sapiens
aacuaaacuuuacuaggua

SEQ ID NO: 1868359 - RNA, 23 nt, Homo sapiens
uuccucauuagcauuuugcuaaa

SEQ ID NO: 1868360 - RNA, 15 nt, Homo sapiens
gcaggcuagaaccug

SEQ ID NO: 1868361 - RNA, 17 nt, Homo sapiens
acuccuccuaguacuaa

SEQ ID NO: 1868362 - RNA, 20 nt, Homo sapiens
ccccuugguauaacugauuu

SEQ ID NO: 1868363 - RNA, 21 nt, Homo sapiens
gaaugugugccuuguucaagg

SEQ ID NO: 1868364 - RNA, 18 nt, Homo sapiens
cuccuuucccaacacuuc

SEQ ID NO: 1868365 - RNA, 16 nt, Homo sapiens
ucuaaggaaugaucca

SEQ ID NO: 1868366 - RNA, 17 nt, Homo sapiens
gaggagguucacugagc

SEQ ID NO: 1868367 - RNA, 20 nt, Homo sapiens
agcuggggggcuguccugag

SEQ ID NO: 1868368 - RNA, 22 nt, Homo sapiens
gaaaaagcggugccccuauaca

SEQ ID NO: 1868369 - RNA, 15 nt, Homo sapiens
cccgggacucugcau

SEQ ID NO: 1868370 - RNA, 17 nt, Homo sapiens
cuccacuguuucaugag

SEQ ID NO: 1868371 - RNA, 21 nt, Homo sapiens
uaccauuugcuacuguacaua

SEQ ID NO: 1868372 - RNA, 22 nt, Homo sapiens
auguaauucagguaccacguau

SEQ ID NO: 1868373 - RNA, 20 nt, Homo sapiens
cuuuggacgcacacagcuuu

SEQ ID NO: 1868374 - RNA, 18 nt, Homo sapiens
uggaaggccuucuuucua

SEQ ID NO: 1868375 - RNA, 15 nt, Homo sapiens
uagcauuugccacuu

SEQ ID NO: 1868376 - RNA, 15 nt, Homo sapiens
uggaguugugaucau

SEQ ID NO: 1868377 - RNA, 18 nt, Homo sapiens
guggaaaaaaaaagaaua

SEQ ID NO: 1868378 - RNA, 15 nt, Homo sapiens
gagaaccucagauca

SEQ ID NO: 1868379 - RNA, 11 nt, Homo sapiens
cccuguacaau

SEQ ID NO: 1868380 - RNA, 13 nt, Homo sapiens
gccaaagugccug

SEQ ID NO: 1868381 - RNA, 23 nt, Homo sapiens
gaagaagauaugugaagaaaaau

SEQ ID NO: 1868382 - RNA, 19 nt, Homo sapiens
aacaugcugaaaacuacac

SEQ ID NO: 1868383 - RNA, 22 nt, Homo sapiens
gaggaggcucccacuggaucca

SEQ ID NO: 1868384 - RNA, 15 nt, Homo sapiens
ugaacagaaccuccc

SEQ ID NO: 1868385 - RNA, 16 nt, Homo sapiens
gcauaugcacagucaa

SEQ ID NO: 1868386 - RNA, 15 nt, Homo sapiens
uguucaguugacuua

SEQ ID NO: 1868387 - RNA, 16 nt, Homo sapiens
uagauauccuuggcac

SEQ ID NO: 1868388 - RNA, 18 nt, Homo sapiens
cauugccuuuucuagccc

SEQ ID NO: 1868389 - RNA, 16 nt, Homo sapiens
ucacugcuuguugaca

SEQ ID NO: 1868390 - RNA, 22 nt, Homo sapiens
cauguacuauggaaaaguacaa

SEQ ID NO: 1868391 - RNA, 15 nt, Homo sapiens
gcgcguccagcugcc

SEQ ID NO: 1868392 - RNA, 23 nt, Homo sapiens
accccuccucccuuuuuccuugu

SEQ ID NO: 1868393 - RNA, 19 nt, Homo sapiens
acuccacccuccuacaggu

SEQ ID NO: 1868394 - RNA, 13 nt, Homo sapiens
cccagcuacuuga

SEQ ID NO: 1868395 - RNA, 22 nt, Homo sapiens
gagaucguaccuauugcacucc

SEQ ID NO: 1868396 - RNA, 14 nt, Homo sapiens
aaggauagccucag

SEQ ID NO: 1868397 - RNA, 16 nt, Homo sapiens
guaaaaauaacauaau

SEQ ID NO: 1868398 - RNA, 18 nt, Homo sapiens
ucacugcaagcucugccu

SEQ ID NO: 1868399 - RNA, 16 nt, Homo sapiens
ugcucauauugugauu

SEQ ID NO: 1868400 - RNA, 22 nt, Homo sapiens
uucauuuccuacuucauuccag

SEQ ID NO: 1868401 - RNA, 17 nt, Homo sapiens
aagagaggaguucaaug

SEQ ID NO: 1868402 - RNA, 14 nt, Homo sapiens
cuuuucugccaaaa

SEQ ID NO: 1868403 - RNA, 13 nt, Homo sapiens
aaaacauuggcau

SEQ ID NO: 1868404 - RNA, 17 nt, Homo sapiens
cuucugcaacaucuuaa

SEQ ID NO: 1868405 - RNA, 22 nt, Homo sapiens
aucaugugugagauaacuuccu

SEQ ID NO: 1868406 - RNA, 16 nt, Homo sapiens
gaguucccacccaagc

SEQ ID NO: 1868407 - RNA, 20 nt, Homo sapiens
auaaauuuuuugaaacacaa

SEQ ID NO: 1868408 - RNA, 19 nt, Homo sapiens
uuuccuacaggcagucucu

SEQ ID NO: 1868409 - RNA, 16 nt, Homo sapiens
aacucacagcuucucc

SEQ ID NO: 1868410 - RNA, 14 nt, Homo sapiens
ccucuucugugguc

SEQ ID NO: 1868411 - RNA, 23 nt, Homo sapiens
acacagauuauguuccugcugua

SEQ ID NO: 1868412 - RNA, 16 nt, Homo sapiens
caacugauaauauuga

SEQ ID NO: 1868413 - RNA, 18 nt, Homo sapiens
caccccacacccaugugu

SEQ ID NO: 1868414 - RNA, 22 nt, Homo sapiens
gacacuucuuguguuaaacuaa

SEQ ID NO: 1868415 - RNA, 20 nt, Homo sapiens
acagguguagaccagagugu

SEQ ID NO: 1868416 - RNA, 19 nt, Homo sapiens
aacccagcggcucuagcca

SEQ ID NO: 1868417 - RNA, 21 nt, Homo sapiens
cacauugucaccccaagccau

SEQ ID NO: 1868418 - RNA, 17 nt, Homo sapiens
aauuggagaagauuuau

SEQ ID NO: 1868419 - RNA, 22 nt, Homo sapiens
uuaugccacagaauuugcuaau

SEQ ID NO: 1868420 - RNA, 20 nt, Homo sapiens
gcauuuuaaguaaaagucua

SEQ ID NO: 1868421 - RNA, 18 nt, Homo sapiens
ucuauuuuaaucuugcua

SEQ ID NO: 1868422 - RNA, 23 nt, Homo sapiens
ugagucugcuuucacugugacug

SEQ ID NO: 1868423 - RNA, 17 nt, Homo sapiens
uaaguuucaggugacau

SEQ ID NO: 1868424 - RNA, 15 nt, Homo sapiens
auuggaucagugaaa

SEQ ID NO: 1868425 - RNA, 23 nt, Homo sapiens
cuguaaaauggaggccauugugu

SEQ ID NO: 1868426 - RNA, 20 nt, Homo sapiens
aucugauuuccuaaugucag

SEQ ID NO: 1868427 - RNA, 17 nt, Homo sapiens
agccucugggugacaaa

SEQ ID NO: 1868428 - RNA, 15 nt, Homo sapiens
ggcuaaaaagcaaca

SEQ ID NO: 1868429 - RNA, 22 nt, Homo sapiens
uaagcaaacuauauuuuaauaa

SEQ ID NO: 1868430 - RNA, 22 nt, Homo sapiens
gaugccucuccccagagcauuu

SEQ ID NO: 1868431 - RNA, 16 nt, Homo sapiens
auccagcaucccaaga

SEQ ID NO: 1868432 - RNA, 15 nt, Homo sapiens
acuuuuaaaaugccc

SEQ ID NO: 1868433 - RNA, 20 nt, Homo sapiens
gaacuugcugcugagugcac

SEQ ID NO: 1868434 - RNA, 21 nt, Homo sapiens
cagggccugacuugagccacu

SEQ ID NO: 1868435 - RNA, 19 nt, Homo sapiens
cuguaggcacacuuugcac

SEQ ID NO: 1868436 - RNA, 13 nt, Homo sapiens
uuuacagcugugu

SEQ ID NO: 1868437 - RNA, 21 nt, Homo sapiens
uaagcuguguccuaguucuug

SEQ ID NO: 1868438 - RNA, 15 nt, Homo sapiens
cuguccuuccugacc

SEQ ID NO: 1868439 - RNA, 21 nt, Homo sapiens
cgcccacuugucccacuaucu

SEQ ID NO: 1868440 - RNA, 15 nt, Homo sapiens
uaacugaaccaaauu

SEQ ID NO: 1868441 - RNA, 13 nt, Homo sapiens
auuauuauuucca

SEQ ID NO: 1868442 - RNA, 13 nt, Homo sapiens
gacaacagacuga

SEQ ID NO: 1868443 - RNA, 13 nt, Homo sapiens
agcucuucuuccc

SEQ ID NO: 1868444 - RNA, 20 nt, Homo sapiens
gggccgcuguguuuggagac

SEQ ID NO: 1868445 - RNA, 14 nt, Homo sapiens
ucuguauauacuca

SEQ ID NO: 1868446 - RNA, 21 nt, Homo sapiens
aggaacugcuugugcacugga

SEQ ID NO: 1868447 - RNA, 23 nt, Homo sapiens
ugagcuccuuguuuuugccaaag

SEQ ID NO: 1868448 - RNA, 18 nt, Homo sapiens
uguaagugagagagacaa

SEQ ID NO: 1868449 - RNA, 22 nt, Homo sapiens
accaggaaggaaaaugugaaca

SEQ ID NO: 1868450 - RNA, 13 nt, Homo sapiens
aagauccucuugc

SEQ ID NO: 1868451 - RNA, 17 nt, Homo sapiens
aaacugcuccaaaccaa

SEQ ID NO: 1868452 - RNA, 22 nt, Homo sapiens
ccgggaagccacccucccagcu

SEQ ID NO: 1868453 - RNA, 19 nt, Homo sapiens
ucaguauuagaugcacuua

SEQ ID NO: 1868454 - RNA, 15 nt, Homo sapiens
ugaaauuuggcaaag

SEQ ID NO: 1868455 - RNA, 21 nt, Homo sapiens
guuuggccugugcuucugcuu

SEQ ID NO: 1868456 - RNA, 11 nt, Homo sapiens
auugagcucuc

SEQ ID NO: 1868457 - RNA, 13 nt, Homo sapiens
uaauuuugcuugc

SEQ ID NO: 1868458 - RNA, 20 nt, Homo sapiens
cagcagaagauuuucaagaa

SEQ ID NO: 1868459 - RNA, 19 nt, Homo sapiens
acaaguauauaauauguca

SEQ ID NO: 1868460 - RNA, 21 nt, Homo sapiens
aaugaccgcacguucucugcc

SEQ ID NO: 1868461 - RNA, 19 nt, Homo sapiens
ccgcagagccugacgcuca

SEQ ID NO: 1868462 - RNA, 16 nt, Homo sapiens
uauuaaacuugucaga

SEQ ID NO: 1868463 - RNA, 22 nt, Homo sapiens
caagcuuggcugucucaucccc

SEQ ID NO: 1868464 - RNA, 20 nt, Homo sapiens
aggggaacagaagaaaauaa

SEQ ID NO: 1868465 - RNA, 22 nt, Homo sapiens
ggcuaggaaagggaagccugac

SEQ ID NO: 1868466 - RNA, 13 nt, Homo sapiens
acgaccacagggu

SEQ ID NO: 1868467 - RNA, 19 nt, Homo sapiens
gaccacagagggcaggaac

SEQ ID NO: 1868468 - RNA, 20 nt, Homo sapiens
ucaaggcugacuacucacuu

SEQ ID NO: 1868469 - RNA, 14 nt, Homo sapiens
caugcuuuccauau

SEQ ID NO: 1868470 - RNA, 22 nt, Homo sapiens
ugucuuucucagaggacaauaa

SEQ ID NO: 1868471 - RNA, 18 nt, Homo sapiens
auccaucacccaucucac

SEQ ID NO: 1868472 - RNA, 23 nt, Homo sapiens
cccaugcacaacucuccaaaaca

SEQ ID NO: 1868473 - RNA, 16 nt, Homo sapiens
uaaugguuggaacuaa

SEQ ID NO: 1868474 - RNA, 15 nt, Homo sapiens
uccggcacacugcca

SEQ ID NO: 1868475 - RNA, 18 nt, Homo sapiens
ggaagaaagaauguuacu

SEQ ID NO: 1868476 - RNA, 17 nt, Homo sapiens
aaaauucagagaguuag

SEQ ID NO: 1868477 - RNA, 16 nt, Homo sapiens
uuuccuuuaugugaau

SEQ ID NO: 1868478 - RNA, 23 nt, Homo sapiens
uaaagggaccaucugcugcaguu

SEQ ID NO: 1868479 - RNA, 17 nt, Homo sapiens
uauugaacuuaugcaaa

SEQ ID NO: 1868480 - RNA, 14 nt, Homo sapiens
auaaaaaugacaac

SEQ ID NO: 1868481 - RNA, 15 nt, Homo sapiens
cuuuuuuuccaauuu

SEQ ID NO: 1868482 - RNA, 18 nt, Homo sapiens
uucaggggacuguucuca

SEQ ID NO: 1868483 - RNA, 13 nt, Homo sapiens
uaauaaagacagg

SEQ ID NO: 1868484 - RNA, 20 nt, Homo sapiens
cucaugcccugccaagcagc

SEQ ID NO: 1868485 - RNA, 19 nt, Homo sapiens
acacuaauguauuauaugu

SEQ ID NO: 1868486 - RNA, 18 nt, Homo sapiens
agggcucacagaauucau

SEQ ID NO: 1868487 - RNA, 12 nt, Homo sapiens
aguuacugugua

SEQ ID NO: 1868488 - RNA, 13 nt, Homo sapiens
aggagacgcugca

SEQ ID NO: 1868489 - RNA, 21 nt, Homo sapiens
acgcugcccaggcucugcuga

SEQ ID NO: 1868490 - RNA, 16 nt, Homo sapiens
cuuauuauugaugaua

SEQ ID NO: 1868491 - RNA, 15 nt, Homo sapiens
gggagaagagcccug

SEQ ID NO: 1868492 - RNA, 15 nt, Homo sapiens
ucauuucuaggcaaa

SEQ ID NO: 1868493 - RNA, 17 nt, Homo sapiens
gcagcauggauucugca

SEQ ID NO: 1868494 - RNA, 15 nt, Homo sapiens
ugcacacguccaugu

SEQ ID NO: 1868495 - RNA, 22 nt, Homo sapiens
augaggggaagccauuuuccag

SEQ ID NO: 1868496 - RNA, 14 nt, Homo sapiens
aaggcggugcucag

SEQ ID NO: 1868497 - RNA, 22 nt, Homo sapiens
uacagagaagccaucaccucag

SEQ ID NO: 1868498 - RNA, 20 nt, Homo sapiens
gaggcugggccccugggaug

SEQ ID NO: 1868499 - RNA, 21 nt, Homo sapiens
guagccugggcucacugugcu

SEQ ID NO: 1868500 - RNA, 13 nt, Homo sapiens
aucaaaugcucaa

SEQ ID NO: 1868501 - RNA, 13 nt, Homo sapiens
aacacaugcacac

SEQ ID NO: 1868502 - RNA, 20 nt, Homo sapiens
cguucacuuccccuuccaac

SEQ ID NO: 1868503 - RNA, 17 nt, Homo sapiens
gauuuucugaacaagcu

SEQ ID NO: 1868504 - RNA, 17 nt, Homo sapiens
ccccaaguuaguucaau

SEQ ID NO: 1868505 - RNA, 17 nt, Homo sapiens
ucucacaaauaaguaau

SEQ ID NO: 1868506 - RNA, 11 nt, Homo sapiens
ugcugugacaa

SEQ ID NO: 1868507 - RNA, 18 nt, Homo sapiens
ccagugcagggcuggucu

SEQ ID NO: 1868508 - RNA, 22 nt, Homo sapiens
cugagacaggagaaacacuuga

SEQ ID NO: 1868509 - RNA, 16 nt, Homo sapiens
caaaaugcucuugucc

SEQ ID NO: 1868510 - RNA, 20 nt, Homo sapiens
gaaccgagcuggagccaaca

SEQ ID NO: 1868511 - RNA, 12 nt, Homo sapiens
cugugucccugc

SEQ ID NO: 1868512 - RNA, 14 nt, Homo sapiens
ucauucagccuuua

SEQ ID NO: 1868513 - RNA, 21 nt, Homo sapiens
caaguuaaugcaaaugacugu

SEQ ID NO: 1868514 - RNA, 21 nt, Homo sapiens
uacccaggcccacccaucacg

SEQ ID NO: 1868515 - RNA, 22 nt, Homo sapiens
uuauugaaacaggauacacaca

SEQ ID NO: 1868516 - RNA, 21 nt, Homo sapiens
uugagguuuccuucagacaga

SEQ ID NO: 1868517 - RNA, 20 nt, Homo sapiens
ugccaaggggcugagugagu

SEQ ID NO: 1868518 - RNA, 22 nt, Homo sapiens
ggcagauaaaaugccagucuca

SEQ ID NO: 1868519 - RNA, 12 nt, Homo sapiens
caccccgugcca

SEQ ID NO: 1868520 - RNA, 20 nt, Homo sapiens
cagcacgccuuagcuuugca

SEQ ID NO: 1868521 - RNA, 21 nt, Homo sapiens
aagggccaggcuuacugagcu

SEQ ID NO: 1868522 - RNA, 21 nt, Homo sapiens
cuuuagucaggaauggcugca

SEQ ID NO: 1868523 - RNA, 16 nt, Homo sapiens
uuuaaaaaguuugaau

SEQ ID NO: 1868524 - RNA, 14 nt, Homo sapiens
cacuggaugcagaa

SEQ ID NO: 1868525 - RNA, 23 nt, Homo sapiens
uaaagcaaucugauucagcauca

SEQ ID NO: 1868526 - RNA, 17 nt, Homo sapiens
caccuggcugagcaguu

SEQ ID NO: 1868527 - RNA, 16 nt, Homo sapiens
agucucauucugucac

SEQ ID NO: 1868528 - RNA, 13 nt, Homo sapiens
gaagugugugauc

SEQ ID NO: 1868529 - RNA, 15 nt, Homo sapiens
uccuuaucacugaca

SEQ ID NO: 1868530 - RNA, 22 nt, Homo sapiens
agguccuccucucucuacuuga

SEQ ID NO: 1868531 - RNA, 15 nt, Homo sapiens
uaguuuguuaugugu

SEQ ID NO: 1868532 - RNA, 17 nt, Homo sapiens
uaucacagacucugcua

SEQ ID NO: 1868533 - RNA, 12 nt, Homo sapiens
ugagggcucacu

SEQ ID NO: 1868534 - RNA, 17 nt, Homo sapiens
guucuuuaaaauguaaa

SEQ ID NO: 1868535 - RNA, 18 nt, Homo sapiens
ccugcauugcugagucaa

SEQ ID NO: 1868536 - RNA, 16 nt, Homo sapiens
agguuuuuggucugac

SEQ ID NO: 1868537 - RNA, 21 nt, Homo sapiens
uagcuccuuggagcaggcaaa

SEQ ID NO: 1868538 - RNA, 18 nt, Homo sapiens
gaaaauacauaagaccau

SEQ ID NO: 1868539 - RNA, 23 nt, Homo sapiens
acuaaugucucuucuaacaucuu

SEQ ID NO: 1868540 - RNA, 18 nt, Homo sapiens
cuucucccaagacugcuc

SEQ ID NO: 1868541 - RNA, 12 nt, Homo sapiens
cuuuuaaaaacu

SEQ ID NO: 1868542 - RNA, 20 nt, Homo sapiens
cccuaggaaacucacacucc

SEQ ID NO: 1868543 - RNA, 20 nt, Homo sapiens
gauuaugaugcauacaguuu

SEQ ID NO: 1868544 - RNA, 17 nt, Homo sapiens
acuguuccuguuugcug

SEQ ID NO: 1868545 - RNA, 16 nt, Homo sapiens
caucuuccgagcccuu

SEQ ID NO: 1868546 - RNA, 16 nt, Homo sapiens
gaggcucucaugucuc

SEQ ID NO: 1868547 - RNA, 14 nt, Homo sapiens
uuuacauacuuuau

SEQ ID NO: 1868548 - RNA, 21 nt, Homo sapiens
ucaaugggaaauacuacuccu

SEQ ID NO: 1868549 - RNA, 14 nt, Homo sapiens
uaaauguacuuuuc

SEQ ID NO: 1868550 - RNA, 13 nt, Homo sapiens
cuagaaacaaaca

SEQ ID NO: 1868551 - RNA, 21 nt, Homo sapiens
ucugcauuaucugaggucaca

SEQ ID NO: 1868552 - RNA, 15 nt, Homo sapiens
uggauugacucugca

SEQ ID NO: 1868553 - RNA, 18 nt, Homo sapiens
uugaacuauaacuguugg

SEQ ID NO: 1868554 - RNA, 22 nt, Homo sapiens
ccagaccccaaggcccagacag

SEQ ID NO: 1868555 - RNA, 17 nt, Homo sapiens
acaugaugcacuucaaa

SEQ ID NO: 1868556 - RNA, 20 nt, Homo sapiens
aggccgaagcugcugugacu

SEQ ID NO: 1868557 - RNA, 20 nt, Homo sapiens
uaagaagcaaauaaauauca

SEQ ID NO: 1868558 - RNA, 18 nt, Homo sapiens
aguauuaugacacuccca

SEQ ID NO: 1868559 - RNA, 13 nt, Homo sapiens
cauaaagguuuac

SEQ ID NO: 1868560 - RNA, 16 nt, Homo sapiens
acagagggcugcauuc

SEQ ID NO: 1868561 - RNA, 22 nt, Homo sapiens
accagacucgccaacaugguga

SEQ ID NO: 1868562 - RNA, 17 nt, Homo sapiens
cacuagaucucccuuaa

SEQ ID NO: 1868563 - RNA, 16 nt, Homo sapiens
guggcucccaaaaaga

SEQ ID NO: 1868564 - RNA, 13 nt, Homo sapiens
uucaugugagaaa

SEQ ID NO: 1868565 - RNA, 13 nt, Homo sapiens
uuucugcauuuca

SEQ ID NO: 1868566 - RNA, 13 nt, Homo sapiens
ucucugcaucuca

SEQ ID NO: 1868567 - RNA, 15 nt, Homo sapiens
uucacaguacaggau

SEQ ID NO: 1868568 - RNA, 23 nt, Homo sapiens
aaaagcgcguuguguauauuaca

SEQ ID NO: 1868569 - RNA, 11 nt, Homo sapiens
ccgcugcugag

SEQ ID NO: 1868570 - RNA, 22 nt, Homo sapiens
gagaagucuggucagagccaca

SEQ ID NO: 1868571 - RNA, 23 nt, Homo sapiens
gaaccuguuuaauguuaugagga

SEQ ID NO: 1868572 - RNA, 17 nt, Homo sapiens
caaagggccagcagucu

SEQ ID NO: 1868573 - RNA, 15 nt, Homo sapiens
cuugcuaaguuuuca

SEQ ID NO: 1868574 - RNA, 14 nt, Homo sapiens
agcaauccagccuc

SEQ ID NO: 1868575 - RNA, 14 nt, Homo sapiens
ugccagacauggac

SEQ ID NO: 1868576 - RNA, 19 nt, Homo sapiens
cuuccugugccugugacuc

SEQ ID NO: 1868577 - RNA, 18 nt, Homo sapiens
cuggauuucugguucuga

SEQ ID NO: 1868578 - RNA, 17 nt, Homo sapiens
cuccagguucacuuugg

SEQ ID NO: 1868579 - RNA, 14 nt, Homo sapiens
ugaauaaauacaaa

SEQ ID NO: 1868580 - RNA, 14 nt, Homo sapiens
uacaaaaaugaaua

SEQ ID NO: 1868581 - RNA, 20 nt, Homo sapiens
acccauaaguuuaacuguau

SEQ ID NO: 1868582 - RNA, 18 nt, Homo sapiens
ugggucacagagugagac

SEQ ID NO: 1868583 - RNA, 20 nt, Homo sapiens
ggagaugucucugcaaccau

SEQ ID NO: 1868584 - RNA, 18 nt, Homo sapiens
gguucuaacugcuguuaa

SEQ ID NO: 1868585 - RNA, 20 nt, Homo sapiens
cuuccaguggcuucucccaa

SEQ ID NO: 1868586 - RNA, 16 nt, Homo sapiens
ucuuguaguguggcug

SEQ ID NO: 1868587 - RNA, 13 nt, Homo sapiens
augggauugcuaa

SEQ ID NO: 1868588 - RNA, 15 nt, Homo sapiens
gcaagggcagugaag

SEQ ID NO: 1868589 - RNA, 16 nt, Homo sapiens
uucagcucuguuuuac

SEQ ID NO: 1868590 - RNA, 17 nt, Homo sapiens
aaugaguuuauauggaa

SEQ ID NO: 1868591 - RNA, 19 nt, Homo sapiens
ugauguuuuacgugcaaac

SEQ ID NO: 1868592 - RNA, 12 nt, Homo sapiens
gcacugaugucc

SEQ ID NO: 1868593 - RNA, 22 nt, Homo sapiens
uacccauggcauggguggaauu

SEQ ID NO: 1868594 - RNA, 17 nt, Homo sapiens
auaguaacaucaaagau

SEQ ID NO: 1868595 - RNA, 18 nt, Homo sapiens
ugaauacaaagaaccaag

SEQ ID NO: 1868596 - RNA, 23 nt, Homo sapiens
ugcagauacuuugaagugcagcu

SEQ ID NO: 1868597 - RNA, 23 nt, Homo sapiens
aagauuuagaaaaaaguuuacaa

SEQ ID NO: 1868598 - RNA, 14 nt, Homo sapiens
acugcaacuuguga

SEQ ID NO: 1868599 - RNA, 16 nt, Homo sapiens
ccagcaggacacugau

SEQ ID NO: 1868600 - RNA, 16 nt, Homo sapiens
cacccacccugugcca

SEQ ID NO: 1868601 - RNA, 23 nt, Homo sapiens
aauuuauugucugucuacauuuc

SEQ ID NO: 1868602 - RNA, 21 nt, Homo sapiens
ugaacacucuuuugcuuuauu

SEQ ID NO: 1868603 - RNA, 17 nt, Homo sapiens
cgguguuuaaagucaac

SEQ ID NO: 1868604 - RNA, 16 nt, Homo sapiens
uggaaugaaauaauuc

SEQ ID NO: 1868605 - RNA, 20 nt, Homo sapiens
auaaacuaguuuccagugga

SEQ ID NO: 1868606 - RNA, 16 nt, Homo sapiens
gcuucuucuucaagau

SEQ ID NO: 1868607 - RNA, 20 nt, Homo sapiens
ggcauucgcagugcccagug

SEQ ID NO: 1868608 - RNA, 16 nt, Homo sapiens
gaucacguugcaaugg

SEQ ID NO: 1868609 - RNA, 14 nt, Homo sapiens
uucauauuuuccau

SEQ ID NO: 1868610 - RNA, 22 nt, Homo sapiens
ugaacuguuagguucugaugac

SEQ ID NO: 1868611 - RNA, 19 nt, Homo sapiens
agaguuuguuaccuaccuu

SEQ ID NO: 1868612 - RNA, 16 nt, Homo sapiens
aauagauacuuuugau

SEQ ID NO: 1868613 - RNA, 15 nt, Homo sapiens
guuuuggcaagagcg

SEQ ID NO: 1868614 - RNA, 13 nt, Homo sapiens
cagaacugaaccg

SEQ ID NO: 1868615 - RNA, 18 nt, Homo sapiens
cacccuggagagugcaca

SEQ ID NO: 1868616 - RNA, 13 nt, Homo sapiens
ccgagugcaauga

SEQ ID NO: 1868617 - RNA, 19 nt, Homo sapiens
aaaacccaggacaucuccu

SEQ ID NO: 1868618 - RNA, 17 nt, Homo sapiens
acuucauacaauguaag

SEQ ID NO: 1868619 - RNA, 18 nt, Homo sapiens
cuagcccagacucugagc

SEQ ID NO: 1868620 - RNA, 14 nt, Homo sapiens
uccuugacuguaaa

SEQ ID NO: 1868621 - RNA, 19 nt, Homo sapiens
cuuucagauaacuguuauu

SEQ ID NO: 1868622 - RNA, 17 nt, Homo sapiens
ggcauuuaacuccucau

SEQ ID NO: 1868623 - RNA, 12 nt, Homo sapiens
aacaaguauaaa

SEQ ID NO: 1868624 - RNA, 21 nt, Homo sapiens
uuaaauuugagaaucaaacau

SEQ ID NO: 1868625 - RNA, 13 nt, Homo sapiens
aggugaaccaaag

SEQ ID NO: 1868626 - RNA, 21 nt, Homo sapiens
cagggcaaagaacacaaaccc

SEQ ID NO: 1868627 - RNA, 17 nt, Homo sapiens
gcaagaucuugucucca

SEQ ID NO: 1868628 - RNA, 20 nt, Homo sapiens
agacuuggguugaucucuua

SEQ ID NO: 1868629 - RNA, 14 nt, Homo sapiens
ccaaggcuggagug

SEQ ID NO: 1868630 - RNA, 14 nt, Homo sapiens
cguguccugcuagc

SEQ ID NO: 1868631 - RNA, 16 nt, Homo sapiens
ggcugacaccuggauu

SEQ ID NO: 1868632 - RNA, 22 nt, Homo sapiens
ucccucugauuuccuucugcua

SEQ ID NO: 1868633 - RNA, 20 nt, Homo sapiens
gaaaaucuacacuccaguga

SEQ ID NO: 1868634 - RNA, 18 nt, Homo sapiens
gucuuucuuugucauuca

SEQ ID NO: 1868635 - RNA, 18 nt, Homo sapiens
ccuugacgacaagaccac

SEQ ID NO: 1868636 - RNA, 21 nt, Homo sapiens
acucccucguuaaucacagga

SEQ ID NO: 1868637 - RNA, 20 nt, Homo sapiens
auuuccuguguguguugccc

SEQ ID NO: 1868638 - RNA, 21 nt, Homo sapiens
agaugggcgucacuacugcua

SEQ ID NO: 1868639 - RNA, 15 nt, Homo sapiens
ccacugcgaccacaa

SEQ ID NO: 1868640 - RNA, 13 nt, Homo sapiens
cuaucaguacuuu

SEQ ID NO: 1868641 - RNA, 14 nt, Homo sapiens
aauuuuuaccuguu

SEQ ID NO: 1868642 - RNA, 17 nt, Homo sapiens
guuaaaaacuuguguau

SEQ ID NO: 1868643 - RNA, 18 nt, Homo sapiens
gcagccgugaucaaggga

SEQ ID NO: 1868644 - RNA, 15 nt, Homo sapiens
aagacaucaaugaaa

SEQ ID NO: 1868645 - RNA, 13 nt, Homo sapiens
agcuuaucugccc

SEQ ID NO: 1868646 - RNA, 17 nt, Homo sapiens
ucagcaccugacccugu

SEQ ID NO: 1868647 - RNA, 15 nt, Homo sapiens
ucucugccugcuucc

SEQ ID NO: 1868648 - RNA, 22 nt, Homo sapiens
aguuugccggauacaaacuggu

SEQ ID NO: 1868649 - RNA, 23 nt, Homo sapiens
ugcccacccagggaaggugcuga

SEQ ID NO: 1868650 - RNA, 13 nt, Homo sapiens
uuggaauggugua

SEQ ID NO: 1868651 - RNA, 13 nt, Homo sapiens
ucagcauggcauc

SEQ ID NO: 1868652 - RNA, 17 nt, Homo sapiens
acgacugcaagcuccau

SEQ ID NO: 1868653 - RNA, 17 nt, Homo sapiens
aacagugaggugcccag

SEQ ID NO: 1868654 - RNA, 18 nt, Homo sapiens
cccuuguguuuugaagaa

SEQ ID NO: 1868655 - RNA, 21 nt, Homo sapiens
cccaguggccggucagccaca

SEQ ID NO: 1868656 - RNA, 23 nt, Homo sapiens
agaaagcagccauuggcacugug

SEQ ID NO: 1868657 - RNA, 21 nt, Homo sapiens
cgggcugcccuucgcugccag

SEQ ID NO: 1868658 - RNA, 17 nt, Homo sapiens
aauuguggcuguucacu

SEQ ID NO: 1868659 - RNA, 21 nt, Homo sapiens
ggccucucccuccuccaggaa

SEQ ID NO: 1868660 - RNA, 15 nt, Homo sapiens
aguggugcuccaagg

SEQ ID NO: 1868661 - RNA, 19 nt, Homo sapiens
cucugugcagacaguguca

SEQ ID NO: 1868662 - RNA, 16 nt, Homo sapiens
ccucauaggcuucugg

SEQ ID NO: 1868663 - RNA, 12 nt, Homo sapiens
uugaucaaugaa

SEQ ID NO: 1868664 - RNA, 22 nt, Homo sapiens
ccagccugcuagcuagcucaac

SEQ ID NO: 1868665 - RNA, 17 nt, Homo sapiens
cugguggggauggggcu

SEQ ID NO: 1868666 - RNA, 15 nt, Homo sapiens
aaguugugacaguca

SEQ ID NO: 1868667 - RNA, 21 nt, Homo sapiens
uauauaaacacuccacagugu

SEQ ID NO: 1868668 - RNA, 12 nt, Homo sapiens
ugcaggucucaa

SEQ ID NO: 1868669 - RNA, 13 nt, Homo sapiens
ugacguagcugca

SEQ ID NO: 1868670 - RNA, 17 nt, Homo sapiens
aucuaaacccagcaaaa

SEQ ID NO: 1868671 - RNA, 16 nt, Homo sapiens
gauucaacacauauuu

SEQ ID NO: 1868672 - RNA, 14 nt, Homo sapiens
augaaggacacucu

SEQ ID NO: 1868673 - RNA, 16 nt, Homo sapiens
agaguuuucuguugca

SEQ ID NO: 1868674 - RNA, 19 nt, Homo sapiens
gugcagugccaccaucaua

SEQ ID NO: 1868675 - RNA, 13 nt, Homo sapiens
uucuugucucuga

SEQ ID NO: 1868676 - RNA, 20 nt, Homo sapiens
aacauaaaaucugugaauua

SEQ ID NO: 1868677 - RNA, 15 nt, Homo sapiens
agacugguauucucu

SEQ ID NO: 1868678 - RNA, 20 nt, Homo sapiens
cugcucacuaccuccucagg

SEQ ID NO: 1868679 - RNA, 18 nt, Homo sapiens
cuugguuuugauguugaa

SEQ ID NO: 1868680 - RNA, 22 nt, Homo sapiens
cagucuuuggagagcucaguac

SEQ ID NO: 1868681 - RNA, 19 nt, Homo sapiens
aagauccugaagcaguuca

SEQ ID NO: 1868682 - RNA, 16 nt, Homo sapiens
cacauacauauauaca

SEQ ID NO: 1868683 - RNA, 23 nt, Homo sapiens
ggccuggacugcacaggcagcaa

SEQ ID NO: 1868684 - RNA, 21 nt, Homo sapiens
acaagcauucaagaaacugau

SEQ ID NO: 1868685 - RNA, 13 nt, Homo sapiens
gaaucuauuugug

SEQ ID NO: 1868686 - RNA, 15 nt, Homo sapiens
ucagcucuguuuacg

SEQ ID NO: 1868687 - RNA, 20 nt, Homo sapiens
caggaagggagaacuugaaa

SEQ ID NO: 1868688 - RNA, 13 nt, Homo sapiens
uagaauuaucucu

SEQ ID NO: 1868689 - RNA, 13 nt, Homo sapiens
uuuauauagcuug

SEQ ID NO: 1868690 - RNA, 20 nt, Homo sapiens
gauccugccuugcugugaaa

SEQ ID NO: 1868691 - RNA, 15 nt, Homo sapiens
agcuuuuccaaaaua

SEQ ID NO: 1868692 - RNA, 23 nt, Homo sapiens
uguggacccccacccugcacuuu

SEQ ID NO: 1868693 - RNA, 21 nt, Homo sapiens
aguuccuucuggugucugcuu

SEQ ID NO: 1868694 - RNA, 23 nt, Homo sapiens
ucaaacuccuagguucacuuugg

SEQ ID NO: 1868695 - RNA, 14 nt, Homo sapiens
gccgccugcuccuc

SEQ ID NO: 1868696 - RNA, 21 nt, Homo sapiens
auccugaacugggauggaaug

SEQ ID NO: 1868697 - RNA, 17 nt, Homo sapiens
cuuauggaaagguccug

SEQ ID NO: 1868698 - RNA, 21 nt, Homo sapiens
ccaggugccagaauccucuca

SEQ ID NO: 1868699 - RNA, 12 nt, Homo sapiens
gauuauuugaac

SEQ ID NO: 1868700 - RNA, 16 nt, Homo sapiens
acuugcccaaguccca

SEQ ID NO: 1868701 - RNA, 18 nt, Homo sapiens
ccugggggccgugcucac

SEQ ID NO: 1868702 - RNA, 19 nt, Homo sapiens
ucuaaaugggaauucucag

SEQ ID NO: 1868703 - RNA, 18 nt, Homo sapiens
uguuaggaagggacugca

SEQ ID NO: 1868704 - RNA, 16 nt, Homo sapiens
gguggccagggcucca

SEQ ID NO: 1868705 - RNA, 16 nt, Homo sapiens
aaugaauaugccaucu

SEQ ID NO: 1868706 - RNA, 16 nt, Homo sapiens
guacuucucucuucca

SEQ ID NO: 1868707 - RNA, 16 nt, Homo sapiens
ccaaacagcaugugcu

SEQ ID NO: 1868708 - RNA, 17 nt, Homo sapiens
cauucuggaaaagcaaa

SEQ ID NO: 1868709 - RNA, 21 nt, Homo sapiens
cccuauaucuauaaacacugu

SEQ ID NO: 1868710 - RNA, 15 nt, Homo sapiens
ugcagcacgucucag

SEQ ID NO: 1868711 - RNA, 14 nt, Homo sapiens
gucucgaugcugcu

SEQ ID NO: 1868712 - RNA, 16 nt, Homo sapiens
ggagcacuuguccacg

SEQ ID NO: 1868713 - RNA, 14 nt, Homo sapiens
ugauaugaguauac

SEQ ID NO: 1868714 - RNA, 17 nt, Homo sapiens
aacccgggcgcugccug

SEQ ID NO: 1868715 - RNA, 23 nt, Homo sapiens
agccaauauaggggaaaaaacuc

SEQ ID NO: 1868716 - RNA, 22 nt, Homo sapiens
ggcgccccugccaccucccuga

SEQ ID NO: 1868717 - RNA, 19 nt, Homo sapiens
aaagccccauuaacugcuu

SEQ ID NO: 1868718 - RNA, 16 nt, Homo sapiens
cagcuuccugagucac

SEQ ID NO: 1868719 - RNA, 23 nt, Homo sapiens
cauguaaauauuuuguuaucuga

SEQ ID NO: 1868720 - RNA, 22 nt, Homo sapiens
guuguuuaaaauaaaaguaccu

SEQ ID NO: 1868721 - RNA, 16 nt, Homo sapiens
cccaucauacacuucc

SEQ ID NO: 1868722 - RNA, 18 nt, Homo sapiens
uuuuaguagagacagggu

SEQ ID NO: 1868723 - RNA, 18 nt, Homo sapiens
uaauucuuaaaacuauaa

SEQ ID NO: 1868724 - RNA, 14 nt, Homo sapiens
aauacuucauuaau

SEQ ID NO: 1868725 - RNA, 14 nt, Homo sapiens
aaaugugcuuaugu

SEQ ID NO: 1868726 - RNA, 15 nt, Homo sapiens
cagaagcucaucuca

SEQ ID NO: 1868727 - RNA, 23 nt, Homo sapiens
gcauauucccugcacacacaugc

SEQ ID NO: 1868728 - RNA, 16 nt, Homo sapiens
agcgaagucucauggg

SEQ ID NO: 1868729 - RNA, 17 nt, Homo sapiens
cgauugguaugaugcug

SEQ ID NO: 1868730 - RNA, 17 nt, Homo sapiens
aaggccuggggugaccc

SEQ ID NO: 1868731 - RNA, 14 nt, Homo sapiens
aaagguugcagugc

SEQ ID NO: 1868732 - RNA, 23 nt, Homo sapiens
ucuaaauuuuuacuuaacuuaau

SEQ ID NO: 1868733 - RNA, 15 nt, Homo sapiens
ccaaauuuggcuaaa

SEQ ID NO: 1868734 - RNA, 22 nt, Homo sapiens
uuaccauagaaagaugacaaaa

SEQ ID NO: 1868735 - RNA, 19 nt, Homo sapiens
auuuacaauguguaucaaa

SEQ ID NO: 1868736 - RNA, 17 nt, Homo sapiens
aagaagccagcaccacc

SEQ ID NO: 1868737 - RNA, 18 nt, Homo sapiens
gcaggcuuuuguguucuc

SEQ ID NO: 1868738 - RNA, 22 nt, Homo sapiens
accuauggcccagccacugcag

SEQ ID NO: 1868739 - RNA, 22 nt, Homo sapiens
aggaagggaaagggaagugaua

SEQ ID NO: 1868740 - RNA, 17 nt, Homo sapiens
acacaauuaauucaucc

SEQ ID NO: 1868741 - RNA, 22 nt, Homo sapiens
cccacucagccuuuugggaaua

SEQ ID NO: 1868742 - RNA, 14 nt, Homo sapiens
agugagugcugcuc

SEQ ID NO: 1868743 - RNA, 21 nt, Homo sapiens
uaugauaauuauuuacaaaau

SEQ ID NO: 1868744 - RNA, 23 nt, Homo sapiens
ugaugguguggccuguggcuguc

SEQ ID NO: 1868745 - RNA, 20 nt, Homo sapiens
gauaauagagggcuggaauu

SEQ ID NO: 1868746 - RNA, 20 nt, Homo sapiens
aaagucuguggcccaagaga

SEQ ID NO: 1868747 - RNA, 18 nt, Homo sapiens
cacugaucugaacaucug

SEQ ID NO: 1868748 - RNA, 20 nt, Homo sapiens
uaugcugacagcucuucaca

SEQ ID NO: 1868749 - RNA, 22 nt, Homo sapiens
ccacaguccuucuuugacacca

SEQ ID NO: 1868750 - RNA, 17 nt, Homo sapiens
uauugucacaugaugaa

SEQ ID NO: 1868751 - RNA, 23 nt, Homo sapiens
aagggggcuccaugcuggugugg

SEQ ID NO: 1868752 - RNA, 15 nt, Homo sapiens
auaagucuacauuaa

SEQ ID NO: 1868753 - RNA, 15 nt, Homo sapiens
auaaauauucuagca

SEQ ID NO: 1868754 - RNA, 21 nt, Homo sapiens
ggauaagggaguccagggugg

SEQ ID NO: 1868755 - RNA, 15 nt, Homo sapiens
auaguugcugucauc

SEQ ID NO: 1868756 - RNA, 13 nt, Homo sapiens
ccuucuauccucu

SEQ ID NO: 1868757 - RNA, 22 nt, Homo sapiens
ugaggcaggagaaucucuugaa

SEQ ID NO: 1868758 - RNA, 18 nt, Homo sapiens
cggggccagcacuuccau

SEQ ID NO: 1868759 - RNA, 20 nt, Homo sapiens
gaugcaggauuuguucucug

SEQ ID NO: 1868760 - RNA, 20 nt, Homo sapiens
uccucugaaacccuccucca

SEQ ID NO: 1868761 - RNA, 23 nt, Homo sapiens
uacaucugcaauaugaauucaag

SEQ ID NO: 1868762 - RNA, 22 nt, Homo sapiens
auucuuuuuaaugcuguuaacu

SEQ ID NO: 1868763 - RNA, 22 nt, Homo sapiens
ugagcugaaagaggccaaacag

SEQ ID NO: 1868764 - RNA, 22 nt, Homo sapiens
uaccuguaaccuaccuuaucau

SEQ ID NO: 1868765 - RNA, 21 nt, Homo sapiens
ccagguaaagucaaagcuuug

SEQ ID NO: 1868766 - RNA, 11 nt, Homo sapiens
ggaaugcuucu

SEQ ID NO: 1868767 - RNA, 23 nt, Homo sapiens
aaggaagggacugacaagaagcu

SEQ ID NO: 1868768 - RNA, 22 nt, Homo sapiens
ugguauccugugacauguaaca

SEQ ID NO: 1868769 - RNA, 13 nt, Homo sapiens
aaauaaaugacaa

SEQ ID NO: 1868770 - RNA, 14 nt, Homo sapiens
cuuccagagucauc

SEQ ID NO: 1868771 - RNA, 14 nt, Homo sapiens
aguuggagugagau

SEQ ID NO: 1868772 - RNA, 15 nt, Homo sapiens
acuguguguacauau

SEQ ID NO: 1868773 - RNA, 17 nt, Homo sapiens
ugcagaauccaaaguaa

SEQ ID NO: 1868774 - RNA, 13 nt, Homo sapiens
aaauaaaugugca

SEQ ID NO: 1868775 - RNA, 16 nt, Homo sapiens
uauauacauacgcaau

SEQ ID NO: 1868776 - RNA, 21 nt, Homo sapiens
agacgagguuucacuguguug

SEQ ID NO: 1868777 - RNA, 17 nt, Homo sapiens
cuugaggaucauaugaa

SEQ ID NO: 1868778 - RNA, 21 nt, Homo sapiens
auauaauacuaaagugucuau

SEQ ID NO: 1868779 - RNA, 23 nt, Homo sapiens
gagccugggguguccuacaguga

SEQ ID NO: 1868780 - RNA, 16 nt, Homo sapiens
ucagggucugggauga

SEQ ID NO: 1868781 - RNA, 18 nt, Homo sapiens
aacagaaagcauccuaaa

SEQ ID NO: 1868782 - RNA, 16 nt, Homo sapiens
cccuacagacagcuua

SEQ ID NO: 1868783 - RNA, 18 nt, Homo sapiens
gcaauagcuagcuauaua

SEQ ID NO: 1868784 - RNA, 17 nt, Homo sapiens
aacgucugguccuaacc

SEQ ID NO: 1868785 - RNA, 17 nt, Homo sapiens
acuuaaucucacauuca

SEQ ID NO: 1868786 - RNA, 18 nt, Homo sapiens
agggccagcucacaagcc

SEQ ID NO: 1868787 - RNA, 13 nt, Homo sapiens
uaaacccaucugu

SEQ ID NO: 1868788 - RNA, 16 nt, Homo sapiens
ccuggcuuagaaggca

SEQ ID NO: 1868789 - RNA, 13 nt, Homo sapiens
ccugucucaguga

SEQ ID NO: 1868790 - RNA, 12 nt, Homo sapiens
uucccuguuaua

SEQ ID NO: 1868791 - RNA, 20 nt, Homo sapiens
acaugcccucggucacugag

SEQ ID NO: 1868792 - RNA, 21 nt, Homo sapiens
gcccuuagucauauaaccaaa

SEQ ID NO: 1868793 - RNA, 17 nt, Homo sapiens
uggggagacuucuuggc

SEQ ID NO: 1868794 - RNA, 18 nt, Homo sapiens
gaccccaucccuauccau

SEQ ID NO: 1868795 - RNA, 14 nt, Homo sapiens
aaauuuucuguaca

SEQ ID NO: 1868796 - RNA, 23 nt, Homo sapiens
cuaacacccagucuguuccccau

SEQ ID NO: 1868797 - RNA, 18 nt, Homo sapiens
caacaaaggcugaacugg

SEQ ID NO: 1868798 - RNA, 18 nt, Homo sapiens
uuuaauuagaaauaucuu

SEQ ID NO: 1868799 - RNA, 13 nt, Homo sapiens
gaaacaccacuua

SEQ ID NO: 1868800 - RNA, 17 nt, Homo sapiens
gcuuuacuuugcccagg

SEQ ID NO: 1868801 - RNA, 16 nt, Homo sapiens
uguauuaauaccaaag

SEQ ID NO: 1868802 - RNA, 14 nt, Homo sapiens
ggcucugugccuug

SEQ ID NO: 1868803 - RNA, 22 nt, Homo sapiens
uauugaaucuaaaaccaaauau

SEQ ID NO: 1868804 - RNA, 22 nt, Homo sapiens
cccgccgccuccugcaccgaga

SEQ ID NO: 1868805 - RNA, 19 nt, Homo sapiens
guguuugggagaaaaguau

SEQ ID NO: 1868806 - RNA, 17 nt, Homo sapiens
caaagcagauuuuccua

SEQ ID NO: 1868807 - RNA, 16 nt, Homo sapiens
gccgggcaugguggca

SEQ ID NO: 1868808 - RNA, 17 nt, Homo sapiens
gaaccuuacuggcacug

SEQ ID NO: 1868809 - RNA, 20 nt, Homo sapiens
gugccagaggcuggaccaca

SEQ ID NO: 1868810 - RNA, 12 nt, Homo sapiens
cugagcugccac

SEQ ID NO: 1868811 - RNA, 20 nt, Homo sapiens
ccaaaaagacaagugcucaa

SEQ ID NO: 1868812 - RNA, 15 nt, Homo sapiens
ccccugcaaggcgcu

SEQ ID NO: 1868813 - RNA, 23 nt, Homo sapiens
aaguuauuuacuuuuaccacuau

SEQ ID NO: 1868814 - RNA, 19 nt, Homo sapiens
cacagaugugaaaugaaug

SEQ ID NO: 1868815 - RNA, 17 nt, Homo sapiens
ccuaaacauagugguau

SEQ ID NO: 1868816 - RNA, 22 nt, Homo sapiens
cuugcuuuaccuuuucagggcu

SEQ ID NO: 1868817 - RNA, 17 nt, Homo sapiens
gcuccagccugacaaca

SEQ ID NO: 1868818 - RNA, 20 nt, Homo sapiens
aaaaugagucacuuacuuca

SEQ ID NO: 1868819 - RNA, 18 nt, Homo sapiens
caucugcacccgguacaa

SEQ ID NO: 1868820 - RNA, 15 nt, Homo sapiens
guagagagagaccua

SEQ ID NO: 1868821 - RNA, 16 nt, Homo sapiens
uccaccuuccaaagga

SEQ ID NO: 1868822 - RNA, 21 nt, Homo sapiens
acuaauuuuaguauucauucu

SEQ ID NO: 1868823 - RNA, 14 nt, Homo sapiens
gcccccagggcacu

SEQ ID NO: 1868824 - RNA, 14 nt, Homo sapiens
uguuuaacauauau

SEQ ID NO: 1868825 - RNA, 14 nt, Homo sapiens
uuggcuucccaaag

SEQ ID NO: 1868826 - RNA, 17 nt, Homo sapiens
agggagccacacagaga

SEQ ID NO: 1868827 - RNA, 19 nt, Homo sapiens
gccuccucagccucugcaa

SEQ ID NO: 1868828 - RNA, 16 nt, Homo sapiens
gucuguaaugugaauu

SEQ ID NO: 1868829 - RNA, 15 nt, Homo sapiens
aaaguguaagcacuu

SEQ ID NO: 1868830 - RNA, 16 nt, Homo sapiens
uguuggauguaugugu

SEQ ID NO: 1868831 - RNA, 20 nt, Homo sapiens
acccauuugucucuacuuuu

SEQ ID NO: 1868832 - RNA, 19 nt, Homo sapiens
cucaacaacaaaccaaaac

SEQ ID NO: 1868833 - RNA, 19 nt, Homo sapiens
uccacccacgagcacuuua

SEQ ID NO: 1868834 - RNA, 19 nt, Homo sapiens
ugaauaaauuuucaaaucc

SEQ ID NO: 1868835 - RNA, 15 nt, Homo sapiens
uaaauguucuaacag

SEQ ID NO: 1868836 - RNA, 20 nt, Homo sapiens
auucuuucccaauucacauc

SEQ ID NO: 1868837 - RNA, 16 nt, Homo sapiens
guggcucagugccuuc

SEQ ID NO: 1868838 - RNA, 21 nt, Homo sapiens
gccaaggaaacccccagugua

SEQ ID NO: 1868839 - RNA, 14 nt, Homo sapiens
cuaugugagcacaa

SEQ ID NO: 1868840 - RNA, 18 nt, Homo sapiens
gugcugucuucuggucug

SEQ ID NO: 1868841 - RNA, 19 nt, Homo sapiens
cuuuggcaaaggucccuga

SEQ ID NO: 1868842 - RNA, 11 nt, Homo sapiens
ugagugcaagg

SEQ ID NO: 1868843 - RNA, 20 nt, Homo sapiens
uaaaucuguuauuuugcuau

SEQ ID NO: 1868844 - RNA, 12 nt, Homo sapiens
agaacacugaga

SEQ ID NO: 1868845 - RNA, 13 nt, Homo sapiens
cccaauacaaaga

SEQ ID NO: 1868846 - RNA, 15 nt, Homo sapiens
uaaaaaagcaaaaac

SEQ ID NO: 1868847 - RNA, 15 nt, Homo sapiens
gcuccugaggggcau

SEQ ID NO: 1868848 - RNA, 14 nt, Homo sapiens
agugacuccugcug

SEQ ID NO: 1868849 - RNA, 11 nt, Homo sapiens
cacgugcaaua

SEQ ID NO: 1868850 - RNA, 13 nt, Homo sapiens
caguauacugugu

SEQ ID NO: 1868851 - RNA, 12 nt, Homo sapiens
ucugguauuucc

SEQ ID NO: 1868852 - RNA, 15 nt, Homo sapiens
guguguguugucuga

SEQ ID NO: 1868853 - RNA, 23 nt, Homo sapiens
gcuguauuuuuauuuuugcacaa

SEQ ID NO: 1868854 - RNA, 21 nt, Homo sapiens
aauuaauuugugaauuugcaa

SEQ ID NO: 1868855 - RNA, 17 nt, Homo sapiens
ucuguucugcacacagc

SEQ ID NO: 1868856 - RNA, 20 nt, Homo sapiens
acaccguguuuucugacaca

SEQ ID NO: 1868857 - RNA, 21 nt, Homo sapiens
acacagaacaggaacuagauu

SEQ ID NO: 1868858 - RNA, 15 nt, Homo sapiens
aguuuaucacacagu

SEQ ID NO: 1868859 - RNA, 18 nt, Homo sapiens
auugcuuuuggacaagga

SEQ ID NO: 1868860 - RNA, 22 nt, Homo sapiens
ccaucauaauauaaaacaggau

SEQ ID NO: 1868861 - RNA, 18 nt, Homo sapiens
ucagaaggugguuugaca

SEQ ID NO: 1868862 - RNA, 20 nt, Homo sapiens
ugguagccaucaagcacuuc

SEQ ID NO: 1868863 - RNA, 12 nt, Homo sapiens
uaaaucaagucc

SEQ ID NO: 1868864 - RNA, 18 nt, Homo sapiens
gaugaccuacagugcugu

SEQ ID NO: 1868865 - RNA, 17 nt, Homo sapiens
aagggagggucccugug

SEQ ID NO: 1868866 - RNA, 11 nt, Homo sapiens
ccucagaugau

SEQ ID NO: 1868867 - RNA, 21 nt, Homo sapiens
ugugcaauaaaaccaagugcu

SEQ ID NO: 1868868 - RNA, 18 nt, Homo sapiens
uauuucccucaccuuucc

SEQ ID NO: 1868869 - RNA, 11 nt, Homo sapiens
ugauguaaaac

SEQ ID NO: 1868870 - RNA, 16 nt, Homo sapiens
uugaaaacucacagaa

SEQ ID NO: 1868871 - RNA, 20 nt, Homo sapiens
aguuucugggucuacaagga

SEQ ID NO: 1868872 - RNA, 19 nt, Homo sapiens
gcuccguagcuucuagucu

SEQ ID NO: 1868873 - RNA, 13 nt, Homo sapiens
aauuuacauauag

SEQ ID NO: 1868874 - RNA, 16 nt, Homo sapiens
auguuugguaccaaga

SEQ ID NO: 1868875 - RNA, 19 nt, Homo sapiens
cccaugguagacugugaca

SEQ ID NO: 1868876 - RNA, 13 nt, Homo sapiens
cauagggucugca

SEQ ID NO: 1868877 - RNA, 13 nt, Homo sapiens
uccccagccugcu

SEQ ID NO: 1868878 - RNA, 19 nt, Homo sapiens
caguuacucccuacacuga

SEQ ID NO: 1868879 - RNA, 19 nt, Homo sapiens
aggcaaggaugucugagac

SEQ ID NO: 1868880 - RNA, 13 nt, Homo sapiens
cagggcacaaaga

SEQ ID NO: 1868881 - RNA, 21 nt, Homo sapiens
ccgacugccgcugagaagggu

SEQ ID NO: 1868882 - RNA, 21 nt, Homo sapiens
cuggccaaaaugcagacauuu

SEQ ID NO: 1868883 - RNA, 13 nt, Homo sapiens
aaugaaugauucu

SEQ ID NO: 1868884 - RNA, 17 nt, Homo sapiens
caguucagguaugugug

SEQ ID NO: 1868885 - RNA, 17 nt, Homo sapiens
accccugcuauauacua

SEQ ID NO: 1868886 - RNA, 18 nt, Homo sapiens
gauuaguugacaguauua

SEQ ID NO: 1868887 - RNA, 16 nt, Homo sapiens
uaaacaaacauugugu

SEQ ID NO: 1868888 - RNA, 18 nt, Homo sapiens
gcugaauagcuucuccaa

SEQ ID NO: 1868889 - RNA, 16 nt, Homo sapiens
caaauuaucaagcuaa

SEQ ID NO: 1868890 - RNA, 20 nt, Homo sapiens
cacuggguucccauucugag

SEQ ID NO: 1868891 - RNA, 11 nt, Homo sapiens
cugccacuguu

SEQ ID NO: 1868892 - RNA, 19 nt, Homo sapiens
gagcaggaagccgauguga

SEQ ID NO: 1868893 - RNA, 23 nt, Homo sapiens
agacaguacucuuaacuccuagc

SEQ ID NO: 1868894 - RNA, 17 nt, Homo sapiens
aaaaauaaugcauuugu

SEQ ID NO: 1868895 - RNA, 15 nt, Homo sapiens
ggcacaaaaccagaa

SEQ ID NO: 1868896 - RNA, 13 nt, Homo sapiens
cugaucagucuaa

SEQ ID NO: 1868897 - RNA, 20 nt, Homo sapiens
guccucccacccuaccacag

SEQ ID NO: 1868898 - RNA, 15 nt, Homo sapiens
ccugucacacacugg

SEQ ID NO: 1868899 - RNA, 14 nt, Homo sapiens
ggccuugaugguga

SEQ ID NO: 1868900 - RNA, 19 nt, Homo sapiens
aggauauauuuaacaaacc

SEQ ID NO: 1868901 - RNA, 15 nt, Homo sapiens
cucccuucucaucuc

SEQ ID NO: 1868902 - RNA, 20 nt, Homo sapiens
cuuaaggacaaagugccaaa

SEQ ID NO: 1868903 - RNA, 15 nt, Homo sapiens
aaaugaauaaauuca

SEQ ID NO: 1868904 - RNA, 20 nt, Homo sapiens
auuguaucaaaugugacauu

SEQ ID NO: 1868905 - RNA, 12 nt, Homo sapiens
ccgauucaccug

SEQ ID NO: 1868906 - RNA, 13 nt, Homo sapiens
uccacuuugacua

SEQ ID NO: 1868907 - RNA, 19 nt, Homo sapiens
gaacuuaguaaguaauauc

SEQ ID NO: 1868908 - RNA, 21 nt, Homo sapiens
ucaaacauauguauacaaauu

SEQ ID NO: 1868909 - RNA, 19 nt, Homo sapiens
cagaggacccaggggaaac

SEQ ID NO: 1868910 - RNA, 21 nt, Homo sapiens
cuuaacaaagccuuugcuuug

SEQ ID NO: 1868911 - RNA, 20 nt, Homo sapiens
ggacagcaaagcagcagugu

SEQ ID NO: 1868912 - RNA, 14 nt, Homo sapiens
ccacaaaaguuccc

SEQ ID NO: 1868913 - RNA, 13 nt, Homo sapiens
auaggcaaagggg

SEQ ID NO: 1868914 - RNA, 17 nt, Homo sapiens
ucagaaucagacuauga

SEQ ID NO: 1868915 - RNA, 14 nt, Homo sapiens
accauuucucugca

SEQ ID NO: 1868916 - RNA, 18 nt, Homo sapiens
agguuuccucaaacugug

SEQ ID NO: 1868917 - RNA, 20 nt, Homo sapiens
guccuaaucauacaccagaa

SEQ ID NO: 1868918 - RNA, 19 nt, Homo sapiens
agccacgggggacugacgc

SEQ ID NO: 1868919 - RNA, 19 nt, Homo sapiens
agaauucuuaacauagcca

SEQ ID NO: 1868920 - RNA, 22 nt, Homo sapiens
aaauguaucauuuuugugcaca

SEQ ID NO: 1868921 - RNA, 18 nt, Homo sapiens
uaagauguucugccuuau

SEQ ID NO: 1868922 - RNA, 19 nt, Homo sapiens
ugacacaucaagcuuuucu

SEQ ID NO: 1868923 - RNA, 19 nt, Homo sapiens
uccaccuucuacgcaauug

SEQ ID NO: 1868924 - RNA, 13 nt, Homo sapiens
acagcaugugcaa

SEQ ID NO: 1868925 - RNA, 22 nt, Homo sapiens
uaagccauaugacaauuucaaa

SEQ ID NO: 1868926 - RNA, 17 nt, Homo sapiens
guagcagccugcguuaa

SEQ ID NO: 1868927 - RNA, 14 nt, Homo sapiens
aguuuaacagaguu

SEQ ID NO: 1868928 - RNA, 16 nt, Homo sapiens
auuucacugaauuuca

SEQ ID NO: 1868929 - RNA, 15 nt, Homo sapiens
cucaggauccaguga

SEQ ID NO: 1868930 - RNA, 21 nt, Homo sapiens
accuuucaugugccugaaggc

SEQ ID NO: 1868931 - RNA, 15 nt, Homo sapiens
auuucagaagccuaa

SEQ ID NO: 1868932 - RNA, 16 nt, Homo sapiens
cugagcaacaugguga

SEQ ID NO: 1868933 - RNA, 22 nt, Homo sapiens
uaucaauccaggcuacaaucuu

SEQ ID NO: 1868934 - RNA, 16 nt, Homo sapiens
aaaauguucaccuaga

SEQ ID NO: 1868935 - RNA, 20 nt, Homo sapiens
uagcucuaggguauauaucc

SEQ ID NO: 1868936 - RNA, 20 nt, Homo sapiens
gagaggcaccacggccucac

SEQ ID NO: 1868937 - RNA, 21 nt, Homo sapiens
ggcaagcugugacuucuccag

SEQ ID NO: 1868938 - RNA, 20 nt, Homo sapiens
ucugaacccuuccaccaaaa

SEQ ID NO: 1868939 - RNA, 12 nt, Homo sapiens
agaaaacacagc

SEQ ID NO: 1868940 - RNA, 18 nt, Homo sapiens
acuguugcacagccagaa

SEQ ID NO: 1868941 - RNA, 13 nt, Homo sapiens
acccugaguucau

SEQ ID NO: 1868942 - RNA, 13 nt, Homo sapiens
uuacugagacaau

SEQ ID NO: 1868943 - RNA, 12 nt, Homo sapiens
cagcaagcuuug

SEQ ID NO: 1868944 - RNA, 16 nt, Homo sapiens
acuugacaagccuucu

SEQ ID NO: 1868945 - RNA, 21 nt, Homo sapiens
uacucagguuaaugcugaaaa

SEQ ID NO: 1868946 - RNA, 17 nt, Homo sapiens
cuuuuccuugacuauua

SEQ ID NO: 1868947 - RNA, 18 nt, Homo sapiens
cugaagugcagcucagga

SEQ ID NO: 1868948 - RNA, 16 nt, Homo sapiens
uuaaaaauguauguug

SEQ ID NO: 1868949 - RNA, 11 nt, Homo sapiens
uuggacagggg

SEQ ID NO: 1868950 - RNA, 19 nt, Homo sapiens
aaagcagacuuuugugaac

SEQ ID NO: 1868951 - RNA, 20 nt, Homo sapiens
aauaaaucguccucccaggc

SEQ ID NO: 1868952 - RNA, 20 nt, Homo sapiens
aguuuaaaacagaagccuga

SEQ ID NO: 1868953 - RNA, 23 nt, Homo sapiens
ugcuuccugcacauagacauucc

SEQ ID NO: 1868954 - RNA, 21 nt, Homo sapiens
guccuuucaauuccaccaggg

SEQ ID NO: 1868955 - RNA, 17 nt, Homo sapiens
ugcagccccucaugccu

SEQ ID NO: 1868956 - RNA, 12 nt, Homo sapiens
ugcuaaucuugu

SEQ ID NO: 1868957 - RNA, 12 nt, Homo sapiens
aaccauaugccc

SEQ ID NO: 1868958 - RNA, 12 nt, Homo sapiens
gaauauauacau

SEQ ID NO: 1868959 - RNA, 16 nt, Homo sapiens
gugccacaaauugaaa

SEQ ID NO: 1868960 - RNA, 13 nt, Homo sapiens
caagauacacguc

SEQ ID NO: 1868961 - RNA, 15 nt, Homo sapiens
aggccucaucuccuu

SEQ ID NO: 1868962 - RNA, 22 nt, Homo sapiens
gucauaaaaugcauacuguuga

SEQ ID NO: 1868963 - RNA, 23 nt, Homo sapiens
cuagaaccuucuaauccaugugc

SEQ ID NO: 1868964 - RNA, 19 nt, Homo sapiens
aguuuccuaggaugucaug

SEQ ID NO: 1868965 - RNA, 22 nt, Homo sapiens
acuccuugcaggugacauuugc

SEQ ID NO: 1868966 - RNA, 17 nt, Homo sapiens
uaucuaccaacuuucaa

SEQ ID NO: 1868967 - RNA, 20 nt, Homo sapiens
acugacccaaaaugugaaug

SEQ ID NO: 1868968 - RNA, 23 nt, Homo sapiens
uauaaagcaguauuuuucuugac

SEQ ID NO: 1868969 - RNA, 15 nt, Homo sapiens
ugaaagagcuuuuag

SEQ ID NO: 1868970 - RNA, 23 nt, Homo sapiens
cuucgauacaccgggccuggaga

SEQ ID NO: 1868971 - RNA, 16 nt, Homo sapiens
cuucuaguucugccag

SEQ ID NO: 1868972 - RNA, 18 nt, Homo sapiens
acuuggugauuaccugaa

SEQ ID NO: 1868973 - RNA, 17 nt, Homo sapiens
agaauauaaaaaacuuu

SEQ ID NO: 1868974 - RNA, 21 nt, Homo sapiens
auugaucuuuugcuaaugcaa

SEQ ID NO: 1868975 - RNA, 17 nt, Homo sapiens
aacacuggaacauucca

SEQ ID NO: 1868976 - RNA, 19 nt, Homo sapiens
uucucugaaaagcaaagga

SEQ ID NO: 1868977 - RNA, 18 nt, Homo sapiens
aauacugauggugcauuu

SEQ ID NO: 1868978 - RNA, 21 nt, Homo sapiens
agcccuuccuaccucugguga

SEQ ID NO: 1868979 - RNA, 23 nt, Homo sapiens
gggaacuuuuuuagaaaugcaaa

SEQ ID NO: 1868980 - RNA, 18 nt, Homo sapiens
acacaguuuugucuucgu

SEQ ID NO: 1868981 - RNA, 19 nt, Homo sapiens
aauuuguaacuuugcagcg

SEQ ID NO: 1868982 - RNA, 17 nt, Homo sapiens
agaagccaucaccucag

SEQ ID NO: 1868983 - RNA, 14 nt, Homo sapiens
ccccgcuggugacc

SEQ ID NO: 1868984 - RNA, 22 nt, Homo sapiens
uaagccagggcacaaccagaaa

SEQ ID NO: 1868985 - RNA, 22 nt, Homo sapiens
acuacauauuugcacugaagca

SEQ ID NO: 1868986 - RNA, 18 nt, Homo sapiens
gucuggucuccucagccu

SEQ ID NO: 1868987 - RNA, 14 nt, Homo sapiens
ccaaguggcaguuu

SEQ ID NO: 1868988 - RNA, 22 nt, Homo sapiens
ugugcgcugacaaccaccgcuc

SEQ ID NO: 1868989 - RNA, 14 nt, Homo sapiens
aagaaauguuauaa

SEQ ID NO: 1868990 - RNA, 22 nt, Homo sapiens
caaaaauuuauuauauauuuac

SEQ ID NO: 1868991 - RNA, 14 nt, Homo sapiens
uguuuauagcaaaa

SEQ ID NO: 1868992 - RNA, 18 nt, Homo sapiens
uguuuccugugcaaguca

SEQ ID NO: 1868993 - RNA, 20 nt, Homo sapiens
aauauuuaauggaaguguau

SEQ ID NO: 1868994 - RNA, 17 nt, Homo sapiens
caugacgggaaaaccaa

SEQ ID NO: 1868995 - RNA, 17 nt, Homo sapiens
ggaccaggucuuguuca

SEQ ID NO: 1868996 - RNA, 20 nt, Homo sapiens
auucauccaguugcaauaaa

SEQ ID NO: 1868997 - RNA, 17 nt, Homo sapiens
uccccucuucugagcua

SEQ ID NO: 1868998 - RNA, 21 nt, Homo sapiens
aggucuuaagaugcaaaucaa

SEQ ID NO: 1868999 - RNA, 16 nt, Homo sapiens
uuccagccuaucuaau

SEQ ID NO: 1869000 - RNA, 21 nt, Homo sapiens
cuaccucagaaagauuugaug

SEQ ID NO: 1869001 - RNA, 16 nt, Homo sapiens
cuuaugauacuugagg

SEQ ID NO: 1869002 - RNA, 20 nt, Homo sapiens
agcaggcuuuuguguucucu

SEQ ID NO: 1869003 - RNA, 18 nt, Homo sapiens
augucucuugagcaucaa

SEQ ID NO: 1869004 - RNA, 20 nt, Homo sapiens
caaggcagcccugucugaag

SEQ ID NO: 1869005 - RNA, 17 nt, Homo sapiens
gcuguugucacaucuca

SEQ ID NO: 1869006 - RNA, 17 nt, Homo sapiens
cccagacagcaaggugu

SEQ ID NO: 1869007 - RNA, 15 nt, Homo sapiens
aaaauauuuugaucu

SEQ ID NO: 1869008 - RNA, 20 nt, Homo sapiens
ccagcuucaggcaccagcau

SEQ ID NO: 1869009 - RNA, 14 nt, Homo sapiens
cuuuauaucugucu

SEQ ID NO: 1869010 - RNA, 16 nt, Homo sapiens
uccugcccaagcacuu

SEQ ID NO: 1869011 - RNA, 16 nt, Homo sapiens
aacugaaucacuuaaa

SEQ ID NO: 1869012 - RNA, 20 nt, Homo sapiens
uugaauguuuucaaaaccaa

SEQ ID NO: 1869013 - RNA, 21 nt, Homo sapiens
gacguuugacuagccaucuca

SEQ ID NO: 1869014 - RNA, 21 nt, Homo sapiens
uucucuguaaguaauugccac

SEQ ID NO: 1869015 - RNA, 17 nt, Homo sapiens
auagaagugcauucucc

SEQ ID NO: 1869016 - RNA, 15 nt, Homo sapiens
accuguaaucccagc

SEQ ID NO: 1869017 - RNA, 19 nt, Homo sapiens
accuaaccacuuagcaugu

SEQ ID NO: 1869018 - RNA, 13 nt, Homo sapiens
accagcucagggg

SEQ ID NO: 1869019 - RNA, 17 nt, Homo sapiens
aauauaaauuaucugaa

SEQ ID NO: 1869020 - RNA, 12 nt, Homo sapiens
aucaguuugcag

SEQ ID NO: 1869021 - RNA, 16 nt, Homo sapiens
uuccucaucugcagaa

SEQ ID NO: 1869022 - RNA, 15 nt, Homo sapiens
uccccgugggccaug

SEQ ID NO: 1869023 - RNA, 16 nt, Homo sapiens
ucacucacagagucaa

SEQ ID NO: 1869024 - RNA, 14 nt, Homo sapiens
uucccguaugcuuu

SEQ ID NO: 1869025 - RNA, 16 nt, Homo sapiens
uggauugcagacucau

SEQ ID NO: 1869026 - RNA, 17 nt, Homo sapiens
agagggauaaaaacaau

SEQ ID NO: 1869027 - RNA, 14 nt, Homo sapiens
caggcacacgccac

SEQ ID NO: 1869028 - RNA, 16 nt, Homo sapiens
cugcacugaaguguga

SEQ ID NO: 1869029 - RNA, 18 nt, Homo sapiens
agacaccuccuucuuccu

SEQ ID NO: 1869030 - RNA, 18 nt, Homo sapiens
ucuugcggcaccgcccac

SEQ ID NO: 1869031 - RNA, 20 nt, Homo sapiens
ccucgaauuuuaucugugga

SEQ ID NO: 1869032 - RNA, 21 nt, Homo sapiens
aaccaacugaacgacaaagca

SEQ ID NO: 1869033 - RNA, 21 nt, Homo sapiens
agggaggaaaguuucuuugaa

SEQ ID NO: 1869034 - RNA, 18 nt, Homo sapiens
uuugcuaagugaggauga

SEQ ID NO: 1869035 - RNA, 14 nt, Homo sapiens
aaugcacuuccuua

SEQ ID NO: 1869036 - RNA, 15 nt, Homo sapiens
uccuuuuguuuacaa

SEQ ID NO: 1869037 - RNA, 14 nt, Homo sapiens
cucuaacauaccuu

SEQ ID NO: 1869038 - RNA, 17 nt, Homo sapiens
uaauaugccuagcacaa

SEQ ID NO: 1869039 - RNA, 14 nt, Homo sapiens
aaggagguagcucc

SEQ ID NO: 1869040 - RNA, 14 nt, Homo sapiens
uacaguaaauucuc

SEQ ID NO: 1869041 - RNA, 14 nt, Homo sapiens
aagucaacauguag

SEQ ID NO: 1869042 - RNA, 19 nt, Homo sapiens
aaaugucuaagguccccac

SEQ ID NO: 1869043 - RNA, 16 nt, Homo sapiens
cauuuaggaguauuau

SEQ ID NO: 1869044 - RNA, 18 nt, Homo sapiens
agggagaaaggagaaauu

SEQ ID NO: 1869045 - RNA, 15 nt, Homo sapiens
auauacaaacaugug

SEQ ID NO: 1869046 - RNA, 19 nt, Homo sapiens
caguauuuucuccacuuca

SEQ ID NO: 1869047 - RNA, 14 nt, Homo sapiens
uccaugaauguauc

SEQ ID NO: 1869048 - RNA, 20 nt, Homo sapiens
ucuaaggcuaagcaucuuca

SEQ ID NO: 1869049 - RNA, 19 nt, Homo sapiens
cggccacaacuacaccacg

SEQ ID NO: 1869050 - RNA, 17 nt, Homo sapiens
auaauggcucuuugaca

SEQ ID NO: 1869051 - RNA, 13 nt, Homo sapiens
ucuguuuaacuuc

SEQ ID NO: 1869052 - RNA, 18 nt, Homo sapiens
uaaaacuauuugcagaug

SEQ ID NO: 1869053 - RNA, 14 nt, Homo sapiens
ugaagaggggccag

SEQ ID NO: 1869054 - RNA, 15 nt, Homo sapiens
cuguuuuucuuuaau

SEQ ID NO: 1869055 - RNA, 15 nt, Homo sapiens
uugcaucuuuucuac

SEQ ID NO: 1869056 - RNA, 16 nt, Homo sapiens
cucccaagcacuucaa

SEQ ID NO: 1869057 - RNA, 20 nt, Homo sapiens
acugaucgugggguugacca

SEQ ID NO: 1869058 - RNA, 18 nt, Homo sapiens
ggaagacuugaagcacag

SEQ ID NO: 1869059 - RNA, 21 nt, Homo sapiens
auuguggaucuuuucauucuc

SEQ ID NO: 1869060 - RNA, 13 nt, Homo sapiens
ugcaaugacugug

SEQ ID NO: 1869061 - RNA, 16 nt, Homo sapiens
uacugcaaucacugug

SEQ ID NO: 1869062 - RNA, 18 nt, Homo sapiens
agccgggacccucaggug

SEQ ID NO: 1869063 - RNA, 16 nt, Homo sapiens
ccuguuccugacuguu

SEQ ID NO: 1869064 - RNA, 23 nt, Homo sapiens
caagaauagaugcugacuguacu

SEQ ID NO: 1869065 - RNA, 17 nt, Homo sapiens
uaaccccuagugucuuu

SEQ ID NO: 1869066 - RNA, 13 nt, Homo sapiens
caaaggcugagaa

SEQ ID NO: 1869067 - RNA, 13 nt, Homo sapiens
uaagauccacaaa

SEQ ID NO: 1869068 - RNA, 23 nt, Homo sapiens
guauaguaaaugccucauuuaau

SEQ ID NO: 1869069 - RNA, 13 nt, Homo sapiens
acaggacauucac

SEQ ID NO: 1869070 - RNA, 12 nt, Homo sapiens
ucccgacaccag

SEQ ID NO: 1869071 - RNA, 17 nt, Homo sapiens
cagaaagggaacagaaa

SEQ ID NO: 1869072 - RNA, 16 nt, Homo sapiens
uuccuggaauugccag

SEQ ID NO: 1869073 - RNA, 21 nt, Homo sapiens
cgggcaggguguggggccaug

SEQ ID NO: 1869074 - RNA, 15 nt, Homo sapiens
gacuugauuuacaau

SEQ ID NO: 1869075 - RNA, 21 nt, Homo sapiens
guuacuguguuuaucuugaua

SEQ ID NO: 1869076 - RNA, 23 nt, Homo sapiens
cugggaagcccggacugaccaaa

SEQ ID NO: 1869077 - RNA, 12 nt, Homo sapiens
acccugucugua

SEQ ID NO: 1869078 - RNA, 19 nt, Homo sapiens
cagaaugcggccucugaga

SEQ ID NO: 1869079 - RNA, 20 nt, Homo sapiens
uaucaaaugaauaaauccuc

SEQ ID NO: 1869080 - RNA, 19 nt, Homo sapiens
acacauaguguuuguaaca

SEQ ID NO: 1869081 - RNA, 19 nt, Homo sapiens
aggacaguggcacaaucau

SEQ ID NO: 1869082 - RNA, 13 nt, Homo sapiens
accuguuacuuga

SEQ ID NO: 1869083 - RNA, 15 nt, Homo sapiens
aggugagcaucaucu

SEQ ID NO: 1869084 - RNA, 19 nt, Homo sapiens
auuacccccuccuucagac

SEQ ID NO: 1869085 - RNA, 18 nt, Homo sapiens
cccuccaaaccuccagcc

SEQ ID NO: 1869086 - RNA, 19 nt, Homo sapiens
ucuuucugaauugcacaug

SEQ ID NO: 1869087 - RNA, 18 nt, Homo sapiens
ggaguuugggcuggagcu

SEQ ID NO: 1869088 - RNA, 22 nt, Homo sapiens
gcagaucuuggaaugaaugaca

SEQ ID NO: 1869089 - RNA, 15 nt, Homo sapiens
cuguuguaauagucc

SEQ ID NO: 1869090 - RNA, 15 nt, Homo sapiens
uguaaggacagaaua

SEQ ID NO: 1869091 - RNA, 14 nt, Homo sapiens
cguaaguacagaga

SEQ ID NO: 1869092 - RNA, 13 nt, Homo sapiens
uuuuagaacaguc

SEQ ID NO: 1869093 - RNA, 15 nt, Homo sapiens
cugaggcauccucug

SEQ ID NO: 1869094 - RNA, 10 nt, Homo sapiens
aauauugcca

SEQ ID NO: 1869095 - RNA, 15 nt, Homo sapiens
uaaagacuugugcau

SEQ ID NO: 1869096 - RNA, 20 nt, Homo sapiens
ucucaaaucaaauacauaca

SEQ ID NO: 1869097 - RNA, 18 nt, Homo sapiens
ucuggaacccagacucag

SEQ ID NO: 1869098 - RNA, 18 nt, Homo sapiens
gauaaaguaaugaucuca

SEQ ID NO: 1869099 - RNA, 14 nt, Homo sapiens
uaucucauuacuua

SEQ ID NO: 1869100 - RNA, 12 nt, Homo sapiens
cugacagccuuu

SEQ ID NO: 1869101 - RNA, 15 nt, Homo sapiens
uuccagcaugcaucc

SEQ ID NO: 1869102 - RNA, 15 nt, Homo sapiens
uuuaacaaugucuga

SEQ ID NO: 1869103 - RNA, 13 nt, Homo sapiens
ugauucaccaaac

SEQ ID NO: 1869104 - RNA, 14 nt, Homo sapiens
guaauaaugugcaa

SEQ ID NO: 1869105 - RNA, 19 nt, Homo sapiens
ucagaaugggaggacucca

SEQ ID NO: 1869106 - RNA, 18 nt, Homo sapiens
gcagauccaccugcacaa

SEQ ID NO: 1869107 - RNA, 21 nt, Homo sapiens
auauuacccucagaauauuaa

SEQ ID NO: 1869108 - RNA, 23 nt, Homo sapiens
auuagugguuuaucagcaaaaaa

SEQ ID NO: 1869109 - RNA, 14 nt, Homo sapiens
aggggcagccugaa

SEQ ID NO: 1869110 - RNA, 15 nt, Homo sapiens
cgcacugcccagguc

SEQ ID NO: 1869111 - RNA, 19 nt, Homo sapiens
aaucuuggagcugcuugga

SEQ ID NO: 1869112 - RNA, 14 nt, Homo sapiens
cuagaaacucuggc

SEQ ID NO: 1869113 - RNA, 19 nt, Homo sapiens
gccaaccggucacccagga

SEQ ID NO: 1869114 - RNA, 16 nt, Homo sapiens
accaggcuggggccag

SEQ ID NO: 1869115 - RNA, 20 nt, Homo sapiens
cacgcagugcggauccggga

SEQ ID NO: 1869116 - RNA, 16 nt, Homo sapiens
uccuuggacuacuugu

SEQ ID NO: 1869117 - RNA, 14 nt, Homo sapiens
cauucagagucagc

SEQ ID NO: 1869118 - RNA, 18 nt, Homo sapiens
uggaggucaggaguuuga

SEQ ID NO: 1869119 - RNA, 19 nt, Homo sapiens
ugcaccaucucacugcagu

SEQ ID NO: 1869120 - RNA, 14 nt, Homo sapiens
aggacagcccuccu

SEQ ID NO: 1869121 - RNA, 19 nt, Homo sapiens
ucaggagcagcaucauuca

SEQ ID NO: 1869122 - RNA, 14 nt, Homo sapiens
cugcccuccaagac

SEQ ID NO: 1869123 - RNA, 19 nt, Homo sapiens
ugggaccugcuucauucaa

SEQ ID NO: 1869124 - RNA, 19 nt, Homo sapiens
acuucucccgugagccagg

SEQ ID NO: 1869125 - RNA, 19 nt, Homo sapiens
acuucuggaugcccaucca

SEQ ID NO: 1869126 - RNA, 14 nt, Homo sapiens
gcuggaaugcagug

SEQ ID NO: 1869127 - RNA, 17 nt, Homo sapiens
ugaaaaucaacccaaua

SEQ ID NO: 1869128 - RNA, 23 nt, Homo sapiens
ucgauuugcacccaccuuucugc

SEQ ID NO: 1869129 - RNA, 12 nt, Homo sapiens
ccuucaaauaca

SEQ ID NO: 1869130 - RNA, 19 nt, Homo sapiens
caguguguguuuaacauuc

SEQ ID NO: 1869131 - RNA, 17 nt, Homo sapiens
uacugcaauauuuggau

SEQ ID NO: 1869132 - RNA, 20 nt, Homo sapiens
uaucacuucauucacauuca

SEQ ID NO: 1869133 - RNA, 15 nt, Homo sapiens
uauaagucaagcaca

SEQ ID NO: 1869134 - RNA, 13 nt, Homo sapiens
aauagugccacaa

SEQ ID NO: 1869135 - RNA, 13 nt, Homo sapiens
augaaaaugucau

SEQ ID NO: 1869136 - RNA, 19 nt, Homo sapiens
acugacuccaaccauucaa

SEQ ID NO: 1869137 - RNA, 15 nt, Homo sapiens
ggugccucagagcag

SEQ ID NO: 1869138 - RNA, 11 nt, Homo sapiens
ucacacuccua

SEQ ID NO: 1869139 - RNA, 14 nt, Homo sapiens
aacuguccagucca

SEQ ID NO: 1869140 - RNA, 20 nt, Homo sapiens
ugaaaaguagagaaauggau

SEQ ID NO: 1869141 - RNA, 15 nt, Homo sapiens
ugaauauuacucuca

SEQ ID NO: 1869142 - RNA, 16 nt, Homo sapiens
aaaaaugugucuguaa

SEQ ID NO: 1869143 - RNA, 17 nt, Homo sapiens
ugcuguugggaaaaccg

SEQ ID NO: 1869144 - RNA, 20 nt, Homo sapiens
ccauccagaugugugcaaug

SEQ ID NO: 1869145 - RNA, 13 nt, Homo sapiens
uaaauaaauggaa

SEQ ID NO: 1869146 - RNA, 22 nt, Homo sapiens
ggcuacuccgugguuuugugac

SEQ ID NO: 1869147 - RNA, 19 nt, Homo sapiens
uggucuguggaucagcauu

SEQ ID NO: 1869148 - RNA, 13 nt, Homo sapiens
guaggcagggaac

SEQ ID NO: 1869149 - RNA, 16 nt, Homo sapiens
uuaagccucaguuaua

SEQ ID NO: 1869150 - RNA, 23 nt, Homo sapiens
agcugcccucuccugggcagcug

SEQ ID NO: 1869151 - RNA, 17 nt, Homo sapiens
ggcuuaggacuucaaaa

SEQ ID NO: 1869152 - RNA, 23 nt, Homo sapiens
gaggugagagaaagccacaaagu

SEQ ID NO: 1869153 - RNA, 21 nt, Homo sapiens
ggucugggacuuccuugcucu

SEQ ID NO: 1869154 - RNA, 18 nt, Homo sapiens
caaaugcaaauucaucau

SEQ ID NO: 1869155 - RNA, 19 nt, Homo sapiens
uuuguauuauuucaccagc

SEQ ID NO: 1869156 - RNA, 14 nt, Homo sapiens
ucguuucucagaag

SEQ ID NO: 1869157 - RNA, 11 nt, Homo sapiens
uugucauugcc

SEQ ID NO: 1869158 - RNA, 18 nt, Homo sapiens
ccagaagaagagaagcug

SEQ ID NO: 1869159 - RNA, 15 nt, Homo sapiens
aaauaucugucauau

SEQ ID NO: 1869160 - RNA, 21 nt, Homo sapiens
ccagagcacacauauaaauuu

SEQ ID NO: 1869161 - RNA, 20 nt, Homo sapiens
cugucucaaaccuccaaaag

SEQ ID NO: 1869162 - RNA, 18 nt, Homo sapiens
gccaggacaugaagaaaa

SEQ ID NO: 1869163 - RNA, 22 nt, Homo sapiens
aagauauuaagucccuuucaaa

SEQ ID NO: 1869164 - RNA, 20 nt, Homo sapiens
cauuaagaauaauugaacaa

SEQ ID NO: 1869165 - RNA, 22 nt, Homo sapiens
caggacggaauauagaggagca

SEQ ID NO: 1869166 - RNA, 18 nt, Homo sapiens
guaaaaugacaaucaugu

SEQ ID NO: 1869167 - RNA, 23 nt, Homo sapiens
ugagccccuggucuucucuacag

SEQ ID NO: 1869168 - RNA, 13 nt, Homo sapiens
cuugucauuccag

SEQ ID NO: 1869169 - RNA, 18 nt, Homo sapiens
guuuguaauacuuuacaa

SEQ ID NO: 1869170 - RNA, 21 nt, Homo sapiens
agcaggccggaaccacagggc

SEQ ID NO: 1869171 - RNA, 20 nt, Homo sapiens
uacacuccucuaucaugcaa

SEQ ID NO: 1869172 - RNA, 16 nt, Homo sapiens
uacauagucaagucca

SEQ ID NO: 1869173 - RNA, 20 nt, Homo sapiens
acaccuaggucgccagugaa

SEQ ID NO: 1869174 - RNA, 15 nt, Homo sapiens
caccaaccacugcga

SEQ ID NO: 1869175 - RNA, 22 nt, Homo sapiens
aaggcucugagcaaauguggcu

SEQ ID NO: 1869176 - RNA, 13 nt, Homo sapiens
ucgugacaacaug

SEQ ID NO: 1869177 - RNA, 13 nt, Homo sapiens
uuaaaacaaugaa

SEQ ID NO: 1869178 - RNA, 20 nt, Homo sapiens
cacuccaaagagaaaccuau

SEQ ID NO: 1869179 - RNA, 14 nt, Homo sapiens
ugaggucacagucc

SEQ ID NO: 1869180 - RNA, 15 nt, Homo sapiens
guucacauccauuac

SEQ ID NO: 1869181 - RNA, 22 nt, Homo sapiens
aaagucacacggcuugugggca

SEQ ID NO: 1869182 - RNA, 23 nt, Homo sapiens
cuccacaauagcagacaguguuu

SEQ ID NO: 1869183 - RNA, 17 nt, Homo sapiens
aucuuagauguuucaca

SEQ ID NO: 1869184 - RNA, 17 nt, Homo sapiens
gaaauccauuccauuuu

SEQ ID NO: 1869185 - RNA, 21 nt, Homo sapiens
ugaggagggcccugaggaaua

SEQ ID NO: 1869186 - RNA, 12 nt, Homo sapiens
aauaacuugaag

SEQ ID NO: 1869187 - RNA, 19 nt, Homo sapiens
gauuaagugcacaccgugu

SEQ ID NO: 1869188 - RNA, 19 nt, Homo sapiens
uuggaucuucaauggcuuu

SEQ ID NO: 1869189 - RNA, 11 nt, Homo sapiens
ucaaaccugug

SEQ ID NO: 1869190 - RNA, 15 nt, Homo sapiens
agcagacacugccuu

SEQ ID NO: 1869191 - RNA, 18 nt, Homo sapiens
agccacugguuucucaga

SEQ ID NO: 1869192 - RNA, 21 nt, Homo sapiens
accacuaucuuuuguucuacc

SEQ ID NO: 1869193 - RNA, 20 nt, Homo sapiens
cuacaaauuuuuacuugaag

SEQ ID NO: 1869194 - RNA, 22 nt, Homo sapiens
caggccuguucccugaggaccu

SEQ ID NO: 1869195 - RNA, 21 nt, Homo sapiens
aaccacaaccuugcaguauuu

SEQ ID NO: 1869196 - RNA, 20 nt, Homo sapiens
auuaucuuuaauaaaauguu

SEQ ID NO: 1869197 - RNA, 14 nt, Homo sapiens
cagcacauugucac

SEQ ID NO: 1869198 - RNA, 20 nt, Homo sapiens
cuccaagguagaauuugcaa

SEQ ID NO: 1869199 - RNA, 18 nt, Homo sapiens
uaacacuguuggcacuua

SEQ ID NO: 1869200 - RNA, 15 nt, Homo sapiens
ugaggagugaacauu

SEQ ID NO: 1869201 - RNA, 22 nt, Homo sapiens
augcagcgccguguccucucug

SEQ ID NO: 1869202 - RNA, 14 nt, Homo sapiens
auacuuaacaaaua

SEQ ID NO: 1869203 - RNA, 22 nt, Homo sapiens
aucaugucuccuuuaacuagca

SEQ ID NO: 1869204 - RNA, 17 nt, Homo sapiens
caucaucuuuaucuccu

SEQ ID NO: 1869205 - RNA, 18 nt, Homo sapiens
uacagaaaugccaaaaau

SEQ ID NO: 1869206 - RNA, 21 nt, Homo sapiens
aacccuaggcaucacaugcuc

SEQ ID NO: 1869207 - RNA, 16 nt, Homo sapiens
guuuagaagagccuga

SEQ ID NO: 1869208 - RNA, 12 nt, Homo sapiens
acacacagcagc

SEQ ID NO: 1869209 - RNA, 15 nt, Homo sapiens
uaggcagugcuaaag

SEQ ID NO: 1869210 - RNA, 20 nt, Homo sapiens
aggcuggagugcagugccac

SEQ ID NO: 1869211 - RNA, 23 nt, Homo sapiens
aggugacuuuccuaugacacuca

SEQ ID NO: 1869212 - RNA, 21 nt, Homo sapiens
cauacccacccuuacuuccug

SEQ ID NO: 1869213 - RNA, 17 nt, Homo sapiens
uccuuggggacaucuca

SEQ ID NO: 1869214 - RNA, 13 nt, Homo sapiens
cccauccaaacac

SEQ ID NO: 1869215 - RNA, 20 nt, Homo sapiens
ggauggcuggcucugcaccu

SEQ ID NO: 1869216 - RNA, 23 nt, Homo sapiens
ggcaugguggugugugccuauag

SEQ ID NO: 1869217 - RNA, 14 nt, Homo sapiens
uggaaaaaugucac

SEQ ID NO: 1869218 - RNA, 13 nt, Homo sapiens
uugccauugcugc

SEQ ID NO: 1869219 - RNA, 17 nt, Homo sapiens
cuuaccgugggcacuga

SEQ ID NO: 1869220 - RNA, 22 nt, Homo sapiens
uuugcaauuggaauaaucacuu

SEQ ID NO: 1869221 - RNA, 12 nt, Homo sapiens
aauauuuuccau

SEQ ID NO: 1869222 - RNA, 15 nt, Homo sapiens
ucacaacuccuucca

SEQ ID NO: 1869223 - RNA, 14 nt, Homo sapiens
uuucaaucaaccaa

SEQ ID NO: 1869224 - RNA, 22 nt, Homo sapiens
uacauagugcaaaacuguguca

SEQ ID NO: 1869225 - RNA, 14 nt, Homo sapiens
ugagaaggugcuuu

SEQ ID NO: 1869226 - RNA, 13 nt, Homo sapiens
uugaacaaacugg

SEQ ID NO: 1869227 - RNA, 12 nt, Homo sapiens
gucacuccaggc

SEQ ID NO: 1869228 - RNA, 18 nt, Homo sapiens
uaaugggaaucauuccac

SEQ ID NO: 1869229 - RNA, 18 nt, Homo sapiens
agggucugccuccagcca

SEQ ID NO: 1869230 - RNA, 15 nt, Homo sapiens
auuuauaacucauca

SEQ ID NO: 1869231 - RNA, 23 nt, Homo sapiens
gaauugagauaauaucugugagg

SEQ ID NO: 1869232 - RNA, 14 nt, Homo sapiens
cuggcucucagaag

SEQ ID NO: 1869233 - RNA, 16 nt, Homo sapiens
agcccaugcuuuccca

SEQ ID NO: 1869234 - RNA, 20 nt, Homo sapiens
cugguguaaucucaaugcaa

SEQ ID NO: 1869235 - RNA, 21 nt, Homo sapiens
agcaguguccugugcuuucug

SEQ ID NO: 1869236 - RNA, 14 nt, Homo sapiens
aaacucaccugccc

SEQ ID NO: 1869237 - RNA, 10 nt, Homo sapiens
uuaugccaug

SEQ ID NO: 1869238 - RNA, 20 nt, Homo sapiens
aagucugcauuucauauuau

SEQ ID NO: 1869239 - RNA, 14 nt, Homo sapiens
cauauauaugcaua

SEQ ID NO: 1869240 - RNA, 12 nt, Homo sapiens
cauaaagcaauu

SEQ ID NO: 1869241 - RNA, 12 nt, Homo sapiens
aaauaagccaaa

SEQ ID NO: 1869242 - RNA, 16 nt, Homo sapiens
cuuuuaaaauacauuu

SEQ ID NO: 1869243 - RNA, 15 nt, Homo sapiens
ugucuggccagggag

SEQ ID NO: 1869244 - RNA, 15 nt, Homo sapiens
uucaugaacuuggcu

SEQ ID NO: 1869245 - RNA, 18 nt, Homo sapiens
agacuuagccccaugagu

SEQ ID NO: 1869246 - RNA, 14 nt, Homo sapiens
caggucaacaucua

SEQ ID NO: 1869247 - RNA, 14 nt, Homo sapiens
uacacacacacaaa

SEQ ID NO: 1869248 - RNA, 16 nt, Homo sapiens
aagagaagaaauagca

SEQ ID NO: 1869249 - RNA, 20 nt, Homo sapiens
auacaauguucuguuguaaa

SEQ ID NO: 1869250 - RNA, 19 nt, Homo sapiens
uacugagucacacaaggga

SEQ ID NO: 1869251 - RNA, 13 nt, Homo sapiens
gaauucacugagu

SEQ ID NO: 1869252 - RNA, 23 nt, Homo sapiens
accauuuguaauaaaguauauaa

SEQ ID NO: 1869253 - RNA, 18 nt, Homo sapiens
guauccugugacauguaa

SEQ ID NO: 1869254 - RNA, 13 nt, Homo sapiens
augugucuugcaa

SEQ ID NO: 1869255 - RNA, 16 nt, Homo sapiens
uaaaacagcugcgaca

SEQ ID NO: 1869256 - RNA, 15 nt, Homo sapiens
guuauagaacuucau

SEQ ID NO: 1869257 - RNA, 14 nt, Homo sapiens
aacugaaauacuuu

SEQ ID NO: 1869258 - RNA, 14 nt, Homo sapiens
aauacuuaacucaa

SEQ ID NO: 1869259 - RNA, 14 nt, Homo sapiens
caaccuuaccaaaa

SEQ ID NO: 1869260 - RNA, 14 nt, Homo sapiens
gacuuuucuaccag

SEQ ID NO: 1869261 - RNA, 14 nt, Homo sapiens
auccugugggaccu

SEQ ID NO: 1869262 - RNA, 15 nt, Homo sapiens
uccccagcugggaag

SEQ ID NO: 1869263 - RNA, 19 nt, Homo sapiens
agcgucauguccuuggcag

SEQ ID NO: 1869264 - RNA, 15 nt, Homo sapiens
auccuaucuggggag

SEQ ID NO: 1869265 - RNA, 13 nt, Homo sapiens
gaaaacacuguca

SEQ ID NO: 1869266 - RNA, 12 nt, Homo sapiens
ugcccauucucu

SEQ ID NO: 1869267 - RNA, 13 nt, Homo sapiens
cauauacauauga

SEQ ID NO: 1869268 - RNA, 22 nt, Homo sapiens
aacugcugcugugcacauuuau

SEQ ID NO: 1869269 - RNA, 14 nt, Homo sapiens
auggaugcauuuca

SEQ ID NO: 1869270 - RNA, 13 nt, Homo sapiens
cuaauaugauuau

SEQ ID NO: 1869271 - RNA, 21 nt, Homo sapiens
cauuucugucucucucugucc

SEQ ID NO: 1869272 - RNA, 15 nt, Homo sapiens
auucaugcaucucaa

SEQ ID NO: 1869273 - RNA, 21 nt, Homo sapiens
cacaugugagcaugucacuuc

SEQ ID NO: 1869274 - RNA, 22 nt, Homo sapiens
auguggccuaaaaaugcaacuu

SEQ ID NO: 1869275 - RNA, 14 nt, Homo sapiens
gguccugaagugac

SEQ ID NO: 1869276 - RNA, 20 nt, Homo sapiens
auaaccaacccuucccugaa

SEQ ID NO: 1869277 - RNA, 21 nt, Homo sapiens
gcugaaggaaaccagugcaac

SEQ ID NO: 1869278 - RNA, 21 nt, Homo sapiens
aggucccugagcucuugcuau

SEQ ID NO: 1869279 - RNA, 15 nt, Homo sapiens
cuacccuaaagggag

SEQ ID NO: 1869280 - RNA, 16 nt, Homo sapiens
acaggagacccagaga

SEQ ID NO: 1869281 - RNA, 20 nt, Homo sapiens
ccuggauggggcuuccagcu

SEQ ID NO: 1869282 - RNA, 12 nt, Homo sapiens
gccagaagucaa

SEQ ID NO: 1869283 - RNA, 18 nt, Homo sapiens
gccaaggggucugcuccu

SEQ ID NO: 1869284 - RNA, 19 nt, Homo sapiens
aauagcagccuuucucucu

SEQ ID NO: 1869285 - RNA, 17 nt, Homo sapiens
uuugcuaagagccagag

SEQ ID NO: 1869286 - RNA, 21 nt, Homo sapiens
gaagagccugcaggugcugcu

SEQ ID NO: 1869287 - RNA, 17 nt, Homo sapiens
aaaggccaucagagcaa

SEQ ID NO: 1869288 - RNA, 20 nt, Homo sapiens
agaggaucuccuguccauca

SEQ ID NO: 1869289 - RNA, 18 nt, Homo sapiens
cagugccauuuguuaaaa

SEQ ID NO: 1869290 - RNA, 21 nt, Homo sapiens
ccuccuuacauaugcaaaaau

SEQ ID NO: 1869291 - RNA, 17 nt, Homo sapiens
ggaaaaauauuuuacua

SEQ ID NO: 1869292 - RNA, 13 nt, Homo sapiens
aguucugaugcuu

SEQ ID NO: 1869293 - RNA, 18 nt, Homo sapiens
caaagcuuuuuucauuua

SEQ ID NO: 1869294 - RNA, 19 nt, Homo sapiens
ucuggacaccaggggaccu

SEQ ID NO: 1869295 - RNA, 14 nt, Homo sapiens
cauugggauauucu

SEQ ID NO: 1869296 - RNA, 15 nt, Homo sapiens
aucuaucccagagua

SEQ ID NO: 1869297 - RNA, 15 nt, Homo sapiens
aaauacuauuggaca

SEQ ID NO: 1869298 - RNA, 15 nt, Homo sapiens
uuauggaaaaggggu

SEQ ID NO: 1869299 - RNA, 13 nt, Homo sapiens
ggaacagaauguu

SEQ ID NO: 1869300 - RNA, 19 nt, Homo sapiens
gaguggccuagagcacucu

SEQ ID NO: 1869301 - RNA, 22 nt, Homo sapiens
cugcccuguacaugcuaguuca

SEQ ID NO: 1869302 - RNA, 17 nt, Homo sapiens
aaugaaacuuguggaga

SEQ ID NO: 1869303 - RNA, 13 nt, Homo sapiens
acuaugugcaaaa

SEQ ID NO: 1869304 - RNA, 15 nt, Homo sapiens
cguucucacacccac

SEQ ID NO: 1869305 - RNA, 23 nt, Homo sapiens
ccaacuuucccuccaccagugug

SEQ ID NO: 1869306 - RNA, 21 nt, Homo sapiens
ucagacuucauaagcgcagca

SEQ ID NO: 1869307 - RNA, 17 nt, Homo sapiens
auuugguuaugauggaa

SEQ ID NO: 1869308 - RNA, 18 nt, Homo sapiens
uuacuguucuugcugcua

SEQ ID NO: 1869309 - RNA, 17 nt, Homo sapiens
acauggaggaacaguau

SEQ ID NO: 1869310 - RNA, 13 nt, Homo sapiens
acauagcaucuca

SEQ ID NO: 1869311 - RNA, 22 nt, Homo sapiens
auucaccugcccugugcauguc

SEQ ID NO: 1869312 - RNA, 15 nt, Homo sapiens
ugacccacugaucuc

SEQ ID NO: 1869313 - RNA, 18 nt, Homo sapiens
gugccauaaaaugugcuu

SEQ ID NO: 1869314 - RNA, 22 nt, Homo sapiens
gguauugugugagugcaugugu

SEQ ID NO: 1869315 - RNA, 16 nt, Homo sapiens
ccugcagaauccagcu

SEQ ID NO: 1869316 - RNA, 20 nt, Homo sapiens
ggguccacccagcaaagagu

SEQ ID NO: 1869317 - RNA, 16 nt, Homo sapiens
acuguaaucagguuau

SEQ ID NO: 1869318 - RNA, 18 nt, Homo sapiens
cucccacaucccccgugu

SEQ ID NO: 1869319 - RNA, 11 nt, Homo sapiens
caguguugccc

SEQ ID NO: 1869320 - RNA, 11 nt, Homo sapiens
accuguugaag

SEQ ID NO: 1869321 - RNA, 16 nt, Homo sapiens
auguucugugacugaa

SEQ ID NO: 1869322 - RNA, 13 nt, Homo sapiens
ucaaucaugucag

SEQ ID NO: 1869323 - RNA, 14 nt, Homo sapiens
ggucaagggccagu

SEQ ID NO: 1869324 - RNA, 21 nt, Homo sapiens
auaacuuuugguaucuacuuc

SEQ ID NO: 1869325 - RNA, 14 nt, Homo sapiens
auuacauuggcaca

SEQ ID NO: 1869326 - RNA, 13 nt, Homo sapiens
augcuugcugcug

SEQ ID NO: 1869327 - RNA, 15 nt, Homo sapiens
gugagaugcuggaga

SEQ ID NO: 1869328 - RNA, 15 nt, Homo sapiens
ccugggcugugaugu

SEQ ID NO: 1869329 - RNA, 14 nt, Homo sapiens
ucacagcugcagcu

SEQ ID NO: 1869330 - RNA, 13 nt, Homo sapiens
aaggugacuaaga

SEQ ID NO: 1869331 - RNA, 15 nt, Homo sapiens
uucaguuaauucuua

SEQ ID NO: 1869332 - RNA, 21 nt, Homo sapiens
cugucugggcucagacaucca

SEQ ID NO: 1869333 - RNA, 13 nt, Homo sapiens
aaaagaacauaaa

SEQ ID NO: 1869334 - RNA, 13 nt, Homo sapiens
cuaagaaccaaaa

SEQ ID NO: 1869335 - RNA, 14 nt, Homo sapiens
aauuaaaguauaca

SEQ ID NO: 1869336 - RNA, 19 nt, Homo sapiens
ccacuucuccaugcugcaa

SEQ ID NO: 1869337 - RNA, 15 nt, Homo sapiens
auccuucuaagacau

SEQ ID NO: 1869338 - RNA, 16 nt, Homo sapiens
caaaaucaacaugacu

SEQ ID NO: 1869339 - RNA, 20 nt, Homo sapiens
uccaugcaccuaccuuagaa

SEQ ID NO: 1869340 - RNA, 15 nt, Homo sapiens
aguuucguaugcacu

SEQ ID NO: 1869341 - RNA, 18 nt, Homo sapiens
uccugaccucaagugauc

SEQ ID NO: 1869342 - RNA, 16 nt, Homo sapiens
ugacuguguuugcauu

SEQ ID NO: 1869343 - RNA, 16 nt, Homo sapiens
aaucacuggugcuaua

SEQ ID NO: 1869344 - RNA, 19 nt, Homo sapiens
gccacuuuugugugugucu

SEQ ID NO: 1869345 - RNA, 14 nt, Homo sapiens
auguacuaugucug

SEQ ID NO: 1869346 - RNA, 16 nt, Homo sapiens
cgugauaaugcagaua

SEQ ID NO: 1869347 - RNA, 13 nt, Homo sapiens
aggaaccuuccuu

SEQ ID NO: 1869348 - RNA, 11 nt, Homo sapiens
ugcacuccaga

SEQ ID NO: 1869349 - RNA, 15 nt, Homo sapiens
cacauacaccacaaa

SEQ ID NO: 1869350 - RNA, 16 nt, Homo sapiens
gccccaucagcagcuu

SEQ ID NO: 1869351 - RNA, 19 nt, Homo sapiens
aacuauguucacaagaaca

SEQ ID NO: 1869352 - RNA, 18 nt, Homo sapiens
uccaacucuuccaccucu

SEQ ID NO: 1869353 - RNA, 13 nt, Homo sapiens
aauucugguauac

SEQ ID NO: 1869354 - RNA, 12 nt, Homo sapiens
caacagaugugu

SEQ ID NO: 1869355 - RNA, 22 nt, Homo sapiens
acccagucagaguugugcacau

SEQ ID NO: 1869356 - RNA, 15 nt, Homo sapiens
ccucccugcacucau

SEQ ID NO: 1869357 - RNA, 16 nt, Homo sapiens
uguauucagaggcagu

SEQ ID NO: 1869358 - RNA, 16 nt, Homo sapiens
auucucacccugugaa

SEQ ID NO: 1869359 - RNA, 14 nt, Homo sapiens
gcaaagacaggagg

SEQ ID NO: 1869360 - RNA, 17 nt, Homo sapiens
gucuugacgggagcauu

SEQ ID NO: 1869361 - RNA, 13 nt, Homo sapiens
cuagauuacuuuu

SEQ ID NO: 1869362 - RNA, 15 nt, Homo sapiens
ggugcccucucaggu

SEQ ID NO: 1869363 - RNA, 22 nt, Homo sapiens
gaggucuccaucauggcaguga

SEQ ID NO: 1869364 - RNA, 15 nt, Homo sapiens
cccacgagcacuuua

SEQ ID NO: 1869365 - RNA, 17 nt, Homo sapiens
cuucccagcaauuauua

SEQ ID NO: 1869366 - RNA, 16 nt, Homo sapiens
gagcugagcacuuuug

SEQ ID NO: 1869367 - RNA, 19 nt, Homo sapiens
aauuguuuaaaaaccgaau

SEQ ID NO: 1869368 - RNA, 14 nt, Homo sapiens
aggcaaugggcuac

SEQ ID NO: 1869369 - RNA, 20 nt, Homo sapiens
gcuucuccaauucugcccaa

SEQ ID NO: 1869370 - RNA, 13 nt, Homo sapiens
caucacaugacca

SEQ ID NO: 1869371 - RNA, 16 nt, Homo sapiens
uucacguguaccugug

SEQ ID NO: 1869372 - RNA, 20 nt, Homo sapiens
gcaagagaacaauguuucuu

SEQ ID NO: 1869373 - RNA, 23 nt, Homo sapiens
caguagaaagcauaacaaaaaga

SEQ ID NO: 1869374 - RNA, 22 nt, Homo sapiens
uagcaaaagcagaacacacucu

SEQ ID NO: 1869375 - RNA, 22 nt, Homo sapiens
uuuugucacaauuauagauuag

SEQ ID NO: 1869376 - RNA, 20 nt, Homo sapiens
uacuugugaaacacagcugu

SEQ ID NO: 1869377 - RNA, 15 nt, Homo sapiens
cgugagccaccaaac

SEQ ID NO: 1869378 - RNA, 15 nt, Homo sapiens
uuccacugauggaaa

SEQ ID NO: 1869379 - RNA, 15 nt, Homo sapiens
cuugaagggcccaga

SEQ ID NO: 1869380 - RNA, 13 nt, Homo sapiens
guaaaugugcauu

SEQ ID NO: 1869381 - RNA, 15 nt, Homo sapiens
uggcugaugaugucu

SEQ ID NO: 1869382 - RNA, 15 nt, Homo sapiens
guguuuagaaaucau

SEQ ID NO: 1869383 - RNA, 21 nt, Homo sapiens
caucugaaaagaaaugcuaau

SEQ ID NO: 1869384 - RNA, 18 nt, Homo sapiens
ccagguccucacagcagu

SEQ ID NO: 1869385 - RNA, 14 nt, Homo sapiens
aguaaaccugaaca

SEQ ID NO: 1869386 - RNA, 21 nt, Homo sapiens
aguguuuuggacuccaucucu

SEQ ID NO: 1869387 - RNA, 16 nt, Homo sapiens
gaaaauuuuacuucca

SEQ ID NO: 1869388 - RNA, 21 nt, Homo sapiens
cauaaagauguuaaauggaau

SEQ ID NO: 1869389 - RNA, 21 nt, Homo sapiens
ucaaaccaauuucuuccuucc

SEQ ID NO: 1869390 - RNA, 14 nt, Homo sapiens
auucugagauccag

SEQ ID NO: 1869391 - RNA, 22 nt, Homo sapiens
uccagcuggccgggagccugau

SEQ ID NO: 1869392 - RNA, 19 nt, Homo sapiens
aaugacgugccuaccucuu

SEQ ID NO: 1869393 - RNA, 14 nt, Homo sapiens
ucacuccacuugga

SEQ ID NO: 1869394 - RNA, 20 nt, Homo sapiens
cugauuacuuguaauuauga

SEQ ID NO: 1869395 - RNA, 22 nt, Homo sapiens
accgugauggagaggacagagc

SEQ ID NO: 1869396 - RNA, 15 nt, Homo sapiens
ucugccaaccccagg

SEQ ID NO: 1869397 - RNA, 20 nt, Homo sapiens
agaagcuuaaaaucugugaa

SEQ ID NO: 1869398 - RNA, 17 nt, Homo sapiens
cagggugaggugcuuga

SEQ ID NO: 1869399 - RNA, 18 nt, Homo sapiens
aggaacuaugaaaaccag

SEQ ID NO: 1869400 - RNA, 20 nt, Homo sapiens
gaugaauagaugugaucacu

SEQ ID NO: 1869401 - RNA, 19 nt, Homo sapiens
ucugagauaggagauacaa

SEQ ID NO: 1869402 - RNA, 12 nt, Homo sapiens
uuaaacucaggg

SEQ ID NO: 1869403 - RNA, 19 nt, Homo sapiens
cuggcacuuagcccaagag

SEQ ID NO: 1869404 - RNA, 14 nt, Homo sapiens
ucuauuguuaccuc

SEQ ID NO: 1869405 - RNA, 11 nt, Homo sapiens
uacacaugaca

SEQ ID NO: 1869406 - RNA, 11 nt, Homo sapiens
cacugcuguac

SEQ ID NO: 1869407 - RNA, 11 nt, Homo sapiens
uuaugcugcua

SEQ ID NO: 1869408 - RNA, 20 nt, Homo sapiens
aacccaucacugugucucau

SEQ ID NO: 1869409 - RNA, 21 nt, Homo sapiens
cugaguccgccugcgccucca

SEQ ID NO: 1869410 - RNA, 14 nt, Homo sapiens
uuuggauguuucca

SEQ ID NO: 1869411 - RNA, 12 nt, Homo sapiens
acauucuuggcu

SEQ ID NO: 1869412 - RNA, 19 nt, Homo sapiens
uaaaacaauaaaugaauga

SEQ ID NO: 1869413 - RNA, 13 nt, Homo sapiens
agugguacuugau

SEQ ID NO: 1869414 - RNA, 20 nt, Homo sapiens
gcaucauuuacaagacaaca

SEQ ID NO: 1869415 - RNA, 19 nt, Homo sapiens
uuugcuuuuuuaaacuuga

SEQ ID NO: 1869416 - RNA, 15 nt, Homo sapiens
accagaaagcaguug

SEQ ID NO: 1869417 - RNA, 18 nt, Homo sapiens
cuauacugguuauaguug

SEQ ID NO: 1869418 - RNA, 18 nt, Homo sapiens
auggcccaaauccagugu

SEQ ID NO: 1869419 - RNA, 20 nt, Homo sapiens
uacaugcuuauuccaugacu

SEQ ID NO: 1869420 - RNA, 22 nt, Homo sapiens
caaggcaaggaaggguguugca

SEQ ID NO: 1869421 - RNA, 17 nt, Homo sapiens
auguuuggaaaccacag

SEQ ID NO: 1869422 - RNA, 16 nt, Homo sapiens
guccuagugucuauuc

SEQ ID NO: 1869423 - RNA, 12 nt, Homo sapiens
acucucuugcac

SEQ ID NO: 1869424 - RNA, 15 nt, Homo sapiens
uaaguccaaauccaa

SEQ ID NO: 1869425 - RNA, 14 nt, Homo sapiens
acccguuaccauau

SEQ ID NO: 1869426 - RNA, 17 nt, Homo sapiens
aaggaaaugucauguga

SEQ ID NO: 1869427 - RNA, 17 nt, Homo sapiens
auuuuguguaagaaaua

SEQ ID NO: 1869428 - RNA, 17 nt, Homo sapiens
caaacuugagucacaaa

SEQ ID NO: 1869429 - RNA, 12 nt, Homo sapiens
acaagauugaaa

SEQ ID NO: 1869430 - RNA, 12 nt, Homo sapiens
aaaagauugcaa

SEQ ID NO: 1869431 - RNA, 15 nt, Homo sapiens
ccauacuucucucag

SEQ ID NO: 1869432 - RNA, 19 nt, Homo sapiens
gauggaccagugguuucca

SEQ ID NO: 1869433 - RNA, 20 nt, Homo sapiens
uucuccaugcugagaacaaa

SEQ ID NO: 1869434 - RNA, 13 nt, Homo sapiens
uccuucgcuuucc

SEQ ID NO: 1869435 - RNA, 15 nt, Homo sapiens
auuucaugugcuaua

SEQ ID NO: 1869436 - RNA, 12 nt, Homo sapiens
aaugccacagug

SEQ ID NO: 1869437 - RNA, 11 nt, Homo sapiens
uugagacagag

SEQ ID NO: 1869438 - RNA, 20 nt, Homo sapiens
guuaaacuuauaacccacuu

SEQ ID NO: 1869439 - RNA, 14 nt, Homo sapiens
acaguaaaucucac

SEQ ID NO: 1869440 - RNA, 15 nt, Homo sapiens
acugcuuaauucaaa

SEQ ID NO: 1869441 - RNA, 13 nt, Homo sapiens
cuucuuuucucau

SEQ ID NO: 1869442 - RNA, 13 nt, Homo sapiens
auucaauacaggc

SEQ ID NO: 1869443 - RNA, 15 nt, Homo sapiens
cuucaggccuugccu

SEQ ID NO: 1869444 - RNA, 22 nt, Homo sapiens
ggcacuuggguguggcuccucu

SEQ ID NO: 1869445 - RNA, 12 nt, Homo sapiens
guauuuugccag

SEQ ID NO: 1869446 - RNA, 17 nt, Homo sapiens
accaugagaaaucaugc

SEQ ID NO: 1869447 - RNA, 20 nt, Homo sapiens
uuaagcagggagcugggcua

SEQ ID NO: 1869448 - RNA, 21 nt, Homo sapiens
ggugucaagugccugcaccag

SEQ ID NO: 1869449 - RNA, 12 nt, Homo sapiens
ugccugugccag

SEQ ID NO: 1869450 - RNA, 14 nt, Homo sapiens
cagcagugaucuca

SEQ ID NO: 1869451 - RNA, 20 nt, Homo sapiens
gcuguugcaugggcuaauga

SEQ ID NO: 1869452 - RNA, 14 nt, Homo sapiens
ccaggccucaggga

SEQ ID NO: 1869453 - RNA, 15 nt, Homo sapiens
cauaaacagcauuua

SEQ ID NO: 1869454 - RNA, 13 nt, Homo sapiens
aauugauuauucu

SEQ ID NO: 1869455 - RNA, 19 nt, Homo sapiens
cugagcuggcccuugggga

SEQ ID NO: 1869456 - RNA, 16 nt, Homo sapiens
guuucuguugcuguua

SEQ ID NO: 1869457 - RNA, 12 nt, Homo sapiens
cugccuguaacu

SEQ ID NO: 1869458 - RNA, 18 nt, Homo sapiens
gcacugcccuuuucagga

SEQ ID NO: 1869459 - RNA, 18 nt, Homo sapiens
gucuuuauaaugggauau

SEQ ID NO: 1869460 - RNA, 20 nt, Homo sapiens
aauguacaaaaagaacaaua

SEQ ID NO: 1869461 - RNA, 14 nt, Homo sapiens
aaggauagacauac

SEQ ID NO: 1869462 - RNA, 19 nt, Homo sapiens
ugaccuaguagaguguaau

SEQ ID NO: 1869463 - RNA, 17 nt, Homo sapiens
aacacagcaugcauuua

SEQ ID NO: 1869464 - RNA, 16 nt, Homo sapiens
agugaaaacaucugca

SEQ ID NO: 1869465 - RNA, 18 nt, Homo sapiens
uaaauauuggauuauauc

SEQ ID NO: 1869466 - RNA, 22 nt, Homo sapiens
cuucccugucugccagggccag

SEQ ID NO: 1869467 - RNA, 15 nt, Homo sapiens
cccacagaaccuuca

SEQ ID NO: 1869468 - RNA, 21 nt, Homo sapiens
ucucagucauuuuuaaccucu

SEQ ID NO: 1869469 - RNA, 16 nt, Homo sapiens
agucuuugcuauugug

SEQ ID NO: 1869470 - RNA, 20 nt, Homo sapiens
ccacacugagagaguggaga

SEQ ID NO: 1869471 - RNA, 20 nt, Homo sapiens
uguauauuguggauguguuc

SEQ ID NO: 1869472 - RNA, 12 nt, Homo sapiens
aaccaaugagcu

SEQ ID NO: 1869473 - RNA, 23 nt, Homo sapiens
accuuuucccugcaccacucucu

SEQ ID NO: 1869474 - RNA, 21 nt, Homo sapiens
uaaauguagcgacugucaaca

SEQ ID NO: 1869475 - RNA, 20 nt, Homo sapiens
aggguuucaccauguuggcu

SEQ ID NO: 1869476 - RNA, 16 nt, Homo sapiens
uccagugauaccuugu

SEQ ID NO: 1869477 - RNA, 22 nt, Homo sapiens
aaaaucugugaccugucagaau

SEQ ID NO: 1869478 - RNA, 22 nt, Homo sapiens
agaguguggggaaugggaagaa

SEQ ID NO: 1869479 - RNA, 19 nt, Homo sapiens
agcaaauacaggaguuuuc

SEQ ID NO: 1869480 - RNA, 22 nt, Homo sapiens
agucaaaacagagaugugauaa

SEQ ID NO: 1869481 - RNA, 22 nt, Homo sapiens
gucuaauucauuuacucaccau

SEQ ID NO: 1869482 - RNA, 19 nt, Homo sapiens
accuccucccuaaugcuca

SEQ ID NO: 1869483 - RNA, 22 nt, Homo sapiens
uugagaagccuucagcuccagg

SEQ ID NO: 1869484 - RNA, 22 nt, Homo sapiens
aaacuuuuguuuagagcccucc

SEQ ID NO: 1869485 - RNA, 17 nt, Homo sapiens
uaauuuugcuugcugaa

SEQ ID NO: 1869486 - RNA, 16 nt, Homo sapiens
ccaaacaucuuucagc

SEQ ID NO: 1869487 - RNA, 15 nt, Homo sapiens
ugguaaaauacauau

SEQ ID NO: 1869488 - RNA, 15 nt, Homo sapiens
ugguccucaggggag

SEQ ID NO: 1869489 - RNA, 15 nt, Homo sapiens
ggcagaucaugaagc

SEQ ID NO: 1869490 - RNA, 20 nt, Homo sapiens
gcccagggugccugcacuuu

SEQ ID NO: 1869491 - RNA, 22 nt, Homo sapiens
uccuguaaaagauacugaggaa

SEQ ID NO: 1869492 - RNA, 16 nt, Homo sapiens
auguaauuuaggguac

SEQ ID NO: 1869493 - RNA, 14 nt, Homo sapiens
ucugcagcucugac

SEQ ID NO: 1869494 - RNA, 10 nt, Homo sapiens
uuagucaauc

SEQ ID NO: 1869495 - RNA, 20 nt, Homo sapiens
gcagacauagaagagccaag

SEQ ID NO: 1869496 - RNA, 21 nt, Homo sapiens
cauuuuguauacccugaagaa

SEQ ID NO: 1869497 - RNA, 16 nt, Homo sapiens
ggauggguggaccaaa

SEQ ID NO: 1869498 - RNA, 22 nt, Homo sapiens
agauuauagaaguagcaaaaag

SEQ ID NO: 1869499 - RNA, 16 nt, Homo sapiens
uuagaccaaaagauuc

SEQ ID NO: 1869500 - RNA, 16 nt, Homo sapiens
uaauguccauaugcua

SEQ ID NO: 1869501 - RNA, 14 nt, Homo sapiens
gauuugaggacuug

SEQ ID NO: 1869502 - RNA, 19 nt, Homo sapiens
ucaaaucagagcagugauu

SEQ ID NO: 1869503 - RNA, 20 nt, Homo sapiens
agugugacuucuuacacaua

SEQ ID NO: 1869504 - RNA, 20 nt, Homo sapiens
gacagugcccagagugacag

SEQ ID NO: 1869505 - RNA, 20 nt, Homo sapiens
aacaagcccuaacuucugua

SEQ ID NO: 1869506 - RNA, 21 nt, Homo sapiens
gggcuugugauuuccauuucu

SEQ ID NO: 1869507 - RNA, 22 nt, Homo sapiens
ggucaccucacucagcaccacu

SEQ ID NO: 1869508 - RNA, 16 nt, Homo sapiens
cggccacucccugcca

SEQ ID NO: 1869509 - RNA, 21 nt, Homo sapiens
uaacuagguugacagauacuu

SEQ ID NO: 1869510 - RNA, 19 nt, Homo sapiens
aauagguuucaacauauga

SEQ ID NO: 1869511 - RNA, 21 nt, Homo sapiens
guacccaggcuuuagcauuau

SEQ ID NO: 1869512 - RNA, 19 nt, Homo sapiens
gaaucuauuguuucuccuc

SEQ ID NO: 1869513 - RNA, 18 nt, Homo sapiens
augcagugucagcuccuc

SEQ ID NO: 1869514 - RNA, 17 nt, Homo sapiens
aacagcucgauccaaau

SEQ ID NO: 1869515 - RNA, 20 nt, Homo sapiens
ggcugugcuagcaacaccca

SEQ ID NO: 1869516 - RNA, 14 nt, Homo sapiens
cucagaugcacaug

SEQ ID NO: 1869517 - RNA, 20 nt, Homo sapiens
accgaguuugcuaaauugag

SEQ ID NO: 1869518 - RNA, 20 nt, Homo sapiens
aauuuaagaauuugugacau

SEQ ID NO: 1869519 - RNA, 16 nt, Homo sapiens
agauuccuaugaugga

SEQ ID NO: 1869520 - RNA, 14 nt, Homo sapiens
caucugauaugcag

SEQ ID NO: 1869521 - RNA, 17 nt, Homo sapiens
uuuaaggggaucuaaaa

SEQ ID NO: 1869522 - RNA, 13 nt, Homo sapiens
ucaucacuuugac

SEQ ID NO: 1869523 - RNA, 17 nt, Homo sapiens
ugaguaauacaucaaag

SEQ ID NO: 1869524 - RNA, 17 nt, Homo sapiens
cucaugguuaaugcagg

SEQ ID NO: 1869525 - RNA, 17 nt, Homo sapiens
agaguagaugcuugcuc

SEQ ID NO: 1869526 - RNA, 19 nt, Homo sapiens
ucuccaccagcccuacucc

SEQ ID NO: 1869527 - RNA, 17 nt, Homo sapiens
ugcauccccaacuuagc

SEQ ID NO: 1869528 - RNA, 18 nt, Homo sapiens
accagagcccacuuccau

SEQ ID NO: 1869529 - RNA, 16 nt, Homo sapiens
gugaugggaucuguaa

SEQ ID NO: 1869530 - RNA, 19 nt, Homo sapiens
acagucauauaaacguccu

SEQ ID NO: 1869531 - RNA, 15 nt, Homo sapiens
agucugagaaagccu

SEQ ID NO: 1869532 - RNA, 12 nt, Homo sapiens
guuaaaacaaag

SEQ ID NO: 1869533 - RNA, 21 nt, Homo sapiens
aaucacagcacccacuaccau

SEQ ID NO: 1869534 - RNA, 15 nt, Homo sapiens
uuuggagagcugcuu

SEQ ID NO: 1869535 - RNA, 16 nt, Homo sapiens
guaaggcagugcagua

SEQ ID NO: 1869536 - RNA, 11 nt, Homo sapiens
agcaugaucuu

SEQ ID NO: 1869537 - RNA, 16 nt, Homo sapiens
aggugccuaaccuggg

SEQ ID NO: 1869538 - RNA, 15 nt, Homo sapiens
aacucaaccuggaca

SEQ ID NO: 1869539 - RNA, 18 nt, Homo sapiens
uaccuauuucugaugaug

SEQ ID NO: 1869540 - RNA, 16 nt, Homo sapiens
acagaccgccaaauaa

SEQ ID NO: 1869541 - RNA, 17 nt, Homo sapiens
cucaaaugauccuccca

SEQ ID NO: 1869542 - RNA, 13 nt, Homo sapiens
cuucucugcaaug

SEQ ID NO: 1869543 - RNA, 13 nt, Homo sapiens
uugccccaugaga

SEQ ID NO: 1869544 - RNA, 21 nt, Homo sapiens
auaaacauugguauauuucca

SEQ ID NO: 1869545 - RNA, 15 nt, Homo sapiens
uucucauucccaugu

SEQ ID NO: 1869546 - RNA, 18 nt, Homo sapiens
uacagagaugcaaugaua

SEQ ID NO: 1869547 - RNA, 14 nt, Homo sapiens
uuaaacugauucau

SEQ ID NO: 1869548 - RNA, 13 nt, Homo sapiens
acuugaagcacuu

SEQ ID NO: 1869549 - RNA, 13 nt, Homo sapiens
ucaauagcuccaa

SEQ ID NO: 1869550 - RNA, 13 nt, Homo sapiens
caaauagccacaa

SEQ ID NO: 1869551 - RNA, 19 nt, Homo sapiens
gaaugugucucaggaaaac

SEQ ID NO: 1869552 - RNA, 15 nt, Homo sapiens
cagcgagcugugcaa

SEQ ID NO: 1869553 - RNA, 15 nt, Homo sapiens
agcugucaggcagua

SEQ ID NO: 1869554 - RNA, 15 nt, Homo sapiens
gcccugcucccugcc

SEQ ID NO: 1869555 - RNA, 13 nt, Homo sapiens
cuugacugcauua

SEQ ID NO: 1869556 - RNA, 13 nt, Homo sapiens
uaagucuguuauu

SEQ ID NO: 1869557 - RNA, 13 nt, Homo sapiens
cauuucuguucca

SEQ ID NO: 1869558 - RNA, 19 nt, Homo sapiens
uuguuuccucgcugaucga

SEQ ID NO: 1869559 - RNA, 15 nt, Homo sapiens
ccaggcuggucuuga

SEQ ID NO: 1869560 - RNA, 17 nt, Homo sapiens
acggacaauaaaccucc

SEQ ID NO: 1869561 - RNA, 21 nt, Homo sapiens
uagagguuuuaaagugauuaa

SEQ ID NO: 1869562 - RNA, 19 nt, Homo sapiens
cacuucccaucuccaggga

SEQ ID NO: 1869563 - RNA, 22 nt, Homo sapiens
ucauguaugaugagcauacaca

SEQ ID NO: 1869564 - RNA, 16 nt, Homo sapiens
caaaaaugggcagcca

SEQ ID NO: 1869565 - RNA, 23 nt, Homo sapiens
ucccauuuugauggugucuguga

SEQ ID NO: 1869566 - RNA, 15 nt, Homo sapiens
ucuguguacugaaca

SEQ ID NO: 1869567 - RNA, 21 nt, Homo sapiens
gagccaagaucgcaccacugc

SEQ ID NO: 1869568 - RNA, 14 nt, Homo sapiens
acauucccacugcc

SEQ ID NO: 1869569 - RNA, 16 nt, Homo sapiens
gacuccaauggggcca

SEQ ID NO: 1869570 - RNA, 15 nt, Homo sapiens
uugugucuguacacg

SEQ ID NO: 1869571 - RNA, 19 nt, Homo sapiens
uguaaaaauguuacgugaa

SEQ ID NO: 1869572 - RNA, 17 nt, Homo sapiens
ugaaguacuaagcgcua

SEQ ID NO: 1869573 - RNA, 19 nt, Homo sapiens
guucucaugaacuacccca

SEQ ID NO: 1869574 - RNA, 18 nt, Homo sapiens
caaucuauguuugcacuu

SEQ ID NO: 1869575 - RNA, 20 nt, Homo sapiens
ccuguguuccucaaucacac

SEQ ID NO: 1869576 - RNA, 15 nt, Homo sapiens
gaugaaggcuuguca

SEQ ID NO: 1869577 - RNA, 22 nt, Homo sapiens
aacaacuaggcuucagcauauu

SEQ ID NO: 1869578 - RNA, 14 nt, Homo sapiens
auguaacaguuuaa

SEQ ID NO: 1869579 - RNA, 11 nt, Homo sapiens
uuuuggucaaa

SEQ ID NO: 1869580 - RNA, 23 nt, Homo sapiens
agucuuucccuggugauggucuc

SEQ ID NO: 1869581 - RNA, 17 nt, Homo sapiens
agagacagauaccucca

SEQ ID NO: 1869582 - RNA, 12 nt, Homo sapiens
uaaugagccauu

SEQ ID NO: 1869583 - RNA, 16 nt, Homo sapiens
uauuuauuccauauuc

SEQ ID NO: 1869584 - RNA, 15 nt, Homo sapiens
acaucucccuuccac

SEQ ID NO: 1869585 - RNA, 14 nt, Homo sapiens
uuucuauucuguca

SEQ ID NO: 1869586 - RNA, 16 nt, Homo sapiens
aaguucuuaggcacca

SEQ ID NO: 1869587 - RNA, 14 nt, Homo sapiens
augcugccuaggcu

SEQ ID NO: 1869588 - RNA, 15 nt, Homo sapiens
gaaugaugcuaugaa

SEQ ID NO: 1869589 - RNA, 15 nt, Homo sapiens
cagaccaggugaccu

SEQ ID NO: 1869590 - RNA, 15 nt, Homo sapiens
cuucccaggaucccu

SEQ ID NO: 1869591 - RNA, 13 nt, Homo sapiens
caugaaauguguu

SEQ ID NO: 1869592 - RNA, 14 nt, Homo sapiens
guauacaugugcca

SEQ ID NO: 1869593 - RNA, 18 nt, Homo sapiens
uacagucuuccauuugca

SEQ ID NO: 1869594 - RNA, 20 nt, Homo sapiens
cacagcuccuuuuccagagc

SEQ ID NO: 1869595 - RNA, 15 nt, Homo sapiens
uccaagcaaauguga

SEQ ID NO: 1869596 - RNA, 13 nt, Homo sapiens
aaguuacuacuga

SEQ ID NO: 1869597 - RNA, 16 nt, Homo sapiens
cuagagugcaguggcg

SEQ ID NO: 1869598 - RNA, 11 nt, Homo sapiens
aggcacugggc

SEQ ID NO: 1869599 - RNA, 21 nt, Homo sapiens
ccagguucugguuagcucagc

SEQ ID NO: 1869600 - RNA, 18 nt, Homo sapiens
uuggugucuguacucagc

SEQ ID NO: 1869601 - RNA, 22 nt, Homo sapiens
ccgaaguccagcuuucugcaga

SEQ ID NO: 1869602 - RNA, 18 nt, Homo sapiens
aggcugaccacagcacag

SEQ ID NO: 1869603 - RNA, 20 nt, Homo sapiens
ucccaaagugcagggauuac

SEQ ID NO: 1869604 - RNA, 20 nt, Homo sapiens
caugacacgaauauugcuga

SEQ ID NO: 1869605 - RNA, 22 nt, Homo sapiens
cuccauguaccuuguguacuuu

SEQ ID NO: 1869606 - RNA, 22 nt, Homo sapiens
acccaggccugauucacuggcc

SEQ ID NO: 1869607 - RNA, 12 nt, Homo sapiens
acucaucuuucc

SEQ ID NO: 1869608 - RNA, 22 nt, Homo sapiens
gugcuaccuggccuuccugcca

SEQ ID NO: 1869609 - RNA, 21 nt, Homo sapiens
uugguuugagaaaggcacaua

SEQ ID NO: 1869610 - RNA, 20 nt, Homo sapiens
uccccuacaucaaaugcuca

SEQ ID NO: 1869611 - RNA, 11 nt, Homo sapiens
gccagugcaga

SEQ ID NO: 1869612 - RNA, 20 nt, Homo sapiens
auccucccauugcccaguga

SEQ ID NO: 1869613 - RNA, 20 nt, Homo sapiens
accaguccacaccacuguug

SEQ ID NO: 1869614 - RNA, 18 nt, Homo sapiens
uuuaggauugaaguggcu

SEQ ID NO: 1869615 - RNA, 17 nt, Homo sapiens
augaacuggccucugcc

SEQ ID NO: 1869616 - RNA, 16 nt, Homo sapiens
guuuuacuacccaaau

SEQ ID NO: 1869617 - RNA, 20 nt, Homo sapiens
agcagaagagaaaauguugu

SEQ ID NO: 1869618 - RNA, 19 nt, Homo sapiens
aaugagcucugaaaucuuc

SEQ ID NO: 1869619 - RNA, 13 nt, Homo sapiens
ugcugaguacuca

SEQ ID NO: 1869620 - RNA, 11 nt, Homo sapiens
auuucagggaa

SEQ ID NO: 1869621 - RNA, 22 nt, Homo sapiens
uccccugcccccuguacauuug

SEQ ID NO: 1869622 - RNA, 20 nt, Homo sapiens
auaagcuauagacccgagga

SEQ ID NO: 1869623 - RNA, 13 nt, Homo sapiens
ugcuaaaugcaaa

SEQ ID NO: 1869624 - RNA, 15 nt, Homo sapiens
uuucugauucuucaa

SEQ ID NO: 1869625 - RNA, 20 nt, Homo sapiens
uauuuaaaaaugcaugauaa

SEQ ID NO: 1869626 - RNA, 14 nt, Homo sapiens
auaacaauguuaag

SEQ ID NO: 1869627 - RNA, 19 nt, Homo sapiens
ggcuccacucuugaucucu

SEQ ID NO: 1869628 - RNA, 13 nt, Homo sapiens
cucuaacauuugc

SEQ ID NO: 1869629 - RNA, 15 nt, Homo sapiens
ucuuucuacaugacu

SEQ ID NO: 1869630 - RNA, 13 nt, Homo sapiens
aguuaaacuuuga

SEQ ID NO: 1869631 - RNA, 21 nt, Homo sapiens
guaagaacaccugacaacuuc

SEQ ID NO: 1869632 - RNA, 22 nt, Homo sapiens
uucccuccgaacgcugcuccau

SEQ ID NO: 1869633 - RNA, 13 nt, Homo sapiens
uucuugcaauuug

SEQ ID NO: 1869634 - RNA, 22 nt, Homo sapiens
uauugggguuggaacauuucag

SEQ ID NO: 1869635 - RNA, 14 nt, Homo sapiens
acaaaguuuugcuc

SEQ ID NO: 1869636 - RNA, 21 nt, Homo sapiens
uggaggccaagaacuugcaau

SEQ ID NO: 1869637 - RNA, 15 nt, Homo sapiens
uuagaaaccaugaaa

SEQ ID NO: 1869638 - RNA, 15 nt, Homo sapiens
gaggaguaccgccag

SEQ ID NO: 1869639 - RNA, 22 nt, Homo sapiens
cauuccaaucagccaacuaagu

SEQ ID NO: 1869640 - RNA, 22 nt, Homo sapiens
uuguguguguguguugauccca

SEQ ID NO: 1869641 - RNA, 20 nt, Homo sapiens
ggacacuguggagacuuucu

SEQ ID NO: 1869642 - RNA, 16 nt, Homo sapiens
gguauccugcccagug

SEQ ID NO: 1869643 - RNA, 18 nt, Homo sapiens
aagaacugcuugcauuuc

SEQ ID NO: 1869644 - RNA, 13 nt, Homo sapiens
cucagagcugucc

SEQ ID NO: 1869645 - RNA, 18 nt, Homo sapiens
uauugaacugcaggugac

SEQ ID NO: 1869646 - RNA, 15 nt, Homo sapiens
guaauaaaaagccuc

SEQ ID NO: 1869647 - RNA, 15 nt, Homo sapiens
gaaauuaaaugccac

SEQ ID NO: 1869648 - RNA, 18 nt, Homo sapiens
cagugauuuucaaaacca

SEQ ID NO: 1869649 - RNA, 20 nt, Homo sapiens
ccuacaaaauuucaccugca

SEQ ID NO: 1869650 - RNA, 23 nt, Homo sapiens
acuuuuaauguggcaaguuugca

SEQ ID NO: 1869651 - RNA, 20 nt, Homo sapiens
ccagacuucucccgugagcc

SEQ ID NO: 1869652 - RNA, 19 nt, Homo sapiens
acucagaacucuccaggga

SEQ ID NO: 1869653 - RNA, 21 nt, Homo sapiens
uagaugccucgcucuuuucaa

SEQ ID NO: 1869654 - RNA, 13 nt, Homo sapiens
ccugugcacacac

SEQ ID NO: 1869655 - RNA, 20 nt, Homo sapiens
acaguuugugcucuacuguu

SEQ ID NO: 1869656 - RNA, 23 nt, Homo sapiens
uacauaacuuagagacuuuagag

SEQ ID NO: 1869657 - RNA, 15 nt, Homo sapiens
auuucucuacagaug

SEQ ID NO: 1869658 - RNA, 16 nt, Homo sapiens
uaagacuguaaugugu

SEQ ID NO: 1869659 - RNA, 21 nt, Homo sapiens
cagcccuagagccugccugga

SEQ ID NO: 1869660 - RNA, 12 nt, Homo sapiens
ucuaaacauuuc

SEQ ID NO: 1869661 - RNA, 13 nt, Homo sapiens
ggaacacugcacu

SEQ ID NO: 1869662 - RNA, 15 nt, Homo sapiens
uauagugacaaugaa

SEQ ID NO: 1869663 - RNA, 15 nt, Homo sapiens
gcaucugcaguacag

SEQ ID NO: 1869664 - RNA, 22 nt, Homo sapiens
caaucaggcucaaaaccagaga

SEQ ID NO: 1869665 - RNA, 19 nt, Homo sapiens
aucuuugagaauauuauaa

SEQ ID NO: 1869666 - RNA, 18 nt, Homo sapiens
ugccuucugagcugucua

SEQ ID NO: 1869667 - RNA, 17 nt, Homo sapiens
caccaaucuuacuuugu

SEQ ID NO: 1869668 - RNA, 15 nt, Homo sapiens
ucaucagcauaccuu

SEQ ID NO: 1869669 - RNA, 17 nt, Homo sapiens
ccagagggacuuugccu

SEQ ID NO: 1869670 - RNA, 15 nt, Homo sapiens
ccugauuacaccagc

SEQ ID NO: 1869671 - RNA, 12 nt, Homo sapiens
agcuuugucacu

SEQ ID NO: 1869672 - RNA, 14 nt, Homo sapiens
cgcagacgggcaca

SEQ ID NO: 1869673 - RNA, 17 nt, Homo sapiens
acaauaaagcaaugugg

SEQ ID NO: 1869674 - RNA, 11 nt, Homo sapiens
uguacacugug

SEQ ID NO: 1869675 - RNA, 18 nt, Homo sapiens
uggugggggucaggugga

SEQ ID NO: 1869676 - RNA, 21 nt, Homo sapiens
gauuauaggcaugagccacca

SEQ ID NO: 1869677 - RNA, 17 nt, Homo sapiens
gagguggcacuagggau

SEQ ID NO: 1869678 - RNA, 21 nt, Homo sapiens
ccaaaaucaggaaccacagau

SEQ ID NO: 1869679 - RNA, 18 nt, Homo sapiens
ucaaccucccaagcaguu

SEQ ID NO: 1869680 - RNA, 22 nt, Homo sapiens
ggccguugcuacaagucaccug

SEQ ID NO: 1869681 - RNA, 19 nt, Homo sapiens
ucucccuggggcacuuuca

SEQ ID NO: 1869682 - RNA, 22 nt, Homo sapiens
aagccugcagucaucuugacca

SEQ ID NO: 1869683 - RNA, 14 nt, Homo sapiens
cguggagaaaauca

SEQ ID NO: 1869684 - RNA, 21 nt, Homo sapiens
uaauuauuuauguauggugca

SEQ ID NO: 1869685 - RNA, 15 nt, Homo sapiens
cuuuuuacacuuuau

SEQ ID NO: 1869686 - RNA, 17 nt, Homo sapiens
ucccuccuuauuuuuga

SEQ ID NO: 1869687 - RNA, 13 nt, Homo sapiens
gaggucuggcuga

SEQ ID NO: 1869688 - RNA, 16 nt, Homo sapiens
uuaaucuugaucauuc

SEQ ID NO: 1869689 - RNA, 23 nt, Homo sapiens
uaugaguaucuguauguauauau

SEQ ID NO: 1869690 - RNA, 20 nt, Homo sapiens
agaacagcuucauguuccca

SEQ ID NO: 1869691 - RNA, 17 nt, Homo sapiens
cacuccugaauucaguu

SEQ ID NO: 1869692 - RNA, 16 nt, Homo sapiens
cuuugcucuugccaaa

SEQ ID NO: 1869693 - RNA, 19 nt, Homo sapiens
ugccaauggcggacucaaa

SEQ ID NO: 1869694 - RNA, 23 nt, Homo sapiens
gcagcugggcuuggccuggagag

SEQ ID NO: 1869695 - RNA, 22 nt, Homo sapiens
uccaaagaggcugccccucuca

SEQ ID NO: 1869696 - RNA, 18 nt, Homo sapiens
agcgcccuuccucuccac

SEQ ID NO: 1869697 - RNA, 20 nt, Homo sapiens
caacaaugcaaaagccaaga

SEQ ID NO: 1869698 - RNA, 12 nt, Homo sapiens
gccuuugugagc

SEQ ID NO: 1869699 - RNA, 21 nt, Homo sapiens
agccaauagaauggggugauu

SEQ ID NO: 1869700 - RNA, 19 nt, Homo sapiens
cgccccucgcugcugcuac

SEQ ID NO: 1869701 - RNA, 19 nt, Homo sapiens
accauggcaugguuauuga

SEQ ID NO: 1869702 - RNA, 22 nt, Homo sapiens
uauucugcuuccacaugugcca

SEQ ID NO: 1869703 - RNA, 13 nt, Homo sapiens
gcaaggccuugaa

SEQ ID NO: 1869704 - RNA, 15 nt, Homo sapiens
uuucucuucuacaca

SEQ ID NO: 1869705 - RNA, 15 nt, Homo sapiens
uaaaaauucauauaa

SEQ ID NO: 1869706 - RNA, 18 nt, Homo sapiens
uauuuauaaaugagcaaa

SEQ ID NO: 1869707 - RNA, 17 nt, Homo sapiens
agucauggcaccaaagc

SEQ ID NO: 1869708 - RNA, 18 nt, Homo sapiens
cgugcccgugugcauguc

SEQ ID NO: 1869709 - RNA, 17 nt, Homo sapiens
gaccugggccauaguca

SEQ ID NO: 1869710 - RNA, 20 nt, Homo sapiens
gcgcccagccaggcuccagu

SEQ ID NO: 1869711 - RNA, 16 nt, Homo sapiens
ccagguuuaaacauca

SEQ ID NO: 1869712 - RNA, 17 nt, Homo sapiens
gccaggcacugcccuuu

SEQ ID NO: 1869713 - RNA, 19 nt, Homo sapiens
uaccucuaauaguccuguc

SEQ ID NO: 1869714 - RNA, 20 nt, Homo sapiens
gcccagggaagacacaugau

SEQ ID NO: 1869715 - RNA, 20 nt, Homo sapiens
gcccacgcuggagugcagug

SEQ ID NO: 1869716 - RNA, 19 nt, Homo sapiens
aaaaauucaugcaucucaa

SEQ ID NO: 1869717 - RNA, 15 nt, Homo sapiens
auaaagaugucugcu

SEQ ID NO: 1869718 - RNA, 18 nt, Homo sapiens
gcucccagccacauggcg

SEQ ID NO: 1869719 - RNA, 23 nt, Homo sapiens
cauuaaggggaagaaugaaagcu

SEQ ID NO: 1869720 - RNA, 17 nt, Homo sapiens
ccuuucaagcggugccu

SEQ ID NO: 1869721 - RNA, 18 nt, Homo sapiens
aauuagugccacaaauaa

SEQ ID NO: 1869722 - RNA, 18 nt, Homo sapiens
acccacggaaagccucau

SEQ ID NO: 1869723 - RNA, 15 nt, Homo sapiens
aacucaucugucacc

SEQ ID NO: 1869724 - RNA, 13 nt, Homo sapiens
cgggcugcacaga

SEQ ID NO: 1869725 - RNA, 14 nt, Homo sapiens
uuauacaccagcaa

SEQ ID NO: 1869726 - RNA, 14 nt, Homo sapiens
cugcacacuaauaa

SEQ ID NO: 1869727 - RNA, 17 nt, Homo sapiens
uuguuaagauaugaugu

SEQ ID NO: 1869728 - RNA, 22 nt, Homo sapiens
uacagcgcauuuucuaccugaa

SEQ ID NO: 1869729 - RNA, 17 nt, Homo sapiens
gguugcagucacuguga

SEQ ID NO: 1869730 - RNA, 19 nt, Homo sapiens
ugcccaaagccaucuuccu

SEQ ID NO: 1869731 - RNA, 19 nt, Homo sapiens
cacgauuugucuuaucccc

SEQ ID NO: 1869732 - RNA, 23 nt, Homo sapiens
aacuguauuucaguauuuuccag

SEQ ID NO: 1869733 - RNA, 19 nt, Homo sapiens
ugcuuuguugcacugaaau

SEQ ID NO: 1869734 - RNA, 18 nt, Homo sapiens
cuuugccacacuguggua

SEQ ID NO: 1869735 - RNA, 11 nt, Homo sapiens
cugaggucuca

SEQ ID NO: 1869736 - RNA, 22 nt, Homo sapiens
gagaccaaaauuuaaguuaacu

SEQ ID NO: 1869737 - RNA, 14 nt, Homo sapiens
gccccugccugaga

SEQ ID NO: 1869738 - RNA, 21 nt, Homo sapiens
uaaauagaguauaugcacuuu

SEQ ID NO: 1869739 - RNA, 14 nt, Homo sapiens
agcgggaauggcag

SEQ ID NO: 1869740 - RNA, 16 nt, Homo sapiens
aacaucaacaacacag

SEQ ID NO: 1869741 - RNA, 14 nt, Homo sapiens
auccacacugagag

SEQ ID NO: 1869742 - RNA, 14 nt, Homo sapiens
auaaauauacauau

SEQ ID NO: 1869743 - RNA, 14 nt, Homo sapiens
gcaaauuugauaca

SEQ ID NO: 1869744 - RNA, 22 nt, Homo sapiens
acccaagccugauccagccuuu

SEQ ID NO: 1869745 - RNA, 23 nt, Homo sapiens
uucagaacuauuuaaaauaaaga

SEQ ID NO: 1869746 - RNA, 12 nt, Homo sapiens
auuacauaacag

SEQ ID NO: 1869747 - RNA, 17 nt, Homo sapiens
uuauucauuuuguggca

SEQ ID NO: 1869748 - RNA, 20 nt, Homo sapiens
gauguaugcacacacauaua

SEQ ID NO: 1869749 - RNA, 14 nt, Homo sapiens
ccgugcccugguga

SEQ ID NO: 1869750 - RNA, 15 nt, Homo sapiens
cuuggggucacuccu

SEQ ID NO: 1869751 - RNA, 20 nt, Homo sapiens
gaagagugcccugcuuugca

SEQ ID NO: 1869752 - RNA, 13 nt, Homo sapiens
caauacauuugau

SEQ ID NO: 1869753 - RNA, 16 nt, Homo sapiens
cgguggugugaucucg

SEQ ID NO: 1869754 - RNA, 17 nt, Homo sapiens
cucucaagcuagccaga

SEQ ID NO: 1869755 - RNA, 13 nt, Homo sapiens
cugaagucacaca

SEQ ID NO: 1869756 - RNA, 12 nt, Homo sapiens
cuaugagcuucu

SEQ ID NO: 1869757 - RNA, 17 nt, Homo sapiens
aaaaguuuaaagacacu

SEQ ID NO: 1869758 - RNA, 19 nt, Homo sapiens
aacuuuuccuggacacuuu

SEQ ID NO: 1869759 - RNA, 15 nt, Homo sapiens
cacaagauccaggca

SEQ ID NO: 1869760 - RNA, 22 nt, Homo sapiens
cuuccuuuuuucuuucuuuacu

SEQ ID NO: 1869761 - RNA, 12 nt, Homo sapiens
cuguaccaguua

SEQ ID NO: 1869762 - RNA, 15 nt, Homo sapiens
ucugaaauggaauau

SEQ ID NO: 1869763 - RNA, 17 nt, Homo sapiens
auuaaauacagacacua

SEQ ID NO: 1869764 - RNA, 21 nt, Homo sapiens
uaauaauuguaucuacauuaa

SEQ ID NO: 1869765 - RNA, 18 nt, Homo sapiens
cuuuauuggugaccuuuu

SEQ ID NO: 1869766 - RNA, 14 nt, Homo sapiens
acaaacaugugguu

SEQ ID NO: 1869767 - RNA, 19 nt, Homo sapiens
uggaacaacugauacuuca

SEQ ID NO: 1869768 - RNA, 22 nt, Homo sapiens
acaaacaugauacugcugcuug

SEQ ID NO: 1869769 - RNA, 13 nt, Homo sapiens
caacuuggcuuuc

SEQ ID NO: 1869770 - RNA, 23 nt, Homo sapiens
ggccauacuucuguuuccaucug

SEQ ID NO: 1869771 - RNA, 21 nt, Homo sapiens
ccgucuucucccuauucccuc

SEQ ID NO: 1869772 - RNA, 21 nt, Homo sapiens
ucacuaauuuaaguacuugag

SEQ ID NO: 1869773 - RNA, 16 nt, Homo sapiens
ucauuguuguuaauag

SEQ ID NO: 1869774 - RNA, 12 nt, Homo sapiens
ucugaagccacc

SEQ ID NO: 1869775 - RNA, 20 nt, Homo sapiens
uguauaaauaagcacuauuc

SEQ ID NO: 1869776 - RNA, 22 nt, Homo sapiens
gacaguagugaaaucuugugau

SEQ ID NO: 1869777 - RNA, 23 nt, Homo sapiens
aaaaauauuguuucugcauucau

SEQ ID NO: 1869778 - RNA, 13 nt, Homo sapiens
ucuuuacucaggc

SEQ ID NO: 1869779 - RNA, 18 nt, Homo sapiens
aguguucaaauacuucaa

SEQ ID NO: 1869780 - RNA, 14 nt, Homo sapiens
guccuagcuguuag

SEQ ID NO: 1869781 - RNA, 21 nt, Homo sapiens
uugcaucguggagacagggca

SEQ ID NO: 1869782 - RNA, 14 nt, Homo sapiens
cuuugaguccagca

SEQ ID NO: 1869783 - RNA, 21 nt, Homo sapiens
cgccccucauuuaucccucaa

SEQ ID NO: 1869784 - RNA, 19 nt, Homo sapiens
agccaaccuuaaaccucuu

SEQ ID NO: 1869785 - RNA, 19 nt, Homo sapiens
gggacaagacaaaaccaaa

SEQ ID NO: 1869786 - RNA, 14 nt, Homo sapiens
uggcccagagccau

SEQ ID NO: 1869787 - RNA, 15 nt, Homo sapiens
agaguggugcugcuu

SEQ ID NO: 1869788 - RNA, 22 nt, Homo sapiens
aauguuuguuaaagcuagauag

SEQ ID NO: 1869789 - RNA, 20 nt, Homo sapiens
aauaguaccuucaauacuua

SEQ ID NO: 1869790 - RNA, 14 nt, Homo sapiens
caaggcacugccug

SEQ ID NO: 1869791 - RNA, 17 nt, Homo sapiens
ucgcuggggauggaauu

SEQ ID NO: 1869792 - RNA, 15 nt, Homo sapiens
guaaauucucuccca

SEQ ID NO: 1869793 - RNA, 13 nt, Homo sapiens
aguaacccaaacc

SEQ ID NO: 1869794 - RNA, 17 nt, Homo sapiens
caccaaaccagacagag

SEQ ID NO: 1869795 - RNA, 16 nt, Homo sapiens
cucuguaccccaugac

SEQ ID NO: 1869796 - RNA, 11 nt, Homo sapiens
aaaacucuccu

SEQ ID NO: 1869797 - RNA, 20 nt, Homo sapiens
gauaccauggcacugacaau

SEQ ID NO: 1869798 - RNA, 18 nt, Homo sapiens
gaugccuccccaagacug

SEQ ID NO: 1869799 - RNA, 18 nt, Homo sapiens
uccaacacaagacuggca

SEQ ID NO: 1869800 - RNA, 19 nt, Homo sapiens
ggcagguguguauuuacuu

SEQ ID NO: 1869801 - RNA, 15 nt, Homo sapiens
gcaaaaauauaccuu

SEQ ID NO: 1869802 - RNA, 16 nt, Homo sapiens
acgaucccccaagugu

SEQ ID NO: 1869803 - RNA, 21 nt, Homo sapiens
ugaccaaaagugagaugggaa

SEQ ID NO: 1869804 - RNA, 20 nt, Homo sapiens
cuugucauauucgauguacu

SEQ ID NO: 1869805 - RNA, 14 nt, Homo sapiens
caggaaggagcaaa

SEQ ID NO: 1869806 - RNA, 18 nt, Homo sapiens
augagucacuuacuucau

SEQ ID NO: 1869807 - RNA, 13 nt, Homo sapiens
gcgagacauuggg

SEQ ID NO: 1869808 - RNA, 21 nt, Homo sapiens
cuuucucaggaccuaguugcu

SEQ ID NO: 1869809 - RNA, 15 nt, Homo sapiens
cuaaccauguguuau

SEQ ID NO: 1869810 - RNA, 22 nt, Homo sapiens
uacagcugggagccuuugccau

SEQ ID NO: 1869811 - RNA, 23 nt, Homo sapiens
agccgagcacgguggugcaugcc

SEQ ID NO: 1869812 - RNA, 15 nt, Homo sapiens
ugagcaccaggggau

SEQ ID NO: 1869813 - RNA, 18 nt, Homo sapiens
aggcccuaagaugccuug

SEQ ID NO: 1869814 - RNA, 15 nt, Homo sapiens
auccccugcuacccu

SEQ ID NO: 1869815 - RNA, 20 nt, Homo sapiens
uaaacagguuuuuaguuugu

SEQ ID NO: 1869816 - RNA, 20 nt, Homo sapiens
gaaacccuggucuccguggc

SEQ ID NO: 1869817 - RNA, 16 nt, Homo sapiens
aauauuauguguuucc

SEQ ID NO: 1869818 - RNA, 20 nt, Homo sapiens
gcagaacauuguaucacauu

SEQ ID NO: 1869819 - RNA, 13 nt, Homo sapiens
aucauuccuugag

SEQ ID NO: 1869820 - RNA, 19 nt, Homo sapiens
cuguuuuguaagugcugcu

SEQ ID NO: 1869821 - RNA, 14 nt, Homo sapiens
caaacauugaugcu

SEQ ID NO: 1869822 - RNA, 19 nt, Homo sapiens
gaaaaaaguuccuuccuaa

SEQ ID NO: 1869823 - RNA, 18 nt, Homo sapiens
cagacuaugcagcucauc

SEQ ID NO: 1869824 - RNA, 15 nt, Homo sapiens
cacuccagcucugag

SEQ ID NO: 1869825 - RNA, 21 nt, Homo sapiens
ggaagugguagaaacuuuaaa

SEQ ID NO: 1869826 - RNA, 17 nt, Homo sapiens
agccugucucucccuac

SEQ ID NO: 1869827 - RNA, 17 nt, Homo sapiens
acuucucuauuaucuca

SEQ ID NO: 1869828 - RNA, 13 nt, Homo sapiens
auuuuugaauaca

SEQ ID NO: 1869829 - RNA, 19 nt, Homo sapiens
caggcacuccaaaccuguc

SEQ ID NO: 1869830 - RNA, 15 nt, Homo sapiens
ugguuuauaaucuga

SEQ ID NO: 1869831 - RNA, 17 nt, Homo sapiens
cuguuuuaugugcacac

SEQ ID NO: 1869832 - RNA, 19 nt, Homo sapiens
aaugaaauaauucaaacac

SEQ ID NO: 1869833 - RNA, 22 nt, Homo sapiens
guaaauaaaugugaaacaucuu

SEQ ID NO: 1869834 - RNA, 19 nt, Homo sapiens
ccaauguccaaaaggcuag

SEQ ID NO: 1869835 - RNA, 20 nt, Homo sapiens
cccaggguaggggagggugg

SEQ ID NO: 1869836 - RNA, 22 nt, Homo sapiens
caccacgccuggccagaugcau

SEQ ID NO: 1869837 - RNA, 17 nt, Homo sapiens
gacuuuuauaacauuuu

SEQ ID NO: 1869838 - RNA, 22 nt, Homo sapiens
uugauuauaucauuuuguggau

SEQ ID NO: 1869839 - RNA, 15 nt, Homo sapiens
agcucuccuccucca

SEQ ID NO: 1869840 - RNA, 23 nt, Homo sapiens
cuuugagguggaagagggcugca

SEQ ID NO: 1869841 - RNA, 15 nt, Homo sapiens
ccauuucagcuugac

SEQ ID NO: 1869842 - RNA, 13 nt, Homo sapiens
ugcaucuuugaug

SEQ ID NO: 1869843 - RNA, 19 nt, Homo sapiens
uaaguggcuucucugugaa

SEQ ID NO: 1869844 - RNA, 21 nt, Homo sapiens
agcugcagcaggugaccuccc

SEQ ID NO: 1869845 - RNA, 15 nt, Homo sapiens
cucagagcagcacug

SEQ ID NO: 1869846 - RNA, 20 nt, Homo sapiens
cugcaauccagccugggcaa

SEQ ID NO: 1869847 - RNA, 16 nt, Homo sapiens
uggauuccucacuuug

SEQ ID NO: 1869848 - RNA, 21 nt, Homo sapiens
caaguucaugcagcuguggca

SEQ ID NO: 1869849 - RNA, 12 nt, Homo sapiens
uggugcccugga

SEQ ID NO: 1869850 - RNA, 16 nt, Homo sapiens
uacacucaaacaauca

SEQ ID NO: 1869851 - RNA, 16 nt, Homo sapiens
auguuuugaaugugga

SEQ ID NO: 1869852 - RNA, 18 nt, Homo sapiens
aaguuauuaccuuuacau

SEQ ID NO: 1869853 - RNA, 15 nt, Homo sapiens
auaugcauauauaug

SEQ ID NO: 1869854 - RNA, 13 nt, Homo sapiens
aaggaacacaaag

SEQ ID NO: 1869855 - RNA, 19 nt, Homo sapiens
acccauauauaauucuccc

SEQ ID NO: 1869856 - RNA, 22 nt, Homo sapiens
cacugucaccacccugcucauc

SEQ ID NO: 1869857 - RNA, 20 nt, Homo sapiens
augaaacaaacuacuguguc

SEQ ID NO: 1869858 - RNA, 14 nt, Homo sapiens
uucccaucuacuaa

SEQ ID NO: 1869859 - RNA, 23 nt, Homo sapiens
uguccacuuggagcuaaaacugg

SEQ ID NO: 1869860 - RNA, 21 nt, Homo sapiens
aguuguuucuacuacauggaa

SEQ ID NO: 1869861 - RNA, 22 nt, Homo sapiens
ucuuaauauuaaauauaugauu

SEQ ID NO: 1869862 - RNA, 12 nt, Homo sapiens
uggcucaucucu

SEQ ID NO: 1869863 - RNA, 20 nt, Homo sapiens
agaggcuccugaaugugacu

SEQ ID NO: 1869864 - RNA, 15 nt, Homo sapiens
acauacuuaaugcau

SEQ ID NO: 1869865 - RNA, 13 nt, Homo sapiens
aggggaguucagu

SEQ ID NO: 1869866 - RNA, 18 nt, Homo sapiens
accuccuuuucucuuuca

SEQ ID NO: 1869867 - RNA, 19 nt, Homo sapiens
uccagcuuuuccucagggu

SEQ ID NO: 1869868 - RNA, 12 nt, Homo sapiens
cagccaggcuau

SEQ ID NO: 1869869 - RNA, 12 nt, Homo sapiens
uggaagggucaa

SEQ ID NO: 1869870 - RNA, 11 nt, Homo sapiens
cuguguguucc

SEQ ID NO: 1869871 - RNA, 21 nt, Homo sapiens
uuaaccugaaccuugagcaaa

SEQ ID NO: 1869872 - RNA, 15 nt, Homo sapiens
uguccaaguccaacc

SEQ ID NO: 1869873 - RNA, 16 nt, Homo sapiens
auugaagccuuugcca

SEQ ID NO: 1869874 - RNA, 16 nt, Homo sapiens
uagucaugcuaauuau

SEQ ID NO: 1869875 - RNA, 17 nt, Homo sapiens
ugcugguugacaucaga

SEQ ID NO: 1869876 - RNA, 16 nt, Homo sapiens
gagcccuggcucccac

SEQ ID NO: 1869877 - RNA, 14 nt, Homo sapiens
cuccaaaaggcccu

SEQ ID NO: 1869878 - RNA, 18 nt, Homo sapiens
gcugauugggauuuccau

SEQ ID NO: 1869879 - RNA, 15 nt, Homo sapiens
ucagucgcccggggc

SEQ ID NO: 1869880 - RNA, 13 nt, Homo sapiens
auggggcuugccc

SEQ ID NO: 1869881 - RNA, 20 nt, Homo sapiens
uaaacugugguccaucucca

SEQ ID NO: 1869882 - RNA, 21 nt, Homo sapiens
gcuuaucuuugcacauguuaa

SEQ ID NO: 1869883 - RNA, 16 nt, Homo sapiens
ugacaucaguggcaug

SEQ ID NO: 1869884 - RNA, 19 nt, Homo sapiens
auugauccucccaucucag

SEQ ID NO: 1869885 - RNA, 18 nt, Homo sapiens
uucccccacccagcuuuc

SEQ ID NO: 1869886 - RNA, 23 nt, Homo sapiens
aacucugcauagacaaaggccuu

SEQ ID NO: 1869887 - RNA, 15 nt, Homo sapiens
ugaagauacaggaca

SEQ ID NO: 1869888 - RNA, 20 nt, Homo sapiens
ugcaacucuuuuaagugccu

SEQ ID NO: 1869889 - RNA, 20 nt, Homo sapiens
ccccuucuaggggcagguga

SEQ ID NO: 1869890 - RNA, 19 nt, Homo sapiens
uaaaauguuaccacuacuu

SEQ ID NO: 1869891 - RNA, 13 nt, Homo sapiens
auugcacuaugaa

SEQ ID NO: 1869892 - RNA, 17 nt, Homo sapiens
cuauuugagacuccuca

SEQ ID NO: 1869893 - RNA, 13 nt, Homo sapiens
agcugcauuucag

SEQ ID NO: 1869894 - RNA, 22 nt, Homo sapiens
gacacagcccaugggccagaac

SEQ ID NO: 1869895 - RNA, 19 nt, Homo sapiens
aauguagcccucuccaaau

SEQ ID NO: 1869896 - RNA, 14 nt, Homo sapiens
auuuaagaagccaa

SEQ ID NO: 1869897 - RNA, 16 nt, Homo sapiens
uucauugcacuuugau

SEQ ID NO: 1869898 - RNA, 16 nt, Homo sapiens
agggcagcuccagugc

SEQ ID NO: 1869899 - RNA, 20 nt, Homo sapiens
cagcauuuuacuacuuuaaa

SEQ ID NO: 1869900 - RNA, 20 nt, Homo sapiens
gaaaagcaaaugacuaguaa

SEQ ID NO: 1869901 - RNA, 21 nt, Homo sapiens
gcuggaguuuuguugguguga

SEQ ID NO: 1869902 - RNA, 13 nt, Homo sapiens
augguugcagaua

SEQ ID NO: 1869903 - RNA, 14 nt, Homo sapiens
auaaaauucuguaa

SEQ ID NO: 1869904 - RNA, 23 nt, Homo sapiens
uaaaaauggcaggggguggaauu

SEQ ID NO: 1869905 - RNA, 18 nt, Homo sapiens
uaauuuuuuacauuuucc

SEQ ID NO: 1869906 - RNA, 20 nt, Homo sapiens
uauucuucccuuuuaaacac

SEQ ID NO: 1869907 - RNA, 19 nt, Homo sapiens
gucauggcuaauuuaacac

SEQ ID NO: 1869908 - RNA, 15 nt, Homo sapiens
ucucuuucguuacag

SEQ ID NO: 1869909 - RNA, 21 nt, Homo sapiens
gcugugaaggaguaaugggau

SEQ ID NO: 1869910 - RNA, 21 nt, Homo sapiens
cucugaacuaggugaucucag

SEQ ID NO: 1869911 - RNA, 16 nt, Homo sapiens
cgaacaauucauauau

SEQ ID NO: 1869912 - RNA, 18 nt, Homo sapiens
cuaaauuuuuacaucaaa

SEQ ID NO: 1869913 - RNA, 20 nt, Homo sapiens
auuucuacuaugagggccuu

SEQ ID NO: 1869914 - RNA, 21 nt, Homo sapiens
uacuaagaguaugugccagga

SEQ ID NO: 1869915 - RNA, 16 nt, Homo sapiens
aguuaaugagccauca

SEQ ID NO: 1869916 - RNA, 17 nt, Homo sapiens
uccgcagacuuggucau

SEQ ID NO: 1869917 - RNA, 22 nt, Homo sapiens
auucuuacacugccuguauacu

SEQ ID NO: 1869918 - RNA, 20 nt, Homo sapiens
acccauucguggugaucaau

SEQ ID NO: 1869919 - RNA, 17 nt, Homo sapiens
uuguacuccugugcugg

SEQ ID NO: 1869920 - RNA, 17 nt, Homo sapiens
ugugaaaugcuuuuaua

SEQ ID NO: 1869921 - RNA, 18 nt, Homo sapiens
uuccugggguaaaguauc

SEQ ID NO: 1869922 - RNA, 22 nt, Homo sapiens
aggaguuugagguuacagugau

SEQ ID NO: 1869923 - RNA, 14 nt, Homo sapiens
guuaugacagugaa

SEQ ID NO: 1869924 - RNA, 22 nt, Homo sapiens
uucuccagaaauuuaccacaaa

SEQ ID NO: 1869925 - RNA, 20 nt, Homo sapiens
uugacugaaauuacuuuaac

SEQ ID NO: 1869926 - RNA, 21 nt, Homo sapiens
uagcauuugcuaacaggacca

SEQ ID NO: 1869927 - RNA, 19 nt, Homo sapiens
cuccugagccccucaaucc

SEQ ID NO: 1869928 - RNA, 18 nt, Homo sapiens
uuaauggggauuccacua

SEQ ID NO: 1869929 - RNA, 16 nt, Homo sapiens
uugcugagaaaugggg

SEQ ID NO: 1869930 - RNA, 20 nt, Homo sapiens
cuguuugcguacuuguaaua

SEQ ID NO: 1869931 - RNA, 14 nt, Homo sapiens
cguagacuugacaa

SEQ ID NO: 1869932 - RNA, 17 nt, Homo sapiens
aagaaucuagaaaauca

SEQ ID NO: 1869933 - RNA, 22 nt, Homo sapiens
uagauugagaaguuuuguacag

SEQ ID NO: 1869934 - RNA, 14 nt, Homo sapiens
ccuguguggugcca

SEQ ID NO: 1869935 - RNA, 18 nt, Homo sapiens
uaaauggcaucagcacuu

SEQ ID NO: 1869936 - RNA, 20 nt, Homo sapiens
uucuucaagauuuauggaaa

SEQ ID NO: 1869937 - RNA, 16 nt, Homo sapiens
cagaaagaguucagua

SEQ ID NO: 1869938 - RNA, 14 nt, Homo sapiens
gcuuagaaauucag

SEQ ID NO: 1869939 - RNA, 13 nt, Homo sapiens
guccaccaugcuc

SEQ ID NO: 1869940 - RNA, 19 nt, Homo sapiens
cuuucuggccugcuauguc

SEQ ID NO: 1869941 - RNA, 16 nt, Homo sapiens
cuguaagauauuaguu

SEQ ID NO: 1869942 - RNA, 14 nt, Homo sapiens
ucugugacauuucc

SEQ ID NO: 1869943 - RNA, 12 nt, Homo sapiens
acugagccagca

SEQ ID NO: 1869944 - RNA, 20 nt, Homo sapiens
uaaagaaaaaaauacuauuu

SEQ ID NO: 1869945 - RNA, 13 nt, Homo sapiens
cagacuucagcug

SEQ ID NO: 1869946 - RNA, 22 nt, Homo sapiens
ucagcuucccagccaugcccag

SEQ ID NO: 1869947 - RNA, 16 nt, Homo sapiens
gaccagcuuggcucag

SEQ ID NO: 1869948 - RNA, 20 nt, Homo sapiens
uaaucauuguaugugcuuca

SEQ ID NO: 1869949 - RNA, 19 nt, Homo sapiens
gcaauuccucugaacaaaa

SEQ ID NO: 1869950 - RNA, 17 nt, Homo sapiens
guacacaauaagcaaaa

SEQ ID NO: 1869951 - RNA, 21 nt, Homo sapiens
uuauuaaaauucuuuaauaau

SEQ ID NO: 1869952 - RNA, 17 nt, Homo sapiens
aacugugcugaaugcuu

SEQ ID NO: 1869953 - RNA, 18 nt, Homo sapiens
agagccccuacagcauug

SEQ ID NO: 1869954 - RNA, 16 nt, Homo sapiens
ugccguccucaggugg

SEQ ID NO: 1869955 - RNA, 12 nt, Homo sapiens
ugcucaccagcc

SEQ ID NO: 1869956 - RNA, 12 nt, Homo sapiens
ugcccaccagcu

SEQ ID NO: 1869957 - RNA, 20 nt, Homo sapiens
uggaugauuuuuuaagcaga

SEQ ID NO: 1869958 - RNA, 15 nt, Homo sapiens
uagcaugcugcuuuu

SEQ ID NO: 1869959 - RNA, 17 nt, Homo sapiens
cauaaaugaagcagcuu

SEQ ID NO: 1869960 - RNA, 22 nt, Homo sapiens
agcccaugcucaaccacugugg

SEQ ID NO: 1869961 - RNA, 20 nt, Homo sapiens
ugaaauggcaggauucuaaa

SEQ ID NO: 1869962 - RNA, 14 nt, Homo sapiens
caagcuuguauaua

SEQ ID NO: 1869963 - RNA, 19 nt, Homo sapiens
acaacuggacucauuauca

SEQ ID NO: 1869964 - RNA, 18 nt, Homo sapiens
ucacuuguuuguguuuga

SEQ ID NO: 1869965 - RNA, 20 nt, Homo sapiens
caaaaauguguaagaacaac

SEQ ID NO: 1869966 - RNA, 19 nt, Homo sapiens
auaaaagaguuaacauccc

SEQ ID NO: 1869967 - RNA, 15 nt, Homo sapiens
cuauucuacuuuaaa

SEQ ID NO: 1869968 - RNA, 16 nt, Homo sapiens
uucugacuacuuguug

SEQ ID NO: 1869969 - RNA, 15 nt, Homo sapiens
uauuuaugaaguuua

SEQ ID NO: 1869970 - RNA, 23 nt, Homo sapiens
auuauuccucucaccccacuccu

SEQ ID NO: 1869971 - RNA, 14 nt, Homo sapiens
gaaaugaaagggaa

SEQ ID NO: 1869972 - RNA, 15 nt, Homo sapiens
ucuggacgugaaaua

SEQ ID NO: 1869973 - RNA, 13 nt, Homo sapiens
cuaaccugccaua

SEQ ID NO: 1869974 - RNA, 17 nt, Homo sapiens
uauacguguagcuauau

SEQ ID NO: 1869975 - RNA, 19 nt, Homo sapiens
uucccauuuguugcugcug

SEQ ID NO: 1869976 - RNA, 19 nt, Homo sapiens
agaaauaucugaaaaugua

SEQ ID NO: 1869977 - RNA, 22 nt, Homo sapiens
cucagaaggcaggagugcugcc

SEQ ID NO: 1869978 - RNA, 16 nt, Homo sapiens
ugagguggacucucac

SEQ ID NO: 1869979 - RNA, 23 nt, Homo sapiens
ccacuccucucccuugagggaua

SEQ ID NO: 1869980 - RNA, 23 nt, Homo sapiens
caagcuagaaggccacaugucac

SEQ ID NO: 1869981 - RNA, 15 nt, Homo sapiens
uaaguuugauuucau

SEQ ID NO: 1869982 - RNA, 14 nt, Homo sapiens
ccuccuccagggaa

SEQ ID NO: 1869983 - RNA, 16 nt, Homo sapiens
ugaaaaucacuauaac

SEQ ID NO: 1869984 - RNA, 18 nt, Homo sapiens
uucaggcaacgcacaaaa

SEQ ID NO: 1869985 - RNA, 12 nt, Homo sapiens
agucccauuccu

SEQ ID NO: 1869986 - RNA, 15 nt, Homo sapiens
uaucuccacaaccuc

SEQ ID NO: 1869987 - RNA, 17 nt, Homo sapiens
auguacauuucucaggc

SEQ ID NO: 1869988 - RNA, 22 nt, Homo sapiens
ucugggcugucagcccaugugc

SEQ ID NO: 1869989 - RNA, 18 nt, Homo sapiens
aggaauuucaagaagugu

SEQ ID NO: 1869990 - RNA, 19 nt, Homo sapiens
agaacaguaacugccauca

SEQ ID NO: 1869991 - RNA, 22 nt, Homo sapiens
uccaggccgagaugugcaacac

SEQ ID NO: 1869992 - RNA, 17 nt, Homo sapiens
ccagaaaguuauugaua

SEQ ID NO: 1869993 - RNA, 22 nt, Homo sapiens
uauuagcaagacagcaugccuu

SEQ ID NO: 1869994 - RNA, 19 nt, Homo sapiens
uucuuucggcuuucugcua

SEQ ID NO: 1869995 - RNA, 22 nt, Homo sapiens
aaugaauugugccuaguggaga

SEQ ID NO: 1869996 - RNA, 21 nt, Homo sapiens
agugcaggguggacaucaccu

SEQ ID NO: 1869997 - RNA, 23 nt, Homo sapiens
ccaauguucuaaaguuuugcaac

SEQ ID NO: 1869998 - RNA, 19 nt, Homo sapiens
auguaaaauccuacaguga

SEQ ID NO: 1869999 - RNA, 16 nt, Homo sapiens
aaacgugacagggaaa

SEQ ID NO: 1870000 - RNA, 23 nt, Homo sapiens
ugaagggaugcugcaauguagga

SEQ ID NO: 1870001 - RNA, 13 nt, Homo sapiens
ggugccuugggga

SEQ ID NO: 1870002 - RNA, 23 nt, Homo sapiens
agccugugucuuuaaaugcugcu

SEQ ID NO: 1870003 - RNA, 17 nt, Homo sapiens
gcaaaaugcucuugucc

SEQ ID NO: 1870004 - RNA, 16 nt, Homo sapiens
ugaguuauuuugcuaa

SEQ ID NO: 1870005 - RNA, 13 nt, Homo sapiens
cuaggaugugaug

SEQ ID NO: 1870006 - RNA, 13 nt, Homo sapiens
cuuucaugugugc

SEQ ID NO: 1870007 - RNA, 15 nt, Homo sapiens
augaaauugucaaaa

SEQ ID NO: 1870008 - RNA, 15 nt, Homo sapiens
gaucagcaucuguga

SEQ ID NO: 1870009 - RNA, 15 nt, Homo sapiens
gccugugccaugccc

SEQ ID NO: 1870010 - RNA, 14 nt, Homo sapiens
cauaguuacugugu

SEQ ID NO: 1870011 - RNA, 22 nt, Homo sapiens
gcucagcaugcagaagugcaug

SEQ ID NO: 1870012 - RNA, 22 nt, Homo sapiens
gcacuccagucuggaugacaga

SEQ ID NO: 1870013 - RNA, 22 nt, Homo sapiens
ugacuggaggaggccuguccca

SEQ ID NO: 1870014 - RNA, 14 nt, Homo sapiens
aaagaccuaccucc

SEQ ID NO: 1870015 - RNA, 19 nt, Homo sapiens
cucuacagauggcauaccu

SEQ ID NO: 1870016 - RNA, 23 nt, Homo sapiens
ugcugcugauuuaaacacauuaa

SEQ ID NO: 1870017 - RNA, 15 nt, Homo sapiens
acuggcucucuccag

SEQ ID NO: 1870018 - RNA, 15 nt, Homo sapiens
gacugcgaacacuga

SEQ ID NO: 1870019 - RNA, 22 nt, Homo sapiens
aggaucuaagggaagaucacug

SEQ ID NO: 1870020 - RNA, 17 nt, Homo sapiens
gauaaaaucuuccaaau

SEQ ID NO: 1870021 - RNA, 15 nt, Homo sapiens
gucuuagacuuugaa

SEQ ID NO: 1870022 - RNA, 21 nt, Homo sapiens
aagagauuucccuucauuuaa

SEQ ID NO: 1870023 - RNA, 17 nt, Homo sapiens
caguuucucaaacugag

SEQ ID NO: 1870024 - RNA, 15 nt, Homo sapiens
agcucuuuaacaugg

SEQ ID NO: 1870025 - RNA, 16 nt, Homo sapiens
aaggaagcccucucag

SEQ ID NO: 1870026 - RNA, 16 nt, Homo sapiens
aaauaugcauaaucag

SEQ ID NO: 1870027 - RNA, 16 nt, Homo sapiens
agaaucuccacuacuu

SEQ ID NO: 1870028 - RNA, 14 nt, Homo sapiens
uuucaaaauucuca

SEQ ID NO: 1870029 - RNA, 14 nt, Homo sapiens
ugucacaaugcucc

SEQ ID NO: 1870030 - RNA, 20 nt, Homo sapiens
ccaugaacaaguuaguuucu

SEQ ID NO: 1870031 - RNA, 23 nt, Homo sapiens
auggggauaaaggagaaggcaug

SEQ ID NO: 1870032 - RNA, 23 nt, Homo sapiens
uauauuuuuuaaaauaagucuga

SEQ ID NO: 1870033 - RNA, 13 nt, Homo sapiens
auugcacuuuccu

SEQ ID NO: 1870034 - RNA, 18 nt, Homo sapiens
auuacuguuccagauucc

SEQ ID NO: 1870035 - RNA, 15 nt, Homo sapiens
uaagacagagucuca

SEQ ID NO: 1870036 - RNA, 15 nt, Homo sapiens
guugcuguaugucuc

SEQ ID NO: 1870037 - RNA, 22 nt, Homo sapiens
agcuucaacuacuucucuugca

SEQ ID NO: 1870038 - RNA, 18 nt, Homo sapiens
aaucucugaauuugagau

SEQ ID NO: 1870039 - RNA, 12 nt, Homo sapiens
cuaaugguguug

SEQ ID NO: 1870040 - RNA, 12 nt, Homo sapiens
ccuguggugcaa

SEQ ID NO: 1870041 - RNA, 16 nt, Homo sapiens
guauuuuucacaaagg

SEQ ID NO: 1870042 - RNA, 13 nt, Homo sapiens
guccugucagugc

SEQ ID NO: 1870043 - RNA, 15 nt, Homo sapiens
caguggcucaugccu

SEQ ID NO: 1870044 - RNA, 14 nt, Homo sapiens
acaugccacaagga

SEQ ID NO: 1870045 - RNA, 23 nt, Homo sapiens
ccuggacuguuucaagguccaug

SEQ ID NO: 1870046 - RNA, 19 nt, Homo sapiens
aaaauuuuuaaaacacaga

SEQ ID NO: 1870047 - RNA, 12 nt, Homo sapiens
ccagagcugugc

SEQ ID NO: 1870048 - RNA, 22 nt, Homo sapiens
aaugaugguaaagccauguuaa

SEQ ID NO: 1870049 - RNA, 16 nt, Homo sapiens
agcccuccucugucaa

SEQ ID NO: 1870050 - RNA, 12 nt, Homo sapiens
aauugugugaug

SEQ ID NO: 1870051 - RNA, 10 nt, Homo sapiens
aaucuuguca

SEQ ID NO: 1870052 - RNA, 19 nt, Homo sapiens
gguuuuuuucuucuguauu

SEQ ID NO: 1870053 - RNA, 21 nt, Homo sapiens
ccaacuucuucagagcugaca

SEQ ID NO: 1870054 - RNA, 14 nt, Homo sapiens
ucaaugcagguuug

SEQ ID NO: 1870055 - RNA, 18 nt, Homo sapiens
cuuaaaaaucaagacacu

SEQ ID NO: 1870056 - RNA, 18 nt, Homo sapiens
acugacccucaggcacac

SEQ ID NO: 1870057 - RNA, 18 nt, Homo sapiens
agaaccagagcucagaga

SEQ ID NO: 1870058 - RNA, 18 nt, Homo sapiens
accccaacagcacccucu

SEQ ID NO: 1870059 - RNA, 14 nt, Homo sapiens
auucuacacauaua

SEQ ID NO: 1870060 - RNA, 14 nt, Homo sapiens
cacccacaaucaca

SEQ ID NO: 1870061 - RNA, 19 nt, Homo sapiens
aagaguuucacaaauccuu

SEQ ID NO: 1870062 - RNA, 15 nt, Homo sapiens
uauauuuauacucua

SEQ ID NO: 1870063 - RNA, 21 nt, Homo sapiens
uuuugcauguaugacuuaaua

SEQ ID NO: 1870064 - RNA, 11 nt, Homo sapiens
gauauggcaug

SEQ ID NO: 1870065 - RNA, 20 nt, Homo sapiens
acagggauuuugaauaugcc

SEQ ID NO: 1870066 - RNA, 14 nt, Homo sapiens
aggaccaauugacu

SEQ ID NO: 1870067 - RNA, 19 nt, Homo sapiens
cauuccaguagccaguauc

SEQ ID NO: 1870068 - RNA, 15 nt, Homo sapiens
uacacuucaccuccu

SEQ ID NO: 1870069 - RNA, 18 nt, Homo sapiens
cuacuccaguaugacaga

SEQ ID NO: 1870070 - RNA, 18 nt, Homo sapiens
agauaagguggcuucuca

SEQ ID NO: 1870071 - RNA, 21 nt, Homo sapiens
uuaauguucccaaaccagaga

SEQ ID NO: 1870072 - RNA, 18 nt, Homo sapiens
gauuacagaaacugaugc

SEQ ID NO: 1870073 - RNA, 14 nt, Homo sapiens
augccgacuaggug

SEQ ID NO: 1870074 - RNA, 19 nt, Homo sapiens
ugugaggagguagauuugg

SEQ ID NO: 1870075 - RNA, 14 nt, Homo sapiens
cagacacaggugua

SEQ ID NO: 1870076 - RNA, 22 nt, Homo sapiens
gaagcuggggaggagcuuuguu

SEQ ID NO: 1870077 - RNA, 21 nt, Homo sapiens
uccuuggggcacagucauuca

SEQ ID NO: 1870078 - RNA, 16 nt, Homo sapiens
uguggagcacguggag

SEQ ID NO: 1870079 - RNA, 20 nt, Homo sapiens
ucuccuuugcucuugccaaa

SEQ ID NO: 1870080 - RNA, 12 nt, Homo sapiens
cuguuaugucaa

SEQ ID NO: 1870081 - RNA, 14 nt, Homo sapiens
ccaagagagguccu

SEQ ID NO: 1870082 - RNA, 21 nt, Homo sapiens
cagaagauccaagaggcccug

SEQ ID NO: 1870083 - RNA, 19 nt, Homo sapiens
agaaauuauacuuacuucu

SEQ ID NO: 1870084 - RNA, 16 nt, Homo sapiens
cacuuaaacucaucua

SEQ ID NO: 1870085 - RNA, 17 nt, Homo sapiens
ugcaaccuccgccuccc

SEQ ID NO: 1870086 - RNA, 21 nt, Homo sapiens
cugccuacuuuuaguugacuc

SEQ ID NO: 1870087 - RNA, 14 nt, Homo sapiens
acagaggcuguggu

SEQ ID NO: 1870088 - RNA, 12 nt, Homo sapiens
cuaaagugcaag

SEQ ID NO: 1870089 - RNA, 21 nt, Homo sapiens
uggaaauagaaagaagccaua

SEQ ID NO: 1870090 - RNA, 23 nt, Homo sapiens
caggcuguggguagaugugcaau

SEQ ID NO: 1870091 - RNA, 22 nt, Homo sapiens
guucugagaagcccgaggucau

SEQ ID NO: 1870092 - RNA, 18 nt, Homo sapiens
agcuccuguccccugcua

SEQ ID NO: 1870093 - RNA, 16 nt, Homo sapiens
auuucuuguugcucaa

SEQ ID NO: 1870094 - RNA, 17 nt, Homo sapiens
guuuguauuuugcauac

SEQ ID NO: 1870095 - RNA, 16 nt, Homo sapiens
ccaucucuaccaucau

SEQ ID NO: 1870096 - RNA, 23 nt, Homo sapiens
cccaugaguagugcccacuugag

SEQ ID NO: 1870097 - RNA, 14 nt, Homo sapiens
uccaucucuuccuu

SEQ ID NO: 1870098 - RNA, 20 nt, Homo sapiens
caagacauuaaaucuaugaa

SEQ ID NO: 1870099 - RNA, 17 nt, Homo sapiens
aaacguauucagaguua

SEQ ID NO: 1870100 - RNA, 23 nt, Homo sapiens
ccucugugcucccucggucaccu

SEQ ID NO: 1870101 - RNA, 14 nt, Homo sapiens
cugggaugaaggcu

SEQ ID NO: 1870102 - RNA, 16 nt, Homo sapiens
auccuugauaaaugcc

SEQ ID NO: 1870103 - RNA, 23 nt, Homo sapiens
gaaggaaacagauuuaagcaaga

SEQ ID NO: 1870104 - RNA, 19 nt, Homo sapiens
ugcuucuaaguaaauacaa

SEQ ID NO: 1870105 - RNA, 13 nt, Homo sapiens
uccuggcacuaac

SEQ ID NO: 1870106 - RNA, 18 nt, Homo sapiens
cccccacgugacagugcc

SEQ ID NO: 1870107 - RNA, 23 nt, Homo sapiens
gguggguccacacggucuucaca

SEQ ID NO: 1870108 - RNA, 19 nt, Homo sapiens
gaaaggcacauuacauuua

SEQ ID NO: 1870109 - RNA, 14 nt, Homo sapiens
auacaaugaugcua

SEQ ID NO: 1870110 - RNA, 14 nt, Homo sapiens
gagauguggaaaag

SEQ ID NO: 1870111 - RNA, 18 nt, Homo sapiens
ugugaaacacaugccagu

SEQ ID NO: 1870112 - RNA, 13 nt, Homo sapiens
aagggagugcaug

SEQ ID NO: 1870113 - RNA, 17 nt, Homo sapiens
ggccacacugugacaca

SEQ ID NO: 1870114 - RNA, 17 nt, Homo sapiens
ugucugucagcugugaa

SEQ ID NO: 1870115 - RNA, 19 nt, Homo sapiens
ugugcugcaccuggucaua

SEQ ID NO: 1870116 - RNA, 20 nt, Homo sapiens
uggccacuggggugccuuca

SEQ ID NO: 1870117 - RNA, 19 nt, Homo sapiens
cuggagccagagagacaga

SEQ ID NO: 1870118 - RNA, 17 nt, Homo sapiens
agagcugagugagcuga

SEQ ID NO: 1870119 - RNA, 15 nt, Homo sapiens
auuugcauccagcag

SEQ ID NO: 1870120 - RNA, 17 nt, Homo sapiens
cuauaauaaaacuaaac

SEQ ID NO: 1870121 - RNA, 14 nt, Homo sapiens
cgagaccccggcuu

SEQ ID NO: 1870122 - RNA, 22 nt, Homo sapiens
uaaacaguugcacagcaucuca

SEQ ID NO: 1870123 - RNA, 21 nt, Homo sapiens
caccucuuacuuccugccuca

SEQ ID NO: 1870124 - RNA, 20 nt, Homo sapiens
agaagggaauuuauugccuc

SEQ ID NO: 1870125 - RNA, 14 nt, Homo sapiens
agaaagaugacaaa

SEQ ID NO: 1870126 - RNA, 14 nt, Homo sapiens
caaacaccuggacu

SEQ ID NO: 1870127 - RNA, 14 nt, Homo sapiens
uuggaauauuacaa

SEQ ID NO: 1870128 - RNA, 19 nt, Homo sapiens
ccuuuagcuguguuauuau

SEQ ID NO: 1870129 - RNA, 17 nt, Homo sapiens
aauuguagugcaaaaug

SEQ ID NO: 1870130 - RNA, 16 nt, Homo sapiens
aggaagauaucaugaa

SEQ ID NO: 1870131 - RNA, 20 nt, Homo sapiens
ugagcugagaucacaccacu

SEQ ID NO: 1870132 - RNA, 15 nt, Homo sapiens
uucaccuccauguca

SEQ ID NO: 1870133 - RNA, 15 nt, Homo sapiens
uguuaggugugcaaa

SEQ ID NO: 1870134 - RNA, 21 nt, Homo sapiens
aauuuauauaaaaauaccuua

SEQ ID NO: 1870135 - RNA, 21 nt, Homo sapiens
ccuuaauaaaaauauauauua

SEQ ID NO: 1870136 - RNA, 19 nt, Homo sapiens
uauuagugaaguaugcacu

SEQ ID NO: 1870137 - RNA, 12 nt, Homo sapiens
aauggacuggag

SEQ ID NO: 1870138 - RNA, 22 nt, Homo sapiens
gcuaacuuuuauuacagucaau

SEQ ID NO: 1870139 - RNA, 20 nt, Homo sapiens
aacaacauggggaccaguca

SEQ ID NO: 1870140 - RNA, 14 nt, Homo sapiens
aauaaaaccucagg

SEQ ID NO: 1870141 - RNA, 14 nt, Homo sapiens
uuucccauguauuu

SEQ ID NO: 1870142 - RNA, 22 nt, Homo sapiens
aauaucuucauuucuaaauuga

SEQ ID NO: 1870143 - RNA, 22 nt, Homo sapiens
cuugaaaugaugguaaguuaau

SEQ ID NO: 1870144 - RNA, 22 nt, Homo sapiens
uagacuguacuuauuuuccaau

SEQ ID NO: 1870145 - RNA, 19 nt, Homo sapiens
ugauuccuugaguuucaua

SEQ ID NO: 1870146 - RNA, 17 nt, Homo sapiens
uuaccacuaguugcuua

SEQ ID NO: 1870147 - RNA, 16 nt, Homo sapiens
uauaguaugugacuuu

SEQ ID NO: 1870148 - RNA, 20 nt, Homo sapiens
caagagaacauuuuacuguu

SEQ ID NO: 1870149 - RNA, 20 nt, Homo sapiens
uuaugaaguuaacagucuca

SEQ ID NO: 1870150 - RNA, 17 nt, Homo sapiens
auauuaaaauauggcua

SEQ ID NO: 1870151 - RNA, 17 nt, Homo sapiens
ccaguaacugugcugua

SEQ ID NO: 1870152 - RNA, 15 nt, Homo sapiens
uauagcggcauauag

SEQ ID NO: 1870153 - RNA, 15 nt, Homo sapiens
uucuucagcucugaa

SEQ ID NO: 1870154 - RNA, 17 nt, Homo sapiens
auuuaacagucauuuaa

SEQ ID NO: 1870155 - RNA, 21 nt, Homo sapiens
caaaagcuuuuugauguauaa

SEQ ID NO: 1870156 - RNA, 15 nt, Homo sapiens
gccggaggccagcua

SEQ ID NO: 1870157 - RNA, 16 nt, Homo sapiens
agaccagaagugaaug

SEQ ID NO: 1870158 - RNA, 22 nt, Homo sapiens
gaguuagaauaauaaauauuua

SEQ ID NO: 1870159 - RNA, 13 nt, Homo sapiens
ucugagagccaua

SEQ ID NO: 1870160 - RNA, 20 nt, Homo sapiens
ccaggacugggucugaccug

SEQ ID NO: 1870161 - RNA, 21 nt, Homo sapiens
gaaauucuauaugauccugaa

SEQ ID NO: 1870162 - RNA, 13 nt, Homo sapiens
accgccucagggu

SEQ ID NO: 1870163 - RNA, 13 nt, Homo sapiens
agguucucaccuc

SEQ ID NO: 1870164 - RNA, 17 nt, Homo sapiens
uguggcaucuugccaag

SEQ ID NO: 1870165 - RNA, 14 nt, Homo sapiens
ucuccagauguuaa

SEQ ID NO: 1870166 - RNA, 13 nt, Homo sapiens
cucaccaagguga

SEQ ID NO: 1870167 - RNA, 14 nt, Homo sapiens
caaauaaacauguc

SEQ ID NO: 1870168 - RNA, 18 nt, Homo sapiens
cagguucucuuagagcca

SEQ ID NO: 1870169 - RNA, 18 nt, Homo sapiens
gaguuuccacuaucccaa

SEQ ID NO: 1870170 - RNA, 19 nt, Homo sapiens
caucuguggaaaugacagc

SEQ ID NO: 1870171 - RNA, 18 nt, Homo sapiens
uuucauccaccaauauca

SEQ ID NO: 1870172 - RNA, 13 nt, Homo sapiens
ugccccuccgucc

SEQ ID NO: 1870173 - RNA, 15 nt, Homo sapiens
aauuuuaaguaggaa

SEQ ID NO: 1870174 - RNA, 19 nt, Homo sapiens
ccuuuggauugacucugca

SEQ ID NO: 1870175 - RNA, 20 nt, Homo sapiens
cuagauguuuagaugagguu

SEQ ID NO: 1870176 - RNA, 16 nt, Homo sapiens
cucugcaaugcuucug

SEQ ID NO: 1870177 - RNA, 13 nt, Homo sapiens
uaacaccugaugu

SEQ ID NO: 1870178 - RNA, 13 nt, Homo sapiens
cuccuugucacag

SEQ ID NO: 1870179 - RNA, 13 nt, Homo sapiens
guaaagauuuguu

SEQ ID NO: 1870180 - RNA, 13 nt, Homo sapiens
gucuuucaucucc

SEQ ID NO: 1870181 - RNA, 19 nt, Homo sapiens
gaaccaauauuuguagaag

SEQ ID NO: 1870182 - RNA, 13 nt, Homo sapiens
gaaugacaggcuu

SEQ ID NO: 1870183 - RNA, 12 nt, Homo sapiens
acuuagcaacuu

SEQ ID NO: 1870184 - RNA, 12 nt, Homo sapiens
uugaagcauuga

SEQ ID NO: 1870185 - RNA, 22 nt, Homo sapiens
gacaaaaauauuucagcaaacg

SEQ ID NO: 1870186 - RNA, 17 nt, Homo sapiens
ccccuugcaaaguaaua

SEQ ID NO: 1870187 - RNA, 21 nt, Homo sapiens
uaggauaagcacuagaucucc

SEQ ID NO: 1870188 - RNA, 12 nt, Homo sapiens
acauuccaaacu

SEQ ID NO: 1870189 - RNA, 20 nt, Homo sapiens
aaacguggacucauuucacu

SEQ ID NO: 1870190 - RNA, 22 nt, Homo sapiens
uuucccucuucccugaccuccc

SEQ ID NO: 1870191 - RNA, 14 nt, Homo sapiens
ucacugccuuggcc

SEQ ID NO: 1870192 - RNA, 14 nt, Homo sapiens
ccuuccucauuugc

SEQ ID NO: 1870193 - RNA, 20 nt, Homo sapiens
acagauguuuuccacugagc

SEQ ID NO: 1870194 - RNA, 19 nt, Homo sapiens
ugcuugacaugguuuccaa

SEQ ID NO: 1870195 - RNA, 23 nt, Homo sapiens
agacuuuguguuuacaucugcau

SEQ ID NO: 1870196 - RNA, 18 nt, Homo sapiens
ugcagacaccugccuuaa

SEQ ID NO: 1870197 - RNA, 19 nt, Homo sapiens
cuucucugagcuccagugg

SEQ ID NO: 1870198 - RNA, 19 nt, Homo sapiens
acacaauuguuuuaccugu

SEQ ID NO: 1870199 - RNA, 21 nt, Homo sapiens
acuagguaggcuucuaccugc

SEQ ID NO: 1870200 - RNA, 22 nt, Homo sapiens
caaguacaaguauauaauaugu

SEQ ID NO: 1870201 - RNA, 18 nt, Homo sapiens
uguuggguggaggaugga

SEQ ID NO: 1870202 - RNA, 11 nt, Homo sapiens
ucccagugucu

SEQ ID NO: 1870203 - RNA, 11 nt, Homo sapiens
ucucagugucc

SEQ ID NO: 1870204 - RNA, 20 nt, Homo sapiens
ccuaaguauaaaugguuguc

SEQ ID NO: 1870205 - RNA, 21 nt, Homo sapiens
ggagaaagcucucuauaccaa

SEQ ID NO: 1870206 - RNA, 18 nt, Homo sapiens
aguagauaugaggcauuu

SEQ ID NO: 1870207 - RNA, 18 nt, Homo sapiens
caguuacugaugcuccug

SEQ ID NO: 1870208 - RNA, 23 nt, Homo sapiens
auauauuuuugguugucaauauu

SEQ ID NO: 1870209 - RNA, 17 nt, Homo sapiens
uuuuuaaaaaguguuua

SEQ ID NO: 1870210 - RNA, 22 nt, Homo sapiens
uugcaaaucuaaaguugcucca

SEQ ID NO: 1870211 - RNA, 11 nt, Homo sapiens
aaaugaugcag

SEQ ID NO: 1870212 - RNA, 17 nt, Homo sapiens
gaaauuacccacuguca

SEQ ID NO: 1870213 - RNA, 14 nt, Homo sapiens
ggaucaagacauaa

SEQ ID NO: 1870214 - RNA, 23 nt, Homo sapiens
gaagcaguuuaugagacagcuga

SEQ ID NO: 1870215 - RNA, 20 nt, Homo sapiens
cauguggcauguucaucgua

SEQ ID NO: 1870216 - RNA, 16 nt, Homo sapiens
acuggaaaccuguuau

SEQ ID NO: 1870217 - RNA, 23 nt, Homo sapiens
ucccuucccugaagaucuaguga

SEQ ID NO: 1870218 - RNA, 16 nt, Homo sapiens
aaggauggaagaaaga

SEQ ID NO: 1870219 - RNA, 15 nt, Homo sapiens
guguucauacauuug

SEQ ID NO: 1870220 - RNA, 15 nt, Homo sapiens
aguguggagcuggac

SEQ ID NO: 1870221 - RNA, 22 nt, Homo sapiens
uaaagaacacgaauugcucaau

SEQ ID NO: 1870222 - RNA, 12 nt, Homo sapiens
caaguaaaguau

SEQ ID NO: 1870223 - RNA, 23 nt, Homo sapiens
ccuauggaagcauauuguuauua

SEQ ID NO: 1870224 - RNA, 23 nt, Homo sapiens
cacaagaaguucuuguucuucag

SEQ ID NO: 1870225 - RNA, 13 nt, Homo sapiens
uuuuaacauucca

SEQ ID NO: 1870226 - RNA, 19 nt, Homo sapiens
accagcccugagaaagaau

SEQ ID NO: 1870227 - RNA, 18 nt, Homo sapiens
ucaaauuauuaccaguga

SEQ ID NO: 1870228 - RNA, 22 nt, Homo sapiens
gacagagucccuggcuccucua

SEQ ID NO: 1870229 - RNA, 12 nt, Homo sapiens
ugauccauaaag

SEQ ID NO: 1870230 - RNA, 18 nt, Homo sapiens
uuuaaauauaugcuaagu

SEQ ID NO: 1870231 - RNA, 19 nt, Homo sapiens
ggacucuuacugcuaacuu

SEQ ID NO: 1870232 - RNA, 15 nt, Homo sapiens
cuggacggggcgggc

SEQ ID NO: 1870233 - RNA, 22 nt, Homo sapiens
cugucauguggaaacuauuuaa

SEQ ID NO: 1870234 - RNA, 14 nt, Homo sapiens
gaagauuagcuuuu

SEQ ID NO: 1870235 - RNA, 16 nt, Homo sapiens
uuauggaacagggaug

SEQ ID NO: 1870236 - RNA, 18 nt, Homo sapiens
aacuaauaaaacuuugac

SEQ ID NO: 1870237 - RNA, 15 nt, Homo sapiens
uccccuaacacaagu

SEQ ID NO: 1870238 - RNA, 14 nt, Homo sapiens
cuuccagugguuug

SEQ ID NO: 1870239 - RNA, 21 nt, Homo sapiens
ggaaggcagaggcuggcacca

SEQ ID NO: 1870240 - RNA, 19 nt, Homo sapiens
aagucaaagaagacucagu

SEQ ID NO: 1870241 - RNA, 13 nt, Homo sapiens
cuuucuuccacua

SEQ ID NO: 1870242 - RNA, 20 nt, Homo sapiens
caaagaaguguauuuacaau

SEQ ID NO: 1870243 - RNA, 11 nt, Homo sapiens
auuugcucagg

SEQ ID NO: 1870244 - RNA, 14 nt, Homo sapiens
ugacauccaagcuu

SEQ ID NO: 1870245 - RNA, 17 nt, Homo sapiens
acuuuuuccuggcucau

SEQ ID NO: 1870246 - RNA, 23 nt, Homo sapiens
gacccuccuggggcucucagugu

SEQ ID NO: 1870247 - RNA, 20 nt, Homo sapiens
uccaaguuccugcacuccag

SEQ ID NO: 1870248 - RNA, 15 nt, Homo sapiens
auuauauauacaugg

SEQ ID NO: 1870249 - RNA, 14 nt, Homo sapiens
aauauggacaugua

SEQ ID NO: 1870250 - RNA, 22 nt, Homo sapiens
uguuagcaaaauggauaugaca

SEQ ID NO: 1870251 - RNA, 19 nt, Homo sapiens
auuauugaaauuguacaua

SEQ ID NO: 1870252 - RNA, 20 nt, Homo sapiens
aaggucauggccacacugug

SEQ ID NO: 1870253 - RNA, 21 nt, Homo sapiens
auacacuucuggcucacagga

SEQ ID NO: 1870254 - RNA, 15 nt, Homo sapiens
uucaaaagugauuau

SEQ ID NO: 1870255 - RNA, 22 nt, Homo sapiens
cucaguaacacaauacaguacu

SEQ ID NO: 1870256 - RNA, 19 nt, Homo sapiens
acaaaaucuuguaggucau

SEQ ID NO: 1870257 - RNA, 20 nt, Homo sapiens
aagauauaugacugcuucau

SEQ ID NO: 1870258 - RNA, 22 nt, Homo sapiens
gcugaauuauuggacagucuca

SEQ ID NO: 1870259 - RNA, 16 nt, Homo sapiens
uuuuccugauggcugg

SEQ ID NO: 1870260 - RNA, 23 nt, Homo sapiens
aucaacaccuaggucgccaguga

SEQ ID NO: 1870261 - RNA, 13 nt, Homo sapiens
gcaagaagacugu

SEQ ID NO: 1870262 - RNA, 21 nt, Homo sapiens
aauguuggcauuuaguagaaa

SEQ ID NO: 1870263 - RNA, 13 nt, Homo sapiens
gaaacuccaucuc

SEQ ID NO: 1870264 - RNA, 15 nt, Homo sapiens
acuccccugcacugg

SEQ ID NO: 1870265 - RNA, 16 nt, Homo sapiens
caagacaaugagagua

SEQ ID NO: 1870266 - RNA, 15 nt, Homo sapiens
aaugaguaaaaucac

SEQ ID NO: 1870267 - RNA, 22 nt, Homo sapiens
agugggcaggauaaacugaaaa

SEQ ID NO: 1870268 - RNA, 18 nt, Homo sapiens
agcaagcugcccagcccu

SEQ ID NO: 1870269 - RNA, 15 nt, Homo sapiens
uaaacaggcaaaaca

SEQ ID NO: 1870270 - RNA, 18 nt, Homo sapiens
ggaguccagcacaaccuu

SEQ ID NO: 1870271 - RNA, 19 nt, Homo sapiens
ggaaugcagcacaguacuc

SEQ ID NO: 1870272 - RNA, 22 nt, Homo sapiens
guagcuuuccacauuugucaca

SEQ ID NO: 1870273 - RNA, 22 nt, Homo sapiens
uugcuaaguggccggaaaacaa

SEQ ID NO: 1870274 - RNA, 18 nt, Homo sapiens
agcugccuggggcccaag

SEQ ID NO: 1870275 - RNA, 22 nt, Homo sapiens
guaggaaaugaaugaucuuggc

SEQ ID NO: 1870276 - RNA, 17 nt, Homo sapiens
uaaauucagaacaagca

SEQ ID NO: 1870277 - RNA, 14 nt, Homo sapiens
gccugagugaucca

SEQ ID NO: 1870278 - RNA, 17 nt, Homo sapiens
guggcugcugcugccac

SEQ ID NO: 1870279 - RNA, 18 nt, Homo sapiens
cagugccucaugccugua

SEQ ID NO: 1870280 - RNA, 18 nt, Homo sapiens
uuaccaccgucugucuca

SEQ ID NO: 1870281 - RNA, 15 nt, Homo sapiens
ugcagaguaaguauu

SEQ ID NO: 1870282 - RNA, 23 nt, Homo sapiens
agaagaauuguuugaaccuggga

SEQ ID NO: 1870283 - RNA, 23 nt, Homo sapiens
auaagauuuguacauauuaucau

SEQ ID NO: 1870284 - RNA, 21 nt, Homo sapiens
auaaucauucuuauuucauga

SEQ ID NO: 1870285 - RNA, 23 nt, Homo sapiens
aacuuaggcccuagcggcagaaa

SEQ ID NO: 1870286 - RNA, 20 nt, Homo sapiens
uggcccuauuuaaggcagau

SEQ ID NO: 1870287 - RNA, 17 nt, Homo sapiens
aggagcuuggcagagag

SEQ ID NO: 1870288 - RNA, 12 nt, Homo sapiens
accuaggagcag

SEQ ID NO: 1870289 - RNA, 19 nt, Homo sapiens
ccagugccucagugcugca

SEQ ID NO: 1870290 - RNA, 12 nt, Homo sapiens
aggucaggagac

SEQ ID NO: 1870291 - RNA, 14 nt, Homo sapiens
aacaugaagcacaa

SEQ ID NO: 1870292 - RNA, 17 nt, Homo sapiens
aggcgugggaucagauu

SEQ ID NO: 1870293 - RNA, 14 nt, Homo sapiens
uacacuuuguugca

SEQ ID NO: 1870294 - RNA, 23 nt, Homo sapiens
uacaauuuguuaauuccuaugaa

SEQ ID NO: 1870295 - RNA, 12 nt, Homo sapiens
ccaaggugggaa

SEQ ID NO: 1870296 - RNA, 23 nt, Homo sapiens
uauccccaaacaccaugaaucuu

SEQ ID NO: 1870297 - RNA, 17 nt, Homo sapiens
caagauuggcauaucau

SEQ ID NO: 1870298 - RNA, 16 nt, Homo sapiens
ccucuuuuucuagucu

SEQ ID NO: 1870299 - RNA, 14 nt, Homo sapiens
ggaugauaacuacu

SEQ ID NO: 1870300 - RNA, 21 nt, Homo sapiens
cacuaggugccugcccaggga

SEQ ID NO: 1870301 - RNA, 20 nt, Homo sapiens
uaucugagggagacugcaaa

SEQ ID NO: 1870302 - RNA, 21 nt, Homo sapiens
gucagugcugccuguccccau

SEQ ID NO: 1870303 - RNA, 17 nt, Homo sapiens
aauaugggcucaaguca

SEQ ID NO: 1870304 - RNA, 15 nt, Homo sapiens
aaugugaaaccauca

SEQ ID NO: 1870305 - RNA, 13 nt, Homo sapiens
agaauugcacauc

SEQ ID NO: 1870306 - RNA, 20 nt, Homo sapiens
caguuggaugaacauucaag

SEQ ID NO: 1870307 - RNA, 22 nt, Homo sapiens
uuaaauggcuuuugccacauac

SEQ ID NO: 1870308 - RNA, 21 nt, Homo sapiens
cuuuuauguaguaauugacau

SEQ ID NO: 1870309 - RNA, 19 nt, Homo sapiens
ucucgccucauuacuguga

SEQ ID NO: 1870310 - RNA, 14 nt, Homo sapiens
uuuuuucugccuga

SEQ ID NO: 1870311 - RNA, 17 nt, Homo sapiens
caguucaccugcacuua

SEQ ID NO: 1870312 - RNA, 24 nt, Homo sapiens
ucuuccgcagacuuggucaucgac

SEQ ID NO: 1870313 - RNA, 18 nt, Homo sapiens
cugcggccccgucugugg

SEQ ID NO: 1870314 - RNA, 16 nt, Homo sapiens
aaauuucagccuacau

SEQ ID NO: 1870315 - RNA, 18 nt, Homo sapiens
auacuguauauucaggac

SEQ ID NO: 1870316 - RNA, 18 nt, Homo sapiens
gacucauggccgggcuga

SEQ ID NO: 1870317 - RNA, 18 nt, Homo sapiens
gccaaccaagaugcaaau

SEQ ID NO: 1870318 - RNA, 17 nt, Homo sapiens
gcugucauuuuaugcua

SEQ ID NO: 1870319 - RNA, 20 nt, Homo sapiens
guauuaggugucauuuccau

SEQ ID NO: 1870320 - RNA, 16 nt, Homo sapiens
aggcaaaaaacucuua

SEQ ID NO: 1870321 - RNA, 18 nt, Homo sapiens
uuacccuccacacacuuc

SEQ ID NO: 1870322 - RNA, 17 nt, Homo sapiens
guuugacaccuuagaga

SEQ ID NO: 1870323 - RNA, 17 nt, Homo sapiens
auucacaaaauuuccac

SEQ ID NO: 1870324 - RNA, 11 nt, Homo sapiens
uuaacccucaa

SEQ ID NO: 1870325 - RNA, 15 nt, Homo sapiens
ugagaccacaggcuu

SEQ ID NO: 1870326 - RNA, 15 nt, Homo sapiens
agcaaaacaguucuc

SEQ ID NO: 1870327 - RNA, 16 nt, Homo sapiens
auauacauaugacaua

SEQ ID NO: 1870328 - RNA, 20 nt, Homo sapiens
uggaaagguggcuuuuagca

SEQ ID NO: 1870329 - RNA, 14 nt, Homo sapiens
accgugcugggcuc

SEQ ID NO: 1870330 - RNA, 18 nt, Homo sapiens
cacggaugacuuaacugc

SEQ ID NO: 1870331 - RNA, 15 nt, Homo sapiens
uucacugucaccacc

SEQ ID NO: 1870332 - RNA, 12 nt, Homo sapiens
gaaccacaagag

SEQ ID NO: 1870333 - RNA, 20 nt, Homo sapiens
accuuaaagaaccaucagca

SEQ ID NO: 1870334 - RNA, 20 nt, Homo sapiens
ugggacuguuuacaaaugag

SEQ ID NO: 1870335 - RNA, 21 nt, Homo sapiens
aucagggaggguuaggaaaac

SEQ ID NO: 1870336 - RNA, 21 nt, Homo sapiens
auaugggguguuuguucccau

SEQ ID NO: 1870337 - RNA, 21 nt, Homo sapiens
gccagggugagggagggccaa

SEQ ID NO: 1870338 - RNA, 15 nt, Homo sapiens
uccuuucacaaccuu

SEQ ID NO: 1870339 - RNA, 15 nt, Homo sapiens
cccaggagcaaguga

SEQ ID NO: 1870340 - RNA, 20 nt, Homo sapiens
agaagucccucccaucucua

SEQ ID NO: 1870341 - RNA, 19 nt, Homo sapiens
guaaaaugcacccaucagc

SEQ ID NO: 1870342 - RNA, 21 nt, Homo sapiens
augaguccccccucuugucuc

SEQ ID NO: 1870343 - RNA, 23 nt, Homo sapiens
acaggagcugggauccuaagggc

SEQ ID NO: 1870344 - RNA, 12 nt, Homo sapiens
cacugcuugcac

SEQ ID NO: 1870345 - RNA, 16 nt, Homo sapiens
uuaagaguugaaagaa

SEQ ID NO: 1870346 - RNA, 15 nt, Homo sapiens
cagugcugcuguaaa

SEQ ID NO: 1870347 - RNA, 14 nt, Homo sapiens
cagacguacaggcc

SEQ ID NO: 1870348 - RNA, 18 nt, Homo sapiens
cuuaacuaauuugaaugu

SEQ ID NO: 1870349 - RNA, 23 nt, Homo sapiens
ucuuaaagacaaauuuugcauau

SEQ ID NO: 1870350 - RNA, 18 nt, Homo sapiens
acguggacucugugcuca

SEQ ID NO: 1870351 - RNA, 20 nt, Homo sapiens
aaagagcuccaaauugaauc

SEQ ID NO: 1870352 - RNA, 12 nt, Homo sapiens
gcguuacugcuu

SEQ ID NO: 1870353 - RNA, 12 nt, Homo sapiens
aagauacuaaua

SEQ ID NO: 1870354 - RNA, 14 nt, Homo sapiens
accaagcuucagag

SEQ ID NO: 1870355 - RNA, 20 nt, Homo sapiens
cuaacauauauguauauaca

SEQ ID NO: 1870356 - RNA, 15 nt, Homo sapiens
auacuucaaguaaga

SEQ ID NO: 1870357 - RNA, 17 nt, Homo sapiens
ugguccuagguccucug

SEQ ID NO: 1870358 - RNA, 18 nt, Homo sapiens
cacagagauaugcacaca

SEQ ID NO: 1870359 - RNA, 14 nt, Homo sapiens
agccuauuuaccug

SEQ ID NO: 1870360 - RNA, 18 nt, Homo sapiens
aaaagcugggaaccagca

SEQ ID NO: 1870361 - RNA, 20 nt, Homo sapiens
augacugacccaaaauguga

SEQ ID NO: 1870362 - RNA, 18 nt, Homo sapiens
aaacacagauguguugca

SEQ ID NO: 1870363 - RNA, 15 nt, Homo sapiens
auucaauauuaugaa

SEQ ID NO: 1870364 - RNA, 13 nt, Homo sapiens
acaccuggacaau

SEQ ID NO: 1870365 - RNA, 16 nt, Homo sapiens
guucccgacaccagaa

SEQ ID NO: 1870366 - RNA, 13 nt, Homo sapiens
ucuauaucaaaaa

SEQ ID NO: 1870367 - RNA, 14 nt, Homo sapiens
guuucccuaucucg

SEQ ID NO: 1870368 - RNA, 21 nt, Homo sapiens
uaaggaccaauagcaucugug

SEQ ID NO: 1870369 - RNA, 14 nt, Homo sapiens
aacacacucaaaag

SEQ ID NO: 1870370 - RNA, 19 nt, Homo sapiens
cagagaccacaccacuaac

SEQ ID NO: 1870371 - RNA, 21 nt, Homo sapiens
ccuagugaacugcaaccucaa

SEQ ID NO: 1870372 - RNA, 14 nt, Homo sapiens
caucccauguauuu

SEQ ID NO: 1870373 - RNA, 16 nt, Homo sapiens
ugcagagaugacuguc

SEQ ID NO: 1870374 - RNA, 17 nt, Homo sapiens
cacguguguguguuuca

SEQ ID NO: 1870375 - RNA, 15 nt, Homo sapiens
gaccauaaccacuga

SEQ ID NO: 1870376 - RNA, 15 nt, Homo sapiens
auuucagcuaugcua

SEQ ID NO: 1870377 - RNA, 17 nt, Homo sapiens
caguaucucuuacauca

SEQ ID NO: 1870378 - RNA, 19 nt, Homo sapiens
gucacuccguuuugcaaaa

SEQ ID NO: 1870379 - RNA, 20 nt, Homo sapiens
uucugaggguccacuacuca

SEQ ID NO: 1870380 - RNA, 22 nt, Homo sapiens
accaggcugaagucagcucaga

SEQ ID NO: 1870381 - RNA, 19 nt, Homo sapiens
ccacaacucccuugcacgu

SEQ ID NO: 1870382 - RNA, 19 nt, Homo sapiens
uaguauucucuugugcauu

SEQ ID NO: 1870383 - RNA, 20 nt, Homo sapiens
cagaaaugaaauagcuuagc

SEQ ID NO: 1870384 - RNA, 23 nt, Homo sapiens
uuauggcucaaaauccacugacg

SEQ ID NO: 1870385 - RNA, 13 nt, Homo sapiens
acagugaauuuaa

SEQ ID NO: 1870386 - RNA, 17 nt, Homo sapiens
uggcugacuggcaguaa

SEQ ID NO: 1870387 - RNA, 17 nt, Homo sapiens
caaaaggaaaccaagug

SEQ ID NO: 1870388 - RNA, 14 nt, Homo sapiens
cccaugggacaaau

SEQ ID NO: 1870389 - RNA, 21 nt, Homo sapiens
gaaaaccagugaagugccaca

SEQ ID NO: 1870390 - RNA, 14 nt, Homo sapiens
cacccuauauauaa

SEQ ID NO: 1870391 - RNA, 18 nt, Homo sapiens
aaacaggcugacuggcag

SEQ ID NO: 1870392 - RNA, 21 nt, Homo sapiens
auauguacaaauaauauugcc

SEQ ID NO: 1870393 - RNA, 20 nt, Homo sapiens
uugggggggguggucucuuc

SEQ ID NO: 1870394 - RNA, 21 nt, Homo sapiens
gggacagggcucgccucagga

SEQ ID NO: 1870395 - RNA, 18 nt, Homo sapiens
uuggagugagaugaagga

SEQ ID NO: 1870396 - RNA, 14 nt, Homo sapiens
uuaugucuauaacu

SEQ ID NO: 1870397 - RNA, 23 nt, Homo sapiens
cugccacugggcucuggaccuca

SEQ ID NO: 1870398 - RNA, 19 nt, Homo sapiens
uggacccccuggaagcuga

SEQ ID NO: 1870399 - RNA, 17 nt, Homo sapiens
aguaccggccaagcaua

SEQ ID NO: 1870400 - RNA, 21 nt, Homo sapiens
agagaagccuucaagcucuga

SEQ ID NO: 1870401 - RNA, 16 nt, Homo sapiens
agauggcugugccucu

SEQ ID NO: 1870402 - RNA, 21 nt, Homo sapiens
uauggagagauggucagaaau

SEQ ID NO: 1870403 - RNA, 21 nt, Homo sapiens
ccucuagaagaagccaagaau

SEQ ID NO: 1870404 - RNA, 14 nt, Homo sapiens
aaggcacagcauuc

SEQ ID NO: 1870405 - RNA, 18 nt, Homo sapiens
uucacaugccuugcaaug

SEQ ID NO: 1870406 - RNA, 14 nt, Homo sapiens
auugagaccugagu

SEQ ID NO: 1870407 - RNA, 17 nt, Homo sapiens
augaugugcaaccagca

SEQ ID NO: 1870408 - RNA, 16 nt, Homo sapiens
cucaggauccagugac

SEQ ID NO: 1870409 - RNA, 23 nt, Homo sapiens
gaauugcgccuuccgagcacaca

SEQ ID NO: 1870410 - RNA, 18 nt, Homo sapiens
uguaacacuguauaacau

SEQ ID NO: 1870411 - RNA, 16 nt, Homo sapiens
cuuuucuccacuguca

SEQ ID NO: 1870412 - RNA, 19 nt, Homo sapiens
ccagagugugcagacugau

SEQ ID NO: 1870413 - RNA, 14 nt, Homo sapiens
agguaugagccagg

SEQ ID NO: 1870414 - RNA, 16 nt, Homo sapiens
ccagcgagcacccuca

SEQ ID NO: 1870415 - RNA, 19 nt, Homo sapiens
aaaugaaccugaucacuuu

SEQ ID NO: 1870416 - RNA, 16 nt, Homo sapiens
ugcauaauaugcauau

SEQ ID NO: 1870417 - RNA, 17 nt, Homo sapiens
uuaccacaaugagcaau

SEQ ID NO: 1870418 - RNA, 20 nt, Homo sapiens
cacacaucaguaauguauuc

SEQ ID NO: 1870419 - RNA, 22 nt, Homo sapiens
aacucaggcuuucagcugugcu

SEQ ID NO: 1870420 - RNA, 12 nt, Homo sapiens
auucuugcacug

SEQ ID NO: 1870421 - RNA, 16 nt, Homo sapiens
agaggacaccauccaa

SEQ ID NO: 1870422 - RNA, 18 nt, Homo sapiens
uuaaagucuacacugccu

SEQ ID NO: 1870423 - RNA, 21 nt, Homo sapiens
ugagaaggguugauccugcau

SEQ ID NO: 1870424 - RNA, 19 nt, Homo sapiens
cagcucagggacuggcaca

SEQ ID NO: 1870425 - RNA, 14 nt, Homo sapiens
acauuuuguuauag

SEQ ID NO: 1870426 - RNA, 22 nt, Homo sapiens
gaaaaugccagagcuugugaac

SEQ ID NO: 1870427 - RNA, 21 nt, Homo sapiens
agaacuguuucaacuguauaa

SEQ ID NO: 1870428 - RNA, 14 nt, Homo sapiens
acugacugcuuaua

SEQ ID NO: 1870429 - RNA, 16 nt, Homo sapiens
auagaaagcuguuuau

SEQ ID NO: 1870430 - RNA, 17 nt, Homo sapiens
guggcuccuaucugugu

SEQ ID NO: 1870431 - RNA, 16 nt, Homo sapiens
acacagccuauaucaa

SEQ ID NO: 1870432 - RNA, 13 nt, Homo sapiens
uaucgaucucuua

SEQ ID NO: 1870433 - RNA, 11 nt, Homo sapiens
cugaagggaau

SEQ ID NO: 1870434 - RNA, 13 nt, Homo sapiens
ucuaucagguuuu

SEQ ID NO: 1870435 - RNA, 13 nt, Homo sapiens
gccaccaguucuc

SEQ ID NO: 1870436 - RNA, 19 nt, Homo sapiens
ucccagccugguuugcaaa

SEQ ID NO: 1870437 - RNA, 20 nt, Homo sapiens
gagaaaccccuggggaccau

SEQ ID NO: 1870438 - RNA, 16 nt, Homo sapiens
auuuuaauguuuccuu

SEQ ID NO: 1870439 - RNA, 14 nt, Homo sapiens
aaugucuucaagac

SEQ ID NO: 1870440 - RNA, 19 nt, Homo sapiens
cuguuagggcugaaucuuc

SEQ ID NO: 1870441 - RNA, 20 nt, Homo sapiens
cuauuuaucuucauuugaau

SEQ ID NO: 1870442 - RNA, 17 nt, Homo sapiens
cugaccuacucuugccu

SEQ ID NO: 1870443 - RNA, 18 nt, Homo sapiens
gaauauuaaagcucuuca

SEQ ID NO: 1870444 - RNA, 20 nt, Homo sapiens
cgaagugccagaacccaaau

SEQ ID NO: 1870445 - RNA, 19 nt, Homo sapiens
uucuauuuaacaacugggu

SEQ ID NO: 1870446 - RNA, 23 nt, Homo sapiens
aacccacagguguuggcugccug

SEQ ID NO: 1870447 - RNA, 22 nt, Homo sapiens
cccuaugugggugggaccacag

SEQ ID NO: 1870448 - RNA, 23 nt, Homo sapiens
agugcaucugggaagauuucuac

SEQ ID NO: 1870449 - RNA, 22 nt, Homo sapiens
ccaugcaagaacucaucacugu

SEQ ID NO: 1870450 - RNA, 24 nt, Homo sapiens
acagacuaugucacccaaugcaua

SEQ ID NO: 1870451 - RNA, 20 nt, Homo sapiens
ccaugugcuacaggggccag

SEQ ID NO: 1870452 - RNA, 13 nt, Homo sapiens
guuuucaugacca

SEQ ID NO: 1870453 - RNA, 17 nt, Homo sapiens
accaggccucagcucuu

SEQ ID NO: 1870454 - RNA, 16 nt, Homo sapiens
ucuuaauaggcuuuau

SEQ ID NO: 1870455 - RNA, 14 nt, Homo sapiens
uuauuuuucuauga

SEQ ID NO: 1870456 - RNA, 17 nt, Homo sapiens
gaaauauuuaaguauau

SEQ ID NO: 1870457 - RNA, 14 nt, Homo sapiens
gaugauacauccaa

SEQ ID NO: 1870458 - RNA, 19 nt, Homo sapiens
uaaacaguuugaaaagaca

SEQ ID NO: 1870459 - RNA, 15 nt, Homo sapiens
uucacuagacugugc

SEQ ID NO: 1870460 - RNA, 15 nt, Homo sapiens
ccuuguaugacauau

SEQ ID NO: 1870461 - RNA, 23 nt, Homo sapiens
ccuggaaaagaagaaacuuugcc

SEQ ID NO: 1870462 - RNA, 18 nt, Homo sapiens
uaagcuaccuugucauau

SEQ ID NO: 1870463 - RNA, 18 nt, Homo sapiens
guugagggcaauggacaa

SEQ ID NO: 1870464 - RNA, 21 nt, Homo sapiens
gggcagaugucuccccugcca

SEQ ID NO: 1870465 - RNA, 17 nt, Homo sapiens
ucccacugacuguaugg

SEQ ID NO: 1870466 - RNA, 13 nt, Homo sapiens
cagagccuaccuu

SEQ ID NO: 1870467 - RNA, 16 nt, Homo sapiens
cugggccauagucauu

SEQ ID NO: 1870468 - RNA, 18 nt, Homo sapiens
auaaaagaugauuucuca

SEQ ID NO: 1870469 - RNA, 21 nt, Homo sapiens
cacugaauucacuccagucaa

SEQ ID NO: 1870470 - RNA, 22 nt, Homo sapiens
accuacugauaaccacuccuaa

SEQ ID NO: 1870471 - RNA, 12 nt, Homo sapiens
aggggcugucca

SEQ ID NO: 1870472 - RNA, 20 nt, Homo sapiens
uguaaaucuauaugauuuca

SEQ ID NO: 1870473 - RNA, 17 nt, Homo sapiens
gggagccgcagagccug

SEQ ID NO: 1870474 - RNA, 14 nt, Homo sapiens
ucugcaacugaaau

SEQ ID NO: 1870475 - RNA, 22 nt, Homo sapiens
auaagaacuucuauaauuguau

SEQ ID NO: 1870476 - RNA, 14 nt, Homo sapiens
acuccuuccuugaa

SEQ ID NO: 1870477 - RNA, 12 nt, Homo sapiens
cucuuauuacag

SEQ ID NO: 1870478 - RNA, 19 nt, Homo sapiens
uaagucagggaagagcagu

SEQ ID NO: 1870479 - RNA, 19 nt, Homo sapiens
cauguaaaugauuaucucc

SEQ ID NO: 1870480 - RNA, 15 nt, Homo sapiens
acauguuuuugauau

SEQ ID NO: 1870481 - RNA, 14 nt, Homo sapiens
aaauuuucuaauua

SEQ ID NO: 1870482 - RNA, 13 nt, Homo sapiens
uucugugaucuuu

SEQ ID NO: 1870483 - RNA, 14 nt, Homo sapiens
aggaacaaagacag

SEQ ID NO: 1870484 - RNA, 22 nt, Homo sapiens
augaagccacagcccaggccuc

SEQ ID NO: 1870485 - RNA, 21 nt, Homo sapiens
aaaauauuuuuagaacuccaa

SEQ ID NO: 1870486 - RNA, 14 nt, Homo sapiens
guggucgagcuuuu

SEQ ID NO: 1870487 - RNA, 18 nt, Homo sapiens
guggggauguuuugacau

SEQ ID NO: 1870488 - RNA, 20 nt, Homo sapiens
uugaacuccugaccucaggu

SEQ ID NO: 1870489 - RNA, 19 nt, Homo sapiens
cagaaaaacuggcucugau

SEQ ID NO: 1870490 - RNA, 17 nt, Homo sapiens
cguaagugguaugcaug

SEQ ID NO: 1870491 - RNA, 16 nt, Homo sapiens
ucgucuggcaucuccc

SEQ ID NO: 1870492 - RNA, 18 nt, Homo sapiens
gccugagcaacaugguga

SEQ ID NO: 1870493 - RNA, 16 nt, Homo sapiens
uuuaaaaucuguucac

SEQ ID NO: 1870494 - RNA, 10 nt, Homo sapiens
uggcacuuug

SEQ ID NO: 1870495 - RNA, 15 nt, Homo sapiens
aagcgagagcagcug

SEQ ID NO: 1870496 - RNA, 20 nt, Homo sapiens
ggccucugacucugagucca

SEQ ID NO: 1870497 - RNA, 20 nt, Homo sapiens
caugugugagugugugcaag

SEQ ID NO: 1870498 - RNA, 16 nt, Homo sapiens
ggucucauguccugcu

SEQ ID NO: 1870499 - RNA, 15 nt, Homo sapiens
guagugacacacaga

SEQ ID NO: 1870500 - RNA, 21 nt, Homo sapiens
uuucaucacacuggguggugg

SEQ ID NO: 1870501 - RNA, 17 nt, Homo sapiens
ugaacuccauugcuuaa

SEQ ID NO: 1870502 - RNA, 17 nt, Homo sapiens
ccccaggggucccagcc

SEQ ID NO: 1870503 - RNA, 22 nt, Homo sapiens
accuucauuuaacucuuugaaa

SEQ ID NO: 1870504 - RNA, 18 nt, Homo sapiens
aguauuaagagcaauuca

SEQ ID NO: 1870505 - RNA, 15 nt, Homo sapiens
ugggagaagaucuca

SEQ ID NO: 1870506 - RNA, 17 nt, Homo sapiens
aauguaaagugcaauca

SEQ ID NO: 1870507 - RNA, 23 nt, Homo sapiens
gauaguggggagacuucuuggcu

SEQ ID NO: 1870508 - RNA, 22 nt, Homo sapiens
uaaaagguuaaauauugucaua

SEQ ID NO: 1870509 - RNA, 16 nt, Homo sapiens
agugugaacaaaagau

SEQ ID NO: 1870510 - RNA, 19 nt, Homo sapiens
cgacuccccccccagagac

SEQ ID NO: 1870511 - RNA, 16 nt, Homo sapiens
cuuggguuagaccuac

SEQ ID NO: 1870512 - RNA, 16 nt, Homo sapiens
cccugccggugcacag

SEQ ID NO: 1870513 - RNA, 22 nt, Homo sapiens
ggccggggcagggacuugccuc

SEQ ID NO: 1870514 - RNA, 22 nt, Homo sapiens
cggcgugagccaccaugccugg

SEQ ID NO: 1870515 - RNA, 20 nt, Homo sapiens
cagccugggugacagagcaa

SEQ ID NO: 1870516 - RNA, 19 nt, Homo sapiens
cuauuacugaugugugcaa

SEQ ID NO: 1870517 - RNA, 15 nt, Homo sapiens
cuucuucaauacuga

SEQ ID NO: 1870518 - RNA, 20 nt, Homo sapiens
aaccauuucagcuguuucac

SEQ ID NO: 1870519 - RNA, 21 nt, Homo sapiens
uagauguucuuuucuauuuau

SEQ ID NO: 1870520 - RNA, 14 nt, Homo sapiens
agacaaacacugcc

SEQ ID NO: 1870521 - RNA, 14 nt, Homo sapiens
gcagauuugcacug

SEQ ID NO: 1870522 - RNA, 19 nt, Homo sapiens
uguacauguucuugucaua

SEQ ID NO: 1870523 - RNA, 15 nt, Homo sapiens
cagugucuggcugca

SEQ ID NO: 1870524 - RNA, 21 nt, Homo sapiens
cucugaggggaggcaccucca

SEQ ID NO: 1870525 - RNA, 20 nt, Homo sapiens
guauguauuuucaguuacaa

SEQ ID NO: 1870526 - RNA, 15 nt, Homo sapiens
uuugugcuuugucca

SEQ ID NO: 1870527 - RNA, 22 nt, Homo sapiens
uucaagcaauucuccugccuca

SEQ ID NO: 1870528 - RNA, 15 nt, Homo sapiens
cuuauggaacugagu

SEQ ID NO: 1870529 - RNA, 12 nt, Homo sapiens
acuacaggugug

SEQ ID NO: 1870530 - RNA, 19 nt, Homo sapiens
ccucuucuuauucaugcuu

SEQ ID NO: 1870531 - RNA, 15 nt, Homo sapiens
ggaggaucaguuuuu

SEQ ID NO: 1870532 - RNA, 22 nt, Homo sapiens
gaagcuggccuggaccauuccu

SEQ ID NO: 1870533 - RNA, 17 nt, Homo sapiens
aacccauucccucucca

SEQ ID NO: 1870534 - RNA, 20 nt, Homo sapiens
ugaaaugaaugauucuacag

SEQ ID NO: 1870535 - RNA, 22 nt, Homo sapiens
ugaggcaugaguuacugugcau

SEQ ID NO: 1870536 - RNA, 21 nt, Homo sapiens
cuuugggccuuuccucagugu

SEQ ID NO: 1870537 - RNA, 13 nt, Homo sapiens
gaucucagcucac

SEQ ID NO: 1870538 - RNA, 16 nt, Homo sapiens
aaguaaucuguugaca

SEQ ID NO: 1870539 - RNA, 15 nt, Homo sapiens
gagaucaugucucac

SEQ ID NO: 1870540 - RNA, 18 nt, Homo sapiens
ugguaaaauacauauaaa

SEQ ID NO: 1870541 - RNA, 14 nt, Homo sapiens
ugggauuaacauaa

SEQ ID NO: 1870542 - RNA, 14 nt, Homo sapiens
ucauauguggaauc

SEQ ID NO: 1870543 - RNA, 18 nt, Homo sapiens
agugugguuccaagagau

SEQ ID NO: 1870544 - RNA, 17 nt, Homo sapiens
aucuaagggucucucau

SEQ ID NO: 1870545 - RNA, 17 nt, Homo sapiens
guaugagucuucuguaa

SEQ ID NO: 1870546 - RNA, 23 nt, Homo sapiens
uaaaaugcacccaucagugcucu

SEQ ID NO: 1870547 - RNA, 13 nt, Homo sapiens
acugaacuguuac

SEQ ID NO: 1870548 - RNA, 15 nt, Homo sapiens
gcagaggccaugaag

SEQ ID NO: 1870549 - RNA, 16 nt, Homo sapiens
uuuaccgagcacugug

SEQ ID NO: 1870550 - RNA, 20 nt, Homo sapiens
aucucuugucucacaugcua

SEQ ID NO: 1870551 - RNA, 20 nt, Homo sapiens
aguccaauuccuugcacaua

SEQ ID NO: 1870552 - RNA, 20 nt, Homo sapiens
cacuggggacuuaggggugc

SEQ ID NO: 1870553 - RNA, 19 nt, Homo sapiens
auaacacguccacuuucaa

SEQ ID NO: 1870554 - RNA, 20 nt, Homo sapiens
aggacaggauggcugugugu

SEQ ID NO: 1870555 - RNA, 16 nt, Homo sapiens
uugcuguugcuugaau

SEQ ID NO: 1870556 - RNA, 15 nt, Homo sapiens
uaguucauccaaucc

SEQ ID NO: 1870557 - RNA, 17 nt, Homo sapiens
gagcagaagaucaagga

SEQ ID NO: 1870558 - RNA, 16 nt, Homo sapiens
uccauguugcugccaa

SEQ ID NO: 1870559 - RNA, 13 nt, Homo sapiens
gaugaaucacuua

SEQ ID NO: 1870560 - RNA, 20 nt, Homo sapiens
agcuugaagaggggguuaga

SEQ ID NO: 1870561 - RNA, 21 nt, Homo sapiens
gaaucucguugaggccaagga

SEQ ID NO: 1870562 - RNA, 21 nt, Homo sapiens
auuccaaacacauacaggaag

SEQ ID NO: 1870563 - RNA, 14 nt, Homo sapiens
augucuggucuguc

SEQ ID NO: 1870564 - RNA, 13 nt, Homo sapiens
uccuuucuauauc

SEQ ID NO: 1870565 - RNA, 22 nt, Homo sapiens
ccgccucugcccucauccuccc

SEQ ID NO: 1870566 - RNA, 11 nt, Homo sapiens
aaaccaaaaaa

SEQ ID NO: 1870567 - RNA, 11 nt, Homo sapiens
gccccaaagcc

SEQ ID NO: 1870568 - RNA, 13 nt, Homo sapiens
auguuauuaccua

SEQ ID NO: 1870569 - RNA, 19 nt, Homo sapiens
cucuguacagcugcucuua

SEQ ID NO: 1870570 - RNA, 20 nt, Homo sapiens
uaagcaaacgggagaaauuu

SEQ ID NO: 1870571 - RNA, 15 nt, Homo sapiens
uaaccccuggcaacc

SEQ ID NO: 1870572 - RNA, 17 nt, Homo sapiens
caagaagugggugcccu

SEQ ID NO: 1870573 - RNA, 16 nt, Homo sapiens
acuuguuugcacugug

SEQ ID NO: 1870574 - RNA, 20 nt, Homo sapiens
acaguauugacuuguauacc

SEQ ID NO: 1870575 - RNA, 21 nt, Homo sapiens
agucccuuucagcugcugcuu

SEQ ID NO: 1870576 - RNA, 12 nt, Homo sapiens
aaaguguguauu

SEQ ID NO: 1870577 - RNA, 21 nt, Homo sapiens
cuguguacagaauucugcuac

SEQ ID NO: 1870578 - RNA, 18 nt, Homo sapiens
uccugggcccaagugauc

SEQ ID NO: 1870579 - RNA, 16 nt, Homo sapiens
gcagcugggauuacag

SEQ ID NO: 1870580 - RNA, 13 nt, Homo sapiens
accaaaacauuga

SEQ ID NO: 1870581 - RNA, 23 nt, Homo sapiens
cauuuuuccaaaggaagugcuaa

SEQ ID NO: 1870582 - RNA, 15 nt, Homo sapiens
ggcccccuucaggag

SEQ ID NO: 1870583 - RNA, 18 nt, Homo sapiens
uggcaugggaaugaaugu

SEQ ID NO: 1870584 - RNA, 15 nt, Homo sapiens
uaaucaguucugugu

SEQ ID NO: 1870585 - RNA, 14 nt, Homo sapiens
acucuccuagucaa

SEQ ID NO: 1870586 - RNA, 21 nt, Homo sapiens
auuuagaccccauacaaguuu

SEQ ID NO: 1870587 - RNA, 11 nt, Homo sapiens
cuaagcacucu

SEQ ID NO: 1870588 - RNA, 19 nt, Homo sapiens
cuauucuuaagcacuuuga

SEQ ID NO: 1870589 - RNA, 16 nt, Homo sapiens
ccucuuguguaacuaa

SEQ ID NO: 1870590 - RNA, 12 nt, Homo sapiens
uuaagaaaagca

SEQ ID NO: 1870591 - RNA, 17 nt, Homo sapiens
aguuggggaauugugag

SEQ ID NO: 1870592 - RNA, 21 nt, Homo sapiens
augccacguggucacugugca

SEQ ID NO: 1870593 - RNA, 13 nt, Homo sapiens
ugaaugccuaccu

SEQ ID NO: 1870594 - RNA, 13 nt, Homo sapiens
acagaucuucaac

SEQ ID NO: 1870595 - RNA, 21 nt, Homo sapiens
cuccagcuguuaccugagaua

SEQ ID NO: 1870596 - RNA, 14 nt, Homo sapiens
auacacuaaccaaa

SEQ ID NO: 1870597 - RNA, 22 nt, Homo sapiens
aaagccaacauguggcuccucc

SEQ ID NO: 1870598 - RNA, 16 nt, Homo sapiens
auaugaugccuuuucc

SEQ ID NO: 1870599 - RNA, 17 nt, Homo sapiens
ugaagagcugucuuccc

SEQ ID NO: 1870600 - RNA, 14 nt, Homo sapiens
cacaagagugaauu

SEQ ID NO: 1870601 - RNA, 15 nt, Homo sapiens
aagaaucugcucuga

SEQ ID NO: 1870602 - RNA, 15 nt, Homo sapiens
cccacacuguggcca

SEQ ID NO: 1870603 - RNA, 23 nt, Homo sapiens
cacaggaugaaggcaaugccauc

SEQ ID NO: 1870604 - RNA, 14 nt, Homo sapiens
gggggccacugugu

SEQ ID NO: 1870605 - RNA, 21 nt, Homo sapiens
cccagccuagcccacuuguca

SEQ ID NO: 1870606 - RNA, 17 nt, Homo sapiens
acaucaagauacacuug

SEQ ID NO: 1870607 - RNA, 23 nt, Homo sapiens
ucucaggaaaucaaauaugcaaa

SEQ ID NO: 1870608 - RNA, 16 nt, Homo sapiens
uaaaguacagacuuuu

SEQ ID NO: 1870609 - RNA, 12 nt, Homo sapiens
aagaugcagugg

SEQ ID NO: 1870610 - RNA, 17 nt, Homo sapiens
ggcauacagacugggga

SEQ ID NO: 1870611 - RNA, 19 nt, Homo sapiens
aauaucccuccuguuggga

SEQ ID NO: 1870612 - RNA, 16 nt, Homo sapiens
ugccgcaauacaggaa

SEQ ID NO: 1870613 - RNA, 14 nt, Homo sapiens
uaaaugaagccaag

SEQ ID NO: 1870614 - RNA, 23 nt, Homo sapiens
gugagacaguuuacuuugccaac

SEQ ID NO: 1870615 - RNA, 19 nt, Homo sapiens
ugggaaucaacagcauauu

SEQ ID NO: 1870616 - RNA, 16 nt, Homo sapiens
gucugcuuugguacua

SEQ ID NO: 1870617 - RNA, 20 nt, Homo sapiens
ccacacuaccaguuucacac

SEQ ID NO: 1870618 - RNA, 15 nt, Homo sapiens
auuuucuaagauuaa

SEQ ID NO: 1870619 - RNA, 16 nt, Homo sapiens
acguaccccacugggc

SEQ ID NO: 1870620 - RNA, 18 nt, Homo sapiens
uaggauuaaaauggauuu

SEQ ID NO: 1870621 - RNA, 17 nt, Homo sapiens
ugaguggaugauguuuc

SEQ ID NO: 1870622 - RNA, 13 nt, Homo sapiens
aaacagggcaaag

SEQ ID NO: 1870623 - RNA, 22 nt, Homo sapiens
ccucuucacgguuucacuuuua

SEQ ID NO: 1870624 - RNA, 23 nt, Homo sapiens
gagggagcugagaagacucaagu

SEQ ID NO: 1870625 - RNA, 17 nt, Homo sapiens
ccugaggagcccagcgu

SEQ ID NO: 1870626 - RNA, 15 nt, Homo sapiens
cugaacccauuuuga

SEQ ID NO: 1870627 - RNA, 17 nt, Homo sapiens
agcaagacuccaucuca

SEQ ID NO: 1870628 - RNA, 22 nt, Homo sapiens
ugggccucuccugcccucugcu

SEQ ID NO: 1870629 - RNA, 17 nt, Homo sapiens
caaauucaguuucauaa

SEQ ID NO: 1870630 - RNA, 16 nt, Homo sapiens
auagaugucuguguau

SEQ ID NO: 1870631 - RNA, 21 nt, Homo sapiens
cucguuccagaaauuguggga

SEQ ID NO: 1870632 - RNA, 14 nt, Homo sapiens
cccaaaacugucau

SEQ ID NO: 1870633 - RNA, 22 nt, Homo sapiens
cagaaggagggcagagccaugg

SEQ ID NO: 1870634 - RNA, 15 nt, Homo sapiens
ugguuuuuugccagg

SEQ ID NO: 1870635 - RNA, 12 nt, Homo sapiens
uuuucuuuccaa

SEQ ID NO: 1870636 - RNA, 21 nt, Homo sapiens
acacucauccccucacuugcc

SEQ ID NO: 1870637 - RNA, 16 nt, Homo sapiens
ugauaccauggcacug

SEQ ID NO: 1870638 - RNA, 15 nt, Homo sapiens
caacaaaacauuugc

SEQ ID NO: 1870639 - RNA, 19 nt, Homo sapiens
caaaaaaauuaaaauggau

SEQ ID NO: 1870640 - RNA, 19 nt, Homo sapiens
ugucauggacuguugccac

SEQ ID NO: 1870641 - RNA, 19 nt, Homo sapiens
cucucaccucugugccucu

SEQ ID NO: 1870642 - RNA, 13 nt, Homo sapiens
aucauuucacugu

SEQ ID NO: 1870643 - RNA, 17 nt, Homo sapiens
cuugccucaccugcugu

SEQ ID NO: 1870644 - RNA, 13 nt, Homo sapiens
uggcucacuacug

SEQ ID NO: 1870645 - RNA, 18 nt, Homo sapiens
cacauccacacagccaau

SEQ ID NO: 1870646 - RNA, 13 nt, Homo sapiens
ccaucuuucacua

SEQ ID NO: 1870647 - RNA, 15 nt, Homo sapiens
agagggcugguccuu

SEQ ID NO: 1870648 - RNA, 18 nt, Homo sapiens
cgucucaaaaacaaaaca

SEQ ID NO: 1870649 - RNA, 18 nt, Homo sapiens
gauaaacaguuucuuugu

SEQ ID NO: 1870650 - RNA, 13 nt, Homo sapiens
aggaggccugcac

SEQ ID NO: 1870651 - RNA, 15 nt, Homo sapiens
aaauaaaaugacguc

SEQ ID NO: 1870652 - RNA, 19 nt, Homo sapiens
auacauaaaaaaguguuua

SEQ ID NO: 1870653 - RNA, 18 nt, Homo sapiens
uggccccggccuuuaugu

SEQ ID NO: 1870654 - RNA, 18 nt, Homo sapiens
ugcaugaugucuaccuca

SEQ ID NO: 1870655 - RNA, 14 nt, Homo sapiens
augcauccauuuca

SEQ ID NO: 1870656 - RNA, 20 nt, Homo sapiens
aauacacaacuccacugucu

SEQ ID NO: 1870657 - RNA, 14 nt, Homo sapiens
aggucuuccagacc

SEQ ID NO: 1870658 - RNA, 19 nt, Homo sapiens
gugaacgggacucaggugu

SEQ ID NO: 1870659 - RNA, 18 nt, Homo sapiens
auuuuggagagauaggaa

SEQ ID NO: 1870660 - RNA, 23 nt, Homo sapiens
acaguaguaccaaaugcuuuaaa

SEQ ID NO: 1870661 - RNA, 18 nt, Homo sapiens
auauaaauuauuaguuua

SEQ ID NO: 1870662 - RNA, 20 nt, Homo sapiens
agaugccacccaguugugac

SEQ ID NO: 1870663 - RNA, 23 nt, Homo sapiens
cuggccuggaucuccccacucua

SEQ ID NO: 1870664 - RNA, 18 nt, Homo sapiens
aaaccuuaaaacagcugu

SEQ ID NO: 1870665 - RNA, 20 nt, Homo sapiens
ccuggggguggcaggcacac

SEQ ID NO: 1870666 - RNA, 18 nt, Homo sapiens
uacuaugguucuccacua

SEQ ID NO: 1870667 - RNA, 14 nt, Homo sapiens
ucacgacuggucac

SEQ ID NO: 1870668 - RNA, 21 nt, Homo sapiens
acuccacaguuuugccuuaaa

SEQ ID NO: 1870669 - RNA, 18 nt, Homo sapiens
acagcccuuuugugaacc

SEQ ID NO: 1870670 - RNA, 17 nt, Homo sapiens
ucaccuaacuuucauua

SEQ ID NO: 1870671 - RNA, 20 nt, Homo sapiens
cuuguucauggagagcuguu

SEQ ID NO: 1870672 - RNA, 17 nt, Homo sapiens
gugucuggcaguuuaua

SEQ ID NO: 1870673 - RNA, 17 nt, Homo sapiens
uacaucaguuuguuccu

SEQ ID NO: 1870674 - RNA, 23 nt, Homo sapiens
gacccacugaaaugaccaagaca

SEQ ID NO: 1870675 - RNA, 15 nt, Homo sapiens
gcacaagaaggccag

SEQ ID NO: 1870676 - RNA, 13 nt, Homo sapiens
gcaaguugcuuau

SEQ ID NO: 1870677 - RNA, 14 nt, Homo sapiens
caucaagcaucauu

SEQ ID NO: 1870678 - RNA, 23 nt, Homo sapiens
caggaaccucuucagaaagugug

SEQ ID NO: 1870679 - RNA, 14 nt, Homo sapiens
cuuuccccagugug

SEQ ID NO: 1870680 - RNA, 13 nt, Homo sapiens
acaaugugcccuc

SEQ ID NO: 1870681 - RNA, 16 nt, Homo sapiens
caguuuggagucacug

SEQ ID NO: 1870682 - RNA, 23 nt, Homo sapiens
gugggagcaaacugcaugcccag

SEQ ID NO: 1870683 - RNA, 14 nt, Homo sapiens
uuuuuaaccuccua

SEQ ID NO: 1870684 - RNA, 21 nt, Homo sapiens
aauuuauaccucaaacuaucu

SEQ ID NO: 1870685 - RNA, 11 nt, Homo sapiens
acaaugugcac

SEQ ID NO: 1870686 - RNA, 22 nt, Homo sapiens
aagaaaccaccgaaaucccuca

SEQ ID NO: 1870687 - RNA, 20 nt, Homo sapiens
uauaugguauauauacauau

SEQ ID NO: 1870688 - RNA, 13 nt, Homo sapiens
agaacaaaugauc

SEQ ID NO: 1870689 - RNA, 23 nt, Homo sapiens
cuacuugccugggaaacauagca

SEQ ID NO: 1870690 - RNA, 22 nt, Homo sapiens
ugucauugaugaacugccaaag

SEQ ID NO: 1870691 - RNA, 17 nt, Homo sapiens
aguucccaccaucugau

SEQ ID NO: 1870692 - RNA, 21 nt, Homo sapiens
auuccauuucuggacaugacg

SEQ ID NO: 1870693 - RNA, 18 nt, Homo sapiens
cacgccacaacuccagug

SEQ ID NO: 1870694 - RNA, 13 nt, Homo sapiens
ugcagacuggagg

SEQ ID NO: 1870695 - RNA, 13 nt, Homo sapiens
uacaaacugaaga

SEQ ID NO: 1870696 - RNA, 21 nt, Homo sapiens
gcuccaagugauacuucugcc

SEQ ID NO: 1870697 - RNA, 20 nt, Homo sapiens
cugaaucagcuggacauacu

SEQ ID NO: 1870698 - RNA, 18 nt, Homo sapiens
guacauuucccugugcug

SEQ ID NO: 1870699 - RNA, 22 nt, Homo sapiens
auauagauagauaauguucucc

SEQ ID NO: 1870700 - RNA, 14 nt, Homo sapiens
agcuuugugucguc

SEQ ID NO: 1870701 - RNA, 20 nt, Homo sapiens
uccccuucaaacaaauaaua

SEQ ID NO: 1870702 - RNA, 15 nt, Homo sapiens
uaaaggccaugugaa

SEQ ID NO: 1870703 - RNA, 14 nt, Homo sapiens
caaggaggggccag

SEQ ID NO: 1870704 - RNA, 22 nt, Homo sapiens
cagugcccacaggaucagucug

SEQ ID NO: 1870705 - RNA, 14 nt, Homo sapiens
agaugggacauucc

SEQ ID NO: 1870706 - RNA, 15 nt, Homo sapiens
uuugagcgcgcugag

SEQ ID NO: 1870707 - RNA, 16 nt, Homo sapiens
uugccacccaggugau

SEQ ID NO: 1870708 - RNA, 18 nt, Homo sapiens
cugugcacugcccaugga

SEQ ID NO: 1870709 - RNA, 15 nt, Homo sapiens
caugacucagacugc

SEQ ID NO: 1870710 - RNA, 19 nt, Homo sapiens
ucauaggagacccaugugc

SEQ ID NO: 1870711 - RNA, 22 nt, Homo sapiens
guacaauaaaaguaaaccacaa

SEQ ID NO: 1870712 - RNA, 16 nt, Homo sapiens
cacuguauuccuguca

SEQ ID NO: 1870713 - RNA, 22 nt, Homo sapiens
ccucuuggugugauugcacaga

SEQ ID NO: 1870714 - RNA, 19 nt, Homo sapiens
uagcaaaauauuaucugaa

SEQ ID NO: 1870715 - RNA, 15 nt, Homo sapiens
gaguaccugcaaaaa

SEQ ID NO: 1870716 - RNA, 17 nt, Homo sapiens
ccacccgcccacagcca

SEQ ID NO: 1870717 - RNA, 23 nt, Homo sapiens
gaacauuccuuagucucaagggc

SEQ ID NO: 1870718 - RNA, 23 nt, Homo sapiens
uaaaugucuucauguugaugugu

SEQ ID NO: 1870719 - RNA, 12 nt, Homo sapiens
cuacugacgucc

SEQ ID NO: 1870720 - RNA, 20 nt, Homo sapiens
acacuuucaggaccuuccuu

SEQ ID NO: 1870721 - RNA, 16 nt, Homo sapiens
gagaagcuaaguaaua

SEQ ID NO: 1870722 - RNA, 16 nt, Homo sapiens
auuucucaugcuucuu

SEQ ID NO: 1870723 - RNA, 18 nt, Homo sapiens
cugcaaaucagccaugug

SEQ ID NO: 1870724 - RNA, 20 nt, Homo sapiens
agcauccaaguauauaugaa

SEQ ID NO: 1870725 - RNA, 15 nt, Homo sapiens
cuauugcuaguacua

SEQ ID NO: 1870726 - RNA, 14 nt, Homo sapiens
aauaauacacuaau

SEQ ID NO: 1870727 - RNA, 14 nt, Homo sapiens
cauuugccaaguga

SEQ ID NO: 1870728 - RNA, 21 nt, Homo sapiens
gccuccaucuuuuucuugggu

SEQ ID NO: 1870729 - RNA, 19 nt, Homo sapiens
ucgaggacagcaaugcaga

SEQ ID NO: 1870730 - RNA, 16 nt, Homo sapiens
cuuauuaaauauucua

SEQ ID NO: 1870731 - RNA, 18 nt, Homo sapiens
cgggagcaguagucauug

SEQ ID NO: 1870732 - RNA, 16 nt, Homo sapiens
caaguaauacaaacua

SEQ ID NO: 1870733 - RNA, 18 nt, Homo sapiens
acccagauauugcacuag

SEQ ID NO: 1870734 - RNA, 14 nt, Homo sapiens
auguuuuagcacag

SEQ ID NO: 1870735 - RNA, 17 nt, Homo sapiens
agggugggaagcuugcu

SEQ ID NO: 1870736 - RNA, 21 nt, Homo sapiens
aaccccuuccagaucacugcc

SEQ ID NO: 1870737 - RNA, 18 nt, Homo sapiens
ucaacagauaaaugacaa

SEQ ID NO: 1870738 - RNA, 16 nt, Homo sapiens
ucauuuugagucucag

SEQ ID NO: 1870739 - RNA, 21 nt, Homo sapiens
uaaacuuaccugggcauucuu

SEQ ID NO: 1870740 - RNA, 23 nt, Homo sapiens
caguguguaaauaauuugcacug

SEQ ID NO: 1870741 - RNA, 16 nt, Homo sapiens
augggaggaucacuug

SEQ ID NO: 1870742 - RNA, 14 nt, Homo sapiens
aagugaacuuuguu

SEQ ID NO: 1870743 - RNA, 20 nt, Homo sapiens
uaauucccugcuaaaugcca

SEQ ID NO: 1870744 - RNA, 17 nt, Homo sapiens
cagugggaaaggccacc

SEQ ID NO: 1870745 - RNA, 14 nt, Homo sapiens
caaguaauugugaa

SEQ ID NO: 1870746 - RNA, 17 nt, Homo sapiens
gucauuguccaugccua

SEQ ID NO: 1870747 - RNA, 22 nt, Homo sapiens
ggaugucaugucugcuugucaa

SEQ ID NO: 1870748 - RNA, 19 nt, Homo sapiens
aguucgcagccacccugag

SEQ ID NO: 1870749 - RNA, 16 nt, Homo sapiens
augccuugaaaccaga

SEQ ID NO: 1870750 - RNA, 16 nt, Homo sapiens
caaggugacugggaug

SEQ ID NO: 1870751 - RNA, 13 nt, Homo sapiens
cguuguacuccag

SEQ ID NO: 1870752 - RNA, 20 nt, Homo sapiens
aaaguugauaaguacaugau

SEQ ID NO: 1870753 - RNA, 14 nt, Homo sapiens
uguaaucacauucc

SEQ ID NO: 1870754 - RNA, 14 nt, Homo sapiens
gucacacucucuug

SEQ ID NO: 1870755 - RNA, 22 nt, Homo sapiens
cauuuuaaguuuguaguaaaag

SEQ ID NO: 1870756 - RNA, 22 nt, Homo sapiens
ugaagaggggaagucucuuccu

SEQ ID NO: 1870757 - RNA, 21 nt, Homo sapiens
caccuuagagcaaccucugua

SEQ ID NO: 1870758 - RNA, 18 nt, Homo sapiens
auccaauucccaccacua

SEQ ID NO: 1870759 - RNA, 17 nt, Homo sapiens
agcugucaggcugauua

SEQ ID NO: 1870760 - RNA, 17 nt, Homo sapiens
aaacuuuuaaacuacag

SEQ ID NO: 1870761 - RNA, 15 nt, Homo sapiens
uccucccaccucagc

SEQ ID NO: 1870762 - RNA, 18 nt, Homo sapiens
aggaucucagaucacugc

SEQ ID NO: 1870763 - RNA, 15 nt, Homo sapiens
aauaaaaaaucugaa

SEQ ID NO: 1870764 - RNA, 18 nt, Homo sapiens
gcuugaaauagugucuga

SEQ ID NO: 1870765 - RNA, 13 nt, Homo sapiens
augaggugcucaa

SEQ ID NO: 1870766 - RNA, 18 nt, Homo sapiens
aagcuuaacacuugaccu

SEQ ID NO: 1870767 - RNA, 17 nt, Homo sapiens
uguaugugccaguacuu

SEQ ID NO: 1870768 - RNA, 16 nt, Homo sapiens
cucaguuggugcugcu

SEQ ID NO: 1870769 - RNA, 17 nt, Homo sapiens
cugcaucaccaccucag

SEQ ID NO: 1870770 - RNA, 18 nt, Homo sapiens
gaugcaauauaagcauaa

SEQ ID NO: 1870771 - RNA, 17 nt, Homo sapiens
gcccuugucugagaugc

SEQ ID NO: 1870772 - RNA, 23 nt, Homo sapiens
uucauuccuaaagaaaaauaucu

SEQ ID NO: 1870773 - RNA, 20 nt, Homo sapiens
uuacugagcuucucugugaa

SEQ ID NO: 1870774 - RNA, 18 nt, Homo sapiens
agaagcaucucugaccag

SEQ ID NO: 1870775 - RNA, 11 nt, Homo sapiens
cuccuaccugg

SEQ ID NO: 1870776 - RNA, 22 nt, Homo sapiens
cagaauacgggucccucuaacc

SEQ ID NO: 1870777 - RNA, 20 nt, Homo sapiens
guuccagcaaacaaaaugga

SEQ ID NO: 1870778 - RNA, 20 nt, Homo sapiens
uacuaagaguaaagcaacuc

SEQ ID NO: 1870779 - RNA, 16 nt, Homo sapiens
caaaagacaccagcca

SEQ ID NO: 1870780 - RNA, 16 nt, Homo sapiens
uauuauuuacuuugca

SEQ ID NO: 1870781 - RNA, 18 nt, Homo sapiens
caggccacccaaaggagc

SEQ ID NO: 1870782 - RNA, 23 nt, Homo sapiens
acuuuuauuuuuugguggugaaa

SEQ ID NO: 1870783 - RNA, 22 nt, Homo sapiens
ugcuacuuuauuugccuaaaua

SEQ ID NO: 1870784 - RNA, 22 nt, Homo sapiens
caggcuggagugcaguggcacg

SEQ ID NO: 1870785 - RNA, 13 nt, Homo sapiens
uacgcugccucaa

SEQ ID NO: 1870786 - RNA, 23 nt, Homo sapiens
ccugagguacagagaagagugag

SEQ ID NO: 1870787 - RNA, 15 nt, Homo sapiens
ucugaaacuaaugaa

SEQ ID NO: 1870788 - RNA, 16 nt, Homo sapiens
ucacccaucaaaagca

SEQ ID NO: 1870789 - RNA, 17 nt, Homo sapiens
aucugcacucaccucac

SEQ ID NO: 1870790 - RNA, 16 nt, Homo sapiens
ucucucucucuacaaa

SEQ ID NO: 1870791 - RNA, 16 nt, Homo sapiens
uacugauuuuagcaua

SEQ ID NO: 1870792 - RNA, 14 nt, Homo sapiens
uauuuucuuuauca

SEQ ID NO: 1870793 - RNA, 15 nt, Homo sapiens
cacucacagagucaa

SEQ ID NO: 1870794 - RNA, 16 nt, Homo sapiens
guuuaaacaucacuug

SEQ ID NO: 1870795 - RNA, 13 nt, Homo sapiens
uccagccaccuca

SEQ ID NO: 1870796 - RNA, 18 nt, Homo sapiens
ucucaccugcucccaguc

SEQ ID NO: 1870797 - RNA, 12 nt, Homo sapiens
aucacuacugca

SEQ ID NO: 1870798 - RNA, 20 nt, Homo sapiens
aaaucagacgggcacagugg

SEQ ID NO: 1870799 - RNA, 15 nt, Homo sapiens
uuauucuccaucuca

SEQ ID NO: 1870800 - RNA, 23 nt, Homo sapiens
guuuauaucacugucuagcuguu

SEQ ID NO: 1870801 - RNA, 22 nt, Homo sapiens
uuaaacuuccuucuuacuugcc

SEQ ID NO: 1870802 - RNA, 14 nt, Homo sapiens
ucaugacuuuucca

SEQ ID NO: 1870803 - RNA, 18 nt, Homo sapiens
uguuaaagcaucagagau

SEQ ID NO: 1870804 - RNA, 22 nt, Homo sapiens
uaaggccuccagccccaugugu

SEQ ID NO: 1870805 - RNA, 22 nt, Homo sapiens
gcuccaaaacuggaccaccaga

SEQ ID NO: 1870806 - RNA, 15 nt, Homo sapiens
cuaugauggugacau

SEQ ID NO: 1870807 - RNA, 18 nt, Homo sapiens
cagggaaagcccguguca

SEQ ID NO: 1870808 - RNA, 11 nt, Homo sapiens
ccuugacuguc

SEQ ID NO: 1870809 - RNA, 18 nt, Homo sapiens
gaaucgaggcuguguguc

SEQ ID NO: 1870810 - RNA, 19 nt, Homo sapiens
uuuuaagcugaaugauuca

SEQ ID NO: 1870811 - RNA, 20 nt, Homo sapiens
uggucauaucuagucacuug

SEQ ID NO: 1870812 - RNA, 23 nt, Homo sapiens
uuugaagguuuuaagugguuuga

SEQ ID NO: 1870813 - RNA, 20 nt, Homo sapiens
ucauggagggagaagaaaga

SEQ ID NO: 1870814 - RNA, 18 nt, Homo sapiens
aguaaaggccaugugaag

SEQ ID NO: 1870815 - RNA, 21 nt, Homo sapiens
cacuuaaagccuuuuccugaa

SEQ ID NO: 1870816 - RNA, 21 nt, Homo sapiens
gcuuuugggaauggacucacu

SEQ ID NO: 1870817 - RNA, 21 nt, Homo sapiens
aaugugcccaaagcucugaau

SEQ ID NO: 1870818 - RNA, 22 nt, Homo sapiens
uuggcuuuuuucacauugauca

SEQ ID NO: 1870819 - RNA, 20 nt, Homo sapiens
caccuaauccaggcagaucc

SEQ ID NO: 1870820 - RNA, 13 nt, Homo sapiens
guaaaauguucuc

SEQ ID NO: 1870821 - RNA, 14 nt, Homo sapiens
ggcaacucggagag

SEQ ID NO: 1870822 - RNA, 21 nt, Homo sapiens
auaucccuacauguauugcac

SEQ ID NO: 1870823 - RNA, 14 nt, Homo sapiens
auucuucacuugcu

SEQ ID NO: 1870824 - RNA, 15 nt, Homo sapiens
agucucugccuugcc

SEQ ID NO: 1870825 - RNA, 10 nt, Homo sapiens
ccaucugauu

SEQ ID NO: 1870826 - RNA, 19 nt, Homo sapiens
aagguaucaguuauaugau

SEQ ID NO: 1870827 - RNA, 22 nt, Homo sapiens
ggaaaaaacaccaggauuuaag

SEQ ID NO: 1870828 - RNA, 19 nt, Homo sapiens
caaagagcaauauuccagu

SEQ ID NO: 1870829 - RNA, 15 nt, Homo sapiens
aagaaagaagugacu

SEQ ID NO: 1870830 - RNA, 17 nt, Homo sapiens
ggaaccacgucugcuaa

SEQ ID NO: 1870831 - RNA, 18 nt, Homo sapiens
uuuuauucauaagccaau

SEQ ID NO: 1870832 - RNA, 14 nt, Homo sapiens
guccacccuuccau

SEQ ID NO: 1870833 - RNA, 18 nt, Homo sapiens
aaucaagcuuuugcuuga

SEQ ID NO: 1870834 - RNA, 13 nt, Homo sapiens
uuaggaaacacug

SEQ ID NO: 1870835 - RNA, 16 nt, Homo sapiens
cuggagugcugugcug

SEQ ID NO: 1870836 - RNA, 19 nt, Homo sapiens
caaugcuuccuccuuggaa

SEQ ID NO: 1870837 - RNA, 16 nt, Homo sapiens
gcccaggacugcauug

SEQ ID NO: 1870838 - RNA, 19 nt, Homo sapiens
ccucucugggcagucagaa

SEQ ID NO: 1870839 - RNA, 20 nt, Homo sapiens
uagacagguguuacuuacag

SEQ ID NO: 1870840 - RNA, 22 nt, Homo sapiens
uuuccuaaagucucugcugcua

SEQ ID NO: 1870841 - RNA, 20 nt, Homo sapiens
aguucacaggguauuaauau

SEQ ID NO: 1870842 - RNA, 21 nt, Homo sapiens
guugauuguauaaaugcaaua

SEQ ID NO: 1870843 - RNA, 17 nt, Homo sapiens
agcugggauaaucacau

SEQ ID NO: 1870844 - RNA, 22 nt, Homo sapiens
ucccucucuuccccuucccuua

SEQ ID NO: 1870845 - RNA, 23 nt, Homo sapiens
agcccauuucuuuauugcaucug

SEQ ID NO: 1870846 - RNA, 18 nt, Homo sapiens
guccgcgcugcucugcag

SEQ ID NO: 1870847 - RNA, 19 nt, Homo sapiens
ugcuugggaagacuccuag

SEQ ID NO: 1870848 - RNA, 17 nt, Homo sapiens
aauagguuuuucuugcu

SEQ ID NO: 1870849 - RNA, 16 nt, Homo sapiens
gacaguuuacaaauga

SEQ ID NO: 1870850 - RNA, 20 nt, Homo sapiens
ccagccuggccaacauggca

SEQ ID NO: 1870851 - RNA, 19 nt, Homo sapiens
cuguaagugcuuaaucaua

SEQ ID NO: 1870852 - RNA, 19 nt, Homo sapiens
gaaguuugguuucuuugcu

SEQ ID NO: 1870853 - RNA, 20 nt, Homo sapiens
caaagacgcaaggugugcuc

SEQ ID NO: 1870854 - RNA, 21 nt, Homo sapiens
uuuuuggaccccuaaugucag

SEQ ID NO: 1870855 - RNA, 18 nt, Homo sapiens
aaaaagaugguugccaag

SEQ ID NO: 1870856 - RNA, 13 nt, Homo sapiens
ucucugaaagugu

SEQ ID NO: 1870857 - RNA, 16 nt, Homo sapiens
uuauagccucagauuc

SEQ ID NO: 1870858 - RNA, 20 nt, Homo sapiens
cugaaaacuacaguuguaau

SEQ ID NO: 1870859 - RNA, 18 nt, Homo sapiens
ccaaagaagccuugccau

SEQ ID NO: 1870860 - RNA, 22 nt, Homo sapiens
uacuaccccaggacgcaugcag

SEQ ID NO: 1870861 - RNA, 15 nt, Homo sapiens
gaaacuuacacuguu

SEQ ID NO: 1870862 - RNA, 15 nt, Homo sapiens
gaaagaaacacucaa

SEQ ID NO: 1870863 - RNA, 22 nt, Homo sapiens
uacuagucuuuuccucuaggaa

SEQ ID NO: 1870864 - RNA, 20 nt, Homo sapiens
cauuuuguauguauguguag

SEQ ID NO: 1870865 - RNA, 11 nt, Homo sapiens
uggacucagag

SEQ ID NO: 1870866 - RNA, 16 nt, Homo sapiens
cuagucaugugccuug

SEQ ID NO: 1870867 - RNA, 17 nt, Homo sapiens
uagagaugauucagagg

SEQ ID NO: 1870868 - RNA, 21 nt, Homo sapiens
acaaaucuaugccacucagaa

SEQ ID NO: 1870869 - RNA, 20 nt, Homo sapiens
aaagccucacguauuucaca

SEQ ID NO: 1870870 - RNA, 13 nt, Homo sapiens
cauaaagccuuua

SEQ ID NO: 1870871 - RNA, 13 nt, Homo sapiens
auuuaagcaauaa

SEQ ID NO: 1870872 - RNA, 14 nt, Homo sapiens
guugcugcuucaau

SEQ ID NO: 1870873 - RNA, 14 nt, Homo sapiens
uaauaaacucacaa

SEQ ID NO: 1870874 - RNA, 19 nt, Homo sapiens
cuccgcagaccugcuguga

SEQ ID NO: 1870875 - RNA, 22 nt, Homo sapiens
agugggacaccauucugaauuu

SEQ ID NO: 1870876 - RNA, 21 nt, Homo sapiens
uauagagucaaccaccacaga

SEQ ID NO: 1870877 - RNA, 14 nt, Homo sapiens
ccgacaaaauucca

SEQ ID NO: 1870878 - RNA, 20 nt, Homo sapiens
uaaugacguugagcaucuau

SEQ ID NO: 1870879 - RNA, 20 nt, Homo sapiens
auauuuaggcaugagcucuu

SEQ ID NO: 1870880 - RNA, 19 nt, Homo sapiens
gucuccucucucuguaaua

SEQ ID NO: 1870881 - RNA, 22 nt, Homo sapiens
cuauuaaagugcuaagguucua

SEQ ID NO: 1870882 - RNA, 20 nt, Homo sapiens
auacccaaaugucccugcaa

SEQ ID NO: 1870883 - RNA, 15 nt, Homo sapiens
agcuuaccugacaca

SEQ ID NO: 1870884 - RNA, 16 nt, Homo sapiens
uugaaauagucugugu

SEQ ID NO: 1870885 - RNA, 15 nt, Homo sapiens
agcuuguugaaaaag

SEQ ID NO: 1870886 - RNA, 18 nt, Homo sapiens
agcuguguuuggaaaauu

SEQ ID NO: 1870887 - RNA, 17 nt, Homo sapiens
guaggaugucucuugga

SEQ ID NO: 1870888 - RNA, 15 nt, Homo sapiens
auuuaaacaacagcu

SEQ ID NO: 1870889 - RNA, 16 nt, Homo sapiens
caggaaggggugugcu

SEQ ID NO: 1870890 - RNA, 23 nt, Homo sapiens
cugcggcucuggcccacugagcc

SEQ ID NO: 1870891 - RNA, 17 nt, Homo sapiens
gagaagcucacccaaua

SEQ ID NO: 1870892 - RNA, 15 nt, Homo sapiens
auacuguaugcagua

SEQ ID NO: 1870893 - RNA, 18 nt, Homo sapiens
guaccuucccacuggccu

SEQ ID NO: 1870894 - RNA, 19 nt, Homo sapiens
ggaggcccgcagagcacag

SEQ ID NO: 1870895 - RNA, 13 nt, Homo sapiens
gcgcucaccucag

SEQ ID NO: 1870896 - RNA, 20 nt, Homo sapiens
cagaaagcuuuauauguaau

SEQ ID NO: 1870897 - RNA, 17 nt, Homo sapiens
acaaugacuuacuguac

SEQ ID NO: 1870898 - RNA, 11 nt, Homo sapiens
gcaaacauuua

SEQ ID NO: 1870899 - RNA, 16 nt, Homo sapiens
aaccagguuuagacag

SEQ ID NO: 1870900 - RNA, 14 nt, Homo sapiens
ccuaacaagccuug

SEQ ID NO: 1870901 - RNA, 21 nt, Homo sapiens
agaaggaguuucacuacaauc

SEQ ID NO: 1870902 - RNA, 13 nt, Homo sapiens
aaucagcauuuag

SEQ ID NO: 1870903 - RNA, 13 nt, Homo sapiens
uuacagcaaaaag

SEQ ID NO: 1870904 - RNA, 17 nt, Homo sapiens
ccuguacugucaggugc

SEQ ID NO: 1870905 - RNA, 19 nt, Homo sapiens
uggagcagccaccccaugc

SEQ ID NO: 1870906 - RNA, 17 nt, Homo sapiens
gaauuccugcauuugau

SEQ ID NO: 1870907 - RNA, 23 nt, Homo sapiens
uccuuuuuuucccuuuucuuucc

SEQ ID NO: 1870908 - RNA, 18 nt, Homo sapiens
caccaucucacugcagua

SEQ ID NO: 1870909 - RNA, 19 nt, Homo sapiens
auauaaaguaguccuguga

SEQ ID NO: 1870910 - RNA, 18 nt, Homo sapiens
agggauggggagcagcug

SEQ ID NO: 1870911 - RNA, 16 nt, Homo sapiens
cugcgagggccggugc

SEQ ID NO: 1870912 - RNA, 17 nt, Homo sapiens
gaaaugaaaucuuccca

SEQ ID NO: 1870913 - RNA, 22 nt, Homo sapiens
aaagagccagacucugucucaa

SEQ ID NO: 1870914 - RNA, 20 nt, Homo sapiens
uuuugaaaaagagaacagaa

SEQ ID NO: 1870915 - RNA, 18 nt, Homo sapiens
ucauaaguuaugccucug

SEQ ID NO: 1870916 - RNA, 19 nt, Homo sapiens
cuaacuuuucuuaagguuu

SEQ ID NO: 1870917 - RNA, 15 nt, Homo sapiens
acccuccguugacag

SEQ ID NO: 1870918 - RNA, 21 nt, Homo sapiens
uaugugugcauguguguauaa

SEQ ID NO: 1870919 - RNA, 20 nt, Homo sapiens
caaagggaaggcugcugugu

SEQ ID NO: 1870920 - RNA, 18 nt, Homo sapiens
aauauauuucagacauuu

SEQ ID NO: 1870921 - RNA, 14 nt, Homo sapiens
cuggaaaagggaag

SEQ ID NO: 1870922 - RNA, 13 nt, Homo sapiens
gugaacucucaga

SEQ ID NO: 1870923 - RNA, 20 nt, Homo sapiens
ugaaagaccugaauaccacu

SEQ ID NO: 1870924 - RNA, 15 nt, Homo sapiens
uauaaugaagcuuua

SEQ ID NO: 1870925 - RNA, 24 nt, Homo sapiens
cagcgccaccucuugucagugcuc

SEQ ID NO: 1870926 - RNA, 16 nt, Homo sapiens
uguguauuagauauca

SEQ ID NO: 1870927 - RNA, 17 nt, Homo sapiens
gacaugcccaaggccac

SEQ ID NO: 1870928 - RNA, 19 nt, Homo sapiens
cauuuuacaggugcgaaug

SEQ ID NO: 1870929 - RNA, 22 nt, Homo sapiens
agaaaccugcguaacuccaucu

SEQ ID NO: 1870930 - RNA, 21 nt, Homo sapiens
uacaggaaggugccuggccau

SEQ ID NO: 1870931 - RNA, 14 nt, Homo sapiens
cacuauuuccacau

SEQ ID NO: 1870932 - RNA, 17 nt, Homo sapiens
ggucauaaugaacacuc

SEQ ID NO: 1870933 - RNA, 23 nt, Homo sapiens
cuaccugagucccaaagcucccu

SEQ ID NO: 1870934 - RNA, 16 nt, Homo sapiens
cugugauuuaugccaa

SEQ ID NO: 1870935 - RNA, 14 nt, Homo sapiens
aaccacagaugugu

SEQ ID NO: 1870936 - RNA, 14 nt, Homo sapiens
aagcaaaaucauuu

SEQ ID NO: 1870937 - RNA, 17 nt, Homo sapiens
ucaaguuguuugucaau

SEQ ID NO: 1870938 - RNA, 21 nt, Homo sapiens
cuauccagugacuuguucuga

SEQ ID NO: 1870939 - RNA, 17 nt, Homo sapiens
cucuucguaaugaauuu

SEQ ID NO: 1870940 - RNA, 17 nt, Homo sapiens
uaugugguuaucuguga

SEQ ID NO: 1870941 - RNA, 13 nt, Homo sapiens
uuauaaaaaugag

SEQ ID NO: 1870942 - RNA, 13 nt, Homo sapiens
uugagaaaauaua

SEQ ID NO: 1870943 - RNA, 17 nt, Homo sapiens
ugagaguaauugcuuga

SEQ ID NO: 1870944 - RNA, 20 nt, Homo sapiens
gaguuuaaaaaugguaucaa

SEQ ID NO: 1870945 - RNA, 21 nt, Homo sapiens
agauagggggaagacagauau

SEQ ID NO: 1870946 - RNA, 13 nt, Homo sapiens
aaauauaaauauc

SEQ ID NO: 1870947 - RNA, 14 nt, Homo sapiens
auaauuuacaugca

SEQ ID NO: 1870948 - RNA, 16 nt, Homo sapiens
guguuagcuuguauau

SEQ ID NO: 1870949 - RNA, 14 nt, Homo sapiens
ugcagacaguguca

SEQ ID NO: 1870950 - RNA, 17 nt, Homo sapiens
gacugauguuacaucac

SEQ ID NO: 1870951 - RNA, 20 nt, Homo sapiens
agcuguggggaacacagcua

SEQ ID NO: 1870952 - RNA, 12 nt, Homo sapiens
ugugugugauau

SEQ ID NO: 1870953 - RNA, 16 nt, Homo sapiens
augagaguuccuucuc

SEQ ID NO: 1870954 - RNA, 17 nt, Homo sapiens
uguaggaagaguagcau

SEQ ID NO: 1870955 - RNA, 15 nt, Homo sapiens
aggaaagauuuuguu

SEQ ID NO: 1870956 - RNA, 16 nt, Homo sapiens
ccauucacaugcccuc

SEQ ID NO: 1870957 - RNA, 23 nt, Homo sapiens
ugaggggggggcauuagugcuga

SEQ ID NO: 1870958 - RNA, 19 nt, Homo sapiens
ucugaacuaggugaucuca

SEQ ID NO: 1870959 - RNA, 13 nt, Homo sapiens
cugagaucucccu

SEQ ID NO: 1870960 - RNA, 12 nt, Homo sapiens
ccugcacaggcu

SEQ ID NO: 1870961 - RNA, 14 nt, Homo sapiens
ggcugaggugggca

SEQ ID NO: 1870962 - RNA, 13 nt, Homo sapiens
ggagucuuuguaa

SEQ ID NO: 1870963 - RNA, 14 nt, Homo sapiens
gccuucaucuucac

SEQ ID NO: 1870964 - RNA, 14 nt, Homo sapiens
ugcuguuaaucuga

SEQ ID NO: 1870965 - RNA, 21 nt, Homo sapiens
agaguguuuaauuguacucaa

SEQ ID NO: 1870966 - RNA, 13 nt, Homo sapiens
accagaaccacau

SEQ ID NO: 1870967 - RNA, 21 nt, Homo sapiens
aacugcuuuccauuccauaau

SEQ ID NO: 1870968 - RNA, 14 nt, Homo sapiens
uggugugcucucuu

SEQ ID NO: 1870969 - RNA, 13 nt, Homo sapiens
aaaagccagucaa

SEQ ID NO: 1870970 - RNA, 21 nt, Homo sapiens
aaagcaccagcaggcacguua

SEQ ID NO: 1870971 - RNA, 18 nt, Homo sapiens
uuacuugaaguaacuaua

SEQ ID NO: 1870972 - RNA, 17 nt, Homo sapiens
agugauucucaugccuc

SEQ ID NO: 1870973 - RNA, 22 nt, Homo sapiens
acaccuggggucggguccacca

SEQ ID NO: 1870974 - RNA, 17 nt, Homo sapiens
aaagaaggcucacagau

SEQ ID NO: 1870975 - RNA, 16 nt, Homo sapiens
cuauguauguguaaaa

SEQ ID NO: 1870976 - RNA, 14 nt, Homo sapiens
uccagcgucugcug

SEQ ID NO: 1870977 - RNA, 19 nt, Homo sapiens
aguuaccaaacauuacaaa

SEQ ID NO: 1870978 - RNA, 14 nt, Homo sapiens
ugcuggcuuuucac

SEQ ID NO: 1870979 - RNA, 11 nt, Homo sapiens
gaaaaaccuug

SEQ ID NO: 1870980 - RNA, 15 nt, Homo sapiens
acuccaguggugaag

SEQ ID NO: 1870981 - RNA, 13 nt, Homo sapiens
caccuuugugcag

SEQ ID NO: 1870982 - RNA, 18 nt, Homo sapiens
agugcugggucugucaca

SEQ ID NO: 1870983 - RNA, 16 nt, Homo sapiens
gcccucagacugucag

SEQ ID NO: 1870984 - RNA, 16 nt, Homo sapiens
aucccuauguugcuau

SEQ ID NO: 1870985 - RNA, 15 nt, Homo sapiens
aggaagggcauccuu

SEQ ID NO: 1870986 - RNA, 18 nt, Homo sapiens
aagaggggaagucucuuc

SEQ ID NO: 1870987 - RNA, 15 nt, Homo sapiens
cacaagcguguuucu

SEQ ID NO: 1870988 - RNA, 13 nt, Homo sapiens
ugucaggaaguaa

SEQ ID NO: 1870989 - RNA, 22 nt, Homo sapiens
uauaauucagaagacuacuaua

SEQ ID NO: 1870990 - RNA, 14 nt, Homo sapiens
uccaaaaacaguga

SEQ ID NO: 1870991 - RNA, 17 nt, Homo sapiens
cauuuuuaauaugacaa

SEQ ID NO: 1870992 - RNA, 18 nt, Homo sapiens
gauuuaaaaaaagaacau

SEQ ID NO: 1870993 - RNA, 22 nt, Homo sapiens
gaguggcucguguuucacagug

SEQ ID NO: 1870994 - RNA, 14 nt, Homo sapiens
cacuaccuaaguaa

SEQ ID NO: 1870995 - RNA, 18 nt, Homo sapiens
ccauugcuccauucacuc

SEQ ID NO: 1870996 - RNA, 21 nt, Homo sapiens
ucuaauguacaauaaagcaau

SEQ ID NO: 1870997 - RNA, 21 nt, Homo sapiens
uagaaaaauauuauaacucau

SEQ ID NO: 1870998 - RNA, 22 nt, Homo sapiens
acuuagucucuaaagaguuuau

SEQ ID NO: 1870999 - RNA, 23 nt, Homo sapiens
cagucuucucuggacgcucccuu

SEQ ID NO: 1871000 - RNA, 18 nt, Homo sapiens
cuuaugacuugcuacuuu

SEQ ID NO: 1871001 - RNA, 22 nt, Homo sapiens
gaugaaagaggggugggaucca

SEQ ID NO: 1871002 - RNA, 18 nt, Homo sapiens
gggcuguuuuaagaccag

SEQ ID NO: 1871003 - RNA, 18 nt, Homo sapiens
gcuggggugcacugggga

SEQ ID NO: 1871004 - RNA, 17 nt, Homo sapiens
gcagucaacaguucaaa

SEQ ID NO: 1871005 - RNA, 16 nt, Homo sapiens
caaggaaauuccucag

SEQ ID NO: 1871006 - RNA, 17 nt, Homo sapiens
aaguuuauaaaagugaa

SEQ ID NO: 1871007 - RNA, 17 nt, Homo sapiens
ucuaaguguacuucaua

SEQ ID NO: 1871008 - RNA, 23 nt, Homo sapiens
cccaggccuaucuggaagccacc

SEQ ID NO: 1871009 - RNA, 19 nt, Homo sapiens
aaucuugaaggaacacaaa

SEQ ID NO: 1871010 - RNA, 17 nt, Homo sapiens
cgggccgucugcacuuc

SEQ ID NO: 1871011 - RNA, 17 nt, Homo sapiens
cauguguauuaaugucu

SEQ ID NO: 1871012 - RNA, 14 nt, Homo sapiens
uucuuuuugcucua

SEQ ID NO: 1871013 - RNA, 18 nt, Homo sapiens
uccaacaaguaccuguga

SEQ ID NO: 1871014 - RNA, 20 nt, Homo sapiens
agaacaaauaaaugagccca

SEQ ID NO: 1871015 - RNA, 15 nt, Homo sapiens
aaugcagugcagcau

SEQ ID NO: 1871016 - RNA, 18 nt, Homo sapiens
auaacucuccugcccaug

SEQ ID NO: 1871017 - RNA, 19 nt, Homo sapiens
agggaugucacgucuugaa

SEQ ID NO: 1871018 - RNA, 14 nt, Homo sapiens
gugugcgugcaugu

SEQ ID NO: 1871019 - RNA, 19 nt, Homo sapiens
uguuuaaaagcaaaacugc

SEQ ID NO: 1871020 - RNA, 15 nt, Homo sapiens
aaaauagcucuuuca

SEQ ID NO: 1871021 - RNA, 17 nt, Homo sapiens
gugcccugcaggcacag

SEQ ID NO: 1871022 - RNA, 19 nt, Homo sapiens
acuacgguugaucuugcaa

SEQ ID NO: 1871023 - RNA, 21 nt, Homo sapiens
uaacuuaaauuuuaagcuuga

SEQ ID NO: 1871024 - RNA, 17 nt, Homo sapiens
uaacugauuuccaucca

SEQ ID NO: 1871025 - RNA, 16 nt, Homo sapiens
cugauuacaauucuga

SEQ ID NO: 1871026 - RNA, 22 nt, Homo sapiens
acucugcucgccuuagcacuac

SEQ ID NO: 1871027 - RNA, 17 nt, Homo sapiens
uaaaauggaugccuuga

SEQ ID NO: 1871028 - RNA, 12 nt, Homo sapiens
acuuuuuccacc

SEQ ID NO: 1871029 - RNA, 15 nt, Homo sapiens
ucuuggcuucuuaaa

SEQ ID NO: 1871030 - RNA, 20 nt, Homo sapiens
agugcugagauuacaggugu

SEQ ID NO: 1871031 - RNA, 16 nt, Homo sapiens
agucugauuguagcua

SEQ ID NO: 1871032 - RNA, 16 nt, Homo sapiens
uaaagcuuaaacugaa

SEQ ID NO: 1871033 - RNA, 19 nt, Homo sapiens
ggaaugugcauucucugag

SEQ ID NO: 1871034 - RNA, 12 nt, Homo sapiens
cuaguuuuccag

SEQ ID NO: 1871035 - RNA, 20 nt, Homo sapiens
ucauggaugcuuuggcaaug

SEQ ID NO: 1871036 - RNA, 13 nt, Homo sapiens
ucuucuuacucca

SEQ ID NO: 1871037 - RNA, 21 nt, Homo sapiens
caccaaugaaaacauguacua

SEQ ID NO: 1871038 - RNA, 23 nt, Homo sapiens
gccccucccugcuaccaaggccc

SEQ ID NO: 1871039 - RNA, 19 nt, Homo sapiens
accugggcagggaugaugg

SEQ ID NO: 1871040 - RNA, 17 nt, Homo sapiens
acacuacaaauguuaaa

SEQ ID NO: 1871041 - RNA, 22 nt, Homo sapiens
cuugaauacucugcccucuaga

SEQ ID NO: 1871042 - RNA, 15 nt, Homo sapiens
ccuuaaaccuaccuc

SEQ ID NO: 1871043 - RNA, 16 nt, Homo sapiens
agcuuuaggggaccau

SEQ ID NO: 1871044 - RNA, 18 nt, Homo sapiens
aagcaauaaaacugcuag

SEQ ID NO: 1871045 - RNA, 13 nt, Homo sapiens
acaccagggccag

SEQ ID NO: 1871046 - RNA, 15 nt, Homo sapiens
ccuuucuguguguga

SEQ ID NO: 1871047 - RNA, 13 nt, Homo sapiens
uguuuaaaagcau

SEQ ID NO: 1871048 - RNA, 13 nt, Homo sapiens
ucuuuaaaaccau

SEQ ID NO: 1871049 - RNA, 16 nt, Homo sapiens
aacuaucucacuucca

SEQ ID NO: 1871050 - RNA, 16 nt, Homo sapiens
cauaauaaaauaucau

SEQ ID NO: 1871051 - RNA, 22 nt, Homo sapiens
aacaaaauguuaugauaaucuu

SEQ ID NO: 1871052 - RNA, 15 nt, Homo sapiens
cacacacaccacaca

SEQ ID NO: 1871053 - RNA, 13 nt, Homo sapiens
ugccuucuuccag

SEQ ID NO: 1871054 - RNA, 16 nt, Homo sapiens
augcagcaucuaagua

SEQ ID NO: 1871055 - RNA, 18 nt, Homo sapiens
cuuaggcauucuaaguca

SEQ ID NO: 1871056 - RNA, 22 nt, Homo sapiens
aaaacauaugcauuaugaaguu

SEQ ID NO: 1871057 - RNA, 18 nt, Homo sapiens
auuugagauguauuucaa

SEQ ID NO: 1871058 - RNA, 20 nt, Homo sapiens
guagguacuucacauugcaa

SEQ ID NO: 1871059 - RNA, 13 nt, Homo sapiens
gcucuacccauga

SEQ ID NO: 1871060 - RNA, 14 nt, Homo sapiens
agguauugauugaa

SEQ ID NO: 1871061 - RNA, 22 nt, Homo sapiens
acccuagauccaauugcauuua

SEQ ID NO: 1871062 - RNA, 23 nt, Homo sapiens
agccacaggacugagcccucuca

SEQ ID NO: 1871063 - RNA, 17 nt, Homo sapiens
caucucaagccccaaau

SEQ ID NO: 1871064 - RNA, 15 nt, Homo sapiens
uaucagcaauacuca

SEQ ID NO: 1871065 - RNA, 14 nt, Homo sapiens
cauuggaugcauuu

SEQ ID NO: 1871066 - RNA, 17 nt, Homo sapiens
auucagcacacugugaa

SEQ ID NO: 1871067 - RNA, 18 nt, Homo sapiens
gggauugaagcccuccaa

SEQ ID NO: 1871068 - RNA, 17 nt, Homo sapiens
ggcuuguccucaucucu

SEQ ID NO: 1871069 - RNA, 13 nt, Homo sapiens
ggacucugcacau

SEQ ID NO: 1871070 - RNA, 17 nt, Homo sapiens
gacuuauauauuugaaa

SEQ ID NO: 1871071 - RNA, 15 nt, Homo sapiens
agccacaaccaaaaa

SEQ ID NO: 1871072 - RNA, 15 nt, Homo sapiens
gcagaaagggccuug

SEQ ID NO: 1871073 - RNA, 18 nt, Homo sapiens
auauuuuucaaaaucaaa

SEQ ID NO: 1871074 - RNA, 12 nt, Homo sapiens
uacacacuugac

SEQ ID NO: 1871075 - RNA, 17 nt, Homo sapiens
gagacuccgucucaagg

SEQ ID NO: 1871076 - RNA, 21 nt, Homo sapiens
gaaauuuaaaagcagagcauu

SEQ ID NO: 1871077 - RNA, 14 nt, Homo sapiens
guugcagugagcca

SEQ ID NO: 1871078 - RNA, 15 nt, Homo sapiens
ugccauaucagugaa

SEQ ID NO: 1871079 - RNA, 13 nt, Homo sapiens
cucauacacagaa

SEQ ID NO: 1871080 - RNA, 16 nt, Homo sapiens
agucuuucuugagcag

SEQ ID NO: 1871081 - RNA, 13 nt, Homo sapiens
caccauauugcua

SEQ ID NO: 1871082 - RNA, 20 nt, Homo sapiens
ugcucuuaucuuucuugacu

SEQ ID NO: 1871083 - RNA, 19 nt, Homo sapiens
agucugaauucugcucuaa

SEQ ID NO: 1871084 - RNA, 23 nt, Homo sapiens
uaaaagggaagucuagaguuccu

SEQ ID NO: 1871085 - RNA, 20 nt, Homo sapiens
aagaguauuaagagcaauuc

SEQ ID NO: 1871086 - RNA, 20 nt, Homo sapiens
gauucuccaggccauuuaau

SEQ ID NO: 1871087 - RNA, 14 nt, Homo sapiens
uggggaagaggcaa

SEQ ID NO: 1871088 - RNA, 14 nt, Homo sapiens
cuuguuacugugau

SEQ ID NO: 1871089 - RNA, 14 nt, Homo sapiens
cuccucacugccac

SEQ ID NO: 1871090 - RNA, 20 nt, Homo sapiens
acacacgcguccacauacac

SEQ ID NO: 1871091 - RNA, 14 nt, Homo sapiens
caguaaaaauccac

SEQ ID NO: 1871092 - RNA, 18 nt, Homo sapiens
ucuacccagauaaacaaa

SEQ ID NO: 1871093 - RNA, 18 nt, Homo sapiens
uguaagcccagcauuuga

SEQ ID NO: 1871094 - RNA, 12 nt, Homo sapiens
aucacagaugag

SEQ ID NO: 1871095 - RNA, 15 nt, Homo sapiens
cagggcacuacauaa

SEQ ID NO: 1871096 - RNA, 15 nt, Homo sapiens
aagucugcuacccuc

SEQ ID NO: 1871097 - RNA, 23 nt, Homo sapiens
gcaauucauaacuaaugaauuga

SEQ ID NO: 1871098 - RNA, 20 nt, Homo sapiens
aguggcuuggguucacagug

SEQ ID NO: 1871099 - RNA, 21 nt, Homo sapiens
agccuggcacagggcaguggg

SEQ ID NO: 1871100 - RNA, 18 nt, Homo sapiens
uguccccagccuaccucu

SEQ ID NO: 1871101 - RNA, 13 nt, Homo sapiens
acccgauuccacc

SEQ ID NO: 1871102 - RNA, 21 nt, Homo sapiens
ucccaucacuguauccauucu

SEQ ID NO: 1871103 - RNA, 17 nt, Homo sapiens
cuccugugugcuuguca

SEQ ID NO: 1871104 - RNA, 15 nt, Homo sapiens
aacuccaauacucac

SEQ ID NO: 1871105 - RNA, 15 nt, Homo sapiens
agacaccaugacaaa

SEQ ID NO: 1871106 - RNA, 19 nt, Homo sapiens
accuauucacugcuuaugc

SEQ ID NO: 1871107 - RNA, 11 nt, Homo sapiens
uucugauuaca

SEQ ID NO: 1871108 - RNA, 18 nt, Homo sapiens
cagcaauaggguggcaca

SEQ ID NO: 1871109 - RNA, 21 nt, Homo sapiens
caagcugugacuucuccaggu

SEQ ID NO: 1871110 - RNA, 12 nt, Homo sapiens
auaaugugauuu

SEQ ID NO: 1871111 - RNA, 12 nt, Homo sapiens
gauuuguggaaa

SEQ ID NO: 1871112 - RNA, 14 nt, Homo sapiens
uuaaauaucugaac

SEQ ID NO: 1871113 - RNA, 15 nt, Homo sapiens
uguaaaugugacauu

SEQ ID NO: 1871114 - RNA, 21 nt, Homo sapiens
gaaaucccccuuucucuaaua

SEQ ID NO: 1871115 - RNA, 17 nt, Homo sapiens
uccaggccccaccuccu

SEQ ID NO: 1871116 - RNA, 12 nt, Homo sapiens
ccugguacugau

SEQ ID NO: 1871117 - RNA, 15 nt, Homo sapiens
ggaaacugcucccau

SEQ ID NO: 1871118 - RNA, 15 nt, Homo sapiens
uucaauuaguaacau

SEQ ID NO: 1871119 - RNA, 21 nt, Homo sapiens
uugaugucgaugcucacugcu

SEQ ID NO: 1871120 - RNA, 14 nt, Homo sapiens
gaacucuugcuauc

SEQ ID NO: 1871121 - RNA, 22 nt, Homo sapiens
guaaauaugguucuugccaaaa

SEQ ID NO: 1871122 - RNA, 18 nt, Homo sapiens
gagcaucugccccaggua

SEQ ID NO: 1871123 - RNA, 18 nt, Homo sapiens
uugagcugacauauacug

SEQ ID NO: 1871124 - RNA, 12 nt, Homo sapiens
agugaugucagg

SEQ ID NO: 1871125 - RNA, 11 nt, Homo sapiens
uaaagaccaaa

SEQ ID NO: 1871126 - RNA, 23 nt, Homo sapiens
uccacuucaauguccaccuguga

SEQ ID NO: 1871127 - RNA, 16 nt, Homo sapiens
ggaugaaagagccaga

SEQ ID NO: 1871128 - RNA, 13 nt, Homo sapiens
gaucaaauacuuu

SEQ ID NO: 1871129 - RNA, 15 nt, Homo sapiens
cguggguucugucau

SEQ ID NO: 1871130 - RNA, 16 nt, Homo sapiens
cgcaaaucaacacuuu

SEQ ID NO: 1871131 - RNA, 14 nt, Homo sapiens
ccuugacacacugu

SEQ ID NO: 1871132 - RNA, 21 nt, Homo sapiens
ucauaaucacucuaauuaauu

SEQ ID NO: 1871133 - RNA, 20 nt, Homo sapiens
agaagggagggagagaauuu

SEQ ID NO: 1871134 - RNA, 20 nt, Homo sapiens
uuuaucauucaaguguaaaa

SEQ ID NO: 1871135 - RNA, 16 nt, Homo sapiens
acugguuuacacuuua

SEQ ID NO: 1871136 - RNA, 13 nt, Homo sapiens
cugggcuguggua

SEQ ID NO: 1871137 - RNA, 14 nt, Homo sapiens
cucuaaacugcaaa

SEQ ID NO: 1871138 - RNA, 13 nt, Homo sapiens
acaaaugagccau

SEQ ID NO: 1871139 - RNA, 12 nt, Homo sapiens
cacacuguggaa

SEQ ID NO: 1871140 - RNA, 19 nt, Homo sapiens
cauuacacgccacaacucc

SEQ ID NO: 1871141 - RNA, 17 nt, Homo sapiens
gcagaagcuggaggcac

SEQ ID NO: 1871142 - RNA, 16 nt, Homo sapiens
cagaaaugccacucac

SEQ ID NO: 1871143 - RNA, 14 nt, Homo sapiens
aaaugucaucaaac

SEQ ID NO: 1871144 - RNA, 15 nt, Homo sapiens
uuacucaaccaaauu

SEQ ID NO: 1871145 - RNA, 14 nt, Homo sapiens
auggugaugucacu

SEQ ID NO: 1871146 - RNA, 21 nt, Homo sapiens
ugccaauuucagcacccaacu

SEQ ID NO: 1871147 - RNA, 22 nt, Homo sapiens
ccccgcacugggcuuggggacc

SEQ ID NO: 1871148 - RNA, 14 nt, Homo sapiens
aauauaaagcaucu

SEQ ID NO: 1871149 - RNA, 22 nt, Homo sapiens
aguaagacuugauugguuuaaa

SEQ ID NO: 1871150 - RNA, 17 nt, Homo sapiens
cucuuacuuauuaucuu

SEQ ID NO: 1871151 - RNA, 19 nt, Homo sapiens
guccauuuugcccuuccau

SEQ ID NO: 1871152 - RNA, 21 nt, Homo sapiens
auucuauuacauuuucaguga

SEQ ID NO: 1871153 - RNA, 21 nt, Homo sapiens
cuugcuaucggggaagccaga

SEQ ID NO: 1871154 - RNA, 14 nt, Homo sapiens
cacacguacuuaaa

SEQ ID NO: 1871155 - RNA, 21 nt, Homo sapiens
agaauguuuucaaauguucuc

SEQ ID NO: 1871156 - RNA, 13 nt, Homo sapiens
cugcagucucuau

SEQ ID NO: 1871157 - RNA, 18 nt, Homo sapiens
caaucauguaaaucuaua

SEQ ID NO: 1871158 - RNA, 20 nt, Homo sapiens
ccuuccugaggaugggcaac

SEQ ID NO: 1871159 - RNA, 21 nt, Homo sapiens
caggaggcagaggguugcagu

SEQ ID NO: 1871160 - RNA, 20 nt, Homo sapiens
gcauagcaguauauguuaau

SEQ ID NO: 1871161 - RNA, 18 nt, Homo sapiens
cuaaauuacagugcaguu

SEQ ID NO: 1871162 - RNA, 22 nt, Homo sapiens
caccucaaaucuucuaauucca

SEQ ID NO: 1871163 - RNA, 14 nt, Homo sapiens
cauaauuagaacaa

SEQ ID NO: 1871164 - RNA, 21 nt, Homo sapiens
cucauacagucucuauuugau

SEQ ID NO: 1871165 - RNA, 15 nt, Homo sapiens
augaguagacauugu

SEQ ID NO: 1871166 - RNA, 18 nt, Homo sapiens
ucccucucguaagauuuc

SEQ ID NO: 1871167 - RNA, 11 nt, Homo sapiens
uuucauaccuu

SEQ ID NO: 1871168 - RNA, 19 nt, Homo sapiens
aacacccaaagcauggacu

SEQ ID NO: 1871169 - RNA, 21 nt, Homo sapiens
aaucuuacaaaagauugucau

SEQ ID NO: 1871170 - RNA, 23 nt, Homo sapiens
ugcaagaguuucuuguaagccau

SEQ ID NO: 1871171 - RNA, 16 nt, Homo sapiens
cuugccaccaccagau

SEQ ID NO: 1871172 - RNA, 15 nt, Homo sapiens
aaaguguaacauaug

SEQ ID NO: 1871173 - RNA, 18 nt, Homo sapiens
ugccaccaucauagcuca

SEQ ID NO: 1871174 - RNA, 15 nt, Homo sapiens
ggacucagggacuca

SEQ ID NO: 1871175 - RNA, 15 nt, Homo sapiens
acucagggacucagg

SEQ ID NO: 1871176 - RNA, 18 nt, Homo sapiens
auaagucugggcacugga

SEQ ID NO: 1871177 - RNA, 15 nt, Homo sapiens
aaucuauguuugcac

SEQ ID NO: 1871178 - RNA, 13 nt, Homo sapiens
uuaaaauuauuca

SEQ ID NO: 1871179 - RNA, 17 nt, Homo sapiens
accucccccuccugucc

SEQ ID NO: 1871180 - RNA, 21 nt, Homo sapiens
cagccccggcugacaccugga

SEQ ID NO: 1871181 - RNA, 23 nt, Homo sapiens
aggacggaguggggggacagaga

SEQ ID NO: 1871182 - RNA, 15 nt, Homo sapiens
uggaagaggggacag

SEQ ID NO: 1871183 - RNA, 17 nt, Homo sapiens
ucuugcccgcaccccuc

SEQ ID NO: 1871184 - RNA, 18 nt, Homo sapiens
auguggucauacucucag

SEQ ID NO: 1871185 - RNA, 18 nt, Homo sapiens
uagaagauagaugcacuu

SEQ ID NO: 1871186 - RNA, 18 nt, Homo sapiens
ucuucaccaagugcaaua

SEQ ID NO: 1871187 - RNA, 18 nt, Homo sapiens
augguagaaaaugcacca

SEQ ID NO: 1871188 - RNA, 17 nt, Homo sapiens
uuaacugcauuuuacca

SEQ ID NO: 1871189 - RNA, 16 nt, Homo sapiens
cugucaguguccucag

SEQ ID NO: 1871190 - RNA, 13 nt, Homo sapiens
gagaacugugcuc

SEQ ID NO: 1871191 - RNA, 18 nt, Homo sapiens
aauacaaaacugugaaua

SEQ ID NO: 1871192 - RNA, 18 nt, Homo sapiens
ucacacaguucaacauaa

SEQ ID NO: 1871193 - RNA, 13 nt, Homo sapiens
ucagucucugagc

SEQ ID NO: 1871194 - RNA, 15 nt, Homo sapiens
uuuaaagaagaguaa

SEQ ID NO: 1871195 - RNA, 16 nt, Homo sapiens
cccagcaguucucugc

SEQ ID NO: 1871196 - RNA, 17 nt, Homo sapiens
agcaugaaagcaguuua

SEQ ID NO: 1871197 - RNA, 19 nt, Homo sapiens
ugcauccagccuccugcua

SEQ ID NO: 1871198 - RNA, 23 nt, Homo sapiens
agugcacugagaacagcauauga

SEQ ID NO: 1871199 - RNA, 20 nt, Homo sapiens
gagaaaaguugacaccugag

SEQ ID NO: 1871200 - RNA, 20 nt, Homo sapiens
gcuuuaaccaccccaucugc

SEQ ID NO: 1871201 - RNA, 16 nt, Homo sapiens
cuuagaauacuguauu

SEQ ID NO: 1871202 - RNA, 22 nt, Homo sapiens
aucuggucaaccuccuggacau

SEQ ID NO: 1871203 - RNA, 17 nt, Homo sapiens
augugucccagccacag

SEQ ID NO: 1871204 - RNA, 17 nt, Homo sapiens
ugcuccgaggggcucau

SEQ ID NO: 1871205 - RNA, 15 nt, Homo sapiens
caugaggaccaggug

SEQ ID NO: 1871206 - RNA, 14 nt, Homo sapiens
gagaaauaaacaua

SEQ ID NO: 1871207 - RNA, 21 nt, Homo sapiens
aauggguacaauguacauuau

SEQ ID NO: 1871208 - RNA, 14 nt, Homo sapiens
aauacaacauguag

SEQ ID NO: 1871209 - RNA, 16 nt, Homo sapiens
cugguaucugcaugua

SEQ ID NO: 1871210 - RNA, 23 nt, Homo sapiens
auauuuguguauauaaaccgauc

SEQ ID NO: 1871211 - RNA, 14 nt, Homo sapiens
acacucuucaguga

SEQ ID NO: 1871212 - RNA, 15 nt, Homo sapiens
gaaaauaaacaccau

SEQ ID NO: 1871213 - RNA, 15 nt, Homo sapiens
gcggaggacuugggg

SEQ ID NO: 1871214 - RNA, 16 nt, Homo sapiens
cgaggccuauuguuga

SEQ ID NO: 1871215 - RNA, 14 nt, Homo sapiens
aguugagacuuaaa

SEQ ID NO: 1871216 - RNA, 15 nt, Homo sapiens
gauuacaacaucugu

SEQ ID NO: 1871217 - RNA, 16 nt, Homo sapiens
gagaagccugugcccu

SEQ ID NO: 1871218 - RNA, 15 nt, Homo sapiens
cagguaaugagggac

SEQ ID NO: 1871219 - RNA, 16 nt, Homo sapiens
caagucagucauucag

SEQ ID NO: 1871220 - RNA, 12 nt, Homo sapiens
cagccacauggg

SEQ ID NO: 1871221 - RNA, 14 nt, Homo sapiens
guuuccucagugau

SEQ ID NO: 1871222 - RNA, 15 nt, Homo sapiens
cuuaauucucugcaa

SEQ ID NO: 1871223 - RNA, 13 nt, Homo sapiens
gaagccacugccu

SEQ ID NO: 1871224 - RNA, 18 nt, Homo sapiens
ccaaggguugagagccag

SEQ ID NO: 1871225 - RNA, 21 nt, Homo sapiens
agguggccuccuugcuuguua

SEQ ID NO: 1871226 - RNA, 12 nt, Homo sapiens
ucaggggcuccc

SEQ ID NO: 1871227 - RNA, 13 nt, Homo sapiens
cccagacacuggc

SEQ ID NO: 1871228 - RNA, 15 nt, Homo sapiens
aaucccagcacuaug

SEQ ID NO: 1871229 - RNA, 18 nt, Homo sapiens
ugccuauuuguguggaca

SEQ ID NO: 1871230 - RNA, 13 nt, Homo sapiens
uauuaagaccaaa

SEQ ID NO: 1871231 - RNA, 18 nt, Homo sapiens
aggaggauucagcucagg

SEQ ID NO: 1871232 - RNA, 21 nt, Homo sapiens
uuagguuucagcagagcugaa

SEQ ID NO: 1871233 - RNA, 15 nt, Homo sapiens
agugucuaaaauacu

SEQ ID NO: 1871234 - RNA, 16 nt, Homo sapiens
uuucuuaaaaaacaua

SEQ ID NO: 1871235 - RNA, 21 nt, Homo sapiens
caaaacacccaaaaauaucuc

SEQ ID NO: 1871236 - RNA, 16 nt, Homo sapiens
auaaauggaccauccu

SEQ ID NO: 1871237 - RNA, 10 nt, Homo sapiens
uucacugaga

SEQ ID NO: 1871238 - RNA, 14 nt, Homo sapiens
ucccaaacuccucu

SEQ ID NO: 1871239 - RNA, 19 nt, Homo sapiens
aauuguacaaccugugauc

SEQ ID NO: 1871240 - RNA, 16 nt, Homo sapiens
agccaauaggcagcuu

SEQ ID NO: 1871241 - RNA, 18 nt, Homo sapiens
guagcuaaccaucacccc

SEQ ID NO: 1871242 - RNA, 17 nt, Homo sapiens
aaucacuuuuaggaugu

SEQ ID NO: 1871243 - RNA, 23 nt, Homo sapiens
ucuucugccccagcuuugcagga

SEQ ID NO: 1871244 - RNA, 22 nt, Homo sapiens
guuccauccaccaccuugccaa

SEQ ID NO: 1871245 - RNA, 18 nt, Homo sapiens
ucuucagggcacugcugc

SEQ ID NO: 1871246 - RNA, 18 nt, Homo sapiens
gucaccucagcugauauu

SEQ ID NO: 1871247 - RNA, 17 nt, Homo sapiens
caauggugaacugucau

SEQ ID NO: 1871248 - RNA, 14 nt, Homo sapiens
ccaaauggcugcuu

SEQ ID NO: 1871249 - RNA, 21 nt, Homo sapiens
auucuccuccuauugccucca

SEQ ID NO: 1871250 - RNA, 16 nt, Homo sapiens
uguaauugaaaaccaa

SEQ ID NO: 1871251 - RNA, 23 nt, Homo sapiens
ugcguguuuccugugcaagucag

SEQ ID NO: 1871252 - RNA, 14 nt, Homo sapiens
gaucugucccuuaa

SEQ ID NO: 1871253 - RNA, 15 nt, Homo sapiens
aucaguauuuucaca

SEQ ID NO: 1871254 - RNA, 16 nt, Homo sapiens
gccccucacacugcaa

SEQ ID NO: 1871255 - RNA, 14 nt, Homo sapiens
gguucugaggccag

SEQ ID NO: 1871256 - RNA, 20 nt, Homo sapiens
ccacagccaaacuaggacac

SEQ ID NO: 1871257 - RNA, 13 nt, Homo sapiens
uuaauauuuccaa

SEQ ID NO: 1871258 - RNA, 18 nt, Homo sapiens
caacgagagcacuugaaa

SEQ ID NO: 1871259 - RNA, 20 nt, Homo sapiens
gcucaaauuccgagugcaga

SEQ ID NO: 1871260 - RNA, 17 nt, Homo sapiens
aguacuugaaacaguca

SEQ ID NO: 1871261 - RNA, 19 nt, Homo sapiens
cacagaaugacugacaaag

SEQ ID NO: 1871262 - RNA, 17 nt, Homo sapiens
caaaucuggaagccaaa

SEQ ID NO: 1871263 - RNA, 21 nt, Homo sapiens
ccgcccacacccucggggggu

SEQ ID NO: 1871264 - RNA, 23 nt, Homo sapiens
acugcugaaacagacaugaaaua

SEQ ID NO: 1871265 - RNA, 18 nt, Homo sapiens
cauuucauacaacagaaa

SEQ ID NO: 1871266 - RNA, 15 nt, Homo sapiens
cacaacuucagcagg

SEQ ID NO: 1871267 - RNA, 15 nt, Homo sapiens
ucaaucauagccaag

SEQ ID NO: 1871268 - RNA, 13 nt, Homo sapiens
guccaagggccau

SEQ ID NO: 1871269 - RNA, 22 nt, Homo sapiens
caugaauaacauuuaaauucca

SEQ ID NO: 1871270 - RNA, 13 nt, Homo sapiens
acuuaacauugau

SEQ ID NO: 1871271 - RNA, 23 nt, Homo sapiens
gcagaaauuuaucuuucaaagag

SEQ ID NO: 1871272 - RNA, 15 nt, Homo sapiens
gaaguuacuuuguaa

SEQ ID NO: 1871273 - RNA, 19 nt, Homo sapiens
caaagcugccugugccaug

SEQ ID NO: 1871274 - RNA, 17 nt, Homo sapiens
cagccacaguguuaugc

SEQ ID NO: 1871275 - RNA, 19 nt, Homo sapiens
agaaaagcaugcauaucau

SEQ ID NO: 1871276 - RNA, 19 nt, Homo sapiens
aguaaacuggauacuguac

SEQ ID NO: 1871277 - RNA, 16 nt, Homo sapiens
ucucuccgaggggugg

SEQ ID NO: 1871278 - RNA, 17 nt, Homo sapiens
uuucccugcuagggguu

SEQ ID NO: 1871279 - RNA, 18 nt, Homo sapiens
accuuggggcuugacuuu

SEQ ID NO: 1871280 - RNA, 18 nt, Homo sapiens
aggcucugccagcccugg

SEQ ID NO: 1871281 - RNA, 16 nt, Homo sapiens
ugcuuugucuggccuc

SEQ ID NO: 1871282 - RNA, 19 nt, Homo sapiens
cuccccaccccacgcgugc

SEQ ID NO: 1871283 - RNA, 14 nt, Homo sapiens
gcccagcaccugcu

SEQ ID NO: 1871284 - RNA, 19 nt, Homo sapiens
cauguaaagaaaaaaacuu

SEQ ID NO: 1871285 - RNA, 18 nt, Homo sapiens
ccucaguuucucaaagau

SEQ ID NO: 1871286 - RNA, 14 nt, Homo sapiens
ugauuucagcacau

SEQ ID NO: 1871287 - RNA, 16 nt, Homo sapiens
uccagagaggcuggau

SEQ ID NO: 1871288 - RNA, 16 nt, Homo sapiens
agucucccuucuccca

SEQ ID NO: 1871289 - RNA, 23 nt, Homo sapiens
caaaacuuaucacgccuacuuaa

SEQ ID NO: 1871290 - RNA, 15 nt, Homo sapiens
accauagcuacauca

SEQ ID NO: 1871291 - RNA, 22 nt, Homo sapiens
uucuuuaaaauguaaagccaug

SEQ ID NO: 1871292 - RNA, 15 nt, Homo sapiens
cgacuuucucagcag

SEQ ID NO: 1871293 - RNA, 15 nt, Homo sapiens
auaaaagacagugaa

SEQ ID NO: 1871294 - RNA, 21 nt, Homo sapiens
uuuucuuguccucauucuugc

SEQ ID NO: 1871295 - RNA, 19 nt, Homo sapiens
aggugcccgaguagcaucc

SEQ ID NO: 1871296 - RNA, 12 nt, Homo sapiens
uagucucaguga

SEQ ID NO: 1871297 - RNA, 16 nt, Homo sapiens
uggacaaacagccuca

SEQ ID NO: 1871298 - RNA, 16 nt, Homo sapiens
agauagugccucugca

SEQ ID NO: 1871299 - RNA, 22 nt, Homo sapiens
aauagacuuaaaucucauugcu

SEQ ID NO: 1871300 - RNA, 17 nt, Homo sapiens
augcacccauugugauu

SEQ ID NO: 1871301 - RNA, 13 nt, Homo sapiens
cacugcaagcacu

SEQ ID NO: 1871302 - RNA, 14 nt, Homo sapiens
aaucguuugaacuc

SEQ ID NO: 1871303 - RNA, 17 nt, Homo sapiens
gucacagaaucuccauu

SEQ ID NO: 1871304 - RNA, 22 nt, Homo sapiens
uguucccacaccccaacacuuc

SEQ ID NO: 1871305 - RNA, 23 nt, Homo sapiens
acugaagggcccuucacugccuu

SEQ ID NO: 1871306 - RNA, 21 nt, Homo sapiens
uugcaaccacugcaauaucuu

SEQ ID NO: 1871307 - RNA, 23 nt, Homo sapiens
acauguuagucaaggacugguaa

SEQ ID NO: 1871308 - RNA, 18 nt, Homo sapiens
gaaauuuacccacaguga

SEQ ID NO: 1871309 - RNA, 15 nt, Homo sapiens
auguggcccuggcug

SEQ ID NO: 1871310 - RNA, 22 nt, Homo sapiens
aaugaagggacggcugugggac

SEQ ID NO: 1871311 - RNA, 15 nt, Homo sapiens
uucugcugucucucc

SEQ ID NO: 1871312 - RNA, 16 nt, Homo sapiens
cacccaugcccagcug

SEQ ID NO: 1871313 - RNA, 19 nt, Homo sapiens
cagugauuuccuacagugu

SEQ ID NO: 1871314 - RNA, 14 nt, Homo sapiens
cagaaauccuuuca

SEQ ID NO: 1871315 - RNA, 13 nt, Homo sapiens
auuuuuagccuaa

SEQ ID NO: 1871316 - RNA, 18 nt, Homo sapiens
auauuaggagacacaggg

SEQ ID NO: 1871317 - RNA, 14 nt, Homo sapiens
gugagggcuggaug

SEQ ID NO: 1871318 - RNA, 12 nt, Homo sapiens
auucagccuuau

SEQ ID NO: 1871319 - RNA, 15 nt, Homo sapiens
caccccucccugcuu

SEQ ID NO: 1871320 - RNA, 23 nt, Homo sapiens
ccccugcucaagucuacccugau

SEQ ID NO: 1871321 - RNA, 21 nt, Homo sapiens
auugugaacaugauaguuaaa

SEQ ID NO: 1871322 - RNA, 17 nt, Homo sapiens
uuaguuuccguuuccag

SEQ ID NO: 1871323 - RNA, 14 nt, Homo sapiens
uguggucacaggaa

SEQ ID NO: 1871324 - RNA, 19 nt, Homo sapiens
ccacauacugcggaccaag

SEQ ID NO: 1871325 - RNA, 13 nt, Homo sapiens
acugaccaucugc

SEQ ID NO: 1871326 - RNA, 18 nt, Homo sapiens
cucuccaagucucagugg

SEQ ID NO: 1871327 - RNA, 13 nt, Homo sapiens
gcaauuguauaua

SEQ ID NO: 1871328 - RNA, 17 nt, Homo sapiens
cacuggccccugagauc

SEQ ID NO: 1871329 - RNA, 23 nt, Homo sapiens
ugagcaggggcggggacuggagc

SEQ ID NO: 1871330 - RNA, 13 nt, Homo sapiens
ccauaggacugug

SEQ ID NO: 1871331 - RNA, 23 nt, Homo sapiens
cugaaucuggaccccaucuguga

SEQ ID NO: 1871332 - RNA, 22 nt, Homo sapiens
agggaaugccagggacauuuuc

SEQ ID NO: 1871333 - RNA, 21 nt, Homo sapiens
aauacauaucgcugacuucau

SEQ ID NO: 1871334 - RNA, 16 nt, Homo sapiens
gcuuccuucugugaaa

SEQ ID NO: 1871335 - RNA, 20 nt, Homo sapiens
uuuuaaaauaaaaauuuaau

SEQ ID NO: 1871336 - RNA, 16 nt, Homo sapiens
aacagcaguguucuca

SEQ ID NO: 1871337 - RNA, 22 nt, Homo sapiens
ugcucuccugacgcagcacaag

SEQ ID NO: 1871338 - RNA, 16 nt, Homo sapiens
agcaugucgucaaagc

SEQ ID NO: 1871339 - RNA, 14 nt, Homo sapiens
gacacuguugcaaa

SEQ ID NO: 1871340 - RNA, 14 nt, Homo sapiens
uggccugugagcaa

SEQ ID NO: 1871341 - RNA, 14 nt, Homo sapiens
aaggcuuccaggcu

SEQ ID NO: 1871342 - RNA, 14 nt, Homo sapiens
ccuuccucacuucc

SEQ ID NO: 1871343 - RNA, 22 nt, Homo sapiens
ugcauguuuuccagcuccucau

SEQ ID NO: 1871344 - RNA, 20 nt, Homo sapiens
ugagcugguuugucaaacaa

SEQ ID NO: 1871345 - RNA, 16 nt, Homo sapiens
ccuguuuuugcaaaaa

SEQ ID NO: 1871346 - RNA, 15 nt, Homo sapiens
cagccaucaaauagu

SEQ ID NO: 1871347 - RNA, 12 nt, Homo sapiens
ucuucucccacc

SEQ ID NO: 1871348 - RNA, 15 nt, Homo sapiens
uuguaaauacaugua

SEQ ID NO: 1871349 - RNA, 15 nt, Homo sapiens
guaacugaagcauaa

SEQ ID NO: 1871350 - RNA, 20 nt, Homo sapiens
aaugucaagaguauuuauua

SEQ ID NO: 1871351 - RNA, 18 nt, Homo sapiens
uuaaauuuggguugcaaa

SEQ ID NO: 1871352 - RNA, 19 nt, Homo sapiens
cuacaucuucagcucccau

SEQ ID NO: 1871353 - RNA, 20 nt, Homo sapiens
uuucuacuuuuuguauaaag

SEQ ID NO: 1871354 - RNA, 16 nt, Homo sapiens
cugcacuccagccugg

SEQ ID NO: 1871355 - RNA, 23 nt, Homo sapiens
ugagaauauuuuucccaggacua

SEQ ID NO: 1871356 - RNA, 15 nt, Homo sapiens
uacuguugcacugau

SEQ ID NO: 1871357 - RNA, 14 nt, Homo sapiens
caagugcacuugaa

SEQ ID NO: 1871358 - RNA, 17 nt, Homo sapiens
guacacugccccaggac

SEQ ID NO: 1871359 - RNA, 23 nt, Homo sapiens
cuacacaaauuauaagcauacaa

SEQ ID NO: 1871360 - RNA, 16 nt, Homo sapiens
cccauguugacugucu

SEQ ID NO: 1871361 - RNA, 17 nt, Homo sapiens
cugaguaucacaucaca

SEQ ID NO: 1871362 - RNA, 21 nt, Homo sapiens
acauuucuuaaaauguuucau

SEQ ID NO: 1871363 - RNA, 22 nt, Homo sapiens
auacaaccauauaaaugaaggc

SEQ ID NO: 1871364 - RNA, 15 nt, Homo sapiens
aagagaagcugagaa

SEQ ID NO: 1871365 - RNA, 15 nt, Homo sapiens
augggaagcagggaa

SEQ ID NO: 1871366 - RNA, 22 nt, Homo sapiens
caguaaagcacuugcaaccguc

SEQ ID NO: 1871367 - RNA, 20 nt, Homo sapiens
auauuuuaccauacauuuaa

SEQ ID NO: 1871368 - RNA, 21 nt, Homo sapiens
uaucauugauacgggauuucu

SEQ ID NO: 1871369 - RNA, 18 nt, Homo sapiens
cgagaaaacaaacccagg

SEQ ID NO: 1871370 - RNA, 16 nt, Homo sapiens
gaacucuggaguucau

SEQ ID NO: 1871371 - RNA, 16 nt, Homo sapiens
uugucccugugccuaa

SEQ ID NO: 1871372 - RNA, 19 nt, Homo sapiens
uuuauaggagaaagcaaaa

SEQ ID NO: 1871373 - RNA, 22 nt, Homo sapiens
aagugacacuuugaacuccuca

SEQ ID NO: 1871374 - RNA, 20 nt, Homo sapiens
uggcagcccuguguguguca

SEQ ID NO: 1871375 - RNA, 13 nt, Homo sapiens
ccuuccaaagacu

SEQ ID NO: 1871376 - RNA, 14 nt, Homo sapiens
aaagauuggccaug

SEQ ID NO: 1871377 - RNA, 12 nt, Homo sapiens
ugggcuuccuga

SEQ ID NO: 1871378 - RNA, 12 nt, Homo sapiens
aauaaaugucau

SEQ ID NO: 1871379 - RNA, 12 nt, Homo sapiens
auugagcacaua

SEQ ID NO: 1871380 - RNA, 13 nt, Homo sapiens
accucccaccuau

SEQ ID NO: 1871381 - RNA, 11 nt, Homo sapiens
cuuugcacuug

SEQ ID NO: 1871382 - RNA, 22 nt, Homo sapiens
aagacuuuuaugauacuugaaa

SEQ ID NO: 1871383 - RNA, 18 nt, Homo sapiens
uaaguugagaaggugccu

SEQ ID NO: 1871384 - RNA, 17 nt, Homo sapiens
auaaauguauccagaua

SEQ ID NO: 1871385 - RNA, 14 nt, Homo sapiens
cuccaaugccuacu

SEQ ID NO: 1871386 - RNA, 21 nt, Homo sapiens
cagacugaaacgccuugcacg

SEQ ID NO: 1871387 - RNA, 15 nt, Homo sapiens
uuuuucuguguuacu

SEQ ID NO: 1871388 - RNA, 16 nt, Homo sapiens
aaauucucaguucucu

SEQ ID NO: 1871389 - RNA, 15 nt, Homo sapiens
acagcagccugugag

SEQ ID NO: 1871390 - RNA, 16 nt, Homo sapiens
cccagccccacacccu

SEQ ID NO: 1871391 - RNA, 18 nt, Homo sapiens
aaacuaagcccccgcugu

SEQ ID NO: 1871392 - RNA, 19 nt, Homo sapiens
acacagacucugugagauu

SEQ ID NO: 1871393 - RNA, 12 nt, Homo sapiens
acagauaaaaca

SEQ ID NO: 1871394 - RNA, 19 nt, Homo sapiens
caugugacacauaugcacc

SEQ ID NO: 1871395 - RNA, 22 nt, Homo sapiens
agggugguuuggcaacaccucc

SEQ ID NO: 1871396 - RNA, 21 nt, Homo sapiens
ucaguaagaccggaagcuccu

SEQ ID NO: 1871397 - RNA, 18 nt, Homo sapiens
gccccgcugucacuugcc

SEQ ID NO: 1871398 - RNA, 18 nt, Homo sapiens
gggugugaucauauauca

SEQ ID NO: 1871399 - RNA, 18 nt, Homo sapiens
agacgcagagcaaaugag

SEQ ID NO: 1871400 - RNA, 20 nt, Homo sapiens
caaggagcaugucacuccag

SEQ ID NO: 1871401 - RNA, 17 nt, Homo sapiens
ggaggccguugcagaca

SEQ ID NO: 1871402 - RNA, 19 nt, Homo sapiens
uuuucuaaaccuucaucau

SEQ ID NO: 1871403 - RNA, 13 nt, Homo sapiens
uauaugcugcauu

SEQ ID NO: 1871404 - RNA, 22 nt, Homo sapiens
ucacaguccucauuuacuggau

SEQ ID NO: 1871405 - RNA, 18 nt, Homo sapiens
aagccaugaccuugugcc

SEQ ID NO: 1871406 - RNA, 14 nt, Homo sapiens
augggcaauccugg

SEQ ID NO: 1871407 - RNA, 13 nt, Homo sapiens
aaauaaagcuuuu

SEQ ID NO: 1871408 - RNA, 15 nt, Homo sapiens
cagagcccuggaccu

SEQ ID NO: 1871409 - RNA, 21 nt, Homo sapiens
ucccugcacccaugacaauca

SEQ ID NO: 1871410 - RNA, 18 nt, Homo sapiens
ccacacagcuacagcuuu

SEQ ID NO: 1871411 - RNA, 20 nt, Homo sapiens
uugcuucaguaaaaggaccu

SEQ ID NO: 1871412 - RNA, 19 nt, Homo sapiens
caccaggagcagcagccag

SEQ ID NO: 1871413 - RNA, 19 nt, Homo sapiens
gccuggacacuguaccgac

SEQ ID NO: 1871414 - RNA, 16 nt, Homo sapiens
cuuauacuguacaaua

SEQ ID NO: 1871415 - RNA, 13 nt, Homo sapiens
cagauaccucacc

SEQ ID NO: 1871416 - RNA, 14 nt, Homo sapiens
uuguauugacuauu

SEQ ID NO: 1871417 - RNA, 15 nt, Homo sapiens
ucuuaacagucucca

SEQ ID NO: 1871418 - RNA, 13 nt, Homo sapiens
gucauugaugaac

SEQ ID NO: 1871419 - RNA, 16 nt, Homo sapiens
auucagucuucuggau

SEQ ID NO: 1871420 - RNA, 20 nt, Homo sapiens
cuugcaagggaagagccuuu

SEQ ID NO: 1871421 - RNA, 23 nt, Homo sapiens
ccuguuaaggcauccacuucaca

SEQ ID NO: 1871422 - RNA, 15 nt, Homo sapiens
ccuggcuuccagggg

SEQ ID NO: 1871423 - RNA, 12 nt, Homo sapiens
cccaucauccca

SEQ ID NO: 1871424 - RNA, 13 nt, Homo sapiens
aggagugccauac

SEQ ID NO: 1871425 - RNA, 13 nt, Homo sapiens
gggcaccagcuca

SEQ ID NO: 1871426 - RNA, 20 nt, Homo sapiens
gcacuaacacaugcacacac

SEQ ID NO: 1871427 - RNA, 12 nt, Homo sapiens
agacugaucauc

SEQ ID NO: 1871428 - RNA, 16 nt, Homo sapiens
accagccacacagagc

SEQ ID NO: 1871429 - RNA, 14 nt, Homo sapiens
auuaagagcacgua

SEQ ID NO: 1871430 - RNA, 13 nt, Homo sapiens
ggaacacaaccau

SEQ ID NO: 1871431 - RNA, 21 nt, Homo sapiens
accacucaggccaacaagcca

SEQ ID NO: 1871432 - RNA, 17 nt, Homo sapiens
ccagggcucugccccag

SEQ ID NO: 1871433 - RNA, 17 nt, Homo sapiens
guuuuauuguaaucaua

SEQ ID NO: 1871434 - RNA, 22 nt, Homo sapiens
gagggccaacgcuugacacaaa

SEQ ID NO: 1871435 - RNA, 21 nt, Homo sapiens
uuuaagggaaggggaaggaua

SEQ ID NO: 1871436 - RNA, 19 nt, Homo sapiens
aucacagcaugugcaauau

SEQ ID NO: 1871437 - RNA, 22 nt, Homo sapiens
ugaaagaggggugggauccaca

SEQ ID NO: 1871438 - RNA, 22 nt, Homo sapiens
aaugaguaaauaaacucuucaa

SEQ ID NO: 1871439 - RNA, 14 nt, Homo sapiens
ggcccuagacucau

SEQ ID NO: 1871440 - RNA, 20 nt, Homo sapiens
uuucucugauacagaaaagu

SEQ ID NO: 1871441 - RNA, 14 nt, Homo sapiens
aaauuuaauaccag

SEQ ID NO: 1871442 - RNA, 14 nt, Homo sapiens
gccccagcuuuauc

SEQ ID NO: 1871443 - RNA, 19 nt, Homo sapiens
ugugagaguggcuuucuac

SEQ ID NO: 1871444 - RNA, 21 nt, Homo sapiens
agauguagauaaacucagaaa

SEQ ID NO: 1871445 - RNA, 10 nt, Homo sapiens
ugaacacuug

SEQ ID NO: 1871446 - RNA, 19 nt, Homo sapiens
uuggauacuccauggggug

SEQ ID NO: 1871447 - RNA, 21 nt, Homo sapiens
aagaaauuccuuccuuaccug

SEQ ID NO: 1871448 - RNA, 15 nt, Homo sapiens
aggccgucacccugg

SEQ ID NO: 1871449 - RNA, 17 nt, Homo sapiens
ucaaggccugcucccug

SEQ ID NO: 1871450 - RNA, 12 nt, Homo sapiens
acuuuuuuacaa

SEQ ID NO: 1871451 - RNA, 19 nt, Homo sapiens
acccucuccuugucacaga

SEQ ID NO: 1871452 - RNA, 18 nt, Homo sapiens
aguaagagcuuuguuuca

SEQ ID NO: 1871453 - RNA, 14 nt, Homo sapiens
cagauaauuggcaa

SEQ ID NO: 1871454 - RNA, 12 nt, Homo sapiens
uuuaucugugau

SEQ ID NO: 1871455 - RNA, 22 nt, Homo sapiens
ccacagaggaugcugacaucau

SEQ ID NO: 1871456 - RNA, 18 nt, Homo sapiens
ucuccugaaacccaaagc

SEQ ID NO: 1871457 - RNA, 21 nt, Homo sapiens
gucccccgagaggugggagac

SEQ ID NO: 1871458 - RNA, 23 nt, Homo sapiens
acggaguuuaguuuuauauugcu

SEQ ID NO: 1871459 - RNA, 24 nt, Homo sapiens
auugccaagugccauaaccaugag

SEQ ID NO: 1871460 - RNA, 22 nt, Homo sapiens
auaaacauccuucaagaacucu

SEQ ID NO: 1871461 - RNA, 14 nt, Homo sapiens
ugucauuuccucua

SEQ ID NO: 1871462 - RNA, 12 nt, Homo sapiens
aguaugcauuaa

SEQ ID NO: 1871463 - RNA, 18 nt, Homo sapiens
aagcagccuuuuucacca

SEQ ID NO: 1871464 - RNA, 16 nt, Homo sapiens
agaaauuaaguacuua

SEQ ID NO: 1871465 - RNA, 16 nt, Homo sapiens
cuggaauggcacguug

SEQ ID NO: 1871466 - RNA, 19 nt, Homo sapiens
uaugcuggacugcauucac

SEQ ID NO: 1871467 - RNA, 13 nt, Homo sapiens
aacucaucucauu

SEQ ID NO: 1871468 - RNA, 16 nt, Homo sapiens
ugaggauaaauugcca

SEQ ID NO: 1871469 - RNA, 14 nt, Homo sapiens
ccguaguaccuccc

SEQ ID NO: 1871470 - RNA, 14 nt, Homo sapiens
auuuaaaaaugcau

SEQ ID NO: 1871471 - RNA, 19 nt, Homo sapiens
cugccuugcccacuccugc

SEQ ID NO: 1871472 - RNA, 21 nt, Homo sapiens
caagaaggccaauugccuaaa

SEQ ID NO: 1871473 - RNA, 15 nt, Homo sapiens
cucagcagaaacaca

SEQ ID NO: 1871474 - RNA, 22 nt, Homo sapiens
uagaaaacagcccccacuccag

SEQ ID NO: 1871475 - RNA, 18 nt, Homo sapiens
cugaaggcagucauauca

SEQ ID NO: 1871476 - RNA, 16 nt, Homo sapiens
gcaaauguaauauaau

SEQ ID NO: 1871477 - RNA, 19 nt, Homo sapiens
aagagggggagaaugagaa

SEQ ID NO: 1871478 - RNA, 13 nt, Homo sapiens
uucugcucuggaa

SEQ ID NO: 1871479 - RNA, 20 nt, Homo sapiens
guacauuugugcuguuuuca

SEQ ID NO: 1871480 - RNA, 20 nt, Homo sapiens
cugaauuuuaaauguucaca

SEQ ID NO: 1871481 - RNA, 22 nt, Homo sapiens
ucuuagaacuggugauguaaag

SEQ ID NO: 1871482 - RNA, 22 nt, Homo sapiens
gacaagcuccucccuugagaau

SEQ ID NO: 1871483 - RNA, 22 nt, Homo sapiens
uguagugucuguaauaccuuag

SEQ ID NO: 1871484 - RNA, 16 nt, Homo sapiens
uaccauauguuuauca

SEQ ID NO: 1871485 - RNA, 18 nt, Homo sapiens
cuuuaauaaaauuugcuu

SEQ ID NO: 1871486 - RNA, 18 nt, Homo sapiens
gacaagaaggccacuggu

SEQ ID NO: 1871487 - RNA, 13 nt, Homo sapiens
gcugccuguggug

SEQ ID NO: 1871488 - RNA, 19 nt, Homo sapiens
gaaguuuuuggugucacag

SEQ ID NO: 1871489 - RNA, 14 nt, Homo sapiens
ccgcugggugguuu

SEQ ID NO: 1871490 - RNA, 15 nt, Homo sapiens
ccaagcaugacccag

SEQ ID NO: 1871491 - RNA, 17 nt, Homo sapiens
uauguuuccuaacugug

SEQ ID NO: 1871492 - RNA, 17 nt, Homo sapiens
cuguaauuguauuucaa

SEQ ID NO: 1871493 - RNA, 13 nt, Homo sapiens
cuccucagugaca

SEQ ID NO: 1871494 - RNA, 16 nt, Homo sapiens
cagaccuguucugacc

SEQ ID NO: 1871495 - RNA, 13 nt, Homo sapiens
ucccagacacugg

SEQ ID NO: 1871496 - RNA, 16 nt, Homo sapiens
uuugccaaucauugca

SEQ ID NO: 1871497 - RNA, 16 nt, Homo sapiens
cccaggccgacccaag

SEQ ID NO: 1871498 - RNA, 13 nt, Homo sapiens
cacggagggcagu

SEQ ID NO: 1871499 - RNA, 13 nt, Homo sapiens
gccugaggcaauu

SEQ ID NO: 1871500 - RNA, 15 nt, Homo sapiens
uuauccagaugaacu

SEQ ID NO: 1871501 - RNA, 19 nt, Homo sapiens
ucuuguaaauacauguccc

SEQ ID NO: 1871502 - RNA, 19 nt, Homo sapiens
uagguuucucugccuccag

SEQ ID NO: 1871503 - RNA, 17 nt, Homo sapiens
acuuuugaagaacaaaa

SEQ ID NO: 1871504 - RNA, 18 nt, Homo sapiens
aagcugugaugugccuac

SEQ ID NO: 1871505 - RNA, 14 nt, Homo sapiens
gcggaaacaggugu

SEQ ID NO: 1871506 - RNA, 21 nt, Homo sapiens
aagcugugcccugaccacccu

SEQ ID NO: 1871507 - RNA, 23 nt, Homo sapiens
uaugcauagcuuugcacuucaaa

SEQ ID NO: 1871508 - RNA, 22 nt, Homo sapiens
acuuauuuaaaugacagcaccu

SEQ ID NO: 1871509 - RNA, 22 nt, Homo sapiens
ucucaaguauaugucauuuacu

SEQ ID NO: 1871510 - RNA, 12 nt, Homo sapiens
ggaaaccaaagg

SEQ ID NO: 1871511 - RNA, 19 nt, Homo sapiens
uggugaaacauacgacaga

SEQ ID NO: 1871512 - RNA, 20 nt, Homo sapiens
caggcccugcuccugcagca

SEQ ID NO: 1871513 - RNA, 18 nt, Homo sapiens
ggagacauauuucaguga

SEQ ID NO: 1871514 - RNA, 13 nt, Homo sapiens
uuucagacugcaa

SEQ ID NO: 1871515 - RNA, 18 nt, Homo sapiens
aaaugugugcccagcuua

SEQ ID NO: 1871516 - RNA, 16 nt, Homo sapiens
guucaugcacacuugc

SEQ ID NO: 1871517 - RNA, 20 nt, Homo sapiens
ccguuuuuacuaaguaaaag

SEQ ID NO: 1871518 - RNA, 14 nt, Homo sapiens
ucacagggcugaaa

SEQ ID NO: 1871519 - RNA, 21 nt, Homo sapiens
agaauauuauaaagugcuuua

SEQ ID NO: 1871520 - RNA, 18 nt, Homo sapiens
uugaagaaaguagcagaa

SEQ ID NO: 1871521 - RNA, 20 nt, Homo sapiens
aaaagcagauggacuugaaa

SEQ ID NO: 1871522 - RNA, 19 nt, Homo sapiens
gcagacaccauucauucca

SEQ ID NO: 1871523 - RNA, 19 nt, Homo sapiens
uuuccuuuaaauuucagcu

SEQ ID NO: 1871524 - RNA, 16 nt, Homo sapiens
aaucccaaagugccuu

SEQ ID NO: 1871525 - RNA, 20 nt, Homo sapiens
gagcccaagaaaguaauuag

SEQ ID NO: 1871526 - RNA, 14 nt, Homo sapiens
uuccucagcugcca

SEQ ID NO: 1871527 - RNA, 17 nt, Homo sapiens
aaauaaucauacacaga

SEQ ID NO: 1871528 - RNA, 20 nt, Homo sapiens
uauuucuuacaggcacaaaa

SEQ ID NO: 1871529 - RNA, 18 nt, Homo sapiens
uaagggagaaaauaaucc

SEQ ID NO: 1871530 - RNA, 17 nt, Homo sapiens
aagaugucuauguagcu

SEQ ID NO: 1871531 - RNA, 16 nt, Homo sapiens
gcccgcagcacauuuc

SEQ ID NO: 1871532 - RNA, 14 nt, Homo sapiens
cuggaguucacuuu

SEQ ID NO: 1871533 - RNA, 14 nt, Homo sapiens
uaauuguacugugu

SEQ ID NO: 1871534 - RNA, 18 nt, Homo sapiens
auggggaacucccccaga

SEQ ID NO: 1871535 - RNA, 13 nt, Homo sapiens
ugccuagggccug

SEQ ID NO: 1871536 - RNA, 16 nt, Homo sapiens
aaagccaaggcagcuc

SEQ ID NO: 1871537 - RNA, 17 nt, Homo sapiens
gacuucuucuucuuugu

SEQ ID NO: 1871538 - RNA, 19 nt, Homo sapiens
cuggagacggggcaucucc

SEQ ID NO: 1871539 - RNA, 19 nt, Homo sapiens
caguuagagcugagcacuu

SEQ ID NO: 1871540 - RNA, 12 nt, Homo sapiens
uagaggugguga

SEQ ID NO: 1871541 - RNA, 16 nt, Homo sapiens
cucacaaaucaguaaa

SEQ ID NO: 1871542 - RNA, 14 nt, Homo sapiens
agcugaacaauagg

SEQ ID NO: 1871543 - RNA, 13 nt, Homo sapiens
gccauucaugucc

SEQ ID NO: 1871544 - RNA, 15 nt, Homo sapiens
cuaccaggcuguaaa

SEQ ID NO: 1871545 - RNA, 21 nt, Homo sapiens
aggaaagaugauggugacuua

SEQ ID NO: 1871546 - RNA, 11 nt, Homo sapiens
ggccagggacc

SEQ ID NO: 1871547 - RNA, 19 nt, Homo sapiens
auuugaagcgagucauuuc

SEQ ID NO: 1871548 - RNA, 20 nt, Homo sapiens
cagacuaaaggauccagaga

SEQ ID NO: 1871549 - RNA, 16 nt, Homo sapiens
cauagcaccauuccuc

SEQ ID NO: 1871550 - RNA, 21 nt, Homo sapiens
cuuuugaaagucccuaauaaa

SEQ ID NO: 1871551 - RNA, 18 nt, Homo sapiens
agcaaagaugcauuuuca

SEQ ID NO: 1871552 - RNA, 15 nt, Homo sapiens
cgugagaacaaucau

SEQ ID NO: 1871553 - RNA, 17 nt, Homo sapiens
cugugugugccuccagc

SEQ ID NO: 1871554 - RNA, 17 nt, Homo sapiens
acuggcgccuucucgga

SEQ ID NO: 1871555 - RNA, 16 nt, Homo sapiens
aguggugagacuguau

SEQ ID NO: 1871556 - RNA, 19 nt, Homo sapiens
auugcuuuuaucaguguua

SEQ ID NO: 1871557 - RNA, 18 nt, Homo sapiens
acaaggaucagaauggaa

SEQ ID NO: 1871558 - RNA, 17 nt, Homo sapiens
augcuaugcuauggaau

SEQ ID NO: 1871559 - RNA, 12 nt, Homo sapiens
gaaaaaugccug

SEQ ID NO: 1871560 - RNA, 14 nt, Homo sapiens
cacucagcacuuuc

SEQ ID NO: 1871561 - RNA, 15 nt, Homo sapiens
agcuuccucuggcca

SEQ ID NO: 1871562 - RNA, 21 nt, Homo sapiens
acuggaaauguauauuuugua

SEQ ID NO: 1871563 - RNA, 13 nt, Homo sapiens
auuguuagcacua

SEQ ID NO: 1871564 - RNA, 21 nt, Homo sapiens
aguuucuccauccagcucacg

SEQ ID NO: 1871565 - RNA, 22 nt, Homo sapiens
aguaacccccacuggacugacc

SEQ ID NO: 1871566 - RNA, 17 nt, Homo sapiens
cauuuccaaauucacaa

SEQ ID NO: 1871567 - RNA, 17 nt, Homo sapiens
ccugucuuccugcauuc

SEQ ID NO: 1871568 - RNA, 19 nt, Homo sapiens
ggcucucuugugcauugua

SEQ ID NO: 1871569 - RNA, 13 nt, Homo sapiens
aagaugaauacaa

SEQ ID NO: 1871570 - RNA, 22 nt, Homo sapiens
cuccucuucagaggagaaagaa

SEQ ID NO: 1871571 - RNA, 14 nt, Homo sapiens
cuuucauuucuuga

SEQ ID NO: 1871572 - RNA, 20 nt, Homo sapiens
uuuguauccucugaccuaca

SEQ ID NO: 1871573 - RNA, 16 nt, Homo sapiens
gcacagggcaccagag

SEQ ID NO: 1871574 - RNA, 22 nt, Homo sapiens
cucagggaguuugacgagcuca

SEQ ID NO: 1871575 - RNA, 22 nt, Homo sapiens
caggcuuuuccuccaaccugug

SEQ ID NO: 1871576 - RNA, 20 nt, Homo sapiens
aaacacuuccagucuggaga

SEQ ID NO: 1871577 - RNA, 20 nt, Homo sapiens
aaauuuuaaaagccacaggu

SEQ ID NO: 1871578 - RNA, 15 nt, Homo sapiens
ccaacauuaaaacuc

SEQ ID NO: 1871579 - RNA, 16 nt, Homo sapiens
gacucgagagugggca

SEQ ID NO: 1871580 - RNA, 19 nt, Homo sapiens
uguauucagaguugauggu

SEQ ID NO: 1871581 - RNA, 23 nt, Homo sapiens
ccugcgggcgcgggcagccaccc

SEQ ID NO: 1871582 - RNA, 21 nt, Homo sapiens
agggcccucuggggcucagcc

SEQ ID NO: 1871583 - RNA, 13 nt, Homo sapiens
cucuuuucaauua

SEQ ID NO: 1871584 - RNA, 15 nt, Homo sapiens
aaugcagcaucuuug

SEQ ID NO: 1871585 - RNA, 18 nt, Homo sapiens
uauuggauguauucugua

SEQ ID NO: 1871586 - RNA, 20 nt, Homo sapiens
uucuagaugaucaacauaau

SEQ ID NO: 1871587 - RNA, 10 nt, Homo sapiens
gaacauaaaa

SEQ ID NO: 1871588 - RNA, 18 nt, Homo sapiens
cuuauccccucagaaucc

SEQ ID NO: 1871589 - RNA, 15 nt, Homo sapiens
cuaaguuauuuacuu

SEQ ID NO: 1871590 - RNA, 21 nt, Homo sapiens
ucuggauggccaaacccaaga

SEQ ID NO: 1871591 - RNA, 19 nt, Homo sapiens
guagaguaaaaugcugugu

SEQ ID NO: 1871592 - RNA, 22 nt, Homo sapiens
guaucacugguccaccuccuga

SEQ ID NO: 1871593 - RNA, 22 nt, Homo sapiens
cuccuagaagaaccaaauaccu

SEQ ID NO: 1871594 - RNA, 20 nt, Homo sapiens
ccagaugugaaaacaucuca

SEQ ID NO: 1871595 - RNA, 14 nt, Homo sapiens
aaccuguaagccca

SEQ ID NO: 1871596 - RNA, 19 nt, Homo sapiens
gaucuggggaaggaccaac

SEQ ID NO: 1871597 - RNA, 22 nt, Homo sapiens
aagucaaauauguagauugccu

SEQ ID NO: 1871598 - RNA, 14 nt, Homo sapiens
cgggagccccaucu

SEQ ID NO: 1871599 - RNA, 15 nt, Homo sapiens
aacacauaacauugu

SEQ ID NO: 1871600 - RNA, 12 nt, Homo sapiens
accugcaaguug

SEQ ID NO: 1871601 - RNA, 14 nt, Homo sapiens
auuuacacagugag

SEQ ID NO: 1871602 - RNA, 15 nt, Homo sapiens
ggacaucacagggug

SEQ ID NO: 1871603 - RNA, 14 nt, Homo sapiens
ucugccucagcuuc

SEQ ID NO: 1871604 - RNA, 16 nt, Homo sapiens
gauaauaguuguuauu

SEQ ID NO: 1871605 - RNA, 15 nt, Homo sapiens
cccaacaagugcucu

SEQ ID NO: 1871606 - RNA, 16 nt, Homo sapiens
ggucuugguuccagcc

SEQ ID NO: 1871607 - RNA, 20 nt, Homo sapiens
ggagcuucccacuccaggac

SEQ ID NO: 1871608 - RNA, 20 nt, Homo sapiens
ugacucuuccccauaaucac

SEQ ID NO: 1871609 - RNA, 21 nt, Homo sapiens
uuuccagguuccugagcccua

SEQ ID NO: 1871610 - RNA, 22 nt, Homo sapiens
cuucuagaguaauuaucuguga

SEQ ID NO: 1871611 - RNA, 12 nt, Homo sapiens
aaaugcacugug

SEQ ID NO: 1871612 - RNA, 20 nt, Homo sapiens
aagaaaggcgcgcgacaaug

SEQ ID NO: 1871613 - RNA, 19 nt, Homo sapiens
aauuuauuugaaaaugcau

SEQ ID NO: 1871614 - RNA, 16 nt, Homo sapiens
aaugagccaucacuag

SEQ ID NO: 1871615 - RNA, 19 nt, Homo sapiens
cuugugacuagugcugaag

SEQ ID NO: 1871616 - RNA, 20 nt, Homo sapiens
ucugccaaaggaugugauau

SEQ ID NO: 1871617 - RNA, 11 nt, Homo sapiens
gacacugggga

SEQ ID NO: 1871618 - RNA, 18 nt, Homo sapiens
ccauacacacuguuguca

SEQ ID NO: 1871619 - RNA, 15 nt, Homo sapiens
guaauggaaugcaaa

SEQ ID NO: 1871620 - RNA, 20 nt, Homo sapiens
caccgaugcacacgcacaua

SEQ ID NO: 1871621 - RNA, 17 nt, Homo sapiens
uccugcccaagcacuuc

SEQ ID NO: 1871622 - RNA, 23 nt, Homo sapiens
uucucucuguguggcaaacauuu

SEQ ID NO: 1871623 - RNA, 23 nt, Homo sapiens
ucaggagaggggcagaacagccg

SEQ ID NO: 1871624 - RNA, 17 nt, Homo sapiens
cccaaggacucuuccac

SEQ ID NO: 1871625 - RNA, 14 nt, Homo sapiens
aauaaacacugugu

SEQ ID NO: 1871626 - RNA, 13 nt, Homo sapiens
ugggucuccaggg

SEQ ID NO: 1871627 - RNA, 22 nt, Homo sapiens
uuacugauucuccugucagaga

SEQ ID NO: 1871628 - RNA, 13 nt, Homo sapiens
gucauucucaccu

SEQ ID NO: 1871629 - RNA, 18 nt, Homo sapiens
aagcgagcagucagcauu

SEQ ID NO: 1871630 - RNA, 22 nt, Homo sapiens
cagaguagcccaggucacuguu

SEQ ID NO: 1871631 - RNA, 13 nt, Homo sapiens
aucugaacauucu

SEQ ID NO: 1871632 - RNA, 19 nt, Homo sapiens
cuugguuucagccaagggg

SEQ ID NO: 1871633 - RNA, 18 nt, Homo sapiens
uccugggcucaagugauc

SEQ ID NO: 1871634 - RNA, 15 nt, Homo sapiens
cucagauuuccacag

SEQ ID NO: 1871635 - RNA, 12 nt, Homo sapiens
cauuacagggaa

SEQ ID NO: 1871636 - RNA, 18 nt, Homo sapiens
auagaagcaaaugacaaa

SEQ ID NO: 1871637 - RNA, 21 nt, Homo sapiens
acuguggccuguuaacuggua

SEQ ID NO: 1871638 - RNA, 16 nt, Homo sapiens
cccaagcagcuggcca

SEQ ID NO: 1871639 - RNA, 14 nt, Homo sapiens
acccagaaucucau

SEQ ID NO: 1871640 - RNA, 12 nt, Homo sapiens
ugaaagccaaau

SEQ ID NO: 1871641 - RNA, 18 nt, Homo sapiens
augaaggaugugggccca

SEQ ID NO: 1871642 - RNA, 23 nt, Homo sapiens
acaguagggaugaguacccaaaa

SEQ ID NO: 1871643 - RNA, 20 nt, Homo sapiens
ggaaaggaggcaugccucug

SEQ ID NO: 1871644 - RNA, 17 nt, Homo sapiens
cauccuucaagaacucu

SEQ ID NO: 1871645 - RNA, 19 nt, Homo sapiens
caacauuucucacugaaag

SEQ ID NO: 1871646 - RNA, 18 nt, Homo sapiens
gcagcucuacaggugagg

SEQ ID NO: 1871647 - RNA, 16 nt, Homo sapiens
ugccucaagcuaugug

SEQ ID NO: 1871648 - RNA, 18 nt, Homo sapiens
auaugaaacuaggguuug

SEQ ID NO: 1871649 - RNA, 18 nt, Homo sapiens
gcugagauuacucugaaa

SEQ ID NO: 1871650 - RNA, 18 nt, Homo sapiens
uucacauaggcaauaucu

SEQ ID NO: 1871651 - RNA, 18 nt, Homo sapiens
ucacaauacucaaaagag

SEQ ID NO: 1871652 - RNA, 16 nt, Homo sapiens
gucuaaauuuucuaaa

SEQ ID NO: 1871653 - RNA, 14 nt, Homo sapiens
uagacacaguauug

SEQ ID NO: 1871654 - RNA, 13 nt, Homo sapiens
uugagaccagccu

SEQ ID NO: 1871655 - RNA, 20 nt, Homo sapiens
cuccuuauucccaguguucc

SEQ ID NO: 1871656 - RNA, 13 nt, Homo sapiens
cuggccacagacu

SEQ ID NO: 1871657 - RNA, 16 nt, Homo sapiens
aucuuuaccacugcag

SEQ ID NO: 1871658 - RNA, 18 nt, Homo sapiens
uuucucauaaauuucucu

SEQ ID NO: 1871659 - RNA, 22 nt, Homo sapiens
ccuuugagcugcugacugccaa

SEQ ID NO: 1871660 - RNA, 14 nt, Homo sapiens
ugaugcauugaccu

SEQ ID NO: 1871661 - RNA, 12 nt, Homo sapiens
uaauauauugcu

SEQ ID NO: 1871662 - RNA, 19 nt, Homo sapiens
aguuuguccuacaauagaa

SEQ ID NO: 1871663 - RNA, 21 nt, Homo sapiens
guuugaggauaggaguucacu

SEQ ID NO: 1871664 - RNA, 20 nt, Homo sapiens
gcaagcucuaucaccaagga

SEQ ID NO: 1871665 - RNA, 23 nt, Homo sapiens
gcaaauaaaugaacugacuucaa

SEQ ID NO: 1871666 - RNA, 19 nt, Homo sapiens
ggcucugguaugaauucac

SEQ ID NO: 1871667 - RNA, 14 nt, Homo sapiens
cagacagaaaaaac

SEQ ID NO: 1871668 - RNA, 17 nt, Homo sapiens
auaccguaucuucuaaa

SEQ ID NO: 1871669 - RNA, 13 nt, Homo sapiens
aucaacaucucuu

SEQ ID NO: 1871670 - RNA, 11 nt, Homo sapiens
ugggugacaaa

SEQ ID NO: 1871671 - RNA, 16 nt, Homo sapiens
aggaggaaaagcccag

SEQ ID NO: 1871672 - RNA, 15 nt, Homo sapiens
cccaucucccugcuu

SEQ ID NO: 1871673 - RNA, 22 nt, Homo sapiens
agaaagcaggagcagcugugcu

SEQ ID NO: 1871674 - RNA, 13 nt, Homo sapiens
agccaucucuaau

SEQ ID NO: 1871675 - RNA, 16 nt, Homo sapiens
cuguugauaauaucuc

SEQ ID NO: 1871676 - RNA, 21 nt, Homo sapiens
aauguacguuacagcuuucac

SEQ ID NO: 1871677 - RNA, 20 nt, Homo sapiens
cagggccuuugucugucuca

SEQ ID NO: 1871678 - RNA, 21 nt, Homo sapiens
cauuuuaugagaguuuggaau

SEQ ID NO: 1871679 - RNA, 19 nt, Homo sapiens
guucucaaaguuaauucac

SEQ ID NO: 1871680 - RNA, 21 nt, Homo sapiens
gaauacugcauuuacagugua

SEQ ID NO: 1871681 - RNA, 18 nt, Homo sapiens
ccacauucuggcuccacc

SEQ ID NO: 1871682 - RNA, 19 nt, Homo sapiens
gagcugcagaaugacucca

SEQ ID NO: 1871683 - RNA, 22 nt, Homo sapiens
cauagauauacuugaguaacau

SEQ ID NO: 1871684 - RNA, 21 nt, Homo sapiens
uggacuauggcucuacuuuca

SEQ ID NO: 1871685 - RNA, 19 nt, Homo sapiens
cguuugacuagccaucuca

SEQ ID NO: 1871686 - RNA, 22 nt, Homo sapiens
uccccaagugcggggaguacaa

SEQ ID NO: 1871687 - RNA, 16 nt, Homo sapiens
gcaagacguccuggaa

SEQ ID NO: 1871688 - RNA, 14 nt, Homo sapiens
ucagaaauugaaag

SEQ ID NO: 1871689 - RNA, 21 nt, Homo sapiens
auaaguuucugagaugggaga

SEQ ID NO: 1871690 - RNA, 19 nt, Homo sapiens
acaugaaucaagcaaucca

SEQ ID NO: 1871691 - RNA, 17 nt, Homo sapiens
aagcagaugggaacuga

SEQ ID NO: 1871692 - RNA, 12 nt, Homo sapiens
auaaauacuuau

SEQ ID NO: 1871693 - RNA, 14 nt, Homo sapiens
cugaguagcuuuca

SEQ ID NO: 1871694 - RNA, 13 nt, Homo sapiens
cugggcucucacc

SEQ ID NO: 1871695 - RNA, 20 nt, Homo sapiens
uucuuccuggggcccaaaug

SEQ ID NO: 1871696 - RNA, 21 nt, Homo sapiens
cccaagcaugggggaccccuu

SEQ ID NO: 1871697 - RNA, 14 nt, Homo sapiens
uaaucaaaugauuc

SEQ ID NO: 1871698 - RNA, 16 nt, Homo sapiens
cucugaaggaggccac

SEQ ID NO: 1871699 - RNA, 16 nt, Homo sapiens
aguaaaggguauguca

SEQ ID NO: 1871700 - RNA, 16 nt, Homo sapiens
uuccagauuaacauaa

SEQ ID NO: 1871701 - RNA, 23 nt, Homo sapiens
aaguugcugggauuacaggugug

SEQ ID NO: 1871702 - RNA, 18 nt, Homo sapiens
aagggaaaaaagcaacuu

SEQ ID NO: 1871703 - RNA, 20 nt, Homo sapiens
gacgcauguuauggugcuaa

SEQ ID NO: 1871704 - RNA, 23 nt, Homo sapiens
gauuuucaaccagauaacauacc

SEQ ID NO: 1871705 - RNA, 21 nt, Homo sapiens
auuugucaacaaagucaccca

SEQ ID NO: 1871706 - RNA, 18 nt, Homo sapiens
ugaaaauaugacacucua

SEQ ID NO: 1871707 - RNA, 18 nt, Homo sapiens
uaaacaaaaaacccacaa

SEQ ID NO: 1871708 - RNA, 12 nt, Homo sapiens
cacacagugaaa

SEQ ID NO: 1871709 - RNA, 20 nt, Homo sapiens
uauguuuagugugauuguga

SEQ ID NO: 1871710 - RNA, 17 nt, Homo sapiens
caguaucccacauccaa

SEQ ID NO: 1871711 - RNA, 13 nt, Homo sapiens
aaucaucaaguaa

SEQ ID NO: 1871712 - RNA, 21 nt, Homo sapiens
aggucccugcugccagcuuca

SEQ ID NO: 1871713 - RNA, 18 nt, Homo sapiens
caguuucucuccaacucc

SEQ ID NO: 1871714 - RNA, 18 nt, Homo sapiens
ucccugcccucaucucuc

SEQ ID NO: 1871715 - RNA, 16 nt, Homo sapiens
uaggagagacuggcca

SEQ ID NO: 1871716 - RNA, 20 nt, Homo sapiens
ugagaaccuuggaccacucc

SEQ ID NO: 1871717 - RNA, 12 nt, Homo sapiens
uguuugccucau

SEQ ID NO: 1871718 - RNA, 18 nt, Homo sapiens
aacuagccaaaccaggac

SEQ ID NO: 1871719 - RNA, 22 nt, Homo sapiens
guuacauuucuaucaguacuuu

SEQ ID NO: 1871720 - RNA, 14 nt, Homo sapiens
ugcacaccuuggaa

SEQ ID NO: 1871721 - RNA, 18 nt, Homo sapiens
uuuccauauggauuuucu

SEQ ID NO: 1871722 - RNA, 13 nt, Homo sapiens
aagaaaugcacaa

SEQ ID NO: 1871723 - RNA, 20 nt, Homo sapiens
agcuguauauauauaugugu

SEQ ID NO: 1871724 - RNA, 19 nt, Homo sapiens
agcccuucaccaucuaccu

SEQ ID NO: 1871725 - RNA, 11 nt, Homo sapiens
cacuaucuuuc

SEQ ID NO: 1871726 - RNA, 15 nt, Homo sapiens
cuuuuguuucuagaa

SEQ ID NO: 1871727 - RNA, 17 nt, Homo sapiens
ccuuccuugaacccuaa

SEQ ID NO: 1871728 - RNA, 10 nt, Homo sapiens
guuugacaac

SEQ ID NO: 1871729 - RNA, 23 nt, Homo sapiens
uuguauagguaacuagguaacuu

SEQ ID NO: 1871730 - RNA, 17 nt, Homo sapiens
augaaugggagugaggg

SEQ ID NO: 1871731 - RNA, 16 nt, Homo sapiens
aaccaacgggucugug

SEQ ID NO: 1871732 - RNA, 16 nt, Homo sapiens
gcuagaauucuggugu

SEQ ID NO: 1871733 - RNA, 13 nt, Homo sapiens
auuuaaaaugccu

SEQ ID NO: 1871734 - RNA, 16 nt, Homo sapiens
uuccaugggaccacaa

SEQ ID NO: 1871735 - RNA, 16 nt, Homo sapiens
gcccaggucccagugc

SEQ ID NO: 1871736 - RNA, 17 nt, Homo sapiens
uuccugaaccgaugaga

SEQ ID NO: 1871737 - RNA, 17 nt, Homo sapiens
uaauacauaaguuaaua

SEQ ID NO: 1871738 - RNA, 22 nt, Homo sapiens
ccaagccucugccccaaggggc

SEQ ID NO: 1871739 - RNA, 23 nt, Homo sapiens
cacugcgcccuuaacugcaucca

SEQ ID NO: 1871740 - RNA, 15 nt, Homo sapiens
accggcaaccuguaa

SEQ ID NO: 1871741 - RNA, 13 nt, Homo sapiens
gguuaacuuguau

SEQ ID NO: 1871742 - RNA, 13 nt, Homo sapiens
guuuuacuuuuaa

SEQ ID NO: 1871743 - RNA, 15 nt, Homo sapiens
caaaauuuccaguac

SEQ ID NO: 1871744 - RNA, 18 nt, Homo sapiens
ugccacuguguacugugg

SEQ ID NO: 1871745 - RNA, 20 nt, Homo sapiens
cguagaugcugccuaggguu

SEQ ID NO: 1871746 - RNA, 20 nt, Homo sapiens
ugugaauaaaaacccuguau

SEQ ID NO: 1871747 - RNA, 16 nt, Homo sapiens
cuuucuugaauugcau

SEQ ID NO: 1871748 - RNA, 16 nt, Homo sapiens
aaaccuaaauguucaa

SEQ ID NO: 1871749 - RNA, 19 nt, Homo sapiens
uuaaauuuugaaaacugug

SEQ ID NO: 1871750 - RNA, 22 nt, Homo sapiens
augaacuugcacuuguuauauu

SEQ ID NO: 1871751 - RNA, 21 nt, Homo sapiens
auggacaugaagggaugcugc

SEQ ID NO: 1871752 - RNA, 18 nt, Homo sapiens
acauuguuuuuguauauu

SEQ ID NO: 1871753 - RNA, 18 nt, Homo sapiens
aacgaacuuuccauggga

SEQ ID NO: 1871754 - RNA, 23 nt, Homo sapiens
cucugaauaaauacccauugaac

SEQ ID NO: 1871755 - RNA, 16 nt, Homo sapiens
gaagaucaagccaguu

SEQ ID NO: 1871756 - RNA, 19 nt, Homo sapiens
auuugagguuaagacaaac

SEQ ID NO: 1871757 - RNA, 22 nt, Homo sapiens
aagaaaaucacaucacuaccua

SEQ ID NO: 1871758 - RNA, 16 nt, Homo sapiens
ccucccugacuuuucu

SEQ ID NO: 1871759 - RNA, 17 nt, Homo sapiens
gcgugcccagcucuuca

SEQ ID NO: 1871760 - RNA, 21 nt, Homo sapiens
ccugcguguccccgugcagua

SEQ ID NO: 1871761 - RNA, 15 nt, Homo sapiens
aauacauguuuucac

SEQ ID NO: 1871762 - RNA, 23 nt, Homo sapiens
ugaagaaguuauaccuuccucuu

SEQ ID NO: 1871763 - RNA, 22 nt, Homo sapiens
ccuguaggaagucauccugcca

SEQ ID NO: 1871764 - RNA, 16 nt, Homo sapiens
gaaaggcaagggaggu

SEQ ID NO: 1871765 - RNA, 17 nt, Homo sapiens
auaucauacuguucaau

SEQ ID NO: 1871766 - RNA, 18 nt, Homo sapiens
acugugaaguuacaugca

SEQ ID NO: 1871767 - RNA, 14 nt, Homo sapiens
caaauaaacacugu

SEQ ID NO: 1871768 - RNA, 18 nt, Homo sapiens
uaaguuaauguauauaaa

SEQ ID NO: 1871769 - RNA, 18 nt, Homo sapiens
ugcaugggcuaaugaaga

SEQ ID NO: 1871770 - RNA, 22 nt, Homo sapiens
cugugggccccucaacagccaa

SEQ ID NO: 1871771 - RNA, 12 nt, Homo sapiens
gagaacacugug

SEQ ID NO: 1871772 - RNA, 18 nt, Homo sapiens
auauuccuauauguagcu

SEQ ID NO: 1871773 - RNA, 22 nt, Homo sapiens
cuauuguccuuguguauccuga

SEQ ID NO: 1871774 - RNA, 22 nt, Homo sapiens
uccauuggaucuuuuacuuuaa

SEQ ID NO: 1871775 - RNA, 22 nt, Homo sapiens
ucaagcaauccuccugccucag

SEQ ID NO: 1871776 - RNA, 21 nt, Homo sapiens
cagucagaguccagugcucug

SEQ ID NO: 1871777 - RNA, 12 nt, Homo sapiens
aauuaguuucaa

SEQ ID NO: 1871778 - RNA, 22 nt, Homo sapiens
auacacuccacuugaagcacuu

SEQ ID NO: 1871779 - RNA, 22 nt, Homo sapiens
agucucauugucaccucuguga

SEQ ID NO: 1871780 - RNA, 15 nt, Homo sapiens
uauccaaaccaaaua

SEQ ID NO: 1871781 - RNA, 15 nt, Homo sapiens
acugaaagacaccau

SEQ ID NO: 1871782 - RNA, 15 nt, Homo sapiens
uacgaaaagccagcu

SEQ ID NO: 1871783 - RNA, 18 nt, Homo sapiens
caggacguccuaucuccc

SEQ ID NO: 1871784 - RNA, 16 nt, Homo sapiens
ucccaaauguggaauu

SEQ ID NO: 1871785 - RNA, 16 nt, Homo sapiens
cagaaaucacagucaa

SEQ ID NO: 1871786 - RNA, 17 nt, Homo sapiens
ccuguggccuuugcaau

SEQ ID NO: 1871787 - RNA, 22 nt, Homo sapiens
uguauuuuccuaaugugaucau

SEQ ID NO: 1871788 - RNA, 23 nt, Homo sapiens
aaucccuacagggugucugucag

SEQ ID NO: 1871789 - RNA, 14 nt, Homo sapiens
cuuugaauuuacug

SEQ ID NO: 1871790 - RNA, 22 nt, Homo sapiens
uguuucccaucacuguauccau

SEQ ID NO: 1871791 - RNA, 19 nt, Homo sapiens
acacucugccagcaaagag

SEQ ID NO: 1871792 - RNA, 19 nt, Homo sapiens
uaaaguuugguauuguaaa

SEQ ID NO: 1871793 - RNA, 14 nt, Homo sapiens
accaaaucucagua

SEQ ID NO: 1871794 - RNA, 17 nt, Homo sapiens
ccagcucaggauauuau

SEQ ID NO: 1871795 - RNA, 21 nt, Homo sapiens
ggcacggcccguggcuguuga

SEQ ID NO: 1871796 - RNA, 18 nt, Homo sapiens
uggagugcaguggugcga

SEQ ID NO: 1871797 - RNA, 13 nt, Homo sapiens
gaccuuuccucuc

SEQ ID NO: 1871798 - RNA, 21 nt, Homo sapiens
gcaccauggaggcaggcuccc

SEQ ID NO: 1871799 - RNA, 18 nt, Homo sapiens
uaacuggcuacugggaaa

SEQ ID NO: 1871800 - RNA, 14 nt, Homo sapiens
ugagucaugauccu

SEQ ID NO: 1871801 - RNA, 20 nt, Homo sapiens
cuagacguuguaaugcacac

SEQ ID NO: 1871802 - RNA, 17 nt, Homo sapiens
uuacaaugugcacugaa

SEQ ID NO: 1871803 - RNA, 15 nt, Homo sapiens
aaaguggcaaucuca

SEQ ID NO: 1871804 - RNA, 14 nt, Homo sapiens
uaaauuuguguucu

SEQ ID NO: 1871805 - RNA, 14 nt, Homo sapiens
uauuuaugugaaca

SEQ ID NO: 1871806 - RNA, 16 nt, Homo sapiens
aucuaacuauauguac

SEQ ID NO: 1871807 - RNA, 17 nt, Homo sapiens
cagacaggacaggugug

SEQ ID NO: 1871808 - RNA, 15 nt, Homo sapiens
uuugagauagcccau

SEQ ID NO: 1871809 - RNA, 14 nt, Homo sapiens
cuuuggaccugcag

SEQ ID NO: 1871810 - RNA, 22 nt, Homo sapiens
ggucuaagcaccuuggugcuua

SEQ ID NO: 1871811 - RNA, 23 nt, Homo sapiens
auguuugcugcucuauauuacaa

SEQ ID NO: 1871812 - RNA, 18 nt, Homo sapiens
accauguuggccaggcug

SEQ ID NO: 1871813 - RNA, 14 nt, Homo sapiens
ccaauuucauaacu

SEQ ID NO: 1871814 - RNA, 14 nt, Homo sapiens
ccucucucauuccc

SEQ ID NO: 1871815 - RNA, 22 nt, Homo sapiens
cugaagccaaaguuaugcaagg

SEQ ID NO: 1871816 - RNA, 19 nt, Homo sapiens
uuauucaaugugacaccua

SEQ ID NO: 1871817 - RNA, 23 nt, Homo sapiens
gugggccagggcugcccugagaa

SEQ ID NO: 1871818 - RNA, 18 nt, Homo sapiens
guucucuuugguguuaca

SEQ ID NO: 1871819 - RNA, 22 nt, Homo sapiens
cuguuagcuccucacuguggua

SEQ ID NO: 1871820 - RNA, 13 nt, Homo sapiens
gagguugcaauga

SEQ ID NO: 1871821 - RNA, 17 nt, Homo sapiens
aaaaugucagucugguu

SEQ ID NO: 1871822 - RNA, 21 nt, Homo sapiens
aaaguuuuuuauuaugcauua

SEQ ID NO: 1871823 - RNA, 15 nt, Homo sapiens
ucaaguaauacaaac

SEQ ID NO: 1871824 - RNA, 17 nt, Homo sapiens
cagcuggcgaacccugg

SEQ ID NO: 1871825 - RNA, 22 nt, Homo sapiens
ccuuaccacgcaguaacuaaag

SEQ ID NO: 1871826 - RNA, 13 nt, Homo sapiens
gguaaaacagggc

SEQ ID NO: 1871827 - RNA, 20 nt, Homo sapiens
gccuuuuccacacgcauuaa

SEQ ID NO: 1871828 - RNA, 15 nt, Homo sapiens
aacaaauuauguuac

SEQ ID NO: 1871829 - RNA, 23 nt, Homo sapiens
aagucucagacugauuucuugcg

SEQ ID NO: 1871830 - RNA, 23 nt, Homo sapiens
accccacuuagccuuucuuuucu

SEQ ID NO: 1871831 - RNA, 15 nt, Homo sapiens
agcuacaugguggag

SEQ ID NO: 1871832 - RNA, 16 nt, Homo sapiens
gcauaguauuccauug

SEQ ID NO: 1871833 - RNA, 19 nt, Homo sapiens
acacuuuugggagguccag

SEQ ID NO: 1871834 - RNA, 15 nt, Homo sapiens
agccauguaucucag

SEQ ID NO: 1871835 - RNA, 14 nt, Homo sapiens
caauccaacaucca

SEQ ID NO: 1871836 - RNA, 20 nt, Homo sapiens
acccuccccuagucacucau

SEQ ID NO: 1871837 - RNA, 16 nt, Homo sapiens
uaucacauauuugaua

SEQ ID NO: 1871838 - RNA, 14 nt, Homo sapiens
uucccuuccacugc

SEQ ID NO: 1871839 - RNA, 13 nt, Homo sapiens
cauauaugcaaua

SEQ ID NO: 1871840 - RNA, 22 nt, Homo sapiens
cggacacaagcggcccugacac

SEQ ID NO: 1871841 - RNA, 16 nt, Homo sapiens
uaaacuuggcuguaug

SEQ ID NO: 1871842 - RNA, 19 nt, Homo sapiens
gcuccccgagaguccucag

SEQ ID NO: 1871843 - RNA, 23 nt, Homo sapiens
cuuaaggggggcagggagugaug

SEQ ID NO: 1871844 - RNA, 20 nt, Homo sapiens
ugggaguaagaaaugggccu

SEQ ID NO: 1871845 - RNA, 12 nt, Homo sapiens
uucugcacacac

SEQ ID NO: 1871846 - RNA, 13 nt, Homo sapiens
acaauaucuucau

SEQ ID NO: 1871847 - RNA, 17 nt, Homo sapiens
ucuugcacugaauauau

SEQ ID NO: 1871848 - RNA, 21 nt, Homo sapiens
cgugcaaacaaccugaaucuu

SEQ ID NO: 1871849 - RNA, 21 nt, Homo sapiens
uguauacagauucuagccaaa

SEQ ID NO: 1871850 - RNA, 22 nt, Homo sapiens
aucuggaacgcucuaggcagaa

SEQ ID NO: 1871851 - RNA, 22 nt, Homo sapiens
uucaaggaggcccacugugucu

SEQ ID NO: 1871852 - RNA, 19 nt, Homo sapiens
aucauguuugucaauggaa

SEQ ID NO: 1871853 - RNA, 22 nt, Homo sapiens
ggccuuaauuuucaguauaauu

SEQ ID NO: 1871854 - RNA, 14 nt, Homo sapiens
aagggagaaaauaa

SEQ ID NO: 1871855 - RNA, 15 nt, Homo sapiens
auuaauucaaugaaa

SEQ ID NO: 1871856 - RNA, 15 nt, Homo sapiens
aggccacuugcucag

SEQ ID NO: 1871857 - RNA, 18 nt, Homo sapiens
aaucggcauguauacuua

SEQ ID NO: 1871858 - RNA, 18 nt, Homo sapiens
aaaauuccucuuacugua

SEQ ID NO: 1871859 - RNA, 19 nt, Homo sapiens
ucaggaggaaggcuuacac

SEQ ID NO: 1871860 - RNA, 14 nt, Homo sapiens
cacagagcaauggu

SEQ ID NO: 1871861 - RNA, 13 nt, Homo sapiens
uggaacugcauca

SEQ ID NO: 1871862 - RNA, 14 nt, Homo sapiens
cccaauagcacuuu

SEQ ID NO: 1871863 - RNA, 16 nt, Homo sapiens
agcuguacaugaugau

SEQ ID NO: 1871864 - RNA, 13 nt, Homo sapiens
guuuacucagggu

SEQ ID NO: 1871865 - RNA, 16 nt, Homo sapiens
cuggagccugggauuu

SEQ ID NO: 1871866 - RNA, 16 nt, Homo sapiens
agcuaaauggcaacaa

SEQ ID NO: 1871867 - RNA, 16 nt, Homo sapiens
auaaacauguauaaaa

SEQ ID NO: 1871868 - RNA, 22 nt, Homo sapiens
cuguaauuguuguuuguaugua

SEQ ID NO: 1871869 - RNA, 17 nt, Homo sapiens
acuguuagcacuguuga

SEQ ID NO: 1871870 - RNA, 19 nt, Homo sapiens
cauuguuuuucugauaugu

SEQ ID NO: 1871871 - RNA, 16 nt, Homo sapiens
cuacgguuaugaaggc

SEQ ID NO: 1871872 - RNA, 20 nt, Homo sapiens
gcauccagagauucauuuuc

SEQ ID NO: 1871873 - RNA, 21 nt, Homo sapiens
cacugacacugcgaacucuca

SEQ ID NO: 1871874 - RNA, 23 nt, Homo sapiens
accuaguacugccccccaugagg

SEQ ID NO: 1871875 - RNA, 17 nt, Homo sapiens
ugcauuaugcacguguc

SEQ ID NO: 1871876 - RNA, 19 nt, Homo sapiens
ucaaguucuacaucaauau

SEQ ID NO: 1871877 - RNA, 23 nt, Homo sapiens
uuuguuagauauuaggucccauc

SEQ ID NO: 1871878 - RNA, 12 nt, Homo sapiens
acaacuuugcaa

SEQ ID NO: 1871879 - RNA, 23 nt, Homo sapiens
aaggcucagacugggcacugggg

SEQ ID NO: 1871880 - RNA, 16 nt, Homo sapiens
ggcaguggaguaggga

SEQ ID NO: 1871881 - RNA, 23 nt, Homo sapiens
gggucuugcggcugaagugucac

SEQ ID NO: 1871882 - RNA, 13 nt, Homo sapiens
agaggaacaagca

SEQ ID NO: 1871883 - RNA, 21 nt, Homo sapiens
agacagggaauagugggauca

SEQ ID NO: 1871884 - RNA, 12 nt, Homo sapiens
ccucagggccaa

SEQ ID NO: 1871885 - RNA, 15 nt, Homo sapiens
caauccuccuaccuc

SEQ ID NO: 1871886 - RNA, 14 nt, Homo sapiens
cauggacuuuauaa

SEQ ID NO: 1871887 - RNA, 12 nt, Homo sapiens
gauuuuugccca

SEQ ID NO: 1871888 - RNA, 16 nt, Homo sapiens
aggacacgaacuggaa

SEQ ID NO: 1871889 - RNA, 15 nt, Homo sapiens
uuaaugaauaugcca

SEQ ID NO: 1871890 - RNA, 15 nt, Homo sapiens
uccagggaacugagc

SEQ ID NO: 1871891 - RNA, 14 nt, Homo sapiens
ucuacuuguucuaa

SEQ ID NO: 1871892 - RNA, 14 nt, Homo sapiens
cuuuggcacugggg

SEQ ID NO: 1871893 - RNA, 23 nt, Homo sapiens
cauuuacagucucuuucuuccuu

SEQ ID NO: 1871894 - RNA, 23 nt, Homo sapiens
cucagcauagggucacuuugcca

SEQ ID NO: 1871895 - RNA, 22 nt, Homo sapiens
ccccugagcaaugucugugcua

SEQ ID NO: 1871896 - RNA, 14 nt, Homo sapiens
agcccaacaguaau

SEQ ID NO: 1871897 - RNA, 15 nt, Homo sapiens
cuaagcacauuccaa

SEQ ID NO: 1871898 - RNA, 16 nt, Homo sapiens
cucugguuuucuugcc

SEQ ID NO: 1871899 - RNA, 19 nt, Homo sapiens
cuaaccucagccaaacaca

SEQ ID NO: 1871900 - RNA, 16 nt, Homo sapiens
uacucagaaccugcuc

SEQ ID NO: 1871901 - RNA, 17 nt, Homo sapiens
gccuggagggcacuucc

SEQ ID NO: 1871902 - RNA, 22 nt, Homo sapiens
uuacuccuuuggcuucaaagga

SEQ ID NO: 1871903 - RNA, 15 nt, Homo sapiens
caguaaauaucccaa

SEQ ID NO: 1871904 - RNA, 12 nt, Homo sapiens
gccaucaccuca

SEQ ID NO: 1871905 - RNA, 15 nt, Homo sapiens
cuuuuguaauuugua

SEQ ID NO: 1871906 - RNA, 18 nt, Homo sapiens
auuaaaagugacauuugu

SEQ ID NO: 1871907 - RNA, 22 nt, Homo sapiens
cacaagcugagcaggacagcca

SEQ ID NO: 1871908 - RNA, 13 nt, Homo sapiens
ggggccaggccag

SEQ ID NO: 1871909 - RNA, 14 nt, Homo sapiens
cuaugggcauuugg

SEQ ID NO: 1871910 - RNA, 18 nt, Homo sapiens
acagcccauaaagcaaga

SEQ ID NO: 1871911 - RNA, 17 nt, Homo sapiens
gguggcugccucauuua

SEQ ID NO: 1871912 - RNA, 15 nt, Homo sapiens
gaaacccccagugua

SEQ ID NO: 1871913 - RNA, 19 nt, Homo sapiens
caguggaagcaguuucaga

SEQ ID NO: 1871914 - RNA, 12 nt, Homo sapiens
ucaccccaguuc

SEQ ID NO: 1871915 - RNA, 19 nt, Homo sapiens
cuccuacuuacaacccagg

SEQ ID NO: 1871916 - RNA, 19 nt, Homo sapiens
gugcacccaacgugaugcu

SEQ ID NO: 1871917 - RNA, 16 nt, Homo sapiens
gauacuuauucaaaaa

SEQ ID NO: 1871918 - RNA, 18 nt, Homo sapiens
aaagcaaaacagacugug

SEQ ID NO: 1871919 - RNA, 20 nt, Homo sapiens
agcaugaauuuguaaugucu

SEQ ID NO: 1871920 - RNA, 13 nt, Homo sapiens
ugaugccauguaa

SEQ ID NO: 1871921 - RNA, 16 nt, Homo sapiens
uuagacccgguccugc

SEQ ID NO: 1871922 - RNA, 12 nt, Homo sapiens
ucagaaagccaa

SEQ ID NO: 1871923 - RNA, 19 nt, Homo sapiens
acugcuaauaaaugaccag

SEQ ID NO: 1871924 - RNA, 22 nt, Homo sapiens
agauguaagguaauuucugugu

SEQ ID NO: 1871925 - RNA, 18 nt, Homo sapiens
agagucuuugauucacca

SEQ ID NO: 1871926 - RNA, 15 nt, Homo sapiens
acauaaacacauaca

SEQ ID NO: 1871927 - RNA, 15 nt, Homo sapiens
auauaaacauauaca

SEQ ID NO: 1871928 - RNA, 10 nt, Homo sapiens
uuuccaugau

SEQ ID NO: 1871929 - RNA, 23 nt, Homo sapiens
uuuccuguauguuguacaaucaa

SEQ ID NO: 1871930 - RNA, 16 nt, Homo sapiens
uuacagucacauucag

SEQ ID NO: 1871931 - RNA, 12 nt, Homo sapiens
gagauucugggu

SEQ ID NO: 1871932 - RNA, 15 nt, Homo sapiens
uugauggagccccag

SEQ ID NO: 1871933 - RNA, 15 nt, Homo sapiens
uugguggccuaauuu

SEQ ID NO: 1871934 - RNA, 17 nt, Homo sapiens
agcuguucucauugcca

SEQ ID NO: 1871935 - RNA, 21 nt, Homo sapiens
ugccgguaaacacgccugcaa

SEQ ID NO: 1871936 - RNA, 11 nt, Homo sapiens
cugccacugug

SEQ ID NO: 1871937 - RNA, 17 nt, Homo sapiens
uacgcucagcucaucca

SEQ ID NO: 1871938 - RNA, 17 nt, Homo sapiens
ggagcaugguguuuuca

SEQ ID NO: 1871939 - RNA, 19 nt, Homo sapiens
gaaguuuuguuuuaguuuu

SEQ ID NO: 1871940 - RNA, 16 nt, Homo sapiens
caaauacacauuugcu

SEQ ID NO: 1871941 - RNA, 17 nt, Homo sapiens
uuucuuugcaccaaaga

SEQ ID NO: 1871942 - RNA, 15 nt, Homo sapiens
caacugacaauauga

SEQ ID NO: 1871943 - RNA, 11 nt, Homo sapiens
ugaccaggaac

SEQ ID NO: 1871944 - RNA, 12 nt, Homo sapiens
ucuuuucugcau

SEQ ID NO: 1871945 - RNA, 16 nt, Homo sapiens
uaugccagcucaccuu

SEQ ID NO: 1871946 - RNA, 12 nt, Homo sapiens
ccuuuaaacugu

SEQ ID NO: 1871947 - RNA, 17 nt, Homo sapiens
cuaaugagacugaccau

SEQ ID NO: 1871948 - RNA, 17 nt, Homo sapiens
ugcauuuucauauugcu

SEQ ID NO: 1871949 - RNA, 20 nt, Homo sapiens
ccugagaucugcacagucag

SEQ ID NO: 1871950 - RNA, 16 nt, Homo sapiens
uuuuucaaaugaucuu

SEQ ID NO: 1871951 - RNA, 18 nt, Homo sapiens
caaggcauugaaucucua

SEQ ID NO: 1871952 - RNA, 17 nt, Homo sapiens
agccuuccaugaccucc

SEQ ID NO: 1871953 - RNA, 15 nt, Homo sapiens
ucuagcuuuagggga

SEQ ID NO: 1871954 - RNA, 23 nt, Homo sapiens
cagggugugagggauggggagca

SEQ ID NO: 1871955 - RNA, 19 nt, Homo sapiens
cuuuugcuaaugcaauuag

SEQ ID NO: 1871956 - RNA, 20 nt, Homo sapiens
uuauaacauccacaaagaga

SEQ ID NO: 1871957 - RNA, 18 nt, Homo sapiens
ugaacucuucaaucucuu

SEQ ID NO: 1871958 - RNA, 16 nt, Homo sapiens
caugcauuacugcaug

SEQ ID NO: 1871959 - RNA, 16 nt, Homo sapiens
cauuagcuacuuuuca

SEQ ID NO: 1871960 - RNA, 15 nt, Homo sapiens
gagguagaggaaaau

SEQ ID NO: 1871961 - RNA, 23 nt, Homo sapiens
uaaugcuuagaauucugagaucc

SEQ ID NO: 1871962 - RNA, 20 nt, Homo sapiens
cuucaggagggagcauagaa

SEQ ID NO: 1871963 - RNA, 14 nt, Homo sapiens
cauccagcugggag

SEQ ID NO: 1871964 - RNA, 23 nt, Homo sapiens
ccuggacaaggcuaacaucccac

SEQ ID NO: 1871965 - RNA, 20 nt, Homo sapiens
cugcacuggcaucuagucaa

SEQ ID NO: 1871966 - RNA, 16 nt, Homo sapiens
acaaugucuggggaca

SEQ ID NO: 1871967 - RNA, 15 nt, Homo sapiens
ugccacacaccuuua

SEQ ID NO: 1871968 - RNA, 20 nt, Homo sapiens
auauugaaaguugcuuuuau

SEQ ID NO: 1871969 - RNA, 17 nt, Homo sapiens
caaaauagucuucucaa

SEQ ID NO: 1871970 - RNA, 23 nt, Homo sapiens
uucaauaaaccuaauaaucugaa

SEQ ID NO: 1871971 - RNA, 19 nt, Homo sapiens
cucaggauauuauguuucu

SEQ ID NO: 1871972 - RNA, 21 nt, Homo sapiens
ugcagucucagagacuauuua

SEQ ID NO: 1871973 - RNA, 18 nt, Homo sapiens
aacauuacuuauuuaacu

SEQ ID NO: 1871974 - RNA, 19 nt, Homo sapiens
uuguaaacguuucaguaau

SEQ ID NO: 1871975 - RNA, 13 nt, Homo sapiens
cugugcauuguag

SEQ ID NO: 1871976 - RNA, 21 nt, Homo sapiens
agacuuugcuaaagacaugaa

SEQ ID NO: 1871977 - RNA, 22 nt, Homo sapiens
aaucccuacagggugucuguca

SEQ ID NO: 1871978 - RNA, 22 nt, Homo sapiens
agggagcuccagaaacuuucca

SEQ ID NO: 1871979 - RNA, 17 nt, Homo sapiens
ccugaguaguaaucuca

SEQ ID NO: 1871980 - RNA, 15 nt, Homo sapiens
gaggcuuuaaaaaga

SEQ ID NO: 1871981 - RNA, 23 nt, Homo sapiens
gaucaagggaauguaacugcuga

SEQ ID NO: 1871982 - RNA, 21 nt, Homo sapiens
ggccugagaugcaggugaugc

SEQ ID NO: 1871983 - RNA, 18 nt, Homo sapiens
uaaagacuuguauagcau

SEQ ID NO: 1871984 - RNA, 13 nt, Homo sapiens
gccugaugacauc

SEQ ID NO: 1871985 - RNA, 13 nt, Homo sapiens
uguccuaugccuc

SEQ ID NO: 1871986 - RNA, 20 nt, Homo sapiens
uaaagaaaaucaaugaagga

SEQ ID NO: 1871987 - RNA, 14 nt, Homo sapiens
gccaccugcugcug

SEQ ID NO: 1871988 - RNA, 17 nt, Homo sapiens
uccccaccccaccucac

SEQ ID NO: 1871989 - RNA, 13 nt, Homo sapiens
aauuucgagauuu

SEQ ID NO: 1871990 - RNA, 16 nt, Homo sapiens
cuuuucaaaugcagca

SEQ ID NO: 1871991 - RNA, 15 nt, Homo sapiens
aucugccacguguau

SEQ ID NO: 1871992 - RNA, 14 nt, Homo sapiens
accccuugcucucu

SEQ ID NO: 1871993 - RNA, 19 nt, Homo sapiens
ugaaugcuauguucuggga

SEQ ID NO: 1871994 - RNA, 19 nt, Homo sapiens
guuaugugauuuuccuuug

SEQ ID NO: 1871995 - RNA, 19 nt, Homo sapiens
acuugaaaagaaaaccaca

SEQ ID NO: 1871996 - RNA, 20 nt, Homo sapiens
cccccagaacauacacugug

SEQ ID NO: 1871997 - RNA, 17 nt, Homo sapiens
cuucccaguucuugacc

SEQ ID NO: 1871998 - RNA, 13 nt, Homo sapiens
aucuuacuugagc

SEQ ID NO: 1871999 - RNA, 11 nt, Homo sapiens
ugucugcuacc

SEQ ID NO: 1872000 - RNA, 15 nt, Homo sapiens
cacucccagugcuug

SEQ ID NO: 1872001 - RNA, 15 nt, Homo sapiens
ucaggaacuaaccua

SEQ ID NO: 1872002 - RNA, 14 nt, Homo sapiens
gucaguacuauuca

SEQ ID NO: 1872003 - RNA, 13 nt, Homo sapiens
aucaaaugcugua

SEQ ID NO: 1872004 - RNA, 21 nt, Homo sapiens
caaugagauuccaguuuacaa

SEQ ID NO: 1872005 - RNA, 17 nt, Homo sapiens
cuuucugcuuacaaaga

SEQ ID NO: 1872006 - RNA, 20 nt, Homo sapiens
auauugcagcuuauauucau

SEQ ID NO: 1872007 - RNA, 14 nt, Homo sapiens
uaaaagaugcagag

SEQ ID NO: 1872008 - RNA, 17 nt, Homo sapiens
auaaucuucaggugaaa

SEQ ID NO: 1872009 - RNA, 16 nt, Homo sapiens
ucuugaggcauuucca

SEQ ID NO: 1872010 - RNA, 17 nt, Homo sapiens
acauaauuucaguggga

SEQ ID NO: 1872011 - RNA, 19 nt, Homo sapiens
cuuuauacacaguggauug

SEQ ID NO: 1872012 - RNA, 20 nt, Homo sapiens
cagggcccugagcucggugg

SEQ ID NO: 1872013 - RNA, 15 nt, Homo sapiens
ugaacacacauugcu

SEQ ID NO: 1872014 - RNA, 13 nt, Homo sapiens
ugcccaacugccu

SEQ ID NO: 1872015 - RNA, 15 nt, Homo sapiens
gaugucaggcccaga

SEQ ID NO: 1872016 - RNA, 23 nt, Homo sapiens
aucaauaaauacuuuaacuucca

SEQ ID NO: 1872017 - RNA, 20 nt, Homo sapiens
agagugauaggacauucuau

SEQ ID NO: 1872018 - RNA, 18 nt, Homo sapiens
acccauucuacacagagc

SEQ ID NO: 1872019 - RNA, 23 nt, Homo sapiens
gugaaaucccaucugcauuugau

SEQ ID NO: 1872020 - RNA, 16 nt, Homo sapiens
uaacuagaguaugugu

SEQ ID NO: 1872021 - RNA, 13 nt, Homo sapiens
uuugguaauguua

SEQ ID NO: 1872022 - RNA, 14 nt, Homo sapiens
uugagaacugacaa

SEQ ID NO: 1872023 - RNA, 14 nt, Homo sapiens
cagcagaacaugug

SEQ ID NO: 1872024 - RNA, 14 nt, Homo sapiens
gccagccccacaca

SEQ ID NO: 1872025 - RNA, 17 nt, Homo sapiens
cccauaucugugaaaug

SEQ ID NO: 1872026 - RNA, 15 nt, Homo sapiens
gaggcgcaggcgacc

SEQ ID NO: 1872027 - RNA, 21 nt, Homo sapiens
uccucaaaucagucuuccuug

SEQ ID NO: 1872028 - RNA, 14 nt, Homo sapiens
aauugccugaacau

SEQ ID NO: 1872029 - RNA, 19 nt, Homo sapiens
uccauugcauucauguacu

SEQ ID NO: 1872030 - RNA, 15 nt, Homo sapiens
ggacgaugagacuuu

SEQ ID NO: 1872031 - RNA, 19 nt, Homo sapiens
ccuggauccucaguucuca

SEQ ID NO: 1872032 - RNA, 12 nt, Homo sapiens
uuuaugcugcug

SEQ ID NO: 1872033 - RNA, 12 nt, Homo sapiens
cuaucuuuauga

SEQ ID NO: 1872034 - RNA, 12 nt, Homo sapiens
auaaucuuaucu

SEQ ID NO: 1872035 - RNA, 17 nt, Homo sapiens
uauaucaaucucucuua

SEQ ID NO: 1872036 - RNA, 19 nt, Homo sapiens
ggccccucuuauuccucua

SEQ ID NO: 1872037 - RNA, 13 nt, Homo sapiens
cuacucuauguau

SEQ ID NO: 1872038 - RNA, 20 nt, Homo sapiens
auauaauccuaccagaagga

SEQ ID NO: 1872039 - RNA, 15 nt, Homo sapiens
ccguuccagagggaa

SEQ ID NO: 1872040 - RNA, 18 nt, Homo sapiens
agugucucuugacuggcu

SEQ ID NO: 1872041 - RNA, 22 nt, Homo sapiens
cucacauucauuaauauaugga

SEQ ID NO: 1872042 - RNA, 13 nt, Homo sapiens
agaaguaugggaa

SEQ ID NO: 1872043 - RNA, 21 nt, Homo sapiens
caugccuuucauaguuuauua

SEQ ID NO: 1872044 - RNA, 16 nt, Homo sapiens
ccugccaucuucccag

SEQ ID NO: 1872045 - RNA, 23 nt, Homo sapiens
gccagggaaagcccgugucaaug

SEQ ID NO: 1872046 - RNA, 20 nt, Homo sapiens
gucuuggccucccaaagugc

SEQ ID NO: 1872047 - RNA, 20 nt, Homo sapiens
gagcuuauuacuuauuugug

SEQ ID NO: 1872048 - RNA, 14 nt, Homo sapiens
uaaaauacauaaua

SEQ ID NO: 1872049 - RNA, 14 nt, Homo sapiens
uccuuucugugcau

SEQ ID NO: 1872050 - RNA, 23 nt, Homo sapiens
ucuugugaaggggucaccccagc

SEQ ID NO: 1872051 - RNA, 24 nt, Homo sapiens
cauccuuaaaacaauucugugaca

SEQ ID NO: 1872052 - RNA, 14 nt, Homo sapiens
auaguuagauucca

SEQ ID NO: 1872053 - RNA, 14 nt, Homo sapiens
gcagugugucacac

SEQ ID NO: 1872054 - RNA, 15 nt, Homo sapiens
auugaauuucacugu

SEQ ID NO: 1872055 - RNA, 18 nt, Homo sapiens
cuaucugagugaauuaca

SEQ ID NO: 1872056 - RNA, 20 nt, Homo sapiens
ugccugucaggaccauuuua

SEQ ID NO: 1872057 - RNA, 22 nt, Homo sapiens
ugaaggguggucaguaguuuca

SEQ ID NO: 1872058 - RNA, 14 nt, Homo sapiens
ugauuucucuccca

SEQ ID NO: 1872059 - RNA, 21 nt, Homo sapiens
ugagaacaagucacagcugca

SEQ ID NO: 1872060 - RNA, 18 nt, Homo sapiens
acuaagguggacagcaga

SEQ ID NO: 1872061 - RNA, 18 nt, Homo sapiens
agaacaguacuccacaaa

SEQ ID NO: 1872062 - RNA, 16 nt, Homo sapiens
aauuagucaaaccacu

SEQ ID NO: 1872063 - RNA, 15 nt, Homo sapiens
aacuuugccucaaga

SEQ ID NO: 1872064 - RNA, 13 nt, Homo sapiens
uauugaguucuga

SEQ ID NO: 1872065 - RNA, 13 nt, Homo sapiens
gcagaagugaaug

SEQ ID NO: 1872066 - RNA, 16 nt, Homo sapiens
auagacugaagauuua

SEQ ID NO: 1872067 - RNA, 23 nt, Homo sapiens
auuauauaaagggugacuuacau

SEQ ID NO: 1872068 - RNA, 16 nt, Homo sapiens
acaccaaaaaugaugc

SEQ ID NO: 1872069 - RNA, 18 nt, Homo sapiens
ugcuuuugaggaacauua

SEQ ID NO: 1872070 - RNA, 14 nt, Homo sapiens
aggauugcuucaau

SEQ ID NO: 1872071 - RNA, 18 nt, Homo sapiens
gaccuugaugagcugugc

SEQ ID NO: 1872072 - RNA, 20 nt, Homo sapiens
uuaagugaaaggucacacua

SEQ ID NO: 1872073 - RNA, 16 nt, Homo sapiens
ucauccagaacuacca

SEQ ID NO: 1872074 - RNA, 13 nt, Homo sapiens
caauauagucuuu

SEQ ID NO: 1872075 - RNA, 17 nt, Homo sapiens
cugaggguggcacucaa

SEQ ID NO: 1872076 - RNA, 24 nt, Homo sapiens
ggaaucgguggucuccaccuguca

SEQ ID NO: 1872077 - RNA, 16 nt, Homo sapiens
aguaaucuguguacaa

SEQ ID NO: 1872078 - RNA, 19 nt, Homo sapiens
gagaagccaggaggccugc

SEQ ID NO: 1872079 - RNA, 17 nt, Homo sapiens
cuaagguucagccugaa

SEQ ID NO: 1872080 - RNA, 21 nt, Homo sapiens
uucuuaagugcccacauuuga

SEQ ID NO: 1872081 - RNA, 17 nt, Homo sapiens
uagaaacuauuggugcu

SEQ ID NO: 1872082 - RNA, 19 nt, Homo sapiens
cuggcccugcccugaggaa

SEQ ID NO: 1872083 - RNA, 18 nt, Homo sapiens
uugcugguagcacuugcu

SEQ ID NO: 1872084 - RNA, 20 nt, Homo sapiens
ucucaucacauuuguaaaug

SEQ ID NO: 1872085 - RNA, 20 nt, Homo sapiens
aagauaaguguguuugcaaa

SEQ ID NO: 1872086 - RNA, 20 nt, Homo sapiens
gcgugacacucuccuugcag

SEQ ID NO: 1872087 - RNA, 16 nt, Homo sapiens
auuggagauuaaucua

SEQ ID NO: 1872088 - RNA, 21 nt, Homo sapiens
aggacuuucauuguucuuggc

SEQ ID NO: 1872089 - RNA, 14 nt, Homo sapiens
uacuauucacugau

SEQ ID NO: 1872090 - RNA, 21 nt, Homo sapiens
cuauuaaaagaauccaaauuc

SEQ ID NO: 1872091 - RNA, 21 nt, Homo sapiens
cuuaaaaaguggcguuguuca

SEQ ID NO: 1872092 - RNA, 20 nt, Homo sapiens
guccuugaguccccaccagc

SEQ ID NO: 1872093 - RNA, 19 nt, Homo sapiens
aauguauuggcacagugcu

SEQ ID NO: 1872094 - RNA, 15 nt, Homo sapiens
aagacacaaaugcau

SEQ ID NO: 1872095 - RNA, 15 nt, Homo sapiens
caaccagagcacugu

SEQ ID NO: 1872096 - RNA, 19 nt, Homo sapiens
acauuuucaguaccaaaga

SEQ ID NO: 1872097 - RNA, 13 nt, Homo sapiens
aacaucaguuucu

SEQ ID NO: 1872098 - RNA, 18 nt, Homo sapiens
aagcugcacaugugccac

SEQ ID NO: 1872099 - RNA, 18 nt, Homo sapiens
caugucuauuuuugauga

SEQ ID NO: 1872100 - RNA, 20 nt, Homo sapiens
acuuuggaacacuacucuua

SEQ ID NO: 1872101 - RNA, 19 nt, Homo sapiens
accaauguaacacuggcca

SEQ ID NO: 1872102 - RNA, 21 nt, Homo sapiens
ugggagaaauugacagaucaa

SEQ ID NO: 1872103 - RNA, 19 nt, Homo sapiens
cuggggccuagcgaucucu

SEQ ID NO: 1872104 - RNA, 22 nt, Homo sapiens
uacugaacauaguagauugaca

SEQ ID NO: 1872105 - RNA, 22 nt, Homo sapiens
cggucauuugaaugagaccugg

SEQ ID NO: 1872106 - RNA, 16 nt, Homo sapiens
gcauaccaaguugaua

SEQ ID NO: 1872107 - RNA, 21 nt, Homo sapiens
ugcacuaggucaaaacauuca

SEQ ID NO: 1872108 - RNA, 18 nt, Homo sapiens
aucaauuauuacauuuau

SEQ ID NO: 1872109 - RNA, 14 nt, Homo sapiens
ucuuuggauuugau

SEQ ID NO: 1872110 - RNA, 15 nt, Homo sapiens
cuuucugguuauuau

SEQ ID NO: 1872111 - RNA, 22 nt, Homo sapiens
ccuuuuccccaaccacagagaa

SEQ ID NO: 1872112 - RNA, 23 nt, Homo sapiens
cagggcuggaaaagucacacaga

SEQ ID NO: 1872113 - RNA, 16 nt, Homo sapiens
ugauguccucucucag

SEQ ID NO: 1872114 - RNA, 23 nt, Homo sapiens
guucucaaaguuaauucaccuau

SEQ ID NO: 1872115 - RNA, 21 nt, Homo sapiens
gucucuugugacucagcagag

SEQ ID NO: 1872116 - RNA, 17 nt, Homo sapiens
uaguugacuaaugaggc

SEQ ID NO: 1872117 - RNA, 17 nt, Homo sapiens
cuugcaguuaaggguua

SEQ ID NO: 1872118 - RNA, 16 nt, Homo sapiens
auuaacugaacuuaau

SEQ ID NO: 1872119 - RNA, 19 nt, Homo sapiens
aauauuccaggaugcugcu

SEQ ID NO: 1872120 - RNA, 17 nt, Homo sapiens
cugcagugccacuaaaa

SEQ ID NO: 1872121 - RNA, 15 nt, Homo sapiens
guauuuuuauagcca

SEQ ID NO: 1872122 - RNA, 17 nt, Homo sapiens
acugcauuuacagugua

SEQ ID NO: 1872123 - RNA, 22 nt, Homo sapiens
cagauauauagaaggacugcag

SEQ ID NO: 1872124 - RNA, 14 nt, Homo sapiens
aagcaaagcacaga

SEQ ID NO: 1872125 - RNA, 17 nt, Homo sapiens
ccagcaacauugaccca

SEQ ID NO: 1872126 - RNA, 20 nt, Homo sapiens
ggcuugaccaggcuuggccu

SEQ ID NO: 1872127 - RNA, 16 nt, Homo sapiens
acagguuggaucucac

SEQ ID NO: 1872128 - RNA, 16 nt, Homo sapiens
auauuuuaaagcacuu

SEQ ID NO: 1872129 - RNA, 15 nt, Homo sapiens
uugcuggcugugaaa

SEQ ID NO: 1872130 - RNA, 14 nt, Homo sapiens
gcaacuuccuuuga

SEQ ID NO: 1872131 - RNA, 15 nt, Homo sapiens
uagguuaacuaugua

SEQ ID NO: 1872132 - RNA, 22 nt, Homo sapiens
ugaggcagacagcagcucaggc

SEQ ID NO: 1872133 - RNA, 15 nt, Homo sapiens
gacacccagugccag

SEQ ID NO: 1872134 - RNA, 11 nt, Homo sapiens
ugcaucucauu

SEQ ID NO: 1872135 - RNA, 14 nt, Homo sapiens
uaauugcaugacaa

SEQ ID NO: 1872136 - RNA, 19 nt, Homo sapiens
ucaaggaagugauaacacu

SEQ ID NO: 1872137 - RNA, 18 nt, Homo sapiens
uccugggacacuccgucu

SEQ ID NO: 1872138 - RNA, 23 nt, Homo sapiens
gcagagccaccagggcacugucu

SEQ ID NO: 1872139 - RNA, 14 nt, Homo sapiens
gagcaaguccuucc

SEQ ID NO: 1872140 - RNA, 23 nt, Homo sapiens
aucuguaacaauuauguuuucag

SEQ ID NO: 1872141 - RNA, 19 nt, Homo sapiens
cagguccucuacuuaauga

SEQ ID NO: 1872142 - RNA, 22 nt, Homo sapiens
ugucuacaccauuaugugcgcu

SEQ ID NO: 1872143 - RNA, 16 nt, Homo sapiens
agccacugacuugcuc

SEQ ID NO: 1872144 - RNA, 20 nt, Homo sapiens
gcccagaagaaaauucuccu

SEQ ID NO: 1872145 - RNA, 14 nt, Homo sapiens
agcaugagugccgu

SEQ ID NO: 1872146 - RNA, 15 nt, Homo sapiens
aaaggaaaagucaac

SEQ ID NO: 1872147 - RNA, 14 nt, Homo sapiens
gaagcacuucugcu

SEQ ID NO: 1872148 - RNA, 17 nt, Homo sapiens
aggacagggcugagcgu

SEQ ID NO: 1872149 - RNA, 17 nt, Homo sapiens
cagauugaacaagagcu

SEQ ID NO: 1872150 - RNA, 19 nt, Homo sapiens
cagcccgugcacccuggaa

SEQ ID NO: 1872151 - RNA, 19 nt, Homo sapiens
ccacaugggugcauuugua

SEQ ID NO: 1872152 - RNA, 16 nt, Homo sapiens
cagcaucaaacaugaa

SEQ ID NO: 1872153 - RNA, 12 nt, Homo sapiens
uuucccaggacg

SEQ ID NO: 1872154 - RNA, 17 nt, Homo sapiens
gacuccugccgcaguga

SEQ ID NO: 1872155 - RNA, 21 nt, Homo sapiens
acauauggaaauguuacuguc

SEQ ID NO: 1872156 - RNA, 14 nt, Homo sapiens
cugaaaaagacaua

SEQ ID NO: 1872157 - RNA, 22 nt, Homo sapiens
uuccauaguuaaagaagacauu

SEQ ID NO: 1872158 - RNA, 22 nt, Homo sapiens
ugguaagacugcugguugacau

SEQ ID NO: 1872159 - RNA, 19 nt, Homo sapiens
ucuucuacaugcaauuuag

SEQ ID NO: 1872160 - RNA, 15 nt, Homo sapiens
aggaacuuuccagca

SEQ ID NO: 1872161 - RNA, 18 nt, Homo sapiens
cauucagguauagcugac

SEQ ID NO: 1872162 - RNA, 14 nt, Homo sapiens
uaagugcugcuaua

SEQ ID NO: 1872163 - RNA, 14 nt, Homo sapiens
cacuugaaccuggg

SEQ ID NO: 1872164 - RNA, 14 nt, Homo sapiens
ccugugaacacugg

SEQ ID NO: 1872165 - RNA, 15 nt, Homo sapiens
agauggaaugcugug

SEQ ID NO: 1872166 - RNA, 16 nt, Homo sapiens
uuuaccuugcauuuua

SEQ ID NO: 1872167 - RNA, 11 nt, Homo sapiens
uuucucaaggg

SEQ ID NO: 1872168 - RNA, 22 nt, Homo sapiens
uauauauacauacacuuguaua

SEQ ID NO: 1872169 - RNA, 13 nt, Homo sapiens
acugccuuugcag

SEQ ID NO: 1872170 - RNA, 19 nt, Homo sapiens
cuuuucggucuuucccauu

SEQ ID NO: 1872171 - RNA, 21 nt, Homo sapiens
uccagaaagaaggacacuugu

SEQ ID NO: 1872172 - RNA, 21 nt, Homo sapiens
ucugagagugaaaccaugacu

SEQ ID NO: 1872173 - RNA, 13 nt, Homo sapiens
acugguccaucug

SEQ ID NO: 1872174 - RNA, 19 nt, Homo sapiens
caauaaaauagcaauccua

SEQ ID NO: 1872175 - RNA, 23 nt, Homo sapiens
aaguguguugaugaccacugagc

SEQ ID NO: 1872176 - RNA, 22 nt, Homo sapiens
cagccacgagacgucaccaaga

SEQ ID NO: 1872177 - RNA, 13 nt, Homo sapiens
cacccaagcacaa

SEQ ID NO: 1872178 - RNA, 19 nt, Homo sapiens
ccauauuaacaaauugcau

SEQ ID NO: 1872179 - RNA, 21 nt, Homo sapiens
cuucaaauaaacaugucugcc

SEQ ID NO: 1872180 - RNA, 21 nt, Homo sapiens
aagacaauuuuaauguuuaca

SEQ ID NO: 1872181 - RNA, 21 nt, Homo sapiens
aagacaauuugauacauaaua

SEQ ID NO: 1872182 - RNA, 23 nt, Homo sapiens
ucauagaaauaccucauucgccu

SEQ ID NO: 1872183 - RNA, 22 nt, Homo sapiens
auaaaacaguguuuccagugac

SEQ ID NO: 1872184 - RNA, 15 nt, Homo sapiens
augcccgcccgggga

SEQ ID NO: 1872185 - RNA, 18 nt, Homo sapiens
auuaauagcuuuugauua

SEQ ID NO: 1872186 - RNA, 21 nt, Homo sapiens
cgagcuguuuacagugaugcc

SEQ ID NO: 1872187 - RNA, 15 nt, Homo sapiens
cagaugcccccguga

SEQ ID NO: 1872188 - RNA, 17 nt, Homo sapiens
auauauguccuauucau

SEQ ID NO: 1872189 - RNA, 18 nt, Homo sapiens
aggauggcaaagagaguc

SEQ ID NO: 1872190 - RNA, 14 nt, Homo sapiens
agggcgccuagucc

SEQ ID NO: 1872191 - RNA, 14 nt, Homo sapiens
cggccgacugccug

SEQ ID NO: 1872192 - RNA, 17 nt, Homo sapiens
caugugaaaucauucau

SEQ ID NO: 1872193 - RNA, 23 nt, Homo sapiens
cauuuuaacuggcaugucauuug

SEQ ID NO: 1872194 - RNA, 13 nt, Homo sapiens
auguuugcaaugu

SEQ ID NO: 1872195 - RNA, 16 nt, Homo sapiens
uggggaaugcucccag

SEQ ID NO: 1872196 - RNA, 18 nt, Homo sapiens
agcauaaaacuuuggcaa

SEQ ID NO: 1872197 - RNA, 14 nt, Homo sapiens
cuuuuccuccauga

SEQ ID NO: 1872198 - RNA, 18 nt, Homo sapiens
ccucaacccucucaaguc

SEQ ID NO: 1872199 - RNA, 22 nt, Homo sapiens
ugcccguaaaaccugagccauu

SEQ ID NO: 1872200 - RNA, 24 nt, Homo sapiens
ggaugguugggaccagauugacua

SEQ ID NO: 1872201 - RNA, 20 nt, Homo sapiens
gcuuccuacccacaccucug

SEQ ID NO: 1872202 - RNA, 18 nt, Homo sapiens
agaagaccagauccaaga

SEQ ID NO: 1872203 - RNA, 16 nt, Homo sapiens
uccucacugggcucac

SEQ ID NO: 1872204 - RNA, 18 nt, Homo sapiens
gccuguguccaucugacc

SEQ ID NO: 1872205 - RNA, 18 nt, Homo sapiens
uccuuucuaaauugcaug

SEQ ID NO: 1872206 - RNA, 12 nt, Homo sapiens
uacucucaggca

SEQ ID NO: 1872207 - RNA, 12 nt, Homo sapiens
uacacucaggcu

SEQ ID NO: 1872208 - RNA, 15 nt, Homo sapiens
guauuaucaccagca

SEQ ID NO: 1872209 - RNA, 14 nt, Homo sapiens
acacuuaaugauac

SEQ ID NO: 1872210 - RNA, 19 nt, Homo sapiens
uugcccuggauuguugaca

SEQ ID NO: 1872211 - RNA, 13 nt, Homo sapiens
uccaacccgggga

SEQ ID NO: 1872212 - RNA, 21 nt, Homo sapiens
ggaagcuuuuguuauguauuu

SEQ ID NO: 1872213 - RNA, 14 nt, Homo sapiens
aagaauuacuugug

SEQ ID NO: 1872214 - RNA, 16 nt, Homo sapiens
auuguaugaaguuuga

SEQ ID NO: 1872215 - RNA, 17 nt, Homo sapiens
acauacauauuaucuca

SEQ ID NO: 1872216 - RNA, 19 nt, Homo sapiens
gauuuaaagcaucaucugu

SEQ ID NO: 1872217 - RNA, 15 nt, Homo sapiens
aggccugcuggcauc

SEQ ID NO: 1872218 - RNA, 21 nt, Homo sapiens
ccccacaggcuggcgcucggc

SEQ ID NO: 1872219 - RNA, 21 nt, Homo sapiens
acguucagaggugcagcugga

SEQ ID NO: 1872220 - RNA, 14 nt, Homo sapiens
gaccuguugggagu

SEQ ID NO: 1872221 - RNA, 16 nt, Homo sapiens
acaaguagauugaucu

SEQ ID NO: 1872222 - RNA, 21 nt, Homo sapiens
cggagacuuucaaacauauau

SEQ ID NO: 1872223 - RNA, 22 nt, Homo sapiens
uauaacucuccuuugcucucug

SEQ ID NO: 1872224 - RNA, 20 nt, Homo sapiens
accuggaaucuacaagccaa

SEQ ID NO: 1872225 - RNA, 17 nt, Homo sapiens
aagacacaggcauggcu

SEQ ID NO: 1872226 - RNA, 18 nt, Homo sapiens
cacugacauuauaucaug

SEQ ID NO: 1872227 - RNA, 17 nt, Homo sapiens
aaacucuuuuucaucca

SEQ ID NO: 1872228 - RNA, 15 nt, Homo sapiens
ggccaacacuguggg

SEQ ID NO: 1872229 - RNA, 23 nt, Homo sapiens
uagaaagaaauuguuuuucugaa

SEQ ID NO: 1872230 - RNA, 13 nt, Homo sapiens
cugaauugcacau

SEQ ID NO: 1872231 - RNA, 17 nt, Homo sapiens
aaaagaggccuguucau

SEQ ID NO: 1872232 - RNA, 20 nt, Homo sapiens
acacacucugagucucugaa

SEQ ID NO: 1872233 - RNA, 18 nt, Homo sapiens
gaagggaaggaagcaagc

SEQ ID NO: 1872234 - RNA, 16 nt, Homo sapiens
gcuuaccaaaguauua

SEQ ID NO: 1872235 - RNA, 15 nt, Homo sapiens
aggcaagaguagggu

SEQ ID NO: 1872236 - RNA, 14 nt, Homo sapiens
uugauucuaugacu

SEQ ID NO: 1872237 - RNA, 15 nt, Homo sapiens
ugguccaacugcaac

SEQ ID NO: 1872238 - RNA, 15 nt, Homo sapiens
uuuaaacucagggac

SEQ ID NO: 1872239 - RNA, 13 nt, Homo sapiens
ccccaugaacucu

SEQ ID NO: 1872240 - RNA, 15 nt, Homo sapiens
auucuuagugacuuu

SEQ ID NO: 1872241 - RNA, 15 nt, Homo sapiens
ggggguucuguuuca

SEQ ID NO: 1872242 - RNA, 18 nt, Homo sapiens
gcugcauuuuacacaugu

SEQ ID NO: 1872243 - RNA, 23 nt, Homo sapiens
auauccaagaagcaugcagagaa

SEQ ID NO: 1872244 - RNA, 17 nt, Homo sapiens
ucccugaaggccuucaa

SEQ ID NO: 1872245 - RNA, 13 nt, Homo sapiens
gaaaccuaaaugu

SEQ ID NO: 1872246 - RNA, 12 nt, Homo sapiens
aauucagacuug

SEQ ID NO: 1872247 - RNA, 16 nt, Homo sapiens
cagcuuucugggaugu

SEQ ID NO: 1872248 - RNA, 21 nt, Homo sapiens
aauucuuucccagucugucga

SEQ ID NO: 1872249 - RNA, 22 nt, Homo sapiens
auacaauauggacauguaaaaa

SEQ ID NO: 1872250 - RNA, 19 nt, Homo sapiens
uauaguugguacacaacua

SEQ ID NO: 1872251 - RNA, 19 nt, Homo sapiens
uucccugaaaccguuaaaa

SEQ ID NO: 1872252 - RNA, 15 nt, Homo sapiens
cucugaaugaagcug

SEQ ID NO: 1872253 - RNA, 15 nt, Homo sapiens
uagagcuagcugcca

SEQ ID NO: 1872254 - RNA, 21 nt, Homo sapiens
ugacucucgugcauuucaacu

SEQ ID NO: 1872255 - RNA, 13 nt, Homo sapiens
uauuauaagcauu

SEQ ID NO: 1872256 - RNA, 22 nt, Homo sapiens
acccgagggacagcagauucca

SEQ ID NO: 1872257 - RNA, 23 nt, Homo sapiens
gaagugcuguuuuauuacuguuu

SEQ ID NO: 1872258 - RNA, 16 nt, Homo sapiens
ucuggcccuucuugcc

SEQ ID NO: 1872259 - RNA, 18 nt, Homo sapiens
uccucaaauaagucuucc

SEQ ID NO: 1872260 - RNA, 15 nt, Homo sapiens
cagugcucaccagcc

SEQ ID NO: 1872261 - RNA, 20 nt, Homo sapiens
cuuagaaaccaaauuacaag

SEQ ID NO: 1872262 - RNA, 22 nt, Homo sapiens
aaaauuuugggguaaaaaggag

SEQ ID NO: 1872263 - RNA, 21 nt, Homo sapiens
ccagugugcaagggcagugaa

SEQ ID NO: 1872264 - RNA, 15 nt, Homo sapiens
aaguuucaaugugau

SEQ ID NO: 1872265 - RNA, 15 nt, Homo sapiens
aaugugguuuguaca

SEQ ID NO: 1872266 - RNA, 13 nt, Homo sapiens
cuuuccuucucua

SEQ ID NO: 1872267 - RNA, 22 nt, Homo sapiens
uuugagauaaagucaaaugcca

SEQ ID NO: 1872268 - RNA, 13 nt, Homo sapiens
aaagauacuagag

SEQ ID NO: 1872269 - RNA, 21 nt, Homo sapiens
guacugcaagaaggagcucag

SEQ ID NO: 1872270 - RNA, 22 nt, Homo sapiens
ccaaagugcugagauuacaggu

SEQ ID NO: 1872271 - RNA, 18 nt, Homo sapiens
auucuucaaccucauuga

SEQ ID NO: 1872272 - RNA, 16 nt, Homo sapiens
auacacgaauagacau

SEQ ID NO: 1872273 - RNA, 16 nt, Homo sapiens
ccccacuucucuacuc

SEQ ID NO: 1872274 - RNA, 21 nt, Homo sapiens
gcugagugcacuccuggugau

SEQ ID NO: 1872275 - RNA, 16 nt, Homo sapiens
auacacauacauacac

SEQ ID NO: 1872276 - RNA, 17 nt, Homo sapiens
cguugcccccagacuuc

SEQ ID NO: 1872277 - RNA, 17 nt, Homo sapiens
ggacacuuuuauguuaa

SEQ ID NO: 1872278 - RNA, 16 nt, Homo sapiens
uuagcgucaagacauu

SEQ ID NO: 1872279 - RNA, 11 nt, Homo sapiens
agagugugagc

SEQ ID NO: 1872280 - RNA, 23 nt, Homo sapiens
gaaucuaagugggagacaauauu

SEQ ID NO: 1872281 - RNA, 14 nt, Homo sapiens
gacagcccuuccuc

SEQ ID NO: 1872282 - RNA, 22 nt, Homo sapiens
cuuuuaaagccagaagucacau

SEQ ID NO: 1872283 - RNA, 23 nt, Homo sapiens
uuguuuuuaaacaauaaagcaau

SEQ ID NO: 1872284 - RNA, 18 nt, Homo sapiens
uuacuaugugccaguucc

SEQ ID NO: 1872285 - RNA, 21 nt, Homo sapiens
agaaaauaacgauaaaagaca

SEQ ID NO: 1872286 - RNA, 14 nt, Homo sapiens
uauuguucacuuua

SEQ ID NO: 1872287 - RNA, 14 nt, Homo sapiens
gcacugugcuaaua

SEQ ID NO: 1872288 - RNA, 22 nt, Homo sapiens
aguguugugccccuucacucau

SEQ ID NO: 1872289 - RNA, 21 nt, Homo sapiens
ccuugaugggucaaccuuugu

SEQ ID NO: 1872290 - RNA, 18 nt, Homo sapiens
gccacaccugagcgcugu

SEQ ID NO: 1872291 - RNA, 15 nt, Homo sapiens
gauugguucaugccu

SEQ ID NO: 1872292 - RNA, 13 nt, Homo sapiens
aaagaaucucaag

SEQ ID NO: 1872293 - RNA, 18 nt, Homo sapiens
ugugguggccgugccuga

SEQ ID NO: 1872294 - RNA, 12 nt, Homo sapiens
augugugcucac

SEQ ID NO: 1872295 - RNA, 17 nt, Homo sapiens
acuguugcuuuagucac

SEQ ID NO: 1872296 - RNA, 20 nt, Homo sapiens
guuacuguggccaguauuuu

SEQ ID NO: 1872297 - RNA, 23 nt, Homo sapiens
gccguuugagaagaaaacaucua

SEQ ID NO: 1872298 - RNA, 23 nt, Homo sapiens
ugaaaaaauacccucugacugua

SEQ ID NO: 1872299 - RNA, 14 nt, Homo sapiens
acaacuaaauaacu

SEQ ID NO: 1872300 - RNA, 21 nt, Homo sapiens
augucauagaagaaaauccau

SEQ ID NO: 1872301 - RNA, 18 nt, Homo sapiens
uucugcauguucuaaaua

SEQ ID NO: 1872302 - RNA, 21 nt, Homo sapiens
ucuuccaacguggcccagaga

SEQ ID NO: 1872303 - RNA, 18 nt, Homo sapiens
gcuagacaagcuugucca

SEQ ID NO: 1872304 - RNA, 17 nt, Homo sapiens
uagcugaguaugcugaa

SEQ ID NO: 1872305 - RNA, 21 nt, Homo sapiens
aggcaggcagcugccugcucu

SEQ ID NO: 1872306 - RNA, 19 nt, Homo sapiens
agaacaagcacuguggaac

SEQ ID NO: 1872307 - RNA, 12 nt, Homo sapiens
aacacuccucua

SEQ ID NO: 1872308 - RNA, 21 nt, Homo sapiens
ugguucucacugccuccuaca

SEQ ID NO: 1872309 - RNA, 21 nt, Homo sapiens
ugaaacaagcaacagauggau

SEQ ID NO: 1872310 - RNA, 21 nt, Homo sapiens
aggugaagguaugagaauuaa

SEQ ID NO: 1872311 - RNA, 14 nt, Homo sapiens
agaaggccaggaaa

SEQ ID NO: 1872312 - RNA, 12 nt, Homo sapiens
guauaucagcuc

SEQ ID NO: 1872313 - RNA, 13 nt, Homo sapiens
uacaaaguuucaa

SEQ ID NO: 1872314 - RNA, 18 nt, Homo sapiens
gccuauaauacuugcaac

SEQ ID NO: 1872315 - RNA, 22 nt, Homo sapiens
ugggucccuccucucaccucuc

SEQ ID NO: 1872316 - RNA, 14 nt, Homo sapiens
caggugggugcugc

SEQ ID NO: 1872317 - RNA, 16 nt, Homo sapiens
accuaaaccaccagug

SEQ ID NO: 1872318 - RNA, 17 nt, Homo sapiens
aaagucuaaaaccuuaa

SEQ ID NO: 1872319 - RNA, 15 nt, Homo sapiens
uccaccuuguuacac

SEQ ID NO: 1872320 - RNA, 18 nt, Homo sapiens
aggcagcugauccaggca

SEQ ID NO: 1872321 - RNA, 17 nt, Homo sapiens
guaaaggaaacauauuu

SEQ ID NO: 1872322 - RNA, 19 nt, Homo sapiens
uggcuuaaugcuucuuuca

SEQ ID NO: 1872323 - RNA, 24 nt, Homo sapiens
uuaaauuccaaacuaugacuacua

SEQ ID NO: 1872324 - RNA, 22 nt, Homo sapiens
gccccacucccuggccaucuca

SEQ ID NO: 1872325 - RNA, 16 nt, Homo sapiens
uccuguuccugccaca

SEQ ID NO: 1872326 - RNA, 18 nt, Homo sapiens
uacaacuugcauauguca

SEQ ID NO: 1872327 - RNA, 22 nt, Homo sapiens
cauagcaacuccccuacaucaa

SEQ ID NO: 1872328 - RNA, 22 nt, Homo sapiens
uccuauuuauaagagugccgua

SEQ ID NO: 1872329 - RNA, 23 nt, Homo sapiens
cuuuuuaaauccuaaaaaacacu

SEQ ID NO: 1872330 - RNA, 22 nt, Homo sapiens
ggaugucuccaucucugucuca

SEQ ID NO: 1872331 - RNA, 18 nt, Homo sapiens
aaggccucauccuccacu

SEQ ID NO: 1872332 - RNA, 20 nt, Homo sapiens
ccuccuuuagaguugcauga

SEQ ID NO: 1872333 - RNA, 17 nt, Homo sapiens
aauaccagaucacucaa

SEQ ID NO: 1872334 - RNA, 14 nt, Homo sapiens
aaugacaucuucaa

SEQ ID NO: 1872335 - RNA, 16 nt, Homo sapiens
auacagaugacaaugg

SEQ ID NO: 1872336 - RNA, 19 nt, Homo sapiens
aagugacugaaaauggcau

SEQ ID NO: 1872337 - RNA, 20 nt, Homo sapiens
agugggagcugaguggggga

SEQ ID NO: 1872338 - RNA, 22 nt, Homo sapiens
uuccaguuauuuauuuccaaaa

SEQ ID NO: 1872339 - RNA, 16 nt, Homo sapiens
ccuuaugaccagugag

SEQ ID NO: 1872340 - RNA, 15 nt, Homo sapiens
acugauaucuggccu

SEQ ID NO: 1872341 - RNA, 11 nt, Homo sapiens
aauauuaacau

SEQ ID NO: 1872342 - RNA, 21 nt, Homo sapiens
aacaggcugauaccuuuguga

SEQ ID NO: 1872343 - RNA, 19 nt, Homo sapiens
uccgguuggaggcucucau

SEQ ID NO: 1872344 - RNA, 15 nt, Homo sapiens
ugucaugacuuucag

SEQ ID NO: 1872345 - RNA, 19 nt, Homo sapiens
auaaauuuguaacuuugca

SEQ ID NO: 1872346 - RNA, 15 nt, Homo sapiens
cagccugcuccagcu

SEQ ID NO: 1872347 - RNA, 16 nt, Homo sapiens
aggugggaaaugguau

SEQ ID NO: 1872348 - RNA, 19 nt, Homo sapiens
uaauuguaaacuaguacua

SEQ ID NO: 1872349 - RNA, 15 nt, Homo sapiens
ucauuaaaguucuag

SEQ ID NO: 1872350 - RNA, 22 nt, Homo sapiens
acacuaaucacaaacugaauga

SEQ ID NO: 1872351 - RNA, 16 nt, Homo sapiens
aguacauuaaaacacu

SEQ ID NO: 1872352 - RNA, 15 nt, Homo sapiens
acaaaagauguaucc

SEQ ID NO: 1872353 - RNA, 17 nt, Homo sapiens
caaaccucucagcacua

SEQ ID NO: 1872354 - RNA, 21 nt, Homo sapiens
gcaguggagaggggacuugga

SEQ ID NO: 1872355 - RNA, 12 nt, Homo sapiens
gcuggaauucua

SEQ ID NO: 1872356 - RNA, 15 nt, Homo sapiens
uccaccaaaugaauu

SEQ ID NO: 1872357 - RNA, 16 nt, Homo sapiens
ucacaguuuguucagu

SEQ ID NO: 1872358 - RNA, 20 nt, Homo sapiens
gcaaccuccgccucccaggu

SEQ ID NO: 1872359 - RNA, 15 nt, Homo sapiens
ccuccugcugcucac

SEQ ID NO: 1872360 - RNA, 16 nt, Homo sapiens
cagauauacacaugga

SEQ ID NO: 1872361 - RNA, 19 nt, Homo sapiens
cucugucuagcaugccaac

SEQ ID NO: 1872362 - RNA, 17 nt, Homo sapiens
uggauauccacgcagca

SEQ ID NO: 1872363 - RNA, 16 nt, Homo sapiens
uuuggaaagacuggac

SEQ ID NO: 1872364 - RNA, 13 nt, Homo sapiens
caucucagugcag

SEQ ID NO: 1872365 - RNA, 19 nt, Homo sapiens
ugaggucuuuuacauacag

SEQ ID NO: 1872366 - RNA, 20 nt, Homo sapiens
caaagcagagugaaauucaa

SEQ ID NO: 1872367 - RNA, 21 nt, Homo sapiens
cauacauggaauagcaccugg

SEQ ID NO: 1872368 - RNA, 13 nt, Homo sapiens
cuacugauacuuu

SEQ ID NO: 1872369 - RNA, 15 nt, Homo sapiens
cuucugacauuuauc

SEQ ID NO: 1872370 - RNA, 22 nt, Homo sapiens
uguucagacauuccauggugau

SEQ ID NO: 1872371 - RNA, 12 nt, Homo sapiens
aaucuccucuga

SEQ ID NO: 1872372 - RNA, 22 nt, Homo sapiens
ucccugccagaggggaaggagg

SEQ ID NO: 1872373 - RNA, 19 nt, Homo sapiens
caggaaggggaaacacagc

SEQ ID NO: 1872374 - RNA, 20 nt, Homo sapiens
ccugaauggcuuugucuuga

SEQ ID NO: 1872375 - RNA, 22 nt, Homo sapiens
caucuugugaaauggccaggau

SEQ ID NO: 1872376 - RNA, 22 nt, Homo sapiens
gucagcuguggggaacacagcu

SEQ ID NO: 1872377 - RNA, 14 nt, Homo sapiens
ucuuaagcacuuug

SEQ ID NO: 1872378 - RNA, 14 nt, Homo sapiens
auugaagcuuugug

SEQ ID NO: 1872379 - RNA, 22 nt, Homo sapiens
gaaaagauacccaaaggucaag

SEQ ID NO: 1872380 - RNA, 16 nt, Homo sapiens
gcauugagcaaagggg

SEQ ID NO: 1872381 - RNA, 20 nt, Homo sapiens
gaagucuucuccuccaugaa

SEQ ID NO: 1872382 - RNA, 18 nt, Homo sapiens
ucugucuucacuauucag

SEQ ID NO: 1872383 - RNA, 11 nt, Homo sapiens
uggcauauaau

SEQ ID NO: 1872384 - RNA, 23 nt, Homo sapiens
cuuguaacuaaaauaauuuugua

SEQ ID NO: 1872385 - RNA, 16 nt, Homo sapiens
cuagucuguuggcaau

SEQ ID NO: 1872386 - RNA, 15 nt, Homo sapiens
accuuuccugaggaa

SEQ ID NO: 1872387 - RNA, 13 nt, Homo sapiens
ucaccagucccau

SEQ ID NO: 1872388 - RNA, 17 nt, Homo sapiens
aggaugggaagaaaaag

SEQ ID NO: 1872389 - RNA, 17 nt, Homo sapiens
gaaaacaggcacugccc

SEQ ID NO: 1872390 - RNA, 21 nt, Homo sapiens
caugcuggcucccagggccau

SEQ ID NO: 1872391 - RNA, 16 nt, Homo sapiens
uggccaccagcuuccc

SEQ ID NO: 1872392 - RNA, 22 nt, Homo sapiens
auguacccuaaggucauuacca

SEQ ID NO: 1872393 - RNA, 13 nt, Homo sapiens
ggagucucaggag

SEQ ID NO: 1872394 - RNA, 18 nt, Homo sapiens
gguguuauuuucugagag

SEQ ID NO: 1872395 - RNA, 18 nt, Homo sapiens
aacugcuugugcacugga

SEQ ID NO: 1872396 - RNA, 13 nt, Homo sapiens
uguagcagugaga

SEQ ID NO: 1872397 - RNA, 18 nt, Homo sapiens
gcuauugugauaugacaa

SEQ ID NO: 1872398 - RNA, 21 nt, Homo sapiens
agaaaccuuauuguaccucuc

SEQ ID NO: 1872399 - RNA, 15 nt, Homo sapiens
gcaccugcacacucc

SEQ ID NO: 1872400 - RNA, 15 nt, Homo sapiens
ggagucccagagcug

SEQ ID NO: 1872401 - RNA, 12 nt, Homo sapiens
cuucccugcuau

SEQ ID NO: 1872402 - RNA, 18 nt, Homo sapiens
acacccaggucucuuccu

SEQ ID NO: 1872403 - RNA, 17 nt, Homo sapiens
gacuucugcaucuuaca

SEQ ID NO: 1872404 - RNA, 19 nt, Homo sapiens
cagugacaaguagggcaca

SEQ ID NO: 1872405 - RNA, 11 nt, Homo sapiens
aucuguuccuu

SEQ ID NO: 1872406 - RNA, 16 nt, Homo sapiens
uaugcugacagcucuu

SEQ ID NO: 1872407 - RNA, 21 nt, Homo sapiens
cuaaaaauauuaaagccucau

SEQ ID NO: 1872408 - RNA, 20 nt, Homo sapiens
cuuucucuaucccaagccaa

SEQ ID NO: 1872409 - RNA, 23 nt, Homo sapiens
uagcaauacuucagugagauuaa

SEQ ID NO: 1872410 - RNA, 21 nt, Homo sapiens
auguguccuuugauaaccaaa

SEQ ID NO: 1872411 - RNA, 23 nt, Homo sapiens
ugcagaagcaugaucacagcuca

SEQ ID NO: 1872412 - RNA, 14 nt, Homo sapiens
cgcugcaaccuccu

SEQ ID NO: 1872413 - RNA, 11 nt, Homo sapiens
uuaaucccagu

SEQ ID NO: 1872414 - RNA, 17 nt, Homo sapiens
aaaccaaggacugagca

SEQ ID NO: 1872415 - RNA, 18 nt, Homo sapiens
aaggccuuauucauuuca

SEQ ID NO: 1872416 - RNA, 18 nt, Homo sapiens
ugauuugauaccauggca

SEQ ID NO: 1872417 - RNA, 15 nt, Homo sapiens
gcuucuccaaaggga

SEQ ID NO: 1872418 - RNA, 13 nt, Homo sapiens
cugagugugcaga

SEQ ID NO: 1872419 - RNA, 22 nt, Homo sapiens
uauuugauaagcuccuauuaau

SEQ ID NO: 1872420 - RNA, 15 nt, Homo sapiens
cacccacuuugucca

SEQ ID NO: 1872421 - RNA, 21 nt, Homo sapiens
aguuuugccccuacaaggggu

SEQ ID NO: 1872422 - RNA, 18 nt, Homo sapiens
gagcugcucacuaccucc

SEQ ID NO: 1872423 - RNA, 13 nt, Homo sapiens
auguagccucaac

SEQ ID NO: 1872424 - RNA, 22 nt, Homo sapiens
auaaaauggaauaacauaucaa

SEQ ID NO: 1872425 - RNA, 16 nt, Homo sapiens
uauguaguaugcuaug

SEQ ID NO: 1872426 - RNA, 14 nt, Homo sapiens
ugauugccaacagu

SEQ ID NO: 1872427 - RNA, 17 nt, Homo sapiens
caugucucaauaguaaa

SEQ ID NO: 1872428 - RNA, 13 nt, Homo sapiens
cuccuggugcuaa

SEQ ID NO: 1872429 - RNA, 17 nt, Homo sapiens
cuguacugagcacugaa

SEQ ID NO: 1872430 - RNA, 10 nt, Homo sapiens
cccauguauu

SEQ ID NO: 1872431 - RNA, 13 nt, Homo sapiens
gagcuagaaccua

SEQ ID NO: 1872432 - RNA, 21 nt, Homo sapiens
uaaucagugucucacacuggc

SEQ ID NO: 1872433 - RNA, 20 nt, Homo sapiens
gcguuucaaauuucagacca

SEQ ID NO: 1872434 - RNA, 21 nt, Homo sapiens
acuaugacuggaguaaaccau

SEQ ID NO: 1872435 - RNA, 23 nt, Homo sapiens
cauuccaaaguucaacuugguga

SEQ ID NO: 1872436 - RNA, 18 nt, Homo sapiens
gccuuuauauccaaaaua

SEQ ID NO: 1872437 - RNA, 18 nt, Homo sapiens
gaaauugcucauaaucug

SEQ ID NO: 1872438 - RNA, 13 nt, Homo sapiens
accuguuucugca

SEQ ID NO: 1872439 - RNA, 16 nt, Homo sapiens
acauuuugcucuguga

SEQ ID NO: 1872440 - RNA, 21 nt, Homo sapiens
cucaguaaggcagugcaguac

SEQ ID NO: 1872441 - RNA, 18 nt, Homo sapiens
aguuuacuucacuuucau

SEQ ID NO: 1872442 - RNA, 23 nt, Homo sapiens
ucuuccuuacuuuuuauauauau

SEQ ID NO: 1872443 - RNA, 11 nt, Homo sapiens
ucuacugagca

SEQ ID NO: 1872444 - RNA, 18 nt, Homo sapiens
cacauaauuuugugcaug

SEQ ID NO: 1872445 - RNA, 20 nt, Homo sapiens
augauucaagccauuccaaa

SEQ ID NO: 1872446 - RNA, 14 nt, Homo sapiens
acccuucgcaguua

SEQ ID NO: 1872447 - RNA, 22 nt, Homo sapiens
cuuuuggcuuguaaaguacaga

SEQ ID NO: 1872448 - RNA, 14 nt, Homo sapiens
cugguagaccacug

SEQ ID NO: 1872449 - RNA, 20 nt, Homo sapiens
cauaauugcuuugccaaaau

SEQ ID NO: 1872450 - RNA, 19 nt, Homo sapiens
agaacagcauuggucccag

SEQ ID NO: 1872451 - RNA, 18 nt, Homo sapiens
auuugucgcaaagacgua

SEQ ID NO: 1872452 - RNA, 23 nt, Homo sapiens
ugacugagaauauaauacuguau

SEQ ID NO: 1872453 - RNA, 16 nt, Homo sapiens
gcgcaugaaccuggac

SEQ ID NO: 1872454 - RNA, 15 nt, Homo sapiens
cagggucuugcucug

SEQ ID NO: 1872455 - RNA, 17 nt, Homo sapiens
uguuacucuugggacau

SEQ ID NO: 1872456 - RNA, 23 nt, Homo sapiens
acauuuauguaauuuuauuuaca

SEQ ID NO: 1872457 - RNA, 21 nt, Homo sapiens
gucugcuggcuucuacacugg

SEQ ID NO: 1872458 - RNA, 23 nt, Homo sapiens
uccuguggaacccagcaguucug

SEQ ID NO: 1872459 - RNA, 14 nt, Homo sapiens
gaaaccuuccucuu

SEQ ID NO: 1872460 - RNA, 16 nt, Homo sapiens
gacucugcuucagucc

SEQ ID NO: 1872461 - RNA, 19 nt, Homo sapiens
uuuaagguuuuuacuguga

SEQ ID NO: 1872462 - RNA, 16 nt, Homo sapiens
aacaucugauuucuga

SEQ ID NO: 1872463 - RNA, 16 nt, Homo sapiens
ucugcugagacugagc

SEQ ID NO: 1872464 - RNA, 11 nt, Homo sapiens
gggaaagccuc

SEQ ID NO: 1872465 - RNA, 15 nt, Homo sapiens
accacagcaacugac

SEQ ID NO: 1872466 - RNA, 13 nt, Homo sapiens
ucaauucuaguca

SEQ ID NO: 1872467 - RNA, 15 nt, Homo sapiens
uuuuaaugggcacaa

SEQ ID NO: 1872468 - RNA, 20 nt, Homo sapiens
ucccugggguuuacugaggu

SEQ ID NO: 1872469 - RNA, 22 nt, Homo sapiens
ucagugaagaugcaaucagaca

SEQ ID NO: 1872470 - RNA, 15 nt, Homo sapiens
ucuguauaucagcuc

SEQ ID NO: 1872471 - RNA, 20 nt, Homo sapiens
gcuuaaaggggcuagaguga

SEQ ID NO: 1872472 - RNA, 12 nt, Homo sapiens
ggcugcugagaa

SEQ ID NO: 1872473 - RNA, 21 nt, Homo sapiens
auacccuccuuccaccaaguu

SEQ ID NO: 1872474 - RNA, 15 nt, Homo sapiens
ucugcacuccagaua

SEQ ID NO: 1872475 - RNA, 17 nt, Homo sapiens
ugaaagagauuacuuaa

SEQ ID NO: 1872476 - RNA, 15 nt, Homo sapiens
caggacaugugcucu

SEQ ID NO: 1872477 - RNA, 15 nt, Homo sapiens
ucuuguucuacugag

SEQ ID NO: 1872478 - RNA, 18 nt, Homo sapiens
ucauagccaaaaacuuuu

SEQ ID NO: 1872479 - RNA, 22 nt, Homo sapiens
uguccuccaccaugcacucacc

SEQ ID NO: 1872480 - RNA, 13 nt, Homo sapiens
agggcucacucag

SEQ ID NO: 1872481 - RNA, 23 nt, Homo sapiens
ccaccugccgcaugcucccuccu

SEQ ID NO: 1872482 - RNA, 21 nt, Homo sapiens
acugccaggcuugcagucucc

SEQ ID NO: 1872483 - RNA, 18 nt, Homo sapiens
aaugggcuuugcugcuua

SEQ ID NO: 1872484 - RNA, 20 nt, Homo sapiens
uccauccugucaccaugacu

SEQ ID NO: 1872485 - RNA, 15 nt, Homo sapiens
agugggggagccuga

SEQ ID NO: 1872486 - RNA, 19 nt, Homo sapiens
uccaaagguuucaacugua

SEQ ID NO: 1872487 - RNA, 19 nt, Homo sapiens
gggaagcccugugggccac

SEQ ID NO: 1872488 - RNA, 15 nt, Homo sapiens
gcuaauuucuggccc

SEQ ID NO: 1872489 - RNA, 18 nt, Homo sapiens
auguuagacucuggucau

SEQ ID NO: 1872490 - RNA, 19 nt, Homo sapiens
aauacagaucaucuuggaa

SEQ ID NO: 1872491 - RNA, 23 nt, Homo sapiens
ugcugcuucuccaagcuuucaga

SEQ ID NO: 1872492 - RNA, 16 nt, Homo sapiens
cugcauuugccuguca

SEQ ID NO: 1872493 - RNA, 22 nt, Homo sapiens
cuuagaucaggagaaacucggg

SEQ ID NO: 1872494 - RNA, 15 nt, Homo sapiens
agcuuugagguggaa

SEQ ID NO: 1872495 - RNA, 14 nt, Homo sapiens
gauggaggacucca

SEQ ID NO: 1872496 - RNA, 21 nt, Homo sapiens
acaaagauuugcaacauuaga

SEQ ID NO: 1872497 - RNA, 14 nt, Homo sapiens
ccuaaaacacuugc

SEQ ID NO: 1872498 - RNA, 13 nt, Homo sapiens
gaccaaugugaag

SEQ ID NO: 1872499 - RNA, 14 nt, Homo sapiens
cucaagggcuuuau

SEQ ID NO: 1872500 - RNA, 12 nt, Homo sapiens
uauugugacaga

SEQ ID NO: 1872501 - RNA, 19 nt, Homo sapiens
ccaccauggucaucaccac

SEQ ID NO: 1872502 - RNA, 15 nt, Homo sapiens
acugccgacaucccu

SEQ ID NO: 1872503 - RNA, 19 nt, Homo sapiens
uccaccugcuaaucacauc

SEQ ID NO: 1872504 - RNA, 20 nt, Homo sapiens
ggacucugcuucaguccacu

SEQ ID NO: 1872505 - RNA, 15 nt, Homo sapiens
aauccucccacuuca

SEQ ID NO: 1872506 - RNA, 16 nt, Homo sapiens
gggcucuuuagccagu

SEQ ID NO: 1872507 - RNA, 21 nt, Homo sapiens
gcuccuggggagcuccuggga

SEQ ID NO: 1872508 - RNA, 19 nt, Homo sapiens
cuuuggaaucuaaccacuu

SEQ ID NO: 1872509 - RNA, 13 nt, Homo sapiens
agcuaaugugcag

SEQ ID NO: 1872510 - RNA, 17 nt, Homo sapiens
ggaggcugcgugccagu

SEQ ID NO: 1872511 - RNA, 19 nt, Homo sapiens
acaucaagauacacuugua

SEQ ID NO: 1872512 - RNA, 16 nt, Homo sapiens
cuuggcucacugcaac

SEQ ID NO: 1872513 - RNA, 13 nt, Homo sapiens
cuuaaaucauggg

SEQ ID NO: 1872514 - RNA, 16 nt, Homo sapiens
uauuuaucugugcaaa

SEQ ID NO: 1872515 - RNA, 20 nt, Homo sapiens
gaaggugugcuacagaaaau

SEQ ID NO: 1872516 - RNA, 20 nt, Homo sapiens
ucuaaggaaggcagagaccu

SEQ ID NO: 1872517 - RNA, 19 nt, Homo sapiens
cacguggaggaaugcuccc

SEQ ID NO: 1872518 - RNA, 17 nt, Homo sapiens
cuacccaugacuuuaua

SEQ ID NO: 1872519 - RNA, 17 nt, Homo sapiens
gccgcaugucugcaugg

SEQ ID NO: 1872520 - RNA, 23 nt, Homo sapiens
gaccauuaauaaagacacuggca

SEQ ID NO: 1872521 - RNA, 15 nt, Homo sapiens
aacguccacaugaaa

SEQ ID NO: 1872522 - RNA, 16 nt, Homo sapiens
uuauacgcuggcaaca

SEQ ID NO: 1872523 - RNA, 17 nt, Homo sapiens
ccagcggccucaggguc

SEQ ID NO: 1872524 - RNA, 23 nt, Homo sapiens
aaauuguagaacauagaugcuac

SEQ ID NO: 1872525 - RNA, 18 nt, Homo sapiens
accuacccacaugcacuc

SEQ ID NO: 1872526 - RNA, 19 nt, Homo sapiens
uugccauggugauggugua

SEQ ID NO: 1872527 - RNA, 22 nt, Homo sapiens
acagagcugagcauuggugaca

SEQ ID NO: 1872528 - RNA, 12 nt, Homo sapiens
aaauaccacaug

SEQ ID NO: 1872529 - RNA, 13 nt, Homo sapiens
cagauaucuucag

SEQ ID NO: 1872530 - RNA, 18 nt, Homo sapiens
ggagaaagcucauggcug

SEQ ID NO: 1872531 - RNA, 12 nt, Homo sapiens
cugagauucaau

SEQ ID NO: 1872532 - RNA, 21 nt, Homo sapiens
acggaggccagacacaggccg

SEQ ID NO: 1872533 - RNA, 22 nt, Homo sapiens
agcucguggugggugcucaaga

SEQ ID NO: 1872534 - RNA, 23 nt, Homo sapiens
uuuguaagaaauaacacugugaa

SEQ ID NO: 1872535 - RNA, 16 nt, Homo sapiens
guuccaccaugagcuc

SEQ ID NO: 1872536 - RNA, 16 nt, Homo sapiens
auuuugagguuuagca

SEQ ID NO: 1872537 - RNA, 16 nt, Homo sapiens
cugcuggaaaugcuga

SEQ ID NO: 1872538 - RNA, 20 nt, Homo sapiens
uaucauggugaaaagcucca

SEQ ID NO: 1872539 - RNA, 21 nt, Homo sapiens
acaguggaggaagagggacag

SEQ ID NO: 1872540 - RNA, 18 nt, Homo sapiens
ggaaaaucacuugccaaa

SEQ ID NO: 1872541 - RNA, 18 nt, Homo sapiens
aauuucaaucaaccaaag

SEQ ID NO: 1872542 - RNA, 20 nt, Homo sapiens
aagugagggcugggcagcug

SEQ ID NO: 1872543 - RNA, 22 nt, Homo sapiens
ucauucuuuuaaauguugaaua

SEQ ID NO: 1872544 - RNA, 17 nt, Homo sapiens
gccgcaggugggugcug

SEQ ID NO: 1872545 - RNA, 16 nt, Homo sapiens
cuauggaaucaauuca

SEQ ID NO: 1872546 - RNA, 20 nt, Homo sapiens
caaagcccacucacccuuug

SEQ ID NO: 1872547 - RNA, 13 nt, Homo sapiens
cguuacuguagac

SEQ ID NO: 1872548 - RNA, 23 nt, Homo sapiens
agaaauggcuuuccacaucccca

SEQ ID NO: 1872549 - RNA, 12 nt, Homo sapiens
ugcauaugcuuc

SEQ ID NO: 1872550 - RNA, 21 nt, Homo sapiens
aacuucugacuuacugucagu

SEQ ID NO: 1872551 - RNA, 15 nt, Homo sapiens
cacagggacugaaaa

SEQ ID NO: 1872552 - RNA, 18 nt, Homo sapiens
auaaauguaucugaauau

SEQ ID NO: 1872553 - RNA, 20 nt, Homo sapiens
cacggccacaucaaagaggc

SEQ ID NO: 1872554 - RNA, 15 nt, Homo sapiens
uaaguuugaaaggaa

SEQ ID NO: 1872555 - RNA, 15 nt, Homo sapiens
agcccagccugggag

SEQ ID NO: 1872556 - RNA, 17 nt, Homo sapiens
aacuuaaaaaaaugaca

SEQ ID NO: 1872557 - RNA, 22 nt, Homo sapiens
accuguuaauuuuuauacugac

SEQ ID NO: 1872558 - RNA, 13 nt, Homo sapiens
caucagccaguga

SEQ ID NO: 1872559 - RNA, 15 nt, Homo sapiens
ugugccccaugucca

SEQ ID NO: 1872560 - RNA, 16 nt, Homo sapiens
ugcguuuuauaucuuc

SEQ ID NO: 1872561 - RNA, 19 nt, Homo sapiens
uaccugaugugcaguuuaa

SEQ ID NO: 1872562 - RNA, 15 nt, Homo sapiens
guagaauugcauuga

SEQ ID NO: 1872563 - RNA, 14 nt, Homo sapiens
ucucugcucuugcc

SEQ ID NO: 1872564 - RNA, 20 nt, Homo sapiens
uugacaccacaccaucaggc

SEQ ID NO: 1872565 - RNA, 14 nt, Homo sapiens
ccacacacugaguu

SEQ ID NO: 1872566 - RNA, 23 nt, Homo sapiens
ccucuuaagaucugacugccaaa

SEQ ID NO: 1872567 - RNA, 16 nt, Homo sapiens
cuaauauaacuugaaa

SEQ ID NO: 1872568 - RNA, 19 nt, Homo sapiens
uaagaauuuuucagcacuu

SEQ ID NO: 1872569 - RNA, 15 nt, Homo sapiens
cccagggugugaaca

SEQ ID NO: 1872570 - RNA, 23 nt, Homo sapiens
cgggauccccagccuacugccuc

SEQ ID NO: 1872571 - RNA, 19 nt, Homo sapiens
acgguacaaacccaaaaaa

SEQ ID NO: 1872572 - RNA, 19 nt, Homo sapiens
aguauuggcauucaaaaag

SEQ ID NO: 1872573 - RNA, 16 nt, Homo sapiens
gagcacccuacaggga

SEQ ID NO: 1872574 - RNA, 20 nt, Homo sapiens
acuuuuuuugaggacauuga

SEQ ID NO: 1872575 - RNA, 15 nt, Homo sapiens
aaguauaacaacuuu

SEQ ID NO: 1872576 - RNA, 18 nt, Homo sapiens
gggcagcucccagccucu

SEQ ID NO: 1872577 - RNA, 21 nt, Homo sapiens
caugcagaacaccaauauuaa

SEQ ID NO: 1872578 - RNA, 21 nt, Homo sapiens
agugaggacucggccacugug

SEQ ID NO: 1872579 - RNA, 17 nt, Homo sapiens
acguacuuaauuuacuu

SEQ ID NO: 1872580 - RNA, 18 nt, Homo sapiens
aaacccuucuuuacuaga

SEQ ID NO: 1872581 - RNA, 15 nt, Homo sapiens
guccauuaacugcuu

SEQ ID NO: 1872582 - RNA, 15 nt, Homo sapiens
acugcggaguccagg

SEQ ID NO: 1872583 - RNA, 21 nt, Homo sapiens
ugggaggcugaggcagcagac

SEQ ID NO: 1872584 - RNA, 13 nt, Homo sapiens
ccaucagccauuu

SEQ ID NO: 1872585 - RNA, 18 nt, Homo sapiens
aaggucauggucugagug

SEQ ID NO: 1872586 - RNA, 19 nt, Homo sapiens
ucuuaacccccuagaaaga

SEQ ID NO: 1872587 - RNA, 16 nt, Homo sapiens
ucacuacugcauuuau

SEQ ID NO: 1872588 - RNA, 15 nt, Homo sapiens
gaaugagugccuuga

SEQ ID NO: 1872589 - RNA, 16 nt, Homo sapiens
auguuaaaaagugaaa

SEQ ID NO: 1872590 - RNA, 21 nt, Homo sapiens
ugaguuggggccauugcuuac

SEQ ID NO: 1872591 - RNA, 18 nt, Homo sapiens
caugaguuaucaugaauu

SEQ ID NO: 1872592 - RNA, 21 nt, Homo sapiens
uuuuuggcuacacacaaacca

SEQ ID NO: 1872593 - RNA, 15 nt, Homo sapiens
aaaauuaaauacaua

SEQ ID NO: 1872594 - RNA, 18 nt, Homo sapiens
guaucaguucugcugaca

SEQ ID NO: 1872595 - RNA, 14 nt, Homo sapiens
caggggucuugcaa

SEQ ID NO: 1872596 - RNA, 13 nt, Homo sapiens
cucgaugcugcug

SEQ ID NO: 1872597 - RNA, 13 nt, Homo sapiens
agaucaguuauuc

SEQ ID NO: 1872598 - RNA, 13 nt, Homo sapiens
agaauaguuauau

SEQ ID NO: 1872599 - RNA, 16 nt, Homo sapiens
guauaagucaagcaca

SEQ ID NO: 1872600 - RNA, 14 nt, Homo sapiens
auaaaacagucaug

SEQ ID NO: 1872601 - RNA, 18 nt, Homo sapiens
ugcuuguaguuauaguga

SEQ ID NO: 1872602 - RNA, 21 nt, Homo sapiens
gcagcgacgugaggguccuga

SEQ ID NO: 1872603 - RNA, 18 nt, Homo sapiens
augguccauugcuacucu

SEQ ID NO: 1872604 - RNA, 21 nt, Homo sapiens
caacaugcauguucuccucua

SEQ ID NO: 1872605 - RNA, 20 nt, Homo sapiens
aauaaaguacccugugcuca

SEQ ID NO: 1872606 - RNA, 22 nt, Homo sapiens
cuaaucagcauucucacuccua

SEQ ID NO: 1872607 - RNA, 14 nt, Homo sapiens
ugacaggacuuuca

SEQ ID NO: 1872608 - RNA, 14 nt, Homo sapiens
auauacauaugaca

SEQ ID NO: 1872609 - RNA, 14 nt, Homo sapiens
uaaaacauuaguca

SEQ ID NO: 1872610 - RNA, 22 nt, Homo sapiens
agaagaaaauccauucauucaa

SEQ ID NO: 1872611 - RNA, 19 nt, Homo sapiens
gguccacagguccaaggac

SEQ ID NO: 1872612 - RNA, 13 nt, Homo sapiens
aaugugccaagaa

SEQ ID NO: 1872613 - RNA, 13 nt, Homo sapiens
uugaagccuuugu

SEQ ID NO: 1872614 - RNA, 22 nt, Homo sapiens
aucuggcccaggaauuagagaa

SEQ ID NO: 1872615 - RNA, 19 nt, Homo sapiens
gacccaccuucaagcagcu

SEQ ID NO: 1872616 - RNA, 21 nt, Homo sapiens
caggacuugugcagacgccac

SEQ ID NO: 1872617 - RNA, 20 nt, Homo sapiens
cugguguuagggcuaucuca

SEQ ID NO: 1872618 - RNA, 21 nt, Homo sapiens
aucugaaggcgugagucugca

SEQ ID NO: 1872619 - RNA, 18 nt, Homo sapiens
caguuugucucuuugcaa

SEQ ID NO: 1872620 - RNA, 16 nt, Homo sapiens
gccaggccacuggccc

SEQ ID NO: 1872621 - RNA, 18 nt, Homo sapiens
acagacauucaccuguau

SEQ ID NO: 1872622 - RNA, 14 nt, Homo sapiens
uaggaaaaccauga

SEQ ID NO: 1872623 - RNA, 19 nt, Homo sapiens
aacacacccaaacacacca

SEQ ID NO: 1872624 - RNA, 11 nt, Homo sapiens
caagcauguau

SEQ ID NO: 1872625 - RNA, 22 nt, Homo sapiens
uccagcacaccugccgucuuca

SEQ ID NO: 1872626 - RNA, 16 nt, Homo sapiens
cagaauaucacagaaa

SEQ ID NO: 1872627 - RNA, 19 nt, Homo sapiens
uaaaccgcaugugaucucc

SEQ ID NO: 1872628 - RNA, 20 nt, Homo sapiens
cucucccucccuaacaguga

SEQ ID NO: 1872629 - RNA, 14 nt, Homo sapiens
caggguugaucaca

SEQ ID NO: 1872630 - RNA, 21 nt, Homo sapiens
uaauuuuuaaaagacuuugau

SEQ ID NO: 1872631 - RNA, 20 nt, Homo sapiens
acaaauuguuuuuacugucu

SEQ ID NO: 1872632 - RNA, 19 nt, Homo sapiens
ucugcccuguguacuuccc

SEQ ID NO: 1872633 - RNA, 23 nt, Homo sapiens
aaagauguccugacuuugccccc

SEQ ID NO: 1872634 - RNA, 19 nt, Homo sapiens
agaggaugaggugggcuga

SEQ ID NO: 1872635 - RNA, 20 nt, Homo sapiens
cuaugguaucauaucaugaa

SEQ ID NO: 1872636 - RNA, 20 nt, Homo sapiens
cuacaaugcugcgucuccca

SEQ ID NO: 1872637 - RNA, 15 nt, Homo sapiens
gaaguagcugagaaa

SEQ ID NO: 1872638 - RNA, 14 nt, Homo sapiens
ucuaccuucagggu

SEQ ID NO: 1872639 - RNA, 20 nt, Homo sapiens
aagcucugccccuuccccau

SEQ ID NO: 1872640 - RNA, 20 nt, Homo sapiens
ccaaaggacacggcucagca

SEQ ID NO: 1872641 - RNA, 21 nt, Homo sapiens
ugauuaccagucugauuauac

SEQ ID NO: 1872642 - RNA, 15 nt, Homo sapiens
aaaggaugggaccaa

SEQ ID NO: 1872643 - RNA, 22 nt, Homo sapiens
gacagaaacccaguaacuugca

SEQ ID NO: 1872644 - RNA, 15 nt, Homo sapiens
aguugauucagcucu

SEQ ID NO: 1872645 - RNA, 16 nt, Homo sapiens
guacccccucauuugu

SEQ ID NO: 1872646 - RNA, 20 nt, Homo sapiens
gaaagugugagcucuucccu

SEQ ID NO: 1872647 - RNA, 18 nt, Homo sapiens
uugaacuuuauaaaacau

SEQ ID NO: 1872648 - RNA, 20 nt, Homo sapiens
cagggggaggggaaccuguc

SEQ ID NO: 1872649 - RNA, 15 nt, Homo sapiens
caugcaaaggauaaa

SEQ ID NO: 1872650 - RNA, 20 nt, Homo sapiens
agcggacaagcagcuggugc

SEQ ID NO: 1872651 - RNA, 13 nt, Homo sapiens
aacuuuggcuuau

SEQ ID NO: 1872652 - RNA, 16 nt, Homo sapiens
aggcccaaaacauaua

SEQ ID NO: 1872653 - RNA, 18 nt, Homo sapiens
ugacuuaguugcguuaca

SEQ ID NO: 1872654 - RNA, 14 nt, Homo sapiens
acuuagagaaccua

SEQ ID NO: 1872655 - RNA, 18 nt, Homo sapiens
gcuuauguuaacugacaa

SEQ ID NO: 1872656 - RNA, 19 nt, Homo sapiens
caggauggucucgaucucu

SEQ ID NO: 1872657 - RNA, 23 nt, Homo sapiens
ucuggaaguauuuuccuccaaag

SEQ ID NO: 1872658 - RNA, 23 nt, Homo sapiens
uguuaagguccugaaaguaacuc

SEQ ID NO: 1872659 - RNA, 17 nt, Homo sapiens
cuuuuuuuaacugguga

SEQ ID NO: 1872660 - RNA, 16 nt, Homo sapiens
ggcagcuguugcagug

SEQ ID NO: 1872661 - RNA, 12 nt, Homo sapiens
cugcugauccag

SEQ ID NO: 1872662 - RNA, 15 nt, Homo sapiens
augaagaaaauugag

SEQ ID NO: 1872663 - RNA, 14 nt, Homo sapiens
cagucccauuccuc

SEQ ID NO: 1872664 - RNA, 20 nt, Homo sapiens
ugaccuggcccccucagugu

SEQ ID NO: 1872665 - RNA, 16 nt, Homo sapiens
aguaacacagugcagu

SEQ ID NO: 1872666 - RNA, 19 nt, Homo sapiens
aagguauuuugaauaccau

SEQ ID NO: 1872667 - RNA, 16 nt, Homo sapiens
cgagggcgccaugcag

SEQ ID NO: 1872668 - RNA, 15 nt, Homo sapiens
cagguccaugugcac

SEQ ID NO: 1872669 - RNA, 18 nt, Homo sapiens
ggcagaaaacacagccug

SEQ ID NO: 1872670 - RNA, 13 nt, Homo sapiens
uuuaucauaugcu

SEQ ID NO: 1872671 - RNA, 20 nt, Homo sapiens
gcccaggauggagugcagug

SEQ ID NO: 1872672 - RNA, 15 nt, Homo sapiens
cacuuguuugcacug

SEQ ID NO: 1872673 - RNA, 13 nt, Homo sapiens
caagucugugaaa

SEQ ID NO: 1872674 - RNA, 13 nt, Homo sapiens
caggucuguggaa

SEQ ID NO: 1872675 - RNA, 22 nt, Homo sapiens
ccaucauucaugcuacugccaa

SEQ ID NO: 1872676 - RNA, 21 nt, Homo sapiens
ugcuagugccugagaugcacg

SEQ ID NO: 1872677 - RNA, 19 nt, Homo sapiens
acuuacccacgugcuguuc

SEQ ID NO: 1872678 - RNA, 18 nt, Homo sapiens
ucacagaugugugauuca

SEQ ID NO: 1872679 - RNA, 22 nt, Homo sapiens
acccuuuacauuuugugcagug

SEQ ID NO: 1872680 - RNA, 18 nt, Homo sapiens
aaauuugauaaacugaau

SEQ ID NO: 1872681 - RNA, 13 nt, Homo sapiens
aaaauacuguaca

SEQ ID NO: 1872682 - RNA, 17 nt, Homo sapiens
cauaaucacaaauauag

SEQ ID NO: 1872683 - RNA, 22 nt, Homo sapiens
ccauuuccuccuuuaccuuuca

SEQ ID NO: 1872684 - RNA, 16 nt, Homo sapiens
aacuuauguauguggu

SEQ ID NO: 1872685 - RNA, 15 nt, Homo sapiens
cuccugaagccacag

SEQ ID NO: 1872686 - RNA, 16 nt, Homo sapiens
uucacugcagauuucu

SEQ ID NO: 1872687 - RNA, 15 nt, Homo sapiens
ugaauaaaugucacu

SEQ ID NO: 1872688 - RNA, 18 nt, Homo sapiens
agaagcuaaagucaucca

SEQ ID NO: 1872689 - RNA, 15 nt, Homo sapiens
cagccccucccccau

SEQ ID NO: 1872690 - RNA, 20 nt, Homo sapiens
ccugacccagggacucucca

SEQ ID NO: 1872691 - RNA, 16 nt, Homo sapiens
agcacagcuccugcca

SEQ ID NO: 1872692 - RNA, 16 nt, Homo sapiens
ccccaacuuagcuguc

SEQ ID NO: 1872693 - RNA, 16 nt, Homo sapiens
aguuagucaauccugu

SEQ ID NO: 1872694 - RNA, 14 nt, Homo sapiens
aggggcucucucau

SEQ ID NO: 1872695 - RNA, 16 nt, Homo sapiens
gauccuaaaacaaaag

SEQ ID NO: 1872696 - RNA, 20 nt, Homo sapiens
gaacaaagugagacagucca

SEQ ID NO: 1872697 - RNA, 13 nt, Homo sapiens
gaauuugcaaagu

SEQ ID NO: 1872698 - RNA, 13 nt, Homo sapiens
gcuugugcacugg

SEQ ID NO: 1872699 - RNA, 23 nt, Homo sapiens
cgcacugggagccauggggagca

SEQ ID NO: 1872700 - RNA, 14 nt, Homo sapiens
aaauauauauguca

SEQ ID NO: 1872701 - RNA, 13 nt, Homo sapiens
uucaaaguguaag

SEQ ID NO: 1872702 - RNA, 15 nt, Homo sapiens
ugaccacagcaguuu

SEQ ID NO: 1872703 - RNA, 13 nt, Homo sapiens
ugauguauguuau

SEQ ID NO: 1872704 - RNA, 13 nt, Homo sapiens
ccucaguucuugc

SEQ ID NO: 1872705 - RNA, 20 nt, Homo sapiens
agauacaggggaucauguua

SEQ ID NO: 1872706 - RNA, 14 nt, Homo sapiens
aaugcccagacauu

SEQ ID NO: 1872707 - RNA, 18 nt, Homo sapiens
uaaacaauguccucuuug

SEQ ID NO: 1872708 - RNA, 20 nt, Homo sapiens
cauuaacugcacaaacaaua

SEQ ID NO: 1872709 - RNA, 14 nt, Homo sapiens
ccauuuaaaaaaca

SEQ ID NO: 1872710 - RNA, 16 nt, Homo sapiens
aagaccugagaaugua

SEQ ID NO: 1872711 - RNA, 11 nt, Homo sapiens
gauaacaaaca

SEQ ID NO: 1872712 - RNA, 13 nt, Homo sapiens
ccucccacucuau

SEQ ID NO: 1872713 - RNA, 19 nt, Homo sapiens
cuggugucuaauaaacaca

SEQ ID NO: 1872714 - RNA, 19 nt, Homo sapiens
ugcugggccccaucuccac

SEQ ID NO: 1872715 - RNA, 21 nt, Homo sapiens
cuuuggcugaaauucuucaac

SEQ ID NO: 1872716 - RNA, 20 nt, Homo sapiens
uuuugagggguucuucuggg

SEQ ID NO: 1872717 - RNA, 15 nt, Homo sapiens
acauacgugucugug

SEQ ID NO: 1872718 - RNA, 16 nt, Homo sapiens
cccucgaggaaggggg

SEQ ID NO: 1872719 - RNA, 16 nt, Homo sapiens
uuguccccguccccca

SEQ ID NO: 1872720 - RNA, 15 nt, Homo sapiens
ucucucucuugccug

SEQ ID NO: 1872721 - RNA, 20 nt, Homo sapiens
gcuagugauuuacacagguu

SEQ ID NO: 1872722 - RNA, 21 nt, Homo sapiens
aaggucauaaaaauauuguua

SEQ ID NO: 1872723 - RNA, 22 nt, Homo sapiens
agugagacccccaucucuacaa

SEQ ID NO: 1872724 - RNA, 20 nt, Homo sapiens
augccuuuucucaccuguca

SEQ ID NO: 1872725 - RNA, 20 nt, Homo sapiens
ggaggcaagcguguucucag

SEQ ID NO: 1872726 - RNA, 23 nt, Homo sapiens
cuuauaguguuuggacagcugau

SEQ ID NO: 1872727 - RNA, 14 nt, Homo sapiens
augugaauuuugcc

SEQ ID NO: 1872728 - RNA, 18 nt, Homo sapiens
gcugccauccaugugcua

SEQ ID NO: 1872729 - RNA, 13 nt, Homo sapiens
acugccacccaca

SEQ ID NO: 1872730 - RNA, 16 nt, Homo sapiens
ccacggcucuaggugg

SEQ ID NO: 1872731 - RNA, 12 nt, Homo sapiens
guaaacagucag

SEQ ID NO: 1872732 - RNA, 16 nt, Homo sapiens
agagugguaucuugca

SEQ ID NO: 1872733 - RNA, 14 nt, Homo sapiens
auucaaaugcauga

SEQ ID NO: 1872734 - RNA, 14 nt, Homo sapiens
guuuggagucacug

SEQ ID NO: 1872735 - RNA, 14 nt, Homo sapiens
uaguugcaguauug

SEQ ID NO: 1872736 - RNA, 17 nt, Homo sapiens
gacccagggguccaggc

SEQ ID NO: 1872737 - RNA, 17 nt, Homo sapiens
aauaaaaaagcaaaaac

SEQ ID NO: 1872738 - RNA, 20 nt, Homo sapiens
gagccaugauuuucuaaaaa

SEQ ID NO: 1872739 - RNA, 16 nt, Homo sapiens
ugcuuucugaaauuca

SEQ ID NO: 1872740 - RNA, 15 nt, Homo sapiens
cugcagcucagggac

SEQ ID NO: 1872741 - RNA, 14 nt, Homo sapiens
ugggcucuccgggg

SEQ ID NO: 1872742 - RNA, 15 nt, Homo sapiens
gcucugcccaugccu

SEQ ID NO: 1872743 - RNA, 18 nt, Homo sapiens
gcgaccccgucacagccu

SEQ ID NO: 1872744 - RNA, 21 nt, Homo sapiens
acaaggauuucucuaacccua

SEQ ID NO: 1872745 - RNA, 16 nt, Homo sapiens
ucagcugcacauuccu

SEQ ID NO: 1872746 - RNA, 16 nt, Homo sapiens
ugugagccaccacguc

SEQ ID NO: 1872747 - RNA, 22 nt, Homo sapiens
caaauccuuagaucuggcaugu

SEQ ID NO: 1872748 - RNA, 10 nt, Homo sapiens
cccucaggcc

SEQ ID NO: 1872749 - RNA, 17 nt, Homo sapiens
ugcccaccccgccucug

SEQ ID NO: 1872750 - RNA, 21 nt, Homo sapiens
uacagacaucuaauguucucc

SEQ ID NO: 1872751 - RNA, 20 nt, Homo sapiens
cuccuguauuuaacaaaaag

SEQ ID NO: 1872752 - RNA, 20 nt, Homo sapiens
caugcgguagccagcacaca

SEQ ID NO: 1872753 - RNA, 19 nt, Homo sapiens
cuguguaagcucacaucca

SEQ ID NO: 1872754 - RNA, 16 nt, Homo sapiens
auggggcuccuggaaa

SEQ ID NO: 1872755 - RNA, 16 nt, Homo sapiens
ucuaaaaugcaaagaa

SEQ ID NO: 1872756 - RNA, 11 nt, Homo sapiens
gcacagacagg

SEQ ID NO: 1872757 - RNA, 18 nt, Homo sapiens
ugaggagaugcggccaaa

SEQ ID NO: 1872758 - RNA, 21 nt, Homo sapiens
acaccugagaaacaucuagaa

SEQ ID NO: 1872759 - RNA, 22 nt, Homo sapiens
cucugcaagcccacuggccagc

SEQ ID NO: 1872760 - RNA, 22 nt, Homo sapiens
guaugguuacuaaaaaguacca

SEQ ID NO: 1872761 - RNA, 22 nt, Homo sapiens
aauuaggaacugaguaugugua

SEQ ID NO: 1872762 - RNA, 17 nt, Homo sapiens
gaacaguuucaucagga

SEQ ID NO: 1872763 - RNA, 16 nt, Homo sapiens
gugcaccaccaugcca

SEQ ID NO: 1872764 - RNA, 17 nt, Homo sapiens
cucuucagcacaaagac

SEQ ID NO: 1872765 - RNA, 19 nt, Homo sapiens
agacucucgcaucuuccca

SEQ ID NO: 1872766 - RNA, 20 nt, Homo sapiens
aguuauuaaaguaauuuaca

SEQ ID NO: 1872767 - RNA, 23 nt, Homo sapiens
aaauacacagugcugaccagaca

SEQ ID NO: 1872768 - RNA, 20 nt, Homo sapiens
aauucaggaugcugugauac

SEQ ID NO: 1872769 - RNA, 23 nt, Homo sapiens
ucgccaggaggccacgggccacg

SEQ ID NO: 1872770 - RNA, 23 nt, Homo sapiens
gauuucccaaaaacacuaaaggu

SEQ ID NO: 1872771 - RNA, 20 nt, Homo sapiens
ucccugcaaggugcaccugc

SEQ ID NO: 1872772 - RNA, 13 nt, Homo sapiens
aagacucaccuca

SEQ ID NO: 1872773 - RNA, 22 nt, Homo sapiens
caacauuacagggaaugccuga

SEQ ID NO: 1872774 - RNA, 21 nt, Homo sapiens
cagaugcccaguaucauacgu

SEQ ID NO: 1872775 - RNA, 19 nt, Homo sapiens
uuaaaguggcagcuucacu

SEQ ID NO: 1872776 - RNA, 17 nt, Homo sapiens
agcugggacuacaggca

SEQ ID NO: 1872777 - RNA, 12 nt, Homo sapiens
agcugguguccu

SEQ ID NO: 1872778 - RNA, 15 nt, Homo sapiens
aacacagggcugcau

SEQ ID NO: 1872779 - RNA, 12 nt, Homo sapiens
cugucugcauuu

SEQ ID NO: 1872780 - RNA, 19 nt, Homo sapiens
cuauguuugugugauuucc

SEQ ID NO: 1872781 - RNA, 16 nt, Homo sapiens
cuuauuucaucauuca

SEQ ID NO: 1872782 - RNA, 22 nt, Homo sapiens
uuaggagaacagguguuccucc

SEQ ID NO: 1872783 - RNA, 14 nt, Homo sapiens
cuuggcuugccauu

SEQ ID NO: 1872784 - RNA, 21 nt, Homo sapiens
aguuuugccaguucaagaauu

SEQ ID NO: 1872785 - RNA, 18 nt, Homo sapiens
uaaauaucacaguauuau

SEQ ID NO: 1872786 - RNA, 13 nt, Homo sapiens
accagacacugcu

SEQ ID NO: 1872787 - RNA, 19 nt, Homo sapiens
aaucuguuguuuguuugau

SEQ ID NO: 1872788 - RNA, 22 nt, Homo sapiens
cauuucacaaauguuuagugaa

SEQ ID NO: 1872789 - RNA, 12 nt, Homo sapiens
ccaaaguguccc

SEQ ID NO: 1872790 - RNA, 19 nt, Homo sapiens
uguaaacuacaaaguaaaa

SEQ ID NO: 1872791 - RNA, 22 nt, Homo sapiens
agcuccuccuuuacuuucucuc

SEQ ID NO: 1872792 - RNA, 18 nt, Homo sapiens
agcaaucagaauugugcu

SEQ ID NO: 1872793 - RNA, 23 nt, Homo sapiens
ccuugauuaguguaguguuaaag

SEQ ID NO: 1872794 - RNA, 21 nt, Homo sapiens
gaauaaaagaugauuucucaa

SEQ ID NO: 1872795 - RNA, 15 nt, Homo sapiens
auggccuaggaucuu

SEQ ID NO: 1872796 - RNA, 16 nt, Homo sapiens
gaagaacuggcaucuu

SEQ ID NO: 1872797 - RNA, 18 nt, Homo sapiens
accuuugauuuuugccca

SEQ ID NO: 1872798 - RNA, 15 nt, Homo sapiens
acauucucuaauaag

SEQ ID NO: 1872799 - RNA, 16 nt, Homo sapiens
ccugaccuaccccagc

SEQ ID NO: 1872800 - RNA, 24 nt, Homo sapiens
aagcacaaccauguucuugagcag

SEQ ID NO: 1872801 - RNA, 22 nt, Homo sapiens
ucagccugggcaacauggugaa

SEQ ID NO: 1872802 - RNA, 21 nt, Homo sapiens
ugagagggaaaagauugacug

SEQ ID NO: 1872803 - RNA, 22 nt, Homo sapiens
agaugauaaaaggaaucuggca

SEQ ID NO: 1872804 - RNA, 17 nt, Homo sapiens
ggaccauucauacccac

SEQ ID NO: 1872805 - RNA, 15 nt, Homo sapiens
cagagaaaaugaauu

SEQ ID NO: 1872806 - RNA, 13 nt, Homo sapiens
caucaucuauggc

SEQ ID NO: 1872807 - RNA, 20 nt, Homo sapiens
ugaccaagagagaaagaagu

SEQ ID NO: 1872808 - RNA, 21 nt, Homo sapiens
acgcuaguuaucaugcauguu

SEQ ID NO: 1872809 - RNA, 16 nt, Homo sapiens
ugacugccacccacac

SEQ ID NO: 1872810 - RNA, 15 nt, Homo sapiens
acaauguucuggcac

SEQ ID NO: 1872811 - RNA, 21 nt, Homo sapiens
ugguaucacugaacuacuaaa

SEQ ID NO: 1872812 - RNA, 19 nt, Homo sapiens
uaucauuuauccuuacauu

SEQ ID NO: 1872813 - RNA, 20 nt, Homo sapiens
ccuggcaucugacacugaca

SEQ ID NO: 1872814 - RNA, 21 nt, Homo sapiens
ugaguuagcuguuacuuuuac

SEQ ID NO: 1872815 - RNA, 12 nt, Homo sapiens
ucucugcuugca

SEQ ID NO: 1872816 - RNA, 22 nt, Homo sapiens
agcugaccugcaccccugaugu

SEQ ID NO: 1872817 - RNA, 20 nt, Homo sapiens
gcauaggcugacuuuugcag

SEQ ID NO: 1872818 - RNA, 21 nt, Homo sapiens
acuuggaauuuguaaccucag

SEQ ID NO: 1872819 - RNA, 13 nt, Homo sapiens
ugacaauagaaca

SEQ ID NO: 1872820 - RNA, 13 nt, Homo sapiens
gacacauaugcac

SEQ ID NO: 1872821 - RNA, 15 nt, Homo sapiens
caggaaggaaugcaa

SEQ ID NO: 1872822 - RNA, 22 nt, Homo sapiens
ggacguccugcuggcaccucag

SEQ ID NO: 1872823 - RNA, 21 nt, Homo sapiens
gaaggugucucuggucuucca

SEQ ID NO: 1872824 - RNA, 14 nt, Homo sapiens
agagaccugcucag

SEQ ID NO: 1872825 - RNA, 11 nt, Homo sapiens
ucaagugauag

SEQ ID NO: 1872826 - RNA, 12 nt, Homo sapiens
aucaauaccugc

SEQ ID NO: 1872827 - RNA, 20 nt, Homo sapiens
cuccccggcaggccugagaa

SEQ ID NO: 1872828 - RNA, 14 nt, Homo sapiens
uaaucccaggauua

SEQ ID NO: 1872829 - RNA, 15 nt, Homo sapiens
auagugacaugcagu

SEQ ID NO: 1872830 - RNA, 20 nt, Homo sapiens
augcucaaaaucuuuccaaa

SEQ ID NO: 1872831 - RNA, 14 nt, Homo sapiens
aaaaguuaagcaaa

SEQ ID NO: 1872832 - RNA, 18 nt, Homo sapiens
gcuccccaaucccugacc

SEQ ID NO: 1872833 - RNA, 16 nt, Homo sapiens
gugagcucuuccagga

SEQ ID NO: 1872834 - RNA, 16 nt, Homo sapiens
cccaccccuaccucua

SEQ ID NO: 1872835 - RNA, 21 nt, Homo sapiens
ucccaggcccgagaugugacc

SEQ ID NO: 1872836 - RNA, 14 nt, Homo sapiens
guguauucauuuua

SEQ ID NO: 1872837 - RNA, 14 nt, Homo sapiens
ugugugguggagcc

SEQ ID NO: 1872838 - RNA, 14 nt, Homo sapiens
ucugugugguauau

SEQ ID NO: 1872839 - RNA, 16 nt, Homo sapiens
ccucuuuuucuuacca

SEQ ID NO: 1872840 - RNA, 14 nt, Homo sapiens
augauuuguggaaa

SEQ ID NO: 1872841 - RNA, 13 nt, Homo sapiens
cuagaugaccuca

SEQ ID NO: 1872842 - RNA, 17 nt, Homo sapiens
gggagcucugcuugccg

SEQ ID NO: 1872843 - RNA, 22 nt, Homo sapiens
ccguuaucauggagaacagcau

SEQ ID NO: 1872844 - RNA, 16 nt, Homo sapiens
guagcucugcugcuga

SEQ ID NO: 1872845 - RNA, 14 nt, Homo sapiens
ucagcagaggcagu

SEQ ID NO: 1872846 - RNA, 18 nt, Homo sapiens
aaaaguaaaacacucuaa

SEQ ID NO: 1872847 - RNA, 12 nt, Homo sapiens
agggaagcaaua

SEQ ID NO: 1872848 - RNA, 17 nt, Homo sapiens
uauacauuuauuuacac

SEQ ID NO: 1872849 - RNA, 22 nt, Homo sapiens
acagaccgccgucuaacucaaa

SEQ ID NO: 1872850 - RNA, 15 nt, Homo sapiens
agagaaccucagauc

SEQ ID NO: 1872851 - RNA, 15 nt, Homo sapiens
ucuuuagcaguuuug

SEQ ID NO: 1872852 - RNA, 22 nt, Homo sapiens
ggagcaucagugcccuccagga

SEQ ID NO: 1872853 - RNA, 14 nt, Homo sapiens
gugccuuuugcaga

SEQ ID NO: 1872854 - RNA, 12 nt, Homo sapiens
guaagacacaaa

SEQ ID NO: 1872855 - RNA, 12 nt, Homo sapiens
cauggacaguug

SEQ ID NO: 1872856 - RNA, 19 nt, Homo sapiens
augguaugcacaauuccau

SEQ ID NO: 1872857 - RNA, 13 nt, Homo sapiens
acgcagacuccac

SEQ ID NO: 1872858 - RNA, 16 nt, Homo sapiens
uguuuauauaguuuag

SEQ ID NO: 1872859 - RNA, 16 nt, Homo sapiens
ucucugggucccgggg

SEQ ID NO: 1872860 - RNA, 16 nt, Homo sapiens
aauuguucaacuuuuc

SEQ ID NO: 1872861 - RNA, 22 nt, Homo sapiens
auauagaccaauugaagcauga

SEQ ID NO: 1872862 - RNA, 22 nt, Homo sapiens
uuggaaaaagaaaaaaggguuu

SEQ ID NO: 1872863 - RNA, 21 nt, Homo sapiens
caccaauuccaccaagacagu

SEQ ID NO: 1872864 - RNA, 21 nt, Homo sapiens
uggagcggagaggaagccagc

SEQ ID NO: 1872865 - RNA, 17 nt, Homo sapiens
acagcaaccucuucaug

SEQ ID NO: 1872866 - RNA, 19 nt, Homo sapiens
uggggagucagucauguca

SEQ ID NO: 1872867 - RNA, 23 nt, Homo sapiens
ucaggugcagucccaguccuuga

SEQ ID NO: 1872868 - RNA, 20 nt, Homo sapiens
caaaccccagggcacugagg

SEQ ID NO: 1872869 - RNA, 17 nt, Homo sapiens
ccggcgggugcucugag

SEQ ID NO: 1872870 - RNA, 15 nt, Homo sapiens
gcuuucagugccugc

SEQ ID NO: 1872871 - RNA, 21 nt, Homo sapiens
auuuguaaaacauuccaaaua

SEQ ID NO: 1872872 - RNA, 16 nt, Homo sapiens
ccaggcuggagugcag

SEQ ID NO: 1872873 - RNA, 16 nt, Homo sapiens
ccaggcuagagugcaa

SEQ ID NO: 1872874 - RNA, 13 nt, Homo sapiens
cgucaucuucccu

SEQ ID NO: 1872875 - RNA, 19 nt, Homo sapiens
cugccuuaaauaaaacugc

SEQ ID NO: 1872876 - RNA, 17 nt, Homo sapiens
uaaaauaagcucaguga

SEQ ID NO: 1872877 - RNA, 10 nt, Homo sapiens
gaccucuugu

SEQ ID NO: 1872878 - RNA, 21 nt, Homo sapiens
gcuguccccacagcuucucua

SEQ ID NO: 1872879 - RNA, 19 nt, Homo sapiens
caccaaucuuacuuuguaa

SEQ ID NO: 1872880 - RNA, 23 nt, Homo sapiens
aagaagccacccuccuugcagga

SEQ ID NO: 1872881 - RNA, 19 nt, Homo sapiens
cuucaugcaauccuuccaa

SEQ ID NO: 1872882 - RNA, 21 nt, Homo sapiens
uuuaagugaaaaaagcaaaua

SEQ ID NO: 1872883 - RNA, 15 nt, Homo sapiens
acacaacauguaugu

SEQ ID NO: 1872884 - RNA, 13 nt, Homo sapiens
gugaacacuggag

SEQ ID NO: 1872885 - RNA, 20 nt, Homo sapiens
aaacauuuucacacaauaca

SEQ ID NO: 1872886 - RNA, 19 nt, Homo sapiens
gcucuggcauguugaauau

SEQ ID NO: 1872887 - RNA, 15 nt, Homo sapiens
aguaacauguguuaa

SEQ ID NO: 1872888 - RNA, 15 nt, Homo sapiens
gcuauuucagccaau

SEQ ID NO: 1872889 - RNA, 15 nt, Homo sapiens
augcugagcugugau

SEQ ID NO: 1872890 - RNA, 19 nt, Homo sapiens
uucaaguguuaccuaacaa

SEQ ID NO: 1872891 - RNA, 12 nt, Homo sapiens
gagggucucaga

SEQ ID NO: 1872892 - RNA, 12 nt, Homo sapiens
cuaggucuguaa

SEQ ID NO: 1872893 - RNA, 19 nt, Homo sapiens
aacaucuaauaaguauaua

SEQ ID NO: 1872894 - RNA, 12 nt, Homo sapiens
uccucucuggcu

SEQ ID NO: 1872895 - RNA, 13 nt, Homo sapiens
guaauagcuguaa

SEQ ID NO: 1872896 - RNA, 19 nt, Homo sapiens
aggcuuguuuaccuuucuc

SEQ ID NO: 1872897 - RNA, 20 nt, Homo sapiens
uaauguacuuuuuauugcau

SEQ ID NO: 1872898 - RNA, 13 nt, Homo sapiens
ccuugcugugaaa

SEQ ID NO: 1872899 - RNA, 15 nt, Homo sapiens
cugugaaucaccuag

SEQ ID NO: 1872900 - RNA, 23 nt, Homo sapiens
aagaacuugggauaagaguguga

SEQ ID NO: 1872901 - RNA, 17 nt, Homo sapiens
ucaagagcuuccagaaa

SEQ ID NO: 1872902 - RNA, 19 nt, Homo sapiens
uuucaaugcugacuggacu

SEQ ID NO: 1872903 - RNA, 15 nt, Homo sapiens
cuuguugacucagcu

SEQ ID NO: 1872904 - RNA, 15 nt, Homo sapiens
cuugucuguuagcca

SEQ ID NO: 1872905 - RNA, 15 nt, Homo sapiens
gcaucugccaggaca

SEQ ID NO: 1872906 - RNA, 18 nt, Homo sapiens
cuauucuuggaaccacga

SEQ ID NO: 1872907 - RNA, 17 nt, Homo sapiens
ugcucuuuugugaugaa

SEQ ID NO: 1872908 - RNA, 16 nt, Homo sapiens
gugcccagagugacag

SEQ ID NO: 1872909 - RNA, 20 nt, Homo sapiens
uuccacugucuuucaaugac

SEQ ID NO: 1872910 - RNA, 13 nt, Homo sapiens
cuaaccugugacc

SEQ ID NO: 1872911 - RNA, 20 nt, Homo sapiens
gaacacuacucuuacaugua

SEQ ID NO: 1872912 - RNA, 21 nt, Homo sapiens
ugucaccggggcaacugccug

SEQ ID NO: 1872913 - RNA, 19 nt, Homo sapiens
uacuucauuuucagaguga

SEQ ID NO: 1872914 - RNA, 23 nt, Homo sapiens
cuugagucagaaaacagagaaag

SEQ ID NO: 1872915 - RNA, 21 nt, Homo sapiens
uacuugggaggcugagccagg

SEQ ID NO: 1872916 - RNA, 19 nt, Homo sapiens
cagaggacuuuauucggac

SEQ ID NO: 1872917 - RNA, 16 nt, Homo sapiens
gugauuuuuaaucgcu

SEQ ID NO: 1872918 - RNA, 14 nt, Homo sapiens
uucuccacuguucu

SEQ ID NO: 1872919 - RNA, 17 nt, Homo sapiens
ucauagcccucagacau

SEQ ID NO: 1872920 - RNA, 14 nt, Homo sapiens
accauggcacugag

SEQ ID NO: 1872921 - RNA, 17 nt, Homo sapiens
gauauguuuguacaaga

SEQ ID NO: 1872922 - RNA, 19 nt, Homo sapiens
ccuugcuuagccugugcug

SEQ ID NO: 1872923 - RNA, 14 nt, Homo sapiens
ucuauuuugcaaac

SEQ ID NO: 1872924 - RNA, 21 nt, Homo sapiens
agaucaagccugccucaauca

SEQ ID NO: 1872925 - RNA, 19 nt, Homo sapiens
accagagcugccaccugcc

SEQ ID NO: 1872926 - RNA, 12 nt, Homo sapiens
aaaccugaguga

SEQ ID NO: 1872927 - RNA, 22 nt, Homo sapiens
cauccuugucuuauucccuucc

SEQ ID NO: 1872928 - RNA, 15 nt, Homo sapiens
acuagauugcaugcu

SEQ ID NO: 1872929 - RNA, 11 nt, Homo sapiens
agaaacccugu

SEQ ID NO: 1872930 - RNA, 15 nt, Homo sapiens
auauuuaauauguca

SEQ ID NO: 1872931 - RNA, 15 nt, Homo sapiens
uuuuguaccaaauag

SEQ ID NO: 1872932 - RNA, 23 nt, Homo sapiens
uuucuaaauuuauauucauaaag

SEQ ID NO: 1872933 - RNA, 20 nt, Homo sapiens
uauaaauuuaucaacuguca

SEQ ID NO: 1872934 - RNA, 17 nt, Homo sapiens
aaucgacauccuagccc

SEQ ID NO: 1872935 - RNA, 17 nt, Homo sapiens
gucucaaucuccugacu

SEQ ID NO: 1872936 - RNA, 17 nt, Homo sapiens
gauaugcugcuugugac

SEQ ID NO: 1872937 - RNA, 23 nt, Homo sapiens
ugccaucucaauugugcuuugua

SEQ ID NO: 1872938 - RNA, 16 nt, Homo sapiens
cacgauuccagugcag

SEQ ID NO: 1872939 - RNA, 19 nt, Homo sapiens
gucauccugugaagggaca

SEQ ID NO: 1872940 - RNA, 14 nt, Homo sapiens
aggugcuuggcucu

SEQ ID NO: 1872941 - RNA, 20 nt, Homo sapiens
ugacaauuacucagguuuga

SEQ ID NO: 1872942 - RNA, 15 nt, Homo sapiens
uccacugucuuucaa

SEQ ID NO: 1872943 - RNA, 10 nt, Homo sapiens
ucugugaaag

SEQ ID NO: 1872944 - RNA, 23 nt, Homo sapiens
ccaccucggccucccacagugcu

SEQ ID NO: 1872945 - RNA, 15 nt, Homo sapiens
acauucaauagcaua

SEQ ID NO: 1872946 - RNA, 14 nt, Homo sapiens
augacugacccaaa

SEQ ID NO: 1872947 - RNA, 19 nt, Homo sapiens
guaucauucuuuacauauu

SEQ ID NO: 1872948 - RNA, 20 nt, Homo sapiens
ugugaggaugaaaggaguga

SEQ ID NO: 1872949 - RNA, 13 nt, Homo sapiens
aaauaaauucucu

SEQ ID NO: 1872950 - RNA, 12 nt, Homo sapiens
guacuauguaaa

SEQ ID NO: 1872951 - RNA, 19 nt, Homo sapiens
gcaggcuuugaguccagca

SEQ ID NO: 1872952 - RNA, 14 nt, Homo sapiens
guucuuuuacugua

SEQ ID NO: 1872953 - RNA, 18 nt, Homo sapiens
acaguguuggguguacca

SEQ ID NO: 1872954 - RNA, 22 nt, Homo sapiens
aggacucccucuaaguggaaua

SEQ ID NO: 1872955 - RNA, 16 nt, Homo sapiens
gaaggccuuucugcug

SEQ ID NO: 1872956 - RNA, 15 nt, Homo sapiens
gcugugucuuuagaa

SEQ ID NO: 1872957 - RNA, 22 nt, Homo sapiens
cucaaagaagucggaaugucau

SEQ ID NO: 1872958 - RNA, 19 nt, Homo sapiens
uggguacuauucugauuac

SEQ ID NO: 1872959 - RNA, 18 nt, Homo sapiens
gaauaaaugaaugcacaa

SEQ ID NO: 1872960 - RNA, 23 nt, Homo sapiens
aagaauuuuuauauccacuaaaa

SEQ ID NO: 1872961 - RNA, 20 nt, Homo sapiens
auggcuuaggaucgacaaga

SEQ ID NO: 1872962 - RNA, 14 nt, Homo sapiens
cccauucacaugcc

SEQ ID NO: 1872963 - RNA, 14 nt, Homo sapiens
uuuggugaggaccu

SEQ ID NO: 1872964 - RNA, 16 nt, Homo sapiens
agcgugggacccuuca

SEQ ID NO: 1872965 - RNA, 22 nt, Homo sapiens
uucacaccuagcgucaguauuu

SEQ ID NO: 1872966 - RNA, 13 nt, Homo sapiens
caaaugugacauu

SEQ ID NO: 1872967 - RNA, 17 nt, Homo sapiens
uagccuaucaagccuua

SEQ ID NO: 1872968 - RNA, 17 nt, Homo sapiens
cgagaucacaccacugu

SEQ ID NO: 1872969 - RNA, 14 nt, Homo sapiens
ccugaaaaccaucc

SEQ ID NO: 1872970 - RNA, 23 nt, Homo sapiens
cacuguuuuauuuuaauucaguu

SEQ ID NO: 1872971 - RNA, 18 nt, Homo sapiens
aauuaaaauucucaaaaa

SEQ ID NO: 1872972 - RNA, 13 nt, Homo sapiens
uuuauuccaaaau

SEQ ID NO: 1872973 - RNA, 23 nt, Homo sapiens
ugguguuguauacuucauuagca

SEQ ID NO: 1872974 - RNA, 21 nt, Homo sapiens
gcugucuacaaaaugccaagg

SEQ ID NO: 1872975 - RNA, 18 nt, Homo sapiens
aucccucauaccauggag

SEQ ID NO: 1872976 - RNA, 10 nt, Homo sapiens
uugcuuuaug

SEQ ID NO: 1872977 - RNA, 17 nt, Homo sapiens
ggccaccuuuugcucca

SEQ ID NO: 1872978 - RNA, 16 nt, Homo sapiens
gucacuggaaauugag

SEQ ID NO: 1872979 - RNA, 19 nt, Homo sapiens
accaagaaagcucacugua

SEQ ID NO: 1872980 - RNA, 15 nt, Homo sapiens
ccuacccacaugcac

SEQ ID NO: 1872981 - RNA, 23 nt, Homo sapiens
aggacacuggugguucuacugac

SEQ ID NO: 1872982 - RNA, 13 nt, Homo sapiens
uuaaaccuguucc

SEQ ID NO: 1872983 - RNA, 14 nt, Homo sapiens
augcugacagcucu

SEQ ID NO: 1872984 - RNA, 21 nt, Homo sapiens
cccacguggucgccugcauuu

SEQ ID NO: 1872985 - RNA, 17 nt, Homo sapiens
auaguauucaucugugu

SEQ ID NO: 1872986 - RNA, 14 nt, Homo sapiens
agccagaggaacca

SEQ ID NO: 1872987 - RNA, 15 nt, Homo sapiens
ccccuccacugucac

SEQ ID NO: 1872988 - RNA, 15 nt, Homo sapiens
gccuucaagugccaa

SEQ ID NO: 1872989 - RNA, 18 nt, Homo sapiens
auagcccaucaagcuccu

SEQ ID NO: 1872990 - RNA, 18 nt, Homo sapiens
aucacgucagugcucaga

SEQ ID NO: 1872991 - RNA, 22 nt, Homo sapiens
aacggacucaguggacacucag

SEQ ID NO: 1872992 - RNA, 22 nt, Homo sapiens
gguacaugccuguuaauauuca

SEQ ID NO: 1872993 - RNA, 13 nt, Homo sapiens
aaacgcuaccucu

SEQ ID NO: 1872994 - RNA, 14 nt, Homo sapiens
gcugaacauugcau

SEQ ID NO: 1872995 - RNA, 13 nt, Homo sapiens
ugugacacauaug

SEQ ID NO: 1872996 - RNA, 21 nt, Homo sapiens
gaaaacaguaaaugaacaaaa

SEQ ID NO: 1872997 - RNA, 14 nt, Homo sapiens
aaaaaauuaugaca

SEQ ID NO: 1872998 - RNA, 15 nt, Homo sapiens
agaugcuacuggacu

SEQ ID NO: 1872999 - RNA, 17 nt, Homo sapiens
acagcugcucaauaaag

SEQ ID NO: 1873000 - RNA, 17 nt, Homo sapiens
ggacucccgggccacgc

SEQ ID NO: 1873001 - RNA, 19 nt, Homo sapiens
ggacuugugucacaucucu

SEQ ID NO: 1873002 - RNA, 16 nt, Homo sapiens
auuccagaucuuucag

SEQ ID NO: 1873003 - RNA, 14 nt, Homo sapiens
gucacacaaaggca

SEQ ID NO: 1873004 - RNA, 21 nt, Homo sapiens
uccuggcuucuagaucuggaa

SEQ ID NO: 1873005 - RNA, 18 nt, Homo sapiens
uggauuuaugacauuaca

SEQ ID NO: 1873006 - RNA, 18 nt, Homo sapiens
cuugccaaauauaaauaa

SEQ ID NO: 1873007 - RNA, 14 nt, Homo sapiens
ugaaauaaguaaau

SEQ ID NO: 1873008 - RNA, 23 nt, Homo sapiens
aucuuuaacauaguccuguuacu

SEQ ID NO: 1873009 - RNA, 14 nt, Homo sapiens
agaugcacauagca

SEQ ID NO: 1873010 - RNA, 19 nt, Homo sapiens
uucuccuggccccugccug

SEQ ID NO: 1873011 - RNA, 17 nt, Homo sapiens
acugccagcagcuguuu

SEQ ID NO: 1873012 - RNA, 14 nt, Homo sapiens
gcugggagaaccaa

SEQ ID NO: 1873013 - RNA, 20 nt, Homo sapiens
ggcuggagugcaguggcaca

SEQ ID NO: 1873014 - RNA, 23 nt, Homo sapiens
caagacagcauuuguguguuaca

SEQ ID NO: 1873015 - RNA, 15 nt, Homo sapiens
ccugaugcagugcuc

SEQ ID NO: 1873016 - RNA, 13 nt, Homo sapiens
gaaauacuuucag

SEQ ID NO: 1873017 - RNA, 20 nt, Homo sapiens
aaccucaggcuuccuuggca

SEQ ID NO: 1873018 - RNA, 23 nt, Homo sapiens
gucauuaugaggggcacauucuu

SEQ ID NO: 1873019 - RNA, 21 nt, Homo sapiens
auaaauuuggaucauguuaug

SEQ ID NO: 1873020 - RNA, 19 nt, Homo sapiens
gugagggcagcacugggaa

SEQ ID NO: 1873021 - RNA, 14 nt, Homo sapiens
ucaagaccugagua

SEQ ID NO: 1873022 - RNA, 19 nt, Homo sapiens
cccuuuugcgugguccuua

SEQ ID NO: 1873023 - RNA, 21 nt, Homo sapiens
guuuccuuuuggaacauuucu

SEQ ID NO: 1873024 - RNA, 13 nt, Homo sapiens
aacauauccaaaa

SEQ ID NO: 1873025 - RNA, 13 nt, Homo sapiens
ccaaggaacaaga

SEQ ID NO: 1873026 - RNA, 14 nt, Homo sapiens
uaaugacauuucac

SEQ ID NO: 1873027 - RNA, 16 nt, Homo sapiens
cagaucacagcuucag

SEQ ID NO: 1873028 - RNA, 13 nt, Homo sapiens
ucuauugcugcuc

SEQ ID NO: 1873029 - RNA, 14 nt, Homo sapiens
ugcucacucccuca

SEQ ID NO: 1873030 - RNA, 18 nt, Homo sapiens
acagguucuaugauuugu

SEQ ID NO: 1873031 - RNA, 13 nt, Homo sapiens
uaauaaacauguc

SEQ ID NO: 1873032 - RNA, 12 nt, Homo sapiens
aagguccaggca

SEQ ID NO: 1873033 - RNA, 22 nt, Homo sapiens
agcugauauuauggcaagugau

SEQ ID NO: 1873034 - RNA, 19 nt, Homo sapiens
cccaguucauugcacuuug

SEQ ID NO: 1873035 - RNA, 16 nt, Homo sapiens
gugccaaguuccacuu

SEQ ID NO: 1873036 - RNA, 14 nt, Homo sapiens
aguuguacacugug

SEQ ID NO: 1873037 - RNA, 18 nt, Homo sapiens
uuugaaucuuucuguguc

SEQ ID NO: 1873038 - RNA, 12 nt, Homo sapiens
cauccccacuca

SEQ ID NO: 1873039 - RNA, 13 nt, Homo sapiens
cauggacacagac

SEQ ID NO: 1873040 - RNA, 20 nt, Homo sapiens
agcccucgucuagagcagac

SEQ ID NO: 1873041 - RNA, 14 nt, Homo sapiens
ugcccaggagacag

SEQ ID NO: 1873042 - RNA, 19 nt, Homo sapiens
aaaucauugugugucuuca

SEQ ID NO: 1873043 - RNA, 14 nt, Homo sapiens
gcuguuuccucacg

SEQ ID NO: 1873044 - RNA, 14 nt, Homo sapiens
acauguaugugugc

SEQ ID NO: 1873045 - RNA, 13 nt, Homo sapiens
auaagacuuccac

SEQ ID NO: 1873046 - RNA, 20 nt, Homo sapiens
ugcacaugaacauaugucca

SEQ ID NO: 1873047 - RNA, 16 nt, Homo sapiens
aaggguaugucagcua

SEQ ID NO: 1873048 - RNA, 18 nt, Homo sapiens
cccaaccucauggucaug

SEQ ID NO: 1873049 - RNA, 13 nt, Homo sapiens
ccuccuucugugg

SEQ ID NO: 1873050 - RNA, 22 nt, Homo sapiens
acuuuuuuuuaacacuuuggac

SEQ ID NO: 1873051 - RNA, 16 nt, Homo sapiens
ugauuucuaguguaua

SEQ ID NO: 1873052 - RNA, 23 nt, Homo sapiens
aaaaauuugaaccaaaacauucc

SEQ ID NO: 1873053 - RNA, 20 nt, Homo sapiens
agggugggaccccauuccag

SEQ ID NO: 1873054 - RNA, 23 nt, Homo sapiens
cuuuauuuacacuccucuaucau

SEQ ID NO: 1873055 - RNA, 22 nt, Homo sapiens
acuuccucacauggucugcuua

SEQ ID NO: 1873056 - RNA, 15 nt, Homo sapiens
aucccgauaccucag

SEQ ID NO: 1873057 - RNA, 14 nt, Homo sapiens
gaaggacuaugaca

SEQ ID NO: 1873058 - RNA, 20 nt, Homo sapiens
cccacuucucuacucuggaa

SEQ ID NO: 1873059 - RNA, 12 nt, Homo sapiens
uucuuucaggaa

SEQ ID NO: 1873060 - RNA, 12 nt, Homo sapiens
uaagcauuguau

SEQ ID NO: 1873061 - RNA, 14 nt, Homo sapiens
gagucauuguuaca

SEQ ID NO: 1873062 - RNA, 15 nt, Homo sapiens
caguucaaauccuca

SEQ ID NO: 1873063 - RNA, 20 nt, Homo sapiens
cuuuucuuuguaucauucau

SEQ ID NO: 1873064 - RNA, 12 nt, Homo sapiens
uuaauccagaau

SEQ ID NO: 1873065 - RNA, 16 nt, Homo sapiens
uggcagagcacagccc

SEQ ID NO: 1873066 - RNA, 16 nt, Homo sapiens
ucuuuucaucugggaa

SEQ ID NO: 1873067 - RNA, 14 nt, Homo sapiens
aagacaccauuuau

SEQ ID NO: 1873068 - RNA, 20 nt, Homo sapiens
cagccacuguuuguuuacaa

SEQ ID NO: 1873069 - RNA, 14 nt, Homo sapiens
gagccccacacgga

SEQ ID NO: 1873070 - RNA, 22 nt, Homo sapiens
ugugucuaucugcuuuugccua

SEQ ID NO: 1873071 - RNA, 15 nt, Homo sapiens
cccaggacauggcug

SEQ ID NO: 1873072 - RNA, 14 nt, Homo sapiens
cuccaccugugaga

SEQ ID NO: 1873073 - RNA, 20 nt, Homo sapiens
aagacuuugugacugucacu

SEQ ID NO: 1873074 - RNA, 15 nt, Homo sapiens
gcaaugggaaguaaa

SEQ ID NO: 1873075 - RNA, 15 nt, Homo sapiens
gaaaucuccagugug

SEQ ID NO: 1873076 - RNA, 19 nt, Homo sapiens
ucacuguuuaaagcuuuga

SEQ ID NO: 1873077 - RNA, 18 nt, Homo sapiens
ucucgugguaggacugua

SEQ ID NO: 1873078 - RNA, 23 nt, Homo sapiens
agcugaaagggaaggacagcugu

SEQ ID NO: 1873079 - RNA, 16 nt, Homo sapiens
aggucgagcugugcuc

SEQ ID NO: 1873080 - RNA, 17 nt, Homo sapiens
ccauucacagccaggag

SEQ ID NO: 1873081 - RNA, 16 nt, Homo sapiens
caugugcagacacuca

SEQ ID NO: 1873082 - RNA, 13 nt, Homo sapiens
acugacacuggua

SEQ ID NO: 1873083 - RNA, 13 nt, Homo sapiens
acuugcacugggg

SEQ ID NO: 1873084 - RNA, 15 nt, Homo sapiens
uggcacucucaggug

SEQ ID NO: 1873085 - RNA, 23 nt, Homo sapiens
ucuuuguuuuuuguuuucauuaa

SEQ ID NO: 1873086 - RNA, 15 nt, Homo sapiens
aaacucacugcucaa

SEQ ID NO: 1873087 - RNA, 14 nt, Homo sapiens
cugaagaaaguuau

SEQ ID NO: 1873088 - RNA, 14 nt, Homo sapiens
uuuauauuugucaa

SEQ ID NO: 1873089 - RNA, 18 nt, Homo sapiens
agauuguuaaauucaaug

SEQ ID NO: 1873090 - RNA, 22 nt, Homo sapiens
auuuucauguucuugcagucau

SEQ ID NO: 1873091 - RNA, 13 nt, Homo sapiens
ucaggguccagug

SEQ ID NO: 1873092 - RNA, 19 nt, Homo sapiens
uugcccccguggggcuccc

SEQ ID NO: 1873093 - RNA, 23 nt, Homo sapiens
acucuggcuucucuccucagacu

SEQ ID NO: 1873094 - RNA, 17 nt, Homo sapiens
gugacacucuccuugca

SEQ ID NO: 1873095 - RNA, 14 nt, Homo sapiens
cuggcaucacguca

SEQ ID NO: 1873096 - RNA, 12 nt, Homo sapiens
uuuuaauggugu

SEQ ID NO: 1873097 - RNA, 15 nt, Homo sapiens
aauaccacaugauuu

SEQ ID NO: 1873098 - RNA, 11 nt, Homo sapiens
aggcucugaaa

SEQ ID NO: 1873099 - RNA, 19 nt, Homo sapiens
aauuucucuuuacuugaaa

SEQ ID NO: 1873100 - RNA, 19 nt, Homo sapiens
ucaccauguuagccuuaga

SEQ ID NO: 1873101 - RNA, 17 nt, Homo sapiens
ucaugggaauauucaaa

SEQ ID NO: 1873102 - RNA, 15 nt, Homo sapiens
ucccuuggauaccua

SEQ ID NO: 1873103 - RNA, 17 nt, Homo sapiens
guucaaucaaacuuuca

SEQ ID NO: 1873104 - RNA, 17 nt, Homo sapiens
gaaauaugaagagcaaa

SEQ ID NO: 1873105 - RNA, 11 nt, Homo sapiens
uucuccugacc

SEQ ID NO: 1873106 - RNA, 21 nt, Homo sapiens
uuucccugggagcuguucucu

SEQ ID NO: 1873107 - RNA, 14 nt, Homo sapiens
aagcuuuagauuga

SEQ ID NO: 1873108 - RNA, 17 nt, Homo sapiens
aagcacuaccaguaucu

SEQ ID NO: 1873109 - RNA, 15 nt, Homo sapiens
ucagagagguagcac

SEQ ID NO: 1873110 - RNA, 17 nt, Homo sapiens
uacuauaaagcuuuugu

SEQ ID NO: 1873111 - RNA, 14 nt, Homo sapiens
uccuccaugggaga

SEQ ID NO: 1873112 - RNA, 16 nt, Homo sapiens
uacuguucuugcugcu

SEQ ID NO: 1873113 - RNA, 20 nt, Homo sapiens
uagcugagaagcaauggguc

SEQ ID NO: 1873114 - RNA, 19 nt, Homo sapiens
agaaacugccaaacuauuu

SEQ ID NO: 1873115 - RNA, 17 nt, Homo sapiens
aguguucugauuccuuc

SEQ ID NO: 1873116 - RNA, 17 nt, Homo sapiens
auuuuaaauguuuuaca

SEQ ID NO: 1873117 - RNA, 22 nt, Homo sapiens
auguguuaggggccuggcccaa

SEQ ID NO: 1873118 - RNA, 14 nt, Homo sapiens
ucuccuucaaaaca

SEQ ID NO: 1873119 - RNA, 16 nt, Homo sapiens
cuaaaguuacuacuga

SEQ ID NO: 1873120 - RNA, 15 nt, Homo sapiens
cugauuucagggaaa

SEQ ID NO: 1873121 - RNA, 18 nt, Homo sapiens
caacaugccagccacugu

SEQ ID NO: 1873122 - RNA, 21 nt, Homo sapiens
ucacgaagucaguaguuugag

SEQ ID NO: 1873123 - RNA, 16 nt, Homo sapiens
cugaagagcucuuggc

SEQ ID NO: 1873124 - RNA, 14 nt, Homo sapiens
caccccagagccau

SEQ ID NO: 1873125 - RNA, 21 nt, Homo sapiens
uaggaaaaauaaaacuucaca

SEQ ID NO: 1873126 - RNA, 23 nt, Homo sapiens
gaacucuccuggccuucuaggaa

SEQ ID NO: 1873127 - RNA, 13 nt, Homo sapiens
caaaaagacauua

SEQ ID NO: 1873128 - RNA, 15 nt, Homo sapiens
ccagauuuaugcaua

SEQ ID NO: 1873129 - RNA, 16 nt, Homo sapiens
uaucucaguaccccau

SEQ ID NO: 1873130 - RNA, 19 nt, Homo sapiens
ugggcugccugcuguguua

SEQ ID NO: 1873131 - RNA, 18 nt, Homo sapiens
uacagugagcucuagcaa

SEQ ID NO: 1873132 - RNA, 19 nt, Homo sapiens
ugccaccacaccuggcuaa

SEQ ID NO: 1873133 - RNA, 23 nt, Homo sapiens
cuuccaaggugguuuuacuucug

SEQ ID NO: 1873134 - RNA, 17 nt, Homo sapiens
auauuugcuaugaagcg

SEQ ID NO: 1873135 - RNA, 12 nt, Homo sapiens
auuuccacugaa

SEQ ID NO: 1873136 - RNA, 17 nt, Homo sapiens
ucaccuuuucccgggga

SEQ ID NO: 1873137 - RNA, 15 nt, Homo sapiens
gacuuaaaaccaaau

SEQ ID NO: 1873138 - RNA, 17 nt, Homo sapiens
ucccaguccuccagacc

SEQ ID NO: 1873139 - RNA, 22 nt, Homo sapiens
caugcuugcauuauauuuguaa

SEQ ID NO: 1873140 - RNA, 13 nt, Homo sapiens
uaucaaauguaac

SEQ ID NO: 1873141 - RNA, 20 nt, Homo sapiens
uauuuuaggaaacucuccau

SEQ ID NO: 1873142 - RNA, 17 nt, Homo sapiens
cccugccccguggagcc

SEQ ID NO: 1873143 - RNA, 15 nt, Homo sapiens
cuccagagacaggga

SEQ ID NO: 1873144 - RNA, 19 nt, Homo sapiens
cuucuccccuuccuggaca

SEQ ID NO: 1873145 - RNA, 14 nt, Homo sapiens
ggagccacaggcag

SEQ ID NO: 1873146 - RNA, 16 nt, Homo sapiens
auguagaccugugaga

SEQ ID NO: 1873147 - RNA, 20 nt, Homo sapiens
aguuauaucacuugcauauc

SEQ ID NO: 1873148 - RNA, 16 nt, Homo sapiens
uccaacuucccaguuc

SEQ ID NO: 1873149 - RNA, 21 nt, Homo sapiens
uauugaacuuuuguacugaau

SEQ ID NO: 1873150 - RNA, 18 nt, Homo sapiens
aauuuccuuacucuugau

SEQ ID NO: 1873151 - RNA, 14 nt, Homo sapiens
ccuguguucugggc

SEQ ID NO: 1873152 - RNA, 13 nt, Homo sapiens
agguccaccugcu

SEQ ID NO: 1873153 - RNA, 14 nt, Homo sapiens
uagccuugcacuuu

SEQ ID NO: 1873154 - RNA, 14 nt, Homo sapiens
gugauguuugcucu

SEQ ID NO: 1873155 - RNA, 17 nt, Homo sapiens
cugcacacucaguucug

SEQ ID NO: 1873156 - RNA, 14 nt, Homo sapiens
aauauuaccaaaaa

SEQ ID NO: 1873157 - RNA, 17 nt, Homo sapiens
cauggccugagcaucca

SEQ ID NO: 1873158 - RNA, 19 nt, Homo sapiens
uaaucaaugaucaucucac

SEQ ID NO: 1873159 - RNA, 18 nt, Homo sapiens
aaugucuaagaaauccag

SEQ ID NO: 1873160 - RNA, 15 nt, Homo sapiens
agaaguuuguuauag

SEQ ID NO: 1873161 - RNA, 21 nt, Homo sapiens
aaacacauuaagccuuccaca

SEQ ID NO: 1873162 - RNA, 18 nt, Homo sapiens
ucuuuguugaaguauuua

SEQ ID NO: 1873163 - RNA, 14 nt, Homo sapiens
ggcuauugaagaug

SEQ ID NO: 1873164 - RNA, 14 nt, Homo sapiens
cuuccuaauuuuag

SEQ ID NO: 1873165 - RNA, 14 nt, Homo sapiens
uaccaguucuugca

SEQ ID NO: 1873166 - RNA, 18 nt, Homo sapiens
guuugucagcaucugacc

SEQ ID NO: 1873167 - RNA, 17 nt, Homo sapiens
uuucaaacagcaucaaa

SEQ ID NO: 1873168 - RNA, 13 nt, Homo sapiens
ccccuacugaggc

SEQ ID NO: 1873169 - RNA, 16 nt, Homo sapiens
ccuguagucccagcua

SEQ ID NO: 1873170 - RNA, 19 nt, Homo sapiens
uauuacacggagugugcua

SEQ ID NO: 1873171 - RNA, 13 nt, Homo sapiens
gaucaauuacuua

SEQ ID NO: 1873172 - RNA, 14 nt, Homo sapiens
uguagaaaucucau

SEQ ID NO: 1873173 - RNA, 14 nt, Homo sapiens
caucaaagaugacu

SEQ ID NO: 1873174 - RNA, 17 nt, Homo sapiens
ccacaagcaauggaccu

SEQ ID NO: 1873175 - RNA, 17 nt, Homo sapiens
aacacauucuuauuaau

SEQ ID NO: 1873176 - RNA, 19 nt, Homo sapiens
ccagcacagauuugcuuuu

SEQ ID NO: 1873177 - RNA, 21 nt, Homo sapiens
gagauuugucuaauugcaucu

SEQ ID NO: 1873178 - RNA, 20 nt, Homo sapiens
cuucuucaucuugacaugua

SEQ ID NO: 1873179 - RNA, 20 nt, Homo sapiens
aggaaaaacucccauaucau

SEQ ID NO: 1873180 - RNA, 20 nt, Homo sapiens
ccuaugcugcaauacauuaa

SEQ ID NO: 1873181 - RNA, 11 nt, Homo sapiens
cgccugcaaac

SEQ ID NO: 1873182 - RNA, 18 nt, Homo sapiens
gcaagaacucaucacugu

SEQ ID NO: 1873183 - RNA, 13 nt, Homo sapiens
aaguucaugucua

SEQ ID NO: 1873184 - RNA, 14 nt, Homo sapiens
uaauagcgugugaa

SEQ ID NO: 1873185 - RNA, 20 nt, Homo sapiens
ggacuuuuauuuccagugaa

SEQ ID NO: 1873186 - RNA, 15 nt, Homo sapiens
guaaacagcucugug

SEQ ID NO: 1873187 - RNA, 21 nt, Homo sapiens
uggauaaauagauaccacuga

SEQ ID NO: 1873188 - RNA, 16 nt, Homo sapiens
ucuuuguauauuucua

SEQ ID NO: 1873189 - RNA, 16 nt, Homo sapiens
acacacaaaaacagaa

SEQ ID NO: 1873190 - RNA, 19 nt, Homo sapiens
uuucagacuucaucuucaa

SEQ ID NO: 1873191 - RNA, 14 nt, Homo sapiens
uauuaugugcaaca

SEQ ID NO: 1873192 - RNA, 14 nt, Homo sapiens
ugcuccaucucaua

SEQ ID NO: 1873193 - RNA, 17 nt, Homo sapiens
aaaguaugguauugaaa

SEQ ID NO: 1873194 - RNA, 15 nt, Homo sapiens
uacacugucaaacau

SEQ ID NO: 1873195 - RNA, 15 nt, Homo sapiens
cacgcuuguucacac

SEQ ID NO: 1873196 - RNA, 19 nt, Homo sapiens
caucuccucuguaaugauc

SEQ ID NO: 1873197 - RNA, 13 nt, Homo sapiens
ucuccuuugaggg

SEQ ID NO: 1873198 - RNA, 13 nt, Homo sapiens
ggaggaagacugu

SEQ ID NO: 1873199 - RNA, 14 nt, Homo sapiens
cuucccagugaauu

SEQ ID NO: 1873200 - RNA, 17 nt, Homo sapiens
caaaaccuuucaaagga

SEQ ID NO: 1873201 - RNA, 22 nt, Homo sapiens
cugagcuuuggacacacacagc

SEQ ID NO: 1873202 - RNA, 19 nt, Homo sapiens
uaaacauugccugauuugu

SEQ ID NO: 1873203 - RNA, 13 nt, Homo sapiens
auuggcagaagca

SEQ ID NO: 1873204 - RNA, 21 nt, Homo sapiens
cuauaacuuuugguaucuacu

SEQ ID NO: 1873205 - RNA, 20 nt, Homo sapiens
uuaaauuccacagauuauca

SEQ ID NO: 1873206 - RNA, 17 nt, Homo sapiens
uucacuacauugugcaa

SEQ ID NO: 1873207 - RNA, 22 nt, Homo sapiens
uagugguauuuuaacauagcag

SEQ ID NO: 1873208 - RNA, 23 nt, Homo sapiens
ccauaagucugauucucuuuaac

SEQ ID NO: 1873209 - RNA, 22 nt, Homo sapiens
uccuaauggcauggagacucug

SEQ ID NO: 1873210 - RNA, 22 nt, Homo sapiens
gacuuaaaauauuccugcauuu

SEQ ID NO: 1873211 - RNA, 16 nt, Homo sapiens
aaauaaaugccuucca

SEQ ID NO: 1873212 - RNA, 18 nt, Homo sapiens
ccuacugucuaagcaguu

SEQ ID NO: 1873213 - RNA, 15 nt, Homo sapiens
uaaaaaaaaaauuca

SEQ ID NO: 1873214 - RNA, 21 nt, Homo sapiens
gcugccugccgguaaacacgc

SEQ ID NO: 1873215 - RNA, 14 nt, Homo sapiens
caggucccuccuca

SEQ ID NO: 1873216 - RNA, 23 nt, Homo sapiens
uuugccucucgguugaaaccugu

SEQ ID NO: 1873217 - RNA, 13 nt, Homo sapiens
caguuaggugcug

SEQ ID NO: 1873218 - RNA, 19 nt, Homo sapiens
guuaaggcagugacuuuag

SEQ ID NO: 1873219 - RNA, 17 nt, Homo sapiens
uuuuuaacaggaauuua

SEQ ID NO: 1873220 - RNA, 15 nt, Homo sapiens
ugccaaggcaaaaaa

SEQ ID NO: 1873221 - RNA, 15 nt, Homo sapiens
aaguacuacauaccu

SEQ ID NO: 1873222 - RNA, 15 nt, Homo sapiens
uuaugaggucaagaa

SEQ ID NO: 1873223 - RNA, 23 nt, Homo sapiens
aucuaaaauaaacaagcuguggu

SEQ ID NO: 1873224 - RNA, 21 nt, Homo sapiens
ggugcccagaacuucccugau

SEQ ID NO: 1873225 - RNA, 17 nt, Homo sapiens
acacacucagugacauu

SEQ ID NO: 1873226 - RNA, 17 nt, Homo sapiens
uaaaaugucaagacagg

SEQ ID NO: 1873227 - RNA, 19 nt, Homo sapiens
aguaacccugucuaaugaa

SEQ ID NO: 1873228 - RNA, 19 nt, Homo sapiens
cugagccacagaugggcaa

SEQ ID NO: 1873229 - RNA, 17 nt, Homo sapiens
auuugaauauauacauu

SEQ ID NO: 1873230 - RNA, 15 nt, Homo sapiens
aaagcucuguugcaa

SEQ ID NO: 1873231 - RNA, 18 nt, Homo sapiens
ugacuagaacaacuugaa

SEQ ID NO: 1873232 - RNA, 18 nt, Homo sapiens
cucucuaggugucaggag

SEQ ID NO: 1873233 - RNA, 13 nt, Homo sapiens
cuucuucuugacc

SEQ ID NO: 1873234 - RNA, 20 nt, Homo sapiens
uuucuugaagaauaaauucu

SEQ ID NO: 1873235 - RNA, 22 nt, Homo sapiens
ggccacagccacuaaucaggag

SEQ ID NO: 1873236 - RNA, 16 nt, Homo sapiens
gcacucaaccaaccuc

SEQ ID NO: 1873237 - RNA, 20 nt, Homo sapiens
acaaggaaggaaaagaaaga

SEQ ID NO: 1873238 - RNA, 23 nt, Homo sapiens
cuggaagcauguaggagaaucca

SEQ ID NO: 1873239 - RNA, 17 nt, Homo sapiens
gagaccucagauguguu

SEQ ID NO: 1873240 - RNA, 20 nt, Homo sapiens
agcccucugcugcuuuccaa

SEQ ID NO: 1873241 - RNA, 17 nt, Homo sapiens
ucccaggacgcagggag

SEQ ID NO: 1873242 - RNA, 21 nt, Homo sapiens
aguuugauaccugcacugucc

SEQ ID NO: 1873243 - RNA, 21 nt, Homo sapiens
uugcuauaccacagucuuucg

SEQ ID NO: 1873244 - RNA, 19 nt, Homo sapiens
cauauuaguauuaauacua

SEQ ID NO: 1873245 - RNA, 16 nt, Homo sapiens
gcuacaguaaccaaaa

SEQ ID NO: 1873246 - RNA, 12 nt, Homo sapiens
caguaagccaag

SEQ ID NO: 1873247 - RNA, 22 nt, Homo sapiens
uuugugcagagauaaagaccuu

SEQ ID NO: 1873248 - RNA, 16 nt, Homo sapiens
acgugcgcgaugugac

SEQ ID NO: 1873249 - RNA, 12 nt, Homo sapiens
aucaaauuucac

SEQ ID NO: 1873250 - RNA, 20 nt, Homo sapiens
aucuguagcuacacuguaua

SEQ ID NO: 1873251 - RNA, 17 nt, Homo sapiens
ucucacagcauuugcca

SEQ ID NO: 1873252 - RNA, 19 nt, Homo sapiens
ccagcaagaugaaacaggg

SEQ ID NO: 1873253 - RNA, 23 nt, Homo sapiens
cuugagcccuccccaggaauuug

SEQ ID NO: 1873254 - RNA, 11 nt, Homo sapiens
cuuuugguguc

SEQ ID NO: 1873255 - RNA, 10 nt, Homo sapiens
uauguaaaaa

SEQ ID NO: 1873256 - RNA, 10 nt, Homo sapiens
uuuguaaaau

SEQ ID NO: 1873257 - RNA, 21 nt, Homo sapiens
cucuucccauaccacccaaaa

SEQ ID NO: 1873258 - RNA, 17 nt, Homo sapiens
uagauuucuacacugag

SEQ ID NO: 1873259 - RNA, 23 nt, Homo sapiens
acuaaguucacggcaaaauguca

SEQ ID NO: 1873260 - RNA, 19 nt, Homo sapiens
gaacuccuauuccuugcuu

SEQ ID NO: 1873261 - RNA, 22 nt, Homo sapiens
aacacauugaaacuguauuuac

SEQ ID NO: 1873262 - RNA, 20 nt, Homo sapiens
caagugguuuccuggugcuu

SEQ ID NO: 1873263 - RNA, 22 nt, Homo sapiens
cauuugauuaaauuaugaauga

SEQ ID NO: 1873264 - RNA, 19 nt, Homo sapiens
gcugcugcccauguuucaa

SEQ ID NO: 1873265 - RNA, 13 nt, Homo sapiens
aaguucacacagu

SEQ ID NO: 1873266 - RNA, 18 nt, Homo sapiens
cacaagcagggcacucug

SEQ ID NO: 1873267 - RNA, 18 nt, Homo sapiens
cauagaguauagcucugu

SEQ ID NO: 1873268 - RNA, 19 nt, Homo sapiens
agaagacaacauuucucaa

SEQ ID NO: 1873269 - RNA, 16 nt, Homo sapiens
uguuauagaacuucau

SEQ ID NO: 1873270 - RNA, 18 nt, Homo sapiens
ggagcauuggcugagaga

SEQ ID NO: 1873271 - RNA, 15 nt, Homo sapiens
aagcuguugcuauuu

SEQ ID NO: 1873272 - RNA, 14 nt, Homo sapiens
cuucagauagaaaa

SEQ ID NO: 1873273 - RNA, 12 nt, Homo sapiens
agcuacaacagc

SEQ ID NO: 1873274 - RNA, 18 nt, Homo sapiens
guauuuacugacugcuua

SEQ ID NO: 1873275 - RNA, 20 nt, Homo sapiens
cuuucauucuucucacaucc

SEQ ID NO: 1873276 - RNA, 20 nt, Homo sapiens
cagccucccgaauagcuggg

SEQ ID NO: 1873277 - RNA, 20 nt, Homo sapiens
cagccucccgaguagcugga

SEQ ID NO: 1873278 - RNA, 23 nt, Homo sapiens
ccucgacacgcaacuggcucaaa

SEQ ID NO: 1873279 - RNA, 20 nt, Homo sapiens
ccaucucugugauuaccucu

SEQ ID NO: 1873280 - RNA, 21 nt, Homo sapiens
auauuuuccaaauuaugugga

SEQ ID NO: 1873281 - RNA, 14 nt, Homo sapiens
ccagcuggucuuca

SEQ ID NO: 1873282 - RNA, 19 nt, Homo sapiens
aaccgcgggggcugugagc

SEQ ID NO: 1873283 - RNA, 18 nt, Homo sapiens
aaugacuaaucagaugau

SEQ ID NO: 1873284 - RNA, 19 nt, Homo sapiens
uacuuaauuccuuucucau

SEQ ID NO: 1873285 - RNA, 20 nt, Homo sapiens
ccaccuggggaugaagcuca

SEQ ID NO: 1873286 - RNA, 14 nt, Homo sapiens
uaccaaaugcuuua

SEQ ID NO: 1873287 - RNA, 18 nt, Homo sapiens
caucuuccagaaguguga

SEQ ID NO: 1873288 - RNA, 18 nt, Homo sapiens
agccucggcagauguggc

SEQ ID NO: 1873289 - RNA, 16 nt, Homo sapiens
cugaacguggcacucu

SEQ ID NO: 1873290 - RNA, 17 nt, Homo sapiens
cuagcugccucaaguga

SEQ ID NO: 1873291 - RNA, 15 nt, Homo sapiens
auggaaacauuuuau

SEQ ID NO: 1873292 - RNA, 14 nt, Homo sapiens
aguggggaaggcau

SEQ ID NO: 1873293 - RNA, 17 nt, Homo sapiens
aagcuaguggcuucaaa

SEQ ID NO: 1873294 - RNA, 19 nt, Homo sapiens
ugucgagggaaagagaccc

SEQ ID NO: 1873295 - RNA, 16 nt, Homo sapiens
ugacaucucugcaauc

SEQ ID NO: 1873296 - RNA, 15 nt, Homo sapiens
gcuucuuucccuuag

SEQ ID NO: 1873297 - RNA, 19 nt, Homo sapiens
cccuacaucaaaugcucaa

SEQ ID NO: 1873298 - RNA, 17 nt, Homo sapiens
auggccucauguggcug

SEQ ID NO: 1873299 - RNA, 20 nt, Homo sapiens
aggacuuuagggaucugggg

SEQ ID NO: 1873300 - RNA, 23 nt, Homo sapiens
aacacucacauuuauucugcuca

SEQ ID NO: 1873301 - RNA, 20 nt, Homo sapiens
ugcagcuggaaaagggucuu

SEQ ID NO: 1873302 - RNA, 15 nt, Homo sapiens
agccccaucugugca

SEQ ID NO: 1873303 - RNA, 21 nt, Homo sapiens
ugcacaccuuggaauucgcuu

SEQ ID NO: 1873304 - RNA, 18 nt, Homo sapiens
cucggcucacugcauccu

SEQ ID NO: 1873305 - RNA, 14 nt, Homo sapiens
aacccaggcagcug

SEQ ID NO: 1873306 - RNA, 22 nt, Homo sapiens
agugugugguguuagggugcag

SEQ ID NO: 1873307 - RNA, 18 nt, Homo sapiens
augagcuccuuaaggcuc

SEQ ID NO: 1873308 - RNA, 22 nt, Homo sapiens
uucuguggcaacuuguacugaa

SEQ ID NO: 1873309 - RNA, 23 nt, Homo sapiens
caaucugccuguaucucucacua

SEQ ID NO: 1873310 - RNA, 23 nt, Homo sapiens
gagcacaauuucccuucauacuc

SEQ ID NO: 1873311 - RNA, 19 nt, Homo sapiens
cagcagagggaguagggcu

SEQ ID NO: 1873312 - RNA, 21 nt, Homo sapiens
aggaaaccuuuucaugccuuu

SEQ ID NO: 1873313 - RNA, 18 nt, Homo sapiens
agcccgcagcacauuucc

SEQ ID NO: 1873314 - RNA, 19 nt, Homo sapiens
augcuaugauuaaauuuac

SEQ ID NO: 1873315 - RNA, 12 nt, Homo sapiens
cccacaguguca

SEQ ID NO: 1873316 - RNA, 17 nt, Homo sapiens
agaagauuagcaugaaa

SEQ ID NO: 1873317 - RNA, 16 nt, Homo sapiens
ggacacccacagcugc

SEQ ID NO: 1873318 - RNA, 17 nt, Homo sapiens
aagcaggaaucagagac

SEQ ID NO: 1873319 - RNA, 21 nt, Homo sapiens
cagugcuggggguuucuguag

SEQ ID NO: 1873320 - RNA, 18 nt, Homo sapiens
aaguuucugcagcagaug

SEQ ID NO: 1873321 - RNA, 23 nt, Homo sapiens
cacgucugugcucuguccuugug

SEQ ID NO: 1873322 - RNA, 12 nt, Homo sapiens
acuacuguaaau

SEQ ID NO: 1873323 - RNA, 12 nt, Homo sapiens
aauacuguacau

SEQ ID NO: 1873324 - RNA, 12 nt, Homo sapiens
gcuucugugaaa

SEQ ID NO: 1873325 - RNA, 21 nt, Homo sapiens
agagcuguggcacagaccccc

SEQ ID NO: 1873326 - RNA, 23 nt, Homo sapiens
gugacgguaaccccauacucucc

SEQ ID NO: 1873327 - RNA, 13 nt, Homo sapiens
acuccacugcccu

SEQ ID NO: 1873328 - RNA, 17 nt, Homo sapiens
uagacuccauguaguua

SEQ ID NO: 1873329 - RNA, 21 nt, Homo sapiens
guagcuuaccagaagcuucca

SEQ ID NO: 1873330 - RNA, 17 nt, Homo sapiens
cacacagaggggaguca

SEQ ID NO: 1873331 - RNA, 14 nt, Homo sapiens
ugggccacagccau

SEQ ID NO: 1873332 - RNA, 13 nt, Homo sapiens
aaaccuuccccag

SEQ ID NO: 1873333 - RNA, 14 nt, Homo sapiens
aucuguaacagggu

SEQ ID NO: 1873334 - RNA, 15 nt, Homo sapiens
gcacugcucucaccu

SEQ ID NO: 1873335 - RNA, 19 nt, Homo sapiens
agcuaauaacaugugaaaa

SEQ ID NO: 1873336 - RNA, 16 nt, Homo sapiens
ucagagaauuaucuca

SEQ ID NO: 1873337 - RNA, 15 nt, Homo sapiens
gaaauaaacacuggu

SEQ ID NO: 1873338 - RNA, 20 nt, Homo sapiens
uccacugacacaaaagaaga

SEQ ID NO: 1873339 - RNA, 21 nt, Homo sapiens
uuuuacauagaucauauugua

SEQ ID NO: 1873340 - RNA, 21 nt, Homo sapiens
agauacccuacgcuguccaga

SEQ ID NO: 1873341 - RNA, 14 nt, Homo sapiens
acucacacuggcca

SEQ ID NO: 1873342 - RNA, 14 nt, Homo sapiens
auugacacacagca

SEQ ID NO: 1873343 - RNA, 15 nt, Homo sapiens
ccaucacaaggggaa

SEQ ID NO: 1873344 - RNA, 17 nt, Homo sapiens
gcaauacauguaucuaa

SEQ ID NO: 1873345 - RNA, 17 nt, Homo sapiens
auucaaagagacauaua

SEQ ID NO: 1873346 - RNA, 23 nt, Homo sapiens
accaccuguguagucucucuagu

SEQ ID NO: 1873347 - RNA, 17 nt, Homo sapiens
aaagaauugcacguaug

SEQ ID NO: 1873348 - RNA, 20 nt, Homo sapiens
ccuccagcccccaguguccc

SEQ ID NO: 1873349 - RNA, 23 nt, Homo sapiens
aaagacugaaucuaccugcccua

SEQ ID NO: 1873350 - RNA, 19 nt, Homo sapiens
uuggguaagggacuccaga

SEQ ID NO: 1873351 - RNA, 17 nt, Homo sapiens
cagcgaagacugcuaaa

SEQ ID NO: 1873352 - RNA, 15 nt, Homo sapiens
ugcaggaaugcugac

SEQ ID NO: 1873353 - RNA, 20 nt, Homo sapiens
ugagagcaauuguaacgguu

SEQ ID NO: 1873354 - RNA, 21 nt, Homo sapiens
agcccccuguuuuaugcccuu

SEQ ID NO: 1873355 - RNA, 21 nt, Homo sapiens
uuggucucacuacuugaccau

SEQ ID NO: 1873356 - RNA, 21 nt, Homo sapiens
uacaaaaauuguucaaccuaa

SEQ ID NO: 1873357 - RNA, 18 nt, Homo sapiens
aaccauaaacuguacaaa

SEQ ID NO: 1873358 - RNA, 20 nt, Homo sapiens
caauaaaagugucacuaaga

SEQ ID NO: 1873359 - RNA, 21 nt, Homo sapiens
cucaggcuguuuuugggugca

SEQ ID NO: 1873360 - RNA, 17 nt, Homo sapiens
gguguuaaaaaccauua

SEQ ID NO: 1873361 - RNA, 18 nt, Homo sapiens
cuccucacucaccuucag

SEQ ID NO: 1873362 - RNA, 20 nt, Homo sapiens
gaaguuuaacaaguauuuau

SEQ ID NO: 1873363 - RNA, 15 nt, Homo sapiens
cuuggcucacugcaa

SEQ ID NO: 1873364 - RNA, 22 nt, Homo sapiens
gucaagaagcguuaugugcagu

SEQ ID NO: 1873365 - RNA, 22 nt, Homo sapiens
acccuguaaugguugggaccag

SEQ ID NO: 1873366 - RNA, 14 nt, Homo sapiens
ucccuugauucaaa

SEQ ID NO: 1873367 - RNA, 18 nt, Homo sapiens
gugagacccaaaggaaga

SEQ ID NO: 1873368 - RNA, 19 nt, Homo sapiens
aauaagggccuagaaacuc

SEQ ID NO: 1873369 - RNA, 13 nt, Homo sapiens
auucaugcaucuc

SEQ ID NO: 1873370 - RNA, 17 nt, Homo sapiens
uauucuuaaaaugcaau

SEQ ID NO: 1873371 - RNA, 20 nt, Homo sapiens
accugcgugguccauuccau

SEQ ID NO: 1873372 - RNA, 15 nt, Homo sapiens
ucaagaucacgccau

SEQ ID NO: 1873373 - RNA, 21 nt, Homo sapiens
ccagggagagcccaggagcuc

SEQ ID NO: 1873374 - RNA, 13 nt, Homo sapiens
uggcugcccagga

SEQ ID NO: 1873375 - RNA, 12 nt, Homo sapiens
gcugacaucugg

SEQ ID NO: 1873376 - RNA, 16 nt, Homo sapiens
cuggagcaauguugcu

SEQ ID NO: 1873377 - RNA, 20 nt, Homo sapiens
gggagccaagggauggacau

SEQ ID NO: 1873378 - RNA, 19 nt, Homo sapiens
gcagcuucgugugcagcua

SEQ ID NO: 1873379 - RNA, 15 nt, Homo sapiens
caaugacauaccuug

SEQ ID NO: 1873380 - RNA, 14 nt, Homo sapiens
gucugcccuuguca

SEQ ID NO: 1873381 - RNA, 21 nt, Homo sapiens
uggugcauuuauuauguucaa

SEQ ID NO: 1873382 - RNA, 22 nt, Homo sapiens
cucuguauuccgauacaaagug

SEQ ID NO: 1873383 - RNA, 20 nt, Homo sapiens
gcucuggaccaacccuguuu

SEQ ID NO: 1873384 - RNA, 18 nt, Homo sapiens
augcaugaguaugugcac

SEQ ID NO: 1873385 - RNA, 20 nt, Homo sapiens
uuagacaaccauagaacugu

SEQ ID NO: 1873386 - RNA, 16 nt, Homo sapiens
aauacaaguacuaggu

SEQ ID NO: 1873387 - RNA, 17 nt, Homo sapiens
ugugucuccaugcacau

SEQ ID NO: 1873388 - RNA, 20 nt, Homo sapiens
acaaacguauguaaauguau

SEQ ID NO: 1873389 - RNA, 23 nt, Homo sapiens
ggccaguauuuuuauuucuuuaa

SEQ ID NO: 1873390 - RNA, 13 nt, Homo sapiens
acugcuugugaga

SEQ ID NO: 1873391 - RNA, 18 nt, Homo sapiens
aacagcccucagacuguc

SEQ ID NO: 1873392 - RNA, 17 nt, Homo sapiens
ccacacacuuuccaucu

SEQ ID NO: 1873393 - RNA, 21 nt, Homo sapiens
gguuucacccuuaacccaagg

SEQ ID NO: 1873394 - RNA, 18 nt, Homo sapiens
uccaguguauaaauccaa

SEQ ID NO: 1873395 - RNA, 19 nt, Homo sapiens
aaaaucugccaccugcaca

SEQ ID NO: 1873396 - RNA, 17 nt, Homo sapiens
caggucaaaaaggccaa

SEQ ID NO: 1873397 - RNA, 17 nt, Homo sapiens
gacugaccauauugugc

SEQ ID NO: 1873398 - RNA, 13 nt, Homo sapiens
uaaagcagaggau

SEQ ID NO: 1873399 - RNA, 19 nt, Homo sapiens
guaaaugagccuuucugcc

SEQ ID NO: 1873400 - RNA, 18 nt, Homo sapiens
aaauaaaaaggaaguacu

SEQ ID NO: 1873401 - RNA, 21 nt, Homo sapiens
aaggccugacuucugcuggca

SEQ ID NO: 1873402 - RNA, 13 nt, Homo sapiens
cugccgaggugug

SEQ ID NO: 1873403 - RNA, 18 nt, Homo sapiens
gguuacagcaagagccac

SEQ ID NO: 1873404 - RNA, 22 nt, Homo sapiens
cuguggagacacugagucagaa

SEQ ID NO: 1873405 - RNA, 13 nt, Homo sapiens
aacauaccagacc

SEQ ID NO: 1873406 - RNA, 15 nt, Homo sapiens
cacaucuguccucac

SEQ ID NO: 1873407 - RNA, 14 nt, Homo sapiens
aacauuaugccuua

SEQ ID NO: 1873408 - RNA, 16 nt, Homo sapiens
auuucuaccuaaguca

SEQ ID NO: 1873409 - RNA, 19 nt, Homo sapiens
caucccaucauggcugcug

SEQ ID NO: 1873410 - RNA, 14 nt, Homo sapiens
aggucagguguuca

SEQ ID NO: 1873411 - RNA, 23 nt, Homo sapiens
aggucugaaucccgacucugaua

SEQ ID NO: 1873412 - RNA, 12 nt, Homo sapiens
agaaaguauuug

SEQ ID NO: 1873413 - RNA, 22 nt, Homo sapiens
uaauaguucuauccuuuugccu

SEQ ID NO: 1873414 - RNA, 16 nt, Homo sapiens
ggccugcccucaggga

SEQ ID NO: 1873415 - RNA, 19 nt, Homo sapiens
aggugugaaccacugugcc

SEQ ID NO: 1873416 - RNA, 23 nt, Homo sapiens
agacuaagggcgcuugucccauc

SEQ ID NO: 1873417 - RNA, 15 nt, Homo sapiens
gccucuccuuggaag

SEQ ID NO: 1873418 - RNA, 16 nt, Homo sapiens
acauauggacucugca

SEQ ID NO: 1873419 - RNA, 22 nt, Homo sapiens
uggaaaaggggugaccuaguag

SEQ ID NO: 1873420 - RNA, 22 nt, Homo sapiens
acauuuguuuuagucugaacaa

SEQ ID NO: 1873421 - RNA, 15 nt, Homo sapiens
acucccacuucuuca

SEQ ID NO: 1873422 - RNA, 21 nt, Homo sapiens
acuguggcuagugacaaauaa

SEQ ID NO: 1873423 - RNA, 14 nt, Homo sapiens
cugggcacagucag

SEQ ID NO: 1873424 - RNA, 12 nt, Homo sapiens
ggaguccagacc

SEQ ID NO: 1873425 - RNA, 14 nt, Homo sapiens
aggagaacaucuuu

SEQ ID NO: 1873426 - RNA, 20 nt, Homo sapiens
ccuucucugcuccaccacau

SEQ ID NO: 1873427 - RNA, 18 nt, Homo sapiens
ugaacuguaaauauguca

SEQ ID NO: 1873428 - RNA, 15 nt, Homo sapiens
aggagagggggcaag

SEQ ID NO: 1873429 - RNA, 12 nt, Homo sapiens
ccuauuacuuuu

SEQ ID NO: 1873430 - RNA, 20 nt, Homo sapiens
uuggaggacccagcacugac

SEQ ID NO: 1873431 - RNA, 21 nt, Homo sapiens
aacaaucuugucauacuugaa

SEQ ID NO: 1873432 - RNA, 15 nt, Homo sapiens
ugaagacauguuuca

SEQ ID NO: 1873433 - RNA, 21 nt, Homo sapiens
cccugaggauggccuggauuc

SEQ ID NO: 1873434 - RNA, 17 nt, Homo sapiens
uuaaaaaaauaagaaga

SEQ ID NO: 1873435 - RNA, 18 nt, Homo sapiens
gaaacgagaagugcccuu

SEQ ID NO: 1873436 - RNA, 13 nt, Homo sapiens
augcuugagaugu

SEQ ID NO: 1873437 - RNA, 13 nt, Homo sapiens
uauauuuugccug

SEQ ID NO: 1873438 - RNA, 15 nt, Homo sapiens
cuucagcaccugccc

SEQ ID NO: 1873439 - RNA, 19 nt, Homo sapiens
uccacaaaaacaacuuauu

SEQ ID NO: 1873440 - RNA, 16 nt, Homo sapiens
uacuucaaacugagau

SEQ ID NO: 1873441 - RNA, 13 nt, Homo sapiens
uccuucauucacu

SEQ ID NO: 1873442 - RNA, 13 nt, Homo sapiens
cccuccauccacc

SEQ ID NO: 1873443 - RNA, 13 nt, Homo sapiens
gucagaauauucu

SEQ ID NO: 1873444 - RNA, 14 nt, Homo sapiens
ucccccaaagccau

SEQ ID NO: 1873445 - RNA, 13 nt, Homo sapiens
gcaaggcugugcu

SEQ ID NO: 1873446 - RNA, 18 nt, Homo sapiens
uagaggcaaagaacaauu

SEQ ID NO: 1873447 - RNA, 20 nt, Homo sapiens
gagcaguguuuugcagaaug

SEQ ID NO: 1873448 - RNA, 19 nt, Homo sapiens
aaauaucucccucucucca

SEQ ID NO: 1873449 - RNA, 17 nt, Homo sapiens
ucaucauuaaugacuuu

SEQ ID NO: 1873450 - RNA, 22 nt, Homo sapiens
ccacauugcuuuucacauccau

SEQ ID NO: 1873451 - RNA, 21 nt, Homo sapiens
uggacucgcguucccaaagau

SEQ ID NO: 1873452 - RNA, 17 nt, Homo sapiens
uagucgaacaauucaua

SEQ ID NO: 1873453 - RNA, 23 nt, Homo sapiens
ucagaugauucuaugucucauga

SEQ ID NO: 1873454 - RNA, 22 nt, Homo sapiens
ccguguggguggcgggugcaca

SEQ ID NO: 1873455 - RNA, 13 nt, Homo sapiens
uaucaauucacau

SEQ ID NO: 1873456 - RNA, 21 nt, Homo sapiens
uugacauaggcaauaauaagu

SEQ ID NO: 1873457 - RNA, 18 nt, Homo sapiens
agaaagccagacaacuuc

SEQ ID NO: 1873458 - RNA, 19 nt, Homo sapiens
cuucucucccacacaagca

SEQ ID NO: 1873459 - RNA, 21 nt, Homo sapiens
caagaacagaaccugcaaaua

SEQ ID NO: 1873460 - RNA, 13 nt, Homo sapiens
cuagacugccagg

SEQ ID NO: 1873461 - RNA, 18 nt, Homo sapiens
uagguuucaccucccaaa

SEQ ID NO: 1873462 - RNA, 14 nt, Homo sapiens
ucuggaacugcugc

SEQ ID NO: 1873463 - RNA, 16 nt, Homo sapiens
aagccuacccuauucu

SEQ ID NO: 1873464 - RNA, 18 nt, Homo sapiens
caagaacaagucaccucc

SEQ ID NO: 1873465 - RNA, 15 nt, Homo sapiens
agcuuaaacauugcc

SEQ ID NO: 1873466 - RNA, 22 nt, Homo sapiens
gccccacauguccagcaccuug

SEQ ID NO: 1873467 - RNA, 16 nt, Homo sapiens
uccaacguggcccaga

SEQ ID NO: 1873468 - RNA, 15 nt, Homo sapiens
gcagccucacuucua

SEQ ID NO: 1873469 - RNA, 22 nt, Homo sapiens
guuucuuuguuuucgauuuuga

SEQ ID NO: 1873470 - RNA, 12 nt, Homo sapiens
ccuuggcuuuau

SEQ ID NO: 1873471 - RNA, 13 nt, Homo sapiens
aagcacagaauau

SEQ ID NO: 1873472 - RNA, 13 nt, Homo sapiens
uggaacagugucu

SEQ ID NO: 1873473 - RNA, 14 nt, Homo sapiens
ugguaagcaccagg

SEQ ID NO: 1873474 - RNA, 14 nt, Homo sapiens
aaagaacacccauc

SEQ ID NO: 1873475 - RNA, 14 nt, Homo sapiens
ccuucgacagcauu

SEQ ID NO: 1873476 - RNA, 22 nt, Homo sapiens
cccagcucggacuauacugcug

SEQ ID NO: 1873477 - RNA, 22 nt, Homo sapiens
gauucaucuucacagcacauuu

SEQ ID NO: 1873478 - RNA, 15 nt, Homo sapiens
uugcauacugaaaau

SEQ ID NO: 1873479 - RNA, 14 nt, Homo sapiens
uacuccuggcuuua

SEQ ID NO: 1873480 - RNA, 17 nt, Homo sapiens
ucugggcccccacuuuc

SEQ ID NO: 1873481 - RNA, 22 nt, Homo sapiens
cacacagaaaauauacuguaaa

SEQ ID NO: 1873482 - RNA, 20 nt, Homo sapiens
aaucugcugcauagcucuau

SEQ ID NO: 1873483 - RNA, 13 nt, Homo sapiens
cucuccaugcaag

SEQ ID NO: 1873484 - RNA, 20 nt, Homo sapiens
gggccugagagaauuggcuc

SEQ ID NO: 1873485 - RNA, 14 nt, Homo sapiens
uagugcaacuuaga

SEQ ID NO: 1873486 - RNA, 13 nt, Homo sapiens
aaugaacuguaaa

SEQ ID NO: 1873487 - RNA, 18 nt, Homo sapiens
cccuguauaucaggguac

SEQ ID NO: 1873488 - RNA, 16 nt, Homo sapiens
ccaaucuggacacuuc

SEQ ID NO: 1873489 - RNA, 18 nt, Homo sapiens
gauauucaaauggacaaa

SEQ ID NO: 1873490 - RNA, 19 nt, Homo sapiens
acuguuuugaaucucauaa

SEQ ID NO: 1873491 - RNA, 17 nt, Homo sapiens
uaguaccuucaauacuu

SEQ ID NO: 1873492 - RNA, 16 nt, Homo sapiens
ccuguagccacuggca

SEQ ID NO: 1873493 - RNA, 19 nt, Homo sapiens
cuggaucucacaagcacuu

SEQ ID NO: 1873494 - RNA, 23 nt, Homo sapiens
uauauguaugguuguuacuaugg

SEQ ID NO: 1873495 - RNA, 15 nt, Homo sapiens
uucggccuuggugaa

SEQ ID NO: 1873496 - RNA, 20 nt, Homo sapiens
gaaauucuaacgcaaaaaua

SEQ ID NO: 1873497 - RNA, 18 nt, Homo sapiens
cugaaaagggacugugag

SEQ ID NO: 1873498 - RNA, 13 nt, Homo sapiens
aaguguacaugaa

SEQ ID NO: 1873499 - RNA, 20 nt, Homo sapiens
acccuauuuagaaauggauu

SEQ ID NO: 1873500 - RNA, 20 nt, Homo sapiens
ccugucccaccccuaccucu

SEQ ID NO: 1873501 - RNA, 21 nt, Homo sapiens
ugccuaagaagaugacuuccc

SEQ ID NO: 1873502 - RNA, 14 nt, Homo sapiens
ccaagguauuuuua

SEQ ID NO: 1873503 - RNA, 19 nt, Homo sapiens
gcugaguagggacucaggg

SEQ ID NO: 1873504 - RNA, 15 nt, Homo sapiens
uaaaauggaugccuu

SEQ ID NO: 1873505 - RNA, 18 nt, Homo sapiens
ccuagauguaacauuccu

SEQ ID NO: 1873506 - RNA, 21 nt, Homo sapiens
uugaaagaaaaguauuuccaa

SEQ ID NO: 1873507 - RNA, 16 nt, Homo sapiens
augaacuguccuucca

SEQ ID NO: 1873508 - RNA, 14 nt, Homo sapiens
uaaaucacacugaa

SEQ ID NO: 1873509 - RNA, 15 nt, Homo sapiens
cuauucugaguucca

SEQ ID NO: 1873510 - RNA, 14 nt, Homo sapiens
cuguggaagcuuug

SEQ ID NO: 1873511 - RNA, 18 nt, Homo sapiens
guaucuuccaaguacuca

SEQ ID NO: 1873512 - RNA, 21 nt, Homo sapiens
ucuuuauacuuaaacagcuuu

SEQ ID NO: 1873513 - RNA, 20 nt, Homo sapiens
ucaaaagccauaacuugaaa

SEQ ID NO: 1873514 - RNA, 17 nt, Homo sapiens
gccaaggagcugcuaua

SEQ ID NO: 1873515 - RNA, 23 nt, Homo sapiens
aaaaguccaauguugugugcaug

SEQ ID NO: 1873516 - RNA, 20 nt, Homo sapiens
aauaacugagcacuuugaau

SEQ ID NO: 1873517 - RNA, 16 nt, Homo sapiens
guuucagaaguacugg

SEQ ID NO: 1873518 - RNA, 22 nt, Homo sapiens
ucuaaagauggaaaaaccaccc

SEQ ID NO: 1873519 - RNA, 23 nt, Homo sapiens
uacucagauaagguaaaaugcca

SEQ ID NO: 1873520 - RNA, 16 nt, Homo sapiens
aaaacuugacauguag

SEQ ID NO: 1873521 - RNA, 16 nt, Homo sapiens
cugcuggggaccucac

SEQ ID NO: 1873522 - RNA, 18 nt, Homo sapiens
ccugugaaccaacacaga

SEQ ID NO: 1873523 - RNA, 14 nt, Homo sapiens
augggaacacaagu

SEQ ID NO: 1873524 - RNA, 18 nt, Homo sapiens
cuucauaauuuccaugau

SEQ ID NO: 1873525 - RNA, 14 nt, Homo sapiens
aaagcugaagacca

SEQ ID NO: 1873526 - RNA, 20 nt, Homo sapiens
cccaggaaagaagcauuucu

SEQ ID NO: 1873527 - RNA, 18 nt, Homo sapiens
uggaaguucacuggaguc

SEQ ID NO: 1873528 - RNA, 17 nt, Homo sapiens
ugagguuucuucagggu

SEQ ID NO: 1873529 - RNA, 23 nt, Homo sapiens
cuauaauuguauauaugccuuug

SEQ ID NO: 1873530 - RNA, 18 nt, Homo sapiens
aggggaggacuaggaaaa

SEQ ID NO: 1873531 - RNA, 18 nt, Homo sapiens
augaggacagaccacaga

SEQ ID NO: 1873532 - RNA, 16 nt, Homo sapiens
uguuucaaacuuugga

SEQ ID NO: 1873533 - RNA, 11 nt, Homo sapiens
cggacaaauca

SEQ ID NO: 1873534 - RNA, 14 nt, Homo sapiens
ccagucucuggcag

SEQ ID NO: 1873535 - RNA, 13 nt, Homo sapiens
agauuucuucucu

SEQ ID NO: 1873536 - RNA, 13 nt, Homo sapiens
ucauaucuaguca

SEQ ID NO: 1873537 - RNA, 16 nt, Homo sapiens
uagguagaugagaaaa

SEQ ID NO: 1873538 - RNA, 14 nt, Homo sapiens
auaugauccagagc

SEQ ID NO: 1873539 - RNA, 16 nt, Homo sapiens
cacuuggagcuaaaac

SEQ ID NO: 1873540 - RNA, 20 nt, Homo sapiens
cauaugaauuuacuacuuua

SEQ ID NO: 1873541 - RNA, 14 nt, Homo sapiens
uggggcagacaaua

SEQ ID NO: 1873542 - RNA, 23 nt, Homo sapiens
ccuucucugaacacaggcagcuu

SEQ ID NO: 1873543 - RNA, 13 nt, Homo sapiens
uaucccacggaaa

SEQ ID NO: 1873544 - RNA, 15 nt, Homo sapiens
gauagcucauauuau

SEQ ID NO: 1873545 - RNA, 22 nt, Homo sapiens
uaaacauugguaagaaugagcu

SEQ ID NO: 1873546 - RNA, 22 nt, Homo sapiens
ugcuagcaaauggcagaaccaa

SEQ ID NO: 1873547 - RNA, 15 nt, Homo sapiens
caucuguuacauucu

SEQ ID NO: 1873548 - RNA, 13 nt, Homo sapiens
cauuuacauugcc

SEQ ID NO: 1873549 - RNA, 16 nt, Homo sapiens
cccuaaaagcauuuga

SEQ ID NO: 1873550 - RNA, 13 nt, Homo sapiens
gauuuugaaccca

SEQ ID NO: 1873551 - RNA, 16 nt, Homo sapiens
gcuccagucagugugc

SEQ ID NO: 1873552 - RNA, 20 nt, Homo sapiens
gcacacuagccucuccagga

SEQ ID NO: 1873553 - RNA, 20 nt, Homo sapiens
ugugauugacgggacuguug

SEQ ID NO: 1873554 - RNA, 22 nt, Homo sapiens
cuugaaauuaguuuaccucauc

SEQ ID NO: 1873555 - RNA, 15 nt, Homo sapiens
gcagaucugugccug

SEQ ID NO: 1873556 - RNA, 17 nt, Homo sapiens
cugaacccuaaggugag

SEQ ID NO: 1873557 - RNA, 14 nt, Homo sapiens
guuugaccaucacc

SEQ ID NO: 1873558 - RNA, 20 nt, Homo sapiens
gccaagagcagcugccauug

SEQ ID NO: 1873559 - RNA, 17 nt, Homo sapiens
ccuccgugauccaucca

SEQ ID NO: 1873560 - RNA, 17 nt, Homo sapiens
uuuccuccucccagugc

SEQ ID NO: 1873561 - RNA, 14 nt, Homo sapiens
ucaagucacuccca

SEQ ID NO: 1873562 - RNA, 14 nt, Homo sapiens
ccugaggcugugag

SEQ ID NO: 1873563 - RNA, 18 nt, Homo sapiens
ugcucacccauugucuca

SEQ ID NO: 1873564 - RNA, 15 nt, Homo sapiens
ucauccucaugcugc

SEQ ID NO: 1873565 - RNA, 22 nt, Homo sapiens
gaagaaugcacaagaauggauc

SEQ ID NO: 1873566 - RNA, 17 nt, Homo sapiens
auucucauuugucacac

SEQ ID NO: 1873567 - RNA, 21 nt, Homo sapiens
aagcccugaaccccaagcgcu

SEQ ID NO: 1873568 - RNA, 20 nt, Homo sapiens
aggaacacucugaauuccaa

SEQ ID NO: 1873569 - RNA, 14 nt, Homo sapiens
agggcuccuaucuu

SEQ ID NO: 1873570 - RNA, 21 nt, Homo sapiens
uccugaaauuugagagacaaa

SEQ ID NO: 1873571 - RNA, 18 nt, Homo sapiens
aggagcguguacuacccc

SEQ ID NO: 1873572 - RNA, 18 nt, Homo sapiens
ugcuugcucccaagcccc

SEQ ID NO: 1873573 - RNA, 18 nt, Homo sapiens
ugaaugaaaugccaauaa

SEQ ID NO: 1873574 - RNA, 19 nt, Homo sapiens
gaagggugccgcgagccag

SEQ ID NO: 1873575 - RNA, 15 nt, Homo sapiens
ugcugcaucaguggg

SEQ ID NO: 1873576 - RNA, 18 nt, Homo sapiens
ucacucuguugcucaggc

SEQ ID NO: 1873577 - RNA, 18 nt, Homo sapiens
acaauuuauccaaagcau

SEQ ID NO: 1873578 - RNA, 17 nt, Homo sapiens
agauugugguggugcua

SEQ ID NO: 1873579 - RNA, 21 nt, Homo sapiens
uuuaaucuuuuaugauugccu

SEQ ID NO: 1873580 - RNA, 16 nt, Homo sapiens
ccaccuuccuuaccuc

SEQ ID NO: 1873581 - RNA, 16 nt, Homo sapiens
auuaggcaugccuaau

SEQ ID NO: 1873582 - RNA, 14 nt, Homo sapiens
gggucucagaugga

SEQ ID NO: 1873583 - RNA, 22 nt, Homo sapiens
uuaacuucuguuuuaccagcau

SEQ ID NO: 1873584 - RNA, 16 nt, Homo sapiens
ccaucauuacugguaa

SEQ ID NO: 1873585 - RNA, 19 nt, Homo sapiens
uggcagggggcugcugcug

SEQ ID NO: 1873586 - RNA, 18 nt, Homo sapiens
uuaaauuauacuggagaa

SEQ ID NO: 1873587 - RNA, 17 nt, Homo sapiens
ucagguaguacugggaa

SEQ ID NO: 1873588 - RNA, 15 nt, Homo sapiens
gagccaaguuccaaa

SEQ ID NO: 1873589 - RNA, 21 nt, Homo sapiens
uauuugauaacaguuacucca

SEQ ID NO: 1873590 - RNA, 20 nt, Homo sapiens
ucccuccauucauccuucca

SEQ ID NO: 1873591 - RNA, 18 nt, Homo sapiens
aacaaaguuuucaugugc

SEQ ID NO: 1873592 - RNA, 20 nt, Homo sapiens
uuucuccagaacccauuuga

SEQ ID NO: 1873593 - RNA, 16 nt, Homo sapiens
acuggggcuggcacaa

SEQ ID NO: 1873594 - RNA, 14 nt, Homo sapiens
accacuuaucacau

SEQ ID NO: 1873595 - RNA, 16 nt, Homo sapiens
guaaaggcaagccagc

SEQ ID NO: 1873596 - RNA, 18 nt, Homo sapiens
gccugccgguaaacacgc

SEQ ID NO: 1873597 - RNA, 20 nt, Homo sapiens
aacacaagugcgccuugcaa

SEQ ID NO: 1873598 - RNA, 21 nt, Homo sapiens
uuuuucugcuuuagacuugaa

SEQ ID NO: 1873599 - RNA, 20 nt, Homo sapiens
ggaaaauacgaaaaucccau

SEQ ID NO: 1873600 - RNA, 22 nt, Homo sapiens
ccuuuuauguaauuucuuuaaa

SEQ ID NO: 1873601 - RNA, 18 nt, Homo sapiens
cccaaaggcccagggagg

SEQ ID NO: 1873602 - RNA, 16 nt, Homo sapiens
auggcugaagugcaug

SEQ ID NO: 1873603 - RNA, 23 nt, Homo sapiens
agacagucccugccaauggacua

SEQ ID NO: 1873604 - RNA, 21 nt, Homo sapiens
aaccuaaugggaaucauucca

SEQ ID NO: 1873605 - RNA, 17 nt, Homo sapiens
cugggacagcccaggaa

SEQ ID NO: 1873606 - RNA, 22 nt, Homo sapiens
cgcuaaaugaaaaucgugacaa

SEQ ID NO: 1873607 - RNA, 19 nt, Homo sapiens
guuuccugguccaucucau

SEQ ID NO: 1873608 - RNA, 17 nt, Homo sapiens
ucuaugaagaguauuaa

SEQ ID NO: 1873609 - RNA, 22 nt, Homo sapiens
ucuucuuaucacacuugcaaau

SEQ ID NO: 1873610 - RNA, 19 nt, Homo sapiens
accuuggacggaaugggau

SEQ ID NO: 1873611 - RNA, 16 nt, Homo sapiens
cuguccaacucuguau

SEQ ID NO: 1873612 - RNA, 15 nt, Homo sapiens
gacuuacaauaccau

SEQ ID NO: 1873613 - RNA, 19 nt, Homo sapiens
ugaagauuucauggacacu

SEQ ID NO: 1873614 - RNA, 20 nt, Homo sapiens
ggauaugagccuuugcacag

SEQ ID NO: 1873615 - RNA, 23 nt, Homo sapiens
cacuuuggacauggcucacaaac

SEQ ID NO: 1873616 - RNA, 23 nt, Homo sapiens
uggagcuccucccuccagcugcg

SEQ ID NO: 1873617 - RNA, 11 nt, Homo sapiens
cuguagguuaa

SEQ ID NO: 1873618 - RNA, 16 nt, Homo sapiens
aggaaaaucugaacuc

SEQ ID NO: 1873619 - RNA, 16 nt, Homo sapiens
cuuucaaacauguuga

SEQ ID NO: 1873620 - RNA, 21 nt, Homo sapiens
auuguuggaguguaaaccaaa

SEQ ID NO: 1873621 - RNA, 19 nt, Homo sapiens
cugcccccaucccacauga

SEQ ID NO: 1873622 - RNA, 23 nt, Homo sapiens
ugcagaaucucuauguauauucu

SEQ ID NO: 1873623 - RNA, 22 nt, Homo sapiens
ucacccuccacaaagcaaaggc

SEQ ID NO: 1873624 - RNA, 15 nt, Homo sapiens
cuuuauuccuuucag

SEQ ID NO: 1873625 - RNA, 18 nt, Homo sapiens
uaaauguauacuauagua

SEQ ID NO: 1873626 - RNA, 20 nt, Homo sapiens
aaagauaggaggaaccacaa

SEQ ID NO: 1873627 - RNA, 22 nt, Homo sapiens
aagggucacuggccucucccca

SEQ ID NO: 1873628 - RNA, 19 nt, Homo sapiens
uaggaggaugggcucgccc

SEQ ID NO: 1873629 - RNA, 22 nt, Homo sapiens
cauagaggugagggaagccuga

SEQ ID NO: 1873630 - RNA, 22 nt, Homo sapiens
agggcaguguggugggaggggu

SEQ ID NO: 1873631 - RNA, 17 nt, Homo sapiens
caggaacccuccagacc

SEQ ID NO: 1873632 - RNA, 19 nt, Homo sapiens
uugcuccacucgcacuuau

SEQ ID NO: 1873633 - RNA, 15 nt, Homo sapiens
uucagauauuccagg

SEQ ID NO: 1873634 - RNA, 21 nt, Homo sapiens
uacuuugaagucauaccaaug

SEQ ID NO: 1873635 - RNA, 23 nt, Homo sapiens
gagcucacaguacaauguuucag

SEQ ID NO: 1873636 - RNA, 22 nt, Homo sapiens
gcaagauuggcauaucauugua

SEQ ID NO: 1873637 - RNA, 16 nt, Homo sapiens
ugagcuggcugacuaa

SEQ ID NO: 1873638 - RNA, 15 nt, Homo sapiens
agaugccaaaaaaga

SEQ ID NO: 1873639 - RNA, 22 nt, Homo sapiens
agcaagccaucauccuccauug

SEQ ID NO: 1873640 - RNA, 15 nt, Homo sapiens
uguagcaguaucuca

SEQ ID NO: 1873641 - RNA, 23 nt, Homo sapiens
gacacccuucccuggauccagac

SEQ ID NO: 1873642 - RNA, 22 nt, Homo sapiens
acuuagcauuuucugcaucucc

SEQ ID NO: 1873643 - RNA, 15 nt, Homo sapiens
cagucucucaaagac

SEQ ID NO: 1873644 - RNA, 16 nt, Homo sapiens
cuuuccucuagcuuuu

SEQ ID NO: 1873645 - RNA, 19 nt, Homo sapiens
aacuuuauuggucuugccc

SEQ ID NO: 1873646 - RNA, 22 nt, Homo sapiens
ccucccuguaaugcacuccugc

SEQ ID NO: 1873647 - RNA, 16 nt, Homo sapiens
gcugccccaccugccg

SEQ ID NO: 1873648 - RNA, 20 nt, Homo sapiens
ccagugacacuaaaacaaga

SEQ ID NO: 1873649 - RNA, 21 nt, Homo sapiens
ggaauaaccuuccauacauuu

SEQ ID NO: 1873650 - RNA, 12 nt, Homo sapiens
cuucaacuaauu

SEQ ID NO: 1873651 - RNA, 15 nt, Homo sapiens
ugaaauuuuaccaag

SEQ ID NO: 1873652 - RNA, 23 nt, Homo sapiens
ucacaauccuguggaucugggca

SEQ ID NO: 1873653 - RNA, 18 nt, Homo sapiens
caguuguauaguauauga

SEQ ID NO: 1873654 - RNA, 15 nt, Homo sapiens
auugugagccaccac

SEQ ID NO: 1873655 - RNA, 21 nt, Homo sapiens
uaagcuuuggacccaaggaaa

SEQ ID NO: 1873656 - RNA, 18 nt, Homo sapiens
cacguacacacacauaca

SEQ ID NO: 1873657 - RNA, 20 nt, Homo sapiens
ggugccuuuugugugaugcg

SEQ ID NO: 1873658 - RNA, 21 nt, Homo sapiens
acaauccccacauaccaucug

SEQ ID NO: 1873659 - RNA, 21 nt, Homo sapiens
aauaguucuauccuuuugccu

SEQ ID NO: 1873660 - RNA, 16 nt, Homo sapiens
augacaacuuugccag

SEQ ID NO: 1873661 - RNA, 21 nt, Homo sapiens
ucaucuguaggucacucucca

SEQ ID NO: 1873662 - RNA, 17 nt, Homo sapiens
aauuggcucuagucacu

SEQ ID NO: 1873663 - RNA, 18 nt, Homo sapiens
ugccucucucauccacuu

SEQ ID NO: 1873664 - RNA, 16 nt, Homo sapiens
uacuaucucagagaua

SEQ ID NO: 1873665 - RNA, 18 nt, Homo sapiens
ucuucacuguguuuuaaa

SEQ ID NO: 1873666 - RNA, 15 nt, Homo sapiens
cuuuuaagaaacaca

SEQ ID NO: 1873667 - RNA, 20 nt, Homo sapiens
ggucuccugcccccacaccu

SEQ ID NO: 1873668 - RNA, 13 nt, Homo sapiens
auaucaagcuuaa

SEQ ID NO: 1873669 - RNA, 13 nt, Homo sapiens
auuaaaagcuauc

SEQ ID NO: 1873670 - RNA, 16 nt, Homo sapiens
augggcacagcacagc

SEQ ID NO: 1873671 - RNA, 22 nt, Homo sapiens
ugaucaaaaauaaacuaguuuc

SEQ ID NO: 1873672 - RNA, 19 nt, Homo sapiens
cuggugauuucugagauuu

SEQ ID NO: 1873673 - RNA, 21 nt, Homo sapiens
ucaccuuuugaccauaacugu

SEQ ID NO: 1873674 - RNA, 17 nt, Homo sapiens
acucaccuguucucacu

SEQ ID NO: 1873675 - RNA, 20 nt, Homo sapiens
ugccaaacacauuuacccuu

SEQ ID NO: 1873676 - RNA, 21 nt, Homo sapiens
caggcuuuuuuccagacucua

SEQ ID NO: 1873677 - RNA, 17 nt, Homo sapiens
cagaacuguuggcugcu

SEQ ID NO: 1873678 - RNA, 24 nt, Homo sapiens
cuaacuccuuaacaacuguagcaa

SEQ ID NO: 1873679 - RNA, 17 nt, Homo sapiens
uaagggugggugcucag

SEQ ID NO: 1873680 - RNA, 18 nt, Homo sapiens
cuauggagugcucacaaa

SEQ ID NO: 1873681 - RNA, 19 nt, Homo sapiens
auauauuuaauaugucaaa

SEQ ID NO: 1873682 - RNA, 23 nt, Homo sapiens
gguuucacuguggucucaaucuc

SEQ ID NO: 1873683 - RNA, 16 nt, Homo sapiens
cacuaccguaaauguc

SEQ ID NO: 1873684 - RNA, 21 nt, Homo sapiens
uaaaauaaacacuagacugua

SEQ ID NO: 1873685 - RNA, 18 nt, Homo sapiens
uuuuaaaagccuuggccu

SEQ ID NO: 1873686 - RNA, 23 nt, Homo sapiens
gugugaggccacacccagaguag

SEQ ID NO: 1873687 - RNA, 15 nt, Homo sapiens
cccagaggugcucca

SEQ ID NO: 1873688 - RNA, 19 nt, Homo sapiens
cccaggggccggccagugg

SEQ ID NO: 1873689 - RNA, 22 nt, Homo sapiens
caugcacaaaaagaugcaucua

SEQ ID NO: 1873690 - RNA, 20 nt, Homo sapiens
cgacagaagucuugucucaa

SEQ ID NO: 1873691 - RNA, 17 nt, Homo sapiens
aucucggcucauugaac

SEQ ID NO: 1873692 - RNA, 20 nt, Homo sapiens
augcuacagagagugaauac

SEQ ID NO: 1873693 - RNA, 15 nt, Homo sapiens
auggguucaccagcc

SEQ ID NO: 1873694 - RNA, 15 nt, Homo sapiens
ccggcccugugugca

SEQ ID NO: 1873695 - RNA, 21 nt, Homo sapiens
uaaaaggaaagaaaacaucuu

SEQ ID NO: 1873696 - RNA, 16 nt, Homo sapiens
uaggggucaggcucca

SEQ ID NO: 1873697 - RNA, 23 nt, Homo sapiens
cuccagagggugcgcucagagac

SEQ ID NO: 1873698 - RNA, 21 nt, Homo sapiens
guucucacuagaugacuguaa

SEQ ID NO: 1873699 - RNA, 22 nt, Homo sapiens
gccacgugguggcccagcuccu

SEQ ID NO: 1873700 - RNA, 19 nt, Homo sapiens
gggcugaagacgccacucc

SEQ ID NO: 1873701 - RNA, 12 nt, Homo sapiens
caucaccacagc

SEQ ID NO: 1873702 - RNA, 17 nt, Homo sapiens
ugaaguuuacauuguaa

SEQ ID NO: 1873703 - RNA, 15 nt, Homo sapiens
gaguuuguauuauua

SEQ ID NO: 1873704 - RNA, 20 nt, Homo sapiens
caagauuuugggagaguaaa

SEQ ID NO: 1873705 - RNA, 14 nt, Homo sapiens
caaaugagccauga

SEQ ID NO: 1873706 - RNA, 15 nt, Homo sapiens
ggcugggauggugac

SEQ ID NO: 1873707 - RNA, 20 nt, Homo sapiens
uauaggcaaagaaagcucua

SEQ ID NO: 1873708 - RNA, 13 nt, Homo sapiens
cgugccccugaag

SEQ ID NO: 1873709 - RNA, 23 nt, Homo sapiens
uuggagaaacccuugaaaagaca

SEQ ID NO: 1873710 - RNA, 15 nt, Homo sapiens
guccuagacaggugu

SEQ ID NO: 1873711 - RNA, 13 nt, Homo sapiens
uaaagcauugcaa

SEQ ID NO: 1873712 - RNA, 23 nt, Homo sapiens
gcuaugaggguccccgggagcac

SEQ ID NO: 1873713 - RNA, 17 nt, Homo sapiens
cagucaucugucuuuca

SEQ ID NO: 1873714 - RNA, 23 nt, Homo sapiens
aagagacucucuuagggaaacca

SEQ ID NO: 1873715 - RNA, 23 nt, Homo sapiens
cuuaggcuuuguaugacagugaa

SEQ ID NO: 1873716 - RNA, 21 nt, Homo sapiens
gcucauuauuaccacuuagaa

SEQ ID NO: 1873717 - RNA, 17 nt, Homo sapiens
augaaaacuaaggauuu

SEQ ID NO: 1873718 - RNA, 13 nt, Homo sapiens
gaggaaagaaaga

SEQ ID NO: 1873719 - RNA, 14 nt, Homo sapiens
auauaccuuacuga

SEQ ID NO: 1873720 - RNA, 22 nt, Homo sapiens
agguggggccucagccuggggc

SEQ ID NO: 1873721 - RNA, 22 nt, Homo sapiens
guucucugcuaaaacauuuggu

SEQ ID NO: 1873722 - RNA, 12 nt, Homo sapiens
cuucuccauaaa

SEQ ID NO: 1873723 - RNA, 13 nt, Homo sapiens
ccacaaaugccac

SEQ ID NO: 1873724 - RNA, 16 nt, Homo sapiens
gucuucucucuggcuc

SEQ ID NO: 1873725 - RNA, 22 nt, Homo sapiens
ccagguucuaauguguggaaug

SEQ ID NO: 1873726 - RNA, 22 nt, Homo sapiens
gccuguaaacuaaaaucuguua

SEQ ID NO: 1873727 - RNA, 22 nt, Homo sapiens
gguuuuuccuacuguccucaga

SEQ ID NO: 1873728 - RNA, 12 nt, Homo sapiens
ugugcagggaua

SEQ ID NO: 1873729 - RNA, 16 nt, Homo sapiens
uccacuggaaaacugc

SEQ ID NO: 1873730 - RNA, 21 nt, Homo sapiens
cuuccaaacagaacuauggaa

SEQ ID NO: 1873731 - RNA, 20 nt, Homo sapiens
uuuccuaccuugugcuuagc

SEQ ID NO: 1873732 - RNA, 20 nt, Homo sapiens
agcccugcucccagacauaa

SEQ ID NO: 1873733 - RNA, 17 nt, Homo sapiens
uaucugauuguugucag

SEQ ID NO: 1873734 - RNA, 18 nt, Homo sapiens
cuugagcuuggcagcuga

SEQ ID NO: 1873735 - RNA, 20 nt, Homo sapiens
acaaugucaugucugugauu

SEQ ID NO: 1873736 - RNA, 21 nt, Homo sapiens
uggcuccaggccagggggcca

SEQ ID NO: 1873737 - RNA, 13 nt, Homo sapiens
ccggccacacccc

SEQ ID NO: 1873738 - RNA, 13 nt, Homo sapiens
gcccucaccagcc

SEQ ID NO: 1873739 - RNA, 13 nt, Homo sapiens
aauuauaugauau

SEQ ID NO: 1873740 - RNA, 19 nt, Homo sapiens
aucaguaaaauuauacugu

SEQ ID NO: 1873741 - RNA, 13 nt, Homo sapiens
ucccuucaaugcu

SEQ ID NO: 1873742 - RNA, 21 nt, Homo sapiens
uucuaaaaucuuauaguucua

SEQ ID NO: 1873743 - RNA, 15 nt, Homo sapiens
caaaaucacacagcc

SEQ ID NO: 1873744 - RNA, 23 nt, Homo sapiens
gagcaugcucaguuggugcugcu

SEQ ID NO: 1873745 - RNA, 15 nt, Homo sapiens
aauauuacaauccuu

SEQ ID NO: 1873746 - RNA, 14 nt, Homo sapiens
uuuauuccuguaug

SEQ ID NO: 1873747 - RNA, 15 nt, Homo sapiens
gacccuggcuucucc

SEQ ID NO: 1873748 - RNA, 23 nt, Homo sapiens
ccagccugugguuacagugcaga

SEQ ID NO: 1873749 - RNA, 16 nt, Homo sapiens
caaaguuaaacgugau

SEQ ID NO: 1873750 - RNA, 16 nt, Homo sapiens
agaauaaaauacucuu

SEQ ID NO: 1873751 - RNA, 15 nt, Homo sapiens
aagugggcagucacc

SEQ ID NO: 1873752 - RNA, 17 nt, Homo sapiens
uugauaccucugcuggg

SEQ ID NO: 1873753 - RNA, 12 nt, Homo sapiens
cuuugaaaacug

SEQ ID NO: 1873754 - RNA, 15 nt, Homo sapiens
ugcacuucuguucca

SEQ ID NO: 1873755 - RNA, 18 nt, Homo sapiens
uuugaugguaaccauaau

SEQ ID NO: 1873756 - RNA, 21 nt, Homo sapiens
uacucuguccauuuauccaca

SEQ ID NO: 1873757 - RNA, 14 nt, Homo sapiens
acccaaacccccug

SEQ ID NO: 1873758 - RNA, 21 nt, Homo sapiens
cauggacagauagacagugcu

SEQ ID NO: 1873759 - RNA, 11 nt, Homo sapiens
uauuagcaaac

SEQ ID NO: 1873760 - RNA, 13 nt, Homo sapiens
acaugcacugacc

SEQ ID NO: 1873761 - RNA, 18 nt, Homo sapiens
uagcugaaccgacacuca

SEQ ID NO: 1873762 - RNA, 17 nt, Homo sapiens
auuucaggcacaucauu

SEQ ID NO: 1873763 - RNA, 15 nt, Homo sapiens
gagaggacacuucaa

SEQ ID NO: 1873764 - RNA, 13 nt, Homo sapiens
aggaacuggucca

SEQ ID NO: 1873765 - RNA, 24 nt, Homo sapiens
gcuugcccagggugcagugugagu

SEQ ID NO: 1873766 - RNA, 22 nt, Homo sapiens
ugguaccuuaauuugacugucc

SEQ ID NO: 1873767 - RNA, 20 nt, Homo sapiens
acaguauaaagggcaaagga

SEQ ID NO: 1873768 - RNA, 13 nt, Homo sapiens
uuuaugaaaugac

SEQ ID NO: 1873769 - RNA, 22 nt, Homo sapiens
agauugugauaagaaaagccag

SEQ ID NO: 1873770 - RNA, 19 nt, Homo sapiens
cuggaagaacccuucucag

SEQ ID NO: 1873771 - RNA, 16 nt, Homo sapiens
gugguaaaugccacac

SEQ ID NO: 1873772 - RNA, 13 nt, Homo sapiens
uugguuagcucac

SEQ ID NO: 1873773 - RNA, 17 nt, Homo sapiens
ccacuaauagcauuguc

SEQ ID NO: 1873774 - RNA, 13 nt, Homo sapiens
guuuaaaugccaa

SEQ ID NO: 1873775 - RNA, 21 nt, Homo sapiens
uacaucuuuuuuucuaugaaa

SEQ ID NO: 1873776 - RNA, 22 nt, Homo sapiens
acagacuacauuuucacaacuc

SEQ ID NO: 1873777 - RNA, 12 nt, Homo sapiens
agcugucaucac

SEQ ID NO: 1873778 - RNA, 19 nt, Homo sapiens
ucucggggccugugccgca

SEQ ID NO: 1873779 - RNA, 11 nt, Homo sapiens
caaaugagauc

SEQ ID NO: 1873780 - RNA, 17 nt, Homo sapiens
ccuguucaucuugccaa

SEQ ID NO: 1873781 - RNA, 16 nt, Homo sapiens
uaauauuacucuauga

SEQ ID NO: 1873782 - RNA, 22 nt, Homo sapiens
cuugcucucuucaauaaaccac

SEQ ID NO: 1873783 - RNA, 23 nt, Homo sapiens
cgguuugugagagcccagucauu

SEQ ID NO: 1873784 - RNA, 11 nt, Homo sapiens
cugaguuugcu

SEQ ID NO: 1873785 - RNA, 21 nt, Homo sapiens
uuguuucccaucagacuguca

SEQ ID NO: 1873786 - RNA, 16 nt, Homo sapiens
uuuguccaugugcaaa

SEQ ID NO: 1873787 - RNA, 23 nt, Homo sapiens
guaauaauuggagaagauuuaug

SEQ ID NO: 1873788 - RNA, 16 nt, Homo sapiens
aguuacagaauuccua

SEQ ID NO: 1873789 - RNA, 21 nt, Homo sapiens
gauggguggggagcaaaucau

SEQ ID NO: 1873790 - RNA, 18 nt, Homo sapiens
gaaauaaacgcuccccuc

SEQ ID NO: 1873791 - RNA, 15 nt, Homo sapiens
caugugggucuucca

SEQ ID NO: 1873792 - RNA, 21 nt, Homo sapiens
aauguuccaugucugaaguuu

SEQ ID NO: 1873793 - RNA, 20 nt, Homo sapiens
uaugaaaccacugcuggcag

SEQ ID NO: 1873794 - RNA, 20 nt, Homo sapiens
gcucugaacugcacaaugca

SEQ ID NO: 1873795 - RNA, 22 nt, Homo sapiens
ccagauacauggugaugguuag

SEQ ID NO: 1873796 - RNA, 12 nt, Homo sapiens
gucuaugcugcu

SEQ ID NO: 1873797 - RNA, 22 nt, Homo sapiens
aaccaaacccagacaaccaaaa

SEQ ID NO: 1873798 - RNA, 21 nt, Homo sapiens
aaacaaaaggguguauagugu

SEQ ID NO: 1873799 - RNA, 12 nt, Homo sapiens
ggcuggcuuccu

SEQ ID NO: 1873800 - RNA, 18 nt, Homo sapiens
ucuuuuaaugucaucucu

SEQ ID NO: 1873801 - RNA, 21 nt, Homo sapiens
uaaaauaagaaagcccuaaaa

SEQ ID NO: 1873802 - RNA, 13 nt, Homo sapiens
cuaagaagacauu

SEQ ID NO: 1873803 - RNA, 22 nt, Homo sapiens
cauuuagaaaauagagcuuuua

SEQ ID NO: 1873804 - RNA, 22 nt, Homo sapiens
gccagauuaccgacacugucac

SEQ ID NO: 1873805 - RNA, 11 nt, Homo sapiens
cagucagggac

SEQ ID NO: 1873806 - RNA, 19 nt, Homo sapiens
agaaauaaaaauaccucuu

SEQ ID NO: 1873807 - RNA, 19 nt, Homo sapiens
ggguucaagugauucucau

SEQ ID NO: 1873808 - RNA, 16 nt, Homo sapiens
uccuucaccucugaaa

SEQ ID NO: 1873809 - RNA, 18 nt, Homo sapiens
auuugcaaacuuacuuaa

SEQ ID NO: 1873810 - RNA, 23 nt, Homo sapiens
cuccaacccugccgucaccacca

SEQ ID NO: 1873811 - RNA, 18 nt, Homo sapiens
aggccuuugggauuugcc

SEQ ID NO: 1873812 - RNA, 12 nt, Homo sapiens
ucaggacucucu

SEQ ID NO: 1873813 - RNA, 19 nt, Homo sapiens
ugcugagagaaauauggaa

SEQ ID NO: 1873814 - RNA, 14 nt, Homo sapiens
cagaacacagugcc

SEQ ID NO: 1873815 - RNA, 19 nt, Homo sapiens
acuggaacaugcuuuuacu

SEQ ID NO: 1873816 - RNA, 12 nt, Homo sapiens
gcaacagacugu

SEQ ID NO: 1873817 - RNA, 12 nt, Homo sapiens
uagagauuacaa

SEQ ID NO: 1873818 - RNA, 10 nt, Homo sapiens
aaaaccaaug

SEQ ID NO: 1873819 - RNA, 23 nt, Homo sapiens
gugcccaaacaccagucaccucg

SEQ ID NO: 1873820 - RNA, 20 nt, Homo sapiens
ugacugauagcuuacacuga

SEQ ID NO: 1873821 - RNA, 14 nt, Homo sapiens
uccaacaccacaga

SEQ ID NO: 1873822 - RNA, 19 nt, Homo sapiens
uaauauuuuaauguacuaa

SEQ ID NO: 1873823 - RNA, 17 nt, Homo sapiens
acucagccacugucaca

SEQ ID NO: 1873824 - RNA, 12 nt, Homo sapiens
aaaucaguuuug

SEQ ID NO: 1873825 - RNA, 19 nt, Homo sapiens
gaauagacaguaugacaua

SEQ ID NO: 1873826 - RNA, 14 nt, Homo sapiens
gaggcagaucuuug

SEQ ID NO: 1873827 - RNA, 21 nt, Homo sapiens
auacuauuuaauuauuucacu

SEQ ID NO: 1873828 - RNA, 19 nt, Homo sapiens
guugguuaccuauugcugu

SEQ ID NO: 1873829 - RNA, 24 nt, Homo sapiens
uaagaaugugaugggccacaagga

SEQ ID NO: 1873830 - RNA, 16 nt, Homo sapiens
gccagggcaaugccau

SEQ ID NO: 1873831 - RNA, 22 nt, Homo sapiens
gaggcaggggcuuccuggugcu

SEQ ID NO: 1873832 - RNA, 20 nt, Homo sapiens
gugagacccugucucaaaaa

SEQ ID NO: 1873833 - RNA, 13 nt, Homo sapiens
acaggacugauuc

SEQ ID NO: 1873834 - RNA, 22 nt, Homo sapiens
aauauuuguugagauuuugcag

SEQ ID NO: 1873835 - RNA, 15 nt, Homo sapiens
auuaagcaucagaaa

SEQ ID NO: 1873836 - RNA, 19 nt, Homo sapiens
gcugucccugcagggccau

SEQ ID NO: 1873837 - RNA, 22 nt, Homo sapiens
gccugggguggggucaugcccu

SEQ ID NO: 1873838 - RNA, 20 nt, Homo sapiens
cuuccuaaacuuuccaaaac

SEQ ID NO: 1873839 - RNA, 15 nt, Homo sapiens
aacugucuuccucaa

SEQ ID NO: 1873840 - RNA, 16 nt, Homo sapiens
uaaaagcuacuaugua

SEQ ID NO: 1873841 - RNA, 19 nt, Homo sapiens
uaaaagugggaauuaggag

SEQ ID NO: 1873842 - RNA, 15 nt, Homo sapiens
caucucuauuucuca

SEQ ID NO: 1873843 - RNA, 22 nt, Homo sapiens
uguccacguaucuuugggucuu

SEQ ID NO: 1873844 - RNA, 19 nt, Homo sapiens
ucauaguguauaauaauau

SEQ ID NO: 1873845 - RNA, 22 nt, Homo sapiens
auuuccccucuuacaacuuuca

SEQ ID NO: 1873846 - RNA, 14 nt, Homo sapiens
uaauuccucuccag

SEQ ID NO: 1873847 - RNA, 14 nt, Homo sapiens
caacuuuugugcuc

SEQ ID NO: 1873848 - RNA, 18 nt, Homo sapiens
uacaugugagugacgaug

SEQ ID NO: 1873849 - RNA, 21 nt, Homo sapiens
gaaaaacaaguuugcuaguga

SEQ ID NO: 1873850 - RNA, 17 nt, Homo sapiens
cugcauggcauccucca

SEQ ID NO: 1873851 - RNA, 16 nt, Homo sapiens
ccaagucggaacagca

SEQ ID NO: 1873852 - RNA, 19 nt, Homo sapiens
cuucuauaauuuugccuuu

SEQ ID NO: 1873853 - RNA, 13 nt, Homo sapiens
accucauucugaa

SEQ ID NO: 1873854 - RNA, 23 nt, Homo sapiens
gaacaccauaccuuugcuacuac

SEQ ID NO: 1873855 - RNA, 14 nt, Homo sapiens
ccuucuuuaaacac

SEQ ID NO: 1873856 - RNA, 22 nt, Homo sapiens
aauacagaaguccccucuacuu

SEQ ID NO: 1873857 - RNA, 19 nt, Homo sapiens
agggccaaagaaccaaaga

SEQ ID NO: 1873858 - RNA, 15 nt, Homo sapiens
ccaguaugacaguau

SEQ ID NO: 1873859 - RNA, 21 nt, Homo sapiens
gacuaaauauuuaagugcagu

SEQ ID NO: 1873860 - RNA, 20 nt, Homo sapiens
uucccuaaagugaugggcuu

SEQ ID NO: 1873861 - RNA, 14 nt, Homo sapiens
uuuuguucauauuc

SEQ ID NO: 1873862 - RNA, 14 nt, Homo sapiens
aacacacaauauua

SEQ ID NO: 1873863 - RNA, 23 nt, Homo sapiens
ucagaguuugaaauaaaacuugg

SEQ ID NO: 1873864 - RNA, 15 nt, Homo sapiens
uugacuguacagaga

SEQ ID NO: 1873865 - RNA, 20 nt, Homo sapiens
cauuaaauguuugacacaau

SEQ ID NO: 1873866 - RNA, 19 nt, Homo sapiens
agcguucaaacugcuggaa

SEQ ID NO: 1873867 - RNA, 13 nt, Homo sapiens
guaauuccagcua

SEQ ID NO: 1873868 - RNA, 15 nt, Homo sapiens
cuaagcagaccacug

SEQ ID NO: 1873869 - RNA, 14 nt, Homo sapiens
auuugaccauucuu

SEQ ID NO: 1873870 - RNA, 19 nt, Homo sapiens
accccuagaaaggagagaa

SEQ ID NO: 1873871 - RNA, 16 nt, Homo sapiens
caccaguuccuuucaa

SEQ ID NO: 1873872 - RNA, 13 nt, Homo sapiens
guuuugagacaaa

SEQ ID NO: 1873873 - RNA, 17 nt, Homo sapiens
gaaucugauaccaaaga

SEQ ID NO: 1873874 - RNA, 20 nt, Homo sapiens
agcuaugauuaugccacugc

SEQ ID NO: 1873875 - RNA, 17 nt, Homo sapiens
gucuuuguucugugauu

SEQ ID NO: 1873876 - RNA, 21 nt, Homo sapiens
ggcaggaccagcccacgcuga

SEQ ID NO: 1873877 - RNA, 16 nt, Homo sapiens
uggggagggacacaga

SEQ ID NO: 1873878 - RNA, 21 nt, Homo sapiens
uauguucuccccuacauuagu

SEQ ID NO: 1873879 - RNA, 23 nt, Homo sapiens
gaagacauccugagcagugccag

SEQ ID NO: 1873880 - RNA, 21 nt, Homo sapiens
agguagcauucuuuggaguua

SEQ ID NO: 1873881 - RNA, 20 nt, Homo sapiens
uaauaugguguacauucuuc

SEQ ID NO: 1873882 - RNA, 18 nt, Homo sapiens
ucaagguuuaaccuuaaa

SEQ ID NO: 1873883 - RNA, 16 nt, Homo sapiens
ugguacuauugugacc

SEQ ID NO: 1873884 - RNA, 15 nt, Homo sapiens
ugcaccuacugcuua

SEQ ID NO: 1873885 - RNA, 23 nt, Homo sapiens
uacguuuguguggugacauuuua

SEQ ID NO: 1873886 - RNA, 18 nt, Homo sapiens
aaagccaacaaaccaaga

SEQ ID NO: 1873887 - RNA, 19 nt, Homo sapiens
cuuucaacagaauucacuu

SEQ ID NO: 1873888 - RNA, 23 nt, Homo sapiens
uagucaccccaaguagucugcuc

SEQ ID NO: 1873889 - RNA, 12 nt, Homo sapiens
cuauaccaauaa

SEQ ID NO: 1873890 - RNA, 15 nt, Homo sapiens
gaaaaaaaaaugcca

SEQ ID NO: 1873891 - RNA, 19 nt, Homo sapiens
ccaaucccaucuauucucu

SEQ ID NO: 1873892 - RNA, 17 nt, Homo sapiens
acgcugacuacagggcc

SEQ ID NO: 1873893 - RNA, 12 nt, Homo sapiens
cacccucaggaa

SEQ ID NO: 1873894 - RNA, 18 nt, Homo sapiens
ucaaauacacauuugcua

SEQ ID NO: 1873895 - RNA, 14 nt, Homo sapiens
ucugagcccccuga

SEQ ID NO: 1873896 - RNA, 14 nt, Homo sapiens
uuuaaaaaauacca

SEQ ID NO: 1873897 - RNA, 16 nt, Homo sapiens
ccacacuccacugaca

SEQ ID NO: 1873898 - RNA, 12 nt, Homo sapiens
aggaaugcaaga

SEQ ID NO: 1873899 - RNA, 12 nt, Homo sapiens
aauaaugcagua

SEQ ID NO: 1873900 - RNA, 12 nt, Homo sapiens
uaccaugcugcc

SEQ ID NO: 1873901 - RNA, 16 nt, Homo sapiens
gaggcagaaccuggug

SEQ ID NO: 1873902 - RNA, 19 nt, Homo sapiens
aaaugcugagccagccauc

SEQ ID NO: 1873903 - RNA, 24 nt, Homo sapiens
aaaauuggauuacaguauggcaau

SEQ ID NO: 1873904 - RNA, 13 nt, Homo sapiens
cuggaaggcuucc

SEQ ID NO: 1873905 - RNA, 16 nt, Homo sapiens
ccccuaaaccaaaaac

SEQ ID NO: 1873906 - RNA, 15 nt, Homo sapiens
gugccuccaaugugg

SEQ ID NO: 1873907 - RNA, 13 nt, Homo sapiens
ccagaagauucua

SEQ ID NO: 1873908 - RNA, 11 nt, Homo sapiens
uacaauuguga

SEQ ID NO: 1873909 - RNA, 13 nt, Homo sapiens
ugauacaucaucg

SEQ ID NO: 1873910 - RNA, 22 nt, Homo sapiens
caacagcuucuugcuuguaaaa

SEQ ID NO: 1873911 - RNA, 22 nt, Homo sapiens
acagaguguggucccuccacua

SEQ ID NO: 1873912 - RNA, 22 nt, Homo sapiens
cagcacuaaacuuggugcuuau

SEQ ID NO: 1873913 - RNA, 18 nt, Homo sapiens
cacccuccacucugaggu

SEQ ID NO: 1873914 - RNA, 21 nt, Homo sapiens
cagacacuggcguuacugcuu

SEQ ID NO: 1873915 - RNA, 15 nt, Homo sapiens
caagugcuauuucag

SEQ ID NO: 1873916 - RNA, 20 nt, Homo sapiens
cauuaaaaaugaaagccaaa

SEQ ID NO: 1873917 - RNA, 16 nt, Homo sapiens
uuaaauuauuuuauca

SEQ ID NO: 1873918 - RNA, 15 nt, Homo sapiens
cugcaaaaaaagccu

SEQ ID NO: 1873919 - RNA, 22 nt, Homo sapiens
cugcgcugguugaaaaauggca

SEQ ID NO: 1873920 - RNA, 9 nt, Homo sapiens
ggacacugc

SEQ ID NO: 1873921 - RNA, 19 nt, Homo sapiens
uccuggaagggaccugguu

SEQ ID NO: 1873922 - RNA, 23 nt, Homo sapiens
caggguguguguuuugacacuga

SEQ ID NO: 1873923 - RNA, 21 nt, Homo sapiens
gccuggcccuugaguggggca

SEQ ID NO: 1873924 - RNA, 15 nt, Homo sapiens
uagagaacugucacc

SEQ ID NO: 1873925 - RNA, 16 nt, Homo sapiens
ccucucucccuggacc

SEQ ID NO: 1873926 - RNA, 16 nt, Homo sapiens
auugucugagguaaau

SEQ ID NO: 1873927 - RNA, 17 nt, Homo sapiens
uccccuguggucuugga

SEQ ID NO: 1873928 - RNA, 16 nt, Homo sapiens
gccauuuucagaauca

SEQ ID NO: 1873929 - RNA, 12 nt, Homo sapiens
ucgcuuugccau

SEQ ID NO: 1873930 - RNA, 20 nt, Homo sapiens
uuaugguaccagaugcagcu

SEQ ID NO: 1873931 - RNA, 15 nt, Homo sapiens
cuaacuuuccuucau

SEQ ID NO: 1873932 - RNA, 12 nt, Homo sapiens
guucuaugagaa

SEQ ID NO: 1873933 - RNA, 20 nt, Homo sapiens
acaggaagcaccccaugcca

SEQ ID NO: 1873934 - RNA, 14 nt, Homo sapiens
uucaccucccaaac

SEQ ID NO: 1873935 - RNA, 19 nt, Homo sapiens
ugaauaaauguaucugaau

SEQ ID NO: 1873936 - RNA, 19 nt, Homo sapiens
gugcaguggcaucaucuca

SEQ ID NO: 1873937 - RNA, 17 nt, Homo sapiens
cauuuugaaugaagugu

SEQ ID NO: 1873938 - RNA, 14 nt, Homo sapiens
caccccucugucca

SEQ ID NO: 1873939 - RNA, 22 nt, Homo sapiens
agcuuuuauuccuuugaauauu

SEQ ID NO: 1873940 - RNA, 11 nt, Homo sapiens
auaugcaaauc

SEQ ID NO: 1873941 - RNA, 18 nt, Homo sapiens
cagugucucgaugccaua

SEQ ID NO: 1873942 - RNA, 20 nt, Homo sapiens
aucugcugggccaccagcca

SEQ ID NO: 1873943 - RNA, 20 nt, Homo sapiens
ggaaguaucuugguugugac

SEQ ID NO: 1873944 - RNA, 23 nt, Homo sapiens
acuguggagacuuucuguuacua

SEQ ID NO: 1873945 - RNA, 19 nt, Homo sapiens
ucuugaaguauauauauca

SEQ ID NO: 1873946 - RNA, 21 nt, Homo sapiens
cagaauaguuuacacacugug

SEQ ID NO: 1873947 - RNA, 14 nt, Homo sapiens
uaauaacagugcau

SEQ ID NO: 1873948 - RNA, 14 nt, Homo sapiens
uaaccucaguguca

SEQ ID NO: 1873949 - RNA, 18 nt, Homo sapiens
aagcaauuucuugcucua

SEQ ID NO: 1873950 - RNA, 21 nt, Homo sapiens
gcagagucguuggagacugaa

SEQ ID NO: 1873951 - RNA, 17 nt, Homo sapiens
aaacaucacaccugccc

SEQ ID NO: 1873952 - RNA, 21 nt, Homo sapiens
ccagggccagagcagcuccac

SEQ ID NO: 1873953 - RNA, 21 nt, Homo sapiens
uaaaaugcggcacuauuucug

SEQ ID NO: 1873954 - RNA, 13 nt, Homo sapiens
uauggcugcugaa

SEQ ID NO: 1873955 - RNA, 22 nt, Homo sapiens
cuucuaggauuuauuguuauau

SEQ ID NO: 1873956 - RNA, 20 nt, Homo sapiens
auaucugcuguccagacagc

SEQ ID NO: 1873957 - RNA, 15 nt, Homo sapiens
ccuaaccucauuccc

SEQ ID NO: 1873958 - RNA, 15 nt, Homo sapiens
aaagugcuagccacu

SEQ ID NO: 1873959 - RNA, 16 nt, Homo sapiens
acucuaauagugcuua

SEQ ID NO: 1873960 - RNA, 16 nt, Homo sapiens
uauuuaccuagugcaa

SEQ ID NO: 1873961 - RNA, 19 nt, Homo sapiens
ucacaggacucugccuccu

SEQ ID NO: 1873962 - RNA, 14 nt, Homo sapiens
aagcaauaagcucu

SEQ ID NO: 1873963 - RNA, 15 nt, Homo sapiens
uaauaguccuuugau

SEQ ID NO: 1873964 - RNA, 21 nt, Homo sapiens
uugcauauaguuaaacugaga

SEQ ID NO: 1873965 - RNA, 20 nt, Homo sapiens
ccagcacacggcugccugac

SEQ ID NO: 1873966 - RNA, 19 nt, Homo sapiens
cucaugccuguaaucccag

SEQ ID NO: 1873967 - RNA, 13 nt, Homo sapiens
cacagggagcucc

SEQ ID NO: 1873968 - RNA, 15 nt, Homo sapiens
aacaucacaccugcc

SEQ ID NO: 1873969 - RNA, 21 nt, Homo sapiens
ucauugaggauaaauugccau

SEQ ID NO: 1873970 - RNA, 22 nt, Homo sapiens
aaagaaaccacuucuggucaau

SEQ ID NO: 1873971 - RNA, 23 nt, Homo sapiens
ugucacaauucuuagaucuggug

SEQ ID NO: 1873972 - RNA, 14 nt, Homo sapiens
uaugcagaauguug

SEQ ID NO: 1873973 - RNA, 10 nt, Homo sapiens
gucuuugcag

SEQ ID NO: 1873974 - RNA, 21 nt, Homo sapiens
gcgagaaaccucccccaaugu

SEQ ID NO: 1873975 - RNA, 23 nt, Homo sapiens
gagugcuagcuagccagcugugu

SEQ ID NO: 1873976 - RNA, 16 nt, Homo sapiens
gaucaucagugauacu

SEQ ID NO: 1873977 - RNA, 16 nt, Homo sapiens
acuugcuaaagcacuu

SEQ ID NO: 1873978 - RNA, 14 nt, Homo sapiens
aaugucauagguaa

SEQ ID NO: 1873979 - RNA, 16 nt, Homo sapiens
ucucaaucagugcagu

SEQ ID NO: 1873980 - RNA, 13 nt, Homo sapiens
gucgcuuugccau

SEQ ID NO: 1873981 - RNA, 16 nt, Homo sapiens
uuagguuaaaguuaau

SEQ ID NO: 1873982 - RNA, 18 nt, Homo sapiens
gagcauccugcaagguga

SEQ ID NO: 1873983 - RNA, 15 nt, Homo sapiens
ccaggugauucuguu

SEQ ID NO: 1873984 - RNA, 15 nt, Homo sapiens
ccccacccaggagua

SEQ ID NO: 1873985 - RNA, 15 nt, Homo sapiens
accuuuuuaauccag

SEQ ID NO: 1873986 - RNA, 18 nt, Homo sapiens
aauaaauuuguaugcuca

SEQ ID NO: 1873987 - RNA, 16 nt, Homo sapiens
aaggaauccucuggga

SEQ ID NO: 1873988 - RNA, 23 nt, Homo sapiens
ucaagaaauaaaaggaagccaaa

SEQ ID NO: 1873989 - RNA, 18 nt, Homo sapiens
agguuauuguaggaauaa

SEQ ID NO: 1873990 - RNA, 16 nt, Homo sapiens
augaaguagcugagaa

SEQ ID NO: 1873991 - RNA, 15 nt, Homo sapiens
aaaguacuucaggca

SEQ ID NO: 1873992 - RNA, 23 nt, Homo sapiens
guucuacuauggcugaguucugg

SEQ ID NO: 1873993 - RNA, 19 nt, Homo sapiens
cagcugauugcacuaagcc

SEQ ID NO: 1873994 - RNA, 15 nt, Homo sapiens
uggcaaugaaacaaa

SEQ ID NO: 1873995 - RNA, 14 nt, Homo sapiens
uaucuaaaccauau

SEQ ID NO: 1873996 - RNA, 18 nt, Homo sapiens
aaaacuuuggaaccagac

SEQ ID NO: 1873997 - RNA, 19 nt, Homo sapiens
cauauccaggcaccaggac

SEQ ID NO: 1873998 - RNA, 12 nt, Homo sapiens
ccccaucauuaa

SEQ ID NO: 1873999 - RNA, 16 nt, Homo sapiens
gaagagaagcugagaa

SEQ ID NO: 1874000 - RNA, 16 nt, Homo sapiens
acacugucucuaccaa

SEQ ID NO: 1874001 - RNA, 21 nt, Homo sapiens
cugugcaugacagcggcaauc

SEQ ID NO: 1874002 - RNA, 16 nt, Homo sapiens
gggauagccauuucca

SEQ ID NO: 1874003 - RNA, 15 nt, Homo sapiens
uggcuaagcauuuau

SEQ ID NO: 1874004 - RNA, 17 nt, Homo sapiens
caugucucccaucagaa

SEQ ID NO: 1874005 - RNA, 15 nt, Homo sapiens
gcuuagagacuauca

SEQ ID NO: 1874006 - RNA, 14 nt, Homo sapiens
caguggucaugcuc

SEQ ID NO: 1874007 - RNA, 22 nt, Homo sapiens
uaguuggucuuuccaucuauca

SEQ ID NO: 1874008 - RNA, 16 nt, Homo sapiens
ugacccuccaccgcag

SEQ ID NO: 1874009 - RNA, 14 nt, Homo sapiens
auaugcugccaaau

SEQ ID NO: 1874010 - RNA, 17 nt, Homo sapiens
aacuggugauauaucuc

SEQ ID NO: 1874011 - RNA, 21 nt, Homo sapiens
uauguaaauagcuaagauaua

SEQ ID NO: 1874012 - RNA, 17 nt, Homo sapiens
cauccugagugugauga

SEQ ID NO: 1874013 - RNA, 18 nt, Homo sapiens
auaggacuaaguucucau

SEQ ID NO: 1874014 - RNA, 13 nt, Homo sapiens
gcaaagcaguaug

SEQ ID NO: 1874015 - RNA, 15 nt, Homo sapiens
cggcaccagugccuc

SEQ ID NO: 1874016 - RNA, 15 nt, Homo sapiens
cucacccaggcaauc

SEQ ID NO: 1874017 - RNA, 14 nt, Homo sapiens
acggagcacugcac

SEQ ID NO: 1874018 - RNA, 22 nt, Homo sapiens
aggaggagaaaucucacuuuuc

SEQ ID NO: 1874019 - RNA, 21 nt, Homo sapiens
gagaaaugauaagugacaaaa

SEQ ID NO: 1874020 - RNA, 18 nt, Homo sapiens
acugacaguaaaucucac

SEQ ID NO: 1874021 - RNA, 17 nt, Homo sapiens
ugagcuggguacugacu

SEQ ID NO: 1874022 - RNA, 16 nt, Homo sapiens
cauagguuacuaccua

SEQ ID NO: 1874023 - RNA, 19 nt, Homo sapiens
caauaaagaaugcaaucca

SEQ ID NO: 1874024 - RNA, 16 nt, Homo sapiens
gcuaauaauuugccau

SEQ ID NO: 1874025 - RNA, 16 nt, Homo sapiens
ucagaaacaucugauu

SEQ ID NO: 1874026 - RNA, 13 nt, Homo sapiens
gucagcaugaauu

SEQ ID NO: 1874027 - RNA, 23 nt, Homo sapiens
uccuccaagaauuugacuuggaa

SEQ ID NO: 1874028 - RNA, 17 nt, Homo sapiens
augcuuucccugaggaa

SEQ ID NO: 1874029 - RNA, 17 nt, Homo sapiens
aucugggggaguggaau

SEQ ID NO: 1874030 - RNA, 20 nt, Homo sapiens
uaaaaguuuuaaccucaggu

SEQ ID NO: 1874031 - RNA, 23 nt, Homo sapiens
uauuuuguaugaaauauauguga

SEQ ID NO: 1874032 - RNA, 23 nt, Homo sapiens
cccaaaggaacacugacaucaau

SEQ ID NO: 1874033 - RNA, 16 nt, Homo sapiens
aaauaacaacugagau

SEQ ID NO: 1874034 - RNA, 16 nt, Homo sapiens
gaauggcagcuggaau

SEQ ID NO: 1874035 - RNA, 14 nt, Homo sapiens
aucuucacugucuu

SEQ ID NO: 1874036 - RNA, 20 nt, Homo sapiens
ggacucaguucuuggccugc

SEQ ID NO: 1874037 - RNA, 22 nt, Homo sapiens
gggauggaagcaggacagacac

SEQ ID NO: 1874038 - RNA, 15 nt, Homo sapiens
caggcuuaugaauau

SEQ ID NO: 1874039 - RNA, 20 nt, Homo sapiens
aaggacaaagugccaaagaa

SEQ ID NO: 1874040 - RNA, 13 nt, Homo sapiens
acacagacucauc

SEQ ID NO: 1874041 - RNA, 17 nt, Homo sapiens
ccucugccucacaacau

SEQ ID NO: 1874042 - RNA, 18 nt, Homo sapiens
gagccccaaagaucccac

SEQ ID NO: 1874043 - RNA, 21 nt, Homo sapiens
gagcugaugccccuucucccc

SEQ ID NO: 1874044 - RNA, 17 nt, Homo sapiens
ucucauagguugccaau

SEQ ID NO: 1874045 - RNA, 15 nt, Homo sapiens
cauccuucuaagaca

SEQ ID NO: 1874046 - RNA, 14 nt, Homo sapiens
gaaagaaaugccca

SEQ ID NO: 1874047 - RNA, 17 nt, Homo sapiens
agcuuuacgcucaucac

SEQ ID NO: 1874048 - RNA, 21 nt, Homo sapiens
gauggccaccccagaggccac

SEQ ID NO: 1874049 - RNA, 14 nt, Homo sapiens
gauaagccacuggg

SEQ ID NO: 1874050 - RNA, 19 nt, Homo sapiens
agaccauauaacugugaug

SEQ ID NO: 1874051 - RNA, 22 nt, Homo sapiens
ugagaaggagggucucuugccc

SEQ ID NO: 1874052 - RNA, 15 nt, Homo sapiens
uguugcauauaguua

SEQ ID NO: 1874053 - RNA, 19 nt, Homo sapiens
auauaccguauguauuuau

SEQ ID NO: 1874054 - RNA, 20 nt, Homo sapiens
guugccccacucaucugccg

SEQ ID NO: 1874055 - RNA, 13 nt, Homo sapiens
uuucucuuugcca

SEQ ID NO: 1874056 - RNA, 17 nt, Homo sapiens
cuggaaggacacaguga

SEQ ID NO: 1874057 - RNA, 16 nt, Homo sapiens
uugcacacugcacugu

SEQ ID NO: 1874058 - RNA, 13 nt, Homo sapiens
cauuaaacacugu

SEQ ID NO: 1874059 - RNA, 15 nt, Homo sapiens
uaaaaagugugcuua

SEQ ID NO: 1874060 - RNA, 12 nt, Homo sapiens
uacaauauugca

SEQ ID NO: 1874061 - RNA, 14 nt, Homo sapiens
caaaaaaucuucca

SEQ ID NO: 1874062 - RNA, 15 nt, Homo sapiens
gggcccucccugcca

SEQ ID NO: 1874063 - RNA, 17 nt, Homo sapiens
ccaggcugcuagaggug

SEQ ID NO: 1874064 - RNA, 18 nt, Homo sapiens
ugaagaaagagacugugg

SEQ ID NO: 1874065 - RNA, 12 nt, Homo sapiens
cacccaccaggg

SEQ ID NO: 1874066 - RNA, 12 nt, Homo sapiens
cagccaccagcg

SEQ ID NO: 1874067 - RNA, 13 nt, Homo sapiens
uaaucccaccacc

SEQ ID NO: 1874068 - RNA, 20 nt, Homo sapiens
ccuuaucuaaaucaccagag

SEQ ID NO: 1874069 - RNA, 20 nt, Homo sapiens
gaaaagcccaugaucuucaa

SEQ ID NO: 1874070 - RNA, 21 nt, Homo sapiens
cgggacccccgucuccagggg

SEQ ID NO: 1874071 - RNA, 22 nt, Homo sapiens
aacccccagcccacagagccug

SEQ ID NO: 1874072 - RNA, 16 nt, Homo sapiens
agucacuuauugucca

SEQ ID NO: 1874073 - RNA, 22 nt, Homo sapiens
caucugccuccccuucacuccc

SEQ ID NO: 1874074 - RNA, 13 nt, Homo sapiens
cuucagccuucaa

SEQ ID NO: 1874075 - RNA, 14 nt, Homo sapiens
ucaguaguguacau

SEQ ID NO: 1874076 - RNA, 17 nt, Homo sapiens
guugauguaaugaaauu

SEQ ID NO: 1874077 - RNA, 19 nt, Homo sapiens
agagauuacuuugcugccu

SEQ ID NO: 1874078 - RNA, 21 nt, Homo sapiens
ggcagccuccugcucugugaa

SEQ ID NO: 1874079 - RNA, 22 nt, Homo sapiens
cccaacacaaacccccacucca

SEQ ID NO: 1874080 - RNA, 18 nt, Homo sapiens
agugccauuccacuccac

SEQ ID NO: 1874081 - RNA, 21 nt, Homo sapiens
cccuuacagccucugacuuaa

SEQ ID NO: 1874082 - RNA, 22 nt, Homo sapiens
uuggcccugggccccuggccau

SEQ ID NO: 1874083 - RNA, 15 nt, Homo sapiens
cagggaauucuuaca

SEQ ID NO: 1874084 - RNA, 14 nt, Homo sapiens
uucagggauucccu

SEQ ID NO: 1874085 - RNA, 23 nt, Homo sapiens
guuugaucccuguuacccagaga

SEQ ID NO: 1874086 - RNA, 15 nt, Homo sapiens
gcuucauuuuacuaa

SEQ ID NO: 1874087 - RNA, 23 nt, Homo sapiens
augccaauaacacguccacuuuc

SEQ ID NO: 1874088 - RNA, 11 nt, Homo sapiens
ugugaaagugc

SEQ ID NO: 1874089 - RNA, 17 nt, Homo sapiens
uuaaaacucaucacaua

SEQ ID NO: 1874090 - RNA, 19 nt, Homo sapiens
cacuuggugauauguccua

SEQ ID NO: 1874091 - RNA, 16 nt, Homo sapiens
ucugccauaucaguga

SEQ ID NO: 1874092 - RNA, 13 nt, Homo sapiens
aggcaauuucacc

SEQ ID NO: 1874093 - RNA, 16 nt, Homo sapiens
cugagaauuccaagga

SEQ ID NO: 1874094 - RNA, 20 nt, Homo sapiens
aucauuagagaaaugcaaau

SEQ ID NO: 1874095 - RNA, 22 nt, Homo sapiens
uguacauuauaaaccuucagaa

SEQ ID NO: 1874096 - RNA, 20 nt, Homo sapiens
accaugcagugccccuagcu

SEQ ID NO: 1874097 - RNA, 18 nt, Homo sapiens
agagguuugucaacaaaa

SEQ ID NO: 1874098 - RNA, 20 nt, Homo sapiens
acuugggccacugugaagag

SEQ ID NO: 1874099 - RNA, 22 nt, Homo sapiens
cucauggauuugaaugaaaugc

SEQ ID NO: 1874100 - RNA, 12 nt, Homo sapiens
aucucuugccug

SEQ ID NO: 1874101 - RNA, 16 nt, Homo sapiens
uggcgguggaccaaag

SEQ ID NO: 1874102 - RNA, 17 nt, Homo sapiens
uucugagacauguguca

SEQ ID NO: 1874103 - RNA, 16 nt, Homo sapiens
uuucacauuguacuua

SEQ ID NO: 1874104 - RNA, 10 nt, Homo sapiens
augucacuuu

SEQ ID NO: 1874105 - RNA, 20 nt, Homo sapiens
ucugccucccggguucaagc

SEQ ID NO: 1874106 - RNA, 22 nt, Homo sapiens
gcugccuccacucccacuuccc

SEQ ID NO: 1874107 - RNA, 22 nt, Homo sapiens
auugagauauaauuaacauaaa

SEQ ID NO: 1874108 - RNA, 17 nt, Homo sapiens
augugaaacacaugcca

SEQ ID NO: 1874109 - RNA, 14 nt, Homo sapiens
ggagaugaugauga

SEQ ID NO: 1874110 - RNA, 16 nt, Homo sapiens
auauaauuuauuucca

SEQ ID NO: 1874111 - RNA, 20 nt, Homo sapiens
ucauuauuucaucaugacug

SEQ ID NO: 1874112 - RNA, 18 nt, Homo sapiens
ugagacagcucugcauac

SEQ ID NO: 1874113 - RNA, 15 nt, Homo sapiens
ccauucccuagucau

SEQ ID NO: 1874114 - RNA, 13 nt, Homo sapiens
uccugucauggcu

SEQ ID NO: 1874115 - RNA, 17 nt, Homo sapiens
aacaugauacuauucag

SEQ ID NO: 1874116 - RNA, 16 nt, Homo sapiens
uuauuuauuuauucau

SEQ ID NO: 1874117 - RNA, 16 nt, Homo sapiens
gugugcauguguguau

SEQ ID NO: 1874118 - RNA, 16 nt, Homo sapiens
uagaauuauagaacua

SEQ ID NO: 1874119 - RNA, 19 nt, Homo sapiens
cuuccugccagcaggggug

SEQ ID NO: 1874120 - RNA, 14 nt, Homo sapiens
uaaauccaucacua

SEQ ID NO: 1874121 - RNA, 18 nt, Homo sapiens
gggagacucagccuuccu

SEQ ID NO: 1874122 - RNA, 19 nt, Homo sapiens
ucuuugucagcaguucccu

SEQ ID NO: 1874123 - RNA, 17 nt, Homo sapiens
aaauuaaucuugcuuca

SEQ ID NO: 1874124 - RNA, 21 nt, Homo sapiens
guagaacaccccugugcaaau

SEQ ID NO: 1874125 - RNA, 21 nt, Homo sapiens
gaauaaaaagguuggccuuag

SEQ ID NO: 1874126 - RNA, 14 nt, Homo sapiens
gaggagaucagggc

SEQ ID NO: 1874127 - RNA, 20 nt, Homo sapiens
aaggucuagacuaguuacau

SEQ ID NO: 1874128 - RNA, 12 nt, Homo sapiens
gggucuuugugg

SEQ ID NO: 1874129 - RNA, 19 nt, Homo sapiens
auuuaugacagugaacauu

SEQ ID NO: 1874130 - RNA, 16 nt, Homo sapiens
uucaaaaauauucauu

SEQ ID NO: 1874131 - RNA, 23 nt, Homo sapiens
caauucacuagaccagaagugga

SEQ ID NO: 1874132 - RNA, 12 nt, Homo sapiens
uuccuacuggag

SEQ ID NO: 1874133 - RNA, 21 nt, Homo sapiens
aagggagggguuaaugcagau

SEQ ID NO: 1874134 - RNA, 14 nt, Homo sapiens
ugcauguacuugaa

SEQ ID NO: 1874135 - RNA, 21 nt, Homo sapiens
aaguaguugauucagcccuca

SEQ ID NO: 1874136 - RNA, 23 nt, Homo sapiens
gccgcugugcuguugucugccgu

SEQ ID NO: 1874137 - RNA, 13 nt, Homo sapiens
aacaaaaccaacu

SEQ ID NO: 1874138 - RNA, 20 nt, Homo sapiens
accacaccuggcccuugcaa

SEQ ID NO: 1874139 - RNA, 21 nt, Homo sapiens
uuuaaaaaaaaauacugaugu

SEQ ID NO: 1874140 - RNA, 16 nt, Homo sapiens
gaaaaucacugugcug

SEQ ID NO: 1874141 - RNA, 14 nt, Homo sapiens
agaggggcuggacc

SEQ ID NO: 1874142 - RNA, 19 nt, Homo sapiens
gcccaggauggagugcagu

SEQ ID NO: 1874143 - RNA, 19 nt, Homo sapiens
ccagcacaacccccaggaa

SEQ ID NO: 1874144 - RNA, 14 nt, Homo sapiens
cagauggugaccca

SEQ ID NO: 1874145 - RNA, 17 nt, Homo sapiens
auuccagggaaccagag

SEQ ID NO: 1874146 - RNA, 19 nt, Homo sapiens
uaaaauucuggacacauua

SEQ ID NO: 1874147 - RNA, 22 nt, Homo sapiens
caagcuccuccucccugcaucu

SEQ ID NO: 1874148 - RNA, 20 nt, Homo sapiens
acugucauucccauuccuuu

SEQ ID NO: 1874149 - RNA, 12 nt, Homo sapiens
aaaaagcuucca

SEQ ID NO: 1874150 - RNA, 14 nt, Homo sapiens
aacucuuuggugca

SEQ ID NO: 1874151 - RNA, 20 nt, Homo sapiens
aagcaacaucuagcaaaugu

SEQ ID NO: 1874152 - RNA, 13 nt, Homo sapiens
auucuuagcaaaa

SEQ ID NO: 1874153 - RNA, 19 nt, Homo sapiens
aggccuuggggacaaccuu

SEQ ID NO: 1874154 - RNA, 15 nt, Homo sapiens
cuggccaugcugucc

SEQ ID NO: 1874155 - RNA, 20 nt, Homo sapiens
gacuauuucacuaauaaaca

SEQ ID NO: 1874156 - RNA, 13 nt, Homo sapiens
aucaagcuguaca

SEQ ID NO: 1874157 - RNA, 12 nt, Homo sapiens
ucugucaggggu

SEQ ID NO: 1874158 - RNA, 23 nt, Homo sapiens
ccugaugugggaacagcucuucu

SEQ ID NO: 1874159 - RNA, 17 nt, Homo sapiens
gcuguggaccguggaca

SEQ ID NO: 1874160 - RNA, 21 nt, Homo sapiens
aauaaccuaaaaaucaaucac

SEQ ID NO: 1874161 - RNA, 18 nt, Homo sapiens
uccaugagauagcuauua

SEQ ID NO: 1874162 - RNA, 21 nt, Homo sapiens
aaccuagaaguauuuuugucu

SEQ ID NO: 1874163 - RNA, 13 nt, Homo sapiens
aaauguacagcaa

SEQ ID NO: 1874164 - RNA, 13 nt, Homo sapiens
ccgcuagcucuuu

SEQ ID NO: 1874165 - RNA, 17 nt, Homo sapiens
uaacuuaugaaccuuua

SEQ ID NO: 1874166 - RNA, 17 nt, Homo sapiens
uguccuccccucaagga

SEQ ID NO: 1874167 - RNA, 23 nt, Homo sapiens
augcaguuuuucagaguggaaug

SEQ ID NO: 1874168 - RNA, 14 nt, Homo sapiens
gacuccuuggugcu

SEQ ID NO: 1874169 - RNA, 17 nt, Homo sapiens
acggugcccauccugcc

SEQ ID NO: 1874170 - RNA, 20 nt, Homo sapiens
gcuaaggaccuuaagacaga

SEQ ID NO: 1874171 - RNA, 16 nt, Homo sapiens
cuaccaccccacuggc

SEQ ID NO: 1874172 - RNA, 20 nt, Homo sapiens
gcugaauaaugaguuguucc

SEQ ID NO: 1874173 - RNA, 15 nt, Homo sapiens
gaacugcuucuaaga

SEQ ID NO: 1874174 - RNA, 20 nt, Homo sapiens
cgcccuuggcuucugugaug

SEQ ID NO: 1874175 - RNA, 19 nt, Homo sapiens
auuaaagaauguuuuggaa

SEQ ID NO: 1874176 - RNA, 18 nt, Homo sapiens
uggcuguggagacaaugu

SEQ ID NO: 1874177 - RNA, 19 nt, Homo sapiens
ggacugaucgauuugcacc

SEQ ID NO: 1874178 - RNA, 12 nt, Homo sapiens
aaagcacuaccu

SEQ ID NO: 1874179 - RNA, 12 nt, Homo sapiens
gaagcacugccu

SEQ ID NO: 1874180 - RNA, 12 nt, Homo sapiens
cacucacuccag

SEQ ID NO: 1874181 - RNA, 21 nt, Homo sapiens
ugaucccugaacauaguuuuc

SEQ ID NO: 1874182 - RNA, 12 nt, Homo sapiens
gcucaguauuuu

SEQ ID NO: 1874183 - RNA, 21 nt, Homo sapiens
gcagcacagucacccauggaa

SEQ ID NO: 1874184 - RNA, 15 nt, Homo sapiens
gcccaauguaaugca

SEQ ID NO: 1874185 - RNA, 19 nt, Homo sapiens
augcugcaguuccaaaaga

SEQ ID NO: 1874186 - RNA, 16 nt, Homo sapiens
aauacccucugacugu

SEQ ID NO: 1874187 - RNA, 15 nt, Homo sapiens
ccuggcugaccugcu

SEQ ID NO: 1874188 - RNA, 15 nt, Homo sapiens
agcucucuuccuguc

SEQ ID NO: 1874189 - RNA, 13 nt, Homo sapiens
cuguaaucaauau

SEQ ID NO: 1874190 - RNA, 19 nt, Homo sapiens
ggcucccucacucucagga

SEQ ID NO: 1874191 - RNA, 17 nt, Homo sapiens
ugaagaccaaucaaaua

SEQ ID NO: 1874192 - RNA, 21 nt, Homo sapiens
gcuucaccagagcauuuccaa

SEQ ID NO: 1874193 - RNA, 19 nt, Homo sapiens
uggcagaucuacaugucua

SEQ ID NO: 1874194 - RNA, 20 nt, Homo sapiens
agcccuggagucaugccaag

SEQ ID NO: 1874195 - RNA, 13 nt, Homo sapiens
aagugugcaugau

SEQ ID NO: 1874196 - RNA, 17 nt, Homo sapiens
gugaguuuuucuuuuga

SEQ ID NO: 1874197 - RNA, 12 nt, Homo sapiens
gaccuggcacag

SEQ ID NO: 1874198 - RNA, 21 nt, Homo sapiens
agugccucaccuuccaacacu

SEQ ID NO: 1874199 - RNA, 21 nt, Homo sapiens
ucaauaccugcugagaguacu

SEQ ID NO: 1874200 - RNA, 17 nt, Homo sapiens
agccauagagccugaaa

SEQ ID NO: 1874201 - RNA, 18 nt, Homo sapiens
aagauuccuguccuugag

SEQ ID NO: 1874202 - RNA, 16 nt, Homo sapiens
auauugagggagacag

SEQ ID NO: 1874203 - RNA, 16 nt, Homo sapiens
agucaaaacacuugua

SEQ ID NO: 1874204 - RNA, 19 nt, Homo sapiens
cagcugcauuucuuuugca

SEQ ID NO: 1874205 - RNA, 21 nt, Homo sapiens
cagccuggccaguauggugaa

SEQ ID NO: 1874206 - RNA, 13 nt, Homo sapiens
gcccagucuuuca

SEQ ID NO: 1874207 - RNA, 16 nt, Homo sapiens
agaaggagccuuguug

SEQ ID NO: 1874208 - RNA, 18 nt, Homo sapiens
ccccacaggagcguguac

SEQ ID NO: 1874209 - RNA, 23 nt, Homo sapiens
gggcagcucccagccucuuccca

SEQ ID NO: 1874210 - RNA, 15 nt, Homo sapiens
uucuguucaucuuaa

SEQ ID NO: 1874211 - RNA, 16 nt, Homo sapiens
ucucaaagaaggcauu

SEQ ID NO: 1874212 - RNA, 17 nt, Homo sapiens
gagacugugugugcccu

SEQ ID NO: 1874213 - RNA, 17 nt, Homo sapiens
ucuuauucuugugcacu

SEQ ID NO: 1874214 - RNA, 12 nt, Homo sapiens
ucuucagaauua

SEQ ID NO: 1874215 - RNA, 14 nt, Homo sapiens
uccccaauucaugu

SEQ ID NO: 1874216 - RNA, 13 nt, Homo sapiens
uaagaccuggcag

SEQ ID NO: 1874217 - RNA, 13 nt, Homo sapiens
aauucagcauuug

SEQ ID NO: 1874218 - RNA, 12 nt, Homo sapiens
augaagcuuugg

SEQ ID NO: 1874219 - RNA, 16 nt, Homo sapiens
cacuccacucugauuc

SEQ ID NO: 1874220 - RNA, 14 nt, Homo sapiens
ucccaacacuguca

SEQ ID NO: 1874221 - RNA, 15 nt, Homo sapiens
gagugagaugccugc

SEQ ID NO: 1874222 - RNA, 22 nt, Homo sapiens
acaguaauaaauuaaaccaaca

SEQ ID NO: 1874223 - RNA, 16 nt, Homo sapiens
acgacucuaaacacac

SEQ ID NO: 1874224 - RNA, 16 nt, Homo sapiens
aagaaucacuugaacc

SEQ ID NO: 1874225 - RNA, 20 nt, Homo sapiens
aaggacuccucagaaaaaac

SEQ ID NO: 1874226 - RNA, 15 nt, Homo sapiens
acucuaggguccagu

SEQ ID NO: 1874227 - RNA, 17 nt, Homo sapiens
agcaggggcuuguugca

SEQ ID NO: 1874228 - RNA, 20 nt, Homo sapiens
ugaacauuggagaaucucaa

SEQ ID NO: 1874229 - RNA, 21 nt, Homo sapiens
gcucagcuucuuccuaggucc

SEQ ID NO: 1874230 - RNA, 19 nt, Homo sapiens
aauuggaggaaaugaaugc

SEQ ID NO: 1874231 - RNA, 17 nt, Homo sapiens
caggaguccacugccuc

SEQ ID NO: 1874232 - RNA, 14 nt, Homo sapiens
accucccuccucag

SEQ ID NO: 1874233 - RNA, 15 nt, Homo sapiens
uuugagcaggucuca

SEQ ID NO: 1874234 - RNA, 14 nt, Homo sapiens
gauucccuguggug

SEQ ID NO: 1874235 - RNA, 16 nt, Homo sapiens
uuuuucuauuguacuc

SEQ ID NO: 1874236 - RNA, 21 nt, Homo sapiens
auaguguauaugcuaacugga

SEQ ID NO: 1874237 - RNA, 23 nt, Homo sapiens
cugggaaggagggagcugcucag

SEQ ID NO: 1874238 - RNA, 20 nt, Homo sapiens
agacuggcaauaaacuccua

SEQ ID NO: 1874239 - RNA, 15 nt, Homo sapiens
ugaaagcuauugaga

SEQ ID NO: 1874240 - RNA, 18 nt, Homo sapiens
uaauuaagaaaacuauua

SEQ ID NO: 1874241 - RNA, 14 nt, Homo sapiens
ccacugauaucaug

SEQ ID NO: 1874242 - RNA, 15 nt, Homo sapiens
uagaaauauauucau

SEQ ID NO: 1874243 - RNA, 16 nt, Homo sapiens
gcugcugcacccaacu

SEQ ID NO: 1874244 - RNA, 23 nt, Homo sapiens
ccugugucggggcugaccucuca

SEQ ID NO: 1874245 - RNA, 10 nt, Homo sapiens
cuucuaauau

SEQ ID NO: 1874246 - RNA, 23 nt, Homo sapiens
cucgagcaucagagcuuccagca

SEQ ID NO: 1874247 - RNA, 13 nt, Homo sapiens
cucuaaaaaccaa

SEQ ID NO: 1874248 - RNA, 21 nt, Homo sapiens
ggcugagcaucggaguggagu

SEQ ID NO: 1874249 - RNA, 22 nt, Homo sapiens
cucccacaaccccccacacucc

SEQ ID NO: 1874250 - RNA, 13 nt, Homo sapiens
agagagaggaauu

SEQ ID NO: 1874251 - RNA, 14 nt, Homo sapiens
uugcucacagcuga

SEQ ID NO: 1874252 - RNA, 14 nt, Homo sapiens
acacaaaacaaauc

SEQ ID NO: 1874253 - RNA, 18 nt, Homo sapiens
ggaaugacuuacuuuccu

SEQ ID NO: 1874254 - RNA, 21 nt, Homo sapiens
cagagcuguggaggauugcua

SEQ ID NO: 1874255 - RNA, 13 nt, Homo sapiens
cuaugaagucuuu

SEQ ID NO: 1874256 - RNA, 21 nt, Homo sapiens
gauggucacacaccagcacuu

SEQ ID NO: 1874257 - RNA, 15 nt, Homo sapiens
uggcuaccauuguca

SEQ ID NO: 1874258 - RNA, 18 nt, Homo sapiens
uuaaauaccaguacuuga

SEQ ID NO: 1874259 - RNA, 22 nt, Homo sapiens
uucuccuguugcaaugacacau

SEQ ID NO: 1874260 - RNA, 11 nt, Homo sapiens
cuauguucccc

SEQ ID NO: 1874261 - RNA, 23 nt, Homo sapiens
agauaaaucuaguauacauuguc

SEQ ID NO: 1874262 - RNA, 13 nt, Homo sapiens
cuucaaacuuuag

SEQ ID NO: 1874263 - RNA, 14 nt, Homo sapiens
agccugcagucauc

SEQ ID NO: 1874264 - RNA, 18 nt, Homo sapiens
cucaauuuuuuucaccuc

SEQ ID NO: 1874265 - RNA, 18 nt, Homo sapiens
acccugccccugccuuga

SEQ ID NO: 1874266 - RNA, 17 nt, Homo sapiens
uacuuaauucugauaaa

SEQ ID NO: 1874267 - RNA, 21 nt, Homo sapiens
uauuucuaguuauuacccaga

SEQ ID NO: 1874268 - RNA, 23 nt, Homo sapiens
caugacauuuuuccucucugcaa

SEQ ID NO: 1874269 - RNA, 19 nt, Homo sapiens
caaaucugguauugaacug

SEQ ID NO: 1874270 - RNA, 18 nt, Homo sapiens
uuugaccuguggugcaaa

SEQ ID NO: 1874271 - RNA, 15 nt, Homo sapiens
ucaggagggugcagu

SEQ ID NO: 1874272 - RNA, 20 nt, Homo sapiens
uaaugcuaaauaaaacugug

SEQ ID NO: 1874273 - RNA, 16 nt, Homo sapiens
aauaauccaaauccau

SEQ ID NO: 1874274 - RNA, 20 nt, Homo sapiens
uuacaucugggaucaugaua

SEQ ID NO: 1874275 - RNA, 20 nt, Homo sapiens
ucacagcuaagaugccaugu

SEQ ID NO: 1874276 - RNA, 21 nt, Homo sapiens
uuccugaugacagaacacaga

SEQ ID NO: 1874277 - RNA, 20 nt, Homo sapiens
gccaagcccaauacagccau

SEQ ID NO: 1874278 - RNA, 24 nt, Homo sapiens
ucaacuccgugcuuaaccaaagaa

SEQ ID NO: 1874279 - RNA, 21 nt, Homo sapiens
uauuacacaaaaaaguauaga

SEQ ID NO: 1874280 - RNA, 17 nt, Homo sapiens
auuaacgggcauguauu

SEQ ID NO: 1874281 - RNA, 17 nt, Homo sapiens
gagcagagccuacagaa

SEQ ID NO: 1874282 - RNA, 15 nt, Homo sapiens
aaauugacaugcugu

SEQ ID NO: 1874283 - RNA, 23 nt, Homo sapiens
ggcuacgugaauagcgcccucaa

SEQ ID NO: 1874284 - RNA, 18 nt, Homo sapiens
caugacauuuaccagcaa

SEQ ID NO: 1874285 - RNA, 23 nt, Homo sapiens
gccuuugucaauaaaccugucau

SEQ ID NO: 1874286 - RNA, 13 nt, Homo sapiens
ucauaaacuauau

SEQ ID NO: 1874287 - RNA, 16 nt, Homo sapiens
ggauagagacuggaac

SEQ ID NO: 1874288 - RNA, 13 nt, Homo sapiens
augagagcauaau

SEQ ID NO: 1874289 - RNA, 13 nt, Homo sapiens
agaggagcagggu

SEQ ID NO: 1874290 - RNA, 18 nt, Homo sapiens
caugcaugagcaccuuuc

SEQ ID NO: 1874291 - RNA, 16 nt, Homo sapiens
gaagauacaauaauua

SEQ ID NO: 1874292 - RNA, 21 nt, Homo sapiens
cuccucaggcacacagcuacu

SEQ ID NO: 1874293 - RNA, 18 nt, Homo sapiens
gccacauuuggaauacuu

SEQ ID NO: 1874294 - RNA, 16 nt, Homo sapiens
ucugaugaucauugcu

SEQ ID NO: 1874295 - RNA, 18 nt, Homo sapiens
acucuggugcuccugcau

SEQ ID NO: 1874296 - RNA, 19 nt, Homo sapiens
gccucccuccccagugcaa

SEQ ID NO: 1874297 - RNA, 19 nt, Homo sapiens
gaaaccccaucucuacuaa

SEQ ID NO: 1874298 - RNA, 15 nt, Homo sapiens
gccuugccuccucac

SEQ ID NO: 1874299 - RNA, 13 nt, Homo sapiens
accaaccaaaggg

SEQ ID NO: 1874300 - RNA, 15 nt, Homo sapiens
gaggcuggaucucuc

SEQ ID NO: 1874301 - RNA, 14 nt, Homo sapiens
cugggcuucauucc

SEQ ID NO: 1874302 - RNA, 14 nt, Homo sapiens
aggcaagccaugga

SEQ ID NO: 1874303 - RNA, 21 nt, Homo sapiens
auuaccaaccuguuaccuacu

SEQ ID NO: 1874304 - RNA, 13 nt, Homo sapiens
agcaaaacauaaa

SEQ ID NO: 1874305 - RNA, 19 nt, Homo sapiens
ccucuaaauuuccauaucc

SEQ ID NO: 1874306 - RNA, 17 nt, Homo sapiens
aauaacugagcacuuug

SEQ ID NO: 1874307 - RNA, 16 nt, Homo sapiens
acauuuuauaaucuau

SEQ ID NO: 1874308 - RNA, 13 nt, Homo sapiens
uuugauugcacau

SEQ ID NO: 1874309 - RNA, 14 nt, Homo sapiens
cauauguguaaaag

SEQ ID NO: 1874310 - RNA, 13 nt, Homo sapiens
aucaacacaguga

SEQ ID NO: 1874311 - RNA, 10 nt, Homo sapiens
aagcugaggc

SEQ ID NO: 1874312 - RNA, 20 nt, Homo sapiens
guuuggugggccauaugccu

SEQ ID NO: 1874313 - RNA, 14 nt, Homo sapiens
gauccaccugccuu

SEQ ID NO: 1874314 - RNA, 20 nt, Homo sapiens
acuuucacagugaagugccu

SEQ ID NO: 1874315 - RNA, 13 nt, Homo sapiens
ggccuuuccugug

SEQ ID NO: 1874316 - RNA, 9 nt, Homo sapiens
gaaaugcaa

SEQ ID NO: 1874317 - RNA, 17 nt, Homo sapiens
acgcacacugucugccc

SEQ ID NO: 1874318 - RNA, 17 nt, Homo sapiens
gggugcaaagacucuga

SEQ ID NO: 1874319 - RNA, 22 nt, Homo sapiens
cucacuaggcccccacuugccu

SEQ ID NO: 1874320 - RNA, 16 nt, Homo sapiens
agaugcggaaagcccu

SEQ ID NO: 1874321 - RNA, 22 nt, Homo sapiens
uacauaacugaaaaugugcuau

SEQ ID NO: 1874322 - RNA, 17 nt, Homo sapiens
ucucauuuauauugcag

SEQ ID NO: 1874323 - RNA, 21 nt, Homo sapiens
ugugaaacuguaaauuucaua

SEQ ID NO: 1874324 - RNA, 15 nt, Homo sapiens
gauaaacauuuaacu

SEQ ID NO: 1874325 - RNA, 13 nt, Homo sapiens
caugucuaauuca

SEQ ID NO: 1874326 - RNA, 17 nt, Homo sapiens
accaugucagcaaaaag

SEQ ID NO: 1874327 - RNA, 14 nt, Homo sapiens
agcaugaaaacuga

SEQ ID NO: 1874328 - RNA, 20 nt, Homo sapiens
gucccacccccuccuucuag

SEQ ID NO: 1874329 - RNA, 17 nt, Homo sapiens
cuuaugagauacuuugc

SEQ ID NO: 1874330 - RNA, 14 nt, Homo sapiens
auagaacuuugcca

SEQ ID NO: 1874331 - RNA, 17 nt, Homo sapiens
agaaaauaaauacauaa

SEQ ID NO: 1874332 - RNA, 19 nt, Homo sapiens
uguccacauucuacuucag

SEQ ID NO: 1874333 - RNA, 12 nt, Homo sapiens
ugccaucaucuc

SEQ ID NO: 1874334 - RNA, 23 nt, Homo sapiens
ucugggguccauucucugaguca

SEQ ID NO: 1874335 - RNA, 16 nt, Homo sapiens
aguuuacugaagcaaa

SEQ ID NO: 1874336 - RNA, 22 nt, Homo sapiens
cagauguccuaauggugaugca

SEQ ID NO: 1874337 - RNA, 20 nt, Homo sapiens
aacauuuguaaaaauacugu

SEQ ID NO: 1874338 - RNA, 22 nt, Homo sapiens
uucacugauaaaugaagaaaag

SEQ ID NO: 1874339 - RNA, 17 nt, Homo sapiens
aauaacccugaaucaga

SEQ ID NO: 1874340 - RNA, 18 nt, Homo sapiens
gaagaccaugaucucaau

SEQ ID NO: 1874341 - RNA, 18 nt, Homo sapiens
aaucuucuugauccacuu

SEQ ID NO: 1874342 - RNA, 14 nt, Homo sapiens
uucuagauucacug

SEQ ID NO: 1874343 - RNA, 18 nt, Homo sapiens
auuggcuacaaagaccua

SEQ ID NO: 1874344 - RNA, 23 nt, Homo sapiens
ugagaaauuuacuacaguaguua

SEQ ID NO: 1874345 - RNA, 21 nt, Homo sapiens
cuguguggucuccaugcucac

SEQ ID NO: 1874346 - RNA, 20 nt, Homo sapiens
cuuuaugcuguaaauaauca

SEQ ID NO: 1874347 - RNA, 12 nt, Homo sapiens
uguagcacaaag

SEQ ID NO: 1874348 - RNA, 23 nt, Homo sapiens
gaaaaucuagaggaaaagaaaga

SEQ ID NO: 1874349 - RNA, 13 nt, Homo sapiens
cuuucuccauuua

SEQ ID NO: 1874350 - RNA, 13 nt, Homo sapiens
cgggcuccaggga

SEQ ID NO: 1874351 - RNA, 18 nt, Homo sapiens
cugcaucccccaaagcca

SEQ ID NO: 1874352 - RNA, 19 nt, Homo sapiens
uccaauccucaggauuuca

SEQ ID NO: 1874353 - RNA, 15 nt, Homo sapiens
accccaggcacuguu

SEQ ID NO: 1874354 - RNA, 20 nt, Homo sapiens
ugccacauacaggugcucaa

SEQ ID NO: 1874355 - RNA, 17 nt, Homo sapiens
cuaauaaauugacauaa

SEQ ID NO: 1874356 - RNA, 14 nt, Homo sapiens
gaccugcggcagua

SEQ ID NO: 1874357 - RNA, 19 nt, Homo sapiens
aaagaaauaaaccaaagga

SEQ ID NO: 1874358 - RNA, 23 nt, Homo sapiens
gcaguagccauguuaacaugaca

SEQ ID NO: 1874359 - RNA, 13 nt, Homo sapiens
gcuuaggucucau

SEQ ID NO: 1874360 - RNA, 22 nt, Homo sapiens
gaagccaggcaccguggcucac

SEQ ID NO: 1874361 - RNA, 19 nt, Homo sapiens
aacuuccuuaaaaaagaau

SEQ ID NO: 1874362 - RNA, 21 nt, Homo sapiens
gccuuguugaugaagcacauu

SEQ ID NO: 1874363 - RNA, 17 nt, Homo sapiens
uuggcacugaugcaaug

SEQ ID NO: 1874364 - RNA, 19 nt, Homo sapiens
ugcauuaaaagaaaauaaa

SEQ ID NO: 1874365 - RNA, 18 nt, Homo sapiens
aaagaagccuugccaucu

SEQ ID NO: 1874366 - RNA, 18 nt, Homo sapiens
ugccagccccuuugccau

SEQ ID NO: 1874367 - RNA, 15 nt, Homo sapiens
gccacgcacagccag

SEQ ID NO: 1874368 - RNA, 21 nt, Homo sapiens
gcauccagagucccugccugg

SEQ ID NO: 1874369 - RNA, 14 nt, Homo sapiens
uuugggagagacca

SEQ ID NO: 1874370 - RNA, 20 nt, Homo sapiens
gucagcucccuucucuguag

SEQ ID NO: 1874371 - RNA, 23 nt, Homo sapiens
uauacauuuuuuaggacaucuua

SEQ ID NO: 1874372 - RNA, 13 nt, Homo sapiens
ucuuucuguaaac

SEQ ID NO: 1874373 - RNA, 14 nt, Homo sapiens
guuaaaugaacuug

SEQ ID NO: 1874374 - RNA, 21 nt, Homo sapiens
guacaccccaggacaguuuau

SEQ ID NO: 1874375 - RNA, 21 nt, Homo sapiens
gccuaaaagugggcuugauuc

SEQ ID NO: 1874376 - RNA, 14 nt, Homo sapiens
gccccacucaggga

SEQ ID NO: 1874377 - RNA, 23 nt, Homo sapiens
ucccagaaaaacuggcucugauu

SEQ ID NO: 1874378 - RNA, 22 nt, Homo sapiens
aggcauauauaccaaggacuua

SEQ ID NO: 1874379 - RNA, 17 nt, Homo sapiens
ucuugaucagugugcua

SEQ ID NO: 1874380 - RNA, 20 nt, Homo sapiens
acucuucuugcagcuguuga

SEQ ID NO: 1874381 - RNA, 17 nt, Homo sapiens
gaccccaugguccaucc

SEQ ID NO: 1874382 - RNA, 19 nt, Homo sapiens
guaugcauuuuauacaugu

SEQ ID NO: 1874383 - RNA, 14 nt, Homo sapiens
uugugugucacaag

SEQ ID NO: 1874384 - RNA, 16 nt, Homo sapiens
gcaagucccugacucu

SEQ ID NO: 1874385 - RNA, 17 nt, Homo sapiens
caaaguaaauucuuagc

SEQ ID NO: 1874386 - RNA, 22 nt, Homo sapiens
ggccccagcgucugcaggguga

SEQ ID NO: 1874387 - RNA, 19 nt, Homo sapiens
ccaaugcgacaaguaguuc

SEQ ID NO: 1874388 - RNA, 13 nt, Homo sapiens
uaauaaagcuucu

SEQ ID NO: 1874389 - RNA, 21 nt, Homo sapiens
gucuguguuuaauauuaccaa

SEQ ID NO: 1874390 - RNA, 22 nt, Homo sapiens
gcacauagagauaugcacacac

SEQ ID NO: 1874391 - RNA, 21 nt, Homo sapiens
aguacuaugacacuguuaaua

SEQ ID NO: 1874392 - RNA, 12 nt, Homo sapiens
uggaaacuaaga

SEQ ID NO: 1874393 - RNA, 17 nt, Homo sapiens
cuucagcaccaaauaca

SEQ ID NO: 1874394 - RNA, 16 nt, Homo sapiens
aaugaaugccuuucaa

SEQ ID NO: 1874395 - RNA, 11 nt, Homo sapiens
uuugggagcag

SEQ ID NO: 1874396 - RNA, 22 nt, Homo sapiens
aguggguaaaauuagaugcaug

SEQ ID NO: 1874397 - RNA, 20 nt, Homo sapiens
cugacuuccgucccacugaa

SEQ ID NO: 1874398 - RNA, 15 nt, Homo sapiens
agcucuccaccagcu

SEQ ID NO: 1874399 - RNA, 14 nt, Homo sapiens
gggaguuaugcaaa

SEQ ID NO: 1874400 - RNA, 16 nt, Homo sapiens
accugucgcacccacu

SEQ ID NO: 1874401 - RNA, 22 nt, Homo sapiens
aaaagcuuuuguuuugcuuaca

SEQ ID NO: 1874402 - RNA, 13 nt, Homo sapiens
aacccaccuugac

SEQ ID NO: 1874403 - RNA, 23 nt, Homo sapiens
auaccagcaggagguucugggcc

SEQ ID NO: 1874404 - RNA, 13 nt, Homo sapiens
aacacaccuugcc

SEQ ID NO: 1874405 - RNA, 10 nt, Homo sapiens
acaacccagg

SEQ ID NO: 1874406 - RNA, 15 nt, Homo sapiens
cagaugcugugcaaa

SEQ ID NO: 1874407 - RNA, 14 nt, Homo sapiens
uacucaaauggugu

SEQ ID NO: 1874408 - RNA, 16 nt, Homo sapiens
ugggaagaagcugcac

SEQ ID NO: 1874409 - RNA, 20 nt, Homo sapiens
aaaugagugagagaguucag

SEQ ID NO: 1874410 - RNA, 15 nt, Homo sapiens
ucaauaauacaaagc

SEQ ID NO: 1874411 - RNA, 12 nt, Homo sapiens
uuauauguugcu

SEQ ID NO: 1874412 - RNA, 15 nt, Homo sapiens
cucauaaacauuuga

SEQ ID NO: 1874413 - RNA, 15 nt, Homo sapiens
uccuuaauacuagau

SEQ ID NO: 1874414 - RNA, 16 nt, Homo sapiens
cuuccccaacgaaaag

SEQ ID NO: 1874415 - RNA, 23 nt, Homo sapiens
uuuuuccaacacacacaacguaa

SEQ ID NO: 1874416 - RNA, 20 nt, Homo sapiens
cuagcaaaggaaaauugcac

SEQ ID NO: 1874417 - RNA, 14 nt, Homo sapiens
uuccuccugcagac

SEQ ID NO: 1874418 - RNA, 15 nt, Homo sapiens
ccuuugacaaaggua

SEQ ID NO: 1874419 - RNA, 16 nt, Homo sapiens
auuuugucacugcugu

SEQ ID NO: 1874420 - RNA, 12 nt, Homo sapiens
uuucaagcugca

SEQ ID NO: 1874421 - RNA, 14 nt, Homo sapiens
uuagaaauuacuaa

SEQ ID NO: 1874422 - RNA, 18 nt, Homo sapiens
cccucccaaggagccauu

SEQ ID NO: 1874423 - RNA, 14 nt, Homo sapiens
ccauuuaccagcag

SEQ ID NO: 1874424 - RNA, 9 nt, Homo sapiens
ccugcucag

SEQ ID NO: 1874425 - RNA, 13 nt, Homo sapiens
gauauggaguucu

SEQ ID NO: 1874426 - RNA, 22 nt, Homo sapiens
gcguggcccuaggacaggagga

SEQ ID NO: 1874427 - RNA, 21 nt, Homo sapiens
cacuuugguauucaauuugau

SEQ ID NO: 1874428 - RNA, 14 nt, Homo sapiens
aauuggacaauuau

SEQ ID NO: 1874429 - RNA, 14 nt, Homo sapiens
ugccugcacuggaa

SEQ ID NO: 1874430 - RNA, 21 nt, Homo sapiens
gaggacagcugaggccaagga

SEQ ID NO: 1874431 - RNA, 19 nt, Homo sapiens
caucaauaaauacuuuaac

SEQ ID NO: 1874432 - RNA, 20 nt, Homo sapiens
ccaaggauagaagcugcagu

SEQ ID NO: 1874433 - RNA, 18 nt, Homo sapiens
cuugcucauaugcaugua

SEQ ID NO: 1874434 - RNA, 14 nt, Homo sapiens
guggcucaugccug

SEQ ID NO: 1874435 - RNA, 14 nt, Homo sapiens
gacugaauucugcc

SEQ ID NO: 1874436 - RNA, 17 nt, Homo sapiens
gauauuggaaugcacag

SEQ ID NO: 1874437 - RNA, 13 nt, Homo sapiens
gcauaaagcaugu

SEQ ID NO: 1874438 - RNA, 15 nt, Homo sapiens
caaaaggcuccaguu

SEQ ID NO: 1874439 - RNA, 18 nt, Homo sapiens
gauucaggaaugggccaa

SEQ ID NO: 1874440 - RNA, 15 nt, Homo sapiens
cacuuuggaaucaga

SEQ ID NO: 1874441 - RNA, 20 nt, Homo sapiens
cauauauacaggcauaaaau

SEQ ID NO: 1874442 - RNA, 17 nt, Homo sapiens
gugcuuaauaauaccaa

SEQ ID NO: 1874443 - RNA, 21 nt, Homo sapiens
uauaagacuauuccaacuggg

SEQ ID NO: 1874444 - RNA, 14 nt, Homo sapiens
auugaggaugaacu

SEQ ID NO: 1874445 - RNA, 16 nt, Homo sapiens
agacccacaaggccag

SEQ ID NO: 1874446 - RNA, 17 nt, Homo sapiens
ugaccccuccccagugc

SEQ ID NO: 1874447 - RNA, 22 nt, Homo sapiens
ccuaaguuuaaaggacugauuu

SEQ ID NO: 1874448 - RNA, 17 nt, Homo sapiens
uguuuguucacacuccu

SEQ ID NO: 1874449 - RNA, 15 nt, Homo sapiens
auccccucccuguga

SEQ ID NO: 1874450 - RNA, 21 nt, Homo sapiens
aucacuagaagaaaagcccau

SEQ ID NO: 1874451 - RNA, 20 nt, Homo sapiens
aguacugccaauacugccaa

SEQ ID NO: 1874452 - RNA, 15 nt, Homo sapiens
gcccggaccuccauc

SEQ ID NO: 1874453 - RNA, 17 nt, Homo sapiens
gacacaugcaaggucau

SEQ ID NO: 1874454 - RNA, 14 nt, Homo sapiens
ccacacccacuguc

SEQ ID NO: 1874455 - RNA, 16 nt, Homo sapiens
ucagugaagacuauga

SEQ ID NO: 1874456 - RNA, 14 nt, Homo sapiens
aaauuaguuugaca

SEQ ID NO: 1874457 - RNA, 17 nt, Homo sapiens
cccagcccucccagcug

SEQ ID NO: 1874458 - RNA, 15 nt, Homo sapiens
ugaaaggaacacugg

SEQ ID NO: 1874459 - RNA, 18 nt, Homo sapiens
gugccauuuggaguucac

SEQ ID NO: 1874460 - RNA, 13 nt, Homo sapiens
agaugugauuuau

SEQ ID NO: 1874461 - RNA, 14 nt, Homo sapiens
ucaaaauacuucuu

SEQ ID NO: 1874462 - RNA, 20 nt, Homo sapiens
uugauagacuuacuaauaaa

SEQ ID NO: 1874463 - RNA, 19 nt, Homo sapiens
uuggagcuuuuuucuuuaa

SEQ ID NO: 1874464 - RNA, 14 nt, Homo sapiens
uacuaaucauguga

SEQ ID NO: 1874465 - RNA, 16 nt, Homo sapiens
uguagaauaaaugaag

SEQ ID NO: 1874466 - RNA, 20 nt, Homo sapiens
caagaauuaaguauuuuccu

SEQ ID NO: 1874467 - RNA, 19 nt, Homo sapiens
cugaggaauaaagcuucuc

SEQ ID NO: 1874468 - RNA, 17 nt, Homo sapiens
gauuuucucagcacaaa

SEQ ID NO: 1874469 - RNA, 18 nt, Homo sapiens
gcucuguccccaccccau

SEQ ID NO: 1874470 - RNA, 18 nt, Homo sapiens
aucacugaaaaugugcuc

SEQ ID NO: 1874471 - RNA, 23 nt, Homo sapiens
guguguggggcccaagcaugccc

SEQ ID NO: 1874472 - RNA, 17 nt, Homo sapiens
ggugaacugaagcagag

SEQ ID NO: 1874473 - RNA, 15 nt, Homo sapiens
cuggaguacaccaac

SEQ ID NO: 1874474 - RNA, 15 nt, Homo sapiens
cugaacucuaagcag

SEQ ID NO: 1874475 - RNA, 17 nt, Homo sapiens
aucccaagaaauggaau

SEQ ID NO: 1874476 - RNA, 14 nt, Homo sapiens
cacuccuccuagcc

SEQ ID NO: 1874477 - RNA, 21 nt, Homo sapiens
aauugccauaauaugaugcaa

SEQ ID NO: 1874478 - RNA, 23 nt, Homo sapiens
aaucacauucuguuuaucaagcc

SEQ ID NO: 1874479 - RNA, 13 nt, Homo sapiens
gugacaugcaguu

SEQ ID NO: 1874480 - RNA, 18 nt, Homo sapiens
ugggagaucagccacgga

SEQ ID NO: 1874481 - RNA, 17 nt, Homo sapiens
aauaugaguuacugaag

SEQ ID NO: 1874482 - RNA, 13 nt, Homo sapiens
aagacaugaacca

SEQ ID NO: 1874483 - RNA, 17 nt, Homo sapiens
guauuacuaauuuccau

SEQ ID NO: 1874484 - RNA, 12 nt, Homo sapiens
uuuuacuauaaa

SEQ ID NO: 1874485 - RNA, 17 nt, Homo sapiens
ucagaggucucugcuag

SEQ ID NO: 1874486 - RNA, 18 nt, Homo sapiens
agagcuaguuuucagcug

SEQ ID NO: 1874487 - RNA, 13 nt, Homo sapiens
ugaaggaugccau

SEQ ID NO: 1874488 - RNA, 15 nt, Homo sapiens
agguuuucuccccca

SEQ ID NO: 1874489 - RNA, 12 nt, Homo sapiens
auuuacuagcug

SEQ ID NO: 1874490 - RNA, 18 nt, Homo sapiens
ucguauaaauaucuauua

SEQ ID NO: 1874491 - RNA, 17 nt, Homo sapiens
cagaaggaagacuucau

SEQ ID NO: 1874492 - RNA, 19 nt, Homo sapiens
aaauaauuucuacucuguc

SEQ ID NO: 1874493 - RNA, 19 nt, Homo sapiens
uacuuugaguuagugccau

SEQ ID NO: 1874494 - RNA, 17 nt, Homo sapiens
ccagcaacacgucauug

SEQ ID NO: 1874495 - RNA, 20 nt, Homo sapiens
uuaacauguauucuguucuu

SEQ ID NO: 1874496 - RNA, 21 nt, Homo sapiens
ccgucggacugcccccagaaa

SEQ ID NO: 1874497 - RNA, 18 nt, Homo sapiens
gagacaggccccugaguc

SEQ ID NO: 1874498 - RNA, 14 nt, Homo sapiens
augaacugccaaag

SEQ ID NO: 1874499 - RNA, 22 nt, Homo sapiens
uuccagccccuauguuauugau

SEQ ID NO: 1874500 - RNA, 12 nt, Homo sapiens
uuuuaaaguaau

SEQ ID NO: 1874501 - RNA, 17 nt, Homo sapiens
guccgccaaacacucca

SEQ ID NO: 1874502 - RNA, 23 nt, Homo sapiens
ugggugucucccucgggggcucu

SEQ ID NO: 1874503 - RNA, 20 nt, Homo sapiens
uaugaccauauuuacucuuu

SEQ ID NO: 1874504 - RNA, 16 nt, Homo sapiens
uuuccccaguacugag

SEQ ID NO: 1874505 - RNA, 13 nt, Homo sapiens
gcucaacauuuaa

SEQ ID NO: 1874506 - RNA, 13 nt, Homo sapiens
guucaacaucuaa

SEQ ID NO: 1874507 - RNA, 12 nt, Homo sapiens
uacaaacuacaa

SEQ ID NO: 1874508 - RNA, 12 nt, Homo sapiens
aaaaaacuucca

SEQ ID NO: 1874509 - RNA, 20 nt, Homo sapiens
acaauaaaaugucuucuccc

SEQ ID NO: 1874510 - RNA, 16 nt, Homo sapiens
gccacacggcucucac

SEQ ID NO: 1874511 - RNA, 17 nt, Homo sapiens
ccauaaaaaggaacaag

SEQ ID NO: 1874512 - RNA, 18 nt, Homo sapiens
auccacaaucugacauuc

SEQ ID NO: 1874513 - RNA, 18 nt, Homo sapiens
gaagagggaacuaagcau

SEQ ID NO: 1874514 - RNA, 20 nt, Homo sapiens
cacugagauccagagaggcu

SEQ ID NO: 1874515 - RNA, 15 nt, Homo sapiens
uuucaugcagccuaa

SEQ ID NO: 1874516 - RNA, 20 nt, Homo sapiens
aagugugcuggccucucuga

SEQ ID NO: 1874517 - RNA, 20 nt, Homo sapiens
ugagaguggugcccuggaac

SEQ ID NO: 1874518 - RNA, 14 nt, Homo sapiens
cccuccugacucau

SEQ ID NO: 1874519 - RNA, 19 nt, Homo sapiens
cauuggaauucuacuggaa

SEQ ID NO: 1874520 - RNA, 14 nt, Homo sapiens
uaacaguucacuuu

SEQ ID NO: 1874521 - RNA, 16 nt, Homo sapiens
gcuuuccuucaucucc

SEQ ID NO: 1874522 - RNA, 22 nt, Homo sapiens
ugauuaugccacugcuuuccag

SEQ ID NO: 1874523 - RNA, 23 nt, Homo sapiens
ccuaauggucucuaccuaaugga

SEQ ID NO: 1874524 - RNA, 21 nt, Homo sapiens
agagagcagcuucagugacaa

SEQ ID NO: 1874525 - RNA, 14 nt, Homo sapiens
acucccucuuccaa

SEQ ID NO: 1874526 - RNA, 20 nt, Homo sapiens
cgaggagggagagucuccca

SEQ ID NO: 1874527 - RNA, 18 nt, Homo sapiens
cuuugucgugguucuuaa

SEQ ID NO: 1874528 - RNA, 21 nt, Homo sapiens
ugcuuguuugcucaccugggg

SEQ ID NO: 1874529 - RNA, 17 nt, Homo sapiens
ccaccuauaccaauauu

SEQ ID NO: 1874530 - RNA, 21 nt, Homo sapiens
caugaaggugucauacagauu

SEQ ID NO: 1874531 - RNA, 23 nt, Homo sapiens
cauacacccccaccuccugcaau

SEQ ID NO: 1874532 - RNA, 15 nt, Homo sapiens
gaaugugucucagga

SEQ ID NO: 1874533 - RNA, 19 nt, Homo sapiens
gcugcuccaucaccugguu

SEQ ID NO: 1874534 - RNA, 13 nt, Homo sapiens
aacugugccuugu

SEQ ID NO: 1874535 - RNA, 15 nt, Homo sapiens
gaagggaaagccaga

SEQ ID NO: 1874536 - RNA, 19 nt, Homo sapiens
uaaacuugucaggguauaa

SEQ ID NO: 1874537 - RNA, 21 nt, Homo sapiens
uaagccuugacacacuguguu

SEQ ID NO: 1874538 - RNA, 13 nt, Homo sapiens
gacaggaggccau

SEQ ID NO: 1874539 - RNA, 18 nt, Homo sapiens
acucaguauagcauugaa

SEQ ID NO: 1874540 - RNA, 18 nt, Homo sapiens
cagguccugucucugcac

SEQ ID NO: 1874541 - RNA, 20 nt, Homo sapiens
aguauuauauaaacugugcc

SEQ ID NO: 1874542 - RNA, 17 nt, Homo sapiens
ucccaucugcauuugau

SEQ ID NO: 1874543 - RNA, 22 nt, Homo sapiens
gugcacuuuaagaggugggagc

SEQ ID NO: 1874544 - RNA, 22 nt, Homo sapiens
gguguacagaccaccuuucaca

SEQ ID NO: 1874545 - RNA, 13 nt, Homo sapiens
ugaggaauccaaa

SEQ ID NO: 1874546 - RNA, 21 nt, Homo sapiens
aucccgugaguggauugugag

SEQ ID NO: 1874547 - RNA, 21 nt, Homo sapiens
uuccaauauaacuaggcaaaa

SEQ ID NO: 1874548 - RNA, 12 nt, Homo sapiens
caaaacagccug

SEQ ID NO: 1874549 - RNA, 15 nt, Homo sapiens
aaccauuacuguaau

SEQ ID NO: 1874550 - RNA, 14 nt, Homo sapiens
gccgaaugugcagg

SEQ ID NO: 1874551 - RNA, 15 nt, Homo sapiens
aauuuaacugcauau

SEQ ID NO: 1874552 - RNA, 18 nt, Homo sapiens
ucaagagaguaaacagac

SEQ ID NO: 1874553 - RNA, 21 nt, Homo sapiens
accuaagacuauguugguacu

SEQ ID NO: 1874554 - RNA, 15 nt, Homo sapiens
cuguauacaaacagg

SEQ ID NO: 1874555 - RNA, 19 nt, Homo sapiens
uaaaguuguuugugccuuu

SEQ ID NO: 1874556 - RNA, 17 nt, Homo sapiens
cauacccacacauucca

SEQ ID NO: 1874557 - RNA, 17 nt, Homo sapiens
aagcuguuuugagccag

SEQ ID NO: 1874558 - RNA, 15 nt, Homo sapiens
uagagagugugaugu

SEQ ID NO: 1874559 - RNA, 13 nt, Homo sapiens
uuucauacaacag

SEQ ID NO: 1874560 - RNA, 15 nt, Homo sapiens
cuaccacucuaauca

SEQ ID NO: 1874561 - RNA, 14 nt, Homo sapiens
cucaagauauggaa

SEQ ID NO: 1874562 - RNA, 23 nt, Homo sapiens
gaagcgacuauaaagguuuuuga

SEQ ID NO: 1874563 - RNA, 16 nt, Homo sapiens
uguuuucauuuuacug

SEQ ID NO: 1874564 - RNA, 13 nt, Homo sapiens
aauaaaacuuuac

SEQ ID NO: 1874565 - RNA, 15 nt, Homo sapiens
gaaguugcugagaaa

SEQ ID NO: 1874566 - RNA, 23 nt, Homo sapiens
uuucccuaggaaacucacacucc

SEQ ID NO: 1874567 - RNA, 17 nt, Homo sapiens
aaaaaugugacucaaga

SEQ ID NO: 1874568 - RNA, 18 nt, Homo sapiens
cucagccaagcacagugg

SEQ ID NO: 1874569 - RNA, 15 nt, Homo sapiens
gcuuuuaauucucau

SEQ ID NO: 1874570 - RNA, 18 nt, Homo sapiens
aguacaucucuacuaaaa

SEQ ID NO: 1874571 - RNA, 22 nt, Homo sapiens
uacccuaaacauccuaagcuca

SEQ ID NO: 1874572 - RNA, 23 nt, Homo sapiens
cugccuggagucuuguguucacc

SEQ ID NO: 1874573 - RNA, 17 nt, Homo sapiens
auugucugccauuacac

SEQ ID NO: 1874574 - RNA, 11 nt, Homo sapiens
ucaaguugcac

SEQ ID NO: 1874575 - RNA, 14 nt, Homo sapiens
acccuccuggugcu

SEQ ID NO: 1874576 - RNA, 17 nt, Homo sapiens
cuccccuugaaaacugc

SEQ ID NO: 1874577 - RNA, 18 nt, Homo sapiens
uguugaaucccacuucag

SEQ ID NO: 1874578 - RNA, 19 nt, Homo sapiens
ugauaauaguccuuuacaa

SEQ ID NO: 1874579 - RNA, 12 nt, Homo sapiens
acuuucugauua

SEQ ID NO: 1874580 - RNA, 15 nt, Homo sapiens
ccuggucagcccaaa

SEQ ID NO: 1874581 - RNA, 17 nt, Homo sapiens
uaaaagaucuugcagaa

SEQ ID NO: 1874582 - RNA, 16 nt, Homo sapiens
guugaguuugcuguau

SEQ ID NO: 1874583 - RNA, 21 nt, Homo sapiens
aggguugggcgugcuaccugc

SEQ ID NO: 1874584 - RNA, 13 nt, Homo sapiens
cccagagugagcu

SEQ ID NO: 1874585 - RNA, 18 nt, Homo sapiens
cauuucuugacuucacag

SEQ ID NO: 1874586 - RNA, 22 nt, Homo sapiens
aaugaucuuaauuuacuuuaag

SEQ ID NO: 1874587 - RNA, 12 nt, Homo sapiens
gcucaacuuaga

SEQ ID NO: 1874588 - RNA, 20 nt, Homo sapiens
agagacugggcgcaguggcu

SEQ ID NO: 1874589 - RNA, 15 nt, Homo sapiens
uuccuuuucccagga

SEQ ID NO: 1874590 - RNA, 15 nt, Homo sapiens
cugauuuaguugcau

SEQ ID NO: 1874591 - RNA, 18 nt, Homo sapiens
cagcuagaauucacucca

SEQ ID NO: 1874592 - RNA, 21 nt, Homo sapiens
guuuagccccugaaagccaug

SEQ ID NO: 1874593 - RNA, 14 nt, Homo sapiens
cucaggugaucuac

SEQ ID NO: 1874594 - RNA, 14 nt, Homo sapiens
cucaagugaucugc

SEQ ID NO: 1874595 - RNA, 18 nt, Homo sapiens
gugaauaaaaacccugua

SEQ ID NO: 1874596 - RNA, 20 nt, Homo sapiens
aacaagguucccucugagaa

SEQ ID NO: 1874597 - RNA, 21 nt, Homo sapiens
agcaucuguagugacccacug

SEQ ID NO: 1874598 - RNA, 18 nt, Homo sapiens
ucagcaacaaccaucuca

SEQ ID NO: 1874599 - RNA, 22 nt, Homo sapiens
acacucaauaaauugcaacaua

SEQ ID NO: 1874600 - RNA, 22 nt, Homo sapiens
aaauuugacucaugaacuauuu

SEQ ID NO: 1874601 - RNA, 14 nt, Homo sapiens
augauagcagacau

SEQ ID NO: 1874602 - RNA, 17 nt, Homo sapiens
cauagacuuuaugcaau

SEQ ID NO: 1874603 - RNA, 22 nt, Homo sapiens
ccucacugcuguagacauuugc

SEQ ID NO: 1874604 - RNA, 14 nt, Homo sapiens
uuaaaaugcgaaau

SEQ ID NO: 1874605 - RNA, 16 nt, Homo sapiens
cuggcuucuuucacuu

SEQ ID NO: 1874606 - RNA, 13 nt, Homo sapiens
gccucaucuucaa

SEQ ID NO: 1874607 - RNA, 13 nt, Homo sapiens
gaggcacacagcu

SEQ ID NO: 1874608 - RNA, 14 nt, Homo sapiens
ugccauaacauaaa

SEQ ID NO: 1874609 - RNA, 19 nt, Homo sapiens
uccuugucucucauucucu

SEQ ID NO: 1874610 - RNA, 14 nt, Homo sapiens
gcccagaugugguu

SEQ ID NO: 1874611 - RNA, 17 nt, Homo sapiens
caugugcuagucacugg

SEQ ID NO: 1874612 - RNA, 15 nt, Homo sapiens
aaggaaugaacuuau

SEQ ID NO: 1874613 - RNA, 17 nt, Homo sapiens
gcuuugugucaucacaa

SEQ ID NO: 1874614 - RNA, 12 nt, Homo sapiens
ucuguaugcuga

SEQ ID NO: 1874615 - RNA, 14 nt, Homo sapiens
cucccuaaccacua

SEQ ID NO: 1874616 - RNA, 21 nt, Homo sapiens
cauccaauggauugugcaaau

SEQ ID NO: 1874617 - RNA, 17 nt, Homo sapiens
aaccaagaccuuucugc

SEQ ID NO: 1874618 - RNA, 20 nt, Homo sapiens
uacuagagcgacugaggcag

SEQ ID NO: 1874619 - RNA, 21 nt, Homo sapiens
ugcagguuuucuucacugcca

SEQ ID NO: 1874620 - RNA, 19 nt, Homo sapiens
auaagaucuguuuuuggac

SEQ ID NO: 1874621 - RNA, 17 nt, Homo sapiens
ucugcuccugaagcccu

SEQ ID NO: 1874622 - RNA, 18 nt, Homo sapiens
caaaagaaguugaucuga

SEQ ID NO: 1874623 - RNA, 22 nt, Homo sapiens
acuugucucaagccuaucuaua

SEQ ID NO: 1874624 - RNA, 15 nt, Homo sapiens
gcuguacgagugugu

SEQ ID NO: 1874625 - RNA, 12 nt, Homo sapiens
aagcugcucagg

SEQ ID NO: 1874626 - RNA, 18 nt, Homo sapiens
acaccauuaugugcgcug

SEQ ID NO: 1874627 - RNA, 12 nt, Homo sapiens
agauugcacugc

SEQ ID NO: 1874628 - RNA, 16 nt, Homo sapiens
acaccugacacaucuu

SEQ ID NO: 1874629 - RNA, 16 nt, Homo sapiens
uccagucugaucugug

SEQ ID NO: 1874630 - RNA, 23 nt, Homo sapiens
aguuggcuucugugccugacucu

SEQ ID NO: 1874631 - RNA, 16 nt, Homo sapiens
caaaucuaccacugua

SEQ ID NO: 1874632 - RNA, 18 nt, Homo sapiens
gccucccacuggggucca

SEQ ID NO: 1874633 - RNA, 12 nt, Homo sapiens
cucucuuuacau

SEQ ID NO: 1874634 - RNA, 14 nt, Homo sapiens
aucucuccacugag

SEQ ID NO: 1874635 - RNA, 13 nt, Homo sapiens
acuuuaucgcucu

SEQ ID NO: 1874636 - RNA, 15 nt, Homo sapiens
uaacuaaugccauag

SEQ ID NO: 1874637 - RNA, 22 nt, Homo sapiens
aaugugcagggauauugccuua

SEQ ID NO: 1874638 - RNA, 22 nt, Homo sapiens
ccuugcaagcuaauucuuugac

SEQ ID NO: 1874639 - RNA, 16 nt, Homo sapiens
uaauuggcagcagauu

SEQ ID NO: 1874640 - RNA, 22 nt, Homo sapiens
aacauagccagauguagucuca

SEQ ID NO: 1874641 - RNA, 21 nt, Homo sapiens
auagauuauuauaaacuauaa

SEQ ID NO: 1874642 - RNA, 17 nt, Homo sapiens
aaggaugggaaggaggg

SEQ ID NO: 1874643 - RNA, 15 nt, Homo sapiens
agaccugaaguaggc

SEQ ID NO: 1874644 - RNA, 15 nt, Homo sapiens
ugcucuggugcacgc

SEQ ID NO: 1874645 - RNA, 22 nt, Homo sapiens
cagccugaaagauacaggggau

SEQ ID NO: 1874646 - RNA, 16 nt, Homo sapiens
agagugggcuuuccag

SEQ ID NO: 1874647 - RNA, 12 nt, Homo sapiens
uuuaaucagcuu

SEQ ID NO: 1874648 - RNA, 22 nt, Homo sapiens
agggugaagcuauuuaucugua

SEQ ID NO: 1874649 - RNA, 18 nt, Homo sapiens
ccugacucgucugacugu

SEQ ID NO: 1874650 - RNA, 21 nt, Homo sapiens
aggccaaacuggcaaacuuca

SEQ ID NO: 1874651 - RNA, 19 nt, Homo sapiens
gcaaguuucaucagucaau

SEQ ID NO: 1874652 - RNA, 15 nt, Homo sapiens
aguguucccaaugcu

SEQ ID NO: 1874653 - RNA, 19 nt, Homo sapiens
augguuuuucugugucaau

SEQ ID NO: 1874654 - RNA, 20 nt, Homo sapiens
ugucaucagccaccauccua

SEQ ID NO: 1874655 - RNA, 16 nt, Homo sapiens
ucugguauggccaaag

SEQ ID NO: 1874656 - RNA, 20 nt, Homo sapiens
auuuuucuguaacugucacc

SEQ ID NO: 1874657 - RNA, 19 nt, Homo sapiens
aauacagugagcucuagca

SEQ ID NO: 1874658 - RNA, 20 nt, Homo sapiens
aagccugcguucuugugaca

SEQ ID NO: 1874659 - RNA, 23 nt, Homo sapiens
aucaagcuggaguacgugaaaug

SEQ ID NO: 1874660 - RNA, 17 nt, Homo sapiens
acauauguauacaugug

SEQ ID NO: 1874661 - RNA, 17 nt, Homo sapiens
auuugggggcucgggga

SEQ ID NO: 1874662 - RNA, 14 nt, Homo sapiens
auccagcaguguug

SEQ ID NO: 1874663 - RNA, 14 nt, Homo sapiens
agaugaacaucucu

SEQ ID NO: 1874664 - RNA, 22 nt, Homo sapiens
gugggugcuagggacaugggaa

SEQ ID NO: 1874665 - RNA, 19 nt, Homo sapiens
ucucuaguuuccagaggcu

SEQ ID NO: 1874666 - RNA, 23 nt, Homo sapiens
uccagggggcagcccaguggaau

SEQ ID NO: 1874667 - RNA, 22 nt, Homo sapiens
caaaaaauaagcugauuaauaa

SEQ ID NO: 1874668 - RNA, 12 nt, Homo sapiens
aaaucagccuaa

SEQ ID NO: 1874669 - RNA, 15 nt, Homo sapiens
agcugugaacaggcu

SEQ ID NO: 1874670 - RNA, 17 nt, Homo sapiens
uaaacacaccggagaag

SEQ ID NO: 1874671 - RNA, 17 nt, Homo sapiens
agagaugggacuaggac

SEQ ID NO: 1874672 - RNA, 20 nt, Homo sapiens
ccuggcuggggccuguugaa

SEQ ID NO: 1874673 - RNA, 23 nt, Homo sapiens
ugcaaucacacguggugaccuca

SEQ ID NO: 1874674 - RNA, 22 nt, Homo sapiens
cuugacuuagaccuauacugaa

SEQ ID NO: 1874675 - RNA, 12 nt, Homo sapiens
aaggugcuuccg

SEQ ID NO: 1874676 - RNA, 23 nt, Homo sapiens
augcucaauaaauaaugaucaca

SEQ ID NO: 1874677 - RNA, 18 nt, Homo sapiens
cugacuuuugcagaugga

SEQ ID NO: 1874678 - RNA, 14 nt, Homo sapiens
ucagaaacuguuuc

SEQ ID NO: 1874679 - RNA, 19 nt, Homo sapiens
gaagcaauaagccauucua

SEQ ID NO: 1874680 - RNA, 14 nt, Homo sapiens
uauauauauaugca

SEQ ID NO: 1874681 - RNA, 20 nt, Homo sapiens
gaggaaaagauauggaguua

SEQ ID NO: 1874682 - RNA, 15 nt, Homo sapiens
ccaaggucaggaggc

SEQ ID NO: 1874683 - RNA, 16 nt, Homo sapiens
ccaggacucacccuca

SEQ ID NO: 1874684 - RNA, 14 nt, Homo sapiens
ggaaagaugagcuu

SEQ ID NO: 1874685 - RNA, 16 nt, Homo sapiens
augaggugccacccag

SEQ ID NO: 1874686 - RNA, 15 nt, Homo sapiens
acaugcugccuggca

SEQ ID NO: 1874687 - RNA, 19 nt, Homo sapiens
uugggguauaggucucauc

SEQ ID NO: 1874688 - RNA, 22 nt, Homo sapiens
agggaaggaacucuggcuucca

SEQ ID NO: 1874689 - RNA, 13 nt, Homo sapiens
ccgggcgcaggaa

SEQ ID NO: 1874690 - RNA, 18 nt, Homo sapiens
cuuaaccuuuuaauacug

SEQ ID NO: 1874691 - RNA, 16 nt, Homo sapiens
agagcaauuccaggcu

SEQ ID NO: 1874692 - RNA, 13 nt, Homo sapiens
agcgggacauuua

SEQ ID NO: 1874693 - RNA, 17 nt, Homo sapiens
uggccucucuguacacu

SEQ ID NO: 1874694 - RNA, 22 nt, Homo sapiens
uacuacuguaagagacaugaau

SEQ ID NO: 1874695 - RNA, 20 nt, Homo sapiens
aaaacaauguaagagccuaa

SEQ ID NO: 1874696 - RNA, 17 nt, Homo sapiens
gauaacuugagcaccgu

SEQ ID NO: 1874697 - RNA, 21 nt, Homo sapiens
uugugaaagguaauggacuca

SEQ ID NO: 1874698 - RNA, 18 nt, Homo sapiens
uucugccuuuagcuuuga

SEQ ID NO: 1874699 - RNA, 20 nt, Homo sapiens
auccuguuuuuagugcugac

SEQ ID NO: 1874700 - RNA, 12 nt, Homo sapiens
uuuccuguaaua

SEQ ID NO: 1874701 - RNA, 21 nt, Homo sapiens
uuacaguaaucccauuuccca

SEQ ID NO: 1874702 - RNA, 20 nt, Homo sapiens
uccugcagccuccuccugac

SEQ ID NO: 1874703 - RNA, 18 nt, Homo sapiens
agaugguucccuuuguug

SEQ ID NO: 1874704 - RNA, 13 nt, Homo sapiens
uuaauauaguuua

SEQ ID NO: 1874705 - RNA, 16 nt, Homo sapiens
ccuccgcuuauccugc

SEQ ID NO: 1874706 - RNA, 13 nt, Homo sapiens
auucucaccagga

SEQ ID NO: 1874707 - RNA, 15 nt, Homo sapiens
uugacacugcucuaa

SEQ ID NO: 1874708 - RNA, 21 nt, Homo sapiens
ugggccagcugucgcaucuca

SEQ ID NO: 1874709 - RNA, 17 nt, Homo sapiens
auaauguugcccagugu

SEQ ID NO: 1874710 - RNA, 16 nt, Homo sapiens
cacucggggucccugg

SEQ ID NO: 1874711 - RNA, 19 nt, Homo sapiens
ccucagaagaaaacaaagu

SEQ ID NO: 1874712 - RNA, 20 nt, Homo sapiens
agcacuggaaccaccuggac

SEQ ID NO: 1874713 - RNA, 15 nt, Homo sapiens
aaacccacaaaaaug

SEQ ID NO: 1874714 - RNA, 18 nt, Homo sapiens
cuuauguacuugauacug

SEQ ID NO: 1874715 - RNA, 20 nt, Homo sapiens
auacaaaaaauuagccagau

SEQ ID NO: 1874716 - RNA, 16 nt, Homo sapiens
acaggcugaaagccca

SEQ ID NO: 1874717 - RNA, 14 nt, Homo sapiens
uugacacggccaug

SEQ ID NO: 1874718 - RNA, 16 nt, Homo sapiens
ucugagcccccugacc

SEQ ID NO: 1874719 - RNA, 17 nt, Homo sapiens
uucaguugcaguaguau

SEQ ID NO: 1874720 - RNA, 20 nt, Homo sapiens
gaccaagacugagccagcuu

SEQ ID NO: 1874721 - RNA, 14 nt, Homo sapiens
aaggaaaaauaaca

SEQ ID NO: 1874722 - RNA, 17 nt, Homo sapiens
uucagauuccccaucaa

SEQ ID NO: 1874723 - RNA, 15 nt, Homo sapiens
cagaugagcuuacaa

SEQ ID NO: 1874724 - RNA, 16 nt, Homo sapiens
uggcuuggguucacag

SEQ ID NO: 1874725 - RNA, 20 nt, Homo sapiens
acagauuuaaagaaaaccac

SEQ ID NO: 1874726 - RNA, 16 nt, Homo sapiens
cuggucagcuugcuca

SEQ ID NO: 1874727 - RNA, 17 nt, Homo sapiens
acccugccggguagcug

SEQ ID NO: 1874728 - RNA, 18 nt, Homo sapiens
ucacugggucugcuggcu

SEQ ID NO: 1874729 - RNA, 12 nt, Homo sapiens
cugucccaaaga

SEQ ID NO: 1874730 - RNA, 22 nt, Homo sapiens
agagugaaaaucuucucuucaa

SEQ ID NO: 1874731 - RNA, 20 nt, Homo sapiens
ccagucagagauaacaucca

SEQ ID NO: 1874732 - RNA, 16 nt, Homo sapiens
cgcccagcgcucgcca

SEQ ID NO: 1874733 - RNA, 12 nt, Homo sapiens
cuauugcugcuc

SEQ ID NO: 1874734 - RNA, 17 nt, Homo sapiens
cagagacagauaccucc

SEQ ID NO: 1874735 - RNA, 12 nt, Homo sapiens
ugucccagagag

SEQ ID NO: 1874736 - RNA, 15 nt, Homo sapiens
uaugcaagucuguga

SEQ ID NO: 1874737 - RNA, 16 nt, Homo sapiens
ugccaggcacacugag

SEQ ID NO: 1874738 - RNA, 22 nt, Homo sapiens
aaaacagaaauugguaccuugc

SEQ ID NO: 1874739 - RNA, 17 nt, Homo sapiens
aaauagugucugaugaa

SEQ ID NO: 1874740 - RNA, 19 nt, Homo sapiens
gacugggucugaccuggug

SEQ ID NO: 1874741 - RNA, 20 nt, Homo sapiens
aauauaauaggacaaucauc

SEQ ID NO: 1874742 - RNA, 12 nt, Homo sapiens
agauaaauuacu

SEQ ID NO: 1874743 - RNA, 12 nt, Homo sapiens
aaaaaaauugca

SEQ ID NO: 1874744 - RNA, 21 nt, Homo sapiens
ccaggccgagaugugcaacac

SEQ ID NO: 1874745 - RNA, 20 nt, Homo sapiens
augaccuacagugcugugua

SEQ ID NO: 1874746 - RNA, 19 nt, Homo sapiens
guaguuuaugaugcaaauc

SEQ ID NO: 1874747 - RNA, 20 nt, Homo sapiens
cuucagucucuauaccaaua

SEQ ID NO: 1874748 - RNA, 15 nt, Homo sapiens
gaauacuuugcuuca

SEQ ID NO: 1874749 - RNA, 21 nt, Homo sapiens
aaaugcacuguauugcuccuc

SEQ ID NO: 1874750 - RNA, 23 nt, Homo sapiens
uaaacucuguccacgauucacuc

SEQ ID NO: 1874751 - RNA, 14 nt, Homo sapiens
aagaucacaccacu

SEQ ID NO: 1874752 - RNA, 22 nt, Homo sapiens
ccccuggaaucgaggcugugug

SEQ ID NO: 1874753 - RNA, 17 nt, Homo sapiens
ugguuacucacaccugu

SEQ ID NO: 1874754 - RNA, 15 nt, Homo sapiens
ccauuugaacacauu

SEQ ID NO: 1874755 - RNA, 15 nt, Homo sapiens
cuguauuaaugcuug

SEQ ID NO: 1874756 - RNA, 14 nt, Homo sapiens
aauaaagcuucauu

SEQ ID NO: 1874757 - RNA, 13 nt, Homo sapiens
cauagcagugcua

SEQ ID NO: 1874758 - RNA, 19 nt, Homo sapiens
uuucugggguccauucucu

SEQ ID NO: 1874759 - RNA, 15 nt, Homo sapiens
uuuaaauucuagugu

SEQ ID NO: 1874760 - RNA, 12 nt, Homo sapiens
uuggccagugag

SEQ ID NO: 1874761 - RNA, 17 nt, Homo sapiens
cugggggauaccagcug

SEQ ID NO: 1874762 - RNA, 16 nt, Homo sapiens
ccacuuuccagggugg

SEQ ID NO: 1874763 - RNA, 20 nt, Homo sapiens
gcaaaaagucuacauacuuu

SEQ ID NO: 1874764 - RNA, 17 nt, Homo sapiens
cagaugccacacaagga

SEQ ID NO: 1874765 - RNA, 18 nt, Homo sapiens
ccuuuggaaagacuugaa

SEQ ID NO: 1874766 - RNA, 21 nt, Homo sapiens
ucuuuuaagcuauccacagcu

SEQ ID NO: 1874767 - RNA, 18 nt, Homo sapiens
uucacaaccucaccaaac

SEQ ID NO: 1874768 - RNA, 19 nt, Homo sapiens
uuucuuggugcuuugucua

SEQ ID NO: 1874769 - RNA, 22 nt, Homo sapiens
acaggagacccaacaaugagug

SEQ ID NO: 1874770 - RNA, 16 nt, Homo sapiens
uuccaccagggccaga

SEQ ID NO: 1874771 - RNA, 17 nt, Homo sapiens
aagggcaacccaccauc

SEQ ID NO: 1874772 - RNA, 17 nt, Homo sapiens
acuugcaccucaugucc

SEQ ID NO: 1874773 - RNA, 15 nt, Homo sapiens
cagcauaugauuucu

SEQ ID NO: 1874774 - RNA, 21 nt, Homo sapiens
agcucuuguuccgugccaggc

SEQ ID NO: 1874775 - RNA, 14 nt, Homo sapiens
caaaaaugaacuga

SEQ ID NO: 1874776 - RNA, 17 nt, Homo sapiens
uauuucucaacaaagca

SEQ ID NO: 1874777 - RNA, 19 nt, Homo sapiens
uaaccagacacauacucau

SEQ ID NO: 1874778 - RNA, 23 nt, Homo sapiens
uaagggaaaccuugagugguggu

SEQ ID NO: 1874779 - RNA, 19 nt, Homo sapiens
cuauggcagccauccauga

SEQ ID NO: 1874780 - RNA, 22 nt, Homo sapiens
gcuuccauuugugugugugcaa

SEQ ID NO: 1874781 - RNA, 15 nt, Homo sapiens
cugugugaccuggga

SEQ ID NO: 1874782 - RNA, 14 nt, Homo sapiens
uacugaauugucag

SEQ ID NO: 1874783 - RNA, 17 nt, Homo sapiens
caaaauucauaccugac

SEQ ID NO: 1874784 - RNA, 23 nt, Homo sapiens
uacacauuccaucuuacauuagu

SEQ ID NO: 1874785 - RNA, 20 nt, Homo sapiens
gugaauuuuugcacauucua

SEQ ID NO: 1874786 - RNA, 23 nt, Homo sapiens
agaguauccuccucccuuuacca

SEQ ID NO: 1874787 - RNA, 23 nt, Homo sapiens
cccaggagguggagguugcagug

SEQ ID NO: 1874788 - RNA, 20 nt, Homo sapiens
agucucaugcaagacuucac

SEQ ID NO: 1874789 - RNA, 16 nt, Homo sapiens
aucauacaugacucag

SEQ ID NO: 1874790 - RNA, 12 nt, Homo sapiens
auagaacacaga

SEQ ID NO: 1874791 - RNA, 17 nt, Homo sapiens
uucauugugaacagaag

SEQ ID NO: 1874792 - RNA, 15 nt, Homo sapiens
guuaaagaagcugca

SEQ ID NO: 1874793 - RNA, 19 nt, Homo sapiens
uagagcuagaugugucuua

SEQ ID NO: 1874794 - RNA, 22 nt, Homo sapiens
acacugcuucucggaggccagg

SEQ ID NO: 1874795 - RNA, 22 nt, Homo sapiens
ugcaaauacaaucagcccagug

SEQ ID NO: 1874796 - RNA, 17 nt, Homo sapiens
cacacgccaaugcacac

SEQ ID NO: 1874797 - RNA, 22 nt, Homo sapiens
acaggauauuaaacguguaaau

SEQ ID NO: 1874798 - RNA, 23 nt, Homo sapiens
uauacggaaacaaaaaugauccu

SEQ ID NO: 1874799 - RNA, 18 nt, Homo sapiens
ucuggagcuggcacugug

SEQ ID NO: 1874800 - RNA, 12 nt, Homo sapiens
uacaaaugguau

SEQ ID NO: 1874801 - RNA, 18 nt, Homo sapiens
cuugcucuccuggagcaa

SEQ ID NO: 1874802 - RNA, 17 nt, Homo sapiens
agagaucccaaguagaa

SEQ ID NO: 1874803 - RNA, 19 nt, Homo sapiens
caaccaauggaaugugaug

SEQ ID NO: 1874804 - RNA, 13 nt, Homo sapiens
uuaauaaauaugu

SEQ ID NO: 1874805 - RNA, 14 nt, Homo sapiens
agugaguacuguua

SEQ ID NO: 1874806 - RNA, 13 nt, Homo sapiens
ugcacgcacacau

SEQ ID NO: 1874807 - RNA, 13 nt, Homo sapiens
uuugaagaauuua

SEQ ID NO: 1874808 - RNA, 23 nt, Homo sapiens
ggggcuccugaauaucagucacu

SEQ ID NO: 1874809 - RNA, 21 nt, Homo sapiens
auggcccccagaggcuuccag

SEQ ID NO: 1874810 - RNA, 21 nt, Homo sapiens
cuguauucccaguuacuuggg

SEQ ID NO: 1874811 - RNA, 14 nt, Homo sapiens
acaucaagcucaag

SEQ ID NO: 1874812 - RNA, 14 nt, Homo sapiens
cuauauucaaaaug

SEQ ID NO: 1874813 - RNA, 16 nt, Homo sapiens
ugaaauucaaguguac

SEQ ID NO: 1874814 - RNA, 22 nt, Homo sapiens
cguuuccccaauaaagccuuuu

SEQ ID NO: 1874815 - RNA, 14 nt, Homo sapiens
cuuccaaacaggcu

SEQ ID NO: 1874816 - RNA, 15 nt, Homo sapiens
gucuuuaacugucaa

SEQ ID NO: 1874817 - RNA, 14 nt, Homo sapiens
ugcgcuguguacaa

SEQ ID NO: 1874818 - RNA, 13 nt, Homo sapiens
cggacacuucuca

SEQ ID NO: 1874819 - RNA, 23 nt, Homo sapiens
cgucuuuugaaaagcucacuuca

SEQ ID NO: 1874820 - RNA, 13 nt, Homo sapiens
ccuccacuuggaa

SEQ ID NO: 1874821 - RNA, 16 nt, Homo sapiens
caaagucacuucccca

SEQ ID NO: 1874822 - RNA, 21 nt, Homo sapiens
uaauggcaucaauauacauaa

SEQ ID NO: 1874823 - RNA, 19 nt, Homo sapiens
gaacuugauguuccuggga

SEQ ID NO: 1874824 - RNA, 15 nt, Homo sapiens
cuagacauggacgca

SEQ ID NO: 1874825 - RNA, 15 nt, Homo sapiens
uuucaauagcacaua

SEQ ID NO: 1874826 - RNA, 22 nt, Homo sapiens
aaugucuuuuucacaaucaugu

SEQ ID NO: 1874827 - RNA, 19 nt, Homo sapiens
accucugauggcugaagaa

SEQ ID NO: 1874828 - RNA, 15 nt, Homo sapiens
gaaggauugcaaugc

SEQ ID NO: 1874829 - RNA, 13 nt, Homo sapiens
gauggggcacuga

SEQ ID NO: 1874830 - RNA, 21 nt, Homo sapiens
accucccccaaugucuucaag

SEQ ID NO: 1874831 - RNA, 21 nt, Homo sapiens
accaagccucccacacugaaa

SEQ ID NO: 1874832 - RNA, 19 nt, Homo sapiens
uguuauaucaucaauacuu

SEQ ID NO: 1874833 - RNA, 20 nt, Homo sapiens
uugaugacugaaaaugaacu

SEQ ID NO: 1874834 - RNA, 14 nt, Homo sapiens
cuugggaugaucuu

SEQ ID NO: 1874835 - RNA, 23 nt, Homo sapiens
auaacauuuaaauuccacagauu

SEQ ID NO: 1874836 - RNA, 15 nt, Homo sapiens
ggugugauugcacag

SEQ ID NO: 1874837 - RNA, 18 nt, Homo sapiens
uaaagaagacauuugcca

SEQ ID NO: 1874838 - RNA, 21 nt, Homo sapiens
augaugcuaugguuugccauu

SEQ ID NO: 1874839 - RNA, 18 nt, Homo sapiens
cucagaucugaacacagu

SEQ ID NO: 1874840 - RNA, 20 nt, Homo sapiens
auaaauuuaucaacugucaa

SEQ ID NO: 1874841 - RNA, 12 nt, Homo sapiens
caacugugcuac

SEQ ID NO: 1874842 - RNA, 20 nt, Homo sapiens
gauuucaccguauuagccag

SEQ ID NO: 1874843 - RNA, 19 nt, Homo sapiens
acaggcacuauucuaauca

SEQ ID NO: 1874844 - RNA, 20 nt, Homo sapiens
guggacguggguugcacugg

SEQ ID NO: 1874845 - RNA, 23 nt, Homo sapiens
cccuuggagagagaggcugccuc

SEQ ID NO: 1874846 - RNA, 19 nt, Homo sapiens
guuggucaaaaucugcaaa

SEQ ID NO: 1874847 - RNA, 13 nt, Homo sapiens
auauucagaauua

SEQ ID NO: 1874848 - RNA, 12 nt, Homo sapiens
gaaacacuggac

SEQ ID NO: 1874849 - RNA, 20 nt, Homo sapiens
cugccauccuugacuuugaa

SEQ ID NO: 1874850 - RNA, 20 nt, Homo sapiens
cucgagccgccaggacacag

SEQ ID NO: 1874851 - RNA, 12 nt, Homo sapiens
aaacucaucucc

SEQ ID NO: 1874852 - RNA, 23 nt, Homo sapiens
uccccuucucuaaaucagggugg

SEQ ID NO: 1874853 - RNA, 18 nt, Homo sapiens
acaacucguguucacuca

SEQ ID NO: 1874854 - RNA, 16 nt, Homo sapiens
agcgacagugugggac

SEQ ID NO: 1874855 - RNA, 15 nt, Homo sapiens
acugcacaaacaaua

SEQ ID NO: 1874856 - RNA, 19 nt, Homo sapiens
accagcgcuugaagccuga

SEQ ID NO: 1874857 - RNA, 18 nt, Homo sapiens
ucagagaaccagugcaga

SEQ ID NO: 1874858 - RNA, 14 nt, Homo sapiens
aucgagagaagcug

SEQ ID NO: 1874859 - RNA, 12 nt, Homo sapiens
ccgcacaccucu

SEQ ID NO: 1874860 - RNA, 19 nt, Homo sapiens
ggaacguugccacaccaau

SEQ ID NO: 1874861 - RNA, 12 nt, Homo sapiens
aagucacacaga

SEQ ID NO: 1874862 - RNA, 14 nt, Homo sapiens
gggaaccauccccg

SEQ ID NO: 1874863 - RNA, 13 nt, Homo sapiens
uacugccauguac

SEQ ID NO: 1874864 - RNA, 16 nt, Homo sapiens
caacaaccuaugcacc

SEQ ID NO: 1874865 - RNA, 23 nt, Homo sapiens
cacuggauccauccguccagcca

SEQ ID NO: 1874866 - RNA, 15 nt, Homo sapiens
ucacuguccugugaa

SEQ ID NO: 1874867 - RNA, 12 nt, Homo sapiens
agugcagggauu

SEQ ID NO: 1874868 - RNA, 20 nt, Homo sapiens
aaaagcacagcucucacugg

SEQ ID NO: 1874869 - RNA, 16 nt, Homo sapiens
ugggggcuagcagaag

SEQ ID NO: 1874870 - RNA, 21 nt, Homo sapiens
gucuauggucaguugaggaau

SEQ ID NO: 1874871 - RNA, 17 nt, Homo sapiens
gugcacgagcuggccca

SEQ ID NO: 1874872 - RNA, 19 nt, Homo sapiens
auugacaucagcaucaccu

SEQ ID NO: 1874873 - RNA, 21 nt, Homo sapiens
acugaaauaaaccugcacuga

SEQ ID NO: 1874874 - RNA, 22 nt, Homo sapiens
gaaccaacacagacacccaagc

SEQ ID NO: 1874875 - RNA, 21 nt, Homo sapiens
uccaaggcaaauguccaagca

SEQ ID NO: 1874876 - RNA, 17 nt, Homo sapiens
aguuuuaguuggugcug

SEQ ID NO: 1874877 - RNA, 17 nt, Homo sapiens
agcaaggccuuggugga

SEQ ID NO: 1874878 - RNA, 15 nt, Homo sapiens
aauuccaaucauugu

SEQ ID NO: 1874879 - RNA, 13 nt, Homo sapiens
guccucccuccca

SEQ ID NO: 1874880 - RNA, 12 nt, Homo sapiens
cuugugaugugc

SEQ ID NO: 1874881 - RNA, 18 nt, Homo sapiens
ucauggagaaacauccua

SEQ ID NO: 1874882 - RNA, 21 nt, Homo sapiens
cuacaauauuaacauaagaaa

SEQ ID NO: 1874883 - RNA, 13 nt, Homo sapiens
aaagucaccugcc

SEQ ID NO: 1874884 - RNA, 19 nt, Homo sapiens
cagaacccuuccugagacc

SEQ ID NO: 1874885 - RNA, 17 nt, Homo sapiens
aauacugcguguucuca

SEQ ID NO: 1874886 - RNA, 13 nt, Homo sapiens
uaucuugagucuu

SEQ ID NO: 1874887 - RNA, 21 nt, Homo sapiens
uccaacuuaggcuacagaaug

SEQ ID NO: 1874888 - RNA, 23 nt, Homo sapiens
ugucugccauugauccagcucag

SEQ ID NO: 1874889 - RNA, 15 nt, Homo sapiens
aguucccaggugaua

SEQ ID NO: 1874890 - RNA, 22 nt, Homo sapiens
cccaugugagucccugugaugg

SEQ ID NO: 1874891 - RNA, 10 nt, Homo sapiens
aaugcuccau

SEQ ID NO: 1874892 - RNA, 13 nt, Homo sapiens
ucucucucucaaa

SEQ ID NO: 1874893 - RNA, 17 nt, Homo sapiens
uugucuuauuacagcau

SEQ ID NO: 1874894 - RNA, 13 nt, Homo sapiens
cgcuguucuugcu

SEQ ID NO: 1874895 - RNA, 16 nt, Homo sapiens
aaaaaugcugcuucuc

SEQ ID NO: 1874896 - RNA, 20 nt, Homo sapiens
aacuugcacauuugaauuca

SEQ ID NO: 1874897 - RNA, 22 nt, Homo sapiens
aaaaccuuaagaguucuaacca

SEQ ID NO: 1874898 - RNA, 16 nt, Homo sapiens
augcuuauaagcaaca

SEQ ID NO: 1874899 - RNA, 19 nt, Homo sapiens
ugcaacugcuacugaccau

SEQ ID NO: 1874900 - RNA, 17 nt, Homo sapiens
aaugcaagggucucaca

SEQ ID NO: 1874901 - RNA, 20 nt, Homo sapiens
aagguggcccuucacugucc

SEQ ID NO: 1874902 - RNA, 14 nt, Homo sapiens
auuuagucugcauu

SEQ ID NO: 1874903 - RNA, 23 nt, Homo sapiens
uauucauacacucccuccccuuu

SEQ ID NO: 1874904 - RNA, 20 nt, Homo sapiens
uuacaaucagccacauucua

SEQ ID NO: 1874905 - RNA, 21 nt, Homo sapiens
ucuggagauaaaauaaaaaga

SEQ ID NO: 1874906 - RNA, 15 nt, Homo sapiens
acauucauacuguag

SEQ ID NO: 1874907 - RNA, 13 nt, Homo sapiens
gcacuguucaaua

SEQ ID NO: 1874908 - RNA, 16 nt, Homo sapiens
uaaaauaacuugcauc

SEQ ID NO: 1874909 - RNA, 17 nt, Homo sapiens
gggaugggaacacuggu

SEQ ID NO: 1874910 - RNA, 20 nt, Homo sapiens
uggauuucauuaucauauga

SEQ ID NO: 1874911 - RNA, 15 nt, Homo sapiens
acucuaacugauguu

SEQ ID NO: 1874912 - RNA, 15 nt, Homo sapiens
uuacaaaugugaaac

SEQ ID NO: 1874913 - RNA, 22 nt, Homo sapiens
gaugaugucuucuggugucaug

SEQ ID NO: 1874914 - RNA, 14 nt, Homo sapiens
cuaucacagucuac

SEQ ID NO: 1874915 - RNA, 18 nt, Homo sapiens
auugccuuccucgugcag

SEQ ID NO: 1874916 - RNA, 15 nt, Homo sapiens
guugaucccaagaca

SEQ ID NO: 1874917 - RNA, 14 nt, Homo sapiens
ggucacucaucuaa

SEQ ID NO: 1874918 - RNA, 21 nt, Homo sapiens
aauuaaaccaaggagucugau

SEQ ID NO: 1874919 - RNA, 20 nt, Homo sapiens
auuaacugaaaagcaguuua

SEQ ID NO: 1874920 - RNA, 22 nt, Homo sapiens
cuuccagugcauguugccauga

SEQ ID NO: 1874921 - RNA, 16 nt, Homo sapiens
uguccuaggcuuuuac

SEQ ID NO: 1874922 - RNA, 20 nt, Homo sapiens
uguccuggcugugcacauuc

SEQ ID NO: 1874923 - RNA, 12 nt, Homo sapiens
agcuaugaaggc

SEQ ID NO: 1874924 - RNA, 13 nt, Homo sapiens
gucaccucaugga

SEQ ID NO: 1874925 - RNA, 12 nt, Homo sapiens
acacagcuuuua

SEQ ID NO: 1874926 - RNA, 19 nt, Homo sapiens
cagacuuuggaaaaugcau

SEQ ID NO: 1874927 - RNA, 13 nt, Homo sapiens
uggagauucucau

SEQ ID NO: 1874928 - RNA, 14 nt, Homo sapiens
ucugguuugcagag

SEQ ID NO: 1874929 - RNA, 13 nt, Homo sapiens
uauucauccagag

SEQ ID NO: 1874930 - RNA, 22 nt, Homo sapiens
accauucaucuuuccuuugcuc

SEQ ID NO: 1874931 - RNA, 20 nt, Homo sapiens
aaacagcagauuucagauca

SEQ ID NO: 1874932 - RNA, 22 nt, Homo sapiens
ggccucccaaaguacugggauu

SEQ ID NO: 1874933 - RNA, 13 nt, Homo sapiens
aaagagaugucaa

SEQ ID NO: 1874934 - RNA, 20 nt, Homo sapiens
agguacuauauuugcuagac

SEQ ID NO: 1874935 - RNA, 20 nt, Homo sapiens
uacaaucugggauaguuugg

SEQ ID NO: 1874936 - RNA, 22 nt, Homo sapiens
uaaaauaaauaaaugcaauaug

SEQ ID NO: 1874937 - RNA, 20 nt, Homo sapiens
ucugcagcuuucaagcucau

SEQ ID NO: 1874938 - RNA, 16 nt, Homo sapiens
auuagcucuggaccag

SEQ ID NO: 1874939 - RNA, 17 nt, Homo sapiens
ugcuauagaaauugaga

SEQ ID NO: 1874940 - RNA, 12 nt, Homo sapiens
aucugcugucuu

SEQ ID NO: 1874941 - RNA, 15 nt, Homo sapiens
uacucccucuuccaa

SEQ ID NO: 1874942 - RNA, 22 nt, Homo sapiens
gaauauuguuuuugcaccagac

SEQ ID NO: 1874943 - RNA, 20 nt, Homo sapiens
uauguguaaaagcuuacaca

SEQ ID NO: 1874944 - RNA, 22 nt, Homo sapiens
aaggaagggcugcuggagccca

SEQ ID NO: 1874945 - RNA, 23 nt, Homo sapiens
cccagacacuggcguuacugcuu

SEQ ID NO: 1874946 - RNA, 23 nt, Homo sapiens
auuaaucuuuuauauugauaaca

SEQ ID NO: 1874947 - RNA, 22 nt, Homo sapiens
ugauaaaaacccaaaauacagc

SEQ ID NO: 1874948 - RNA, 14 nt, Homo sapiens
uaaaaugagcauug

SEQ ID NO: 1874949 - RNA, 14 nt, Homo sapiens
ccacccccaagaaa

SEQ ID NO: 1874950 - RNA, 12 nt, Homo sapiens
gcugggcagcua

SEQ ID NO: 1874951 - RNA, 21 nt, Homo sapiens
gcugcaucuccccucagauuc

SEQ ID NO: 1874952 - RNA, 15 nt, Homo sapiens
acacucauggggaag

SEQ ID NO: 1874953 - RNA, 18 nt, Homo sapiens
caggggccaaccucaggc

SEQ ID NO: 1874954 - RNA, 11 nt, Homo sapiens
aauaugugcuu

SEQ ID NO: 1874955 - RNA, 19 nt, Homo sapiens
acagucauuuccuacccuu

SEQ ID NO: 1874956 - RNA, 20 nt, Homo sapiens
gcuccagccugacaacagcc

SEQ ID NO: 1874957 - RNA, 18 nt, Homo sapiens
uggaagagcuggguacca

SEQ ID NO: 1874958 - RNA, 17 nt, Homo sapiens
aaggaauuccucuauga

SEQ ID NO: 1874959 - RNA, 21 nt, Homo sapiens
uaaacguggauguuacuccaa

SEQ ID NO: 1874960 - RNA, 17 nt, Homo sapiens
aggucguuuuccaaaga

SEQ ID NO: 1874961 - RNA, 15 nt, Homo sapiens
aagcaugaguggccu

SEQ ID NO: 1874962 - RNA, 14 nt, Homo sapiens
auuuacaagggaag

SEQ ID NO: 1874963 - RNA, 13 nt, Homo sapiens
ucaccuguaaaac

SEQ ID NO: 1874964 - RNA, 12 nt, Homo sapiens
aucuguaauuca

SEQ ID NO: 1874965 - RNA, 16 nt, Homo sapiens
aauguaaacugugcca

SEQ ID NO: 1874966 - RNA, 13 nt, Homo sapiens
cuuuugagcauau

SEQ ID NO: 1874967 - RNA, 15 nt, Homo sapiens
uuuucuguaguguga

SEQ ID NO: 1874968 - RNA, 16 nt, Homo sapiens
auacaggcuagggaug

SEQ ID NO: 1874969 - RNA, 12 nt, Homo sapiens
aaauauuauuca

SEQ ID NO: 1874970 - RNA, 23 nt, Homo sapiens
uauuuaaaggaaaaucacaucuc

SEQ ID NO: 1874971 - RNA, 13 nt, Homo sapiens
agaggaauccaug

SEQ ID NO: 1874972 - RNA, 22 nt, Homo sapiens
uucagucuaugcugugugcaga

SEQ ID NO: 1874973 - RNA, 21 nt, Homo sapiens
gucaaggaauguuaucaguau

SEQ ID NO: 1874974 - RNA, 14 nt, Homo sapiens
cuugagguugguga

SEQ ID NO: 1874975 - RNA, 14 nt, Homo sapiens
ugagacucacagga

SEQ ID NO: 1874976 - RNA, 19 nt, Homo sapiens
gacacacaucaaaaaccug

SEQ ID NO: 1874977 - RNA, 17 nt, Homo sapiens
gaaauaccacaagccug

SEQ ID NO: 1874978 - RNA, 13 nt, Homo sapiens
agaaucuagccuc

SEQ ID NO: 1874979 - RNA, 18 nt, Homo sapiens
gugaauuauugacacuga

SEQ ID NO: 1874980 - RNA, 16 nt, Homo sapiens
agccguuggcaccucu

SEQ ID NO: 1874981 - RNA, 13 nt, Homo sapiens
auaucagugacag

SEQ ID NO: 1874982 - RNA, 13 nt, Homo sapiens
cuuuaagugugcu

SEQ ID NO: 1874983 - RNA, 21 nt, Homo sapiens
gcacuugauguuuguuugcau

SEQ ID NO: 1874984 - RNA, 14 nt, Homo sapiens
guuaaaaaguucau

SEQ ID NO: 1874985 - RNA, 14 nt, Homo sapiens
uaaaauaauaacaa

SEQ ID NO: 1874986 - RNA, 17 nt, Homo sapiens
uguuaaacuuauuucaa

SEQ ID NO: 1874987 - RNA, 17 nt, Homo sapiens
cuccaguggaagggaaa

SEQ ID NO: 1874988 - RNA, 16 nt, Homo sapiens
caaaccugaguaucag

SEQ ID NO: 1874989 - RNA, 21 nt, Homo sapiens
uaccaaguuggucuuacuuug

SEQ ID NO: 1874990 - RNA, 20 nt, Homo sapiens
guuucuugcuuggaagccag

SEQ ID NO: 1874991 - RNA, 12 nt, Homo sapiens
accccugcauug

SEQ ID NO: 1874992 - RNA, 21 nt, Homo sapiens
uggcgaggccucucucaggag

SEQ ID NO: 1874993 - RNA, 21 nt, Homo sapiens
auuuauuuugagaagcucuga

SEQ ID NO: 1874994 - RNA, 14 nt, Homo sapiens
acaguuccauucaa

SEQ ID NO: 1874995 - RNA, 21 nt, Homo sapiens
cccccaguuccucccaggaag

SEQ ID NO: 1874996 - RNA, 20 nt, Homo sapiens
agcccagaucgcaccacugc

SEQ ID NO: 1874997 - RNA, 20 nt, Homo sapiens
gagaauaaaauuccuaucuc

SEQ ID NO: 1874998 - RNA, 14 nt, Homo sapiens
gaccacccccuguu

SEQ ID NO: 1874999 - RNA, 13 nt, Homo sapiens
guuucacugagag

SEQ ID NO: 1875000 - RNA, 21 nt, Homo sapiens
uggucugauggaacuguguau

SEQ ID NO: 1875001 - RNA, 14 nt, Homo sapiens
cuucuuacuaagcu

SEQ ID NO: 1875002 - RNA, 13 nt, Homo sapiens
uucugcucacaua

SEQ ID NO: 1875003 - RNA, 14 nt, Homo sapiens
gccgacuuggagac

SEQ ID NO: 1875004 - RNA, 19 nt, Homo sapiens
cauuuauuucucuggcaaa

SEQ ID NO: 1875005 - RNA, 12 nt, Homo sapiens
ggaauugucaaa

SEQ ID NO: 1875006 - RNA, 16 nt, Homo sapiens
gacacagagggggccu

SEQ ID NO: 1875007 - RNA, 15 nt, Homo sapiens
ccugguuaccacagu

SEQ ID NO: 1875008 - RNA, 15 nt, Homo sapiens
aaucaugaaaagggg

SEQ ID NO: 1875009 - RNA, 12 nt, Homo sapiens
auuuuuaucucc

SEQ ID NO: 1875010 - RNA, 11 nt, Homo sapiens
cuaguaaugcu

SEQ ID NO: 1875011 - RNA, 19 nt, Homo sapiens
ugcgcuguguacaauguga

SEQ ID NO: 1875012 - RNA, 23 nt, Homo sapiens
uacaaauuauguuuuaauuccaa

SEQ ID NO: 1875013 - RNA, 15 nt, Homo sapiens
gcugcugcuuugaaa

SEQ ID NO: 1875014 - RNA, 21 nt, Homo sapiens
aagguacgaguagagguuuaa

SEQ ID NO: 1875015 - RNA, 15 nt, Homo sapiens
cuugguagcacuuua

SEQ ID NO: 1875016 - RNA, 17 nt, Homo sapiens
cugcccuuccugccuga

SEQ ID NO: 1875017 - RNA, 20 nt, Homo sapiens
acuauuuaaaauaagcacac

SEQ ID NO: 1875018 - RNA, 15 nt, Homo sapiens
agcaaauaucuuacc

SEQ ID NO: 1875019 - RNA, 18 nt, Homo sapiens
cacaaaaugauaaucaau

SEQ ID NO: 1875020 - RNA, 13 nt, Homo sapiens
uacugucuggaag

SEQ ID NO: 1875021 - RNA, 23 nt, Homo sapiens
accaggaggcggcagugcaacaa

SEQ ID NO: 1875022 - RNA, 22 nt, Homo sapiens
agaaaggaacuuuuaaacugca

SEQ ID NO: 1875023 - RNA, 22 nt, Homo sapiens
cagacggaaggguaaacaauau

SEQ ID NO: 1875024 - RNA, 19 nt, Homo sapiens
uggaaauugcaguaacaaa

SEQ ID NO: 1875025 - RNA, 16 nt, Homo sapiens
auuaggagacacaggg

SEQ ID NO: 1875026 - RNA, 12 nt, Homo sapiens
gcugcuccaugg

SEQ ID NO: 1875027 - RNA, 16 nt, Homo sapiens
aagcguucagugaugu

SEQ ID NO: 1875028 - RNA, 16 nt, Homo sapiens
agggccacaugggagg

SEQ ID NO: 1875029 - RNA, 18 nt, Homo sapiens
agcuccugggaagcccug

SEQ ID NO: 1875030 - RNA, 15 nt, Homo sapiens
gcaggggaagccuug

SEQ ID NO: 1875031 - RNA, 21 nt, Homo sapiens
accucaggugauccaccugcc

SEQ ID NO: 1875032 - RNA, 23 nt, Homo sapiens
cucacaaaaaggcaaauauugaa

SEQ ID NO: 1875033 - RNA, 15 nt, Homo sapiens
gagugggcuaagcac

SEQ ID NO: 1875034 - RNA, 16 nt, Homo sapiens
gcuuugaaaacauaca

SEQ ID NO: 1875035 - RNA, 18 nt, Homo sapiens
acagaucuggaaccucag

SEQ ID NO: 1875036 - RNA, 18 nt, Homo sapiens
cuuucauucagccuuuag

SEQ ID NO: 1875037 - RNA, 14 nt, Homo sapiens
ugauuuccauccaa

SEQ ID NO: 1875038 - RNA, 11 nt, Homo sapiens
uagagccugug

SEQ ID NO: 1875039 - RNA, 19 nt, Homo sapiens
auuuuauguuuaguugcac

SEQ ID NO: 1875040 - RNA, 20 nt, Homo sapiens
acgguuuuauaaaagccuug

SEQ ID NO: 1875041 - RNA, 12 nt, Homo sapiens
acuccugcaaaa

SEQ ID NO: 1875042 - RNA, 15 nt, Homo sapiens
uucucauuugucaca

SEQ ID NO: 1875043 - RNA, 16 nt, Homo sapiens
agcccuggaaacauac

SEQ ID NO: 1875044 - RNA, 13 nt, Homo sapiens
cugggagccccaa

SEQ ID NO: 1875045 - RNA, 16 nt, Homo sapiens
ucaagaggacaaucua

SEQ ID NO: 1875046 - RNA, 22 nt, Homo sapiens
acccuuucuucaauacaaaaag

SEQ ID NO: 1875047 - RNA, 16 nt, Homo sapiens
aacaccaguaccugaa

SEQ ID NO: 1875048 - RNA, 15 nt, Homo sapiens
ugugcuagacuguaa

SEQ ID NO: 1875049 - RNA, 16 nt, Homo sapiens
caguacuuguuucuau

SEQ ID NO: 1875050 - RNA, 20 nt, Homo sapiens
gaauccuuggggagcacuug

SEQ ID NO: 1875051 - RNA, 15 nt, Homo sapiens
ugccuaccuggguca

SEQ ID NO: 1875052 - RNA, 19 nt, Homo sapiens
ugcaaggugaaacgacuca

SEQ ID NO: 1875053 - RNA, 12 nt, Homo sapiens
cugccagugcag

SEQ ID NO: 1875054 - RNA, 16 nt, Homo sapiens
cucacugcagugcuga

SEQ ID NO: 1875055 - RNA, 16 nt, Homo sapiens
auauaauuucaaacca

SEQ ID NO: 1875056 - RNA, 13 nt, Homo sapiens
agauguguaaaca

SEQ ID NO: 1875057 - RNA, 23 nt, Homo sapiens
gaggacuacuauuugaagcaaug

SEQ ID NO: 1875058 - RNA, 22 nt, Homo sapiens
agccagcaaagccuccagcauc

SEQ ID NO: 1875059 - RNA, 15 nt, Homo sapiens
gauuuguacaggagu

SEQ ID NO: 1875060 - RNA, 17 nt, Homo sapiens
gucuuuuccacuccuau

SEQ ID NO: 1875061 - RNA, 18 nt, Homo sapiens
gcuucugugugcugcuaa

SEQ ID NO: 1875062 - RNA, 14 nt, Homo sapiens
agugcugucuggga

SEQ ID NO: 1875063 - RNA, 12 nt, Homo sapiens
cuuacuauucau

SEQ ID NO: 1875064 - RNA, 19 nt, Homo sapiens
uacagaauuuccacuguaa

SEQ ID NO: 1875065 - RNA, 22 nt, Homo sapiens
caaaauggagggagccaucccu

SEQ ID NO: 1875066 - RNA, 14 nt, Homo sapiens
caaugguguagcug

SEQ ID NO: 1875067 - RNA, 19 nt, Homo sapiens
aaacuucugaagacugaga

SEQ ID NO: 1875068 - RNA, 19 nt, Homo sapiens
aauggaggucccagcccug

SEQ ID NO: 1875069 - RNA, 14 nt, Homo sapiens
uaauagacuuccca

SEQ ID NO: 1875070 - RNA, 17 nt, Homo sapiens
agugaaaggucaucuca

SEQ ID NO: 1875071 - RNA, 19 nt, Homo sapiens
acauuuuuuucuaccuaua

SEQ ID NO: 1875072 - RNA, 15 nt, Homo sapiens
uguuacugugucagg

SEQ ID NO: 1875073 - RNA, 16 nt, Homo sapiens
caauggcagauaucua

SEQ ID NO: 1875074 - RNA, 19 nt, Homo sapiens
uacauagcauuuguguaaa

SEQ ID NO: 1875075 - RNA, 16 nt, Homo sapiens
cgcuaccucuccagcc

SEQ ID NO: 1875076 - RNA, 13 nt, Homo sapiens
gaaugugcagugu

SEQ ID NO: 1875077 - RNA, 17 nt, Homo sapiens
uaaaagacaagcacuuu

SEQ ID NO: 1875078 - RNA, 14 nt, Homo sapiens
gaguuuggccagaa

SEQ ID NO: 1875079 - RNA, 16 nt, Homo sapiens
ggucuccuugcacuuu

SEQ ID NO: 1875080 - RNA, 14 nt, Homo sapiens
ucagguggccagaa

SEQ ID NO: 1875081 - RNA, 23 nt, Homo sapiens
aguucaaaugaugaagaccaaag

SEQ ID NO: 1875082 - RNA, 16 nt, Homo sapiens
uggcagcggguggcau

SEQ ID NO: 1875083 - RNA, 14 nt, Homo sapiens
uggaaacguauuca

SEQ ID NO: 1875084 - RNA, 20 nt, Homo sapiens
ugcaggacguuagacuguug

SEQ ID NO: 1875085 - RNA, 21 nt, Homo sapiens
gcauuggugacucacuucaau

SEQ ID NO: 1875086 - RNA, 17 nt, Homo sapiens
ucaguuacuuaccugca

SEQ ID NO: 1875087 - RNA, 21 nt, Homo sapiens
ccgaggugggcagaucacuug

SEQ ID NO: 1875088 - RNA, 23 nt, Homo sapiens
ugcagugaguugagucaugggau

SEQ ID NO: 1875089 - RNA, 19 nt, Homo sapiens
aggaaaaacacaagcaaaa

SEQ ID NO: 1875090 - RNA, 16 nt, Homo sapiens
uuuaucuucuucacgg

SEQ ID NO: 1875091 - RNA, 15 nt, Homo sapiens
cuuuaugcagagcca

SEQ ID NO: 1875092 - RNA, 17 nt, Homo sapiens
cagcagcugaacagcca

SEQ ID NO: 1875093 - RNA, 22 nt, Homo sapiens
auguuaagacuugacaguggaa

SEQ ID NO: 1875094 - RNA, 18 nt, Homo sapiens
uucuagaacaccugccuu

SEQ ID NO: 1875095 - RNA, 15 nt, Homo sapiens
acacacaccaaugcg

SEQ ID NO: 1875096 - RNA, 15 nt, Homo sapiens
acacacgccaaugca

SEQ ID NO: 1875097 - RNA, 20 nt, Homo sapiens
acguggucacugugcacugc

SEQ ID NO: 1875098 - RNA, 21 nt, Homo sapiens
aauuuauggaaucuaccaacu

SEQ ID NO: 1875099 - RNA, 16 nt, Homo sapiens
ccucgcagagaggcca

SEQ ID NO: 1875100 - RNA, 15 nt, Homo sapiens
aaguauuuaucuccu

SEQ ID NO: 1875101 - RNA, 18 nt, Homo sapiens
accaugcacuauauuugu

SEQ ID NO: 1875102 - RNA, 23 nt, Homo sapiens
uuguaagucagccacugggaccc

SEQ ID NO: 1875103 - RNA, 20 nt, Homo sapiens
acccuaugugggugggacca

SEQ ID NO: 1875104 - RNA, 14 nt, Homo sapiens
caccugcaaauggu

SEQ ID NO: 1875105 - RNA, 16 nt, Homo sapiens
ccuggugccaccucag

SEQ ID NO: 1875106 - RNA, 21 nt, Homo sapiens
acaugcuacaaaaaaguagca

SEQ ID NO: 1875107 - RNA, 15 nt, Homo sapiens
aaugucaauuggcag

SEQ ID NO: 1875108 - RNA, 12 nt, Homo sapiens
aauaaugaucuu

SEQ ID NO: 1875109 - RNA, 15 nt, Homo sapiens
ucauauguugcucag

SEQ ID NO: 1875110 - RNA, 21 nt, Homo sapiens
cugucuucaccugccaccaca

SEQ ID NO: 1875111 - RNA, 20 nt, Homo sapiens
auaaaguuuuugacuuccuu

SEQ ID NO: 1875112 - RNA, 15 nt, Homo sapiens
auuuugaccuuguau

SEQ ID NO: 1875113 - RNA, 12 nt, Homo sapiens
cuugucuucuag

SEQ ID NO: 1875114 - RNA, 16 nt, Homo sapiens
ucucucugaccuuuca

SEQ ID NO: 1875115 - RNA, 12 nt, Homo sapiens
auacauaccuac

SEQ ID NO: 1875116 - RNA, 22 nt, Homo sapiens
cauaauuuuagaugccugugaa

SEQ ID NO: 1875117 - RNA, 21 nt, Homo sapiens
uacgaaggugaggucugggau

SEQ ID NO: 1875118 - RNA, 16 nt, Homo sapiens
cagaaggguaaugcgu

SEQ ID NO: 1875119 - RNA, 14 nt, Homo sapiens
aacagacuucucaa

SEQ ID NO: 1875120 - RNA, 19 nt, Homo sapiens
aaaugaaaaaucuguugau

SEQ ID NO: 1875121 - RNA, 17 nt, Homo sapiens
uaagugaauacauuaac

SEQ ID NO: 1875122 - RNA, 12 nt, Homo sapiens
ccaccugugacc

SEQ ID NO: 1875123 - RNA, 16 nt, Homo sapiens
uuuguuugauuacugu

SEQ ID NO: 1875124 - RNA, 21 nt, Homo sapiens
ucacaaauuugucuugccuua

SEQ ID NO: 1875125 - RNA, 21 nt, Homo sapiens
guuguucuaaaggcuguuaaa

SEQ ID NO: 1875126 - RNA, 18 nt, Homo sapiens
ucugguccacacuagaaa

SEQ ID NO: 1875127 - RNA, 14 nt, Homo sapiens
gacugcugagucaa

SEQ ID NO: 1875128 - RNA, 17 nt, Homo sapiens
gcugagaucgugccacu

SEQ ID NO: 1875129 - RNA, 22 nt, Homo sapiens
gccauccuaaggugcuuaccuc

SEQ ID NO: 1875130 - RNA, 16 nt, Homo sapiens
aaacccaaaacaguaa

SEQ ID NO: 1875131 - RNA, 12 nt, Homo sapiens
aagggcauuuaa

SEQ ID NO: 1875132 - RNA, 22 nt, Homo sapiens
agaaauauucuacacauaucuu

SEQ ID NO: 1875133 - RNA, 20 nt, Homo sapiens
gaaucacuguuuagaacaca

SEQ ID NO: 1875134 - RNA, 19 nt, Homo sapiens
gugguuuaucagcaaaaaa

SEQ ID NO: 1875135 - RNA, 15 nt, Homo sapiens
aagcuguaugccaca

SEQ ID NO: 1875136 - RNA, 23 nt, Homo sapiens
aauuguguaccugaaguacagua

SEQ ID NO: 1875137 - RNA, 23 nt, Homo sapiens
gccaaccacuuucaccugggaug

SEQ ID NO: 1875138 - RNA, 23 nt, Homo sapiens
aacaucagcaaaaaaguacuuaa

SEQ ID NO: 1875139 - RNA, 12 nt, Homo sapiens
ugcccagauucc

SEQ ID NO: 1875140 - RNA, 14 nt, Homo sapiens
agauguaucaugau

SEQ ID NO: 1875141 - RNA, 21 nt, Homo sapiens
aaugacggcaaccucugagcc

SEQ ID NO: 1875142 - RNA, 19 nt, Homo sapiens
gccaaugccccacuggcag

SEQ ID NO: 1875143 - RNA, 20 nt, Homo sapiens
uaggcuuacguacuacuugu

SEQ ID NO: 1875144 - RNA, 20 nt, Homo sapiens
aaagacuucauuuaacacug

SEQ ID NO: 1875145 - RNA, 19 nt, Homo sapiens
cucuucagucucuauacca

SEQ ID NO: 1875146 - RNA, 19 nt, Homo sapiens
acuggacuugucuuccuug

SEQ ID NO: 1875147 - RNA, 21 nt, Homo sapiens
ccacgugggcaaacaggcagu

SEQ ID NO: 1875148 - RNA, 20 nt, Homo sapiens
gcuagugguggcuucuccag

SEQ ID NO: 1875149 - RNA, 15 nt, Homo sapiens
aaaccauuaccugua

SEQ ID NO: 1875150 - RNA, 17 nt, Homo sapiens
ugcauggaggcccuccu

SEQ ID NO: 1875151 - RNA, 12 nt, Homo sapiens
caggaugacccc

SEQ ID NO: 1875152 - RNA, 19 nt, Homo sapiens
cucacugcaggcaugcuga

SEQ ID NO: 1875153 - RNA, 12 nt, Homo sapiens
gacuacacagcu

SEQ ID NO: 1875154 - RNA, 21 nt, Homo sapiens
gagagaggugccacacugaaa

SEQ ID NO: 1875155 - RNA, 19 nt, Homo sapiens
caugugaaaucauucauuu

SEQ ID NO: 1875156 - RNA, 22 nt, Homo sapiens
gcccuggcuaauuccccuucca

SEQ ID NO: 1875157 - RNA, 14 nt, Homo sapiens
ccuggggugcaucu

SEQ ID NO: 1875158 - RNA, 18 nt, Homo sapiens
uaucccuuccuacaguaa

SEQ ID NO: 1875159 - RNA, 13 nt, Homo sapiens
aaauuaauuccua

SEQ ID NO: 1875160 - RNA, 18 nt, Homo sapiens
aggcugagaacucguuca

SEQ ID NO: 1875161 - RNA, 20 nt, Homo sapiens
ugaagcuucacucacuguca

SEQ ID NO: 1875162 - RNA, 21 nt, Homo sapiens
ucgcuauugauuuuuacuuca

SEQ ID NO: 1875163 - RNA, 17 nt, Homo sapiens
gaacaaauacaauucag

SEQ ID NO: 1875164 - RNA, 18 nt, Homo sapiens
auuucagcacaugcacua

SEQ ID NO: 1875165 - RNA, 18 nt, Homo sapiens
accaaagcuuuauuucaa

SEQ ID NO: 1875166 - RNA, 16 nt, Homo sapiens
gcuuuacuagugccaa

SEQ ID NO: 1875167 - RNA, 23 nt, Homo sapiens
gccccauagaaaacaaucugccc

SEQ ID NO: 1875168 - RNA, 23 nt, Homo sapiens
ucuacauggacucagagaaaaga

SEQ ID NO: 1875169 - RNA, 18 nt, Homo sapiens
agcccuccacgccggcuc

SEQ ID NO: 1875170 - RNA, 14 nt, Homo sapiens
uccacuucacucca

SEQ ID NO: 1875171 - RNA, 17 nt, Homo sapiens
accuucuaccaccaggg

SEQ ID NO: 1875172 - RNA, 15 nt, Homo sapiens
gagcauuaagcccaa

SEQ ID NO: 1875173 - RNA, 22 nt, Homo sapiens
ugaggagcggacucacuugaug

SEQ ID NO: 1875174 - RNA, 17 nt, Homo sapiens
ugcacucaccucacugu

SEQ ID NO: 1875175 - RNA, 17 nt, Homo sapiens
guuccucaagguccauu

SEQ ID NO: 1875176 - RNA, 14 nt, Homo sapiens
agcuccaguaagau

SEQ ID NO: 1875177 - RNA, 20 nt, Homo sapiens
ucagucaagugaggugacac

SEQ ID NO: 1875178 - RNA, 16 nt, Homo sapiens
acaugagucccagugg

SEQ ID NO: 1875179 - RNA, 17 nt, Homo sapiens
uguuaguucuagcucua

SEQ ID NO: 1875180 - RNA, 16 nt, Homo sapiens
cuggucuuuucuccua

SEQ ID NO: 1875181 - RNA, 16 nt, Homo sapiens
aacuuuggguacuuau

SEQ ID NO: 1875182 - RNA, 18 nt, Homo sapiens
auuugagugucuuugacu

SEQ ID NO: 1875183 - RNA, 14 nt, Homo sapiens
ucauguaacuagaa

SEQ ID NO: 1875184 - RNA, 14 nt, Homo sapiens
ccuuguaauuugaa

SEQ ID NO: 1875185 - RNA, 20 nt, Homo sapiens
gcaaagcgcuauuucaggca

SEQ ID NO: 1875186 - RNA, 20 nt, Homo sapiens
ucacaguguggggaagccca

SEQ ID NO: 1875187 - RNA, 13 nt, Homo sapiens
gcuuaugucauag

SEQ ID NO: 1875188 - RNA, 22 nt, Homo sapiens
aaggacuccauuggaucugcaa

SEQ ID NO: 1875189 - RNA, 18 nt, Homo sapiens
cgggucacacaaaggcau

SEQ ID NO: 1875190 - RNA, 23 nt, Homo sapiens
uguauaugccucauacacauaau

SEQ ID NO: 1875191 - RNA, 15 nt, Homo sapiens
uuaguguauguucua

SEQ ID NO: 1875192 - RNA, 19 nt, Homo sapiens
cucaggccaagggaccagg

SEQ ID NO: 1875193 - RNA, 23 nt, Homo sapiens
ccaacuuuuaaugggauuucaug

SEQ ID NO: 1875194 - RNA, 23 nt, Homo sapiens
cacucaaggaaaagaugugcucc

SEQ ID NO: 1875195 - RNA, 14 nt, Homo sapiens
gugcucacauagga

SEQ ID NO: 1875196 - RNA, 20 nt, Homo sapiens
gcacucccucccagagaaca

SEQ ID NO: 1875197 - RNA, 21 nt, Homo sapiens
cugaugacuuuauccugaguc

SEQ ID NO: 1875198 - RNA, 21 nt, Homo sapiens
gcacagcugaguuaugaugua

SEQ ID NO: 1875199 - RNA, 14 nt, Homo sapiens
uuggucucaugccc

SEQ ID NO: 1875200 - RNA, 21 nt, Homo sapiens
auacuucaugaaauccugggu

SEQ ID NO: 1875201 - RNA, 23 nt, Homo sapiens
auuacugagguuuuuaacaugua

SEQ ID NO: 1875202 - RNA, 16 nt, Homo sapiens
ccucucucagugucaa

SEQ ID NO: 1875203 - RNA, 21 nt, Homo sapiens
cuuagaaauguaaacugccau

SEQ ID NO: 1875204 - RNA, 14 nt, Homo sapiens
auuacacauuucac

SEQ ID NO: 1875205 - RNA, 14 nt, Homo sapiens
uggacacaaggcac

SEQ ID NO: 1875206 - RNA, 18 nt, Homo sapiens
gucagagacagauaccuc

SEQ ID NO: 1875207 - RNA, 19 nt, Homo sapiens
cagagaaaguuggugcugc

SEQ ID NO: 1875208 - RNA, 21 nt, Homo sapiens
uggcauucacacagcccauaa

SEQ ID NO: 1875209 - RNA, 21 nt, Homo sapiens
ggcuguugagggccacuuuuu

SEQ ID NO: 1875210 - RNA, 18 nt, Homo sapiens
auccagcaguguugcuca

SEQ ID NO: 1875211 - RNA, 23 nt, Homo sapiens
uccccuggggucucugcugcauu

SEQ ID NO: 1875212 - RNA, 22 nt, Homo sapiens
ccaagggggcggggacugcugg

SEQ ID NO: 1875213 - RNA, 16 nt, Homo sapiens
acgugugcaguuguag

SEQ ID NO: 1875214 - RNA, 13 nt, Homo sapiens
uaugagauauuaa

SEQ ID NO: 1875215 - RNA, 21 nt, Homo sapiens
gugcauaugaaauccuugacu

SEQ ID NO: 1875216 - RNA, 18 nt, Homo sapiens
cagcugugagaagucacu

SEQ ID NO: 1875217 - RNA, 20 nt, Homo sapiens
uucaacaggagaauuuuacu

SEQ ID NO: 1875218 - RNA, 20 nt, Homo sapiens
guuacaaaguuauauucaca

SEQ ID NO: 1875219 - RNA, 12 nt, Homo sapiens
ugaugcuaaaac

SEQ ID NO: 1875220 - RNA, 15 nt, Homo sapiens
uccauguuuguaaaa

SEQ ID NO: 1875221 - RNA, 23 nt, Homo sapiens
agaguggcuuggccucaagagaa

SEQ ID NO: 1875222 - RNA, 15 nt, Homo sapiens
ccagucucaccuuca

SEQ ID NO: 1875223 - RNA, 15 nt, Homo sapiens
uucaacagagacuga

SEQ ID NO: 1875224 - RNA, 22 nt, Homo sapiens
ugaccaccaacauucuguguuc

SEQ ID NO: 1875225 - RNA, 23 nt, Homo sapiens
agcaaauaagucaucugaugaga

SEQ ID NO: 1875226 - RNA, 22 nt, Homo sapiens
gugcugucaugcccagcuugga

SEQ ID NO: 1875227 - RNA, 19 nt, Homo sapiens
ugagagcugcucuggaaaa

SEQ ID NO: 1875228 - RNA, 22 nt, Homo sapiens
aaagugccuucagccaagacca

SEQ ID NO: 1875229 - RNA, 21 nt, Homo sapiens
acguuugacuagccaucucaa

SEQ ID NO: 1875230 - RNA, 22 nt, Homo sapiens
cauaguuacuguguaaacucau

SEQ ID NO: 1875231 - RNA, 15 nt, Homo sapiens
aucccuucaacccca

SEQ ID NO: 1875232 - RNA, 15 nt, Homo sapiens
uaucaauuuccucau

SEQ ID NO: 1875233 - RNA, 22 nt, Homo sapiens
guccuuaacaccugaucuggcc

SEQ ID NO: 1875234 - RNA, 13 nt, Homo sapiens
aaggaaucugugc

SEQ ID NO: 1875235 - RNA, 20 nt, Homo sapiens
aaaaaugcaagccaucucua

SEQ ID NO: 1875236 - RNA, 17 nt, Homo sapiens
aaacaugcggugccaug

SEQ ID NO: 1875237 - RNA, 19 nt, Homo sapiens
uggaaaaccugaggccaaa

SEQ ID NO: 1875238 - RNA, 11 nt, Homo sapiens
accaagcuaua

SEQ ID NO: 1875239 - RNA, 14 nt, Homo sapiens
augaagaagccacu

SEQ ID NO: 1875240 - RNA, 20 nt, Homo sapiens
uguagaguggcccagaauug

SEQ ID NO: 1875241 - RNA, 14 nt, Homo sapiens
cucaucugggucuc

SEQ ID NO: 1875242 - RNA, 12 nt, Homo sapiens
uagaagcucagg

SEQ ID NO: 1875243 - RNA, 16 nt, Homo sapiens
uaagcaaagacuauga

SEQ ID NO: 1875244 - RNA, 19 nt, Homo sapiens
uccuccugcuucaugggaa

SEQ ID NO: 1875245 - RNA, 18 nt, Homo sapiens
uuauaaugaaaauaaaca

SEQ ID NO: 1875246 - RNA, 21 nt, Homo sapiens
cucagaacucuuugcucuugu

SEQ ID NO: 1875247 - RNA, 19 nt, Homo sapiens
ucacagcuaagaugccaug

SEQ ID NO: 1875248 - RNA, 19 nt, Homo sapiens
cagacuauuaaaacuaaua

SEQ ID NO: 1875249 - RNA, 22 nt, Homo sapiens
uaaaaaagccugguuuuucuca

SEQ ID NO: 1875250 - RNA, 20 nt, Homo sapiens
ggaucacgaggucaggagau

SEQ ID NO: 1875251 - RNA, 12 nt, Homo sapiens
ccuuagcagcuc

SEQ ID NO: 1875252 - RNA, 21 nt, Homo sapiens
cuggugccuauuuauucauuc

SEQ ID NO: 1875253 - RNA, 19 nt, Homo sapiens
gcagacacauugucaucag

SEQ ID NO: 1875254 - RNA, 13 nt, Homo sapiens
agaaucagucuug

SEQ ID NO: 1875255 - RNA, 20 nt, Homo sapiens
ccuuauuuaccuagugcaaa

SEQ ID NO: 1875256 - RNA, 14 nt, Homo sapiens
cuaagacauauuca

SEQ ID NO: 1875257 - RNA, 19 nt, Homo sapiens
gccaggagugcggacacca

SEQ ID NO: 1875258 - RNA, 19 nt, Homo sapiens
aggugcugacuucaucucc

SEQ ID NO: 1875259 - RNA, 15 nt, Homo sapiens
augacuauauauaca

SEQ ID NO: 1875260 - RNA, 15 nt, Homo sapiens
aaaggaaacugcuau

SEQ ID NO: 1875261 - RNA, 21 nt, Homo sapiens
acuuagaauuaguggcacuug

SEQ ID NO: 1875262 - RNA, 21 nt, Homo sapiens
ugugccugggaucgugcauuu

SEQ ID NO: 1875263 - RNA, 15 nt, Homo sapiens
aguaugaagacacug

SEQ ID NO: 1875264 - RNA, 21 nt, Homo sapiens
gcaaagaaucccuagacuuua

SEQ ID NO: 1875265 - RNA, 19 nt, Homo sapiens
uuuaucuuugauucuccuu

SEQ ID NO: 1875266 - RNA, 15 nt, Homo sapiens
uaaugaaauggagga

SEQ ID NO: 1875267 - RNA, 17 nt, Homo sapiens
guuuugaacaaaggaau

SEQ ID NO: 1875268 - RNA, 21 nt, Homo sapiens
ucaugauuuugaaaccaugaa

SEQ ID NO: 1875269 - RNA, 12 nt, Homo sapiens
cacucaaccaug

SEQ ID NO: 1875270 - RNA, 19 nt, Homo sapiens
gucugccacaccucuccaa

SEQ ID NO: 1875271 - RNA, 16 nt, Homo sapiens
uuuaaaaaaaagcaua

SEQ ID NO: 1875272 - RNA, 19 nt, Homo sapiens
cugggacaucuuaguguuu

SEQ ID NO: 1875273 - RNA, 15 nt, Homo sapiens
uggcuuagcugccau

SEQ ID NO: 1875274 - RNA, 23 nt, Homo sapiens
uauacacuuacacuuuaugcaca

SEQ ID NO: 1875275 - RNA, 12 nt, Homo sapiens
auucaaggggag

SEQ ID NO: 1875276 - RNA, 21 nt, Homo sapiens
aacaauggaagauuugcccau

SEQ ID NO: 1875277 - RNA, 17 nt, Homo sapiens
acauuggaaugccuugg

SEQ ID NO: 1875278 - RNA, 22 nt, Homo sapiens
aacagaccaucccccacuccuu

SEQ ID NO: 1875279 - RNA, 18 nt, Homo sapiens
uugugauauauucuguac

SEQ ID NO: 1875280 - RNA, 23 nt, Homo sapiens
aauagcacacuuuuccacauucc

SEQ ID NO: 1875281 - RNA, 16 nt, Homo sapiens
cugauuuaacuuguau

SEQ ID NO: 1875282 - RNA, 17 nt, Homo sapiens
aucggagacagugaucu

SEQ ID NO: 1875283 - RNA, 13 nt, Homo sapiens
aagggcacucuga

SEQ ID NO: 1875284 - RNA, 18 nt, Homo sapiens
ucuagugucugacuuuug

SEQ ID NO: 1875285 - RNA, 16 nt, Homo sapiens
uccaccccgacugcuc

SEQ ID NO: 1875286 - RNA, 17 nt, Homo sapiens
uggucuucagcaaaaaa

SEQ ID NO: 1875287 - RNA, 19 nt, Homo sapiens
uauugaagaaaagcacuuu

SEQ ID NO: 1875288 - RNA, 20 nt, Homo sapiens
gaagcugaggcccauggcca

SEQ ID NO: 1875289 - RNA, 15 nt, Homo sapiens
gugucaccaauucca

SEQ ID NO: 1875290 - RNA, 18 nt, Homo sapiens
acucuuccauucaguuuu

SEQ ID NO: 1875291 - RNA, 16 nt, Homo sapiens
ccaaacaugaauguac

SEQ ID NO: 1875292 - RNA, 18 nt, Homo sapiens
uauauguauauugucuag

SEQ ID NO: 1875293 - RNA, 23 nt, Homo sapiens
uacaguuugauuuuugaccagug

SEQ ID NO: 1875294 - RNA, 15 nt, Homo sapiens
cuucucgcaacugaa

SEQ ID NO: 1875295 - RNA, 17 nt, Homo sapiens
uugcugugugucugucc

SEQ ID NO: 1875296 - RNA, 13 nt, Homo sapiens
aauaagcaaaaag

SEQ ID NO: 1875297 - RNA, 13 nt, Homo sapiens
uuuaggcauuaaa

SEQ ID NO: 1875298 - RNA, 18 nt, Homo sapiens
uccauguaaauugcaaau

SEQ ID NO: 1875299 - RNA, 22 nt, Homo sapiens
agacagggugggaguagugcuu

SEQ ID NO: 1875300 - RNA, 15 nt, Homo sapiens
uagugcccucaucca

SEQ ID NO: 1875301 - RNA, 17 nt, Homo sapiens
ugcaucaucagccuauu

SEQ ID NO: 1875302 - RNA, 19 nt, Homo sapiens
guccuaaugcuugcugcug

SEQ ID NO: 1875303 - RNA, 20 nt, Homo sapiens
aguucuuacugcuuaauuca

SEQ ID NO: 1875304 - RNA, 17 nt, Homo sapiens
gaaauguagcccugggu

SEQ ID NO: 1875305 - RNA, 23 nt, Homo sapiens
cuguccaaauuuaaaaugugugc

SEQ ID NO: 1875306 - RNA, 13 nt, Homo sapiens
ugcauuuagcuuc

SEQ ID NO: 1875307 - RNA, 23 nt, Homo sapiens
gggagccccuaggaaagcagugu

SEQ ID NO: 1875308 - RNA, 15 nt, Homo sapiens
ccaugguucugccuc

SEQ ID NO: 1875309 - RNA, 22 nt, Homo sapiens
gcagucauggaggccaagaacu

SEQ ID NO: 1875310 - RNA, 18 nt, Homo sapiens
agggcaauggacaaggaa

SEQ ID NO: 1875311 - RNA, 15 nt, Homo sapiens
gcacugccacugugg

SEQ ID NO: 1875312 - RNA, 17 nt, Homo sapiens
auaaacagaacucccuu

SEQ ID NO: 1875313 - RNA, 19 nt, Homo sapiens
cuauuggccucccaaaaga

SEQ ID NO: 1875314 - RNA, 18 nt, Homo sapiens
cuuaacacuaucauggac

SEQ ID NO: 1875315 - RNA, 22 nt, Homo sapiens
aggcaccgcagccugucagcca

SEQ ID NO: 1875316 - RNA, 20 nt, Homo sapiens
gaacaacuuguagcagcuau

SEQ ID NO: 1875317 - RNA, 20 nt, Homo sapiens
uacauucacgacaguacuuu

SEQ ID NO: 1875318 - RNA, 13 nt, Homo sapiens
uugccguaccaau

SEQ ID NO: 1875319 - RNA, 15 nt, Homo sapiens
gccccuggcccagag

SEQ ID NO: 1875320 - RNA, 22 nt, Homo sapiens
uucugaaguugaaacccaugau

SEQ ID NO: 1875321 - RNA, 15 nt, Homo sapiens
agauuaaacuucacc

SEQ ID NO: 1875322 - RNA, 19 nt, Homo sapiens
cuagcucuuccccaucuca

SEQ ID NO: 1875323 - RNA, 22 nt, Homo sapiens
aucacacucauaacucauuguc

SEQ ID NO: 1875324 - RNA, 21 nt, Homo sapiens
gcacuuugaaggggccucacc

SEQ ID NO: 1875325 - RNA, 23 nt, Homo sapiens
acacacgggaagucugguagcuc

SEQ ID NO: 1875326 - RNA, 15 nt, Homo sapiens
ucuauaacuacauau

SEQ ID NO: 1875327 - RNA, 18 nt, Homo sapiens
cccagacacagacuggca

SEQ ID NO: 1875328 - RNA, 15 nt, Homo sapiens
ugaauagaaauggga

SEQ ID NO: 1875329 - RNA, 23 nt, Homo sapiens
ccaacauggugaaacuccaucuc

SEQ ID NO: 1875330 - RNA, 22 nt, Homo sapiens
ugaccuaaauaaggaucaauug

SEQ ID NO: 1875331 - RNA, 15 nt, Homo sapiens
cacgugugcagacug

SEQ ID NO: 1875332 - RNA, 15 nt, Homo sapiens
aacugagcaucucca

SEQ ID NO: 1875333 - RNA, 17 nt, Homo sapiens
agaugcuuuccugcaca

SEQ ID NO: 1875334 - RNA, 14 nt, Homo sapiens
uaccucagcauuua

SEQ ID NO: 1875335 - RNA, 13 nt, Homo sapiens
cugcccagacaag

SEQ ID NO: 1875336 - RNA, 17 nt, Homo sapiens
gauuccccuggacauau

SEQ ID NO: 1875337 - RNA, 21 nt, Homo sapiens
uuuuguaucaccucuucacaa

SEQ ID NO: 1875338 - RNA, 20 nt, Homo sapiens
caauuuuucaagagcuccuu

SEQ ID NO: 1875339 - RNA, 15 nt, Homo sapiens
cugauccaggcaauc

SEQ ID NO: 1875340 - RNA, 18 nt, Homo sapiens
cccagagguaacagaaca

SEQ ID NO: 1875341 - RNA, 16 nt, Homo sapiens
uuucccaacauaugcc

SEQ ID NO: 1875342 - RNA, 19 nt, Homo sapiens
cagggcugggucaggggua

SEQ ID NO: 1875343 - RNA, 21 nt, Homo sapiens
cuggauuugccugcagaguuu

SEQ ID NO: 1875344 - RNA, 19 nt, Homo sapiens
guaaauauagcucagguag

SEQ ID NO: 1875345 - RNA, 24 nt, Homo sapiens
guuguuuucagacucagacuccau

SEQ ID NO: 1875346 - RNA, 13 nt, Homo sapiens
uucuaauauggag

SEQ ID NO: 1875347 - RNA, 19 nt, Homo sapiens
ccagggcaaugccaucagc

SEQ ID NO: 1875348 - RNA, 17 nt, Homo sapiens
auacaccuacuacucaa

SEQ ID NO: 1875349 - RNA, 17 nt, Homo sapiens
cugggugcggugacuca

SEQ ID NO: 1875350 - RNA, 18 nt, Homo sapiens
ucgcaccauugcacucca

SEQ ID NO: 1875351 - RNA, 15 nt, Homo sapiens
cugggagaaccucag

SEQ ID NO: 1875352 - RNA, 11 nt, Homo sapiens
acacaucucuu

SEQ ID NO: 1875353 - RNA, 12 nt, Homo sapiens
gacuuugcuugc

SEQ ID NO: 1875354 - RNA, 21 nt, Homo sapiens
cagaucuuuuagcccagucau

SEQ ID NO: 1875355 - RNA, 12 nt, Homo sapiens
uuaauuuugcca

SEQ ID NO: 1875356 - RNA, 16 nt, Homo sapiens
ucccacccuaccacag

SEQ ID NO: 1875357 - RNA, 12 nt, Homo sapiens
uguuuacuguaa

SEQ ID NO: 1875358 - RNA, 18 nt, Homo sapiens
acgucuccuucacugaag

SEQ ID NO: 1875359 - RNA, 15 nt, Homo sapiens
ugugggucucuggaa

SEQ ID NO: 1875360 - RNA, 22 nt, Homo sapiens
aaccuuucagcuggcagaguua

SEQ ID NO: 1875361 - RNA, 15 nt, Homo sapiens
ccacacauauugcac

SEQ ID NO: 1875362 - RNA, 12 nt, Homo sapiens
ucuucuaugcaa

SEQ ID NO: 1875363 - RNA, 23 nt, Homo sapiens
aaacugcagucaucaacaaugau

SEQ ID NO: 1875364 - RNA, 19 nt, Homo sapiens
cucuuauuuuacugaggau

SEQ ID NO: 1875365 - RNA, 17 nt, Homo sapiens
gaauccgcccaucuggg

SEQ ID NO: 1875366 - RNA, 22 nt, Homo sapiens
acccucugcuaugucugugaug

SEQ ID NO: 1875367 - RNA, 23 nt, Homo sapiens
cccauuccauuuaucuuucuaca

SEQ ID NO: 1875368 - RNA, 19 nt, Homo sapiens
ccggaggaaaauuugacau

SEQ ID NO: 1875369 - RNA, 13 nt, Homo sapiens
auacauauguuaa

SEQ ID NO: 1875370 - RNA, 23 nt, Homo sapiens
auguguaguguugcuauguguac

SEQ ID NO: 1875371 - RNA, 16 nt, Homo sapiens
cauggcuggcacauug

SEQ ID NO: 1875372 - RNA, 13 nt, Homo sapiens
ccauuuucuuuac

SEQ ID NO: 1875373 - RNA, 14 nt, Homo sapiens
aaugcaugcuucuu

SEQ ID NO: 1875374 - RNA, 23 nt, Homo sapiens
uucaaggacuagaaccuaucuuu

SEQ ID NO: 1875375 - RNA, 13 nt, Homo sapiens
ucagcugaugcuc

SEQ ID NO: 1875376 - RNA, 21 nt, Homo sapiens
aacaguuguauguuugcugau

SEQ ID NO: 1875377 - RNA, 20 nt, Homo sapiens
ugcuuacuuuuuauauagca

SEQ ID NO: 1875378 - RNA, 15 nt, Homo sapiens
guggcucacuacuga

SEQ ID NO: 1875379 - RNA, 21 nt, Homo sapiens
ugugugagagcuguacauuaa

SEQ ID NO: 1875380 - RNA, 12 nt, Homo sapiens
uccuugcacuuu

SEQ ID NO: 1875381 - RNA, 21 nt, Homo sapiens
ugcucccagcagcccuaagga

SEQ ID NO: 1875382 - RNA, 18 nt, Homo sapiens
ugggaccccacagaguug

SEQ ID NO: 1875383 - RNA, 10 nt, Homo sapiens
auuaaggguu

SEQ ID NO: 1875384 - RNA, 22 nt, Homo sapiens
uccuaccacaaugcagugccuu

SEQ ID NO: 1875385 - RNA, 19 nt, Homo sapiens
auguuucaccaaggaaaua

SEQ ID NO: 1875386 - RNA, 14 nt, Homo sapiens
cccuaaaaauucca

SEQ ID NO: 1875387 - RNA, 17 nt, Homo sapiens
uuguuaggagaugucau

SEQ ID NO: 1875388 - RNA, 19 nt, Homo sapiens
agaacugaaggcauaugca

SEQ ID NO: 1875389 - RNA, 18 nt, Homo sapiens
aggaggggucucaugucc

SEQ ID NO: 1875390 - RNA, 18 nt, Homo sapiens
ugguauaaagcucucaaa

SEQ ID NO: 1875391 - RNA, 12 nt, Homo sapiens
uggccaagcuga

SEQ ID NO: 1875392 - RNA, 23 nt, Homo sapiens
acccagaauguagcaucugagaa

SEQ ID NO: 1875393 - RNA, 14 nt, Homo sapiens
cuggagccugggca

SEQ ID NO: 1875394 - RNA, 14 nt, Homo sapiens
acuuugcacugaua

SEQ ID NO: 1875395 - RNA, 17 nt, Homo sapiens
auauagaaaaauaacuu

SEQ ID NO: 1875396 - RNA, 19 nt, Homo sapiens
caaaaauuuuuuaaauuca

SEQ ID NO: 1875397 - RNA, 14 nt, Homo sapiens
acuugaagcacuua

SEQ ID NO: 1875398 - RNA, 15 nt, Homo sapiens
uuauacagugauaaa

SEQ ID NO: 1875399 - RNA, 15 nt, Homo sapiens
cugggggcuagcaga

SEQ ID NO: 1875400 - RNA, 15 nt, Homo sapiens
ucccuggugcccuuc

SEQ ID NO: 1875401 - RNA, 18 nt, Homo sapiens
auucgggugugagucuuu

SEQ ID NO: 1875402 - RNA, 22 nt, Homo sapiens
agcagauggucccauuauucua

SEQ ID NO: 1875403 - RNA, 21 nt, Homo sapiens
cgagacuccaccucuaccaaa

SEQ ID NO: 1875404 - RNA, 22 nt, Homo sapiens
gagggaacccugacuacagaaa

SEQ ID NO: 1875405 - RNA, 17 nt, Homo sapiens
aguguggggaaugggaa

SEQ ID NO: 1875406 - RNA, 15 nt, Homo sapiens
cugcauuagucucau

SEQ ID NO: 1875407 - RNA, 17 nt, Homo sapiens
uaauucccgccuuaugc

SEQ ID NO: 1875408 - RNA, 19 nt, Homo sapiens
acagugccuggcaaggccu

SEQ ID NO: 1875409 - RNA, 15 nt, Homo sapiens
aauauuuauaagcua

SEQ ID NO: 1875410 - RNA, 16 nt, Homo sapiens
uccaggcuucacaguc

SEQ ID NO: 1875411 - RNA, 20 nt, Homo sapiens
acagaggauggcuuccccau

SEQ ID NO: 1875412 - RNA, 21 nt, Homo sapiens
uuuaacaugacuucugcccca

SEQ ID NO: 1875413 - RNA, 16 nt, Homo sapiens
gaugacugcugugaaa

SEQ ID NO: 1875414 - RNA, 12 nt, Homo sapiens
aguggugucauu

SEQ ID NO: 1875415 - RNA, 21 nt, Homo sapiens
aaaccaaccgcacaugcagau

SEQ ID NO: 1875416 - RNA, 20 nt, Homo sapiens
caauguccaaacccacucau

SEQ ID NO: 1875417 - RNA, 18 nt, Homo sapiens
gccuugguaugugccagg

SEQ ID NO: 1875418 - RNA, 15 nt, Homo sapiens
aaacagccucuccaa

SEQ ID NO: 1875419 - RNA, 13 nt, Homo sapiens
ggcuuuugugcau

SEQ ID NO: 1875420 - RNA, 18 nt, Homo sapiens
uguaaguugggcuugcua

SEQ ID NO: 1875421 - RNA, 23 nt, Homo sapiens
uguuugggauauuaaaacacaaa

SEQ ID NO: 1875422 - RNA, 16 nt, Homo sapiens
auucagccaggagaug

SEQ ID NO: 1875423 - RNA, 20 nt, Homo sapiens
cagcuuguugguugucacuc

SEQ ID NO: 1875424 - RNA, 20 nt, Homo sapiens
cagguucaagcaauucuccu

SEQ ID NO: 1875425 - RNA, 17 nt, Homo sapiens
uuugaauaaaugucacu

SEQ ID NO: 1875426 - RNA, 21 nt, Homo sapiens
acaggaaggaagcacaaaaga

SEQ ID NO: 1875427 - RNA, 16 nt, Homo sapiens
ucugucccaaucuuac

SEQ ID NO: 1875428 - RNA, 13 nt, Homo sapiens
ugaauuacccuuu

SEQ ID NO: 1875429 - RNA, 20 nt, Homo sapiens
uucacacuaucaacacugca

SEQ ID NO: 1875430 - RNA, 22 nt, Homo sapiens
cagcuacacaaggaaggcauuu

SEQ ID NO: 1875431 - RNA, 17 nt, Homo sapiens
aaccacuccacuggccu

SEQ ID NO: 1875432 - RNA, 14 nt, Homo sapiens
uccugggugcauca

SEQ ID NO: 1875433 - RNA, 19 nt, Homo sapiens
aagauuuaugaugcacuua

SEQ ID NO: 1875434 - RNA, 19 nt, Homo sapiens
ggggcacacuacagagcag

SEQ ID NO: 1875435 - RNA, 22 nt, Homo sapiens
ucaagagaucuuucuuuccaaa

SEQ ID NO: 1875436 - RNA, 14 nt, Homo sapiens
caccaugcccagcu

SEQ ID NO: 1875437 - RNA, 23 nt, Homo sapiens
augcaugucugccuaugcacuga

SEQ ID NO: 1875438 - RNA, 14 nt, Homo sapiens
auucaagcauuuag

SEQ ID NO: 1875439 - RNA, 20 nt, Homo sapiens
agauucuguuaacucuugaa

SEQ ID NO: 1875440 - RNA, 22 nt, Homo sapiens
aacaugcacauucauccucaca

SEQ ID NO: 1875441 - RNA, 23 nt, Homo sapiens
uaccuccccuuuucuauguugcu

SEQ ID NO: 1875442 - RNA, 15 nt, Homo sapiens
ucccuucuuacuuaa

SEQ ID NO: 1875443 - RNA, 15 nt, Homo sapiens
gccuaucugaccaaa

SEQ ID NO: 1875444 - RNA, 15 nt, Homo sapiens
aaucuucuacuuuaa

SEQ ID NO: 1875445 - RNA, 21 nt, Homo sapiens
aaggacguggaugaagcagag

SEQ ID NO: 1875446 - RNA, 23 nt, Homo sapiens
guacccuuccuacagauagucaa

SEQ ID NO: 1875447 - RNA, 20 nt, Homo sapiens
uccuauuuuucuuguuuuau

SEQ ID NO: 1875448 - RNA, 22 nt, Homo sapiens
ggccuccugccucuacugggaa

SEQ ID NO: 1875449 - RNA, 14 nt, Homo sapiens
ucagacacaggaaa

SEQ ID NO: 1875450 - RNA, 22 nt, Homo sapiens
agggcucucuuuccuucuugcc

SEQ ID NO: 1875451 - RNA, 16 nt, Homo sapiens
uccucucguacuugaa

SEQ ID NO: 1875452 - RNA, 23 nt, Homo sapiens
ccauaugaauuuacuacuuuaaa

SEQ ID NO: 1875453 - RNA, 23 nt, Homo sapiens
ucaguauaaauuaucuuaugaaa

SEQ ID NO: 1875454 - RNA, 17 nt, Homo sapiens
uauugcaguaaugauau

SEQ ID NO: 1875455 - RNA, 15 nt, Homo sapiens
ugcuuucuaucuaau

SEQ ID NO: 1875456 - RNA, 17 nt, Homo sapiens
ccaggcugcagccucca

SEQ ID NO: 1875457 - RNA, 17 nt, Homo sapiens
acaauuuuuuccacuua

SEQ ID NO: 1875458 - RNA, 14 nt, Homo sapiens
uaaguaugccucag

SEQ ID NO: 1875459 - RNA, 13 nt, Homo sapiens
ucugcaggccacu

SEQ ID NO: 1875460 - RNA, 21 nt, Homo sapiens
ucaguugauauaaaacucugg

SEQ ID NO: 1875461 - RNA, 17 nt, Homo sapiens
gauaauuaaaugaaaua

SEQ ID NO: 1875462 - RNA, 14 nt, Homo sapiens
auucaccaacacag

SEQ ID NO: 1875463 - RNA, 15 nt, Homo sapiens
aucuuacagucagca

SEQ ID NO: 1875464 - RNA, 23 nt, Homo sapiens
caaugugcuccuucauaagccau

SEQ ID NO: 1875465 - RNA, 13 nt, Homo sapiens
cugcauacagggg

SEQ ID NO: 1875466 - RNA, 21 nt, Homo sapiens
ucucaggcucuugacuacuug

SEQ ID NO: 1875467 - RNA, 15 nt, Homo sapiens
uucauccuagucuag

SEQ ID NO: 1875468 - RNA, 14 nt, Homo sapiens
uagagcagauucua

SEQ ID NO: 1875469 - RNA, 21 nt, Homo sapiens
uccuccuagacucugugaucu

SEQ ID NO: 1875470 - RNA, 22 nt, Homo sapiens
uggacuccaucucucauccucc

SEQ ID NO: 1875471 - RNA, 17 nt, Homo sapiens
gacacagacauccucua

SEQ ID NO: 1875472 - RNA, 14 nt, Homo sapiens
aaaaauccugucau

SEQ ID NO: 1875473 - RNA, 16 nt, Homo sapiens
gcguguguacacggga

SEQ ID NO: 1875474 - RNA, 20 nt, Homo sapiens
gcuagaaauaagcccaacag

SEQ ID NO: 1875475 - RNA, 20 nt, Homo sapiens
ccaccuuuccagccauagag

SEQ ID NO: 1875476 - RNA, 12 nt, Homo sapiens
gaagaauggaga

SEQ ID NO: 1875477 - RNA, 12 nt, Homo sapiens
gaacugugccac

SEQ ID NO: 1875478 - RNA, 23 nt, Homo sapiens
cugucuuucaaugacacccugau

SEQ ID NO: 1875479 - RNA, 16 nt, Homo sapiens
aacagaggcauuuaaa

SEQ ID NO: 1875480 - RNA, 19 nt, Homo sapiens
ugcaaacucacugcucaag

SEQ ID NO: 1875481 - RNA, 19 nt, Homo sapiens
gcccugaaggugccacucc

SEQ ID NO: 1875482 - RNA, 13 nt, Homo sapiens
agcuagaauuuga

SEQ ID NO: 1875483 - RNA, 21 nt, Homo sapiens
cugagcaaagggaacagugag

SEQ ID NO: 1875484 - RNA, 19 nt, Homo sapiens
cucaguuaggcagugcagu

SEQ ID NO: 1875485 - RNA, 19 nt, Homo sapiens
uaugccuuuauauacuuag

SEQ ID NO: 1875486 - RNA, 22 nt, Homo sapiens
aaaauauuaagacaauagcacu

SEQ ID NO: 1875487 - RNA, 16 nt, Homo sapiens
ugauccuuggugcugu

SEQ ID NO: 1875488 - RNA, 20 nt, Homo sapiens
cacuuucccaaaacugccac

SEQ ID NO: 1875489 - RNA, 15 nt, Homo sapiens
aguccuuuauugucc

SEQ ID NO: 1875490 - RNA, 22 nt, Homo sapiens
caccucccacuccugcugcaca

SEQ ID NO: 1875491 - RNA, 18 nt, Homo sapiens
cugugugaaaucuuucaa

SEQ ID NO: 1875492 - RNA, 22 nt, Homo sapiens
ucuggcaucucuuucugcaaag

SEQ ID NO: 1875493 - RNA, 15 nt, Homo sapiens
ucccuucuacugcuu

SEQ ID NO: 1875494 - RNA, 20 nt, Homo sapiens
gacuaaagauugcagcauuu

SEQ ID NO: 1875495 - RNA, 15 nt, Homo sapiens
ugaaaaucauaggca

SEQ ID NO: 1875496 - RNA, 16 nt, Homo sapiens
gucuguuggcaauuga

SEQ ID NO: 1875497 - RNA, 14 nt, Homo sapiens
gaaaaucauguuga

SEQ ID NO: 1875498 - RNA, 14 nt, Homo sapiens
cauaucagcucucu

SEQ ID NO: 1875499 - RNA, 16 nt, Homo sapiens
ugaggcagaaccuggu

SEQ ID NO: 1875500 - RNA, 19 nt, Homo sapiens
aagagggcacacacugugu

SEQ ID NO: 1875501 - RNA, 13 nt, Homo sapiens
ugcgcugcucaac

SEQ ID NO: 1875502 - RNA, 17 nt, Homo sapiens
auuaaucauacaaacuc

SEQ ID NO: 1875503 - RNA, 22 nt, Homo sapiens
gaaaauuuuagaagacagccua

SEQ ID NO: 1875504 - RNA, 14 nt, Homo sapiens
gcccuccacgccgg

SEQ ID NO: 1875505 - RNA, 15 nt, Homo sapiens
caucauaucuacuau

SEQ ID NO: 1875506 - RNA, 21 nt, Homo sapiens
ccaccucuugggcaugcucag

SEQ ID NO: 1875507 - RNA, 17 nt, Homo sapiens
cuucuccccuccaagug

SEQ ID NO: 1875508 - RNA, 17 nt, Homo sapiens
accugguaugugccagg

SEQ ID NO: 1875509 - RNA, 12 nt, Homo sapiens
cuacuguucuaa

SEQ ID NO: 1875510 - RNA, 16 nt, Homo sapiens
cacuucuaaaugcaua

SEQ ID NO: 1875511 - RNA, 18 nt, Homo sapiens
ccagcugaauaguuacug

SEQ ID NO: 1875512 - RNA, 21 nt, Homo sapiens
uucuucuuggucucaguguca

SEQ ID NO: 1875513 - RNA, 11 nt, Homo sapiens
aagcuguuauu

SEQ ID NO: 1875514 - RNA, 15 nt, Homo sapiens
ucccuggaagaggaa

SEQ ID NO: 1875515 - RNA, 18 nt, Homo sapiens
auuguuuugaccccuuac

SEQ ID NO: 1875516 - RNA, 20 nt, Homo sapiens
uuugaauucuauguuggcau

SEQ ID NO: 1875517 - RNA, 20 nt, Homo sapiens
augaaggagugcgugccugc

SEQ ID NO: 1875518 - RNA, 12 nt, Homo sapiens
cccaccucuggc

SEQ ID NO: 1875519 - RNA, 17 nt, Homo sapiens
caagucacucaucucag

SEQ ID NO: 1875520 - RNA, 20 nt, Homo sapiens
ucuugauaucucgaacuuuc

SEQ ID NO: 1875521 - RNA, 20 nt, Homo sapiens
agaauaagaaaacaaucaca

SEQ ID NO: 1875522 - RNA, 23 nt, Homo sapiens
ucaucauuaaaagcaaggcucaa

SEQ ID NO: 1875523 - RNA, 20 nt, Homo sapiens
cgggggaaagcacaccucau

SEQ ID NO: 1875524 - RNA, 18 nt, Homo sapiens
aacaaugccgccugucaa

SEQ ID NO: 1875525 - RNA, 13 nt, Homo sapiens
gagaagcugccau

SEQ ID NO: 1875526 - RNA, 12 nt, Homo sapiens
ucaacagaucaa

SEQ ID NO: 1875527 - RNA, 16 nt, Homo sapiens
augggggugcauuuga

SEQ ID NO: 1875528 - RNA, 16 nt, Homo sapiens
acccaucucacucucc

SEQ ID NO: 1875529 - RNA, 19 nt, Homo sapiens
ccacauuauacauuugaug

SEQ ID NO: 1875530 - RNA, 18 nt, Homo sapiens
gaacguggauugugaaga

SEQ ID NO: 1875531 - RNA, 15 nt, Homo sapiens
uccccucagauucca

SEQ ID NO: 1875532 - RNA, 16 nt, Homo sapiens
cugacauugccaaaaa

SEQ ID NO: 1875533 - RNA, 15 nt, Homo sapiens
gccucucucugccug

SEQ ID NO: 1875534 - RNA, 13 nt, Homo sapiens
cccagcugcauuu

SEQ ID NO: 1875535 - RNA, 23 nt, Homo sapiens
cuaauguuuaaaagcaaaacugc

SEQ ID NO: 1875536 - RNA, 18 nt, Homo sapiens
agaaaauucaagcauuua

SEQ ID NO: 1875537 - RNA, 22 nt, Homo sapiens
ugucauggcucugaacugcaca

SEQ ID NO: 1875538 - RNA, 14 nt, Homo sapiens
cauucauccuucca

SEQ ID NO: 1875539 - RNA, 14 nt, Homo sapiens
acaauugugaaguc

SEQ ID NO: 1875540 - RNA, 17 nt, Homo sapiens
cugcccacgcagaggac

SEQ ID NO: 1875541 - RNA, 21 nt, Homo sapiens
gcgcuaauuuugaaugcccuc

SEQ ID NO: 1875542 - RNA, 19 nt, Homo sapiens
gacagcuguauauugcuca

SEQ ID NO: 1875543 - RNA, 20 nt, Homo sapiens
uggcucagugccaccuaugc

SEQ ID NO: 1875544 - RNA, 15 nt, Homo sapiens
cucuuggacccuggg

SEQ ID NO: 1875545 - RNA, 16 nt, Homo sapiens
uacugggcugcauucc

SEQ ID NO: 1875546 - RNA, 22 nt, Homo sapiens
aacacuacucuuacauguauaa

SEQ ID NO: 1875547 - RNA, 16 nt, Homo sapiens
agacauggaacagugu

SEQ ID NO: 1875548 - RNA, 21 nt, Homo sapiens
uggggucuuuuuaugcauuug

SEQ ID NO: 1875549 - RNA, 12 nt, Homo sapiens
aaacugugaacc

SEQ ID NO: 1875550 - RNA, 12 nt, Homo sapiens
aacaugugaaaa

SEQ ID NO: 1875551 - RNA, 14 nt, Homo sapiens
caccauucauucca

SEQ ID NO: 1875552 - RNA, 16 nt, Homo sapiens
caugcccccucaguga

SEQ ID NO: 1875553 - RNA, 21 nt, Homo sapiens
guggcauccccacguggacaa

SEQ ID NO: 1875554 - RNA, 13 nt, Homo sapiens
ucuauuccugacc

SEQ ID NO: 1875555 - RNA, 20 nt, Homo sapiens
cagugaaguaaaauugagug

SEQ ID NO: 1875556 - RNA, 19 nt, Homo sapiens
uuagauauugcuacuauaa

SEQ ID NO: 1875557 - RNA, 21 nt, Homo sapiens
uaggagacagagccaagcacu

SEQ ID NO: 1875558 - RNA, 23 nt, Homo sapiens
ucugcaagauucugugggcagcu

SEQ ID NO: 1875559 - RNA, 15 nt, Homo sapiens
ggugacacaggucag

SEQ ID NO: 1875560 - RNA, 15 nt, Homo sapiens
uucacuguacugcau

SEQ ID NO: 1875561 - RNA, 19 nt, Homo sapiens
ugggcagcuggcucugaau

SEQ ID NO: 1875562 - RNA, 20 nt, Homo sapiens
aggcguuugaaucagaguga

SEQ ID NO: 1875563 - RNA, 14 nt, Homo sapiens
agucauaccaucca

SEQ ID NO: 1875564 - RNA, 22 nt, Homo sapiens
cuaguccccagccugcucccua

SEQ ID NO: 1875565 - RNA, 22 nt, Homo sapiens
augccagcagccagccaacccu

SEQ ID NO: 1875566 - RNA, 20 nt, Homo sapiens
ugggggagugugaguuuugc

SEQ ID NO: 1875567 - RNA, 21 nt, Homo sapiens
cuggcagagagcacagugauc

SEQ ID NO: 1875568 - RNA, 18 nt, Homo sapiens
uaauuuucuacaaccuaa

SEQ ID NO: 1875569 - RNA, 18 nt, Homo sapiens
ggccgggcugcugcugau

SEQ ID NO: 1875570 - RNA, 14 nt, Homo sapiens
gccuucacauuccc

SEQ ID NO: 1875571 - RNA, 16 nt, Homo sapiens
ucugugcuuugacuca

SEQ ID NO: 1875572 - RNA, 20 nt, Homo sapiens
agcucuggugauaaggacau

SEQ ID NO: 1875573 - RNA, 14 nt, Homo sapiens
ugaaaccguaucuc

SEQ ID NO: 1875574 - RNA, 13 nt, Homo sapiens
cguuuaaucacau

SEQ ID NO: 1875575 - RNA, 21 nt, Homo sapiens
caggagagaaugcccagugac

SEQ ID NO: 1875576 - RNA, 21 nt, Homo sapiens
ucauuuguaccucgaguuuua

SEQ ID NO: 1875577 - RNA, 17 nt, Homo sapiens
aaagucaaaugccaaac

SEQ ID NO: 1875578 - RNA, 24 nt, Homo sapiens
cugucaugaaaucagcaagagagg

SEQ ID NO: 1875579 - RNA, 15 nt, Homo sapiens
gcuuugccauuguga

SEQ ID NO: 1875580 - RNA, 17 nt, Homo sapiens
acuuuuacuacagugac

SEQ ID NO: 1875581 - RNA, 23 nt, Homo sapiens
agcccuacauugugcugcaccug

SEQ ID NO: 1875582 - RNA, 12 nt, Homo sapiens
ucccucugaugu

SEQ ID NO: 1875583 - RNA, 14 nt, Homo sapiens
caagccacuauguc

SEQ ID NO: 1875584 - RNA, 16 nt, Homo sapiens
ggaaggugacugugug

SEQ ID NO: 1875585 - RNA, 13 nt, Homo sapiens
caucccagagccc

SEQ ID NO: 1875586 - RNA, 22 nt, Homo sapiens
gcugcaucuuauagcacuuuga

SEQ ID NO: 1875587 - RNA, 20 nt, Homo sapiens
augaaauccagugagcacua

SEQ ID NO: 1875588 - RNA, 13 nt, Homo sapiens
cagccuggaaggg

SEQ ID NO: 1875589 - RNA, 15 nt, Homo sapiens
ucuuuuucacacuga

SEQ ID NO: 1875590 - RNA, 21 nt, Homo sapiens
uccacucagguucuucagggc

SEQ ID NO: 1875591 - RNA, 23 nt, Homo sapiens
auuucacuggccuaaugagauaa

SEQ ID NO: 1875592 - RNA, 21 nt, Homo sapiens
ucuuacugcuugguccuugau

SEQ ID NO: 1875593 - RNA, 21 nt, Homo sapiens
cucauuuugugaugugucaca

SEQ ID NO: 1875594 - RNA, 22 nt, Homo sapiens
ugcagauaugggacugauucug

SEQ ID NO: 1875595 - RNA, 17 nt, Homo sapiens
agauaauaucugugagg

SEQ ID NO: 1875596 - RNA, 20 nt, Homo sapiens
caguuccauucaacuggaac

SEQ ID NO: 1875597 - RNA, 17 nt, Homo sapiens
augcauuuucuucagaa

SEQ ID NO: 1875598 - RNA, 18 nt, Homo sapiens
uggaucaccugaggucag

SEQ ID NO: 1875599 - RNA, 19 nt, Homo sapiens
acaccagagacaagcagag

SEQ ID NO: 1875600 - RNA, 17 nt, Homo sapiens
aaagcaaucuguugaaa

SEQ ID NO: 1875601 - RNA, 22 nt, Homo sapiens
acugacaacaugcuagguagug

SEQ ID NO: 1875602 - RNA, 16 nt, Homo sapiens
uaaaagacaugcauuu

SEQ ID NO: 1875603 - RNA, 19 nt, Homo sapiens
cuucucagcucccauuucu

SEQ ID NO: 1875604 - RNA, 16 nt, Homo sapiens
ucaaaaacacaguguu

SEQ ID NO: 1875605 - RNA, 20 nt, Homo sapiens
aacaaucuauggcuuauuuc

SEQ ID NO: 1875606 - RNA, 23 nt, Homo sapiens
cucaaccaccuaggcaaugaaga

SEQ ID NO: 1875607 - RNA, 21 nt, Homo sapiens
cuacaugccucagugaaggac

SEQ ID NO: 1875608 - RNA, 22 nt, Homo sapiens
ucuuaaccucagggagugcaga

SEQ ID NO: 1875609 - RNA, 12 nt, Homo sapiens
ugagaugaaugu

SEQ ID NO: 1875610 - RNA, 17 nt, Homo sapiens
uugaguagaguugauca

SEQ ID NO: 1875611 - RNA, 12 nt, Homo sapiens
acaauguugcac

SEQ ID NO: 1875612 - RNA, 15 nt, Homo sapiens
uggggccucaccugc

SEQ ID NO: 1875613 - RNA, 21 nt, Homo sapiens
cugcucccaccaccagugaga

SEQ ID NO: 1875614 - RNA, 20 nt, Homo sapiens
aaugugcuucuaguaggcac

SEQ ID NO: 1875615 - RNA, 14 nt, Homo sapiens
gacuuguggggcag

SEQ ID NO: 1875616 - RNA, 16 nt, Homo sapiens
aauuuucuaugcuuau

SEQ ID NO: 1875617 - RNA, 23 nt, Homo sapiens
uucaaguuuuuuucaaaguccaa

SEQ ID NO: 1875618 - RNA, 14 nt, Homo sapiens
guagauaugauaga

SEQ ID NO: 1875619 - RNA, 22 nt, Homo sapiens
gcaggaacucuaagaccacaga

SEQ ID NO: 1875620 - RNA, 22 nt, Homo sapiens
ccugaaucugugccugcacuga

SEQ ID NO: 1875621 - RNA, 17 nt, Homo sapiens
uggcuccccaaagggug

SEQ ID NO: 1875622 - RNA, 16 nt, Homo sapiens
cuuucuccagcccuga

SEQ ID NO: 1875623 - RNA, 22 nt, Homo sapiens
cccucuguggcucacauuucau

SEQ ID NO: 1875624 - RNA, 20 nt, Homo sapiens
ccuaauaaauuuuggucaga

SEQ ID NO: 1875625 - RNA, 18 nt, Homo sapiens
agauauuaaaugauguuu

SEQ ID NO: 1875626 - RNA, 18 nt, Homo sapiens
agcccccagcuuccagca

SEQ ID NO: 1875627 - RNA, 16 nt, Homo sapiens
acggagucuugcucug

SEQ ID NO: 1875628 - RNA, 14 nt, Homo sapiens
gucauuguauguua

SEQ ID NO: 1875629 - RNA, 14 nt, Homo sapiens
aaguaagugacaau

SEQ ID NO: 1875630 - RNA, 21 nt, Homo sapiens
ugaaagcuuuauacaguugaa

SEQ ID NO: 1875631 - RNA, 19 nt, Homo sapiens
aagauuccuuuccacucca

SEQ ID NO: 1875632 - RNA, 14 nt, Homo sapiens
augagagugcacug

SEQ ID NO: 1875633 - RNA, 18 nt, Homo sapiens
guccuacagaaaaaccuu

SEQ ID NO: 1875634 - RNA, 23 nt, Homo sapiens
cucuuagaugcaguucugaagaa

SEQ ID NO: 1875635 - RNA, 18 nt, Homo sapiens
cccaucuggcugugacag

SEQ ID NO: 1875636 - RNA, 22 nt, Homo sapiens
uucacuggucucuaaguguaaa

SEQ ID NO: 1875637 - RNA, 22 nt, Homo sapiens
uguuuuaaaugaaccaaaccaa

SEQ ID NO: 1875638 - RNA, 21 nt, Homo sapiens
cacaaggaaaaggccauuaaa

SEQ ID NO: 1875639 - RNA, 23 nt, Homo sapiens
agugucugucagcuucauucucu

SEQ ID NO: 1875640 - RNA, 13 nt, Homo sapiens
agagccuuuccaa

SEQ ID NO: 1875641 - RNA, 19 nt, Homo sapiens
cuugaauuucuccgaaugu

SEQ ID NO: 1875642 - RNA, 13 nt, Homo sapiens
guacuccucagac

SEQ ID NO: 1875643 - RNA, 21 nt, Homo sapiens
cugcccgugaggagggggaga

SEQ ID NO: 1875644 - RNA, 19 nt, Homo sapiens
accuucuauagcaucacuu

SEQ ID NO: 1875645 - RNA, 17 nt, Homo sapiens
ugagcagaugggacaag

SEQ ID NO: 1875646 - RNA, 13 nt, Homo sapiens
uggaaaaagccug

SEQ ID NO: 1875647 - RNA, 16 nt, Homo sapiens
cuaaucccuuccucuc

SEQ ID NO: 1875648 - RNA, 19 nt, Homo sapiens
auuucuguauaagacuguu

SEQ ID NO: 1875649 - RNA, 13 nt, Homo sapiens
ucuugaaccagaa

SEQ ID NO: 1875650 - RNA, 14 nt, Homo sapiens
ggcagggugcagua

SEQ ID NO: 1875651 - RNA, 13 nt, Homo sapiens
uuaucucaggggu

SEQ ID NO: 1875652 - RNA, 13 nt, Homo sapiens
guuuggucauuuu

SEQ ID NO: 1875653 - RNA, 15 nt, Homo sapiens
auuuaugagucucaa

SEQ ID NO: 1875654 - RNA, 21 nt, Homo sapiens
aguaguugggauuacagguga

SEQ ID NO: 1875655 - RNA, 20 nt, Homo sapiens
aaauuauuugaaaacauaua

SEQ ID NO: 1875656 - RNA, 21 nt, Homo sapiens
uccggaagcugucgacuucau

SEQ ID NO: 1875657 - RNA, 17 nt, Homo sapiens
agccugccccugugauc

SEQ ID NO: 1875658 - RNA, 17 nt, Homo sapiens
ugccagacacugagcuu

SEQ ID NO: 1875659 - RNA, 16 nt, Homo sapiens
gcagagcuguggcaca

SEQ ID NO: 1875660 - RNA, 13 nt, Homo sapiens
cugucuuugcaaa

SEQ ID NO: 1875661 - RNA, 16 nt, Homo sapiens
aauuggauuacaguau

SEQ ID NO: 1875662 - RNA, 13 nt, Homo sapiens
cacuucuguucca

SEQ ID NO: 1875663 - RNA, 23 nt, Homo sapiens
augccacuuccuuuuaacugcca

SEQ ID NO: 1875664 - RNA, 15 nt, Homo sapiens
uccuguugaugggaa

SEQ ID NO: 1875665 - RNA, 21 nt, Homo sapiens
uggauuccaaccccaacucca

SEQ ID NO: 1875666 - RNA, 17 nt, Homo sapiens
ccugccggacacagagg

SEQ ID NO: 1875667 - RNA, 16 nt, Homo sapiens
ggaauggagucuccca

SEQ ID NO: 1875668 - RNA, 18 nt, Homo sapiens
ccacuucuccaugcugca

SEQ ID NO: 1875669 - RNA, 15 nt, Homo sapiens
caggguuaaacugca

SEQ ID NO: 1875670 - RNA, 16 nt, Homo sapiens
cuccuucccucuccag

SEQ ID NO: 1875671 - RNA, 22 nt, Homo sapiens
gcaaacagggcuuuacuaucuu

SEQ ID NO: 1875672 - RNA, 21 nt, Homo sapiens
uaauuugugcuacaguuuuuc

SEQ ID NO: 1875673 - RNA, 16 nt, Homo sapiens
gaccagcccuugaggg

SEQ ID NO: 1875674 - RNA, 21 nt, Homo sapiens
acaagagcuguuaugcuguuu

SEQ ID NO: 1875675 - RNA, 14 nt, Homo sapiens
aaucuucuucagau

SEQ ID NO: 1875676 - RNA, 18 nt, Homo sapiens
aacuuaaaugaaaugcau

SEQ ID NO: 1875677 - RNA, 12 nt, Homo sapiens
accauuuagugg

SEQ ID NO: 1875678 - RNA, 23 nt, Homo sapiens
ugggaacaguaaagaaagcagaa

SEQ ID NO: 1875679 - RNA, 18 nt, Homo sapiens
ggccuucacagugaccau

SEQ ID NO: 1875680 - RNA, 18 nt, Homo sapiens
ugaaaauuaugucaguuu

SEQ ID NO: 1875681 - RNA, 23 nt, Homo sapiens
gauauauacauguuuaguauuau

SEQ ID NO: 1875682 - RNA, 13 nt, Homo sapiens
ccggaaacuccac

SEQ ID NO: 1875683 - RNA, 14 nt, Homo sapiens
ugaugacauuucac

SEQ ID NO: 1875684 - RNA, 15 nt, Homo sapiens
cgaacucauuaacaa

SEQ ID NO: 1875685 - RNA, 15 nt, Homo sapiens
acaaaugacauggac

SEQ ID NO: 1875686 - RNA, 20 nt, Homo sapiens
uagcuauuuuucuuguugca

SEQ ID NO: 1875687 - RNA, 22 nt, Homo sapiens
agaagcagccaucacaugaucu

SEQ ID NO: 1875688 - RNA, 19 nt, Homo sapiens
gauuuucuaagaaccaaaa

SEQ ID NO: 1875689 - RNA, 16 nt, Homo sapiens
ucugugccccaugccu

SEQ ID NO: 1875690 - RNA, 17 nt, Homo sapiens
uaaucuagagcuaugca

SEQ ID NO: 1875691 - RNA, 17 nt, Homo sapiens
augacucagcauaccug

SEQ ID NO: 1875692 - RNA, 12 nt, Homo sapiens
cuuagaacaaag

SEQ ID NO: 1875693 - RNA, 21 nt, Homo sapiens
uugucucauuuaggacugggu

SEQ ID NO: 1875694 - RNA, 23 nt, Homo sapiens
uguuugccaggacaugcaauaaa

SEQ ID NO: 1875695 - RNA, 21 nt, Homo sapiens
aauugaagacacguucuugcc

SEQ ID NO: 1875696 - RNA, 14 nt, Homo sapiens
aaguacaguuuucu

SEQ ID NO: 1875697 - RNA, 17 nt, Homo sapiens
uaccuucaccaucugua

SEQ ID NO: 1875698 - RNA, 13 nt, Homo sapiens
cacugaagccgga

SEQ ID NO: 1875699 - RNA, 22 nt, Homo sapiens
aucuucuaaacccaauccaaau

SEQ ID NO: 1875700 - RNA, 16 nt, Homo sapiens
aaauaaauagcuauau

SEQ ID NO: 1875701 - RNA, 22 nt, Homo sapiens
uuauaaaugauaucaaagaaga

SEQ ID NO: 1875702 - RNA, 13 nt, Homo sapiens
augaucuuuucaa

SEQ ID NO: 1875703 - RNA, 20 nt, Homo sapiens
caugauuggcuuaaagugaa

SEQ ID NO: 1875704 - RNA, 17 nt, Homo sapiens
gucucacccacuaggau

SEQ ID NO: 1875705 - RNA, 21 nt, Homo sapiens
ccccaauuacagggugacuca

SEQ ID NO: 1875706 - RNA, 15 nt, Homo sapiens
auucacauaauaaac

SEQ ID NO: 1875707 - RNA, 15 nt, Homo sapiens
guaaaccugaacaaa

SEQ ID NO: 1875708 - RNA, 24 nt, Homo sapiens
ucaguacuuguuucuaugcagaug

SEQ ID NO: 1875709 - RNA, 19 nt, Homo sapiens
uuaagagaucccuuaagaa

SEQ ID NO: 1875710 - RNA, 18 nt, Homo sapiens
acauuuguaaauuuucaa

SEQ ID NO: 1875711 - RNA, 11 nt, Homo sapiens
cagaaacaaca

SEQ ID NO: 1875712 - RNA, 16 nt, Homo sapiens
ucaaguguccuggaaa

SEQ ID NO: 1875713 - RNA, 15 nt, Homo sapiens
auacccuaaaguaua

SEQ ID NO: 1875714 - RNA, 18 nt, Homo sapiens
cuaacuaaauaccauuca

SEQ ID NO: 1875715 - RNA, 18 nt, Homo sapiens
aagcuaaaaugauuuuau

SEQ ID NO: 1875716 - RNA, 20 nt, Homo sapiens
ccagcuuaaaggcaguauuu

SEQ ID NO: 1875717 - RNA, 19 nt, Homo sapiens
cuucuguguacugggugau

SEQ ID NO: 1875718 - RNA, 19 nt, Homo sapiens
gaaagcuuucaugaccaua

SEQ ID NO: 1875719 - RNA, 16 nt, Homo sapiens
cuuguuuuugcacaug

SEQ ID NO: 1875720 - RNA, 14 nt, Homo sapiens
uucccauccagcuc

SEQ ID NO: 1875721 - RNA, 15 nt, Homo sapiens
cucaucuacaagcau

SEQ ID NO: 1875722 - RNA, 15 nt, Homo sapiens
caguaaaccuuaaca

SEQ ID NO: 1875723 - RNA, 19 nt, Homo sapiens
cugaauaucagucacuguu

SEQ ID NO: 1875724 - RNA, 14 nt, Homo sapiens
cccaacugcucugc

SEQ ID NO: 1875725 - RNA, 15 nt, Homo sapiens
aauaucaguuacuca

SEQ ID NO: 1875726 - RNA, 18 nt, Homo sapiens
ugaaguucuuaaaguuua

SEQ ID NO: 1875727 - RNA, 14 nt, Homo sapiens
cugccagacaugga

SEQ ID NO: 1875728 - RNA, 14 nt, Homo sapiens
gaaaaaaaaacugg

SEQ ID NO: 1875729 - RNA, 22 nt, Homo sapiens
acugccugcagcugagauucca

SEQ ID NO: 1875730 - RNA, 23 nt, Homo sapiens
ggaggacaagcaauaacucucua

SEQ ID NO: 1875731 - RNA, 21 nt, Homo sapiens
cuugugccuaguuaagugggu

SEQ ID NO: 1875732 - RNA, 14 nt, Homo sapiens
uguuccuauggaaa

SEQ ID NO: 1875733 - RNA, 20 nt, Homo sapiens
gccccucucuguuuacccuc

SEQ ID NO: 1875734 - RNA, 22 nt, Homo sapiens
gcuguuuaaaaguaaugcaaua

SEQ ID NO: 1875735 - RNA, 15 nt, Homo sapiens
gcguugacuacugcu

SEQ ID NO: 1875736 - RNA, 13 nt, Homo sapiens
uauauaguagcau

SEQ ID NO: 1875737 - RNA, 18 nt, Homo sapiens
aaaacuacacaaauuaua

SEQ ID NO: 1875738 - RNA, 15 nt, Homo sapiens
ggaauggugaaugaa

SEQ ID NO: 1875739 - RNA, 22 nt, Homo sapiens
ugagaaaauaucuugcuuucaa

SEQ ID NO: 1875740 - RNA, 18 nt, Homo sapiens
guugaagaucgugaugcu

SEQ ID NO: 1875741 - RNA, 12 nt, Homo sapiens
gcgucacuacug

SEQ ID NO: 1875742 - RNA, 16 nt, Homo sapiens
cuaguccgcugaagau

SEQ ID NO: 1875743 - RNA, 19 nt, Homo sapiens
uacuuugauuuacagugcc

SEQ ID NO: 1875744 - RNA, 14 nt, Homo sapiens
aauaggaccagagc

SEQ ID NO: 1875745 - RNA, 16 nt, Homo sapiens
ucuucaaaacugccau

SEQ ID NO: 1875746 - RNA, 19 nt, Homo sapiens
auauuuacauaaagacugu

SEQ ID NO: 1875747 - RNA, 17 nt, Homo sapiens
aagugccaaaugcucuc

SEQ ID NO: 1875748 - RNA, 21 nt, Homo sapiens
uaacugucuuaguacaccaua

SEQ ID NO: 1875749 - RNA, 15 nt, Homo sapiens
agggaauggccacaa

SEQ ID NO: 1875750 - RNA, 17 nt, Homo sapiens
ucuuaauucuuagcuca

SEQ ID NO: 1875751 - RNA, 14 nt, Homo sapiens
cucuucacagucac

SEQ ID NO: 1875752 - RNA, 17 nt, Homo sapiens
acuuaccuugcaucuca

SEQ ID NO: 1875753 - RNA, 17 nt, Homo sapiens
ccacuucacuccagcau

SEQ ID NO: 1875754 - RNA, 19 nt, Homo sapiens
uucgcauggcagccaucaa

SEQ ID NO: 1875755 - RNA, 14 nt, Homo sapiens
gaagaagaaaccag

SEQ ID NO: 1875756 - RNA, 18 nt, Homo sapiens
auacaauaaacaugucaa

SEQ ID NO: 1875757 - RNA, 14 nt, Homo sapiens
cguuuuuuucauuc

SEQ ID NO: 1875758 - RNA, 22 nt, Homo sapiens
acugugugugcccucugggcuc

SEQ ID NO: 1875759 - RNA, 16 nt, Homo sapiens
uaaaccaagugaucaa

SEQ ID NO: 1875760 - RNA, 15 nt, Homo sapiens
guuucaaaauucuca

SEQ ID NO: 1875761 - RNA, 16 nt, Homo sapiens
uaggugcuaaccugga

SEQ ID NO: 1875762 - RNA, 14 nt, Homo sapiens
ccagcgagccacag

SEQ ID NO: 1875763 - RNA, 14 nt, Homo sapiens
uuuacaaagcaugu

SEQ ID NO: 1875764 - RNA, 17 nt, Homo sapiens
cuuaaauccaguuuuca

SEQ ID NO: 1875765 - RNA, 22 nt, Homo sapiens
cucacauacauaagcagcauuu

SEQ ID NO: 1875766 - RNA, 16 nt, Homo sapiens
auccaggcuuuguaca

SEQ ID NO: 1875767 - RNA, 15 nt, Homo sapiens
gccaacucaacuuuc

SEQ ID NO: 1875768 - RNA, 15 nt, Homo sapiens
auauuuuauguguaa

SEQ ID NO: 1875769 - RNA, 16 nt, Homo sapiens
ugcuuauguaugccua

SEQ ID NO: 1875770 - RNA, 13 nt, Homo sapiens
cacauauuucaca

SEQ ID NO: 1875771 - RNA, 20 nt, Homo sapiens
cucuugccugcuccaucuca

SEQ ID NO: 1875772 - RNA, 17 nt, Homo sapiens
ucugaauaagcacuuuu

SEQ ID NO: 1875773 - RNA, 19 nt, Homo sapiens
uaaccauccccaacuccau

SEQ ID NO: 1875774 - RNA, 18 nt, Homo sapiens
ggcugggaacagugugca

SEQ ID NO: 1875775 - RNA, 14 nt, Homo sapiens
caccacugcuuuaa

SEQ ID NO: 1875776 - RNA, 14 nt, Homo sapiens
aauucaaacauauu

SEQ ID NO: 1875777 - RNA, 13 nt, Homo sapiens
agugguggagcug

SEQ ID NO: 1875778 - RNA, 20 nt, Homo sapiens
cugaacagcugguguagcua

SEQ ID NO: 1875779 - RNA, 19 nt, Homo sapiens
uggacccagggaacagcca

SEQ ID NO: 1875780 - RNA, 18 nt, Homo sapiens
uguacuuuuuauucaauu

SEQ ID NO: 1875781 - RNA, 19 nt, Homo sapiens
uuggccauguucauucaca

SEQ ID NO: 1875782 - RNA, 23 nt, Homo sapiens
aauaaucaucccuccuugccuag

SEQ ID NO: 1875783 - RNA, 14 nt, Homo sapiens
aaugcccagugacc

SEQ ID NO: 1875784 - RNA, 12 nt, Homo sapiens
uugcgcugcuaa

SEQ ID NO: 1875785 - RNA, 14 nt, Homo sapiens
cucuggaacccagg

SEQ ID NO: 1875786 - RNA, 21 nt, Homo sapiens
ucacuuaaacucaucuaucca

SEQ ID NO: 1875787 - RNA, 21 nt, Homo sapiens
aacuuucaaaauauauuuuca

SEQ ID NO: 1875788 - RNA, 14 nt, Homo sapiens
agaaagaguucagu

SEQ ID NO: 1875789 - RNA, 15 nt, Homo sapiens
uaauaaacuacucuu

SEQ ID NO: 1875790 - RNA, 15 nt, Homo sapiens
agacaaacagcccuu

SEQ ID NO: 1875791 - RNA, 17 nt, Homo sapiens
cccugcuccaacuccau

SEQ ID NO: 1875792 - RNA, 21 nt, Homo sapiens
auauuuauguuuucacaguca

SEQ ID NO: 1875793 - RNA, 14 nt, Homo sapiens
cccgaaaugccacg

SEQ ID NO: 1875794 - RNA, 16 nt, Homo sapiens
uguugaguuuccaaau

SEQ ID NO: 1875795 - RNA, 15 nt, Homo sapiens
aacuauaacuguugg

SEQ ID NO: 1875796 - RNA, 18 nt, Homo sapiens
agguuaaagcuaaacuga

SEQ ID NO: 1875797 - RNA, 20 nt, Homo sapiens
acugcaaauacuuccaaaga

SEQ ID NO: 1875798 - RNA, 22 nt, Homo sapiens
uuuaaagacaaagacauuauuu

SEQ ID NO: 1875799 - RNA, 12 nt, Homo sapiens
uuuggagucaga

SEQ ID NO: 1875800 - RNA, 20 nt, Homo sapiens
gcuauuaaaaaaaaagaagg

SEQ ID NO: 1875801 - RNA, 15 nt, Homo sapiens
uguguuuuucaguua

SEQ ID NO: 1875802 - RNA, 22 nt, Homo sapiens
aaagaauaaccaacacccugag

SEQ ID NO: 1875803 - RNA, 22 nt, Homo sapiens
augaaguugauucauauugcau

SEQ ID NO: 1875804 - RNA, 15 nt, Homo sapiens
ugguguucucaucua

SEQ ID NO: 1875805 - RNA, 19 nt, Homo sapiens
auaauauuuuacauacacu

SEQ ID NO: 1875806 - RNA, 19 nt, Homo sapiens
caggucucuuccuuugcuc

SEQ ID NO: 1875807 - RNA, 16 nt, Homo sapiens
cguuucugguggucug

SEQ ID NO: 1875808 - RNA, 22 nt, Homo sapiens
aauaaauguuuuuuaaaucuga

SEQ ID NO: 1875809 - RNA, 18 nt, Homo sapiens
ucugguggucucugcuug

SEQ ID NO: 1875810 - RNA, 14 nt, Homo sapiens
uggagggagccauc

SEQ ID NO: 1875811 - RNA, 17 nt, Homo sapiens
guaucacguuaccccaa

SEQ ID NO: 1875812 - RNA, 18 nt, Homo sapiens
cugacuaagccuuugacu

SEQ ID NO: 1875813 - RNA, 19 nt, Homo sapiens
acucugccagccacaucca

SEQ ID NO: 1875814 - RNA, 14 nt, Homo sapiens
aguccuugacauuu

SEQ ID NO: 1875815 - RNA, 13 nt, Homo sapiens
aacugacuuucuc

SEQ ID NO: 1875816 - RNA, 21 nt, Homo sapiens
cacaguaguguucuguucacu

SEQ ID NO: 1875817 - RNA, 23 nt, Homo sapiens
aaaaaugcguaagaccaagcugu

SEQ ID NO: 1875818 - RNA, 23 nt, Homo sapiens
gccccaguccugguucaguggga

SEQ ID NO: 1875819 - RNA, 16 nt, Homo sapiens
aucuacaaaagugaac

SEQ ID NO: 1875820 - RNA, 22 nt, Homo sapiens
agcaguggcucauccuaccugu

SEQ ID NO: 1875821 - RNA, 20 nt, Homo sapiens
uccccucucagagcuacuug

SEQ ID NO: 1875822 - RNA, 16 nt, Homo sapiens
cgguucaccagccucu

SEQ ID NO: 1875823 - RNA, 14 nt, Homo sapiens
auuucaugugucaa

SEQ ID NO: 1875824 - RNA, 13 nt, Homo sapiens
uauaagcuuuuag

SEQ ID NO: 1875825 - RNA, 13 nt, Homo sapiens
aaauugcucccua

SEQ ID NO: 1875826 - RNA, 15 nt, Homo sapiens
gccacagaagccagg

SEQ ID NO: 1875827 - RNA, 16 nt, Homo sapiens
aaguuauucucuucac

SEQ ID NO: 1875828 - RNA, 15 nt, Homo sapiens
caugugaaagugcac

SEQ ID NO: 1875829 - RNA, 20 nt, Homo sapiens
aagugaacaaucagcggcau

SEQ ID NO: 1875830 - RNA, 21 nt, Homo sapiens
cugaggaaugcgguucagggc

SEQ ID NO: 1875831 - RNA, 14 nt, Homo sapiens
agccccauuaacug

SEQ ID NO: 1875832 - RNA, 16 nt, Homo sapiens
aaguacaacuaccuau

SEQ ID NO: 1875833 - RNA, 13 nt, Homo sapiens
guaaccauuuuau

SEQ ID NO: 1875834 - RNA, 22 nt, Homo sapiens
agaaucagucuauccacagaga

SEQ ID NO: 1875835 - RNA, 15 nt, Homo sapiens
aaucaaagaauuaca

SEQ ID NO: 1875836 - RNA, 20 nt, Homo sapiens
aggcuauuccuaggccucag

SEQ ID NO: 1875837 - RNA, 22 nt, Homo sapiens
guaugaugucacacaagcuccu

SEQ ID NO: 1875838 - RNA, 19 nt, Homo sapiens
gcccaggcuggaguacaau

SEQ ID NO: 1875839 - RNA, 13 nt, Homo sapiens
ugggaacucccaa

SEQ ID NO: 1875840 - RNA, 17 nt, Homo sapiens
ccuggcuccuucacuga

SEQ ID NO: 1875841 - RNA, 23 nt, Homo sapiens
ucaggaguuuugggaaugcacuu

SEQ ID NO: 1875842 - RNA, 23 nt, Homo sapiens
uucuuuacuaaagauaucagagc

SEQ ID NO: 1875843 - RNA, 20 nt, Homo sapiens
aggaaggugcuugccuggga

SEQ ID NO: 1875844 - RNA, 20 nt, Homo sapiens
aggaggcuuaggacuuucca

SEQ ID NO: 1875845 - RNA, 13 nt, Homo sapiens
aggauguggagcu

SEQ ID NO: 1875846 - RNA, 22 nt, Homo sapiens
cugcauuugccugucaugcgca

SEQ ID NO: 1875847 - RNA, 19 nt, Homo sapiens
uagugauaccccaucucuu

SEQ ID NO: 1875848 - RNA, 21 nt, Homo sapiens
cucaaggaaaagaugugcucc

SEQ ID NO: 1875849 - RNA, 13 nt, Homo sapiens
uaaugaauaugcc

SEQ ID NO: 1875850 - RNA, 22 nt, Homo sapiens
ccaaaaucugauuagaaguaua

SEQ ID NO: 1875851 - RNA, 12 nt, Homo sapiens
ugaguccaggcc

SEQ ID NO: 1875852 - RNA, 18 nt, Homo sapiens
caggaccacagagcuccu

SEQ ID NO: 1875853 - RNA, 22 nt, Homo sapiens
acuuaauaaauauuacagugaa

SEQ ID NO: 1875854 - RNA, 18 nt, Homo sapiens
auuuaacaaugacaagau

SEQ ID NO: 1875855 - RNA, 15 nt, Homo sapiens
uucuuuuggcuuuga

SEQ ID NO: 1875856 - RNA, 14 nt, Homo sapiens
auacgugugugaag

SEQ ID NO: 1875857 - RNA, 16 nt, Homo sapiens
ugguggcucaugccuc

SEQ ID NO: 1875858 - RNA, 13 nt, Homo sapiens
cuuguccccauga

SEQ ID NO: 1875859 - RNA, 12 nt, Homo sapiens
aguuaagcaaau

SEQ ID NO: 1875860 - RNA, 13 nt, Homo sapiens
ucuucauccauuu

SEQ ID NO: 1875861 - RNA, 15 nt, Homo sapiens
aauuuccuaugccug

SEQ ID NO: 1875862 - RNA, 18 nt, Homo sapiens
aauaguggcauaccaaau

SEQ ID NO: 1875863 - RNA, 17 nt, Homo sapiens
cccugcuuugcaucuuu

SEQ ID NO: 1875864 - RNA, 14 nt, Homo sapiens
uucccaugccuguc

SEQ ID NO: 1875865 - RNA, 21 nt, Homo sapiens
ucgcucuugucugucugucuc

SEQ ID NO: 1875866 - RNA, 17 nt, Homo sapiens
aguugcagugaauucau

SEQ ID NO: 1875867 - RNA, 19 nt, Homo sapiens
gaaggcuccaucuccagug

SEQ ID NO: 1875868 - RNA, 15 nt, Homo sapiens
gccugugccagguga

SEQ ID NO: 1875869 - RNA, 16 nt, Homo sapiens
ggcagcccaguggaau

SEQ ID NO: 1875870 - RNA, 21 nt, Homo sapiens
auaaauaguuuaugauuccac

SEQ ID NO: 1875871 - RNA, 17 nt, Homo sapiens
aaaagcccgcuugcucg

SEQ ID NO: 1875872 - RNA, 16 nt, Homo sapiens
ccagggcaagcuccgc

SEQ ID NO: 1875873 - RNA, 17 nt, Homo sapiens
auaucaaaagcaaauaa

SEQ ID NO: 1875874 - RNA, 22 nt, Homo sapiens
gucuuaguuuugugaaggugau

SEQ ID NO: 1875875 - RNA, 22 nt, Homo sapiens
cuaucauuggccuccaaacaca

SEQ ID NO: 1875876 - RNA, 18 nt, Homo sapiens
gagcacuugcguccugca

SEQ ID NO: 1875877 - RNA, 16 nt, Homo sapiens
ugccugaacuccagag

SEQ ID NO: 1875878 - RNA, 18 nt, Homo sapiens
aagcucauaaacugccaa

SEQ ID NO: 1875879 - RNA, 14 nt, Homo sapiens
gcucuugugucauu

SEQ ID NO: 1875880 - RNA, 19 nt, Homo sapiens
gaccugccugugugcuccg

SEQ ID NO: 1875881 - RNA, 16 nt, Homo sapiens
ccauugauccagcuca

SEQ ID NO: 1875882 - RNA, 22 nt, Homo sapiens
caaaguagccagcuggucuuca

SEQ ID NO: 1875883 - RNA, 17 nt, Homo sapiens
auuaaugacguauacau

SEQ ID NO: 1875884 - RNA, 23 nt, Homo sapiens
agcugaaaacuaauguacuguac

SEQ ID NO: 1875885 - RNA, 18 nt, Homo sapiens
ccugaauacaagccuaug

SEQ ID NO: 1875886 - RNA, 18 nt, Homo sapiens
uagagauagcuacagugu

SEQ ID NO: 1875887 - RNA, 19 nt, Homo sapiens
auaaagcuguucucauucc

SEQ ID NO: 1875888 - RNA, 23 nt, Homo sapiens
uguucuuagagcagauucuagca

SEQ ID NO: 1875889 - RNA, 19 nt, Homo sapiens
uucucucaggguucugagu

SEQ ID NO: 1875890 - RNA, 15 nt, Homo sapiens
ucuguagucauuuac

SEQ ID NO: 1875891 - RNA, 16 nt, Homo sapiens
aaucacuaaacuuuau

SEQ ID NO: 1875892 - RNA, 21 nt, Homo sapiens
uggacuuguccucagcagcug

SEQ ID NO: 1875893 - RNA, 15 nt, Homo sapiens
aaguugauucugucc

SEQ ID NO: 1875894 - RNA, 18 nt, Homo sapiens
agagaaagaaguaggcau

SEQ ID NO: 1875895 - RNA, 21 nt, Homo sapiens
cuuauuccuaggcaacuauua

SEQ ID NO: 1875896 - RNA, 13 nt, Homo sapiens
gccugcccagaca

SEQ ID NO: 1875897 - RNA, 23 nt, Homo sapiens
cugcauuguucuuugccagagac

SEQ ID NO: 1875898 - RNA, 17 nt, Homo sapiens
ugaaggcaucaaauaaa

SEQ ID NO: 1875899 - RNA, 16 nt, Homo sapiens
gaggugaucuagcaga

SEQ ID NO: 1875900 - RNA, 16 nt, Homo sapiens
cuugugauuccagggc

SEQ ID NO: 1875901 - RNA, 21 nt, Homo sapiens
augcacauuucauguauucca

SEQ ID NO: 1875902 - RNA, 21 nt, Homo sapiens
cagaggcagcucgugugccug

SEQ ID NO: 1875903 - RNA, 18 nt, Homo sapiens
caugaaggauaaaagccc

SEQ ID NO: 1875904 - RNA, 20 nt, Homo sapiens
gggaggaacuccuugcacac

SEQ ID NO: 1875905 - RNA, 13 nt, Homo sapiens
gauaacucagugg

SEQ ID NO: 1875906 - RNA, 13 nt, Homo sapiens
uucuacaguauua

SEQ ID NO: 1875907 - RNA, 17 nt, Homo sapiens
gcccaccguuauuugua

SEQ ID NO: 1875908 - RNA, 13 nt, Homo sapiens
acacugaguuucu

SEQ ID NO: 1875909 - RNA, 17 nt, Homo sapiens
aaacaugauuguuuaca

SEQ ID NO: 1875910 - RNA, 17 nt, Homo sapiens
aaaugcauguccucaaa

SEQ ID NO: 1875911 - RNA, 18 nt, Homo sapiens
uuaaugaacuaacugaca

SEQ ID NO: 1875912 - RNA, 23 nt, Homo sapiens
cuacuuguuucaaaugugucaaa

SEQ ID NO: 1875913 - RNA, 16 nt, Homo sapiens
uuugcugcuguggaaa

SEQ ID NO: 1875914 - RNA, 12 nt, Homo sapiens
ugacaacaucgc

SEQ ID NO: 1875915 - RNA, 14 nt, Homo sapiens
gacaggcaccagau

SEQ ID NO: 1875916 - RNA, 14 nt, Homo sapiens
gagaagcugcugac

SEQ ID NO: 1875917 - RNA, 23 nt, Homo sapiens
gcugcagcucccauuucaucagc

SEQ ID NO: 1875918 - RNA, 14 nt, Homo sapiens
aggagugguucuca

SEQ ID NO: 1875919 - RNA, 12 nt, Homo sapiens
cccuuaauaaac

SEQ ID NO: 1875920 - RNA, 14 nt, Homo sapiens
aagacuacaaaaau

SEQ ID NO: 1875921 - RNA, 14 nt, Homo sapiens
aaauaaacaaguca

SEQ ID NO: 1875922 - RNA, 15 nt, Homo sapiens
gacuacuauuuucuu

SEQ ID NO: 1875923 - RNA, 19 nt, Homo sapiens
cugaggccuggacuuuccu

SEQ ID NO: 1875924 - RNA, 21 nt, Homo sapiens
aggcuuaauaccugggugauu

SEQ ID NO: 1875925 - RNA, 19 nt, Homo sapiens
ucaacuuggugacacucua

SEQ ID NO: 1875926 - RNA, 15 nt, Homo sapiens
cccagggggccuuuc

SEQ ID NO: 1875927 - RNA, 16 nt, Homo sapiens
guugggcugagacccu

SEQ ID NO: 1875928 - RNA, 17 nt, Homo sapiens
ccuacaucuaacucauc

SEQ ID NO: 1875929 - RNA, 18 nt, Homo sapiens
cacaccccuaaguacaag

SEQ ID NO: 1875930 - RNA, 19 nt, Homo sapiens
caucgacauguauuguuaa

SEQ ID NO: 1875931 - RNA, 14 nt, Homo sapiens
uucuauacuguaaa

SEQ ID NO: 1875932 - RNA, 13 nt, Homo sapiens
gucuuuaacucau

SEQ ID NO: 1875933 - RNA, 18 nt, Homo sapiens
ugacaucaccacaguuua

SEQ ID NO: 1875934 - RNA, 14 nt, Homo sapiens
cuauaugauaugca

SEQ ID NO: 1875935 - RNA, 15 nt, Homo sapiens
auuccucauccucag

SEQ ID NO: 1875936 - RNA, 15 nt, Homo sapiens
aggaucagaggcugg

SEQ ID NO: 1875937 - RNA, 19 nt, Homo sapiens
guuuaucgaccaguuugaa

SEQ ID NO: 1875938 - RNA, 14 nt, Homo sapiens
acaguucugugguu

SEQ ID NO: 1875939 - RNA, 14 nt, Homo sapiens
auguaucugcauau

SEQ ID NO: 1875940 - RNA, 13 nt, Homo sapiens
ucuguugccaugg

SEQ ID NO: 1875941 - RNA, 16 nt, Homo sapiens
ucuucuaaaaugcuuu

SEQ ID NO: 1875942 - RNA, 16 nt, Homo sapiens
caagcaaugagaagac

SEQ ID NO: 1875943 - RNA, 12 nt, Homo sapiens
guccagugacuu

SEQ ID NO: 1875944 - RNA, 15 nt, Homo sapiens
ugacaauaugaauua

SEQ ID NO: 1875945 - RNA, 22 nt, Homo sapiens
caacccauauuucauccaggag

SEQ ID NO: 1875946 - RNA, 23 nt, Homo sapiens
ucgccaacauggugagacccugu

SEQ ID NO: 1875947 - RNA, 14 nt, Homo sapiens
gcagggaaugcaau

SEQ ID NO: 1875948 - RNA, 18 nt, Homo sapiens
uauggcaaaaguaggcau

SEQ ID NO: 1875949 - RNA, 18 nt, Homo sapiens
cucuacaggugaggccca

SEQ ID NO: 1875950 - RNA, 20 nt, Homo sapiens
acaagauuaccccaccuugc

SEQ ID NO: 1875951 - RNA, 15 nt, Homo sapiens
aaucaugucaggcca

SEQ ID NO: 1875952 - RNA, 17 nt, Homo sapiens
uuuuacauaguugagau

SEQ ID NO: 1875953 - RNA, 19 nt, Homo sapiens
aaaccaaugagcuguaucu

SEQ ID NO: 1875954 - RNA, 15 nt, Homo sapiens
aguugggaguacaua

SEQ ID NO: 1875955 - RNA, 15 nt, Homo sapiens
caggaggauggcaaa

SEQ ID NO: 1875956 - RNA, 14 nt, Homo sapiens
gagcuguuacugaa

SEQ ID NO: 1875957 - RNA, 14 nt, Homo sapiens
gacagccuugccca

SEQ ID NO: 1875958 - RNA, 13 nt, Homo sapiens
ugacaaugggcac

SEQ ID NO: 1875959 - RNA, 21 nt, Homo sapiens
aacacacaggugcaacagacu

SEQ ID NO: 1875960 - RNA, 13 nt, Homo sapiens
guucuaucccacc

SEQ ID NO: 1875961 - RNA, 13 nt, Homo sapiens
cugagagaugaca

SEQ ID NO: 1875962 - RNA, 22 nt, Homo sapiens
cugaggccccucuccaagagga

SEQ ID NO: 1875963 - RNA, 17 nt, Homo sapiens
guaccagaacuauuuau

SEQ ID NO: 1875964 - RNA, 20 nt, Homo sapiens
cuaauauugaaaaugucacu

SEQ ID NO: 1875965 - RNA, 16 nt, Homo sapiens
aguggugcccuggaac

SEQ ID NO: 1875966 - RNA, 18 nt, Homo sapiens
uccacauauagagcucca

SEQ ID NO: 1875967 - RNA, 18 nt, Homo sapiens
ucacaguugacaaaaagc

SEQ ID NO: 1875968 - RNA, 12 nt, Homo sapiens
cccaguggugcg

SEQ ID NO: 1875969 - RNA, 17 nt, Homo sapiens
uuguaagagugagcucu

SEQ ID NO: 1875970 - RNA, 12 nt, Homo sapiens
uuaagugacuug

SEQ ID NO: 1875971 - RNA, 19 nt, Homo sapiens
aggccgggcucaguggcuc

SEQ ID NO: 1875972 - RNA, 20 nt, Homo sapiens
ugaucugacauccccacuca

SEQ ID NO: 1875973 - RNA, 15 nt, Homo sapiens
caaacuuucacuuug

SEQ ID NO: 1875974 - RNA, 12 nt, Homo sapiens
cuaaacauuucu

SEQ ID NO: 1875975 - RNA, 12 nt, Homo sapiens
cucuacauuuaa

SEQ ID NO: 1875976 - RNA, 16 nt, Homo sapiens
agcugugaugguaccu

SEQ ID NO: 1875977 - RNA, 21 nt, Homo sapiens
cagcaacuggugauuguuuca

SEQ ID NO: 1875978 - RNA, 20 nt, Homo sapiens
gauguaugugugaaacaaug

SEQ ID NO: 1875979 - RNA, 12 nt, Homo sapiens
uagauaacgcuu

SEQ ID NO: 1875980 - RNA, 20 nt, Homo sapiens
cugaugugacgcacuguauu

SEQ ID NO: 1875981 - RNA, 17 nt, Homo sapiens
ugugacccuugucaucu

SEQ ID NO: 1875982 - RNA, 19 nt, Homo sapiens
uuaccauuucacacauaag

SEQ ID NO: 1875983 - RNA, 23 nt, Homo sapiens
ucucaaaaaaaaaaacaaacaaa

SEQ ID NO: 1875984 - RNA, 18 nt, Homo sapiens
accccgaggcccugcaug

SEQ ID NO: 1875985 - RNA, 19 nt, Homo sapiens
aaguguaauauaauugugu

SEQ ID NO: 1875986 - RNA, 17 nt, Homo sapiens
cauuauuggaugucaau

SEQ ID NO: 1875987 - RNA, 17 nt, Homo sapiens
uauaucuguacagauca

SEQ ID NO: 1875988 - RNA, 19 nt, Homo sapiens
acaggaaaccuacuuuuua

SEQ ID NO: 1875989 - RNA, 14 nt, Homo sapiens
gaauuaaugcucua

SEQ ID NO: 1875990 - RNA, 13 nt, Homo sapiens
acugcugaauuca

SEQ ID NO: 1875991 - RNA, 17 nt, Homo sapiens
uguuaaagucuguucca

SEQ ID NO: 1875992 - RNA, 16 nt, Homo sapiens
ccagaugcagggcagu

SEQ ID NO: 1875993 - RNA, 22 nt, Homo sapiens
cccugaagcuaugucucuagca

SEQ ID NO: 1875994 - RNA, 14 nt, Homo sapiens
cuaguuucccugaa

SEQ ID NO: 1875995 - RNA, 21 nt, Homo sapiens
cuuuuuuuucaugacauaaua

SEQ ID NO: 1875996 - RNA, 21 nt, Homo sapiens
gugcuaugaauuuucaaguaa

SEQ ID NO: 1875997 - RNA, 17 nt, Homo sapiens
agcggggaucugaugaa

SEQ ID NO: 1875998 - RNA, 15 nt, Homo sapiens
cauuucaaacagucu

SEQ ID NO: 1875999 - RNA, 17 nt, Homo sapiens
agauguugacucuaaag

SEQ ID NO: 1876000 - RNA, 19 nt, Homo sapiens
cucucgcacacacagugau

SEQ ID NO: 1876001 - RNA, 14 nt, Homo sapiens
ucccuuuugcauug

SEQ ID NO: 1876002 - RNA, 19 nt, Homo sapiens
gacauuuugggcuggauaa

SEQ ID NO: 1876003 - RNA, 15 nt, Homo sapiens
caaaagggccaaaga

SEQ ID NO: 1876004 - RNA, 23 nt, Homo sapiens
uacaauuacugugagaacuguga

SEQ ID NO: 1876005 - RNA, 15 nt, Homo sapiens
uaaucaaaugauuca

SEQ ID NO: 1876006 - RNA, 12 nt, Homo sapiens
caccuaauccag

SEQ ID NO: 1876007 - RNA, 22 nt, Homo sapiens
cuccgauuuugcucugucuccu

SEQ ID NO: 1876008 - RNA, 12 nt, Homo sapiens
cucaauucuucc

SEQ ID NO: 1876009 - RNA, 20 nt, Homo sapiens
gaaaaugucagaaaccaguu

SEQ ID NO: 1876010 - RNA, 18 nt, Homo sapiens
acuuauaaauauccugcu

SEQ ID NO: 1876011 - RNA, 14 nt, Homo sapiens
cuggagcuauucac

SEQ ID NO: 1876012 - RNA, 11 nt, Homo sapiens
ugauccagugg

SEQ ID NO: 1876013 - RNA, 16 nt, Homo sapiens
gcaucaaagaugagaa

SEQ ID NO: 1876014 - RNA, 16 nt, Homo sapiens
gaugaacaucuuuuaa

SEQ ID NO: 1876015 - RNA, 15 nt, Homo sapiens
auagaauaacaacug

SEQ ID NO: 1876016 - RNA, 19 nt, Homo sapiens
aggacccugcuucugagug

SEQ ID NO: 1876017 - RNA, 12 nt, Homo sapiens
ccugugccccag

SEQ ID NO: 1876018 - RNA, 17 nt, Homo sapiens
cugaauuaugauggucu

SEQ ID NO: 1876019 - RNA, 18 nt, Homo sapiens
cucaguguccucaucuau

SEQ ID NO: 1876020 - RNA, 22 nt, Homo sapiens
gaguauggugcuggguccuuaa

SEQ ID NO: 1876021 - RNA, 14 nt, Homo sapiens
ugucaggacaccag

SEQ ID NO: 1876022 - RNA, 12 nt, Homo sapiens
ugauauucaccu

SEQ ID NO: 1876023 - RNA, 19 nt, Homo sapiens
uucagcccccaccagggga

SEQ ID NO: 1876024 - RNA, 23 nt, Homo sapiens
aaucauuuccccucccgucuucc

SEQ ID NO: 1876025 - RNA, 13 nt, Homo sapiens
caugcacccgcau

SEQ ID NO: 1876026 - RNA, 22 nt, Homo sapiens
uaaugucuucauaaaguacuug

SEQ ID NO: 1876027 - RNA, 16 nt, Homo sapiens
acaugcugcuugccuc

SEQ ID NO: 1876028 - RNA, 19 nt, Homo sapiens
aggcguguggcagccacac

SEQ ID NO: 1876029 - RNA, 22 nt, Homo sapiens
ucaaagauuaggugagguuuau

SEQ ID NO: 1876030 - RNA, 15 nt, Homo sapiens
caaccuccacauguu

SEQ ID NO: 1876031 - RNA, 15 nt, Homo sapiens
auaaaauacagccau

SEQ ID NO: 1876032 - RNA, 17 nt, Homo sapiens
caauuacugccugcaga

SEQ ID NO: 1876033 - RNA, 15 nt, Homo sapiens
uacauuagugccaua

SEQ ID NO: 1876034 - RNA, 16 nt, Homo sapiens
acaugucaaucugucc

SEQ ID NO: 1876035 - RNA, 14 nt, Homo sapiens
agaaauacaguaug

SEQ ID NO: 1876036 - RNA, 18 nt, Homo sapiens
aagucgucacuaauacac

SEQ ID NO: 1876037 - RNA, 12 nt, Homo sapiens
aaugaucauuaa

SEQ ID NO: 1876038 - RNA, 15 nt, Homo sapiens
cuuuaaaagucauua

SEQ ID NO: 1876039 - RNA, 16 nt, Homo sapiens
uuuucaguaacccagc

SEQ ID NO: 1876040 - RNA, 20 nt, Homo sapiens
cauuucaucuggguggucug

SEQ ID NO: 1876041 - RNA, 13 nt, Homo sapiens
gcaucaucugcac

SEQ ID NO: 1876042 - RNA, 14 nt, Homo sapiens
ucaagcucauguca

SEQ ID NO: 1876043 - RNA, 16 nt, Homo sapiens
agauacuaaaucuggg

SEQ ID NO: 1876044 - RNA, 22 nt, Homo sapiens
cucuuaaguggucuagucaagg

SEQ ID NO: 1876045 - RNA, 17 nt, Homo sapiens
gggccuuugcagcgucu

SEQ ID NO: 1876046 - RNA, 22 nt, Homo sapiens
cugucaauguccuacugagaca

SEQ ID NO: 1876047 - RNA, 13 nt, Homo sapiens
uauccacauaaau

SEQ ID NO: 1876048 - RNA, 13 nt, Homo sapiens
uacugaagcccuu

SEQ ID NO: 1876049 - RNA, 17 nt, Homo sapiens
cugcagcaggaguggug

SEQ ID NO: 1876050 - RNA, 10 nt, Homo sapiens
gcauugcuga

SEQ ID NO: 1876051 - RNA, 16 nt, Homo sapiens
gccagggauccuuucc

SEQ ID NO: 1876052 - RNA, 14 nt, Homo sapiens
cguaucacaguguu

SEQ ID NO: 1876053 - RNA, 19 nt, Homo sapiens
uggauaaguugugauuuga

SEQ ID NO: 1876054 - RNA, 18 nt, Homo sapiens
uaaccucaucuacaagca

SEQ ID NO: 1876055 - RNA, 22 nt, Homo sapiens
gugggagcuuuugguaugugac

SEQ ID NO: 1876056 - RNA, 19 nt, Homo sapiens
augauacuuggaugcagcu

SEQ ID NO: 1876057 - RNA, 23 nt, Homo sapiens
aaguaguaaauuuugugaugaau

SEQ ID NO: 1876058 - RNA, 15 nt, Homo sapiens
cauuucaggugugag

SEQ ID NO: 1876059 - RNA, 15 nt, Homo sapiens
cuggcccacugagcc

SEQ ID NO: 1876060 - RNA, 18 nt, Homo sapiens
uuugucucugcaucucau

SEQ ID NO: 1876061 - RNA, 14 nt, Homo sapiens
uuggcagcauucca

SEQ ID NO: 1876062 - RNA, 23 nt, Homo sapiens
cagagcauugcuauuuaucucaa

SEQ ID NO: 1876063 - RNA, 20 nt, Homo sapiens
ccagggagucucagcuucac

SEQ ID NO: 1876064 - RNA, 15 nt, Homo sapiens
gcuuccccagcucag

SEQ ID NO: 1876065 - RNA, 22 nt, Homo sapiens
acagcauggagucacagccacu

SEQ ID NO: 1876066 - RNA, 17 nt, Homo sapiens
ugguuuuuguugagucu

SEQ ID NO: 1876067 - RNA, 13 nt, Homo sapiens
uaaauaccaaaaa

SEQ ID NO: 1876068 - RNA, 18 nt, Homo sapiens
aaggacagaccaaaaauc

SEQ ID NO: 1876069 - RNA, 18 nt, Homo sapiens
cuucuauuuauuugacug

SEQ ID NO: 1876070 - RNA, 11 nt, Homo sapiens
acuucuuggcu

SEQ ID NO: 1876071 - RNA, 18 nt, Homo sapiens
cuguacucuugaauacaa

SEQ ID NO: 1876072 - RNA, 19 nt, Homo sapiens
cuuaagcccucgugcacac

SEQ ID NO: 1876073 - RNA, 12 nt, Homo sapiens
ugguugccaugg

SEQ ID NO: 1876074 - RNA, 16 nt, Homo sapiens
cuuaugagcuaucuac

SEQ ID NO: 1876075 - RNA, 20 nt, Homo sapiens
ggaggcggagguugcaguga

SEQ ID NO: 1876076 - RNA, 23 nt, Homo sapiens
ugauggcacauuagaugaaguua

SEQ ID NO: 1876077 - RNA, 14 nt, Homo sapiens
cacagcacagccag

SEQ ID NO: 1876078 - RNA, 16 nt, Homo sapiens
agcacuaccaguaucu

SEQ ID NO: 1876079 - RNA, 23 nt, Homo sapiens
aggcccgcccucugccuccucag

SEQ ID NO: 1876080 - RNA, 16 nt, Homo sapiens
uuccacagauuaucaa

SEQ ID NO: 1876081 - RNA, 22 nt, Homo sapiens
guucaaguuugguuuuugaaua

SEQ ID NO: 1876082 - RNA, 20 nt, Homo sapiens
uugaaaacagaaucaguguu

SEQ ID NO: 1876083 - RNA, 11 nt, Homo sapiens
caucugacccc

SEQ ID NO: 1876084 - RNA, 16 nt, Homo sapiens
cagccacagcauuuau

SEQ ID NO: 1876085 - RNA, 17 nt, Homo sapiens
uuccuuaccauaccacu

SEQ ID NO: 1876086 - RNA, 23 nt, Homo sapiens
ggguaucuaauaaauacuuaaga

SEQ ID NO: 1876087 - RNA, 15 nt, Homo sapiens
aaucugggcaucucg

SEQ ID NO: 1876088 - RNA, 15 nt, Homo sapiens
accccaggcauccca

SEQ ID NO: 1876089 - RNA, 19 nt, Homo sapiens
ugauucugauaaugcucac

SEQ ID NO: 1876090 - RNA, 13 nt, Homo sapiens
augguggggccaa

SEQ ID NO: 1876091 - RNA, 18 nt, Homo sapiens
gacccugguugcuuugug

SEQ ID NO: 1876092 - RNA, 17 nt, Homo sapiens
uuguccugggucugugu

SEQ ID NO: 1876093 - RNA, 15 nt, Homo sapiens
uugauauuaucuaca

SEQ ID NO: 1876094 - RNA, 22 nt, Homo sapiens
uccugaaggaaaauaaacugac

SEQ ID NO: 1876095 - RNA, 18 nt, Homo sapiens
uuggagauucccaucuga

SEQ ID NO: 1876096 - RNA, 14 nt, Homo sapiens
cuucccuuccucca

SEQ ID NO: 1876097 - RNA, 17 nt, Homo sapiens
uucuguuuuguuaauau

SEQ ID NO: 1876098 - RNA, 14 nt, Homo sapiens
ucauuauuccaucu

SEQ ID NO: 1876099 - RNA, 17 nt, Homo sapiens
gaagcggagagagccaa

SEQ ID NO: 1876100 - RNA, 18 nt, Homo sapiens
aaagaaaacuuuaucgcu

SEQ ID NO: 1876101 - RNA, 16 nt, Homo sapiens
aaauaacuaacaaaca

SEQ ID NO: 1876102 - RNA, 16 nt, Homo sapiens
aaguucuuaaaguuua

SEQ ID NO: 1876103 - RNA, 17 nt, Homo sapiens
ucaaccugcacuucaua

SEQ ID NO: 1876104 - RNA, 18 nt, Homo sapiens
uuccuuuguuacuucucu

SEQ ID NO: 1876105 - RNA, 17 nt, Homo sapiens
aaugagccgagaucacg

SEQ ID NO: 1876106 - RNA, 14 nt, Homo sapiens
ugcauuuuuauuaa

SEQ ID NO: 1876107 - RNA, 17 nt, Homo sapiens
ugaaaauacuuaggaag

SEQ ID NO: 1876108 - RNA, 18 nt, Homo sapiens
ugauucugauguacucua

SEQ ID NO: 1876109 - RNA, 16 nt, Homo sapiens
gagcgugaccuugcaa

SEQ ID NO: 1876110 - RNA, 20 nt, Homo sapiens
guacuauuauccccauuucu

SEQ ID NO: 1876111 - RNA, 20 nt, Homo sapiens
uccgcugucggcacauucag

SEQ ID NO: 1876112 - RNA, 13 nt, Homo sapiens
auuagcugugauu

SEQ ID NO: 1876113 - RNA, 12 nt, Homo sapiens
ucugcuuaccaa

SEQ ID NO: 1876114 - RNA, 18 nt, Homo sapiens
uuccauagccuccaaaca

SEQ ID NO: 1876115 - RNA, 19 nt, Homo sapiens
acagaaagcuccuuccaga

SEQ ID NO: 1876116 - RNA, 16 nt, Homo sapiens
gaccagacugcacagg

SEQ ID NO: 1876117 - RNA, 23 nt, Homo sapiens
cccccuccucugaaacagcugcc

SEQ ID NO: 1876118 - RNA, 16 nt, Homo sapiens
augacuugcucaaguu

SEQ ID NO: 1876119 - RNA, 20 nt, Homo sapiens
aagcaguucgacaaauauac

SEQ ID NO: 1876120 - RNA, 18 nt, Homo sapiens
ucaggaaugauugcugac

SEQ ID NO: 1876121 - RNA, 23 nt, Homo sapiens
gccaguuucucugccuucuucca

SEQ ID NO: 1876122 - RNA, 15 nt, Homo sapiens
agaucacaauacuca

SEQ ID NO: 1876123 - RNA, 15 nt, Homo sapiens
gugcuacagggucca

SEQ ID NO: 1876124 - RNA, 19 nt, Homo sapiens
uaacguggggcuaggacac

SEQ ID NO: 1876125 - RNA, 20 nt, Homo sapiens
caagccuaaaauuguauaga

SEQ ID NO: 1876126 - RNA, 15 nt, Homo sapiens
uuaaaaaagcuauaa

SEQ ID NO: 1876127 - RNA, 15 nt, Homo sapiens
uuuuauaagcauuua

SEQ ID NO: 1876128 - RNA, 13 nt, Homo sapiens
uuuaucucaaaaa

SEQ ID NO: 1876129 - RNA, 17 nt, Homo sapiens
cucaauuguuaauguga

SEQ ID NO: 1876130 - RNA, 17 nt, Homo sapiens
acauuucccccuagccu

SEQ ID NO: 1876131 - RNA, 16 nt, Homo sapiens
gagacccaacagcagu

SEQ ID NO: 1876132 - RNA, 13 nt, Homo sapiens
uccuaugacauua

SEQ ID NO: 1876133 - RNA, 15 nt, Homo sapiens
ugacagcacuacaaa

SEQ ID NO: 1876134 - RNA, 12 nt, Homo sapiens
ccaugucuuucu

SEQ ID NO: 1876135 - RNA, 16 nt, Homo sapiens
gacagaacgagacucc

SEQ ID NO: 1876136 - RNA, 13 nt, Homo sapiens
gaggaucacugga

SEQ ID NO: 1876137 - RNA, 17 nt, Homo sapiens
ugacuuuagguucacau

SEQ ID NO: 1876138 - RNA, 21 nt, Homo sapiens
aaacaccggcagaaaacggag

SEQ ID NO: 1876139 - RNA, 16 nt, Homo sapiens
cuuccaacaugugaug

SEQ ID NO: 1876140 - RNA, 12 nt, Homo sapiens
ccuaacuuguaa

SEQ ID NO: 1876141 - RNA, 23 nt, Homo sapiens
aaauauuuugcacagauuuacuc

SEQ ID NO: 1876142 - RNA, 13 nt, Homo sapiens
uucccuggcauga

SEQ ID NO: 1876143 - RNA, 14 nt, Homo sapiens
cagccuacauucac

SEQ ID NO: 1876144 - RNA, 23 nt, Homo sapiens
gcauguuccugccccacaggaau

SEQ ID NO: 1876145 - RNA, 11 nt, Homo sapiens
cacacacagcu

SEQ ID NO: 1876146 - RNA, 20 nt, Homo sapiens
cuuugcccacacacacuccu

SEQ ID NO: 1876147 - RNA, 18 nt, Homo sapiens
agauguugagaggaacaa

SEQ ID NO: 1876148 - RNA, 15 nt, Homo sapiens
caaacuguacaguuu

SEQ ID NO: 1876149 - RNA, 18 nt, Homo sapiens
uacagaucaggccuucuu

SEQ ID NO: 1876150 - RNA, 18 nt, Homo sapiens
uguucccagguaccucau

SEQ ID NO: 1876151 - RNA, 21 nt, Homo sapiens
ccacagcgagggcagcugcua

SEQ ID NO: 1876152 - RNA, 14 nt, Homo sapiens
ggccugguagcaca

SEQ ID NO: 1876153 - RNA, 19 nt, Homo sapiens
uuggagcuaaaacuggccc

SEQ ID NO: 1876154 - RNA, 16 nt, Homo sapiens
aucggcuuugcagugc

SEQ ID NO: 1876155 - RNA, 20 nt, Homo sapiens
uuugaaaucaaugcaagagu

SEQ ID NO: 1876156 - RNA, 20 nt, Homo sapiens
uggaucucccccucauccaa

SEQ ID NO: 1876157 - RNA, 15 nt, Homo sapiens
cuugucauugccagc

SEQ ID NO: 1876158 - RNA, 22 nt, Homo sapiens
auuccccugcccaccuccuucc

SEQ ID NO: 1876159 - RNA, 21 nt, Homo sapiens
ucacucccucugccuucaggc

SEQ ID NO: 1876160 - RNA, 13 nt, Homo sapiens
agcugaaagggag

SEQ ID NO: 1876161 - RNA, 17 nt, Homo sapiens
caaagggacacacagug

SEQ ID NO: 1876162 - RNA, 14 nt, Homo sapiens
ccccuggcuuuuca

SEQ ID NO: 1876163 - RNA, 21 nt, Homo sapiens
ucuccuuguaaaagccuaugu

SEQ ID NO: 1876164 - RNA, 23 nt, Homo sapiens
uaacuguauuucaguauuuucca

SEQ ID NO: 1876165 - RNA, 23 nt, Homo sapiens
cugcaugacggagccgagccaug

SEQ ID NO: 1876166 - RNA, 15 nt, Homo sapiens
ugaaacuagaaaucu

SEQ ID NO: 1876167 - RNA, 14 nt, Homo sapiens
gggauuacagacau

SEQ ID NO: 1876168 - RNA, 23 nt, Homo sapiens
uguucaaggccccugacagcugu

SEQ ID NO: 1876169 - RNA, 23 nt, Homo sapiens
acugguucauauuggacugauaa

SEQ ID NO: 1876170 - RNA, 16 nt, Homo sapiens
gagucuuaucauuuga

SEQ ID NO: 1876171 - RNA, 11 nt, Homo sapiens
cucaaaaucuu

SEQ ID NO: 1876172 - RNA, 13 nt, Homo sapiens
gacagugcugaga

SEQ ID NO: 1876173 - RNA, 16 nt, Homo sapiens
gaugcuugagccuuug

SEQ ID NO: 1876174 - RNA, 21 nt, Homo sapiens
ugugauuuccuaauaugaucu

SEQ ID NO: 1876175 - RNA, 15 nt, Homo sapiens
acagucuugggaucu

SEQ ID NO: 1876176 - RNA, 17 nt, Homo sapiens
uccaaguuugacuugua

SEQ ID NO: 1876177 - RNA, 20 nt, Homo sapiens
gauuaacugcaagucuucau

SEQ ID NO: 1876178 - RNA, 19 nt, Homo sapiens
cuacaugaugacucaaggc

SEQ ID NO: 1876179 - RNA, 16 nt, Homo sapiens
cuagggagccauuuga

SEQ ID NO: 1876180 - RNA, 18 nt, Homo sapiens
cuguagucccagcacuuu

SEQ ID NO: 1876181 - RNA, 14 nt, Homo sapiens
gaaaugagcaggga

SEQ ID NO: 1876182 - RNA, 15 nt, Homo sapiens
gacguagcugcaaag

SEQ ID NO: 1876183 - RNA, 22 nt, Homo sapiens
uucccaaggacagucagcauuu

SEQ ID NO: 1876184 - RNA, 17 nt, Homo sapiens
ggcaugcuaagaauaaa

SEQ ID NO: 1876185 - RNA, 12 nt, Homo sapiens
ggaccuaccucc

SEQ ID NO: 1876186 - RNA, 13 nt, Homo sapiens
ugcuucaaugauu

SEQ ID NO: 1876187 - RNA, 15 nt, Homo sapiens
aauuuuugucucaga

SEQ ID NO: 1876188 - RNA, 14 nt, Homo sapiens
cugcgccacuuccu

SEQ ID NO: 1876189 - RNA, 15 nt, Homo sapiens
ccaaauaaauauauu

SEQ ID NO: 1876190 - RNA, 14 nt, Homo sapiens
ggucagagugccac

SEQ ID NO: 1876191 - RNA, 22 nt, Homo sapiens
cagaggagagauagccuguggc

SEQ ID NO: 1876192 - RNA, 13 nt, Homo sapiens
cuuauaccaugag

SEQ ID NO: 1876193 - RNA, 19 nt, Homo sapiens
uggcaccaaagaugcagcc

SEQ ID NO: 1876194 - RNA, 19 nt, Homo sapiens
acauagccugcaaagcugg

SEQ ID NO: 1876195 - RNA, 16 nt, Homo sapiens
gcugagugcuaugugu

SEQ ID NO: 1876196 - RNA, 22 nt, Homo sapiens
cugccuaagugcagccccgugg

SEQ ID NO: 1876197 - RNA, 22 nt, Homo sapiens
ucuguuggaugacuuugagauu

SEQ ID NO: 1876198 - RNA, 17 nt, Homo sapiens
aaagcuaaaguaucugu

SEQ ID NO: 1876199 - RNA, 13 nt, Homo sapiens
ugagccacugcac

SEQ ID NO: 1876200 - RNA, 20 nt, Homo sapiens
uuaaacugaaucacaaugua

SEQ ID NO: 1876201 - RNA, 15 nt, Homo sapiens
uaggcaaccuucuaa

SEQ ID NO: 1876202 - RNA, 18 nt, Homo sapiens
aacucauaauuuuugcag

SEQ ID NO: 1876203 - RNA, 16 nt, Homo sapiens
auggacucucuaagga

SEQ ID NO: 1876204 - RNA, 12 nt, Homo sapiens
ugguccuguaaa

SEQ ID NO: 1876205 - RNA, 16 nt, Homo sapiens
agaaaaaaaccaaagu

SEQ ID NO: 1876206 - RNA, 19 nt, Homo sapiens
aauaaaguacuuuaccuaa

SEQ ID NO: 1876207 - RNA, 17 nt, Homo sapiens
aauagcuaaauaccuca

SEQ ID NO: 1876208 - RNA, 17 nt, Homo sapiens
augcauuuucuucacag

SEQ ID NO: 1876209 - RNA, 21 nt, Homo sapiens
caaacuggugugugccucauu

SEQ ID NO: 1876210 - RNA, 17 nt, Homo sapiens
accaaugagcuguaucu

SEQ ID NO: 1876211 - RNA, 15 nt, Homo sapiens
auguguucaaugaaa

SEQ ID NO: 1876212 - RNA, 20 nt, Homo sapiens
uacuccccauuguucuggaa

SEQ ID NO: 1876213 - RNA, 17 nt, Homo sapiens
ugcccugccgugguggc

SEQ ID NO: 1876214 - RNA, 13 nt, Homo sapiens
ugaauggggacca

SEQ ID NO: 1876215 - RNA, 15 nt, Homo sapiens
aaagcaacuccauca

SEQ ID NO: 1876216 - RNA, 14 nt, Homo sapiens
uccuugaccagcag

SEQ ID NO: 1876217 - RNA, 14 nt, Homo sapiens
cagaggcacagccg

SEQ ID NO: 1876218 - RNA, 14 nt, Homo sapiens
aaaccacaaaaaga

SEQ ID NO: 1876219 - RNA, 22 nt, Homo sapiens
ggaagugcccucgagcacugaa

SEQ ID NO: 1876220 - RNA, 21 nt, Homo sapiens
cccagccccuucugacccaug

SEQ ID NO: 1876221 - RNA, 14 nt, Homo sapiens
uaaugagauauuaa

SEQ ID NO: 1876222 - RNA, 14 nt, Homo sapiens
accagacagcacag

SEQ ID NO: 1876223 - RNA, 14 nt, Homo sapiens
ucccucuacuggga

SEQ ID NO: 1876224 - RNA, 15 nt, Homo sapiens
accaaagagacugga

SEQ ID NO: 1876225 - RNA, 19 nt, Homo sapiens
cuaaauaaacuaguaugaa

SEQ ID NO: 1876226 - RNA, 21 nt, Homo sapiens
ucuucuguuuucccauugcag

SEQ ID NO: 1876227 - RNA, 18 nt, Homo sapiens
uauaccaauauuuacuca

SEQ ID NO: 1876228 - RNA, 15 nt, Homo sapiens
agagaugacugucca

SEQ ID NO: 1876229 - RNA, 14 nt, Homo sapiens
uggcucaucucuuu

SEQ ID NO: 1876230 - RNA, 20 nt, Homo sapiens
ugaaaggacaguuaaguauu

SEQ ID NO: 1876231 - RNA, 15 nt, Homo sapiens
aggagaagcaauggg

SEQ ID NO: 1876232 - RNA, 20 nt, Homo sapiens
cuuguuaaauugcuuauucu

SEQ ID NO: 1876233 - RNA, 23 nt, Homo sapiens
caaauuugugaacugucaugaua

SEQ ID NO: 1876234 - RNA, 22 nt, Homo sapiens
gcaaaaccaaauauuccagaga

SEQ ID NO: 1876235 - RNA, 19 nt, Homo sapiens
uauguaggagcugcaguuc

SEQ ID NO: 1876236 - RNA, 19 nt, Homo sapiens
ucaauuuucacuugcuuaa

SEQ ID NO: 1876237 - RNA, 15 nt, Homo sapiens
ugaagugcgugaaug

SEQ ID NO: 1876238 - RNA, 23 nt, Homo sapiens
auacaaaucauccauccuugcca

SEQ ID NO: 1876239 - RNA, 22 nt, Homo sapiens
gucagaaugugaaaaaggaaua

SEQ ID NO: 1876240 - RNA, 18 nt, Homo sapiens
uaaaugcagucagucaca

SEQ ID NO: 1876241 - RNA, 12 nt, Homo sapiens
uagauacuguau

SEQ ID NO: 1876242 - RNA, 21 nt, Homo sapiens
cuuugagcaacuaacuaacca

SEQ ID NO: 1876243 - RNA, 11 nt, Homo sapiens
accuugcccau

SEQ ID NO: 1876244 - RNA, 13 nt, Homo sapiens
acuuccacuaccu

SEQ ID NO: 1876245 - RNA, 16 nt, Homo sapiens
aguucuuaaaguuuaa

SEQ ID NO: 1876246 - RNA, 20 nt, Homo sapiens
gcagccuucugacaagcaag

SEQ ID NO: 1876247 - RNA, 14 nt, Homo sapiens
ggucuuucagaaca

SEQ ID NO: 1876248 - RNA, 15 nt, Homo sapiens
agaauagggagacaa

SEQ ID NO: 1876249 - RNA, 14 nt, Homo sapiens
gcaagucccaugau

SEQ ID NO: 1876250 - RNA, 12 nt, Homo sapiens
aguaucugagau

SEQ ID NO: 1876251 - RNA, 14 nt, Homo sapiens
cugugucuguguau

SEQ ID NO: 1876252 - RNA, 14 nt, Homo sapiens
cuuuauagcucauc

SEQ ID NO: 1876253 - RNA, 13 nt, Homo sapiens
auuagugcugaua

SEQ ID NO: 1876254 - RNA, 21 nt, Homo sapiens
uguaauuucgccuuaaacucu

SEQ ID NO: 1876255 - RNA, 13 nt, Homo sapiens
guuuucuacucca

SEQ ID NO: 1876256 - RNA, 14 nt, Homo sapiens
ucucuguugucgua

SEQ ID NO: 1876257 - RNA, 12 nt, Homo sapiens
gccuacagccag

SEQ ID NO: 1876258 - RNA, 18 nt, Homo sapiens
aggaaccaaauuuaagac

SEQ ID NO: 1876259 - RNA, 21 nt, Homo sapiens
gauggugguggaaggugugcu

SEQ ID NO: 1876260 - RNA, 18 nt, Homo sapiens
ccuuaguuugcugccauc

SEQ ID NO: 1876261 - RNA, 18 nt, Homo sapiens
aacaaaaagaacaauaga

SEQ ID NO: 1876262 - RNA, 14 nt, Homo sapiens
acagacuccugagg

SEQ ID NO: 1876263 - RNA, 15 nt, Homo sapiens
uuugaauacugugaa

SEQ ID NO: 1876264 - RNA, 18 nt, Homo sapiens
ccacuagugcaaaucaua

SEQ ID NO: 1876265 - RNA, 13 nt, Homo sapiens
cuaaggcaggaau

SEQ ID NO: 1876266 - RNA, 16 nt, Homo sapiens
uuaccccagucacuuc

SEQ ID NO: 1876267 - RNA, 21 nt, Homo sapiens
uagaaaguugcuaacugggaa

SEQ ID NO: 1876268 - RNA, 19 nt, Homo sapiens
gguuugaauagacauuucu

SEQ ID NO: 1876269 - RNA, 19 nt, Homo sapiens
cuuccacagagacaucucc

SEQ ID NO: 1876270 - RNA, 19 nt, Homo sapiens
uucugaaccauuacuguaa

SEQ ID NO: 1876271 - RNA, 22 nt, Homo sapiens
caauuucaccaccaaaugccaa

SEQ ID NO: 1876272 - RNA, 14 nt, Homo sapiens
auacuuaggaagga

SEQ ID NO: 1876273 - RNA, 16 nt, Homo sapiens
gcuaggugucugggau

SEQ ID NO: 1876274 - RNA, 22 nt, Homo sapiens
ggagguagcucccagcacucaa

SEQ ID NO: 1876275 - RNA, 13 nt, Homo sapiens
ucuccccaugugc

SEQ ID NO: 1876276 - RNA, 14 nt, Homo sapiens
ugcaaaaaaagccu

SEQ ID NO: 1876277 - RNA, 19 nt, Homo sapiens
ugcugacaggauguggcac

SEQ ID NO: 1876278 - RNA, 15 nt, Homo sapiens
gugauuucagagagg

SEQ ID NO: 1876279 - RNA, 22 nt, Homo sapiens
ugcugcuugugccucccuuccc

SEQ ID NO: 1876280 - RNA, 15 nt, Homo sapiens
gucaauagcaugcaa

SEQ ID NO: 1876281 - RNA, 18 nt, Homo sapiens
aaccacagcagacaccau

SEQ ID NO: 1876282 - RNA, 16 nt, Homo sapiens
ccccaggcacuuugca

SEQ ID NO: 1876283 - RNA, 15 nt, Homo sapiens
gcugcuggacaguau

SEQ ID NO: 1876284 - RNA, 19 nt, Homo sapiens
accaaaauccccuucucau

SEQ ID NO: 1876285 - RNA, 23 nt, Homo sapiens
cuccaggaagaaagaauguuacu

SEQ ID NO: 1876286 - RNA, 15 nt, Homo sapiens
gccccaggaagccgu

SEQ ID NO: 1876287 - RNA, 22 nt, Homo sapiens
auuagccacauguacacuacau

SEQ ID NO: 1876288 - RNA, 14 nt, Homo sapiens
agcauguauugugu

SEQ ID NO: 1876289 - RNA, 14 nt, Homo sapiens
gcugagccaugggg

SEQ ID NO: 1876290 - RNA, 16 nt, Homo sapiens
uaaaacccagcaugua

SEQ ID NO: 1876291 - RNA, 21 nt, Homo sapiens
ccgagaauauucaaaauucca

SEQ ID NO: 1876292 - RNA, 17 nt, Homo sapiens
gcccaggacugcauugu

SEQ ID NO: 1876293 - RNA, 19 nt, Homo sapiens
caacaacauccauguccua

SEQ ID NO: 1876294 - RNA, 19 nt, Homo sapiens
ucccaguaaagauaccaug

SEQ ID NO: 1876295 - RNA, 12 nt, Homo sapiens
gcucagugccac

SEQ ID NO: 1876296 - RNA, 21 nt, Homo sapiens
uccugccaaaagaucugggga

SEQ ID NO: 1876297 - RNA, 12 nt, Homo sapiens
guaaagugcuua

SEQ ID NO: 1876298 - RNA, 15 nt, Homo sapiens
caaaaccgccagcuc

SEQ ID NO: 1876299 - RNA, 23 nt, Homo sapiens
aauagcauacaucaauggugugu

SEQ ID NO: 1876300 - RNA, 19 nt, Homo sapiens
uguaaacaaucagaccaca

SEQ ID NO: 1876301 - RNA, 21 nt, Homo sapiens
cgggcgaggucugauggagcu

SEQ ID NO: 1876302 - RNA, 20 nt, Homo sapiens
acuuuauuuauacacugucu

SEQ ID NO: 1876303 - RNA, 19 nt, Homo sapiens
acccaugcaagcagaggac

SEQ ID NO: 1876304 - RNA, 20 nt, Homo sapiens
gacauauuacaacacuuuaa

SEQ ID NO: 1876305 - RNA, 18 nt, Homo sapiens
ccuccugaacuggccacu

SEQ ID NO: 1876306 - RNA, 10 nt, Homo sapiens
uaaagacaga

SEQ ID NO: 1876307 - RNA, 17 nt, Homo sapiens
cagcccagacccagugg

SEQ ID NO: 1876308 - RNA, 16 nt, Homo sapiens
ggcucgacugcucaac

SEQ ID NO: 1876309 - RNA, 22 nt, Homo sapiens
caggacuuucauuguucuuggc

SEQ ID NO: 1876310 - RNA, 11 nt, Homo sapiens
ggggucucaga

SEQ ID NO: 1876311 - RNA, 17 nt, Homo sapiens
cgcuuucccaucuuaaa

SEQ ID NO: 1876312 - RNA, 23 nt, Homo sapiens
auccugauucauauuuaauuuga

SEQ ID NO: 1876313 - RNA, 16 nt, Homo sapiens
aggcuggcuuucagag

SEQ ID NO: 1876314 - RNA, 19 nt, Homo sapiens
gaugucauggagugacaga

SEQ ID NO: 1876315 - RNA, 18 nt, Homo sapiens
gaugcgcacugcauucca

SEQ ID NO: 1876316 - RNA, 22 nt, Homo sapiens
uucaugaaauuauccaugguaa

SEQ ID NO: 1876317 - RNA, 18 nt, Homo sapiens
caccauguaacaaccaga

SEQ ID NO: 1876318 - RNA, 15 nt, Homo sapiens
aguaggagcacuggg

SEQ ID NO: 1876319 - RNA, 22 nt, Homo sapiens
gcaucguggagacagggcauuu

SEQ ID NO: 1876320 - RNA, 16 nt, Homo sapiens
ccgcuuuuucacuccc

SEQ ID NO: 1876321 - RNA, 14 nt, Homo sapiens
ucaacaaaagggag

SEQ ID NO: 1876322 - RNA, 15 nt, Homo sapiens
gcauauagacuguac

SEQ ID NO: 1876323 - RNA, 22 nt, Homo sapiens
aagcuggugccccacugaauuu

SEQ ID NO: 1876324 - RNA, 17 nt, Homo sapiens
guuucggaagagcuguu

SEQ ID NO: 1876325 - RNA, 19 nt, Homo sapiens
auuccauuugggucagccu

SEQ ID NO: 1876326 - RNA, 19 nt, Homo sapiens
aagcacaaaagacaagcau

SEQ ID NO: 1876327 - RNA, 16 nt, Homo sapiens
ccaccucccucugcca

SEQ ID NO: 1876328 - RNA, 20 nt, Homo sapiens
aaaggcuggaugugcuuuca

SEQ ID NO: 1876329 - RNA, 16 nt, Homo sapiens
ggcagguugaucagug

SEQ ID NO: 1876330 - RNA, 12 nt, Homo sapiens
ccagcaucugga

SEQ ID NO: 1876331 - RNA, 18 nt, Homo sapiens
aagaacaacugccaagaa

SEQ ID NO: 1876332 - RNA, 23 nt, Homo sapiens
uccugauaaacauuaaacacugu

SEQ ID NO: 1876333 - RNA, 12 nt, Homo sapiens
uuucugcuuuaa

SEQ ID NO: 1876334 - RNA, 21 nt, Homo sapiens
uagauuuaaccauggcacuga

SEQ ID NO: 1876335 - RNA, 15 nt, Homo sapiens
aggcugucauuucau

SEQ ID NO: 1876336 - RNA, 21 nt, Homo sapiens
ugcccuccacuccacugccuu

SEQ ID NO: 1876337 - RNA, 17 nt, Homo sapiens
acugggugguccaaaga

SEQ ID NO: 1876338 - RNA, 15 nt, Homo sapiens
auuauaaaaugcaau

SEQ ID NO: 1876339 - RNA, 16 nt, Homo sapiens
aggggcuggaagggaa

SEQ ID NO: 1876340 - RNA, 21 nt, Homo sapiens
uaaaugauucuuagugacuuu

SEQ ID NO: 1876341 - RNA, 22 nt, Homo sapiens
uuuugcagaugaaguaacugag

SEQ ID NO: 1876342 - RNA, 12 nt, Homo sapiens
gcccagugcaaa

SEQ ID NO: 1876343 - RNA, 12 nt, Homo sapiens
gaacagugccca

SEQ ID NO: 1876344 - RNA, 21 nt, Homo sapiens
ucaugggguggacucuaacag

SEQ ID NO: 1876345 - RNA, 12 nt, Homo sapiens
auugcugugaau

SEQ ID NO: 1876346 - RNA, 14 nt, Homo sapiens
uugauuacuuuuca

SEQ ID NO: 1876347 - RNA, 21 nt, Homo sapiens
aagaacucauuugaaugcuua

SEQ ID NO: 1876348 - RNA, 20 nt, Homo sapiens
acaccucuccuuugugacuu

SEQ ID NO: 1876349 - RNA, 13 nt, Homo sapiens
uguguugggaccu

SEQ ID NO: 1876350 - RNA, 18 nt, Homo sapiens
gagcuugaaauagugucu

SEQ ID NO: 1876351 - RNA, 20 nt, Homo sapiens
uaaauaaaacuuaaaucuca

SEQ ID NO: 1876352 - RNA, 18 nt, Homo sapiens
guuccucauggcuguuau

SEQ ID NO: 1876353 - RNA, 18 nt, Homo sapiens
cacagaugauacuuccaa

SEQ ID NO: 1876354 - RNA, 18 nt, Homo sapiens
aucauaagcugauuugau

SEQ ID NO: 1876355 - RNA, 13 nt, Homo sapiens
ccuggaaaccaca

SEQ ID NO: 1876356 - RNA, 18 nt, Homo sapiens
cuacguauaaauaugaaa

SEQ ID NO: 1876357 - RNA, 13 nt, Homo sapiens
ucuuuuagcacau

SEQ ID NO: 1876358 - RNA, 21 nt, Homo sapiens
uugucauuuugaaauacuuaa

SEQ ID NO: 1876359 - RNA, 18 nt, Homo sapiens
cuuauacuaaagguugug

SEQ ID NO: 1876360 - RNA, 19 nt, Homo sapiens
agucuuggaaaaaaaccac

SEQ ID NO: 1876361 - RNA, 22 nt, Homo sapiens
uggccccgaggcugggacacug

SEQ ID NO: 1876362 - RNA, 19 nt, Homo sapiens
cucaaauuccgagugcaga

SEQ ID NO: 1876363 - RNA, 16 nt, Homo sapiens
auguaccauaaugcua

SEQ ID NO: 1876364 - RNA, 14 nt, Homo sapiens
acagccaccaagaa

SEQ ID NO: 1876365 - RNA, 13 nt, Homo sapiens
aauagauaccacc

SEQ ID NO: 1876366 - RNA, 21 nt, Homo sapiens
agucccaauuugaauucaauu

SEQ ID NO: 1876367 - RNA, 17 nt, Homo sapiens
cuguuuaaugucugcca

SEQ ID NO: 1876368 - RNA, 19 nt, Homo sapiens
gaggcugcaaucacacuga

SEQ ID NO: 1876369 - RNA, 18 nt, Homo sapiens
cuaagcuauucaguaaua

SEQ ID NO: 1876370 - RNA, 23 nt, Homo sapiens
ucacaaaaacagcaaaauugugg

SEQ ID NO: 1876371 - RNA, 15 nt, Homo sapiens
aauagagacuguaga

SEQ ID NO: 1876372 - RNA, 17 nt, Homo sapiens
gcccgcugccugcacug

SEQ ID NO: 1876373 - RNA, 16 nt, Homo sapiens
guagacucuugcuccu

SEQ ID NO: 1876374 - RNA, 19 nt, Homo sapiens
gcacauucgggccauuucc

SEQ ID NO: 1876375 - RNA, 17 nt, Homo sapiens
cagcucuuccuguguuu

SEQ ID NO: 1876376 - RNA, 12 nt, Homo sapiens
ccucaaggacaa

SEQ ID NO: 1876377 - RNA, 18 nt, Homo sapiens
cgaaacacccccagauuc

SEQ ID NO: 1876378 - RNA, 17 nt, Homo sapiens
ccaccugccacaguuca

SEQ ID NO: 1876379 - RNA, 18 nt, Homo sapiens
caaugcacauccauuccc

SEQ ID NO: 1876380 - RNA, 19 nt, Homo sapiens
cccacagcuggcucugaca

SEQ ID NO: 1876381 - RNA, 17 nt, Homo sapiens
ccuugagaaauucugaa

SEQ ID NO: 1876382 - RNA, 23 nt, Homo sapiens
cccuucucccggcccucacuaag

SEQ ID NO: 1876383 - RNA, 18 nt, Homo sapiens
acccugggaacaauuucc

SEQ ID NO: 1876384 - RNA, 15 nt, Homo sapiens
aucauugcauuucca

SEQ ID NO: 1876385 - RNA, 13 nt, Homo sapiens
uuuuaacaucuga

SEQ ID NO: 1876386 - RNA, 12 nt, Homo sapiens
acuaagcacaaa

SEQ ID NO: 1876387 - RNA, 16 nt, Homo sapiens
ugaauguagcuuccac

SEQ ID NO: 1876388 - RNA, 13 nt, Homo sapiens
cagagagggccca

SEQ ID NO: 1876389 - RNA, 17 nt, Homo sapiens
ugauuucuuccugcaga

SEQ ID NO: 1876390 - RNA, 13 nt, Homo sapiens
uuuuucagcuccu

SEQ ID NO: 1876391 - RNA, 14 nt, Homo sapiens
acauucagcacacu

SEQ ID NO: 1876392 - RNA, 14 nt, Homo sapiens
augcaaguguuccu

SEQ ID NO: 1876393 - RNA, 20 nt, Homo sapiens
aauauuuauuaccucugaua

SEQ ID NO: 1876394 - RNA, 17 nt, Homo sapiens
uacuauuugccauuuaa

SEQ ID NO: 1876395 - RNA, 20 nt, Homo sapiens
uccucagagcaggggccaga

SEQ ID NO: 1876396 - RNA, 18 nt, Homo sapiens
gaauccagaucauuccuc

SEQ ID NO: 1876397 - RNA, 17 nt, Homo sapiens
ccauuagagaguggcaa

SEQ ID NO: 1876398 - RNA, 15 nt, Homo sapiens
agguuuagaugugca

SEQ ID NO: 1876399 - RNA, 19 nt, Homo sapiens
gaauuuacauauagcugau

SEQ ID NO: 1876400 - RNA, 15 nt, Homo sapiens
aucuuuguaccaaaa

SEQ ID NO: 1876401 - RNA, 23 nt, Homo sapiens
agugcccaaggaauuucugcucu

SEQ ID NO: 1876402 - RNA, 22 nt, Homo sapiens
auguacaccagagccucaguga

SEQ ID NO: 1876403 - RNA, 17 nt, Homo sapiens
agugcuucagaguuugu

SEQ ID NO: 1876404 - RNA, 13 nt, Homo sapiens
caaauaaucacag

SEQ ID NO: 1876405 - RNA, 21 nt, Homo sapiens
ggaaugcaguccucaucucca

SEQ ID NO: 1876406 - RNA, 16 nt, Homo sapiens
ccuugguaaaaacugc

SEQ ID NO: 1876407 - RNA, 12 nt, Homo sapiens
ugcugauccaga

SEQ ID NO: 1876408 - RNA, 15 nt, Homo sapiens
cugccgcuaccugga

SEQ ID NO: 1876409 - RNA, 15 nt, Homo sapiens
accugccucugccca

SEQ ID NO: 1876410 - RNA, 16 nt, Homo sapiens
uuaaucuugcuuucuu

SEQ ID NO: 1876411 - RNA, 18 nt, Homo sapiens
ggaguucaaaacauucau

SEQ ID NO: 1876412 - RNA, 23 nt, Homo sapiens
uuuaguaagugcuuguuuuacau

SEQ ID NO: 1876413 - RNA, 15 nt, Homo sapiens
ggcuaugugagcaca

SEQ ID NO: 1876414 - RNA, 21 nt, Homo sapiens
ccagccugcuagcuagcucaa

SEQ ID NO: 1876415 - RNA, 16 nt, Homo sapiens
ugacccuuccagacau

SEQ ID NO: 1876416 - RNA, 17 nt, Homo sapiens
gucuagacacaauuuca

SEQ ID NO: 1876417 - RNA, 17 nt, Homo sapiens
agcaugcuucccagagg

SEQ ID NO: 1876418 - RNA, 15 nt, Homo sapiens
cuggagccccugugu

SEQ ID NO: 1876419 - RNA, 22 nt, Homo sapiens
ucaauagucaguuacugaugcu

SEQ ID NO: 1876420 - RNA, 14 nt, Homo sapiens
uuuucccaguauuu

SEQ ID NO: 1876421 - RNA, 17 nt, Homo sapiens
ucugcacauaggcagua

SEQ ID NO: 1876422 - RNA, 23 nt, Homo sapiens
uagucauacucccugguguagug

SEQ ID NO: 1876423 - RNA, 12 nt, Homo sapiens
uuuuugugauca

SEQ ID NO: 1876424 - RNA, 13 nt, Homo sapiens
ccucucacacugg

SEQ ID NO: 1876425 - RNA, 23 nt, Homo sapiens
gcuggccucucugacauaugcua

SEQ ID NO: 1876426 - RNA, 20 nt, Homo sapiens
aguuaggcuauucacaacca

SEQ ID NO: 1876427 - RNA, 19 nt, Homo sapiens
gaggacuugugucucugug

SEQ ID NO: 1876428 - RNA, 16 nt, Homo sapiens
ucuauuaucaugguau

SEQ ID NO: 1876429 - RNA, 16 nt, Homo sapiens
ugcucucagagcaccu

SEQ ID NO: 1876430 - RNA, 19 nt, Homo sapiens
gagauucagugaacuaauu

SEQ ID NO: 1876431 - RNA, 22 nt, Homo sapiens
uguucccucucucccuccaggg

SEQ ID NO: 1876432 - RNA, 21 nt, Homo sapiens
aaucuuaaccugaugcuaauu

SEQ ID NO: 1876433 - RNA, 20 nt, Homo sapiens
cccccuuuagcgggacucag

SEQ ID NO: 1876434 - RNA, 16 nt, Homo sapiens
uaaagcguccucucag

SEQ ID NO: 1876435 - RNA, 19 nt, Homo sapiens
uuuccuuuuguuuacaaca

SEQ ID NO: 1876436 - RNA, 18 nt, Homo sapiens
aacauuaugaucuaauaa

SEQ ID NO: 1876437 - RNA, 19 nt, Homo sapiens
uauucuguaauuuggcucc

SEQ ID NO: 1876438 - RNA, 19 nt, Homo sapiens
auuguacuuccaggcuugg

SEQ ID NO: 1876439 - RNA, 16 nt, Homo sapiens
ccaaugcuuacgucaa

SEQ ID NO: 1876440 - RNA, 18 nt, Homo sapiens
uggccacccaaacaggac

SEQ ID NO: 1876441 - RNA, 19 nt, Homo sapiens
auaaguucauucaugccaa

SEQ ID NO: 1876442 - RNA, 20 nt, Homo sapiens
cacaugucuuguacaugugu

SEQ ID NO: 1876443 - RNA, 14 nt, Homo sapiens
auauucuggaguca

SEQ ID NO: 1876444 - RNA, 20 nt, Homo sapiens
cccagcugacgcgacuauca

SEQ ID NO: 1876445 - RNA, 14 nt, Homo sapiens
gggcucccaggcca

SEQ ID NO: 1876446 - RNA, 20 nt, Homo sapiens
agcuucauuuuacuaaaaag

SEQ ID NO: 1876447 - RNA, 17 nt, Homo sapiens
gucuugguucuaaaggu

SEQ ID NO: 1876448 - RNA, 13 nt, Homo sapiens
uaugcauucacuc

SEQ ID NO: 1876449 - RNA, 12 nt, Homo sapiens
ucauucauuugc

SEQ ID NO: 1876450 - RNA, 18 nt, Homo sapiens
uagcagagauaacuuauc

SEQ ID NO: 1876451 - RNA, 15 nt, Homo sapiens
ugcuaccugagccaa

SEQ ID NO: 1876452 - RNA, 14 nt, Homo sapiens
gagucacacagugu

SEQ ID NO: 1876453 - RNA, 14 nt, Homo sapiens
cagugucagaguca

SEQ ID NO: 1876454 - RNA, 22 nt, Homo sapiens
uagaacgagccuggaagcacua

SEQ ID NO: 1876455 - RNA, 16 nt, Homo sapiens
agccagcucugcauua

SEQ ID NO: 1876456 - RNA, 22 nt, Homo sapiens
ccagaguuggacccgaccccaa

SEQ ID NO: 1876457 - RNA, 17 nt, Homo sapiens
gaaacaugucuugacug

SEQ ID NO: 1876458 - RNA, 20 nt, Homo sapiens
gacaaucaugaaauaugcau

SEQ ID NO: 1876459 - RNA, 16 nt, Homo sapiens
acuagcauuuuccacg

SEQ ID NO: 1876460 - RNA, 17 nt, Homo sapiens
gccucugccccaagggg

SEQ ID NO: 1876461 - RNA, 15 nt, Homo sapiens
gcaaaccugcaguuu

SEQ ID NO: 1876462 - RNA, 19 nt, Homo sapiens
aaugacuuuuauaacauuu

SEQ ID NO: 1876463 - RNA, 19 nt, Homo sapiens
cccugugcuccgugccucc

SEQ ID NO: 1876464 - RNA, 14 nt, Homo sapiens
acuuacucuugucg

SEQ ID NO: 1876465 - RNA, 16 nt, Homo sapiens
ucugauucuucaaaga

SEQ ID NO: 1876466 - RNA, 14 nt, Homo sapiens
cauuuccauggugc

SEQ ID NO: 1876467 - RNA, 16 nt, Homo sapiens
cccauugacuugcaca

SEQ ID NO: 1876468 - RNA, 16 nt, Homo sapiens
ucccaaaucaauaaga

SEQ ID NO: 1876469 - RNA, 15 nt, Homo sapiens
cucccggaccccuug

SEQ ID NO: 1876470 - RNA, 16 nt, Homo sapiens
cugagcuguccagugg

SEQ ID NO: 1876471 - RNA, 17 nt, Homo sapiens
uaugagaauauaccuua

SEQ ID NO: 1876472 - RNA, 23 nt, Homo sapiens
aucccuaugguaucauaucauga

SEQ ID NO: 1876473 - RNA, 22 nt, Homo sapiens
aacucuuucauucuucucacau

SEQ ID NO: 1876474 - RNA, 19 nt, Homo sapiens
acucuuuggguccauucag

SEQ ID NO: 1876475 - RNA, 19 nt, Homo sapiens
cugcuuagauuucuagcag

SEQ ID NO: 1876476 - RNA, 16 nt, Homo sapiens
cuccgcaagcaucauc

SEQ ID NO: 1876477 - RNA, 19 nt, Homo sapiens
caucuccaagaaugcugaa

SEQ ID NO: 1876478 - RNA, 16 nt, Homo sapiens
uuaaauuacaguauau

SEQ ID NO: 1876479 - RNA, 23 nt, Homo sapiens
ugaagaucaagccaguucuccuu

SEQ ID NO: 1876480 - RNA, 16 nt, Homo sapiens
auggucuaacacuggc

SEQ ID NO: 1876481 - RNA, 14 nt, Homo sapiens
aacuuguccugacu

SEQ ID NO: 1876482 - RNA, 21 nt, Homo sapiens
cucuccgaaagaagacacaga

SEQ ID NO: 1876483 - RNA, 21 nt, Homo sapiens
agcucaggacauggaggugcc

SEQ ID NO: 1876484 - RNA, 13 nt, Homo sapiens
auuuuaugcugcu

SEQ ID NO: 1876485 - RNA, 17 nt, Homo sapiens
uacuuuuuaaacagugu

SEQ ID NO: 1876486 - RNA, 23 nt, Homo sapiens
ccuagagcuccaguucuuuauaa

SEQ ID NO: 1876487 - RNA, 14 nt, Homo sapiens
uuccaucuuugggu

SEQ ID NO: 1876488 - RNA, 13 nt, Homo sapiens
auguuacugagau

SEQ ID NO: 1876489 - RNA, 13 nt, Homo sapiens
gacuaacuaucaa

SEQ ID NO: 1876490 - RNA, 19 nt, Homo sapiens
aggaacacucugaauucca

SEQ ID NO: 1876491 - RNA, 19 nt, Homo sapiens
ccggguuagccuggugaca

SEQ ID NO: 1876492 - RNA, 22 nt, Homo sapiens
ucaauacauagugcugcugugu

SEQ ID NO: 1876493 - RNA, 16 nt, Homo sapiens
acgcugcgugccauga

SEQ ID NO: 1876494 - RNA, 22 nt, Homo sapiens
guuugccuacguuggugcaagu

SEQ ID NO: 1876495 - RNA, 17 nt, Homo sapiens
guuagaaacaccagccg

SEQ ID NO: 1876496 - RNA, 15 nt, Homo sapiens
caccacgacuggcca

SEQ ID NO: 1876497 - RNA, 20 nt, Homo sapiens
ccccagaaccccuggcucca

SEQ ID NO: 1876498 - RNA, 11 nt, Homo sapiens
aaaauguucuc

SEQ ID NO: 1876499 - RNA, 15 nt, Homo sapiens
uucacgccauucucc

SEQ ID NO: 1876500 - RNA, 22 nt, Homo sapiens
gaauguuuuggcaagagcguua

SEQ ID NO: 1876501 - RNA, 22 nt, Homo sapiens
caaagggggaggcuaaagccca

SEQ ID NO: 1876502 - RNA, 19 nt, Homo sapiens
ggcucuccuguagcucucc

SEQ ID NO: 1876503 - RNA, 21 nt, Homo sapiens
cguguuuaauuaaauuucaca

SEQ ID NO: 1876504 - RNA, 21 nt, Homo sapiens
cauuggaggggcuggcacugg

SEQ ID NO: 1876505 - RNA, 13 nt, Homo sapiens
gauggccaaagca

SEQ ID NO: 1876506 - RNA, 14 nt, Homo sapiens
agaccccaugccug

SEQ ID NO: 1876507 - RNA, 12 nt, Homo sapiens
augaccaagaaa

SEQ ID NO: 1876508 - RNA, 18 nt, Homo sapiens
ggacuccuggacuacuuu

SEQ ID NO: 1876509 - RNA, 18 nt, Homo sapiens
uuaagaaaaaaagcaaaa

SEQ ID NO: 1876510 - RNA, 17 nt, Homo sapiens
uuaaagggacaguuugu

SEQ ID NO: 1876511 - RNA, 16 nt, Homo sapiens
ugccaaguaaauagca

SEQ ID NO: 1876512 - RNA, 13 nt, Homo sapiens
caagcacuucaaa

SEQ ID NO: 1876513 - RNA, 14 nt, Homo sapiens
auuacagaggguag

SEQ ID NO: 1876514 - RNA, 19 nt, Homo sapiens
ccaggcugggcucugggau

SEQ ID NO: 1876515 - RNA, 18 nt, Homo sapiens
ccuacagggugucuguca

SEQ ID NO: 1876516 - RNA, 16 nt, Homo sapiens
caaacuuaacauggaa

SEQ ID NO: 1876517 - RNA, 22 nt, Homo sapiens
cucugaagaguggguuucacaa

SEQ ID NO: 1876518 - RNA, 14 nt, Homo sapiens
cuuuaacugacuua

SEQ ID NO: 1876519 - RNA, 20 nt, Homo sapiens
aucugacaucuuauuuacuu

SEQ ID NO: 1876520 - RNA, 15 nt, Homo sapiens
ucagaggacuuggca

SEQ ID NO: 1876521 - RNA, 18 nt, Homo sapiens
uaaagcuguuauucuugu

SEQ ID NO: 1876522 - RNA, 13 nt, Homo sapiens
ggaaaagauuucu

SEQ ID NO: 1876523 - RNA, 21 nt, Homo sapiens
aguacaguauauucuuguaaa

SEQ ID NO: 1876524 - RNA, 16 nt, Homo sapiens
cuuggccucccaaagu

SEQ ID NO: 1876525 - RNA, 22 nt, Homo sapiens
ucggggaacuccuggaaauauc

SEQ ID NO: 1876526 - RNA, 17 nt, Homo sapiens
agaaagaaguccuuucu

SEQ ID NO: 1876527 - RNA, 16 nt, Homo sapiens
aacaccaccucuccag

SEQ ID NO: 1876528 - RNA, 22 nt, Homo sapiens
caaagcggucccugucccucua

SEQ ID NO: 1876529 - RNA, 15 nt, Homo sapiens
cagugcauuugccuu

SEQ ID NO: 1876530 - RNA, 15 nt, Homo sapiens
aagauuaauguagga

SEQ ID NO: 1876531 - RNA, 15 nt, Homo sapiens
ucauauauacuguau

SEQ ID NO: 1876532 - RNA, 16 nt, Homo sapiens
caagcaccaaccucca

SEQ ID NO: 1876533 - RNA, 12 nt, Homo sapiens
uaaauugcauca

SEQ ID NO: 1876534 - RNA, 22 nt, Homo sapiens
agcugagagugccccacugcac

SEQ ID NO: 1876535 - RNA, 18 nt, Homo sapiens
ucaauguucaguuuuccu

SEQ ID NO: 1876536 - RNA, 15 nt, Homo sapiens
aagcauuucaccuuu

SEQ ID NO: 1876537 - RNA, 20 nt, Homo sapiens
gacuucugcugaaggacaga

SEQ ID NO: 1876538 - RNA, 21 nt, Homo sapiens
uuuuccuggauuauaaggaaa

SEQ ID NO: 1876539 - RNA, 20 nt, Homo sapiens
auuagcucuacuggaauuuu

SEQ ID NO: 1876540 - RNA, 15 nt, Homo sapiens
uccagcaggcagcug

SEQ ID NO: 1876541 - RNA, 14 nt, Homo sapiens
caacaaggcaaaau

SEQ ID NO: 1876542 - RNA, 14 nt, Homo sapiens
gagacugggagcca

SEQ ID NO: 1876543 - RNA, 19 nt, Homo sapiens
ugggucuucagggggccag

SEQ ID NO: 1876544 - RNA, 21 nt, Homo sapiens
ggaacagugaaucagucccau

SEQ ID NO: 1876545 - RNA, 22 nt, Homo sapiens
cuuccucacagucccacugugc

SEQ ID NO: 1876546 - RNA, 13 nt, Homo sapiens
caaauaaguggaa

SEQ ID NO: 1876547 - RNA, 20 nt, Homo sapiens
uaguguuaagugugcaguau

SEQ ID NO: 1876548 - RNA, 19 nt, Homo sapiens
caacaaacuuggucuuaca

SEQ ID NO: 1876549 - RNA, 13 nt, Homo sapiens
agcugagccuucu

SEQ ID NO: 1876550 - RNA, 23 nt, Homo sapiens
aaauuucaccauugcugucaagu

SEQ ID NO: 1876551 - RNA, 14 nt, Homo sapiens
agggacccacuuca

SEQ ID NO: 1876552 - RNA, 17 nt, Homo sapiens
uuaccuacaagaacaau

SEQ ID NO: 1876553 - RNA, 21 nt, Homo sapiens
aaacuugugaaauaaagauuc

SEQ ID NO: 1876554 - RNA, 22 nt, Homo sapiens
gauauaccuaauguuaaaugac

SEQ ID NO: 1876555 - RNA, 14 nt, Homo sapiens
ugcugauccagaug

SEQ ID NO: 1876556 - RNA, 19 nt, Homo sapiens
uuuguggaggcagugucau

SEQ ID NO: 1876557 - RNA, 12 nt, Homo sapiens
uuauaagcuaca

SEQ ID NO: 1876558 - RNA, 18 nt, Homo sapiens
auuuucaucuucuuccau

SEQ ID NO: 1876559 - RNA, 17 nt, Homo sapiens
uauguuuucuuucucac

SEQ ID NO: 1876560 - RNA, 21 nt, Homo sapiens
ccaggcaaauaaaauucccua

SEQ ID NO: 1876561 - RNA, 16 nt, Homo sapiens
ggccagccaccacuga

SEQ ID NO: 1876562 - RNA, 14 nt, Homo sapiens
ugaacaggcaugca

SEQ ID NO: 1876563 - RNA, 12 nt, Homo sapiens
aagaucaaagac

SEQ ID NO: 1876564 - RNA, 12 nt, Homo sapiens
gaaaucaagggc

SEQ ID NO: 1876565 - RNA, 17 nt, Homo sapiens
ugaaguacaauaauuca

SEQ ID NO: 1876566 - RNA, 16 nt, Homo sapiens
aaugaacuaacugaca

SEQ ID NO: 1876567 - RNA, 23 nt, Homo sapiens
cucucauuuguguggagucauuu

SEQ ID NO: 1876568 - RNA, 17 nt, Homo sapiens
ucuucaugcgugcccuu

SEQ ID NO: 1876569 - RNA, 15 nt, Homo sapiens
aucaauucauugugu

SEQ ID NO: 1876570 - RNA, 22 nt, Homo sapiens
uaccauccccgaccaucugauu

SEQ ID NO: 1876571 - RNA, 18 nt, Homo sapiens
acaaugaaauacuccagc

SEQ ID NO: 1876572 - RNA, 13 nt, Homo sapiens
uuuucacauaucu

SEQ ID NO: 1876573 - RNA, 13 nt, Homo sapiens
gaacagaccagug

SEQ ID NO: 1876574 - RNA, 13 nt, Homo sapiens
uugauguaucuga

SEQ ID NO: 1876575 - RNA, 20 nt, Homo sapiens
uccagccccuccucccucag

SEQ ID NO: 1876576 - RNA, 20 nt, Homo sapiens
uauucuauaaaacucugcau

SEQ ID NO: 1876577 - RNA, 23 nt, Homo sapiens
aagacuguuaaaugaaaccagaa

SEQ ID NO: 1876578 - RNA, 16 nt, Homo sapiens
ccagcaagcucuucac

SEQ ID NO: 1876579 - RNA, 16 nt, Homo sapiens
guaugugcgugcaugu

SEQ ID NO: 1876580 - RNA, 18 nt, Homo sapiens
uucccaauauuugcuaaa

SEQ ID NO: 1876581 - RNA, 16 nt, Homo sapiens
uugaagccacugccuu

SEQ ID NO: 1876582 - RNA, 22 nt, Homo sapiens
agaucacuuguuguuuuacuaa

SEQ ID NO: 1876583 - RNA, 16 nt, Homo sapiens
aggucagagaugggcu

SEQ ID NO: 1876584 - RNA, 14 nt, Homo sapiens
ugaacuaguuuuac

SEQ ID NO: 1876585 - RNA, 17 nt, Homo sapiens
gccucgugccaugaucu

SEQ ID NO: 1876586 - RNA, 22 nt, Homo sapiens
uuauucacauauaucaaaguga

SEQ ID NO: 1876587 - RNA, 20 nt, Homo sapiens
cccuucauccgccugugggc

SEQ ID NO: 1876588 - RNA, 19 nt, Homo sapiens
ugcacuguucaaaccucug

SEQ ID NO: 1876589 - RNA, 20 nt, Homo sapiens
gaggagcaccuccgccagau

SEQ ID NO: 1876590 - RNA, 20 nt, Homo sapiens
aagcuucccucucagcugcu

SEQ ID NO: 1876591 - RNA, 13 nt, Homo sapiens
ggaccuaccuccc

SEQ ID NO: 1876592 - RNA, 19 nt, Homo sapiens
auuuaagugauacauaccu

SEQ ID NO: 1876593 - RNA, 22 nt, Homo sapiens
ucauaacuagaguauguguaug

SEQ ID NO: 1876594 - RNA, 13 nt, Homo sapiens
guugcacugauau

SEQ ID NO: 1876595 - RNA, 21 nt, Homo sapiens
acauggaaaacagaguauuuc

SEQ ID NO: 1876596 - RNA, 23 nt, Homo sapiens
guuucacucuuuccagauaagca

SEQ ID NO: 1876597 - RNA, 16 nt, Homo sapiens
uggcgcaucauaugca

SEQ ID NO: 1876598 - RNA, 21 nt, Homo sapiens
ugcauguaaacacgccugcaa

SEQ ID NO: 1876599 - RNA, 17 nt, Homo sapiens
cucccuuuccuuuccca

SEQ ID NO: 1876600 - RNA, 18 nt, Homo sapiens
gugcauggccacagccac

SEQ ID NO: 1876601 - RNA, 12 nt, Homo sapiens
gagccuggccag

SEQ ID NO: 1876602 - RNA, 19 nt, Homo sapiens
ccucugucagucacagcca

SEQ ID NO: 1876603 - RNA, 18 nt, Homo sapiens
agaaugggggcagcaccu

SEQ ID NO: 1876604 - RNA, 21 nt, Homo sapiens
uggcaagaccaauaguuugaa

SEQ ID NO: 1876605 - RNA, 20 nt, Homo sapiens
cugacugaagugaacuauga

SEQ ID NO: 1876606 - RNA, 20 nt, Homo sapiens
gcaguuagagcugagcacuu

SEQ ID NO: 1876607 - RNA, 10 nt, Homo sapiens
gcuccaugag

SEQ ID NO: 1876608 - RNA, 16 nt, Homo sapiens
uauuacgugcaauacu

SEQ ID NO: 1876609 - RNA, 14 nt, Homo sapiens
gcuucaugagcuaa

SEQ ID NO: 1876610 - RNA, 20 nt, Homo sapiens
uccguucacaugugugguac

SEQ ID NO: 1876611 - RNA, 13 nt, Homo sapiens
ggcuaccuacaua

SEQ ID NO: 1876612 - RNA, 21 nt, Homo sapiens
gucaggggugacacagacuca

SEQ ID NO: 1876613 - RNA, 21 nt, Homo sapiens
uccuugaaaaaaaguugcuuu

SEQ ID NO: 1876614 - RNA, 19 nt, Homo sapiens
cccuuucaacagaauucac

SEQ ID NO: 1876615 - RNA, 22 nt, Homo sapiens
agaggucuccaucauggcagug

SEQ ID NO: 1876616 - RNA, 17 nt, Homo sapiens
ugaaaacacugugcaca

SEQ ID NO: 1876617 - RNA, 15 nt, Homo sapiens
gucacuccacgcagc

SEQ ID NO: 1876618 - RNA, 23 nt, Homo sapiens
cugacucaacauguuacugacca

SEQ ID NO: 1876619 - RNA, 23 nt, Homo sapiens
ugauacagugaagauacaggaca

SEQ ID NO: 1876620 - RNA, 18 nt, Homo sapiens
ucauauuaauauauuucc

SEQ ID NO: 1876621 - RNA, 19 nt, Homo sapiens
caggcgauucuccugccuc

SEQ ID NO: 1876622 - RNA, 12 nt, Homo sapiens
agaaaguacaag

SEQ ID NO: 1876623 - RNA, 13 nt, Homo sapiens
uggaagaccccac

SEQ ID NO: 1876624 - RNA, 15 nt, Homo sapiens
agggaagcucagggg

SEQ ID NO: 1876625 - RNA, 18 nt, Homo sapiens
gccucguguccagacuca

SEQ ID NO: 1876626 - RNA, 16 nt, Homo sapiens
ucauuucacacaguga

SEQ ID NO: 1876627 - RNA, 12 nt, Homo sapiens
accuccuuccag

SEQ ID NO: 1876628 - RNA, 23 nt, Homo sapiens
aaagcuaggaugguucugugacc

SEQ ID NO: 1876629 - RNA, 21 nt, Homo sapiens
gcagccuaacacggugcucau

SEQ ID NO: 1876630 - RNA, 14 nt, Homo sapiens
uuguaagacauuuc

SEQ ID NO: 1876631 - RNA, 12 nt, Homo sapiens
gaccuggcacug

SEQ ID NO: 1876632 - RNA, 20 nt, Homo sapiens
acagcagggucuugcuguaa

SEQ ID NO: 1876633 - RNA, 12 nt, Homo sapiens
gcuaugacugua

SEQ ID NO: 1876634 - RNA, 17 nt, Homo sapiens
accauugaccucagcug

SEQ ID NO: 1876635 - RNA, 14 nt, Homo sapiens
uaaguguggagcug

SEQ ID NO: 1876636 - RNA, 12 nt, Homo sapiens
ccaucugcugag

SEQ ID NO: 1876637 - RNA, 19 nt, Homo sapiens
ugugagaggcgugauaucu

SEQ ID NO: 1876638 - RNA, 22 nt, Homo sapiens
cuacugagcugagaccacugag

SEQ ID NO: 1876639 - RNA, 15 nt, Homo sapiens
uccauacuucucuca

SEQ ID NO: 1876640 - RNA, 13 nt, Homo sapiens
aacuaaggacaaa

SEQ ID NO: 1876641 - RNA, 13 nt, Homo sapiens
ucugagaugcuaa

SEQ ID NO: 1876642 - RNA, 16 nt, Homo sapiens
agggagggaaagacaa

SEQ ID NO: 1876643 - RNA, 17 nt, Homo sapiens
cucccuuggguucugau

SEQ ID NO: 1876644 - RNA, 13 nt, Homo sapiens
cugcgauggugcu

SEQ ID NO: 1876645 - RNA, 20 nt, Homo sapiens
gagccugggugguacccagg

SEQ ID NO: 1876646 - RNA, 17 nt, Homo sapiens
uugcagugucugcugga

SEQ ID NO: 1876647 - RNA, 22 nt, Homo sapiens
cuuggggaaaauggccaugcag

SEQ ID NO: 1876648 - RNA, 22 nt, Homo sapiens
agcguaguguuuugaccuuucu

SEQ ID NO: 1876649 - RNA, 13 nt, Homo sapiens
aauagacauguag

SEQ ID NO: 1876650 - RNA, 13 nt, Homo sapiens
aggaaacauagaa

SEQ ID NO: 1876651 - RNA, 13 nt, Homo sapiens
ugcaaacaaacaa

SEQ ID NO: 1876652 - RNA, 15 nt, Homo sapiens
agccucgccuuccau

SEQ ID NO: 1876653 - RNA, 12 nt, Homo sapiens
cuagaagucaaa

SEQ ID NO: 1876654 - RNA, 15 nt, Homo sapiens
aguguuggcuuucau

SEQ ID NO: 1876655 - RNA, 20 nt, Homo sapiens
agccgauggaaaauaccuaa

SEQ ID NO: 1876656 - RNA, 19 nt, Homo sapiens
ugcaaccuaguacuuuauu

SEQ ID NO: 1876657 - RNA, 17 nt, Homo sapiens
auucuguugcuuuacag

SEQ ID NO: 1876658 - RNA, 20 nt, Homo sapiens
uaaaaguucuuuuugcucua

SEQ ID NO: 1876659 - RNA, 16 nt, Homo sapiens
cuccuucccaaaaagc

SEQ ID NO: 1876660 - RNA, 20 nt, Homo sapiens
uggagacuggaacacaacca

SEQ ID NO: 1876661 - RNA, 15 nt, Homo sapiens
aaucaaugcuauaac

SEQ ID NO: 1876662 - RNA, 15 nt, Homo sapiens
cauaaaacaaugaag

SEQ ID NO: 1876663 - RNA, 18 nt, Homo sapiens
ucuaugggacucaaugca

SEQ ID NO: 1876664 - RNA, 14 nt, Homo sapiens
gcccacacauggga

SEQ ID NO: 1876665 - RNA, 22 nt, Homo sapiens
augguaauaaaacaaguuauuc

SEQ ID NO: 1876666 - RNA, 21 nt, Homo sapiens
uuucagaucauauuucacaau

SEQ ID NO: 1876667 - RNA, 21 nt, Homo sapiens
uuccagcauuuuuauaaacua

SEQ ID NO: 1876668 - RNA, 21 nt, Homo sapiens
ccuacuuuuggccucaucucu

SEQ ID NO: 1876669 - RNA, 15 nt, Homo sapiens
cacacaaggugcaaa

SEQ ID NO: 1876670 - RNA, 17 nt, Homo sapiens
ugcauacucugugcaag

SEQ ID NO: 1876671 - RNA, 13 nt, Homo sapiens
acgcugccuuaau

SEQ ID NO: 1876672 - RNA, 21 nt, Homo sapiens
aagauagguucugcuuucuga

SEQ ID NO: 1876673 - RNA, 16 nt, Homo sapiens
gccuaucagcauuuua

SEQ ID NO: 1876674 - RNA, 18 nt, Homo sapiens
uguucuuccucuuaccug

SEQ ID NO: 1876675 - RNA, 23 nt, Homo sapiens
gcaauuauagaguaucacuccca

SEQ ID NO: 1876676 - RNA, 22 nt, Homo sapiens
uccucaugcuuagaaaguucca

SEQ ID NO: 1876677 - RNA, 12 nt, Homo sapiens
gcuaauaccugu

SEQ ID NO: 1876678 - RNA, 21 nt, Homo sapiens
uacauguuuauaaaucuuaug

SEQ ID NO: 1876679 - RNA, 16 nt, Homo sapiens
agcugaaguugcugag

SEQ ID NO: 1876680 - RNA, 17 nt, Homo sapiens
caagaagcacagguccu

SEQ ID NO: 1876681 - RNA, 16 nt, Homo sapiens
uguauuuucacuggag

SEQ ID NO: 1876682 - RNA, 18 nt, Homo sapiens
aucuacaugaaugcaaaa

SEQ ID NO: 1876683 - RNA, 15 nt, Homo sapiens
uacccaucaaauuga

SEQ ID NO: 1876684 - RNA, 19 nt, Homo sapiens
aaagaggaggagaguugaa

SEQ ID NO: 1876685 - RNA, 16 nt, Homo sapiens
cuaguacuuauuacau

SEQ ID NO: 1876686 - RNA, 17 nt, Homo sapiens
gaccuggccuuucacuu

SEQ ID NO: 1876687 - RNA, 18 nt, Homo sapiens
caucaggccgcauccuga

SEQ ID NO: 1876688 - RNA, 18 nt, Homo sapiens
uucagcauuguacuugaa

SEQ ID NO: 1876689 - RNA, 21 nt, Homo sapiens
cuaaagaguuauucaaaugaa

SEQ ID NO: 1876690 - RNA, 21 nt, Homo sapiens
cugcggcaguauguacuucag

SEQ ID NO: 1876691 - RNA, 20 nt, Homo sapiens
accugaaggaauaaaaugau

SEQ ID NO: 1876692 - RNA, 18 nt, Homo sapiens
ccacuaaaugaucugauu

SEQ ID NO: 1876693 - RNA, 22 nt, Homo sapiens
uaccccugcuaaggaguucuca

SEQ ID NO: 1876694 - RNA, 19 nt, Homo sapiens
uugagggauugucacggga

SEQ ID NO: 1876695 - RNA, 23 nt, Homo sapiens
aguucaguagcuuaucucaguua

SEQ ID NO: 1876696 - RNA, 13 nt, Homo sapiens
ucuauauaccaaa

SEQ ID NO: 1876697 - RNA, 14 nt, Homo sapiens
uggacgugcacuga

SEQ ID NO: 1876698 - RNA, 17 nt, Homo sapiens
auggcacaugucauugc

SEQ ID NO: 1876699 - RNA, 21 nt, Homo sapiens
cuuuccagauaagcagaguug

SEQ ID NO: 1876700 - RNA, 17 nt, Homo sapiens
ucuagcucuaguucaaa

SEQ ID NO: 1876701 - RNA, 21 nt, Homo sapiens
aauccucucuaucacaucccc

SEQ ID NO: 1876702 - RNA, 20 nt, Homo sapiens
aguuuuaucuuaacacugaa

SEQ ID NO: 1876703 - RNA, 19 nt, Homo sapiens
gcaccagagcaaccucuca

SEQ ID NO: 1876704 - RNA, 19 nt, Homo sapiens
auaacgcagucuaauuaca

SEQ ID NO: 1876705 - RNA, 14 nt, Homo sapiens
cuucagugacaagu

SEQ ID NO: 1876706 - RNA, 18 nt, Homo sapiens
ucagccuagugaacugca

SEQ ID NO: 1876707 - RNA, 14 nt, Homo sapiens
aucaguagauuucu

SEQ ID NO: 1876708 - RNA, 13 nt, Homo sapiens
ugggcacugggau

SEQ ID NO: 1876709 - RNA, 21 nt, Homo sapiens
gugcuugcuuuucaugcaaac

SEQ ID NO: 1876710 - RNA, 12 nt, Homo sapiens
cugccgcugcuu

SEQ ID NO: 1876711 - RNA, 16 nt, Homo sapiens
cagaacuuucuuucac

SEQ ID NO: 1876712 - RNA, 16 nt, Homo sapiens
ugaccaucgcaaccag

SEQ ID NO: 1876713 - RNA, 21 nt, Homo sapiens
uucccuacauuaaacaugacu

SEQ ID NO: 1876714 - RNA, 17 nt, Homo sapiens
agggaucagacgaaagu

SEQ ID NO: 1876715 - RNA, 12 nt, Homo sapiens
gaggcacuucca

SEQ ID NO: 1876716 - RNA, 21 nt, Homo sapiens
guauucucuaaaagcuuuaaa

SEQ ID NO: 1876717 - RNA, 12 nt, Homo sapiens
cggccugcagug

SEQ ID NO: 1876718 - RNA, 20 nt, Homo sapiens
uucuguuuggcacuuguauu

SEQ ID NO: 1876719 - RNA, 13 nt, Homo sapiens
agggcuccuccau

SEQ ID NO: 1876720 - RNA, 15 nt, Homo sapiens
uucccucuugcucag

SEQ ID NO: 1876721 - RNA, 15 nt, Homo sapiens
auucuuguaguuuac

SEQ ID NO: 1876722 - RNA, 12 nt, Homo sapiens
aggcucugggaa

SEQ ID NO: 1876723 - RNA, 13 nt, Homo sapiens
uccagacuuugaa

SEQ ID NO: 1876724 - RNA, 17 nt, Homo sapiens
agcuccagcgauggugc

SEQ ID NO: 1876725 - RNA, 11 nt, Homo sapiens
uggcagccacc

SEQ ID NO: 1876726 - RNA, 17 nt, Homo sapiens
gacucaaaaauagggaa

SEQ ID NO: 1876727 - RNA, 17 nt, Homo sapiens
ccugcacggggcauucc

SEQ ID NO: 1876728 - RNA, 12 nt, Homo sapiens
gucuuccauaau

SEQ ID NO: 1876729 - RNA, 12 nt, Homo sapiens
uucuuccagaau

SEQ ID NO: 1876730 - RNA, 23 nt, Homo sapiens
ucaaauauuucugauacugcuga

SEQ ID NO: 1876731 - RNA, 13 nt, Homo sapiens
cgcccuccacaaa

SEQ ID NO: 1876732 - RNA, 17 nt, Homo sapiens
agcaccacgugccaagg

SEQ ID NO: 1876733 - RNA, 22 nt, Homo sapiens
cugacaauuugugauaucuaau

SEQ ID NO: 1876734 - RNA, 18 nt, Homo sapiens
accacccagaguggccca

SEQ ID NO: 1876735 - RNA, 17 nt, Homo sapiens
cugcaauaauaucaaaa

SEQ ID NO: 1876736 - RNA, 15 nt, Homo sapiens
aaacucgaauaaagg

SEQ ID NO: 1876737 - RNA, 18 nt, Homo sapiens
ugcaaucucuugucucac

SEQ ID NO: 1876738 - RNA, 20 nt, Homo sapiens
uuauugugacuucacuguau

SEQ ID NO: 1876739 - RNA, 15 nt, Homo sapiens
guacuucucacccag

SEQ ID NO: 1876740 - RNA, 14 nt, Homo sapiens
uccccuuuguccug

SEQ ID NO: 1876741 - RNA, 23 nt, Homo sapiens
uguuugucauagggcaguuggaa

SEQ ID NO: 1876742 - RNA, 17 nt, Homo sapiens
acaggaggccagugggc

SEQ ID NO: 1876743 - RNA, 15 nt, Homo sapiens
uauauccucuggaaa

SEQ ID NO: 1876744 - RNA, 17 nt, Homo sapiens
caggccucacacacaau

SEQ ID NO: 1876745 - RNA, 21 nt, Homo sapiens
ugaacacacauggaugcacac

SEQ ID NO: 1876746 - RNA, 15 nt, Homo sapiens
guugucagcacugua

SEQ ID NO: 1876747 - RNA, 22 nt, Homo sapiens
cagagaagcggauuuccaggga

SEQ ID NO: 1876748 - RNA, 12 nt, Homo sapiens
uauuaagggaaa

SEQ ID NO: 1876749 - RNA, 22 nt, Homo sapiens
ccuacaucaaaugcucaagccc

SEQ ID NO: 1876750 - RNA, 14 nt, Homo sapiens
ugguucaggguugg

SEQ ID NO: 1876751 - RNA, 13 nt, Homo sapiens
aguggccaggugc

SEQ ID NO: 1876752 - RNA, 16 nt, Homo sapiens
guuuguaguugaauau

SEQ ID NO: 1876753 - RNA, 18 nt, Homo sapiens
gcuggugggucugagcug

SEQ ID NO: 1876754 - RNA, 15 nt, Homo sapiens
aaguggacucucuga

SEQ ID NO: 1876755 - RNA, 22 nt, Homo sapiens
aaacagggcugccuucuggccu

SEQ ID NO: 1876756 - RNA, 17 nt, Homo sapiens
gugugcggagcugauaa

SEQ ID NO: 1876757 - RNA, 12 nt, Homo sapiens
ccaaagaucuca

SEQ ID NO: 1876758 - RNA, 19 nt, Homo sapiens
gguggcacucaacucugag

SEQ ID NO: 1876759 - RNA, 16 nt, Homo sapiens
agcauuuagcacauac

SEQ ID NO: 1876760 - RNA, 15 nt, Homo sapiens
cagcccaggcacaac

SEQ ID NO: 1876761 - RNA, 15 nt, Homo sapiens
ccuuucagagauaua

SEQ ID NO: 1876762 - RNA, 17 nt, Homo sapiens
aggccaacagcaagugu

SEQ ID NO: 1876763 - RNA, 16 nt, Homo sapiens
uggccucuucaggccu

SEQ ID NO: 1876764 - RNA, 15 nt, Homo sapiens
aaagguaaucagcuc

SEQ ID NO: 1876765 - RNA, 19 nt, Homo sapiens
ugagcagugccagcuuucu

SEQ ID NO: 1876766 - RNA, 23 nt, Homo sapiens
agcagcugguggaagaccuggac

SEQ ID NO: 1876767 - RNA, 13 nt, Homo sapiens
uauuaacaucauc

SEQ ID NO: 1876768 - RNA, 15 nt, Homo sapiens
ccauagcuacaucag

SEQ ID NO: 1876769 - RNA, 17 nt, Homo sapiens
gaaacaccaguaccuga

SEQ ID NO: 1876770 - RNA, 18 nt, Homo sapiens
guguugaggaggggagca

SEQ ID NO: 1876771 - RNA, 16 nt, Homo sapiens
uuaauggaaaccaagc

SEQ ID NO: 1876772 - RNA, 19 nt, Homo sapiens
gagauaccccaccucccuc

SEQ ID NO: 1876773 - RNA, 12 nt, Homo sapiens
ccaaacacuggg

SEQ ID NO: 1876774 - RNA, 19 nt, Homo sapiens
gcugcuuagacauaacaaa

SEQ ID NO: 1876775 - RNA, 20 nt, Homo sapiens
gcucuguucccaguaguuau

SEQ ID NO: 1876776 - RNA, 15 nt, Homo sapiens
uaucuaguucauuga

SEQ ID NO: 1876777 - RNA, 23 nt, Homo sapiens
ucacaggugggaucggcacucag

SEQ ID NO: 1876778 - RNA, 19 nt, Homo sapiens
agggccggcggcucugagc

SEQ ID NO: 1876779 - RNA, 13 nt, Homo sapiens
ugaagcacaucaa

SEQ ID NO: 1876780 - RNA, 14 nt, Homo sapiens
guuagcaguucugg

SEQ ID NO: 1876781 - RNA, 18 nt, Homo sapiens
acucuugauaacaccaag

SEQ ID NO: 1876782 - RNA, 21 nt, Homo sapiens
caggcccugaucuagugcagu

SEQ ID NO: 1876783 - RNA, 15 nt, Homo sapiens
auauauacuaaacaa

SEQ ID NO: 1876784 - RNA, 21 nt, Homo sapiens
ccuaguauuccuaaccuguca

SEQ ID NO: 1876785 - RNA, 19 nt, Homo sapiens
gagacagcugauacuucau

SEQ ID NO: 1876786 - RNA, 18 nt, Homo sapiens
aggggcagggagagcgcc

SEQ ID NO: 1876787 - RNA, 18 nt, Homo sapiens
ugcagggccucugucaau

SEQ ID NO: 1876788 - RNA, 18 nt, Homo sapiens
uuaagaccuggcagcucu

SEQ ID NO: 1876789 - RNA, 23 nt, Homo sapiens
augaauucuuccucuccuuccca

SEQ ID NO: 1876790 - RNA, 19 nt, Homo sapiens
ucaguaacccccacuggac

SEQ ID NO: 1876791 - RNA, 20 nt, Homo sapiens
gacacgugauggaccaaagc

SEQ ID NO: 1876792 - RNA, 12 nt, Homo sapiens
ggaugcaugugc

SEQ ID NO: 1876793 - RNA, 15 nt, Homo sapiens
aacaugcaccuugcu

SEQ ID NO: 1876794 - RNA, 18 nt, Homo sapiens
cauuucaaauaacugcag

SEQ ID NO: 1876795 - RNA, 13 nt, Homo sapiens
gagacacagggca

SEQ ID NO: 1876796 - RNA, 16 nt, Homo sapiens
cagauggaacacugga

SEQ ID NO: 1876797 - RNA, 12 nt, Homo sapiens
ugcuuacaggac

SEQ ID NO: 1876798 - RNA, 18 nt, Homo sapiens
aucuucauguggacauug

SEQ ID NO: 1876799 - RNA, 13 nt, Homo sapiens
uugggacucagga

SEQ ID NO: 1876800 - RNA, 14 nt, Homo sapiens
ccaccccacuggcu

SEQ ID NO: 1876801 - RNA, 21 nt, Homo sapiens
caggggagggguuaaugcaga

SEQ ID NO: 1876802 - RNA, 20 nt, Homo sapiens
aacugggaccugcaggccaa

SEQ ID NO: 1876803 - RNA, 20 nt, Homo sapiens
agccuacauugaugccaagc

SEQ ID NO: 1876804 - RNA, 20 nt, Homo sapiens
caggaacacuggagccugca

SEQ ID NO: 1876805 - RNA, 16 nt, Homo sapiens
cacugagccauccuca

SEQ ID NO: 1876806 - RNA, 22 nt, Homo sapiens
uuaaggaacaagaauugcuaaa

SEQ ID NO: 1876807 - RNA, 16 nt, Homo sapiens
cauuagucaauaacua

SEQ ID NO: 1876808 - RNA, 16 nt, Homo sapiens
cucaggcaaucugccc

SEQ ID NO: 1876809 - RNA, 14 nt, Homo sapiens
uacagaacauaucc

SEQ ID NO: 1876810 - RNA, 17 nt, Homo sapiens
uguuccagugucuauaa

SEQ ID NO: 1876811 - RNA, 19 nt, Homo sapiens
guauaagugguguguguau

SEQ ID NO: 1876812 - RNA, 21 nt, Homo sapiens
ccacugaauucacuccaguca

SEQ ID NO: 1876813 - RNA, 19 nt, Homo sapiens
ucuucccuuuuaaacacau

SEQ ID NO: 1876814 - RNA, 18 nt, Homo sapiens
cucuccucucugaccugg

SEQ ID NO: 1876815 - RNA, 22 nt, Homo sapiens
agcucaaucugcaaacaugcca

SEQ ID NO: 1876816 - RNA, 17 nt, Homo sapiens
aagcugauuaccugaag

SEQ ID NO: 1876817 - RNA, 16 nt, Homo sapiens
ugaauuaaauauugaa

SEQ ID NO: 1876818 - RNA, 22 nt, Homo sapiens
aaaaugagguucaacuguugau

SEQ ID NO: 1876819 - RNA, 21 nt, Homo sapiens
auaccccuuacuuagcaugca

SEQ ID NO: 1876820 - RNA, 18 nt, Homo sapiens
uuccucgccugacaacca

SEQ ID NO: 1876821 - RNA, 16 nt, Homo sapiens
agagauguuuggaaac

SEQ ID NO: 1876822 - RNA, 19 nt, Homo sapiens
augugucuuguauuaucau

SEQ ID NO: 1876823 - RNA, 20 nt, Homo sapiens
ucaaugcaagagugauugca

SEQ ID NO: 1876824 - RNA, 13 nt, Homo sapiens
acuauaccuuauc

SEQ ID NO: 1876825 - RNA, 20 nt, Homo sapiens
uugagaccuaaucucuguaa

SEQ ID NO: 1876826 - RNA, 20 nt, Homo sapiens
ccucaguuuccucaucugca

SEQ ID NO: 1876827 - RNA, 15 nt, Homo sapiens
cuggagcaugagcca

SEQ ID NO: 1876828 - RNA, 18 nt, Homo sapiens
cucugcaguaaaacacau

SEQ ID NO: 1876829 - RNA, 23 nt, Homo sapiens
cuccuguugccacacuuucacug

SEQ ID NO: 1876830 - RNA, 15 nt, Homo sapiens
ugcgacaggcauuua

SEQ ID NO: 1876831 - RNA, 22 nt, Homo sapiens
ccgucgucucuucugggcaccc

SEQ ID NO: 1876832 - RNA, 18 nt, Homo sapiens
uuucccaggaauauccca

SEQ ID NO: 1876833 - RNA, 17 nt, Homo sapiens
ucaagaaauagcgcagu

SEQ ID NO: 1876834 - RNA, 13 nt, Homo sapiens
gugcuuacaggac

SEQ ID NO: 1876835 - RNA, 10 nt, Homo sapiens
cugugacacu

SEQ ID NO: 1876836 - RNA, 22 nt, Homo sapiens
cucucgguugaaaccuguauaa

SEQ ID NO: 1876837 - RNA, 22 nt, Homo sapiens
ugucuuuauuaacaaacaggau

SEQ ID NO: 1876838 - RNA, 12 nt, Homo sapiens
auagcagggaua

SEQ ID NO: 1876839 - RNA, 15 nt, Homo sapiens
agaggauuugcucug

SEQ ID NO: 1876840 - RNA, 21 nt, Homo sapiens
uuuggcagagcuucuuccagg

SEQ ID NO: 1876841 - RNA, 17 nt, Homo sapiens
aaugacuacuacacacu

SEQ ID NO: 1876842 - RNA, 22 nt, Homo sapiens
aguccacuuuuaaaacuauauu

SEQ ID NO: 1876843 - RNA, 15 nt, Homo sapiens
ccgggcuggcccaag

SEQ ID NO: 1876844 - RNA, 22 nt, Homo sapiens
acuuuauagaucagccagugac

SEQ ID NO: 1876845 - RNA, 17 nt, Homo sapiens
ucuaccccugcuaagga

SEQ ID NO: 1876846 - RNA, 17 nt, Homo sapiens
cagugaucucgacuccc

SEQ ID NO: 1876847 - RNA, 13 nt, Homo sapiens
ucaaagacauucu

SEQ ID NO: 1876848 - RNA, 17 nt, Homo sapiens
aagcuggagugcagugg

SEQ ID NO: 1876849 - RNA, 19 nt, Homo sapiens
cugccuuuuuacuauacag

SEQ ID NO: 1876850 - RNA, 19 nt, Homo sapiens
ugaccagccacucaaagga

SEQ ID NO: 1876851 - RNA, 12 nt, Homo sapiens
uuccuucaaugu

SEQ ID NO: 1876852 - RNA, 17 nt, Homo sapiens
gcacugcccaaagugcu

SEQ ID NO: 1876853 - RNA, 18 nt, Homo sapiens
aauuuuuaagcuacuuau

SEQ ID NO: 1876854 - RNA, 15 nt, Homo sapiens
aaaccucuguucuca

SEQ ID NO: 1876855 - RNA, 14 nt, Homo sapiens
gggcaucauucucu

SEQ ID NO: 1876856 - RNA, 12 nt, Homo sapiens
cuauacaucucu

SEQ ID NO: 1876857 - RNA, 22 nt, Homo sapiens
agguuuuaucaguagaaguguc

SEQ ID NO: 1876858 - RNA, 17 nt, Homo sapiens
agggggaauuccuggaa

SEQ ID NO: 1876859 - RNA, 22 nt, Homo sapiens
auucuauccccaaucagcuccu

SEQ ID NO: 1876860 - RNA, 14 nt, Homo sapiens
agaccaaggcacug

SEQ ID NO: 1876861 - RNA, 14 nt, Homo sapiens
uuuagagcauuaaa

SEQ ID NO: 1876862 - RNA, 21 nt, Homo sapiens
agagaaaaacuuucauuuuug

SEQ ID NO: 1876863 - RNA, 11 nt, Homo sapiens
auucauucucu

SEQ ID NO: 1876864 - RNA, 15 nt, Homo sapiens
uggaugcaugagcua

SEQ ID NO: 1876865 - RNA, 19 nt, Homo sapiens
gaauggggggcgggccagg

SEQ ID NO: 1876866 - RNA, 22 nt, Homo sapiens
aacuucccuccauccaccccuc

SEQ ID NO: 1876867 - RNA, 22 nt, Homo sapiens
acauucuacaaaauaucccugg

SEQ ID NO: 1876868 - RNA, 17 nt, Homo sapiens
auauguaaaaagucaua

SEQ ID NO: 1876869 - RNA, 16 nt, Homo sapiens
gccaagauuguccuuu

SEQ ID NO: 1876870 - RNA, 17 nt, Homo sapiens
ugguaugucucuuuaag

SEQ ID NO: 1876871 - RNA, 23 nt, Homo sapiens
cugaacucaccauagagacccau

SEQ ID NO: 1876872 - RNA, 16 nt, Homo sapiens
acacuuggaugcaggg

SEQ ID NO: 1876873 - RNA, 12 nt, Homo sapiens
cugcuccaugag

SEQ ID NO: 1876874 - RNA, 17 nt, Homo sapiens
aggaaaggcacauguca

SEQ ID NO: 1876875 - RNA, 17 nt, Homo sapiens
caaaauauuuuuugcaa

SEQ ID NO: 1876876 - RNA, 20 nt, Homo sapiens
aaacagcucagccagugggg

SEQ ID NO: 1876877 - RNA, 17 nt, Homo sapiens
ggcuugcuguggcuaug

SEQ ID NO: 1876878 - RNA, 23 nt, Homo sapiens
aguguauuuauuuuacagcucau

SEQ ID NO: 1876879 - RNA, 23 nt, Homo sapiens
gcacagcccugggagggggcuau

SEQ ID NO: 1876880 - RNA, 20 nt, Homo sapiens
cagaaagugauaagugcagg

SEQ ID NO: 1876881 - RNA, 18 nt, Homo sapiens
auagucaauuucuacuuc

SEQ ID NO: 1876882 - RNA, 15 nt, Homo sapiens
agugucuuuugacau

SEQ ID NO: 1876883 - RNA, 14 nt, Homo sapiens
gacacacacuggcu

SEQ ID NO: 1876884 - RNA, 14 nt, Homo sapiens
uauagcucuaaugu

SEQ ID NO: 1876885 - RNA, 22 nt, Homo sapiens
acaugcuggauaaaaugucagu

SEQ ID NO: 1876886 - RNA, 18 nt, Homo sapiens
auuuaugcugacaugcca

SEQ ID NO: 1876887 - RNA, 18 nt, Homo sapiens
agauugcuucaugagcua

SEQ ID NO: 1876888 - RNA, 13 nt, Homo sapiens
cuguggccuucag

SEQ ID NO: 1876889 - RNA, 15 nt, Homo sapiens
cacggaugcacagag

SEQ ID NO: 1876890 - RNA, 22 nt, Homo sapiens
aauuuggaucuggaucuguuaa

SEQ ID NO: 1876891 - RNA, 19 nt, Homo sapiens
aacaaccuggucacaggac

SEQ ID NO: 1876892 - RNA, 15 nt, Homo sapiens
ucuucccccuuccac

SEQ ID NO: 1876893 - RNA, 12 nt, Homo sapiens
ugcagacuguuc

SEQ ID NO: 1876894 - RNA, 18 nt, Homo sapiens
gaggcuccggauguuucu

SEQ ID NO: 1876895 - RNA, 24 nt, Homo sapiens
ggcccuuagggaaguugucuccuu

SEQ ID NO: 1876896 - RNA, 18 nt, Homo sapiens
uacaacacuuuaaguaaa

SEQ ID NO: 1876897 - RNA, 20 nt, Homo sapiens
uccugaggaguguccugucu

SEQ ID NO: 1876898 - RNA, 18 nt, Homo sapiens
gagcuuguaauugcacca

SEQ ID NO: 1876899 - RNA, 16 nt, Homo sapiens
aaggcaaauauaagcu

SEQ ID NO: 1876900 - RNA, 22 nt, Homo sapiens
cuauauuuuacaaagcauguga

SEQ ID NO: 1876901 - RNA, 21 nt, Homo sapiens
cagaucuuucuccuugaauau

SEQ ID NO: 1876902 - RNA, 20 nt, Homo sapiens
aauuuucugaaacugcauaa

SEQ ID NO: 1876903 - RNA, 17 nt, Homo sapiens
cucugugucugcucuca

SEQ ID NO: 1876904 - RNA, 13 nt, Homo sapiens
ccaccucuaccaa

SEQ ID NO: 1876905 - RNA, 16 nt, Homo sapiens
acucuaacaucuagcu

SEQ ID NO: 1876906 - RNA, 17 nt, Homo sapiens
aacuuaagagaggggcc

SEQ ID NO: 1876907 - RNA, 13 nt, Homo sapiens
cuuucuguucucc

SEQ ID NO: 1876908 - RNA, 21 nt, Homo sapiens
gcuuuuaugauauauauaugc

SEQ ID NO: 1876909 - RNA, 18 nt, Homo sapiens
acucaaaaugaugcaacc

SEQ ID NO: 1876910 - RNA, 17 nt, Homo sapiens
gcucccacauaagcacu

SEQ ID NO: 1876911 - RNA, 18 nt, Homo sapiens
gcucagauacacaaguga

SEQ ID NO: 1876912 - RNA, 20 nt, Homo sapiens
auugaaaacagugucuugag

SEQ ID NO: 1876913 - RNA, 23 nt, Homo sapiens
gaccgaccccuccccagugccuc

SEQ ID NO: 1876914 - RNA, 22 nt, Homo sapiens
gcaaugaggcagauagcacugg

SEQ ID NO: 1876915 - RNA, 18 nt, Homo sapiens
cuauuucuucuacugcua

SEQ ID NO: 1876916 - RNA, 20 nt, Homo sapiens
guauauugauguaacugugu

SEQ ID NO: 1876917 - RNA, 13 nt, Homo sapiens
uuguuuuggacua

SEQ ID NO: 1876918 - RNA, 22 nt, Homo sapiens
uuuaaaaucauucccuuuccca

SEQ ID NO: 1876919 - RNA, 23 nt, Homo sapiens
cuuguuuguguuugaauugauuu

SEQ ID NO: 1876920 - RNA, 17 nt, Homo sapiens
uacaacagugcauuuac

SEQ ID NO: 1876921 - RNA, 20 nt, Homo sapiens
ccugucugaaggacacuucc

SEQ ID NO: 1876922 - RNA, 23 nt, Homo sapiens
cauggcagaguuuguguguuguc

SEQ ID NO: 1876923 - RNA, 22 nt, Homo sapiens
aaucugcauuucuuaccagugu

SEQ ID NO: 1876924 - RNA, 17 nt, Homo sapiens
gacaacucagaggccag

SEQ ID NO: 1876925 - RNA, 14 nt, Homo sapiens
cccuagucuauuca

SEQ ID NO: 1876926 - RNA, 14 nt, Homo sapiens
aacaauauugcucc

SEQ ID NO: 1876927 - RNA, 13 nt, Homo sapiens
aauaaaauacuuc

SEQ ID NO: 1876928 - RNA, 21 nt, Homo sapiens
ugucugugugcugagccaguu

SEQ ID NO: 1876929 - RNA, 17 nt, Homo sapiens
agggccaggcuuacuga

SEQ ID NO: 1876930 - RNA, 17 nt, Homo sapiens
accucauuuuaguugcc

SEQ ID NO: 1876931 - RNA, 22 nt, Homo sapiens
aguauucugaucaguugccaaa

SEQ ID NO: 1876932 - RNA, 22 nt, Homo sapiens
gcucguguuugcuacaaauagu

SEQ ID NO: 1876933 - RNA, 19 nt, Homo sapiens
uacuuguggugugaccaug

SEQ ID NO: 1876934 - RNA, 17 nt, Homo sapiens
caacucacuuuuuuaca

SEQ ID NO: 1876935 - RNA, 20 nt, Homo sapiens
cugaaagaccuaugagcaaa

SEQ ID NO: 1876936 - RNA, 18 nt, Homo sapiens
uaaagugccuuacagggu

SEQ ID NO: 1876937 - RNA, 13 nt, Homo sapiens
aauaaaacauuca

SEQ ID NO: 1876938 - RNA, 17 nt, Homo sapiens
cagauccuuugucuaca

SEQ ID NO: 1876939 - RNA, 12 nt, Homo sapiens
gaagagcauuug

SEQ ID NO: 1876940 - RNA, 18 nt, Homo sapiens
aagcccuugagaagccaa

SEQ ID NO: 1876941 - RNA, 16 nt, Homo sapiens
ucacggcucacugcag

SEQ ID NO: 1876942 - RNA, 19 nt, Homo sapiens
ggggugggaguuuugcucu

SEQ ID NO: 1876943 - RNA, 12 nt, Homo sapiens
ugacacacagca

SEQ ID NO: 1876944 - RNA, 12 nt, Homo sapiens
agccacacugaa

SEQ ID NO: 1876945 - RNA, 23 nt, Homo sapiens
gcagggccaagugcccaugagca

SEQ ID NO: 1876946 - RNA, 15 nt, Homo sapiens
ugaauccuuugccug

SEQ ID NO: 1876947 - RNA, 16 nt, Homo sapiens
cuggagccucagaaau

SEQ ID NO: 1876948 - RNA, 15 nt, Homo sapiens
ggugcagcugucaca

SEQ ID NO: 1876949 - RNA, 21 nt, Homo sapiens
cucacucugcuuugcaucccc

SEQ ID NO: 1876950 - RNA, 13 nt, Homo sapiens
ucuauacuguaaa

SEQ ID NO: 1876951 - RNA, 20 nt, Homo sapiens
ucucuagcugaucagaauuu

SEQ ID NO: 1876952 - RNA, 16 nt, Homo sapiens
agcaaugugcacuuca

SEQ ID NO: 1876953 - RNA, 15 nt, Homo sapiens
ugcaauaccaauguu

SEQ ID NO: 1876954 - RNA, 22 nt, Homo sapiens
guaaguggcuuuuuguacugua

SEQ ID NO: 1876955 - RNA, 18 nt, Homo sapiens
ccauuuuggugucuuucu

SEQ ID NO: 1876956 - RNA, 21 nt, Homo sapiens
guuugguaguuagccaucuaa

SEQ ID NO: 1876957 - RNA, 14 nt, Homo sapiens
gcaaacccuuucau

SEQ ID NO: 1876958 - RNA, 17 nt, Homo sapiens
uggcaacagagcaagac

SEQ ID NO: 1876959 - RNA, 22 nt, Homo sapiens
ugcauaagugaaaaucuuacaa

SEQ ID NO: 1876960 - RNA, 18 nt, Homo sapiens
agaaggugguuacuugga

SEQ ID NO: 1876961 - RNA, 19 nt, Homo sapiens
cagcggcuucaagagccag

SEQ ID NO: 1876962 - RNA, 23 nt, Homo sapiens
ugggggaaaguguugaccacaga

SEQ ID NO: 1876963 - RNA, 13 nt, Homo sapiens
gcugacucuccag

SEQ ID NO: 1876964 - RNA, 14 nt, Homo sapiens
aguuuaucauguca

SEQ ID NO: 1876965 - RNA, 16 nt, Homo sapiens
gcagguggcaucucua

SEQ ID NO: 1876966 - RNA, 19 nt, Homo sapiens
caaggcugcagugagccau

SEQ ID NO: 1876967 - RNA, 16 nt, Homo sapiens
ugcccucgugguggaa

SEQ ID NO: 1876968 - RNA, 12 nt, Homo sapiens
augucccaugac

SEQ ID NO: 1876969 - RNA, 12 nt, Homo sapiens
uugccccaagau

SEQ ID NO: 1876970 - RNA, 18 nt, Homo sapiens
cugcaaaggacagaucca

SEQ ID NO: 1876971 - RNA, 15 nt, Homo sapiens
ugcaagucagaggau

SEQ ID NO: 1876972 - RNA, 19 nt, Homo sapiens
cagaggguggcuggaguga

SEQ ID NO: 1876973 - RNA, 21 nt, Homo sapiens
uuuguuguuguuuuuccucaa

SEQ ID NO: 1876974 - RNA, 14 nt, Homo sapiens
agcccaugugcacc

SEQ ID NO: 1876975 - RNA, 17 nt, Homo sapiens
ugaaguacucaguaaua

SEQ ID NO: 1876976 - RNA, 16 nt, Homo sapiens
aggagggcccuaccug

SEQ ID NO: 1876977 - RNA, 14 nt, Homo sapiens
acccaguguagcau

SEQ ID NO: 1876978 - RNA, 14 nt, Homo sapiens
cccuguggcacuca

SEQ ID NO: 1876979 - RNA, 14 nt, Homo sapiens
aaugcuggacugga

SEQ ID NO: 1876980 - RNA, 23 nt, Homo sapiens
uuauagaguguacuuaacuauuc

SEQ ID NO: 1876981 - RNA, 9 nt, Homo sapiens
cccauuucu

SEQ ID NO: 1876982 - RNA, 15 nt, Homo sapiens
uggucgggaagggag

SEQ ID NO: 1876983 - RNA, 19 nt, Homo sapiens
gugcaaaaauaaaaggaaa

SEQ ID NO: 1876984 - RNA, 19 nt, Homo sapiens
ugcccugauccaaguuuac

SEQ ID NO: 1876985 - RNA, 16 nt, Homo sapiens
accuuggcaccagaca

SEQ ID NO: 1876986 - RNA, 20 nt, Homo sapiens
cccaacuaacagucaagaaa

SEQ ID NO: 1876987 - RNA, 20 nt, Homo sapiens
aaaucaccacaccaaaccuc

SEQ ID NO: 1876988 - RNA, 18 nt, Homo sapiens
caguaauagcaagucuua

SEQ ID NO: 1876989 - RNA, 16 nt, Homo sapiens
guguaagggccagaaa

SEQ ID NO: 1876990 - RNA, 23 nt, Homo sapiens
uuuaaagugguucuggauaucuu

SEQ ID NO: 1876991 - RNA, 12 nt, Homo sapiens
uaaaauugcuau

SEQ ID NO: 1876992 - RNA, 21 nt, Homo sapiens
aauccaugagauagcuauuau

SEQ ID NO: 1876993 - RNA, 18 nt, Homo sapiens
ucuccagaauaauucuua

SEQ ID NO: 1876994 - RNA, 21 nt, Homo sapiens
cccugucccaccaacucugca

SEQ ID NO: 1876995 - RNA, 16 nt, Homo sapiens
auggaggcgcugcugc

SEQ ID NO: 1876996 - RNA, 15 nt, Homo sapiens
agcccaaaacccagg

SEQ ID NO: 1876997 - RNA, 15 nt, Homo sapiens
agaagauagauccaa

SEQ ID NO: 1876998 - RNA, 21 nt, Homo sapiens
gagaaaguggaaaaugaccuc

SEQ ID NO: 1876999 - RNA, 20 nt, Homo sapiens
gggaacacagugccccagug

SEQ ID NO: 1877000 - RNA, 21 nt, Homo sapiens
uaaauucaagcugcuuuggac

SEQ ID NO: 1877001 - RNA, 17 nt, Homo sapiens
accugccacaaugugau

SEQ ID NO: 1877002 - RNA, 14 nt, Homo sapiens
aagagaaugccauu

SEQ ID NO: 1877003 - RNA, 22 nt, Homo sapiens
auucuuugaccucaaccuguga

SEQ ID NO: 1877004 - RNA, 13 nt, Homo sapiens
agacaauaaaccc

SEQ ID NO: 1877005 - RNA, 18 nt, Homo sapiens
gacacuuuugaggacaag

SEQ ID NO: 1877006 - RNA, 13 nt, Homo sapiens
aucaugugccaga

SEQ ID NO: 1877007 - RNA, 16 nt, Homo sapiens
auuucuucacgcaccu

SEQ ID NO: 1877008 - RNA, 22 nt, Homo sapiens
ggcacucgccgguuaagacagg

SEQ ID NO: 1877009 - RNA, 16 nt, Homo sapiens
ccccugcacuaggcag

SEQ ID NO: 1877010 - RNA, 13 nt, Homo sapiens
cagccucaagucu

SEQ ID NO: 1877011 - RNA, 14 nt, Homo sapiens
acucugguggcaca

SEQ ID NO: 1877012 - RNA, 19 nt, Homo sapiens
uaauaaaacugcacagugc

SEQ ID NO: 1877013 - RNA, 14 nt, Homo sapiens
uugugucaaaacug

SEQ ID NO: 1877014 - RNA, 23 nt, Homo sapiens
ucuucucaagcacugacacucau

SEQ ID NO: 1877015 - RNA, 18 nt, Homo sapiens
gugcucugucuacuugcu

SEQ ID NO: 1877016 - RNA, 20 nt, Homo sapiens
uacgguaccuggcaauguuu

SEQ ID NO: 1877017 - RNA, 13 nt, Homo sapiens
ucacaagaauuua

SEQ ID NO: 1877018 - RNA, 14 nt, Homo sapiens
ugauaaauuugacu

SEQ ID NO: 1877019 - RNA, 18 nt, Homo sapiens
uaccaacuauuucaauaa

SEQ ID NO: 1877020 - RNA, 20 nt, Homo sapiens
aauucuuuucacucauucac

SEQ ID NO: 1877021 - RNA, 21 nt, Homo sapiens
aaaggugguccuuccuaccuc

SEQ ID NO: 1877022 - RNA, 14 nt, Homo sapiens
ucauuaaugcacau

SEQ ID NO: 1877023 - RNA, 16 nt, Homo sapiens
ugcaguggagcuggca

SEQ ID NO: 1877024 - RNA, 23 nt, Homo sapiens
gauuauuuguuauuuguacaguu

SEQ ID NO: 1877025 - RNA, 15 nt, Homo sapiens
ucgaaacugccauug

SEQ ID NO: 1877026 - RNA, 19 nt, Homo sapiens
uuguuaccuuucccaugcu

SEQ ID NO: 1877027 - RNA, 22 nt, Homo sapiens
cccuugcccaaccaaugcacac

SEQ ID NO: 1877028 - RNA, 16 nt, Homo sapiens
cucuucccccaugugc

SEQ ID NO: 1877029 - RNA, 20 nt, Homo sapiens
aaguagcuuucuccagauca

SEQ ID NO: 1877030 - RNA, 18 nt, Homo sapiens
gugaucgucccaucccca

SEQ ID NO: 1877031 - RNA, 18 nt, Homo sapiens
caugugagucccugugau

SEQ ID NO: 1877032 - RNA, 16 nt, Homo sapiens
cucaggccugaacuca

SEQ ID NO: 1877033 - RNA, 21 nt, Homo sapiens
caacccucucaaguccaucaa

SEQ ID NO: 1877034 - RNA, 15 nt, Homo sapiens
auauauaagccaaaa

SEQ ID NO: 1877035 - RNA, 13 nt, Homo sapiens
ggggcucucucau

SEQ ID NO: 1877036 - RNA, 22 nt, Homo sapiens
guuucuaauaaagaaagcagcu

SEQ ID NO: 1877037 - RNA, 21 nt, Homo sapiens
cccagagggaguagaauacgc

SEQ ID NO: 1877038 - RNA, 15 nt, Homo sapiens
auaugcagugauaua

SEQ ID NO: 1877039 - RNA, 13 nt, Homo sapiens
ccccagcuaggaa

SEQ ID NO: 1877040 - RNA, 18 nt, Homo sapiens
aaaugcuggcaaauccag

SEQ ID NO: 1877041 - RNA, 15 nt, Homo sapiens
ugucuggugguggca

SEQ ID NO: 1877042 - RNA, 12 nt, Homo sapiens
uguccauaugaa

SEQ ID NO: 1877043 - RNA, 22 nt, Homo sapiens
agugaccugguuaaacaaacca

SEQ ID NO: 1877044 - RNA, 20 nt, Homo sapiens
aacucgagaagauucaauca

SEQ ID NO: 1877045 - RNA, 10 nt, Homo sapiens
aaauuucagg

SEQ ID NO: 1877046 - RNA, 17 nt, Homo sapiens
aguugcaguaguaucaa

SEQ ID NO: 1877047 - RNA, 16 nt, Homo sapiens
ucuuaauagcuauaca

SEQ ID NO: 1877048 - RNA, 15 nt, Homo sapiens
uuccccaacagggca

SEQ ID NO: 1877049 - RNA, 18 nt, Homo sapiens
aauauuuuauaccaaagc

SEQ ID NO: 1877050 - RNA, 21 nt, Homo sapiens
uccauaguggaccacuuggaa

SEQ ID NO: 1877051 - RNA, 20 nt, Homo sapiens
agacaggaugguuacucuug

SEQ ID NO: 1877052 - RNA, 14 nt, Homo sapiens
uauaacgucaugug

SEQ ID NO: 1877053 - RNA, 13 nt, Homo sapiens
auuuugauugauu

SEQ ID NO: 1877054 - RNA, 22 nt, Homo sapiens
cuauggacagcuuuucccaaga

SEQ ID NO: 1877055 - RNA, 17 nt, Homo sapiens
gcaaggacacagaugaa

SEQ ID NO: 1877056 - RNA, 16 nt, Homo sapiens
gugggcaguguccacg

SEQ ID NO: 1877057 - RNA, 18 nt, Homo sapiens
auuccagcacuucaggag

SEQ ID NO: 1877058 - RNA, 21 nt, Homo sapiens
ugaaagcaggaugaauuuucu

SEQ ID NO: 1877059 - RNA, 18 nt, Homo sapiens
uuauauaaggcauuccac

SEQ ID NO: 1877060 - RNA, 20 nt, Homo sapiens
uuauuaaugaacugugacag

SEQ ID NO: 1877061 - RNA, 9 nt, Homo sapiens
cacaaaaga

SEQ ID NO: 1877062 - RNA, 15 nt, Homo sapiens
ucagggcucuaccaa

SEQ ID NO: 1877063 - RNA, 17 nt, Homo sapiens
cuguaaugcacuccugc

SEQ ID NO: 1877064 - RNA, 18 nt, Homo sapiens
ugaaaguaaaagcagcau

SEQ ID NO: 1877065 - RNA, 15 nt, Homo sapiens
augggaggcagggac

SEQ ID NO: 1877066 - RNA, 21 nt, Homo sapiens
uucagcagguuccagugccug

SEQ ID NO: 1877067 - RNA, 15 nt, Homo sapiens
augauuuuggccuca

SEQ ID NO: 1877068 - RNA, 16 nt, Homo sapiens
accagugauccauguc

SEQ ID NO: 1877069 - RNA, 13 nt, Homo sapiens
ugguggagccagg

SEQ ID NO: 1877070 - RNA, 20 nt, Homo sapiens
uugaacccgggggacagagg

SEQ ID NO: 1877071 - RNA, 13 nt, Homo sapiens
auaagcugaauaa

SEQ ID NO: 1877072 - RNA, 17 nt, Homo sapiens
uuuacaagcaucaugga

SEQ ID NO: 1877073 - RNA, 19 nt, Homo sapiens
uaaaauggugauauccucu

SEQ ID NO: 1877074 - RNA, 19 nt, Homo sapiens
aaaccuggccuuauaucau

SEQ ID NO: 1877075 - RNA, 17 nt, Homo sapiens
acacagccaagccaguc

SEQ ID NO: 1877076 - RNA, 18 nt, Homo sapiens
cacaagccacagaagcca

SEQ ID NO: 1877077 - RNA, 14 nt, Homo sapiens
uccugaaugcaucc

SEQ ID NO: 1877078 - RNA, 17 nt, Homo sapiens
gaacuauauuaguaugu

SEQ ID NO: 1877079 - RNA, 15 nt, Homo sapiens
agaguuucaaaagca

SEQ ID NO: 1877080 - RNA, 16 nt, Homo sapiens
gagcuagcuaaucucu

SEQ ID NO: 1877081 - RNA, 13 nt, Homo sapiens
auuguuacuggua

SEQ ID NO: 1877082 - RNA, 23 nt, Homo sapiens
cuucuccacaaccuccuccucca

SEQ ID NO: 1877083 - RNA, 23 nt, Homo sapiens
ccauagagacccaugucagcaaa

SEQ ID NO: 1877084 - RNA, 15 nt, Homo sapiens
uguccuuuugcaaag

SEQ ID NO: 1877085 - RNA, 23 nt, Homo sapiens
cauaaauaaaagaaaaauaugca

SEQ ID NO: 1877086 - RNA, 12 nt, Homo sapiens
uuuaaaagucac

SEQ ID NO: 1877087 - RNA, 15 nt, Homo sapiens
cacgaucucaguuca

SEQ ID NO: 1877088 - RNA, 14 nt, Homo sapiens
auuguuagucucuu

SEQ ID NO: 1877089 - RNA, 15 nt, Homo sapiens
cuggaaaaggcauau

SEQ ID NO: 1877090 - RNA, 15 nt, Homo sapiens
uaagacuuacuugca

SEQ ID NO: 1877091 - RNA, 20 nt, Homo sapiens
ggcuuaacacuaucauggac

SEQ ID NO: 1877092 - RNA, 21 nt, Homo sapiens
ucuuuggaccacuccccucaa

SEQ ID NO: 1877093 - RNA, 18 nt, Homo sapiens
agaaaagugaaugcucaa

SEQ ID NO: 1877094 - RNA, 19 nt, Homo sapiens
aacuuccgcugaggggucu

SEQ ID NO: 1877095 - RNA, 19 nt, Homo sapiens
ucaugccaagacaguauca

SEQ ID NO: 1877096 - RNA, 20 nt, Homo sapiens
aagucuccagucaccuacaa

SEQ ID NO: 1877097 - RNA, 14 nt, Homo sapiens
ucaggcagugcagu

SEQ ID NO: 1877098 - RNA, 20 nt, Homo sapiens
acugcccuuucaaagcacuu

SEQ ID NO: 1877099 - RNA, 19 nt, Homo sapiens
caaaaagagcagcacagga

SEQ ID NO: 1877100 - RNA, 11 nt, Homo sapiens
caggacauaua

SEQ ID NO: 1877101 - RNA, 23 nt, Homo sapiens
aacuugaauuaauccacacauca

SEQ ID NO: 1877102 - RNA, 14 nt, Homo sapiens
agcaucucugacca

SEQ ID NO: 1877103 - RNA, 21 nt, Homo sapiens
ggacuuuucuaccagguauga

SEQ ID NO: 1877104 - RNA, 18 nt, Homo sapiens
accucagcaccuugcucu

SEQ ID NO: 1877105 - RNA, 17 nt, Homo sapiens
cauugcuucacuaccca

SEQ ID NO: 1877106 - RNA, 22 nt, Homo sapiens
uguuauuuucuguugaaguuua

SEQ ID NO: 1877107 - RNA, 20 nt, Homo sapiens
auucagucuuuucucugaaa

SEQ ID NO: 1877108 - RNA, 18 nt, Homo sapiens
guaguuugaucaguugaa

SEQ ID NO: 1877109 - RNA, 23 nt, Homo sapiens
gacaagauuuuuuaauuguuuaa

SEQ ID NO: 1877110 - RNA, 22 nt, Homo sapiens
cauauaucuacacauacagaaa

SEQ ID NO: 1877111 - RNA, 16 nt, Homo sapiens
acaguccaagcccugg

SEQ ID NO: 1877112 - RNA, 13 nt, Homo sapiens
cuggucaccacaa

SEQ ID NO: 1877113 - RNA, 23 nt, Homo sapiens
aucagggugggaccccauuccag

SEQ ID NO: 1877114 - RNA, 15 nt, Homo sapiens
cagacuggauuaaaa

SEQ ID NO: 1877115 - RNA, 19 nt, Homo sapiens
gcagacugaaccaguccag

SEQ ID NO: 1877116 - RNA, 22 nt, Homo sapiens
cuccaagcuuucagacaagaau

SEQ ID NO: 1877117 - RNA, 13 nt, Homo sapiens
gcaaaaaacuaau

SEQ ID NO: 1877118 - RNA, 23 nt, Homo sapiens
gaaucaucaaagcucacaccaaa

SEQ ID NO: 1877119 - RNA, 21 nt, Homo sapiens
gauccagauguuaugcuccug

SEQ ID NO: 1877120 - RNA, 14 nt, Homo sapiens
agcucuuuggugcc

SEQ ID NO: 1877121 - RNA, 17 nt, Homo sapiens
cuuccaaauuuggcuca

SEQ ID NO: 1877122 - RNA, 17 nt, Homo sapiens
ucauucaagagucucau

SEQ ID NO: 1877123 - RNA, 18 nt, Homo sapiens
uaaaaugcuaaaugucaa

SEQ ID NO: 1877124 - RNA, 14 nt, Homo sapiens
aaugugucugcaac

SEQ ID NO: 1877125 - RNA, 15 nt, Homo sapiens
gugauuaaagcaaga

SEQ ID NO: 1877126 - RNA, 13 nt, Homo sapiens
uuccuuagucuca

SEQ ID NO: 1877127 - RNA, 22 nt, Homo sapiens
ucaaaucccaaaccauuacuga

SEQ ID NO: 1877128 - RNA, 18 nt, Homo sapiens
gagcucucggaacugcau

SEQ ID NO: 1877129 - RNA, 15 nt, Homo sapiens
guuauuuaugcacug

SEQ ID NO: 1877130 - RNA, 17 nt, Homo sapiens
aagccuuuguaucuuuc

SEQ ID NO: 1877131 - RNA, 15 nt, Homo sapiens
ggggcugaugcaguu

SEQ ID NO: 1877132 - RNA, 12 nt, Homo sapiens
acaccugagaaa

SEQ ID NO: 1877133 - RNA, 21 nt, Homo sapiens
agacuuaauagaaacauugaa

SEQ ID NO: 1877134 - RNA, 21 nt, Homo sapiens
uaacuuauuuuguacuagugu

SEQ ID NO: 1877135 - RNA, 18 nt, Homo sapiens
ucccuucuacugcuucua

SEQ ID NO: 1877136 - RNA, 13 nt, Homo sapiens
auggggugggggg

SEQ ID NO: 1877137 - RNA, 16 nt, Homo sapiens
ggcucaaggcugugca

SEQ ID NO: 1877138 - RNA, 19 nt, Homo sapiens
uguaguuacaucucagugc

SEQ ID NO: 1877139 - RNA, 18 nt, Homo sapiens
uguuugcuggggccgaaa

SEQ ID NO: 1877140 - RNA, 14 nt, Homo sapiens
ugauuugaaccaaa

SEQ ID NO: 1877141 - RNA, 20 nt, Homo sapiens
agcugaugccuccuuggcca

SEQ ID NO: 1877142 - RNA, 22 nt, Homo sapiens
ucuacaaaaugggccucaugga

SEQ ID NO: 1877143 - RNA, 20 nt, Homo sapiens
ccuccauuucucuccaggaa

SEQ ID NO: 1877144 - RNA, 23 nt, Homo sapiens
auaaaggugauugauuguauugc

SEQ ID NO: 1877145 - RNA, 22 nt, Homo sapiens
ucaucaauuuuuauacauauca

SEQ ID NO: 1877146 - RNA, 12 nt, Homo sapiens
caggaugcauau

SEQ ID NO: 1877147 - RNA, 17 nt, Homo sapiens
aagccaaacucugccag

SEQ ID NO: 1877148 - RNA, 18 nt, Homo sapiens
uauuauagcaacuuuaag

SEQ ID NO: 1877149 - RNA, 15 nt, Homo sapiens
uuuaauuaugccuuu

SEQ ID NO: 1877150 - RNA, 23 nt, Homo sapiens
ugcugaugggccagcaggagcca

SEQ ID NO: 1877151 - RNA, 15 nt, Homo sapiens
agcaagcaauucugc

SEQ ID NO: 1877152 - RNA, 14 nt, Homo sapiens
gaaauaaaaugaua

SEQ ID NO: 1877153 - RNA, 23 nt, Homo sapiens
gaauuuuauacuuucccuacccu

SEQ ID NO: 1877154 - RNA, 23 nt, Homo sapiens
acucaucuccucuguaaugauca

SEQ ID NO: 1877155 - RNA, 19 nt, Homo sapiens
cugggugacagagcaagac

SEQ ID NO: 1877156 - RNA, 17 nt, Homo sapiens
gaagaauuggccaucuu

SEQ ID NO: 1877157 - RNA, 23 nt, Homo sapiens
gaagauuguuggugaauuuucaa

SEQ ID NO: 1877158 - RNA, 21 nt, Homo sapiens
augccaagcacugugcucagg

SEQ ID NO: 1877159 - RNA, 15 nt, Homo sapiens
ugcuggaagcccagc

SEQ ID NO: 1877160 - RNA, 21 nt, Homo sapiens
cucaacaauauauguccuaua

SEQ ID NO: 1877161 - RNA, 18 nt, Homo sapiens
agaaagaacgugaucucc

SEQ ID NO: 1877162 - RNA, 21 nt, Homo sapiens
ugccauagaggacagcaacug

SEQ ID NO: 1877163 - RNA, 20 nt, Homo sapiens
auauauuuaaaaauaaguca

SEQ ID NO: 1877164 - RNA, 19 nt, Homo sapiens
ugaaugcagaagcgcucca

SEQ ID NO: 1877165 - RNA, 14 nt, Homo sapiens
aauacagugcuuua

SEQ ID NO: 1877166 - RNA, 15 nt, Homo sapiens
uguaaauacaucaaa

SEQ ID NO: 1877167 - RNA, 23 nt, Homo sapiens
uagugcuuuaccuuuauuaauga

SEQ ID NO: 1877168 - RNA, 22 nt, Homo sapiens
uuauugguuuuguucuugccua

SEQ ID NO: 1877169 - RNA, 13 nt, Homo sapiens
guuauaauuugca

SEQ ID NO: 1877170 - RNA, 10 nt, Homo sapiens
ucccaugaga

SEQ ID NO: 1877171 - RNA, 20 nt, Homo sapiens
gaggaagucaggcuguuggc

SEQ ID NO: 1877172 - RNA, 13 nt, Homo sapiens
uaacucccaguga

SEQ ID NO: 1877173 - RNA, 23 nt, Homo sapiens
agccagagcugugccugcucagc

SEQ ID NO: 1877174 - RNA, 14 nt, Homo sapiens
aaaaugcaugauaa

SEQ ID NO: 1877175 - RNA, 23 nt, Homo sapiens
cucauguuguucccacacacaaa

SEQ ID NO: 1877176 - RNA, 19 nt, Homo sapiens
cguuguacuguaugugaug

SEQ ID NO: 1877177 - RNA, 18 nt, Homo sapiens
auggcaggaggcauccaa

SEQ ID NO: 1877178 - RNA, 14 nt, Homo sapiens
acuaagaagcagau

SEQ ID NO: 1877179 - RNA, 20 nt, Homo sapiens
ucaauuuaagauacaaauaa

SEQ ID NO: 1877180 - RNA, 19 nt, Homo sapiens
acuaugcaccuauaaauac

SEQ ID NO: 1877181 - RNA, 12 nt, Homo sapiens
ggcuaugccuug

SEQ ID NO: 1877182 - RNA, 20 nt, Homo sapiens
uaauggauguaauacauuuc

SEQ ID NO: 1877183 - RNA, 19 nt, Homo sapiens
uccaacagaaagcauagac

SEQ ID NO: 1877184 - RNA, 19 nt, Homo sapiens
aucaaacgcagacacugua

SEQ ID NO: 1877185 - RNA, 21 nt, Homo sapiens
gaggugguaguaaaacacaga

SEQ ID NO: 1877186 - RNA, 14 nt, Homo sapiens
ucacccggccucuu

SEQ ID NO: 1877187 - RNA, 19 nt, Homo sapiens
ccauggcaugggggccuca

SEQ ID NO: 1877188 - RNA, 20 nt, Homo sapiens
agugagagagagaauaagga

SEQ ID NO: 1877189 - RNA, 18 nt, Homo sapiens
cagggaacagccacuccc

SEQ ID NO: 1877190 - RNA, 20 nt, Homo sapiens
uuuaucccuuuccugguuuc

SEQ ID NO: 1877191 - RNA, 15 nt, Homo sapiens
ugucaucugugcacu

SEQ ID NO: 1877192 - RNA, 20 nt, Homo sapiens
cuauaagcaaauugcuuuuu

SEQ ID NO: 1877193 - RNA, 16 nt, Homo sapiens
uauauuccagguuuaa

SEQ ID NO: 1877194 - RNA, 13 nt, Homo sapiens
ugaaaaaugccuc

SEQ ID NO: 1877195 - RNA, 13 nt, Homo sapiens
cagagauguuaaa

SEQ ID NO: 1877196 - RNA, 14 nt, Homo sapiens
guuacaaagacaug

SEQ ID NO: 1877197 - RNA, 22 nt, Homo sapiens
ugccaucaucucuuuaccuggg

SEQ ID NO: 1877198 - RNA, 23 nt, Homo sapiens
cagucgucccagcagcaccucag

SEQ ID NO: 1877199 - RNA, 20 nt, Homo sapiens
agccccuguauggcacuggc

SEQ ID NO: 1877200 - RNA, 14 nt, Homo sapiens
aaaagcaacuuucc

SEQ ID NO: 1877201 - RNA, 15 nt, Homo sapiens
aggacauagcacgaa

SEQ ID NO: 1877202 - RNA, 15 nt, Homo sapiens
ugacuacugggcaaa

SEQ ID NO: 1877203 - RNA, 18 nt, Homo sapiens
uccucuuuuuucuuguca

SEQ ID NO: 1877204 - RNA, 13 nt, Homo sapiens
ugccuaaauauaa

SEQ ID NO: 1877205 - RNA, 23 nt, Homo sapiens
agagaauuucaaggcaggggauu

SEQ ID NO: 1877206 - RNA, 16 nt, Homo sapiens
uucuuuuucuguugaa

SEQ ID NO: 1877207 - RNA, 16 nt, Homo sapiens
guauuuaauucuucac

SEQ ID NO: 1877208 - RNA, 17 nt, Homo sapiens
gcucaagaggccacuua

SEQ ID NO: 1877209 - RNA, 16 nt, Homo sapiens
gcuuuuuccuuuucau

SEQ ID NO: 1877210 - RNA, 18 nt, Homo sapiens
augugacaacaugcaaga

SEQ ID NO: 1877211 - RNA, 19 nt, Homo sapiens
ccagaagccggcggagcuc

SEQ ID NO: 1877212 - RNA, 12 nt, Homo sapiens
auggacacucca

SEQ ID NO: 1877213 - RNA, 15 nt, Homo sapiens
uuguugagaguguga

SEQ ID NO: 1877214 - RNA, 17 nt, Homo sapiens
aguuucgacguuugacu

SEQ ID NO: 1877215 - RNA, 14 nt, Homo sapiens
ccaugcauucaccu

SEQ ID NO: 1877216 - RNA, 22 nt, Homo sapiens
cgauauucuuugcucuugccau

SEQ ID NO: 1877217 - RNA, 18 nt, Homo sapiens
uacgaaaaucccaugaga

SEQ ID NO: 1877218 - RNA, 19 nt, Homo sapiens
aaaccuccuucagaucucu

SEQ ID NO: 1877219 - RNA, 10 nt, Homo sapiens
uauguacaaa

SEQ ID NO: 1877220 - RNA, 14 nt, Homo sapiens
acuuacaugcauua

SEQ ID NO: 1877221 - RNA, 22 nt, Homo sapiens
cuggagcaauaaaagacaaaug

SEQ ID NO: 1877222 - RNA, 23 nt, Homo sapiens
cuuguuaucagcuuucagggcca

SEQ ID NO: 1877223 - RNA, 21 nt, Homo sapiens
ugugaacagaaguuuaauuca

SEQ ID NO: 1877224 - RNA, 21 nt, Homo sapiens
ccucaagugcaaggaccaaag

SEQ ID NO: 1877225 - RNA, 14 nt, Homo sapiens
cugugaggugcuga

SEQ ID NO: 1877226 - RNA, 14 nt, Homo sapiens
gugccuagacuguu

SEQ ID NO: 1877227 - RNA, 23 nt, Homo sapiens
aaauaaaaaucauucuacugaac

SEQ ID NO: 1877228 - RNA, 21 nt, Homo sapiens
cuguggucuucaaauugucuu

SEQ ID NO: 1877229 - RNA, 16 nt, Homo sapiens
uccuggggaacauaga

SEQ ID NO: 1877230 - RNA, 22 nt, Homo sapiens
auuucuucaaauccuuccaaaa

SEQ ID NO: 1877231 - RNA, 22 nt, Homo sapiens
uaagcacauccaacuacuccua

SEQ ID NO: 1877232 - RNA, 15 nt, Homo sapiens
aagucuacacugccu

SEQ ID NO: 1877233 - RNA, 15 nt, Homo sapiens
uacucagaaccugcu

SEQ ID NO: 1877234 - RNA, 21 nt, Homo sapiens
ugggauuacaggugugcacca

SEQ ID NO: 1877235 - RNA, 11 nt, Homo sapiens
caaagcacaga

SEQ ID NO: 1877236 - RNA, 15 nt, Homo sapiens
ucauuuaguaaggau

SEQ ID NO: 1877237 - RNA, 21 nt, Homo sapiens
aagcugggauaaucacauuau

SEQ ID NO: 1877238 - RNA, 19 nt, Homo sapiens
augggacugugaggccaua

SEQ ID NO: 1877239 - RNA, 14 nt, Homo sapiens
uuauaagcauuuaa

SEQ ID NO: 1877240 - RNA, 23 nt, Homo sapiens
ugcaggacaucaaaaacaaccug

SEQ ID NO: 1877241 - RNA, 16 nt, Homo sapiens
ccgcuuccccuugcca

SEQ ID NO: 1877242 - RNA, 20 nt, Homo sapiens
ugagcuaaggcagccuucag

SEQ ID NO: 1877243 - RNA, 14 nt, Homo sapiens
ucgaauaagacuca

SEQ ID NO: 1877244 - RNA, 14 nt, Homo sapiens
cucuucugcuccuu

SEQ ID NO: 1877245 - RNA, 12 nt, Homo sapiens
aacacaucacuu

SEQ ID NO: 1877246 - RNA, 21 nt, Homo sapiens
aagcagguuuuuaaguugucu

SEQ ID NO: 1877247 - RNA, 13 nt, Homo sapiens
auguucacuggua

SEQ ID NO: 1877248 - RNA, 14 nt, Homo sapiens
ucauuuugaugaua

SEQ ID NO: 1877249 - RNA, 17 nt, Homo sapiens
uguucaacuuaaugaag

SEQ ID NO: 1877250 - RNA, 23 nt, Homo sapiens
uacacugcuccuguggccuucca

SEQ ID NO: 1877251 - RNA, 17 nt, Homo sapiens
gaaugaguugaggccac

SEQ ID NO: 1877252 - RNA, 15 nt, Homo sapiens
cugaccuuccagagc

SEQ ID NO: 1877253 - RNA, 22 nt, Homo sapiens
aagaguauuuuaagaagacaua

SEQ ID NO: 1877254 - RNA, 20 nt, Homo sapiens
caagaucuuuuuccagguuc

SEQ ID NO: 1877255 - RNA, 19 nt, Homo sapiens
cacaauaaaagacauccac

SEQ ID NO: 1877256 - RNA, 12 nt, Homo sapiens
ucaucaaugcaa

SEQ ID NO: 1877257 - RNA, 14 nt, Homo sapiens
uaaugcaauauacu

SEQ ID NO: 1877258 - RNA, 19 nt, Homo sapiens
ucaguuauucagauugaca

SEQ ID NO: 1877259 - RNA, 15 nt, Homo sapiens
uacaaauacuaucca

SEQ ID NO: 1877260 - RNA, 12 nt, Homo sapiens
cauuucaucuca

SEQ ID NO: 1877261 - RNA, 22 nt, Homo sapiens
ugagguccaggguugcuaggaa

SEQ ID NO: 1877262 - RNA, 14 nt, Homo sapiens
aagcaaagugccca

SEQ ID NO: 1877263 - RNA, 14 nt, Homo sapiens
uucaagaauuuaau

SEQ ID NO: 1877264 - RNA, 18 nt, Homo sapiens
aucuguucagucaucucc

SEQ ID NO: 1877265 - RNA, 20 nt, Homo sapiens
agaucaguauuucacugaua

SEQ ID NO: 1877266 - RNA, 14 nt, Homo sapiens
aguaaaaucaaaug

SEQ ID NO: 1877267 - RNA, 12 nt, Homo sapiens
cccagagcagga

SEQ ID NO: 1877268 - RNA, 18 nt, Homo sapiens
agaacauggccuaagggc

SEQ ID NO: 1877269 - RNA, 21 nt, Homo sapiens
aguuugugagaaacaucucaa

SEQ ID NO: 1877270 - RNA, 14 nt, Homo sapiens
ugauggacacucca

SEQ ID NO: 1877271 - RNA, 16 nt, Homo sapiens
cagacaggaccaggga

SEQ ID NO: 1877272 - RNA, 19 nt, Homo sapiens
uacucuaaaauggacauuu

SEQ ID NO: 1877273 - RNA, 19 nt, Homo sapiens
aggagacugguuaggacaa

SEQ ID NO: 1877274 - RNA, 17 nt, Homo sapiens
gauacaugagccaguga

SEQ ID NO: 1877275 - RNA, 21 nt, Homo sapiens
aaugaccagcagcagcuuuca

SEQ ID NO: 1877276 - RNA, 12 nt, Homo sapiens
caguuagggcug

SEQ ID NO: 1877277 - RNA, 21 nt, Homo sapiens
cacuaauucauuaaucugccu

SEQ ID NO: 1877278 - RNA, 16 nt, Homo sapiens
ggccuucugauuucaa

SEQ ID NO: 1877279 - RNA, 18 nt, Homo sapiens
uggagggucuugagggga

SEQ ID NO: 1877280 - RNA, 16 nt, Homo sapiens
cuugucugucuaguua

SEQ ID NO: 1877281 - RNA, 20 nt, Homo sapiens
acagaggagcuuuucuggaa

SEQ ID NO: 1877282 - RNA, 17 nt, Homo sapiens
cagcauuugccauuccu

SEQ ID NO: 1877283 - RNA, 22 nt, Homo sapiens
cuggagcugcuaagcuaaagaa

SEQ ID NO: 1877284 - RNA, 23 nt, Homo sapiens
ucagguuuuugaggaaacaaaga

SEQ ID NO: 1877285 - RNA, 14 nt, Homo sapiens
aguaagaucaagaa

SEQ ID NO: 1877286 - RNA, 20 nt, Homo sapiens
ccccucauuguuuauuaaca

SEQ ID NO: 1877287 - RNA, 18 nt, Homo sapiens
aggucccuguugucagau

SEQ ID NO: 1877288 - RNA, 20 nt, Homo sapiens
ccauaaggcacuuaucccug

SEQ ID NO: 1877289 - RNA, 15 nt, Homo sapiens
acauaaguucauuca

SEQ ID NO: 1877290 - RNA, 16 nt, Homo sapiens
aaggacgccuccaagc

SEQ ID NO: 1877291 - RNA, 19 nt, Homo sapiens
uaaaagagccaaguucaaa

SEQ ID NO: 1877292 - RNA, 16 nt, Homo sapiens
guuucucaagcgcuau

SEQ ID NO: 1877293 - RNA, 22 nt, Homo sapiens
cuuuuuaaagaagugcaugaaa

SEQ ID NO: 1877294 - RNA, 21 nt, Homo sapiens
cagcugcucccuggcauucaa

SEQ ID NO: 1877295 - RNA, 16 nt, Homo sapiens
ccccagcuuuccaucu

SEQ ID NO: 1877296 - RNA, 23 nt, Homo sapiens
cuugggaguauguugucauaaca

SEQ ID NO: 1877297 - RNA, 14 nt, Homo sapiens
agaucauggcccac

SEQ ID NO: 1877298 - RNA, 14 nt, Homo sapiens
accuaaugggaccc

SEQ ID NO: 1877299 - RNA, 18 nt, Homo sapiens
acuucauuugaugcuaaa

SEQ ID NO: 1877300 - RNA, 23 nt, Homo sapiens
cuuuuuuuuuuuuuaaagacaga

SEQ ID NO: 1877301 - RNA, 14 nt, Homo sapiens
cacuucaguuccuu

SEQ ID NO: 1877302 - RNA, 21 nt, Homo sapiens
cuuauuggccacugggucuca

SEQ ID NO: 1877303 - RNA, 21 nt, Homo sapiens
ggaaauauuuugugauggugu

SEQ ID NO: 1877304 - RNA, 14 nt, Homo sapiens
gaacccaagugccu

SEQ ID NO: 1877305 - RNA, 23 nt, Homo sapiens
cccacaccauaagcuacugccau

SEQ ID NO: 1877306 - RNA, 19 nt, Homo sapiens
aaucacaaaccaagccaug

SEQ ID NO: 1877307 - RNA, 23 nt, Homo sapiens
aagaauuuuaauuuauucaucuu

SEQ ID NO: 1877308 - RNA, 22 nt, Homo sapiens
cuacccuauucuauccaucucc

SEQ ID NO: 1877309 - RNA, 17 nt, Homo sapiens
gcaauucuccugccuca

SEQ ID NO: 1877310 - RNA, 17 nt, Homo sapiens
cagaauuuuuaacaaaa

SEQ ID NO: 1877311 - RNA, 15 nt, Homo sapiens
uuaaacccauacaau

SEQ ID NO: 1877312 - RNA, 19 nt, Homo sapiens
agucaaauaccacaugauu

SEQ ID NO: 1877313 - RNA, 15 nt, Homo sapiens
cccacccccacuuca

SEQ ID NO: 1877314 - RNA, 15 nt, Homo sapiens
agcucaggcacacuu

SEQ ID NO: 1877315 - RNA, 17 nt, Homo sapiens
agcaccacacccagugg

SEQ ID NO: 1877316 - RNA, 23 nt, Homo sapiens
gggcaagggguucccuugagggc

SEQ ID NO: 1877317 - RNA, 18 nt, Homo sapiens
agauuccccugugucauc

SEQ ID NO: 1877318 - RNA, 23 nt, Homo sapiens
ugccuccucagcagccucacugc

SEQ ID NO: 1877319 - RNA, 13 nt, Homo sapiens
agucuucuuucau

SEQ ID NO: 1877320 - RNA, 21 nt, Homo sapiens
cagaggcagcuucuuugccaa

SEQ ID NO: 1877321 - RNA, 14 nt, Homo sapiens
gauuagacagucaa

SEQ ID NO: 1877322 - RNA, 16 nt, Homo sapiens
gagguucuuucccaca

SEQ ID NO: 1877323 - RNA, 18 nt, Homo sapiens
uuaauccuuaacacauuc

SEQ ID NO: 1877324 - RNA, 20 nt, Homo sapiens
ucaacgcucccagacgguca

SEQ ID NO: 1877325 - RNA, 20 nt, Homo sapiens
ugaauaauacaguaucucag

SEQ ID NO: 1877326 - RNA, 22 nt, Homo sapiens
accugugagauccgugaauucu

SEQ ID NO: 1877327 - RNA, 19 nt, Homo sapiens
gccuguagucccagcuacu

SEQ ID NO: 1877328 - RNA, 15 nt, Homo sapiens
caaucucaucugaua

SEQ ID NO: 1877329 - RNA, 10 nt, Homo sapiens
gucucaggcc

SEQ ID NO: 1877330 - RNA, 18 nt, Homo sapiens
cagugaaugaagcugaug

SEQ ID NO: 1877331 - RNA, 23 nt, Homo sapiens
ccagacucaccccaucugcagca

SEQ ID NO: 1877332 - RNA, 21 nt, Homo sapiens
guguuaucagucauaacuaaa

SEQ ID NO: 1877333 - RNA, 17 nt, Homo sapiens
gugaacgucacauuggc

SEQ ID NO: 1877334 - RNA, 21 nt, Homo sapiens
cuggucacccccacccccggg

SEQ ID NO: 1877335 - RNA, 18 nt, Homo sapiens
caaucuuguuacugcuga

SEQ ID NO: 1877336 - RNA, 16 nt, Homo sapiens
gagagugaagugaaga

SEQ ID NO: 1877337 - RNA, 18 nt, Homo sapiens
ccuaguccuugcugcauu

SEQ ID NO: 1877338 - RNA, 16 nt, Homo sapiens
aggggucaccuugaga

SEQ ID NO: 1877339 - RNA, 16 nt, Homo sapiens
uucuuacuaaaaagua

SEQ ID NO: 1877340 - RNA, 15 nt, Homo sapiens
aauuugauacagguu

SEQ ID NO: 1877341 - RNA, 19 nt, Homo sapiens
cauuggguuguagccaaag

SEQ ID NO: 1877342 - RNA, 19 nt, Homo sapiens
gcguucaaacugcuggaaa

SEQ ID NO: 1877343 - RNA, 17 nt, Homo sapiens
ccguuuaccuagaagaa

SEQ ID NO: 1877344 - RNA, 22 nt, Homo sapiens
gugccuugguuuccugagccac

SEQ ID NO: 1877345 - RNA, 21 nt, Homo sapiens
uuuguuccccagcccuaagau

SEQ ID NO: 1877346 - RNA, 19 nt, Homo sapiens
gacccugucacuaacaaaa

SEQ ID NO: 1877347 - RNA, 11 nt, Homo sapiens
aaaccaugacu

SEQ ID NO: 1877348 - RNA, 21 nt, Homo sapiens
acuugaaaugcucuuuugcac

SEQ ID NO: 1877349 - RNA, 16 nt, Homo sapiens
uagacugaagugccag

SEQ ID NO: 1877350 - RNA, 16 nt, Homo sapiens
cuuaucagugccauga

SEQ ID NO: 1877351 - RNA, 22 nt, Homo sapiens
gcucugcccugcccuagcucca

SEQ ID NO: 1877352 - RNA, 18 nt, Homo sapiens
ugagauauauucaguauu

SEQ ID NO: 1877353 - RNA, 19 nt, Homo sapiens
gucuacauugagcauuuga

SEQ ID NO: 1877354 - RNA, 19 nt, Homo sapiens
auuuuguaaaauauuaugu

SEQ ID NO: 1877355 - RNA, 19 nt, Homo sapiens
uuaggauuuguuucuucuc

SEQ ID NO: 1877356 - RNA, 23 nt, Homo sapiens
agaauuuaguuuguacucagugg

SEQ ID NO: 1877357 - RNA, 20 nt, Homo sapiens
aauauuuauguuuaagugcu

SEQ ID NO: 1877358 - RNA, 15 nt, Homo sapiens
ggaaaaugucuuaaa

SEQ ID NO: 1877359 - RNA, 22 nt, Homo sapiens
aguuugauuuguuaauccuuuc

SEQ ID NO: 1877360 - RNA, 22 nt, Homo sapiens
uuuaagaagaaauacccacuaa

SEQ ID NO: 1877361 - RNA, 14 nt, Homo sapiens
ggauuuuaccaaag

SEQ ID NO: 1877362 - RNA, 19 nt, Homo sapiens
cucccaagccacuagccca

SEQ ID NO: 1877363 - RNA, 13 nt, Homo sapiens
gaauugagaugau

SEQ ID NO: 1877364 - RNA, 15 nt, Homo sapiens
cuuacuguacauaca

SEQ ID NO: 1877365 - RNA, 20 nt, Homo sapiens
accaguguccccuccacugu

SEQ ID NO: 1877366 - RNA, 21 nt, Homo sapiens
cugagcuucccccccaccaca

SEQ ID NO: 1877367 - RNA, 17 nt, Homo sapiens
uguauguuccucuauga

SEQ ID NO: 1877368 - RNA, 23 nt, Homo sapiens
caucaagccccacaguucuuaau

SEQ ID NO: 1877369 - RNA, 20 nt, Homo sapiens
uuagauugaaaccauuccag

SEQ ID NO: 1877370 - RNA, 22 nt, Homo sapiens
uguagagccaauuagacuugaa

SEQ ID NO: 1877371 - RNA, 11 nt, Homo sapiens
agccacagaug

SEQ ID NO: 1877372 - RNA, 18 nt, Homo sapiens
uccaaacagguccaccau

SEQ ID NO: 1877373 - RNA, 16 nt, Homo sapiens
accaucuuggcucacu

SEQ ID NO: 1877374 - RNA, 12 nt, Homo sapiens
uuugaacuucau

SEQ ID NO: 1877375 - RNA, 23 nt, Homo sapiens
cugucgccaaguuggagugcaau

SEQ ID NO: 1877376 - RNA, 14 nt, Homo sapiens
aggacaaucuagcu

SEQ ID NO: 1877377 - RNA, 12 nt, Homo sapiens
accucauuccaa

SEQ ID NO: 1877378 - RNA, 16 nt, Homo sapiens
cugcgcaggccaugca

SEQ ID NO: 1877379 - RNA, 14 nt, Homo sapiens
gaaaauaaugcaaa

SEQ ID NO: 1877380 - RNA, 22 nt, Homo sapiens
guaagugucugugaugcuccca

SEQ ID NO: 1877381 - RNA, 20 nt, Homo sapiens
guucacuuaaaagcuggcuu

SEQ ID NO: 1877382 - RNA, 17 nt, Homo sapiens
gcccugguguguuucca

SEQ ID NO: 1877383 - RNA, 19 nt, Homo sapiens
ugccgaauuugguacacau

SEQ ID NO: 1877384 - RNA, 11 nt, Homo sapiens
uuuauguugca

SEQ ID NO: 1877385 - RNA, 14 nt, Homo sapiens
uaacugagauuaca

SEQ ID NO: 1877386 - RNA, 23 nt, Homo sapiens
aauccugcuccugacucggucaa

SEQ ID NO: 1877387 - RNA, 19 nt, Homo sapiens
uuaccuaaucuccacuuuu

SEQ ID NO: 1877388 - RNA, 20 nt, Homo sapiens
uguaucuuuuauccugggag

SEQ ID NO: 1877389 - RNA, 22 nt, Homo sapiens
ggagaaucgcuugaacccagga

SEQ ID NO: 1877390 - RNA, 14 nt, Homo sapiens
gugaagcaaaaacu

SEQ ID NO: 1877391 - RNA, 20 nt, Homo sapiens
ucuugaaucucugaauuuga

SEQ ID NO: 1877392 - RNA, 21 nt, Homo sapiens
ucauggcuucucucucucuuu

SEQ ID NO: 1877393 - RNA, 14 nt, Homo sapiens
cucacuggcaucuu

SEQ ID NO: 1877394 - RNA, 20 nt, Homo sapiens
caacauuucucuucagugug

SEQ ID NO: 1877395 - RNA, 11 nt, Homo sapiens
agauguucaaa

SEQ ID NO: 1877396 - RNA, 24 nt, Homo sapiens
guugcuuauuucccucaucuugcc

SEQ ID NO: 1877397 - RNA, 21 nt, Homo sapiens
ugagcagugcuugaaugaagu

SEQ ID NO: 1877398 - RNA, 20 nt, Homo sapiens
uucaaucuuaacaaaaguga

SEQ ID NO: 1877399 - RNA, 18 nt, Homo sapiens
uacaacugaucauuugca

SEQ ID NO: 1877400 - RNA, 15 nt, Homo sapiens
aucccuccuugccua

SEQ ID NO: 1877401 - RNA, 16 nt, Homo sapiens
uuuguaagaaaaccaa

SEQ ID NO: 1877402 - RNA, 17 nt, Homo sapiens
agcuggcuuccuagccu

SEQ ID NO: 1877403 - RNA, 13 nt, Homo sapiens
gagugccacaucc

SEQ ID NO: 1877404 - RNA, 17 nt, Homo sapiens
ugagcuggggaugucuc

SEQ ID NO: 1877405 - RNA, 19 nt, Homo sapiens
uccagucagaugaggcaaa

SEQ ID NO: 1877406 - RNA, 18 nt, Homo sapiens
caaaguccacuuuacuca

SEQ ID NO: 1877407 - RNA, 19 nt, Homo sapiens
gccauaccugguaagcaaa

SEQ ID NO: 1877408 - RNA, 14 nt, Homo sapiens
cuugaauagucuca

SEQ ID NO: 1877409 - RNA, 12 nt, Homo sapiens
aaauuacaguca

SEQ ID NO: 1877410 - RNA, 14 nt, Homo sapiens
cagaaaaugagggc

SEQ ID NO: 1877411 - RNA, 20 nt, Homo sapiens
uagucuaaccaaaugcauca

SEQ ID NO: 1877412 - RNA, 15 nt, Homo sapiens
cuggauaagucacuu

SEQ ID NO: 1877413 - RNA, 12 nt, Homo sapiens
gacaaaaauauu

SEQ ID NO: 1877414 - RNA, 13 nt, Homo sapiens
aaaugucugccau

SEQ ID NO: 1877415 - RNA, 17 nt, Homo sapiens
ucuuuucgaauguggcu

SEQ ID NO: 1877416 - RNA, 13 nt, Homo sapiens
ucuauaaacauga

SEQ ID NO: 1877417 - RNA, 15 nt, Homo sapiens
aaugccuacugagua

SEQ ID NO: 1877418 - RNA, 22 nt, Homo sapiens
acuguauuuaagaaaacaccau

SEQ ID NO: 1877419 - RNA, 14 nt, Homo sapiens
aaugguuauggguc

SEQ ID NO: 1877420 - RNA, 16 nt, Homo sapiens
auaauaaaauucauuc

SEQ ID NO: 1877421 - RNA, 12 nt, Homo sapiens
gcccucuuccau

SEQ ID NO: 1877422 - RNA, 22 nt, Homo sapiens
aauuaguuuauauuacucucau

SEQ ID NO: 1877423 - RNA, 17 nt, Homo sapiens
gccaggauuaaaagcca

SEQ ID NO: 1877424 - RNA, 14 nt, Homo sapiens
uccuuuacaaccau

SEQ ID NO: 1877425 - RNA, 18 nt, Homo sapiens
ucaaaggagccuuuucaa

SEQ ID NO: 1877426 - RNA, 14 nt, Homo sapiens
guaaaauauacuua

SEQ ID NO: 1877427 - RNA, 20 nt, Homo sapiens
ugccaaaugcuauacugugu

SEQ ID NO: 1877428 - RNA, 13 nt, Homo sapiens
cacacuuugccaa

SEQ ID NO: 1877429 - RNA, 17 nt, Homo sapiens
gcccuccacgucagugc

SEQ ID NO: 1877430 - RNA, 20 nt, Homo sapiens
aauaaucacgcuuuccugaa

SEQ ID NO: 1877431 - RNA, 13 nt, Homo sapiens
cacuaacugagga

SEQ ID NO: 1877432 - RNA, 16 nt, Homo sapiens
cgcccuggacugugug

SEQ ID NO: 1877433 - RNA, 13 nt, Homo sapiens
augcaagugcaaa

SEQ ID NO: 1877434 - RNA, 20 nt, Homo sapiens
agaagcacccaggacuucca

SEQ ID NO: 1877435 - RNA, 14 nt, Homo sapiens
cacugcauuugccu

SEQ ID NO: 1877436 - RNA, 22 nt, Homo sapiens
ucauuuuuuuguacuaauguga

SEQ ID NO: 1877437 - RNA, 14 nt, Homo sapiens
aaaccuuacuuaaa

SEQ ID NO: 1877438 - RNA, 15 nt, Homo sapiens
cagccucccauccag

SEQ ID NO: 1877439 - RNA, 20 nt, Homo sapiens
agcauuuauguagacauugu

SEQ ID NO: 1877440 - RNA, 19 nt, Homo sapiens
uuuccucccuuucccugag

SEQ ID NO: 1877441 - RNA, 23 nt, Homo sapiens
guuagaaucccauggauguuucu

SEQ ID NO: 1877442 - RNA, 20 nt, Homo sapiens
gaggcaggaggauugcuuga

SEQ ID NO: 1877443 - RNA, 16 nt, Homo sapiens
gguuauaaauucaaag

SEQ ID NO: 1877444 - RNA, 17 nt, Homo sapiens
auaugcuaccaccagcu

SEQ ID NO: 1877445 - RNA, 15 nt, Homo sapiens
agugaggaaagccuc

SEQ ID NO: 1877446 - RNA, 17 nt, Homo sapiens
uagaacaaugcuauaau

SEQ ID NO: 1877447 - RNA, 21 nt, Homo sapiens
ugcuaaccuuguagcauguga

SEQ ID NO: 1877448 - RNA, 23 nt, Homo sapiens
gaaaucauuuuacccuuggcuca

SEQ ID NO: 1877449 - RNA, 19 nt, Homo sapiens
caacaaucccagcaucuga

SEQ ID NO: 1877450 - RNA, 15 nt, Homo sapiens
ucagcagacacaggu

SEQ ID NO: 1877451 - RNA, 12 nt, Homo sapiens
aauaucugggug

SEQ ID NO: 1877452 - RNA, 14 nt, Homo sapiens
aacgcuuaagucau

SEQ ID NO: 1877453 - RNA, 11 nt, Homo sapiens
uugcuuagccc

SEQ ID NO: 1877454 - RNA, 15 nt, Homo sapiens
aagcgauucuccugc

SEQ ID NO: 1877455 - RNA, 19 nt, Homo sapiens
cauuucuccagaacccauu

SEQ ID NO: 1877456 - RNA, 18 nt, Homo sapiens
cuaauguaggacuguaua

SEQ ID NO: 1877457 - RNA, 16 nt, Homo sapiens
cagcugccaagugcuc

SEQ ID NO: 1877458 - RNA, 12 nt, Homo sapiens
agaaugugcaaa

SEQ ID NO: 1877459 - RNA, 19 nt, Homo sapiens
gcggggugucugucuuccu

SEQ ID NO: 1877460 - RNA, 21 nt, Homo sapiens
uuggguuaggaagaaaauaau

SEQ ID NO: 1877461 - RNA, 15 nt, Homo sapiens
ucucuguucagaaag

SEQ ID NO: 1877462 - RNA, 20 nt, Homo sapiens
ucuucccauucuccauuugu

SEQ ID NO: 1877463 - RNA, 23 nt, Homo sapiens
uucagcauacugacuccaggugu

SEQ ID NO: 1877464 - RNA, 21 nt, Homo sapiens
auuuuggcccuaccuguaacu

SEQ ID NO: 1877465 - RNA, 19 nt, Homo sapiens
guaaacacuugacuauaaa

SEQ ID NO: 1877466 - RNA, 22 nt, Homo sapiens
cucuuggagcugagaugagccc

SEQ ID NO: 1877467 - RNA, 14 nt, Homo sapiens
gcucucuaauucca

SEQ ID NO: 1877468 - RNA, 22 nt, Homo sapiens
aauccuggaaggacacagugau

SEQ ID NO: 1877469 - RNA, 23 nt, Homo sapiens
aagaaugagacugaacuguguga

SEQ ID NO: 1877470 - RNA, 19 nt, Homo sapiens
ucaaaccugugcugaccaa

SEQ ID NO: 1877471 - RNA, 18 nt, Homo sapiens
ccagggagggaaguguga

SEQ ID NO: 1877472 - RNA, 21 nt, Homo sapiens
ucaaaaacugucaaagaauca

SEQ ID NO: 1877473 - RNA, 16 nt, Homo sapiens
agcuucuggagcagaa

SEQ ID NO: 1877474 - RNA, 13 nt, Homo sapiens
aagcuggaggcac

SEQ ID NO: 1877475 - RNA, 22 nt, Homo sapiens
cuuucuaaaggaaaucaaauga

SEQ ID NO: 1877476 - RNA, 11 nt, Homo sapiens
gaauacuguau

SEQ ID NO: 1877477 - RNA, 22 nt, Homo sapiens
acucuguguuuggaauaucucu

SEQ ID NO: 1877478 - RNA, 13 nt, Homo sapiens
accucacuagcuc

SEQ ID NO: 1877479 - RNA, 13 nt, Homo sapiens
ugaaaacuucaaa

SEQ ID NO: 1877480 - RNA, 13 nt, Homo sapiens
uguauacuucuau

SEQ ID NO: 1877481 - RNA, 13 nt, Homo sapiens
acuuaacuaguua

SEQ ID NO: 1877482 - RNA, 13 nt, Homo sapiens
cgcucacucccuc

SEQ ID NO: 1877483 - RNA, 19 nt, Homo sapiens
uauuugauaaguuuucaca

SEQ ID NO: 1877484 - RNA, 20 nt, Homo sapiens
aaagguaaaucagacuauga

SEQ ID NO: 1877485 - RNA, 15 nt, Homo sapiens
augggaaaguauucu

SEQ ID NO: 1877486 - RNA, 19 nt, Homo sapiens
uagaucaagcauuacacac

SEQ ID NO: 1877487 - RNA, 17 nt, Homo sapiens
acugcagccuccagaga

SEQ ID NO: 1877488 - RNA, 13 nt, Homo sapiens
ccaaaucucagua

SEQ ID NO: 1877489 - RNA, 18 nt, Homo sapiens
caccuuuuuucuuugguu

SEQ ID NO: 1877490 - RNA, 20 nt, Homo sapiens
agaaauggacuggagcucau

SEQ ID NO: 1877491 - RNA, 12 nt, Homo sapiens
cuuucucuguga

SEQ ID NO: 1877492 - RNA, 17 nt, Homo sapiens
caagauccuuaaugcag

SEQ ID NO: 1877493 - RNA, 14 nt, Homo sapiens
gccuguguacaacu

SEQ ID NO: 1877494 - RNA, 16 nt, Homo sapiens
cagcaguccaagguau

SEQ ID NO: 1877495 - RNA, 18 nt, Homo sapiens
uccuggcaugacacucua

SEQ ID NO: 1877496 - RNA, 19 nt, Homo sapiens
uagcaaauaguaaucugua

SEQ ID NO: 1877497 - RNA, 13 nt, Homo sapiens
ggaacagaccuga

SEQ ID NO: 1877498 - RNA, 22 nt, Homo sapiens
aggccucuuguugagugccagc

SEQ ID NO: 1877499 - RNA, 20 nt, Homo sapiens
aauguugcauuuaugaugca

SEQ ID NO: 1877500 - RNA, 18 nt, Homo sapiens
uagguggagguugugcau

SEQ ID NO: 1877501 - RNA, 23 nt, Homo sapiens
ggcuuguugcccucugcaguuga

SEQ ID NO: 1877502 - RNA, 12 nt, Homo sapiens
uccccauugccu

SEQ ID NO: 1877503 - RNA, 13 nt, Homo sapiens
caauucauucucu

SEQ ID NO: 1877504 - RNA, 22 nt, Homo sapiens
ucuaaucaagaaaagaauuaca

SEQ ID NO: 1877505 - RNA, 18 nt, Homo sapiens
uacaguugcauguuauau

SEQ ID NO: 1877506 - RNA, 19 nt, Homo sapiens
caugagacucagugcagau

SEQ ID NO: 1877507 - RNA, 11 nt, Homo sapiens
caggugcugcc

SEQ ID NO: 1877508 - RNA, 14 nt, Homo sapiens
uauccuucuacuug

SEQ ID NO: 1877509 - RNA, 13 nt, Homo sapiens
accacagucagug

SEQ ID NO: 1877510 - RNA, 14 nt, Homo sapiens
uggcuuacuccagg

SEQ ID NO: 1877511 - RNA, 20 nt, Homo sapiens
cugagaucaccccacuucca

SEQ ID NO: 1877512 - RNA, 12 nt, Homo sapiens
cugacugcaaaa

SEQ ID NO: 1877513 - RNA, 21 nt, Homo sapiens
gucugaaagacagaaugucac

SEQ ID NO: 1877514 - RNA, 17 nt, Homo sapiens
ggccugggaugcaguga

SEQ ID NO: 1877515 - RNA, 15 nt, Homo sapiens
cacgccuacuuaaga

SEQ ID NO: 1877516 - RNA, 20 nt, Homo sapiens
ugcucggcuguaaacagcuc

SEQ ID NO: 1877517 - RNA, 18 nt, Homo sapiens
caucugaagccaccucuc

SEQ ID NO: 1877518 - RNA, 13 nt, Homo sapiens
guaaaugcucaaa

SEQ ID NO: 1877519 - RNA, 14 nt, Homo sapiens
auguguaaauguua

SEQ ID NO: 1877520 - RNA, 20 nt, Homo sapiens
ggcucagucgcuagcauuuc

SEQ ID NO: 1877521 - RNA, 23 nt, Homo sapiens
auucauagaauaacaacugcugg

SEQ ID NO: 1877522 - RNA, 18 nt, Homo sapiens
uccauauaacaauucagu

SEQ ID NO: 1877523 - RNA, 19 nt, Homo sapiens
caggugggcucgcuaggcg

SEQ ID NO: 1877524 - RNA, 13 nt, Homo sapiens
ggugaaacccagu

SEQ ID NO: 1877525 - RNA, 22 nt, Homo sapiens
gugagacuagacauaguaccga

SEQ ID NO: 1877526 - RNA, 14 nt, Homo sapiens
ccuuccgaugacag

SEQ ID NO: 1877527 - RNA, 17 nt, Homo sapiens
gaauuagagaagcugaa

SEQ ID NO: 1877528 - RNA, 15 nt, Homo sapiens
cacacagagauaugc

SEQ ID NO: 1877529 - RNA, 16 nt, Homo sapiens
uucuguccaaggcaca

SEQ ID NO: 1877530 - RNA, 20 nt, Homo sapiens
auaaccaaacauaacauuau

SEQ ID NO: 1877531 - RNA, 17 nt, Homo sapiens
cacaaaagucuacuuua

SEQ ID NO: 1877532 - RNA, 13 nt, Homo sapiens
acagccccggggc

SEQ ID NO: 1877533 - RNA, 23 nt, Homo sapiens
ugccuaucaaagaguauguugua

SEQ ID NO: 1877534 - RNA, 15 nt, Homo sapiens
gccagucaagggcau

SEQ ID NO: 1877535 - RNA, 14 nt, Homo sapiens
cucaggggcuccau

SEQ ID NO: 1877536 - RNA, 14 nt, Homo sapiens
cuguuuuaaagggu

SEQ ID NO: 1877537 - RNA, 17 nt, Homo sapiens
acucacuccauuccuag

SEQ ID NO: 1877538 - RNA, 16 nt, Homo sapiens
ucagacucuggauuca

SEQ ID NO: 1877539 - RNA, 15 nt, Homo sapiens
gcuacauauaugcaa

SEQ ID NO: 1877540 - RNA, 17 nt, Homo sapiens
aagaaacuuauuucuca

SEQ ID NO: 1877541 - RNA, 22 nt, Homo sapiens
caauauuuuccuucucucucaa

SEQ ID NO: 1877542 - RNA, 23 nt, Homo sapiens
uucagaauguacggaaagaugau

SEQ ID NO: 1877543 - RNA, 16 nt, Homo sapiens
aucauuaaaauuaaca

SEQ ID NO: 1877544 - RNA, 20 nt, Homo sapiens
uaaacagugagccugaauuu

SEQ ID NO: 1877545 - RNA, 15 nt, Homo sapiens
acuccuccuugccug

SEQ ID NO: 1877546 - RNA, 14 nt, Homo sapiens
gccacucaaaggaa

SEQ ID NO: 1877547 - RNA, 20 nt, Homo sapiens
ucuagccuggcuauguccua

SEQ ID NO: 1877548 - RNA, 16 nt, Homo sapiens
acugccugcccagugc

SEQ ID NO: 1877549 - RNA, 13 nt, Homo sapiens
cugggacuauggc

SEQ ID NO: 1877550 - RNA, 14 nt, Homo sapiens
cauucaccaagagc

SEQ ID NO: 1877551 - RNA, 23 nt, Homo sapiens
gggucccccugcuugucuucacc

SEQ ID NO: 1877552 - RNA, 22 nt, Homo sapiens
aaacucuuauggccaaauucaa

SEQ ID NO: 1877553 - RNA, 14 nt, Homo sapiens
cuggguccucugca

SEQ ID NO: 1877554 - RNA, 21 nt, Homo sapiens
gcuacagaaaccacagucuuc

SEQ ID NO: 1877555 - RNA, 15 nt, Homo sapiens
gaaaauguacauacu

SEQ ID NO: 1877556 - RNA, 21 nt, Homo sapiens
gauacaugugccgaaugugca

SEQ ID NO: 1877557 - RNA, 12 nt, Homo sapiens
ugccacccaguu

SEQ ID NO: 1877558 - RNA, 15 nt, Homo sapiens
uguuaccaaaucuca

SEQ ID NO: 1877559 - RNA, 16 nt, Homo sapiens
ugcagugcugagauag

SEQ ID NO: 1877560 - RNA, 19 nt, Homo sapiens
cuccgaaugucaagguucc

SEQ ID NO: 1877561 - RNA, 19 nt, Homo sapiens
cugauucccaagcucugcu

SEQ ID NO: 1877562 - RNA, 20 nt, Homo sapiens
gucggccccaccagugccuc

SEQ ID NO: 1877563 - RNA, 22 nt, Homo sapiens
agaguagaacagauaaucagug

SEQ ID NO: 1877564 - RNA, 13 nt, Homo sapiens
uguauaauggugu

SEQ ID NO: 1877565 - RNA, 13 nt, Homo sapiens
uuuauaauguugu

SEQ ID NO: 1877566 - RNA, 13 nt, Homo sapiens
uagaaaaugagga

SEQ ID NO: 1877567 - RNA, 16 nt, Homo sapiens
uaagguuuccagucag

SEQ ID NO: 1877568 - RNA, 12 nt, Homo sapiens
uguaaaauccac

SEQ ID NO: 1877569 - RNA, 13 nt, Homo sapiens
uagcaacuacagu

SEQ ID NO: 1877570 - RNA, 14 nt, Homo sapiens
aguaaugaucucaa

SEQ ID NO: 1877571 - RNA, 12 nt, Homo sapiens
uugcuacauucu

SEQ ID NO: 1877572 - RNA, 12 nt, Homo sapiens
ugcaacuacuau

SEQ ID NO: 1877573 - RNA, 23 nt, Homo sapiens
agugacgggugcccguaauccca

SEQ ID NO: 1877574 - RNA, 13 nt, Homo sapiens
guucaguucuguu

SEQ ID NO: 1877575 - RNA, 22 nt, Homo sapiens
uucuaccuguguucauucuuac

SEQ ID NO: 1877576 - RNA, 13 nt, Homo sapiens
uacaaaugacucc

SEQ ID NO: 1877577 - RNA, 18 nt, Homo sapiens
gagaagucaaacauuuca

SEQ ID NO: 1877578 - RNA, 19 nt, Homo sapiens
aaucacgagaucuuccuuc

SEQ ID NO: 1877579 - RNA, 19 nt, Homo sapiens
aaugccugcugcugccaag

SEQ ID NO: 1877580 - RNA, 16 nt, Homo sapiens
acagggccgccggcaa

SEQ ID NO: 1877581 - RNA, 13 nt, Homo sapiens
ugcagcuacugga

SEQ ID NO: 1877582 - RNA, 15 nt, Homo sapiens
cucagguugucugua

SEQ ID NO: 1877583 - RNA, 15 nt, Homo sapiens
ucugagauugaauau

SEQ ID NO: 1877584 - RNA, 20 nt, Homo sapiens
ucacuuuuuguggauuugug

SEQ ID NO: 1877585 - RNA, 19 nt, Homo sapiens
aggaggcugcccugagggg

SEQ ID NO: 1877586 - RNA, 19 nt, Homo sapiens
ucugcauuuagcacaaaaa

SEQ ID NO: 1877587 - RNA, 12 nt, Homo sapiens
aaaugcuuuaac

SEQ ID NO: 1877588 - RNA, 13 nt, Homo sapiens
cauaaacugccaa

SEQ ID NO: 1877589 - RNA, 14 nt, Homo sapiens
caguggcccggcuu

SEQ ID NO: 1877590 - RNA, 19 nt, Homo sapiens
cuggcugaacccugugcug

SEQ ID NO: 1877591 - RNA, 20 nt, Homo sapiens
aggguuacuugcugcucaca

SEQ ID NO: 1877592 - RNA, 18 nt, Homo sapiens
cugugccucccaagcuca

SEQ ID NO: 1877593 - RNA, 22 nt, Homo sapiens
cuccucaugcccccucagugag

SEQ ID NO: 1877594 - RNA, 14 nt, Homo sapiens
ucauguugcaaaga

SEQ ID NO: 1877595 - RNA, 20 nt, Homo sapiens
aaugcaguggcgccaucuca

SEQ ID NO: 1877596 - RNA, 20 nt, Homo sapiens
ucggcuucccaaagugcuga

SEQ ID NO: 1877597 - RNA, 13 nt, Homo sapiens
aauaaauacgugu

SEQ ID NO: 1877598 - RNA, 23 nt, Homo sapiens
aagcucaucucagucauccugca

SEQ ID NO: 1877599 - RNA, 19 nt, Homo sapiens
cugccaaugauuccagacg

SEQ ID NO: 1877600 - RNA, 12 nt, Homo sapiens
caauaccaaugu

SEQ ID NO: 1877601 - RNA, 23 nt, Homo sapiens
uaucuauuugagauugaugacaa

SEQ ID NO: 1877602 - RNA, 19 nt, Homo sapiens
ccugauuccuuuaaaugaa

SEQ ID NO: 1877603 - RNA, 16 nt, Homo sapiens
agccuucugaccuggg

SEQ ID NO: 1877604 - RNA, 17 nt, Homo sapiens
cacccaagcagagcaau

SEQ ID NO: 1877605 - RNA, 12 nt, Homo sapiens
cuccuugccacc

SEQ ID NO: 1877606 - RNA, 19 nt, Homo sapiens
ucaugcugaauacuccucc

SEQ ID NO: 1877607 - RNA, 16 nt, Homo sapiens
cugaaucagcaugaaa

SEQ ID NO: 1877608 - RNA, 14 nt, Homo sapiens
cagccaacuauggc

SEQ ID NO: 1877609 - RNA, 17 nt, Homo sapiens
cugccauguugccccuu

SEQ ID NO: 1877610 - RNA, 21 nt, Homo sapiens
caagcaaaaacaaaugggaaa

SEQ ID NO: 1877611 - RNA, 16 nt, Homo sapiens
acucagugauacucau

SEQ ID NO: 1877612 - RNA, 14 nt, Homo sapiens
acauuucugacacc

SEQ ID NO: 1877613 - RNA, 12 nt, Homo sapiens
aacaugacuaua

SEQ ID NO: 1877614 - RNA, 14 nt, Homo sapiens
gaagagaauauucc

SEQ ID NO: 1877615 - RNA, 13 nt, Homo sapiens
uuugccaggugac

SEQ ID NO: 1877616 - RNA, 20 nt, Homo sapiens
ucagagaaugaucacccuga

SEQ ID NO: 1877617 - RNA, 15 nt, Homo sapiens
cucuggcucuugucc

SEQ ID NO: 1877618 - RNA, 16 nt, Homo sapiens
cugagugagccacaga

SEQ ID NO: 1877619 - RNA, 20 nt, Homo sapiens
gaaagugcauuaaacugaau

SEQ ID NO: 1877620 - RNA, 18 nt, Homo sapiens
uaaaauguuauauaauaa

SEQ ID NO: 1877621 - RNA, 18 nt, Homo sapiens
caguagcaaacuuuucac

SEQ ID NO: 1877622 - RNA, 14 nt, Homo sapiens
ccugcccugccuca

SEQ ID NO: 1877623 - RNA, 20 nt, Homo sapiens
cuucagaaaagacacuucaa

SEQ ID NO: 1877624 - RNA, 14 nt, Homo sapiens
ggcacccacccugg

SEQ ID NO: 1877625 - RNA, 18 nt, Homo sapiens
caggugugacucuagcaa

SEQ ID NO: 1877626 - RNA, 20 nt, Homo sapiens
uauguggaagaacugugaua

SEQ ID NO: 1877627 - RNA, 18 nt, Homo sapiens
caccccagccucacucca

SEQ ID NO: 1877628 - RNA, 21 nt, Homo sapiens
aauuauguuuccgaggcacug

SEQ ID NO: 1877629 - RNA, 19 nt, Homo sapiens
acaaauaauaaauguucuc

SEQ ID NO: 1877630 - RNA, 22 nt, Homo sapiens
agccaauaaaccgaaaguguua

SEQ ID NO: 1877631 - RNA, 17 nt, Homo sapiens
cuauaaauauacauaua

SEQ ID NO: 1877632 - RNA, 15 nt, Homo sapiens
auucauuauuccuca

SEQ ID NO: 1877633 - RNA, 16 nt, Homo sapiens
uggcacccaugcaccu

SEQ ID NO: 1877634 - RNA, 23 nt, Homo sapiens
caggugggagauuuggaauacac

SEQ ID NO: 1877635 - RNA, 22 nt, Homo sapiens
uaguaaagccguuguuuacuua

SEQ ID NO: 1877636 - RNA, 15 nt, Homo sapiens
ugauaauaugcaaau

SEQ ID NO: 1877637 - RNA, 15 nt, Homo sapiens
gaaauuaagacuuua

SEQ ID NO: 1877638 - RNA, 16 nt, Homo sapiens
gcaaaaaacauacuua

SEQ ID NO: 1877639 - RNA, 15 nt, Homo sapiens
uaaaacccaaaacag

SEQ ID NO: 1877640 - RNA, 14 nt, Homo sapiens
gccagcccacuggg

SEQ ID NO: 1877641 - RNA, 18 nt, Homo sapiens
acagaaaauacgagaaaa

SEQ ID NO: 1877642 - RNA, 14 nt, Homo sapiens
ugcuugaacccaag

SEQ ID NO: 1877643 - RNA, 21 nt, Homo sapiens
uaagaaagugcgaguccucca

SEQ ID NO: 1877644 - RNA, 22 nt, Homo sapiens
gaagaagggagacgaaaaucca

SEQ ID NO: 1877645 - RNA, 18 nt, Homo sapiens
agcagagcgucuggcaca

SEQ ID NO: 1877646 - RNA, 22 nt, Homo sapiens
cuucucccgauggccacugggu

SEQ ID NO: 1877647 - RNA, 18 nt, Homo sapiens
gacugccaugcuagacaa

SEQ ID NO: 1877648 - RNA, 13 nt, Homo sapiens
gcuuuugaugaaa

SEQ ID NO: 1877649 - RNA, 19 nt, Homo sapiens
ugacauaauuuacaugcaa

SEQ ID NO: 1877650 - RNA, 17 nt, Homo sapiens
ccagagccucaaaugag

SEQ ID NO: 1877651 - RNA, 13 nt, Homo sapiens
accuucuguaaua

SEQ ID NO: 1877652 - RNA, 22 nt, Homo sapiens
acauuucuggacaguaccugau

SEQ ID NO: 1877653 - RNA, 16 nt, Homo sapiens
uccaauggcuguaaac

SEQ ID NO: 1877654 - RNA, 15 nt, Homo sapiens
ugccagcauaugcag

SEQ ID NO: 1877655 - RNA, 18 nt, Homo sapiens
aggagggagagaacuuaa

SEQ ID NO: 1877656 - RNA, 20 nt, Homo sapiens
uaagaugaaacaucauuuca

SEQ ID NO: 1877657 - RNA, 14 nt, Homo sapiens
ucaauucugucuca

SEQ ID NO: 1877658 - RNA, 15 nt, Homo sapiens
aagaaccccucugcu

SEQ ID NO: 1877659 - RNA, 21 nt, Homo sapiens
uccucuuggagaaaauaacaa

SEQ ID NO: 1877660 - RNA, 13 nt, Homo sapiens
gagauuuugcaau

SEQ ID NO: 1877661 - RNA, 22 nt, Homo sapiens
uuucccuacuaacaucccaaua

SEQ ID NO: 1877662 - RNA, 13 nt, Homo sapiens
uaaaugcuacuga

SEQ ID NO: 1877663 - RNA, 14 nt, Homo sapiens
cagccccugccucg

SEQ ID NO: 1877664 - RNA, 19 nt, Homo sapiens
uuccagcugacaucuugca

SEQ ID NO: 1877665 - RNA, 20 nt, Homo sapiens
cucccggggguguaucugag

SEQ ID NO: 1877666 - RNA, 18 nt, Homo sapiens
aaaauucugauacauuag

SEQ ID NO: 1877667 - RNA, 16 nt, Homo sapiens
acuuuuccaacauaca

SEQ ID NO: 1877668 - RNA, 14 nt, Homo sapiens
gcugugcacaccug

SEQ ID NO: 1877669 - RNA, 18 nt, Homo sapiens
cugggacacuuaacagau

SEQ ID NO: 1877670 - RNA, 22 nt, Homo sapiens
aauaauaggccaggcacugugg

SEQ ID NO: 1877671 - RNA, 22 nt, Homo sapiens
ucguccgucugucucgaugccu

SEQ ID NO: 1877672 - RNA, 18 nt, Homo sapiens
agccugcugccugcuuuu

SEQ ID NO: 1877673 - RNA, 15 nt, Homo sapiens
ugagaaacaucucaa

SEQ ID NO: 1877674 - RNA, 16 nt, Homo sapiens
uucaccucuuugcucc

SEQ ID NO: 1877675 - RNA, 20 nt, Homo sapiens
cuuaaacagcagauuucaga

SEQ ID NO: 1877676 - RNA, 14 nt, Homo sapiens
ucuggcauaugauu

SEQ ID NO: 1877677 - RNA, 13 nt, Homo sapiens
aacaaaucuucaa

SEQ ID NO: 1877678 - RNA, 22 nt, Homo sapiens
aaauucauuuuuuucacuggag

SEQ ID NO: 1877679 - RNA, 21 nt, Homo sapiens
uacaagugguuaaaacauagc

SEQ ID NO: 1877680 - RNA, 18 nt, Homo sapiens
acgaaacacagaacucag

SEQ ID NO: 1877681 - RNA, 18 nt, Homo sapiens
ugucaccaugauucuguc

SEQ ID NO: 1877682 - RNA, 13 nt, Homo sapiens
aacgcaugcaggg

SEQ ID NO: 1877683 - RNA, 21 nt, Homo sapiens
uguauaauuugaggugaaauu

SEQ ID NO: 1877684 - RNA, 17 nt, Homo sapiens
gucccccacgugugaag

SEQ ID NO: 1877685 - RNA, 18 nt, Homo sapiens
gguaugaucacggcucac

SEQ ID NO: 1877686 - RNA, 17 nt, Homo sapiens
agccucccgaguagcug

SEQ ID NO: 1877687 - RNA, 17 nt, Homo sapiens
agccucccaaguagcua

SEQ ID NO: 1877688 - RNA, 23 nt, Homo sapiens
aauuuuauaucuuguagcuuuau

SEQ ID NO: 1877689 - RNA, 16 nt, Homo sapiens
agguauuagugcuagu

SEQ ID NO: 1877690 - RNA, 17 nt, Homo sapiens
agcaugcuauggcauuu

SEQ ID NO: 1877691 - RNA, 21 nt, Homo sapiens
uagcccaggccagagugcagu

SEQ ID NO: 1877692 - RNA, 19 nt, Homo sapiens
gcagaagguuacuaccuag

SEQ ID NO: 1877693 - RNA, 15 nt, Homo sapiens
gagguugaagccaag

SEQ ID NO: 1877694 - RNA, 23 nt, Homo sapiens
agaagaguuucuccuuuugacca

SEQ ID NO: 1877695 - RNA, 19 nt, Homo sapiens
ugaauauuuaguguucaua

SEQ ID NO: 1877696 - RNA, 21 nt, Homo sapiens
gaaacggucacgagacccaga

SEQ ID NO: 1877697 - RNA, 17 nt, Homo sapiens
ccaaaugaaaugccaaa

SEQ ID NO: 1877698 - RNA, 18 nt, Homo sapiens
ggcagcaugcgaugucau

SEQ ID NO: 1877699 - RNA, 14 nt, Homo sapiens
aaccgugugucaug

SEQ ID NO: 1877700 - RNA, 19 nt, Homo sapiens
gcuuuauaccccauuugau

SEQ ID NO: 1877701 - RNA, 22 nt, Homo sapiens
cucuccugauuauuuaucacau

SEQ ID NO: 1877702 - RNA, 20 nt, Homo sapiens
gguuuuuuucuuuggcugca

SEQ ID NO: 1877703 - RNA, 17 nt, Homo sapiens
caaaaggcugauuacug

SEQ ID NO: 1877704 - RNA, 21 nt, Homo sapiens
aagaaagcuucuugugauccu

SEQ ID NO: 1877705 - RNA, 20 nt, Homo sapiens
cagugugcaauacuguguac

SEQ ID NO: 1877706 - RNA, 14 nt, Homo sapiens
guauccucuugcca

SEQ ID NO: 1877707 - RNA, 21 nt, Homo sapiens
gccagcccucgguaucugcag

SEQ ID NO: 1877708 - RNA, 17 nt, Homo sapiens
augacuccuacuuuuca

SEQ ID NO: 1877709 - RNA, 21 nt, Homo sapiens
auccauucccaagaugccuga

SEQ ID NO: 1877710 - RNA, 19 nt, Homo sapiens
cgagacuccgucucaagga

SEQ ID NO: 1877711 - RNA, 23 nt, Homo sapiens
aggcagggugagcuccagcugcu

SEQ ID NO: 1877712 - RNA, 11 nt, Homo sapiens
uucacugugag

SEQ ID NO: 1877713 - RNA, 21 nt, Homo sapiens
ucugcaauggcagcaggaucu

SEQ ID NO: 1877714 - RNA, 16 nt, Homo sapiens
gaacugguaccaucua

SEQ ID NO: 1877715 - RNA, 15 nt, Homo sapiens
cuggcuuaaacaaca

SEQ ID NO: 1877716 - RNA, 17 nt, Homo sapiens
acuuggucuuacaucug

SEQ ID NO: 1877717 - RNA, 19 nt, Homo sapiens
auauuucuggguucucaau

SEQ ID NO: 1877718 - RNA, 19 nt, Homo sapiens
ccaaagagggcuuccucua

SEQ ID NO: 1877719 - RNA, 17 nt, Homo sapiens
auuggccuccaaacaca

SEQ ID NO: 1877720 - RNA, 17 nt, Homo sapiens
ucaaacaaauguaaaua

SEQ ID NO: 1877721 - RNA, 21 nt, Homo sapiens
uugacaccuagauuauagucu

SEQ ID NO: 1877722 - RNA, 18 nt, Homo sapiens
uacaugacugaaggacau

SEQ ID NO: 1877723 - RNA, 23 nt, Homo sapiens
gcaaucugcccauucaucuucau

SEQ ID NO: 1877724 - RNA, 13 nt, Homo sapiens
gaaguggccagag

SEQ ID NO: 1877725 - RNA, 14 nt, Homo sapiens
ggcuggguggcacc

SEQ ID NO: 1877726 - RNA, 19 nt, Homo sapiens
gaaaaaccaccaccaucac

SEQ ID NO: 1877727 - RNA, 15 nt, Homo sapiens
ugaggacaaaaucac

SEQ ID NO: 1877728 - RNA, 22 nt, Homo sapiens
ggagaaggagagggaguacaaa

SEQ ID NO: 1877729 - RNA, 19 nt, Homo sapiens
guggcacgugccugugauc

SEQ ID NO: 1877730 - RNA, 16 nt, Homo sapiens
uaacacugucaucugu

SEQ ID NO: 1877731 - RNA, 23 nt, Homo sapiens
gcaggaauaaagacuugugcauc

SEQ ID NO: 1877732 - RNA, 17 nt, Homo sapiens
acucuguuauuuagacu

SEQ ID NO: 1877733 - RNA, 18 nt, Homo sapiens
cuauucccuaacucucgg

SEQ ID NO: 1877734 - RNA, 19 nt, Homo sapiens
gagaggggccgaugcccag

SEQ ID NO: 1877735 - RNA, 18 nt, Homo sapiens
cuaauuauacuacuuugu

SEQ ID NO: 1877736 - RNA, 11 nt, Homo sapiens
uguaugccaau

SEQ ID NO: 1877737 - RNA, 13 nt, Homo sapiens
uguuccccagaga

SEQ ID NO: 1877738 - RNA, 13 nt, Homo sapiens
cuaugccaugugc

SEQ ID NO: 1877739 - RNA, 15 nt, Homo sapiens
ugcucuugcauucuc

SEQ ID NO: 1877740 - RNA, 16 nt, Homo sapiens
cccagggccccuguga

SEQ ID NO: 1877741 - RNA, 18 nt, Homo sapiens
uuguuuaccgagcacugu

SEQ ID NO: 1877742 - RNA, 10 nt, Homo sapiens
ccugccugua

SEQ ID NO: 1877743 - RNA, 22 nt, Homo sapiens
acuucauauuguugcauugcuu

SEQ ID NO: 1877744 - RNA, 17 nt, Homo sapiens
aauaaaaaggcaaucac

SEQ ID NO: 1877745 - RNA, 17 nt, Homo sapiens
ccuuucagugcaguuuc

SEQ ID NO: 1877746 - RNA, 23 nt, Homo sapiens
cacaggcccuggcugaggucucu

SEQ ID NO: 1877747 - RNA, 19 nt, Homo sapiens
ccagugagauuacagagga

SEQ ID NO: 1877748 - RNA, 18 nt, Homo sapiens
ggguccucaguccacugc

SEQ ID NO: 1877749 - RNA, 15 nt, Homo sapiens
auccucacaaccacc

SEQ ID NO: 1877750 - RNA, 16 nt, Homo sapiens
uccagaguaagugaug

SEQ ID NO: 1877751 - RNA, 14 nt, Homo sapiens
cuuugugggcucca

SEQ ID NO: 1877752 - RNA, 13 nt, Homo sapiens
aagucaugggaga

SEQ ID NO: 1877753 - RNA, 16 nt, Homo sapiens
agggaagaggggugca

SEQ ID NO: 1877754 - RNA, 13 nt, Homo sapiens
gugguugcuguug

SEQ ID NO: 1877755 - RNA, 18 nt, Homo sapiens
agccuggccaccagccau

SEQ ID NO: 1877756 - RNA, 12 nt, Homo sapiens
ucuucacucuga

SEQ ID NO: 1877757 - RNA, 11 nt, Homo sapiens
uaaaugcccug

SEQ ID NO: 1877758 - RNA, 16 nt, Homo sapiens
ccauaagaaagcacua

SEQ ID NO: 1877759 - RNA, 22 nt, Homo sapiens
auuagccagggugguggugcac

SEQ ID NO: 1877760 - RNA, 19 nt, Homo sapiens
cugagacaaauuuuaacuu

SEQ ID NO: 1877761 - RNA, 13 nt, Homo sapiens
ggcauugcucagc

SEQ ID NO: 1877762 - RNA, 14 nt, Homo sapiens
cuuuucuuugccau

SEQ ID NO: 1877763 - RNA, 13 nt, Homo sapiens
aagcaaggccaaa

SEQ ID NO: 1877764 - RNA, 18 nt, Homo sapiens
aucuauugcucaucagcu

SEQ ID NO: 1877765 - RNA, 18 nt, Homo sapiens
cuggguugguauggaguu

SEQ ID NO: 1877766 - RNA, 16 nt, Homo sapiens
cuaugugcacacuuac

SEQ ID NO: 1877767 - RNA, 16 nt, Homo sapiens
ucccugucauuugaac

SEQ ID NO: 1877768 - RNA, 17 nt, Homo sapiens
agcacagcguuaugugu

SEQ ID NO: 1877769 - RNA, 13 nt, Homo sapiens
ugcagcagucgcc

SEQ ID NO: 1877770 - RNA, 15 nt, Homo sapiens
ccuuguaaagacaga

SEQ ID NO: 1877771 - RNA, 18 nt, Homo sapiens
cugacuuccaagauccuu

SEQ ID NO: 1877772 - RNA, 17 nt, Homo sapiens
cuuuccugaauccaaac

SEQ ID NO: 1877773 - RNA, 14 nt, Homo sapiens
cugacuaccagcua

SEQ ID NO: 1877774 - RNA, 20 nt, Homo sapiens
uuaccuucuaccucuuggcu

SEQ ID NO: 1877775 - RNA, 17 nt, Homo sapiens
auuauuagacucuaaaa

SEQ ID NO: 1877776 - RNA, 16 nt, Homo sapiens
cauacauauuaucuca

SEQ ID NO: 1877777 - RNA, 14 nt, Homo sapiens
cugggcagcuccuc

SEQ ID NO: 1877778 - RNA, 14 nt, Homo sapiens
cuuugcugcagaac

SEQ ID NO: 1877779 - RNA, 16 nt, Homo sapiens
ucacccugacuguggg

SEQ ID NO: 1877780 - RNA, 18 nt, Homo sapiens
ucaugaagaaaagaccuu

SEQ ID NO: 1877781 - RNA, 18 nt, Homo sapiens
accacuagaacucuccau

SEQ ID NO: 1877782 - RNA, 18 nt, Homo sapiens
aagugccuagacuguuac

SEQ ID NO: 1877783 - RNA, 21 nt, Homo sapiens
uguuacuugaaauaccaguga

SEQ ID NO: 1877784 - RNA, 20 nt, Homo sapiens
caacccauaaucauguaaau

SEQ ID NO: 1877785 - RNA, 18 nt, Homo sapiens
cuccagucuggcaacaga

SEQ ID NO: 1877786 - RNA, 15 nt, Homo sapiens
cauguucaugugauu

SEQ ID NO: 1877787 - RNA, 17 nt, Homo sapiens
gccaccggugggcagug

SEQ ID NO: 1877788 - RNA, 18 nt, Homo sapiens
ucucuauucucugcaauu

SEQ ID NO: 1877789 - RNA, 22 nt, Homo sapiens
uucaaaauugcuucuucuucaa

SEQ ID NO: 1877790 - RNA, 16 nt, Homo sapiens
aucucauuacugcuuc

SEQ ID NO: 1877791 - RNA, 23 nt, Homo sapiens
cauguaauauaagugaacaacug

SEQ ID NO: 1877792 - RNA, 20 nt, Homo sapiens
gcgcacacacagauaugcac

SEQ ID NO: 1877793 - RNA, 19 nt, Homo sapiens
ccaagaauggaggcuguag

SEQ ID NO: 1877794 - RNA, 15 nt, Homo sapiens
ccugcucugcuuccu

SEQ ID NO: 1877795 - RNA, 13 nt, Homo sapiens
gaaucacuugaac

SEQ ID NO: 1877796 - RNA, 17 nt, Homo sapiens
gccauggcaacuuagag

SEQ ID NO: 1877797 - RNA, 22 nt, Homo sapiens
ugugccuggaagaguuggucuc

SEQ ID NO: 1877798 - RNA, 11 nt, Homo sapiens
gcaaucacaac

SEQ ID NO: 1877799 - RNA, 21 nt, Homo sapiens
cacaguggauggacggacaag

SEQ ID NO: 1877800 - RNA, 19 nt, Homo sapiens
aagucauggacauucaugc

SEQ ID NO: 1877801 - RNA, 21 nt, Homo sapiens
acuuauaaaucauauugauga

SEQ ID NO: 1877802 - RNA, 21 nt, Homo sapiens
gcuucaugaauuucuccuuuc

SEQ ID NO: 1877803 - RNA, 14 nt, Homo sapiens
cugcugaucaauga

SEQ ID NO: 1877804 - RNA, 14 nt, Homo sapiens
caccuaugacauac

SEQ ID NO: 1877805 - RNA, 20 nt, Homo sapiens
uccuucccaagguacagcug

SEQ ID NO: 1877806 - RNA, 14 nt, Homo sapiens
cacuaccauugcug

SEQ ID NO: 1877807 - RNA, 18 nt, Homo sapiens
gugcaguaguaauugauu

SEQ ID NO: 1877808 - RNA, 10 nt, Homo sapiens
guuggaagag

SEQ ID NO: 1877809 - RNA, 15 nt, Homo sapiens
uccccaguacagggg

SEQ ID NO: 1877810 - RNA, 21 nt, Homo sapiens
ucaaaguuuggauuguaucaa

SEQ ID NO: 1877811 - RNA, 20 nt, Homo sapiens
auguguucucggagugugua

SEQ ID NO: 1877812 - RNA, 16 nt, Homo sapiens
aaccaauggaauguga

SEQ ID NO: 1877813 - RNA, 23 nt, Homo sapiens
ggccuggacuuccagugcucaga

SEQ ID NO: 1877814 - RNA, 16 nt, Homo sapiens
gacuuagccugaguca

SEQ ID NO: 1877815 - RNA, 19 nt, Homo sapiens
gacacauugccccaugaga

SEQ ID NO: 1877816 - RNA, 22 nt, Homo sapiens
aaagaacacaucaccuuccuga

SEQ ID NO: 1877817 - RNA, 23 nt, Homo sapiens
ccuucucugucugccucuccaca

SEQ ID NO: 1877818 - RNA, 23 nt, Homo sapiens
gaaacaaaacuagguaaaaucua

SEQ ID NO: 1877819 - RNA, 15 nt, Homo sapiens
acuauggagugcuca

SEQ ID NO: 1877820 - RNA, 22 nt, Homo sapiens
gaccacaguggccaagaucaca

SEQ ID NO: 1877821 - RNA, 19 nt, Homo sapiens
agccacuccccuccacucu

SEQ ID NO: 1877822 - RNA, 16 nt, Homo sapiens
ggguccucagccucag

SEQ ID NO: 1877823 - RNA, 22 nt, Homo sapiens
cucaagugaucuucccacacca

SEQ ID NO: 1877824 - RNA, 12 nt, Homo sapiens
caggacuguuga

SEQ ID NO: 1877825 - RNA, 20 nt, Homo sapiens
cagaacugcuugaacccagg

SEQ ID NO: 1877826 - RNA, 22 nt, Homo sapiens
uaaaccauucuugggaggacac

SEQ ID NO: 1877827 - RNA, 17 nt, Homo sapiens
aaaagauucaaaucucc

SEQ ID NO: 1877828 - RNA, 15 nt, Homo sapiens
agccagacuuguucu

SEQ ID NO: 1877829 - RNA, 18 nt, Homo sapiens
gaaguaggcauauaucac

SEQ ID NO: 1877830 - RNA, 14 nt, Homo sapiens
ucaaaucauuccuu

SEQ ID NO: 1877831 - RNA, 17 nt, Homo sapiens
auauuauacagaccgaa

SEQ ID NO: 1877832 - RNA, 16 nt, Homo sapiens
ucaaaagguagauccu

SEQ ID NO: 1877833 - RNA, 15 nt, Homo sapiens
ccauggaaugacuga

SEQ ID NO: 1877834 - RNA, 15 nt, Homo sapiens
ugauggcaccacugc

SEQ ID NO: 1877835 - RNA, 15 nt, Homo sapiens
cugaaaacuacacaa

SEQ ID NO: 1877836 - RNA, 22 nt, Homo sapiens
ccgaguggauagaugcccugcu

SEQ ID NO: 1877837 - RNA, 20 nt, Homo sapiens
ugucagacugcucuuucaua

SEQ ID NO: 1877838 - RNA, 23 nt, Homo sapiens
gauaggggcagauaggagcugca

SEQ ID NO: 1877839 - RNA, 23 nt, Homo sapiens
ucagugacagaguucacuauaaa

SEQ ID NO: 1877840 - RNA, 21 nt, Homo sapiens
agugcagugagccgagaucac

SEQ ID NO: 1877841 - RNA, 13 nt, Homo sapiens
aaaugugcacuuu

SEQ ID NO: 1877842 - RNA, 17 nt, Homo sapiens
caucaauauuauauuca

SEQ ID NO: 1877843 - RNA, 15 nt, Homo sapiens
uauaauauacuaugc

SEQ ID NO: 1877844 - RNA, 21 nt, Homo sapiens
caccuuuuccccaaccacaga

SEQ ID NO: 1877845 - RNA, 18 nt, Homo sapiens
ucauuguaaucacuguug

SEQ ID NO: 1877846 - RNA, 21 nt, Homo sapiens
acggagccgcgggacagccaa

SEQ ID NO: 1877847 - RNA, 15 nt, Homo sapiens
gaugcagagcuuuca

SEQ ID NO: 1877848 - RNA, 16 nt, Homo sapiens
cagaaugagaaagccu

SEQ ID NO: 1877849 - RNA, 21 nt, Homo sapiens
ccacucaggcauuugacugaa

SEQ ID NO: 1877850 - RNA, 13 nt, Homo sapiens
gacuguccacuuc

SEQ ID NO: 1877851 - RNA, 23 nt, Homo sapiens
aagggacaguuuguaacuugggc

SEQ ID NO: 1877852 - RNA, 14 nt, Homo sapiens
aauauacauucaaa

SEQ ID NO: 1877853 - RNA, 15 nt, Homo sapiens
acuucuggaauacug

SEQ ID NO: 1877854 - RNA, 22 nt, Homo sapiens
uuaaugacuggcuacagaguaa

SEQ ID NO: 1877855 - RNA, 18 nt, Homo sapiens
ugauggaccagcccugag

SEQ ID NO: 1877856 - RNA, 15 nt, Homo sapiens
ccucagaacuuucua

SEQ ID NO: 1877857 - RNA, 15 nt, Homo sapiens
uuaacauaccuaaga

SEQ ID NO: 1877858 - RNA, 15 nt, Homo sapiens
ccuauuuauucauuc

SEQ ID NO: 1877859 - RNA, 15 nt, Homo sapiens
cuagcgugugccagg

SEQ ID NO: 1877860 - RNA, 21 nt, Homo sapiens
agcacgguggugcccaagcca

SEQ ID NO: 1877861 - RNA, 19 nt, Homo sapiens
caccuugacaaaaucuuuu

SEQ ID NO: 1877862 - RNA, 22 nt, Homo sapiens
gcacacccuccagagacaacag

SEQ ID NO: 1877863 - RNA, 20 nt, Homo sapiens
caaagaaggaauucuaggca

SEQ ID NO: 1877864 - RNA, 15 nt, Homo sapiens
ucaaaccuuugccaa

SEQ ID NO: 1877865 - RNA, 23 nt, Homo sapiens
augucugugggcaggaagugaag

SEQ ID NO: 1877866 - RNA, 15 nt, Homo sapiens
uuucuauaccugucu

SEQ ID NO: 1877867 - RNA, 22 nt, Homo sapiens
cauuucuucucucugugcuggu

SEQ ID NO: 1877868 - RNA, 16 nt, Homo sapiens
ucauucugaaccuuau

SEQ ID NO: 1877869 - RNA, 15 nt, Homo sapiens
aaagugacuauucag

SEQ ID NO: 1877870 - RNA, 21 nt, Homo sapiens
uagugccacccaccuuugcca

SEQ ID NO: 1877871 - RNA, 18 nt, Homo sapiens
cccacauaauacauucca

SEQ ID NO: 1877872 - RNA, 21 nt, Homo sapiens
aaguuccaagagucuaaagau

SEQ ID NO: 1877873 - RNA, 20 nt, Homo sapiens
ccuggugaguaacuuagaaa

SEQ ID NO: 1877874 - RNA, 16 nt, Homo sapiens
caagacuauaccuuau

SEQ ID NO: 1877875 - RNA, 19 nt, Homo sapiens
uaaaaacugcccauuguaa

SEQ ID NO: 1877876 - RNA, 13 nt, Homo sapiens
uaaaacagucauc

SEQ ID NO: 1877877 - RNA, 15 nt, Homo sapiens
aaggaaaagcacaag

SEQ ID NO: 1877878 - RNA, 17 nt, Homo sapiens
ugucguaguuacucuca

SEQ ID NO: 1877879 - RNA, 23 nt, Homo sapiens
uuccggggcauuugggcacugua

SEQ ID NO: 1877880 - RNA, 21 nt, Homo sapiens
aaucaaggagucuucuaaugu

SEQ ID NO: 1877881 - RNA, 21 nt, Homo sapiens
ucaaauacuuagagcagugaa

SEQ ID NO: 1877882 - RNA, 21 nt, Homo sapiens
ugaauacauuaacggugcuaa

SEQ ID NO: 1877883 - RNA, 17 nt, Homo sapiens
uguucagcuccagcuca

SEQ ID NO: 1877884 - RNA, 19 nt, Homo sapiens
aauaguuccugaacauugc

SEQ ID NO: 1877885 - RNA, 15 nt, Homo sapiens
gggcccugcacagau

SEQ ID NO: 1877886 - RNA, 20 nt, Homo sapiens
gcagaguacuggcugaugga

SEQ ID NO: 1877887 - RNA, 20 nt, Homo sapiens
aauccuccccaccagucuca

SEQ ID NO: 1877888 - RNA, 20 nt, Homo sapiens
aauguauauacacauauacc

SEQ ID NO: 1877889 - RNA, 12 nt, Homo sapiens
ggacacaggcca

SEQ ID NO: 1877890 - RNA, 16 nt, Homo sapiens
acuaaugaaguauuac

SEQ ID NO: 1877891 - RNA, 21 nt, Homo sapiens
guaacaaauaaauaagaucag

SEQ ID NO: 1877892 - RNA, 19 nt, Homo sapiens
caggagcguguccuauccc

SEQ ID NO: 1877893 - RNA, 16 nt, Homo sapiens
caggcggggugggcag

SEQ ID NO: 1877894 - RNA, 17 nt, Homo sapiens
guauugucuuuugacau

SEQ ID NO: 1877895 - RNA, 12 nt, Homo sapiens
gauacuauucag

SEQ ID NO: 1877896 - RNA, 20 nt, Homo sapiens
cagagacccuggugcugcca

SEQ ID NO: 1877897 - RNA, 18 nt, Homo sapiens
gugguguuagggugcagc

SEQ ID NO: 1877898 - RNA, 21 nt, Homo sapiens
cuuccucaaauacaugcacag

SEQ ID NO: 1877899 - RNA, 13 nt, Homo sapiens
gcacugacacuca

SEQ ID NO: 1877900 - RNA, 20 nt, Homo sapiens
gucagauuaucuacuuagau

SEQ ID NO: 1877901 - RNA, 19 nt, Homo sapiens
ugccugggaucgugcauuu

SEQ ID NO: 1877902 - RNA, 18 nt, Homo sapiens
gugaaugcacugugugau

SEQ ID NO: 1877903 - RNA, 18 nt, Homo sapiens
ccuggcccuccaugacac

SEQ ID NO: 1877904 - RNA, 23 nt, Homo sapiens
caaauccuggaaggacacaguga

SEQ ID NO: 1877905 - RNA, 16 nt, Homo sapiens
gagcugauacuuugac

SEQ ID NO: 1877906 - RNA, 23 nt, Homo sapiens
acuuggaaccuuggaaaugacca

SEQ ID NO: 1877907 - RNA, 14 nt, Homo sapiens
auacauuauauucc

SEQ ID NO: 1877908 - RNA, 16 nt, Homo sapiens
cagaguucugugacac

SEQ ID NO: 1877909 - RNA, 16 nt, Homo sapiens
gucaaaaugaacucca

SEQ ID NO: 1877910 - RNA, 16 nt, Homo sapiens
ucuggugacaccagcc

SEQ ID NO: 1877911 - RNA, 15 nt, Homo sapiens
aaaguauugugaaag

SEQ ID NO: 1877912 - RNA, 14 nt, Homo sapiens
uccaaauaacauca

SEQ ID NO: 1877913 - RNA, 22 nt, Homo sapiens
ggcugccuuuguggugggcgcu

SEQ ID NO: 1877914 - RNA, 19 nt, Homo sapiens
cuucucaagcacugacacu

SEQ ID NO: 1877915 - RNA, 22 nt, Homo sapiens
auucuaaggaauaugagcuuua

SEQ ID NO: 1877916 - RNA, 22 nt, Homo sapiens
cagacucccaccccagggauug

SEQ ID NO: 1877917 - RNA, 15 nt, Homo sapiens
auuaauuuaugcaga

SEQ ID NO: 1877918 - RNA, 19 nt, Homo sapiens
ucugcccaccccagcauca

SEQ ID NO: 1877919 - RNA, 13 nt, Homo sapiens
gucaacauaugca

SEQ ID NO: 1877920 - RNA, 14 nt, Homo sapiens
cuggcaacaucuua

SEQ ID NO: 1877921 - RNA, 22 nt, Homo sapiens
ucacugacucaagacacugaga

SEQ ID NO: 1877922 - RNA, 19 nt, Homo sapiens
ugaaacacacaauguggac

SEQ ID NO: 1877923 - RNA, 20 nt, Homo sapiens
aucauuuaacugaacuguga

SEQ ID NO: 1877924 - RNA, 14 nt, Homo sapiens
agaccacuauucuu

SEQ ID NO: 1877925 - RNA, 19 nt, Homo sapiens
cacugcaggcaucacagcu

SEQ ID NO: 1877926 - RNA, 16 nt, Homo sapiens
uuaucuccugucuaca

SEQ ID NO: 1877927 - RNA, 16 nt, Homo sapiens
acaauaaaauuuugca

SEQ ID NO: 1877928 - RNA, 15 nt, Homo sapiens
gagagaaccucaggu

SEQ ID NO: 1877929 - RNA, 14 nt, Homo sapiens
aggagggugugagu

SEQ ID NO: 1877930 - RNA, 22 nt, Homo sapiens
uugcaugcuucgugccacacgc

SEQ ID NO: 1877931 - RNA, 19 nt, Homo sapiens
uuauauaaggcaguauuau

SEQ ID NO: 1877932 - RNA, 15 nt, Homo sapiens
ugagcaacaugguga

SEQ ID NO: 1877933 - RNA, 19 nt, Homo sapiens
aaaagcccaugaucuucaa

SEQ ID NO: 1877934 - RNA, 13 nt, Homo sapiens
gacagacccaggu

SEQ ID NO: 1877935 - RNA, 16 nt, Homo sapiens
caaucaggaauugaaa

SEQ ID NO: 1877936 - RNA, 14 nt, Homo sapiens
aucaaauacuagua

SEQ ID NO: 1877937 - RNA, 23 nt, Homo sapiens
cauaugagagcucuaguauuucc

SEQ ID NO: 1877938 - RNA, 22 nt, Homo sapiens
cugcacuuuggaaaccaagcaa

SEQ ID NO: 1877939 - RNA, 22 nt, Homo sapiens
aauccucuucuuuauacuguaa

SEQ ID NO: 1877940 - RNA, 17 nt, Homo sapiens
ucguucaaaacauucca

SEQ ID NO: 1877941 - RNA, 21 nt, Homo sapiens
ugccccaggccucgucuuuca

SEQ ID NO: 1877942 - RNA, 18 nt, Homo sapiens
guugcagcugcucuugca

SEQ ID NO: 1877943 - RNA, 19 nt, Homo sapiens
gaauguagagaauguagcc

SEQ ID NO: 1877944 - RNA, 20 nt, Homo sapiens
ccuuaaccucucuaagccac

SEQ ID NO: 1877945 - RNA, 18 nt, Homo sapiens
auuuauuaaauaaucucu

SEQ ID NO: 1877946 - RNA, 11 nt, Homo sapiens
uuggggguccu

SEQ ID NO: 1877947 - RNA, 20 nt, Homo sapiens
ucaaguaccaaaauguuaau

SEQ ID NO: 1877948 - RNA, 17 nt, Homo sapiens
gcccccucucuuacccc

SEQ ID NO: 1877949 - RNA, 18 nt, Homo sapiens
ggaggaccuggggcacag

SEQ ID NO: 1877950 - RNA, 16 nt, Homo sapiens
ucaauaauccaugaaa

SEQ ID NO: 1877951 - RNA, 18 nt, Homo sapiens
ccucaaccuccuggguuc

SEQ ID NO: 1877952 - RNA, 18 nt, Homo sapiens
gggcaugaagcugcauau

SEQ ID NO: 1877953 - RNA, 18 nt, Homo sapiens
guccaugugugugcaagu

SEQ ID NO: 1877954 - RNA, 22 nt, Homo sapiens
ggcugggaauggggacacggug

SEQ ID NO: 1877955 - RNA, 16 nt, Homo sapiens
guguucacacuguaaa

SEQ ID NO: 1877956 - RNA, 15 nt, Homo sapiens
cggcagucacuucca

SEQ ID NO: 1877957 - RNA, 15 nt, Homo sapiens
cccuucucuuuaauc

SEQ ID NO: 1877958 - RNA, 14 nt, Homo sapiens
aguggguacuuucu

SEQ ID NO: 1877959 - RNA, 22 nt, Homo sapiens
uucagcagcagcucacacccua

SEQ ID NO: 1877960 - RNA, 19 nt, Homo sapiens
uagaccagaaagugugugu

SEQ ID NO: 1877961 - RNA, 15 nt, Homo sapiens
acaaaugacaucaaa

SEQ ID NO: 1877962 - RNA, 16 nt, Homo sapiens
ucauguuggauaguca

SEQ ID NO: 1877963 - RNA, 23 nt, Homo sapiens
gugugguguccccuccuuucuau

SEQ ID NO: 1877964 - RNA, 17 nt, Homo sapiens
aaaugagugccacaaaa

SEQ ID NO: 1877965 - RNA, 22 nt, Homo sapiens
gaaacaugcaagauacaggaaa

SEQ ID NO: 1877966 - RNA, 13 nt, Homo sapiens
aucugagaucucc

SEQ ID NO: 1877967 - RNA, 18 nt, Homo sapiens
caaguugaaaaauagcau

SEQ ID NO: 1877968 - RNA, 16 nt, Homo sapiens
cuuccagugcauguug

SEQ ID NO: 1877969 - RNA, 16 nt, Homo sapiens
ugaacuauauuuacug

SEQ ID NO: 1877970 - RNA, 12 nt, Homo sapiens
aauuugcugcug

SEQ ID NO: 1877971 - RNA, 23 nt, Homo sapiens
ugcaagauuccuuuccacuccaa

SEQ ID NO: 1877972 - RNA, 16 nt, Homo sapiens
ccagggagggaagugu

SEQ ID NO: 1877973 - RNA, 14 nt, Homo sapiens
cguuucuuuccacc

SEQ ID NO: 1877974 - RNA, 17 nt, Homo sapiens
auuccuguugcucuguu

SEQ ID NO: 1877975 - RNA, 22 nt, Homo sapiens
caccugucaacuggagugcucu

SEQ ID NO: 1877976 - RNA, 16 nt, Homo sapiens
aagccggccugagaaa

SEQ ID NO: 1877977 - RNA, 14 nt, Homo sapiens
cuagggcagggaau

SEQ ID NO: 1877978 - RNA, 14 nt, Homo sapiens
aacugaaaggugau

SEQ ID NO: 1877979 - RNA, 15 nt, Homo sapiens
acuugaugauacaau

SEQ ID NO: 1877980 - RNA, 19 nt, Homo sapiens
aucucagcuggaucuccau

SEQ ID NO: 1877981 - RNA, 12 nt, Homo sapiens
cuuuccagccua

SEQ ID NO: 1877982 - RNA, 17 nt, Homo sapiens
auccaugaaacauuaca

SEQ ID NO: 1877983 - RNA, 23 nt, Homo sapiens
acuuuauguuacuacaugcacuu

SEQ ID NO: 1877984 - RNA, 12 nt, Homo sapiens
uccccacugugc

SEQ ID NO: 1877985 - RNA, 19 nt, Homo sapiens
ccuugauuuaucacacaaa

SEQ ID NO: 1877986 - RNA, 21 nt, Homo sapiens
uucuaaggauagccuuuguag

SEQ ID NO: 1877987 - RNA, 14 nt, Homo sapiens
uagcagcacagcug

SEQ ID NO: 1877988 - RNA, 22 nt, Homo sapiens
ucucagauugggauuaacauaa

SEQ ID NO: 1877989 - RNA, 15 nt, Homo sapiens
agcccucacauuaga

SEQ ID NO: 1877990 - RNA, 19 nt, Homo sapiens
aucucaggggucuuaccuu

SEQ ID NO: 1877991 - RNA, 18 nt, Homo sapiens
aagcaagcagaugaacua

SEQ ID NO: 1877992 - RNA, 13 nt, Homo sapiens
gcuuucagucuuc

SEQ ID NO: 1877993 - RNA, 13 nt, Homo sapiens
cuauguacuuuaa

SEQ ID NO: 1877994 - RNA, 13 nt, Homo sapiens
uaaaguaccauua

SEQ ID NO: 1877995 - RNA, 19 nt, Homo sapiens
gaagguacugaaggcuucu

SEQ ID NO: 1877996 - RNA, 14 nt, Homo sapiens
agacaggagacaug

SEQ ID NO: 1877997 - RNA, 18 nt, Homo sapiens
cuccacaggagagacugg

SEQ ID NO: 1877998 - RNA, 21 nt, Homo sapiens
cuguccccacagcaggugccu

SEQ ID NO: 1877999 - RNA, 17 nt, Homo sapiens
ggcuccuucccaucgcu

SEQ ID NO: 1878000 - RNA, 14 nt, Homo sapiens
aauagcucuuucag

SEQ ID NO: 1878001 - RNA, 18 nt, Homo sapiens
ugacccucuccccacugc

SEQ ID NO: 1878002 - RNA, 15 nt, Homo sapiens
uuuaaaaaacuaaaa

SEQ ID NO: 1878003 - RNA, 15 nt, Homo sapiens
uuuauuuaacuauuu

SEQ ID NO: 1878004 - RNA, 15 nt, Homo sapiens
caggauggcacuguu

SEQ ID NO: 1878005 - RNA, 20 nt, Homo sapiens
ggggagaaaaaaaaagcaaa

SEQ ID NO: 1878006 - RNA, 20 nt, Homo sapiens
cuuucugcaaaggcaccuga

SEQ ID NO: 1878007 - RNA, 17 nt, Homo sapiens
gcaggagauuugcuuga

SEQ ID NO: 1878008 - RNA, 24 nt, Homo sapiens
ucccuggcugaccugcuguggaug

SEQ ID NO: 1878009 - RNA, 16 nt, Homo sapiens
aauacaugccuuucca

SEQ ID NO: 1878010 - RNA, 17 nt, Homo sapiens
gcacuaauugacccaaa

SEQ ID NO: 1878011 - RNA, 17 nt, Homo sapiens
cagcuccuuucccugga

SEQ ID NO: 1878012 - RNA, 19 nt, Homo sapiens
uauucauuagggaaaugca

SEQ ID NO: 1878013 - RNA, 19 nt, Homo sapiens
accuccaagccacugagca

SEQ ID NO: 1878014 - RNA, 17 nt, Homo sapiens
uuuguugagccuaauau

SEQ ID NO: 1878015 - RNA, 22 nt, Homo sapiens
gaauggcacaugucauugccca

SEQ ID NO: 1878016 - RNA, 22 nt, Homo sapiens
acagggaaugccugagugccug

SEQ ID NO: 1878017 - RNA, 22 nt, Homo sapiens
cuagaccuggaccuggguggga

SEQ ID NO: 1878018 - RNA, 12 nt, Homo sapiens
ccauaagcagaa

SEQ ID NO: 1878019 - RNA, 22 nt, Homo sapiens
caaguccauguuauucucucac

SEQ ID NO: 1878020 - RNA, 13 nt, Homo sapiens
aaacaccaaguga

SEQ ID NO: 1878021 - RNA, 14 nt, Homo sapiens
uaaugaacacucau

SEQ ID NO: 1878022 - RNA, 15 nt, Homo sapiens
gugcuccggccaugg

SEQ ID NO: 1878023 - RNA, 19 nt, Homo sapiens
agcaaaguaaugguucuca

SEQ ID NO: 1878024 - RNA, 21 nt, Homo sapiens
ucugaccucaugagugucaaa

SEQ ID NO: 1878025 - RNA, 17 nt, Homo sapiens
caaacuaagcuauguga

SEQ ID NO: 1878026 - RNA, 13 nt, Homo sapiens
cgggagauugaac

SEQ ID NO: 1878027 - RNA, 19 nt, Homo sapiens
ccuggggccucaccugcug

SEQ ID NO: 1878028 - RNA, 23 nt, Homo sapiens
uaaggacaaagaaggaaauauca

SEQ ID NO: 1878029 - RNA, 13 nt, Homo sapiens
cuaaagcaagccu

SEQ ID NO: 1878030 - RNA, 22 nt, Homo sapiens
aucaauuuaaaggaaaguucua

SEQ ID NO: 1878031 - RNA, 19 nt, Homo sapiens
caguuucauuaacugguga

SEQ ID NO: 1878032 - RNA, 21 nt, Homo sapiens
auauuauuuuaguguguaaaa

SEQ ID NO: 1878033 - RNA, 22 nt, Homo sapiens
guuucucugccuucuuccagga

SEQ ID NO: 1878034 - RNA, 19 nt, Homo sapiens
uaaaguacuaaaucucacc

SEQ ID NO: 1878035 - RNA, 22 nt, Homo sapiens
ccaggaggauugccuuuaauau

SEQ ID NO: 1878036 - RNA, 13 nt, Homo sapiens
aaacucaagacaa

SEQ ID NO: 1878037 - RNA, 23 nt, Homo sapiens
cucauuaaaauugugaugcuccu

SEQ ID NO: 1878038 - RNA, 12 nt, Homo sapiens
accuugagcaaa

SEQ ID NO: 1878039 - RNA, 19 nt, Homo sapiens
caguguauuuaauguuugu

SEQ ID NO: 1878040 - RNA, 18 nt, Homo sapiens
ugcuuuuaaaauccacuu

SEQ ID NO: 1878041 - RNA, 16 nt, Homo sapiens
aguuucuaaaaacaca

SEQ ID NO: 1878042 - RNA, 16 nt, Homo sapiens
ccagcugcaccugcca

SEQ ID NO: 1878043 - RNA, 22 nt, Homo sapiens
agaccuggugcucuaaugccaa

SEQ ID NO: 1878044 - RNA, 22 nt, Homo sapiens
uuaaucucuaaaauucuagucu

SEQ ID NO: 1878045 - RNA, 16 nt, Homo sapiens
auauugugauucugcc

SEQ ID NO: 1878046 - RNA, 16 nt, Homo sapiens
uucagaggauaaauau

SEQ ID NO: 1878047 - RNA, 21 nt, Homo sapiens
acgucuguccuccuuucuuau

SEQ ID NO: 1878048 - RNA, 15 nt, Homo sapiens
ugugcauaucugccu

SEQ ID NO: 1878049 - RNA, 12 nt, Homo sapiens
gggcaagcuccu

SEQ ID NO: 1878050 - RNA, 24 nt, Homo sapiens
cacagacuggagacaaugcagaug

SEQ ID NO: 1878051 - RNA, 14 nt, Homo sapiens
cuguuccaccaaau

SEQ ID NO: 1878052 - RNA, 13 nt, Homo sapiens
agaaaagcacuuu

SEQ ID NO: 1878053 - RNA, 21 nt, Homo sapiens
gccacaaauaaguuacaucua

SEQ ID NO: 1878054 - RNA, 20 nt, Homo sapiens
aaacaugugguuaaugccau

SEQ ID NO: 1878055 - RNA, 18 nt, Homo sapiens
cacagaaacuauaugcaa

SEQ ID NO: 1878056 - RNA, 20 nt, Homo sapiens
ccuucggagccaacaagacc

SEQ ID NO: 1878057 - RNA, 14 nt, Homo sapiens
gcccaggcucugcu

SEQ ID NO: 1878058 - RNA, 20 nt, Homo sapiens
caugaauguucauauagcca

SEQ ID NO: 1878059 - RNA, 14 nt, Homo sapiens
accuauauugauuu

SEQ ID NO: 1878060 - RNA, 14 nt, Homo sapiens
ucacaaaaugcacu

SEQ ID NO: 1878061 - RNA, 15 nt, Homo sapiens
caauacauguuuuca

SEQ ID NO: 1878062 - RNA, 21 nt, Homo sapiens
ugcuguagacauuugcuauga

SEQ ID NO: 1878063 - RNA, 15 nt, Homo sapiens
agguuaagcacuuua

SEQ ID NO: 1878064 - RNA, 15 nt, Homo sapiens
uuccucucucagggg

SEQ ID NO: 1878065 - RNA, 16 nt, Homo sapiens
ugagcgccugugcaca

SEQ ID NO: 1878066 - RNA, 19 nt, Homo sapiens
gucuaauagucuuugccag

SEQ ID NO: 1878067 - RNA, 13 nt, Homo sapiens
uguuucugugcuc

SEQ ID NO: 1878068 - RNA, 14 nt, Homo sapiens
auaaauuugagcua

SEQ ID NO: 1878069 - RNA, 14 nt, Homo sapiens
augcuauugaaaau

SEQ ID NO: 1878070 - RNA, 14 nt, Homo sapiens
ugcuucagagcuca

SEQ ID NO: 1878071 - RNA, 20 nt, Homo sapiens
uauuucagccaaaacauacc

SEQ ID NO: 1878072 - RNA, 16 nt, Homo sapiens
cccagcccuacucugu

SEQ ID NO: 1878073 - RNA, 16 nt, Homo sapiens
gcgcugcaaagccaua

SEQ ID NO: 1878074 - RNA, 15 nt, Homo sapiens
ugcuauaauguauaa

SEQ ID NO: 1878075 - RNA, 15 nt, Homo sapiens
aggacacccaggaau

SEQ ID NO: 1878076 - RNA, 15 nt, Homo sapiens
ugaugaaaaccaccc

SEQ ID NO: 1878077 - RNA, 16 nt, Homo sapiens
caugcauuucaauaaa

SEQ ID NO: 1878078 - RNA, 17 nt, Homo sapiens
uucugccugagauucuu

SEQ ID NO: 1878079 - RNA, 14 nt, Homo sapiens
uccaguguccugag

SEQ ID NO: 1878080 - RNA, 19 nt, Homo sapiens
aaaaaguuuaagauugcaa

SEQ ID NO: 1878081 - RNA, 20 nt, Homo sapiens
uuuuugaaaguaaaagcagc

SEQ ID NO: 1878082 - RNA, 21 nt, Homo sapiens
uacuguuuucugggccaguga

SEQ ID NO: 1878083 - RNA, 18 nt, Homo sapiens
augaauauuuuguaacua

SEQ ID NO: 1878084 - RNA, 12 nt, Homo sapiens
ccagaaccacua

SEQ ID NO: 1878085 - RNA, 13 nt, Homo sapiens
auacaauuccaaa

SEQ ID NO: 1878086 - RNA, 15 nt, Homo sapiens
ugaaaugaaugucug

SEQ ID NO: 1878087 - RNA, 23 nt, Homo sapiens
acuggucuccuaaccaaggugca

SEQ ID NO: 1878088 - RNA, 14 nt, Homo sapiens
cauaugauucugcu

SEQ ID NO: 1878089 - RNA, 11 nt, Homo sapiens
caucuuucuaa

SEQ ID NO: 1878090 - RNA, 17 nt, Homo sapiens
gcggaggcgguggcaga

SEQ ID NO: 1878091 - RNA, 19 nt, Homo sapiens
auccagccaugccugaggu

SEQ ID NO: 1878092 - RNA, 19 nt, Homo sapiens
uagggcacuuuaagucagu

SEQ ID NO: 1878093 - RNA, 14 nt, Homo sapiens
gaucuccuguccau

SEQ ID NO: 1878094 - RNA, 15 nt, Homo sapiens
gccugggugcaaaga

SEQ ID NO: 1878095 - RNA, 17 nt, Homo sapiens
aacaccugauguguaca

SEQ ID NO: 1878096 - RNA, 20 nt, Homo sapiens
uugaauagauuuucucugga

SEQ ID NO: 1878097 - RNA, 14 nt, Homo sapiens
aacgucucucaccu

SEQ ID NO: 1878098 - RNA, 14 nt, Homo sapiens
uguaucaucagugc

SEQ ID NO: 1878099 - RNA, 15 nt, Homo sapiens
aacagaacuaucuca

SEQ ID NO: 1878100 - RNA, 13 nt, Homo sapiens
uguccuugcacac

SEQ ID NO: 1878101 - RNA, 21 nt, Homo sapiens
cuggaaugggcacagcacagc

SEQ ID NO: 1878102 - RNA, 23 nt, Homo sapiens
accucacucuugccaaccuguaa

SEQ ID NO: 1878103 - RNA, 12 nt, Homo sapiens
cuaauuccuguu

SEQ ID NO: 1878104 - RNA, 18 nt, Homo sapiens
gaagcccuccuugccacc

SEQ ID NO: 1878105 - RNA, 21 nt, Homo sapiens
gagcauugcagucacuuugac

SEQ ID NO: 1878106 - RNA, 17 nt, Homo sapiens
cauuggaauaaggcaug

SEQ ID NO: 1878107 - RNA, 18 nt, Homo sapiens
cagguuagggcucugccc

SEQ ID NO: 1878108 - RNA, 23 nt, Homo sapiens
agcuguccugaaccgacugaccc

SEQ ID NO: 1878109 - RNA, 14 nt, Homo sapiens
uaauauuuuccaua

SEQ ID NO: 1878110 - RNA, 20 nt, Homo sapiens
ugcagaaucagcaugauucu

SEQ ID NO: 1878111 - RNA, 16 nt, Homo sapiens
gcccuggccagggccu

SEQ ID NO: 1878112 - RNA, 20 nt, Homo sapiens
cucauccaggcuaccauccg

SEQ ID NO: 1878113 - RNA, 23 nt, Homo sapiens
cugguugaacucugguggcacag

SEQ ID NO: 1878114 - RNA, 17 nt, Homo sapiens
uggccgagucagcacgu

SEQ ID NO: 1878115 - RNA, 17 nt, Homo sapiens
gaccggaguuaugacaa

SEQ ID NO: 1878116 - RNA, 14 nt, Homo sapiens
gagcccacuuccau

SEQ ID NO: 1878117 - RNA, 23 nt, Homo sapiens
augcuggcccuacaguaccccca

SEQ ID NO: 1878118 - RNA, 14 nt, Homo sapiens
ccuaagcacuuuau

SEQ ID NO: 1878119 - RNA, 18 nt, Homo sapiens
aacaugcaguucauuauu

SEQ ID NO: 1878120 - RNA, 22 nt, Homo sapiens
cauugaggcaggcacugccaaa

SEQ ID NO: 1878121 - RNA, 14 nt, Homo sapiens
ucuucauaccuaca

SEQ ID NO: 1878122 - RNA, 14 nt, Homo sapiens
uuuaacuacuuuac

SEQ ID NO: 1878123 - RNA, 21 nt, Homo sapiens
cuaaaauauuuucuacaucuu

SEQ ID NO: 1878124 - RNA, 21 nt, Homo sapiens
gccugucggccacaccccaga

SEQ ID NO: 1878125 - RNA, 13 nt, Homo sapiens
cuaacacauuucg

SEQ ID NO: 1878126 - RNA, 19 nt, Homo sapiens
ugauucauaguaacuucuu

SEQ ID NO: 1878127 - RNA, 21 nt, Homo sapiens
aaaaguuagucaauccuguca

SEQ ID NO: 1878128 - RNA, 20 nt, Homo sapiens
ucggugacugguuaucacac

SEQ ID NO: 1878129 - RNA, 21 nt, Homo sapiens
cuuguuguaccgaaucaacug

SEQ ID NO: 1878130 - RNA, 18 nt, Homo sapiens
uucuugcucuaucucuca

SEQ ID NO: 1878131 - RNA, 20 nt, Homo sapiens
accuaaacgguucaguuucu

SEQ ID NO: 1878132 - RNA, 19 nt, Homo sapiens
cacuauucuuaagcacuuu

SEQ ID NO: 1878133 - RNA, 13 nt, Homo sapiens
gccugccuuaggg

SEQ ID NO: 1878134 - RNA, 21 nt, Homo sapiens
agaaugagaacauccaucuac

SEQ ID NO: 1878135 - RNA, 13 nt, Homo sapiens
aggaggaacaaag

SEQ ID NO: 1878136 - RNA, 15 nt, Homo sapiens
ugcaaacuuguuaga

SEQ ID NO: 1878137 - RNA, 19 nt, Homo sapiens
ugaaaccccaucucuacua

SEQ ID NO: 1878138 - RNA, 17 nt, Homo sapiens
aauauauccacacauuu

SEQ ID NO: 1878139 - RNA, 15 nt, Homo sapiens
cucaggagaagggau

SEQ ID NO: 1878140 - RNA, 17 nt, Homo sapiens
ucuguucaaagcugccu

SEQ ID NO: 1878141 - RNA, 16 nt, Homo sapiens
gaaaugacuucuccag

SEQ ID NO: 1878142 - RNA, 19 nt, Homo sapiens
ucaagcuaugugagcucac

SEQ ID NO: 1878143 - RNA, 15 nt, Homo sapiens
uucugagaaggugag

SEQ ID NO: 1878144 - RNA, 22 nt, Homo sapiens
agauguaaaugugccaagaaua

SEQ ID NO: 1878145 - RNA, 18 nt, Homo sapiens
cacaaauuuguaaacuuu

SEQ ID NO: 1878146 - RNA, 22 nt, Homo sapiens
gccucauccugagagaccugcc

SEQ ID NO: 1878147 - RNA, 19 nt, Homo sapiens
gaggccaguaccuuuccau

SEQ ID NO: 1878148 - RNA, 17 nt, Homo sapiens
ucugagacagaaucuca

SEQ ID NO: 1878149 - RNA, 22 nt, Homo sapiens
ccaccaauugccaaagguccaa

SEQ ID NO: 1878150 - RNA, 14 nt, Homo sapiens
cuccuaacccuuau

SEQ ID NO: 1878151 - RNA, 15 nt, Homo sapiens
caggcuuguggcagc

SEQ ID NO: 1878152 - RNA, 18 nt, Homo sapiens
guauucauuacuagauaa

SEQ ID NO: 1878153 - RNA, 21 nt, Homo sapiens
uggaaaauaaauucagaucaa

SEQ ID NO: 1878154 - RNA, 18 nt, Homo sapiens
acccacccuaauuugccc

SEQ ID NO: 1878155 - RNA, 23 nt, Homo sapiens
cuuguaaugguucuuuacacauc

SEQ ID NO: 1878156 - RNA, 16 nt, Homo sapiens
augauuaagugcacac

SEQ ID NO: 1878157 - RNA, 17 nt, Homo sapiens
aaagccugccucuucca

SEQ ID NO: 1878158 - RNA, 20 nt, Homo sapiens
uugagauaaugucaaaauca

SEQ ID NO: 1878159 - RNA, 15 nt, Homo sapiens
ucuuauuacugagag

SEQ ID NO: 1878160 - RNA, 19 nt, Homo sapiens
acagccaguaagugauaaa

SEQ ID NO: 1878161 - RNA, 19 nt, Homo sapiens
caugugugugcaagugugu

SEQ ID NO: 1878162 - RNA, 18 nt, Homo sapiens
caggaggaggaaagguag

SEQ ID NO: 1878163 - RNA, 16 nt, Homo sapiens
aaacagcuaguagaca

SEQ ID NO: 1878164 - RNA, 14 nt, Homo sapiens
gcugcccaggccac

SEQ ID NO: 1878165 - RNA, 20 nt, Homo sapiens
ugagggcgugaaacacaaua

SEQ ID NO: 1878166 - RNA, 12 nt, Homo sapiens
uucaaacauaua

SEQ ID NO: 1878167 - RNA, 12 nt, Homo sapiens
uucuaacauauu

SEQ ID NO: 1878168 - RNA, 19 nt, Homo sapiens
acagcuaucgaacuucaca

SEQ ID NO: 1878169 - RNA, 14 nt, Homo sapiens
uuucaaacauauau

SEQ ID NO: 1878170 - RNA, 18 nt, Homo sapiens
caacuucagaaggccuca

SEQ ID NO: 1878171 - RNA, 15 nt, Homo sapiens
ugagaagaugaucca

SEQ ID NO: 1878172 - RNA, 21 nt, Homo sapiens
cuguucucugcugagggccaa

SEQ ID NO: 1878173 - RNA, 15 nt, Homo sapiens
uuuaaagaagucucu

SEQ ID NO: 1878174 - RNA, 14 nt, Homo sapiens
uggagcugucuguc

SEQ ID NO: 1878175 - RNA, 20 nt, Homo sapiens
ugccgaguggucacugucag

SEQ ID NO: 1878176 - RNA, 16 nt, Homo sapiens
aaucaggagccugcua

SEQ ID NO: 1878177 - RNA, 17 nt, Homo sapiens
ggcaacaauaaaauagc

SEQ ID NO: 1878178 - RNA, 17 nt, Homo sapiens
gcagcagggggagcucc

SEQ ID NO: 1878179 - RNA, 13 nt, Homo sapiens
ugagacuguguug

SEQ ID NO: 1878180 - RNA, 20 nt, Homo sapiens
acucugccugaacacugcuu

SEQ ID NO: 1878181 - RNA, 21 nt, Homo sapiens
cacugugcucagccaccaucu

SEQ ID NO: 1878182 - RNA, 17 nt, Homo sapiens
cagcugucgcaucucag

SEQ ID NO: 1878183 - RNA, 11 nt, Homo sapiens
cauauguuaau

SEQ ID NO: 1878184 - RNA, 22 nt, Homo sapiens
ccaaauguaaaaauccuuuuga

SEQ ID NO: 1878185 - RNA, 16 nt, Homo sapiens
augaauaaagugcaaa

SEQ ID NO: 1878186 - RNA, 12 nt, Homo sapiens
ucaaaagcuuuu

SEQ ID NO: 1878187 - RNA, 12 nt, Homo sapiens
auuuaagcacaa

SEQ ID NO: 1878188 - RNA, 18 nt, Homo sapiens
ugaggaccaggugucucu

SEQ ID NO: 1878189 - RNA, 16 nt, Homo sapiens
uuaaaugauacaguau

SEQ ID NO: 1878190 - RNA, 23 nt, Homo sapiens
ugguuuuuguugagucucugaac

SEQ ID NO: 1878191 - RNA, 17 nt, Homo sapiens
cacugugaagagacuuu

SEQ ID NO: 1878192 - RNA, 19 nt, Homo sapiens
agcacucagccucauucag

SEQ ID NO: 1878193 - RNA, 14 nt, Homo sapiens
uucuccugccucag

SEQ ID NO: 1878194 - RNA, 21 nt, Homo sapiens
ugggcuguaaagcaaacuggg

SEQ ID NO: 1878195 - RNA, 16 nt, Homo sapiens
gacaaugaagugacac

SEQ ID NO: 1878196 - RNA, 20 nt, Homo sapiens
aaucaaaacccaacaugacu

SEQ ID NO: 1878197 - RNA, 18 nt, Homo sapiens
uggguccucggcccugua

SEQ ID NO: 1878198 - RNA, 24 nt, Homo sapiens
gaaauacuccagcaccuguggcug

SEQ ID NO: 1878199 - RNA, 17 nt, Homo sapiens
gugagaaauuucuguga

SEQ ID NO: 1878200 - RNA, 23 nt, Homo sapiens
guuucuugcucccagaccaaggc

SEQ ID NO: 1878201 - RNA, 15 nt, Homo sapiens
uguauuuucagcuca

SEQ ID NO: 1878202 - RNA, 17 nt, Homo sapiens
cuauuuacuuuauuaac

SEQ ID NO: 1878203 - RNA, 20 nt, Homo sapiens
uaaaacauguuugcacuugu

SEQ ID NO: 1878204 - RNA, 12 nt, Homo sapiens
cccccacuccag

SEQ ID NO: 1878205 - RNA, 14 nt, Homo sapiens
cuguugacauauuu

SEQ ID NO: 1878206 - RNA, 19 nt, Homo sapiens
caaggcccacuucuucuca

SEQ ID NO: 1878207 - RNA, 22 nt, Homo sapiens
gcagucuccgcucccgcagcgg

SEQ ID NO: 1878208 - RNA, 20 nt, Homo sapiens
augauuucauuaucacauga

SEQ ID NO: 1878209 - RNA, 22 nt, Homo sapiens
cugugaauggaggcagagaccu

SEQ ID NO: 1878210 - RNA, 18 nt, Homo sapiens
ugagugcacugacuguga

SEQ ID NO: 1878211 - RNA, 15 nt, Homo sapiens
uuagcagcucuuccc

SEQ ID NO: 1878212 - RNA, 18 nt, Homo sapiens
accagugauccauguccu

SEQ ID NO: 1878213 - RNA, 14 nt, Homo sapiens
agcgccugugcaca

SEQ ID NO: 1878214 - RNA, 21 nt, Homo sapiens
acccuguccuaugacuugauc

SEQ ID NO: 1878215 - RNA, 23 nt, Homo sapiens
uugcugugggugcagcugucaca

SEQ ID NO: 1878216 - RNA, 15 nt, Homo sapiens
gaggaaacucuguca

SEQ ID NO: 1878217 - RNA, 19 nt, Homo sapiens
acuuugaagcaaauacaau

SEQ ID NO: 1878218 - RNA, 19 nt, Homo sapiens
acuguuaccuaaguucuca

SEQ ID NO: 1878219 - RNA, 19 nt, Homo sapiens
uucaagaaagaauuccugc

SEQ ID NO: 1878220 - RNA, 12 nt, Homo sapiens
auugagauacua

SEQ ID NO: 1878221 - RNA, 17 nt, Homo sapiens
uuuuugagguggcacuu

SEQ ID NO: 1878222 - RNA, 21 nt, Homo sapiens
agacuggacuggaccagacaa

SEQ ID NO: 1878223 - RNA, 15 nt, Homo sapiens
ugaacacuagucugu

SEQ ID NO: 1878224 - RNA, 17 nt, Homo sapiens
guaaaggggcccagaaa

SEQ ID NO: 1878225 - RNA, 20 nt, Homo sapiens
cuagauaccuaaaacauaag

SEQ ID NO: 1878226 - RNA, 13 nt, Homo sapiens
gcagcuuguagua

SEQ ID NO: 1878227 - RNA, 14 nt, Homo sapiens
aguugcacugugac

SEQ ID NO: 1878228 - RNA, 14 nt, Homo sapiens
agaugaacugagaa

SEQ ID NO: 1878229 - RNA, 12 nt, Homo sapiens
uuuucuacugua

SEQ ID NO: 1878230 - RNA, 11 nt, Homo sapiens
cucucuugccc

SEQ ID NO: 1878231 - RNA, 19 nt, Homo sapiens
aagcauuuuuaaucugugu

SEQ ID NO: 1878232 - RNA, 19 nt, Homo sapiens
uccuugcccccagugccuc

SEQ ID NO: 1878233 - RNA, 22 nt, Homo sapiens
gacuugcacagggauucucaca

SEQ ID NO: 1878234 - RNA, 21 nt, Homo sapiens
ggccacccugccucuacccaa

SEQ ID NO: 1878235 - RNA, 20 nt, Homo sapiens
ccuucauuaacaaaauguau

SEQ ID NO: 1878236 - RNA, 22 nt, Homo sapiens
ucagaauuuaguguauccauaa

SEQ ID NO: 1878237 - RNA, 13 nt, Homo sapiens
gugguagcucuga

SEQ ID NO: 1878238 - RNA, 14 nt, Homo sapiens
accaauaaagccuu

SEQ ID NO: 1878239 - RNA, 17 nt, Homo sapiens
uguuguauuucuauaca

SEQ ID NO: 1878240 - RNA, 20 nt, Homo sapiens
uacagcagauccaccugcac

SEQ ID NO: 1878241 - RNA, 20 nt, Homo sapiens
gcaaguauguuuuagcaugu

SEQ ID NO: 1878242 - RNA, 14 nt, Homo sapiens
ugggaucagaucaa

SEQ ID NO: 1878243 - RNA, 18 nt, Homo sapiens
uuucucuggcuccagaau

SEQ ID NO: 1878244 - RNA, 23 nt, Homo sapiens
ucuagcauggcauauuuuucaca

SEQ ID NO: 1878245 - RNA, 15 nt, Homo sapiens
caguugacaaaaagc

SEQ ID NO: 1878246 - RNA, 14 nt, Homo sapiens
gcagcuccacaggg

SEQ ID NO: 1878247 - RNA, 23 nt, Homo sapiens
guuauccaacuauuaagauaucu

SEQ ID NO: 1878248 - RNA, 14 nt, Homo sapiens
aagucccuaauaaa

SEQ ID NO: 1878249 - RNA, 14 nt, Homo sapiens
uuuuaccuuugaca

SEQ ID NO: 1878250 - RNA, 23 nt, Homo sapiens
cagcuuuguuuguugucagcuga

SEQ ID NO: 1878251 - RNA, 17 nt, Homo sapiens
aaguaauguuaauucuu

SEQ ID NO: 1878252 - RNA, 18 nt, Homo sapiens
gucugccagccagcagcc

SEQ ID NO: 1878253 - RNA, 14 nt, Homo sapiens
acuacauacaagca

SEQ ID NO: 1878254 - RNA, 22 nt, Homo sapiens
uggcucugcuguccccuuggca

SEQ ID NO: 1878255 - RNA, 17 nt, Homo sapiens
aggagggugagugcaag

SEQ ID NO: 1878256 - RNA, 16 nt, Homo sapiens
ucagacauuuucacug

SEQ ID NO: 1878257 - RNA, 18 nt, Homo sapiens
auugugaaaaggcaaauu

SEQ ID NO: 1878258 - RNA, 20 nt, Homo sapiens
gucgagcccugcagccaaac

SEQ ID NO: 1878259 - RNA, 16 nt, Homo sapiens
accuaaaugaccucag

SEQ ID NO: 1878260 - RNA, 20 nt, Homo sapiens
ucagccagcugcccacaagc

SEQ ID NO: 1878261 - RNA, 19 nt, Homo sapiens
auaaacuguuguaugccug

SEQ ID NO: 1878262 - RNA, 15 nt, Homo sapiens
uccucccugcaucug

SEQ ID NO: 1878263 - RNA, 21 nt, Homo sapiens
cugcacaaagcccuuccaugu

SEQ ID NO: 1878264 - RNA, 23 nt, Homo sapiens
uuguaucuuaaaucugugaagua

SEQ ID NO: 1878265 - RNA, 22 nt, Homo sapiens
gcugcaguuuccucaucuguca

SEQ ID NO: 1878266 - RNA, 15 nt, Homo sapiens
ucaccuggaugugca

SEQ ID NO: 1878267 - RNA, 11 nt, Homo sapiens
ugugagcaaag

SEQ ID NO: 1878268 - RNA, 14 nt, Homo sapiens
caggagagcccucu

SEQ ID NO: 1878269 - RNA, 14 nt, Homo sapiens
ugcgccgggggacc

SEQ ID NO: 1878270 - RNA, 19 nt, Homo sapiens
aacuagcuaaaaccaaagg

SEQ ID NO: 1878271 - RNA, 23 nt, Homo sapiens
cauuuuauaaaugauaucaaaga

SEQ ID NO: 1878272 - RNA, 20 nt, Homo sapiens
uccugcgcauauagacugua

SEQ ID NO: 1878273 - RNA, 21 nt, Homo sapiens
agacgugaugggcuaggccuc

SEQ ID NO: 1878274 - RNA, 16 nt, Homo sapiens
augucugguguuuguc

SEQ ID NO: 1878275 - RNA, 16 nt, Homo sapiens
ugggugggacagccuc

SEQ ID NO: 1878276 - RNA, 18 nt, Homo sapiens
cuggggauuaccauucag

SEQ ID NO: 1878277 - RNA, 15 nt, Homo sapiens
cguguggcaguguuu

SEQ ID NO: 1878278 - RNA, 23 nt, Homo sapiens
agaucauaccacggcacuccagc

SEQ ID NO: 1878279 - RNA, 12 nt, Homo sapiens
gccaagugcagg

SEQ ID NO: 1878280 - RNA, 21 nt, Homo sapiens
uccagggaaugaugacaacaa

SEQ ID NO: 1878281 - RNA, 18 nt, Homo sapiens
uauagaaaauucuugaga

SEQ ID NO: 1878282 - RNA, 14 nt, Homo sapiens
aaucucaccugcug

SEQ ID NO: 1878283 - RNA, 19 nt, Homo sapiens
aauuagccggucauggugg

SEQ ID NO: 1878284 - RNA, 21 nt, Homo sapiens
auccaguuucccaccaccuug

SEQ ID NO: 1878285 - RNA, 14 nt, Homo sapiens
cuguaaccagauua

SEQ ID NO: 1878286 - RNA, 13 nt, Homo sapiens
uacacugccaucu

SEQ ID NO: 1878287 - RNA, 11 nt, Homo sapiens
gaacuaugaac

SEQ ID NO: 1878288 - RNA, 23 nt, Homo sapiens
ugcuugauauguaaguacuucca

SEQ ID NO: 1878289 - RNA, 21 nt, Homo sapiens
uuucaaguuuccccagcuuca

SEQ ID NO: 1878290 - RNA, 23 nt, Homo sapiens
caaaaccccccagauaucaucua

SEQ ID NO: 1878291 - RNA, 16 nt, Homo sapiens
ccuuaauugaugcaaa

SEQ ID NO: 1878292 - RNA, 22 nt, Homo sapiens
cagcuguucucauugccaguga

SEQ ID NO: 1878293 - RNA, 16 nt, Homo sapiens
ccuuuggucuccugga

SEQ ID NO: 1878294 - RNA, 19 nt, Homo sapiens
uaaccuuaucuaagaacuu

SEQ ID NO: 1878295 - RNA, 12 nt, Homo sapiens
aaaggugacuuc

SEQ ID NO: 1878296 - RNA, 19 nt, Homo sapiens
aagaccgauagcaggugaa

SEQ ID NO: 1878297 - RNA, 18 nt, Homo sapiens
ugcaccaauuaucaucuu

SEQ ID NO: 1878298 - RNA, 23 nt, Homo sapiens
uccagugccaggccagugaccuc

SEQ ID NO: 1878299 - RNA, 21 nt, Homo sapiens
caagacuuuugucugaucaag

SEQ ID NO: 1878300 - RNA, 19 nt, Homo sapiens
agacacuggcguuacugcu

SEQ ID NO: 1878301 - RNA, 15 nt, Homo sapiens
augcuuuuauagcug

SEQ ID NO: 1878302 - RNA, 15 nt, Homo sapiens
aucaucuuuccuguu

SEQ ID NO: 1878303 - RNA, 17 nt, Homo sapiens
ugggaggguguggugcu

SEQ ID NO: 1878304 - RNA, 21 nt, Homo sapiens
uucucuuagaacauuguauua

SEQ ID NO: 1878305 - RNA, 12 nt, Homo sapiens
gugcuacaugac

SEQ ID NO: 1878306 - RNA, 15 nt, Homo sapiens
ggugguagaaccacu

SEQ ID NO: 1878307 - RNA, 19 nt, Homo sapiens
cuaaccugcgucauuucag

SEQ ID NO: 1878308 - RNA, 12 nt, Homo sapiens
aaacaucaucaa

SEQ ID NO: 1878309 - RNA, 13 nt, Homo sapiens
guggaucacgaca

SEQ ID NO: 1878310 - RNA, 14 nt, Homo sapiens
caguggaaggcauu

SEQ ID NO: 1878311 - RNA, 22 nt, Homo sapiens
uucaauuauacuaaaccucaca

SEQ ID NO: 1878312 - RNA, 18 nt, Homo sapiens
uuuaaagauguaaaaccu

SEQ ID NO: 1878313 - RNA, 15 nt, Homo sapiens
ugucauuaaccaucu

SEQ ID NO: 1878314 - RNA, 18 nt, Homo sapiens
cccccaggauucccagag

SEQ ID NO: 1878315 - RNA, 17 nt, Homo sapiens
uccuuuugguuccucac

SEQ ID NO: 1878316 - RNA, 15 nt, Homo sapiens
agccuugggguugga

SEQ ID NO: 1878317 - RNA, 17 nt, Homo sapiens
aacccaggggacagcug

SEQ ID NO: 1878318 - RNA, 13 nt, Homo sapiens
caauugaaguaaa

SEQ ID NO: 1878319 - RNA, 20 nt, Homo sapiens
aucaaguuguugacugugau

SEQ ID NO: 1878320 - RNA, 23 nt, Homo sapiens
gaagacacugucaaugagguuau

SEQ ID NO: 1878321 - RNA, 22 nt, Homo sapiens
ccuuucugccagggauggcagu

SEQ ID NO: 1878322 - RNA, 11 nt, Homo sapiens
cugaauaugaa

SEQ ID NO: 1878323 - RNA, 17 nt, Homo sapiens
auucagaaggaucuuca

SEQ ID NO: 1878324 - RNA, 17 nt, Homo sapiens
cuucucaccugggccua

SEQ ID NO: 1878325 - RNA, 21 nt, Homo sapiens
ucugcugcgauccggcagccu

SEQ ID NO: 1878326 - RNA, 17 nt, Homo sapiens
gcaggacggguaccaug

SEQ ID NO: 1878327 - RNA, 14 nt, Homo sapiens
auguaugugcacug

SEQ ID NO: 1878328 - RNA, 20 nt, Homo sapiens
caggaggauucagcucagga

SEQ ID NO: 1878329 - RNA, 17 nt, Homo sapiens
guccaugcaggggccac

SEQ ID NO: 1878330 - RNA, 20 nt, Homo sapiens
cucuguuuauagugacccac

SEQ ID NO: 1878331 - RNA, 18 nt, Homo sapiens
agcauggcucauucugca

SEQ ID NO: 1878332 - RNA, 22 nt, Homo sapiens
gggaugggcucccacccucccc

SEQ ID NO: 1878333 - RNA, 15 nt, Homo sapiens
aauuuuuacauggag

SEQ ID NO: 1878334 - RNA, 19 nt, Homo sapiens
cugcugucaccuugcucag

SEQ ID NO: 1878335 - RNA, 15 nt, Homo sapiens
auguucuaacagauc

SEQ ID NO: 1878336 - RNA, 17 nt, Homo sapiens
agcagugccuuccauaa

SEQ ID NO: 1878337 - RNA, 16 nt, Homo sapiens
uaggcaggaagcccaa

SEQ ID NO: 1878338 - RNA, 18 nt, Homo sapiens
uauauuuacaacacuuua

SEQ ID NO: 1878339 - RNA, 21 nt, Homo sapiens
guuuuagcggucaauuugccu

SEQ ID NO: 1878340 - RNA, 17 nt, Homo sapiens
ggcagacucgggaccaa

SEQ ID NO: 1878341 - RNA, 16 nt, Homo sapiens
ugguuuagucauugca

SEQ ID NO: 1878342 - RNA, 19 nt, Homo sapiens
ugcuaagggcaggcccaaa

SEQ ID NO: 1878343 - RNA, 12 nt, Homo sapiens
acugcugagcug

SEQ ID NO: 1878344 - RNA, 15 nt, Homo sapiens
aguuguuugcuucuu

SEQ ID NO: 1878345 - RNA, 19 nt, Homo sapiens
ugaaucuuucuuacuauug

SEQ ID NO: 1878346 - RNA, 14 nt, Homo sapiens
accgcucaguauua

SEQ ID NO: 1878347 - RNA, 17 nt, Homo sapiens
uccaaccaggagcugau

SEQ ID NO: 1878348 - RNA, 19 nt, Homo sapiens
aggugcuauuguuacucuu

SEQ ID NO: 1878349 - RNA, 11 nt, Homo sapiens
cucucucauga

SEQ ID NO: 1878350 - RNA, 19 nt, Homo sapiens
cagugccacccaugcagcu

SEQ ID NO: 1878351 - RNA, 13 nt, Homo sapiens
aaaaccaaauucu

SEQ ID NO: 1878352 - RNA, 19 nt, Homo sapiens
accugaagcugucaccucu

SEQ ID NO: 1878353 - RNA, 11 nt, Homo sapiens
ucccaucccau

SEQ ID NO: 1878354 - RNA, 12 nt, Homo sapiens
cuguuugucaau

SEQ ID NO: 1878355 - RNA, 20 nt, Homo sapiens
ugaaacauauuuauaguuua

SEQ ID NO: 1878356 - RNA, 23 nt, Homo sapiens
gacaaagagauugagguucucua

SEQ ID NO: 1878357 - RNA, 21 nt, Homo sapiens
uacauguaucuaaacaaugua

SEQ ID NO: 1878358 - RNA, 21 nt, Homo sapiens
uggcuucacagaugugugauu

SEQ ID NO: 1878359 - RNA, 16 nt, Homo sapiens
uuaacauguauacaaa

SEQ ID NO: 1878360 - RNA, 20 nt, Homo sapiens
ucaaaacacuuucccaugag

SEQ ID NO: 1878361 - RNA, 16 nt, Homo sapiens
ugccucaguaggcauc

SEQ ID NO: 1878362 - RNA, 15 nt, Homo sapiens
cuccucuaggccuca

SEQ ID NO: 1878363 - RNA, 17 nt, Homo sapiens
auuaggaauuguuuaua

SEQ ID NO: 1878364 - RNA, 18 nt, Homo sapiens
uagcaucuucucauuccc

SEQ ID NO: 1878365 - RNA, 14 nt, Homo sapiens
cccaggguggagug

SEQ ID NO: 1878366 - RNA, 13 nt, Homo sapiens
aaugucacuguga

SEQ ID NO: 1878367 - RNA, 17 nt, Homo sapiens
cugugcugguugccaca

SEQ ID NO: 1878368 - RNA, 14 nt, Homo sapiens
ggcaaggaagggug

SEQ ID NO: 1878369 - RNA, 23 nt, Homo sapiens
cuauguugccuaagcuggucuca

SEQ ID NO: 1878370 - RNA, 15 nt, Homo sapiens
ccucaguaggcauca

SEQ ID NO: 1878371 - RNA, 17 nt, Homo sapiens
guaccaugugcuacagg

SEQ ID NO: 1878372 - RNA, 18 nt, Homo sapiens
uuucuucccccccaagau

SEQ ID NO: 1878373 - RNA, 21 nt, Homo sapiens
uugcaguaagccaaggucaug

SEQ ID NO: 1878374 - RNA, 22 nt, Homo sapiens
gccccccagccuucacugacag

SEQ ID NO: 1878375 - RNA, 10 nt, Homo sapiens
agacagugaa

SEQ ID NO: 1878376 - RNA, 17 nt, Homo sapiens
cccacuguccuguaaac

SEQ ID NO: 1878377 - RNA, 17 nt, Homo sapiens
acuuaauaauguguaca

SEQ ID NO: 1878378 - RNA, 14 nt, Homo sapiens
agccucaaguucca

SEQ ID NO: 1878379 - RNA, 15 nt, Homo sapiens
auaaaaggcaaauac

SEQ ID NO: 1878380 - RNA, 17 nt, Homo sapiens
aguuggcacuucugcca

SEQ ID NO: 1878381 - RNA, 22 nt, Homo sapiens
aaaccuucaucugaaacccaca

SEQ ID NO: 1878382 - RNA, 21 nt, Homo sapiens
aagcaaugggucacucauuaa

SEQ ID NO: 1878383 - RNA, 14 nt, Homo sapiens
agggaaggagccca

SEQ ID NO: 1878384 - RNA, 20 nt, Homo sapiens
guuauccuguuuuugcaaaa

SEQ ID NO: 1878385 - RNA, 15 nt, Homo sapiens
auccauauacauaua

SEQ ID NO: 1878386 - RNA, 12 nt, Homo sapiens
acagacagcagc

SEQ ID NO: 1878387 - RNA, 23 nt, Homo sapiens
gauuauuggcugcuuugccucua

SEQ ID NO: 1878388 - RNA, 14 nt, Homo sapiens
aggaagagccaaug

SEQ ID NO: 1878389 - RNA, 22 nt, Homo sapiens
ccuugauacgauaguuacauaa

SEQ ID NO: 1878390 - RNA, 14 nt, Homo sapiens
gaucacacagccac

SEQ ID NO: 1878391 - RNA, 20 nt, Homo sapiens
gagccaccgugcccggccaa

SEQ ID NO: 1878392 - RNA, 13 nt, Homo sapiens
uaacacaucuuua

SEQ ID NO: 1878393 - RNA, 20 nt, Homo sapiens
gccuuggcugccuuggugca

SEQ ID NO: 1878394 - RNA, 16 nt, Homo sapiens
caugagaagucacuca

SEQ ID NO: 1878395 - RNA, 19 nt, Homo sapiens
agaauguuacugccuuaau

SEQ ID NO: 1878396 - RNA, 19 nt, Homo sapiens
ucuuaaauguuuauacugu

SEQ ID NO: 1878397 - RNA, 22 nt, Homo sapiens
uaggaaggucucauucuuccaa

SEQ ID NO: 1878398 - RNA, 18 nt, Homo sapiens
uauuuagacucaucuuac

SEQ ID NO: 1878399 - RNA, 14 nt, Homo sapiens
cagcucacacauga

SEQ ID NO: 1878400 - RNA, 21 nt, Homo sapiens
auugcuuguuagcaaaaugga

SEQ ID NO: 1878401 - RNA, 16 nt, Homo sapiens
aguucauguugcucag

SEQ ID NO: 1878402 - RNA, 14 nt, Homo sapiens
ccggcuuugcaggg

SEQ ID NO: 1878403 - RNA, 19 nt, Homo sapiens
uacucugcucuaugccagg

SEQ ID NO: 1878404 - RNA, 17 nt, Homo sapiens
ccuuucucuaaaacugc

SEQ ID NO: 1878405 - RNA, 14 nt, Homo sapiens
agcuuuuucacucu

SEQ ID NO: 1878406 - RNA, 20 nt, Homo sapiens
aagagggugauugcuggggc

SEQ ID NO: 1878407 - RNA, 15 nt, Homo sapiens
aaacucuccagacau

SEQ ID NO: 1878408 - RNA, 23 nt, Homo sapiens
uguauguguauaauaauuugaga

SEQ ID NO: 1878409 - RNA, 15 nt, Homo sapiens
cucaagaaucuagaa

SEQ ID NO: 1878410 - RNA, 19 nt, Homo sapiens
augaccaggccaagacuca

SEQ ID NO: 1878411 - RNA, 19 nt, Homo sapiens
ggacagauggcccaaggga

SEQ ID NO: 1878412 - RNA, 13 nt, Homo sapiens
gaagggguggcug

SEQ ID NO: 1878413 - RNA, 20 nt, Homo sapiens
uagagaacgggaguggccau

SEQ ID NO: 1878414 - RNA, 15 nt, Homo sapiens
uuccucuuaauuccc

SEQ ID NO: 1878415 - RNA, 15 nt, Homo sapiens
agugauucccaacuc

SEQ ID NO: 1878416 - RNA, 21 nt, Homo sapiens
cuucccacacuguccauucuu

SEQ ID NO: 1878417 - RNA, 17 nt, Homo sapiens
guaaauagcauucucua

SEQ ID NO: 1878418 - RNA, 17 nt, Homo sapiens
ugcuuuccauauuguga

SEQ ID NO: 1878419 - RNA, 22 nt, Homo sapiens
ccuuuuuuuuacggaauuccaa

SEQ ID NO: 1878420 - RNA, 17 nt, Homo sapiens
ugacagaaggugccacu

SEQ ID NO: 1878421 - RNA, 19 nt, Homo sapiens
ccauguacaguauguucaa

SEQ ID NO: 1878422 - RNA, 12 nt, Homo sapiens
cuaauuguggau

SEQ ID NO: 1878423 - RNA, 11 nt, Homo sapiens
agaacucugcc

SEQ ID NO: 1878424 - RNA, 18 nt, Homo sapiens
gcauagguuuagcaguau

SEQ ID NO: 1878425 - RNA, 18 nt, Homo sapiens
ugauggucgccaucauaa

SEQ ID NO: 1878426 - RNA, 14 nt, Homo sapiens
cugcuaccugcuga

SEQ ID NO: 1878427 - RNA, 12 nt, Homo sapiens
uaggaacagacu

SEQ ID NO: 1878428 - RNA, 15 nt, Homo sapiens
gccuauuuaguucca

SEQ ID NO: 1878429 - RNA, 9 nt, Homo sapiens
aaugcaaaa

SEQ ID NO: 1878430 - RNA, 14 nt, Homo sapiens
gagggauggugccc

SEQ ID NO: 1878431 - RNA, 19 nt, Homo sapiens
caaauaggauuaaacacac

SEQ ID NO: 1878432 - RNA, 12 nt, Homo sapiens
ccacauccagcc

SEQ ID NO: 1878433 - RNA, 13 nt, Homo sapiens
gcaacaucagcuu

SEQ ID NO: 1878434 - RNA, 22 nt, Homo sapiens
uaaaguuuaaauaccaguacuu

SEQ ID NO: 1878435 - RNA, 15 nt, Homo sapiens
gcaaaacauugcugc

SEQ ID NO: 1878436 - RNA, 23 nt, Homo sapiens
acagcggaaagcccugugcucca

SEQ ID NO: 1878437 - RNA, 16 nt, Homo sapiens
gaggcacccucagaga

SEQ ID NO: 1878438 - RNA, 14 nt, Homo sapiens
ccaagcccaguuca

SEQ ID NO: 1878439 - RNA, 23 nt, Homo sapiens
gaaaccugcaugaaagcauucuu

SEQ ID NO: 1878440 - RNA, 14 nt, Homo sapiens
ucacaagaauuuaa

SEQ ID NO: 1878441 - RNA, 22 nt, Homo sapiens
ucccacucccuuuccaaccuca

SEQ ID NO: 1878442 - RNA, 13 nt, Homo sapiens
uaguuucucucaa

SEQ ID NO: 1878443 - RNA, 21 nt, Homo sapiens
uagcuacagagaaaccagcuu

SEQ ID NO: 1878444 - RNA, 17 nt, Homo sapiens
auggaggccagugccau

SEQ ID NO: 1878445 - RNA, 12 nt, Homo sapiens
uaggcaaagacu

SEQ ID NO: 1878446 - RNA, 16 nt, Homo sapiens
cagacacuaaguuaua

SEQ ID NO: 1878447 - RNA, 20 nt, Homo sapiens
auuugccauagaguacacug

SEQ ID NO: 1878448 - RNA, 23 nt, Homo sapiens
guagauccagauccagacuguaa

SEQ ID NO: 1878449 - RNA, 16 nt, Homo sapiens
auuuaaguacuugaga

SEQ ID NO: 1878450 - RNA, 14 nt, Homo sapiens
uaaaugugacucag

SEQ ID NO: 1878451 - RNA, 16 nt, Homo sapiens
cagaacccugccaugg

SEQ ID NO: 1878452 - RNA, 14 nt, Homo sapiens
caugggacauuugc

SEQ ID NO: 1878453 - RNA, 19 nt, Homo sapiens
ucaaccucuucuggcucaa

SEQ ID NO: 1878454 - RNA, 17 nt, Homo sapiens
ggcaagcccugccucug

SEQ ID NO: 1878455 - RNA, 14 nt, Homo sapiens
cuuucuacuuccaa

SEQ ID NO: 1878456 - RNA, 21 nt, Homo sapiens
gaacuuuagugaaacauaaua

SEQ ID NO: 1878457 - RNA, 22 nt, Homo sapiens
aaagguuucauguucacuguga

SEQ ID NO: 1878458 - RNA, 23 nt, Homo sapiens
uggcacaugucauugcccacuuc

SEQ ID NO: 1878459 - RNA, 14 nt, Homo sapiens
acugaauauuauca

SEQ ID NO: 1878460 - RNA, 19 nt, Homo sapiens
acugccacuccaguccugc

SEQ ID NO: 1878461 - RNA, 20 nt, Homo sapiens
uaauggagaggaaaccagau

SEQ ID NO: 1878462 - RNA, 21 nt, Homo sapiens
caggugggagccaacugucag

SEQ ID NO: 1878463 - RNA, 23 nt, Homo sapiens
ccgcaauguugguuucacugaga

SEQ ID NO: 1878464 - RNA, 14 nt, Homo sapiens
agugccuucucuca

SEQ ID NO: 1878465 - RNA, 20 nt, Homo sapiens
agcaauuccuggacucgggg

SEQ ID NO: 1878466 - RNA, 22 nt, Homo sapiens
aacauuucuugguuccaauaaa

SEQ ID NO: 1878467 - RNA, 17 nt, Homo sapiens
gucacacagagugccug

SEQ ID NO: 1878468 - RNA, 13 nt, Homo sapiens
ucuacacauaucu

SEQ ID NO: 1878469 - RNA, 17 nt, Homo sapiens
gcuaagcuguuugcuca

SEQ ID NO: 1878470 - RNA, 17 nt, Homo sapiens
ugccuggaagcuuuguc

SEQ ID NO: 1878471 - RNA, 22 nt, Homo sapiens
cagauugcagaaauacaguaug

SEQ ID NO: 1878472 - RNA, 13 nt, Homo sapiens
gcuguuauacugu

SEQ ID NO: 1878473 - RNA, 13 nt, Homo sapiens
gcuccuccucacc

SEQ ID NO: 1878474 - RNA, 13 nt, Homo sapiens
acaauaaucucac

SEQ ID NO: 1878475 - RNA, 13 nt, Homo sapiens
cuccagagacccc

SEQ ID NO: 1878476 - RNA, 17 nt, Homo sapiens
ugaagggguuuucuuga

SEQ ID NO: 1878477 - RNA, 17 nt, Homo sapiens
acuacauugugcaauug

SEQ ID NO: 1878478 - RNA, 16 nt, Homo sapiens
aauagcccauuucugu

SEQ ID NO: 1878479 - RNA, 21 nt, Homo sapiens
uuuaccugaaauaaaauucau

SEQ ID NO: 1878480 - RNA, 19 nt, Homo sapiens
uaacuagguugcuacuuua

SEQ ID NO: 1878481 - RNA, 13 nt, Homo sapiens
ugaccucuccagc

SEQ ID NO: 1878482 - RNA, 14 nt, Homo sapiens
gugaucuuggcuca

SEQ ID NO: 1878483 - RNA, 16 nt, Homo sapiens
auuuaaacucaagaca

SEQ ID NO: 1878484 - RNA, 14 nt, Homo sapiens
ugugaccaucccaa

SEQ ID NO: 1878485 - RNA, 14 nt, Homo sapiens
gaaauaaaugacaa

SEQ ID NO: 1878486 - RNA, 12 nt, Homo sapiens
uacuuauuuucc

SEQ ID NO: 1878487 - RNA, 11 nt, Homo sapiens
uuuuuguacug

SEQ ID NO: 1878488 - RNA, 13 nt, Homo sapiens
gcaccugauucuc

SEQ ID NO: 1878489 - RNA, 19 nt, Homo sapiens
uaaccugcccacccacucc

SEQ ID NO: 1878490 - RNA, 12 nt, Homo sapiens
uuguucuuguug

SEQ ID NO: 1878491 - RNA, 17 nt, Homo sapiens
auuucccugguagugua

SEQ ID NO: 1878492 - RNA, 12 nt, Homo sapiens
uuuugucucaga

SEQ ID NO: 1878493 - RNA, 15 nt, Homo sapiens
uguacacaugccaac

SEQ ID NO: 1878494 - RNA, 19 nt, Homo sapiens
aauacaauuaaagcuguua

SEQ ID NO: 1878495 - RNA, 19 nt, Homo sapiens
uaaagauuucuaguaggca

SEQ ID NO: 1878496 - RNA, 14 nt, Homo sapiens
aacaccacuuugua

SEQ ID NO: 1878497 - RNA, 14 nt, Homo sapiens
cacucccaccucac

SEQ ID NO: 1878498 - RNA, 14 nt, Homo sapiens
augcuauuaauaca

SEQ ID NO: 1878499 - RNA, 16 nt, Homo sapiens
cugcgucugacauccu

SEQ ID NO: 1878500 - RNA, 10 nt, Homo sapiens
uucacuuuga

SEQ ID NO: 1878501 - RNA, 17 nt, Homo sapiens
cauuauaaaccuucaga

SEQ ID NO: 1878502 - RNA, 23 nt, Homo sapiens
uggccucugcaaaggaaauacca

SEQ ID NO: 1878503 - RNA, 14 nt, Homo sapiens
agaucaaauggaaa

SEQ ID NO: 1878504 - RNA, 23 nt, Homo sapiens
uuuaaaaaaccacauggcacaga

SEQ ID NO: 1878505 - RNA, 19 nt, Homo sapiens
accuuuuguaagacauuag

SEQ ID NO: 1878506 - RNA, 12 nt, Homo sapiens
gguggggccagc

SEQ ID NO: 1878507 - RNA, 13 nt, Homo sapiens
uuucuuccaggau

SEQ ID NO: 1878508 - RNA, 22 nt, Homo sapiens
ggcccuguuaaggcauccacuu

SEQ ID NO: 1878509 - RNA, 17 nt, Homo sapiens
agucagugacagccccu

SEQ ID NO: 1878510 - RNA, 20 nt, Homo sapiens
ugcaguuuuuuucuugucua

SEQ ID NO: 1878511 - RNA, 17 nt, Homo sapiens
gagccugugcuaaagaa

SEQ ID NO: 1878512 - RNA, 23 nt, Homo sapiens
caaagucccaggcccagugcagu

SEQ ID NO: 1878513 - RNA, 12 nt, Homo sapiens
cuuuaaauucaa

SEQ ID NO: 1878514 - RNA, 13 nt, Homo sapiens
ucgcucugagcau

SEQ ID NO: 1878515 - RNA, 17 nt, Homo sapiens
aucaagcccuuuacuug

SEQ ID NO: 1878516 - RNA, 20 nt, Homo sapiens
aaaaucuguuauagcuuuaa

SEQ ID NO: 1878517 - RNA, 15 nt, Homo sapiens
agacauucauuuagu

SEQ ID NO: 1878518 - RNA, 15 nt, Homo sapiens
auauugucagucuuu

SEQ ID NO: 1878519 - RNA, 19 nt, Homo sapiens
aucccuguaauauuuagcu

SEQ ID NO: 1878520 - RNA, 23 nt, Homo sapiens
ugagcaaggacauugccccaaga

SEQ ID NO: 1878521 - RNA, 24 nt, Homo sapiens
ucuuguguuuuuugcucacuguca

SEQ ID NO: 1878522 - RNA, 17 nt, Homo sapiens
cgacagcccaucaccuc

SEQ ID NO: 1878523 - RNA, 21 nt, Homo sapiens
agaaacuuauuucucauauca

SEQ ID NO: 1878524 - RNA, 13 nt, Homo sapiens
uccuaacaaaaga

SEQ ID NO: 1878525 - RNA, 16 nt, Homo sapiens
aucagaccacucccuu

SEQ ID NO: 1878526 - RNA, 20 nt, Homo sapiens
ucuuaggcuaagagauguga

SEQ ID NO: 1878527 - RNA, 22 nt, Homo sapiens
cuaucccccgcagcgcucuccu

SEQ ID NO: 1878528 - RNA, 20 nt, Homo sapiens
ugaauagaaaaaguaaucaa

SEQ ID NO: 1878529 - RNA, 13 nt, Homo sapiens
ggcugaugcaguu

SEQ ID NO: 1878530 - RNA, 14 nt, Homo sapiens
aacauuauucucaa

SEQ ID NO: 1878531 - RNA, 14 nt, Homo sapiens
uugagcaguuccca

SEQ ID NO: 1878532 - RNA, 15 nt, Homo sapiens
augcuaaucuugucc

SEQ ID NO: 1878533 - RNA, 20 nt, Homo sapiens
gaccugagccuggccauguc

SEQ ID NO: 1878534 - RNA, 14 nt, Homo sapiens
cuuauccagucaaa

SEQ ID NO: 1878535 - RNA, 15 nt, Homo sapiens
uccagccccaugugu

SEQ ID NO: 1878536 - RNA, 15 nt, Homo sapiens
caucagugaucucac

SEQ ID NO: 1878537 - RNA, 20 nt, Homo sapiens
aaggggccuuugucuuguca

SEQ ID NO: 1878538 - RNA, 15 nt, Homo sapiens
agcuuagagccuccc

SEQ ID NO: 1878539 - RNA, 11 nt, Homo sapiens
uucaagagcca

SEQ ID NO: 1878540 - RNA, 16 nt, Homo sapiens
agccacuugacuggca

SEQ ID NO: 1878541 - RNA, 23 nt, Homo sapiens
guaucccccgccuuuaguucucc

SEQ ID NO: 1878542 - RNA, 19 nt, Homo sapiens
uagcgauugauugauguac

SEQ ID NO: 1878543 - RNA, 23 nt, Homo sapiens
uacugacacauugcugauaugca

SEQ ID NO: 1878544 - RNA, 15 nt, Homo sapiens
aagugucaacucuuu

SEQ ID NO: 1878545 - RNA, 13 nt, Homo sapiens
cucaucuugccuc

SEQ ID NO: 1878546 - RNA, 18 nt, Homo sapiens
ggaagagcugcaacggaa

SEQ ID NO: 1878547 - RNA, 19 nt, Homo sapiens
acaguuagaaacaccagcc

SEQ ID NO: 1878548 - RNA, 21 nt, Homo sapiens
uucauaaaaaauaaugguguc

SEQ ID NO: 1878549 - RNA, 17 nt, Homo sapiens
auaauguauuuacuuuu

SEQ ID NO: 1878550 - RNA, 15 nt, Homo sapiens
ugugcuuaacauuga

SEQ ID NO: 1878551 - RNA, 18 nt, Homo sapiens
uccuucucauaaccucaa

SEQ ID NO: 1878552 - RNA, 19 nt, Homo sapiens
uauaucucacaggaguugg

SEQ ID NO: 1878553 - RNA, 17 nt, Homo sapiens
auuugucaacaaaguca

SEQ ID NO: 1878554 - RNA, 14 nt, Homo sapiens
uuguaauacacaua

SEQ ID NO: 1878555 - RNA, 17 nt, Homo sapiens
cuaggauccccccaugc

SEQ ID NO: 1878556 - RNA, 21 nt, Homo sapiens
aaugacaaugaagugacacuu

SEQ ID NO: 1878557 - RNA, 20 nt, Homo sapiens
cuucacagaaaguucuuaaa

SEQ ID NO: 1878558 - RNA, 13 nt, Homo sapiens
ucuguucacuuuc

SEQ ID NO: 1878559 - RNA, 15 nt, Homo sapiens
ggaugaccuccagaa

SEQ ID NO: 1878560 - RNA, 14 nt, Homo sapiens
cggccacaacuaca

SEQ ID NO: 1878561 - RNA, 22 nt, Homo sapiens
aaacugggugggauggaugcug

SEQ ID NO: 1878562 - RNA, 21 nt, Homo sapiens
uacuauccuguaaauauaucu

SEQ ID NO: 1878563 - RNA, 23 nt, Homo sapiens
acauaauaagacuuuucucuacu

SEQ ID NO: 1878564 - RNA, 17 nt, Homo sapiens
cuuaggcaaucacauag

SEQ ID NO: 1878565 - RNA, 14 nt, Homo sapiens
acuauuuccaccuc

SEQ ID NO: 1878566 - RNA, 21 nt, Homo sapiens
cauacagagauuguaguauuu

SEQ ID NO: 1878567 - RNA, 15 nt, Homo sapiens
aagugcaaagcugcu

SEQ ID NO: 1878568 - RNA, 14 nt, Homo sapiens
ucucauccacagag

SEQ ID NO: 1878569 - RNA, 11 nt, Homo sapiens
cccucagggau

SEQ ID NO: 1878570 - RNA, 19 nt, Homo sapiens
uuaaggguuaaaucacuuu

SEQ ID NO: 1878571 - RNA, 22 nt, Homo sapiens
uguucccauaaccccuagucau

SEQ ID NO: 1878572 - RNA, 13 nt, Homo sapiens
uccaggguggaug

SEQ ID NO: 1878573 - RNA, 17 nt, Homo sapiens
ggcucagccuugcacac

SEQ ID NO: 1878574 - RNA, 11 nt, Homo sapiens
aauucuaguuu

SEQ ID NO: 1878575 - RNA, 18 nt, Homo sapiens
ggaacuaagaaagcccuu

SEQ ID NO: 1878576 - RNA, 23 nt, Homo sapiens
auuuggaaaauguuaugugcucu

SEQ ID NO: 1878577 - RNA, 20 nt, Homo sapiens
cugcuccaaaggaaauccaa

SEQ ID NO: 1878578 - RNA, 15 nt, Homo sapiens
uaaaaggcaagucaa

SEQ ID NO: 1878579 - RNA, 11 nt, Homo sapiens
cuuuucucugu

SEQ ID NO: 1878580 - RNA, 16 nt, Homo sapiens
acacagauuuuuacac

SEQ ID NO: 1878581 - RNA, 22 nt, Homo sapiens
aggaaacuuuuuccaccuuucu

SEQ ID NO: 1878582 - RNA, 21 nt, Homo sapiens
ggcgguccuacugcugugagc

SEQ ID NO: 1878583 - RNA, 22 nt, Homo sapiens
aagacgucucuuuuugguaaua

SEQ ID NO: 1878584 - RNA, 16 nt, Homo sapiens
aauuuuuaaaacugca

SEQ ID NO: 1878585 - RNA, 16 nt, Homo sapiens
aguucccucaguguga

SEQ ID NO: 1878586 - RNA, 18 nt, Homo sapiens
uuucuuguugcaaaaaau

SEQ ID NO: 1878587 - RNA, 15 nt, Homo sapiens
agcauccccugugaa

SEQ ID NO: 1878588 - RNA, 14 nt, Homo sapiens
auggggguguagua

SEQ ID NO: 1878589 - RNA, 11 nt, Homo sapiens
cucuccaugau

SEQ ID NO: 1878590 - RNA, 18 nt, Homo sapiens
aggcacacagcuacucuc

SEQ ID NO: 1878591 - RNA, 15 nt, Homo sapiens
guuuaauaguauauc

SEQ ID NO: 1878592 - RNA, 17 nt, Homo sapiens
ugggaaggggaggaccc

SEQ ID NO: 1878593 - RNA, 22 nt, Homo sapiens
caucucaaggggcccagccucc

SEQ ID NO: 1878594 - RNA, 22 nt, Homo sapiens
agaaggcagugauuagcacuug

SEQ ID NO: 1878595 - RNA, 17 nt, Homo sapiens
uccaaagacuguacugg

SEQ ID NO: 1878596 - RNA, 16 nt, Homo sapiens
augaaguaacuugucu

SEQ ID NO: 1878597 - RNA, 17 nt, Homo sapiens
aaguggcccucccucag

SEQ ID NO: 1878598 - RNA, 15 nt, Homo sapiens
uucagacaagcugca

SEQ ID NO: 1878599 - RNA, 17 nt, Homo sapiens
cccaacaucgaaugugu

SEQ ID NO: 1878600 - RNA, 16 nt, Homo sapiens
cuugaagagaaaaaag

SEQ ID NO: 1878601 - RNA, 16 nt, Homo sapiens
gcgucucuaaugucug

SEQ ID NO: 1878602 - RNA, 14 nt, Homo sapiens
uguucaaggcagug

SEQ ID NO: 1878603 - RNA, 15 nt, Homo sapiens
ucuuagugcaaaaaa

SEQ ID NO: 1878604 - RNA, 19 nt, Homo sapiens
caugaaauggauacuuaua

SEQ ID NO: 1878605 - RNA, 12 nt, Homo sapiens
ugacaaccauua

SEQ ID NO: 1878606 - RNA, 17 nt, Homo sapiens
cacagggaggaaggcag

SEQ ID NO: 1878607 - RNA, 13 nt, Homo sapiens
uuucaccuguaaa

SEQ ID NO: 1878608 - RNA, 13 nt, Homo sapiens
ugcagggagcuca

SEQ ID NO: 1878609 - RNA, 15 nt, Homo sapiens
gaugugacauuccau

SEQ ID NO: 1878610 - RNA, 13 nt, Homo sapiens
cugcaaagccaua

SEQ ID NO: 1878611 - RNA, 17 nt, Homo sapiens
aguggcuucaucuguca

SEQ ID NO: 1878612 - RNA, 19 nt, Homo sapiens
ucacauuuucucagugugc

SEQ ID NO: 1878613 - RNA, 18 nt, Homo sapiens
agaaucgaccucacuguc

SEQ ID NO: 1878614 - RNA, 18 nt, Homo sapiens
ucuuguaggucauugcac

SEQ ID NO: 1878615 - RNA, 14 nt, Homo sapiens
acuuuaucuugaau

SEQ ID NO: 1878616 - RNA, 23 nt, Homo sapiens
gccccaacucaagugucaccucc

SEQ ID NO: 1878617 - RNA, 15 nt, Homo sapiens
caacaaauccaugga

SEQ ID NO: 1878618 - RNA, 13 nt, Homo sapiens
aggucaugggaag

SEQ ID NO: 1878619 - RNA, 21 nt, Homo sapiens
agugcaagccccugcuccaga

SEQ ID NO: 1878620 - RNA, 12 nt, Homo sapiens
ccagacagagcc

SEQ ID NO: 1878621 - RNA, 22 nt, Homo sapiens
ggucuuccuuuggcaugggaug

SEQ ID NO: 1878622 - RNA, 23 nt, Homo sapiens
gcaacuccuguucuuugggcuca

SEQ ID NO: 1878623 - RNA, 13 nt, Homo sapiens
agaaagcauuaca

SEQ ID NO: 1878624 - RNA, 15 nt, Homo sapiens
cucccucagacccag

SEQ ID NO: 1878625 - RNA, 15 nt, Homo sapiens
guuggucacauggag

SEQ ID NO: 1878626 - RNA, 12 nt, Homo sapiens
guugcuuuucag

SEQ ID NO: 1878627 - RNA, 21 nt, Homo sapiens
ccucaguucucugccacccau

SEQ ID NO: 1878628 - RNA, 18 nt, Homo sapiens
uuuaaaauacacacucaa

SEQ ID NO: 1878629 - RNA, 19 nt, Homo sapiens
aggcgcugagacugugcug

SEQ ID NO: 1878630 - RNA, 21 nt, Homo sapiens
cccccucccaacagcgcuuua

SEQ ID NO: 1878631 - RNA, 18 nt, Homo sapiens
cugauacuuugacagugu

SEQ ID NO: 1878632 - RNA, 17 nt, Homo sapiens
aacuguaacugcauuag

SEQ ID NO: 1878633 - RNA, 18 nt, Homo sapiens
uauacuuccaugcacucu

SEQ ID NO: 1878634 - RNA, 18 nt, Homo sapiens
aguauacuuuuguuucag

SEQ ID NO: 1878635 - RNA, 19 nt, Homo sapiens
ucuucuauuaaucaagaga

SEQ ID NO: 1878636 - RNA, 16 nt, Homo sapiens
aauagacaguagccaa

SEQ ID NO: 1878637 - RNA, 14 nt, Homo sapiens
ugagcuggggacuc

SEQ ID NO: 1878638 - RNA, 22 nt, Homo sapiens
acacugaaacagccagaucuca

SEQ ID NO: 1878639 - RNA, 13 nt, Homo sapiens
gguaaaauguauu

SEQ ID NO: 1878640 - RNA, 18 nt, Homo sapiens
cuccacugaggaugugag

SEQ ID NO: 1878641 - RNA, 16 nt, Homo sapiens
uugagaucacuacuca

SEQ ID NO: 1878642 - RNA, 17 nt, Homo sapiens
cucuacugcuucaggaa

SEQ ID NO: 1878643 - RNA, 18 nt, Homo sapiens
cuggcugaaggacuguga

SEQ ID NO: 1878644 - RNA, 16 nt, Homo sapiens
cuucauuugugccaca

SEQ ID NO: 1878645 - RNA, 17 nt, Homo sapiens
agauguaccauguuaaa

SEQ ID NO: 1878646 - RNA, 17 nt, Homo sapiens
guuuucuuucucaccca

SEQ ID NO: 1878647 - RNA, 20 nt, Homo sapiens
guaaacuguacuagucugug

SEQ ID NO: 1878648 - RNA, 18 nt, Homo sapiens
gagccccagggugcccag

SEQ ID NO: 1878649 - RNA, 12 nt, Homo sapiens
aaaugaccucag

SEQ ID NO: 1878650 - RNA, 17 nt, Homo sapiens
cuccaauuggugcuuca

SEQ ID NO: 1878651 - RNA, 22 nt, Homo sapiens
aguuuggcaguaccucaaaaag

SEQ ID NO: 1878652 - RNA, 22 nt, Homo sapiens
gccuggcuggaagagggugaaa

SEQ ID NO: 1878653 - RNA, 19 nt, Homo sapiens
uugaaauuauaucuguggu

SEQ ID NO: 1878654 - RNA, 21 nt, Homo sapiens
ccucgugguggaaacuuuucu

SEQ ID NO: 1878655 - RNA, 19 nt, Homo sapiens
aaguuaaacuuuaucucac

SEQ ID NO: 1878656 - RNA, 12 nt, Homo sapiens
aaauaacagcug

SEQ ID NO: 1878657 - RNA, 15 nt, Homo sapiens
aaaauuguccuccuu

SEQ ID NO: 1878658 - RNA, 20 nt, Homo sapiens
aggagguggaggcugcagug

SEQ ID NO: 1878659 - RNA, 17 nt, Homo sapiens
ucucagccccucagaga

SEQ ID NO: 1878660 - RNA, 19 nt, Homo sapiens
acugcagauagccagacac

SEQ ID NO: 1878661 - RNA, 20 nt, Homo sapiens
ugaccuuccuucaagaggac

SEQ ID NO: 1878662 - RNA, 21 nt, Homo sapiens
uaaaagugaaugaaagauuaa

SEQ ID NO: 1878663 - RNA, 21 nt, Homo sapiens
aacugccuuggcuucagggga

SEQ ID NO: 1878664 - RNA, 16 nt, Homo sapiens
uuucccacccaggaaa

SEQ ID NO: 1878665 - RNA, 20 nt, Homo sapiens
uccuaaugguuugggagcaa

SEQ ID NO: 1878666 - RNA, 15 nt, Homo sapiens
cccaaguccugcucc

SEQ ID NO: 1878667 - RNA, 19 nt, Homo sapiens
uucuacauuuuauuacacu

SEQ ID NO: 1878668 - RNA, 23 nt, Homo sapiens
uugcccauauaaaaugcugauau

SEQ ID NO: 1878669 - RNA, 21 nt, Homo sapiens
aagaaccacuccuucauguuu

SEQ ID NO: 1878670 - RNA, 17 nt, Homo sapiens
ucucuucucagaaggaa

SEQ ID NO: 1878671 - RNA, 16 nt, Homo sapiens
caaacaggugcuaaca

SEQ ID NO: 1878672 - RNA, 22 nt, Homo sapiens
uaaaggcuugguugguagauau

SEQ ID NO: 1878673 - RNA, 19 nt, Homo sapiens
cauauucagcuugcacauu

SEQ ID NO: 1878674 - RNA, 21 nt, Homo sapiens
aagaaauacuccuguauugag

SEQ ID NO: 1878675 - RNA, 14 nt, Homo sapiens
aaguaugccuuaag

SEQ ID NO: 1878676 - RNA, 22 nt, Homo sapiens
ugggaaguuggcuggugucccu

SEQ ID NO: 1878677 - RNA, 22 nt, Homo sapiens
uaaugacuuacuuagaauuuau

SEQ ID NO: 1878678 - RNA, 22 nt, Homo sapiens
ucacuugaggucaggaguuuga

SEQ ID NO: 1878679 - RNA, 14 nt, Homo sapiens
aucuaccagcauaa

SEQ ID NO: 1878680 - RNA, 22 nt, Homo sapiens
uaauccaguggguuccucccag

SEQ ID NO: 1878681 - RNA, 17 nt, Homo sapiens
auaugaaggauuacucu

SEQ ID NO: 1878682 - RNA, 16 nt, Homo sapiens
uauggacuuacccuaa

SEQ ID NO: 1878683 - RNA, 15 nt, Homo sapiens
gcuuacuaugaccuu

SEQ ID NO: 1878684 - RNA, 14 nt, Homo sapiens
gcuggcacugagca

SEQ ID NO: 1878685 - RNA, 16 nt, Homo sapiens
ugaccucugccccaga

SEQ ID NO: 1878686 - RNA, 12 nt, Homo sapiens
uucauuuugcca

SEQ ID NO: 1878687 - RNA, 14 nt, Homo sapiens
uuauuauguucaau

SEQ ID NO: 1878688 - RNA, 19 nt, Homo sapiens
ggcauuguccaaaguuuau

SEQ ID NO: 1878689 - RNA, 18 nt, Homo sapiens
uaaauauccacaguacuc

SEQ ID NO: 1878690 - RNA, 13 nt, Homo sapiens
ccaccugccugac

SEQ ID NO: 1878691 - RNA, 16 nt, Homo sapiens
uaacuuguauauucca

SEQ ID NO: 1878692 - RNA, 21 nt, Homo sapiens
ucucuucaugcgcagucccca

SEQ ID NO: 1878693 - RNA, 17 nt, Homo sapiens
cuuuucagcagagucua

SEQ ID NO: 1878694 - RNA, 23 nt, Homo sapiens
uaaagccuucagaggguuuggac

SEQ ID NO: 1878695 - RNA, 19 nt, Homo sapiens
gaggcagaccauccaccag

SEQ ID NO: 1878696 - RNA, 16 nt, Homo sapiens
acacucagaacccagg

SEQ ID NO: 1878697 - RNA, 17 nt, Homo sapiens
ccugcccgagagcucuu

SEQ ID NO: 1878698 - RNA, 17 nt, Homo sapiens
agaaauuauacuuacuu

SEQ ID NO: 1878699 - RNA, 21 nt, Homo sapiens
ggagacugauggccaggcaag

SEQ ID NO: 1878700 - RNA, 16 nt, Homo sapiens
uuaacagacacuguaa

SEQ ID NO: 1878701 - RNA, 17 nt, Homo sapiens
gacacugaugaguuuca

SEQ ID NO: 1878702 - RNA, 22 nt, Homo sapiens
agaguaucugaggcacauguca

SEQ ID NO: 1878703 - RNA, 11 nt, Homo sapiens
uguauuaccaa

SEQ ID NO: 1878704 - RNA, 22 nt, Homo sapiens
guauaccuaucacuuacauuuu

SEQ ID NO: 1878705 - RNA, 14 nt, Homo sapiens
uccuuguacuugau

SEQ ID NO: 1878706 - RNA, 16 nt, Homo sapiens
uuuucuacuuugccac

SEQ ID NO: 1878707 - RNA, 16 nt, Homo sapiens
uccauggcucuguuau

SEQ ID NO: 1878708 - RNA, 20 nt, Homo sapiens
gcucugagaggcccuggauc

SEQ ID NO: 1878709 - RNA, 16 nt, Homo sapiens
acaaaacuucuuguca

SEQ ID NO: 1878710 - RNA, 22 nt, Homo sapiens
gaaggaaagggaagagucuucc

SEQ ID NO: 1878711 - RNA, 17 nt, Homo sapiens
aguuccagcagaugcca

SEQ ID NO: 1878712 - RNA, 15 nt, Homo sapiens
cuauuuuauucccuu

SEQ ID NO: 1878713 - RNA, 14 nt, Homo sapiens
uaauuuugaccaaa

SEQ ID NO: 1878714 - RNA, 15 nt, Homo sapiens
caagcccacagauga

SEQ ID NO: 1878715 - RNA, 17 nt, Homo sapiens
ccuuggcaguguggcag

SEQ ID NO: 1878716 - RNA, 18 nt, Homo sapiens
uccuguauaccuccucca

SEQ ID NO: 1878717 - RNA, 16 nt, Homo sapiens
cacagaacugaucuca

SEQ ID NO: 1878718 - RNA, 18 nt, Homo sapiens
aagcgauucucaugccuc

SEQ ID NO: 1878719 - RNA, 17 nt, Homo sapiens
uuccagaaaaauuuccc

SEQ ID NO: 1878720 - RNA, 13 nt, Homo sapiens
agcaauuugaaau

SEQ ID NO: 1878721 - RNA, 21 nt, Homo sapiens
uaagcaucugccaucugcuuu

SEQ ID NO: 1878722 - RNA, 15 nt, Homo sapiens
uggaaauaaaccugg

SEQ ID NO: 1878723 - RNA, 20 nt, Homo sapiens
cugguuugaaagaugcagug

SEQ ID NO: 1878724 - RNA, 18 nt, Homo sapiens
ugacuauaaagcuguuau

SEQ ID NO: 1878725 - RNA, 16 nt, Homo sapiens
gagauacccucugaga

SEQ ID NO: 1878726 - RNA, 18 nt, Homo sapiens
aaagcuauauaugaauaa

SEQ ID NO: 1878727 - RNA, 14 nt, Homo sapiens
cugaggacucugca

SEQ ID NO: 1878728 - RNA, 17 nt, Homo sapiens
gcaucugcucugagacg

SEQ ID NO: 1878729 - RNA, 16 nt, Homo sapiens
agucaacaaccaugcc

SEQ ID NO: 1878730 - RNA, 19 nt, Homo sapiens
ggacuauuuauaacuaaua

SEQ ID NO: 1878731 - RNA, 14 nt, Homo sapiens
caguccuguuugca

SEQ ID NO: 1878732 - RNA, 21 nt, Homo sapiens
uacagugaauuucugauuuca

SEQ ID NO: 1878733 - RNA, 15 nt, Homo sapiens
guuucaauaacagcu

SEQ ID NO: 1878734 - RNA, 22 nt, Homo sapiens
augggugauacuggagucuuau

SEQ ID NO: 1878735 - RNA, 20 nt, Homo sapiens
cuaaagaguuuucuaugaau

SEQ ID NO: 1878736 - RNA, 22 nt, Homo sapiens
uguauguaggcaauacauguau

SEQ ID NO: 1878737 - RNA, 15 nt, Homo sapiens
uccaagaaaugcaaa

SEQ ID NO: 1878738 - RNA, 23 nt, Homo sapiens
aaagguuggccuuaguagucaaa

SEQ ID NO: 1878739 - RNA, 22 nt, Homo sapiens
gaaacucccagccacagcauuu

SEQ ID NO: 1878740 - RNA, 18 nt, Homo sapiens
gaaaggagccggaccaag

SEQ ID NO: 1878741 - RNA, 15 nt, Homo sapiens
aagggcuccagacac

SEQ ID NO: 1878742 - RNA, 15 nt, Homo sapiens
cagaccucaagggac

SEQ ID NO: 1878743 - RNA, 13 nt, Homo sapiens
aacaguguucuca

SEQ ID NO: 1878744 - RNA, 22 nt, Homo sapiens
augcccaauauuaaguaaaaaa

SEQ ID NO: 1878745 - RNA, 13 nt, Homo sapiens
caucagcacaaag

SEQ ID NO: 1878746 - RNA, 12 nt, Homo sapiens
auguuuacuucu

SEQ ID NO: 1878747 - RNA, 16 nt, Homo sapiens
uggaaagucaugcaau

SEQ ID NO: 1878748 - RNA, 18 nt, Homo sapiens
uaaaacaaacaauaccug

SEQ ID NO: 1878749 - RNA, 21 nt, Homo sapiens
gcuggagcgaagccuucugca

SEQ ID NO: 1878750 - RNA, 22 nt, Homo sapiens
guaauauagugacuaugaacuu

SEQ ID NO: 1878751 - RNA, 22 nt, Homo sapiens
ucaguucccuccuucuuacaga

SEQ ID NO: 1878752 - RNA, 13 nt, Homo sapiens
acuuuaucaaaga

SEQ ID NO: 1878753 - RNA, 17 nt, Homo sapiens
gcaggagaacuacuuga

SEQ ID NO: 1878754 - RNA, 15 nt, Homo sapiens
cagaaggccaagagg

SEQ ID NO: 1878755 - RNA, 15 nt, Homo sapiens
aggaggacagaggga

SEQ ID NO: 1878756 - RNA, 13 nt, Homo sapiens
gccugcuccucac

SEQ ID NO: 1878757 - RNA, 20 nt, Homo sapiens
ccuguuaaaauguacacugg

SEQ ID NO: 1878758 - RNA, 17 nt, Homo sapiens
gcauuaauacauuucaa

SEQ ID NO: 1878759 - RNA, 12 nt, Homo sapiens
agcaucugacca

SEQ ID NO: 1878760 - RNA, 17 nt, Homo sapiens
cagcuuaagaguagcug

SEQ ID NO: 1878761 - RNA, 14 nt, Homo sapiens
cauuucguauuucu

SEQ ID NO: 1878762 - RNA, 16 nt, Homo sapiens
gugguccaucucugaa

SEQ ID NO: 1878763 - RNA, 22 nt, Homo sapiens
ugaaucaaugaaaaauguaauu

SEQ ID NO: 1878764 - RNA, 20 nt, Homo sapiens
agcguccucguucaaaacau

SEQ ID NO: 1878765 - RNA, 21 nt, Homo sapiens
gaggagggcccugaggaauaa

SEQ ID NO: 1878766 - RNA, 18 nt, Homo sapiens
guguucacaacagugaaa

SEQ ID NO: 1878767 - RNA, 19 nt, Homo sapiens
uaaauaagcaaaaugccaa

SEQ ID NO: 1878768 - RNA, 23 nt, Homo sapiens
uggccuaggugggagccaccacu

SEQ ID NO: 1878769 - RNA, 16 nt, Homo sapiens
aagccuccgcugggcu

SEQ ID NO: 1878770 - RNA, 17 nt, Homo sapiens
cuucacucuucacuuga

SEQ ID NO: 1878771 - RNA, 15 nt, Homo sapiens
ccagcacuuggcuga

SEQ ID NO: 1878772 - RNA, 13 nt, Homo sapiens
uacagagaaguca

SEQ ID NO: 1878773 - RNA, 17 nt, Homo sapiens
aaaaagcccuuugcuaa

SEQ ID NO: 1878774 - RNA, 19 nt, Homo sapiens
uucuacacuguauuacaua

SEQ ID NO: 1878775 - RNA, 22 nt, Homo sapiens
ucuaaauaauaauaaaacaaca

SEQ ID NO: 1878776 - RNA, 17 nt, Homo sapiens
gugcuuugcauguauua

SEQ ID NO: 1878777 - RNA, 22 nt, Homo sapiens
uuaagaaacacaggguuuugua

SEQ ID NO: 1878778 - RNA, 17 nt, Homo sapiens
ucaguguugacauagcc

SEQ ID NO: 1878779 - RNA, 21 nt, Homo sapiens
guuccuguucgguuccagaca

SEQ ID NO: 1878780 - RNA, 10 nt, Homo sapiens
gcuaccuccc

SEQ ID NO: 1878781 - RNA, 18 nt, Homo sapiens
ugcccaggaccaucuucc

SEQ ID NO: 1878782 - RNA, 16 nt, Homo sapiens
aucucucuagugaugg

SEQ ID NO: 1878783 - RNA, 18 nt, Homo sapiens
uucucaugaacuacccca

SEQ ID NO: 1878784 - RNA, 20 nt, Homo sapiens
cuuugcagaccgcauaguca

SEQ ID NO: 1878785 - RNA, 18 nt, Homo sapiens
aaggcaggaacacuggag

SEQ ID NO: 1878786 - RNA, 16 nt, Homo sapiens
gguucaccaugcagug

SEQ ID NO: 1878787 - RNA, 17 nt, Homo sapiens
ggcucuuaaaugcugca

SEQ ID NO: 1878788 - RNA, 17 nt, Homo sapiens
gagcuguggacuuuguu

SEQ ID NO: 1878789 - RNA, 22 nt, Homo sapiens
ccuacacaaaauacagcacuuu

SEQ ID NO: 1878790 - RNA, 14 nt, Homo sapiens
acugcuacaugugc

SEQ ID NO: 1878791 - RNA, 19 nt, Homo sapiens
auuuguagcauaacuguag

SEQ ID NO: 1878792 - RNA, 20 nt, Homo sapiens
gacacccaacacuuuuucca

SEQ ID NO: 1878793 - RNA, 20 nt, Homo sapiens
aauuaaaauacagcugcacu

SEQ ID NO: 1878794 - RNA, 15 nt, Homo sapiens
uggaugcacuuccug

SEQ ID NO: 1878795 - RNA, 15 nt, Homo sapiens
cccaagucacaccca

SEQ ID NO: 1878796 - RNA, 17 nt, Homo sapiens
gcuuaagccaucuuugu

SEQ ID NO: 1878797 - RNA, 14 nt, Homo sapiens
uacuugaaauacca

SEQ ID NO: 1878798 - RNA, 13 nt, Homo sapiens
aaaaaauagcaca

SEQ ID NO: 1878799 - RNA, 21 nt, Homo sapiens
aagcuguacucagagcagagc

SEQ ID NO: 1878800 - RNA, 21 nt, Homo sapiens
guccugacacuauucauuuga

SEQ ID NO: 1878801 - RNA, 16 nt, Homo sapiens
caggcucaaccuucca

SEQ ID NO: 1878802 - RNA, 16 nt, Homo sapiens
cuucugcguaagaaag

SEQ ID NO: 1878803 - RNA, 14 nt, Homo sapiens
ugauuaaguuccua

SEQ ID NO: 1878804 - RNA, 18 nt, Homo sapiens
ugcaagggggacacauga

SEQ ID NO: 1878805 - RNA, 24 nt, Homo sapiens
uccccagguccugucucugcacag

SEQ ID NO: 1878806 - RNA, 21 nt, Homo sapiens
uaccugacggacguccugcug

SEQ ID NO: 1878807 - RNA, 21 nt, Homo sapiens
cagcugcuugggcuucauccu

SEQ ID NO: 1878808 - RNA, 20 nt, Homo sapiens
uucaagacuugauacugcaa

SEQ ID NO: 1878809 - RNA, 20 nt, Homo sapiens
ucugacuuaagugugcaaaa

SEQ ID NO: 1878810 - RNA, 18 nt, Homo sapiens
cugucccucgugaaguca

SEQ ID NO: 1878811 - RNA, 14 nt, Homo sapiens
ucacuucugaauug

SEQ ID NO: 1878812 - RNA, 17 nt, Homo sapiens
gucuacaugccaugacc

SEQ ID NO: 1878813 - RNA, 15 nt, Homo sapiens
agaacagcagacuca

SEQ ID NO: 1878814 - RNA, 19 nt, Homo sapiens
aaacaaaaaaaagaaccuu

SEQ ID NO: 1878815 - RNA, 23 nt, Homo sapiens
ccucccuccugauguuuuuccca

SEQ ID NO: 1878816 - RNA, 20 nt, Homo sapiens
cccaacauuucuuaaauuau

SEQ ID NO: 1878817 - RNA, 18 nt, Homo sapiens
gacacagacaaagugaca

SEQ ID NO: 1878818 - RNA, 12 nt, Homo sapiens
caagcucagggc

SEQ ID NO: 1878819 - RNA, 17 nt, Homo sapiens
cagcccagugcugccac

SEQ ID NO: 1878820 - RNA, 13 nt, Homo sapiens
aaaacuaugcaag

SEQ ID NO: 1878821 - RNA, 18 nt, Homo sapiens
gcuagcuauuacugcaga

SEQ ID NO: 1878822 - RNA, 11 nt, Homo sapiens
auuuaauucca

SEQ ID NO: 1878823 - RNA, 20 nt, Homo sapiens
agggaaaggguggaugcucu

SEQ ID NO: 1878824 - RNA, 19 nt, Homo sapiens
uuaacucccuccaccagcc

SEQ ID NO: 1878825 - RNA, 20 nt, Homo sapiens
aaccaagacaaaaagccaca

SEQ ID NO: 1878826 - RNA, 19 nt, Homo sapiens
cugugcccaguacuuccug

SEQ ID NO: 1878827 - RNA, 12 nt, Homo sapiens
ucuuuauacugg

SEQ ID NO: 1878828 - RNA, 17 nt, Homo sapiens
ugcccaggguuuugccc

SEQ ID NO: 1878829 - RNA, 21 nt, Homo sapiens
uaccacugucuucuucagggu

SEQ ID NO: 1878830 - RNA, 15 nt, Homo sapiens
uugauuucauuaaua

SEQ ID NO: 1878831 - RNA, 15 nt, Homo sapiens
uauauuucaagaaua

SEQ ID NO: 1878832 - RNA, 15 nt, Homo sapiens
gaaaaacuuccauga

SEQ ID NO: 1878833 - RNA, 13 nt, Homo sapiens
uauguaacaguuu

SEQ ID NO: 1878834 - RNA, 13 nt, Homo sapiens
aauuuaacugugu

SEQ ID NO: 1878835 - RNA, 17 nt, Homo sapiens
ugaagacuuacagcaaa

SEQ ID NO: 1878836 - RNA, 17 nt, Homo sapiens
agagcaggggcuccagc

SEQ ID NO: 1878837 - RNA, 13 nt, Homo sapiens
gcaggaggccauu

SEQ ID NO: 1878838 - RNA, 21 nt, Homo sapiens
ucaugcuacagagagugaaua

SEQ ID NO: 1878839 - RNA, 19 nt, Homo sapiens
cauaaggcauauacaaaua

SEQ ID NO: 1878840 - RNA, 13 nt, Homo sapiens
caggggcugcuca

SEQ ID NO: 1878841 - RNA, 20 nt, Homo sapiens
cucaacaaccggccccagag

SEQ ID NO: 1878842 - RNA, 18 nt, Homo sapiens
ggaccuuccacacagggu

SEQ ID NO: 1878843 - RNA, 15 nt, Homo sapiens
ugucugcaacaugga

SEQ ID NO: 1878844 - RNA, 21 nt, Homo sapiens
uggggaauucacuucucuucc

SEQ ID NO: 1878845 - RNA, 21 nt, Homo sapiens
gaacuacgggcugcucuacug

SEQ ID NO: 1878846 - RNA, 22 nt, Homo sapiens
ccgggaagcggagguugcaggg

SEQ ID NO: 1878847 - RNA, 19 nt, Homo sapiens
cuccaguguccugagcuca

SEQ ID NO: 1878848 - RNA, 12 nt, Homo sapiens
aacugugacugu

SEQ ID NO: 1878849 - RNA, 20 nt, Homo sapiens
guuuugagcauggguucauc

SEQ ID NO: 1878850 - RNA, 17 nt, Homo sapiens
ucuuaugauuacuauca

SEQ ID NO: 1878851 - RNA, 18 nt, Homo sapiens
ccagcuacucaggagucu

SEQ ID NO: 1878852 - RNA, 14 nt, Homo sapiens
uuaaucacugcauu

SEQ ID NO: 1878853 - RNA, 14 nt, Homo sapiens
agcuuuacauauuc

SEQ ID NO: 1878854 - RNA, 18 nt, Homo sapiens
uauuacacuaaaugauau

SEQ ID NO: 1878855 - RNA, 14 nt, Homo sapiens
cagagcuuccucag

SEQ ID NO: 1878856 - RNA, 22 nt, Homo sapiens
uguucauucuuguucaaaaaga

SEQ ID NO: 1878857 - RNA, 21 nt, Homo sapiens
agauuauagcucccaaaagaa

SEQ ID NO: 1878858 - RNA, 15 nt, Homo sapiens
aagcaugacccaggu

SEQ ID NO: 1878859 - RNA, 18 nt, Homo sapiens
uccuagcugugugaauac

SEQ ID NO: 1878860 - RNA, 12 nt, Homo sapiens
acucugacucuc

SEQ ID NO: 1878861 - RNA, 13 nt, Homo sapiens
uugaccacccacc

SEQ ID NO: 1878862 - RNA, 23 nt, Homo sapiens
agguagcuuguccaaggucucau

SEQ ID NO: 1878863 - RNA, 16 nt, Homo sapiens
uaagcauuagcacaua

SEQ ID NO: 1878864 - RNA, 15 nt, Homo sapiens
gauguagaaacaaua

SEQ ID NO: 1878865 - RNA, 13 nt, Homo sapiens
cccgaaaccagag

SEQ ID NO: 1878866 - RNA, 15 nt, Homo sapiens
ugucacacaaaaagu

SEQ ID NO: 1878867 - RNA, 12 nt, Homo sapiens
aucaaaguaaua

SEQ ID NO: 1878868 - RNA, 23 nt, Homo sapiens
ggaucuaauaaacuuccaaacag

SEQ ID NO: 1878869 - RNA, 21 nt, Homo sapiens
ucauucaagaggaauuccagc

SEQ ID NO: 1878870 - RNA, 19 nt, Homo sapiens
gcccugguguguuuccaga

SEQ ID NO: 1878871 - RNA, 11 nt, Homo sapiens
ugaaagcacag

SEQ ID NO: 1878872 - RNA, 16 nt, Homo sapiens
acacuccccugcacug

SEQ ID NO: 1878873 - RNA, 22 nt, Homo sapiens
aacaugguacacugcaucucaa

SEQ ID NO: 1878874 - RNA, 12 nt, Homo sapiens
cccuuugcacac

SEQ ID NO: 1878875 - RNA, 18 nt, Homo sapiens
auaagcaacuucacagaa

SEQ ID NO: 1878876 - RNA, 16 nt, Homo sapiens
acuugaucauucucag

SEQ ID NO: 1878877 - RNA, 22 nt, Homo sapiens
ugaaucucguugaggccaagga

SEQ ID NO: 1878878 - RNA, 21 nt, Homo sapiens
acugcaccuggcccagaugau

SEQ ID NO: 1878879 - RNA, 19 nt, Homo sapiens
ucuuccuaucccaucccau

SEQ ID NO: 1878880 - RNA, 16 nt, Homo sapiens
ugcaagucauacuuag

SEQ ID NO: 1878881 - RNA, 21 nt, Homo sapiens
ggagucagucaugucacugaa

SEQ ID NO: 1878882 - RNA, 15 nt, Homo sapiens
uacagacugaugcca

SEQ ID NO: 1878883 - RNA, 13 nt, Homo sapiens
ugagacuggaaaa

SEQ ID NO: 1878884 - RNA, 16 nt, Homo sapiens
cuucagcuugcuuaga

SEQ ID NO: 1878885 - RNA, 18 nt, Homo sapiens
ucuucuccaacaccaccu

SEQ ID NO: 1878886 - RNA, 19 nt, Homo sapiens
gcaccuggcccagaugaua

SEQ ID NO: 1878887 - RNA, 18 nt, Homo sapiens
agaacugcuuaguauuag

SEQ ID NO: 1878888 - RNA, 20 nt, Homo sapiens
caccagcccagaagugcaga

SEQ ID NO: 1878889 - RNA, 20 nt, Homo sapiens
ccuccuccccuccuugcacc

SEQ ID NO: 1878890 - RNA, 13 nt, Homo sapiens
cuguacacaggcg

SEQ ID NO: 1878891 - RNA, 19 nt, Homo sapiens
guuacaaaaauaaacuaua

SEQ ID NO: 1878892 - RNA, 18 nt, Homo sapiens
agcugugccgggaggcag

SEQ ID NO: 1878893 - RNA, 23 nt, Homo sapiens
aaugguaaagaaauacacaggga

SEQ ID NO: 1878894 - RNA, 22 nt, Homo sapiens
cugaggcaggagaauugcuuga

SEQ ID NO: 1878895 - RNA, 22 nt, Homo sapiens
cugaggcaagagaauuacuuga

SEQ ID NO: 1878896 - RNA, 14 nt, Homo sapiens
caagagcacacuug

SEQ ID NO: 1878897 - RNA, 16 nt, Homo sapiens
uaaagccaguggcagu

SEQ ID NO: 1878898 - RNA, 11 nt, Homo sapiens
augaacauaua

SEQ ID NO: 1878899 - RNA, 19 nt, Homo sapiens
cccagaaguccagaagggu

SEQ ID NO: 1878900 - RNA, 12 nt, Homo sapiens
caagaaaccacu

SEQ ID NO: 1878901 - RNA, 17 nt, Homo sapiens
gauugggucguggugga

SEQ ID NO: 1878902 - RNA, 22 nt, Homo sapiens
aggccugccuucucagggacuu

SEQ ID NO: 1878903 - RNA, 18 nt, Homo sapiens
gaaugaggucccaggcag

SEQ ID NO: 1878904 - RNA, 15 nt, Homo sapiens
acccuuuccucuuaa

SEQ ID NO: 1878905 - RNA, 21 nt, Homo sapiens
acaccaucuuuccaucccagg

SEQ ID NO: 1878906 - RNA, 13 nt, Homo sapiens
cucucuggucuuu

SEQ ID NO: 1878907 - RNA, 23 nt, Homo sapiens
guauccagagauacuacaauauu

SEQ ID NO: 1878908 - RNA, 21 nt, Homo sapiens
agguaggcacaaauacauucc

SEQ ID NO: 1878909 - RNA, 13 nt, Homo sapiens
aggaacuucugaa

SEQ ID NO: 1878910 - RNA, 15 nt, Homo sapiens
gaagacagcuuccca

SEQ ID NO: 1878911 - RNA, 23 nt, Homo sapiens
ccugcgguggggcugaggggugg

SEQ ID NO: 1878912 - RNA, 22 nt, Homo sapiens
aggccaucuguaaauaucccag

SEQ ID NO: 1878913 - RNA, 17 nt, Homo sapiens
acccugcaggacuugcc

SEQ ID NO: 1878914 - RNA, 15 nt, Homo sapiens
ucuuuucagcuuguu

SEQ ID NO: 1878915 - RNA, 18 nt, Homo sapiens
aaauauuucaugauucac

SEQ ID NO: 1878916 - RNA, 23 nt, Homo sapiens
agugauuucggaccgaaggugac

SEQ ID NO: 1878917 - RNA, 14 nt, Homo sapiens
uagauacagaauaa

SEQ ID NO: 1878918 - RNA, 20 nt, Homo sapiens
caguguuuugccauguuggc

SEQ ID NO: 1878919 - RNA, 12 nt, Homo sapiens
uccuuccauccc

SEQ ID NO: 1878920 - RNA, 12 nt, Homo sapiens
ucccuccauccu

SEQ ID NO: 1878921 - RNA, 15 nt, Homo sapiens
guggggcaaucuauu

SEQ ID NO: 1878922 - RNA, 14 nt, Homo sapiens
ucauuguaaucacu

SEQ ID NO: 1878923 - RNA, 14 nt, Homo sapiens
uggagauagucuca

SEQ ID NO: 1878924 - RNA, 19 nt, Homo sapiens
cauuuuaauuuuaaccaaa

SEQ ID NO: 1878925 - RNA, 14 nt, Homo sapiens
cugcauugccugcg

SEQ ID NO: 1878926 - RNA, 13 nt, Homo sapiens
uauccaugcaugu

SEQ ID NO: 1878927 - RNA, 12 nt, Homo sapiens
gaacuccacugc

SEQ ID NO: 1878928 - RNA, 14 nt, Homo sapiens
uguagacagccuuc

SEQ ID NO: 1878929 - RNA, 15 nt, Homo sapiens
gcuggacgugcgcga

SEQ ID NO: 1878930 - RNA, 12 nt, Homo sapiens
gugcaugcacac

SEQ ID NO: 1878931 - RNA, 10 nt, Homo sapiens
uuggggacca

SEQ ID NO: 1878932 - RNA, 14 nt, Homo sapiens
cuguuucuaccuau

SEQ ID NO: 1878933 - RNA, 14 nt, Homo sapiens
uuguagaugcauua

SEQ ID NO: 1878934 - RNA, 20 nt, Homo sapiens
aucucgaacuccuaaccuca

SEQ ID NO: 1878935 - RNA, 20 nt, Homo sapiens
aucucaaacuccugaccuca

SEQ ID NO: 1878936 - RNA, 18 nt, Homo sapiens
ccacucaggauugggaau

SEQ ID NO: 1878937 - RNA, 21 nt, Homo sapiens
ccgggugggcggcacagccuu

SEQ ID NO: 1878938 - RNA, 18 nt, Homo sapiens
agacuguucuuacuguaa

SEQ ID NO: 1878939 - RNA, 14 nt, Homo sapiens
agcucuacagguga

SEQ ID NO: 1878940 - RNA, 16 nt, Homo sapiens
uaaauugguacaguau

SEQ ID NO: 1878941 - RNA, 22 nt, Homo sapiens
auaacaauaaaaaccaaacucu

SEQ ID NO: 1878942 - RNA, 21 nt, Homo sapiens
agccuccagggcauugcucag

SEQ ID NO: 1878943 - RNA, 20 nt, Homo sapiens
ugacaauugcaaaucagagc

SEQ ID NO: 1878944 - RNA, 18 nt, Homo sapiens
auguaaacaaaaagggaa

SEQ ID NO: 1878945 - RNA, 15 nt, Homo sapiens
cucccgacugaccac

SEQ ID NO: 1878946 - RNA, 20 nt, Homo sapiens
acaaauuuuucaaaucauuc

SEQ ID NO: 1878947 - RNA, 13 nt, Homo sapiens
ugaagaucugaga

SEQ ID NO: 1878948 - RNA, 15 nt, Homo sapiens
agcgcccccacuccu

SEQ ID NO: 1878949 - RNA, 18 nt, Homo sapiens
cuaggauuugaacacuug

SEQ ID NO: 1878950 - RNA, 17 nt, Homo sapiens
uacagcuggcuaucuac

SEQ ID NO: 1878951 - RNA, 16 nt, Homo sapiens
uacccauacacccccu

SEQ ID NO: 1878952 - RNA, 16 nt, Homo sapiens
gagccugcugcauggg

SEQ ID NO: 1878953 - RNA, 23 nt, Homo sapiens
acagaauuucauucauuugugcu

SEQ ID NO: 1878954 - RNA, 19 nt, Homo sapiens
gggaagacuuuaaaccacc

SEQ ID NO: 1878955 - RNA, 15 nt, Homo sapiens
cugggcacaagcagg

SEQ ID NO: 1878956 - RNA, 18 nt, Homo sapiens
gcgcccagccucaucucu

SEQ ID NO: 1878957 - RNA, 15 nt, Homo sapiens
cuuauugaacauucu

SEQ ID NO: 1878958 - RNA, 22 nt, Homo sapiens
agcuaugauuaugccacugcuu

SEQ ID NO: 1878959 - RNA, 14 nt, Homo sapiens
aaucccagcacuug

SEQ ID NO: 1878960 - RNA, 15 nt, Homo sapiens
aauccuuuacuguua

SEQ ID NO: 1878961 - RNA, 18 nt, Homo sapiens
ggaagugacauuguguca

SEQ ID NO: 1878962 - RNA, 22 nt, Homo sapiens
auucaugugggcauuucuugcg

SEQ ID NO: 1878963 - RNA, 13 nt, Homo sapiens
uccaagcugcaug

SEQ ID NO: 1878964 - RNA, 21 nt, Homo sapiens
guugucucauagaacugccug

SEQ ID NO: 1878965 - RNA, 16 nt, Homo sapiens
accugucccaccucaa

SEQ ID NO: 1878966 - RNA, 17 nt, Homo sapiens
agaggaagacgagacag

SEQ ID NO: 1878967 - RNA, 13 nt, Homo sapiens
auccucucucugu

SEQ ID NO: 1878968 - RNA, 23 nt, Homo sapiens
uggacuguuuucaauaacaaagc

SEQ ID NO: 1878969 - RNA, 15 nt, Homo sapiens
auagcauguaauggu

SEQ ID NO: 1878970 - RNA, 22 nt, Homo sapiens
accugauuccuguugcuuccag

SEQ ID NO: 1878971 - RNA, 16 nt, Homo sapiens
guaacauuaauucuac

SEQ ID NO: 1878972 - RNA, 15 nt, Homo sapiens
acuacagaaagcaaa

SEQ ID NO: 1878973 - RNA, 18 nt, Homo sapiens
uuucucuucaaauuuagc

SEQ ID NO: 1878974 - RNA, 16 nt, Homo sapiens
ucugauuacacaaaac

SEQ ID NO: 1878975 - RNA, 17 nt, Homo sapiens
ugcuaggauuacaggca

SEQ ID NO: 1878976 - RNA, 18 nt, Homo sapiens
agaaauaaggcuaaccau

SEQ ID NO: 1878977 - RNA, 22 nt, Homo sapiens
cccugaaaaacuaguaauacug

SEQ ID NO: 1878978 - RNA, 14 nt, Homo sapiens
uuauuuagcccaua

SEQ ID NO: 1878979 - RNA, 17 nt, Homo sapiens
ugacagcaaacacaguc

SEQ ID NO: 1878980 - RNA, 13 nt, Homo sapiens
aguuuacaggaua

SEQ ID NO: 1878981 - RNA, 20 nt, Homo sapiens
cugauaaccacuccuaauau

SEQ ID NO: 1878982 - RNA, 18 nt, Homo sapiens
uaauaaauuuaauaaaua

SEQ ID NO: 1878983 - RNA, 18 nt, Homo sapiens
aaaugaggaggaugcuaa

SEQ ID NO: 1878984 - RNA, 16 nt, Homo sapiens
ccaccaaagacaguug

SEQ ID NO: 1878985 - RNA, 12 nt, Homo sapiens
ccucaugccaug

SEQ ID NO: 1878986 - RNA, 22 nt, Homo sapiens
aacuggaaaguacguuaugaua

SEQ ID NO: 1878987 - RNA, 19 nt, Homo sapiens
uaggagaaaccagcuuuua

SEQ ID NO: 1878988 - RNA, 18 nt, Homo sapiens
acuuugauaucugaucaa

SEQ ID NO: 1878989 - RNA, 14 nt, Homo sapiens
gagacagauaacuc

SEQ ID NO: 1878990 - RNA, 11 nt, Homo sapiens
cauuguuaaag

SEQ ID NO: 1878991 - RNA, 21 nt, Homo sapiens
cagaucacucaaaaaggugug

SEQ ID NO: 1878992 - RNA, 16 nt, Homo sapiens
uguuuauucuauaguu

SEQ ID NO: 1878993 - RNA, 23 nt, Homo sapiens
acagacucauccugaacagcaug

SEQ ID NO: 1878994 - RNA, 16 nt, Homo sapiens
gggauaagggagucca

SEQ ID NO: 1878995 - RNA, 16 nt, Homo sapiens
uccuggcuaacacgug

SEQ ID NO: 1878996 - RNA, 17 nt, Homo sapiens
aguuaccagugccuuaa

SEQ ID NO: 1878997 - RNA, 15 nt, Homo sapiens
ucucugaacugcaac

SEQ ID NO: 1878998 - RNA, 15 nt, Homo sapiens
acucugcacaugucu

SEQ ID NO: 1878999 - RNA, 17 nt, Homo sapiens
gaccuugggguacaauu

SEQ ID NO: 1879000 - RNA, 18 nt, Homo sapiens
agagagucccacugccuc

SEQ ID NO: 1879001 - RNA, 10 nt, Homo sapiens
ucuguacaau

SEQ ID NO: 1879002 - RNA, 14 nt, Homo sapiens
agccauaaaccaau

SEQ ID NO: 1879003 - RNA, 15 nt, Homo sapiens
guugagaaauucugc

SEQ ID NO: 1879004 - RNA, 17 nt, Homo sapiens
ccagugcagacucaaga

SEQ ID NO: 1879005 - RNA, 22 nt, Homo sapiens
acuccucuccuccccccaagcu

SEQ ID NO: 1879006 - RNA, 16 nt, Homo sapiens
acauggccuaugcaca

SEQ ID NO: 1879007 - RNA, 20 nt, Homo sapiens
cagcugcauuucuuuugcaa

SEQ ID NO: 1879008 - RNA, 18 nt, Homo sapiens
ucccuagucuauucauua

SEQ ID NO: 1879009 - RNA, 14 nt, Homo sapiens
aaucagacuaugaa

SEQ ID NO: 1879010 - RNA, 23 nt, Homo sapiens
aacuuugccaaauauaaucucac

SEQ ID NO: 1879011 - RNA, 18 nt, Homo sapiens
ugggcaugagggguuccu

SEQ ID NO: 1879012 - RNA, 20 nt, Homo sapiens
uccaagauuuaaaugccaua

SEQ ID NO: 1879013 - RNA, 16 nt, Homo sapiens
cuaugaggcaaccaca

SEQ ID NO: 1879014 - RNA, 19 nt, Homo sapiens
agcugcauuucacaugccu

SEQ ID NO: 1879015 - RNA, 17 nt, Homo sapiens
ucugguccgagucucag

SEQ ID NO: 1879016 - RNA, 22 nt, Homo sapiens
acagccucugaccccuccucac

SEQ ID NO: 1879017 - RNA, 13 nt, Homo sapiens
aacugguacaauu

SEQ ID NO: 1879018 - RNA, 22 nt, Homo sapiens
cccagggccuccugggggaccu

SEQ ID NO: 1879019 - RNA, 21 nt, Homo sapiens
auaaguuuuauguuaaaucaa

SEQ ID NO: 1879020 - RNA, 18 nt, Homo sapiens
ccucacaggccccaggaa

SEQ ID NO: 1879021 - RNA, 21 nt, Homo sapiens
uuucacaaaaaggcauaugca

SEQ ID NO: 1879022 - RNA, 17 nt, Homo sapiens
auucaauuaguggucau

SEQ ID NO: 1879023 - RNA, 22 nt, Homo sapiens
acaugguugugagucuugacaa

SEQ ID NO: 1879024 - RNA, 15 nt, Homo sapiens
auugaaguuguuuau

SEQ ID NO: 1879025 - RNA, 18 nt, Homo sapiens
auuuuaaaaauaaauuca

SEQ ID NO: 1879026 - RNA, 13 nt, Homo sapiens
uuuguuuuaaucc

SEQ ID NO: 1879027 - RNA, 20 nt, Homo sapiens
aaggauccucuccacuccau

SEQ ID NO: 1879028 - RNA, 12 nt, Homo sapiens
uacucugugaaa

SEQ ID NO: 1879029 - RNA, 18 nt, Homo sapiens
cccagacaccaugugcaa

SEQ ID NO: 1879030 - RNA, 19 nt, Homo sapiens
uaagacccucucaaacuaa

SEQ ID NO: 1879031 - RNA, 9 nt, Homo sapiens
acacaaaac

SEQ ID NO: 1879032 - RNA, 22 nt, Homo sapiens
cacuggugguucuacugaccca

SEQ ID NO: 1879033 - RNA, 22 nt, Homo sapiens
uuguguuuauauauaagccaaa

SEQ ID NO: 1879034 - RNA, 23 nt, Homo sapiens
agggccuucugccugcugaccau

SEQ ID NO: 1879035 - RNA, 13 nt, Homo sapiens
cuacccucaguga

SEQ ID NO: 1879036 - RNA, 13 nt, Homo sapiens
caauuccucuggg

SEQ ID NO: 1879037 - RNA, 21 nt, Homo sapiens
auggagcuguauaacugugca

SEQ ID NO: 1879038 - RNA, 16 nt, Homo sapiens
ccugcuuugggaagcc

SEQ ID NO: 1879039 - RNA, 21 nt, Homo sapiens
uaccuccauccauccuuccaa

SEQ ID NO: 1879040 - RNA, 21 nt, Homo sapiens
uggagacagagagacuggcca

SEQ ID NO: 1879041 - RNA, 11 nt, Homo sapiens
agccauuuagg

SEQ ID NO: 1879042 - RNA, 13 nt, Homo sapiens
uggcccaagacuc

SEQ ID NO: 1879043 - RNA, 20 nt, Homo sapiens
augaaggcaggggcucagug

SEQ ID NO: 1879044 - RNA, 12 nt, Homo sapiens
uacguggauguu

SEQ ID NO: 1879045 - RNA, 14 nt, Homo sapiens
agcaacuaacuaac

SEQ ID NO: 1879046 - RNA, 22 nt, Homo sapiens
accuuggaaaugaccaggccaa

SEQ ID NO: 1879047 - RNA, 16 nt, Homo sapiens
guccgccgcugcacau

SEQ ID NO: 1879048 - RNA, 16 nt, Homo sapiens
guauaaauuuuuaccu

SEQ ID NO: 1879049 - RNA, 22 nt, Homo sapiens
ccuuccaacccauuagccauuu

SEQ ID NO: 1879050 - RNA, 16 nt, Homo sapiens
uaaaaauugacaauga

SEQ ID NO: 1879051 - RNA, 19 nt, Homo sapiens
caaacaggcuguaauucca

SEQ ID NO: 1879052 - RNA, 17 nt, Homo sapiens
aggagagugagugccuu

SEQ ID NO: 1879053 - RNA, 21 nt, Homo sapiens
cuaucauggcagcaugcgaug

SEQ ID NO: 1879054 - RNA, 18 nt, Homo sapiens
aauauuugaaucuugucu

SEQ ID NO: 1879055 - RNA, 16 nt, Homo sapiens
auguaaaauguugaau

SEQ ID NO: 1879056 - RNA, 19 nt, Homo sapiens
auaacuagaguauguguau

SEQ ID NO: 1879057 - RNA, 22 nt, Homo sapiens
uagauucccaucauacacuucc

SEQ ID NO: 1879058 - RNA, 19 nt, Homo sapiens
cccugcuaaggaguucuca

SEQ ID NO: 1879059 - RNA, 22 nt, Homo sapiens
aagaaaagcaguuugcacuuaa

SEQ ID NO: 1879060 - RNA, 22 nt, Homo sapiens
ccacaggcuccccaucuucucc

SEQ ID NO: 1879061 - RNA, 15 nt, Homo sapiens
cagcaggggugggag

SEQ ID NO: 1879062 - RNA, 21 nt, Homo sapiens
gugccaucuguagcuauaaug

SEQ ID NO: 1879063 - RNA, 16 nt, Homo sapiens
uucaguuguuuugcau

SEQ ID NO: 1879064 - RNA, 15 nt, Homo sapiens
agaagguugugauga

SEQ ID NO: 1879065 - RNA, 18 nt, Homo sapiens
ugcaacuugugaacucca

SEQ ID NO: 1879066 - RNA, 22 nt, Homo sapiens
aaagccgguugcagagaaucug

SEQ ID NO: 1879067 - RNA, 23 nt, Homo sapiens
ucuuucuauauaaaauguauuca

SEQ ID NO: 1879068 - RNA, 17 nt, Homo sapiens
ccuuggcacccaagacc

SEQ ID NO: 1879069 - RNA, 19 nt, Homo sapiens
auacagagguaacuaucaa

SEQ ID NO: 1879070 - RNA, 14 nt, Homo sapiens
agggucucacucug

SEQ ID NO: 1879071 - RNA, 20 nt, Homo sapiens
agcagcugucagaacacucc

SEQ ID NO: 1879072 - RNA, 22 nt, Homo sapiens
caacuuuagcuaguaucuucaa

SEQ ID NO: 1879073 - RNA, 13 nt, Homo sapiens
cuucucuacagac

SEQ ID NO: 1879074 - RNA, 22 nt, Homo sapiens
gcauugguggcaucacagaccc

SEQ ID NO: 1879075 - RNA, 16 nt, Homo sapiens
auuucugccaggcaug

SEQ ID NO: 1879076 - RNA, 20 nt, Homo sapiens
ggccaguuccuucucuuuaa

SEQ ID NO: 1879077 - RNA, 21 nt, Homo sapiens
uugaaggguggucaguaguuu

SEQ ID NO: 1879078 - RNA, 22 nt, Homo sapiens
guugggcgggcgccaucuucca

SEQ ID NO: 1879079 - RNA, 22 nt, Homo sapiens
aaaaugguauaaguaacuuuau

SEQ ID NO: 1879080 - RNA, 16 nt, Homo sapiens
gagcuggcagcaaugg

SEQ ID NO: 1879081 - RNA, 18 nt, Homo sapiens
cauucuuuccuaaauaua

SEQ ID NO: 1879082 - RNA, 19 nt, Homo sapiens
ugaccaggggcccuaccug

SEQ ID NO: 1879083 - RNA, 18 nt, Homo sapiens
uaaguaaccucuacaggc

SEQ ID NO: 1879084 - RNA, 16 nt, Homo sapiens
uuuguaauauucucuc

SEQ ID NO: 1879085 - RNA, 22 nt, Homo sapiens
ggguaggcgggaaggaggguua

SEQ ID NO: 1879086 - RNA, 21 nt, Homo sapiens
cuaggacuguggaggggagcu

SEQ ID NO: 1879087 - RNA, 22 nt, Homo sapiens
gucugggaguauacggaaacaa

SEQ ID NO: 1879088 - RNA, 18 nt, Homo sapiens
uggccagagccucuggcc

SEQ ID NO: 1879089 - RNA, 15 nt, Homo sapiens
aucuuacccuucaau

SEQ ID NO: 1879090 - RNA, 17 nt, Homo sapiens
gcauauuuguuacuuua

SEQ ID NO: 1879091 - RNA, 17 nt, Homo sapiens
auuaaugcacaucugca

SEQ ID NO: 1879092 - RNA, 21 nt, Homo sapiens
gauccagcggggcuucugggc

SEQ ID NO: 1879093 - RNA, 18 nt, Homo sapiens
gagcggcugcccgacuca

SEQ ID NO: 1879094 - RNA, 14 nt, Homo sapiens
cagagagcaggcag

SEQ ID NO: 1879095 - RNA, 15 nt, Homo sapiens
uaauacuacugcaca

SEQ ID NO: 1879096 - RNA, 18 nt, Homo sapiens
auuucagccuacauugau

SEQ ID NO: 1879097 - RNA, 19 nt, Homo sapiens
ugucuagguccccacugcc

SEQ ID NO: 1879098 - RNA, 12 nt, Homo sapiens
uuucuagccuua

SEQ ID NO: 1879099 - RNA, 15 nt, Homo sapiens
cuucuguguagucaa

SEQ ID NO: 1879100 - RNA, 13 nt, Homo sapiens
cauggcaaauggg

SEQ ID NO: 1879101 - RNA, 12 nt, Homo sapiens
gaaaaccaucac

SEQ ID NO: 1879102 - RNA, 21 nt, Homo sapiens
cugaacauugcacugauauca

SEQ ID NO: 1879103 - RNA, 16 nt, Homo sapiens
uccugaaggucugggu

SEQ ID NO: 1879104 - RNA, 18 nt, Homo sapiens
uacuaaaagcaauguuua

SEQ ID NO: 1879105 - RNA, 22 nt, Homo sapiens
gcacacacacauaagcacugaa

SEQ ID NO: 1879106 - RNA, 22 nt, Homo sapiens
aauugacugagacuggaaauau

SEQ ID NO: 1879107 - RNA, 19 nt, Homo sapiens
cacuccaggacaguggaga

SEQ ID NO: 1879108 - RNA, 12 nt, Homo sapiens
uccaagcccuuu

SEQ ID NO: 1879109 - RNA, 18 nt, Homo sapiens
uuuuuguuaaucauagca

SEQ ID NO: 1879110 - RNA, 23 nt, Homo sapiens
uuuaaaaacuagauugcuuugaa

SEQ ID NO: 1879111 - RNA, 18 nt, Homo sapiens
gugaugaaucuacauuug

SEQ ID NO: 1879112 - RNA, 23 nt, Homo sapiens
ggucacuuaaagggucuuaugaa

SEQ ID NO: 1879113 - RNA, 17 nt, Homo sapiens
ucuuguagccagaauuc

SEQ ID NO: 1879114 - RNA, 17 nt, Homo sapiens
gcauggucccuugucac

SEQ ID NO: 1879115 - RNA, 13 nt, Homo sapiens
uugguagaugaca

SEQ ID NO: 1879116 - RNA, 20 nt, Homo sapiens
gugaggagaugcggccaaag

SEQ ID NO: 1879117 - RNA, 16 nt, Homo sapiens
caucauuuucuacuug

SEQ ID NO: 1879118 - RNA, 21 nt, Homo sapiens
uuaacaacauguuuccagcau

SEQ ID NO: 1879119 - RNA, 15 nt, Homo sapiens
ggcaaauaacaguaa

SEQ ID NO: 1879120 - RNA, 22 nt, Homo sapiens
uguguccuuggggcacagucau

SEQ ID NO: 1879121 - RNA, 16 nt, Homo sapiens
ucauucuugugacuua

SEQ ID NO: 1879122 - RNA, 15 nt, Homo sapiens
uuuuacacacugaaa

SEQ ID NO: 1879123 - RNA, 20 nt, Homo sapiens
uacacggaccaucgccucug

SEQ ID NO: 1879124 - RNA, 21 nt, Homo sapiens
acccucccuggaguguggcug

SEQ ID NO: 1879125 - RNA, 20 nt, Homo sapiens
acugugacaaaagccagcau

SEQ ID NO: 1879126 - RNA, 14 nt, Homo sapiens
auauuuacucauag

SEQ ID NO: 1879127 - RNA, 23 nt, Homo sapiens
aguuaccuuauaguuacugugua

SEQ ID NO: 1879128 - RNA, 17 nt, Homo sapiens
ccggagagacagugaca

SEQ ID NO: 1879129 - RNA, 23 nt, Homo sapiens
ugcccagcaaggaccagugagac

SEQ ID NO: 1879130 - RNA, 15 nt, Homo sapiens
aguugaucagacuga

SEQ ID NO: 1879131 - RNA, 21 nt, Homo sapiens
ucuuuacuauguuucucagau

SEQ ID NO: 1879132 - RNA, 15 nt, Homo sapiens
cucuggaggcugaga

SEQ ID NO: 1879133 - RNA, 14 nt, Homo sapiens
cagcacggacaaua

SEQ ID NO: 1879134 - RNA, 18 nt, Homo sapiens
ugagcuagugauuugccu

SEQ ID NO: 1879135 - RNA, 15 nt, Homo sapiens
accaacaccacaaac

SEQ ID NO: 1879136 - RNA, 13 nt, Homo sapiens
agggaggggagca

SEQ ID NO: 1879137 - RNA, 18 nt, Homo sapiens
uccucuacagauugucau

SEQ ID NO: 1879138 - RNA, 12 nt, Homo sapiens
uuuuuauagguu

SEQ ID NO: 1879139 - RNA, 18 nt, Homo sapiens
gucccagcucccugggca

SEQ ID NO: 1879140 - RNA, 18 nt, Homo sapiens
agucuuccagaaagcaag

SEQ ID NO: 1879141 - RNA, 21 nt, Homo sapiens
cauuuagaucuacacucucga

SEQ ID NO: 1879142 - RNA, 15 nt, Homo sapiens
aggcaaccacaggca

SEQ ID NO: 1879143 - RNA, 13 nt, Homo sapiens
ccccgccuccagu

SEQ ID NO: 1879144 - RNA, 17 nt, Homo sapiens
ugcaucccugcagcuca

SEQ ID NO: 1879145 - RNA, 17 nt, Homo sapiens
aaauuuuauaaugucau

SEQ ID NO: 1879146 - RNA, 21 nt, Homo sapiens
aaggccaagaaucaagcuaga

SEQ ID NO: 1879147 - RNA, 20 nt, Homo sapiens
acagauguaaaugccacaaa

SEQ ID NO: 1879148 - RNA, 21 nt, Homo sapiens
uggauuccuagauuacaucug

SEQ ID NO: 1879149 - RNA, 16 nt, Homo sapiens
cuuggaaaaacaggaa

SEQ ID NO: 1879150 - RNA, 15 nt, Homo sapiens
gucaauaaaaugaac

SEQ ID NO: 1879151 - RNA, 19 nt, Homo sapiens
cuucugugcccagcucagu

SEQ ID NO: 1879152 - RNA, 18 nt, Homo sapiens
augggguuucacaaauag

SEQ ID NO: 1879153 - RNA, 12 nt, Homo sapiens
caccacaaacuu

SEQ ID NO: 1879154 - RNA, 17 nt, Homo sapiens
guaacuccccucaggga

SEQ ID NO: 1879155 - RNA, 21 nt, Homo sapiens
gcauuagcaaggcagagccuu

SEQ ID NO: 1879156 - RNA, 12 nt, Homo sapiens
gcacccggccug

SEQ ID NO: 1879157 - RNA, 15 nt, Homo sapiens
gcugcucacucccgc

SEQ ID NO: 1879158 - RNA, 17 nt, Homo sapiens
uaccauuuaucuacuau

SEQ ID NO: 1879159 - RNA, 19 nt, Homo sapiens
acagauggggucugugacu

SEQ ID NO: 1879160 - RNA, 21 nt, Homo sapiens
cccaagggccucccaccagag

SEQ ID NO: 1879161 - RNA, 23 nt, Homo sapiens
accuguagguuugcuucaaauaa

SEQ ID NO: 1879162 - RNA, 13 nt, Homo sapiens
uuugacuuuucca

SEQ ID NO: 1879163 - RNA, 14 nt, Homo sapiens
gaccaauaccuccu

SEQ ID NO: 1879164 - RNA, 19 nt, Homo sapiens
ggaucacuugagcccagga

SEQ ID NO: 1879165 - RNA, 16 nt, Homo sapiens
agccaggagcagcccu

SEQ ID NO: 1879166 - RNA, 18 nt, Homo sapiens
acacuaccaauuucccau

SEQ ID NO: 1879167 - RNA, 21 nt, Homo sapiens
cacuugaugccguuucuuuca

SEQ ID NO: 1879168 - RNA, 14 nt, Homo sapiens
cugaccuugcacaa

SEQ ID NO: 1879169 - RNA, 18 nt, Homo sapiens
uuaaacauugaaguaaug

SEQ ID NO: 1879170 - RNA, 22 nt, Homo sapiens
cugucagcaagacugaagaugg

SEQ ID NO: 1879171 - RNA, 18 nt, Homo sapiens
gcaucccccaaagccauc

SEQ ID NO: 1879172 - RNA, 19 nt, Homo sapiens
agacugcugcugaauuuau

SEQ ID NO: 1879173 - RNA, 18 nt, Homo sapiens
gcgauucucaugccucag

SEQ ID NO: 1879174 - RNA, 23 nt, Homo sapiens
cuuauuuaaucuguacuauccag

SEQ ID NO: 1879175 - RNA, 19 nt, Homo sapiens
uagcaguuuagaauggagg

SEQ ID NO: 1879176 - RNA, 18 nt, Homo sapiens
uacaaacguuugacaaac

SEQ ID NO: 1879177 - RNA, 13 nt, Homo sapiens
auugcuuuacugg

SEQ ID NO: 1879178 - RNA, 17 nt, Homo sapiens
gagcccauccagucucc

SEQ ID NO: 1879179 - RNA, 15 nt, Homo sapiens
guucuggaacauucu

SEQ ID NO: 1879180 - RNA, 12 nt, Homo sapiens
cccaacuugcca

SEQ ID NO: 1879181 - RNA, 18 nt, Homo sapiens
uuuucuauuucacuaauc

SEQ ID NO: 1879182 - RNA, 15 nt, Homo sapiens
caaaugucauuucau

SEQ ID NO: 1879183 - RNA, 12 nt, Homo sapiens
uggcucugccag

SEQ ID NO: 1879184 - RNA, 22 nt, Homo sapiens
auuuuaaaaaauguuaugcagg

SEQ ID NO: 1879185 - RNA, 18 nt, Homo sapiens
uaacuucucugugaacua

SEQ ID NO: 1879186 - RNA, 13 nt, Homo sapiens
cauguaaccacug

SEQ ID NO: 1879187 - RNA, 19 nt, Homo sapiens
gaagguuuguauauuguca

SEQ ID NO: 1879188 - RNA, 20 nt, Homo sapiens
uuucuaggguaaugccguag

SEQ ID NO: 1879189 - RNA, 21 nt, Homo sapiens
uugccaauuuucuuugaaaau

SEQ ID NO: 1879190 - RNA, 15 nt, Homo sapiens
guguguaugcacaug

SEQ ID NO: 1879191 - RNA, 15 nt, Homo sapiens
gugcauaugcaugug

SEQ ID NO: 1879192 - RNA, 19 nt, Homo sapiens
uacagucaucugucuuuca

SEQ ID NO: 1879193 - RNA, 21 nt, Homo sapiens
aggagaaaugauaagugacaa

SEQ ID NO: 1879194 - RNA, 16 nt, Homo sapiens
ugagcaucugucucaa

SEQ ID NO: 1879195 - RNA, 17 nt, Homo sapiens
uuuugcacauuccaaaa

SEQ ID NO: 1879196 - RNA, 14 nt, Homo sapiens
uagaauugcacaua

SEQ ID NO: 1879197 - RNA, 14 nt, Homo sapiens
aggcaagcuggcag

SEQ ID NO: 1879198 - RNA, 16 nt, Homo sapiens
acccagggcuaugagg

SEQ ID NO: 1879199 - RNA, 20 nt, Homo sapiens
guuuacagacgcugcuguca

SEQ ID NO: 1879200 - RNA, 16 nt, Homo sapiens
auucuaucaagcccag

SEQ ID NO: 1879201 - RNA, 14 nt, Homo sapiens
ggcaguuccaggag

SEQ ID NO: 1879202 - RNA, 11 nt, Homo sapiens
guuucuagucu

SEQ ID NO: 1879203 - RNA, 14 nt, Homo sapiens
cuaaauccaaagaa

SEQ ID NO: 1879204 - RNA, 21 nt, Homo sapiens
gucucuucagccaccucccag

SEQ ID NO: 1879205 - RNA, 17 nt, Homo sapiens
acuguccaguccaguga

SEQ ID NO: 1879206 - RNA, 12 nt, Homo sapiens
aagaagccacag

SEQ ID NO: 1879207 - RNA, 14 nt, Homo sapiens
uguagcugcuauau

SEQ ID NO: 1879208 - RNA, 13 nt, Homo sapiens
cacccagucucau

SEQ ID NO: 1879209 - RNA, 12 nt, Homo sapiens
accaauguagaa

SEQ ID NO: 1879210 - RNA, 14 nt, Homo sapiens
cuguagugccaugg

SEQ ID NO: 1879211 - RNA, 22 nt, Homo sapiens
guguuuggaaaauuguguauga

SEQ ID NO: 1879212 - RNA, 22 nt, Homo sapiens
ccuagguaggcaccacagagaa

SEQ ID NO: 1879213 - RNA, 14 nt, Homo sapiens
accucaccaaggac

SEQ ID NO: 1879214 - RNA, 11 nt, Homo sapiens
aguccuggaag

SEQ ID NO: 1879215 - RNA, 17 nt, Homo sapiens
ccgguucuuaaauccau

SEQ ID NO: 1879216 - RNA, 20 nt, Homo sapiens
aacuaggaccucauaucuuc

SEQ ID NO: 1879217 - RNA, 16 nt, Homo sapiens
cugacaccucacugag

SEQ ID NO: 1879218 - RNA, 18 nt, Homo sapiens
uagauucucugugucuaa

SEQ ID NO: 1879219 - RNA, 19 nt, Homo sapiens
ccuauuggcuauuuuccca

SEQ ID NO: 1879220 - RNA, 17 nt, Homo sapiens
gaaauuuauaaacuuuu

SEQ ID NO: 1879221 - RNA, 21 nt, Homo sapiens
guuccuaagccuguugcugaa

SEQ ID NO: 1879222 - RNA, 20 nt, Homo sapiens
ucugcccccaaaagugucaa

SEQ ID NO: 1879223 - RNA, 12 nt, Homo sapiens
agugcuaagcau

SEQ ID NO: 1879224 - RNA, 22 nt, Homo sapiens
cauuaaaauauagagacaggac

SEQ ID NO: 1879225 - RNA, 19 nt, Homo sapiens
cagaccugguucccacuga

SEQ ID NO: 1879226 - RNA, 21 nt, Homo sapiens
cccacccuccuuucaccacau

SEQ ID NO: 1879227 - RNA, 14 nt, Homo sapiens
gcugaguccuugcu

SEQ ID NO: 1879228 - RNA, 15 nt, Homo sapiens
auuacugcaaagggu

SEQ ID NO: 1879229 - RNA, 21 nt, Homo sapiens
acaaagugcccaagucuuucc

SEQ ID NO: 1879230 - RNA, 21 nt, Homo sapiens
ggggccugcaucaccaccuca

SEQ ID NO: 1879231 - RNA, 18 nt, Homo sapiens
aagugauauugucuucau

SEQ ID NO: 1879232 - RNA, 13 nt, Homo sapiens
cucagaugaucuc

SEQ ID NO: 1879233 - RNA, 21 nt, Homo sapiens
aauagaauuucuuucccuaaa

SEQ ID NO: 1879234 - RNA, 15 nt, Homo sapiens
uauguguugccaaag

SEQ ID NO: 1879235 - RNA, 20 nt, Homo sapiens
aucucuacuaccacaaggaa

SEQ ID NO: 1879236 - RNA, 13 nt, Homo sapiens
aguaucuuugcac

SEQ ID NO: 1879237 - RNA, 23 nt, Homo sapiens
aauauuaagguaguuauucacaa

SEQ ID NO: 1879238 - RNA, 17 nt, Homo sapiens
aaaauaaagcuguucuc

SEQ ID NO: 1879239 - RNA, 19 nt, Homo sapiens
cauggcucugaacugcaca

SEQ ID NO: 1879240 - RNA, 16 nt, Homo sapiens
agagaauuaugggaaa

SEQ ID NO: 1879241 - RNA, 18 nt, Homo sapiens
aacauacuuacauuucag

SEQ ID NO: 1879242 - RNA, 22 nt, Homo sapiens
ugcuagaccugauggaauguua

SEQ ID NO: 1879243 - RNA, 15 nt, Homo sapiens
accauccagugacaa

SEQ ID NO: 1879244 - RNA, 17 nt, Homo sapiens
gacccaccccugugcuc

SEQ ID NO: 1879245 - RNA, 20 nt, Homo sapiens
ggucuccuggaccuugacag

SEQ ID NO: 1879246 - RNA, 21 nt, Homo sapiens
guccuugugaugugcacguaa

SEQ ID NO: 1879247 - RNA, 13 nt, Homo sapiens
agccuaaaagaca

SEQ ID NO: 1879248 - RNA, 23 nt, Homo sapiens
aauauagaugcuggccagcauuu

SEQ ID NO: 1879249 - RNA, 13 nt, Homo sapiens
acaauaaaaccaa

SEQ ID NO: 1879250 - RNA, 22 nt, Homo sapiens
cuuccaaacuccucaacuggga

SEQ ID NO: 1879251 - RNA, 19 nt, Homo sapiens
cugggaggcagagguugca

SEQ ID NO: 1879252 - RNA, 20 nt, Homo sapiens
aguugagggcagcuccagug

SEQ ID NO: 1879253 - RNA, 23 nt, Homo sapiens
aaucccauuucccaaaccuaaaa

SEQ ID NO: 1879254 - RNA, 20 nt, Homo sapiens
cuuuagaaaugucaguugcu

SEQ ID NO: 1879255 - RNA, 16 nt, Homo sapiens
auggcugccaucucac

SEQ ID NO: 1879256 - RNA, 14 nt, Homo sapiens
cuaugccuguggug

SEQ ID NO: 1879257 - RNA, 19 nt, Homo sapiens
ccagcacgaguggccaguu

SEQ ID NO: 1879258 - RNA, 23 nt, Homo sapiens
uugauaaaaaauuuauuaugucc

SEQ ID NO: 1879259 - RNA, 19 nt, Homo sapiens
cagguguguugcagugucu

SEQ ID NO: 1879260 - RNA, 14 nt, Homo sapiens
aauauguucugaca

SEQ ID NO: 1879261 - RNA, 22 nt, Homo sapiens
acagaaucuccauuucugcuca

SEQ ID NO: 1879262 - RNA, 22 nt, Homo sapiens
agcacuguuuauacacugugua

SEQ ID NO: 1879263 - RNA, 20 nt, Homo sapiens
gaagccggaggguguuuaug

SEQ ID NO: 1879264 - RNA, 21 nt, Homo sapiens
uuguuauucgaaccacugaga

SEQ ID NO: 1879265 - RNA, 19 nt, Homo sapiens
uuucuggccuuucauggca

SEQ ID NO: 1879266 - RNA, 12 nt, Homo sapiens
ucaaaaagggaa

SEQ ID NO: 1879267 - RNA, 20 nt, Homo sapiens
aaacacgccugcaaacgcug

SEQ ID NO: 1879268 - RNA, 22 nt, Homo sapiens
cccccaggacagcacacgguga

SEQ ID NO: 1879269 - RNA, 20 nt, Homo sapiens
cacaagcuuuuuuacacaaa

SEQ ID NO: 1879270 - RNA, 20 nt, Homo sapiens
caaggagggcagaucacuuc

SEQ ID NO: 1879271 - RNA, 19 nt, Homo sapiens
uagauuaggucacauuaca

SEQ ID NO: 1879272 - RNA, 16 nt, Homo sapiens
acacaacacugaugug

SEQ ID NO: 1879273 - RNA, 23 nt, Homo sapiens
cuucugccagcauaauacuugcu

SEQ ID NO: 1879274 - RNA, 16 nt, Homo sapiens
ucugagcucccaccuc

SEQ ID NO: 1879275 - RNA, 14 nt, Homo sapiens
acucugcacauguc

SEQ ID NO: 1879276 - RNA, 19 nt, Homo sapiens
aggaguccaagaccagacu

SEQ ID NO: 1879277 - RNA, 12 nt, Homo sapiens
guauaaacauua

SEQ ID NO: 1879278 - RNA, 14 nt, Homo sapiens
gccugcucccugua

SEQ ID NO: 1879279 - RNA, 23 nt, Homo sapiens
caggagaaguuaagaauugagca

SEQ ID NO: 1879280 - RNA, 22 nt, Homo sapiens
cccgucauguuccucaaaagca

SEQ ID NO: 1879281 - RNA, 23 nt, Homo sapiens
uauacuuugccuuuccauaauca

SEQ ID NO: 1879282 - RNA, 23 nt, Homo sapiens
cuuggaauccuggggaacauaga

SEQ ID NO: 1879283 - RNA, 15 nt, Homo sapiens
acuugggauucugac

SEQ ID NO: 1879284 - RNA, 16 nt, Homo sapiens
cuggggcaagcuccuc

SEQ ID NO: 1879285 - RNA, 13 nt, Homo sapiens
aagguaaauccca

SEQ ID NO: 1879286 - RNA, 19 nt, Homo sapiens
gccuccuggcccaggugag

SEQ ID NO: 1879287 - RNA, 14 nt, Homo sapiens
accaggccgugccu

SEQ ID NO: 1879288 - RNA, 16 nt, Homo sapiens
cugacaccaccaucua

SEQ ID NO: 1879289 - RNA, 23 nt, Homo sapiens
uuuuaaauguguugcuuuggaua

SEQ ID NO: 1879290 - RNA, 17 nt, Homo sapiens
ccugcaccguugacuca

SEQ ID NO: 1879291 - RNA, 13 nt, Homo sapiens
uaaaugccuaaua

SEQ ID NO: 1879292 - RNA, 19 nt, Homo sapiens
auaaaacucccuuccuuau

SEQ ID NO: 1879293 - RNA, 14 nt, Homo sapiens
uaaccccuagucau

SEQ ID NO: 1879294 - RNA, 20 nt, Homo sapiens
acuguuuucucugaucucaa

SEQ ID NO: 1879295 - RNA, 17 nt, Homo sapiens
aaaugggaaaaccagac

SEQ ID NO: 1879296 - RNA, 20 nt, Homo sapiens
uaaaauagcaugccuuucuc

SEQ ID NO: 1879297 - RNA, 15 nt, Homo sapiens
caauauuaccaucuu

SEQ ID NO: 1879298 - RNA, 15 nt, Homo sapiens
gaugcuaagcugaua

SEQ ID NO: 1879299 - RNA, 15 nt, Homo sapiens
aacaaaaaaccacaa

SEQ ID NO: 1879300 - RNA, 22 nt, Homo sapiens
ugccuauuuauuggggugccua

SEQ ID NO: 1879301 - RNA, 22 nt, Homo sapiens
uucauuagugagccaugaaauc

SEQ ID NO: 1879302 - RNA, 19 nt, Homo sapiens
uacuucaaccagccuacaa

SEQ ID NO: 1879303 - RNA, 17 nt, Homo sapiens
ugauuacaaggcuuuau

SEQ ID NO: 1879304 - RNA, 19 nt, Homo sapiens
uuuguaccgaaacaccccg

SEQ ID NO: 1879305 - RNA, 20 nt, Homo sapiens
uagcaagcugccgaaccaaa

SEQ ID NO: 1879306 - RNA, 16 nt, Homo sapiens
cuuccugugacuucag

SEQ ID NO: 1879307 - RNA, 15 nt, Homo sapiens
ucccagcuacuuggg

SEQ ID NO: 1879308 - RNA, 18 nt, Homo sapiens
cugcuucuuauauugcaa

SEQ ID NO: 1879309 - RNA, 22 nt, Homo sapiens
cauuccucagcuucuucacagg

SEQ ID NO: 1879310 - RNA, 16 nt, Homo sapiens
cuggggggccauuucc

SEQ ID NO: 1879311 - RNA, 19 nt, Homo sapiens
gccaugaggagcguggacu

SEQ ID NO: 1879312 - RNA, 18 nt, Homo sapiens
uuuuuacuauacagcaua

SEQ ID NO: 1879313 - RNA, 14 nt, Homo sapiens
aaagcuuacuguuu

SEQ ID NO: 1879314 - RNA, 20 nt, Homo sapiens
caccacugcuuaagugccua

SEQ ID NO: 1879315 - RNA, 20 nt, Homo sapiens
guauugcuguccuugaaugc

SEQ ID NO: 1879316 - RNA, 17 nt, Homo sapiens
cacuggauauguuguua

SEQ ID NO: 1879317 - RNA, 22 nt, Homo sapiens
caggucacuugaucaugcugca

SEQ ID NO: 1879318 - RNA, 15 nt, Homo sapiens
ugcaugauaaugagu

SEQ ID NO: 1879319 - RNA, 16 nt, Homo sapiens
aucucuguuucuucaa

SEQ ID NO: 1879320 - RNA, 18 nt, Homo sapiens
cccucagauuuuauauuu

SEQ ID NO: 1879321 - RNA, 14 nt, Homo sapiens
ucccagucugauau

SEQ ID NO: 1879322 - RNA, 18 nt, Homo sapiens
caaccugccugugcauga

SEQ ID NO: 1879323 - RNA, 13 nt, Homo sapiens
uguccugggguau

SEQ ID NO: 1879324 - RNA, 12 nt, Homo sapiens
aagugauccuca

SEQ ID NO: 1879325 - RNA, 16 nt, Homo sapiens
gauugagaaguuuugu

SEQ ID NO: 1879326 - RNA, 18 nt, Homo sapiens
agucugugacccacuuac

SEQ ID NO: 1879327 - RNA, 16 nt, Homo sapiens
aguaacuaaagcuuua

SEQ ID NO: 1879328 - RNA, 20 nt, Homo sapiens
aguguguuacuaucuacaaa

SEQ ID NO: 1879329 - RNA, 18 nt, Homo sapiens
caggacagggaagggagc

SEQ ID NO: 1879330 - RNA, 12 nt, Homo sapiens
ugguuccauuuu

SEQ ID NO: 1879331 - RNA, 13 nt, Homo sapiens
uccugugaaggaa

SEQ ID NO: 1879332 - RNA, 22 nt, Homo sapiens
caguauuuucccaauagcacuu

SEQ ID NO: 1879333 - RNA, 17 nt, Homo sapiens
ggcucucccagccaggu

SEQ ID NO: 1879334 - RNA, 17 nt, Homo sapiens
cgcgccccagucacuuc

SEQ ID NO: 1879335 - RNA, 23 nt, Homo sapiens
ugcuucccggcgucccuaccucc

SEQ ID NO: 1879336 - RNA, 16 nt, Homo sapiens
augagcugacaucuca

SEQ ID NO: 1879337 - RNA, 17 nt, Homo sapiens
aagccaucauccuccau

SEQ ID NO: 1879338 - RNA, 13 nt, Homo sapiens
ucuggcuugcccc

SEQ ID NO: 1879339 - RNA, 19 nt, Homo sapiens
ugaaaucugcuagaaaguu

SEQ ID NO: 1879340 - RNA, 20 nt, Homo sapiens
agccaaggaggggccugagg

SEQ ID NO: 1879341 - RNA, 19 nt, Homo sapiens
gaagcguuuuucucaaagg

SEQ ID NO: 1879342 - RNA, 18 nt, Homo sapiens
uuuccaauuauuugacuu

SEQ ID NO: 1879343 - RNA, 20 nt, Homo sapiens
aauguuacugaucaugcauu

SEQ ID NO: 1879344 - RNA, 18 nt, Homo sapiens
aagaugguuuaugcaugu

SEQ ID NO: 1879345 - RNA, 13 nt, Homo sapiens
auauaaaugggaa

SEQ ID NO: 1879346 - RNA, 15 nt, Homo sapiens
cagcgaacagccuua

SEQ ID NO: 1879347 - RNA, 11 nt, Homo sapiens
ugggaugcuac

SEQ ID NO: 1879348 - RNA, 21 nt, Homo sapiens
ggauuccacuguuuucuuugg

SEQ ID NO: 1879349 - RNA, 17 nt, Homo sapiens
agucaggcgcugaccca

SEQ ID NO: 1879350 - RNA, 16 nt, Homo sapiens
ucuuuugucccagaaa

SEQ ID NO: 1879351 - RNA, 15 nt, Homo sapiens
auuuccauaacucau

SEQ ID NO: 1879352 - RNA, 18 nt, Homo sapiens
ucagauauuguaagcauu

SEQ ID NO: 1879353 - RNA, 15 nt, Homo sapiens
cacauuugauguaca

SEQ ID NO: 1879354 - RNA, 13 nt, Homo sapiens
cagugcacaugaa

SEQ ID NO: 1879355 - RNA, 14 nt, Homo sapiens
ugcacagcugcuug

SEQ ID NO: 1879356 - RNA, 15 nt, Homo sapiens
uauuuucaguauacu

SEQ ID NO: 1879357 - RNA, 19 nt, Homo sapiens
uagguuuaacucagaucac

SEQ ID NO: 1879358 - RNA, 18 nt, Homo sapiens
cacuucccauacccaguc

SEQ ID NO: 1879359 - RNA, 16 nt, Homo sapiens
cuuuacugauacuaca

SEQ ID NO: 1879360 - RNA, 15 nt, Homo sapiens
agcauuacagugggu

SEQ ID NO: 1879361 - RNA, 19 nt, Homo sapiens
gcugcuuccuccuggaaau

SEQ ID NO: 1879362 - RNA, 18 nt, Homo sapiens
uuauaaaucauauucuca

SEQ ID NO: 1879363 - RNA, 15 nt, Homo sapiens
cauuucacaaaaaca

SEQ ID NO: 1879364 - RNA, 18 nt, Homo sapiens
agaucagccagugaccaa

SEQ ID NO: 1879365 - RNA, 21 nt, Homo sapiens
caaaauaaauaaucuacugua

SEQ ID NO: 1879366 - RNA, 19 nt, Homo sapiens
guugguaccuuucuagccu

SEQ ID NO: 1879367 - RNA, 21 nt, Homo sapiens
augcaaauaacaaaugccaaa

SEQ ID NO: 1879368 - RNA, 14 nt, Homo sapiens
uuacaauaagcuaa

SEQ ID NO: 1879369 - RNA, 20 nt, Homo sapiens
gcuguccaggaacuuuccag

SEQ ID NO: 1879370 - RNA, 19 nt, Homo sapiens
aucccucuccaacugccua

SEQ ID NO: 1879371 - RNA, 16 nt, Homo sapiens
agcauccucaguuccu

SEQ ID NO: 1879372 - RNA, 14 nt, Homo sapiens
ccaguauggugaaa

SEQ ID NO: 1879373 - RNA, 11 nt, Homo sapiens
ucugagcccac

SEQ ID NO: 1879374 - RNA, 17 nt, Homo sapiens
aauauuuugcugcugaa

SEQ ID NO: 1879375 - RNA, 15 nt, Homo sapiens
augcugcacagaaau

SEQ ID NO: 1879376 - RNA, 13 nt, Homo sapiens
uucucucuguaau

SEQ ID NO: 1879377 - RNA, 16 nt, Homo sapiens
aagcugcugugacugu

SEQ ID NO: 1879378 - RNA, 16 nt, Homo sapiens
cauucuccugccucag

SEQ ID NO: 1879379 - RNA, 22 nt, Homo sapiens
gcuugcaacuuagcucacaccu

SEQ ID NO: 1879380 - RNA, 19 nt, Homo sapiens
caacuuaaguugguccuuu

SEQ ID NO: 1879381 - RNA, 18 nt, Homo sapiens
cugagccuggucccacga

SEQ ID NO: 1879382 - RNA, 16 nt, Homo sapiens
ccaaaaauuacuuagu

SEQ ID NO: 1879383 - RNA, 23 nt, Homo sapiens
gccugaaguuugugggggccaaa

SEQ ID NO: 1879384 - RNA, 20 nt, Homo sapiens
accaauauuguacaguuuuu

SEQ ID NO: 1879385 - RNA, 22 nt, Homo sapiens
aguaauuuuguuuaugcugcuc

SEQ ID NO: 1879386 - RNA, 19 nt, Homo sapiens
caaccuugacuucugccca

SEQ ID NO: 1879387 - RNA, 14 nt, Homo sapiens
agacuugauuuaca

SEQ ID NO: 1879388 - RNA, 18 nt, Homo sapiens
cacacugccagaagagaa

SEQ ID NO: 1879389 - RNA, 14 nt, Homo sapiens
gaaaaugccaccau

SEQ ID NO: 1879390 - RNA, 14 nt, Homo sapiens
aaaggcugaaaaga

SEQ ID NO: 1879391 - RNA, 14 nt, Homo sapiens
cugggacugugccu

SEQ ID NO: 1879392 - RNA, 15 nt, Homo sapiens
cgaacauucuuugcc

SEQ ID NO: 1879393 - RNA, 16 nt, Homo sapiens
cauuuuugcucuaugg

SEQ ID NO: 1879394 - RNA, 15 nt, Homo sapiens
agagugugguuauga

SEQ ID NO: 1879395 - RNA, 13 nt, Homo sapiens
cgccagggccaag

SEQ ID NO: 1879396 - RNA, 19 nt, Homo sapiens
ugugagguucgcuuaucaa

SEQ ID NO: 1879397 - RNA, 21 nt, Homo sapiens
uacccaaacccauggcucuau

SEQ ID NO: 1879398 - RNA, 18 nt, Homo sapiens
ugucacuguuccuuguca

SEQ ID NO: 1879399 - RNA, 17 nt, Homo sapiens
gagucgaggacagggag

SEQ ID NO: 1879400 - RNA, 17 nt, Homo sapiens
cauauuucaaaugauuu

SEQ ID NO: 1879401 - RNA, 23 nt, Homo sapiens
agagaagccugucuguacuucau

SEQ ID NO: 1879402 - RNA, 21 nt, Homo sapiens
caccugaauuucuguuugaau

SEQ ID NO: 1879403 - RNA, 15 nt, Homo sapiens
uuccuuuacuacgaa

SEQ ID NO: 1879404 - RNA, 22 nt, Homo sapiens
aguaccaaaugcuuuaaaaacu

SEQ ID NO: 1879405 - RNA, 19 nt, Homo sapiens
gugcucccgaugcugcuau

SEQ ID NO: 1879406 - RNA, 16 nt, Homo sapiens
uauguacuucagugca

SEQ ID NO: 1879407 - RNA, 19 nt, Homo sapiens
aguuucugcauuucaagaa

SEQ ID NO: 1879408 - RNA, 23 nt, Homo sapiens
gaugcccgcccggggaguuuccg

SEQ ID NO: 1879409 - RNA, 19 nt, Homo sapiens
agcaguuggccaagcagaa

SEQ ID NO: 1879410 - RNA, 21 nt, Homo sapiens
cuaagaaauggcuuuccacau

SEQ ID NO: 1879411 - RNA, 18 nt, Homo sapiens
uucuuuuucuacauguga

SEQ ID NO: 1879412 - RNA, 15 nt, Homo sapiens
aaaccaucacaugac

SEQ ID NO: 1879413 - RNA, 18 nt, Homo sapiens
auucauuugcauccaugg

SEQ ID NO: 1879414 - RNA, 16 nt, Homo sapiens
uuauaaauagccuuca

SEQ ID NO: 1879415 - RNA, 12 nt, Homo sapiens
gaauuagcucac

SEQ ID NO: 1879416 - RNA, 21 nt, Homo sapiens
agcuuucaacauguacaggaa

SEQ ID NO: 1879417 - RNA, 20 nt, Homo sapiens
aauuucauacccaugucaga

SEQ ID NO: 1879418 - RNA, 18 nt, Homo sapiens
aucuguuuguuacugcau

SEQ ID NO: 1879419 - RNA, 18 nt, Homo sapiens
aguguguauccagaagaa

SEQ ID NO: 1879420 - RNA, 17 nt, Homo sapiens
cacagauauuguuauaa

SEQ ID NO: 1879421 - RNA, 20 nt, Homo sapiens
caaaugucuuccuggauuau

SEQ ID NO: 1879422 - RNA, 17 nt, Homo sapiens
auguuuauuuacuaauu

SEQ ID NO: 1879423 - RNA, 18 nt, Homo sapiens
ggagacugaagacucagc

SEQ ID NO: 1879424 - RNA, 15 nt, Homo sapiens
cauuuaaaccaguau

SEQ ID NO: 1879425 - RNA, 14 nt, Homo sapiens
uguuccccuaguuc

SEQ ID NO: 1879426 - RNA, 14 nt, Homo sapiens
ccuucaaggcucuu

SEQ ID NO: 1879427 - RNA, 18 nt, Homo sapiens
aauucucauuugucacac

SEQ ID NO: 1879428 - RNA, 15 nt, Homo sapiens
cauuuauaaaaccau

SEQ ID NO: 1879429 - RNA, 22 nt, Homo sapiens
agcaauuccccuacaucaaaug

SEQ ID NO: 1879430 - RNA, 22 nt, Homo sapiens
aaacugucucccccauugcucu

SEQ ID NO: 1879431 - RNA, 23 nt, Homo sapiens
aaugcguggcacaucuaaauuga

SEQ ID NO: 1879432 - RNA, 13 nt, Homo sapiens
ugaugauuuugca

SEQ ID NO: 1879433 - RNA, 16 nt, Homo sapiens
agcccagugcugccac

SEQ ID NO: 1879434 - RNA, 14 nt, Homo sapiens
guccucgagcaacu

SEQ ID NO: 1879435 - RNA, 21 nt, Homo sapiens
gagaaacuuguaauggucucu

SEQ ID NO: 1879436 - RNA, 19 nt, Homo sapiens
cauguaucacccccaaaaa

SEQ ID NO: 1879437 - RNA, 19 nt, Homo sapiens
aaccuaaugggaaucauuc

SEQ ID NO: 1879438 - RNA, 19 nt, Homo sapiens
ugcaagccaucucuaauaa

SEQ ID NO: 1879439 - RNA, 23 nt, Homo sapiens
gagccuuuccagaacuaccaaaa

SEQ ID NO: 1879440 - RNA, 22 nt, Homo sapiens
uagcuauuuauguucaucuuca

SEQ ID NO: 1879441 - RNA, 17 nt, Homo sapiens
gucuuaaguguuucuca

SEQ ID NO: 1879442 - RNA, 18 nt, Homo sapiens
cacugaauuaaucaucua

SEQ ID NO: 1879443 - RNA, 19 nt, Homo sapiens
cuccacauguucaacuauu

SEQ ID NO: 1879444 - RNA, 20 nt, Homo sapiens
uacaacaaaaaucaccaucu

SEQ ID NO: 1879445 - RNA, 17 nt, Homo sapiens
uaaaguuacuugaauuu

SEQ ID NO: 1879446 - RNA, 23 nt, Homo sapiens
uguuucuaaauuuugugauucua

SEQ ID NO: 1879447 - RNA, 13 nt, Homo sapiens
agaguaugucagu

SEQ ID NO: 1879448 - RNA, 13 nt, Homo sapiens
ucucaaugaguca

SEQ ID NO: 1879449 - RNA, 21 nt, Homo sapiens
aaaguuauauuucagauguaa

SEQ ID NO: 1879450 - RNA, 18 nt, Homo sapiens
ucccaugccuggucccaa

SEQ ID NO: 1879451 - RNA, 19 nt, Homo sapiens
uuccccggaguaccuauug

SEQ ID NO: 1879452 - RNA, 16 nt, Homo sapiens
gcagccccucuaccuc

SEQ ID NO: 1879453 - RNA, 17 nt, Homo sapiens
uccacucuacccuccca

SEQ ID NO: 1879454 - RNA, 20 nt, Homo sapiens
uucauguggagucauuauaa

SEQ ID NO: 1879455 - RNA, 14 nt, Homo sapiens
agagucuugcuacc

SEQ ID NO: 1879456 - RNA, 22 nt, Homo sapiens
cugugcuguacugagcacugaa

SEQ ID NO: 1879457 - RNA, 15 nt, Homo sapiens
ggugccuucacuggg

SEQ ID NO: 1879458 - RNA, 17 nt, Homo sapiens
auuuugggacauuugca

SEQ ID NO: 1879459 - RNA, 15 nt, Homo sapiens
agauucuaacauauu

SEQ ID NO: 1879460 - RNA, 15 nt, Homo sapiens
acuauuaaaguaaca

SEQ ID NO: 1879461 - RNA, 20 nt, Homo sapiens
cuuuacaaucugcacuuuaa

SEQ ID NO: 1879462 - RNA, 15 nt, Homo sapiens
gaaaaauaaaaacca

SEQ ID NO: 1879463 - RNA, 15 nt, Homo sapiens
accuagauuccauac

SEQ ID NO: 1879464 - RNA, 18 nt, Homo sapiens
guauaaaugugauaugau

SEQ ID NO: 1879465 - RNA, 17 nt, Homo sapiens
caccugucaauugugaa

SEQ ID NO: 1879466 - RNA, 16 nt, Homo sapiens
uuugccuucugcacau

SEQ ID NO: 1879467 - RNA, 15 nt, Homo sapiens
ugauuucagacugca

SEQ ID NO: 1879468 - RNA, 23 nt, Homo sapiens
uguaaauugcaaauaaaccacuu

SEQ ID NO: 1879469 - RNA, 12 nt, Homo sapiens
auguugccuguc

SEQ ID NO: 1879470 - RNA, 19 nt, Homo sapiens
ucuugguaaacaacagacu

SEQ ID NO: 1879471 - RNA, 21 nt, Homo sapiens
aaggaacucuacuucagucaa

SEQ ID NO: 1879472 - RNA, 21 nt, Homo sapiens
cuguucagcuuuucagugaau

SEQ ID NO: 1879473 - RNA, 18 nt, Homo sapiens
guuuuacgucugggagaa

SEQ ID NO: 1879474 - RNA, 14 nt, Homo sapiens
cuguuaaaggucau

SEQ ID NO: 1879475 - RNA, 15 nt, Homo sapiens
uuagagagucucaag

SEQ ID NO: 1879476 - RNA, 17 nt, Homo sapiens
gcagggcccaucugccg

SEQ ID NO: 1879477 - RNA, 21 nt, Homo sapiens
caauuuggacuggugugcucu

SEQ ID NO: 1879478 - RNA, 20 nt, Homo sapiens
agguguguugcagugucugc

SEQ ID NO: 1879479 - RNA, 13 nt, Homo sapiens
gccaacccuuuca

SEQ ID NO: 1879480 - RNA, 22 nt, Homo sapiens
uuuaaagaauaugaaguucuau

SEQ ID NO: 1879481 - RNA, 19 nt, Homo sapiens
ugcaccccaggaaaggagg

SEQ ID NO: 1879482 - RNA, 17 nt, Homo sapiens
agagauuagcaugaaag

SEQ ID NO: 1879483 - RNA, 14 nt, Homo sapiens
acauguccuauuac

SEQ ID NO: 1879484 - RNA, 18 nt, Homo sapiens
uuucuuccacugagucuu

SEQ ID NO: 1879485 - RNA, 17 nt, Homo sapiens
uccccaagaacacaaga

SEQ ID NO: 1879486 - RNA, 17 nt, Homo sapiens
ucacuacaaaaauacaa

SEQ ID NO: 1879487 - RNA, 20 nt, Homo sapiens
uuggcuaucuacugagacau

SEQ ID NO: 1879488 - RNA, 15 nt, Homo sapiens
uacauuugaacuaua

SEQ ID NO: 1879489 - RNA, 12 nt, Homo sapiens
cucccugaugua

SEQ ID NO: 1879490 - RNA, 23 nt, Homo sapiens
ggccacauucaccaaccaaaggg

SEQ ID NO: 1879491 - RNA, 16 nt, Homo sapiens
uuaaaauauaugucua

SEQ ID NO: 1879492 - RNA, 20 nt, Homo sapiens
uauuugcacuaugagccuau

SEQ ID NO: 1879493 - RNA, 19 nt, Homo sapiens
aagcacaggagaacaugcu

SEQ ID NO: 1879494 - RNA, 13 nt, Homo sapiens
cugagaaaccucg

SEQ ID NO: 1879495 - RNA, 22 nt, Homo sapiens
acagcuauuauaucagcuuuuc

SEQ ID NO: 1879496 - RNA, 23 nt, Homo sapiens
ucaauaccugcugagaguacugu

SEQ ID NO: 1879497 - RNA, 22 nt, Homo sapiens
gcagcccccacugaccugccca

SEQ ID NO: 1879498 - RNA, 18 nt, Homo sapiens
aaugauaaaauagccaag

SEQ ID NO: 1879499 - RNA, 20 nt, Homo sapiens
caguaaacgggaacaugccc

SEQ ID NO: 1879500 - RNA, 15 nt, Homo sapiens
accaaggcagugcau

SEQ ID NO: 1879501 - RNA, 13 nt, Homo sapiens
augagaugugagc

SEQ ID NO: 1879502 - RNA, 15 nt, Homo sapiens
cacauuggcagugug

SEQ ID NO: 1879503 - RNA, 18 nt, Homo sapiens
ugauuuaccuauacauua

SEQ ID NO: 1879504 - RNA, 14 nt, Homo sapiens
agagcaucaugccu

SEQ ID NO: 1879505 - RNA, 17 nt, Homo sapiens
aaaggaagccuugcuca

SEQ ID NO: 1879506 - RNA, 22 nt, Homo sapiens
uuuuaguauaaguacauuauug

SEQ ID NO: 1879507 - RNA, 19 nt, Homo sapiens
agacagacuuauacacccc

SEQ ID NO: 1879508 - RNA, 15 nt, Homo sapiens
ccacuaggacuucaa

SEQ ID NO: 1879509 - RNA, 21 nt, Homo sapiens
gggcccccacauuugugccga

SEQ ID NO: 1879510 - RNA, 16 nt, Homo sapiens
cugacaucacagcagc

SEQ ID NO: 1879511 - RNA, 23 nt, Homo sapiens
guucaauaaaaguaaacucagca

SEQ ID NO: 1879512 - RNA, 22 nt, Homo sapiens
ggccauuuccaagaggcuguag

SEQ ID NO: 1879513 - RNA, 22 nt, Homo sapiens
agauugagaagccauguacuca

SEQ ID NO: 1879514 - RNA, 18 nt, Homo sapiens
agacaggguuuggcugug

SEQ ID NO: 1879515 - RNA, 18 nt, Homo sapiens
auugaggagcugcacuga

SEQ ID NO: 1879516 - RNA, 14 nt, Homo sapiens
ugagaaucccuggc

SEQ ID NO: 1879517 - RNA, 19 nt, Homo sapiens
caagaccagccugggcaac

SEQ ID NO: 1879518 - RNA, 21 nt, Homo sapiens
aguccuaucgacuuuauacag

SEQ ID NO: 1879519 - RNA, 16 nt, Homo sapiens
aucauguccauacacu

SEQ ID NO: 1879520 - RNA, 14 nt, Homo sapiens
acgaucucgacuca

SEQ ID NO: 1879521 - RNA, 22 nt, Homo sapiens
uccacugccuccugugacguga

SEQ ID NO: 1879522 - RNA, 16 nt, Homo sapiens
aucugacuucauacau

SEQ ID NO: 1879523 - RNA, 16 nt, Homo sapiens
aagggaguuagaccaa

SEQ ID NO: 1879524 - RNA, 15 nt, Homo sapiens
agaacaaagccacug

SEQ ID NO: 1879525 - RNA, 18 nt, Homo sapiens
uaccacacaaacuauggg

SEQ ID NO: 1879526 - RNA, 21 nt, Homo sapiens
ucaggacugugaccaaagcau

SEQ ID NO: 1879527 - RNA, 23 nt, Homo sapiens
ucgaucuguacgaaaugugaaau

SEQ ID NO: 1879528 - RNA, 18 nt, Homo sapiens
accuuuauuaaaaccauu

SEQ ID NO: 1879529 - RNA, 14 nt, Homo sapiens
cugguucaguggga

SEQ ID NO: 1879530 - RNA, 17 nt, Homo sapiens
cuggucaggcucuccag

SEQ ID NO: 1879531 - RNA, 18 nt, Homo sapiens
cagauuuaagccuuacaa

SEQ ID NO: 1879532 - RNA, 16 nt, Homo sapiens
ucaauaaaaugugauu

SEQ ID NO: 1879533 - RNA, 11 nt, Homo sapiens
cagucucaagc

SEQ ID NO: 1879534 - RNA, 22 nt, Homo sapiens
aacccagucacugugagcuccc

SEQ ID NO: 1879535 - RNA, 21 nt, Homo sapiens
uacauuuagaaccugcauuua

SEQ ID NO: 1879536 - RNA, 12 nt, Homo sapiens
uguggugcaaaa

SEQ ID NO: 1879537 - RNA, 22 nt, Homo sapiens
augacagaaccaauuuacacuc

SEQ ID NO: 1879538 - RNA, 12 nt, Homo sapiens
cagaugaacugg

SEQ ID NO: 1879539 - RNA, 15 nt, Homo sapiens
guuuguucacuuaaa

SEQ ID NO: 1879540 - RNA, 14 nt, Homo sapiens
cuccagauggugcu

SEQ ID NO: 1879541 - RNA, 15 nt, Homo sapiens
aaccccugauguuug

SEQ ID NO: 1879542 - RNA, 12 nt, Homo sapiens
ccuacagcagca

SEQ ID NO: 1879543 - RNA, 14 nt, Homo sapiens
cuacaacagaauuu

SEQ ID NO: 1879544 - RNA, 14 nt, Homo sapiens
agugaggcccuaaa

SEQ ID NO: 1879545 - RNA, 16 nt, Homo sapiens
ugaugcacccaccuca

SEQ ID NO: 1879546 - RNA, 15 nt, Homo sapiens
gauuacccugagcug

SEQ ID NO: 1879547 - RNA, 15 nt, Homo sapiens
ccuggccgcagugag

SEQ ID NO: 1879548 - RNA, 18 nt, Homo sapiens
auggagagggauggaaau

SEQ ID NO: 1879549 - RNA, 22 nt, Homo sapiens
cauauaauguaaaaagaucuac

SEQ ID NO: 1879550 - RNA, 15 nt, Homo sapiens
caucuacgaagccac

SEQ ID NO: 1879551 - RNA, 14 nt, Homo sapiens
cgaaucaucucaaa

SEQ ID NO: 1879552 - RNA, 18 nt, Homo sapiens
uacuauggcuccaacaga

SEQ ID NO: 1879553 - RNA, 19 nt, Homo sapiens
cccuuugaagccucagcua

SEQ ID NO: 1879554 - RNA, 18 nt, Homo sapiens
cucgggcuugagugagaa

SEQ ID NO: 1879555 - RNA, 20 nt, Homo sapiens
caaccccuccccuccauccc

SEQ ID NO: 1879556 - RNA, 22 nt, Homo sapiens
aaccacuaguugauguauggua

SEQ ID NO: 1879557 - RNA, 22 nt, Homo sapiens
guaccuuuguguccuuguucau

SEQ ID NO: 1879558 - RNA, 21 nt, Homo sapiens
uucccacgucuaacuggaaac

SEQ ID NO: 1879559 - RNA, 18 nt, Homo sapiens
cuuaaauuugaaucugag

SEQ ID NO: 1879560 - RNA, 20 nt, Homo sapiens
ggguggacgagggagugucu

SEQ ID NO: 1879561 - RNA, 14 nt, Homo sapiens
uucuggauaccauu

SEQ ID NO: 1879562 - RNA, 14 nt, Homo sapiens
uuaaugauacaugu

SEQ ID NO: 1879563 - RNA, 18 nt, Homo sapiens
uugaagcucaacuguugc

SEQ ID NO: 1879564 - RNA, 22 nt, Homo sapiens
acaggacagcccuucuuuccac

SEQ ID NO: 1879565 - RNA, 15 nt, Homo sapiens
auuaacaaagugcca

SEQ ID NO: 1879566 - RNA, 16 nt, Homo sapiens
acguuuaacauacaau

SEQ ID NO: 1879567 - RNA, 12 nt, Homo sapiens
ugauuuauugaa

SEQ ID NO: 1879568 - RNA, 21 nt, Homo sapiens
guaugauucccagccagcaca

SEQ ID NO: 1879569 - RNA, 12 nt, Homo sapiens
cauaagcacaga

SEQ ID NO: 1879570 - RNA, 17 nt, Homo sapiens
auacacaagugcacaga

SEQ ID NO: 1879571 - RNA, 23 nt, Homo sapiens
aaucucgguagaugucauuacaa

SEQ ID NO: 1879572 - RNA, 18 nt, Homo sapiens
aaaacucuucagugcaaa

SEQ ID NO: 1879573 - RNA, 10 nt, Homo sapiens
gugauuuucc

SEQ ID NO: 1879574 - RNA, 12 nt, Homo sapiens
guggcuggucuc

SEQ ID NO: 1879575 - RNA, 12 nt, Homo sapiens
ugggucaggggu

SEQ ID NO: 1879576 - RNA, 16 nt, Homo sapiens
gucauuuucuauucac

SEQ ID NO: 1879577 - RNA, 10 nt, Homo sapiens
cucuguaacc

SEQ ID NO: 1879578 - RNA, 21 nt, Homo sapiens
gaucucuucuuuuggcuucca

SEQ ID NO: 1879579 - RNA, 16 nt, Homo sapiens
caaguugaucaugcag

SEQ ID NO: 1879580 - RNA, 22 nt, Homo sapiens
gauucucucaucuaacugauga

SEQ ID NO: 1879581 - RNA, 20 nt, Homo sapiens
ccagaaaaccagucuguguu

SEQ ID NO: 1879582 - RNA, 15 nt, Homo sapiens
cccuccuuggcuuua

SEQ ID NO: 1879583 - RNA, 15 nt, Homo sapiens
auaaauuuacugaaa

SEQ ID NO: 1879584 - RNA, 22 nt, Homo sapiens
uaugcuuuguagaguuuuguca

SEQ ID NO: 1879585 - RNA, 11 nt, Homo sapiens
uuuuaccauac

SEQ ID NO: 1879586 - RNA, 19 nt, Homo sapiens
cccugggccauaugugcua

SEQ ID NO: 1879587 - RNA, 18 nt, Homo sapiens
agguggagccuccuggcu

SEQ ID NO: 1879588 - RNA, 18 nt, Homo sapiens
auaaucuccaacuuuauu

SEQ ID NO: 1879589 - RNA, 13 nt, Homo sapiens
uuggaacaugcua

SEQ ID NO: 1879590 - RNA, 19 nt, Homo sapiens
agcccuucccuagcacacu

SEQ ID NO: 1879591 - RNA, 16 nt, Homo sapiens
ucccugcagaugccac

SEQ ID NO: 1879592 - RNA, 15 nt, Homo sapiens
guuccuuucuuuucc

SEQ ID NO: 1879593 - RNA, 19 nt, Homo sapiens
ccucugaagccuucuuugu

SEQ ID NO: 1879594 - RNA, 15 nt, Homo sapiens
agcuaggugcuauuu

SEQ ID NO: 1879595 - RNA, 19 nt, Homo sapiens
gcaauguggauaugaccaa

SEQ ID NO: 1879596 - RNA, 16 nt, Homo sapiens
ucaagaagaagaugga

SEQ ID NO: 1879597 - RNA, 18 nt, Homo sapiens
acaucugggugcccugaa

SEQ ID NO: 1879598 - RNA, 20 nt, Homo sapiens
ccaggauagacuuuucccaa

SEQ ID NO: 1879599 - RNA, 14 nt, Homo sapiens
uagggacuuuggca

SEQ ID NO: 1879600 - RNA, 19 nt, Homo sapiens
uagaagucacauuccugaa

SEQ ID NO: 1879601 - RNA, 14 nt, Homo sapiens
ggucuugacucuaa

SEQ ID NO: 1879602 - RNA, 13 nt, Homo sapiens
aguuucaguuugu

SEQ ID NO: 1879603 - RNA, 17 nt, Homo sapiens
cagcuuuguuaaaucca

SEQ ID NO: 1879604 - RNA, 16 nt, Homo sapiens
ggcucaagucugcaca

SEQ ID NO: 1879605 - RNA, 17 nt, Homo sapiens
cuuuuguuuuuccaguu

SEQ ID NO: 1879606 - RNA, 22 nt, Homo sapiens
gcaucccaggaucgcaagagcc

SEQ ID NO: 1879607 - RNA, 17 nt, Homo sapiens
auaugcacacacaugga

SEQ ID NO: 1879608 - RNA, 20 nt, Homo sapiens
cagagugagaccauguuuca

SEQ ID NO: 1879609 - RNA, 12 nt, Homo sapiens
aaagcacuguug

SEQ ID NO: 1879610 - RNA, 14 nt, Homo sapiens
caaauuguuuacau

SEQ ID NO: 1879611 - RNA, 22 nt, Homo sapiens
gaagacaacagcauaacuaaau

SEQ ID NO: 1879612 - RNA, 18 nt, Homo sapiens
uuuaaaaaggaauuuugu

SEQ ID NO: 1879613 - RNA, 18 nt, Homo sapiens
ugacaaaacaucuuuuca

SEQ ID NO: 1879614 - RNA, 22 nt, Homo sapiens
ugaaaaguuugauuaaaauuca

SEQ ID NO: 1879615 - RNA, 10 nt, Homo sapiens
ggggccacag

SEQ ID NO: 1879616 - RNA, 21 nt, Homo sapiens
gccauuggguuuggggccaug

SEQ ID NO: 1879617 - RNA, 10 nt, Homo sapiens
ggggcuucca

SEQ ID NO: 1879618 - RNA, 18 nt, Homo sapiens
cuacacacggugccuuua

SEQ ID NO: 1879619 - RNA, 23 nt, Homo sapiens
aaguuuugaguagauauuacuuu

SEQ ID NO: 1879620 - RNA, 22 nt, Homo sapiens
gucaaggauggaugcagaucca

SEQ ID NO: 1879621 - RNA, 20 nt, Homo sapiens
uagagcagcccuggagucau

SEQ ID NO: 1879622 - RNA, 17 nt, Homo sapiens
gagauuaccuccugaga

SEQ ID NO: 1879623 - RNA, 20 nt, Homo sapiens
aauguaugccacaucucagu

SEQ ID NO: 1879624 - RNA, 14 nt, Homo sapiens
uugugucacugacu

SEQ ID NO: 1879625 - RNA, 17 nt, Homo sapiens
gguaucugaugauguuc

SEQ ID NO: 1879626 - RNA, 16 nt, Homo sapiens
uaccuuugaacuuuca

SEQ ID NO: 1879627 - RNA, 12 nt, Homo sapiens
gggaauggggac

SEQ ID NO: 1879628 - RNA, 15 nt, Homo sapiens
ucaaccccacuuccu

SEQ ID NO: 1879629 - RNA, 16 nt, Homo sapiens
agcucauucucaccaa

SEQ ID NO: 1879630 - RNA, 20 nt, Homo sapiens
uauggugcuaauguacuuuc

SEQ ID NO: 1879631 - RNA, 13 nt, Homo sapiens
ggggcccacagga

SEQ ID NO: 1879632 - RNA, 22 nt, Homo sapiens
gaagggccuucuccacagggac

SEQ ID NO: 1879633 - RNA, 23 nt, Homo sapiens
ggaggagaaaagugacagauccu

SEQ ID NO: 1879634 - RNA, 12 nt, Homo sapiens
uuuaauuugcua

SEQ ID NO: 1879635 - RNA, 21 nt, Homo sapiens
cagaggcgcccuggguggugg

SEQ ID NO: 1879636 - RNA, 18 nt, Homo sapiens
ugccuuuuuuaacuugag

SEQ ID NO: 1879637 - RNA, 16 nt, Homo sapiens
uaaaacacaccaauca

SEQ ID NO: 1879638 - RNA, 11 nt, Homo sapiens
caaccagacag

SEQ ID NO: 1879639 - RNA, 23 nt, Homo sapiens
caaaacguugaauugaugaugca

SEQ ID NO: 1879640 - RNA, 20 nt, Homo sapiens
ucaacuggggggaccaaaua

SEQ ID NO: 1879641 - RNA, 21 nt, Homo sapiens
uagcauugggaggaagcacag

SEQ ID NO: 1879642 - RNA, 20 nt, Homo sapiens
gcacacacacacgcuuucuu

SEQ ID NO: 1879643 - RNA, 18 nt, Homo sapiens
ugagcacgcuaccaaauc

SEQ ID NO: 1879644 - RNA, 21 nt, Homo sapiens
acagucaccauacacacuguu

SEQ ID NO: 1879645 - RNA, 18 nt, Homo sapiens
ggaaguaaaccugaacaa

SEQ ID NO: 1879646 - RNA, 17 nt, Homo sapiens
ugcaguacucaguaaua

SEQ ID NO: 1879647 - RNA, 18 nt, Homo sapiens
gauuugugaacuggaaga

SEQ ID NO: 1879648 - RNA, 13 nt, Homo sapiens
agauuaugaucuc

SEQ ID NO: 1879649 - RNA, 21 nt, Homo sapiens
agccucuuaaccucuucuuac

SEQ ID NO: 1879650 - RNA, 17 nt, Homo sapiens
cacgaucucgacucacu

SEQ ID NO: 1879651 - RNA, 16 nt, Homo sapiens
auggucaaugcuagca

SEQ ID NO: 1879652 - RNA, 20 nt, Homo sapiens
aauaaagguucuaugauaua

SEQ ID NO: 1879653 - RNA, 17 nt, Homo sapiens
gguuauuuaggucuuau

SEQ ID NO: 1879654 - RNA, 19 nt, Homo sapiens
gugccauuguuuugccagu

SEQ ID NO: 1879655 - RNA, 15 nt, Homo sapiens
gcugaagagaggugc

SEQ ID NO: 1879656 - RNA, 14 nt, Homo sapiens
gauaaacaaacaag

SEQ ID NO: 1879657 - RNA, 19 nt, Homo sapiens
agaaacguuuggaacaauc

SEQ ID NO: 1879658 - RNA, 19 nt, Homo sapiens
ggcucugccuucaaaggga

SEQ ID NO: 1879659 - RNA, 14 nt, Homo sapiens
uccugccauguuua

SEQ ID NO: 1879660 - RNA, 21 nt, Homo sapiens
auaaggggccuugcucugagc

SEQ ID NO: 1879661 - RNA, 23 nt, Homo sapiens
cauggucaggggugagaccugaa

SEQ ID NO: 1879662 - RNA, 22 nt, Homo sapiens
uugcacuguccagcugguugua

SEQ ID NO: 1879663 - RNA, 15 nt, Homo sapiens
gaauaaccaucugaa

SEQ ID NO: 1879664 - RNA, 14 nt, Homo sapiens
cuuguuuccaaaaa

SEQ ID NO: 1879665 - RNA, 14 nt, Homo sapiens
uuaauuucuaugaa

SEQ ID NO: 1879666 - RNA, 18 nt, Homo sapiens
uccacuguguguugacac

SEQ ID NO: 1879667 - RNA, 20 nt, Homo sapiens
ccuccuuccccccaccagac

SEQ ID NO: 1879668 - RNA, 17 nt, Homo sapiens
uuaacugugaaccugga

SEQ ID NO: 1879669 - RNA, 18 nt, Homo sapiens
ccaacccccgacuucauc

SEQ ID NO: 1879670 - RNA, 20 nt, Homo sapiens
ugcuggucagagagaccuca

SEQ ID NO: 1879671 - RNA, 21 nt, Homo sapiens
ugaauuugaaauagacuguga

SEQ ID NO: 1879672 - RNA, 18 nt, Homo sapiens
uaagaaauaaugccucca

SEQ ID NO: 1879673 - RNA, 22 nt, Homo sapiens
gugaagaggcugcuucucuaca

SEQ ID NO: 1879674 - RNA, 20 nt, Homo sapiens
acaguacucaggcagugcaa

SEQ ID NO: 1879675 - RNA, 18 nt, Homo sapiens
aauguuugguuucaggua

SEQ ID NO: 1879676 - RNA, 15 nt, Homo sapiens
uggccagcaugguga

SEQ ID NO: 1879677 - RNA, 20 nt, Homo sapiens
uacugauucaagaacaagca

SEQ ID NO: 1879678 - RNA, 12 nt, Homo sapiens
ucaaucucuggg

SEQ ID NO: 1879679 - RNA, 18 nt, Homo sapiens
caagggggaauauuuuaa

SEQ ID NO: 1879680 - RNA, 20 nt, Homo sapiens
aauccuuaacauauuugcac

SEQ ID NO: 1879681 - RNA, 20 nt, Homo sapiens
guauaauacauccauucuac

SEQ ID NO: 1879682 - RNA, 19 nt, Homo sapiens
aggggcaacaaaugcauca

SEQ ID NO: 1879683 - RNA, 13 nt, Homo sapiens
uacuaaauaucau

SEQ ID NO: 1879684 - RNA, 23 nt, Homo sapiens
ugaguugaggccacuguguuccu

SEQ ID NO: 1879685 - RNA, 16 nt, Homo sapiens
gaaaagcaccucuuga

SEQ ID NO: 1879686 - RNA, 13 nt, Homo sapiens
aaauguagcagcu

SEQ ID NO: 1879687 - RNA, 23 nt, Homo sapiens
cauuaucuuugucuguucacuuu

SEQ ID NO: 1879688 - RNA, 20 nt, Homo sapiens
augaaaaaaaugcauuuuau

SEQ ID NO: 1879689 - RNA, 19 nt, Homo sapiens
cuggcugcccuggcccuga

SEQ ID NO: 1879690 - RNA, 18 nt, Homo sapiens
ugcuuaaagcaaggcaua

SEQ ID NO: 1879691 - RNA, 20 nt, Homo sapiens
uggcccaggcuccagccaca

SEQ ID NO: 1879692 - RNA, 14 nt, Homo sapiens
agcaaaugucaugc

SEQ ID NO: 1879693 - RNA, 17 nt, Homo sapiens
ugguuuuaaaaaagcau

SEQ ID NO: 1879694 - RNA, 19 nt, Homo sapiens
uuggacagucugagcugua

SEQ ID NO: 1879695 - RNA, 22 nt, Homo sapiens
gucaaacccaaguuaguucaau

SEQ ID NO: 1879696 - RNA, 14 nt, Homo sapiens
ugagaagaguuuuc

SEQ ID NO: 1879697 - RNA, 13 nt, Homo sapiens
guacuaccccaga

SEQ ID NO: 1879698 - RNA, 16 nt, Homo sapiens
cuuguauauacgcauc

SEQ ID NO: 1879699 - RNA, 19 nt, Homo sapiens
auauuuucccccaaucaga

SEQ ID NO: 1879700 - RNA, 14 nt, Homo sapiens
uaugccuuauguaa

SEQ ID NO: 1879701 - RNA, 17 nt, Homo sapiens
aaaggaaaccacaguga

SEQ ID NO: 1879702 - RNA, 16 nt, Homo sapiens
ucacgugacccugugc

SEQ ID NO: 1879703 - RNA, 14 nt, Homo sapiens
gaaugaacacuccc

SEQ ID NO: 1879704 - RNA, 18 nt, Homo sapiens
ccccuaugcccacucuaa

SEQ ID NO: 1879705 - RNA, 15 nt, Homo sapiens
cuagcaauuccauca

SEQ ID NO: 1879706 - RNA, 13 nt, Homo sapiens
gcuucugugcaau

SEQ ID NO: 1879707 - RNA, 16 nt, Homo sapiens
uaaaaggcuucacuuu

SEQ ID NO: 1879708 - RNA, 22 nt, Homo sapiens
cuguccaucagccaggacaguc

SEQ ID NO: 1879709 - RNA, 21 nt, Homo sapiens
agggaccucaagcaccacgcc

SEQ ID NO: 1879710 - RNA, 19 nt, Homo sapiens
ggaaauggcuugaagccaa

SEQ ID NO: 1879711 - RNA, 17 nt, Homo sapiens
uaggauaccacuuuuca

SEQ ID NO: 1879712 - RNA, 16 nt, Homo sapiens
aauuacaggaaguacu

SEQ ID NO: 1879713 - RNA, 13 nt, Homo sapiens
agucuugccuugc

SEQ ID NO: 1879714 - RNA, 14 nt, Homo sapiens
ggcucccaugacca

SEQ ID NO: 1879715 - RNA, 20 nt, Homo sapiens
caugguuuuucacauugcaa

SEQ ID NO: 1879716 - RNA, 16 nt, Homo sapiens
acugacaaagacaucg

SEQ ID NO: 1879717 - RNA, 15 nt, Homo sapiens
aggaagagagaggga

SEQ ID NO: 1879718 - RNA, 15 nt, Homo sapiens
ucauuuccauuugag

SEQ ID NO: 1879719 - RNA, 15 nt, Homo sapiens
uaaggcagugcagua

SEQ ID NO: 1879720 - RNA, 16 nt, Homo sapiens
auguaaauagugauuu

SEQ ID NO: 1879721 - RNA, 21 nt, Homo sapiens
agcauugggaggaagcucaga

SEQ ID NO: 1879722 - RNA, 15 nt, Homo sapiens
cuggaaauucugcug

SEQ ID NO: 1879723 - RNA, 14 nt, Homo sapiens
aguaaucuguacau

SEQ ID NO: 1879724 - RNA, 16 nt, Homo sapiens
uuguugacacggccau

SEQ ID NO: 1879725 - RNA, 15 nt, Homo sapiens
uuauaaaucgcuuuu

SEQ ID NO: 1879726 - RNA, 16 nt, Homo sapiens
gacccugucucaaaaa

SEQ ID NO: 1879727 - RNA, 21 nt, Homo sapiens
aauggugcaaaaaaaaacuua

SEQ ID NO: 1879728 - RNA, 16 nt, Homo sapiens
uguccuggcaccaaau

SEQ ID NO: 1879729 - RNA, 18 nt, Homo sapiens
gaaucaacaagauuucca

SEQ ID NO: 1879730 - RNA, 14 nt, Homo sapiens
acuauucacuaaaa

SEQ ID NO: 1879731 - RNA, 19 nt, Homo sapiens
cuguucugggggacagaga

SEQ ID NO: 1879732 - RNA, 15 nt, Homo sapiens
agccacagcugugca

SEQ ID NO: 1879733 - RNA, 16 nt, Homo sapiens
cauuuauuuuucucau

SEQ ID NO: 1879734 - RNA, 16 nt, Homo sapiens
caauacaugcugcuaa

SEQ ID NO: 1879735 - RNA, 22 nt, Homo sapiens
aucugcaaaggaaucacuuuag

SEQ ID NO: 1879736 - RNA, 14 nt, Homo sapiens
cucucaccuccuaa

SEQ ID NO: 1879737 - RNA, 19 nt, Homo sapiens
caagcauauuggaaaguga

SEQ ID NO: 1879738 - RNA, 12 nt, Homo sapiens
aauguaagauuu

SEQ ID NO: 1879739 - RNA, 16 nt, Homo sapiens
cagcagcccaagcuua

SEQ ID NO: 1879740 - RNA, 19 nt, Homo sapiens
auuaaaucaauuuaucacu

SEQ ID NO: 1879741 - RNA, 16 nt, Homo sapiens
cacaugucuuguacau

SEQ ID NO: 1879742 - RNA, 18 nt, Homo sapiens
gcuccaucucauaggcua

SEQ ID NO: 1879743 - RNA, 17 nt, Homo sapiens
uccagaauccugauggu

SEQ ID NO: 1879744 - RNA, 23 nt, Homo sapiens
cuuccaaauccuggaaggacaca

SEQ ID NO: 1879745 - RNA, 18 nt, Homo sapiens
aggcaggauuuagcccuu

SEQ ID NO: 1879746 - RNA, 23 nt, Homo sapiens
ggagagagauuguguucuuccuc

SEQ ID NO: 1879747 - RNA, 12 nt, Homo sapiens
uguuauugcaug

SEQ ID NO: 1879748 - RNA, 20 nt, Homo sapiens
aaaaggaaagcuguguuuau

SEQ ID NO: 1879749 - RNA, 12 nt, Homo sapiens
aggcuggucucg

SEQ ID NO: 1879750 - RNA, 15 nt, Homo sapiens
uggccucccaacuca

SEQ ID NO: 1879751 - RNA, 23 nt, Homo sapiens
cucccaucuccuuaccucuggaa

SEQ ID NO: 1879752 - RNA, 21 nt, Homo sapiens
uucagaacuaaauuuuucaua

SEQ ID NO: 1879753 - RNA, 13 nt, Homo sapiens
ggcucuuuccuug

SEQ ID NO: 1879754 - RNA, 20 nt, Homo sapiens
accugggcccaggaccugcc

SEQ ID NO: 1879755 - RNA, 23 nt, Homo sapiens
cagaaagugauaagugcagggag

SEQ ID NO: 1879756 - RNA, 18 nt, Homo sapiens
cuauauaccaaagcacau

SEQ ID NO: 1879757 - RNA, 17 nt, Homo sapiens
uuucaugucuugucaua

SEQ ID NO: 1879758 - RNA, 19 nt, Homo sapiens
aauuuuuauuuuuggcaaa

SEQ ID NO: 1879759 - RNA, 17 nt, Homo sapiens
uguaccuauggcaauuu

SEQ ID NO: 1879760 - RNA, 13 nt, Homo sapiens
cagucaagcuccu

SEQ ID NO: 1879761 - RNA, 20 nt, Homo sapiens
aaugauugguuaaaauguga

SEQ ID NO: 1879762 - RNA, 14 nt, Homo sapiens
ucauccagcucacu

SEQ ID NO: 1879763 - RNA, 22 nt, Homo sapiens
uaaacuuccuucuuacuugcca

SEQ ID NO: 1879764 - RNA, 13 nt, Homo sapiens
aaaaaaagucaga

SEQ ID NO: 1879765 - RNA, 14 nt, Homo sapiens
uaaaggguaugaaa

SEQ ID NO: 1879766 - RNA, 19 nt, Homo sapiens
uggguccagaagaccccac

SEQ ID NO: 1879767 - RNA, 22 nt, Homo sapiens
aguugaugcuacaaaacaccuu

SEQ ID NO: 1879768 - RNA, 17 nt, Homo sapiens
gaaaaaugccacucccu

SEQ ID NO: 1879769 - RNA, 19 nt, Homo sapiens
aggccauuuacaauugcau

SEQ ID NO: 1879770 - RNA, 15 nt, Homo sapiens
aaauacuugcaucca

SEQ ID NO: 1879771 - RNA, 15 nt, Homo sapiens
acccccaugaccacu

SEQ ID NO: 1879772 - RNA, 17 nt, Homo sapiens
uacuuugaagugcagcu

SEQ ID NO: 1879773 - RNA, 18 nt, Homo sapiens
ggccuuuccugguuuuca

SEQ ID NO: 1879774 - RNA, 21 nt, Homo sapiens
agccccuuacuaugaucucag

SEQ ID NO: 1879775 - RNA, 16 nt, Homo sapiens
cuacucagguggcuaa

SEQ ID NO: 1879776 - RNA, 19 nt, Homo sapiens
aaucagccagcucauuugg

SEQ ID NO: 1879777 - RNA, 19 nt, Homo sapiens
ugaaugccuaugguggauc

SEQ ID NO: 1879778 - RNA, 19 nt, Homo sapiens
uagaaaguaagagcucuaa

SEQ ID NO: 1879779 - RNA, 19 nt, Homo sapiens
uaugcucauaacuguguca

SEQ ID NO: 1879780 - RNA, 22 nt, Homo sapiens
cuuaugaaaauuauacugagaa

SEQ ID NO: 1879781 - RNA, 17 nt, Homo sapiens
uugucucugugacugaa

SEQ ID NO: 1879782 - RNA, 15 nt, Homo sapiens
uuggagggaaagcca

SEQ ID NO: 1879783 - RNA, 17 nt, Homo sapiens
gugccuggccaugucac

SEQ ID NO: 1879784 - RNA, 20 nt, Homo sapiens
caauuuggcagugauauuca

SEQ ID NO: 1879785 - RNA, 18 nt, Homo sapiens
uaaccaaggaggggccag

SEQ ID NO: 1879786 - RNA, 18 nt, Homo sapiens
aucuaaaauuuguaauau

SEQ ID NO: 1879787 - RNA, 18 nt, Homo sapiens
ggccaugagggacagggu

SEQ ID NO: 1879788 - RNA, 17 nt, Homo sapiens
gcuuccugacugacaca

SEQ ID NO: 1879789 - RNA, 22 nt, Homo sapiens
ccagauccuggaaacagcagug

SEQ ID NO: 1879790 - RNA, 17 nt, Homo sapiens
uauagagccuaccugua

SEQ ID NO: 1879791 - RNA, 21 nt, Homo sapiens
gaauggagaaaguaagucuuu

SEQ ID NO: 1879792 - RNA, 17 nt, Homo sapiens
cuuaaugaaccuuagaa

SEQ ID NO: 1879793 - RNA, 14 nt, Homo sapiens
augcuucuuucauu

SEQ ID NO: 1879794 - RNA, 22 nt, Homo sapiens
uucaagugauucuuccaccuca

SEQ ID NO: 1879795 - RNA, 22 nt, Homo sapiens
cucacuuuuuuacaacuccaac

SEQ ID NO: 1879796 - RNA, 18 nt, Homo sapiens
ucaaucucugauucuguc

SEQ ID NO: 1879797 - RNA, 14 nt, Homo sapiens
cuggccacacuggg

SEQ ID NO: 1879798 - RNA, 12 nt, Homo sapiens
ggcucuggagac

SEQ ID NO: 1879799 - RNA, 20 nt, Homo sapiens
aauagauaaaaaucccagac

SEQ ID NO: 1879800 - RNA, 22 nt, Homo sapiens
ugguuuuaaagcuaaacguaau

SEQ ID NO: 1879801 - RNA, 23 nt, Homo sapiens
ccagcauugugauauauucugua

SEQ ID NO: 1879802 - RNA, 23 nt, Homo sapiens
gccaggcuguuggaaaauccaga

SEQ ID NO: 1879803 - RNA, 14 nt, Homo sapiens
uaagguucuaauag

SEQ ID NO: 1879804 - RNA, 22 nt, Homo sapiens
ccugcugugcccucccauagca

SEQ ID NO: 1879805 - RNA, 15 nt, Homo sapiens
aagcuuuguaccuuu

SEQ ID NO: 1879806 - RNA, 19 nt, Homo sapiens
uguccuggugcucucugcc

SEQ ID NO: 1879807 - RNA, 20 nt, Homo sapiens
gauucacugcauggcuccca

SEQ ID NO: 1879808 - RNA, 23 nt, Homo sapiens
gcacacgcugcucugccccagcu

SEQ ID NO: 1879809 - RNA, 19 nt, Homo sapiens
auuuagugaaguugugcaa

SEQ ID NO: 1879810 - RNA, 16 nt, Homo sapiens
auguagcucuuuguca

SEQ ID NO: 1879811 - RNA, 16 nt, Homo sapiens
acaauugacaacaguu

SEQ ID NO: 1879812 - RNA, 16 nt, Homo sapiens
cauaagcccaguucau

SEQ ID NO: 1879813 - RNA, 20 nt, Homo sapiens
ccauagcaagauugcuuaaa

SEQ ID NO: 1879814 - RNA, 16 nt, Homo sapiens
cuuccauauuuggaag

SEQ ID NO: 1879815 - RNA, 16 nt, Homo sapiens
auccaccccaccccau

SEQ ID NO: 1879816 - RNA, 15 nt, Homo sapiens
cuguguguugccaca

SEQ ID NO: 1879817 - RNA, 19 nt, Homo sapiens
acauaaacacauacauugc

SEQ ID NO: 1879818 - RNA, 23 nt, Homo sapiens
ugucuaaaaaccagacaaggaaa

SEQ ID NO: 1879819 - RNA, 17 nt, Homo sapiens
uugucugagucuugggu

SEQ ID NO: 1879820 - RNA, 15 nt, Homo sapiens
ggucuauuccagcuc

SEQ ID NO: 1879821 - RNA, 22 nt, Homo sapiens
agggcaguuuugaggcaugacu

SEQ ID NO: 1879822 - RNA, 12 nt, Homo sapiens
cagcacuuugac

SEQ ID NO: 1879823 - RNA, 18 nt, Homo sapiens
agcugaguuuaacaugug

SEQ ID NO: 1879824 - RNA, 14 nt, Homo sapiens
cugcccagagccac

SEQ ID NO: 1879825 - RNA, 16 nt, Homo sapiens
caguuuauaaagccaa

SEQ ID NO: 1879826 - RNA, 14 nt, Homo sapiens
gaccuuccuuccac

SEQ ID NO: 1879827 - RNA, 24 nt, Homo sapiens
aaaugaauagccaggccugaccuc

SEQ ID NO: 1879828 - RNA, 17 nt, Homo sapiens
gacugggggacugggag

SEQ ID NO: 1879829 - RNA, 18 nt, Homo sapiens
auaucuagaaaugauaau

SEQ ID NO: 1879830 - RNA, 18 nt, Homo sapiens
agggguuauagcuucagg

SEQ ID NO: 1879831 - RNA, 19 nt, Homo sapiens
ccucaacaaagaagaacca

SEQ ID NO: 1879832 - RNA, 17 nt, Homo sapiens
cauggcacugacaaugg

SEQ ID NO: 1879833 - RNA, 19 nt, Homo sapiens
ucccucacagcaaagcaac

SEQ ID NO: 1879834 - RNA, 16 nt, Homo sapiens
aauccuguauauuuag

SEQ ID NO: 1879835 - RNA, 15 nt, Homo sapiens
agccuccacugccuc

SEQ ID NO: 1879836 - RNA, 15 nt, Homo sapiens
cugacaccuuugcag

SEQ ID NO: 1879837 - RNA, 17 nt, Homo sapiens
aaaauuauguguugcca

SEQ ID NO: 1879838 - RNA, 17 nt, Homo sapiens
uugcaguugugauauaa

SEQ ID NO: 1879839 - RNA, 20 nt, Homo sapiens
cccacccagucucugcucca

SEQ ID NO: 1879840 - RNA, 14 nt, Homo sapiens
ugcggaguccaggc

SEQ ID NO: 1879841 - RNA, 23 nt, Homo sapiens
cacagcaugugaaugggggagug

SEQ ID NO: 1879842 - RNA, 21 nt, Homo sapiens
ugcuuuaauagguagcauuga

SEQ ID NO: 1879843 - RNA, 16 nt, Homo sapiens
aggaaaucuacuuccu

SEQ ID NO: 1879844 - RNA, 19 nt, Homo sapiens
ccaaggaaacgcuaccucu

SEQ ID NO: 1879845 - RNA, 10 nt, Homo sapiens
caugaugucu

SEQ ID NO: 1879846 - RNA, 16 nt, Homo sapiens
ccugacgucaguaguu

SEQ ID NO: 1879847 - RNA, 16 nt, Homo sapiens
gauggaauaaagcccu

SEQ ID NO: 1879848 - RNA, 24 nt, Homo sapiens
gaaacuauuucuguuccagucaca

SEQ ID NO: 1879849 - RNA, 19 nt, Homo sapiens
guuauuuauuccccaguga

SEQ ID NO: 1879850 - RNA, 19 nt, Homo sapiens
ccuacugccucuccagcac

SEQ ID NO: 1879851 - RNA, 13 nt, Homo sapiens
augcucaguaccu

SEQ ID NO: 1879852 - RNA, 15 nt, Homo sapiens
auuuuguaaucucau

SEQ ID NO: 1879853 - RNA, 15 nt, Homo sapiens
ugcgugcaugugcac

SEQ ID NO: 1879854 - RNA, 22 nt, Homo sapiens
uuaaugaaaaugauaaaacaga

SEQ ID NO: 1879855 - RNA, 16 nt, Homo sapiens
uaugcuauuacauaca

SEQ ID NO: 1879856 - RNA, 13 nt, Homo sapiens
gucagcaucugac

SEQ ID NO: 1879857 - RNA, 16 nt, Homo sapiens
agaaaggcucauaccu

SEQ ID NO: 1879858 - RNA, 18 nt, Homo sapiens
ccaccugggcccuaggca

SEQ ID NO: 1879859 - RNA, 21 nt, Homo sapiens
ugucucuuaacuuaccauucc

SEQ ID NO: 1879860 - RNA, 23 nt, Homo sapiens
uugaaaggaugguauugaaucua

SEQ ID NO: 1879861 - RNA, 13 nt, Homo sapiens
gccaccuggcgcu

SEQ ID NO: 1879862 - RNA, 12 nt, Homo sapiens
gcccagacuaca

SEQ ID NO: 1879863 - RNA, 15 nt, Homo sapiens
uaaacauuugccaaa

SEQ ID NO: 1879864 - RNA, 17 nt, Homo sapiens
gguguuuuaugggccac

SEQ ID NO: 1879865 - RNA, 23 nt, Homo sapiens
ucauaauuuccaugauacaaaga

SEQ ID NO: 1879866 - RNA, 21 nt, Homo sapiens
gucagaaaaagcuagcacuaa

SEQ ID NO: 1879867 - RNA, 13 nt, Homo sapiens
uaauugcaugaaa

SEQ ID NO: 1879868 - RNA, 13 nt, Homo sapiens
uacucauggcaag

SEQ ID NO: 1879869 - RNA, 16 nt, Homo sapiens
agaucucccuuaauaa

SEQ ID NO: 1879870 - RNA, 20 nt, Homo sapiens
aaaauuguuaguaaacauag

SEQ ID NO: 1879871 - RNA, 17 nt, Homo sapiens
acaaucuuugcuguaua

SEQ ID NO: 1879872 - RNA, 14 nt, Homo sapiens
uugugaagaaacau

SEQ ID NO: 1879873 - RNA, 15 nt, Homo sapiens
ucgaccacaccagcc

SEQ ID NO: 1879874 - RNA, 13 nt, Homo sapiens
ucuccacacccau

SEQ ID NO: 1879875 - RNA, 20 nt, Homo sapiens
gagaacuaaagguggccaca

SEQ ID NO: 1879876 - RNA, 23 nt, Homo sapiens
uagcugccuuuuuuaacacuaga

SEQ ID NO: 1879877 - RNA, 20 nt, Homo sapiens
aaugucucuucauaauacuu

SEQ ID NO: 1879878 - RNA, 15 nt, Homo sapiens
gaguccccaccagcu

SEQ ID NO: 1879879 - RNA, 22 nt, Homo sapiens
caaacacugccauauuguguaa

SEQ ID NO: 1879880 - RNA, 17 nt, Homo sapiens
aagagugguuaugccuc

SEQ ID NO: 1879881 - RNA, 21 nt, Homo sapiens
uucccagagcucccucugccc

SEQ ID NO: 1879882 - RNA, 15 nt, Homo sapiens
aggaguaacaaaaca

SEQ ID NO: 1879883 - RNA, 16 nt, Homo sapiens
cccagucccuuucagc

SEQ ID NO: 1879884 - RNA, 23 nt, Homo sapiens
cagaguuaaaauguuuacuguaa

SEQ ID NO: 1879885 - RNA, 15 nt, Homo sapiens
cccagggacaaggga

SEQ ID NO: 1879886 - RNA, 14 nt, Homo sapiens
ccucuccagcuccu

SEQ ID NO: 1879887 - RNA, 17 nt, Homo sapiens
caugggaagcaugugga

SEQ ID NO: 1879888 - RNA, 15 nt, Homo sapiens
cugcuagcuagcuca

SEQ ID NO: 1879889 - RNA, 11 nt, Homo sapiens
ccacaucuugc

SEQ ID NO: 1879890 - RNA, 16 nt, Homo sapiens
gcucccagcuccagcu

SEQ ID NO: 1879891 - RNA, 17 nt, Homo sapiens
uccaacuguacuuuuaa

SEQ ID NO: 1879892 - RNA, 23 nt, Homo sapiens
ccagucuuuucuggcaaauaaca

SEQ ID NO: 1879893 - RNA, 20 nt, Homo sapiens
uggaauuuucagucaucuca

SEQ ID NO: 1879894 - RNA, 16 nt, Homo sapiens
uuugcacuucaaaaaa

SEQ ID NO: 1879895 - RNA, 17 nt, Homo sapiens
aaacuuuucugcugaua

SEQ ID NO: 1879896 - RNA, 14 nt, Homo sapiens
acacucaugcugaa

SEQ ID NO: 1879897 - RNA, 14 nt, Homo sapiens
aauacuguguuuca

SEQ ID NO: 1879898 - RNA, 13 nt, Homo sapiens
ccaacaacucugc

SEQ ID NO: 1879899 - RNA, 16 nt, Homo sapiens
cucuaugccccaaaua

SEQ ID NO: 1879900 - RNA, 22 nt, Homo sapiens
cagcuacauuccucagcugcca

SEQ ID NO: 1879901 - RNA, 18 nt, Homo sapiens
cugguacaguaugggggu

SEQ ID NO: 1879902 - RNA, 17 nt, Homo sapiens
uugggaugcucucuggu

SEQ ID NO: 1879903 - RNA, 14 nt, Homo sapiens
ucaaacccucaaga

SEQ ID NO: 1879904 - RNA, 13 nt, Homo sapiens
ggccuucauccuc

SEQ ID NO: 1879905 - RNA, 20 nt, Homo sapiens
aguuauggcuucacauucau

SEQ ID NO: 1879906 - RNA, 22 nt, Homo sapiens
aaauaaaaauucaaccacagau

SEQ ID NO: 1879907 - RNA, 21 nt, Homo sapiens
accuacccuccacaggcacag

SEQ ID NO: 1879908 - RNA, 19 nt, Homo sapiens
ucccaaggugaaaugaagc

SEQ ID NO: 1879909 - RNA, 12 nt, Homo sapiens
uuucugagcuuu

SEQ ID NO: 1879910 - RNA, 14 nt, Homo sapiens
uucuuagcauacau

SEQ ID NO: 1879911 - RNA, 11 nt, Homo sapiens
ccucucugcaa

SEQ ID NO: 1879912 - RNA, 17 nt, Homo sapiens
caagugagacaaaaagc

SEQ ID NO: 1879913 - RNA, 22 nt, Homo sapiens
cuauauauccaagaagcaugca

SEQ ID NO: 1879914 - RNA, 13 nt, Homo sapiens
acucacugccuag

SEQ ID NO: 1879915 - RNA, 17 nt, Homo sapiens
gccacagugucacuggu

SEQ ID NO: 1879916 - RNA, 22 nt, Homo sapiens
cuucagacacgcacuucugggg

SEQ ID NO: 1879917 - RNA, 17 nt, Homo sapiens
agagcuucccaggaucc

SEQ ID NO: 1879918 - RNA, 16 nt, Homo sapiens
aucugcuccuagccca

SEQ ID NO: 1879919 - RNA, 13 nt, Homo sapiens
uaccagaugcuac

SEQ ID NO: 1879920 - RNA, 12 nt, Homo sapiens
uaaaaagcucca

SEQ ID NO: 1879921 - RNA, 15 nt, Homo sapiens
aaagggacaguuugu

SEQ ID NO: 1879922 - RNA, 17 nt, Homo sapiens
agaaacuugcugaucca

SEQ ID NO: 1879923 - RNA, 18 nt, Homo sapiens
ccaucagagaugacucug

SEQ ID NO: 1879924 - RNA, 12 nt, Homo sapiens
cauuucauauua

SEQ ID NO: 1879925 - RNA, 16 nt, Homo sapiens
cugugggggugagggu

SEQ ID NO: 1879926 - RNA, 17 nt, Homo sapiens
caauccagguacgcaca

SEQ ID NO: 1879927 - RNA, 20 nt, Homo sapiens
aagggauugguuuggcaaga

SEQ ID NO: 1879928 - RNA, 17 nt, Homo sapiens
ugcugguuguugccagg

SEQ ID NO: 1879929 - RNA, 13 nt, Homo sapiens
ggugcucaaagau

SEQ ID NO: 1879930 - RNA, 18 nt, Homo sapiens
caggaagaaagggaaauu

SEQ ID NO: 1879931 - RNA, 18 nt, Homo sapiens
gacggcaaccucugagcc

SEQ ID NO: 1879932 - RNA, 15 nt, Homo sapiens
auagaccaugcacag

SEQ ID NO: 1879933 - RNA, 15 nt, Homo sapiens
ggaggaugaugccag

SEQ ID NO: 1879934 - RNA, 14 nt, Homo sapiens
cuccuuggugccug

SEQ ID NO: 1879935 - RNA, 12 nt, Homo sapiens
cccagcuuuauc

SEQ ID NO: 1879936 - RNA, 16 nt, Homo sapiens
uucaguuuuucacuuc

SEQ ID NO: 1879937 - RNA, 18 nt, Homo sapiens
ugccuuuaaaucugugau

SEQ ID NO: 1879938 - RNA, 17 nt, Homo sapiens
ucacuacccuauucucu

SEQ ID NO: 1879939 - RNA, 22 nt, Homo sapiens
cuuuccugagucauggccucaa

SEQ ID NO: 1879940 - RNA, 17 nt, Homo sapiens
ugaaaggcacacuuuga

SEQ ID NO: 1879941 - RNA, 19 nt, Homo sapiens
gacaugaagacaccaucuc

SEQ ID NO: 1879942 - RNA, 17 nt, Homo sapiens
auuucuacaaugcacau

SEQ ID NO: 1879943 - RNA, 15 nt, Homo sapiens
aauuuuaaaguauca

SEQ ID NO: 1879944 - RNA, 15 nt, Homo sapiens
aguuccuuugaucuc

SEQ ID NO: 1879945 - RNA, 16 nt, Homo sapiens
ggccccucaccuggua

SEQ ID NO: 1879946 - RNA, 23 nt, Homo sapiens
gugauugacagcuuugcugcuga

SEQ ID NO: 1879947 - RNA, 12 nt, Homo sapiens
aauguaugcauu

SEQ ID NO: 1879948 - RNA, 15 nt, Homo sapiens
ggagcaggaggccaa

SEQ ID NO: 1879949 - RNA, 23 nt, Homo sapiens
caccuuggggccuugaugacugc

SEQ ID NO: 1879950 - RNA, 13 nt, Homo sapiens
uguauaugugcca

SEQ ID NO: 1879951 - RNA, 11 nt, Homo sapiens
auuaacuaauc

SEQ ID NO: 1879952 - RNA, 18 nt, Homo sapiens
aacacaaccuacucugca

SEQ ID NO: 1879953 - RNA, 18 nt, Homo sapiens
aacucauuacuuuuccau

SEQ ID NO: 1879954 - RNA, 18 nt, Homo sapiens
gaauaaaugucacuuuuu

SEQ ID NO: 1879955 - RNA, 19 nt, Homo sapiens
gucauacagagaagucaca

SEQ ID NO: 1879956 - RNA, 14 nt, Homo sapiens
uaucaucaguauug

SEQ ID NO: 1879957 - RNA, 18 nt, Homo sapiens
uccugacucuucaggcca

SEQ ID NO: 1879958 - RNA, 14 nt, Homo sapiens
uacacuguuuccau

SEQ ID NO: 1879959 - RNA, 16 nt, Homo sapiens
auuugaaaguccuugu

SEQ ID NO: 1879960 - RNA, 15 nt, Homo sapiens
aagguuggcagugau

SEQ ID NO: 1879961 - RNA, 15 nt, Homo sapiens
augguggcauauacu

SEQ ID NO: 1879962 - RNA, 15 nt, Homo sapiens
aauacgcacuuucag

SEQ ID NO: 1879963 - RNA, 17 nt, Homo sapiens
ugcacaaacuugugagc

SEQ ID NO: 1879964 - RNA, 16 nt, Homo sapiens
uugucuaaugacagau

SEQ ID NO: 1879965 - RNA, 19 nt, Homo sapiens
ucacucuuuauagugcaca

SEQ ID NO: 1879966 - RNA, 20 nt, Homo sapiens
gcagaaacacaaccacucac

SEQ ID NO: 1879967 - RNA, 20 nt, Homo sapiens
ggagacccaccccaccugca

SEQ ID NO: 1879968 - RNA, 15 nt, Homo sapiens
agcccuccuuaucaa

SEQ ID NO: 1879969 - RNA, 14 nt, Homo sapiens
uaagcaacuggaaa

SEQ ID NO: 1879970 - RNA, 22 nt, Homo sapiens
gauuucuuucuuugcaccaaag

SEQ ID NO: 1879971 - RNA, 15 nt, Homo sapiens
ucccucccaaugcca

SEQ ID NO: 1879972 - RNA, 13 nt, Homo sapiens
gaacauacacugu

SEQ ID NO: 1879973 - RNA, 19 nt, Homo sapiens
cucgucuuccucucucuca

SEQ ID NO: 1879974 - RNA, 12 nt, Homo sapiens
uacaauuucacu

SEQ ID NO: 1879975 - RNA, 22 nt, Homo sapiens
acccucuucccaucuguuucug

SEQ ID NO: 1879976 - RNA, 18 nt, Homo sapiens
auauaacuuauuugcccu

SEQ ID NO: 1879977 - RNA, 18 nt, Homo sapiens
cuuaagucuuaauauuaa

SEQ ID NO: 1879978 - RNA, 17 nt, Homo sapiens
cauugcuaaacugauga

SEQ ID NO: 1879979 - RNA, 20 nt, Homo sapiens
ugaaugacacgccuaagguc

SEQ ID NO: 1879980 - RNA, 16 nt, Homo sapiens
caaagucaugcaaagg

SEQ ID NO: 1879981 - RNA, 21 nt, Homo sapiens
caaaauggacguacugguuua

SEQ ID NO: 1879982 - RNA, 16 nt, Homo sapiens
ugaaacagacuuguau

SEQ ID NO: 1879983 - RNA, 16 nt, Homo sapiens
cagcccggcacuccag

SEQ ID NO: 1879984 - RNA, 17 nt, Homo sapiens
aauguguggcugaagac

SEQ ID NO: 1879985 - RNA, 22 nt, Homo sapiens
ucuguauauaacuuauuugccc

SEQ ID NO: 1879986 - RNA, 16 nt, Homo sapiens
caugauucaugagcug

SEQ ID NO: 1879987 - RNA, 21 nt, Homo sapiens
ucacugccaucaaacuguaaa

SEQ ID NO: 1879988 - RNA, 13 nt, Homo sapiens
cagaacacacaga

SEQ ID NO: 1879989 - RNA, 12 nt, Homo sapiens
ucuaaagcugaa

SEQ ID NO: 1879990 - RNA, 12 nt, Homo sapiens
ugagaagcucug

SEQ ID NO: 1879991 - RNA, 17 nt, Homo sapiens
ugaggccaucucaggag

SEQ ID NO: 1879992 - RNA, 13 nt, Homo sapiens
gagugagccagug

SEQ ID NO: 1879993 - RNA, 19 nt, Homo sapiens
gucaugauggagacuucag

SEQ ID NO: 1879994 - RNA, 17 nt, Homo sapiens
aaccauaaaucaauuca

SEQ ID NO: 1879995 - RNA, 18 nt, Homo sapiens
ccucuaagccacucuucc

SEQ ID NO: 1879996 - RNA, 16 nt, Homo sapiens
ccccaggacugucauu

SEQ ID NO: 1879997 - RNA, 12 nt, Homo sapiens
cucagugccugg

SEQ ID NO: 1879998 - RNA, 18 nt, Homo sapiens
gauauuucguguacugca

SEQ ID NO: 1879999 - RNA, 15 nt, Homo sapiens
agauacaaauaccuu

SEQ ID NO: 1880000 - RNA, 16 nt, Homo sapiens
acucagaucugaucaa

SEQ ID NO: 1880001 - RNA, 20 nt, Homo sapiens
uaaggcagugcagugcucag

SEQ ID NO: 1880002 - RNA, 16 nt, Homo sapiens
gcugucccgugcaugg

SEQ ID NO: 1880003 - RNA, 17 nt, Homo sapiens
uccagaguucugugaca

SEQ ID NO: 1880004 - RNA, 18 nt, Homo sapiens
caguaaauaacuggaaaa

SEQ ID NO: 1880005 - RNA, 23 nt, Homo sapiens
guuugagaacugccauucaguag

SEQ ID NO: 1880006 - RNA, 16 nt, Homo sapiens
ggaauacagucauucc

SEQ ID NO: 1880007 - RNA, 16 nt, Homo sapiens
aauauaucuaccccag

SEQ ID NO: 1880008 - RNA, 18 nt, Homo sapiens
aaauaggcucucugugaa

SEQ ID NO: 1880009 - RNA, 22 nt, Homo sapiens
ggcagggaagaggccagcguga

SEQ ID NO: 1880010 - RNA, 14 nt, Homo sapiens
cagugcauguugcc

SEQ ID NO: 1880011 - RNA, 22 nt, Homo sapiens
uccacgcugauguuuauguacu

SEQ ID NO: 1880012 - RNA, 14 nt, Homo sapiens
uauucccagccuag

SEQ ID NO: 1880013 - RNA, 18 nt, Homo sapiens
uacuuuuuccauuuggca

SEQ ID NO: 1880014 - RNA, 21 nt, Homo sapiens
acucugcccucagggugccug

SEQ ID NO: 1880015 - RNA, 19 nt, Homo sapiens
ccugcacacaccugcacac

SEQ ID NO: 1880016 - RNA, 21 nt, Homo sapiens
caaucuguguucgauggcuca

SEQ ID NO: 1880017 - RNA, 23 nt, Homo sapiens
uuguuccagcaguuuucaaguca

SEQ ID NO: 1880018 - RNA, 17 nt, Homo sapiens
aaggcucugugccuugg

SEQ ID NO: 1880019 - RNA, 13 nt, Homo sapiens
ggaauacugucuc

SEQ ID NO: 1880020 - RNA, 13 nt, Homo sapiens
gaggucacuggaa

SEQ ID NO: 1880021 - RNA, 17 nt, Homo sapiens
aggacacagcaguauug

SEQ ID NO: 1880022 - RNA, 17 nt, Homo sapiens
aaagaaaugcauaaaag

SEQ ID NO: 1880023 - RNA, 19 nt, Homo sapiens
uuucaucaggaaaccuuau

SEQ ID NO: 1880024 - RNA, 15 nt, Homo sapiens
cacucaguuuacucu

SEQ ID NO: 1880025 - RNA, 19 nt, Homo sapiens
guaaagcguuugcauuugc

SEQ ID NO: 1880026 - RNA, 16 nt, Homo sapiens
aacacucaacaauaaa

SEQ ID NO: 1880027 - RNA, 14 nt, Homo sapiens
augcuguucagaaa

SEQ ID NO: 1880028 - RNA, 20 nt, Homo sapiens
ugucugaguggcuucacucc

SEQ ID NO: 1880029 - RNA, 21 nt, Homo sapiens
aauucauuuucaucacuggga

SEQ ID NO: 1880030 - RNA, 18 nt, Homo sapiens
uuauuugacucagcacug

SEQ ID NO: 1880031 - RNA, 20 nt, Homo sapiens
cauuacuccuucagcucugg

SEQ ID NO: 1880032 - RNA, 21 nt, Homo sapiens
uccuaaaucuuccagcaugca

SEQ ID NO: 1880033 - RNA, 16 nt, Homo sapiens
gcuaugccugccucaa

SEQ ID NO: 1880034 - RNA, 19 nt, Homo sapiens
accaaaacagugaagauga

SEQ ID NO: 1880035 - RNA, 20 nt, Homo sapiens
gguuucauguucacugugag

SEQ ID NO: 1880036 - RNA, 16 nt, Homo sapiens
uaccuuguuaagacaa

SEQ ID NO: 1880037 - RNA, 22 nt, Homo sapiens
agcacccuaugauuuauucccu

SEQ ID NO: 1880038 - RNA, 14 nt, Homo sapiens
caccgcugcugcug

SEQ ID NO: 1880039 - RNA, 13 nt, Homo sapiens
caugguuguugca

SEQ ID NO: 1880040 - RNA, 19 nt, Homo sapiens
cuaauuuaaguacuugaga

SEQ ID NO: 1880041 - RNA, 15 nt, Homo sapiens
cucaaacaaugacaa

SEQ ID NO: 1880042 - RNA, 22 nt, Homo sapiens
gucuccaagggcaucacugggu

SEQ ID NO: 1880043 - RNA, 17 nt, Homo sapiens
agccauuaaaugaauau

SEQ ID NO: 1880044 - RNA, 18 nt, Homo sapiens
aaaugugcaaccacugcu

SEQ ID NO: 1880045 - RNA, 16 nt, Homo sapiens
augugcuuuagcauaa

SEQ ID NO: 1880046 - RNA, 23 nt, Homo sapiens
aaacauaauaaaucacacauuca

SEQ ID NO: 1880047 - RNA, 13 nt, Homo sapiens
uugagaagggaca

SEQ ID NO: 1880048 - RNA, 15 nt, Homo sapiens
ccagaggauggugag

SEQ ID NO: 1880049 - RNA, 16 nt, Homo sapiens
agcuuagcauaucuga

SEQ ID NO: 1880050 - RNA, 23 nt, Homo sapiens
aucagcauuuuagaaacuacaaa

SEQ ID NO: 1880051 - RNA, 14 nt, Homo sapiens
acuugccuuacccu

SEQ ID NO: 1880052 - RNA, 18 nt, Homo sapiens
uuuuacuucucuauacaa

SEQ ID NO: 1880053 - RNA, 16 nt, Homo sapiens
ugaauuucccacauac

SEQ ID NO: 1880054 - RNA, 19 nt, Homo sapiens
auacaaaaaucagccagac

SEQ ID NO: 1880055 - RNA, 15 nt, Homo sapiens
agauagagaccaucu

SEQ ID NO: 1880056 - RNA, 16 nt, Homo sapiens
ugccaccaacuuacaa

SEQ ID NO: 1880057 - RNA, 17 nt, Homo sapiens
gaauacuggccaugccu

SEQ ID NO: 1880058 - RNA, 17 nt, Homo sapiens
ggcuucugucucuauga

SEQ ID NO: 1880059 - RNA, 17 nt, Homo sapiens
aaggacugaucauuuga

SEQ ID NO: 1880060 - RNA, 22 nt, Homo sapiens
aggcugcccccauccagccacg

SEQ ID NO: 1880061 - RNA, 16 nt, Homo sapiens
caguugggagcacugg

SEQ ID NO: 1880062 - RNA, 12 nt, Homo sapiens
gcagcuagacac

SEQ ID NO: 1880063 - RNA, 14 nt, Homo sapiens
ccggacacuucuca

SEQ ID NO: 1880064 - RNA, 16 nt, Homo sapiens
cauuucacuacuggug

SEQ ID NO: 1880065 - RNA, 16 nt, Homo sapiens
gcaggaguauaugagc

SEQ ID NO: 1880066 - RNA, 16 nt, Homo sapiens
ucugcauacuaaccua

SEQ ID NO: 1880067 - RNA, 18 nt, Homo sapiens
agguggcagagugaaugu

SEQ ID NO: 1880068 - RNA, 11 nt, Homo sapiens
uaaacuuguag

SEQ ID NO: 1880069 - RNA, 14 nt, Homo sapiens
ucucugcaccggac

SEQ ID NO: 1880070 - RNA, 14 nt, Homo sapiens
aaugucuuaaucau

SEQ ID NO: 1880071 - RNA, 17 nt, Homo sapiens
ucaguaaggcagugcag

SEQ ID NO: 1880072 - RNA, 13 nt, Homo sapiens
uguauauacaguu

SEQ ID NO: 1880073 - RNA, 21 nt, Homo sapiens
acaucaguuuaaacaaaggga

SEQ ID NO: 1880074 - RNA, 16 nt, Homo sapiens
cgggccccuggcacgu

SEQ ID NO: 1880075 - RNA, 15 nt, Homo sapiens
ugagcagaauacugg

SEQ ID NO: 1880076 - RNA, 11 nt, Homo sapiens
ugucagcauca

SEQ ID NO: 1880077 - RNA, 15 nt, Homo sapiens
caugaucauagcuca

SEQ ID NO: 1880078 - RNA, 17 nt, Homo sapiens
ugcuagaugcugugaca

SEQ ID NO: 1880079 - RNA, 14 nt, Homo sapiens
augcauccaaauag

SEQ ID NO: 1880080 - RNA, 14 nt, Homo sapiens
cauuccaucuuccc

SEQ ID NO: 1880081 - RNA, 14 nt, Homo sapiens
gaccccaugucucc

SEQ ID NO: 1880082 - RNA, 23 nt, Homo sapiens
uggaaauaaaguuauuacucuga

SEQ ID NO: 1880083 - RNA, 22 nt, Homo sapiens
uucccacucagcacucagagac

SEQ ID NO: 1880084 - RNA, 14 nt, Homo sapiens
cauuuaauauggau

SEQ ID NO: 1880085 - RNA, 14 nt, Homo sapiens
caagaacacaguga

SEQ ID NO: 1880086 - RNA, 16 nt, Homo sapiens
agacuggaaaagugau

SEQ ID NO: 1880087 - RNA, 14 nt, Homo sapiens
auaucuuacagcca

SEQ ID NO: 1880088 - RNA, 21 nt, Homo sapiens
gcaguaucagaggguggagau

SEQ ID NO: 1880089 - RNA, 20 nt, Homo sapiens
cuugcccucgccuguucccc

SEQ ID NO: 1880090 - RNA, 23 nt, Homo sapiens
ucccuacacagggccugcuauug

SEQ ID NO: 1880091 - RNA, 15 nt, Homo sapiens
ucagacacuacauga

SEQ ID NO: 1880092 - RNA, 14 nt, Homo sapiens
uccccacacuccac

SEQ ID NO: 1880093 - RNA, 21 nt, Homo sapiens
agcaguggacucaaaacccau

SEQ ID NO: 1880094 - RNA, 16 nt, Homo sapiens
aaaccuagcuaggcua

SEQ ID NO: 1880095 - RNA, 16 nt, Homo sapiens
aaaaaucguccaggga

SEQ ID NO: 1880096 - RNA, 17 nt, Homo sapiens
cuuaauaaugguuacuc

SEQ ID NO: 1880097 - RNA, 14 nt, Homo sapiens
cuccuaacaaaaga

SEQ ID NO: 1880098 - RNA, 21 nt, Homo sapiens
auaacuuuuuuuuaaguuaca

SEQ ID NO: 1880099 - RNA, 17 nt, Homo sapiens
aucacucuaauucggau

SEQ ID NO: 1880100 - RNA, 16 nt, Homo sapiens
aggcgcugaguggaac

SEQ ID NO: 1880101 - RNA, 21 nt, Homo sapiens
gcagccccuccccauggugca

SEQ ID NO: 1880102 - RNA, 19 nt, Homo sapiens
agaccaggagggcacugga

SEQ ID NO: 1880103 - RNA, 20 nt, Homo sapiens
gaagcugcuguucuuagcaa

SEQ ID NO: 1880104 - RNA, 14 nt, Homo sapiens
ccacaaccaaaaaa

SEQ ID NO: 1880105 - RNA, 19 nt, Homo sapiens
gcucugagccacaguggga

SEQ ID NO: 1880106 - RNA, 23 nt, Homo sapiens
acagcauuaacugucuuaaagag

SEQ ID NO: 1880107 - RNA, 21 nt, Homo sapiens
cauggccagguggccacucca

SEQ ID NO: 1880108 - RNA, 12 nt, Homo sapiens
augauacuugag

SEQ ID NO: 1880109 - RNA, 21 nt, Homo sapiens
ggugacacucuauaagauucc

SEQ ID NO: 1880110 - RNA, 19 nt, Homo sapiens
gcugcggccuaggggucca

SEQ ID NO: 1880111 - RNA, 23 nt, Homo sapiens
cugaguagcuggaacuacaagga

SEQ ID NO: 1880112 - RNA, 17 nt, Homo sapiens
caauuacuacuuuguua

SEQ ID NO: 1880113 - RNA, 22 nt, Homo sapiens
cuguuuacacucuuugccacug

SEQ ID NO: 1880114 - RNA, 13 nt, Homo sapiens
cuggcacacuccc

SEQ ID NO: 1880115 - RNA, 14 nt, Homo sapiens
ccuccucaagaagu

SEQ ID NO: 1880116 - RNA, 19 nt, Homo sapiens
uccugcaaaaguggaauca

SEQ ID NO: 1880117 - RNA, 17 nt, Homo sapiens
aauaugaagaccaaaug

SEQ ID NO: 1880118 - RNA, 14 nt, Homo sapiens
uuggugaauuucac

SEQ ID NO: 1880119 - RNA, 22 nt, Homo sapiens
ucccaagucagacagaugucag

SEQ ID NO: 1880120 - RNA, 22 nt, Homo sapiens
guuugguuuguuuauaauguua

SEQ ID NO: 1880121 - RNA, 22 nt, Homo sapiens
aaugacugccggucauuugaau

SEQ ID NO: 1880122 - RNA, 14 nt, Homo sapiens
uaggggcaaggaaa

SEQ ID NO: 1880123 - RNA, 21 nt, Homo sapiens
caggacacgacuuguaaugaa

SEQ ID NO: 1880124 - RNA, 19 nt, Homo sapiens
cccuuugaugauuaauuca

SEQ ID NO: 1880125 - RNA, 16 nt, Homo sapiens
aaaauaaaaacuauuc

SEQ ID NO: 1880126 - RNA, 18 nt, Homo sapiens
cuccacccagugauccca

SEQ ID NO: 1880127 - RNA, 17 nt, Homo sapiens
cugagguuuugaaagaa

SEQ ID NO: 1880128 - RNA, 22 nt, Homo sapiens
ccuugauauaaaaaaucuuuag

SEQ ID NO: 1880129 - RNA, 12 nt, Homo sapiens
guuaacaucuca

SEQ ID NO: 1880130 - RNA, 12 nt, Homo sapiens
cuccacauguuc

SEQ ID NO: 1880131 - RNA, 21 nt, Homo sapiens
agucugcucugcugcucugac

SEQ ID NO: 1880132 - RNA, 21 nt, Homo sapiens
ccauucaacccagcaaucuca

SEQ ID NO: 1880133 - RNA, 14 nt, Homo sapiens
caauacaaauggau

SEQ ID NO: 1880134 - RNA, 20 nt, Homo sapiens
auguaaagaaaaaagcacca

SEQ ID NO: 1880135 - RNA, 13 nt, Homo sapiens
ugcuggaaaaagc

SEQ ID NO: 1880136 - RNA, 23 nt, Homo sapiens
uguauauauuuauuauuuucaua

SEQ ID NO: 1880137 - RNA, 13 nt, Homo sapiens
guaccaagcauuu

SEQ ID NO: 1880138 - RNA, 19 nt, Homo sapiens
agcagucccaguauucuca

SEQ ID NO: 1880139 - RNA, 17 nt, Homo sapiens
aucacugguugcacuua

SEQ ID NO: 1880140 - RNA, 19 nt, Homo sapiens
aauguuauuauuaccagca

SEQ ID NO: 1880141 - RNA, 22 nt, Homo sapiens
ugcccuccagagauuugcucaa

SEQ ID NO: 1880142 - RNA, 17 nt, Homo sapiens
cucacaugauuccagcc

SEQ ID NO: 1880143 - RNA, 13 nt, Homo sapiens
cauuucacucugg

SEQ ID NO: 1880144 - RNA, 19 nt, Homo sapiens
cugggguccuccugugcua

SEQ ID NO: 1880145 - RNA, 15 nt, Homo sapiens
gguggagaagccauu

SEQ ID NO: 1880146 - RNA, 20 nt, Homo sapiens
ucuaccuuuugcuacuuauu

SEQ ID NO: 1880147 - RNA, 22 nt, Homo sapiens
ucccaggagcagcggggcagug

SEQ ID NO: 1880148 - RNA, 17 nt, Homo sapiens
uacagguuacaugagag

SEQ ID NO: 1880149 - RNA, 21 nt, Homo sapiens
acacguagacugauggaacag

SEQ ID NO: 1880150 - RNA, 19 nt, Homo sapiens
gaaacuaguguacauuucu

SEQ ID NO: 1880151 - RNA, 19 nt, Homo sapiens
agcagccuuacuauucaua

SEQ ID NO: 1880152 - RNA, 16 nt, Homo sapiens
augcgaggaccacuuu

SEQ ID NO: 1880153 - RNA, 18 nt, Homo sapiens
agccugcagaauccagcu

SEQ ID NO: 1880154 - RNA, 16 nt, Homo sapiens
cacuauccucacuccc

SEQ ID NO: 1880155 - RNA, 23 nt, Homo sapiens
aaauguggagaaacuguagucuc

SEQ ID NO: 1880156 - RNA, 18 nt, Homo sapiens
gaagagucccccaugaca

SEQ ID NO: 1880157 - RNA, 13 nt, Homo sapiens
ggaagugacauug

SEQ ID NO: 1880158 - RNA, 21 nt, Homo sapiens
ucacaggaaggacuucuucca

SEQ ID NO: 1880159 - RNA, 20 nt, Homo sapiens
uauaaagguggugggcaaaa

SEQ ID NO: 1880160 - RNA, 19 nt, Homo sapiens
uagaagccuaauugucaca

SEQ ID NO: 1880161 - RNA, 20 nt, Homo sapiens
cgccuugaaaacaagccucc

SEQ ID NO: 1880162 - RNA, 15 nt, Homo sapiens
cagccucuuggcaau

SEQ ID NO: 1880163 - RNA, 21 nt, Homo sapiens
gucucuauaccaaccaaacca

SEQ ID NO: 1880164 - RNA, 16 nt, Homo sapiens
gucacugauacacaga

SEQ ID NO: 1880165 - RNA, 14 nt, Homo sapiens
aaguugugccaaau

SEQ ID NO: 1880166 - RNA, 17 nt, Homo sapiens
gugauuccugcugccug

SEQ ID NO: 1880167 - RNA, 23 nt, Homo sapiens
cauuccauuuugugaauugugac

SEQ ID NO: 1880168 - RNA, 22 nt, Homo sapiens
aaugaucacaucuaaagcuuua

SEQ ID NO: 1880169 - RNA, 16 nt, Homo sapiens
agccagguaaugugaa

SEQ ID NO: 1880170 - RNA, 11 nt, Homo sapiens
aaaaugugcag

SEQ ID NO: 1880171 - RNA, 17 nt, Homo sapiens
gauuaggaaucauucug

SEQ ID NO: 1880172 - RNA, 20 nt, Homo sapiens
gcugggcuagaaagaccacu

SEQ ID NO: 1880173 - RNA, 16 nt, Homo sapiens
agagugaauuucagua

SEQ ID NO: 1880174 - RNA, 23 nt, Homo sapiens
caggagagugcagaucugugcuc

SEQ ID NO: 1880175 - RNA, 17 nt, Homo sapiens
uggaucugggcacaauc

SEQ ID NO: 1880176 - RNA, 17 nt, Homo sapiens
gugccccuuuccuucac

SEQ ID NO: 1880177 - RNA, 15 nt, Homo sapiens
ggccacgcagccagg

SEQ ID NO: 1880178 - RNA, 22 nt, Homo sapiens
gacacuggaucaaguucagcca

SEQ ID NO: 1880179 - RNA, 18 nt, Homo sapiens
auuaacucugcauagaca

SEQ ID NO: 1880180 - RNA, 20 nt, Homo sapiens
agaaaccccgggccauccca

SEQ ID NO: 1880181 - RNA, 16 nt, Homo sapiens
uggcagcauacacaga

SEQ ID NO: 1880182 - RNA, 22 nt, Homo sapiens
uuucacaccccauucucaaaaa

SEQ ID NO: 1880183 - RNA, 21 nt, Homo sapiens
agcuggcagacucgggaccaa

SEQ ID NO: 1880184 - RNA, 14 nt, Homo sapiens
auucuucaaccagu

SEQ ID NO: 1880185 - RNA, 20 nt, Homo sapiens
ucagcagaaacccccaggag

SEQ ID NO: 1880186 - RNA, 14 nt, Homo sapiens
ggccacacugggcu

SEQ ID NO: 1880187 - RNA, 20 nt, Homo sapiens
ucccuucucacagcacaugc

SEQ ID NO: 1880188 - RNA, 18 nt, Homo sapiens
cuagaaagccauauucca

SEQ ID NO: 1880189 - RNA, 17 nt, Homo sapiens
uaggauguguauuucau

SEQ ID NO: 1880190 - RNA, 23 nt, Homo sapiens
agguccugcuccgcugccuggaa

SEQ ID NO: 1880191 - RNA, 21 nt, Homo sapiens
uaaauuauuacauaugguuaa

SEQ ID NO: 1880192 - RNA, 21 nt, Homo sapiens
gaaccacucauaauucuucac

SEQ ID NO: 1880193 - RNA, 16 nt, Homo sapiens
cuagccaugcuuuaug

SEQ ID NO: 1880194 - RNA, 15 nt, Homo sapiens
ucagaauuguagcca

SEQ ID NO: 1880195 - RNA, 15 nt, Homo sapiens
ucaggguaagcugcu

SEQ ID NO: 1880196 - RNA, 13 nt, Homo sapiens
ugggagcacagcu

SEQ ID NO: 1880197 - RNA, 17 nt, Homo sapiens
uaggaaagagaagcuuu

SEQ ID NO: 1880198 - RNA, 23 nt, Homo sapiens
acagagcugguugggaagacaug

SEQ ID NO: 1880199 - RNA, 18 nt, Homo sapiens
agcuugcauagucaauau

SEQ ID NO: 1880200 - RNA, 23 nt, Homo sapiens
aucuggaagccaccucaccaagg

SEQ ID NO: 1880201 - RNA, 13 nt, Homo sapiens
uuuaaguaggaau

SEQ ID NO: 1880202 - RNA, 13 nt, Homo sapiens
ggaaaguauuuau

SEQ ID NO: 1880203 - RNA, 13 nt, Homo sapiens
gccucccacaaga

SEQ ID NO: 1880204 - RNA, 17 nt, Homo sapiens
gaaauaugccacugacc

SEQ ID NO: 1880205 - RNA, 14 nt, Homo sapiens
uuuuuaacagucag

SEQ ID NO: 1880206 - RNA, 19 nt, Homo sapiens
acccucccccaccauucca

SEQ ID NO: 1880207 - RNA, 16 nt, Homo sapiens
uuuguaauauggaaug

SEQ ID NO: 1880208 - RNA, 15 nt, Homo sapiens
aauguccuuuuauga

SEQ ID NO: 1880209 - RNA, 23 nt, Homo sapiens
ugcagugauguuugccauuugcu

SEQ ID NO: 1880210 - RNA, 16 nt, Homo sapiens
gugcacugacugugaa

SEQ ID NO: 1880211 - RNA, 22 nt, Homo sapiens
ugcaucuccccucagauuccac

SEQ ID NO: 1880212 - RNA, 16 nt, Homo sapiens
ggcucguguauuuauu

SEQ ID NO: 1880213 - RNA, 16 nt, Homo sapiens
ucucccuuguuuacuc

SEQ ID NO: 1880214 - RNA, 16 nt, Homo sapiens
agccggcuugauuucc

SEQ ID NO: 1880215 - RNA, 22 nt, Homo sapiens
agaauuauagaacuaaaguauc

SEQ ID NO: 1880216 - RNA, 15 nt, Homo sapiens
ucugggcaccaccuc

SEQ ID NO: 1880217 - RNA, 13 nt, Homo sapiens
ucuggauuugccu

SEQ ID NO: 1880218 - RNA, 14 nt, Homo sapiens
uuuaaaucugugau

SEQ ID NO: 1880219 - RNA, 23 nt, Homo sapiens
gugggaggcuccuguuagcuccu

SEQ ID NO: 1880220 - RNA, 15 nt, Homo sapiens
accuccccaacagca

SEQ ID NO: 1880221 - RNA, 16 nt, Homo sapiens
guuagaacuagccaaa

SEQ ID NO: 1880222 - RNA, 15 nt, Homo sapiens
caguugaauucagug

SEQ ID NO: 1880223 - RNA, 16 nt, Homo sapiens
cuaagguaaaaccauc

SEQ ID NO: 1880224 - RNA, 13 nt, Homo sapiens
agaacugcagaua

SEQ ID NO: 1880225 - RNA, 14 nt, Homo sapiens
gccugggugucaag

SEQ ID NO: 1880226 - RNA, 17 nt, Homo sapiens
gggcaagcuuugcuccu

SEQ ID NO: 1880227 - RNA, 21 nt, Homo sapiens
gggacagagccaugcugggaa

SEQ ID NO: 1880228 - RNA, 11 nt, Homo sapiens
cauaucugccu

SEQ ID NO: 1880229 - RNA, 13 nt, Homo sapiens
aggacgauuucac

SEQ ID NO: 1880230 - RNA, 19 nt, Homo sapiens
ucuccucccaaaauacuac

SEQ ID NO: 1880231 - RNA, 21 nt, Homo sapiens
agaggccucauccagggccca

SEQ ID NO: 1880232 - RNA, 16 nt, Homo sapiens
ggcaaguggagccacc

SEQ ID NO: 1880233 - RNA, 15 nt, Homo sapiens
guuguucacauauau

SEQ ID NO: 1880234 - RNA, 18 nt, Homo sapiens
cagugaggcggauugaga

SEQ ID NO: 1880235 - RNA, 19 nt, Homo sapiens
uauaaauuguacauuuugu

SEQ ID NO: 1880236 - RNA, 14 nt, Homo sapiens
aaaauauacaagua

SEQ ID NO: 1880237 - RNA, 14 nt, Homo sapiens
caaaaaaccacaaa

SEQ ID NO: 1880238 - RNA, 22 nt, Homo sapiens
aaucaaaucucuuccacauggg

SEQ ID NO: 1880239 - RNA, 12 nt, Homo sapiens
agcagucacuuu

SEQ ID NO: 1880240 - RNA, 23 nt, Homo sapiens
uuaauauaaaucguaaccuauga

SEQ ID NO: 1880241 - RNA, 22 nt, Homo sapiens
ccaaggugcugaugucaaagug

SEQ ID NO: 1880242 - RNA, 18 nt, Homo sapiens
aaacauugauugcuaaau

SEQ ID NO: 1880243 - RNA, 18 nt, Homo sapiens
uccacaguuuugccuuaa

SEQ ID NO: 1880244 - RNA, 13 nt, Homo sapiens
accaaacacccag

SEQ ID NO: 1880245 - RNA, 13 nt, Homo sapiens
cccagacaaccaa

SEQ ID NO: 1880246 - RNA, 14 nt, Homo sapiens
guagaguggugcug

SEQ ID NO: 1880247 - RNA, 15 nt, Homo sapiens
auauuccauacuuau

SEQ ID NO: 1880248 - RNA, 21 nt, Homo sapiens
ccagcugagucugaauucugc

SEQ ID NO: 1880249 - RNA, 21 nt, Homo sapiens
cuuuugagaguauagcaugaa

SEQ ID NO: 1880250 - RNA, 19 nt, Homo sapiens
agcuguucaacaucacuga

SEQ ID NO: 1880251 - RNA, 12 nt, Homo sapiens
gcuacaccuuuc

SEQ ID NO: 1880252 - RNA, 19 nt, Homo sapiens
aaaggcaugaaucuucccu

SEQ ID NO: 1880253 - RNA, 17 nt, Homo sapiens
caaggugagggaugcca

SEQ ID NO: 1880254 - RNA, 18 nt, Homo sapiens
cucccugguuuuacccca

SEQ ID NO: 1880255 - RNA, 15 nt, Homo sapiens
auaguagcaauggau

SEQ ID NO: 1880256 - RNA, 19 nt, Homo sapiens
uugaaagaacauggucugu

SEQ ID NO: 1880257 - RNA, 21 nt, Homo sapiens
guacucaguaacagugcagua

SEQ ID NO: 1880258 - RNA, 15 nt, Homo sapiens
aguaagaaaugcugc

SEQ ID NO: 1880259 - RNA, 13 nt, Homo sapiens
ucccuccauacag

SEQ ID NO: 1880260 - RNA, 13 nt, Homo sapiens
acucuccaaauag

SEQ ID NO: 1880261 - RNA, 14 nt, Homo sapiens
auaaucucaucccc

SEQ ID NO: 1880262 - RNA, 17 nt, Homo sapiens
ucccugcuuaaugaaaa

SEQ ID NO: 1880263 - RNA, 21 nt, Homo sapiens
ucccuuucagcugcugcuuaa

SEQ ID NO: 1880264 - RNA, 22 nt, Homo sapiens
aaugucccuuucagagacagcu

SEQ ID NO: 1880265 - RNA, 12 nt, Homo sapiens
gaaauaugcaac

SEQ ID NO: 1880266 - RNA, 20 nt, Homo sapiens
gcugccuggaacaccagcag

SEQ ID NO: 1880267 - RNA, 18 nt, Homo sapiens
uagccaccugucaccucu

SEQ ID NO: 1880268 - RNA, 14 nt, Homo sapiens
cuacugacuuuucc

SEQ ID NO: 1880269 - RNA, 11 nt, Homo sapiens
aguucuugcaa

SEQ ID NO: 1880270 - RNA, 15 nt, Homo sapiens
cccagcuacuuuaac

SEQ ID NO: 1880271 - RNA, 12 nt, Homo sapiens
ugggacugugag

SEQ ID NO: 1880272 - RNA, 12 nt, Homo sapiens
ugguacugugau

SEQ ID NO: 1880273 - RNA, 21 nt, Homo sapiens
uguugucauuguaaacaaacu

SEQ ID NO: 1880274 - RNA, 20 nt, Homo sapiens
cuguguguaaguccuaauaa

SEQ ID NO: 1880275 - RNA, 20 nt, Homo sapiens
cagggccaauggccugguga

SEQ ID NO: 1880276 - RNA, 19 nt, Homo sapiens
aaauuagcuugagcaaccu

SEQ ID NO: 1880277 - RNA, 17 nt, Homo sapiens
guuugugaacgcuguga

SEQ ID NO: 1880278 - RNA, 17 nt, Homo sapiens
gccauggggcagccucc

SEQ ID NO: 1880279 - RNA, 11 nt, Homo sapiens
gcacaucucug

SEQ ID NO: 1880280 - RNA, 10 nt, Homo sapiens
uuacuguugg

SEQ ID NO: 1880281 - RNA, 21 nt, Homo sapiens
accugaggcugguuucuuuca

SEQ ID NO: 1880282 - RNA, 22 nt, Homo sapiens
ggucagccauuuuuaaugaucu

SEQ ID NO: 1880283 - RNA, 14 nt, Homo sapiens
uuuccuucccaaua

SEQ ID NO: 1880284 - RNA, 18 nt, Homo sapiens
cuaaggaaacugcuuuau

SEQ ID NO: 1880285 - RNA, 18 nt, Homo sapiens
ucaccuuggcaccagaca

SEQ ID NO: 1880286 - RNA, 17 nt, Homo sapiens
uggaacuccuggccuuu

SEQ ID NO: 1880287 - RNA, 15 nt, Homo sapiens
ggaagccuccugucu

SEQ ID NO: 1880288 - RNA, 15 nt, Homo sapiens
uguaauggaucuuaa

SEQ ID NO: 1880289 - RNA, 18 nt, Homo sapiens
gccccagaagggggcauu

SEQ ID NO: 1880290 - RNA, 17 nt, Homo sapiens
uaaagcguccucucagu

SEQ ID NO: 1880291 - RNA, 20 nt, Homo sapiens
guagaagguaacucuuugca

SEQ ID NO: 1880292 - RNA, 14 nt, Homo sapiens
gaugaggaccuccu

SEQ ID NO: 1880293 - RNA, 20 nt, Homo sapiens
cagacgcacgugggucuuca

SEQ ID NO: 1880294 - RNA, 20 nt, Homo sapiens
ugggggaaagcaaagcacag

SEQ ID NO: 1880295 - RNA, 14 nt, Homo sapiens
uacuuugacagugu

SEQ ID NO: 1880296 - RNA, 15 nt, Homo sapiens
aguccaacaguagca

SEQ ID NO: 1880297 - RNA, 21 nt, Homo sapiens
gcuuagacuaaggccauuauu

SEQ ID NO: 1880298 - RNA, 21 nt, Homo sapiens
ucuucuucucaagcacugaca

SEQ ID NO: 1880299 - RNA, 17 nt, Homo sapiens
auuuguauuguuagcca

SEQ ID NO: 1880300 - RNA, 15 nt, Homo sapiens
cuagccucagggguc

SEQ ID NO: 1880301 - RNA, 22 nt, Homo sapiens
uugggacucaaggcuugaguca

SEQ ID NO: 1880302 - RNA, 23 nt, Homo sapiens
uguucucuuaugaucaccaugua

SEQ ID NO: 1880303 - RNA, 24 nt, Homo sapiens
cagagcaagagauaagucuuucau

SEQ ID NO: 1880304 - RNA, 14 nt, Homo sapiens
uaggagcaagguga

SEQ ID NO: 1880305 - RNA, 22 nt, Homo sapiens
uccuccagaaagcaccaaggaa

SEQ ID NO: 1880306 - RNA, 16 nt, Homo sapiens
ccagacacagacuggc

SEQ ID NO: 1880307 - RNA, 18 nt, Homo sapiens
gaacugagaccuccagaa

SEQ ID NO: 1880308 - RNA, 15 nt, Homo sapiens
caaaggcgcuuugaa

SEQ ID NO: 1880309 - RNA, 18 nt, Homo sapiens
uucaauagcuaagcaucu

SEQ ID NO: 1880310 - RNA, 21 nt, Homo sapiens
cugcagccagcucacguccag

SEQ ID NO: 1880311 - RNA, 23 nt, Homo sapiens
caacugcccaggaaggacugugc

SEQ ID NO: 1880312 - RNA, 20 nt, Homo sapiens
caguggcgcgaucucagcuc

SEQ ID NO: 1880313 - RNA, 21 nt, Homo sapiens
caagauggcgaccaccaaagu

SEQ ID NO: 1880314 - RNA, 20 nt, Homo sapiens
accuggcuugaagcugcuca

SEQ ID NO: 1880315 - RNA, 22 nt, Homo sapiens
ccuucucuaguuuccccucuca

SEQ ID NO: 1880316 - RNA, 19 nt, Homo sapiens
ggguccccacagcccgugc

SEQ ID NO: 1880317 - RNA, 13 nt, Homo sapiens
caagcacugcuca

SEQ ID NO: 1880318 - RNA, 16 nt, Homo sapiens
ucucugugugcacaaa

SEQ ID NO: 1880319 - RNA, 19 nt, Homo sapiens
uugaaauuuuauuuaguuc

SEQ ID NO: 1880320 - RNA, 21 nt, Homo sapiens
augacacccacccugugccau

SEQ ID NO: 1880321 - RNA, 21 nt, Homo sapiens
augccagccaagcucugcagu

SEQ ID NO: 1880322 - RNA, 19 nt, Homo sapiens
gaaccaaaagaauuugcac

SEQ ID NO: 1880323 - RNA, 18 nt, Homo sapiens
ccccuagagacagugaug

SEQ ID NO: 1880324 - RNA, 22 nt, Homo sapiens
gaaugaaauauaaacugugaga

SEQ ID NO: 1880325 - RNA, 22 nt, Homo sapiens
auuauaaauaaauagauguguc

SEQ ID NO: 1880326 - RNA, 15 nt, Homo sapiens
agaugccacuucuca

SEQ ID NO: 1880327 - RNA, 14 nt, Homo sapiens
uuaucuuuguucuc

SEQ ID NO: 1880328 - RNA, 20 nt, Homo sapiens
ccuuuaaagugaguacuguu

SEQ ID NO: 1880329 - RNA, 15 nt, Homo sapiens
ccacaccagcugcug

SEQ ID NO: 1880330 - RNA, 12 nt, Homo sapiens
auaacagaauua

SEQ ID NO: 1880331 - RNA, 15 nt, Homo sapiens
aaaagaaucauuugc

SEQ ID NO: 1880332 - RNA, 17 nt, Homo sapiens
cuguccacguacuuaau

SEQ ID NO: 1880333 - RNA, 13 nt, Homo sapiens
aguuugcacuaua

SEQ ID NO: 1880334 - RNA, 16 nt, Homo sapiens
ccagcuuggagugcca

SEQ ID NO: 1880335 - RNA, 19 nt, Homo sapiens
ucuuuuuccagguuccuga

SEQ ID NO: 1880336 - RNA, 23 nt, Homo sapiens
cuacucaggaaggugggagagag

SEQ ID NO: 1880337 - RNA, 19 nt, Homo sapiens
cacaugaccugaucacuag

SEQ ID NO: 1880338 - RNA, 14 nt, Homo sapiens
gauguuuccugggu

SEQ ID NO: 1880339 - RNA, 18 nt, Homo sapiens
augauaauuauguaaaga

SEQ ID NO: 1880340 - RNA, 19 nt, Homo sapiens
ccucgggccccauccucau

SEQ ID NO: 1880341 - RNA, 15 nt, Homo sapiens
caaaccuuacuaugg

SEQ ID NO: 1880342 - RNA, 13 nt, Homo sapiens
caaggcaguuaau

SEQ ID NO: 1880343 - RNA, 18 nt, Homo sapiens
uuaaccagucugaaguuu

SEQ ID NO: 1880344 - RNA, 17 nt, Homo sapiens
cuagucuacaguacuga

SEQ ID NO: 1880345 - RNA, 13 nt, Homo sapiens
gauguuaaccaau

SEQ ID NO: 1880346 - RNA, 16 nt, Homo sapiens
gacccuagccagagaa

SEQ ID NO: 1880347 - RNA, 18 nt, Homo sapiens
uucgaauaaagugaauac

SEQ ID NO: 1880348 - RNA, 19 nt, Homo sapiens
auuuguggaggacuuugaa

SEQ ID NO: 1880349 - RNA, 20 nt, Homo sapiens
gcuucuuccucacacugcug

SEQ ID NO: 1880350 - RNA, 23 nt, Homo sapiens
ccagucagaugguaguugagggu

SEQ ID NO: 1880351 - RNA, 15 nt, Homo sapiens
aaaauaaaaaaugug

SEQ ID NO: 1880352 - RNA, 15 nt, Homo sapiens
agguuugaaggagaa

SEQ ID NO: 1880353 - RNA, 20 nt, Homo sapiens
acugacacaagaauggucuu

SEQ ID NO: 1880354 - RNA, 19 nt, Homo sapiens
caaagaagcugucuuggaa

SEQ ID NO: 1880355 - RNA, 21 nt, Homo sapiens
agacgggaauucaugcaaaug

SEQ ID NO: 1880356 - RNA, 18 nt, Homo sapiens
ggucuucuuuuacuggac

SEQ ID NO: 1880357 - RNA, 23 nt, Homo sapiens
cugccaccacugggcaaacagaa

SEQ ID NO: 1880358 - RNA, 13 nt, Homo sapiens
gcaauacauuucu

SEQ ID NO: 1880359 - RNA, 20 nt, Homo sapiens
aggacgcugaccguggagcu

SEQ ID NO: 1880360 - RNA, 16 nt, Homo sapiens
auuccucuaagaucuu

SEQ ID NO: 1880361 - RNA, 13 nt, Homo sapiens
auuucaacugaag

SEQ ID NO: 1880362 - RNA, 13 nt, Homo sapiens
agaaauauaugca

SEQ ID NO: 1880363 - RNA, 15 nt, Homo sapiens
ccuacuaacauauaa

SEQ ID NO: 1880364 - RNA, 16 nt, Homo sapiens
ugagcugucaucaaca

SEQ ID NO: 1880365 - RNA, 21 nt, Homo sapiens
acucugcuuuuuuucuacugu

SEQ ID NO: 1880366 - RNA, 15 nt, Homo sapiens
gcccaggcaggccac

SEQ ID NO: 1880367 - RNA, 11 nt, Homo sapiens
ccaugcuauuu

SEQ ID NO: 1880368 - RNA, 22 nt, Homo sapiens
caggccucugggacccacagaa

SEQ ID NO: 1880369 - RNA, 18 nt, Homo sapiens
cugcuuuuuuucagggaa

SEQ ID NO: 1880370 - RNA, 14 nt, Homo sapiens
ggaugugugucuca

SEQ ID NO: 1880371 - RNA, 12 nt, Homo sapiens
gaucacauaaca

SEQ ID NO: 1880372 - RNA, 20 nt, Homo sapiens
auuacccccuccuccagauc

SEQ ID NO: 1880373 - RNA, 17 nt, Homo sapiens
uaacauuccauguuuca

SEQ ID NO: 1880374 - RNA, 17 nt, Homo sapiens
ucaaagcuccucucuug

SEQ ID NO: 1880375 - RNA, 12 nt, Homo sapiens
ugaagaaguagu

SEQ ID NO: 1880376 - RNA, 15 nt, Homo sapiens
cagugagcacugaaa

SEQ ID NO: 1880377 - RNA, 18 nt, Homo sapiens
ccuuauacaucacuuccu

SEQ ID NO: 1880378 - RNA, 22 nt, Homo sapiens
cgcaaugcuucuagaguuuuau

SEQ ID NO: 1880379 - RNA, 22 nt, Homo sapiens
uauuccauggcuaacuggcgag

SEQ ID NO: 1880380 - RNA, 12 nt, Homo sapiens
aauagggagaaa

SEQ ID NO: 1880381 - RNA, 15 nt, Homo sapiens
cuuugacaguguuuu

SEQ ID NO: 1880382 - RNA, 19 nt, Homo sapiens
aagcaguucaugucugaaa

SEQ ID NO: 1880383 - RNA, 19 nt, Homo sapiens
uugaagauaguaacuguag

SEQ ID NO: 1880384 - RNA, 19 nt, Homo sapiens
aagaaacuucggggcugca

SEQ ID NO: 1880385 - RNA, 21 nt, Homo sapiens
gaaaagcaaaccuuaauuuga

SEQ ID NO: 1880386 - RNA, 14 nt, Homo sapiens
aacaaauacauuca

SEQ ID NO: 1880387 - RNA, 22 nt, Homo sapiens
ucccaugggcgaccagggccau

SEQ ID NO: 1880388 - RNA, 15 nt, Homo sapiens
uaaccuuugcuguag

SEQ ID NO: 1880389 - RNA, 15 nt, Homo sapiens
uggacagcugagcac

SEQ ID NO: 1880390 - RNA, 21 nt, Homo sapiens
uccugucuuaugguccagaaa

SEQ ID NO: 1880391 - RNA, 22 nt, Homo sapiens
cucucaccgggcuacuaccugg

SEQ ID NO: 1880392 - RNA, 23 nt, Homo sapiens
guccccaaaacacugucugcaua

SEQ ID NO: 1880393 - RNA, 20 nt, Homo sapiens
uuugagccauuuaaagacca

SEQ ID NO: 1880394 - RNA, 20 nt, Homo sapiens
uaucuaauauauaugaauaa

SEQ ID NO: 1880395 - RNA, 20 nt, Homo sapiens
uugagauguuguguggcaau

SEQ ID NO: 1880396 - RNA, 19 nt, Homo sapiens
auguagcuaaacauuguga

SEQ ID NO: 1880397 - RNA, 16 nt, Homo sapiens
aauuaugcacuaaaua

SEQ ID NO: 1880398 - RNA, 14 nt, Homo sapiens
uacuaccacaagga

SEQ ID NO: 1880399 - RNA, 15 nt, Homo sapiens
ugucaaggcaguugc

SEQ ID NO: 1880400 - RNA, 16 nt, Homo sapiens
gcuagccacuggaaau

SEQ ID NO: 1880401 - RNA, 16 nt, Homo sapiens
uauaacugugcaaaua

SEQ ID NO: 1880402 - RNA, 15 nt, Homo sapiens
augcacuauauacau

SEQ ID NO: 1880403 - RNA, 19 nt, Homo sapiens
aaguucuuggauuacuuua

SEQ ID NO: 1880404 - RNA, 23 nt, Homo sapiens
cuacuuacaacccagggugugaa

SEQ ID NO: 1880405 - RNA, 22 nt, Homo sapiens
aaaguaaugccucugucuagca

SEQ ID NO: 1880406 - RNA, 18 nt, Homo sapiens
cuguaacaggguagugug

SEQ ID NO: 1880407 - RNA, 15 nt, Homo sapiens
uaacuuuuugcacua

SEQ ID NO: 1880408 - RNA, 23 nt, Homo sapiens
ggugcaucgaaauguauucaccu

SEQ ID NO: 1880409 - RNA, 20 nt, Homo sapiens
gcacacauuauuuggcuuaa

SEQ ID NO: 1880410 - RNA, 17 nt, Homo sapiens
uuuccuacuucauucca

SEQ ID NO: 1880411 - RNA, 21 nt, Homo sapiens
ccucguugggccgcucugauu

SEQ ID NO: 1880412 - RNA, 17 nt, Homo sapiens
uugaacuccugggcuca

SEQ ID NO: 1880413 - RNA, 22 nt, Homo sapiens
uagcauugaaguguuugcugca

SEQ ID NO: 1880414 - RNA, 16 nt, Homo sapiens
uaaugaaauacaucau

SEQ ID NO: 1880415 - RNA, 20 nt, Homo sapiens
agucugucgauuuaugccuc

SEQ ID NO: 1880416 - RNA, 17 nt, Homo sapiens
uguucaaacuacuguac

SEQ ID NO: 1880417 - RNA, 16 nt, Homo sapiens
uccacacccucuccca

SEQ ID NO: 1880418 - RNA, 21 nt, Homo sapiens
gaucacuggggggcucucagg

SEQ ID NO: 1880419 - RNA, 16 nt, Homo sapiens
uuucauacauuugacu

SEQ ID NO: 1880420 - RNA, 21 nt, Homo sapiens
agccucugaccccuccucacu

SEQ ID NO: 1880421 - RNA, 14 nt, Homo sapiens
ccccuuucacuuac

SEQ ID NO: 1880422 - RNA, 18 nt, Homo sapiens
cagcaaccucuucaugag

SEQ ID NO: 1880423 - RNA, 16 nt, Homo sapiens
cagugccucaugccug

SEQ ID NO: 1880424 - RNA, 21 nt, Homo sapiens
augccauggaaugacugaaga

SEQ ID NO: 1880425 - RNA, 23 nt, Homo sapiens
auggagugaccaaaaugccaaaa

SEQ ID NO: 1880426 - RNA, 15 nt, Homo sapiens
auacacagugcugac

SEQ ID NO: 1880427 - RNA, 21 nt, Homo sapiens
cugacacgugauggaccaaag

SEQ ID NO: 1880428 - RNA, 14 nt, Homo sapiens
uuuaccacagcagc

SEQ ID NO: 1880429 - RNA, 16 nt, Homo sapiens
cacuauuuucaaagaa

SEQ ID NO: 1880430 - RNA, 16 nt, Homo sapiens
augugacuuaaaguca

SEQ ID NO: 1880431 - RNA, 20 nt, Homo sapiens
cuugccucaaguuccaugcu

SEQ ID NO: 1880432 - RNA, 14 nt, Homo sapiens
gagacaacuuccca

SEQ ID NO: 1880433 - RNA, 12 nt, Homo sapiens
cggucuucacaa

SEQ ID NO: 1880434 - RNA, 18 nt, Homo sapiens
accauuugacuguucaau

SEQ ID NO: 1880435 - RNA, 22 nt, Homo sapiens
uuuauaauauucauacaacaaa

SEQ ID NO: 1880436 - RNA, 17 nt, Homo sapiens
aguuuugaguguauaca

SEQ ID NO: 1880437 - RNA, 22 nt, Homo sapiens
agaagcuagaaauuuagcaguc

SEQ ID NO: 1880438 - RNA, 17 nt, Homo sapiens
gcugcagugagccauca

SEQ ID NO: 1880439 - RNA, 20 nt, Homo sapiens
aacuuucucacugcugucag

SEQ ID NO: 1880440 - RNA, 20 nt, Homo sapiens
gcagcugccauugcagauuc

SEQ ID NO: 1880441 - RNA, 20 nt, Homo sapiens
gcuuuagaauguuuuccuuc

SEQ ID NO: 1880442 - RNA, 16 nt, Homo sapiens
acugugaccaucccaa

SEQ ID NO: 1880443 - RNA, 16 nt, Homo sapiens
acagcccagaaccaca

SEQ ID NO: 1880444 - RNA, 15 nt, Homo sapiens
auucagguaauacaa

SEQ ID NO: 1880445 - RNA, 15 nt, Homo sapiens
uuaaguguguguaua

SEQ ID NO: 1880446 - RNA, 22 nt, Homo sapiens
ccuuuugguuccucacauauua

SEQ ID NO: 1880447 - RNA, 20 nt, Homo sapiens
cuuugugagccuaugauauu

SEQ ID NO: 1880448 - RNA, 15 nt, Homo sapiens
guccugacuucaggg

SEQ ID NO: 1880449 - RNA, 20 nt, Homo sapiens
gugggagauguuagacucau

SEQ ID NO: 1880450 - RNA, 22 nt, Homo sapiens
ugauacccaaguuauugggaug

SEQ ID NO: 1880451 - RNA, 15 nt, Homo sapiens
uguucaaagugugac

SEQ ID NO: 1880452 - RNA, 20 nt, Homo sapiens
uugaacucuuagugauugag

SEQ ID NO: 1880453 - RNA, 21 nt, Homo sapiens
acccauugugauuguggaaga

SEQ ID NO: 1880454 - RNA, 16 nt, Homo sapiens
uguauacacauauaua

SEQ ID NO: 1880455 - RNA, 14 nt, Homo sapiens
gacaguaugcauac

SEQ ID NO: 1880456 - RNA, 12 nt, Homo sapiens
ugacaaaugcca

SEQ ID NO: 1880457 - RNA, 13 nt, Homo sapiens
guugaagcagaau

SEQ ID NO: 1880458 - RNA, 15 nt, Homo sapiens
cucucccaguccauu

SEQ ID NO: 1880459 - RNA, 18 nt, Homo sapiens
guacauuuugcuugcgug

SEQ ID NO: 1880460 - RNA, 20 nt, Homo sapiens
acuguuuucucucucuaugg

SEQ ID NO: 1880461 - RNA, 23 nt, Homo sapiens
cccagaaggcagagguugcagug

SEQ ID NO: 1880462 - RNA, 23 nt, Homo sapiens
uaaugugcaaauuuugcauuuag

SEQ ID NO: 1880463 - RNA, 14 nt, Homo sapiens
ggaacucacuuucc

SEQ ID NO: 1880464 - RNA, 18 nt, Homo sapiens
caggccggccagccucac

SEQ ID NO: 1880465 - RNA, 21 nt, Homo sapiens
cuuucugauacaucugucagu

SEQ ID NO: 1880466 - RNA, 15 nt, Homo sapiens
guuaggcagugcagu

SEQ ID NO: 1880467 - RNA, 14 nt, Homo sapiens
cuauucuuugacca

SEQ ID NO: 1880468 - RNA, 21 nt, Homo sapiens
gccccgcaggguccaaaggcc

SEQ ID NO: 1880469 - RNA, 14 nt, Homo sapiens
cuuuauagcucuca

SEQ ID NO: 1880470 - RNA, 22 nt, Homo sapiens
auggaagguucucugugcuccu

SEQ ID NO: 1880471 - RNA, 14 nt, Homo sapiens
uaucuugugcuucu

SEQ ID NO: 1880472 - RNA, 16 nt, Homo sapiens
uacaaguaauuuugca

SEQ ID NO: 1880473 - RNA, 17 nt, Homo sapiens
aauauuauguuccucaa

SEQ ID NO: 1880474 - RNA, 20 nt, Homo sapiens
auguuaagggcuuuaauaca

SEQ ID NO: 1880475 - RNA, 17 nt, Homo sapiens
guuuugaaaagaacaaa

SEQ ID NO: 1880476 - RNA, 13 nt, Homo sapiens
acccacaaggcca

SEQ ID NO: 1880477 - RNA, 17 nt, Homo sapiens
acgguuuaauucugucu

SEQ ID NO: 1880478 - RNA, 13 nt, Homo sapiens
cccuuugugaaag

SEQ ID NO: 1880479 - RNA, 17 nt, Homo sapiens
ugagcugagaccacuga

SEQ ID NO: 1880480 - RNA, 17 nt, Homo sapiens
aguuggaccagaggaag

SEQ ID NO: 1880481 - RNA, 22 nt, Homo sapiens
ucuugauguuuagaaaaguauu

SEQ ID NO: 1880482 - RNA, 19 nt, Homo sapiens
ggcaggcccugcccagcca

SEQ ID NO: 1880483 - RNA, 16 nt, Homo sapiens
cauuauuccuccagga

SEQ ID NO: 1880484 - RNA, 19 nt, Homo sapiens
cuugaucuccugaccucau

SEQ ID NO: 1880485 - RNA, 19 nt, Homo sapiens
agacccugaugcaggucag

SEQ ID NO: 1880486 - RNA, 21 nt, Homo sapiens
uauaacuaguccuuuacuaau

SEQ ID NO: 1880487 - RNA, 19 nt, Homo sapiens
ccuccagagaccccaggaa

SEQ ID NO: 1880488 - RNA, 14 nt, Homo sapiens
cauuuaucaccucu

SEQ ID NO: 1880489 - RNA, 13 nt, Homo sapiens
ggauuuguugcca

SEQ ID NO: 1880490 - RNA, 15 nt, Homo sapiens
caaaucccuuucaug

SEQ ID NO: 1880491 - RNA, 14 nt, Homo sapiens
auaaagccaaauuu

SEQ ID NO: 1880492 - RNA, 18 nt, Homo sapiens
uggaaacagcaugaauaa

SEQ ID NO: 1880493 - RNA, 22 nt, Homo sapiens
aaaguggcauuucuuuaugaaa

SEQ ID NO: 1880494 - RNA, 17 nt, Homo sapiens
augccaagaaaguauuu

SEQ ID NO: 1880495 - RNA, 16 nt, Homo sapiens
gcaggugccuguaauc

SEQ ID NO: 1880496 - RNA, 13 nt, Homo sapiens
cugauaauuccag

SEQ ID NO: 1880497 - RNA, 15 nt, Homo sapiens
cccagcgagcucuca

SEQ ID NO: 1880498 - RNA, 22 nt, Homo sapiens
agauguaagaaauguucuugca

SEQ ID NO: 1880499 - RNA, 17 nt, Homo sapiens
ugaaacagggcacccca

SEQ ID NO: 1880500 - RNA, 17 nt, Homo sapiens
caggggugcugggaccu

SEQ ID NO: 1880501 - RNA, 20 nt, Homo sapiens
ugggauuacaggcacaugca

SEQ ID NO: 1880502 - RNA, 18 nt, Homo sapiens
acugccccacuucuggca

SEQ ID NO: 1880503 - RNA, 21 nt, Homo sapiens
gcacuuucauccucaagcuca

SEQ ID NO: 1880504 - RNA, 13 nt, Homo sapiens
cauugccuguaac

SEQ ID NO: 1880505 - RNA, 19 nt, Homo sapiens
ccugcccaggacugcauug

SEQ ID NO: 1880506 - RNA, 23 nt, Homo sapiens
gccagcugggcuuggaaggaaaa

SEQ ID NO: 1880507 - RNA, 19 nt, Homo sapiens
cccaaggcugcaaagcaaa

SEQ ID NO: 1880508 - RNA, 15 nt, Homo sapiens
gacccugcaagacca

SEQ ID NO: 1880509 - RNA, 12 nt, Homo sapiens
acauucagaaaa

SEQ ID NO: 1880510 - RNA, 20 nt, Homo sapiens
cuggcagagauucugguaca

SEQ ID NO: 1880511 - RNA, 13 nt, Homo sapiens
acccagagcugcc

SEQ ID NO: 1880512 - RNA, 13 nt, Homo sapiens
augugugauucac

SEQ ID NO: 1880513 - RNA, 16 nt, Homo sapiens
cccagcucuggaugaa

SEQ ID NO: 1880514 - RNA, 14 nt, Homo sapiens
cuuucccaguccca

SEQ ID NO: 1880515 - RNA, 18 nt, Homo sapiens
aagcauuaauacauuuca

SEQ ID NO: 1880516 - RNA, 18 nt, Homo sapiens
cuuaccuaccacaugcca

SEQ ID NO: 1880517 - RNA, 22 nt, Homo sapiens
uuacuguaaaggcaagccagca

SEQ ID NO: 1880518 - RNA, 20 nt, Homo sapiens
ugccuuucugguggcuuuuu

SEQ ID NO: 1880519 - RNA, 16 nt, Homo sapiens
guuuuuugaaccucca

SEQ ID NO: 1880520 - RNA, 23 nt, Homo sapiens
acccuuucauaaagucuugccuu

SEQ ID NO: 1880521 - RNA, 20 nt, Homo sapiens
uucuaagucacaggaugaga

SEQ ID NO: 1880522 - RNA, 21 nt, Homo sapiens
gaugaggaucucuuuuugccc

SEQ ID NO: 1880523 - RNA, 18 nt, Homo sapiens
ucgucccguucuccauuc

SEQ ID NO: 1880524 - RNA, 17 nt, Homo sapiens
uggcccuuacacacuca

SEQ ID NO: 1880525 - RNA, 21 nt, Homo sapiens
gaaguuuucuguagucauuua

SEQ ID NO: 1880526 - RNA, 19 nt, Homo sapiens
augcucaguauugagacac

SEQ ID NO: 1880527 - RNA, 14 nt, Homo sapiens
uguucccucuggcu

SEQ ID NO: 1880528 - RNA, 15 nt, Homo sapiens
uccaagcuauguauu

SEQ ID NO: 1880529 - RNA, 15 nt, Homo sapiens
aggaaaaggcuugag

SEQ ID NO: 1880530 - RNA, 22 nt, Homo sapiens
ccacaauuagagcuugaugccu

SEQ ID NO: 1880531 - RNA, 16 nt, Homo sapiens
ccuggcccaggugccc

SEQ ID NO: 1880532 - RNA, 22 nt, Homo sapiens
acacacuaacaaaagcaugaaa

SEQ ID NO: 1880533 - RNA, 11 nt, Homo sapiens
augguguuaca

SEQ ID NO: 1880534 - RNA, 12 nt, Homo sapiens
gagauugcacag

SEQ ID NO: 1880535 - RNA, 22 nt, Homo sapiens
gagaugaccccaucaaccccag

SEQ ID NO: 1880536 - RNA, 13 nt, Homo sapiens
aaagaucacacau

SEQ ID NO: 1880537 - RNA, 12 nt, Homo sapiens
uuagcuucagga

SEQ ID NO: 1880538 - RNA, 17 nt, Homo sapiens
accagcacggugacucu

SEQ ID NO: 1880539 - RNA, 15 nt, Homo sapiens
acacuuuccaucucu

SEQ ID NO: 1880540 - RNA, 13 nt, Homo sapiens
guggcacucugug

SEQ ID NO: 1880541 - RNA, 23 nt, Homo sapiens
uucuaaauaaggaauuuccuccc

SEQ ID NO: 1880542 - RNA, 20 nt, Homo sapiens
gacaucugcuucaccaagga

SEQ ID NO: 1880543 - RNA, 18 nt, Homo sapiens
cagugacuccacucugag

SEQ ID NO: 1880544 - RNA, 15 nt, Homo sapiens
uacauauuugcacug

SEQ ID NO: 1880545 - RNA, 15 nt, Homo sapiens
ugacaggcaccagau

SEQ ID NO: 1880546 - RNA, 22 nt, Homo sapiens
uaauacugguuauccugugcua

SEQ ID NO: 1880547 - RNA, 18 nt, Homo sapiens
auugaaauguuugcauaa

SEQ ID NO: 1880548 - RNA, 23 nt, Homo sapiens
gaaagcaucauuauuugcagaga

SEQ ID NO: 1880549 - RNA, 20 nt, Homo sapiens
gagagauguauggucuugcc

SEQ ID NO: 1880550 - RNA, 22 nt, Homo sapiens
gcuauuuugagaacuccagcug

SEQ ID NO: 1880551 - RNA, 13 nt, Homo sapiens
cagaugcacacac

SEQ ID NO: 1880552 - RNA, 18 nt, Homo sapiens
ucaaaccuccaaaagccc

SEQ ID NO: 1880553 - RNA, 18 nt, Homo sapiens
aaagaaugaugcuaugaa

SEQ ID NO: 1880554 - RNA, 24 nt, Homo sapiens
caacacugcgccggguaccaugga

SEQ ID NO: 1880555 - RNA, 22 nt, Homo sapiens
uuauuaaguaacuuauuuauga

SEQ ID NO: 1880556 - RNA, 12 nt, Homo sapiens
guuaaagcaaag

SEQ ID NO: 1880557 - RNA, 11 nt, Homo sapiens
uuuuaccacaa

SEQ ID NO: 1880558 - RNA, 23 nt, Homo sapiens
uagaacaggguuucucagccuua

SEQ ID NO: 1880559 - RNA, 15 nt, Homo sapiens
auaaucaucaaguaa

SEQ ID NO: 1880560 - RNA, 19 nt, Homo sapiens
uuauaaagaggucacauag

SEQ ID NO: 1880561 - RNA, 12 nt, Homo sapiens
cacaaacuccau

SEQ ID NO: 1880562 - RNA, 16 nt, Homo sapiens
aauaaaggcaccuccc

SEQ ID NO: 1880563 - RNA, 15 nt, Homo sapiens
auuuuauucacauau

SEQ ID NO: 1880564 - RNA, 14 nt, Homo sapiens
augggccagcccuu

SEQ ID NO: 1880565 - RNA, 14 nt, Homo sapiens
uuuauuuccagugg

SEQ ID NO: 1880566 - RNA, 15 nt, Homo sapiens
cuugauaauacuuga

SEQ ID NO: 1880567 - RNA, 16 nt, Homo sapiens
auuugauaaacauucc

SEQ ID NO: 1880568 - RNA, 23 nt, Homo sapiens
augcucaguuggugcugcuuucu

SEQ ID NO: 1880569 - RNA, 18 nt, Homo sapiens
ugcugaacaucacagcuu

SEQ ID NO: 1880570 - RNA, 20 nt, Homo sapiens
gucauauauuacuagcauau

SEQ ID NO: 1880571 - RNA, 22 nt, Homo sapiens
accuguauugucugacuucuca

SEQ ID NO: 1880572 - RNA, 16 nt, Homo sapiens
ugccuguuaauuuaua

SEQ ID NO: 1880573 - RNA, 23 nt, Homo sapiens
gccccugucccaccccuaccucu

SEQ ID NO: 1880574 - RNA, 16 nt, Homo sapiens
ucuaauaauaagucag

SEQ ID NO: 1880575 - RNA, 22 nt, Homo sapiens
gaacucuuccuggaaugcauuc

SEQ ID NO: 1880576 - RNA, 18 nt, Homo sapiens
gcagcugacuaaaggcca

SEQ ID NO: 1880577 - RNA, 21 nt, Homo sapiens
uuauaagaagagaaccagcca

SEQ ID NO: 1880578 - RNA, 14 nt, Homo sapiens
aaaaugacccaaga

SEQ ID NO: 1880579 - RNA, 15 nt, Homo sapiens
ugugcacaugaaucc

SEQ ID NO: 1880580 - RNA, 20 nt, Homo sapiens
aaccucaagggcuuucccac

SEQ ID NO: 1880581 - RNA, 14 nt, Homo sapiens
cuucuccugaaauc

SEQ ID NO: 1880582 - RNA, 21 nt, Homo sapiens
accugccagccgguucugcua

SEQ ID NO: 1880583 - RNA, 15 nt, Homo sapiens
ccuguccugccugug

SEQ ID NO: 1880584 - RNA, 21 nt, Homo sapiens
uaauaacugugaaguuuacau

SEQ ID NO: 1880585 - RNA, 15 nt, Homo sapiens
ggcccucugccucau

SEQ ID NO: 1880586 - RNA, 15 nt, Homo sapiens
uccuuauuugccuuc

SEQ ID NO: 1880587 - RNA, 14 nt, Homo sapiens
gaaaaaauuacuca

SEQ ID NO: 1880588 - RNA, 22 nt, Homo sapiens
ucaguacugacuuucugauuac

SEQ ID NO: 1880589 - RNA, 21 nt, Homo sapiens
uucaaugugacaccuaacucu

SEQ ID NO: 1880590 - RNA, 23 nt, Homo sapiens
ucccucucugcaccugucucaua

SEQ ID NO: 1880591 - RNA, 20 nt, Homo sapiens
ccgcaggcagacuacacagg

SEQ ID NO: 1880592 - RNA, 20 nt, Homo sapiens
aucauggaaauguauuuuag

SEQ ID NO: 1880593 - RNA, 14 nt, Homo sapiens
ucacccuaccugug

SEQ ID NO: 1880594 - RNA, 20 nt, Homo sapiens
auaggaagauuaaaaccaca

SEQ ID NO: 1880595 - RNA, 22 nt, Homo sapiens
aguuaaaagccuaccuaagcau

SEQ ID NO: 1880596 - RNA, 13 nt, Homo sapiens
agagagcugccau

SEQ ID NO: 1880597 - RNA, 17 nt, Homo sapiens
acaugcauugagcucuc

SEQ ID NO: 1880598 - RNA, 18 nt, Homo sapiens
cuuuucaccaaugagccu

SEQ ID NO: 1880599 - RNA, 13 nt, Homo sapiens
uagaguaacacau

SEQ ID NO: 1880600 - RNA, 21 nt, Homo sapiens
cuaccuccccaagacuuuacu

SEQ ID NO: 1880601 - RNA, 15 nt, Homo sapiens
gagcauuacgugagc

SEQ ID NO: 1880602 - RNA, 17 nt, Homo sapiens
agacaaucacugaaaca

SEQ ID NO: 1880603 - RNA, 16 nt, Homo sapiens
ucugcucuaugccagg

SEQ ID NO: 1880604 - RNA, 16 nt, Homo sapiens
cauagcuggacuugau

SEQ ID NO: 1880605 - RNA, 17 nt, Homo sapiens
augggggcagcaccucc

SEQ ID NO: 1880606 - RNA, 19 nt, Homo sapiens
gcccagccccuacugcugu

SEQ ID NO: 1880607 - RNA, 17 nt, Homo sapiens
acagaagucuugucuca

SEQ ID NO: 1880608 - RNA, 15 nt, Homo sapiens
uccagucacagccau

SEQ ID NO: 1880609 - RNA, 17 nt, Homo sapiens
uaauuuauuauacaccu

SEQ ID NO: 1880610 - RNA, 17 nt, Homo sapiens
cagaauguugcuuucug

SEQ ID NO: 1880611 - RNA, 20 nt, Homo sapiens
uagguuuacauucaucucau

SEQ ID NO: 1880612 - RNA, 13 nt, Homo sapiens
ugccugcuggaaa

SEQ ID NO: 1880613 - RNA, 21 nt, Homo sapiens
cuccaaaccagacggugacgc

SEQ ID NO: 1880614 - RNA, 15 nt, Homo sapiens
uugguacacaugugu

SEQ ID NO: 1880615 - RNA, 16 nt, Homo sapiens
gaagagcuccuugaua

SEQ ID NO: 1880616 - RNA, 16 nt, Homo sapiens
cccucucauucucacu

SEQ ID NO: 1880617 - RNA, 15 nt, Homo sapiens
aauuuuugcaauaau

SEQ ID NO: 1880618 - RNA, 21 nt, Homo sapiens
gcccuccagagauuugcucaa

SEQ ID NO: 1880619 - RNA, 17 nt, Homo sapiens
aagcccacucacccuuu

SEQ ID NO: 1880620 - RNA, 20 nt, Homo sapiens
caauaaauuggaacaccucc

SEQ ID NO: 1880621 - RNA, 18 nt, Homo sapiens
aaagcccaaccuccugac

SEQ ID NO: 1880622 - RNA, 15 nt, Homo sapiens
caaaugauucagcuc

SEQ ID NO: 1880623 - RNA, 21 nt, Homo sapiens
cuguugauuaucuucagccca

SEQ ID NO: 1880624 - RNA, 19 nt, Homo sapiens
uuguauaaucccacccacc

SEQ ID NO: 1880625 - RNA, 19 nt, Homo sapiens
gaaacuccaucucuacuga

SEQ ID NO: 1880626 - RNA, 19 nt, Homo sapiens
aucgcagcuucagcaucuc

SEQ ID NO: 1880627 - RNA, 21 nt, Homo sapiens
auaaaucaauucauuguguau

SEQ ID NO: 1880628 - RNA, 18 nt, Homo sapiens
ugggagucugaggccuga

SEQ ID NO: 1880629 - RNA, 17 nt, Homo sapiens
accuaaaagagauuuca

SEQ ID NO: 1880630 - RNA, 15 nt, Homo sapiens
aaacagaagugcauc

SEQ ID NO: 1880631 - RNA, 15 nt, Homo sapiens
ccauucccguggucu

SEQ ID NO: 1880632 - RNA, 20 nt, Homo sapiens
aggcaaccgugguuacugua

SEQ ID NO: 1880633 - RNA, 15 nt, Homo sapiens
aggcaguaaugccuu

SEQ ID NO: 1880634 - RNA, 15 nt, Homo sapiens
auguacagacauaca

SEQ ID NO: 1880635 - RNA, 15 nt, Homo sapiens
uguacaguaucagaa

SEQ ID NO: 1880636 - RNA, 17 nt, Homo sapiens
cuuucuccagaucagac

SEQ ID NO: 1880637 - RNA, 24 nt, Homo sapiens
agaccagccugaccaacaugguga

SEQ ID NO: 1880638 - RNA, 22 nt, Homo sapiens
gagacagugacuggugccagug

SEQ ID NO: 1880639 - RNA, 15 nt, Homo sapiens
cuguauugucuauua

SEQ ID NO: 1880640 - RNA, 22 nt, Homo sapiens
gugggugccuuccauacuguuu

SEQ ID NO: 1880641 - RNA, 14 nt, Homo sapiens
ucauaaaguugacu

SEQ ID NO: 1880642 - RNA, 20 nt, Homo sapiens
auacagugacaauacaaaua

SEQ ID NO: 1880643 - RNA, 15 nt, Homo sapiens
ugugacuugcaauaa

SEQ ID NO: 1880644 - RNA, 11 nt, Homo sapiens
uguguccaaaa

SEQ ID NO: 1880645 - RNA, 16 nt, Homo sapiens
agcuauacucaugguc

SEQ ID NO: 1880646 - RNA, 16 nt, Homo sapiens
ugagaaucagacugac

SEQ ID NO: 1880647 - RNA, 17 nt, Homo sapiens
cauggaauaguuuugua

SEQ ID NO: 1880648 - RNA, 17 nt, Homo sapiens
ugaauauugccauuaug

SEQ ID NO: 1880649 - RNA, 17 nt, Homo sapiens
cccuuaaaacuuccacu

SEQ ID NO: 1880650 - RNA, 15 nt, Homo sapiens
gaaagaggcagggac

SEQ ID NO: 1880651 - RNA, 15 nt, Homo sapiens
cgaggcgggggagcc

SEQ ID NO: 1880652 - RNA, 21 nt, Homo sapiens
cuacuuuauuuugaaacauuu

SEQ ID NO: 1880653 - RNA, 21 nt, Homo sapiens
uaaagaacgcugcagcuuuuu

SEQ ID NO: 1880654 - RNA, 14 nt, Homo sapiens
auguagcuuccaaa

SEQ ID NO: 1880655 - RNA, 20 nt, Homo sapiens
cuggucgccaauccaugcuc

SEQ ID NO: 1880656 - RNA, 16 nt, Homo sapiens
aucuguaacacuauua

SEQ ID NO: 1880657 - RNA, 20 nt, Homo sapiens
caaauaauauuuuagauuac

SEQ ID NO: 1880658 - RNA, 23 nt, Homo sapiens
aaccuaguacugccccccaugag

SEQ ID NO: 1880659 - RNA, 22 nt, Homo sapiens
cuugaacugauucacaucucau

SEQ ID NO: 1880660 - RNA, 18 nt, Homo sapiens
acuaucaaaauugccuuu

SEQ ID NO: 1880661 - RNA, 19 nt, Homo sapiens
cuggcuuuucuuucuacca

SEQ ID NO: 1880662 - RNA, 15 nt, Homo sapiens
gacaguccaguguca

SEQ ID NO: 1880663 - RNA, 19 nt, Homo sapiens
uguuuuuaauaaagacagg

SEQ ID NO: 1880664 - RNA, 16 nt, Homo sapiens
ucuuccaaauccaaaa

SEQ ID NO: 1880665 - RNA, 15 nt, Homo sapiens
ucuguggaaugauuc

SEQ ID NO: 1880666 - RNA, 21 nt, Homo sapiens
ccgccauggugcuggggagcc

SEQ ID NO: 1880667 - RNA, 16 nt, Homo sapiens
aagccauugagcucuc

SEQ ID NO: 1880668 - RNA, 17 nt, Homo sapiens
ucaggagggugcaguau

SEQ ID NO: 1880669 - RNA, 14 nt, Homo sapiens
ugcacacacauaua

SEQ ID NO: 1880670 - RNA, 19 nt, Homo sapiens
ucaagagaguaaacagaca

SEQ ID NO: 1880671 - RNA, 16 nt, Homo sapiens
gaaaguaaaucugaga

SEQ ID NO: 1880672 - RNA, 15 nt, Homo sapiens
uaccuuauugaucuu

SEQ ID NO: 1880673 - RNA, 14 nt, Homo sapiens
uugcaaucuauaau

SEQ ID NO: 1880674 - RNA, 23 nt, Homo sapiens
uagauaaaagaaccgagcaauuu

SEQ ID NO: 1880675 - RNA, 20 nt, Homo sapiens
acacaaaucccuauguugcu

SEQ ID NO: 1880676 - RNA, 20 nt, Homo sapiens
aaauuuuacacaguucauca

SEQ ID NO: 1880677 - RNA, 18 nt, Homo sapiens
auguugguuuuaauacuu

SEQ ID NO: 1880678 - RNA, 14 nt, Homo sapiens
gcagccugacccca

SEQ ID NO: 1880679 - RNA, 20 nt, Homo sapiens
aacaauccccaucagguagc

SEQ ID NO: 1880680 - RNA, 17 nt, Homo sapiens
gcacacucaugugcaaa

SEQ ID NO: 1880681 - RNA, 19 nt, Homo sapiens
guuugugucaaaacugguu

SEQ ID NO: 1880682 - RNA, 15 nt, Homo sapiens
cuugcuuguaaaaau

SEQ ID NO: 1880683 - RNA, 10 nt, Homo sapiens
ugcaccaaau

SEQ ID NO: 1880684 - RNA, 10 nt, Homo sapiens
uucaccaaag

SEQ ID NO: 1880685 - RNA, 20 nt, Homo sapiens
gucacuggaaagagugccag

SEQ ID NO: 1880686 - RNA, 16 nt, Homo sapiens
agaucagcaguggcag

SEQ ID NO: 1880687 - RNA, 15 nt, Homo sapiens
aucaaugucaaguac

SEQ ID NO: 1880688 - RNA, 20 nt, Homo sapiens
uguccucagggcuacagcag

SEQ ID NO: 1880689 - RNA, 21 nt, Homo sapiens
guggaucucccccucauccaa

SEQ ID NO: 1880690 - RNA, 20 nt, Homo sapiens
uucaagcgauucucuugccu

SEQ ID NO: 1880691 - RNA, 18 nt, Homo sapiens
ccccugcagcuggaaugu

SEQ ID NO: 1880692 - RNA, 17 nt, Homo sapiens
agugggaggacagagcc

SEQ ID NO: 1880693 - RNA, 14 nt, Homo sapiens
ccugcugcuugccc

SEQ ID NO: 1880694 - RNA, 20 nt, Homo sapiens
auuacacuaaagugcauuau

SEQ ID NO: 1880695 - RNA, 15 nt, Homo sapiens
uacauacaaauucua

SEQ ID NO: 1880696 - RNA, 15 nt, Homo sapiens
cugaaaaacuuaccu

SEQ ID NO: 1880697 - RNA, 22 nt, Homo sapiens
uuucuccuuuugaccaaauaaa

SEQ ID NO: 1880698 - RNA, 20 nt, Homo sapiens
aggagcuugggugugcugac

SEQ ID NO: 1880699 - RNA, 15 nt, Homo sapiens
gcucuuuacauuucu

SEQ ID NO: 1880700 - RNA, 17 nt, Homo sapiens
gaaauuaaagucuucca

SEQ ID NO: 1880701 - RNA, 18 nt, Homo sapiens
aagaaaaaaaguugcaau

SEQ ID NO: 1880702 - RNA, 11 nt, Homo sapiens
gcaggcauuuc

SEQ ID NO: 1880703 - RNA, 15 nt, Homo sapiens
aaugagaccuggaac

SEQ ID NO: 1880704 - RNA, 15 nt, Homo sapiens
aaagaauuccaaagc

SEQ ID NO: 1880705 - RNA, 23 nt, Homo sapiens
acuaauguuggacagacacuguu

SEQ ID NO: 1880706 - RNA, 18 nt, Homo sapiens
uggacaggcuucgucuca

SEQ ID NO: 1880707 - RNA, 21 nt, Homo sapiens
acccauagugcacacuuguau

SEQ ID NO: 1880708 - RNA, 16 nt, Homo sapiens
gcugggagggggcccu

SEQ ID NO: 1880709 - RNA, 21 nt, Homo sapiens
aauuguugacaguucugaaga

SEQ ID NO: 1880710 - RNA, 21 nt, Homo sapiens
gaucuacuucauagcuccuug

SEQ ID NO: 1880711 - RNA, 23 nt, Homo sapiens
gaacaaacaaggcauucauggga

SEQ ID NO: 1880712 - RNA, 17 nt, Homo sapiens
gucaguggggcucucug

SEQ ID NO: 1880713 - RNA, 15 nt, Homo sapiens
aagaaacuaguaaga

SEQ ID NO: 1880714 - RNA, 15 nt, Homo sapiens
agaguauuccucaaa

SEQ ID NO: 1880715 - RNA, 13 nt, Homo sapiens
cugaggucccugu

SEQ ID NO: 1880716 - RNA, 22 nt, Homo sapiens
acagggcuggaaagaggcugcu

SEQ ID NO: 1880717 - RNA, 14 nt, Homo sapiens
ugcuauuugcaaac

SEQ ID NO: 1880718 - RNA, 14 nt, Homo sapiens
gcauccuuugcacu

SEQ ID NO: 1880719 - RNA, 21 nt, Homo sapiens
ggcuucaugcaauccuuccaa

SEQ ID NO: 1880720 - RNA, 19 nt, Homo sapiens
guauugacuguaccacaga

SEQ ID NO: 1880721 - RNA, 21 nt, Homo sapiens
gaaauuguuuugcaaauggau

SEQ ID NO: 1880722 - RNA, 14 nt, Homo sapiens
aauucuagccaaaa

SEQ ID NO: 1880723 - RNA, 19 nt, Homo sapiens
aaugcccagacaaaaagcu

SEQ ID NO: 1880724 - RNA, 19 nt, Homo sapiens
agauccucaagcagaccua

SEQ ID NO: 1880725 - RNA, 20 nt, Homo sapiens
acucccauuaaaaacaaaac

SEQ ID NO: 1880726 - RNA, 20 nt, Homo sapiens
acuccagauuuuuuacagcu

SEQ ID NO: 1880727 - RNA, 13 nt, Homo sapiens
caugaauaaucca

SEQ ID NO: 1880728 - RNA, 14 nt, Homo sapiens
cuaaauacaggaaa

SEQ ID NO: 1880729 - RNA, 13 nt, Homo sapiens
uugcaauacugcu

SEQ ID NO: 1880730 - RNA, 15 nt, Homo sapiens
gagaaacaauggcua

SEQ ID NO: 1880731 - RNA, 13 nt, Homo sapiens
aaaccuuugcaaa

SEQ ID NO: 1880732 - RNA, 17 nt, Homo sapiens
ucucuacuaaaaauaca

SEQ ID NO: 1880733 - RNA, 11 nt, Homo sapiens
aguugcagcug

SEQ ID NO: 1880734 - RNA, 17 nt, Homo sapiens
cauuucacacauaagaa

SEQ ID NO: 1880735 - RNA, 17 nt, Homo sapiens
aauuuggagauacguaa

SEQ ID NO: 1880736 - RNA, 15 nt, Homo sapiens
cuuuuaaaaaugucc

SEQ ID NO: 1880737 - RNA, 15 nt, Homo sapiens
guuagccugcaaaca

SEQ ID NO: 1880738 - RNA, 16 nt, Homo sapiens
ccuuagcaacagccga

SEQ ID NO: 1880739 - RNA, 23 nt, Homo sapiens
ggccauuucaccagucacugcca

SEQ ID NO: 1880740 - RNA, 20 nt, Homo sapiens
agagugccccacugcacucc

SEQ ID NO: 1880741 - RNA, 22 nt, Homo sapiens
uacgucccagcggccucagggu

SEQ ID NO: 1880742 - RNA, 19 nt, Homo sapiens
acaauguuucuucauuucu

SEQ ID NO: 1880743 - RNA, 12 nt, Homo sapiens
cagggugcagga

SEQ ID NO: 1880744 - RNA, 17 nt, Homo sapiens
uacaucccgggccucag

SEQ ID NO: 1880745 - RNA, 13 nt, Homo sapiens
uuuugcaccagcg

SEQ ID NO: 1880746 - RNA, 12 nt, Homo sapiens
agcacuccucaa

SEQ ID NO: 1880747 - RNA, 16 nt, Homo sapiens
uaaauguuaugacucc

SEQ ID NO: 1880748 - RNA, 16 nt, Homo sapiens
ccaugaccuuuuucac

SEQ ID NO: 1880749 - RNA, 14 nt, Homo sapiens
ccaaauuuaagcaa

SEQ ID NO: 1880750 - RNA, 20 nt, Homo sapiens
caccuauuaccaguguuccc

SEQ ID NO: 1880751 - RNA, 16 nt, Homo sapiens
ugcaggugacauuugc

SEQ ID NO: 1880752 - RNA, 18 nt, Homo sapiens
caacucacugugcuccua

SEQ ID NO: 1880753 - RNA, 18 nt, Homo sapiens
ugacccaagagaacucac

SEQ ID NO: 1880754 - RNA, 21 nt, Homo sapiens
ugucggcggcuugauaaacag

SEQ ID NO: 1880755 - RNA, 12 nt, Homo sapiens
gcugacuggcca

SEQ ID NO: 1880756 - RNA, 13 nt, Homo sapiens
uuguaaugcaaaa

SEQ ID NO: 1880757 - RNA, 15 nt, Homo sapiens
auuaaaagacucauc

SEQ ID NO: 1880758 - RNA, 18 nt, Homo sapiens
cuuaaaaaaauaugccuu

SEQ ID NO: 1880759 - RNA, 21 nt, Homo sapiens
aggguaggcucaaaacagggu

SEQ ID NO: 1880760 - RNA, 12 nt, Homo sapiens
aauuugccaguu

SEQ ID NO: 1880761 - RNA, 16 nt, Homo sapiens
ugucaaacagugccaa

SEQ ID NO: 1880762 - RNA, 15 nt, Homo sapiens
cucuagaagcucagg

SEQ ID NO: 1880763 - RNA, 20 nt, Homo sapiens
ccaguggauucccacagcac

SEQ ID NO: 1880764 - RNA, 13 nt, Homo sapiens
caggugaguguga

SEQ ID NO: 1880765 - RNA, 21 nt, Homo sapiens
uuuaagaagucuaaaugaagu

SEQ ID NO: 1880766 - RNA, 16 nt, Homo sapiens
uaacagaaacuuucaa

SEQ ID NO: 1880767 - RNA, 11 nt, Homo sapiens
uuccaucaucu

SEQ ID NO: 1880768 - RNA, 16 nt, Homo sapiens
agaaaaucaaccagca

SEQ ID NO: 1880769 - RNA, 15 nt, Homo sapiens
auaaauaaaacauuu

SEQ ID NO: 1880770 - RNA, 13 nt, Homo sapiens
ucucagaguccac

SEQ ID NO: 1880771 - RNA, 20 nt, Homo sapiens
gcauaguauuccauggugua

SEQ ID NO: 1880772 - RNA, 22 nt, Homo sapiens
guggagauuuacacuacauugu

SEQ ID NO: 1880773 - RNA, 19 nt, Homo sapiens
ccuaagauguaaguauuaa

SEQ ID NO: 1880774 - RNA, 23 nt, Homo sapiens
aaauaaaagaucuugaauagucu

SEQ ID NO: 1880775 - RNA, 15 nt, Homo sapiens
gcaccauucagacuu

SEQ ID NO: 1880776 - RNA, 18 nt, Homo sapiens
acuuacuauucauuaaau

SEQ ID NO: 1880777 - RNA, 18 nt, Homo sapiens
cucuauuuccuaucauuu

SEQ ID NO: 1880778 - RNA, 23 nt, Homo sapiens
ggcuggugacagaacaugcagca

SEQ ID NO: 1880779 - RNA, 15 nt, Homo sapiens
agccuuggaagcaaa

SEQ ID NO: 1880780 - RNA, 18 nt, Homo sapiens
cuaugcuggaaaacugag

SEQ ID NO: 1880781 - RNA, 19 nt, Homo sapiens
ucagcuuucagggccaugg

SEQ ID NO: 1880782 - RNA, 14 nt, Homo sapiens
gccucccacagugc

SEQ ID NO: 1880783 - RNA, 23 nt, Homo sapiens
ucacacugaggaacucacaauuc

SEQ ID NO: 1880784 - RNA, 17 nt, Homo sapiens
ccggcuguuuccugaca

SEQ ID NO: 1880785 - RNA, 13 nt, Homo sapiens
ccuccuucucugc

SEQ ID NO: 1880786 - RNA, 14 nt, Homo sapiens
auacaauuaaagcu

SEQ ID NO: 1880787 - RNA, 15 nt, Homo sapiens
uggaacauucuguca

SEQ ID NO: 1880788 - RNA, 16 nt, Homo sapiens
aucgaugaaggaauau

SEQ ID NO: 1880789 - RNA, 16 nt, Homo sapiens
ugcucuguuguagggg

SEQ ID NO: 1880790 - RNA, 18 nt, Homo sapiens
aaauauacaaaacuuuau

SEQ ID NO: 1880791 - RNA, 18 nt, Homo sapiens
agagcagggucucucuaa

SEQ ID NO: 1880792 - RNA, 19 nt, Homo sapiens
cagauaugauggaaugcau

SEQ ID NO: 1880793 - RNA, 23 nt, Homo sapiens
uguaaucgaguaaggcacaccca

SEQ ID NO: 1880794 - RNA, 19 nt, Homo sapiens
aauguauucuuaaauucau

SEQ ID NO: 1880795 - RNA, 18 nt, Homo sapiens
uuaugggguuuaccuguu

SEQ ID NO: 1880796 - RNA, 16 nt, Homo sapiens
caagaauugaguauca

SEQ ID NO: 1880797 - RNA, 23 nt, Homo sapiens
agauauuuuccauauauuggcac

SEQ ID NO: 1880798 - RNA, 21 nt, Homo sapiens
agagucuggccuggacccuga

SEQ ID NO: 1880799 - RNA, 17 nt, Homo sapiens
accccucuguccagcca

SEQ ID NO: 1880800 - RNA, 15 nt, Homo sapiens
ugaguucccaaaggg

SEQ ID NO: 1880801 - RNA, 17 nt, Homo sapiens
caagauacagccugcaa

SEQ ID NO: 1880802 - RNA, 19 nt, Homo sapiens
ucaaaccugcauauuguga

SEQ ID NO: 1880803 - RNA, 15 nt, Homo sapiens
cuuguccacagucuc

SEQ ID NO: 1880804 - RNA, 20 nt, Homo sapiens
uaaaguacugagcaguauua

SEQ ID NO: 1880805 - RNA, 19 nt, Homo sapiens
guucuaacaaaacaaguug

SEQ ID NO: 1880806 - RNA, 22 nt, Homo sapiens
auaucacacacauugcugugaa

SEQ ID NO: 1880807 - RNA, 14 nt, Homo sapiens
aaagugccaaagaa

SEQ ID NO: 1880808 - RNA, 16 nt, Homo sapiens
auuaugauuagcuuug

SEQ ID NO: 1880809 - RNA, 14 nt, Homo sapiens
cuuucaaacauguu

SEQ ID NO: 1880810 - RNA, 18 nt, Homo sapiens
cauuuucugacaugcauu

SEQ ID NO: 1880811 - RNA, 14 nt, Homo sapiens
aagacccaacuugc

SEQ ID NO: 1880812 - RNA, 15 nt, Homo sapiens
cagccagacccugca

SEQ ID NO: 1880813 - RNA, 16 nt, Homo sapiens
gccuccaaaauauuaa

SEQ ID NO: 1880814 - RNA, 20 nt, Homo sapiens
cccuggcagcagcaggugug

SEQ ID NO: 1880815 - RNA, 23 nt, Homo sapiens
cuauccaaucucaucucuuguaa

SEQ ID NO: 1880816 - RNA, 17 nt, Homo sapiens
uggcaugagaaauacaa

SEQ ID NO: 1880817 - RNA, 14 nt, Homo sapiens
accuugcacagguc

SEQ ID NO: 1880818 - RNA, 15 nt, Homo sapiens
ucuacuaaaaauaca

SEQ ID NO: 1880819 - RNA, 20 nt, Homo sapiens
uucucccccuuuccaaaaac

SEQ ID NO: 1880820 - RNA, 13 nt, Homo sapiens
cuggaauugauau

SEQ ID NO: 1880821 - RNA, 19 nt, Homo sapiens
gacugucuagccacucccu

SEQ ID NO: 1880822 - RNA, 21 nt, Homo sapiens
ucccaguauuacccuggauga

SEQ ID NO: 1880823 - RNA, 20 nt, Homo sapiens
ucauuaagaauaauugaaca

SEQ ID NO: 1880824 - RNA, 21 nt, Homo sapiens
cugauggaccgggugggccug

SEQ ID NO: 1880825 - RNA, 18 nt, Homo sapiens
cuuccuguccccaaaaug

SEQ ID NO: 1880826 - RNA, 19 nt, Homo sapiens
ucccuucuuugcuucuuuu

SEQ ID NO: 1880827 - RNA, 13 nt, Homo sapiens
acaugacugcaau

SEQ ID NO: 1880828 - RNA, 13 nt, Homo sapiens
augagacuguguu

SEQ ID NO: 1880829 - RNA, 22 nt, Homo sapiens
cgccccagggcacuacauaauu

SEQ ID NO: 1880830 - RNA, 19 nt, Homo sapiens
acugguaaaauacauauaa

SEQ ID NO: 1880831 - RNA, 14 nt, Homo sapiens
cagaaccacauuaa

SEQ ID NO: 1880832 - RNA, 14 nt, Homo sapiens
aguauccaagguua

SEQ ID NO: 1880833 - RNA, 17 nt, Homo sapiens
auauuuuuuuaacuuua

SEQ ID NO: 1880834 - RNA, 23 nt, Homo sapiens
aaaaccauuauaaaaucuuucca

SEQ ID NO: 1880835 - RNA, 21 nt, Homo sapiens
agucugaggccccuuaacuca

SEQ ID NO: 1880836 - RNA, 23 nt, Homo sapiens
ucggggagcguucuaaauaugaa

SEQ ID NO: 1880837 - RNA, 15 nt, Homo sapiens
ugccuaucugaccaa

SEQ ID NO: 1880838 - RNA, 14 nt, Homo sapiens
ugugugugucucca

SEQ ID NO: 1880839 - RNA, 13 nt, Homo sapiens
cauagacauuccu

SEQ ID NO: 1880840 - RNA, 16 nt, Homo sapiens
uguuuacccaguauuc

SEQ ID NO: 1880841 - RNA, 16 nt, Homo sapiens
auuguuguugccaaag

SEQ ID NO: 1880842 - RNA, 13 nt, Homo sapiens
agcaaugugauuu

SEQ ID NO: 1880843 - RNA, 14 nt, Homo sapiens
auccgggugcucaa

SEQ ID NO: 1880844 - RNA, 23 nt, Homo sapiens
cucuugcaauucaauacagauca

SEQ ID NO: 1880845 - RNA, 21 nt, Homo sapiens
gaagaguauuuuugacagaau

SEQ ID NO: 1880846 - RNA, 16 nt, Homo sapiens
caguaugauuuguaca

SEQ ID NO: 1880847 - RNA, 13 nt, Homo sapiens
aaacagaauauuc

SEQ ID NO: 1880848 - RNA, 14 nt, Homo sapiens
agcaaauggccuca

SEQ ID NO: 1880849 - RNA, 15 nt, Homo sapiens
aggcugggaagggga

SEQ ID NO: 1880850 - RNA, 18 nt, Homo sapiens
cucacaaaccaugcaaau

SEQ ID NO: 1880851 - RNA, 19 nt, Homo sapiens
gaauguuauccaacuauua

SEQ ID NO: 1880852 - RNA, 17 nt, Homo sapiens
caagggugugugcagca

SEQ ID NO: 1880853 - RNA, 22 nt, Homo sapiens
guagcucucugaccuccuccuu

SEQ ID NO: 1880854 - RNA, 18 nt, Homo sapiens
cacacuggcugguggaga

SEQ ID NO: 1880855 - RNA, 15 nt, Homo sapiens
auacacuuaaugaua

SEQ ID NO: 1880856 - RNA, 16 nt, Homo sapiens
guaguaaacuuggaac

SEQ ID NO: 1880857 - RNA, 21 nt, Homo sapiens
cagccaagaauaaaauacucu

SEQ ID NO: 1880858 - RNA, 13 nt, Homo sapiens
uguguguagcuaa

SEQ ID NO: 1880859 - RNA, 13 nt, Homo sapiens
cgugggcaucuca

SEQ ID NO: 1880860 - RNA, 17 nt, Homo sapiens
caggucaguuguaauaa

SEQ ID NO: 1880861 - RNA, 14 nt, Homo sapiens
aagagacugggaag

SEQ ID NO: 1880862 - RNA, 23 nt, Homo sapiens
caaaaggagagacucccaugaag

SEQ ID NO: 1880863 - RNA, 22 nt, Homo sapiens
aaugcauauuugcaaaguguau

SEQ ID NO: 1880864 - RNA, 15 nt, Homo sapiens
auuguaaauguucaa

SEQ ID NO: 1880865 - RNA, 12 nt, Homo sapiens
accccaccugcu

SEQ ID NO: 1880866 - RNA, 20 nt, Homo sapiens
acuuucaucuaaauuacuga

SEQ ID NO: 1880867 - RNA, 23 nt, Homo sapiens
auuuuacuaaaauggcagcuuaa

SEQ ID NO: 1880868 - RNA, 17 nt, Homo sapiens
acaaggcuaacauccca

SEQ ID NO: 1880869 - RNA, 16 nt, Homo sapiens
uauuucuacuaugagg

SEQ ID NO: 1880870 - RNA, 22 nt, Homo sapiens
aacucccgcacccuccuuucuc

SEQ ID NO: 1880871 - RNA, 16 nt, Homo sapiens
ugccaugugugcugaa

SEQ ID NO: 1880872 - RNA, 16 nt, Homo sapiens
augagcuggguacuga

SEQ ID NO: 1880873 - RNA, 14 nt, Homo sapiens
cacacacuuuugca

SEQ ID NO: 1880874 - RNA, 18 nt, Homo sapiens
ucgacaccauccuggcua

SEQ ID NO: 1880875 - RNA, 14 nt, Homo sapiens
augggucaaagccg

SEQ ID NO: 1880876 - RNA, 18 nt, Homo sapiens
ucuguaacccuugaauuu

SEQ ID NO: 1880877 - RNA, 16 nt, Homo sapiens
auauuguaaauacugg

SEQ ID NO: 1880878 - RNA, 18 nt, Homo sapiens
caaauaaaauguucccua

SEQ ID NO: 1880879 - RNA, 14 nt, Homo sapiens
uuacuuuaagcauu

SEQ ID NO: 1880880 - RNA, 15 nt, Homo sapiens
acguguguuucuaga

SEQ ID NO: 1880881 - RNA, 20 nt, Homo sapiens
uauauacccguacaacgugu

SEQ ID NO: 1880882 - RNA, 18 nt, Homo sapiens
aucaguccauugcucuug

SEQ ID NO: 1880883 - RNA, 12 nt, Homo sapiens
agucgcucucau

SEQ ID NO: 1880884 - RNA, 19 nt, Homo sapiens
cagggauuaggagcagcuc

SEQ ID NO: 1880885 - RNA, 19 nt, Homo sapiens
caguuacguugcauccaca

SEQ ID NO: 1880886 - RNA, 14 nt, Homo sapiens
uaaaaugucuagcu

SEQ ID NO: 1880887 - RNA, 14 nt, Homo sapiens
agggggucaugccg

SEQ ID NO: 1880888 - RNA, 14 nt, Homo sapiens
uguaugacagugaa

SEQ ID NO: 1880889 - RNA, 18 nt, Homo sapiens
gcuagagaaggaccagaa

SEQ ID NO: 1880890 - RNA, 13 nt, Homo sapiens
ccugucuacugac

SEQ ID NO: 1880891 - RNA, 16 nt, Homo sapiens
gucaugaccuccaggg

SEQ ID NO: 1880892 - RNA, 15 nt, Homo sapiens
ucacucaucugccaa

SEQ ID NO: 1880893 - RNA, 14 nt, Homo sapiens
uucuaacauaagua

SEQ ID NO: 1880894 - RNA, 17 nt, Homo sapiens
cacuuuugggaggucaa

SEQ ID NO: 1880895 - RNA, 21 nt, Homo sapiens
aaccacauuuagaaauguuua

SEQ ID NO: 1880896 - RNA, 21 nt, Homo sapiens
cagauccuuuuauucuccaga

SEQ ID NO: 1880897 - RNA, 12 nt, Homo sapiens
caacaaauuuca

SEQ ID NO: 1880898 - RNA, 15 nt, Homo sapiens
caauacuuaccuaau

SEQ ID NO: 1880899 - RNA, 21 nt, Homo sapiens
uccacaaaauuagaaaggaca

SEQ ID NO: 1880900 - RNA, 15 nt, Homo sapiens
auuuuuguuaagcuc

SEQ ID NO: 1880901 - RNA, 22 nt, Homo sapiens
acaucucagacccuuuagccaa

SEQ ID NO: 1880902 - RNA, 13 nt, Homo sapiens
gaggaagaauuca

SEQ ID NO: 1880903 - RNA, 14 nt, Homo sapiens
gcaccaacuuugaa

SEQ ID NO: 1880904 - RNA, 19 nt, Homo sapiens
caaaaacuuuccaugacag

SEQ ID NO: 1880905 - RNA, 20 nt, Homo sapiens
aaucauggauuauguugaca

SEQ ID NO: 1880906 - RNA, 19 nt, Homo sapiens
acaaaaaacugcaguuuga

SEQ ID NO: 1880907 - RNA, 14 nt, Homo sapiens
uaaaaggcauucau

SEQ ID NO: 1880908 - RNA, 18 nt, Homo sapiens
gauguccuccucugugaa

SEQ ID NO: 1880909 - RNA, 15 nt, Homo sapiens
ccucagaauccacaa

SEQ ID NO: 1880910 - RNA, 15 nt, Homo sapiens
ucaucuuaacuuggc

SEQ ID NO: 1880911 - RNA, 23 nt, Homo sapiens
cugaugggccagcaggagccagc

SEQ ID NO: 1880912 - RNA, 14 nt, Homo sapiens
aguguuuguauacc

SEQ ID NO: 1880913 - RNA, 16 nt, Homo sapiens
gggagucagagcccug

SEQ ID NO: 1880914 - RNA, 22 nt, Homo sapiens
uggccaucucccuccccagaaa

SEQ ID NO: 1880915 - RNA, 12 nt, Homo sapiens
uuuuaugcauug

SEQ ID NO: 1880916 - RNA, 17 nt, Homo sapiens
guaauacaaacuauaua

SEQ ID NO: 1880917 - RNA, 14 nt, Homo sapiens
cuaagaaaaucagu

SEQ ID NO: 1880918 - RNA, 13 nt, Homo sapiens
gcaguuuccaaua

SEQ ID NO: 1880919 - RNA, 13 nt, Homo sapiens
aacaagucccugu

SEQ ID NO: 1880920 - RNA, 15 nt, Homo sapiens
aagucacacccacuc

SEQ ID NO: 1880921 - RNA, 14 nt, Homo sapiens
aucucaauguacau

SEQ ID NO: 1880922 - RNA, 19 nt, Homo sapiens
agggcuuugugucuggcca

SEQ ID NO: 1880923 - RNA, 17 nt, Homo sapiens
cagugacaugauucuga

SEQ ID NO: 1880924 - RNA, 23 nt, Homo sapiens
agaggagguuuggggucugccac

SEQ ID NO: 1880925 - RNA, 14 nt, Homo sapiens
caugcaccuugcuc

SEQ ID NO: 1880926 - RNA, 21 nt, Homo sapiens
uagcccaggacccaucuuucu

SEQ ID NO: 1880927 - RNA, 17 nt, Homo sapiens
gucuuggcagcaccugu

SEQ ID NO: 1880928 - RNA, 17 nt, Homo sapiens
aaccaagauauccacuu

SEQ ID NO: 1880929 - RNA, 23 nt, Homo sapiens
cagguuccauccaccaccuugcc

SEQ ID NO: 1880930 - RNA, 20 nt, Homo sapiens
aaucccuguuuaauauuuaa

SEQ ID NO: 1880931 - RNA, 19 nt, Homo sapiens
ucugccaauuuuugccuuc

SEQ ID NO: 1880932 - RNA, 11 nt, Homo sapiens
acacaaauaga

SEQ ID NO: 1880933 - RNA, 13 nt, Homo sapiens
ggaaguauacuuu

SEQ ID NO: 1880934 - RNA, 13 nt, Homo sapiens
cuuguaaggggaa

SEQ ID NO: 1880935 - RNA, 22 nt, Homo sapiens
aacauguuuugugcagcacagu

SEQ ID NO: 1880936 - RNA, 14 nt, Homo sapiens
gcauccaacugaga

SEQ ID NO: 1880937 - RNA, 13 nt, Homo sapiens
cugcccauucucu

SEQ ID NO: 1880938 - RNA, 23 nt, Homo sapiens
ugcagagauccuacuucucugag

SEQ ID NO: 1880939 - RNA, 19 nt, Homo sapiens
cauacaagagacauauaau

SEQ ID NO: 1880940 - RNA, 18 nt, Homo sapiens
cacccaggccacugaccu

SEQ ID NO: 1880941 - RNA, 21 nt, Homo sapiens
caaagguuggcaacauuguac

SEQ ID NO: 1880942 - RNA, 14 nt, Homo sapiens
auucaaaagaucaa

SEQ ID NO: 1880943 - RNA, 22 nt, Homo sapiens
agccacggaccguugcacaaaa

SEQ ID NO: 1880944 - RNA, 22 nt, Homo sapiens
cacaagaccccugcuccugacu

SEQ ID NO: 1880945 - RNA, 17 nt, Homo sapiens
acagucuauacaaugaa

SEQ ID NO: 1880946 - RNA, 16 nt, Homo sapiens
cuauuaucaacugcug

SEQ ID NO: 1880947 - RNA, 19 nt, Homo sapiens
acgcuuuucuuuguuauac

SEQ ID NO: 1880948 - RNA, 13 nt, Homo sapiens
caaaucguauacc

SEQ ID NO: 1880949 - RNA, 18 nt, Homo sapiens
aagaguaggaagacuuug

SEQ ID NO: 1880950 - RNA, 15 nt, Homo sapiens
ugaggacgcaccgcc

SEQ ID NO: 1880951 - RNA, 17 nt, Homo sapiens
aaauaaaagcacuuaug

SEQ ID NO: 1880952 - RNA, 15 nt, Homo sapiens
cuggagggacaggga

SEQ ID NO: 1880953 - RNA, 14 nt, Homo sapiens
agaucuacauacaa

SEQ ID NO: 1880954 - RNA, 17 nt, Homo sapiens
cuguuucaacuguauaa

SEQ ID NO: 1880955 - RNA, 22 nt, Homo sapiens
cccacacuccauggagucugga

SEQ ID NO: 1880956 - RNA, 21 nt, Homo sapiens
ggcagaaccaagaacauaaac

SEQ ID NO: 1880957 - RNA, 19 nt, Homo sapiens
gguaaaacucacugugauc

SEQ ID NO: 1880958 - RNA, 23 nt, Homo sapiens
uaccuuagauuagcucuggacca

SEQ ID NO: 1880959 - RNA, 22 nt, Homo sapiens
ggaaacucaaaucgaauaggga

SEQ ID NO: 1880960 - RNA, 21 nt, Homo sapiens
uauuucauuuugagaacauuc

SEQ ID NO: 1880961 - RNA, 21 nt, Homo sapiens
guuccccaguagagcucuacu

SEQ ID NO: 1880962 - RNA, 22 nt, Homo sapiens
agauugcacagucaaaacgacu

SEQ ID NO: 1880963 - RNA, 13 nt, Homo sapiens
aaaaggacuguga

SEQ ID NO: 1880964 - RNA, 14 nt, Homo sapiens
caacagauucagaa

SEQ ID NO: 1880965 - RNA, 21 nt, Homo sapiens
auacuuuuuaaaguuuaccau

SEQ ID NO: 1880966 - RNA, 22 nt, Homo sapiens
cuguaaauaugaaucugcucac

SEQ ID NO: 1880967 - RNA, 22 nt, Homo sapiens
aaaugacgucuucaccaaguga

SEQ ID NO: 1880968 - RNA, 16 nt, Homo sapiens
aaauaaauguguaaau

SEQ ID NO: 1880969 - RNA, 21 nt, Homo sapiens
ccacuaaaaaaccaacaaugu

SEQ ID NO: 1880970 - RNA, 16 nt, Homo sapiens
cccaucuuuacaaaga

SEQ ID NO: 1880971 - RNA, 16 nt, Homo sapiens
gaccaggcuacuucuc

SEQ ID NO: 1880972 - RNA, 16 nt, Homo sapiens
ggccaacaugucagaa

SEQ ID NO: 1880973 - RNA, 15 nt, Homo sapiens
auccuagccaacauc

SEQ ID NO: 1880974 - RNA, 19 nt, Homo sapiens
cuuuauagauuauaugaau

SEQ ID NO: 1880975 - RNA, 18 nt, Homo sapiens
uuaucaccgugggcuccc

SEQ ID NO: 1880976 - RNA, 19 nt, Homo sapiens
caggcgugagccaccgugc

SEQ ID NO: 1880977 - RNA, 20 nt, Homo sapiens
gaccugagucugcaugugca

SEQ ID NO: 1880978 - RNA, 22 nt, Homo sapiens
aaguagcguuggagacauacac

SEQ ID NO: 1880979 - RNA, 15 nt, Homo sapiens
uucaaauuccugcaa

SEQ ID NO: 1880980 - RNA, 21 nt, Homo sapiens
cugcuuguccugcucucuuca

SEQ ID NO: 1880981 - RNA, 16 nt, Homo sapiens
uacuaaaugguugucu

SEQ ID NO: 1880982 - RNA, 20 nt, Homo sapiens
gcucccccaggcuguucucc

SEQ ID NO: 1880983 - RNA, 13 nt, Homo sapiens
cauauuauuccau

SEQ ID NO: 1880984 - RNA, 19 nt, Homo sapiens
cagcacaaaaggaauagau

SEQ ID NO: 1880985 - RNA, 23 nt, Homo sapiens
aacucaaauggggccagauccag

SEQ ID NO: 1880986 - RNA, 20 nt, Homo sapiens
cugagaacuccugacuguaa

SEQ ID NO: 1880987 - RNA, 20 nt, Homo sapiens
ugagacccacaggucuaaga

SEQ ID NO: 1880988 - RNA, 14 nt, Homo sapiens
ucuggucuuugguu

SEQ ID NO: 1880989 - RNA, 14 nt, Homo sapiens
cuugcauacaaaca

SEQ ID NO: 1880990 - RNA, 23 nt, Homo sapiens
acuccuaaauaaacuaguaugaa

SEQ ID NO: 1880991 - RNA, 20 nt, Homo sapiens
uccuaaccucgggugaucca

SEQ ID NO: 1880992 - RNA, 13 nt, Homo sapiens
gcagcggcuuccu

SEQ ID NO: 1880993 - RNA, 15 nt, Homo sapiens
acaugcucaggcuac

SEQ ID NO: 1880994 - RNA, 15 nt, Homo sapiens
cugccucggggacac

SEQ ID NO: 1880995 - RNA, 16 nt, Homo sapiens
guacugaggugcuaug

SEQ ID NO: 1880996 - RNA, 15 nt, Homo sapiens
ccugcuccagaauuu

SEQ ID NO: 1880997 - RNA, 19 nt, Homo sapiens
gagacauacaccuauguca

SEQ ID NO: 1880998 - RNA, 22 nt, Homo sapiens
caugaucgcuuucuacacugua

SEQ ID NO: 1880999 - RNA, 20 nt, Homo sapiens
cugacuuaugaaacuugaaa

SEQ ID NO: 1881000 - RNA, 17 nt, Homo sapiens
guuaccacauuacucug

SEQ ID NO: 1881001 - RNA, 14 nt, Homo sapiens
gcccaacagcacuu

SEQ ID NO: 1881002 - RNA, 15 nt, Homo sapiens
aauacugcuuuugca

SEQ ID NO: 1881003 - RNA, 17 nt, Homo sapiens
gagccaagcuaaugugg

SEQ ID NO: 1881004 - RNA, 14 nt, Homo sapiens
gcccaccagguguc

SEQ ID NO: 1881005 - RNA, 16 nt, Homo sapiens
gcacgggggccaagga

SEQ ID NO: 1881006 - RNA, 18 nt, Homo sapiens
ccuauuucuuauagucaa

SEQ ID NO: 1881007 - RNA, 14 nt, Homo sapiens
guucauccuacccu

SEQ ID NO: 1881008 - RNA, 21 nt, Homo sapiens
agcucucuugccgaggagcca

SEQ ID NO: 1881009 - RNA, 23 nt, Homo sapiens
accuaggagggugugaguggcau

SEQ ID NO: 1881010 - RNA, 18 nt, Homo sapiens
guggaaaaauaaaggaaa

SEQ ID NO: 1881011 - RNA, 18 nt, Homo sapiens
uaaaaggauaggaaaaga

SEQ ID NO: 1881012 - RNA, 15 nt, Homo sapiens
aauaaucaagugcau

SEQ ID NO: 1881013 - RNA, 13 nt, Homo sapiens
cuucaugugacac

SEQ ID NO: 1881014 - RNA, 19 nt, Homo sapiens
gaccuggguugugcugaca

SEQ ID NO: 1881015 - RNA, 17 nt, Homo sapiens
acuccugaccucaggug

SEQ ID NO: 1881016 - RNA, 14 nt, Homo sapiens
acaccauauacugu

SEQ ID NO: 1881017 - RNA, 14 nt, Homo sapiens
cuguauuauugcaa

SEQ ID NO: 1881018 - RNA, 18 nt, Homo sapiens
gagaaugacauugauucu

SEQ ID NO: 1881019 - RNA, 16 nt, Homo sapiens
uucacaauacagugga

SEQ ID NO: 1881020 - RNA, 20 nt, Homo sapiens
ugacgguguccaugccuucc

SEQ ID NO: 1881021 - RNA, 18 nt, Homo sapiens
cauauguuguugcuugua

SEQ ID NO: 1881022 - RNA, 22 nt, Homo sapiens
gcccaggccuucccaccaggaa

SEQ ID NO: 1881023 - RNA, 15 nt, Homo sapiens
uggacucugcacaug

SEQ ID NO: 1881024 - RNA, 14 nt, Homo sapiens
ggcaagggguuucc

SEQ ID NO: 1881025 - RNA, 13 nt, Homo sapiens
uucucaugaucca

SEQ ID NO: 1881026 - RNA, 22 nt, Homo sapiens
ccugagauucuuuaaggagaua

SEQ ID NO: 1881027 - RNA, 17 nt, Homo sapiens
aauuguucaacuuuuca

SEQ ID NO: 1881028 - RNA, 19 nt, Homo sapiens
ccaaucccaccaacccuca

SEQ ID NO: 1881029 - RNA, 15 nt, Homo sapiens
aagugaugacauauu

SEQ ID NO: 1881030 - RNA, 16 nt, Homo sapiens
cugauggaacugugua

SEQ ID NO: 1881031 - RNA, 12 nt, Homo sapiens
uugcugccuuca

SEQ ID NO: 1881032 - RNA, 13 nt, Homo sapiens
ugaucaaauguac

SEQ ID NO: 1881033 - RNA, 14 nt, Homo sapiens
auaauuuuguaaga

SEQ ID NO: 1881034 - RNA, 14 nt, Homo sapiens
agcccaaccgggaa

SEQ ID NO: 1881035 - RNA, 14 nt, Homo sapiens
ucacaaacuacaaa

SEQ ID NO: 1881036 - RNA, 19 nt, Homo sapiens
uauggguuuuacugauaug

SEQ ID NO: 1881037 - RNA, 22 nt, Homo sapiens
acuuuuaaguugcugaugaacu

SEQ ID NO: 1881038 - RNA, 16 nt, Homo sapiens
guguuccuucauuaac

SEQ ID NO: 1881039 - RNA, 11 nt, Homo sapiens
uauugcugcua

SEQ ID NO: 1881040 - RNA, 15 nt, Homo sapiens
agaugccugugaaau

SEQ ID NO: 1881041 - RNA, 21 nt, Homo sapiens
cuguggagcucuggggggcaa

SEQ ID NO: 1881042 - RNA, 17 nt, Homo sapiens
uauaucaauaaauucca

SEQ ID NO: 1881043 - RNA, 20 nt, Homo sapiens
caugucacuucccugcuuaa

SEQ ID NO: 1881044 - RNA, 20 nt, Homo sapiens
uggaagucaucucauuccac

SEQ ID NO: 1881045 - RNA, 23 nt, Homo sapiens
ucacccaaugcaucacguacccc

SEQ ID NO: 1881046 - RNA, 19 nt, Homo sapiens
ucuugcucugccacccagg

SEQ ID NO: 1881047 - RNA, 17 nt, Homo sapiens
cagcugcuggcugugac

SEQ ID NO: 1881048 - RNA, 19 nt, Homo sapiens
gggacucuggcacagugau

SEQ ID NO: 1881049 - RNA, 23 nt, Homo sapiens
cauuacauuaacauuuaggaacc

SEQ ID NO: 1881050 - RNA, 13 nt, Homo sapiens
ggagagcaucugc

SEQ ID NO: 1881051 - RNA, 16 nt, Homo sapiens
caaacucaggcuuuca

SEQ ID NO: 1881052 - RNA, 13 nt, Homo sapiens
uccacaucugccu

SEQ ID NO: 1881053 - RNA, 19 nt, Homo sapiens
uugagcugcucugcaagag

SEQ ID NO: 1881054 - RNA, 22 nt, Homo sapiens
auacuauuuaaagccuccucau

SEQ ID NO: 1881055 - RNA, 23 nt, Homo sapiens
caaccuggucacaggacucugcc

SEQ ID NO: 1881056 - RNA, 18 nt, Homo sapiens
guggcacagaagcucauc

SEQ ID NO: 1881057 - RNA, 14 nt, Homo sapiens
cugggagcugccug

SEQ ID NO: 1881058 - RNA, 19 nt, Homo sapiens
aggucugggccagaugcug

SEQ ID NO: 1881059 - RNA, 16 nt, Homo sapiens
uucaccuugauaaggu

SEQ ID NO: 1881060 - RNA, 18 nt, Homo sapiens
cuauguuucacugugcaa

SEQ ID NO: 1881061 - RNA, 17 nt, Homo sapiens
agaggguguccugcacc

SEQ ID NO: 1881062 - RNA, 17 nt, Homo sapiens
agcuguugugugagguu

SEQ ID NO: 1881063 - RNA, 21 nt, Homo sapiens
gucccagaaauaaacugagaa

SEQ ID NO: 1881064 - RNA, 22 nt, Homo sapiens
gcauauuauuuuauguugcaua

SEQ ID NO: 1881065 - RNA, 22 nt, Homo sapiens
cacuuaauuuguaaacuucuga

SEQ ID NO: 1881066 - RNA, 19 nt, Homo sapiens
caggauggggaggggcucu

SEQ ID NO: 1881067 - RNA, 19 nt, Homo sapiens
guaaagaauuuagcuguau

SEQ ID NO: 1881068 - RNA, 18 nt, Homo sapiens
caguugcacagcaucuca

SEQ ID NO: 1881069 - RNA, 22 nt, Homo sapiens
gauaccuucuggcugugcuacc

SEQ ID NO: 1881070 - RNA, 17 nt, Homo sapiens
acaggguuucuccaugu

SEQ ID NO: 1881071 - RNA, 15 nt, Homo sapiens
uugucaucugcaugu

SEQ ID NO: 1881072 - RNA, 18 nt, Homo sapiens
uuauacauuaacuucagc

SEQ ID NO: 1881073 - RNA, 20 nt, Homo sapiens
cugcaaagaucuguccucag

SEQ ID NO: 1881074 - RNA, 21 nt, Homo sapiens
agugugcauuaccacacucag

SEQ ID NO: 1881075 - RNA, 19 nt, Homo sapiens
cagaugggggaaagcacag

SEQ ID NO: 1881076 - RNA, 13 nt, Homo sapiens
ugggaucugccaa

SEQ ID NO: 1881077 - RNA, 19 nt, Homo sapiens
auauaauucccaagcuuuu

SEQ ID NO: 1881078 - RNA, 21 nt, Homo sapiens
cauaaagugagacauugugaa

SEQ ID NO: 1881079 - RNA, 21 nt, Homo sapiens
uuuucauccuauaagcuuaaa

SEQ ID NO: 1881080 - RNA, 19 nt, Homo sapiens
uucccuuaaacaaaagugu

SEQ ID NO: 1881081 - RNA, 15 nt, Homo sapiens
uuaauuuuauuccag

SEQ ID NO: 1881082 - RNA, 16 nt, Homo sapiens
ccauguacaugaagaa

SEQ ID NO: 1881083 - RNA, 17 nt, Homo sapiens
augguaauuaugugaua

SEQ ID NO: 1881084 - RNA, 17 nt, Homo sapiens
acgagaagguacugaaa

SEQ ID NO: 1881085 - RNA, 18 nt, Homo sapiens
guguuuuuuaaauugauc

SEQ ID NO: 1881086 - RNA, 19 nt, Homo sapiens
cccuggccuugaguagaaa

SEQ ID NO: 1881087 - RNA, 14 nt, Homo sapiens
acauacuccaacug

SEQ ID NO: 1881088 - RNA, 20 nt, Homo sapiens
gcacacuuaugggccaagcc

SEQ ID NO: 1881089 - RNA, 23 nt, Homo sapiens
cuguagaagaagcccauaucaca

SEQ ID NO: 1881090 - RNA, 17 nt, Homo sapiens
uuucagauaaauuucaa

SEQ ID NO: 1881091 - RNA, 19 nt, Homo sapiens
uauaauuuuaaaauugcag

SEQ ID NO: 1881092 - RNA, 21 nt, Homo sapiens
cugagcagcuuagacagcagg

SEQ ID NO: 1881093 - RNA, 15 nt, Homo sapiens
ccacugacaggcuuu

SEQ ID NO: 1881094 - RNA, 14 nt, Homo sapiens
gucauaugacugau

SEQ ID NO: 1881095 - RNA, 19 nt, Homo sapiens
uuaaacugucgugucauac

SEQ ID NO: 1881096 - RNA, 16 nt, Homo sapiens
gucauuguccucugag

SEQ ID NO: 1881097 - RNA, 19 nt, Homo sapiens
cccuagcgcucucuuccag

SEQ ID NO: 1881098 - RNA, 23 nt, Homo sapiens
ccuugcaguuuuacuaaaacacu

SEQ ID NO: 1881099 - RNA, 19 nt, Homo sapiens
caugugccauagugcaggc

SEQ ID NO: 1881100 - RNA, 19 nt, Homo sapiens
ucauguuuacagaggacag

SEQ ID NO: 1881101 - RNA, 20 nt, Homo sapiens
ucuuaauuuugguuguauuc

SEQ ID NO: 1881102 - RNA, 19 nt, Homo sapiens
ggccaggugccuccugaca

SEQ ID NO: 1881103 - RNA, 12 nt, Homo sapiens
gaucacaccuca

SEQ ID NO: 1881104 - RNA, 14 nt, Homo sapiens
uuuaccaucugcau

SEQ ID NO: 1881105 - RNA, 23 nt, Homo sapiens
ucuuugcagccuggguggcuaug

SEQ ID NO: 1881106 - RNA, 23 nt, Homo sapiens
caugugugugcaagugugugcau

SEQ ID NO: 1881107 - RNA, 23 nt, Homo sapiens
agggaggcuuccugacugacaca

SEQ ID NO: 1881108 - RNA, 19 nt, Homo sapiens
aucagaguuccuccuacuu

SEQ ID NO: 1881109 - RNA, 19 nt, Homo sapiens
cuucagaaucagacuauga

SEQ ID NO: 1881110 - RNA, 16 nt, Homo sapiens
uuuacaaaauacaaaa

SEQ ID NO: 1881111 - RNA, 20 nt, Homo sapiens
uaaacagauguccaucagau

SEQ ID NO: 1881112 - RNA, 16 nt, Homo sapiens
uccaaaagcacagacu

SEQ ID NO: 1881113 - RNA, 24 nt, Homo sapiens
gcaccuacuuuauguauggagcuc

SEQ ID NO: 1881114 - RNA, 14 nt, Homo sapiens
acacagucaugugu

SEQ ID NO: 1881115 - RNA, 14 nt, Homo sapiens
agaaagagacugug

SEQ ID NO: 1881116 - RNA, 22 nt, Homo sapiens
augaugauuuuaacaguuuuac

SEQ ID NO: 1881117 - RNA, 22 nt, Homo sapiens
acagaauuuuaugcggcauuuu

SEQ ID NO: 1881118 - RNA, 19 nt, Homo sapiens
ccacgugauuuccagugag

SEQ ID NO: 1881119 - RNA, 20 nt, Homo sapiens
gggcacagcacagccagggc

SEQ ID NO: 1881120 - RNA, 23 nt, Homo sapiens
auguuaaacuagcauaucugccu

SEQ ID NO: 1881121 - RNA, 14 nt, Homo sapiens
ccucagugagauaa

SEQ ID NO: 1881122 - RNA, 13 nt, Homo sapiens
caaaaugugaugc

SEQ ID NO: 1881123 - RNA, 13 nt, Homo sapiens
augacaaauuuag

SEQ ID NO: 1881124 - RNA, 14 nt, Homo sapiens
agggccuugaaucc

SEQ ID NO: 1881125 - RNA, 15 nt, Homo sapiens
guuguuggucuguag

SEQ ID NO: 1881126 - RNA, 22 nt, Homo sapiens
ugagggaucugucucacuggca

SEQ ID NO: 1881127 - RNA, 14 nt, Homo sapiens
cucuucacagugcc

SEQ ID NO: 1881128 - RNA, 14 nt, Homo sapiens
augugaacugcuga

SEQ ID NO: 1881129 - RNA, 19 nt, Homo sapiens
agacauaccucucaacuua

SEQ ID NO: 1881130 - RNA, 13 nt, Homo sapiens
gaaccuguccagu

SEQ ID NO: 1881131 - RNA, 17 nt, Homo sapiens
uugaagguuuguccaca

SEQ ID NO: 1881132 - RNA, 15 nt, Homo sapiens
gcuucaguggcagcu

SEQ ID NO: 1881133 - RNA, 13 nt, Homo sapiens
cauagcacccgug

SEQ ID NO: 1881134 - RNA, 21 nt, Homo sapiens
gaaacagucccgcgugcaaag

SEQ ID NO: 1881135 - RNA, 19 nt, Homo sapiens
ucuagucuggaacugcugc

SEQ ID NO: 1881136 - RNA, 18 nt, Homo sapiens
cugcagcaggugaccucc

SEQ ID NO: 1881137 - RNA, 23 nt, Homo sapiens
gacccucaccugaauaagggacu

SEQ ID NO: 1881138 - RNA, 14 nt, Homo sapiens
cucucuguggcucc

SEQ ID NO: 1881139 - RNA, 19 nt, Homo sapiens
ccuucauaugugcaguauu

SEQ ID NO: 1881140 - RNA, 12 nt, Homo sapiens
gacucaagcaag

SEQ ID NO: 1881141 - RNA, 21 nt, Homo sapiens
agagcuuggacuggaugcaug

SEQ ID NO: 1881142 - RNA, 17 nt, Homo sapiens
cugaaaaggacuucugg

SEQ ID NO: 1881143 - RNA, 14 nt, Homo sapiens
cuucucuugccuua

SEQ ID NO: 1881144 - RNA, 22 nt, Homo sapiens
cuguacaaaggggaaagaacau

SEQ ID NO: 1881145 - RNA, 19 nt, Homo sapiens
augaaggucauaaguuucu

SEQ ID NO: 1881146 - RNA, 23 nt, Homo sapiens
gaagaagguaggagaaagggcgg

SEQ ID NO: 1881147 - RNA, 22 nt, Homo sapiens
ccuaacaugcaccuugcuccca

SEQ ID NO: 1881148 - RNA, 16 nt, Homo sapiens
guccuaggacuuaaaa

SEQ ID NO: 1881149 - RNA, 18 nt, Homo sapiens
augucauguggcuaccug

SEQ ID NO: 1881150 - RNA, 21 nt, Homo sapiens
uacauguggaaaacucacaga

SEQ ID NO: 1881151 - RNA, 15 nt, Homo sapiens
uaucaaaauuacccu

SEQ ID NO: 1881152 - RNA, 19 nt, Homo sapiens
guugcaccaggcacugcug

SEQ ID NO: 1881153 - RNA, 21 nt, Homo sapiens
ucuccuguuggcucacagggc

SEQ ID NO: 1881154 - RNA, 19 nt, Homo sapiens
gcaugugugcaugugcugu

SEQ ID NO: 1881155 - RNA, 13 nt, Homo sapiens
uacaaacaagaua

SEQ ID NO: 1881156 - RNA, 16 nt, Homo sapiens
caggaagggaccccac

SEQ ID NO: 1881157 - RNA, 14 nt, Homo sapiens
acugacaacauuau

SEQ ID NO: 1881158 - RNA, 14 nt, Homo sapiens
gcuggcugcaguga

SEQ ID NO: 1881159 - RNA, 18 nt, Homo sapiens
uccaugaaagaacuuaag

SEQ ID NO: 1881160 - RNA, 15 nt, Homo sapiens
uacauuccucagcug

SEQ ID NO: 1881161 - RNA, 23 nt, Homo sapiens
gaacaaauuauaaaaaccaugga

SEQ ID NO: 1881162 - RNA, 17 nt, Homo sapiens
ugccccuccucucugcc

SEQ ID NO: 1881163 - RNA, 12 nt, Homo sapiens
cuuugcauucau

SEQ ID NO: 1881164 - RNA, 20 nt, Homo sapiens
acaauauggucccaaaugac

SEQ ID NO: 1881165 - RNA, 16 nt, Homo sapiens
ggaaugaaugucagug

SEQ ID NO: 1881166 - RNA, 20 nt, Homo sapiens
aaaauguauauagcugugag

SEQ ID NO: 1881167 - RNA, 16 nt, Homo sapiens
gcagaugcuuugccca

SEQ ID NO: 1881168 - RNA, 13 nt, Homo sapiens
cccacaauggagu

SEQ ID NO: 1881169 - RNA, 13 nt, Homo sapiens
acaugauugccaa

SEQ ID NO: 1881170 - RNA, 13 nt, Homo sapiens
caauaaagcaaug

SEQ ID NO: 1881171 - RNA, 13 nt, Homo sapiens
acaagaagacaaa

SEQ ID NO: 1881172 - RNA, 16 nt, Homo sapiens
agcaaacaaugguguc

SEQ ID NO: 1881173 - RNA, 22 nt, Homo sapiens
aacccugcuugcacuuuguaac

SEQ ID NO: 1881174 - RNA, 13 nt, Homo sapiens
uguggaugcucuu

SEQ ID NO: 1881175 - RNA, 17 nt, Homo sapiens
uuuccacuccaaccaga

SEQ ID NO: 1881176 - RNA, 20 nt, Homo sapiens
cucaaggcugcagugagcca

SEQ ID NO: 1881177 - RNA, 17 nt, Homo sapiens
cuaaaaauaagcuuuau

SEQ ID NO: 1881178 - RNA, 17 nt, Homo sapiens
cagcucagcgccagccu

SEQ ID NO: 1881179 - RNA, 15 nt, Homo sapiens
cucgcaugacuguua

SEQ ID NO: 1881180 - RNA, 16 nt, Homo sapiens
uucccauuaaagaagu

SEQ ID NO: 1881181 - RNA, 13 nt, Homo sapiens
cccaacccauuca

SEQ ID NO: 1881182 - RNA, 16 nt, Homo sapiens
cggcgaagugcuaaaa

SEQ ID NO: 1881183 - RNA, 17 nt, Homo sapiens
acuguccuuaaagccau

SEQ ID NO: 1881184 - RNA, 18 nt, Homo sapiens
aagaaagcuauauaugaa

SEQ ID NO: 1881185 - RNA, 14 nt, Homo sapiens
gauaggguggcaca

SEQ ID NO: 1881186 - RNA, 18 nt, Homo sapiens
uuuaaguaauuucaugca

SEQ ID NO: 1881187 - RNA, 23 nt, Homo sapiens
cccucuuucagggguccuaagcc

SEQ ID NO: 1881188 - RNA, 17 nt, Homo sapiens
ggcagagaaagggacaa

SEQ ID NO: 1881189 - RNA, 17 nt, Homo sapiens
agguuauuuugauguaa

SEQ ID NO: 1881190 - RNA, 18 nt, Homo sapiens
cagcccaggucccagugc

SEQ ID NO: 1881191 - RNA, 18 nt, Homo sapiens
uucuggcuaccuguuuga

SEQ ID NO: 1881192 - RNA, 22 nt, Homo sapiens
agcacccucuggauucugaauc

SEQ ID NO: 1881193 - RNA, 16 nt, Homo sapiens
uuagcaucaaguucuc

SEQ ID NO: 1881194 - RNA, 17 nt, Homo sapiens
acguugugcacauguac

SEQ ID NO: 1881195 - RNA, 21 nt, Homo sapiens
uacggauuuagcuaacaaaag

SEQ ID NO: 1881196 - RNA, 17 nt, Homo sapiens
aaaaugugugugugcuu

SEQ ID NO: 1881197 - RNA, 14 nt, Homo sapiens
ucuggccaggcaug

SEQ ID NO: 1881198 - RNA, 20 nt, Homo sapiens
cucuucccgggaucacuuaa

SEQ ID NO: 1881199 - RNA, 20 nt, Homo sapiens
cauaugaggggacccagcgc

SEQ ID NO: 1881200 - RNA, 19 nt, Homo sapiens
uucaaauccauagauuucg

SEQ ID NO: 1881201 - RNA, 14 nt, Homo sapiens
cagggcacauguga

SEQ ID NO: 1881202 - RNA, 19 nt, Homo sapiens
cuagaugaguaaucugauu

SEQ ID NO: 1881203 - RNA, 18 nt, Homo sapiens
aauguguguagauuucau

SEQ ID NO: 1881204 - RNA, 19 nt, Homo sapiens
uauaguaacacacuuccag

SEQ ID NO: 1881205 - RNA, 18 nt, Homo sapiens
ugaugagcauuuguuuga

SEQ ID NO: 1881206 - RNA, 20 nt, Homo sapiens
gccaggaagaucccccagaa

SEQ ID NO: 1881207 - RNA, 12 nt, Homo sapiens
gacaacauuucu

SEQ ID NO: 1881208 - RNA, 17 nt, Homo sapiens
gucuguaagagaauucu

SEQ ID NO: 1881209 - RNA, 23 nt, Homo sapiens
uguucugggaaaauccacuauga

SEQ ID NO: 1881210 - RNA, 20 nt, Homo sapiens
caucgcaggaugacagcucc

SEQ ID NO: 1881211 - RNA, 17 nt, Homo sapiens
uaugaaguuacuuucuu

SEQ ID NO: 1881212 - RNA, 22 nt, Homo sapiens
gugccagaaagagagaaccaag

SEQ ID NO: 1881213 - RNA, 16 nt, Homo sapiens
aaagccuuucauacca

SEQ ID NO: 1881214 - RNA, 16 nt, Homo sapiens
guuuagaugcuuugug

SEQ ID NO: 1881215 - RNA, 16 nt, Homo sapiens
agagauucccaagcca

SEQ ID NO: 1881216 - RNA, 16 nt, Homo sapiens
aggauaauuauccaau

SEQ ID NO: 1881217 - RNA, 23 nt, Homo sapiens
cagcagagaagcuguaggacugu

SEQ ID NO: 1881218 - RNA, 17 nt, Homo sapiens
caaaugggccugccaaa

SEQ ID NO: 1881219 - RNA, 14 nt, Homo sapiens
gcccucucaugcag

SEQ ID NO: 1881220 - RNA, 14 nt, Homo sapiens
cugauaauauugau

SEQ ID NO: 1881221 - RNA, 23 nt, Homo sapiens
ucugcacuucuguuccagguuuu

SEQ ID NO: 1881222 - RNA, 19 nt, Homo sapiens
gcuccugagacacaugggu

SEQ ID NO: 1881223 - RNA, 22 nt, Homo sapiens
cucaggugaaaauccaucucau

SEQ ID NO: 1881224 - RNA, 21 nt, Homo sapiens
uugggaugagaaugaaagcuu

SEQ ID NO: 1881225 - RNA, 13 nt, Homo sapiens
agccuugugauca

SEQ ID NO: 1881226 - RNA, 14 nt, Homo sapiens
ugagaaugugcuuu

SEQ ID NO: 1881227 - RNA, 18 nt, Homo sapiens
ucagggaccagcuuuacu

SEQ ID NO: 1881228 - RNA, 15 nt, Homo sapiens
cucugcucugugcac

SEQ ID NO: 1881229 - RNA, 20 nt, Homo sapiens
uacaagagaagaaagugaaa

SEQ ID NO: 1881230 - RNA, 18 nt, Homo sapiens
uuacaggcuugagccucc

SEQ ID NO: 1881231 - RNA, 19 nt, Homo sapiens
agccgagcggggagccagg

SEQ ID NO: 1881232 - RNA, 12 nt, Homo sapiens
acaaggccaucu

SEQ ID NO: 1881233 - RNA, 17 nt, Homo sapiens
guccccacgaacuggcc

SEQ ID NO: 1881234 - RNA, 22 nt, Homo sapiens
ugauagucuuacuaaaugcaga

SEQ ID NO: 1881235 - RNA, 23 nt, Homo sapiens
uaucaaacagccccagucuuccu

SEQ ID NO: 1881236 - RNA, 22 nt, Homo sapiens
augugauuuuauggugauguca

SEQ ID NO: 1881237 - RNA, 15 nt, Homo sapiens
ccuuugacucugggg

SEQ ID NO: 1881238 - RNA, 20 nt, Homo sapiens
uugguuucgucugucuguaa

SEQ ID NO: 1881239 - RNA, 17 nt, Homo sapiens
acuuuaccucuguggac

SEQ ID NO: 1881240 - RNA, 23 nt, Homo sapiens
cacccaccccacagacuccggcc

SEQ ID NO: 1881241 - RNA, 16 nt, Homo sapiens
agaacgguuuuuggau

SEQ ID NO: 1881242 - RNA, 19 nt, Homo sapiens
cuuccaaggguacuaagga

SEQ ID NO: 1881243 - RNA, 14 nt, Homo sapiens
cacaaggugcucag

SEQ ID NO: 1881244 - RNA, 20 nt, Homo sapiens
aagguuaugaaacauaucau

SEQ ID NO: 1881245 - RNA, 17 nt, Homo sapiens
agcagugucuguaccuc

SEQ ID NO: 1881246 - RNA, 13 nt, Homo sapiens
cccuccccauuca

SEQ ID NO: 1881247 - RNA, 12 nt, Homo sapiens
ccuacagaauuu

SEQ ID NO: 1881248 - RNA, 22 nt, Homo sapiens
aucugcagggagcaacucucca

SEQ ID NO: 1881249 - RNA, 17 nt, Homo sapiens
aaaagaucuucuuccaa

SEQ ID NO: 1881250 - RNA, 12 nt, Homo sapiens
aggucuccauca

SEQ ID NO: 1881251 - RNA, 23 nt, Homo sapiens
auuguugaauguuucacuaguua

SEQ ID NO: 1881252 - RNA, 15 nt, Homo sapiens
cucaaggaaccauau

SEQ ID NO: 1881253 - RNA, 15 nt, Homo sapiens
agccuuuccugauga

SEQ ID NO: 1881254 - RNA, 20 nt, Homo sapiens
ucaaaagccugggugagaau

SEQ ID NO: 1881255 - RNA, 16 nt, Homo sapiens
caagaucuacaggaca

SEQ ID NO: 1881256 - RNA, 13 nt, Homo sapiens
acugacacucauu

SEQ ID NO: 1881257 - RNA, 21 nt, Homo sapiens
guuaacgcacuuggaguaauu

SEQ ID NO: 1881258 - RNA, 22 nt, Homo sapiens
uaaaucugaguauauauuuaca

SEQ ID NO: 1881259 - RNA, 22 nt, Homo sapiens
ccauuuuauuuuuugggccauu

SEQ ID NO: 1881260 - RNA, 14 nt, Homo sapiens
cucacuggcuuuag

SEQ ID NO: 1881261 - RNA, 16 nt, Homo sapiens
aauguuuuuaagauuu

SEQ ID NO: 1881262 - RNA, 20 nt, Homo sapiens
ucaucuauguauucaaguaa

SEQ ID NO: 1881263 - RNA, 20 nt, Homo sapiens
uaaauucuauaggaacauau

SEQ ID NO: 1881264 - RNA, 15 nt, Homo sapiens
uuaauguguauucau

SEQ ID NO: 1881265 - RNA, 20 nt, Homo sapiens
uuuuaucaaauuugccauga

SEQ ID NO: 1881266 - RNA, 22 nt, Homo sapiens
cccuaugaacucuugauaacac

SEQ ID NO: 1881267 - RNA, 21 nt, Homo sapiens
guaaguggcuucucugugaau

SEQ ID NO: 1881268 - RNA, 18 nt, Homo sapiens
aaaguggacaaggagugu

SEQ ID NO: 1881269 - RNA, 22 nt, Homo sapiens
ccagauuaucagaccucuucau

SEQ ID NO: 1881270 - RNA, 21 nt, Homo sapiens
guccuggccggccgcccacau

SEQ ID NO: 1881271 - RNA, 16 nt, Homo sapiens
auggcaugagauagcu

SEQ ID NO: 1881272 - RNA, 17 nt, Homo sapiens
cagaauggggacaucuu

SEQ ID NO: 1881273 - RNA, 15 nt, Homo sapiens
aagauacaaucuggg

SEQ ID NO: 1881274 - RNA, 14 nt, Homo sapiens
cuucuuugcugcug

SEQ ID NO: 1881275 - RNA, 21 nt, Homo sapiens
auaaaauguaucaacacacau

SEQ ID NO: 1881276 - RNA, 18 nt, Homo sapiens
cacagcuucuccaagcau

SEQ ID NO: 1881277 - RNA, 19 nt, Homo sapiens
uccugugccucaucacugc

SEQ ID NO: 1881278 - RNA, 18 nt, Homo sapiens
aauuuuacauaugucacu

SEQ ID NO: 1881279 - RNA, 15 nt, Homo sapiens
uugugaaauacagua

SEQ ID NO: 1881280 - RNA, 17 nt, Homo sapiens
uucucauucguggcaug

SEQ ID NO: 1881281 - RNA, 24 nt, Homo sapiens
ugccaggaauguuucagcugcagu

SEQ ID NO: 1881282 - RNA, 14 nt, Homo sapiens
aaacaaaugcuccu

SEQ ID NO: 1881283 - RNA, 13 nt, Homo sapiens
uucuuagauauga

SEQ ID NO: 1881284 - RNA, 17 nt, Homo sapiens
ucagcucuccugcugca

SEQ ID NO: 1881285 - RNA, 17 nt, Homo sapiens
uaccacaagccugagaa

SEQ ID NO: 1881286 - RNA, 14 nt, Homo sapiens
gcccaugagucagg

SEQ ID NO: 1881287 - RNA, 15 nt, Homo sapiens
ugggcccaagaacug

SEQ ID NO: 1881288 - RNA, 12 nt, Homo sapiens
gcggcucuccag

SEQ ID NO: 1881289 - RNA, 13 nt, Homo sapiens
aaaaucauuugag

SEQ ID NO: 1881290 - RNA, 15 nt, Homo sapiens
ccuuccuggacagcu

SEQ ID NO: 1881291 - RNA, 20 nt, Homo sapiens
uccugcaaggggacauucca

SEQ ID NO: 1881292 - RNA, 13 nt, Homo sapiens
caucugaucugua

SEQ ID NO: 1881293 - RNA, 23 nt, Homo sapiens
cucacuuguucucacugucuguu

SEQ ID NO: 1881294 - RNA, 22 nt, Homo sapiens
uaggccucaguguccucaucua

SEQ ID NO: 1881295 - RNA, 15 nt, Homo sapiens
auuuauuucuagcaa

SEQ ID NO: 1881296 - RNA, 21 nt, Homo sapiens
aaggaugcggcaggugcucug

SEQ ID NO: 1881297 - RNA, 18 nt, Homo sapiens
accucugauuacauguau

SEQ ID NO: 1881298 - RNA, 20 nt, Homo sapiens
cacuuauaggaauugaccca

SEQ ID NO: 1881299 - RNA, 20 nt, Homo sapiens
gcccccuucucccacacugc

SEQ ID NO: 1881300 - RNA, 23 nt, Homo sapiens
gaguaccaaauccacaagccauu

SEQ ID NO: 1881301 - RNA, 22 nt, Homo sapiens
agucgggggguggcugccaggg

SEQ ID NO: 1881302 - RNA, 23 nt, Homo sapiens
ucuacuagggaaaaauaaacaca

SEQ ID NO: 1881303 - RNA, 11 nt, Homo sapiens
ccuaagacauu

SEQ ID NO: 1881304 - RNA, 17 nt, Homo sapiens
uaaauguaucauagaaa

SEQ ID NO: 1881305 - RNA, 20 nt, Homo sapiens
acaaaugggacugaugucau

SEQ ID NO: 1881306 - RNA, 13 nt, Homo sapiens
auuuuaauacagg

SEQ ID NO: 1881307 - RNA, 17 nt, Homo sapiens
aaaaauauuaaauagaa

SEQ ID NO: 1881308 - RNA, 16 nt, Homo sapiens
ucagccaggcugcuaa

SEQ ID NO: 1881309 - RNA, 13 nt, Homo sapiens
cauuucauuccau

SEQ ID NO: 1881310 - RNA, 15 nt, Homo sapiens
caccccuaaagagau

SEQ ID NO: 1881311 - RNA, 12 nt, Homo sapiens
aaaagugcagua

SEQ ID NO: 1881312 - RNA, 11 nt, Homo sapiens
aaccacaaagg

SEQ ID NO: 1881313 - RNA, 18 nt, Homo sapiens
gguuauuuauuuccuuag

SEQ ID NO: 1881314 - RNA, 13 nt, Homo sapiens
cugacuucaucug

SEQ ID NO: 1881315 - RNA, 19 nt, Homo sapiens
ggggagccaggaaagaaga

SEQ ID NO: 1881316 - RNA, 17 nt, Homo sapiens
uuucaugcccuugccua

SEQ ID NO: 1881317 - RNA, 15 nt, Homo sapiens
aauguugaauacuua

SEQ ID NO: 1881318 - RNA, 22 nt, Homo sapiens
uaauuucgccuuaaacucugga

SEQ ID NO: 1881319 - RNA, 19 nt, Homo sapiens
ucauguaaaugcucaaaga

SEQ ID NO: 1881320 - RNA, 23 nt, Homo sapiens
ugcgacauuagcauaaacacauc

SEQ ID NO: 1881321 - RNA, 16 nt, Homo sapiens
ugugaacugucuuggc

SEQ ID NO: 1881322 - RNA, 16 nt, Homo sapiens
cuucugauacguguau

SEQ ID NO: 1881323 - RNA, 19 nt, Homo sapiens
uugaacccucgguguacac

SEQ ID NO: 1881324 - RNA, 23 nt, Homo sapiens
aaugauuuaaauagaacuugauu

SEQ ID NO: 1881325 - RNA, 14 nt, Homo sapiens
uauuccaagggaau

SEQ ID NO: 1881326 - RNA, 16 nt, Homo sapiens
uaauagccauaugcaa

SEQ ID NO: 1881327 - RNA, 13 nt, Homo sapiens
ccacaacuuuaaa

SEQ ID NO: 1881328 - RNA, 22 nt, Homo sapiens
gcagcacuuuaacccucucuuc

SEQ ID NO: 1881329 - RNA, 13 nt, Homo sapiens
agaagaaacugcu

SEQ ID NO: 1881330 - RNA, 21 nt, Homo sapiens
agguuguucuagggacaggcc

SEQ ID NO: 1881331 - RNA, 20 nt, Homo sapiens
auccucacagugaacacuca

SEQ ID NO: 1881332 - RNA, 19 nt, Homo sapiens
gcugccuuuucucauucug

SEQ ID NO: 1881333 - RNA, 15 nt, Homo sapiens
accagcaaagcaaug

SEQ ID NO: 1881334 - RNA, 21 nt, Homo sapiens
cauuuuuuuguacuaauguga

SEQ ID NO: 1881335 - RNA, 14 nt, Homo sapiens
gcugcagagcagug

SEQ ID NO: 1881336 - RNA, 16 nt, Homo sapiens
agccuagugaacugca

SEQ ID NO: 1881337 - RNA, 23 nt, Homo sapiens
ucccuugauggucucaagcuaug

SEQ ID NO: 1881338 - RNA, 15 nt, Homo sapiens
ugagaaaacugagag

SEQ ID NO: 1881339 - RNA, 17 nt, Homo sapiens
gacuuggagaauacugc

SEQ ID NO: 1881340 - RNA, 18 nt, Homo sapiens
cugaacccagaaacaaca

SEQ ID NO: 1881341 - RNA, 23 nt, Homo sapiens
auuucuacuucuggaagucaucu

SEQ ID NO: 1881342 - RNA, 17 nt, Homo sapiens
caucuugcaaaacuaca

SEQ ID NO: 1881343 - RNA, 13 nt, Homo sapiens
ccauuaccuccau

SEQ ID NO: 1881344 - RNA, 23 nt, Homo sapiens
agcucugccucccucuccauauc

SEQ ID NO: 1881345 - RNA, 20 nt, Homo sapiens
aaaacuagaauuucauuuau

SEQ ID NO: 1881346 - RNA, 12 nt, Homo sapiens
uacuucuuuauu

SEQ ID NO: 1881347 - RNA, 23 nt, Homo sapiens
cacaacaaaagcuuuugauaaau

SEQ ID NO: 1881348 - RNA, 22 nt, Homo sapiens
accaaguguguugggaauugca

SEQ ID NO: 1881349 - RNA, 14 nt, Homo sapiens
aaugacccaaagac

SEQ ID NO: 1881350 - RNA, 21 nt, Homo sapiens
agguuuuuuugucaacauugu

SEQ ID NO: 1881351 - RNA, 14 nt, Homo sapiens
guauacuauaguac

SEQ ID NO: 1881352 - RNA, 18 nt, Homo sapiens
caacucuuuuaagugccu

SEQ ID NO: 1881353 - RNA, 12 nt, Homo sapiens
uaugccaaaaug

SEQ ID NO: 1881354 - RNA, 12 nt, Homo sapiens
ugacccaaagac

SEQ ID NO: 1881355 - RNA, 12 nt, Homo sapiens
uggaccaaagga

SEQ ID NO: 1881356 - RNA, 12 nt, Homo sapiens
ugagccaaagag

SEQ ID NO: 1881357 - RNA, 12 nt, Homo sapiens
ugaaccaaagaa

SEQ ID NO: 1881358 - RNA, 13 nt, Homo sapiens
gccaacccuguga

SEQ ID NO: 1881359 - RNA, 14 nt, Homo sapiens
ucauugcugacaga

SEQ ID NO: 1881360 - RNA, 16 nt, Homo sapiens
uucccaucauacccuu

SEQ ID NO: 1881361 - RNA, 12 nt, Homo sapiens
aagaggggccag

SEQ ID NO: 1881362 - RNA, 19 nt, Homo sapiens
gcuggggaggagcuuuguu

SEQ ID NO: 1881363 - RNA, 15 nt, Homo sapiens
gucucuaaccauuca

SEQ ID NO: 1881364 - RNA, 21 nt, Homo sapiens
ccuagcacuuugggaggccaa

SEQ ID NO: 1881365 - RNA, 14 nt, Homo sapiens
ucuaaguaaauaca

SEQ ID NO: 1881366 - RNA, 18 nt, Homo sapiens
guaauauuuuacuuugag

SEQ ID NO: 1881367 - RNA, 14 nt, Homo sapiens
auuguuaccaugaa

SEQ ID NO: 1881368 - RNA, 14 nt, Homo sapiens
ccaaaggacauuau

SEQ ID NO: 1881369 - RNA, 23 nt, Homo sapiens
uguuccuucuggggcuuugccau

SEQ ID NO: 1881370 - RNA, 18 nt, Homo sapiens
aaaucaauacacuaguug

SEQ ID NO: 1881371 - RNA, 12 nt, Homo sapiens
uaaccaguauuu

SEQ ID NO: 1881372 - RNA, 16 nt, Homo sapiens
aggugggagcaucucc

SEQ ID NO: 1881373 - RNA, 16 nt, Homo sapiens
aggccccaugaccucc

SEQ ID NO: 1881374 - RNA, 18 nt, Homo sapiens
uaaauaaaaggacuguga

SEQ ID NO: 1881375 - RNA, 18 nt, Homo sapiens
cuaagaauucaaacuggg

SEQ ID NO: 1881376 - RNA, 17 nt, Homo sapiens
cacagaggacucacuug

SEQ ID NO: 1881377 - RNA, 15 nt, Homo sapiens
ggucugcuccuggga

SEQ ID NO: 1881378 - RNA, 19 nt, Homo sapiens
gcugcagguguuugaccuc

SEQ ID NO: 1881379 - RNA, 20 nt, Homo sapiens
acagcuacuugggaggcuga

SEQ ID NO: 1881380 - RNA, 14 nt, Homo sapiens
agcccucucagauc

SEQ ID NO: 1881381 - RNA, 14 nt, Homo sapiens
guucauucauucag

SEQ ID NO: 1881382 - RNA, 16 nt, Homo sapiens
agccuuuugaugucuu

SEQ ID NO: 1881383 - RNA, 11 nt, Homo sapiens
ccuugugauug

SEQ ID NO: 1881384 - RNA, 22 nt, Homo sapiens
uccaugacugcauuuuacugua

SEQ ID NO: 1881385 - RNA, 17 nt, Homo sapiens
uaaguuccacugagcuc

SEQ ID NO: 1881386 - RNA, 21 nt, Homo sapiens
ugacuuauuuguaguuguuag

SEQ ID NO: 1881387 - RNA, 21 nt, Homo sapiens
uaauaaaaccggucacugaug

SEQ ID NO: 1881388 - RNA, 19 nt, Homo sapiens
auaauguuccuuaguggua

SEQ ID NO: 1881389 - RNA, 21 nt, Homo sapiens
cucugggucuggcauuauaaa

SEQ ID NO: 1881390 - RNA, 20 nt, Homo sapiens
cagccagacgcauccugcca

SEQ ID NO: 1881391 - RNA, 18 nt, Homo sapiens
gcucucacuccaggacag

SEQ ID NO: 1881392 - RNA, 21 nt, Homo sapiens
gugguagccaucaagcacuuc

SEQ ID NO: 1881393 - RNA, 18 nt, Homo sapiens
ugguuguauuaaagcagg

SEQ ID NO: 1881394 - RNA, 14 nt, Homo sapiens
aggauuguggucac

SEQ ID NO: 1881395 - RNA, 22 nt, Homo sapiens
ccuugcaggagugacucaagaa

SEQ ID NO: 1881396 - RNA, 15 nt, Homo sapiens
agcuuguaggagcug

SEQ ID NO: 1881397 - RNA, 13 nt, Homo sapiens
uguaacagcauua

SEQ ID NO: 1881398 - RNA, 20 nt, Homo sapiens
caaacucccaggaccuggag

SEQ ID NO: 1881399 - RNA, 16 nt, Homo sapiens
augauucagcucccuu

SEQ ID NO: 1881400 - RNA, 13 nt, Homo sapiens
aaguguucagugu

SEQ ID NO: 1881401 - RNA, 15 nt, Homo sapiens
cuucaaguuuucuca

SEQ ID NO: 1881402 - RNA, 20 nt, Homo sapiens
gguccaaauaggcaucauca

SEQ ID NO: 1881403 - RNA, 20 nt, Homo sapiens
cauccggccaaaugcaaaau

SEQ ID NO: 1881404 - RNA, 15 nt, Homo sapiens
cccaugccaguuuug

SEQ ID NO: 1881405 - RNA, 19 nt, Homo sapiens
cuccaagccauucacuucc

SEQ ID NO: 1881406 - RNA, 15 nt, Homo sapiens
uuguugaaaccugcu

SEQ ID NO: 1881407 - RNA, 14 nt, Homo sapiens
cuucagguuuuauc

SEQ ID NO: 1881408 - RNA, 18 nt, Homo sapiens
guuuccuggccucagagc

SEQ ID NO: 1881409 - RNA, 22 nt, Homo sapiens
cugccggaaucacuucuccaau

SEQ ID NO: 1881410 - RNA, 16 nt, Homo sapiens
aauguguaagacaaaa

SEQ ID NO: 1881411 - RNA, 21 nt, Homo sapiens
aacugaacuuaaucaugucgu

SEQ ID NO: 1881412 - RNA, 15 nt, Homo sapiens
gacuucacugcagcc

SEQ ID NO: 1881413 - RNA, 20 nt, Homo sapiens
cugaggugccugcucaggug

SEQ ID NO: 1881414 - RNA, 12 nt, Homo sapiens
agcacaccucag

SEQ ID NO: 1881415 - RNA, 18 nt, Homo sapiens
agaaggcucuucugacua

SEQ ID NO: 1881416 - RNA, 17 nt, Homo sapiens
ccugcaccccugcaguu

SEQ ID NO: 1881417 - RNA, 18 nt, Homo sapiens
ggucuaaagugagcucua

SEQ ID NO: 1881418 - RNA, 13 nt, Homo sapiens
aaccccucucuca

SEQ ID NO: 1881419 - RNA, 15 nt, Homo sapiens
ugggaggcugugauu

SEQ ID NO: 1881420 - RNA, 23 nt, Homo sapiens
gaacauaaaaaauaaaguaccac

SEQ ID NO: 1881421 - RNA, 13 nt, Homo sapiens
gacauuugccaac

SEQ ID NO: 1881422 - RNA, 22 nt, Homo sapiens
cauuuggauaaaaggaaccaac

SEQ ID NO: 1881423 - RNA, 20 nt, Homo sapiens
gcuaaauuuggguacugggu

SEQ ID NO: 1881424 - RNA, 14 nt, Homo sapiens
caugcgaugugucc

SEQ ID NO: 1881425 - RNA, 17 nt, Homo sapiens
uggaaacacauacuccu

SEQ ID NO: 1881426 - RNA, 13 nt, Homo sapiens
uguaauaucauuu

SEQ ID NO: 1881427 - RNA, 13 nt, Homo sapiens
agggcagguagcu

SEQ ID NO: 1881428 - RNA, 13 nt, Homo sapiens
cucccucuguguu

SEQ ID NO: 1881429 - RNA, 13 nt, Homo sapiens
cguaauaagguuu

SEQ ID NO: 1881430 - RNA, 17 nt, Homo sapiens
aacaggcucacagagau

SEQ ID NO: 1881431 - RNA, 19 nt, Homo sapiens
agugcaagccccugcucca

SEQ ID NO: 1881432 - RNA, 16 nt, Homo sapiens
gguuccgccacuccag

SEQ ID NO: 1881433 - RNA, 15 nt, Homo sapiens
ugucuguugcuugua

SEQ ID NO: 1881434 - RNA, 13 nt, Homo sapiens
guucccuguucug

SEQ ID NO: 1881435 - RNA, 14 nt, Homo sapiens
cugacaccaagaag

SEQ ID NO: 1881436 - RNA, 14 nt, Homo sapiens
aaugagugcaccug

SEQ ID NO: 1881437 - RNA, 13 nt, Homo sapiens
uaguuugugcugu

SEQ ID NO: 1881438 - RNA, 22 nt, Homo sapiens
accuuuguacgcuuugcucaaa

SEQ ID NO: 1881439 - RNA, 17 nt, Homo sapiens
gcuguggggaacacagc

SEQ ID NO: 1881440 - RNA, 13 nt, Homo sapiens
agcaggucuuuca

SEQ ID NO: 1881441 - RNA, 18 nt, Homo sapiens
ccugcaggcuuagguccu

SEQ ID NO: 1881442 - RNA, 15 nt, Homo sapiens
caaagucaacuucca

SEQ ID NO: 1881443 - RNA, 21 nt, Homo sapiens
gcuggagaggagcccugccuc

SEQ ID NO: 1881444 - RNA, 15 nt, Homo sapiens
gcagaaugaagccau

SEQ ID NO: 1881445 - RNA, 16 nt, Homo sapiens
cuacauaauacccagg

SEQ ID NO: 1881446 - RNA, 15 nt, Homo sapiens
uucccuuagacuuua

SEQ ID NO: 1881447 - RNA, 17 nt, Homo sapiens
agaguuggggaaggcaa

SEQ ID NO: 1881448 - RNA, 15 nt, Homo sapiens
acaauauacuuguau

SEQ ID NO: 1881449 - RNA, 16 nt, Homo sapiens
auuaaguaaacuaaug

SEQ ID NO: 1881450 - RNA, 15 nt, Homo sapiens
aacuugcaacuuuga

SEQ ID NO: 1881451 - RNA, 12 nt, Homo sapiens
cauauuucacag

SEQ ID NO: 1881452 - RNA, 20 nt, Homo sapiens
cuuccugaaauaaacacugg

SEQ ID NO: 1881453 - RNA, 14 nt, Homo sapiens
ugcuaaaccauuca

SEQ ID NO: 1881454 - RNA, 13 nt, Homo sapiens
uaaauugugaaag

SEQ ID NO: 1881455 - RNA, 19 nt, Homo sapiens
ugccaaaaaggauacauaa

SEQ ID NO: 1881456 - RNA, 13 nt, Homo sapiens
uugaaacuaguua

SEQ ID NO: 1881457 - RNA, 17 nt, Homo sapiens
caaguaaaacuguggua

SEQ ID NO: 1881458 - RNA, 20 nt, Homo sapiens
agccaagaugacacaacugc

SEQ ID NO: 1881459 - RNA, 23 nt, Homo sapiens
ugcaacagggaggcauagucucu

SEQ ID NO: 1881460 - RNA, 17 nt, Homo sapiens
aaauguuuugaguguua

SEQ ID NO: 1881461 - RNA, 19 nt, Homo sapiens
gucuucuaauuucaaaaau

SEQ ID NO: 1881462 - RNA, 19 nt, Homo sapiens
cggacagcccuuccuccca

SEQ ID NO: 1881463 - RNA, 16 nt, Homo sapiens
caaaauguucaguuua

SEQ ID NO: 1881464 - RNA, 13 nt, Homo sapiens
gggugguggcaca

SEQ ID NO: 1881465 - RNA, 22 nt, Homo sapiens
caaaacuauacuugaacaaaag

SEQ ID NO: 1881466 - RNA, 11 nt, Homo sapiens
agaauuugcac

SEQ ID NO: 1881467 - RNA, 14 nt, Homo sapiens
acauucacacaggg

SEQ ID NO: 1881468 - RNA, 19 nt, Homo sapiens
gaguuccccugucuguccc

SEQ ID NO: 1881469 - RNA, 21 nt, Homo sapiens
gcauaaagcugggaggccaaa

SEQ ID NO: 1881470 - RNA, 21 nt, Homo sapiens
uguguauggaagacaaauaca

SEQ ID NO: 1881471 - RNA, 23 nt, Homo sapiens
cauagcaauuccccuacaucaaa

SEQ ID NO: 1881472 - RNA, 16 nt, Homo sapiens
ugcauucacccagaca

SEQ ID NO: 1881473 - RNA, 13 nt, Homo sapiens
acaguggggccag

SEQ ID NO: 1881474 - RNA, 18 nt, Homo sapiens
auccaccccaucccagac

SEQ ID NO: 1881475 - RNA, 21 nt, Homo sapiens
aacccugcuguuucauuguua

SEQ ID NO: 1881476 - RNA, 23 nt, Homo sapiens
agugcuccuccguguggacugug

SEQ ID NO: 1881477 - RNA, 19 nt, Homo sapiens
uugaaugcagucuguccag

SEQ ID NO: 1881478 - RNA, 14 nt, Homo sapiens
cuuccccuccaaaa

SEQ ID NO: 1881479 - RNA, 20 nt, Homo sapiens
aggauggggugucuguguua

SEQ ID NO: 1881480 - RNA, 16 nt, Homo sapiens
caagucaucuggauga

SEQ ID NO: 1881481 - RNA, 18 nt, Homo sapiens
cuaugaaaauuauaucuc

SEQ ID NO: 1881482 - RNA, 18 nt, Homo sapiens
aguuguuuggaugauuaa

SEQ ID NO: 1881483 - RNA, 15 nt, Homo sapiens
cuuugaaucugggac

SEQ ID NO: 1881484 - RNA, 14 nt, Homo sapiens
ccaaggagaaggca

SEQ ID NO: 1881485 - RNA, 14 nt, Homo sapiens
ucucuucuucggga

SEQ ID NO: 1881486 - RNA, 17 nt, Homo sapiens
gccucccuucaugcaug

SEQ ID NO: 1881487 - RNA, 15 nt, Homo sapiens
acaaaacaagugcaa

SEQ ID NO: 1881488 - RNA, 20 nt, Homo sapiens
caaacaacugaaauguggau

SEQ ID NO: 1881489 - RNA, 20 nt, Homo sapiens
cucccugagagccacaggug

SEQ ID NO: 1881490 - RNA, 13 nt, Homo sapiens
ggcagagaggguc

SEQ ID NO: 1881491 - RNA, 21 nt, Homo sapiens
caaccaugcaaauugugaaau

SEQ ID NO: 1881492 - RNA, 16 nt, Homo sapiens
aguuacaaacagacca

SEQ ID NO: 1881493 - RNA, 16 nt, Homo sapiens
aaccagagccacaggc

SEQ ID NO: 1881494 - RNA, 15 nt, Homo sapiens
aauauaugucugaua

SEQ ID NO: 1881495 - RNA, 19 nt, Homo sapiens
uugaaucccuuaaacucag

SEQ ID NO: 1881496 - RNA, 16 nt, Homo sapiens
cacuccuuuacaacca

SEQ ID NO: 1881497 - RNA, 16 nt, Homo sapiens
gcuggcagagggcauc

SEQ ID NO: 1881498 - RNA, 15 nt, Homo sapiens
aaacucccagccaca

SEQ ID NO: 1881499 - RNA, 15 nt, Homo sapiens
aauuuaccacaaaag

SEQ ID NO: 1881500 - RNA, 12 nt, Homo sapiens
gcuaugcaaaau

SEQ ID NO: 1881501 - RNA, 20 nt, Homo sapiens
ccucgcggcucuccagggcu

SEQ ID NO: 1881502 - RNA, 23 nt, Homo sapiens
ugugcguccauauuuaacaugua

SEQ ID NO: 1881503 - RNA, 22 nt, Homo sapiens
agcccgguaagagcaaaagaau

SEQ ID NO: 1881504 - RNA, 19 nt, Homo sapiens
cuuuguuuuuuaauguugu

SEQ ID NO: 1881505 - RNA, 23 nt, Homo sapiens
cccauuccugccugguccagugg

SEQ ID NO: 1881506 - RNA, 17 nt, Homo sapiens
augauccuugcugauaa

SEQ ID NO: 1881507 - RNA, 17 nt, Homo sapiens
uucuauaggaacauaug

SEQ ID NO: 1881508 - RNA, 22 nt, Homo sapiens
guaaauugacguacuugcaguu

SEQ ID NO: 1881509 - RNA, 16 nt, Homo sapiens
uguccaggaacugccu

SEQ ID NO: 1881510 - RNA, 18 nt, Homo sapiens
uuguaacuuuuugcacua

SEQ ID NO: 1881511 - RNA, 16 nt, Homo sapiens
gucccugcugcugcca

SEQ ID NO: 1881512 - RNA, 12 nt, Homo sapiens
uaugcuggccag

SEQ ID NO: 1881513 - RNA, 16 nt, Homo sapiens
uaaauguauaugucau

SEQ ID NO: 1881514 - RNA, 11 nt, Homo sapiens
gaaagcuuugu

SEQ ID NO: 1881515 - RNA, 15 nt, Homo sapiens
gguccuuccuaccuc

SEQ ID NO: 1881516 - RNA, 16 nt, Homo sapiens
caugauuagauugcaa

SEQ ID NO: 1881517 - RNA, 17 nt, Homo sapiens
gcaauaagccauucuaa

SEQ ID NO: 1881518 - RNA, 11 nt, Homo sapiens
gucccaccagg

SEQ ID NO: 1881519 - RNA, 19 nt, Homo sapiens
cuucccugguaccuagcaa

SEQ ID NO: 1881520 - RNA, 21 nt, Homo sapiens
caggcaagcuuauucuuuccu

SEQ ID NO: 1881521 - RNA, 21 nt, Homo sapiens
cucagggacuggcacacuggc

SEQ ID NO: 1881522 - RNA, 20 nt, Homo sapiens
ggauaauauccacugcaaua

SEQ ID NO: 1881523 - RNA, 22 nt, Homo sapiens
cauuuuggaaguuuucaggacu

SEQ ID NO: 1881524 - RNA, 14 nt, Homo sapiens
caauugcugccaau

SEQ ID NO: 1881525 - RNA, 23 nt, Homo sapiens
auuacaggugugugccaccacac

SEQ ID NO: 1881526 - RNA, 23 nt, Homo sapiens
acugaccaucucccagaccgcca

SEQ ID NO: 1881527 - RNA, 21 nt, Homo sapiens
uagugccucuguuaccaccac

SEQ ID NO: 1881528 - RNA, 13 nt, Homo sapiens
uccgucucaaaaa

SEQ ID NO: 1881529 - RNA, 12 nt, Homo sapiens
cugcaagacaca

SEQ ID NO: 1881530 - RNA, 12 nt, Homo sapiens
cuccaagacaga

SEQ ID NO: 1881531 - RNA, 21 nt, Homo sapiens
uugucagauucacacaugcca

SEQ ID NO: 1881532 - RNA, 22 nt, Homo sapiens
aggccagucugaaccugagguu

SEQ ID NO: 1881533 - RNA, 13 nt, Homo sapiens
agccaugaucaug

SEQ ID NO: 1881534 - RNA, 15 nt, Homo sapiens
gccuguggauuugau

SEQ ID NO: 1881535 - RNA, 21 nt, Homo sapiens
gccuaaaguacagccuggacc

SEQ ID NO: 1881536 - RNA, 15 nt, Homo sapiens
ccacaaccacaugua

SEQ ID NO: 1881537 - RNA, 16 nt, Homo sapiens
ugcaaaucuuuuaaca

SEQ ID NO: 1881538 - RNA, 22 nt, Homo sapiens
accgaggagggagagucuccca

SEQ ID NO: 1881539 - RNA, 19 nt, Homo sapiens
acagucauaauguguugug

SEQ ID NO: 1881540 - RNA, 13 nt, Homo sapiens
cuuagaugagauc

SEQ ID NO: 1881541 - RNA, 17 nt, Homo sapiens
uaugcaauucaguguuc

SEQ ID NO: 1881542 - RNA, 18 nt, Homo sapiens
gcugagaaccacggugaa

SEQ ID NO: 1881543 - RNA, 21 nt, Homo sapiens
ggaauaauaugaugccacuuu

SEQ ID NO: 1881544 - RNA, 20 nt, Homo sapiens
cuccggaggagacacaguua

SEQ ID NO: 1881545 - RNA, 21 nt, Homo sapiens
cuguccuucugaagugugucc

SEQ ID NO: 1881546 - RNA, 15 nt, Homo sapiens
cuugaccuguuucuc

SEQ ID NO: 1881547 - RNA, 18 nt, Homo sapiens
agugcacaccgugugcca

SEQ ID NO: 1881548 - RNA, 20 nt, Homo sapiens
agaaugaaauguaugugcuc

SEQ ID NO: 1881549 - RNA, 14 nt, Homo sapiens
accuccugucucug

SEQ ID NO: 1881550 - RNA, 19 nt, Homo sapiens
ugcaaucuucuacuuuaag

SEQ ID NO: 1881551 - RNA, 15 nt, Homo sapiens
auaaaagaucuugaa

SEQ ID NO: 1881552 - RNA, 22 nt, Homo sapiens
aucuuaccagaugcuacuggac

SEQ ID NO: 1881553 - RNA, 16 nt, Homo sapiens
auuaauacuguaguua

SEQ ID NO: 1881554 - RNA, 16 nt, Homo sapiens
cuuccaaggaaaagca

SEQ ID NO: 1881555 - RNA, 15 nt, Homo sapiens
gggucuggcauuaua

SEQ ID NO: 1881556 - RNA, 22 nt, Homo sapiens
uauaagagggcauauacaguga

SEQ ID NO: 1881557 - RNA, 15 nt, Homo sapiens
gaaagcugcugugau

SEQ ID NO: 1881558 - RNA, 14 nt, Homo sapiens
gcaccagggcucac

SEQ ID NO: 1881559 - RNA, 23 nt, Homo sapiens
cuaggucugagaacucaggcuuu

SEQ ID NO: 1881560 - RNA, 15 nt, Homo sapiens
ucaccugaaacacuu

SEQ ID NO: 1881561 - RNA, 16 nt, Homo sapiens
cacuuccccacaggcu

SEQ ID NO: 1881562 - RNA, 19 nt, Homo sapiens
cuucauuucaucuaccauu

SEQ ID NO: 1881563 - RNA, 18 nt, Homo sapiens
ucucgcucuguugcccag

SEQ ID NO: 1881564 - RNA, 17 nt, Homo sapiens
aaagcccuugaaccagc

SEQ ID NO: 1881565 - RNA, 17 nt, Homo sapiens
ccuccagguuuaucuuu

SEQ ID NO: 1881566 - RNA, 13 nt, Homo sapiens
uuccaucuuguaa

SEQ ID NO: 1881567 - RNA, 13 nt, Homo sapiens
ccucuccagcuuu

SEQ ID NO: 1881568 - RNA, 17 nt, Homo sapiens
cauuauuaaauguuucu

SEQ ID NO: 1881569 - RNA, 18 nt, Homo sapiens
uaaaagcaauccauguga

SEQ ID NO: 1881570 - RNA, 23 nt, Homo sapiens
cauuagugaauuacacucaagga

SEQ ID NO: 1881571 - RNA, 17 nt, Homo sapiens
uuuguaauacuuuacaa

SEQ ID NO: 1881572 - RNA, 18 nt, Homo sapiens
uuucaccuauccagagag

SEQ ID NO: 1881573 - RNA, 19 nt, Homo sapiens
auaaugguugacuggguuu

SEQ ID NO: 1881574 - RNA, 16 nt, Homo sapiens
gaugcuggacuugccu

SEQ ID NO: 1881575 - RNA, 23 nt, Homo sapiens
gagaacuucaaucacuguagucu

SEQ ID NO: 1881576 - RNA, 15 nt, Homo sapiens
uuugaucacacagcc

SEQ ID NO: 1881577 - RNA, 22 nt, Homo sapiens
auuuacagacugaugccagaca

SEQ ID NO: 1881578 - RNA, 19 nt, Homo sapiens
gcccucugcugcuuuccaa

SEQ ID NO: 1881579 - RNA, 22 nt, Homo sapiens
cccagcugugacugagggccug

SEQ ID NO: 1881580 - RNA, 20 nt, Homo sapiens
uugggauccuauugaaccau

SEQ ID NO: 1881581 - RNA, 20 nt, Homo sapiens
auucugccuuugccagguga

SEQ ID NO: 1881582 - RNA, 14 nt, Homo sapiens
cuccaagaagcccu

SEQ ID NO: 1881583 - RNA, 19 nt, Homo sapiens
cagguaggggcacagugaa

SEQ ID NO: 1881584 - RNA, 15 nt, Homo sapiens
cuuuugggucugucc

SEQ ID NO: 1881585 - RNA, 21 nt, Homo sapiens
gacguuggccucagggccagg

SEQ ID NO: 1881586 - RNA, 21 nt, Homo sapiens
gcaauagacacauacauguca

SEQ ID NO: 1881587 - RNA, 21 nt, Homo sapiens
uagauggggagccucgggaaa

SEQ ID NO: 1881588 - RNA, 19 nt, Homo sapiens
caaguguccugaaagcuua

SEQ ID NO: 1881589 - RNA, 14 nt, Homo sapiens
gcuagcucugccaa

SEQ ID NO: 1881590 - RNA, 22 nt, Homo sapiens
acuggacaaagaauuccaaagc

SEQ ID NO: 1881591 - RNA, 20 nt, Homo sapiens
uauauuggaaauaucacccc

SEQ ID NO: 1881592 - RNA, 19 nt, Homo sapiens
ggaaggcuaauauauucca

SEQ ID NO: 1881593 - RNA, 21 nt, Homo sapiens
cacagauuauaccuggaugau

SEQ ID NO: 1881594 - RNA, 15 nt, Homo sapiens
aaagaugauggaaac

SEQ ID NO: 1881595 - RNA, 14 nt, Homo sapiens
auaaagugacccug

SEQ ID NO: 1881596 - RNA, 14 nt, Homo sapiens
uuuugagggagcaa

SEQ ID NO: 1881597 - RNA, 14 nt, Homo sapiens
auauugcagucaau

SEQ ID NO: 1881598 - RNA, 12 nt, Homo sapiens
gaucgcuuugua

SEQ ID NO: 1881599 - RNA, 16 nt, Homo sapiens
uuaaauaauagacaua

SEQ ID NO: 1881600 - RNA, 13 nt, Homo sapiens
ccagaagcacugg

SEQ ID NO: 1881601 - RNA, 22 nt, Homo sapiens
ccaaggugucauuuauguguca

SEQ ID NO: 1881602 - RNA, 13 nt, Homo sapiens
agccacugugaua

SEQ ID NO: 1881603 - RNA, 18 nt, Homo sapiens
gcagcuucucuccacuga

SEQ ID NO: 1881604 - RNA, 12 nt, Homo sapiens
uuuugguaucua

SEQ ID NO: 1881605 - RNA, 22 nt, Homo sapiens
ccccuaaguuuuauacuugauu

SEQ ID NO: 1881606 - RNA, 18 nt, Homo sapiens
acugguagaaaaacaucu

SEQ ID NO: 1881607 - RNA, 20 nt, Homo sapiens
cuagauuaaaauauccuuuc

SEQ ID NO: 1881608 - RNA, 21 nt, Homo sapiens
ucucuucuggcuuucugagca

SEQ ID NO: 1881609 - RNA, 20 nt, Homo sapiens
ugcaaauagcaaaacuaaau

SEQ ID NO: 1881610 - RNA, 14 nt, Homo sapiens
uguaguagccuuuc

SEQ ID NO: 1881611 - RNA, 23 nt, Homo sapiens
uccugccugagaauguuaccaga

SEQ ID NO: 1881612 - RNA, 12 nt, Homo sapiens
aaaugugaugcu

SEQ ID NO: 1881613 - RNA, 13 nt, Homo sapiens
cucuuuaacaagg

SEQ ID NO: 1881614 - RNA, 13 nt, Homo sapiens
ucuccuguggucu

SEQ ID NO: 1881615 - RNA, 16 nt, Homo sapiens
uccuggcaucucuugu

SEQ ID NO: 1881616 - RNA, 17 nt, Homo sapiens
uggagaucacagcccca

SEQ ID NO: 1881617 - RNA, 14 nt, Homo sapiens
uucccuaaacugca

SEQ ID NO: 1881618 - RNA, 16 nt, Homo sapiens
ucugucaccaagccuu

SEQ ID NO: 1881619 - RNA, 23 nt, Homo sapiens
ugcuuuccuuuuuuaaaaaugca

SEQ ID NO: 1881620 - RNA, 14 nt, Homo sapiens
aacucugcaccuaa

SEQ ID NO: 1881621 - RNA, 13 nt, Homo sapiens
aacucacugugcu

SEQ ID NO: 1881622 - RNA, 12 nt, Homo sapiens
uaagacugauaa

SEQ ID NO: 1881623 - RNA, 19 nt, Homo sapiens
gaggagccggccaccagau

SEQ ID NO: 1881624 - RNA, 21 nt, Homo sapiens
aaucaugugaaauuuaggcag

SEQ ID NO: 1881625 - RNA, 16 nt, Homo sapiens
ugccuguauacuuuag

SEQ ID NO: 1881626 - RNA, 18 nt, Homo sapiens
cugcugagacgccacgga

SEQ ID NO: 1881627 - RNA, 17 nt, Homo sapiens
ugcaucuuauuucuguc

SEQ ID NO: 1881628 - RNA, 14 nt, Homo sapiens
gggauuaucuguca

SEQ ID NO: 1881629 - RNA, 13 nt, Homo sapiens
aauaaacauguca

SEQ ID NO: 1881630 - RNA, 20 nt, Homo sapiens
ugccucugacacacagcucu

SEQ ID NO: 1881631 - RNA, 18 nt, Homo sapiens
acauccauugucucuuca

SEQ ID NO: 1881632 - RNA, 18 nt, Homo sapiens
guguguauccgacucuaa

SEQ ID NO: 1881633 - RNA, 21 nt, Homo sapiens
cucaaagauuggauuuuacag

SEQ ID NO: 1881634 - RNA, 23 nt, Homo sapiens
acucccuucucggggugggacag

SEQ ID NO: 1881635 - RNA, 23 nt, Homo sapiens
aacagauuggauuuuauguugac

SEQ ID NO: 1881636 - RNA, 18 nt, Homo sapiens
auuuuaguuuuaauucca

SEQ ID NO: 1881637 - RNA, 18 nt, Homo sapiens
aagcggagcuugcaguga

SEQ ID NO: 1881638 - RNA, 15 nt, Homo sapiens
aaaaauaaaguacgu

SEQ ID NO: 1881639 - RNA, 11 nt, Homo sapiens
uguacauagac

SEQ ID NO: 1881640 - RNA, 21 nt, Homo sapiens
aguaagaaccuugccugaaca

SEQ ID NO: 1881641 - RNA, 16 nt, Homo sapiens
cuccacccacugugga

SEQ ID NO: 1881642 - RNA, 23 nt, Homo sapiens
aacauuaguucuauuucuauccc

SEQ ID NO: 1881643 - RNA, 16 nt, Homo sapiens
ugacuuaagcacacuu

SEQ ID NO: 1881644 - RNA, 20 nt, Homo sapiens
cucaccugcuggggaccuca

SEQ ID NO: 1881645 - RNA, 16 nt, Homo sapiens
gucaccugcuccagaa

SEQ ID NO: 1881646 - RNA, 15 nt, Homo sapiens
auaacugucuuguuu

SEQ ID NO: 1881647 - RNA, 13 nt, Homo sapiens
uauaccaaaaggg

SEQ ID NO: 1881648 - RNA, 14 nt, Homo sapiens
caggccaugugguu

SEQ ID NO: 1881649 - RNA, 22 nt, Homo sapiens
gucaccaggauuacuagucaaa

SEQ ID NO: 1881650 - RNA, 14 nt, Homo sapiens
ccccugagcccacu

SEQ ID NO: 1881651 - RNA, 14 nt, Homo sapiens
gccacuaggcccug

SEQ ID NO: 1881652 - RNA, 20 nt, Homo sapiens
acagauguagcaacaugaga

SEQ ID NO: 1881653 - RNA, 20 nt, Homo sapiens
aacugaagugugcugugaca

SEQ ID NO: 1881654 - RNA, 23 nt, Homo sapiens
caggagucagugcccauguguau

SEQ ID NO: 1881655 - RNA, 18 nt, Homo sapiens
ucaugccacccugcauuu

SEQ ID NO: 1881656 - RNA, 19 nt, Homo sapiens
aauguauuuuaagugaauu

SEQ ID NO: 1881657 - RNA, 17 nt, Homo sapiens
acuaguccugacacuga

SEQ ID NO: 1881658 - RNA, 13 nt, Homo sapiens
cuagcaguggcag

SEQ ID NO: 1881659 - RNA, 13 nt, Homo sapiens
ggcaagugauauc

SEQ ID NO: 1881660 - RNA, 12 nt, Homo sapiens
cgggaaaaccaa

SEQ ID NO: 1881661 - RNA, 17 nt, Homo sapiens
gcaccccacuccucagu

SEQ ID NO: 1881662 - RNA, 15 nt, Homo sapiens
ucuggagagacugug

SEQ ID NO: 1881663 - RNA, 14 nt, Homo sapiens
gucuacacugccuu

SEQ ID NO: 1881664 - RNA, 14 nt, Homo sapiens
ugucccguggcauu

SEQ ID NO: 1881665 - RNA, 18 nt, Homo sapiens
guaaauauccacagacuc

SEQ ID NO: 1881666 - RNA, 22 nt, Homo sapiens
uguggugggagggguguuccaa

SEQ ID NO: 1881667 - RNA, 16 nt, Homo sapiens
uuuaggugccuggaua

SEQ ID NO: 1881668 - RNA, 22 nt, Homo sapiens
cugcccccacacccacuccaca

SEQ ID NO: 1881669 - RNA, 17 nt, Homo sapiens
aguguaacagauaucag

SEQ ID NO: 1881670 - RNA, 23 nt, Homo sapiens
auuagauagaaaagguccaaaac

SEQ ID NO: 1881671 - RNA, 19 nt, Homo sapiens
cucuucuuggggcccagug

SEQ ID NO: 1881672 - RNA, 13 nt, Homo sapiens
ccacuggggacuu

SEQ ID NO: 1881673 - RNA, 12 nt, Homo sapiens
cagcccgucucc

SEQ ID NO: 1881674 - RNA, 23 nt, Homo sapiens
ucuuaaugcagacaaacaaacau

SEQ ID NO: 1881675 - RNA, 15 nt, Homo sapiens
gccaccccuccuucc

SEQ ID NO: 1881676 - RNA, 23 nt, Homo sapiens
uuaaaagggaacacaaaacauuu

SEQ ID NO: 1881677 - RNA, 13 nt, Homo sapiens
ugucuaauuugca

SEQ ID NO: 1881678 - RNA, 22 nt, Homo sapiens
auccauugucucuucaugucua

SEQ ID NO: 1881679 - RNA, 12 nt, Homo sapiens
cuaaaugcagaa

SEQ ID NO: 1881680 - RNA, 22 nt, Homo sapiens
aggaagacacacuggaugugau

SEQ ID NO: 1881681 - RNA, 13 nt, Homo sapiens
cuucccaaaacca

SEQ ID NO: 1881682 - RNA, 15 nt, Homo sapiens
cagacacgauugaga

SEQ ID NO: 1881683 - RNA, 19 nt, Homo sapiens
uagaauagcauuugccacu

SEQ ID NO: 1881684 - RNA, 19 nt, Homo sapiens
gaccacagcaucauuuugc

SEQ ID NO: 1881685 - RNA, 12 nt, Homo sapiens
gcuuugcagcug

SEQ ID NO: 1881686 - RNA, 12 nt, Homo sapiens
caugugcacauu

SEQ ID NO: 1881687 - RNA, 11 nt, Homo sapiens
gaaaugaagga

SEQ ID NO: 1881688 - RNA, 11 nt, Homo sapiens
ugaaugaauaa

SEQ ID NO: 1881689 - RNA, 16 nt, Homo sapiens
auccugagcaaacaaa

SEQ ID NO: 1881690 - RNA, 17 nt, Homo sapiens
gcccucaacuauucugu

SEQ ID NO: 1881691 - RNA, 21 nt, Homo sapiens
agaccagucacagccauuuca

SEQ ID NO: 1881692 - RNA, 13 nt, Homo sapiens
cuggacaagccaa

SEQ ID NO: 1881693 - RNA, 18 nt, Homo sapiens
aucuucuuuuucaggcuc

SEQ ID NO: 1881694 - RNA, 14 nt, Homo sapiens
ccuuuuauaauacu

SEQ ID NO: 1881695 - RNA, 21 nt, Homo sapiens
aggggucugaacgucuccuag

SEQ ID NO: 1881696 - RNA, 14 nt, Homo sapiens
gaucaauuucuccc

SEQ ID NO: 1881697 - RNA, 22 nt, Homo sapiens
aaauccccuuaugacuugcuac

SEQ ID NO: 1881698 - RNA, 20 nt, Homo sapiens
agcagaaaacagaggccaca

SEQ ID NO: 1881699 - RNA, 21 nt, Homo sapiens
auuacacaucaagcgaugaaa

SEQ ID NO: 1881700 - RNA, 12 nt, Homo sapiens
uuuaaugaguca

SEQ ID NO: 1881701 - RNA, 22 nt, Homo sapiens
acagaagacagcagcaagugug

SEQ ID NO: 1881702 - RNA, 18 nt, Homo sapiens
uguugugagagcugggau

SEQ ID NO: 1881703 - RNA, 22 nt, Homo sapiens
cuuuguauuaugugucacaugg

SEQ ID NO: 1881704 - RNA, 17 nt, Homo sapiens
ccuguguacugccuuaa

SEQ ID NO: 1881705 - RNA, 19 nt, Homo sapiens
ucacuguuguacacagucu

SEQ ID NO: 1881706 - RNA, 15 nt, Homo sapiens
gaaagauugcuauaa

SEQ ID NO: 1881707 - RNA, 14 nt, Homo sapiens
cuauauaugacugg

SEQ ID NO: 1881708 - RNA, 15 nt, Homo sapiens
ccucugcugaacaaa

SEQ ID NO: 1881709 - RNA, 14 nt, Homo sapiens
uuagaaauauaucu

SEQ ID NO: 1881710 - RNA, 22 nt, Homo sapiens
auccauauuacguuguuucuua

SEQ ID NO: 1881711 - RNA, 16 nt, Homo sapiens
cuucagacucauggau

SEQ ID NO: 1881712 - RNA, 14 nt, Homo sapiens
uccauccugcucuu

SEQ ID NO: 1881713 - RNA, 16 nt, Homo sapiens
cguaagggaucuuccu

SEQ ID NO: 1881714 - RNA, 21 nt, Homo sapiens
aguaaaauuucaggauuaacu

SEQ ID NO: 1881715 - RNA, 22 nt, Homo sapiens
caguccacuucugacagccuca

SEQ ID NO: 1881716 - RNA, 19 nt, Homo sapiens
ugcugagagaccucaggga

SEQ ID NO: 1881717 - RNA, 14 nt, Homo sapiens
aagucaaccugcuu

SEQ ID NO: 1881718 - RNA, 13 nt, Homo sapiens
auguggucucagg

SEQ ID NO: 1881719 - RNA, 22 nt, Homo sapiens
caagccaagugcccucucugaa

SEQ ID NO: 1881720 - RNA, 16 nt, Homo sapiens
uaacuguacauuucac

SEQ ID NO: 1881721 - RNA, 23 nt, Homo sapiens
guggcagcuggggagcagcugag

SEQ ID NO: 1881722 - RNA, 14 nt, Homo sapiens
uguucugcacugaa

SEQ ID NO: 1881723 - RNA, 16 nt, Homo sapiens
uucuacuguauaaaca

SEQ ID NO: 1881724 - RNA, 21 nt, Homo sapiens
acguucuggaacauucuguca

SEQ ID NO: 1881725 - RNA, 18 nt, Homo sapiens
ggagucagaaaccaaagu

SEQ ID NO: 1881726 - RNA, 17 nt, Homo sapiens
auuaccucugauaccuc

SEQ ID NO: 1881727 - RNA, 16 nt, Homo sapiens
gggccaggagaaagaa

SEQ ID NO: 1881728 - RNA, 16 nt, Homo sapiens
cuacauguauugcaca

SEQ ID NO: 1881729 - RNA, 18 nt, Homo sapiens
uuucaguggacuaucuua

SEQ ID NO: 1881730 - RNA, 22 nt, Homo sapiens
uccucugcaguguggcaagcaa

SEQ ID NO: 1881731 - RNA, 12 nt, Homo sapiens
uaguauuggcaa

SEQ ID NO: 1881732 - RNA, 22 nt, Homo sapiens
cuuuaugcaaauacaaucagcc

SEQ ID NO: 1881733 - RNA, 15 nt, Homo sapiens
gcagaggccugagga

SEQ ID NO: 1881734 - RNA, 16 nt, Homo sapiens
cuaggauuuuaaggga

SEQ ID NO: 1881735 - RNA, 21 nt, Homo sapiens
auuuuccgcccucaaaaugac

SEQ ID NO: 1881736 - RNA, 16 nt, Homo sapiens
uaucaguaccucucaa

SEQ ID NO: 1881737 - RNA, 21 nt, Homo sapiens
gugugcacaugcgcacucuca

SEQ ID NO: 1881738 - RNA, 14 nt, Homo sapiens
uguuuaaucauaua

SEQ ID NO: 1881739 - RNA, 18 nt, Homo sapiens
uguagucccagcuacuca

SEQ ID NO: 1881740 - RNA, 17 nt, Homo sapiens
caggccccgugaggcaa

SEQ ID NO: 1881741 - RNA, 18 nt, Homo sapiens
cccugucaccuagcucaa

SEQ ID NO: 1881742 - RNA, 15 nt, Homo sapiens
uuuacauuuaucugu

SEQ ID NO: 1881743 - RNA, 23 nt, Homo sapiens
ccugcucucuggagguacugaga

SEQ ID NO: 1881744 - RNA, 18 nt, Homo sapiens
aaguagaggggacgugag

SEQ ID NO: 1881745 - RNA, 22 nt, Homo sapiens
uauaaacauugguauauuucca

SEQ ID NO: 1881746 - RNA, 22 nt, Homo sapiens
augcagagauaauggcauguau

SEQ ID NO: 1881747 - RNA, 20 nt, Homo sapiens
cuggcuguggguaucaggac

SEQ ID NO: 1881748 - RNA, 19 nt, Homo sapiens
cugaaggacacuuccugcc

SEQ ID NO: 1881749 - RNA, 20 nt, Homo sapiens
ugguauauucagucucugug

SEQ ID NO: 1881750 - RNA, 19 nt, Homo sapiens
gcaaaguucccuacuuccu

SEQ ID NO: 1881751 - RNA, 18 nt, Homo sapiens
auggaagccaaaguauuc

SEQ ID NO: 1881752 - RNA, 13 nt, Homo sapiens
uaagucauuccaa

SEQ ID NO: 1881753 - RNA, 20 nt, Homo sapiens
uacugcacuaccaaauucau

SEQ ID NO: 1881754 - RNA, 20 nt, Homo sapiens
gccuaugguuuuucuguguc

SEQ ID NO: 1881755 - RNA, 11 nt, Homo sapiens
gaccucugggc

SEQ ID NO: 1881756 - RNA, 11 nt, Homo sapiens
gguauuugaau

SEQ ID NO: 1881757 - RNA, 13 nt, Homo sapiens
cacaaggacccuu

SEQ ID NO: 1881758 - RNA, 13 nt, Homo sapiens
ccauaggacaaau

SEQ ID NO: 1881759 - RNA, 20 nt, Homo sapiens
agagcuuuuaaaaauguccu

SEQ ID NO: 1881760 - RNA, 20 nt, Homo sapiens
cuccccacaggggggaggca

SEQ ID NO: 1881761 - RNA, 23 nt, Homo sapiens
agcuggcucuccaccuuguuaca

SEQ ID NO: 1881762 - RNA, 21 nt, Homo sapiens
auauuucuccaagaaagccaa

SEQ ID NO: 1881763 - RNA, 20 nt, Homo sapiens
acuuuagaguagcaugagag

SEQ ID NO: 1881764 - RNA, 16 nt, Homo sapiens
acaucagaaguuugca

SEQ ID NO: 1881765 - RNA, 21 nt, Homo sapiens
auucugaccuuacaaaagugu

SEQ ID NO: 1881766 - RNA, 15 nt, Homo sapiens
uuguguuauuucacu

SEQ ID NO: 1881767 - RNA, 14 nt, Homo sapiens
aagcccccagcugg

SEQ ID NO: 1881768 - RNA, 17 nt, Homo sapiens
uucucccaagcccacgu

SEQ ID NO: 1881769 - RNA, 16 nt, Homo sapiens
ugggaacuaauuucaa

SEQ ID NO: 1881770 - RNA, 18 nt, Homo sapiens
agcacaugcacuacugaa

SEQ ID NO: 1881771 - RNA, 22 nt, Homo sapiens
caguacuauaaguacugaguac

SEQ ID NO: 1881772 - RNA, 15 nt, Homo sapiens
gaaugacuuacuuuc

SEQ ID NO: 1881773 - RNA, 22 nt, Homo sapiens
aaauuguauuaucaacagcauu

SEQ ID NO: 1881774 - RNA, 19 nt, Homo sapiens
ugaucucagcucacucugc

SEQ ID NO: 1881775 - RNA, 21 nt, Homo sapiens
gcaucuucccaaaaccauuga

SEQ ID NO: 1881776 - RNA, 13 nt, Homo sapiens
aaagauacaugau

SEQ ID NO: 1881777 - RNA, 13 nt, Homo sapiens
uaaguuacuugaa

SEQ ID NO: 1881778 - RNA, 20 nt, Homo sapiens
uggggccccuaagcuccuag

SEQ ID NO: 1881779 - RNA, 15 nt, Homo sapiens
cacagucaguggaga

SEQ ID NO: 1881780 - RNA, 18 nt, Homo sapiens
cacagauguguugcaaag

SEQ ID NO: 1881781 - RNA, 14 nt, Homo sapiens
uaaugaaacaaaga

SEQ ID NO: 1881782 - RNA, 23 nt, Homo sapiens
cuucugggaagacaacuaggaua

SEQ ID NO: 1881783 - RNA, 21 nt, Homo sapiens
guauuucaggugaagcuggag

SEQ ID NO: 1881784 - RNA, 17 nt, Homo sapiens
auuaauuccaugugaua

SEQ ID NO: 1881785 - RNA, 18 nt, Homo sapiens
cagcugguucgugguuuu

SEQ ID NO: 1881786 - RNA, 13 nt, Homo sapiens
aaaguagccacgu

SEQ ID NO: 1881787 - RNA, 17 nt, Homo sapiens
gacaaggaggaguucca

SEQ ID NO: 1881788 - RNA, 13 nt, Homo sapiens
accgaagcccaga

SEQ ID NO: 1881789 - RNA, 20 nt, Homo sapiens
gcaguggacucaaaacccau

SEQ ID NO: 1881790 - RNA, 23 nt, Homo sapiens
ugggacuacaggcgugagccacc

SEQ ID NO: 1881791 - RNA, 13 nt, Homo sapiens
ugugucauagaau

SEQ ID NO: 1881792 - RNA, 16 nt, Homo sapiens
agcucgguacccgggg

SEQ ID NO: 1881793 - RNA, 21 nt, Homo sapiens
uaugauucuccucucccaaau

SEQ ID NO: 1881794 - RNA, 19 nt, Homo sapiens
aaaagaaaugaaauugaca

SEQ ID NO: 1881795 - RNA, 22 nt, Homo sapiens
cagaauuuguugcuaauuugcc

SEQ ID NO: 1881796 - RNA, 11 nt, Homo sapiens
gauuucagagc

SEQ ID NO: 1881797 - RNA, 18 nt, Homo sapiens
ucagaagauuagcaugaa

SEQ ID NO: 1881798 - RNA, 14 nt, Homo sapiens
aagaaccucuccau

SEQ ID NO: 1881799 - RNA, 14 nt, Homo sapiens
cagcacuguuuuca

SEQ ID NO: 1881800 - RNA, 19 nt, Homo sapiens
auggacuuacccuaaagau

SEQ ID NO: 1881801 - RNA, 20 nt, Homo sapiens
ugauuugucccagccugggg

SEQ ID NO: 1881802 - RNA, 22 nt, Homo sapiens
cagugugcuccagauggugcua

SEQ ID NO: 1881803 - RNA, 18 nt, Homo sapiens
uauuaggagacacaggga

SEQ ID NO: 1881804 - RNA, 13 nt, Homo sapiens
acuucacagagac

SEQ ID NO: 1881805 - RNA, 22 nt, Homo sapiens
ggugggugcucaagacuggcau

SEQ ID NO: 1881806 - RNA, 17 nt, Homo sapiens
cugaagccuggauucca

SEQ ID NO: 1881807 - RNA, 16 nt, Homo sapiens
uaaugaauacuuucuu

SEQ ID NO: 1881808 - RNA, 14 nt, Homo sapiens
aaaaauuaggccgu

SEQ ID NO: 1881809 - RNA, 17 nt, Homo sapiens
aaauugcuguuccuuaa

SEQ ID NO: 1881810 - RNA, 14 nt, Homo sapiens
aagcuggcccugcc

SEQ ID NO: 1881811 - RNA, 11 nt, Homo sapiens
cguccacaggg

SEQ ID NO: 1881812 - RNA, 15 nt, Homo sapiens
auuuauaaguugaag

SEQ ID NO: 1881813 - RNA, 20 nt, Homo sapiens
ugccauuggacuauggagug

SEQ ID NO: 1881814 - RNA, 12 nt, Homo sapiens
ucaaaguggcaa

SEQ ID NO: 1881815 - RNA, 12 nt, Homo sapiens
guaaaguguuaa

SEQ ID NO: 1881816 - RNA, 15 nt, Homo sapiens
cacccuccuacaggu

SEQ ID NO: 1881817 - RNA, 17 nt, Homo sapiens
ucucuguauuccuagaa

SEQ ID NO: 1881818 - RNA, 19 nt, Homo sapiens
uaaauuacuuuuucauucu

SEQ ID NO: 1881819 - RNA, 14 nt, Homo sapiens
cugggcucagcuca

SEQ ID NO: 1881820 - RNA, 16 nt, Homo sapiens
auuuuucacauaucua

SEQ ID NO: 1881821 - RNA, 17 nt, Homo sapiens
gccugggaucuggcaca

SEQ ID NO: 1881822 - RNA, 21 nt, Homo sapiens
agauagcuuucuuucccuuac

SEQ ID NO: 1881823 - RNA, 17 nt, Homo sapiens
ccagcucccagccacau

SEQ ID NO: 1881824 - RNA, 16 nt, Homo sapiens
auuuaucccuggugca

SEQ ID NO: 1881825 - RNA, 16 nt, Homo sapiens
agccgaggucaugcca

SEQ ID NO: 1881826 - RNA, 22 nt, Homo sapiens
uguguacagaaacaacugccaa

SEQ ID NO: 1881827 - RNA, 19 nt, Homo sapiens
ugaaaaaguuaaugcuuaa

SEQ ID NO: 1881828 - RNA, 16 nt, Homo sapiens
auguuuuacacuguac

SEQ ID NO: 1881829 - RNA, 13 nt, Homo sapiens
ggaauucaucucu

SEQ ID NO: 1881830 - RNA, 15 nt, Homo sapiens
aaucuaacaucgugg

SEQ ID NO: 1881831 - RNA, 13 nt, Homo sapiens
ugaaauuuuaccg

SEQ ID NO: 1881832 - RNA, 12 nt, Homo sapiens
cuuccacuuugc

SEQ ID NO: 1881833 - RNA, 18 nt, Homo sapiens
ucuuuauguccauaagcu

SEQ ID NO: 1881834 - RNA, 19 nt, Homo sapiens
aggcgagagaggagccaga

SEQ ID NO: 1881835 - RNA, 21 nt, Homo sapiens
aguauauucaaccaaauacuu

SEQ ID NO: 1881836 - RNA, 11 nt, Homo sapiens
aggccacugcc

SEQ ID NO: 1881837 - RNA, 16 nt, Homo sapiens
ggcaugccccggccac

SEQ ID NO: 1881838 - RNA, 15 nt, Homo sapiens
uccuaaucaaaaagg

SEQ ID NO: 1881839 - RNA, 12 nt, Homo sapiens
cagucaguucau

SEQ ID NO: 1881840 - RNA, 17 nt, Homo sapiens
auggaccuucucuccag

SEQ ID NO: 1881841 - RNA, 19 nt, Homo sapiens
ccguugcgggguggaguga

SEQ ID NO: 1881842 - RNA, 22 nt, Homo sapiens
cagguguucuacacucaucuua

SEQ ID NO: 1881843 - RNA, 17 nt, Homo sapiens
cagaacucaaaugagcc

SEQ ID NO: 1881844 - RNA, 20 nt, Homo sapiens
gccggcuccaguuuccccau

SEQ ID NO: 1881845 - RNA, 21 nt, Homo sapiens
cacacugacauaauguaguga

SEQ ID NO: 1881846 - RNA, 17 nt, Homo sapiens
cugucuucguacuggga

SEQ ID NO: 1881847 - RNA, 15 nt, Homo sapiens
uggucauacggguca

SEQ ID NO: 1881848 - RNA, 23 nt, Homo sapiens
ucuccacaggcaggcucauuuca

SEQ ID NO: 1881849 - RNA, 15 nt, Homo sapiens
agaaaacauaaucuu

SEQ ID NO: 1881850 - RNA, 15 nt, Homo sapiens
ugaggagccucccag

SEQ ID NO: 1881851 - RNA, 17 nt, Homo sapiens
gugucaucaaguaguag

SEQ ID NO: 1881852 - RNA, 20 nt, Homo sapiens
aacauuguacuguaauggag

SEQ ID NO: 1881853 - RNA, 19 nt, Homo sapiens
gcagcacugcccaucagug

SEQ ID NO: 1881854 - RNA, 13 nt, Homo sapiens
ucauuuacugugg

SEQ ID NO: 1881855 - RNA, 13 nt, Homo sapiens
acaguuacaguug

SEQ ID NO: 1881856 - RNA, 17 nt, Homo sapiens
cuuugcaggacuugcac

SEQ ID NO: 1881857 - RNA, 15 nt, Homo sapiens
cauccucucacugca

SEQ ID NO: 1881858 - RNA, 13 nt, Homo sapiens
cgugggcucccug

SEQ ID NO: 1881859 - RNA, 17 nt, Homo sapiens
uaaugauuagcacuuaa

SEQ ID NO: 1881860 - RNA, 14 nt, Homo sapiens
acccagcauguaca

SEQ ID NO: 1881861 - RNA, 14 nt, Homo sapiens
uccacccuguuacu

SEQ ID NO: 1881862 - RNA, 17 nt, Homo sapiens
uacaacuucaagugcau

SEQ ID NO: 1881863 - RNA, 16 nt, Homo sapiens
auuuccccagccacag

SEQ ID NO: 1881864 - RNA, 22 nt, Homo sapiens
ccuccuuuaccgaggacagccu

SEQ ID NO: 1881865 - RNA, 20 nt, Homo sapiens
cguguaauuggcccaaguca

SEQ ID NO: 1881866 - RNA, 17 nt, Homo sapiens
ccucaagugauccaccu

SEQ ID NO: 1881867 - RNA, 18 nt, Homo sapiens
ucacaaagcuaaauacau

SEQ ID NO: 1881868 - RNA, 12 nt, Homo sapiens
gugcaaagggaa

SEQ ID NO: 1881869 - RNA, 23 nt, Homo sapiens
cuuaucuuggaaucaugcaaaaa

SEQ ID NO: 1881870 - RNA, 23 nt, Homo sapiens
augauaaaauuccgagucuuucu

SEQ ID NO: 1881871 - RNA, 19 nt, Homo sapiens
uaaauucuuuggaacuuua

SEQ ID NO: 1881872 - RNA, 19 nt, Homo sapiens
gugacaguggcguuuguaa

SEQ ID NO: 1881873 - RNA, 17 nt, Homo sapiens
caucaaauuauuaaucu

SEQ ID NO: 1881874 - RNA, 23 nt, Homo sapiens
agcuguccugcagcaaacacucc

SEQ ID NO: 1881875 - RNA, 19 nt, Homo sapiens
gccuccauuucucugggac

SEQ ID NO: 1881876 - RNA, 23 nt, Homo sapiens
uccggugucuggaaaagcacuuu

SEQ ID NO: 1881877 - RNA, 20 nt, Homo sapiens
aauaccuuuucucacaaaaa

SEQ ID NO: 1881878 - RNA, 14 nt, Homo sapiens
uucauauguacuug

SEQ ID NO: 1881879 - RNA, 18 nt, Homo sapiens
accuaguggcccuucaca

SEQ ID NO: 1881880 - RNA, 17 nt, Homo sapiens
uuuaaauguauuuuaca

SEQ ID NO: 1881881 - RNA, 17 nt, Homo sapiens
acuguaagaguucacau

SEQ ID NO: 1881882 - RNA, 13 nt, Homo sapiens
uuugcaagacaua

SEQ ID NO: 1881883 - RNA, 16 nt, Homo sapiens
ccagcuccaaggggaa

SEQ ID NO: 1881884 - RNA, 19 nt, Homo sapiens
uggcuccuuaggaacagcu

SEQ ID NO: 1881885 - RNA, 14 nt, Homo sapiens
guuuaccuuuuaau

SEQ ID NO: 1881886 - RNA, 15 nt, Homo sapiens
cacucuucuugagca

SEQ ID NO: 1881887 - RNA, 22 nt, Homo sapiens
cccuuucaguauguccccauaa

SEQ ID NO: 1881888 - RNA, 17 nt, Homo sapiens
uccagucaugugugcau

SEQ ID NO: 1881889 - RNA, 19 nt, Homo sapiens
auguuccugccccacagga

SEQ ID NO: 1881890 - RNA, 19 nt, Homo sapiens
gcagccccacaacuuuaaa

SEQ ID NO: 1881891 - RNA, 12 nt, Homo sapiens
agccugcauuga

SEQ ID NO: 1881892 - RNA, 15 nt, Homo sapiens
auucaagucagcucu

SEQ ID NO: 1881893 - RNA, 20 nt, Homo sapiens
ggauuaaugguccugugaug

SEQ ID NO: 1881894 - RNA, 11 nt, Homo sapiens
acacuguaaug

SEQ ID NO: 1881895 - RNA, 19 nt, Homo sapiens
ugugcuauuuuacuuguaa

SEQ ID NO: 1881896 - RNA, 15 nt, Homo sapiens
aaaucaacuugugua

SEQ ID NO: 1881897 - RNA, 12 nt, Homo sapiens
aucacacuguaa

SEQ ID NO: 1881898 - RNA, 14 nt, Homo sapiens
aaugauuuuaucug

SEQ ID NO: 1881899 - RNA, 18 nt, Homo sapiens
acaugucagccacuguga

SEQ ID NO: 1881900 - RNA, 12 nt, Homo sapiens
caauaagccagc

SEQ ID NO: 1881901 - RNA, 13 nt, Homo sapiens
agguaacaguuau

SEQ ID NO: 1881902 - RNA, 13 nt, Homo sapiens
cccagauguugca

SEQ ID NO: 1881903 - RNA, 23 nt, Homo sapiens
acacuuugcuccucuggcccaag

SEQ ID NO: 1881904 - RNA, 16 nt, Homo sapiens
ccauccuugacuuuga

SEQ ID NO: 1881905 - RNA, 13 nt, Homo sapiens
cucagcaacaagg

SEQ ID NO: 1881906 - RNA, 21 nt, Homo sapiens
gcagcuaccacgggucugcca

SEQ ID NO: 1881907 - RNA, 17 nt, Homo sapiens
cugucuccuuucucagc

SEQ ID NO: 1881908 - RNA, 16 nt, Homo sapiens
cuacauauuugcacug

SEQ ID NO: 1881909 - RNA, 19 nt, Homo sapiens
uuaacuguuguagaagaca

SEQ ID NO: 1881910 - RNA, 20 nt, Homo sapiens
gggcacagaaaauggaagac

SEQ ID NO: 1881911 - RNA, 19 nt, Homo sapiens
cuugcaaccuaccuguuga

SEQ ID NO: 1881912 - RNA, 16 nt, Homo sapiens
ggugcucacgacucuu

SEQ ID NO: 1881913 - RNA, 19 nt, Homo sapiens
gcugggagaaauacuugaa

SEQ ID NO: 1881914 - RNA, 22 nt, Homo sapiens
cauacguguuaggaggcugcau

SEQ ID NO: 1881915 - RNA, 11 nt, Homo sapiens
guagccucaac

SEQ ID NO: 1881916 - RNA, 14 nt, Homo sapiens
uaccauggugccau

SEQ ID NO: 1881917 - RNA, 20 nt, Homo sapiens
ccuuguuucaaaauucucau

SEQ ID NO: 1881918 - RNA, 18 nt, Homo sapiens
acaguguucugugacaaa

SEQ ID NO: 1881919 - RNA, 21 nt, Homo sapiens
aauuugggggacuuacaugau

SEQ ID NO: 1881920 - RNA, 19 nt, Homo sapiens
uagcuuuuaccaacccaaa

SEQ ID NO: 1881921 - RNA, 14 nt, Homo sapiens
acuuuaaaaugcga

SEQ ID NO: 1881922 - RNA, 13 nt, Homo sapiens
ucauguaucuuau

SEQ ID NO: 1881923 - RNA, 20 nt, Homo sapiens
uagagugcauuacuuugaau

SEQ ID NO: 1881924 - RNA, 12 nt, Homo sapiens
uaaaauugugag

SEQ ID NO: 1881925 - RNA, 18 nt, Homo sapiens
uguuugauuucaacauga

SEQ ID NO: 1881926 - RNA, 14 nt, Homo sapiens
gcugggucaggggu

SEQ ID NO: 1881927 - RNA, 18 nt, Homo sapiens
gcauccugugugcugaca

SEQ ID NO: 1881928 - RNA, 18 nt, Homo sapiens
ucaugacccuccugucca

SEQ ID NO: 1881929 - RNA, 22 nt, Homo sapiens
ggcaagagaauugaaaugaggu

SEQ ID NO: 1881930 - RNA, 14 nt, Homo sapiens
agagggaagcugag

SEQ ID NO: 1881931 - RNA, 16 nt, Homo sapiens
agucuuuucauugcua

SEQ ID NO: 1881932 - RNA, 17 nt, Homo sapiens
augugguugauaaugau

SEQ ID NO: 1881933 - RNA, 13 nt, Homo sapiens
gaaggcagccgcc

SEQ ID NO: 1881934 - RNA, 16 nt, Homo sapiens
uaaaaauuuacuacaa

SEQ ID NO: 1881935 - RNA, 13 nt, Homo sapiens
uauauauauagua

SEQ ID NO: 1881936 - RNA, 17 nt, Homo sapiens
acggguaccaugcugcc

SEQ ID NO: 1881937 - RNA, 20 nt, Homo sapiens
gugguugggaaacucauuua

SEQ ID NO: 1881938 - RNA, 18 nt, Homo sapiens
gcccagaaagaggcagug

SEQ ID NO: 1881939 - RNA, 14 nt, Homo sapiens
gguuaacaccagag

SEQ ID NO: 1881940 - RNA, 18 nt, Homo sapiens
ucgugcauaggcaaagaa

SEQ ID NO: 1881941 - RNA, 21 nt, Homo sapiens
uacaugucuagagaacacugu

SEQ ID NO: 1881942 - RNA, 18 nt, Homo sapiens
ggggaagaguggucuuga

SEQ ID NO: 1881943 - RNA, 21 nt, Homo sapiens
aaugacuaagccaagcugugu

SEQ ID NO: 1881944 - RNA, 23 nt, Homo sapiens
gucaucaauaguguccuaugcaa

SEQ ID NO: 1881945 - RNA, 20 nt, Homo sapiens
ugucauugcgaccauuucuc

SEQ ID NO: 1881946 - RNA, 20 nt, Homo sapiens
aggcauugauugcacuugau

SEQ ID NO: 1881947 - RNA, 21 nt, Homo sapiens
uacaccuaacucaccuaacuc

SEQ ID NO: 1881948 - RNA, 20 nt, Homo sapiens
cuuuuguaaaauaaaaccac

SEQ ID NO: 1881949 - RNA, 18 nt, Homo sapiens
uucuugacaaucaucucc

SEQ ID NO: 1881950 - RNA, 13 nt, Homo sapiens
gaggaaagauuca

SEQ ID NO: 1881951 - RNA, 23 nt, Homo sapiens
cuguaaccgcuucuggggccaca

SEQ ID NO: 1881952 - RNA, 15 nt, Homo sapiens
acugaaaaaugucag

SEQ ID NO: 1881953 - RNA, 20 nt, Homo sapiens
agaagagaggacacaucucc

SEQ ID NO: 1881954 - RNA, 20 nt, Homo sapiens
uacauggaauaacauguaau

SEQ ID NO: 1881955 - RNA, 20 nt, Homo sapiens
gucagugcuucgugccucga

SEQ ID NO: 1881956 - RNA, 16 nt, Homo sapiens
uggguugaaagccaag

SEQ ID NO: 1881957 - RNA, 17 nt, Homo sapiens
uauuuugaauauguaaa

SEQ ID NO: 1881958 - RNA, 14 nt, Homo sapiens
uccucucucagggg

SEQ ID NO: 1881959 - RNA, 15 nt, Homo sapiens
cagacucgggaccaa

SEQ ID NO: 1881960 - RNA, 22 nt, Homo sapiens
gcacauuuuucucuuguuuucu

SEQ ID NO: 1881961 - RNA, 15 nt, Homo sapiens
aucccagcagcagag

SEQ ID NO: 1881962 - RNA, 13 nt, Homo sapiens
aucuauuauuaca

SEQ ID NO: 1881963 - RNA, 16 nt, Homo sapiens
uugaaagcauccaugu

SEQ ID NO: 1881964 - RNA, 20 nt, Homo sapiens
guaccugcaaguauccagac

SEQ ID NO: 1881965 - RNA, 13 nt, Homo sapiens
agacuacagguga

SEQ ID NO: 1881966 - RNA, 12 nt, Homo sapiens
cagcucuucucc

SEQ ID NO: 1881967 - RNA, 16 nt, Homo sapiens
ucaagauuccauuucu

SEQ ID NO: 1881968 - RNA, 20 nt, Homo sapiens
auccuaucuggggagcuccu

SEQ ID NO: 1881969 - RNA, 20 nt, Homo sapiens
gucagaauuucccucugaua

SEQ ID NO: 1881970 - RNA, 16 nt, Homo sapiens
accaaauaaagcaaag

SEQ ID NO: 1881971 - RNA, 23 nt, Homo sapiens
cuuaaaauaaugaauacauuucc

SEQ ID NO: 1881972 - RNA, 16 nt, Homo sapiens
auuuucuuucacuuaa

SEQ ID NO: 1881973 - RNA, 18 nt, Homo sapiens
agcauugcuggacucuga

SEQ ID NO: 1881974 - RNA, 15 nt, Homo sapiens
cgugguccauuccau

SEQ ID NO: 1881975 - RNA, 23 nt, Homo sapiens
cagaccaccugccagccaucaca

SEQ ID NO: 1881976 - RNA, 22 nt, Homo sapiens
ucaugugcgaacacagugacac

SEQ ID NO: 1881977 - RNA, 17 nt, Homo sapiens
guggugacaccuccccc

SEQ ID NO: 1881978 - RNA, 21 nt, Homo sapiens
cuuguccugggucugugucag

SEQ ID NO: 1881979 - RNA, 21 nt, Homo sapiens
agaagauagaugcacuuaugc

SEQ ID NO: 1881980 - RNA, 18 nt, Homo sapiens
cuuccuaaguagcugggu

SEQ ID NO: 1881981 - RNA, 22 nt, Homo sapiens
ggcuaaaugcaccaagaaagcu

SEQ ID NO: 1881982 - RNA, 19 nt, Homo sapiens
gcauaggugauccauguaa

SEQ ID NO: 1881983 - RNA, 16 nt, Homo sapiens
uacucuugaugugaag

SEQ ID NO: 1881984 - RNA, 23 nt, Homo sapiens
ucacaauuauuaccaucucucca

SEQ ID NO: 1881985 - RNA, 21 nt, Homo sapiens
aaggugguuacuuggaccaga

SEQ ID NO: 1881986 - RNA, 22 nt, Homo sapiens
cacccaacugucucgaugcaau

SEQ ID NO: 1881987 - RNA, 22 nt, Homo sapiens
uaaauuacguaugcaagucugu

SEQ ID NO: 1881988 - RNA, 11 nt, Homo sapiens
cagaagaucug

SEQ ID NO: 1881989 - RNA, 14 nt, Homo sapiens
aauuaucacaucau

SEQ ID NO: 1881990 - RNA, 19 nt, Homo sapiens
cucgccuaccaaucucugc

SEQ ID NO: 1881991 - RNA, 22 nt, Homo sapiens
caaaauggagagaauacaauaa

SEQ ID NO: 1881992 - RNA, 13 nt, Homo sapiens
cagagaagguaag

SEQ ID NO: 1881993 - RNA, 16 nt, Homo sapiens
cauguuuaaauagccu

SEQ ID NO: 1881994 - RNA, 22 nt, Homo sapiens
uguggagggauugaacacaggc

SEQ ID NO: 1881995 - RNA, 23 nt, Homo sapiens
agcacaggcaccuauguggcaug

SEQ ID NO: 1881996 - RNA, 23 nt, Homo sapiens
uagaauaaauucccaacuucucu

SEQ ID NO: 1881997 - RNA, 20 nt, Homo sapiens
agcgcuaguggaggguugga

SEQ ID NO: 1881998 - RNA, 16 nt, Homo sapiens
gauccccucucuuccu

SEQ ID NO: 1881999 - RNA, 13 nt, Homo sapiens
ccagaggacacag

SEQ ID NO: 1882000 - RNA, 12 nt, Homo sapiens
guagaugggagg

SEQ ID NO: 1882001 - RNA, 22 nt, Homo sapiens
acccacccuguggcucacagug

SEQ ID NO: 1882002 - RNA, 16 nt, Homo sapiens
gaagaaaaacuagaca

SEQ ID NO: 1882003 - RNA, 18 nt, Homo sapiens
guuuuuauggaaggguaa

SEQ ID NO: 1882004 - RNA, 13 nt, Homo sapiens
aaauacucagggu

SEQ ID NO: 1882005 - RNA, 20 nt, Homo sapiens
uuuagaucccaugucaccuc

SEQ ID NO: 1882006 - RNA, 23 nt, Homo sapiens
ccucaggaacccacccucuccac

SEQ ID NO: 1882007 - RNA, 19 nt, Homo sapiens
agcaucuguccucaucagu

SEQ ID NO: 1882008 - RNA, 15 nt, Homo sapiens
uuugaaauaccucau

SEQ ID NO: 1882009 - RNA, 18 nt, Homo sapiens
ggagaaccucuccaaaga

SEQ ID NO: 1882010 - RNA, 21 nt, Homo sapiens
acugauaugguucuuauucac

SEQ ID NO: 1882011 - RNA, 13 nt, Homo sapiens
auuccagugccag

SEQ ID NO: 1882012 - RNA, 20 nt, Homo sapiens
gccauauucugguucuugaa

SEQ ID NO: 1882013 - RNA, 23 nt, Homo sapiens
aggaguuucacccugaccauugc

SEQ ID NO: 1882014 - RNA, 19 nt, Homo sapiens
acuuagcuggccacaguga

SEQ ID NO: 1882015 - RNA, 18 nt, Homo sapiens
caaggacccuccaggagu

SEQ ID NO: 1882016 - RNA, 17 nt, Homo sapiens
ccaugcuaagcaagcua

SEQ ID NO: 1882017 - RNA, 13 nt, Homo sapiens
gaucacaccacug

SEQ ID NO: 1882018 - RNA, 13 nt, Homo sapiens
ggaacacuggugg

SEQ ID NO: 1882019 - RNA, 20 nt, Homo sapiens
aggaaagaauuugccuucuc

SEQ ID NO: 1882020 - RNA, 16 nt, Homo sapiens
ccuaaaagcacacuca

SEQ ID NO: 1882021 - RNA, 20 nt, Homo sapiens
uguacaggacauguacugag

SEQ ID NO: 1882022 - RNA, 13 nt, Homo sapiens
auuacugugaauu

SEQ ID NO: 1882023 - RNA, 23 nt, Homo sapiens
acugagcucugccucaacuccac

SEQ ID NO: 1882024 - RNA, 20 nt, Homo sapiens
aaaauguuuuucaaaacaau

SEQ ID NO: 1882025 - RNA, 12 nt, Homo sapiens
caaggugggggc

SEQ ID NO: 1882026 - RNA, 22 nt, Homo sapiens
cuuagaacagauggcugugaaa

SEQ ID NO: 1882027 - RNA, 18 nt, Homo sapiens
cauugaaauguaauuuca

SEQ ID NO: 1882028 - RNA, 17 nt, Homo sapiens
caaggauuaaaucuggu

SEQ ID NO: 1882029 - RNA, 14 nt, Homo sapiens
uucuuuccuuuuca

SEQ ID NO: 1882030 - RNA, 14 nt, Homo sapiens
auccuuccauucca

SEQ ID NO: 1882031 - RNA, 18 nt, Homo sapiens
accaaauacaugauaaau

SEQ ID NO: 1882032 - RNA, 16 nt, Homo sapiens
gcaugaguuacugugc

SEQ ID NO: 1882033 - RNA, 16 nt, Homo sapiens
uuguaauugacacuau

SEQ ID NO: 1882034 - RNA, 23 nt, Homo sapiens
uggucugccucugagccacugga

SEQ ID NO: 1882035 - RNA, 22 nt, Homo sapiens
aaugguuguacguuuugcacau

SEQ ID NO: 1882036 - RNA, 23 nt, Homo sapiens
uuggugacuaucccaacagucau

SEQ ID NO: 1882037 - RNA, 18 nt, Homo sapiens
agaucucaucucaugaca

SEQ ID NO: 1882038 - RNA, 24 nt, Homo sapiens
cuuuaugaugcuaugguuugccau

SEQ ID NO: 1882039 - RNA, 13 nt, Homo sapiens
caagauccuuaau

SEQ ID NO: 1882040 - RNA, 14 nt, Homo sapiens
uagugauggagcuu

SEQ ID NO: 1882041 - RNA, 19 nt, Homo sapiens
cuucuaccuuugugcuaaa

SEQ ID NO: 1882042 - RNA, 20 nt, Homo sapiens
acggcucacgcuuaccucaa

SEQ ID NO: 1882043 - RNA, 11 nt, Homo sapiens
cuuaagccauc

SEQ ID NO: 1882044 - RNA, 16 nt, Homo sapiens
gagccuggcuccaaac

SEQ ID NO: 1882045 - RNA, 20 nt, Homo sapiens
cucccaggcuggagugcagu

SEQ ID NO: 1882046 - RNA, 22 nt, Homo sapiens
aaaugaaucucguucccaaaga

SEQ ID NO: 1882047 - RNA, 21 nt, Homo sapiens
ggcccagugacaaagacuccu

SEQ ID NO: 1882048 - RNA, 23 nt, Homo sapiens
gaacuguuuuguaagugcugcua

SEQ ID NO: 1882049 - RNA, 15 nt, Homo sapiens
uccaguuguauuuga

SEQ ID NO: 1882050 - RNA, 20 nt, Homo sapiens
ugucuucuggacuuggucuu

SEQ ID NO: 1882051 - RNA, 14 nt, Homo sapiens
uucaggaggcugga

SEQ ID NO: 1882052 - RNA, 19 nt, Homo sapiens
ugcaacaggcuugugcaac

SEQ ID NO: 1882053 - RNA, 19 nt, Homo sapiens
caagucccuugaccuuucc

SEQ ID NO: 1882054 - RNA, 15 nt, Homo sapiens
uuaaauucaaguuua

SEQ ID NO: 1882055 - RNA, 22 nt, Homo sapiens
uuuguauacaaauauauuguua

SEQ ID NO: 1882056 - RNA, 15 nt, Homo sapiens
agaccgugugugaaa

SEQ ID NO: 1882057 - RNA, 20 nt, Homo sapiens
cccuuaauaaacucacaacu

SEQ ID NO: 1882058 - RNA, 22 nt, Homo sapiens
cuagugaaagaggcagcuugaa

SEQ ID NO: 1882059 - RNA, 15 nt, Homo sapiens
agcaaauacaauuca

SEQ ID NO: 1882060 - RNA, 16 nt, Homo sapiens
uagguuugaaaguacu

SEQ ID NO: 1882061 - RNA, 17 nt, Homo sapiens
ucacuucagacaauuca

SEQ ID NO: 1882062 - RNA, 17 nt, Homo sapiens
cucacugcaagcacugc

SEQ ID NO: 1882063 - RNA, 13 nt, Homo sapiens
aacaaucauguaa

SEQ ID NO: 1882064 - RNA, 11 nt, Homo sapiens
caaugccagua

SEQ ID NO: 1882065 - RNA, 13 nt, Homo sapiens
ccagggcugccag

SEQ ID NO: 1882066 - RNA, 21 nt, Homo sapiens
ucuaagacuacuaaggccuuu

SEQ ID NO: 1882067 - RNA, 20 nt, Homo sapiens
agaugccuuccugucuuucu

SEQ ID NO: 1882068 - RNA, 16 nt, Homo sapiens
aagaauuuuaccauuc

SEQ ID NO: 1882069 - RNA, 21 nt, Homo sapiens
agcauacgguaugauauugca

SEQ ID NO: 1882070 - RNA, 19 nt, Homo sapiens
acccccaccacucuugacu

SEQ ID NO: 1882071 - RNA, 15 nt, Homo sapiens
aacuuguagcauuaa

SEQ ID NO: 1882072 - RNA, 18 nt, Homo sapiens
aggacugugaccaaagca

SEQ ID NO: 1882073 - RNA, 16 nt, Homo sapiens
ggagguugguuccuug

SEQ ID NO: 1882074 - RNA, 19 nt, Homo sapiens
gaccuggugggagcaccug

SEQ ID NO: 1882075 - RNA, 12 nt, Homo sapiens
auuucagccaaa

SEQ ID NO: 1882076 - RNA, 24 nt, Homo sapiens
cacugcuaaaauagaauauagcau

SEQ ID NO: 1882077 - RNA, 12 nt, Homo sapiens
ccuaaaaaucug

SEQ ID NO: 1882078 - RNA, 13 nt, Homo sapiens
caaagcguggaca

SEQ ID NO: 1882079 - RNA, 22 nt, Homo sapiens
caagaauaaauuuuucuucucu

SEQ ID NO: 1882080 - RNA, 19 nt, Homo sapiens
caugacacauuugaaauca

SEQ ID NO: 1882081 - RNA, 12 nt, Homo sapiens
cucucaugguga

SEQ ID NO: 1882082 - RNA, 18 nt, Homo sapiens
ugaccucgggaauggcaa

SEQ ID NO: 1882083 - RNA, 22 nt, Homo sapiens
cugcagcaggcagaggagagua

SEQ ID NO: 1882084 - RNA, 20 nt, Homo sapiens
cuuguacccccagguggaag

SEQ ID NO: 1882085 - RNA, 19 nt, Homo sapiens
ucaucuaauucucugugga

SEQ ID NO: 1882086 - RNA, 15 nt, Homo sapiens
accugcccaugucca

SEQ ID NO: 1882087 - RNA, 16 nt, Homo sapiens
caucuuucuugaauga

SEQ ID NO: 1882088 - RNA, 19 nt, Homo sapiens
ugugccugguucgugccau

SEQ ID NO: 1882089 - RNA, 21 nt, Homo sapiens
uaucuguugccuuauuucuca

SEQ ID NO: 1882090 - RNA, 16 nt, Homo sapiens
cagcccuuuggcuuca

SEQ ID NO: 1882091 - RNA, 19 nt, Homo sapiens
uaugucagcuacaugaagu

SEQ ID NO: 1882092 - RNA, 22 nt, Homo sapiens
cagaggcggaaaccuugcagca

SEQ ID NO: 1882093 - RNA, 22 nt, Homo sapiens
caggugcaacacucaagucuau

SEQ ID NO: 1882094 - RNA, 18 nt, Homo sapiens
gcaauaaaggcaccuccc

SEQ ID NO: 1882095 - RNA, 16 nt, Homo sapiens
cggccccacauugcac

SEQ ID NO: 1882096 - RNA, 14 nt, Homo sapiens
ugggggugcagaug

SEQ ID NO: 1882097 - RNA, 15 nt, Homo sapiens
ucucaagaacugcca

SEQ ID NO: 1882098 - RNA, 16 nt, Homo sapiens
auagccaaaaacuuuu

SEQ ID NO: 1882099 - RNA, 19 nt, Homo sapiens
uaaaguauguuauugcaua

SEQ ID NO: 1882100 - RNA, 17 nt, Homo sapiens
agugauacucacguuug

SEQ ID NO: 1882101 - RNA, 22 nt, Homo sapiens
aacagauaaaguuuuuauuuuc

SEQ ID NO: 1882102 - RNA, 20 nt, Homo sapiens
gagagaaucccuagucuuca

SEQ ID NO: 1882103 - RNA, 15 nt, Homo sapiens
ccgagguccaaggca

SEQ ID NO: 1882104 - RNA, 22 nt, Homo sapiens
cacaaacugcagcugugagugc

SEQ ID NO: 1882105 - RNA, 14 nt, Homo sapiens
ccguaccaaucucu

SEQ ID NO: 1882106 - RNA, 14 nt, Homo sapiens
ucuuguugcucaaa

SEQ ID NO: 1882107 - RNA, 13 nt, Homo sapiens
uuucucaugaagc

SEQ ID NO: 1882108 - RNA, 17 nt, Homo sapiens
uggauucagaaccaaga

SEQ ID NO: 1882109 - RNA, 14 nt, Homo sapiens
aaaaaugugagcua

SEQ ID NO: 1882110 - RNA, 18 nt, Homo sapiens
aacaggguuucucagccu

SEQ ID NO: 1882111 - RNA, 15 nt, Homo sapiens
uuuauggggcucuca

SEQ ID NO: 1882112 - RNA, 21 nt, Homo sapiens
uaaguucagcacuugucucau

SEQ ID NO: 1882113 - RNA, 24 nt, Homo sapiens
cccuccugugucccuuguaaauag

SEQ ID NO: 1882114 - RNA, 19 nt, Homo sapiens
uguuuucaagaugguguua

SEQ ID NO: 1882115 - RNA, 21 nt, Homo sapiens
ucuaugccagcucagucccau

SEQ ID NO: 1882116 - RNA, 19 nt, Homo sapiens
ucccauggguuaagagcuc

SEQ ID NO: 1882117 - RNA, 14 nt, Homo sapiens
gugucaaaagccag

SEQ ID NO: 1882118 - RNA, 16 nt, Homo sapiens
gaggggagaguccagu

SEQ ID NO: 1882119 - RNA, 17 nt, Homo sapiens
gagaaugauuuugcuga

SEQ ID NO: 1882120 - RNA, 16 nt, Homo sapiens
uggugaaggaaacaga

SEQ ID NO: 1882121 - RNA, 19 nt, Homo sapiens
gaacaaauuauaaaaacca

SEQ ID NO: 1882122 - RNA, 21 nt, Homo sapiens
auaggccagggcauguguaug

SEQ ID NO: 1882123 - RNA, 15 nt, Homo sapiens
caguguaggcauuua

SEQ ID NO: 1882124 - RNA, 21 nt, Homo sapiens
aucuauuuaucugucugagcc

SEQ ID NO: 1882125 - RNA, 19 nt, Homo sapiens
cuguuccccuguccuguga

SEQ ID NO: 1882126 - RNA, 23 nt, Homo sapiens
gcagauguggauuugaauccaag

SEQ ID NO: 1882127 - RNA, 22 nt, Homo sapiens
gcccaauuucacagaguacaaa

SEQ ID NO: 1882128 - RNA, 16 nt, Homo sapiens
accuaugcuucuagaa

SEQ ID NO: 1882129 - RNA, 21 nt, Homo sapiens
gaagcugcaggcuuugccauu

SEQ ID NO: 1882130 - RNA, 19 nt, Homo sapiens
cuugaagggccagagccag

SEQ ID NO: 1882131 - RNA, 17 nt, Homo sapiens
cucagggguuaagagcu

SEQ ID NO: 1882132 - RNA, 15 nt, Homo sapiens
caagaaauucauuaa

SEQ ID NO: 1882133 - RNA, 14 nt, Homo sapiens
aaggggcugaggac

SEQ ID NO: 1882134 - RNA, 23 nt, Homo sapiens
gcagaagaucaaggaguacaaug

SEQ ID NO: 1882135 - RNA, 21 nt, Homo sapiens
aguugcguggacucugcacau

SEQ ID NO: 1882136 - RNA, 17 nt, Homo sapiens
aacaagauacaaucuca

SEQ ID NO: 1882137 - RNA, 23 nt, Homo sapiens
ccugcagggccaauggccuggug

SEQ ID NO: 1882138 - RNA, 23 nt, Homo sapiens
auagugguggugaacagaacaaa

SEQ ID NO: 1882139 - RNA, 20 nt, Homo sapiens
uugaagucuguacagauuca

SEQ ID NO: 1882140 - RNA, 17 nt, Homo sapiens
gaacauuaguugcacua

SEQ ID NO: 1882141 - RNA, 23 nt, Homo sapiens
uaaaaggcaagucaaauaccaca

SEQ ID NO: 1882142 - RNA, 20 nt, Homo sapiens
gaacuacagguguuugacuu

SEQ ID NO: 1882143 - RNA, 18 nt, Homo sapiens
auaucuauaguagacaca

SEQ ID NO: 1882144 - RNA, 15 nt, Homo sapiens
ucacuucaccaucaa

SEQ ID NO: 1882145 - RNA, 18 nt, Homo sapiens
uuaaacguaugcauguga

SEQ ID NO: 1882146 - RNA, 13 nt, Homo sapiens
ccagguggagaaa

SEQ ID NO: 1882147 - RNA, 12 nt, Homo sapiens
agcagccagcug

SEQ ID NO: 1882148 - RNA, 13 nt, Homo sapiens
cuucgcacucaau

SEQ ID NO: 1882149 - RNA, 19 nt, Homo sapiens
auuaguuccauuuggucuu

SEQ ID NO: 1882150 - RNA, 15 nt, Homo sapiens
acacauuuacuguac

SEQ ID NO: 1882151 - RNA, 14 nt, Homo sapiens
acuaaauaauacuu

SEQ ID NO: 1882152 - RNA, 19 nt, Homo sapiens
cccaggcuggagugcagua

SEQ ID NO: 1882153 - RNA, 14 nt, Homo sapiens
ccugaacacuguga

SEQ ID NO: 1882154 - RNA, 17 nt, Homo sapiens
gugaaaggcuguggcau

SEQ ID NO: 1882155 - RNA, 15 nt, Homo sapiens
ucaaaggaagacuug

SEQ ID NO: 1882156 - RNA, 14 nt, Homo sapiens
agugaaaccagcuu

SEQ ID NO: 1882157 - RNA, 20 nt, Homo sapiens
aguaacacaauuuucacuuu

SEQ ID NO: 1882158 - RNA, 17 nt, Homo sapiens
agcuguuccacuucucu

SEQ ID NO: 1882159 - RNA, 14 nt, Homo sapiens
auuagcaaagcaaa

SEQ ID NO: 1882160 - RNA, 23 nt, Homo sapiens
aacuacuaaagugccuaccccag

SEQ ID NO: 1882161 - RNA, 16 nt, Homo sapiens
cuuaacccaaggagca

SEQ ID NO: 1882162 - RNA, 19 nt, Homo sapiens
cagacaaagcauaaucaau

SEQ ID NO: 1882163 - RNA, 17 nt, Homo sapiens
ucuaauaugauuauaca

SEQ ID NO: 1882164 - RNA, 20 nt, Homo sapiens
aacagcuaguagacaugaau

SEQ ID NO: 1882165 - RNA, 21 nt, Homo sapiens
caagaaccuggaaaaauucca

SEQ ID NO: 1882166 - RNA, 14 nt, Homo sapiens
aacaaagaacugaa

SEQ ID NO: 1882167 - RNA, 19 nt, Homo sapiens
uaucauucuuuguaucuua

SEQ ID NO: 1882168 - RNA, 15 nt, Homo sapiens
aguugaaccugauga

SEQ ID NO: 1882169 - RNA, 16 nt, Homo sapiens
uccuguucccaugaga

SEQ ID NO: 1882170 - RNA, 16 nt, Homo sapiens
gcacggcccguggcug

SEQ ID NO: 1882171 - RNA, 22 nt, Homo sapiens
uaaauugguauuaacuaugauc

SEQ ID NO: 1882172 - RNA, 21 nt, Homo sapiens
ccucaacauugcauggugcua

SEQ ID NO: 1882173 - RNA, 18 nt, Homo sapiens
agguacuggugagggcaa

SEQ ID NO: 1882174 - RNA, 14 nt, Homo sapiens
cuuacuuaaaccca

SEQ ID NO: 1882175 - RNA, 10 nt, Homo sapiens
uacucugcaa

SEQ ID NO: 1882176 - RNA, 12 nt, Homo sapiens
augagcauuugu

SEQ ID NO: 1882177 - RNA, 12 nt, Homo sapiens
gcugcugucaca

SEQ ID NO: 1882178 - RNA, 16 nt, Homo sapiens
gcauccugugugcuga

SEQ ID NO: 1882179 - RNA, 15 nt, Homo sapiens
guuuauguacuguaa

SEQ ID NO: 1882180 - RNA, 13 nt, Homo sapiens
uggaaacuucugu

SEQ ID NO: 1882181 - RNA, 17 nt, Homo sapiens
auguucccccuguuuca

SEQ ID NO: 1882182 - RNA, 14 nt, Homo sapiens
auguaacugugcca

SEQ ID NO: 1882183 - RNA, 15 nt, Homo sapiens
ccuguagcgccagug

SEQ ID NO: 1882184 - RNA, 22 nt, Homo sapiens
acacugccuuaccuucacuuaa

SEQ ID NO: 1882185 - RNA, 23 nt, Homo sapiens
ucccuggaugacauuaaagaagg

SEQ ID NO: 1882186 - RNA, 22 nt, Homo sapiens
uuuucuaggccaaaaaugguga

SEQ ID NO: 1882187 - RNA, 12 nt, Homo sapiens
aauuguguuucc

SEQ ID NO: 1882188 - RNA, 22 nt, Homo sapiens
aaacucuaucagcauuguuuca

SEQ ID NO: 1882189 - RNA, 18 nt, Homo sapiens
aguauguccgaugguauc

SEQ ID NO: 1882190 - RNA, 19 nt, Homo sapiens
aauuuuucuaaaggugcua

SEQ ID NO: 1882191 - RNA, 16 nt, Homo sapiens
uucuauaaugugccug

SEQ ID NO: 1882192 - RNA, 23 nt, Homo sapiens
caugucaacuucuggcuccucaa

SEQ ID NO: 1882193 - RNA, 22 nt, Homo sapiens
ccccaucuguuaaaugagagaa

SEQ ID NO: 1882194 - RNA, 16 nt, Homo sapiens
cacaccuugacaaaau

SEQ ID NO: 1882195 - RNA, 18 nt, Homo sapiens
aauacaugaugauuucag

SEQ ID NO: 1882196 - RNA, 14 nt, Homo sapiens
ccccaacacuccag

SEQ ID NO: 1882197 - RNA, 23 nt, Homo sapiens
acugcccgagcuggugcauuaca

SEQ ID NO: 1882198 - RNA, 14 nt, Homo sapiens
gugucuugcaauga

SEQ ID NO: 1882199 - RNA, 14 nt, Homo sapiens
caggguugguagca

SEQ ID NO: 1882200 - RNA, 22 nt, Homo sapiens
ugccacgcuuugaugagcauuu

SEQ ID NO: 1882201 - RNA, 14 nt, Homo sapiens
acacauuaagccuu

SEQ ID NO: 1882202 - RNA, 15 nt, Homo sapiens
gauauacuuacucau

SEQ ID NO: 1882203 - RNA, 15 nt, Homo sapiens
gaguugagugauaga

SEQ ID NO: 1882204 - RNA, 18 nt, Homo sapiens
auuaauaguucaguguau

SEQ ID NO: 1882205 - RNA, 17 nt, Homo sapiens
uccccuuccauucccaa

SEQ ID NO: 1882206 - RNA, 16 nt, Homo sapiens
uuaaucucuaguaaaa

SEQ ID NO: 1882207 - RNA, 22 nt, Homo sapiens
gccguaggauuuggggugaaug

SEQ ID NO: 1882208 - RNA, 16 nt, Homo sapiens
uggcucaacauugugu

SEQ ID NO: 1882209 - RNA, 14 nt, Homo sapiens
aggacacagaugaa

SEQ ID NO: 1882210 - RNA, 13 nt, Homo sapiens
ccaccagccacuu

SEQ ID NO: 1882211 - RNA, 13 nt, Homo sapiens
aggguacaugugc

SEQ ID NO: 1882212 - RNA, 21 nt, Homo sapiens
gacaugaaauugagucauuuu

SEQ ID NO: 1882213 - RNA, 19 nt, Homo sapiens
ccagagagacccugccaac

SEQ ID NO: 1882214 - RNA, 17 nt, Homo sapiens
uaauuucaggaauugaa

SEQ ID NO: 1882215 - RNA, 15 nt, Homo sapiens
cauugcuuucgugua

SEQ ID NO: 1882216 - RNA, 15 nt, Homo sapiens
auggucacaagcaca

SEQ ID NO: 1882217 - RNA, 21 nt, Homo sapiens
ccgggacuucaaagccgugau

SEQ ID NO: 1882218 - RNA, 16 nt, Homo sapiens
cacagauguguugcaa

SEQ ID NO: 1882219 - RNA, 17 nt, Homo sapiens
acuucacaaaaugcaag

SEQ ID NO: 1882220 - RNA, 14 nt, Homo sapiens
auucucaugugauc

SEQ ID NO: 1882221 - RNA, 19 nt, Homo sapiens
guccacuuuuaaaacuaua

SEQ ID NO: 1882222 - RNA, 16 nt, Homo sapiens
cuucuccucccagcgu

SEQ ID NO: 1882223 - RNA, 23 nt, Homo sapiens
cagggauuuguccuuggggacau

SEQ ID NO: 1882224 - RNA, 21 nt, Homo sapiens
cuucaguauguugucaaagag

SEQ ID NO: 1882225 - RNA, 20 nt, Homo sapiens
uuaggccuggcacagugucu

SEQ ID NO: 1882226 - RNA, 14 nt, Homo sapiens
uggauguucacugc

SEQ ID NO: 1882227 - RNA, 21 nt, Homo sapiens
ucagaccaacucucuccugua

SEQ ID NO: 1882228 - RNA, 19 nt, Homo sapiens
caauucuuacaaacaugug

SEQ ID NO: 1882229 - RNA, 17 nt, Homo sapiens
caagcagguaagagcug

SEQ ID NO: 1882230 - RNA, 11 nt, Homo sapiens
auaaugcagaa

SEQ ID NO: 1882231 - RNA, 11 nt, Homo sapiens
aagaugcagug

SEQ ID NO: 1882232 - RNA, 21 nt, Homo sapiens
ccccuggugggacaacaaaga

SEQ ID NO: 1882233 - RNA, 20 nt, Homo sapiens
uccccugcuacccuagauga

SEQ ID NO: 1882234 - RNA, 22 nt, Homo sapiens
uuuaagaaaacaaguauauaau

SEQ ID NO: 1882235 - RNA, 14 nt, Homo sapiens
agcagaaugcacau

SEQ ID NO: 1882236 - RNA, 15 nt, Homo sapiens
ggugccaaguuccac

SEQ ID NO: 1882237 - RNA, 21 nt, Homo sapiens
acaaauuccaaauucucacag

SEQ ID NO: 1882238 - RNA, 15 nt, Homo sapiens
aaugcugucugucca

SEQ ID NO: 1882239 - RNA, 12 nt, Homo sapiens
acaguacauugu

SEQ ID NO: 1882240 - RNA, 16 nt, Homo sapiens
auuuucugcaauccaa

SEQ ID NO: 1882241 - RNA, 21 nt, Homo sapiens
acacauugccccaugagacag

SEQ ID NO: 1882242 - RNA, 16 nt, Homo sapiens
aggggccugcccucau

SEQ ID NO: 1882243 - RNA, 20 nt, Homo sapiens
cagauggaaugcuguguuaa

SEQ ID NO: 1882244 - RNA, 21 nt, Homo sapiens
caagauggaugcgacccaaga

SEQ ID NO: 1882245 - RNA, 17 nt, Homo sapiens
aagcccagugcacugaa

SEQ ID NO: 1882246 - RNA, 17 nt, Homo sapiens
accucacacuccuuuag

SEQ ID NO: 1882247 - RNA, 22 nt, Homo sapiens
cuuaaaccacacacacaaggug

SEQ ID NO: 1882248 - RNA, 18 nt, Homo sapiens
caugaaaguggacaagga

SEQ ID NO: 1882249 - RNA, 18 nt, Homo sapiens
guucuguuaacugaauac

SEQ ID NO: 1882250 - RNA, 22 nt, Homo sapiens
cuguuggacacccagugccagg

SEQ ID NO: 1882251 - RNA, 14 nt, Homo sapiens
caggaaaguguuau

SEQ ID NO: 1882252 - RNA, 22 nt, Homo sapiens
cuuaaaguggcuuucaacuuca

SEQ ID NO: 1882253 - RNA, 21 nt, Homo sapiens
uguuuuacuaaagaaagauua

SEQ ID NO: 1882254 - RNA, 15 nt, Homo sapiens
caguauguuuacuau

SEQ ID NO: 1882255 - RNA, 19 nt, Homo sapiens
gcccugccugcugcaucuu

SEQ ID NO: 1882256 - RNA, 19 nt, Homo sapiens
aaagcauaguuauuuuaca

SEQ ID NO: 1882257 - RNA, 15 nt, Homo sapiens
acccacgugcauuca

SEQ ID NO: 1882258 - RNA, 18 nt, Homo sapiens
guuugcuuaaugccagaa

SEQ ID NO: 1882259 - RNA, 21 nt, Homo sapiens
aaagugggcaaaagcuuacaa

SEQ ID NO: 1882260 - RNA, 15 nt, Homo sapiens
uaaaauuacuuugaa

SEQ ID NO: 1882261 - RNA, 17 nt, Homo sapiens
ugaggagcugcacugau

SEQ ID NO: 1882262 - RNA, 20 nt, Homo sapiens
uauucucccacugacagaaa

SEQ ID NO: 1882263 - RNA, 23 nt, Homo sapiens
ugaacacucaguggcccauggca

SEQ ID NO: 1882264 - RNA, 23 nt, Homo sapiens
ucugagugggcccagcacauggc

SEQ ID NO: 1882265 - RNA, 15 nt, Homo sapiens
uggccgacucaggga

SEQ ID NO: 1882266 - RNA, 16 nt, Homo sapiens
uuaccccauaccccuu

SEQ ID NO: 1882267 - RNA, 13 nt, Homo sapiens
cagcuucugggac

SEQ ID NO: 1882268 - RNA, 19 nt, Homo sapiens
gcaaaguccagguccauuu

SEQ ID NO: 1882269 - RNA, 13 nt, Homo sapiens
caagaugacacaa

SEQ ID NO: 1882270 - RNA, 17 nt, Homo sapiens
acaagucggcuguggag

SEQ ID NO: 1882271 - RNA, 12 nt, Homo sapiens
cagacuccaaaa

SEQ ID NO: 1882272 - RNA, 13 nt, Homo sapiens
aaguccaguguga

SEQ ID NO: 1882273 - RNA, 12 nt, Homo sapiens
uucucacacugg

SEQ ID NO: 1882274 - RNA, 17 nt, Homo sapiens
gacuucugcccauucuc

SEQ ID NO: 1882275 - RNA, 15 nt, Homo sapiens
uggcuuuaugcaaau

SEQ ID NO: 1882276 - RNA, 20 nt, Homo sapiens
uugaauuaaaacagcugcga

SEQ ID NO: 1882277 - RNA, 20 nt, Homo sapiens
acccuaccugcagaguuacu

SEQ ID NO: 1882278 - RNA, 22 nt, Homo sapiens
uggacgagugcucucggcccaa

SEQ ID NO: 1882279 - RNA, 17 nt, Homo sapiens
uuaaaauguuuacugua

SEQ ID NO: 1882280 - RNA, 17 nt, Homo sapiens
cuuccaugcuacaugua

SEQ ID NO: 1882281 - RNA, 18 nt, Homo sapiens
auccuucuggcagauuca

SEQ ID NO: 1882282 - RNA, 23 nt, Homo sapiens
ugcuaggaggugugggugccuuc

SEQ ID NO: 1882283 - RNA, 14 nt, Homo sapiens
acugcaugucagag

SEQ ID NO: 1882284 - RNA, 15 nt, Homo sapiens
cuugcuuaccucuca

SEQ ID NO: 1882285 - RNA, 22 nt, Homo sapiens
ucauucaauauugacauuugua

SEQ ID NO: 1882286 - RNA, 15 nt, Homo sapiens
aaugaucauugcaug

SEQ ID NO: 1882287 - RNA, 13 nt, Homo sapiens
cguaaagauuugg

SEQ ID NO: 1882288 - RNA, 18 nt, Homo sapiens
uugcuauaauaaagaagu

SEQ ID NO: 1882289 - RNA, 20 nt, Homo sapiens
ugauacaaauugcagacugu

SEQ ID NO: 1882290 - RNA, 13 nt, Homo sapiens
aguagucauuuca

SEQ ID NO: 1882291 - RNA, 18 nt, Homo sapiens
uaguaucagagaugucca

SEQ ID NO: 1882292 - RNA, 16 nt, Homo sapiens
ccaauccccagacuca

SEQ ID NO: 1882293 - RNA, 23 nt, Homo sapiens
aaugccacaaaacugacaguaaa

SEQ ID NO: 1882294 - RNA, 22 nt, Homo sapiens
auauaucccauggguuaucugu

SEQ ID NO: 1882295 - RNA, 18 nt, Homo sapiens
aaaugucuucauguugau

SEQ ID NO: 1882296 - RNA, 14 nt, Homo sapiens
gggugucucugcau

SEQ ID NO: 1882297 - RNA, 19 nt, Homo sapiens
guguaaauauguacauuuc

SEQ ID NO: 1882298 - RNA, 17 nt, Homo sapiens
ccuuauccuaaugaugc

SEQ ID NO: 1882299 - RNA, 21 nt, Homo sapiens
ugcuggagaucagcaugccug

SEQ ID NO: 1882300 - RNA, 18 nt, Homo sapiens
gcugcucagaggggcccc

SEQ ID NO: 1882301 - RNA, 12 nt, Homo sapiens
agaaaacuucag

SEQ ID NO: 1882302 - RNA, 12 nt, Homo sapiens
acagaacuugaa

SEQ ID NO: 1882303 - RNA, 22 nt, Homo sapiens
gccuguaauuccagccacucga

SEQ ID NO: 1882304 - RNA, 16 nt, Homo sapiens
agugagccaucaucau

SEQ ID NO: 1882305 - RNA, 15 nt, Homo sapiens
ccagauguugcuuuu

SEQ ID NO: 1882306 - RNA, 18 nt, Homo sapiens
uuucaaucuucaauccuu

SEQ ID NO: 1882307 - RNA, 15 nt, Homo sapiens
cugugacuaccucaa

SEQ ID NO: 1882308 - RNA, 19 nt, Homo sapiens
aggacaguggaugcugcug

SEQ ID NO: 1882309 - RNA, 19 nt, Homo sapiens
gggcuggcccagggcugca

SEQ ID NO: 1882310 - RNA, 22 nt, Homo sapiens
ggcagcugacaguuuguggcau

SEQ ID NO: 1882311 - RNA, 20 nt, Homo sapiens
cacccagaacuccauaccau

SEQ ID NO: 1882312 - RNA, 16 nt, Homo sapiens
uggagcuaaaacuggc

SEQ ID NO: 1882313 - RNA, 22 nt, Homo sapiens
gacauuuuuauuuuauggaaua

SEQ ID NO: 1882314 - RNA, 14 nt, Homo sapiens
gauggguccagggg

SEQ ID NO: 1882315 - RNA, 15 nt, Homo sapiens
agaauuccaaagcaa

SEQ ID NO: 1882316 - RNA, 12 nt, Homo sapiens
aaaaaagcuuuu

SEQ ID NO: 1882317 - RNA, 22 nt, Homo sapiens
auccacagagagucccacugcc

SEQ ID NO: 1882318 - RNA, 20 nt, Homo sapiens
cugugugugugugugcauau

SEQ ID NO: 1882319 - RNA, 19 nt, Homo sapiens
uaacaccaugauuaaccac

SEQ ID NO: 1882320 - RNA, 18 nt, Homo sapiens
auuuuuaacaggaauuua

SEQ ID NO: 1882321 - RNA, 21 nt, Homo sapiens
auuaugugccagauuuaugca

SEQ ID NO: 1882322 - RNA, 17 nt, Homo sapiens
auuaauugccuguuaaa

SEQ ID NO: 1882323 - RNA, 19 nt, Homo sapiens
ccccaugcucccuuuuaca

SEQ ID NO: 1882324 - RNA, 18 nt, Homo sapiens
accaugucuuucucucuc

SEQ ID NO: 1882325 - RNA, 19 nt, Homo sapiens
gaccccagcuuuucuugcc

SEQ ID NO: 1882326 - RNA, 15 nt, Homo sapiens
aguaaugugucauau

SEQ ID NO: 1882327 - RNA, 16 nt, Homo sapiens
aaauugggcagucuua

SEQ ID NO: 1882328 - RNA, 15 nt, Homo sapiens
ucacuuguauugacu

SEQ ID NO: 1882329 - RNA, 19 nt, Homo sapiens
cugcugggcgucuguucuu

SEQ ID NO: 1882330 - RNA, 20 nt, Homo sapiens
aggaggaguuuaaacugaau

SEQ ID NO: 1882331 - RNA, 17 nt, Homo sapiens
guguucugaagugggaa

SEQ ID NO: 1882332 - RNA, 19 nt, Homo sapiens
ucauuaagguuaugcacug

SEQ ID NO: 1882333 - RNA, 15 nt, Homo sapiens
uaccuguuccauugu

SEQ ID NO: 1882334 - RNA, 13 nt, Homo sapiens
gugcaauauguga

SEQ ID NO: 1882335 - RNA, 22 nt, Homo sapiens
aggaaagagcuccaaauugaau

SEQ ID NO: 1882336 - RNA, 17 nt, Homo sapiens
caaugauacagucccua

SEQ ID NO: 1882337 - RNA, 23 nt, Homo sapiens
uaugcaaccuuuggaugcacuuu

SEQ ID NO: 1882338 - RNA, 19 nt, Homo sapiens
uaaacaaagugaaguaaaa

SEQ ID NO: 1882339 - RNA, 21 nt, Homo sapiens
cuucuggacugguuuucacau

SEQ ID NO: 1882340 - RNA, 17 nt, Homo sapiens
cucugugcccuccagca

SEQ ID NO: 1882341 - RNA, 18 nt, Homo sapiens
cacaaugcauaaugucuu

SEQ ID NO: 1882342 - RNA, 17 nt, Homo sapiens
guaauuagcauggcccc

SEQ ID NO: 1882343 - RNA, 14 nt, Homo sapiens
gaccuacucuugcc

SEQ ID NO: 1882344 - RNA, 15 nt, Homo sapiens
uacagugcuaaagau

SEQ ID NO: 1882345 - RNA, 13 nt, Homo sapiens
uuuuucauuauug

SEQ ID NO: 1882346 - RNA, 13 nt, Homo sapiens
gagugcauguguu

SEQ ID NO: 1882347 - RNA, 15 nt, Homo sapiens
cacagaaacacugcc

SEQ ID NO: 1882348 - RNA, 13 nt, Homo sapiens
guccauuuugccu

SEQ ID NO: 1882349 - RNA, 18 nt, Homo sapiens
aaguccuggcacaguuuu

SEQ ID NO: 1882350 - RNA, 16 nt, Homo sapiens
gaagagaggaguucaa

SEQ ID NO: 1882351 - RNA, 13 nt, Homo sapiens
uggacgugcacug

SEQ ID NO: 1882352 - RNA, 23 nt, Homo sapiens
caggugcugggcuggacuggcca

SEQ ID NO: 1882353 - RNA, 14 nt, Homo sapiens
ucaucggugccugg

SEQ ID NO: 1882354 - RNA, 17 nt, Homo sapiens
gccuaguuucuuacaca

SEQ ID NO: 1882355 - RNA, 16 nt, Homo sapiens
acagcauuaacugucu

SEQ ID NO: 1882356 - RNA, 17 nt, Homo sapiens
cugauguucaguguaau

SEQ ID NO: 1882357 - RNA, 23 nt, Homo sapiens
cuuugccggaggaaaagcagcuc

SEQ ID NO: 1882358 - RNA, 15 nt, Homo sapiens
ucaguaauagcugaa

SEQ ID NO: 1882359 - RNA, 17 nt, Homo sapiens
agagcagccucauccca

SEQ ID NO: 1882360 - RNA, 21 nt, Homo sapiens
aaagccccuggaaaugugcua

SEQ ID NO: 1882361 - RNA, 22 nt, Homo sapiens
accaggaggcggcagugcaaca

SEQ ID NO: 1882362 - RNA, 12 nt, Homo sapiens
gcaggaugcccu

SEQ ID NO: 1882363 - RNA, 22 nt, Homo sapiens
agagugguuaagacuacugaag

SEQ ID NO: 1882364 - RNA, 18 nt, Homo sapiens
agcaucugccucuauuca

SEQ ID NO: 1882365 - RNA, 19 nt, Homo sapiens
ugcuacaccuuagcagcuc

SEQ ID NO: 1882366 - RNA, 20 nt, Homo sapiens
ucugagggaaagcccagaaa

SEQ ID NO: 1882367 - RNA, 13 nt, Homo sapiens
cgccaucuuccau

SEQ ID NO: 1882368 - RNA, 15 nt, Homo sapiens
acccauaaguaauau

SEQ ID NO: 1882369 - RNA, 15 nt, Homo sapiens
ccgcugcgugccauc

SEQ ID NO: 1882370 - RNA, 21 nt, Homo sapiens
uagggcacuuuaagucaguga

SEQ ID NO: 1882371 - RNA, 19 nt, Homo sapiens
cucugacccugaugcuuaa

SEQ ID NO: 1882372 - RNA, 12 nt, Homo sapiens
auagaauccaaa

SEQ ID NO: 1882373 - RNA, 20 nt, Homo sapiens
cugguacugcaggaccucca

SEQ ID NO: 1882374 - RNA, 15 nt, Homo sapiens
auuuugaguucuaca

SEQ ID NO: 1882375 - RNA, 13 nt, Homo sapiens
aaagcugcuguca

SEQ ID NO: 1882376 - RNA, 13 nt, Homo sapiens
cagucugagcugu

SEQ ID NO: 1882377 - RNA, 22 nt, Homo sapiens
aagaguacagaagcuuuagcaa

SEQ ID NO: 1882378 - RNA, 15 nt, Homo sapiens
uuaacagcaacgaac

SEQ ID NO: 1882379 - RNA, 14 nt, Homo sapiens
caaucacugugcua

SEQ ID NO: 1882380 - RNA, 21 nt, Homo sapiens
uacacacucauacgugugugu

SEQ ID NO: 1882381 - RNA, 14 nt, Homo sapiens
guagcaucauguau

SEQ ID NO: 1882382 - RNA, 20 nt, Homo sapiens
ccaugagcuuaggcauucua

SEQ ID NO: 1882383 - RNA, 17 nt, Homo sapiens
uaagccaagggccucuu

SEQ ID NO: 1882384 - RNA, 13 nt, Homo sapiens
acuccaugcaaac

SEQ ID NO: 1882385 - RNA, 20 nt, Homo sapiens
auuucuagacaguauugcca

SEQ ID NO: 1882386 - RNA, 22 nt, Homo sapiens
uguugguguggcccauggcugu

SEQ ID NO: 1882387 - RNA, 14 nt, Homo sapiens
gacacagaagcccc

SEQ ID NO: 1882388 - RNA, 19 nt, Homo sapiens
ucaguaacacagugcagug

SEQ ID NO: 1882389 - RNA, 22 nt, Homo sapiens
guucucuauugcugcucucuca

SEQ ID NO: 1882390 - RNA, 14 nt, Homo sapiens
ccuuaggugugagg

SEQ ID NO: 1882391 - RNA, 19 nt, Homo sapiens
augcuuacgucaaaacagc

SEQ ID NO: 1882392 - RNA, 12 nt, Homo sapiens
cacauagcuggg

SEQ ID NO: 1882393 - RNA, 23 nt, Homo sapiens
uuccccuccuuggcuuuaugcaa

SEQ ID NO: 1882394 - RNA, 20 nt, Homo sapiens
uacuaggaguacaggcauag

SEQ ID NO: 1882395 - RNA, 15 nt, Homo sapiens
uagauaucaauguua

SEQ ID NO: 1882396 - RNA, 18 nt, Homo sapiens
acuuuucguuaacauuga

SEQ ID NO: 1882397 - RNA, 14 nt, Homo sapiens
gaaguagcucuuuu

SEQ ID NO: 1882398 - RNA, 19 nt, Homo sapiens
augacuaaagcagggacaa

SEQ ID NO: 1882399 - RNA, 21 nt, Homo sapiens
gccugcuucuucucuccacau

SEQ ID NO: 1882400 - RNA, 21 nt, Homo sapiens
gcucauauuaauguacuuaaa

SEQ ID NO: 1882401 - RNA, 18 nt, Homo sapiens
aauuuuauuggggggcaa

SEQ ID NO: 1882402 - RNA, 23 nt, Homo sapiens
ugugguuugggcuccacauugca

SEQ ID NO: 1882403 - RNA, 22 nt, Homo sapiens
cugcuuucgaauaaagugaaua

SEQ ID NO: 1882404 - RNA, 20 nt, Homo sapiens
aucuuauucuuuuguaauau

SEQ ID NO: 1882405 - RNA, 19 nt, Homo sapiens
uccauguuuauccauguac

SEQ ID NO: 1882406 - RNA, 19 nt, Homo sapiens
uagagcacuagaagcacag

SEQ ID NO: 1882407 - RNA, 22 nt, Homo sapiens
ucaguaaacaacuuguacuugu

SEQ ID NO: 1882408 - RNA, 13 nt, Homo sapiens
uuggaauucucuc

SEQ ID NO: 1882409 - RNA, 14 nt, Homo sapiens
aagaagccuuuccu

SEQ ID NO: 1882410 - RNA, 23 nt, Homo sapiens
agaacuucucuucccauaccacc

SEQ ID NO: 1882411 - RNA, 15 nt, Homo sapiens
acucuucacuccaaa

SEQ ID NO: 1882412 - RNA, 21 nt, Homo sapiens
cauggcaaaucaggggccaga

SEQ ID NO: 1882413 - RNA, 15 nt, Homo sapiens
auuuuuccaguaacu

SEQ ID NO: 1882414 - RNA, 19 nt, Homo sapiens
cuccacgguagcacuugac

SEQ ID NO: 1882415 - RNA, 14 nt, Homo sapiens
guggggaauggaaa

SEQ ID NO: 1882416 - RNA, 14 nt, Homo sapiens
uccuaucaaagugu

SEQ ID NO: 1882417 - RNA, 21 nt, Homo sapiens
ucuagccuggggcuugaauuu

SEQ ID NO: 1882418 - RNA, 19 nt, Homo sapiens
aauuaaaauccucaaucca

SEQ ID NO: 1882419 - RNA, 16 nt, Homo sapiens
aauguugggacugcua

SEQ ID NO: 1882420 - RNA, 18 nt, Homo sapiens
gcuucuacggccaugaga

SEQ ID NO: 1882421 - RNA, 16 nt, Homo sapiens
uggcuggacuguagaa

SEQ ID NO: 1882422 - RNA, 21 nt, Homo sapiens
aagucaucauaauucagcucu

SEQ ID NO: 1882423 - RNA, 17 nt, Homo sapiens
aagcacaacugaaacca

SEQ ID NO: 1882424 - RNA, 16 nt, Homo sapiens
ccagacuggcacaguu

SEQ ID NO: 1882425 - RNA, 12 nt, Homo sapiens
uugaaaagcuaa

SEQ ID NO: 1882426 - RNA, 15 nt, Homo sapiens
auuacuuguugccua

SEQ ID NO: 1882427 - RNA, 15 nt, Homo sapiens
acaguccugggagaa

SEQ ID NO: 1882428 - RNA, 14 nt, Homo sapiens
guuuaaaauuacuu

SEQ ID NO: 1882429 - RNA, 13 nt, Homo sapiens
ucaaauagcauaa

SEQ ID NO: 1882430 - RNA, 20 nt, Homo sapiens
gacaugugcuggacacuguc

SEQ ID NO: 1882431 - RNA, 21 nt, Homo sapiens
cuucaaaauauaaaaugccaa

SEQ ID NO: 1882432 - RNA, 14 nt, Homo sapiens
aauuuccugcugaa

SEQ ID NO: 1882433 - RNA, 18 nt, Homo sapiens
agguucugagaccagugu

SEQ ID NO: 1882434 - RNA, 22 nt, Homo sapiens
ggucucauuaucuccaugauaa

SEQ ID NO: 1882435 - RNA, 15 nt, Homo sapiens
uaguuacuauaugcc

SEQ ID NO: 1882436 - RNA, 15 nt, Homo sapiens
ucaaccugugaugag

SEQ ID NO: 1882437 - RNA, 20 nt, Homo sapiens
cauuuguggucugacuccuu

SEQ ID NO: 1882438 - RNA, 21 nt, Homo sapiens
ccugacacugcaauuggcacc

SEQ ID NO: 1882439 - RNA, 20 nt, Homo sapiens
aggcuaagaaagaaaugcua

SEQ ID NO: 1882440 - RNA, 18 nt, Homo sapiens
cagggucuuuacugggaa

SEQ ID NO: 1882441 - RNA, 20 nt, Homo sapiens
cauccuggcuaacacaguga

SEQ ID NO: 1882442 - RNA, 20 nt, Homo sapiens
auguggauugaguaauggga

SEQ ID NO: 1882443 - RNA, 17 nt, Homo sapiens
ugcaugagacauugaca

SEQ ID NO: 1882444 - RNA, 21 nt, Homo sapiens
agaccuugagggugggccagc

SEQ ID NO: 1882445 - RNA, 15 nt, Homo sapiens
auugacaacauuuua

SEQ ID NO: 1882446 - RNA, 19 nt, Homo sapiens
gaauauacuaaauuaacuu

SEQ ID NO: 1882447 - RNA, 18 nt, Homo sapiens
gcauguguauauauguca

SEQ ID NO: 1882448 - RNA, 20 nt, Homo sapiens
aaucagucuaccaaggggcu

SEQ ID NO: 1882449 - RNA, 13 nt, Homo sapiens
guaauaagcacuu

SEQ ID NO: 1882450 - RNA, 17 nt, Homo sapiens
caaauuucauugcacuu

SEQ ID NO: 1882451 - RNA, 17 nt, Homo sapiens
gaauggagcuggcccuc

SEQ ID NO: 1882452 - RNA, 18 nt, Homo sapiens
ccaaagccagaccagaag

SEQ ID NO: 1882453 - RNA, 19 nt, Homo sapiens
cucccacccuuucugccag

SEQ ID NO: 1882454 - RNA, 13 nt, Homo sapiens
aagaaacuaucaa

SEQ ID NO: 1882455 - RNA, 14 nt, Homo sapiens
ucucacaagcacuu

SEQ ID NO: 1882456 - RNA, 22 nt, Homo sapiens
ccauaugauauuuugucuccua

SEQ ID NO: 1882457 - RNA, 22 nt, Homo sapiens
gaaggcucuucugacuacuggg

SEQ ID NO: 1882458 - RNA, 18 nt, Homo sapiens
cugguagcaugaccuuuu

SEQ ID NO: 1882459 - RNA, 18 nt, Homo sapiens
gugaggugcuugagucuc

SEQ ID NO: 1882460 - RNA, 22 nt, Homo sapiens
uacugcucaucauuccuugaga

SEQ ID NO: 1882461 - RNA, 19 nt, Homo sapiens
guggaaaacgaagcucauu

SEQ ID NO: 1882462 - RNA, 17 nt, Homo sapiens
auguacaccacaugcua

SEQ ID NO: 1882463 - RNA, 18 nt, Homo sapiens
cccuaucaaaacauauca

SEQ ID NO: 1882464 - RNA, 14 nt, Homo sapiens
ggcccaggagucca

SEQ ID NO: 1882465 - RNA, 20 nt, Homo sapiens
caagucauaccuacauucaa

SEQ ID NO: 1882466 - RNA, 22 nt, Homo sapiens
cauauaauuuucacuucugucu

SEQ ID NO: 1882467 - RNA, 15 nt, Homo sapiens
cagccucagugccac

SEQ ID NO: 1882468 - RNA, 20 nt, Homo sapiens
ggaagcuaccagagcucuau

SEQ ID NO: 1882469 - RNA, 20 nt, Homo sapiens
uuucagaagcucuucuaaaa

SEQ ID NO: 1882470 - RNA, 17 nt, Homo sapiens
ggcuagugaaguggccu

SEQ ID NO: 1882471 - RNA, 17 nt, Homo sapiens
agaacucaccacaagcc

SEQ ID NO: 1882472 - RNA, 15 nt, Homo sapiens
aagaagaaccaucuu

SEQ ID NO: 1882473 - RNA, 18 nt, Homo sapiens
uucauuaaauuagcuauu

SEQ ID NO: 1882474 - RNA, 15 nt, Homo sapiens
agcaacauggugaga

SEQ ID NO: 1882475 - RNA, 21 nt, Homo sapiens
gacuguccucuccccuccagc

SEQ ID NO: 1882476 - RNA, 20 nt, Homo sapiens
cagcuuaggggcugcugacc

SEQ ID NO: 1882477 - RNA, 13 nt, Homo sapiens
auguuccaugccu

SEQ ID NO: 1882478 - RNA, 16 nt, Homo sapiens
gcacaaccugcaucuu

SEQ ID NO: 1882479 - RNA, 20 nt, Homo sapiens
gcuaugcccggaccuccauc

SEQ ID NO: 1882480 - RNA, 16 nt, Homo sapiens
gcaucacacaucacuc

SEQ ID NO: 1882481 - RNA, 19 nt, Homo sapiens
cugucucucaugaaccuca

SEQ ID NO: 1882482 - RNA, 19 nt, Homo sapiens
aaaguccguguccuaccuc

SEQ ID NO: 1882483 - RNA, 22 nt, Homo sapiens
uuucuagaaguuucccuuccuc

SEQ ID NO: 1882484 - RNA, 22 nt, Homo sapiens
gcaggagccugcagucacuggc

SEQ ID NO: 1882485 - RNA, 19 nt, Homo sapiens
gucauugauggagccugaa

SEQ ID NO: 1882486 - RNA, 13 nt, Homo sapiens
acuaccuuuauag

SEQ ID NO: 1882487 - RNA, 17 nt, Homo sapiens
agggugguuuccugcca

SEQ ID NO: 1882488 - RNA, 14 nt, Homo sapiens
accuccuuaccugg

SEQ ID NO: 1882489 - RNA, 17 nt, Homo sapiens
agccuuacccaguccua

SEQ ID NO: 1882490 - RNA, 16 nt, Homo sapiens
uggccuagagcacucu

SEQ ID NO: 1882491 - RNA, 18 nt, Homo sapiens
ugaugguaucuauaguca

SEQ ID NO: 1882492 - RNA, 14 nt, Homo sapiens
acuucuagacucac

SEQ ID NO: 1882493 - RNA, 18 nt, Homo sapiens
uucucccuugauuccacu

SEQ ID NO: 1882494 - RNA, 16 nt, Homo sapiens
ugccauggcagacagu

SEQ ID NO: 1882495 - RNA, 20 nt, Homo sapiens
uugcuuggugcugguuuauu

SEQ ID NO: 1882496 - RNA, 15 nt, Homo sapiens
accccaaaguguccc

SEQ ID NO: 1882497 - RNA, 19 nt, Homo sapiens
aaggauccucuugacuccu

SEQ ID NO: 1882498 - RNA, 23 nt, Homo sapiens
cauguuguagauacaaucagcug

SEQ ID NO: 1882499 - RNA, 14 nt, Homo sapiens
agaucccagaggau

SEQ ID NO: 1882500 - RNA, 17 nt, Homo sapiens
agcaucuuauacgagua

SEQ ID NO: 1882501 - RNA, 13 nt, Homo sapiens
acccucauuccuu

SEQ ID NO: 1882502 - RNA, 21 nt, Homo sapiens
uaacgcaaaaauagcucuugc

SEQ ID NO: 1882503 - RNA, 15 nt, Homo sapiens
uggacccauuugcca

SEQ ID NO: 1882504 - RNA, 18 nt, Homo sapiens
aaauguggcccccagugg

SEQ ID NO: 1882505 - RNA, 16 nt, Homo sapiens
gaagaaacagcuauga

SEQ ID NO: 1882506 - RNA, 18 nt, Homo sapiens
agccaaauaaaaccucag

SEQ ID NO: 1882507 - RNA, 15 nt, Homo sapiens
uccaagccucaaagu

SEQ ID NO: 1882508 - RNA, 15 nt, Homo sapiens
cuucuuuacuagaua

SEQ ID NO: 1882509 - RNA, 15 nt, Homo sapiens
cagauucuagcacau

SEQ ID NO: 1882510 - RNA, 14 nt, Homo sapiens
cauuguacuccagc

SEQ ID NO: 1882511 - RNA, 16 nt, Homo sapiens
gggacauugcagagug

SEQ ID NO: 1882512 - RNA, 14 nt, Homo sapiens
agacuguggcucaa

SEQ ID NO: 1882513 - RNA, 21 nt, Homo sapiens
cuuccucagggccccugggga

SEQ ID NO: 1882514 - RNA, 16 nt, Homo sapiens
guauauaauaugucac

SEQ ID NO: 1882515 - RNA, 22 nt, Homo sapiens
aggacguuggccucagggccag

SEQ ID NO: 1882516 - RNA, 12 nt, Homo sapiens
ccaaaaucucaa

SEQ ID NO: 1882517 - RNA, 11 nt, Homo sapiens
caaacauauau

SEQ ID NO: 1882518 - RNA, 11 nt, Homo sapiens
uaaacauacau

SEQ ID NO: 1882519 - RNA, 16 nt, Homo sapiens
caaauguucacuggua

SEQ ID NO: 1882520 - RNA, 23 nt, Homo sapiens
ggaggcagccgccccaucugccc

SEQ ID NO: 1882521 - RNA, 17 nt, Homo sapiens
uguaaccagaauuauac

SEQ ID NO: 1882522 - RNA, 18 nt, Homo sapiens
cugugccagagauguacu

SEQ ID NO: 1882523 - RNA, 18 nt, Homo sapiens
ugaaucaaaucucuucca

SEQ ID NO: 1882524 - RNA, 17 nt, Homo sapiens
cuuuuaucuccuugugg

SEQ ID NO: 1882525 - RNA, 13 nt, Homo sapiens
cuuucuccagugu

SEQ ID NO: 1882526 - RNA, 14 nt, Homo sapiens
gauaccuccaaccc

SEQ ID NO: 1882527 - RNA, 14 nt, Homo sapiens
cuugccaaagcaga

SEQ ID NO: 1882528 - RNA, 16 nt, Homo sapiens
gugccuggccauguca

SEQ ID NO: 1882529 - RNA, 16 nt, Homo sapiens
gcauuguuuugguaua

SEQ ID NO: 1882530 - RNA, 16 nt, Homo sapiens
accuacagacuaagaa

SEQ ID NO: 1882531 - RNA, 19 nt, Homo sapiens
gaccaaaauaauacaacaa

SEQ ID NO: 1882532 - RNA, 18 nt, Homo sapiens
gcucuuaggcaaucacau

SEQ ID NO: 1882533 - RNA, 17 nt, Homo sapiens
gaaugugauauuugaag

SEQ ID NO: 1882534 - RNA, 20 nt, Homo sapiens
cuguuguaggguugccagau

SEQ ID NO: 1882535 - RNA, 17 nt, Homo sapiens
acacgcguggcaaacaa

SEQ ID NO: 1882536 - RNA, 19 nt, Homo sapiens
cuggaauaagaagcaaaua

SEQ ID NO: 1882537 - RNA, 19 nt, Homo sapiens
ccacaggcaaaacucagua

SEQ ID NO: 1882538 - RNA, 20 nt, Homo sapiens
ucaguuaagaugcuuugaca

SEQ ID NO: 1882539 - RNA, 22 nt, Homo sapiens
aaugcccuuacacuuacuguug

SEQ ID NO: 1882540 - RNA, 14 nt, Homo sapiens
gaaaugucuauguu

SEQ ID NO: 1882541 - RNA, 16 nt, Homo sapiens
uagcacaaacuacaau

SEQ ID NO: 1882542 - RNA, 18 nt, Homo sapiens
gagcagggcccucagagg

SEQ ID NO: 1882543 - RNA, 20 nt, Homo sapiens
cagaggucguuugauuucaa

SEQ ID NO: 1882544 - RNA, 23 nt, Homo sapiens
cuggacacacuguuacacgugcc

SEQ ID NO: 1882545 - RNA, 18 nt, Homo sapiens
auaauuuuuaauuuggcu

SEQ ID NO: 1882546 - RNA, 22 nt, Homo sapiens
ucuuuguaaagaaaguggcuug

SEQ ID NO: 1882547 - RNA, 17 nt, Homo sapiens
aggaagucccuugccau

SEQ ID NO: 1882548 - RNA, 20 nt, Homo sapiens
cagguuagaagcaaggcaca

SEQ ID NO: 1882549 - RNA, 20 nt, Homo sapiens
agagacugcaauuucuccaa

SEQ ID NO: 1882550 - RNA, 14 nt, Homo sapiens
ucugggaugaaggc

SEQ ID NO: 1882551 - RNA, 19 nt, Homo sapiens
uccccaacaagauugcuua

SEQ ID NO: 1882552 - RNA, 23 nt, Homo sapiens
acuuuguaucuucacugccaagc

SEQ ID NO: 1882553 - RNA, 16 nt, Homo sapiens
cauucacuuuccugca

SEQ ID NO: 1882554 - RNA, 18 nt, Homo sapiens
ucuuauacgucuagccua

SEQ ID NO: 1882555 - RNA, 16 nt, Homo sapiens
uccucccugucauaga

SEQ ID NO: 1882556 - RNA, 13 nt, Homo sapiens
uccugggacccuu

SEQ ID NO: 1882557 - RNA, 12 nt, Homo sapiens
ccuccuugcaac

SEQ ID NO: 1882558 - RNA, 21 nt, Homo sapiens
ugugcuaucaugauggaauuu

SEQ ID NO: 1882559 - RNA, 14 nt, Homo sapiens
ugccucugagccac

SEQ ID NO: 1882560 - RNA, 23 nt, Homo sapiens
ccaggccuuaucugaaaggccag

SEQ ID NO: 1882561 - RNA, 22 nt, Homo sapiens
gaaucaccaauggcuccuugcc

SEQ ID NO: 1882562 - RNA, 17 nt, Homo sapiens
augaaagguaaucugaa

SEQ ID NO: 1882563 - RNA, 23 nt, Homo sapiens
guugggauaaggaaacacuucua

SEQ ID NO: 1882564 - RNA, 14 nt, Homo sapiens
gcuuuuccucccuu

SEQ ID NO: 1882565 - RNA, 12 nt, Homo sapiens
gcaucugugaug

SEQ ID NO: 1882566 - RNA, 11 nt, Homo sapiens
uaacauuuuac

SEQ ID NO: 1882567 - RNA, 16 nt, Homo sapiens
gucacgugacccugug

SEQ ID NO: 1882568 - RNA, 23 nt, Homo sapiens
auauuuuccugauagcauaugac

SEQ ID NO: 1882569 - RNA, 16 nt, Homo sapiens
uggagcauaguggcaa

SEQ ID NO: 1882570 - RNA, 18 nt, Homo sapiens
uccugccuccagcacucc

SEQ ID NO: 1882571 - RNA, 17 nt, Homo sapiens
ccuuccagagaacacag

SEQ ID NO: 1882572 - RNA, 13 nt, Homo sapiens
uccucacugcuga

SEQ ID NO: 1882573 - RNA, 12 nt, Homo sapiens
aauauucacaca

SEQ ID NO: 1882574 - RNA, 17 nt, Homo sapiens
gaaacgagaagugcccu

SEQ ID NO: 1882575 - RNA, 14 nt, Homo sapiens
aauuuaacaagcuc

SEQ ID NO: 1882576 - RNA, 17 nt, Homo sapiens
accacuagaacucucca

SEQ ID NO: 1882577 - RNA, 21 nt, Homo sapiens
cgguuguauuuucugaucauu

SEQ ID NO: 1882578 - RNA, 14 nt, Homo sapiens
aaaccuccugcugu

SEQ ID NO: 1882579 - RNA, 14 nt, Homo sapiens
acaaagccaugcca

SEQ ID NO: 1882580 - RNA, 14 nt, Homo sapiens
acacaaccaugacg

SEQ ID NO: 1882581 - RNA, 23 nt, Homo sapiens
auuauagcccggugcagccucua

SEQ ID NO: 1882582 - RNA, 14 nt, Homo sapiens
cgcuagcaguacua

SEQ ID NO: 1882583 - RNA, 21 nt, Homo sapiens
aagucucaggggaccauuccc

SEQ ID NO: 1882584 - RNA, 15 nt, Homo sapiens
agaguucugcucuag

SEQ ID NO: 1882585 - RNA, 19 nt, Homo sapiens
gauaugcacuugaaaugau

SEQ ID NO: 1882586 - RNA, 18 nt, Homo sapiens
cccaaucuuucuauauaa

SEQ ID NO: 1882587 - RNA, 21 nt, Homo sapiens
cagcuuucccuggcucaggga

SEQ ID NO: 1882588 - RNA, 23 nt, Homo sapiens
gacccuguccugcagucccacac

SEQ ID NO: 1882589 - RNA, 13 nt, Homo sapiens
gacccucugggaa

SEQ ID NO: 1882590 - RNA, 23 nt, Homo sapiens
uauccaguggauggauucaucau

SEQ ID NO: 1882591 - RNA, 16 nt, Homo sapiens
cauuuuucacaucucu

SEQ ID NO: 1882592 - RNA, 23 nt, Homo sapiens
agaacggggcucuucucauuuca

SEQ ID NO: 1882593 - RNA, 18 nt, Homo sapiens
cauagcuugcaguuucau

SEQ ID NO: 1882594 - RNA, 22 nt, Homo sapiens
aaagcaguggcuuagcugccau

SEQ ID NO: 1882595 - RNA, 20 nt, Homo sapiens
aauagcuguuuuguguauau

SEQ ID NO: 1882596 - RNA, 14 nt, Homo sapiens
acccuuucuucaau

SEQ ID NO: 1882597 - RNA, 11 nt, Homo sapiens
gugugggagac

SEQ ID NO: 1882598 - RNA, 23 nt, Homo sapiens
augaggaccaagggcaccuggag

SEQ ID NO: 1882599 - RNA, 20 nt, Homo sapiens
gacaaaggaaucaauuacuu

SEQ ID NO: 1882600 - RNA, 17 nt, Homo sapiens
ucugugcaugguggcac

SEQ ID NO: 1882601 - RNA, 19 nt, Homo sapiens
aaagaauguuaagauuuau

SEQ ID NO: 1882602 - RNA, 19 nt, Homo sapiens
uucagauccugaauuccag

SEQ ID NO: 1882603 - RNA, 18 nt, Homo sapiens
aauugcuucacagccuug

SEQ ID NO: 1882604 - RNA, 13 nt, Homo sapiens
aguccaccacagc

SEQ ID NO: 1882605 - RNA, 19 nt, Homo sapiens
uucagcacaaagacacaga

SEQ ID NO: 1882606 - RNA, 12 nt, Homo sapiens
gcccuguggcag

SEQ ID NO: 1882607 - RNA, 20 nt, Homo sapiens
aacgaugccugcaggcaugg

SEQ ID NO: 1882608 - RNA, 15 nt, Homo sapiens
uuuuguggcaaaaua

SEQ ID NO: 1882609 - RNA, 16 nt, Homo sapiens
ggagcaucaagccacu

SEQ ID NO: 1882610 - RNA, 14 nt, Homo sapiens
aucucagucacuuu

SEQ ID NO: 1882611 - RNA, 19 nt, Homo sapiens
gugcuccuucauaagccau

SEQ ID NO: 1882612 - RNA, 13 nt, Homo sapiens
uuaagugugcuua

SEQ ID NO: 1882613 - RNA, 18 nt, Homo sapiens
aucuuccccaacgaaaag

SEQ ID NO: 1882614 - RNA, 13 nt, Homo sapiens
ccuggacacacac

SEQ ID NO: 1882615 - RNA, 15 nt, Homo sapiens
uauggaaauccacaa

SEQ ID NO: 1882616 - RNA, 18 nt, Homo sapiens
gacccaugcugcccugug

SEQ ID NO: 1882617 - RNA, 23 nt, Homo sapiens
auuuggggaccaaaggucaggga

SEQ ID NO: 1882618 - RNA, 14 nt, Homo sapiens
ugguaaaugaucac

SEQ ID NO: 1882619 - RNA, 14 nt, Homo sapiens
ugccuuaucuugca

SEQ ID NO: 1882620 - RNA, 24 nt, Homo sapiens
uccaauuaaggauuuuaugcuuua

SEQ ID NO: 1882621 - RNA, 14 nt, Homo sapiens
gaugacccacuguc

SEQ ID NO: 1882622 - RNA, 17 nt, Homo sapiens
cucuggagcagccaagg

SEQ ID NO: 1882623 - RNA, 19 nt, Homo sapiens
auagcaauaucauaauuaa

SEQ ID NO: 1882624 - RNA, 15 nt, Homo sapiens
ucaagcuguccuccc

SEQ ID NO: 1882625 - RNA, 22 nt, Homo sapiens
aagcgcuguugcccgcccucca

SEQ ID NO: 1882626 - RNA, 23 nt, Homo sapiens
aauucguucuguaaggagcacca

SEQ ID NO: 1882627 - RNA, 21 nt, Homo sapiens
ugccauaaugacucagaauau

SEQ ID NO: 1882628 - RNA, 16 nt, Homo sapiens
aaacaccaggauuuaa

SEQ ID NO: 1882629 - RNA, 23 nt, Homo sapiens
gccggucauggugguggacaccu

SEQ ID NO: 1882630 - RNA, 19 nt, Homo sapiens
ggccaagguguccaggguc

SEQ ID NO: 1882631 - RNA, 18 nt, Homo sapiens
aaugcuuucucuccucuu

SEQ ID NO: 1882632 - RNA, 15 nt, Homo sapiens
cuuguccuccuaaua

SEQ ID NO: 1882633 - RNA, 22 nt, Homo sapiens
agcccccagcuaagaaccugga

SEQ ID NO: 1882634 - RNA, 13 nt, Homo sapiens
uccaauggcugua

SEQ ID NO: 1882635 - RNA, 20 nt, Homo sapiens
acugggcugguugugcugca

SEQ ID NO: 1882636 - RNA, 17 nt, Homo sapiens
uuugcugcagucaucua

SEQ ID NO: 1882637 - RNA, 13 nt, Homo sapiens
auuccacugaaaa

SEQ ID NO: 1882638 - RNA, 22 nt, Homo sapiens
acuuaccucugcuucugaccga

SEQ ID NO: 1882639 - RNA, 18 nt, Homo sapiens
gagugaaaaaagucaccu

SEQ ID NO: 1882640 - RNA, 18 nt, Homo sapiens
ccacugagcccuugcaca

SEQ ID NO: 1882641 - RNA, 20 nt, Homo sapiens
uucaucaggaaggaaaugac

SEQ ID NO: 1882642 - RNA, 12 nt, Homo sapiens
agcccagaauaa

SEQ ID NO: 1882643 - RNA, 18 nt, Homo sapiens
gaaccauaguugacaguu

SEQ ID NO: 1882644 - RNA, 16 nt, Homo sapiens
aagaucugcaacuacu

SEQ ID NO: 1882645 - RNA, 17 nt, Homo sapiens
caaacaaugaaaguggg

SEQ ID NO: 1882646 - RNA, 20 nt, Homo sapiens
gguccuaaccagugagcacu

SEQ ID NO: 1882647 - RNA, 14 nt, Homo sapiens
aaauacacauagca

SEQ ID NO: 1882648 - RNA, 21 nt, Homo sapiens
cuaugacauaaaaacaacuuu

SEQ ID NO: 1882649 - RNA, 18 nt, Homo sapiens
gucuggcccacugugcag

SEQ ID NO: 1882650 - RNA, 19 nt, Homo sapiens
cauuuuaguaugaagcaau

SEQ ID NO: 1882651 - RNA, 20 nt, Homo sapiens
cuaaaaacacuggauucauu

SEQ ID NO: 1882652 - RNA, 14 nt, Homo sapiens
agaaaaaaacuucu

SEQ ID NO: 1882653 - RNA, 18 nt, Homo sapiens
caguuuuuuuuuuuccag

SEQ ID NO: 1882654 - RNA, 16 nt, Homo sapiens
cucacacuaaucugaa

SEQ ID NO: 1882655 - RNA, 14 nt, Homo sapiens
cacacugaucugaa

SEQ ID NO: 1882656 - RNA, 15 nt, Homo sapiens
uacuauugcauuuua

SEQ ID NO: 1882657 - RNA, 14 nt, Homo sapiens
ugaaggcuguccuu

SEQ ID NO: 1882658 - RNA, 18 nt, Homo sapiens
ccauucugacauccacau

SEQ ID NO: 1882659 - RNA, 23 nt, Homo sapiens
cccuccuuuucacggagaccuau

SEQ ID NO: 1882660 - RNA, 20 nt, Homo sapiens
caguucugagcaccguguca

SEQ ID NO: 1882661 - RNA, 13 nt, Homo sapiens
ugguaccagauaa

SEQ ID NO: 1882662 - RNA, 18 nt, Homo sapiens
acaguuaaacuugcaaug

SEQ ID NO: 1882663 - RNA, 19 nt, Homo sapiens
ucauaacugguagcuauaa

SEQ ID NO: 1882664 - RNA, 13 nt, Homo sapiens
ccuugaagacaga

SEQ ID NO: 1882665 - RNA, 17 nt, Homo sapiens
caggugccagagcuaaa

SEQ ID NO: 1882666 - RNA, 22 nt, Homo sapiens
acauauuuuuauacuuuauuga

SEQ ID NO: 1882667 - RNA, 14 nt, Homo sapiens
uguguguuguaaca

SEQ ID NO: 1882668 - RNA, 12 nt, Homo sapiens
uccugaccaaag

SEQ ID NO: 1882669 - RNA, 14 nt, Homo sapiens
cacaugaccuccau

SEQ ID NO: 1882670 - RNA, 12 nt, Homo sapiens
augaacauacug

SEQ ID NO: 1882671 - RNA, 17 nt, Homo sapiens
agaggguggguguucau

SEQ ID NO: 1882672 - RNA, 13 nt, Homo sapiens
gagugaugggcaa

SEQ ID NO: 1882673 - RNA, 22 nt, Homo sapiens
uucuacuuccuguaauguacaa

SEQ ID NO: 1882674 - RNA, 16 nt, Homo sapiens
augaaaaacaaccaag

SEQ ID NO: 1882675 - RNA, 21 nt, Homo sapiens
caggaagucuuuccugauaua

SEQ ID NO: 1882676 - RNA, 14 nt, Homo sapiens
aaugcuucauucaa

SEQ ID NO: 1882677 - RNA, 14 nt, Homo sapiens
uaugcuucuuucaa

SEQ ID NO: 1882678 - RNA, 23 nt, Homo sapiens
ucucacuaguugucagcuucucu

SEQ ID NO: 1882679 - RNA, 16 nt, Homo sapiens
uugucccaagugccaa

SEQ ID NO: 1882680 - RNA, 17 nt, Homo sapiens
aagauccagcugccuau

SEQ ID NO: 1882681 - RNA, 22 nt, Homo sapiens
agcuuucccagagacccgggga

SEQ ID NO: 1882682 - RNA, 22 nt, Homo sapiens
ugcaucacuuaacggaccaaag

SEQ ID NO: 1882683 - RNA, 20 nt, Homo sapiens
cauguauguuuuuuacuguu

SEQ ID NO: 1882684 - RNA, 21 nt, Homo sapiens
acagcccucaugaucauucuc

SEQ ID NO: 1882685 - RNA, 22 nt, Homo sapiens
caggaagacuuugugacuguca

SEQ ID NO: 1882686 - RNA, 20 nt, Homo sapiens
acuauuaagcaagaaugcag

SEQ ID NO: 1882687 - RNA, 14 nt, Homo sapiens
cucagcugguccug

SEQ ID NO: 1882688 - RNA, 14 nt, Homo sapiens
aaccaaagucacaa

SEQ ID NO: 1882689 - RNA, 20 nt, Homo sapiens
agucagacugauagacacca

SEQ ID NO: 1882690 - RNA, 19 nt, Homo sapiens
aucaccagaaaugauagcg

SEQ ID NO: 1882691 - RNA, 21 nt, Homo sapiens
caugguguguguguccagagg

SEQ ID NO: 1882692 - RNA, 12 nt, Homo sapiens
cagauugcugca

SEQ ID NO: 1882693 - RNA, 12 nt, Homo sapiens
uggauugccaca

SEQ ID NO: 1882694 - RNA, 15 nt, Homo sapiens
aaggccccucugugg

SEQ ID NO: 1882695 - RNA, 13 nt, Homo sapiens
gcuauacauaugu

SEQ ID NO: 1882696 - RNA, 18 nt, Homo sapiens
guucugggacuacaggca

SEQ ID NO: 1882697 - RNA, 12 nt, Homo sapiens
uaaccugaauua

SEQ ID NO: 1882698 - RNA, 23 nt, Homo sapiens
ccucauuagauuacauuguaguu

SEQ ID NO: 1882699 - RNA, 18 nt, Homo sapiens
cagccaagccaagaggau

SEQ ID NO: 1882700 - RNA, 16 nt, Homo sapiens
uauucauaaugugaga

SEQ ID NO: 1882701 - RNA, 18 nt, Homo sapiens
aacaacguacuauggaag

SEQ ID NO: 1882702 - RNA, 16 nt, Homo sapiens
gcaaagcccccagagc

SEQ ID NO: 1882703 - RNA, 22 nt, Homo sapiens
accucaagcaaccaugaacuca

SEQ ID NO: 1882704 - RNA, 22 nt, Homo sapiens
cugagugaaggaaaugaaucuu

SEQ ID NO: 1882705 - RNA, 19 nt, Homo sapiens
uaaauguuuguuuauauca

SEQ ID NO: 1882706 - RNA, 15 nt, Homo sapiens
guaacccucacccac

SEQ ID NO: 1882707 - RNA, 21 nt, Homo sapiens
uaucuuuguauauauguguau

SEQ ID NO: 1882708 - RNA, 22 nt, Homo sapiens
cccaaugcacauccauucccaa

SEQ ID NO: 1882709 - RNA, 17 nt, Homo sapiens
cuccugaccaaguagau

SEQ ID NO: 1882710 - RNA, 15 nt, Homo sapiens
gggucaucgauucaa

SEQ ID NO: 1882711 - RNA, 15 nt, Homo sapiens
uguccagugccuaca

SEQ ID NO: 1882712 - RNA, 12 nt, Homo sapiens
uuucugacacag

SEQ ID NO: 1882713 - RNA, 15 nt, Homo sapiens
augcugcuguacaac

SEQ ID NO: 1882714 - RNA, 16 nt, Homo sapiens
ucagcuacacaaggaa

SEQ ID NO: 1882715 - RNA, 14 nt, Homo sapiens
uacaaaacuguuca

SEQ ID NO: 1882716 - RNA, 17 nt, Homo sapiens
aaauaugaagacauaaa

SEQ ID NO: 1882717 - RNA, 17 nt, Homo sapiens
aaacucuucagugcaaa

SEQ ID NO: 1882718 - RNA, 17 nt, Homo sapiens
gcccugaacccacugcu

SEQ ID NO: 1882719 - RNA, 14 nt, Homo sapiens
ucuugaaaguauug

SEQ ID NO: 1882720 - RNA, 16 nt, Homo sapiens
aauuaugucugcugaa

SEQ ID NO: 1882721 - RNA, 19 nt, Homo sapiens
cugacauaauggggauuaa

SEQ ID NO: 1882722 - RNA, 13 nt, Homo sapiens
caauaaugcagua

SEQ ID NO: 1882723 - RNA, 23 nt, Homo sapiens
uuauugccuggagugugaacugu

SEQ ID NO: 1882724 - RNA, 14 nt, Homo sapiens
aucauuaagaauaa

SEQ ID NO: 1882725 - RNA, 16 nt, Homo sapiens
cuuuaggaugacugua

SEQ ID NO: 1882726 - RNA, 15 nt, Homo sapiens
ugggagaaccaaaaa

SEQ ID NO: 1882727 - RNA, 18 nt, Homo sapiens
cccuuccuggucuuugaa

SEQ ID NO: 1882728 - RNA, 16 nt, Homo sapiens
gcuucccccacuucac

SEQ ID NO: 1882729 - RNA, 16 nt, Homo sapiens
gcccacaguaggcacu

SEQ ID NO: 1882730 - RNA, 14 nt, Homo sapiens
gcaaugacauuuau

SEQ ID NO: 1882731 - RNA, 20 nt, Homo sapiens
aacuccagcaacuucuucuc

SEQ ID NO: 1882732 - RNA, 13 nt, Homo sapiens
cacauucuucagu

SEQ ID NO: 1882733 - RNA, 22 nt, Homo sapiens
uauuaccuccccuacucccuua

SEQ ID NO: 1882734 - RNA, 19 nt, Homo sapiens
guguuuaauuaaauuucac

SEQ ID NO: 1882735 - RNA, 15 nt, Homo sapiens
cacuuggcauacaaa

SEQ ID NO: 1882736 - RNA, 21 nt, Homo sapiens
guggugaccaaugcauuaccu

SEQ ID NO: 1882737 - RNA, 15 nt, Homo sapiens
uaacuucuguugaca

SEQ ID NO: 1882738 - RNA, 21 nt, Homo sapiens
gcacucacuccugacugcccg

SEQ ID NO: 1882739 - RNA, 15 nt, Homo sapiens
cuuagauucagggga

SEQ ID NO: 1882740 - RNA, 18 nt, Homo sapiens
ccugauguuuacaguguc

SEQ ID NO: 1882741 - RNA, 21 nt, Homo sapiens
gauugagugcuccugugugcu

SEQ ID NO: 1882742 - RNA, 19 nt, Homo sapiens
acagcucacugcagccuca

SEQ ID NO: 1882743 - RNA, 15 nt, Homo sapiens
uggggaaaaaagcac

SEQ ID NO: 1882744 - RNA, 21 nt, Homo sapiens
uacuuuacuaauaaacugugu

SEQ ID NO: 1882745 - RNA, 18 nt, Homo sapiens
gaaauacaguacuguuuc

SEQ ID NO: 1882746 - RNA, 15 nt, Homo sapiens
ugguaggcauuuccu

SEQ ID NO: 1882747 - RNA, 19 nt, Homo sapiens
aggcccgaaggucucucug

SEQ ID NO: 1882748 - RNA, 15 nt, Homo sapiens
ugaccuguguucccu

SEQ ID NO: 1882749 - RNA, 23 nt, Homo sapiens
uggccagggguggugagggcagu

SEQ ID NO: 1882750 - RNA, 17 nt, Homo sapiens
ggccggaaccacagggc

SEQ ID NO: 1882751 - RNA, 18 nt, Homo sapiens
aaauggugagauguaugu

SEQ ID NO: 1882752 - RNA, 17 nt, Homo sapiens
aggaugaaucauauuca

SEQ ID NO: 1882753 - RNA, 15 nt, Homo sapiens
ggacucuucucaucc

SEQ ID NO: 1882754 - RNA, 15 nt, Homo sapiens
ugagcagaugauucc

SEQ ID NO: 1882755 - RNA, 23 nt, Homo sapiens
agccuaccccuccugcgcugccc

SEQ ID NO: 1882756 - RNA, 22 nt, Homo sapiens
auaaagaucaaacaugcaugga

SEQ ID NO: 1882757 - RNA, 14 nt, Homo sapiens
auuaucuucaggac

SEQ ID NO: 1882758 - RNA, 14 nt, Homo sapiens
aggaaggacugugc

SEQ ID NO: 1882759 - RNA, 14 nt, Homo sapiens
cuuuagagugcaag

SEQ ID NO: 1882760 - RNA, 16 nt, Homo sapiens
uuccauuaaacuacuu

SEQ ID NO: 1882761 - RNA, 14 nt, Homo sapiens
gaaguugaaaauca

SEQ ID NO: 1882762 - RNA, 19 nt, Homo sapiens
ggauagaucaaagucaaaa

SEQ ID NO: 1882763 - RNA, 19 nt, Homo sapiens
aauguacaauaaagcaaug

SEQ ID NO: 1882764 - RNA, 19 nt, Homo sapiens
aaagagcuguuauacugug

SEQ ID NO: 1882765 - RNA, 22 nt, Homo sapiens
gauuggguuggaaugcuuucca

SEQ ID NO: 1882766 - RNA, 17 nt, Homo sapiens
gcccaggcugugcagcg

SEQ ID NO: 1882767 - RNA, 15 nt, Homo sapiens
ugaguuuuguauuca

SEQ ID NO: 1882768 - RNA, 17 nt, Homo sapiens
acugaguccacucggag

SEQ ID NO: 1882769 - RNA, 22 nt, Homo sapiens
aaggaguacaaugcccagauca

SEQ ID NO: 1882770 - RNA, 19 nt, Homo sapiens
aucuagaagagucuauugu

SEQ ID NO: 1882771 - RNA, 21 nt, Homo sapiens
cugacagagcccuaucuaugu

SEQ ID NO: 1882772 - RNA, 14 nt, Homo sapiens
ccugcucaagucua

SEQ ID NO: 1882773 - RNA, 18 nt, Homo sapiens
cuguuaucaaacugcugu

SEQ ID NO: 1882774 - RNA, 13 nt, Homo sapiens
aaauaaaccugga

SEQ ID NO: 1882775 - RNA, 21 nt, Homo sapiens
agaaguauuuuuuuaauuucu

SEQ ID NO: 1882776 - RNA, 14 nt, Homo sapiens
auuucucagaacaa

SEQ ID NO: 1882777 - RNA, 13 nt, Homo sapiens
agggacuugccuc

SEQ ID NO: 1882778 - RNA, 13 nt, Homo sapiens
caauuugcugcca

SEQ ID NO: 1882779 - RNA, 14 nt, Homo sapiens
ugacagggccagug

SEQ ID NO: 1882780 - RNA, 15 nt, Homo sapiens
acugcucaggccuca

SEQ ID NO: 1882781 - RNA, 14 nt, Homo sapiens
agcaucucugagca

SEQ ID NO: 1882782 - RNA, 21 nt, Homo sapiens
augaaaccugugucucugaga

SEQ ID NO: 1882783 - RNA, 16 nt, Homo sapiens
ugcuguucagccuuug

SEQ ID NO: 1882784 - RNA, 12 nt, Homo sapiens
ucgaguguuuca

SEQ ID NO: 1882785 - RNA, 12 nt, Homo sapiens
uccuguguuugu

SEQ ID NO: 1882786 - RNA, 19 nt, Homo sapiens
uggaaagcggcuagguuuu

SEQ ID NO: 1882787 - RNA, 14 nt, Homo sapiens
uauggacaccgacu

SEQ ID NO: 1882788 - RNA, 22 nt, Homo sapiens
aacucuuucuggccugccuucg

SEQ ID NO: 1882789 - RNA, 20 nt, Homo sapiens
ucuucaccaggaagaaggcc

SEQ ID NO: 1882790 - RNA, 20 nt, Homo sapiens
ugagccaccgugcccggcca

SEQ ID NO: 1882791 - RNA, 14 nt, Homo sapiens
uuagcaagacagca

SEQ ID NO: 1882792 - RNA, 23 nt, Homo sapiens
caguucacaaacaguaaaggcca

SEQ ID NO: 1882793 - RNA, 19 nt, Homo sapiens
gcacucagaagacacugau

SEQ ID NO: 1882794 - RNA, 13 nt, Homo sapiens
cuugaagcacuua

SEQ ID NO: 1882795 - RNA, 20 nt, Homo sapiens
acaggggucgccaacacuug

SEQ ID NO: 1882796 - RNA, 21 nt, Homo sapiens
agccuccagugcuggcugcug

SEQ ID NO: 1882797 - RNA, 23 nt, Homo sapiens
gcuccugcagcauggucccugcc

SEQ ID NO: 1882798 - RNA, 22 nt, Homo sapiens
acauucuuuuucuguugaaacu

SEQ ID NO: 1882799 - RNA, 21 nt, Homo sapiens
aguaggcccggugugguggcu

SEQ ID NO: 1882800 - RNA, 14 nt, Homo sapiens
caaggcagauccuc

SEQ ID NO: 1882801 - RNA, 19 nt, Homo sapiens
gggccuggcaggccagugu

SEQ ID NO: 1882802 - RNA, 19 nt, Homo sapiens
cugcagccugccccuguga

SEQ ID NO: 1882803 - RNA, 15 nt, Homo sapiens
uggcccuguacaguu

SEQ ID NO: 1882804 - RNA, 15 nt, Homo sapiens
acaaagcuuuugcau

SEQ ID NO: 1882805 - RNA, 17 nt, Homo sapiens
aaauaccacaagccuga

SEQ ID NO: 1882806 - RNA, 15 nt, Homo sapiens
ccucagcaagccaug

SEQ ID NO: 1882807 - RNA, 22 nt, Homo sapiens
ucuggccuguggcuaauggagg

SEQ ID NO: 1882808 - RNA, 23 nt, Homo sapiens
uaaaaauuuuuacaaaacugcca

SEQ ID NO: 1882809 - RNA, 14 nt, Homo sapiens
uuacuccauauaua

SEQ ID NO: 1882810 - RNA, 18 nt, Homo sapiens
agucaacucaacauggca

SEQ ID NO: 1882811 - RNA, 11 nt, Homo sapiens
aucaaguaaua

SEQ ID NO: 1882812 - RNA, 17 nt, Homo sapiens
guuuucagauuccacac

SEQ ID NO: 1882813 - RNA, 22 nt, Homo sapiens
acauauaucuacacauacagaa

SEQ ID NO: 1882814 - RNA, 17 nt, Homo sapiens
ucaagacuuagcuccug

SEQ ID NO: 1882815 - RNA, 17 nt, Homo sapiens
agguugacagauacuuu

SEQ ID NO: 1882816 - RNA, 15 nt, Homo sapiens
uauggcaugauuuau

SEQ ID NO: 1882817 - RNA, 21 nt, Homo sapiens
ugaacauuccuaucaauccaa

SEQ ID NO: 1882818 - RNA, 15 nt, Homo sapiens
ugaaauaagcuauuu

SEQ ID NO: 1882819 - RNA, 22 nt, Homo sapiens
aguacuuugguuucugagcacc

SEQ ID NO: 1882820 - RNA, 12 nt, Homo sapiens
uuaaaguauaaa

SEQ ID NO: 1882821 - RNA, 20 nt, Homo sapiens
uguggccgccaccugaggug

SEQ ID NO: 1882822 - RNA, 20 nt, Homo sapiens
gauuuucgacguuugacuag

SEQ ID NO: 1882823 - RNA, 20 nt, Homo sapiens
cacuggaucaaguucagcca

SEQ ID NO: 1882824 - RNA, 21 nt, Homo sapiens
gaguacacucagccacuguca

SEQ ID NO: 1882825 - RNA, 19 nt, Homo sapiens
acaagaaggccacugguag

SEQ ID NO: 1882826 - RNA, 17 nt, Homo sapiens
gcauucaaaguaauaua

SEQ ID NO: 1882827 - RNA, 16 nt, Homo sapiens
aguguaauuagcuuuu

SEQ ID NO: 1882828 - RNA, 16 nt, Homo sapiens
uagcaauuagugauau

SEQ ID NO: 1882829 - RNA, 17 nt, Homo sapiens
uuuugacagggucucac

SEQ ID NO: 1882830 - RNA, 14 nt, Homo sapiens
agacacagcaagac

SEQ ID NO: 1882831 - RNA, 19 nt, Homo sapiens
gcucuuccuggacagugag

SEQ ID NO: 1882832 - RNA, 14 nt, Homo sapiens
uggugaggcaauaa

SEQ ID NO: 1882833 - RNA, 20 nt, Homo sapiens
agcaaauuugugguuguaga

SEQ ID NO: 1882834 - RNA, 12 nt, Homo sapiens
ugauugugaaac

SEQ ID NO: 1882835 - RNA, 16 nt, Homo sapiens
uggcauuuuacuguac

SEQ ID NO: 1882836 - RNA, 23 nt, Homo sapiens
caucuugugguaacuugcugcuu

SEQ ID NO: 1882837 - RNA, 18 nt, Homo sapiens
aagagugaauucccucac

SEQ ID NO: 1882838 - RNA, 13 nt, Homo sapiens
gcgaguacuggga

SEQ ID NO: 1882839 - RNA, 12 nt, Homo sapiens
acaguagugcau

SEQ ID NO: 1882840 - RNA, 14 nt, Homo sapiens
auuuuguccauguc

SEQ ID NO: 1882841 - RNA, 13 nt, Homo sapiens
ccauccaguggag

SEQ ID NO: 1882842 - RNA, 16 nt, Homo sapiens
aaaguaugcagauuau

SEQ ID NO: 1882843 - RNA, 22 nt, Homo sapiens
cagcugccccuggcaccugugu

SEQ ID NO: 1882844 - RNA, 12 nt, Homo sapiens
aucucacugcag

SEQ ID NO: 1882845 - RNA, 14 nt, Homo sapiens
cacagaggaugcug

SEQ ID NO: 1882846 - RNA, 14 nt, Homo sapiens
augcagcaucuaag

SEQ ID NO: 1882847 - RNA, 17 nt, Homo sapiens
gaaccuccucugugaag

SEQ ID NO: 1882848 - RNA, 14 nt, Homo sapiens
ccagaagugccaug

SEQ ID NO: 1882849 - RNA, 23 nt, Homo sapiens
uacauauuccaugggacuuuccu

SEQ ID NO: 1882850 - RNA, 20 nt, Homo sapiens
uguuacugacuccucagucc

SEQ ID NO: 1882851 - RNA, 15 nt, Homo sapiens
cuucuggggguggug

SEQ ID NO: 1882852 - RNA, 21 nt, Homo sapiens
ucugcugaaucaaaucucuuc

SEQ ID NO: 1882853 - RNA, 12 nt, Homo sapiens
cauuuauagaau

SEQ ID NO: 1882854 - RNA, 22 nt, Homo sapiens
aaauggccaccaccauucuccu

SEQ ID NO: 1882855 - RNA, 14 nt, Homo sapiens
cuaaaucaccagaa

SEQ ID NO: 1882856 - RNA, 22 nt, Homo sapiens
ccggcugguugugggcacuggc

SEQ ID NO: 1882857 - RNA, 19 nt, Homo sapiens
ugaaccuuccaucucgcca

SEQ ID NO: 1882858 - RNA, 16 nt, Homo sapiens
ucuggggcacuguuga

SEQ ID NO: 1882859 - RNA, 11 nt, Homo sapiens
caccaguguua

SEQ ID NO: 1882860 - RNA, 15 nt, Homo sapiens
aacuaaacagauaaa

SEQ ID NO: 1882861 - RNA, 15 nt, Homo sapiens
aggacuaugacaaau

SEQ ID NO: 1882862 - RNA, 14 nt, Homo sapiens
cugaacuauuucag

SEQ ID NO: 1882863 - RNA, 11 nt, Homo sapiens
ucugauuucag

SEQ ID NO: 1882864 - RNA, 12 nt, Homo sapiens
uucaucuaauaa

SEQ ID NO: 1882865 - RNA, 23 nt, Homo sapiens
aaucccucaaaacaaucuuguca

SEQ ID NO: 1882866 - RNA, 18 nt, Homo sapiens
cuucagaaauauaugcag

SEQ ID NO: 1882867 - RNA, 13 nt, Homo sapiens
guacagaccuccg

SEQ ID NO: 1882868 - RNA, 20 nt, Homo sapiens
gggcaccaggggccaaccuc

SEQ ID NO: 1882869 - RNA, 23 nt, Homo sapiens
cugaaggcaaaucuccuuugucc

SEQ ID NO: 1882870 - RNA, 15 nt, Homo sapiens
ugcaguucccaucuc

SEQ ID NO: 1882871 - RNA, 12 nt, Homo sapiens
ucccuuugugaa

SEQ ID NO: 1882872 - RNA, 19 nt, Homo sapiens
uguucacggugacacaggu

SEQ ID NO: 1882873 - RNA, 24 nt, Homo sapiens
aaagcuuugggggagugggcgcag

SEQ ID NO: 1882874 - RNA, 23 nt, Homo sapiens
ccaucugggcuuauauguacuuu

SEQ ID NO: 1882875 - RNA, 13 nt, Homo sapiens
cuuuuaaguugcu

SEQ ID NO: 1882876 - RNA, 21 nt, Homo sapiens
cagacuuuuguguaaaaagca

SEQ ID NO: 1882877 - RNA, 14 nt, Homo sapiens
ugucaugugucuca

SEQ ID NO: 1882878 - RNA, 22 nt, Homo sapiens
aaaugugaccguccauccuccu

SEQ ID NO: 1882879 - RNA, 17 nt, Homo sapiens
cuauugcuggcaaagac

SEQ ID NO: 1882880 - RNA, 13 nt, Homo sapiens
augaaauugccaa

SEQ ID NO: 1882881 - RNA, 20 nt, Homo sapiens
caaauauguagaauguaaua

SEQ ID NO: 1882882 - RNA, 21 nt, Homo sapiens
caagaccaugggguggaagga

SEQ ID NO: 1882883 - RNA, 16 nt, Homo sapiens
accuccccagacaggg

SEQ ID NO: 1882884 - RNA, 21 nt, Homo sapiens
ucaccucuuaugcacaccucc

SEQ ID NO: 1882885 - RNA, 21 nt, Homo sapiens
ccagaggaaucuauaguuuaa

SEQ ID NO: 1882886 - RNA, 23 nt, Homo sapiens
aacuagccagacaaaauuugaga

SEQ ID NO: 1882887 - RNA, 15 nt, Homo sapiens
accuucaauacuuaa

SEQ ID NO: 1882888 - RNA, 17 nt, Homo sapiens
acuggacagacccaggu

SEQ ID NO: 1882889 - RNA, 17 nt, Homo sapiens
augugcagauaucacag

SEQ ID NO: 1882890 - RNA, 17 nt, Homo sapiens
aaaaaccccaaacuguu

SEQ ID NO: 1882891 - RNA, 23 nt, Homo sapiens
aguaggauuuugagggugggggu

SEQ ID NO: 1882892 - RNA, 22 nt, Homo sapiens
uguuuuuaaagaaaagcauuca

SEQ ID NO: 1882893 - RNA, 23 nt, Homo sapiens
uaaagggcaggugguucuaauau

SEQ ID NO: 1882894 - RNA, 14 nt, Homo sapiens
agguucaaugagau

SEQ ID NO: 1882895 - RNA, 13 nt, Homo sapiens
ucauucauuugca

SEQ ID NO: 1882896 - RNA, 23 nt, Homo sapiens
acaaacaaccugccacaauguga

SEQ ID NO: 1882897 - RNA, 21 nt, Homo sapiens
uauauauuuuugugcacauuu

SEQ ID NO: 1882898 - RNA, 17 nt, Homo sapiens
uaaacacccaugaauca

SEQ ID NO: 1882899 - RNA, 15 nt, Homo sapiens
aacucuugagaucuu

SEQ ID NO: 1882900 - RNA, 15 nt, Homo sapiens
uacauaugugaauau

SEQ ID NO: 1882901 - RNA, 22 nt, Homo sapiens
gaacugacaggcagccuggaca

SEQ ID NO: 1882902 - RNA, 14 nt, Homo sapiens
gagcggcuggagaa

SEQ ID NO: 1882903 - RNA, 22 nt, Homo sapiens
auucaaguugcuucucauggau

SEQ ID NO: 1882904 - RNA, 12 nt, Homo sapiens
ucaacaguguga

SEQ ID NO: 1882905 - RNA, 16 nt, Homo sapiens
auccaacuccaggaua

SEQ ID NO: 1882906 - RNA, 14 nt, Homo sapiens
gcuuagacagcagg

SEQ ID NO: 1882907 - RNA, 19 nt, Homo sapiens
agaccucuuuuucuuacca

SEQ ID NO: 1882908 - RNA, 16 nt, Homo sapiens
auuugauacauaauaa

SEQ ID NO: 1882909 - RNA, 15 nt, Homo sapiens
ucauccugacucugc

SEQ ID NO: 1882910 - RNA, 17 nt, Homo sapiens
ccuuguccugccagcug

SEQ ID NO: 1882911 - RNA, 18 nt, Homo sapiens
acuugaagggccagagcc

SEQ ID NO: 1882912 - RNA, 17 nt, Homo sapiens
agagaccacacauuuua

SEQ ID NO: 1882913 - RNA, 20 nt, Homo sapiens
ccacguauucauucagugag

SEQ ID NO: 1882914 - RNA, 16 nt, Homo sapiens
cuuuagucugcaaaau

SEQ ID NO: 1882915 - RNA, 18 nt, Homo sapiens
uaauuuuaguuauacucc

SEQ ID NO: 1882916 - RNA, 15 nt, Homo sapiens
caugaaaaacacggc

SEQ ID NO: 1882917 - RNA, 15 nt, Homo sapiens
uccugauuccuuuaa

SEQ ID NO: 1882918 - RNA, 15 nt, Homo sapiens
uggaaucuagccgau

SEQ ID NO: 1882919 - RNA, 22 nt, Homo sapiens
uagugauuugccucaacaacgu

SEQ ID NO: 1882920 - RNA, 14 nt, Homo sapiens
cagccucccaagua

SEQ ID NO: 1882921 - RNA, 18 nt, Homo sapiens
aaaaggccaauauaccua

SEQ ID NO: 1882922 - RNA, 17 nt, Homo sapiens
ucauuguucuugugaac

SEQ ID NO: 1882923 - RNA, 13 nt, Homo sapiens
ugcugugcugugu

SEQ ID NO: 1882924 - RNA, 16 nt, Homo sapiens
uuuuccuuuagaucaa

SEQ ID NO: 1882925 - RNA, 18 nt, Homo sapiens
gcucauaugaacuuucau

SEQ ID NO: 1882926 - RNA, 15 nt, Homo sapiens
acaagcaacccaaac

SEQ ID NO: 1882927 - RNA, 21 nt, Homo sapiens
uaugggcuuuguuaucuucca

SEQ ID NO: 1882928 - RNA, 14 nt, Homo sapiens
gaauuuucaccucc

SEQ ID NO: 1882929 - RNA, 16 nt, Homo sapiens
aaaugacaguaauauu

SEQ ID NO: 1882930 - RNA, 23 nt, Homo sapiens
aggauugggccaacaaggacuca

SEQ ID NO: 1882931 - RNA, 23 nt, Homo sapiens
aaaauuaagaaguacaauaagca

SEQ ID NO: 1882932 - RNA, 14 nt, Homo sapiens
gagguuaaggcaua

SEQ ID NO: 1882933 - RNA, 19 nt, Homo sapiens
auuucuucagacucaaaac

SEQ ID NO: 1882934 - RNA, 16 nt, Homo sapiens
cuggugcauggccuua

SEQ ID NO: 1882935 - RNA, 21 nt, Homo sapiens
aacuuccaggaaagugugaag

SEQ ID NO: 1882936 - RNA, 15 nt, Homo sapiens
gccccagacugggcc

SEQ ID NO: 1882937 - RNA, 22 nt, Homo sapiens
uuagcuccuugaagacauauca

SEQ ID NO: 1882938 - RNA, 22 nt, Homo sapiens
uauguauaaaauguaacacuga

SEQ ID NO: 1882939 - RNA, 21 nt, Homo sapiens
cgggaagcgaugaauuuggag

SEQ ID NO: 1882940 - RNA, 22 nt, Homo sapiens
ugggccacucaggggucauuca

SEQ ID NO: 1882941 - RNA, 21 nt, Homo sapiens
caaaucaguuggcaggcacca

SEQ ID NO: 1882942 - RNA, 13 nt, Homo sapiens
agaaaagccagau

SEQ ID NO: 1882943 - RNA, 14 nt, Homo sapiens
agcugggaucugac

SEQ ID NO: 1882944 - RNA, 18 nt, Homo sapiens
aaccuaguacgacuucau

SEQ ID NO: 1882945 - RNA, 14 nt, Homo sapiens
uagauugacaucua

SEQ ID NO: 1882946 - RNA, 19 nt, Homo sapiens
uggguacuggagcuuuuaa

SEQ ID NO: 1882947 - RNA, 17 nt, Homo sapiens
gcuuuacucugaauuuc

SEQ ID NO: 1882948 - RNA, 21 nt, Homo sapiens
uaaauuccucugacuugccaa

SEQ ID NO: 1882949 - RNA, 12 nt, Homo sapiens
guuuaccagaga

SEQ ID NO: 1882950 - RNA, 23 nt, Homo sapiens
aauucucuaucauguugaaguca

SEQ ID NO: 1882951 - RNA, 16 nt, Homo sapiens
acucaaaagacaaaca

SEQ ID NO: 1882952 - RNA, 22 nt, Homo sapiens
uugugaccacugaauucacucc

SEQ ID NO: 1882953 - RNA, 14 nt, Homo sapiens
agacaggaaagcca

SEQ ID NO: 1882954 - RNA, 17 nt, Homo sapiens
uaagauuuugugaauug

SEQ ID NO: 1882955 - RNA, 14 nt, Homo sapiens
ggauccuuuccugg

SEQ ID NO: 1882956 - RNA, 20 nt, Homo sapiens
gcucauucuucaguucucua

SEQ ID NO: 1882957 - RNA, 22 nt, Homo sapiens
acccggccgccgccaggacugu

SEQ ID NO: 1882958 - RNA, 20 nt, Homo sapiens
cgggagcugcggaagcccag

SEQ ID NO: 1882959 - RNA, 16 nt, Homo sapiens
agggggugacuggaag

SEQ ID NO: 1882960 - RNA, 14 nt, Homo sapiens
cuuguuuacagcac

SEQ ID NO: 1882961 - RNA, 18 nt, Homo sapiens
uuuagccuggauguugcu

SEQ ID NO: 1882962 - RNA, 14 nt, Homo sapiens
aucacugcauuuca

SEQ ID NO: 1882963 - RNA, 19 nt, Homo sapiens
gucaucaaacauuugccaa

SEQ ID NO: 1882964 - RNA, 15 nt, Homo sapiens
cuccuuucaugcucc

SEQ ID NO: 1882965 - RNA, 23 nt, Homo sapiens
aaauucuacucuaaagcuucuau

SEQ ID NO: 1882966 - RNA, 15 nt, Homo sapiens
auucuauccaucucc

SEQ ID NO: 1882967 - RNA, 16 nt, Homo sapiens
auaauuuuagacauuc

SEQ ID NO: 1882968 - RNA, 20 nt, Homo sapiens
caaccaaugaaaacaguccc

SEQ ID NO: 1882969 - RNA, 22 nt, Homo sapiens
caugggacuaugcuuuucucaa

SEQ ID NO: 1882970 - RNA, 20 nt, Homo sapiens
uuuuguuuacauaauacuug

SEQ ID NO: 1882971 - RNA, 23 nt, Homo sapiens
ccacugcaugcagaaacuuggau

SEQ ID NO: 1882972 - RNA, 16 nt, Homo sapiens
aaaugucuggucuguc

SEQ ID NO: 1882973 - RNA, 12 nt, Homo sapiens
cuagcaucucau

SEQ ID NO: 1882974 - RNA, 21 nt, Homo sapiens
gacugcaccuucugugccuca

SEQ ID NO: 1882975 - RNA, 18 nt, Homo sapiens
auuuuagacuuaccuuga

SEQ ID NO: 1882976 - RNA, 21 nt, Homo sapiens
uaugcuuucacuucccaccuc

SEQ ID NO: 1882977 - RNA, 14 nt, Homo sapiens
cuuggucucagugu

SEQ ID NO: 1882978 - RNA, 15 nt, Homo sapiens
cuuuauugugaucua

SEQ ID NO: 1882979 - RNA, 23 nt, Homo sapiens
cgauccuccugucuaauuugcac

SEQ ID NO: 1882980 - RNA, 22 nt, Homo sapiens
aguaccaacucuccaaaacuaa

SEQ ID NO: 1882981 - RNA, 17 nt, Homo sapiens
gaaauggcuuuccacau

SEQ ID NO: 1882982 - RNA, 20 nt, Homo sapiens
cucgagcaucagagcuucca

SEQ ID NO: 1882983 - RNA, 19 nt, Homo sapiens
aguucagaaaaaaugugaa

SEQ ID NO: 1882984 - RNA, 21 nt, Homo sapiens
aaccucauuguucuguacaaa

SEQ ID NO: 1882985 - RNA, 15 nt, Homo sapiens
gagucugccaaaaca

SEQ ID NO: 1882986 - RNA, 16 nt, Homo sapiens
cacugacucugacuca

SEQ ID NO: 1882987 - RNA, 22 nt, Homo sapiens
uaccuggauuugggaugaaaua

SEQ ID NO: 1882988 - RNA, 12 nt, Homo sapiens
uggaaacagggc

SEQ ID NO: 1882989 - RNA, 18 nt, Homo sapiens
uacauuucuuccuucaaa

SEQ ID NO: 1882990 - RNA, 18 nt, Homo sapiens
aaaguguaaaucuaaaca

SEQ ID NO: 1882991 - RNA, 17 nt, Homo sapiens
ucuagaugccacuccca

SEQ ID NO: 1882992 - RNA, 21 nt, Homo sapiens
aaguucuaggcauacuuuuca

SEQ ID NO: 1882993 - RNA, 11 nt, Homo sapiens
uccucuauucc

SEQ ID NO: 1882994 - RNA, 16 nt, Homo sapiens
ggaggugacggcacuc

SEQ ID NO: 1882995 - RNA, 19 nt, Homo sapiens
cuauauguugaccauucca

SEQ ID NO: 1882996 - RNA, 16 nt, Homo sapiens
agaggagaguaccccc

SEQ ID NO: 1882997 - RNA, 14 nt, Homo sapiens
guaggccuccaguu

SEQ ID NO: 1882998 - RNA, 21 nt, Homo sapiens
cauuuggccgagucagcacgu

SEQ ID NO: 1882999 - RNA, 16 nt, Homo sapiens
ccaauaggaaugcuaa

SEQ ID NO: 1883000 - RNA, 17 nt, Homo sapiens
agugcucucggcccaac

SEQ ID NO: 1883001 - RNA, 19 nt, Homo sapiens
cccuugcugaacacacaca

SEQ ID NO: 1883002 - RNA, 20 nt, Homo sapiens
acaacccacaccgucuuccu

SEQ ID NO: 1883003 - RNA, 16 nt, Homo sapiens
gauuagacacuaugug

SEQ ID NO: 1883004 - RNA, 15 nt, Homo sapiens
augaauaagcacuug

SEQ ID NO: 1883005 - RNA, 17 nt, Homo sapiens
ggucaaccuccuggaca

SEQ ID NO: 1883006 - RNA, 18 nt, Homo sapiens
gcuguugaugaggccucu

SEQ ID NO: 1883007 - RNA, 12 nt, Homo sapiens
ccaaacuccucu

SEQ ID NO: 1883008 - RNA, 22 nt, Homo sapiens
uaggauaagauuccaguauugu

SEQ ID NO: 1883009 - RNA, 23 nt, Homo sapiens
uccagcugcucugucuucuuugc

SEQ ID NO: 1883010 - RNA, 23 nt, Homo sapiens
aacuuucaggggcugacucucca

SEQ ID NO: 1883011 - RNA, 17 nt, Homo sapiens
cacaaaggauacuuuua

SEQ ID NO: 1883012 - RNA, 18 nt, Homo sapiens
ucaucuacaagcauuugc

SEQ ID NO: 1883013 - RNA, 15 nt, Homo sapiens
agucaauuucuacuu

SEQ ID NO: 1883014 - RNA, 14 nt, Homo sapiens
acuucugcccaaau

SEQ ID NO: 1883015 - RNA, 23 nt, Homo sapiens
gaggccacgucccaccccaccuc

SEQ ID NO: 1883016 - RNA, 22 nt, Homo sapiens
aaaggaccuuaccuguguuuca

SEQ ID NO: 1883017 - RNA, 23 nt, Homo sapiens
ccuccuuggcggcaaaagcccau

SEQ ID NO: 1883018 - RNA, 13 nt, Homo sapiens
gugguggcacuga

SEQ ID NO: 1883019 - RNA, 14 nt, Homo sapiens
agagcaggacucca

SEQ ID NO: 1883020 - RNA, 17 nt, Homo sapiens
uggaugcggccauucaa

SEQ ID NO: 1883021 - RNA, 18 nt, Homo sapiens
gcgggagggccugcagug

SEQ ID NO: 1883022 - RNA, 20 nt, Homo sapiens
augucugcaaagugauucac

SEQ ID NO: 1883023 - RNA, 17 nt, Homo sapiens
cuuaaaugcuacugaaa

SEQ ID NO: 1883024 - RNA, 19 nt, Homo sapiens
gcagccucaaaacggguca

SEQ ID NO: 1883025 - RNA, 20 nt, Homo sapiens
gguggguacuugggugagga

SEQ ID NO: 1883026 - RNA, 21 nt, Homo sapiens
gucucucauucucuuucuuuu

SEQ ID NO: 1883027 - RNA, 15 nt, Homo sapiens
ucuuaccuacaaaau

SEQ ID NO: 1883028 - RNA, 19 nt, Homo sapiens
guuucgugguuucgucuau

SEQ ID NO: 1883029 - RNA, 12 nt, Homo sapiens
uagauguuuaca

SEQ ID NO: 1883030 - RNA, 18 nt, Homo sapiens
aaucuaacagugacuuca

SEQ ID NO: 1883031 - RNA, 18 nt, Homo sapiens
cuuuuaagaaacacaggg

SEQ ID NO: 1883032 - RNA, 13 nt, Homo sapiens
agaccaccucuca

SEQ ID NO: 1883033 - RNA, 18 nt, Homo sapiens
cagagugaagcccacaga

SEQ ID NO: 1883034 - RNA, 16 nt, Homo sapiens
gaacaugcacauuuau

SEQ ID NO: 1883035 - RNA, 20 nt, Homo sapiens
gaaucuucaagaccaaagca

SEQ ID NO: 1883036 - RNA, 19 nt, Homo sapiens
gcugaggccacccacugac

SEQ ID NO: 1883037 - RNA, 23 nt, Homo sapiens
uaccucuaaguacauauguagau

SEQ ID NO: 1883038 - RNA, 13 nt, Homo sapiens
gucucauucuguc

SEQ ID NO: 1883039 - RNA, 15 nt, Homo sapiens
agaugcuguugugaa

SEQ ID NO: 1883040 - RNA, 23 nt, Homo sapiens
uuacaauaaaauuuugcaugugc

SEQ ID NO: 1883041 - RNA, 19 nt, Homo sapiens
ccccaggggacaagggauu

SEQ ID NO: 1883042 - RNA, 22 nt, Homo sapiens
gaaaaguuagucaauccuguca

SEQ ID NO: 1883043 - RNA, 18 nt, Homo sapiens
gggauggccguuggccac

SEQ ID NO: 1883044 - RNA, 20 nt, Homo sapiens
uuguucuuguaaaacuguga

SEQ ID NO: 1883045 - RNA, 15 nt, Homo sapiens
cuuuuugacacugaa

SEQ ID NO: 1883046 - RNA, 23 nt, Homo sapiens
uuuuaaguggacucucugacaaa

SEQ ID NO: 1883047 - RNA, 17 nt, Homo sapiens
acuccucaaaccacuug

SEQ ID NO: 1883048 - RNA, 14 nt, Homo sapiens
auauuuacagugaa

SEQ ID NO: 1883049 - RNA, 17 nt, Homo sapiens
uguuucuaccuauaugc

SEQ ID NO: 1883050 - RNA, 18 nt, Homo sapiens
ccuguaagcaacacuuua

SEQ ID NO: 1883051 - RNA, 18 nt, Homo sapiens
ucacacuuacuguaagac

SEQ ID NO: 1883052 - RNA, 22 nt, Homo sapiens
uauuauuugcuuuucauguaga

SEQ ID NO: 1883053 - RNA, 19 nt, Homo sapiens
gcccugaugcgucuaccca

SEQ ID NO: 1883054 - RNA, 13 nt, Homo sapiens
cacucuucuguaa

SEQ ID NO: 1883055 - RNA, 17 nt, Homo sapiens
acaugaagaaugcauuc

SEQ ID NO: 1883056 - RNA, 22 nt, Homo sapiens
uggggacagaggauuucugcuu

SEQ ID NO: 1883057 - RNA, 13 nt, Homo sapiens
cuaagccaagagu

SEQ ID NO: 1883058 - RNA, 18 nt, Homo sapiens
cugggugagaauccugcc

SEQ ID NO: 1883059 - RNA, 12 nt, Homo sapiens
cacuuccagggg

SEQ ID NO: 1883060 - RNA, 15 nt, Homo sapiens
ccucuccaggcauuu

SEQ ID NO: 1883061 - RNA, 23 nt, Homo sapiens
aacuaacaggcuuagugauguaa

SEQ ID NO: 1883062 - RNA, 13 nt, Homo sapiens
aauggaaaacugc

SEQ ID NO: 1883063 - RNA, 20 nt, Homo sapiens
cauacagaacucuaaaagau

SEQ ID NO: 1883064 - RNA, 19 nt, Homo sapiens
cuugauucauaaugacuua

SEQ ID NO: 1883065 - RNA, 15 nt, Homo sapiens
ugacaugagucucca

SEQ ID NO: 1883066 - RNA, 15 nt, Homo sapiens
acuuuuugcauuuaa

SEQ ID NO: 1883067 - RNA, 20 nt, Homo sapiens
aacauuccuguugaugggaa

SEQ ID NO: 1883068 - RNA, 17 nt, Homo sapiens
uuucuguugccacaacc

SEQ ID NO: 1883069 - RNA, 19 nt, Homo sapiens
cuacacugagcagggagac

SEQ ID NO: 1883070 - RNA, 16 nt, Homo sapiens
cagugaguugagucau

SEQ ID NO: 1883071 - RNA, 23 nt, Homo sapiens
ccugauucacugccuaugaacag

SEQ ID NO: 1883072 - RNA, 21 nt, Homo sapiens
cacucagccucauucagcaug

SEQ ID NO: 1883073 - RNA, 13 nt, Homo sapiens
cuuacucugagga

SEQ ID NO: 1883074 - RNA, 18 nt, Homo sapiens
uucuccccauuuccccca

SEQ ID NO: 1883075 - RNA, 23 nt, Homo sapiens
aauuucccauuuuggaaccuaau

SEQ ID NO: 1883076 - RNA, 18 nt, Homo sapiens
guuaaaucaguaaucugu

SEQ ID NO: 1883077 - RNA, 14 nt, Homo sapiens
uacuguuaaaggaa

SEQ ID NO: 1883078 - RNA, 19 nt, Homo sapiens
ccucugcugagugcugggc

SEQ ID NO: 1883079 - RNA, 19 nt, Homo sapiens
aacuuaaaagucaguauca

SEQ ID NO: 1883080 - RNA, 21 nt, Homo sapiens
ugaguauucauuuugcaacuu

SEQ ID NO: 1883081 - RNA, 18 nt, Homo sapiens
accagaaaucuaaucucu

SEQ ID NO: 1883082 - RNA, 14 nt, Homo sapiens
uaauaccucuaaua

SEQ ID NO: 1883083 - RNA, 20 nt, Homo sapiens
agacagauucuucacugugu

SEQ ID NO: 1883084 - RNA, 21 nt, Homo sapiens
ugcacaagucuuuccagagga

SEQ ID NO: 1883085 - RNA, 18 nt, Homo sapiens
ugauguacugaauuccau

SEQ ID NO: 1883086 - RNA, 18 nt, Homo sapiens
cugccauguuucaaagac

SEQ ID NO: 1883087 - RNA, 22 nt, Homo sapiens
ugcccaguguuguuuguaaaua

SEQ ID NO: 1883088 - RNA, 16 nt, Homo sapiens
cuuuuauaguggaaaa

SEQ ID NO: 1883089 - RNA, 16 nt, Homo sapiens
cuuguauaguguaaaa

SEQ ID NO: 1883090 - RNA, 18 nt, Homo sapiens
gcgugucccucucggaag

SEQ ID NO: 1883091 - RNA, 12 nt, Homo sapiens
cugugugccagg

SEQ ID NO: 1883092 - RNA, 15 nt, Homo sapiens
gaaagccucuggcaa

SEQ ID NO: 1883093 - RNA, 19 nt, Homo sapiens
ccaauguuuagcaaauaca

SEQ ID NO: 1883094 - RNA, 21 nt, Homo sapiens
cauggcaagucaguggggaca

SEQ ID NO: 1883095 - RNA, 19 nt, Homo sapiens
agagaagugggugggcaca

SEQ ID NO: 1883096 - RNA, 14 nt, Homo sapiens
cucacuaugcugcu

SEQ ID NO: 1883097 - RNA, 19 nt, Homo sapiens
uucucgacucuuugcaaca

SEQ ID NO: 1883098 - RNA, 15 nt, Homo sapiens
gcaagccacuauguc

SEQ ID NO: 1883099 - RNA, 16 nt, Homo sapiens
uucuguuuuucucaaa

SEQ ID NO: 1883100 - RNA, 22 nt, Homo sapiens
aucucugggaguuauaggucau

SEQ ID NO: 1883101 - RNA, 21 nt, Homo sapiens
uauucacugguuuauuugcag

SEQ ID NO: 1883102 - RNA, 16 nt, Homo sapiens
cagcccaucaccucua

SEQ ID NO: 1883103 - RNA, 18 nt, Homo sapiens
caaggggugggccuguga

SEQ ID NO: 1883104 - RNA, 18 nt, Homo sapiens
cagcccaaccuucacauc

SEQ ID NO: 1883105 - RNA, 17 nt, Homo sapiens
ugaucuuguuacuguga

SEQ ID NO: 1883106 - RNA, 14 nt, Homo sapiens
augucaaagcuuug

SEQ ID NO: 1883107 - RNA, 14 nt, Homo sapiens
ucuuucccagacuu

SEQ ID NO: 1883108 - RNA, 17 nt, Homo sapiens
uacccaaaggucuucaa

SEQ ID NO: 1883109 - RNA, 17 nt, Homo sapiens
acagccugugugcagug

SEQ ID NO: 1883110 - RNA, 18 nt, Homo sapiens
uaccaggcagccuaugaa

SEQ ID NO: 1883111 - RNA, 19 nt, Homo sapiens
gaagaguggguuucacaag

SEQ ID NO: 1883112 - RNA, 14 nt, Homo sapiens
gcagaaguagggga

SEQ ID NO: 1883113 - RNA, 19 nt, Homo sapiens
aggcugggauggagcacuu

SEQ ID NO: 1883114 - RNA, 16 nt, Homo sapiens
cagaguggacucuucc

SEQ ID NO: 1883115 - RNA, 19 nt, Homo sapiens
gaacuuacuguagccucag

SEQ ID NO: 1883116 - RNA, 17 nt, Homo sapiens
uggggaucgaugugcuc

SEQ ID NO: 1883117 - RNA, 17 nt, Homo sapiens
cuucacugcagauuucu

SEQ ID NO: 1883118 - RNA, 12 nt, Homo sapiens
uuaacacagccu

SEQ ID NO: 1883119 - RNA, 16 nt, Homo sapiens
guaaauaccugucaau

SEQ ID NO: 1883120 - RNA, 18 nt, Homo sapiens
cagggcucauuuuugcac

SEQ ID NO: 1883121 - RNA, 13 nt, Homo sapiens
aauuuucuuucac

SEQ ID NO: 1883122 - RNA, 17 nt, Homo sapiens
aucaaaucucuuccaca

SEQ ID NO: 1883123 - RNA, 19 nt, Homo sapiens
aguagagacggguuucacc

SEQ ID NO: 1883124 - RNA, 18 nt, Homo sapiens
uaaaucugacagucucaa

SEQ ID NO: 1883125 - RNA, 20 nt, Homo sapiens
acacggccucccucugcuac

SEQ ID NO: 1883126 - RNA, 21 nt, Homo sapiens
ucccaaaagucaccacuccau

SEQ ID NO: 1883127 - RNA, 17 nt, Homo sapiens
cccugaccuuccaaacc

SEQ ID NO: 1883128 - RNA, 20 nt, Homo sapiens
ugucucagacgacuagccca

SEQ ID NO: 1883129 - RNA, 14 nt, Homo sapiens
aaagguauuuucac

SEQ ID NO: 1883130 - RNA, 16 nt, Homo sapiens
agccuggggauuccag

SEQ ID NO: 1883131 - RNA, 21 nt, Homo sapiens
aguggcugaguagcucugccu

SEQ ID NO: 1883132 - RNA, 22 nt, Homo sapiens
uccugaugugacgcacuguauu

SEQ ID NO: 1883133 - RNA, 16 nt, Homo sapiens
agggugaagaguccaa

SEQ ID NO: 1883134 - RNA, 23 nt, Homo sapiens
cacgucauaggaaguuagccuuu

SEQ ID NO: 1883135 - RNA, 24 nt, Homo sapiens
uauuuuaaaauuucacucuggcau

SEQ ID NO: 1883136 - RNA, 23 nt, Homo sapiens
gcuaugccauuucuucucucugu

SEQ ID NO: 1883137 - RNA, 20 nt, Homo sapiens
aaugagaaauugugccaaag

SEQ ID NO: 1883138 - RNA, 23 nt, Homo sapiens
gggcacagauccccccacaaagu

SEQ ID NO: 1883139 - RNA, 14 nt, Homo sapiens
gcccaaguugcagu

SEQ ID NO: 1883140 - RNA, 15 nt, Homo sapiens
cagcggucuucaggc

SEQ ID NO: 1883141 - RNA, 16 nt, Homo sapiens
gcuaacuccagucucc

SEQ ID NO: 1883142 - RNA, 14 nt, Homo sapiens
aaucugugaugaca

SEQ ID NO: 1883143 - RNA, 18 nt, Homo sapiens
gccauaaaugaccuaacg

SEQ ID NO: 1883144 - RNA, 23 nt, Homo sapiens
acucgaauaaaggaugggaccaa

SEQ ID NO: 1883145 - RNA, 16 nt, Homo sapiens
uuuccaaaacauuucu

SEQ ID NO: 1883146 - RNA, 22 nt, Homo sapiens
aacauuuggaaaccaugcacua

SEQ ID NO: 1883147 - RNA, 21 nt, Homo sapiens
caucuuguaauuuccagcuuu

SEQ ID NO: 1883148 - RNA, 22 nt, Homo sapiens
aagaaauguuuuccuugccaaa

SEQ ID NO: 1883149 - RNA, 22 nt, Homo sapiens
cuugcuggguugaucuagaugu

SEQ ID NO: 1883150 - RNA, 15 nt, Homo sapiens
auuguggaugaugau

SEQ ID NO: 1883151 - RNA, 24 nt, Homo sapiens
uuugaaauaauaaaucugguagaa

SEQ ID NO: 1883152 - RNA, 16 nt, Homo sapiens
uacaguagaagcucac

SEQ ID NO: 1883153 - RNA, 17 nt, Homo sapiens
auuccauuuuacuucca

SEQ ID NO: 1883154 - RNA, 16 nt, Homo sapiens
uaugaccagaagccuu

SEQ ID NO: 1883155 - RNA, 16 nt, Homo sapiens
aauggccggcuggaaa

SEQ ID NO: 1883156 - RNA, 19 nt, Homo sapiens
aaagcaaacuuaagaaaca

SEQ ID NO: 1883157 - RNA, 13 nt, Homo sapiens
aggccucccucaa

SEQ ID NO: 1883158 - RNA, 21 nt, Homo sapiens
auggaaugauuuugguggaaa

SEQ ID NO: 1883159 - RNA, 18 nt, Homo sapiens
aaaguaaccugaacuaau

SEQ ID NO: 1883160 - RNA, 13 nt, Homo sapiens
auuaaaaccaauu

SEQ ID NO: 1883161 - RNA, 12 nt, Homo sapiens
aaucugaguaua

SEQ ID NO: 1883162 - RNA, 20 nt, Homo sapiens
cauuaguaauaaguaaaaug

SEQ ID NO: 1883163 - RNA, 19 nt, Homo sapiens
acugcgagguuguuuuaaa

SEQ ID NO: 1883164 - RNA, 16 nt, Homo sapiens
gccuuacgauggcaau

SEQ ID NO: 1883165 - RNA, 12 nt, Homo sapiens
cagaaagggaac

SEQ ID NO: 1883166 - RNA, 21 nt, Homo sapiens
gcccuguuucuggucuucgca

SEQ ID NO: 1883167 - RNA, 16 nt, Homo sapiens
auuaauugugugucac

SEQ ID NO: 1883168 - RNA, 20 nt, Homo sapiens
agcagucuacccaccucagc

SEQ ID NO: 1883169 - RNA, 19 nt, Homo sapiens
aaaaauccauaaaauccuu

SEQ ID NO: 1883170 - RNA, 16 nt, Homo sapiens
ccuugggggaagacuu

SEQ ID NO: 1883171 - RNA, 24 nt, Homo sapiens
uuugcacacccagcauagccuccu

SEQ ID NO: 1883172 - RNA, 15 nt, Homo sapiens
agaucaaagaacuca

SEQ ID NO: 1883173 - RNA, 17 nt, Homo sapiens
aaagagucugacccuuu

SEQ ID NO: 1883174 - RNA, 19 nt, Homo sapiens
ugaaaaggacuucuggcua

SEQ ID NO: 1883175 - RNA, 14 nt, Homo sapiens
cuaacuuucuugcu

SEQ ID NO: 1883176 - RNA, 13 nt, Homo sapiens
gcuuccaucugcc

SEQ ID NO: 1883177 - RNA, 16 nt, Homo sapiens
aucucgccuuccugca

SEQ ID NO: 1883178 - RNA, 16 nt, Homo sapiens
agacucccugauccca

SEQ ID NO: 1883179 - RNA, 18 nt, Homo sapiens
aaccuuuaaaaaagcaaa

SEQ ID NO: 1883180 - RNA, 16 nt, Homo sapiens
ugaaaugcuuaugcuu

SEQ ID NO: 1883181 - RNA, 23 nt, Homo sapiens
ccacaggcccuuuccucaggcaa

SEQ ID NO: 1883182 - RNA, 22 nt, Homo sapiens
aggagccggugcucuggaagac

SEQ ID NO: 1883183 - RNA, 17 nt, Homo sapiens
aacugauuacguuuaca

SEQ ID NO: 1883184 - RNA, 23 nt, Homo sapiens
guagcaauaagcuggacuagugu

SEQ ID NO: 1883185 - RNA, 12 nt, Homo sapiens
aaauaaugauuu

SEQ ID NO: 1883186 - RNA, 13 nt, Homo sapiens
auugcucauaauc

SEQ ID NO: 1883187 - RNA, 15 nt, Homo sapiens
uuagcccaaaaccaa

SEQ ID NO: 1883188 - RNA, 18 nt, Homo sapiens
cugcaucaagaugugaca

SEQ ID NO: 1883189 - RNA, 18 nt, Homo sapiens
ugaaggugauucaccaaa

SEQ ID NO: 1883190 - RNA, 17 nt, Homo sapiens
uggaccagccucuccac

SEQ ID NO: 1883191 - RNA, 20 nt, Homo sapiens
uucaagugaguggcaugugg

SEQ ID NO: 1883192 - RNA, 14 nt, Homo sapiens
ccagccagcaguuc

SEQ ID NO: 1883193 - RNA, 18 nt, Homo sapiens
uccaauccacuaacacuu

SEQ ID NO: 1883194 - RNA, 12 nt, Homo sapiens
uacagaaauauc

SEQ ID NO: 1883195 - RNA, 13 nt, Homo sapiens
auccccugccucu

SEQ ID NO: 1883196 - RNA, 12 nt, Homo sapiens
uugaaugugauu

SEQ ID NO: 1883197 - RNA, 17 nt, Homo sapiens
guccugcuccacagugu

SEQ ID NO: 1883198 - RNA, 17 nt, Homo sapiens
uaaccuugaaugcugcc

SEQ ID NO: 1883199 - RNA, 18 nt, Homo sapiens
uccucaugugagaaagca

SEQ ID NO: 1883200 - RNA, 23 nt, Homo sapiens
auuccagaagaacaacuuuagca

SEQ ID NO: 1883201 - RNA, 16 nt, Homo sapiens
gcaaguggagcugucu

SEQ ID NO: 1883202 - RNA, 18 nt, Homo sapiens
aucagacuccugugcaac

SEQ ID NO: 1883203 - RNA, 16 nt, Homo sapiens
uguuuuuaaaaccacu

SEQ ID NO: 1883204 - RNA, 14 nt, Homo sapiens
cuuaaccucaggga

SEQ ID NO: 1883205 - RNA, 23 nt, Homo sapiens
cuagugcuuuucagugauacuca

SEQ ID NO: 1883206 - RNA, 15 nt, Homo sapiens
ucugcuuuacucugg

SEQ ID NO: 1883207 - RNA, 16 nt, Homo sapiens
ggcugagaacacugug

SEQ ID NO: 1883208 - RNA, 21 nt, Homo sapiens
caauaugaaaacgaaguuaaa

SEQ ID NO: 1883209 - RNA, 23 nt, Homo sapiens
uccuuaaaaugugagugaccuca

SEQ ID NO: 1883210 - RNA, 22 nt, Homo sapiens
gccgcacaucuggucucggagc

SEQ ID NO: 1883211 - RNA, 15 nt, Homo sapiens
ucuaccaagacauaa

SEQ ID NO: 1883212 - RNA, 20 nt, Homo sapiens
aguccccucaccuccucuaa

SEQ ID NO: 1883213 - RNA, 17 nt, Homo sapiens
ugaggaggaacuguggc

SEQ ID NO: 1883214 - RNA, 22 nt, Homo sapiens
uuguguccauugaugucauuca

SEQ ID NO: 1883215 - RNA, 19 nt, Homo sapiens
uccugucccucauccauag

SEQ ID NO: 1883216 - RNA, 22 nt, Homo sapiens
ccaccuguuguccugaacugug

SEQ ID NO: 1883217 - RNA, 16 nt, Homo sapiens
aacagaaaaucuuucc

SEQ ID NO: 1883218 - RNA, 16 nt, Homo sapiens
aagaccaaagaccaag

SEQ ID NO: 1883219 - RNA, 13 nt, Homo sapiens
cuagggcacuucu

SEQ ID NO: 1883220 - RNA, 18 nt, Homo sapiens
gguccugaggccaagaaa

SEQ ID NO: 1883221 - RNA, 20 nt, Homo sapiens
aucauuuacuuuuaaacuuu

SEQ ID NO: 1883222 - RNA, 15 nt, Homo sapiens
ugguugaaugaauaa

SEQ ID NO: 1883223 - RNA, 13 nt, Homo sapiens
gaauucagcacca

SEQ ID NO: 1883224 - RNA, 15 nt, Homo sapiens
uagaagcaagcugga

SEQ ID NO: 1883225 - RNA, 15 nt, Homo sapiens
uggaauaaaacuguc

SEQ ID NO: 1883226 - RNA, 16 nt, Homo sapiens
ugucauuuauguguca

SEQ ID NO: 1883227 - RNA, 18 nt, Homo sapiens
aaaacacugcccucuugu

SEQ ID NO: 1883228 - RNA, 15 nt, Homo sapiens
aaaauauauacucaa

SEQ ID NO: 1883229 - RNA, 17 nt, Homo sapiens
aggagaacaaauauuca

SEQ ID NO: 1883230 - RNA, 18 nt, Homo sapiens
cuacaggauuugaaauug

SEQ ID NO: 1883231 - RNA, 21 nt, Homo sapiens
uugucaagccugugcaaaaaa

SEQ ID NO: 1883232 - RNA, 16 nt, Homo sapiens
aacagagggaguuuaa

SEQ ID NO: 1883233 - RNA, 17 nt, Homo sapiens
cccgaguaacugagauu

SEQ ID NO: 1883234 - RNA, 21 nt, Homo sapiens
cgacguuugacuagccaucuc

SEQ ID NO: 1883235 - RNA, 13 nt, Homo sapiens
gcuacuugggagg

SEQ ID NO: 1883236 - RNA, 23 nt, Homo sapiens
agauacugaggaaugucuuucag

SEQ ID NO: 1883237 - RNA, 21 nt, Homo sapiens
acgcucaguaaccaugcaaaa

SEQ ID NO: 1883238 - RNA, 16 nt, Homo sapiens
auuacccauaggucuu

SEQ ID NO: 1883239 - RNA, 14 nt, Homo sapiens
ccgcccacagccag

SEQ ID NO: 1883240 - RNA, 22 nt, Homo sapiens
guuauuaguccaaaugugauca

SEQ ID NO: 1883241 - RNA, 22 nt, Homo sapiens
uuuucagauuugcacaaaaaga

SEQ ID NO: 1883242 - RNA, 14 nt, Homo sapiens
ggauugcugugaaa

SEQ ID NO: 1883243 - RNA, 17 nt, Homo sapiens
acaugggaaggugccac

SEQ ID NO: 1883244 - RNA, 22 nt, Homo sapiens
uuuggagccucccuucugccuu

SEQ ID NO: 1883245 - RNA, 19 nt, Homo sapiens
uaugcucauugaacuuuaa

SEQ ID NO: 1883246 - RNA, 15 nt, Homo sapiens
gccagccacaggacc

SEQ ID NO: 1883247 - RNA, 20 nt, Homo sapiens
agcgucagcgggcgcugcug

SEQ ID NO: 1883248 - RNA, 21 nt, Homo sapiens
gaagccagcaggcucucaggc

SEQ ID NO: 1883249 - RNA, 18 nt, Homo sapiens
uuccucaaagcauuugca

SEQ ID NO: 1883250 - RNA, 17 nt, Homo sapiens
cagauuaucuuguacag

SEQ ID NO: 1883251 - RNA, 23 nt, Homo sapiens
cuggaauuaaaaggaaagucaag

SEQ ID NO: 1883252 - RNA, 16 nt, Homo sapiens
uugaguuuguaauuaa

SEQ ID NO: 1883253 - RNA, 19 nt, Homo sapiens
cauuaggcaaaguacaaaa

SEQ ID NO: 1883254 - RNA, 20 nt, Homo sapiens
aaacuccuagguucacuuug

SEQ ID NO: 1883255 - RNA, 17 nt, Homo sapiens
ugcaucucaaaauuauu

SEQ ID NO: 1883256 - RNA, 20 nt, Homo sapiens
ucguccucccccacucccuc

SEQ ID NO: 1883257 - RNA, 16 nt, Homo sapiens
ucuaccccugcuccca

SEQ ID NO: 1883258 - RNA, 21 nt, Homo sapiens
cacucagcuggacugcauuga

SEQ ID NO: 1883259 - RNA, 15 nt, Homo sapiens
aucagaauaucacag

SEQ ID NO: 1883260 - RNA, 12 nt, Homo sapiens
guaaaaaacugu

SEQ ID NO: 1883261 - RNA, 21 nt, Homo sapiens
aacuguaacguuuucuuucac

SEQ ID NO: 1883262 - RNA, 13 nt, Homo sapiens
cuacauucacuuu

SEQ ID NO: 1883263 - RNA, 12 nt, Homo sapiens
aacuuuuuauuc

SEQ ID NO: 1883264 - RNA, 21 nt, Homo sapiens
cugaauguccugacaccugcu

SEQ ID NO: 1883265 - RNA, 18 nt, Homo sapiens
caauaacacacagcuaac

SEQ ID NO: 1883266 - RNA, 20 nt, Homo sapiens
caacaaagaaugggcuugaa

SEQ ID NO: 1883267 - RNA, 17 nt, Homo sapiens
gaaaaaugcauguugcc

SEQ ID NO: 1883268 - RNA, 24 nt, Homo sapiens
gcguucugcaagcaucaguucuac

SEQ ID NO: 1883269 - RNA, 14 nt, Homo sapiens
gagucaggggcucu

SEQ ID NO: 1883270 - RNA, 22 nt, Homo sapiens
ugaugccuguguacugccuuaa

SEQ ID NO: 1883271 - RNA, 16 nt, Homo sapiens
ucacuucaauguguca

SEQ ID NO: 1883272 - RNA, 20 nt, Homo sapiens
uugcuaggaggccuuagcaa

SEQ ID NO: 1883273 - RNA, 18 nt, Homo sapiens
auuuguuaaagggccaaa

SEQ ID NO: 1883274 - RNA, 23 nt, Homo sapiens
auguaccuucuuucacucuguca

SEQ ID NO: 1883275 - RNA, 21 nt, Homo sapiens
ugcaggaaccagcaaugagaa

SEQ ID NO: 1883276 - RNA, 13 nt, Homo sapiens
auucauuuaguga

SEQ ID NO: 1883277 - RNA, 21 nt, Homo sapiens
agugccuaugcaaaccagcuu

SEQ ID NO: 1883278 - RNA, 22 nt, Homo sapiens
uuucuccccaaugagacuugcc

SEQ ID NO: 1883279 - RNA, 16 nt, Homo sapiens
aagggcgcuuguccca

SEQ ID NO: 1883280 - RNA, 22 nt, Homo sapiens
cuucagggcugggcagguccug

SEQ ID NO: 1883281 - RNA, 18 nt, Homo sapiens
cccuccguggcaucaccu

SEQ ID NO: 1883282 - RNA, 19 nt, Homo sapiens
aaugugguaguacccaggg

SEQ ID NO: 1883283 - RNA, 20 nt, Homo sapiens
uacugaggaaauauuuccau

SEQ ID NO: 1883284 - RNA, 13 nt, Homo sapiens
ugacuucuagaaa

SEQ ID NO: 1883285 - RNA, 15 nt, Homo sapiens
aggagcaacagcgau

SEQ ID NO: 1883286 - RNA, 14 nt, Homo sapiens
ucaguauuuucaca

SEQ ID NO: 1883287 - RNA, 16 nt, Homo sapiens
cuucugucuccagggc

SEQ ID NO: 1883288 - RNA, 13 nt, Homo sapiens
gcaucuccugugc

SEQ ID NO: 1883289 - RNA, 21 nt, Homo sapiens
uuggacccgcucuggaccaac

SEQ ID NO: 1883290 - RNA, 15 nt, Homo sapiens
auaguuuaaauucaa

SEQ ID NO: 1883291 - RNA, 16 nt, Homo sapiens
ugaaaaaaacaaccua

SEQ ID NO: 1883292 - RNA, 16 nt, Homo sapiens
aguaaaagucuaccug

SEQ ID NO: 1883293 - RNA, 19 nt, Homo sapiens
gugacauuuauuuuucuca

SEQ ID NO: 1883294 - RNA, 16 nt, Homo sapiens
aaagcuaauuaaucau

SEQ ID NO: 1883295 - RNA, 19 nt, Homo sapiens
gcauuuaccaugugcuaau

SEQ ID NO: 1883296 - RNA, 15 nt, Homo sapiens
uguaucuaauccuca

SEQ ID NO: 1883297 - RNA, 19 nt, Homo sapiens
uauaggucucaucucuuca

SEQ ID NO: 1883298 - RNA, 17 nt, Homo sapiens
cucagaaacuccaugau

SEQ ID NO: 1883299 - RNA, 20 nt, Homo sapiens
uucacauaaacacauacauu

SEQ ID NO: 1883300 - RNA, 11 nt, Homo sapiens
uugaggacaag

SEQ ID NO: 1883301 - RNA, 19 nt, Homo sapiens
ugacaacaaccuaugcacc

SEQ ID NO: 1883302 - RNA, 18 nt, Homo sapiens
uccagcuaauucagguca

SEQ ID NO: 1883303 - RNA, 15 nt, Homo sapiens
uauaaagcacaucuc

SEQ ID NO: 1883304 - RNA, 19 nt, Homo sapiens
ggcuucuugcuuacaggaa

SEQ ID NO: 1883305 - RNA, 15 nt, Homo sapiens
ggacccagggccuga

SEQ ID NO: 1883306 - RNA, 18 nt, Homo sapiens
uccaguagaaagcauaac

SEQ ID NO: 1883307 - RNA, 13 nt, Homo sapiens
gcucuguauauau

SEQ ID NO: 1883308 - RNA, 18 nt, Homo sapiens
ccauaaacaguaaugacu

SEQ ID NO: 1883309 - RNA, 13 nt, Homo sapiens
agagccugggaag

SEQ ID NO: 1883310 - RNA, 20 nt, Homo sapiens
cuuucugacaucagcacuuu

SEQ ID NO: 1883311 - RNA, 15 nt, Homo sapiens
gagaagcagcauuug

SEQ ID NO: 1883312 - RNA, 14 nt, Homo sapiens
aaugucauguugcu

SEQ ID NO: 1883313 - RNA, 14 nt, Homo sapiens
auacccaugaacuu

SEQ ID NO: 1883314 - RNA, 23 nt, Homo sapiens
gcccuggacugugugcucaggag

SEQ ID NO: 1883315 - RNA, 18 nt, Homo sapiens
ccugagaagaaguggcug

SEQ ID NO: 1883316 - RNA, 22 nt, Homo sapiens
uauuacaguuuaucuauggcac

SEQ ID NO: 1883317 - RNA, 17 nt, Homo sapiens
ccaucugcucaccagau

SEQ ID NO: 1883318 - RNA, 13 nt, Homo sapiens
aggccugugcugc

SEQ ID NO: 1883319 - RNA, 19 nt, Homo sapiens
acagccucagaauaaaaga

SEQ ID NO: 1883320 - RNA, 11 nt, Homo sapiens
caagucugcag

SEQ ID NO: 1883321 - RNA, 21 nt, Homo sapiens
gggacgcacagugcaguugag

SEQ ID NO: 1883322 - RNA, 19 nt, Homo sapiens
uaaauguuuauacuguauu

SEQ ID NO: 1883323 - RNA, 14 nt, Homo sapiens
ggugggugugagca

SEQ ID NO: 1883324 - RNA, 19 nt, Homo sapiens
ugucuucuguauucacuua

SEQ ID NO: 1883325 - RNA, 17 nt, Homo sapiens
uucuggagguuuccaaa

SEQ ID NO: 1883326 - RNA, 16 nt, Homo sapiens
ucaaggcugcagugag

SEQ ID NO: 1883327 - RNA, 12 nt, Homo sapiens
guucuuuccucc

SEQ ID NO: 1883328 - RNA, 12 nt, Homo sapiens
gaauaaccacuu

SEQ ID NO: 1883329 - RNA, 14 nt, Homo sapiens
auggaacagugcag

SEQ ID NO: 1883330 - RNA, 18 nt, Homo sapiens
ugucaaaaugagauucca

SEQ ID NO: 1883331 - RNA, 23 nt, Homo sapiens
ucuacacagugggaacucugaca

SEQ ID NO: 1883332 - RNA, 19 nt, Homo sapiens
agugcgguggugugaucuc

SEQ ID NO: 1883333 - RNA, 19 nt, Homo sapiens
cuacauggaguauauguca

SEQ ID NO: 1883334 - RNA, 19 nt, Homo sapiens
ucagcucacuggcaggaaa

SEQ ID NO: 1883335 - RNA, 17 nt, Homo sapiens
gcccagcuccucaccca

SEQ ID NO: 1883336 - RNA, 22 nt, Homo sapiens
uucuucuggagggaagcaccau

SEQ ID NO: 1883337 - RNA, 20 nt, Homo sapiens
gcgccgcaaaccacacugga

SEQ ID NO: 1883338 - RNA, 15 nt, Homo sapiens
ugauuuccauuugca

SEQ ID NO: 1883339 - RNA, 14 nt, Homo sapiens
uucaaauaauccau

SEQ ID NO: 1883340 - RNA, 15 nt, Homo sapiens
uuggcuguuccugca

SEQ ID NO: 1883341 - RNA, 13 nt, Homo sapiens
ccuugguucucau

SEQ ID NO: 1883342 - RNA, 22 nt, Homo sapiens
uucucacaggcccaauccugaa

SEQ ID NO: 1883343 - RNA, 18 nt, Homo sapiens
agggagaaauuggaaugu

SEQ ID NO: 1883344 - RNA, 20 nt, Homo sapiens
ugagucaccaagcccaguua

SEQ ID NO: 1883345 - RNA, 21 nt, Homo sapiens
uucaagcaaaacaguucucag

SEQ ID NO: 1883346 - RNA, 18 nt, Homo sapiens
acuuauauugaagacaau

SEQ ID NO: 1883347 - RNA, 12 nt, Homo sapiens
uuuguaaccaua

SEQ ID NO: 1883348 - RNA, 17 nt, Homo sapiens
uucuagaugacuuuaau

SEQ ID NO: 1883349 - RNA, 12 nt, Homo sapiens
cucugugaaagc

SEQ ID NO: 1883350 - RNA, 14 nt, Homo sapiens
ucucuacugucagc

SEQ ID NO: 1883351 - RNA, 19 nt, Homo sapiens
uucaccauauuggccaguc

SEQ ID NO: 1883352 - RNA, 21 nt, Homo sapiens
gaaucuguagaggagccugga

SEQ ID NO: 1883353 - RNA, 20 nt, Homo sapiens
acugccccccuccuuuccaa

SEQ ID NO: 1883354 - RNA, 14 nt, Homo sapiens
auaaucuuuuaaca

SEQ ID NO: 1883355 - RNA, 13 nt, Homo sapiens
acuaggacuccuu

SEQ ID NO: 1883356 - RNA, 14 nt, Homo sapiens
caauacgacacuga

SEQ ID NO: 1883357 - RNA, 15 nt, Homo sapiens
cccucugcugaucuc

SEQ ID NO: 1883358 - RNA, 16 nt, Homo sapiens
auuuaauuuuugcaau

SEQ ID NO: 1883359 - RNA, 18 nt, Homo sapiens
uaauuuuauguucacuug

SEQ ID NO: 1883360 - RNA, 19 nt, Homo sapiens
caccucucugagcucugca

SEQ ID NO: 1883361 - RNA, 15 nt, Homo sapiens
gacaggaggccaugc

SEQ ID NO: 1883362 - RNA, 17 nt, Homo sapiens
guuauuuuaucugcuau

SEQ ID NO: 1883363 - RNA, 18 nt, Homo sapiens
cuuccagugucugucauu

SEQ ID NO: 1883364 - RNA, 13 nt, Homo sapiens
gaaaggggugaga

SEQ ID NO: 1883365 - RNA, 17 nt, Homo sapiens
aucacuaagagcuuuau

SEQ ID NO: 1883366 - RNA, 15 nt, Homo sapiens
caggaaggaccccac

SEQ ID NO: 1883367 - RNA, 16 nt, Homo sapiens
aggugaggcucuucac

SEQ ID NO: 1883368 - RNA, 19 nt, Homo sapiens
gccaagaauauugcaaaau

SEQ ID NO: 1883369 - RNA, 12 nt, Homo sapiens
gcaacauuacaa

SEQ ID NO: 1883370 - RNA, 17 nt, Homo sapiens
augcugugcaaauguua

SEQ ID NO: 1883371 - RNA, 20 nt, Homo sapiens
uaucucaguuaugaguauaa

SEQ ID NO: 1883372 - RNA, 23 nt, Homo sapiens
aagcaguuauugaaaugauuaac

SEQ ID NO: 1883373 - RNA, 17 nt, Homo sapiens
gaagcagagcacugugu

SEQ ID NO: 1883374 - RNA, 13 nt, Homo sapiens
auuuaaaguggca

SEQ ID NO: 1883375 - RNA, 20 nt, Homo sapiens
guaaacagauggcacuuuga

SEQ ID NO: 1883376 - RNA, 19 nt, Homo sapiens
cauuuucuuguggagcaau

SEQ ID NO: 1883377 - RNA, 19 nt, Homo sapiens
uuugauacaagaaagcaau

SEQ ID NO: 1883378 - RNA, 17 nt, Homo sapiens
accauacagccaggaaa

SEQ ID NO: 1883379 - RNA, 14 nt, Homo sapiens
gccugcggaccaga

SEQ ID NO: 1883380 - RNA, 23 nt, Homo sapiens
aaacuaacaauaugauugcacua

SEQ ID NO: 1883381 - RNA, 22 nt, Homo sapiens
gcuccuccguguggacugugcc

SEQ ID NO: 1883382 - RNA, 11 nt, Homo sapiens
aagacauuucu

SEQ ID NO: 1883383 - RNA, 13 nt, Homo sapiens
cugcccccagaaa

SEQ ID NO: 1883384 - RNA, 19 nt, Homo sapiens
caucugaguugagcacugg

SEQ ID NO: 1883385 - RNA, 17 nt, Homo sapiens
uaugaaucacaguauug

SEQ ID NO: 1883386 - RNA, 21 nt, Homo sapiens
acuauaaugaaaacauccuug

SEQ ID NO: 1883387 - RNA, 12 nt, Homo sapiens
agacacugcugc

SEQ ID NO: 1883388 - RNA, 14 nt, Homo sapiens
gcauucucuccauu

SEQ ID NO: 1883389 - RNA, 13 nt, Homo sapiens
uaggaauacucuu

SEQ ID NO: 1883390 - RNA, 16 nt, Homo sapiens
acuaggguaaucugac

SEQ ID NO: 1883391 - RNA, 13 nt, Homo sapiens
ucccagaaccaca

SEQ ID NO: 1883392 - RNA, 16 nt, Homo sapiens
gaauaaaauuguuauu

SEQ ID NO: 1883393 - RNA, 20 nt, Homo sapiens
ugccauuaagcucacaauaa

SEQ ID NO: 1883394 - RNA, 17 nt, Homo sapiens
aagcauugacuugccgu

SEQ ID NO: 1883395 - RNA, 19 nt, Homo sapiens
ucgaacuccugggcucaag

SEQ ID NO: 1883396 - RNA, 18 nt, Homo sapiens
cuugugugugggcuguga

SEQ ID NO: 1883397 - RNA, 21 nt, Homo sapiens
ugaagagaagcaagacagagg

SEQ ID NO: 1883398 - RNA, 20 nt, Homo sapiens
cugcacauaaguuaugguuu

SEQ ID NO: 1883399 - RNA, 18 nt, Homo sapiens
cugcagaccucaagccau

SEQ ID NO: 1883400 - RNA, 15 nt, Homo sapiens
ugggauggauuucca

SEQ ID NO: 1883401 - RNA, 21 nt, Homo sapiens
aacuguugguauuaaggcaga

SEQ ID NO: 1883402 - RNA, 23 nt, Homo sapiens
auguacucacauauaacaugcaa

SEQ ID NO: 1883403 - RNA, 23 nt, Homo sapiens
agagcccccaccuugaucccaau

SEQ ID NO: 1883404 - RNA, 22 nt, Homo sapiens
ugacauauacucaaaacaguaa

SEQ ID NO: 1883405 - RNA, 20 nt, Homo sapiens
caacuuuguggaugucuucc

SEQ ID NO: 1883406 - RNA, 18 nt, Homo sapiens
ugcaacuggaguuccuua

SEQ ID NO: 1883407 - RNA, 14 nt, Homo sapiens
aagagaagcaauuu

SEQ ID NO: 1883408 - RNA, 19 nt, Homo sapiens
ucugggaccaaaacaucaa

SEQ ID NO: 1883409 - RNA, 19 nt, Homo sapiens
uaugcugauuuacuacuua

SEQ ID NO: 1883410 - RNA, 17 nt, Homo sapiens
gcauuugaguuugcaaa

SEQ ID NO: 1883411 - RNA, 18 nt, Homo sapiens
gucugcauuucauauuau

SEQ ID NO: 1883412 - RNA, 18 nt, Homo sapiens
ccauuuuuugucugugau

SEQ ID NO: 1883413 - RNA, 15 nt, Homo sapiens
caacauuuucuugaa

SEQ ID NO: 1883414 - RNA, 21 nt, Homo sapiens
aaggucugaaauccagcaucu

SEQ ID NO: 1883415 - RNA, 14 nt, Homo sapiens
aucaccacugacag

SEQ ID NO: 1883416 - RNA, 16 nt, Homo sapiens
acccugugcaauucag

SEQ ID NO: 1883417 - RNA, 12 nt, Homo sapiens
cacccaccagag

SEQ ID NO: 1883418 - RNA, 19 nt, Homo sapiens
gugaaauuugccucugucc

SEQ ID NO: 1883419 - RNA, 15 nt, Homo sapiens
ugugugaaaauguga

SEQ ID NO: 1883420 - RNA, 15 nt, Homo sapiens
uggggagaaagggag

SEQ ID NO: 1883421 - RNA, 23 nt, Homo sapiens
aauauuaaaaucacugucaauau

SEQ ID NO: 1883422 - RNA, 21 nt, Homo sapiens
auuuuacuuuuuccuggcuca

SEQ ID NO: 1883423 - RNA, 15 nt, Homo sapiens
uguacccacuccuca

SEQ ID NO: 1883424 - RNA, 16 nt, Homo sapiens
cuucugggaagacaac

SEQ ID NO: 1883425 - RNA, 13 nt, Homo sapiens
aagaaaauauucu

SEQ ID NO: 1883426 - RNA, 14 nt, Homo sapiens
aaacauccaaaagu

SEQ ID NO: 1883427 - RNA, 18 nt, Homo sapiens
uggagugcaauggugcga

SEQ ID NO: 1883428 - RNA, 16 nt, Homo sapiens
auaucuuuaucuuuau

SEQ ID NO: 1883429 - RNA, 21 nt, Homo sapiens
ucaauccugauuccucucuaa

SEQ ID NO: 1883430 - RNA, 13 nt, Homo sapiens
aaauguuacguga

SEQ ID NO: 1883431 - RNA, 19 nt, Homo sapiens
caguauauuaaaacaaugu

SEQ ID NO: 1883432 - RNA, 23 nt, Homo sapiens
aguucaaagaacccuagcacaaa

SEQ ID NO: 1883433 - RNA, 20 nt, Homo sapiens
acccacaguuugagaccagc

SEQ ID NO: 1883434 - RNA, 18 nt, Homo sapiens
uucagagcugacacagga

SEQ ID NO: 1883435 - RNA, 22 nt, Homo sapiens
auaaauaguguacacagacuga

SEQ ID NO: 1883436 - RNA, 20 nt, Homo sapiens
cuaucugcuguauauggaau

SEQ ID NO: 1883437 - RNA, 19 nt, Homo sapiens
auuauuuuucacugcccca

SEQ ID NO: 1883438 - RNA, 13 nt, Homo sapiens
gugcugcuuuaau

SEQ ID NO: 1883439 - RNA, 14 nt, Homo sapiens
gaauuaaacuaaaa

SEQ ID NO: 1883440 - RNA, 14 nt, Homo sapiens
guagagagugcccu

SEQ ID NO: 1883441 - RNA, 17 nt, Homo sapiens
cagaaaagaugugcaga

SEQ ID NO: 1883442 - RNA, 20 nt, Homo sapiens
gagccuggccaggcagggag

SEQ ID NO: 1883443 - RNA, 15 nt, Homo sapiens
ccucaucauuuccca

SEQ ID NO: 1883444 - RNA, 18 nt, Homo sapiens
ccuguauaaguagaucug

SEQ ID NO: 1883445 - RNA, 17 nt, Homo sapiens
ugcauuuaugauuuauc

SEQ ID NO: 1883446 - RNA, 18 nt, Homo sapiens
ucaggauggaggacccug

SEQ ID NO: 1883447 - RNA, 14 nt, Homo sapiens
auuuuuuuuuggau

SEQ ID NO: 1883448 - RNA, 22 nt, Homo sapiens
ggaugaaggccucccugucuaa

SEQ ID NO: 1883449 - RNA, 15 nt, Homo sapiens
ugcuucaggauacca

SEQ ID NO: 1883450 - RNA, 20 nt, Homo sapiens
caagcaauucuccugccuca

SEQ ID NO: 1883451 - RNA, 20 nt, Homo sapiens
augagcugcacuccaugagu

SEQ ID NO: 1883452 - RNA, 12 nt, Homo sapiens
ugcaccacugca

SEQ ID NO: 1883453 - RNA, 17 nt, Homo sapiens
uaagagagauaaccuua

SEQ ID NO: 1883454 - RNA, 16 nt, Homo sapiens
uggacucugagcucau

SEQ ID NO: 1883455 - RNA, 23 nt, Homo sapiens
uuccacacccccaccccuugcuc

SEQ ID NO: 1883456 - RNA, 15 nt, Homo sapiens
cguaacaacuguggu

SEQ ID NO: 1883457 - RNA, 20 nt, Homo sapiens
agccaaggagucacugagac

SEQ ID NO: 1883458 - RNA, 16 nt, Homo sapiens
aagcagucaguuugca

SEQ ID NO: 1883459 - RNA, 16 nt, Homo sapiens
ugaacccuaaggugag

SEQ ID NO: 1883460 - RNA, 18 nt, Homo sapiens
cuaccuauaaauggacuu

SEQ ID NO: 1883461 - RNA, 22 nt, Homo sapiens
uggucucugauagguagcauuu

SEQ ID NO: 1883462 - RNA, 13 nt, Homo sapiens
uuuuaaagacaaa

SEQ ID NO: 1883463 - RNA, 17 nt, Homo sapiens
cuggucagggcaaaccu

SEQ ID NO: 1883464 - RNA, 15 nt, Homo sapiens
ggagaauuagauuuc

SEQ ID NO: 1883465 - RNA, 15 nt, Homo sapiens
gcaggucaggacuca

SEQ ID NO: 1883466 - RNA, 22 nt, Homo sapiens
uggauacagcugcuuugagcua

SEQ ID NO: 1883467 - RNA, 22 nt, Homo sapiens
gacucgauagugguggugaaca

SEQ ID NO: 1883468 - RNA, 22 nt, Homo sapiens
ucuucuaagaauuuuaucuguu

SEQ ID NO: 1883469 - RNA, 15 nt, Homo sapiens
uaacuauguuuuauc

SEQ ID NO: 1883470 - RNA, 21 nt, Homo sapiens
ccagccagaggcaucugaggg

SEQ ID NO: 1883471 - RNA, 21 nt, Homo sapiens
uuaagcuaggauguugcucag

SEQ ID NO: 1883472 - RNA, 21 nt, Homo sapiens
ccauuuagcugcccacgcugc

SEQ ID NO: 1883473 - RNA, 17 nt, Homo sapiens
gauucacacccagcuga

SEQ ID NO: 1883474 - RNA, 12 nt, Homo sapiens
cugccacuccau

SEQ ID NO: 1883475 - RNA, 13 nt, Homo sapiens
gcucagacauuuu

SEQ ID NO: 1883476 - RNA, 16 nt, Homo sapiens
aaucuuagaaaauuaa

SEQ ID NO: 1883477 - RNA, 15 nt, Homo sapiens
uaacaaagcacauaa

SEQ ID NO: 1883478 - RNA, 13 nt, Homo sapiens
acacuucagaucu

SEQ ID NO: 1883479 - RNA, 12 nt, Homo sapiens
auauaccaucuc

SEQ ID NO: 1883480 - RNA, 15 nt, Homo sapiens
gauccagugcugagc

SEQ ID NO: 1883481 - RNA, 17 nt, Homo sapiens
augcccucauacccaug

SEQ ID NO: 1883482 - RNA, 21 nt, Homo sapiens
cugcuguccaggaacuuucca

SEQ ID NO: 1883483 - RNA, 18 nt, Homo sapiens
cacugaaauagagugaau

SEQ ID NO: 1883484 - RNA, 14 nt, Homo sapiens
aaccaacugcacaa

SEQ ID NO: 1883485 - RNA, 14 nt, Homo sapiens
uggcgccagggcca

SEQ ID NO: 1883486 - RNA, 12 nt, Homo sapiens
uuacacauaccc

SEQ ID NO: 1883487 - RNA, 20 nt, Homo sapiens
auuguuuugaccccuuacac

SEQ ID NO: 1883488 - RNA, 15 nt, Homo sapiens
ucauuuauugagcac

SEQ ID NO: 1883489 - RNA, 15 nt, Homo sapiens
aacuuauaaauuuca

SEQ ID NO: 1883490 - RNA, 21 nt, Homo sapiens
guauuucaacugaaguucuau

SEQ ID NO: 1883491 - RNA, 18 nt, Homo sapiens
ccugccacagccagagga

SEQ ID NO: 1883492 - RNA, 23 nt, Homo sapiens
gcuguuuaaugucugccagguga

SEQ ID NO: 1883493 - RNA, 14 nt, Homo sapiens
aguaaaucaaagau

SEQ ID NO: 1883494 - RNA, 12 nt, Homo sapiens
gagccugcaguu

SEQ ID NO: 1883495 - RNA, 18 nt, Homo sapiens
ucccccaaagcaauguga

SEQ ID NO: 1883496 - RNA, 20 nt, Homo sapiens
ccggguucaagcaauucucc

SEQ ID NO: 1883497 - RNA, 17 nt, Homo sapiens
guuguucuguggucaca

SEQ ID NO: 1883498 - RNA, 16 nt, Homo sapiens
uagaagugaguguaau

SEQ ID NO: 1883499 - RNA, 22 nt, Homo sapiens
ccucagcuccccggcacugcag

SEQ ID NO: 1883500 - RNA, 17 nt, Homo sapiens
cauguagauuuuaguuc

SEQ ID NO: 1883501 - RNA, 14 nt, Homo sapiens
cugcagucaucucc

SEQ ID NO: 1883502 - RNA, 20 nt, Homo sapiens
uaauauuuuucaaaaucaaa

SEQ ID NO: 1883503 - RNA, 23 nt, Homo sapiens
gccuauguuugcggaaugcauug

SEQ ID NO: 1883504 - RNA, 11 nt, Homo sapiens
ucuaccaagaa

SEQ ID NO: 1883505 - RNA, 12 nt, Homo sapiens
aucauuagaaca

SEQ ID NO: 1883506 - RNA, 23 nt, Homo sapiens
uugaagcuaaaauaaaccagacu

SEQ ID NO: 1883507 - RNA, 14 nt, Homo sapiens
aauacuucauucuc

SEQ ID NO: 1883508 - RNA, 14 nt, Homo sapiens
cucaccuccaccuu

SEQ ID NO: 1883509 - RNA, 19 nt, Homo sapiens
caacugggucugacaugaa

SEQ ID NO: 1883510 - RNA, 22 nt, Homo sapiens
uaacccacaguucuccauuuca

SEQ ID NO: 1883511 - RNA, 21 nt, Homo sapiens
caucaauaaaauagugacaua

SEQ ID NO: 1883512 - RNA, 13 nt, Homo sapiens
aacuucaugaaga

SEQ ID NO: 1883513 - RNA, 23 nt, Homo sapiens
uuuuuggaauuaugucugcugaa

SEQ ID NO: 1883514 - RNA, 20 nt, Homo sapiens
auuucucaguaucaguauuu

SEQ ID NO: 1883515 - RNA, 14 nt, Homo sapiens
aaaugaacugcaua

SEQ ID NO: 1883516 - RNA, 19 nt, Homo sapiens
gaaaccuggccuuauauca

SEQ ID NO: 1883517 - RNA, 22 nt, Homo sapiens
agcuccgcaagcaucaucccug

SEQ ID NO: 1883518 - RNA, 23 nt, Homo sapiens
uugauacauucccaagguuacuu

SEQ ID NO: 1883519 - RNA, 20 nt, Homo sapiens
uaaacccugagccaccgugu

SEQ ID NO: 1883520 - RNA, 20 nt, Homo sapiens
ccaguaggaaaucaggcagu

SEQ ID NO: 1883521 - RNA, 14 nt, Homo sapiens
ucuuucucuuacaa

SEQ ID NO: 1883522 - RNA, 20 nt, Homo sapiens
agcucuucagcacaaagaca

SEQ ID NO: 1883523 - RNA, 13 nt, Homo sapiens
ugcugcuaugaaa

SEQ ID NO: 1883524 - RNA, 17 nt, Homo sapiens
gaguuuggaugucugua

SEQ ID NO: 1883525 - RNA, 23 nt, Homo sapiens
gaccaucugcccggcacugggga

SEQ ID NO: 1883526 - RNA, 17 nt, Homo sapiens
guaacccuggcacuuaa

SEQ ID NO: 1883527 - RNA, 17 nt, Homo sapiens
ccuaaaauuguaugaaa

SEQ ID NO: 1883528 - RNA, 13 nt, Homo sapiens
gcuuaaacuaaug

SEQ ID NO: 1883529 - RNA, 15 nt, Homo sapiens
cagucauauguucuc

SEQ ID NO: 1883530 - RNA, 18 nt, Homo sapiens
caaagaggccaguacuuu

SEQ ID NO: 1883531 - RNA, 16 nt, Homo sapiens
gugguaaauacuguga

SEQ ID NO: 1883532 - RNA, 12 nt, Homo sapiens
caaugugcugcu

SEQ ID NO: 1883533 - RNA, 14 nt, Homo sapiens
acuauuauggaauu

SEQ ID NO: 1883534 - RNA, 23 nt, Homo sapiens
aaaccaagauagauccauuugga

SEQ ID NO: 1883535 - RNA, 21 nt, Homo sapiens
acccucaucgggcgcuacugu

SEQ ID NO: 1883536 - RNA, 16 nt, Homo sapiens
cccaggacgcuucuga

SEQ ID NO: 1883537 - RNA, 16 nt, Homo sapiens
cagugcuuuucacuac

SEQ ID NO: 1883538 - RNA, 15 nt, Homo sapiens
agcuuuuucccucac

SEQ ID NO: 1883539 - RNA, 21 nt, Homo sapiens
aucucaaacuacuggcaauuu

SEQ ID NO: 1883540 - RNA, 16 nt, Homo sapiens
augccuuaaaauggaa

SEQ ID NO: 1883541 - RNA, 18 nt, Homo sapiens
uauuuuaaucuaauucua

SEQ ID NO: 1883542 - RNA, 15 nt, Homo sapiens
guuuaauguuuaguc

SEQ ID NO: 1883543 - RNA, 17 nt, Homo sapiens
uguaauaauaaaaccaa

SEQ ID NO: 1883544 - RNA, 20 nt, Homo sapiens
uaaggaguaaucuguguaca

SEQ ID NO: 1883545 - RNA, 15 nt, Homo sapiens
caguguuuugcagaa

SEQ ID NO: 1883546 - RNA, 20 nt, Homo sapiens
gagagcccagaaaacuguca

SEQ ID NO: 1883547 - RNA, 21 nt, Homo sapiens
acuuuguuauuguaccuaagu

SEQ ID NO: 1883548 - RNA, 19 nt, Homo sapiens
agugcagaagcaugaucac

SEQ ID NO: 1883549 - RNA, 19 nt, Homo sapiens
aucuauuucauaccaugga

SEQ ID NO: 1883550 - RNA, 18 nt, Homo sapiens
ccuucauuuucuaauucu

SEQ ID NO: 1883551 - RNA, 16 nt, Homo sapiens
auuccaaaauccaaaa

SEQ ID NO: 1883552 - RNA, 18 nt, Homo sapiens
agccccaacauguucaga

SEQ ID NO: 1883553 - RNA, 13 nt, Homo sapiens
ugcuccucagggg

SEQ ID NO: 1883554 - RNA, 21 nt, Homo sapiens
uccuuugaauagcagguaguu

SEQ ID NO: 1883555 - RNA, 14 nt, Homo sapiens
cuuaucuagccaaa

SEQ ID NO: 1883556 - RNA, 23 nt, Homo sapiens
aggaaagggauaguccaaagacu

SEQ ID NO: 1883557 - RNA, 22 nt, Homo sapiens
aacauauccaaaauaaugagga

SEQ ID NO: 1883558 - RNA, 15 nt, Homo sapiens
agcauaccacuugaa

SEQ ID NO: 1883559 - RNA, 13 nt, Homo sapiens
cccaaaaugugaa

SEQ ID NO: 1883560 - RNA, 19 nt, Homo sapiens
ugcaaauuuugcauuuagu

SEQ ID NO: 1883561 - RNA, 22 nt, Homo sapiens
acaucaaaacuaaccaucugaa

SEQ ID NO: 1883562 - RNA, 20 nt, Homo sapiens
gucucucggguucaagcaau

SEQ ID NO: 1883563 - RNA, 13 nt, Homo sapiens
uaaaauauggacu

SEQ ID NO: 1883564 - RNA, 16 nt, Homo sapiens
gauaaaugauagacaa

SEQ ID NO: 1883565 - RNA, 18 nt, Homo sapiens
ccucuuuccaagaccaac

SEQ ID NO: 1883566 - RNA, 18 nt, Homo sapiens
cucacgggcccugcccca

SEQ ID NO: 1883567 - RNA, 22 nt, Homo sapiens
cuaaucuaaacuguagcuguau

SEQ ID NO: 1883568 - RNA, 13 nt, Homo sapiens
uuacagacaugaa

SEQ ID NO: 1883569 - RNA, 13 nt, Homo sapiens
acauaacuugaua

SEQ ID NO: 1883570 - RNA, 16 nt, Homo sapiens
uuuauagaacaguuga

SEQ ID NO: 1883571 - RNA, 15 nt, Homo sapiens
ccuggaaggugcugu

SEQ ID NO: 1883572 - RNA, 20 nt, Homo sapiens
guccaacuaaaaacaaaccc

SEQ ID NO: 1883573 - RNA, 16 nt, Homo sapiens
ggucauagauguuucc

SEQ ID NO: 1883574 - RNA, 15 nt, Homo sapiens
cccuccccuccaucc

SEQ ID NO: 1883575 - RNA, 20 nt, Homo sapiens
guaaguagcaacccugugau

SEQ ID NO: 1883576 - RNA, 17 nt, Homo sapiens
aaaccaccccauuaaaa

SEQ ID NO: 1883577 - RNA, 19 nt, Homo sapiens
ucagugcuccuguaaguca

SEQ ID NO: 1883578 - RNA, 21 nt, Homo sapiens
ccucagccuccugaguagcua

SEQ ID NO: 1883579 - RNA, 16 nt, Homo sapiens
aaccacuaauguuaga

SEQ ID NO: 1883580 - RNA, 19 nt, Homo sapiens
uacagcuguauugucugaa

SEQ ID NO: 1883581 - RNA, 13 nt, Homo sapiens
uaauuguguguca

SEQ ID NO: 1883582 - RNA, 16 nt, Homo sapiens
uccaucucugacuuaa

SEQ ID NO: 1883583 - RNA, 17 nt, Homo sapiens
aucuuguucaaugaaga

SEQ ID NO: 1883584 - RNA, 13 nt, Homo sapiens
cagccugccugga

SEQ ID NO: 1883585 - RNA, 21 nt, Homo sapiens
acuauauguugaccauuccaa

SEQ ID NO: 1883586 - RNA, 14 nt, Homo sapiens
agagcccuugccuc

SEQ ID NO: 1883587 - RNA, 22 nt, Homo sapiens
ugcagagccugcagggugaccu

SEQ ID NO: 1883588 - RNA, 12 nt, Homo sapiens
auuuaucuuuag

SEQ ID NO: 1883589 - RNA, 22 nt, Homo sapiens
cuuaacuauccuaacaagccuu

SEQ ID NO: 1883590 - RNA, 19 nt, Homo sapiens
ugagcaggcugagcaccuc

SEQ ID NO: 1883591 - RNA, 18 nt, Homo sapiens
ucguuauuguuguugcca

SEQ ID NO: 1883592 - RNA, 14 nt, Homo sapiens
ccuucaaaccuaaa

SEQ ID NO: 1883593 - RNA, 15 nt, Homo sapiens
augcagaagcaaaca

SEQ ID NO: 1883594 - RNA, 19 nt, Homo sapiens
ugacaacauuucuauagcc

SEQ ID NO: 1883595 - RNA, 13 nt, Homo sapiens
gaaugaucuuucu

SEQ ID NO: 1883596 - RNA, 18 nt, Homo sapiens
cagcauuuccucagucuc

SEQ ID NO: 1883597 - RNA, 14 nt, Homo sapiens
guuuuccucucaau

SEQ ID NO: 1883598 - RNA, 18 nt, Homo sapiens
agaugcauauagacacac

SEQ ID NO: 1883599 - RNA, 13 nt, Homo sapiens
uuuuguugcacug

SEQ ID NO: 1883600 - RNA, 23 nt, Homo sapiens
gucuggaaaacagaaaccauucu

SEQ ID NO: 1883601 - RNA, 14 nt, Homo sapiens
agaaguaccagacu

SEQ ID NO: 1883602 - RNA, 18 nt, Homo sapiens
guggagaauguacacagu

SEQ ID NO: 1883603 - RNA, 17 nt, Homo sapiens
gcaaaucagaaaaccca

SEQ ID NO: 1883604 - RNA, 13 nt, Homo sapiens
acucaguagagau

SEQ ID NO: 1883605 - RNA, 20 nt, Homo sapiens
uaaaaaauuaaacuaaagau

SEQ ID NO: 1883606 - RNA, 14 nt, Homo sapiens
guaaggagccuuuc

SEQ ID NO: 1883607 - RNA, 14 nt, Homo sapiens
guaagcagccuuug

SEQ ID NO: 1883608 - RNA, 21 nt, Homo sapiens
auuguuuugaaacucaguaug

SEQ ID NO: 1883609 - RNA, 21 nt, Homo sapiens
cuggcccuuucuggaccagau

SEQ ID NO: 1883610 - RNA, 15 nt, Homo sapiens
aaaauaccaacucau

SEQ ID NO: 1883611 - RNA, 19 nt, Homo sapiens
ugggagcuucccacaccug

SEQ ID NO: 1883612 - RNA, 13 nt, Homo sapiens
acaacagagugaa

SEQ ID NO: 1883613 - RNA, 23 nt, Homo sapiens
cugcauccuacuccuaccugguc

SEQ ID NO: 1883614 - RNA, 23 nt, Homo sapiens
gcuuucuaugcuguuuguaguga

SEQ ID NO: 1883615 - RNA, 14 nt, Homo sapiens
ucuuuaagaugugu

SEQ ID NO: 1883616 - RNA, 13 nt, Homo sapiens
uaauauggcaaaa

SEQ ID NO: 1883617 - RNA, 15 nt, Homo sapiens
uaacuguagugccuc

SEQ ID NO: 1883618 - RNA, 13 nt, Homo sapiens
acucaucagagca

SEQ ID NO: 1883619 - RNA, 13 nt, Homo sapiens
aagccucagcucc

SEQ ID NO: 1883620 - RNA, 23 nt, Homo sapiens
acaggcaaugcuggcuguuggcu

SEQ ID NO: 1883621 - RNA, 20 nt, Homo sapiens
cuggagugaaguggugugau

SEQ ID NO: 1883622 - RNA, 18 nt, Homo sapiens
aaugggguuguuagcuuu

SEQ ID NO: 1883623 - RNA, 16 nt, Homo sapiens
aaggggugugacuuga

SEQ ID NO: 1883624 - RNA, 22 nt, Homo sapiens
ucuucccucucugcagacuucc

SEQ ID NO: 1883625 - RNA, 23 nt, Homo sapiens
ugacaccgucccucagugauacg

SEQ ID NO: 1883626 - RNA, 16 nt, Homo sapiens
aacgcaaugucauuuu

SEQ ID NO: 1883627 - RNA, 18 nt, Homo sapiens
uuuauaagagggaacaaa

SEQ ID NO: 1883628 - RNA, 23 nt, Homo sapiens
aauguccacuuaaaauacaugaa

SEQ ID NO: 1883629 - RNA, 21 nt, Homo sapiens
cacagauggcaccuguggcca

SEQ ID NO: 1883630 - RNA, 22 nt, Homo sapiens
caaaauaaaucaucuuuauuaa

SEQ ID NO: 1883631 - RNA, 14 nt, Homo sapiens
ugaacacagugucu

SEQ ID NO: 1883632 - RNA, 20 nt, Homo sapiens
cauaaaaaguaauaaaugag

SEQ ID NO: 1883633 - RNA, 14 nt, Homo sapiens
guauauuuaauuca

SEQ ID NO: 1883634 - RNA, 14 nt, Homo sapiens
cacccccagcucaa

SEQ ID NO: 1883635 - RNA, 22 nt, Homo sapiens
aagacacgcccgacucucucca

SEQ ID NO: 1883636 - RNA, 17 nt, Homo sapiens
ugaagaagcaucuuccu

SEQ ID NO: 1883637 - RNA, 20 nt, Homo sapiens
ucaccaugguuuuucacauu

SEQ ID NO: 1883638 - RNA, 14 nt, Homo sapiens
cugcuccaucucau

SEQ ID NO: 1883639 - RNA, 15 nt, Homo sapiens
uaauguucugggaag

SEQ ID NO: 1883640 - RNA, 22 nt, Homo sapiens
ucccccaaacagcaugugcuca

SEQ ID NO: 1883641 - RNA, 20 nt, Homo sapiens
acccuaaggucauuaccaca

SEQ ID NO: 1883642 - RNA, 22 nt, Homo sapiens
cauaauugugaguuaauuugau

SEQ ID NO: 1883643 - RNA, 20 nt, Homo sapiens
ucacguacaccauaugcaag

SEQ ID NO: 1883644 - RNA, 22 nt, Homo sapiens
cccucugaguuuuuguauguau

SEQ ID NO: 1883645 - RNA, 17 nt, Homo sapiens
ugcugucuucagucuca

SEQ ID NO: 1883646 - RNA, 23 nt, Homo sapiens
uaaccuuucaggaaaguaucucu

SEQ ID NO: 1883647 - RNA, 17 nt, Homo sapiens
uuguuauuugaaaacau

SEQ ID NO: 1883648 - RNA, 15 nt, Homo sapiens
ugcuaucaccaauca

SEQ ID NO: 1883649 - RNA, 13 nt, Homo sapiens
gagauaugcacac

SEQ ID NO: 1883650 - RNA, 21 nt, Homo sapiens
cauuuuuaagauagaacacaa

SEQ ID NO: 1883651 - RNA, 12 nt, Homo sapiens
aaugaaggucau

SEQ ID NO: 1883652 - RNA, 18 nt, Homo sapiens
uuaguaaauuaagagcau

SEQ ID NO: 1883653 - RNA, 16 nt, Homo sapiens
cucuaguauuuccaca

SEQ ID NO: 1883654 - RNA, 14 nt, Homo sapiens
uaaucuacuguaaa

SEQ ID NO: 1883655 - RNA, 12 nt, Homo sapiens
caaggacagggc

SEQ ID NO: 1883656 - RNA, 16 nt, Homo sapiens
uccuuguaaauuacau

SEQ ID NO: 1883657 - RNA, 19 nt, Homo sapiens
cuuggggauuaucugucau

SEQ ID NO: 1883658 - RNA, 19 nt, Homo sapiens
aauuuagaaauauaauuga

SEQ ID NO: 1883659 - RNA, 23 nt, Homo sapiens
gugcaaggaccaaagggggcccu

SEQ ID NO: 1883660 - RNA, 16 nt, Homo sapiens
cuuggcucagacaccu

SEQ ID NO: 1883661 - RNA, 20 nt, Homo sapiens
caacuauauuaucaugcaaa

SEQ ID NO: 1883662 - RNA, 18 nt, Homo sapiens
gguggcauacagacuggg

SEQ ID NO: 1883663 - RNA, 13 nt, Homo sapiens
ucacacucaucca

SEQ ID NO: 1883664 - RNA, 15 nt, Homo sapiens
cuauuacauguguua

SEQ ID NO: 1883665 - RNA, 12 nt, Homo sapiens
augaagugcaaa

SEQ ID NO: 1883666 - RNA, 21 nt, Homo sapiens
uuaauuucugucaaaugcagu

SEQ ID NO: 1883667 - RNA, 23 nt, Homo sapiens
gccuugugaugucauacagagaa

SEQ ID NO: 1883668 - RNA, 15 nt, Homo sapiens
auauuucaagcuaua

SEQ ID NO: 1883669 - RNA, 22 nt, Homo sapiens
gacgccaucccagccccaauga

SEQ ID NO: 1883670 - RNA, 18 nt, Homo sapiens
uguguguauguuugcaca

SEQ ID NO: 1883671 - RNA, 13 nt, Homo sapiens
cucauuacugcuu

SEQ ID NO: 1883672 - RNA, 18 nt, Homo sapiens
gcgauucuccugccucag

SEQ ID NO: 1883673 - RNA, 17 nt, Homo sapiens
agaucuaaggaugucac

SEQ ID NO: 1883674 - RNA, 21 nt, Homo sapiens
uaauauuccaggaugcugcug

SEQ ID NO: 1883675 - RNA, 23 nt, Homo sapiens
uuugcuguuguugggacauggca

SEQ ID NO: 1883676 - RNA, 19 nt, Homo sapiens
caaagaagaguuaagaaga

SEQ ID NO: 1883677 - RNA, 16 nt, Homo sapiens
ugcggaguugugcacg

SEQ ID NO: 1883678 - RNA, 18 nt, Homo sapiens
aagaauguguuuaaacuu

SEQ ID NO: 1883679 - RNA, 21 nt, Homo sapiens
ucugccuagaguguagccuaa

SEQ ID NO: 1883680 - RNA, 23 nt, Homo sapiens
cgauucucuugccucaaccuccc

SEQ ID NO: 1883681 - RNA, 18 nt, Homo sapiens
uaacacaauuuucacuuu

SEQ ID NO: 1883682 - RNA, 11 nt, Homo sapiens
caaucuugccc

SEQ ID NO: 1883683 - RNA, 20 nt, Homo sapiens
gugagacuguaaguuacaug

SEQ ID NO: 1883684 - RNA, 19 nt, Homo sapiens
guguguguuuagugauaga

SEQ ID NO: 1883685 - RNA, 21 nt, Homo sapiens
gucuuuagcugaaauggucca

SEQ ID NO: 1883686 - RNA, 17 nt, Homo sapiens
uaggagagaacagggau

SEQ ID NO: 1883687 - RNA, 23 nt, Homo sapiens
caaauaauuccauuccaguuuuu

SEQ ID NO: 1883688 - RNA, 19 nt, Homo sapiens
ggagaaugaauacugggaa

SEQ ID NO: 1883689 - RNA, 22 nt, Homo sapiens
cugugccuggagcuccugggaa

SEQ ID NO: 1883690 - RNA, 17 nt, Homo sapiens
acacauguccaguggga

SEQ ID NO: 1883691 - RNA, 13 nt, Homo sapiens
accagauucacuu

SEQ ID NO: 1883692 - RNA, 21 nt, Homo sapiens
ggcacaagguugguugcuaag

SEQ ID NO: 1883693 - RNA, 16 nt, Homo sapiens
aaacccagugagacag

SEQ ID NO: 1883694 - RNA, 23 nt, Homo sapiens
ucugccuguaucucucacuauua

SEQ ID NO: 1883695 - RNA, 18 nt, Homo sapiens
acucuuucauucuucuca

SEQ ID NO: 1883696 - RNA, 18 nt, Homo sapiens
aauacaccacuacauucu

SEQ ID NO: 1883697 - RNA, 18 nt, Homo sapiens
aaaaccacagcaguugaa

SEQ ID NO: 1883698 - RNA, 17 nt, Homo sapiens
uccccaucauuacuggu

SEQ ID NO: 1883699 - RNA, 14 nt, Homo sapiens
ccaugaaacagcag

SEQ ID NO: 1883700 - RNA, 18 nt, Homo sapiens
agugucauugagcaguau

SEQ ID NO: 1883701 - RNA, 20 nt, Homo sapiens
gaucgcaccagugcacucca

SEQ ID NO: 1883702 - RNA, 12 nt, Homo sapiens
ccuaaguacugu

SEQ ID NO: 1883703 - RNA, 19 nt, Homo sapiens
uuacaauguaucaacauau

SEQ ID NO: 1883704 - RNA, 18 nt, Homo sapiens
uagcuucaggauacugua

SEQ ID NO: 1883705 - RNA, 23 nt, Homo sapiens
auuggagauuacuaacuguggac

SEQ ID NO: 1883706 - RNA, 20 nt, Homo sapiens
ucauuucccuuuauauuucc

SEQ ID NO: 1883707 - RNA, 18 nt, Homo sapiens
agguaggcaccacagaga

SEQ ID NO: 1883708 - RNA, 20 nt, Homo sapiens
caguauuucaagaggcauuc

SEQ ID NO: 1883709 - RNA, 12 nt, Homo sapiens
aucuggaaaaua

SEQ ID NO: 1883710 - RNA, 20 nt, Homo sapiens
caagaauauugcaaaauaca

SEQ ID NO: 1883711 - RNA, 21 nt, Homo sapiens
gccuggaucucacaagcacuu

SEQ ID NO: 1883712 - RNA, 20 nt, Homo sapiens
agaggacccugaguccccac

SEQ ID NO: 1883713 - RNA, 16 nt, Homo sapiens
cuuauuuaaugaaaga

SEQ ID NO: 1883714 - RNA, 16 nt, Homo sapiens
guauacuauaguacca

SEQ ID NO: 1883715 - RNA, 13 nt, Homo sapiens
uggacacagaucc

SEQ ID NO: 1883716 - RNA, 14 nt, Homo sapiens
ugucugugugcaag

SEQ ID NO: 1883717 - RNA, 14 nt, Homo sapiens
ugcauuugugucau

SEQ ID NO: 1883718 - RNA, 19 nt, Homo sapiens
augcuguacuugugguucu

SEQ ID NO: 1883719 - RNA, 21 nt, Homo sapiens
cuuaaauaaauucaaaccauu

SEQ ID NO: 1883720 - RNA, 14 nt, Homo sapiens
cucauacccaugca

SEQ ID NO: 1883721 - RNA, 23 nt, Homo sapiens
auaaaucguccucccaggccagg

SEQ ID NO: 1883722 - RNA, 15 nt, Homo sapiens
aacacucaugaagca

SEQ ID NO: 1883723 - RNA, 16 nt, Homo sapiens
gaauucucucaccucu

SEQ ID NO: 1883724 - RNA, 14 nt, Homo sapiens
ccacggugccucca

SEQ ID NO: 1883725 - RNA, 21 nt, Homo sapiens
acauuugggacugucuugaga

SEQ ID NO: 1883726 - RNA, 11 nt, Homo sapiens
ucuaauaaccu

SEQ ID NO: 1883727 - RNA, 20 nt, Homo sapiens
gaaaucagaagccuacuuug

SEQ ID NO: 1883728 - RNA, 21 nt, Homo sapiens
cugcagcuuuguuuguuguca

SEQ ID NO: 1883729 - RNA, 18 nt, Homo sapiens
gaugauucuuaacacagc

SEQ ID NO: 1883730 - RNA, 18 nt, Homo sapiens
augcagcaccucucagga

SEQ ID NO: 1883731 - RNA, 18 nt, Homo sapiens
ccuaaggguuuuaucucc

SEQ ID NO: 1883732 - RNA, 15 nt, Homo sapiens
caagaacuccuccca

SEQ ID NO: 1883733 - RNA, 22 nt, Homo sapiens
auuuuuguaggaaauguaagau

SEQ ID NO: 1883734 - RNA, 15 nt, Homo sapiens
ccccauaaucacuga

SEQ ID NO: 1883735 - RNA, 23 nt, Homo sapiens
auguagacugaaaagccaugugu

SEQ ID NO: 1883736 - RNA, 18 nt, Homo sapiens
acugacauuccuccaugu

SEQ ID NO: 1883737 - RNA, 19 nt, Homo sapiens
cauccaucccuccauucau

SEQ ID NO: 1883738 - RNA, 19 nt, Homo sapiens
agguucuuagugucacuua

SEQ ID NO: 1883739 - RNA, 13 nt, Homo sapiens
gucugaggacuga

SEQ ID NO: 1883740 - RNA, 19 nt, Homo sapiens
cugcuaugcuaaaccuccu

SEQ ID NO: 1883741 - RNA, 15 nt, Homo sapiens
cugaaaggaugugga

SEQ ID NO: 1883742 - RNA, 16 nt, Homo sapiens
aacccccagagguggc

SEQ ID NO: 1883743 - RNA, 18 nt, Homo sapiens
ccacugcgcucuugggac

SEQ ID NO: 1883744 - RNA, 17 nt, Homo sapiens
uuccuuccacaguuauc

SEQ ID NO: 1883745 - RNA, 22 nt, Homo sapiens
ucagauucaauaaugagagcuc

SEQ ID NO: 1883746 - RNA, 17 nt, Homo sapiens
uccucuacuguuuaaca

SEQ ID NO: 1883747 - RNA, 16 nt, Homo sapiens
agacaaccuuguccca

SEQ ID NO: 1883748 - RNA, 13 nt, Homo sapiens
aaacugcuuuaua

SEQ ID NO: 1883749 - RNA, 13 nt, Homo sapiens
uauaucaguccuc

SEQ ID NO: 1883750 - RNA, 20 nt, Homo sapiens
cuguucuuucuuacacaaga

SEQ ID NO: 1883751 - RNA, 17 nt, Homo sapiens
ucugggaggggugcugc

SEQ ID NO: 1883752 - RNA, 20 nt, Homo sapiens
uggagggcacauuccuugcc

SEQ ID NO: 1883753 - RNA, 19 nt, Homo sapiens
caaguauuaacagcacaag

SEQ ID NO: 1883754 - RNA, 19 nt, Homo sapiens
uucauacgcaucccaucuc

SEQ ID NO: 1883755 - RNA, 21 nt, Homo sapiens
gagaaguccccuuccauccca

SEQ ID NO: 1883756 - RNA, 11 nt, Homo sapiens
agaaucccaag

SEQ ID NO: 1883757 - RNA, 17 nt, Homo sapiens
uggcaaagguggcucuc

SEQ ID NO: 1883758 - RNA, 17 nt, Homo sapiens
auuucagggcugggcua

SEQ ID NO: 1883759 - RNA, 17 nt, Homo sapiens
guagcaggccauggcuc

SEQ ID NO: 1883760 - RNA, 18 nt, Homo sapiens
auuuaggugauaccuaaa

SEQ ID NO: 1883761 - RNA, 22 nt, Homo sapiens
uaccucugcuauuugcuguuau

SEQ ID NO: 1883762 - RNA, 21 nt, Homo sapiens
caagccgagcucuccuuguua

SEQ ID NO: 1883763 - RNA, 21 nt, Homo sapiens
aggcaaaggcccccaucacac

SEQ ID NO: 1883764 - RNA, 14 nt, Homo sapiens
uuaaagacguaaaa

SEQ ID NO: 1883765 - RNA, 22 nt, Homo sapiens
caauaaggggagaguaacccug

SEQ ID NO: 1883766 - RNA, 18 nt, Homo sapiens
ucaaaucaggaacuguau

SEQ ID NO: 1883767 - RNA, 20 nt, Homo sapiens
cagaugauuuucuucuccau

SEQ ID NO: 1883768 - RNA, 22 nt, Homo sapiens
caguguggcccagggaagccaa

SEQ ID NO: 1883769 - RNA, 17 nt, Homo sapiens
ucgcccagacaccaugu

SEQ ID NO: 1883770 - RNA, 15 nt, Homo sapiens
uuugcauguuuugua

SEQ ID NO: 1883771 - RNA, 17 nt, Homo sapiens
aaucucugugaaauacu

SEQ ID NO: 1883772 - RNA, 12 nt, Homo sapiens
uccacaccaagc

SEQ ID NO: 1883773 - RNA, 19 nt, Homo sapiens
acuccaggucuaaacagcu

SEQ ID NO: 1883774 - RNA, 20 nt, Homo sapiens
cccuucaguacccucucagc

SEQ ID NO: 1883775 - RNA, 19 nt, Homo sapiens
ugcaagcgucugugcauuu

SEQ ID NO: 1883776 - RNA, 23 nt, Homo sapiens
aauugugacauaauaauagcagu

SEQ ID NO: 1883777 - RNA, 21 nt, Homo sapiens
ggaguuuuauuuuuaagaaaa

SEQ ID NO: 1883778 - RNA, 15 nt, Homo sapiens
gaaaauuaccuuuaa

SEQ ID NO: 1883779 - RNA, 15 nt, Homo sapiens
aaaacacaucuuucc

SEQ ID NO: 1883780 - RNA, 15 nt, Homo sapiens
ucggcacuguacaaa

SEQ ID NO: 1883781 - RNA, 13 nt, Homo sapiens
cgaccccaagagu

SEQ ID NO: 1883782 - RNA, 16 nt, Homo sapiens
cuacuuuuuauacucc

SEQ ID NO: 1883783 - RNA, 12 nt, Homo sapiens
uacuaccccagg

SEQ ID NO: 1883784 - RNA, 16 nt, Homo sapiens
gugaacugcgugccag

SEQ ID NO: 1883785 - RNA, 19 nt, Homo sapiens
caggugcgugccaccacac

SEQ ID NO: 1883786 - RNA, 15 nt, Homo sapiens
uugauaaaauccaaa

SEQ ID NO: 1883787 - RNA, 17 nt, Homo sapiens
uucccaggaauauccca

SEQ ID NO: 1883788 - RNA, 14 nt, Homo sapiens
ucacugcucaagaa

SEQ ID NO: 1883789 - RNA, 22 nt, Homo sapiens
gggcacacgccucccacugggg

SEQ ID NO: 1883790 - RNA, 12 nt, Homo sapiens
uuaagauugcaa

SEQ ID NO: 1883791 - RNA, 12 nt, Homo sapiens
gguucugugcaa

SEQ ID NO: 1883792 - RNA, 19 nt, Homo sapiens
caucccuagucucuaccca

SEQ ID NO: 1883793 - RNA, 21 nt, Homo sapiens
aauacagacuacuucuucccc

SEQ ID NO: 1883794 - RNA, 14 nt, Homo sapiens
cacaacagugcccu

SEQ ID NO: 1883795 - RNA, 17 nt, Homo sapiens
ccaugagaaaucaugcc

SEQ ID NO: 1883796 - RNA, 20 nt, Homo sapiens
auuucucacccuacucugga

SEQ ID NO: 1883797 - RNA, 16 nt, Homo sapiens
uggcaucucacuuuau

SEQ ID NO: 1883798 - RNA, 21 nt, Homo sapiens
uauguaugguuguuacuaugg

SEQ ID NO: 1883799 - RNA, 14 nt, Homo sapiens
uauaaauaaacaca

SEQ ID NO: 1883800 - RNA, 11 nt, Homo sapiens
gaauauuccac

SEQ ID NO: 1883801 - RNA, 18 nt, Homo sapiens
agcuuccuggcucugggg

SEQ ID NO: 1883802 - RNA, 14 nt, Homo sapiens
ucaaggaugacucc

SEQ ID NO: 1883803 - RNA, 23 nt, Homo sapiens
gcuguuuuaauaauuaugugcca

SEQ ID NO: 1883804 - RNA, 15 nt, Homo sapiens
ugaacaaauaugcuu

SEQ ID NO: 1883805 - RNA, 18 nt, Homo sapiens
caacauuggagacaucac

SEQ ID NO: 1883806 - RNA, 18 nt, Homo sapiens
guuugaaauauguuaaac

SEQ ID NO: 1883807 - RNA, 12 nt, Homo sapiens
gaacaugcaguu

SEQ ID NO: 1883808 - RNA, 20 nt, Homo sapiens
cucagauaaauuaugguaaa

SEQ ID NO: 1883809 - RNA, 19 nt, Homo sapiens
caggagcauuuugugucuu

SEQ ID NO: 1883810 - RNA, 17 nt, Homo sapiens
ccaaagcuuaugugaca

SEQ ID NO: 1883811 - RNA, 15 nt, Homo sapiens
gacacuaucacucau

SEQ ID NO: 1883812 - RNA, 15 nt, Homo sapiens
cuuuuuauguuauau

SEQ ID NO: 1883813 - RNA, 14 nt, Homo sapiens
gcuccaccuucaua

SEQ ID NO: 1883814 - RNA, 22 nt, Homo sapiens
cauaaaaaauaaaguaccacac

SEQ ID NO: 1883815 - RNA, 16 nt, Homo sapiens
cagccugggugacaga

SEQ ID NO: 1883816 - RNA, 19 nt, Homo sapiens
ucucauggugaaaucugcu

SEQ ID NO: 1883817 - RNA, 18 nt, Homo sapiens
cccuguuauaauuugcac

SEQ ID NO: 1883818 - RNA, 14 nt, Homo sapiens
cuacauuaucucac

SEQ ID NO: 1883819 - RNA, 23 nt, Homo sapiens
gaaacagaccuuuuucucucuua

SEQ ID NO: 1883820 - RNA, 23 nt, Homo sapiens
aaguagacuucauuuuuccuaac

SEQ ID NO: 1883821 - RNA, 17 nt, Homo sapiens
auucugugccuccagga

SEQ ID NO: 1883822 - RNA, 22 nt, Homo sapiens
uuuuucccccaaccucccccuc

SEQ ID NO: 1883823 - RNA, 16 nt, Homo sapiens
aaagacuggcuuuuau

SEQ ID NO: 1883824 - RNA, 19 nt, Homo sapiens
cauccaaucuauuauuucu

SEQ ID NO: 1883825 - RNA, 22 nt, Homo sapiens
caaagcugaugacaacuuccca

SEQ ID NO: 1883826 - RNA, 18 nt, Homo sapiens
guagccuaacacacucca

SEQ ID NO: 1883827 - RNA, 11 nt, Homo sapiens
ccuaaauggag

SEQ ID NO: 1883828 - RNA, 13 nt, Homo sapiens
gcaaguaacauua

SEQ ID NO: 1883829 - RNA, 18 nt, Homo sapiens
uauaauuuuaaaauugca

SEQ ID NO: 1883830 - RNA, 18 nt, Homo sapiens
cuuuagaugccaaaccac

SEQ ID NO: 1883831 - RNA, 21 nt, Homo sapiens
uaagcucagagaaaguuccau

SEQ ID NO: 1883832 - RNA, 16 nt, Homo sapiens
ugccuuugauguggau

SEQ ID NO: 1883833 - RNA, 21 nt, Homo sapiens
ugcagcuaacaugaguaucau

SEQ ID NO: 1883834 - RNA, 12 nt, Homo sapiens
ugugauugccuc

SEQ ID NO: 1883835 - RNA, 12 nt, Homo sapiens
gcuggaagggaa

SEQ ID NO: 1883836 - RNA, 13 nt, Homo sapiens
ucaagacaccaaa

SEQ ID NO: 1883837 - RNA, 16 nt, Homo sapiens
cgaguccauuguggag

SEQ ID NO: 1883838 - RNA, 22 nt, Homo sapiens
aaucucuauguagaaaucucau

SEQ ID NO: 1883839 - RNA, 20 nt, Homo sapiens
gcugaugaaguuaagcacaa

SEQ ID NO: 1883840 - RNA, 16 nt, Homo sapiens
aaagagagaagccagc

SEQ ID NO: 1883841 - RNA, 15 nt, Homo sapiens
uucuuguuaagugcu

SEQ ID NO: 1883842 - RNA, 16 nt, Homo sapiens
uggagagugagggcuc

SEQ ID NO: 1883843 - RNA, 12 nt, Homo sapiens
ucaucucagcuu

SEQ ID NO: 1883844 - RNA, 22 nt, Homo sapiens
uuguugcaggcuguaaggcaug

SEQ ID NO: 1883845 - RNA, 14 nt, Homo sapiens
cauauuuacugguc

SEQ ID NO: 1883846 - RNA, 22 nt, Homo sapiens
uggucucaaacuccugaccuca

SEQ ID NO: 1883847 - RNA, 21 nt, Homo sapiens
gggcacggcuucccaggggaa

SEQ ID NO: 1883848 - RNA, 19 nt, Homo sapiens
uucuauguccaaaccuggu

SEQ ID NO: 1883849 - RNA, 16 nt, Homo sapiens
uuuccuuucugccacc

SEQ ID NO: 1883850 - RNA, 20 nt, Homo sapiens
guuccaaauucaguuucaua

SEQ ID NO: 1883851 - RNA, 18 nt, Homo sapiens
gcaguugucaccaaauac

SEQ ID NO: 1883852 - RNA, 19 nt, Homo sapiens
uccagcuacuuuugccaaa

SEQ ID NO: 1883853 - RNA, 12 nt, Homo sapiens
cagugacaguau

SEQ ID NO: 1883854 - RNA, 14 nt, Homo sapiens
cagacacagacugg

SEQ ID NO: 1883855 - RNA, 14 nt, Homo sapiens
ugguuuacuguguu

SEQ ID NO: 1883856 - RNA, 18 nt, Homo sapiens
uaaugaacagaacauaga

SEQ ID NO: 1883857 - RNA, 23 nt, Homo sapiens
aaaaugagcuaggcaugguggca

SEQ ID NO: 1883858 - RNA, 13 nt, Homo sapiens
cagccaugugcug

SEQ ID NO: 1883859 - RNA, 17 nt, Homo sapiens
uguauccagaagccagu

SEQ ID NO: 1883860 - RNA, 18 nt, Homo sapiens
cguggugaccuuucacga

SEQ ID NO: 1883861 - RNA, 19 nt, Homo sapiens
aauucuaaagagcacuuac

SEQ ID NO: 1883862 - RNA, 22 nt, Homo sapiens
accuguguauggugaccucucc

SEQ ID NO: 1883863 - RNA, 16 nt, Homo sapiens
gcauucccucccauca

SEQ ID NO: 1883864 - RNA, 13 nt, Homo sapiens
ccacuauggucau

SEQ ID NO: 1883865 - RNA, 22 nt, Homo sapiens
ugcaucuuugccucaacuccag

SEQ ID NO: 1883866 - RNA, 17 nt, Homo sapiens
aaauaaaaggaagccaa

SEQ ID NO: 1883867 - RNA, 17 nt, Homo sapiens
auucauaaaaacuguga

SEQ ID NO: 1883868 - RNA, 16 nt, Homo sapiens
guugauagacugcuac

SEQ ID NO: 1883869 - RNA, 20 nt, Homo sapiens
uaaugauaaaauacuaaacu

SEQ ID NO: 1883870 - RNA, 21 nt, Homo sapiens
uagggcccugucuuauucaac

SEQ ID NO: 1883871 - RNA, 22 nt, Homo sapiens
gucugaaggagaggagugcgcu

SEQ ID NO: 1883872 - RNA, 18 nt, Homo sapiens
aguauaacugaguuaaau

SEQ ID NO: 1883873 - RNA, 13 nt, Homo sapiens
caugggugggugg

SEQ ID NO: 1883874 - RNA, 13 nt, Homo sapiens
caggggugggggg

SEQ ID NO: 1883875 - RNA, 18 nt, Homo sapiens
agccugcaucuucuugca

SEQ ID NO: 1883876 - RNA, 14 nt, Homo sapiens
aaugucugcagcuc

SEQ ID NO: 1883877 - RNA, 14 nt, Homo sapiens
caucccugaaggcc

SEQ ID NO: 1883878 - RNA, 23 nt, Homo sapiens
caggaggaucauuugagcucaug

SEQ ID NO: 1883879 - RNA, 13 nt, Homo sapiens
cagcacaagcuca

SEQ ID NO: 1883880 - RNA, 17 nt, Homo sapiens
gcacgcggagcgaaaca

SEQ ID NO: 1883881 - RNA, 14 nt, Homo sapiens
aaccuccgccuccc

SEQ ID NO: 1883882 - RNA, 14 nt, Homo sapiens
agucauucuucccu

SEQ ID NO: 1883883 - RNA, 18 nt, Homo sapiens
guuaaugcaaaugacugu

SEQ ID NO: 1883884 - RNA, 20 nt, Homo sapiens
gaggucugguccgagucuca

SEQ ID NO: 1883885 - RNA, 16 nt, Homo sapiens
uucuaggaagcuccag

SEQ ID NO: 1883886 - RNA, 13 nt, Homo sapiens
gugggaacucuga

SEQ ID NO: 1883887 - RNA, 14 nt, Homo sapiens
augauucaaauguc

SEQ ID NO: 1883888 - RNA, 14 nt, Homo sapiens
uguaagacuuacaa

SEQ ID NO: 1883889 - RNA, 17 nt, Homo sapiens
cauuauuucaucaugac

SEQ ID NO: 1883890 - RNA, 20 nt, Homo sapiens
cucgccuguuggggaccuca

SEQ ID NO: 1883891 - RNA, 15 nt, Homo sapiens
agacuccaagccaag

SEQ ID NO: 1883892 - RNA, 11 nt, Homo sapiens
ucaucauauga

SEQ ID NO: 1883893 - RNA, 21 nt, Homo sapiens
gccugaagaagcacuucugcu

SEQ ID NO: 1883894 - RNA, 20 nt, Homo sapiens
uauacccacauguacagaca

SEQ ID NO: 1883895 - RNA, 14 nt, Homo sapiens
ucccaaucuugccc

SEQ ID NO: 1883896 - RNA, 22 nt, Homo sapiens
ccagcaaaagagcuauugccaa

SEQ ID NO: 1883897 - RNA, 22 nt, Homo sapiens
uugauacaacauuaaggaauuu

SEQ ID NO: 1883898 - RNA, 23 nt, Homo sapiens
ugcuuugugccaucacugagcau

SEQ ID NO: 1883899 - RNA, 18 nt, Homo sapiens
cagacccaggucuuccag

SEQ ID NO: 1883900 - RNA, 17 nt, Homo sapiens
uaccuacagagcagcca

SEQ ID NO: 1883901 - RNA, 13 nt, Homo sapiens
ugguuuguacuca

SEQ ID NO: 1883902 - RNA, 12 nt, Homo sapiens
caugcaugcaaa

SEQ ID NO: 1883903 - RNA, 13 nt, Homo sapiens
gugcccuugcccu

SEQ ID NO: 1883904 - RNA, 18 nt, Homo sapiens
agcucccaggccaacagu

SEQ ID NO: 1883905 - RNA, 22 nt, Homo sapiens
cagaaaaccuaccacauucacu

SEQ ID NO: 1883906 - RNA, 20 nt, Homo sapiens
aauccauguaaauugcaaau

SEQ ID NO: 1883907 - RNA, 22 nt, Homo sapiens
aggaugccuuaucucuucucac

SEQ ID NO: 1883908 - RNA, 17 nt, Homo sapiens
uuuaugugaacuaugau

SEQ ID NO: 1883909 - RNA, 15 nt, Homo sapiens
gugcuguugggauau

SEQ ID NO: 1883910 - RNA, 18 nt, Homo sapiens
auacaauuggacgcauuu

SEQ ID NO: 1883911 - RNA, 20 nt, Homo sapiens
cucuguccacgauucacuca

SEQ ID NO: 1883912 - RNA, 19 nt, Homo sapiens
aaggcuguacgacacgggu

SEQ ID NO: 1883913 - RNA, 22 nt, Homo sapiens
ugaaggcaaaaccaacucucua

SEQ ID NO: 1883914 - RNA, 12 nt, Homo sapiens
caggcacuuugc

SEQ ID NO: 1883915 - RNA, 12 nt, Homo sapiens
ugagacuccauc

SEQ ID NO: 1883916 - RNA, 15 nt, Homo sapiens
augucaguagugcua

SEQ ID NO: 1883917 - RNA, 19 nt, Homo sapiens
ccacagaggacagugcuga

SEQ ID NO: 1883918 - RNA, 14 nt, Homo sapiens
uuugacuuugccaa

SEQ ID NO: 1883919 - RNA, 12 nt, Homo sapiens
uggccuggcaca

SEQ ID NO: 1883920 - RNA, 16 nt, Homo sapiens
cauucugcaaguauac

SEQ ID NO: 1883921 - RNA, 21 nt, Homo sapiens
ccauauacucuucaaggacuu

SEQ ID NO: 1883922 - RNA, 24 nt, Homo sapiens
uugacucauggcagcuguuucuca

SEQ ID NO: 1883923 - RNA, 23 nt, Homo sapiens
gccucugcggggcagggccuucc

SEQ ID NO: 1883924 - RNA, 19 nt, Homo sapiens
gcagcgcugcaguugcuca

SEQ ID NO: 1883925 - RNA, 22 nt, Homo sapiens
auacuccauacauaacuugaua

SEQ ID NO: 1883926 - RNA, 16 nt, Homo sapiens
augaauaaagcaucca

SEQ ID NO: 1883927 - RNA, 21 nt, Homo sapiens
uuaauagggauuuuuucagcu

SEQ ID NO: 1883928 - RNA, 19 nt, Homo sapiens
aucaccccaaaagcaagac

SEQ ID NO: 1883929 - RNA, 17 nt, Homo sapiens
uugugucacugacucag

SEQ ID NO: 1883930 - RNA, 19 nt, Homo sapiens
uaagagacacuccaaaccu

SEQ ID NO: 1883931 - RNA, 12 nt, Homo sapiens
ugggaccacaga

SEQ ID NO: 1883932 - RNA, 19 nt, Homo sapiens
ccuauagcacugagcucac

SEQ ID NO: 1883933 - RNA, 16 nt, Homo sapiens
cugcccuugucacugg

SEQ ID NO: 1883934 - RNA, 18 nt, Homo sapiens
augaccuaaccuaagcaa

SEQ ID NO: 1883935 - RNA, 15 nt, Homo sapiens
uaauucucuguggaa

SEQ ID NO: 1883936 - RNA, 20 nt, Homo sapiens
agcuggagcccgugcccuac

SEQ ID NO: 1883937 - RNA, 14 nt, Homo sapiens
gaucugauucuacc

SEQ ID NO: 1883938 - RNA, 19 nt, Homo sapiens
caaaucccucauccugaca

SEQ ID NO: 1883939 - RNA, 17 nt, Homo sapiens
acagaguuucaccaugu

SEQ ID NO: 1883940 - RNA, 20 nt, Homo sapiens
cugggaucaagaaggggaca

SEQ ID NO: 1883941 - RNA, 19 nt, Homo sapiens
cucugcaccguacugugga

SEQ ID NO: 1883942 - RNA, 14 nt, Homo sapiens
aucacuaguggcaa

SEQ ID NO: 1883943 - RNA, 21 nt, Homo sapiens
aauucugaccuuacaaaagug

SEQ ID NO: 1883944 - RNA, 19 nt, Homo sapiens
cugaacaguguuaauaaua

SEQ ID NO: 1883945 - RNA, 14 nt, Homo sapiens
uuaucuauaucuca

SEQ ID NO: 1883946 - RNA, 17 nt, Homo sapiens
ucccacaagaaauucau

SEQ ID NO: 1883947 - RNA, 14 nt, Homo sapiens
ccaggacugcauug

SEQ ID NO: 1883948 - RNA, 16 nt, Homo sapiens
cugaucuagugcagua

SEQ ID NO: 1883949 - RNA, 22 nt, Homo sapiens
cagaauucaaaagugauuaucu

SEQ ID NO: 1883950 - RNA, 14 nt, Homo sapiens
uccuaccugucugc

SEQ ID NO: 1883951 - RNA, 12 nt, Homo sapiens
caacaaaaggga

SEQ ID NO: 1883952 - RNA, 13 nt, Homo sapiens
cagugcauuugcc

SEQ ID NO: 1883953 - RNA, 20 nt, Homo sapiens
cucagcgcgucucagcucag

SEQ ID NO: 1883954 - RNA, 22 nt, Homo sapiens
cagggugcucccuccucagucu

SEQ ID NO: 1883955 - RNA, 14 nt, Homo sapiens
gugaaugcacagug

SEQ ID NO: 1883956 - RNA, 16 nt, Homo sapiens
aucaacagaccuaaga

SEQ ID NO: 1883957 - RNA, 19 nt, Homo sapiens
aaguagccucuuucauccc

SEQ ID NO: 1883958 - RNA, 14 nt, Homo sapiens
uccccucccagaug

SEQ ID NO: 1883959 - RNA, 17 nt, Homo sapiens
caggcuggcgugcagca

SEQ ID NO: 1883960 - RNA, 18 nt, Homo sapiens
acugaguuagaauguuga

SEQ ID NO: 1883961 - RNA, 12 nt, Homo sapiens
guagaagccagu

SEQ ID NO: 1883962 - RNA, 14 nt, Homo sapiens
aagaaauaaugccu

SEQ ID NO: 1883963 - RNA, 15 nt, Homo sapiens
agggcagucugcuca

SEQ ID NO: 1883964 - RNA, 17 nt, Homo sapiens
auuauuuaaacaucagc

SEQ ID NO: 1883965 - RNA, 20 nt, Homo sapiens
ccagcucauuucaguuucua

SEQ ID NO: 1883966 - RNA, 19 nt, Homo sapiens
ucuagaggauguaucucac

SEQ ID NO: 1883967 - RNA, 14 nt, Homo sapiens
auaugaucccuaau

SEQ ID NO: 1883968 - RNA, 13 nt, Homo sapiens
ugccccugggaac

SEQ ID NO: 1883969 - RNA, 14 nt, Homo sapiens
agcuucugcaauau

SEQ ID NO: 1883970 - RNA, 19 nt, Homo sapiens
ggagccuaggaccacucag

SEQ ID NO: 1883971 - RNA, 16 nt, Homo sapiens
auaaucuuaaacaauu

SEQ ID NO: 1883972 - RNA, 17 nt, Homo sapiens
uguaucaucuuugccaa

SEQ ID NO: 1883973 - RNA, 13 nt, Homo sapiens
auguagauugccu

SEQ ID NO: 1883974 - RNA, 21 nt, Homo sapiens
guaaaccaaguucaaaggaaa

SEQ ID NO: 1883975 - RNA, 13 nt, Homo sapiens
acuauucugauua

SEQ ID NO: 1883976 - RNA, 18 nt, Homo sapiens
aaaauguccaccaauaga

SEQ ID NO: 1883977 - RNA, 11 nt, Homo sapiens
uacaaccagcc

SEQ ID NO: 1883978 - RNA, 14 nt, Homo sapiens
cucaccagccucac

SEQ ID NO: 1883979 - RNA, 17 nt, Homo sapiens
cucuucaucccauucca

SEQ ID NO: 1883980 - RNA, 13 nt, Homo sapiens
accaacuaagaaa

SEQ ID NO: 1883981 - RNA, 18 nt, Homo sapiens
uuugccaggacaugcaau

SEQ ID NO: 1883982 - RNA, 14 nt, Homo sapiens
ucauguuccucaaa

SEQ ID NO: 1883983 - RNA, 15 nt, Homo sapiens
ugggaggggugcugc

SEQ ID NO: 1883984 - RNA, 22 nt, Homo sapiens
gcauccgaaaccagcaucugca

SEQ ID NO: 1883985 - RNA, 19 nt, Homo sapiens
aggggcuuaaaagaaacua

SEQ ID NO: 1883986 - RNA, 17 nt, Homo sapiens
auacuggcaaagcagaa

SEQ ID NO: 1883987 - RNA, 14 nt, Homo sapiens
cucaacaugcugcc

SEQ ID NO: 1883988 - RNA, 19 nt, Homo sapiens
gcgaaaucuguugugcaug

SEQ ID NO: 1883989 - RNA, 13 nt, Homo sapiens
augauggggucag

SEQ ID NO: 1883990 - RNA, 18 nt, Homo sapiens
cucagccuuccaaagugc

SEQ ID NO: 1883991 - RNA, 22 nt, Homo sapiens
cccaggcuuuugaaaaacaaac

SEQ ID NO: 1883992 - RNA, 23 nt, Homo sapiens
ugccccuugggagacuccaggga

SEQ ID NO: 1883993 - RNA, 14 nt, Homo sapiens
uccagaaugaucau

SEQ ID NO: 1883994 - RNA, 17 nt, Homo sapiens
aggagcugagguuucac

SEQ ID NO: 1883995 - RNA, 18 nt, Homo sapiens
ugauaaucaucagguuua

SEQ ID NO: 1883996 - RNA, 16 nt, Homo sapiens
ccgaggggcucaggaa

SEQ ID NO: 1883997 - RNA, 21 nt, Homo sapiens
acacucaccauuuaaucauuu

SEQ ID NO: 1883998 - RNA, 21 nt, Homo sapiens
ggauccccagccuacugccuc

SEQ ID NO: 1883999 - RNA, 15 nt, Homo sapiens
gguggguggugggcu

SEQ ID NO: 1884000 - RNA, 22 nt, Homo sapiens
aaauuaugucaaauggauguaa

SEQ ID NO: 1884001 - RNA, 18 nt, Homo sapiens
ucuuuuuuuucuauuuca

SEQ ID NO: 1884002 - RNA, 19 nt, Homo sapiens
gccgcucccgguucccucc

SEQ ID NO: 1884003 - RNA, 14 nt, Homo sapiens
ggcgaaccaucuca

SEQ ID NO: 1884004 - RNA, 19 nt, Homo sapiens
ugaauuuuuuuuaaugcuu

SEQ ID NO: 1884005 - RNA, 22 nt, Homo sapiens
uuuaauuuugucagauucacac

SEQ ID NO: 1884006 - RNA, 16 nt, Homo sapiens
acuagugacagcuugu

SEQ ID NO: 1884007 - RNA, 19 nt, Homo sapiens
uugauguuuuacgugcaaa

SEQ ID NO: 1884008 - RNA, 14 nt, Homo sapiens
cauacaguuuucau

SEQ ID NO: 1884009 - RNA, 15 nt, Homo sapiens
cgaaggcauuuucca

SEQ ID NO: 1884010 - RNA, 21 nt, Homo sapiens
gagacagagagccaagcuaau

SEQ ID NO: 1884011 - RNA, 22 nt, Homo sapiens
uuuagguacugaagauuaucac

SEQ ID NO: 1884012 - RNA, 20 nt, Homo sapiens
gaacccaggaggcagagguu

SEQ ID NO: 1884013 - RNA, 19 nt, Homo sapiens
acccuccuaauagucauac

SEQ ID NO: 1884014 - RNA, 14 nt, Homo sapiens
cauaaacugccaag

SEQ ID NO: 1884015 - RNA, 14 nt, Homo sapiens
auaaauguguaaau

SEQ ID NO: 1884016 - RNA, 14 nt, Homo sapiens
agugcaguggugca

SEQ ID NO: 1884017 - RNA, 17 nt, Homo sapiens
ugugccugaagucccag

SEQ ID NO: 1884018 - RNA, 19 nt, Homo sapiens
gaguccagugaguccaggc

SEQ ID NO: 1884019 - RNA, 18 nt, Homo sapiens
uuucuauuuuuaugauga

SEQ ID NO: 1884020 - RNA, 22 nt, Homo sapiens
uaagaagccuuaauuugcacag

SEQ ID NO: 1884021 - RNA, 21 nt, Homo sapiens
cacaggaguugguuagaauuu

SEQ ID NO: 1884022 - RNA, 12 nt, Homo sapiens
cauggauacuuc

SEQ ID NO: 1884023 - RNA, 21 nt, Homo sapiens
cacugaccuuggagagacaca

SEQ ID NO: 1884024 - RNA, 14 nt, Homo sapiens
caugcucuguccag

SEQ ID NO: 1884025 - RNA, 22 nt, Homo sapiens
uuuaaaaauuauauacauauau

SEQ ID NO: 1884026 - RNA, 13 nt, Homo sapiens
cucagcacucugc

SEQ ID NO: 1884027 - RNA, 16 nt, Homo sapiens
acuguacagugucuuu

SEQ ID NO: 1884028 - RNA, 22 nt, Homo sapiens
caggccgcccugcgggugaaca

SEQ ID NO: 1884029 - RNA, 18 nt, Homo sapiens
auaauuuauuaacuauuu

SEQ ID NO: 1884030 - RNA, 18 nt, Homo sapiens
ccuaacaugcaccuugcu

SEQ ID NO: 1884031 - RNA, 22 nt, Homo sapiens
acuggaccguuuccaagcugcg

SEQ ID NO: 1884032 - RNA, 12 nt, Homo sapiens
gcuuagauuucc

SEQ ID NO: 1884033 - RNA, 17 nt, Homo sapiens
aaguguaguugacugaa

SEQ ID NO: 1884034 - RNA, 15 nt, Homo sapiens
uggcauccugugacc

SEQ ID NO: 1884035 - RNA, 19 nt, Homo sapiens
caugugaaaauaauagcca

SEQ ID NO: 1884036 - RNA, 16 nt, Homo sapiens
ucuccauguuggucag

SEQ ID NO: 1884037 - RNA, 18 nt, Homo sapiens
gccaacacuuaaucauuu

SEQ ID NO: 1884038 - RNA, 13 nt, Homo sapiens
aagcauacuuugu

SEQ ID NO: 1884039 - RNA, 17 nt, Homo sapiens
gaggccauggacucugu

SEQ ID NO: 1884040 - RNA, 20 nt, Homo sapiens
aauaacuuggagacagagag

SEQ ID NO: 1884041 - RNA, 19 nt, Homo sapiens
ugccacuggggaaaacucc

SEQ ID NO: 1884042 - RNA, 15 nt, Homo sapiens
aggaauaugggagaa

SEQ ID NO: 1884043 - RNA, 18 nt, Homo sapiens
ugaguauuccaccacagg

SEQ ID NO: 1884044 - RNA, 23 nt, Homo sapiens
gauaaaauaaaaagaugaagcug

SEQ ID NO: 1884045 - RNA, 14 nt, Homo sapiens
auugagaaacauga

SEQ ID NO: 1884046 - RNA, 21 nt, Homo sapiens
gcccgcugcgugccaucacuc

SEQ ID NO: 1884047 - RNA, 21 nt, Homo sapiens
gcauuuaaaaggacugcugau

SEQ ID NO: 1884048 - RNA, 18 nt, Homo sapiens
gccugcucugcugugagc

SEQ ID NO: 1884049 - RNA, 14 nt, Homo sapiens
ggaaaaaccuugug

SEQ ID NO: 1884050 - RNA, 20 nt, Homo sapiens
uacugcaagaaggagcucag

SEQ ID NO: 1884051 - RNA, 18 nt, Homo sapiens
aaaauaagaaaaauauua

SEQ ID NO: 1884052 - RNA, 17 nt, Homo sapiens
cuuuaucuugacauuca

SEQ ID NO: 1884053 - RNA, 18 nt, Homo sapiens
ucaaaaucucuccacuuu

SEQ ID NO: 1884054 - RNA, 18 nt, Homo sapiens
agcagaauacaaugggaa

SEQ ID NO: 1884055 - RNA, 22 nt, Homo sapiens
uaugcaugcccuuccuuucuau

SEQ ID NO: 1884056 - RNA, 20 nt, Homo sapiens
cugagcauuagauuucucau

SEQ ID NO: 1884057 - RNA, 21 nt, Homo sapiens
agacuuccuguaagauugcuu

SEQ ID NO: 1884058 - RNA, 19 nt, Homo sapiens
cugaguucuggggugggag

SEQ ID NO: 1884059 - RNA, 19 nt, Homo sapiens
ggcuucucuugagucacac

SEQ ID NO: 1884060 - RNA, 21 nt, Homo sapiens
cucuauaauuaguuaugacag

SEQ ID NO: 1884061 - RNA, 10 nt, Homo sapiens
uguguucaag

SEQ ID NO: 1884062 - RNA, 13 nt, Homo sapiens
ggauuugugcuuu

SEQ ID NO: 1884063 - RNA, 23 nt, Homo sapiens
agcucuguccucugucagucaug

SEQ ID NO: 1884064 - RNA, 18 nt, Homo sapiens
gaaguaugagugcugauu

SEQ ID NO: 1884065 - RNA, 22 nt, Homo sapiens
gucccaccccuaccucuaguaa

SEQ ID NO: 1884066 - RNA, 15 nt, Homo sapiens
caaaucuucaguauu

SEQ ID NO: 1884067 - RNA, 18 nt, Homo sapiens
ugacaacgcccuacagca

SEQ ID NO: 1884068 - RNA, 21 nt, Homo sapiens
uccaaacuccucaacugggaa

SEQ ID NO: 1884069 - RNA, 21 nt, Homo sapiens
ggcccaugugacuguggcauu

SEQ ID NO: 1884070 - RNA, 15 nt, Homo sapiens
aucucaucaggguag

SEQ ID NO: 1884071 - RNA, 16 nt, Homo sapiens
ugaaguagaauccuaa

SEQ ID NO: 1884072 - RNA, 19 nt, Homo sapiens
cagcuugcacaaagaggau

SEQ ID NO: 1884073 - RNA, 19 nt, Homo sapiens
aaugugugggguauagaaa

SEQ ID NO: 1884074 - RNA, 21 nt, Homo sapiens
ugcccuuuaacuuucuaauga

SEQ ID NO: 1884075 - RNA, 16 nt, Homo sapiens
caaaauauuucaguga

SEQ ID NO: 1884076 - RNA, 15 nt, Homo sapiens
gcucugccuccugcc

SEQ ID NO: 1884077 - RNA, 18 nt, Homo sapiens
agguaaauagguuaaaaa

SEQ ID NO: 1884078 - RNA, 11 nt, Homo sapiens
ucaugcacugu

SEQ ID NO: 1884079 - RNA, 14 nt, Homo sapiens
uacaauaaacaugu

SEQ ID NO: 1884080 - RNA, 14 nt, Homo sapiens
uaauggaaaccaag

SEQ ID NO: 1884081 - RNA, 23 nt, Homo sapiens
gguucccuuuccccauucaguga

SEQ ID NO: 1884082 - RNA, 22 nt, Homo sapiens
ugagaacauuaacaaaagcaau

SEQ ID NO: 1884083 - RNA, 20 nt, Homo sapiens
ggaagggucuuaacacuuac

SEQ ID NO: 1884084 - RNA, 16 nt, Homo sapiens
ugucucagucauugcu

SEQ ID NO: 1884085 - RNA, 14 nt, Homo sapiens
agaaauaggacaau

SEQ ID NO: 1884086 - RNA, 14 nt, Homo sapiens
gaaaauagagcaau

SEQ ID NO: 1884087 - RNA, 15 nt, Homo sapiens
auauaugugcaguau

SEQ ID NO: 1884088 - RNA, 18 nt, Homo sapiens
accugcaugugcugucac

SEQ ID NO: 1884089 - RNA, 17 nt, Homo sapiens
gguuguacuaugcuguu

SEQ ID NO: 1884090 - RNA, 19 nt, Homo sapiens
aaucuuuuaaaaauucaaa

SEQ ID NO: 1884091 - RNA, 19 nt, Homo sapiens
gucauugcacaaggcagaa

SEQ ID NO: 1884092 - RNA, 12 nt, Homo sapiens
gaggacacagau

SEQ ID NO: 1884093 - RNA, 14 nt, Homo sapiens
augcaaacugugcu

SEQ ID NO: 1884094 - RNA, 14 nt, Homo sapiens
auaaauaugagugc

SEQ ID NO: 1884095 - RNA, 16 nt, Homo sapiens
caguuuuuucaccucc

SEQ ID NO: 1884096 - RNA, 21 nt, Homo sapiens
agcaucacuugggauuaauau

SEQ ID NO: 1884097 - RNA, 18 nt, Homo sapiens
aucuugucccagccucag

SEQ ID NO: 1884098 - RNA, 19 nt, Homo sapiens
aguacugucuaucaaaggu

SEQ ID NO: 1884099 - RNA, 14 nt, Homo sapiens
guuucccuccuucc

SEQ ID NO: 1884100 - RNA, 21 nt, Homo sapiens
cuuagccaucagaugaggcuc

SEQ ID NO: 1884101 - RNA, 15 nt, Homo sapiens
gaagccaaagcagcu

SEQ ID NO: 1884102 - RNA, 17 nt, Homo sapiens
agaaaaucuaccaagaa

SEQ ID NO: 1884103 - RNA, 16 nt, Homo sapiens
ucaaaaauuauucuau

SEQ ID NO: 1884104 - RNA, 19 nt, Homo sapiens
augauaauauuguggugcc

SEQ ID NO: 1884105 - RNA, 16 nt, Homo sapiens
caaaauaaaaugaguu

SEQ ID NO: 1884106 - RNA, 16 nt, Homo sapiens
acuuuccaaucucagu

SEQ ID NO: 1884107 - RNA, 17 nt, Homo sapiens
ucugguguuuauaagca

SEQ ID NO: 1884108 - RNA, 12 nt, Homo sapiens
acagugcauauu

SEQ ID NO: 1884109 - RNA, 13 nt, Homo sapiens
acuaaaaagccau

SEQ ID NO: 1884110 - RNA, 22 nt, Homo sapiens
cagagacauacaccuaugucau

SEQ ID NO: 1884111 - RNA, 17 nt, Homo sapiens
acuuuaauuuccuugac

SEQ ID NO: 1884112 - RNA, 22 nt, Homo sapiens
ugaguccuguugaagacuuccu

SEQ ID NO: 1884113 - RNA, 22 nt, Homo sapiens
acacugaucugaacaucuggcc

SEQ ID NO: 1884114 - RNA, 17 nt, Homo sapiens
ggccccuucuccagcaa

SEQ ID NO: 1884115 - RNA, 18 nt, Homo sapiens
aaacucauccuucuucca

SEQ ID NO: 1884116 - RNA, 16 nt, Homo sapiens
ccucucaucacugaaa

SEQ ID NO: 1884117 - RNA, 22 nt, Homo sapiens
uugcucccucuguuagguccau

SEQ ID NO: 1884118 - RNA, 19 nt, Homo sapiens
acaacuuguauuuccaaac

SEQ ID NO: 1884119 - RNA, 16 nt, Homo sapiens
uaaaacugauguuacu

SEQ ID NO: 1884120 - RNA, 14 nt, Homo sapiens
ucuauuacacugga

SEQ ID NO: 1884121 - RNA, 20 nt, Homo sapiens
ggcuggccagccaccacuga

SEQ ID NO: 1884122 - RNA, 19 nt, Homo sapiens
aguaacaggaaaccacuua

SEQ ID NO: 1884123 - RNA, 17 nt, Homo sapiens
uauaagcagucuuucua

SEQ ID NO: 1884124 - RNA, 23 nt, Homo sapiens
gggaggcucuggagcccacugua

SEQ ID NO: 1884125 - RNA, 20 nt, Homo sapiens
auauguaauucuuuccauca

SEQ ID NO: 1884126 - RNA, 16 nt, Homo sapiens
cugugcuccuguggau

SEQ ID NO: 1884127 - RNA, 22 nt, Homo sapiens
ggcaaagaucucagcagccagc

SEQ ID NO: 1884128 - RNA, 14 nt, Homo sapiens
aguucaucaccauu

SEQ ID NO: 1884129 - RNA, 11 nt, Homo sapiens
ggugucauauu

SEQ ID NO: 1884130 - RNA, 14 nt, Homo sapiens
cggcggcagggugg

SEQ ID NO: 1884131 - RNA, 12 nt, Homo sapiens
gccuuacuguau

SEQ ID NO: 1884132 - RNA, 16 nt, Homo sapiens
ugucuaaagcagggaa

SEQ ID NO: 1884133 - RNA, 17 nt, Homo sapiens
aauggaucccaaucuga

SEQ ID NO: 1884134 - RNA, 22 nt, Homo sapiens
uuucuugccuuaaccagucucu

SEQ ID NO: 1884135 - RNA, 12 nt, Homo sapiens
gccucaugaaca

SEQ ID NO: 1884136 - RNA, 19 nt, Homo sapiens
cauuugaauuuuuuaguga

SEQ ID NO: 1884137 - RNA, 17 nt, Homo sapiens
ggacauuugaacauguu

SEQ ID NO: 1884138 - RNA, 18 nt, Homo sapiens
uuuaagugcguguguaga

SEQ ID NO: 1884139 - RNA, 20 nt, Homo sapiens
cacaguaaagaguacacuca

SEQ ID NO: 1884140 - RNA, 14 nt, Homo sapiens
aauucccugcuaaa

SEQ ID NO: 1884141 - RNA, 22 nt, Homo sapiens
cugugccaucaccauaaccucu

SEQ ID NO: 1884142 - RNA, 22 nt, Homo sapiens
acuuaagcccagugcacugaaa

SEQ ID NO: 1884143 - RNA, 18 nt, Homo sapiens
gacaugaagaaaaggaaa

SEQ ID NO: 1884144 - RNA, 18 nt, Homo sapiens
agccugggcgacagagca

SEQ ID NO: 1884145 - RNA, 19 nt, Homo sapiens
caguacucaggcagugcag

SEQ ID NO: 1884146 - RNA, 16 nt, Homo sapiens
cugauuccgcagcuca

SEQ ID NO: 1884147 - RNA, 24 nt, Homo sapiens
gacucugggaaugacaacaccugg

SEQ ID NO: 1884148 - RNA, 18 nt, Homo sapiens
gcuuuccugcacauucuc

SEQ ID NO: 1884149 - RNA, 18 nt, Homo sapiens
auguuccaaacccuccug

SEQ ID NO: 1884150 - RNA, 22 nt, Homo sapiens
auuauguuuccgaggcacuguu

SEQ ID NO: 1884151 - RNA, 18 nt, Homo sapiens
ucaccagcccugagccau

SEQ ID NO: 1884152 - RNA, 15 nt, Homo sapiens
acuuucuugcaugaa

SEQ ID NO: 1884153 - RNA, 18 nt, Homo sapiens
aguccauguggacugugc

SEQ ID NO: 1884154 - RNA, 14 nt, Homo sapiens
ugaagucaguucuc

SEQ ID NO: 1884155 - RNA, 18 nt, Homo sapiens
aucuggcccucgacacuc

SEQ ID NO: 1884156 - RNA, 12 nt, Homo sapiens
ccucaccucuca

SEQ ID NO: 1884157 - RNA, 19 nt, Homo sapiens
auuacgaucccccaagugu

SEQ ID NO: 1884158 - RNA, 18 nt, Homo sapiens
aacguaggcgucaaagag

SEQ ID NO: 1884159 - RNA, 20 nt, Homo sapiens
cugggcaagagaugggacaa

SEQ ID NO: 1884160 - RNA, 21 nt, Homo sapiens
ggugggccuuccaugggcaug

SEQ ID NO: 1884161 - RNA, 13 nt, Homo sapiens
gcuccaaacccuc

SEQ ID NO: 1884162 - RNA, 16 nt, Homo sapiens
aauagugucugaugaa

SEQ ID NO: 1884163 - RNA, 18 nt, Homo sapiens
gauggaaguugcagugag

SEQ ID NO: 1884164 - RNA, 16 nt, Homo sapiens
aacuagagacucugug

SEQ ID NO: 1884165 - RNA, 19 nt, Homo sapiens
gaaugagcacccauuccaa

SEQ ID NO: 1884166 - RNA, 16 nt, Homo sapiens
cucacaguguacucua

SEQ ID NO: 1884167 - RNA, 13 nt, Homo sapiens
ggcuuacuuccua

SEQ ID NO: 1884168 - RNA, 18 nt, Homo sapiens
uaacuuacaaacugguuu

SEQ ID NO: 1884169 - RNA, 18 nt, Homo sapiens
agggaugcauggagauag

SEQ ID NO: 1884170 - RNA, 22 nt, Homo sapiens
agucugcuacccucauuucuca

SEQ ID NO: 1884171 - RNA, 22 nt, Homo sapiens
gagaaaccuuauuguaccucuc

SEQ ID NO: 1884172 - RNA, 15 nt, Homo sapiens
caaccacuguagcaa

SEQ ID NO: 1884173 - RNA, 13 nt, Homo sapiens
gauuagcuuuguc

SEQ ID NO: 1884174 - RNA, 14 nt, Homo sapiens
uuugcagacaggca

SEQ ID NO: 1884175 - RNA, 14 nt, Homo sapiens
uaccuuuccccaaa

SEQ ID NO: 1884176 - RNA, 22 nt, Homo sapiens
ccagaugcccuuuggaaagcca

SEQ ID NO: 1884177 - RNA, 16 nt, Homo sapiens
auuuauaagugacuuu

SEQ ID NO: 1884178 - RNA, 22 nt, Homo sapiens
cccucucccagggaugcucuuu

SEQ ID NO: 1884179 - RNA, 14 nt, Homo sapiens
ccuucauugccaca

SEQ ID NO: 1884180 - RNA, 22 nt, Homo sapiens
gucauguaugugaaacaaugug

SEQ ID NO: 1884181 - RNA, 22 nt, Homo sapiens
ccgccuguccugccucucugcu

SEQ ID NO: 1884182 - RNA, 13 nt, Homo sapiens
aucccaaaccauu

SEQ ID NO: 1884183 - RNA, 21 nt, Homo sapiens
cacccugccaagacuccucag

SEQ ID NO: 1884184 - RNA, 17 nt, Homo sapiens
cucuuuuuucuugucau

SEQ ID NO: 1884185 - RNA, 14 nt, Homo sapiens
guaaucacucccau

SEQ ID NO: 1884186 - RNA, 18 nt, Homo sapiens
aaaccacuuuuugcagcu

SEQ ID NO: 1884187 - RNA, 19 nt, Homo sapiens
uggcacuuaagugcacuuu

SEQ ID NO: 1884188 - RNA, 15 nt, Homo sapiens
ugagauguguucaca

SEQ ID NO: 1884189 - RNA, 16 nt, Homo sapiens
ccagcgguccaaaguu

SEQ ID NO: 1884190 - RNA, 23 nt, Homo sapiens
agauccacguguggccuccgucc

SEQ ID NO: 1884191 - RNA, 14 nt, Homo sapiens
agaugauuucucaa

SEQ ID NO: 1884192 - RNA, 14 nt, Homo sapiens
ucagaccugagguu

SEQ ID NO: 1884193 - RNA, 15 nt, Homo sapiens
guuucuuccacaaca

SEQ ID NO: 1884194 - RNA, 20 nt, Homo sapiens
cugaguaauaaagauacaaa

SEQ ID NO: 1884195 - RNA, 22 nt, Homo sapiens
gaggcuucauaaucauggcucu

SEQ ID NO: 1884196 - RNA, 14 nt, Homo sapiens
ucuguauguuuacg

SEQ ID NO: 1884197 - RNA, 22 nt, Homo sapiens
uugucacauggaaucuacaugu

SEQ ID NO: 1884198 - RNA, 17 nt, Homo sapiens
aaaauauuccugugacu

SEQ ID NO: 1884199 - RNA, 20 nt, Homo sapiens
aucauuuccccaacagggca

SEQ ID NO: 1884200 - RNA, 15 nt, Homo sapiens
aacaauacuguucua

SEQ ID NO: 1884201 - RNA, 17 nt, Homo sapiens
gagacgggguuugccau

SEQ ID NO: 1884202 - RNA, 19 nt, Homo sapiens
accuagaaaggaacugcaa

SEQ ID NO: 1884203 - RNA, 12 nt, Homo sapiens
ggacacugugac

SEQ ID NO: 1884204 - RNA, 12 nt, Homo sapiens
uaauacuggaau

SEQ ID NO: 1884205 - RNA, 14 nt, Homo sapiens
cccuggagcucaag

SEQ ID NO: 1884206 - RNA, 21 nt, Homo sapiens
aauguuugaguuuucaaagau

SEQ ID NO: 1884207 - RNA, 14 nt, Homo sapiens
cagauacucgccaa

SEQ ID NO: 1884208 - RNA, 15 nt, Homo sapiens
ccaccauuucugggg

SEQ ID NO: 1884209 - RNA, 16 nt, Homo sapiens
ugacgcagccugagaa

SEQ ID NO: 1884210 - RNA, 18 nt, Homo sapiens
aucccugaaacauugcau

SEQ ID NO: 1884211 - RNA, 19 nt, Homo sapiens
cagugcuggccacacagca

SEQ ID NO: 1884212 - RNA, 20 nt, Homo sapiens
agggcaggagcuuggcagag

SEQ ID NO: 1884213 - RNA, 17 nt, Homo sapiens
gugaauggucucuguca

SEQ ID NO: 1884214 - RNA, 15 nt, Homo sapiens
cuugccuaggcgauu

SEQ ID NO: 1884215 - RNA, 15 nt, Homo sapiens
uuuacacaaagggaa

SEQ ID NO: 1884216 - RNA, 17 nt, Homo sapiens
ggagcguguacuacccc

SEQ ID NO: 1884217 - RNA, 18 nt, Homo sapiens
uauggcacccaugcaccu

SEQ ID NO: 1884218 - RNA, 14 nt, Homo sapiens
aaguagaauccuaa

SEQ ID NO: 1884219 - RNA, 23 nt, Homo sapiens
acuuagcaguaaauuauagcuca

SEQ ID NO: 1884220 - RNA, 21 nt, Homo sapiens
guauuuucaugaaaauaccau

SEQ ID NO: 1884221 - RNA, 20 nt, Homo sapiens
gaaacuacugccuuuagaaa

SEQ ID NO: 1884222 - RNA, 20 nt, Homo sapiens
aguccguuaacacuacuuaa

SEQ ID NO: 1884223 - RNA, 13 nt, Homo sapiens
ucugcauauucua

SEQ ID NO: 1884224 - RNA, 14 nt, Homo sapiens
ucucagggugcaga

SEQ ID NO: 1884225 - RNA, 17 nt, Homo sapiens
caagucuguuuacugca

SEQ ID NO: 1884226 - RNA, 15 nt, Homo sapiens
uaguccuuccuggca

SEQ ID NO: 1884227 - RNA, 20 nt, Homo sapiens
gucccagaacacggcagcug

SEQ ID NO: 1884228 - RNA, 16 nt, Homo sapiens
cugcaagcuucuugcu

SEQ ID NO: 1884229 - RNA, 17 nt, Homo sapiens
caccccuccucgaaguc

SEQ ID NO: 1884230 - RNA, 13 nt, Homo sapiens
gagccuuugccuu

SEQ ID NO: 1884231 - RNA, 21 nt, Homo sapiens
ugugggaaaucccagggcaaa

SEQ ID NO: 1884232 - RNA, 19 nt, Homo sapiens
gaaucaaaccugaccaagc

SEQ ID NO: 1884233 - RNA, 19 nt, Homo sapiens
aauagguucaaaagcaauc

SEQ ID NO: 1884234 - RNA, 22 nt, Homo sapiens
ggcuuugcuacccauuuacaaa

SEQ ID NO: 1884235 - RNA, 22 nt, Homo sapiens
cuguacaauaaguuacuugaaa

SEQ ID NO: 1884236 - RNA, 18 nt, Homo sapiens
cuuacaaacaugugguua

SEQ ID NO: 1884237 - RNA, 15 nt, Homo sapiens
aauugggcaggugaa

SEQ ID NO: 1884238 - RNA, 23 nt, Homo sapiens
uugggguagguagauaccaaaug

SEQ ID NO: 1884239 - RNA, 21 nt, Homo sapiens
aaaauacaaacauucuaauua

SEQ ID NO: 1884240 - RNA, 21 nt, Homo sapiens
guuacagcuaugcacuguaaa

SEQ ID NO: 1884241 - RNA, 22 nt, Homo sapiens
gcaaccuuuuucccucuuccca

SEQ ID NO: 1884242 - RNA, 11 nt, Homo sapiens
gggcacugccu

SEQ ID NO: 1884243 - RNA, 14 nt, Homo sapiens
ucuuaggcaaucac

SEQ ID NO: 1884244 - RNA, 22 nt, Homo sapiens
cccaacuauaaaacuaggugcu

SEQ ID NO: 1884245 - RNA, 24 nt, Homo sapiens
uauuauugguuguuguauugauca

SEQ ID NO: 1884246 - RNA, 13 nt, Homo sapiens
agucugcauugcu

SEQ ID NO: 1884247 - RNA, 16 nt, Homo sapiens
cuuugaaauuauguaa

SEQ ID NO: 1884248 - RNA, 20 nt, Homo sapiens
uagugacagcucugccuguu

SEQ ID NO: 1884249 - RNA, 23 nt, Homo sapiens
aauguaaguugaccuucucuuag

SEQ ID NO: 1884250 - RNA, 23 nt, Homo sapiens
accaaaaauaaaacuuuucaugu

SEQ ID NO: 1884251 - RNA, 13 nt, Homo sapiens
uguccagccuuaa

SEQ ID NO: 1884252 - RNA, 12 nt, Homo sapiens
acuguugccagg

SEQ ID NO: 1884253 - RNA, 15 nt, Homo sapiens
uuaacucucaagcua

SEQ ID NO: 1884254 - RNA, 20 nt, Homo sapiens
uucuauaauuuugccuuuaa

SEQ ID NO: 1884255 - RNA, 15 nt, Homo sapiens
ucuccuaacauauau

SEQ ID NO: 1884256 - RNA, 14 nt, Homo sapiens
ggccaggcacugug

SEQ ID NO: 1884257 - RNA, 17 nt, Homo sapiens
aaacuaaacuacagaaa

SEQ ID NO: 1884258 - RNA, 17 nt, Homo sapiens
uggaguguaguggcaca

SEQ ID NO: 1884259 - RNA, 16 nt, Homo sapiens
aaaauacaagaaccaa

SEQ ID NO: 1884260 - RNA, 16 nt, Homo sapiens
acucuccaauguucua

SEQ ID NO: 1884261 - RNA, 16 nt, Homo sapiens
aauccuaggugcuacu

SEQ ID NO: 1884262 - RNA, 24 nt, Homo sapiens
aagugcaauuuccccucugugucc

SEQ ID NO: 1884263 - RNA, 15 nt, Homo sapiens
gaaugaccaagcuca

SEQ ID NO: 1884264 - RNA, 18 nt, Homo sapiens
agaacagagggaacuuug

SEQ ID NO: 1884265 - RNA, 21 nt, Homo sapiens
ccaaaaugacuuugaacugaa

SEQ ID NO: 1884266 - RNA, 18 nt, Homo sapiens
gauuuuacacaccaccag

SEQ ID NO: 1884267 - RNA, 14 nt, Homo sapiens
gauccucuggacac

SEQ ID NO: 1884268 - RNA, 22 nt, Homo sapiens
auaguggacaguaaccuuucaa

SEQ ID NO: 1884269 - RNA, 19 nt, Homo sapiens
ggcaccugguaugugccag

SEQ ID NO: 1884270 - RNA, 18 nt, Homo sapiens
cuuccaucaucacuguaa

SEQ ID NO: 1884271 - RNA, 19 nt, Homo sapiens
ggcaucuccuguccugggc

SEQ ID NO: 1884272 - RNA, 14 nt, Homo sapiens
gcuuuccucuguga

SEQ ID NO: 1884273 - RNA, 18 nt, Homo sapiens
uugugaaagacauguaac

SEQ ID NO: 1884274 - RNA, 19 nt, Homo sapiens
uaugcuuauauuguucacu

SEQ ID NO: 1884275 - RNA, 17 nt, Homo sapiens
ucuucccguaaaaacua

SEQ ID NO: 1884276 - RNA, 22 nt, Homo sapiens
uauuauugguuguuguauugau

SEQ ID NO: 1884277 - RNA, 20 nt, Homo sapiens
cauugaccaagaacugcaug

SEQ ID NO: 1884278 - RNA, 13 nt, Homo sapiens
uggauuuugucaa

SEQ ID NO: 1884279 - RNA, 21 nt, Homo sapiens
gauuacaggcgugagccaccg

SEQ ID NO: 1884280 - RNA, 17 nt, Homo sapiens
gaagugagagauguugc

SEQ ID NO: 1884281 - RNA, 13 nt, Homo sapiens
ugcagacacucaa

SEQ ID NO: 1884282 - RNA, 14 nt, Homo sapiens
caauaccagugaca

SEQ ID NO: 1884283 - RNA, 19 nt, Homo sapiens
cuaacaagucaccaaaaga

SEQ ID NO: 1884284 - RNA, 16 nt, Homo sapiens
ugcaggaccucaggug

SEQ ID NO: 1884285 - RNA, 14 nt, Homo sapiens
cgagauugcacugc

SEQ ID NO: 1884286 - RNA, 11 nt, Homo sapiens
caaauguguaa

SEQ ID NO: 1884287 - RNA, 15 nt, Homo sapiens
uccugucuggcauuu

SEQ ID NO: 1884288 - RNA, 15 nt, Homo sapiens
caauaaaucuuucaa

SEQ ID NO: 1884289 - RNA, 17 nt, Homo sapiens
ugcucaggcucagaggg

SEQ ID NO: 1884290 - RNA, 20 nt, Homo sapiens
ccaguauaaaauuacagugg

SEQ ID NO: 1884291 - RNA, 14 nt, Homo sapiens
cuuccgccgucuca

SEQ ID NO: 1884292 - RNA, 16 nt, Homo sapiens
ccaccuuggaccucag

SEQ ID NO: 1884293 - RNA, 18 nt, Homo sapiens
aaacacugggcucugagg

SEQ ID NO: 1884294 - RNA, 21 nt, Homo sapiens
cuaggcuggaggacaguggca

SEQ ID NO: 1884295 - RNA, 18 nt, Homo sapiens
uuuugcaauaguuaccuc

SEQ ID NO: 1884296 - RNA, 18 nt, Homo sapiens
aaacuacccucuggagau

SEQ ID NO: 1884297 - RNA, 17 nt, Homo sapiens
cugcugaagacuugccc

SEQ ID NO: 1884298 - RNA, 16 nt, Homo sapiens
aucaaagaaauucaga

SEQ ID NO: 1884299 - RNA, 18 nt, Homo sapiens
aaccauaugauacuauca

SEQ ID NO: 1884300 - RNA, 10 nt, Homo sapiens
uguacauuuc

SEQ ID NO: 1884301 - RNA, 22 nt, Homo sapiens
ugcacaguacuguuucaaauca

SEQ ID NO: 1884302 - RNA, 14 nt, Homo sapiens
gucuuacauugcca

SEQ ID NO: 1884303 - RNA, 13 nt, Homo sapiens
aaagaagcucucc

SEQ ID NO: 1884304 - RNA, 12 nt, Homo sapiens
auuaauuacuua

SEQ ID NO: 1884305 - RNA, 12 nt, Homo sapiens
auaaauuacuaa

SEQ ID NO: 1884306 - RNA, 16 nt, Homo sapiens
aaaaggacauuuucau

SEQ ID NO: 1884307 - RNA, 12 nt, Homo sapiens
aguguugcuugg

SEQ ID NO: 1884308 - RNA, 13 nt, Homo sapiens
auggcaaguucug

SEQ ID NO: 1884309 - RNA, 13 nt, Homo sapiens
gcuaauuacacac

SEQ ID NO: 1884310 - RNA, 20 nt, Homo sapiens
guugauuguauaaaugcaau

SEQ ID NO: 1884311 - RNA, 17 nt, Homo sapiens
agaguuuagcuggaaaa

SEQ ID NO: 1884312 - RNA, 22 nt, Homo sapiens
agaugaaccugcagcaagcagc

SEQ ID NO: 1884313 - RNA, 18 nt, Homo sapiens
caggggggagaaguucuu

SEQ ID NO: 1884314 - RNA, 17 nt, Homo sapiens
gaagugcauccaaaggu

SEQ ID NO: 1884315 - RNA, 16 nt, Homo sapiens
ugcccgagcuggugca

SEQ ID NO: 1884316 - RNA, 18 nt, Homo sapiens
gagccagggcugucuucg

SEQ ID NO: 1884317 - RNA, 14 nt, Homo sapiens
aagcuggucuuuga

SEQ ID NO: 1884318 - RNA, 17 nt, Homo sapiens
acuuaucagaugcucau

SEQ ID NO: 1884319 - RNA, 23 nt, Homo sapiens
cagcaacuugaacuucaccugca

SEQ ID NO: 1884320 - RNA, 23 nt, Homo sapiens
cuguauguguucgucaguguuca

SEQ ID NO: 1884321 - RNA, 18 nt, Homo sapiens
cucucccgccagacuguu

SEQ ID NO: 1884322 - RNA, 23 nt, Homo sapiens
aaccucauuuuaguugccuaagc

SEQ ID NO: 1884323 - RNA, 13 nt, Homo sapiens
aaaguucuaguga

SEQ ID NO: 1884324 - RNA, 13 nt, Homo sapiens
caagggagaguga

SEQ ID NO: 1884325 - RNA, 20 nt, Homo sapiens
cucugucccucuccuugccc

SEQ ID NO: 1884326 - RNA, 18 nt, Homo sapiens
cugccuuacccugguaau

SEQ ID NO: 1884327 - RNA, 21 nt, Homo sapiens
cugcugacaggauguggcacu

SEQ ID NO: 1884328 - RNA, 13 nt, Homo sapiens
gaauggucuuucu

SEQ ID NO: 1884329 - RNA, 14 nt, Homo sapiens
caggccagcugccu

SEQ ID NO: 1884330 - RNA, 14 nt, Homo sapiens
gucguaagucacug

SEQ ID NO: 1884331 - RNA, 17 nt, Homo sapiens
uucauccccuuacccuu

SEQ ID NO: 1884332 - RNA, 21 nt, Homo sapiens
agccacuuaccaauugcuaag

SEQ ID NO: 1884333 - RNA, 19 nt, Homo sapiens
ucugaauccaagacagcca

SEQ ID NO: 1884334 - RNA, 18 nt, Homo sapiens
uacaaacauucuaauuaa

SEQ ID NO: 1884335 - RNA, 22 nt, Homo sapiens
acucaccauuuaaucauuucca

SEQ ID NO: 1884336 - RNA, 17 nt, Homo sapiens
uccugauguuuuuccca

SEQ ID NO: 1884337 - RNA, 18 nt, Homo sapiens
gcuggcccugcagguggu

SEQ ID NO: 1884338 - RNA, 14 nt, Homo sapiens
uaccaguacuugag

SEQ ID NO: 1884339 - RNA, 11 nt, Homo sapiens
ggcagcauuuu

SEQ ID NO: 1884340 - RNA, 14 nt, Homo sapiens
uccagugggacccc

SEQ ID NO: 1884341 - RNA, 18 nt, Homo sapiens
ccccacuaggcacugugg

SEQ ID NO: 1884342 - RNA, 21 nt, Homo sapiens
ggauccauccugcuagcaccu

SEQ ID NO: 1884343 - RNA, 14 nt, Homo sapiens
aagguuaaauuuca

SEQ ID NO: 1884344 - RNA, 18 nt, Homo sapiens
gcugaacacauuugccca

SEQ ID NO: 1884345 - RNA, 15 nt, Homo sapiens
agccaauggugcaca

SEQ ID NO: 1884346 - RNA, 16 nt, Homo sapiens
uuggcuauaaccucca

SEQ ID NO: 1884347 - RNA, 12 nt, Homo sapiens
aggucacugcua

SEQ ID NO: 1884348 - RNA, 19 nt, Homo sapiens
ugcugcuuuugagccucag

SEQ ID NO: 1884349 - RNA, 19 nt, Homo sapiens
ugacuuagcgucaagacau

SEQ ID NO: 1884350 - RNA, 15 nt, Homo sapiens
aaaauuagacuguga

SEQ ID NO: 1884351 - RNA, 16 nt, Homo sapiens
acuguacaaaauaagu

SEQ ID NO: 1884352 - RNA, 15 nt, Homo sapiens
gggugaggcugccgu

SEQ ID NO: 1884353 - RNA, 23 nt, Homo sapiens
aggggagugugaaggucuuggcc

SEQ ID NO: 1884354 - RNA, 14 nt, Homo sapiens
uucuaaccaaauac

SEQ ID NO: 1884355 - RNA, 20 nt, Homo sapiens
ccuucuucuuagcaccacaa

SEQ ID NO: 1884356 - RNA, 22 nt, Homo sapiens
uucugggaagggagaguucuuu

SEQ ID NO: 1884357 - RNA, 23 nt, Homo sapiens
uaaacauuccuguugaugggaaa

SEQ ID NO: 1884358 - RNA, 20 nt, Homo sapiens
ggaggcagagguugcaauga

SEQ ID NO: 1884359 - RNA, 20 nt, Homo sapiens
guuuuaagaaacuagcagau

SEQ ID NO: 1884360 - RNA, 21 nt, Homo sapiens
cuggcuuacacuggcaauggu

SEQ ID NO: 1884361 - RNA, 16 nt, Homo sapiens
gccaaagauaaucucu

SEQ ID NO: 1884362 - RNA, 13 nt, Homo sapiens
uagggcagaguau

SEQ ID NO: 1884363 - RNA, 22 nt, Homo sapiens
ucccuccccagaaacagugugc

SEQ ID NO: 1884364 - RNA, 20 nt, Homo sapiens
acaccauucuccugccucac

SEQ ID NO: 1884365 - RNA, 19 nt, Homo sapiens
aaaugcucuaacuggacau

SEQ ID NO: 1884366 - RNA, 21 nt, Homo sapiens
uuagaaacuaagagaaugaua

SEQ ID NO: 1884367 - RNA, 17 nt, Homo sapiens
cucuuuaacaugguuca

SEQ ID NO: 1884368 - RNA, 17 nt, Homo sapiens
uugggaagggcagggaa

SEQ ID NO: 1884369 - RNA, 14 nt, Homo sapiens
auguuuuaacucuu

SEQ ID NO: 1884370 - RNA, 23 nt, Homo sapiens
ucuggcccacccccaacaggaau

SEQ ID NO: 1884371 - RNA, 15 nt, Homo sapiens
caugcauacuuuauu

SEQ ID NO: 1884372 - RNA, 13 nt, Homo sapiens
uaugcaaucugag

SEQ ID NO: 1884373 - RNA, 23 nt, Homo sapiens
ggcaaggaaacucgaauaaagga

SEQ ID NO: 1884374 - RNA, 16 nt, Homo sapiens
ugguuauucauuauuc

SEQ ID NO: 1884375 - RNA, 13 nt, Homo sapiens
cuuuaucugugac

SEQ ID NO: 1884376 - RNA, 12 nt, Homo sapiens
gggagaaaaaga

SEQ ID NO: 1884377 - RNA, 24 nt, Homo sapiens
cagccuccaccuugagcacuauuc

SEQ ID NO: 1884378 - RNA, 18 nt, Homo sapiens
cauucuuucugcuauauu

SEQ ID NO: 1884379 - RNA, 12 nt, Homo sapiens
acucaguauuau

SEQ ID NO: 1884380 - RNA, 12 nt, Homo sapiens
acacaguauuuu

SEQ ID NO: 1884381 - RNA, 15 nt, Homo sapiens
cuuucuuucuuagaa

SEQ ID NO: 1884382 - RNA, 15 nt, Homo sapiens
accugaauaccacuu

SEQ ID NO: 1884383 - RNA, 18 nt, Homo sapiens
auggugcuaaaccauuca

SEQ ID NO: 1884384 - RNA, 23 nt, Homo sapiens
cccacaggagcguguacuacccc

SEQ ID NO: 1884385 - RNA, 12 nt, Homo sapiens
gaaauuuugccu

SEQ ID NO: 1884386 - RNA, 18 nt, Homo sapiens
ccugaagcaugaaacugu

SEQ ID NO: 1884387 - RNA, 15 nt, Homo sapiens
uuccuggacaguuuu

SEQ ID NO: 1884388 - RNA, 15 nt, Homo sapiens
ccuagauaugaagaa

SEQ ID NO: 1884389 - RNA, 12 nt, Homo sapiens
ccuuguuucaaa

SEQ ID NO: 1884390 - RNA, 20 nt, Homo sapiens
auaaaauaaaguacauuauu

SEQ ID NO: 1884391 - RNA, 13 nt, Homo sapiens
aaaagaacuguau

SEQ ID NO: 1884392 - RNA, 18 nt, Homo sapiens
cccugaguuccuagccac

SEQ ID NO: 1884393 - RNA, 17 nt, Homo sapiens
gucaauccugucauaua

SEQ ID NO: 1884394 - RNA, 15 nt, Homo sapiens
acccuugagcugugu

SEQ ID NO: 1884395 - RNA, 17 nt, Homo sapiens
gugaucucgacuccccc

SEQ ID NO: 1884396 - RNA, 19 nt, Homo sapiens
auagcuuucuuucccuuac

SEQ ID NO: 1884397 - RNA, 20 nt, Homo sapiens
gguuaggauuuaacagucau

SEQ ID NO: 1884398 - RNA, 13 nt, Homo sapiens
acaggcacuuuga

SEQ ID NO: 1884399 - RNA, 15 nt, Homo sapiens
uacauaguuguauau

SEQ ID NO: 1884400 - RNA, 17 nt, Homo sapiens
auaaauuauacacuaug

SEQ ID NO: 1884401 - RNA, 17 nt, Homo sapiens
ugugaauauuagauugc

SEQ ID NO: 1884402 - RNA, 11 nt, Homo sapiens
cauucuaugau

SEQ ID NO: 1884403 - RNA, 20 nt, Homo sapiens
uaaaagaugaaggcuguauc

SEQ ID NO: 1884404 - RNA, 19 nt, Homo sapiens
cagauaaaugacaagcaaa

SEQ ID NO: 1884405 - RNA, 16 nt, Homo sapiens
aaccacacacaguaaa

SEQ ID NO: 1884406 - RNA, 20 nt, Homo sapiens
agggggcgcucaggacccag

SEQ ID NO: 1884407 - RNA, 17 nt, Homo sapiens
aagcacuguuucucuca

SEQ ID NO: 1884408 - RNA, 17 nt, Homo sapiens
gaggacugguugucucu

SEQ ID NO: 1884409 - RNA, 23 nt, Homo sapiens
acacccgacugugcacacuucca

SEQ ID NO: 1884410 - RNA, 21 nt, Homo sapiens
guuuauuuuauuuucuucauu

SEQ ID NO: 1884411 - RNA, 20 nt, Homo sapiens
acugagcuccccagaucucc

SEQ ID NO: 1884412 - RNA, 18 nt, Homo sapiens
auggccccaguccaugcu

SEQ ID NO: 1884413 - RNA, 13 nt, Homo sapiens
ggaacacuggaac

SEQ ID NO: 1884414 - RNA, 13 nt, Homo sapiens
gcaaaacugcaaa

SEQ ID NO: 1884415 - RNA, 13 nt, Homo sapiens
uugaaacuuugaa

SEQ ID NO: 1884416 - RNA, 13 nt, Homo sapiens
gggaaacugggaa

SEQ ID NO: 1884417 - RNA, 13 nt, Homo sapiens
uguauacuuguau

SEQ ID NO: 1884418 - RNA, 19 nt, Homo sapiens
aaauggcuuguucagucac

SEQ ID NO: 1884419 - RNA, 15 nt, Homo sapiens
uccugggaucacuga

SEQ ID NO: 1884420 - RNA, 18 nt, Homo sapiens
aaugcauuugauggccac

SEQ ID NO: 1884421 - RNA, 24 nt, Homo sapiens
cagcuugagaaggucacuacugca

SEQ ID NO: 1884422 - RNA, 16 nt, Homo sapiens
uaaaguuaauucauua

SEQ ID NO: 1884423 - RNA, 13 nt, Homo sapiens
uccuagcuguuag

SEQ ID NO: 1884424 - RNA, 16 nt, Homo sapiens
aagucaugguccuggc

SEQ ID NO: 1884425 - RNA, 21 nt, Homo sapiens
uaaagagaccuaccucagguu

SEQ ID NO: 1884426 - RNA, 17 nt, Homo sapiens
caggggcuccagcaccu

SEQ ID NO: 1884427 - RNA, 22 nt, Homo sapiens
gaacgcuucugcuuaaucugag

SEQ ID NO: 1884428 - RNA, 23 nt, Homo sapiens
ugaggggcacauucuuaucucca

SEQ ID NO: 1884429 - RNA, 18 nt, Homo sapiens
aggaacaggacugcaaaa

SEQ ID NO: 1884430 - RNA, 15 nt, Homo sapiens
uucauacacaacgua

SEQ ID NO: 1884431 - RNA, 14 nt, Homo sapiens
ugaaacgccuugca

SEQ ID NO: 1884432 - RNA, 15 nt, Homo sapiens
gaaaagcaguuugca

SEQ ID NO: 1884433 - RNA, 13 nt, Homo sapiens
accacgacuggcc

SEQ ID NO: 1884434 - RNA, 16 nt, Homo sapiens
aguuacacagaaaugc

SEQ ID NO: 1884435 - RNA, 14 nt, Homo sapiens
acacaaauucuaaa

SEQ ID NO: 1884436 - RNA, 14 nt, Homo sapiens
aauaaaauuaacaa

SEQ ID NO: 1884437 - RNA, 17 nt, Homo sapiens
cccccgucuucucucca

SEQ ID NO: 1884438 - RNA, 14 nt, Homo sapiens
gagacagccucagc

SEQ ID NO: 1884439 - RNA, 23 nt, Homo sapiens
aaaagcagucgaccgcacuuaug

SEQ ID NO: 1884440 - RNA, 12 nt, Homo sapiens
agaucacagugu

SEQ ID NO: 1884441 - RNA, 22 nt, Homo sapiens
auuuagaaaauagagcuuuuaa

SEQ ID NO: 1884442 - RNA, 22 nt, Homo sapiens
uuagaccccauacaaguuuaua

SEQ ID NO: 1884443 - RNA, 19 nt, Homo sapiens
acugugugucucaugguau

SEQ ID NO: 1884444 - RNA, 11 nt, Homo sapiens
aaaaaauuacu

SEQ ID NO: 1884445 - RNA, 12 nt, Homo sapiens
ucuuugccaagu

SEQ ID NO: 1884446 - RNA, 17 nt, Homo sapiens
augucugccacagagag

SEQ ID NO: 1884447 - RNA, 19 nt, Homo sapiens
auuguuguuaauaggucuu

SEQ ID NO: 1884448 - RNA, 12 nt, Homo sapiens
uaccucugagaa

SEQ ID NO: 1884449 - RNA, 14 nt, Homo sapiens
uaauuaaacuauga

SEQ ID NO: 1884450 - RNA, 20 nt, Homo sapiens
agacuugggaaacuauucau

SEQ ID NO: 1884451 - RNA, 16 nt, Homo sapiens
uuaccacuugcacuau

SEQ ID NO: 1884452 - RNA, 18 nt, Homo sapiens
cagacguggugcuucuca

SEQ ID NO: 1884453 - RNA, 20 nt, Homo sapiens
cacuguacaagguaccccuu

SEQ ID NO: 1884454 - RNA, 13 nt, Homo sapiens
caccauuccuuua

SEQ ID NO: 1884455 - RNA, 20 nt, Homo sapiens
ucagagcuauguucccucca

SEQ ID NO: 1884456 - RNA, 13 nt, Homo sapiens
cucaaacuaucug

SEQ ID NO: 1884457 - RNA, 13 nt, Homo sapiens
aaguuuugauacu

SEQ ID NO: 1884458 - RNA, 22 nt, Homo sapiens
ucccccuguagacuagugccgu

SEQ ID NO: 1884459 - RNA, 22 nt, Homo sapiens
gacugccuucuccaucaugccc

SEQ ID NO: 1884460 - RNA, 15 nt, Homo sapiens
uaaagaugcagguuu

SEQ ID NO: 1884461 - RNA, 20 nt, Homo sapiens
ugcuuugaggcucaccagaa

SEQ ID NO: 1884462 - RNA, 19 nt, Homo sapiens
acacguguuguuccaccuu

SEQ ID NO: 1884463 - RNA, 21 nt, Homo sapiens
gaguuaauauauagaagggua

SEQ ID NO: 1884464 - RNA, 11 nt, Homo sapiens
gaggauaucau

SEQ ID NO: 1884465 - RNA, 16 nt, Homo sapiens
uccuggacaaccugga

SEQ ID NO: 1884466 - RNA, 20 nt, Homo sapiens
aauaaggcuccuucaugugg

SEQ ID NO: 1884467 - RNA, 16 nt, Homo sapiens
uguuauugcacuauga

SEQ ID NO: 1884468 - RNA, 22 nt, Homo sapiens
cugcaggcaaagugagacugac

SEQ ID NO: 1884469 - RNA, 22 nt, Homo sapiens
auuuaucaagcauuuaccaugu

SEQ ID NO: 1884470 - RNA, 16 nt, Homo sapiens
gccaugauguggagug

SEQ ID NO: 1884471 - RNA, 11 nt, Homo sapiens
ugcacuuuuaa

SEQ ID NO: 1884472 - RNA, 11 nt, Homo sapiens
ggcacuuugaa

SEQ ID NO: 1884473 - RNA, 21 nt, Homo sapiens
agacauuauuuuguauggaau

SEQ ID NO: 1884474 - RNA, 18 nt, Homo sapiens
ccuuagcccaucuuucaa

SEQ ID NO: 1884475 - RNA, 22 nt, Homo sapiens
auuuaaccccacacagcacuuc

SEQ ID NO: 1884476 - RNA, 14 nt, Homo sapiens
ggcagcgccaagug

SEQ ID NO: 1884477 - RNA, 15 nt, Homo sapiens
ccauuuucuuuacag

SEQ ID NO: 1884478 - RNA, 17 nt, Homo sapiens
cuuuauuuguaaaccau

SEQ ID NO: 1884479 - RNA, 20 nt, Homo sapiens
uuuugagucauugacuucau

SEQ ID NO: 1884480 - RNA, 18 nt, Homo sapiens
ucugggggauaagggagu

SEQ ID NO: 1884481 - RNA, 23 nt, Homo sapiens
cacaucacgaaggaaaacugcca

SEQ ID NO: 1884482 - RNA, 13 nt, Homo sapiens
aaaucccaagugu

SEQ ID NO: 1884483 - RNA, 14 nt, Homo sapiens
acuacacuaauaaa

SEQ ID NO: 1884484 - RNA, 22 nt, Homo sapiens
cucuguguuucuggggacacca

SEQ ID NO: 1884485 - RNA, 19 nt, Homo sapiens
cauuacuuugauaucugau

SEQ ID NO: 1884486 - RNA, 19 nt, Homo sapiens
aggucccagcgagccacag

SEQ ID NO: 1884487 - RNA, 14 nt, Homo sapiens
uugcaguaucagag

SEQ ID NO: 1884488 - RNA, 15 nt, Homo sapiens
caggggaucauguua

SEQ ID NO: 1884489 - RNA, 20 nt, Homo sapiens
aguauuauuguugcauuaaa

SEQ ID NO: 1884490 - RNA, 20 nt, Homo sapiens
cagcauugccauaccauucc

SEQ ID NO: 1884491 - RNA, 15 nt, Homo sapiens
uaagaagacaugaca

SEQ ID NO: 1884492 - RNA, 21 nt, Homo sapiens
ccccuguuguguggacuuuga

SEQ ID NO: 1884493 - RNA, 16 nt, Homo sapiens
uguguuuaacauucac

SEQ ID NO: 1884494 - RNA, 13 nt, Homo sapiens
cccagcuugccaa

SEQ ID NO: 1884495 - RNA, 12 nt, Homo sapiens
accauuugcacu

SEQ ID NO: 1884496 - RNA, 17 nt, Homo sapiens
aacuuguguacugauaa

SEQ ID NO: 1884497 - RNA, 12 nt, Homo sapiens
acuccucagacg

SEQ ID NO: 1884498 - RNA, 12 nt, Homo sapiens
gacugaacucca

SEQ ID NO: 1884499 - RNA, 20 nt, Homo sapiens
auuccugcagucagugcuaa

SEQ ID NO: 1884500 - RNA, 14 nt, Homo sapiens
cuaauacuaauuca

SEQ ID NO: 1884501 - RNA, 22 nt, Homo sapiens
aacauuaggaauuguuuauaca

SEQ ID NO: 1884502 - RNA, 22 nt, Homo sapiens
uuaaaaguuaaauuagcuuucu

SEQ ID NO: 1884503 - RNA, 19 nt, Homo sapiens
cgccaccuccccacuccag

SEQ ID NO: 1884504 - RNA, 20 nt, Homo sapiens
aauuuccaaaauaaucuaua

SEQ ID NO: 1884505 - RNA, 13 nt, Homo sapiens
acagcacagccaa

SEQ ID NO: 1884506 - RNA, 19 nt, Homo sapiens
uacuguuacugugucagga

SEQ ID NO: 1884507 - RNA, 15 nt, Homo sapiens
aaacaacaccuccuc

SEQ ID NO: 1884508 - RNA, 20 nt, Homo sapiens
gcuuauaaauggcaccacau

SEQ ID NO: 1884509 - RNA, 13 nt, Homo sapiens
ugaggacuuuggu

SEQ ID NO: 1884510 - RNA, 13 nt, Homo sapiens
ugaauacuuugag

SEQ ID NO: 1884511 - RNA, 19 nt, Homo sapiens
uggaaguaguaauugcaag

SEQ ID NO: 1884512 - RNA, 12 nt, Homo sapiens
ggcccacaggaa

SEQ ID NO: 1884513 - RNA, 18 nt, Homo sapiens
aucuagcauguaaggccu

SEQ ID NO: 1884514 - RNA, 21 nt, Homo sapiens
caggcaucuucccuucacuca

SEQ ID NO: 1884515 - RNA, 15 nt, Homo sapiens
gcuggcacuauccag

SEQ ID NO: 1884516 - RNA, 21 nt, Homo sapiens
aacccacaguucuccauuuca

SEQ ID NO: 1884517 - RNA, 14 nt, Homo sapiens
aucuucaguuuaau

SEQ ID NO: 1884518 - RNA, 22 nt, Homo sapiens
aggaaacuugcauacagagaca

SEQ ID NO: 1884519 - RNA, 22 nt, Homo sapiens
uagucauucuuacaauugcacu

SEQ ID NO: 1884520 - RNA, 17 nt, Homo sapiens
agcauuagucacuuuga

SEQ ID NO: 1884521 - RNA, 17 nt, Homo sapiens
cucugcuggauucuaaa

SEQ ID NO: 1884522 - RNA, 15 nt, Homo sapiens
auuauucaacagaga

SEQ ID NO: 1884523 - RNA, 18 nt, Homo sapiens
auuuaaaagcaucucagc

SEQ ID NO: 1884524 - RNA, 14 nt, Homo sapiens
ggauacugcugcgu

SEQ ID NO: 1884525 - RNA, 15 nt, Homo sapiens
agacuccugugcaac

SEQ ID NO: 1884526 - RNA, 22 nt, Homo sapiens
acccggaucauucacugugaua

SEQ ID NO: 1884527 - RNA, 18 nt, Homo sapiens
gcgcacuaccacacccag

SEQ ID NO: 1884528 - RNA, 23 nt, Homo sapiens
aaccagccagcgucccuugguga

SEQ ID NO: 1884529 - RNA, 16 nt, Homo sapiens
agugauaagucauuca

SEQ ID NO: 1884530 - RNA, 20 nt, Homo sapiens
uacccuguccuuugcaauug

SEQ ID NO: 1884531 - RNA, 18 nt, Homo sapiens
aauugcaugcugcuuuaa

SEQ ID NO: 1884532 - RNA, 22 nt, Homo sapiens
aauucuaaaauacaaacccaug

SEQ ID NO: 1884533 - RNA, 19 nt, Homo sapiens
ucucuugucauucauccag

SEQ ID NO: 1884534 - RNA, 16 nt, Homo sapiens
gaacaauucacaguau

SEQ ID NO: 1884535 - RNA, 14 nt, Homo sapiens
guuuaugagccaga

SEQ ID NO: 1884536 - RNA, 14 nt, Homo sapiens
aucaugcccugccu

SEQ ID NO: 1884537 - RNA, 21 nt, Homo sapiens
aucucuucuuauacagauaaa

SEQ ID NO: 1884538 - RNA, 22 nt, Homo sapiens
uuacacagagaaauacaaaaua

SEQ ID NO: 1884539 - RNA, 20 nt, Homo sapiens
cuucuaaagaaacugcucca

SEQ ID NO: 1884540 - RNA, 22 nt, Homo sapiens
uaauagccuaauacaacaugua

SEQ ID NO: 1884541 - RNA, 14 nt, Homo sapiens
caaggcagugcaug

SEQ ID NO: 1884542 - RNA, 16 nt, Homo sapiens
ugauuuuaacaguuuu

SEQ ID NO: 1884543 - RNA, 13 nt, Homo sapiens
caaggcacugccu

SEQ ID NO: 1884544 - RNA, 20 nt, Homo sapiens
agcaacagauguuuuauuga

SEQ ID NO: 1884545 - RNA, 14 nt, Homo sapiens
accagaggacaaag

SEQ ID NO: 1884546 - RNA, 11 nt, Homo sapiens
acuuugugcaa

SEQ ID NO: 1884547 - RNA, 19 nt, Homo sapiens
aagauagagaaugcccuca

SEQ ID NO: 1884548 - RNA, 19 nt, Homo sapiens
ucauguuugcuucauaaau

SEQ ID NO: 1884549 - RNA, 20 nt, Homo sapiens
uccaaaagagacagggagaa

SEQ ID NO: 1884550 - RNA, 15 nt, Homo sapiens
aaauuagugaguaua

SEQ ID NO: 1884551 - RNA, 22 nt, Homo sapiens
caggcaggaggccauuccagga

SEQ ID NO: 1884552 - RNA, 16 nt, Homo sapiens
augaaaauuaggauuu

SEQ ID NO: 1884553 - RNA, 15 nt, Homo sapiens
ccacuagguggugcu

SEQ ID NO: 1884554 - RNA, 18 nt, Homo sapiens
aguuugggcuuguaccac

SEQ ID NO: 1884555 - RNA, 19 nt, Homo sapiens
uuaaagauggauuugaaaa

SEQ ID NO: 1884556 - RNA, 22 nt, Homo sapiens
ggugagaaauuugccuuguuca

SEQ ID NO: 1884557 - RNA, 13 nt, Homo sapiens
aacuccauucucu

SEQ ID NO: 1884558 - RNA, 17 nt, Homo sapiens
cucuaaguucaagaaga

SEQ ID NO: 1884559 - RNA, 20 nt, Homo sapiens
uggacaaggagugugaccac

SEQ ID NO: 1884560 - RNA, 15 nt, Homo sapiens
ccuucagaugugucu

SEQ ID NO: 1884561 - RNA, 17 nt, Homo sapiens
auuugggcugaauguau

SEQ ID NO: 1884562 - RNA, 13 nt, Homo sapiens
ucuucuccacugg

SEQ ID NO: 1884563 - RNA, 12 nt, Homo sapiens
ucugucucaaaa

SEQ ID NO: 1884564 - RNA, 16 nt, Homo sapiens
gauuuuucucuucauu

SEQ ID NO: 1884565 - RNA, 11 nt, Homo sapiens
ucaaagggaaa

SEQ ID NO: 1884566 - RNA, 17 nt, Homo sapiens
cuguaaaugcuccuaga

SEQ ID NO: 1884567 - RNA, 16 nt, Homo sapiens
caagagaaguacuauc

SEQ ID NO: 1884568 - RNA, 20 nt, Homo sapiens
aaggugggaggaucguuuga

SEQ ID NO: 1884569 - RNA, 13 nt, Homo sapiens
uacauuucauuaa

SEQ ID NO: 1884570 - RNA, 19 nt, Homo sapiens
ccaaagaaauguaagggaa

SEQ ID NO: 1884571 - RNA, 11 nt, Homo sapiens
gaaccugacau

SEQ ID NO: 1884572 - RNA, 18 nt, Homo sapiens
ugaggacaagauaccaag

SEQ ID NO: 1884573 - RNA, 19 nt, Homo sapiens
cuuacaucugcagcucuuu

SEQ ID NO: 1884574 - RNA, 14 nt, Homo sapiens
cauccucacugugg

SEQ ID NO: 1884575 - RNA, 20 nt, Homo sapiens
ccaacugucccuuuguuuga

SEQ ID NO: 1884576 - RNA, 19 nt, Homo sapiens
aggcgcccgccaccaugcc

SEQ ID NO: 1884577 - RNA, 20 nt, Homo sapiens
ucuaccucugucacccgagc

SEQ ID NO: 1884578 - RNA, 20 nt, Homo sapiens
aaagcuuaaacauugccuua

SEQ ID NO: 1884579 - RNA, 17 nt, Homo sapiens
cugaggaaugucuuuca

SEQ ID NO: 1884580 - RNA, 17 nt, Homo sapiens
aggagauucugccuuug

SEQ ID NO: 1884581 - RNA, 17 nt, Homo sapiens
cugguagguugggacac

SEQ ID NO: 1884582 - RNA, 17 nt, Homo sapiens
auguguuaaaauacuca

SEQ ID NO: 1884583 - RNA, 21 nt, Homo sapiens
gacaguuaagagaaaugagcu

SEQ ID NO: 1884584 - RNA, 11 nt, Homo sapiens
acaaguccagc

SEQ ID NO: 1884585 - RNA, 16 nt, Homo sapiens
acugccuggauuccau

SEQ ID NO: 1884586 - RNA, 17 nt, Homo sapiens
ccucugcauaaauauua

SEQ ID NO: 1884587 - RNA, 18 nt, Homo sapiens
ccuaauguuaaaugacga

SEQ ID NO: 1884588 - RNA, 22 nt, Homo sapiens
aauccuaaaagagaucugggca

SEQ ID NO: 1884589 - RNA, 18 nt, Homo sapiens
aggauggucucgaucucc

SEQ ID NO: 1884590 - RNA, 14 nt, Homo sapiens
acuuggcucucaau

SEQ ID NO: 1884591 - RNA, 15 nt, Homo sapiens
caucuauuauuacac

SEQ ID NO: 1884592 - RNA, 21 nt, Homo sapiens
uuaguaaauaaacaagucaaa

SEQ ID NO: 1884593 - RNA, 18 nt, Homo sapiens
uccagguauuuuccacuu

SEQ ID NO: 1884594 - RNA, 22 nt, Homo sapiens
agaaaauguucuguuugcugug

SEQ ID NO: 1884595 - RNA, 16 nt, Homo sapiens
aaaaacagagccuccu

SEQ ID NO: 1884596 - RNA, 15 nt, Homo sapiens
cauugugauguauau

SEQ ID NO: 1884597 - RNA, 14 nt, Homo sapiens
ugccaaaacaucaa

SEQ ID NO: 1884598 - RNA, 18 nt, Homo sapiens
aucacgggucacuugaaa

SEQ ID NO: 1884599 - RNA, 18 nt, Homo sapiens
acaauacagauaacauua

SEQ ID NO: 1884600 - RNA, 16 nt, Homo sapiens
ucugggcugggcaccu

SEQ ID NO: 1884601 - RNA, 17 nt, Homo sapiens
aaggcuuggcacacagc

SEQ ID NO: 1884602 - RNA, 15 nt, Homo sapiens
cuguuuaacauuucc

SEQ ID NO: 1884603 - RNA, 17 nt, Homo sapiens
aggcuuccuggucagaa

SEQ ID NO: 1884604 - RNA, 21 nt, Homo sapiens
caccugccuccucguuccuuu

SEQ ID NO: 1884605 - RNA, 22 nt, Homo sapiens
gaggcugcggccuaggggucca

SEQ ID NO: 1884606 - RNA, 14 nt, Homo sapiens
cuauugucacauga

SEQ ID NO: 1884607 - RNA, 19 nt, Homo sapiens
cagccucccaaagugcagg

SEQ ID NO: 1884608 - RNA, 14 nt, Homo sapiens
agcuacaauaucuu

SEQ ID NO: 1884609 - RNA, 14 nt, Homo sapiens
cauugagucccugc

SEQ ID NO: 1884610 - RNA, 21 nt, Homo sapiens
aauagcacuuucauugccagu

SEQ ID NO: 1884611 - RNA, 19 nt, Homo sapiens
gagacccagagagcuaggg

SEQ ID NO: 1884612 - RNA, 13 nt, Homo sapiens
ucuccuacuuuga

SEQ ID NO: 1884613 - RNA, 13 nt, Homo sapiens
uccgcuacuucca

SEQ ID NO: 1884614 - RNA, 13 nt, Homo sapiens
ucaucuauaguug

SEQ ID NO: 1884615 - RNA, 23 nt, Homo sapiens
ccuuuccgguguuuaagacauuu

SEQ ID NO: 1884616 - RNA, 13 nt, Homo sapiens
ugcccucucccca

SEQ ID NO: 1884617 - RNA, 14 nt, Homo sapiens
gcugaggccagagg

SEQ ID NO: 1884618 - RNA, 18 nt, Homo sapiens
aaguagcaaauguuuacu

SEQ ID NO: 1884619 - RNA, 19 nt, Homo sapiens
uuucuauauuaggauauca

SEQ ID NO: 1884620 - RNA, 20 nt, Homo sapiens
ucccagcguuaacacaaaau

SEQ ID NO: 1884621 - RNA, 21 nt, Homo sapiens
uggcacaaaaacacacguaga

SEQ ID NO: 1884622 - RNA, 13 nt, Homo sapiens
ccuuuccucaaaa

SEQ ID NO: 1884623 - RNA, 22 nt, Homo sapiens
cuuguggaagacaagucugugg

SEQ ID NO: 1884624 - RNA, 21 nt, Homo sapiens
acagaacgagacuccaccuca

SEQ ID NO: 1884625 - RNA, 15 nt, Homo sapiens
caagaucuguaaugu

SEQ ID NO: 1884626 - RNA, 19 nt, Homo sapiens
uuaguguuugaaauugaau

SEQ ID NO: 1884627 - RNA, 16 nt, Homo sapiens
gccguuguacuccagc

SEQ ID NO: 1884628 - RNA, 16 nt, Homo sapiens
cuaucaauuacagucc

SEQ ID NO: 1884629 - RNA, 18 nt, Homo sapiens
auuuauuggggaucugca

SEQ ID NO: 1884630 - RNA, 22 nt, Homo sapiens
gccuaaugagagugcacugcuc

SEQ ID NO: 1884631 - RNA, 18 nt, Homo sapiens
ugagccagugagggcagu

SEQ ID NO: 1884632 - RNA, 22 nt, Homo sapiens
ggucugacaccaaaacaugccg

SEQ ID NO: 1884633 - RNA, 23 nt, Homo sapiens
ucaggccugaacccguccauuca

SEQ ID NO: 1884634 - RNA, 19 nt, Homo sapiens
caugccauugaaacuaaga

SEQ ID NO: 1884635 - RNA, 17 nt, Homo sapiens
agcagccacacuuccuu

SEQ ID NO: 1884636 - RNA, 22 nt, Homo sapiens
cuggaaacugcucccaucauuc

SEQ ID NO: 1884637 - RNA, 19 nt, Homo sapiens
ucacagacaccagcaaagc

SEQ ID NO: 1884638 - RNA, 21 nt, Homo sapiens
ggaacugcugccacugagggg

SEQ ID NO: 1884639 - RNA, 19 nt, Homo sapiens
ugacgcauucucguaucca

SEQ ID NO: 1884640 - RNA, 17 nt, Homo sapiens
ugcaguaugguacauuu

SEQ ID NO: 1884641 - RNA, 16 nt, Homo sapiens
uaggaguucacuucau

SEQ ID NO: 1884642 - RNA, 16 nt, Homo sapiens
uucagccaacauguga

SEQ ID NO: 1884643 - RNA, 15 nt, Homo sapiens
uuacugaauuugcua

SEQ ID NO: 1884644 - RNA, 12 nt, Homo sapiens
uuagcagacagg

SEQ ID NO: 1884645 - RNA, 22 nt, Homo sapiens
uguguauauaaauacaugcaca

SEQ ID NO: 1884646 - RNA, 24 nt, Homo sapiens
cuuuuguaaauauucuuguccaca

SEQ ID NO: 1884647 - RNA, 21 nt, Homo sapiens
uagucuuauguaaaguauguu

SEQ ID NO: 1884648 - RNA, 18 nt, Homo sapiens
ccuaaggaucucucagga

SEQ ID NO: 1884649 - RNA, 15 nt, Homo sapiens
ucuaaaaugcaaaga

SEQ ID NO: 1884650 - RNA, 20 nt, Homo sapiens
uguacaaaaugaauugccuu

SEQ ID NO: 1884651 - RNA, 19 nt, Homo sapiens
ugaggaccugacacaaucc

SEQ ID NO: 1884652 - RNA, 13 nt, Homo sapiens
auaugagucacug

SEQ ID NO: 1884653 - RNA, 18 nt, Homo sapiens
aggagcccacgacacugc

SEQ ID NO: 1884654 - RNA, 12 nt, Homo sapiens
uaaacuccuuaa

SEQ ID NO: 1884655 - RNA, 21 nt, Homo sapiens
ucucaugccaguaacaggcuc

SEQ ID NO: 1884656 - RNA, 14 nt, Homo sapiens
ucucagugcuucuu

SEQ ID NO: 1884657 - RNA, 16 nt, Homo sapiens
ggcaccucucuugaac

SEQ ID NO: 1884658 - RNA, 16 nt, Homo sapiens
cuuuguugaguauuau

SEQ ID NO: 1884659 - RNA, 13 nt, Homo sapiens
ucuuaaccccagu

SEQ ID NO: 1884660 - RNA, 18 nt, Homo sapiens
cuuaguaguuuuuacaaa

SEQ ID NO: 1884661 - RNA, 20 nt, Homo sapiens
acccaggccugauucacugg

SEQ ID NO: 1884662 - RNA, 18 nt, Homo sapiens
uccugugcuugcuuagag

SEQ ID NO: 1884663 - RNA, 17 nt, Homo sapiens
auuuggggauauuguca

SEQ ID NO: 1884664 - RNA, 16 nt, Homo sapiens
uccccaagcacggugu

SEQ ID NO: 1884665 - RNA, 19 nt, Homo sapiens
ggccagaaaaggcauuuuu

SEQ ID NO: 1884666 - RNA, 15 nt, Homo sapiens
gaacccccuccagac

SEQ ID NO: 1884667 - RNA, 19 nt, Homo sapiens
aaacaaaaaaugugcuguu

SEQ ID NO: 1884668 - RNA, 15 nt, Homo sapiens
ccuuucccuagagaa

SEQ ID NO: 1884669 - RNA, 21 nt, Homo sapiens
gucauuauuuuuguuagcaaa

SEQ ID NO: 1884670 - RNA, 18 nt, Homo sapiens
caugugacuuuuaucugu

SEQ ID NO: 1884671 - RNA, 15 nt, Homo sapiens
cuuugcuucucucca

SEQ ID NO: 1884672 - RNA, 15 nt, Homo sapiens
uacaccuaugucauu

SEQ ID NO: 1884673 - RNA, 18 nt, Homo sapiens
gccccugggacuaaagcc

SEQ ID NO: 1884674 - RNA, 16 nt, Homo sapiens
aaccugaguauaguau

SEQ ID NO: 1884675 - RNA, 17 nt, Homo sapiens
uugacaaaauauauaau

SEQ ID NO: 1884676 - RNA, 14 nt, Homo sapiens
agaauucuacccug

SEQ ID NO: 1884677 - RNA, 22 nt, Homo sapiens
ucuuauucuuucuaaacuacaa

SEQ ID NO: 1884678 - RNA, 18 nt, Homo sapiens
gugcaugggucagggugu

SEQ ID NO: 1884679 - RNA, 20 nt, Homo sapiens
acuaaaugguguuacauuaa

SEQ ID NO: 1884680 - RNA, 15 nt, Homo sapiens
gccacugagcagucu

SEQ ID NO: 1884681 - RNA, 20 nt, Homo sapiens
ucaauggugagaaacauuau

SEQ ID NO: 1884682 - RNA, 15 nt, Homo sapiens
caggacccuccugcc

SEQ ID NO: 1884683 - RNA, 13 nt, Homo sapiens
ugaaauaccagug

SEQ ID NO: 1884684 - RNA, 21 nt, Homo sapiens
auuuuuuccuaacauaccuaa

SEQ ID NO: 1884685 - RNA, 19 nt, Homo sapiens
uuacaauacugaaugggaa

SEQ ID NO: 1884686 - RNA, 20 nt, Homo sapiens
ggggaaacagcaucuccaag

SEQ ID NO: 1884687 - RNA, 19 nt, Homo sapiens
auuacaggcaugagccauu

SEQ ID NO: 1884688 - RNA, 13 nt, Homo sapiens
accugagccugcc

SEQ ID NO: 1884689 - RNA, 13 nt, Homo sapiens
augacucagcaua

SEQ ID NO: 1884690 - RNA, 18 nt, Homo sapiens
aguaaaaagaaauauacc

SEQ ID NO: 1884691 - RNA, 18 nt, Homo sapiens
cauucuuaacaaacucuu

SEQ ID NO: 1884692 - RNA, 17 nt, Homo sapiens
caauacaauaguaugca

SEQ ID NO: 1884693 - RNA, 17 nt, Homo sapiens
cugacugaauaaccacu

SEQ ID NO: 1884694 - RNA, 11 nt, Homo sapiens
ggacugagaug

SEQ ID NO: 1884695 - RNA, 22 nt, Homo sapiens
uaaaaaaaaaaacaaagcaaca

SEQ ID NO: 1884696 - RNA, 19 nt, Homo sapiens
uguuuuaaaaaaacugaag

SEQ ID NO: 1884697 - RNA, 12 nt, Homo sapiens
cugugugcagag

SEQ ID NO: 1884698 - RNA, 17 nt, Homo sapiens
guauaacccuguuacaa

SEQ ID NO: 1884699 - RNA, 20 nt, Homo sapiens
caagcuuuucaaaauuggac

SEQ ID NO: 1884700 - RNA, 10 nt, Homo sapiens
ggacaugggc

SEQ ID NO: 1884701 - RNA, 14 nt, Homo sapiens
agguugacagauac

SEQ ID NO: 1884702 - RNA, 14 nt, Homo sapiens
uuggagggucccaa

SEQ ID NO: 1884703 - RNA, 18 nt, Homo sapiens
ggccuucuuuuggacaaa

SEQ ID NO: 1884704 - RNA, 18 nt, Homo sapiens
aaguucuacaguuaauua

SEQ ID NO: 1884705 - RNA, 13 nt, Homo sapiens
agcgcgucucagc

SEQ ID NO: 1884706 - RNA, 19 nt, Homo sapiens
agggaagagucccagugaa

SEQ ID NO: 1884707 - RNA, 16 nt, Homo sapiens
aaugcuaaaauauuua

SEQ ID NO: 1884708 - RNA, 19 nt, Homo sapiens
gagcaucucuugaggccag

SEQ ID NO: 1884709 - RNA, 20 nt, Homo sapiens
gagagcagaugguccuccau

SEQ ID NO: 1884710 - RNA, 13 nt, Homo sapiens
aaguaugaucuau

SEQ ID NO: 1884711 - RNA, 18 nt, Homo sapiens
cuccaacuccugaccuca

SEQ ID NO: 1884712 - RNA, 16 nt, Homo sapiens
gagccucaauuuccuc

SEQ ID NO: 1884713 - RNA, 22 nt, Homo sapiens
ggcuuguuuuccaaagaaaagu

SEQ ID NO: 1884714 - RNA, 14 nt, Homo sapiens
ucugacuaacgcca

SEQ ID NO: 1884715 - RNA, 13 nt, Homo sapiens
cuacucucagguu

SEQ ID NO: 1884716 - RNA, 17 nt, Homo sapiens
cuauucaugcuacccag

SEQ ID NO: 1884717 - RNA, 20 nt, Homo sapiens
cuaaauauccaaagacugua

SEQ ID NO: 1884718 - RNA, 18 nt, Homo sapiens
augagcugacaucucagu

SEQ ID NO: 1884719 - RNA, 16 nt, Homo sapiens
aaaucauuuagucuaa

SEQ ID NO: 1884720 - RNA, 13 nt, Homo sapiens
aguauguguaugu

SEQ ID NO: 1884721 - RNA, 19 nt, Homo sapiens
caagguggguggaucaccu

SEQ ID NO: 1884722 - RNA, 14 nt, Homo sapiens
cucagucacuuuuu

SEQ ID NO: 1884723 - RNA, 19 nt, Homo sapiens
acaccauuucugggcuccu

SEQ ID NO: 1884724 - RNA, 18 nt, Homo sapiens
aaccuccaacacagugca

SEQ ID NO: 1884725 - RNA, 14 nt, Homo sapiens
uuuaaguaguaaga

SEQ ID NO: 1884726 - RNA, 21 nt, Homo sapiens
auuucagggagaaacuccaaa

SEQ ID NO: 1884727 - RNA, 16 nt, Homo sapiens
ccaugcacucaaagau

SEQ ID NO: 1884728 - RNA, 19 nt, Homo sapiens
ucuguaaaaaauggagcuc

SEQ ID NO: 1884729 - RNA, 17 nt, Homo sapiens
gggcugacccagugugu

SEQ ID NO: 1884730 - RNA, 20 nt, Homo sapiens
auuugucuguaaaaaaugga

SEQ ID NO: 1884731 - RNA, 11 nt, Homo sapiens
accacuuugaa

SEQ ID NO: 1884732 - RNA, 18 nt, Homo sapiens
cuauauuuugucauauca

SEQ ID NO: 1884733 - RNA, 13 nt, Homo sapiens
agaugugcaauug

SEQ ID NO: 1884734 - RNA, 22 nt, Homo sapiens
ggacguggcucagccagcacuu

SEQ ID NO: 1884735 - RNA, 14 nt, Homo sapiens
ucuguuuacugcaa

SEQ ID NO: 1884736 - RNA, 18 nt, Homo sapiens
acagaagggaaauuucaa

SEQ ID NO: 1884737 - RNA, 13 nt, Homo sapiens
ccacauuauuugu

SEQ ID NO: 1884738 - RNA, 17 nt, Homo sapiens
gcaggagguuacagggc

SEQ ID NO: 1884739 - RNA, 20 nt, Homo sapiens
uucacugaauucacugagau

SEQ ID NO: 1884740 - RNA, 22 nt, Homo sapiens
cuccuuugugugugugucagcu

SEQ ID NO: 1884741 - RNA, 17 nt, Homo sapiens
agauuuaagguuucaca

SEQ ID NO: 1884742 - RNA, 15 nt, Homo sapiens
cuauuguuacauuau

SEQ ID NO: 1884743 - RNA, 15 nt, Homo sapiens
gcagcaaaacaaacg

SEQ ID NO: 1884744 - RNA, 15 nt, Homo sapiens
auuauuuugauugau

SEQ ID NO: 1884745 - RNA, 14 nt, Homo sapiens
cgcacagcaguucc

SEQ ID NO: 1884746 - RNA, 23 nt, Homo sapiens
uuauuuaaagaaaaaaaaggcag

SEQ ID NO: 1884747 - RNA, 17 nt, Homo sapiens
agaaagaggucuuucag

SEQ ID NO: 1884748 - RNA, 19 nt, Homo sapiens
cugugcugggggaaugagc

SEQ ID NO: 1884749 - RNA, 15 nt, Homo sapiens
gggcagcauagcaag

SEQ ID NO: 1884750 - RNA, 21 nt, Homo sapiens
gcauauacagugaagaguaag

SEQ ID NO: 1884751 - RNA, 22 nt, Homo sapiens
augguggcaggaaaauggacau

SEQ ID NO: 1884752 - RNA, 17 nt, Homo sapiens
gaacccuccuccuguca

SEQ ID NO: 1884753 - RNA, 23 nt, Homo sapiens
cuuguguugcaaguugguccaca

SEQ ID NO: 1884754 - RNA, 16 nt, Homo sapiens
uuaccugggaccucac

SEQ ID NO: 1884755 - RNA, 20 nt, Homo sapiens
ugagucuauuuuuguacaaa

SEQ ID NO: 1884756 - RNA, 23 nt, Homo sapiens
agaaccuugugccuggcucagag

SEQ ID NO: 1884757 - RNA, 20 nt, Homo sapiens
ccagccuuggugggggagcc

SEQ ID NO: 1884758 - RNA, 15 nt, Homo sapiens
cccccagugugcaag

SEQ ID NO: 1884759 - RNA, 14 nt, Homo sapiens
ggccccuggcccag

SEQ ID NO: 1884760 - RNA, 20 nt, Homo sapiens
gccagcagggcaucuuggaa

SEQ ID NO: 1884761 - RNA, 17 nt, Homo sapiens
cauuacugguaaagccu

SEQ ID NO: 1884762 - RNA, 18 nt, Homo sapiens
ccaaaggauaaguguccc

SEQ ID NO: 1884763 - RNA, 19 nt, Homo sapiens
ugugucuuuuuuuacuuau

SEQ ID NO: 1884764 - RNA, 22 nt, Homo sapiens
uggggccucuccuacuaugcaa

SEQ ID NO: 1884765 - RNA, 19 nt, Homo sapiens
cauugaucaaauauuucaa

SEQ ID NO: 1884766 - RNA, 17 nt, Homo sapiens
aaccuggugcuggauau

SEQ ID NO: 1884767 - RNA, 14 nt, Homo sapiens
aauauguaauacuu

SEQ ID NO: 1884768 - RNA, 15 nt, Homo sapiens
aucugguugugauuu

SEQ ID NO: 1884769 - RNA, 20 nt, Homo sapiens
cuugcaagauuccaaguucu

SEQ ID NO: 1884770 - RNA, 19 nt, Homo sapiens
aaaugugauccugccuugc

SEQ ID NO: 1884771 - RNA, 19 nt, Homo sapiens
caguguggcugaggccacc

SEQ ID NO: 1884772 - RNA, 11 nt, Homo sapiens
aagaagacauu

SEQ ID NO: 1884773 - RNA, 14 nt, Homo sapiens
cauauaauuugcca

SEQ ID NO: 1884774 - RNA, 23 nt, Homo sapiens
cuggaagaagccauugagcucuc

SEQ ID NO: 1884775 - RNA, 17 nt, Homo sapiens
cugcuagggaauaucaa

SEQ ID NO: 1884776 - RNA, 17 nt, Homo sapiens
acugugauggggucauc

SEQ ID NO: 1884777 - RNA, 22 nt, Homo sapiens
ccccacacagcuacagcuuucu

SEQ ID NO: 1884778 - RNA, 17 nt, Homo sapiens
cacacauuuuaugagag

SEQ ID NO: 1884779 - RNA, 19 nt, Homo sapiens
ucaccagcccugagccaug

SEQ ID NO: 1884780 - RNA, 14 nt, Homo sapiens
cuuccaucuaguga

SEQ ID NO: 1884781 - RNA, 15 nt, Homo sapiens
aaugcucaccuuuau

SEQ ID NO: 1884782 - RNA, 12 nt, Homo sapiens
ugaggucuugca

SEQ ID NO: 1884783 - RNA, 19 nt, Homo sapiens
aaggaacaaaaaaaccaca

SEQ ID NO: 1884784 - RNA, 14 nt, Homo sapiens
acucuuaggacauu

SEQ ID NO: 1884785 - RNA, 16 nt, Homo sapiens
ugugaccgaacacugc

SEQ ID NO: 1884786 - RNA, 15 nt, Homo sapiens
aaaacaacaaauacu

SEQ ID NO: 1884787 - RNA, 21 nt, Homo sapiens
gacuucuugcuggucuaguca

SEQ ID NO: 1884788 - RNA, 20 nt, Homo sapiens
auguagaggcuuguuuaccu

SEQ ID NO: 1884789 - RNA, 19 nt, Homo sapiens
gauuacaggugugagccac

SEQ ID NO: 1884790 - RNA, 17 nt, Homo sapiens
auagugugguucaguga

SEQ ID NO: 1884791 - RNA, 19 nt, Homo sapiens
ccagcugaugacucaagau

SEQ ID NO: 1884792 - RNA, 20 nt, Homo sapiens
caugcuuguugcaauugccu

SEQ ID NO: 1884793 - RNA, 20 nt, Homo sapiens
ccagaccauucaggacacag

SEQ ID NO: 1884794 - RNA, 18 nt, Homo sapiens
guuaagagaaaugagcuu

SEQ ID NO: 1884795 - RNA, 16 nt, Homo sapiens
gaggaaggcucuguca

SEQ ID NO: 1884796 - RNA, 18 nt, Homo sapiens
gaggcuagucucuucuca

SEQ ID NO: 1884797 - RNA, 21 nt, Homo sapiens
aacucagguuuuggcauuaaa

SEQ ID NO: 1884798 - RNA, 15 nt, Homo sapiens
uaugcagcugugaua

SEQ ID NO: 1884799 - RNA, 15 nt, Homo sapiens
uugugaugucuuuuc

SEQ ID NO: 1884800 - RNA, 18 nt, Homo sapiens
aagauguacagaacacau

SEQ ID NO: 1884801 - RNA, 22 nt, Homo sapiens
gcagcgauuaauaacaggcaaa

SEQ ID NO: 1884802 - RNA, 20 nt, Homo sapiens
ugagacugggcaucucugag

SEQ ID NO: 1884803 - RNA, 17 nt, Homo sapiens
ugcuccagaugguggga

SEQ ID NO: 1884804 - RNA, 16 nt, Homo sapiens
uauauuauauauacau

SEQ ID NO: 1884805 - RNA, 13 nt, Homo sapiens
uguagccagguac

SEQ ID NO: 1884806 - RNA, 17 nt, Homo sapiens
cucauaugauugugcac

SEQ ID NO: 1884807 - RNA, 14 nt, Homo sapiens
cugagaaugaauga

SEQ ID NO: 1884808 - RNA, 13 nt, Homo sapiens
cuucaaguaauac

SEQ ID NO: 1884809 - RNA, 15 nt, Homo sapiens
uaccuuguuuugcca

SEQ ID NO: 1884810 - RNA, 11 nt, Homo sapiens
gugcacagcuu

SEQ ID NO: 1884811 - RNA, 17 nt, Homo sapiens
cucucccacccucaguc

SEQ ID NO: 1884812 - RNA, 21 nt, Homo sapiens
ucuuuuggggucaucuuugau

SEQ ID NO: 1884813 - RNA, 16 nt, Homo sapiens
ccauaucaggagaccu

SEQ ID NO: 1884814 - RNA, 23 nt, Homo sapiens
uagcaaagcacauagagccagcu

SEQ ID NO: 1884815 - RNA, 13 nt, Homo sapiens
ucauuacugcuuc

SEQ ID NO: 1884816 - RNA, 14 nt, Homo sapiens
ugaaggauugugaa

SEQ ID NO: 1884817 - RNA, 17 nt, Homo sapiens
uggagcaguaaugcagc

SEQ ID NO: 1884818 - RNA, 16 nt, Homo sapiens
ucagauucuucucuua

SEQ ID NO: 1884819 - RNA, 20 nt, Homo sapiens
caaggaggaguuccaccaug

SEQ ID NO: 1884820 - RNA, 13 nt, Homo sapiens
cugugagcacaua

SEQ ID NO: 1884821 - RNA, 15 nt, Homo sapiens
aggcuaagggacugg

SEQ ID NO: 1884822 - RNA, 21 nt, Homo sapiens
acuuucuguguaccacuggga

SEQ ID NO: 1884823 - RNA, 14 nt, Homo sapiens
ucagugaucucacu

SEQ ID NO: 1884824 - RNA, 19 nt, Homo sapiens
gauacuauuuaauuauuuc

SEQ ID NO: 1884825 - RNA, 12 nt, Homo sapiens
agcaucugcaac

SEQ ID NO: 1884826 - RNA, 16 nt, Homo sapiens
aaacuuuaaugggagg

SEQ ID NO: 1884827 - RNA, 23 nt, Homo sapiens
uuagaaugccgguuaaauuccau

SEQ ID NO: 1884828 - RNA, 23 nt, Homo sapiens
agaggcuguagagagagccucag

SEQ ID NO: 1884829 - RNA, 22 nt, Homo sapiens
cugaggugggaaaaucacuuga

SEQ ID NO: 1884830 - RNA, 23 nt, Homo sapiens
uucaaaucuacgguuaugaaggc

SEQ ID NO: 1884831 - RNA, 22 nt, Homo sapiens
ugcagaggaaacuuaagcauaa

SEQ ID NO: 1884832 - RNA, 21 nt, Homo sapiens
cacacugggcucacauuccca

SEQ ID NO: 1884833 - RNA, 20 nt, Homo sapiens
agucugcucacaguaaccca

SEQ ID NO: 1884834 - RNA, 13 nt, Homo sapiens
aguaacacagugu

SEQ ID NO: 1884835 - RNA, 14 nt, Homo sapiens
uacauguauugcac

SEQ ID NO: 1884836 - RNA, 13 nt, Homo sapiens
uguaacacugugu

SEQ ID NO: 1884837 - RNA, 21 nt, Homo sapiens
agcuuuuagaaaaugcaguca

SEQ ID NO: 1884838 - RNA, 16 nt, Homo sapiens
augcagaggaauauua

SEQ ID NO: 1884839 - RNA, 20 nt, Homo sapiens
acauuaaggaccaauagcau

SEQ ID NO: 1884840 - RNA, 22 nt, Homo sapiens
gaaaagccagaguuccauguuu

SEQ ID NO: 1884841 - RNA, 18 nt, Homo sapiens
cuugggcccugcacagau

SEQ ID NO: 1884842 - RNA, 17 nt, Homo sapiens
acagccugccucugcca

SEQ ID NO: 1884843 - RNA, 16 nt, Homo sapiens
aagauagaagaaccac

SEQ ID NO: 1884844 - RNA, 16 nt, Homo sapiens
uuauuuccuaugaugu

SEQ ID NO: 1884845 - RNA, 22 nt, Homo sapiens
gauuguucuguccaguuuccaa

SEQ ID NO: 1884846 - RNA, 18 nt, Homo sapiens
aaacuuaaaaguauucau

SEQ ID NO: 1884847 - RNA, 18 nt, Homo sapiens
uccagggugacaaggccu

SEQ ID NO: 1884848 - RNA, 19 nt, Homo sapiens
ccauuuuggaaccuaauaa

SEQ ID NO: 1884849 - RNA, 18 nt, Homo sapiens
gacugaugagcacaucuc

SEQ ID NO: 1884850 - RNA, 14 nt, Homo sapiens
cacuugcucaaaac

SEQ ID NO: 1884851 - RNA, 14 nt, Homo sapiens
ugaaagcagaugag

SEQ ID NO: 1884852 - RNA, 14 nt, Homo sapiens
acuacgaaguauaa

SEQ ID NO: 1884853 - RNA, 19 nt, Homo sapiens
aaauaaaauuuuuauguaa

SEQ ID NO: 1884854 - RNA, 21 nt, Homo sapiens
uuccuguguggccugccuuca

SEQ ID NO: 1884855 - RNA, 16 nt, Homo sapiens
ucaugugacucuuucc

SEQ ID NO: 1884856 - RNA, 22 nt, Homo sapiens
cagaauaaacuggcagcucagc

SEQ ID NO: 1884857 - RNA, 18 nt, Homo sapiens
aaacauucuuauuucagu

SEQ ID NO: 1884858 - RNA, 20 nt, Homo sapiens
guaacuauuaaaccauacua

SEQ ID NO: 1884859 - RNA, 22 nt, Homo sapiens
acuccucucccuugagggauaa

SEQ ID NO: 1884860 - RNA, 16 nt, Homo sapiens
accucuuaugagcucc

SEQ ID NO: 1884861 - RNA, 18 nt, Homo sapiens
ucaaaguuaagaaucuuu

SEQ ID NO: 1884862 - RNA, 17 nt, Homo sapiens
gagccugaaaucaucuu

SEQ ID NO: 1884863 - RNA, 17 nt, Homo sapiens
cauacucugcuuagaau

SEQ ID NO: 1884864 - RNA, 14 nt, Homo sapiens
ucauagcugagauu

SEQ ID NO: 1884865 - RNA, 19 nt, Homo sapiens
ccuggucucuucaccacug

SEQ ID NO: 1884866 - RNA, 17 nt, Homo sapiens
agugucacuggauguca

SEQ ID NO: 1884867 - RNA, 15 nt, Homo sapiens
caucucaagugccau

SEQ ID NO: 1884868 - RNA, 19 nt, Homo sapiens
gaagccggccggcugggau

SEQ ID NO: 1884869 - RNA, 22 nt, Homo sapiens
ucaugaugcuagccagcaaaga

SEQ ID NO: 1884870 - RNA, 19 nt, Homo sapiens
auacauuaucucacuugug

SEQ ID NO: 1884871 - RNA, 17 nt, Homo sapiens
aagaucucggugcugaa

SEQ ID NO: 1884872 - RNA, 20 nt, Homo sapiens
ugucguagagcccuccacau

SEQ ID NO: 1884873 - RNA, 15 nt, Homo sapiens
agcucccggggacga

SEQ ID NO: 1884874 - RNA, 16 nt, Homo sapiens
uccaauuuguguaauu

SEQ ID NO: 1884875 - RNA, 22 nt, Homo sapiens
acaaucaugagucagacauuug

SEQ ID NO: 1884876 - RNA, 15 nt, Homo sapiens
acugagugugcucuu

SEQ ID NO: 1884877 - RNA, 12 nt, Homo sapiens
uccaaugagcuu

SEQ ID NO: 1884878 - RNA, 20 nt, Homo sapiens
uagauaugaagaaucugcuc

SEQ ID NO: 1884879 - RNA, 13 nt, Homo sapiens
cuuuggcugcacg

SEQ ID NO: 1884880 - RNA, 21 nt, Homo sapiens
augugggguccccaucauccc

SEQ ID NO: 1884881 - RNA, 13 nt, Homo sapiens
gacacuuauuuau

SEQ ID NO: 1884882 - RNA, 16 nt, Homo sapiens
ccuaauaagaccccac

SEQ ID NO: 1884883 - RNA, 19 nt, Homo sapiens
gcuggggaggccugccugg

SEQ ID NO: 1884884 - RNA, 14 nt, Homo sapiens
uccuguagcacaaa

SEQ ID NO: 1884885 - RNA, 17 nt, Homo sapiens
guccucuagugaaugua

SEQ ID NO: 1884886 - RNA, 12 nt, Homo sapiens
agggaacugacc

SEQ ID NO: 1884887 - RNA, 15 nt, Homo sapiens
ggagacaaguuccau

SEQ ID NO: 1884888 - RNA, 20 nt, Homo sapiens
acugacuuguuugucuucca

SEQ ID NO: 1884889 - RNA, 19 nt, Homo sapiens
acucaaaagcccacgucag

SEQ ID NO: 1884890 - RNA, 14 nt, Homo sapiens
ucucaccucuaggu

SEQ ID NO: 1884891 - RNA, 19 nt, Homo sapiens
ucagaacaguaucuuugca

SEQ ID NO: 1884892 - RNA, 16 nt, Homo sapiens
cagcauaaagcacauu

SEQ ID NO: 1884893 - RNA, 12 nt, Homo sapiens
acacacacaagu

SEQ ID NO: 1884894 - RNA, 22 nt, Homo sapiens
aaaagguggcccuucacugucc

SEQ ID NO: 1884895 - RNA, 15 nt, Homo sapiens
gugagaugauuugua

SEQ ID NO: 1884896 - RNA, 19 nt, Homo sapiens
auuuugcuugucauauucg

SEQ ID NO: 1884897 - RNA, 12 nt, Homo sapiens
aggcuuacuuca

SEQ ID NO: 1884898 - RNA, 14 nt, Homo sapiens
agcuacaaaugccu

SEQ ID NO: 1884899 - RNA, 20 nt, Homo sapiens
caggagcuuuacucauggca

SEQ ID NO: 1884900 - RNA, 12 nt, Homo sapiens
gagcuugagcuc

SEQ ID NO: 1884901 - RNA, 12 nt, Homo sapiens
aaguuugaacuu

SEQ ID NO: 1884902 - RNA, 18 nt, Homo sapiens
caaacuauuacuuacaaa

SEQ ID NO: 1884903 - RNA, 20 nt, Homo sapiens
accaaggcaaacccuagauu

SEQ ID NO: 1884904 - RNA, 20 nt, Homo sapiens
gugcaagugucugugugcaa

SEQ ID NO: 1884905 - RNA, 20 nt, Homo sapiens
acuuccuuugaaagcuguau

SEQ ID NO: 1884906 - RNA, 14 nt, Homo sapiens
accaugaagaagaa

SEQ ID NO: 1884907 - RNA, 17 nt, Homo sapiens
caugcugccuggcacag

SEQ ID NO: 1884908 - RNA, 22 nt, Homo sapiens
ugagaccauccauucuccucag

SEQ ID NO: 1884909 - RNA, 21 nt, Homo sapiens
caguacuugucauauguagcc

SEQ ID NO: 1884910 - RNA, 13 nt, Homo sapiens
cagggcuagugac

SEQ ID NO: 1884911 - RNA, 17 nt, Homo sapiens
uaaucucagauuccuua

SEQ ID NO: 1884912 - RNA, 14 nt, Homo sapiens
gcauuuaacugccu

SEQ ID NO: 1884913 - RNA, 15 nt, Homo sapiens
gggccucuucugcuu

SEQ ID NO: 1884914 - RNA, 18 nt, Homo sapiens
uauacuauaugaaaagag

SEQ ID NO: 1884915 - RNA, 18 nt, Homo sapiens
caucauguuggccaggcu

SEQ ID NO: 1884916 - RNA, 21 nt, Homo sapiens
cuggggugaggggaggcaucu

SEQ ID NO: 1884917 - RNA, 17 nt, Homo sapiens
agccaacacccugucua

SEQ ID NO: 1884918 - RNA, 16 nt, Homo sapiens
guuuauaaugcaauga

SEQ ID NO: 1884919 - RNA, 16 nt, Homo sapiens
uaguaagagauuccug

SEQ ID NO: 1884920 - RNA, 17 nt, Homo sapiens
caagaaggaaagauuug

SEQ ID NO: 1884921 - RNA, 18 nt, Homo sapiens
cuccauugucaugagucc

SEQ ID NO: 1884922 - RNA, 14 nt, Homo sapiens
cagccucagaggag

SEQ ID NO: 1884923 - RNA, 14 nt, Homo sapiens
uuguggaaacagcu

SEQ ID NO: 1884924 - RNA, 22 nt, Homo sapiens
gcacuguucugggacuccaggu

SEQ ID NO: 1884925 - RNA, 21 nt, Homo sapiens
caugaugcuacccgagguuug

SEQ ID NO: 1884926 - RNA, 22 nt, Homo sapiens
ccagcugaggcugggggcgggg

SEQ ID NO: 1884927 - RNA, 23 nt, Homo sapiens
guccucagggcucuaccaagaca

SEQ ID NO: 1884928 - RNA, 17 nt, Homo sapiens
aggcgauucuccugccu

SEQ ID NO: 1884929 - RNA, 23 nt, Homo sapiens
ggcauguuuugcccaccagauca

SEQ ID NO: 1884930 - RNA, 18 nt, Homo sapiens
aaucaggaauauuuucca

SEQ ID NO: 1884931 - RNA, 14 nt, Homo sapiens
auuagaaugcaugu

SEQ ID NO: 1884932 - RNA, 15 nt, Homo sapiens
aacagcaggugccag

SEQ ID NO: 1884933 - RNA, 13 nt, Homo sapiens
uaccaaaucucaa

SEQ ID NO: 1884934 - RNA, 21 nt, Homo sapiens
cagaaauaauaaaaaauuuca

SEQ ID NO: 1884935 - RNA, 21 nt, Homo sapiens
uaaaaucuuuucuauuuuccc

SEQ ID NO: 1884936 - RNA, 16 nt, Homo sapiens
aguuuucggaaacacu

SEQ ID NO: 1884937 - RNA, 21 nt, Homo sapiens
gugagacccugucucuacuaa

SEQ ID NO: 1884938 - RNA, 14 nt, Homo sapiens
uugauggugaugaa

SEQ ID NO: 1884939 - RNA, 23 nt, Homo sapiens
gcaagcagagguggcgauuuguu

SEQ ID NO: 1884940 - RNA, 20 nt, Homo sapiens
agucaugguuguggcgugug

SEQ ID NO: 1884941 - RNA, 19 nt, Homo sapiens
agugccacuugacauuccu

SEQ ID NO: 1884942 - RNA, 18 nt, Homo sapiens
aucuauauauaagcucau

SEQ ID NO: 1884943 - RNA, 19 nt, Homo sapiens
auggcuuggggggcuccag

SEQ ID NO: 1884944 - RNA, 12 nt, Homo sapiens
uucauacuguac

SEQ ID NO: 1884945 - RNA, 13 nt, Homo sapiens
guggaacaaaagu

SEQ ID NO: 1884946 - RNA, 20 nt, Homo sapiens
acugugugcaacagacaaaa

SEQ ID NO: 1884947 - RNA, 23 nt, Homo sapiens
auugccacagcucaacucggggg

SEQ ID NO: 1884948 - RNA, 13 nt, Homo sapiens
cuguuccagguuu

SEQ ID NO: 1884949 - RNA, 20 nt, Homo sapiens
cuuuuucucuuuccaugaca

SEQ ID NO: 1884950 - RNA, 14 nt, Homo sapiens
uagcauuucuucca

SEQ ID NO: 1884951 - RNA, 15 nt, Homo sapiens
ucccucaguccuuua

SEQ ID NO: 1884952 - RNA, 12 nt, Homo sapiens
aagccacauauc

SEQ ID NO: 1884953 - RNA, 17 nt, Homo sapiens
agcauuugguacacacu

SEQ ID NO: 1884954 - RNA, 17 nt, Homo sapiens
uguuugcaucauuuaac

SEQ ID NO: 1884955 - RNA, 16 nt, Homo sapiens
ccuuuacuugucuuuc

SEQ ID NO: 1884956 - RNA, 19 nt, Homo sapiens
cucucaugucuuugcugca

SEQ ID NO: 1884957 - RNA, 12 nt, Homo sapiens
ccccugcagauu

SEQ ID NO: 1884958 - RNA, 11 nt, Homo sapiens
ggucugcagcu

SEQ ID NO: 1884959 - RNA, 15 nt, Homo sapiens
uaaauauauauguca

SEQ ID NO: 1884960 - RNA, 22 nt, Homo sapiens
agaugccauuuuguacauguau

SEQ ID NO: 1884961 - RNA, 16 nt, Homo sapiens
augaguaacauuugcu

SEQ ID NO: 1884962 - RNA, 13 nt, Homo sapiens
agcauacuucaaa

SEQ ID NO: 1884963 - RNA, 18 nt, Homo sapiens
guguucugaugaggcauu

SEQ ID NO: 1884964 - RNA, 21 nt, Homo sapiens
cuuggccucccaaagugcugg

SEQ ID NO: 1884965 - RNA, 21 nt, Homo sapiens
agcucugguguaguuucugca

SEQ ID NO: 1884966 - RNA, 13 nt, Homo sapiens
cacuuuguuucau

SEQ ID NO: 1884967 - RNA, 13 nt, Homo sapiens
caaaauguuuaua

SEQ ID NO: 1884968 - RNA, 18 nt, Homo sapiens
ccugugacuggcagcauu

SEQ ID NO: 1884969 - RNA, 18 nt, Homo sapiens
ucauuuuaacaucugaga

SEQ ID NO: 1884970 - RNA, 18 nt, Homo sapiens
ggaauauuuaaacaguag

SEQ ID NO: 1884971 - RNA, 14 nt, Homo sapiens
uccuugaccuauga

SEQ ID NO: 1884972 - RNA, 18 nt, Homo sapiens
gccuuugcaaaucagugu

SEQ ID NO: 1884973 - RNA, 22 nt, Homo sapiens
uauauuugaaaaaaacuucauu

SEQ ID NO: 1884974 - RNA, 16 nt, Homo sapiens
ugcaacagcacuggcu

SEQ ID NO: 1884975 - RNA, 22 nt, Homo sapiens
aagacagugccuauacugccuc

SEQ ID NO: 1884976 - RNA, 21 nt, Homo sapiens
guuacagggaaggaggguagg

SEQ ID NO: 1884977 - RNA, 21 nt, Homo sapiens
ucagggagcucgcauucucuu

SEQ ID NO: 1884978 - RNA, 13 nt, Homo sapiens
guacuaacccagu

SEQ ID NO: 1884979 - RNA, 15 nt, Homo sapiens
ucucagagccuucca

SEQ ID NO: 1884980 - RNA, 14 nt, Homo sapiens
uuucuauaucaaaa

SEQ ID NO: 1884981 - RNA, 14 nt, Homo sapiens
aguaacaucaaaga

SEQ ID NO: 1884982 - RNA, 14 nt, Homo sapiens
cucaucuuacugua

SEQ ID NO: 1884983 - RNA, 10 nt, Homo sapiens
ccugccuuca

SEQ ID NO: 1884984 - RNA, 21 nt, Homo sapiens
uauuagaucaaauaguugcau

SEQ ID NO: 1884985 - RNA, 19 nt, Homo sapiens
cucauucagggauagcacu

SEQ ID NO: 1884986 - RNA, 13 nt, Homo sapiens
ccuucaagugcca

SEQ ID NO: 1884987 - RNA, 13 nt, Homo sapiens
uggacugugccau

SEQ ID NO: 1884988 - RNA, 16 nt, Homo sapiens
agugcaguggugcaau

SEQ ID NO: 1884989 - RNA, 16 nt, Homo sapiens
auacauguguacauau

SEQ ID NO: 1884990 - RNA, 16 nt, Homo sapiens
gccaauaaaccaauga

SEQ ID NO: 1884991 - RNA, 23 nt, Homo sapiens
gacacccucccuccaggguccuc

SEQ ID NO: 1884992 - RNA, 15 nt, Homo sapiens
aagacuccaucucaa

SEQ ID NO: 1884993 - RNA, 19 nt, Homo sapiens
uuaacaccuucauccagau

SEQ ID NO: 1884994 - RNA, 14 nt, Homo sapiens
guucuauaugcauu

SEQ ID NO: 1884995 - RNA, 18 nt, Homo sapiens
acaauggcagaacaggug

SEQ ID NO: 1884996 - RNA, 15 nt, Homo sapiens
cccaguguccuucca

SEQ ID NO: 1884997 - RNA, 17 nt, Homo sapiens
uacauauaucucugugu

SEQ ID NO: 1884998 - RNA, 21 nt, Homo sapiens
cccugcacguauacacccaga

SEQ ID NO: 1884999 - RNA, 19 nt, Homo sapiens
caucuaagucaguuucaca

SEQ ID NO: 1885000 - RNA, 10 nt, Homo sapiens
uuggcacugu

SEQ ID NO: 1885001 - RNA, 18 nt, Homo sapiens
caccgguaauaagccaag

SEQ ID NO: 1885002 - RNA, 10 nt, Homo sapiens
gugucuccca

SEQ ID NO: 1885003 - RNA, 19 nt, Homo sapiens
acaggagaaacacuugaac

SEQ ID NO: 1885004 - RNA, 15 nt, Homo sapiens
auaaucacugaccag

SEQ ID NO: 1885005 - RNA, 14 nt, Homo sapiens
caguugcuuugcag

SEQ ID NO: 1885006 - RNA, 16 nt, Homo sapiens
uuuauacuugaaauga

SEQ ID NO: 1885007 - RNA, 19 nt, Homo sapiens
uuggauuuauaaaugcuau

SEQ ID NO: 1885008 - RNA, 17 nt, Homo sapiens
ugugcuauugaacugag

SEQ ID NO: 1885009 - RNA, 22 nt, Homo sapiens
ugcaugcugcccagccacucca

SEQ ID NO: 1885010 - RNA, 22 nt, Homo sapiens
aggaacacccggaaagacugaa

SEQ ID NO: 1885011 - RNA, 14 nt, Homo sapiens
gucacggguaaaaa

SEQ ID NO: 1885012 - RNA, 18 nt, Homo sapiens
accauggaccagcccauu

SEQ ID NO: 1885013 - RNA, 22 nt, Homo sapiens
caggaaagagagcaccacguga

SEQ ID NO: 1885014 - RNA, 12 nt, Homo sapiens
ugugucugcaac

SEQ ID NO: 1885015 - RNA, 14 nt, Homo sapiens
augcuacauggcuc

SEQ ID NO: 1885016 - RNA, 18 nt, Homo sapiens
ccaccugcuaaucacauc

SEQ ID NO: 1885017 - RNA, 19 nt, Homo sapiens
aaauuugcuuuacauauga

SEQ ID NO: 1885018 - RNA, 15 nt, Homo sapiens
cccagugugugcuca

SEQ ID NO: 1885019 - RNA, 18 nt, Homo sapiens
gccagacuggcacaguuu

SEQ ID NO: 1885020 - RNA, 12 nt, Homo sapiens
acaauacaguaa

SEQ ID NO: 1885021 - RNA, 13 nt, Homo sapiens
cauugucugcaau

SEQ ID NO: 1885022 - RNA, 19 nt, Homo sapiens
cgagagcuuggacuacaca

SEQ ID NO: 1885023 - RNA, 15 nt, Homo sapiens
gguguuugucugugu

SEQ ID NO: 1885024 - RNA, 15 nt, Homo sapiens
ucgaguggccagcuu

SEQ ID NO: 1885025 - RNA, 20 nt, Homo sapiens
agacaggaggucagcacaag

SEQ ID NO: 1885026 - RNA, 19 nt, Homo sapiens
caucuccucaacucugagu

SEQ ID NO: 1885027 - RNA, 13 nt, Homo sapiens
gaauaaagcuucu

SEQ ID NO: 1885028 - RNA, 14 nt, Homo sapiens
ugcaucccugguga

SEQ ID NO: 1885029 - RNA, 12 nt, Homo sapiens
cuaagugcugcu

SEQ ID NO: 1885030 - RNA, 22 nt, Homo sapiens
acauacaccucgucaagagcau

SEQ ID NO: 1885031 - RNA, 20 nt, Homo sapiens
cagccucccucugaccugca

SEQ ID NO: 1885032 - RNA, 20 nt, Homo sapiens
gcuagcaacauaccagacca

SEQ ID NO: 1885033 - RNA, 13 nt, Homo sapiens
aagcagaugagga

SEQ ID NO: 1885034 - RNA, 19 nt, Homo sapiens
gcuuaccuaucuguggaaa

SEQ ID NO: 1885035 - RNA, 18 nt, Homo sapiens
ggagucugcuucauuucc

SEQ ID NO: 1885036 - RNA, 20 nt, Homo sapiens
agcacugugcuaauaacagu

SEQ ID NO: 1885037 - RNA, 12 nt, Homo sapiens
ccugagugucca

SEQ ID NO: 1885038 - RNA, 16 nt, Homo sapiens
agagagggcuuucuca

SEQ ID NO: 1885039 - RNA, 21 nt, Homo sapiens
gugcucauucauuuaacagag

SEQ ID NO: 1885040 - RNA, 17 nt, Homo sapiens
aagggauggggugccag

SEQ ID NO: 1885041 - RNA, 14 nt, Homo sapiens
cuucuccucccagc

SEQ ID NO: 1885042 - RNA, 13 nt, Homo sapiens
gugcuagccacug

SEQ ID NO: 1885043 - RNA, 16 nt, Homo sapiens
uccaacaugugcucag

SEQ ID NO: 1885044 - RNA, 16 nt, Homo sapiens
gaauauucaaauaucu

SEQ ID NO: 1885045 - RNA, 15 nt, Homo sapiens
acuacugcagucuuu

SEQ ID NO: 1885046 - RNA, 16 nt, Homo sapiens
ccugugacugucucac

SEQ ID NO: 1885047 - RNA, 16 nt, Homo sapiens
caacccugagcacucu

SEQ ID NO: 1885048 - RNA, 20 nt, Homo sapiens
caugccucugauaugggacu

SEQ ID NO: 1885049 - RNA, 14 nt, Homo sapiens
ucaccauacuucau

SEQ ID NO: 1885050 - RNA, 15 nt, Homo sapiens
ugagucacacugcau

SEQ ID NO: 1885051 - RNA, 12 nt, Homo sapiens
uuuccugcacau

SEQ ID NO: 1885052 - RNA, 20 nt, Homo sapiens
ugaugucagaauagcuucca

SEQ ID NO: 1885053 - RNA, 14 nt, Homo sapiens
uccuagacuugaaa

SEQ ID NO: 1885054 - RNA, 14 nt, Homo sapiens
cugaaagacuugaa

SEQ ID NO: 1885055 - RNA, 12 nt, Homo sapiens
uauuuauuuucc

SEQ ID NO: 1885056 - RNA, 20 nt, Homo sapiens
aaguaauaaugugcaaaucu

SEQ ID NO: 1885057 - RNA, 17 nt, Homo sapiens
aauuuuguaauguauca

SEQ ID NO: 1885058 - RNA, 21 nt, Homo sapiens
cuugguucaucaguguuaaaa

SEQ ID NO: 1885059 - RNA, 14 nt, Homo sapiens
gcggagcugcaugg

SEQ ID NO: 1885060 - RNA, 22 nt, Homo sapiens
uuuugcuuaccuuuuccuauuc

SEQ ID NO: 1885061 - RNA, 17 nt, Homo sapiens
caugcaauaaugugcaa

SEQ ID NO: 1885062 - RNA, 17 nt, Homo sapiens
ucauauuuuuacaaaua

SEQ ID NO: 1885063 - RNA, 19 nt, Homo sapiens
guuuuuucagucugugaaa

SEQ ID NO: 1885064 - RNA, 22 nt, Homo sapiens
ccugguccagauuguagcucuu

SEQ ID NO: 1885065 - RNA, 22 nt, Homo sapiens
gccauggcuuucauccuguguc

SEQ ID NO: 1885066 - RNA, 22 nt, Homo sapiens
gggccccggaugacuuggggac

SEQ ID NO: 1885067 - RNA, 21 nt, Homo sapiens
guauaacaagccaaacauucu

SEQ ID NO: 1885068 - RNA, 23 nt, Homo sapiens
agucccacugcaccccccugugc

SEQ ID NO: 1885069 - RNA, 22 nt, Homo sapiens
gcaguugcuaaauuuguguucc

SEQ ID NO: 1885070 - RNA, 15 nt, Homo sapiens
guucucauuucucag

SEQ ID NO: 1885071 - RNA, 21 nt, Homo sapiens
cucagccacugucacaggcau

SEQ ID NO: 1885072 - RNA, 16 nt, Homo sapiens
ugcuuuggaaaucaca

SEQ ID NO: 1885073 - RNA, 12 nt, Homo sapiens
ugcagggcuccc

SEQ ID NO: 1885074 - RNA, 15 nt, Homo sapiens
uccaaccucagggac

SEQ ID NO: 1885075 - RNA, 20 nt, Homo sapiens
cccuggcugugagcagccuc

SEQ ID NO: 1885076 - RNA, 19 nt, Homo sapiens
guuacaugaaggcagcaga

SEQ ID NO: 1885077 - RNA, 16 nt, Homo sapiens
cauuguagccucaauc

SEQ ID NO: 1885078 - RNA, 20 nt, Homo sapiens
cuacuuaaacaaaaacuuuc

SEQ ID NO: 1885079 - RNA, 15 nt, Homo sapiens
cuucuuacccaaagc

SEQ ID NO: 1885080 - RNA, 23 nt, Homo sapiens
uguccaaauggacauaagacaga

SEQ ID NO: 1885081 - RNA, 17 nt, Homo sapiens
cacuagucacauucuug

SEQ ID NO: 1885082 - RNA, 20 nt, Homo sapiens
agcucguccccauugcuuaa

SEQ ID NO: 1885083 - RNA, 20 nt, Homo sapiens
gugcacauuucauaguuuca

SEQ ID NO: 1885084 - RNA, 17 nt, Homo sapiens
acauuucccuacccuaa

SEQ ID NO: 1885085 - RNA, 20 nt, Homo sapiens
uguaccaaaacauccacuua

SEQ ID NO: 1885086 - RNA, 17 nt, Homo sapiens
uuguuuuaaaauagcuu

SEQ ID NO: 1885087 - RNA, 19 nt, Homo sapiens
cccuauugguaaagaaugg

SEQ ID NO: 1885088 - RNA, 13 nt, Homo sapiens
uggacuacacaca

SEQ ID NO: 1885089 - RNA, 20 nt, Homo sapiens
gugggcccagccccugccag

SEQ ID NO: 1885090 - RNA, 17 nt, Homo sapiens
caauucaauacagauca

SEQ ID NO: 1885091 - RNA, 14 nt, Homo sapiens
ugagaaccgugaca

SEQ ID NO: 1885092 - RNA, 12 nt, Homo sapiens
ccgccacuccag

SEQ ID NO: 1885093 - RNA, 14 nt, Homo sapiens
gaauccuacauaca

SEQ ID NO: 1885094 - RNA, 16 nt, Homo sapiens
ugacucugcucuugca

SEQ ID NO: 1885095 - RNA, 20 nt, Homo sapiens
aaccauacacaggcuaucaa

SEQ ID NO: 1885096 - RNA, 21 nt, Homo sapiens
acccuggauaagucacuuaaa

SEQ ID NO: 1885097 - RNA, 14 nt, Homo sapiens
aaagcaaaugauuc

SEQ ID NO: 1885098 - RNA, 20 nt, Homo sapiens
acuauagaaugcaacuccau

SEQ ID NO: 1885099 - RNA, 15 nt, Homo sapiens
uuaguacuuacauca

SEQ ID NO: 1885100 - RNA, 17 nt, Homo sapiens
ggcacccccaaauucaa

SEQ ID NO: 1885101 - RNA, 16 nt, Homo sapiens
uuuaaccauuccauaa

SEQ ID NO: 1885102 - RNA, 14 nt, Homo sapiens
ugcaugaccuacca

SEQ ID NO: 1885103 - RNA, 18 nt, Homo sapiens
uuguagccacaagccuga

SEQ ID NO: 1885104 - RNA, 18 nt, Homo sapiens
agucuucugacugucacc

SEQ ID NO: 1885105 - RNA, 15 nt, Homo sapiens
agagggccucaucuc

SEQ ID NO: 1885106 - RNA, 18 nt, Homo sapiens
acaguggggcugcaggca

SEQ ID NO: 1885107 - RNA, 14 nt, Homo sapiens
agugucacugagcu

SEQ ID NO: 1885108 - RNA, 17 nt, Homo sapiens
auguacaauaaagcaau

SEQ ID NO: 1885109 - RNA, 20 nt, Homo sapiens
ugguucugaugaugugccug

SEQ ID NO: 1885110 - RNA, 16 nt, Homo sapiens
aaucaaauacauacaa

SEQ ID NO: 1885111 - RNA, 14 nt, Homo sapiens
guuagcaucuggcu

SEQ ID NO: 1885112 - RNA, 17 nt, Homo sapiens
auacuuggagggcccag

SEQ ID NO: 1885113 - RNA, 21 nt, Homo sapiens
gguucccagaaaacacauuuc

SEQ ID NO: 1885114 - RNA, 14 nt, Homo sapiens
ucagcaucucacuu

SEQ ID NO: 1885115 - RNA, 20 nt, Homo sapiens
gacaaaccuuaaaacagcug

SEQ ID NO: 1885116 - RNA, 15 nt, Homo sapiens
aguuggcaugacucu

SEQ ID NO: 1885117 - RNA, 20 nt, Homo sapiens
uugucaaagaaggugcugau

SEQ ID NO: 1885118 - RNA, 15 nt, Homo sapiens
gcggcccagacccag

SEQ ID NO: 1885119 - RNA, 18 nt, Homo sapiens
uucuccccuuccuggaca

SEQ ID NO: 1885120 - RNA, 20 nt, Homo sapiens
aacaaacauuguguugacau

SEQ ID NO: 1885121 - RNA, 16 nt, Homo sapiens
ugggccuugggcuccg

SEQ ID NO: 1885122 - RNA, 21 nt, Homo sapiens
gaucaaguuguugacugugau

SEQ ID NO: 1885123 - RNA, 24 nt, Homo sapiens
acugguuaaaaaacaaauguucau

SEQ ID NO: 1885124 - RNA, 17 nt, Homo sapiens
agccccgucuggugcca

SEQ ID NO: 1885125 - RNA, 17 nt, Homo sapiens
cauaucacuaugaacuu

SEQ ID NO: 1885126 - RNA, 23 nt, Homo sapiens
ugcuagguuguuuuuaaaaccac

SEQ ID NO: 1885127 - RNA, 22 nt, Homo sapiens
agaucgcuuuucucagacucac

SEQ ID NO: 1885128 - RNA, 19 nt, Homo sapiens
auuacagacaugaaccacc

SEQ ID NO: 1885129 - RNA, 20 nt, Homo sapiens
uucugcaaaauagacauauu

SEQ ID NO: 1885130 - RNA, 15 nt, Homo sapiens
cacuuuccacccucu

SEQ ID NO: 1885131 - RNA, 18 nt, Homo sapiens
ugauugguugcauccagg

SEQ ID NO: 1885132 - RNA, 19 nt, Homo sapiens
cuuccgugggucaucccag

SEQ ID NO: 1885133 - RNA, 15 nt, Homo sapiens
gcuuucagcacucac

SEQ ID NO: 1885134 - RNA, 15 nt, Homo sapiens
uuagguguacuguac

SEQ ID NO: 1885135 - RNA, 21 nt, Homo sapiens
uacacguuggaguauaccuau

SEQ ID NO: 1885136 - RNA, 16 nt, Homo sapiens
aaggcauccccagugc

SEQ ID NO: 1885137 - RNA, 12 nt, Homo sapiens
aaggguauguca

SEQ ID NO: 1885138 - RNA, 20 nt, Homo sapiens
auccacaaaugaagggauau

SEQ ID NO: 1885139 - RNA, 22 nt, Homo sapiens
aauuuaaaaaauauauaugcau

SEQ ID NO: 1885140 - RNA, 21 nt, Homo sapiens
ugaauuguccuuuucuaggaa

SEQ ID NO: 1885141 - RNA, 18 nt, Homo sapiens
uuagggaugacugugauu

SEQ ID NO: 1885142 - RNA, 14 nt, Homo sapiens
cuggcaacaugaag

SEQ ID NO: 1885143 - RNA, 17 nt, Homo sapiens
cagcugcuuuugcauuu

SEQ ID NO: 1885144 - RNA, 11 nt, Homo sapiens
cuggucccugc

SEQ ID NO: 1885145 - RNA, 23 nt, Homo sapiens
agaauccauccaaaguucccuau

SEQ ID NO: 1885146 - RNA, 15 nt, Homo sapiens
uugucagaacuagaa

SEQ ID NO: 1885147 - RNA, 21 nt, Homo sapiens
uuaucaguuaaaaucacauuu

SEQ ID NO: 1885148 - RNA, 20 nt, Homo sapiens
gcauuucacgaacuguucac

SEQ ID NO: 1885149 - RNA, 16 nt, Homo sapiens
caguuauacauaccuc

SEQ ID NO: 1885150 - RNA, 22 nt, Homo sapiens
uccuuaauuuaauugcuuugaa

SEQ ID NO: 1885151 - RNA, 19 nt, Homo sapiens
uaccugccacucacacagc

SEQ ID NO: 1885152 - RNA, 14 nt, Homo sapiens
cgaccguugccacg

SEQ ID NO: 1885153 - RNA, 12 nt, Homo sapiens
cugccugagcuu

SEQ ID NO: 1885154 - RNA, 23 nt, Homo sapiens
cccaagauguggccuuuagcaaa

SEQ ID NO: 1885155 - RNA, 19 nt, Homo sapiens
agucauuccaugaagcccc

SEQ ID NO: 1885156 - RNA, 16 nt, Homo sapiens
ucuuucuacucuccua

SEQ ID NO: 1885157 - RNA, 19 nt, Homo sapiens
uguauuugucaaugcauca

SEQ ID NO: 1885158 - RNA, 15 nt, Homo sapiens
cccuguacugaagaa

SEQ ID NO: 1885159 - RNA, 17 nt, Homo sapiens
uuguauacuaccauagu

SEQ ID NO: 1885160 - RNA, 23 nt, Homo sapiens
ucagggggccuuuaaagacuuaa

SEQ ID NO: 1885161 - RNA, 22 nt, Homo sapiens
ugaucaccauguuagccuuaga

SEQ ID NO: 1885162 - RNA, 20 nt, Homo sapiens
acauauggacucugcacaug

SEQ ID NO: 1885163 - RNA, 17 nt, Homo sapiens
uaauuuccuaugccugu

SEQ ID NO: 1885164 - RNA, 17 nt, Homo sapiens
accaggugucaaaugag

SEQ ID NO: 1885165 - RNA, 20 nt, Homo sapiens
augcacaccuaagcccaaau

SEQ ID NO: 1885166 - RNA, 13 nt, Homo sapiens
cugggggccaagg

SEQ ID NO: 1885167 - RNA, 22 nt, Homo sapiens
gggagcaugggacugugccuuu

SEQ ID NO: 1885168 - RNA, 22 nt, Homo sapiens
auaaagugcacaccuuuauuca

SEQ ID NO: 1885169 - RNA, 10 nt, Homo sapiens
ggacuuuguu

SEQ ID NO: 1885170 - RNA, 20 nt, Homo sapiens
ccuuaucguccccugugauu

SEQ ID NO: 1885171 - RNA, 19 nt, Homo sapiens
caagagagaaaagcucacu

SEQ ID NO: 1885172 - RNA, 17 nt, Homo sapiens
aucuggagaaccucauc

SEQ ID NO: 1885173 - RNA, 15 nt, Homo sapiens
acaugaauuacauau

SEQ ID NO: 1885174 - RNA, 13 nt, Homo sapiens
guuguuuuguaca

SEQ ID NO: 1885175 - RNA, 13 nt, Homo sapiens
acacauuuacugu

SEQ ID NO: 1885176 - RNA, 15 nt, Homo sapiens
augaggcuucccaga

SEQ ID NO: 1885177 - RNA, 21 nt, Homo sapiens
cuuucagacuugccaugugac

SEQ ID NO: 1885178 - RNA, 16 nt, Homo sapiens
cgaagaccauacauaa

SEQ ID NO: 1885179 - RNA, 23 nt, Homo sapiens
uacuucccuuuccuccacucccc

SEQ ID NO: 1885180 - RNA, 23 nt, Homo sapiens
gcaaaugcuguauucuucuuugg

SEQ ID NO: 1885181 - RNA, 10 nt, Homo sapiens
uaguuugaua

SEQ ID NO: 1885182 - RNA, 18 nt, Homo sapiens
uucgguacuuacccggag

SEQ ID NO: 1885183 - RNA, 21 nt, Homo sapiens
ccagcagagggggaguagcca

SEQ ID NO: 1885184 - RNA, 20 nt, Homo sapiens
ucgggaaccucacucuugcc

SEQ ID NO: 1885185 - RNA, 14 nt, Homo sapiens
cuuuauugcuccug

SEQ ID NO: 1885186 - RNA, 15 nt, Homo sapiens
gugguauaaucucca

SEQ ID NO: 1885187 - RNA, 11 nt, Homo sapiens
cagucuuccag

SEQ ID NO: 1885188 - RNA, 14 nt, Homo sapiens
uugcccauugcacu

SEQ ID NO: 1885189 - RNA, 19 nt, Homo sapiens
guaauuuuuuuuccuugcc

SEQ ID NO: 1885190 - RNA, 12 nt, Homo sapiens
uacuccuuccuu

SEQ ID NO: 1885191 - RNA, 17 nt, Homo sapiens
aaguccuucaccucacu

SEQ ID NO: 1885192 - RNA, 23 nt, Homo sapiens
cucuuuuuaaagaaaaaugcuaa

SEQ ID NO: 1885193 - RNA, 16 nt, Homo sapiens
uugaguggacagcagc

SEQ ID NO: 1885194 - RNA, 17 nt, Homo sapiens
gaaauauuaagagcuau

SEQ ID NO: 1885195 - RNA, 14 nt, Homo sapiens
auuuuacaguaucu

SEQ ID NO: 1885196 - RNA, 17 nt, Homo sapiens
auucaauuaaagaaaua

SEQ ID NO: 1885197 - RNA, 20 nt, Homo sapiens
ucgagugccccugcagggga

SEQ ID NO: 1885198 - RNA, 12 nt, Homo sapiens
acaucaaugaug

SEQ ID NO: 1885199 - RNA, 18 nt, Homo sapiens
uaugcccugcagagcaau

SEQ ID NO: 1885200 - RNA, 16 nt, Homo sapiens
cccaagggcccagacc

SEQ ID NO: 1885201 - RNA, 16 nt, Homo sapiens
cccuccuuuucacgga

SEQ ID NO: 1885202 - RNA, 14 nt, Homo sapiens
uucaucucccaaag

SEQ ID NO: 1885203 - RNA, 16 nt, Homo sapiens
cuacuuaaacaaaaac

SEQ ID NO: 1885204 - RNA, 20 nt, Homo sapiens
acuuguuaaaaaaauuaaau

SEQ ID NO: 1885205 - RNA, 18 nt, Homo sapiens
ucauauuguaaucuaugu

SEQ ID NO: 1885206 - RNA, 15 nt, Homo sapiens
guaauagaauaaagg

SEQ ID NO: 1885207 - RNA, 16 nt, Homo sapiens
ucuuaugaaaugggcu

SEQ ID NO: 1885208 - RNA, 15 nt, Homo sapiens
ucuugaaguacuuaa

SEQ ID NO: 1885209 - RNA, 22 nt, Homo sapiens
uacaagaguuucaaaacauaca

SEQ ID NO: 1885210 - RNA, 21 nt, Homo sapiens
ugccaucauuguaacaugaca

SEQ ID NO: 1885211 - RNA, 21 nt, Homo sapiens
uaugcagaauuugauucguau

SEQ ID NO: 1885212 - RNA, 19 nt, Homo sapiens
caacauuuugagaacaaag

SEQ ID NO: 1885213 - RNA, 20 nt, Homo sapiens
uccaaugcacugauguguga

SEQ ID NO: 1885214 - RNA, 13 nt, Homo sapiens
aacucacaggugu

SEQ ID NO: 1885215 - RNA, 17 nt, Homo sapiens
aacgcacaacaugcaca

SEQ ID NO: 1885216 - RNA, 15 nt, Homo sapiens
acacauuacgugcuc

SEQ ID NO: 1885217 - RNA, 15 nt, Homo sapiens
ccuuuuguguaauaa

SEQ ID NO: 1885218 - RNA, 16 nt, Homo sapiens
gauaucagcacuggau

SEQ ID NO: 1885219 - RNA, 19 nt, Homo sapiens
aaucacaaccacaaccaac

SEQ ID NO: 1885220 - RNA, 12 nt, Homo sapiens
caagaaacagaa

SEQ ID NO: 1885221 - RNA, 22 nt, Homo sapiens
aacuaagguacggugagacucu

SEQ ID NO: 1885222 - RNA, 14 nt, Homo sapiens
ugaaaccaaaacau

SEQ ID NO: 1885223 - RNA, 19 nt, Homo sapiens
cuagcccuuacguccuucc

SEQ ID NO: 1885224 - RNA, 15 nt, Homo sapiens
ugaagaauauuuaac

SEQ ID NO: 1885225 - RNA, 17 nt, Homo sapiens
cggaagaaaaagagcca

SEQ ID NO: 1885226 - RNA, 15 nt, Homo sapiens
uuagagagagaacuu

SEQ ID NO: 1885227 - RNA, 12 nt, Homo sapiens
aggaacuuuuaa

SEQ ID NO: 1885228 - RNA, 18 nt, Homo sapiens
cugggagauacagccauc

SEQ ID NO: 1885229 - RNA, 18 nt, Homo sapiens
agugacaagugaccccca

SEQ ID NO: 1885230 - RNA, 20 nt, Homo sapiens
cuaagccaagagucauguca

SEQ ID NO: 1885231 - RNA, 18 nt, Homo sapiens
aggaaacuuuuuccaccu

SEQ ID NO: 1885232 - RNA, 21 nt, Homo sapiens
ccauccuggccaacauuguaa

SEQ ID NO: 1885233 - RNA, 18 nt, Homo sapiens
cuuaaggucauaaaaaua

SEQ ID NO: 1885234 - RNA, 15 nt, Homo sapiens
gcccugcccugccac

SEQ ID NO: 1885235 - RNA, 11 nt, Homo sapiens
gagugcacaug

SEQ ID NO: 1885236 - RNA, 22 nt, Homo sapiens
uaaaagucacgugaaacagagu

SEQ ID NO: 1885237 - RNA, 18 nt, Homo sapiens
uuuccagugucacuugac

SEQ ID NO: 1885238 - RNA, 17 nt, Homo sapiens
uguuaaacuuuuuacca

SEQ ID NO: 1885239 - RNA, 23 nt, Homo sapiens
uaacaauaaagcauuuugcaaac

SEQ ID NO: 1885240 - RNA, 14 nt, Homo sapiens
gcauacaugcugcg

SEQ ID NO: 1885241 - RNA, 18 nt, Homo sapiens
ggccaugcuucuugcccc

SEQ ID NO: 1885242 - RNA, 14 nt, Homo sapiens
agccccacuccaca

SEQ ID NO: 1885243 - RNA, 22 nt, Homo sapiens
auucaccaacaacagucagcca

SEQ ID NO: 1885244 - RNA, 19 nt, Homo sapiens
ugggguucucuacaggccu

SEQ ID NO: 1885245 - RNA, 13 nt, Homo sapiens
gugaccaugagaa

SEQ ID NO: 1885246 - RNA, 13 nt, Homo sapiens
cagcuggggagca

SEQ ID NO: 1885247 - RNA, 14 nt, Homo sapiens
gaauuuguccaauu

SEQ ID NO: 1885248 - RNA, 19 nt, Homo sapiens
ugcauuuauuauucucaaa

SEQ ID NO: 1885249 - RNA, 13 nt, Homo sapiens
auguaacacugau

SEQ ID NO: 1885250 - RNA, 22 nt, Homo sapiens
gaugguggcaggaaaauggaca

SEQ ID NO: 1885251 - RNA, 19 nt, Homo sapiens
uuugucuaagaacuucgaa

SEQ ID NO: 1885252 - RNA, 22 nt, Homo sapiens
uucuccguugucauugacuuca

SEQ ID NO: 1885253 - RNA, 19 nt, Homo sapiens
uaugaaagaccuuagacau

SEQ ID NO: 1885254 - RNA, 18 nt, Homo sapiens
aauaugaaagaaaaaugg

SEQ ID NO: 1885255 - RNA, 14 nt, Homo sapiens
aacuggcaguuuuc

SEQ ID NO: 1885256 - RNA, 17 nt, Homo sapiens
cagagaauuacuauuua

SEQ ID NO: 1885257 - RNA, 11 nt, Homo sapiens
aaauauguaaa

SEQ ID NO: 1885258 - RNA, 12 nt, Homo sapiens
agugaaacugca

SEQ ID NO: 1885259 - RNA, 12 nt, Homo sapiens
gaaugcggccca

SEQ ID NO: 1885260 - RNA, 13 nt, Homo sapiens
auccguucauuca

SEQ ID NO: 1885261 - RNA, 23 nt, Homo sapiens
auuuuaauuuuuuuuaguauuua

SEQ ID NO: 1885262 - RNA, 16 nt, Homo sapiens
ugcccuggggaucaaa

SEQ ID NO: 1885263 - RNA, 14 nt, Homo sapiens
gucuuucuauccug

SEQ ID NO: 1885264 - RNA, 16 nt, Homo sapiens
uaaucgcucuuuucca

SEQ ID NO: 1885265 - RNA, 18 nt, Homo sapiens
cugagccuacagaugaac

SEQ ID NO: 1885266 - RNA, 20 nt, Homo sapiens
cucaucuggagggaugagug

SEQ ID NO: 1885267 - RNA, 23 nt, Homo sapiens
caccuagcaucucaugagugcca

SEQ ID NO: 1885268 - RNA, 16 nt, Homo sapiens
aacauggccuuugcuu

SEQ ID NO: 1885269 - RNA, 13 nt, Homo sapiens
aacacacuggcca

SEQ ID NO: 1885270 - RNA, 22 nt, Homo sapiens
cucagauucuucacuggugaga

SEQ ID NO: 1885271 - RNA, 19 nt, Homo sapiens
cauguggaaaacucacaga

SEQ ID NO: 1885272 - RNA, 18 nt, Homo sapiens
augugugugccaagcccu

SEQ ID NO: 1885273 - RNA, 18 nt, Homo sapiens
uucgaggagauaaacuga

SEQ ID NO: 1885274 - RNA, 20 nt, Homo sapiens
caccccagcgccugugcuga

SEQ ID NO: 1885275 - RNA, 12 nt, Homo sapiens
cugcuggucucu

SEQ ID NO: 1885276 - RNA, 22 nt, Homo sapiens
ggauuccucuaagaucuugccu

SEQ ID NO: 1885277 - RNA, 15 nt, Homo sapiens
uguacuagugccauu

SEQ ID NO: 1885278 - RNA, 20 nt, Homo sapiens
uacaaaugaaaacaauccag

SEQ ID NO: 1885279 - RNA, 17 nt, Homo sapiens
caagucuguaccucaaa

SEQ ID NO: 1885280 - RNA, 20 nt, Homo sapiens
cucagaauaaaagaugauuu

SEQ ID NO: 1885281 - RNA, 21 nt, Homo sapiens
gucuuuugagguaaguggaau

SEQ ID NO: 1885282 - RNA, 12 nt, Homo sapiens
ccagaggcaucu

SEQ ID NO: 1885283 - RNA, 22 nt, Homo sapiens
aagaacuacgggcugcucuacu

SEQ ID NO: 1885284 - RNA, 13 nt, Homo sapiens
agagucugugcug

SEQ ID NO: 1885285 - RNA, 22 nt, Homo sapiens
ggcuggggccaccaucccugau

SEQ ID NO: 1885286 - RNA, 21 nt, Homo sapiens
agagguguucugguaaacuga

SEQ ID NO: 1885287 - RNA, 13 nt, Homo sapiens
aagagucuuccaa

SEQ ID NO: 1885288 - RNA, 13 nt, Homo sapiens
uguuccaccaaau

SEQ ID NO: 1885289 - RNA, 21 nt, Homo sapiens
gcacauagugggccuucauua

SEQ ID NO: 1885290 - RNA, 15 nt, Homo sapiens
acuacagcuaugaag

SEQ ID NO: 1885291 - RNA, 20 nt, Homo sapiens
uuugaggaccccuuaaucuu

SEQ ID NO: 1885292 - RNA, 17 nt, Homo sapiens
gagagcuaggagcaaag

SEQ ID NO: 1885293 - RNA, 17 nt, Homo sapiens
gcuucuaucagguccca

SEQ ID NO: 1885294 - RNA, 22 nt, Homo sapiens
cauucuugugacuuacagugcc

SEQ ID NO: 1885295 - RNA, 15 nt, Homo sapiens
gaaaucccugagaca

SEQ ID NO: 1885296 - RNA, 15 nt, Homo sapiens
cucucaccacuucag

SEQ ID NO: 1885297 - RNA, 11 nt, Homo sapiens
ccaaauucuga

SEQ ID NO: 1885298 - RNA, 14 nt, Homo sapiens
cuguugcugccuca

SEQ ID NO: 1885299 - RNA, 21 nt, Homo sapiens
uuaucuauuccugaaauuucu

SEQ ID NO: 1885300 - RNA, 12 nt, Homo sapiens
cagucuucuuca

SEQ ID NO: 1885301 - RNA, 23 nt, Homo sapiens
caacuguuggaauucacuuuauu

SEQ ID NO: 1885302 - RNA, 18 nt, Homo sapiens
uuccaucccuacuuuuca

SEQ ID NO: 1885303 - RNA, 20 nt, Homo sapiens
acaaaauuggaagcugucau

SEQ ID NO: 1885304 - RNA, 23 nt, Homo sapiens
cccucugacucuaagaauucucu

SEQ ID NO: 1885305 - RNA, 17 nt, Homo sapiens
gugagaccccuucucaa

SEQ ID NO: 1885306 - RNA, 18 nt, Homo sapiens
gauacagaaaugcaaaag

SEQ ID NO: 1885307 - RNA, 11 nt, Homo sapiens
aaagugucauc

SEQ ID NO: 1885308 - RNA, 16 nt, Homo sapiens
auauguuuccaucacu

SEQ ID NO: 1885309 - RNA, 14 nt, Homo sapiens
agaugcagggcagu

SEQ ID NO: 1885310 - RNA, 12 nt, Homo sapiens
ugagaacaaagc

SEQ ID NO: 1885311 - RNA, 19 nt, Homo sapiens
ggagaacgagaccugugug

SEQ ID NO: 1885312 - RNA, 18 nt, Homo sapiens
aggguaugggaagccaua

SEQ ID NO: 1885313 - RNA, 14 nt, Homo sapiens
ggcacaaccagaaa

SEQ ID NO: 1885314 - RNA, 14 nt, Homo sapiens
gagauaccaucuca

SEQ ID NO: 1885315 - RNA, 17 nt, Homo sapiens
uccuuuuuuauugaaua

SEQ ID NO: 1885316 - RNA, 24 nt, Homo sapiens
caaccaacggccgacugccuguga

SEQ ID NO: 1885317 - RNA, 14 nt, Homo sapiens
caauuaaugauuca

SEQ ID NO: 1885318 - RNA, 22 nt, Homo sapiens
cugccaucgccuccaucagcca

SEQ ID NO: 1885319 - RNA, 14 nt, Homo sapiens
ugucauccucaugc

SEQ ID NO: 1885320 - RNA, 21 nt, Homo sapiens
ugccugggaagcccacccaga

SEQ ID NO: 1885321 - RNA, 16 nt, Homo sapiens
uuguaauggugcuuau

SEQ ID NO: 1885322 - RNA, 23 nt, Homo sapiens
cuuugacguggagcugcucaacu

SEQ ID NO: 1885323 - RNA, 14 nt, Homo sapiens
ugcaguugucucug

SEQ ID NO: 1885324 - RNA, 22 nt, Homo sapiens
caaaugcugugcaaacagugua

SEQ ID NO: 1885325 - RNA, 14 nt, Homo sapiens
guccugcuagcugu

SEQ ID NO: 1885326 - RNA, 23 nt, Homo sapiens
acauuuuuaagugcugcauuuaa

SEQ ID NO: 1885327 - RNA, 12 nt, Homo sapiens
ccucagggccag

SEQ ID NO: 1885328 - RNA, 21 nt, Homo sapiens
uguguuacugcuuugcaaaga

SEQ ID NO: 1885329 - RNA, 14 nt, Homo sapiens
ucacccuguccaaa

SEQ ID NO: 1885330 - RNA, 14 nt, Homo sapiens
uugagagacacugg

SEQ ID NO: 1885331 - RNA, 23 nt, Homo sapiens
uucaaacaggccaggcuccagca

SEQ ID NO: 1885332 - RNA, 16 nt, Homo sapiens
gaaauuauuucucuca

SEQ ID NO: 1885333 - RNA, 15 nt, Homo sapiens
aaaaugcauuaggga

SEQ ID NO: 1885334 - RNA, 21 nt, Homo sapiens
cgugagauccggcagcacaag

SEQ ID NO: 1885335 - RNA, 15 nt, Homo sapiens
aguagaaauuguucc

SEQ ID NO: 1885336 - RNA, 20 nt, Homo sapiens
ugcccucucacugacuucuc

SEQ ID NO: 1885337 - RNA, 15 nt, Homo sapiens
uguaucaaaugugac

SEQ ID NO: 1885338 - RNA, 18 nt, Homo sapiens
aauucuuuggaacuuuaa

SEQ ID NO: 1885339 - RNA, 14 nt, Homo sapiens
aaggucuacauuac

SEQ ID NO: 1885340 - RNA, 20 nt, Homo sapiens
acacugcauguuugugauug

SEQ ID NO: 1885341 - RNA, 14 nt, Homo sapiens
cagcccauucccaa

SEQ ID NO: 1885342 - RNA, 20 nt, Homo sapiens
ccuagauguuuaacaaaucu

SEQ ID NO: 1885343 - RNA, 15 nt, Homo sapiens
caggcuggucucaaa

SEQ ID NO: 1885344 - RNA, 20 nt, Homo sapiens
aauguucacauagugaaaua

SEQ ID NO: 1885345 - RNA, 15 nt, Homo sapiens
uaucgggaacagugu

SEQ ID NO: 1885346 - RNA, 19 nt, Homo sapiens
cuugggucagguucuugcc

SEQ ID NO: 1885347 - RNA, 20 nt, Homo sapiens
aagagagcucguuccuaccu

SEQ ID NO: 1885348 - RNA, 19 nt, Homo sapiens
cucuguaacaguugcauug

SEQ ID NO: 1885349 - RNA, 12 nt, Homo sapiens
ucucccuuccac

SEQ ID NO: 1885350 - RNA, 12 nt, Homo sapiens
ucugccuuccag

SEQ ID NO: 1885351 - RNA, 15 nt, Homo sapiens
gccagccccaagcug

SEQ ID NO: 1885352 - RNA, 21 nt, Homo sapiens
aggguggugaccaaugcauua

SEQ ID NO: 1885353 - RNA, 11 nt, Homo sapiens
acaugauuuca

SEQ ID NO: 1885354 - RNA, 22 nt, Homo sapiens
aacuuauucucuguaggccaaa

SEQ ID NO: 1885355 - RNA, 16 nt, Homo sapiens
uguacucacugaguaa

SEQ ID NO: 1885356 - RNA, 19 nt, Homo sapiens
cuuccagaccugcuuccug

SEQ ID NO: 1885357 - RNA, 16 nt, Homo sapiens
uuacaaaggugaaaau

SEQ ID NO: 1885358 - RNA, 15 nt, Homo sapiens
aagccuaacauuggu

SEQ ID NO: 1885359 - RNA, 17 nt, Homo sapiens
guguugcuauguguacu

SEQ ID NO: 1885360 - RNA, 16 nt, Homo sapiens
gcacaagaaggccagc

SEQ ID NO: 1885361 - RNA, 19 nt, Homo sapiens
ggucuucuaccucagacac

SEQ ID NO: 1885362 - RNA, 15 nt, Homo sapiens
agcacacauccaaga

SEQ ID NO: 1885363 - RNA, 16 nt, Homo sapiens
gaaaaaccugcucccu

SEQ ID NO: 1885364 - RNA, 17 nt, Homo sapiens
agagacucacacuggac

SEQ ID NO: 1885365 - RNA, 22 nt, Homo sapiens
caacuugaacuucaccugcaaa

SEQ ID NO: 1885366 - RNA, 21 nt, Homo sapiens
auacaucugagguccugugau

SEQ ID NO: 1885367 - RNA, 23 nt, Homo sapiens
ccugccccacuucucuacucugg

SEQ ID NO: 1885368 - RNA, 19 nt, Homo sapiens
gagcuuucuuugcacuuaa

SEQ ID NO: 1885369 - RNA, 20 nt, Homo sapiens
aucauauauauaguuaugca

SEQ ID NO: 1885370 - RNA, 15 nt, Homo sapiens
uccaaaaacagcagg

SEQ ID NO: 1885371 - RNA, 18 nt, Homo sapiens
gggccuggguguguguga

SEQ ID NO: 1885372 - RNA, 22 nt, Homo sapiens
aaaugaaaagcuuaggaccaga

SEQ ID NO: 1885373 - RNA, 21 nt, Homo sapiens
cucgccaagcaggacagugcu

SEQ ID NO: 1885374 - RNA, 16 nt, Homo sapiens
aauuugugauggaauc

SEQ ID NO: 1885375 - RNA, 19 nt, Homo sapiens
cagugugcccaggauugaa

SEQ ID NO: 1885376 - RNA, 15 nt, Homo sapiens
agcuucuuacuggau

SEQ ID NO: 1885377 - RNA, 19 nt, Homo sapiens
uaugugugugugugcauau

SEQ ID NO: 1885378 - RNA, 15 nt, Homo sapiens
uuuuaauccuaccuc

SEQ ID NO: 1885379 - RNA, 19 nt, Homo sapiens
uaaggcaaugguuucacau

SEQ ID NO: 1885380 - RNA, 16 nt, Homo sapiens
cuucucaucacacaca

SEQ ID NO: 1885381 - RNA, 23 nt, Homo sapiens
guucuuuggaaaguacacucugc

SEQ ID NO: 1885382 - RNA, 13 nt, Homo sapiens
uaaucucaaagga

SEQ ID NO: 1885383 - RNA, 16 nt, Homo sapiens
gugcaggcuggccagc

SEQ ID NO: 1885384 - RNA, 18 nt, Homo sapiens
cacugaagagagcauuug

SEQ ID NO: 1885385 - RNA, 22 nt, Homo sapiens
gccuggucaggcccuggugcga

SEQ ID NO: 1885386 - RNA, 16 nt, Homo sapiens
uagacauacagagaua

SEQ ID NO: 1885387 - RNA, 13 nt, Homo sapiens
cccaucaauucuu

SEQ ID NO: 1885388 - RNA, 15 nt, Homo sapiens
cuuugcgacuuguca

SEQ ID NO: 1885389 - RNA, 19 nt, Homo sapiens
gcuaucaagaggcugagac

SEQ ID NO: 1885390 - RNA, 13 nt, Homo sapiens
gaaguucagugau

SEQ ID NO: 1885391 - RNA, 21 nt, Homo sapiens
accaaauucuauacauguaua

SEQ ID NO: 1885392 - RNA, 13 nt, Homo sapiens
aaugcugccaugc

SEQ ID NO: 1885393 - RNA, 13 nt, Homo sapiens
auuacugccuuac

SEQ ID NO: 1885394 - RNA, 13 nt, Homo sapiens
cauugugcaauug

SEQ ID NO: 1885395 - RNA, 17 nt, Homo sapiens
aucuagagaaggcauuu

SEQ ID NO: 1885396 - RNA, 19 nt, Homo sapiens
gaaugcuccagucaacaaa

SEQ ID NO: 1885397 - RNA, 16 nt, Homo sapiens
cagccuucagucacau

SEQ ID NO: 1885398 - RNA, 12 nt, Homo sapiens
caagcuguggua

SEQ ID NO: 1885399 - RNA, 19 nt, Homo sapiens
augcugcuuuccccugugg

SEQ ID NO: 1885400 - RNA, 12 nt, Homo sapiens
ugacguccuucc

SEQ ID NO: 1885401 - RNA, 17 nt, Homo sapiens
uucaggagaaucuacac

SEQ ID NO: 1885402 - RNA, 21 nt, Homo sapiens
ugacauggagaccgugaccag

SEQ ID NO: 1885403 - RNA, 17 nt, Homo sapiens
uauauugggcgauuugg

SEQ ID NO: 1885404 - RNA, 21 nt, Homo sapiens
aaaaugugaauugcaugacuu

SEQ ID NO: 1885405 - RNA, 17 nt, Homo sapiens
ugccugacucagugacc

SEQ ID NO: 1885406 - RNA, 14 nt, Homo sapiens
acuccucugucaua

SEQ ID NO: 1885407 - RNA, 16 nt, Homo sapiens
cacuuccccuccuacc

SEQ ID NO: 1885408 - RNA, 14 nt, Homo sapiens
aguggucacuguca

SEQ ID NO: 1885409 - RNA, 18 nt, Homo sapiens
auuugcuacugucauuuc

SEQ ID NO: 1885410 - RNA, 21 nt, Homo sapiens
ucucaggacagaaccacugag

SEQ ID NO: 1885411 - RNA, 21 nt, Homo sapiens
acugugaaggaacucugcagu

SEQ ID NO: 1885412 - RNA, 22 nt, Homo sapiens
auauaagggaaguaguuaucau

SEQ ID NO: 1885413 - RNA, 22 nt, Homo sapiens
cuuugcuaaugcuaugcaaaaa

SEQ ID NO: 1885414 - RNA, 20 nt, Homo sapiens
aacacacagauuugagcuca

SEQ ID NO: 1885415 - RNA, 16 nt, Homo sapiens
ucaccaccaucuccag

SEQ ID NO: 1885416 - RNA, 18 nt, Homo sapiens
gacuuugcugcauuuuac

SEQ ID NO: 1885417 - RNA, 15 nt, Homo sapiens
agaacaacuaccuga

SEQ ID NO: 1885418 - RNA, 22 nt, Homo sapiens
agccccuuacuaugaucucagg

SEQ ID NO: 1885419 - RNA, 18 nt, Homo sapiens
cuuuaccauaaagccuuu

SEQ ID NO: 1885420 - RNA, 17 nt, Homo sapiens
ugccuaguuuugaugaa

SEQ ID NO: 1885421 - RNA, 18 nt, Homo sapiens
aaguaauuuucuucucau

SEQ ID NO: 1885422 - RNA, 20 nt, Homo sapiens
cggcuucccaaagugcugag

SEQ ID NO: 1885423 - RNA, 17 nt, Homo sapiens
auauuagauuacuaagu

SEQ ID NO: 1885424 - RNA, 21 nt, Homo sapiens
auggcaauugcacucaugugg

SEQ ID NO: 1885425 - RNA, 19 nt, Homo sapiens
ggugacaucacucuaggaa

SEQ ID NO: 1885426 - RNA, 18 nt, Homo sapiens
auucugagacauguguca

SEQ ID NO: 1885427 - RNA, 19 nt, Homo sapiens
uggggauuccacuaucuca

SEQ ID NO: 1885428 - RNA, 13 nt, Homo sapiens
guguccaugugug

SEQ ID NO: 1885429 - RNA, 19 nt, Homo sapiens
gagaaaaguccacagugau

SEQ ID NO: 1885430 - RNA, 23 nt, Homo sapiens
aauguuaagacuugacaguggaa

SEQ ID NO: 1885431 - RNA, 19 nt, Homo sapiens
auacugggugcugucacca

SEQ ID NO: 1885432 - RNA, 15 nt, Homo sapiens
uggucaggagccucu

SEQ ID NO: 1885433 - RNA, 17 nt, Homo sapiens
cugggaugaggggugcu

SEQ ID NO: 1885434 - RNA, 22 nt, Homo sapiens
ccaaugcugucugguugcgcca

SEQ ID NO: 1885435 - RNA, 21 nt, Homo sapiens
gcagaaucuguuaccagagga

SEQ ID NO: 1885436 - RNA, 21 nt, Homo sapiens
cccccuguauucucagcacuu

SEQ ID NO: 1885437 - RNA, 15 nt, Homo sapiens
uuaaaccaugcucug

SEQ ID NO: 1885438 - RNA, 22 nt, Homo sapiens
aauggaaaaugauuuuacuuag

SEQ ID NO: 1885439 - RNA, 17 nt, Homo sapiens
aagaagauguccgugag

SEQ ID NO: 1885440 - RNA, 21 nt, Homo sapiens
gcuacuaccuagggcacuuua

SEQ ID NO: 1885441 - RNA, 20 nt, Homo sapiens
uugaaucuaaaaccaaauau

SEQ ID NO: 1885442 - RNA, 19 nt, Homo sapiens
ugaagacccccuccaaaga

SEQ ID NO: 1885443 - RNA, 15 nt, Homo sapiens
cuggaugcagccuca

SEQ ID NO: 1885444 - RNA, 14 nt, Homo sapiens
aagacaucaaugaa

SEQ ID NO: 1885445 - RNA, 19 nt, Homo sapiens
uuccaaacaauuuagccag

SEQ ID NO: 1885446 - RNA, 21 nt, Homo sapiens
uuacuaagaugaaauugccaa

SEQ ID NO: 1885447 - RNA, 21 nt, Homo sapiens
uuuuccuuauuuuuacuugua

SEQ ID NO: 1885448 - RNA, 13 nt, Homo sapiens
agugcuggcugcu

SEQ ID NO: 1885449 - RNA, 15 nt, Homo sapiens
aacaaaaacuguugc

SEQ ID NO: 1885450 - RNA, 21 nt, Homo sapiens
uaagugggguagacugaggga

SEQ ID NO: 1885451 - RNA, 23 nt, Homo sapiens
ucuuaauauaaauucacuuucau

SEQ ID NO: 1885452 - RNA, 13 nt, Homo sapiens
uauaggucacuuu

SEQ ID NO: 1885453 - RNA, 13 nt, Homo sapiens
uacaucugccuua

SEQ ID NO: 1885454 - RNA, 22 nt, Homo sapiens
aacuuuguggaugucuuccuug

SEQ ID NO: 1885455 - RNA, 20 nt, Homo sapiens
aggcccugccuucagcccug

SEQ ID NO: 1885456 - RNA, 13 nt, Homo sapiens
ccugagagucagc

SEQ ID NO: 1885457 - RNA, 23 nt, Homo sapiens
auuuagacucugguauggccaaa

SEQ ID NO: 1885458 - RNA, 22 nt, Homo sapiens
gaaaaccucuuucggaaaugau

SEQ ID NO: 1885459 - RNA, 18 nt, Homo sapiens
cuaaaccaaucaaauguc

SEQ ID NO: 1885460 - RNA, 16 nt, Homo sapiens
gucauaagugacaguu

SEQ ID NO: 1885461 - RNA, 15 nt, Homo sapiens
augccacccuagcca

SEQ ID NO: 1885462 - RNA, 15 nt, Homo sapiens
gggccaaccucaggc

SEQ ID NO: 1885463 - RNA, 17 nt, Homo sapiens
acauuaaguaaaugcug

SEQ ID NO: 1885464 - RNA, 15 nt, Homo sapiens
aagccuaccaaugua

SEQ ID NO: 1885465 - RNA, 23 nt, Homo sapiens
cugaaguaugguauuacaaaaca

SEQ ID NO: 1885466 - RNA, 15 nt, Homo sapiens
acugguuuucugcca

SEQ ID NO: 1885467 - RNA, 22 nt, Homo sapiens
guacuuuguuuuuccauguguu

SEQ ID NO: 1885468 - RNA, 15 nt, Homo sapiens
aaagaggguaacaau

SEQ ID NO: 1885469 - RNA, 19 nt, Homo sapiens
aauugugagaauuacuguu

SEQ ID NO: 1885470 - RNA, 16 nt, Homo sapiens
uccaugauguuuucca

SEQ ID NO: 1885471 - RNA, 20 nt, Homo sapiens
accagguguuaaaaaccauu

SEQ ID NO: 1885472 - RNA, 16 nt, Homo sapiens
uugaagcugacucaaa

SEQ ID NO: 1885473 - RNA, 21 nt, Homo sapiens
cuucugugucugucaccacau

SEQ ID NO: 1885474 - RNA, 18 nt, Homo sapiens
cacugcccccugcugcca

SEQ ID NO: 1885475 - RNA, 15 nt, Homo sapiens
augcauguauguagg

SEQ ID NO: 1885476 - RNA, 18 nt, Homo sapiens
auacugaccuuguagcua

SEQ ID NO: 1885477 - RNA, 12 nt, Homo sapiens
gaauaaagccuc

SEQ ID NO: 1885478 - RNA, 15 nt, Homo sapiens
uugugccaaacuaua

SEQ ID NO: 1885479 - RNA, 15 nt, Homo sapiens
agugcuauugcagag

SEQ ID NO: 1885480 - RNA, 18 nt, Homo sapiens
uaacuagaggagaauuua

SEQ ID NO: 1885481 - RNA, 12 nt, Homo sapiens
acuccuacuaaa

SEQ ID NO: 1885482 - RNA, 12 nt, Homo sapiens
auauuacuugcc

SEQ ID NO: 1885483 - RNA, 23 nt, Homo sapiens
uuaacuuuuugccaaauaaaaua

SEQ ID NO: 1885484 - RNA, 23 nt, Homo sapiens
cacaaugcauaaugucuuuaaaa

SEQ ID NO: 1885485 - RNA, 22 nt, Homo sapiens
aggaagucauccagucuauuca

SEQ ID NO: 1885486 - RNA, 12 nt, Homo sapiens
ugguuacuguau

SEQ ID NO: 1885487 - RNA, 18 nt, Homo sapiens
ccauggaagguucucugu

SEQ ID NO: 1885488 - RNA, 14 nt, Homo sapiens
cgaggacacagugg

SEQ ID NO: 1885489 - RNA, 19 nt, Homo sapiens
cccauagcagcagugcaug

SEQ ID NO: 1885490 - RNA, 14 nt, Homo sapiens
auaucaaaagcaaa

SEQ ID NO: 1885491 - RNA, 18 nt, Homo sapiens
uguuaugguaaccauucu

SEQ ID NO: 1885492 - RNA, 12 nt, Homo sapiens
uauacacccaga

SEQ ID NO: 1885493 - RNA, 14 nt, Homo sapiens
ggcugaugaugucu

SEQ ID NO: 1885494 - RNA, 16 nt, Homo sapiens
gaacuaugaacuacaa

SEQ ID NO: 1885495 - RNA, 16 nt, Homo sapiens
aguguaguuggaucuc

SEQ ID NO: 1885496 - RNA, 16 nt, Homo sapiens
cuaggguaugggaaau

SEQ ID NO: 1885497 - RNA, 21 nt, Homo sapiens
cagaagcaugaucacagcuca

SEQ ID NO: 1885498 - RNA, 18 nt, Homo sapiens
aaucuuucugaacuguaa

SEQ ID NO: 1885499 - RNA, 17 nt, Homo sapiens
ucuccuaaagcuuuuau

SEQ ID NO: 1885500 - RNA, 14 nt, Homo sapiens
gguugacugauguu

SEQ ID NO: 1885501 - RNA, 19 nt, Homo sapiens
uccuuacauaugcaaaaau

SEQ ID NO: 1885502 - RNA, 16 nt, Homo sapiens
agacuucagacuuuca

SEQ ID NO: 1885503 - RNA, 16 nt, Homo sapiens
uaaugucauuuaauaa

SEQ ID NO: 1885504 - RNA, 13 nt, Homo sapiens
uguuggcaauuau

SEQ ID NO: 1885505 - RNA, 16 nt, Homo sapiens
ggaaauauuaugcaaa

SEQ ID NO: 1885506 - RNA, 14 nt, Homo sapiens
gccccucacacugc

SEQ ID NO: 1885507 - RNA, 15 nt, Homo sapiens
uuuucuugauuugag

SEQ ID NO: 1885508 - RNA, 15 nt, Homo sapiens
uucuguugaucucag

SEQ ID NO: 1885509 - RNA, 15 nt, Homo sapiens
ccuagaaguggcaga

SEQ ID NO: 1885510 - RNA, 16 nt, Homo sapiens
gacagagguugcagug

SEQ ID NO: 1885511 - RNA, 16 nt, Homo sapiens
ccagugggacccacag

SEQ ID NO: 1885512 - RNA, 19 nt, Homo sapiens
cuggacuggcccuugccca

SEQ ID NO: 1885513 - RNA, 17 nt, Homo sapiens
uuagccagguaauguga

SEQ ID NO: 1885514 - RNA, 21 nt, Homo sapiens
uacuacuugccacacacuguu

SEQ ID NO: 1885515 - RNA, 21 nt, Homo sapiens
ccucugauguucuuccaguga

SEQ ID NO: 1885516 - RNA, 21 nt, Homo sapiens
ugaaaaugugcucuacaucuc

SEQ ID NO: 1885517 - RNA, 16 nt, Homo sapiens
cugcugcauccaggac

SEQ ID NO: 1885518 - RNA, 21 nt, Homo sapiens
uuuucuaaacaagaaccauuu

SEQ ID NO: 1885519 - RNA, 18 nt, Homo sapiens
gugauauauuucuaugug

SEQ ID NO: 1885520 - RNA, 13 nt, Homo sapiens
uuagaaaauauuc

SEQ ID NO: 1885521 - RNA, 20 nt, Homo sapiens
gcagucggugguaccugaga

SEQ ID NO: 1885522 - RNA, 14 nt, Homo sapiens
guccccagccugcu

SEQ ID NO: 1885523 - RNA, 13 nt, Homo sapiens
acagcguuuacau

SEQ ID NO: 1885524 - RNA, 13 nt, Homo sapiens
acugccaccagca

SEQ ID NO: 1885525 - RNA, 14 nt, Homo sapiens
ccucucucugcucc

SEQ ID NO: 1885526 - RNA, 17 nt, Homo sapiens
aacaguaccugugccug

SEQ ID NO: 1885527 - RNA, 14 nt, Homo sapiens
acuuugaucucugc

SEQ ID NO: 1885528 - RNA, 18 nt, Homo sapiens
gacgugauuuugcuguag

SEQ ID NO: 1885529 - RNA, 15 nt, Homo sapiens
aggagccuguccugc

SEQ ID NO: 1885530 - RNA, 19 nt, Homo sapiens
aguauacuagggagccauu

SEQ ID NO: 1885531 - RNA, 13 nt, Homo sapiens
ugcaaaugcuuua

SEQ ID NO: 1885532 - RNA, 16 nt, Homo sapiens
aggauggucucugcca

SEQ ID NO: 1885533 - RNA, 16 nt, Homo sapiens
auggccuuugcuuaug

SEQ ID NO: 1885534 - RNA, 16 nt, Homo sapiens
aacuaccauuguaaua

SEQ ID NO: 1885535 - RNA, 19 nt, Homo sapiens
cucccagguucaagugauu

SEQ ID NO: 1885536 - RNA, 14 nt, Homo sapiens
gcuugauguuacaa

SEQ ID NO: 1885537 - RNA, 16 nt, Homo sapiens
cucagccuccugagua

SEQ ID NO: 1885538 - RNA, 21 nt, Homo sapiens
gaguccaguccuuuguugcug

SEQ ID NO: 1885539 - RNA, 19 nt, Homo sapiens
ugggagugugucugcugag

SEQ ID NO: 1885540 - RNA, 14 nt, Homo sapiens
uaaaugacaaugua

SEQ ID NO: 1885541 - RNA, 16 nt, Homo sapiens
ucccauucgcaauaag

SEQ ID NO: 1885542 - RNA, 23 nt, Homo sapiens
gccuggaucuccccacucuaggg

SEQ ID NO: 1885543 - RNA, 22 nt, Homo sapiens
uauaauucuuauggcugcugaa

SEQ ID NO: 1885544 - RNA, 11 nt, Homo sapiens
cauuacugugu

SEQ ID NO: 1885545 - RNA, 17 nt, Homo sapiens
gguauugucuacucuga

SEQ ID NO: 1885546 - RNA, 16 nt, Homo sapiens
gaguucaaugaucuag

SEQ ID NO: 1885547 - RNA, 22 nt, Homo sapiens
ucccuuuucuuuaaguuuuauu

SEQ ID NO: 1885548 - RNA, 13 nt, Homo sapiens
acuccgaacaauu

SEQ ID NO: 1885549 - RNA, 17 nt, Homo sapiens
uguuuuaaauguacaga

SEQ ID NO: 1885550 - RNA, 15 nt, Homo sapiens
agauccagacuguaa

SEQ ID NO: 1885551 - RNA, 17 nt, Homo sapiens
cagcagacaccauucau

SEQ ID NO: 1885552 - RNA, 16 nt, Homo sapiens
aaaacaaaaacaccua

SEQ ID NO: 1885553 - RNA, 14 nt, Homo sapiens
ggaugucuguagca

SEQ ID NO: 1885554 - RNA, 18 nt, Homo sapiens
gagcaguggcccauguga

SEQ ID NO: 1885555 - RNA, 23 nt, Homo sapiens
guucaucauccuaagcuauucag

SEQ ID NO: 1885556 - RNA, 15 nt, Homo sapiens
uacuuaaugugaugc

SEQ ID NO: 1885557 - RNA, 14 nt, Homo sapiens
acuucgaaaccugg

SEQ ID NO: 1885558 - RNA, 18 nt, Homo sapiens
uacagggcauucaaaugg

SEQ ID NO: 1885559 - RNA, 15 nt, Homo sapiens
aauaauuuauuacaa

SEQ ID NO: 1885560 - RNA, 21 nt, Homo sapiens
gccguucuguuccaaccuccu

SEQ ID NO: 1885561 - RNA, 21 nt, Homo sapiens
gacuggcauccauaagugugc

SEQ ID NO: 1885562 - RNA, 17 nt, Homo sapiens
ccuggucaauaaaccac

SEQ ID NO: 1885563 - RNA, 17 nt, Homo sapiens
cagcgcagaaugaaggg

SEQ ID NO: 1885564 - RNA, 17 nt, Homo sapiens
uuauuuuccccaaccuc

SEQ ID NO: 1885565 - RNA, 16 nt, Homo sapiens
uacaguugaugucgau

SEQ ID NO: 1885566 - RNA, 18 nt, Homo sapiens
uucuuggugguggaugac

SEQ ID NO: 1885567 - RNA, 13 nt, Homo sapiens
ucagaacaugaaa

SEQ ID NO: 1885568 - RNA, 17 nt, Homo sapiens
uccaccaaaugugcuuu

SEQ ID NO: 1885569 - RNA, 21 nt, Homo sapiens
cuaauuuuccauaagcuauuu

SEQ ID NO: 1885570 - RNA, 15 nt, Homo sapiens
cagauccaccugcac

SEQ ID NO: 1885571 - RNA, 15 nt, Homo sapiens
accaggccaucccca

SEQ ID NO: 1885572 - RNA, 12 nt, Homo sapiens
acagaugcacaa

SEQ ID NO: 1885573 - RNA, 13 nt, Homo sapiens
cagccuucaauca

SEQ ID NO: 1885574 - RNA, 21 nt, Homo sapiens
gagcacguggagauagugcca

SEQ ID NO: 1885575 - RNA, 17 nt, Homo sapiens
auccauaaagacaauca

SEQ ID NO: 1885576 - RNA, 15 nt, Homo sapiens
aacaguuggcuguau

SEQ ID NO: 1885577 - RNA, 23 nt, Homo sapiens
gaugauuguucuuuuguuucauu

SEQ ID NO: 1885578 - RNA, 14 nt, Homo sapiens
aaccagccaggcag

SEQ ID NO: 1885579 - RNA, 18 nt, Homo sapiens
agaaaggcauugcacaga

SEQ ID NO: 1885580 - RNA, 17 nt, Homo sapiens
gcaaaauccuggugaug

SEQ ID NO: 1885581 - RNA, 13 nt, Homo sapiens
agcugaccuggua

SEQ ID NO: 1885582 - RNA, 13 nt, Homo sapiens
caaagugcuggga

SEQ ID NO: 1885583 - RNA, 16 nt, Homo sapiens
acagggccucaguuuc

SEQ ID NO: 1885584 - RNA, 19 nt, Homo sapiens
gucaugccaagcauuuaau

SEQ ID NO: 1885585 - RNA, 14 nt, Homo sapiens
uuaugucaaaugga

SEQ ID NO: 1885586 - RNA, 14 nt, Homo sapiens
agagcagcuggcuc

SEQ ID NO: 1885587 - RNA, 18 nt, Homo sapiens
auacaggugacagugaag

SEQ ID NO: 1885588 - RNA, 18 nt, Homo sapiens
uguacaaauaauauugcc

SEQ ID NO: 1885589 - RNA, 14 nt, Homo sapiens
ugggguaugggaga

SEQ ID NO: 1885590 - RNA, 14 nt, Homo sapiens
uuggaaaugugaau

SEQ ID NO: 1885591 - RNA, 22 nt, Homo sapiens
ucauuccugaaagaaacaguua

SEQ ID NO: 1885592 - RNA, 18 nt, Homo sapiens
uucccaagcccuggugac

SEQ ID NO: 1885593 - RNA, 14 nt, Homo sapiens
uuagucaagguaca

SEQ ID NO: 1885594 - RNA, 21 nt, Homo sapiens
aaacauuuaacuuguuuccaa

SEQ ID NO: 1885595 - RNA, 14 nt, Homo sapiens
ccuuuaacucuuau

SEQ ID NO: 1885596 - RNA, 14 nt, Homo sapiens
cagauuacuagaaa

SEQ ID NO: 1885597 - RNA, 17 nt, Homo sapiens
cugacucugccagggug

SEQ ID NO: 1885598 - RNA, 19 nt, Homo sapiens
accuguguguaagucccaa

SEQ ID NO: 1885599 - RNA, 13 nt, Homo sapiens
uuaagguacuuaa

SEQ ID NO: 1885600 - RNA, 23 nt, Homo sapiens
gaauacaggaggcagacaaugac

SEQ ID NO: 1885601 - RNA, 23 nt, Homo sapiens
acuagauaucaaucaguaauuaa

SEQ ID NO: 1885602 - RNA, 23 nt, Homo sapiens
cgcaucccugaggcuggacucca

SEQ ID NO: 1885603 - RNA, 17 nt, Homo sapiens
aaacacccaauaccuua

SEQ ID NO: 1885604 - RNA, 15 nt, Homo sapiens
cugacauaugcuaac

SEQ ID NO: 1885605 - RNA, 17 nt, Homo sapiens
ucggguuuuauaugcaa

SEQ ID NO: 1885606 - RNA, 23 nt, Homo sapiens
cggggacugcuucguguucugua

SEQ ID NO: 1885607 - RNA, 14 nt, Homo sapiens
cuuucugggagcag

SEQ ID NO: 1885608 - RNA, 15 nt, Homo sapiens
ggaauuuucuuccaa

SEQ ID NO: 1885609 - RNA, 17 nt, Homo sapiens
uacagauauuugucaug

SEQ ID NO: 1885610 - RNA, 14 nt, Homo sapiens
cuguggucauguaa

SEQ ID NO: 1885611 - RNA, 16 nt, Homo sapiens
uuaguccuaauucaau

SEQ ID NO: 1885612 - RNA, 13 nt, Homo sapiens
aggggcuguguuu

SEQ ID NO: 1885613 - RNA, 14 nt, Homo sapiens
gcccuaauagcaga

SEQ ID NO: 1885614 - RNA, 20 nt, Homo sapiens
aauacucauccuuguauaaa

SEQ ID NO: 1885615 - RNA, 21 nt, Homo sapiens
gaaaaguuuaaagacacuuag

SEQ ID NO: 1885616 - RNA, 17 nt, Homo sapiens
aaccugugaucaagcaa

SEQ ID NO: 1885617 - RNA, 13 nt, Homo sapiens
ucaccaugaucac

SEQ ID NO: 1885618 - RNA, 19 nt, Homo sapiens
uggauacaugguuaaagga

SEQ ID NO: 1885619 - RNA, 17 nt, Homo sapiens
gauucaagccauuccaa

SEQ ID NO: 1885620 - RNA, 18 nt, Homo sapiens
gaaagccguacugucuau

SEQ ID NO: 1885621 - RNA, 13 nt, Homo sapiens
gaauagacaguau

SEQ ID NO: 1885622 - RNA, 20 nt, Homo sapiens
uuacaaguuucuagcucuca

SEQ ID NO: 1885623 - RNA, 16 nt, Homo sapiens
aucgcuuuccuuccuc

SEQ ID NO: 1885624 - RNA, 12 nt, Homo sapiens
agcagcacugga

SEQ ID NO: 1885625 - RNA, 19 nt, Homo sapiens
uaucuuugcacaaucaaua

SEQ ID NO: 1885626 - RNA, 15 nt, Homo sapiens
uguaaauauagugaa

SEQ ID NO: 1885627 - RNA, 18 nt, Homo sapiens
uguuuauucaaaguauuu

SEQ ID NO: 1885628 - RNA, 22 nt, Homo sapiens
cuuguuugaggcaaaucuaaaa

SEQ ID NO: 1885629 - RNA, 18 nt, Homo sapiens
caaaaggagagacuccca

SEQ ID NO: 1885630 - RNA, 22 nt, Homo sapiens
gcagugcaauauuuagcugcua

SEQ ID NO: 1885631 - RNA, 16 nt, Homo sapiens
uaaugcagaaguauuc

SEQ ID NO: 1885632 - RNA, 18 nt, Homo sapiens
aagugcagucugauccag

SEQ ID NO: 1885633 - RNA, 18 nt, Homo sapiens
caucagugucuguuucag

SEQ ID NO: 1885634 - RNA, 18 nt, Homo sapiens
uuugacaacaauccaaaa

SEQ ID NO: 1885635 - RNA, 14 nt, Homo sapiens
agaguuuaguugua

SEQ ID NO: 1885636 - RNA, 16 nt, Homo sapiens
gcauuacucugcacua

SEQ ID NO: 1885637 - RNA, 22 nt, Homo sapiens
gaagugaaaauagccaguuccu

SEQ ID NO: 1885638 - RNA, 16 nt, Homo sapiens
uaaaguucaauuguga

SEQ ID NO: 1885639 - RNA, 15 nt, Homo sapiens
gccuggcuccaaacc

SEQ ID NO: 1885640 - RNA, 18 nt, Homo sapiens
aacaucccaauucuuuag

SEQ ID NO: 1885641 - RNA, 15 nt, Homo sapiens
uucagaaagcuucaa

SEQ ID NO: 1885642 - RNA, 13 nt, Homo sapiens
uuccuaaagccaa

SEQ ID NO: 1885643 - RNA, 15 nt, Homo sapiens
cagagccucuggccc

SEQ ID NO: 1885644 - RNA, 21 nt, Homo sapiens
ucuaaacagacucauuacaaa

SEQ ID NO: 1885645 - RNA, 14 nt, Homo sapiens
aacaguccuucaaa

SEQ ID NO: 1885646 - RNA, 20 nt, Homo sapiens
ggacccaccccaacucuccc

SEQ ID NO: 1885647 - RNA, 16 nt, Homo sapiens
agcaggggcaaugacc

SEQ ID NO: 1885648 - RNA, 16 nt, Homo sapiens
ugcacaaagcccuucc

SEQ ID NO: 1885649 - RNA, 21 nt, Homo sapiens
aagugauccuuccaccucagu

SEQ ID NO: 1885650 - RNA, 15 nt, Homo sapiens
ccucacucuguugcu

SEQ ID NO: 1885651 - RNA, 13 nt, Homo sapiens
auaacucuucuaa

SEQ ID NO: 1885652 - RNA, 21 nt, Homo sapiens
ucauuaaaauuaacaugugcc

SEQ ID NO: 1885653 - RNA, 15 nt, Homo sapiens
gaccuacuaaaaaua

SEQ ID NO: 1885654 - RNA, 13 nt, Homo sapiens
ucugaaacagaga

SEQ ID NO: 1885655 - RNA, 23 nt, Homo sapiens
ugcuaauaugaacagaaaugcau

SEQ ID NO: 1885656 - RNA, 23 nt, Homo sapiens
caaucuuugcuguauacuuuuaa

SEQ ID NO: 1885657 - RNA, 15 nt, Homo sapiens
aucucagaugcaguu

SEQ ID NO: 1885658 - RNA, 21 nt, Homo sapiens
ugcugaaaauguccuugugau

SEQ ID NO: 1885659 - RNA, 20 nt, Homo sapiens
aggucugguuuauuucccag

SEQ ID NO: 1885660 - RNA, 19 nt, Homo sapiens
ucgaacuccaggcuuucug

SEQ ID NO: 1885661 - RNA, 13 nt, Homo sapiens
caaauuccccucc

SEQ ID NO: 1885662 - RNA, 20 nt, Homo sapiens
auuagccauuucacucucaa

SEQ ID NO: 1885663 - RNA, 14 nt, Homo sapiens
uggccuuuaggaag

SEQ ID NO: 1885664 - RNA, 12 nt, Homo sapiens
aaagcugcucag

SEQ ID NO: 1885665 - RNA, 19 nt, Homo sapiens
ugcuuuuugcuuguguaca

SEQ ID NO: 1885666 - RNA, 12 nt, Homo sapiens
uuaaagcaaaaa

SEQ ID NO: 1885667 - RNA, 20 nt, Homo sapiens
gccuacaucccaucauggcu

SEQ ID NO: 1885668 - RNA, 20 nt, Homo sapiens
ugacuuccuccaauccccac

SEQ ID NO: 1885669 - RNA, 14 nt, Homo sapiens
guacuaaacauuuc

SEQ ID NO: 1885670 - RNA, 12 nt, Homo sapiens
cucagugccacu

SEQ ID NO: 1885671 - RNA, 20 nt, Homo sapiens
aucuaggagaagggucucau

SEQ ID NO: 1885672 - RNA, 13 nt, Homo sapiens
uuuaaaugaucau

SEQ ID NO: 1885673 - RNA, 11 nt, Homo sapiens
aggcugagggc

SEQ ID NO: 1885674 - RNA, 18 nt, Homo sapiens
cucaaaggcccucaguga

SEQ ID NO: 1885675 - RNA, 16 nt, Homo sapiens
gucucaguccaugaag

SEQ ID NO: 1885676 - RNA, 19 nt, Homo sapiens
ccaacaacuucuccauccu

SEQ ID NO: 1885677 - RNA, 19 nt, Homo sapiens
ccacccucccagcucugag

SEQ ID NO: 1885678 - RNA, 14 nt, Homo sapiens
uggcucagccuguc

SEQ ID NO: 1885679 - RNA, 13 nt, Homo sapiens
ugauuuacauuuc

SEQ ID NO: 1885680 - RNA, 21 nt, Homo sapiens
aacagcuccauacuucuuuca

SEQ ID NO: 1885681 - RNA, 11 nt, Homo sapiens
ucgcuagucag

SEQ ID NO: 1885682 - RNA, 18 nt, Homo sapiens
cccuaucuccuucccacc

SEQ ID NO: 1885683 - RNA, 17 nt, Homo sapiens
aaugucuuacugugauc

SEQ ID NO: 1885684 - RNA, 17 nt, Homo sapiens
uaccccugauaagcaaa

SEQ ID NO: 1885685 - RNA, 19 nt, Homo sapiens
ucaauaaccuuucacuuaa

SEQ ID NO: 1885686 - RNA, 17 nt, Homo sapiens
uccccugaaaaacugau

SEQ ID NO: 1885687 - RNA, 17 nt, Homo sapiens
acacugcacacaugcac

SEQ ID NO: 1885688 - RNA, 16 nt, Homo sapiens
uccuaucauucccuag

SEQ ID NO: 1885689 - RNA, 20 nt, Homo sapiens
auugagcgccauaagcagaa

SEQ ID NO: 1885690 - RNA, 13 nt, Homo sapiens
gacacucaaucua

SEQ ID NO: 1885691 - RNA, 16 nt, Homo sapiens
aggccugggaccuccc

SEQ ID NO: 1885692 - RNA, 22 nt, Homo sapiens
ucagaccagguggaauuacuua

SEQ ID NO: 1885693 - RNA, 15 nt, Homo sapiens
ugcucuauacugugg

SEQ ID NO: 1885694 - RNA, 15 nt, Homo sapiens
ccuccaccuaccugc

SEQ ID NO: 1885695 - RNA, 18 nt, Homo sapiens
aaguaucuugcacugaua

SEQ ID NO: 1885696 - RNA, 23 nt, Homo sapiens
agugucccauccucucacacuca

SEQ ID NO: 1885697 - RNA, 18 nt, Homo sapiens
acaguggcacaaucaugg

SEQ ID NO: 1885698 - RNA, 14 nt, Homo sapiens
gcguggcacucgcu

SEQ ID NO: 1885699 - RNA, 16 nt, Homo sapiens
cucauuaccagugacu

SEQ ID NO: 1885700 - RNA, 19 nt, Homo sapiens
ccuacagcacuacugggug

SEQ ID NO: 1885701 - RNA, 19 nt, Homo sapiens
auccuaaggugcuuaccuc

SEQ ID NO: 1885702 - RNA, 18 nt, Homo sapiens
ugaaugcacacuagccuc

SEQ ID NO: 1885703 - RNA, 17 nt, Homo sapiens
cagccacuuucugccag

SEQ ID NO: 1885704 - RNA, 13 nt, Homo sapiens
caucuauggugug

SEQ ID NO: 1885705 - RNA, 20 nt, Homo sapiens
gaaugcagcacugcugccuc

SEQ ID NO: 1885706 - RNA, 20 nt, Homo sapiens
uguccuccuuccugggaccc

SEQ ID NO: 1885707 - RNA, 17 nt, Homo sapiens
caagcaaaaugcuuaca

SEQ ID NO: 1885708 - RNA, 21 nt, Homo sapiens
ugcaaaaugucuuguguauuu

SEQ ID NO: 1885709 - RNA, 13 nt, Homo sapiens
ucaagcacuaaaa

SEQ ID NO: 1885710 - RNA, 18 nt, Homo sapiens
ccaguuuauuaacuugag

SEQ ID NO: 1885711 - RNA, 14 nt, Homo sapiens
augaaaauucuuga

SEQ ID NO: 1885712 - RNA, 17 nt, Homo sapiens
cugugaauuucaaaaaa

SEQ ID NO: 1885713 - RNA, 14 nt, Homo sapiens
cugcauauugugau

SEQ ID NO: 1885714 - RNA, 20 nt, Homo sapiens
gcaggugaaacccagucacu

SEQ ID NO: 1885715 - RNA, 21 nt, Homo sapiens
aggaaagccaaacacuguuuc

SEQ ID NO: 1885716 - RNA, 18 nt, Homo sapiens
gauuucugggcacuuuuu

SEQ ID NO: 1885717 - RNA, 19 nt, Homo sapiens
uuagacacuacaacauaug

SEQ ID NO: 1885718 - RNA, 17 nt, Homo sapiens
caggaugaaggggccag

SEQ ID NO: 1885719 - RNA, 12 nt, Homo sapiens
acaccaauuuag

SEQ ID NO: 1885720 - RNA, 19 nt, Homo sapiens
cauccuugagucaaaaaau

SEQ ID NO: 1885721 - RNA, 15 nt, Homo sapiens
accaacccauguaua

SEQ ID NO: 1885722 - RNA, 11 nt, Homo sapiens
ccuacauucaa

SEQ ID NO: 1885723 - RNA, 11 nt, Homo sapiens
uaaacauuucu

SEQ ID NO: 1885724 - RNA, 12 nt, Homo sapiens
cggucccggcug

SEQ ID NO: 1885725 - RNA, 23 nt, Homo sapiens
cuauuuuuguuggggggugggag

SEQ ID NO: 1885726 - RNA, 12 nt, Homo sapiens
uaaacagaauaa

SEQ ID NO: 1885727 - RNA, 20 nt, Homo sapiens
aacucauccacguccugucu

SEQ ID NO: 1885728 - RNA, 13 nt, Homo sapiens
aacaaaaagguaa

SEQ ID NO: 1885729 - RNA, 22 nt, Homo sapiens
cauugcuaccucagugcuccug

SEQ ID NO: 1885730 - RNA, 19 nt, Homo sapiens
aauuaugucuuaguuauaa

SEQ ID NO: 1885731 - RNA, 20 nt, Homo sapiens
auucccucccaucaugcccg

SEQ ID NO: 1885732 - RNA, 14 nt, Homo sapiens
auguucucuaucau

SEQ ID NO: 1885733 - RNA, 22 nt, Homo sapiens
gaagcauuuuauaaaucgcuuu

SEQ ID NO: 1885734 - RNA, 13 nt, Homo sapiens
gaaagaguuucug

SEQ ID NO: 1885735 - RNA, 13 nt, Homo sapiens
gggcaaucuuugc

SEQ ID NO: 1885736 - RNA, 15 nt, Homo sapiens
acaaggcugaggaua

SEQ ID NO: 1885737 - RNA, 17 nt, Homo sapiens
gaaaaugaacugcccac

SEQ ID NO: 1885738 - RNA, 19 nt, Homo sapiens
agucccucacguuucuucc

SEQ ID NO: 1885739 - RNA, 14 nt, Homo sapiens
ugcaccacuuuuaa

SEQ ID NO: 1885740 - RNA, 18 nt, Homo sapiens
cuuacuagaccuguaacu

SEQ ID NO: 1885741 - RNA, 19 nt, Homo sapiens
agagcauuuuuuaugauau

SEQ ID NO: 1885742 - RNA, 17 nt, Homo sapiens
ccuucucccauccaaga

SEQ ID NO: 1885743 - RNA, 15 nt, Homo sapiens
cugaccuugugaucc

SEQ ID NO: 1885744 - RNA, 14 nt, Homo sapiens
cauuugucaacaaa

SEQ ID NO: 1885745 - RNA, 18 nt, Homo sapiens
uaagcagaaagucuucau

SEQ ID NO: 1885746 - RNA, 21 nt, Homo sapiens
uaaauaaccggggauucugua

SEQ ID NO: 1885747 - RNA, 22 nt, Homo sapiens
gauuuacuaaaucaaucugcag

SEQ ID NO: 1885748 - RNA, 12 nt, Homo sapiens
cugugcacagac

SEQ ID NO: 1885749 - RNA, 14 nt, Homo sapiens
caugccaagcacug

SEQ ID NO: 1885750 - RNA, 17 nt, Homo sapiens
cagagauaucuaugaaa

SEQ ID NO: 1885751 - RNA, 15 nt, Homo sapiens
accaugcccagcuag

SEQ ID NO: 1885752 - RNA, 14 nt, Homo sapiens
cugaguugcuuuua

SEQ ID NO: 1885753 - RNA, 18 nt, Homo sapiens
ucacuaaauccuuuccaa

SEQ ID NO: 1885754 - RNA, 14 nt, Homo sapiens
uccuacccacuggu

SEQ ID NO: 1885755 - RNA, 22 nt, Homo sapiens
ugaguaacauuuauuuacauaa

SEQ ID NO: 1885756 - RNA, 21 nt, Homo sapiens
ugacuccaggaaccauuuuca

SEQ ID NO: 1885757 - RNA, 22 nt, Homo sapiens
uguucccuccagcagugguauu

SEQ ID NO: 1885758 - RNA, 19 nt, Homo sapiens
auuuauaccucaguuugca

SEQ ID NO: 1885759 - RNA, 20 nt, Homo sapiens
ucaggccaucaucaguggag

SEQ ID NO: 1885760 - RNA, 17 nt, Homo sapiens
cagcaagggaccugcuc

SEQ ID NO: 1885761 - RNA, 16 nt, Homo sapiens
acaaaccuaccaaaau

SEQ ID NO: 1885762 - RNA, 14 nt, Homo sapiens
acucuugaucucuc

SEQ ID NO: 1885763 - RNA, 13 nt, Homo sapiens
auccuacucaaca

SEQ ID NO: 1885764 - RNA, 17 nt, Homo sapiens
gccugaagccaggccau

SEQ ID NO: 1885765 - RNA, 21 nt, Homo sapiens
uucuucuauauaugaaccuau

SEQ ID NO: 1885766 - RNA, 20 nt, Homo sapiens
gguccuucccucucaugacu

SEQ ID NO: 1885767 - RNA, 13 nt, Homo sapiens
gccucccccaugg

SEQ ID NO: 1885768 - RNA, 18 nt, Homo sapiens
aaucccagcacuuugaua

SEQ ID NO: 1885769 - RNA, 20 nt, Homo sapiens
aggcagugggucccacuucc

SEQ ID NO: 1885770 - RNA, 15 nt, Homo sapiens
aaggggaacgcagag

SEQ ID NO: 1885771 - RNA, 14 nt, Homo sapiens
gcugggccccaccu

SEQ ID NO: 1885772 - RNA, 15 nt, Homo sapiens
auaaaggucauauug

SEQ ID NO: 1885773 - RNA, 20 nt, Homo sapiens
gguaccuagguuggagucca

SEQ ID NO: 1885774 - RNA, 17 nt, Homo sapiens
acuguaccgacuuugau

SEQ ID NO: 1885775 - RNA, 13 nt, Homo sapiens
augcaaugaacac

SEQ ID NO: 1885776 - RNA, 14 nt, Homo sapiens
aggcugacuaagaa

SEQ ID NO: 1885777 - RNA, 16 nt, Homo sapiens
auauucuacuaugcau

SEQ ID NO: 1885778 - RNA, 21 nt, Homo sapiens
cuucaguuuccauccccagga

SEQ ID NO: 1885779 - RNA, 17 nt, Homo sapiens
augcucuuaauugccac

SEQ ID NO: 1885780 - RNA, 18 nt, Homo sapiens
cagcacuuucccucugca

SEQ ID NO: 1885781 - RNA, 22 nt, Homo sapiens
agggcggccuuucccacugguc

SEQ ID NO: 1885782 - RNA, 14 nt, Homo sapiens
ccacuguaugagug

SEQ ID NO: 1885783 - RNA, 19 nt, Homo sapiens
cucacagccccggcccccu

SEQ ID NO: 1885784 - RNA, 18 nt, Homo sapiens
uaugcagccaaccaagau

SEQ ID NO: 1885785 - RNA, 11 nt, Homo sapiens
agaauguuucu

SEQ ID NO: 1885786 - RNA, 12 nt, Homo sapiens
gaacaauuccuu

SEQ ID NO: 1885787 - RNA, 18 nt, Homo sapiens
ugaggggcugacuucaau

SEQ ID NO: 1885788 - RNA, 19 nt, Homo sapiens
aaaauggacaaaauccaug

SEQ ID NO: 1885789 - RNA, 23 nt, Homo sapiens
aauucauauaaagugcaauugca

SEQ ID NO: 1885790 - RNA, 15 nt, Homo sapiens
gacuccugaagggaa

SEQ ID NO: 1885791 - RNA, 15 nt, Homo sapiens
aggaagaagccagac

SEQ ID NO: 1885792 - RNA, 21 nt, Homo sapiens
cagcaguucucugccaaagcu

SEQ ID NO: 1885793 - RNA, 15 nt, Homo sapiens
gaggggagaagccaa

SEQ ID NO: 1885794 - RNA, 19 nt, Homo sapiens
cuccuguggccugccaguc

SEQ ID NO: 1885795 - RNA, 15 nt, Homo sapiens
uuagauucacuuuga

SEQ ID NO: 1885796 - RNA, 13 nt, Homo sapiens
uguucuggcuuua

SEQ ID NO: 1885797 - RNA, 18 nt, Homo sapiens
cuggccggccagccagcc

SEQ ID NO: 1885798 - RNA, 14 nt, Homo sapiens
cuguuaaaugucaa

SEQ ID NO: 1885799 - RNA, 19 nt, Homo sapiens
uuguagaaaugagccagaa

SEQ ID NO: 1885800 - RNA, 23 nt, Homo sapiens
acuggcagcuuugaaaaaacacc

SEQ ID NO: 1885801 - RNA, 16 nt, Homo sapiens
aaugcgugcaguuccu

SEQ ID NO: 1885802 - RNA, 15 nt, Homo sapiens
uucugaccuccccac

SEQ ID NO: 1885803 - RNA, 19 nt, Homo sapiens
gccuucgcacucaaugcca

SEQ ID NO: 1885804 - RNA, 13 nt, Homo sapiens
cauucuucuacuu

SEQ ID NO: 1885805 - RNA, 24 nt, Homo sapiens
aguuacuuuugacccaugugcaag

SEQ ID NO: 1885806 - RNA, 21 nt, Homo sapiens
ucuugaaugcuuaaaugauca

SEQ ID NO: 1885807 - RNA, 21 nt, Homo sapiens
aaacacacuuuugcacauaua

SEQ ID NO: 1885808 - RNA, 22 nt, Homo sapiens
uaagaaccacucauaauucuuc

SEQ ID NO: 1885809 - RNA, 15 nt, Homo sapiens
ccagcuacucgggag

SEQ ID NO: 1885810 - RNA, 21 nt, Homo sapiens
ucaaauugggaaauccauucc

SEQ ID NO: 1885811 - RNA, 16 nt, Homo sapiens
ugcagggccagccacu

SEQ ID NO: 1885812 - RNA, 12 nt, Homo sapiens
cugccacugggc

SEQ ID NO: 1885813 - RNA, 22 nt, Homo sapiens
uguuauuuaaugagucagucaa

SEQ ID NO: 1885814 - RNA, 13 nt, Homo sapiens
acuuugugcuuuc

SEQ ID NO: 1885815 - RNA, 18 nt, Homo sapiens
aaggaaaccaagugguca

SEQ ID NO: 1885816 - RNA, 16 nt, Homo sapiens
uaaaauggcaguuuga

SEQ ID NO: 1885817 - RNA, 20 nt, Homo sapiens
uagaaugaucuauugcucau

SEQ ID NO: 1885818 - RNA, 21 nt, Homo sapiens
ucuggucuucgcagccuagau

SEQ ID NO: 1885819 - RNA, 20 nt, Homo sapiens
uauaauuuuauugcuggaau

SEQ ID NO: 1885820 - RNA, 14 nt, Homo sapiens
uauuuuauguauau

SEQ ID NO: 1885821 - RNA, 21 nt, Homo sapiens
ggacgcgccaggggaguuccu

SEQ ID NO: 1885822 - RNA, 19 nt, Homo sapiens
ugaaauaaaugccccaaag

SEQ ID NO: 1885823 - RNA, 17 nt, Homo sapiens
ucccaaacagcugccuc

SEQ ID NO: 1885824 - RNA, 14 nt, Homo sapiens
auuuugcauuucau

SEQ ID NO: 1885825 - RNA, 22 nt, Homo sapiens
auagucccauuuuucucuugcc

SEQ ID NO: 1885826 - RNA, 22 nt, Homo sapiens
gggcaugcuggggcaagucccu

SEQ ID NO: 1885827 - RNA, 15 nt, Homo sapiens
ccugcggcccagaag

SEQ ID NO: 1885828 - RNA, 12 nt, Homo sapiens
uaacaugcuuua

SEQ ID NO: 1885829 - RNA, 16 nt, Homo sapiens
ugguuaccgaggaccc

SEQ ID NO: 1885830 - RNA, 17 nt, Homo sapiens
cugucuuucagcauuca

SEQ ID NO: 1885831 - RNA, 18 nt, Homo sapiens
augcagugcuccauccaa

SEQ ID NO: 1885832 - RNA, 17 nt, Homo sapiens
caagggaggcccagcgc

SEQ ID NO: 1885833 - RNA, 18 nt, Homo sapiens
cccagaucaccaccugaa

SEQ ID NO: 1885834 - RNA, 13 nt, Homo sapiens
auuaaguuaucuu

SEQ ID NO: 1885835 - RNA, 18 nt, Homo sapiens
uccuauuacugaugugug

SEQ ID NO: 1885836 - RNA, 15 nt, Homo sapiens
cucaugacugcauga

SEQ ID NO: 1885837 - RNA, 15 nt, Homo sapiens
aaagcuucucucuga

SEQ ID NO: 1885838 - RNA, 22 nt, Homo sapiens
acaaugaagaugaugcuauuaa

SEQ ID NO: 1885839 - RNA, 21 nt, Homo sapiens
agcaagugcuggagucgggac

SEQ ID NO: 1885840 - RNA, 23 nt, Homo sapiens
agcuaugugacucggauggucuu

SEQ ID NO: 1885841 - RNA, 23 nt, Homo sapiens
aucagucauuucuucauguacag

SEQ ID NO: 1885842 - RNA, 14 nt, Homo sapiens
aaaauaaauuacaa

SEQ ID NO: 1885843 - RNA, 17 nt, Homo sapiens
caauuuuaaacauaucc

SEQ ID NO: 1885844 - RNA, 13 nt, Homo sapiens
gaagucaucucau

SEQ ID NO: 1885845 - RNA, 16 nt, Homo sapiens
aggaggcugcaugcuc

SEQ ID NO: 1885846 - RNA, 16 nt, Homo sapiens
ugucauguuaugcagu

SEQ ID NO: 1885847 - RNA, 19 nt, Homo sapiens
gaaccguuugugauugcca

SEQ ID NO: 1885848 - RNA, 21 nt, Homo sapiens
gaagagaggaguucaaugauc

SEQ ID NO: 1885849 - RNA, 19 nt, Homo sapiens
ugcaccagagcaaccucuc

SEQ ID NO: 1885850 - RNA, 11 nt, Homo sapiens
gacagccucag

SEQ ID NO: 1885851 - RNA, 20 nt, Homo sapiens
aagaaaggcugcuguacuga

SEQ ID NO: 1885852 - RNA, 16 nt, Homo sapiens
ggcuggaaucucauga

SEQ ID NO: 1885853 - RNA, 22 nt, Homo sapiens
agauauuugguaccauggugua

SEQ ID NO: 1885854 - RNA, 18 nt, Homo sapiens
uacaugccgaaugccaca

SEQ ID NO: 1885855 - RNA, 18 nt, Homo sapiens
cuccagacuuuuaccuac

SEQ ID NO: 1885856 - RNA, 14 nt, Homo sapiens
caggcuggagccca

SEQ ID NO: 1885857 - RNA, 16 nt, Homo sapiens
caggaucacagcucac

SEQ ID NO: 1885858 - RNA, 20 nt, Homo sapiens
uccccagaccucagggacaa

SEQ ID NO: 1885859 - RNA, 14 nt, Homo sapiens
ucuaaaugccaaug

SEQ ID NO: 1885860 - RNA, 18 nt, Homo sapiens
ucugauuacuguccagcu

SEQ ID NO: 1885861 - RNA, 15 nt, Homo sapiens
agugcucacacaauc

SEQ ID NO: 1885862 - RNA, 18 nt, Homo sapiens
gcacauggcuggcacuga

SEQ ID NO: 1885863 - RNA, 20 nt, Homo sapiens
auuuuuauuauuaaucucau

SEQ ID NO: 1885864 - RNA, 15 nt, Homo sapiens
cagaauaacuagcac

SEQ ID NO: 1885865 - RNA, 13 nt, Homo sapiens
auggcuggaauau

SEQ ID NO: 1885866 - RNA, 22 nt, Homo sapiens
uggaauuggagucguguuguca

SEQ ID NO: 1885867 - RNA, 21 nt, Homo sapiens
gaaccuggaaaaauuccagaa

SEQ ID NO: 1885868 - RNA, 15 nt, Homo sapiens
gccaucaagcacuuc

SEQ ID NO: 1885869 - RNA, 19 nt, Homo sapiens
agaaucugccccuguugag

SEQ ID NO: 1885870 - RNA, 16 nt, Homo sapiens
gucaugugcaccuuug

SEQ ID NO: 1885871 - RNA, 16 nt, Homo sapiens
caucagacaauugcau

SEQ ID NO: 1885872 - RNA, 15 nt, Homo sapiens
ccucuaguaguauau

SEQ ID NO: 1885873 - RNA, 15 nt, Homo sapiens
uuggaaggggccuug

SEQ ID NO: 1885874 - RNA, 16 nt, Homo sapiens
gggagugugggcugcc

SEQ ID NO: 1885875 - RNA, 21 nt, Homo sapiens
gcaccaaccacagcaucggga

SEQ ID NO: 1885876 - RNA, 20 nt, Homo sapiens
aauuauagaaacaauacugu

SEQ ID NO: 1885877 - RNA, 19 nt, Homo sapiens
ccauacccccacaugccaa

SEQ ID NO: 1885878 - RNA, 22 nt, Homo sapiens
acugugucccagugucuggccc

SEQ ID NO: 1885879 - RNA, 11 nt, Homo sapiens
uugacaaugau

SEQ ID NO: 1885880 - RNA, 13 nt, Homo sapiens
aauccaaaccaca

SEQ ID NO: 1885881 - RNA, 17 nt, Homo sapiens
aaauagcaaaagaagaa

SEQ ID NO: 1885882 - RNA, 14 nt, Homo sapiens
ggaaacccccagug

SEQ ID NO: 1885883 - RNA, 24 nt, Homo sapiens
ugaaacuuuagagauuaacgacaa

SEQ ID NO: 1885884 - RNA, 18 nt, Homo sapiens
acgaaaauaguauuucag

SEQ ID NO: 1885885 - RNA, 14 nt, Homo sapiens
aaucccgugaaaga

SEQ ID NO: 1885886 - RNA, 13 nt, Homo sapiens
ccuagugcuauuc

SEQ ID NO: 1885887 - RNA, 18 nt, Homo sapiens
acuuguacuuacacugaa

SEQ ID NO: 1885888 - RNA, 13 nt, Homo sapiens
cugcucccauucc

SEQ ID NO: 1885889 - RNA, 17 nt, Homo sapiens
caucaagaugugacaug

SEQ ID NO: 1885890 - RNA, 13 nt, Homo sapiens
gaauuaugcuucc

SEQ ID NO: 1885891 - RNA, 16 nt, Homo sapiens
ccuggucugugcauug

SEQ ID NO: 1885892 - RNA, 14 nt, Homo sapiens
cuccacauugcaau

SEQ ID NO: 1885893 - RNA, 15 nt, Homo sapiens
gaauucuuuacaaua

SEQ ID NO: 1885894 - RNA, 16 nt, Homo sapiens
auuuuauaaugucaua

SEQ ID NO: 1885895 - RNA, 13 nt, Homo sapiens
ggagaguaccugu

SEQ ID NO: 1885896 - RNA, 20 nt, Homo sapiens
ucacagcccagaaccacaga

SEQ ID NO: 1885897 - RNA, 22 nt, Homo sapiens
auugucaacacaaacuggcuua

SEQ ID NO: 1885898 - RNA, 15 nt, Homo sapiens
agcuuuacagugcca

SEQ ID NO: 1885899 - RNA, 18 nt, Homo sapiens
agaugccucccugagcua

SEQ ID NO: 1885900 - RNA, 15 nt, Homo sapiens
uguccuguuacaaaa

SEQ ID NO: 1885901 - RNA, 16 nt, Homo sapiens
cucagguguugccaaa

SEQ ID NO: 1885902 - RNA, 21 nt, Homo sapiens
ccagagaugacuauuacuuuu

SEQ ID NO: 1885903 - RNA, 16 nt, Homo sapiens
caacacucuuacaccu

SEQ ID NO: 1885904 - RNA, 15 nt, Homo sapiens
auaugcuuucaucuu

SEQ ID NO: 1885905 - RNA, 23 nt, Homo sapiens
ccuuguuguucuuuaacccucac

SEQ ID NO: 1885906 - RNA, 21 nt, Homo sapiens
acacacuggcuccuggaccua

SEQ ID NO: 1885907 - RNA, 22 nt, Homo sapiens
cucaacucccagccaucuguau

SEQ ID NO: 1885908 - RNA, 19 nt, Homo sapiens
cacgucccgggcacuguca

SEQ ID NO: 1885909 - RNA, 22 nt, Homo sapiens
auaaguauuuccauaacucaua

SEQ ID NO: 1885910 - RNA, 14 nt, Homo sapiens
ccagacccacugaa

SEQ ID NO: 1885911 - RNA, 14 nt, Homo sapiens
caugagaaagggag

SEQ ID NO: 1885912 - RNA, 18 nt, Homo sapiens
aaacacucaacaauaaag

SEQ ID NO: 1885913 - RNA, 14 nt, Homo sapiens
ccugggcauggugg

SEQ ID NO: 1885914 - RNA, 16 nt, Homo sapiens
auucacacccagcuga

SEQ ID NO: 1885915 - RNA, 15 nt, Homo sapiens
cccagccacgugucu

SEQ ID NO: 1885916 - RNA, 15 nt, Homo sapiens
aucugcucugagacg

SEQ ID NO: 1885917 - RNA, 15 nt, Homo sapiens
cugaucacaugugcc

SEQ ID NO: 1885918 - RNA, 20 nt, Homo sapiens
cgugccagcucuaguuuuca

SEQ ID NO: 1885919 - RNA, 23 nt, Homo sapiens
cuugggggaaaauaccacaauca

SEQ ID NO: 1885920 - RNA, 13 nt, Homo sapiens
uaaugacauuccc

SEQ ID NO: 1885921 - RNA, 12 nt, Homo sapiens
ucuaaacuuuaa

SEQ ID NO: 1885922 - RNA, 12 nt, Homo sapiens
auugaacuacag

SEQ ID NO: 1885923 - RNA, 16 nt, Homo sapiens
ugcacaugaaugcagu

SEQ ID NO: 1885924 - RNA, 14 nt, Homo sapiens
cugucuugucuccc

SEQ ID NO: 1885925 - RNA, 15 nt, Homo sapiens
uacacugauacacuu

SEQ ID NO: 1885926 - RNA, 15 nt, Homo sapiens
cucagggacucaggu

SEQ ID NO: 1885927 - RNA, 15 nt, Homo sapiens
gggguggaggggugu

SEQ ID NO: 1885928 - RNA, 15 nt, Homo sapiens
auaucuuugcacuga

SEQ ID NO: 1885929 - RNA, 19 nt, Homo sapiens
cagaaugagaccaaacgca

SEQ ID NO: 1885930 - RNA, 14 nt, Homo sapiens
ccucuuaagccugc

SEQ ID NO: 1885931 - RNA, 12 nt, Homo sapiens
gugaacauuucc

SEQ ID NO: 1885932 - RNA, 14 nt, Homo sapiens
uggcuaacauagca

SEQ ID NO: 1885933 - RNA, 21 nt, Homo sapiens
ugcuuguguaacaggaacaaa

SEQ ID NO: 1885934 - RNA, 16 nt, Homo sapiens
agcaacacaauguuau

SEQ ID NO: 1885935 - RNA, 13 nt, Homo sapiens
cugaucccugugc

SEQ ID NO: 1885936 - RNA, 16 nt, Homo sapiens
uggucaaucaguguua

SEQ ID NO: 1885937 - RNA, 12 nt, Homo sapiens
uaagaauguuca

SEQ ID NO: 1885938 - RNA, 12 nt, Homo sapiens
cuagaaugcaca

SEQ ID NO: 1885939 - RNA, 23 nt, Homo sapiens
cuucuugcuuacaggaaugaagg

SEQ ID NO: 1885940 - RNA, 22 nt, Homo sapiens
cuuuuaucaauaaagcacuauu

SEQ ID NO: 1885941 - RNA, 18 nt, Homo sapiens
guaaucuguguacaaaga

SEQ ID NO: 1885942 - RNA, 13 nt, Homo sapiens
uucugaauucaua

SEQ ID NO: 1885943 - RNA, 11 nt, Homo sapiens
uccugcccuug

SEQ ID NO: 1885944 - RNA, 11 nt, Homo sapiens
cccugccccug

SEQ ID NO: 1885945 - RNA, 13 nt, Homo sapiens
auucccacugccg

SEQ ID NO: 1885946 - RNA, 13 nt, Homo sapiens
aucuccacuguug

SEQ ID NO: 1885947 - RNA, 21 nt, Homo sapiens
aaccuaauaaauauuuagucu

SEQ ID NO: 1885948 - RNA, 19 nt, Homo sapiens
caaucugugaugacauucc

SEQ ID NO: 1885949 - RNA, 22 nt, Homo sapiens
aguauauaacgcaggccuuuua

SEQ ID NO: 1885950 - RNA, 16 nt, Homo sapiens
gaccaauaggugcaaa

SEQ ID NO: 1885951 - RNA, 15 nt, Homo sapiens
ccaggcaugcaaugc

SEQ ID NO: 1885952 - RNA, 19 nt, Homo sapiens
caaacuccauucuccaggg

SEQ ID NO: 1885953 - RNA, 18 nt, Homo sapiens
uuuauuauaugauuauca

SEQ ID NO: 1885954 - RNA, 12 nt, Homo sapiens
caguguuuagaa

SEQ ID NO: 1885955 - RNA, 19 nt, Homo sapiens
ucuaugaucuggacuuccu

SEQ ID NO: 1885956 - RNA, 15 nt, Homo sapiens
auucuccuuccccac

SEQ ID NO: 1885957 - RNA, 19 nt, Homo sapiens
agaaauaucccucauuuca

SEQ ID NO: 1885958 - RNA, 18 nt, Homo sapiens
ugggccaagccaggguuc

SEQ ID NO: 1885959 - RNA, 17 nt, Homo sapiens
cugggcugggaaaaacu

SEQ ID NO: 1885960 - RNA, 19 nt, Homo sapiens
cucuguccuaaauaucuca

SEQ ID NO: 1885961 - RNA, 17 nt, Homo sapiens
agcuucuuccuaggucc

SEQ ID NO: 1885962 - RNA, 12 nt, Homo sapiens
ccuuagaguaug

SEQ ID NO: 1885963 - RNA, 12 nt, Homo sapiens
uuguucugagua

SEQ ID NO: 1885964 - RNA, 18 nt, Homo sapiens
cuccugacgcagcacaag

SEQ ID NO: 1885965 - RNA, 19 nt, Homo sapiens
uuuaaagacagggucuugc

SEQ ID NO: 1885966 - RNA, 16 nt, Homo sapiens
guauagcugaaauucc

SEQ ID NO: 1885967 - RNA, 17 nt, Homo sapiens
gcacccgcauguacaaa

SEQ ID NO: 1885968 - RNA, 14 nt, Homo sapiens
caaagccaauguga

SEQ ID NO: 1885969 - RNA, 18 nt, Homo sapiens
cuugugaauuauucugau

SEQ ID NO: 1885970 - RNA, 13 nt, Homo sapiens
aaccacagcacuu

SEQ ID NO: 1885971 - RNA, 20 nt, Homo sapiens
acauaauggcugaagccaaa

SEQ ID NO: 1885972 - RNA, 23 nt, Homo sapiens
uaauagcugccuucaaggacugu

SEQ ID NO: 1885973 - RNA, 15 nt, Homo sapiens
aggcaauguacucuu

SEQ ID NO: 1885974 - RNA, 20 nt, Homo sapiens
aacucauaauuuuugcagaa

SEQ ID NO: 1885975 - RNA, 20 nt, Homo sapiens
auucuuuugaauuguuacau

SEQ ID NO: 1885976 - RNA, 14 nt, Homo sapiens
accacugggugaga

SEQ ID NO: 1885977 - RNA, 23 nt, Homo sapiens
uggaaugcagggaagagggcagu

SEQ ID NO: 1885978 - RNA, 23 nt, Homo sapiens
aggaucuuucacccacagaaaga

SEQ ID NO: 1885979 - RNA, 14 nt, Homo sapiens
ucuuugugccaaac

SEQ ID NO: 1885980 - RNA, 15 nt, Homo sapiens
acuuggggucagaga

SEQ ID NO: 1885981 - RNA, 17 nt, Homo sapiens
acugugaagaucucacu

SEQ ID NO: 1885982 - RNA, 15 nt, Homo sapiens
agccuguauguggug

SEQ ID NO: 1885983 - RNA, 16 nt, Homo sapiens
cuccaguaacagccua

SEQ ID NO: 1885984 - RNA, 12 nt, Homo sapiens
ccucucauccca

SEQ ID NO: 1885985 - RNA, 14 nt, Homo sapiens
guguucuguguuau

SEQ ID NO: 1885986 - RNA, 15 nt, Homo sapiens
ggaagaugaaagagg

SEQ ID NO: 1885987 - RNA, 12 nt, Homo sapiens
acaguggcucau

SEQ ID NO: 1885988 - RNA, 18 nt, Homo sapiens
cuagccacugagcggcua

SEQ ID NO: 1885989 - RNA, 21 nt, Homo sapiens
auauuuaggcaugagcucuug

SEQ ID NO: 1885990 - RNA, 17 nt, Homo sapiens
aaggcgauauaagcaaa

SEQ ID NO: 1885991 - RNA, 23 nt, Homo sapiens
accgccccuugugcucgccucau

SEQ ID NO: 1885992 - RNA, 13 nt, Homo sapiens
cucggucuuaccc

SEQ ID NO: 1885993 - RNA, 13 nt, Homo sapiens
agcugggcagcug

SEQ ID NO: 1885994 - RNA, 19 nt, Homo sapiens
acugagcugggcaccacag

SEQ ID NO: 1885995 - RNA, 19 nt, Homo sapiens
gggcagcuccugaccaaag

SEQ ID NO: 1885996 - RNA, 14 nt, Homo sapiens
uuucuaaacuggag

SEQ ID NO: 1885997 - RNA, 22 nt, Homo sapiens
agaugguccuccauuucaacuc

SEQ ID NO: 1885998 - RNA, 12 nt, Homo sapiens
cucuacauggac

SEQ ID NO: 1885999 - RNA, 13 nt, Homo sapiens
uuaaaaugguuau

SEQ ID NO: 1886000 - RNA, 19 nt, Homo sapiens
ugccuuucuacaacugauu

SEQ ID NO: 1886001 - RNA, 15 nt, Homo sapiens
agacagcuucucauc

SEQ ID NO: 1886002 - RNA, 18 nt, Homo sapiens
cgauccuggauucacuca

SEQ ID NO: 1886003 - RNA, 18 nt, Homo sapiens
ugucaacugaacacugua

SEQ ID NO: 1886004 - RNA, 17 nt, Homo sapiens
aaagagaaaaaccaaug

SEQ ID NO: 1886005 - RNA, 15 nt, Homo sapiens
cacucugcuaccuug

SEQ ID NO: 1886006 - RNA, 19 nt, Homo sapiens
agggcuugucacagucucu

SEQ ID NO: 1886007 - RNA, 20 nt, Homo sapiens
ccuagcagaggaaaguguaa

SEQ ID NO: 1886008 - RNA, 23 nt, Homo sapiens
cacaguuuauuuuuauacuuuca

SEQ ID NO: 1886009 - RNA, 14 nt, Homo sapiens
cuguuuacagugug

SEQ ID NO: 1886010 - RNA, 15 nt, Homo sapiens
uguguuuuuugcuca

SEQ ID NO: 1886011 - RNA, 21 nt, Homo sapiens
ggccuucccgccggaggccag

SEQ ID NO: 1886012 - RNA, 14 nt, Homo sapiens
cucaugguagaaaa

SEQ ID NO: 1886013 - RNA, 19 nt, Homo sapiens
aaauaucagugggcucucu

SEQ ID NO: 1886014 - RNA, 14 nt, Homo sapiens
cacucgugugcaug

SEQ ID NO: 1886015 - RNA, 18 nt, Homo sapiens
gccuggcaggccaguguc

SEQ ID NO: 1886016 - RNA, 14 nt, Homo sapiens
acauagcaaauuaa

SEQ ID NO: 1886017 - RNA, 20 nt, Homo sapiens
uuauccaucuuucacuaucu

SEQ ID NO: 1886018 - RNA, 19 nt, Homo sapiens
aauggcaccuucauucucc

SEQ ID NO: 1886019 - RNA, 20 nt, Homo sapiens
caggugaaacccagucacug

SEQ ID NO: 1886020 - RNA, 19 nt, Homo sapiens
cggcuugugggcuggugcc

SEQ ID NO: 1886021 - RNA, 20 nt, Homo sapiens
acuucugcaucuuacaguca

SEQ ID NO: 1886022 - RNA, 16 nt, Homo sapiens
gcugcucggcuacugg

SEQ ID NO: 1886023 - RNA, 22 nt, Homo sapiens
acgcuggguccuaauuaccagu

SEQ ID NO: 1886024 - RNA, 18 nt, Homo sapiens
aaucacaaaccaagccau

SEQ ID NO: 1886025 - RNA, 11 nt, Homo sapiens
aguuggcagaa

SEQ ID NO: 1886026 - RNA, 17 nt, Homo sapiens
gaucuauguuucaucuu

SEQ ID NO: 1886027 - RNA, 15 nt, Homo sapiens
ccuucuccugcauug

SEQ ID NO: 1886028 - RNA, 13 nt, Homo sapiens
uagaaauuuuaca

SEQ ID NO: 1886029 - RNA, 15 nt, Homo sapiens
caaaugaaauaaaua

SEQ ID NO: 1886030 - RNA, 21 nt, Homo sapiens
auccaagauuuaaaugccaua

SEQ ID NO: 1886031 - RNA, 19 nt, Homo sapiens
aacacagacauucugccag

SEQ ID NO: 1886032 - RNA, 19 nt, Homo sapiens
cucucuugucaagucagaa

SEQ ID NO: 1886033 - RNA, 15 nt, Homo sapiens
gacuuuaaaccaccu

SEQ ID NO: 1886034 - RNA, 15 nt, Homo sapiens
caguaugaaugaugu

SEQ ID NO: 1886035 - RNA, 18 nt, Homo sapiens
gucacucuccagcaguua

SEQ ID NO: 1886036 - RNA, 14 nt, Homo sapiens
uagagugacaggca

SEQ ID NO: 1886037 - RNA, 20 nt, Homo sapiens
cacagaaaauggaagacagc

SEQ ID NO: 1886038 - RNA, 16 nt, Homo sapiens
acaugcuguacauacu

SEQ ID NO: 1886039 - RNA, 14 nt, Homo sapiens
cagaacacuguaau

SEQ ID NO: 1886040 - RNA, 23 nt, Homo sapiens
accaccauuuaauuucauguaua

SEQ ID NO: 1886041 - RNA, 19 nt, Homo sapiens
cacugguauuaacuuuaua

SEQ ID NO: 1886042 - RNA, 15 nt, Homo sapiens
ccuuccucuucucaa

SEQ ID NO: 1886043 - RNA, 15 nt, Homo sapiens
gcccacgcagaggac

SEQ ID NO: 1886044 - RNA, 16 nt, Homo sapiens
gcgguuuccaggccac

SEQ ID NO: 1886045 - RNA, 19 nt, Homo sapiens
uuccugggcacacgcugcu

SEQ ID NO: 1886046 - RNA, 19 nt, Homo sapiens
gacuggggagcacaggugu

SEQ ID NO: 1886047 - RNA, 18 nt, Homo sapiens
caucacuguaaagacaaa

SEQ ID NO: 1886048 - RNA, 14 nt, Homo sapiens
cuggaggcaccugg

SEQ ID NO: 1886049 - RNA, 18 nt, Homo sapiens
gaacuuuaagaagcagug

SEQ ID NO: 1886050 - RNA, 22 nt, Homo sapiens
cuaaggggcagcuccugaccaa

SEQ ID NO: 1886051 - RNA, 17 nt, Homo sapiens
guuaugcaagcacaaau

SEQ ID NO: 1886052 - RNA, 14 nt, Homo sapiens
agucagacugucag

SEQ ID NO: 1886053 - RNA, 14 nt, Homo sapiens
agggaaacugggaa

SEQ ID NO: 1886054 - RNA, 14 nt, Homo sapiens
uuaaauacauaaau

SEQ ID NO: 1886055 - RNA, 18 nt, Homo sapiens
uacaauggcgugaucucg

SEQ ID NO: 1886056 - RNA, 14 nt, Homo sapiens
uuucacacauucac

SEQ ID NO: 1886057 - RNA, 14 nt, Homo sapiens
uccccaacacccca

SEQ ID NO: 1886058 - RNA, 16 nt, Homo sapiens
cauuguuaugcacuuu

SEQ ID NO: 1886059 - RNA, 16 nt, Homo sapiens
acccagaaaaucugaa

SEQ ID NO: 1886060 - RNA, 16 nt, Homo sapiens
agaaccgagcaaagau

SEQ ID NO: 1886061 - RNA, 17 nt, Homo sapiens
uggacccccagcuuugc

SEQ ID NO: 1886062 - RNA, 22 nt, Homo sapiens
aaggauccagacucucauuccu

SEQ ID NO: 1886063 - RNA, 17 nt, Homo sapiens
aaucugagaaacucuac

SEQ ID NO: 1886064 - RNA, 19 nt, Homo sapiens
ucaggaaauguuuucuuaa

SEQ ID NO: 1886065 - RNA, 18 nt, Homo sapiens
auguacuaggauacugcu

SEQ ID NO: 1886066 - RNA, 22 nt, Homo sapiens
caagaaaaagaaaaaaaaagca

SEQ ID NO: 1886067 - RNA, 22 nt, Homo sapiens
uugccuugugaauuugcugcua

SEQ ID NO: 1886068 - RNA, 16 nt, Homo sapiens
auuuguuaauaucacu

SEQ ID NO: 1886069 - RNA, 16 nt, Homo sapiens
cauucauauuccugcc

SEQ ID NO: 1886070 - RNA, 16 nt, Homo sapiens
uuccuugaccagcaga

SEQ ID NO: 1886071 - RNA, 19 nt, Homo sapiens
agcucuugaagacacugaa

SEQ ID NO: 1886072 - RNA, 22 nt, Homo sapiens
gucccaucaggacccuccugcc

SEQ ID NO: 1886073 - RNA, 13 nt, Homo sapiens
ccgggaaugagcu

SEQ ID NO: 1886074 - RNA, 10 nt, Homo sapiens
ugccuggcaa

SEQ ID NO: 1886075 - RNA, 17 nt, Homo sapiens
gagaauguugaauacuu

SEQ ID NO: 1886076 - RNA, 24 nt, Homo sapiens
ugcucaguggaucacacacaugga

SEQ ID NO: 1886077 - RNA, 14 nt, Homo sapiens
uagcaacccuguga

SEQ ID NO: 1886078 - RNA, 16 nt, Homo sapiens
acuuccuguaauguac

SEQ ID NO: 1886079 - RNA, 14 nt, Homo sapiens
uuuguaacugccua

SEQ ID NO: 1886080 - RNA, 22 nt, Homo sapiens
cuguguugggcaagaccucuuc

SEQ ID NO: 1886081 - RNA, 15 nt, Homo sapiens
uagcaagaugcaaau

SEQ ID NO: 1886082 - RNA, 16 nt, Homo sapiens
cucagaauagcuguuu

SEQ ID NO: 1886083 - RNA, 18 nt, Homo sapiens
cuaagcuggagugcagug

SEQ ID NO: 1886084 - RNA, 21 nt, Homo sapiens
agucucuauuugauuugcaac

SEQ ID NO: 1886085 - RNA, 23 nt, Homo sapiens
cuacccacuaugcacagauuaaa

SEQ ID NO: 1886086 - RNA, 16 nt, Homo sapiens
aauguuuauguucuca

SEQ ID NO: 1886087 - RNA, 15 nt, Homo sapiens
gaaaucaguuucuca

SEQ ID NO: 1886088 - RNA, 18 nt, Homo sapiens
cccccaccccucugccaa

SEQ ID NO: 1886089 - RNA, 21 nt, Homo sapiens
uuuaugccacagaauuugcua

SEQ ID NO: 1886090 - RNA, 22 nt, Homo sapiens
ugcagccacuggcuuggaacac

SEQ ID NO: 1886091 - RNA, 23 nt, Homo sapiens
accucuguauuaguuuuugauca

SEQ ID NO: 1886092 - RNA, 13 nt, Homo sapiens
accaccucagaaa

SEQ ID NO: 1886093 - RNA, 23 nt, Homo sapiens
cuacccugcuggggaaaguacaa

SEQ ID NO: 1886094 - RNA, 19 nt, Homo sapiens
cuccucucccauccuugau

SEQ ID NO: 1886095 - RNA, 12 nt, Homo sapiens
gccuagccucac

SEQ ID NO: 1886096 - RNA, 23 nt, Homo sapiens
ccuuguaucuauuuguggugaau

SEQ ID NO: 1886097 - RNA, 18 nt, Homo sapiens
gagucaaaacacuuguaa

SEQ ID NO: 1886098 - RNA, 19 nt, Homo sapiens
cucagagcuccucacuuag

SEQ ID NO: 1886099 - RNA, 14 nt, Homo sapiens
cugucaaaugaugu

SEQ ID NO: 1886100 - RNA, 22 nt, Homo sapiens
uaacugacuuaguucuucccuu

SEQ ID NO: 1886101 - RNA, 14 nt, Homo sapiens
aaaaguagauuaaa

SEQ ID NO: 1886102 - RNA, 14 nt, Homo sapiens
uaaaauaguuuaga

SEQ ID NO: 1886103 - RNA, 13 nt, Homo sapiens
cuuuuuccuguga

SEQ ID NO: 1886104 - RNA, 13 nt, Homo sapiens
agcuccuacaugg

SEQ ID NO: 1886105 - RNA, 15 nt, Homo sapiens
gucaugccacugcac

SEQ ID NO: 1886106 - RNA, 21 nt, Homo sapiens
gagccaggaaagcagcaaagg

SEQ ID NO: 1886107 - RNA, 15 nt, Homo sapiens
uacaccacacacaac

SEQ ID NO: 1886108 - RNA, 15 nt, Homo sapiens
cguucucugcuaaaa

SEQ ID NO: 1886109 - RNA, 14 nt, Homo sapiens
ccauaguauaauca

SEQ ID NO: 1886110 - RNA, 18 nt, Homo sapiens
gcaugauugugaccucca

SEQ ID NO: 1886111 - RNA, 19 nt, Homo sapiens
ugaagggccccuugcaaag

SEQ ID NO: 1886112 - RNA, 22 nt, Homo sapiens
uguaaucccagcaugcugagau

SEQ ID NO: 1886113 - RNA, 20 nt, Homo sapiens
uccccaccagaugcugaaaa

SEQ ID NO: 1886114 - RNA, 22 nt, Homo sapiens
gggaccaauauuaccaucuuaa

SEQ ID NO: 1886115 - RNA, 18 nt, Homo sapiens
cacuggcacacugcucuu

SEQ ID NO: 1886116 - RNA, 17 nt, Homo sapiens
uccaauucgaaaacaac

SEQ ID NO: 1886117 - RNA, 17 nt, Homo sapiens
uggucucgaugcugcug

SEQ ID NO: 1886118 - RNA, 14 nt, Homo sapiens
uggcucuucugccc

SEQ ID NO: 1886119 - RNA, 20 nt, Homo sapiens
uguugcaaacucagugcaaa

SEQ ID NO: 1886120 - RNA, 19 nt, Homo sapiens
guaauaauaaaaccaaaga

SEQ ID NO: 1886121 - RNA, 16 nt, Homo sapiens
gcagaguacuggcuga

SEQ ID NO: 1886122 - RNA, 22 nt, Homo sapiens
acuacucagcauggaaacaaga

SEQ ID NO: 1886123 - RNA, 14 nt, Homo sapiens
uaaacuuuucauua

SEQ ID NO: 1886124 - RNA, 15 nt, Homo sapiens
uaaaagaauugcacg

SEQ ID NO: 1886125 - RNA, 22 nt, Homo sapiens
uccucguugguucauguguugu

SEQ ID NO: 1886126 - RNA, 18 nt, Homo sapiens
cacagagccacucuucaa

SEQ ID NO: 1886127 - RNA, 14 nt, Homo sapiens
uucccuguucuccc

SEQ ID NO: 1886128 - RNA, 20 nt, Homo sapiens
agauggccuggcugcugcug

SEQ ID NO: 1886129 - RNA, 13 nt, Homo sapiens
cucacucaggacu

SEQ ID NO: 1886130 - RNA, 16 nt, Homo sapiens
cacuguccugucuuaa

SEQ ID NO: 1886131 - RNA, 19 nt, Homo sapiens
uggugccccaggaccagcu

SEQ ID NO: 1886132 - RNA, 13 nt, Homo sapiens
caguaacacuggc

SEQ ID NO: 1886133 - RNA, 12 nt, Homo sapiens
cagaauguaucu

SEQ ID NO: 1886134 - RNA, 18 nt, Homo sapiens
uacacacuugcaugacaa

SEQ ID NO: 1886135 - RNA, 21 nt, Homo sapiens
aauauuagcaaagaagcuuca

SEQ ID NO: 1886136 - RNA, 20 nt, Homo sapiens
aggaaauacuuuguaacuuu

SEQ ID NO: 1886137 - RNA, 15 nt, Homo sapiens
uugcacaauccauga

SEQ ID NO: 1886138 - RNA, 18 nt, Homo sapiens
ugauuuaauaacauaaca

SEQ ID NO: 1886139 - RNA, 18 nt, Homo sapiens
gaucacagcguuucagga

SEQ ID NO: 1886140 - RNA, 17 nt, Homo sapiens
ugcccauccugacugaa

SEQ ID NO: 1886141 - RNA, 19 nt, Homo sapiens
uaaccucucugaacugcaa

SEQ ID NO: 1886142 - RNA, 21 nt, Homo sapiens
uucaugggaaaacagaccugu

SEQ ID NO: 1886143 - RNA, 12 nt, Homo sapiens
auuaacaauuaa

SEQ ID NO: 1886144 - RNA, 15 nt, Homo sapiens
caucagcuagcaaaa

SEQ ID NO: 1886145 - RNA, 18 nt, Homo sapiens
ugcauaagugcaugacau

SEQ ID NO: 1886146 - RNA, 14 nt, Homo sapiens
gucugcagaccauc

SEQ ID NO: 1886147 - RNA, 23 nt, Homo sapiens
acccaucguccaccccagugugc

SEQ ID NO: 1886148 - RNA, 18 nt, Homo sapiens
uauugccucuaugugcaa

SEQ ID NO: 1886149 - RNA, 15 nt, Homo sapiens
aggucgagacauucc

SEQ ID NO: 1886150 - RNA, 20 nt, Homo sapiens
ccaggagaacaucuuugaca

SEQ ID NO: 1886151 - RNA, 20 nt, Homo sapiens
uagaguauaccugugguuug

SEQ ID NO: 1886152 - RNA, 16 nt, Homo sapiens
aaacuugggucucuua

SEQ ID NO: 1886153 - RNA, 14 nt, Homo sapiens
ccaggcauguccua

SEQ ID NO: 1886154 - RNA, 22 nt, Homo sapiens
ugggacccuucagccacuacaa

SEQ ID NO: 1886155 - RNA, 15 nt, Homo sapiens
uacaggaggaugugu

SEQ ID NO: 1886156 - RNA, 16 nt, Homo sapiens
uaaaugcacauuucag

SEQ ID NO: 1886157 - RNA, 19 nt, Homo sapiens
caggcagccucuggggggu

SEQ ID NO: 1886158 - RNA, 19 nt, Homo sapiens
ggaagcagcaaaaccuuca

SEQ ID NO: 1886159 - RNA, 13 nt, Homo sapiens
agaaugacucugg

SEQ ID NO: 1886160 - RNA, 17 nt, Homo sapiens
ucuuccuuggccuauuc

SEQ ID NO: 1886161 - RNA, 15 nt, Homo sapiens
agguccaccugcuaa

SEQ ID NO: 1886162 - RNA, 17 nt, Homo sapiens
ggguuagacugccagcu

SEQ ID NO: 1886163 - RNA, 19 nt, Homo sapiens
aaaucuauucuguguugca

SEQ ID NO: 1886164 - RNA, 16 nt, Homo sapiens
uucaagcaaaacaguu

SEQ ID NO: 1886165 - RNA, 15 nt, Homo sapiens
ccacuguuugucuca

SEQ ID NO: 1886166 - RNA, 15 nt, Homo sapiens
cauacauacauauau

SEQ ID NO: 1886167 - RNA, 15 nt, Homo sapiens
cacacacacacauac

SEQ ID NO: 1886168 - RNA, 15 nt, Homo sapiens
aaguuaaaaagucaa

SEQ ID NO: 1886169 - RNA, 23 nt, Homo sapiens
ugguaacugauuaccugccaauu

SEQ ID NO: 1886170 - RNA, 16 nt, Homo sapiens
cucugagcuguuaucu

SEQ ID NO: 1886171 - RNA, 19 nt, Homo sapiens
gcacucccuuaggcauuau

SEQ ID NO: 1886172 - RNA, 12 nt, Homo sapiens
agggaccugcug

SEQ ID NO: 1886173 - RNA, 12 nt, Homo sapiens
aggcaccugcuc

SEQ ID NO: 1886174 - RNA, 23 nt, Homo sapiens
cauucaaucaaccugcacuucau

SEQ ID NO: 1886175 - RNA, 24 nt, Homo sapiens
gaauacuguauuguuacagcugaa

SEQ ID NO: 1886176 - RNA, 21 nt, Homo sapiens
ccacauccuccacguucugcu

SEQ ID NO: 1886177 - RNA, 17 nt, Homo sapiens
uaaaagccuuauucuaa

SEQ ID NO: 1886178 - RNA, 15 nt, Homo sapiens
cugaaaagcauacaa

SEQ ID NO: 1886179 - RNA, 24 nt, Homo sapiens
aaccagacagagggucacaguguu

SEQ ID NO: 1886180 - RNA, 16 nt, Homo sapiens
cuguaauaaagcucuu

SEQ ID NO: 1886181 - RNA, 21 nt, Homo sapiens
uaaccccuggcaaccaggaau

SEQ ID NO: 1886182 - RNA, 19 nt, Homo sapiens
gaguggguauuugcugaca

SEQ ID NO: 1886183 - RNA, 22 nt, Homo sapiens
caguaucuacuugcauguguau

SEQ ID NO: 1886184 - RNA, 23 nt, Homo sapiens
guaugguuuuucaccaaaccaug

SEQ ID NO: 1886185 - RNA, 20 nt, Homo sapiens
uccugaguagcugagacuac

SEQ ID NO: 1886186 - RNA, 16 nt, Homo sapiens
ucuguaaggacgccuu

SEQ ID NO: 1886187 - RNA, 17 nt, Homo sapiens
cuuuggaaaccaagcaa

SEQ ID NO: 1886188 - RNA, 20 nt, Homo sapiens
uacagguuaagacaaagggu

SEQ ID NO: 1886189 - RNA, 20 nt, Homo sapiens
uuaaaauuccauuaucuuau

SEQ ID NO: 1886190 - RNA, 23 nt, Homo sapiens
agcagaaaggaaaagauuccugu

SEQ ID NO: 1886191 - RNA, 19 nt, Homo sapiens
auagcuaauuuuugcaaau

SEQ ID NO: 1886192 - RNA, 19 nt, Homo sapiens
cucugcccuuacacccaug

SEQ ID NO: 1886193 - RNA, 12 nt, Homo sapiens
aaggugccacug

SEQ ID NO: 1886194 - RNA, 21 nt, Homo sapiens
cauccacauacccugaccugg

SEQ ID NO: 1886195 - RNA, 18 nt, Homo sapiens
ccgcuguggccuucguca

SEQ ID NO: 1886196 - RNA, 22 nt, Homo sapiens
aggaauggccuuucaccuucuc

SEQ ID NO: 1886197 - RNA, 22 nt, Homo sapiens
ucaccccagguucucaccucag

SEQ ID NO: 1886198 - RNA, 19 nt, Homo sapiens
accugagcauauguacaca

SEQ ID NO: 1886199 - RNA, 23 nt, Homo sapiens
aaguugcagcuguuuuguugaca

SEQ ID NO: 1886200 - RNA, 18 nt, Homo sapiens
ggccccaucuccacagga

SEQ ID NO: 1886201 - RNA, 19 nt, Homo sapiens
augccauuuuguacaugua

SEQ ID NO: 1886202 - RNA, 17 nt, Homo sapiens
aacugcucuacuuugag

SEQ ID NO: 1886203 - RNA, 16 nt, Homo sapiens
uuuccaacacaucuau

SEQ ID NO: 1886204 - RNA, 23 nt, Homo sapiens
ugcagaaaaagaaaaaaacuaua

SEQ ID NO: 1886205 - RNA, 22 nt, Homo sapiens
uagugucauguucugugcauau

SEQ ID NO: 1886206 - RNA, 18 nt, Homo sapiens
gaaagacaagacauugug

SEQ ID NO: 1886207 - RNA, 17 nt, Homo sapiens
auguaucaguguccuuu

SEQ ID NO: 1886208 - RNA, 18 nt, Homo sapiens
aauuuacaguuccuucaa

SEQ ID NO: 1886209 - RNA, 16 nt, Homo sapiens
uggggaggaguugucu

SEQ ID NO: 1886210 - RNA, 14 nt, Homo sapiens
auacuuagugguau

SEQ ID NO: 1886211 - RNA, 14 nt, Homo sapiens
acagcuaacaugga

SEQ ID NO: 1886212 - RNA, 18 nt, Homo sapiens
ccagcacucaaccaaccu

SEQ ID NO: 1886213 - RNA, 16 nt, Homo sapiens
cacccaguugugacaa

SEQ ID NO: 1886214 - RNA, 21 nt, Homo sapiens
gucuuggaaaaaaaccacagc

SEQ ID NO: 1886215 - RNA, 20 nt, Homo sapiens
aaaaagcuuuuaugagcuca

SEQ ID NO: 1886216 - RNA, 14 nt, Homo sapiens
auuuccuguucccu

SEQ ID NO: 1886217 - RNA, 22 nt, Homo sapiens
uuuauauuguauauucuggaaa

SEQ ID NO: 1886218 - RNA, 21 nt, Homo sapiens
ucccaacacggguaaaucuag

SEQ ID NO: 1886219 - RNA, 20 nt, Homo sapiens
ccuuugguuuuaaaagagaa

SEQ ID NO: 1886220 - RNA, 15 nt, Homo sapiens
cagcagaugcuguug

SEQ ID NO: 1886221 - RNA, 23 nt, Homo sapiens
gucuucccuucuuugcacuuuug

SEQ ID NO: 1886222 - RNA, 16 nt, Homo sapiens
aggcuuauaacaaaua

SEQ ID NO: 1886223 - RNA, 21 nt, Homo sapiens
agcacugguuucaagaauaug

SEQ ID NO: 1886224 - RNA, 17 nt, Homo sapiens
gugaguucucacucugg

SEQ ID NO: 1886225 - RNA, 19 nt, Homo sapiens
ucacuucgaugacuggaua

SEQ ID NO: 1886226 - RNA, 21 nt, Homo sapiens
cauggaaacgaagcaccauca

SEQ ID NO: 1886227 - RNA, 15 nt, Homo sapiens
ugaaugcaaaccaua

SEQ ID NO: 1886228 - RNA, 23 nt, Homo sapiens
uuuaaacuaugugggucugugaa

SEQ ID NO: 1886229 - RNA, 17 nt, Homo sapiens
gaacuggaccaucucca

SEQ ID NO: 1886230 - RNA, 22 nt, Homo sapiens
guaacagccaccuggagaacuu

SEQ ID NO: 1886231 - RNA, 16 nt, Homo sapiens
cauuacccagcuaaau

SEQ ID NO: 1886232 - RNA, 13 nt, Homo sapiens
auuggaugcauuu

SEQ ID NO: 1886233 - RNA, 22 nt, Homo sapiens
ggccuuuccugugccaaccuga

SEQ ID NO: 1886234 - RNA, 15 nt, Homo sapiens
aggagggcuguagga

SEQ ID NO: 1886235 - RNA, 15 nt, Homo sapiens
auucugcauugcuag

SEQ ID NO: 1886236 - RNA, 17 nt, Homo sapiens
gcacuuuccuuucaaua

SEQ ID NO: 1886237 - RNA, 16 nt, Homo sapiens
ucauuaugcuuugaac

SEQ ID NO: 1886238 - RNA, 13 nt, Homo sapiens
cuuuaagccucag

SEQ ID NO: 1886239 - RNA, 13 nt, Homo sapiens
aucagagcauuua

SEQ ID NO: 1886240 - RNA, 22 nt, Homo sapiens
ggcuucuuccuccuccaucacc

SEQ ID NO: 1886241 - RNA, 13 nt, Homo sapiens
ucuguacuguuac

SEQ ID NO: 1886242 - RNA, 18 nt, Homo sapiens
caaggaaaaaugcugcuu

SEQ ID NO: 1886243 - RNA, 21 nt, Homo sapiens
aauguaauauacugagcugcu

SEQ ID NO: 1886244 - RNA, 16 nt, Homo sapiens
acggccaccacugcag

SEQ ID NO: 1886245 - RNA, 23 nt, Homo sapiens
agggugucacgagcccauucuca

SEQ ID NO: 1886246 - RNA, 17 nt, Homo sapiens
ucgaaugagucuaagaa

SEQ ID NO: 1886247 - RNA, 22 nt, Homo sapiens
uagcaucaguagauuucuggca

SEQ ID NO: 1886248 - RNA, 20 nt, Homo sapiens
caaaucuugaauuucugcca

SEQ ID NO: 1886249 - RNA, 14 nt, Homo sapiens
cuggauugggacgc

SEQ ID NO: 1886250 - RNA, 19 nt, Homo sapiens
cagcacccucuccagauga

SEQ ID NO: 1886251 - RNA, 22 nt, Homo sapiens
uggccaggguaguaagaauuag

SEQ ID NO: 1886252 - RNA, 14 nt, Homo sapiens
uggcucugaccgaa

SEQ ID NO: 1886253 - RNA, 12 nt, Homo sapiens
aauucaguucug

SEQ ID NO: 1886254 - RNA, 14 nt, Homo sapiens
uggugcaaguugag

SEQ ID NO: 1886255 - RNA, 23 nt, Homo sapiens
cugaccaaaucacccaaucccag

SEQ ID NO: 1886256 - RNA, 15 nt, Homo sapiens
cagaagcacauauga

SEQ ID NO: 1886257 - RNA, 22 nt, Homo sapiens
uacucugcccaccccagcauca

SEQ ID NO: 1886258 - RNA, 18 nt, Homo sapiens
cagauggccacugcucuu

SEQ ID NO: 1886259 - RNA, 16 nt, Homo sapiens
acaauaguucuguggg

SEQ ID NO: 1886260 - RNA, 21 nt, Homo sapiens
gauuuuuuuuuuuugguaaca

SEQ ID NO: 1886261 - RNA, 15 nt, Homo sapiens
agauuaguaaccagu

SEQ ID NO: 1886262 - RNA, 19 nt, Homo sapiens
aggugaagcaccaagcuca

SEQ ID NO: 1886263 - RNA, 23 nt, Homo sapiens
gcaggggcuuguugcaggcugug

SEQ ID NO: 1886264 - RNA, 20 nt, Homo sapiens
gaaugcauacucugugcaag

SEQ ID NO: 1886265 - RNA, 23 nt, Homo sapiens
aaccuugugccuggcucagagcc

SEQ ID NO: 1886266 - RNA, 18 nt, Homo sapiens
uuauugcuuacuguguua

SEQ ID NO: 1886267 - RNA, 23 nt, Homo sapiens
gacccaggucugcugcccaggaa

SEQ ID NO: 1886268 - RNA, 21 nt, Homo sapiens
caggccgcacaucucacuuca

SEQ ID NO: 1886269 - RNA, 20 nt, Homo sapiens
cucccccucgcccuaugcaa

SEQ ID NO: 1886270 - RNA, 17 nt, Homo sapiens
cggcuaggaagcagcug

SEQ ID NO: 1886271 - RNA, 15 nt, Homo sapiens
ugaaaaagaacugua

SEQ ID NO: 1886272 - RNA, 19 nt, Homo sapiens
gccuggugggggaagggga

SEQ ID NO: 1886273 - RNA, 22 nt, Homo sapiens
aggguggcugccagcccacugc

SEQ ID NO: 1886274 - RNA, 18 nt, Homo sapiens
ucugaucauguaugcauc

SEQ ID NO: 1886275 - RNA, 23 nt, Homo sapiens
ccucucagagccucagcuucugg

SEQ ID NO: 1886276 - RNA, 17 nt, Homo sapiens
agauaaacaacaaauaa

SEQ ID NO: 1886277 - RNA, 20 nt, Homo sapiens
aguggcccccgggccugcac

SEQ ID NO: 1886278 - RNA, 21 nt, Homo sapiens
ugacguuuuuccaguucacau

SEQ ID NO: 1886279 - RNA, 18 nt, Homo sapiens
cugucuccuguauguggg

SEQ ID NO: 1886280 - RNA, 20 nt, Homo sapiens
aaacuuguauuggaaguaua

SEQ ID NO: 1886281 - RNA, 20 nt, Homo sapiens
uaaaaagcucacugcugauc

SEQ ID NO: 1886282 - RNA, 16 nt, Homo sapiens
cacccacucuguccug

SEQ ID NO: 1886283 - RNA, 20 nt, Homo sapiens
gucccaauuugaauucaauu

SEQ ID NO: 1886284 - RNA, 20 nt, Homo sapiens
cagacguggugcuucucaca

SEQ ID NO: 1886285 - RNA, 15 nt, Homo sapiens
agagaagcugugucu

SEQ ID NO: 1886286 - RNA, 20 nt, Homo sapiens
cuggaggaaauccuaccuuu

SEQ ID NO: 1886287 - RNA, 13 nt, Homo sapiens
ucagccagaguug

SEQ ID NO: 1886288 - RNA, 22 nt, Homo sapiens
acccagacacaucgcacugugg

SEQ ID NO: 1886289 - RNA, 15 nt, Homo sapiens
caacucuccacucca

SEQ ID NO: 1886290 - RNA, 17 nt, Homo sapiens
cuaauaaagaaauaaua

SEQ ID NO: 1886291 - RNA, 19 nt, Homo sapiens
ucuccucccagcgugugua

SEQ ID NO: 1886292 - RNA, 14 nt, Homo sapiens
cuauggugcucugu

SEQ ID NO: 1886293 - RNA, 22 nt, Homo sapiens
auuccagaggacucugcuuaaa

SEQ ID NO: 1886294 - RNA, 19 nt, Homo sapiens
aauguuauucaauggaauc

SEQ ID NO: 1886295 - RNA, 22 nt, Homo sapiens
uccccaacccaccucucuuccc

SEQ ID NO: 1886296 - RNA, 17 nt, Homo sapiens
ccugcaggcuccaugca

SEQ ID NO: 1886297 - RNA, 21 nt, Homo sapiens
agggcuaugccuccauuucag

SEQ ID NO: 1886298 - RNA, 16 nt, Homo sapiens
uaaaagugaucuacau

SEQ ID NO: 1886299 - RNA, 22 nt, Homo sapiens
auuucagaauauuagccaguac

SEQ ID NO: 1886300 - RNA, 16 nt, Homo sapiens
gauaaaagguaauaac

SEQ ID NO: 1886301 - RNA, 21 nt, Homo sapiens
cccucuacauggacucagaga

SEQ ID NO: 1886302 - RNA, 14 nt, Homo sapiens
gggcaacuguagaa

SEQ ID NO: 1886303 - RNA, 20 nt, Homo sapiens
agccuuauaaaccaaucuua

SEQ ID NO: 1886304 - RNA, 18 nt, Homo sapiens
gcaaaggaaucacuuuag

SEQ ID NO: 1886305 - RNA, 20 nt, Homo sapiens
ccuggaucucacaagcacuu

SEQ ID NO: 1886306 - RNA, 23 nt, Homo sapiens
acugugcuguacugagcacugaa

SEQ ID NO: 1886307 - RNA, 17 nt, Homo sapiens
agggaacagcauaugca

SEQ ID NO: 1886308 - RNA, 18 nt, Homo sapiens
uuccgcuuugaaagaagc

SEQ ID NO: 1886309 - RNA, 19 nt, Homo sapiens
acucuggccacccaaacag

SEQ ID NO: 1886310 - RNA, 17 nt, Homo sapiens
ugguuuuuuagugcaau

SEQ ID NO: 1886311 - RNA, 14 nt, Homo sapiens
cagaggaaguggaa

SEQ ID NO: 1886312 - RNA, 19 nt, Homo sapiens
uaauuaccuguauugugga

SEQ ID NO: 1886313 - RNA, 15 nt, Homo sapiens
gcuacagcugugucc

SEQ ID NO: 1886314 - RNA, 19 nt, Homo sapiens
auugagaaagaaacuaaua

SEQ ID NO: 1886315 - RNA, 16 nt, Homo sapiens
uucuggaccugggcau

SEQ ID NO: 1886316 - RNA, 16 nt, Homo sapiens
ucccuauucugccaug

SEQ ID NO: 1886317 - RNA, 16 nt, Homo sapiens
cuguucauuccuccag

SEQ ID NO: 1886318 - RNA, 15 nt, Homo sapiens
cuuccugccuagucu

SEQ ID NO: 1886319 - RNA, 17 nt, Homo sapiens
cacucagaguaaugucu

SEQ ID NO: 1886320 - RNA, 15 nt, Homo sapiens
uacagggaguguagu

SEQ ID NO: 1886321 - RNA, 17 nt, Homo sapiens
cuccuuguaaaagccua

SEQ ID NO: 1886322 - RNA, 18 nt, Homo sapiens
ccuagucgggacuuguaa

SEQ ID NO: 1886323 - RNA, 18 nt, Homo sapiens
ucuuuuauauugauaaca

SEQ ID NO: 1886324 - RNA, 21 nt, Homo sapiens
ucucuuggacccaccuguggg

SEQ ID NO: 1886325 - RNA, 14 nt, Homo sapiens
agaaagagccugaa

SEQ ID NO: 1886326 - RNA, 17 nt, Homo sapiens
ccaccaacacugcucac

SEQ ID NO: 1886327 - RNA, 11 nt, Homo sapiens
uacaacacuga

SEQ ID NO: 1886328 - RNA, 19 nt, Homo sapiens
aacuaccucaaaacacuuu

SEQ ID NO: 1886329 - RNA, 13 nt, Homo sapiens
uucuuuuuccacc

SEQ ID NO: 1886330 - RNA, 16 nt, Homo sapiens
caaagaucacugccca

SEQ ID NO: 1886331 - RNA, 15 nt, Homo sapiens
cuuccugacacuuua

SEQ ID NO: 1886332 - RNA, 18 nt, Homo sapiens
aagccagcauauuccuag

SEQ ID NO: 1886333 - RNA, 17 nt, Homo sapiens
uauaucuuguagcuuua

SEQ ID NO: 1886334 - RNA, 23 nt, Homo sapiens
uggcaaagauuuuuggcacuuug

SEQ ID NO: 1886335 - RNA, 13 nt, Homo sapiens
gugauggcuaugc

SEQ ID NO: 1886336 - RNA, 14 nt, Homo sapiens
cucccuaugucugc

SEQ ID NO: 1886337 - RNA, 15 nt, Homo sapiens
cugaucuuugccccu

SEQ ID NO: 1886338 - RNA, 22 nt, Homo sapiens
auaucuguuuuguuucuugacu

SEQ ID NO: 1886339 - RNA, 21 nt, Homo sapiens
ucuagaacauucagauuuacc

SEQ ID NO: 1886340 - RNA, 16 nt, Homo sapiens
cuugcacaucauggag

SEQ ID NO: 1886341 - RNA, 15 nt, Homo sapiens
uagauaccacuuaac

SEQ ID NO: 1886342 - RNA, 22 nt, Homo sapiens
caauaacuuuucaccaaugagc

SEQ ID NO: 1886343 - RNA, 18 nt, Homo sapiens
agacuuggggaccagagg

SEQ ID NO: 1886344 - RNA, 20 nt, Homo sapiens
ccuaaucaggcugagguguc

SEQ ID NO: 1886345 - RNA, 22 nt, Homo sapiens
acaucugugucucuggaaccca

SEQ ID NO: 1886346 - RNA, 15 nt, Homo sapiens
uacgguuaugaaggc

SEQ ID NO: 1886347 - RNA, 12 nt, Homo sapiens
ccaucaccagac

SEQ ID NO: 1886348 - RNA, 15 nt, Homo sapiens
cuuuguaagugcagg

SEQ ID NO: 1886349 - RNA, 17 nt, Homo sapiens
aaugguugaugauacuu

SEQ ID NO: 1886350 - RNA, 16 nt, Homo sapiens
gccccucucagcuuuc

SEQ ID NO: 1886351 - RNA, 16 nt, Homo sapiens
uccucucuucucuauu

SEQ ID NO: 1886352 - RNA, 17 nt, Homo sapiens
uccgguuuagucaucca

SEQ ID NO: 1886353 - RNA, 21 nt, Homo sapiens
acucaguggacagugcuguug

SEQ ID NO: 1886354 - RNA, 17 nt, Homo sapiens
uagauaucaauguuaau

SEQ ID NO: 1886355 - RNA, 17 nt, Homo sapiens
cagucagacauggccaa

SEQ ID NO: 1886356 - RNA, 16 nt, Homo sapiens
cuccagauaugugcca

SEQ ID NO: 1886357 - RNA, 18 nt, Homo sapiens
gcgcaugugcgcacacac

SEQ ID NO: 1886358 - RNA, 14 nt, Homo sapiens
auaaccuuguucca

SEQ ID NO: 1886359 - RNA, 23 nt, Homo sapiens
uaaguuuccuucccuacccaguc

SEQ ID NO: 1886360 - RNA, 22 nt, Homo sapiens
ccaauuauuguuacacauuaag

SEQ ID NO: 1886361 - RNA, 12 nt, Homo sapiens
uuauuuugugaa

SEQ ID NO: 1886362 - RNA, 17 nt, Homo sapiens
uguacaaagauacuuga

SEQ ID NO: 1886363 - RNA, 21 nt, Homo sapiens
aaggucauaagggagcaugau

SEQ ID NO: 1886364 - RNA, 19 nt, Homo sapiens
guuuauuauguacuauuca

SEQ ID NO: 1886365 - RNA, 13 nt, Homo sapiens
caauuaugucucu

SEQ ID NO: 1886366 - RNA, 20 nt, Homo sapiens
uccugagggauuucuaacca

SEQ ID NO: 1886367 - RNA, 17 nt, Homo sapiens
gccagugagggcagucc

SEQ ID NO: 1886368 - RNA, 21 nt, Homo sapiens
cucugguccuucugaccccac

SEQ ID NO: 1886369 - RNA, 12 nt, Homo sapiens
acauguguaaac

SEQ ID NO: 1886370 - RNA, 21 nt, Homo sapiens
guccucuuugugauaauucuc

SEQ ID NO: 1886371 - RNA, 13 nt, Homo sapiens
uaauggaggccaa

SEQ ID NO: 1886372 - RNA, 20 nt, Homo sapiens
acuccagccugggugacaaa

SEQ ID NO: 1886373 - RNA, 22 nt, Homo sapiens
cagaucgcucccuuggcuuuga

SEQ ID NO: 1886374 - RNA, 15 nt, Homo sapiens
caaaaggcagcucac

SEQ ID NO: 1886375 - RNA, 19 nt, Homo sapiens
uggagacaucacuugccaa

SEQ ID NO: 1886376 - RNA, 14 nt, Homo sapiens
aauaauaaacagug

SEQ ID NO: 1886377 - RNA, 13 nt, Homo sapiens
ggaugcugugcua

SEQ ID NO: 1886378 - RNA, 15 nt, Homo sapiens
uucuaugaauuccua

SEQ ID NO: 1886379 - RNA, 19 nt, Homo sapiens
uauuuuuauaucaugcaaa

SEQ ID NO: 1886380 - RNA, 15 nt, Homo sapiens
gagcaccuugcaguu

SEQ ID NO: 1886381 - RNA, 14 nt, Homo sapiens
gagacuauguguca

SEQ ID NO: 1886382 - RNA, 18 nt, Homo sapiens
ucagggcagggcucugau

SEQ ID NO: 1886383 - RNA, 15 nt, Homo sapiens
uucccagggaccuug

SEQ ID NO: 1886384 - RNA, 19 nt, Homo sapiens
ucugagaagaggagcccuc

SEQ ID NO: 1886385 - RNA, 23 nt, Homo sapiens
cauaggaaaucuuguccagagac

SEQ ID NO: 1886386 - RNA, 19 nt, Homo sapiens
uuuagcgugcucacugacc

SEQ ID NO: 1886387 - RNA, 19 nt, Homo sapiens
ucaaugagaugguggcauu

SEQ ID NO: 1886388 - RNA, 13 nt, Homo sapiens
auuauguauaaca

SEQ ID NO: 1886389 - RNA, 12 nt, Homo sapiens
ugguacagagaa

SEQ ID NO: 1886390 - RNA, 12 nt, Homo sapiens
uugaugccauau

SEQ ID NO: 1886391 - RNA, 18 nt, Homo sapiens
ccuucaacugcucugcau

SEQ ID NO: 1886392 - RNA, 23 nt, Homo sapiens
ggaauucuuuacaauaaacauag

SEQ ID NO: 1886393 - RNA, 19 nt, Homo sapiens
ccucuuuccuuccuuccuc

SEQ ID NO: 1886394 - RNA, 22 nt, Homo sapiens
cauugaaaugcacagaucugcu

SEQ ID NO: 1886395 - RNA, 19 nt, Homo sapiens
augucagacacuacaugau

SEQ ID NO: 1886396 - RNA, 21 nt, Homo sapiens
auuggucuggguggaugugag

SEQ ID NO: 1886397 - RNA, 13 nt, Homo sapiens
gggauuacaggcg

SEQ ID NO: 1886398 - RNA, 14 nt, Homo sapiens
ucucuuaauuuuuc

SEQ ID NO: 1886399 - RNA, 17 nt, Homo sapiens
cacccaccuaugugcca

SEQ ID NO: 1886400 - RNA, 19 nt, Homo sapiens
acaaacacuuagcauccca

SEQ ID NO: 1886401 - RNA, 23 nt, Homo sapiens
guacucaaguaccaccaagggau

SEQ ID NO: 1886402 - RNA, 14 nt, Homo sapiens
ucauccaugcacuu

SEQ ID NO: 1886403 - RNA, 19 nt, Homo sapiens
aauaauuugguauccuuau

SEQ ID NO: 1886404 - RNA, 18 nt, Homo sapiens
cagaauaaauggguaaca

SEQ ID NO: 1886405 - RNA, 17 nt, Homo sapiens
auauauuauauauacau

SEQ ID NO: 1886406 - RNA, 20 nt, Homo sapiens
uccggauuucuaacaguccu

SEQ ID NO: 1886407 - RNA, 14 nt, Homo sapiens
aguccucccuggug

SEQ ID NO: 1886408 - RNA, 21 nt, Homo sapiens
cggucacuuuacuguccccau

SEQ ID NO: 1886409 - RNA, 13 nt, Homo sapiens
agcaugcuacagu

SEQ ID NO: 1886410 - RNA, 15 nt, Homo sapiens
augcuuguacauaau

SEQ ID NO: 1886411 - RNA, 20 nt, Homo sapiens
gagcacagguuccaguacug

SEQ ID NO: 1886412 - RNA, 20 nt, Homo sapiens
ugcucacacauuacaacagu

SEQ ID NO: 1886413 - RNA, 22 nt, Homo sapiens
uaaaacaaucuguaauugcuua

SEQ ID NO: 1886414 - RNA, 16 nt, Homo sapiens
cagagggcaggggugc

SEQ ID NO: 1886415 - RNA, 15 nt, Homo sapiens
guauuuggaaaccuu

SEQ ID NO: 1886416 - RNA, 20 nt, Homo sapiens
uuagaaaaacaucccaagaa

SEQ ID NO: 1886417 - RNA, 13 nt, Homo sapiens
uaguuaaacugag

SEQ ID NO: 1886418 - RNA, 13 nt, Homo sapiens
uugagaaacaguu

SEQ ID NO: 1886419 - RNA, 16 nt, Homo sapiens
cccgggaccgugggcc

SEQ ID NO: 1886420 - RNA, 20 nt, Homo sapiens
acuacaguuagggcuccuau

SEQ ID NO: 1886421 - RNA, 18 nt, Homo sapiens
cuauucccaggcagggag

SEQ ID NO: 1886422 - RNA, 23 nt, Homo sapiens
aaucaggcgagacgccuuuguga

SEQ ID NO: 1886423 - RNA, 16 nt, Homo sapiens
uaaaacaaaaccaagc

SEQ ID NO: 1886424 - RNA, 20 nt, Homo sapiens
uaaaacuuaccuuuacugaa

SEQ ID NO: 1886425 - RNA, 18 nt, Homo sapiens
caguugccauugacagaa

SEQ ID NO: 1886426 - RNA, 20 nt, Homo sapiens
caggggugcuaugacaugca

SEQ ID NO: 1886427 - RNA, 14 nt, Homo sapiens
ugacauaaugccaa

SEQ ID NO: 1886428 - RNA, 14 nt, Homo sapiens
cuuaagaacuuuaa

SEQ ID NO: 1886429 - RNA, 15 nt, Homo sapiens
aaauguuaacacuca

SEQ ID NO: 1886430 - RNA, 15 nt, Homo sapiens
ucauaaccauuccca

SEQ ID NO: 1886431 - RNA, 12 nt, Homo sapiens
cugaugcugaca

SEQ ID NO: 1886432 - RNA, 20 nt, Homo sapiens
augauugagaguuggcugua

SEQ ID NO: 1886433 - RNA, 22 nt, Homo sapiens
uggcguuacugcuugaccaaag

SEQ ID NO: 1886434 - RNA, 13 nt, Homo sapiens
cucgaugccugau

SEQ ID NO: 1886435 - RNA, 19 nt, Homo sapiens
caugcccugagcucucuga

SEQ ID NO: 1886436 - RNA, 17 nt, Homo sapiens
cuacaguaaccaaaaca

SEQ ID NO: 1886437 - RNA, 16 nt, Homo sapiens
gaaaaugaaucuucac

SEQ ID NO: 1886438 - RNA, 18 nt, Homo sapiens
uccccaagaacacaagaa

SEQ ID NO: 1886439 - RNA, 17 nt, Homo sapiens
cagcugugcuuuuugca

SEQ ID NO: 1886440 - RNA, 16 nt, Homo sapiens
ugcgacgcagguguac

SEQ ID NO: 1886441 - RNA, 20 nt, Homo sapiens
cuuuuaaugugaggaacuca

SEQ ID NO: 1886442 - RNA, 15 nt, Homo sapiens
aaaaugcaauaucug

SEQ ID NO: 1886443 - RNA, 15 nt, Homo sapiens
agaagcauccuccac

SEQ ID NO: 1886444 - RNA, 17 nt, Homo sapiens
cagccugggcccaucuc

SEQ ID NO: 1886445 - RNA, 23 nt, Homo sapiens
accaacuacuaccuguaaugaca

SEQ ID NO: 1886446 - RNA, 15 nt, Homo sapiens
auaaauaaaagaaca

SEQ ID NO: 1886447 - RNA, 22 nt, Homo sapiens
agacacauuaaaggguagccua

SEQ ID NO: 1886448 - RNA, 14 nt, Homo sapiens
uccacucaaugucu

SEQ ID NO: 1886449 - RNA, 13 nt, Homo sapiens
agccuacagccag

SEQ ID NO: 1886450 - RNA, 18 nt, Homo sapiens
auauuuugucacugcugu

SEQ ID NO: 1886451 - RNA, 18 nt, Homo sapiens
uucuuauaacauuguaug

SEQ ID NO: 1886452 - RNA, 12 nt, Homo sapiens
gccacaccuguc

SEQ ID NO: 1886453 - RNA, 13 nt, Homo sapiens
cucucucugaggg

SEQ ID NO: 1886454 - RNA, 15 nt, Homo sapiens
uugcucugauagaca

SEQ ID NO: 1886455 - RNA, 16 nt, Homo sapiens
cuggccagccaccacu

SEQ ID NO: 1886456 - RNA, 18 nt, Homo sapiens
guucccauuggaugcauu

SEQ ID NO: 1886457 - RNA, 12 nt, Homo sapiens
cagggagccuuu

SEQ ID NO: 1886458 - RNA, 19 nt, Homo sapiens
uaguucaaaacaaccacuu

SEQ ID NO: 1886459 - RNA, 22 nt, Homo sapiens
uaaauuuuuuuuuuuuacuuga

SEQ ID NO: 1886460 - RNA, 14 nt, Homo sapiens
cauuuuaugcagaa

SEQ ID NO: 1886461 - RNA, 13 nt, Homo sapiens
gcuggcugugaaa

SEQ ID NO: 1886462 - RNA, 23 nt, Homo sapiens
acuggaauauaauuucaaaccac

SEQ ID NO: 1886463 - RNA, 20 nt, Homo sapiens
acacuccuuuagauagcagc

SEQ ID NO: 1886464 - RNA, 20 nt, Homo sapiens
acuccagcugggagacacag

SEQ ID NO: 1886465 - RNA, 20 nt, Homo sapiens
aggcacuguaguucuaagac

SEQ ID NO: 1886466 - RNA, 19 nt, Homo sapiens
ucaacagaaauauucuaca

SEQ ID NO: 1886467 - RNA, 16 nt, Homo sapiens
cuguagaaauguaucc

SEQ ID NO: 1886468 - RNA, 16 nt, Homo sapiens
ccugguccacugggaa

SEQ ID NO: 1886469 - RNA, 20 nt, Homo sapiens
acuguaguaauuguuacaau

SEQ ID NO: 1886470 - RNA, 21 nt, Homo sapiens
gggccaugguggagggcacuu

SEQ ID NO: 1886471 - RNA, 19 nt, Homo sapiens
ugaugucauuuuguuuaua

SEQ ID NO: 1886472 - RNA, 17 nt, Homo sapiens
ccucaaaugcggggugg

SEQ ID NO: 1886473 - RNA, 19 nt, Homo sapiens
cccucgcaaaaugauguga

SEQ ID NO: 1886474 - RNA, 20 nt, Homo sapiens
gcucugugcagucacuggag

SEQ ID NO: 1886475 - RNA, 19 nt, Homo sapiens
aaccccccuccugcuccuc

SEQ ID NO: 1886476 - RNA, 21 nt, Homo sapiens
aacggaggacugaacugggga

SEQ ID NO: 1886477 - RNA, 20 nt, Homo sapiens
cugacaggcgcaacuccucc

SEQ ID NO: 1886478 - RNA, 17 nt, Homo sapiens
auucuuuaccucagguu

SEQ ID NO: 1886479 - RNA, 22 nt, Homo sapiens
ucuugcauauuuuguaacuucc

SEQ ID NO: 1886480 - RNA, 22 nt, Homo sapiens
caaccuggccaacauggugaaa

SEQ ID NO: 1886481 - RNA, 14 nt, Homo sapiens
uuauuuuuccagcu

SEQ ID NO: 1886482 - RNA, 15 nt, Homo sapiens
gccgcuucagaugac

SEQ ID NO: 1886483 - RNA, 18 nt, Homo sapiens
cauauuugaaaaccauau

SEQ ID NO: 1886484 - RNA, 13 nt, Homo sapiens
auuucauuaucau

SEQ ID NO: 1886485 - RNA, 20 nt, Homo sapiens
ucacucaauuucucugagga

SEQ ID NO: 1886486 - RNA, 12 nt, Homo sapiens
uggacccuggaa

SEQ ID NO: 1886487 - RNA, 18 nt, Homo sapiens
uucucugugcaguagcau

SEQ ID NO: 1886488 - RNA, 18 nt, Homo sapiens
agagaaaugucugagaua

SEQ ID NO: 1886489 - RNA, 14 nt, Homo sapiens
uugcuugagcccag

SEQ ID NO: 1886490 - RNA, 15 nt, Homo sapiens
cuuuucuaaagccuu

SEQ ID NO: 1886491 - RNA, 14 nt, Homo sapiens
uaaccuacuuguaa

SEQ ID NO: 1886492 - RNA, 13 nt, Homo sapiens
gggagacacugau

SEQ ID NO: 1886493 - RNA, 14 nt, Homo sapiens
acuuaguaagugcu

SEQ ID NO: 1886494 - RNA, 23 nt, Homo sapiens
uuuuuccuacagcuacauugaga

SEQ ID NO: 1886495 - RNA, 13 nt, Homo sapiens
uaucacuguugca

SEQ ID NO: 1886496 - RNA, 13 nt, Homo sapiens
gugccguggcacc

SEQ ID NO: 1886497 - RNA, 13 nt, Homo sapiens
gucucacacuccu

SEQ ID NO: 1886498 - RNA, 21 nt, Homo sapiens
ugccaggugcaaucuacugga

SEQ ID NO: 1886499 - RNA, 15 nt, Homo sapiens
agaagcaacuaaguu

SEQ ID NO: 1886500 - RNA, 21 nt, Homo sapiens
gaacaaaaaaaccacaaaggc

SEQ ID NO: 1886501 - RNA, 22 nt, Homo sapiens
ccaggcugcccccaacacucca

SEQ ID NO: 1886502 - RNA, 21 nt, Homo sapiens
ccagaguguauuacaacaauc

SEQ ID NO: 1886503 - RNA, 22 nt, Homo sapiens
gacuuugggcugugagcauuua

SEQ ID NO: 1886504 - RNA, 20 nt, Homo sapiens
cugucuucccaaacccaguc

SEQ ID NO: 1886505 - RNA, 18 nt, Homo sapiens
cuggcuuuguucuuguca

SEQ ID NO: 1886506 - RNA, 17 nt, Homo sapiens
cugagccuccugaaguu

SEQ ID NO: 1886507 - RNA, 18 nt, Homo sapiens
uagaaagcaagauguacu

SEQ ID NO: 1886508 - RNA, 17 nt, Homo sapiens
uuuccuugucccaggau

SEQ ID NO: 1886509 - RNA, 13 nt, Homo sapiens
gcucuucagcaca

SEQ ID NO: 1886510 - RNA, 13 nt, Homo sapiens
cauaaucacaaau

SEQ ID NO: 1886511 - RNA, 18 nt, Homo sapiens
gcaggaucugucugugca

SEQ ID NO: 1886512 - RNA, 14 nt, Homo sapiens
ggucucucuggaaa

SEQ ID NO: 1886513 - RNA, 20 nt, Homo sapiens
cacuguacauuuuuauacag

SEQ ID NO: 1886514 - RNA, 13 nt, Homo sapiens
caaaaaauuugag

SEQ ID NO: 1886515 - RNA, 14 nt, Homo sapiens
acacucagaccagc

SEQ ID NO: 1886516 - RNA, 22 nt, Homo sapiens
uuaguauagccacaaaugccuu

SEQ ID NO: 1886517 - RNA, 16 nt, Homo sapiens
gccucguacguguguu

SEQ ID NO: 1886518 - RNA, 17 nt, Homo sapiens
gacccauguucucaaua

SEQ ID NO: 1886519 - RNA, 13 nt, Homo sapiens
ccauugcucuuga

SEQ ID NO: 1886520 - RNA, 14 nt, Homo sapiens
acaguugauuucca

SEQ ID NO: 1886521 - RNA, 15 nt, Homo sapiens
cacaaagcacuggcc

SEQ ID NO: 1886522 - RNA, 20 nt, Homo sapiens
ccuauuuaugaaaaccauau

SEQ ID NO: 1886523 - RNA, 23 nt, Homo sapiens
acaaaguuacugauucacugcau

SEQ ID NO: 1886524 - RNA, 18 nt, Homo sapiens
aggcagccaccaguggac

SEQ ID NO: 1886525 - RNA, 17 nt, Homo sapiens
gcaugggugagaccuga

SEQ ID NO: 1886526 - RNA, 14 nt, Homo sapiens
caguggagcccacg

SEQ ID NO: 1886527 - RNA, 21 nt, Homo sapiens
auguauuuauauuuugugcua

SEQ ID NO: 1886528 - RNA, 15 nt, Homo sapiens
aggcccaggcuccag

SEQ ID NO: 1886529 - RNA, 18 nt, Homo sapiens
caacugucaguucauccu

SEQ ID NO: 1886530 - RNA, 19 nt, Homo sapiens
ucaauugcuucugugcaau

SEQ ID NO: 1886531 - RNA, 13 nt, Homo sapiens
accaaaacacaga

SEQ ID NO: 1886532 - RNA, 14 nt, Homo sapiens
gcccagaucaugcc

SEQ ID NO: 1886533 - RNA, 17 nt, Homo sapiens
uagguaucauucaacuc

SEQ ID NO: 1886534 - RNA, 18 nt, Homo sapiens
acaccgugugccauagaa

SEQ ID NO: 1886535 - RNA, 23 nt, Homo sapiens
uuaacgacagaagguugccaggu

SEQ ID NO: 1886536 - RNA, 12 nt, Homo sapiens
aaugcacaguga

SEQ ID NO: 1886537 - RNA, 14 nt, Homo sapiens
auaaacacauuucc

SEQ ID NO: 1886538 - RNA, 19 nt, Homo sapiens
ugcagacagaccucaaggg

SEQ ID NO: 1886539 - RNA, 17 nt, Homo sapiens
cauuuugcuucccaucu

SEQ ID NO: 1886540 - RNA, 19 nt, Homo sapiens
ccacaaucugggacuuuca

SEQ ID NO: 1886541 - RNA, 12 nt, Homo sapiens
uauaugucuugc

SEQ ID NO: 1886542 - RNA, 21 nt, Homo sapiens
gaaagggucaacggcccuguu

SEQ ID NO: 1886543 - RNA, 14 nt, Homo sapiens
aaggagacauguga

SEQ ID NO: 1886544 - RNA, 17 nt, Homo sapiens
guccgcgcgccagcaca

SEQ ID NO: 1886545 - RNA, 21 nt, Homo sapiens
caugcagcuguggcagaguua

SEQ ID NO: 1886546 - RNA, 20 nt, Homo sapiens
uaaucuuugaaagcugaaua

SEQ ID NO: 1886547 - RNA, 18 nt, Homo sapiens
aaaucccauauauucuuc

SEQ ID NO: 1886548 - RNA, 21 nt, Homo sapiens
gugggguaaccaaauguuggc

SEQ ID NO: 1886549 - RNA, 22 nt, Homo sapiens
gacaagaaauccuaguggccuc

SEQ ID NO: 1886550 - RNA, 13 nt, Homo sapiens
uaacauguguaug

SEQ ID NO: 1886551 - RNA, 12 nt, Homo sapiens
uuuucaguauga

SEQ ID NO: 1886552 - RNA, 22 nt, Homo sapiens
cucagucaauaaauuugcaaau

SEQ ID NO: 1886553 - RNA, 20 nt, Homo sapiens
uguaaaguaaaagcuauaaa

SEQ ID NO: 1886554 - RNA, 18 nt, Homo sapiens
aguuacaguucugugguu

SEQ ID NO: 1886555 - RNA, 12 nt, Homo sapiens
cuuuccuugccu

SEQ ID NO: 1886556 - RNA, 15 nt, Homo sapiens
cuguaauguguacug

SEQ ID NO: 1886557 - RNA, 23 nt, Homo sapiens
ggagaacuucauaaagaugucuc

SEQ ID NO: 1886558 - RNA, 16 nt, Homo sapiens
auuguuaugcacagaa

SEQ ID NO: 1886559 - RNA, 16 nt, Homo sapiens
ugcaccaacuuugaag

SEQ ID NO: 1886560 - RNA, 20 nt, Homo sapiens
ugacacggccaugaccacuu

SEQ ID NO: 1886561 - RNA, 12 nt, Homo sapiens
cacugcucccua

SEQ ID NO: 1886562 - RNA, 20 nt, Homo sapiens
ccucuccuuccaacaaaaga

SEQ ID NO: 1886563 - RNA, 19 nt, Homo sapiens
uagaaacauugaagaugaa

SEQ ID NO: 1886564 - RNA, 19 nt, Homo sapiens
cuauuccaucaacugugaa

SEQ ID NO: 1886565 - RNA, 12 nt, Homo sapiens
gauaaaagacag

SEQ ID NO: 1886566 - RNA, 15 nt, Homo sapiens
cacauaccuucaugu

SEQ ID NO: 1886567 - RNA, 17 nt, Homo sapiens
aaguacuacuccucaaa

SEQ ID NO: 1886568 - RNA, 19 nt, Homo sapiens
gaacuacuuuuggugcuua

SEQ ID NO: 1886569 - RNA, 14 nt, Homo sapiens
aagcuuuggacaag

SEQ ID NO: 1886570 - RNA, 17 nt, Homo sapiens
uaguggaccacuuggaa

SEQ ID NO: 1886571 - RNA, 12 nt, Homo sapiens
uuggccagugac

SEQ ID NO: 1886572 - RNA, 14 nt, Homo sapiens
ccaagccaggguuc

SEQ ID NO: 1886573 - RNA, 23 nt, Homo sapiens
ucuauggcaguccagccagcucc

SEQ ID NO: 1886574 - RNA, 15 nt, Homo sapiens
uauaaucugaagaua

SEQ ID NO: 1886575 - RNA, 16 nt, Homo sapiens
acugcacagaagacag

SEQ ID NO: 1886576 - RNA, 23 nt, Homo sapiens
uaugaaaaccguaaagugccuua

SEQ ID NO: 1886577 - RNA, 12 nt, Homo sapiens
ggagcucagagc

SEQ ID NO: 1886578 - RNA, 12 nt, Homo sapiens
aaaccucaaggg

SEQ ID NO: 1886579 - RNA, 12 nt, Homo sapiens
gagccucaggag

SEQ ID NO: 1886580 - RNA, 14 nt, Homo sapiens
cugucgcccagucu

SEQ ID NO: 1886581 - RNA, 17 nt, Homo sapiens
uuucauuuuugccaguc

SEQ ID NO: 1886582 - RNA, 23 nt, Homo sapiens
ucccaggaaguggccaaaagcua

SEQ ID NO: 1886583 - RNA, 22 nt, Homo sapiens
augccuguaaucccagcacuuu

SEQ ID NO: 1886584 - RNA, 18 nt, Homo sapiens
cuggccuugugucacugg

SEQ ID NO: 1886585 - RNA, 19 nt, Homo sapiens
auucuguuugcguacuugu

SEQ ID NO: 1886586 - RNA, 17 nt, Homo sapiens
gcuguggaccauggagu

SEQ ID NO: 1886587 - RNA, 12 nt, Homo sapiens
cagauuugcaac

SEQ ID NO: 1886588 - RNA, 16 nt, Homo sapiens
gagcccagagggccaa

SEQ ID NO: 1886589 - RNA, 14 nt, Homo sapiens
acuugagggccugu

SEQ ID NO: 1886590 - RNA, 19 nt, Homo sapiens
ccuguuuguugagugcacu

SEQ ID NO: 1886591 - RNA, 14 nt, Homo sapiens
ugguccaacugcaa

SEQ ID NO: 1886592 - RNA, 15 nt, Homo sapiens
uucaagcgcuuaacu

SEQ ID NO: 1886593 - RNA, 18 nt, Homo sapiens
gaaccagcaucucagcgc

SEQ ID NO: 1886594 - RNA, 20 nt, Homo sapiens
aagaccuggcagcucuggac

SEQ ID NO: 1886595 - RNA, 22 nt, Homo sapiens
aggcagccacccugucaccuag

SEQ ID NO: 1886596 - RNA, 23 nt, Homo sapiens
gaacuuaauuaccuaagagccac

SEQ ID NO: 1886597 - RNA, 12 nt, Homo sapiens
uacauagccuau

SEQ ID NO: 1886598 - RNA, 14 nt, Homo sapiens
cuuuugcuccuauc

SEQ ID NO: 1886599 - RNA, 15 nt, Homo sapiens
cugugccuugccaca

SEQ ID NO: 1886600 - RNA, 15 nt, Homo sapiens
aagaccugagcugaa

SEQ ID NO: 1886601 - RNA, 15 nt, Homo sapiens
uuauucucuucacuc

SEQ ID NO: 1886602 - RNA, 15 nt, Homo sapiens
aacuuuccaaaaccu

SEQ ID NO: 1886603 - RNA, 15 nt, Homo sapiens
cagugcauguugcca

SEQ ID NO: 1886604 - RNA, 15 nt, Homo sapiens
ucaaggaaagaauga

SEQ ID NO: 1886605 - RNA, 15 nt, Homo sapiens
cuugcagaacugcca

SEQ ID NO: 1886606 - RNA, 23 nt, Homo sapiens
gaauacuaauaaaauacauacua

SEQ ID NO: 1886607 - RNA, 20 nt, Homo sapiens
aggccagguguggugacuca

SEQ ID NO: 1886608 - RNA, 16 nt, Homo sapiens
uuguaauugcauuaua

SEQ ID NO: 1886609 - RNA, 23 nt, Homo sapiens
uuaaauuugcaaaucucaggaua

SEQ ID NO: 1886610 - RNA, 17 nt, Homo sapiens
gcuacccaugacuuuau

SEQ ID NO: 1886611 - RNA, 15 nt, Homo sapiens
gcuguuguuccauug

SEQ ID NO: 1886612 - RNA, 13 nt, Homo sapiens
agagauuugagaa

SEQ ID NO: 1886613 - RNA, 19 nt, Homo sapiens
cuggcugaugauccagaac

SEQ ID NO: 1886614 - RNA, 16 nt, Homo sapiens
augucucuaaagcacu

SEQ ID NO: 1886615 - RNA, 17 nt, Homo sapiens
uuaacaagucauuucaa

SEQ ID NO: 1886616 - RNA, 21 nt, Homo sapiens
aggccagugggaccccacaga

SEQ ID NO: 1886617 - RNA, 21 nt, Homo sapiens
agacuuaaauaguucaguaua

SEQ ID NO: 1886618 - RNA, 20 nt, Homo sapiens
aauagguuucaacauaugaa

SEQ ID NO: 1886619 - RNA, 13 nt, Homo sapiens
aaguugagaacaa

SEQ ID NO: 1886620 - RNA, 15 nt, Homo sapiens
caguaaaauaauaau

SEQ ID NO: 1886621 - RNA, 19 nt, Homo sapiens
uucagccaaacaguaugau

SEQ ID NO: 1886622 - RNA, 22 nt, Homo sapiens
cuccucguucuuauuuaaucuc

SEQ ID NO: 1886623 - RNA, 21 nt, Homo sapiens
uccugguuccuaggugagcag

SEQ ID NO: 1886624 - RNA, 22 nt, Homo sapiens
gcaacagccacuacauuacuuc

SEQ ID NO: 1886625 - RNA, 18 nt, Homo sapiens
gggaaaaucuauuccugc

SEQ ID NO: 1886626 - RNA, 18 nt, Homo sapiens
uuaaauaaaugugagaac

SEQ ID NO: 1886627 - RNA, 15 nt, Homo sapiens
auccacuuacauaua

SEQ ID NO: 1886628 - RNA, 15 nt, Homo sapiens
cagaauugagaguga

SEQ ID NO: 1886629 - RNA, 23 nt, Homo sapiens
cucagaauaaaagaugauuucuc

SEQ ID NO: 1886630 - RNA, 22 nt, Homo sapiens
uccuuuaagagcucuggugaua

SEQ ID NO: 1886631 - RNA, 15 nt, Homo sapiens
augggggccaggaca

SEQ ID NO: 1886632 - RNA, 15 nt, Homo sapiens
agacaugcagcuuuc

SEQ ID NO: 1886633 - RNA, 15 nt, Homo sapiens
agccuugcagauauc

SEQ ID NO: 1886634 - RNA, 21 nt, Homo sapiens
cuggauucacuuggauucuga

SEQ ID NO: 1886635 - RNA, 14 nt, Homo sapiens
aacacaucacagau

SEQ ID NO: 1886636 - RNA, 19 nt, Homo sapiens
gcugaagcaaagugcccau

SEQ ID NO: 1886637 - RNA, 14 nt, Homo sapiens
cccagaaagaggca

SEQ ID NO: 1886638 - RNA, 12 nt, Homo sapiens
cugcgucuuccg

SEQ ID NO: 1886639 - RNA, 18 nt, Homo sapiens
cuccauacguucagaggu

SEQ ID NO: 1886640 - RNA, 14 nt, Homo sapiens
uccuauuacugaug

SEQ ID NO: 1886641 - RNA, 17 nt, Homo sapiens
aacagcccccacuccag

SEQ ID NO: 1886642 - RNA, 16 nt, Homo sapiens
acggguuaagaucuga

SEQ ID NO: 1886643 - RNA, 19 nt, Homo sapiens
gccucaguaagacgacaag

SEQ ID NO: 1886644 - RNA, 14 nt, Homo sapiens
cugcugcaaggugg

SEQ ID NO: 1886645 - RNA, 13 nt, Homo sapiens
cuggccacaagga

SEQ ID NO: 1886646 - RNA, 15 nt, Homo sapiens
caagcaaaaugcaaa

SEQ ID NO: 1886647 - RNA, 17 nt, Homo sapiens
caaggcaaaucucuccu

SEQ ID NO: 1886648 - RNA, 14 nt, Homo sapiens
uggugacaguccaa

SEQ ID NO: 1886649 - RNA, 17 nt, Homo sapiens
gagggccauugaacucu

SEQ ID NO: 1886650 - RNA, 21 nt, Homo sapiens
uaugccucagucuauucugua

SEQ ID NO: 1886651 - RNA, 20 nt, Homo sapiens
augggcccacaggguaccag

SEQ ID NO: 1886652 - RNA, 14 nt, Homo sapiens
aaauuauaucucag

SEQ ID NO: 1886653 - RNA, 23 nt, Homo sapiens
uacauuguuugucugucuucaua

SEQ ID NO: 1886654 - RNA, 18 nt, Homo sapiens
aucccuuugcaccugaga

SEQ ID NO: 1886655 - RNA, 15 nt, Homo sapiens
gcugaugcagacaca

SEQ ID NO: 1886656 - RNA, 14 nt, Homo sapiens
uguauuccacuuag

SEQ ID NO: 1886657 - RNA, 23 nt, Homo sapiens
cugauugaaacaugaaacaacuc

SEQ ID NO: 1886658 - RNA, 16 nt, Homo sapiens
ccuuuuucacuuugaa

SEQ ID NO: 1886659 - RNA, 16 nt, Homo sapiens
cuacuuucauacugaa

SEQ ID NO: 1886660 - RNA, 21 nt, Homo sapiens
cuauuuucagagcaugauaca

SEQ ID NO: 1886661 - RNA, 11 nt, Homo sapiens
guccaaaaagc

SEQ ID NO: 1886662 - RNA, 13 nt, Homo sapiens
auauauauuuauc

SEQ ID NO: 1886663 - RNA, 14 nt, Homo sapiens
ucugauaccaaaga

SEQ ID NO: 1886664 - RNA, 16 nt, Homo sapiens
auucaggccucugagg

SEQ ID NO: 1886665 - RNA, 14 nt, Homo sapiens
gaacacacagacuu

SEQ ID NO: 1886666 - RNA, 20 nt, Homo sapiens
cugugcaaaauaaaaugagu

SEQ ID NO: 1886667 - RNA, 15 nt, Homo sapiens
cacauggacacagac

SEQ ID NO: 1886668 - RNA, 15 nt, Homo sapiens
cauugagacauuugc

SEQ ID NO: 1886669 - RNA, 16 nt, Homo sapiens
ugucuacugcuuggau

SEQ ID NO: 1886670 - RNA, 19 nt, Homo sapiens
gaaaugugauuugucuucc

SEQ ID NO: 1886671 - RNA, 15 nt, Homo sapiens
ugggcauuuugacaa

SEQ ID NO: 1886672 - RNA, 14 nt, Homo sapiens
auuaagaccaaaga

SEQ ID NO: 1886673 - RNA, 12 nt, Homo sapiens
ggugccugcacu

SEQ ID NO: 1886674 - RNA, 15 nt, Homo sapiens
uggucaagugaugaa

SEQ ID NO: 1886675 - RNA, 12 nt, Homo sapiens
gucagacuggau

SEQ ID NO: 1886676 - RNA, 14 nt, Homo sapiens
gucucaagugcaau

SEQ ID NO: 1886677 - RNA, 16 nt, Homo sapiens
cuucuccaugcugcaa

SEQ ID NO: 1886678 - RNA, 13 nt, Homo sapiens
guuuuaucuggaa

SEQ ID NO: 1886679 - RNA, 13 nt, Homo sapiens
caaugagcaauga

SEQ ID NO: 1886680 - RNA, 12 nt, Homo sapiens
aaccagcaacau

SEQ ID NO: 1886681 - RNA, 19 nt, Homo sapiens
accaaccccgcggcccaga

SEQ ID NO: 1886682 - RNA, 19 nt, Homo sapiens
aauaauuaguaagcuagca

SEQ ID NO: 1886683 - RNA, 17 nt, Homo sapiens
uggugccaaacaaaaag

SEQ ID NO: 1886684 - RNA, 17 nt, Homo sapiens
gcuggccucucuagcac

SEQ ID NO: 1886685 - RNA, 19 nt, Homo sapiens
acuaugaagcuaccucaaa

SEQ ID NO: 1886686 - RNA, 22 nt, Homo sapiens
aguaauuucaagaauguuucag

SEQ ID NO: 1886687 - RNA, 14 nt, Homo sapiens
acaucucugcaauc

SEQ ID NO: 1886688 - RNA, 14 nt, Homo sapiens
auuuuucuguuacc

SEQ ID NO: 1886689 - RNA, 14 nt, Homo sapiens
auaucucuguaauc

SEQ ID NO: 1886690 - RNA, 22 nt, Homo sapiens
aacaucgugaaaccccaucucu

SEQ ID NO: 1886691 - RNA, 24 nt, Homo sapiens
aaaugagagaagggacacauucaa

SEQ ID NO: 1886692 - RNA, 17 nt, Homo sapiens
auguaccuuucuucacu

SEQ ID NO: 1886693 - RNA, 21 nt, Homo sapiens
cugaacacacccugaagaaau

SEQ ID NO: 1886694 - RNA, 13 nt, Homo sapiens
aucucuuccacau

SEQ ID NO: 1886695 - RNA, 20 nt, Homo sapiens
ucuagaguaauuaucuguga

SEQ ID NO: 1886696 - RNA, 21 nt, Homo sapiens
uaaacaauaaaaguguccauu

SEQ ID NO: 1886697 - RNA, 23 nt, Homo sapiens
ugaaaacauguacuacagcuaua

SEQ ID NO: 1886698 - RNA, 13 nt, Homo sapiens
aggaggccaauaa

SEQ ID NO: 1886699 - RNA, 16 nt, Homo sapiens
ccaaauaaauguguaa

SEQ ID NO: 1886700 - RNA, 19 nt, Homo sapiens
aguccugucacugagcaca

SEQ ID NO: 1886701 - RNA, 16 nt, Homo sapiens
uggcugccucugggag

SEQ ID NO: 1886702 - RNA, 16 nt, Homo sapiens
acccagggguccaggc

SEQ ID NO: 1886703 - RNA, 20 nt, Homo sapiens
ucugaauuugcaaaguacug

SEQ ID NO: 1886704 - RNA, 20 nt, Homo sapiens
ugaucucaaguauaugucau

SEQ ID NO: 1886705 - RNA, 16 nt, Homo sapiens
gugagaaaaggggcau

SEQ ID NO: 1886706 - RNA, 16 nt, Homo sapiens
accaauuugcaccagu

SEQ ID NO: 1886707 - RNA, 17 nt, Homo sapiens
cuaaguccacucuaguu

SEQ ID NO: 1886708 - RNA, 16 nt, Homo sapiens
ucucuuauagaauauu

SEQ ID NO: 1886709 - RNA, 17 nt, Homo sapiens
uuuuuacaguuaugcau

SEQ ID NO: 1886710 - RNA, 20 nt, Homo sapiens
acagcuugguguacuuaaua

SEQ ID NO: 1886711 - RNA, 16 nt, Homo sapiens
cccuuauccuucuccc

SEQ ID NO: 1886712 - RNA, 13 nt, Homo sapiens
gcccuuggaagaa

SEQ ID NO: 1886713 - RNA, 14 nt, Homo sapiens
uuagaguccugcuc

SEQ ID NO: 1886714 - RNA, 17 nt, Homo sapiens
aggagaaacacaucuuc

SEQ ID NO: 1886715 - RNA, 16 nt, Homo sapiens
uuucucaacuaccucg

SEQ ID NO: 1886716 - RNA, 16 nt, Homo sapiens
cgaguuuacuucauga

SEQ ID NO: 1886717 - RNA, 17 nt, Homo sapiens
acaguucugggcaaaga

SEQ ID NO: 1886718 - RNA, 21 nt, Homo sapiens
ggagacuagauuuaugaauac

SEQ ID NO: 1886719 - RNA, 16 nt, Homo sapiens
auauagugaugugcua

SEQ ID NO: 1886720 - RNA, 12 nt, Homo sapiens
cauuugaacuug

SEQ ID NO: 1886721 - RNA, 16 nt, Homo sapiens
cuaacaaugacauuua

SEQ ID NO: 1886722 - RNA, 15 nt, Homo sapiens
gaaauucugcugaca

SEQ ID NO: 1886723 - RNA, 19 nt, Homo sapiens
auuugguacacacuugacc

SEQ ID NO: 1886724 - RNA, 15 nt, Homo sapiens
gaccaggagggcacu

SEQ ID NO: 1886725 - RNA, 13 nt, Homo sapiens
agucauggucaca

SEQ ID NO: 1886726 - RNA, 19 nt, Homo sapiens
aacaaguggucuuacauau

SEQ ID NO: 1886727 - RNA, 14 nt, Homo sapiens
ucuccgacucugca

SEQ ID NO: 1886728 - RNA, 14 nt, Homo sapiens
aauauucuacacau

SEQ ID NO: 1886729 - RNA, 14 nt, Homo sapiens
acucuucuaaaaau

SEQ ID NO: 1886730 - RNA, 16 nt, Homo sapiens
gcuuuguugugagaau

SEQ ID NO: 1886731 - RNA, 18 nt, Homo sapiens
aauuuaggaccaauaccu

SEQ ID NO: 1886732 - RNA, 22 nt, Homo sapiens
ugcuguguggacuucaucucaa

SEQ ID NO: 1886733 - RNA, 17 nt, Homo sapiens
uaguuacuccagugcca

SEQ ID NO: 1886734 - RNA, 13 nt, Homo sapiens
cacacacacucug

SEQ ID NO: 1886735 - RNA, 18 nt, Homo sapiens
caucccaucccaucccau

SEQ ID NO: 1886736 - RNA, 17 nt, Homo sapiens
cucacuguugcaguggc

SEQ ID NO: 1886737 - RNA, 18 nt, Homo sapiens
cagugcaaauacucuggu

SEQ ID NO: 1886738 - RNA, 19 nt, Homo sapiens
gccuccagagaccccagga

SEQ ID NO: 1886739 - RNA, 16 nt, Homo sapiens
gauauugaauguuaaa

SEQ ID NO: 1886740 - RNA, 16 nt, Homo sapiens
uccugcauagucuguu

SEQ ID NO: 1886741 - RNA, 17 nt, Homo sapiens
caauaaaagugucacua

SEQ ID NO: 1886742 - RNA, 15 nt, Homo sapiens
ucauagacccucuca

SEQ ID NO: 1886743 - RNA, 12 nt, Homo sapiens
guguacugccuu

SEQ ID NO: 1886744 - RNA, 20 nt, Homo sapiens
ccgugagcgccugugcacac

SEQ ID NO: 1886745 - RNA, 13 nt, Homo sapiens
ugugccaugucac

SEQ ID NO: 1886746 - RNA, 19 nt, Homo sapiens
aggaagcuccacugucacc

SEQ ID NO: 1886747 - RNA, 14 nt, Homo sapiens
cagguguuuauaca

SEQ ID NO: 1886748 - RNA, 21 nt, Homo sapiens
uuacuauauuuauugauuuca

SEQ ID NO: 1886749 - RNA, 14 nt, Homo sapiens
aauucaagcuuucc

SEQ ID NO: 1886750 - RNA, 20 nt, Homo sapiens
gagaugcuucucuccuugcc

SEQ ID NO: 1886751 - RNA, 19 nt, Homo sapiens
guaaaacaaacaauaccug

SEQ ID NO: 1886752 - RNA, 19 nt, Homo sapiens
acacucauuaccgucugug

SEQ ID NO: 1886753 - RNA, 20 nt, Homo sapiens
uuugcugccaaacacccaug

SEQ ID NO: 1886754 - RNA, 15 nt, Homo sapiens
ggcgucggaaaugau

SEQ ID NO: 1886755 - RNA, 23 nt, Homo sapiens
uacccauccaacuccucuaguca

SEQ ID NO: 1886756 - RNA, 17 nt, Homo sapiens
acagaagcaaaaauuca

SEQ ID NO: 1886757 - RNA, 14 nt, Homo sapiens
cuaccacauucacu

SEQ ID NO: 1886758 - RNA, 17 nt, Homo sapiens
ugugacaacauuucaua

SEQ ID NO: 1886759 - RNA, 18 nt, Homo sapiens
ucacuagaaguccugcug

SEQ ID NO: 1886760 - RNA, 16 nt, Homo sapiens
ccuuuccauaaggaau

SEQ ID NO: 1886761 - RNA, 20 nt, Homo sapiens
ugaaggaaaugaaucuuuga

SEQ ID NO: 1886762 - RNA, 20 nt, Homo sapiens
ggccuccccaauccaggcca

SEQ ID NO: 1886763 - RNA, 17 nt, Homo sapiens
agccccagacaacagcc

SEQ ID NO: 1886764 - RNA, 14 nt, Homo sapiens
aaccaguucaugca

SEQ ID NO: 1886765 - RNA, 23 nt, Homo sapiens
uacuguuaacacugcuaaugaaa

SEQ ID NO: 1886766 - RNA, 14 nt, Homo sapiens
ccccaucuggucca

SEQ ID NO: 1886767 - RNA, 13 nt, Homo sapiens
ccucauuccugaa

SEQ ID NO: 1886768 - RNA, 17 nt, Homo sapiens
auuuauugaaaugauuu

SEQ ID NO: 1886769 - RNA, 13 nt, Homo sapiens
caguuggugcugc

SEQ ID NO: 1886770 - RNA, 13 nt, Homo sapiens
ucuucaagacucu

SEQ ID NO: 1886771 - RNA, 23 nt, Homo sapiens
auaaggccucauccuccacugaa

SEQ ID NO: 1886772 - RNA, 20 nt, Homo sapiens
cagaauucuacccuggaaaa

SEQ ID NO: 1886773 - RNA, 15 nt, Homo sapiens
aggcacacuuugcac

SEQ ID NO: 1886774 - RNA, 22 nt, Homo sapiens
augaagaaguuggucaguauug

SEQ ID NO: 1886775 - RNA, 17 nt, Homo sapiens
ucaggcugcuccuucuc

SEQ ID NO: 1886776 - RNA, 18 nt, Homo sapiens
uagaaugagaacauccau

SEQ ID NO: 1886777 - RNA, 17 nt, Homo sapiens
gaaaguaagcauuucca

SEQ ID NO: 1886778 - RNA, 14 nt, Homo sapiens
ugcuucccaccucc

SEQ ID NO: 1886779 - RNA, 20 nt, Homo sapiens
uuuuugccaacccuguguca

SEQ ID NO: 1886780 - RNA, 17 nt, Homo sapiens
uccugauucagcacuuu

SEQ ID NO: 1886781 - RNA, 15 nt, Homo sapiens
gagacccuacagaca

SEQ ID NO: 1886782 - RNA, 15 nt, Homo sapiens
uuuaauugcauuuaa

SEQ ID NO: 1886783 - RNA, 21 nt, Homo sapiens
ucugggcaaugaaaccaaagc

SEQ ID NO: 1886784 - RNA, 12 nt, Homo sapiens
acucagcauuug

SEQ ID NO: 1886785 - RNA, 18 nt, Homo sapiens
uggugcccuguucucuac

SEQ ID NO: 1886786 - RNA, 22 nt, Homo sapiens
uuaucuaaucaugaaacucccu

SEQ ID NO: 1886787 - RNA, 21 nt, Homo sapiens
aggaugucccugaagugccag

SEQ ID NO: 1886788 - RNA, 16 nt, Homo sapiens
auugaaauaguuucca

SEQ ID NO: 1886789 - RNA, 22 nt, Homo sapiens
uaaccaaaagacaccagccacu

SEQ ID NO: 1886790 - RNA, 17 nt, Homo sapiens
uucacaucagaacagac

SEQ ID NO: 1886791 - RNA, 16 nt, Homo sapiens
uuguucagaagacaca

SEQ ID NO: 1886792 - RNA, 16 nt, Homo sapiens
gcaucuggauucugcc

SEQ ID NO: 1886793 - RNA, 19 nt, Homo sapiens
ccgucacacaguauuuauu

SEQ ID NO: 1886794 - RNA, 20 nt, Homo sapiens
gauccuggccccucaaccuc

SEQ ID NO: 1886795 - RNA, 22 nt, Homo sapiens
gagggaaguggagguugcugua

SEQ ID NO: 1886796 - RNA, 16 nt, Homo sapiens
uaguggauaaccacag

SEQ ID NO: 1886797 - RNA, 14 nt, Homo sapiens
ccuucagagugaau

SEQ ID NO: 1886798 - RNA, 12 nt, Homo sapiens
gcaucuacuuag

SEQ ID NO: 1886799 - RNA, 12 nt, Homo sapiens
uacuaaauauga

SEQ ID NO: 1886800 - RNA, 20 nt, Homo sapiens
aaugcagcaguaaauccaag

SEQ ID NO: 1886801 - RNA, 14 nt, Homo sapiens
ugaccccugcucag

SEQ ID NO: 1886802 - RNA, 13 nt, Homo sapiens
auucaacaaauau

SEQ ID NO: 1886803 - RNA, 13 nt, Homo sapiens
uaccuacauucaa

SEQ ID NO: 1886804 - RNA, 13 nt, Homo sapiens
cauaaacacuucu

SEQ ID NO: 1886805 - RNA, 18 nt, Homo sapiens
uucagaccagugaaagag

SEQ ID NO: 1886806 - RNA, 22 nt, Homo sapiens
gcacuggggagcccgucucagu

SEQ ID NO: 1886807 - RNA, 16 nt, Homo sapiens
cugccugagggccccu

SEQ ID NO: 1886808 - RNA, 16 nt, Homo sapiens
uggaggaacugcuugu

SEQ ID NO: 1886809 - RNA, 15 nt, Homo sapiens
aacuuuuuacauuac

SEQ ID NO: 1886810 - RNA, 17 nt, Homo sapiens
uuuucucaaagucucau

SEQ ID NO: 1886811 - RNA, 16 nt, Homo sapiens
uggaggcgagccagau

SEQ ID NO: 1886812 - RNA, 17 nt, Homo sapiens
cuucuccccagcuccca

SEQ ID NO: 1886813 - RNA, 20 nt, Homo sapiens
cugcuguagccugggaccag

SEQ ID NO: 1886814 - RNA, 13 nt, Homo sapiens
uacagcagaucca

SEQ ID NO: 1886815 - RNA, 12 nt, Homo sapiens
aaugaucagccu

SEQ ID NO: 1886816 - RNA, 17 nt, Homo sapiens
ugaauaaguauucuuca

SEQ ID NO: 1886817 - RNA, 16 nt, Homo sapiens
aauagucuuccacaaa

SEQ ID NO: 1886818 - RNA, 19 nt, Homo sapiens
agccauaagaaagcacuau

SEQ ID NO: 1886819 - RNA, 18 nt, Homo sapiens
ccagaugugagggcacca

SEQ ID NO: 1886820 - RNA, 16 nt, Homo sapiens
caaugaaugaacaaau

SEQ ID NO: 1886821 - RNA, 12 nt, Homo sapiens
cuguaaugacaa

SEQ ID NO: 1886822 - RNA, 20 nt, Homo sapiens
auuucuaguaggcagcaaaa

SEQ ID NO: 1886823 - RNA, 12 nt, Homo sapiens
ggggagacaaau

SEQ ID NO: 1886824 - RNA, 18 nt, Homo sapiens
uccauggcugccaucuca

SEQ ID NO: 1886825 - RNA, 20 nt, Homo sapiens
ccacaggguaccaggauaaa

SEQ ID NO: 1886826 - RNA, 20 nt, Homo sapiens
gcuaaauauaaaaacauaaa

SEQ ID NO: 1886827 - RNA, 20 nt, Homo sapiens
aauguucuaaaguuuugcaa

SEQ ID NO: 1886828 - RNA, 13 nt, Homo sapiens
caugaauaugauu

SEQ ID NO: 1886829 - RNA, 21 nt, Homo sapiens
cugcucacccgccucuugccc

SEQ ID NO: 1886830 - RNA, 15 nt, Homo sapiens
gccugugaagcaguc

SEQ ID NO: 1886831 - RNA, 19 nt, Homo sapiens
acaguuucaaaaacuguau

SEQ ID NO: 1886832 - RNA, 18 nt, Homo sapiens
cuuccucaaauacaugca

SEQ ID NO: 1886833 - RNA, 18 nt, Homo sapiens
uucaggaguuggagacca

SEQ ID NO: 1886834 - RNA, 21 nt, Homo sapiens
uacuguacccucgcaugacug

SEQ ID NO: 1886835 - RNA, 16 nt, Homo sapiens
aggagacugagaccau

SEQ ID NO: 1886836 - RNA, 19 nt, Homo sapiens
uuuauuucauucauauccu

SEQ ID NO: 1886837 - RNA, 16 nt, Homo sapiens
gaagaaggccagagag

SEQ ID NO: 1886838 - RNA, 17 nt, Homo sapiens
cagcugugcuguaacac

SEQ ID NO: 1886839 - RNA, 14 nt, Homo sapiens
uggguuggcugugg

SEQ ID NO: 1886840 - RNA, 19 nt, Homo sapiens
aggcaucugauuugcauau

SEQ ID NO: 1886841 - RNA, 11 nt, Homo sapiens
ucagugcugcc

SEQ ID NO: 1886842 - RNA, 19 nt, Homo sapiens
agugggguccugaggccaa

SEQ ID NO: 1886843 - RNA, 15 nt, Homo sapiens
gauacgcuccaguac

SEQ ID NO: 1886844 - RNA, 15 nt, Homo sapiens
uaggauuacaggcau

SEQ ID NO: 1886845 - RNA, 17 nt, Homo sapiens
aacaugaugucaacuuc

SEQ ID NO: 1886846 - RNA, 17 nt, Homo sapiens
gcacuuauguacuugau

SEQ ID NO: 1886847 - RNA, 20 nt, Homo sapiens
gaagaacaucccaagccaga

SEQ ID NO: 1886848 - RNA, 14 nt, Homo sapiens
auaaaaaagcaaaa

SEQ ID NO: 1886849 - RNA, 20 nt, Homo sapiens
caaguugagcuaugacuuaa

SEQ ID NO: 1886850 - RNA, 15 nt, Homo sapiens
ucuucaauuuggaua

SEQ ID NO: 1886851 - RNA, 21 nt, Homo sapiens
cuaucugugguuuauaaucuu

SEQ ID NO: 1886852 - RNA, 13 nt, Homo sapiens
gccuuggccuccc

SEQ ID NO: 1886853 - RNA, 17 nt, Homo sapiens
cauauucuaaauucacu

SEQ ID NO: 1886854 - RNA, 12 nt, Homo sapiens
ucagcugagcuu

SEQ ID NO: 1886855 - RNA, 14 nt, Homo sapiens
gucuagacugccag

SEQ ID NO: 1886856 - RNA, 17 nt, Homo sapiens
gccaagagguacuguaa

SEQ ID NO: 1886857 - RNA, 18 nt, Homo sapiens
uagagucuuaaagcauuu

SEQ ID NO: 1886858 - RNA, 18 nt, Homo sapiens
uaugugaauggaaucaua

SEQ ID NO: 1886859 - RNA, 17 nt, Homo sapiens
uguggccaacugcaaaa

SEQ ID NO: 1886860 - RNA, 12 nt, Homo sapiens
cagaacucacug

SEQ ID NO: 1886861 - RNA, 23 nt, Homo sapiens
uuguacccuuccuacagauaguc

SEQ ID NO: 1886862 - RNA, 13 nt, Homo sapiens
uaccacuacuuag

SEQ ID NO: 1886863 - RNA, 13 nt, Homo sapiens
auguccauaucua

SEQ ID NO: 1886864 - RNA, 13 nt, Homo sapiens
cuccacaucugcc

SEQ ID NO: 1886865 - RNA, 15 nt, Homo sapiens
ucaaaguggcaaaaa

SEQ ID NO: 1886866 - RNA, 19 nt, Homo sapiens
aucuccaucauaugccuga

SEQ ID NO: 1886867 - RNA, 15 nt, Homo sapiens
auuuuugccaaaaua

SEQ ID NO: 1886868 - RNA, 22 nt, Homo sapiens
aaguauguaccaaaacauugau

SEQ ID NO: 1886869 - RNA, 21 nt, Homo sapiens
aagggcacgugaagucauuga

SEQ ID NO: 1886870 - RNA, 16 nt, Homo sapiens
auucagguaacacuag

SEQ ID NO: 1886871 - RNA, 17 nt, Homo sapiens
cgccugggaucucgcca

SEQ ID NO: 1886872 - RNA, 17 nt, Homo sapiens
agcccauuccucugcca

SEQ ID NO: 1886873 - RNA, 19 nt, Homo sapiens
uguagauaaacucagaaau

SEQ ID NO: 1886874 - RNA, 19 nt, Homo sapiens
gcuguggaggauugcuauc

SEQ ID NO: 1886875 - RNA, 18 nt, Homo sapiens
aaccuggaguauaauauu

SEQ ID NO: 1886876 - RNA, 23 nt, Homo sapiens
gcuaauccggaaaucagcaaacu

SEQ ID NO: 1886877 - RNA, 20 nt, Homo sapiens
uaaauacuguaaaugcauug

SEQ ID NO: 1886878 - RNA, 11 nt, Homo sapiens
aucuacuacau

SEQ ID NO: 1886879 - RNA, 17 nt, Homo sapiens
gcuaaaugcacugaccc

SEQ ID NO: 1886880 - RNA, 22 nt, Homo sapiens
ggggcaggacugaagauuucac

SEQ ID NO: 1886881 - RNA, 19 nt, Homo sapiens
aggcaugugucccuuccaa

SEQ ID NO: 1886882 - RNA, 18 nt, Homo sapiens
cgggggaccccuuugccc

SEQ ID NO: 1886883 - RNA, 17 nt, Homo sapiens
acucaaggaauuugcau

SEQ ID NO: 1886884 - RNA, 15 nt, Homo sapiens
uaaaaugugcaguau

SEQ ID NO: 1886885 - RNA, 22 nt, Homo sapiens
cucacaguaccuaugacuuuuu

SEQ ID NO: 1886886 - RNA, 19 nt, Homo sapiens
ccauguguuuugcuuuuau

SEQ ID NO: 1886887 - RNA, 12 nt, Homo sapiens
auaaagugccag

SEQ ID NO: 1886888 - RNA, 12 nt, Homo sapiens
cagaguggcuca

SEQ ID NO: 1886889 - RNA, 23 nt, Homo sapiens
agccuucacacagauagaccuuu

SEQ ID NO: 1886890 - RNA, 16 nt, Homo sapiens
ccucugggaaccuccc

SEQ ID NO: 1886891 - RNA, 20 nt, Homo sapiens
auauuugugugaaaauguga

SEQ ID NO: 1886892 - RNA, 14 nt, Homo sapiens
uccccaaacugugc

SEQ ID NO: 1886893 - RNA, 17 nt, Homo sapiens
agccuugggaacaugcg

SEQ ID NO: 1886894 - RNA, 16 nt, Homo sapiens
auuaccaaaaucauuu

SEQ ID NO: 1886895 - RNA, 21 nt, Homo sapiens
ugaacugcuucuccaaggaca

SEQ ID NO: 1886896 - RNA, 19 nt, Homo sapiens
uuuacuuaucuuaugccac

SEQ ID NO: 1886897 - RNA, 21 nt, Homo sapiens
ccucauuuaagaaaaaucaua

SEQ ID NO: 1886898 - RNA, 22 nt, Homo sapiens
uccacacagggguggaguuucu

SEQ ID NO: 1886899 - RNA, 17 nt, Homo sapiens
ugcuucauccaauguga

SEQ ID NO: 1886900 - RNA, 13 nt, Homo sapiens
ucaaucaaacagg

SEQ ID NO: 1886901 - RNA, 16 nt, Homo sapiens
cuggaaugagcagcuu

SEQ ID NO: 1886902 - RNA, 14 nt, Homo sapiens
uacauccucugaua

SEQ ID NO: 1886903 - RNA, 13 nt, Homo sapiens
uacuccucugcag

SEQ ID NO: 1886904 - RNA, 21 nt, Homo sapiens
cuugugaauguuuagugugcu

SEQ ID NO: 1886905 - RNA, 18 nt, Homo sapiens
uguacauauuuacagacu

SEQ ID NO: 1886906 - RNA, 21 nt, Homo sapiens
cuuguagucuuggcuaaggaa

SEQ ID NO: 1886907 - RNA, 15 nt, Homo sapiens
uccugcccgcccucc

SEQ ID NO: 1886908 - RNA, 14 nt, Homo sapiens
uggagaggaaccca

SEQ ID NO: 1886909 - RNA, 17 nt, Homo sapiens
gaggaagaugaagacca

SEQ ID NO: 1886910 - RNA, 18 nt, Homo sapiens
uaucucugaguugcccug

SEQ ID NO: 1886911 - RNA, 13 nt, Homo sapiens
acuuguccugacu

SEQ ID NO: 1886912 - RNA, 19 nt, Homo sapiens
uccacacugucagagcugu

SEQ ID NO: 1886913 - RNA, 11 nt, Homo sapiens
ugagggacaau

SEQ ID NO: 1886914 - RNA, 15 nt, Homo sapiens
guucagacacagcuc

SEQ ID NO: 1886915 - RNA, 19 nt, Homo sapiens
guggccuaauuuacaagca

SEQ ID NO: 1886916 - RNA, 20 nt, Homo sapiens
auuagccgggcaugguggca

SEQ ID NO: 1886917 - RNA, 13 nt, Homo sapiens
aauuagaugacug

SEQ ID NO: 1886918 - RNA, 17 nt, Homo sapiens
gaccucuuccuggaaua

SEQ ID NO: 1886919 - RNA, 22 nt, Homo sapiens
ucaaaagcacuuugugcugugu

SEQ ID NO: 1886920 - RNA, 18 nt, Homo sapiens
uuucuuccuuuacuuucc

SEQ ID NO: 1886921 - RNA, 17 nt, Homo sapiens
augaccgucugagccca

SEQ ID NO: 1886922 - RNA, 13 nt, Homo sapiens
gaacaaauuuuca

SEQ ID NO: 1886923 - RNA, 17 nt, Homo sapiens
uaguaguuacugucagc

SEQ ID NO: 1886924 - RNA, 17 nt, Homo sapiens
uccaauacauugaacac

SEQ ID NO: 1886925 - RNA, 22 nt, Homo sapiens
gaccaaccgaacaugaccaaaa

SEQ ID NO: 1886926 - RNA, 20 nt, Homo sapiens
aaugcauacucugugcaagg

SEQ ID NO: 1886927 - RNA, 13 nt, Homo sapiens
auaucagagcucu

SEQ ID NO: 1886928 - RNA, 16 nt, Homo sapiens
cuaguuuugaugaauu

SEQ ID NO: 1886929 - RNA, 15 nt, Homo sapiens
gaaugacccugucaa

SEQ ID NO: 1886930 - RNA, 13 nt, Homo sapiens
agcacccauucca

SEQ ID NO: 1886931 - RNA, 13 nt, Homo sapiens
aaauguucuguca

SEQ ID NO: 1886932 - RNA, 21 nt, Homo sapiens
gaaaaaaaagagacugguuag

SEQ ID NO: 1886933 - RNA, 14 nt, Homo sapiens
ucuaaauagcccuu

SEQ ID NO: 1886934 - RNA, 15 nt, Homo sapiens
gaguuguuggcaagu

SEQ ID NO: 1886935 - RNA, 21 nt, Homo sapiens
cacuucuuguuccccacugac

SEQ ID NO: 1886936 - RNA, 21 nt, Homo sapiens
cuuuaaugacauugauuucua

SEQ ID NO: 1886937 - RNA, 24 nt, Homo sapiens
aaaaauccgcuuuucugccacaga

SEQ ID NO: 1886938 - RNA, 15 nt, Homo sapiens
agcuggagugcagug

SEQ ID NO: 1886939 - RNA, 22 nt, Homo sapiens
aggccuccagccccauguguga

SEQ ID NO: 1886940 - RNA, 22 nt, Homo sapiens
caauaaauuuuuuuuggucaaa

SEQ ID NO: 1886941 - RNA, 19 nt, Homo sapiens
cucaucacugcuccuguca

SEQ ID NO: 1886942 - RNA, 15 nt, Homo sapiens
guguugacauagccu

SEQ ID NO: 1886943 - RNA, 15 nt, Homo sapiens
ucuccaaggcuuuua

SEQ ID NO: 1886944 - RNA, 22 nt, Homo sapiens
gccuggacgccacggccucuca

SEQ ID NO: 1886945 - RNA, 22 nt, Homo sapiens
cacgaucucgacucacugcaac

SEQ ID NO: 1886946 - RNA, 22 nt, Homo sapiens
gagcagccugcugcucucagga

SEQ ID NO: 1886947 - RNA, 15 nt, Homo sapiens
ugcagcagaaaacaa

SEQ ID NO: 1886948 - RNA, 19 nt, Homo sapiens
uggcccagggaagccaaaa

SEQ ID NO: 1886949 - RNA, 22 nt, Homo sapiens
gcucagcuucuccugugugauu

SEQ ID NO: 1886950 - RNA, 20 nt, Homo sapiens
cacacaguuugagacuccaa

SEQ ID NO: 1886951 - RNA, 12 nt, Homo sapiens
cucacuaugaau

SEQ ID NO: 1886952 - RNA, 15 nt, Homo sapiens
acaaagggugggcau

SEQ ID NO: 1886953 - RNA, 16 nt, Homo sapiens
agcuuugguucugcca

SEQ ID NO: 1886954 - RNA, 23 nt, Homo sapiens
aggcauucucccagcucuagccu

SEQ ID NO: 1886955 - RNA, 13 nt, Homo sapiens
gugaaagugcugc

SEQ ID NO: 1886956 - RNA, 14 nt, Homo sapiens
ugaaaaaucuaagu

SEQ ID NO: 1886957 - RNA, 13 nt, Homo sapiens
gugguacaggaag

SEQ ID NO: 1886958 - RNA, 16 nt, Homo sapiens
gccagccuccagcacc

SEQ ID NO: 1886959 - RNA, 20 nt, Homo sapiens
cacuuuugaaaauguacaug

SEQ ID NO: 1886960 - RNA, 21 nt, Homo sapiens
aaaacauagcacuagcauuca

SEQ ID NO: 1886961 - RNA, 18 nt, Homo sapiens
ugcuaccacagcaacuau

SEQ ID NO: 1886962 - RNA, 21 nt, Homo sapiens
gcaaacaaaauuguucuuggg

SEQ ID NO: 1886963 - RNA, 23 nt, Homo sapiens
uaauuuugccacaggguacuaaa

SEQ ID NO: 1886964 - RNA, 19 nt, Homo sapiens
ccugaauuuaaauagcuuu

SEQ ID NO: 1886965 - RNA, 16 nt, Homo sapiens
uaaaauagcaauccua

SEQ ID NO: 1886966 - RNA, 22 nt, Homo sapiens
acaaacucuuguguaccuuugu

SEQ ID NO: 1886967 - RNA, 18 nt, Homo sapiens
acucugguauggccaaag

SEQ ID NO: 1886968 - RNA, 16 nt, Homo sapiens
uaugggcuacacagca

SEQ ID NO: 1886969 - RNA, 22 nt, Homo sapiens
ccgcuucuccaagucugcugau

SEQ ID NO: 1886970 - RNA, 21 nt, Homo sapiens
ucaacuggaauggaugguaca

SEQ ID NO: 1886971 - RNA, 15 nt, Homo sapiens
agggccaugucagac

SEQ ID NO: 1886972 - RNA, 13 nt, Homo sapiens
gcuucaugcaauc

SEQ ID NO: 1886973 - RNA, 16 nt, Homo sapiens
ucccacuccaagccca

SEQ ID NO: 1886974 - RNA, 20 nt, Homo sapiens
guaguuaacaauuuugcacu

SEQ ID NO: 1886975 - RNA, 21 nt, Homo sapiens
ucuuaaugcuauuugccaaga

SEQ ID NO: 1886976 - RNA, 13 nt, Homo sapiens
ucacuguccucca

SEQ ID NO: 1886977 - RNA, 21 nt, Homo sapiens
ucguagguugugaugauagca

SEQ ID NO: 1886978 - RNA, 23 nt, Homo sapiens
cacacacggaugcacacacagau

SEQ ID NO: 1886979 - RNA, 18 nt, Homo sapiens
aacucacccccaccacca

SEQ ID NO: 1886980 - RNA, 16 nt, Homo sapiens
uuuucugagacagagu

SEQ ID NO: 1886981 - RNA, 20 nt, Homo sapiens
cuccuggccucaagugauuc

SEQ ID NO: 1886982 - RNA, 22 nt, Homo sapiens
uuuaaacacuuaucuucuggau

SEQ ID NO: 1886983 - RNA, 22 nt, Homo sapiens
cuaacaucuuuacguacuguaa

SEQ ID NO: 1886984 - RNA, 15 nt, Homo sapiens
agaauaggcugugua

SEQ ID NO: 1886985 - RNA, 16 nt, Homo sapiens
agauuccgcaccaaua

SEQ ID NO: 1886986 - RNA, 22 nt, Homo sapiens
ucagcuccugaccaguugcagu

SEQ ID NO: 1886987 - RNA, 15 nt, Homo sapiens
guaaaauuuguguaa

SEQ ID NO: 1886988 - RNA, 19 nt, Homo sapiens
aaucaaucuuugugccuca

SEQ ID NO: 1886989 - RNA, 14 nt, Homo sapiens
ucuccauuaauuaa

SEQ ID NO: 1886990 - RNA, 14 nt, Homo sapiens
uaaaauugugaugu

SEQ ID NO: 1886991 - RNA, 21 nt, Homo sapiens
ugacaccgaguuccaccccau

SEQ ID NO: 1886992 - RNA, 14 nt, Homo sapiens
cucaagauucagua

SEQ ID NO: 1886993 - RNA, 14 nt, Homo sapiens
aaggaaccaaagcg

SEQ ID NO: 1886994 - RNA, 22 nt, Homo sapiens
gcccccagcuucaccucuggga

SEQ ID NO: 1886995 - RNA, 23 nt, Homo sapiens
aaaacaggaaaggagcaaugaag

SEQ ID NO: 1886996 - RNA, 13 nt, Homo sapiens
uuggcacacagca

SEQ ID NO: 1886997 - RNA, 18 nt, Homo sapiens
gugcucuuggcugacccc

SEQ ID NO: 1886998 - RNA, 16 nt, Homo sapiens
acuuccgucacccuug

SEQ ID NO: 1886999 - RNA, 14 nt, Homo sapiens
uugcaauggcagcc

SEQ ID NO: 1887000 - RNA, 22 nt, Homo sapiens
uaauuucuuugaucuggacaga

SEQ ID NO: 1887001 - RNA, 17 nt, Homo sapiens
acuguguuuuugccacu

SEQ ID NO: 1887002 - RNA, 14 nt, Homo sapiens
agagugcccauggg

SEQ ID NO: 1887003 - RNA, 11 nt, Homo sapiens
aauaaagccuu

SEQ ID NO: 1887004 - RNA, 11 nt, Homo sapiens
auuaaagccau

SEQ ID NO: 1887005 - RNA, 23 nt, Homo sapiens
guuuaauaaacacugacauuucc

SEQ ID NO: 1887006 - RNA, 14 nt, Homo sapiens
gucucccaaagugc

SEQ ID NO: 1887007 - RNA, 17 nt, Homo sapiens
cccucugcagucucuau

SEQ ID NO: 1887008 - RNA, 16 nt, Homo sapiens
acaagaaacauuucag

SEQ ID NO: 1887009 - RNA, 14 nt, Homo sapiens
uuuguuucaaucuc

SEQ ID NO: 1887010 - RNA, 22 nt, Homo sapiens
ucuaaggcugugccaucagcuc

SEQ ID NO: 1887011 - RNA, 20 nt, Homo sapiens
aucugauuguugucaggcca

SEQ ID NO: 1887012 - RNA, 23 nt, Homo sapiens
ugugaagaauaaugccuuguaug

SEQ ID NO: 1887013 - RNA, 13 nt, Homo sapiens
acaucuaaugucu

SEQ ID NO: 1887014 - RNA, 17 nt, Homo sapiens
cugaacccuaugugucc

SEQ ID NO: 1887015 - RNA, 14 nt, Homo sapiens
uccugaagaaucuc

SEQ ID NO: 1887016 - RNA, 16 nt, Homo sapiens
cagaacuuaaucugga

SEQ ID NO: 1887017 - RNA, 21 nt, Homo sapiens
ucccucuaagcacauuccaaa

SEQ ID NO: 1887018 - RNA, 16 nt, Homo sapiens
auacccccugcaaagc

SEQ ID NO: 1887019 - RNA, 16 nt, Homo sapiens
acucagaagacacuga

SEQ ID NO: 1887020 - RNA, 14 nt, Homo sapiens
ucaggaacagucuu

SEQ ID NO: 1887021 - RNA, 18 nt, Homo sapiens
guucauucuuaccgagaa

SEQ ID NO: 1887022 - RNA, 15 nt, Homo sapiens
ugcuaauaaaguccu

SEQ ID NO: 1887023 - RNA, 21 nt, Homo sapiens
cuuucuuaagcaacaauggau

SEQ ID NO: 1887024 - RNA, 12 nt, Homo sapiens
ugcccaugugaa

SEQ ID NO: 1887025 - RNA, 16 nt, Homo sapiens
cuccuguugcaaugac

SEQ ID NO: 1887026 - RNA, 19 nt, Homo sapiens
acaugacacccgaagggac

SEQ ID NO: 1887027 - RNA, 20 nt, Homo sapiens
ucuggccagaaaaggcauuu

SEQ ID NO: 1887028 - RNA, 17 nt, Homo sapiens
ugcuaggccagagccau

SEQ ID NO: 1887029 - RNA, 23 nt, Homo sapiens
acugagucuuucuuagauuaaau

SEQ ID NO: 1887030 - RNA, 15 nt, Homo sapiens
gaagucuucuauuua

SEQ ID NO: 1887031 - RNA, 19 nt, Homo sapiens
acuggcauuuuuagcuccu

SEQ ID NO: 1887032 - RNA, 22 nt, Homo sapiens
aucuauagcuaaguacacaaua

SEQ ID NO: 1887033 - RNA, 17 nt, Homo sapiens
aaaugagcuuucaggaa

SEQ ID NO: 1887034 - RNA, 19 nt, Homo sapiens
uguuggacccgcucuggac

SEQ ID NO: 1887035 - RNA, 19 nt, Homo sapiens
ggaugcuggggcacuuuaa

SEQ ID NO: 1887036 - RNA, 24 nt, Homo sapiens
uauccucaagguagaaaugucuau

SEQ ID NO: 1887037 - RNA, 14 nt, Homo sapiens
agaauagcacaaac

SEQ ID NO: 1887038 - RNA, 19 nt, Homo sapiens
aucuuuccaucucauuaca

SEQ ID NO: 1887039 - RNA, 14 nt, Homo sapiens
ugaaugaucuuggc

SEQ ID NO: 1887040 - RNA, 21 nt, Homo sapiens
auaauaaaaagcuucagggaa

SEQ ID NO: 1887041 - RNA, 15 nt, Homo sapiens
gaauauuuaagcaau

SEQ ID NO: 1887042 - RNA, 19 nt, Homo sapiens
gaaaccgaagggacuggau

SEQ ID NO: 1887043 - RNA, 15 nt, Homo sapiens
ugaaauuacugugua

SEQ ID NO: 1887044 - RNA, 14 nt, Homo sapiens
gaaagcuuuggcag

SEQ ID NO: 1887045 - RNA, 22 nt, Homo sapiens
cugcuacaccuuagcagcucuu

SEQ ID NO: 1887046 - RNA, 17 nt, Homo sapiens
ugccuccagaaccuucc

SEQ ID NO: 1887047 - RNA, 20 nt, Homo sapiens
cacuaagagaauacaggaaa

SEQ ID NO: 1887048 - RNA, 18 nt, Homo sapiens
uaauaacugcuuacucaa

SEQ ID NO: 1887049 - RNA, 16 nt, Homo sapiens
uugauaauugcauuca

SEQ ID NO: 1887050 - RNA, 22 nt, Homo sapiens
uacaagaaaaaaugaauuuugu

SEQ ID NO: 1887051 - RNA, 23 nt, Homo sapiens
caguugaauauauucuauuccau

SEQ ID NO: 1887052 - RNA, 22 nt, Homo sapiens
guuuaaaagccaucaaacacaa

SEQ ID NO: 1887053 - RNA, 15 nt, Homo sapiens
caccuugugaucaug

SEQ ID NO: 1887054 - RNA, 17 nt, Homo sapiens
auuuuaauuacugcuau

SEQ ID NO: 1887055 - RNA, 22 nt, Homo sapiens
augucuaccuggcagauacuca

SEQ ID NO: 1887056 - RNA, 14 nt, Homo sapiens
gaaagacacuguuu

SEQ ID NO: 1887057 - RNA, 13 nt, Homo sapiens
acauauagaauaa

SEQ ID NO: 1887058 - RNA, 17 nt, Homo sapiens
uguaaaaugacaaucau

SEQ ID NO: 1887059 - RNA, 22 nt, Homo sapiens
ccugcagagccaauggugcaca

SEQ ID NO: 1887060 - RNA, 15 nt, Homo sapiens
cugaugcuucuauca

SEQ ID NO: 1887061 - RNA, 23 nt, Homo sapiens
gagauacaucuuauaaacugacu

SEQ ID NO: 1887062 - RNA, 14 nt, Homo sapiens
ccaggaaaggccca

SEQ ID NO: 1887063 - RNA, 18 nt, Homo sapiens
aguagggauaaagucauc

SEQ ID NO: 1887064 - RNA, 21 nt, Homo sapiens
aacacaugugcagucacuggu

SEQ ID NO: 1887065 - RNA, 21 nt, Homo sapiens
cccuucccugcacuaaagcca

SEQ ID NO: 1887066 - RNA, 20 nt, Homo sapiens
gugucucuaucuugcaucua

SEQ ID NO: 1887067 - RNA, 19 nt, Homo sapiens
ccugaagcguuuuucucaa

SEQ ID NO: 1887068 - RNA, 18 nt, Homo sapiens
gauccauuaucuauuuaa

SEQ ID NO: 1887069 - RNA, 18 nt, Homo sapiens
agcaccuucuuucuggac

SEQ ID NO: 1887070 - RNA, 17 nt, Homo sapiens
cugugaaauaccacaag

SEQ ID NO: 1887071 - RNA, 17 nt, Homo sapiens
uugccguuugacauuuu

SEQ ID NO: 1887072 - RNA, 16 nt, Homo sapiens
aguuauguggauuuca

SEQ ID NO: 1887073 - RNA, 17 nt, Homo sapiens
cucccuucaggcccgcu

SEQ ID NO: 1887074 - RNA, 11 nt, Homo sapiens
ccagugaugau

SEQ ID NO: 1887075 - RNA, 21 nt, Homo sapiens
acauugaggaccucauccaaa

SEQ ID NO: 1887076 - RNA, 20 nt, Homo sapiens
guaauuuaaaaagugcuaua

SEQ ID NO: 1887077 - RNA, 18 nt, Homo sapiens
cagaguuguucucagggg

SEQ ID NO: 1887078 - RNA, 16 nt, Homo sapiens
gcaaauuaacuaauuu

SEQ ID NO: 1887079 - RNA, 21 nt, Homo sapiens
cuaaagucacauauaaaaguu

SEQ ID NO: 1887080 - RNA, 12 nt, Homo sapiens
cuacuuguggac

SEQ ID NO: 1887081 - RNA, 14 nt, Homo sapiens
caggagguggguga

SEQ ID NO: 1887082 - RNA, 18 nt, Homo sapiens
agcuaagccacauggcug

SEQ ID NO: 1887083 - RNA, 22 nt, Homo sapiens
ugcauguccucuuguugcugag

SEQ ID NO: 1887084 - RNA, 17 nt, Homo sapiens
agccccuccucugagca

SEQ ID NO: 1887085 - RNA, 14 nt, Homo sapiens
ucacuucuaccugc

SEQ ID NO: 1887086 - RNA, 14 nt, Homo sapiens
ugauauauucuuga

SEQ ID NO: 1887087 - RNA, 16 nt, Homo sapiens
cauguuuuguauacaa

SEQ ID NO: 1887088 - RNA, 22 nt, Homo sapiens
uuuaauaaaugguuuauucugc

SEQ ID NO: 1887089 - RNA, 17 nt, Homo sapiens
aauucuuacauguuuuc

SEQ ID NO: 1887090 - RNA, 21 nt, Homo sapiens
auaaaauaauuauaaauauca

SEQ ID NO: 1887091 - RNA, 12 nt, Homo sapiens
agaaggaaagca

SEQ ID NO: 1887092 - RNA, 19 nt, Homo sapiens
ggcagggucucacucuguu

SEQ ID NO: 1887093 - RNA, 21 nt, Homo sapiens
gcagccuacaacugaauagca

SEQ ID NO: 1887094 - RNA, 14 nt, Homo sapiens
ugaagcaaugcuuc

SEQ ID NO: 1887095 - RNA, 14 nt, Homo sapiens
acauuuaaaccagu

SEQ ID NO: 1887096 - RNA, 15 nt, Homo sapiens
auaugcagauuuugc

SEQ ID NO: 1887097 - RNA, 14 nt, Homo sapiens
uguuugcccagugu

SEQ ID NO: 1887098 - RNA, 15 nt, Homo sapiens
aauuuaauuuugcag

SEQ ID NO: 1887099 - RNA, 16 nt, Homo sapiens
ccuccuagauguaaca

SEQ ID NO: 1887100 - RNA, 23 nt, Homo sapiens
gcuggcaccuuaguugcaugacc

SEQ ID NO: 1887101 - RNA, 21 nt, Homo sapiens
agcaguguucucacagugugg

SEQ ID NO: 1887102 - RNA, 21 nt, Homo sapiens
gcaucuauuuccucugugcaa

SEQ ID NO: 1887103 - RNA, 23 nt, Homo sapiens
cuguuuacaaaagcccaauguaa

SEQ ID NO: 1887104 - RNA, 15 nt, Homo sapiens
ugagcauaccugucu

SEQ ID NO: 1887105 - RNA, 20 nt, Homo sapiens
gauauccaacagaaagcaua

SEQ ID NO: 1887106 - RNA, 13 nt, Homo sapiens
agccucaccucau

SEQ ID NO: 1887107 - RNA, 19 nt, Homo sapiens
ugcuuucacuucccaccuc

SEQ ID NO: 1887108 - RNA, 12 nt, Homo sapiens
ucauaaacuaua

SEQ ID NO: 1887109 - RNA, 21 nt, Homo sapiens
acauuggagaugccauccucu

SEQ ID NO: 1887110 - RNA, 13 nt, Homo sapiens
cacacccguguca

SEQ ID NO: 1887111 - RNA, 15 nt, Homo sapiens
aagggcagcugugau

SEQ ID NO: 1887112 - RNA, 17 nt, Homo sapiens
ugaaccacauucaggga

SEQ ID NO: 1887113 - RNA, 18 nt, Homo sapiens
acagaucaagcugugaga

SEQ ID NO: 1887114 - RNA, 15 nt, Homo sapiens
uagucucagcacuau

SEQ ID NO: 1887115 - RNA, 14 nt, Homo sapiens
cuauaaagaucaua

SEQ ID NO: 1887116 - RNA, 17 nt, Homo sapiens
cuacugagacaugacua

SEQ ID NO: 1887117 - RNA, 19 nt, Homo sapiens
gcaccaaucagcacucugu

SEQ ID NO: 1887118 - RNA, 17 nt, Homo sapiens
ggcaaaggguccagaag

SEQ ID NO: 1887119 - RNA, 16 nt, Homo sapiens
guuacuggaugcagca

SEQ ID NO: 1887120 - RNA, 17 nt, Homo sapiens
auaaaaggagacagaag

SEQ ID NO: 1887121 - RNA, 19 nt, Homo sapiens
gcccauguauggccaggaa

SEQ ID NO: 1887122 - RNA, 23 nt, Homo sapiens
aagcauguggaugacacaauccc

SEQ ID NO: 1887123 - RNA, 17 nt, Homo sapiens
uugagcucuucuuaaag

SEQ ID NO: 1887124 - RNA, 12 nt, Homo sapiens
aauauaaugcaa

SEQ ID NO: 1887125 - RNA, 11 nt, Homo sapiens
uaguacuccuu

SEQ ID NO: 1887126 - RNA, 21 nt, Homo sapiens
uuauaauucauugugauuuau

SEQ ID NO: 1887127 - RNA, 23 nt, Homo sapiens
uuaauaaagaugaguugguucuc

SEQ ID NO: 1887128 - RNA, 11 nt, Homo sapiens
gcagugucuua

SEQ ID NO: 1887129 - RNA, 17 nt, Homo sapiens
guguugagcguuugcac

SEQ ID NO: 1887130 - RNA, 11 nt, Homo sapiens
cucugacugua

SEQ ID NO: 1887131 - RNA, 23 nt, Homo sapiens
uuuugaaagaacauggucugugg

SEQ ID NO: 1887132 - RNA, 14 nt, Homo sapiens
uauggcuccuccau

SEQ ID NO: 1887133 - RNA, 13 nt, Homo sapiens
ugagucacuugaa

SEQ ID NO: 1887134 - RNA, 23 nt, Homo sapiens
ccccggcugggugagcugagaug

SEQ ID NO: 1887135 - RNA, 14 nt, Homo sapiens
guggaauccagugu

SEQ ID NO: 1887136 - RNA, 19 nt, Homo sapiens
ugcggaauuccaccuggaa

SEQ ID NO: 1887137 - RNA, 22 nt, Homo sapiens
uucuccagggguuuacagugaa

SEQ ID NO: 1887138 - RNA, 17 nt, Homo sapiens
aauuaucaaaaaacaga

SEQ ID NO: 1887139 - RNA, 13 nt, Homo sapiens
uuucaacauauga

SEQ ID NO: 1887140 - RNA, 18 nt, Homo sapiens
cuguuacugauguucaau

SEQ ID NO: 1887141 - RNA, 20 nt, Homo sapiens
agacggagucuugcucugua

SEQ ID NO: 1887142 - RNA, 16 nt, Homo sapiens
uguuggcauagcucug

SEQ ID NO: 1887143 - RNA, 19 nt, Homo sapiens
ugagaaucaaacauucuau

SEQ ID NO: 1887144 - RNA, 16 nt, Homo sapiens
ucuuaugugugccuuu

SEQ ID NO: 1887145 - RNA, 13 nt, Homo sapiens
gagacuaauucua

SEQ ID NO: 1887146 - RNA, 15 nt, Homo sapiens
gcgaaaccccaucuc

SEQ ID NO: 1887147 - RNA, 21 nt, Homo sapiens
cucaucugggggaguggaaua

SEQ ID NO: 1887148 - RNA, 22 nt, Homo sapiens
aggaaucggagcgaagcagaga

SEQ ID NO: 1887149 - RNA, 14 nt, Homo sapiens
caagccuuacucac

SEQ ID NO: 1887150 - RNA, 12 nt, Homo sapiens
cuugagguggga

SEQ ID NO: 1887151 - RNA, 16 nt, Homo sapiens
cuaagucacauaucag

SEQ ID NO: 1887152 - RNA, 12 nt, Homo sapiens
uauuuuuacuaa

SEQ ID NO: 1887153 - RNA, 11 nt, Homo sapiens
acuuacaugau

SEQ ID NO: 1887154 - RNA, 17 nt, Homo sapiens
uagguuuugcuugggaa

SEQ ID NO: 1887155 - RNA, 20 nt, Homo sapiens
acugaugagucuugaucuag

SEQ ID NO: 1887156 - RNA, 19 nt, Homo sapiens
acagugcucgccacagugg

SEQ ID NO: 1887157 - RNA, 17 nt, Homo sapiens
aaguaaacggucucuca

SEQ ID NO: 1887158 - RNA, 15 nt, Homo sapiens
gggagcagaugcaau

SEQ ID NO: 1887159 - RNA, 14 nt, Homo sapiens
auccuuuaccacuc

SEQ ID NO: 1887160 - RNA, 16 nt, Homo sapiens
gcugccucaggaccca

SEQ ID NO: 1887161 - RNA, 17 nt, Homo sapiens
ugcuuacaaucuuuauu

SEQ ID NO: 1887162 - RNA, 18 nt, Homo sapiens
cagguguauaaauguaca

SEQ ID NO: 1887163 - RNA, 20 nt, Homo sapiens
ggaccacgugagaucauuca

SEQ ID NO: 1887164 - RNA, 13 nt, Homo sapiens
uuuaacuuugaaa

SEQ ID NO: 1887165 - RNA, 13 nt, Homo sapiens
agcuuacaacauu

SEQ ID NO: 1887166 - RNA, 23 nt, Homo sapiens
aggaugagagcccagagguaaca

SEQ ID NO: 1887167 - RNA, 13 nt, Homo sapiens
gaucccacuggaa

SEQ ID NO: 1887168 - RNA, 13 nt, Homo sapiens
aaauacugaauua

SEQ ID NO: 1887169 - RNA, 13 nt, Homo sapiens
agacacugaguca

SEQ ID NO: 1887170 - RNA, 18 nt, Homo sapiens
aaacugguuuuagacaaa

SEQ ID NO: 1887171 - RNA, 17 nt, Homo sapiens
aaagaguccauguggac

SEQ ID NO: 1887172 - RNA, 22 nt, Homo sapiens
caauaggugagagaauguauuu

SEQ ID NO: 1887173 - RNA, 15 nt, Homo sapiens
cucaucugacuugaa

SEQ ID NO: 1887174 - RNA, 14 nt, Homo sapiens
auuugaagaagagu

SEQ ID NO: 1887175 - RNA, 14 nt, Homo sapiens
cagacuagcuuuca

SEQ ID NO: 1887176 - RNA, 15 nt, Homo sapiens
uuuagaacaggagac

SEQ ID NO: 1887177 - RNA, 16 nt, Homo sapiens
aagacugccagguggu

SEQ ID NO: 1887178 - RNA, 20 nt, Homo sapiens
acgggguugucgagaucuca

SEQ ID NO: 1887179 - RNA, 15 nt, Homo sapiens
cuuuuucacuuugaa

SEQ ID NO: 1887180 - RNA, 13 nt, Homo sapiens
ugaauacugggaa

SEQ ID NO: 1887181 - RNA, 23 nt, Homo sapiens
ggaugcucaguugcuaaacacug

SEQ ID NO: 1887182 - RNA, 19 nt, Homo sapiens
ccaccuggacacaacacca

SEQ ID NO: 1887183 - RNA, 21 nt, Homo sapiens
ugguauccauuauaaacaauc

SEQ ID NO: 1887184 - RNA, 20 nt, Homo sapiens
ucgagaauguauggauuuac

SEQ ID NO: 1887185 - RNA, 14 nt, Homo sapiens
ccuaggggacacuu

SEQ ID NO: 1887186 - RNA, 12 nt, Homo sapiens
agucagcaggga

SEQ ID NO: 1887187 - RNA, 19 nt, Homo sapiens
cacuuacauuuacaaacug

SEQ ID NO: 1887188 - RNA, 20 nt, Homo sapiens
uucugguauaaagcucucaa

SEQ ID NO: 1887189 - RNA, 12 nt, Homo sapiens
ugucucugccug

SEQ ID NO: 1887190 - RNA, 21 nt, Homo sapiens
gccuacagcccucacuaacaa

SEQ ID NO: 1887191 - RNA, 21 nt, Homo sapiens
uguacuaacaaagccaaauuc

SEQ ID NO: 1887192 - RNA, 18 nt, Homo sapiens
caaguuuuauaauccuua

SEQ ID NO: 1887193 - RNA, 20 nt, Homo sapiens
cagggccuccugggggaccu

SEQ ID NO: 1887194 - RNA, 15 nt, Homo sapiens
agagaugccaugaua

SEQ ID NO: 1887195 - RNA, 13 nt, Homo sapiens
gucaauccuguca

SEQ ID NO: 1887196 - RNA, 14 nt, Homo sapiens
uaauaaagguuuaa

SEQ ID NO: 1887197 - RNA, 17 nt, Homo sapiens
guguaauuuuguucuag

SEQ ID NO: 1887198 - RNA, 23 nt, Homo sapiens
acauaauuccagucacaguuuuu

SEQ ID NO: 1887199 - RNA, 21 nt, Homo sapiens
accagaugcugaaaauguccu

SEQ ID NO: 1887200 - RNA, 16 nt, Homo sapiens
uuucugaguaccauua

SEQ ID NO: 1887201 - RNA, 17 nt, Homo sapiens
aauauaauuuucaaaaa

SEQ ID NO: 1887202 - RNA, 14 nt, Homo sapiens
ucccuagugccuuc

SEQ ID NO: 1887203 - RNA, 12 nt, Homo sapiens
gauaguuuaccu

SEQ ID NO: 1887204 - RNA, 15 nt, Homo sapiens
ccauuaucuuaugaa

SEQ ID NO: 1887205 - RNA, 23 nt, Homo sapiens
aacuuugacgagucaccuuccag

SEQ ID NO: 1887206 - RNA, 18 nt, Homo sapiens
aaauacaacacugauacu

SEQ ID NO: 1887207 - RNA, 23 nt, Homo sapiens
agaccaagcaggaagaacauuga

SEQ ID NO: 1887208 - RNA, 20 nt, Homo sapiens
aacuccaccgccuaucccaa

SEQ ID NO: 1887209 - RNA, 13 nt, Homo sapiens
acccaguguaaag

SEQ ID NO: 1887210 - RNA, 12 nt, Homo sapiens
guuugucccauc

SEQ ID NO: 1887211 - RNA, 16 nt, Homo sapiens
auuucaucuacuacag

SEQ ID NO: 1887212 - RNA, 14 nt, Homo sapiens
agggagcacugggu

SEQ ID NO: 1887213 - RNA, 12 nt, Homo sapiens
cuaaacacuuca

SEQ ID NO: 1887214 - RNA, 23 nt, Homo sapiens
gcuguaugauauuaauguggaag

SEQ ID NO: 1887215 - RNA, 23 nt, Homo sapiens
acgggagugacccagcuacugaa

SEQ ID NO: 1887216 - RNA, 19 nt, Homo sapiens
cagaggaacuguccagaga

SEQ ID NO: 1887217 - RNA, 17 nt, Homo sapiens
acaauucaguaacaaag

SEQ ID NO: 1887218 - RNA, 15 nt, Homo sapiens
uaagaaauaagcaug

SEQ ID NO: 1887219 - RNA, 23 nt, Homo sapiens
uuaacuauaacaaucacuggcua

SEQ ID NO: 1887220 - RNA, 15 nt, Homo sapiens
cugacgacaguacug

SEQ ID NO: 1887221 - RNA, 20 nt, Homo sapiens
cuuucaagcagucgugccug

SEQ ID NO: 1887222 - RNA, 20 nt, Homo sapiens
uccacuuuucuuuacauuuu

SEQ ID NO: 1887223 - RNA, 14 nt, Homo sapiens
uuguuggcucagaa

SEQ ID NO: 1887224 - RNA, 18 nt, Homo sapiens
ugucccaccuugaccaaa

SEQ ID NO: 1887225 - RNA, 15 nt, Homo sapiens
agaagaaaaauggaa

SEQ ID NO: 1887226 - RNA, 16 nt, Homo sapiens
gauaaaagacagugaa

SEQ ID NO: 1887227 - RNA, 18 nt, Homo sapiens
auuauuccuugcuuucau

SEQ ID NO: 1887228 - RNA, 16 nt, Homo sapiens
uaggaggaaaagacag

SEQ ID NO: 1887229 - RNA, 16 nt, Homo sapiens
gaggagcaugcagcga

SEQ ID NO: 1887230 - RNA, 13 nt, Homo sapiens
agacaucacuugc

SEQ ID NO: 1887231 - RNA, 19 nt, Homo sapiens
cuggaaaauucuauggaau

SEQ ID NO: 1887232 - RNA, 19 nt, Homo sapiens
cccacuggaggcaugugau

SEQ ID NO: 1887233 - RNA, 13 nt, Homo sapiens
gcuuccaucccaa

SEQ ID NO: 1887234 - RNA, 14 nt, Homo sapiens
cugcuggacagggg

SEQ ID NO: 1887235 - RNA, 22 nt, Homo sapiens
gugcaaggccaucugcuuacca

SEQ ID NO: 1887236 - RNA, 20 nt, Homo sapiens
aguuuauaucucucaugcau

SEQ ID NO: 1887237 - RNA, 22 nt, Homo sapiens
ugccagcauauacugaagucuu

SEQ ID NO: 1887238 - RNA, 17 nt, Homo sapiens
aagguccucacaggugu

SEQ ID NO: 1887239 - RNA, 19 nt, Homo sapiens
agugcugccaguuucccaa

SEQ ID NO: 1887240 - RNA, 19 nt, Homo sapiens
cuagauuuuguugaccuca

SEQ ID NO: 1887241 - RNA, 19 nt, Homo sapiens
gccagcagggcaucuugga

SEQ ID NO: 1887242 - RNA, 15 nt, Homo sapiens
ccuccaugauuccaa

SEQ ID NO: 1887243 - RNA, 15 nt, Homo sapiens
ccauccugaaagcca

SEQ ID NO: 1887244 - RNA, 23 nt, Homo sapiens
cagaaucacauguaauccaaaga

SEQ ID NO: 1887245 - RNA, 14 nt, Homo sapiens
guuggaagcuuguu

SEQ ID NO: 1887246 - RNA, 16 nt, Homo sapiens
uacaguguacucuuau

SEQ ID NO: 1887247 - RNA, 18 nt, Homo sapiens
auugaaaaccucuuucca

SEQ ID NO: 1887248 - RNA, 21 nt, Homo sapiens
uuuguuuuaauaaacaguaua

SEQ ID NO: 1887249 - RNA, 12 nt, Homo sapiens
uggccugugcug

SEQ ID NO: 1887250 - RNA, 17 nt, Homo sapiens
caucucuuguaccagcc

SEQ ID NO: 1887251 - RNA, 14 nt, Homo sapiens
gaaagaucaaagac

SEQ ID NO: 1887252 - RNA, 16 nt, Homo sapiens
ugcuuaaacaaaguga

SEQ ID NO: 1887253 - RNA, 19 nt, Homo sapiens
ucuccagggacauguggaa

SEQ ID NO: 1887254 - RNA, 20 nt, Homo sapiens
aacuaaucuaauuacugaag

SEQ ID NO: 1887255 - RNA, 20 nt, Homo sapiens
uguagcccucuccaaaucaa

SEQ ID NO: 1887256 - RNA, 18 nt, Homo sapiens
ccuggagaugcugccugg

SEQ ID NO: 1887257 - RNA, 23 nt, Homo sapiens
gacuuacuuuccugugguuuuau

SEQ ID NO: 1887258 - RNA, 15 nt, Homo sapiens
gaaugcugcacuaau

SEQ ID NO: 1887259 - RNA, 22 nt, Homo sapiens
gaugcugaggguguuucuuccu

SEQ ID NO: 1887260 - RNA, 17 nt, Homo sapiens
uuagcugggaagaccaa

SEQ ID NO: 1887261 - RNA, 14 nt, Homo sapiens
aagccuauaugaaa

SEQ ID NO: 1887262 - RNA, 12 nt, Homo sapiens
gugccucugucu

SEQ ID NO: 1887263 - RNA, 12 nt, Homo sapiens
agcucucuaggc

SEQ ID NO: 1887264 - RNA, 17 nt, Homo sapiens
cugaaucaaagacauuu

SEQ ID NO: 1887265 - RNA, 18 nt, Homo sapiens
aggcagcuucuacuccug

SEQ ID NO: 1887266 - RNA, 19 nt, Homo sapiens
ucaccugucaucucacauu

SEQ ID NO: 1887267 - RNA, 22 nt, Homo sapiens
aggcuuccggcugagcugugcc

SEQ ID NO: 1887268 - RNA, 24 nt, Homo sapiens
auugccaggaauguuucagcugca

SEQ ID NO: 1887269 - RNA, 19 nt, Homo sapiens
ggcuggagugcaguggcgu

SEQ ID NO: 1887270 - RNA, 13 nt, Homo sapiens
ccacuccacaguu

SEQ ID NO: 1887271 - RNA, 22 nt, Homo sapiens
gaugaaaauaauuuacugugac

SEQ ID NO: 1887272 - RNA, 23 nt, Homo sapiens
cauuaaugagauguuauuacugu

SEQ ID NO: 1887273 - RNA, 16 nt, Homo sapiens
auuuucaagcaaauau

SEQ ID NO: 1887274 - RNA, 16 nt, Homo sapiens
ggacagccaccaagaa

SEQ ID NO: 1887275 - RNA, 13 nt, Homo sapiens
ugcuggcucagga

SEQ ID NO: 1887276 - RNA, 19 nt, Homo sapiens
ucucccauccagugucuca

SEQ ID NO: 1887277 - RNA, 15 nt, Homo sapiens
uuuccuaauuuugac

SEQ ID NO: 1887278 - RNA, 13 nt, Homo sapiens
caacaacaacaac

SEQ ID NO: 1887279 - RNA, 13 nt, Homo sapiens
uuuucuggugcua

SEQ ID NO: 1887280 - RNA, 15 nt, Homo sapiens
auuuuguauguuaaa

SEQ ID NO: 1887281 - RNA, 16 nt, Homo sapiens
gcucacugcaaccucc

SEQ ID NO: 1887282 - RNA, 21 nt, Homo sapiens
gagaucgcgccacugcacucc

SEQ ID NO: 1887283 - RNA, 20 nt, Homo sapiens
ucuguggucuaaacaaaaaa

SEQ ID NO: 1887284 - RNA, 17 nt, Homo sapiens
auaugccuaaucuguaa

SEQ ID NO: 1887285 - RNA, 17 nt, Homo sapiens
cauuaagcacuguggau

SEQ ID NO: 1887286 - RNA, 14 nt, Homo sapiens
ucaauuucuacuuc

SEQ ID NO: 1887287 - RNA, 14 nt, Homo sapiens
ccaaguuccacugc

SEQ ID NO: 1887288 - RNA, 20 nt, Homo sapiens
gaggguugguccucuugccu

SEQ ID NO: 1887289 - RNA, 18 nt, Homo sapiens
aaaaugccuacacaguaa

SEQ ID NO: 1887290 - RNA, 21 nt, Homo sapiens
uucauuaucucaaaacugcac

SEQ ID NO: 1887291 - RNA, 18 nt, Homo sapiens
ucaccggucagugccuuu

SEQ ID NO: 1887292 - RNA, 12 nt, Homo sapiens
agaaaacauaua

SEQ ID NO: 1887293 - RNA, 19 nt, Homo sapiens
cugaucccuggccacugaa

SEQ ID NO: 1887294 - RNA, 21 nt, Homo sapiens
accacguugcugccugugaau

SEQ ID NO: 1887295 - RNA, 15 nt, Homo sapiens
uaguguaaaucaugc

SEQ ID NO: 1887296 - RNA, 14 nt, Homo sapiens
gcauagauuugcag

SEQ ID NO: 1887297 - RNA, 14 nt, Homo sapiens
cuucaaguacuguu

SEQ ID NO: 1887298 - RNA, 11 nt, Homo sapiens
uaaagugaauu

SEQ ID NO: 1887299 - RNA, 20 nt, Homo sapiens
ucccaaguagcugggauuac

SEQ ID NO: 1887300 - RNA, 13 nt, Homo sapiens
accucuagucaga

SEQ ID NO: 1887301 - RNA, 16 nt, Homo sapiens
uccauugacauguaca

SEQ ID NO: 1887302 - RNA, 14 nt, Homo sapiens
accacaggcaucua

SEQ ID NO: 1887303 - RNA, 16 nt, Homo sapiens
agcccuggcugaagga

SEQ ID NO: 1887304 - RNA, 19 nt, Homo sapiens
agaauggcuuuggucucuu

SEQ ID NO: 1887305 - RNA, 21 nt, Homo sapiens
caccagcucuauucuuugccu

SEQ ID NO: 1887306 - RNA, 21 nt, Homo sapiens
auuuaaaagacagacauuccu

SEQ ID NO: 1887307 - RNA, 13 nt, Homo sapiens
cacagugcaguac

SEQ ID NO: 1887308 - RNA, 21 nt, Homo sapiens
uccucacaccacaaaucugaa

SEQ ID NO: 1887309 - RNA, 18 nt, Homo sapiens
auguuuguaagacuuaca

SEQ ID NO: 1887310 - RNA, 19 nt, Homo sapiens
gccuguccaacauggugaa

SEQ ID NO: 1887311 - RNA, 15 nt, Homo sapiens
uuguacuucugcucc

SEQ ID NO: 1887312 - RNA, 16 nt, Homo sapiens
gaacugcugccaacuc

SEQ ID NO: 1887313 - RNA, 17 nt, Homo sapiens
accucuugagccuugaa

SEQ ID NO: 1887314 - RNA, 17 nt, Homo sapiens
uaccaggaauaaugaua

SEQ ID NO: 1887315 - RNA, 22 nt, Homo sapiens
caccugagcuuuggacgcacac

SEQ ID NO: 1887316 - RNA, 19 nt, Homo sapiens
aagaaaucuggcccagggu

SEQ ID NO: 1887317 - RNA, 14 nt, Homo sapiens
acuccacaccuuuu

SEQ ID NO: 1887318 - RNA, 16 nt, Homo sapiens
uccaacagaaagcaua

SEQ ID NO: 1887319 - RNA, 13 nt, Homo sapiens
cacuuguagauuu

SEQ ID NO: 1887320 - RNA, 15 nt, Homo sapiens
agaagagaagcugcu

SEQ ID NO: 1887321 - RNA, 14 nt, Homo sapiens
cagagucugucucu

SEQ ID NO: 1887322 - RNA, 14 nt, Homo sapiens
uuuagugggugaga

SEQ ID NO: 1887323 - RNA, 14 nt, Homo sapiens
ggccuuucaggaag

SEQ ID NO: 1887324 - RNA, 14 nt, Homo sapiens
uuugaauacuaaau

SEQ ID NO: 1887325 - RNA, 17 nt, Homo sapiens
aagcgauucucuugccu

SEQ ID NO: 1887326 - RNA, 15 nt, Homo sapiens
aggacguggugacuu

SEQ ID NO: 1887327 - RNA, 14 nt, Homo sapiens
uuccugucauugcg

SEQ ID NO: 1887328 - RNA, 11 nt, Homo sapiens
acauagugaua

SEQ ID NO: 1887329 - RNA, 18 nt, Homo sapiens
uaauuggcaugugaauua

SEQ ID NO: 1887330 - RNA, 16 nt, Homo sapiens
cauccuucaucuggau

SEQ ID NO: 1887331 - RNA, 15 nt, Homo sapiens
ucucauuauucacag

SEQ ID NO: 1887332 - RNA, 17 nt, Homo sapiens
cuaaagaagaucuguaa

SEQ ID NO: 1887333 - RNA, 23 nt, Homo sapiens
uugggcuuaguauuucucaggaa

SEQ ID NO: 1887334 - RNA, 18 nt, Homo sapiens
aacuugguugugaaccaa

SEQ ID NO: 1887335 - RNA, 13 nt, Homo sapiens
agcacgugucuca

SEQ ID NO: 1887336 - RNA, 16 nt, Homo sapiens
aggaauccacucccag

SEQ ID NO: 1887337 - RNA, 14 nt, Homo sapiens
gacagcuucaugaa

SEQ ID NO: 1887338 - RNA, 19 nt, Homo sapiens
auuuugggugccauuaaau

SEQ ID NO: 1887339 - RNA, 20 nt, Homo sapiens
cagggcuggcuccugaucca

SEQ ID NO: 1887340 - RNA, 14 nt, Homo sapiens
aagaauguucucaa

SEQ ID NO: 1887341 - RNA, 19 nt, Homo sapiens
ccaacauucuguguucaca

SEQ ID NO: 1887342 - RNA, 21 nt, Homo sapiens
uccaaaaaggaacacuggaaa

SEQ ID NO: 1887343 - RNA, 15 nt, Homo sapiens
gaaaacugagacuca

SEQ ID NO: 1887344 - RNA, 22 nt, Homo sapiens
acuuuauuacaauuuguauuac

SEQ ID NO: 1887345 - RNA, 17 nt, Homo sapiens
ugcuuucuauuaucuau

SEQ ID NO: 1887346 - RNA, 22 nt, Homo sapiens
auuucugaaagaauaggauuaa

SEQ ID NO: 1887347 - RNA, 23 nt, Homo sapiens
uuaagguguugguguauuugcca

SEQ ID NO: 1887348 - RNA, 19 nt, Homo sapiens
gcccaaccuaccucaccau

SEQ ID NO: 1887349 - RNA, 22 nt, Homo sapiens
acugugaagagaaccauaucaa

SEQ ID NO: 1887350 - RNA, 14 nt, Homo sapiens
ucuuuaaucaaaag

SEQ ID NO: 1887351 - RNA, 15 nt, Homo sapiens
auaauucagucuugc

SEQ ID NO: 1887352 - RNA, 18 nt, Homo sapiens
agggucucuuuguucaau

SEQ ID NO: 1887353 - RNA, 22 nt, Homo sapiens
cuagaaggaugaacaguucucc

SEQ ID NO: 1887354 - RNA, 22 nt, Homo sapiens
cugaauuaugauggucugcauu

SEQ ID NO: 1887355 - RNA, 13 nt, Homo sapiens
uggccaguucauu

SEQ ID NO: 1887356 - RNA, 15 nt, Homo sapiens
cuaaaggugcacugc

SEQ ID NO: 1887357 - RNA, 15 nt, Homo sapiens
cuaauugugcacauc

SEQ ID NO: 1887358 - RNA, 23 nt, Homo sapiens
cccuggccuuaaaaggggcccaa

SEQ ID NO: 1887359 - RNA, 14 nt, Homo sapiens
auggcuccagaaau

SEQ ID NO: 1887360 - RNA, 17 nt, Homo sapiens
uacaccuuagugcagcg

SEQ ID NO: 1887361 - RNA, 18 nt, Homo sapiens
ucagcagaugccagugaa

SEQ ID NO: 1887362 - RNA, 23 nt, Homo sapiens
ccuuugccccaaggcugcucaga

SEQ ID NO: 1887363 - RNA, 23 nt, Homo sapiens
cuuccaugacauaagugcuauug

SEQ ID NO: 1887364 - RNA, 21 nt, Homo sapiens
uaaaagcuauuacuuggcaaa

SEQ ID NO: 1887365 - RNA, 12 nt, Homo sapiens
gcauccugugac

SEQ ID NO: 1887366 - RNA, 15 nt, Homo sapiens
ccuggugauguguuu

SEQ ID NO: 1887367 - RNA, 21 nt, Homo sapiens
aagugcucuucagcacugucu

SEQ ID NO: 1887368 - RNA, 12 nt, Homo sapiens
gaucgugccacu

SEQ ID NO: 1887369 - RNA, 24 nt, Homo sapiens
auuuagaaacagugacaccugcau

SEQ ID NO: 1887370 - RNA, 19 nt, Homo sapiens
caaaacuuaaaaguauuca

SEQ ID NO: 1887371 - RNA, 17 nt, Homo sapiens
cuccuuuggccauucca

SEQ ID NO: 1887372 - RNA, 20 nt, Homo sapiens
aaaaggcuaagcuucacugu

SEQ ID NO: 1887373 - RNA, 17 nt, Homo sapiens
ugugaccuuacagccau

SEQ ID NO: 1887374 - RNA, 22 nt, Homo sapiens
caucuuuggguccuuagugcaa

SEQ ID NO: 1887375 - RNA, 16 nt, Homo sapiens
cugcccaggugugagc

SEQ ID NO: 1887376 - RNA, 22 nt, Homo sapiens
gaguguaguggcacaaucucag

SEQ ID NO: 1887377 - RNA, 13 nt, Homo sapiens
ccuccaaccagga

SEQ ID NO: 1887378 - RNA, 17 nt, Homo sapiens
gccuuagcuuucuaggc

SEQ ID NO: 1887379 - RNA, 12 nt, Homo sapiens
uguauuuaguga

SEQ ID NO: 1887380 - RNA, 23 nt, Homo sapiens
auauccuaggagguaaugaccau

SEQ ID NO: 1887381 - RNA, 15 nt, Homo sapiens
uacuaaaaauacaaa

SEQ ID NO: 1887382 - RNA, 13 nt, Homo sapiens
cuucuagaaccag

SEQ ID NO: 1887383 - RNA, 14 nt, Homo sapiens
aggaaaagacaccc

SEQ ID NO: 1887384 - RNA, 23 nt, Homo sapiens
ucucaacugcucuuuuauacugu

SEQ ID NO: 1887385 - RNA, 16 nt, Homo sapiens
agcugccccaauguga

SEQ ID NO: 1887386 - RNA, 19 nt, Homo sapiens
gcagguguugggaccugcu

SEQ ID NO: 1887387 - RNA, 18 nt, Homo sapiens
ugagagaugcagaaauau

SEQ ID NO: 1887388 - RNA, 13 nt, Homo sapiens
guuugaaucugac

SEQ ID NO: 1887389 - RNA, 17 nt, Homo sapiens
ugacauuaaaugcaaua

SEQ ID NO: 1887390 - RNA, 20 nt, Homo sapiens
gaacuaaugauaaucccacc

SEQ ID NO: 1887391 - RNA, 17 nt, Homo sapiens
ucagggaccagcuuuac

SEQ ID NO: 1887392 - RNA, 19 nt, Homo sapiens
ugcagagacucauuucaca

SEQ ID NO: 1887393 - RNA, 22 nt, Homo sapiens
aguccauaacuuaccucugcuu

SEQ ID NO: 1887394 - RNA, 18 nt, Homo sapiens
ccacauuggagauguuua

SEQ ID NO: 1887395 - RNA, 14 nt, Homo sapiens
cugguuccuuucau

SEQ ID NO: 1887396 - RNA, 15 nt, Homo sapiens
cuuucuucucuccag

SEQ ID NO: 1887397 - RNA, 17 nt, Homo sapiens
gagcuagaaacucagga

SEQ ID NO: 1887398 - RNA, 15 nt, Homo sapiens
ucccgccacccucaa

SEQ ID NO: 1887399 - RNA, 12 nt, Homo sapiens
uuuaaaacaaag

SEQ ID NO: 1887400 - RNA, 15 nt, Homo sapiens
gaauuaaaguacuuu

SEQ ID NO: 1887401 - RNA, 19 nt, Homo sapiens
guucaacauguaccucacc

SEQ ID NO: 1887402 - RNA, 22 nt, Homo sapiens
ugaagacucacuucucagcuga

SEQ ID NO: 1887403 - RNA, 22 nt, Homo sapiens
ggacagcccgccgucagggugg

SEQ ID NO: 1887404 - RNA, 15 nt, Homo sapiens
gaagccuuuugcaaa

SEQ ID NO: 1887405 - RNA, 22 nt, Homo sapiens
aacuacacacccccaagccaca

SEQ ID NO: 1887406 - RNA, 19 nt, Homo sapiens
aauguaggcaucaugcaug

SEQ ID NO: 1887407 - RNA, 23 nt, Homo sapiens
ggcaacugagagcugagcgcuuu

SEQ ID NO: 1887408 - RNA, 14 nt, Homo sapiens
gcacacacaccgau

SEQ ID NO: 1887409 - RNA, 18 nt, Homo sapiens
aggcauccugugugcuga

SEQ ID NO: 1887410 - RNA, 13 nt, Homo sapiens
ucuaauacauucc

SEQ ID NO: 1887411 - RNA, 17 nt, Homo sapiens
aguccccgggcaucuuu

SEQ ID NO: 1887412 - RNA, 13 nt, Homo sapiens
uccccuacaucaa

SEQ ID NO: 1887413 - RNA, 12 nt, Homo sapiens
uaaucagcauua

SEQ ID NO: 1887414 - RNA, 23 nt, Homo sapiens
aaccucaggccacaucuuuucca

SEQ ID NO: 1887415 - RNA, 24 nt, Homo sapiens
ggccuaugcagagguccacaacac

SEQ ID NO: 1887416 - RNA, 18 nt, Homo sapiens
auuugcacuauuuccaca

SEQ ID NO: 1887417 - RNA, 13 nt, Homo sapiens
acucucugcucua

SEQ ID NO: 1887418 - RNA, 17 nt, Homo sapiens
accugacacaaucccua

SEQ ID NO: 1887419 - RNA, 20 nt, Homo sapiens
guauuuuugccggcugguga

SEQ ID NO: 1887420 - RNA, 17 nt, Homo sapiens
aaaauuauacuaacuua

SEQ ID NO: 1887421 - RNA, 21 nt, Homo sapiens
gaauagaagguagugaagaaa

SEQ ID NO: 1887422 - RNA, 14 nt, Homo sapiens
aagaaacuuauuuc

SEQ ID NO: 1887423 - RNA, 23 nt, Homo sapiens
cauagcuugcacaacauccucag

SEQ ID NO: 1887424 - RNA, 15 nt, Homo sapiens
cuuguagacucagaa

SEQ ID NO: 1887425 - RNA, 21 nt, Homo sapiens
agacccugagaaggacccugg

SEQ ID NO: 1887426 - RNA, 16 nt, Homo sapiens
agaacuccaauacuca

SEQ ID NO: 1887427 - RNA, 15 nt, Homo sapiens
uaagauguacauuua

SEQ ID NO: 1887428 - RNA, 20 nt, Homo sapiens
acagacaccaaguuccguca

SEQ ID NO: 1887429 - RNA, 18 nt, Homo sapiens
gucaccauacacacuguu

SEQ ID NO: 1887430 - RNA, 16 nt, Homo sapiens
ugcaugacaaaccuua

SEQ ID NO: 1887431 - RNA, 20 nt, Homo sapiens
ggccugaaaugacauuucac

SEQ ID NO: 1887432 - RNA, 16 nt, Homo sapiens
cuggggcucucagugu

SEQ ID NO: 1887433 - RNA, 16 nt, Homo sapiens
aaagacaagaugcaac

SEQ ID NO: 1887434 - RNA, 14 nt, Homo sapiens
gaccugagucaaug

SEQ ID NO: 1887435 - RNA, 20 nt, Homo sapiens
uaccaugggcuacagugucu

SEQ ID NO: 1887436 - RNA, 17 nt, Homo sapiens
ugugggucaaaccaaga

SEQ ID NO: 1887437 - RNA, 21 nt, Homo sapiens
acucucuuuccuugagcuguu

SEQ ID NO: 1887438 - RNA, 16 nt, Homo sapiens
ggcuaauauacuugua

SEQ ID NO: 1887439 - RNA, 11 nt, Homo sapiens
ugaacauaugu

SEQ ID NO: 1887440 - RNA, 11 nt, Homo sapiens
uaaacauauau

SEQ ID NO: 1887441 - RNA, 17 nt, Homo sapiens
aucagcaaccugacuca

SEQ ID NO: 1887442 - RNA, 23 nt, Homo sapiens
caucuaagaaguuuuguucuguc

SEQ ID NO: 1887443 - RNA, 23 nt, Homo sapiens
ucuggcugcaacuuaaugcucug

SEQ ID NO: 1887444 - RNA, 21 nt, Homo sapiens
aaugauugagguccauauuua

SEQ ID NO: 1887445 - RNA, 16 nt, Homo sapiens
uauucacaucauuugg

SEQ ID NO: 1887446 - RNA, 19 nt, Homo sapiens
auacaaauuguuucuggaa

SEQ ID NO: 1887447 - RNA, 17 nt, Homo sapiens
cacuucaaaaaagcuua

SEQ ID NO: 1887448 - RNA, 13 nt, Homo sapiens
agagacaccugca

SEQ ID NO: 1887449 - RNA, 16 nt, Homo sapiens
acuaaugccucuucau

SEQ ID NO: 1887450 - RNA, 13 nt, Homo sapiens
ccugguggccaug

SEQ ID NO: 1887451 - RNA, 21 nt, Homo sapiens
aguuccagauuguucugucca

SEQ ID NO: 1887452 - RNA, 11 nt, Homo sapiens
cacagccagag

SEQ ID NO: 1887453 - RNA, 19 nt, Homo sapiens
ucccaugagggagaugcca

SEQ ID NO: 1887454 - RNA, 16 nt, Homo sapiens
gugguugaaaaccaca

SEQ ID NO: 1887455 - RNA, 18 nt, Homo sapiens
auucccuuuucuuuaagu

SEQ ID NO: 1887456 - RNA, 22 nt, Homo sapiens
ugaguuucuggcucuugaggca

SEQ ID NO: 1887457 - RNA, 21 nt, Homo sapiens
gaaaugaaacaaauaaucaca

SEQ ID NO: 1887458 - RNA, 21 nt, Homo sapiens
ucugcuguauacuguacugag

SEQ ID NO: 1887459 - RNA, 15 nt, Homo sapiens
gaaaagaguauguag

SEQ ID NO: 1887460 - RNA, 13 nt, Homo sapiens
agggaggaccaaa

SEQ ID NO: 1887461 - RNA, 20 nt, Homo sapiens
auauuuuaggaaacucucca

SEQ ID NO: 1887462 - RNA, 18 nt, Homo sapiens
caaucuuaaggggcagcu

SEQ ID NO: 1887463 - RNA, 18 nt, Homo sapiens
gcgaacucucagaaauaa

SEQ ID NO: 1887464 - RNA, 14 nt, Homo sapiens
gagaaaagccagau

SEQ ID NO: 1887465 - RNA, 23 nt, Homo sapiens
uaacugugacaaagaagaccaca

SEQ ID NO: 1887466 - RNA, 18 nt, Homo sapiens
cuauggcucuacuuucag

SEQ ID NO: 1887467 - RNA, 23 nt, Homo sapiens
agcuuguccaacaacuccaggaa

SEQ ID NO: 1887468 - RNA, 20 nt, Homo sapiens
cagagaucgagaccauccua

SEQ ID NO: 1887469 - RNA, 18 nt, Homo sapiens
aagaggaaaaaaagccgu

SEQ ID NO: 1887470 - RNA, 19 nt, Homo sapiens
ugcacagcccaaccaggag

SEQ ID NO: 1887471 - RNA, 18 nt, Homo sapiens
ugacacaggggacacuga

SEQ ID NO: 1887472 - RNA, 22 nt, Homo sapiens
gaagugaugauuguaaguccca

SEQ ID NO: 1887473 - RNA, 18 nt, Homo sapiens
ccuuucauuuacuguggc

SEQ ID NO: 1887474 - RNA, 12 nt, Homo sapiens
uaugcaaucuga

SEQ ID NO: 1887475 - RNA, 17 nt, Homo sapiens
ucgcucuugggagucag

SEQ ID NO: 1887476 - RNA, 14 nt, Homo sapiens
uuauuucacuaaau

SEQ ID NO: 1887477 - RNA, 18 nt, Homo sapiens
ggucacccuucaacgcuc

SEQ ID NO: 1887478 - RNA, 21 nt, Homo sapiens
uauaaaaugcugauauuuacu

SEQ ID NO: 1887479 - RNA, 19 nt, Homo sapiens
aauucuuacacugccugua

SEQ ID NO: 1887480 - RNA, 20 nt, Homo sapiens
caugcuuugaaaaaucacuu

SEQ ID NO: 1887481 - RNA, 13 nt, Homo sapiens
ccagauaccagcc

SEQ ID NO: 1887482 - RNA, 23 nt, Homo sapiens
ugaagacccaguguaaagaauaa

SEQ ID NO: 1887483 - RNA, 21 nt, Homo sapiens
acagguggggccucagccugg

SEQ ID NO: 1887484 - RNA, 22 nt, Homo sapiens
uuaaaaaacuauuuuauguuca

SEQ ID NO: 1887485 - RNA, 18 nt, Homo sapiens
uuugcuuaaacuaaugaa

SEQ ID NO: 1887486 - RNA, 20 nt, Homo sapiens
cuuccaugauguuacauuag

SEQ ID NO: 1887487 - RNA, 15 nt, Homo sapiens
auuuacagcugugcu

SEQ ID NO: 1887488 - RNA, 21 nt, Homo sapiens
gaaugaaaauaacugaaccaa

SEQ ID NO: 1887489 - RNA, 16 nt, Homo sapiens
acaguguuuacacuuu

SEQ ID NO: 1887490 - RNA, 23 nt, Homo sapiens
acgcagcagcccucuggcuccag

SEQ ID NO: 1887491 - RNA, 17 nt, Homo sapiens
cuaaaucuccaguacuu

SEQ ID NO: 1887492 - RNA, 23 nt, Homo sapiens
auuauuccucuuugcccaaaaua

SEQ ID NO: 1887493 - RNA, 13 nt, Homo sapiens
ggagaaacuggaa

SEQ ID NO: 1887494 - RNA, 13 nt, Homo sapiens
cagagcaggcuca

SEQ ID NO: 1887495 - RNA, 22 nt, Homo sapiens
cuaacuuuguauccguucaaua

SEQ ID NO: 1887496 - RNA, 21 nt, Homo sapiens
accaccuggauggaucugcuc

SEQ ID NO: 1887497 - RNA, 17 nt, Homo sapiens
uguuuagaaaaguauuc

SEQ ID NO: 1887498 - RNA, 23 nt, Homo sapiens
gccuccccuccucugcuugccau

SEQ ID NO: 1887499 - RNA, 17 nt, Homo sapiens
auuuuuuuaagcuauca

SEQ ID NO: 1887500 - RNA, 20 nt, Homo sapiens
gccagcuguacugaguucuc

SEQ ID NO: 1887501 - RNA, 17 nt, Homo sapiens
uccuucauccaaugcag

SEQ ID NO: 1887502 - RNA, 14 nt, Homo sapiens
auuuucuacuuuaa

SEQ ID NO: 1887503 - RNA, 23 nt, Homo sapiens
guggcuccugccacugaccucac

SEQ ID NO: 1887504 - RNA, 18 nt, Homo sapiens
uaaaaauuauuugguccu

SEQ ID NO: 1887505 - RNA, 20 nt, Homo sapiens
ugucaaacauaggacuggaa

SEQ ID NO: 1887506 - RNA, 15 nt, Homo sapiens
caacugcucugccca

SEQ ID NO: 1887507 - RNA, 21 nt, Homo sapiens
aucacaugcucaaugacucuc

SEQ ID NO: 1887508 - RNA, 14 nt, Homo sapiens
acaacagaagucau

SEQ ID NO: 1887509 - RNA, 23 nt, Homo sapiens
uucccucuuggugugauugcaca

SEQ ID NO: 1887510 - RNA, 16 nt, Homo sapiens
aaagcaucauuguaaa

SEQ ID NO: 1887511 - RNA, 22 nt, Homo sapiens
gaaaaaacuagagccugugcua

SEQ ID NO: 1887512 - RNA, 19 nt, Homo sapiens
ggcuucuauguccaacaga

SEQ ID NO: 1887513 - RNA, 15 nt, Homo sapiens
agcauuacccuccuc

SEQ ID NO: 1887514 - RNA, 17 nt, Homo sapiens
augucacgaacuugaaa

SEQ ID NO: 1887515 - RNA, 18 nt, Homo sapiens
uauggaggggagggaucu

SEQ ID NO: 1887516 - RNA, 19 nt, Homo sapiens
caccagaaauaucgcugau

SEQ ID NO: 1887517 - RNA, 13 nt, Homo sapiens
uccugucaccaag

SEQ ID NO: 1887518 - RNA, 18 nt, Homo sapiens
cuaaugccuaucugacca

SEQ ID NO: 1887519 - RNA, 22 nt, Homo sapiens
auuuuauuaucaccaugcaaug

SEQ ID NO: 1887520 - RNA, 18 nt, Homo sapiens
gaugacgugucuccucac

SEQ ID NO: 1887521 - RNA, 19 nt, Homo sapiens
auggcaaagacuggaucca

SEQ ID NO: 1887522 - RNA, 23 nt, Homo sapiens
cagaggagcucuacccugcuccc

SEQ ID NO: 1887523 - RNA, 14 nt, Homo sapiens
ucagcacucuguaa

SEQ ID NO: 1887524 - RNA, 16 nt, Homo sapiens
augcucuuuugcacaa

SEQ ID NO: 1887525 - RNA, 14 nt, Homo sapiens
uaaaacaagccuua

SEQ ID NO: 1887526 - RNA, 15 nt, Homo sapiens
cguuuucuacuuuga

SEQ ID NO: 1887527 - RNA, 15 nt, Homo sapiens
auguauucaccuuuc

SEQ ID NO: 1887528 - RNA, 21 nt, Homo sapiens
augaccuaguaaacuuuguac

SEQ ID NO: 1887529 - RNA, 20 nt, Homo sapiens
cuuuaaaauguauuuuucac

SEQ ID NO: 1887530 - RNA, 13 nt, Homo sapiens
uaagaaacugcca

SEQ ID NO: 1887531 - RNA, 21 nt, Homo sapiens
ggccgcaugucugcauggcag

SEQ ID NO: 1887532 - RNA, 18 nt, Homo sapiens
caggcaagcuuauucuuu

SEQ ID NO: 1887533 - RNA, 18 nt, Homo sapiens
cuauaaaauuaacaguau

SEQ ID NO: 1887534 - RNA, 13 nt, Homo sapiens
ugaaccacuuugc

SEQ ID NO: 1887535 - RNA, 19 nt, Homo sapiens
cugcuggggaucuagggaa

SEQ ID NO: 1887536 - RNA, 21 nt, Homo sapiens
cagcaaugauuacucuuugag

SEQ ID NO: 1887537 - RNA, 23 nt, Homo sapiens
ccaaaacaagggauuaucacaua

SEQ ID NO: 1887538 - RNA, 15 nt, Homo sapiens
uggaagugucccuuu

SEQ ID NO: 1887539 - RNA, 15 nt, Homo sapiens
uggugcugaccucca

SEQ ID NO: 1887540 - RNA, 15 nt, Homo sapiens
cauggcuuugcuuug

SEQ ID NO: 1887541 - RNA, 19 nt, Homo sapiens
agccagagcuugaauucau

SEQ ID NO: 1887542 - RNA, 17 nt, Homo sapiens
aucauuguuuauuguau

SEQ ID NO: 1887543 - RNA, 18 nt, Homo sapiens
ucagcugcucugcaagca

SEQ ID NO: 1887544 - RNA, 12 nt, Homo sapiens
cuagaguuuuau

SEQ ID NO: 1887545 - RNA, 18 nt, Homo sapiens
cuuggggcugaugcaguu

SEQ ID NO: 1887546 - RNA, 23 nt, Homo sapiens
auguuucgugaaguauacuguau

SEQ ID NO: 1887547 - RNA, 13 nt, Homo sapiens
ugaccuuccaaac

SEQ ID NO: 1887548 - RNA, 20 nt, Homo sapiens
auggguuagggaaaacauuc

SEQ ID NO: 1887549 - RNA, 15 nt, Homo sapiens
ccccuacacugugaa

SEQ ID NO: 1887550 - RNA, 14 nt, Homo sapiens
ucagcauugucucg

SEQ ID NO: 1887551 - RNA, 23 nt, Homo sapiens
ugggagaggagaggcugcuguca

SEQ ID NO: 1887552 - RNA, 23 nt, Homo sapiens
ugcuguucuagcacuucaucugg

SEQ ID NO: 1887553 - RNA, 16 nt, Homo sapiens
ucuucauguccaguga

SEQ ID NO: 1887554 - RNA, 18 nt, Homo sapiens
auauauaguuagcuuuau

SEQ ID NO: 1887555 - RNA, 18 nt, Homo sapiens
uaagauugauaucuauaa

SEQ ID NO: 1887556 - RNA, 17 nt, Homo sapiens
ggagacaaaucucagaa

SEQ ID NO: 1887557 - RNA, 20 nt, Homo sapiens
ucaaugaagauuaacacuga

SEQ ID NO: 1887558 - RNA, 13 nt, Homo sapiens
uucaggagagugu

SEQ ID NO: 1887559 - RNA, 22 nt, Homo sapiens
guguugcuuuggauacacacau

SEQ ID NO: 1887560 - RNA, 22 nt, Homo sapiens
auuaugugcacuaccauagcua

SEQ ID NO: 1887561 - RNA, 13 nt, Homo sapiens
gacacucuucccu

SEQ ID NO: 1887562 - RNA, 17 nt, Homo sapiens
acuguaaauuccaaaga

SEQ ID NO: 1887563 - RNA, 22 nt, Homo sapiens
gaaaucuguuucaacagaugac

SEQ ID NO: 1887564 - RNA, 17 nt, Homo sapiens
uagugcugaagcuuauu

SEQ ID NO: 1887565 - RNA, 18 nt, Homo sapiens
uggcugggagggggcccu

SEQ ID NO: 1887566 - RNA, 14 nt, Homo sapiens
guugaggugcaagg

SEQ ID NO: 1887567 - RNA, 20 nt, Homo sapiens
ucuguuacacaaagaaccac

SEQ ID NO: 1887568 - RNA, 22 nt, Homo sapiens
agugggauuuccagaaccacac

SEQ ID NO: 1887569 - RNA, 14 nt, Homo sapiens
agcucacuguucua

SEQ ID NO: 1887570 - RNA, 15 nt, Homo sapiens
uuuuuaagacucaau

SEQ ID NO: 1887571 - RNA, 20 nt, Homo sapiens
uaaagcucauaaacugccaa

SEQ ID NO: 1887572 - RNA, 18 nt, Homo sapiens
cuaggugacauauacaua

SEQ ID NO: 1887573 - RNA, 12 nt, Homo sapiens
acugucuuucag

SEQ ID NO: 1887574 - RNA, 13 nt, Homo sapiens
acuaugaucucag

SEQ ID NO: 1887575 - RNA, 20 nt, Homo sapiens
uccauuuaagacacauugac

SEQ ID NO: 1887576 - RNA, 14 nt, Homo sapiens
ugugauuaccucuc

SEQ ID NO: 1887577 - RNA, 23 nt, Homo sapiens
uccaaguauauaugaaugaauaa

SEQ ID NO: 1887578 - RNA, 16 nt, Homo sapiens
caucuaagcuauacug

SEQ ID NO: 1887579 - RNA, 17 nt, Homo sapiens
auaaguaucacacugua

SEQ ID NO: 1887580 - RNA, 16 nt, Homo sapiens
uugagaaugguuacaa

SEQ ID NO: 1887581 - RNA, 16 nt, Homo sapiens
gguugaaauugaacau

SEQ ID NO: 1887582 - RNA, 21 nt, Homo sapiens
ccuuccucugauuuacauuca

SEQ ID NO: 1887583 - RNA, 14 nt, Homo sapiens
gacauggaccucca

SEQ ID NO: 1887584 - RNA, 17 nt, Homo sapiens
acacuaaggcugcuuca

SEQ ID NO: 1887585 - RNA, 17 nt, Homo sapiens
aaagcaaggaucuuuca

SEQ ID NO: 1887586 - RNA, 17 nt, Homo sapiens
uuugagauaaugucaaa

SEQ ID NO: 1887587 - RNA, 20 nt, Homo sapiens
aacuggagagcuuuacuuug

SEQ ID NO: 1887588 - RNA, 12 nt, Homo sapiens
cuguucuuccca

SEQ ID NO: 1887589 - RNA, 18 nt, Homo sapiens
cuuguuguuuuuaagucc

SEQ ID NO: 1887590 - RNA, 19 nt, Homo sapiens
cuuguagaaaucucagaaa

SEQ ID NO: 1887591 - RNA, 13 nt, Homo sapiens
ugcauacuugcca

SEQ ID NO: 1887592 - RNA, 19 nt, Homo sapiens
cagugccuuaaacucuguu

SEQ ID NO: 1887593 - RNA, 11 nt, Homo sapiens
ucacugugagu

SEQ ID NO: 1887594 - RNA, 22 nt, Homo sapiens
cagauaugggacugauucugug

SEQ ID NO: 1887595 - RNA, 20 nt, Homo sapiens
aaacauguuguacauuucac

SEQ ID NO: 1887596 - RNA, 13 nt, Homo sapiens
uaguccaaaaagc

SEQ ID NO: 1887597 - RNA, 23 nt, Homo sapiens
aguuucagccuaagagacuggug

SEQ ID NO: 1887598 - RNA, 22 nt, Homo sapiens
cuuacauuuuccugagaccuca

SEQ ID NO: 1887599 - RNA, 15 nt, Homo sapiens
auuucauugcacuuu

SEQ ID NO: 1887600 - RNA, 20 nt, Homo sapiens
cauccugggcagcauacuga

SEQ ID NO: 1887601 - RNA, 16 nt, Homo sapiens
uauggggacauuccaa

SEQ ID NO: 1887602 - RNA, 17 nt, Homo sapiens
ugccauguuugcucuaa

SEQ ID NO: 1887603 - RNA, 15 nt, Homo sapiens
gagcuccccaaaaac

SEQ ID NO: 1887604 - RNA, 19 nt, Homo sapiens
ucuuacuauauuuauugau

SEQ ID NO: 1887605 - RNA, 20 nt, Homo sapiens
auucugcuaauuuaugaaga

SEQ ID NO: 1887606 - RNA, 19 nt, Homo sapiens
ggcagaaugcauauaucuc

SEQ ID NO: 1887607 - RNA, 23 nt, Homo sapiens
accaaaucuugguugaugccaaa

SEQ ID NO: 1887608 - RNA, 18 nt, Homo sapiens
auaggcauuaacacaaag

SEQ ID NO: 1887609 - RNA, 13 nt, Homo sapiens
uaagaagggaaaa

SEQ ID NO: 1887610 - RNA, 18 nt, Homo sapiens
ccugaucgccaaccuuuc

SEQ ID NO: 1887611 - RNA, 19 nt, Homo sapiens
auuuuuguguggauaugaa

SEQ ID NO: 1887612 - RNA, 20 nt, Homo sapiens
uacaggugagugccaccaca

SEQ ID NO: 1887613 - RNA, 17 nt, Homo sapiens
caggggcuggcuucagg

SEQ ID NO: 1887614 - RNA, 17 nt, Homo sapiens
ugcccuuucaaagcacu

SEQ ID NO: 1887615 - RNA, 23 nt, Homo sapiens
agacuuccccucaacaugcugcc

SEQ ID NO: 1887616 - RNA, 17 nt, Homo sapiens
gccccuuaaauuucugc

SEQ ID NO: 1887617 - RNA, 20 nt, Homo sapiens
gucuacucccuccucacccc

SEQ ID NO: 1887618 - RNA, 22 nt, Homo sapiens
aagacugcaaacauguugccuc

SEQ ID NO: 1887619 - RNA, 17 nt, Homo sapiens
gaggccuuuuuugccag

SEQ ID NO: 1887620 - RNA, 21 nt, Homo sapiens
gcccaggaacccuccagaccu

SEQ ID NO: 1887621 - RNA, 18 nt, Homo sapiens
uaauaaguuucacugacu

SEQ ID NO: 1887622 - RNA, 19 nt, Homo sapiens
ccagguuggagugcagugg

SEQ ID NO: 1887623 - RNA, 14 nt, Homo sapiens
cugcucucuaucca

SEQ ID NO: 1887624 - RNA, 23 nt, Homo sapiens
ugagaauguuuuagcacagcguu

SEQ ID NO: 1887625 - RNA, 21 nt, Homo sapiens
uacaacuuccacuccaaguga

SEQ ID NO: 1887626 - RNA, 18 nt, Homo sapiens
uucccaaaauaacugaga

SEQ ID NO: 1887627 - RNA, 13 nt, Homo sapiens
aaacaaucugccc

SEQ ID NO: 1887628 - RNA, 16 nt, Homo sapiens
uccauauuuacauucu

SEQ ID NO: 1887629 - RNA, 11 nt, Homo sapiens
gccacaaccaa

SEQ ID NO: 1887630 - RNA, 17 nt, Homo sapiens
agcauggagagccucuu

SEQ ID NO: 1887631 - RNA, 12 nt, Homo sapiens
cucccacagaac

SEQ ID NO: 1887632 - RNA, 10 nt, Homo sapiens
uccuggaccc

SEQ ID NO: 1887633 - RNA, 17 nt, Homo sapiens
aauugaaaggcauucuc

SEQ ID NO: 1887634 - RNA, 20 nt, Homo sapiens
ucucuagacaacuaccccuu

SEQ ID NO: 1887635 - RNA, 20 nt, Homo sapiens
aguucaaucucccgcugcug

SEQ ID NO: 1887636 - RNA, 18 nt, Homo sapiens
gaauccgcucccaagggu

SEQ ID NO: 1887637 - RNA, 14 nt, Homo sapiens
cggccaacacuuug

SEQ ID NO: 1887638 - RNA, 16 nt, Homo sapiens
ucauaaccuuaccaga

SEQ ID NO: 1887639 - RNA, 14 nt, Homo sapiens
gaggcugagacagg

SEQ ID NO: 1887640 - RNA, 24 nt, Homo sapiens
cauuuugcauuuucaucuacucau

SEQ ID NO: 1887641 - RNA, 17 nt, Homo sapiens
gucuuuuuguaucucau

SEQ ID NO: 1887642 - RNA, 13 nt, Homo sapiens
uucccuccaguga

SEQ ID NO: 1887643 - RNA, 21 nt, Homo sapiens
aauagacuaacuucaguagga

SEQ ID NO: 1887644 - RNA, 11 nt, Homo sapiens
acuuuuuccag

SEQ ID NO: 1887645 - RNA, 12 nt, Homo sapiens
acacaaggucau

SEQ ID NO: 1887646 - RNA, 20 nt, Homo sapiens
agguccacaacacacagauu

SEQ ID NO: 1887647 - RNA, 15 nt, Homo sapiens
uacuucacuaaugac

SEQ ID NO: 1887648 - RNA, 23 nt, Homo sapiens
gccugccccaaacaaauaugcaa

SEQ ID NO: 1887649 - RNA, 20 nt, Homo sapiens
acaccauucuccugccucag

SEQ ID NO: 1887650 - RNA, 22 nt, Homo sapiens
uguuguagcuaauuaggaagcu

SEQ ID NO: 1887651 - RNA, 20 nt, Homo sapiens
uucucuccccuccucugaau

SEQ ID NO: 1887652 - RNA, 15 nt, Homo sapiens
cucaaucugcagcca

SEQ ID NO: 1887653 - RNA, 13 nt, Homo sapiens
ugaagaccaaaga

SEQ ID NO: 1887654 - RNA, 13 nt, Homo sapiens
ugagaaccaaaag

SEQ ID NO: 1887655 - RNA, 16 nt, Homo sapiens
ugugaucauagcucac

SEQ ID NO: 1887656 - RNA, 17 nt, Homo sapiens
ugugaccccaccugcuc

SEQ ID NO: 1887657 - RNA, 20 nt, Homo sapiens
agcaaaaacucuugugguac

SEQ ID NO: 1887658 - RNA, 19 nt, Homo sapiens
cagcggaggagaccagcuc

SEQ ID NO: 1887659 - RNA, 14 nt, Homo sapiens
uguaucuacauuaa

SEQ ID NO: 1887660 - RNA, 15 nt, Homo sapiens
uugaacauacuucaa

SEQ ID NO: 1887661 - RNA, 20 nt, Homo sapiens
gccacggccacagccacuaa

SEQ ID NO: 1887662 - RNA, 21 nt, Homo sapiens
ccauccuggccaacaugguga

SEQ ID NO: 1887663 - RNA, 16 nt, Homo sapiens
ugaaaaccagaacaaa

SEQ ID NO: 1887664 - RNA, 21 nt, Homo sapiens
aucaguuuuuuuuuauacacu

SEQ ID NO: 1887665 - RNA, 18 nt, Homo sapiens
gaccuuccaaggacauau

SEQ ID NO: 1887666 - RNA, 24 nt, Homo sapiens
uaaauaucacaguauuaucugugu

SEQ ID NO: 1887667 - RNA, 14 nt, Homo sapiens
ucacacaugccacu

SEQ ID NO: 1887668 - RNA, 13 nt, Homo sapiens
aaagccacacucu

SEQ ID NO: 1887669 - RNA, 24 nt, Homo sapiens
ccuuaaaaguuaaaaacauuuuca

SEQ ID NO: 1887670 - RNA, 17 nt, Homo sapiens
aaccaguuaaagccaca

SEQ ID NO: 1887671 - RNA, 13 nt, Homo sapiens
gcagacugucccu

SEQ ID NO: 1887672 - RNA, 17 nt, Homo sapiens
aaagccaccuuguuaca

SEQ ID NO: 1887673 - RNA, 18 nt, Homo sapiens
cauauaccaguugugaua

SEQ ID NO: 1887674 - RNA, 12 nt, Homo sapiens
cuggcuacuccc

SEQ ID NO: 1887675 - RNA, 17 nt, Homo sapiens
aacauguucagaaaaga

SEQ ID NO: 1887676 - RNA, 18 nt, Homo sapiens
guagacucauucuucaca

SEQ ID NO: 1887677 - RNA, 19 nt, Homo sapiens
cuucuacgggauggccaga

SEQ ID NO: 1887678 - RNA, 19 nt, Homo sapiens
ugaguuaucuuuaacugac

SEQ ID NO: 1887679 - RNA, 20 nt, Homo sapiens
auuugcuucuaauguucccc

SEQ ID NO: 1887680 - RNA, 15 nt, Homo sapiens
uuuuucugccugaga

SEQ ID NO: 1887681 - RNA, 23 nt, Homo sapiens
auuuaauaaguacaacuaccuau

SEQ ID NO: 1887682 - RNA, 16 nt, Homo sapiens
aauaugggcacuuuaa

SEQ ID NO: 1887683 - RNA, 19 nt, Homo sapiens
cacgcaccuguagucccag

SEQ ID NO: 1887684 - RNA, 18 nt, Homo sapiens
agcugguuggagagcuag

SEQ ID NO: 1887685 - RNA, 17 nt, Homo sapiens
aggggaaggaagagaga

SEQ ID NO: 1887686 - RNA, 22 nt, Homo sapiens
ggacuguuggcugauuggaaaa

SEQ ID NO: 1887687 - RNA, 21 nt, Homo sapiens
ucuagcccaaccuacauucca

SEQ ID NO: 1887688 - RNA, 15 nt, Homo sapiens
acccauaucugugug

SEQ ID NO: 1887689 - RNA, 19 nt, Homo sapiens
acccugucaccuagcucaa

SEQ ID NO: 1887690 - RNA, 16 nt, Homo sapiens
aaagucaccugcccaa

SEQ ID NO: 1887691 - RNA, 13 nt, Homo sapiens
cucuaaaguccag

SEQ ID NO: 1887692 - RNA, 12 nt, Homo sapiens
aauauuaaggag

SEQ ID NO: 1887693 - RNA, 19 nt, Homo sapiens
cuccacaaagcaaaggcag

SEQ ID NO: 1887694 - RNA, 17 nt, Homo sapiens
agaauucaaggaggaaa

SEQ ID NO: 1887695 - RNA, 21 nt, Homo sapiens
auauagucacaggaaacuacu

SEQ ID NO: 1887696 - RNA, 22 nt, Homo sapiens
ggcaccucauggacuccaggau

SEQ ID NO: 1887697 - RNA, 15 nt, Homo sapiens
ugugcacucauauga

SEQ ID NO: 1887698 - RNA, 15 nt, Homo sapiens
cauaugauugugcac

SEQ ID NO: 1887699 - RNA, 20 nt, Homo sapiens
ucccccaggccugagcugcu

SEQ ID NO: 1887700 - RNA, 9 nt, Homo sapiens
ccucuggag

SEQ ID NO: 1887701 - RNA, 19 nt, Homo sapiens
ccagaauuguuuugcauuu

SEQ ID NO: 1887702 - RNA, 19 nt, Homo sapiens
aauagugaauaaagucauu

SEQ ID NO: 1887703 - RNA, 17 nt, Homo sapiens
aacuaccuccucagucu

SEQ ID NO: 1887704 - RNA, 13 nt, Homo sapiens
uuccuccuaccug

SEQ ID NO: 1887705 - RNA, 14 nt, Homo sapiens
cuucggcaucuucu

SEQ ID NO: 1887706 - RNA, 17 nt, Homo sapiens
cgcugccacccgcccac

SEQ ID NO: 1887707 - RNA, 19 nt, Homo sapiens
gacaaaguugaauguaaag

SEQ ID NO: 1887708 - RNA, 13 nt, Homo sapiens
cugugccacuuug

SEQ ID NO: 1887709 - RNA, 16 nt, Homo sapiens
aaacacucgugugcau

SEQ ID NO: 1887710 - RNA, 12 nt, Homo sapiens
aagccaugcccc

SEQ ID NO: 1887711 - RNA, 16 nt, Homo sapiens
gcccuggggccuguac

SEQ ID NO: 1887712 - RNA, 18 nt, Homo sapiens
gaggucccucagcugcga

SEQ ID NO: 1887713 - RNA, 21 nt, Homo sapiens
uccaggaacagacauggaccu

SEQ ID NO: 1887714 - RNA, 15 nt, Homo sapiens
ccucuuucuacauuc

SEQ ID NO: 1887715 - RNA, 11 nt, Homo sapiens
uacauucuucc

SEQ ID NO: 1887716 - RNA, 20 nt, Homo sapiens
uccagacuuccuugagacac

SEQ ID NO: 1887717 - RNA, 12 nt, Homo sapiens
gucagacauaaa

SEQ ID NO: 1887718 - RNA, 23 nt, Homo sapiens
gacuauucccuucuaaccugaac

SEQ ID NO: 1887719 - RNA, 14 nt, Homo sapiens
ugcacuagugcaau

SEQ ID NO: 1887720 - RNA, 13 nt, Homo sapiens
caccccuaccucu

SEQ ID NO: 1887721 - RNA, 22 nt, Homo sapiens
ugaaaccagaaaucuaaucucu

SEQ ID NO: 1887722 - RNA, 22 nt, Homo sapiens
auaucuccuuuaaugacauuga

SEQ ID NO: 1887723 - RNA, 22 nt, Homo sapiens
caugucuugcuaacaggauaug

SEQ ID NO: 1887724 - RNA, 17 nt, Homo sapiens
aggcugcugcacaccaa

SEQ ID NO: 1887725 - RNA, 19 nt, Homo sapiens
uuauacaaaauaagaacga

SEQ ID NO: 1887726 - RNA, 23 nt, Homo sapiens
ucucaggagcaggggcauugcug

SEQ ID NO: 1887727 - RNA, 12 nt, Homo sapiens
agacaggaugag

SEQ ID NO: 1887728 - RNA, 23 nt, Homo sapiens
agauugcguggaccccgacaaag

SEQ ID NO: 1887729 - RNA, 20 nt, Homo sapiens
cacuuaauacagauguauca

SEQ ID NO: 1887730 - RNA, 15 nt, Homo sapiens
aacuucccugauuga

SEQ ID NO: 1887731 - RNA, 23 nt, Homo sapiens
ccgggucugcuucugcauucaca

SEQ ID NO: 1887732 - RNA, 15 nt, Homo sapiens
aucaagucuguuuac

SEQ ID NO: 1887733 - RNA, 16 nt, Homo sapiens
augcuccagauuagag

SEQ ID NO: 1887734 - RNA, 21 nt, Homo sapiens
guggcugauauuaacugucaa

SEQ ID NO: 1887735 - RNA, 16 nt, Homo sapiens
acuggagcaugcagag

SEQ ID NO: 1887736 - RNA, 14 nt, Homo sapiens
ucuggaaauagccc

SEQ ID NO: 1887737 - RNA, 21 nt, Homo sapiens
ugugcauuaaaauuaaauacu

SEQ ID NO: 1887738 - RNA, 18 nt, Homo sapiens
gagaaauggcgaauguca

SEQ ID NO: 1887739 - RNA, 18 nt, Homo sapiens
gcaggacuaaaugucuag

SEQ ID NO: 1887740 - RNA, 22 nt, Homo sapiens
uaaacccaaauaaauguguaaa

SEQ ID NO: 1887741 - RNA, 23 nt, Homo sapiens
aaccaguauuuuugcugcuucug

SEQ ID NO: 1887742 - RNA, 22 nt, Homo sapiens
gucuagacuauuaggugcaauu

SEQ ID NO: 1887743 - RNA, 15 nt, Homo sapiens
augucuauguagcug

SEQ ID NO: 1887744 - RNA, 21 nt, Homo sapiens
ccuauaccuguguuucuugcc

SEQ ID NO: 1887745 - RNA, 14 nt, Homo sapiens
cuugucauguguau

SEQ ID NO: 1887746 - RNA, 18 nt, Homo sapiens
cugacccugcuccuagca

SEQ ID NO: 1887747 - RNA, 17 nt, Homo sapiens
cagaaccccuacaugaa

SEQ ID NO: 1887748 - RNA, 14 nt, Homo sapiens
aauuaaagggcaga

SEQ ID NO: 1887749 - RNA, 15 nt, Homo sapiens
auuuuuaugugcaau

SEQ ID NO: 1887750 - RNA, 19 nt, Homo sapiens
agacuacagcuggggugca

SEQ ID NO: 1887751 - RNA, 15 nt, Homo sapiens
auucacggccuggca

SEQ ID NO: 1887752 - RNA, 13 nt, Homo sapiens
uuucagguuuugu

SEQ ID NO: 1887753 - RNA, 12 nt, Homo sapiens
aaguuagucaau

SEQ ID NO: 1887754 - RNA, 16 nt, Homo sapiens
cugacaaugaagggaa

SEQ ID NO: 1887755 - RNA, 19 nt, Homo sapiens
gcuccucccgaaacccaag

SEQ ID NO: 1887756 - RNA, 22 nt, Homo sapiens
gaauugauugucagccaccucc

SEQ ID NO: 1887757 - RNA, 20 nt, Homo sapiens
ccauuucaguguauuguuua

SEQ ID NO: 1887758 - RNA, 17 nt, Homo sapiens
acuccacugucuuuaaa

SEQ ID NO: 1887759 - RNA, 16 nt, Homo sapiens
aauuaaacuuccaaag

SEQ ID NO: 1887760 - RNA, 14 nt, Homo sapiens
ccauuuuaucuuau

SEQ ID NO: 1887761 - RNA, 14 nt, Homo sapiens
caaguauauaugaa

SEQ ID NO: 1887762 - RNA, 22 nt, Homo sapiens
ugucccugugggugaaacagaa

SEQ ID NO: 1887763 - RNA, 17 nt, Homo sapiens
gaauaaaugaaucuuac

SEQ ID NO: 1887764 - RNA, 16 nt, Homo sapiens
uggcauuacaauugca

SEQ ID NO: 1887765 - RNA, 16 nt, Homo sapiens
acaccuauuaucccag

SEQ ID NO: 1887766 - RNA, 17 nt, Homo sapiens
cgccuccgcuacuucca

SEQ ID NO: 1887767 - RNA, 21 nt, Homo sapiens
aaagggccugcccagacaaga

SEQ ID NO: 1887768 - RNA, 17 nt, Homo sapiens
cagucuuccuugucucu

SEQ ID NO: 1887769 - RNA, 14 nt, Homo sapiens
ggcccuccaugaca

SEQ ID NO: 1887770 - RNA, 12 nt, Homo sapiens
aaaaaacuauuu

SEQ ID NO: 1887771 - RNA, 12 nt, Homo sapiens
uuuaaacuuaau

SEQ ID NO: 1887772 - RNA, 14 nt, Homo sapiens
ccucauuugcaagg

SEQ ID NO: 1887773 - RNA, 15 nt, Homo sapiens
uuuggauuguaucaa

SEQ ID NO: 1887774 - RNA, 18 nt, Homo sapiens
cccacagccgcagcugua

SEQ ID NO: 1887775 - RNA, 15 nt, Homo sapiens
guauauauauauagu

SEQ ID NO: 1887776 - RNA, 14 nt, Homo sapiens
aagcccgccuccag

SEQ ID NO: 1887777 - RNA, 12 nt, Homo sapiens
caaauucauccu

SEQ ID NO: 1887778 - RNA, 10 nt, Homo sapiens
cuucuuccaa

SEQ ID NO: 1887779 - RNA, 10 nt, Homo sapiens
caucuuccau

SEQ ID NO: 1887780 - RNA, 22 nt, Homo sapiens
acugccuagaaacaacacugua

SEQ ID NO: 1887781 - RNA, 23 nt, Homo sapiens
caugucuacugcuuggauccaua

SEQ ID NO: 1887782 - RNA, 20 nt, Homo sapiens
uuuaauuuuuuaaacuguag

SEQ ID NO: 1887783 - RNA, 12 nt, Homo sapiens
aucauucaucuu

SEQ ID NO: 1887784 - RNA, 23 nt, Homo sapiens
cugagaccaguugggagcacugg

SEQ ID NO: 1887785 - RNA, 17 nt, Homo sapiens
uguucacacacacaguu

SEQ ID NO: 1887786 - RNA, 11 nt, Homo sapiens
uguacaggaug

SEQ ID NO: 1887787 - RNA, 22 nt, Homo sapiens
aacugugacugcagugcuguaa

SEQ ID NO: 1887788 - RNA, 17 nt, Homo sapiens
gcucagaaaaucaaaga

SEQ ID NO: 1887789 - RNA, 21 nt, Homo sapiens
guggaaaaaucagaagcacaa

SEQ ID NO: 1887790 - RNA, 16 nt, Homo sapiens
caaauucagcucugau

SEQ ID NO: 1887791 - RNA, 19 nt, Homo sapiens
gugacuccugaaaccucuu

SEQ ID NO: 1887792 - RNA, 19 nt, Homo sapiens
aauacuggugcacuucuua

SEQ ID NO: 1887793 - RNA, 16 nt, Homo sapiens
ucugaggaauggacau

SEQ ID NO: 1887794 - RNA, 15 nt, Homo sapiens
accuguggugcaaaa

SEQ ID NO: 1887795 - RNA, 19 nt, Homo sapiens
ugucgcaugagaacauuaa

SEQ ID NO: 1887796 - RNA, 22 nt, Homo sapiens
gcagcaggucuagaagaacaac

SEQ ID NO: 1887797 - RNA, 14 nt, Homo sapiens
uuccuguaauauau

SEQ ID NO: 1887798 - RNA, 12 nt, Homo sapiens
uuccaccucacc

SEQ ID NO: 1887799 - RNA, 20 nt, Homo sapiens
ugcaauagugcaacaucucu

SEQ ID NO: 1887800 - RNA, 11 nt, Homo sapiens
uauacauacuu

SEQ ID NO: 1887801 - RNA, 15 nt, Homo sapiens
gaaaggacagcucag

SEQ ID NO: 1887802 - RNA, 15 nt, Homo sapiens
ugggacguggcucag

SEQ ID NO: 1887803 - RNA, 20 nt, Homo sapiens
auaaguucuuaugccauguu

SEQ ID NO: 1887804 - RNA, 19 nt, Homo sapiens
uucugaguuucaacacuag

SEQ ID NO: 1887805 - RNA, 17 nt, Homo sapiens
uagagugcaguggcaug

SEQ ID NO: 1887806 - RNA, 12 nt, Homo sapiens
caagagugucua

SEQ ID NO: 1887807 - RNA, 22 nt, Homo sapiens
cacacugcggugucugcagcuc

SEQ ID NO: 1887808 - RNA, 21 nt, Homo sapiens
gaaacuccacauccuguggga

SEQ ID NO: 1887809 - RNA, 20 nt, Homo sapiens
ucauuacaaaaaaacacgug

SEQ ID NO: 1887810 - RNA, 22 nt, Homo sapiens
cucuuacguggagagugcacug

SEQ ID NO: 1887811 - RNA, 18 nt, Homo sapiens
ccuucuccacacccacuu

SEQ ID NO: 1887812 - RNA, 18 nt, Homo sapiens
acuuaucaucacacaacu

SEQ ID NO: 1887813 - RNA, 13 nt, Homo sapiens
cucuauuucacaa

SEQ ID NO: 1887814 - RNA, 16 nt, Homo sapiens
ccccuccuugggcacu

SEQ ID NO: 1887815 - RNA, 16 nt, Homo sapiens
auuguacaauacuugc

SEQ ID NO: 1887816 - RNA, 15 nt, Homo sapiens
caauacaguuuauaa

SEQ ID NO: 1887817 - RNA, 15 nt, Homo sapiens
ugcugccagcacagu

SEQ ID NO: 1887818 - RNA, 15 nt, Homo sapiens
cucucuucucuccag

SEQ ID NO: 1887819 - RNA, 21 nt, Homo sapiens
cuggauuccucgaaacugcca

SEQ ID NO: 1887820 - RNA, 20 nt, Homo sapiens
ugguggacaugcacagcuaa

SEQ ID NO: 1887821 - RNA, 14 nt, Homo sapiens
agaugcagcauuuu

SEQ ID NO: 1887822 - RNA, 19 nt, Homo sapiens
ucacuaccuccucagggau

SEQ ID NO: 1887823 - RNA, 21 nt, Homo sapiens
aaguucccuucuauauccuca

SEQ ID NO: 1887824 - RNA, 18 nt, Homo sapiens
gaaugcuucuucucaggc

SEQ ID NO: 1887825 - RNA, 20 nt, Homo sapiens
uguuuaccucuucuaugcaa

SEQ ID NO: 1887826 - RNA, 17 nt, Homo sapiens
ccuugccugggauauca

SEQ ID NO: 1887827 - RNA, 15 nt, Homo sapiens
gucagucacagccac

SEQ ID NO: 1887828 - RNA, 17 nt, Homo sapiens
ucuguaucaguggauuu

SEQ ID NO: 1887829 - RNA, 17 nt, Homo sapiens
gcucacuuggugauaug

SEQ ID NO: 1887830 - RNA, 22 nt, Homo sapiens
gccaaggugggcggaucacuug

SEQ ID NO: 1887831 - RNA, 17 nt, Homo sapiens
agauucuauaguucuag

SEQ ID NO: 1887832 - RNA, 15 nt, Homo sapiens
agaaccacuuggcug

SEQ ID NO: 1887833 - RNA, 17 nt, Homo sapiens
aagcccaggaucucuuu

SEQ ID NO: 1887834 - RNA, 20 nt, Homo sapiens
accgccaugcaacuccaugc

SEQ ID NO: 1887835 - RNA, 15 nt, Homo sapiens
aaagacucugagaug

SEQ ID NO: 1887836 - RNA, 22 nt, Homo sapiens
gauaucacagaggccuauaacu

SEQ ID NO: 1887837 - RNA, 17 nt, Homo sapiens
aacuacuaaagugccua

SEQ ID NO: 1887838 - RNA, 22 nt, Homo sapiens
ggaacuagagggauacacugaa

SEQ ID NO: 1887839 - RNA, 21 nt, Homo sapiens
gcagauaucugcaugugucau

SEQ ID NO: 1887840 - RNA, 14 nt, Homo sapiens
aagacuugaugaau

SEQ ID NO: 1887841 - RNA, 20 nt, Homo sapiens
uuggagggcccacuuguauc

SEQ ID NO: 1887842 - RNA, 20 nt, Homo sapiens
caugaaccucaagcugcauc

SEQ ID NO: 1887843 - RNA, 14 nt, Homo sapiens
acccacaggacauu

SEQ ID NO: 1887844 - RNA, 16 nt, Homo sapiens
cuguucuguagcuuau

SEQ ID NO: 1887845 - RNA, 19 nt, Homo sapiens
agagccugagucacugguc

SEQ ID NO: 1887846 - RNA, 18 nt, Homo sapiens
acauauugauagaugcaa

SEQ ID NO: 1887847 - RNA, 16 nt, Homo sapiens
cugccugaagucacac

SEQ ID NO: 1887848 - RNA, 21 nt, Homo sapiens
cagaugcccacguaugugaaa

SEQ ID NO: 1887849 - RNA, 23 nt, Homo sapiens
cacauaagccaaaacugagcaua

SEQ ID NO: 1887850 - RNA, 19 nt, Homo sapiens
agcauaaaugggaacugau

SEQ ID NO: 1887851 - RNA, 14 nt, Homo sapiens
gcuuuacucauggc

SEQ ID NO: 1887852 - RNA, 17 nt, Homo sapiens
cuaugugugcuuauaca

SEQ ID NO: 1887853 - RNA, 15 nt, Homo sapiens
ucccugaacacucau

SEQ ID NO: 1887854 - RNA, 20 nt, Homo sapiens
gggagcuuuuguagaaguca

SEQ ID NO: 1887855 - RNA, 14 nt, Homo sapiens
acucaggccaguca

SEQ ID NO: 1887856 - RNA, 17 nt, Homo sapiens
ggaauuggaacuccuau

SEQ ID NO: 1887857 - RNA, 20 nt, Homo sapiens
cauuacugaggggauucucu

SEQ ID NO: 1887858 - RNA, 17 nt, Homo sapiens
ccccauccccaccagcu

SEQ ID NO: 1887859 - RNA, 20 nt, Homo sapiens
gcgcagcccgaagcccaguu

SEQ ID NO: 1887860 - RNA, 22 nt, Homo sapiens
gggcuccugcauccucacugug

SEQ ID NO: 1887861 - RNA, 18 nt, Homo sapiens
aaccuucaaguaugugcu

SEQ ID NO: 1887862 - RNA, 19 nt, Homo sapiens
uuaaccugccagggagaca

SEQ ID NO: 1887863 - RNA, 15 nt, Homo sapiens
acaagagaccacuuc

SEQ ID NO: 1887864 - RNA, 12 nt, Homo sapiens
gcuugccacuaa

SEQ ID NO: 1887865 - RNA, 22 nt, Homo sapiens
acagucaaaaccaagucacuua

SEQ ID NO: 1887866 - RNA, 16 nt, Homo sapiens
uccuccuucccaggga

SEQ ID NO: 1887867 - RNA, 15 nt, Homo sapiens
gcacuuuaacugacu

SEQ ID NO: 1887868 - RNA, 20 nt, Homo sapiens
auguuguuccaggaugugga

SEQ ID NO: 1887869 - RNA, 15 nt, Homo sapiens
caaccuuaccaaaaa

SEQ ID NO: 1887870 - RNA, 22 nt, Homo sapiens
cucaaaccugugcugaccaaag

SEQ ID NO: 1887871 - RNA, 21 nt, Homo sapiens
aggaaaacuaccuguauuuaa

SEQ ID NO: 1887872 - RNA, 14 nt, Homo sapiens
caacauuaacauug

SEQ ID NO: 1887873 - RNA, 15 nt, Homo sapiens
ucagccaaacuguag

SEQ ID NO: 1887874 - RNA, 18 nt, Homo sapiens
caugcaccuugcucccaa

SEQ ID NO: 1887875 - RNA, 13 nt, Homo sapiens
uucucuugccuca

SEQ ID NO: 1887876 - RNA, 22 nt, Homo sapiens
ggggcaauaguagaauggacaa

SEQ ID NO: 1887877 - RNA, 17 nt, Homo sapiens
cuuuuuacaucuauccc

SEQ ID NO: 1887878 - RNA, 14 nt, Homo sapiens
aauuucuggaagaa

SEQ ID NO: 1887879 - RNA, 15 nt, Homo sapiens
cauuuaauuuaguga

SEQ ID NO: 1887880 - RNA, 15 nt, Homo sapiens
ucuguugccauuaaa

SEQ ID NO: 1887881 - RNA, 16 nt, Homo sapiens
uccaaaugcccagcuu

SEQ ID NO: 1887882 - RNA, 16 nt, Homo sapiens
cacauuaauuagauuu

SEQ ID NO: 1887883 - RNA, 22 nt, Homo sapiens
ugcuugagcuuucugugcaugu

SEQ ID NO: 1887884 - RNA, 13 nt, Homo sapiens
auauacagaggaa

SEQ ID NO: 1887885 - RNA, 12 nt, Homo sapiens
caaaugguguga

SEQ ID NO: 1887886 - RNA, 19 nt, Homo sapiens
caaaaguagacugauuaca

SEQ ID NO: 1887887 - RNA, 16 nt, Homo sapiens
gcucacuggcuuuagc

SEQ ID NO: 1887888 - RNA, 21 nt, Homo sapiens
cacuuccauaugucauugcua

SEQ ID NO: 1887889 - RNA, 22 nt, Homo sapiens
uuaaguuacacauuuuucagau

SEQ ID NO: 1887890 - RNA, 17 nt, Homo sapiens
ucuuuauuaauguuuag

SEQ ID NO: 1887891 - RNA, 20 nt, Homo sapiens
cauuugggugaacuguggac

SEQ ID NO: 1887892 - RNA, 18 nt, Homo sapiens
agcugucucaaaccucca

SEQ ID NO: 1887893 - RNA, 13 nt, Homo sapiens
cuaaucucuacaa

SEQ ID NO: 1887894 - RNA, 13 nt, Homo sapiens
caaaucucuucaa

SEQ ID NO: 1887895 - RNA, 13 nt, Homo sapiens
ugugucugcaaca

SEQ ID NO: 1887896 - RNA, 15 nt, Homo sapiens
gaucgauuugcaccc

SEQ ID NO: 1887897 - RNA, 17 nt, Homo sapiens
agaauggaccacugaga

SEQ ID NO: 1887898 - RNA, 16 nt, Homo sapiens
gagagccaccaagagg

SEQ ID NO: 1887899 - RNA, 20 nt, Homo sapiens
gaauuuuauuuauaaaugag

SEQ ID NO: 1887900 - RNA, 18 nt, Homo sapiens
gaaugagguaggcacaaa

SEQ ID NO: 1887901 - RNA, 16 nt, Homo sapiens
gaaauagacaguauau

SEQ ID NO: 1887902 - RNA, 18 nt, Homo sapiens
acaguuaaagaagcaauc

SEQ ID NO: 1887903 - RNA, 19 nt, Homo sapiens
acaaaacuuauaauuucca

SEQ ID NO: 1887904 - RNA, 15 nt, Homo sapiens
cucagugucauuuau

SEQ ID NO: 1887905 - RNA, 12 nt, Homo sapiens
uuugcagucucu

SEQ ID NO: 1887906 - RNA, 11 nt, Homo sapiens
ucaucaugcuu

SEQ ID NO: 1887907 - RNA, 11 nt, Homo sapiens
cuuucauguca

SEQ ID NO: 1887908 - RNA, 20 nt, Homo sapiens
uaaguugcaccaacuuugaa

SEQ ID NO: 1887909 - RNA, 18 nt, Homo sapiens
guaacaucauaauuacau

SEQ ID NO: 1887910 - RNA, 19 nt, Homo sapiens
uccagacucagcagaguga

SEQ ID NO: 1887911 - RNA, 15 nt, Homo sapiens
gcuuggcaugaccuc

SEQ ID NO: 1887912 - RNA, 22 nt, Homo sapiens
auguccaauggaguucagagau

SEQ ID NO: 1887913 - RNA, 20 nt, Homo sapiens
aggaggcagcuguugcagug

SEQ ID NO: 1887914 - RNA, 20 nt, Homo sapiens
aaaaaaguaaguaccacuca

SEQ ID NO: 1887915 - RNA, 16 nt, Homo sapiens
cccuauccacccagcc

SEQ ID NO: 1887916 - RNA, 20 nt, Homo sapiens
uggcucccucacucucagga

SEQ ID NO: 1887917 - RNA, 14 nt, Homo sapiens
uauuaaagcaccaa

SEQ ID NO: 1887918 - RNA, 16 nt, Homo sapiens
ugggacagcaaccugu

SEQ ID NO: 1887919 - RNA, 18 nt, Homo sapiens
cagguccugagagcugcu

SEQ ID NO: 1887920 - RNA, 14 nt, Homo sapiens
ucaaggggcuggaa

SEQ ID NO: 1887921 - RNA, 14 nt, Homo sapiens
ucucaacauacugu

SEQ ID NO: 1887922 - RNA, 24 nt, Homo sapiens
gguuaacaaaugagccauccccag

SEQ ID NO: 1887923 - RNA, 22 nt, Homo sapiens
auugcacuaggaauucuuugca

SEQ ID NO: 1887924 - RNA, 20 nt, Homo sapiens
uuugaaucugaaucagccag

SEQ ID NO: 1887925 - RNA, 16 nt, Homo sapiens
cccugugggcucacac

SEQ ID NO: 1887926 - RNA, 19 nt, Homo sapiens
caaucaauggugcaaaaaa

SEQ ID NO: 1887927 - RNA, 21 nt, Homo sapiens
ucuuauuuuucuagucaguaa

SEQ ID NO: 1887928 - RNA, 22 nt, Homo sapiens
auucauucugagcccccuuccu

SEQ ID NO: 1887929 - RNA, 14 nt, Homo sapiens
aucccucuguucac

SEQ ID NO: 1887930 - RNA, 13 nt, Homo sapiens
cuacacuguauua

SEQ ID NO: 1887931 - RNA, 22 nt, Homo sapiens
aucuagcuucuucagagaucaa

SEQ ID NO: 1887932 - RNA, 19 nt, Homo sapiens
cuguuggaaguucacugga

SEQ ID NO: 1887933 - RNA, 18 nt, Homo sapiens
uuugccauccuaggcuua

SEQ ID NO: 1887934 - RNA, 15 nt, Homo sapiens
cugcccugcugugga

SEQ ID NO: 1887935 - RNA, 16 nt, Homo sapiens
ucucucguacucucuc

SEQ ID NO: 1887936 - RNA, 16 nt, Homo sapiens
gauacccagagcauua

SEQ ID NO: 1887937 - RNA, 12 nt, Homo sapiens
ugcaugugaaga

SEQ ID NO: 1887938 - RNA, 21 nt, Homo sapiens
aaaaucuuuguuacucuguaa

SEQ ID NO: 1887939 - RNA, 12 nt, Homo sapiens
uuccacuaugag

SEQ ID NO: 1887940 - RNA, 13 nt, Homo sapiens
uuuucaaaaccaa

SEQ ID NO: 1887941 - RNA, 13 nt, Homo sapiens
acuucaaauucaa

SEQ ID NO: 1887942 - RNA, 14 nt, Homo sapiens
ggacaaacugccag

SEQ ID NO: 1887943 - RNA, 21 nt, Homo sapiens
ggaggugggcaugccacccuc

SEQ ID NO: 1887944 - RNA, 15 nt, Homo sapiens
uuacacuccaggugu

SEQ ID NO: 1887945 - RNA, 13 nt, Homo sapiens
uucaaaauggaaa

SEQ ID NO: 1887946 - RNA, 13 nt, Homo sapiens
gaagguucuggua

SEQ ID NO: 1887947 - RNA, 18 nt, Homo sapiens
ugauggcuaugccuugca

SEQ ID NO: 1887948 - RNA, 14 nt, Homo sapiens
uccuagagugcagg

SEQ ID NO: 1887949 - RNA, 14 nt, Homo sapiens
accuacagagcagc

SEQ ID NO: 1887950 - RNA, 23 nt, Homo sapiens
auaccugauugaucacacagugu

SEQ ID NO: 1887951 - RNA, 22 nt, Homo sapiens
gcuuguguguaugucuaugugu

SEQ ID NO: 1887952 - RNA, 15 nt, Homo sapiens
gucuaggagcuccuu

SEQ ID NO: 1887953 - RNA, 15 nt, Homo sapiens
uccucugauuucagu

SEQ ID NO: 1887954 - RNA, 18 nt, Homo sapiens
cauuaaugcacaucugca

SEQ ID NO: 1887955 - RNA, 21 nt, Homo sapiens
acucagccucauucagcaugg

SEQ ID NO: 1887956 - RNA, 23 nt, Homo sapiens
uucucacacuggaggagcacaca

SEQ ID NO: 1887957 - RNA, 19 nt, Homo sapiens
uguaucguaaccagccaga

SEQ ID NO: 1887958 - RNA, 22 nt, Homo sapiens
cugcaccgacccgaggcccaga

SEQ ID NO: 1887959 - RNA, 18 nt, Homo sapiens
cauauauuuccacuucuu

SEQ ID NO: 1887960 - RNA, 14 nt, Homo sapiens
acauuugugcagaa

SEQ ID NO: 1887961 - RNA, 21 nt, Homo sapiens
uccuaagggucgaaagcucua

SEQ ID NO: 1887962 - RNA, 22 nt, Homo sapiens
ugccacacccugcucugggcac

SEQ ID NO: 1887963 - RNA, 20 nt, Homo sapiens
uaugguuauuuaugcacugu

SEQ ID NO: 1887964 - RNA, 18 nt, Homo sapiens
aaaaugaaacaacaaaac

SEQ ID NO: 1887965 - RNA, 23 nt, Homo sapiens
ugcauauguugaccuuugcaaaa

SEQ ID NO: 1887966 - RNA, 19 nt, Homo sapiens
cagagcaagcgcuguaaac

SEQ ID NO: 1887967 - RNA, 15 nt, Homo sapiens
uaaaggaugggacca

SEQ ID NO: 1887968 - RNA, 22 nt, Homo sapiens
ugaccauggaggccagugccag

SEQ ID NO: 1887969 - RNA, 13 nt, Homo sapiens
cagagcugccucc

SEQ ID NO: 1887970 - RNA, 23 nt, Homo sapiens
cagccgccagcugggagcacugg

SEQ ID NO: 1887971 - RNA, 17 nt, Homo sapiens
gcuuucagguguuacag

SEQ ID NO: 1887972 - RNA, 21 nt, Homo sapiens
acuacaaccaauggaauguga

SEQ ID NO: 1887973 - RNA, 12 nt, Homo sapiens
ucuuccaugacc

SEQ ID NO: 1887974 - RNA, 15 nt, Homo sapiens
ugcccggcugugauu

SEQ ID NO: 1887975 - RNA, 21 nt, Homo sapiens
auccagacucagagcucucuc

SEQ ID NO: 1887976 - RNA, 13 nt, Homo sapiens
ucugggucuacaa

SEQ ID NO: 1887977 - RNA, 15 nt, Homo sapiens
gcauggugaaaccuc

SEQ ID NO: 1887978 - RNA, 19 nt, Homo sapiens
acaagaagaccagacugug

SEQ ID NO: 1887979 - RNA, 19 nt, Homo sapiens
gaacuccugaccucaggug

SEQ ID NO: 1887980 - RNA, 21 nt, Homo sapiens
uuuaugguauuugagugugca

SEQ ID NO: 1887981 - RNA, 20 nt, Homo sapiens
gaaauagaagcaaaugacaa

SEQ ID NO: 1887982 - RNA, 18 nt, Homo sapiens
caauuagcauucugucuc

SEQ ID NO: 1887983 - RNA, 15 nt, Homo sapiens
agauauuuuugcaac

SEQ ID NO: 1887984 - RNA, 22 nt, Homo sapiens
cccuuacuuagcaugcacaaag

SEQ ID NO: 1887985 - RNA, 13 nt, Homo sapiens
cuccuucauuuca

SEQ ID NO: 1887986 - RNA, 19 nt, Homo sapiens
auuuugcccaaccuaaugc

SEQ ID NO: 1887987 - RNA, 17 nt, Homo sapiens
ugaaauaagcugugauu

SEQ ID NO: 1887988 - RNA, 14 nt, Homo sapiens
ccuagacugugcua

SEQ ID NO: 1887989 - RNA, 14 nt, Homo sapiens
ccucuucugugagu

SEQ ID NO: 1887990 - RNA, 20 nt, Homo sapiens
cagaccacugauaaaaccau

SEQ ID NO: 1887991 - RNA, 18 nt, Homo sapiens
guaaguuuaccuauguaa

SEQ ID NO: 1887992 - RNA, 16 nt, Homo sapiens
guuaagcagccuuucu

SEQ ID NO: 1887993 - RNA, 14 nt, Homo sapiens
uccaagcauuucau

SEQ ID NO: 1887994 - RNA, 12 nt, Homo sapiens
ucaaauguguca

SEQ ID NO: 1887995 - RNA, 22 nt, Homo sapiens
gaaugggagcauaugugagaaa

SEQ ID NO: 1887996 - RNA, 15 nt, Homo sapiens
cacacaccucucaag

SEQ ID NO: 1887997 - RNA, 13 nt, Homo sapiens
caaucccucaaaa

SEQ ID NO: 1887998 - RNA, 16 nt, Homo sapiens
uaacuuccaguaucau

SEQ ID NO: 1887999 - RNA, 20 nt, Homo sapiens
gaucugauaaggaucuagga

SEQ ID NO: 1888000 - RNA, 21 nt, Homo sapiens
uaaacucaaccuaacacauua

SEQ ID NO: 1888001 - RNA, 16 nt, Homo sapiens
uacacuauugcauugu

SEQ ID NO: 1888002 - RNA, 20 nt, Homo sapiens
aucugcaauguuuuugugua

SEQ ID NO: 1888003 - RNA, 17 nt, Homo sapiens
cuguacacacacagaca

SEQ ID NO: 1888004 - RNA, 21 nt, Homo sapiens
cugaagcguuuuucucaaagg

SEQ ID NO: 1888005 - RNA, 17 nt, Homo sapiens
uaccuguagacugugga

SEQ ID NO: 1888006 - RNA, 17 nt, Homo sapiens
uuuuguaagaaggcaau

SEQ ID NO: 1888007 - RNA, 22 nt, Homo sapiens
aaugcaaaagauacggcccaug

SEQ ID NO: 1888008 - RNA, 23 nt, Homo sapiens
auucauucuuuuugaaaugucaa

SEQ ID NO: 1888009 - RNA, 23 nt, Homo sapiens
aauuuuguguguaccugugacua

SEQ ID NO: 1888010 - RNA, 21 nt, Homo sapiens
ugcaagguauuacacucugua

SEQ ID NO: 1888011 - RNA, 17 nt, Homo sapiens
ucucuugccagcauuuu

SEQ ID NO: 1888012 - RNA, 17 nt, Homo sapiens
ccuucaccuuggauggu

SEQ ID NO: 1888013 - RNA, 16 nt, Homo sapiens
gugaacauaacuguaa

SEQ ID NO: 1888014 - RNA, 18 nt, Homo sapiens
agcugagaggaagaugaa

SEQ ID NO: 1888015 - RNA, 15 nt, Homo sapiens
ucucuggaguauucu

SEQ ID NO: 1888016 - RNA, 18 nt, Homo sapiens
ugcccaggcuggagugua

SEQ ID NO: 1888017 - RNA, 23 nt, Homo sapiens
cuaaauauaaaccagcuacuuga

SEQ ID NO: 1888018 - RNA, 18 nt, Homo sapiens
cugggaaggugaccacau

SEQ ID NO: 1888019 - RNA, 22 nt, Homo sapiens
gacuauggaaugucaguguuca

SEQ ID NO: 1888020 - RNA, 17 nt, Homo sapiens
uggauuggucugagggg

SEQ ID NO: 1888021 - RNA, 15 nt, Homo sapiens
ucccuaaauuugcau

SEQ ID NO: 1888022 - RNA, 21 nt, Homo sapiens
auagauggauuuguaucaaua

SEQ ID NO: 1888023 - RNA, 20 nt, Homo sapiens
accuguagacuguggaacua

SEQ ID NO: 1888024 - RNA, 18 nt, Homo sapiens
ccagcucauacaaaauaa

SEQ ID NO: 1888025 - RNA, 20 nt, Homo sapiens
cuucacauuuagaauuugaa

SEQ ID NO: 1888026 - RNA, 22 nt, Homo sapiens
caaugacaugaauuuuagcuuu

SEQ ID NO: 1888027 - RNA, 21 nt, Homo sapiens
uagcaucuguaacagcauuaa

SEQ ID NO: 1888028 - RNA, 22 nt, Homo sapiens
ugcacuuucaggaacacucuga

SEQ ID NO: 1888029 - RNA, 13 nt, Homo sapiens
aauucugugaaga

SEQ ID NO: 1888030 - RNA, 16 nt, Homo sapiens
gagcaagaacauucaa

SEQ ID NO: 1888031 - RNA, 18 nt, Homo sapiens
ugaaaccuacacacuguc

SEQ ID NO: 1888032 - RNA, 17 nt, Homo sapiens
ucugaaucucccaagga

SEQ ID NO: 1888033 - RNA, 17 nt, Homo sapiens
agugugggcuugaccag

SEQ ID NO: 1888034 - RNA, 23 nt, Homo sapiens
cccuuggucuuuucuugccuuuu

SEQ ID NO: 1888035 - RNA, 14 nt, Homo sapiens
aaggaaacuccuga

SEQ ID NO: 1888036 - RNA, 14 nt, Homo sapiens
augaacucuuucaa

SEQ ID NO: 1888037 - RNA, 16 nt, Homo sapiens
ccuucuuacaaugcau

SEQ ID NO: 1888038 - RNA, 12 nt, Homo sapiens
cuguaucccuac

SEQ ID NO: 1888039 - RNA, 15 nt, Homo sapiens
auaaaguuugcuaag

SEQ ID NO: 1888040 - RNA, 13 nt, Homo sapiens
cugcccacuccca

SEQ ID NO: 1888041 - RNA, 23 nt, Homo sapiens
uccaggaagguagcccagcacug

SEQ ID NO: 1888042 - RNA, 22 nt, Homo sapiens
aauaggaguggguauuaugcaa

SEQ ID NO: 1888043 - RNA, 13 nt, Homo sapiens
gguucaugccauu

SEQ ID NO: 1888044 - RNA, 16 nt, Homo sapiens
cagaacuugaaggguu

SEQ ID NO: 1888045 - RNA, 11 nt, Homo sapiens
ucuuaucauuu

SEQ ID NO: 1888046 - RNA, 16 nt, Homo sapiens
cucucaccugcuccca

SEQ ID NO: 1888047 - RNA, 14 nt, Homo sapiens
ugcuuccaacaagg

SEQ ID NO: 1888048 - RNA, 19 nt, Homo sapiens
ggcuccaucuccaguggga

SEQ ID NO: 1888049 - RNA, 23 nt, Homo sapiens
ggagcacugcguuuuccuagcug

SEQ ID NO: 1888050 - RNA, 14 nt, Homo sapiens
aggaggccguggcu

SEQ ID NO: 1888051 - RNA, 23 nt, Homo sapiens
aggagcgcuagugccuugcccac

SEQ ID NO: 1888052 - RNA, 14 nt, Homo sapiens
aucaggccaacccc

SEQ ID NO: 1888053 - RNA, 13 nt, Homo sapiens
cucaagugccuua

SEQ ID NO: 1888054 - RNA, 19 nt, Homo sapiens
acuucccaacucacuuugu

SEQ ID NO: 1888055 - RNA, 19 nt, Homo sapiens
cauuggagacaucacuugc

SEQ ID NO: 1888056 - RNA, 11 nt, Homo sapiens
gcacacuuuac

SEQ ID NO: 1888057 - RNA, 15 nt, Homo sapiens
acuauuuuaccugaa

SEQ ID NO: 1888058 - RNA, 21 nt, Homo sapiens
gccaaguggcauuacauugag

SEQ ID NO: 1888059 - RNA, 17 nt, Homo sapiens
ucccccguggugccugc

SEQ ID NO: 1888060 - RNA, 14 nt, Homo sapiens
gaauaaacaaaauu

SEQ ID NO: 1888061 - RNA, 13 nt, Homo sapiens
gccaccagggagc

SEQ ID NO: 1888062 - RNA, 18 nt, Homo sapiens
cucacacuuggagcuaau

SEQ ID NO: 1888063 - RNA, 15 nt, Homo sapiens
uguuugaacagggca

SEQ ID NO: 1888064 - RNA, 18 nt, Homo sapiens
caucuuucacuaucugua

SEQ ID NO: 1888065 - RNA, 20 nt, Homo sapiens
cuaggcuaccucaagacuca

SEQ ID NO: 1888066 - RNA, 16 nt, Homo sapiens
aauuaugguaguuauu

SEQ ID NO: 1888067 - RNA, 15 nt, Homo sapiens
aggaagucaccaaaa

SEQ ID NO: 1888068 - RNA, 17 nt, Homo sapiens
aguuuuacuaaaacacu

SEQ ID NO: 1888069 - RNA, 22 nt, Homo sapiens
uuauugcaagcauugacuauaa

SEQ ID NO: 1888070 - RNA, 19 nt, Homo sapiens
cggccucccucccccugca

SEQ ID NO: 1888071 - RNA, 21 nt, Homo sapiens
cagauguugaauucuuuugcc

SEQ ID NO: 1888072 - RNA, 21 nt, Homo sapiens
caacagaugaguccauuugaa

SEQ ID NO: 1888073 - RNA, 19 nt, Homo sapiens
uugaguacagauacuguga

SEQ ID NO: 1888074 - RNA, 13 nt, Homo sapiens
ugucaacacaaag

SEQ ID NO: 1888075 - RNA, 17 nt, Homo sapiens
cccagggaagccaaaag

SEQ ID NO: 1888076 - RNA, 15 nt, Homo sapiens
ccuucagcagcuacu

SEQ ID NO: 1888077 - RNA, 13 nt, Homo sapiens
gauguauguguau

SEQ ID NO: 1888078 - RNA, 18 nt, Homo sapiens
gcccaugguacuccaugc

SEQ ID NO: 1888079 - RNA, 12 nt, Homo sapiens
aguacaggugaa

SEQ ID NO: 1888080 - RNA, 20 nt, Homo sapiens
uccuguaagcaacacuuuaa

SEQ ID NO: 1888081 - RNA, 19 nt, Homo sapiens
uucaaacaauucaaucaaa

SEQ ID NO: 1888082 - RNA, 17 nt, Homo sapiens
aucuacccagucaugua

SEQ ID NO: 1888083 - RNA, 20 nt, Homo sapiens
ucuuaccagugugaccacac

SEQ ID NO: 1888084 - RNA, 16 nt, Homo sapiens
acagaacaugcuguua

SEQ ID NO: 1888085 - RNA, 19 nt, Homo sapiens
cugaaaauggagaaagcca

SEQ ID NO: 1888086 - RNA, 13 nt, Homo sapiens
guuacucucaggc

SEQ ID NO: 1888087 - RNA, 14 nt, Homo sapiens
aagcugucagggac

SEQ ID NO: 1888088 - RNA, 18 nt, Homo sapiens
uauuacagaaauucugaa

SEQ ID NO: 1888089 - RNA, 21 nt, Homo sapiens
cuaguccuuggcuggacugua

SEQ ID NO: 1888090 - RNA, 20 nt, Homo sapiens
auguauuggauacgcuccag

SEQ ID NO: 1888091 - RNA, 20 nt, Homo sapiens
uugacaaaggagcauugcag

SEQ ID NO: 1888092 - RNA, 15 nt, Homo sapiens
ccaggcccugcucau

SEQ ID NO: 1888093 - RNA, 12 nt, Homo sapiens
gcaaaagucauu

SEQ ID NO: 1888094 - RNA, 15 nt, Homo sapiens
gacaauacaaauaca

SEQ ID NO: 1888095 - RNA, 20 nt, Homo sapiens
caaaacucagagaaaugugu

SEQ ID NO: 1888096 - RNA, 15 nt, Homo sapiens
aauuuaaauagcuuu

SEQ ID NO: 1888097 - RNA, 13 nt, Homo sapiens
uuccuuucauuua

SEQ ID NO: 1888098 - RNA, 14 nt, Homo sapiens
auucuggugucuaa

SEQ ID NO: 1888099 - RNA, 17 nt, Homo sapiens
gaucuggcuuacagggg

SEQ ID NO: 1888100 - RNA, 13 nt, Homo sapiens
uuucuuuuugcca

SEQ ID NO: 1888101 - RNA, 18 nt, Homo sapiens
ccagacucucacaugcag

SEQ ID NO: 1888102 - RNA, 22 nt, Homo sapiens
cacggugggcugaguacaguca

SEQ ID NO: 1888103 - RNA, 13 nt, Homo sapiens
cuaccagagcucu

SEQ ID NO: 1888104 - RNA, 20 nt, Homo sapiens
aacuacuauuuuucuuucca

SEQ ID NO: 1888105 - RNA, 17 nt, Homo sapiens
aauccccuaucccauuc

SEQ ID NO: 1888106 - RNA, 11 nt, Homo sapiens
gagacuguaaa

SEQ ID NO: 1888107 - RNA, 16 nt, Homo sapiens
aacuguagaugaugua

SEQ ID NO: 1888108 - RNA, 12 nt, Homo sapiens
aggucggcacuu

SEQ ID NO: 1888109 - RNA, 23 nt, Homo sapiens
aucccagcuggccuguaauccca

SEQ ID NO: 1888110 - RNA, 22 nt, Homo sapiens
ccuuggggccacugccugaggc

SEQ ID NO: 1888111 - RNA, 14 nt, Homo sapiens
cuuaauucaaauaa

SEQ ID NO: 1888112 - RNA, 14 nt, Homo sapiens
caaacuucauuuca

SEQ ID NO: 1888113 - RNA, 15 nt, Homo sapiens
uugcagaugacaaaa

SEQ ID NO: 1888114 - RNA, 13 nt, Homo sapiens
agcagacaugcca

SEQ ID NO: 1888115 - RNA, 14 nt, Homo sapiens
cccuugugucuguu

SEQ ID NO: 1888116 - RNA, 21 nt, Homo sapiens
cuccucuaguaagaugcacug

SEQ ID NO: 1888117 - RNA, 12 nt, Homo sapiens
guggacgaggga

SEQ ID NO: 1888118 - RNA, 18 nt, Homo sapiens
ggccugaaaugaucaaau

SEQ ID NO: 1888119 - RNA, 20 nt, Homo sapiens
augcuucaguuguacuucca

SEQ ID NO: 1888120 - RNA, 13 nt, Homo sapiens
accauuacuguaa

SEQ ID NO: 1888121 - RNA, 18 nt, Homo sapiens
aaauaaaguuuuuauucu

SEQ ID NO: 1888122 - RNA, 20 nt, Homo sapiens
aagugggacauucaaaaaac

SEQ ID NO: 1888123 - RNA, 17 nt, Homo sapiens
ucagcacucuguaaaac

SEQ ID NO: 1888124 - RNA, 19 nt, Homo sapiens
cucuggccacugcugcaga

SEQ ID NO: 1888125 - RNA, 15 nt, Homo sapiens
ccauauggucaucca

SEQ ID NO: 1888126 - RNA, 12 nt, Homo sapiens
uagaaccaguga

SEQ ID NO: 1888127 - RNA, 21 nt, Homo sapiens
aaagggaaggugacugaaggc

SEQ ID NO: 1888128 - RNA, 17 nt, Homo sapiens
uaauuuccucacugccu

SEQ ID NO: 1888129 - RNA, 15 nt, Homo sapiens
uuaugauauucuauc

SEQ ID NO: 1888130 - RNA, 20 nt, Homo sapiens
gugcaguggcaugaugucaa

SEQ ID NO: 1888131 - RNA, 15 nt, Homo sapiens
ccugagacucccgcc

SEQ ID NO: 1888132 - RNA, 14 nt, Homo sapiens
gucugggugucuca

SEQ ID NO: 1888133 - RNA, 17 nt, Homo sapiens
ucaaccagauaacauac

SEQ ID NO: 1888134 - RNA, 23 nt, Homo sapiens
uauccaugaucacacagcuaaua

SEQ ID NO: 1888135 - RNA, 21 nt, Homo sapiens
gucauuucauuccauugccua

SEQ ID NO: 1888136 - RNA, 20 nt, Homo sapiens
aauuuuauuccagacaguca

SEQ ID NO: 1888137 - RNA, 22 nt, Homo sapiens
augcuacaaaaaaguagcaaaa

SEQ ID NO: 1888138 - RNA, 20 nt, Homo sapiens
cuuccuuaugcuucuuucaa

SEQ ID NO: 1888139 - RNA, 15 nt, Homo sapiens
cuaggguucaugucu

SEQ ID NO: 1888140 - RNA, 16 nt, Homo sapiens
cggccccaucucucau

SEQ ID NO: 1888141 - RNA, 12 nt, Homo sapiens
acuuuagcauug

SEQ ID NO: 1888142 - RNA, 15 nt, Homo sapiens
aagaaguuuuguucc

SEQ ID NO: 1888143 - RNA, 19 nt, Homo sapiens
ugaaggcgggccugcaagc

SEQ ID NO: 1888144 - RNA, 13 nt, Homo sapiens
caacuccauucuc

SEQ ID NO: 1888145 - RNA, 22 nt, Homo sapiens
cacauauggacucugcacauga

SEQ ID NO: 1888146 - RNA, 14 nt, Homo sapiens
ucagcuccuuccac

SEQ ID NO: 1888147 - RNA, 15 nt, Homo sapiens
guuuuucuugcaugg

SEQ ID NO: 1888148 - RNA, 15 nt, Homo sapiens
cuuaucccaagagaa

SEQ ID NO: 1888149 - RNA, 21 nt, Homo sapiens
ggaaguaagggagucauugcc

SEQ ID NO: 1888150 - RNA, 18 nt, Homo sapiens
gguccucuagcccacucc

SEQ ID NO: 1888151 - RNA, 17 nt, Homo sapiens
cucaguuucacuuucac

SEQ ID NO: 1888152 - RNA, 22 nt, Homo sapiens
gucagcuguaacccucacccac

SEQ ID NO: 1888153 - RNA, 15 nt, Homo sapiens
caagugcuacucuca

SEQ ID NO: 1888154 - RNA, 23 nt, Homo sapiens
uccaugacugcauuuuacuguac

SEQ ID NO: 1888155 - RNA, 15 nt, Homo sapiens
ugcugauguccucac

SEQ ID NO: 1888156 - RNA, 14 nt, Homo sapiens
acaagcauauuuga

SEQ ID NO: 1888157 - RNA, 21 nt, Homo sapiens
gagaaguuuguagccagguac

SEQ ID NO: 1888158 - RNA, 17 nt, Homo sapiens
gcucugaccgaaacagc

SEQ ID NO: 1888159 - RNA, 19 nt, Homo sapiens
cuaaaauaaaaaccagaau

SEQ ID NO: 1888160 - RNA, 13 nt, Homo sapiens
gagucacugaccc

SEQ ID NO: 1888161 - RNA, 19 nt, Homo sapiens
aggugggaucacuaaggga

SEQ ID NO: 1888162 - RNA, 23 nt, Homo sapiens
cuccugugucuguguauauuaca

SEQ ID NO: 1888163 - RNA, 16 nt, Homo sapiens
ccugucuuucagcauu

SEQ ID NO: 1888164 - RNA, 24 nt, Homo sapiens
ugauucuauaaaacacaucaucaa

SEQ ID NO: 1888165 - RNA, 18 nt, Homo sapiens
uugaugccaguaggcuca

SEQ ID NO: 1888166 - RNA, 19 nt, Homo sapiens
auugcuugcacaaaccaau

SEQ ID NO: 1888167 - RNA, 16 nt, Homo sapiens
ugugagcacaaugcau

SEQ ID NO: 1888168 - RNA, 16 nt, Homo sapiens
cuagucucccucacag

SEQ ID NO: 1888169 - RNA, 17 nt, Homo sapiens
caggagcaggcacgggu

SEQ ID NO: 1888170 - RNA, 17 nt, Homo sapiens
ugaaccguuacaaaaga

SEQ ID NO: 1888171 - RNA, 19 nt, Homo sapiens
gaacccugccaggcugcua

SEQ ID NO: 1888172 - RNA, 18 nt, Homo sapiens
uccugugcuggacuguuu

SEQ ID NO: 1888173 - RNA, 22 nt, Homo sapiens
ugugggugggaccacagacuca

SEQ ID NO: 1888174 - RNA, 21 nt, Homo sapiens
caggggcuugaacaacacuac

SEQ ID NO: 1888175 - RNA, 20 nt, Homo sapiens
caagagaaaugauguuguca

SEQ ID NO: 1888176 - RNA, 13 nt, Homo sapiens
agacuaauugugu

SEQ ID NO: 1888177 - RNA, 18 nt, Homo sapiens
gcucugcuucuccaagga

SEQ ID NO: 1888178 - RNA, 20 nt, Homo sapiens
aagacaaaauaaacauuuua

SEQ ID NO: 1888179 - RNA, 14 nt, Homo sapiens
cuggcuugcuccua

SEQ ID NO: 1888180 - RNA, 15 nt, Homo sapiens
augaaugaguaggaa

SEQ ID NO: 1888181 - RNA, 16 nt, Homo sapiens
aaacuaagagcucuca

SEQ ID NO: 1888182 - RNA, 17 nt, Homo sapiens
aguugaacacugucauc

SEQ ID NO: 1888183 - RNA, 15 nt, Homo sapiens
uccuuacuugcacug

SEQ ID NO: 1888184 - RNA, 15 nt, Homo sapiens
uaaauuuauauucau

SEQ ID NO: 1888185 - RNA, 13 nt, Homo sapiens
aaccuuucuuucu

SEQ ID NO: 1888186 - RNA, 13 nt, Homo sapiens
ggccaguugccca

SEQ ID NO: 1888187 - RNA, 16 nt, Homo sapiens
ugcacagugacuucug

SEQ ID NO: 1888188 - RNA, 20 nt, Homo sapiens
aaacacacagucacauucga

SEQ ID NO: 1888189 - RNA, 19 nt, Homo sapiens
ccaaaggagaagaguguaa

SEQ ID NO: 1888190 - RNA, 15 nt, Homo sapiens
auaaaugaaaaucua

SEQ ID NO: 1888191 - RNA, 22 nt, Homo sapiens
ggagaaagcagccauuggcacu

SEQ ID NO: 1888192 - RNA, 20 nt, Homo sapiens
uaaaugggucaugacaagau

SEQ ID NO: 1888193 - RNA, 18 nt, Homo sapiens
caugugccgaaugugcag

SEQ ID NO: 1888194 - RNA, 17 nt, Homo sapiens
agagcaagacccaucuc

SEQ ID NO: 1888195 - RNA, 20 nt, Homo sapiens
gccccugucgucaggaccuc

SEQ ID NO: 1888196 - RNA, 17 nt, Homo sapiens
aaaguauuuauuguaca

SEQ ID NO: 1888197 - RNA, 13 nt, Homo sapiens
cuugaauuucaaa

SEQ ID NO: 1888198 - RNA, 15 nt, Homo sapiens
cugaccugaccccau

SEQ ID NO: 1888199 - RNA, 14 nt, Homo sapiens
ggaaauuagucuuu

SEQ ID NO: 1888200 - RNA, 15 nt, Homo sapiens
agcauucagaacuuc

SEQ ID NO: 1888201 - RNA, 22 nt, Homo sapiens
ucacgauuccuucccacgguca

SEQ ID NO: 1888202 - RNA, 16 nt, Homo sapiens
aaaaguauuauucucu

SEQ ID NO: 1888203 - RNA, 23 nt, Homo sapiens
gaacugcuuuuccucaagcaaua

SEQ ID NO: 1888204 - RNA, 19 nt, Homo sapiens
uaaucuguugacagugcca

SEQ ID NO: 1888205 - RNA, 12 nt, Homo sapiens
uuuuccuagucu

SEQ ID NO: 1888206 - RNA, 18 nt, Homo sapiens
agggcauccaacugagaa

SEQ ID NO: 1888207 - RNA, 18 nt, Homo sapiens
uucccgggcuguccacua

SEQ ID NO: 1888208 - RNA, 17 nt, Homo sapiens
acaugcauuacugcaug

SEQ ID NO: 1888209 - RNA, 22 nt, Homo sapiens
ucagcccuguguauaaagccau

SEQ ID NO: 1888210 - RNA, 19 nt, Homo sapiens
cuugguggcaggcagagaa

SEQ ID NO: 1888211 - RNA, 16 nt, Homo sapiens
gaaaaucgaccacagu

SEQ ID NO: 1888212 - RNA, 22 nt, Homo sapiens
aauugaugaaaugcaaaaggaa

SEQ ID NO: 1888213 - RNA, 22 nt, Homo sapiens
cucaaaaggcccuagcuaauaa

SEQ ID NO: 1888214 - RNA, 13 nt, Homo sapiens
cuuccuucuuacu

SEQ ID NO: 1888215 - RNA, 18 nt, Homo sapiens
uuugaaaugaauuccuca

SEQ ID NO: 1888216 - RNA, 13 nt, Homo sapiens
gaggccacuguuu

SEQ ID NO: 1888217 - RNA, 22 nt, Homo sapiens
cacugccccacguugucccuga

SEQ ID NO: 1888218 - RNA, 21 nt, Homo sapiens
acaaagcccauagcacugggc

SEQ ID NO: 1888219 - RNA, 14 nt, Homo sapiens
auaaaguaccacac

SEQ ID NO: 1888220 - RNA, 15 nt, Homo sapiens
aaccugauuacaagu

SEQ ID NO: 1888221 - RNA, 16 nt, Homo sapiens
augugucaacugagag

SEQ ID NO: 1888222 - RNA, 22 nt, Homo sapiens
agcagaggaggggaaaguccag

SEQ ID NO: 1888223 - RNA, 20 nt, Homo sapiens
acuucaaaaggaaugaacuu

SEQ ID NO: 1888224 - RNA, 22 nt, Homo sapiens
guauuaaccuaccugugaauca

SEQ ID NO: 1888225 - RNA, 18 nt, Homo sapiens
auauuuauuuuuugccau

SEQ ID NO: 1888226 - RNA, 17 nt, Homo sapiens
gcuguauuuaauggcau

SEQ ID NO: 1888227 - RNA, 14 nt, Homo sapiens
gaacaagacccugu

SEQ ID NO: 1888228 - RNA, 19 nt, Homo sapiens
cccagcuaacuaaugccau

SEQ ID NO: 1888229 - RNA, 22 nt, Homo sapiens
uuucccuuccugggucuaccac

SEQ ID NO: 1888230 - RNA, 21 nt, Homo sapiens
guaaaaguucuuuuugcucua

SEQ ID NO: 1888231 - RNA, 18 nt, Homo sapiens
auuguggguaacgugaga

SEQ ID NO: 1888232 - RNA, 15 nt, Homo sapiens
agcacguggagcucu

SEQ ID NO: 1888233 - RNA, 12 nt, Homo sapiens
ggcccagugcau

SEQ ID NO: 1888234 - RNA, 13 nt, Homo sapiens
ccaaaauggucuc

SEQ ID NO: 1888235 - RNA, 20 nt, Homo sapiens
uguaucauuuuugugcacag

SEQ ID NO: 1888236 - RNA, 21 nt, Homo sapiens
uacauuuugaaggugaugcau

SEQ ID NO: 1888237 - RNA, 23 nt, Homo sapiens
ugcuccccaggccaccccgcuga

SEQ ID NO: 1888238 - RNA, 17 nt, Homo sapiens
gaaacuuauucgcaaua

SEQ ID NO: 1888239 - RNA, 13 nt, Homo sapiens
auaucuagucacu

SEQ ID NO: 1888240 - RNA, 21 nt, Homo sapiens
augugugugguggugacucau

SEQ ID NO: 1888241 - RNA, 22 nt, Homo sapiens
accagaaggggauggacuucau

SEQ ID NO: 1888242 - RNA, 13 nt, Homo sapiens
accucaccaagga

SEQ ID NO: 1888243 - RNA, 17 nt, Homo sapiens
gucaucaaagaugacuu

SEQ ID NO: 1888244 - RNA, 12 nt, Homo sapiens
aaaaaaauggag

SEQ ID NO: 1888245 - RNA, 12 nt, Homo sapiens
aaagaaauggaa

SEQ ID NO: 1888246 - RNA, 13 nt, Homo sapiens
aaauaaaccuccu

SEQ ID NO: 1888247 - RNA, 17 nt, Homo sapiens
ugauccacuucucucag

SEQ ID NO: 1888248 - RNA, 21 nt, Homo sapiens
aggcagggaagcucuaccgca

SEQ ID NO: 1888249 - RNA, 19 nt, Homo sapiens
ugcuucucucagccagcug

SEQ ID NO: 1888250 - RNA, 20 nt, Homo sapiens
gccaucgcaagucacagaaa

SEQ ID NO: 1888251 - RNA, 15 nt, Homo sapiens
gacauguuucacaac

SEQ ID NO: 1888252 - RNA, 13 nt, Homo sapiens
aaacuucaucaca

SEQ ID NO: 1888253 - RNA, 16 nt, Homo sapiens
guccagcucguucucu

SEQ ID NO: 1888254 - RNA, 22 nt, Homo sapiens
uagauccauuuggacaaaaugg

SEQ ID NO: 1888255 - RNA, 14 nt, Homo sapiens
ccaucgaagcagau

SEQ ID NO: 1888256 - RNA, 14 nt, Homo sapiens
ugcacuguccugcu

SEQ ID NO: 1888257 - RNA, 18 nt, Homo sapiens
ucagaggugaaugcacag

SEQ ID NO: 1888258 - RNA, 19 nt, Homo sapiens
guuagauauuaggucccau

SEQ ID NO: 1888259 - RNA, 16 nt, Homo sapiens
cuucccaccucagugc

SEQ ID NO: 1888260 - RNA, 16 nt, Homo sapiens
aggcuuccagucucac

SEQ ID NO: 1888261 - RNA, 21 nt, Homo sapiens
uauugagauaauuuauuuaau

SEQ ID NO: 1888262 - RNA, 20 nt, Homo sapiens
cuacuggucuguacuccuug

SEQ ID NO: 1888263 - RNA, 17 nt, Homo sapiens
acccaaguuaugcaucc

SEQ ID NO: 1888264 - RNA, 19 nt, Homo sapiens
gaguggggccuuugccagc

SEQ ID NO: 1888265 - RNA, 20 nt, Homo sapiens
ccuauaauggguccccaaaa

SEQ ID NO: 1888266 - RNA, 22 nt, Homo sapiens
gucuacauugagcauuugaaag

SEQ ID NO: 1888267 - RNA, 16 nt, Homo sapiens
ccugcuugcacuuugu

SEQ ID NO: 1888268 - RNA, 22 nt, Homo sapiens
cacucuuuauagugcacaaaau

SEQ ID NO: 1888269 - RNA, 20 nt, Homo sapiens
agcuaaguacacaauaagca

SEQ ID NO: 1888270 - RNA, 19 nt, Homo sapiens
auauauucaguaaugaaga

SEQ ID NO: 1888271 - RNA, 12 nt, Homo sapiens
gcagagcacagc

SEQ ID NO: 1888272 - RNA, 15 nt, Homo sapiens
cuugcugucaaggaa

SEQ ID NO: 1888273 - RNA, 13 nt, Homo sapiens
ggacugugccugg

SEQ ID NO: 1888274 - RNA, 14 nt, Homo sapiens
aagccaccagugag

SEQ ID NO: 1888275 - RNA, 19 nt, Homo sapiens
aucugccaaugccaugacu

SEQ ID NO: 1888276 - RNA, 23 nt, Homo sapiens
cugucauucgcucccacauucug

SEQ ID NO: 1888277 - RNA, 13 nt, Homo sapiens
uuucuugccucau

SEQ ID NO: 1888278 - RNA, 13 nt, Homo sapiens
uucacugccuucc

SEQ ID NO: 1888279 - RNA, 16 nt, Homo sapiens
caagacugucuuaccu

SEQ ID NO: 1888280 - RNA, 18 nt, Homo sapiens
guuucaguugacaaaaua

SEQ ID NO: 1888281 - RNA, 12 nt, Homo sapiens
uucuuucugucc

SEQ ID NO: 1888282 - RNA, 20 nt, Homo sapiens
guuaaaaguuguguuuugaa

SEQ ID NO: 1888283 - RNA, 13 nt, Homo sapiens
uuuccugacaggg

SEQ ID NO: 1888284 - RNA, 18 nt, Homo sapiens
uuccucccauuucccauu

SEQ ID NO: 1888285 - RNA, 15 nt, Homo sapiens
cauucaucucucaaa

SEQ ID NO: 1888286 - RNA, 15 nt, Homo sapiens
ccacccacuaauacu

SEQ ID NO: 1888287 - RNA, 16 nt, Homo sapiens
auuccugugcggacag

SEQ ID NO: 1888288 - RNA, 13 nt, Homo sapiens
agggaaaggggag

SEQ ID NO: 1888289 - RNA, 15 nt, Homo sapiens
cacuggccggaguca

SEQ ID NO: 1888290 - RNA, 21 nt, Homo sapiens
ugaauuuaucagcguauuuca

SEQ ID NO: 1888291 - RNA, 20 nt, Homo sapiens
ccuggauuuuuaccagucuc

SEQ ID NO: 1888292 - RNA, 15 nt, Homo sapiens
uaacuggccagccau

SEQ ID NO: 1888293 - RNA, 13 nt, Homo sapiens
cuauuaucucaau

SEQ ID NO: 1888294 - RNA, 17 nt, Homo sapiens
uaagaauaguucuaaaa

SEQ ID NO: 1888295 - RNA, 23 nt, Homo sapiens
uccuagguauuuacccaagagaa

SEQ ID NO: 1888296 - RNA, 14 nt, Homo sapiens
gccucaagaucaau

SEQ ID NO: 1888297 - RNA, 15 nt, Homo sapiens
caaaugacaaaaagc

SEQ ID NO: 1888298 - RNA, 22 nt, Homo sapiens
gacugaucgauuugcacccacc

SEQ ID NO: 1888299 - RNA, 19 nt, Homo sapiens
aacuguucuuugcagugaa

SEQ ID NO: 1888300 - RNA, 22 nt, Homo sapiens
uagacucacggcugcaccugca

SEQ ID NO: 1888301 - RNA, 18 nt, Homo sapiens
cucauuaccuugugcuaa

SEQ ID NO: 1888302 - RNA, 14 nt, Homo sapiens
ccauaaagccuuua

SEQ ID NO: 1888303 - RNA, 15 nt, Homo sapiens
gauaucacuuacuca

SEQ ID NO: 1888304 - RNA, 12 nt, Homo sapiens
ucauaccacaau

SEQ ID NO: 1888305 - RNA, 15 nt, Homo sapiens
uauugcauaacagca

SEQ ID NO: 1888306 - RNA, 15 nt, Homo sapiens
aacaccauuauucca

SEQ ID NO: 1888307 - RNA, 17 nt, Homo sapiens
agcuugaaagcaguuaa

SEQ ID NO: 1888308 - RNA, 13 nt, Homo sapiens
cauaauuugcaua

SEQ ID NO: 1888309 - RNA, 23 nt, Homo sapiens
auuuuucacuuugcucucaauua

SEQ ID NO: 1888310 - RNA, 21 nt, Homo sapiens
uaccuauucuggauauuucau

SEQ ID NO: 1888311 - RNA, 22 nt, Homo sapiens
ugcaggcacucaaugcagccag

SEQ ID NO: 1888312 - RNA, 15 nt, Homo sapiens
aacaauaaagauaca

SEQ ID NO: 1888313 - RNA, 16 nt, Homo sapiens
cgcuguauaaagcaug

SEQ ID NO: 1888314 - RNA, 21 nt, Homo sapiens
aaguugcagaacagacacuuu

SEQ ID NO: 1888315 - RNA, 19 nt, Homo sapiens
gaaagugagcccccaagau

SEQ ID NO: 1888316 - RNA, 20 nt, Homo sapiens
cuccgucuaagucaugagcu

SEQ ID NO: 1888317 - RNA, 12 nt, Homo sapiens
gaacagcagaaa

SEQ ID NO: 1888318 - RNA, 16 nt, Homo sapiens
cccugaguucauccag

SEQ ID NO: 1888319 - RNA, 23 nt, Homo sapiens
ggccacugcugcuucuccauggc

SEQ ID NO: 1888320 - RNA, 21 nt, Homo sapiens
ucaagccaagccuccuguggu

SEQ ID NO: 1888321 - RNA, 19 nt, Homo sapiens
gccacauggagcuugacuu

SEQ ID NO: 1888322 - RNA, 15 nt, Homo sapiens
aagcuaaacguaauu

SEQ ID NO: 1888323 - RNA, 17 nt, Homo sapiens
aguaagacagugcagug

SEQ ID NO: 1888324 - RNA, 23 nt, Homo sapiens
gccauggaagguucucugugcuc

SEQ ID NO: 1888325 - RNA, 19 nt, Homo sapiens
agcucuguaguggaauaug

SEQ ID NO: 1888326 - RNA, 16 nt, Homo sapiens
cugggucucacuccug

SEQ ID NO: 1888327 - RNA, 17 nt, Homo sapiens
agcuauuugauaugcac

SEQ ID NO: 1888328 - RNA, 20 nt, Homo sapiens
gaugcugagauccugaguca

SEQ ID NO: 1888329 - RNA, 16 nt, Homo sapiens
uuguaagaguguagaa

SEQ ID NO: 1888330 - RNA, 16 nt, Homo sapiens
ggccagcugacuagau

SEQ ID NO: 1888331 - RNA, 21 nt, Homo sapiens
cauuuuauuagaaaggacugu

SEQ ID NO: 1888332 - RNA, 23 nt, Homo sapiens
gcacguccuugggcgucucuaau

SEQ ID NO: 1888333 - RNA, 22 nt, Homo sapiens
gcuacccgcagaguucucagaa

SEQ ID NO: 1888334 - RNA, 19 nt, Homo sapiens
cuggcaaugggacucugag

SEQ ID NO: 1888335 - RNA, 15 nt, Homo sapiens
agagcuuaaauuguc

SEQ ID NO: 1888336 - RNA, 15 nt, Homo sapiens
ugaugccauaugccu

SEQ ID NO: 1888337 - RNA, 19 nt, Homo sapiens
acuggcaccaagugcgggu

SEQ ID NO: 1888338 - RNA, 19 nt, Homo sapiens
caguggccacguucaggga

SEQ ID NO: 1888339 - RNA, 19 nt, Homo sapiens
agaguuaagugaaugucua

SEQ ID NO: 1888340 - RNA, 21 nt, Homo sapiens
augccaaacaggaacaaucca

SEQ ID NO: 1888341 - RNA, 16 nt, Homo sapiens
ucccaaucccauuccu

SEQ ID NO: 1888342 - RNA, 13 nt, Homo sapiens
cgagcaugagcug

SEQ ID NO: 1888343 - RNA, 11 nt, Homo sapiens
ccgacucuggc

SEQ ID NO: 1888344 - RNA, 20 nt, Homo sapiens
cccgcacccccgcacccuua

SEQ ID NO: 1888345 - RNA, 16 nt, Homo sapiens
cugaguucuggucugu

SEQ ID NO: 1888346 - RNA, 19 nt, Homo sapiens
gcugcauaguauuccaugg

SEQ ID NO: 1888347 - RNA, 16 nt, Homo sapiens
aguacuacauaccuca

SEQ ID NO: 1888348 - RNA, 23 nt, Homo sapiens
ggccuaaccgagaucaguauuua

SEQ ID NO: 1888349 - RNA, 21 nt, Homo sapiens
cgaacuccuggccucaaguga

SEQ ID NO: 1888350 - RNA, 23 nt, Homo sapiens
uuauacauguaacagaguagcag

SEQ ID NO: 1888351 - RNA, 21 nt, Homo sapiens
aaucccucccugacccacugu

SEQ ID NO: 1888352 - RNA, 18 nt, Homo sapiens
aguagcaaauguuuacug

SEQ ID NO: 1888353 - RNA, 14 nt, Homo sapiens
uggucagagugcca

SEQ ID NO: 1888354 - RNA, 20 nt, Homo sapiens
ggauccaauuuuaauauuaa

SEQ ID NO: 1888355 - RNA, 11 nt, Homo sapiens
auuuccuuuac

SEQ ID NO: 1888356 - RNA, 20 nt, Homo sapiens
aaucuauugaaagaagaaca

SEQ ID NO: 1888357 - RNA, 17 nt, Homo sapiens
uucgauuucuaccucag

SEQ ID NO: 1888358 - RNA, 14 nt, Homo sapiens
ucuuacaacuuuca

SEQ ID NO: 1888359 - RNA, 13 nt, Homo sapiens
agccacagugggg

SEQ ID NO: 1888360 - RNA, 14 nt, Homo sapiens
gcaccgagaccaaa

SEQ ID NO: 1888361 - RNA, 10 nt, Homo sapiens
guaaccacug

SEQ ID NO: 1888362 - RNA, 22 nt, Homo sapiens
gccuccccuccucugcuugcca

SEQ ID NO: 1888363 - RNA, 15 nt, Homo sapiens
gagacuuuccauuaa

SEQ ID NO: 1888364 - RNA, 16 nt, Homo sapiens
acccgcagaguucuca

SEQ ID NO: 1888365 - RNA, 15 nt, Homo sapiens
ucuaacgugcauuau

SEQ ID NO: 1888366 - RNA, 14 nt, Homo sapiens
cucauaauuuugca

SEQ ID NO: 1888367 - RNA, 16 nt, Homo sapiens
cccaaggaagagccaa

SEQ ID NO: 1888368 - RNA, 23 nt, Homo sapiens
cagcucuuggcuaagaccaggag

SEQ ID NO: 1888369 - RNA, 16 nt, Homo sapiens
gcuuacauuugaauaa

SEQ ID NO: 1888370 - RNA, 16 nt, Homo sapiens
gugaccgggggcugcu

SEQ ID NO: 1888371 - RNA, 21 nt, Homo sapiens
guuuucccugaccucccucua

SEQ ID NO: 1888372 - RNA, 16 nt, Homo sapiens
aaaauuuuuuacuuuu

SEQ ID NO: 1888373 - RNA, 20 nt, Homo sapiens
ucuccagaaagcucaucuca

SEQ ID NO: 1888374 - RNA, 16 nt, Homo sapiens
cucagccucccaaagu

SEQ ID NO: 1888375 - RNA, 19 nt, Homo sapiens
aagugccugcaaaaacaga

SEQ ID NO: 1888376 - RNA, 21 nt, Homo sapiens
auucuagaggauguaucucac

SEQ ID NO: 1888377 - RNA, 19 nt, Homo sapiens
cagagcucuuuaccaagga

SEQ ID NO: 1888378 - RNA, 17 nt, Homo sapiens
agacggcaagacuccau

SEQ ID NO: 1888379 - RNA, 17 nt, Homo sapiens
auaaugacuuaagcaca

SEQ ID NO: 1888380 - RNA, 15 nt, Homo sapiens
gucaccauugcacaa

SEQ ID NO: 1888381 - RNA, 15 nt, Homo sapiens
gggcuccagccaucu

SEQ ID NO: 1888382 - RNA, 13 nt, Homo sapiens
acugggaugaggu

SEQ ID NO: 1888383 - RNA, 15 nt, Homo sapiens
caaauuagugaacca

SEQ ID NO: 1888384 - RNA, 14 nt, Homo sapiens
ucuggggaagggaa

SEQ ID NO: 1888385 - RNA, 14 nt, Homo sapiens
aggcucaccuuugu

SEQ ID NO: 1888386 - RNA, 15 nt, Homo sapiens
uguuacuccaaaacu

SEQ ID NO: 1888387 - RNA, 22 nt, Homo sapiens
aacuagucgucuccucuuggcc

SEQ ID NO: 1888388 - RNA, 19 nt, Homo sapiens
ugccauguacccauugcag

SEQ ID NO: 1888389 - RNA, 17 nt, Homo sapiens
cauuguucuccucgucc

SEQ ID NO: 1888390 - RNA, 18 nt, Homo sapiens
ugaagccuauguaugcca

SEQ ID NO: 1888391 - RNA, 17 nt, Homo sapiens
cacgcccaccagccuug

SEQ ID NO: 1888392 - RNA, 17 nt, Homo sapiens
uacaacuuucaaaccag

SEQ ID NO: 1888393 - RNA, 21 nt, Homo sapiens
ccuuuuugucaucuauuuaaa

SEQ ID NO: 1888394 - RNA, 14 nt, Homo sapiens
uuugauugagagua

SEQ ID NO: 1888395 - RNA, 21 nt, Homo sapiens
uucagacaggagccacaggga

SEQ ID NO: 1888396 - RNA, 17 nt, Homo sapiens
cuaauauauccacacau

SEQ ID NO: 1888397 - RNA, 9 nt, Homo sapiens
acaaaauac

SEQ ID NO: 1888398 - RNA, 16 nt, Homo sapiens
uauccaaagcauugca

SEQ ID NO: 1888399 - RNA, 12 nt, Homo sapiens
agaaaaagccac

SEQ ID NO: 1888400 - RNA, 15 nt, Homo sapiens
cucccgaugcugcua

SEQ ID NO: 1888401 - RNA, 13 nt, Homo sapiens
ugggcacacugaa

SEQ ID NO: 1888402 - RNA, 22 nt, Homo sapiens
cccucggagugccacacaugcc

SEQ ID NO: 1888403 - RNA, 21 nt, Homo sapiens
caguuaaaucccccaccucca

SEQ ID NO: 1888404 - RNA, 13 nt, Homo sapiens
cugcaugcagaaa

SEQ ID NO: 1888405 - RNA, 15 nt, Homo sapiens
cauuaggaaacacug

SEQ ID NO: 1888406 - RNA, 23 nt, Homo sapiens
agcuagcaaagacuugugugaug

SEQ ID NO: 1888407 - RNA, 20 nt, Homo sapiens
guccaacagacacaauuuau

SEQ ID NO: 1888408 - RNA, 11 nt, Homo sapiens
cauacuuuuca

SEQ ID NO: 1888409 - RNA, 16 nt, Homo sapiens
auucauauugcaucau

SEQ ID NO: 1888410 - RNA, 14 nt, Homo sapiens
uuucccuacugaac

SEQ ID NO: 1888411 - RNA, 15 nt, Homo sapiens
uauauugcaaaaaca

SEQ ID NO: 1888412 - RNA, 23 nt, Homo sapiens
uaaaaauugugaucagaccauaa

SEQ ID NO: 1888413 - RNA, 14 nt, Homo sapiens
ccuagaaagacaga

SEQ ID NO: 1888414 - RNA, 20 nt, Homo sapiens
caggaggcagagguugcaau

SEQ ID NO: 1888415 - RNA, 12 nt, Homo sapiens
ccauuguucacc

SEQ ID NO: 1888416 - RNA, 16 nt, Homo sapiens
uagacugaaaagccau

SEQ ID NO: 1888417 - RNA, 18 nt, Homo sapiens
cuuucacaguuucuucca

SEQ ID NO: 1888418 - RNA, 14 nt, Homo sapiens
cuucuuacuugcca

SEQ ID NO: 1888419 - RNA, 18 nt, Homo sapiens
caaguugcuuuuaccuga

SEQ ID NO: 1888420 - RNA, 19 nt, Homo sapiens
cuuuggaccuaauccaagc

SEQ ID NO: 1888421 - RNA, 23 nt, Homo sapiens
agagcuauggugagguguggaua

SEQ ID NO: 1888422 - RNA, 16 nt, Homo sapiens
cuuccguaacccaacu

SEQ ID NO: 1888423 - RNA, 19 nt, Homo sapiens
uggggcugagugaaaacau

SEQ ID NO: 1888424 - RNA, 11 nt, Homo sapiens
ggcacugccug

SEQ ID NO: 1888425 - RNA, 20 nt, Homo sapiens
gucccucauggagaccucau

SEQ ID NO: 1888426 - RNA, 16 nt, Homo sapiens
gaaguggagucucaug

SEQ ID NO: 1888427 - RNA, 11 nt, Homo sapiens
guuaccacagu

SEQ ID NO: 1888428 - RNA, 16 nt, Homo sapiens
cauggaggccaagaac

SEQ ID NO: 1888429 - RNA, 15 nt, Homo sapiens
accuggggaguuuac

SEQ ID NO: 1888430 - RNA, 16 nt, Homo sapiens
auuaagaggaugcugg

SEQ ID NO: 1888431 - RNA, 13 nt, Homo sapiens
ggcagagccuuug

SEQ ID NO: 1888432 - RNA, 14 nt, Homo sapiens
agcugagccaguca

SEQ ID NO: 1888433 - RNA, 19 nt, Homo sapiens
ugugcugacuaacuauaag

SEQ ID NO: 1888434 - RNA, 16 nt, Homo sapiens
agacuucccacuguuc

SEQ ID NO: 1888435 - RNA, 20 nt, Homo sapiens
uggcugauuuagaccaaaag

SEQ ID NO: 1888436 - RNA, 19 nt, Homo sapiens
gcgcucggcuccaccccag

SEQ ID NO: 1888437 - RNA, 19 nt, Homo sapiens
gaggagggucggugccuuc

SEQ ID NO: 1888438 - RNA, 16 nt, Homo sapiens
auaaagacuaguuuac

SEQ ID NO: 1888439 - RNA, 15 nt, Homo sapiens
gcuacaauucugcag

SEQ ID NO: 1888440 - RNA, 21 nt, Homo sapiens
ucccuggggcugcugugcgcu

SEQ ID NO: 1888441 - RNA, 17 nt, Homo sapiens
cuauaguuauacaucaa

SEQ ID NO: 1888442 - RNA, 16 nt, Homo sapiens
uagaagugcauucucc

SEQ ID NO: 1888443 - RNA, 21 nt, Homo sapiens
aauuacccuacuuucauuccu

SEQ ID NO: 1888444 - RNA, 16 nt, Homo sapiens
augggcucagggccag

SEQ ID NO: 1888445 - RNA, 15 nt, Homo sapiens
uggaaugauucacau

SEQ ID NO: 1888446 - RNA, 13 nt, Homo sapiens
guaagucauuuau

SEQ ID NO: 1888447 - RNA, 17 nt, Homo sapiens
aguacaucucuacuaaa

SEQ ID NO: 1888448 - RNA, 21 nt, Homo sapiens
acuuguaaauaaaggaaccau

SEQ ID NO: 1888449 - RNA, 13 nt, Homo sapiens
cuuaaaaugaaag

SEQ ID NO: 1888450 - RNA, 19 nt, Homo sapiens
aguguggcugcaucuugcu

SEQ ID NO: 1888451 - RNA, 16 nt, Homo sapiens
cauugcuucugcuaaa

SEQ ID NO: 1888452 - RNA, 14 nt, Homo sapiens
uuccagccacucga

SEQ ID NO: 1888453 - RNA, 14 nt, Homo sapiens
ucuuggccaucuaa

SEQ ID NO: 1888454 - RNA, 15 nt, Homo sapiens
uauggguuuaauuaa

SEQ ID NO: 1888455 - RNA, 21 nt, Homo sapiens
gagcaucuccucaacucugag

SEQ ID NO: 1888456 - RNA, 17 nt, Homo sapiens
auuuuuuuuuuuaacua

SEQ ID NO: 1888457 - RNA, 11 nt, Homo sapiens
ggauauguagu

SEQ ID NO: 1888458 - RNA, 12 nt, Homo sapiens
ugucucucauga

SEQ ID NO: 1888459 - RNA, 18 nt, Homo sapiens
ucuaaaaggaugugaaaa

SEQ ID NO: 1888460 - RNA, 17 nt, Homo sapiens
aauuacagucauuucua

SEQ ID NO: 1888461 - RNA, 16 nt, Homo sapiens
uguccagugagcagug

SEQ ID NO: 1888462 - RNA, 16 nt, Homo sapiens
ucaaaaggaaaccaag

SEQ ID NO: 1888463 - RNA, 19 nt, Homo sapiens
acugaugggcaacccccag

SEQ ID NO: 1888464 - RNA, 17 nt, Homo sapiens
aaaucuaggaugugaug

SEQ ID NO: 1888465 - RNA, 19 nt, Homo sapiens
cagcuccccagaguccucu

SEQ ID NO: 1888466 - RNA, 22 nt, Homo sapiens
aauuguagaacauagaugcuac

SEQ ID NO: 1888467 - RNA, 14 nt, Homo sapiens
gucuucacauguau

SEQ ID NO: 1888468 - RNA, 18 nt, Homo sapiens
gcugaaauuaugucaaau

SEQ ID NO: 1888469 - RNA, 17 nt, Homo sapiens
acaucaggugauccacc

SEQ ID NO: 1888470 - RNA, 11 nt, Homo sapiens
aagucuuccau

SEQ ID NO: 1888471 - RNA, 14 nt, Homo sapiens
ucuauaacuacaua

SEQ ID NO: 1888472 - RNA, 17 nt, Homo sapiens
auugauggaugucuucu

SEQ ID NO: 1888473 - RNA, 23 nt, Homo sapiens
cuucagcucacacaugagaucua

SEQ ID NO: 1888474 - RNA, 15 nt, Homo sapiens
ucuccugccucagcc

SEQ ID NO: 1888475 - RNA, 20 nt, Homo sapiens
guaucacuuuaacucaggag

SEQ ID NO: 1888476 - RNA, 16 nt, Homo sapiens
augucauaaaugucac

SEQ ID NO: 1888477 - RNA, 13 nt, Homo sapiens
uccugcucaggaa

SEQ ID NO: 1888478 - RNA, 22 nt, Homo sapiens
cugauuacugaaauuuaagaaa

SEQ ID NO: 1888479 - RNA, 16 nt, Homo sapiens
auaucugcuauucucc

SEQ ID NO: 1888480 - RNA, 22 nt, Homo sapiens
aagcauuuuacaagaucuugca

SEQ ID NO: 1888481 - RNA, 21 nt, Homo sapiens
auuucauaagaaccucaaaau

SEQ ID NO: 1888482 - RNA, 17 nt, Homo sapiens
ucaugccuuaaucccag

SEQ ID NO: 1888483 - RNA, 13 nt, Homo sapiens
ccauucugaccau

SEQ ID NO: 1888484 - RNA, 13 nt, Homo sapiens
auauccugcucac

SEQ ID NO: 1888485 - RNA, 16 nt, Homo sapiens
gaauuugggccucuug

SEQ ID NO: 1888486 - RNA, 21 nt, Homo sapiens
cuguaaucccagcuacuuggg

SEQ ID NO: 1888487 - RNA, 15 nt, Homo sapiens
ugacauaaguaacuu

SEQ ID NO: 1888488 - RNA, 19 nt, Homo sapiens
gaaagcaguucugaugcuu

SEQ ID NO: 1888489 - RNA, 13 nt, Homo sapiens
uauuuaagugcaa

SEQ ID NO: 1888490 - RNA, 19 nt, Homo sapiens
caguaauaaaacaucuuuc

SEQ ID NO: 1888491 - RNA, 14 nt, Homo sapiens
aggaggacaaggac

SEQ ID NO: 1888492 - RNA, 17 nt, Homo sapiens
ucauguaaauuugguuu

SEQ ID NO: 1888493 - RNA, 21 nt, Homo sapiens
gaaacaccgagugaggccaua

SEQ ID NO: 1888494 - RNA, 18 nt, Homo sapiens
ccagaggguagggcagca

SEQ ID NO: 1888495 - RNA, 14 nt, Homo sapiens
cugacagcacuccu

SEQ ID NO: 1888496 - RNA, 18 nt, Homo sapiens
uacuccuuuuaagcagug

SEQ ID NO: 1888497 - RNA, 17 nt, Homo sapiens
aaaaagaaggugccgau

SEQ ID NO: 1888498 - RNA, 11 nt, Homo sapiens
gggcaucuccu

SEQ ID NO: 1888499 - RNA, 16 nt, Homo sapiens
auugcucucccucgug

SEQ ID NO: 1888500 - RNA, 14 nt, Homo sapiens
ucacucuguggucc

SEQ ID NO: 1888501 - RNA, 16 nt, Homo sapiens
agaccucuaguagcug

SEQ ID NO: 1888502 - RNA, 20 nt, Homo sapiens
uuuccgaggccccugucuca

SEQ ID NO: 1888503 - RNA, 14 nt, Homo sapiens
uaaggcguggagcu

SEQ ID NO: 1888504 - RNA, 22 nt, Homo sapiens
uccaacaaguaccugugaacag

SEQ ID NO: 1888505 - RNA, 20 nt, Homo sapiens
cggagggaggggagggguga

SEQ ID NO: 1888506 - RNA, 22 nt, Homo sapiens
cuuaugaauugaugacuauaua

SEQ ID NO: 1888507 - RNA, 15 nt, Homo sapiens
agcaaaaguagccau

SEQ ID NO: 1888508 - RNA, 18 nt, Homo sapiens
uaaauucccaacuucucu

SEQ ID NO: 1888509 - RNA, 18 nt, Homo sapiens
agaauuguugacuugcau

SEQ ID NO: 1888510 - RNA, 12 nt, Homo sapiens
cugcuucuguua

SEQ ID NO: 1888511 - RNA, 16 nt, Homo sapiens
agagacugcuugacaa

SEQ ID NO: 1888512 - RNA, 22 nt, Homo sapiens
cucacagauuuaaagcaucauc

SEQ ID NO: 1888513 - RNA, 16 nt, Homo sapiens
ugggagauucaugcga

SEQ ID NO: 1888514 - RNA, 15 nt, Homo sapiens
ugaccucaccugguc

SEQ ID NO: 1888515 - RNA, 18 nt, Homo sapiens
aaaacaaaggagcauuaa

SEQ ID NO: 1888516 - RNA, 22 nt, Homo sapiens
gcuggagcuccuacauggugca

SEQ ID NO: 1888517 - RNA, 18 nt, Homo sapiens
caauaaagcaauguggua

SEQ ID NO: 1888518 - RNA, 16 nt, Homo sapiens
gaccaccuaauaucaa

SEQ ID NO: 1888519 - RNA, 18 nt, Homo sapiens
ugaguccgacccagacau

SEQ ID NO: 1888520 - RNA, 16 nt, Homo sapiens
cuuaaugauacauguu

SEQ ID NO: 1888521 - RNA, 23 nt, Homo sapiens
ucugggaguuauaggucauggga

SEQ ID NO: 1888522 - RNA, 14 nt, Homo sapiens
gcuugacaacaucu

SEQ ID NO: 1888523 - RNA, 20 nt, Homo sapiens
ugggcccagaggcacagccg

SEQ ID NO: 1888524 - RNA, 21 nt, Homo sapiens
accacuuucucaggcuucuca

SEQ ID NO: 1888525 - RNA, 18 nt, Homo sapiens
uuaaauaaaauauuugcu

SEQ ID NO: 1888526 - RNA, 23 nt, Homo sapiens
agacacagaaaucuuucacuugu

SEQ ID NO: 1888527 - RNA, 16 nt, Homo sapiens
ucaaaaaaccuuuaca

SEQ ID NO: 1888528 - RNA, 16 nt, Homo sapiens
uaaacuuuccuguacu

SEQ ID NO: 1888529 - RNA, 15 nt, Homo sapiens
ugcccagaucaacag

SEQ ID NO: 1888530 - RNA, 13 nt, Homo sapiens
cacacaacugugg

SEQ ID NO: 1888531 - RNA, 23 nt, Homo sapiens
accugcauaaaaaggucuuuaaa

SEQ ID NO: 1888532 - RNA, 20 nt, Homo sapiens
cagggucucgcucuguugcc

SEQ ID NO: 1888533 - RNA, 13 nt, Homo sapiens
gaguuagugccau

SEQ ID NO: 1888534 - RNA, 19 nt, Homo sapiens
uuguagaccuguuucauaa

SEQ ID NO: 1888535 - RNA, 14 nt, Homo sapiens
cauccuaagacaga

SEQ ID NO: 1888536 - RNA, 15 nt, Homo sapiens
acacuuacacuuuau

SEQ ID NO: 1888537 - RNA, 13 nt, Homo sapiens
uggaacuggccac

SEQ ID NO: 1888538 - RNA, 16 nt, Homo sapiens
augauccuaaugaaug

SEQ ID NO: 1888539 - RNA, 18 nt, Homo sapiens
ucaucauucucugucuca

SEQ ID NO: 1888540 - RNA, 22 nt, Homo sapiens
uaacuuugcaaaaagauuuacu

SEQ ID NO: 1888541 - RNA, 13 nt, Homo sapiens
uaaaaaguaauaa

SEQ ID NO: 1888542 - RNA, 20 nt, Homo sapiens
gcucucaagucaaggaagcu

SEQ ID NO: 1888543 - RNA, 16 nt, Homo sapiens
aagcugcucugaggua

SEQ ID NO: 1888544 - RNA, 20 nt, Homo sapiens
ccgcagggugaacugcagcg

SEQ ID NO: 1888545 - RNA, 17 nt, Homo sapiens
uucuagcugucugugaa

SEQ ID NO: 1888546 - RNA, 16 nt, Homo sapiens
aacagauaaaugacaa

SEQ ID NO: 1888547 - RNA, 16 nt, Homo sapiens
aauuccuuacauuuac

SEQ ID NO: 1888548 - RNA, 13 nt, Homo sapiens
cgaccaccaaagu

SEQ ID NO: 1888549 - RNA, 9 nt, Homo sapiens
guaccaaaa

SEQ ID NO: 1888550 - RNA, 20 nt, Homo sapiens
ggaagugugcugaggugggc

SEQ ID NO: 1888551 - RNA, 20 nt, Homo sapiens
accacucuucuuuaagccau

SEQ ID NO: 1888552 - RNA, 14 nt, Homo sapiens
acuaauaaauugac

SEQ ID NO: 1888553 - RNA, 15 nt, Homo sapiens
agagggaagaucugg

SEQ ID NO: 1888554 - RNA, 13 nt, Homo sapiens
caaacaugcaaga

SEQ ID NO: 1888555 - RNA, 13 nt, Homo sapiens
ugaguggccccac

SEQ ID NO: 1888556 - RNA, 19 nt, Homo sapiens
cuucagauacuugugaaca

SEQ ID NO: 1888557 - RNA, 15 nt, Homo sapiens
ccagggaugcaaagg

SEQ ID NO: 1888558 - RNA, 21 nt, Homo sapiens
accccugugcuccccugccac

SEQ ID NO: 1888559 - RNA, 20 nt, Homo sapiens
agagcccuucacugccauga

SEQ ID NO: 1888560 - RNA, 17 nt, Homo sapiens
ucaauaagccucagcuu

SEQ ID NO: 1888561 - RNA, 12 nt, Homo sapiens
ccaugaagccac

SEQ ID NO: 1888562 - RNA, 23 nt, Homo sapiens
aauacagacaaagcauaaucaau

SEQ ID NO: 1888563 - RNA, 14 nt, Homo sapiens
auuaaaguguccau

SEQ ID NO: 1888564 - RNA, 18 nt, Homo sapiens
gagaauagaaauuugccc

SEQ ID NO: 1888565 - RNA, 21 nt, Homo sapiens
gcagcaccuccuccaugcagg

SEQ ID NO: 1888566 - RNA, 12 nt, Homo sapiens
agcaaaagccuc

SEQ ID NO: 1888567 - RNA, 16 nt, Homo sapiens
cauauucacaauggaa

SEQ ID NO: 1888568 - RNA, 12 nt, Homo sapiens
aaaaaugauucu

SEQ ID NO: 1888569 - RNA, 16 nt, Homo sapiens
cuucuuuccucuggag

SEQ ID NO: 1888570 - RNA, 17 nt, Homo sapiens
aauggagaaguucagga

SEQ ID NO: 1888571 - RNA, 21 nt, Homo sapiens
gccuaggaguugaguacagug

SEQ ID NO: 1888572 - RNA, 16 nt, Homo sapiens
gguauaaagcucucaa

SEQ ID NO: 1888573 - RNA, 16 nt, Homo sapiens
gaaguuuaauugacuu

SEQ ID NO: 1888574 - RNA, 23 nt, Homo sapiens
agguggagguugcagugagccaa

SEQ ID NO: 1888575 - RNA, 13 nt, Homo sapiens
aucuggaaguuga

SEQ ID NO: 1888576 - RNA, 17 nt, Homo sapiens
gauauucaaucuuaaca

SEQ ID NO: 1888577 - RNA, 16 nt, Homo sapiens
ccaagcuccaaaucca

SEQ ID NO: 1888578 - RNA, 15 nt, Homo sapiens
agaagggccagauuu

SEQ ID NO: 1888579 - RNA, 21 nt, Homo sapiens
auggugaaaccaaacaaauac

SEQ ID NO: 1888580 - RNA, 16 nt, Homo sapiens
gacagcugugugacau

SEQ ID NO: 1888581 - RNA, 14 nt, Homo sapiens
cguuaugugcagua

SEQ ID NO: 1888582 - RNA, 15 nt, Homo sapiens
uccacaguuaucuua

SEQ ID NO: 1888583 - RNA, 20 nt, Homo sapiens
uaaagcagggacugugaaca

SEQ ID NO: 1888584 - RNA, 15 nt, Homo sapiens
caguguuuugcacau

SEQ ID NO: 1888585 - RNA, 14 nt, Homo sapiens
ugaagagcauuugg

SEQ ID NO: 1888586 - RNA, 13 nt, Homo sapiens
cccccaguguaau

SEQ ID NO: 1888587 - RNA, 17 nt, Homo sapiens
uauaaauuauagaaucu

SEQ ID NO: 1888588 - RNA, 15 nt, Homo sapiens
ugcugcugacccagc

SEQ ID NO: 1888589 - RNA, 22 nt, Homo sapiens
gaaacugauuucuucagaauua

SEQ ID NO: 1888590 - RNA, 16 nt, Homo sapiens
auccccaggcaccuca

SEQ ID NO: 1888591 - RNA, 18 nt, Homo sapiens
cugucacgugugggcaau

SEQ ID NO: 1888592 - RNA, 17 nt, Homo sapiens
gccucaagaggaaugaa

SEQ ID NO: 1888593 - RNA, 14 nt, Homo sapiens
uugauucuccuuca

SEQ ID NO: 1888594 - RNA, 13 nt, Homo sapiens
aagacgccuucau

SEQ ID NO: 1888595 - RNA, 20 nt, Homo sapiens
uaggacauaaacccuugcca

SEQ ID NO: 1888596 - RNA, 23 nt, Homo sapiens
aagcaaauauuuaugaccucaac

SEQ ID NO: 1888597 - RNA, 14 nt, Homo sapiens
aacugaaucacuua

SEQ ID NO: 1888598 - RNA, 20 nt, Homo sapiens
ugacauuagauugaugugca

SEQ ID NO: 1888599 - RNA, 22 nt, Homo sapiens
aauuuuuuuagaaagcauuuga

SEQ ID NO: 1888600 - RNA, 18 nt, Homo sapiens
guccuuucccaccauucc

SEQ ID NO: 1888601 - RNA, 17 nt, Homo sapiens
cacagggcaccugccac

SEQ ID NO: 1888602 - RNA, 13 nt, Homo sapiens
aagaaaccuucau

SEQ ID NO: 1888603 - RNA, 17 nt, Homo sapiens
gcuucagcgaaagggac

SEQ ID NO: 1888604 - RNA, 13 nt, Homo sapiens
uuuuaauggaugg

SEQ ID NO: 1888605 - RNA, 20 nt, Homo sapiens
gaguugcagccagggccagu

SEQ ID NO: 1888606 - RNA, 18 nt, Homo sapiens
uguccaggagaccuucca

SEQ ID NO: 1888607 - RNA, 11 nt, Homo sapiens
ggcauuccuga

SEQ ID NO: 1888608 - RNA, 16 nt, Homo sapiens
gaauuaaugcauucaa

SEQ ID NO: 1888609 - RNA, 16 nt, Homo sapiens
uaucucuucagucucu

SEQ ID NO: 1888610 - RNA, 13 nt, Homo sapiens
ugaccucaaggaa

SEQ ID NO: 1888611 - RNA, 16 nt, Homo sapiens
ccagugagaagcugag

SEQ ID NO: 1888612 - RNA, 16 nt, Homo sapiens
aacuauccuaacaagc

SEQ ID NO: 1888613 - RNA, 11 nt, Homo sapiens
uauuuuccacc

SEQ ID NO: 1888614 - RNA, 15 nt, Homo sapiens
uauauggccucaaga

SEQ ID NO: 1888615 - RNA, 14 nt, Homo sapiens
aggccgggugcuca

SEQ ID NO: 1888616 - RNA, 19 nt, Homo sapiens
auugcagaaauacaguaug

SEQ ID NO: 1888617 - RNA, 15 nt, Homo sapiens
agauaauacauuccg

SEQ ID NO: 1888618 - RNA, 18 nt, Homo sapiens
cucuuugaucuacuugcc

SEQ ID NO: 1888619 - RNA, 21 nt, Homo sapiens
uagaggggcucugggagacuu

SEQ ID NO: 1888620 - RNA, 22 nt, Homo sapiens
ugaccaaugugugaaguaugca

SEQ ID NO: 1888621 - RNA, 13 nt, Homo sapiens
gcugcaccugguc

SEQ ID NO: 1888622 - RNA, 17 nt, Homo sapiens
uaaauccaugguguuau

SEQ ID NO: 1888623 - RNA, 20 nt, Homo sapiens
cuauaaaaugagaagucuca

SEQ ID NO: 1888624 - RNA, 20 nt, Homo sapiens
uugcuguguccaacuccagu

SEQ ID NO: 1888625 - RNA, 17 nt, Homo sapiens
uuccccaccuuccuuac

SEQ ID NO: 1888626 - RNA, 14 nt, Homo sapiens
acccaguucaguga

SEQ ID NO: 1888627 - RNA, 22 nt, Homo sapiens
cuucacuuuguucacuaccugu

SEQ ID NO: 1888628 - RNA, 15 nt, Homo sapiens
accaguggggauuug

SEQ ID NO: 1888629 - RNA, 17 nt, Homo sapiens
caagcucuucuccucag

SEQ ID NO: 1888630 - RNA, 23 nt, Homo sapiens
uauugccccaagagaccuagcua

SEQ ID NO: 1888631 - RNA, 13 nt, Homo sapiens
aaagugccaaaau

SEQ ID NO: 1888632 - RNA, 13 nt, Homo sapiens
ccuccacgccauu

SEQ ID NO: 1888633 - RNA, 16 nt, Homo sapiens
cugguuuucugccaau

SEQ ID NO: 1888634 - RNA, 18 nt, Homo sapiens
gcuguuugccaagcugaa

SEQ ID NO: 1888635 - RNA, 20 nt, Homo sapiens
caugaaggagcagcauugac

SEQ ID NO: 1888636 - RNA, 17 nt, Homo sapiens
gacaccaguugcgaagg

SEQ ID NO: 1888637 - RNA, 23 nt, Homo sapiens
ccaaugucugauuuaacacuauc

SEQ ID NO: 1888638 - RNA, 22 nt, Homo sapiens
cacgccuaaggucacagcuagu

SEQ ID NO: 1888639 - RNA, 13 nt, Homo sapiens
cugggugugcaac

SEQ ID NO: 1888640 - RNA, 18 nt, Homo sapiens
caugaucuauacacauaa

SEQ ID NO: 1888641 - RNA, 14 nt, Homo sapiens
aaaaauuuuaacca

SEQ ID NO: 1888642 - RNA, 14 nt, Homo sapiens
aucaauuuuuccca

SEQ ID NO: 1888643 - RNA, 13 nt, Homo sapiens
agcugccugguau

SEQ ID NO: 1888644 - RNA, 18 nt, Homo sapiens
caagaaguggcugccaaa

SEQ ID NO: 1888645 - RNA, 23 nt, Homo sapiens
acuuuccgagccuccaguccaaa

SEQ ID NO: 1888646 - RNA, 18 nt, Homo sapiens
auccuaguaauugccuag

SEQ ID NO: 1888647 - RNA, 21 nt, Homo sapiens
guuucaacaaaauaaugcacu

SEQ ID NO: 1888648 - RNA, 10 nt, Homo sapiens
ugaugaauaa

SEQ ID NO: 1888649 - RNA, 21 nt, Homo sapiens
ccacugcccuccagggccagg

SEQ ID NO: 1888650 - RNA, 21 nt, Homo sapiens
ugugcccccaaccauuuccuc

SEQ ID NO: 1888651 - RNA, 13 nt, Homo sapiens
acagaagcaggcu

SEQ ID NO: 1888652 - RNA, 15 nt, Homo sapiens
cuaaaauucuagucu

SEQ ID NO: 1888653 - RNA, 12 nt, Homo sapiens
aaaaaugguacu

SEQ ID NO: 1888654 - RNA, 15 nt, Homo sapiens
gauguuaucaaugac

SEQ ID NO: 1888655 - RNA, 17 nt, Homo sapiens
aucacacagacaguuuc

SEQ ID NO: 1888656 - RNA, 20 nt, Homo sapiens
ccccagagaaaacccggagc

SEQ ID NO: 1888657 - RNA, 12 nt, Homo sapiens
cccauaaggcca

SEQ ID NO: 1888658 - RNA, 23 nt, Homo sapiens
auuuuaaagccugaaaauuccaa

SEQ ID NO: 1888659 - RNA, 23 nt, Homo sapiens
uaaauauuuuuuaaaaccauaaa

SEQ ID NO: 1888660 - RNA, 19 nt, Homo sapiens
cugcccccagccaugguga

SEQ ID NO: 1888661 - RNA, 19 nt, Homo sapiens
cagucaccgacaacaugcu

SEQ ID NO: 1888662 - RNA, 14 nt, Homo sapiens
cuauuaacucugca

SEQ ID NO: 1888663 - RNA, 13 nt, Homo sapiens
ugcaguuaccaca

SEQ ID NO: 1888664 - RNA, 13 nt, Homo sapiens
cuucaugcuugau

SEQ ID NO: 1888665 - RNA, 23 nt, Homo sapiens
ccugaaacagccucuccaagggu

SEQ ID NO: 1888666 - RNA, 12 nt, Homo sapiens
ugaggguggaag

SEQ ID NO: 1888667 - RNA, 18 nt, Homo sapiens
ugagaguuccggggagaa

SEQ ID NO: 1888668 - RNA, 17 nt, Homo sapiens
cgucugucaaugacauc

SEQ ID NO: 1888669 - RNA, 18 nt, Homo sapiens
ugggcuguuuuuggccua

SEQ ID NO: 1888670 - RNA, 15 nt, Homo sapiens
uaauguuauuuccac

SEQ ID NO: 1888671 - RNA, 14 nt, Homo sapiens
guuuugccugagaa

SEQ ID NO: 1888672 - RNA, 21 nt, Homo sapiens
ggccauggaauaaaccauuuu

SEQ ID NO: 1888673 - RNA, 20 nt, Homo sapiens
uuuucuauuaaaagacucau

SEQ ID NO: 1888674 - RNA, 14 nt, Homo sapiens
ugcucauuugccaa

SEQ ID NO: 1888675 - RNA, 18 nt, Homo sapiens
cuguugagguaccuccaa

SEQ ID NO: 1888676 - RNA, 23 nt, Homo sapiens
guaggcauucuuuagucuacaua

SEQ ID NO: 1888677 - RNA, 17 nt, Homo sapiens
cugccuuugccagguga

SEQ ID NO: 1888678 - RNA, 15 nt, Homo sapiens
ucccccuucacaaag

SEQ ID NO: 1888679 - RNA, 13 nt, Homo sapiens
uuuuccuuaccau

SEQ ID NO: 1888680 - RNA, 23 nt, Homo sapiens
cacuuuuagccagagaugcaaua

SEQ ID NO: 1888681 - RNA, 17 nt, Homo sapiens
uggacucacaaggggaa

SEQ ID NO: 1888682 - RNA, 16 nt, Homo sapiens
gccaauucacaaguua

SEQ ID NO: 1888683 - RNA, 22 nt, Homo sapiens
cuguuggcaucuugcugcuaau

SEQ ID NO: 1888684 - RNA, 20 nt, Homo sapiens
cagacugaacuuaccgugag

SEQ ID NO: 1888685 - RNA, 12 nt, Homo sapiens
agucuggcaaca

SEQ ID NO: 1888686 - RNA, 17 nt, Homo sapiens
auuuuuguuagcaaaga

SEQ ID NO: 1888687 - RNA, 19 nt, Homo sapiens
aauauauguuuggcugaaa

SEQ ID NO: 1888688 - RNA, 23 nt, Homo sapiens
cuucaccagauuuaaauaacugg

SEQ ID NO: 1888689 - RNA, 20 nt, Homo sapiens
agggagaauaaaauuccuau

SEQ ID NO: 1888690 - RNA, 22 nt, Homo sapiens
gaggggaggauguauaaaaugg

SEQ ID NO: 1888691 - RNA, 14 nt, Homo sapiens
cacagcuaugaagg

SEQ ID NO: 1888692 - RNA, 12 nt, Homo sapiens
gaagacacugca

SEQ ID NO: 1888693 - RNA, 12 nt, Homo sapiens
ucggacucugcu

SEQ ID NO: 1888694 - RNA, 15 nt, Homo sapiens
acaauaaagaucgcc

SEQ ID NO: 1888695 - RNA, 17 nt, Homo sapiens
uggacaugcgugaccag

SEQ ID NO: 1888696 - RNA, 23 nt, Homo sapiens
aguuuguguguauuuguauuaau

SEQ ID NO: 1888697 - RNA, 15 nt, Homo sapiens
uggaaaaggccugug

SEQ ID NO: 1888698 - RNA, 18 nt, Homo sapiens
aguuggccaugaugucuu

SEQ ID NO: 1888699 - RNA, 21 nt, Homo sapiens
aaucuagaauuuagugauacu

SEQ ID NO: 1888700 - RNA, 22 nt, Homo sapiens
cagagggcggggagaaucucag

SEQ ID NO: 1888701 - RNA, 12 nt, Homo sapiens
ucccagucccau

SEQ ID NO: 1888702 - RNA, 22 nt, Homo sapiens
cauauauuggguuccauucuca

SEQ ID NO: 1888703 - RNA, 20 nt, Homo sapiens
gccauacuucuguuuccauc

SEQ ID NO: 1888704 - RNA, 22 nt, Homo sapiens
uccaaacaauuuaaaaaugagu

SEQ ID NO: 1888705 - RNA, 16 nt, Homo sapiens
gcuuggggaccugaac

SEQ ID NO: 1888706 - RNA, 17 nt, Homo sapiens
ucaucaguccugcauuu

SEQ ID NO: 1888707 - RNA, 14 nt, Homo sapiens
ccagcaguacucag

SEQ ID NO: 1888708 - RNA, 20 nt, Homo sapiens
aaacuauccugauuccaaau

SEQ ID NO: 1888709 - RNA, 22 nt, Homo sapiens
acuccuuaauaugaucugugga

SEQ ID NO: 1888710 - RNA, 17 nt, Homo sapiens
aaaguacaagagcuuaa

SEQ ID NO: 1888711 - RNA, 16 nt, Homo sapiens
ugcuaguucaacagaa

SEQ ID NO: 1888712 - RNA, 18 nt, Homo sapiens
aaugaauaacagccucau

SEQ ID NO: 1888713 - RNA, 17 nt, Homo sapiens
cggaugcacacacagau

SEQ ID NO: 1888714 - RNA, 22 nt, Homo sapiens
cucaccugcuggggaccucacc

SEQ ID NO: 1888715 - RNA, 16 nt, Homo sapiens
aggcagccuugaccac

SEQ ID NO: 1888716 - RNA, 13 nt, Homo sapiens
ucuuucacagugg

SEQ ID NO: 1888717 - RNA, 18 nt, Homo sapiens
auaaaucuauucugcuaa

SEQ ID NO: 1888718 - RNA, 18 nt, Homo sapiens
ccaccuccccucagacua

SEQ ID NO: 1888719 - RNA, 23 nt, Homo sapiens
uccuaggucacuugaagccaaac

SEQ ID NO: 1888720 - RNA, 13 nt, Homo sapiens
ccaucaaagaguc

SEQ ID NO: 1888721 - RNA, 18 nt, Homo sapiens
gccuagaacaucccuggg

SEQ ID NO: 1888722 - RNA, 21 nt, Homo sapiens
gcccccggguccccggcacca

SEQ ID NO: 1888723 - RNA, 17 nt, Homo sapiens
aggggccucuggcugcc

SEQ ID NO: 1888724 - RNA, 14 nt, Homo sapiens
ucaguaacuuuuaa

SEQ ID NO: 1888725 - RNA, 13 nt, Homo sapiens
caaugcauacaau

SEQ ID NO: 1888726 - RNA, 15 nt, Homo sapiens
cuagauucaaagguu

SEQ ID NO: 1888727 - RNA, 12 nt, Homo sapiens
gauuugggaaaa

SEQ ID NO: 1888728 - RNA, 17 nt, Homo sapiens
ugccucaaguuccaugc

SEQ ID NO: 1888729 - RNA, 16 nt, Homo sapiens
uuuugcaacuagguau

SEQ ID NO: 1888730 - RNA, 14 nt, Homo sapiens
cuugcucaaaacac

SEQ ID NO: 1888731 - RNA, 18 nt, Homo sapiens
ucgccgggccauucugau

SEQ ID NO: 1888732 - RNA, 19 nt, Homo sapiens
uuuucucaaaggcccucag

SEQ ID NO: 1888733 - RNA, 13 nt, Homo sapiens
gcuuccugaaaua

SEQ ID NO: 1888734 - RNA, 11 nt, Homo sapiens
acugagccauc

SEQ ID NO: 1888735 - RNA, 13 nt, Homo sapiens
agugggugaauaa

SEQ ID NO: 1888736 - RNA, 20 nt, Homo sapiens
gaaaaguugaugguauucau

SEQ ID NO: 1888737 - RNA, 15 nt, Homo sapiens
ucccauguaccagca

SEQ ID NO: 1888738 - RNA, 17 nt, Homo sapiens
cuuccagaucacugcca

SEQ ID NO: 1888739 - RNA, 17 nt, Homo sapiens
gccugagcggaccuucc

SEQ ID NO: 1888740 - RNA, 21 nt, Homo sapiens
gccuccuggaaaaaacaaaaa

SEQ ID NO: 1888741 - RNA, 17 nt, Homo sapiens
gccccagcugugacuga

SEQ ID NO: 1888742 - RNA, 20 nt, Homo sapiens
uauucaauggaaagcugcuu

SEQ ID NO: 1888743 - RNA, 18 nt, Homo sapiens
gcauuuucuucacagugc

SEQ ID NO: 1888744 - RNA, 14 nt, Homo sapiens
uaaagcccuugaac

SEQ ID NO: 1888745 - RNA, 21 nt, Homo sapiens
gcgaugggggaucagcagggc

SEQ ID NO: 1888746 - RNA, 15 nt, Homo sapiens
ccuccucaccuuaau

SEQ ID NO: 1888747 - RNA, 21 nt, Homo sapiens
gcccucaugauauguccucag

SEQ ID NO: 1888748 - RNA, 15 nt, Homo sapiens
uccuggcaagugacc

SEQ ID NO: 1888749 - RNA, 18 nt, Homo sapiens
cucuugaauauguauuaa

SEQ ID NO: 1888750 - RNA, 22 nt, Homo sapiens
augaguuacuugaaauuugccu

SEQ ID NO: 1888751 - RNA, 23 nt, Homo sapiens
cccuauaugcuuacugugcaccu

SEQ ID NO: 1888752 - RNA, 16 nt, Homo sapiens
gcaggugaugccauua

SEQ ID NO: 1888753 - RNA, 14 nt, Homo sapiens
cggacucacuugau

SEQ ID NO: 1888754 - RNA, 21 nt, Homo sapiens
cugcccgggaaggucaccagc

SEQ ID NO: 1888755 - RNA, 14 nt, Homo sapiens
ugcacacaugcaca

SEQ ID NO: 1888756 - RNA, 14 nt, Homo sapiens
cauucccacauucc

SEQ ID NO: 1888757 - RNA, 13 nt, Homo sapiens
ucaguaggcuucu

SEQ ID NO: 1888758 - RNA, 18 nt, Homo sapiens
gacgcuuccagaccaccu

SEQ ID NO: 1888759 - RNA, 15 nt, Homo sapiens
aaauagccacuauua

SEQ ID NO: 1888760 - RNA, 16 nt, Homo sapiens
ccggcgucuugcccag

SEQ ID NO: 1888761 - RNA, 20 nt, Homo sapiens
caggggcuagcuaagccaag

SEQ ID NO: 1888762 - RNA, 19 nt, Homo sapiens
ucaugccacugcacugcag

SEQ ID NO: 1888763 - RNA, 19 nt, Homo sapiens
ccagccucuagaacagcca

SEQ ID NO: 1888764 - RNA, 14 nt, Homo sapiens
uccagaaagugaca

SEQ ID NO: 1888765 - RNA, 17 nt, Homo sapiens
aucuccacaccaaaguc

SEQ ID NO: 1888766 - RNA, 16 nt, Homo sapiens
cuccacuuggucugug

SEQ ID NO: 1888767 - RNA, 14 nt, Homo sapiens
uaaauaacaggcau

SEQ ID NO: 1888768 - RNA, 19 nt, Homo sapiens
gucaagaucaacauuccag

SEQ ID NO: 1888769 - RNA, 19 nt, Homo sapiens
acacucgccuacuaaguac

SEQ ID NO: 1888770 - RNA, 21 nt, Homo sapiens
uaguauucuugagggacaaug

SEQ ID NO: 1888771 - RNA, 15 nt, Homo sapiens
ucccgaugcugcuau

SEQ ID NO: 1888772 - RNA, 18 nt, Homo sapiens
auuccacacagaaugcaa

SEQ ID NO: 1888773 - RNA, 17 nt, Homo sapiens
acacugcuguacccaga

SEQ ID NO: 1888774 - RNA, 19 nt, Homo sapiens
cuuugguuucugucuguaa

SEQ ID NO: 1888775 - RNA, 22 nt, Homo sapiens
uauggccugacaauaugaauua

SEQ ID NO: 1888776 - RNA, 18 nt, Homo sapiens
agggaugagauacuuaug

SEQ ID NO: 1888777 - RNA, 17 nt, Homo sapiens
cauacacguaaaugcag

SEQ ID NO: 1888778 - RNA, 20 nt, Homo sapiens
aaguucagugauaacucuga

SEQ ID NO: 1888779 - RNA, 14 nt, Homo sapiens
uugcugcuugugau

SEQ ID NO: 1888780 - RNA, 18 nt, Homo sapiens
ccacccuuuccucuuaau

SEQ ID NO: 1888781 - RNA, 18 nt, Homo sapiens
gauuucugguucugaugc

SEQ ID NO: 1888782 - RNA, 20 nt, Homo sapiens
ucuaccaacugucccuuugu

SEQ ID NO: 1888783 - RNA, 14 nt, Homo sapiens
agaagaaagcuuuu

SEQ ID NO: 1888784 - RNA, 14 nt, Homo sapiens
aguaugauccagga

SEQ ID NO: 1888785 - RNA, 17 nt, Homo sapiens
aacauuauucaucucuc

SEQ ID NO: 1888786 - RNA, 12 nt, Homo sapiens
uggaagcacugc

SEQ ID NO: 1888787 - RNA, 12 nt, Homo sapiens
uguaagcacuuc

SEQ ID NO: 1888788 - RNA, 14 nt, Homo sapiens
uaaacaccauuuca

SEQ ID NO: 1888789 - RNA, 20 nt, Homo sapiens
aaauguuugaguauucugca

SEQ ID NO: 1888790 - RNA, 20 nt, Homo sapiens
auaaaauuaugccauagcaa

SEQ ID NO: 1888791 - RNA, 21 nt, Homo sapiens
ccccaaauuuaauuaaagccu

SEQ ID NO: 1888792 - RNA, 14 nt, Homo sapiens
auguucagcacugu

SEQ ID NO: 1888793 - RNA, 19 nt, Homo sapiens
agaacaugguuaccauguc

SEQ ID NO: 1888794 - RNA, 14 nt, Homo sapiens
gcacugagggccac

SEQ ID NO: 1888795 - RNA, 18 nt, Homo sapiens
caccuuaagauuuugcac

SEQ ID NO: 1888796 - RNA, 23 nt, Homo sapiens
uuaaauguuuuuuuuaaucauca

SEQ ID NO: 1888797 - RNA, 22 nt, Homo sapiens
gcagcucaagaacacaugugca

SEQ ID NO: 1888798 - RNA, 14 nt, Homo sapiens
auucauuggugaag

SEQ ID NO: 1888799 - RNA, 21 nt, Homo sapiens
ugcacagaucugcuugaucaa

SEQ ID NO: 1888800 - RNA, 14 nt, Homo sapiens
guagccaugaccuu

SEQ ID NO: 1888801 - RNA, 23 nt, Homo sapiens
ugaaaauauuuguccaauugagu

SEQ ID NO: 1888802 - RNA, 20 nt, Homo sapiens
agauaaagaauaauaauuaa

SEQ ID NO: 1888803 - RNA, 16 nt, Homo sapiens
accaaauucuauacau

SEQ ID NO: 1888804 - RNA, 14 nt, Homo sapiens
uugaaauaccucau

SEQ ID NO: 1888805 - RNA, 18 nt, Homo sapiens
ucaucagcuuugugccac

SEQ ID NO: 1888806 - RNA, 16 nt, Homo sapiens
ugcugaccccaggaag

SEQ ID NO: 1888807 - RNA, 13 nt, Homo sapiens
acauaauguucca

SEQ ID NO: 1888808 - RNA, 22 nt, Homo sapiens
uucuuugacaucauucaugaca

SEQ ID NO: 1888809 - RNA, 16 nt, Homo sapiens
gacaccugcagccuuu

SEQ ID NO: 1888810 - RNA, 16 nt, Homo sapiens
guagcuacaggacauu

SEQ ID NO: 1888811 - RNA, 14 nt, Homo sapiens
acauucucuuccca

SEQ ID NO: 1888812 - RNA, 19 nt, Homo sapiens
ucagaauauucauauugga

SEQ ID NO: 1888813 - RNA, 15 nt, Homo sapiens
acucaguaaggcagu

SEQ ID NO: 1888814 - RNA, 17 nt, Homo sapiens
ugcguuuuauaucuucc

SEQ ID NO: 1888815 - RNA, 16 nt, Homo sapiens
aguaaugaucucaaac

SEQ ID NO: 1888816 - RNA, 15 nt, Homo sapiens
gacggaugauuggau

SEQ ID NO: 1888817 - RNA, 16 nt, Homo sapiens
cacuuuagaaagccag

SEQ ID NO: 1888818 - RNA, 14 nt, Homo sapiens
cauccgcuccguga

SEQ ID NO: 1888819 - RNA, 18 nt, Homo sapiens
ugauuccauuuuacuucc

SEQ ID NO: 1888820 - RNA, 16 nt, Homo sapiens
gacaggaauacuuaac

SEQ ID NO: 1888821 - RNA, 14 nt, Homo sapiens
cacuggacugucua

SEQ ID NO: 1888822 - RNA, 15 nt, Homo sapiens
auugggauacuguaa

SEQ ID NO: 1888823 - RNA, 22 nt, Homo sapiens
accaauguucauagcaacauua

SEQ ID NO: 1888824 - RNA, 23 nt, Homo sapiens
ugugcagggugaagcagcucauu

SEQ ID NO: 1888825 - RNA, 12 nt, Homo sapiens
uugccacuuaac

SEQ ID NO: 1888826 - RNA, 12 nt, Homo sapiens
guagcacugagg

SEQ ID NO: 1888827 - RNA, 15 nt, Homo sapiens
caaaacucugucagg

SEQ ID NO: 1888828 - RNA, 14 nt, Homo sapiens
ucagccuugcacac

SEQ ID NO: 1888829 - RNA, 21 nt, Homo sapiens
acaaaucuucaagguguaaaa

SEQ ID NO: 1888830 - RNA, 20 nt, Homo sapiens
augaacuucagaagugccau

SEQ ID NO: 1888831 - RNA, 21 nt, Homo sapiens
uuaucaugcaaaugcuguauu

SEQ ID NO: 1888832 - RNA, 14 nt, Homo sapiens
agucucauucuguc

SEQ ID NO: 1888833 - RNA, 15 nt, Homo sapiens
ugccagggcuggaag

SEQ ID NO: 1888834 - RNA, 18 nt, Homo sapiens
cauuucccccgagcucuu

SEQ ID NO: 1888835 - RNA, 17 nt, Homo sapiens
ucacugcuuuuuccuua

SEQ ID NO: 1888836 - RNA, 19 nt, Homo sapiens
ugggggaacacugagaaag

SEQ ID NO: 1888837 - RNA, 16 nt, Homo sapiens
ucugcuuucauccagc

SEQ ID NO: 1888838 - RNA, 19 nt, Homo sapiens
cuaauugggggagguguga

SEQ ID NO: 1888839 - RNA, 13 nt, Homo sapiens
gugaaugugggca

SEQ ID NO: 1888840 - RNA, 21 nt, Homo sapiens
uggugccuauuuauucauuca

SEQ ID NO: 1888841 - RNA, 14 nt, Homo sapiens
cuuugccagccauu

SEQ ID NO: 1888842 - RNA, 15 nt, Homo sapiens
uggccagagccucug

SEQ ID NO: 1888843 - RNA, 19 nt, Homo sapiens
caucauggaggucauacau

SEQ ID NO: 1888844 - RNA, 13 nt, Homo sapiens
cacuggcuuccau

SEQ ID NO: 1888845 - RNA, 13 nt, Homo sapiens
acaucuuccacca

SEQ ID NO: 1888846 - RNA, 17 nt, Homo sapiens
cccuauccuuggcacca

SEQ ID NO: 1888847 - RNA, 15 nt, Homo sapiens
ugggccugugcacug

SEQ ID NO: 1888848 - RNA, 22 nt, Homo sapiens
auugucacagcuaccaaagugu

SEQ ID NO: 1888849 - RNA, 20 nt, Homo sapiens
guuucccuccuuggauuucu

SEQ ID NO: 1888850 - RNA, 16 nt, Homo sapiens
auaaacuuauaaucaa

SEQ ID NO: 1888851 - RNA, 16 nt, Homo sapiens
auuaauuuauuauuaa

SEQ ID NO: 1888852 - RNA, 18 nt, Homo sapiens
ugacucccaaguuuccau

SEQ ID NO: 1888853 - RNA, 15 nt, Homo sapiens
gaguggcccaagacu

SEQ ID NO: 1888854 - RNA, 16 nt, Homo sapiens
agguuacaagccugca

SEQ ID NO: 1888855 - RNA, 22 nt, Homo sapiens
ccgagcuuugaaaauucagugg

SEQ ID NO: 1888856 - RNA, 13 nt, Homo sapiens
gugcagucuuuga

SEQ ID NO: 1888857 - RNA, 21 nt, Homo sapiens
uuggaaagaaauuaaagaagg

SEQ ID NO: 1888858 - RNA, 17 nt, Homo sapiens
auauggaauucaaagcu

SEQ ID NO: 1888859 - RNA, 13 nt, Homo sapiens
ucuucagucucua

SEQ ID NO: 1888860 - RNA, 18 nt, Homo sapiens
uaugauucucuugagaua

SEQ ID NO: 1888861 - RNA, 17 nt, Homo sapiens
cuaccagcuaugccaaa

SEQ ID NO: 1888862 - RNA, 22 nt, Homo sapiens
ggauauugguucuuccccucau

SEQ ID NO: 1888863 - RNA, 15 nt, Homo sapiens
gguuaagacaaaggg

SEQ ID NO: 1888864 - RNA, 16 nt, Homo sapiens
aacucacaagugcuca

SEQ ID NO: 1888865 - RNA, 22 nt, Homo sapiens
guacaccagcaggacacugauc

SEQ ID NO: 1888866 - RNA, 23 nt, Homo sapiens
acaacagcaaaacuccaucucaa

SEQ ID NO: 1888867 - RNA, 19 nt, Homo sapiens
ccauuucuugaaaagccuu

SEQ ID NO: 1888868 - RNA, 20 nt, Homo sapiens
caguauauuuauagucacaa

SEQ ID NO: 1888869 - RNA, 13 nt, Homo sapiens
ccuucaucaagaa

SEQ ID NO: 1888870 - RNA, 13 nt, Homo sapiens
aggagccaugaca

SEQ ID NO: 1888871 - RNA, 20 nt, Homo sapiens
ccuauuuaaaaaaauagaaa

SEQ ID NO: 1888872 - RNA, 18 nt, Homo sapiens
ccuguuaacgucaucuca

SEQ ID NO: 1888873 - RNA, 20 nt, Homo sapiens
gagucaacaggucacuugau

SEQ ID NO: 1888874 - RNA, 20 nt, Homo sapiens
uagauuguuuugccacuuag

SEQ ID NO: 1888875 - RNA, 16 nt, Homo sapiens
agccugggcaacaaga

SEQ ID NO: 1888876 - RNA, 19 nt, Homo sapiens
auuuagucaacauauacua

SEQ ID NO: 1888877 - RNA, 20 nt, Homo sapiens
aaaccccaucuccacuaaaa

SEQ ID NO: 1888878 - RNA, 14 nt, Homo sapiens
uuucaaaugaucuu

SEQ ID NO: 1888879 - RNA, 22 nt, Homo sapiens
gccugagugcuuuaccuuuaaa

SEQ ID NO: 1888880 - RNA, 20 nt, Homo sapiens
agccaguagccuaaaucucc

SEQ ID NO: 1888881 - RNA, 22 nt, Homo sapiens
aggaaguaccaagaacagucaa

SEQ ID NO: 1888882 - RNA, 13 nt, Homo sapiens
aauaaucacuugg

SEQ ID NO: 1888883 - RNA, 19 nt, Homo sapiens
ugcuuaguauugacacucu

SEQ ID NO: 1888884 - RNA, 16 nt, Homo sapiens
cccaaccccaguggau

SEQ ID NO: 1888885 - RNA, 17 nt, Homo sapiens
accaugacgcacugcuc

SEQ ID NO: 1888886 - RNA, 23 nt, Homo sapiens
aaacucaugacugagucuggcaa

SEQ ID NO: 1888887 - RNA, 19 nt, Homo sapiens
cguggcuaagaguguccua

SEQ ID NO: 1888888 - RNA, 15 nt, Homo sapiens
ugcuaccccuuugau

SEQ ID NO: 1888889 - RNA, 23 nt, Homo sapiens
uagccuuuaucuaccaacuuuca

SEQ ID NO: 1888890 - RNA, 13 nt, Homo sapiens
agcugagcacagc

SEQ ID NO: 1888891 - RNA, 12 nt, Homo sapiens
agcaaccugccu

SEQ ID NO: 1888892 - RNA, 13 nt, Homo sapiens
guguucauuuuau

SEQ ID NO: 1888893 - RNA, 16 nt, Homo sapiens
guagucccagcacuuu

SEQ ID NO: 1888894 - RNA, 20 nt, Homo sapiens
uccuguuuuugucauguuua

SEQ ID NO: 1888895 - RNA, 19 nt, Homo sapiens
ggaaaccuugcagcauuuu

SEQ ID NO: 1888896 - RNA, 21 nt, Homo sapiens
caugugacauuuauauauuga

SEQ ID NO: 1888897 - RNA, 18 nt, Homo sapiens
ucaagccuguugucuuaa

SEQ ID NO: 1888898 - RNA, 21 nt, Homo sapiens
aaucacuaucuuucugauaac

SEQ ID NO: 1888899 - RNA, 23 nt, Homo sapiens
cuaauuuucuucccaagugcugu

SEQ ID NO: 1888900 - RNA, 21 nt, Homo sapiens
cuugugugugggcugugagug

SEQ ID NO: 1888901 - RNA, 19 nt, Homo sapiens
accaugagaccacuguuau

SEQ ID NO: 1888902 - RNA, 17 nt, Homo sapiens
gaacacaaacacauugu

SEQ ID NO: 1888903 - RNA, 22 nt, Homo sapiens
acauuucucauaccuuccccac

SEQ ID NO: 1888904 - RNA, 19 nt, Homo sapiens
cauagaugaaugaaacccu

SEQ ID NO: 1888905 - RNA, 21 nt, Homo sapiens
ucuacugccuugaaaaaugac

SEQ ID NO: 1888906 - RNA, 23 nt, Homo sapiens
aucauagcucacugcacccucaa

SEQ ID NO: 1888907 - RNA, 18 nt, Homo sapiens
gaaagcaucacuugggau

SEQ ID NO: 1888908 - RNA, 15 nt, Homo sapiens
ccuuaaaaugcauug

SEQ ID NO: 1888909 - RNA, 14 nt, Homo sapiens
ucccaacccauuca

SEQ ID NO: 1888910 - RNA, 15 nt, Homo sapiens
uuguucuuacaguua

SEQ ID NO: 1888911 - RNA, 19 nt, Homo sapiens
ccagauuucagaaaacuga

SEQ ID NO: 1888912 - RNA, 21 nt, Homo sapiens
gcuuuauuuuuuaaguauuua

SEQ ID NO: 1888913 - RNA, 13 nt, Homo sapiens
gaaguaaacugau

SEQ ID NO: 1888914 - RNA, 19 nt, Homo sapiens
caacaaagccaacagucaa

SEQ ID NO: 1888915 - RNA, 19 nt, Homo sapiens
auaaaggaagucaccaaaa

SEQ ID NO: 1888916 - RNA, 12 nt, Homo sapiens
aagaggaccaga

SEQ ID NO: 1888917 - RNA, 17 nt, Homo sapiens
ucccuggaugacauuaa

SEQ ID NO: 1888918 - RNA, 14 nt, Homo sapiens
uucuacugccauuc

SEQ ID NO: 1888919 - RNA, 16 nt, Homo sapiens
guuaguguacuuugaa

SEQ ID NO: 1888920 - RNA, 21 nt, Homo sapiens
ccagcaccuggaggggcacca

SEQ ID NO: 1888921 - RNA, 14 nt, Homo sapiens
uaaaucugugauga

SEQ ID NO: 1888922 - RNA, 15 nt, Homo sapiens
guaacuagcugagca

SEQ ID NO: 1888923 - RNA, 15 nt, Homo sapiens
cagggcuggaagcuu

SEQ ID NO: 1888924 - RNA, 22 nt, Homo sapiens
aacucguguucacucagcacuu

SEQ ID NO: 1888925 - RNA, 21 nt, Homo sapiens
aaguuugucacuaaacucuca

SEQ ID NO: 1888926 - RNA, 20 nt, Homo sapiens
uagauaauacugucuaggaa

SEQ ID NO: 1888927 - RNA, 19 nt, Homo sapiens
cuugccgacuggcugugag

SEQ ID NO: 1888928 - RNA, 19 nt, Homo sapiens
ggaaaacacagccucccug

SEQ ID NO: 1888929 - RNA, 19 nt, Homo sapiens
accuugcugggacuuggau

SEQ ID NO: 1888930 - RNA, 14 nt, Homo sapiens
acccagaacuccau

SEQ ID NO: 1888931 - RNA, 20 nt, Homo sapiens
cagcaccuucuuucuggacu

SEQ ID NO: 1888932 - RNA, 23 nt, Homo sapiens
cuguggccuuuuggaaauccaaa

SEQ ID NO: 1888933 - RNA, 19 nt, Homo sapiens
gaagcuuaaaaucugugaa

SEQ ID NO: 1888934 - RNA, 22 nt, Homo sapiens
agugaaguugugcaacggccag

SEQ ID NO: 1888935 - RNA, 17 nt, Homo sapiens
cagcuaagaugccaugu

SEQ ID NO: 1888936 - RNA, 20 nt, Homo sapiens
acuaaugggaagaccaaaau

SEQ ID NO: 1888937 - RNA, 20 nt, Homo sapiens
ccauacacacuguugucaaa

SEQ ID NO: 1888938 - RNA, 12 nt, Homo sapiens
aagcuauaucua

SEQ ID NO: 1888939 - RNA, 16 nt, Homo sapiens
ucucuuugguguuaca

SEQ ID NO: 1888940 - RNA, 19 nt, Homo sapiens
uaagucuguccauuaucua

SEQ ID NO: 1888941 - RNA, 19 nt, Homo sapiens
gcaaaggucccugagcucu

SEQ ID NO: 1888942 - RNA, 23 nt, Homo sapiens
acccuacuuucuggaaguggagu

SEQ ID NO: 1888943 - RNA, 19 nt, Homo sapiens
ucaggaauacauuuggaaa

SEQ ID NO: 1888944 - RNA, 17 nt, Homo sapiens
cucgggauuaguacaca

SEQ ID NO: 1888945 - RNA, 14 nt, Homo sapiens
cauguauguaggca

SEQ ID NO: 1888946 - RNA, 22 nt, Homo sapiens
uuugagcucccacuucugccag

SEQ ID NO: 1888947 - RNA, 15 nt, Homo sapiens
aaccagucuguguuu

SEQ ID NO: 1888948 - RNA, 20 nt, Homo sapiens
aggcagacgucugucagggg

SEQ ID NO: 1888949 - RNA, 15 nt, Homo sapiens
ggaacuuuagugaaa

SEQ ID NO: 1888950 - RNA, 19 nt, Homo sapiens
cacuaccuucugaccuccc

SEQ ID NO: 1888951 - RNA, 15 nt, Homo sapiens
auugaaguacuuaau

SEQ ID NO: 1888952 - RNA, 20 nt, Homo sapiens
cuggcuuauuuuaaugugau

SEQ ID NO: 1888953 - RNA, 13 nt, Homo sapiens
gcacaaggccuug

SEQ ID NO: 1888954 - RNA, 18 nt, Homo sapiens
cucugcccaggcaaggaa

SEQ ID NO: 1888955 - RNA, 21 nt, Homo sapiens
ggcauuuguaaaaaguagauu

SEQ ID NO: 1888956 - RNA, 13 nt, Homo sapiens
uguaccuuucuaa

SEQ ID NO: 1888957 - RNA, 17 nt, Homo sapiens
caacaucacacaguaua

SEQ ID NO: 1888958 - RNA, 14 nt, Homo sapiens
aaacauaugcauua

SEQ ID NO: 1888959 - RNA, 13 nt, Homo sapiens
uucuaagauucua

SEQ ID NO: 1888960 - RNA, 13 nt, Homo sapiens
ucaaaagaucaaa

SEQ ID NO: 1888961 - RNA, 19 nt, Homo sapiens
gaauaauagaugaugguaa

SEQ ID NO: 1888962 - RNA, 12 nt, Homo sapiens
uggcacccugca

SEQ ID NO: 1888963 - RNA, 19 nt, Homo sapiens
ugucucgcuauacugcacu

SEQ ID NO: 1888964 - RNA, 19 nt, Homo sapiens
caaauccucuucuaacuca

SEQ ID NO: 1888965 - RNA, 17 nt, Homo sapiens
aggcugaggcaggugga

SEQ ID NO: 1888966 - RNA, 16 nt, Homo sapiens
ucaaucaguauucaua

SEQ ID NO: 1888967 - RNA, 15 nt, Homo sapiens
aggucagacuaggau

SEQ ID NO: 1888968 - RNA, 21 nt, Homo sapiens
aucugccaacuguccuacuca

SEQ ID NO: 1888969 - RNA, 18 nt, Homo sapiens
ccuuauccucccuguaac

SEQ ID NO: 1888970 - RNA, 18 nt, Homo sapiens
gaugucuccuaagcaccu

SEQ ID NO: 1888971 - RNA, 20 nt, Homo sapiens
agccccagcugacaccugga

SEQ ID NO: 1888972 - RNA, 19 nt, Homo sapiens
guagugauguuguuuggga

SEQ ID NO: 1888973 - RNA, 15 nt, Homo sapiens
gcuguguuggugugg

SEQ ID NO: 1888974 - RNA, 21 nt, Homo sapiens
gggcaacaauacaugcugcua

SEQ ID NO: 1888975 - RNA, 14 nt, Homo sapiens
uggacagacacugu

SEQ ID NO: 1888976 - RNA, 20 nt, Homo sapiens
cacuaagaauucaaacuggg

SEQ ID NO: 1888977 - RNA, 13 nt, Homo sapiens
acagcaacaucca

SEQ ID NO: 1888978 - RNA, 16 nt, Homo sapiens
ugcgggaucacugggg

SEQ ID NO: 1888979 - RNA, 22 nt, Homo sapiens
auaaagcacccuguaucacaga

SEQ ID NO: 1888980 - RNA, 14 nt, Homo sapiens
uauucuggugucua

SEQ ID NO: 1888981 - RNA, 15 nt, Homo sapiens
aauuugaugccagga

SEQ ID NO: 1888982 - RNA, 19 nt, Homo sapiens
cggcgggagggcgcggggc

SEQ ID NO: 1888983 - RNA, 23 nt, Homo sapiens
cuggcuuguuguaaagcaauaaa

SEQ ID NO: 1888984 - RNA, 19 nt, Homo sapiens
gaugcauucccggugcaga

SEQ ID NO: 1888985 - RNA, 16 nt, Homo sapiens
uccugugccucaucac

SEQ ID NO: 1888986 - RNA, 18 nt, Homo sapiens
cugacuuucucuucuaca

SEQ ID NO: 1888987 - RNA, 12 nt, Homo sapiens
uaauauaaccau

SEQ ID NO: 1888988 - RNA, 17 nt, Homo sapiens
ugaguccuaggacuuaa

SEQ ID NO: 1888989 - RNA, 18 nt, Homo sapiens
cugauacuuauuuaccua

SEQ ID NO: 1888990 - RNA, 16 nt, Homo sapiens
agcaaauuaguaauug

SEQ ID NO: 1888991 - RNA, 14 nt, Homo sapiens
uuaagcugagccac

SEQ ID NO: 1888992 - RNA, 20 nt, Homo sapiens
caccuuucuggacggaacca

SEQ ID NO: 1888993 - RNA, 14 nt, Homo sapiens
caauaaaacacuuu

SEQ ID NO: 1888994 - RNA, 22 nt, Homo sapiens
acugcagggaaaauuauuugca

SEQ ID NO: 1888995 - RNA, 15 nt, Homo sapiens
cucuaagaucuuaga

SEQ ID NO: 1888996 - RNA, 17 nt, Homo sapiens
aggaaucugaaaguaua

SEQ ID NO: 1888997 - RNA, 18 nt, Homo sapiens
gaauaaaguuccugucau

SEQ ID NO: 1888998 - RNA, 13 nt, Homo sapiens
agugaccaaaggu

SEQ ID NO: 1888999 - RNA, 20 nt, Homo sapiens
ccuccugagcagcugggauu

SEQ ID NO: 1889000 - RNA, 13 nt, Homo sapiens
aaauccuuccuaa

SEQ ID NO: 1889001 - RNA, 19 nt, Homo sapiens
auccauauuugcuaagaau

SEQ ID NO: 1889002 - RNA, 18 nt, Homo sapiens
cuguagucccagcuacuu

SEQ ID NO: 1889003 - RNA, 14 nt, Homo sapiens
acaugcuggugcau

SEQ ID NO: 1889004 - RNA, 19 nt, Homo sapiens
caaggucauagacaauucc

SEQ ID NO: 1889005 - RNA, 12 nt, Homo sapiens
gggugucucagg

SEQ ID NO: 1889006 - RNA, 23 nt, Homo sapiens
cuguugaaggacuacagguauuu

SEQ ID NO: 1889007 - RNA, 16 nt, Homo sapiens
cucaguuucuguuguu

SEQ ID NO: 1889008 - RNA, 12 nt, Homo sapiens
cuuaaagccauu

SEQ ID NO: 1889009 - RNA, 23 nt, Homo sapiens
uguuagggcuaucucaggcaaua

SEQ ID NO: 1889010 - RNA, 22 nt, Homo sapiens
guuucacaaaauuaaguguugu

SEQ ID NO: 1889011 - RNA, 19 nt, Homo sapiens
gccaguuugcuuaguucuc

SEQ ID NO: 1889012 - RNA, 13 nt, Homo sapiens
aacuagcagauuu

SEQ ID NO: 1889013 - RNA, 18 nt, Homo sapiens
acaggacuaacacucaga

SEQ ID NO: 1889014 - RNA, 13 nt, Homo sapiens
cuccugggacaac

SEQ ID NO: 1889015 - RNA, 16 nt, Homo sapiens
cccagcaacacaagcu

SEQ ID NO: 1889016 - RNA, 14 nt, Homo sapiens
acucagaggaccca

SEQ ID NO: 1889017 - RNA, 15 nt, Homo sapiens
aaaauuacagacaaa

SEQ ID NO: 1889018 - RNA, 15 nt, Homo sapiens
cacacguuccacgac

SEQ ID NO: 1889019 - RNA, 19 nt, Homo sapiens
uauaaagaaauaccugaga

SEQ ID NO: 1889020 - RNA, 16 nt, Homo sapiens
auuaugucguaaguca

SEQ ID NO: 1889021 - RNA, 13 nt, Homo sapiens
gaagugacaggac

SEQ ID NO: 1889022 - RNA, 15 nt, Homo sapiens
cucuucuguaaaaug

SEQ ID NO: 1889023 - RNA, 18 nt, Homo sapiens
uccccuucucucaucucu

SEQ ID NO: 1889024 - RNA, 17 nt, Homo sapiens
caaaauuaauacauucu

SEQ ID NO: 1889025 - RNA, 13 nt, Homo sapiens
aagcucuguguaa

SEQ ID NO: 1889026 - RNA, 15 nt, Homo sapiens
ugcuuuuucucagcc

SEQ ID NO: 1889027 - RNA, 14 nt, Homo sapiens
uaucccuacaugua

SEQ ID NO: 1889028 - RNA, 10 nt, Homo sapiens
uccagccaca

SEQ ID NO: 1889029 - RNA, 22 nt, Homo sapiens
acugguccagcucugacauccc

SEQ ID NO: 1889030 - RNA, 16 nt, Homo sapiens
cuguaauugaauauaa

SEQ ID NO: 1889031 - RNA, 19 nt, Homo sapiens
ucucgcaguacauguuacu

SEQ ID NO: 1889032 - RNA, 15 nt, Homo sapiens
uuugggcaucagaaa

SEQ ID NO: 1889033 - RNA, 19 nt, Homo sapiens
augaugucguuugaaucac

SEQ ID NO: 1889034 - RNA, 16 nt, Homo sapiens
uaagguagaacuugag

SEQ ID NO: 1889035 - RNA, 17 nt, Homo sapiens
ugcugcucuucauccca

SEQ ID NO: 1889036 - RNA, 17 nt, Homo sapiens
gacguuugacuagccau

SEQ ID NO: 1889037 - RNA, 15 nt, Homo sapiens
cugaccauugcccua

SEQ ID NO: 1889038 - RNA, 13 nt, Homo sapiens
cuuuuccaaacau

SEQ ID NO: 1889039 - RNA, 19 nt, Homo sapiens
ucuauugucgcuaugugac

SEQ ID NO: 1889040 - RNA, 22 nt, Homo sapiens
uaaacccagcucccuucuuccc

SEQ ID NO: 1889041 - RNA, 23 nt, Homo sapiens
auauguccucuuuuguuguuucu

SEQ ID NO: 1889042 - RNA, 12 nt, Homo sapiens
uguucaauguuu

SEQ ID NO: 1889043 - RNA, 13 nt, Homo sapiens
uacagauccugca

SEQ ID NO: 1889044 - RNA, 23 nt, Homo sapiens
cuuaagaauaugcugacuucacu

SEQ ID NO: 1889045 - RNA, 15 nt, Homo sapiens
acuccuccuagccac

SEQ ID NO: 1889046 - RNA, 23 nt, Homo sapiens
auccuaagacuaacaaaggcagc

SEQ ID NO: 1889047 - RNA, 23 nt, Homo sapiens
ugggcaacagagcaagacuccau

SEQ ID NO: 1889048 - RNA, 15 nt, Homo sapiens
aaccagacucuguaa

SEQ ID NO: 1889049 - RNA, 21 nt, Homo sapiens
agaccaggagggcacuggagc

SEQ ID NO: 1889050 - RNA, 17 nt, Homo sapiens
cccagcuguagccaugg

SEQ ID NO: 1889051 - RNA, 16 nt, Homo sapiens
aagcaccucaagugca

SEQ ID NO: 1889052 - RNA, 20 nt, Homo sapiens
ggcccuuuucuuacaguaac

SEQ ID NO: 1889053 - RNA, 21 nt, Homo sapiens
uccagagguggaggugggcug

SEQ ID NO: 1889054 - RNA, 13 nt, Homo sapiens
ccauugcauucau

SEQ ID NO: 1889055 - RNA, 21 nt, Homo sapiens
cuccuggaccuugacagagca

SEQ ID NO: 1889056 - RNA, 21 nt, Homo sapiens
gacaaaauagcccagccuuuu

SEQ ID NO: 1889057 - RNA, 18 nt, Homo sapiens
gaguuuggaugucuguag

SEQ ID NO: 1889058 - RNA, 21 nt, Homo sapiens
aacaacuuguacuuguuucau

SEQ ID NO: 1889059 - RNA, 21 nt, Homo sapiens
aucagccauaagaaagcacua

SEQ ID NO: 1889060 - RNA, 22 nt, Homo sapiens
uggaaucacaaaccaagccaug

SEQ ID NO: 1889061 - RNA, 19 nt, Homo sapiens
cguuggugcaagugugcau

SEQ ID NO: 1889062 - RNA, 17 nt, Homo sapiens
acauuuggacauuucca

SEQ ID NO: 1889063 - RNA, 12 nt, Homo sapiens
agacaaacugca

SEQ ID NO: 1889064 - RNA, 13 nt, Homo sapiens
uccuauacucuau

SEQ ID NO: 1889065 - RNA, 19 nt, Homo sapiens
ucaaacgaugugcaauaca

SEQ ID NO: 1889066 - RNA, 15 nt, Homo sapiens
cuauuacuaguacua

SEQ ID NO: 1889067 - RNA, 16 nt, Homo sapiens
ugaaauugaaccuuug

SEQ ID NO: 1889068 - RNA, 21 nt, Homo sapiens
guaaauguuaucuuauacugu

SEQ ID NO: 1889069 - RNA, 13 nt, Homo sapiens
cucuagaacagcc

SEQ ID NO: 1889070 - RNA, 21 nt, Homo sapiens
augguacuaguguuuuuuaga

SEQ ID NO: 1889071 - RNA, 15 nt, Homo sapiens
agaaaagacacuuca

SEQ ID NO: 1889072 - RNA, 16 nt, Homo sapiens
gaaccuaauaaauauu

SEQ ID NO: 1889073 - RNA, 15 nt, Homo sapiens
uuagugauggagcuu

SEQ ID NO: 1889074 - RNA, 13 nt, Homo sapiens
uggcccagaugau

SEQ ID NO: 1889075 - RNA, 12 nt, Homo sapiens
cauucuuuugca

SEQ ID NO: 1889076 - RNA, 21 nt, Homo sapiens
uugaacugccaagaaaaggca

SEQ ID NO: 1889077 - RNA, 15 nt, Homo sapiens
ucagccuccugagua

SEQ ID NO: 1889078 - RNA, 21 nt, Homo sapiens
guucagugugcugaucauuca

SEQ ID NO: 1889079 - RNA, 18 nt, Homo sapiens
gaugaaaaugaaucuuca

SEQ ID NO: 1889080 - RNA, 14 nt, Homo sapiens
ucuuuuugaaauca

SEQ ID NO: 1889081 - RNA, 19 nt, Homo sapiens
cggccagccuugcacugug

SEQ ID NO: 1889082 - RNA, 18 nt, Homo sapiens
cacaggcuccaaacugga

SEQ ID NO: 1889083 - RNA, 12 nt, Homo sapiens
acauaugcauuu

SEQ ID NO: 1889084 - RNA, 23 nt, Homo sapiens
gggauuuuuggcuacacacaaac

SEQ ID NO: 1889085 - RNA, 15 nt, Homo sapiens
aggcaaaguggaaug

SEQ ID NO: 1889086 - RNA, 19 nt, Homo sapiens
agccucuuagaugcaguuc

SEQ ID NO: 1889087 - RNA, 14 nt, Homo sapiens
uuguauaugcugca

SEQ ID NO: 1889088 - RNA, 17 nt, Homo sapiens
aucuuaagauuccauuu

SEQ ID NO: 1889089 - RNA, 17 nt, Homo sapiens
gaacuuuaagucucacc

SEQ ID NO: 1889090 - RNA, 17 nt, Homo sapiens
augucugaaaaaugccu

SEQ ID NO: 1889091 - RNA, 22 nt, Homo sapiens
aaggucuucagauuucuugcau

SEQ ID NO: 1889092 - RNA, 15 nt, Homo sapiens
aacagccucacuccu

SEQ ID NO: 1889093 - RNA, 22 nt, Homo sapiens
gggaaacuuagaucaucaguca

SEQ ID NO: 1889094 - RNA, 21 nt, Homo sapiens
ugaaaaaggcaagccacagaa

SEQ ID NO: 1889095 - RNA, 19 nt, Homo sapiens
auugcugcaccaaugcacu

SEQ ID NO: 1889096 - RNA, 18 nt, Homo sapiens
aagucauuuuaacuuuau

SEQ ID NO: 1889097 - RNA, 20 nt, Homo sapiens
aacccuggagaguucaaugg

SEQ ID NO: 1889098 - RNA, 20 nt, Homo sapiens
uccugaucgccaaccuuucc

SEQ ID NO: 1889099 - RNA, 20 nt, Homo sapiens
cucucacuaaguaugaucua

SEQ ID NO: 1889100 - RNA, 14 nt, Homo sapiens
auccuaagcaaaaa

SEQ ID NO: 1889101 - RNA, 21 nt, Homo sapiens
ccaggcuucugcuggggccug

SEQ ID NO: 1889102 - RNA, 23 nt, Homo sapiens
uccugaagggaaggcaaaggcag

SEQ ID NO: 1889103 - RNA, 23 nt, Homo sapiens
uguucccccuaaacauggcuguu

SEQ ID NO: 1889104 - RNA, 23 nt, Homo sapiens
cuuuaauuguaucuccuucagaa

SEQ ID NO: 1889105 - RNA, 17 nt, Homo sapiens
agcccagccacauuuca

SEQ ID NO: 1889106 - RNA, 14 nt, Homo sapiens
cagggcccaagucc

SEQ ID NO: 1889107 - RNA, 22 nt, Homo sapiens
uucauucuggaggggcagugga

SEQ ID NO: 1889108 - RNA, 17 nt, Homo sapiens
gcaucucugaacauuuc

SEQ ID NO: 1889109 - RNA, 15 nt, Homo sapiens
ccaucccaguguccu

SEQ ID NO: 1889110 - RNA, 12 nt, Homo sapiens
aaccagugcaga

SEQ ID NO: 1889111 - RNA, 19 nt, Homo sapiens
cugagccacagcagcauuu

SEQ ID NO: 1889112 - RNA, 11 nt, Homo sapiens
acaacuuucaa

SEQ ID NO: 1889113 - RNA, 12 nt, Homo sapiens
agaugggugauu

SEQ ID NO: 1889114 - RNA, 23 nt, Homo sapiens
accaucuaaucuaugcauguaug

SEQ ID NO: 1889115 - RNA, 17 nt, Homo sapiens
ugaccagcagaucccag

SEQ ID NO: 1889116 - RNA, 17 nt, Homo sapiens
agaauacaaugggaaaa

SEQ ID NO: 1889117 - RNA, 22 nt, Homo sapiens
ugaggugcaaggaguguaaaau

SEQ ID NO: 1889118 - RNA, 15 nt, Homo sapiens
agaaaggcacauauu

SEQ ID NO: 1889119 - RNA, 20 nt, Homo sapiens
aucccuuuguccacaaguaa

SEQ ID NO: 1889120 - RNA, 13 nt, Homo sapiens
cuauagcucagga

SEQ ID NO: 1889121 - RNA, 12 nt, Homo sapiens
uuggacuggaaa

SEQ ID NO: 1889122 - RNA, 20 nt, Homo sapiens
ucaacucacagcuucuccaa

SEQ ID NO: 1889123 - RNA, 13 nt, Homo sapiens
gcgggcuugacug

SEQ ID NO: 1889124 - RNA, 18 nt, Homo sapiens
cagaacacgagacagcuu

SEQ ID NO: 1889125 - RNA, 13 nt, Homo sapiens
agagcagcugcca

SEQ ID NO: 1889126 - RNA, 14 nt, Homo sapiens
aauuacugccuuac

SEQ ID NO: 1889127 - RNA, 14 nt, Homo sapiens
acauugugcaauug

SEQ ID NO: 1889128 - RNA, 17 nt, Homo sapiens
gggaggcacacuuucug

SEQ ID NO: 1889129 - RNA, 19 nt, Homo sapiens
ggucaaaucccaaaccauu

SEQ ID NO: 1889130 - RNA, 16 nt, Homo sapiens
auaucccuaugcugcc

SEQ ID NO: 1889131 - RNA, 21 nt, Homo sapiens
acucacuuuucccacuccaag

SEQ ID NO: 1889132 - RNA, 19 nt, Homo sapiens
cugcaaaaggccugugauc

SEQ ID NO: 1889133 - RNA, 14 nt, Homo sapiens
ugauauauuuucca

SEQ ID NO: 1889134 - RNA, 16 nt, Homo sapiens
auguguccaagacaca

SEQ ID NO: 1889135 - RNA, 18 nt, Homo sapiens
acagaccaccuuucacaa

SEQ ID NO: 1889136 - RNA, 16 nt, Homo sapiens
cuaauaaaauaucauu

SEQ ID NO: 1889137 - RNA, 20 nt, Homo sapiens
acugagauuuugguauuaca

SEQ ID NO: 1889138 - RNA, 23 nt, Homo sapiens
uuggaggaauuuucuaaaagcca

SEQ ID NO: 1889139 - RNA, 22 nt, Homo sapiens
auucauaaccaaacacaaugau

SEQ ID NO: 1889140 - RNA, 18 nt, Homo sapiens
cauaaagaagcaauaaag

SEQ ID NO: 1889141 - RNA, 20 nt, Homo sapiens
aagagagggcugagccaugg

SEQ ID NO: 1889142 - RNA, 22 nt, Homo sapiens
ggcggugggcacccacccuggg

SEQ ID NO: 1889143 - RNA, 13 nt, Homo sapiens
ggcucaugaccug

SEQ ID NO: 1889144 - RNA, 18 nt, Homo sapiens
gacccauugcuguugucc

SEQ ID NO: 1889145 - RNA, 15 nt, Homo sapiens
caggccagugucugg

SEQ ID NO: 1889146 - RNA, 14 nt, Homo sapiens
ccaacguacuccuc

SEQ ID NO: 1889147 - RNA, 23 nt, Homo sapiens
auuugucauaauuuuuccucuuu

SEQ ID NO: 1889148 - RNA, 15 nt, Homo sapiens
cuacuaaaaacacaa

SEQ ID NO: 1889149 - RNA, 20 nt, Homo sapiens
agccaaguuuuaaauauuau

SEQ ID NO: 1889150 - RNA, 19 nt, Homo sapiens
uaaugcacauccucauuca

SEQ ID NO: 1889151 - RNA, 19 nt, Homo sapiens
gccccguaguugcucuuuc

SEQ ID NO: 1889152 - RNA, 23 nt, Homo sapiens
aaucuaccaacgaaagacgugau

SEQ ID NO: 1889153 - RNA, 17 nt, Homo sapiens
ggaauucacccucucau

SEQ ID NO: 1889154 - RNA, 21 nt, Homo sapiens
guuccaaacccuccugggaag

SEQ ID NO: 1889155 - RNA, 16 nt, Homo sapiens
aauuuggcauugaucu

SEQ ID NO: 1889156 - RNA, 19 nt, Homo sapiens
agaggagauuggccaguga

SEQ ID NO: 1889157 - RNA, 23 nt, Homo sapiens
caccugccccgucccccuagaga

SEQ ID NO: 1889158 - RNA, 19 nt, Homo sapiens
uugagaaauaaagcacauu

SEQ ID NO: 1889159 - RNA, 22 nt, Homo sapiens
acugggacaggggagaaccuag

SEQ ID NO: 1889160 - RNA, 16 nt, Homo sapiens
agggcauaucggcuca

SEQ ID NO: 1889161 - RNA, 16 nt, Homo sapiens
uggcuccucuacuguu

SEQ ID NO: 1889162 - RNA, 14 nt, Homo sapiens
aaaaucaccaucuu

SEQ ID NO: 1889163 - RNA, 22 nt, Homo sapiens
aaaaagggauccguacauucaa

SEQ ID NO: 1889164 - RNA, 14 nt, Homo sapiens
guucagaugugcau

SEQ ID NO: 1889165 - RNA, 16 nt, Homo sapiens
cccuuccuuaugucuc

SEQ ID NO: 1889166 - RNA, 15 nt, Homo sapiens
guugcugacuuagaa

SEQ ID NO: 1889167 - RNA, 15 nt, Homo sapiens
cacugucaugcccag

SEQ ID NO: 1889168 - RNA, 22 nt, Homo sapiens
gggccuuaucgggcuccagcca

SEQ ID NO: 1889169 - RNA, 23 nt, Homo sapiens
uccacugauggaaacaaagugga

SEQ ID NO: 1889170 - RNA, 21 nt, Homo sapiens
cagcuuuuucucucaggguuc

SEQ ID NO: 1889171 - RNA, 16 nt, Homo sapiens
cagcgauucccugugu

SEQ ID NO: 1889172 - RNA, 23 nt, Homo sapiens
ucauucaacucuccaauguucua

SEQ ID NO: 1889173 - RNA, 16 nt, Homo sapiens
aggcccccacuugccu

SEQ ID NO: 1889174 - RNA, 15 nt, Homo sapiens
agggcuggggacaga

SEQ ID NO: 1889175 - RNA, 16 nt, Homo sapiens
uguaauggaagcuacc

SEQ ID NO: 1889176 - RNA, 15 nt, Homo sapiens
uuaugugaacaacug

SEQ ID NO: 1889177 - RNA, 21 nt, Homo sapiens
acacacccacuaaggagaaag

SEQ ID NO: 1889178 - RNA, 20 nt, Homo sapiens
cuauuccccccaccuaacuc

SEQ ID NO: 1889179 - RNA, 16 nt, Homo sapiens
gugccaugagggcaga

SEQ ID NO: 1889180 - RNA, 16 nt, Homo sapiens
caaauugcuucuagga

SEQ ID NO: 1889181 - RNA, 22 nt, Homo sapiens
caacacaugagacuuacugcuc

SEQ ID NO: 1889182 - RNA, 16 nt, Homo sapiens
cugucagaggcuaaga

SEQ ID NO: 1889183 - RNA, 22 nt, Homo sapiens
agugagguucuuguaccacuuc

SEQ ID NO: 1889184 - RNA, 23 nt, Homo sapiens
ggacuacauuuugcucugugaac

SEQ ID NO: 1889185 - RNA, 18 nt, Homo sapiens
gaacccaaauccaagcuu

SEQ ID NO: 1889186 - RNA, 22 nt, Homo sapiens
gugaccacagccuuaccaaagc

SEQ ID NO: 1889187 - RNA, 13 nt, Homo sapiens
gcauagcuuucac

SEQ ID NO: 1889188 - RNA, 11 nt, Homo sapiens
uauuaccuccc

SEQ ID NO: 1889189 - RNA, 16 nt, Homo sapiens
ugagauugcaccacug

SEQ ID NO: 1889190 - RNA, 22 nt, Homo sapiens
ccuagugucuauucccuggaau

SEQ ID NO: 1889191 - RNA, 17 nt, Homo sapiens
cccaaggccccagggac

SEQ ID NO: 1889192 - RNA, 16 nt, Homo sapiens
gcccuuauggccaaua

SEQ ID NO: 1889193 - RNA, 16 nt, Homo sapiens
ccaaagugacacagag

SEQ ID NO: 1889194 - RNA, 21 nt, Homo sapiens
aaaauauaguguuguguuaca

SEQ ID NO: 1889195 - RNA, 20 nt, Homo sapiens
cacuaaccaugucuccaugu

SEQ ID NO: 1889196 - RNA, 16 nt, Homo sapiens
uagaucaucagucacc

SEQ ID NO: 1889197 - RNA, 22 nt, Homo sapiens
auuaaauuuuaauguaaaauuc

SEQ ID NO: 1889198 - RNA, 14 nt, Homo sapiens
caaaacgacacugc

SEQ ID NO: 1889199 - RNA, 13 nt, Homo sapiens
cuucucucugagc

SEQ ID NO: 1889200 - RNA, 15 nt, Homo sapiens
ucaggcuugugacau

SEQ ID NO: 1889201 - RNA, 12 nt, Homo sapiens
uuauuaaucuga

SEQ ID NO: 1889202 - RNA, 14 nt, Homo sapiens
aucaguauugugaa

SEQ ID NO: 1889203 - RNA, 13 nt, Homo sapiens
cuugguguugccc

SEQ ID NO: 1889204 - RNA, 23 nt, Homo sapiens
ccucugaucaaagcaccuugaau

SEQ ID NO: 1889205 - RNA, 19 nt, Homo sapiens
gcaggucuggaggggccau

SEQ ID NO: 1889206 - RNA, 17 nt, Homo sapiens
ucacagucaauggaucc

SEQ ID NO: 1889207 - RNA, 16 nt, Homo sapiens
aauuauaagagacuua

SEQ ID NO: 1889208 - RNA, 13 nt, Homo sapiens
augugucaaauac

SEQ ID NO: 1889209 - RNA, 19 nt, Homo sapiens
ugcucauugcuaaccacug

SEQ ID NO: 1889210 - RNA, 11 nt, Homo sapiens
acccaaaacag

SEQ ID NO: 1889211 - RNA, 14 nt, Homo sapiens
ggggaggccaagug

SEQ ID NO: 1889212 - RNA, 14 nt, Homo sapiens
augggaacacuggu

SEQ ID NO: 1889213 - RNA, 21 nt, Homo sapiens
ugccuuaaagauacaaucugg

SEQ ID NO: 1889214 - RNA, 12 nt, Homo sapiens
ucuugaaaaaga

SEQ ID NO: 1889215 - RNA, 19 nt, Homo sapiens
ggcucccggagggcccuga

SEQ ID NO: 1889216 - RNA, 17 nt, Homo sapiens
aaaaaccaacaauguga

SEQ ID NO: 1889217 - RNA, 17 nt, Homo sapiens
ggaaaauuucacauuaa

SEQ ID NO: 1889218 - RNA, 17 nt, Homo sapiens
aguuguuuuuauucuuc

SEQ ID NO: 1889219 - RNA, 14 nt, Homo sapiens
cucuugcucaguga

SEQ ID NO: 1889220 - RNA, 14 nt, Homo sapiens
uauugguaaauucu

SEQ ID NO: 1889221 - RNA, 16 nt, Homo sapiens
gaauuauaaaagccag

SEQ ID NO: 1889222 - RNA, 19 nt, Homo sapiens
cagccuucacuggagaccg

SEQ ID NO: 1889223 - RNA, 17 nt, Homo sapiens
caccaccugacgcugca

SEQ ID NO: 1889224 - RNA, 12 nt, Homo sapiens
gcaucuccagug

SEQ ID NO: 1889225 - RNA, 19 nt, Homo sapiens
ccuuucccccuucucuuag

SEQ ID NO: 1889226 - RNA, 18 nt, Homo sapiens
ucuuaauauaacugccuu

SEQ ID NO: 1889227 - RNA, 21 nt, Homo sapiens
cucauuuucaucuucuuccau

SEQ ID NO: 1889228 - RNA, 19 nt, Homo sapiens
aaaaucaccaucuuuguca

SEQ ID NO: 1889229 - RNA, 16 nt, Homo sapiens
ugucacccaaagccug

SEQ ID NO: 1889230 - RNA, 16 nt, Homo sapiens
uucugggacacaguuc

SEQ ID NO: 1889231 - RNA, 21 nt, Homo sapiens
ccugauauagaucacauaaca

SEQ ID NO: 1889232 - RNA, 19 nt, Homo sapiens
uccuguguggaagaaggaa

SEQ ID NO: 1889233 - RNA, 15 nt, Homo sapiens
acuagcucuguauua

SEQ ID NO: 1889234 - RNA, 17 nt, Homo sapiens
aucacuauugcuuccua

SEQ ID NO: 1889235 - RNA, 20 nt, Homo sapiens
gauauaacacuauguuuauu

SEQ ID NO: 1889236 - RNA, 17 nt, Homo sapiens
augccuuuuuuuccaug

SEQ ID NO: 1889237 - RNA, 16 nt, Homo sapiens
gcaguccccagugauu

SEQ ID NO: 1889238 - RNA, 21 nt, Homo sapiens
gcaggccucaugccucgcuca

SEQ ID NO: 1889239 - RNA, 14 nt, Homo sapiens
aaguaauugugaaa

SEQ ID NO: 1889240 - RNA, 16 nt, Homo sapiens
cauuggagagcugucu

SEQ ID NO: 1889241 - RNA, 12 nt, Homo sapiens
ugcaguaucucu

SEQ ID NO: 1889242 - RNA, 15 nt, Homo sapiens
uccuacacacucuga

SEQ ID NO: 1889243 - RNA, 18 nt, Homo sapiens
caguaaagaguacacuca

SEQ ID NO: 1889244 - RNA, 14 nt, Homo sapiens
uucugaaugugauc

SEQ ID NO: 1889245 - RNA, 15 nt, Homo sapiens
agcagugauuguuau

SEQ ID NO: 1889246 - RNA, 11 nt, Homo sapiens
cacaucucagg

SEQ ID NO: 1889247 - RNA, 17 nt, Homo sapiens
aacuagaaaucugccaa

SEQ ID NO: 1889248 - RNA, 17 nt, Homo sapiens
acaugcuaaugacgaca

SEQ ID NO: 1889249 - RNA, 23 nt, Homo sapiens
ugucguuucccucccaacagagc

SEQ ID NO: 1889250 - RNA, 13 nt, Homo sapiens
uaaaucugugaug

SEQ ID NO: 1889251 - RNA, 13 nt, Homo sapiens
uauuucuguguag

SEQ ID NO: 1889252 - RNA, 19 nt, Homo sapiens
cagccucugccgcugccau

SEQ ID NO: 1889253 - RNA, 13 nt, Homo sapiens
cacuucaucugau

SEQ ID NO: 1889254 - RNA, 15 nt, Homo sapiens
ccuguugcaccucag

SEQ ID NO: 1889255 - RNA, 13 nt, Homo sapiens
guuagauguccuc

SEQ ID NO: 1889256 - RNA, 13 nt, Homo sapiens
acacccaggugau

SEQ ID NO: 1889257 - RNA, 14 nt, Homo sapiens
uccuguguaccucu

SEQ ID NO: 1889258 - RNA, 22 nt, Homo sapiens
auaguguauaugcuaacuggau

SEQ ID NO: 1889259 - RNA, 16 nt, Homo sapiens
gaccacggggagcaaa

SEQ ID NO: 1889260 - RNA, 22 nt, Homo sapiens
uguacauaugugugugugggua

SEQ ID NO: 1889261 - RNA, 22 nt, Homo sapiens
augagcugaucugcggaucuca

SEQ ID NO: 1889262 - RNA, 17 nt, Homo sapiens
augcuggccuguggcag

SEQ ID NO: 1889263 - RNA, 16 nt, Homo sapiens
uaaugaggcauuacaa

SEQ ID NO: 1889264 - RNA, 17 nt, Homo sapiens
caaauauucuccauggg

SEQ ID NO: 1889265 - RNA, 24 nt, Homo sapiens
gagagugcugagaaggacaccucc

SEQ ID NO: 1889266 - RNA, 18 nt, Homo sapiens
aggggagaguaacccugu

SEQ ID NO: 1889267 - RNA, 20 nt, Homo sapiens
auuuaacuuacacugaucaa

SEQ ID NO: 1889268 - RNA, 12 nt, Homo sapiens
aucucagcacuu

SEQ ID NO: 1889269 - RNA, 16 nt, Homo sapiens
accucuccauccugcu

SEQ ID NO: 1889270 - RNA, 16 nt, Homo sapiens
gaauccccacagggaa

SEQ ID NO: 1889271 - RNA, 22 nt, Homo sapiens
uggaggaacugcuugugcacug

SEQ ID NO: 1889272 - RNA, 12 nt, Homo sapiens
aacagcauuuag

SEQ ID NO: 1889273 - RNA, 22 nt, Homo sapiens
uuggauucugagagcugugcau

SEQ ID NO: 1889274 - RNA, 15 nt, Homo sapiens
caugaugcuaaaggc

SEQ ID NO: 1889275 - RNA, 16 nt, Homo sapiens
uccuugcacauaguag

SEQ ID NO: 1889276 - RNA, 15 nt, Homo sapiens
uaaggacauuuccca

SEQ ID NO: 1889277 - RNA, 17 nt, Homo sapiens
uuugugugcgucacugu

SEQ ID NO: 1889278 - RNA, 22 nt, Homo sapiens
auuucaugugcggggaucaucu

SEQ ID NO: 1889279 - RNA, 22 nt, Homo sapiens
aaguguaaauagaagaguuuaa

SEQ ID NO: 1889280 - RNA, 18 nt, Homo sapiens
ucauucuuauuucaugaa

SEQ ID NO: 1889281 - RNA, 15 nt, Homo sapiens
caaaugggucccuca

SEQ ID NO: 1889282 - RNA, 22 nt, Homo sapiens
gaacaaugccgccugucaauaa

SEQ ID NO: 1889283 - RNA, 17 nt, Homo sapiens
cucuuccaggaagcaca

SEQ ID NO: 1889284 - RNA, 22 nt, Homo sapiens
aaaaacuacagcaucauugcau

SEQ ID NO: 1889285 - RNA, 20 nt, Homo sapiens
auucugauguuucugugaaa

SEQ ID NO: 1889286 - RNA, 18 nt, Homo sapiens
caggaucuuugacugaaa

SEQ ID NO: 1889287 - RNA, 22 nt, Homo sapiens
uagcagagacuuuagucuuugg

SEQ ID NO: 1889288 - RNA, 18 nt, Homo sapiens
uggaccaaggugaagcaa

SEQ ID NO: 1889289 - RNA, 12 nt, Homo sapiens
uaaugugugaga

SEQ ID NO: 1889290 - RNA, 14 nt, Homo sapiens
ucaaauugaucugc

SEQ ID NO: 1889291 - RNA, 23 nt, Homo sapiens
gcaugaauuccaacucacuuuuu

SEQ ID NO: 1889292 - RNA, 20 nt, Homo sapiens
uacuauucuguuaaaaucag

SEQ ID NO: 1889293 - RNA, 15 nt, Homo sapiens
ggaugucucucauga

SEQ ID NO: 1889294 - RNA, 15 nt, Homo sapiens
uaaaucaaugcuaua

SEQ ID NO: 1889295 - RNA, 15 nt, Homo sapiens
gcacagaagacagca

SEQ ID NO: 1889296 - RNA, 21 nt, Homo sapiens
guuuauaaugaagaacacugu

SEQ ID NO: 1889297 - RNA, 18 nt, Homo sapiens
caaguaaaagaaaagccg

SEQ ID NO: 1889298 - RNA, 15 nt, Homo sapiens
gacaccgaguuccac

SEQ ID NO: 1889299 - RNA, 18 nt, Homo sapiens
cggcuccuggugcuaaca

SEQ ID NO: 1889300 - RNA, 23 nt, Homo sapiens
acaauaagccacgaggugcagua

SEQ ID NO: 1889301 - RNA, 20 nt, Homo sapiens
aaggggcaacaaaugcauca

SEQ ID NO: 1889302 - RNA, 16 nt, Homo sapiens
cuucauguaacuauag

SEQ ID NO: 1889303 - RNA, 22 nt, Homo sapiens
acuuugucccguggcauuucaa

SEQ ID NO: 1889304 - RNA, 15 nt, Homo sapiens
uucaccagagcauuu

SEQ ID NO: 1889305 - RNA, 19 nt, Homo sapiens
aaacuuaagccaauuucaa

SEQ ID NO: 1889306 - RNA, 15 nt, Homo sapiens
gucuugaacuccuga

SEQ ID NO: 1889307 - RNA, 15 nt, Homo sapiens
cacuugcagaccugc

SEQ ID NO: 1889308 - RNA, 14 nt, Homo sapiens
gcugcacuccauga

SEQ ID NO: 1889309 - RNA, 12 nt, Homo sapiens
accugcacuuca

SEQ ID NO: 1889310 - RNA, 14 nt, Homo sapiens
ggaauaauccagaa

SEQ ID NO: 1889311 - RNA, 15 nt, Homo sapiens
caugaggacuaggag

SEQ ID NO: 1889312 - RNA, 20 nt, Homo sapiens
cagauguacaauuuagcuua

SEQ ID NO: 1889313 - RNA, 18 nt, Homo sapiens
auguguuaucuaccucaa

SEQ ID NO: 1889314 - RNA, 20 nt, Homo sapiens
guggcacucaacucugagcc

SEQ ID NO: 1889315 - RNA, 20 nt, Homo sapiens
ggugcacuuuucugugucau

SEQ ID NO: 1889316 - RNA, 15 nt, Homo sapiens
augcauaugauauau

SEQ ID NO: 1889317 - RNA, 15 nt, Homo sapiens
gauauuuuaugcaaa

SEQ ID NO: 1889318 - RNA, 22 nt, Homo sapiens
ucuuguaaaacugugacauucc

SEQ ID NO: 1889319 - RNA, 17 nt, Homo sapiens
ccuaaggcacccacaaa

SEQ ID NO: 1889320 - RNA, 21 nt, Homo sapiens
ugcuaauuugccacaggagcu

SEQ ID NO: 1889321 - RNA, 14 nt, Homo sapiens
agucuguuggcaau

SEQ ID NO: 1889322 - RNA, 21 nt, Homo sapiens
caaaauuaagcaaauguuaaa

SEQ ID NO: 1889323 - RNA, 16 nt, Homo sapiens
ccggggcuccacugaa

SEQ ID NO: 1889324 - RNA, 19 nt, Homo sapiens
gauguacauuacagauuaa

SEQ ID NO: 1889325 - RNA, 18 nt, Homo sapiens
ccacaaagaguaguuaaa

SEQ ID NO: 1889326 - RNA, 21 nt, Homo sapiens
uagguauguagcaguaucuca

SEQ ID NO: 1889327 - RNA, 15 nt, Homo sapiens
acaggcacacaccac

SEQ ID NO: 1889328 - RNA, 12 nt, Homo sapiens
gacugcucaggc

SEQ ID NO: 1889329 - RNA, 17 nt, Homo sapiens
gagagccugcacagcuu

SEQ ID NO: 1889330 - RNA, 21 nt, Homo sapiens
cugcauccccuuggcugugag

SEQ ID NO: 1889331 - RNA, 17 nt, Homo sapiens
uuuaaaccuauacucac

SEQ ID NO: 1889332 - RNA, 21 nt, Homo sapiens
cagcuggcggguguggagacc

SEQ ID NO: 1889333 - RNA, 13 nt, Homo sapiens
uuuucuuacauaa

SEQ ID NO: 1889334 - RNA, 11 nt, Homo sapiens
uggguauuucu

SEQ ID NO: 1889335 - RNA, 19 nt, Homo sapiens
cugccagaggccuggugcc

SEQ ID NO: 1889336 - RNA, 11 nt, Homo sapiens
guuagauuuau

SEQ ID NO: 1889337 - RNA, 22 nt, Homo sapiens
gauauagccccauuacuacaaa

SEQ ID NO: 1889338 - RNA, 19 nt, Homo sapiens
auguguaagcauuguauac

SEQ ID NO: 1889339 - RNA, 16 nt, Homo sapiens
ccaggaguacacccca

SEQ ID NO: 1889340 - RNA, 14 nt, Homo sapiens
guaugucuaccugg

SEQ ID NO: 1889341 - RNA, 22 nt, Homo sapiens
uuccuauuaauaacagguuuaa

SEQ ID NO: 1889342 - RNA, 14 nt, Homo sapiens
cugaccacacuccg

SEQ ID NO: 1889343 - RNA, 19 nt, Homo sapiens
ucuauuggccaacaauccu

SEQ ID NO: 1889344 - RNA, 15 nt, Homo sapiens
uuaaaauaacuaaca

SEQ ID NO: 1889345 - RNA, 15 nt, Homo sapiens
ggucagucacuugaa

SEQ ID NO: 1889346 - RNA, 21 nt, Homo sapiens
ccagagugggaccaaguccaa

SEQ ID NO: 1889347 - RNA, 15 nt, Homo sapiens
aacgucuauguguac

SEQ ID NO: 1889348 - RNA, 14 nt, Homo sapiens
ccugcacaaggugg

SEQ ID NO: 1889349 - RNA, 16 nt, Homo sapiens
cuggaccugguacaaa

SEQ ID NO: 1889350 - RNA, 19 nt, Homo sapiens
agaucgcgccauugcacuc

SEQ ID NO: 1889351 - RNA, 21 nt, Homo sapiens
ggagauggguuuggaggccaa

SEQ ID NO: 1889352 - RNA, 14 nt, Homo sapiens
ugcaaaaacucuua

SEQ ID NO: 1889353 - RNA, 14 nt, Homo sapiens
cuauaaaaugaaua

SEQ ID NO: 1889354 - RNA, 13 nt, Homo sapiens
ucuuaggaauuga

SEQ ID NO: 1889355 - RNA, 14 nt, Homo sapiens
uaaggacauuuccc

SEQ ID NO: 1889356 - RNA, 15 nt, Homo sapiens
ugggugauuucuaga

SEQ ID NO: 1889357 - RNA, 20 nt, Homo sapiens
aucuuugcaagaaagucaga

SEQ ID NO: 1889358 - RNA, 23 nt, Homo sapiens
cagauaucauuuaggaguauuau

SEQ ID NO: 1889359 - RNA, 14 nt, Homo sapiens
ggaaauuugcaaau

SEQ ID NO: 1889360 - RNA, 23 nt, Homo sapiens
auaacguagaauaaaaacauaac

SEQ ID NO: 1889361 - RNA, 13 nt, Homo sapiens
ucuuagaagccau

SEQ ID NO: 1889362 - RNA, 20 nt, Homo sapiens
ccauuuuuccagagcugcag

SEQ ID NO: 1889363 - RNA, 17 nt, Homo sapiens
aacagccaacagguggc

SEQ ID NO: 1889364 - RNA, 17 nt, Homo sapiens
accuggcggagcucucc

SEQ ID NO: 1889365 - RNA, 16 nt, Homo sapiens
auuaaauagugugaug

SEQ ID NO: 1889366 - RNA, 16 nt, Homo sapiens
uauuuauacuuugcaa

SEQ ID NO: 1889367 - RNA, 14 nt, Homo sapiens
ggagaccucaugcc

SEQ ID NO: 1889368 - RNA, 14 nt, Homo sapiens
caagcccuggugac

SEQ ID NO: 1889369 - RNA, 15 nt, Homo sapiens
gcauuugauuuugcc

SEQ ID NO: 1889370 - RNA, 17 nt, Homo sapiens
cuugcucauccaaggau

SEQ ID NO: 1889371 - RNA, 21 nt, Homo sapiens
uuucucgacagaugauuuucu

SEQ ID NO: 1889372 - RNA, 16 nt, Homo sapiens
uuguaaacuaguacua

SEQ ID NO: 1889373 - RNA, 17 nt, Homo sapiens
aaaccugggcaccuaag

SEQ ID NO: 1889374 - RNA, 23 nt, Homo sapiens
aauacagaguuuuagaaaugaga

SEQ ID NO: 1889375 - RNA, 16 nt, Homo sapiens
uccuuuuaacugccaa

SEQ ID NO: 1889376 - RNA, 18 nt, Homo sapiens
gcaagauuuaaauccuuu

SEQ ID NO: 1889377 - RNA, 17 nt, Homo sapiens
ucacccugucaaguuaa

SEQ ID NO: 1889378 - RNA, 22 nt, Homo sapiens
cauccaccuucccuucuacaag

SEQ ID NO: 1889379 - RNA, 22 nt, Homo sapiens
gccaauaccguguggcccaaga

SEQ ID NO: 1889380 - RNA, 23 nt, Homo sapiens
cuugaauuuuucuuccucuccac

SEQ ID NO: 1889381 - RNA, 21 nt, Homo sapiens
accggccugccaggaggaccc

SEQ ID NO: 1889382 - RNA, 13 nt, Homo sapiens
guacggauuuguc

SEQ ID NO: 1889383 - RNA, 17 nt, Homo sapiens
agauauuguaccaggau

SEQ ID NO: 1889384 - RNA, 12 nt, Homo sapiens
accugaacaaac

SEQ ID NO: 1889385 - RNA, 17 nt, Homo sapiens
cuugccgaaacuggaag

SEQ ID NO: 1889386 - RNA, 18 nt, Homo sapiens
gucuccaacggcaaggga

SEQ ID NO: 1889387 - RNA, 21 nt, Homo sapiens
uguuguugagaauugugcuca

SEQ ID NO: 1889388 - RNA, 16 nt, Homo sapiens
aagaauuauuuacuga

SEQ ID NO: 1889389 - RNA, 20 nt, Homo sapiens
ccaauagcaaggcugugcau

SEQ ID NO: 1889390 - RNA, 15 nt, Homo sapiens
aaaguuuuugcuuca

SEQ ID NO: 1889391 - RNA, 15 nt, Homo sapiens
gacgaacaggggcca

SEQ ID NO: 1889392 - RNA, 18 nt, Homo sapiens
uguuuaccucuucuaugc

SEQ ID NO: 1889393 - RNA, 14 nt, Homo sapiens
accugucucagcug

SEQ ID NO: 1889394 - RNA, 13 nt, Homo sapiens
gcauuagaaauga

SEQ ID NO: 1889395 - RNA, 15 nt, Homo sapiens
uaauauuuuguaaua

SEQ ID NO: 1889396 - RNA, 18 nt, Homo sapiens
uguacuuaaauuacacau

SEQ ID NO: 1889397 - RNA, 21 nt, Homo sapiens
uguaagucuuuauuauuuacu

SEQ ID NO: 1889398 - RNA, 18 nt, Homo sapiens
uuucagaccagccccacc

SEQ ID NO: 1889399 - RNA, 19 nt, Homo sapiens
uaaaauuuugccuaauaca

SEQ ID NO: 1889400 - RNA, 20 nt, Homo sapiens
aggcuggaggacaguggcac

SEQ ID NO: 1889401 - RNA, 15 nt, Homo sapiens
ccugcuccuccagua

SEQ ID NO: 1889402 - RNA, 16 nt, Homo sapiens
aaaaauucugaaugua

SEQ ID NO: 1889403 - RNA, 15 nt, Homo sapiens
cguggagcugcucaa

SEQ ID NO: 1889404 - RNA, 16 nt, Homo sapiens
acuguauuaagaguga

SEQ ID NO: 1889405 - RNA, 20 nt, Homo sapiens
ggccaggcuggucuugaacu

SEQ ID NO: 1889406 - RNA, 16 nt, Homo sapiens
cgacaacuuguaacuc

SEQ ID NO: 1889407 - RNA, 22 nt, Homo sapiens
gaaacauuauugucaacuugaa

SEQ ID NO: 1889408 - RNA, 14 nt, Homo sapiens
ccaggauacuggca

SEQ ID NO: 1889409 - RNA, 15 nt, Homo sapiens
auggguuuuacugau

SEQ ID NO: 1889410 - RNA, 19 nt, Homo sapiens
ucccauaccacccaaugcu

SEQ ID NO: 1889411 - RNA, 20 nt, Homo sapiens
uccauaaagacaaucacugc

SEQ ID NO: 1889412 - RNA, 22 nt, Homo sapiens
cugccaaccagcuuguccaaca

SEQ ID NO: 1889413 - RNA, 18 nt, Homo sapiens
uaauuaucgugucugcau

SEQ ID NO: 1889414 - RNA, 19 nt, Homo sapiens
cugcagccuggcugguccu

SEQ ID NO: 1889415 - RNA, 15 nt, Homo sapiens
uugucccucugcuac

SEQ ID NO: 1889416 - RNA, 15 nt, Homo sapiens
ucaccacuccauucc

SEQ ID NO: 1889417 - RNA, 20 nt, Homo sapiens
guuuuuaugaggugggauau

SEQ ID NO: 1889418 - RNA, 23 nt, Homo sapiens
ugaagaggagauuggccagugag

SEQ ID NO: 1889419 - RNA, 14 nt, Homo sapiens
gcucuugaucagug

SEQ ID NO: 1889420 - RNA, 18 nt, Homo sapiens
cugucuauugucacauga

SEQ ID NO: 1889421 - RNA, 16 nt, Homo sapiens
cuuaaaauagccauaa

SEQ ID NO: 1889422 - RNA, 15 nt, Homo sapiens
aauaaaaaucuuaca

SEQ ID NO: 1889423 - RNA, 16 nt, Homo sapiens
uuucauagugcucaga

SEQ ID NO: 1889424 - RNA, 22 nt, Homo sapiens
caauguuguguguugcacucaa

SEQ ID NO: 1889425 - RNA, 19 nt, Homo sapiens
auccaacacuggaugguca

SEQ ID NO: 1889426 - RNA, 20 nt, Homo sapiens
ugcuauucuaacuaaugaca

SEQ ID NO: 1889427 - RNA, 22 nt, Homo sapiens
uugaacuguuagaugcugaaua

SEQ ID NO: 1889428 - RNA, 14 nt, Homo sapiens
uuuaaaaucuguca

SEQ ID NO: 1889429 - RNA, 20 nt, Homo sapiens
agccagcuuacuagcacuuu

SEQ ID NO: 1889430 - RNA, 14 nt, Homo sapiens
uccagcaaccuaua

SEQ ID NO: 1889431 - RNA, 19 nt, Homo sapiens
uggcuaaaaccaucauagu

SEQ ID NO: 1889432 - RNA, 24 nt, Homo sapiens
uauuuuaggucuuaauacacacag

SEQ ID NO: 1889433 - RNA, 14 nt, Homo sapiens
aaccuaucuaugaa

SEQ ID NO: 1889434 - RNA, 15 nt, Homo sapiens
uaggccucucugccu

SEQ ID NO: 1889435 - RNA, 17 nt, Homo sapiens
aaacucaagacaaugca

SEQ ID NO: 1889436 - RNA, 13 nt, Homo sapiens
uaagauuuaccca

SEQ ID NO: 1889437 - RNA, 16 nt, Homo sapiens
gggagcaugcuuaccu

SEQ ID NO: 1889438 - RNA, 22 nt, Homo sapiens
ugcuaaacagaugucuucuugc

SEQ ID NO: 1889439 - RNA, 18 nt, Homo sapiens
gcauggauaugugccagg

SEQ ID NO: 1889440 - RNA, 20 nt, Homo sapiens
ucuuaaggacaaagugccaa

SEQ ID NO: 1889441 - RNA, 13 nt, Homo sapiens
ggacuaugacaaa

SEQ ID NO: 1889442 - RNA, 20 nt, Homo sapiens
ucuucaauacaaaaagccaa

SEQ ID NO: 1889443 - RNA, 22 nt, Homo sapiens
acaguggccggggcugaagcca

SEQ ID NO: 1889444 - RNA, 21 nt, Homo sapiens
ugauaguccaauuuuuacuca

SEQ ID NO: 1889445 - RNA, 12 nt, Homo sapiens
ccaggcaauggc

SEQ ID NO: 1889446 - RNA, 18 nt, Homo sapiens
uuaauagacugagucaga

SEQ ID NO: 1889447 - RNA, 14 nt, Homo sapiens
ccucaccugggcag

SEQ ID NO: 1889448 - RNA, 13 nt, Homo sapiens
ccccuaccucuag

SEQ ID NO: 1889449 - RNA, 19 nt, Homo sapiens
gcaucagaccugcauugaa

SEQ ID NO: 1889450 - RNA, 20 nt, Homo sapiens
uuucuagacaguauugccac

SEQ ID NO: 1889451 - RNA, 14 nt, Homo sapiens
ucccacacuguaua

SEQ ID NO: 1889452 - RNA, 20 nt, Homo sapiens
accugauggaaguaaagccu

SEQ ID NO: 1889453 - RNA, 15 nt, Homo sapiens
acuuugagcugagug

SEQ ID NO: 1889454 - RNA, 19 nt, Homo sapiens
guccauguuugcugccuua

SEQ ID NO: 1889455 - RNA, 16 nt, Homo sapiens
cuucgggcccugccug

SEQ ID NO: 1889456 - RNA, 16 nt, Homo sapiens
cuguaagcaacacuuu

SEQ ID NO: 1889457 - RNA, 20 nt, Homo sapiens
uuggagcaagugacaugcca

SEQ ID NO: 1889458 - RNA, 16 nt, Homo sapiens
acauauguuuaucuca

SEQ ID NO: 1889459 - RNA, 14 nt, Homo sapiens
cacccugggagcca

SEQ ID NO: 1889460 - RNA, 17 nt, Homo sapiens
cauauguauguccaauu

SEQ ID NO: 1889461 - RNA, 14 nt, Homo sapiens
gauagcugcauuac

SEQ ID NO: 1889462 - RNA, 18 nt, Homo sapiens
acauuggaagcucccacc

SEQ ID NO: 1889463 - RNA, 15 nt, Homo sapiens
ccaagugugaacaaa

SEQ ID NO: 1889464 - RNA, 19 nt, Homo sapiens
ucuuccacaaaaaauacuu

SEQ ID NO: 1889465 - RNA, 22 nt, Homo sapiens
ccacuccuaaucaagagucucu

SEQ ID NO: 1889466 - RNA, 13 nt, Homo sapiens
caucacuuaccac

SEQ ID NO: 1889467 - RNA, 20 nt, Homo sapiens
gaagguggggacagggauga

SEQ ID NO: 1889468 - RNA, 18 nt, Homo sapiens
acuuacauuuccauuuau

SEQ ID NO: 1889469 - RNA, 21 nt, Homo sapiens
uaugcuauuuauuaaguauuu

SEQ ID NO: 1889470 - RNA, 14 nt, Homo sapiens
cuuuuuguauguga

SEQ ID NO: 1889471 - RNA, 20 nt, Homo sapiens
cacguaggacgcaugaaggu

SEQ ID NO: 1889472 - RNA, 14 nt, Homo sapiens
uauuccucuaggca

SEQ ID NO: 1889473 - RNA, 13 nt, Homo sapiens
gacagaagcagcu

SEQ ID NO: 1889474 - RNA, 16 nt, Homo sapiens
ggaagauuuucauuga

SEQ ID NO: 1889475 - RNA, 13 nt, Homo sapiens
uuccauuggaaaa

SEQ ID NO: 1889476 - RNA, 15 nt, Homo sapiens
aaguaauugccuaca

SEQ ID NO: 1889477 - RNA, 21 nt, Homo sapiens
gaaaacauagcacuagcauuc

SEQ ID NO: 1889478 - RNA, 20 nt, Homo sapiens
agaucgagaccauccuggcc

SEQ ID NO: 1889479 - RNA, 16 nt, Homo sapiens
uacuguuuauaucuuc

SEQ ID NO: 1889480 - RNA, 15 nt, Homo sapiens
ucacagcccucauga

SEQ ID NO: 1889481 - RNA, 13 nt, Homo sapiens
cagcacuggugaa

SEQ ID NO: 1889482 - RNA, 10 nt, Homo sapiens
acuaugacaa

SEQ ID NO: 1889483 - RNA, 20 nt, Homo sapiens
cuuccaaugaaaucucagga

SEQ ID NO: 1889484 - RNA, 18 nt, Homo sapiens
cuaacuagagcagcccug

SEQ ID NO: 1889485 - RNA, 17 nt, Homo sapiens
cuugcaacuaaggacaa

SEQ ID NO: 1889486 - RNA, 17 nt, Homo sapiens
uaaaacucgcuuuuauu

SEQ ID NO: 1889487 - RNA, 17 nt, Homo sapiens
cagcacccacucagcca

SEQ ID NO: 1889488 - RNA, 14 nt, Homo sapiens
augucuaaccaaga

SEQ ID NO: 1889489 - RNA, 15 nt, Homo sapiens
accugaaugucccaa

SEQ ID NO: 1889490 - RNA, 23 nt, Homo sapiens
caaucaguagccagcaucugccu

SEQ ID NO: 1889491 - RNA, 14 nt, Homo sapiens
ucacccccauccac

SEQ ID NO: 1889492 - RNA, 18 nt, Homo sapiens
cagcuuugggguuccuuu

SEQ ID NO: 1889493 - RNA, 16 nt, Homo sapiens
ugggccaccagccacu

SEQ ID NO: 1889494 - RNA, 17 nt, Homo sapiens
gagguaaauaaguaaaa

SEQ ID NO: 1889495 - RNA, 15 nt, Homo sapiens
ugguuuugugcuuua

SEQ ID NO: 1889496 - RNA, 17 nt, Homo sapiens
cugaaccauuacuguaa

SEQ ID NO: 1889497 - RNA, 21 nt, Homo sapiens
aguuggaaaaacaaaugccau

SEQ ID NO: 1889498 - RNA, 18 nt, Homo sapiens
uagaaaaauuguuuccaa

SEQ ID NO: 1889499 - RNA, 22 nt, Homo sapiens
uauguuagagaaugcuugaauu

SEQ ID NO: 1889500 - RNA, 23 nt, Homo sapiens
auaaccuucaugaugaauuacuu

SEQ ID NO: 1889501 - RNA, 13 nt, Homo sapiens
aaaugaaugaaua

SEQ ID NO: 1889502 - RNA, 20 nt, Homo sapiens
uuucuugggguacucuugau

SEQ ID NO: 1889503 - RNA, 13 nt, Homo sapiens
gccaaaauaccag

SEQ ID NO: 1889504 - RNA, 16 nt, Homo sapiens
ucucuccaguguuucu

SEQ ID NO: 1889505 - RNA, 21 nt, Homo sapiens
ccucgaacuccugggcucaag

SEQ ID NO: 1889506 - RNA, 17 nt, Homo sapiens
gaucuucaagcagggaa

SEQ ID NO: 1889507 - RNA, 22 nt, Homo sapiens
aaugauagucuuacuaaaugca

SEQ ID NO: 1889508 - RNA, 22 nt, Homo sapiens
acagacuggcaauaaacuccua

SEQ ID NO: 1889509 - RNA, 23 nt, Homo sapiens
aggaaacagauuuaagcaagacc

SEQ ID NO: 1889510 - RNA, 22 nt, Homo sapiens
auugcuuuagacaaauuguuaa

SEQ ID NO: 1889511 - RNA, 17 nt, Homo sapiens
ucuuucuggaauugaug

SEQ ID NO: 1889512 - RNA, 18 nt, Homo sapiens
uacugcacccagcagugu

SEQ ID NO: 1889513 - RNA, 13 nt, Homo sapiens
aagaccagacugu

SEQ ID NO: 1889514 - RNA, 23 nt, Homo sapiens
ugucaucccauauaacuaagaca

SEQ ID NO: 1889515 - RNA, 17 nt, Homo sapiens
ugagaaauaaagcacau

SEQ ID NO: 1889516 - RNA, 20 nt, Homo sapiens
ccugcccccacucagcauuu

SEQ ID NO: 1889517 - RNA, 14 nt, Homo sapiens
guauauauaauacu

SEQ ID NO: 1889518 - RNA, 17 nt, Homo sapiens
uaccacuagagucuuca

SEQ ID NO: 1889519 - RNA, 16 nt, Homo sapiens
uccuuuauaaguugcu

SEQ ID NO: 1889520 - RNA, 21 nt, Homo sapiens
cuggcccaugugcccacuguc

SEQ ID NO: 1889521 - RNA, 17 nt, Homo sapiens
cagaugcaagacacugu

SEQ ID NO: 1889522 - RNA, 19 nt, Homo sapiens
aggucuuccagaccugcuu

SEQ ID NO: 1889523 - RNA, 14 nt, Homo sapiens
guuuacaacuugau

SEQ ID NO: 1889524 - RNA, 13 nt, Homo sapiens
cagccacauucua

SEQ ID NO: 1889525 - RNA, 15 nt, Homo sapiens
uaugaauuaggugua

SEQ ID NO: 1889526 - RNA, 15 nt, Homo sapiens
uuacagaacuacuuc

SEQ ID NO: 1889527 - RNA, 17 nt, Homo sapiens
gaagacuucaaaauauu

SEQ ID NO: 1889528 - RNA, 13 nt, Homo sapiens
ugcacauugccug

SEQ ID NO: 1889529 - RNA, 22 nt, Homo sapiens
caugugacacauaugcaccuug

SEQ ID NO: 1889530 - RNA, 23 nt, Homo sapiens
aauggggccuguuacacaugaca

SEQ ID NO: 1889531 - RNA, 19 nt, Homo sapiens
uuauggcauuuuucuggga

SEQ ID NO: 1889532 - RNA, 19 nt, Homo sapiens
cuauaccugcuucagugaa

SEQ ID NO: 1889533 - RNA, 16 nt, Homo sapiens
ccagcgggcacagggc

SEQ ID NO: 1889534 - RNA, 15 nt, Homo sapiens
caagcauuacuuuaa

SEQ ID NO: 1889535 - RNA, 17 nt, Homo sapiens
gaaacaaaucucaaagu

SEQ ID NO: 1889536 - RNA, 15 nt, Homo sapiens
ucaaguagaggcaau

SEQ ID NO: 1889537 - RNA, 20 nt, Homo sapiens
acaucuccagcuggauccca

SEQ ID NO: 1889538 - RNA, 17 nt, Homo sapiens
cuaugggagcagcuuuu

SEQ ID NO: 1889539 - RNA, 13 nt, Homo sapiens
gccacacuuugaa

SEQ ID NO: 1889540 - RNA, 17 nt, Homo sapiens
gcccuucuuucuacccu

SEQ ID NO: 1889541 - RNA, 15 nt, Homo sapiens
gcuuagagaggacaa

SEQ ID NO: 1889542 - RNA, 23 nt, Homo sapiens
uuugcugugaugauguguucuug

SEQ ID NO: 1889543 - RNA, 16 nt, Homo sapiens
ucauuuugcagaagga

SEQ ID NO: 1889544 - RNA, 22 nt, Homo sapiens
ugccucucgguugaaaccugua

SEQ ID NO: 1889545 - RNA, 17 nt, Homo sapiens
cuuucauucagccuuua

SEQ ID NO: 1889546 - RNA, 22 nt, Homo sapiens
ccaaguaaacaggguaccucaa

SEQ ID NO: 1889547 - RNA, 21 nt, Homo sapiens
aaauucacuucuauauauaca

SEQ ID NO: 1889548 - RNA, 15 nt, Homo sapiens
cuucaggggucaccu

SEQ ID NO: 1889549 - RNA, 13 nt, Homo sapiens
ugcugaccaaaga

SEQ ID NO: 1889550 - RNA, 13 nt, Homo sapiens
gacaaaacauaca

SEQ ID NO: 1889551 - RNA, 21 nt, Homo sapiens
gauccaacuucagcaaugaau

SEQ ID NO: 1889552 - RNA, 15 nt, Homo sapiens
uuaaaaaaauuccau

SEQ ID NO: 1889553 - RNA, 13 nt, Homo sapiens
cucaaaugaauuu

SEQ ID NO: 1889554 - RNA, 19 nt, Homo sapiens
uccugcagccugaccccag

SEQ ID NO: 1889555 - RNA, 15 nt, Homo sapiens
cauguaucccuguua

SEQ ID NO: 1889556 - RNA, 21 nt, Homo sapiens
ucaucaguggagccauguuaa

SEQ ID NO: 1889557 - RNA, 19 nt, Homo sapiens
uauuuuuuacuacauaauu

SEQ ID NO: 1889558 - RNA, 20 nt, Homo sapiens
aggugggccagucuguggau

SEQ ID NO: 1889559 - RNA, 22 nt, Homo sapiens
caguuacaauuguuacaguacu

SEQ ID NO: 1889560 - RNA, 12 nt, Homo sapiens
cuaacauuuccu

SEQ ID NO: 1889561 - RNA, 23 nt, Homo sapiens
accaggacacuacccugagaucu

SEQ ID NO: 1889562 - RNA, 16 nt, Homo sapiens
ccuuuuaccugcccaa

SEQ ID NO: 1889563 - RNA, 13 nt, Homo sapiens
gagccagcaagag

SEQ ID NO: 1889564 - RNA, 15 nt, Homo sapiens
gaauuaacccaaaga

SEQ ID NO: 1889565 - RNA, 19 nt, Homo sapiens
cuacugaguagggggagca

SEQ ID NO: 1889566 - RNA, 23 nt, Homo sapiens
cagcggcugcccucuggggccac

SEQ ID NO: 1889567 - RNA, 18 nt, Homo sapiens
guuaugggcacaugccuu

SEQ ID NO: 1889568 - RNA, 18 nt, Homo sapiens
cacagcucacuacaguuu

SEQ ID NO: 1889569 - RNA, 14 nt, Homo sapiens
uugaaauaucaugu

SEQ ID NO: 1889570 - RNA, 23 nt, Homo sapiens
gcaauguagaggggaaaagagau

SEQ ID NO: 1889571 - RNA, 18 nt, Homo sapiens
aggcucccaaacucaggc

SEQ ID NO: 1889572 - RNA, 15 nt, Homo sapiens
aagacuacacuguug

SEQ ID NO: 1889573 - RNA, 20 nt, Homo sapiens
acagauggcaggaugggcac

SEQ ID NO: 1889574 - RNA, 12 nt, Homo sapiens
ccguagcuucua

SEQ ID NO: 1889575 - RNA, 23 nt, Homo sapiens
gcccucuggauccagccaugccu

SEQ ID NO: 1889576 - RNA, 21 nt, Homo sapiens
ucggcuacugguuaccuggag

SEQ ID NO: 1889577 - RNA, 17 nt, Homo sapiens
gagucuuguacacuuaa

SEQ ID NO: 1889578 - RNA, 16 nt, Homo sapiens
cacuauuuuaugcaaa

SEQ ID NO: 1889579 - RNA, 15 nt, Homo sapiens
cuuucaagcaaaaaa

SEQ ID NO: 1889580 - RNA, 15 nt, Homo sapiens
cuauacagcauacca

SEQ ID NO: 1889581 - RNA, 19 nt, Homo sapiens
ugcuguccacaugaccucc

SEQ ID NO: 1889582 - RNA, 21 nt, Homo sapiens
cuggguggaagugugugccaa

SEQ ID NO: 1889583 - RNA, 11 nt, Homo sapiens
ucucaccagcc

SEQ ID NO: 1889584 - RNA, 21 nt, Homo sapiens
aguaauuauuuucuuccuuuc

SEQ ID NO: 1889585 - RNA, 18 nt, Homo sapiens
uauugacaauaauuucag

SEQ ID NO: 1889586 - RNA, 21 nt, Homo sapiens
ccucgggccgaggcccagcgg

SEQ ID NO: 1889587 - RNA, 19 nt, Homo sapiens
uaaaggaguagaauaccaa

SEQ ID NO: 1889588 - RNA, 19 nt, Homo sapiens
caggauagagugggacagu

SEQ ID NO: 1889589 - RNA, 18 nt, Homo sapiens
uaugacauauuacaacac

SEQ ID NO: 1889590 - RNA, 16 nt, Homo sapiens
aacaguuuuacuucug

SEQ ID NO: 1889591 - RNA, 20 nt, Homo sapiens
uaaagaauaugaaguucuau

SEQ ID NO: 1889592 - RNA, 23 nt, Homo sapiens
cuagcuuacugaguuaucaggug

SEQ ID NO: 1889593 - RNA, 15 nt, Homo sapiens
cuugcgcauucucau

SEQ ID NO: 1889594 - RNA, 18 nt, Homo sapiens
cuuauuucagccaaaaca

SEQ ID NO: 1889595 - RNA, 22 nt, Homo sapiens
ugccucaggccucugugccgca

SEQ ID NO: 1889596 - RNA, 22 nt, Homo sapiens
cuccacuuguucagggcuuuuc

SEQ ID NO: 1889597 - RNA, 13 nt, Homo sapiens
cggguugggucac

SEQ ID NO: 1889598 - RNA, 13 nt, Homo sapiens
aaacuacauuuua

SEQ ID NO: 1889599 - RNA, 22 nt, Homo sapiens
auggaccggcccacacucccag

SEQ ID NO: 1889600 - RNA, 23 nt, Homo sapiens
cacccugucuucuuaauucucca

SEQ ID NO: 1889601 - RNA, 18 nt, Homo sapiens
cauguagccaguuaagga

SEQ ID NO: 1889602 - RNA, 22 nt, Homo sapiens
uuauugcuugauacuuuugaca

SEQ ID NO: 1889603 - RNA, 23 nt, Homo sapiens
ggacaaacaagauuccuaaggaa

SEQ ID NO: 1889604 - RNA, 20 nt, Homo sapiens
aaaugcauauccugagccau

SEQ ID NO: 1889605 - RNA, 18 nt, Homo sapiens
uaccuguuguacacuugg

SEQ ID NO: 1889606 - RNA, 13 nt, Homo sapiens
ccguugaccagau

SEQ ID NO: 1889607 - RNA, 21 nt, Homo sapiens
cuuaacuggucuccuugcuuc

SEQ ID NO: 1889608 - RNA, 16 nt, Homo sapiens
aaggaggggagccuuu

SEQ ID NO: 1889609 - RNA, 12 nt, Homo sapiens
cgguaauaucau

SEQ ID NO: 1889610 - RNA, 16 nt, Homo sapiens
agagccaggcucugcc

SEQ ID NO: 1889611 - RNA, 23 nt, Homo sapiens
gcuggaaacacagucacuuggga

SEQ ID NO: 1889612 - RNA, 15 nt, Homo sapiens
agcccagcccggcug

SEQ ID NO: 1889613 - RNA, 20 nt, Homo sapiens
acccaaagccugucccagga

SEQ ID NO: 1889614 - RNA, 16 nt, Homo sapiens
cuuaagcagaagcauu

SEQ ID NO: 1889615 - RNA, 13 nt, Homo sapiens
uugaagccaucua

SEQ ID NO: 1889616 - RNA, 15 nt, Homo sapiens
uuccaagcuccuuau

SEQ ID NO: 1889617 - RNA, 18 nt, Homo sapiens
agaaauaaaccuaugaau

SEQ ID NO: 1889618 - RNA, 19 nt, Homo sapiens
gcaugcagaaacuuggaug

SEQ ID NO: 1889619 - RNA, 17 nt, Homo sapiens
acuggaaucguggcucc

SEQ ID NO: 1889620 - RNA, 19 nt, Homo sapiens
cacaguucuuaauacagga

SEQ ID NO: 1889621 - RNA, 18 nt, Homo sapiens
gggcucauuuuugcacuu

SEQ ID NO: 1889622 - RNA, 14 nt, Homo sapiens
ccuugggccaagau

SEQ ID NO: 1889623 - RNA, 19 nt, Homo sapiens
gccugagacccaggacucc

SEQ ID NO: 1889624 - RNA, 20 nt, Homo sapiens
guguugcaccaggcacugcu

SEQ ID NO: 1889625 - RNA, 16 nt, Homo sapiens
aaguggugugauccca

SEQ ID NO: 1889626 - RNA, 18 nt, Homo sapiens
cacauuacagcuaccuuc

SEQ ID NO: 1889627 - RNA, 18 nt, Homo sapiens
ugacuuucugauuacugu

SEQ ID NO: 1889628 - RNA, 23 nt, Homo sapiens
gcuuccccuuuugccaaucucaa

SEQ ID NO: 1889629 - RNA, 22 nt, Homo sapiens
gccccagucagccucucuccca

SEQ ID NO: 1889630 - RNA, 15 nt, Homo sapiens
uggacugugugcaac

SEQ ID NO: 1889631 - RNA, 22 nt, Homo sapiens
gcuuagauucuguaugcgguga

SEQ ID NO: 1889632 - RNA, 22 nt, Homo sapiens
gauggagccugaaccgugugcu

SEQ ID NO: 1889633 - RNA, 16 nt, Homo sapiens
agcaguaugugugcuc

SEQ ID NO: 1889634 - RNA, 16 nt, Homo sapiens
auugccauaugugcaa

SEQ ID NO: 1889635 - RNA, 15 nt, Homo sapiens
gcgauggcagugaga

SEQ ID NO: 1889636 - RNA, 21 nt, Homo sapiens
cuuccagggauuugccucacc

SEQ ID NO: 1889637 - RNA, 13 nt, Homo sapiens
uucugaccaaaau

SEQ ID NO: 1889638 - RNA, 19 nt, Homo sapiens
uugcuggagccugagucag

SEQ ID NO: 1889639 - RNA, 14 nt, Homo sapiens
agccaccaugccug

SEQ ID NO: 1889640 - RNA, 14 nt, Homo sapiens
ucacagcaacacuc

SEQ ID NO: 1889641 - RNA, 13 nt, Homo sapiens
caugugcuugcca

SEQ ID NO: 1889642 - RNA, 20 nt, Homo sapiens
ggaagcagaaucuuugcaag

SEQ ID NO: 1889643 - RNA, 21 nt, Homo sapiens
cuuauagguuuccacugccaa

SEQ ID NO: 1889644 - RNA, 17 nt, Homo sapiens
aaaccuuuccuguaaca

SEQ ID NO: 1889645 - RNA, 20 nt, Homo sapiens
ucuuugugccaaacaaaaug

SEQ ID NO: 1889646 - RNA, 15 nt, Homo sapiens
uccaugaaaauacca

SEQ ID NO: 1889647 - RNA, 17 nt, Homo sapiens
gucaggcacugggcaug

SEQ ID NO: 1889648 - RNA, 18 nt, Homo sapiens
acagccuuaccaaagcag

SEQ ID NO: 1889649 - RNA, 18 nt, Homo sapiens
aacauuucuguaaauacc

SEQ ID NO: 1889650 - RNA, 15 nt, Homo sapiens
agauaucucaucucu

SEQ ID NO: 1889651 - RNA, 17 nt, Homo sapiens
ggcagaaggcaguaggg

SEQ ID NO: 1889652 - RNA, 23 nt, Homo sapiens
ugaaaggaaacugcuauugaacu

SEQ ID NO: 1889653 - RNA, 16 nt, Homo sapiens
uaaaauaaacuguaaa

SEQ ID NO: 1889654 - RNA, 21 nt, Homo sapiens
aagacuggcauggacaucagc

SEQ ID NO: 1889655 - RNA, 22 nt, Homo sapiens
ccagaaacugaaccaacagaag

SEQ ID NO: 1889656 - RNA, 12 nt, Homo sapiens
cagcaggggugg

SEQ ID NO: 1889657 - RNA, 15 nt, Homo sapiens
cuucauauaccagca

SEQ ID NO: 1889658 - RNA, 22 nt, Homo sapiens
ugaaggaacacaaagaucaaau

SEQ ID NO: 1889659 - RNA, 16 nt, Homo sapiens
uuucuaauguuuacua

SEQ ID NO: 1889660 - RNA, 15 nt, Homo sapiens
cucucuaccagucua

SEQ ID NO: 1889661 - RNA, 12 nt, Homo sapiens
uucugcauuuca

SEQ ID NO: 1889662 - RNA, 12 nt, Homo sapiens
cucugcaucuca

SEQ ID NO: 1889663 - RNA, 23 nt, Homo sapiens
uugaaaaaguuuggaagcacuga

SEQ ID NO: 1889664 - RNA, 17 nt, Homo sapiens
ucggagccaaugaacag

SEQ ID NO: 1889665 - RNA, 17 nt, Homo sapiens
aauuacuuaaugugaug

SEQ ID NO: 1889666 - RNA, 21 nt, Homo sapiens
gcugcagguguucugcugaua

SEQ ID NO: 1889667 - RNA, 16 nt, Homo sapiens
ugauuauccuauaggc

SEQ ID NO: 1889668 - RNA, 17 nt, Homo sapiens
caucugucuguguuucu

SEQ ID NO: 1889669 - RNA, 13 nt, Homo sapiens
uuaaaaaucccaa

SEQ ID NO: 1889670 - RNA, 14 nt, Homo sapiens
uccuccacauucau

SEQ ID NO: 1889671 - RNA, 23 nt, Homo sapiens
ccaaugcauugcuaaaauauuau

SEQ ID NO: 1889672 - RNA, 20 nt, Homo sapiens
ccaguaaaugggggugcauu

SEQ ID NO: 1889673 - RNA, 12 nt, Homo sapiens
auagaugugcaa

SEQ ID NO: 1889674 - RNA, 18 nt, Homo sapiens
cacagcuugucucuugcc

SEQ ID NO: 1889675 - RNA, 14 nt, Homo sapiens
cagcgugaagggau

SEQ ID NO: 1889676 - RNA, 22 nt, Homo sapiens
aacgaggcagucaccgccgucg

SEQ ID NO: 1889677 - RNA, 23 nt, Homo sapiens
caagguggaaauggcccauuuaa

SEQ ID NO: 1889678 - RNA, 15 nt, Homo sapiens
aaucccaagugucuc

SEQ ID NO: 1889679 - RNA, 24 nt, Homo sapiens
uauuagcuguaaauacaugugugg

SEQ ID NO: 1889680 - RNA, 20 nt, Homo sapiens
gagcuguuuucccugaccuc

SEQ ID NO: 1889681 - RNA, 15 nt, Homo sapiens
aggccagaagaccuc

SEQ ID NO: 1889682 - RNA, 15 nt, Homo sapiens
cuaccugacugccac

SEQ ID NO: 1889683 - RNA, 18 nt, Homo sapiens
ggccagagggagugacag

SEQ ID NO: 1889684 - RNA, 17 nt, Homo sapiens
guuuguaagguggucac

SEQ ID NO: 1889685 - RNA, 18 nt, Homo sapiens
caaacucuaaaauuauaa

SEQ ID NO: 1889686 - RNA, 14 nt, Homo sapiens
auucccaagugaau

SEQ ID NO: 1889687 - RNA, 20 nt, Homo sapiens
gaauuauuuugaaugucaca

SEQ ID NO: 1889688 - RNA, 19 nt, Homo sapiens
ucaaaccccagggcacuga

SEQ ID NO: 1889689 - RNA, 21 nt, Homo sapiens
auucuggcauaauuuuuacag

SEQ ID NO: 1889690 - RNA, 18 nt, Homo sapiens
cagucucuauaccaauaa

SEQ ID NO: 1889691 - RNA, 22 nt, Homo sapiens
accugccccggaccuaccuccc

SEQ ID NO: 1889692 - RNA, 23 nt, Homo sapiens
guguaugugagagauucugugau

SEQ ID NO: 1889693 - RNA, 15 nt, Homo sapiens
uauacuguacuuaau

SEQ ID NO: 1889694 - RNA, 11 nt, Homo sapiens
cagucuuccac

SEQ ID NO: 1889695 - RNA, 15 nt, Homo sapiens
guaaauaaauacauu

SEQ ID NO: 1889696 - RNA, 23 nt, Homo sapiens
cguuggagagcagcaggugcugu

SEQ ID NO: 1889697 - RNA, 16 nt, Homo sapiens
uacgggaaugugcuuu

SEQ ID NO: 1889698 - RNA, 12 nt, Homo sapiens
ucagugagaaaa

SEQ ID NO: 1889699 - RNA, 19 nt, Homo sapiens
aaccuuccuuccugcuuga

SEQ ID NO: 1889700 - RNA, 16 nt, Homo sapiens
guuguacuacaguaua

SEQ ID NO: 1889701 - RNA, 15 nt, Homo sapiens
agcucccagccacau

SEQ ID NO: 1889702 - RNA, 22 nt, Homo sapiens
uggaaggagcacauacuaccua

SEQ ID NO: 1889703 - RNA, 17 nt, Homo sapiens
ucauccagccacugccc

SEQ ID NO: 1889704 - RNA, 17 nt, Homo sapiens
aacauucacagcccaga

SEQ ID NO: 1889705 - RNA, 14 nt, Homo sapiens
gagggaaaaugagu

SEQ ID NO: 1889706 - RNA, 16 nt, Homo sapiens
auuugcaccuuugucu

SEQ ID NO: 1889707 - RNA, 18 nt, Homo sapiens
gccaguucccucccucaa

SEQ ID NO: 1889708 - RNA, 22 nt, Homo sapiens
acgcaggaggagaaaagaaaug

SEQ ID NO: 1889709 - RNA, 15 nt, Homo sapiens
uaugugaacuuucuc

SEQ ID NO: 1889710 - RNA, 20 nt, Homo sapiens
cucacaauagcgugagcuaa

SEQ ID NO: 1889711 - RNA, 18 nt, Homo sapiens
aaccaaaugugcauugaa

SEQ ID NO: 1889712 - RNA, 23 nt, Homo sapiens
ugguugguuuuauacuauauuaa

SEQ ID NO: 1889713 - RNA, 16 nt, Homo sapiens
cugaugaacuguggug

SEQ ID NO: 1889714 - RNA, 16 nt, Homo sapiens
aaaauguaaaauggag

SEQ ID NO: 1889715 - RNA, 22 nt, Homo sapiens
aucugccggcccccaggacaag

SEQ ID NO: 1889716 - RNA, 20 nt, Homo sapiens
cucugaacaggacaccuguu

SEQ ID NO: 1889717 - RNA, 16 nt, Homo sapiens
gaaaugcaaauucuca

SEQ ID NO: 1889718 - RNA, 17 nt, Homo sapiens
cugaaaccucuguucuc

SEQ ID NO: 1889719 - RNA, 20 nt, Homo sapiens
auggagauagugguccucau

SEQ ID NO: 1889720 - RNA, 21 nt, Homo sapiens
cuggcaggaagggacugccaa

SEQ ID NO: 1889721 - RNA, 13 nt, Homo sapiens
uaggaucaucucu

SEQ ID NO: 1889722 - RNA, 20 nt, Homo sapiens
uccaacccgcagccucucug

SEQ ID NO: 1889723 - RNA, 23 nt, Homo sapiens
caaaggaccuucguuaagugaua

SEQ ID NO: 1889724 - RNA, 14 nt, Homo sapiens
gcacacaguacaca

SEQ ID NO: 1889725 - RNA, 16 nt, Homo sapiens
ugacccacacuuccau

SEQ ID NO: 1889726 - RNA, 18 nt, Homo sapiens
uuaaagggaaaacccuca

SEQ ID NO: 1889727 - RNA, 15 nt, Homo sapiens
uuggcuauugaccau

SEQ ID NO: 1889728 - RNA, 23 nt, Homo sapiens
ccccaucugcauucccagcucua

SEQ ID NO: 1889729 - RNA, 14 nt, Homo sapiens
gcaguugaguuucu

SEQ ID NO: 1889730 - RNA, 21 nt, Homo sapiens
cugcuuuuuuuuuuccagcaa

SEQ ID NO: 1889731 - RNA, 20 nt, Homo sapiens
ugcucuggaagccugcugau

SEQ ID NO: 1889732 - RNA, 15 nt, Homo sapiens
ucaucaggaguucca

SEQ ID NO: 1889733 - RNA, 19 nt, Homo sapiens
uucuugcuugacucuacua

SEQ ID NO: 1889734 - RNA, 20 nt, Homo sapiens
uggcaauauuccuuagucaa

SEQ ID NO: 1889735 - RNA, 22 nt, Homo sapiens
guguccccuuccccugcugacc

SEQ ID NO: 1889736 - RNA, 20 nt, Homo sapiens
agaaggaguuaauauuucua

SEQ ID NO: 1889737 - RNA, 18 nt, Homo sapiens
ccaccucggucacuccaa

SEQ ID NO: 1889738 - RNA, 15 nt, Homo sapiens
aucucucccacuucc

SEQ ID NO: 1889739 - RNA, 22 nt, Homo sapiens
gacuccggggccccacuggcug

SEQ ID NO: 1889740 - RNA, 17 nt, Homo sapiens
aucauauaaucuuacaa

SEQ ID NO: 1889741 - RNA, 16 nt, Homo sapiens
cauagcauuuguguaa

SEQ ID NO: 1889742 - RNA, 13 nt, Homo sapiens
gguaaacaacaga

SEQ ID NO: 1889743 - RNA, 16 nt, Homo sapiens
uuggcucacaguucug

SEQ ID NO: 1889744 - RNA, 18 nt, Homo sapiens
cacaaguuacacugccau

SEQ ID NO: 1889745 - RNA, 22 nt, Homo sapiens
cauccaacuccucuagucagca

SEQ ID NO: 1889746 - RNA, 16 nt, Homo sapiens
ggaaagaaaugcccau

SEQ ID NO: 1889747 - RNA, 22 nt, Homo sapiens
gaucuuaaaaaaugaauuauuc

SEQ ID NO: 1889748 - RNA, 18 nt, Homo sapiens
guugggaagucucagccu

SEQ ID NO: 1889749 - RNA, 13 nt, Homo sapiens
agucucuucugau

SEQ ID NO: 1889750 - RNA, 21 nt, Homo sapiens
aagcugaaauuuuuguguaaa

SEQ ID NO: 1889751 - RNA, 19 nt, Homo sapiens
acaggauccuauucucacc

SEQ ID NO: 1889752 - RNA, 23 nt, Homo sapiens
auuccauaaccccaggcauccca

SEQ ID NO: 1889753 - RNA, 16 nt, Homo sapiens
cuucuuuuacuugaaa

SEQ ID NO: 1889754 - RNA, 15 nt, Homo sapiens
uugagcagaauacaa

SEQ ID NO: 1889755 - RNA, 17 nt, Homo sapiens
cuccucgagaucccaac

SEQ ID NO: 1889756 - RNA, 17 nt, Homo sapiens
aaaguaaaaacaaagaa

SEQ ID NO: 1889757 - RNA, 17 nt, Homo sapiens
auccaacuccagcaacu

SEQ ID NO: 1889758 - RNA, 21 nt, Homo sapiens
gaagucaucuuagcuuuccac

SEQ ID NO: 1889759 - RNA, 23 nt, Homo sapiens
uauuauaaacagaaaaucuuucc

SEQ ID NO: 1889760 - RNA, 13 nt, Homo sapiens
auuuuaacuacuu

SEQ ID NO: 1889761 - RNA, 13 nt, Homo sapiens
aacgucacaucuu

SEQ ID NO: 1889762 - RNA, 13 nt, Homo sapiens
auauacacaaaga

SEQ ID NO: 1889763 - RNA, 15 nt, Homo sapiens
uauacucaaguuuca

SEQ ID NO: 1889764 - RNA, 11 nt, Homo sapiens
ggacugugauu

SEQ ID NO: 1889765 - RNA, 19 nt, Homo sapiens
uaaaauuaauuugugcauc

SEQ ID NO: 1889766 - RNA, 22 nt, Homo sapiens
gucuauguaggccccuggucug

SEQ ID NO: 1889767 - RNA, 15 nt, Homo sapiens
caaaacuucuauuau

SEQ ID NO: 1889768 - RNA, 16 nt, Homo sapiens
accucucagcugcuga

SEQ ID NO: 1889769 - RNA, 19 nt, Homo sapiens
acaucuaaaagaugaaguu

SEQ ID NO: 1889770 - RNA, 18 nt, Homo sapiens
ucugcucccaacuucgcc

SEQ ID NO: 1889771 - RNA, 19 nt, Homo sapiens
cugagccagaaacgcagau

SEQ ID NO: 1889772 - RNA, 22 nt, Homo sapiens
uccaugaaguuugaacuucaua

SEQ ID NO: 1889773 - RNA, 13 nt, Homo sapiens
cucauuauucaca

SEQ ID NO: 1889774 - RNA, 18 nt, Homo sapiens
cuaauucugggaagggag

SEQ ID NO: 1889775 - RNA, 21 nt, Homo sapiens
gaagaccaguccuguuugcag

SEQ ID NO: 1889776 - RNA, 16 nt, Homo sapiens
gagagcgccugccccu

SEQ ID NO: 1889777 - RNA, 16 nt, Homo sapiens
aguucaaauguuaucc

SEQ ID NO: 1889778 - RNA, 16 nt, Homo sapiens
acaucaacaggacuua

SEQ ID NO: 1889779 - RNA, 22 nt, Homo sapiens
aaacuucaccuacauuaucuca

SEQ ID NO: 1889780 - RNA, 21 nt, Homo sapiens
caaacuccugaccucaggcaa

SEQ ID NO: 1889781 - RNA, 15 nt, Homo sapiens
acugauaaaccaaaa

SEQ ID NO: 1889782 - RNA, 19 nt, Homo sapiens
cgaauuagguccacuucaa

SEQ ID NO: 1889783 - RNA, 17 nt, Homo sapiens
accugggcaucuuagga

SEQ ID NO: 1889784 - RNA, 15 nt, Homo sapiens
ccaggcacuguugcu

SEQ ID NO: 1889785 - RNA, 19 nt, Homo sapiens
cacacaaaauaguuuuagu

SEQ ID NO: 1889786 - RNA, 18 nt, Homo sapiens
cgaucauggcucacugca

SEQ ID NO: 1889787 - RNA, 18 nt, Homo sapiens
aauauauaucuacaauau

SEQ ID NO: 1889788 - RNA, 21 nt, Homo sapiens
cgcccaggcuggacugcagug

SEQ ID NO: 1889789 - RNA, 22 nt, Homo sapiens
cuucauguggcucagugccuuc

SEQ ID NO: 1889790 - RNA, 23 nt, Homo sapiens
uuagacuguaggaagaguagcau

SEQ ID NO: 1889791 - RNA, 16 nt, Homo sapiens
auuccacaucauguua

SEQ ID NO: 1889792 - RNA, 16 nt, Homo sapiens
gaguuaaaucuuccag

SEQ ID NO: 1889793 - RNA, 20 nt, Homo sapiens
aaugccugagugccuggcca

SEQ ID NO: 1889794 - RNA, 14 nt, Homo sapiens
agggaaugugagca

SEQ ID NO: 1889795 - RNA, 14 nt, Homo sapiens
aaaacuuguagaau

SEQ ID NO: 1889796 - RNA, 21 nt, Homo sapiens
uucaagaccauccuggacuga

SEQ ID NO: 1889797 - RNA, 11 nt, Homo sapiens
cgaugcugcug

SEQ ID NO: 1889798 - RNA, 23 nt, Homo sapiens
cugaacgcuucugcuuaaucuga

SEQ ID NO: 1889799 - RNA, 20 nt, Homo sapiens
ugugcucucccaaagccaua

SEQ ID NO: 1889800 - RNA, 12 nt, Homo sapiens
guaauuugccac

SEQ ID NO: 1889801 - RNA, 21 nt, Homo sapiens
aaagcuaaacguaauuuccac

SEQ ID NO: 1889802 - RNA, 20 nt, Homo sapiens
gcucacuaagaagcuugaau

SEQ ID NO: 1889803 - RNA, 20 nt, Homo sapiens
gucauaauaaauuaggacac

SEQ ID NO: 1889804 - RNA, 21 nt, Homo sapiens
ccccacuuuuuguuguucauu

SEQ ID NO: 1889805 - RNA, 14 nt, Homo sapiens
cuuuagagcucagc

SEQ ID NO: 1889806 - RNA, 18 nt, Homo sapiens
aaggaauuugauugcuuu

SEQ ID NO: 1889807 - RNA, 13 nt, Homo sapiens
cacgggugcauga

SEQ ID NO: 1889808 - RNA, 18 nt, Homo sapiens
cugcauuuuucagagaau

SEQ ID NO: 1889809 - RNA, 22 nt, Homo sapiens
ugaaagcacaugaauaauuuca

SEQ ID NO: 1889810 - RNA, 18 nt, Homo sapiens
agaugggaugcuugccua

SEQ ID NO: 1889811 - RNA, 23 nt, Homo sapiens
guccucuuuuguuguuucuuaau

SEQ ID NO: 1889812 - RNA, 17 nt, Homo sapiens
uggaaauaaacugugca

SEQ ID NO: 1889813 - RNA, 21 nt, Homo sapiens
caagagaaaauguguaauuca

SEQ ID NO: 1889814 - RNA, 22 nt, Homo sapiens
ucuguaauauauugccaguaua

SEQ ID NO: 1889815 - RNA, 15 nt, Homo sapiens
ugaauuuauauagca

SEQ ID NO: 1889816 - RNA, 14 nt, Homo sapiens
gaaaaugugucauu

SEQ ID NO: 1889817 - RNA, 17 nt, Homo sapiens
aggugagggcaguggga

SEQ ID NO: 1889818 - RNA, 12 nt, Homo sapiens
gugaaacaaugu

SEQ ID NO: 1889819 - RNA, 16 nt, Homo sapiens
aaagguugagauguaa

SEQ ID NO: 1889820 - RNA, 23 nt, Homo sapiens
ugagggauggacugaugcuuuua

SEQ ID NO: 1889821 - RNA, 19 nt, Homo sapiens
cugugacuuaagaagccuu

SEQ ID NO: 1889822 - RNA, 18 nt, Homo sapiens
aucuacccugcugaccuc

SEQ ID NO: 1889823 - RNA, 17 nt, Homo sapiens
uugaugacccuuuucau

SEQ ID NO: 1889824 - RNA, 23 nt, Homo sapiens
cuuaccagauccuuuuccagaaa

SEQ ID NO: 1889825 - RNA, 15 nt, Homo sapiens
uccucccuacuucca

SEQ ID NO: 1889826 - RNA, 22 nt, Homo sapiens
ugaaguccagcucccuugcuaa

SEQ ID NO: 1889827 - RNA, 15 nt, Homo sapiens
gcacaggccaggaca

SEQ ID NO: 1889828 - RNA, 21 nt, Homo sapiens
uucugucacccagacuggagu

SEQ ID NO: 1889829 - RNA, 20 nt, Homo sapiens
caguucauggcaucacaucu

SEQ ID NO: 1889830 - RNA, 22 nt, Homo sapiens
accugacuuuggagacgaugcu

SEQ ID NO: 1889831 - RNA, 18 nt, Homo sapiens
acuucucacucaccacua

SEQ ID NO: 1889832 - RNA, 20 nt, Homo sapiens
uuuagugacagcucugccug

SEQ ID NO: 1889833 - RNA, 23 nt, Homo sapiens
gccugagaacaccagagaccuca

SEQ ID NO: 1889834 - RNA, 23 nt, Homo sapiens
aucugugcacugcccauggacag

SEQ ID NO: 1889835 - RNA, 21 nt, Homo sapiens
ugaaaccuccuauuccaugcg

SEQ ID NO: 1889836 - RNA, 22 nt, Homo sapiens
gugcuuucccauaucuugccuu

SEQ ID NO: 1889837 - RNA, 20 nt, Homo sapiens
uagucauugcagaguucuua

SEQ ID NO: 1889838 - RNA, 19 nt, Homo sapiens
augccucccccaucuccau

SEQ ID NO: 1889839 - RNA, 14 nt, Homo sapiens
gaacaaaaugaauu

SEQ ID NO: 1889840 - RNA, 23 nt, Homo sapiens
cuccauccuccugugucacugaa

SEQ ID NO: 1889841 - RNA, 14 nt, Homo sapiens
acaccagcagcccu

SEQ ID NO: 1889842 - RNA, 16 nt, Homo sapiens
ugccucaagccccaga

SEQ ID NO: 1889843 - RNA, 13 nt, Homo sapiens
aauuugaaacaca

SEQ ID NO: 1889844 - RNA, 16 nt, Homo sapiens
aggcugccagugccug

SEQ ID NO: 1889845 - RNA, 20 nt, Homo sapiens
uguaaagagagcaagacaga

SEQ ID NO: 1889846 - RNA, 23 nt, Homo sapiens
ugcauaaaagacaagcacuuugg

SEQ ID NO: 1889847 - RNA, 15 nt, Homo sapiens
aauuaaacauauuca

SEQ ID NO: 1889848 - RNA, 20 nt, Homo sapiens
accgguacccuccucccgac

SEQ ID NO: 1889849 - RNA, 19 nt, Homo sapiens
guccucacugcucccugaa

SEQ ID NO: 1889850 - RNA, 15 nt, Homo sapiens
auucaagugccucuu

SEQ ID NO: 1889851 - RNA, 14 nt, Homo sapiens
agcacagccucaga

SEQ ID NO: 1889852 - RNA, 17 nt, Homo sapiens
uucaguaauguugacug

SEQ ID NO: 1889853 - RNA, 22 nt, Homo sapiens
gccaggggugcuccugugcuca

SEQ ID NO: 1889854 - RNA, 21 nt, Homo sapiens
ucucucugggaccacugggua

SEQ ID NO: 1889855 - RNA, 16 nt, Homo sapiens
ucacaauuaugugcaa

SEQ ID NO: 1889856 - RNA, 15 nt, Homo sapiens
uugcuuuauuccaga

SEQ ID NO: 1889857 - RNA, 15 nt, Homo sapiens
cugcagaacuccuuu

SEQ ID NO: 1889858 - RNA, 18 nt, Homo sapiens
auucacaguugagugcau

SEQ ID NO: 1889859 - RNA, 14 nt, Homo sapiens
agaugugauuuauu

SEQ ID NO: 1889860 - RNA, 21 nt, Homo sapiens
cuucaagaccuucaccaaaca

SEQ ID NO: 1889861 - RNA, 12 nt, Homo sapiens
cugguggagcug

SEQ ID NO: 1889862 - RNA, 19 nt, Homo sapiens
uugauuuuccucucucaca

SEQ ID NO: 1889863 - RNA, 13 nt, Homo sapiens
cuacauaaucucu

SEQ ID NO: 1889864 - RNA, 10 nt, Homo sapiens
uuugaucaua

SEQ ID NO: 1889865 - RNA, 11 nt, Homo sapiens
gaggcuaugug

SEQ ID NO: 1889866 - RNA, 22 nt, Homo sapiens
acuggaagcacagccucgggga

SEQ ID NO: 1889867 - RNA, 16 nt, Homo sapiens
gcuucuggccaggaag

SEQ ID NO: 1889868 - RNA, 11 nt, Homo sapiens
ugcuuccucag

SEQ ID NO: 1889869 - RNA, 22 nt, Homo sapiens
uaaguggcaggacccugucagg

SEQ ID NO: 1889870 - RNA, 19 nt, Homo sapiens
ucuauugucaagaugcuac

SEQ ID NO: 1889871 - RNA, 14 nt, Homo sapiens
auuuucagcauuaa

SEQ ID NO: 1889872 - RNA, 18 nt, Homo sapiens
aauucauugucucaguga

SEQ ID NO: 1889873 - RNA, 17 nt, Homo sapiens
acagaaacuaauccuua

SEQ ID NO: 1889874 - RNA, 18 nt, Homo sapiens
ucaguaaaucagugcagu

SEQ ID NO: 1889875 - RNA, 12 nt, Homo sapiens
agaugugcaaca

SEQ ID NO: 1889876 - RNA, 14 nt, Homo sapiens
ggcacuguggcacu

SEQ ID NO: 1889877 - RNA, 14 nt, Homo sapiens
cucucugucucucu

SEQ ID NO: 1889878 - RNA, 14 nt, Homo sapiens
cugucugucugucu

SEQ ID NO: 1889879 - RNA, 14 nt, Homo sapiens
uucacuguuucacu

SEQ ID NO: 1889880 - RNA, 12 nt, Homo sapiens
uuaccaucugaa

SEQ ID NO: 1889881 - RNA, 17 nt, Homo sapiens
uaguuuaugauuccacc

SEQ ID NO: 1889882 - RNA, 21 nt, Homo sapiens
ccacuugacauuccuugucac

SEQ ID NO: 1889883 - RNA, 16 nt, Homo sapiens
aagcuguuauuugcag

SEQ ID NO: 1889884 - RNA, 14 nt, Homo sapiens
gaauaucauaugua

SEQ ID NO: 1889885 - RNA, 21 nt, Homo sapiens
cgaccuuagcuuauugauccc

SEQ ID NO: 1889886 - RNA, 13 nt, Homo sapiens
gugagcacgcuga

SEQ ID NO: 1889887 - RNA, 18 nt, Homo sapiens
ucuguuggauuccaugcu

SEQ ID NO: 1889888 - RNA, 19 nt, Homo sapiens
cuggagaaaauggacgugu

SEQ ID NO: 1889889 - RNA, 11 nt, Homo sapiens
auaguauuuau

SEQ ID NO: 1889890 - RNA, 16 nt, Homo sapiens
agcuaagacauauuca

SEQ ID NO: 1889891 - RNA, 15 nt, Homo sapiens
auccuccccaggacc

SEQ ID NO: 1889892 - RNA, 16 nt, Homo sapiens
agugucugucauuuca

SEQ ID NO: 1889893 - RNA, 19 nt, Homo sapiens
ccauagguaauacaaaaag

SEQ ID NO: 1889894 - RNA, 16 nt, Homo sapiens
cuugaaguaaccuuau

SEQ ID NO: 1889895 - RNA, 14 nt, Homo sapiens
uaacugucacccau

SEQ ID NO: 1889896 - RNA, 16 nt, Homo sapiens
auucuuaagcacuuug

SEQ ID NO: 1889897 - RNA, 17 nt, Homo sapiens
ucgugaccgcaggugau

SEQ ID NO: 1889898 - RNA, 21 nt, Homo sapiens
acucaguaaggcagugcagua

SEQ ID NO: 1889899 - RNA, 20 nt, Homo sapiens
aaguucuaugaagaguauua

SEQ ID NO: 1889900 - RNA, 22 nt, Homo sapiens
acacaguaguguucuguucacu

SEQ ID NO: 1889901 - RNA, 17 nt, Homo sapiens
gggugugaacauguucu

SEQ ID NO: 1889902 - RNA, 22 nt, Homo sapiens
uuuugagacaaagucucacugu

SEQ ID NO: 1889903 - RNA, 14 nt, Homo sapiens
guuaugacugcgua

SEQ ID NO: 1889904 - RNA, 17 nt, Homo sapiens
augagagaauguggaaa

SEQ ID NO: 1889905 - RNA, 12 nt, Homo sapiens
cccagcacuuuu

SEQ ID NO: 1889906 - RNA, 23 nt, Homo sapiens
ccugccagucccagaucacacau

SEQ ID NO: 1889907 - RNA, 12 nt, Homo sapiens
ccuggaugacau

SEQ ID NO: 1889908 - RNA, 15 nt, Homo sapiens
ccuacuaaaugcuca

SEQ ID NO: 1889909 - RNA, 19 nt, Homo sapiens
agaaccucgagguuucuca

SEQ ID NO: 1889910 - RNA, 17 nt, Homo sapiens
gaaaucagcaaacuuug

SEQ ID NO: 1889911 - RNA, 14 nt, Homo sapiens
uuccccuccugacc

SEQ ID NO: 1889912 - RNA, 20 nt, Homo sapiens
ugucaugagcauuuguuuaa

SEQ ID NO: 1889913 - RNA, 17 nt, Homo sapiens
cuccugauuugagauuc

SEQ ID NO: 1889914 - RNA, 15 nt, Homo sapiens
uacuaucauucucag

SEQ ID NO: 1889915 - RNA, 16 nt, Homo sapiens
gcagcgccagugacag

SEQ ID NO: 1889916 - RNA, 16 nt, Homo sapiens
ugucaggggaacagag

SEQ ID NO: 1889917 - RNA, 16 nt, Homo sapiens
acaguaacuaagcaca

SEQ ID NO: 1889918 - RNA, 12 nt, Homo sapiens
cccugcuugcaa

SEQ ID NO: 1889919 - RNA, 13 nt, Homo sapiens
uacaguagugcau

SEQ ID NO: 1889920 - RNA, 19 nt, Homo sapiens
uagugagaaacugauuuau

SEQ ID NO: 1889921 - RNA, 16 nt, Homo sapiens
aucccuuugucuguca

SEQ ID NO: 1889922 - RNA, 14 nt, Homo sapiens
gcuccuguucacac

SEQ ID NO: 1889923 - RNA, 20 nt, Homo sapiens
uuuuuaaaagguagagucuu

SEQ ID NO: 1889924 - RNA, 15 nt, Homo sapiens
ucauuuacuuguacg

SEQ ID NO: 1889925 - RNA, 15 nt, Homo sapiens
aacacuccacagugu

SEQ ID NO: 1889926 - RNA, 17 nt, Homo sapiens
gggaagacuauggugcu

SEQ ID NO: 1889927 - RNA, 15 nt, Homo sapiens
guaaacuaugaccua

SEQ ID NO: 1889928 - RNA, 14 nt, Homo sapiens
caaacuaugaucac

SEQ ID NO: 1889929 - RNA, 15 nt, Homo sapiens
cccugcucacugggc

SEQ ID NO: 1889930 - RNA, 18 nt, Homo sapiens
uugugaugugucacaggu

SEQ ID NO: 1889931 - RNA, 20 nt, Homo sapiens
cuugccacuuuccagccugu

SEQ ID NO: 1889932 - RNA, 16 nt, Homo sapiens
gagagcaacacaggau

SEQ ID NO: 1889933 - RNA, 14 nt, Homo sapiens
acacaaacauuuaa

SEQ ID NO: 1889934 - RNA, 14 nt, Homo sapiens
acaucaacauucca

SEQ ID NO: 1889935 - RNA, 19 nt, Homo sapiens
auggccagagccucuggcc

SEQ ID NO: 1889936 - RNA, 19 nt, Homo sapiens
auaacauauagcagaccaa

SEQ ID NO: 1889937 - RNA, 18 nt, Homo sapiens
caaguugugccuuucaca

SEQ ID NO: 1889938 - RNA, 18 nt, Homo sapiens
ucaguagaagugucacag

SEQ ID NO: 1889939 - RNA, 21 nt, Homo sapiens
gauguaaucucucugcagcug

SEQ ID NO: 1889940 - RNA, 19 nt, Homo sapiens
cacugagcacuguuuucua

SEQ ID NO: 1889941 - RNA, 13 nt, Homo sapiens
gaugcucccucag

SEQ ID NO: 1889942 - RNA, 18 nt, Homo sapiens
cugauaugggacugagcc

SEQ ID NO: 1889943 - RNA, 22 nt, Homo sapiens
aggguuacccugggcacuggcc

SEQ ID NO: 1889944 - RNA, 19 nt, Homo sapiens
gccgaaaaggauaugcagu

SEQ ID NO: 1889945 - RNA, 19 nt, Homo sapiens
cauuuuaacaacugcucuu

SEQ ID NO: 1889946 - RNA, 18 nt, Homo sapiens
gucucugcuauggaaugc

SEQ ID NO: 1889947 - RNA, 20 nt, Homo sapiens
ucuuucuaacuccagugaag

SEQ ID NO: 1889948 - RNA, 20 nt, Homo sapiens
ggcccugcgucaggcagugu

SEQ ID NO: 1889949 - RNA, 16 nt, Homo sapiens
acaucauccuccuuau

SEQ ID NO: 1889950 - RNA, 20 nt, Homo sapiens
gcccaaguaccacgcagugc

SEQ ID NO: 1889951 - RNA, 16 nt, Homo sapiens
agccuucagccuuaau

SEQ ID NO: 1889952 - RNA, 21 nt, Homo sapiens
aguggucaagcccuugcccag

SEQ ID NO: 1889953 - RNA, 20 nt, Homo sapiens
cuugaguuuagugaucugaa

SEQ ID NO: 1889954 - RNA, 18 nt, Homo sapiens
ucugcagggagcaacucu

SEQ ID NO: 1889955 - RNA, 12 nt, Homo sapiens
gcuuuagcauua

SEQ ID NO: 1889956 - RNA, 14 nt, Homo sapiens
gggagcugggcccu

SEQ ID NO: 1889957 - RNA, 13 nt, Homo sapiens
gauuaucuaccca

SEQ ID NO: 1889958 - RNA, 17 nt, Homo sapiens
aaccccaacuacugugu

SEQ ID NO: 1889959 - RNA, 14 nt, Homo sapiens
auauaaacauauca

SEQ ID NO: 1889960 - RNA, 19 nt, Homo sapiens
ugucucugccauguggcag

SEQ ID NO: 1889961 - RNA, 21 nt, Homo sapiens
cuaauuggcagcacccacuca

SEQ ID NO: 1889962 - RNA, 16 nt, Homo sapiens
gccccugcacaaagcc

SEQ ID NO: 1889963 - RNA, 20 nt, Homo sapiens
gcucagacugggcacugggg

SEQ ID NO: 1889964 - RNA, 13 nt, Homo sapiens
aaaccuacuaauc

SEQ ID NO: 1889965 - RNA, 19 nt, Homo sapiens
cucuuccuacccuuccuca

SEQ ID NO: 1889966 - RNA, 18 nt, Homo sapiens
uauuuuugagacugucag

SEQ ID NO: 1889967 - RNA, 20 nt, Homo sapiens
aaaugacauggacacaucag

SEQ ID NO: 1889968 - RNA, 23 nt, Homo sapiens
gucaacauagugagacacugucu

SEQ ID NO: 1889969 - RNA, 15 nt, Homo sapiens
uacugugauguuugu

SEQ ID NO: 1889970 - RNA, 12 nt, Homo sapiens
uuuugacuugaa

SEQ ID NO: 1889971 - RNA, 16 nt, Homo sapiens
uugucagaccauaaga

SEQ ID NO: 1889972 - RNA, 12 nt, Homo sapiens
acugaggcaucc

SEQ ID NO: 1889973 - RNA, 17 nt, Homo sapiens
cuccuugcuuccugucu

SEQ ID NO: 1889974 - RNA, 12 nt, Homo sapiens
ugcacauuugaa

SEQ ID NO: 1889975 - RNA, 22 nt, Homo sapiens
uccucucagaugggcagcagcu

SEQ ID NO: 1889976 - RNA, 22 nt, Homo sapiens
uauuuaaagaagaaacgucuau

SEQ ID NO: 1889977 - RNA, 13 nt, Homo sapiens
cuaucuauagaga

SEQ ID NO: 1889978 - RNA, 17 nt, Homo sapiens
acacugucaauggacug

SEQ ID NO: 1889979 - RNA, 13 nt, Homo sapiens
guuacagaccuca

SEQ ID NO: 1889980 - RNA, 17 nt, Homo sapiens
auaauccagucuucacu

SEQ ID NO: 1889981 - RNA, 22 nt, Homo sapiens
agaccucacacacacaaaaaau

SEQ ID NO: 1889982 - RNA, 18 nt, Homo sapiens
ccaacagaccuggugcuc

SEQ ID NO: 1889983 - RNA, 21 nt, Homo sapiens
ugacuucccuggucaccaagg

SEQ ID NO: 1889984 - RNA, 21 nt, Homo sapiens
cuaaacuacaacgaacacaag

SEQ ID NO: 1889985 - RNA, 12 nt, Homo sapiens
ugugacauucac

SEQ ID NO: 1889986 - RNA, 17 nt, Homo sapiens
auauugccaaauauuaa

SEQ ID NO: 1889987 - RNA, 19 nt, Homo sapiens
gcagcaggaggcuagcaaa

SEQ ID NO: 1889988 - RNA, 14 nt, Homo sapiens
ugacuucacaguga

SEQ ID NO: 1889989 - RNA, 22 nt, Homo sapiens
agccuuaguuccccaucuacaa

SEQ ID NO: 1889990 - RNA, 21 nt, Homo sapiens
agcacgaggccucaggucggc

SEQ ID NO: 1889991 - RNA, 17 nt, Homo sapiens
ugccucccugcacuuca

SEQ ID NO: 1889992 - RNA, 22 nt, Homo sapiens
auucagggcggaauaaugggca

SEQ ID NO: 1889993 - RNA, 19 nt, Homo sapiens
uguuaggaguuaccuuaaa

SEQ ID NO: 1889994 - RNA, 13 nt, Homo sapiens
aagccauuccaaa

SEQ ID NO: 1889995 - RNA, 14 nt, Homo sapiens
acacacacaucuca

SEQ ID NO: 1889996 - RNA, 12 nt, Homo sapiens
gcccccaccagc

SEQ ID NO: 1889997 - RNA, 19 nt, Homo sapiens
aagaauugaaaaaccauuu

SEQ ID NO: 1889998 - RNA, 18 nt, Homo sapiens
acucuucaugagcacuuu

SEQ ID NO: 1889999 - RNA, 22 nt, Homo sapiens
ugauccaacuucagcaaugaau

SEQ ID NO: 1890000 - RNA, 19 nt, Homo sapiens
uggcuucccuaaacugcag

SEQ ID NO: 1890001 - RNA, 14 nt, Homo sapiens
acuacacagcacac

SEQ ID NO: 1890002 - RNA, 17 nt, Homo sapiens
agggugcugggugggca

SEQ ID NO: 1890003 - RNA, 21 nt, Homo sapiens
gggacauuaguaacugcacac

SEQ ID NO: 1890004 - RNA, 13 nt, Homo sapiens
gcuucuuuaccaa

SEQ ID NO: 1890005 - RNA, 10 nt, Homo sapiens
gccaugccuc

SEQ ID NO: 1890006 - RNA, 20 nt, Homo sapiens
aucaguuuuuucaccuggaa

SEQ ID NO: 1890007 - RNA, 15 nt, Homo sapiens
augaggaucugaaaa

SEQ ID NO: 1890008 - RNA, 17 nt, Homo sapiens
cucacaccuguaauccc

SEQ ID NO: 1890009 - RNA, 17 nt, Homo sapiens
uuuaauaaagcacaaaa

SEQ ID NO: 1890010 - RNA, 20 nt, Homo sapiens
cugccuuuguucacugugag

SEQ ID NO: 1890011 - RNA, 14 nt, Homo sapiens
gugcaagcaaagaa

SEQ ID NO: 1890012 - RNA, 13 nt, Homo sapiens
cgcacaugcacac

SEQ ID NO: 1890013 - RNA, 15 nt, Homo sapiens
gcaucaguagcugag

SEQ ID NO: 1890014 - RNA, 20 nt, Homo sapiens
guccauuuuccuaaccacaa

SEQ ID NO: 1890015 - RNA, 15 nt, Homo sapiens
gggccugaugugugu

SEQ ID NO: 1890016 - RNA, 22 nt, Homo sapiens
auuaaaaaauauauauauguau

SEQ ID NO: 1890017 - RNA, 18 nt, Homo sapiens
uacccagagaguccugug

SEQ ID NO: 1890018 - RNA, 19 nt, Homo sapiens
gaaacaauuauuguacacu

SEQ ID NO: 1890019 - RNA, 19 nt, Homo sapiens
uaguuuacuuuggacuaaa

SEQ ID NO: 1890020 - RNA, 22 nt, Homo sapiens
uuguucguggagucucauggga

SEQ ID NO: 1890021 - RNA, 14 nt, Homo sapiens
aucuugcaccccaa

SEQ ID NO: 1890022 - RNA, 15 nt, Homo sapiens
agagacuauggagcc

SEQ ID NO: 1890023 - RNA, 23 nt, Homo sapiens
ggcccggccagcgggcacagggc

SEQ ID NO: 1890024 - RNA, 11 nt, Homo sapiens
uuuauaugcau

SEQ ID NO: 1890025 - RNA, 23 nt, Homo sapiens
aaauuauuuauuacuugugcacu

SEQ ID NO: 1890026 - RNA, 22 nt, Homo sapiens
cuauaaaauaaacuucuuaaca

SEQ ID NO: 1890027 - RNA, 17 nt, Homo sapiens
gccccuccccuccaaaa

SEQ ID NO: 1890028 - RNA, 22 nt, Homo sapiens
augugcuugaagauucaggcuu

SEQ ID NO: 1890029 - RNA, 16 nt, Homo sapiens
gcauccuagucucuau

SEQ ID NO: 1890030 - RNA, 15 nt, Homo sapiens
acuaaaaaaugucua

SEQ ID NO: 1890031 - RNA, 20 nt, Homo sapiens
cuccucccaaaauacuacac

SEQ ID NO: 1890032 - RNA, 20 nt, Homo sapiens
guuugaaucugaaugcuaua

SEQ ID NO: 1890033 - RNA, 22 nt, Homo sapiens
aaaccucugccgcccuccacac

SEQ ID NO: 1890034 - RNA, 17 nt, Homo sapiens
uaaaaaugauacugaug

SEQ ID NO: 1890035 - RNA, 14 nt, Homo sapiens
ccugcagggagcag

SEQ ID NO: 1890036 - RNA, 19 nt, Homo sapiens
uaaccaguuuagcuuuuuc

SEQ ID NO: 1890037 - RNA, 14 nt, Homo sapiens
agacgguguugcag

SEQ ID NO: 1890038 - RNA, 20 nt, Homo sapiens
ucaucucauuccaacuuccc

SEQ ID NO: 1890039 - RNA, 22 nt, Homo sapiens
cccagugcuucuccaacacuga

SEQ ID NO: 1890040 - RNA, 21 nt, Homo sapiens
acucuuaugaaaugggcuuua

SEQ ID NO: 1890041 - RNA, 13 nt, Homo sapiens
cauaaaucacaaa

SEQ ID NO: 1890042 - RNA, 21 nt, Homo sapiens
ugaccuuggagagacacagcg

SEQ ID NO: 1890043 - RNA, 22 nt, Homo sapiens
caaaaccagguccaaugagcuu

SEQ ID NO: 1890044 - RNA, 22 nt, Homo sapiens
aauauauuuuucccuguuugcc

SEQ ID NO: 1890045 - RNA, 20 nt, Homo sapiens
gcuuucuuaacuauccuaac

SEQ ID NO: 1890046 - RNA, 20 nt, Homo sapiens
ucagagagcuucaacuacuu

SEQ ID NO: 1890047 - RNA, 17 nt, Homo sapiens
gauuacaucugccuuaa

SEQ ID NO: 1890048 - RNA, 17 nt, Homo sapiens
ccugcuucaauacccaa

SEQ ID NO: 1890049 - RNA, 21 nt, Homo sapiens
aaagaaucccuagacuuuagg

SEQ ID NO: 1890050 - RNA, 20 nt, Homo sapiens
ucugcucgccuuagcacuac

SEQ ID NO: 1890051 - RNA, 21 nt, Homo sapiens
cucuauagacucuaggacaua

SEQ ID NO: 1890052 - RNA, 23 nt, Homo sapiens
uuagacaacccugagguaucugu

SEQ ID NO: 1890053 - RNA, 19 nt, Homo sapiens
gcuucuccugauccugcaa

SEQ ID NO: 1890054 - RNA, 18 nt, Homo sapiens
auauaugccuucccccac

SEQ ID NO: 1890055 - RNA, 12 nt, Homo sapiens
gaugcugccaaa

SEQ ID NO: 1890056 - RNA, 16 nt, Homo sapiens
acaccauagugucaca

SEQ ID NO: 1890057 - RNA, 12 nt, Homo sapiens
auaaauagccuu

SEQ ID NO: 1890058 - RNA, 17 nt, Homo sapiens
gaccuucuccccauucu

SEQ ID NO: 1890059 - RNA, 16 nt, Homo sapiens
ugucuuagacacugug

SEQ ID NO: 1890060 - RNA, 16 nt, Homo sapiens
cuucuggagucuccag

SEQ ID NO: 1890061 - RNA, 16 nt, Homo sapiens
cuuuaaacaaauucau

SEQ ID NO: 1890062 - RNA, 17 nt, Homo sapiens
agccaugaccuugugcc

SEQ ID NO: 1890063 - RNA, 20 nt, Homo sapiens
auacuuggaugcagcucuug

SEQ ID NO: 1890064 - RNA, 18 nt, Homo sapiens
ggcauggagccagugccu

SEQ ID NO: 1890065 - RNA, 18 nt, Homo sapiens
cccuuggcuucugugaug

SEQ ID NO: 1890066 - RNA, 22 nt, Homo sapiens
caucguguuugcaaagguuaaa

SEQ ID NO: 1890067 - RNA, 15 nt, Homo sapiens
cugccuagaaacaga

SEQ ID NO: 1890068 - RNA, 18 nt, Homo sapiens
cuaaagucuguugauuaa

SEQ ID NO: 1890069 - RNA, 21 nt, Homo sapiens
aauguggcugcugaaacucau

SEQ ID NO: 1890070 - RNA, 16 nt, Homo sapiens
uggcgucugucuucaa

SEQ ID NO: 1890071 - RNA, 24 nt, Homo sapiens
caagccugccucgccuuguguuac

SEQ ID NO: 1890072 - RNA, 21 nt, Homo sapiens
ugcuucugccguugcugccag

SEQ ID NO: 1890073 - RNA, 17 nt, Homo sapiens
acccacuugccugucac

SEQ ID NO: 1890074 - RNA, 17 nt, Homo sapiens
ugccccuggggcuucca

SEQ ID NO: 1890075 - RNA, 16 nt, Homo sapiens
aucucccuuccaccuc

SEQ ID NO: 1890076 - RNA, 18 nt, Homo sapiens
uguccuccccucaaggac

SEQ ID NO: 1890077 - RNA, 17 nt, Homo sapiens
ccucaacugaaggggug

SEQ ID NO: 1890078 - RNA, 16 nt, Homo sapiens
agcaucuaguuucccu

SEQ ID NO: 1890079 - RNA, 23 nt, Homo sapiens
agggaaaguuaaaaguguugauu

SEQ ID NO: 1890080 - RNA, 22 nt, Homo sapiens
gaguuuuauagccuggacugcu

SEQ ID NO: 1890081 - RNA, 15 nt, Homo sapiens
uacucaugcaugcaa

SEQ ID NO: 1890082 - RNA, 13 nt, Homo sapiens
ucacugggccaau

SEQ ID NO: 1890083 - RNA, 15 nt, Homo sapiens
ccauuaaagagccag

SEQ ID NO: 1890084 - RNA, 14 nt, Homo sapiens
ugaaagaacaucag

SEQ ID NO: 1890085 - RNA, 15 nt, Homo sapiens
ugacacgguaggcca

SEQ ID NO: 1890086 - RNA, 15 nt, Homo sapiens
gucuuaucaacuggu

SEQ ID NO: 1890087 - RNA, 15 nt, Homo sapiens
ucuguguuaggggua

SEQ ID NO: 1890088 - RNA, 19 nt, Homo sapiens
ccgugcugucuucuggucu

SEQ ID NO: 1890089 - RNA, 12 nt, Homo sapiens
caguaaggauuu

SEQ ID NO: 1890090 - RNA, 16 nt, Homo sapiens
uaccauaugucugcuu

SEQ ID NO: 1890091 - RNA, 17 nt, Homo sapiens
auugguuuuguacugga

SEQ ID NO: 1890092 - RNA, 16 nt, Homo sapiens
uaauacguuaauacgc

SEQ ID NO: 1890093 - RNA, 16 nt, Homo sapiens
uggaacacuggaacau

SEQ ID NO: 1890094 - RNA, 16 nt, Homo sapiens
agauguuuggaaacca

SEQ ID NO: 1890095 - RNA, 16 nt, Homo sapiens
cuugccuuuuaaguua

SEQ ID NO: 1890096 - RNA, 20 nt, Homo sapiens
uugauuccugguuugacuca

SEQ ID NO: 1890097 - RNA, 15 nt, Homo sapiens
cccacaugaucuuga

SEQ ID NO: 1890098 - RNA, 11 nt, Homo sapiens
uagaaccagcc

SEQ ID NO: 1890099 - RNA, 20 nt, Homo sapiens
agguucuagucucuguugcu

SEQ ID NO: 1890100 - RNA, 12 nt, Homo sapiens
guagggagugaa

SEQ ID NO: 1890101 - RNA, 20 nt, Homo sapiens
cacaaauaaaggaaacccag

SEQ ID NO: 1890102 - RNA, 12 nt, Homo sapiens
aauggcuuccag

SEQ ID NO: 1890103 - RNA, 19 nt, Homo sapiens
agaggcuaauucaguguca

SEQ ID NO: 1890104 - RNA, 22 nt, Homo sapiens
agaaacaccccucugucuagga

SEQ ID NO: 1890105 - RNA, 12 nt, Homo sapiens
guaaagaucuac

SEQ ID NO: 1890106 - RNA, 19 nt, Homo sapiens
uuucuuggucucagcuuca

SEQ ID NO: 1890107 - RNA, 12 nt, Homo sapiens
agguucuugaua

SEQ ID NO: 1890108 - RNA, 16 nt, Homo sapiens
augcacuuauucaaua

SEQ ID NO: 1890109 - RNA, 16 nt, Homo sapiens
uaguuaauuauuucaa

SEQ ID NO: 1890110 - RNA, 17 nt, Homo sapiens
cugccacagacuguggu

SEQ ID NO: 1890111 - RNA, 17 nt, Homo sapiens
gucucugccacuccuga

SEQ ID NO: 1890112 - RNA, 23 nt, Homo sapiens
aacagcaagaguaagcaguguua

SEQ ID NO: 1890113 - RNA, 20 nt, Homo sapiens
ggcuggggccaccuuugugc

SEQ ID NO: 1890114 - RNA, 17 nt, Homo sapiens
ucacauucagagucgcu

SEQ ID NO: 1890115 - RNA, 16 nt, Homo sapiens
uaaaauuaaauuugau

SEQ ID NO: 1890116 - RNA, 13 nt, Homo sapiens
acauguaaugaca

SEQ ID NO: 1890117 - RNA, 14 nt, Homo sapiens
ucuaugguugacau

SEQ ID NO: 1890118 - RNA, 23 nt, Homo sapiens
aagguuuaaaguuugaagauuau

SEQ ID NO: 1890119 - RNA, 22 nt, Homo sapiens
uuuuccaagugugcauauugua

SEQ ID NO: 1890120 - RNA, 14 nt, Homo sapiens
ggggcucccucucu

SEQ ID NO: 1890121 - RNA, 15 nt, Homo sapiens
uccccaacaauguga

SEQ ID NO: 1890122 - RNA, 19 nt, Homo sapiens
aaaauagcaugccuuucuc

SEQ ID NO: 1890123 - RNA, 18 nt, Homo sapiens
gaauauuuauuaccucug

SEQ ID NO: 1890124 - RNA, 14 nt, Homo sapiens
guccacagaccuac

SEQ ID NO: 1890125 - RNA, 19 nt, Homo sapiens
agauggaccugccugcaua

SEQ ID NO: 1890126 - RNA, 22 nt, Homo sapiens
gcuuguaacuccaccaacccau

SEQ ID NO: 1890127 - RNA, 20 nt, Homo sapiens
caguuuuauuuuugccaagg

SEQ ID NO: 1890128 - RNA, 15 nt, Homo sapiens
acaggcaugagccac

SEQ ID NO: 1890129 - RNA, 21 nt, Homo sapiens
ugaggaaaaacucccauauca

SEQ ID NO: 1890130 - RNA, 20 nt, Homo sapiens
ugcuugcuaccaaucuguga

SEQ ID NO: 1890131 - RNA, 16 nt, Homo sapiens
guccccgcacugggcu

SEQ ID NO: 1890132 - RNA, 14 nt, Homo sapiens
cugagugugaugaa

SEQ ID NO: 1890133 - RNA, 13 nt, Homo sapiens
aacauugcaugua

SEQ ID NO: 1890134 - RNA, 15 nt, Homo sapiens
cuccgcaacagccaa

SEQ ID NO: 1890135 - RNA, 22 nt, Homo sapiens
cuuaucaccccuuccuccuucc

SEQ ID NO: 1890136 - RNA, 16 nt, Homo sapiens
uagcugggacuacagg

SEQ ID NO: 1890137 - RNA, 16 nt, Homo sapiens
uacaaaaacacagcaa

SEQ ID NO: 1890138 - RNA, 13 nt, Homo sapiens
uauuauauggaaa

SEQ ID NO: 1890139 - RNA, 17 nt, Homo sapiens
gaggaauucagcucagc

SEQ ID NO: 1890140 - RNA, 22 nt, Homo sapiens
acacucaucacacuucauugua

SEQ ID NO: 1890141 - RNA, 22 nt, Homo sapiens
ccuauaugcuggagauggacaa

SEQ ID NO: 1890142 - RNA, 16 nt, Homo sapiens
accaauauuguacagu

SEQ ID NO: 1890143 - RNA, 15 nt, Homo sapiens
uugggaaagcugccu

SEQ ID NO: 1890144 - RNA, 16 nt, Homo sapiens
gaaguuuaaaaaacca

SEQ ID NO: 1890145 - RNA, 20 nt, Homo sapiens
uccuucaguccaccacagca

SEQ ID NO: 1890146 - RNA, 20 nt, Homo sapiens
auuaaaagaugucucugcaa

SEQ ID NO: 1890147 - RNA, 15 nt, Homo sapiens
uggccaaaaugcaga

SEQ ID NO: 1890148 - RNA, 22 nt, Homo sapiens
cauggcuuuaaaacaugcuguc

SEQ ID NO: 1890149 - RNA, 14 nt, Homo sapiens
aauaucaacaacaa

SEQ ID NO: 1890150 - RNA, 17 nt, Homo sapiens
gcuucucuccacagugu

SEQ ID NO: 1890151 - RNA, 24 nt, Homo sapiens
gaggcagagguugcagugagcuga

SEQ ID NO: 1890152 - RNA, 16 nt, Homo sapiens
auuuuagauuuuccag

SEQ ID NO: 1890153 - RNA, 16 nt, Homo sapiens
gcauaguccaaaaagc

SEQ ID NO: 1890154 - RNA, 13 nt, Homo sapiens
cagccucccucag

SEQ ID NO: 1890155 - RNA, 13 nt, Homo sapiens
accucuugggcau

SEQ ID NO: 1890156 - RNA, 14 nt, Homo sapiens
cucucagauuucca

SEQ ID NO: 1890157 - RNA, 15 nt, Homo sapiens
cacaagcaugaagug

SEQ ID NO: 1890158 - RNA, 15 nt, Homo sapiens
ucagccucauucacu

SEQ ID NO: 1890159 - RNA, 12 nt, Homo sapiens
ggcugguggcca

SEQ ID NO: 1890160 - RNA, 16 nt, Homo sapiens
ccuggcggggucuugc

SEQ ID NO: 1890161 - RNA, 16 nt, Homo sapiens
cucugcauccucugga

SEQ ID NO: 1890162 - RNA, 23 nt, Homo sapiens
acagacuggcuccaacacugcaa

SEQ ID NO: 1890163 - RNA, 17 nt, Homo sapiens
ccauacucaugcaugca

SEQ ID NO: 1890164 - RNA, 14 nt, Homo sapiens
ugaccugugaccag

SEQ ID NO: 1890165 - RNA, 17 nt, Homo sapiens
cgaaaucaagaaacuca

SEQ ID NO: 1890166 - RNA, 23 nt, Homo sapiens
aaggaugaucuaggaagacuuug

SEQ ID NO: 1890167 - RNA, 14 nt, Homo sapiens
ggcggaucaccuga

SEQ ID NO: 1890168 - RNA, 20 nt, Homo sapiens
acuuaaauuugaaucugagu

SEQ ID NO: 1890169 - RNA, 12 nt, Homo sapiens
cacgccugcaaa

SEQ ID NO: 1890170 - RNA, 16 nt, Homo sapiens
gugcuaaaccauucau

SEQ ID NO: 1890171 - RNA, 16 nt, Homo sapiens
ccaccacuguguccca

SEQ ID NO: 1890172 - RNA, 21 nt, Homo sapiens
uuaugaaaacuagcauuacau

SEQ ID NO: 1890173 - RNA, 15 nt, Homo sapiens
auucuugacauucac

SEQ ID NO: 1890174 - RNA, 14 nt, Homo sapiens
gacucugcacaugu

SEQ ID NO: 1890175 - RNA, 13 nt, Homo sapiens
gucuuucugacau

SEQ ID NO: 1890176 - RNA, 20 nt, Homo sapiens
auccccuuugguuuuacuac

SEQ ID NO: 1890177 - RNA, 13 nt, Homo sapiens
acaaaaaauacuu

SEQ ID NO: 1890178 - RNA, 22 nt, Homo sapiens
gcugagguuuagaugugcaacc

SEQ ID NO: 1890179 - RNA, 12 nt, Homo sapiens
uaacaugaugua

SEQ ID NO: 1890180 - RNA, 14 nt, Homo sapiens
aaagcgagauccca

SEQ ID NO: 1890181 - RNA, 22 nt, Homo sapiens
aaauguacaacugcaccuguca

SEQ ID NO: 1890182 - RNA, 13 nt, Homo sapiens
aacauuaccaaaa

SEQ ID NO: 1890183 - RNA, 21 nt, Homo sapiens
ugcgcacacacagauaugcac

SEQ ID NO: 1890184 - RNA, 20 nt, Homo sapiens
accauugcuucacuacccau

SEQ ID NO: 1890185 - RNA, 13 nt, Homo sapiens
auccuaccuguua

SEQ ID NO: 1890186 - RNA, 17 nt, Homo sapiens
guaaagauuaaaaccaa

SEQ ID NO: 1890187 - RNA, 19 nt, Homo sapiens
ucagugacuguuguagcau

SEQ ID NO: 1890188 - RNA, 16 nt, Homo sapiens
gcuuugcccaccccuc

SEQ ID NO: 1890189 - RNA, 23 nt, Homo sapiens
cccaucauucaugcuacugccaa

SEQ ID NO: 1890190 - RNA, 15 nt, Homo sapiens
caggagaagcucagc

SEQ ID NO: 1890191 - RNA, 22 nt, Homo sapiens
uguagcuucucuugcucucgac

SEQ ID NO: 1890192 - RNA, 18 nt, Homo sapiens
gauggccccuccuugcaa

SEQ ID NO: 1890193 - RNA, 16 nt, Homo sapiens
auaaacucaaugagcu

SEQ ID NO: 1890194 - RNA, 22 nt, Homo sapiens
aucucacaccaguccaaauggc

SEQ ID NO: 1890195 - RNA, 16 nt, Homo sapiens
uagaaaagcacuugaa

SEQ ID NO: 1890196 - RNA, 15 nt, Homo sapiens
uuauagaaguagcaa

SEQ ID NO: 1890197 - RNA, 23 nt, Homo sapiens
gcaaccuagaaacacacauuucu

SEQ ID NO: 1890198 - RNA, 17 nt, Homo sapiens
aggcaggaggaucacuu

SEQ ID NO: 1890199 - RNA, 14 nt, Homo sapiens
auucggagugucug

SEQ ID NO: 1890200 - RNA, 12 nt, Homo sapiens
aggcacaguggc

SEQ ID NO: 1890201 - RNA, 12 nt, Homo sapiens
ugaaacagagaa

SEQ ID NO: 1890202 - RNA, 15 nt, Homo sapiens
ggcacaacugcaaua

SEQ ID NO: 1890203 - RNA, 17 nt, Homo sapiens
uuaaacaaaugguccau

SEQ ID NO: 1890204 - RNA, 14 nt, Homo sapiens
aaauuguccuugaa

SEQ ID NO: 1890205 - RNA, 15 nt, Homo sapiens
ugaaagugaacaauc

SEQ ID NO: 1890206 - RNA, 18 nt, Homo sapiens
ucaggggaaccauggggc

SEQ ID NO: 1890207 - RNA, 20 nt, Homo sapiens
augcuggcugaagaggacca

SEQ ID NO: 1890208 - RNA, 20 nt, Homo sapiens
ggcuaaccuguuacacuggg

SEQ ID NO: 1890209 - RNA, 12 nt, Homo sapiens
cucccugagucu

SEQ ID NO: 1890210 - RNA, 19 nt, Homo sapiens
uguauuccucacauucaca

SEQ ID NO: 1890211 - RNA, 18 nt, Homo sapiens
gccaggugccaucaucuc

SEQ ID NO: 1890212 - RNA, 23 nt, Homo sapiens
cuggggggcguggagagcccggc

SEQ ID NO: 1890213 - RNA, 22 nt, Homo sapiens
acugcagaauguaaagguuuca

SEQ ID NO: 1890214 - RNA, 19 nt, Homo sapiens
gaagagguugggcuuccau

SEQ ID NO: 1890215 - RNA, 22 nt, Homo sapiens
auguuuucacuuaaaaguauca

SEQ ID NO: 1890216 - RNA, 14 nt, Homo sapiens
ggguucaugcuuaa

SEQ ID NO: 1890217 - RNA, 16 nt, Homo sapiens
guaauaaacagccagg

SEQ ID NO: 1890218 - RNA, 15 nt, Homo sapiens
agcuggugagugaug

SEQ ID NO: 1890219 - RNA, 12 nt, Homo sapiens
ucuaugugacau

SEQ ID NO: 1890220 - RNA, 18 nt, Homo sapiens
aaucacacucucuucuua

SEQ ID NO: 1890221 - RNA, 12 nt, Homo sapiens
agauggauguaa

SEQ ID NO: 1890222 - RNA, 14 nt, Homo sapiens
agaacuagguuuaa

SEQ ID NO: 1890223 - RNA, 16 nt, Homo sapiens
acaccgauguacacac

SEQ ID NO: 1890224 - RNA, 21 nt, Homo sapiens
cuauccacagaaccuuuguca

SEQ ID NO: 1890225 - RNA, 15 nt, Homo sapiens
aguuaucaacaugca

SEQ ID NO: 1890226 - RNA, 19 nt, Homo sapiens
aucuuuuuucccucuuaca

SEQ ID NO: 1890227 - RNA, 15 nt, Homo sapiens
aaauauucacucucc

SEQ ID NO: 1890228 - RNA, 13 nt, Homo sapiens
gauguaauacuuc

SEQ ID NO: 1890229 - RNA, 11 nt, Homo sapiens
aguugcacagc

SEQ ID NO: 1890230 - RNA, 14 nt, Homo sapiens
uaacacuauuugau

SEQ ID NO: 1890231 - RNA, 23 nt, Homo sapiens
gccuucuuggggauucaaaaaca

SEQ ID NO: 1890232 - RNA, 19 nt, Homo sapiens
accuccggcugccuagccc

SEQ ID NO: 1890233 - RNA, 18 nt, Homo sapiens
auaauggggccuguuaca

SEQ ID NO: 1890234 - RNA, 19 nt, Homo sapiens
aauacuugaccucugugac

SEQ ID NO: 1890235 - RNA, 14 nt, Homo sapiens
auuaauuucagucu

SEQ ID NO: 1890236 - RNA, 14 nt, Homo sapiens
cugaauuuaauucu

SEQ ID NO: 1890237 - RNA, 17 nt, Homo sapiens
cacauuguuaggugcug

SEQ ID NO: 1890238 - RNA, 19 nt, Homo sapiens
agcuccauuucuacucuua

SEQ ID NO: 1890239 - RNA, 18 nt, Homo sapiens
auauuggaucauacuggu

SEQ ID NO: 1890240 - RNA, 12 nt, Homo sapiens
uacuauguuaau

SEQ ID NO: 1890241 - RNA, 22 nt, Homo sapiens
aucuuuuauuucauucauaucc

SEQ ID NO: 1890242 - RNA, 19 nt, Homo sapiens
cuucaaggguaaaagagug

SEQ ID NO: 1890243 - RNA, 13 nt, Homo sapiens
gaaaacuguaguc

SEQ ID NO: 1890244 - RNA, 23 nt, Homo sapiens
aauuuucuaauuuauuuucucaa

SEQ ID NO: 1890245 - RNA, 15 nt, Homo sapiens
ugcaaauauaaucca

SEQ ID NO: 1890246 - RNA, 16 nt, Homo sapiens
caguguauguacuaag

SEQ ID NO: 1890247 - RNA, 21 nt, Homo sapiens
accugcccaaggaugcuguca

SEQ ID NO: 1890248 - RNA, 15 nt, Homo sapiens
auauacauuucauaa

SEQ ID NO: 1890249 - RNA, 18 nt, Homo sapiens
ugcucgacacuuaccacu

SEQ ID NO: 1890250 - RNA, 13 nt, Homo sapiens
uuccccugcaaug

SEQ ID NO: 1890251 - RNA, 19 nt, Homo sapiens
caagaucugaaauaaauga

SEQ ID NO: 1890252 - RNA, 21 nt, Homo sapiens
guuucacaacaggcauuccag

SEQ ID NO: 1890253 - RNA, 13 nt, Homo sapiens
guuuucuguucuc

SEQ ID NO: 1890254 - RNA, 17 nt, Homo sapiens
acuuccuccccauguga

SEQ ID NO: 1890255 - RNA, 14 nt, Homo sapiens
uuuuucaacuugga

SEQ ID NO: 1890256 - RNA, 18 nt, Homo sapiens
gaagcuuuuuguuugcau

SEQ ID NO: 1890257 - RNA, 16 nt, Homo sapiens
cuucaucuuugccaua

SEQ ID NO: 1890258 - RNA, 20 nt, Homo sapiens
gcuuucucugccucugggca

SEQ ID NO: 1890259 - RNA, 15 nt, Homo sapiens
ggccuccgaugccug

SEQ ID NO: 1890260 - RNA, 23 nt, Homo sapiens
uaugucugugugccccuccugcc

SEQ ID NO: 1890261 - RNA, 14 nt, Homo sapiens
cugggaaacagucc

SEQ ID NO: 1890262 - RNA, 15 nt, Homo sapiens
uguucauagcuucca

SEQ ID NO: 1890263 - RNA, 15 nt, Homo sapiens
auuaaugacauauug

SEQ ID NO: 1890264 - RNA, 14 nt, Homo sapiens
cuggggaagccagu

SEQ ID NO: 1890265 - RNA, 21 nt, Homo sapiens
ucagacuccugugcaacuuuc

SEQ ID NO: 1890266 - RNA, 18 nt, Homo sapiens
gagugugacagggccagu

SEQ ID NO: 1890267 - RNA, 15 nt, Homo sapiens
ucccuugguggcaag

SEQ ID NO: 1890268 - RNA, 19 nt, Homo sapiens
ucaaauagauggauuugua

SEQ ID NO: 1890269 - RNA, 13 nt, Homo sapiens
ccuucaaagccac

SEQ ID NO: 1890270 - RNA, 18 nt, Homo sapiens
ccagaaugccuccugcag

SEQ ID NO: 1890271 - RNA, 13 nt, Homo sapiens
gccugaaccuggg

SEQ ID NO: 1890272 - RNA, 13 nt, Homo sapiens
ucagaagugauuu

SEQ ID NO: 1890273 - RNA, 16 nt, Homo sapiens
cugaaacagcugccac

SEQ ID NO: 1890274 - RNA, 15 nt, Homo sapiens
caaagaaacuugaag

SEQ ID NO: 1890275 - RNA, 16 nt, Homo sapiens
aucuucaagaccaaag

SEQ ID NO: 1890276 - RNA, 14 nt, Homo sapiens
cuuuauuugcugua

SEQ ID NO: 1890277 - RNA, 12 nt, Homo sapiens
cuguugaaucuu

SEQ ID NO: 1890278 - RNA, 16 nt, Homo sapiens
agcagcuggcacugac

SEQ ID NO: 1890279 - RNA, 20 nt, Homo sapiens
uauucccccaucuagccauu

SEQ ID NO: 1890280 - RNA, 18 nt, Homo sapiens
aauaaaacuuaacuucca

SEQ ID NO: 1890281 - RNA, 16 nt, Homo sapiens
auguauaguauacucu

SEQ ID NO: 1890282 - RNA, 16 nt, Homo sapiens
ucuguuaauaaucuca

SEQ ID NO: 1890283 - RNA, 21 nt, Homo sapiens
auuugccuucugaaaugugac

SEQ ID NO: 1890284 - RNA, 22 nt, Homo sapiens
aggcuuggcauaguccaaaauu

SEQ ID NO: 1890285 - RNA, 17 nt, Homo sapiens
cuaaagaaauaaucucu

SEQ ID NO: 1890286 - RNA, 21 nt, Homo sapiens
gaaccacggaggaugaugcca

SEQ ID NO: 1890287 - RNA, 17 nt, Homo sapiens
gcaagaucauagcucau

SEQ ID NO: 1890288 - RNA, 15 nt, Homo sapiens
uccuccgucaccuca

SEQ ID NO: 1890289 - RNA, 23 nt, Homo sapiens
ugcugcaggccgugugucuguca

SEQ ID NO: 1890290 - RNA, 21 nt, Homo sapiens
uuuucaccuauccagagagua

SEQ ID NO: 1890291 - RNA, 19 nt, Homo sapiens
uucacugagcuccccagau

SEQ ID NO: 1890292 - RNA, 13 nt, Homo sapiens
agagacagggucu

SEQ ID NO: 1890293 - RNA, 22 nt, Homo sapiens
ccuggcacucuuguucccacac

SEQ ID NO: 1890294 - RNA, 18 nt, Homo sapiens
cagcaccaugggccuucu

SEQ ID NO: 1890295 - RNA, 18 nt, Homo sapiens
gaauuacaauuucuuuaa

SEQ ID NO: 1890296 - RNA, 19 nt, Homo sapiens
cgugugacucgccagcuca

SEQ ID NO: 1890297 - RNA, 23 nt, Homo sapiens
cagaacaaaaagaaaucuugucu

SEQ ID NO: 1890298 - RNA, 18 nt, Homo sapiens
cccagcagaaaucaucau

SEQ ID NO: 1890299 - RNA, 16 nt, Homo sapiens
gagggcucagggcagu

SEQ ID NO: 1890300 - RNA, 21 nt, Homo sapiens
cuguccuggcuuuuauuuaaa

SEQ ID NO: 1890301 - RNA, 17 nt, Homo sapiens
agauaauuuauuauaca

SEQ ID NO: 1890302 - RNA, 19 nt, Homo sapiens
gaauuuagucucuguguca

SEQ ID NO: 1890303 - RNA, 14 nt, Homo sapiens
uuuuguuggucuga

SEQ ID NO: 1890304 - RNA, 17 nt, Homo sapiens
aguaguccuuggcauag

SEQ ID NO: 1890305 - RNA, 21 nt, Homo sapiens
caguggcaaauguagcccugc

SEQ ID NO: 1890306 - RNA, 21 nt, Homo sapiens
uugcuugacccagguagucaa

SEQ ID NO: 1890307 - RNA, 21 nt, Homo sapiens
aaaguauaaccauaugauacu

SEQ ID NO: 1890308 - RNA, 18 nt, Homo sapiens
ugggacuguuuacaaaug

SEQ ID NO: 1890309 - RNA, 15 nt, Homo sapiens
gcuacaccacucugg

SEQ ID NO: 1890310 - RNA, 19 nt, Homo sapiens
uuccugccaccugcugcug

SEQ ID NO: 1890311 - RNA, 12 nt, Homo sapiens
ggucagcaguau

SEQ ID NO: 1890312 - RNA, 15 nt, Homo sapiens
cucucucugcuccca

SEQ ID NO: 1890313 - RNA, 11 nt, Homo sapiens
caacccugugu

SEQ ID NO: 1890314 - RNA, 15 nt, Homo sapiens
aauguagaaagugau

SEQ ID NO: 1890315 - RNA, 14 nt, Homo sapiens
cgggcacugucaug

SEQ ID NO: 1890316 - RNA, 16 nt, Homo sapiens
agccccaggggacaag

SEQ ID NO: 1890317 - RNA, 16 nt, Homo sapiens
acuccaaaauguuggu

SEQ ID NO: 1890318 - RNA, 23 nt, Homo sapiens
caugaaauggacaaacagugcac

SEQ ID NO: 1890319 - RNA, 14 nt, Homo sapiens
agcauauuuugcug

SEQ ID NO: 1890320 - RNA, 21 nt, Homo sapiens
accauguaauggcaguuauau

SEQ ID NO: 1890321 - RNA, 18 nt, Homo sapiens
uuaucuguuuucuaccuc

SEQ ID NO: 1890322 - RNA, 12 nt, Homo sapiens
ugacucaccuga

SEQ ID NO: 1890323 - RNA, 13 nt, Homo sapiens
gcucagaacccag

SEQ ID NO: 1890324 - RNA, 17 nt, Homo sapiens
acuuuuauuuccuguau

SEQ ID NO: 1890325 - RNA, 18 nt, Homo sapiens
ugacuucauuugugccac

SEQ ID NO: 1890326 - RNA, 13 nt, Homo sapiens
cuguagaugaugu

SEQ ID NO: 1890327 - RNA, 21 nt, Homo sapiens
caugcauuuuaccaucacaca

SEQ ID NO: 1890328 - RNA, 20 nt, Homo sapiens
cuugcugugaaaugacugca

SEQ ID NO: 1890329 - RNA, 18 nt, Homo sapiens
uuaaauauuuauaucuca

SEQ ID NO: 1890330 - RNA, 16 nt, Homo sapiens
ccccuggcauguuuca

SEQ ID NO: 1890331 - RNA, 12 nt, Homo sapiens
uaauguacaaaa

SEQ ID NO: 1890332 - RNA, 16 nt, Homo sapiens
accccggccugucuca

SEQ ID NO: 1890333 - RNA, 18 nt, Homo sapiens
uggggaacagagcaagac

SEQ ID NO: 1890334 - RNA, 18 nt, Homo sapiens
gaaaguaucaccaaaaaa

SEQ ID NO: 1890335 - RNA, 22 nt, Homo sapiens
aaacugucaaagaaucaaucca

SEQ ID NO: 1890336 - RNA, 11 nt, Homo sapiens
agucccaagac

SEQ ID NO: 1890337 - RNA, 15 nt, Homo sapiens
uggaccugguacaaa

SEQ ID NO: 1890338 - RNA, 22 nt, Homo sapiens
augcugcuggggaagacagugg

SEQ ID NO: 1890339 - RNA, 23 nt, Homo sapiens
gaauguaaguaagugacaaugcu

SEQ ID NO: 1890340 - RNA, 17 nt, Homo sapiens
auggcagagcugguguc

SEQ ID NO: 1890341 - RNA, 23 nt, Homo sapiens
agaauucucgaacugcauguauu

SEQ ID NO: 1890342 - RNA, 22 nt, Homo sapiens
caugcaguugcagugaauucau

SEQ ID NO: 1890343 - RNA, 12 nt, Homo sapiens
cuucugcaaugu

SEQ ID NO: 1890344 - RNA, 18 nt, Homo sapiens
acccagcucuacuccagg

SEQ ID NO: 1890345 - RNA, 21 nt, Homo sapiens
aaauaguguaagaacuguaca

SEQ ID NO: 1890346 - RNA, 20 nt, Homo sapiens
agugcaugggacccacgaaa

SEQ ID NO: 1890347 - RNA, 15 nt, Homo sapiens
cuacaacagccucac

SEQ ID NO: 1890348 - RNA, 22 nt, Homo sapiens
auauucacuuucauuuuugaca

SEQ ID NO: 1890349 - RNA, 23 nt, Homo sapiens
gccaagcuaauuuauagcaagau

SEQ ID NO: 1890350 - RNA, 16 nt, Homo sapiens
uccugugccagaggaa

SEQ ID NO: 1890351 - RNA, 16 nt, Homo sapiens
gaaacauuaugccuua

SEQ ID NO: 1890352 - RNA, 18 nt, Homo sapiens
cugccugcagcugagauu

SEQ ID NO: 1890353 - RNA, 22 nt, Homo sapiens
ccaaagaaauagggcauggcuu

SEQ ID NO: 1890354 - RNA, 16 nt, Homo sapiens
ccuuucuucaauacaa

SEQ ID NO: 1890355 - RNA, 21 nt, Homo sapiens
ugaagaggagauuggccagug

SEQ ID NO: 1890356 - RNA, 21 nt, Homo sapiens
aauaaaacaucuuuccagucc

SEQ ID NO: 1890357 - RNA, 17 nt, Homo sapiens
gcgaaaaaaucagugaa

SEQ ID NO: 1890358 - RNA, 17 nt, Homo sapiens
ccuggauguacuaucca

SEQ ID NO: 1890359 - RNA, 19 nt, Homo sapiens
uccaccccucuccucagag

SEQ ID NO: 1890360 - RNA, 13 nt, Homo sapiens
cuggucuugugga

SEQ ID NO: 1890361 - RNA, 23 nt, Homo sapiens
agauugaucaaaguguaaacacc

SEQ ID NO: 1890362 - RNA, 14 nt, Homo sapiens
auucugggaaucca

SEQ ID NO: 1890363 - RNA, 11 nt, Homo sapiens
uccugcccaua

SEQ ID NO: 1890364 - RNA, 12 nt, Homo sapiens
ucuuuaccucag

SEQ ID NO: 1890365 - RNA, 16 nt, Homo sapiens
gccaguuuuaccagcg

SEQ ID NO: 1890366 - RNA, 22 nt, Homo sapiens
gccuguacuagagcaagcagga

SEQ ID NO: 1890367 - RNA, 21 nt, Homo sapiens
caggagccggacacuucucag

SEQ ID NO: 1890368 - RNA, 17 nt, Homo sapiens
gagcccccaccacaaac

SEQ ID NO: 1890369 - RNA, 18 nt, Homo sapiens
caugaauucuuaugcuua

SEQ ID NO: 1890370 - RNA, 14 nt, Homo sapiens
uagguccaccugcu

SEQ ID NO: 1890371 - RNA, 24 nt, Homo sapiens
ggcauagaugcaggugagcccaug

SEQ ID NO: 1890372 - RNA, 16 nt, Homo sapiens
agagagaaaagcucac

SEQ ID NO: 1890373 - RNA, 20 nt, Homo sapiens
acuucuaaauuauaccauga

SEQ ID NO: 1890374 - RNA, 19 nt, Homo sapiens
acuucucugugaacuauua

SEQ ID NO: 1890375 - RNA, 14 nt, Homo sapiens
cccauuuugcaaaa

SEQ ID NO: 1890376 - RNA, 16 nt, Homo sapiens
ugucugacaaccucuu

SEQ ID NO: 1890377 - RNA, 21 nt, Homo sapiens
aggagguucucacuguuguga

SEQ ID NO: 1890378 - RNA, 12 nt, Homo sapiens
gggucugugaug

SEQ ID NO: 1890379 - RNA, 22 nt, Homo sapiens
gaaaggcuuggcacacagcagg

SEQ ID NO: 1890380 - RNA, 16 nt, Homo sapiens
ggcuucccacagccuc

SEQ ID NO: 1890381 - RNA, 23 nt, Homo sapiens
uuccauuuuuauuucaaaauaua

SEQ ID NO: 1890382 - RNA, 22 nt, Homo sapiens
aucaccguacgacucuuuucca

SEQ ID NO: 1890383 - RNA, 14 nt, Homo sapiens
aacuaacaaugccu

SEQ ID NO: 1890384 - RNA, 12 nt, Homo sapiens
aaagcugaugag

SEQ ID NO: 1890385 - RNA, 15 nt, Homo sapiens
uaaaagcuacuaugu

SEQ ID NO: 1890386 - RNA, 19 nt, Homo sapiens
ccaaaguucccacuccuuc

SEQ ID NO: 1890387 - RNA, 20 nt, Homo sapiens
auuccuauauaguuuauuga

SEQ ID NO: 1890388 - RNA, 17 nt, Homo sapiens
cauuuggaccacagcau

SEQ ID NO: 1890389 - RNA, 14 nt, Homo sapiens
ccugcucaccugug

SEQ ID NO: 1890390 - RNA, 15 nt, Homo sapiens
uaugcucugugacaa

SEQ ID NO: 1890391 - RNA, 19 nt, Homo sapiens
gccuucgucugguuccuca

SEQ ID NO: 1890392 - RNA, 21 nt, Homo sapiens
cuacacacccauagugcacac

SEQ ID NO: 1890393 - RNA, 19 nt, Homo sapiens
uugcacagugugugacuua

SEQ ID NO: 1890394 - RNA, 20 nt, Homo sapiens
gacaguauugcuaacaucuc

SEQ ID NO: 1890395 - RNA, 21 nt, Homo sapiens
uaacauguaauuaaguacuau

SEQ ID NO: 1890396 - RNA, 22 nt, Homo sapiens
agcugccuuuuuuaacacuaga

SEQ ID NO: 1890397 - RNA, 21 nt, Homo sapiens
caauaaaagaauaguugccaa

SEQ ID NO: 1890398 - RNA, 19 nt, Homo sapiens
aaguuucuggugccauuuc

SEQ ID NO: 1890399 - RNA, 20 nt, Homo sapiens
agcugcugggccaguggcac

SEQ ID NO: 1890400 - RNA, 17 nt, Homo sapiens
ccacaaagagauuauuu

SEQ ID NO: 1890401 - RNA, 16 nt, Homo sapiens
cagaaugaaaauuaga

SEQ ID NO: 1890402 - RNA, 14 nt, Homo sapiens
cccggggagcugca

SEQ ID NO: 1890403 - RNA, 19 nt, Homo sapiens
caguguaaagaauaaauga

SEQ ID NO: 1890404 - RNA, 16 nt, Homo sapiens
aauggcuguaucauag

SEQ ID NO: 1890405 - RNA, 16 nt, Homo sapiens
aaacaggucgagcugu

SEQ ID NO: 1890406 - RNA, 21 nt, Homo sapiens
agcacugaggguggcacucaa

SEQ ID NO: 1890407 - RNA, 17 nt, Homo sapiens
acagugccaacuccuca

SEQ ID NO: 1890408 - RNA, 17 nt, Homo sapiens
agccagguaccuucuca

SEQ ID NO: 1890409 - RNA, 15 nt, Homo sapiens
auggccuaaauuuau

SEQ ID NO: 1890410 - RNA, 23 nt, Homo sapiens
acucucugccuguaaauguuccc

SEQ ID NO: 1890411 - RNA, 16 nt, Homo sapiens
agaagucaguugcaaa

SEQ ID NO: 1890412 - RNA, 22 nt, Homo sapiens
ugcagucacaucacaauauuca

SEQ ID NO: 1890413 - RNA, 14 nt, Homo sapiens
acaaguuugcuaaa

SEQ ID NO: 1890414 - RNA, 15 nt, Homo sapiens
acuuguuaaauguau

SEQ ID NO: 1890415 - RNA, 17 nt, Homo sapiens
gguuaugucccaugacc

SEQ ID NO: 1890416 - RNA, 16 nt, Homo sapiens
agccgaggccuacccc

SEQ ID NO: 1890417 - RNA, 10 nt, Homo sapiens
ccugcuggaa

SEQ ID NO: 1890418 - RNA, 21 nt, Homo sapiens
ucuucuuucuuccacccacaa

SEQ ID NO: 1890419 - RNA, 21 nt, Homo sapiens
ugacccacccuagaucuuccc

SEQ ID NO: 1890420 - RNA, 22 nt, Homo sapiens
caccacuuucccacacugugaa

SEQ ID NO: 1890421 - RNA, 21 nt, Homo sapiens
aaacaacuuauuuuuguucau

SEQ ID NO: 1890422 - RNA, 13 nt, Homo sapiens
ugguauuuggaua

SEQ ID NO: 1890423 - RNA, 23 nt, Homo sapiens
uggauggccgggcugcugcugau

SEQ ID NO: 1890424 - RNA, 18 nt, Homo sapiens
cuuuucacugacaaguua

SEQ ID NO: 1890425 - RNA, 16 nt, Homo sapiens
ccuggcacaccagaag

SEQ ID NO: 1890426 - RNA, 20 nt, Homo sapiens
aaaauauagcuguacaaaua

SEQ ID NO: 1890427 - RNA, 14 nt, Homo sapiens
cacagucaugugcc

SEQ ID NO: 1890428 - RNA, 14 nt, Homo sapiens
ugcagcucagggac

SEQ ID NO: 1890429 - RNA, 20 nt, Homo sapiens
gauaaaauacuaaacuacau

SEQ ID NO: 1890430 - RNA, 23 nt, Homo sapiens
aggcugauuccucucauuuccag

SEQ ID NO: 1890431 - RNA, 21 nt, Homo sapiens
acuacgggcugcucuacugcu

SEQ ID NO: 1890432 - RNA, 19 nt, Homo sapiens
acagcacuuuccuguugca

SEQ ID NO: 1890433 - RNA, 16 nt, Homo sapiens
auaauaguacuauuac

SEQ ID NO: 1890434 - RNA, 17 nt, Homo sapiens
uuaaaauuugacuccuc

SEQ ID NO: 1890435 - RNA, 17 nt, Homo sapiens
acacuccaguuugccca

SEQ ID NO: 1890436 - RNA, 22 nt, Homo sapiens
gcucaggaggcuuggaaagcau

SEQ ID NO: 1890437 - RNA, 13 nt, Homo sapiens
gcacccacccggc

SEQ ID NO: 1890438 - RNA, 14 nt, Homo sapiens
accacacuucuuga

SEQ ID NO: 1890439 - RNA, 13 nt, Homo sapiens
acaaagaugacug

SEQ ID NO: 1890440 - RNA, 14 nt, Homo sapiens
uaaaauguuauuau

SEQ ID NO: 1890441 - RNA, 16 nt, Homo sapiens
ccaggccaggggaccc

SEQ ID NO: 1890442 - RNA, 21 nt, Homo sapiens
cguaggggagggguugccaca

SEQ ID NO: 1890443 - RNA, 20 nt, Homo sapiens
augcuugacaaauauuuuca

SEQ ID NO: 1890444 - RNA, 17 nt, Homo sapiens
auacauguacagacaaa

SEQ ID NO: 1890445 - RNA, 13 nt, Homo sapiens
agcagugagcacu

SEQ ID NO: 1890446 - RNA, 19 nt, Homo sapiens
accauaaaucaauucauug

SEQ ID NO: 1890447 - RNA, 15 nt, Homo sapiens
gcugggguugccaga

SEQ ID NO: 1890448 - RNA, 17 nt, Homo sapiens
auccaaagcugaauaca

SEQ ID NO: 1890449 - RNA, 17 nt, Homo sapiens
agcccaggaggacugcc

SEQ ID NO: 1890450 - RNA, 12 nt, Homo sapiens
gcugccaugcuu

SEQ ID NO: 1890451 - RNA, 18 nt, Homo sapiens
caagcauucucuccauuu

SEQ ID NO: 1890452 - RNA, 21 nt, Homo sapiens
agcuucacuuaaaaucaaauu

SEQ ID NO: 1890453 - RNA, 20 nt, Homo sapiens
guguucuugcuaacuuugcc

SEQ ID NO: 1890454 - RNA, 18 nt, Homo sapiens
gguaggaaacuaggugca

SEQ ID NO: 1890455 - RNA, 18 nt, Homo sapiens
gcccaguuguccaugaca

SEQ ID NO: 1890456 - RNA, 13 nt, Homo sapiens
uacaccauaugca

SEQ ID NO: 1890457 - RNA, 15 nt, Homo sapiens
gccugcgauggugcu

SEQ ID NO: 1890458 - RNA, 13 nt, Homo sapiens
guuuaugaaugac

SEQ ID NO: 1890459 - RNA, 15 nt, Homo sapiens
caggauacucuguca

SEQ ID NO: 1890460 - RNA, 13 nt, Homo sapiens
uccuucgcuggaa

SEQ ID NO: 1890461 - RNA, 22 nt, Homo sapiens
cucucacggcuuguaaauguga

SEQ ID NO: 1890462 - RNA, 15 nt, Homo sapiens
gagaccuuggcugcu

SEQ ID NO: 1890463 - RNA, 15 nt, Homo sapiens
uaugucucacaggga

SEQ ID NO: 1890464 - RNA, 18 nt, Homo sapiens
uaauaagaagugccaagu

SEQ ID NO: 1890465 - RNA, 16 nt, Homo sapiens
ucuuuguauaugcauu

SEQ ID NO: 1890466 - RNA, 19 nt, Homo sapiens
uauaucagcagacacucca

SEQ ID NO: 1890467 - RNA, 22 nt, Homo sapiens
ugagugaguucccuuagugaau

SEQ ID NO: 1890468 - RNA, 18 nt, Homo sapiens
uaaaaaagcauuauccuu

SEQ ID NO: 1890469 - RNA, 13 nt, Homo sapiens
uucagcucuugcu

SEQ ID NO: 1890470 - RNA, 14 nt, Homo sapiens
aagcuaagccuuau

SEQ ID NO: 1890471 - RNA, 17 nt, Homo sapiens
agguugaagucucuucc

SEQ ID NO: 1890472 - RNA, 13 nt, Homo sapiens
gaacagguucuua

SEQ ID NO: 1890473 - RNA, 19 nt, Homo sapiens
cuguaaucccagcacuuug

SEQ ID NO: 1890474 - RNA, 16 nt, Homo sapiens
ugaggugaacuccagg

SEQ ID NO: 1890475 - RNA, 17 nt, Homo sapiens
uauaaucccagcacuuu

SEQ ID NO: 1890476 - RNA, 17 nt, Homo sapiens
cuguucgaguagcucag

SEQ ID NO: 1890477 - RNA, 15 nt, Homo sapiens
ggagugaggaccugu

SEQ ID NO: 1890478 - RNA, 19 nt, Homo sapiens
cagauggcagggcugagga

SEQ ID NO: 1890479 - RNA, 16 nt, Homo sapiens
agcugccucacuuccu

SEQ ID NO: 1890480 - RNA, 15 nt, Homo sapiens
ugcaauguaagcaua

SEQ ID NO: 1890481 - RNA, 14 nt, Homo sapiens
cauacaaguuucau

SEQ ID NO: 1890482 - RNA, 23 nt, Homo sapiens
agcucuccccucagagugcaagc

SEQ ID NO: 1890483 - RNA, 13 nt, Homo sapiens
ccuggaacugcau

SEQ ID NO: 1890484 - RNA, 14 nt, Homo sapiens
ucuucuuacuaggg

SEQ ID NO: 1890485 - RNA, 14 nt, Homo sapiens
agcuagaaccugga

SEQ ID NO: 1890486 - RNA, 15 nt, Homo sapiens
ggaaaauaccccauc

SEQ ID NO: 1890487 - RNA, 19 nt, Homo sapiens
uuuuuauggcugaauaaua

SEQ ID NO: 1890488 - RNA, 16 nt, Homo sapiens
cccagcccaaugccaa

SEQ ID NO: 1890489 - RNA, 18 nt, Homo sapiens
augguaggucaaguaaua

SEQ ID NO: 1890490 - RNA, 14 nt, Homo sapiens
uaaugccucuucau

SEQ ID NO: 1890491 - RNA, 20 nt, Homo sapiens
cauugccuugggccugggaa

SEQ ID NO: 1890492 - RNA, 21 nt, Homo sapiens
aaaggaagcuccacugucacc

SEQ ID NO: 1890493 - RNA, 20 nt, Homo sapiens
ccaggauugaagguguaaau

SEQ ID NO: 1890494 - RNA, 17 nt, Homo sapiens
agacacuaaaugcagac

SEQ ID NO: 1890495 - RNA, 17 nt, Homo sapiens
ucauaugacaugccacc

SEQ ID NO: 1890496 - RNA, 20 nt, Homo sapiens
guaaagggcgcaaagggcau

SEQ ID NO: 1890497 - RNA, 16 nt, Homo sapiens
aacaccuucaugcuua

SEQ ID NO: 1890498 - RNA, 13 nt, Homo sapiens
ucaaaaguauugu

SEQ ID NO: 1890499 - RNA, 21 nt, Homo sapiens
auuuucuuguaugauagugac

SEQ ID NO: 1890500 - RNA, 16 nt, Homo sapiens
aauuaaguuacaauua

SEQ ID NO: 1890501 - RNA, 23 nt, Homo sapiens
acauuggagacaucacuugccaa

SEQ ID NO: 1890502 - RNA, 11 nt, Homo sapiens
cagcacccaca

SEQ ID NO: 1890503 - RNA, 15 nt, Homo sapiens
ggcuggagguaggcu

SEQ ID NO: 1890504 - RNA, 14 nt, Homo sapiens
gacugagcccauga

SEQ ID NO: 1890505 - RNA, 23 nt, Homo sapiens
uuuacaugggccucugauggaag

SEQ ID NO: 1890506 - RNA, 19 nt, Homo sapiens
uagaagugugaagugcaga

SEQ ID NO: 1890507 - RNA, 14 nt, Homo sapiens
uccucauggcuguu

SEQ ID NO: 1890508 - RNA, 13 nt, Homo sapiens
ucaaugguaucau

SEQ ID NO: 1890509 - RNA, 20 nt, Homo sapiens
aaauaugauuuuauuugaca

SEQ ID NO: 1890510 - RNA, 14 nt, Homo sapiens
augucagacuggcu

SEQ ID NO: 1890511 - RNA, 14 nt, Homo sapiens
auucagcucugcaa

SEQ ID NO: 1890512 - RNA, 13 nt, Homo sapiens
aagauaaacacaa

SEQ ID NO: 1890513 - RNA, 15 nt, Homo sapiens
uuccugaagcugcug

SEQ ID NO: 1890514 - RNA, 21 nt, Homo sapiens
uccuuccccaccccaccacaa

SEQ ID NO: 1890515 - RNA, 13 nt, Homo sapiens
caagacagcucuu

SEQ ID NO: 1890516 - RNA, 20 nt, Homo sapiens
aguuuaggugauggccaguc

SEQ ID NO: 1890517 - RNA, 14 nt, Homo sapiens
aagaacaccugaca

SEQ ID NO: 1890518 - RNA, 12 nt, Homo sapiens
uggcaucugugu

SEQ ID NO: 1890519 - RNA, 19 nt, Homo sapiens
acuucaaguucucuugauu

SEQ ID NO: 1890520 - RNA, 19 nt, Homo sapiens
ggacccauagacagcccug

SEQ ID NO: 1890521 - RNA, 21 nt, Homo sapiens
guucuucuucccaguucuuga

SEQ ID NO: 1890522 - RNA, 17 nt, Homo sapiens
agaugccucuuaggacu

SEQ ID NO: 1890523 - RNA, 18 nt, Homo sapiens
aguuggauucagaaccaa

SEQ ID NO: 1890524 - RNA, 22 nt, Homo sapiens
auuuccuaaugucagaguagaa

SEQ ID NO: 1890525 - RNA, 14 nt, Homo sapiens
gggcaagcaaggag

SEQ ID NO: 1890526 - RNA, 13 nt, Homo sapiens
cugaaagagcugu

SEQ ID NO: 1890527 - RNA, 18 nt, Homo sapiens
agagcuugucagcaagag

SEQ ID NO: 1890528 - RNA, 13 nt, Homo sapiens
gauggcacugcuu

SEQ ID NO: 1890529 - RNA, 20 nt, Homo sapiens
aagaagcucgccccaccucc

SEQ ID NO: 1890530 - RNA, 14 nt, Homo sapiens
ugagguuucaccuc

SEQ ID NO: 1890531 - RNA, 19 nt, Homo sapiens
agcucuucaucugcuacaa

SEQ ID NO: 1890532 - RNA, 16 nt, Homo sapiens
ucaauacccacugcca

SEQ ID NO: 1890533 - RNA, 17 nt, Homo sapiens
uaaaaagauagacuuca

SEQ ID NO: 1890534 - RNA, 15 nt, Homo sapiens
agcugcuuuacuuaa

SEQ ID NO: 1890535 - RNA, 22 nt, Homo sapiens
auguagcaauggcacuguugca

SEQ ID NO: 1890536 - RNA, 23 nt, Homo sapiens
ucccucccagaggagccaccagu

SEQ ID NO: 1890537 - RNA, 18 nt, Homo sapiens
agaaguuaucaacaugca

SEQ ID NO: 1890538 - RNA, 16 nt, Homo sapiens
ugaagggagggucccu

SEQ ID NO: 1890539 - RNA, 13 nt, Homo sapiens
auugaagaugaac

SEQ ID NO: 1890540 - RNA, 15 nt, Homo sapiens
auauaaccucaaaca

SEQ ID NO: 1890541 - RNA, 17 nt, Homo sapiens
aauuuugauagucugaa

SEQ ID NO: 1890542 - RNA, 15 nt, Homo sapiens
ugcaaucuauaauau

SEQ ID NO: 1890543 - RNA, 11 nt, Homo sapiens
gugugguggcu

SEQ ID NO: 1890544 - RNA, 21 nt, Homo sapiens
aaaaauaaaacuuuucaugua

SEQ ID NO: 1890545 - RNA, 21 nt, Homo sapiens
cugaaaaaaacauauccaaaa

SEQ ID NO: 1890546 - RNA, 15 nt, Homo sapiens
gacauuuaucaggca

SEQ ID NO: 1890547 - RNA, 14 nt, Homo sapiens
cuccccacacgugc

SEQ ID NO: 1890548 - RNA, 14 nt, Homo sapiens
uggcuggugccuga

SEQ ID NO: 1890549 - RNA, 20 nt, Homo sapiens
auauauggcauuugcagauu

SEQ ID NO: 1890550 - RNA, 23 nt, Homo sapiens
ugggcccugguucccccaggacc

SEQ ID NO: 1890551 - RNA, 18 nt, Homo sapiens
guucaagagcacacuugg

SEQ ID NO: 1890552 - RNA, 17 nt, Homo sapiens
agaagcaagacacgugg

SEQ ID NO: 1890553 - RNA, 16 nt, Homo sapiens
aagucgucuuaacuca

SEQ ID NO: 1890554 - RNA, 13 nt, Homo sapiens
ccuauaaagcccc

SEQ ID NO: 1890555 - RNA, 13 nt, Homo sapiens
ugccccucuuccc

SEQ ID NO: 1890556 - RNA, 15 nt, Homo sapiens
auaaaagcuaugaca

SEQ ID NO: 1890557 - RNA, 18 nt, Homo sapiens
ugggcaacacagcgagac

SEQ ID NO: 1890558 - RNA, 22 nt, Homo sapiens
acacugucuguauagugucugu

SEQ ID NO: 1890559 - RNA, 19 nt, Homo sapiens
uguggugucuguguuccaa

SEQ ID NO: 1890560 - RNA, 22 nt, Homo sapiens
ucaaacccaaguuaguucaauc

SEQ ID NO: 1890561 - RNA, 13 nt, Homo sapiens
uucaguauuguaa

SEQ ID NO: 1890562 - RNA, 21 nt, Homo sapiens
agaagggcagcuccacagggc

SEQ ID NO: 1890563 - RNA, 16 nt, Homo sapiens
agcuaaacgcaauguc

SEQ ID NO: 1890564 - RNA, 21 nt, Homo sapiens
gcaacauuuggggagagauaa

SEQ ID NO: 1890565 - RNA, 16 nt, Homo sapiens
uguguagaccuugaug

SEQ ID NO: 1890566 - RNA, 16 nt, Homo sapiens
gcagaaacaguacuua

SEQ ID NO: 1890567 - RNA, 12 nt, Homo sapiens
aaugugaacuua

SEQ ID NO: 1890568 - RNA, 13 nt, Homo sapiens
guuaugccucaug

SEQ ID NO: 1890569 - RNA, 18 nt, Homo sapiens
uuuacuugccauuacuca

SEQ ID NO: 1890570 - RNA, 18 nt, Homo sapiens
ccuaaaauggugauaucc

SEQ ID NO: 1890571 - RNA, 15 nt, Homo sapiens
gccuccaugaugcaa

SEQ ID NO: 1890572 - RNA, 17 nt, Homo sapiens
gacuugaaaccagaaga

SEQ ID NO: 1890573 - RNA, 21 nt, Homo sapiens
ugauaaaacagaauauugaca

SEQ ID NO: 1890574 - RNA, 19 nt, Homo sapiens
uuaucaaucucuaguuguc

SEQ ID NO: 1890575 - RNA, 23 nt, Homo sapiens
accugucucucucuucucucuag

SEQ ID NO: 1890576 - RNA, 20 nt, Homo sapiens
uggaaggaaagcaaggcaga

SEQ ID NO: 1890577 - RNA, 23 nt, Homo sapiens
ugaagacccucaaugccaagaaa

SEQ ID NO: 1890578 - RNA, 20 nt, Homo sapiens
cuguaguguaccauucucag

SEQ ID NO: 1890579 - RNA, 16 nt, Homo sapiens
uccaaugagcuuucug

SEQ ID NO: 1890580 - RNA, 14 nt, Homo sapiens
gaaucagcaugaaa

SEQ ID NO: 1890581 - RNA, 18 nt, Homo sapiens
accagugaaucuuuguca

SEQ ID NO: 1890582 - RNA, 15 nt, Homo sapiens
aggagacuagauugc

SEQ ID NO: 1890583 - RNA, 14 nt, Homo sapiens
uuugauagcaaugu

SEQ ID NO: 1890584 - RNA, 22 nt, Homo sapiens
cuagaaggcguccauguuuauu

SEQ ID NO: 1890585 - RNA, 15 nt, Homo sapiens
auaaaaugcaaucaa

SEQ ID NO: 1890586 - RNA, 19 nt, Homo sapiens
acuucuuuacuaacacugg

SEQ ID NO: 1890587 - RNA, 19 nt, Homo sapiens
acuuuggguuuuuaacuca

SEQ ID NO: 1890588 - RNA, 15 nt, Homo sapiens
acugaaccauuccaa

SEQ ID NO: 1890589 - RNA, 19 nt, Homo sapiens
cccuguacauaucuuugag

SEQ ID NO: 1890590 - RNA, 14 nt, Homo sapiens
aaacaacagccaaa

SEQ ID NO: 1890591 - RNA, 15 nt, Homo sapiens
gucaagaaguuaaau

SEQ ID NO: 1890592 - RNA, 21 nt, Homo sapiens
uguggucaauccgaaguauga

SEQ ID NO: 1890593 - RNA, 13 nt, Homo sapiens
caucccaggaucg

SEQ ID NO: 1890594 - RNA, 23 nt, Homo sapiens
acaccguguaaaccaaagcccua

SEQ ID NO: 1890595 - RNA, 12 nt, Homo sapiens
ucuccugugaau

SEQ ID NO: 1890596 - RNA, 19 nt, Homo sapiens
ucauacuuuuucuuugaau

SEQ ID NO: 1890597 - RNA, 13 nt, Homo sapiens
uccacaguggaac

SEQ ID NO: 1890598 - RNA, 13 nt, Homo sapiens
ucaauaguggcau

SEQ ID NO: 1890599 - RNA, 21 nt, Homo sapiens
agcagugugucaggugcugca

SEQ ID NO: 1890600 - RNA, 21 nt, Homo sapiens
cauagcaauuccccuacauca

SEQ ID NO: 1890601 - RNA, 16 nt, Homo sapiens
aacaucuggauuucau

SEQ ID NO: 1890602 - RNA, 17 nt, Homo sapiens
cuggcagggauggguuu

SEQ ID NO: 1890603 - RNA, 18 nt, Homo sapiens
cucuaacgccugagccca

SEQ ID NO: 1890604 - RNA, 15 nt, Homo sapiens
gauucuaaagcucaa

SEQ ID NO: 1890605 - RNA, 13 nt, Homo sapiens
cucugcacaagcu

SEQ ID NO: 1890606 - RNA, 13 nt, Homo sapiens
agaauaucuggga

SEQ ID NO: 1890607 - RNA, 18 nt, Homo sapiens
guucuaauccaagggcca

SEQ ID NO: 1890608 - RNA, 13 nt, Homo sapiens
guccugccggugg

SEQ ID NO: 1890609 - RNA, 20 nt, Homo sapiens
ugcgcacacacagauaugca

SEQ ID NO: 1890610 - RNA, 11 nt, Homo sapiens
cugacacaaga

SEQ ID NO: 1890611 - RNA, 19 nt, Homo sapiens
guccuagcaaccuccacau

SEQ ID NO: 1890612 - RNA, 16 nt, Homo sapiens
cgacgaaucuucucaa

SEQ ID NO: 1890613 - RNA, 22 nt, Homo sapiens
ugcaguaagccaaggucaugcc

SEQ ID NO: 1890614 - RNA, 14 nt, Homo sapiens
ggccugcccagaca

SEQ ID NO: 1890615 - RNA, 19 nt, Homo sapiens
aagaggaugaagugauaug

SEQ ID NO: 1890616 - RNA, 19 nt, Homo sapiens
gcucgcauuugucaaugac

SEQ ID NO: 1890617 - RNA, 12 nt, Homo sapiens
auaucuugccuu

SEQ ID NO: 1890618 - RNA, 17 nt, Homo sapiens
guaaaacaaaugaaauu

SEQ ID NO: 1890619 - RNA, 22 nt, Homo sapiens
aagacacagaauaguuuacaca

SEQ ID NO: 1890620 - RNA, 22 nt, Homo sapiens
uuccauuuggucuucuaguaua

SEQ ID NO: 1890621 - RNA, 18 nt, Homo sapiens
ucugcuuuuuuucaggga

SEQ ID NO: 1890622 - RNA, 14 nt, Homo sapiens
gcugcgugccauga

SEQ ID NO: 1890623 - RNA, 15 nt, Homo sapiens
cuccguguagugucu

SEQ ID NO: 1890624 - RNA, 14 nt, Homo sapiens
ccuccccauggugc

SEQ ID NO: 1890625 - RNA, 13 nt, Homo sapiens
ugcaagagaacaa

SEQ ID NO: 1890626 - RNA, 21 nt, Homo sapiens
cuuuauuugaauaacaaggaa

SEQ ID NO: 1890627 - RNA, 16 nt, Homo sapiens
ugccucccaaagugcu

SEQ ID NO: 1890628 - RNA, 17 nt, Homo sapiens
gcgugggggcacugacc

SEQ ID NO: 1890629 - RNA, 16 nt, Homo sapiens
cucaguuucugagucu

SEQ ID NO: 1890630 - RNA, 16 nt, Homo sapiens
gaugucuuugcugcag

SEQ ID NO: 1890631 - RNA, 14 nt, Homo sapiens
uggaaaacuguguu

SEQ ID NO: 1890632 - RNA, 14 nt, Homo sapiens
caggauaccauaua

SEQ ID NO: 1890633 - RNA, 18 nt, Homo sapiens
aaacaaggggcuguuaca

SEQ ID NO: 1890634 - RNA, 16 nt, Homo sapiens
gcaggaccucaccaaa

SEQ ID NO: 1890635 - RNA, 21 nt, Homo sapiens
ucuauuuugggaaaaugaagg

SEQ ID NO: 1890636 - RNA, 20 nt, Homo sapiens
aggccccccagaaagcugcc

SEQ ID NO: 1890637 - RNA, 22 nt, Homo sapiens
cucuuauagagccugugugaaa

SEQ ID NO: 1890638 - RNA, 14 nt, Homo sapiens
uaaagacagaguga

SEQ ID NO: 1890639 - RNA, 15 nt, Homo sapiens
cuggauucuuggccc

SEQ ID NO: 1890640 - RNA, 18 nt, Homo sapiens
ccaaaggaaaaagcacaa

SEQ ID NO: 1890641 - RNA, 18 nt, Homo sapiens
ccuuucucccagugaaau

SEQ ID NO: 1890642 - RNA, 16 nt, Homo sapiens
ugcagcuaacuuauca

SEQ ID NO: 1890643 - RNA, 15 nt, Homo sapiens
agaucauuucccaaa

SEQ ID NO: 1890644 - RNA, 18 nt, Homo sapiens
uccuuaugguacacucca

SEQ ID NO: 1890645 - RNA, 14 nt, Homo sapiens
ggacgcugccggga

SEQ ID NO: 1890646 - RNA, 19 nt, Homo sapiens
auuaaacgguaacauccaa

SEQ ID NO: 1890647 - RNA, 20 nt, Homo sapiens
cucucucccuuuucagggac

SEQ ID NO: 1890648 - RNA, 15 nt, Homo sapiens
cacauacaauuugca

SEQ ID NO: 1890649 - RNA, 23 nt, Homo sapiens
agucugcccacgcagaggacgca

SEQ ID NO: 1890650 - RNA, 17 nt, Homo sapiens
uccauuggcucccaagu

SEQ ID NO: 1890651 - RNA, 19 nt, Homo sapiens
uuggaagaaaagaaucaca

SEQ ID NO: 1890652 - RNA, 19 nt, Homo sapiens
auaaauguuauagcugcau

SEQ ID NO: 1890653 - RNA, 13 nt, Homo sapiens
cauggacacuuug

SEQ ID NO: 1890654 - RNA, 20 nt, Homo sapiens
uuuuacaaauuuaauuuugc

SEQ ID NO: 1890655 - RNA, 15 nt, Homo sapiens
uauuuguuugugcau

SEQ ID NO: 1890656 - RNA, 17 nt, Homo sapiens
aaacaguggcucauaaa

SEQ ID NO: 1890657 - RNA, 15 nt, Homo sapiens
ucuaacuauuaucaa

SEQ ID NO: 1890658 - RNA, 14 nt, Homo sapiens
uaaagaaugccauu

SEQ ID NO: 1890659 - RNA, 22 nt, Homo sapiens
aauucacucaagcacugauauc

SEQ ID NO: 1890660 - RNA, 21 nt, Homo sapiens
ccucugaaagaugcaucaucu

SEQ ID NO: 1890661 - RNA, 19 nt, Homo sapiens
uuccaaugccacagacaac

SEQ ID NO: 1890662 - RNA, 18 nt, Homo sapiens
ggacaggauaagagggau

SEQ ID NO: 1890663 - RNA, 20 nt, Homo sapiens
agucugaccccugccaccuu

SEQ ID NO: 1890664 - RNA, 20 nt, Homo sapiens
uagaggauuaguaagaucuc

SEQ ID NO: 1890665 - RNA, 15 nt, Homo sapiens
auuaaugcacuuucu

SEQ ID NO: 1890666 - RNA, 13 nt, Homo sapiens
ugggcauucacac

SEQ ID NO: 1890667 - RNA, 22 nt, Homo sapiens
ucacauaaaaaagaagcacuuu

SEQ ID NO: 1890668 - RNA, 21 nt, Homo sapiens
gcagccccacaccagggccag

SEQ ID NO: 1890669 - RNA, 11 nt, Homo sapiens
caucacacaag

SEQ ID NO: 1890670 - RNA, 19 nt, Homo sapiens
auugauuaaguauaucuau

SEQ ID NO: 1890671 - RNA, 21 nt, Homo sapiens
gagcucccgaggaagcacagc

SEQ ID NO: 1890672 - RNA, 17 nt, Homo sapiens
gucuuuucaucugggaa

SEQ ID NO: 1890673 - RNA, 15 nt, Homo sapiens
acucugcacuacucc

SEQ ID NO: 1890674 - RNA, 22 nt, Homo sapiens
accuggagaacuagaaccugga

SEQ ID NO: 1890675 - RNA, 14 nt, Homo sapiens
caggccugccuucu

SEQ ID NO: 1890676 - RNA, 16 nt, Homo sapiens
aggcuuuuguuuauuu

SEQ ID NO: 1890677 - RNA, 19 nt, Homo sapiens
uaguacuuuaugcaucucu

SEQ ID NO: 1890678 - RNA, 14 nt, Homo sapiens
cacugcaugcagaa

SEQ ID NO: 1890679 - RNA, 19 nt, Homo sapiens
ccuaggaguacaagugccu

SEQ ID NO: 1890680 - RNA, 22 nt, Homo sapiens
aagggacaccccuacacacacc

SEQ ID NO: 1890681 - RNA, 22 nt, Homo sapiens
cuuagaauuuguuucaucuauu

SEQ ID NO: 1890682 - RNA, 15 nt, Homo sapiens
aauuccccuacauca

SEQ ID NO: 1890683 - RNA, 15 nt, Homo sapiens
cccccaggagaacau

SEQ ID NO: 1890684 - RNA, 22 nt, Homo sapiens
acuuauuguagcauccuggaau

SEQ ID NO: 1890685 - RNA, 21 nt, Homo sapiens
uagucucuggaaaaagacuga

SEQ ID NO: 1890686 - RNA, 17 nt, Homo sapiens
aauucuaggcagcaccu

SEQ ID NO: 1890687 - RNA, 16 nt, Homo sapiens
acaacccuugcugaaa

SEQ ID NO: 1890688 - RNA, 19 nt, Homo sapiens
ugauacgacagcucucugu

SEQ ID NO: 1890689 - RNA, 13 nt, Homo sapiens
auacaugaacuuc

SEQ ID NO: 1890690 - RNA, 17 nt, Homo sapiens
ccagaccccguggcucu

SEQ ID NO: 1890691 - RNA, 22 nt, Homo sapiens
agguuauuuaaacuuugggaaa

SEQ ID NO: 1890692 - RNA, 17 nt, Homo sapiens
cucccaauggauaaauc

SEQ ID NO: 1890693 - RNA, 13 nt, Homo sapiens
guccuuguguuga

SEQ ID NO: 1890694 - RNA, 13 nt, Homo sapiens
cuuguugucucca

SEQ ID NO: 1890695 - RNA, 15 nt, Homo sapiens
gugaaguauugcuga

SEQ ID NO: 1890696 - RNA, 14 nt, Homo sapiens
auauuuuaaauauc

SEQ ID NO: 1890697 - RNA, 22 nt, Homo sapiens
uuagagccaggcacacacugug

SEQ ID NO: 1890698 - RNA, 14 nt, Homo sapiens
aauucaaacugggg

SEQ ID NO: 1890699 - RNA, 14 nt, Homo sapiens
auauuuuugccaua

SEQ ID NO: 1890700 - RNA, 14 nt, Homo sapiens
agcgguugccagga

SEQ ID NO: 1890701 - RNA, 12 nt, Homo sapiens
acuaaguauuaa

SEQ ID NO: 1890702 - RNA, 20 nt, Homo sapiens
auauauguaucuacaauaca

SEQ ID NO: 1890703 - RNA, 23 nt, Homo sapiens
guacaaaaaucccaaauucacuu

SEQ ID NO: 1890704 - RNA, 19 nt, Homo sapiens
aaccgaggcccucaaucca

SEQ ID NO: 1890705 - RNA, 19 nt, Homo sapiens
cccaaagugcuaguauuau

SEQ ID NO: 1890706 - RNA, 19 nt, Homo sapiens
gcccaacagggcaaccaau

SEQ ID NO: 1890707 - RNA, 19 nt, Homo sapiens
guccagaauaagugcuguu

SEQ ID NO: 1890708 - RNA, 18 nt, Homo sapiens
agaaguccuuauguuaag

SEQ ID NO: 1890709 - RNA, 19 nt, Homo sapiens
gaaaauaagccaugagaau

SEQ ID NO: 1890710 - RNA, 22 nt, Homo sapiens
aagcgggaucccagcaucucag

SEQ ID NO: 1890711 - RNA, 19 nt, Homo sapiens
cagccugcuucccaccucc

SEQ ID NO: 1890712 - RNA, 18 nt, Homo sapiens
auauaccucacuagccau

SEQ ID NO: 1890713 - RNA, 13 nt, Homo sapiens
acuucuaguguau

SEQ ID NO: 1890714 - RNA, 14 nt, Homo sapiens
uucuccaaagaaga

SEQ ID NO: 1890715 - RNA, 17 nt, Homo sapiens
aaauguauuuaauucca

SEQ ID NO: 1890716 - RNA, 20 nt, Homo sapiens
acaugacccguacacaccac

SEQ ID NO: 1890717 - RNA, 12 nt, Homo sapiens
agacaccugccu

SEQ ID NO: 1890718 - RNA, 12 nt, Homo sapiens
ccgcuacuucca

SEQ ID NO: 1890719 - RNA, 19 nt, Homo sapiens
acccaccugcuagugugaa

SEQ ID NO: 1890720 - RNA, 16 nt, Homo sapiens
ccucagggcaaagcca

SEQ ID NO: 1890721 - RNA, 17 nt, Homo sapiens
guuucuugcauuuauua

SEQ ID NO: 1890722 - RNA, 14 nt, Homo sapiens
auauucuuaaugac

SEQ ID NO: 1890723 - RNA, 15 nt, Homo sapiens
uucaucuucaguaau

SEQ ID NO: 1890724 - RNA, 12 nt, Homo sapiens
acccugugucac

SEQ ID NO: 1890725 - RNA, 15 nt, Homo sapiens
aaguugaccuucucu

SEQ ID NO: 1890726 - RNA, 13 nt, Homo sapiens
aggcuguggugag

SEQ ID NO: 1890727 - RNA, 23 nt, Homo sapiens
uaccuauccuuacauuucaccua

SEQ ID NO: 1890728 - RNA, 21 nt, Homo sapiens
guucugcuacuccccagaccu

SEQ ID NO: 1890729 - RNA, 20 nt, Homo sapiens
uaugaaugugaagccuuccc

SEQ ID NO: 1890730 - RNA, 15 nt, Homo sapiens
ucaguuaugaaaugu

SEQ ID NO: 1890731 - RNA, 23 nt, Homo sapiens
uggucugaagaaggaaggccuga

SEQ ID NO: 1890732 - RNA, 23 nt, Homo sapiens
cuucacccugaggugagcaucau

SEQ ID NO: 1890733 - RNA, 22 nt, Homo sapiens
cuggcaccgcgugccaugcaua

SEQ ID NO: 1890734 - RNA, 22 nt, Homo sapiens
gaaagcaucugagcuaacuuau

SEQ ID NO: 1890735 - RNA, 18 nt, Homo sapiens
gaaaaauguagacucuga

SEQ ID NO: 1890736 - RNA, 20 nt, Homo sapiens
aaguacucaaauauuucuga

SEQ ID NO: 1890737 - RNA, 18 nt, Homo sapiens
acaaugacuuuauugcau

SEQ ID NO: 1890738 - RNA, 16 nt, Homo sapiens
accagcaaugagaagg

SEQ ID NO: 1890739 - RNA, 15 nt, Homo sapiens
agcugccaccugccu

SEQ ID NO: 1890740 - RNA, 16 nt, Homo sapiens
aguuaacacagaucaa

SEQ ID NO: 1890741 - RNA, 14 nt, Homo sapiens
cagcuaaugggaca

SEQ ID NO: 1890742 - RNA, 18 nt, Homo sapiens
aucuuccaaaugcaauuu

SEQ ID NO: 1890743 - RNA, 14 nt, Homo sapiens
agggcuugucacag

SEQ ID NO: 1890744 - RNA, 13 nt, Homo sapiens
ugcaccuacccau

SEQ ID NO: 1890745 - RNA, 11 nt, Homo sapiens
gcuaaaugcac

SEQ ID NO: 1890746 - RNA, 12 nt, Homo sapiens
cauuacucugca

SEQ ID NO: 1890747 - RNA, 14 nt, Homo sapiens
ugagaacuugacaa

SEQ ID NO: 1890748 - RNA, 19 nt, Homo sapiens
ucagcaccccuagcaugaa

SEQ ID NO: 1890749 - RNA, 17 nt, Homo sapiens
uccacuuugaguaccaa

SEQ ID NO: 1890750 - RNA, 20 nt, Homo sapiens
aucaguccacccccauugug

SEQ ID NO: 1890751 - RNA, 17 nt, Homo sapiens
gauuuucuucugagacu

SEQ ID NO: 1890752 - RNA, 16 nt, Homo sapiens
ucugacacaugcucuc

SEQ ID NO: 1890753 - RNA, 23 nt, Homo sapiens
cacacauugcugugaacaggaaa

SEQ ID NO: 1890754 - RNA, 14 nt, Homo sapiens
uggugcucauuuaa

SEQ ID NO: 1890755 - RNA, 18 nt, Homo sapiens
cuuguggguccaugcuaa

SEQ ID NO: 1890756 - RNA, 13 nt, Homo sapiens
aauaacacuaaaa

SEQ ID NO: 1890757 - RNA, 21 nt, Homo sapiens
uauuuccacuuauaaaggaaa

SEQ ID NO: 1890758 - RNA, 13 nt, Homo sapiens
cccagauaccaug

SEQ ID NO: 1890759 - RNA, 22 nt, Homo sapiens
ucuugggaggacacuuuugcca

SEQ ID NO: 1890760 - RNA, 20 nt, Homo sapiens
aguuggaaccguguccagca

SEQ ID NO: 1890761 - RNA, 18 nt, Homo sapiens
auuccacagggauaccuu

SEQ ID NO: 1890762 - RNA, 15 nt, Homo sapiens
cagauugcugaaugg

SEQ ID NO: 1890763 - RNA, 19 nt, Homo sapiens
guuuucaagucaaauuaau

SEQ ID NO: 1890764 - RNA, 16 nt, Homo sapiens
ucagagauaacaucca

SEQ ID NO: 1890765 - RNA, 14 nt, Homo sapiens
cagagacucuggaa

SEQ ID NO: 1890766 - RNA, 21 nt, Homo sapiens
gccaggcuggucucaaacucc

SEQ ID NO: 1890767 - RNA, 18 nt, Homo sapiens
gugugcauaauuuugcca

SEQ ID NO: 1890768 - RNA, 19 nt, Homo sapiens
accuucccuuccucagcag

SEQ ID NO: 1890769 - RNA, 23 nt, Homo sapiens
ccaauucugucccaaucuuacca

SEQ ID NO: 1890770 - RNA, 22 nt, Homo sapiens
ggacugaucgauuugcacccac

SEQ ID NO: 1890771 - RNA, 23 nt, Homo sapiens
uuguaagucuuuauuauuuacuu

SEQ ID NO: 1890772 - RNA, 14 nt, Homo sapiens
cauagaauacacau

SEQ ID NO: 1890773 - RNA, 16 nt, Homo sapiens
gaaccuuccaucucgc

SEQ ID NO: 1890774 - RNA, 12 nt, Homo sapiens
auguauuaugca

SEQ ID NO: 1890775 - RNA, 16 nt, Homo sapiens
uuaaaaaacacuucau

SEQ ID NO: 1890776 - RNA, 18 nt, Homo sapiens
ucuccagugugaauauau

SEQ ID NO: 1890777 - RNA, 11 nt, Homo sapiens
aauacuugagc

SEQ ID NO: 1890778 - RNA, 17 nt, Homo sapiens
acuuugcuugcuuugaa

SEQ ID NO: 1890779 - RNA, 13 nt, Homo sapiens
uuccuccugacac

SEQ ID NO: 1890780 - RNA, 23 nt, Homo sapiens
ggugaagaacaucccaagccaga

SEQ ID NO: 1890781 - RNA, 17 nt, Homo sapiens
cagaauauggacaaaga

SEQ ID NO: 1890782 - RNA, 12 nt, Homo sapiens
ccaucucagguu

SEQ ID NO: 1890783 - RNA, 16 nt, Homo sapiens
acuggcaggcagcaga

SEQ ID NO: 1890784 - RNA, 14 nt, Homo sapiens
aucuguguacaauu

SEQ ID NO: 1890785 - RNA, 21 nt, Homo sapiens
aacaccacuuugucucugaga

SEQ ID NO: 1890786 - RNA, 16 nt, Homo sapiens
ugaacccaggcagcug

SEQ ID NO: 1890787 - RNA, 19 nt, Homo sapiens
ugugucacgugacccugug

SEQ ID NO: 1890788 - RNA, 23 nt, Homo sapiens
auuuuuaaggucuaaucagugau

SEQ ID NO: 1890789 - RNA, 14 nt, Homo sapiens
acuaacuuacuguc

SEQ ID NO: 1890790 - RNA, 14 nt, Homo sapiens
ucucgugcauuuca

SEQ ID NO: 1890791 - RNA, 18 nt, Homo sapiens
uggaaugucaguguucag

SEQ ID NO: 1890792 - RNA, 19 nt, Homo sapiens
cuuucuucucucuuugucc

SEQ ID NO: 1890793 - RNA, 20 nt, Homo sapiens
agcuaaaagcaucccuguga

SEQ ID NO: 1890794 - RNA, 23 nt, Homo sapiens
caggccagggaaagcccguguca

SEQ ID NO: 1890795 - RNA, 15 nt, Homo sapiens
ugaacagaacaaaag

SEQ ID NO: 1890796 - RNA, 15 nt, Homo sapiens
ucacaagaagaccag

SEQ ID NO: 1890797 - RNA, 23 nt, Homo sapiens
gcucaucagguccagccugggcu

SEQ ID NO: 1890798 - RNA, 16 nt, Homo sapiens
gguaauauucauuuua

SEQ ID NO: 1890799 - RNA, 17 nt, Homo sapiens
uuuuauuagcauucuga

SEQ ID NO: 1890800 - RNA, 12 nt, Homo sapiens
ugggaaagacau

SEQ ID NO: 1890801 - RNA, 14 nt, Homo sapiens
ugccacugcacucc

SEQ ID NO: 1890802 - RNA, 21 nt, Homo sapiens
uuugaaauaaauuuuaauucg

SEQ ID NO: 1890803 - RNA, 16 nt, Homo sapiens
agucagcuuucagagc

SEQ ID NO: 1890804 - RNA, 23 nt, Homo sapiens
aggcggggaggaggaacgggcag

SEQ ID NO: 1890805 - RNA, 23 nt, Homo sapiens
uauagcacuuugaaauaccucau

SEQ ID NO: 1890806 - RNA, 14 nt, Homo sapiens
cuucgcugaccucg

SEQ ID NO: 1890807 - RNA, 10 nt, Homo sapiens
ugccauguca

SEQ ID NO: 1890808 - RNA, 15 nt, Homo sapiens
cagucaauuaacaau

SEQ ID NO: 1890809 - RNA, 23 nt, Homo sapiens
aggucuacucccuccucacccca

SEQ ID NO: 1890810 - RNA, 21 nt, Homo sapiens
cuggccacccaaacaggacaa

SEQ ID NO: 1890811 - RNA, 17 nt, Homo sapiens
ugucaauauuugagcag

SEQ ID NO: 1890812 - RNA, 21 nt, Homo sapiens
ucugucaccagcuaucuguca

SEQ ID NO: 1890813 - RNA, 19 nt, Homo sapiens
gcuguaggaauauaaccuc

SEQ ID NO: 1890814 - RNA, 16 nt, Homo sapiens
aaaguucucaaugcaa

SEQ ID NO: 1890815 - RNA, 15 nt, Homo sapiens
acagaauacaagcca

SEQ ID NO: 1890816 - RNA, 19 nt, Homo sapiens
uaaaauaaaguugagcuua

SEQ ID NO: 1890817 - RNA, 13 nt, Homo sapiens
cccaucuuuccuc

SEQ ID NO: 1890818 - RNA, 21 nt, Homo sapiens
gguauuaaauugauguugcug

SEQ ID NO: 1890819 - RNA, 20 nt, Homo sapiens
auuugcuuuggaaguuuuaa

SEQ ID NO: 1890820 - RNA, 15 nt, Homo sapiens
aauaucacaguauua

SEQ ID NO: 1890821 - RNA, 16 nt, Homo sapiens
aacuuagacuccucuu

SEQ ID NO: 1890822 - RNA, 19 nt, Homo sapiens
ucagucaauagccauauca

SEQ ID NO: 1890823 - RNA, 17 nt, Homo sapiens
auagcaccauuccucaa

SEQ ID NO: 1890824 - RNA, 17 nt, Homo sapiens
uggcauauauguucaaa

SEQ ID NO: 1890825 - RNA, 21 nt, Homo sapiens
aggaaacacugauuaacugca

SEQ ID NO: 1890826 - RNA, 14 nt, Homo sapiens
acuauuugcagagg

SEQ ID NO: 1890827 - RNA, 23 nt, Homo sapiens
agaaacaauguuugcuuuucacu

SEQ ID NO: 1890828 - RNA, 20 nt, Homo sapiens
aauccaagcugcucauuuca

SEQ ID NO: 1890829 - RNA, 21 nt, Homo sapiens
uggugacgcacggcauuagcu

SEQ ID NO: 1890830 - RNA, 12 nt, Homo sapiens
cugcuaccaagg

SEQ ID NO: 1890831 - RNA, 19 nt, Homo sapiens
cauuaauuuaaaugauuua

SEQ ID NO: 1890832 - RNA, 13 nt, Homo sapiens
auucuacacacag

SEQ ID NO: 1890833 - RNA, 13 nt, Homo sapiens
cacagacaauucu

SEQ ID NO: 1890834 - RNA, 12 nt, Homo sapiens
guccuccuccag

SEQ ID NO: 1890835 - RNA, 24 nt, Homo sapiens
aaaguauuuaagguacauggaaca

SEQ ID NO: 1890836 - RNA, 15 nt, Homo sapiens
ugggaagacuauggu

SEQ ID NO: 1890837 - RNA, 19 nt, Homo sapiens
uggaauugcugcucucuga

SEQ ID NO: 1890838 - RNA, 19 nt, Homo sapiens
cuccaguuuuuuguuauau

SEQ ID NO: 1890839 - RNA, 15 nt, Homo sapiens
cuucugugcugugag

SEQ ID NO: 1890840 - RNA, 12 nt, Homo sapiens
gagcccagugaa

SEQ ID NO: 1890841 - RNA, 22 nt, Homo sapiens
uccugcgggcgggcgucugcug

SEQ ID NO: 1890842 - RNA, 23 nt, Homo sapiens
cuuuccuaaagucucugcugcua

SEQ ID NO: 1890843 - RNA, 14 nt, Homo sapiens
aacaagcauuucaa

SEQ ID NO: 1890844 - RNA, 21 nt, Homo sapiens
augaaacuuucaaauccuuca

SEQ ID NO: 1890845 - RNA, 21 nt, Homo sapiens
ccgacuuauucugauuucaga

SEQ ID NO: 1890846 - RNA, 14 nt, Homo sapiens
ccauggaguggcag

SEQ ID NO: 1890847 - RNA, 17 nt, Homo sapiens
uuaaugcauauuccccu

SEQ ID NO: 1890848 - RNA, 21 nt, Homo sapiens
caaggcucacaugcuccuugc

SEQ ID NO: 1890849 - RNA, 12 nt, Homo sapiens
cugcaucuccac

SEQ ID NO: 1890850 - RNA, 19 nt, Homo sapiens
aagacuuuugucugaucaa

SEQ ID NO: 1890851 - RNA, 13 nt, Homo sapiens
uugagacuccuca

SEQ ID NO: 1890852 - RNA, 20 nt, Homo sapiens
aguccaggaccccugcagcu

SEQ ID NO: 1890853 - RNA, 21 nt, Homo sapiens
auccuuuaccacucuaccaaa

SEQ ID NO: 1890854 - RNA, 13 nt, Homo sapiens
uaauaacagcucc

SEQ ID NO: 1890855 - RNA, 14 nt, Homo sapiens
cuauagccauuugc

SEQ ID NO: 1890856 - RNA, 18 nt, Homo sapiens
uugccaggggcauccaag

SEQ ID NO: 1890857 - RNA, 19 nt, Homo sapiens
ccucacaggagcaucuccu

SEQ ID NO: 1890858 - RNA, 23 nt, Homo sapiens
auguuuuuguguagaguggcgau

SEQ ID NO: 1890859 - RNA, 20 nt, Homo sapiens
auuugcaaagaaaaguuuca

SEQ ID NO: 1890860 - RNA, 18 nt, Homo sapiens
ucuguuuucccauugcag

SEQ ID NO: 1890861 - RNA, 15 nt, Homo sapiens
agggaaaaaugggaa

SEQ ID NO: 1890862 - RNA, 15 nt, Homo sapiens
ugguauaauugugua

SEQ ID NO: 1890863 - RNA, 18 nt, Homo sapiens
agaugucccauugauaau

SEQ ID NO: 1890864 - RNA, 19 nt, Homo sapiens
aaggaauuggcauguguau

SEQ ID NO: 1890865 - RNA, 18 nt, Homo sapiens
gaacucaugucuuucuca

SEQ ID NO: 1890866 - RNA, 12 nt, Homo sapiens
ugggacugagau

SEQ ID NO: 1890867 - RNA, 19 nt, Homo sapiens
ucauuuguuuacauuugau

SEQ ID NO: 1890868 - RNA, 22 nt, Homo sapiens
uggcaaaagacauccucaaaag

SEQ ID NO: 1890869 - RNA, 15 nt, Homo sapiens
accuaaacuuacauu

SEQ ID NO: 1890870 - RNA, 17 nt, Homo sapiens
uaaguaacuucacauua

SEQ ID NO: 1890871 - RNA, 22 nt, Homo sapiens
ugccucagccucccgaguaguu

SEQ ID NO: 1890872 - RNA, 17 nt, Homo sapiens
aaacccgcccucagggg

SEQ ID NO: 1890873 - RNA, 22 nt, Homo sapiens
aggaguucacuucaucuucuca

SEQ ID NO: 1890874 - RNA, 12 nt, Homo sapiens
auggguccaggg

SEQ ID NO: 1890875 - RNA, 12 nt, Homo sapiens
uuuaguccugua

SEQ ID NO: 1890876 - RNA, 17 nt, Homo sapiens
aauauuccaauacccua

SEQ ID NO: 1890877 - RNA, 17 nt, Homo sapiens
uauauuaaucagcauua

SEQ ID NO: 1890878 - RNA, 22 nt, Homo sapiens
ccuuugcuagggggcaaauaca

SEQ ID NO: 1890879 - RNA, 20 nt, Homo sapiens
cccaaaggaugagaauguga

SEQ ID NO: 1890880 - RNA, 18 nt, Homo sapiens
aauguuaagccauuuaac

SEQ ID NO: 1890881 - RNA, 15 nt, Homo sapiens
ucagauuuguguuau

SEQ ID NO: 1890882 - RNA, 14 nt, Homo sapiens
ugggcaauucugac

SEQ ID NO: 1890883 - RNA, 21 nt, Homo sapiens
gcucaagcagucuacccaccu

SEQ ID NO: 1890884 - RNA, 14 nt, Homo sapiens
cugcucuaauauca

SEQ ID NO: 1890885 - RNA, 15 nt, Homo sapiens
uuguuaguacuuugg

SEQ ID NO: 1890886 - RNA, 22 nt, Homo sapiens
ccagccucgccgaggagagcaa

SEQ ID NO: 1890887 - RNA, 19 nt, Homo sapiens
gucaaguaagaacugcucu

SEQ ID NO: 1890888 - RNA, 18 nt, Homo sapiens
agcugagacuacagguga

SEQ ID NO: 1890889 - RNA, 16 nt, Homo sapiens
gaagaaaaagagccau

SEQ ID NO: 1890890 - RNA, 18 nt, Homo sapiens
cucgccuuuuaggcucag

SEQ ID NO: 1890891 - RNA, 19 nt, Homo sapiens
ccauggcuguguuggugug

SEQ ID NO: 1890892 - RNA, 12 nt, Homo sapiens
accgagugcaau

SEQ ID NO: 1890893 - RNA, 14 nt, Homo sapiens
caagaucugaauuu

SEQ ID NO: 1890894 - RNA, 16 nt, Homo sapiens
aguaagagagcacagu

SEQ ID NO: 1890895 - RNA, 15 nt, Homo sapiens
uuuugagcacaaaau

SEQ ID NO: 1890896 - RNA, 16 nt, Homo sapiens
cuuggcccgcacagag

SEQ ID NO: 1890897 - RNA, 23 nt, Homo sapiens
auaaacgguuccuggugacuccu

SEQ ID NO: 1890898 - RNA, 13 nt, Homo sapiens
gauaaacucagaa

SEQ ID NO: 1890899 - RNA, 13 nt, Homo sapiens
ucaucucuacuaa

SEQ ID NO: 1890900 - RNA, 20 nt, Homo sapiens
aacuaguaaagcaaagugag

SEQ ID NO: 1890901 - RNA, 20 nt, Homo sapiens
ggccagccgcucuccugcca

SEQ ID NO: 1890902 - RNA, 14 nt, Homo sapiens
gcuuuagcauuauu

SEQ ID NO: 1890903 - RNA, 15 nt, Homo sapiens
gcuuuccuguuucca

SEQ ID NO: 1890904 - RNA, 15 nt, Homo sapiens
acacgcacacaucuu

SEQ ID NO: 1890905 - RNA, 16 nt, Homo sapiens
acguaaauccuggcca

SEQ ID NO: 1890906 - RNA, 16 nt, Homo sapiens
cggcccucaagugccc

SEQ ID NO: 1890907 - RNA, 17 nt, Homo sapiens
cccaugggaucuugagg

SEQ ID NO: 1890908 - RNA, 20 nt, Homo sapiens
aaggaggcugaucccugaga

SEQ ID NO: 1890909 - RNA, 15 nt, Homo sapiens
agagcccacugcuca

SEQ ID NO: 1890910 - RNA, 14 nt, Homo sapiens
ccacgaggugcagu

SEQ ID NO: 1890911 - RNA, 13 nt, Homo sapiens
uuagauucacuua

SEQ ID NO: 1890912 - RNA, 15 nt, Homo sapiens
agcugaauacauucu

SEQ ID NO: 1890913 - RNA, 19 nt, Homo sapiens
uaucugugugugauuugcu

SEQ ID NO: 1890914 - RNA, 18 nt, Homo sapiens
ucuccaccuuaguacuuu

SEQ ID NO: 1890915 - RNA, 17 nt, Homo sapiens
ccaugaggagaugcugg

SEQ ID NO: 1890916 - RNA, 18 nt, Homo sapiens
ucuuacaaaagauuguca

SEQ ID NO: 1890917 - RNA, 18 nt, Homo sapiens
ucuuuugaaagaacauca

SEQ ID NO: 1890918 - RNA, 14 nt, Homo sapiens
aggacagcugugcc

SEQ ID NO: 1890919 - RNA, 15 nt, Homo sapiens
augcguguaccucac

SEQ ID NO: 1890920 - RNA, 16 nt, Homo sapiens
aaaccuggagaugaug

SEQ ID NO: 1890921 - RNA, 23 nt, Homo sapiens
aaguccagaaacuguucccaccu

SEQ ID NO: 1890922 - RNA, 14 nt, Homo sapiens
uugcaguacagaga

SEQ ID NO: 1890923 - RNA, 22 nt, Homo sapiens
acauuauuuggcuuaaaccaga

SEQ ID NO: 1890924 - RNA, 19 nt, Homo sapiens
uguuagaugcuuaguguga

SEQ ID NO: 1890925 - RNA, 15 nt, Homo sapiens
ucaaacaccucugua

SEQ ID NO: 1890926 - RNA, 19 nt, Homo sapiens
ggaagacauuucugcacau

SEQ ID NO: 1890927 - RNA, 16 nt, Homo sapiens
acagcccucacuuucu

SEQ ID NO: 1890928 - RNA, 21 nt, Homo sapiens
cuauaucauaacuauacuuga

SEQ ID NO: 1890929 - RNA, 14 nt, Homo sapiens
uuuuaagcuguaaa

SEQ ID NO: 1890930 - RNA, 17 nt, Homo sapiens
gccaagccagggacuaa

SEQ ID NO: 1890931 - RNA, 21 nt, Homo sapiens
guuagucaauccugucauaua

SEQ ID NO: 1890932 - RNA, 19 nt, Homo sapiens
ccuucccugagcuuuggug

SEQ ID NO: 1890933 - RNA, 17 nt, Homo sapiens
uugaccucgugauccac

SEQ ID NO: 1890934 - RNA, 19 nt, Homo sapiens
gaaagaagaauguguuuca

SEQ ID NO: 1890935 - RNA, 17 nt, Homo sapiens
ugaagugugcugugaca

SEQ ID NO: 1890936 - RNA, 13 nt, Homo sapiens
agccaguggugcu

SEQ ID NO: 1890937 - RNA, 20 nt, Homo sapiens
ucaaucuggcuucugcauua

SEQ ID NO: 1890938 - RNA, 13 nt, Homo sapiens
auaagccagcugc

SEQ ID NO: 1890939 - RNA, 20 nt, Homo sapiens
ugccuucaauaaaugguaua

SEQ ID NO: 1890940 - RNA, 17 nt, Homo sapiens
augugaccugugucacu

SEQ ID NO: 1890941 - RNA, 17 nt, Homo sapiens
caaaucaaacauauucu

SEQ ID NO: 1890942 - RNA, 23 nt, Homo sapiens
acuguuuauuaccagauucacuu

SEQ ID NO: 1890943 - RNA, 19 nt, Homo sapiens
gagacaaaccuuaaaacag

SEQ ID NO: 1890944 - RNA, 18 nt, Homo sapiens
agagacaauaaaacauuc

SEQ ID NO: 1890945 - RNA, 23 nt, Homo sapiens
aaugcauauccaacaugugcuca

SEQ ID NO: 1890946 - RNA, 12 nt, Homo sapiens
gaaguuugccaa

SEQ ID NO: 1890947 - RNA, 18 nt, Homo sapiens
gaugauucaaauaucaaa

SEQ ID NO: 1890948 - RNA, 12 nt, Homo sapiens
augaaaagccaa

SEQ ID NO: 1890949 - RNA, 12 nt, Homo sapiens
auguaaagccau

SEQ ID NO: 1890950 - RNA, 15 nt, Homo sapiens
cuugggacucaggag

SEQ ID NO: 1890951 - RNA, 17 nt, Homo sapiens
agcucacggaacuggag

SEQ ID NO: 1890952 - RNA, 22 nt, Homo sapiens
agacugacuuguuugucuucca

SEQ ID NO: 1890953 - RNA, 12 nt, Homo sapiens
gcccagugcaug

SEQ ID NO: 1890954 - RNA, 17 nt, Homo sapiens
caagucuaacaguuaau

SEQ ID NO: 1890955 - RNA, 17 nt, Homo sapiens
uagaacaacgccuguca

SEQ ID NO: 1890956 - RNA, 17 nt, Homo sapiens
aacauguguuucugaca

SEQ ID NO: 1890957 - RNA, 12 nt, Homo sapiens
agugcagccacu

SEQ ID NO: 1890958 - RNA, 19 nt, Homo sapiens
gacuucacugcagccuuuc

SEQ ID NO: 1890959 - RNA, 18 nt, Homo sapiens
uuugccaucaagaaacau

SEQ ID NO: 1890960 - RNA, 18 nt, Homo sapiens
uaccagaugaacauuuca

SEQ ID NO: 1890961 - RNA, 15 nt, Homo sapiens
gagcccacugcaguu

SEQ ID NO: 1890962 - RNA, 23 nt, Homo sapiens
ccugaguggugccaaacaaaaag

SEQ ID NO: 1890963 - RNA, 20 nt, Homo sapiens
caagagugagugaacaacua

SEQ ID NO: 1890964 - RNA, 19 nt, Homo sapiens
aaaaccuuucaaaggauau

SEQ ID NO: 1890965 - RNA, 21 nt, Homo sapiens
uaauaaaaaauauucuuguca

SEQ ID NO: 1890966 - RNA, 18 nt, Homo sapiens
uacacccaguugccaaag

SEQ ID NO: 1890967 - RNA, 20 nt, Homo sapiens
gaggccuauuguugaauaaa

SEQ ID NO: 1890968 - RNA, 23 nt, Homo sapiens
uaaauuaacucaccagauuuacu

SEQ ID NO: 1890969 - RNA, 17 nt, Homo sapiens
cuuugugauuccaugga

SEQ ID NO: 1890970 - RNA, 21 nt, Homo sapiens
ucuccaaccccccagcacuga

SEQ ID NO: 1890971 - RNA, 21 nt, Homo sapiens
ccuguggggucugaugugucc

SEQ ID NO: 1890972 - RNA, 14 nt, Homo sapiens
ugagcuaaucuuca

SEQ ID NO: 1890973 - RNA, 20 nt, Homo sapiens
ugcccagcggacaguggcag

SEQ ID NO: 1890974 - RNA, 16 nt, Homo sapiens
accagccccaccaugc

SEQ ID NO: 1890975 - RNA, 13 nt, Homo sapiens
caagacaaaaagc

SEQ ID NO: 1890976 - RNA, 18 nt, Homo sapiens
uuuuccaaacacaggcaa

SEQ ID NO: 1890977 - RNA, 18 nt, Homo sapiens
gcccuggaugcccaggaa

SEQ ID NO: 1890978 - RNA, 13 nt, Homo sapiens
cuaccacaaggaa

SEQ ID NO: 1890979 - RNA, 15 nt, Homo sapiens
acacagcuuaacaau

SEQ ID NO: 1890980 - RNA, 20 nt, Homo sapiens
caggagaccacggggagcaa

SEQ ID NO: 1890981 - RNA, 13 nt, Homo sapiens
caaagaagccagc

SEQ ID NO: 1890982 - RNA, 23 nt, Homo sapiens
cugugucuuauagguuuccacug

SEQ ID NO: 1890983 - RNA, 22 nt, Homo sapiens
agaagaucucaaggauccagac

SEQ ID NO: 1890984 - RNA, 22 nt, Homo sapiens
ggagugccaggaccagccugua

SEQ ID NO: 1890985 - RNA, 20 nt, Homo sapiens
ccuccaccuccuggguucaa

SEQ ID NO: 1890986 - RNA, 21 nt, Homo sapiens
agauggagguucucucggagu

SEQ ID NO: 1890987 - RNA, 14 nt, Homo sapiens
guucccauucugag

SEQ ID NO: 1890988 - RNA, 17 nt, Homo sapiens
agugagaaaacugugac

SEQ ID NO: 1890989 - RNA, 13 nt, Homo sapiens
aagaaauugccuc

SEQ ID NO: 1890990 - RNA, 19 nt, Homo sapiens
cuuuugaccuguggugcaa

SEQ ID NO: 1890991 - RNA, 22 nt, Homo sapiens
agauucaguguuacagugcuaa

SEQ ID NO: 1890992 - RNA, 14 nt, Homo sapiens
cuccauuacucuau

SEQ ID NO: 1890993 - RNA, 18 nt, Homo sapiens
gcuucaucuugagccuga

SEQ ID NO: 1890994 - RNA, 21 nt, Homo sapiens
ugcuucaggaaggacauggac

SEQ ID NO: 1890995 - RNA, 18 nt, Homo sapiens
uaaauggauaaguagaau

SEQ ID NO: 1890996 - RNA, 18 nt, Homo sapiens
ugucuccuuaacacugag

SEQ ID NO: 1890997 - RNA, 14 nt, Homo sapiens
ucccauuggccuua

SEQ ID NO: 1890998 - RNA, 20 nt, Homo sapiens
aauccauagccaauacauuu

SEQ ID NO: 1890999 - RNA, 14 nt, Homo sapiens
cuucccccugcaaa

SEQ ID NO: 1891000 - RNA, 16 nt, Homo sapiens
gcuggcaagucuucca

SEQ ID NO: 1891001 - RNA, 17 nt, Homo sapiens
ugcuuuuuuaaauauua

SEQ ID NO: 1891002 - RNA, 12 nt, Homo sapiens
uuauccauguac

SEQ ID NO: 1891003 - RNA, 17 nt, Homo sapiens
aacugguuuuagacaaa

SEQ ID NO: 1891004 - RNA, 10 nt, Homo sapiens
ugaguagccc

SEQ ID NO: 1891005 - RNA, 17 nt, Homo sapiens
cuuaaggcuugaaguaa

SEQ ID NO: 1891006 - RNA, 14 nt, Homo sapiens
aacuugcaauacca

SEQ ID NO: 1891007 - RNA, 20 nt, Homo sapiens
aauauuuaagacacugaaaa

SEQ ID NO: 1891008 - RNA, 13 nt, Homo sapiens
ugccaaaccuuua

SEQ ID NO: 1891009 - RNA, 20 nt, Homo sapiens
caugcacucuuuugagcagu

SEQ ID NO: 1891010 - RNA, 22 nt, Homo sapiens
cacaggcagcaaggucaugguc

SEQ ID NO: 1891011 - RNA, 12 nt, Homo sapiens
cccucaguguug

SEQ ID NO: 1891012 - RNA, 23 nt, Homo sapiens
gauugccacagcucaacucgggg

SEQ ID NO: 1891013 - RNA, 13 nt, Homo sapiens
uccgggcucagaa

SEQ ID NO: 1891014 - RNA, 17 nt, Homo sapiens
ggcaaagaccgauugca

SEQ ID NO: 1891015 - RNA, 22 nt, Homo sapiens
auucaugccagggacugacaaa

SEQ ID NO: 1891016 - RNA, 17 nt, Homo sapiens
gugcuuuguacugcugu

SEQ ID NO: 1891017 - RNA, 20 nt, Homo sapiens
gauacaaaacuauuaaguau

SEQ ID NO: 1891018 - RNA, 20 nt, Homo sapiens
uuuuuaccuaaucuccacuu

SEQ ID NO: 1891019 - RNA, 23 nt, Homo sapiens
cagccagucucagagaccagcac

SEQ ID NO: 1891020 - RNA, 21 nt, Homo sapiens
ccuuccucucaagcuagccag

SEQ ID NO: 1891021 - RNA, 19 nt, Homo sapiens
agaaggucucauuaucucc

SEQ ID NO: 1891022 - RNA, 22 nt, Homo sapiens
aguucacuuuuuacagugcuau

SEQ ID NO: 1891023 - RNA, 14 nt, Homo sapiens
ucuaaugagcauuu

SEQ ID NO: 1891024 - RNA, 16 nt, Homo sapiens
uguucccccgcuggca

SEQ ID NO: 1891025 - RNA, 14 nt, Homo sapiens
acacuuguauaaau

SEQ ID NO: 1891026 - RNA, 15 nt, Homo sapiens
uggacaggcaaagac

SEQ ID NO: 1891027 - RNA, 19 nt, Homo sapiens
aaagccuugugaucacuuu

SEQ ID NO: 1891028 - RNA, 14 nt, Homo sapiens
gugaggagggcagu

SEQ ID NO: 1891029 - RNA, 17 nt, Homo sapiens
guuaugauguaaucucu

SEQ ID NO: 1891030 - RNA, 13 nt, Homo sapiens
aggagcuacccuu

SEQ ID NO: 1891031 - RNA, 17 nt, Homo sapiens
uauaauguaagcucuac

SEQ ID NO: 1891032 - RNA, 14 nt, Homo sapiens
ucuuaaaaacugug

SEQ ID NO: 1891033 - RNA, 23 nt, Homo sapiens
uccugcucucuggaggacgguca

SEQ ID NO: 1891034 - RNA, 10 nt, Homo sapiens
uaaaaaucug

SEQ ID NO: 1891035 - RNA, 14 nt, Homo sapiens
ugauguggcaauaa

SEQ ID NO: 1891036 - RNA, 15 nt, Homo sapiens
uuaaaugacacucau

SEQ ID NO: 1891037 - RNA, 23 nt, Homo sapiens
aggugcuaugucccaagagccau

SEQ ID NO: 1891038 - RNA, 21 nt, Homo sapiens
auuacaaaaucuuaaccuuca

SEQ ID NO: 1891039 - RNA, 13 nt, Homo sapiens
cuuuucuucuagc

SEQ ID NO: 1891040 - RNA, 14 nt, Homo sapiens
uuucaccuguauug

SEQ ID NO: 1891041 - RNA, 19 nt, Homo sapiens
ggcucuuaugugugccuuu

SEQ ID NO: 1891042 - RNA, 14 nt, Homo sapiens
agagucccacugcc

SEQ ID NO: 1891043 - RNA, 22 nt, Homo sapiens
ucacugugcuaucggcagauga

SEQ ID NO: 1891044 - RNA, 13 nt, Homo sapiens
gaugaaaagccau

SEQ ID NO: 1891045 - RNA, 14 nt, Homo sapiens
ccugacaccugcuu

SEQ ID NO: 1891046 - RNA, 17 nt, Homo sapiens
agcuuugguucugccau

SEQ ID NO: 1891047 - RNA, 15 nt, Homo sapiens
ugugcgugugugcaa

SEQ ID NO: 1891048 - RNA, 21 nt, Homo sapiens
cacccaaaagucacccaggga

SEQ ID NO: 1891049 - RNA, 16 nt, Homo sapiens
uuacuuuauguuacua

SEQ ID NO: 1891050 - RNA, 18 nt, Homo sapiens
caccacaggcccuuuccu

SEQ ID NO: 1891051 - RNA, 18 nt, Homo sapiens
agcccuaaccccuuccag

SEQ ID NO: 1891052 - RNA, 21 nt, Homo sapiens
auaauuuaacuguguuuuagg

SEQ ID NO: 1891053 - RNA, 14 nt, Homo sapiens
ggacaaaacuggag

SEQ ID NO: 1891054 - RNA, 12 nt, Homo sapiens
gcugaaagccaa

SEQ ID NO: 1891055 - RNA, 15 nt, Homo sapiens
acccaggugauuucc

SEQ ID NO: 1891056 - RNA, 19 nt, Homo sapiens
aaaccaagauuaugugacu

SEQ ID NO: 1891057 - RNA, 22 nt, Homo sapiens
agaacaguguugaaauuggaaa

SEQ ID NO: 1891058 - RNA, 16 nt, Homo sapiens
auuuauggccguauca

SEQ ID NO: 1891059 - RNA, 20 nt, Homo sapiens
gagacagaauagagugauag

SEQ ID NO: 1891060 - RNA, 23 nt, Homo sapiens
acucugacguugaucccagagag

SEQ ID NO: 1891061 - RNA, 19 nt, Homo sapiens
ucauuacagggcacaggcc

SEQ ID NO: 1891062 - RNA, 17 nt, Homo sapiens
cauaaacuucaugguca

SEQ ID NO: 1891063 - RNA, 22 nt, Homo sapiens
aggcuagaauggaaaacugccu

SEQ ID NO: 1891064 - RNA, 15 nt, Homo sapiens
ggcuucccaggggaa

SEQ ID NO: 1891065 - RNA, 15 nt, Homo sapiens
cucuuuccacuuugu

SEQ ID NO: 1891066 - RNA, 19 nt, Homo sapiens
agcacuauccccacuuuuc

SEQ ID NO: 1891067 - RNA, 18 nt, Homo sapiens
caagcaggugaacuggga

SEQ ID NO: 1891068 - RNA, 16 nt, Homo sapiens
aagccaaagaaaugaa

SEQ ID NO: 1891069 - RNA, 19 nt, Homo sapiens
gauauggcggccugcagug

SEQ ID NO: 1891070 - RNA, 18 nt, Homo sapiens
auuccaugacgacauaca

SEQ ID NO: 1891071 - RNA, 12 nt, Homo sapiens
uuucaguucauc

SEQ ID NO: 1891072 - RNA, 20 nt, Homo sapiens
gucaggacccaccaugucug

SEQ ID NO: 1891073 - RNA, 13 nt, Homo sapiens
uggaugcggccau

SEQ ID NO: 1891074 - RNA, 14 nt, Homo sapiens
aggaagggccacca

SEQ ID NO: 1891075 - RNA, 19 nt, Homo sapiens
ucugcaaccuugaagacua

SEQ ID NO: 1891076 - RNA, 16 nt, Homo sapiens
aauaaaagauucaccu

SEQ ID NO: 1891077 - RNA, 19 nt, Homo sapiens
auaaauacauuuuugucag

SEQ ID NO: 1891078 - RNA, 18 nt, Homo sapiens
agagagggcugagccaug

SEQ ID NO: 1891079 - RNA, 15 nt, Homo sapiens
uacuuuauuaacuua

SEQ ID NO: 1891080 - RNA, 13 nt, Homo sapiens
aaauugcuucuag

SEQ ID NO: 1891081 - RNA, 22 nt, Homo sapiens
agcauuacgugagccagguaau

SEQ ID NO: 1891082 - RNA, 20 nt, Homo sapiens
uccuccugggucagggagaa

SEQ ID NO: 1891083 - RNA, 15 nt, Homo sapiens
auucaguaguggaaa

SEQ ID NO: 1891084 - RNA, 13 nt, Homo sapiens
aauaaccucuggc

SEQ ID NO: 1891085 - RNA, 22 nt, Homo sapiens
aaagaaggaauucuaggcaucc

SEQ ID NO: 1891086 - RNA, 21 nt, Homo sapiens
ugcugaggccacccacugacc

SEQ ID NO: 1891087 - RNA, 15 nt, Homo sapiens
ucuucaugucaucaa

SEQ ID NO: 1891088 - RNA, 21 nt, Homo sapiens
agggccuggcaggccaguguc

SEQ ID NO: 1891089 - RNA, 22 nt, Homo sapiens
acccacuuuaaaauaucuacau

SEQ ID NO: 1891090 - RNA, 19 nt, Homo sapiens
aggcaccugcucccacaga

SEQ ID NO: 1891091 - RNA, 17 nt, Homo sapiens
cagggacccacuucaca

SEQ ID NO: 1891092 - RNA, 14 nt, Homo sapiens
cucccaaucagcuu

SEQ ID NO: 1891093 - RNA, 14 nt, Homo sapiens
gcuuugugcuuguc

SEQ ID NO: 1891094 - RNA, 17 nt, Homo sapiens
caggccaaggcuaugaa

SEQ ID NO: 1891095 - RNA, 21 nt, Homo sapiens
uuugaucucacacaccagggc

SEQ ID NO: 1891096 - RNA, 20 nt, Homo sapiens
agccaccccucagacugggu

SEQ ID NO: 1891097 - RNA, 21 nt, Homo sapiens
gggguacagcccuugcacucc

SEQ ID NO: 1891098 - RNA, 22 nt, Homo sapiens
aaggucucauuaucuccaugau

SEQ ID NO: 1891099 - RNA, 23 nt, Homo sapiens
gacuuucaggaauuuuguaaucu

SEQ ID NO: 1891100 - RNA, 18 nt, Homo sapiens
uacucuauguaugcaucu

SEQ ID NO: 1891101 - RNA, 22 nt, Homo sapiens
uucaguuucuaucaaccuucaa

SEQ ID NO: 1891102 - RNA, 17 nt, Homo sapiens
ugaauuuucaaguaauu

SEQ ID NO: 1891103 - RNA, 13 nt, Homo sapiens
acuaggacacucc

SEQ ID NO: 1891104 - RNA, 14 nt, Homo sapiens
aagagauccaaaga

SEQ ID NO: 1891105 - RNA, 15 nt, Homo sapiens
ucccaggaggggcuu

SEQ ID NO: 1891106 - RNA, 17 nt, Homo sapiens
aaacuauuucuauccug

SEQ ID NO: 1891107 - RNA, 20 nt, Homo sapiens
auuacuuuuucauucuuuua

SEQ ID NO: 1891108 - RNA, 23 nt, Homo sapiens
guucauggauauguuauacugaa

SEQ ID NO: 1891109 - RNA, 22 nt, Homo sapiens
aaauccaucuaaauaccugccc

SEQ ID NO: 1891110 - RNA, 23 nt, Homo sapiens
gaggcacgcaccacugcuuccca

SEQ ID NO: 1891111 - RNA, 15 nt, Homo sapiens
ucuauaccacacaga

SEQ ID NO: 1891112 - RNA, 24 nt, Homo sapiens
uccauauaacaauucaguaacaaa

SEQ ID NO: 1891113 - RNA, 15 nt, Homo sapiens
aaaaguagacaauca

SEQ ID NO: 1891114 - RNA, 21 nt, Homo sapiens
aauauuuagaacgacauguua

SEQ ID NO: 1891115 - RNA, 15 nt, Homo sapiens
uauguuaauaucuga

SEQ ID NO: 1891116 - RNA, 13 nt, Homo sapiens
ugacccugcucuc

SEQ ID NO: 1891117 - RNA, 23 nt, Homo sapiens
cccuugaauuucuagacaguauu

SEQ ID NO: 1891118 - RNA, 23 nt, Homo sapiens
cuguggccacauuuucagccaaa

SEQ ID NO: 1891119 - RNA, 15 nt, Homo sapiens
caaaagggugucuga

SEQ ID NO: 1891120 - RNA, 19 nt, Homo sapiens
uacugggagauacagccau

SEQ ID NO: 1891121 - RNA, 16 nt, Homo sapiens
uuuaaaugcaccugga

SEQ ID NO: 1891122 - RNA, 17 nt, Homo sapiens
ccccugaauuaagcaga

SEQ ID NO: 1891123 - RNA, 16 nt, Homo sapiens
aaaauccauacauuug

SEQ ID NO: 1891124 - RNA, 15 nt, Homo sapiens
auaguuagcuuuauu

SEQ ID NO: 1891125 - RNA, 23 nt, Homo sapiens
aaccauguugguugcacuuugua

SEQ ID NO: 1891126 - RNA, 15 nt, Homo sapiens
cucaggcagugcagu

SEQ ID NO: 1891127 - RNA, 19 nt, Homo sapiens
auaaacauuucauuuccca

SEQ ID NO: 1891128 - RNA, 18 nt, Homo sapiens
acucuguaguuacugugg

SEQ ID NO: 1891129 - RNA, 14 nt, Homo sapiens
auagugaacacacu

SEQ ID NO: 1891130 - RNA, 13 nt, Homo sapiens
gacucccuacccc

SEQ ID NO: 1891131 - RNA, 13 nt, Homo sapiens
aacucccugcccc

SEQ ID NO: 1891132 - RNA, 16 nt, Homo sapiens
acaugauuccagccau

SEQ ID NO: 1891133 - RNA, 21 nt, Homo sapiens
ugaagagauuucaacauauca

SEQ ID NO: 1891134 - RNA, 21 nt, Homo sapiens
ucauuuuuguacaguuugcug

SEQ ID NO: 1891135 - RNA, 20 nt, Homo sapiens
agugaauggugccauuuucg

SEQ ID NO: 1891136 - RNA, 14 nt, Homo sapiens
agauacuggcgcca

SEQ ID NO: 1891137 - RNA, 17 nt, Homo sapiens
ugucuaaaaucccuccu

SEQ ID NO: 1891138 - RNA, 15 nt, Homo sapiens
uuauguauuuuccaa

SEQ ID NO: 1891139 - RNA, 18 nt, Homo sapiens
aucagcuucagaauggca

SEQ ID NO: 1891140 - RNA, 17 nt, Homo sapiens
aguccuguccucuggau

SEQ ID NO: 1891141 - RNA, 18 nt, Homo sapiens
gaauaaaauuguaaaauu

SEQ ID NO: 1891142 - RNA, 14 nt, Homo sapiens
acaauugucaugua

SEQ ID NO: 1891143 - RNA, 14 nt, Homo sapiens
ggcuucaguguuuu

SEQ ID NO: 1891144 - RNA, 17 nt, Homo sapiens
gggaaggggccaugacu

SEQ ID NO: 1891145 - RNA, 19 nt, Homo sapiens
agcaggggcuccagcaccu

SEQ ID NO: 1891146 - RNA, 20 nt, Homo sapiens
uaacauuuuauacaauuucc

SEQ ID NO: 1891147 - RNA, 23 nt, Homo sapiens
uacuuaaauuugaaucugaguga

SEQ ID NO: 1891148 - RNA, 21 nt, Homo sapiens
gacagauuccaggcgaugugc

SEQ ID NO: 1891149 - RNA, 13 nt, Homo sapiens
uaccucucuugcu

SEQ ID NO: 1891150 - RNA, 12 nt, Homo sapiens
uucaaaccaauu

SEQ ID NO: 1891151 - RNA, 14 nt, Homo sapiens
aaaucaaaugugca

SEQ ID NO: 1891152 - RNA, 20 nt, Homo sapiens
cagagugauguccucucuca

SEQ ID NO: 1891153 - RNA, 11 nt, Homo sapiens
caugagaucag

SEQ ID NO: 1891154 - RNA, 14 nt, Homo sapiens
uauguuccaagugc

SEQ ID NO: 1891155 - RNA, 19 nt, Homo sapiens
cuguucuggccucagacca

SEQ ID NO: 1891156 - RNA, 18 nt, Homo sapiens
uauuacaaauccaaugaa

SEQ ID NO: 1891157 - RNA, 14 nt, Homo sapiens
ucaggaaaaauaca

SEQ ID NO: 1891158 - RNA, 18 nt, Homo sapiens
uugaagccaaacuguugg

SEQ ID NO: 1891159 - RNA, 18 nt, Homo sapiens
uagaggugcaugccuaau

SEQ ID NO: 1891160 - RNA, 19 nt, Homo sapiens
uagacuucugcuuuccaca

SEQ ID NO: 1891161 - RNA, 22 nt, Homo sapiens
gcaaacaaacaagcuuacuucc

SEQ ID NO: 1891162 - RNA, 18 nt, Homo sapiens
guuuagucuaccaaaaac

SEQ ID NO: 1891163 - RNA, 19 nt, Homo sapiens
gaacaagucggcuguggag

SEQ ID NO: 1891164 - RNA, 20 nt, Homo sapiens
acagggcgagacuccgucuc

SEQ ID NO: 1891165 - RNA, 19 nt, Homo sapiens
ucauuauuuugugguucua

SEQ ID NO: 1891166 - RNA, 15 nt, Homo sapiens
aggggcuguggcuga

SEQ ID NO: 1891167 - RNA, 20 nt, Homo sapiens
cccugugccaggccaaagau

SEQ ID NO: 1891168 - RNA, 12 nt, Homo sapiens
cuuaacacuucc

SEQ ID NO: 1891169 - RNA, 22 nt, Homo sapiens
uuagagaaacuuugaguacaga

SEQ ID NO: 1891170 - RNA, 22 nt, Homo sapiens
agacuggaaguucauaccuaag

SEQ ID NO: 1891171 - RNA, 14 nt, Homo sapiens
cauguaacacgaca

SEQ ID NO: 1891172 - RNA, 17 nt, Homo sapiens
gcgcaggaccauggacu

SEQ ID NO: 1891173 - RNA, 14 nt, Homo sapiens
acaugccacuugaa

SEQ ID NO: 1891174 - RNA, 13 nt, Homo sapiens
uuuaagacauaaa

SEQ ID NO: 1891175 - RNA, 16 nt, Homo sapiens
agaugguuucuugcaa

SEQ ID NO: 1891176 - RNA, 15 nt, Homo sapiens
ggaccaggucucaua

SEQ ID NO: 1891177 - RNA, 20 nt, Homo sapiens
acuuuauguuacuacaugca

SEQ ID NO: 1891178 - RNA, 17 nt, Homo sapiens
aacuucugaacuuggaa

SEQ ID NO: 1891179 - RNA, 18 nt, Homo sapiens
acaugcugcuaauucaaa

SEQ ID NO: 1891180 - RNA, 15 nt, Homo sapiens
acacuacuaccucuu

SEQ ID NO: 1891181 - RNA, 19 nt, Homo sapiens
gccgagagcagacaccagc

SEQ ID NO: 1891182 - RNA, 21 nt, Homo sapiens
uguggcaggagggcaguggug

SEQ ID NO: 1891183 - RNA, 16 nt, Homo sapiens
auccccuucugcaauc

SEQ ID NO: 1891184 - RNA, 20 nt, Homo sapiens
guaccucaaucuauucugua

SEQ ID NO: 1891185 - RNA, 23 nt, Homo sapiens
guucagaagaaagauugcuauaa

SEQ ID NO: 1891186 - RNA, 21 nt, Homo sapiens
auuuaaaguuguuugugccuu

SEQ ID NO: 1891187 - RNA, 13 nt, Homo sapiens
gauaaaacagaau

SEQ ID NO: 1891188 - RNA, 19 nt, Homo sapiens
gcacaggcaagaguguucu

SEQ ID NO: 1891189 - RNA, 13 nt, Homo sapiens
gcuucugcaaugu

SEQ ID NO: 1891190 - RNA, 19 nt, Homo sapiens
ugacauugugucaguuuca

SEQ ID NO: 1891191 - RNA, 20 nt, Homo sapiens
acaugccucucucaggccaa

SEQ ID NO: 1891192 - RNA, 12 nt, Homo sapiens
guagauauuuga

SEQ ID NO: 1891193 - RNA, 14 nt, Homo sapiens
cucaugaggccaug

SEQ ID NO: 1891194 - RNA, 21 nt, Homo sapiens
cucuguccuggcugugcacau

SEQ ID NO: 1891195 - RNA, 17 nt, Homo sapiens
gguagaguccuaggaca

SEQ ID NO: 1891196 - RNA, 21 nt, Homo sapiens
gucuucaguuuccgaaucucu

SEQ ID NO: 1891197 - RNA, 20 nt, Homo sapiens
caccagugguacuaagcaca

SEQ ID NO: 1891198 - RNA, 12 nt, Homo sapiens
aaaucuggugcu

SEQ ID NO: 1891199 - RNA, 17 nt, Homo sapiens
acagcugaaagauugau

SEQ ID NO: 1891200 - RNA, 15 nt, Homo sapiens
cuuguaacaucaggg

SEQ ID NO: 1891201 - RNA, 24 nt, Homo sapiens
guaguaauuuauugucugucuaca

SEQ ID NO: 1891202 - RNA, 14 nt, Homo sapiens
ucaaaaugugaacu

SEQ ID NO: 1891203 - RNA, 17 nt, Homo sapiens
acggcuuccaucugccc

SEQ ID NO: 1891204 - RNA, 21 nt, Homo sapiens
uuuuugaaauaaagaaccagu

SEQ ID NO: 1891205 - RNA, 19 nt, Homo sapiens
cuuaaugugaugcuugaua

SEQ ID NO: 1891206 - RNA, 14 nt, Homo sapiens
cucagcauccacua

SEQ ID NO: 1891207 - RNA, 23 nt, Homo sapiens
ccuucugauugauggugcuauuu

SEQ ID NO: 1891208 - RNA, 20 nt, Homo sapiens
gagaaaugauaagugacaaa

SEQ ID NO: 1891209 - RNA, 17 nt, Homo sapiens
cagagcuauaaaaugcu

SEQ ID NO: 1891210 - RNA, 16 nt, Homo sapiens
agcaggaaugcucuga

SEQ ID NO: 1891211 - RNA, 21 nt, Homo sapiens
acuggaaaacugcuacuaucu

SEQ ID NO: 1891212 - RNA, 14 nt, Homo sapiens
uaggaacuugagaa

SEQ ID NO: 1891213 - RNA, 23 nt, Homo sapiens
ggucuggccaagguggacggggu

SEQ ID NO: 1891214 - RNA, 23 nt, Homo sapiens
uguaauaauugcucauaagcaau

SEQ ID NO: 1891215 - RNA, 22 nt, Homo sapiens
cagagcgagaacccucaacuga

SEQ ID NO: 1891216 - RNA, 13 nt, Homo sapiens
gcgcccuccaggg

SEQ ID NO: 1891217 - RNA, 12 nt, Homo sapiens
uaccugccucag

SEQ ID NO: 1891218 - RNA, 19 nt, Homo sapiens
uccacuugccuugugauau

SEQ ID NO: 1891219 - RNA, 18 nt, Homo sapiens
cagcaggaagccauagau

SEQ ID NO: 1891220 - RNA, 23 nt, Homo sapiens
gaaacauuaacucuaacugugac

SEQ ID NO: 1891221 - RNA, 14 nt, Homo sapiens
accaugugccacac

SEQ ID NO: 1891222 - RNA, 14 nt, Homo sapiens
aaaaggugaaucua

SEQ ID NO: 1891223 - RNA, 13 nt, Homo sapiens
cccucaccuguca

SEQ ID NO: 1891224 - RNA, 20 nt, Homo sapiens
cuucauuugggaaauucagc

SEQ ID NO: 1891225 - RNA, 15 nt, Homo sapiens
uaauuuuaucuguau

SEQ ID NO: 1891226 - RNA, 18 nt, Homo sapiens
gauugacacacagcacuc

SEQ ID NO: 1891227 - RNA, 18 nt, Homo sapiens
gacuaaccucuaacaaca

SEQ ID NO: 1891228 - RNA, 14 nt, Homo sapiens
gcacccuuagccac

SEQ ID NO: 1891229 - RNA, 13 nt, Homo sapiens
agaacugcacuuu

SEQ ID NO: 1891230 - RNA, 21 nt, Homo sapiens
acgauggggcaugaccucagu

SEQ ID NO: 1891231 - RNA, 17 nt, Homo sapiens
ugggaucugucacacca

SEQ ID NO: 1891232 - RNA, 17 nt, Homo sapiens
cuuaaaguggcuuucaa

SEQ ID NO: 1891233 - RNA, 21 nt, Homo sapiens
cccuuccaugucgccucugca

SEQ ID NO: 1891234 - RNA, 18 nt, Homo sapiens
acuguuccaaagccagug

SEQ ID NO: 1891235 - RNA, 14 nt, Homo sapiens
uaauuaauucucag

SEQ ID NO: 1891236 - RNA, 15 nt, Homo sapiens
auccggcagcacaag

SEQ ID NO: 1891237 - RNA, 22 nt, Homo sapiens
augcuguucacuggacacuuca

SEQ ID NO: 1891238 - RNA, 14 nt, Homo sapiens
ucuugccacugcac

SEQ ID NO: 1891239 - RNA, 15 nt, Homo sapiens
aauuauugacacuga

SEQ ID NO: 1891240 - RNA, 19 nt, Homo sapiens
guaaacuauaaacuacugu

SEQ ID NO: 1891241 - RNA, 24 nt, Homo sapiens
guuucuugaaguccaguguuucca

SEQ ID NO: 1891242 - RNA, 19 nt, Homo sapiens
gaagauggcauccugugaa

SEQ ID NO: 1891243 - RNA, 16 nt, Homo sapiens
uauccaauugcugcuu

SEQ ID NO: 1891244 - RNA, 21 nt, Homo sapiens
uacaagguauuuacacauaca

SEQ ID NO: 1891245 - RNA, 13 nt, Homo sapiens
agcaagacccugu

SEQ ID NO: 1891246 - RNA, 15 nt, Homo sapiens
auggccaaagcacau

SEQ ID NO: 1891247 - RNA, 22 nt, Homo sapiens
cuugcccuuccagcccuuucag

SEQ ID NO: 1891248 - RNA, 17 nt, Homo sapiens
aagugauacauaccucu

SEQ ID NO: 1891249 - RNA, 14 nt, Homo sapiens
aagcugcauccaga

SEQ ID NO: 1891250 - RNA, 17 nt, Homo sapiens
ggcugugccaucagcuc

SEQ ID NO: 1891251 - RNA, 23 nt, Homo sapiens
uaauaaagguuucguugcauggu

SEQ ID NO: 1891252 - RNA, 20 nt, Homo sapiens
auacauuucaauuauacuaa

SEQ ID NO: 1891253 - RNA, 18 nt, Homo sapiens
uaucagaacuccuuucua

SEQ ID NO: 1891254 - RNA, 22 nt, Homo sapiens
aagcacuuuuuugaacuuccca

SEQ ID NO: 1891255 - RNA, 14 nt, Homo sapiens
uuaaaccuguuccu

SEQ ID NO: 1891256 - RNA, 21 nt, Homo sapiens
caaaaaaaugcucacacucca

SEQ ID NO: 1891257 - RNA, 16 nt, Homo sapiens
aaugucuggucugucc

SEQ ID NO: 1891258 - RNA, 20 nt, Homo sapiens
cagaauuguucaacuuuuca

SEQ ID NO: 1891259 - RNA, 22 nt, Homo sapiens
gauuucacuacuuagcauaaua

SEQ ID NO: 1891260 - RNA, 14 nt, Homo sapiens
agucaauuuuacaa

SEQ ID NO: 1891261 - RNA, 13 nt, Homo sapiens
uccaauuggugcu

SEQ ID NO: 1891262 - RNA, 19 nt, Homo sapiens
aauagaccuaacugaauac

SEQ ID NO: 1891263 - RNA, 19 nt, Homo sapiens
guagccggaucaaggcaag

SEQ ID NO: 1891264 - RNA, 15 nt, Homo sapiens
gaaaugccaauaaca

SEQ ID NO: 1891265 - RNA, 23 nt, Homo sapiens
agucgaggacagggaggugaccc

SEQ ID NO: 1891266 - RNA, 17 nt, Homo sapiens
ugaggcauuuuuacuac

SEQ ID NO: 1891267 - RNA, 22 nt, Homo sapiens
cagccugacaacagccugagaa

SEQ ID NO: 1891268 - RNA, 15 nt, Homo sapiens
uucacagccaugauu

SEQ ID NO: 1891269 - RNA, 22 nt, Homo sapiens
ucauucucaguauccacugucu

SEQ ID NO: 1891270 - RNA, 15 nt, Homo sapiens
gcaaggccugugcug

SEQ ID NO: 1891271 - RNA, 20 nt, Homo sapiens
gauaaaguaauaaugugcaa

SEQ ID NO: 1891272 - RNA, 23 nt, Homo sapiens
uuauauucauuuauucaucauuc

SEQ ID NO: 1891273 - RNA, 22 nt, Homo sapiens
aaaugugacccagauccucaca

SEQ ID NO: 1891274 - RNA, 16 nt, Homo sapiens
cauacagcacuacuua

SEQ ID NO: 1891275 - RNA, 15 nt, Homo sapiens
agagaaacauuuuug

SEQ ID NO: 1891276 - RNA, 19 nt, Homo sapiens
ucccaaguucuuucuccau

SEQ ID NO: 1891277 - RNA, 19 nt, Homo sapiens
ucaugacccuccuguccag

SEQ ID NO: 1891278 - RNA, 23 nt, Homo sapiens
aucaugauuaagaugauuccuag

SEQ ID NO: 1891279 - RNA, 19 nt, Homo sapiens
uaaauuuaaaacacaguau

SEQ ID NO: 1891280 - RNA, 21 nt, Homo sapiens
gugccaaaauauaaucagaga

SEQ ID NO: 1891281 - RNA, 20 nt, Homo sapiens
acgugcagacaggcuggcau

SEQ ID NO: 1891282 - RNA, 19 nt, Homo sapiens
ccagaacuggacucaggau

SEQ ID NO: 1891283 - RNA, 16 nt, Homo sapiens
caacauucaaagcagc

SEQ ID NO: 1891284 - RNA, 23 nt, Homo sapiens
ccguuuuucaagaaaacuggaaa

SEQ ID NO: 1891285 - RNA, 13 nt, Homo sapiens
cauaaaauuggau

SEQ ID NO: 1891286 - RNA, 12 nt, Homo sapiens
ccccaauaccua

SEQ ID NO: 1891287 - RNA, 16 nt, Homo sapiens
uuaacucagacacaaa

SEQ ID NO: 1891288 - RNA, 18 nt, Homo sapiens
guaguuguugaguucaag

SEQ ID NO: 1891289 - RNA, 17 nt, Homo sapiens
cuaaaauucugauuuau

SEQ ID NO: 1891290 - RNA, 13 nt, Homo sapiens
uggaaucagugaa

SEQ ID NO: 1891291 - RNA, 17 nt, Homo sapiens
cacauauaucaaaguga

SEQ ID NO: 1891292 - RNA, 17 nt, Homo sapiens
aggcccuucucuacacc

SEQ ID NO: 1891293 - RNA, 14 nt, Homo sapiens
agaccgccaaauaa

SEQ ID NO: 1891294 - RNA, 19 nt, Homo sapiens
ucuuaccuguaugucucca

SEQ ID NO: 1891295 - RNA, 21 nt, Homo sapiens
ucuacgcugccucaacacuga

SEQ ID NO: 1891296 - RNA, 12 nt, Homo sapiens
auguucugggug

SEQ ID NO: 1891297 - RNA, 22 nt, Homo sapiens
cacuggccccucaaaucgucca

SEQ ID NO: 1891298 - RNA, 12 nt, Homo sapiens
uguuuuagauau

SEQ ID NO: 1891299 - RNA, 14 nt, Homo sapiens
acacagguguagac

SEQ ID NO: 1891300 - RNA, 14 nt, Homo sapiens
ugguuauauaguca

SEQ ID NO: 1891301 - RNA, 14 nt, Homo sapiens
uauucauauguuua

SEQ ID NO: 1891302 - RNA, 17 nt, Homo sapiens
uccccuaaaccaaaaac

SEQ ID NO: 1891303 - RNA, 17 nt, Homo sapiens
gaaaaagcaaguguuca

SEQ ID NO: 1891304 - RNA, 21 nt, Homo sapiens
agugugugauuagaagcuaaa

SEQ ID NO: 1891305 - RNA, 21 nt, Homo sapiens
auggcacccuggaaccgggaa

SEQ ID NO: 1891306 - RNA, 12 nt, Homo sapiens
uaaaucuaauca

SEQ ID NO: 1891307 - RNA, 18 nt, Homo sapiens
guaagaacuguacauugu

SEQ ID NO: 1891308 - RNA, 21 nt, Homo sapiens
agcuccauaauugcaagggaa

SEQ ID NO: 1891309 - RNA, 21 nt, Homo sapiens
acucugauguaaaugaaguaa

SEQ ID NO: 1891310 - RNA, 16 nt, Homo sapiens
acccgcuccuacagcu

SEQ ID NO: 1891311 - RNA, 18 nt, Homo sapiens
gccuguguuuguguggau

SEQ ID NO: 1891312 - RNA, 14 nt, Homo sapiens
gcgaugugcaagug

SEQ ID NO: 1891313 - RNA, 16 nt, Homo sapiens
gcuagaauucacucca

SEQ ID NO: 1891314 - RNA, 14 nt, Homo sapiens
gcagaucaacugag

SEQ ID NO: 1891315 - RNA, 20 nt, Homo sapiens
cauuguauuuaaaacauuuc

SEQ ID NO: 1891316 - RNA, 22 nt, Homo sapiens
agaggugggaggaacuccuugc

SEQ ID NO: 1891317 - RNA, 15 nt, Homo sapiens
cccgcauuccaggcu

SEQ ID NO: 1891318 - RNA, 17 nt, Homo sapiens
gcacagcacccauggga

SEQ ID NO: 1891319 - RNA, 17 nt, Homo sapiens
gcuauugucaccagggc

SEQ ID NO: 1891320 - RNA, 14 nt, Homo sapiens
agcagagguuggga

SEQ ID NO: 1891321 - RNA, 20 nt, Homo sapiens
aaugauccguuccauugcaa

SEQ ID NO: 1891322 - RNA, 21 nt, Homo sapiens
gaguguucaaaauacuacuga

SEQ ID NO: 1891323 - RNA, 14 nt, Homo sapiens
gguaaucagcauua

SEQ ID NO: 1891324 - RNA, 19 nt, Homo sapiens
aaucagcucguuacuucag

SEQ ID NO: 1891325 - RNA, 20 nt, Homo sapiens
ucauggggucccugcugcaa

SEQ ID NO: 1891326 - RNA, 18 nt, Homo sapiens
gccccugggcuaccaucu

SEQ ID NO: 1891327 - RNA, 20 nt, Homo sapiens
aaaauaguucuaaacuauca

SEQ ID NO: 1891328 - RNA, 15 nt, Homo sapiens
gucugugauugccau

SEQ ID NO: 1891329 - RNA, 21 nt, Homo sapiens
auacuugugaacaugccuuau

SEQ ID NO: 1891330 - RNA, 12 nt, Homo sapiens
uguagcaaagau

SEQ ID NO: 1891331 - RNA, 18 nt, Homo sapiens
ccucaagccccuucucuc

SEQ ID NO: 1891332 - RNA, 19 nt, Homo sapiens
gagaugaccucuaacugau

SEQ ID NO: 1891333 - RNA, 18 nt, Homo sapiens
aauacgguaaggauacuu

SEQ ID NO: 1891334 - RNA, 22 nt, Homo sapiens
ccaguggagacggaaucugccg

SEQ ID NO: 1891335 - RNA, 20 nt, Homo sapiens
ccacucuuggcuauugaaga

SEQ ID NO: 1891336 - RNA, 17 nt, Homo sapiens
agcagaugccagugaag

SEQ ID NO: 1891337 - RNA, 16 nt, Homo sapiens
cuuucccuacuccaug

SEQ ID NO: 1891338 - RNA, 19 nt, Homo sapiens
uucccuuucuuuucaugcc

SEQ ID NO: 1891339 - RNA, 12 nt, Homo sapiens
uuuccagucuuc

SEQ ID NO: 1891340 - RNA, 17 nt, Homo sapiens
cuugaacaaaaucuguu

SEQ ID NO: 1891341 - RNA, 20 nt, Homo sapiens
uacaggacauguacugagac

SEQ ID NO: 1891342 - RNA, 21 nt, Homo sapiens
uuauauauggggaugguaguu

SEQ ID NO: 1891343 - RNA, 13 nt, Homo sapiens
cuuuccccauuca

SEQ ID NO: 1891344 - RNA, 13 nt, Homo sapiens
cuacuuuacuguu

SEQ ID NO: 1891345 - RNA, 13 nt, Homo sapiens
cucaggggugcug

SEQ ID NO: 1891346 - RNA, 20 nt, Homo sapiens
cauuuggggcuagacaguuc

SEQ ID NO: 1891347 - RNA, 16 nt, Homo sapiens
ugucguauuuggcaca

SEQ ID NO: 1891348 - RNA, 21 nt, Homo sapiens
augagccagcccaagggcauc

SEQ ID NO: 1891349 - RNA, 15 nt, Homo sapiens
gugcccuccaaagag

SEQ ID NO: 1891350 - RNA, 17 nt, Homo sapiens
gcuaggaaugaaauccu

SEQ ID NO: 1891351 - RNA, 21 nt, Homo sapiens
agccuguuacaggaaugaagu

SEQ ID NO: 1891352 - RNA, 19 nt, Homo sapiens
augcuuacauuugaacuug

SEQ ID NO: 1891353 - RNA, 20 nt, Homo sapiens
uuuacagaaaagacucugac

SEQ ID NO: 1891354 - RNA, 19 nt, Homo sapiens
guccuucaaacaauguaaa

SEQ ID NO: 1891355 - RNA, 18 nt, Homo sapiens
gucuggaaagugauguca

SEQ ID NO: 1891356 - RNA, 18 nt, Homo sapiens
guuugagcuuagugaaau

SEQ ID NO: 1891357 - RNA, 16 nt, Homo sapiens
aucgggcccagggaca

SEQ ID NO: 1891358 - RNA, 13 nt, Homo sapiens
ucacaugugcucu

SEQ ID NO: 1891359 - RNA, 15 nt, Homo sapiens
uuaccacuaacuccu

SEQ ID NO: 1891360 - RNA, 14 nt, Homo sapiens
uuccucauuaguaa

SEQ ID NO: 1891361 - RNA, 17 nt, Homo sapiens
caggaaucucaaacucc

SEQ ID NO: 1891362 - RNA, 19 nt, Homo sapiens
aauuuaaaauaaaaggcca

SEQ ID NO: 1891363 - RNA, 14 nt, Homo sapiens
cagguuagaagcaa

SEQ ID NO: 1891364 - RNA, 20 nt, Homo sapiens
accuccgccagauccugcag

SEQ ID NO: 1891365 - RNA, 21 nt, Homo sapiens
cucccugcauggcauccucca

SEQ ID NO: 1891366 - RNA, 14 nt, Homo sapiens
augccagugcucaa

SEQ ID NO: 1891367 - RNA, 21 nt, Homo sapiens
ccuguauugucugacuucuca

SEQ ID NO: 1891368 - RNA, 19 nt, Homo sapiens
caucucuuguuuaaauuca

SEQ ID NO: 1891369 - RNA, 22 nt, Homo sapiens
gucacccaggcuggagugcagu

SEQ ID NO: 1891370 - RNA, 22 nt, Homo sapiens
uuuucaaggaaaaaugcugcuu

SEQ ID NO: 1891371 - RNA, 18 nt, Homo sapiens
acuaucacauacaauuug

SEQ ID NO: 1891372 - RNA, 16 nt, Homo sapiens
augucuuaaugcaaau

SEQ ID NO: 1891373 - RNA, 15 nt, Homo sapiens
aauuaugauagcuua

SEQ ID NO: 1891374 - RNA, 20 nt, Homo sapiens
aaaaugugaggguggugggu

SEQ ID NO: 1891375 - RNA, 20 nt, Homo sapiens
ugugccuccuagagugcagg

SEQ ID NO: 1891376 - RNA, 22 nt, Homo sapiens
guucagaguuguacacugugua

SEQ ID NO: 1891377 - RNA, 14 nt, Homo sapiens
ccagcuggccugua

SEQ ID NO: 1891378 - RNA, 23 nt, Homo sapiens
ggacagaggggacucugggcuau

SEQ ID NO: 1891379 - RNA, 13 nt, Homo sapiens
acccuuccaucag

SEQ ID NO: 1891380 - RNA, 18 nt, Homo sapiens
ccacuuaucugaucagaa

SEQ ID NO: 1891381 - RNA, 13 nt, Homo sapiens
aaaaaagaacaca

SEQ ID NO: 1891382 - RNA, 23 nt, Homo sapiens
cagaauugacaguugaacagagc

SEQ ID NO: 1891383 - RNA, 23 nt, Homo sapiens
ugaacagguucuuuaaaaugcca

SEQ ID NO: 1891384 - RNA, 22 nt, Homo sapiens
uauaguuugggcuucagccuag

SEQ ID NO: 1891385 - RNA, 19 nt, Homo sapiens
auauauuuaaaagugucaa

SEQ ID NO: 1891386 - RNA, 14 nt, Homo sapiens
auugggccaaagaa

SEQ ID NO: 1891387 - RNA, 23 nt, Homo sapiens
gcucugcagcgagccccccaugu

SEQ ID NO: 1891388 - RNA, 23 nt, Homo sapiens
aucuucagcccaggcuuuugcua

SEQ ID NO: 1891389 - RNA, 17 nt, Homo sapiens
caucgagaugaaauuaa

SEQ ID NO: 1891390 - RNA, 13 nt, Homo sapiens
agacucacugugg

SEQ ID NO: 1891391 - RNA, 13 nt, Homo sapiens
ucacucacacugg

SEQ ID NO: 1891392 - RNA, 13 nt, Homo sapiens
uugcaugugcugc

SEQ ID NO: 1891393 - RNA, 19 nt, Homo sapiens
ccaucucuauuaaaauaca

SEQ ID NO: 1891394 - RNA, 15 nt, Homo sapiens
auaggagguggggga

SEQ ID NO: 1891395 - RNA, 14 nt, Homo sapiens
ccuuagacaguccc

SEQ ID NO: 1891396 - RNA, 14 nt, Homo sapiens
uguaauugcauuau

SEQ ID NO: 1891397 - RNA, 16 nt, Homo sapiens
aggacagcccuucuuu

SEQ ID NO: 1891398 - RNA, 22 nt, Homo sapiens
gagaccaaggcccccgggccga

SEQ ID NO: 1891399 - RNA, 21 nt, Homo sapiens
gccccagagaggggacauuuc

SEQ ID NO: 1891400 - RNA, 15 nt, Homo sapiens
cccauccagccagac

SEQ ID NO: 1891401 - RNA, 20 nt, Homo sapiens
cuauuaaagugauuucauuc

SEQ ID NO: 1891402 - RNA, 16 nt, Homo sapiens
uaaguauaaacaguuu

SEQ ID NO: 1891403 - RNA, 13 nt, Homo sapiens
ggaaagcagccau

SEQ ID NO: 1891404 - RNA, 17 nt, Homo sapiens
uugcuaacuugaaaaau

SEQ ID NO: 1891405 - RNA, 23 nt, Homo sapiens
ugugacguuuuuccaguucacau

SEQ ID NO: 1891406 - RNA, 19 nt, Homo sapiens
caaaaaucguuuugcccga

SEQ ID NO: 1891407 - RNA, 21 nt, Homo sapiens
cuggggacguugcugagccag

SEQ ID NO: 1891408 - RNA, 20 nt, Homo sapiens
cuuccauuucuucugcacau

SEQ ID NO: 1891409 - RNA, 13 nt, Homo sapiens
gcuggcuugcagu

SEQ ID NO: 1891410 - RNA, 17 nt, Homo sapiens
gugaugaaaauuugccu

SEQ ID NO: 1891411 - RNA, 22 nt, Homo sapiens
gauaaggacgggaccauuuuua

SEQ ID NO: 1891412 - RNA, 23 nt, Homo sapiens
cagaaagcaucuauucccaaaga

SEQ ID NO: 1891413 - RNA, 16 nt, Homo sapiens
gauugauuaaugaacu

SEQ ID NO: 1891414 - RNA, 17 nt, Homo sapiens
agagguggauccuguag

SEQ ID NO: 1891415 - RNA, 21 nt, Homo sapiens
aaguccagauuuacacuggga

SEQ ID NO: 1891416 - RNA, 17 nt, Homo sapiens
ccacuauuuaaguuauc

SEQ ID NO: 1891417 - RNA, 12 nt, Homo sapiens
acccuaaaaaga

SEQ ID NO: 1891418 - RNA, 12 nt, Homo sapiens
cuuguugcaauu

SEQ ID NO: 1891419 - RNA, 15 nt, Homo sapiens
aaucuguuucuaugu

SEQ ID NO: 1891420 - RNA, 10 nt, Homo sapiens
cuauguguau

SEQ ID NO: 1891421 - RNA, 15 nt, Homo sapiens
uuccgagccauggaa

SEQ ID NO: 1891422 - RNA, 17 nt, Homo sapiens
accccaugcuguugauu

SEQ ID NO: 1891423 - RNA, 14 nt, Homo sapiens
cuauucucuccuca

SEQ ID NO: 1891424 - RNA, 23 nt, Homo sapiens
auuguuucuccucugaagcauuu

SEQ ID NO: 1891425 - RNA, 19 nt, Homo sapiens
uagucuuuuguaauaucaa

SEQ ID NO: 1891426 - RNA, 13 nt, Homo sapiens
gauggcauaccug

SEQ ID NO: 1891427 - RNA, 13 nt, Homo sapiens
gaaaccacaguca

SEQ ID NO: 1891428 - RNA, 12 nt, Homo sapiens
cagaagcaaaaa

SEQ ID NO: 1891429 - RNA, 21 nt, Homo sapiens
aaugguucucauagugguaua

SEQ ID NO: 1891430 - RNA, 16 nt, Homo sapiens
uccagucacacucccc

SEQ ID NO: 1891431 - RNA, 17 nt, Homo sapiens
cuuauagacaacauggc

SEQ ID NO: 1891432 - RNA, 20 nt, Homo sapiens
aggaucagauucuugcugug

SEQ ID NO: 1891433 - RNA, 15 nt, Homo sapiens
auucacagugcaaga

SEQ ID NO: 1891434 - RNA, 16 nt, Homo sapiens
cuguucucacauaaca

SEQ ID NO: 1891435 - RNA, 12 nt, Homo sapiens
ucuaagcugugu

SEQ ID NO: 1891436 - RNA, 22 nt, Homo sapiens
auugcacauaguucugcccaaa

SEQ ID NO: 1891437 - RNA, 15 nt, Homo sapiens
cuuuguuaaaaccaa

SEQ ID NO: 1891438 - RNA, 17 nt, Homo sapiens
gagacaugagaaaggga

SEQ ID NO: 1891439 - RNA, 11 nt, Homo sapiens
ugccugugacu

SEQ ID NO: 1891440 - RNA, 19 nt, Homo sapiens
acauccauugucucuucau

SEQ ID NO: 1891441 - RNA, 22 nt, Homo sapiens
uucuaaaaaaauaaacaaagug

SEQ ID NO: 1891442 - RNA, 13 nt, Homo sapiens
cucuugcugccac

SEQ ID NO: 1891443 - RNA, 13 nt, Homo sapiens
caauuauaacuua

SEQ ID NO: 1891444 - RNA, 20 nt, Homo sapiens
cugaaagaugggcaaaagac

SEQ ID NO: 1891445 - RNA, 18 nt, Homo sapiens
cccagagcaaaauaauuu

SEQ ID NO: 1891446 - RNA, 20 nt, Homo sapiens
uugaguagauauuacuuuau

SEQ ID NO: 1891447 - RNA, 21 nt, Homo sapiens
agcagcugugaccacagcagu

SEQ ID NO: 1891448 - RNA, 16 nt, Homo sapiens
agccgcuucugacugc

SEQ ID NO: 1891449 - RNA, 17 nt, Homo sapiens
uaauggacaaagggaaa

SEQ ID NO: 1891450 - RNA, 18 nt, Homo sapiens
ugcccugugcaugccaug

SEQ ID NO: 1891451 - RNA, 14 nt, Homo sapiens
ggcaucuauuuccu

SEQ ID NO: 1891452 - RNA, 14 nt, Homo sapiens
cucaccggcaugcu

SEQ ID NO: 1891453 - RNA, 19 nt, Homo sapiens
agaagagacccaaccacuu

SEQ ID NO: 1891454 - RNA, 16 nt, Homo sapiens
auaauacuagucuuau

SEQ ID NO: 1891455 - RNA, 22 nt, Homo sapiens
agaaugaucacccugaauucau

SEQ ID NO: 1891456 - RNA, 11 nt, Homo sapiens
cucacacccca

SEQ ID NO: 1891457 - RNA, 14 nt, Homo sapiens
auauuuaaugcauu

SEQ ID NO: 1891458 - RNA, 21 nt, Homo sapiens
aggcaagcaagcucucuugcc

SEQ ID NO: 1891459 - RNA, 15 nt, Homo sapiens
gacccguccauucuu

SEQ ID NO: 1891460 - RNA, 18 nt, Homo sapiens
aggcaucagaaacaucug

SEQ ID NO: 1891461 - RNA, 18 nt, Homo sapiens
ugcuuuugaaaucuguau

SEQ ID NO: 1891462 - RNA, 17 nt, Homo sapiens
cuucuuuuuguucuuca

SEQ ID NO: 1891463 - RNA, 17 nt, Homo sapiens
cgugccuguuugcuuag

SEQ ID NO: 1891464 - RNA, 14 nt, Homo sapiens
aaauacugcacuua

SEQ ID NO: 1891465 - RNA, 17 nt, Homo sapiens
agacugguuuucugcca

SEQ ID NO: 1891466 - RNA, 20 nt, Homo sapiens
cuguaauauuuacaauguau

SEQ ID NO: 1891467 - RNA, 17 nt, Homo sapiens
ugaacuuucacauagca

SEQ ID NO: 1891468 - RNA, 19 nt, Homo sapiens
cuacauuuugcucugugaa

SEQ ID NO: 1891469 - RNA, 16 nt, Homo sapiens
acugaauugacaugac

SEQ ID NO: 1891470 - RNA, 16 nt, Homo sapiens
uccauguccccuccca

SEQ ID NO: 1891471 - RNA, 15 nt, Homo sapiens
gcccccugaccuucc

SEQ ID NO: 1891472 - RNA, 15 nt, Homo sapiens
uugaaagaagucaaa

SEQ ID NO: 1891473 - RNA, 23 nt, Homo sapiens
aagggaaaacaaauauuucacuu

SEQ ID NO: 1891474 - RNA, 22 nt, Homo sapiens
uuuucuggaauggaauuggaca

SEQ ID NO: 1891475 - RNA, 16 nt, Homo sapiens
gaagggaggguggcca

SEQ ID NO: 1891476 - RNA, 17 nt, Homo sapiens
caaagauuugcuuuaau

SEQ ID NO: 1891477 - RNA, 19 nt, Homo sapiens
ugguucacauccuaccccu

SEQ ID NO: 1891478 - RNA, 13 nt, Homo sapiens
cuauuuauauaca

SEQ ID NO: 1891479 - RNA, 13 nt, Homo sapiens
ugcccuccagggc

SEQ ID NO: 1891480 - RNA, 23 nt, Homo sapiens
auauguuguucuuacaaaccaua

SEQ ID NO: 1891481 - RNA, 20 nt, Homo sapiens
uggucguuuucaacagaauu

SEQ ID NO: 1891482 - RNA, 23 nt, Homo sapiens
ucacaaaugaucgcuaucuagca

SEQ ID NO: 1891483 - RNA, 15 nt, Homo sapiens
guuuagauaaaggaa

SEQ ID NO: 1891484 - RNA, 15 nt, Homo sapiens
cccagacacagccca

SEQ ID NO: 1891485 - RNA, 18 nt, Homo sapiens
uccugugggagaucuuca

SEQ ID NO: 1891486 - RNA, 17 nt, Homo sapiens
auggccaauaacuuuuc

SEQ ID NO: 1891487 - RNA, 22 nt, Homo sapiens
cccaguuugauaccugcacugu

SEQ ID NO: 1891488 - RNA, 23 nt, Homo sapiens
cuaguuuuuuugaaauccaaaga

SEQ ID NO: 1891489 - RNA, 12 nt, Homo sapiens
auuccuaucuca

SEQ ID NO: 1891490 - RNA, 21 nt, Homo sapiens
cuggaacguuucacugcaaac

SEQ ID NO: 1891491 - RNA, 14 nt, Homo sapiens
agcuguaucuugau

SEQ ID NO: 1891492 - RNA, 21 nt, Homo sapiens
aggccuugaggacgucuucua

SEQ ID NO: 1891493 - RNA, 19 nt, Homo sapiens
acaguugcacagcaucuca

SEQ ID NO: 1891494 - RNA, 19 nt, Homo sapiens
gcuauuuuuauacagugaa

SEQ ID NO: 1891495 - RNA, 15 nt, Homo sapiens
agggucugcacucua

SEQ ID NO: 1891496 - RNA, 14 nt, Homo sapiens
uaaagacugugauu

SEQ ID NO: 1891497 - RNA, 23 nt, Homo sapiens
uggccuuuaaaaaugcaccacuu

SEQ ID NO: 1891498 - RNA, 20 nt, Homo sapiens
gacccccguggggcagggag

SEQ ID NO: 1891499 - RNA, 21 nt, Homo sapiens
cuaaaaugugggugaagguga

SEQ ID NO: 1891500 - RNA, 20 nt, Homo sapiens
guuauaguaacaucaaagau

SEQ ID NO: 1891501 - RNA, 13 nt, Homo sapiens
ugcucacauauga

SEQ ID NO: 1891502 - RNA, 14 nt, Homo sapiens
gucauuucauuucc

SEQ ID NO: 1891503 - RNA, 23 nt, Homo sapiens
ccauaugugagcacuaucuuuca

SEQ ID NO: 1891504 - RNA, 15 nt, Homo sapiens
cuggggacuccucaa

SEQ ID NO: 1891505 - RNA, 20 nt, Homo sapiens
ccacguucucucugccugug

SEQ ID NO: 1891506 - RNA, 13 nt, Homo sapiens
cacauuaagcacu

SEQ ID NO: 1891507 - RNA, 22 nt, Homo sapiens
uagccugcagaaguaagccuca

SEQ ID NO: 1891508 - RNA, 18 nt, Homo sapiens
ccauauuuauacagcaga

SEQ ID NO: 1891509 - RNA, 15 nt, Homo sapiens
agugugcugcaugga

SEQ ID NO: 1891510 - RNA, 19 nt, Homo sapiens
uuauaacaggaauaagcaa

SEQ ID NO: 1891511 - RNA, 20 nt, Homo sapiens
uuuaaauuuuugaaauucaa

SEQ ID NO: 1891512 - RNA, 20 nt, Homo sapiens
ugcauaaccgcacagacauu

SEQ ID NO: 1891513 - RNA, 19 nt, Homo sapiens
cuugcuuugggcuuugcag

SEQ ID NO: 1891514 - RNA, 22 nt, Homo sapiens
uggcaaggacuuuguacauuug

SEQ ID NO: 1891515 - RNA, 15 nt, Homo sapiens
uauucagguaacuca

SEQ ID NO: 1891516 - RNA, 21 nt, Homo sapiens
ggcagcaaggucauggucuga

SEQ ID NO: 1891517 - RNA, 21 nt, Homo sapiens
uguguacuggacauggucugc

SEQ ID NO: 1891518 - RNA, 12 nt, Homo sapiens
uugaacugguuc

SEQ ID NO: 1891519 - RNA, 18 nt, Homo sapiens
gauaccugugugucucca

SEQ ID NO: 1891520 - RNA, 14 nt, Homo sapiens
cuacauuuagcccc

SEQ ID NO: 1891521 - RNA, 22 nt, Homo sapiens
gauucagaaauuggaacagaau

SEQ ID NO: 1891522 - RNA, 14 nt, Homo sapiens
acaguaugacauau

SEQ ID NO: 1891523 - RNA, 20 nt, Homo sapiens
agguugcuguugugcagugu

SEQ ID NO: 1891524 - RNA, 21 nt, Homo sapiens
ucuccccucacacuuugccau

SEQ ID NO: 1891525 - RNA, 21 nt, Homo sapiens
uggccauuuaacuagcacuuu

SEQ ID NO: 1891526 - RNA, 14 nt, Homo sapiens
gccaggacaccagu

SEQ ID NO: 1891527 - RNA, 15 nt, Homo sapiens
aaaguuucuuaagga

SEQ ID NO: 1891528 - RNA, 19 nt, Homo sapiens
cgauccuuaauaaaugaau

SEQ ID NO: 1891529 - RNA, 15 nt, Homo sapiens
uaauaggcucugccu

SEQ ID NO: 1891530 - RNA, 11 nt, Homo sapiens
cuauccagcua

SEQ ID NO: 1891531 - RNA, 22 nt, Homo sapiens
aaugcacugacauuguuggcca

SEQ ID NO: 1891532 - RNA, 22 nt, Homo sapiens
uggccauugguugccaugguga

SEQ ID NO: 1891533 - RNA, 18 nt, Homo sapiens
cugucuccaugcuggaua

SEQ ID NO: 1891534 - RNA, 23 nt, Homo sapiens
cucacuguugugaagguuguaga

SEQ ID NO: 1891535 - RNA, 18 nt, Homo sapiens
cacauuuuaaauaaagac

SEQ ID NO: 1891536 - RNA, 18 nt, Homo sapiens
uggaacuacaagugugag

SEQ ID NO: 1891537 - RNA, 11 nt, Homo sapiens
gaggccuauaa

SEQ ID NO: 1891538 - RNA, 14 nt, Homo sapiens
guacgcccaggaca

SEQ ID NO: 1891539 - RNA, 20 nt, Homo sapiens
accagagaaaugaaagucag

SEQ ID NO: 1891540 - RNA, 16 nt, Homo sapiens
ccaauauuuguagaag

SEQ ID NO: 1891541 - RNA, 15 nt, Homo sapiens
cagcauggagcuaua

SEQ ID NO: 1891542 - RNA, 16 nt, Homo sapiens
cucuguuuucaugcua

SEQ ID NO: 1891543 - RNA, 24 nt, Homo sapiens
acagagguggcugcugugcuagug

SEQ ID NO: 1891544 - RNA, 19 nt, Homo sapiens
caagcaggcugguuugcaa

SEQ ID NO: 1891545 - RNA, 20 nt, Homo sapiens
gaguccacgaugguggugga

SEQ ID NO: 1891546 - RNA, 17 nt, Homo sapiens
cuuuacuggugauuucu

SEQ ID NO: 1891547 - RNA, 13 nt, Homo sapiens
caugugcuuccac

SEQ ID NO: 1891548 - RNA, 15 nt, Homo sapiens
auugaguuuuuacaa

SEQ ID NO: 1891549 - RNA, 16 nt, Homo sapiens
ugcuauuuaacauuuu

SEQ ID NO: 1891550 - RNA, 22 nt, Homo sapiens
ucacuggcaggaaaguccuugu

SEQ ID NO: 1891551 - RNA, 24 nt, Homo sapiens
aucaugcuucuacuccauggugaa

SEQ ID NO: 1891552 - RNA, 17 nt, Homo sapiens
acaucgucuacaaggag

SEQ ID NO: 1891553 - RNA, 17 nt, Homo sapiens
aacuaguuaaaagccuu

SEQ ID NO: 1891554 - RNA, 16 nt, Homo sapiens
aggugccgacacugag

SEQ ID NO: 1891555 - RNA, 19 nt, Homo sapiens
acaaaggacccaaucccca

SEQ ID NO: 1891556 - RNA, 18 nt, Homo sapiens
gccugggguggacauuca

SEQ ID NO: 1891557 - RNA, 21 nt, Homo sapiens
caccuguauaauguuuuguaa

SEQ ID NO: 1891558 - RNA, 17 nt, Homo sapiens
uaaagaugaucuacuca

SEQ ID NO: 1891559 - RNA, 13 nt, Homo sapiens
cccagaauggagg

SEQ ID NO: 1891560 - RNA, 22 nt, Homo sapiens
uugucaguguagaucaacucau

SEQ ID NO: 1891561 - RNA, 12 nt, Homo sapiens
uaaacagggucu

SEQ ID NO: 1891562 - RNA, 21 nt, Homo sapiens
ggacugagggggccuggaugc

SEQ ID NO: 1891563 - RNA, 23 nt, Homo sapiens
ugaauaaaaauagaaaccugaau

SEQ ID NO: 1891564 - RNA, 16 nt, Homo sapiens
cuauacacaagcaaug

SEQ ID NO: 1891565 - RNA, 11 nt, Homo sapiens
acuuuuugcca

SEQ ID NO: 1891566 - RNA, 18 nt, Homo sapiens
agggugggggugcucucu

SEQ ID NO: 1891567 - RNA, 20 nt, Homo sapiens
uauuucaucaugauaauuca

SEQ ID NO: 1891568 - RNA, 17 nt, Homo sapiens
acugugggaaggccagc

SEQ ID NO: 1891569 - RNA, 16 nt, Homo sapiens
ucugcauguguaaaag

SEQ ID NO: 1891570 - RNA, 19 nt, Homo sapiens
gaccaaaaucagcuuugua

SEQ ID NO: 1891571 - RNA, 23 nt, Homo sapiens
uucugucagcaguaaaacuuaua

SEQ ID NO: 1891572 - RNA, 19 nt, Homo sapiens
augucucuuggaaauguua

SEQ ID NO: 1891573 - RNA, 19 nt, Homo sapiens
guuuuacacucuagugcca

SEQ ID NO: 1891574 - RNA, 15 nt, Homo sapiens
uuuggaaguuuugcu

SEQ ID NO: 1891575 - RNA, 20 nt, Homo sapiens
acuugauagcaaacacuggg

SEQ ID NO: 1891576 - RNA, 16 nt, Homo sapiens
agcugucccacaucac

SEQ ID NO: 1891577 - RNA, 21 nt, Homo sapiens
cuuuucagggcuggcuccuga

SEQ ID NO: 1891578 - RNA, 22 nt, Homo sapiens
accaaaaguuacauguuugcac

SEQ ID NO: 1891579 - RNA, 21 nt, Homo sapiens
gaaacccuaucucuacuaaaa

SEQ ID NO: 1891580 - RNA, 15 nt, Homo sapiens
aaugcauagcauuau

SEQ ID NO: 1891581 - RNA, 12 nt, Homo sapiens
accuccaccucc

SEQ ID NO: 1891582 - RNA, 15 nt, Homo sapiens
gaaucggcuuugcag

SEQ ID NO: 1891583 - RNA, 23 nt, Homo sapiens
aaagguuguacauaguggucauu

SEQ ID NO: 1891584 - RNA, 19 nt, Homo sapiens
uuuaaccccuugguacuga

SEQ ID NO: 1891585 - RNA, 17 nt, Homo sapiens
auguucuccucaaacau

SEQ ID NO: 1891586 - RNA, 19 nt, Homo sapiens
gaacagaagggcuaacuca

SEQ ID NO: 1891587 - RNA, 19 nt, Homo sapiens
aacuccagcguccucagca

SEQ ID NO: 1891588 - RNA, 16 nt, Homo sapiens
aagccacuuuccucuu

SEQ ID NO: 1891589 - RNA, 18 nt, Homo sapiens
uauaguucauagcaauua

SEQ ID NO: 1891590 - RNA, 16 nt, Homo sapiens
ugacuacucaguccag

SEQ ID NO: 1891591 - RNA, 22 nt, Homo sapiens
auucaauuuacagguaccagua

SEQ ID NO: 1891592 - RNA, 22 nt, Homo sapiens
uucucugcuccagguucacuuu

SEQ ID NO: 1891593 - RNA, 16 nt, Homo sapiens
cuagaaagacagaagc

SEQ ID NO: 1891594 - RNA, 19 nt, Homo sapiens
ccauaaacaccagauucca

SEQ ID NO: 1891595 - RNA, 22 nt, Homo sapiens
caaggcgguggacuugaacuuu

SEQ ID NO: 1891596 - RNA, 14 nt, Homo sapiens
uccauucuucgaca

SEQ ID NO: 1891597 - RNA, 23 nt, Homo sapiens
accacuacaugcagcccaugccc

SEQ ID NO: 1891598 - RNA, 20 nt, Homo sapiens
ucaguggcuuggacucuuuc

SEQ ID NO: 1891599 - RNA, 18 nt, Homo sapiens
acagaggcugacuucaga

SEQ ID NO: 1891600 - RNA, 20 nt, Homo sapiens
gggauuuucauuagggcaaa

SEQ ID NO: 1891601 - RNA, 17 nt, Homo sapiens
acacggcggggucugua

SEQ ID NO: 1891602 - RNA, 17 nt, Homo sapiens
uaaccauucuacugugu

SEQ ID NO: 1891603 - RNA, 21 nt, Homo sapiens
ucaggugguguccuucuuccu

SEQ ID NO: 1891604 - RNA, 21 nt, Homo sapiens
uauuuauaugaagcaagcugu

SEQ ID NO: 1891605 - RNA, 14 nt, Homo sapiens
ucuauucauuugau

SEQ ID NO: 1891606 - RNA, 11 nt, Homo sapiens
aucaacaugca

SEQ ID NO: 1891607 - RNA, 17 nt, Homo sapiens
acauucccugcauccaa

SEQ ID NO: 1891608 - RNA, 16 nt, Homo sapiens
cucaacacaugagaag

SEQ ID NO: 1891609 - RNA, 13 nt, Homo sapiens
augauacuuccaa

SEQ ID NO: 1891610 - RNA, 17 nt, Homo sapiens
uccuguguuccugugau

SEQ ID NO: 1891611 - RNA, 17 nt, Homo sapiens
uucuaaguuucuaagau

SEQ ID NO: 1891612 - RNA, 17 nt, Homo sapiens
ucaugugugcaugugag

SEQ ID NO: 1891613 - RNA, 21 nt, Homo sapiens
aauuuguucacauuacaugaa

SEQ ID NO: 1891614 - RNA, 14 nt, Homo sapiens
ggcaggaagucccu

SEQ ID NO: 1891615 - RNA, 18 nt, Homo sapiens
gcccaucagccauuugcc

SEQ ID NO: 1891616 - RNA, 18 nt, Homo sapiens
gccuccuccuuuucugaa

SEQ ID NO: 1891617 - RNA, 17 nt, Homo sapiens
acacuucugacuucacu

SEQ ID NO: 1891618 - RNA, 19 nt, Homo sapiens
ugccagggcccgaccuggg

SEQ ID NO: 1891619 - RNA, 13 nt, Homo sapiens
ucaucacuaaaag

SEQ ID NO: 1891620 - RNA, 15 nt, Homo sapiens
cuugucaaucccaac

SEQ ID NO: 1891621 - RNA, 20 nt, Homo sapiens
cagcagugccuugugcaaug

SEQ ID NO: 1891622 - RNA, 21 nt, Homo sapiens
cucauaugugaaauggccaaa

SEQ ID NO: 1891623 - RNA, 18 nt, Homo sapiens
cauuauuaaucauuccau

SEQ ID NO: 1891624 - RNA, 10 nt, Homo sapiens
guuguggaaa

SEQ ID NO: 1891625 - RNA, 13 nt, Homo sapiens
auuauauuugaca

SEQ ID NO: 1891626 - RNA, 15 nt, Homo sapiens
cauauuguagcucaa

SEQ ID NO: 1891627 - RNA, 23 nt, Homo sapiens
uuaaagacuaggauauugaaugu

SEQ ID NO: 1891628 - RNA, 21 nt, Homo sapiens
agggggccuuuaaagacuuaa

SEQ ID NO: 1891629 - RNA, 20 nt, Homo sapiens
gagaagcauauagaggcaag

SEQ ID NO: 1891630 - RNA, 22 nt, Homo sapiens
agugccccagacugagcucucc

SEQ ID NO: 1891631 - RNA, 22 nt, Homo sapiens
ggcaauauaaggggaugaggaa

SEQ ID NO: 1891632 - RNA, 15 nt, Homo sapiens
agugagugaucacug

SEQ ID NO: 1891633 - RNA, 21 nt, Homo sapiens
uuacaggugugagccaccacg

SEQ ID NO: 1891634 - RNA, 19 nt, Homo sapiens
uugaaaauauuucuaugua

SEQ ID NO: 1891635 - RNA, 22 nt, Homo sapiens
uaaacucaucugaaauguuaca

SEQ ID NO: 1891636 - RNA, 17 nt, Homo sapiens
gacuuuuuuuaaaaaga

SEQ ID NO: 1891637 - RNA, 16 nt, Homo sapiens
cucagaucacuacugc

SEQ ID NO: 1891638 - RNA, 17 nt, Homo sapiens
acaggaaggaaagcgca

SEQ ID NO: 1891639 - RNA, 22 nt, Homo sapiens
guggcugccagggggcaaggag

SEQ ID NO: 1891640 - RNA, 22 nt, Homo sapiens
cugggcauauccaccaccuccc

SEQ ID NO: 1891641 - RNA, 19 nt, Homo sapiens
uugccccacucaucugccg

SEQ ID NO: 1891642 - RNA, 14 nt, Homo sapiens
gugacucuuuccaa

SEQ ID NO: 1891643 - RNA, 22 nt, Homo sapiens
caugcucaggcuacuauagguc

SEQ ID NO: 1891644 - RNA, 17 nt, Homo sapiens
cacaaaaugcucaagga

SEQ ID NO: 1891645 - RNA, 13 nt, Homo sapiens
ugucuucaccuga

SEQ ID NO: 1891646 - RNA, 17 nt, Homo sapiens
cagaagaccucccuuca

SEQ ID NO: 1891647 - RNA, 15 nt, Homo sapiens
ugccuuguuguauuc

SEQ ID NO: 1891648 - RNA, 22 nt, Homo sapiens
cagcaggaauaaagacuugugc

SEQ ID NO: 1891649 - RNA, 20 nt, Homo sapiens
aaauuuauuuauauuucaag

SEQ ID NO: 1891650 - RNA, 14 nt, Homo sapiens
gccugucuccuuug

SEQ ID NO: 1891651 - RNA, 22 nt, Homo sapiens
aaauguaugucugguuccccag

SEQ ID NO: 1891652 - RNA, 20 nt, Homo sapiens
gcagaaauuuuaagccaaaa

SEQ ID NO: 1891653 - RNA, 19 nt, Homo sapiens
ucaacucguuuuuauauua

SEQ ID NO: 1891654 - RNA, 23 nt, Homo sapiens
cucacugcugcaaauacuguaua

SEQ ID NO: 1891655 - RNA, 21 nt, Homo sapiens
acugcaaggaaaaaugaugac

SEQ ID NO: 1891656 - RNA, 15 nt, Homo sapiens
agacccaaaccauac

SEQ ID NO: 1891657 - RNA, 16 nt, Homo sapiens
gcauguauaguuagaa

SEQ ID NO: 1891658 - RNA, 21 nt, Homo sapiens
gccguuccuuaugacuuuuca

SEQ ID NO: 1891659 - RNA, 21 nt, Homo sapiens
aauauagcguucccaacaaca

SEQ ID NO: 1891660 - RNA, 14 nt, Homo sapiens
uugccacacacugu

SEQ ID NO: 1891661 - RNA, 15 nt, Homo sapiens
acuguuuauguuaca

SEQ ID NO: 1891662 - RNA, 22 nt, Homo sapiens
acagcaguccuucagaauuaaa

SEQ ID NO: 1891663 - RNA, 17 nt, Homo sapiens
uccugggccuccugaca

SEQ ID NO: 1891664 - RNA, 14 nt, Homo sapiens
ccgaccccaucuca

SEQ ID NO: 1891665 - RNA, 13 nt, Homo sapiens
agagcagcuggau

SEQ ID NO: 1891666 - RNA, 19 nt, Homo sapiens
aaccuguuccugacuguuc

SEQ ID NO: 1891667 - RNA, 15 nt, Homo sapiens
aaaaccaaacccaga

SEQ ID NO: 1891668 - RNA, 17 nt, Homo sapiens
ugaaaaguuacuaccug

SEQ ID NO: 1891669 - RNA, 18 nt, Homo sapiens
ucccucugccuucaggcu

SEQ ID NO: 1891670 - RNA, 22 nt, Homo sapiens
cuugcuguuaaaaauaauuaca

SEQ ID NO: 1891671 - RNA, 16 nt, Homo sapiens
ccguggagcaugcaac

SEQ ID NO: 1891672 - RNA, 17 nt, Homo sapiens
ccugcaucuaagcccau

SEQ ID NO: 1891673 - RNA, 13 nt, Homo sapiens
ugcacggggccag

SEQ ID NO: 1891674 - RNA, 21 nt, Homo sapiens
augacacucuagucaaagccu

SEQ ID NO: 1891675 - RNA, 14 nt, Homo sapiens
cuggggaaggggag

SEQ ID NO: 1891676 - RNA, 21 nt, Homo sapiens
ucuaguaagaugcacugaaaa

SEQ ID NO: 1891677 - RNA, 14 nt, Homo sapiens
uccuuuuguuuucc

SEQ ID NO: 1891678 - RNA, 17 nt, Homo sapiens
ugguaagaugacucuga

SEQ ID NO: 1891679 - RNA, 23 nt, Homo sapiens
agagaacuggaaagacauagcca

SEQ ID NO: 1891680 - RNA, 18 nt, Homo sapiens
ugcaguuccugaguaccu

SEQ ID NO: 1891681 - RNA, 20 nt, Homo sapiens
uaacuucauuuuucuaauaa

SEQ ID NO: 1891682 - RNA, 20 nt, Homo sapiens
ccacgggaaaggagcugcuu

SEQ ID NO: 1891683 - RNA, 13 nt, Homo sapiens
ccugcuccuccca

SEQ ID NO: 1891684 - RNA, 20 nt, Homo sapiens
caauucuaacuuuuuugcua

SEQ ID NO: 1891685 - RNA, 18 nt, Homo sapiens
agcagcacgccaacccca

SEQ ID NO: 1891686 - RNA, 14 nt, Homo sapiens
ucaagaaucacuug

SEQ ID NO: 1891687 - RNA, 20 nt, Homo sapiens
uuacaucaugaguggacuuu

SEQ ID NO: 1891688 - RNA, 21 nt, Homo sapiens
gguagaaucuuguuaauuuca

SEQ ID NO: 1891689 - RNA, 16 nt, Homo sapiens
auauuuuuacugcuuu

SEQ ID NO: 1891690 - RNA, 16 nt, Homo sapiens
ugguuuaaaugauaca

SEQ ID NO: 1891691 - RNA, 16 nt, Homo sapiens
cagucucccuucuccc

SEQ ID NO: 1891692 - RNA, 12 nt, Homo sapiens
ugacaagcacua

SEQ ID NO: 1891693 - RNA, 20 nt, Homo sapiens
cauagaacugucccacaaaa

SEQ ID NO: 1891694 - RNA, 21 nt, Homo sapiens
cugaguaucacaucacacaaa

SEQ ID NO: 1891695 - RNA, 17 nt, Homo sapiens
uugauaagcacauuaaa

SEQ ID NO: 1891696 - RNA, 12 nt, Homo sapiens
cugcugcucacu

SEQ ID NO: 1891697 - RNA, 20 nt, Homo sapiens
gugacgguuccuacacagga

SEQ ID NO: 1891698 - RNA, 14 nt, Homo sapiens
ucuuuuuugccaaa

SEQ ID NO: 1891699 - RNA, 18 nt, Homo sapiens
gaaacuuuaauccaaaga

SEQ ID NO: 1891700 - RNA, 16 nt, Homo sapiens
uggcauggagaaugca

SEQ ID NO: 1891701 - RNA, 22 nt, Homo sapiens
accccacaauuucuuuaaaaaa

SEQ ID NO: 1891702 - RNA, 20 nt, Homo sapiens
agaagugcagcugcugugcc

SEQ ID NO: 1891703 - RNA, 22 nt, Homo sapiens
ggggcaggacaacacagcugcu

SEQ ID NO: 1891704 - RNA, 16 nt, Homo sapiens
ugcgcugugccaaagc

SEQ ID NO: 1891705 - RNA, 15 nt, Homo sapiens
agcucagcccacccc

SEQ ID NO: 1891706 - RNA, 20 nt, Homo sapiens
augccagaaugacuucugac

SEQ ID NO: 1891707 - RNA, 19 nt, Homo sapiens
gcaaggagaccaccaacag

SEQ ID NO: 1891708 - RNA, 14 nt, Homo sapiens
uaccacuuguauua

SEQ ID NO: 1891709 - RNA, 17 nt, Homo sapiens
acuuaacauugauuuau

SEQ ID NO: 1891710 - RNA, 13 nt, Homo sapiens
cuggucugugcau

SEQ ID NO: 1891711 - RNA, 17 nt, Homo sapiens
aacccccgccaccucag

SEQ ID NO: 1891712 - RNA, 17 nt, Homo sapiens
agcugcagaucuuugcu

SEQ ID NO: 1891713 - RNA, 14 nt, Homo sapiens
cuagaguaugugua

SEQ ID NO: 1891714 - RNA, 17 nt, Homo sapiens
uugcuguagaaacacau

SEQ ID NO: 1891715 - RNA, 23 nt, Homo sapiens
agcuauaucgaauauaguucugu

SEQ ID NO: 1891716 - RNA, 22 nt, Homo sapiens
accauaccgggucuugauucag

SEQ ID NO: 1891717 - RNA, 17 nt, Homo sapiens
gaaaaacccaaacugag

SEQ ID NO: 1891718 - RNA, 17 nt, Homo sapiens
aagaaacccagacugaa

SEQ ID NO: 1891719 - RNA, 20 nt, Homo sapiens
aauagaaauaaauuccuaaa

SEQ ID NO: 1891720 - RNA, 12 nt, Homo sapiens
cauuuuccaaaa

SEQ ID NO: 1891721 - RNA, 21 nt, Homo sapiens
aagacacguguuuuuguaucu

SEQ ID NO: 1891722 - RNA, 13 nt, Homo sapiens
acugguucucaau

SEQ ID NO: 1891723 - RNA, 23 nt, Homo sapiens
gagacaagaaauccuaguggccu

SEQ ID NO: 1891724 - RNA, 12 nt, Homo sapiens
aaguguguaugu

SEQ ID NO: 1891725 - RNA, 22 nt, Homo sapiens
auguucuaaauaaaaagcauua

SEQ ID NO: 1891726 - RNA, 19 nt, Homo sapiens
aacaaagggcacagcaucu

SEQ ID NO: 1891727 - RNA, 19 nt, Homo sapiens
uaagauauucagaaguaua

SEQ ID NO: 1891728 - RNA, 15 nt, Homo sapiens
ugaacacacauggau

SEQ ID NO: 1891729 - RNA, 16 nt, Homo sapiens
ccugcucccuagccag

SEQ ID NO: 1891730 - RNA, 11 nt, Homo sapiens
gcaugcacauc

SEQ ID NO: 1891731 - RNA, 12 nt, Homo sapiens
cuaaaggugcua

SEQ ID NO: 1891732 - RNA, 13 nt, Homo sapiens
augaugugucuuc

SEQ ID NO: 1891733 - RNA, 15 nt, Homo sapiens
cuauuuaacuugagg

SEQ ID NO: 1891734 - RNA, 21 nt, Homo sapiens
uuacucagaggagcugcaaau

SEQ ID NO: 1891735 - RNA, 21 nt, Homo sapiens
auguucccuuuuaaaucugcu

SEQ ID NO: 1891736 - RNA, 16 nt, Homo sapiens
ccagcugcagaagggu

SEQ ID NO: 1891737 - RNA, 22 nt, Homo sapiens
aggaacccuuuuccuccagaca

SEQ ID NO: 1891738 - RNA, 23 nt, Homo sapiens
uuuggaaauguggucaucaaaga

SEQ ID NO: 1891739 - RNA, 14 nt, Homo sapiens
cugagccucagucu

SEQ ID NO: 1891740 - RNA, 15 nt, Homo sapiens
uucuauuaagauaua

SEQ ID NO: 1891741 - RNA, 20 nt, Homo sapiens
acccaugcccugccaagccu

SEQ ID NO: 1891742 - RNA, 19 nt, Homo sapiens
aguuucaaccaugaagucu

SEQ ID NO: 1891743 - RNA, 19 nt, Homo sapiens
uauucuguagccaacuuaa

SEQ ID NO: 1891744 - RNA, 13 nt, Homo sapiens
uucagccaccagc

SEQ ID NO: 1891745 - RNA, 16 nt, Homo sapiens
acaaauagucuaucaa

SEQ ID NO: 1891746 - RNA, 14 nt, Homo sapiens
aaaacuuuuucaca

SEQ ID NO: 1891747 - RNA, 19 nt, Homo sapiens
ugacaccgucgaccaggaa

SEQ ID NO: 1891748 - RNA, 16 nt, Homo sapiens
cauuguggacuuugaa

SEQ ID NO: 1891749 - RNA, 18 nt, Homo sapiens
uuugcaauaaaaaugaua

SEQ ID NO: 1891750 - RNA, 17 nt, Homo sapiens
aaauuguguccacauaa

SEQ ID NO: 1891751 - RNA, 19 nt, Homo sapiens
acauuaaaauaaaccaaau

SEQ ID NO: 1891752 - RNA, 19 nt, Homo sapiens
gacaaaauauuuuccugcc

SEQ ID NO: 1891753 - RNA, 20 nt, Homo sapiens
ggcccagcgcggacaucccc

SEQ ID NO: 1891754 - RNA, 13 nt, Homo sapiens
gacugacauuuag

SEQ ID NO: 1891755 - RNA, 17 nt, Homo sapiens
ucuaccaggcaaauuca

SEQ ID NO: 1891756 - RNA, 22 nt, Homo sapiens
acaauguuaucaaccaacugca

SEQ ID NO: 1891757 - RNA, 22 nt, Homo sapiens
caacuacuacuggugaugccua

SEQ ID NO: 1891758 - RNA, 20 nt, Homo sapiens
gagucccucacguuucuucc

SEQ ID NO: 1891759 - RNA, 16 nt, Homo sapiens
cuuuaucgcccugaga

SEQ ID NO: 1891760 - RNA, 14 nt, Homo sapiens
ucauauacugccuu

SEQ ID NO: 1891761 - RNA, 13 nt, Homo sapiens
augggacugagcc

SEQ ID NO: 1891762 - RNA, 20 nt, Homo sapiens
cacucaguuguuccuacuca

SEQ ID NO: 1891763 - RNA, 15 nt, Homo sapiens
gagagcagaggucuc

SEQ ID NO: 1891764 - RNA, 15 nt, Homo sapiens
aaaaguuacauugug

SEQ ID NO: 1891765 - RNA, 22 nt, Homo sapiens
caccagccaccccaaagcccuc

SEQ ID NO: 1891766 - RNA, 23 nt, Homo sapiens
auuccuagaaauugaacaaaaau

SEQ ID NO: 1891767 - RNA, 22 nt, Homo sapiens
aagccauaguggagagaacuga

SEQ ID NO: 1891768 - RNA, 17 nt, Homo sapiens
ugccuauugcuagagcu

SEQ ID NO: 1891769 - RNA, 21 nt, Homo sapiens
uaacccucacaagcaugaagu

SEQ ID NO: 1891770 - RNA, 16 nt, Homo sapiens
agaaauuuauaaacuu

SEQ ID NO: 1891771 - RNA, 12 nt, Homo sapiens
cagaagaccucc

SEQ ID NO: 1891772 - RNA, 14 nt, Homo sapiens
cauauuuauagaau

SEQ ID NO: 1891773 - RNA, 16 nt, Homo sapiens
ugucuauguauguuau

SEQ ID NO: 1891774 - RNA, 22 nt, Homo sapiens
gucauauucgauguacuuuaag

SEQ ID NO: 1891775 - RNA, 13 nt, Homo sapiens
uuaacucugcaua

SEQ ID NO: 1891776 - RNA, 11 nt, Homo sapiens
cuaagccuuuc

SEQ ID NO: 1891777 - RNA, 19 nt, Homo sapiens
uaaaagcaccacuguucug

SEQ ID NO: 1891778 - RNA, 13 nt, Homo sapiens
uuccacuguaauu

SEQ ID NO: 1891779 - RNA, 11 nt, Homo sapiens
ucucuaguucc

SEQ ID NO: 1891780 - RNA, 14 nt, Homo sapiens
gaaaggacuaacau

SEQ ID NO: 1891781 - RNA, 14 nt, Homo sapiens
ugaaagugcugcuc

SEQ ID NO: 1891782 - RNA, 22 nt, Homo sapiens
cggugcucuggaagaccugaaa

SEQ ID NO: 1891783 - RNA, 22 nt, Homo sapiens
uaaaaccuuacuuaaagcuugu

SEQ ID NO: 1891784 - RNA, 13 nt, Homo sapiens
auacgagagacuu

SEQ ID NO: 1891785 - RNA, 13 nt, Homo sapiens
auuuaagauaugu

SEQ ID NO: 1891786 - RNA, 16 nt, Homo sapiens
ccagauucugugccaa

SEQ ID NO: 1891787 - RNA, 19 nt, Homo sapiens
agguggcacuagggaucaa

SEQ ID NO: 1891788 - RNA, 20 nt, Homo sapiens
cuuaggacuuuccacuccug

SEQ ID NO: 1891789 - RNA, 15 nt, Homo sapiens
auggugugugugucc

SEQ ID NO: 1891790 - RNA, 14 nt, Homo sapiens
gcaggaugugccug

SEQ ID NO: 1891791 - RNA, 15 nt, Homo sapiens
acacacagucacauu

SEQ ID NO: 1891792 - RNA, 15 nt, Homo sapiens
aauuccuguauucua

SEQ ID NO: 1891793 - RNA, 19 nt, Homo sapiens
ucuuacguggagagugcac

SEQ ID NO: 1891794 - RNA, 15 nt, Homo sapiens
uguuagaucagggga

SEQ ID NO: 1891795 - RNA, 19 nt, Homo sapiens
cugucauccucaugcugcu

SEQ ID NO: 1891796 - RNA, 15 nt, Homo sapiens
uauucagcacuaaaa

SEQ ID NO: 1891797 - RNA, 14 nt, Homo sapiens
guaaccaugcaaaa

SEQ ID NO: 1891798 - RNA, 13 nt, Homo sapiens
uggucccaagaca

SEQ ID NO: 1891799 - RNA, 20 nt, Homo sapiens
ugacgacagugcauuugccu

SEQ ID NO: 1891800 - RNA, 13 nt, Homo sapiens
uuauacacaaaga

SEQ ID NO: 1891801 - RNA, 20 nt, Homo sapiens
auauugcuuggacuaccuau

SEQ ID NO: 1891802 - RNA, 18 nt, Homo sapiens
uaaacacuuguagagcag

SEQ ID NO: 1891803 - RNA, 12 nt, Homo sapiens
aaagcuucucuc

SEQ ID NO: 1891804 - RNA, 14 nt, Homo sapiens
cucuuccaggaagc

SEQ ID NO: 1891805 - RNA, 12 nt, Homo sapiens
cagaucaugccg

SEQ ID NO: 1891806 - RNA, 23 nt, Homo sapiens
ucuuguaaccugggaaagccaug

SEQ ID NO: 1891807 - RNA, 16 nt, Homo sapiens
caucuuagugccuuua

SEQ ID NO: 1891808 - RNA, 18 nt, Homo sapiens
uaauaugguguacauucu

SEQ ID NO: 1891809 - RNA, 15 nt, Homo sapiens
uuacucuggugcugu

SEQ ID NO: 1891810 - RNA, 13 nt, Homo sapiens
cagccucuugccc

SEQ ID NO: 1891811 - RNA, 20 nt, Homo sapiens
uaaauuguuuuuacugauga

SEQ ID NO: 1891812 - RNA, 13 nt, Homo sapiens
guucuaccccuaa

SEQ ID NO: 1891813 - RNA, 13 nt, Homo sapiens
cacacauauguau

SEQ ID NO: 1891814 - RNA, 17 nt, Homo sapiens
auuuguuuggucacugc

SEQ ID NO: 1891815 - RNA, 19 nt, Homo sapiens
gggcaaauguuuacauuuu

SEQ ID NO: 1891816 - RNA, 12 nt, Homo sapiens
agcacauaaucc

SEQ ID NO: 1891817 - RNA, 21 nt, Homo sapiens
accacaggcccuuuccucagg

SEQ ID NO: 1891818 - RNA, 17 nt, Homo sapiens
acugaguggcuugugau

SEQ ID NO: 1891819 - RNA, 12 nt, Homo sapiens
gacacacacugg

SEQ ID NO: 1891820 - RNA, 19 nt, Homo sapiens
cuuuuuaucgccauuccag

SEQ ID NO: 1891821 - RNA, 11 nt, Homo sapiens
uccuacugugu

SEQ ID NO: 1891822 - RNA, 12 nt, Homo sapiens
auagcacugggc

SEQ ID NO: 1891823 - RNA, 17 nt, Homo sapiens
ccuaacuuauggacugu

SEQ ID NO: 1891824 - RNA, 18 nt, Homo sapiens
acggcuuguaaaugugac

SEQ ID NO: 1891825 - RNA, 17 nt, Homo sapiens
cagccuccuccugacca

SEQ ID NO: 1891826 - RNA, 20 nt, Homo sapiens
aaaaugagaaucugugcagu

SEQ ID NO: 1891827 - RNA, 22 nt, Homo sapiens
uuuaugaaaacugaagcaucaa

SEQ ID NO: 1891828 - RNA, 17 nt, Homo sapiens
cuagugcugcugaagau

SEQ ID NO: 1891829 - RNA, 20 nt, Homo sapiens
gccaaggucaugccacugca

SEQ ID NO: 1891830 - RNA, 15 nt, Homo sapiens
uuccccucucugccc

SEQ ID NO: 1891831 - RNA, 16 nt, Homo sapiens
cagaagagaauuagaa

SEQ ID NO: 1891832 - RNA, 23 nt, Homo sapiens
cccugccgucaccaccaccccua

SEQ ID NO: 1891833 - RNA, 14 nt, Homo sapiens
uuuaauaccagaua

SEQ ID NO: 1891834 - RNA, 15 nt, Homo sapiens
cccccacucagugcc

SEQ ID NO: 1891835 - RNA, 22 nt, Homo sapiens
aauaacacuguauuuuaaugua

SEQ ID NO: 1891836 - RNA, 22 nt, Homo sapiens
ccgaaagucugaaucucccaag

SEQ ID NO: 1891837 - RNA, 21 nt, Homo sapiens
gaaaauuguauaaauuacuuu

SEQ ID NO: 1891838 - RNA, 17 nt, Homo sapiens
gagcuggaccugccugc

SEQ ID NO: 1891839 - RNA, 20 nt, Homo sapiens
ugugugcuucugcucauuac

SEQ ID NO: 1891840 - RNA, 19 nt, Homo sapiens
aguacagacgucucaagac

SEQ ID NO: 1891841 - RNA, 21 nt, Homo sapiens
aagcccacauauaaauguacu

SEQ ID NO: 1891842 - RNA, 21 nt, Homo sapiens
caccgcaggggacugucucag

SEQ ID NO: 1891843 - RNA, 20 nt, Homo sapiens
cugugaaauucacaguaaua

SEQ ID NO: 1891844 - RNA, 22 nt, Homo sapiens
accucagcaauauaggaggcaa

SEQ ID NO: 1891845 - RNA, 23 nt, Homo sapiens
cucagggcagccucccccggcuc

SEQ ID NO: 1891846 - RNA, 12 nt, Homo sapiens
gccuuccagguc

SEQ ID NO: 1891847 - RNA, 12 nt, Homo sapiens
ugccuccaucuu

SEQ ID NO: 1891848 - RNA, 22 nt, Homo sapiens
gcugucucucuuguugauuucc

SEQ ID NO: 1891849 - RNA, 15 nt, Homo sapiens
aaucuuacuuuguau

SEQ ID NO: 1891850 - RNA, 16 nt, Homo sapiens
ugucacaaauugauca

SEQ ID NO: 1891851 - RNA, 21 nt, Homo sapiens
acccuccacucagcuguccug

SEQ ID NO: 1891852 - RNA, 22 nt, Homo sapiens
acggagucuugcucuguagccc

SEQ ID NO: 1891853 - RNA, 20 nt, Homo sapiens
uuacuaaauuuucuaauuaa

SEQ ID NO: 1891854 - RNA, 19 nt, Homo sapiens
acacaaccuacucugcaaa

SEQ ID NO: 1891855 - RNA, 18 nt, Homo sapiens
cagcggcccugucaucca

SEQ ID NO: 1891856 - RNA, 22 nt, Homo sapiens
uauuuccuuaaauguuuugcca

SEQ ID NO: 1891857 - RNA, 14 nt, Homo sapiens
ucagacuuaccagg

SEQ ID NO: 1891858 - RNA, 20 nt, Homo sapiens
aaaauuggguguguauacuu

SEQ ID NO: 1891859 - RNA, 16 nt, Homo sapiens
aaagaauugugacaua

SEQ ID NO: 1891860 - RNA, 20 nt, Homo sapiens
ugauaaucuuucuccacugu

SEQ ID NO: 1891861 - RNA, 10 nt, Homo sapiens
uuugggacca

SEQ ID NO: 1891862 - RNA, 19 nt, Homo sapiens
cccugaaggaaccaaagcg

SEQ ID NO: 1891863 - RNA, 19 nt, Homo sapiens
ggggacgcccccaccagcu

SEQ ID NO: 1891864 - RNA, 14 nt, Homo sapiens
cuguagguugcaca

SEQ ID NO: 1891865 - RNA, 14 nt, Homo sapiens
agauuuaacacuaa

SEQ ID NO: 1891866 - RNA, 22 nt, Homo sapiens
ugaaaauggcugaagaaacaca

SEQ ID NO: 1891867 - RNA, 15 nt, Homo sapiens
uauuuucaagcaaau

SEQ ID NO: 1891868 - RNA, 21 nt, Homo sapiens
uaaucucacagcauuugccaa

SEQ ID NO: 1891869 - RNA, 19 nt, Homo sapiens
cuuuuagaugaucuaagaa

SEQ ID NO: 1891870 - RNA, 14 nt, Homo sapiens
ucuuccugacacuu

SEQ ID NO: 1891871 - RNA, 14 nt, Homo sapiens
aguuucugugaccu

SEQ ID NO: 1891872 - RNA, 20 nt, Homo sapiens
cuaaaaagcauuuugaaaca

SEQ ID NO: 1891873 - RNA, 15 nt, Homo sapiens
uccucagaacaugag

SEQ ID NO: 1891874 - RNA, 23 nt, Homo sapiens
aaggaguuaaauguauucuuggc

SEQ ID NO: 1891875 - RNA, 14 nt, Homo sapiens
ugcuccauuuacaa

SEQ ID NO: 1891876 - RNA, 13 nt, Homo sapiens
uguaacauacuca

SEQ ID NO: 1891877 - RNA, 14 nt, Homo sapiens
cagaucauccugcu

SEQ ID NO: 1891878 - RNA, 14 nt, Homo sapiens
gcccagggacaccc

SEQ ID NO: 1891879 - RNA, 19 nt, Homo sapiens
uugaauuucuggaagauuc

SEQ ID NO: 1891880 - RNA, 14 nt, Homo sapiens
aaugagaaagccug

SEQ ID NO: 1891881 - RNA, 18 nt, Homo sapiens
uaaaaucagugauuugga

SEQ ID NO: 1891882 - RNA, 18 nt, Homo sapiens
cauuuauuuugacuguga

SEQ ID NO: 1891883 - RNA, 14 nt, Homo sapiens
aaaaagguccugua

SEQ ID NO: 1891884 - RNA, 16 nt, Homo sapiens
uggcaucugacacuga

SEQ ID NO: 1891885 - RNA, 24 nt, Homo sapiens
uguugacaaaggaaacacauacuc

SEQ ID NO: 1891886 - RNA, 20 nt, Homo sapiens
gcucguaugaauucauucuu

SEQ ID NO: 1891887 - RNA, 16 nt, Homo sapiens
uauuaucaguggcugc

SEQ ID NO: 1891888 - RNA, 17 nt, Homo sapiens
gucccugaagucuugca

SEQ ID NO: 1891889 - RNA, 17 nt, Homo sapiens
aauucguucucugccac

SEQ ID NO: 1891890 - RNA, 14 nt, Homo sapiens
caguuuacaucuug

SEQ ID NO: 1891891 - RNA, 20 nt, Homo sapiens
aguugaagcugacucaaaaa

SEQ ID NO: 1891892 - RNA, 19 nt, Homo sapiens
cucucaccuaaaaaaagag

SEQ ID NO: 1891893 - RNA, 12 nt, Homo sapiens
guuacugucauu

SEQ ID NO: 1891894 - RNA, 12 nt, Homo sapiens
gacacugucucu

SEQ ID NO: 1891895 - RNA, 22 nt, Homo sapiens
ugagguuugaaucugacuuuag

SEQ ID NO: 1891896 - RNA, 16 nt, Homo sapiens
aguaguguacauuacc

SEQ ID NO: 1891897 - RNA, 15 nt, Homo sapiens
caugcgagugcucau

SEQ ID NO: 1891898 - RNA, 18 nt, Homo sapiens
auggucacaagcacaaag

SEQ ID NO: 1891899 - RNA, 13 nt, Homo sapiens
uucauaagccauu

SEQ ID NO: 1891900 - RNA, 17 nt, Homo sapiens
uuccagcagaugccaca

SEQ ID NO: 1891901 - RNA, 12 nt, Homo sapiens
cagauaugugcc

SEQ ID NO: 1891902 - RNA, 15 nt, Homo sapiens
gugcugcagguguaa

SEQ ID NO: 1891903 - RNA, 21 nt, Homo sapiens
aauuaucugccuuauacauua

SEQ ID NO: 1891904 - RNA, 22 nt, Homo sapiens
caccucuaaucuggauguuaag

SEQ ID NO: 1891905 - RNA, 12 nt, Homo sapiens
gaccucagagau

SEQ ID NO: 1891906 - RNA, 23 nt, Homo sapiens
cuuaaguuccagcagaugccaca

SEQ ID NO: 1891907 - RNA, 19 nt, Homo sapiens
uggggaacugcguggugcu

SEQ ID NO: 1891908 - RNA, 13 nt, Homo sapiens
agcauccagcugc

SEQ ID NO: 1891909 - RNA, 19 nt, Homo sapiens
uggccugaagcaacugaag

SEQ ID NO: 1891910 - RNA, 23 nt, Homo sapiens
gguccugggaggcugcagccagg

SEQ ID NO: 1891911 - RNA, 19 nt, Homo sapiens
ucaugagcguuagacugac

SEQ ID NO: 1891912 - RNA, 22 nt, Homo sapiens
cagcuuucccuggcucagggau

SEQ ID NO: 1891913 - RNA, 11 nt, Homo sapiens
gggugggagag

SEQ ID NO: 1891914 - RNA, 11 nt, Homo sapiens
ggcugggagac

SEQ ID NO: 1891915 - RNA, 13 nt, Homo sapiens
uaaaucauauuag

SEQ ID NO: 1891916 - RNA, 12 nt, Homo sapiens
cagcagcacugu

SEQ ID NO: 1891917 - RNA, 16 nt, Homo sapiens
caccaaugagccuuag

SEQ ID NO: 1891918 - RNA, 21 nt, Homo sapiens
gcagggccuuugucugucuca

SEQ ID NO: 1891919 - RNA, 17 nt, Homo sapiens
ucuugccauccugaugg

SEQ ID NO: 1891920 - RNA, 12 nt, Homo sapiens
accaucuuggcc

SEQ ID NO: 1891921 - RNA, 21 nt, Homo sapiens
gacaugucucacagacgcucc

SEQ ID NO: 1891922 - RNA, 22 nt, Homo sapiens
gugucaccggggcaacugccug

SEQ ID NO: 1891923 - RNA, 12 nt, Homo sapiens
cugaagugccag

SEQ ID NO: 1891924 - RNA, 20 nt, Homo sapiens
aagccucauuuguguggaaa

SEQ ID NO: 1891925 - RNA, 20 nt, Homo sapiens
gacccggaggggccuggcag

SEQ ID NO: 1891926 - RNA, 15 nt, Homo sapiens
cccuaugucccagcc

SEQ ID NO: 1891927 - RNA, 10 nt, Homo sapiens
uggcuucccu

SEQ ID NO: 1891928 - RNA, 17 nt, Homo sapiens
guuaccacgacuucuag

SEQ ID NO: 1891929 - RNA, 13 nt, Homo sapiens
aguaaacacugug

SEQ ID NO: 1891930 - RNA, 20 nt, Homo sapiens
cacugacugugaaaccuuua

SEQ ID NO: 1891931 - RNA, 18 nt, Homo sapiens
acaucucuaguguagcug

SEQ ID NO: 1891932 - RNA, 15 nt, Homo sapiens
ccaagcaugccccac

SEQ ID NO: 1891933 - RNA, 18 nt, Homo sapiens
ccacugccugcuggagaa

SEQ ID NO: 1891934 - RNA, 17 nt, Homo sapiens
agcuuggagugccacgu

SEQ ID NO: 1891935 - RNA, 12 nt, Homo sapiens
caaguguuacag

SEQ ID NO: 1891936 - RNA, 16 nt, Homo sapiens
augauuugcauaugaa

SEQ ID NO: 1891937 - RNA, 23 nt, Homo sapiens
aagccccugucgcccacccagcu

SEQ ID NO: 1891938 - RNA, 16 nt, Homo sapiens
cacgcagacccaguac

SEQ ID NO: 1891939 - RNA, 13 nt, Homo sapiens
cacagagugccau

SEQ ID NO: 1891940 - RNA, 19 nt, Homo sapiens
gaugaggcuucccagagac

SEQ ID NO: 1891941 - RNA, 20 nt, Homo sapiens
cagccucucugcacacuaau

SEQ ID NO: 1891942 - RNA, 23 nt, Homo sapiens
uagauaaccuguacuucaaguua

SEQ ID NO: 1891943 - RNA, 20 nt, Homo sapiens
uccacuugccuugugauauu

SEQ ID NO: 1891944 - RNA, 19 nt, Homo sapiens
acuuugauugaaguauuca

SEQ ID NO: 1891945 - RNA, 17 nt, Homo sapiens
uauuuauucuuuaacug

SEQ ID NO: 1891946 - RNA, 15 nt, Homo sapiens
acagugggggcacca

SEQ ID NO: 1891947 - RNA, 13 nt, Homo sapiens
acggaauuccaau

SEQ ID NO: 1891948 - RNA, 18 nt, Homo sapiens
ccuggcuuuacagacaaa

SEQ ID NO: 1891949 - RNA, 14 nt, Homo sapiens
uacucagaacuguc

SEQ ID NO: 1891950 - RNA, 19 nt, Homo sapiens
aagaucuugaauagucuca

SEQ ID NO: 1891951 - RNA, 12 nt, Homo sapiens
gcugggcucagu

SEQ ID NO: 1891952 - RNA, 16 nt, Homo sapiens
uaauagugacauauau

SEQ ID NO: 1891953 - RNA, 11 nt, Homo sapiens
auaaagcuuua

SEQ ID NO: 1891954 - RNA, 14 nt, Homo sapiens
gaaaagauuacuga

SEQ ID NO: 1891955 - RNA, 23 nt, Homo sapiens
aggaggaccccgggcguggacca

SEQ ID NO: 1891956 - RNA, 17 nt, Homo sapiens
cagggagugggagccaa

SEQ ID NO: 1891957 - RNA, 20 nt, Homo sapiens
cuuuucgcuuucuuucugca

SEQ ID NO: 1891958 - RNA, 19 nt, Homo sapiens
uuuaauacaggguagauaa

SEQ ID NO: 1891959 - RNA, 16 nt, Homo sapiens
uaaacugaaugaacaa

SEQ ID NO: 1891960 - RNA, 23 nt, Homo sapiens
cagccugggugacagugcaagac

SEQ ID NO: 1891961 - RNA, 22 nt, Homo sapiens
cggcuggaaagaggagaaggag

SEQ ID NO: 1891962 - RNA, 15 nt, Homo sapiens
uccuucccugggaag

SEQ ID NO: 1891963 - RNA, 18 nt, Homo sapiens
uggaugccuugaauaaua

SEQ ID NO: 1891964 - RNA, 19 nt, Homo sapiens
gcguccuggggccugugca

SEQ ID NO: 1891965 - RNA, 20 nt, Homo sapiens
ucccuuuuaaaugcaaauca

SEQ ID NO: 1891966 - RNA, 22 nt, Homo sapiens
cuggaaucacauucuuagcaca

SEQ ID NO: 1891967 - RNA, 21 nt, Homo sapiens
cugcguccgcaucacucugca

SEQ ID NO: 1891968 - RNA, 15 nt, Homo sapiens
cgggcugcucuacug

SEQ ID NO: 1891969 - RNA, 18 nt, Homo sapiens
cacagcccuaguaugaaa

SEQ ID NO: 1891970 - RNA, 18 nt, Homo sapiens
gcaucugucccacuggga

SEQ ID NO: 1891971 - RNA, 19 nt, Homo sapiens
cauuaauuucaaucaacca

SEQ ID NO: 1891972 - RNA, 17 nt, Homo sapiens
ugaauuccucucaaauu

SEQ ID NO: 1891973 - RNA, 12 nt, Homo sapiens
ugaggucccuuc

SEQ ID NO: 1891974 - RNA, 18 nt, Homo sapiens
aauggacucuuaaggcau

SEQ ID NO: 1891975 - RNA, 22 nt, Homo sapiens
cucccccaguuccucccaggaa

SEQ ID NO: 1891976 - RNA, 16 nt, Homo sapiens
gcaccaucuggaagga

SEQ ID NO: 1891977 - RNA, 23 nt, Homo sapiens
uugauguuuguuugcaugauguc

SEQ ID NO: 1891978 - RNA, 14 nt, Homo sapiens
gcacauauugagaa

SEQ ID NO: 1891979 - RNA, 20 nt, Homo sapiens
gaaggccagaauacuggaga

SEQ ID NO: 1891980 - RNA, 11 nt, Homo sapiens
cagugugcaua

SEQ ID NO: 1891981 - RNA, 21 nt, Homo sapiens
ugcccagacacagacuggcaa

SEQ ID NO: 1891982 - RNA, 22 nt, Homo sapiens
aagacagauuuucggaacacau

SEQ ID NO: 1891983 - RNA, 13 nt, Homo sapiens
aguaaccuaguga

SEQ ID NO: 1891984 - RNA, 14 nt, Homo sapiens
uugcacucaucaua

SEQ ID NO: 1891985 - RNA, 19 nt, Homo sapiens
cucauauuuuuacaaauaa

SEQ ID NO: 1891986 - RNA, 23 nt, Homo sapiens
cuguuuuuuaaaaauaagccaca

SEQ ID NO: 1891987 - RNA, 23 nt, Homo sapiens
aaaaccugaagaguucacuuuug

SEQ ID NO: 1891988 - RNA, 16 nt, Homo sapiens
ugucucccacuuccca

SEQ ID NO: 1891989 - RNA, 21 nt, Homo sapiens
cucauuuaaaagcauaaggcc

SEQ ID NO: 1891990 - RNA, 18 nt, Homo sapiens
uauuguaaaaaauucaca

SEQ ID NO: 1891991 - RNA, 15 nt, Homo sapiens
cauuucuacuguaua

SEQ ID NO: 1891992 - RNA, 22 nt, Homo sapiens
agucacaugcuagcagcuguga

SEQ ID NO: 1891993 - RNA, 20 nt, Homo sapiens
uggcccgaggaagcuggaca

SEQ ID NO: 1891994 - RNA, 21 nt, Homo sapiens
cggauguuucuggaauugaua

SEQ ID NO: 1891995 - RNA, 21 nt, Homo sapiens
gaccaaaaaggggacaaagga

SEQ ID NO: 1891996 - RNA, 21 nt, Homo sapiens
ugaauuuacuuccuugcaugu

SEQ ID NO: 1891997 - RNA, 15 nt, Homo sapiens
cuuuuuauuccuaga

SEQ ID NO: 1891998 - RNA, 19 nt, Homo sapiens
gacuacaacaugcaucaug

SEQ ID NO: 1891999 - RNA, 13 nt, Homo sapiens
uugaagaacucau

SEQ ID NO: 1892000 - RNA, 23 nt, Homo sapiens
ugccaggagggcacagcagggga

SEQ ID NO: 1892001 - RNA, 13 nt, Homo sapiens
augaguggaauac

SEQ ID NO: 1892002 - RNA, 15 nt, Homo sapiens
auacaacagcugccg

SEQ ID NO: 1892003 - RNA, 17 nt, Homo sapiens
ggcugauucagcauuuu

SEQ ID NO: 1892004 - RNA, 19 nt, Homo sapiens
uaaaccaauaaaacaagaa

SEQ ID NO: 1892005 - RNA, 15 nt, Homo sapiens
agagcucccaggacg

SEQ ID NO: 1892006 - RNA, 21 nt, Homo sapiens
augguuugcaaggaagccaca

SEQ ID NO: 1892007 - RNA, 18 nt, Homo sapiens
agauacccaauuguuuca

SEQ ID NO: 1892008 - RNA, 18 nt, Homo sapiens
cuagagcuugcagugaag

SEQ ID NO: 1892009 - RNA, 18 nt, Homo sapiens
agugacagcagucaggga

SEQ ID NO: 1892010 - RNA, 17 nt, Homo sapiens
caaccaauggaauguga

SEQ ID NO: 1892011 - RNA, 11 nt, Homo sapiens
caaccaaaauc

SEQ ID NO: 1892012 - RNA, 15 nt, Homo sapiens
ccauauuuuuugcac

SEQ ID NO: 1892013 - RNA, 20 nt, Homo sapiens
uauuauuuguguuuccuaaa

SEQ ID NO: 1892014 - RNA, 20 nt, Homo sapiens
uuuauuuuucucucagugca

SEQ ID NO: 1892015 - RNA, 13 nt, Homo sapiens
aucuacaguguuu

SEQ ID NO: 1892016 - RNA, 16 nt, Homo sapiens
uuaugugaauggaauc

SEQ ID NO: 1892017 - RNA, 14 nt, Homo sapiens
gcugccuaguggga

SEQ ID NO: 1892018 - RNA, 12 nt, Homo sapiens
uuuacuaccauu

SEQ ID NO: 1892019 - RNA, 13 nt, Homo sapiens
ggauacuggcaca

SEQ ID NO: 1892020 - RNA, 15 nt, Homo sapiens
aucucaggugccacu

SEQ ID NO: 1892021 - RNA, 20 nt, Homo sapiens
cauuucuaucaaaacucuau

SEQ ID NO: 1892022 - RNA, 17 nt, Homo sapiens
guagcaaauguuuacug

SEQ ID NO: 1892023 - RNA, 15 nt, Homo sapiens
cauguuguaagcacu

SEQ ID NO: 1892024 - RNA, 18 nt, Homo sapiens
cggcuucccaugccugag

SEQ ID NO: 1892025 - RNA, 23 nt, Homo sapiens
ccaguugguuaucugaauagugu

SEQ ID NO: 1892026 - RNA, 17 nt, Homo sapiens
ccuuugauucuccagua

SEQ ID NO: 1892027 - RNA, 17 nt, Homo sapiens
auuguaucaugugcuag

SEQ ID NO: 1892028 - RNA, 14 nt, Homo sapiens
ucuuacuacacuga

SEQ ID NO: 1892029 - RNA, 13 nt, Homo sapiens
gaugacucaaggc

SEQ ID NO: 1892030 - RNA, 12 nt, Homo sapiens
caugagaauuga

SEQ ID NO: 1892031 - RNA, 21 nt, Homo sapiens
agacucuuaaacuaacaauuc

SEQ ID NO: 1892032 - RNA, 16 nt, Homo sapiens
gagcaggggaggcuca

SEQ ID NO: 1892033 - RNA, 22 nt, Homo sapiens
ccuacuaucacugaacaaacua

SEQ ID NO: 1892034 - RNA, 14 nt, Homo sapiens
aaacuaagcuaugu

SEQ ID NO: 1892035 - RNA, 19 nt, Homo sapiens
ucuggaauuucaaaccauu

SEQ ID NO: 1892036 - RNA, 14 nt, Homo sapiens
gauacaaacugcag

SEQ ID NO: 1892037 - RNA, 15 nt, Homo sapiens
uguguuaagugcagg

SEQ ID NO: 1892038 - RNA, 14 nt, Homo sapiens
uguauauaugugua

SEQ ID NO: 1892039 - RNA, 14 nt, Homo sapiens
caugcauacauaca

SEQ ID NO: 1892040 - RNA, 21 nt, Homo sapiens
gaagacguggacuccucuugg

SEQ ID NO: 1892041 - RNA, 20 nt, Homo sapiens
cccugaggguggucagccaa

SEQ ID NO: 1892042 - RNA, 17 nt, Homo sapiens
uagcaggucaaaaaccu

SEQ ID NO: 1892043 - RNA, 23 nt, Homo sapiens
ugcuuguugggauuccugaccca

SEQ ID NO: 1892044 - RNA, 17 nt, Homo sapiens
cauguauccuuucacac

SEQ ID NO: 1892045 - RNA, 18 nt, Homo sapiens
cacugucuugccagauua

SEQ ID NO: 1892046 - RNA, 15 nt, Homo sapiens
auuucauguacugca

SEQ ID NO: 1892047 - RNA, 19 nt, Homo sapiens
ccugcagaagagacaugca

SEQ ID NO: 1892048 - RNA, 22 nt, Homo sapiens
agcaggcuggagcccagcauuc

SEQ ID NO: 1892049 - RNA, 13 nt, Homo sapiens
caggacagcauua

SEQ ID NO: 1892050 - RNA, 15 nt, Homo sapiens
cccgcaucagcugcu

SEQ ID NO: 1892051 - RNA, 19 nt, Homo sapiens
cuugucucugguguucucu

SEQ ID NO: 1892052 - RNA, 23 nt, Homo sapiens
aaugaucuugaagaugacaaaag

SEQ ID NO: 1892053 - RNA, 18 nt, Homo sapiens
uuauucugccaaaccugu

SEQ ID NO: 1892054 - RNA, 13 nt, Homo sapiens
aguuaucaguccu

SEQ ID NO: 1892055 - RNA, 15 nt, Homo sapiens
agcgcaaugccaucu

SEQ ID NO: 1892056 - RNA, 17 nt, Homo sapiens
gcacccuggccuggucc

SEQ ID NO: 1892057 - RNA, 21 nt, Homo sapiens
uguguccgugaaaguugugau

SEQ ID NO: 1892058 - RNA, 15 nt, Homo sapiens
gcuucccuaaucuau

SEQ ID NO: 1892059 - RNA, 16 nt, Homo sapiens
agcagcauccacccca

SEQ ID NO: 1892060 - RNA, 14 nt, Homo sapiens
acauauacacacac

SEQ ID NO: 1892061 - RNA, 14 nt, Homo sapiens
acacacacacauau

SEQ ID NO: 1892062 - RNA, 14 nt, Homo sapiens
auauacacauacau

SEQ ID NO: 1892063 - RNA, 20 nt, Homo sapiens
uauauauugguaacauccuu

SEQ ID NO: 1892064 - RNA, 21 nt, Homo sapiens
ugccauuaaaagcauugucca

SEQ ID NO: 1892065 - RNA, 16 nt, Homo sapiens
gacuuuggcaaaugag

SEQ ID NO: 1892066 - RNA, 11 nt, Homo sapiens
cccagcacuga

SEQ ID NO: 1892067 - RNA, 13 nt, Homo sapiens
caagacaaaugac

SEQ ID NO: 1892068 - RNA, 12 nt, Homo sapiens
acuccagcauca

SEQ ID NO: 1892069 - RNA, 20 nt, Homo sapiens
ccaggcuacaaucuucauuu

SEQ ID NO: 1892070 - RNA, 15 nt, Homo sapiens
guagaagaugaccuc

SEQ ID NO: 1892071 - RNA, 16 nt, Homo sapiens
ugacaggugugagucu

SEQ ID NO: 1892072 - RNA, 11 nt, Homo sapiens
aagaaaacacu

SEQ ID NO: 1892073 - RNA, 18 nt, Homo sapiens
uggcuucucccaggauuc

SEQ ID NO: 1892074 - RNA, 17 nt, Homo sapiens
cagcacuggaccauucc

SEQ ID NO: 1892075 - RNA, 22 nt, Homo sapiens
uuuagaaaaacaucccaagaaa

SEQ ID NO: 1892076 - RNA, 20 nt, Homo sapiens
uccaaacaauuuagccagaa

SEQ ID NO: 1892077 - RNA, 19 nt, Homo sapiens
aggccuugcucacagcuga

SEQ ID NO: 1892078 - RNA, 20 nt, Homo sapiens
uuggccuuauggauuuggac

SEQ ID NO: 1892079 - RNA, 19 nt, Homo sapiens
ggggccucuuucugugcuu

SEQ ID NO: 1892080 - RNA, 13 nt, Homo sapiens
ccuguggugaccc

SEQ ID NO: 1892081 - RNA, 21 nt, Homo sapiens
gcaaugacaaguuuaacauau

SEQ ID NO: 1892082 - RNA, 22 nt, Homo sapiens
aagcagcagcuuguaguaugcu

SEQ ID NO: 1892083 - RNA, 20 nt, Homo sapiens
ugaacacaauugauacuuca

SEQ ID NO: 1892084 - RNA, 22 nt, Homo sapiens
ucaguuugcuagcagaaaucua

SEQ ID NO: 1892085 - RNA, 20 nt, Homo sapiens
aaauauuuugcggcauuaaa

SEQ ID NO: 1892086 - RNA, 13 nt, Homo sapiens
acacucaccauuu

SEQ ID NO: 1892087 - RNA, 23 nt, Homo sapiens
gcagcaggggccaagcaggcacu

SEQ ID NO: 1892088 - RNA, 23 nt, Homo sapiens
gagucuggggucuccuauacucu

SEQ ID NO: 1892089 - RNA, 12 nt, Homo sapiens
gaaaugcaaaac

SEQ ID NO: 1892090 - RNA, 17 nt, Homo sapiens
cacaguucacaugccac

SEQ ID NO: 1892091 - RNA, 15 nt, Homo sapiens
accuguaagcccagc

SEQ ID NO: 1892092 - RNA, 14 nt, Homo sapiens
cuacaguaaccaaa

SEQ ID NO: 1892093 - RNA, 17 nt, Homo sapiens
cuguggagugaggugua

SEQ ID NO: 1892094 - RNA, 12 nt, Homo sapiens
ucuggucuucca

SEQ ID NO: 1892095 - RNA, 14 nt, Homo sapiens
uccuucuacaugua

SEQ ID NO: 1892096 - RNA, 16 nt, Homo sapiens
cacuaaaagcaugaau

SEQ ID NO: 1892097 - RNA, 21 nt, Homo sapiens
aggucuuuuacauacagugau

SEQ ID NO: 1892098 - RNA, 18 nt, Homo sapiens
cccauugugaauguuguc

SEQ ID NO: 1892099 - RNA, 16 nt, Homo sapiens
uggcuaaggacaggca

SEQ ID NO: 1892100 - RNA, 11 nt, Homo sapiens
guuucuuccaa

SEQ ID NO: 1892101 - RNA, 18 nt, Homo sapiens
cagagucucacuguugcc

SEQ ID NO: 1892102 - RNA, 15 nt, Homo sapiens
uauaaagcacuauac

SEQ ID NO: 1892103 - RNA, 14 nt, Homo sapiens
uauaugauucacau

SEQ ID NO: 1892104 - RNA, 17 nt, Homo sapiens
ccagagcccacuuccau

SEQ ID NO: 1892105 - RNA, 20 nt, Homo sapiens
ggugcuaucgcaccacugug

SEQ ID NO: 1892106 - RNA, 17 nt, Homo sapiens
ucauuaggguaauauca

SEQ ID NO: 1892107 - RNA, 18 nt, Homo sapiens
guauuaaaugaacaucua

SEQ ID NO: 1892108 - RNA, 21 nt, Homo sapiens
cucgugggccguguggcacac

SEQ ID NO: 1892109 - RNA, 18 nt, Homo sapiens
caguucucaaauguugga

SEQ ID NO: 1892110 - RNA, 21 nt, Homo sapiens
cauaucuguccccugcuacua

SEQ ID NO: 1892111 - RNA, 23 nt, Homo sapiens
cuggccaguugcccagagcacuu

SEQ ID NO: 1892112 - RNA, 22 nt, Homo sapiens
aaauacuguuugagguuuuuaa

SEQ ID NO: 1892113 - RNA, 16 nt, Homo sapiens
aacuggggggcaauuu

SEQ ID NO: 1892114 - RNA, 13 nt, Homo sapiens
ccuacaucugaaa

SEQ ID NO: 1892115 - RNA, 18 nt, Homo sapiens
gcccccacuguccuguga

SEQ ID NO: 1892116 - RNA, 17 nt, Homo sapiens
ggccacuguggccagag

SEQ ID NO: 1892117 - RNA, 20 nt, Homo sapiens
uacaauuuuuuaucaugcau

SEQ ID NO: 1892118 - RNA, 15 nt, Homo sapiens
accacaccacugccc

SEQ ID NO: 1892119 - RNA, 14 nt, Homo sapiens
cagcagcagcaguu

SEQ ID NO: 1892120 - RNA, 11 nt, Homo sapiens
auuuccaugga

SEQ ID NO: 1892121 - RNA, 20 nt, Homo sapiens
uuagccuugcucaggugcaa

SEQ ID NO: 1892122 - RNA, 14 nt, Homo sapiens
caaucagcacugaa

SEQ ID NO: 1892123 - RNA, 14 nt, Homo sapiens
caugaagcacauca

SEQ ID NO: 1892124 - RNA, 18 nt, Homo sapiens
gacguccuaucuccccca

SEQ ID NO: 1892125 - RNA, 23 nt, Homo sapiens
uaugacagugaauauugcuuuua

SEQ ID NO: 1892126 - RNA, 14 nt, Homo sapiens
aaucuagaauuuag

SEQ ID NO: 1892127 - RNA, 23 nt, Homo sapiens
cgcaucguggccuugaccuccaa

SEQ ID NO: 1892128 - RNA, 16 nt, Homo sapiens
uuacuaucaugucaaa

SEQ ID NO: 1892129 - RNA, 24 nt, Homo sapiens
cccagggcacuacauaauugcugu

SEQ ID NO: 1892130 - RNA, 12 nt, Homo sapiens
gauauucaccua

SEQ ID NO: 1892131 - RNA, 18 nt, Homo sapiens
ccauugcucuucuuuuga

SEQ ID NO: 1892132 - RNA, 17 nt, Homo sapiens
aagauuaaaaaguaaaa

SEQ ID NO: 1892133 - RNA, 24 nt, Homo sapiens
uucuuccaaggaaauacauaugca

SEQ ID NO: 1892134 - RNA, 13 nt, Homo sapiens
uugguacugugau

SEQ ID NO: 1892135 - RNA, 19 nt, Homo sapiens
ccauuuugguuuuccuuaa

SEQ ID NO: 1892136 - RNA, 16 nt, Homo sapiens
uuugacauugucagaa

SEQ ID NO: 1892137 - RNA, 16 nt, Homo sapiens
aaaggaauccucugug

SEQ ID NO: 1892138 - RNA, 21 nt, Homo sapiens
auaaauucagccaacauguga

SEQ ID NO: 1892139 - RNA, 14 nt, Homo sapiens
ugugaggguggugg

SEQ ID NO: 1892140 - RNA, 12 nt, Homo sapiens
gcaaaaccaaag

SEQ ID NO: 1892141 - RNA, 15 nt, Homo sapiens
auuccugaugaccaa

SEQ ID NO: 1892142 - RNA, 13 nt, Homo sapiens
cgguagucccugu

SEQ ID NO: 1892143 - RNA, 17 nt, Homo sapiens
uugggcgggacauccuc

SEQ ID NO: 1892144 - RNA, 22 nt, Homo sapiens
ccagauccuucaaagagucaua

SEQ ID NO: 1892145 - RNA, 14 nt, Homo sapiens
caggaacucaauaa

SEQ ID NO: 1892146 - RNA, 23 nt, Homo sapiens
caggagaggauggcccaggguga

SEQ ID NO: 1892147 - RNA, 12 nt, Homo sapiens
auaacaaugaaa

SEQ ID NO: 1892148 - RNA, 21 nt, Homo sapiens
acccagccucuagaacagcca

SEQ ID NO: 1892149 - RNA, 23 nt, Homo sapiens
aauaucauucacuagcuuugccu

SEQ ID NO: 1892150 - RNA, 21 nt, Homo sapiens
ccuuugaaaccugcucuguag

SEQ ID NO: 1892151 - RNA, 13 nt, Homo sapiens
aagguugcacagc

SEQ ID NO: 1892152 - RNA, 15 nt, Homo sapiens
agcaauucucuuucu

SEQ ID NO: 1892153 - RNA, 19 nt, Homo sapiens
uucacauucccaucuguca

SEQ ID NO: 1892154 - RNA, 16 nt, Homo sapiens
auauauaaguguacau

SEQ ID NO: 1892155 - RNA, 18 nt, Homo sapiens
cccaucagaaagauucau

SEQ ID NO: 1892156 - RNA, 21 nt, Homo sapiens
aggaaugaucccacucaccag

SEQ ID NO: 1892157 - RNA, 12 nt, Homo sapiens
cccaguaaaauu

SEQ ID NO: 1892158 - RNA, 14 nt, Homo sapiens
agucucuucucaga

SEQ ID NO: 1892159 - RNA, 15 nt, Homo sapiens
aucuuccccggaugu

SEQ ID NO: 1892160 - RNA, 15 nt, Homo sapiens
agcagcuccuguggc

SEQ ID NO: 1892161 - RNA, 17 nt, Homo sapiens
caguuaugauaaccaag

SEQ ID NO: 1892162 - RNA, 21 nt, Homo sapiens
gcucuguucuucaucgcauuc

SEQ ID NO: 1892163 - RNA, 14 nt, Homo sapiens
accagccccucccc

SEQ ID NO: 1892164 - RNA, 22 nt, Homo sapiens
uuacauagcucugaaguuaaaa

SEQ ID NO: 1892165 - RNA, 17 nt, Homo sapiens
ugcgggggugaugugaa

SEQ ID NO: 1892166 - RNA, 21 nt, Homo sapiens
cuuccauaggacauacugcau

SEQ ID NO: 1892167 - RNA, 17 nt, Homo sapiens
uaauauccacugcaaua

SEQ ID NO: 1892168 - RNA, 22 nt, Homo sapiens
cuacccgcccgcguccaacccc

SEQ ID NO: 1892169 - RNA, 21 nt, Homo sapiens
cucccaagggauggugcccug

SEQ ID NO: 1892170 - RNA, 17 nt, Homo sapiens
agcgugugagugaggga

SEQ ID NO: 1892171 - RNA, 14 nt, Homo sapiens
cagugauuucggac

SEQ ID NO: 1892172 - RNA, 17 nt, Homo sapiens
accagcagcccaagggc

SEQ ID NO: 1892173 - RNA, 14 nt, Homo sapiens
gaguuaaacuuuag

SEQ ID NO: 1892174 - RNA, 13 nt, Homo sapiens
ugaaagggcaaua

SEQ ID NO: 1892175 - RNA, 14 nt, Homo sapiens
gcaccacucugggc

SEQ ID NO: 1892176 - RNA, 17 nt, Homo sapiens
cugggcggccucuugcu

SEQ ID NO: 1892177 - RNA, 21 nt, Homo sapiens
cuaguugacuucaaaugugua

SEQ ID NO: 1892178 - RNA, 14 nt, Homo sapiens
ugaaaguaauugag

SEQ ID NO: 1892179 - RNA, 16 nt, Homo sapiens
acaauaucaaucacau

SEQ ID NO: 1892180 - RNA, 13 nt, Homo sapiens
aucaugcaaugca

SEQ ID NO: 1892181 - RNA, 15 nt, Homo sapiens
ucuggaaugcacuga

SEQ ID NO: 1892182 - RNA, 20 nt, Homo sapiens
gugagccacugugucuggcc

SEQ ID NO: 1892183 - RNA, 16 nt, Homo sapiens
acgugagaacaaucau

SEQ ID NO: 1892184 - RNA, 21 nt, Homo sapiens
ccuuugggugcuguuuugcca

SEQ ID NO: 1892185 - RNA, 20 nt, Homo sapiens
uaaaucugcgaucaucguca

SEQ ID NO: 1892186 - RNA, 14 nt, Homo sapiens
caucagcuccagcu

SEQ ID NO: 1892187 - RNA, 20 nt, Homo sapiens
cugcgaacccaagcaauggg

SEQ ID NO: 1892188 - RNA, 19 nt, Homo sapiens
gcugauccagagcacagau

SEQ ID NO: 1892189 - RNA, 18 nt, Homo sapiens
cagugcaucacaucugca

SEQ ID NO: 1892190 - RNA, 14 nt, Homo sapiens
cagaccucuggauu

SEQ ID NO: 1892191 - RNA, 13 nt, Homo sapiens
uacagaugggcaa

SEQ ID NO: 1892192 - RNA, 12 nt, Homo sapiens
ugucugugccau

SEQ ID NO: 1892193 - RNA, 15 nt, Homo sapiens
auuucucuuccuaca

SEQ ID NO: 1892194 - RNA, 15 nt, Homo sapiens
uggaaugacugaaag

SEQ ID NO: 1892195 - RNA, 19 nt, Homo sapiens
gccagaaaaggcagccaga

SEQ ID NO: 1892196 - RNA, 16 nt, Homo sapiens
caauuuuaaacauauc

SEQ ID NO: 1892197 - RNA, 17 nt, Homo sapiens
cucacauuuauucugcu

SEQ ID NO: 1892198 - RNA, 17 nt, Homo sapiens
ugaugagggaagcaaua

SEQ ID NO: 1892199 - RNA, 16 nt, Homo sapiens
agccccagagaugcca

SEQ ID NO: 1892200 - RNA, 23 nt, Homo sapiens
uuaccuuuauuaaugaacuguga

SEQ ID NO: 1892201 - RNA, 23 nt, Homo sapiens
aauccuuuaaggucaacauuguu

SEQ ID NO: 1892202 - RNA, 13 nt, Homo sapiens
ugaaguuuaguca

SEQ ID NO: 1892203 - RNA, 16 nt, Homo sapiens
uacaaucagcccagug

SEQ ID NO: 1892204 - RNA, 18 nt, Homo sapiens
aaagcuuuaaaugucugc

SEQ ID NO: 1892205 - RNA, 21 nt, Homo sapiens
guaucauaucaugaauggacu

SEQ ID NO: 1892206 - RNA, 15 nt, Homo sapiens
ccaccacugccugac

SEQ ID NO: 1892207 - RNA, 15 nt, Homo sapiens
augcaauccuuccaa

SEQ ID NO: 1892208 - RNA, 15 nt, Homo sapiens
aaggcauccaugaaa

SEQ ID NO: 1892209 - RNA, 21 nt, Homo sapiens
cucucaccccaagcggccuuu

SEQ ID NO: 1892210 - RNA, 19 nt, Homo sapiens
ccuccugcccuccaucuca

SEQ ID NO: 1892211 - RNA, 17 nt, Homo sapiens
caaucagccacauucua

SEQ ID NO: 1892212 - RNA, 19 nt, Homo sapiens
cuuucuucauguucaguca

SEQ ID NO: 1892213 - RNA, 20 nt, Homo sapiens
acccucuuucuuguuuguca

SEQ ID NO: 1892214 - RNA, 20 nt, Homo sapiens
uaaucucuaaaauucuaguc

SEQ ID NO: 1892215 - RNA, 17 nt, Homo sapiens
auagaauacucagggaa

SEQ ID NO: 1892216 - RNA, 23 nt, Homo sapiens
auaucacaauuuacgaaaccaaa

SEQ ID NO: 1892217 - RNA, 19 nt, Homo sapiens
ucuuagagcaaagagccag

SEQ ID NO: 1892218 - RNA, 17 nt, Homo sapiens
caucucugcaguuuuuc

SEQ ID NO: 1892219 - RNA, 18 nt, Homo sapiens
aacugcauuagaaaccau

SEQ ID NO: 1892220 - RNA, 22 nt, Homo sapiens
agggcaagagggggaccugcca

SEQ ID NO: 1892221 - RNA, 20 nt, Homo sapiens
acagagcaagacccaucuca

SEQ ID NO: 1892222 - RNA, 12 nt, Homo sapiens
cacugucuuuca

SEQ ID NO: 1892223 - RNA, 15 nt, Homo sapiens
ccuucucaagacuuu

SEQ ID NO: 1892224 - RNA, 20 nt, Homo sapiens
uuauguucaucuucaaaaaa

SEQ ID NO: 1892225 - RNA, 14 nt, Homo sapiens
ucaaagacaaugga

SEQ ID NO: 1892226 - RNA, 12 nt, Homo sapiens
uagugucuauca

SEQ ID NO: 1892227 - RNA, 20 nt, Homo sapiens
gcucaaccacacacaccugu

SEQ ID NO: 1892228 - RNA, 18 nt, Homo sapiens
ccaaggacagucagcauu

SEQ ID NO: 1892229 - RNA, 23 nt, Homo sapiens
gcuaaauguaagaaucauuguaa

SEQ ID NO: 1892230 - RNA, 20 nt, Homo sapiens
caaagccacccuaccaugaa

SEQ ID NO: 1892231 - RNA, 20 nt, Homo sapiens
ugcuguaaaauuauaaacuu

SEQ ID NO: 1892232 - RNA, 23 nt, Homo sapiens
ggguugguagcagggaguaccca

SEQ ID NO: 1892233 - RNA, 16 nt, Homo sapiens
uuauacuggguuucaa

SEQ ID NO: 1892234 - RNA, 13 nt, Homo sapiens
aagcauccuccac

SEQ ID NO: 1892235 - RNA, 15 nt, Homo sapiens
gaggcguuugaauca

SEQ ID NO: 1892236 - RNA, 18 nt, Homo sapiens
uccugaguggcugaaaua

SEQ ID NO: 1892237 - RNA, 16 nt, Homo sapiens
guauuuucuacuagcc

SEQ ID NO: 1892238 - RNA, 19 nt, Homo sapiens
caggaguucaauaaauguc

SEQ ID NO: 1892239 - RNA, 23 nt, Homo sapiens
gcuugugguggcugcuccaugag

SEQ ID NO: 1892240 - RNA, 19 nt, Homo sapiens
acugucaaaauauuucuca

SEQ ID NO: 1892241 - RNA, 16 nt, Homo sapiens
acuucacacagcaccu

SEQ ID NO: 1892242 - RNA, 12 nt, Homo sapiens
uccaugcugcaa

SEQ ID NO: 1892243 - RNA, 20 nt, Homo sapiens
caugucagacccgaacuggc

SEQ ID NO: 1892244 - RNA, 18 nt, Homo sapiens
ggucuuguuaagugcagu

SEQ ID NO: 1892245 - RNA, 14 nt, Homo sapiens
gucauuauucucug

SEQ ID NO: 1892246 - RNA, 17 nt, Homo sapiens
cagccucgcucuugucu

SEQ ID NO: 1892247 - RNA, 22 nt, Homo sapiens
cagccucugaaaaccaauguuc

SEQ ID NO: 1892248 - RNA, 21 nt, Homo sapiens
cucugccagcccugcaguaau

SEQ ID NO: 1892249 - RNA, 18 nt, Homo sapiens
uucugaucucagagcauu

SEQ ID NO: 1892250 - RNA, 22 nt, Homo sapiens
gugcauuuaaaauggacuuuug

SEQ ID NO: 1892251 - RNA, 17 nt, Homo sapiens
ugucacuaagaauauaa

SEQ ID NO: 1892252 - RNA, 20 nt, Homo sapiens
agcugggaugacuggcuuug

SEQ ID NO: 1892253 - RNA, 13 nt, Homo sapiens
aaacccucuguga

SEQ ID NO: 1892254 - RNA, 19 nt, Homo sapiens
acuugaggcuuucagugau

SEQ ID NO: 1892255 - RNA, 22 nt, Homo sapiens
ugugggcauggccgcuucuaga

SEQ ID NO: 1892256 - RNA, 13 nt, Homo sapiens
aauaaauauuaca

SEQ ID NO: 1892257 - RNA, 19 nt, Homo sapiens
gguugcacuggccacccaa

SEQ ID NO: 1892258 - RNA, 14 nt, Homo sapiens
cauaagaaagcacu

SEQ ID NO: 1892259 - RNA, 21 nt, Homo sapiens
aaagacuugaauauguauuua

SEQ ID NO: 1892260 - RNA, 16 nt, Homo sapiens
ucuguguaagcuuuua

SEQ ID NO: 1892261 - RNA, 13 nt, Homo sapiens
guaacugcauuag

SEQ ID NO: 1892262 - RNA, 22 nt, Homo sapiens
ucagugucugaacaaucuccaa

SEQ ID NO: 1892263 - RNA, 17 nt, Homo sapiens
ccugaagaucuagugaa

SEQ ID NO: 1892264 - RNA, 14 nt, Homo sapiens
gcuuaaaugaucaa

SEQ ID NO: 1892265 - RNA, 12 nt, Homo sapiens
aacagugaaagg

SEQ ID NO: 1892266 - RNA, 17 nt, Homo sapiens
ggagggagagaauuuua

SEQ ID NO: 1892267 - RNA, 14 nt, Homo sapiens
accugcaaucccag

SEQ ID NO: 1892268 - RNA, 22 nt, Homo sapiens
aauucaugugagaaagcuaaaa

SEQ ID NO: 1892269 - RNA, 23 nt, Homo sapiens
gagcgagggcauaaauacagcua

SEQ ID NO: 1892270 - RNA, 16 nt, Homo sapiens
cggucccugucccucu

SEQ ID NO: 1892271 - RNA, 12 nt, Homo sapiens
ucugcucaaggu

SEQ ID NO: 1892272 - RNA, 11 nt, Homo sapiens
uuucucauucu

SEQ ID NO: 1892273 - RNA, 13 nt, Homo sapiens
caaguugguccac

SEQ ID NO: 1892274 - RNA, 15 nt, Homo sapiens
auauauuucccugaa

SEQ ID NO: 1892275 - RNA, 17 nt, Homo sapiens
ucuagaaugagcaagac

SEQ ID NO: 1892276 - RNA, 15 nt, Homo sapiens
uuucaaagcacuuaa

SEQ ID NO: 1892277 - RNA, 19 nt, Homo sapiens
ccuggugcccugagacaga

SEQ ID NO: 1892278 - RNA, 22 nt, Homo sapiens
acucugcuugauuuuugccucu

SEQ ID NO: 1892279 - RNA, 19 nt, Homo sapiens
cugaggccacccacugacc

SEQ ID NO: 1892280 - RNA, 15 nt, Homo sapiens
ugauaucagcacugg

SEQ ID NO: 1892281 - RNA, 17 nt, Homo sapiens
caccuugugucuguaca

SEQ ID NO: 1892282 - RNA, 18 nt, Homo sapiens
gcuggaagucuccaugaa

SEQ ID NO: 1892283 - RNA, 16 nt, Homo sapiens
cagacaaguaaucacu

SEQ ID NO: 1892284 - RNA, 16 nt, Homo sapiens
uucaggacaacacuuc

SEQ ID NO: 1892285 - RNA, 17 nt, Homo sapiens
cacaugggaucaagucc

SEQ ID NO: 1892286 - RNA, 21 nt, Homo sapiens
caaagcaacauggcagagcag

SEQ ID NO: 1892287 - RNA, 12 nt, Homo sapiens
acacuuacuguu

SEQ ID NO: 1892288 - RNA, 13 nt, Homo sapiens
ucugggccaguga

SEQ ID NO: 1892289 - RNA, 23 nt, Homo sapiens
gcaucuauucuuuguaccaucug

SEQ ID NO: 1892290 - RNA, 18 nt, Homo sapiens
uuuacuguuuuaauugua

SEQ ID NO: 1892291 - RNA, 20 nt, Homo sapiens
aagcugacucuuugcucuaa

SEQ ID NO: 1892292 - RNA, 20 nt, Homo sapiens
guucaaaugcccuuccagug

SEQ ID NO: 1892293 - RNA, 18 nt, Homo sapiens
ugaagcuuggaggucaca

SEQ ID NO: 1892294 - RNA, 22 nt, Homo sapiens
uaaaacaugcugaaaacuacac

SEQ ID NO: 1892295 - RNA, 22 nt, Homo sapiens
ucgcuguguguuaguucccaac

SEQ ID NO: 1892296 - RNA, 19 nt, Homo sapiens
uugcagugaagauguguaa

SEQ ID NO: 1892297 - RNA, 14 nt, Homo sapiens
uaguuugacacugc

SEQ ID NO: 1892298 - RNA, 17 nt, Homo sapiens
cauuccaggugccagaa

SEQ ID NO: 1892299 - RNA, 19 nt, Homo sapiens
cuggggaugucucucauga

SEQ ID NO: 1892300 - RNA, 14 nt, Homo sapiens
aaugcuaagggcag

SEQ ID NO: 1892301 - RNA, 12 nt, Homo sapiens
acuuaguucaag

SEQ ID NO: 1892302 - RNA, 17 nt, Homo sapiens
cugugauaugccauagg

SEQ ID NO: 1892303 - RNA, 22 nt, Homo sapiens
agucagaaguucuggguggugc

SEQ ID NO: 1892304 - RNA, 13 nt, Homo sapiens
acuuccaagugau

SEQ ID NO: 1892305 - RNA, 19 nt, Homo sapiens
uccuagccaccgccuccua

SEQ ID NO: 1892306 - RNA, 21 nt, Homo sapiens
guugcacguguguuuuucuau

SEQ ID NO: 1892307 - RNA, 20 nt, Homo sapiens
ccucccaaagugcugggauu

SEQ ID NO: 1892308 - RNA, 21 nt, Homo sapiens
aauauguuuaucaacucaaga

SEQ ID NO: 1892309 - RNA, 12 nt, Homo sapiens
guggacaccugc

SEQ ID NO: 1892310 - RNA, 18 nt, Homo sapiens
gaaacaccgagucucugu

SEQ ID NO: 1892311 - RNA, 13 nt, Homo sapiens
accuuggugcuua

SEQ ID NO: 1892312 - RNA, 18 nt, Homo sapiens
uucauacaaagcaucuca

SEQ ID NO: 1892313 - RNA, 14 nt, Homo sapiens
agagaaacugaggu

SEQ ID NO: 1892314 - RNA, 20 nt, Homo sapiens
caaguguaaccuugcaucuc

SEQ ID NO: 1892315 - RNA, 14 nt, Homo sapiens
uacagcucuuggca

SEQ ID NO: 1892316 - RNA, 18 nt, Homo sapiens
uggccacggccacagcca

SEQ ID NO: 1892317 - RNA, 20 nt, Homo sapiens
ucuaaauagauacuuuugau

SEQ ID NO: 1892318 - RNA, 15 nt, Homo sapiens
ugaacugcaggugac

SEQ ID NO: 1892319 - RNA, 16 nt, Homo sapiens
gucccgucgugcaguc

SEQ ID NO: 1892320 - RNA, 23 nt, Homo sapiens
auuuucuucacagugcagcuugc

SEQ ID NO: 1892321 - RNA, 15 nt, Homo sapiens
cuugcacuauuccac

SEQ ID NO: 1892322 - RNA, 21 nt, Homo sapiens
aggacccgcacgccucuuccc

SEQ ID NO: 1892323 - RNA, 18 nt, Homo sapiens
aaacacuucuacuguuca

SEQ ID NO: 1892324 - RNA, 13 nt, Homo sapiens
uagcugcauuugu

SEQ ID NO: 1892325 - RNA, 13 nt, Homo sapiens
guuuucacacuga

SEQ ID NO: 1892326 - RNA, 15 nt, Homo sapiens
auuuuuagauuccca

SEQ ID NO: 1892327 - RNA, 23 nt, Homo sapiens
cuggggacagacaaggugccugu

SEQ ID NO: 1892328 - RNA, 17 nt, Homo sapiens
gacccaucuuccaccuc

SEQ ID NO: 1892329 - RNA, 19 nt, Homo sapiens
cuccugcgcgcaugugcgc

SEQ ID NO: 1892330 - RNA, 17 nt, Homo sapiens
uauuaagaaucauugug

SEQ ID NO: 1892331 - RNA, 18 nt, Homo sapiens
gcgaaaaccuuccucagc

SEQ ID NO: 1892332 - RNA, 18 nt, Homo sapiens
ccuuaaggaaaaguaaag

SEQ ID NO: 1892333 - RNA, 22 nt, Homo sapiens
cugcacugaauggcugaccuga

SEQ ID NO: 1892334 - RNA, 22 nt, Homo sapiens
aacauguguuuucaucauuuca

SEQ ID NO: 1892335 - RNA, 14 nt, Homo sapiens
auauugaggggcaa

SEQ ID NO: 1892336 - RNA, 22 nt, Homo sapiens
cuauuuauggauaucacacaua

SEQ ID NO: 1892337 - RNA, 19 nt, Homo sapiens
cuuuuaaaaugcaauguaa

SEQ ID NO: 1892338 - RNA, 17 nt, Homo sapiens
ucuugacauucaaggca

SEQ ID NO: 1892339 - RNA, 15 nt, Homo sapiens
uucagauugcuuugg

SEQ ID NO: 1892340 - RNA, 10 nt, Homo sapiens
aacugaaaua

SEQ ID NO: 1892341 - RNA, 23 nt, Homo sapiens
gggcaagaacagaaguguucaca

SEQ ID NO: 1892342 - RNA, 18 nt, Homo sapiens
uuuuuaaacaaagacagc

SEQ ID NO: 1892343 - RNA, 22 nt, Homo sapiens
aaguauuugcuuaaaauuguga

SEQ ID NO: 1892344 - RNA, 15 nt, Homo sapiens
aaauuaauugugccu

SEQ ID NO: 1892345 - RNA, 22 nt, Homo sapiens
gcuuccaucaaaccuuugccaa

SEQ ID NO: 1892346 - RNA, 13 nt, Homo sapiens
ucuuuugcaauaa

SEQ ID NO: 1892347 - RNA, 16 nt, Homo sapiens
ggcccuggucuccgga

SEQ ID NO: 1892348 - RNA, 13 nt, Homo sapiens
ugggagacagugg

SEQ ID NO: 1892349 - RNA, 11 nt, Homo sapiens
ccuacagccag

SEQ ID NO: 1892350 - RNA, 22 nt, Homo sapiens
accucuaguaaauuuaagucca

SEQ ID NO: 1892351 - RNA, 22 nt, Homo sapiens
guuuaagccaaaaugcagucuu

SEQ ID NO: 1892352 - RNA, 22 nt, Homo sapiens
agucccucucacaggacaugcu

SEQ ID NO: 1892353 - RNA, 19 nt, Homo sapiens
agaaaccaagucuacuuca

SEQ ID NO: 1892354 - RNA, 16 nt, Homo sapiens
guaugugacuauuuau

SEQ ID NO: 1892355 - RNA, 20 nt, Homo sapiens
acuaagauugugcucaauac

SEQ ID NO: 1892356 - RNA, 21 nt, Homo sapiens
accagagauuuuccucuccaa

SEQ ID NO: 1892357 - RNA, 15 nt, Homo sapiens
aaugcuucuguugau

SEQ ID NO: 1892358 - RNA, 15 nt, Homo sapiens
ucaucccuaugggau

SEQ ID NO: 1892359 - RNA, 16 nt, Homo sapiens
ggaaucaaaucugugc

SEQ ID NO: 1892360 - RNA, 14 nt, Homo sapiens
cuauugccugagag

SEQ ID NO: 1892361 - RNA, 21 nt, Homo sapiens
cuuccuuggaggggggagcca

SEQ ID NO: 1892362 - RNA, 12 nt, Homo sapiens
uaagccagggca

SEQ ID NO: 1892363 - RNA, 22 nt, Homo sapiens
aaauaucuugauccuaugagug

SEQ ID NO: 1892364 - RNA, 20 nt, Homo sapiens
aucaccaccaccauggacaa

SEQ ID NO: 1892365 - RNA, 15 nt, Homo sapiens
ugucuauaauggaaa

SEQ ID NO: 1892366 - RNA, 16 nt, Homo sapiens
cugauagacaccauag

SEQ ID NO: 1892367 - RNA, 16 nt, Homo sapiens
gugcucgaccuugaua

SEQ ID NO: 1892368 - RNA, 18 nt, Homo sapiens
aacuuuguauuaaugugu

SEQ ID NO: 1892369 - RNA, 12 nt, Homo sapiens
uuuaucuauggg

SEQ ID NO: 1892370 - RNA, 16 nt, Homo sapiens
gcugagugcacuggca

SEQ ID NO: 1892371 - RNA, 17 nt, Homo sapiens
ucuuaaggaacaucucu

SEQ ID NO: 1892372 - RNA, 14 nt, Homo sapiens
cuacaaugauggua

SEQ ID NO: 1892373 - RNA, 18 nt, Homo sapiens
guuaugccgcuagauaca

SEQ ID NO: 1892374 - RNA, 15 nt, Homo sapiens
cugugcuauggugcu

SEQ ID NO: 1892375 - RNA, 15 nt, Homo sapiens
uguugaaacuuugaa

SEQ ID NO: 1892376 - RNA, 19 nt, Homo sapiens
ccuuauuaauacaaacaca

SEQ ID NO: 1892377 - RNA, 14 nt, Homo sapiens
acccaucacuuugg

SEQ ID NO: 1892378 - RNA, 17 nt, Homo sapiens
aacucaauauauaguua

SEQ ID NO: 1892379 - RNA, 15 nt, Homo sapiens
gagcuccuccagacc

SEQ ID NO: 1892380 - RNA, 22 nt, Homo sapiens
auauaugacugcuucaugacau

SEQ ID NO: 1892381 - RNA, 18 nt, Homo sapiens
auggcugcauaguauucc

SEQ ID NO: 1892382 - RNA, 18 nt, Homo sapiens
cauuuccaacaccacaga

SEQ ID NO: 1892383 - RNA, 18 nt, Homo sapiens
ugugaaguuuaauugacu

SEQ ID NO: 1892384 - RNA, 20 nt, Homo sapiens
acccagguaaagucaaagcu

SEQ ID NO: 1892385 - RNA, 14 nt, Homo sapiens
cuucugcaacaucu

SEQ ID NO: 1892386 - RNA, 13 nt, Homo sapiens
cuuugacaugacu

SEQ ID NO: 1892387 - RNA, 21 nt, Homo sapiens
uuaauaaacucacaacucucu

SEQ ID NO: 1892388 - RNA, 18 nt, Homo sapiens
agccgcauuggugacuca

SEQ ID NO: 1892389 - RNA, 15 nt, Homo sapiens
agauuuuucugugaa

SEQ ID NO: 1892390 - RNA, 15 nt, Homo sapiens
uucacaaacugugaa

SEQ ID NO: 1892391 - RNA, 22 nt, Homo sapiens
uuagaaccagcagaagccagag

SEQ ID NO: 1892392 - RNA, 17 nt, Homo sapiens
gcuccgggucacugcug

SEQ ID NO: 1892393 - RNA, 21 nt, Homo sapiens
uaccuauuauaaaaucuuacu

SEQ ID NO: 1892394 - RNA, 15 nt, Homo sapiens
acgucagugcucaga

SEQ ID NO: 1892395 - RNA, 20 nt, Homo sapiens
uguauuauaugcagaauuac

SEQ ID NO: 1892396 - RNA, 17 nt, Homo sapiens
cuccugacaauacugua

SEQ ID NO: 1892397 - RNA, 22 nt, Homo sapiens
uuagggacagucaaaaccaagu

SEQ ID NO: 1892398 - RNA, 21 nt, Homo sapiens
ccacacugaaucucaccugcu

SEQ ID NO: 1892399 - RNA, 22 nt, Homo sapiens
uuugucuguacucaugucauuc

SEQ ID NO: 1892400 - RNA, 19 nt, Homo sapiens
auguuaaaacauaaacaca

SEQ ID NO: 1892401 - RNA, 21 nt, Homo sapiens
gauuuacgcucauuguagaaa

SEQ ID NO: 1892402 - RNA, 15 nt, Homo sapiens
uccaagaccccaaau

SEQ ID NO: 1892403 - RNA, 16 nt, Homo sapiens
agccuggccuccugcc

SEQ ID NO: 1892404 - RNA, 17 nt, Homo sapiens
ucagacugcaagugagc

SEQ ID NO: 1892405 - RNA, 23 nt, Homo sapiens
uaaguagcaacccugugauacua

SEQ ID NO: 1892406 - RNA, 20 nt, Homo sapiens
agauagugccagguggcuca

SEQ ID NO: 1892407 - RNA, 11 nt, Homo sapiens
cggaggucucu

SEQ ID NO: 1892408 - RNA, 15 nt, Homo sapiens
ucuuugcaguuccca

SEQ ID NO: 1892409 - RNA, 20 nt, Homo sapiens
cacaguggccaagaucacag

SEQ ID NO: 1892410 - RNA, 12 nt, Homo sapiens
ucgguggcugcc

SEQ ID NO: 1892411 - RNA, 15 nt, Homo sapiens
uaacaaagaacaagc

SEQ ID NO: 1892412 - RNA, 14 nt, Homo sapiens
accccagagccaca

SEQ ID NO: 1892413 - RNA, 14 nt, Homo sapiens
aagcaaggaaguaa

SEQ ID NO: 1892414 - RNA, 23 nt, Homo sapiens
ccagauggucauccagacucaga

SEQ ID NO: 1892415 - RNA, 22 nt, Homo sapiens
auguuugauaguaaauguccac

SEQ ID NO: 1892416 - RNA, 19 nt, Homo sapiens
caaagcuuacaacauuuag

SEQ ID NO: 1892417 - RNA, 15 nt, Homo sapiens
gcgaggccugacaca

SEQ ID NO: 1892418 - RNA, 20 nt, Homo sapiens
auguguaggugaacagucac

SEQ ID NO: 1892419 - RNA, 21 nt, Homo sapiens
aaucccucuggcccacacaga

SEQ ID NO: 1892420 - RNA, 20 nt, Homo sapiens
caaaugcaaucccauuucug

SEQ ID NO: 1892421 - RNA, 17 nt, Homo sapiens
caaagugcagggauuac

SEQ ID NO: 1892422 - RNA, 18 nt, Homo sapiens
cagaagugaugauuguaa

SEQ ID NO: 1892423 - RNA, 19 nt, Homo sapiens
uagcacacaauaagcauuc

SEQ ID NO: 1892424 - RNA, 16 nt, Homo sapiens
agaaacaugacacuga

SEQ ID NO: 1892425 - RNA, 17 nt, Homo sapiens
ucgcaccacugcacucc

SEQ ID NO: 1892426 - RNA, 15 nt, Homo sapiens
cuagggaaaugauca

SEQ ID NO: 1892427 - RNA, 18 nt, Homo sapiens
aucucaaccccaucaucc

SEQ ID NO: 1892428 - RNA, 18 nt, Homo sapiens
accuuccccucacacucc

SEQ ID NO: 1892429 - RNA, 14 nt, Homo sapiens
uuagagacagggac

SEQ ID NO: 1892430 - RNA, 19 nt, Homo sapiens
acuaagagaaggggugcag

SEQ ID NO: 1892431 - RNA, 18 nt, Homo sapiens
ucccgauggccacugggu

SEQ ID NO: 1892432 - RNA, 22 nt, Homo sapiens
caggggacuugaaucuuuccaa

SEQ ID NO: 1892433 - RNA, 13 nt, Homo sapiens
cuuucccuaccuu

SEQ ID NO: 1892434 - RNA, 13 nt, Homo sapiens
acuuuccucucuc

SEQ ID NO: 1892435 - RNA, 20 nt, Homo sapiens
acaaaauaaugcacuuccuu

SEQ ID NO: 1892436 - RNA, 17 nt, Homo sapiens
agcaauagggugcaguu

SEQ ID NO: 1892437 - RNA, 14 nt, Homo sapiens
augaggggugcugg

SEQ ID NO: 1892438 - RNA, 14 nt, Homo sapiens
ccuagcauuucaaa

SEQ ID NO: 1892439 - RNA, 14 nt, Homo sapiens
ccuuaaauuucugc

SEQ ID NO: 1892440 - RNA, 18 nt, Homo sapiens
auuagaggauugcacuag

SEQ ID NO: 1892441 - RNA, 19 nt, Homo sapiens
agguauuuauugagcaccu

SEQ ID NO: 1892442 - RNA, 13 nt, Homo sapiens
uguugccagagau

SEQ ID NO: 1892443 - RNA, 19 nt, Homo sapiens
ggaaaucaaaagggccaaa

SEQ ID NO: 1892444 - RNA, 21 nt, Homo sapiens
uagauaauuucagggugcagc

SEQ ID NO: 1892445 - RNA, 16 nt, Homo sapiens
uucucauaaacagagu

SEQ ID NO: 1892446 - RNA, 19 nt, Homo sapiens
uuccaaacaggcucagagg

SEQ ID NO: 1892447 - RNA, 20 nt, Homo sapiens
ucauucuacugaacagucca

SEQ ID NO: 1892448 - RNA, 14 nt, Homo sapiens
uuuaugacaggaug

SEQ ID NO: 1892449 - RNA, 14 nt, Homo sapiens
auggacacugugac

SEQ ID NO: 1892450 - RNA, 12 nt, Homo sapiens
uguugacugugu

SEQ ID NO: 1892451 - RNA, 17 nt, Homo sapiens
auaucaguuacaguggc

SEQ ID NO: 1892452 - RNA, 17 nt, Homo sapiens
uggguuggacaaccuca

SEQ ID NO: 1892453 - RNA, 22 nt, Homo sapiens
aucaguccucgcggcucuccag

SEQ ID NO: 1892454 - RNA, 12 nt, Homo sapiens
ucccuugagggc

SEQ ID NO: 1892455 - RNA, 20 nt, Homo sapiens
uuuuucuuugacaucauuca

SEQ ID NO: 1892456 - RNA, 22 nt, Homo sapiens
ugguuuuguuuucaaugaauua

SEQ ID NO: 1892457 - RNA, 22 nt, Homo sapiens
aaggaguauaguaaaugccuca

SEQ ID NO: 1892458 - RNA, 18 nt, Homo sapiens
uugagaaguuacuuucca

SEQ ID NO: 1892459 - RNA, 15 nt, Homo sapiens
cauccuugggaccug

SEQ ID NO: 1892460 - RNA, 15 nt, Homo sapiens
caacaaggggucaau

SEQ ID NO: 1892461 - RNA, 23 nt, Homo sapiens
auaagagauagcagaggaaaaag

SEQ ID NO: 1892462 - RNA, 19 nt, Homo sapiens
ucauuuuguggauauaguu

SEQ ID NO: 1892463 - RNA, 16 nt, Homo sapiens
accgccaugcaugaug

SEQ ID NO: 1892464 - RNA, 14 nt, Homo sapiens
uuacacccaugcac

SEQ ID NO: 1892465 - RNA, 22 nt, Homo sapiens
aaagcucaugcauuucaagcag

SEQ ID NO: 1892466 - RNA, 15 nt, Homo sapiens
uaaaucguaaccuau

SEQ ID NO: 1892467 - RNA, 14 nt, Homo sapiens
aucugucauuugag

SEQ ID NO: 1892468 - RNA, 14 nt, Homo sapiens
caaauacaucucca

SEQ ID NO: 1892469 - RNA, 23 nt, Homo sapiens
cggaaacggucacgagacccaga

SEQ ID NO: 1892470 - RNA, 15 nt, Homo sapiens
guuuccuuucauuua

SEQ ID NO: 1892471 - RNA, 20 nt, Homo sapiens
gccaaggcucacaugcuccu

SEQ ID NO: 1892472 - RNA, 16 nt, Homo sapiens
gagcuucaaaaugaga

SEQ ID NO: 1892473 - RNA, 21 nt, Homo sapiens
gugcccuuuucauauacuuau

SEQ ID NO: 1892474 - RNA, 22 nt, Homo sapiens
uaauccacugugacuuugccca

SEQ ID NO: 1892475 - RNA, 15 nt, Homo sapiens
cccacccaacuaauu

SEQ ID NO: 1892476 - RNA, 13 nt, Homo sapiens
uugaaaacacugc

SEQ ID NO: 1892477 - RNA, 23 nt, Homo sapiens
cuaagaacuguggucugguguuc

SEQ ID NO: 1892478 - RNA, 22 nt, Homo sapiens
gucucauuucucauaauuuugc

SEQ ID NO: 1892479 - RNA, 18 nt, Homo sapiens
aauucaaaaauguacaaa

SEQ ID NO: 1892480 - RNA, 16 nt, Homo sapiens
uggagaggaacccaga

SEQ ID NO: 1892481 - RNA, 12 nt, Homo sapiens
ggcuccuaccug

SEQ ID NO: 1892482 - RNA, 18 nt, Homo sapiens
ccugcucacaaaaucacu

SEQ ID NO: 1892483 - RNA, 22 nt, Homo sapiens
acaaauguuguauaaccaauac

SEQ ID NO: 1892484 - RNA, 21 nt, Homo sapiens
gauucuacaaaaaaccaggau

SEQ ID NO: 1892485 - RNA, 22 nt, Homo sapiens
ggcugcuucuccaccuccccca

SEQ ID NO: 1892486 - RNA, 17 nt, Homo sapiens
cuggcuucucuccucag

SEQ ID NO: 1892487 - RNA, 20 nt, Homo sapiens
uauuauuuucccauuugcug

SEQ ID NO: 1892488 - RNA, 14 nt, Homo sapiens
ugacguguguggcu

SEQ ID NO: 1892489 - RNA, 20 nt, Homo sapiens
aacugggggcucuguauaua

SEQ ID NO: 1892490 - RNA, 22 nt, Homo sapiens
caacccgucuggcccaccaggg

SEQ ID NO: 1892491 - RNA, 15 nt, Homo sapiens
gccugcugcucucag

SEQ ID NO: 1892492 - RNA, 17 nt, Homo sapiens
ucccccuacccauaucc

SEQ ID NO: 1892493 - RNA, 19 nt, Homo sapiens
agggaagccccacuugaag

SEQ ID NO: 1892494 - RNA, 18 nt, Homo sapiens
gaagguucccaaggacau

SEQ ID NO: 1892495 - RNA, 12 nt, Homo sapiens
auguggauauca

SEQ ID NO: 1892496 - RNA, 17 nt, Homo sapiens
cuucuccgcccauucug

SEQ ID NO: 1892497 - RNA, 24 nt, Homo sapiens
acaaacuuggucuuacaucugugu

SEQ ID NO: 1892498 - RNA, 15 nt, Homo sapiens
augaugccacuuccc

SEQ ID NO: 1892499 - RNA, 19 nt, Homo sapiens
gcuugucuucguccaucug

SEQ ID NO: 1892500 - RNA, 18 nt, Homo sapiens
agaaucagaauuguagcc

SEQ ID NO: 1892501 - RNA, 13 nt, Homo sapiens
ugacaacugaaag

SEQ ID NO: 1892502 - RNA, 17 nt, Homo sapiens
gaacagauggcugugaa

SEQ ID NO: 1892503 - RNA, 18 nt, Homo sapiens
ucccccaccuauccccau

SEQ ID NO: 1892504 - RNA, 21 nt, Homo sapiens
uaguuucuucauuucaggaag

SEQ ID NO: 1892505 - RNA, 18 nt, Homo sapiens
gguaacauagaugccugg

SEQ ID NO: 1892506 - RNA, 16 nt, Homo sapiens
uggcauuuaaggagca

SEQ ID NO: 1892507 - RNA, 21 nt, Homo sapiens
aaacuuuuuaauaaaguauau

SEQ ID NO: 1892508 - RNA, 22 nt, Homo sapiens
cuucgugugcagcuagagcuuu

SEQ ID NO: 1892509 - RNA, 21 nt, Homo sapiens
cacacaaagaggaugauuucc

SEQ ID NO: 1892510 - RNA, 17 nt, Homo sapiens
ugguuccucucuuggca

SEQ ID NO: 1892511 - RNA, 21 nt, Homo sapiens
acggcucaagugaauuugaau

SEQ ID NO: 1892512 - RNA, 12 nt, Homo sapiens
uuuauacaggaa

SEQ ID NO: 1892513 - RNA, 22 nt, Homo sapiens
agcagcucaaaggcacagugaa

SEQ ID NO: 1892514 - RNA, 15 nt, Homo sapiens
agacacaauauguau

SEQ ID NO: 1892515 - RNA, 19 nt, Homo sapiens
auaagcacugaaaaacaac

SEQ ID NO: 1892516 - RNA, 13 nt, Homo sapiens
cugucugucucca

SEQ ID NO: 1892517 - RNA, 19 nt, Homo sapiens
acagcagauccaccugcac

SEQ ID NO: 1892518 - RNA, 14 nt, Homo sapiens
accugugcuuucau

SEQ ID NO: 1892519 - RNA, 15 nt, Homo sapiens
ucacccuauauauaa

SEQ ID NO: 1892520 - RNA, 23 nt, Homo sapiens
caacagcaccuccccgcugggaa

SEQ ID NO: 1892521 - RNA, 23 nt, Homo sapiens
cccuugggugcgguuugcucagc

SEQ ID NO: 1892522 - RNA, 21 nt, Homo sapiens
ccacaggccugagauuucauc

SEQ ID NO: 1892523 - RNA, 19 nt, Homo sapiens
cagaggcggagcugugcuc

SEQ ID NO: 1892524 - RNA, 19 nt, Homo sapiens
gcauccucucuggucuuuu

SEQ ID NO: 1892525 - RNA, 19 nt, Homo sapiens
aaaugucuucuguauucac

SEQ ID NO: 1892526 - RNA, 15 nt, Homo sapiens
gacacuacauaucua

SEQ ID NO: 1892527 - RNA, 16 nt, Homo sapiens
uucuggacacugucau

SEQ ID NO: 1892528 - RNA, 13 nt, Homo sapiens
agagcucuucaga

SEQ ID NO: 1892529 - RNA, 21 nt, Homo sapiens
uaaaguauguuuuuacauuau

SEQ ID NO: 1892530 - RNA, 19 nt, Homo sapiens
gcaucuuucauaguucugu

SEQ ID NO: 1892531 - RNA, 16 nt, Homo sapiens
agugaagacacuggcu

SEQ ID NO: 1892532 - RNA, 13 nt, Homo sapiens
caauucauucauu

SEQ ID NO: 1892533 - RNA, 14 nt, Homo sapiens
ucaguauuuuccag

SEQ ID NO: 1892534 - RNA, 20 nt, Homo sapiens
cuuccaugcaaaggcuuccu

SEQ ID NO: 1892535 - RNA, 23 nt, Homo sapiens
ucugaguuccggcaccaguagca

SEQ ID NO: 1892536 - RNA, 11 nt, Homo sapiens
ccacauugcac

SEQ ID NO: 1892537 - RNA, 23 nt, Homo sapiens
aauauuuuccaugaaaaugcaac

SEQ ID NO: 1892538 - RNA, 11 nt, Homo sapiens
cagugaucuca

SEQ ID NO: 1892539 - RNA, 22 nt, Homo sapiens
cagcccacccuccugucuuccc

SEQ ID NO: 1892540 - RNA, 19 nt, Homo sapiens
cggcaccagugccucagug

SEQ ID NO: 1892541 - RNA, 19 nt, Homo sapiens
auaugcuacaguacuaugu

SEQ ID NO: 1892542 - RNA, 15 nt, Homo sapiens
ccaauuccaccaaga

SEQ ID NO: 1892543 - RNA, 16 nt, Homo sapiens
agaacacuacugcuaa

SEQ ID NO: 1892544 - RNA, 14 nt, Homo sapiens
aagaaacuccgaag

SEQ ID NO: 1892545 - RNA, 17 nt, Homo sapiens
auauaaauuuucccaaa

SEQ ID NO: 1892546 - RNA, 19 nt, Homo sapiens
uuuuaggaaaggaugauca

SEQ ID NO: 1892547 - RNA, 23 nt, Homo sapiens
uuauagugaaacauguacuuuga

SEQ ID NO: 1892548 - RNA, 13 nt, Homo sapiens
acagcacagccag

SEQ ID NO: 1892549 - RNA, 12 nt, Homo sapiens
ugaccauggcac

SEQ ID NO: 1892550 - RNA, 15 nt, Homo sapiens
uaaacauauuuccua

SEQ ID NO: 1892551 - RNA, 18 nt, Homo sapiens
ccucuccccacugcucau

SEQ ID NO: 1892552 - RNA, 16 nt, Homo sapiens
guagcugaaaggggaa

SEQ ID NO: 1892553 - RNA, 21 nt, Homo sapiens
aguucguggaaggcuguauga

SEQ ID NO: 1892554 - RNA, 22 nt, Homo sapiens
gcagugcccagugauggcauua

SEQ ID NO: 1892555 - RNA, 12 nt, Homo sapiens
gaaaagcacuuu

SEQ ID NO: 1892556 - RNA, 18 nt, Homo sapiens
acccaaggucaccaaaca

SEQ ID NO: 1892557 - RNA, 22 nt, Homo sapiens
cccaagaucugccagaccugca

SEQ ID NO: 1892558 - RNA, 16 nt, Homo sapiens
ugccaggacacugccu

SEQ ID NO: 1892559 - RNA, 22 nt, Homo sapiens
agcccauuggcucccaucugaa

SEQ ID NO: 1892560 - RNA, 21 nt, Homo sapiens
auuuguaaagcucacuuuacu

SEQ ID NO: 1892561 - RNA, 20 nt, Homo sapiens
cacagcuguuuccucacguc

SEQ ID NO: 1892562 - RNA, 16 nt, Homo sapiens
agcaagucccaucuca

SEQ ID NO: 1892563 - RNA, 20 nt, Homo sapiens
cagcaacugcccuuccaggu

SEQ ID NO: 1892564 - RNA, 22 nt, Homo sapiens
cuuagaccuguagauagugaua

SEQ ID NO: 1892565 - RNA, 12 nt, Homo sapiens
caaaauuacuuc

SEQ ID NO: 1892566 - RNA, 16 nt, Homo sapiens
caugaaaaguuuucaa

SEQ ID NO: 1892567 - RNA, 16 nt, Homo sapiens
accccucugucuucaa

SEQ ID NO: 1892568 - RNA, 18 nt, Homo sapiens
uaaaggccuccuccccca

SEQ ID NO: 1892569 - RNA, 23 nt, Homo sapiens
ucuugagguuuucugugcuuuga

SEQ ID NO: 1892570 - RNA, 14 nt, Homo sapiens
uggugcccaccugu

SEQ ID NO: 1892571 - RNA, 15 nt, Homo sapiens
ugugauuagaucaca

SEQ ID NO: 1892572 - RNA, 17 nt, Homo sapiens
agaugaucccagucacu

SEQ ID NO: 1892573 - RNA, 22 nt, Homo sapiens
caaagcguuucuuuacuucuca

SEQ ID NO: 1892574 - RNA, 22 nt, Homo sapiens
ggaacacccgacuccucaaaag

SEQ ID NO: 1892575 - RNA, 21 nt, Homo sapiens
ucaaaauugaccucaaaagaa

SEQ ID NO: 1892576 - RNA, 20 nt, Homo sapiens
cacucaacaaaagugcuuug

SEQ ID NO: 1892577 - RNA, 23 nt, Homo sapiens
augucaucaaauauuaccaaaaa

SEQ ID NO: 1892578 - RNA, 16 nt, Homo sapiens
cguacaaguaguucug

SEQ ID NO: 1892579 - RNA, 15 nt, Homo sapiens
uaauuuuccaaugca

SEQ ID NO: 1892580 - RNA, 22 nt, Homo sapiens
gcccugcaugcugcccagccac

SEQ ID NO: 1892581 - RNA, 14 nt, Homo sapiens
cccacauucugaug

SEQ ID NO: 1892582 - RNA, 17 nt, Homo sapiens
ggggugccgcuuucucu

SEQ ID NO: 1892583 - RNA, 14 nt, Homo sapiens
caugaauuccuuaa

SEQ ID NO: 1892584 - RNA, 14 nt, Homo sapiens
acagccuuaaaucc

SEQ ID NO: 1892585 - RNA, 23 nt, Homo sapiens
uaguugccguggcaacuguggaa

SEQ ID NO: 1892586 - RNA, 22 nt, Homo sapiens
ccauguuguaaugcugcacuuc

SEQ ID NO: 1892587 - RNA, 18 nt, Homo sapiens
ucuuuccuacucugggaa

SEQ ID NO: 1892588 - RNA, 16 nt, Homo sapiens
uuccucugccaggugc

SEQ ID NO: 1892589 - RNA, 15 nt, Homo sapiens
aucucuuccccagag

SEQ ID NO: 1892590 - RNA, 20 nt, Homo sapiens
auagagguaaaauuugcaca

SEQ ID NO: 1892591 - RNA, 18 nt, Homo sapiens
aguuuccucaccagaaaa

SEQ ID NO: 1892592 - RNA, 14 nt, Homo sapiens
ucugggguggggcu

SEQ ID NO: 1892593 - RNA, 19 nt, Homo sapiens
cuaucaaaugugauggcua

SEQ ID NO: 1892594 - RNA, 21 nt, Homo sapiens
acaggcgucugccaccaugcc

SEQ ID NO: 1892595 - RNA, 19 nt, Homo sapiens
acagacuucaucauugugc

SEQ ID NO: 1892596 - RNA, 19 nt, Homo sapiens
ggcacccacacacaaagag

SEQ ID NO: 1892597 - RNA, 18 nt, Homo sapiens
uaaccagaucauugugaa

SEQ ID NO: 1892598 - RNA, 15 nt, Homo sapiens
ugggaaacacuuuga

SEQ ID NO: 1892599 - RNA, 22 nt, Homo sapiens
uuggacuacauauuugcacuga

SEQ ID NO: 1892600 - RNA, 20 nt, Homo sapiens
ugccaagggggugacuggaa

SEQ ID NO: 1892601 - RNA, 16 nt, Homo sapiens
cauauauacaggcaua

SEQ ID NO: 1892602 - RNA, 23 nt, Homo sapiens
cccccaguaaaaucaaaugugca

SEQ ID NO: 1892603 - RNA, 17 nt, Homo sapiens
gccggcucuaguaccuu

SEQ ID NO: 1892604 - RNA, 23 nt, Homo sapiens
ggcaaauauuuugucacugcugu

SEQ ID NO: 1892605 - RNA, 23 nt, Homo sapiens
uaguacuugggagaccuguaauc

SEQ ID NO: 1892606 - RNA, 18 nt, Homo sapiens
auucugaaggccuuguua

SEQ ID NO: 1892607 - RNA, 20 nt, Homo sapiens
uuaccuugaaaugcuguuag

SEQ ID NO: 1892608 - RNA, 19 nt, Homo sapiens
uuuagcaucuuccuugaua

SEQ ID NO: 1892609 - RNA, 22 nt, Homo sapiens
cgcgccccuguccauccgucuc

SEQ ID NO: 1892610 - RNA, 16 nt, Homo sapiens
gaagugagggcucacu

SEQ ID NO: 1892611 - RNA, 20 nt, Homo sapiens
cugucauuuuggcaucugca

SEQ ID NO: 1892612 - RNA, 18 nt, Homo sapiens
guaaaagaugaaguuuua

SEQ ID NO: 1892613 - RNA, 16 nt, Homo sapiens
ucgagaccagccugac

SEQ ID NO: 1892614 - RNA, 19 nt, Homo sapiens
ugccuauaauacuugcaac

SEQ ID NO: 1892615 - RNA, 21 nt, Homo sapiens
cagucacuuaacuuacaugac

SEQ ID NO: 1892616 - RNA, 14 nt, Homo sapiens
gcuaugcauuugaa

SEQ ID NO: 1892617 - RNA, 17 nt, Homo sapiens
agcacugggugaccagc

SEQ ID NO: 1892618 - RNA, 17 nt, Homo sapiens
uguccuugaaugccaua

SEQ ID NO: 1892619 - RNA, 12 nt, Homo sapiens
uauugaaugccu

SEQ ID NO: 1892620 - RNA, 16 nt, Homo sapiens
aauucuaugucuagca

SEQ ID NO: 1892621 - RNA, 21 nt, Homo sapiens
uuuaaccaaggaggggccagu

SEQ ID NO: 1892622 - RNA, 16 nt, Homo sapiens
cacagcccuaccccgc

SEQ ID NO: 1892623 - RNA, 16 nt, Homo sapiens
caaaugauaaguacua

SEQ ID NO: 1892624 - RNA, 11 nt, Homo sapiens
agcacaaacca

SEQ ID NO: 1892625 - RNA, 22 nt, Homo sapiens
uugccaauagugucauccucac

SEQ ID NO: 1892626 - RNA, 14 nt, Homo sapiens
aaccaagcuugucu

SEQ ID NO: 1892627 - RNA, 14 nt, Homo sapiens
agguuuuaacugaa

SEQ ID NO: 1892628 - RNA, 23 nt, Homo sapiens
gaaaugagcagcccuuacaguau

SEQ ID NO: 1892629 - RNA, 14 nt, Homo sapiens
guuuaacugcugca

SEQ ID NO: 1892630 - RNA, 19 nt, Homo sapiens
uccaggauguacaaagaac

SEQ ID NO: 1892631 - RNA, 20 nt, Homo sapiens
ucuccccaguccucaggcag

SEQ ID NO: 1892632 - RNA, 16 nt, Homo sapiens
uagagucaauuugcug

SEQ ID NO: 1892633 - RNA, 21 nt, Homo sapiens
aggcuucccacuauuuauuac

SEQ ID NO: 1892634 - RNA, 16 nt, Homo sapiens
uacauaauauaugacu

SEQ ID NO: 1892635 - RNA, 19 nt, Homo sapiens
caucuuccaccucaccucu

SEQ ID NO: 1892636 - RNA, 19 nt, Homo sapiens
aguuaauuaugugcauauu

SEQ ID NO: 1892637 - RNA, 22 nt, Homo sapiens
accaguuuuuggauaaagaaua

SEQ ID NO: 1892638 - RNA, 14 nt, Homo sapiens
augucccaccacag

SEQ ID NO: 1892639 - RNA, 17 nt, Homo sapiens
gcaugaauccaguccag

SEQ ID NO: 1892640 - RNA, 18 nt, Homo sapiens
ggaacaauagaauaaucu

SEQ ID NO: 1892641 - RNA, 18 nt, Homo sapiens
aggcucuguggagggcau

SEQ ID NO: 1892642 - RNA, 20 nt, Homo sapiens
ccuauggaauuuauaauuca

SEQ ID NO: 1892643 - RNA, 21 nt, Homo sapiens
ugaacucaccauagagaccca

SEQ ID NO: 1892644 - RNA, 22 nt, Homo sapiens
acuacuuccggcuuauggucuc

SEQ ID NO: 1892645 - RNA, 16 nt, Homo sapiens
cuuuccccagacacau

SEQ ID NO: 1892646 - RNA, 16 nt, Homo sapiens
aaacaggaacaaucca

SEQ ID NO: 1892647 - RNA, 19 nt, Homo sapiens
cucugugaggaaagcacac

SEQ ID NO: 1892648 - RNA, 13 nt, Homo sapiens
aaacuaaccaucu

SEQ ID NO: 1892649 - RNA, 13 nt, Homo sapiens
cuugaaacauaga

SEQ ID NO: 1892650 - RNA, 13 nt, Homo sapiens
aaauuaaccauuu

SEQ ID NO: 1892651 - RNA, 15 nt, Homo sapiens
cuuucugggaugcaa

SEQ ID NO: 1892652 - RNA, 13 nt, Homo sapiens
uggccugugaagc

SEQ ID NO: 1892653 - RNA, 22 nt, Homo sapiens
guauauggacacuacacugggg

SEQ ID NO: 1892654 - RNA, 21 nt, Homo sapiens
aaucagcacauugucacccca

SEQ ID NO: 1892655 - RNA, 11 nt, Homo sapiens
aucaaccagca

SEQ ID NO: 1892656 - RNA, 14 nt, Homo sapiens
ugugugcaauguuc

SEQ ID NO: 1892657 - RNA, 15 nt, Homo sapiens
aagcagaacagugau

SEQ ID NO: 1892658 - RNA, 17 nt, Homo sapiens
uaaauacuguguggaac

SEQ ID NO: 1892659 - RNA, 21 nt, Homo sapiens
ggucucuauacuacauuauua

SEQ ID NO: 1892660 - RNA, 20 nt, Homo sapiens
auaucuuggacaaaucacau

SEQ ID NO: 1892661 - RNA, 19 nt, Homo sapiens
aauauuaucuuuguucucc

SEQ ID NO: 1892662 - RNA, 23 nt, Homo sapiens
agaaggcaggugagcaaccaguu

SEQ ID NO: 1892663 - RNA, 20 nt, Homo sapiens
cccccacaggagcauguccu

SEQ ID NO: 1892664 - RNA, 15 nt, Homo sapiens
caugccaacuuguga

SEQ ID NO: 1892665 - RNA, 18 nt, Homo sapiens
cggcagaugcuguuguug

SEQ ID NO: 1892666 - RNA, 13 nt, Homo sapiens
auagaaugaacca

SEQ ID NO: 1892667 - RNA, 16 nt, Homo sapiens
cuucagugagccauga

SEQ ID NO: 1892668 - RNA, 14 nt, Homo sapiens
agauuuuggccaug

SEQ ID NO: 1892669 - RNA, 20 nt, Homo sapiens
uaaguauuucagaugcuuua

SEQ ID NO: 1892670 - RNA, 20 nt, Homo sapiens
cuguugaaaagccauguuua

SEQ ID NO: 1892671 - RNA, 15 nt, Homo sapiens
uaagguaacucccau

SEQ ID NO: 1892672 - RNA, 17 nt, Homo sapiens
ugcaguuuuuguuuaca

SEQ ID NO: 1892673 - RNA, 20 nt, Homo sapiens
aggaacauuggagccugcaa

SEQ ID NO: 1892674 - RNA, 13 nt, Homo sapiens
augccucaagaac

SEQ ID NO: 1892675 - RNA, 13 nt, Homo sapiens
agacaucaaugaa

SEQ ID NO: 1892676 - RNA, 14 nt, Homo sapiens
caguuaaaggcaac

SEQ ID NO: 1892677 - RNA, 20 nt, Homo sapiens
auggucugcauuagucucau

SEQ ID NO: 1892678 - RNA, 19 nt, Homo sapiens
agccaugagugugggccau

SEQ ID NO: 1892679 - RNA, 17 nt, Homo sapiens
auuguguuacucaugau

SEQ ID NO: 1892680 - RNA, 17 nt, Homo sapiens
cccucaucuaugaggaa

SEQ ID NO: 1892681 - RNA, 15 nt, Homo sapiens
ugugauucaugagaa

SEQ ID NO: 1892682 - RNA, 16 nt, Homo sapiens
acuguccccuugauau

SEQ ID NO: 1892683 - RNA, 15 nt, Homo sapiens
uccugcugaccucac

SEQ ID NO: 1892684 - RNA, 21 nt, Homo sapiens
uccagcccgaguggucuccuc

SEQ ID NO: 1892685 - RNA, 14 nt, Homo sapiens
gcaauaaguugaau

SEQ ID NO: 1892686 - RNA, 16 nt, Homo sapiens
gagaggcgucugcugu

SEQ ID NO: 1892687 - RNA, 17 nt, Homo sapiens
cccaguggggacaggga

SEQ ID NO: 1892688 - RNA, 16 nt, Homo sapiens
uccaggugauucuguu

SEQ ID NO: 1892689 - RNA, 19 nt, Homo sapiens
cugcuaacaagucaccaaa

SEQ ID NO: 1892690 - RNA, 16 nt, Homo sapiens
guaacuacccucucaa

SEQ ID NO: 1892691 - RNA, 14 nt, Homo sapiens
ugggaggcuucccc

SEQ ID NO: 1892692 - RNA, 21 nt, Homo sapiens
cuaaggccuuuuauguaauuu

SEQ ID NO: 1892693 - RNA, 15 nt, Homo sapiens
gguaguuauucugcc

SEQ ID NO: 1892694 - RNA, 13 nt, Homo sapiens
acugugaaacugg

SEQ ID NO: 1892695 - RNA, 23 nt, Homo sapiens
cauaaacacccaugaaucaaaga

SEQ ID NO: 1892696 - RNA, 15 nt, Homo sapiens
agagaaaggacucag

SEQ ID NO: 1892697 - RNA, 15 nt, Homo sapiens
cccuccaguguauga

SEQ ID NO: 1892698 - RNA, 14 nt, Homo sapiens
ugcugcuccugaua

SEQ ID NO: 1892699 - RNA, 21 nt, Homo sapiens
guugaguuaugauaacaccag

SEQ ID NO: 1892700 - RNA, 22 nt, Homo sapiens
aagacucuccacugaccugguu

SEQ ID NO: 1892701 - RNA, 22 nt, Homo sapiens
ggcugguauucucucuaugcaa

SEQ ID NO: 1892702 - RNA, 18 nt, Homo sapiens
uguuguuuucccaaagag

SEQ ID NO: 1892703 - RNA, 15 nt, Homo sapiens
acagaaauuguauau

SEQ ID NO: 1892704 - RNA, 12 nt, Homo sapiens
ucacucacagag

SEQ ID NO: 1892705 - RNA, 21 nt, Homo sapiens
uucuaaguggaaaaaguauua

SEQ ID NO: 1892706 - RNA, 12 nt, Homo sapiens
auccaauucauc

SEQ ID NO: 1892707 - RNA, 15 nt, Homo sapiens
uuaagccaauuucaa

SEQ ID NO: 1892708 - RNA, 22 nt, Homo sapiens
accucuggccaaauaugcacuu

SEQ ID NO: 1892709 - RNA, 13 nt, Homo sapiens
auguuuugugauu

SEQ ID NO: 1892710 - RNA, 16 nt, Homo sapiens
cuguccucgcagagaa

SEQ ID NO: 1892711 - RNA, 16 nt, Homo sapiens
cucucccugccaaguc

SEQ ID NO: 1892712 - RNA, 14 nt, Homo sapiens
cagaugaucugggc

SEQ ID NO: 1892713 - RNA, 23 nt, Homo sapiens
ucccaggccagcaagcucuucac

SEQ ID NO: 1892714 - RNA, 15 nt, Homo sapiens
aaacauuccaggaaa

SEQ ID NO: 1892715 - RNA, 20 nt, Homo sapiens
aacuccauacuccacuccaa

SEQ ID NO: 1892716 - RNA, 19 nt, Homo sapiens
aaaauuguuuagugauauu

SEQ ID NO: 1892717 - RNA, 19 nt, Homo sapiens
agccaggcugcuaaccugg

SEQ ID NO: 1892718 - RNA, 16 nt, Homo sapiens
agacacccucuccuua

SEQ ID NO: 1892719 - RNA, 17 nt, Homo sapiens
ugagggaccaagcugcu

SEQ ID NO: 1892720 - RNA, 15 nt, Homo sapiens
cacaauuccaugaau

SEQ ID NO: 1892721 - RNA, 15 nt, Homo sapiens
acgcugcgugccaug

SEQ ID NO: 1892722 - RNA, 14 nt, Homo sapiens
gcagccuggccaac

SEQ ID NO: 1892723 - RNA, 20 nt, Homo sapiens
gagaguccaucagccuccau

SEQ ID NO: 1892724 - RNA, 21 nt, Homo sapiens
gaggggcagcgcaugugugca

SEQ ID NO: 1892725 - RNA, 13 nt, Homo sapiens
aacaacaacuauc

SEQ ID NO: 1892726 - RNA, 13 nt, Homo sapiens
acuuaacauucug

SEQ ID NO: 1892727 - RNA, 17 nt, Homo sapiens
caauaucuuuauugcau

SEQ ID NO: 1892728 - RNA, 22 nt, Homo sapiens
cccucccgggggcacugccuga

SEQ ID NO: 1892729 - RNA, 16 nt, Homo sapiens
auaaagcuucucucug

SEQ ID NO: 1892730 - RNA, 11 nt, Homo sapiens
ucgcucugagc

SEQ ID NO: 1892731 - RNA, 14 nt, Homo sapiens
uccagcugcugucu

SEQ ID NO: 1892732 - RNA, 13 nt, Homo sapiens
accguggggagcc

SEQ ID NO: 1892733 - RNA, 13 nt, Homo sapiens
caagaauaauuca

SEQ ID NO: 1892734 - RNA, 13 nt, Homo sapiens
auucacacacagc

SEQ ID NO: 1892735 - RNA, 17 nt, Homo sapiens
aucacggauggugcaug

SEQ ID NO: 1892736 - RNA, 20 nt, Homo sapiens
cuucagaggccuggcaucuu

SEQ ID NO: 1892737 - RNA, 12 nt, Homo sapiens
cagaguaaaaua

SEQ ID NO: 1892738 - RNA, 14 nt, Homo sapiens
uuccacacugcacu

SEQ ID NO: 1892739 - RNA, 12 nt, Homo sapiens
ccucucuggaaa

SEQ ID NO: 1892740 - RNA, 21 nt, Homo sapiens
ucaacuuacucauaaagggac

SEQ ID NO: 1892741 - RNA, 17 nt, Homo sapiens
caaaccggacccggccg

SEQ ID NO: 1892742 - RNA, 19 nt, Homo sapiens
guaaagaaauuuacuauau

SEQ ID NO: 1892743 - RNA, 18 nt, Homo sapiens
aagguugaaaagacaaua

SEQ ID NO: 1892744 - RNA, 14 nt, Homo sapiens
auccuauaagcuua

SEQ ID NO: 1892745 - RNA, 14 nt, Homo sapiens
uguuccuauuuccc

SEQ ID NO: 1892746 - RNA, 13 nt, Homo sapiens
uaaaguaguuccu

SEQ ID NO: 1892747 - RNA, 12 nt, Homo sapiens
caccugucauug

SEQ ID NO: 1892748 - RNA, 20 nt, Homo sapiens
agagacacaaguggccuuaa

SEQ ID NO: 1892749 - RNA, 21 nt, Homo sapiens
cacauccucugucuauuugag

SEQ ID NO: 1892750 - RNA, 13 nt, Homo sapiens
acugguccauuuc

SEQ ID NO: 1892751 - RNA, 16 nt, Homo sapiens
gcaauuuucuaagcaa

SEQ ID NO: 1892752 - RNA, 19 nt, Homo sapiens
agacaccuucugugcucau

SEQ ID NO: 1892753 - RNA, 17 nt, Homo sapiens
agguaacaguuauauca

SEQ ID NO: 1892754 - RNA, 18 nt, Homo sapiens
agcugcaggggugccugg

SEQ ID NO: 1892755 - RNA, 12 nt, Homo sapiens
auaagaaaaagg

SEQ ID NO: 1892756 - RNA, 16 nt, Homo sapiens
cagacaacaccuuccu

SEQ ID NO: 1892757 - RNA, 12 nt, Homo sapiens
augaguuugaca

SEQ ID NO: 1892758 - RNA, 23 nt, Homo sapiens
gcacaccuuagguugacauucag

SEQ ID NO: 1892759 - RNA, 20 nt, Homo sapiens
agaaaccuggccuuauauca

SEQ ID NO: 1892760 - RNA, 14 nt, Homo sapiens
gauaauaucuuugu

SEQ ID NO: 1892761 - RNA, 23 nt, Homo sapiens
gaagccccauguguaccuacaga

SEQ ID NO: 1892762 - RNA, 19 nt, Homo sapiens
uucugggucaugcacugag

SEQ ID NO: 1892763 - RNA, 19 nt, Homo sapiens
caggcgccuggcacauuuc

SEQ ID NO: 1892764 - RNA, 19 nt, Homo sapiens
ucacugguauuaacuuuau

SEQ ID NO: 1892765 - RNA, 16 nt, Homo sapiens
uccugugcuuucugca

SEQ ID NO: 1892766 - RNA, 23 nt, Homo sapiens
agcaguuucagguagaggugcau

SEQ ID NO: 1892767 - RNA, 24 nt, Homo sapiens
acuacauuuuaaaaacugacuuaa

SEQ ID NO: 1892768 - RNA, 21 nt, Homo sapiens
ggcuacuaccuagggcacuuu

SEQ ID NO: 1892769 - RNA, 16 nt, Homo sapiens
aggggugguguggugu

SEQ ID NO: 1892770 - RNA, 15 nt, Homo sapiens
aauucacuuaggguc

SEQ ID NO: 1892771 - RNA, 15 nt, Homo sapiens
cagacucacugggaa

SEQ ID NO: 1892772 - RNA, 21 nt, Homo sapiens
gcaguggugcaugcacugucu

SEQ ID NO: 1892773 - RNA, 11 nt, Homo sapiens
cuaagcucauc

SEQ ID NO: 1892774 - RNA, 12 nt, Homo sapiens
aagaauuacaua

SEQ ID NO: 1892775 - RNA, 15 nt, Homo sapiens
cgugacaacacaaau

SEQ ID NO: 1892776 - RNA, 21 nt, Homo sapiens
agauuuauggaaaauacucug

SEQ ID NO: 1892777 - RNA, 16 nt, Homo sapiens
caggugccuucccaga

SEQ ID NO: 1892778 - RNA, 20 nt, Homo sapiens
ugcuuucucuucuacuucuu

SEQ ID NO: 1892779 - RNA, 14 nt, Homo sapiens
cugaaaaugugcau

SEQ ID NO: 1892780 - RNA, 13 nt, Homo sapiens
cuggucucagugc

SEQ ID NO: 1892781 - RNA, 13 nt, Homo sapiens
agaggaaauucuu

SEQ ID NO: 1892782 - RNA, 23 nt, Homo sapiens
cauggccgggcccucuguagcuc

SEQ ID NO: 1892783 - RNA, 22 nt, Homo sapiens
aaaagcugcuauccaaugauau

SEQ ID NO: 1892784 - RNA, 12 nt, Homo sapiens
ugagcugggaag

SEQ ID NO: 1892785 - RNA, 19 nt, Homo sapiens
gccaaccagagaagcugcu

SEQ ID NO: 1892786 - RNA, 20 nt, Homo sapiens
accucuugggcaugcucagc

SEQ ID NO: 1892787 - RNA, 17 nt, Homo sapiens
gagaugcgacauuagca

SEQ ID NO: 1892788 - RNA, 19 nt, Homo sapiens
ugaacucuucacucuucaa

SEQ ID NO: 1892789 - RNA, 14 nt, Homo sapiens
guauccaccuugca

SEQ ID NO: 1892790 - RNA, 13 nt, Homo sapiens
gcaugggcacucc

SEQ ID NO: 1892791 - RNA, 16 nt, Homo sapiens
auaugaaaacuauaca

SEQ ID NO: 1892792 - RNA, 23 nt, Homo sapiens
uggcccagagagguuaacuaaua

SEQ ID NO: 1892793 - RNA, 15 nt, Homo sapiens
auaauaauuacuuaa

SEQ ID NO: 1892794 - RNA, 21 nt, Homo sapiens
uguugccccauuccuaagagg

SEQ ID NO: 1892795 - RNA, 22 nt, Homo sapiens
gucugcuuuggggcuuaucaga

SEQ ID NO: 1892796 - RNA, 22 nt, Homo sapiens
ucgauuucaccaagaaguggag

SEQ ID NO: 1892797 - RNA, 16 nt, Homo sapiens
uucccuugaaagggaa

SEQ ID NO: 1892798 - RNA, 19 nt, Homo sapiens
agagaucagcgacccugag

SEQ ID NO: 1892799 - RNA, 15 nt, Homo sapiens
aguaguacaaugagu

SEQ ID NO: 1892800 - RNA, 20 nt, Homo sapiens
cccuccagaccucccagaga

SEQ ID NO: 1892801 - RNA, 19 nt, Homo sapiens
aaggagcuacugacauucc

SEQ ID NO: 1892802 - RNA, 19 nt, Homo sapiens
ccugguagaccacugccau

SEQ ID NO: 1892803 - RNA, 13 nt, Homo sapiens
acaacaggcugug

SEQ ID NO: 1892804 - RNA, 13 nt, Homo sapiens
augagaacauuua

SEQ ID NO: 1892805 - RNA, 19 nt, Homo sapiens
uguaacuguuuucaaggag

SEQ ID NO: 1892806 - RNA, 21 nt, Homo sapiens
gccacaccaaucagagagccu

SEQ ID NO: 1892807 - RNA, 17 nt, Homo sapiens
acuggcuuuugccugua

SEQ ID NO: 1892808 - RNA, 23 nt, Homo sapiens
gccuaaucuguaaucacauuucu

SEQ ID NO: 1892809 - RNA, 20 nt, Homo sapiens
cccgcaggcuucugugugcu

SEQ ID NO: 1892810 - RNA, 16 nt, Homo sapiens
uucuguaaacugugcu

SEQ ID NO: 1892811 - RNA, 12 nt, Homo sapiens
ugaugacuaugg

SEQ ID NO: 1892812 - RNA, 20 nt, Homo sapiens
gcuggagugcaguggcgcga

SEQ ID NO: 1892813 - RNA, 20 nt, Homo sapiens
gcuggaguacaguggcacga

SEQ ID NO: 1892814 - RNA, 14 nt, Homo sapiens
aacuuaaaagauuc

SEQ ID NO: 1892815 - RNA, 23 nt, Homo sapiens
aaggaagguucuggugugaacua

SEQ ID NO: 1892816 - RNA, 16 nt, Homo sapiens
auaaugaaaacauccu

SEQ ID NO: 1892817 - RNA, 16 nt, Homo sapiens
uauauaacuacauuaa

SEQ ID NO: 1892818 - RNA, 14 nt, Homo sapiens
cgguggcccugacu

SEQ ID NO: 1892819 - RNA, 21 nt, Homo sapiens
uaacaucuauuauaaaaccau

SEQ ID NO: 1892820 - RNA, 21 nt, Homo sapiens
gggaaaccccccagagcucuu

SEQ ID NO: 1892821 - RNA, 19 nt, Homo sapiens
aagugacugaccaugcacu

SEQ ID NO: 1892822 - RNA, 19 nt, Homo sapiens
agcagaagcuggaggcaca

SEQ ID NO: 1892823 - RNA, 16 nt, Homo sapiens
aauuuaauauuccugg

SEQ ID NO: 1892824 - RNA, 16 nt, Homo sapiens
gcaucugcagccacuu

SEQ ID NO: 1892825 - RNA, 17 nt, Homo sapiens
ugucuuagcuguauaca

SEQ ID NO: 1892826 - RNA, 17 nt, Homo sapiens
ucuugagagcugcugag

SEQ ID NO: 1892827 - RNA, 12 nt, Homo sapiens
ccauaacaaccu

SEQ ID NO: 1892828 - RNA, 13 nt, Homo sapiens
augaccuggagca

SEQ ID NO: 1892829 - RNA, 11 nt, Homo sapiens
gaaccacugag

SEQ ID NO: 1892830 - RNA, 18 nt, Homo sapiens
aguugaauaguugcuuaa

SEQ ID NO: 1892831 - RNA, 15 nt, Homo sapiens
acugagcgaccccag

SEQ ID NO: 1892832 - RNA, 13 nt, Homo sapiens
gccugagucaccu

SEQ ID NO: 1892833 - RNA, 16 nt, Homo sapiens
ucaugaauuccuuaaa

SEQ ID NO: 1892834 - RNA, 18 nt, Homo sapiens
caauacccuuggcacuga

SEQ ID NO: 1892835 - RNA, 17 nt, Homo sapiens
ccauuugaagcagugau

SEQ ID NO: 1892836 - RNA, 15 nt, Homo sapiens
caagauggauggaaa

SEQ ID NO: 1892837 - RNA, 12 nt, Homo sapiens
uacccacugaag

SEQ ID NO: 1892838 - RNA, 14 nt, Homo sapiens
auuuuuucccccac

SEQ ID NO: 1892839 - RNA, 14 nt, Homo sapiens
auccuuucccuuac

SEQ ID NO: 1892840 - RNA, 22 nt, Homo sapiens
caguaaaauagcugagggaaaa

SEQ ID NO: 1892841 - RNA, 18 nt, Homo sapiens
agagcagugcacaucuga

SEQ ID NO: 1892842 - RNA, 14 nt, Homo sapiens
acagcugucauaua

SEQ ID NO: 1892843 - RNA, 14 nt, Homo sapiens
ucaugucucugauu

SEQ ID NO: 1892844 - RNA, 15 nt, Homo sapiens
ugugugauuuucaua

SEQ ID NO: 1892845 - RNA, 14 nt, Homo sapiens
uuugcagaugacaa

SEQ ID NO: 1892846 - RNA, 17 nt, Homo sapiens
uacagaacccauuccau

SEQ ID NO: 1892847 - RNA, 14 nt, Homo sapiens
gauaccacuuaaca

SEQ ID NO: 1892848 - RNA, 12 nt, Homo sapiens
uaaauacagaca

SEQ ID NO: 1892849 - RNA, 20 nt, Homo sapiens
uaccuccuuguguugcacug

SEQ ID NO: 1892850 - RNA, 22 nt, Homo sapiens
cugagugggagcugucaggcag

SEQ ID NO: 1892851 - RNA, 23 nt, Homo sapiens
gacaggauaugaguacauacuca

SEQ ID NO: 1892852 - RNA, 13 nt, Homo sapiens
ucagagcagagua

SEQ ID NO: 1892853 - RNA, 19 nt, Homo sapiens
agcugccccuucugaggau

SEQ ID NO: 1892854 - RNA, 13 nt, Homo sapiens
ccuucuuccccaa

SEQ ID NO: 1892855 - RNA, 15 nt, Homo sapiens
gagcucugcgccagg

SEQ ID NO: 1892856 - RNA, 15 nt, Homo sapiens
guccacucugagucg

SEQ ID NO: 1892857 - RNA, 21 nt, Homo sapiens
uugucccgccgaguacuaugu

SEQ ID NO: 1892858 - RNA, 17 nt, Homo sapiens
aauuuugaauugauacc

SEQ ID NO: 1892859 - RNA, 20 nt, Homo sapiens
gggcuucucgccccucagug

SEQ ID NO: 1892860 - RNA, 13 nt, Homo sapiens
acagccucagaau

SEQ ID NO: 1892861 - RNA, 22 nt, Homo sapiens
cacugaaaaugucacauucuau

SEQ ID NO: 1892862 - RNA, 14 nt, Homo sapiens
caaaaugguuuauu

SEQ ID NO: 1892863 - RNA, 19 nt, Homo sapiens
cccgggagacucaaaggga

SEQ ID NO: 1892864 - RNA, 14 nt, Homo sapiens
aucugcuacugugu

SEQ ID NO: 1892865 - RNA, 15 nt, Homo sapiens
acaccccacugagcc

SEQ ID NO: 1892866 - RNA, 13 nt, Homo sapiens
uggcuccucugug

SEQ ID NO: 1892867 - RNA, 18 nt, Homo sapiens
gugcgugcaugugcacuu

SEQ ID NO: 1892868 - RNA, 22 nt, Homo sapiens
caacuuguuuucccagcaucau

SEQ ID NO: 1892869 - RNA, 15 nt, Homo sapiens
uugauguuuucacaa

SEQ ID NO: 1892870 - RNA, 17 nt, Homo sapiens
auaguuugacacuugaa

SEQ ID NO: 1892871 - RNA, 17 nt, Homo sapiens
ccagacuggagugcagg

SEQ ID NO: 1892872 - RNA, 13 nt, Homo sapiens
cacuaccaaaaga

SEQ ID NO: 1892873 - RNA, 13 nt, Homo sapiens
cccucccaacagc

SEQ ID NO: 1892874 - RNA, 23 nt, Homo sapiens
aauauucaauaaagcugcugaga

SEQ ID NO: 1892875 - RNA, 15 nt, Homo sapiens
uuccccuggccucag

SEQ ID NO: 1892876 - RNA, 15 nt, Homo sapiens
aggccccugguggca

SEQ ID NO: 1892877 - RNA, 15 nt, Homo sapiens
aaucuuaauguauca

SEQ ID NO: 1892878 - RNA, 14 nt, Homo sapiens
uucagguguuacag

SEQ ID NO: 1892879 - RNA, 18 nt, Homo sapiens
acagagcaucccacagga

SEQ ID NO: 1892880 - RNA, 13 nt, Homo sapiens
ggcugcugaccau

SEQ ID NO: 1892881 - RNA, 22 nt, Homo sapiens
gccugaugggguggaaggcaug

SEQ ID NO: 1892882 - RNA, 13 nt, Homo sapiens
gaaguagauucug

SEQ ID NO: 1892883 - RNA, 22 nt, Homo sapiens
uucagggaugcucauuccauga

SEQ ID NO: 1892884 - RNA, 20 nt, Homo sapiens
uauaccuuuugcauuucuuu

SEQ ID NO: 1892885 - RNA, 20 nt, Homo sapiens
aacuuggaaugcaagcugga

SEQ ID NO: 1892886 - RNA, 16 nt, Homo sapiens
gucaacaaaccaagca

SEQ ID NO: 1892887 - RNA, 16 nt, Homo sapiens
accaacugaaggcuaa

SEQ ID NO: 1892888 - RNA, 13 nt, Homo sapiens
gcuacgugugauu

SEQ ID NO: 1892889 - RNA, 21 nt, Homo sapiens
acucacguuugcuuaaacccu

SEQ ID NO: 1892890 - RNA, 22 nt, Homo sapiens
aauucuaagagcagcagcauau

SEQ ID NO: 1892891 - RNA, 22 nt, Homo sapiens
aguggaccuaaagaagccagau

SEQ ID NO: 1892892 - RNA, 13 nt, Homo sapiens
ucuugggcacugg

SEQ ID NO: 1892893 - RNA, 17 nt, Homo sapiens
cuuucuccacacagcaa

SEQ ID NO: 1892894 - RNA, 17 nt, Homo sapiens
cacaguguaaucucuau

SEQ ID NO: 1892895 - RNA, 18 nt, Homo sapiens
gagccaggaaagcagcaa

SEQ ID NO: 1892896 - RNA, 22 nt, Homo sapiens
cuagugcugacgauguucugua

SEQ ID NO: 1892897 - RNA, 16 nt, Homo sapiens
accugagacuggguga

SEQ ID NO: 1892898 - RNA, 16 nt, Homo sapiens
agcaugauauuuacug

SEQ ID NO: 1892899 - RNA, 22 nt, Homo sapiens
uauuuaaaaaaaaagucagaga

SEQ ID NO: 1892900 - RNA, 16 nt, Homo sapiens
uacaugagauaacuca

SEQ ID NO: 1892901 - RNA, 22 nt, Homo sapiens
uacccagagaguccugugcuga

SEQ ID NO: 1892902 - RNA, 21 nt, Homo sapiens
gauuuuuauaucuaacuuucc

SEQ ID NO: 1892903 - RNA, 13 nt, Homo sapiens
gacuaggucaauu

SEQ ID NO: 1892904 - RNA, 18 nt, Homo sapiens
uacuaugugccaguuccu

SEQ ID NO: 1892905 - RNA, 15 nt, Homo sapiens
cccgacucugauacc

SEQ ID NO: 1892906 - RNA, 15 nt, Homo sapiens
ggauuacugguguga

SEQ ID NO: 1892907 - RNA, 22 nt, Homo sapiens
aucaaaacuuggacccuuggaa

SEQ ID NO: 1892908 - RNA, 19 nt, Homo sapiens
auaaaauaaucauacaguu

SEQ ID NO: 1892909 - RNA, 16 nt, Homo sapiens
cccccacugaccagaa

SEQ ID NO: 1892910 - RNA, 17 nt, Homo sapiens
uacaucagaaguuugca

SEQ ID NO: 1892911 - RNA, 19 nt, Homo sapiens
guggaaacaauaaaaccug

SEQ ID NO: 1892912 - RNA, 13 nt, Homo sapiens
cucagaaccugcu

SEQ ID NO: 1892913 - RNA, 15 nt, Homo sapiens
cuacaguaacuguga

SEQ ID NO: 1892914 - RNA, 15 nt, Homo sapiens
uaaaauguuuucacu

SEQ ID NO: 1892915 - RNA, 14 nt, Homo sapiens
cacucugcucugau

SEQ ID NO: 1892916 - RNA, 16 nt, Homo sapiens
cauggcuuugugcugc

SEQ ID NO: 1892917 - RNA, 19 nt, Homo sapiens
aaauuuaaaaaaacagacu

SEQ ID NO: 1892918 - RNA, 19 nt, Homo sapiens
aaauguauuuuucacaaag

SEQ ID NO: 1892919 - RNA, 11 nt, Homo sapiens
caaugcuauaa

SEQ ID NO: 1892920 - RNA, 18 nt, Homo sapiens
ugaccuugcugccacaac

SEQ ID NO: 1892921 - RNA, 15 nt, Homo sapiens
caugguauguaacuc

SEQ ID NO: 1892922 - RNA, 17 nt, Homo sapiens
auaauuuacaugcaaua

SEQ ID NO: 1892923 - RNA, 22 nt, Homo sapiens
accagagcuucucugggcugaa

SEQ ID NO: 1892924 - RNA, 23 nt, Homo sapiens
gacccuggugggcuguucagcuu

SEQ ID NO: 1892925 - RNA, 20 nt, Homo sapiens
ccuucagaggccaucugauu

SEQ ID NO: 1892926 - RNA, 21 nt, Homo sapiens
ugucacauuuagcugugcuca

SEQ ID NO: 1892927 - RNA, 15 nt, Homo sapiens
ggaagcacaggccag

SEQ ID NO: 1892928 - RNA, 17 nt, Homo sapiens
acuucauauuaauauaa

SEQ ID NO: 1892929 - RNA, 14 nt, Homo sapiens
ccuaucaagccuua

SEQ ID NO: 1892930 - RNA, 23 nt, Homo sapiens
gaccacuuccaggggaaccugcc

SEQ ID NO: 1892931 - RNA, 17 nt, Homo sapiens
guccugggucuguguca

SEQ ID NO: 1892932 - RNA, 12 nt, Homo sapiens
uggugcugcuuu

SEQ ID NO: 1892933 - RNA, 19 nt, Homo sapiens
ggcuuauauuaagcaaaca

SEQ ID NO: 1892934 - RNA, 18 nt, Homo sapiens
ccauuuggaaaauguuca

SEQ ID NO: 1892935 - RNA, 23 nt, Homo sapiens
cuaacaauggaagauuugcccau

SEQ ID NO: 1892936 - RNA, 23 nt, Homo sapiens
gauguacuuuaccugaaacaacc

SEQ ID NO: 1892937 - RNA, 19 nt, Homo sapiens
gaguuaucacuucauuuau

SEQ ID NO: 1892938 - RNA, 20 nt, Homo sapiens
cucuuccuaucccaucccau

SEQ ID NO: 1892939 - RNA, 13 nt, Homo sapiens
uuucuuuccucag

SEQ ID NO: 1892940 - RNA, 17 nt, Homo sapiens
aaugcuagcacaauauu

SEQ ID NO: 1892941 - RNA, 23 nt, Homo sapiens
ggagagagguugaggaugcacug

SEQ ID NO: 1892942 - RNA, 14 nt, Homo sapiens
auuguacuaauacc

SEQ ID NO: 1892943 - RNA, 16 nt, Homo sapiens
acacugcacacaguga

SEQ ID NO: 1892944 - RNA, 13 nt, Homo sapiens
gaaacccaagcuc

SEQ ID NO: 1892945 - RNA, 20 nt, Homo sapiens
uacuauuuuuagcaauguuu

SEQ ID NO: 1892946 - RNA, 16 nt, Homo sapiens
cagaguggggagcucc

SEQ ID NO: 1892947 - RNA, 19 nt, Homo sapiens
ccaggcacuguucaucuca

SEQ ID NO: 1892948 - RNA, 14 nt, Homo sapiens
cuaucuuuucuccc

SEQ ID NO: 1892949 - RNA, 16 nt, Homo sapiens
aaugcauguuaauggu

SEQ ID NO: 1892950 - RNA, 16 nt, Homo sapiens
aauugugaacagccaa

SEQ ID NO: 1892951 - RNA, 13 nt, Homo sapiens
accaaaucucagu

SEQ ID NO: 1892952 - RNA, 14 nt, Homo sapiens
agcccgcuuggcca

SEQ ID NO: 1892953 - RNA, 17 nt, Homo sapiens
agagugaauacacugga

SEQ ID NO: 1892954 - RNA, 12 nt, Homo sapiens
aguuaguaggau

SEQ ID NO: 1892955 - RNA, 15 nt, Homo sapiens
cucuuggccugauca

SEQ ID NO: 1892956 - RNA, 15 nt, Homo sapiens
cuucugggucuccag

SEQ ID NO: 1892957 - RNA, 15 nt, Homo sapiens
uuuucuccucaugga

SEQ ID NO: 1892958 - RNA, 15 nt, Homo sapiens
agcuguacugaggau

SEQ ID NO: 1892959 - RNA, 15 nt, Homo sapiens
aaagaaucuacuaua

SEQ ID NO: 1892960 - RNA, 14 nt, Homo sapiens
agauacaaucagcu

SEQ ID NO: 1892961 - RNA, 17 nt, Homo sapiens
auacauauuaucucauu

SEQ ID NO: 1892962 - RNA, 17 nt, Homo sapiens
gaaaccuugcagcauuu

SEQ ID NO: 1892963 - RNA, 14 nt, Homo sapiens
ugggacaacaaaga

SEQ ID NO: 1892964 - RNA, 21 nt, Homo sapiens
gccaugaucgagccacugcac

SEQ ID NO: 1892965 - RNA, 22 nt, Homo sapiens
agagacuucuaggaggaugcug

SEQ ID NO: 1892966 - RNA, 20 nt, Homo sapiens
uuguuggaucuucaauggcu

SEQ ID NO: 1892967 - RNA, 15 nt, Homo sapiens
ccugagguacagaga

SEQ ID NO: 1892968 - RNA, 16 nt, Homo sapiens
ccugccccacacuccc

SEQ ID NO: 1892969 - RNA, 15 nt, Homo sapiens
cuguucacagcuuuu

SEQ ID NO: 1892970 - RNA, 15 nt, Homo sapiens
aaauccuacagugaa

SEQ ID NO: 1892971 - RNA, 15 nt, Homo sapiens
gcaagcguuauuuug

SEQ ID NO: 1892972 - RNA, 16 nt, Homo sapiens
cuucccucuucccuca

SEQ ID NO: 1892973 - RNA, 19 nt, Homo sapiens
agccuucagcagcagcuca

SEQ ID NO: 1892974 - RNA, 15 nt, Homo sapiens
ugugugaagcaaauu

SEQ ID NO: 1892975 - RNA, 17 nt, Homo sapiens
aaagcaguucugaugcu

SEQ ID NO: 1892976 - RNA, 17 nt, Homo sapiens
ugaauaagcuuucucuc

SEQ ID NO: 1892977 - RNA, 23 nt, Homo sapiens
uuagcacagaggauggcuucccc

SEQ ID NO: 1892978 - RNA, 19 nt, Homo sapiens
caaaauauaauuuacauua

SEQ ID NO: 1892979 - RNA, 23 nt, Homo sapiens
aaguucauccuuugacugugcug

SEQ ID NO: 1892980 - RNA, 15 nt, Homo sapiens
guucuaaaugcaaua

SEQ ID NO: 1892981 - RNA, 22 nt, Homo sapiens
uccaggggcacacaaugcuauu

SEQ ID NO: 1892982 - RNA, 16 nt, Homo sapiens
uguaaccaccucucug

SEQ ID NO: 1892983 - RNA, 16 nt, Homo sapiens
agcccaggccagagug

SEQ ID NO: 1892984 - RNA, 12 nt, Homo sapiens
aucuuuuccacu

SEQ ID NO: 1892985 - RNA, 21 nt, Homo sapiens
ugcacccaucagcacucugua

SEQ ID NO: 1892986 - RNA, 20 nt, Homo sapiens
aguggggggaggaagcagag

SEQ ID NO: 1892987 - RNA, 16 nt, Homo sapiens
agaguccagcuaacac

SEQ ID NO: 1892988 - RNA, 18 nt, Homo sapiens
augaugcuaccaugccuc

SEQ ID NO: 1892989 - RNA, 18 nt, Homo sapiens
gaggagcaggggcgugga

SEQ ID NO: 1892990 - RNA, 21 nt, Homo sapiens
agugcuugauugcguggaauu

SEQ ID NO: 1892991 - RNA, 20 nt, Homo sapiens
uucaccccacacccaugugu

SEQ ID NO: 1892992 - RNA, 19 nt, Homo sapiens
caacuugguucugcuucaa

SEQ ID NO: 1892993 - RNA, 21 nt, Homo sapiens
gaccccaaagagccuggagaa

SEQ ID NO: 1892994 - RNA, 21 nt, Homo sapiens
agaagcagaugccagcgccau

SEQ ID NO: 1892995 - RNA, 21 nt, Homo sapiens
uuucagaaacaaagcauuuga

SEQ ID NO: 1892996 - RNA, 16 nt, Homo sapiens
gaagugugugaucugu

SEQ ID NO: 1892997 - RNA, 20 nt, Homo sapiens
ucucuugaccucgugaucca

SEQ ID NO: 1892998 - RNA, 16 nt, Homo sapiens
cagcccugagccaugg

SEQ ID NO: 1892999 - RNA, 14 nt, Homo sapiens
aagagaacucaccu

SEQ ID NO: 1893000 - RNA, 16 nt, Homo sapiens
augggucaggucauuu

SEQ ID NO: 1893001 - RNA, 13 nt, Homo sapiens
ccaaagcauugcc

SEQ ID NO: 1893002 - RNA, 15 nt, Homo sapiens
cauauagacuguaca

SEQ ID NO: 1893003 - RNA, 15 nt, Homo sapiens
cagcuagacucccau

SEQ ID NO: 1893004 - RNA, 16 nt, Homo sapiens
gaagggccccuugcaa

SEQ ID NO: 1893005 - RNA, 18 nt, Homo sapiens
agacugggcgcaguggcu

SEQ ID NO: 1893006 - RNA, 19 nt, Homo sapiens
aggccagugccagcaccug

SEQ ID NO: 1893007 - RNA, 15 nt, Homo sapiens
gccagggggccaguc

SEQ ID NO: 1893008 - RNA, 18 nt, Homo sapiens
ccuuacagaacuacuucu

SEQ ID NO: 1893009 - RNA, 15 nt, Homo sapiens
aggacuugaaagcau

SEQ ID NO: 1893010 - RNA, 19 nt, Homo sapiens
acagacaaccuaccuucuu

SEQ ID NO: 1893011 - RNA, 20 nt, Homo sapiens
ggagaccaggccucagcucu

SEQ ID NO: 1893012 - RNA, 14 nt, Homo sapiens
gcaggcuccaugca

SEQ ID NO: 1893013 - RNA, 17 nt, Homo sapiens
agacacuucaccaaaga

SEQ ID NO: 1893014 - RNA, 14 nt, Homo sapiens
uagaacaagccaga

SEQ ID NO: 1893015 - RNA, 18 nt, Homo sapiens
gugugagccaccacuccc

SEQ ID NO: 1893016 - RNA, 17 nt, Homo sapiens
ugcuccauuaauccagg

SEQ ID NO: 1893017 - RNA, 16 nt, Homo sapiens
uuggaugcagcuucaa

SEQ ID NO: 1893018 - RNA, 16 nt, Homo sapiens
gcaggcucucaggcca

SEQ ID NO: 1893019 - RNA, 15 nt, Homo sapiens
gaaaaaauucccuca

SEQ ID NO: 1893020 - RNA, 19 nt, Homo sapiens
cuguuaucugcuagaucua

SEQ ID NO: 1893021 - RNA, 21 nt, Homo sapiens
aaagcugccccaucuggggac

SEQ ID NO: 1893022 - RNA, 22 nt, Homo sapiens
aguccccccucgccccaaaguu

SEQ ID NO: 1893023 - RNA, 19 nt, Homo sapiens
uuguacauauuuguggaau

SEQ ID NO: 1893024 - RNA, 19 nt, Homo sapiens
agaucacuuuuuaaacuca

SEQ ID NO: 1893025 - RNA, 20 nt, Homo sapiens
uaaucucuaggaagucaaua

SEQ ID NO: 1893026 - RNA, 22 nt, Homo sapiens
cuauuuugaaguaccaccaaaa

SEQ ID NO: 1893027 - RNA, 14 nt, Homo sapiens
ugcccaaccucacu

SEQ ID NO: 1893028 - RNA, 17 nt, Homo sapiens
ucagugagcugcacuga

SEQ ID NO: 1893029 - RNA, 19 nt, Homo sapiens
ugccuuugugggcccagcu

SEQ ID NO: 1893030 - RNA, 14 nt, Homo sapiens
uauucaaugcauuu

SEQ ID NO: 1893031 - RNA, 20 nt, Homo sapiens
caaaaugaaugccaguccag

SEQ ID NO: 1893032 - RNA, 21 nt, Homo sapiens
caccugggcugaggaggcagu

SEQ ID NO: 1893033 - RNA, 17 nt, Homo sapiens
uucuauacccacccaga

SEQ ID NO: 1893034 - RNA, 14 nt, Homo sapiens
ugggcagagcccaa

SEQ ID NO: 1893035 - RNA, 21 nt, Homo sapiens
cguccauugccggcaauggau

SEQ ID NO: 1893036 - RNA, 18 nt, Homo sapiens
uuccuccuuuaccuuuca

SEQ ID NO: 1893037 - RNA, 17 nt, Homo sapiens
uccuuccacuuccaaga

SEQ ID NO: 1893038 - RNA, 17 nt, Homo sapiens
aagcugcucacugcuca

SEQ ID NO: 1893039 - RNA, 23 nt, Homo sapiens
aaucuucuucagauucagcauuu

SEQ ID NO: 1893040 - RNA, 18 nt, Homo sapiens
aaaacuccugggcuuaag

SEQ ID NO: 1893041 - RNA, 19 nt, Homo sapiens
cucccuguguggcugcuga

SEQ ID NO: 1893042 - RNA, 17 nt, Homo sapiens
acuugaaauucucauca

SEQ ID NO: 1893043 - RNA, 15 nt, Homo sapiens
uauuccugccaccac

SEQ ID NO: 1893044 - RNA, 22 nt, Homo sapiens
acugaauauuaucaguggcugc

SEQ ID NO: 1893045 - RNA, 19 nt, Homo sapiens
acuugaggcuggcacuccc

SEQ ID NO: 1893046 - RNA, 18 nt, Homo sapiens
gaaaugugauuugucuuc

SEQ ID NO: 1893047 - RNA, 14 nt, Homo sapiens
cuacaaaaugccaa

SEQ ID NO: 1893048 - RNA, 16 nt, Homo sapiens
caggagagcagcgcag

SEQ ID NO: 1893049 - RNA, 23 nt, Homo sapiens
caaacugucgugcaaacccagug

SEQ ID NO: 1893050 - RNA, 20 nt, Homo sapiens
cacaaaacaacaaaaaccaa

SEQ ID NO: 1893051 - RNA, 20 nt, Homo sapiens
agucugugaauaaagccaca

SEQ ID NO: 1893052 - RNA, 13 nt, Homo sapiens
uaaauuaagcaug

SEQ ID NO: 1893053 - RNA, 22 nt, Homo sapiens
gggcagcuugggcuggcgggcc

SEQ ID NO: 1893054 - RNA, 12 nt, Homo sapiens
aaauuucaccug

SEQ ID NO: 1893055 - RNA, 22 nt, Homo sapiens
auauuuaauuaaagcacacuuu

SEQ ID NO: 1893056 - RNA, 19 nt, Homo sapiens
gucaaguuguuugucaaug

SEQ ID NO: 1893057 - RNA, 19 nt, Homo sapiens
ccauaugcaggacagcagu

SEQ ID NO: 1893058 - RNA, 14 nt, Homo sapiens
cguaggcaaaucuc

SEQ ID NO: 1893059 - RNA, 14 nt, Homo sapiens
agaagaugcucugg

SEQ ID NO: 1893060 - RNA, 19 nt, Homo sapiens
uggccuugguaugugccag

SEQ ID NO: 1893061 - RNA, 22 nt, Homo sapiens
uggugcaggucuccaccugcac

SEQ ID NO: 1893062 - RNA, 22 nt, Homo sapiens
aucaguugggaucccuccucca

SEQ ID NO: 1893063 - RNA, 21 nt, Homo sapiens
gauuauuggcucauaagcaua

SEQ ID NO: 1893064 - RNA, 17 nt, Homo sapiens
uccacucccacugccag

SEQ ID NO: 1893065 - RNA, 17 nt, Homo sapiens
uagagagcaguggcaga

SEQ ID NO: 1893066 - RNA, 16 nt, Homo sapiens
ugaaaauucuugauaa

SEQ ID NO: 1893067 - RNA, 19 nt, Homo sapiens
uucugauguguucucugau

SEQ ID NO: 1893068 - RNA, 14 nt, Homo sapiens
uugucuggcugugg

SEQ ID NO: 1893069 - RNA, 19 nt, Homo sapiens
ccugugucccaugggcaca

SEQ ID NO: 1893070 - RNA, 19 nt, Homo sapiens
uccuuccccagcuuugcug

SEQ ID NO: 1893071 - RNA, 19 nt, Homo sapiens
acucaagccaagcagccaa

SEQ ID NO: 1893072 - RNA, 19 nt, Homo sapiens
ggauccccccacagccccu

SEQ ID NO: 1893073 - RNA, 19 nt, Homo sapiens
ccugccccagauuuacuaa

SEQ ID NO: 1893074 - RNA, 17 nt, Homo sapiens
auucauccugaccaaga

SEQ ID NO: 1893075 - RNA, 20 nt, Homo sapiens
uaagugauauaaaucagauu

SEQ ID NO: 1893076 - RNA, 21 nt, Homo sapiens
cucacauggcguccugcccuu

SEQ ID NO: 1893077 - RNA, 18 nt, Homo sapiens
aggccagcaacucccagc

SEQ ID NO: 1893078 - RNA, 19 nt, Homo sapiens
aagucuugugacuagugcu

SEQ ID NO: 1893079 - RNA, 20 nt, Homo sapiens
aaaauuuuucuagaagauau

SEQ ID NO: 1893080 - RNA, 19 nt, Homo sapiens
gugcuuuuugggaccauca

SEQ ID NO: 1893081 - RNA, 22 nt, Homo sapiens
ccccagcacacgaguuccagac

SEQ ID NO: 1893082 - RNA, 17 nt, Homo sapiens
gcagguggaucacugga

SEQ ID NO: 1893083 - RNA, 13 nt, Homo sapiens
aauauuuacucau

SEQ ID NO: 1893084 - RNA, 16 nt, Homo sapiens
cuaaguguaccagaga

SEQ ID NO: 1893085 - RNA, 16 nt, Homo sapiens
ucaggcucugaaucuc

SEQ ID NO: 1893086 - RNA, 20 nt, Homo sapiens
ugacauuccuaaacuaucuu

SEQ ID NO: 1893087 - RNA, 15 nt, Homo sapiens
ugaaguaacugugga

SEQ ID NO: 1893088 - RNA, 17 nt, Homo sapiens
uuaaaacuauaacauua

SEQ ID NO: 1893089 - RNA, 15 nt, Homo sapiens
aguacuccugcaaaa

SEQ ID NO: 1893090 - RNA, 18 nt, Homo sapiens
ugaaagucuccuguauca

SEQ ID NO: 1893091 - RNA, 13 nt, Homo sapiens
ccucuuaccugua

SEQ ID NO: 1893092 - RNA, 18 nt, Homo sapiens
uguggcacacaacugugg

SEQ ID NO: 1893093 - RNA, 23 nt, Homo sapiens
uggccaaaacuuaaaagcaagau

SEQ ID NO: 1893094 - RNA, 19 nt, Homo sapiens
aaggguucaagauuguucc

SEQ ID NO: 1893095 - RNA, 23 nt, Homo sapiens
gucuccuuauucggcagccuuau

SEQ ID NO: 1893096 - RNA, 15 nt, Homo sapiens
aagggcaggcccaaa

SEQ ID NO: 1893097 - RNA, 17 nt, Homo sapiens
cagauguggcugaaccg

SEQ ID NO: 1893098 - RNA, 20 nt, Homo sapiens
uccagaagaaauaauugugu

SEQ ID NO: 1893099 - RNA, 21 nt, Homo sapiens
uuaaucucuguuauguacugu

SEQ ID NO: 1893100 - RNA, 15 nt, Homo sapiens
gaagagacucucuua

SEQ ID NO: 1893101 - RNA, 23 nt, Homo sapiens
ccuguaaucccagcuacauggga

SEQ ID NO: 1893102 - RNA, 13 nt, Homo sapiens
ggagagagaucua

SEQ ID NO: 1893103 - RNA, 14 nt, Homo sapiens
cauuaguugagaaa

SEQ ID NO: 1893104 - RNA, 20 nt, Homo sapiens
gugaccucugacaacuguga

SEQ ID NO: 1893105 - RNA, 22 nt, Homo sapiens
cugucaaacaaagccagaagcu

SEQ ID NO: 1893106 - RNA, 17 nt, Homo sapiens
uagcagcauuuacagaa

SEQ ID NO: 1893107 - RNA, 15 nt, Homo sapiens
ggagccucacugggg

SEQ ID NO: 1893108 - RNA, 16 nt, Homo sapiens
agaaacccuucacacc

SEQ ID NO: 1893109 - RNA, 21 nt, Homo sapiens
aauuccuaauaaacugcuauu

SEQ ID NO: 1893110 - RNA, 19 nt, Homo sapiens
aggaaaguuuacccaugaa

SEQ ID NO: 1893111 - RNA, 15 nt, Homo sapiens
agcgucaguuucacu

SEQ ID NO: 1893112 - RNA, 21 nt, Homo sapiens
guauguguauuuguauguacu

SEQ ID NO: 1893113 - RNA, 18 nt, Homo sapiens
cgucccacugagucucau

SEQ ID NO: 1893114 - RNA, 15 nt, Homo sapiens
cuacuaacaucccaa

SEQ ID NO: 1893115 - RNA, 14 nt, Homo sapiens
gccugggcaacaga

SEQ ID NO: 1893116 - RNA, 15 nt, Homo sapiens
uggucaacacuuaag

SEQ ID NO: 1893117 - RNA, 17 nt, Homo sapiens
guggaaauagaugugca

SEQ ID NO: 1893118 - RNA, 16 nt, Homo sapiens
ugagagaaagccacaa

SEQ ID NO: 1893119 - RNA, 15 nt, Homo sapiens
ccccacccuccucca

SEQ ID NO: 1893120 - RNA, 22 nt, Homo sapiens
ugaacucccgccacauuuuagc

SEQ ID NO: 1893121 - RNA, 14 nt, Homo sapiens
cugacuuggggaca

SEQ ID NO: 1893122 - RNA, 14 nt, Homo sapiens
uacuagcaggcaau

SEQ ID NO: 1893123 - RNA, 20 nt, Homo sapiens
gaugcaaauagauucagaga

SEQ ID NO: 1893124 - RNA, 19 nt, Homo sapiens
auuauggcuuugugcuugu

SEQ ID NO: 1893125 - RNA, 20 nt, Homo sapiens
agucuguuuucuaaagccag

SEQ ID NO: 1893126 - RNA, 18 nt, Homo sapiens
augacaaaaaaaauuaag

SEQ ID NO: 1893127 - RNA, 18 nt, Homo sapiens
ucuuggguucaagugauu

SEQ ID NO: 1893128 - RNA, 19 nt, Homo sapiens
agagaagguggaccuggca

SEQ ID NO: 1893129 - RNA, 21 nt, Homo sapiens
acauuucucuaacuccugcca

SEQ ID NO: 1893130 - RNA, 20 nt, Homo sapiens
agcacaccuguguccaagaa

SEQ ID NO: 1893131 - RNA, 18 nt, Homo sapiens
ugugcccaguacuuccug

SEQ ID NO: 1893132 - RNA, 21 nt, Homo sapiens
gugcccacggagccuacccga

SEQ ID NO: 1893133 - RNA, 19 nt, Homo sapiens
cauagauccccccacugag

SEQ ID NO: 1893134 - RNA, 17 nt, Homo sapiens
gcauucgggccacaggg

SEQ ID NO: 1893135 - RNA, 22 nt, Homo sapiens
cugucgcaugagaacauuaaca

SEQ ID NO: 1893136 - RNA, 20 nt, Homo sapiens
cccaggucccauaaggguag

SEQ ID NO: 1893137 - RNA, 14 nt, Homo sapiens
auuacaucugagua

SEQ ID NO: 1893138 - RNA, 23 nt, Homo sapiens
ucuuagcuccccuccaaccuggg

SEQ ID NO: 1893139 - RNA, 22 nt, Homo sapiens
caguggacccuggaccauucca

SEQ ID NO: 1893140 - RNA, 18 nt, Homo sapiens
agaaacuaugaagaucug

SEQ ID NO: 1893141 - RNA, 13 nt, Homo sapiens
gaccucacaguga

SEQ ID NO: 1893142 - RNA, 14 nt, Homo sapiens
aguucgacaaauau

SEQ ID NO: 1893143 - RNA, 19 nt, Homo sapiens
ucaucaggugugcucaggg

SEQ ID NO: 1893144 - RNA, 17 nt, Homo sapiens
aaagcuggacugaccaa

SEQ ID NO: 1893145 - RNA, 22 nt, Homo sapiens
auugcaguucugauucauuuga

SEQ ID NO: 1893146 - RNA, 21 nt, Homo sapiens
cuguagugagauagcauugug

SEQ ID NO: 1893147 - RNA, 19 nt, Homo sapiens
agccuggcugggacuggga

SEQ ID NO: 1893148 - RNA, 18 nt, Homo sapiens
ugaaggaaaggaagaccu

SEQ ID NO: 1893149 - RNA, 18 nt, Homo sapiens
ucaggaauguggcugcaa

SEQ ID NO: 1893150 - RNA, 14 nt, Homo sapiens
aaugacuuacuuuc

SEQ ID NO: 1893151 - RNA, 19 nt, Homo sapiens
cucaagaaauugccuccuu

SEQ ID NO: 1893152 - RNA, 16 nt, Homo sapiens
guccaggguccucuag

SEQ ID NO: 1893153 - RNA, 20 nt, Homo sapiens
uuaacuagucuauaaugaac

SEQ ID NO: 1893154 - RNA, 15 nt, Homo sapiens
aaaucugaguauaua

SEQ ID NO: 1893155 - RNA, 22 nt, Homo sapiens
uuaacccauuugucucuacuuu

SEQ ID NO: 1893156 - RNA, 22 nt, Homo sapiens
acauauggaaauguuacugucu

SEQ ID NO: 1893157 - RNA, 18 nt, Homo sapiens
agcccccaguaucucuuc

SEQ ID NO: 1893158 - RNA, 16 nt, Homo sapiens
agucagaagaagacag

SEQ ID NO: 1893159 - RNA, 20 nt, Homo sapiens
cuaaugauggcccauucuac

SEQ ID NO: 1893160 - RNA, 16 nt, Homo sapiens
uggcccagccaaucua

SEQ ID NO: 1893161 - RNA, 16 nt, Homo sapiens
uucucccucgacauuu

SEQ ID NO: 1893162 - RNA, 20 nt, Homo sapiens
agugcagggcaaaauauuca

SEQ ID NO: 1893163 - RNA, 21 nt, Homo sapiens
ucuguugucguaaagauuugg

SEQ ID NO: 1893164 - RNA, 23 nt, Homo sapiens
ugggcgauuugggggcucgggga

SEQ ID NO: 1893165 - RNA, 16 nt, Homo sapiens
auuguccccaaugaau

SEQ ID NO: 1893166 - RNA, 14 nt, Homo sapiens
agagaacuccccca

SEQ ID NO: 1893167 - RNA, 14 nt, Homo sapiens
uaaagaccacuuua

SEQ ID NO: 1893168 - RNA, 16 nt, Homo sapiens
cucuaagaauucagua

SEQ ID NO: 1893169 - RNA, 20 nt, Homo sapiens
augggaaaugagaacauucc

SEQ ID NO: 1893170 - RNA, 22 nt, Homo sapiens
aagagaauauuagcuuuacugu

SEQ ID NO: 1893171 - RNA, 18 nt, Homo sapiens
agaaaaccuguucaggca

SEQ ID NO: 1893172 - RNA, 13 nt, Homo sapiens
cugguuaauucca

SEQ ID NO: 1893173 - RNA, 24 nt, Homo sapiens
uccuaucaccucgagaaguaauua

SEQ ID NO: 1893174 - RNA, 16 nt, Homo sapiens
accccucacugugacu

SEQ ID NO: 1893175 - RNA, 16 nt, Homo sapiens
uugcaacucuguaaau

SEQ ID NO: 1893176 - RNA, 21 nt, Homo sapiens
agccuuagccaggaggccagg

SEQ ID NO: 1893177 - RNA, 19 nt, Homo sapiens
caagaguaagcaguguuac

SEQ ID NO: 1893178 - RNA, 14 nt, Homo sapiens
uguccaacugagaa

SEQ ID NO: 1893179 - RNA, 14 nt, Homo sapiens
acacacacacugcc

SEQ ID NO: 1893180 - RNA, 18 nt, Homo sapiens
cagaccaguagugaccaa

SEQ ID NO: 1893181 - RNA, 17 nt, Homo sapiens
acaacauucugugggau

SEQ ID NO: 1893182 - RNA, 16 nt, Homo sapiens
uugcuuguaaaaccaa

SEQ ID NO: 1893183 - RNA, 21 nt, Homo sapiens
agccaaccuagcuagcaacau

SEQ ID NO: 1893184 - RNA, 17 nt, Homo sapiens
cauaaagaaacacuuuc

SEQ ID NO: 1893185 - RNA, 18 nt, Homo sapiens
uuuucuaaagccaggacu

SEQ ID NO: 1893186 - RNA, 19 nt, Homo sapiens
uggaaaaccuccuuuacca

SEQ ID NO: 1893187 - RNA, 13 nt, Homo sapiens
agaggugggagac

SEQ ID NO: 1893188 - RNA, 15 nt, Homo sapiens
guguagcuuugcucu

SEQ ID NO: 1893189 - RNA, 15 nt, Homo sapiens
agguaucaaaauguu

SEQ ID NO: 1893190 - RNA, 22 nt, Homo sapiens
cuuacacauaaagcacuaccua

SEQ ID NO: 1893191 - RNA, 21 nt, Homo sapiens
uauaucauaaaguaugccuuc

SEQ ID NO: 1893192 - RNA, 15 nt, Homo sapiens
agcaagcucacuugc

SEQ ID NO: 1893193 - RNA, 17 nt, Homo sapiens
uucucccauccaagaga

SEQ ID NO: 1893194 - RNA, 18 nt, Homo sapiens
aaguagcugggaccacaa

SEQ ID NO: 1893195 - RNA, 20 nt, Homo sapiens
cuaccugagcauucaggcag

SEQ ID NO: 1893196 - RNA, 16 nt, Homo sapiens
ucagaugggcagcagc

SEQ ID NO: 1893197 - RNA, 14 nt, Homo sapiens
uccagccaccucag

SEQ ID NO: 1893198 - RNA, 12 nt, Homo sapiens
caugaaaacugg

SEQ ID NO: 1893199 - RNA, 12 nt, Homo sapiens
uaccucacuuua

SEQ ID NO: 1893200 - RNA, 13 nt, Homo sapiens
uaaauaaccaauu

SEQ ID NO: 1893201 - RNA, 17 nt, Homo sapiens
cugcaaacauguugccu

SEQ ID NO: 1893202 - RNA, 19 nt, Homo sapiens
ugaggugugaaagcccagg

SEQ ID NO: 1893203 - RNA, 19 nt, Homo sapiens
caagcaaaugggggaaaag

SEQ ID NO: 1893204 - RNA, 22 nt, Homo sapiens
aguccuccagacaacccucaga

SEQ ID NO: 1893205 - RNA, 23 nt, Homo sapiens
cgggaugggacacccaacacuuu

SEQ ID NO: 1893206 - RNA, 16 nt, Homo sapiens
guccccgaugcugacc

SEQ ID NO: 1893207 - RNA, 10 nt, Homo sapiens
ugcacuuugu

SEQ ID NO: 1893208 - RNA, 15 nt, Homo sapiens
auauagccauugauc

SEQ ID NO: 1893209 - RNA, 15 nt, Homo sapiens
uuuguucacaugcau

SEQ ID NO: 1893210 - RNA, 16 nt, Homo sapiens
ccuaacaaguguaucu

SEQ ID NO: 1893211 - RNA, 19 nt, Homo sapiens
uaguccuuguaaacaauau

SEQ ID NO: 1893212 - RNA, 17 nt, Homo sapiens
cccuauuaaccuagaga

SEQ ID NO: 1893213 - RNA, 18 nt, Homo sapiens
uucccuuguagaaaguga

SEQ ID NO: 1893214 - RNA, 16 nt, Homo sapiens
gcaaugguuuguguca

SEQ ID NO: 1893215 - RNA, 20 nt, Homo sapiens
gaguuguuuaaacagucaaa

SEQ ID NO: 1893216 - RNA, 13 nt, Homo sapiens
ugaaucugaccac

SEQ ID NO: 1893217 - RNA, 15 nt, Homo sapiens
cagguugcuuugccc

SEQ ID NO: 1893218 - RNA, 15 nt, Homo sapiens
ggagacuagauuuau

SEQ ID NO: 1893219 - RNA, 14 nt, Homo sapiens
cauuauagccucag

SEQ ID NO: 1893220 - RNA, 22 nt, Homo sapiens
uacaggcauagccacuugcuca

SEQ ID NO: 1893221 - RNA, 21 nt, Homo sapiens
auagugggcaccccacugcaa

SEQ ID NO: 1893222 - RNA, 17 nt, Homo sapiens
ccauucuggcacuuuaa

SEQ ID NO: 1893223 - RNA, 17 nt, Homo sapiens
gucucggggcuugcccc

SEQ ID NO: 1893224 - RNA, 12 nt, Homo sapiens
uguauaaaaugg

SEQ ID NO: 1893225 - RNA, 17 nt, Homo sapiens
caaccugggcauuccuu

SEQ ID NO: 1893226 - RNA, 14 nt, Homo sapiens
ucauucaguacuua

SEQ ID NO: 1893227 - RNA, 16 nt, Homo sapiens
acaggaaauugacuua

SEQ ID NO: 1893228 - RNA, 15 nt, Homo sapiens
gaggguuuugcucuu

SEQ ID NO: 1893229 - RNA, 22 nt, Homo sapiens
aagccuuaucaagugucuucca

SEQ ID NO: 1893230 - RNA, 20 nt, Homo sapiens
acccaagugccucaccucga

SEQ ID NO: 1893231 - RNA, 15 nt, Homo sapiens
uauucuccauacucu

SEQ ID NO: 1893232 - RNA, 15 nt, Homo sapiens
ugagaacagcauuua

SEQ ID NO: 1893233 - RNA, 20 nt, Homo sapiens
cacaaugucaugucugugau

SEQ ID NO: 1893234 - RNA, 16 nt, Homo sapiens
gccuggaggauagcag

SEQ ID NO: 1893235 - RNA, 16 nt, Homo sapiens
gcugcccugucuggaa

SEQ ID NO: 1893236 - RNA, 22 nt, Homo sapiens
caguaaggcagugcaguacuca

SEQ ID NO: 1893237 - RNA, 17 nt, Homo sapiens
aucacagcaugugcaau

SEQ ID NO: 1893238 - RNA, 17 nt, Homo sapiens
gaaaggaagcuccacug

SEQ ID NO: 1893239 - RNA, 15 nt, Homo sapiens
cauucccagugguca

SEQ ID NO: 1893240 - RNA, 18 nt, Homo sapiens
guagagacaauacaguaa

SEQ ID NO: 1893241 - RNA, 23 nt, Homo sapiens
gaugccgagguaaaaguucuuuu

SEQ ID NO: 1893242 - RNA, 23 nt, Homo sapiens
auaaaagaucuugaauagucuca

SEQ ID NO: 1893243 - RNA, 14 nt, Homo sapiens
auucauuucaucua

SEQ ID NO: 1893244 - RNA, 22 nt, Homo sapiens
agggcaggcuugccaccgggga

SEQ ID NO: 1893245 - RNA, 15 nt, Homo sapiens
cucggcagaugcugu

SEQ ID NO: 1893246 - RNA, 19 nt, Homo sapiens
cagcugggaucugacugca

SEQ ID NO: 1893247 - RNA, 17 nt, Homo sapiens
ucuuuagcuuaccuggg

SEQ ID NO: 1893248 - RNA, 15 nt, Homo sapiens
augaucuagguuuaa

SEQ ID NO: 1893249 - RNA, 16 nt, Homo sapiens
auccuugcacagacaa

SEQ ID NO: 1893250 - RNA, 17 nt, Homo sapiens
uagccaucucaagcaag

SEQ ID NO: 1893251 - RNA, 14 nt, Homo sapiens
agaaaguacuucuu

SEQ ID NO: 1893252 - RNA, 17 nt, Homo sapiens
ccugacagcauaccuca

SEQ ID NO: 1893253 - RNA, 13 nt, Homo sapiens
ggcagcgacccca

SEQ ID NO: 1893254 - RNA, 14 nt, Homo sapiens
acucuuaugaaaug

SEQ ID NO: 1893255 - RNA, 22 nt, Homo sapiens
aggaggugggggcuauuucuau

SEQ ID NO: 1893256 - RNA, 15 nt, Homo sapiens
auggaccacugagag

SEQ ID NO: 1893257 - RNA, 21 nt, Homo sapiens
cucguccaaggcaguucugug

SEQ ID NO: 1893258 - RNA, 16 nt, Homo sapiens
ccuuaacacacuggcc

SEQ ID NO: 1893259 - RNA, 16 nt, Homo sapiens
cugagaauagugucug

SEQ ID NO: 1893260 - RNA, 19 nt, Homo sapiens
agugcugggauuacaggug

SEQ ID NO: 1893261 - RNA, 13 nt, Homo sapiens
aacugcagcguca

SEQ ID NO: 1893262 - RNA, 16 nt, Homo sapiens
agcauuacauuauuaa

SEQ ID NO: 1893263 - RNA, 16 nt, Homo sapiens
aaauaacuaccuucca

SEQ ID NO: 1893264 - RNA, 17 nt, Homo sapiens
aggauagaauacaugga

SEQ ID NO: 1893265 - RNA, 15 nt, Homo sapiens
uucauucccuuucau

SEQ ID NO: 1893266 - RNA, 19 nt, Homo sapiens
gagcccccagcugccaaag

SEQ ID NO: 1893267 - RNA, 16 nt, Homo sapiens
cccuccuuuucucuga

SEQ ID NO: 1893268 - RNA, 14 nt, Homo sapiens
cauaugaccucaug

SEQ ID NO: 1893269 - RNA, 20 nt, Homo sapiens
gagaaccuuuagaauaucuu

SEQ ID NO: 1893270 - RNA, 19 nt, Homo sapiens
uauuugaugaaacucauga

SEQ ID NO: 1893271 - RNA, 18 nt, Homo sapiens
ccucaucccgagcaccuc

SEQ ID NO: 1893272 - RNA, 13 nt, Homo sapiens
guucauugcacaa

SEQ ID NO: 1893273 - RNA, 15 nt, Homo sapiens
cuucucuuugccuca

SEQ ID NO: 1893274 - RNA, 15 nt, Homo sapiens
gugccuguacaggaa

SEQ ID NO: 1893275 - RNA, 13 nt, Homo sapiens
aguauccacagaa

SEQ ID NO: 1893276 - RNA, 14 nt, Homo sapiens
aaagugugagcaaa

SEQ ID NO: 1893277 - RNA, 17 nt, Homo sapiens
agucuguuuuaugacuu

SEQ ID NO: 1893278 - RNA, 16 nt, Homo sapiens
agccgagaucaugcca

SEQ ID NO: 1893279 - RNA, 19 nt, Homo sapiens
uacaauaccagaucacuca

SEQ ID NO: 1893280 - RNA, 16 nt, Homo sapiens
uaagaugccagcauau

SEQ ID NO: 1893281 - RNA, 13 nt, Homo sapiens
gucacacagggaa

SEQ ID NO: 1893282 - RNA, 14 nt, Homo sapiens
aggugaacaaauaa

SEQ ID NO: 1893283 - RNA, 15 nt, Homo sapiens
cugucaaguuuuuau

SEQ ID NO: 1893284 - RNA, 17 nt, Homo sapiens
gggucuauacauuccug

SEQ ID NO: 1893285 - RNA, 22 nt, Homo sapiens
acaugcucaucccaaaagcuag

SEQ ID NO: 1893286 - RNA, 12 nt, Homo sapiens
aggccccggcug

SEQ ID NO: 1893287 - RNA, 19 nt, Homo sapiens
acccuuucauuagaacuuc

SEQ ID NO: 1893288 - RNA, 23 nt, Homo sapiens
aauaugcacugaauaauucaucu

SEQ ID NO: 1893289 - RNA, 13 nt, Homo sapiens
gauacaacagcug

SEQ ID NO: 1893290 - RNA, 15 nt, Homo sapiens
agcuaauuuuugcau

SEQ ID NO: 1893291 - RNA, 17 nt, Homo sapiens
cacaugaggccaucuca

SEQ ID NO: 1893292 - RNA, 15 nt, Homo sapiens
guccucucaucccag

SEQ ID NO: 1893293 - RNA, 21 nt, Homo sapiens
auugggagugagaugccugca

SEQ ID NO: 1893294 - RNA, 18 nt, Homo sapiens
ucaggucagcucacugag

SEQ ID NO: 1893295 - RNA, 19 nt, Homo sapiens
aaacuauguguucaaugaa

SEQ ID NO: 1893296 - RNA, 19 nt, Homo sapiens
gacaugaagaaugaaucca

SEQ ID NO: 1893297 - RNA, 18 nt, Homo sapiens
acauuaaaaaaauuccau

SEQ ID NO: 1893298 - RNA, 13 nt, Homo sapiens
agacauuccacca

SEQ ID NO: 1893299 - RNA, 16 nt, Homo sapiens
uuuacaaugugcaaua

SEQ ID NO: 1893300 - RNA, 15 nt, Homo sapiens
ccaucuucaucccaa

SEQ ID NO: 1893301 - RNA, 21 nt, Homo sapiens
cucucaggagagugugcaacu

SEQ ID NO: 1893302 - RNA, 22 nt, Homo sapiens
ccggccgcagcccccacugacc

SEQ ID NO: 1893303 - RNA, 13 nt, Homo sapiens
uuccagcauuugc

SEQ ID NO: 1893304 - RNA, 18 nt, Homo sapiens
ugcauauagaauuuugau

SEQ ID NO: 1893305 - RNA, 16 nt, Homo sapiens
aaaaucuaagcagcuu

SEQ ID NO: 1893306 - RNA, 21 nt, Homo sapiens
ucugccucagccuccugagua

SEQ ID NO: 1893307 - RNA, 15 nt, Homo sapiens
aggcaccucucuggg

SEQ ID NO: 1893308 - RNA, 22 nt, Homo sapiens
agacacggagcccagcccuccc

SEQ ID NO: 1893309 - RNA, 17 nt, Homo sapiens
ugccaagcacagugccu

SEQ ID NO: 1893310 - RNA, 20 nt, Homo sapiens
gaaauaauuuucaagcaaag

SEQ ID NO: 1893311 - RNA, 17 nt, Homo sapiens
acucaaggcuugaguca

SEQ ID NO: 1893312 - RNA, 14 nt, Homo sapiens
ugaaagcuauauca

SEQ ID NO: 1893313 - RNA, 15 nt, Homo sapiens
ucuccagugugccag

SEQ ID NO: 1893314 - RNA, 15 nt, Homo sapiens
ugguaacuugagauu

SEQ ID NO: 1893315 - RNA, 11 nt, Homo sapiens
gggugugauga

SEQ ID NO: 1893316 - RNA, 21 nt, Homo sapiens
auucgcugcaaccuguugaua

SEQ ID NO: 1893317 - RNA, 18 nt, Homo sapiens
ggccagccagugccauuc

SEQ ID NO: 1893318 - RNA, 16 nt, Homo sapiens
uucagaaaagacacuu

SEQ ID NO: 1893319 - RNA, 16 nt, Homo sapiens
ugauccuaagucaugu

SEQ ID NO: 1893320 - RNA, 22 nt, Homo sapiens
uggacaugaagggaugcugcaa

SEQ ID NO: 1893321 - RNA, 12 nt, Homo sapiens
aacauucucuca

SEQ ID NO: 1893322 - RNA, 23 nt, Homo sapiens
cuguaugggggagauugaacuuu

SEQ ID NO: 1893323 - RNA, 22 nt, Homo sapiens
gaaugaagaacaacaacucuca

SEQ ID NO: 1893324 - RNA, 15 nt, Homo sapiens
cugauggcugaagaa

SEQ ID NO: 1893325 - RNA, 19 nt, Homo sapiens
gcuuuacaaaccaaccauu

SEQ ID NO: 1893326 - RNA, 22 nt, Homo sapiens
ucugaaaugcuugaaaccagaa

SEQ ID NO: 1893327 - RNA, 13 nt, Homo sapiens
gauugcaaugccc

SEQ ID NO: 1893328 - RNA, 21 nt, Homo sapiens
aggaacugggccuugugugcu

SEQ ID NO: 1893329 - RNA, 21 nt, Homo sapiens
acucaucaauggggccaguca

SEQ ID NO: 1893330 - RNA, 21 nt, Homo sapiens
uggaaccacaggccugagcca

SEQ ID NO: 1893331 - RNA, 19 nt, Homo sapiens
uagauguauaaaucuuucu

SEQ ID NO: 1893332 - RNA, 15 nt, Homo sapiens
aggcuuacuaaugcu

SEQ ID NO: 1893333 - RNA, 18 nt, Homo sapiens
agacacuucccugcauua

SEQ ID NO: 1893334 - RNA, 19 nt, Homo sapiens
uuauuaggaaguaugguuu

SEQ ID NO: 1893335 - RNA, 13 nt, Homo sapiens
aacuuugcauguu

SEQ ID NO: 1893336 - RNA, 16 nt, Homo sapiens
gcucugaaaacaaaaa

SEQ ID NO: 1893337 - RNA, 18 nt, Homo sapiens
caaauagugauuguaaca

SEQ ID NO: 1893338 - RNA, 18 nt, Homo sapiens
ugaaaaccaacaccauca

SEQ ID NO: 1893339 - RNA, 14 nt, Homo sapiens
guaacagugcagua

SEQ ID NO: 1893340 - RNA, 20 nt, Homo sapiens
cuaagaugaaaugcacugua

SEQ ID NO: 1893341 - RNA, 23 nt, Homo sapiens
agagcuguuuggauacagcugcu

SEQ ID NO: 1893342 - RNA, 16 nt, Homo sapiens
uucaguuugcagagua

SEQ ID NO: 1893343 - RNA, 22 nt, Homo sapiens
uagauauuaaaaguuaagcaaa

SEQ ID NO: 1893344 - RNA, 17 nt, Homo sapiens
guaagaacaccugacaa

SEQ ID NO: 1893345 - RNA, 13 nt, Homo sapiens
cacacacaucuau

SEQ ID NO: 1893346 - RNA, 14 nt, Homo sapiens
aaugaugugauaca

SEQ ID NO: 1893347 - RNA, 12 nt, Homo sapiens
uggccacuccug

SEQ ID NO: 1893348 - RNA, 14 nt, Homo sapiens
guugaauaaaugaa

SEQ ID NO: 1893349 - RNA, 16 nt, Homo sapiens
uaguccaaagacuuaa

SEQ ID NO: 1893350 - RNA, 23 nt, Homo sapiens
gauuaaccucugcacuacugaca

SEQ ID NO: 1893351 - RNA, 20 nt, Homo sapiens
agagcgagauuccgucucaa

SEQ ID NO: 1893352 - RNA, 15 nt, Homo sapiens
ccugggcagccguuu

SEQ ID NO: 1893353 - RNA, 13 nt, Homo sapiens
auggggucuguga

SEQ ID NO: 1893354 - RNA, 12 nt, Homo sapiens
acagaacuccac

SEQ ID NO: 1893355 - RNA, 14 nt, Homo sapiens
uccagagagaagca

SEQ ID NO: 1893356 - RNA, 15 nt, Homo sapiens
uaaccuagugaauuu

SEQ ID NO: 1893357 - RNA, 22 nt, Homo sapiens
uccgccauaaccguccugugac

SEQ ID NO: 1893358 - RNA, 17 nt, Homo sapiens
uuaaacccucugccuuu

SEQ ID NO: 1893359 - RNA, 22 nt, Homo sapiens
cagccguucuugacaucaagaa

SEQ ID NO: 1893360 - RNA, 16 nt, Homo sapiens
ugaaucugaccacaga

SEQ ID NO: 1893361 - RNA, 22 nt, Homo sapiens
gacaugugcuggacacugucca

SEQ ID NO: 1893362 - RNA, 13 nt, Homo sapiens
aguccaccuucau

SEQ ID NO: 1893363 - RNA, 20 nt, Homo sapiens
ggaaaagaaucccugcagcc

SEQ ID NO: 1893364 - RNA, 13 nt, Homo sapiens
cgagacaccaucc

SEQ ID NO: 1893365 - RNA, 15 nt, Homo sapiens
uauuccuaugcugca

SEQ ID NO: 1893366 - RNA, 19 nt, Homo sapiens
cauauuguuugaucuacuu

SEQ ID NO: 1893367 - RNA, 18 nt, Homo sapiens
ucaaccuaagcaacagaa

SEQ ID NO: 1893368 - RNA, 14 nt, Homo sapiens
cccacaagucccag

SEQ ID NO: 1893369 - RNA, 13 nt, Homo sapiens
aaaacauuuuacu

SEQ ID NO: 1893370 - RNA, 14 nt, Homo sapiens
ugaaccuuguuuaa

SEQ ID NO: 1893371 - RNA, 15 nt, Homo sapiens
gcaacacagccacua

SEQ ID NO: 1893372 - RNA, 14 nt, Homo sapiens
gguagaaguggcau

SEQ ID NO: 1893373 - RNA, 22 nt, Homo sapiens
agcugccuuggcucagacaugu

SEQ ID NO: 1893374 - RNA, 23 nt, Homo sapiens
gaaucucccagacuuguuuccug

SEQ ID NO: 1893375 - RNA, 18 nt, Homo sapiens
aucaugaaaagugcuguu

SEQ ID NO: 1893376 - RNA, 15 nt, Homo sapiens
ucgagcaugcccuga

SEQ ID NO: 1893377 - RNA, 16 nt, Homo sapiens
aagccuuccaguuuug

SEQ ID NO: 1893378 - RNA, 17 nt, Homo sapiens
ggccaggcaagugggac

SEQ ID NO: 1893379 - RNA, 12 nt, Homo sapiens
cgcuuugugagc

SEQ ID NO: 1893380 - RNA, 14 nt, Homo sapiens
ucccaaggcugcca

SEQ ID NO: 1893381 - RNA, 17 nt, Homo sapiens
aaacguauugcauuuaa

SEQ ID NO: 1893382 - RNA, 16 nt, Homo sapiens
caggcaccugaaguga

SEQ ID NO: 1893383 - RNA, 19 nt, Homo sapiens
cagaaauuuggcauugauc

SEQ ID NO: 1893384 - RNA, 17 nt, Homo sapiens
ucccgagaguuuccauc

SEQ ID NO: 1893385 - RNA, 23 nt, Homo sapiens
cugcagcauuuugcugcuuuauc

SEQ ID NO: 1893386 - RNA, 20 nt, Homo sapiens
agacagcaggcauaaggcac

SEQ ID NO: 1893387 - RNA, 17 nt, Homo sapiens
ucuuccucacuaugaca

SEQ ID NO: 1893388 - RNA, 21 nt, Homo sapiens
auuaaucaagacucuugaaga

SEQ ID NO: 1893389 - RNA, 18 nt, Homo sapiens
ccagaauaacuagcacca

SEQ ID NO: 1893390 - RNA, 15 nt, Homo sapiens
acuuacacucuuuua

SEQ ID NO: 1893391 - RNA, 14 nt, Homo sapiens
cuuucagugcuuuu

SEQ ID NO: 1893392 - RNA, 23 nt, Homo sapiens
caaagcuaaaauaaaauuuuccu

SEQ ID NO: 1893393 - RNA, 23 nt, Homo sapiens
aggccuccagccacuuauuucca

SEQ ID NO: 1893394 - RNA, 20 nt, Homo sapiens
aacauuccucagaaaccaaa

SEQ ID NO: 1893395 - RNA, 17 nt, Homo sapiens
gucugacacaugcucuc

SEQ ID NO: 1893396 - RNA, 21 nt, Homo sapiens
uuauaacccagugaguucagc

SEQ ID NO: 1893397 - RNA, 22 nt, Homo sapiens
uaaaacuuguuacaccacauua

SEQ ID NO: 1893398 - RNA, 21 nt, Homo sapiens
aguaaacgguguauauaccuu

SEQ ID NO: 1893399 - RNA, 16 nt, Homo sapiens
aacccucacugggacu

SEQ ID NO: 1893400 - RNA, 19 nt, Homo sapiens
gaucauucuggagucacug

SEQ ID NO: 1893401 - RNA, 20 nt, Homo sapiens
ugggaaauucuugcacugua

SEQ ID NO: 1893402 - RNA, 14 nt, Homo sapiens
cugacauugaccca

SEQ ID NO: 1893403 - RNA, 20 nt, Homo sapiens
uuuaguuuuucccucaguga

SEQ ID NO: 1893404 - RNA, 18 nt, Homo sapiens
cuagaauuucauuuauuu

SEQ ID NO: 1893405 - RNA, 22 nt, Homo sapiens
guuccugagccuucagcacuaa

SEQ ID NO: 1893406 - RNA, 22 nt, Homo sapiens
cccagucgcucgacugcgacgc

SEQ ID NO: 1893407 - RNA, 21 nt, Homo sapiens
ugcuucccccacuucaccuuc

SEQ ID NO: 1893408 - RNA, 15 nt, Homo sapiens
ucauuuuacagagaa

SEQ ID NO: 1893409 - RNA, 16 nt, Homo sapiens
ucaggaaguccagcca

SEQ ID NO: 1893410 - RNA, 15 nt, Homo sapiens
aaggagggggccuca

SEQ ID NO: 1893411 - RNA, 20 nt, Homo sapiens
gaugauaauacccacauuac

SEQ ID NO: 1893412 - RNA, 17 nt, Homo sapiens
ccaggacuccuccccac

SEQ ID NO: 1893413 - RNA, 21 nt, Homo sapiens
aaaguaaaggccucaucuccu

SEQ ID NO: 1893414 - RNA, 17 nt, Homo sapiens
aguugagauuuuaauuc

SEQ ID NO: 1893415 - RNA, 18 nt, Homo sapiens
cugcuucccagguucaag

SEQ ID NO: 1893416 - RNA, 21 nt, Homo sapiens
ucugcaaaggaaauaccaguu

SEQ ID NO: 1893417 - RNA, 12 nt, Homo sapiens
ggacaaaaugga

SEQ ID NO: 1893418 - RNA, 16 nt, Homo sapiens
uuaaaucuaugaagua

SEQ ID NO: 1893419 - RNA, 21 nt, Homo sapiens
aguuguugaaugacugaccca

SEQ ID NO: 1893420 - RNA, 23 nt, Homo sapiens
uccugauuccuuuaaaugaauau

SEQ ID NO: 1893421 - RNA, 15 nt, Homo sapiens
uuucaauacugcuga

SEQ ID NO: 1893422 - RNA, 22 nt, Homo sapiens
gcagaggcuuugcugcugugaa

SEQ ID NO: 1893423 - RNA, 17 nt, Homo sapiens
auuggcuaaaagacaug

SEQ ID NO: 1893424 - RNA, 15 nt, Homo sapiens
aaccacucauugucu

SEQ ID NO: 1893425 - RNA, 19 nt, Homo sapiens
uacuagaucuuacaucugc

SEQ ID NO: 1893426 - RNA, 14 nt, Homo sapiens
cuguucccaugaga

SEQ ID NO: 1893427 - RNA, 17 nt, Homo sapiens
gcaauuuuacugugaaa

SEQ ID NO: 1893428 - RNA, 20 nt, Homo sapiens
acauaggugugcuucccaaa

SEQ ID NO: 1893429 - RNA, 23 nt, Homo sapiens
acuuuucugugucauaccacaau

SEQ ID NO: 1893430 - RNA, 22 nt, Homo sapiens
uuuucucuggaaugguacaugu

SEQ ID NO: 1893431 - RNA, 12 nt, Homo sapiens
ugugacugccau

SEQ ID NO: 1893432 - RNA, 20 nt, Homo sapiens
auuucuagaagcacaugugu

SEQ ID NO: 1893433 - RNA, 19 nt, Homo sapiens
cucaaacguacaagucagu

SEQ ID NO: 1893434 - RNA, 12 nt, Homo sapiens
cauuuucuuuca

SEQ ID NO: 1893435 - RNA, 18 nt, Homo sapiens
uggcucaaacaacauucc

SEQ ID NO: 1893436 - RNA, 17 nt, Homo sapiens
aggauaggacagaggga

SEQ ID NO: 1893437 - RNA, 19 nt, Homo sapiens
ccauuuaucuacuauuuga

SEQ ID NO: 1893438 - RNA, 24 nt, Homo sapiens
aagacaacuuccucucacuguugc

SEQ ID NO: 1893439 - RNA, 18 nt, Homo sapiens
agccauauucacaccuca

SEQ ID NO: 1893440 - RNA, 16 nt, Homo sapiens
ccauggcacugacaau

SEQ ID NO: 1893441 - RNA, 14 nt, Homo sapiens
cuuaguugaaauga

SEQ ID NO: 1893442 - RNA, 14 nt, Homo sapiens
auauuuugcauaua

SEQ ID NO: 1893443 - RNA, 15 nt, Homo sapiens
ugacaucacuggcau

SEQ ID NO: 1893444 - RNA, 15 nt, Homo sapiens
uguccccuaugccac

SEQ ID NO: 1893445 - RNA, 21 nt, Homo sapiens
cuguuaguaaauuucugugau

SEQ ID NO: 1893446 - RNA, 22 nt, Homo sapiens
gagucuucagaagaaaggacag

SEQ ID NO: 1893447 - RNA, 17 nt, Homo sapiens
cauagugacaugcacac

SEQ ID NO: 1893448 - RNA, 23 nt, Homo sapiens
ccuuuuuuugaaaaaaagcuuuu

SEQ ID NO: 1893449 - RNA, 14 nt, Homo sapiens
aaacugggaugaaa

SEQ ID NO: 1893450 - RNA, 13 nt, Homo sapiens
aagggccaugugg

SEQ ID NO: 1893451 - RNA, 23 nt, Homo sapiens
uucccuacugaagcccuugugaa

SEQ ID NO: 1893452 - RNA, 15 nt, Homo sapiens
uuuggcuugugggcu

SEQ ID NO: 1893453 - RNA, 16 nt, Homo sapiens
gaugacagaaauauga

SEQ ID NO: 1893454 - RNA, 22 nt, Homo sapiens
gccccuccuagacccaggugga

SEQ ID NO: 1893455 - RNA, 20 nt, Homo sapiens
aaaggacugaaccaggguau

SEQ ID NO: 1893456 - RNA, 12 nt, Homo sapiens
agguuccaguga

SEQ ID NO: 1893457 - RNA, 11 nt, Homo sapiens
aaaaaggugcu

SEQ ID NO: 1893458 - RNA, 21 nt, Homo sapiens
ugccacaggaggggaaguagg

SEQ ID NO: 1893459 - RNA, 12 nt, Homo sapiens
auuuaucugugu

SEQ ID NO: 1893460 - RNA, 15 nt, Homo sapiens
gaaaaucucugugaa

SEQ ID NO: 1893461 - RNA, 23 nt, Homo sapiens
ggcuuuacauggguucaauugga

SEQ ID NO: 1893462 - RNA, 19 nt, Homo sapiens
aaauuaugugaauuuugcc

SEQ ID NO: 1893463 - RNA, 14 nt, Homo sapiens
ucuacaaaaugcca

SEQ ID NO: 1893464 - RNA, 16 nt, Homo sapiens
cucaacuguugccagg

SEQ ID NO: 1893465 - RNA, 18 nt, Homo sapiens
auacuugccucccuccua

SEQ ID NO: 1893466 - RNA, 12 nt, Homo sapiens
auauuacuuguu

SEQ ID NO: 1893467 - RNA, 15 nt, Homo sapiens
uuuuuugauccacuu

SEQ ID NO: 1893468 - RNA, 13 nt, Homo sapiens
cucaugcuguucc

SEQ ID NO: 1893469 - RNA, 22 nt, Homo sapiens
uuuuaaacagugucauauacaa

SEQ ID NO: 1893470 - RNA, 19 nt, Homo sapiens
gaaacaacuuguguucuau

SEQ ID NO: 1893471 - RNA, 13 nt, Homo sapiens
ugauaucaccucu

SEQ ID NO: 1893472 - RNA, 21 nt, Homo sapiens
acguacuacggagaaacucau

SEQ ID NO: 1893473 - RNA, 15 nt, Homo sapiens
guaaagacagaguga

SEQ ID NO: 1893474 - RNA, 17 nt, Homo sapiens
ccuuagauaccuugaaa

SEQ ID NO: 1893475 - RNA, 18 nt, Homo sapiens
ucugagaacagugcacaa

SEQ ID NO: 1893476 - RNA, 15 nt, Homo sapiens
acaccauucugaauu

SEQ ID NO: 1893477 - RNA, 19 nt, Homo sapiens
caaccuuuuacauugugac

SEQ ID NO: 1893478 - RNA, 21 nt, Homo sapiens
ugcaucacagucacaugccca

SEQ ID NO: 1893479 - RNA, 15 nt, Homo sapiens
gacggaguccugugu

SEQ ID NO: 1893480 - RNA, 20 nt, Homo sapiens
ccuucugguucuaacugcug

SEQ ID NO: 1893481 - RNA, 19 nt, Homo sapiens
aaaaauaggauugcuucaa

SEQ ID NO: 1893482 - RNA, 13 nt, Homo sapiens
augaucaccaagc

SEQ ID NO: 1893483 - RNA, 16 nt, Homo sapiens
gguacccagucaccuc

SEQ ID NO: 1893484 - RNA, 21 nt, Homo sapiens
auauuacuuguuuucacuuua

SEQ ID NO: 1893485 - RNA, 16 nt, Homo sapiens
caguguuuucaccuca

SEQ ID NO: 1893486 - RNA, 21 nt, Homo sapiens
gguacaaguggcucaucauca

SEQ ID NO: 1893487 - RNA, 23 nt, Homo sapiens
gcaguagaaggugccgugagcag

SEQ ID NO: 1893488 - RNA, 16 nt, Homo sapiens
cagcaagaccuugaac

SEQ ID NO: 1893489 - RNA, 13 nt, Homo sapiens
aucauguaccuca

SEQ ID NO: 1893490 - RNA, 12 nt, Homo sapiens
guuaaugcagau

SEQ ID NO: 1893491 - RNA, 23 nt, Homo sapiens
cccagcuuuuagaaaaugcaguc

SEQ ID NO: 1893492 - RNA, 17 nt, Homo sapiens
ugcaggugacauuugcu

SEQ ID NO: 1893493 - RNA, 21 nt, Homo sapiens
cugccuggucaauaaaccacu

SEQ ID NO: 1893494 - RNA, 21 nt, Homo sapiens
augcuagagccucugccugac

SEQ ID NO: 1893495 - RNA, 18 nt, Homo sapiens
caaaugcuggcaaaucca

SEQ ID NO: 1893496 - RNA, 21 nt, Homo sapiens
caccaaauacuuucugagaug

SEQ ID NO: 1893497 - RNA, 21 nt, Homo sapiens
auugcugggaggacuggaccg

SEQ ID NO: 1893498 - RNA, 18 nt, Homo sapiens
uccuuuucuccuugccuu

SEQ ID NO: 1893499 - RNA, 14 nt, Homo sapiens
gagagucugcacuu

SEQ ID NO: 1893500 - RNA, 14 nt, Homo sapiens
acugagacuguaua

SEQ ID NO: 1893501 - RNA, 13 nt, Homo sapiens
ucacuagucucac

SEQ ID NO: 1893502 - RNA, 17 nt, Homo sapiens
cuuuauaaauccaguga

SEQ ID NO: 1893503 - RNA, 15 nt, Homo sapiens
ugccuuaagccaaua

SEQ ID NO: 1893504 - RNA, 17 nt, Homo sapiens
uucuaaaguucuaagau

SEQ ID NO: 1893505 - RNA, 20 nt, Homo sapiens
aucacccucuuccugugauc

SEQ ID NO: 1893506 - RNA, 14 nt, Homo sapiens
cagcagcuauuuga

SEQ ID NO: 1893507 - RNA, 19 nt, Homo sapiens
ucuuugccucaacuccagg

SEQ ID NO: 1893508 - RNA, 13 nt, Homo sapiens
uaaaauuccaugg

SEQ ID NO: 1893509 - RNA, 22 nt, Homo sapiens
gcagggggggaaaugcauuuau

SEQ ID NO: 1893510 - RNA, 22 nt, Homo sapiens
gcauguuauggugcuaauguac

SEQ ID NO: 1893511 - RNA, 21 nt, Homo sapiens
uugcuagguuuugcuacauga

SEQ ID NO: 1893512 - RNA, 14 nt, Homo sapiens
cuucuccuacuuag

SEQ ID NO: 1893513 - RNA, 15 nt, Homo sapiens
uuggaaucagaauug

SEQ ID NO: 1893514 - RNA, 17 nt, Homo sapiens
ucugagggggugggggu

SEQ ID NO: 1893515 - RNA, 16 nt, Homo sapiens
cagugaaguacucagu

SEQ ID NO: 1893516 - RNA, 17 nt, Homo sapiens
gcucccccugcuucuca

SEQ ID NO: 1893517 - RNA, 16 nt, Homo sapiens
gcuccagacacacagc

SEQ ID NO: 1893518 - RNA, 17 nt, Homo sapiens
cagcccaacagcacuuu

SEQ ID NO: 1893519 - RNA, 22 nt, Homo sapiens
gaauaugauuaaaaauaucaaa

SEQ ID NO: 1893520 - RNA, 20 nt, Homo sapiens
accaauagucucucugcaag

SEQ ID NO: 1893521 - RNA, 19 nt, Homo sapiens
aauaaaucagcacauuuga

SEQ ID NO: 1893522 - RNA, 20 nt, Homo sapiens
ggaauucuaaauaaauuucc

SEQ ID NO: 1893523 - RNA, 17 nt, Homo sapiens
ugaauuuguuagacuag

SEQ ID NO: 1893524 - RNA, 21 nt, Homo sapiens
ucagauuucuauuuugggaaa

SEQ ID NO: 1893525 - RNA, 22 nt, Homo sapiens
gaauaggaaaauguacauacua

SEQ ID NO: 1893526 - RNA, 22 nt, Homo sapiens
accuuuuauguguugaugacuc

SEQ ID NO: 1893527 - RNA, 14 nt, Homo sapiens
cacuuaaagcuuuc

SEQ ID NO: 1893528 - RNA, 16 nt, Homo sapiens
uaacacccccaucacc

SEQ ID NO: 1893529 - RNA, 12 nt, Homo sapiens
uaaaacacauca

SEQ ID NO: 1893530 - RNA, 23 nt, Homo sapiens
ugcaaucucuuuucuacauacau

SEQ ID NO: 1893531 - RNA, 16 nt, Homo sapiens
gagacaggguuucacc

SEQ ID NO: 1893532 - RNA, 14 nt, Homo sapiens
gcccaggagcaaca

SEQ ID NO: 1893533 - RNA, 16 nt, Homo sapiens
agcucagacccuuucu

SEQ ID NO: 1893534 - RNA, 12 nt, Homo sapiens
agaacagccgcu

SEQ ID NO: 1893535 - RNA, 18 nt, Homo sapiens
ccuagaaguucaguuuuu

SEQ ID NO: 1893536 - RNA, 14 nt, Homo sapiens
gcugcucugugguc

SEQ ID NO: 1893537 - RNA, 14 nt, Homo sapiens
acuuggaacacaau

SEQ ID NO: 1893538 - RNA, 17 nt, Homo sapiens
aaacaaauggcuguaaa

SEQ ID NO: 1893539 - RNA, 18 nt, Homo sapiens
gccugaaagcaacuacag

SEQ ID NO: 1893540 - RNA, 21 nt, Homo sapiens
uucaauaaaguaucuacaugc

SEQ ID NO: 1893541 - RNA, 17 nt, Homo sapiens
ucucuacuuuccugaug

SEQ ID NO: 1893542 - RNA, 13 nt, Homo sapiens
cuuaaguucagca

SEQ ID NO: 1893543 - RNA, 22 nt, Homo sapiens
guacaaaaccacucgccagagc

SEQ ID NO: 1893544 - RNA, 22 nt, Homo sapiens
gccaauaacuuuucaccaauga

SEQ ID NO: 1893545 - RNA, 14 nt, Homo sapiens
agaaauacaacaga

SEQ ID NO: 1893546 - RNA, 23 nt, Homo sapiens
uguacuggauuuaacuaccuuug

SEQ ID NO: 1893547 - RNA, 19 nt, Homo sapiens
ccaggagauggaauaucaa

SEQ ID NO: 1893548 - RNA, 19 nt, Homo sapiens
ucagaguccucauuauaaa

SEQ ID NO: 1893549 - RNA, 15 nt, Homo sapiens
aguacccuuucaaac

SEQ ID NO: 1893550 - RNA, 18 nt, Homo sapiens
auuuggauuagaaauuua

SEQ ID NO: 1893551 - RNA, 16 nt, Homo sapiens
uauuaccauguaaaua

SEQ ID NO: 1893552 - RNA, 22 nt, Homo sapiens
gcucagggagguuaagugacuu

SEQ ID NO: 1893553 - RNA, 21 nt, Homo sapiens
ccauucaggucuuucuuuccg

SEQ ID NO: 1893554 - RNA, 16 nt, Homo sapiens
gcccuggaaacauaca

SEQ ID NO: 1893555 - RNA, 21 nt, Homo sapiens
gaucuaauaaacuuccaaaca

SEQ ID NO: 1893556 - RNA, 16 nt, Homo sapiens
gagggaaaucuguaaa

SEQ ID NO: 1893557 - RNA, 18 nt, Homo sapiens
gaagauauaacuauugcc

SEQ ID NO: 1893558 - RNA, 20 nt, Homo sapiens
uucccugucagccugacucu

SEQ ID NO: 1893559 - RNA, 21 nt, Homo sapiens
guuugccaagcuaaucugccu

SEQ ID NO: 1893560 - RNA, 20 nt, Homo sapiens
aagaagcuacugcaugaugu

SEQ ID NO: 1893561 - RNA, 13 nt, Homo sapiens
gaugccauaugcc

SEQ ID NO: 1893562 - RNA, 21 nt, Homo sapiens
uguccaugugugugcaagugu

SEQ ID NO: 1893563 - RNA, 21 nt, Homo sapiens
uccccacucccgaaagccuuu

SEQ ID NO: 1893564 - RNA, 17 nt, Homo sapiens
auugaacagcugugagc

SEQ ID NO: 1893565 - RNA, 16 nt, Homo sapiens
acugcuguaaagcaaa

SEQ ID NO: 1893566 - RNA, 14 nt, Homo sapiens
acaucacauuccca

SEQ ID NO: 1893567 - RNA, 13 nt, Homo sapiens
uugaaccugggaa

SEQ ID NO: 1893568 - RNA, 22 nt, Homo sapiens
uuuagauggcuguaaaucuauu

SEQ ID NO: 1893569 - RNA, 14 nt, Homo sapiens
agaggcauuucccc

SEQ ID NO: 1893570 - RNA, 15 nt, Homo sapiens
uaacauucaguuccc

SEQ ID NO: 1893571 - RNA, 17 nt, Homo sapiens
cuuucucucuaauucag

SEQ ID NO: 1893572 - RNA, 18 nt, Homo sapiens
uuaaagcagacagucaca

SEQ ID NO: 1893573 - RNA, 20 nt, Homo sapiens
cugauacaauuugcccaagg

SEQ ID NO: 1893574 - RNA, 13 nt, Homo sapiens
uacccagugccua

SEQ ID NO: 1893575 - RNA, 19 nt, Homo sapiens
caucagagguuugcuuccu

SEQ ID NO: 1893576 - RNA, 23 nt, Homo sapiens
ccaagcccugccccuccuguaca

SEQ ID NO: 1893577 - RNA, 14 nt, Homo sapiens
uaacaaagcacaua

SEQ ID NO: 1893578 - RNA, 18 nt, Homo sapiens
uacuucuaaaucagaaau

SEQ ID NO: 1893579 - RNA, 22 nt, Homo sapiens
aguggccguugcuacaagucac

SEQ ID NO: 1893580 - RNA, 16 nt, Homo sapiens
ccagggugggcagaca

SEQ ID NO: 1893581 - RNA, 22 nt, Homo sapiens
cauauuuuuaaacaaagacagc

SEQ ID NO: 1893582 - RNA, 21 nt, Homo sapiens
agagaugcauuuggaacagug

SEQ ID NO: 1893583 - RNA, 18 nt, Homo sapiens
uggacuucagucuugccu

SEQ ID NO: 1893584 - RNA, 20 nt, Homo sapiens
cccgccccagcccucaguca

SEQ ID NO: 1893585 - RNA, 20 nt, Homo sapiens
augggaaggguccaucucag

SEQ ID NO: 1893586 - RNA, 21 nt, Homo sapiens
ccagcauucucaggcaccagu

SEQ ID NO: 1893587 - RNA, 12 nt, Homo sapiens
aguacagucuua

SEQ ID NO: 1893588 - RNA, 14 nt, Homo sapiens
ugaauuucaguaaa

SEQ ID NO: 1893589 - RNA, 14 nt, Homo sapiens
gcacuggugccaaa

SEQ ID NO: 1893590 - RNA, 22 nt, Homo sapiens
gaggaugaauguaugugcacug

SEQ ID NO: 1893591 - RNA, 19 nt, Homo sapiens
cauaaacguuguguucaua

SEQ ID NO: 1893592 - RNA, 21 nt, Homo sapiens
agugucuguuccuggcaucua

SEQ ID NO: 1893593 - RNA, 19 nt, Homo sapiens
uguugacaucaacauggca

SEQ ID NO: 1893594 - RNA, 12 nt, Homo sapiens
cugaaacuaaug

SEQ ID NO: 1893595 - RNA, 16 nt, Homo sapiens
acccucuccuugucac

SEQ ID NO: 1893596 - RNA, 17 nt, Homo sapiens
uuguaaauacauguaca

SEQ ID NO: 1893597 - RNA, 19 nt, Homo sapiens
caaaccuaaugaucaucug

SEQ ID NO: 1893598 - RNA, 16 nt, Homo sapiens
uaucuagauacuguau

SEQ ID NO: 1893599 - RNA, 24 nt, Homo sapiens
agacgcaagagguuucagcauucc

SEQ ID NO: 1893600 - RNA, 14 nt, Homo sapiens
cuaccccauauaca

SEQ ID NO: 1893601 - RNA, 22 nt, Homo sapiens
uuuagcugacaaaauacuuguc

SEQ ID NO: 1893602 - RNA, 22 nt, Homo sapiens
uuggaagggaguuggugugcua

SEQ ID NO: 1893603 - RNA, 13 nt, Homo sapiens
agaagcucagguu

SEQ ID NO: 1893604 - RNA, 15 nt, Homo sapiens
aaucacacugucuuc

SEQ ID NO: 1893605 - RNA, 18 nt, Homo sapiens
uacucuguuccuucacau

SEQ ID NO: 1893606 - RNA, 17 nt, Homo sapiens
caucccugccacauaca

SEQ ID NO: 1893607 - RNA, 14 nt, Homo sapiens
aagguuaacaaaga

SEQ ID NO: 1893608 - RNA, 17 nt, Homo sapiens
cacgccgucagcugaga

SEQ ID NO: 1893609 - RNA, 21 nt, Homo sapiens
gauggcauccugugaaguccu

SEQ ID NO: 1893610 - RNA, 21 nt, Homo sapiens
ugcaggggugacggcccucau

SEQ ID NO: 1893611 - RNA, 21 nt, Homo sapiens
gccguccaagaacaagucacc

SEQ ID NO: 1893612 - RNA, 15 nt, Homo sapiens
auuguguguucucac

SEQ ID NO: 1893613 - RNA, 15 nt, Homo sapiens
uugcuuauucuaggu

SEQ ID NO: 1893614 - RNA, 17 nt, Homo sapiens
uaccugucucucucuuc

SEQ ID NO: 1893615 - RNA, 21 nt, Homo sapiens
cuuuggaaaaugucacuguga

SEQ ID NO: 1893616 - RNA, 13 nt, Homo sapiens
ugcaaacuuuuaa

SEQ ID NO: 1893617 - RNA, 21 nt, Homo sapiens
cagccaugaaacugacucauc

SEQ ID NO: 1893618 - RNA, 18 nt, Homo sapiens
ugccacuggaagggcaga

SEQ ID NO: 1893619 - RNA, 21 nt, Homo sapiens
ugggagcacuuuguaggcauu

SEQ ID NO: 1893620 - RNA, 23 nt, Homo sapiens
cacugcagucugcagaguucucc

SEQ ID NO: 1893621 - RNA, 19 nt, Homo sapiens
cccuguuauaauuugcaca

SEQ ID NO: 1893622 - RNA, 13 nt, Homo sapiens
cuagagguucaug

SEQ ID NO: 1893623 - RNA, 18 nt, Homo sapiens
ucuuuaaaauucacuaau

SEQ ID NO: 1893624 - RNA, 20 nt, Homo sapiens
gaaaaugcuguuuucaacau

SEQ ID NO: 1893625 - RNA, 16 nt, Homo sapiens
uucuaguugcuuguaa

SEQ ID NO: 1893626 - RNA, 18 nt, Homo sapiens
gcagguguguauuuacuu

SEQ ID NO: 1893627 - RNA, 21 nt, Homo sapiens
gcagaggcggagcugugcuca

SEQ ID NO: 1893628 - RNA, 18 nt, Homo sapiens
gaauauuuguauacacau

SEQ ID NO: 1893629 - RNA, 15 nt, Homo sapiens
cuuuggcgaccuccu

SEQ ID NO: 1893630 - RNA, 16 nt, Homo sapiens
uaaaugaaacuuaaga

SEQ ID NO: 1893631 - RNA, 15 nt, Homo sapiens
cauacucugugcaag

SEQ ID NO: 1893632 - RNA, 14 nt, Homo sapiens
auuaaucaaaggca

SEQ ID NO: 1893633 - RNA, 18 nt, Homo sapiens
gaaagcucuaaagaccau

SEQ ID NO: 1893634 - RNA, 14 nt, Homo sapiens
cuugacaccugucu

SEQ ID NO: 1893635 - RNA, 19 nt, Homo sapiens
uuucuggcuaugcauuuga

SEQ ID NO: 1893636 - RNA, 17 nt, Homo sapiens
caaugacaggacauuug

SEQ ID NO: 1893637 - RNA, 16 nt, Homo sapiens
gcaugcugcuuugcca

SEQ ID NO: 1893638 - RNA, 12 nt, Homo sapiens
gacucuugcaau

SEQ ID NO: 1893639 - RNA, 13 nt, Homo sapiens
uuuagggugauca

SEQ ID NO: 1893640 - RNA, 19 nt, Homo sapiens
agccaaaaugacuuugaac

SEQ ID NO: 1893641 - RNA, 14 nt, Homo sapiens
aggaggaguuccuc

SEQ ID NO: 1893642 - RNA, 23 nt, Homo sapiens
uggaguguuuuuacauugaucuu

SEQ ID NO: 1893643 - RNA, 15 nt, Homo sapiens
ccuuccuucuguaaa

SEQ ID NO: 1893644 - RNA, 13 nt, Homo sapiens
guccuauucugua

SEQ ID NO: 1893645 - RNA, 22 nt, Homo sapiens
uuacacauguaucuaugcauuu

SEQ ID NO: 1893646 - RNA, 19 nt, Homo sapiens
gagauagcauugugaacug

SEQ ID NO: 1893647 - RNA, 17 nt, Homo sapiens
uaugucuauguguauau

SEQ ID NO: 1893648 - RNA, 17 nt, Homo sapiens
ccauagcagcagugcau

SEQ ID NO: 1893649 - RNA, 15 nt, Homo sapiens
aagcucaugagauga

SEQ ID NO: 1893650 - RNA, 21 nt, Homo sapiens
ucuaaagcagagauguauuau

SEQ ID NO: 1893651 - RNA, 15 nt, Homo sapiens
aacauacuguucacu

SEQ ID NO: 1893652 - RNA, 20 nt, Homo sapiens
caggugugagccacugugcc

SEQ ID NO: 1893653 - RNA, 16 nt, Homo sapiens
aaaucaauacaauccu

SEQ ID NO: 1893654 - RNA, 21 nt, Homo sapiens
cucugggggagugcagggugg

SEQ ID NO: 1893655 - RNA, 18 nt, Homo sapiens
aggcaccaguccagcaaa

SEQ ID NO: 1893656 - RNA, 23 nt, Homo sapiens
accugcaccuccccccacugcag

SEQ ID NO: 1893657 - RNA, 14 nt, Homo sapiens
guaaugauacugau

SEQ ID NO: 1893658 - RNA, 17 nt, Homo sapiens
auguugggaagcuauuu

SEQ ID NO: 1893659 - RNA, 19 nt, Homo sapiens
aaauacuguugguggucuu

SEQ ID NO: 1893660 - RNA, 16 nt, Homo sapiens
uuuaguuuugauuuug

SEQ ID NO: 1893661 - RNA, 20 nt, Homo sapiens
acauccucugcuaccaucuc

SEQ ID NO: 1893662 - RNA, 17 nt, Homo sapiens
agacucacauccugacc

SEQ ID NO: 1893663 - RNA, 13 nt, Homo sapiens
aaguaagcccuug

SEQ ID NO: 1893664 - RNA, 20 nt, Homo sapiens
cccauguugaucuuucucaa

SEQ ID NO: 1893665 - RNA, 20 nt, Homo sapiens
gauacgggggcugugacucu

SEQ ID NO: 1893666 - RNA, 12 nt, Homo sapiens
cgagaaccaguu

SEQ ID NO: 1893667 - RNA, 14 nt, Homo sapiens
ugcccaugagucag

SEQ ID NO: 1893668 - RNA, 16 nt, Homo sapiens
aauaguacuuacaaau

SEQ ID NO: 1893669 - RNA, 20 nt, Homo sapiens
caagaaaugucucugcuccu

SEQ ID NO: 1893670 - RNA, 24 nt, Homo sapiens
uaugaaaaauguaaauacucauga

SEQ ID NO: 1893671 - RNA, 20 nt, Homo sapiens
agggucaaggaguacuccaa

SEQ ID NO: 1893672 - RNA, 17 nt, Homo sapiens
aaccucaggaugggcca

SEQ ID NO: 1893673 - RNA, 20 nt, Homo sapiens
aacacacuuuggucauuucu

SEQ ID NO: 1893674 - RNA, 16 nt, Homo sapiens
cagacaccuggacuga

SEQ ID NO: 1893675 - RNA, 17 nt, Homo sapiens
aggaaugugaaagcacg

SEQ ID NO: 1893676 - RNA, 17 nt, Homo sapiens
auccuuugccucaagga

SEQ ID NO: 1893677 - RNA, 19 nt, Homo sapiens
gcaguauguacaggcugag

SEQ ID NO: 1893678 - RNA, 20 nt, Homo sapiens
agccugauuuuccugaugcu

SEQ ID NO: 1893679 - RNA, 14 nt, Homo sapiens
ccuggcucugccag

SEQ ID NO: 1893680 - RNA, 23 nt, Homo sapiens
aacuugaggacacauguccagug

SEQ ID NO: 1893681 - RNA, 12 nt, Homo sapiens
auuggcacugug

SEQ ID NO: 1893682 - RNA, 13 nt, Homo sapiens
uaacuaauuugug

SEQ ID NO: 1893683 - RNA, 17 nt, Homo sapiens
acauuuuuaaaacaacu

SEQ ID NO: 1893684 - RNA, 12 nt, Homo sapiens
cagauuuccauc

SEQ ID NO: 1893685 - RNA, 20 nt, Homo sapiens
acaguuuugguugcuuuaau

SEQ ID NO: 1893686 - RNA, 20 nt, Homo sapiens
accuccaagcauuucaugaa

SEQ ID NO: 1893687 - RNA, 22 nt, Homo sapiens
gaccuggucgucgucuugacuu

SEQ ID NO: 1893688 - RNA, 13 nt, Homo sapiens
uggcagagccaug

SEQ ID NO: 1893689 - RNA, 23 nt, Homo sapiens
uucuguaucuuucauccuugacu

SEQ ID NO: 1893690 - RNA, 17 nt, Homo sapiens
auuuuaugacaguaucg

SEQ ID NO: 1893691 - RNA, 13 nt, Homo sapiens
uauuaaacauucu

SEQ ID NO: 1893692 - RNA, 20 nt, Homo sapiens
uuaacuagguugcuacuuua

SEQ ID NO: 1893693 - RNA, 23 nt, Homo sapiens
uaggaagugaccgagucuaggaa

SEQ ID NO: 1893694 - RNA, 15 nt, Homo sapiens
aguuuugcacuuuua

SEQ ID NO: 1893695 - RNA, 13 nt, Homo sapiens
auacuucuuuuua

SEQ ID NO: 1893696 - RNA, 17 nt, Homo sapiens
uuugccaaggcucuccc

SEQ ID NO: 1893697 - RNA, 23 nt, Homo sapiens
guaagauuuuguuugcaucugaa

SEQ ID NO: 1893698 - RNA, 16 nt, Homo sapiens
cagcccaacagcacuu

SEQ ID NO: 1893699 - RNA, 16 nt, Homo sapiens
gauuccuagauuacau

SEQ ID NO: 1893700 - RNA, 16 nt, Homo sapiens
uguacauauguaaaau

SEQ ID NO: 1893701 - RNA, 19 nt, Homo sapiens
cuccuccuuuguuuaauaa

SEQ ID NO: 1893702 - RNA, 18 nt, Homo sapiens
augguauguaacucuuaa

SEQ ID NO: 1893703 - RNA, 23 nt, Homo sapiens
auagaaauguaaaaguacucuga

SEQ ID NO: 1893704 - RNA, 19 nt, Homo sapiens
aaacugugcuagugcugac

SEQ ID NO: 1893705 - RNA, 14 nt, Homo sapiens
ucccucuucacucc

SEQ ID NO: 1893706 - RNA, 19 nt, Homo sapiens
auguauauuugaacuccuc

SEQ ID NO: 1893707 - RNA, 21 nt, Homo sapiens
uucuaauauuuuuagcucugu

SEQ ID NO: 1893708 - RNA, 17 nt, Homo sapiens
cucuggcacccaucugc

SEQ ID NO: 1893709 - RNA, 15 nt, Homo sapiens
uacauagauggacca

SEQ ID NO: 1893710 - RNA, 15 nt, Homo sapiens
cuguaguuacugugg

SEQ ID NO: 1893711 - RNA, 14 nt, Homo sapiens
uccacacaucuccc

SEQ ID NO: 1893712 - RNA, 17 nt, Homo sapiens
agccgagaucgcgccac

SEQ ID NO: 1893713 - RNA, 15 nt, Homo sapiens
gcagccgccuuccuu

SEQ ID NO: 1893714 - RNA, 19 nt, Homo sapiens
ccacucugauucaccucuu

SEQ ID NO: 1893715 - RNA, 15 nt, Homo sapiens
gccugagcccccuga

SEQ ID NO: 1893716 - RNA, 22 nt, Homo sapiens
aggucaguacccaccugagcuu

SEQ ID NO: 1893717 - RNA, 19 nt, Homo sapiens
ucucuccuuauagacacuu

SEQ ID NO: 1893718 - RNA, 14 nt, Homo sapiens
ucugcugaacauuu

SEQ ID NO: 1893719 - RNA, 18 nt, Homo sapiens
aaggacacuuccugccua

SEQ ID NO: 1893720 - RNA, 15 nt, Homo sapiens
cauuauguucaucac

SEQ ID NO: 1893721 - RNA, 12 nt, Homo sapiens
uaaaaugauuaa

SEQ ID NO: 1893722 - RNA, 16 nt, Homo sapiens
cccuuggcggggagaa

SEQ ID NO: 1893723 - RNA, 18 nt, Homo sapiens
uacacagaaacacugccu

SEQ ID NO: 1893724 - RNA, 20 nt, Homo sapiens
cugcuuuuggggcucuugau

SEQ ID NO: 1893725 - RNA, 21 nt, Homo sapiens
uccaaggaaauaaugugaaug

SEQ ID NO: 1893726 - RNA, 21 nt, Homo sapiens
auaaacgcagaagagggggag

SEQ ID NO: 1893727 - RNA, 19 nt, Homo sapiens
ugagauuguccucauuucu

SEQ ID NO: 1893728 - RNA, 15 nt, Homo sapiens
ucaaaccacuugccu

SEQ ID NO: 1893729 - RNA, 19 nt, Homo sapiens
gaccccgagaccgcgcugg

SEQ ID NO: 1893730 - RNA, 19 nt, Homo sapiens
uaggaaagcagugcaguac

SEQ ID NO: 1893731 - RNA, 18 nt, Homo sapiens
uggcucccaggacacgac

SEQ ID NO: 1893732 - RNA, 18 nt, Homo sapiens
cucuugaaaaaugcaugu

SEQ ID NO: 1893733 - RNA, 21 nt, Homo sapiens
acauuuuaauuuuaguuucau

SEQ ID NO: 1893734 - RNA, 18 nt, Homo sapiens
auagugccuaaagugcug

SEQ ID NO: 1893735 - RNA, 19 nt, Homo sapiens
augcaucauaaaacaaauc

SEQ ID NO: 1893736 - RNA, 16 nt, Homo sapiens
ugagcagugaccuucc

SEQ ID NO: 1893737 - RNA, 17 nt, Homo sapiens
agguuuuaaagugauua

SEQ ID NO: 1893738 - RNA, 22 nt, Homo sapiens
acuguucacacacacaguuuga

SEQ ID NO: 1893739 - RNA, 19 nt, Homo sapiens
ugauuaagugcacaccgug

SEQ ID NO: 1893740 - RNA, 19 nt, Homo sapiens
uguggucacagaugcacaa

SEQ ID NO: 1893741 - RNA, 19 nt, Homo sapiens
ugcuucugcuuauucaguc

SEQ ID NO: 1893742 - RNA, 13 nt, Homo sapiens
caaguucucccca

SEQ ID NO: 1893743 - RNA, 18 nt, Homo sapiens
gaugagcagucacacugu

SEQ ID NO: 1893744 - RNA, 19 nt, Homo sapiens
uccccacccaaacuuuauu

SEQ ID NO: 1893745 - RNA, 14 nt, Homo sapiens
cagccggguaccuc

SEQ ID NO: 1893746 - RNA, 17 nt, Homo sapiens
acugccagcucucugau

SEQ ID NO: 1893747 - RNA, 17 nt, Homo sapiens
ucuguugaggcaucaaa

SEQ ID NO: 1893748 - RNA, 14 nt, Homo sapiens
agcucuggugaccu

SEQ ID NO: 1893749 - RNA, 23 nt, Homo sapiens
uaggaaaccgacgaaaaagucac

SEQ ID NO: 1893750 - RNA, 15 nt, Homo sapiens
gagcagcagccagca

SEQ ID NO: 1893751 - RNA, 15 nt, Homo sapiens
cagagagaacaacag

SEQ ID NO: 1893752 - RNA, 16 nt, Homo sapiens
cacuucccuacaugga

SEQ ID NO: 1893753 - RNA, 22 nt, Homo sapiens
ucaaaccauuuuuaaaauguga

SEQ ID NO: 1893754 - RNA, 20 nt, Homo sapiens
ccuccuuuucuuucucucuc

SEQ ID NO: 1893755 - RNA, 22 nt, Homo sapiens
cauuacuuuaauacucaccucc

SEQ ID NO: 1893756 - RNA, 23 nt, Homo sapiens
auuucacuugaugauacaaugaa

SEQ ID NO: 1893757 - RNA, 21 nt, Homo sapiens
ugguauuaauaaacacauaca

SEQ ID NO: 1893758 - RNA, 15 nt, Homo sapiens
gagauuauguaacuc

SEQ ID NO: 1893759 - RNA, 15 nt, Homo sapiens
agccuuccacaguga

SEQ ID NO: 1893760 - RNA, 14 nt, Homo sapiens
cuagaucaauuaau

SEQ ID NO: 1893761 - RNA, 17 nt, Homo sapiens
gucagguccaugugcac

SEQ ID NO: 1893762 - RNA, 14 nt, Homo sapiens
aguguacucuauaa

SEQ ID NO: 1893763 - RNA, 17 nt, Homo sapiens
aggcccugcacugccag

SEQ ID NO: 1893764 - RNA, 13 nt, Homo sapiens
aaguccacugggg

SEQ ID NO: 1893765 - RNA, 19 nt, Homo sapiens
aacuauuaaggauguagcu

SEQ ID NO: 1893766 - RNA, 16 nt, Homo sapiens
uggaaaccucuacaua

SEQ ID NO: 1893767 - RNA, 20 nt, Homo sapiens
caccuuguaaccagugcaga

SEQ ID NO: 1893768 - RNA, 18 nt, Homo sapiens
ucugacuccacucaaaga

SEQ ID NO: 1893769 - RNA, 16 nt, Homo sapiens
aggaagugaauugaug

SEQ ID NO: 1893770 - RNA, 23 nt, Homo sapiens
ggacuggcuucucuuucucugag

SEQ ID NO: 1893771 - RNA, 14 nt, Homo sapiens
uucuuuauggaaau

SEQ ID NO: 1893772 - RNA, 17 nt, Homo sapiens
agucaucuuagcuuucc

SEQ ID NO: 1893773 - RNA, 23 nt, Homo sapiens
auggaccagugguuuccagucau

SEQ ID NO: 1893774 - RNA, 17 nt, Homo sapiens
ugacucuucuuaucaca

SEQ ID NO: 1893775 - RNA, 14 nt, Homo sapiens
aggcagccagccgu

SEQ ID NO: 1893776 - RNA, 15 nt, Homo sapiens
agugagacuguacau

SEQ ID NO: 1893777 - RNA, 16 nt, Homo sapiens
ccuuccugccuagucu

SEQ ID NO: 1893778 - RNA, 23 nt, Homo sapiens
cauggcccuaccagacacugcug

SEQ ID NO: 1893779 - RNA, 20 nt, Homo sapiens
gccuguagucucagcuaguu

SEQ ID NO: 1893780 - RNA, 22 nt, Homo sapiens
ucagugagccaugaucaugcca

SEQ ID NO: 1893781 - RNA, 18 nt, Homo sapiens
cauucuagaaacaggaaa

SEQ ID NO: 1893782 - RNA, 16 nt, Homo sapiens
cuauucuugauguaaa

SEQ ID NO: 1893783 - RNA, 21 nt, Homo sapiens
aaaagauggggucuguaaaau

SEQ ID NO: 1893784 - RNA, 20 nt, Homo sapiens
cauauggagcucaugucagc

SEQ ID NO: 1893785 - RNA, 21 nt, Homo sapiens
auuuuuguuagcaaagauuaa

SEQ ID NO: 1893786 - RNA, 16 nt, Homo sapiens
agcuacugccaagggc

SEQ ID NO: 1893787 - RNA, 23 nt, Homo sapiens
cuugggggaggaggaacaaauaa

SEQ ID NO: 1893788 - RNA, 22 nt, Homo sapiens
ccacauugcuucauuaaaacaa

SEQ ID NO: 1893789 - RNA, 21 nt, Homo sapiens
gaaaggcuguggaagggccaa

SEQ ID NO: 1893790 - RNA, 14 nt, Homo sapiens
uaaaaugacaaaca

SEQ ID NO: 1893791 - RNA, 14 nt, Homo sapiens
uaaaauaaaugaaa

SEQ ID NO: 1893792 - RNA, 20 nt, Homo sapiens
gccgagauugcaccacugca

SEQ ID NO: 1893793 - RNA, 20 nt, Homo sapiens
gccaagauugcgccacugca

SEQ ID NO: 1893794 - RNA, 13 nt, Homo sapiens
caaacuuuaguuu

SEQ ID NO: 1893795 - RNA, 22 nt, Homo sapiens
ucuggcccuaacuccuauaaag

SEQ ID NO: 1893796 - RNA, 16 nt, Homo sapiens
cuagcaccaggacuca

SEQ ID NO: 1893797 - RNA, 16 nt, Homo sapiens
ggagaaacacuugaac

SEQ ID NO: 1893798 - RNA, 22 nt, Homo sapiens
caucucuugaaaccuguuaaaa

SEQ ID NO: 1893799 - RNA, 15 nt, Homo sapiens
agugaccacgcauug

SEQ ID NO: 1893800 - RNA, 13 nt, Homo sapiens
uuuggaagcacug

SEQ ID NO: 1893801 - RNA, 15 nt, Homo sapiens
cugccaugccagcuu

SEQ ID NO: 1893802 - RNA, 14 nt, Homo sapiens
aggcaaaugaugcc

SEQ ID NO: 1893803 - RNA, 20 nt, Homo sapiens
ucuuagaaacucaggaaaga

SEQ ID NO: 1893804 - RNA, 22 nt, Homo sapiens
uuggggacuaacccaaugccug

SEQ ID NO: 1893805 - RNA, 20 nt, Homo sapiens
uggccacaguaauuggucau

SEQ ID NO: 1893806 - RNA, 16 nt, Homo sapiens
cuccucuucacuuggc

SEQ ID NO: 1893807 - RNA, 15 nt, Homo sapiens
ggaccagccacugug

SEQ ID NO: 1893808 - RNA, 16 nt, Homo sapiens
caccacaucuggcuaa

SEQ ID NO: 1893809 - RNA, 20 nt, Homo sapiens
cccaccagggagaugucuag

SEQ ID NO: 1893810 - RNA, 23 nt, Homo sapiens
ggucuguuguaggguugccagau

SEQ ID NO: 1893811 - RNA, 19 nt, Homo sapiens
aaaguaacagagcaucaaa

SEQ ID NO: 1893812 - RNA, 19 nt, Homo sapiens
aaagucagggagccuggaa

SEQ ID NO: 1893813 - RNA, 12 nt, Homo sapiens
gcaggugccuug

SEQ ID NO: 1893814 - RNA, 18 nt, Homo sapiens
uuacucaggguucaucug

SEQ ID NO: 1893815 - RNA, 23 nt, Homo sapiens
acuugguugguccuugucugcac

SEQ ID NO: 1893816 - RNA, 11 nt, Homo sapiens
cauucugugac

SEQ ID NO: 1893817 - RNA, 21 nt, Homo sapiens
gcaggcauggcuggugccuga

SEQ ID NO: 1893818 - RNA, 19 nt, Homo sapiens
acauuuagccaaucuuucu

SEQ ID NO: 1893819 - RNA, 13 nt, Homo sapiens
gugugauugcaca

SEQ ID NO: 1893820 - RNA, 11 nt, Homo sapiens
gauagcugucc

SEQ ID NO: 1893821 - RNA, 15 nt, Homo sapiens
gcaggcugguuugca

SEQ ID NO: 1893822 - RNA, 19 nt, Homo sapiens
auaauugcuuugccaaaau

SEQ ID NO: 1893823 - RNA, 23 nt, Homo sapiens
ggcuguaaauccuagacuugaaa

SEQ ID NO: 1893824 - RNA, 16 nt, Homo sapiens
uuacaaugugcacuga

SEQ ID NO: 1893825 - RNA, 19 nt, Homo sapiens
guuugacaccagggccagu

SEQ ID NO: 1893826 - RNA, 20 nt, Homo sapiens
gacauuucucaagggccaug

SEQ ID NO: 1893827 - RNA, 18 nt, Homo sapiens
acauauuguaaagcccau

SEQ ID NO: 1893828 - RNA, 17 nt, Homo sapiens
auucugcauugcuagau

SEQ ID NO: 1893829 - RNA, 17 nt, Homo sapiens
uuucuacagugaauuua

SEQ ID NO: 1893830 - RNA, 22 nt, Homo sapiens
ugucacuugcuggcugugaaac

SEQ ID NO: 1893831 - RNA, 16 nt, Homo sapiens
agggcaggaccaaugg

SEQ ID NO: 1893832 - RNA, 17 nt, Homo sapiens
cauagaguucagacuuu

SEQ ID NO: 1893833 - RNA, 18 nt, Homo sapiens
ugggagaacuaacagagg

SEQ ID NO: 1893834 - RNA, 16 nt, Homo sapiens
guuacagcacaaaaug

SEQ ID NO: 1893835 - RNA, 18 nt, Homo sapiens
auuaagacuuacuugcau

SEQ ID NO: 1893836 - RNA, 22 nt, Homo sapiens
auucauagugauagagugcagu

SEQ ID NO: 1893837 - RNA, 22 nt, Homo sapiens
aaggaauuuguuuaaauaacau

SEQ ID NO: 1893838 - RNA, 17 nt, Homo sapiens
ugcucucaauauauaau

SEQ ID NO: 1893839 - RNA, 17 nt, Homo sapiens
cuguagugagaaacuga

SEQ ID NO: 1893840 - RNA, 13 nt, Homo sapiens
ucacugagaccaa

SEQ ID NO: 1893841 - RNA, 17 nt, Homo sapiens
guuaggggccaauaaaa

SEQ ID NO: 1893842 - RNA, 22 nt, Homo sapiens
gggaauggggacacggugucca

SEQ ID NO: 1893843 - RNA, 23 nt, Homo sapiens
uaccguucacuuccccuuccaac

SEQ ID NO: 1893844 - RNA, 17 nt, Homo sapiens
auacaaaaauacucaga

SEQ ID NO: 1893845 - RNA, 23 nt, Homo sapiens
cugccaucauugaugaucacugu

SEQ ID NO: 1893846 - RNA, 17 nt, Homo sapiens
acucuauucauuccuug

SEQ ID NO: 1893847 - RNA, 12 nt, Homo sapiens
cuugcugugaaa

SEQ ID NO: 1893848 - RNA, 22 nt, Homo sapiens
uuaacugugcguuaaauaagca

SEQ ID NO: 1893849 - RNA, 17 nt, Homo sapiens
auauucaaguaacacuu

SEQ ID NO: 1893850 - RNA, 18 nt, Homo sapiens
uaccuuucuagccuuaga

SEQ ID NO: 1893851 - RNA, 12 nt, Homo sapiens
uuaaaaaagccu

SEQ ID NO: 1893852 - RNA, 20 nt, Homo sapiens
ucauauuuuguauauaucug

SEQ ID NO: 1893853 - RNA, 16 nt, Homo sapiens
aagcauagacgucuca

SEQ ID NO: 1893854 - RNA, 14 nt, Homo sapiens
cguggaacauucug

SEQ ID NO: 1893855 - RNA, 18 nt, Homo sapiens
aaggaguauaccaugaga

SEQ ID NO: 1893856 - RNA, 18 nt, Homo sapiens
cugccagggccagucuug

SEQ ID NO: 1893857 - RNA, 19 nt, Homo sapiens
gaccaguuguugauaacca

SEQ ID NO: 1893858 - RNA, 14 nt, Homo sapiens
ccauccauauacuu

SEQ ID NO: 1893859 - RNA, 23 nt, Homo sapiens
guucucagagccaaguccucccu

SEQ ID NO: 1893860 - RNA, 18 nt, Homo sapiens
gccugcccgcugcaaugc

SEQ ID NO: 1893861 - RNA, 11 nt, Homo sapiens
uccucccucaa

SEQ ID NO: 1893862 - RNA, 22 nt, Homo sapiens
aaugcaucauucuuguuaauua

SEQ ID NO: 1893863 - RNA, 16 nt, Homo sapiens
augauaauuuacuuaa

SEQ ID NO: 1893864 - RNA, 13 nt, Homo sapiens
acauuaacuucag

SEQ ID NO: 1893865 - RNA, 16 nt, Homo sapiens
cauuguuuuguguuua

SEQ ID NO: 1893866 - RNA, 18 nt, Homo sapiens
agcauuguaaaugugcuu

SEQ ID NO: 1893867 - RNA, 15 nt, Homo sapiens
caucuccugauuucu

SEQ ID NO: 1893868 - RNA, 20 nt, Homo sapiens
gcugcccccuccaggccagu

SEQ ID NO: 1893869 - RNA, 15 nt, Homo sapiens
aagacuggacgggga

SEQ ID NO: 1893870 - RNA, 13 nt, Homo sapiens
cucaccaagcuca

SEQ ID NO: 1893871 - RNA, 18 nt, Homo sapiens
auacauuuuauugucaga

SEQ ID NO: 1893872 - RNA, 18 nt, Homo sapiens
cugcagagcaccuuugca

SEQ ID NO: 1893873 - RNA, 12 nt, Homo sapiens
uaaauggagcuu

SEQ ID NO: 1893874 - RNA, 19 nt, Homo sapiens
gcaagauugaaauuugaac

SEQ ID NO: 1893875 - RNA, 15 nt, Homo sapiens
acacagagauaugca

SEQ ID NO: 1893876 - RNA, 13 nt, Homo sapiens
uaagguaacaugg

SEQ ID NO: 1893877 - RNA, 18 nt, Homo sapiens
auauugauuauagcaaug

SEQ ID NO: 1893878 - RNA, 17 nt, Homo sapiens
guuuaaaaacaaaggaa

SEQ ID NO: 1893879 - RNA, 18 nt, Homo sapiens
cucaggggcuccaugcug

SEQ ID NO: 1893880 - RNA, 16 nt, Homo sapiens
uuuaacauacaaucau

SEQ ID NO: 1893881 - RNA, 20 nt, Homo sapiens
ugcagcaaccagagcacugu

SEQ ID NO: 1893882 - RNA, 16 nt, Homo sapiens
uuaugagcagaaggaa

SEQ ID NO: 1893883 - RNA, 21 nt, Homo sapiens
ucccccaguuccucccaggaa

SEQ ID NO: 1893884 - RNA, 17 nt, Homo sapiens
uaagagccauuuagggg

SEQ ID NO: 1893885 - RNA, 14 nt, Homo sapiens
guggggugcacucg

SEQ ID NO: 1893886 - RNA, 14 nt, Homo sapiens
ucacugcucuucag

SEQ ID NO: 1893887 - RNA, 19 nt, Homo sapiens
cugcauugguuuuccauga

SEQ ID NO: 1893888 - RNA, 22 nt, Homo sapiens
cgagaggggaagaguguacugg

SEQ ID NO: 1893889 - RNA, 20 nt, Homo sapiens
guaguauggccugugucacu

SEQ ID NO: 1893890 - RNA, 14 nt, Homo sapiens
agcuugcaaugagc

SEQ ID NO: 1893891 - RNA, 17 nt, Homo sapiens
agaccagggaccacagg

SEQ ID NO: 1893892 - RNA, 18 nt, Homo sapiens
aaagaaguucacaucaga

SEQ ID NO: 1893893 - RNA, 15 nt, Homo sapiens
aaccauuuaccaucu

SEQ ID NO: 1893894 - RNA, 18 nt, Homo sapiens
agcugucgccgcuagucu

SEQ ID NO: 1893895 - RNA, 21 nt, Homo sapiens
acgcaggccagcaacucccag

SEQ ID NO: 1893896 - RNA, 15 nt, Homo sapiens
ggcauucacaccacc

SEQ ID NO: 1893897 - RNA, 21 nt, Homo sapiens
gcuuuagcugcugucuucccc

SEQ ID NO: 1893898 - RNA, 19 nt, Homo sapiens
cccagaacuggacucagga

SEQ ID NO: 1893899 - RNA, 22 nt, Homo sapiens
cagaugcaaucacuuuuggaca

SEQ ID NO: 1893900 - RNA, 17 nt, Homo sapiens
gaguccaggaguuugag

SEQ ID NO: 1893901 - RNA, 19 nt, Homo sapiens
gauagauguugcucuuuca

SEQ ID NO: 1893902 - RNA, 17 nt, Homo sapiens
ugacucuaaaugcaguu

SEQ ID NO: 1893903 - RNA, 14 nt, Homo sapiens
gccuaaaugccuua

SEQ ID NO: 1893904 - RNA, 15 nt, Homo sapiens
aaacuucaucuucaa

SEQ ID NO: 1893905 - RNA, 16 nt, Homo sapiens
auauugcccaggcugu

SEQ ID NO: 1893906 - RNA, 14 nt, Homo sapiens
ucugcccauucucu

SEQ ID NO: 1893907 - RNA, 16 nt, Homo sapiens
uacuuagacaguaugc

SEQ ID NO: 1893908 - RNA, 21 nt, Homo sapiens
uucaugaacacagccugggac

SEQ ID NO: 1893909 - RNA, 16 nt, Homo sapiens
auaaguuaacuuccaa

SEQ ID NO: 1893910 - RNA, 18 nt, Homo sapiens
ugagggaaagcccagaaa

SEQ ID NO: 1893911 - RNA, 21 nt, Homo sapiens
cccgggguggccacaccacag

SEQ ID NO: 1893912 - RNA, 19 nt, Homo sapiens
ccaugauaacugcaauuuu

SEQ ID NO: 1893913 - RNA, 14 nt, Homo sapiens
accaggacagcagc

SEQ ID NO: 1893914 - RNA, 13 nt, Homo sapiens
ugcagcccacugc

SEQ ID NO: 1893915 - RNA, 14 nt, Homo sapiens
uuaccacaccccau

SEQ ID NO: 1893916 - RNA, 21 nt, Homo sapiens
cgccaccucuugucagugcuc

SEQ ID NO: 1893917 - RNA, 21 nt, Homo sapiens
agacggccuagggguggcgcu

SEQ ID NO: 1893918 - RNA, 15 nt, Homo sapiens
aauauagcuguacaa

SEQ ID NO: 1893919 - RNA, 15 nt, Homo sapiens
aucaggucaccgcga

SEQ ID NO: 1893920 - RNA, 20 nt, Homo sapiens
ucuuagugugccaagaguuc

SEQ ID NO: 1893921 - RNA, 18 nt, Homo sapiens
caucagagccagucucac

SEQ ID NO: 1893922 - RNA, 13 nt, Homo sapiens
ggacccuccagag

SEQ ID NO: 1893923 - RNA, 15 nt, Homo sapiens
gaccuccacuugcuu

SEQ ID NO: 1893924 - RNA, 19 nt, Homo sapiens
uaauaagguuuuaauuuag

SEQ ID NO: 1893925 - RNA, 17 nt, Homo sapiens
uguagacggaacagugu

SEQ ID NO: 1893926 - RNA, 23 nt, Homo sapiens
caugcuuaauaaacaugucacaa

SEQ ID NO: 1893927 - RNA, 16 nt, Homo sapiens
ggauuaugcccaugaa

SEQ ID NO: 1893928 - RNA, 23 nt, Homo sapiens
uagaccucauuaaauauuugaca

SEQ ID NO: 1893929 - RNA, 21 nt, Homo sapiens
aaaaagcuuuaugauuuucau

SEQ ID NO: 1893930 - RNA, 23 nt, Homo sapiens
accuuggaucucggucacaggga

SEQ ID NO: 1893931 - RNA, 15 nt, Homo sapiens
agauccugucccaug

SEQ ID NO: 1893932 - RNA, 17 nt, Homo sapiens
uccauguaaauugcaaa

SEQ ID NO: 1893933 - RNA, 22 nt, Homo sapiens
aagcgagucauuucguucccug

SEQ ID NO: 1893934 - RNA, 15 nt, Homo sapiens
aggcagggcccuuaa

SEQ ID NO: 1893935 - RNA, 17 nt, Homo sapiens
acguagauuuuugcucu

SEQ ID NO: 1893936 - RNA, 19 nt, Homo sapiens
agcccccggucaccuuccu

SEQ ID NO: 1893937 - RNA, 17 nt, Homo sapiens
uauucucauucuuccca

SEQ ID NO: 1893938 - RNA, 19 nt, Homo sapiens
cucuugaaaucuguuaaaa

SEQ ID NO: 1893939 - RNA, 11 nt, Homo sapiens
cagaaggcaau

SEQ ID NO: 1893940 - RNA, 22 nt, Homo sapiens
ugauaauucuuacuguucugaa

SEQ ID NO: 1893941 - RNA, 12 nt, Homo sapiens
ugaugauguucu

SEQ ID NO: 1893942 - RNA, 12 nt, Homo sapiens
uucagaugugaa

SEQ ID NO: 1893943 - RNA, 22 nt, Homo sapiens
aggaaagucacccaaacacuuc

SEQ ID NO: 1893944 - RNA, 19 nt, Homo sapiens
uaaacaucacaugagacaa

SEQ ID NO: 1893945 - RNA, 16 nt, Homo sapiens
ggagcagccuccagug

SEQ ID NO: 1893946 - RNA, 20 nt, Homo sapiens
caaauugggaaauccauucc

SEQ ID NO: 1893947 - RNA, 20 nt, Homo sapiens
uguauggugauaaaagucac

SEQ ID NO: 1893948 - RNA, 15 nt, Homo sapiens
aggugaacagucacg

SEQ ID NO: 1893949 - RNA, 18 nt, Homo sapiens
uggacugguugguuuugc

SEQ ID NO: 1893950 - RNA, 22 nt, Homo sapiens
agaugaaauuugauaaacugaa

SEQ ID NO: 1893951 - RNA, 16 nt, Homo sapiens
guucaaagacugugaa

SEQ ID NO: 1893952 - RNA, 16 nt, Homo sapiens
guaguaaaacacagag

SEQ ID NO: 1893953 - RNA, 11 nt, Homo sapiens
ugcuauuucag

SEQ ID NO: 1893954 - RNA, 21 nt, Homo sapiens
ucacaaucaucaucauucuca

SEQ ID NO: 1893955 - RNA, 13 nt, Homo sapiens
cacuucucaggaa

SEQ ID NO: 1893956 - RNA, 16 nt, Homo sapiens
ugaguacuacaguccu

SEQ ID NO: 1893957 - RNA, 13 nt, Homo sapiens
agaacuuaaucug

SEQ ID NO: 1893958 - RNA, 16 nt, Homo sapiens
cuuaacggaccaaagc

SEQ ID NO: 1893959 - RNA, 14 nt, Homo sapiens
auucugauuacaca

SEQ ID NO: 1893960 - RNA, 21 nt, Homo sapiens
ucugguuguccucacugcuga

SEQ ID NO: 1893961 - RNA, 15 nt, Homo sapiens
uucgaccacuacagc

SEQ ID NO: 1893962 - RNA, 20 nt, Homo sapiens
ccccaggccggagcccagau

SEQ ID NO: 1893963 - RNA, 15 nt, Homo sapiens
uggaaacugcucaga

SEQ ID NO: 1893964 - RNA, 20 nt, Homo sapiens
agccaggaccacagagcucc

SEQ ID NO: 1893965 - RNA, 16 nt, Homo sapiens
cauccgcgugugccug

SEQ ID NO: 1893966 - RNA, 19 nt, Homo sapiens
ucuaucccacccaacagcu

SEQ ID NO: 1893967 - RNA, 17 nt, Homo sapiens
uaaguguguauccagaa

SEQ ID NO: 1893968 - RNA, 11 nt, Homo sapiens
auacaaaaaga

SEQ ID NO: 1893969 - RNA, 11 nt, Homo sapiens
agacaaaaaua

SEQ ID NO: 1893970 - RNA, 18 nt, Homo sapiens
agcuccugcucauugugg

SEQ ID NO: 1893971 - RNA, 16 nt, Homo sapiens
uugaaucuaaaaccaa

SEQ ID NO: 1893972 - RNA, 17 nt, Homo sapiens
ccaagguugcacagcaa

SEQ ID NO: 1893973 - RNA, 16 nt, Homo sapiens
agaauuacaguacaca

SEQ ID NO: 1893974 - RNA, 18 nt, Homo sapiens
auccuguuucuugcucug

SEQ ID NO: 1893975 - RNA, 15 nt, Homo sapiens
auuauaguagcuuau

SEQ ID NO: 1893976 - RNA, 21 nt, Homo sapiens
uggaaaaggagcuucaguauu

SEQ ID NO: 1893977 - RNA, 16 nt, Homo sapiens
ccugcaugugcuguca

SEQ ID NO: 1893978 - RNA, 14 nt, Homo sapiens
ugcauaagccucag

SEQ ID NO: 1893979 - RNA, 12 nt, Homo sapiens
cagugcagugaa

SEQ ID NO: 1893980 - RNA, 23 nt, Homo sapiens
ugugauccugccuugcugugaaa

SEQ ID NO: 1893981 - RNA, 21 nt, Homo sapiens
gcauagcacccguggugcaug

SEQ ID NO: 1893982 - RNA, 15 nt, Homo sapiens
uccccuuccauccca

SEQ ID NO: 1893983 - RNA, 19 nt, Homo sapiens
aauccuuuuccuguucaua

SEQ ID NO: 1893984 - RNA, 20 nt, Homo sapiens
ggccaggcugcucuugaacu

SEQ ID NO: 1893985 - RNA, 12 nt, Homo sapiens
uccuaacaggaa

SEQ ID NO: 1893986 - RNA, 22 nt, Homo sapiens
uucaugcagccuaaaguacagc

SEQ ID NO: 1893987 - RNA, 20 nt, Homo sapiens
acauuucuugguuccaauaa

SEQ ID NO: 1893988 - RNA, 18 nt, Homo sapiens
uaugugaauuuugccaua

SEQ ID NO: 1893989 - RNA, 17 nt, Homo sapiens
aggagcacgaggucugg

SEQ ID NO: 1893990 - RNA, 14 nt, Homo sapiens
accuuagaaaucau

SEQ ID NO: 1893991 - RNA, 15 nt, Homo sapiens
gcuccccaauacucu

SEQ ID NO: 1893992 - RNA, 12 nt, Homo sapiens
cggccaggguug

SEQ ID NO: 1893993 - RNA, 21 nt, Homo sapiens
ccucaacugagaagccaagcc

SEQ ID NO: 1893994 - RNA, 17 nt, Homo sapiens
aggaaguuaugggaaua

SEQ ID NO: 1893995 - RNA, 14 nt, Homo sapiens
aacaugugugacug

SEQ ID NO: 1893996 - RNA, 16 nt, Homo sapiens
accugaucuggcccaa

SEQ ID NO: 1893997 - RNA, 17 nt, Homo sapiens
aaucaagaagcugugac

SEQ ID NO: 1893998 - RNA, 12 nt, Homo sapiens
ccccgggcgggu

SEQ ID NO: 1893999 - RNA, 22 nt, Homo sapiens
ggcuugucggagcaaguuucau

SEQ ID NO: 1894000 - RNA, 14 nt, Homo sapiens
aauuauucuaguca

SEQ ID NO: 1894001 - RNA, 22 nt, Homo sapiens
uuaaaaaaaauuaaaaccaauu

SEQ ID NO: 1894002 - RNA, 12 nt, Homo sapiens
gagaaacaggcc

SEQ ID NO: 1894003 - RNA, 14 nt, Homo sapiens
caggagacaguuca

SEQ ID NO: 1894004 - RNA, 14 nt, Homo sapiens
aucuuacaaagugu

SEQ ID NO: 1894005 - RNA, 15 nt, Homo sapiens
cuguggcacuugccu

SEQ ID NO: 1894006 - RNA, 22 nt, Homo sapiens
uauuuuaucaaggaagucuuca

SEQ ID NO: 1894007 - RNA, 18 nt, Homo sapiens
cauggagaccaucuaccc

SEQ ID NO: 1894008 - RNA, 14 nt, Homo sapiens
ggcucuucaaagac

SEQ ID NO: 1894009 - RNA, 15 nt, Homo sapiens
cuuuccaaugugugc

SEQ ID NO: 1894010 - RNA, 21 nt, Homo sapiens
cugcacagauggauuugccug

SEQ ID NO: 1894011 - RNA, 14 nt, Homo sapiens
guguuguguccuga

SEQ ID NO: 1894012 - RNA, 15 nt, Homo sapiens
ccagcaguucucugc

SEQ ID NO: 1894013 - RNA, 17 nt, Homo sapiens
acugcuguauaagguaa

SEQ ID NO: 1894014 - RNA, 18 nt, Homo sapiens
uccaccccccggccacac

SEQ ID NO: 1894015 - RNA, 18 nt, Homo sapiens
aaggaaggcuccaucucc

SEQ ID NO: 1894016 - RNA, 22 nt, Homo sapiens
cugcagcacgcuggacagcacu

SEQ ID NO: 1894017 - RNA, 18 nt, Homo sapiens
caaccagagaagcugcua

SEQ ID NO: 1894018 - RNA, 22 nt, Homo sapiens
gcuaaguuugucuacacuaaaa

SEQ ID NO: 1894019 - RNA, 18 nt, Homo sapiens
cuacccuuaauaacauac

SEQ ID NO: 1894020 - RNA, 22 nt, Homo sapiens
uuuccaaugccaauucaucuca

SEQ ID NO: 1894021 - RNA, 15 nt, Homo sapiens
ggucauacaugcaua

SEQ ID NO: 1894022 - RNA, 13 nt, Homo sapiens
ucauguuacucag

SEQ ID NO: 1894023 - RNA, 23 nt, Homo sapiens
guuuucaauaacaaagcacauaa

SEQ ID NO: 1894024 - RNA, 12 nt, Homo sapiens
uauauacugugu

SEQ ID NO: 1894025 - RNA, 12 nt, Homo sapiens
uucugcauguac

SEQ ID NO: 1894026 - RNA, 17 nt, Homo sapiens
ucccaugguagacugug

SEQ ID NO: 1894027 - RNA, 21 nt, Homo sapiens
ccccaccuucccccaacuacc

SEQ ID NO: 1894028 - RNA, 21 nt, Homo sapiens
augcaguuucaaguaccaaaa

SEQ ID NO: 1894029 - RNA, 17 nt, Homo sapiens
guuucaucaaugcaguu

SEQ ID NO: 1894030 - RNA, 22 nt, Homo sapiens
uuuguauagaguucaucccagc

SEQ ID NO: 1894031 - RNA, 21 nt, Homo sapiens
ggaccucuucuggagauggaa

SEQ ID NO: 1894032 - RNA, 22 nt, Homo sapiens
cucugccuccaggagggcauca

SEQ ID NO: 1894033 - RNA, 16 nt, Homo sapiens
gcauguuucacagugg

SEQ ID NO: 1894034 - RNA, 22 nt, Homo sapiens
aucuggcuacuuuuucauguau

SEQ ID NO: 1894035 - RNA, 15 nt, Homo sapiens
uuaagaaacuguuuc

SEQ ID NO: 1894036 - RNA, 18 nt, Homo sapiens
uguaagaguucagacuca

SEQ ID NO: 1894037 - RNA, 16 nt, Homo sapiens
cuacagagagaaaaau

SEQ ID NO: 1894038 - RNA, 15 nt, Homo sapiens
uccugcuucugauau

SEQ ID NO: 1894039 - RNA, 17 nt, Homo sapiens
gaauugaugaugcaguu

SEQ ID NO: 1894040 - RNA, 14 nt, Homo sapiens
uuaauugaaagaau

SEQ ID NO: 1894041 - RNA, 15 nt, Homo sapiens
aauaccuuggucuca

SEQ ID NO: 1894042 - RNA, 15 nt, Homo sapiens
gaaaguccaagccgu

SEQ ID NO: 1894043 - RNA, 15 nt, Homo sapiens
uacuuggaauuugcu

SEQ ID NO: 1894044 - RNA, 17 nt, Homo sapiens
uauuuauuuuauggcaa

SEQ ID NO: 1894045 - RNA, 18 nt, Homo sapiens
ccaacugauguccauuag

SEQ ID NO: 1894046 - RNA, 14 nt, Homo sapiens
aaacguauuuugau

SEQ ID NO: 1894047 - RNA, 20 nt, Homo sapiens
ugcacaggugacaagcguca

SEQ ID NO: 1894048 - RNA, 17 nt, Homo sapiens
caugugccgggccauug

SEQ ID NO: 1894049 - RNA, 17 nt, Homo sapiens
uguucucuugcuuuaaa

SEQ ID NO: 1894050 - RNA, 13 nt, Homo sapiens
augcugcaugaaa

SEQ ID NO: 1894051 - RNA, 15 nt, Homo sapiens
cuuuuauacugacaa

SEQ ID NO: 1894052 - RNA, 18 nt, Homo sapiens
cauuucacgaacuguuca

SEQ ID NO: 1894053 - RNA, 21 nt, Homo sapiens
uuucccugcuggccaaaguca

SEQ ID NO: 1894054 - RNA, 15 nt, Homo sapiens
gcagaacacauuuca

SEQ ID NO: 1894055 - RNA, 22 nt, Homo sapiens
uuuuaaaaaaaacaauuccaca

SEQ ID NO: 1894056 - RNA, 18 nt, Homo sapiens
guacacacccuccagcac

SEQ ID NO: 1894057 - RNA, 19 nt, Homo sapiens
ugugcacauuuaugaauca

SEQ ID NO: 1894058 - RNA, 18 nt, Homo sapiens
gagccccacgcuguugac

SEQ ID NO: 1894059 - RNA, 16 nt, Homo sapiens
gcccauagaaacauga

SEQ ID NO: 1894060 - RNA, 21 nt, Homo sapiens
ccaccuccuuccagcacugac

SEQ ID NO: 1894061 - RNA, 23 nt, Homo sapiens
cagucucuccagcaucaauucca

SEQ ID NO: 1894062 - RNA, 12 nt, Homo sapiens
aacagaaaccau

SEQ ID NO: 1894063 - RNA, 19 nt, Homo sapiens
aauuguuaaguuaagcuuu

SEQ ID NO: 1894064 - RNA, 19 nt, Homo sapiens
ucagcacugucccuugccu

SEQ ID NO: 1894065 - RNA, 22 nt, Homo sapiens
guuucaacuguaaaauacuucu

SEQ ID NO: 1894066 - RNA, 15 nt, Homo sapiens
uggaauuacauaaca

SEQ ID NO: 1894067 - RNA, 14 nt, Homo sapiens
agacaaguguuuau

SEQ ID NO: 1894068 - RNA, 13 nt, Homo sapiens
agacccucagacc

SEQ ID NO: 1894069 - RNA, 13 nt, Homo sapiens
caugucuccaugu

SEQ ID NO: 1894070 - RNA, 16 nt, Homo sapiens
ugaaaguagcuguaug

SEQ ID NO: 1894071 - RNA, 15 nt, Homo sapiens
cauggaaacaacuuc

SEQ ID NO: 1894072 - RNA, 17 nt, Homo sapiens
uccccaaaacaugcacc

SEQ ID NO: 1894073 - RNA, 21 nt, Homo sapiens
aauauuaacuaaauaaacaga

SEQ ID NO: 1894074 - RNA, 19 nt, Homo sapiens
gaagucucaggagucucug

SEQ ID NO: 1894075 - RNA, 16 nt, Homo sapiens
cuguuuccaaugccaa

SEQ ID NO: 1894076 - RNA, 15 nt, Homo sapiens
cagacuuuuguguaa

SEQ ID NO: 1894077 - RNA, 19 nt, Homo sapiens
cucgcucgaugacugugaa

SEQ ID NO: 1894078 - RNA, 16 nt, Homo sapiens
augauguggacauaug

SEQ ID NO: 1894079 - RNA, 20 nt, Homo sapiens
agugauaagaauucuuaaca

SEQ ID NO: 1894080 - RNA, 19 nt, Homo sapiens
ucccuguuuuaguuucuga

SEQ ID NO: 1894081 - RNA, 20 nt, Homo sapiens
caccacuuuuaacagaacag

SEQ ID NO: 1894082 - RNA, 16 nt, Homo sapiens
ugcugugaaacagugu

SEQ ID NO: 1894083 - RNA, 19 nt, Homo sapiens
cgugccugaucugcacauu

SEQ ID NO: 1894084 - RNA, 17 nt, Homo sapiens
agcugggggccaugagc

SEQ ID NO: 1894085 - RNA, 21 nt, Homo sapiens
auuguaggcucccccuccucu

SEQ ID NO: 1894086 - RNA, 18 nt, Homo sapiens
uccaugagucuucagaag

SEQ ID NO: 1894087 - RNA, 19 nt, Homo sapiens
uguacaagguauuuacaca

SEQ ID NO: 1894088 - RNA, 18 nt, Homo sapiens
ugugcugaucgccuuauu

SEQ ID NO: 1894089 - RNA, 17 nt, Homo sapiens
gaguauuagcuuaccca

SEQ ID NO: 1894090 - RNA, 16 nt, Homo sapiens
cagcuucaacuuuucu

SEQ ID NO: 1894091 - RNA, 19 nt, Homo sapiens
ggggcagcgcaugugugca

SEQ ID NO: 1894092 - RNA, 23 nt, Homo sapiens
uggagaccaggccucagcucuug

SEQ ID NO: 1894093 - RNA, 17 nt, Homo sapiens
aagaacugcuuaguauu

SEQ ID NO: 1894094 - RNA, 17 nt, Homo sapiens
cugucugcccugaaccc

SEQ ID NO: 1894095 - RNA, 12 nt, Homo sapiens
guuccugcagcc

SEQ ID NO: 1894096 - RNA, 23 nt, Homo sapiens
ugcuggcagccauggccauggca

SEQ ID NO: 1894097 - RNA, 12 nt, Homo sapiens
ucucccauuucc

SEQ ID NO: 1894098 - RNA, 19 nt, Homo sapiens
gccuccuugcuuguuacau

SEQ ID NO: 1894099 - RNA, 17 nt, Homo sapiens
ugauuauuaaagccagc

SEQ ID NO: 1894100 - RNA, 21 nt, Homo sapiens
uuuaacagucagaaccacuaa

SEQ ID NO: 1894101 - RNA, 20 nt, Homo sapiens
aguaaagaguacacucagcc

SEQ ID NO: 1894102 - RNA, 22 nt, Homo sapiens
aauagauucagagaaauuuaga

SEQ ID NO: 1894103 - RNA, 20 nt, Homo sapiens
gcuggagugcaguggcacga

SEQ ID NO: 1894104 - RNA, 20 nt, Homo sapiens
gcuggaguguaguggcauga

SEQ ID NO: 1894105 - RNA, 15 nt, Homo sapiens
ucccaaguccagugu

SEQ ID NO: 1894106 - RNA, 14 nt, Homo sapiens
ucaaggaauuugca

SEQ ID NO: 1894107 - RNA, 21 nt, Homo sapiens
gcagguuuggacuuggacuag

SEQ ID NO: 1894108 - RNA, 15 nt, Homo sapiens
ggcuacaguccuucc

SEQ ID NO: 1894109 - RNA, 24 nt, Homo sapiens
gcaggauucuguaauagugaacau

SEQ ID NO: 1894110 - RNA, 18 nt, Homo sapiens
aaaccaaaguaaccuuuu

SEQ ID NO: 1894111 - RNA, 22 nt, Homo sapiens
uaagcugcucggagcucagugc

SEQ ID NO: 1894112 - RNA, 19 nt, Homo sapiens
aggaauaaugcggacacuu

SEQ ID NO: 1894113 - RNA, 18 nt, Homo sapiens
gaagaaguggcugccccu

SEQ ID NO: 1894114 - RNA, 15 nt, Homo sapiens
gggaaaggccagugu

SEQ ID NO: 1894115 - RNA, 20 nt, Homo sapiens
acaaacaugauacugcugcu

SEQ ID NO: 1894116 - RNA, 22 nt, Homo sapiens
cuucuaauugcuguguguccca

SEQ ID NO: 1894117 - RNA, 18 nt, Homo sapiens
ccuccccgugccaaaaau

SEQ ID NO: 1894118 - RNA, 21 nt, Homo sapiens
guacagaaauauccaugacaa

SEQ ID NO: 1894119 - RNA, 20 nt, Homo sapiens
uguucacacacacaguuuga

SEQ ID NO: 1894120 - RNA, 23 nt, Homo sapiens
caacugaccugaccccauuccug

SEQ ID NO: 1894121 - RNA, 19 nt, Homo sapiens
uagcugacaaugcacagcu

SEQ ID NO: 1894122 - RNA, 14 nt, Homo sapiens
ggcuggagugcagu

SEQ ID NO: 1894123 - RNA, 14 nt, Homo sapiens
ggcuagagugcaau

SEQ ID NO: 1894124 - RNA, 15 nt, Homo sapiens
aagaaacacuaagcu

SEQ ID NO: 1894125 - RNA, 15 nt, Homo sapiens
acaagcaaccaaugg

SEQ ID NO: 1894126 - RNA, 15 nt, Homo sapiens
cuccuuaucugcuaa

SEQ ID NO: 1894127 - RNA, 23 nt, Homo sapiens
aaauacauguacagacaaauacu

SEQ ID NO: 1894128 - RNA, 17 nt, Homo sapiens
auucauguuuggugggg

SEQ ID NO: 1894129 - RNA, 14 nt, Homo sapiens
agagaccacaagca

SEQ ID NO: 1894130 - RNA, 16 nt, Homo sapiens
acugaaauuaguguuu

SEQ ID NO: 1894131 - RNA, 16 nt, Homo sapiens
acaccagguagaacac

SEQ ID NO: 1894132 - RNA, 19 nt, Homo sapiens
uuaugaaaaugcuguuuuc

SEQ ID NO: 1894133 - RNA, 14 nt, Homo sapiens
uuuauaauugauga

SEQ ID NO: 1894134 - RNA, 12 nt, Homo sapiens
augcuuucccac

SEQ ID NO: 1894135 - RNA, 18 nt, Homo sapiens
ccagcaugugugugucuc

SEQ ID NO: 1894136 - RNA, 21 nt, Homo sapiens
aaugugggcagauuuggcuca

SEQ ID NO: 1894137 - RNA, 19 nt, Homo sapiens
ugcucaugguuaaugcagg

SEQ ID NO: 1894138 - RNA, 14 nt, Homo sapiens
guucucccaaagau

SEQ ID NO: 1894139 - RNA, 13 nt, Homo sapiens
acucugcagggug

SEQ ID NO: 1894140 - RNA, 20 nt, Homo sapiens
uguuucuugggcagucuuuc

SEQ ID NO: 1894141 - RNA, 18 nt, Homo sapiens
ucaacugucuccuaccuc

SEQ ID NO: 1894142 - RNA, 21 nt, Homo sapiens
uuaggaauaaucuccuguuaa

SEQ ID NO: 1894143 - RNA, 17 nt, Homo sapiens
uuuagaguaaugcauga

SEQ ID NO: 1894144 - RNA, 22 nt, Homo sapiens
auguucagaacuucaucugcca

SEQ ID NO: 1894145 - RNA, 14 nt, Homo sapiens
ugaaauuuacaguu

SEQ ID NO: 1894146 - RNA, 12 nt, Homo sapiens
ccuacagccagc

SEQ ID NO: 1894147 - RNA, 23 nt, Homo sapiens
ggaaaugguauccagaauggaau

SEQ ID NO: 1894148 - RNA, 15 nt, Homo sapiens
auuaacuacauuuau

SEQ ID NO: 1894149 - RNA, 20 nt, Homo sapiens
guuguguucguggaacacau

SEQ ID NO: 1894150 - RNA, 21 nt, Homo sapiens
caacaugaugaaaccccaucu

SEQ ID NO: 1894151 - RNA, 22 nt, Homo sapiens
gaggacuguccucccacagacc

SEQ ID NO: 1894152 - RNA, 20 nt, Homo sapiens
aauuucacuuaauaaugugu

SEQ ID NO: 1894153 - RNA, 17 nt, Homo sapiens
agcucguccccauugcu

SEQ ID NO: 1894154 - RNA, 21 nt, Homo sapiens
acucuagaugaaguuuuacau

SEQ ID NO: 1894155 - RNA, 18 nt, Homo sapiens
cagaggcuggcagugcug

SEQ ID NO: 1894156 - RNA, 23 nt, Homo sapiens
aauaaaccuuugguaaucuucaa

SEQ ID NO: 1894157 - RNA, 20 nt, Homo sapiens
ggugucaaugaauuuugcuu

SEQ ID NO: 1894158 - RNA, 21 nt, Homo sapiens
ccaucuuguaaaggauauuaa

SEQ ID NO: 1894159 - RNA, 15 nt, Homo sapiens
uggguccaugcuaac

SEQ ID NO: 1894160 - RNA, 13 nt, Homo sapiens
cugaacucugcaa

SEQ ID NO: 1894161 - RNA, 17 nt, Homo sapiens
uaaucuuucacagggga

SEQ ID NO: 1894162 - RNA, 16 nt, Homo sapiens
agauuuggagcugucu

SEQ ID NO: 1894163 - RNA, 18 nt, Homo sapiens
cucacaucagagugacau

SEQ ID NO: 1894164 - RNA, 16 nt, Homo sapiens
ucuccugaaugcaucc

SEQ ID NO: 1894165 - RNA, 15 nt, Homo sapiens
gaagggacauauuca

SEQ ID NO: 1894166 - RNA, 12 nt, Homo sapiens
cccccagauauc

SEQ ID NO: 1894167 - RNA, 23 nt, Homo sapiens
accuaagucucugugaauugaaa

SEQ ID NO: 1894168 - RNA, 20 nt, Homo sapiens
agaauaaacauuuuuugauc

SEQ ID NO: 1894169 - RNA, 19 nt, Homo sapiens
ugucagaugagaacaaagc

SEQ ID NO: 1894170 - RNA, 12 nt, Homo sapiens
aguuacuacuga

SEQ ID NO: 1894171 - RNA, 15 nt, Homo sapiens
acgccagaacugcuu

SEQ ID NO: 1894172 - RNA, 18 nt, Homo sapiens
guauauaacgcaggccuu

SEQ ID NO: 1894173 - RNA, 17 nt, Homo sapiens
auuacauggcugugguu

SEQ ID NO: 1894174 - RNA, 20 nt, Homo sapiens
cacguguccccagagcuuua

SEQ ID NO: 1894175 - RNA, 15 nt, Homo sapiens
ccaacaagggcagug

SEQ ID NO: 1894176 - RNA, 16 nt, Homo sapiens
acaugcuuugaaguuu

SEQ ID NO: 1894177 - RNA, 23 nt, Homo sapiens
gaucucacaaauaauaaugucag

SEQ ID NO: 1894178 - RNA, 14 nt, Homo sapiens
aagccugcuccuuc

SEQ ID NO: 1894179 - RNA, 14 nt, Homo sapiens
ucaccuacuccaga

SEQ ID NO: 1894180 - RNA, 14 nt, Homo sapiens
ccagcacugaggaa

SEQ ID NO: 1894181 - RNA, 15 nt, Homo sapiens
ggcuucuauuaccua

SEQ ID NO: 1894182 - RNA, 19 nt, Homo sapiens
uucaauagcauaucacaga

SEQ ID NO: 1894183 - RNA, 14 nt, Homo sapiens
ccuuuacuaaucca

SEQ ID NO: 1894184 - RNA, 20 nt, Homo sapiens
aacauguggugggacuuuca

SEQ ID NO: 1894185 - RNA, 14 nt, Homo sapiens
aggauaaagccacu

SEQ ID NO: 1894186 - RNA, 20 nt, Homo sapiens
ugcuuuuaaaagugcacauu

SEQ ID NO: 1894187 - RNA, 14 nt, Homo sapiens
aacagccucuuugc

SEQ ID NO: 1894188 - RNA, 11 nt, Homo sapiens
accucuuccac

SEQ ID NO: 1894189 - RNA, 11 nt, Homo sapiens
acuucuuccau

SEQ ID NO: 1894190 - RNA, 20 nt, Homo sapiens
aauagguagguuaguagccc

SEQ ID NO: 1894191 - RNA, 13 nt, Homo sapiens
uguaccaaaagau

SEQ ID NO: 1894192 - RNA, 23 nt, Homo sapiens
gcuucacagguuuuauguguucu

SEQ ID NO: 1894193 - RNA, 19 nt, Homo sapiens
ggucuucgcagccuagaua

SEQ ID NO: 1894194 - RNA, 19 nt, Homo sapiens
uuuaccuguauacagugca

SEQ ID NO: 1894195 - RNA, 23 nt, Homo sapiens
uaucuggaaaauuccagagcuau

SEQ ID NO: 1894196 - RNA, 21 nt, Homo sapiens
acccagcccuuguuagauuca

SEQ ID NO: 1894197 - RNA, 14 nt, Homo sapiens
auacuuggaccuca

SEQ ID NO: 1894198 - RNA, 15 nt, Homo sapiens
ugaaaacaaguccuu

SEQ ID NO: 1894199 - RNA, 12 nt, Homo sapiens
uccaaauaccca

SEQ ID NO: 1894200 - RNA, 13 nt, Homo sapiens
ugcaaaccaacag

SEQ ID NO: 1894201 - RNA, 15 nt, Homo sapiens
auuccuuugcauauu

SEQ ID NO: 1894202 - RNA, 14 nt, Homo sapiens
uccuauuuaucaua

SEQ ID NO: 1894203 - RNA, 18 nt, Homo sapiens
aucgugccuugucauuuu

SEQ ID NO: 1894204 - RNA, 20 nt, Homo sapiens
guuuaagcccagccaaguaa

SEQ ID NO: 1894205 - RNA, 13 nt, Homo sapiens
gcucacuguucua

SEQ ID NO: 1894206 - RNA, 17 nt, Homo sapiens
uagguauuuacccaaga

SEQ ID NO: 1894207 - RNA, 22 nt, Homo sapiens
ccaaggaccucucucaaugcca

SEQ ID NO: 1894208 - RNA, 16 nt, Homo sapiens
ucuggaaagaggcucu

SEQ ID NO: 1894209 - RNA, 17 nt, Homo sapiens
aaacuuuucauuacacu

SEQ ID NO: 1894210 - RNA, 16 nt, Homo sapiens
agguaguggggaccaa

SEQ ID NO: 1894211 - RNA, 13 nt, Homo sapiens
auuucgucaugac

SEQ ID NO: 1894212 - RNA, 20 nt, Homo sapiens
acaggcuuguuaccaccaug

SEQ ID NO: 1894213 - RNA, 15 nt, Homo sapiens
gcugauuccagaaca

SEQ ID NO: 1894214 - RNA, 21 nt, Homo sapiens
agaaauuugcaacucacugau

SEQ ID NO: 1894215 - RNA, 16 nt, Homo sapiens
agucuccuauacccag

SEQ ID NO: 1894216 - RNA, 18 nt, Homo sapiens
agcuggggugcagggaug

SEQ ID NO: 1894217 - RNA, 21 nt, Homo sapiens
gaguugauucagcucugcaag

SEQ ID NO: 1894218 - RNA, 13 nt, Homo sapiens
uucaugucaucaa

SEQ ID NO: 1894219 - RNA, 22 nt, Homo sapiens
ugaacaauguauacaaugcacu

SEQ ID NO: 1894220 - RNA, 13 nt, Homo sapiens
uuccucuuuccaa

SEQ ID NO: 1894221 - RNA, 18 nt, Homo sapiens
ccugcuuuggcagugcca

SEQ ID NO: 1894222 - RNA, 15 nt, Homo sapiens
aggggaggagcuucu

SEQ ID NO: 1894223 - RNA, 20 nt, Homo sapiens
acaggugcaacagacuugaa

SEQ ID NO: 1894224 - RNA, 12 nt, Homo sapiens
ggaccauuccug

SEQ ID NO: 1894225 - RNA, 16 nt, Homo sapiens
cuuugaagaguacaaa

SEQ ID NO: 1894226 - RNA, 18 nt, Homo sapiens
gaaaggguuuuuaaucuc

SEQ ID NO: 1894227 - RNA, 20 nt, Homo sapiens
acaaaauaaccaauccugga

SEQ ID NO: 1894228 - RNA, 15 nt, Homo sapiens
caugggagcagucca

SEQ ID NO: 1894229 - RNA, 15 nt, Homo sapiens
gcuaagggggaccau

SEQ ID NO: 1894230 - RNA, 20 nt, Homo sapiens
aaugugguuauuuuacauua

SEQ ID NO: 1894231 - RNA, 14 nt, Homo sapiens
accgaaggugacag

SEQ ID NO: 1894232 - RNA, 12 nt, Homo sapiens
ucaccauguugg

SEQ ID NO: 1894233 - RNA, 13 nt, Homo sapiens
gaggccacaggaa

SEQ ID NO: 1894234 - RNA, 16 nt, Homo sapiens
uccugaaacacuaaag

SEQ ID NO: 1894235 - RNA, 15 nt, Homo sapiens
uuucuugcaauuuga

SEQ ID NO: 1894236 - RNA, 15 nt, Homo sapiens
gggcuggucaccucc

SEQ ID NO: 1894237 - RNA, 23 nt, Homo sapiens
agaucacgccauugcacuccagc

SEQ ID NO: 1894238 - RNA, 20 nt, Homo sapiens
aauuuuacuugcaccuuaua

SEQ ID NO: 1894239 - RNA, 17 nt, Homo sapiens
aaccugaaagggcauuu

SEQ ID NO: 1894240 - RNA, 18 nt, Homo sapiens
cgagcacauagagcuuuu

SEQ ID NO: 1894241 - RNA, 22 nt, Homo sapiens
cuucauugaccaagaugaucac

SEQ ID NO: 1894242 - RNA, 17 nt, Homo sapiens
gcccccagcugcuccuc

SEQ ID NO: 1894243 - RNA, 13 nt, Homo sapiens
aaacagcugcaug

SEQ ID NO: 1894244 - RNA, 23 nt, Homo sapiens
gagcaagugcucagcuacuucuc

SEQ ID NO: 1894245 - RNA, 23 nt, Homo sapiens
ccaucagcuuaggggcugcugac

SEQ ID NO: 1894246 - RNA, 17 nt, Homo sapiens
ucuccaguggaagggaa

SEQ ID NO: 1894247 - RNA, 15 nt, Homo sapiens
cucagugaacuguga

SEQ ID NO: 1894248 - RNA, 15 nt, Homo sapiens
ugccuucucaggaaa

SEQ ID NO: 1894249 - RNA, 22 nt, Homo sapiens
ucuacuagaaccuucuaaucca

SEQ ID NO: 1894250 - RNA, 21 nt, Homo sapiens
caagcauauuuuguggcauuu

SEQ ID NO: 1894251 - RNA, 21 nt, Homo sapiens
acaugaggcaguuccuuccag

SEQ ID NO: 1894252 - RNA, 21 nt, Homo sapiens
acugcuccaaaccaacaugga

SEQ ID NO: 1894253 - RNA, 21 nt, Homo sapiens
auucuauugaaaacagugucu

SEQ ID NO: 1894254 - RNA, 17 nt, Homo sapiens
ucuugucuuuuuccaaa

SEQ ID NO: 1894255 - RNA, 15 nt, Homo sapiens
uccaucgccuugcag

SEQ ID NO: 1894256 - RNA, 16 nt, Homo sapiens
uugaacagaacugccg

SEQ ID NO: 1894257 - RNA, 18 nt, Homo sapiens
ccaccacggccacuggcc

SEQ ID NO: 1894258 - RNA, 16 nt, Homo sapiens
acauggaccuacugca

SEQ ID NO: 1894259 - RNA, 21 nt, Homo sapiens
auauaauucacucaagcacug

SEQ ID NO: 1894260 - RNA, 19 nt, Homo sapiens
ugagacagacauucaccug

SEQ ID NO: 1894261 - RNA, 17 nt, Homo sapiens
gccaagcuaaucugccu

SEQ ID NO: 1894262 - RNA, 22 nt, Homo sapiens
gcacauuuaugaaucacaguau

SEQ ID NO: 1894263 - RNA, 16 nt, Homo sapiens
uggcuugacaugugca

SEQ ID NO: 1894264 - RNA, 16 nt, Homo sapiens
ucuuaaaaaacauaua

SEQ ID NO: 1894265 - RNA, 18 nt, Homo sapiens
ucugcucccaugcucaua

SEQ ID NO: 1894266 - RNA, 18 nt, Homo sapiens
gaaaacccccaaaccaga

SEQ ID NO: 1894267 - RNA, 23 nt, Homo sapiens
cucuuuggaaagagaaccaugaa

SEQ ID NO: 1894268 - RNA, 16 nt, Homo sapiens
cauucuguuugucucg

SEQ ID NO: 1894269 - RNA, 17 nt, Homo sapiens
cucccuagccagaggcu

SEQ ID NO: 1894270 - RNA, 20 nt, Homo sapiens
guuuguuccuacagccccuu

SEQ ID NO: 1894271 - RNA, 17 nt, Homo sapiens
ccuggccauguccucaa

SEQ ID NO: 1894272 - RNA, 21 nt, Homo sapiens
caggaagaugaauccuagcuu

SEQ ID NO: 1894273 - RNA, 13 nt, Homo sapiens
cuugaagcaauaa

SEQ ID NO: 1894274 - RNA, 20 nt, Homo sapiens
cccugcauagcuugcacaac

SEQ ID NO: 1894275 - RNA, 20 nt, Homo sapiens
ugggccuccucacaacaugg

SEQ ID NO: 1894276 - RNA, 17 nt, Homo sapiens
augaaguuugcuauucu

SEQ ID NO: 1894277 - RNA, 19 nt, Homo sapiens
ugaugucagcggugcagcg

SEQ ID NO: 1894278 - RNA, 20 nt, Homo sapiens
aaauuuuagaacuuuaccua

SEQ ID NO: 1894279 - RNA, 17 nt, Homo sapiens
ucagucccucugcucuc

SEQ ID NO: 1894280 - RNA, 14 nt, Homo sapiens
aauaauaccuauau

SEQ ID NO: 1894281 - RNA, 12 nt, Homo sapiens
acagcugcucag

SEQ ID NO: 1894282 - RNA, 18 nt, Homo sapiens
gcgaagccugagcaggca

SEQ ID NO: 1894283 - RNA, 20 nt, Homo sapiens
gauucucccccuguucacau

SEQ ID NO: 1894284 - RNA, 17 nt, Homo sapiens
caccaauuaauguagcu

SEQ ID NO: 1894285 - RNA, 18 nt, Homo sapiens
cuaccuuuugcuguggca

SEQ ID NO: 1894286 - RNA, 22 nt, Homo sapiens
guagagacaggguuuugccaug

SEQ ID NO: 1894287 - RNA, 14 nt, Homo sapiens
ccagugacaacauc

SEQ ID NO: 1894288 - RNA, 22 nt, Homo sapiens
ccucaggacccagggaaugcca

SEQ ID NO: 1894289 - RNA, 21 nt, Homo sapiens
gcagcuccauccucuugacuc

SEQ ID NO: 1894290 - RNA, 14 nt, Homo sapiens
ggaggccugaugcu

SEQ ID NO: 1894291 - RNA, 18 nt, Homo sapiens
gugccucuucccaucuca

SEQ ID NO: 1894292 - RNA, 13 nt, Homo sapiens
uuuuuaauuguga

SEQ ID NO: 1894293 - RNA, 21 nt, Homo sapiens
accuggggagugguuaggcag

SEQ ID NO: 1894294 - RNA, 19 nt, Homo sapiens
acuugcaguauaucacaga

SEQ ID NO: 1894295 - RNA, 20 nt, Homo sapiens
ugaauuuuguguguaccugu

SEQ ID NO: 1894296 - RNA, 12 nt, Homo sapiens
aagccaguuucc

SEQ ID NO: 1894297 - RNA, 15 nt, Homo sapiens
acagaccaccugcuu

SEQ ID NO: 1894298 - RNA, 20 nt, Homo sapiens
uacaauucuuuguugcuuaa

SEQ ID NO: 1894299 - RNA, 12 nt, Homo sapiens
caugcauaacac

SEQ ID NO: 1894300 - RNA, 18 nt, Homo sapiens
aagcaggacugugccucc

SEQ ID NO: 1894301 - RNA, 16 nt, Homo sapiens
aagucauuccaaucag

SEQ ID NO: 1894302 - RNA, 16 nt, Homo sapiens
agccucuuuaacagcu

SEQ ID NO: 1894303 - RNA, 17 nt, Homo sapiens
aacugaaaaauuacuua

SEQ ID NO: 1894304 - RNA, 19 nt, Homo sapiens
uaccaugugaaacucuacc

SEQ ID NO: 1894305 - RNA, 15 nt, Homo sapiens
guucugcugaccaaa

SEQ ID NO: 1894306 - RNA, 18 nt, Homo sapiens
ccuaaaacugaggugggg

SEQ ID NO: 1894307 - RNA, 18 nt, Homo sapiens
gcacacccucucugucca

SEQ ID NO: 1894308 - RNA, 14 nt, Homo sapiens
uuaauuagcccaac

SEQ ID NO: 1894309 - RNA, 20 nt, Homo sapiens
ggcugcagaugaucagggau

SEQ ID NO: 1894310 - RNA, 13 nt, Homo sapiens
ccugaagauacuu

SEQ ID NO: 1894311 - RNA, 22 nt, Homo sapiens
gaguauacaaacauuuaagcug

SEQ ID NO: 1894312 - RNA, 17 nt, Homo sapiens
acacccacccacuucuc

SEQ ID NO: 1894313 - RNA, 16 nt, Homo sapiens
cugaucagugugauaa

SEQ ID NO: 1894314 - RNA, 15 nt, Homo sapiens
ccuugucgacaaaga

SEQ ID NO: 1894315 - RNA, 15 nt, Homo sapiens
uuuggauuggacaaa

SEQ ID NO: 1894316 - RNA, 15 nt, Homo sapiens
acauucgucacagau

SEQ ID NO: 1894317 - RNA, 15 nt, Homo sapiens
ugcuuggugcacaga

SEQ ID NO: 1894318 - RNA, 13 nt, Homo sapiens
cauauacuuccau

SEQ ID NO: 1894319 - RNA, 20 nt, Homo sapiens
aucuaucacccaggaaucuc

SEQ ID NO: 1894320 - RNA, 16 nt, Homo sapiens
uaugcaagugcaaaag

SEQ ID NO: 1894321 - RNA, 15 nt, Homo sapiens
ugacaaaauuacuua

SEQ ID NO: 1894322 - RNA, 16 nt, Homo sapiens
agggugaguccuccag

SEQ ID NO: 1894323 - RNA, 20 nt, Homo sapiens
ccagacuucccacggcuccu

SEQ ID NO: 1894324 - RNA, 21 nt, Homo sapiens
uugaugcucguaugaauucau

SEQ ID NO: 1894325 - RNA, 19 nt, Homo sapiens
uagugaccauuauucacag

SEQ ID NO: 1894326 - RNA, 13 nt, Homo sapiens
acccccaacccaa

SEQ ID NO: 1894327 - RNA, 19 nt, Homo sapiens
aacauaacugcuucuugga

SEQ ID NO: 1894328 - RNA, 18 nt, Homo sapiens
aauuauaaacagcagggu

SEQ ID NO: 1894329 - RNA, 13 nt, Homo sapiens
cugcagaaugacu

SEQ ID NO: 1894330 - RNA, 20 nt, Homo sapiens
ccuggaaagaaaaagcaaua

SEQ ID NO: 1894331 - RNA, 21 nt, Homo sapiens
acuguucucaacauacuguaa

SEQ ID NO: 1894332 - RNA, 12 nt, Homo sapiens
augagaaucacu

SEQ ID NO: 1894333 - RNA, 18 nt, Homo sapiens
agaaaaugcgucucuccu

SEQ ID NO: 1894334 - RNA, 17 nt, Homo sapiens
agaacuguucucaugga

SEQ ID NO: 1894335 - RNA, 22 nt, Homo sapiens
agaaaacacuuaaaaugaucau

SEQ ID NO: 1894336 - RNA, 20 nt, Homo sapiens
guggccccaccgagcuggag

SEQ ID NO: 1894337 - RNA, 17 nt, Homo sapiens
accuuaaaccugcaaaa

SEQ ID NO: 1894338 - RNA, 16 nt, Homo sapiens
caauguacuauaugua

SEQ ID NO: 1894339 - RNA, 17 nt, Homo sapiens
ccccacccaccccacag

SEQ ID NO: 1894340 - RNA, 19 nt, Homo sapiens
augaggaauguacuuuuaa

SEQ ID NO: 1894341 - RNA, 17 nt, Homo sapiens
uggagaggcggguccca

SEQ ID NO: 1894342 - RNA, 22 nt, Homo sapiens
caaauucgcugcaaccuguuga

SEQ ID NO: 1894343 - RNA, 18 nt, Homo sapiens
auacagugaagaguaagu

SEQ ID NO: 1894344 - RNA, 21 nt, Homo sapiens
acacaauacagugguauaaac

SEQ ID NO: 1894345 - RNA, 22 nt, Homo sapiens
gccagcccuccuugacccagaa

SEQ ID NO: 1894346 - RNA, 22 nt, Homo sapiens
gacugcacagcguccuguccac

SEQ ID NO: 1894347 - RNA, 11 nt, Homo sapiens
aucguccaaag

SEQ ID NO: 1894348 - RNA, 15 nt, Homo sapiens
ugaaaaccacaguca

SEQ ID NO: 1894349 - RNA, 18 nt, Homo sapiens
aucuucauagaugaauga

SEQ ID NO: 1894350 - RNA, 20 nt, Homo sapiens
ccaagcaugccccacccacc

SEQ ID NO: 1894351 - RNA, 20 nt, Homo sapiens
gccuggccuccaaaauauua

SEQ ID NO: 1894352 - RNA, 17 nt, Homo sapiens
cugggauuggcugugag

SEQ ID NO: 1894353 - RNA, 13 nt, Homo sapiens
guccugacacuga

SEQ ID NO: 1894354 - RNA, 13 nt, Homo sapiens
auccguacauuca

SEQ ID NO: 1894355 - RNA, 20 nt, Homo sapiens
cuuuaagccugcauucuuaa

SEQ ID NO: 1894356 - RNA, 23 nt, Homo sapiens
uggucauagcccagaucagcucc

SEQ ID NO: 1894357 - RNA, 10 nt, Homo sapiens
aaacuucuca

SEQ ID NO: 1894358 - RNA, 20 nt, Homo sapiens
acagcuaucgaacuucacaa

SEQ ID NO: 1894359 - RNA, 19 nt, Homo sapiens
aggaccacguuuauagcuu

SEQ ID NO: 1894360 - RNA, 12 nt, Homo sapiens
uaaacaacccuu

SEQ ID NO: 1894361 - RNA, 13 nt, Homo sapiens
uccaaagucagau

SEQ ID NO: 1894362 - RNA, 18 nt, Homo sapiens
auuuaauaggacuuccuu

SEQ ID NO: 1894363 - RNA, 22 nt, Homo sapiens
uccuuuucccaggaaagaagca

SEQ ID NO: 1894364 - RNA, 13 nt, Homo sapiens
gaccaucugugac

SEQ ID NO: 1894365 - RNA, 15 nt, Homo sapiens
ugcuucaaaugaucc

SEQ ID NO: 1894366 - RNA, 17 nt, Homo sapiens
accacauugagaucacu

SEQ ID NO: 1894367 - RNA, 13 nt, Homo sapiens
uuuuuuaacauuc

SEQ ID NO: 1894368 - RNA, 13 nt, Homo sapiens
aauggcagggaua

SEQ ID NO: 1894369 - RNA, 21 nt, Homo sapiens
aaaagaagacaacauuucuca

SEQ ID NO: 1894370 - RNA, 20 nt, Homo sapiens
cacagugaccuuagcuacau

SEQ ID NO: 1894371 - RNA, 15 nt, Homo sapiens
uggcuccuugcccuc

SEQ ID NO: 1894372 - RNA, 19 nt, Homo sapiens
acacugcugcuccagugca

SEQ ID NO: 1894373 - RNA, 22 nt, Homo sapiens
uucuuugaaggauuuacugcaa

SEQ ID NO: 1894374 - RNA, 14 nt, Homo sapiens
ggccacauuuucag

SEQ ID NO: 1894375 - RNA, 13 nt, Homo sapiens
ugugugugugaac

SEQ ID NO: 1894376 - RNA, 20 nt, Homo sapiens
cuacagacuccaaaaggccc

SEQ ID NO: 1894377 - RNA, 16 nt, Homo sapiens
caucuuuucacaacuu

SEQ ID NO: 1894378 - RNA, 19 nt, Homo sapiens
uggcauccagggcugccag

SEQ ID NO: 1894379 - RNA, 21 nt, Homo sapiens
cugaagcucccuguccugaaa

SEQ ID NO: 1894380 - RNA, 14 nt, Homo sapiens
ccccucguugguaa

SEQ ID NO: 1894381 - RNA, 23 nt, Homo sapiens
agaagcacgauccgccaaugcac

SEQ ID NO: 1894382 - RNA, 13 nt, Homo sapiens
caguauaccucau

SEQ ID NO: 1894383 - RNA, 22 nt, Homo sapiens
gauccccguuccugacaucaca

SEQ ID NO: 1894384 - RNA, 22 nt, Homo sapiens
uuacucauaaggcauauacaaa

SEQ ID NO: 1894385 - RNA, 19 nt, Homo sapiens
caagaccuuucaaagccau

SEQ ID NO: 1894386 - RNA, 17 nt, Homo sapiens
cucuaaaccauggcacu

SEQ ID NO: 1894387 - RNA, 15 nt, Homo sapiens
uagcuccacuggaga

SEQ ID NO: 1894388 - RNA, 22 nt, Homo sapiens
uuguauuuaagacauaaacaaa

SEQ ID NO: 1894389 - RNA, 18 nt, Homo sapiens
auuuuccaagugugcaua

SEQ ID NO: 1894390 - RNA, 18 nt, Homo sapiens
ccucucaggcucuugacu

SEQ ID NO: 1894391 - RNA, 18 nt, Homo sapiens
cuuaguauuucucaggaa

SEQ ID NO: 1894392 - RNA, 11 nt, Homo sapiens
cucugccccag

SEQ ID NO: 1894393 - RNA, 14 nt, Homo sapiens
gaaagccucuccag

SEQ ID NO: 1894394 - RNA, 21 nt, Homo sapiens
acgaagagacagaacugucca

SEQ ID NO: 1894395 - RNA, 22 nt, Homo sapiens
ugcacacagggugguggcacau

SEQ ID NO: 1894396 - RNA, 21 nt, Homo sapiens
ugcuguugauucagacuuuca

SEQ ID NO: 1894397 - RNA, 23 nt, Homo sapiens
aaaaccccaucucuacaaaaagc

SEQ ID NO: 1894398 - RNA, 18 nt, Homo sapiens
ucuuucuaagagaccuga

SEQ ID NO: 1894399 - RNA, 15 nt, Homo sapiens
ugggaaaaugcacac

SEQ ID NO: 1894400 - RNA, 14 nt, Homo sapiens
ugucuagugccaca

SEQ ID NO: 1894401 - RNA, 23 nt, Homo sapiens
gaauuaugcaucugcuacugugu

SEQ ID NO: 1894402 - RNA, 15 nt, Homo sapiens
auucauugucucagu

SEQ ID NO: 1894403 - RNA, 23 nt, Homo sapiens
auaaagcaaucugauucagcauc

SEQ ID NO: 1894404 - RNA, 23 nt, Homo sapiens
ugcacaugucuuguacaugugua

SEQ ID NO: 1894405 - RNA, 16 nt, Homo sapiens
aaaauaaguauuucca

SEQ ID NO: 1894406 - RNA, 15 nt, Homo sapiens
caagagccccaaaga

SEQ ID NO: 1894407 - RNA, 21 nt, Homo sapiens
ggucuuuccuaaggcugcaag

SEQ ID NO: 1894408 - RNA, 20 nt, Homo sapiens
uacuugccagaaguugugga

SEQ ID NO: 1894409 - RNA, 16 nt, Homo sapiens
aggggcccaagagaga

SEQ ID NO: 1894410 - RNA, 13 nt, Homo sapiens
ucauccugaacag

SEQ ID NO: 1894411 - RNA, 13 nt, Homo sapiens
aaucacucacaag

SEQ ID NO: 1894412 - RNA, 22 nt, Homo sapiens
aaaccuaccuuauagagcacaa

SEQ ID NO: 1894413 - RNA, 12 nt, Homo sapiens
gguguacugugu

SEQ ID NO: 1894414 - RNA, 21 nt, Homo sapiens
uggccagugagaucaauguga

SEQ ID NO: 1894415 - RNA, 17 nt, Homo sapiens
ugccauccagccagaac

SEQ ID NO: 1894416 - RNA, 17 nt, Homo sapiens
agcaauccugcaagaac

SEQ ID NO: 1894417 - RNA, 20 nt, Homo sapiens
gaaguagguggcuugagcua

SEQ ID NO: 1894418 - RNA, 14 nt, Homo sapiens
gcacuuaacuacuu

SEQ ID NO: 1894419 - RNA, 14 nt, Homo sapiens
ccacaaaaguacaa

SEQ ID NO: 1894420 - RNA, 17 nt, Homo sapiens
cagaagacccgcucucc

SEQ ID NO: 1894421 - RNA, 18 nt, Homo sapiens
agaucugcuuucuguuca

SEQ ID NO: 1894422 - RNA, 22 nt, Homo sapiens
aagaauuaugcaucugcuacug

SEQ ID NO: 1894423 - RNA, 14 nt, Homo sapiens
aaagugucccccuu

SEQ ID NO: 1894424 - RNA, 22 nt, Homo sapiens
agaaggggacagcgccaccucu

SEQ ID NO: 1894425 - RNA, 21 nt, Homo sapiens
ucaagaaucuagaagaugugu

SEQ ID NO: 1894426 - RNA, 16 nt, Homo sapiens
uagaggcugaggaauc

SEQ ID NO: 1894427 - RNA, 12 nt, Homo sapiens
gcccaucugccg

SEQ ID NO: 1894428 - RNA, 21 nt, Homo sapiens
gcuggguaagagcacagguua

SEQ ID NO: 1894429 - RNA, 19 nt, Homo sapiens
uaucuauuaucucaauuua

SEQ ID NO: 1894430 - RNA, 14 nt, Homo sapiens
ucuggcccagugaa

SEQ ID NO: 1894431 - RNA, 22 nt, Homo sapiens
cuacaauuaauaguuugucuau

SEQ ID NO: 1894432 - RNA, 19 nt, Homo sapiens
augucacuucccugcuuaa

SEQ ID NO: 1894433 - RNA, 20 nt, Homo sapiens
aaaauggggaagaguugaaa

SEQ ID NO: 1894434 - RNA, 13 nt, Homo sapiens
ugaagggggcuaa

SEQ ID NO: 1894435 - RNA, 16 nt, Homo sapiens
ccuccuaaccuagaga

SEQ ID NO: 1894436 - RNA, 17 nt, Homo sapiens
uaucgggagcagugucu

SEQ ID NO: 1894437 - RNA, 17 nt, Homo sapiens
uacccagaaaguuauug

SEQ ID NO: 1894438 - RNA, 18 nt, Homo sapiens
uuggauucuaaauacaug

SEQ ID NO: 1894439 - RNA, 13 nt, Homo sapiens
guuaggcuuccau

SEQ ID NO: 1894440 - RNA, 16 nt, Homo sapiens
agggcagaggugauca

SEQ ID NO: 1894441 - RNA, 12 nt, Homo sapiens
gaagaacucuuu

SEQ ID NO: 1894442 - RNA, 22 nt, Homo sapiens
acuacaggugugagccaccacu

SEQ ID NO: 1894443 - RNA, 22 nt, Homo sapiens
gggcucuucgccaugggggucu

SEQ ID NO: 1894444 - RNA, 15 nt, Homo sapiens
gccacugacuugcuc

SEQ ID NO: 1894445 - RNA, 23 nt, Homo sapiens
caggagggcagaccacauugcuu

SEQ ID NO: 1894446 - RNA, 16 nt, Homo sapiens
agggcugucuucguau

SEQ ID NO: 1894447 - RNA, 14 nt, Homo sapiens
cuuuuucucaaaau

SEQ ID NO: 1894448 - RNA, 19 nt, Homo sapiens
ggccucuggggcaggacca

SEQ ID NO: 1894449 - RNA, 22 nt, Homo sapiens
ggccagggguggugagggcagu

SEQ ID NO: 1894450 - RNA, 20 nt, Homo sapiens
aacuuuguuuagcccaaaac

SEQ ID NO: 1894451 - RNA, 21 nt, Homo sapiens
cacucuuaucuuacaacuccc

SEQ ID NO: 1894452 - RNA, 22 nt, Homo sapiens
ccauccgugcuaugacauggag

SEQ ID NO: 1894453 - RNA, 11 nt, Homo sapiens
gccaagcccug

SEQ ID NO: 1894454 - RNA, 21 nt, Homo sapiens
cuuaacacauucaauagcaua

SEQ ID NO: 1894455 - RNA, 16 nt, Homo sapiens
auuguauagccccaca

SEQ ID NO: 1894456 - RNA, 13 nt, Homo sapiens
cagagccuguggc

SEQ ID NO: 1894457 - RNA, 18 nt, Homo sapiens
acaggaaaaaaacuuuua

SEQ ID NO: 1894458 - RNA, 11 nt, Homo sapiens
ggagacagggu

SEQ ID NO: 1894459 - RNA, 16 nt, Homo sapiens
augcacacacauauau

SEQ ID NO: 1894460 - RNA, 22 nt, Homo sapiens
gugacagccguuuguuccccaa

SEQ ID NO: 1894461 - RNA, 23 nt, Homo sapiens
cagggcuacacagacccugccca

SEQ ID NO: 1894462 - RNA, 10 nt, Homo sapiens
ggaacuuccu

SEQ ID NO: 1894463 - RNA, 14 nt, Homo sapiens
cuuuuuccuguugu

SEQ ID NO: 1894464 - RNA, 17 nt, Homo sapiens
ggugauguaaaacagaa

SEQ ID NO: 1894465 - RNA, 17 nt, Homo sapiens
aaagcagcccuuggcca

SEQ ID NO: 1894466 - RNA, 22 nt, Homo sapiens
aaugaagaacugcauguggcuu

SEQ ID NO: 1894467 - RNA, 15 nt, Homo sapiens
caaagaccaccucca

SEQ ID NO: 1894468 - RNA, 14 nt, Homo sapiens
uaauaaucaaugca

SEQ ID NO: 1894469 - RNA, 20 nt, Homo sapiens
ugacugcauugaaaugcaau

SEQ ID NO: 1894470 - RNA, 15 nt, Homo sapiens
agucaggcaggguua

SEQ ID NO: 1894471 - RNA, 14 nt, Homo sapiens
cugacagugcccag

SEQ ID NO: 1894472 - RNA, 18 nt, Homo sapiens
acaacgcucuacccugca

SEQ ID NO: 1894473 - RNA, 19 nt, Homo sapiens
cuucucuuccuagaucugc

SEQ ID NO: 1894474 - RNA, 19 nt, Homo sapiens
cgggaaugacuugggccaa

SEQ ID NO: 1894475 - RNA, 17 nt, Homo sapiens
gauucgccaaucucaua

SEQ ID NO: 1894476 - RNA, 13 nt, Homo sapiens
uaauguccagcua

SEQ ID NO: 1894477 - RNA, 22 nt, Homo sapiens
ugcuuguggucacacuguggaa

SEQ ID NO: 1894478 - RNA, 20 nt, Homo sapiens
acuuuuaugagaacaaugga

SEQ ID NO: 1894479 - RNA, 13 nt, Homo sapiens
cuuucuuccaaac

SEQ ID NO: 1894480 - RNA, 20 nt, Homo sapiens
uauuaguguuuuaugcaugu

SEQ ID NO: 1894481 - RNA, 16 nt, Homo sapiens
acagaagcucaucuca

SEQ ID NO: 1894482 - RNA, 17 nt, Homo sapiens
aggcgcggggucucagg

SEQ ID NO: 1894483 - RNA, 11 nt, Homo sapiens
acgaguguucc

SEQ ID NO: 1894484 - RNA, 17 nt, Homo sapiens
agcuuggacuacacaau

SEQ ID NO: 1894485 - RNA, 15 nt, Homo sapiens
guagccuuacuguga

SEQ ID NO: 1894486 - RNA, 17 nt, Homo sapiens
ggagacugacacgaagc

SEQ ID NO: 1894487 - RNA, 13 nt, Homo sapiens
cucucugcuccuc

SEQ ID NO: 1894488 - RNA, 18 nt, Homo sapiens
gggugcagggcucagggg

SEQ ID NO: 1894489 - RNA, 19 nt, Homo sapiens
ccagccuuggauacuccau

SEQ ID NO: 1894490 - RNA, 15 nt, Homo sapiens
aggccuguguagcug

SEQ ID NO: 1894491 - RNA, 13 nt, Homo sapiens
aaaaagcuuuacu

SEQ ID NO: 1894492 - RNA, 19 nt, Homo sapiens
aaauaauuuauuuugcucu

SEQ ID NO: 1894493 - RNA, 14 nt, Homo sapiens
gcaggaggugccug

SEQ ID NO: 1894494 - RNA, 19 nt, Homo sapiens
caguaaauauuaaccugaa

SEQ ID NO: 1894495 - RNA, 18 nt, Homo sapiens
guucgcgcaccagguguc

SEQ ID NO: 1894496 - RNA, 20 nt, Homo sapiens
ccaggagauggguccagggg

SEQ ID NO: 1894497 - RNA, 19 nt, Homo sapiens
uaaauagaacuaucugcau

SEQ ID NO: 1894498 - RNA, 21 nt, Homo sapiens
ccuaugcagacaucucuggag

SEQ ID NO: 1894499 - RNA, 20 nt, Homo sapiens
caggcuggagugcaguggca

SEQ ID NO: 1894500 - RNA, 20 nt, Homo sapiens
caggcuagagugcaauggca

SEQ ID NO: 1894501 - RNA, 20 nt, Homo sapiens
gaucgcgccacugcacuccg

SEQ ID NO: 1894502 - RNA, 22 nt, Homo sapiens
auccccugugaacuuaucaaaa

SEQ ID NO: 1894503 - RNA, 17 nt, Homo sapiens
gggcuggguguguuuca

SEQ ID NO: 1894504 - RNA, 15 nt, Homo sapiens
cauguuacgugugca

SEQ ID NO: 1894505 - RNA, 11 nt, Homo sapiens
uguguuuacuu

SEQ ID NO: 1894506 - RNA, 21 nt, Homo sapiens
ugauacauuaaaaaaauucca

SEQ ID NO: 1894507 - RNA, 20 nt, Homo sapiens
gaggcauucccagaauuugc

SEQ ID NO: 1894508 - RNA, 16 nt, Homo sapiens
uguggaccgaggaaca

SEQ ID NO: 1894509 - RNA, 14 nt, Homo sapiens
cagauaacuuugac

SEQ ID NO: 1894510 - RNA, 18 nt, Homo sapiens
uuugaaugcuuaauucaa

SEQ ID NO: 1894511 - RNA, 19 nt, Homo sapiens
ugucuuuggcucaguucau

SEQ ID NO: 1894512 - RNA, 22 nt, Homo sapiens
gcagccugcagaccacacucug

SEQ ID NO: 1894513 - RNA, 14 nt, Homo sapiens
uuuccuaaagccaa

SEQ ID NO: 1894514 - RNA, 15 nt, Homo sapiens
agagagagcuucugu

SEQ ID NO: 1894515 - RNA, 15 nt, Homo sapiens
aaggaagugccuugg

SEQ ID NO: 1894516 - RNA, 14 nt, Homo sapiens
ugggcauagucagu

SEQ ID NO: 1894517 - RNA, 13 nt, Homo sapiens
uuauaaaaaaugg

SEQ ID NO: 1894518 - RNA, 14 nt, Homo sapiens
agaauaaauacugu

SEQ ID NO: 1894519 - RNA, 14 nt, Homo sapiens
aaaugaaaugcauu

SEQ ID NO: 1894520 - RNA, 15 nt, Homo sapiens
cuguguaacuuucuc

SEQ ID NO: 1894521 - RNA, 13 nt, Homo sapiens
aagaguugagcuc

SEQ ID NO: 1894522 - RNA, 17 nt, Homo sapiens
uacucagugcuaaacau

SEQ ID NO: 1894523 - RNA, 19 nt, Homo sapiens
uccugaccccgccaugcau

SEQ ID NO: 1894524 - RNA, 23 nt, Homo sapiens
aaugaggugagggggguucuccu

SEQ ID NO: 1894525 - RNA, 16 nt, Homo sapiens
cagauuuaaagcacau

SEQ ID NO: 1894526 - RNA, 23 nt, Homo sapiens
uauuuugugggcugguugcugua

SEQ ID NO: 1894527 - RNA, 12 nt, Homo sapiens
ucuccccaauga

SEQ ID NO: 1894528 - RNA, 16 nt, Homo sapiens
acugagcucugccuca

SEQ ID NO: 1894529 - RNA, 18 nt, Homo sapiens
cucugugcuuugacucac

SEQ ID NO: 1894530 - RNA, 23 nt, Homo sapiens
acuccugaaggucugggucucag

SEQ ID NO: 1894531 - RNA, 20 nt, Homo sapiens
uuggcucacaucauguaaua

SEQ ID NO: 1894532 - RNA, 16 nt, Homo sapiens
ccauuaaauagggaaa

SEQ ID NO: 1894533 - RNA, 13 nt, Homo sapiens
cugaugacagugu

SEQ ID NO: 1894534 - RNA, 18 nt, Homo sapiens
guguauggguuaaaucaa

SEQ ID NO: 1894535 - RNA, 14 nt, Homo sapiens
guauuaaaaagccu

SEQ ID NO: 1894536 - RNA, 16 nt, Homo sapiens
uaccagugggcaugua

SEQ ID NO: 1894537 - RNA, 23 nt, Homo sapiens
caacucuaaagccaagcacuuua

SEQ ID NO: 1894538 - RNA, 16 nt, Homo sapiens
aggucaauuuccugau

SEQ ID NO: 1894539 - RNA, 17 nt, Homo sapiens
uugggcucucuucuguc

SEQ ID NO: 1894540 - RNA, 16 nt, Homo sapiens
accagaauuguccuca

SEQ ID NO: 1894541 - RNA, 19 nt, Homo sapiens
uacaauguucuguuguaaa

SEQ ID NO: 1894542 - RNA, 13 nt, Homo sapiens
caaaaucaauuaa

SEQ ID NO: 1894543 - RNA, 18 nt, Homo sapiens
gauguuaagcaaaggaaa

SEQ ID NO: 1894544 - RNA, 22 nt, Homo sapiens
cacaugauuaaugauuuagcuc

SEQ ID NO: 1894545 - RNA, 23 nt, Homo sapiens
uugcaccaggcacugcugcacaa

SEQ ID NO: 1894546 - RNA, 17 nt, Homo sapiens
cuuuucugaggacucaa

SEQ ID NO: 1894547 - RNA, 22 nt, Homo sapiens
gagagugaaaccaugacuguga

SEQ ID NO: 1894548 - RNA, 12 nt, Homo sapiens
gaagugcucccu

SEQ ID NO: 1894549 - RNA, 13 nt, Homo sapiens
uuacauauacauu

SEQ ID NO: 1894550 - RNA, 17 nt, Homo sapiens
agcaccuuucucugaga

SEQ ID NO: 1894551 - RNA, 16 nt, Homo sapiens
ugaccaguuguugaua

SEQ ID NO: 1894552 - RNA, 19 nt, Homo sapiens
acuguguggacugugaugc

SEQ ID NO: 1894553 - RNA, 19 nt, Homo sapiens
augugcauauaucuuucag

SEQ ID NO: 1894554 - RNA, 23 nt, Homo sapiens
ucugccuuuccccccucacacau

SEQ ID NO: 1894555 - RNA, 21 nt, Homo sapiens
ucuaauaguuuuucacuuugu

SEQ ID NO: 1894556 - RNA, 14 nt, Homo sapiens
ugacgcaccugugg

SEQ ID NO: 1894557 - RNA, 19 nt, Homo sapiens
agcacagucccuaggacau

SEQ ID NO: 1894558 - RNA, 13 nt, Homo sapiens
ucucaugauucca

SEQ ID NO: 1894559 - RNA, 18 nt, Homo sapiens
auuuagcccgagaucugg

SEQ ID NO: 1894560 - RNA, 18 nt, Homo sapiens
cuuguuuugaauugucaa

SEQ ID NO: 1894561 - RNA, 17 nt, Homo sapiens
gaaacccuugcugcuuu

SEQ ID NO: 1894562 - RNA, 23 nt, Homo sapiens
ucauccuguuggcugcugccacc

SEQ ID NO: 1894563 - RNA, 14 nt, Homo sapiens
gcugaccacagcac

SEQ ID NO: 1894564 - RNA, 14 nt, Homo sapiens
gcugagcacagcag

SEQ ID NO: 1894565 - RNA, 21 nt, Homo sapiens
auguugggggggacccugccu

SEQ ID NO: 1894566 - RNA, 16 nt, Homo sapiens
gcaacaaauccaugga

SEQ ID NO: 1894567 - RNA, 14 nt, Homo sapiens
ccuguuaagcaauu

SEQ ID NO: 1894568 - RNA, 20 nt, Homo sapiens
gggaccucccaggacaagca

SEQ ID NO: 1894569 - RNA, 15 nt, Homo sapiens
ggacaugcaugacac

SEQ ID NO: 1894570 - RNA, 11 nt, Homo sapiens
aaaucugccac

SEQ ID NO: 1894571 - RNA, 15 nt, Homo sapiens
guuaauaaacagcuc

SEQ ID NO: 1894572 - RNA, 22 nt, Homo sapiens
acuuugauucugauaaugcuca

SEQ ID NO: 1894573 - RNA, 22 nt, Homo sapiens
ggcuggcuucaggagggagcau

SEQ ID NO: 1894574 - RNA, 17 nt, Homo sapiens
cauuuacuuuaauuucc

SEQ ID NO: 1894575 - RNA, 15 nt, Homo sapiens
cagccccuuucccuu

SEQ ID NO: 1894576 - RNA, 12 nt, Homo sapiens
aguuuacuucau

SEQ ID NO: 1894577 - RNA, 22 nt, Homo sapiens
aauguucuuugugugauuaaau

SEQ ID NO: 1894578 - RNA, 21 nt, Homo sapiens
ugucauucuguuagauacuaa

SEQ ID NO: 1894579 - RNA, 19 nt, Homo sapiens
ugggcaguugggagugagu

SEQ ID NO: 1894580 - RNA, 20 nt, Homo sapiens
ccaucuggcagacuuacaaa

SEQ ID NO: 1894581 - RNA, 15 nt, Homo sapiens
cggucccccaugcca

SEQ ID NO: 1894582 - RNA, 16 nt, Homo sapiens
uggagcucagguccca

SEQ ID NO: 1894583 - RNA, 14 nt, Homo sapiens
auggacucuucccc

SEQ ID NO: 1894584 - RNA, 12 nt, Homo sapiens
guauccaugcau

SEQ ID NO: 1894585 - RNA, 12 nt, Homo sapiens
guaaccaugcaa

SEQ ID NO: 1894586 - RNA, 13 nt, Homo sapiens
gcauucaguugaa

SEQ ID NO: 1894587 - RNA, 20 nt, Homo sapiens
cucacauaagcccaguucau

SEQ ID NO: 1894588 - RNA, 18 nt, Homo sapiens
caugacccaccccugugc

SEQ ID NO: 1894589 - RNA, 21 nt, Homo sapiens
uuuaauagggaauauaucucu

SEQ ID NO: 1894590 - RNA, 11 nt, Homo sapiens
aagugagcuuu

SEQ ID NO: 1894591 - RNA, 22 nt, Homo sapiens
uaaugaaauaauguacaucugg

SEQ ID NO: 1894592 - RNA, 12 nt, Homo sapiens
cauauucacagu

SEQ ID NO: 1894593 - RNA, 12 nt, Homo sapiens
uauuuucauaga

SEQ ID NO: 1894594 - RNA, 17 nt, Homo sapiens
acagcaccuccaugugg

SEQ ID NO: 1894595 - RNA, 14 nt, Homo sapiens
auagcagguaguua

SEQ ID NO: 1894596 - RNA, 21 nt, Homo sapiens
ugccuguaaucccagcacuuu

SEQ ID NO: 1894597 - RNA, 22 nt, Homo sapiens
cagucuggugaacuucaaaagc

SEQ ID NO: 1894598 - RNA, 15 nt, Homo sapiens
uuacaguauacauau

SEQ ID NO: 1894599 - RNA, 15 nt, Homo sapiens
uuuaauuuuaucauc

SEQ ID NO: 1894600 - RNA, 16 nt, Homo sapiens
uaugugggggucugug

SEQ ID NO: 1894601 - RNA, 12 nt, Homo sapiens
gaaugcauucaa

SEQ ID NO: 1894602 - RNA, 14 nt, Homo sapiens
caccucacugucau

SEQ ID NO: 1894603 - RNA, 13 nt, Homo sapiens
ugcagaaggccaa

SEQ ID NO: 1894604 - RNA, 12 nt, Homo sapiens
cugggagagcca

SEQ ID NO: 1894605 - RNA, 20 nt, Homo sapiens
aaauuguuguauaucacuaa

SEQ ID NO: 1894606 - RNA, 16 nt, Homo sapiens
aacuugagggcccaga

SEQ ID NO: 1894607 - RNA, 12 nt, Homo sapiens
uuuauuuagcau

SEQ ID NO: 1894608 - RNA, 18 nt, Homo sapiens
uuucagauaaacaacaaa

SEQ ID NO: 1894609 - RNA, 17 nt, Homo sapiens
aguucaagugucuguau

SEQ ID NO: 1894610 - RNA, 17 nt, Homo sapiens
uuacagacaugaacugc

SEQ ID NO: 1894611 - RNA, 20 nt, Homo sapiens
uaaaauuccucuuacuguaa

SEQ ID NO: 1894612 - RNA, 18 nt, Homo sapiens
gcuuucaugaacacagcc

SEQ ID NO: 1894613 - RNA, 23 nt, Homo sapiens
cucugaugacccugaaucugauc

SEQ ID NO: 1894614 - RNA, 20 nt, Homo sapiens
gaggccuuagcaauaaucca

SEQ ID NO: 1894615 - RNA, 22 nt, Homo sapiens
cuggagacccguagaugccagg

SEQ ID NO: 1894616 - RNA, 14 nt, Homo sapiens
cuuuuuuuuaagga

SEQ ID NO: 1894617 - RNA, 14 nt, Homo sapiens
uuuguuuucaauga

SEQ ID NO: 1894618 - RNA, 21 nt, Homo sapiens
ucuaucggggucacuugcaau

SEQ ID NO: 1894619 - RNA, 12 nt, Homo sapiens
cgauguaugcag

SEQ ID NO: 1894620 - RNA, 21 nt, Homo sapiens
acuuuaggaggaggugggggc

SEQ ID NO: 1894621 - RNA, 14 nt, Homo sapiens
cuuucuucucucca

SEQ ID NO: 1894622 - RNA, 14 nt, Homo sapiens
agcaaggugguuua

SEQ ID NO: 1894623 - RNA, 22 nt, Homo sapiens
aggaggggaggaacacugcacu

SEQ ID NO: 1894624 - RNA, 21 nt, Homo sapiens
cugagugccagcccuggcaga

SEQ ID NO: 1894625 - RNA, 19 nt, Homo sapiens
gcuuucuuuuuaguucucu

SEQ ID NO: 1894626 - RNA, 15 nt, Homo sapiens
caaaacaguaaaaau

SEQ ID NO: 1894627 - RNA, 16 nt, Homo sapiens
gaaugcggaaccauag

SEQ ID NO: 1894628 - RNA, 20 nt, Homo sapiens
uacuugaccucugugaccaa

SEQ ID NO: 1894629 - RNA, 17 nt, Homo sapiens
guaaauguuuaauaucu

SEQ ID NO: 1894630 - RNA, 14 nt, Homo sapiens
gcaugguagcucau

SEQ ID NO: 1894631 - RNA, 16 nt, Homo sapiens
ucuuugacguggagcu

SEQ ID NO: 1894632 - RNA, 19 nt, Homo sapiens
aagcaaguguucacaacag

SEQ ID NO: 1894633 - RNA, 13 nt, Homo sapiens
ucuauggcaagca

SEQ ID NO: 1894634 - RNA, 15 nt, Homo sapiens
uccccgggucucuca

SEQ ID NO: 1894635 - RNA, 15 nt, Homo sapiens
aaaaguauaacuuau

SEQ ID NO: 1894636 - RNA, 19 nt, Homo sapiens
uugucccaaguuccacugc

SEQ ID NO: 1894637 - RNA, 20 nt, Homo sapiens
cauauuguuccuuaucaccu

SEQ ID NO: 1894638 - RNA, 22 nt, Homo sapiens
aucaggucauacuaucuacucu

SEQ ID NO: 1894639 - RNA, 20 nt, Homo sapiens
auucuguuuuucguuugcau

SEQ ID NO: 1894640 - RNA, 18 nt, Homo sapiens
uacaaaccagcaacuaau

SEQ ID NO: 1894641 - RNA, 23 nt, Homo sapiens
aaguaaaaacacuaccucuuuug

SEQ ID NO: 1894642 - RNA, 17 nt, Homo sapiens
uaugucagcuacaugaa

SEQ ID NO: 1894643 - RNA, 21 nt, Homo sapiens
acauuuuuucagucauauaaa

SEQ ID NO: 1894644 - RNA, 12 nt, Homo sapiens
uggaucagaggu

SEQ ID NO: 1894645 - RNA, 13 nt, Homo sapiens
cuaucauauauua

SEQ ID NO: 1894646 - RNA, 15 nt, Homo sapiens
cuggauuuuuaccag

SEQ ID NO: 1894647 - RNA, 13 nt, Homo sapiens
agugaauggucuc

SEQ ID NO: 1894648 - RNA, 16 nt, Homo sapiens
uggguagaugugcaau

SEQ ID NO: 1894649 - RNA, 15 nt, Homo sapiens
ucacuugaucuccgu

SEQ ID NO: 1894650 - RNA, 17 nt, Homo sapiens
uaaaaaggcauguaauu

SEQ ID NO: 1894651 - RNA, 22 nt, Homo sapiens
ucuuacauaauuuuuuauucaa

SEQ ID NO: 1894652 - RNA, 23 nt, Homo sapiens
cuucuccaugcugcaaaggagaa

SEQ ID NO: 1894653 - RNA, 19 nt, Homo sapiens
cauggcuuuguuaaacuua

SEQ ID NO: 1894654 - RNA, 19 nt, Homo sapiens
agcuuucuccucugcuaug

SEQ ID NO: 1894655 - RNA, 15 nt, Homo sapiens
agcugaugaggaaua

SEQ ID NO: 1894656 - RNA, 21 nt, Homo sapiens
auuucugauauaacaaacuac

SEQ ID NO: 1894657 - RNA, 17 nt, Homo sapiens
aguuaaagcuacagguc

SEQ ID NO: 1894658 - RNA, 18 nt, Homo sapiens
aaaaaucaaucacuugaa

SEQ ID NO: 1894659 - RNA, 15 nt, Homo sapiens
cagcacuuuccguca

SEQ ID NO: 1894660 - RNA, 21 nt, Homo sapiens
aagcacuuuuucugcauacuu

SEQ ID NO: 1894661 - RNA, 13 nt, Homo sapiens
cuaugugauuaca

SEQ ID NO: 1894662 - RNA, 20 nt, Homo sapiens
ccuagacugacccugaucag

SEQ ID NO: 1894663 - RNA, 20 nt, Homo sapiens
cauuugguacacacuugacc

SEQ ID NO: 1894664 - RNA, 19 nt, Homo sapiens
agguggccaggccugccag

SEQ ID NO: 1894665 - RNA, 15 nt, Homo sapiens
guugacaauucugca

SEQ ID NO: 1894666 - RNA, 15 nt, Homo sapiens
cccgucucucuugga

SEQ ID NO: 1894667 - RNA, 23 nt, Homo sapiens
cauguguccuggugagaaaauau

SEQ ID NO: 1894668 - RNA, 21 nt, Homo sapiens
guuugaaaauauuuuguugcc

SEQ ID NO: 1894669 - RNA, 18 nt, Homo sapiens
aacaguugugaugacuau

SEQ ID NO: 1894670 - RNA, 13 nt, Homo sapiens
aacuuaacgugau

SEQ ID NO: 1894671 - RNA, 23 nt, Homo sapiens
uuagacccaugcuggucagagac

SEQ ID NO: 1894672 - RNA, 17 nt, Homo sapiens
ccucucucaaaucucau

SEQ ID NO: 1894673 - RNA, 20 nt, Homo sapiens
cuggaccugccuccugccug

SEQ ID NO: 1894674 - RNA, 12 nt, Homo sapiens
uguuauucuugu

SEQ ID NO: 1894675 - RNA, 13 nt, Homo sapiens
augacuuguagca

SEQ ID NO: 1894676 - RNA, 19 nt, Homo sapiens
aauuuauauguauccagua

SEQ ID NO: 1894677 - RNA, 20 nt, Homo sapiens
ggagcccucagacaucucca

SEQ ID NO: 1894678 - RNA, 11 nt, Homo sapiens
uuagacuguug

SEQ ID NO: 1894679 - RNA, 14 nt, Homo sapiens
agaaaguauuuuca

SEQ ID NO: 1894680 - RNA, 16 nt, Homo sapiens
aggcagcccugccaug

SEQ ID NO: 1894681 - RNA, 22 nt, Homo sapiens
accucuccuucaugacagccuc

SEQ ID NO: 1894682 - RNA, 19 nt, Homo sapiens
accccaauuuacuugccau

SEQ ID NO: 1894683 - RNA, 12 nt, Homo sapiens
gcaaugacuuuc

SEQ ID NO: 1894684 - RNA, 14 nt, Homo sapiens
cacuguacuuguag

SEQ ID NO: 1894685 - RNA, 14 nt, Homo sapiens
uuauuauacaccuu

SEQ ID NO: 1894686 - RNA, 22 nt, Homo sapiens
uccauguguaagaacaaugcca

SEQ ID NO: 1894687 - RNA, 13 nt, Homo sapiens
gcauuucaucaag

SEQ ID NO: 1894688 - RNA, 17 nt, Homo sapiens
ccggagcgcugggcggu

SEQ ID NO: 1894689 - RNA, 17 nt, Homo sapiens
auaccagagacucugaa

SEQ ID NO: 1894690 - RNA, 18 nt, Homo sapiens
accugcugagggaccagc

SEQ ID NO: 1894691 - RNA, 13 nt, Homo sapiens
ccuggauguugcu

SEQ ID NO: 1894692 - RNA, 18 nt, Homo sapiens
acacgggguuacacuguu

SEQ ID NO: 1894693 - RNA, 21 nt, Homo sapiens
ccauacuuucccacagcacua

SEQ ID NO: 1894694 - RNA, 18 nt, Homo sapiens
acucccugcagaugccac

SEQ ID NO: 1894695 - RNA, 21 nt, Homo sapiens
aaagcuuauucuuuguccaug

SEQ ID NO: 1894696 - RNA, 18 nt, Homo sapiens
ccuccauuucucugggac

SEQ ID NO: 1894697 - RNA, 13 nt, Homo sapiens
gccuuggaccaaa

SEQ ID NO: 1894698 - RNA, 23 nt, Homo sapiens
agguuacccgagaagcacuugag

SEQ ID NO: 1894699 - RNA, 12 nt, Homo sapiens
ccagaccaguag

SEQ ID NO: 1894700 - RNA, 16 nt, Homo sapiens
aagucaaugucaauga

SEQ ID NO: 1894701 - RNA, 14 nt, Homo sapiens
cggaagccaaaggc

SEQ ID NO: 1894702 - RNA, 14 nt, Homo sapiens
agccuuuggugcuu

SEQ ID NO: 1894703 - RNA, 16 nt, Homo sapiens
auuuuuuguaugcuua

SEQ ID NO: 1894704 - RNA, 22 nt, Homo sapiens
aaaaucaacccaauaauucugu

SEQ ID NO: 1894705 - RNA, 14 nt, Homo sapiens
aaggaaaagcaaga

SEQ ID NO: 1894706 - RNA, 18 nt, Homo sapiens
acuuugaauuuuagcaca

SEQ ID NO: 1894707 - RNA, 21 nt, Homo sapiens
aaauaucauuauagcauguaa

SEQ ID NO: 1894708 - RNA, 20 nt, Homo sapiens
acaauaucauuuuccuggga

SEQ ID NO: 1894709 - RNA, 16 nt, Homo sapiens
uagacagagacaauuu

SEQ ID NO: 1894710 - RNA, 15 nt, Homo sapiens
auuaaacagccaaau

SEQ ID NO: 1894711 - RNA, 24 nt, Homo sapiens
ucccuggggaaaacuugcagcuaa

SEQ ID NO: 1894712 - RNA, 17 nt, Homo sapiens
cagcccaagcacggggc

SEQ ID NO: 1894713 - RNA, 14 nt, Homo sapiens
cacauugaaucaug

SEQ ID NO: 1894714 - RNA, 19 nt, Homo sapiens
gggauuggagggaagacag

SEQ ID NO: 1894715 - RNA, 20 nt, Homo sapiens
aaagaaaacuuguguucaau

SEQ ID NO: 1894716 - RNA, 16 nt, Homo sapiens
ggcaauaaaugcccuc

SEQ ID NO: 1894717 - RNA, 19 nt, Homo sapiens
aauuuuauuaaaugcauca

SEQ ID NO: 1894718 - RNA, 21 nt, Homo sapiens
agcuacaccuuucuccuuugu

SEQ ID NO: 1894719 - RNA, 14 nt, Homo sapiens
gugcucagccaaau

SEQ ID NO: 1894720 - RNA, 14 nt, Homo sapiens
ugccaggcacuguu

SEQ ID NO: 1894721 - RNA, 22 nt, Homo sapiens
aacagacucaaaccacauggac

SEQ ID NO: 1894722 - RNA, 18 nt, Homo sapiens
aggugggcagaucacuug

SEQ ID NO: 1894723 - RNA, 18 nt, Homo sapiens
auucuagacccuauacau

SEQ ID NO: 1894724 - RNA, 18 nt, Homo sapiens
aauuuagaccccauacaa

SEQ ID NO: 1894725 - RNA, 22 nt, Homo sapiens
uuuuuaacauguauucuguucu

SEQ ID NO: 1894726 - RNA, 16 nt, Homo sapiens
uucccuaucugcaaaa

SEQ ID NO: 1894727 - RNA, 23 nt, Homo sapiens
aaagcauacaagauucuuccuuu

SEQ ID NO: 1894728 - RNA, 14 nt, Homo sapiens
ccuccauuccccac

SEQ ID NO: 1894729 - RNA, 20 nt, Homo sapiens
acgaaaugcuaugacuguau

SEQ ID NO: 1894730 - RNA, 16 nt, Homo sapiens
uucauggcuaccucag

SEQ ID NO: 1894731 - RNA, 16 nt, Homo sapiens
ucacacuauccagcua

SEQ ID NO: 1894732 - RNA, 20 nt, Homo sapiens
acgcuuaagucaucauuacu

SEQ ID NO: 1894733 - RNA, 15 nt, Homo sapiens
uccccaccagucuca

SEQ ID NO: 1894734 - RNA, 13 nt, Homo sapiens
uuuugaaggcaaa

SEQ ID NO: 1894735 - RNA, 19 nt, Homo sapiens
gaaaugaauaagcuuucuc

SEQ ID NO: 1894736 - RNA, 19 nt, Homo sapiens
caguuaaaucccccaccuc

SEQ ID NO: 1894737 - RNA, 19 nt, Homo sapiens
cuuaguaguggguuucuau

SEQ ID NO: 1894738 - RNA, 14 nt, Homo sapiens
cuguaaacccugac

SEQ ID NO: 1894739 - RNA, 19 nt, Homo sapiens
gcuggagugaagugguaca

SEQ ID NO: 1894740 - RNA, 20 nt, Homo sapiens
aauugggcuucaaucacugu

SEQ ID NO: 1894741 - RNA, 15 nt, Homo sapiens
acuuagacaguaugc

SEQ ID NO: 1894742 - RNA, 22 nt, Homo sapiens
acauuucuguucucauuugauc

SEQ ID NO: 1894743 - RNA, 18 nt, Homo sapiens
aagcuuucuguugauguu

SEQ ID NO: 1894744 - RNA, 15 nt, Homo sapiens
caauaggugcaaaaa

SEQ ID NO: 1894745 - RNA, 16 nt, Homo sapiens
uggauacugcugccaa

SEQ ID NO: 1894746 - RNA, 15 nt, Homo sapiens
auucugguuucuaga

SEQ ID NO: 1894747 - RNA, 16 nt, Homo sapiens
agccaagggcugagug

SEQ ID NO: 1894748 - RNA, 14 nt, Homo sapiens
gcuucaguugcaua

SEQ ID NO: 1894749 - RNA, 13 nt, Homo sapiens
cgcuugcacacau

SEQ ID NO: 1894750 - RNA, 16 nt, Homo sapiens
uguuuugccagugaag

SEQ ID NO: 1894751 - RNA, 15 nt, Homo sapiens
accaugccagggauu

SEQ ID NO: 1894752 - RNA, 12 nt, Homo sapiens
guaacucagugu

SEQ ID NO: 1894753 - RNA, 17 nt, Homo sapiens
aaguacaaauauuccug

SEQ ID NO: 1894754 - RNA, 16 nt, Homo sapiens
aggaggcacugcugau

SEQ ID NO: 1894755 - RNA, 16 nt, Homo sapiens
ccucacccagagucag

SEQ ID NO: 1894756 - RNA, 21 nt, Homo sapiens
agcaaauaucuaaauaauggc

SEQ ID NO: 1894757 - RNA, 17 nt, Homo sapiens
aauccccaagaacacaa

SEQ ID NO: 1894758 - RNA, 17 nt, Homo sapiens
augcacauagcuaucaa

SEQ ID NO: 1894759 - RNA, 22 nt, Homo sapiens
auuuugcccuugacaaagucaa

SEQ ID NO: 1894760 - RNA, 15 nt, Homo sapiens
aaagcucuucauuuc

SEQ ID NO: 1894761 - RNA, 16 nt, Homo sapiens
accucaaaaugucuaa

SEQ ID NO: 1894762 - RNA, 16 nt, Homo sapiens
acuacaaacacaagca

SEQ ID NO: 1894763 - RNA, 14 nt, Homo sapiens
cugacccaagagaa

SEQ ID NO: 1894764 - RNA, 21 nt, Homo sapiens
ucaucccuggucgucuauccc

SEQ ID NO: 1894765 - RNA, 19 nt, Homo sapiens
gcagcuuuaaacucaggga

SEQ ID NO: 1894766 - RNA, 19 nt, Homo sapiens
aguuugagaccaaccuggg

SEQ ID NO: 1894767 - RNA, 22 nt, Homo sapiens
aauuucaaucaaccaaaguuag

SEQ ID NO: 1894768 - RNA, 19 nt, Homo sapiens
ugcugaaacucagugcaaa

SEQ ID NO: 1894769 - RNA, 15 nt, Homo sapiens
ucaucuagcgcaauu

SEQ ID NO: 1894770 - RNA, 16 nt, Homo sapiens
cugccaccucccugac

SEQ ID NO: 1894771 - RNA, 13 nt, Homo sapiens
gcaacauagcaaa

SEQ ID NO: 1894772 - RNA, 14 nt, Homo sapiens
aaauguuugagcac

SEQ ID NO: 1894773 - RNA, 19 nt, Homo sapiens
agaaaagcaauacuguuuc

SEQ ID NO: 1894774 - RNA, 20 nt, Homo sapiens
aaguguuccuucauuaacuc

SEQ ID NO: 1894775 - RNA, 19 nt, Homo sapiens
cuggcagggacgaggacaa

SEQ ID NO: 1894776 - RNA, 13 nt, Homo sapiens
aaugaacacuccc

SEQ ID NO: 1894777 - RNA, 13 nt, Homo sapiens
cuugcacaaacca

SEQ ID NO: 1894778 - RNA, 19 nt, Homo sapiens
caguaguggugacuguggg

SEQ ID NO: 1894779 - RNA, 19 nt, Homo sapiens
uuuaaaaaauugacuaccu

SEQ ID NO: 1894780 - RNA, 22 nt, Homo sapiens
gacuaaaaauaucacacugaau

SEQ ID NO: 1894781 - RNA, 15 nt, Homo sapiens
aguguaaugugacuu

SEQ ID NO: 1894782 - RNA, 15 nt, Homo sapiens
caacuuuccuuaaaa

SEQ ID NO: 1894783 - RNA, 17 nt, Homo sapiens
accagcaggacacugau

SEQ ID NO: 1894784 - RNA, 13 nt, Homo sapiens
aaagccugaaggg

SEQ ID NO: 1894785 - RNA, 23 nt, Homo sapiens
ggauaauauccagccucccacaa

SEQ ID NO: 1894786 - RNA, 19 nt, Homo sapiens
ugagagcucuaguauuucc

SEQ ID NO: 1894787 - RNA, 18 nt, Homo sapiens
gugauucuuagcaaaaaa

SEQ ID NO: 1894788 - RNA, 15 nt, Homo sapiens
augugaaauggccaa

SEQ ID NO: 1894789 - RNA, 23 nt, Homo sapiens
ccacacuucccacccccaggcaa

SEQ ID NO: 1894790 - RNA, 21 nt, Homo sapiens
acaagauacacgucacaaaga

SEQ ID NO: 1894791 - RNA, 15 nt, Homo sapiens
gcuuuucauuucuca

SEQ ID NO: 1894792 - RNA, 21 nt, Homo sapiens
agucugacccuuacagccucu

SEQ ID NO: 1894793 - RNA, 21 nt, Homo sapiens
auagcugaaugagucugcuuu

SEQ ID NO: 1894794 - RNA, 23 nt, Homo sapiens
ucuucugacaaacuguguacaua

SEQ ID NO: 1894795 - RNA, 17 nt, Homo sapiens
uguccacgauucacuca

SEQ ID NO: 1894796 - RNA, 12 nt, Homo sapiens
acuccacaucaa

SEQ ID NO: 1894797 - RNA, 16 nt, Homo sapiens
uaaauaaaaauaugua

SEQ ID NO: 1894798 - RNA, 12 nt, Homo sapiens
ggaaugcaauau

SEQ ID NO: 1894799 - RNA, 22 nt, Homo sapiens
aacauagugaaaccccaucucu

SEQ ID NO: 1894800 - RNA, 16 nt, Homo sapiens
cuccugggcucaagug

SEQ ID NO: 1894801 - RNA, 20 nt, Homo sapiens
ugaguuaucagcucuauguc

SEQ ID NO: 1894802 - RNA, 17 nt, Homo sapiens
aggggcagccuccguca

SEQ ID NO: 1894803 - RNA, 13 nt, Homo sapiens
gaagccacaucac

SEQ ID NO: 1894804 - RNA, 11 nt, Homo sapiens
ugacacuggac

SEQ ID NO: 1894805 - RNA, 11 nt, Homo sapiens
ggacacuguac

SEQ ID NO: 1894806 - RNA, 19 nt, Homo sapiens
ccccccaagauagagucaa

SEQ ID NO: 1894807 - RNA, 22 nt, Homo sapiens
ucauauaagcuauaucauaaau

SEQ ID NO: 1894808 - RNA, 14 nt, Homo sapiens
ccucuuugucccag

SEQ ID NO: 1894809 - RNA, 16 nt, Homo sapiens
agaugcccucaacuca

SEQ ID NO: 1894810 - RNA, 16 nt, Homo sapiens
aaucuggggauacugg

SEQ ID NO: 1894811 - RNA, 17 nt, Homo sapiens
cuguucaaggccccuga

SEQ ID NO: 1894812 - RNA, 23 nt, Homo sapiens
uuaauaagucacugacaucagca

SEQ ID NO: 1894813 - RNA, 14 nt, Homo sapiens
ccuuucagggccaa

SEQ ID NO: 1894814 - RNA, 23 nt, Homo sapiens
uucauuucagauaaacaacaaau

SEQ ID NO: 1894815 - RNA, 21 nt, Homo sapiens
aaguguaaaaagaugacuuaa

SEQ ID NO: 1894816 - RNA, 12 nt, Homo sapiens
guauucuguucu

SEQ ID NO: 1894817 - RNA, 17 nt, Homo sapiens
cagaacucagccuuaag

SEQ ID NO: 1894818 - RNA, 22 nt, Homo sapiens
gagaauauugaaguacuugcca

SEQ ID NO: 1894819 - RNA, 21 nt, Homo sapiens
agugcaguuuuuuucuugucu

SEQ ID NO: 1894820 - RNA, 22 nt, Homo sapiens
cagaagaaguuaucaacaugca

SEQ ID NO: 1894821 - RNA, 14 nt, Homo sapiens
acuggaggugggca

SEQ ID NO: 1894822 - RNA, 18 nt, Homo sapiens
aagcauuucuagcaguga

SEQ ID NO: 1894823 - RNA, 21 nt, Homo sapiens
gaccaaagauuaguaaccagu

SEQ ID NO: 1894824 - RNA, 14 nt, Homo sapiens
aggccccagcugga

SEQ ID NO: 1894825 - RNA, 16 nt, Homo sapiens
augccacgugccauug

SEQ ID NO: 1894826 - RNA, 15 nt, Homo sapiens
acuuuaaauggaaua

SEQ ID NO: 1894827 - RNA, 22 nt, Homo sapiens
aguuucuuuuauuuucauuucu

SEQ ID NO: 1894828 - RNA, 13 nt, Homo sapiens
cucugugcuuuga

SEQ ID NO: 1894829 - RNA, 19 nt, Homo sapiens
acccugacuguauacagaa

SEQ ID NO: 1894830 - RNA, 15 nt, Homo sapiens
aauccugacaccacc

SEQ ID NO: 1894831 - RNA, 21 nt, Homo sapiens
caagcauggaaaaucagugac

SEQ ID NO: 1894832 - RNA, 18 nt, Homo sapiens
ucuuucuaaaauauuuca

SEQ ID NO: 1894833 - RNA, 21 nt, Homo sapiens
cacugaggugccgugugacgg

SEQ ID NO: 1894834 - RNA, 13 nt, Homo sapiens
caaugacaggaca

SEQ ID NO: 1894835 - RNA, 15 nt, Homo sapiens
uuaaucuuccauucc

SEQ ID NO: 1894836 - RNA, 20 nt, Homo sapiens
uugaacaaaggaauuuucaa

SEQ ID NO: 1894837 - RNA, 21 nt, Homo sapiens
gaagaguggacaaacagggaa

SEQ ID NO: 1894838 - RNA, 19 nt, Homo sapiens
cauguguuaguguauguga

SEQ ID NO: 1894839 - RNA, 15 nt, Homo sapiens
aucauuugacuaaga

SEQ ID NO: 1894840 - RNA, 18 nt, Homo sapiens
uucugaaaacacuugaug

SEQ ID NO: 1894841 - RNA, 16 nt, Homo sapiens
auuaggugaagggaug

SEQ ID NO: 1894842 - RNA, 21 nt, Homo sapiens
uacuugaaacagucacuauca

SEQ ID NO: 1894843 - RNA, 19 nt, Homo sapiens
uccccaccccaaccacucu

SEQ ID NO: 1894844 - RNA, 12 nt, Homo sapiens
agauccaggaac

SEQ ID NO: 1894845 - RNA, 18 nt, Homo sapiens
uuacuguuuugccaagaa

SEQ ID NO: 1894846 - RNA, 13 nt, Homo sapiens
uguaacugcugaa

SEQ ID NO: 1894847 - RNA, 19 nt, Homo sapiens
uuccuuuuggaacauuucu

SEQ ID NO: 1894848 - RNA, 20 nt, Homo sapiens
uggcaacaacuuagaagaaa

SEQ ID NO: 1894849 - RNA, 19 nt, Homo sapiens
uucccugcacacacaugca

SEQ ID NO: 1894850 - RNA, 14 nt, Homo sapiens
gaaaacaauacuaa

SEQ ID NO: 1894851 - RNA, 17 nt, Homo sapiens
cacacugcccugucucc

SEQ ID NO: 1894852 - RNA, 11 nt, Homo sapiens
uguauuucccc

SEQ ID NO: 1894853 - RNA, 16 nt, Homo sapiens
cggaccgaaggugaca

SEQ ID NO: 1894854 - RNA, 10 nt, Homo sapiens
aaauguccuc

SEQ ID NO: 1894855 - RNA, 20 nt, Homo sapiens
ugaggagggaggaacguggu

SEQ ID NO: 1894856 - RNA, 17 nt, Homo sapiens
uaguuuuuaaucucucc

SEQ ID NO: 1894857 - RNA, 19 nt, Homo sapiens
aaacaugaacccaaaaaga

SEQ ID NO: 1894858 - RNA, 15 nt, Homo sapiens
aaucauuauguuucc

SEQ ID NO: 1894859 - RNA, 21 nt, Homo sapiens
uuuuccuucuacuuacacauc

SEQ ID NO: 1894860 - RNA, 18 nt, Homo sapiens
uaugugugccagcugugu

SEQ ID NO: 1894861 - RNA, 16 nt, Homo sapiens
gagaguggaacagaag

SEQ ID NO: 1894862 - RNA, 18 nt, Homo sapiens
cauuuuuuaaauuugcca

SEQ ID NO: 1894863 - RNA, 22 nt, Homo sapiens
ugaauggagcagaaauucaccu

SEQ ID NO: 1894864 - RNA, 16 nt, Homo sapiens
aaggaacuggaacaca

SEQ ID NO: 1894865 - RNA, 21 nt, Homo sapiens
ugcuuccccacgggaacauua

SEQ ID NO: 1894866 - RNA, 15 nt, Homo sapiens
uccaauaggcauuug

SEQ ID NO: 1894867 - RNA, 23 nt, Homo sapiens
auuuccaggggccucccaaggaa

SEQ ID NO: 1894868 - RNA, 22 nt, Homo sapiens
acacccuucucccacucuccua

SEQ ID NO: 1894869 - RNA, 12 nt, Homo sapiens
gaaggcuuuagu

SEQ ID NO: 1894870 - RNA, 13 nt, Homo sapiens
caaugaguuauug

SEQ ID NO: 1894871 - RNA, 21 nt, Homo sapiens
acuugaauacuuugaguaaac

SEQ ID NO: 1894872 - RNA, 22 nt, Homo sapiens
acaauuaccugccaaaugcuau

SEQ ID NO: 1894873 - RNA, 13 nt, Homo sapiens
uaauaaacugugu

SEQ ID NO: 1894874 - RNA, 20 nt, Homo sapiens
cugccuccaacccagcaguu

SEQ ID NO: 1894875 - RNA, 12 nt, Homo sapiens
ucagaguucuca

SEQ ID NO: 1894876 - RNA, 23 nt, Homo sapiens
cgcgugaucaaagccacacucug

SEQ ID NO: 1894877 - RNA, 16 nt, Homo sapiens
gcaagucaugcugaau

SEQ ID NO: 1894878 - RNA, 22 nt, Homo sapiens
aggcacacacgccuucaugcca

SEQ ID NO: 1894879 - RNA, 22 nt, Homo sapiens
uugaaaucaguaaacacugugu

SEQ ID NO: 1894880 - RNA, 22 nt, Homo sapiens
acaaauauggggaaaaaacugu

SEQ ID NO: 1894881 - RNA, 23 nt, Homo sapiens
gucauuuuuaacagcaugcugcu

SEQ ID NO: 1894882 - RNA, 18 nt, Homo sapiens
ucugaauacacaguauuc

SEQ ID NO: 1894883 - RNA, 19 nt, Homo sapiens
uuucuacuagccauuggga

SEQ ID NO: 1894884 - RNA, 13 nt, Homo sapiens
caaagaucucagc

SEQ ID NO: 1894885 - RNA, 14 nt, Homo sapiens
agguuaaaggccag

SEQ ID NO: 1894886 - RNA, 21 nt, Homo sapiens
gcuuguuuacagcacuacucu

SEQ ID NO: 1894887 - RNA, 19 nt, Homo sapiens
gaaccauucacagugcaag

SEQ ID NO: 1894888 - RNA, 23 nt, Homo sapiens
auguacaauaaagcaauguggua

SEQ ID NO: 1894889 - RNA, 18 nt, Homo sapiens
uaugauguguugugauag

SEQ ID NO: 1894890 - RNA, 12 nt, Homo sapiens
uccugcacucua

SEQ ID NO: 1894891 - RNA, 16 nt, Homo sapiens
uaaaacaguaucucuu

SEQ ID NO: 1894892 - RNA, 19 nt, Homo sapiens
ugccuauggaguagccauu

SEQ ID NO: 1894893 - RNA, 22 nt, Homo sapiens
cccugccccuggugcccugaga

SEQ ID NO: 1894894 - RNA, 21 nt, Homo sapiens
gaauaugauaaaacacugccc

SEQ ID NO: 1894895 - RNA, 19 nt, Homo sapiens
ggacaccccuuauccagga

SEQ ID NO: 1894896 - RNA, 23 nt, Homo sapiens
aggccagaaaacauaugcauuau

SEQ ID NO: 1894897 - RNA, 21 nt, Homo sapiens
ugguuaucuaaccuguuccau

SEQ ID NO: 1894898 - RNA, 19 nt, Homo sapiens
ccggcugagcugugccagc

SEQ ID NO: 1894899 - RNA, 12 nt, Homo sapiens
cagaaucccucu

SEQ ID NO: 1894900 - RNA, 22 nt, Homo sapiens
gcagaaucccggcugucaaggg

SEQ ID NO: 1894901 - RNA, 17 nt, Homo sapiens
uggaacucuuuaucuca

SEQ ID NO: 1894902 - RNA, 18 nt, Homo sapiens
aguggaaaaaggagagca

SEQ ID NO: 1894903 - RNA, 14 nt, Homo sapiens
uccauauagcaaua

SEQ ID NO: 1894904 - RNA, 19 nt, Homo sapiens
agcucucugacgcuuguga

SEQ ID NO: 1894905 - RNA, 11 nt, Homo sapiens
aaggguccuac

SEQ ID NO: 1894906 - RNA, 23 nt, Homo sapiens
uggggacggggggccccagucag

SEQ ID NO: 1894907 - RNA, 18 nt, Homo sapiens
auuuuacuuuucugccaa

SEQ ID NO: 1894908 - RNA, 15 nt, Homo sapiens
uuaccagugacuaau

SEQ ID NO: 1894909 - RNA, 17 nt, Homo sapiens
aggucauuuucuauuca

SEQ ID NO: 1894910 - RNA, 22 nt, Homo sapiens
caccaguuggagcagaugccuc

SEQ ID NO: 1894911 - RNA, 17 nt, Homo sapiens
aacuauaagauacaaua

SEQ ID NO: 1894912 - RNA, 20 nt, Homo sapiens
aauuucuaccuuuacuacau

SEQ ID NO: 1894913 - RNA, 11 nt, Homo sapiens
auuggcaaaga

SEQ ID NO: 1894914 - RNA, 16 nt, Homo sapiens
uuagaggacacuauug

SEQ ID NO: 1894915 - RNA, 16 nt, Homo sapiens
gauuaugaaagcaaca

SEQ ID NO: 1894916 - RNA, 15 nt, Homo sapiens
ucgcugccagaugau

SEQ ID NO: 1894917 - RNA, 17 nt, Homo sapiens
acuccugaccucaggua

SEQ ID NO: 1894918 - RNA, 22 nt, Homo sapiens
uccaggaaugaucccacucacc

SEQ ID NO: 1894919 - RNA, 14 nt, Homo sapiens
aagaucccuauuau

SEQ ID NO: 1894920 - RNA, 16 nt, Homo sapiens
uucccucagauuucca

SEQ ID NO: 1894921 - RNA, 18 nt, Homo sapiens
uagagacagggucucacu

SEQ ID NO: 1894922 - RNA, 22 nt, Homo sapiens
cuggaguggaaaagcuuaaaaa

SEQ ID NO: 1894923 - RNA, 20 nt, Homo sapiens
uacuugcagguuguugucau

SEQ ID NO: 1894924 - RNA, 15 nt, Homo sapiens
caaugcccuaccugc

SEQ ID NO: 1894925 - RNA, 16 nt, Homo sapiens
aauaaauccuccaguc

SEQ ID NO: 1894926 - RNA, 13 nt, Homo sapiens
cgagauacugcau

SEQ ID NO: 1894927 - RNA, 14 nt, Homo sapiens
accacaaguaucua

SEQ ID NO: 1894928 - RNA, 13 nt, Homo sapiens
cacauauugagaa

SEQ ID NO: 1894929 - RNA, 23 nt, Homo sapiens
gagagcuaaauuacaauugucau

SEQ ID NO: 1894930 - RNA, 15 nt, Homo sapiens
uccaaauaagugcau

SEQ ID NO: 1894931 - RNA, 22 nt, Homo sapiens
gcacuugauguguagacauguc

SEQ ID NO: 1894932 - RNA, 16 nt, Homo sapiens
gccaggcacuguucau

SEQ ID NO: 1894933 - RNA, 19 nt, Homo sapiens
uuggccaccaggugccuuu

SEQ ID NO: 1894934 - RNA, 21 nt, Homo sapiens
uugaacuuaaauaaaugucau

SEQ ID NO: 1894935 - RNA, 19 nt, Homo sapiens
cuugagccacagucacugg

SEQ ID NO: 1894936 - RNA, 16 nt, Homo sapiens
uuucuaaauguuucuu

SEQ ID NO: 1894937 - RNA, 18 nt, Homo sapiens
auagcagcuuugucucug

SEQ ID NO: 1894938 - RNA, 16 nt, Homo sapiens
cuguucugaaaccuua

SEQ ID NO: 1894939 - RNA, 13 nt, Homo sapiens
ggucaauauuuga

SEQ ID NO: 1894940 - RNA, 17 nt, Homo sapiens
aacuccugaccccagau

SEQ ID NO: 1894941 - RNA, 15 nt, Homo sapiens
cgccugacaaccacu

SEQ ID NO: 1894942 - RNA, 23 nt, Homo sapiens
ucagcaugauguguuguguauaa

SEQ ID NO: 1894943 - RNA, 15 nt, Homo sapiens
ugaauaacacuggau

SEQ ID NO: 1894944 - RNA, 16 nt, Homo sapiens
agacccccagcacuug

SEQ ID NO: 1894945 - RNA, 15 nt, Homo sapiens
auaacccccugccca

SEQ ID NO: 1894946 - RNA, 23 nt, Homo sapiens
uuugcagaugaaguaacugaggc

SEQ ID NO: 1894947 - RNA, 12 nt, Homo sapiens
auagaugacaaa

SEQ ID NO: 1894948 - RNA, 13 nt, Homo sapiens
uagcuacagagaa

SEQ ID NO: 1894949 - RNA, 13 nt, Homo sapiens
gauauacauauca

SEQ ID NO: 1894950 - RNA, 13 nt, Homo sapiens
accaaaacauaaa

SEQ ID NO: 1894951 - RNA, 18 nt, Homo sapiens
ucacugaaaacaucugga

SEQ ID NO: 1894952 - RNA, 22 nt, Homo sapiens
gucugggcaaugaaaccaaagc

SEQ ID NO: 1894953 - RNA, 14 nt, Homo sapiens
gagcagccucuuga

SEQ ID NO: 1894954 - RNA, 20 nt, Homo sapiens
agaagggauaucuacugugg

SEQ ID NO: 1894955 - RNA, 19 nt, Homo sapiens
agguuuagaggaccaguga

SEQ ID NO: 1894956 - RNA, 17 nt, Homo sapiens
aguagaauagugguugc

SEQ ID NO: 1894957 - RNA, 11 nt, Homo sapiens
uccuccagguu

SEQ ID NO: 1894958 - RNA, 22 nt, Homo sapiens
uauuauaucagcuuuucugaug

SEQ ID NO: 1894959 - RNA, 20 nt, Homo sapiens
caggcuauguauaaaauaca

SEQ ID NO: 1894960 - RNA, 22 nt, Homo sapiens
auauguuugcauuaaaugcuuu

SEQ ID NO: 1894961 - RNA, 19 nt, Homo sapiens
aacuaguuuuuauagcuau

SEQ ID NO: 1894962 - RNA, 20 nt, Homo sapiens
gcugccagaugauuguucaa

SEQ ID NO: 1894963 - RNA, 15 nt, Homo sapiens
uugcuaacaggauau

SEQ ID NO: 1894964 - RNA, 17 nt, Homo sapiens
ucuguuaaguuacauuu

SEQ ID NO: 1894965 - RNA, 19 nt, Homo sapiens
aucaccauguuagccuuag

SEQ ID NO: 1894966 - RNA, 13 nt, Homo sapiens
caaggacacagau

SEQ ID NO: 1894967 - RNA, 22 nt, Homo sapiens
ucaggaaccucgaguacugugg

SEQ ID NO: 1894968 - RNA, 20 nt, Homo sapiens
uucuaccacccaccaguuga

SEQ ID NO: 1894969 - RNA, 21 nt, Homo sapiens
gagcaugggacugugccuuug

SEQ ID NO: 1894970 - RNA, 18 nt, Homo sapiens
auggcuuuguacuuguga

SEQ ID NO: 1894971 - RNA, 21 nt, Homo sapiens
gcaguuuugugauaaguucua

SEQ ID NO: 1894972 - RNA, 20 nt, Homo sapiens
guguguagggggguuucagg

SEQ ID NO: 1894973 - RNA, 19 nt, Homo sapiens
acuguauguuuuuacugaa

SEQ ID NO: 1894974 - RNA, 22 nt, Homo sapiens
cauuucaaaacccaaauggcua

SEQ ID NO: 1894975 - RNA, 14 nt, Homo sapiens
aaggagcaugucac

SEQ ID NO: 1894976 - RNA, 22 nt, Homo sapiens
augcuagaaaggaagacagauu

SEQ ID NO: 1894977 - RNA, 21 nt, Homo sapiens
gauuccguauugguauacuuu

SEQ ID NO: 1894978 - RNA, 22 nt, Homo sapiens
agaauccacaaagccgugccuu

SEQ ID NO: 1894979 - RNA, 10 nt, Homo sapiens
uaccaaauau

SEQ ID NO: 1894980 - RNA, 13 nt, Homo sapiens
ccaggcacagugg

SEQ ID NO: 1894981 - RNA, 15 nt, Homo sapiens
ccaugcgcugcucaa

SEQ ID NO: 1894982 - RNA, 15 nt, Homo sapiens
ccaugagcugcucca

SEQ ID NO: 1894983 - RNA, 21 nt, Homo sapiens
cagcccagauggcacucagcg

SEQ ID NO: 1894984 - RNA, 17 nt, Homo sapiens
cccuaagaggcagugag

SEQ ID NO: 1894985 - RNA, 15 nt, Homo sapiens
ucccgccauuggccu

SEQ ID NO: 1894986 - RNA, 20 nt, Homo sapiens
aaggggccugggcugugagg

SEQ ID NO: 1894987 - RNA, 14 nt, Homo sapiens
cucaccaaacacaa

SEQ ID NO: 1894988 - RNA, 13 nt, Homo sapiens
auaacuguucuca

SEQ ID NO: 1894989 - RNA, 20 nt, Homo sapiens
acaccuuguggagaacaugc

SEQ ID NO: 1894990 - RNA, 20 nt, Homo sapiens
aguaccuuguuuugccaugu

SEQ ID NO: 1894991 - RNA, 13 nt, Homo sapiens
aaaggaacaaaua

SEQ ID NO: 1894992 - RNA, 13 nt, Homo sapiens
augugaacaugga

SEQ ID NO: 1894993 - RNA, 13 nt, Homo sapiens
uaugaaacuauug

SEQ ID NO: 1894994 - RNA, 13 nt, Homo sapiens
ugaugaacugaga

SEQ ID NO: 1894995 - RNA, 21 nt, Homo sapiens
guauucuuuuccaagcuccuu

SEQ ID NO: 1894996 - RNA, 19 nt, Homo sapiens
gauuauuagaaucaaacau

SEQ ID NO: 1894997 - RNA, 20 nt, Homo sapiens
ugaacaaucaaagcacuugg

SEQ ID NO: 1894998 - RNA, 20 nt, Homo sapiens
cauuucuagagagccccuga

SEQ ID NO: 1894999 - RNA, 16 nt, Homo sapiens
aaaugucuuacuccug

SEQ ID NO: 1895000 - RNA, 18 nt, Homo sapiens
uggucccaagacagugag

SEQ ID NO: 1895001 - RNA, 16 nt, Homo sapiens
gacuuugaaacuauua

SEQ ID NO: 1895002 - RNA, 19 nt, Homo sapiens
caaggggccauuuggcaua

SEQ ID NO: 1895003 - RNA, 17 nt, Homo sapiens
cguauguaaacauucau

SEQ ID NO: 1895004 - RNA, 15 nt, Homo sapiens
caagaaaagaguuaa

SEQ ID NO: 1895005 - RNA, 22 nt, Homo sapiens
gaccagaaaguguguguguucu

SEQ ID NO: 1895006 - RNA, 17 nt, Homo sapiens
cucaaaggcauaaguca

SEQ ID NO: 1895007 - RNA, 22 nt, Homo sapiens
augggacccgguguaugccaag

SEQ ID NO: 1895008 - RNA, 22 nt, Homo sapiens
ugcucugcuuuuccugucugua

SEQ ID NO: 1895009 - RNA, 22 nt, Homo sapiens
acgugauggaccaaagccaccu

SEQ ID NO: 1895010 - RNA, 18 nt, Homo sapiens
gggaaguaacauuugccu

SEQ ID NO: 1895011 - RNA, 16 nt, Homo sapiens
uugcuuuacaaaccaa

SEQ ID NO: 1895012 - RNA, 18 nt, Homo sapiens
uccuagauguaacauucc

SEQ ID NO: 1895013 - RNA, 13 nt, Homo sapiens
agcaauguauaac

SEQ ID NO: 1895014 - RNA, 13 nt, Homo sapiens
gaaggccacuuga

SEQ ID NO: 1895015 - RNA, 20 nt, Homo sapiens
gaagguuauggucaauccca

SEQ ID NO: 1895016 - RNA, 19 nt, Homo sapiens
guaaagaaauacacaggga

SEQ ID NO: 1895017 - RNA, 14 nt, Homo sapiens
ucccuccggccaua

SEQ ID NO: 1895018 - RNA, 14 nt, Homo sapiens
caucacugaaaugc

SEQ ID NO: 1895019 - RNA, 14 nt, Homo sapiens
agcccuugcacagc

SEQ ID NO: 1895020 - RNA, 13 nt, Homo sapiens
cguggacucugca

SEQ ID NO: 1895021 - RNA, 18 nt, Homo sapiens
caguuugaaggcugcaca

SEQ ID NO: 1895022 - RNA, 23 nt, Homo sapiens
augaaugcccaggagcugaggau

SEQ ID NO: 1895023 - RNA, 18 nt, Homo sapiens
guuagucaauccugucau

SEQ ID NO: 1895024 - RNA, 19 nt, Homo sapiens
cugagaggagcguguccua

SEQ ID NO: 1895025 - RNA, 20 nt, Homo sapiens
auauggcagggaagcuuuca

SEQ ID NO: 1895026 - RNA, 20 nt, Homo sapiens
uggaguaaauauauauguca

SEQ ID NO: 1895027 - RNA, 13 nt, Homo sapiens
ccggguccuccua

SEQ ID NO: 1895028 - RNA, 23 nt, Homo sapiens
aagaucaaaagcuuauucaucug

SEQ ID NO: 1895029 - RNA, 24 nt, Homo sapiens
agcuauuuaaaaaaaaaagaggaa

SEQ ID NO: 1895030 - RNA, 13 nt, Homo sapiens
uacauauuaucuc

SEQ ID NO: 1895031 - RNA, 23 nt, Homo sapiens
guccuucagugagccccucccca

SEQ ID NO: 1895032 - RNA, 12 nt, Homo sapiens
aacaugccugau

SEQ ID NO: 1895033 - RNA, 18 nt, Homo sapiens
gaggcuccugcuuauuua

SEQ ID NO: 1895034 - RNA, 20 nt, Homo sapiens
uagaagcagagggacaacca

SEQ ID NO: 1895035 - RNA, 14 nt, Homo sapiens
aggagguuugcagg

SEQ ID NO: 1895036 - RNA, 14 nt, Homo sapiens
acucacugcucaag

SEQ ID NO: 1895037 - RNA, 13 nt, Homo sapiens
aacuaagcacaaa

SEQ ID NO: 1895038 - RNA, 16 nt, Homo sapiens
uuucuuaccaccucuu

SEQ ID NO: 1895039 - RNA, 12 nt, Homo sapiens
accuauguaaca

SEQ ID NO: 1895040 - RNA, 12 nt, Homo sapiens
gaaaaugugcau

SEQ ID NO: 1895041 - RNA, 17 nt, Homo sapiens
acaaaugguuaccuugu

SEQ ID NO: 1895042 - RNA, 19 nt, Homo sapiens
uucacugugaccuugagaa

SEQ ID NO: 1895043 - RNA, 19 nt, Homo sapiens
uaugucuuggacacuguac

SEQ ID NO: 1895044 - RNA, 16 nt, Homo sapiens
uaaaauaaacaugaag

SEQ ID NO: 1895045 - RNA, 13 nt, Homo sapiens
agcacagaauuug

SEQ ID NO: 1895046 - RNA, 22 nt, Homo sapiens
caaugaaaaaaaguacauguau

SEQ ID NO: 1895047 - RNA, 23 nt, Homo sapiens
ccacggccuguacggacacugug

SEQ ID NO: 1895048 - RNA, 12 nt, Homo sapiens
uccaugugaaau

SEQ ID NO: 1895049 - RNA, 20 nt, Homo sapiens
agauuggcaccccuuucuag

SEQ ID NO: 1895050 - RNA, 15 nt, Homo sapiens
agcagcugguggaag

SEQ ID NO: 1895051 - RNA, 16 nt, Homo sapiens
ucauuuauuaaguaua

SEQ ID NO: 1895052 - RNA, 18 nt, Homo sapiens
aaacauuuuuguuuuuaa

SEQ ID NO: 1895053 - RNA, 12 nt, Homo sapiens
ggaggcucucau

SEQ ID NO: 1895054 - RNA, 20 nt, Homo sapiens
cuggauuuauaguaugugac

SEQ ID NO: 1895055 - RNA, 17 nt, Homo sapiens
ucaggaauacauuugga

SEQ ID NO: 1895056 - RNA, 14 nt, Homo sapiens
aauucacauuugcc

SEQ ID NO: 1895057 - RNA, 22 nt, Homo sapiens
auucuuuauucucaguaacuuu

SEQ ID NO: 1895058 - RNA, 19 nt, Homo sapiens
acauguugcuaaugacagu

SEQ ID NO: 1895059 - RNA, 14 nt, Homo sapiens
auguauucuaugaa

SEQ ID NO: 1895060 - RNA, 18 nt, Homo sapiens
aggaauugguaaggccuc

SEQ ID NO: 1895061 - RNA, 22 nt, Homo sapiens
ucacaaucaucaucauucucau

SEQ ID NO: 1895062 - RNA, 18 nt, Homo sapiens
ucaccagcuaucugucau

SEQ ID NO: 1895063 - RNA, 17 nt, Homo sapiens
gccacuugcacugugcu

SEQ ID NO: 1895064 - RNA, 16 nt, Homo sapiens
ccugacaagugaaguu

SEQ ID NO: 1895065 - RNA, 16 nt, Homo sapiens
gcuccagcaagcaaac

SEQ ID NO: 1895066 - RNA, 13 nt, Homo sapiens
uguuuaccaugaa

SEQ ID NO: 1895067 - RNA, 14 nt, Homo sapiens
agcgugaagggauu

SEQ ID NO: 1895068 - RNA, 23 nt, Homo sapiens
caauauaguuuucuaacuccugu

SEQ ID NO: 1895069 - RNA, 18 nt, Homo sapiens
uauauuuaaauaaaggaa

SEQ ID NO: 1895070 - RNA, 20 nt, Homo sapiens
uucaauugcuucugugcaau

SEQ ID NO: 1895071 - RNA, 21 nt, Homo sapiens
gccagggguggugagggcagu

SEQ ID NO: 1895072 - RNA, 22 nt, Homo sapiens
accucuuuggauguuuucccca

SEQ ID NO: 1895073 - RNA, 18 nt, Homo sapiens
ugagccaugcuacaguua

SEQ ID NO: 1895074 - RNA, 16 nt, Homo sapiens
ccuuaaaaauguaugu

SEQ ID NO: 1895075 - RNA, 16 nt, Homo sapiens
guccaaguccaaccug

SEQ ID NO: 1895076 - RNA, 15 nt, Homo sapiens
cugucugaccagaga

SEQ ID NO: 1895077 - RNA, 23 nt, Homo sapiens
caagcgaaaaaaaaaaaugcacu

SEQ ID NO: 1895078 - RNA, 14 nt, Homo sapiens
acagaccagcauag

SEQ ID NO: 1895079 - RNA, 21 nt, Homo sapiens
gucaauuuguauaucaugaaa

SEQ ID NO: 1895080 - RNA, 15 nt, Homo sapiens
augugcgucucucuu

SEQ ID NO: 1895081 - RNA, 23 nt, Homo sapiens
ggagcacuguuucuuuccagcaa

SEQ ID NO: 1895082 - RNA, 23 nt, Homo sapiens
agaagcuaaccugccauagucag

SEQ ID NO: 1895083 - RNA, 16 nt, Homo sapiens
ucauauuuucuuucaa

SEQ ID NO: 1895084 - RNA, 14 nt, Homo sapiens
agaaggcaaaaaug

SEQ ID NO: 1895085 - RNA, 20 nt, Homo sapiens
uagcccugcuccaacuccau

SEQ ID NO: 1895086 - RNA, 16 nt, Homo sapiens
uugggauauucugaaa

SEQ ID NO: 1895087 - RNA, 14 nt, Homo sapiens
uuaacuagugucau

SEQ ID NO: 1895088 - RNA, 19 nt, Homo sapiens
auuuaguaaaauuaucugu

SEQ ID NO: 1895089 - RNA, 21 nt, Homo sapiens
cuuccuggguccuguucccua

SEQ ID NO: 1895090 - RNA, 16 nt, Homo sapiens
augaacacaggcaaug

SEQ ID NO: 1895091 - RNA, 21 nt, Homo sapiens
cagguagaccaggugcucagc

SEQ ID NO: 1895092 - RNA, 14 nt, Homo sapiens
cugagacccagaga

SEQ ID NO: 1895093 - RNA, 21 nt, Homo sapiens
acucaaauggggccagaucca

SEQ ID NO: 1895094 - RNA, 14 nt, Homo sapiens
ugucucccaaaaau

SEQ ID NO: 1895095 - RNA, 17 nt, Homo sapiens
agagauggcaguugcuu

SEQ ID NO: 1895096 - RNA, 16 nt, Homo sapiens
uacacagaugaaggug

SEQ ID NO: 1895097 - RNA, 15 nt, Homo sapiens
aagagaaaaugcguc

SEQ ID NO: 1895098 - RNA, 15 nt, Homo sapiens
uauaacuguucuuca

SEQ ID NO: 1895099 - RNA, 14 nt, Homo sapiens
accugccagggagg

SEQ ID NO: 1895100 - RNA, 24 nt, Homo sapiens
uucaaaaauauuuauauugucacu

SEQ ID NO: 1895101 - RNA, 19 nt, Homo sapiens
cuuccuugaacccuaauaa

SEQ ID NO: 1895102 - RNA, 15 nt, Homo sapiens
ggccuaugacccugu

SEQ ID NO: 1895103 - RNA, 19 nt, Homo sapiens
uuaaauuuuguaugccaau

SEQ ID NO: 1895104 - RNA, 16 nt, Homo sapiens
ucauuuaggaguauua

SEQ ID NO: 1895105 - RNA, 11 nt, Homo sapiens
gcauagcacuu

SEQ ID NO: 1895106 - RNA, 16 nt, Homo sapiens
uuucugaauugcacau

SEQ ID NO: 1895107 - RNA, 22 nt, Homo sapiens
auaaagggaaaaaauugcuuga

SEQ ID NO: 1895108 - RNA, 13 nt, Homo sapiens
cgaugacaguguu

SEQ ID NO: 1895109 - RNA, 21 nt, Homo sapiens
uuucccucucccaguccauuu

SEQ ID NO: 1895110 - RNA, 21 nt, Homo sapiens
uaaauauuuuuuuaaccuaau

SEQ ID NO: 1895111 - RNA, 18 nt, Homo sapiens
ggugggaccacagacuca

SEQ ID NO: 1895112 - RNA, 17 nt, Homo sapiens
gccgugagcauguuugg

SEQ ID NO: 1895113 - RNA, 22 nt, Homo sapiens
acaaacaaauuuuucugcuuua

SEQ ID NO: 1895114 - RNA, 18 nt, Homo sapiens
agcccugcuuagcucauc

SEQ ID NO: 1895115 - RNA, 13 nt, Homo sapiens
cuggcuucaggaa

SEQ ID NO: 1895116 - RNA, 17 nt, Homo sapiens
cugcaaugaaagucaaa

SEQ ID NO: 1895117 - RNA, 19 nt, Homo sapiens
gcauuuuuaaccaacagaa

SEQ ID NO: 1895118 - RNA, 15 nt, Homo sapiens
gucuugccagauuac

SEQ ID NO: 1895119 - RNA, 21 nt, Homo sapiens
ugcucaguagucagacuggau

SEQ ID NO: 1895120 - RNA, 18 nt, Homo sapiens
cauagguaaaaacuggaa

SEQ ID NO: 1895121 - RNA, 21 nt, Homo sapiens
uagaagccacuauuacuggga

SEQ ID NO: 1895122 - RNA, 23 nt, Homo sapiens
guguaaauugcacagagcacacu

SEQ ID NO: 1895123 - RNA, 17 nt, Homo sapiens
auguuagaaagugcuga

SEQ ID NO: 1895124 - RNA, 19 nt, Homo sapiens
caugacauagcacuugccg

SEQ ID NO: 1895125 - RNA, 15 nt, Homo sapiens
acuggggcagacaau

SEQ ID NO: 1895126 - RNA, 23 nt, Homo sapiens
uggguccuggccuugugucacug

SEQ ID NO: 1895127 - RNA, 20 nt, Homo sapiens
ugaaaaugaagaaggaagcu

SEQ ID NO: 1895128 - RNA, 16 nt, Homo sapiens
cacacgcgugcacaca

SEQ ID NO: 1895129 - RNA, 12 nt, Homo sapiens
uugcccaugccu

SEQ ID NO: 1895130 - RNA, 17 nt, Homo sapiens
ugcuccucccauguuau

SEQ ID NO: 1895131 - RNA, 19 nt, Homo sapiens
aggaagauuaaaaccacag

SEQ ID NO: 1895132 - RNA, 16 nt, Homo sapiens
aucaaugaaaugaugu

SEQ ID NO: 1895133 - RNA, 17 nt, Homo sapiens
ggacacugaaccuuguu

SEQ ID NO: 1895134 - RNA, 20 nt, Homo sapiens
gacaccucaaauacauaccu

SEQ ID NO: 1895135 - RNA, 17 nt, Homo sapiens
uacuuuguauccucuga

SEQ ID NO: 1895136 - RNA, 18 nt, Homo sapiens
aaaaaauuuuugcaaaua

SEQ ID NO: 1895137 - RNA, 13 nt, Homo sapiens
ugucgucugugaa

SEQ ID NO: 1895138 - RNA, 12 nt, Homo sapiens
uucaaacuuaaa

SEQ ID NO: 1895139 - RNA, 12 nt, Homo sapiens
uaccaacuuuac

SEQ ID NO: 1895140 - RNA, 21 nt, Homo sapiens
agcaucucuggccuguaccca

SEQ ID NO: 1895141 - RNA, 22 nt, Homo sapiens
agugagauauuugguaccaugg

SEQ ID NO: 1895142 - RNA, 24 nt, Homo sapiens
augguaauacacauauuugcacaa

SEQ ID NO: 1895143 - RNA, 15 nt, Homo sapiens
ccaugggaccacaac

SEQ ID NO: 1895144 - RNA, 17 nt, Homo sapiens
gccuuccggguucaagu

SEQ ID NO: 1895145 - RNA, 16 nt, Homo sapiens
cauggcauuuguucca

SEQ ID NO: 1895146 - RNA, 19 nt, Homo sapiens
cacuucagaaauauaugca

SEQ ID NO: 1895147 - RNA, 18 nt, Homo sapiens
gcuggucuugaacuccug

SEQ ID NO: 1895148 - RNA, 18 nt, Homo sapiens
guuuacuuccccuaugga

SEQ ID NO: 1895149 - RNA, 19 nt, Homo sapiens
ucgcuacaagaaccugcua

SEQ ID NO: 1895150 - RNA, 14 nt, Homo sapiens
agauguguucacaa

SEQ ID NO: 1895151 - RNA, 17 nt, Homo sapiens
auguacuguacauaaau

SEQ ID NO: 1895152 - RNA, 23 nt, Homo sapiens
agcacgcuggacagcacucugcc

SEQ ID NO: 1895153 - RNA, 18 nt, Homo sapiens
auguggccgaggacuuug

SEQ ID NO: 1895154 - RNA, 23 nt, Homo sapiens
agagauccagggaaugaugacaa

SEQ ID NO: 1895155 - RNA, 14 nt, Homo sapiens
cacacuuggaugca

SEQ ID NO: 1895156 - RNA, 16 nt, Homo sapiens
ccuuguauugaaguua

SEQ ID NO: 1895157 - RNA, 16 nt, Homo sapiens
uuugucccaagugcca

SEQ ID NO: 1895158 - RNA, 17 nt, Homo sapiens
cuggaacuacaagugug

SEQ ID NO: 1895159 - RNA, 22 nt, Homo sapiens
gaaguuauggcuucacauucau

SEQ ID NO: 1895160 - RNA, 20 nt, Homo sapiens
cucacacaaauuaaaauaca

SEQ ID NO: 1895161 - RNA, 16 nt, Homo sapiens
aaucucuccauucccg

SEQ ID NO: 1895162 - RNA, 12 nt, Homo sapiens
aucuauaucucu

SEQ ID NO: 1895163 - RNA, 19 nt, Homo sapiens
aacuauuuuauucuaaaca

SEQ ID NO: 1895164 - RNA, 17 nt, Homo sapiens
cuuuuaaugucaucucu

SEQ ID NO: 1895165 - RNA, 15 nt, Homo sapiens
auauucucuuuggug

SEQ ID NO: 1895166 - RNA, 20 nt, Homo sapiens
cuuccugcguagaagauaug

SEQ ID NO: 1895167 - RNA, 18 nt, Homo sapiens
cucaacaagaacgauuca

SEQ ID NO: 1895168 - RNA, 16 nt, Homo sapiens
ucaguaaaugugauuc

SEQ ID NO: 1895169 - RNA, 18 nt, Homo sapiens
caugaaaacacacauaca

SEQ ID NO: 1895170 - RNA, 20 nt, Homo sapiens
ccuagacucuaaaacuauca

SEQ ID NO: 1895171 - RNA, 15 nt, Homo sapiens
gagcuuuauguaaua

SEQ ID NO: 1895172 - RNA, 12 nt, Homo sapiens
cggacuauguaa

SEQ ID NO: 1895173 - RNA, 22 nt, Homo sapiens
cccuuccuccuuccucuucuca

SEQ ID NO: 1895174 - RNA, 12 nt, Homo sapiens
aaaggaugcacc

SEQ ID NO: 1895175 - RNA, 17 nt, Homo sapiens
guguacacgugacagag

SEQ ID NO: 1895176 - RNA, 17 nt, Homo sapiens
ucaagucuacccugauc

SEQ ID NO: 1895177 - RNA, 14 nt, Homo sapiens
gacaagcaacccaa

SEQ ID NO: 1895178 - RNA, 22 nt, Homo sapiens
ugguccgguuauucacuugagu

SEQ ID NO: 1895179 - RNA, 11 nt, Homo sapiens
uccacugccuc

SEQ ID NO: 1895180 - RNA, 11 nt, Homo sapiens
ucuacugccuu

SEQ ID NO: 1895181 - RNA, 11 nt, Homo sapiens
ucaacugccua

SEQ ID NO: 1895182 - RNA, 18 nt, Homo sapiens
aauugugugucacaagaa

SEQ ID NO: 1895183 - RNA, 14 nt, Homo sapiens
cauccuugcugcag

SEQ ID NO: 1895184 - RNA, 19 nt, Homo sapiens
acaggugcccgccaccaca

SEQ ID NO: 1895185 - RNA, 14 nt, Homo sapiens
cuuggaggaucccc

SEQ ID NO: 1895186 - RNA, 18 nt, Homo sapiens
ucuauguaugcaucuaua

SEQ ID NO: 1895187 - RNA, 20 nt, Homo sapiens
gcaguaccaaaguaacugaa

SEQ ID NO: 1895188 - RNA, 17 nt, Homo sapiens
cauugcgaccauuucuc

SEQ ID NO: 1895189 - RNA, 21 nt, Homo sapiens
gugauggagaugcagucacuu

SEQ ID NO: 1895190 - RNA, 15 nt, Homo sapiens
aucuucacauucuga

SEQ ID NO: 1895191 - RNA, 14 nt, Homo sapiens
uguggagugagaac

SEQ ID NO: 1895192 - RNA, 15 nt, Homo sapiens
gauccaggugccaag

SEQ ID NO: 1895193 - RNA, 18 nt, Homo sapiens
acuucuuaaaaugugcua

SEQ ID NO: 1895194 - RNA, 21 nt, Homo sapiens
gaguaaguguaagaaaaugau

SEQ ID NO: 1895195 - RNA, 23 nt, Homo sapiens
cugucucagagauauacuggccc

SEQ ID NO: 1895196 - RNA, 19 nt, Homo sapiens
auggcuuaagccuguguau

SEQ ID NO: 1895197 - RNA, 15 nt, Homo sapiens
cacggggaucacagc

SEQ ID NO: 1895198 - RNA, 15 nt, Homo sapiens
uuggaauauuccacu

SEQ ID NO: 1895199 - RNA, 20 nt, Homo sapiens
ugcucagagaaggaaaagac

SEQ ID NO: 1895200 - RNA, 21 nt, Homo sapiens
gauacauaaugggccacugaa

SEQ ID NO: 1895201 - RNA, 23 nt, Homo sapiens
cccuucucucaaucccuuugcaa

SEQ ID NO: 1895202 - RNA, 16 nt, Homo sapiens
aggcaggaccaugagg

SEQ ID NO: 1895203 - RNA, 16 nt, Homo sapiens
gaucacuggcaaugaa

SEQ ID NO: 1895204 - RNA, 18 nt, Homo sapiens
gcucugugggaggaugaa

SEQ ID NO: 1895205 - RNA, 22 nt, Homo sapiens
ugaaucuucagcauguucucau

SEQ ID NO: 1895206 - RNA, 13 nt, Homo sapiens
aaagaugguuuau

SEQ ID NO: 1895207 - RNA, 20 nt, Homo sapiens
ucgagcaucagagcuuccag

SEQ ID NO: 1895208 - RNA, 20 nt, Homo sapiens
aggcuauguaaacaaaccac

SEQ ID NO: 1895209 - RNA, 14 nt, Homo sapiens
gcccucgcugcuuc

SEQ ID NO: 1895210 - RNA, 11 nt, Homo sapiens
uugcccuguga

SEQ ID NO: 1895211 - RNA, 17 nt, Homo sapiens
aguccccuuuccucuaa

SEQ ID NO: 1895212 - RNA, 14 nt, Homo sapiens
caucuuaccucuca

SEQ ID NO: 1895213 - RNA, 23 nt, Homo sapiens
aacagauuauaauaaauugucau

SEQ ID NO: 1895214 - RNA, 18 nt, Homo sapiens
aucuuuauguagcacuac

SEQ ID NO: 1895215 - RNA, 22 nt, Homo sapiens
augaggaugucaccaacugaau

SEQ ID NO: 1895216 - RNA, 17 nt, Homo sapiens
gacggagccacuggggu

SEQ ID NO: 1895217 - RNA, 21 nt, Homo sapiens
uuaacauacacguuaacugca

SEQ ID NO: 1895218 - RNA, 21 nt, Homo sapiens
agauuauuucuguauuuggcu

SEQ ID NO: 1895219 - RNA, 21 nt, Homo sapiens
gccuuugucacuagucuuuga

SEQ ID NO: 1895220 - RNA, 13 nt, Homo sapiens
gaguucacuucau

SEQ ID NO: 1895221 - RNA, 15 nt, Homo sapiens
gcccauuuacacuuu

SEQ ID NO: 1895222 - RNA, 18 nt, Homo sapiens
guucaacaucacugaaac

SEQ ID NO: 1895223 - RNA, 15 nt, Homo sapiens
ccucgugucaucucc

SEQ ID NO: 1895224 - RNA, 20 nt, Homo sapiens
uuuccuggacuuaacucuaa

SEQ ID NO: 1895225 - RNA, 16 nt, Homo sapiens
uaguucuguguugacc

SEQ ID NO: 1895226 - RNA, 18 nt, Homo sapiens
gacgcgacuaucauucuc

SEQ ID NO: 1895227 - RNA, 14 nt, Homo sapiens
uugaaagaagaaug

SEQ ID NO: 1895228 - RNA, 18 nt, Homo sapiens
gaacaacuccaaaaccca

SEQ ID NO: 1895229 - RNA, 21 nt, Homo sapiens
gcaggucacugucacugccga

SEQ ID NO: 1895230 - RNA, 19 nt, Homo sapiens
caagucugagcccucaaaa

SEQ ID NO: 1895231 - RNA, 16 nt, Homo sapiens
agccuucguguggcuc

SEQ ID NO: 1895232 - RNA, 21 nt, Homo sapiens
uuuaggugaauuaauuaaaca

SEQ ID NO: 1895233 - RNA, 16 nt, Homo sapiens
agcuggggcuuauggg

SEQ ID NO: 1895234 - RNA, 16 nt, Homo sapiens
auuugaguugugauug

SEQ ID NO: 1895235 - RNA, 13 nt, Homo sapiens
agcugcucaggga

SEQ ID NO: 1895236 - RNA, 14 nt, Homo sapiens
uguaauauacaguu

SEQ ID NO: 1895237 - RNA, 15 nt, Homo sapiens
ucaaagaggugaaca

SEQ ID NO: 1895238 - RNA, 21 nt, Homo sapiens
uggaacacuccucuacucuua

SEQ ID NO: 1895239 - RNA, 16 nt, Homo sapiens
uaugacaagcuuucca

SEQ ID NO: 1895240 - RNA, 21 nt, Homo sapiens
uuauuuaaaaugcauaauuca

SEQ ID NO: 1895241 - RNA, 13 nt, Homo sapiens
guauucacaguug

SEQ ID NO: 1895242 - RNA, 15 nt, Homo sapiens
caagagaccacuucc

SEQ ID NO: 1895243 - RNA, 21 nt, Homo sapiens
agagauagccgggcuccaggg

SEQ ID NO: 1895244 - RNA, 12 nt, Homo sapiens
gaaggccaagag

SEQ ID NO: 1895245 - RNA, 22 nt, Homo sapiens
uggaaccuaaauugaacugcca

SEQ ID NO: 1895246 - RNA, 21 nt, Homo sapiens
cagugaaauaauuacagaaua

SEQ ID NO: 1895247 - RNA, 17 nt, Homo sapiens
aaugaaaugccaaagga

SEQ ID NO: 1895248 - RNA, 18 nt, Homo sapiens
acauaggaaaaugccaug

SEQ ID NO: 1895249 - RNA, 14 nt, Homo sapiens
augauuuuauuuga

SEQ ID NO: 1895250 - RNA, 13 nt, Homo sapiens
caucaucacugua

SEQ ID NO: 1895251 - RNA, 16 nt, Homo sapiens
agcauuguagugcuuu

SEQ ID NO: 1895252 - RNA, 19 nt, Homo sapiens
acagcaugaaccuuuagaa

SEQ ID NO: 1895253 - RNA, 15 nt, Homo sapiens
uaaaguuaaguuugu

SEQ ID NO: 1895254 - RNA, 15 nt, Homo sapiens
ccuuccugucuggcc

SEQ ID NO: 1895255 - RNA, 21 nt, Homo sapiens
gaugaucuaggaagacuuugg

SEQ ID NO: 1895256 - RNA, 17 nt, Homo sapiens
uucagauacaaacugca

SEQ ID NO: 1895257 - RNA, 22 nt, Homo sapiens
gcacaggcagauguuugccuca

SEQ ID NO: 1895258 - RNA, 16 nt, Homo sapiens
ggcugauagcucugcc

SEQ ID NO: 1895259 - RNA, 14 nt, Homo sapiens
acagccuggcacag

SEQ ID NO: 1895260 - RNA, 15 nt, Homo sapiens
accucuaaaaaccaa

SEQ ID NO: 1895261 - RNA, 19 nt, Homo sapiens
uuuacccagacucaaggag

SEQ ID NO: 1895262 - RNA, 21 nt, Homo sapiens
cagucauggaaucuugcugca

SEQ ID NO: 1895263 - RNA, 17 nt, Homo sapiens
aucuggauucugccuaa

SEQ ID NO: 1895264 - RNA, 22 nt, Homo sapiens
ucucuuuuuggaggugcuuaag

SEQ ID NO: 1895265 - RNA, 20 nt, Homo sapiens
cuccguucccaccucugagg

SEQ ID NO: 1895266 - RNA, 15 nt, Homo sapiens
gcuuuagagugcaag

SEQ ID NO: 1895267 - RNA, 16 nt, Homo sapiens
ccaggauggcacuguu

SEQ ID NO: 1895268 - RNA, 18 nt, Homo sapiens
agauauaaaauaggcuua

SEQ ID NO: 1895269 - RNA, 16 nt, Homo sapiens
uacaaaccuaccaaaa

SEQ ID NO: 1895270 - RNA, 12 nt, Homo sapiens
cauagcacacau

SEQ ID NO: 1895271 - RNA, 14 nt, Homo sapiens
ggauuaaugaucau

SEQ ID NO: 1895272 - RNA, 11 nt, Homo sapiens
gacacauauca

SEQ ID NO: 1895273 - RNA, 18 nt, Homo sapiens
cucuggagugaggggaau

SEQ ID NO: 1895274 - RNA, 17 nt, Homo sapiens
ugaggaaacugcacugu

SEQ ID NO: 1895275 - RNA, 20 nt, Homo sapiens
ggccucccaaaugagccaug

SEQ ID NO: 1895276 - RNA, 12 nt, Homo sapiens
uuacagucauuu

SEQ ID NO: 1895277 - RNA, 13 nt, Homo sapiens
gaagaugccuuga

SEQ ID NO: 1895278 - RNA, 15 nt, Homo sapiens
gagucacugccaagu

SEQ ID NO: 1895279 - RNA, 12 nt, Homo sapiens
gauccugcacuc

SEQ ID NO: 1895280 - RNA, 16 nt, Homo sapiens
aagaccacugaaugaa

SEQ ID NO: 1895281 - RNA, 15 nt, Homo sapiens
aguuuucugugagaa

SEQ ID NO: 1895282 - RNA, 13 nt, Homo sapiens
ccacuuugacucc

SEQ ID NO: 1895283 - RNA, 19 nt, Homo sapiens
cacagugucuguguacaug

SEQ ID NO: 1895284 - RNA, 13 nt, Homo sapiens
auuuaaaaaucuu

SEQ ID NO: 1895285 - RNA, 14 nt, Homo sapiens
gguggucuuggaga

SEQ ID NO: 1895286 - RNA, 21 nt, Homo sapiens
ugccuguguacugccuuaaau

SEQ ID NO: 1895287 - RNA, 13 nt, Homo sapiens
cuuaauaaagguu

SEQ ID NO: 1895288 - RNA, 14 nt, Homo sapiens
caucuccagccucc

SEQ ID NO: 1895289 - RNA, 22 nt, Homo sapiens
agaaggguuuuccacccuggaa

SEQ ID NO: 1895290 - RNA, 17 nt, Homo sapiens
agcugugucuuuagaca

SEQ ID NO: 1895291 - RNA, 21 nt, Homo sapiens
agguccuuaggccucugagaa

SEQ ID NO: 1895292 - RNA, 21 nt, Homo sapiens
cucuuuccucuggggcauuau

SEQ ID NO: 1895293 - RNA, 17 nt, Homo sapiens
ucacgcucagcacacau

SEQ ID NO: 1895294 - RNA, 18 nt, Homo sapiens
ggguuucaccauguuggc

SEQ ID NO: 1895295 - RNA, 13 nt, Homo sapiens
ugccguggagcuu

SEQ ID NO: 1895296 - RNA, 21 nt, Homo sapiens
auaguuacaaaauacaaaagu

SEQ ID NO: 1895297 - RNA, 20 nt, Homo sapiens
ggaggcuccucccucugccu

SEQ ID NO: 1895298 - RNA, 21 nt, Homo sapiens
aauuuauauuuuuaaagcaag

SEQ ID NO: 1895299 - RNA, 14 nt, Homo sapiens
accugggaccucac

SEQ ID NO: 1895300 - RNA, 13 nt, Homo sapiens
caguggauguaua

SEQ ID NO: 1895301 - RNA, 14 nt, Homo sapiens
caaaucucuuccac

SEQ ID NO: 1895302 - RNA, 22 nt, Homo sapiens
aagcccagccuaucucucuucu

SEQ ID NO: 1895303 - RNA, 17 nt, Homo sapiens
acaguucuuggugacug

SEQ ID NO: 1895304 - RNA, 15 nt, Homo sapiens
uuauacagaacucac

SEQ ID NO: 1895305 - RNA, 12 nt, Homo sapiens
aagacucagggg

SEQ ID NO: 1895306 - RNA, 21 nt, Homo sapiens
ccuccuagcucucccagugaa

SEQ ID NO: 1895307 - RNA, 19 nt, Homo sapiens
auuuuauuuuuaucccauc

SEQ ID NO: 1895308 - RNA, 16 nt, Homo sapiens
augccacccugcaaua

SEQ ID NO: 1895309 - RNA, 15 nt, Homo sapiens
gaauaguaaguggug

SEQ ID NO: 1895310 - RNA, 15 nt, Homo sapiens
gcugaggggcaggga

SEQ ID NO: 1895311 - RNA, 11 nt, Homo sapiens
ucacacuggug

SEQ ID NO: 1895312 - RNA, 21 nt, Homo sapiens
gcuuaaacuugacccaggugg

SEQ ID NO: 1895313 - RNA, 17 nt, Homo sapiens
agccacaagcugcacug

SEQ ID NO: 1895314 - RNA, 22 nt, Homo sapiens
uuuaaagccagaagucacauuu

SEQ ID NO: 1895315 - RNA, 21 nt, Homo sapiens
aagcagucaauuuucacauca

SEQ ID NO: 1895316 - RNA, 22 nt, Homo sapiens
auaaauauuguguugugcagca

SEQ ID NO: 1895317 - RNA, 11 nt, Homo sapiens
gcaugugccau

SEQ ID NO: 1895318 - RNA, 20 nt, Homo sapiens
ucuuauugaaaugcagauug

SEQ ID NO: 1895319 - RNA, 11 nt, Homo sapiens
gcaacuggaaa

SEQ ID NO: 1895320 - RNA, 20 nt, Homo sapiens
agaaaaccuaagcaaacuua

SEQ ID NO: 1895321 - RNA, 14 nt, Homo sapiens
ucgccguggcugcg

SEQ ID NO: 1895322 - RNA, 12 nt, Homo sapiens
uaagaauuucaa

SEQ ID NO: 1895323 - RNA, 19 nt, Homo sapiens
cccacuuuuuguuguucau

SEQ ID NO: 1895324 - RNA, 21 nt, Homo sapiens
gcaaaguaccaacugagccaa

SEQ ID NO: 1895325 - RNA, 14 nt, Homo sapiens
aucagugugauaag

SEQ ID NO: 1895326 - RNA, 15 nt, Homo sapiens
aguugagccagcaga

SEQ ID NO: 1895327 - RNA, 16 nt, Homo sapiens
uccuccccacacucca

SEQ ID NO: 1895328 - RNA, 20 nt, Homo sapiens
uuagaauaaaaaaauuuccc

SEQ ID NO: 1895329 - RNA, 23 nt, Homo sapiens
guuauugguguaagguacuuuca

SEQ ID NO: 1895330 - RNA, 20 nt, Homo sapiens
ccagcugcuuuuugugauuu

SEQ ID NO: 1895331 - RNA, 20 nt, Homo sapiens
auuuaccacaggaugcauau

SEQ ID NO: 1895332 - RNA, 15 nt, Homo sapiens
ggccaacugcaaaaa

SEQ ID NO: 1895333 - RNA, 18 nt, Homo sapiens
cugcuggaaacacaguca

SEQ ID NO: 1895334 - RNA, 19 nt, Homo sapiens
gacaaaugggccugccaaa

SEQ ID NO: 1895335 - RNA, 16 nt, Homo sapiens
auuaagguuaugcacu

SEQ ID NO: 1895336 - RNA, 22 nt, Homo sapiens
gguuccagggucccucugugua

SEQ ID NO: 1895337 - RNA, 13 nt, Homo sapiens
ugaggagcccuua

SEQ ID NO: 1895338 - RNA, 19 nt, Homo sapiens
uuugacuaugccgucuucu

SEQ ID NO: 1895339 - RNA, 16 nt, Homo sapiens
caucacacaacucagc

SEQ ID NO: 1895340 - RNA, 13 nt, Homo sapiens
auguaacaugaag

SEQ ID NO: 1895341 - RNA, 23 nt, Homo sapiens
agaggaguccuuuuugucaugcc

SEQ ID NO: 1895342 - RNA, 21 nt, Homo sapiens
uaggccagaguugcaaagauc

SEQ ID NO: 1895343 - RNA, 16 nt, Homo sapiens
agggggaagaagcaga

SEQ ID NO: 1895344 - RNA, 15 nt, Homo sapiens
cccauaucuugccuu

SEQ ID NO: 1895345 - RNA, 16 nt, Homo sapiens
auaccagugaaccaaa

SEQ ID NO: 1895346 - RNA, 12 nt, Homo sapiens
cuuagugaaugg

SEQ ID NO: 1895347 - RNA, 11 nt, Homo sapiens
gaugcacucuc

SEQ ID NO: 1895348 - RNA, 15 nt, Homo sapiens
uauuuucagugauaa

SEQ ID NO: 1895349 - RNA, 23 nt, Homo sapiens
agaugaagaccaggacuacagcu

SEQ ID NO: 1895350 - RNA, 16 nt, Homo sapiens
caguguguacuucuuc

SEQ ID NO: 1895351 - RNA, 16 nt, Homo sapiens
gagaugagcccacaga

SEQ ID NO: 1895352 - RNA, 16 nt, Homo sapiens
ccaucucuuuaccucc

SEQ ID NO: 1895353 - RNA, 15 nt, Homo sapiens
cauucccaucuguca

SEQ ID NO: 1895354 - RNA, 21 nt, Homo sapiens
ucaccugcacagggcccucug

SEQ ID NO: 1895355 - RNA, 15 nt, Homo sapiens
gcucacauccagccu

SEQ ID NO: 1895356 - RNA, 18 nt, Homo sapiens
acucucaucaccccagag

SEQ ID NO: 1895357 - RNA, 16 nt, Homo sapiens
cagugcuccauccaaa

SEQ ID NO: 1895358 - RNA, 17 nt, Homo sapiens
uaaagcuacaaucuguu

SEQ ID NO: 1895359 - RNA, 21 nt, Homo sapiens
gaggggccggcccugugugca

SEQ ID NO: 1895360 - RNA, 22 nt, Homo sapiens
acuuaagcugggauaaucacau

SEQ ID NO: 1895361 - RNA, 14 nt, Homo sapiens
cccagagcacuuua

SEQ ID NO: 1895362 - RNA, 19 nt, Homo sapiens
gcguggaccccgacaaagg

SEQ ID NO: 1895363 - RNA, 18 nt, Homo sapiens
caucugucuguccuaccc

SEQ ID NO: 1895364 - RNA, 19 nt, Homo sapiens
gugcagaugguacugcuga

SEQ ID NO: 1895365 - RNA, 14 nt, Homo sapiens
uauauuccucugcu

SEQ ID NO: 1895366 - RNA, 15 nt, Homo sapiens
uaggauauuggcauu

SEQ ID NO: 1895367 - RNA, 14 nt, Homo sapiens
aacuuuucccucac

SEQ ID NO: 1895368 - RNA, 19 nt, Homo sapiens
ucacuucuaauaaacagac

SEQ ID NO: 1895369 - RNA, 21 nt, Homo sapiens
caagcuggucccacucagucc

SEQ ID NO: 1895370 - RNA, 20 nt, Homo sapiens
cguggggaacugcguggugc

SEQ ID NO: 1895371 - RNA, 20 nt, Homo sapiens
uaaauaacaaaacugugcca

SEQ ID NO: 1895372 - RNA, 15 nt, Homo sapiens
gcagagaugacuguc

SEQ ID NO: 1895373 - RNA, 15 nt, Homo sapiens
ugccgccagcugccg

SEQ ID NO: 1895374 - RNA, 15 nt, Homo sapiens
gcaucugugccagag

SEQ ID NO: 1895375 - RNA, 13 nt, Homo sapiens
uguacuccucuga

SEQ ID NO: 1895376 - RNA, 13 nt, Homo sapiens
ucugccacccagg

SEQ ID NO: 1895377 - RNA, 18 nt, Homo sapiens
ucaguggugucugugaag

SEQ ID NO: 1895378 - RNA, 13 nt, Homo sapiens
uauuuuacuugaa

SEQ ID NO: 1895379 - RNA, 20 nt, Homo sapiens
aaugaauauucaacagcuca

SEQ ID NO: 1895380 - RNA, 17 nt, Homo sapiens
acaccaucuggagucuu

SEQ ID NO: 1895381 - RNA, 15 nt, Homo sapiens
cucacagaugggcaa

SEQ ID NO: 1895382 - RNA, 22 nt, Homo sapiens
cuaaguaaaaccacagcaguug

SEQ ID NO: 1895383 - RNA, 17 nt, Homo sapiens
agcuuugaaaaaacacc

SEQ ID NO: 1895384 - RNA, 19 nt, Homo sapiens
aaucauagccaaaaacuuu

SEQ ID NO: 1895385 - RNA, 20 nt, Homo sapiens
acacccuaaagcaggcugau

SEQ ID NO: 1895386 - RNA, 21 nt, Homo sapiens
ugaagcacagugaucaaguua

SEQ ID NO: 1895387 - RNA, 19 nt, Homo sapiens
aauggaggggcagagccag

SEQ ID NO: 1895388 - RNA, 20 nt, Homo sapiens
ugaaacauguggaguguauu

SEQ ID NO: 1895389 - RNA, 16 nt, Homo sapiens
ugccacuucuaagaaa

SEQ ID NO: 1895390 - RNA, 22 nt, Homo sapiens
caaugcaguacaggacauauau

SEQ ID NO: 1895391 - RNA, 14 nt, Homo sapiens
cccucccauagcac

SEQ ID NO: 1895392 - RNA, 14 nt, Homo sapiens
ccaaggcaggcaua

SEQ ID NO: 1895393 - RNA, 17 nt, Homo sapiens
aauaauauuaauaagaa

SEQ ID NO: 1895394 - RNA, 19 nt, Homo sapiens
ggcaagucucacauauuca

SEQ ID NO: 1895395 - RNA, 18 nt, Homo sapiens
uauauaugugcaguauuu

SEQ ID NO: 1895396 - RNA, 20 nt, Homo sapiens
ugagcaaagggaacagugag

SEQ ID NO: 1895397 - RNA, 22 nt, Homo sapiens
cccaagccugauacuuuagcca

SEQ ID NO: 1895398 - RNA, 15 nt, Homo sapiens
gaggacuguccuccc

SEQ ID NO: 1895399 - RNA, 18 nt, Homo sapiens
caggggaggugauagcau

SEQ ID NO: 1895400 - RNA, 15 nt, Homo sapiens
cuguacagugucuuu

SEQ ID NO: 1895401 - RNA, 21 nt, Homo sapiens
gauggcagauucccacugccg

SEQ ID NO: 1895402 - RNA, 14 nt, Homo sapiens
cccugcuccagucc

SEQ ID NO: 1895403 - RNA, 14 nt, Homo sapiens
acgagaucaacaca

SEQ ID NO: 1895404 - RNA, 11 nt, Homo sapiens
uugcaggugag

SEQ ID NO: 1895405 - RNA, 14 nt, Homo sapiens
cguggcaacugugg

SEQ ID NO: 1895406 - RNA, 16 nt, Homo sapiens
uagccaaagcuguuag

SEQ ID NO: 1895407 - RNA, 13 nt, Homo sapiens
cuccacuuggcau

SEQ ID NO: 1895408 - RNA, 23 nt, Homo sapiens
ccaaaauggucucuaacauuucc

SEQ ID NO: 1895409 - RNA, 17 nt, Homo sapiens
gggcccugccugcugca

SEQ ID NO: 1895410 - RNA, 15 nt, Homo sapiens
aggccgcuguggccu

SEQ ID NO: 1895411 - RNA, 20 nt, Homo sapiens
caauauuuucugcaauccaa

SEQ ID NO: 1895412 - RNA, 14 nt, Homo sapiens
acuacuuagcacug

SEQ ID NO: 1895413 - RNA, 15 nt, Homo sapiens
auaauguuuauucaa

SEQ ID NO: 1895414 - RNA, 18 nt, Homo sapiens
acuguauauuuguaugau

SEQ ID NO: 1895415 - RNA, 18 nt, Homo sapiens
gaguagccccaacccaaa

SEQ ID NO: 1895416 - RNA, 19 nt, Homo sapiens
ugaaauuacggguaccuga

SEQ ID NO: 1895417 - RNA, 23 nt, Homo sapiens
aacauuugccaagugaguugaau

SEQ ID NO: 1895418 - RNA, 17 nt, Homo sapiens
ccuucccaguagcucuu

SEQ ID NO: 1895419 - RNA, 20 nt, Homo sapiens
cgugugugugugugcacauc

SEQ ID NO: 1895420 - RNA, 18 nt, Homo sapiens
uacuuuguaaauaggauu

SEQ ID NO: 1895421 - RNA, 14 nt, Homo sapiens
uagcuauggaauca

SEQ ID NO: 1895422 - RNA, 15 nt, Homo sapiens
uucucuucauccauu

SEQ ID NO: 1895423 - RNA, 15 nt, Homo sapiens
cugugaauacuugaa

SEQ ID NO: 1895424 - RNA, 15 nt, Homo sapiens
ugugacucuuuccaa

SEQ ID NO: 1895425 - RNA, 22 nt, Homo sapiens
cucuucuuuuggcuuccaugau

SEQ ID NO: 1895426 - RNA, 13 nt, Homo sapiens
cauguguaccuca

SEQ ID NO: 1895427 - RNA, 13 nt, Homo sapiens
uauguguaucuca

SEQ ID NO: 1895428 - RNA, 11 nt, Homo sapiens
auuaaggggau

SEQ ID NO: 1895429 - RNA, 14 nt, Homo sapiens
cugugauccuagca

SEQ ID NO: 1895430 - RNA, 15 nt, Homo sapiens
aguucugaacuggaa

SEQ ID NO: 1895431 - RNA, 13 nt, Homo sapiens
agagcaauuguaa

SEQ ID NO: 1895432 - RNA, 15 nt, Homo sapiens
ugcacuguagccuua

SEQ ID NO: 1895433 - RNA, 22 nt, Homo sapiens
cacauagcgccgugcuguaaau

SEQ ID NO: 1895434 - RNA, 19 nt, Homo sapiens
cgguuuuccucagcucuag

SEQ ID NO: 1895435 - RNA, 13 nt, Homo sapiens
uugauucuugauu

SEQ ID NO: 1895436 - RNA, 20 nt, Homo sapiens
cauucuuuuccacuuguuaa

SEQ ID NO: 1895437 - RNA, 15 nt, Homo sapiens
caacacuauauaaau

SEQ ID NO: 1895438 - RNA, 17 nt, Homo sapiens
uuuaauuugguuuucac

SEQ ID NO: 1895439 - RNA, 19 nt, Homo sapiens
acgaagaguucccuugaaa

SEQ ID NO: 1895440 - RNA, 16 nt, Homo sapiens
auggaugaauucugac

SEQ ID NO: 1895441 - RNA, 16 nt, Homo sapiens
agucaggcaggguuaa

SEQ ID NO: 1895442 - RNA, 20 nt, Homo sapiens
auuguaaacauuaguucuau

SEQ ID NO: 1895443 - RNA, 18 nt, Homo sapiens
aggccugaacccguccau

SEQ ID NO: 1895444 - RNA, 18 nt, Homo sapiens
uagcugcaggacauguau

SEQ ID NO: 1895445 - RNA, 23 nt, Homo sapiens
gaggcagcgcuggucgucaccug

SEQ ID NO: 1895446 - RNA, 21 nt, Homo sapiens
agagagucuuccagguacuga

SEQ ID NO: 1895447 - RNA, 19 nt, Homo sapiens
aagugcgccuugcaaaaaa

SEQ ID NO: 1895448 - RNA, 22 nt, Homo sapiens
gauauaagauuuguacauauua

SEQ ID NO: 1895449 - RNA, 18 nt, Homo sapiens
gaacaucccugccagcuc

SEQ ID NO: 1895450 - RNA, 21 nt, Homo sapiens
agguuaauaaagaugauugaa

SEQ ID NO: 1895451 - RNA, 19 nt, Homo sapiens
augagugugauccacauug

SEQ ID NO: 1895452 - RNA, 16 nt, Homo sapiens
ggagauagguacuguu

SEQ ID NO: 1895453 - RNA, 12 nt, Homo sapiens
caagaaugccag

SEQ ID NO: 1895454 - RNA, 12 nt, Homo sapiens
aaaaaaugacaa

SEQ ID NO: 1895455 - RNA, 18 nt, Homo sapiens
cguggccccgugaacuca

SEQ ID NO: 1895456 - RNA, 20 nt, Homo sapiens
ggcugugggcucccuuccuc

SEQ ID NO: 1895457 - RNA, 23 nt, Homo sapiens
uucucaaauaaaguucaaagcaa

SEQ ID NO: 1895458 - RNA, 17 nt, Homo sapiens
ucauugcugagccucug

SEQ ID NO: 1895459 - RNA, 24 nt, Homo sapiens
aaugucagcaggaccccaucgcca

SEQ ID NO: 1895460 - RNA, 22 nt, Homo sapiens
ccagagucuaggcuaagcacuu

SEQ ID NO: 1895461 - RNA, 23 nt, Homo sapiens
ggaguccagccuaaucaagucaa

SEQ ID NO: 1895462 - RNA, 13 nt, Homo sapiens
caccuugggauga

SEQ ID NO: 1895463 - RNA, 19 nt, Homo sapiens
gagaaacaggcccagagag

SEQ ID NO: 1895464 - RNA, 19 nt, Homo sapiens
cacaccuguccuucucagg

SEQ ID NO: 1895465 - RNA, 21 nt, Homo sapiens
uagcuguuucaaaugugcauu

SEQ ID NO: 1895466 - RNA, 19 nt, Homo sapiens
caucauuauuuauguauug

SEQ ID NO: 1895467 - RNA, 23 nt, Homo sapiens
aaauauuuaugaccucaacaaag

SEQ ID NO: 1895468 - RNA, 16 nt, Homo sapiens
cgcuggcuggugggcc

SEQ ID NO: 1895469 - RNA, 14 nt, Homo sapiens
auguuucucaugua

SEQ ID NO: 1895470 - RNA, 13 nt, Homo sapiens
aucaagcaaaaug

SEQ ID NO: 1895471 - RNA, 15 nt, Homo sapiens
ugagaggugacacug

SEQ ID NO: 1895472 - RNA, 20 nt, Homo sapiens
acagacagcuuacaggagcc

SEQ ID NO: 1895473 - RNA, 18 nt, Homo sapiens
gcccaucuccgucuccca

SEQ ID NO: 1895474 - RNA, 13 nt, Homo sapiens
cucucugcagcug

SEQ ID NO: 1895475 - RNA, 18 nt, Homo sapiens
agggcaucggcagcugaa

SEQ ID NO: 1895476 - RNA, 17 nt, Homo sapiens
uacugaugguuacauau

SEQ ID NO: 1895477 - RNA, 16 nt, Homo sapiens
aacacauacaaaagaa

SEQ ID NO: 1895478 - RNA, 21 nt, Homo sapiens
ggcaucaggagcugcucaggc

SEQ ID NO: 1895479 - RNA, 14 nt, Homo sapiens
uugaccaaugaaau

SEQ ID NO: 1895480 - RNA, 19 nt, Homo sapiens
agccgggaaagaagagccg

SEQ ID NO: 1895481 - RNA, 15 nt, Homo sapiens
guuaauguacuuuca

SEQ ID NO: 1895482 - RNA, 17 nt, Homo sapiens
cacuguggaacugccac

SEQ ID NO: 1895483 - RNA, 16 nt, Homo sapiens
auuucugauacugcug

SEQ ID NO: 1895484 - RNA, 17 nt, Homo sapiens
uuauuugcuaagcauau

SEQ ID NO: 1895485 - RNA, 19 nt, Homo sapiens
ugagcauagguagcuuguc

SEQ ID NO: 1895486 - RNA, 22 nt, Homo sapiens
cugccuuaaauguaccuauggc

SEQ ID NO: 1895487 - RNA, 12 nt, Homo sapiens
gauuccauucca

SEQ ID NO: 1895488 - RNA, 20 nt, Homo sapiens
aaguaugcagauuauuugcc

SEQ ID NO: 1895489 - RNA, 21 nt, Homo sapiens
uaaaccaauuauaacuuauua

SEQ ID NO: 1895490 - RNA, 20 nt, Homo sapiens
ccugacaauuugugauaucu

SEQ ID NO: 1895491 - RNA, 13 nt, Homo sapiens
uuuuguguguaua

SEQ ID NO: 1895492 - RNA, 13 nt, Homo sapiens
uuuaguguguaaa

SEQ ID NO: 1895493 - RNA, 17 nt, Homo sapiens
uugaguuaaaucaguaa

SEQ ID NO: 1895494 - RNA, 20 nt, Homo sapiens
caguccucccagacuaccug

SEQ ID NO: 1895495 - RNA, 16 nt, Homo sapiens
caagagcucaagguca

SEQ ID NO: 1895496 - RNA, 15 nt, Homo sapiens
aaauacuuuuacucu

SEQ ID NO: 1895497 - RNA, 15 nt, Homo sapiens
uuuuaccuaaucucc

SEQ ID NO: 1895498 - RNA, 19 nt, Homo sapiens
aagaauuuguaucauguuu

SEQ ID NO: 1895499 - RNA, 14 nt, Homo sapiens
uuuucuaagcaauu

SEQ ID NO: 1895500 - RNA, 14 nt, Homo sapiens
accgguccagcugg

SEQ ID NO: 1895501 - RNA, 13 nt, Homo sapiens
cauggaaguacua

SEQ ID NO: 1895502 - RNA, 20 nt, Homo sapiens
accuugacuugaaaugcucu

SEQ ID NO: 1895503 - RNA, 14 nt, Homo sapiens
auguauuuuucaca

SEQ ID NO: 1895504 - RNA, 17 nt, Homo sapiens
aauacuguuuuaucucc

SEQ ID NO: 1895505 - RNA, 16 nt, Homo sapiens
cccauaaucucauuca

SEQ ID NO: 1895506 - RNA, 20 nt, Homo sapiens
acccccacccccagcucaau

SEQ ID NO: 1895507 - RNA, 23 nt, Homo sapiens
gacagaaaccaagccauuaauga

SEQ ID NO: 1895508 - RNA, 15 nt, Homo sapiens
cugacuucuguccac

SEQ ID NO: 1895509 - RNA, 21 nt, Homo sapiens
ggacagugcugaccccaggaa

SEQ ID NO: 1895510 - RNA, 18 nt, Homo sapiens
aaagcggggcuucaucug

SEQ ID NO: 1895511 - RNA, 16 nt, Homo sapiens
uguaaaaagugcagua

SEQ ID NO: 1895512 - RNA, 15 nt, Homo sapiens
caauugugcugccau

SEQ ID NO: 1895513 - RNA, 22 nt, Homo sapiens
gaccacaacuauuuucagaugu

SEQ ID NO: 1895514 - RNA, 23 nt, Homo sapiens
cuaguuauuuuauaaucaaugaa

SEQ ID NO: 1895515 - RNA, 16 nt, Homo sapiens
ucaaaacugagccauc

SEQ ID NO: 1895516 - RNA, 21 nt, Homo sapiens
uggagccccauccuguguuau

SEQ ID NO: 1895517 - RNA, 13 nt, Homo sapiens
auacagugccuug

SEQ ID NO: 1895518 - RNA, 14 nt, Homo sapiens
gcuugcacagccaa

SEQ ID NO: 1895519 - RNA, 17 nt, Homo sapiens
cccggagcuuugcaagc

SEQ ID NO: 1895520 - RNA, 22 nt, Homo sapiens
ggggauuugaagaagaguuucu

SEQ ID NO: 1895521 - RNA, 13 nt, Homo sapiens
aaccauccaucug

SEQ ID NO: 1895522 - RNA, 20 nt, Homo sapiens
agcaaucugccuguaucucu

SEQ ID NO: 1895523 - RNA, 19 nt, Homo sapiens
aauaguuuuaaauaugaac

SEQ ID NO: 1895524 - RNA, 19 nt, Homo sapiens
cuccauggcugccaucuca

SEQ ID NO: 1895525 - RNA, 12 nt, Homo sapiens
ccacauccucau

SEQ ID NO: 1895526 - RNA, 23 nt, Homo sapiens
gcauucaaggaugcacagcucaa

SEQ ID NO: 1895527 - RNA, 20 nt, Homo sapiens
cuaauuuguaggaaaaagca

SEQ ID NO: 1895528 - RNA, 23 nt, Homo sapiens
gugcuuuccagccuuuggugcuu

SEQ ID NO: 1895529 - RNA, 21 nt, Homo sapiens
aguucaaaaaacucuugauau

SEQ ID NO: 1895530 - RNA, 18 nt, Homo sapiens
agcugguccuccacuuug

SEQ ID NO: 1895531 - RNA, 16 nt, Homo sapiens
auucuccaucucaaga

SEQ ID NO: 1895532 - RNA, 20 nt, Homo sapiens
aagcugaagaaaaugaagcc

SEQ ID NO: 1895533 - RNA, 14 nt, Homo sapiens
cuguguacugugga

SEQ ID NO: 1895534 - RNA, 19 nt, Homo sapiens
gugguaggaaagccucacu

SEQ ID NO: 1895535 - RNA, 21 nt, Homo sapiens
acccuguaaguuacagucaca

SEQ ID NO: 1895536 - RNA, 14 nt, Homo sapiens
auucucugcucagu

SEQ ID NO: 1895537 - RNA, 15 nt, Homo sapiens
cugagugacggacca

SEQ ID NO: 1895538 - RNA, 23 nt, Homo sapiens
ugccguuuucuugcucaaaggga

SEQ ID NO: 1895539 - RNA, 21 nt, Homo sapiens
uuagugcuuugagauugugaa

SEQ ID NO: 1895540 - RNA, 14 nt, Homo sapiens
ucugagggcacucu

SEQ ID NO: 1895541 - RNA, 14 nt, Homo sapiens
caggggauccagcu

SEQ ID NO: 1895542 - RNA, 15 nt, Homo sapiens
ggagagcccucaguc

SEQ ID NO: 1895543 - RNA, 20 nt, Homo sapiens
uuagauuaggucacauuaca

SEQ ID NO: 1895544 - RNA, 20 nt, Homo sapiens
accaucucaggccaccugcc

SEQ ID NO: 1895545 - RNA, 14 nt, Homo sapiens
cuagucuauucauu

SEQ ID NO: 1895546 - RNA, 16 nt, Homo sapiens
aauauauuucuugcua

SEQ ID NO: 1895547 - RNA, 15 nt, Homo sapiens
uaugaggcuguuguc

SEQ ID NO: 1895548 - RNA, 16 nt, Homo sapiens
uuauauaaaauacaua

SEQ ID NO: 1895549 - RNA, 15 nt, Homo sapiens
acuggauuaguuaac

SEQ ID NO: 1895550 - RNA, 17 nt, Homo sapiens
ggucucgcagccugaag

SEQ ID NO: 1895551 - RNA, 18 nt, Homo sapiens
guacguaacuauuuccaa

SEQ ID NO: 1895552 - RNA, 17 nt, Homo sapiens
acuugcugcugucuugu

SEQ ID NO: 1895553 - RNA, 22 nt, Homo sapiens
aacugugcuucucuaugauaau

SEQ ID NO: 1895554 - RNA, 17 nt, Homo sapiens
cuucaaagccauaugga

SEQ ID NO: 1895555 - RNA, 16 nt, Homo sapiens
ucuuuggccagaacac

SEQ ID NO: 1895556 - RNA, 14 nt, Homo sapiens
acuguguggucuca

SEQ ID NO: 1895557 - RNA, 16 nt, Homo sapiens
cacacaucuuaccucu

SEQ ID NO: 1895558 - RNA, 11 nt, Homo sapiens
ugauugcuaag

SEQ ID NO: 1895559 - RNA, 12 nt, Homo sapiens
cgacccaagacc

SEQ ID NO: 1895560 - RNA, 16 nt, Homo sapiens
cagauuuucaugcaaa

SEQ ID NO: 1895561 - RNA, 15 nt, Homo sapiens
auguauccagaggaa

SEQ ID NO: 1895562 - RNA, 22 nt, Homo sapiens
cauucacugugcacuuugcuca

SEQ ID NO: 1895563 - RNA, 22 nt, Homo sapiens
acagauaugcacacacauggau

SEQ ID NO: 1895564 - RNA, 22 nt, Homo sapiens
guuuucuuuuucugucuuguag

SEQ ID NO: 1895565 - RNA, 14 nt, Homo sapiens
ugaggaagcuguug

SEQ ID NO: 1895566 - RNA, 13 nt, Homo sapiens
acgcucauuacua

SEQ ID NO: 1895567 - RNA, 18 nt, Homo sapiens
aacucaugucuuucucag

SEQ ID NO: 1895568 - RNA, 20 nt, Homo sapiens
caccucugugaccucaggca

SEQ ID NO: 1895569 - RNA, 13 nt, Homo sapiens
uuaaauaaucucu

SEQ ID NO: 1895570 - RNA, 14 nt, Homo sapiens
gcugagauuccugg

SEQ ID NO: 1895571 - RNA, 23 nt, Homo sapiens
aaauguaggcuuucauguugcaa

SEQ ID NO: 1895572 - RNA, 23 nt, Homo sapiens
agauaaaagaaccgagcaauuuu

SEQ ID NO: 1895573 - RNA, 19 nt, Homo sapiens
gauguaaauaaaauugagu

SEQ ID NO: 1895574 - RNA, 13 nt, Homo sapiens
caacagagcaaga

SEQ ID NO: 1895575 - RNA, 23 nt, Homo sapiens
uguauauugcucagagcuuuuau

SEQ ID NO: 1895576 - RNA, 22 nt, Homo sapiens
ugugaagccuuuaucuauggga

SEQ ID NO: 1895577 - RNA, 14 nt, Homo sapiens
uaccagcugagucu

SEQ ID NO: 1895578 - RNA, 12 nt, Homo sapiens
gaggagccucag

SEQ ID NO: 1895579 - RNA, 13 nt, Homo sapiens
cccaggaccagcu

SEQ ID NO: 1895580 - RNA, 16 nt, Homo sapiens
uauuuuaggcacuguu

SEQ ID NO: 1895581 - RNA, 19 nt, Homo sapiens
ccgcuggugacccucugcu

SEQ ID NO: 1895582 - RNA, 15 nt, Homo sapiens
uacucuuaucugggu

SEQ ID NO: 1895583 - RNA, 15 nt, Homo sapiens
augaaaugcuuccaa

SEQ ID NO: 1895584 - RNA, 18 nt, Homo sapiens
ugugugggacuguacaca

SEQ ID NO: 1895585 - RNA, 15 nt, Homo sapiens
uaaacacaauuccaa

SEQ ID NO: 1895586 - RNA, 21 nt, Homo sapiens
ugaaugucacauuugaauucu

SEQ ID NO: 1895587 - RNA, 15 nt, Homo sapiens
accauagagacccau

SEQ ID NO: 1895588 - RNA, 21 nt, Homo sapiens
uauucuuccuugagcuaagca

SEQ ID NO: 1895589 - RNA, 22 nt, Homo sapiens
guuuucuuaggcacugagggau

SEQ ID NO: 1895590 - RNA, 15 nt, Homo sapiens
uucauuacagcuuaa

SEQ ID NO: 1895591 - RNA, 18 nt, Homo sapiens
ccagccccggcaagccac

SEQ ID NO: 1895592 - RNA, 23 nt, Homo sapiens
cucuuaccagggagauuugcuca

SEQ ID NO: 1895593 - RNA, 20 nt, Homo sapiens
aggauacuggacgcuguccu

SEQ ID NO: 1895594 - RNA, 17 nt, Homo sapiens
guauccgacucuaagcu

SEQ ID NO: 1895595 - RNA, 14 nt, Homo sapiens
gcuucaaguggcag

SEQ ID NO: 1895596 - RNA, 13 nt, Homo sapiens
ugggaucaagucc

SEQ ID NO: 1895597 - RNA, 16 nt, Homo sapiens
aaguuuacccaugaag

SEQ ID NO: 1895598 - RNA, 14 nt, Homo sapiens
cggcagcuacucag

SEQ ID NO: 1895599 - RNA, 14 nt, Homo sapiens
caacaaaaagaaca

SEQ ID NO: 1895600 - RNA, 20 nt, Homo sapiens
aaugucauuagauccuuuau

SEQ ID NO: 1895601 - RNA, 15 nt, Homo sapiens
agcaagcugauuaaa

SEQ ID NO: 1895602 - RNA, 18 nt, Homo sapiens
auaggcggggcuugccuu

SEQ ID NO: 1895603 - RNA, 13 nt, Homo sapiens
uaguguauucucu

SEQ ID NO: 1895604 - RNA, 13 nt, Homo sapiens
uuuuguaagugcu

SEQ ID NO: 1895605 - RNA, 12 nt, Homo sapiens
ucucugcugcua

SEQ ID NO: 1895606 - RNA, 18 nt, Homo sapiens
guuuaaugaaugcuuaaa

SEQ ID NO: 1895607 - RNA, 16 nt, Homo sapiens
gaugauucaagccauu

SEQ ID NO: 1895608 - RNA, 10 nt, Homo sapiens
uucugaugaa

SEQ ID NO: 1895609 - RNA, 23 nt, Homo sapiens
aaacacaguuacacuugugcacc

SEQ ID NO: 1895610 - RNA, 15 nt, Homo sapiens
gcuuuuaccaggccu

SEQ ID NO: 1895611 - RNA, 12 nt, Homo sapiens
cucucaaagggg

SEQ ID NO: 1895612 - RNA, 23 nt, Homo sapiens
uucucuguuguuugguucaggga

SEQ ID NO: 1895613 - RNA, 14 nt, Homo sapiens
aggucaaaagucag

SEQ ID NO: 1895614 - RNA, 16 nt, Homo sapiens
ugcucuugagucuuug

SEQ ID NO: 1895615 - RNA, 17 nt, Homo sapiens
cuuuacccaccuagaac

SEQ ID NO: 1895616 - RNA, 14 nt, Homo sapiens
cucaucaggccauu

SEQ ID NO: 1895617 - RNA, 13 nt, Homo sapiens
acaaacucaccau

SEQ ID NO: 1895618 - RNA, 23 nt, Homo sapiens
caguuucuauugggaguuuauac

SEQ ID NO: 1895619 - RNA, 19 nt, Homo sapiens
ugcccugggccaaaaccaa

SEQ ID NO: 1895620 - RNA, 16 nt, Homo sapiens
agcuucuaucccagga

SEQ ID NO: 1895621 - RNA, 15 nt, Homo sapiens
cugagucugcagaug

SEQ ID NO: 1895622 - RNA, 13 nt, Homo sapiens
ucugggugcagua

SEQ ID NO: 1895623 - RNA, 16 nt, Homo sapiens
aacauauuuaaggaac

SEQ ID NO: 1895624 - RNA, 12 nt, Homo sapiens
gugaaccaaaga

SEQ ID NO: 1895625 - RNA, 12 nt, Homo sapiens
guaaaccaaaaa

SEQ ID NO: 1895626 - RNA, 21 nt, Homo sapiens
uacacaaauuauaagcauaca

SEQ ID NO: 1895627 - RNA, 18 nt, Homo sapiens
ccucagcugcucccacac

SEQ ID NO: 1895628 - RNA, 13 nt, Homo sapiens
uuucagugccugc

SEQ ID NO: 1895629 - RNA, 14 nt, Homo sapiens
uuaucagcuuucag

SEQ ID NO: 1895630 - RNA, 16 nt, Homo sapiens
uacuaaaaauacagaa

SEQ ID NO: 1895631 - RNA, 21 nt, Homo sapiens
uagcauguaaggccuuucaau

SEQ ID NO: 1895632 - RNA, 12 nt, Homo sapiens
auuuucugaugg

SEQ ID NO: 1895633 - RNA, 17 nt, Homo sapiens
cucgucuuccuuguuaa

SEQ ID NO: 1895634 - RNA, 15 nt, Homo sapiens
ggcuccuugggauga

SEQ ID NO: 1895635 - RNA, 13 nt, Homo sapiens
guaaacauaauuc

SEQ ID NO: 1895636 - RNA, 22 nt, Homo sapiens
uagaaacacacuuuugcacaua

SEQ ID NO: 1895637 - RNA, 15 nt, Homo sapiens
uaaaaugugcuucuc

SEQ ID NO: 1895638 - RNA, 21 nt, Homo sapiens
ugaggaauuucuguucuucca

SEQ ID NO: 1895639 - RNA, 20 nt, Homo sapiens
aauugccuucuagacacuga

SEQ ID NO: 1895640 - RNA, 18 nt, Homo sapiens
uguuagauauuuuucaua

SEQ ID NO: 1895641 - RNA, 18 nt, Homo sapiens
agucugcauuucauauua

SEQ ID NO: 1895642 - RNA, 16 nt, Homo sapiens
uaaaauaaaagccaac

SEQ ID NO: 1895643 - RNA, 19 nt, Homo sapiens
aauuauauuugaugcaaau

SEQ ID NO: 1895644 - RNA, 14 nt, Homo sapiens
uuagucaaaccacu

SEQ ID NO: 1895645 - RNA, 22 nt, Homo sapiens
aaucuguuugacagucugcuca

SEQ ID NO: 1895646 - RNA, 18 nt, Homo sapiens
uuuccauuuauuuauuca

SEQ ID NO: 1895647 - RNA, 22 nt, Homo sapiens
aaauuuuaaaagccacaggugu

SEQ ID NO: 1895648 - RNA, 21 nt, Homo sapiens
uggaaguguguguuucuugcu

SEQ ID NO: 1895649 - RNA, 18 nt, Homo sapiens
uccaauuaaugauucaau

SEQ ID NO: 1895650 - RNA, 19 nt, Homo sapiens
augacuucagaaauguuaa

SEQ ID NO: 1895651 - RNA, 20 nt, Homo sapiens
ugauuccuuuaugaugacug

SEQ ID NO: 1895652 - RNA, 17 nt, Homo sapiens
uucuaggggcaggugaa

SEQ ID NO: 1895653 - RNA, 18 nt, Homo sapiens
acucuguguggcugugca

SEQ ID NO: 1895654 - RNA, 15 nt, Homo sapiens
ccugccucagcaauu

SEQ ID NO: 1895655 - RNA, 19 nt, Homo sapiens
gaagccuucagcuccaggg

SEQ ID NO: 1895656 - RNA, 16 nt, Homo sapiens
gaugcagagcuuucaa

SEQ ID NO: 1895657 - RNA, 14 nt, Homo sapiens
agcaaacucuugca

SEQ ID NO: 1895658 - RNA, 22 nt, Homo sapiens
guuggaccuucaucagaccacu

SEQ ID NO: 1895659 - RNA, 20 nt, Homo sapiens
ugcucauacuuaucuaaugu

SEQ ID NO: 1895660 - RNA, 17 nt, Homo sapiens
uaauuuuugaaaacugg

SEQ ID NO: 1895661 - RNA, 10 nt, Homo sapiens
uuacauuguu

SEQ ID NO: 1895662 - RNA, 19 nt, Homo sapiens
ccuguguggucuccaugcu

SEQ ID NO: 1895663 - RNA, 22 nt, Homo sapiens
gacugcgacgcagguguaccuc

SEQ ID NO: 1895664 - RNA, 17 nt, Homo sapiens
cuucuuuaaaaaaacac

SEQ ID NO: 1895665 - RNA, 23 nt, Homo sapiens
agggaaucucuugccugcuccau

SEQ ID NO: 1895666 - RNA, 15 nt, Homo sapiens
uuaauuuugauauaa

SEQ ID NO: 1895667 - RNA, 21 nt, Homo sapiens
uacucaguaacacagugcagu

SEQ ID NO: 1895668 - RNA, 14 nt, Homo sapiens
aucaugaagugaua

SEQ ID NO: 1895669 - RNA, 21 nt, Homo sapiens
ccagcccugucaugugccuug

SEQ ID NO: 1895670 - RNA, 18 nt, Homo sapiens
cagaaauuuucuacagua

SEQ ID NO: 1895671 - RNA, 20 nt, Homo sapiens
gacuucaaaaacugucaaag

SEQ ID NO: 1895672 - RNA, 17 nt, Homo sapiens
cuuauuguggauaacaa

SEQ ID NO: 1895673 - RNA, 20 nt, Homo sapiens
ucacagcacccuauauacac

SEQ ID NO: 1895674 - RNA, 12 nt, Homo sapiens
caugcugcucaa

SEQ ID NO: 1895675 - RNA, 21 nt, Homo sapiens
accauguggcagaagggauaa

SEQ ID NO: 1895676 - RNA, 23 nt, Homo sapiens
ccacaaaucaguauauggcuuuu

SEQ ID NO: 1895677 - RNA, 23 nt, Homo sapiens
acagagggggccuucacagugac

SEQ ID NO: 1895678 - RNA, 16 nt, Homo sapiens
agcagcauucagcaca

SEQ ID NO: 1895679 - RNA, 21 nt, Homo sapiens
ucugaaauuuacccacaguga

SEQ ID NO: 1895680 - RNA, 23 nt, Homo sapiens
guugauuucagcaccuacagugu

SEQ ID NO: 1895681 - RNA, 18 nt, Homo sapiens
auuuaauuaaagccuuaa

SEQ ID NO: 1895682 - RNA, 17 nt, Homo sapiens
aucugaguugccaagac

SEQ ID NO: 1895683 - RNA, 13 nt, Homo sapiens
uggucuugaucuc

SEQ ID NO: 1895684 - RNA, 14 nt, Homo sapiens
gacuauucuaauga

SEQ ID NO: 1895685 - RNA, 18 nt, Homo sapiens
ugcauaauaagcuaaaga

SEQ ID NO: 1895686 - RNA, 17 nt, Homo sapiens
cuccauacuucuuucac

SEQ ID NO: 1895687 - RNA, 14 nt, Homo sapiens
uuaaggauagugug

SEQ ID NO: 1895688 - RNA, 21 nt, Homo sapiens
acaucuugaauacucugcccu

SEQ ID NO: 1895689 - RNA, 23 nt, Homo sapiens
caacauguuauucaaugugacac

SEQ ID NO: 1895690 - RNA, 16 nt, Homo sapiens
cuaaugucugcagcuc

SEQ ID NO: 1895691 - RNA, 23 nt, Homo sapiens
cuaguuguaauuuuuuuguggga

SEQ ID NO: 1895692 - RNA, 20 nt, Homo sapiens
guacaauuaaguaaagucaa

SEQ ID NO: 1895693 - RNA, 21 nt, Homo sapiens
gacuccuaggcaggacaugcu

SEQ ID NO: 1895694 - RNA, 18 nt, Homo sapiens
gccaguggggaagugcgu

SEQ ID NO: 1895695 - RNA, 21 nt, Homo sapiens
ucucaggggccagaggaacug

SEQ ID NO: 1895696 - RNA, 21 nt, Homo sapiens
aaugucaagguucccucccac

SEQ ID NO: 1895697 - RNA, 15 nt, Homo sapiens
acuggccucaaguga

SEQ ID NO: 1895698 - RNA, 14 nt, Homo sapiens
cgcggaagugacca

SEQ ID NO: 1895699 - RNA, 22 nt, Homo sapiens
uacaucuaucccagaguacaaa

SEQ ID NO: 1895700 - RNA, 14 nt, Homo sapiens
ucaaauuuuauuaa

SEQ ID NO: 1895701 - RNA, 20 nt, Homo sapiens
cucaggacggaaggucaguu

SEQ ID NO: 1895702 - RNA, 18 nt, Homo sapiens
uugaaugcuuaauucaau

SEQ ID NO: 1895703 - RNA, 23 nt, Homo sapiens
guccucagcuugggcuucuuccu

SEQ ID NO: 1895704 - RNA, 14 nt, Homo sapiens
uaguuuuacuuuua

SEQ ID NO: 1895705 - RNA, 22 nt, Homo sapiens
gucuuuuuccuacuccguuccu

SEQ ID NO: 1895706 - RNA, 18 nt, Homo sapiens
uuaaaguggacuuauuaa

SEQ ID NO: 1895707 - RNA, 22 nt, Homo sapiens
cagugggcccuggcucugucac

SEQ ID NO: 1895708 - RNA, 17 nt, Homo sapiens
acuccuauaugaugcag

SEQ ID NO: 1895709 - RNA, 15 nt, Homo sapiens
acucagaaagccaac

SEQ ID NO: 1895710 - RNA, 17 nt, Homo sapiens
guucuaauggcacuuau

SEQ ID NO: 1895711 - RNA, 21 nt, Homo sapiens
uauauugcuuaccugaucuca

SEQ ID NO: 1895712 - RNA, 14 nt, Homo sapiens
caggcugagugcau

SEQ ID NO: 1895713 - RNA, 14 nt, Homo sapiens
agacauccauguuu

SEQ ID NO: 1895714 - RNA, 16 nt, Homo sapiens
cacugucucugcugca

SEQ ID NO: 1895715 - RNA, 16 nt, Homo sapiens
ucauugcaagcucaag

SEQ ID NO: 1895716 - RNA, 18 nt, Homo sapiens
caggcugagugagccaca

SEQ ID NO: 1895717 - RNA, 23 nt, Homo sapiens
gaaaaguguccuucuugcucccc

SEQ ID NO: 1895718 - RNA, 18 nt, Homo sapiens
ucgggaaccucacucuug

SEQ ID NO: 1895719 - RNA, 17 nt, Homo sapiens
ucuuugagaacaaugga

SEQ ID NO: 1895720 - RNA, 21 nt, Homo sapiens
aacgauccuucaaagucucaa

SEQ ID NO: 1895721 - RNA, 19 nt, Homo sapiens
gccuucacgugucuguucc

SEQ ID NO: 1895722 - RNA, 20 nt, Homo sapiens
ugcagacucuacagaggcca

SEQ ID NO: 1895723 - RNA, 23 nt, Homo sapiens
ucagaaagauuugaugggccaca

SEQ ID NO: 1895724 - RNA, 16 nt, Homo sapiens
ugcucucucaucuugu

SEQ ID NO: 1895725 - RNA, 15 nt, Homo sapiens
ugauucacagugguc

SEQ ID NO: 1895726 - RNA, 16 nt, Homo sapiens
cccacuucuucagcuu

SEQ ID NO: 1895727 - RNA, 20 nt, Homo sapiens
ucaugagcauuuguuuaaua

SEQ ID NO: 1895728 - RNA, 22 nt, Homo sapiens
cuuguuucccagauuucaggaa

SEQ ID NO: 1895729 - RNA, 15 nt, Homo sapiens
auugagguuuccaca

SEQ ID NO: 1895730 - RNA, 19 nt, Homo sapiens
agguucuuucccacacuga

SEQ ID NO: 1895731 - RNA, 18 nt, Homo sapiens
cagaacauuucucaugug

SEQ ID NO: 1895732 - RNA, 20 nt, Homo sapiens
gagucuuguuuuuuacucaa

SEQ ID NO: 1895733 - RNA, 15 nt, Homo sapiens
uacacuacauuguac

SEQ ID NO: 1895734 - RNA, 19 nt, Homo sapiens
cauauaggugauguuugcu

SEQ ID NO: 1895735 - RNA, 14 nt, Homo sapiens
cacccaauguuuga

SEQ ID NO: 1895736 - RNA, 16 nt, Homo sapiens
gcagaauugcuugaac

SEQ ID NO: 1895737 - RNA, 16 nt, Homo sapiens
cuggagaaaaaacaca

SEQ ID NO: 1895738 - RNA, 17 nt, Homo sapiens
ccaggguacccgccuga

SEQ ID NO: 1895739 - RNA, 16 nt, Homo sapiens
ugauucagacagcugc

SEQ ID NO: 1895740 - RNA, 13 nt, Homo sapiens
gaaugaacacucc

SEQ ID NO: 1895741 - RNA, 20 nt, Homo sapiens
gaaaacuuaaggaagcaaau

SEQ ID NO: 1895742 - RNA, 19 nt, Homo sapiens
uggaaauaaaauacuucua

SEQ ID NO: 1895743 - RNA, 13 nt, Homo sapiens
gcuguugcugaau

SEQ ID NO: 1895744 - RNA, 19 nt, Homo sapiens
agccuguuuuaaaaaauac

SEQ ID NO: 1895745 - RNA, 15 nt, Homo sapiens
uaaaagaagcugcuc

SEQ ID NO: 1895746 - RNA, 22 nt, Homo sapiens
cuuuaauaguuuugauccuaaa

SEQ ID NO: 1895747 - RNA, 19 nt, Homo sapiens
cuauagcauagauugucaa

SEQ ID NO: 1895748 - RNA, 17 nt, Homo sapiens
aggugcugucagcucag

SEQ ID NO: 1895749 - RNA, 17 nt, Homo sapiens
ucauauaaucuuacaau

SEQ ID NO: 1895750 - RNA, 21 nt, Homo sapiens
gcccaggcaaagugcaccuca

SEQ ID NO: 1895751 - RNA, 14 nt, Homo sapiens
agcucccagaguuu

SEQ ID NO: 1895752 - RNA, 21 nt, Homo sapiens
acaagugguguuuauugcaau

SEQ ID NO: 1895753 - RNA, 18 nt, Homo sapiens
ugguggggagucugagaa

SEQ ID NO: 1895754 - RNA, 18 nt, Homo sapiens
auuacauagacugugaug

SEQ ID NO: 1895755 - RNA, 13 nt, Homo sapiens
cuuguaaaaccaa

SEQ ID NO: 1895756 - RNA, 13 nt, Homo sapiens
ucagaagcacaaa

SEQ ID NO: 1895757 - RNA, 18 nt, Homo sapiens
gcaagagggggaccugcc

SEQ ID NO: 1895758 - RNA, 19 nt, Homo sapiens
cagccugggggacagagca

SEQ ID NO: 1895759 - RNA, 21 nt, Homo sapiens
cuccaauggggccagcacugg

SEQ ID NO: 1895760 - RNA, 15 nt, Homo sapiens
cucccaaagcucaga

SEQ ID NO: 1895761 - RNA, 22 nt, Homo sapiens
uauguaaaauauuguuacuaga

SEQ ID NO: 1895762 - RNA, 21 nt, Homo sapiens
uucuauauauauauaaauaua

SEQ ID NO: 1895763 - RNA, 14 nt, Homo sapiens
guaguggcaaaaaa

SEQ ID NO: 1895764 - RNA, 16 nt, Homo sapiens
ucuguagcgucuguau

SEQ ID NO: 1895765 - RNA, 18 nt, Homo sapiens
cucauaagcuucuuguca

SEQ ID NO: 1895766 - RNA, 17 nt, Homo sapiens
cauuuuccuguuuacug

SEQ ID NO: 1895767 - RNA, 17 nt, Homo sapiens
ucagccaggccugucau

SEQ ID NO: 1895768 - RNA, 20 nt, Homo sapiens
uuguuuccauucuuguccug

SEQ ID NO: 1895769 - RNA, 19 nt, Homo sapiens
aaucaguaaacacugugua

SEQ ID NO: 1895770 - RNA, 23 nt, Homo sapiens
cuagaaucauacuuaacauuuca

SEQ ID NO: 1895771 - RNA, 16 nt, Homo sapiens
ggccacccugccucua

SEQ ID NO: 1895772 - RNA, 15 nt, Homo sapiens
uuuggcagauuuucu

SEQ ID NO: 1895773 - RNA, 13 nt, Homo sapiens
gaccucaucugcc

SEQ ID NO: 1895774 - RNA, 22 nt, Homo sapiens
uaggaaccucgaagcuguucuc

SEQ ID NO: 1895775 - RNA, 20 nt, Homo sapiens
gccaauaaagugaucugugu

SEQ ID NO: 1895776 - RNA, 14 nt, Homo sapiens
gaacuuugagcuac

SEQ ID NO: 1895777 - RNA, 23 nt, Homo sapiens
gagcacaagccacaagucuucca

SEQ ID NO: 1895778 - RNA, 18 nt, Homo sapiens
uugcauuaaaaaugcaua

SEQ ID NO: 1895779 - RNA, 19 nt, Homo sapiens
cuucaaugucaacagaucc

SEQ ID NO: 1895780 - RNA, 23 nt, Homo sapiens
agcaacgccccuccaaaccucca

SEQ ID NO: 1895781 - RNA, 19 nt, Homo sapiens
cuuuccuacuguccuggaa

SEQ ID NO: 1895782 - RNA, 16 nt, Homo sapiens
ccucuuccaccacaga

SEQ ID NO: 1895783 - RNA, 12 nt, Homo sapiens
ggugugcuguau

SEQ ID NO: 1895784 - RNA, 17 nt, Homo sapiens
gcugggaugaccagcau

SEQ ID NO: 1895785 - RNA, 18 nt, Homo sapiens
uagccaucucaagcaagu

SEQ ID NO: 1895786 - RNA, 14 nt, Homo sapiens
cggccacacuguac

SEQ ID NO: 1895787 - RNA, 22 nt, Homo sapiens
gcucaacucucuuauugccuca

SEQ ID NO: 1895788 - RNA, 15 nt, Homo sapiens
caaaugcaugaacaa

SEQ ID NO: 1895789 - RNA, 18 nt, Homo sapiens
uauauuuuuggugguggu

SEQ ID NO: 1895790 - RNA, 13 nt, Homo sapiens
ugacagcauauag

SEQ ID NO: 1895791 - RNA, 21 nt, Homo sapiens
augguaaagaaauacacaggg

SEQ ID NO: 1895792 - RNA, 23 nt, Homo sapiens
gcaaccuuuuugauuucuuccag

SEQ ID NO: 1895793 - RNA, 14 nt, Homo sapiens
uaaaugcuacugaa

SEQ ID NO: 1895794 - RNA, 17 nt, Homo sapiens
aaauagcacauccacca

SEQ ID NO: 1895795 - RNA, 17 nt, Homo sapiens
uccaagagaaaccagca

SEQ ID NO: 1895796 - RNA, 17 nt, Homo sapiens
ucuugaaaucugaaugc

SEQ ID NO: 1895797 - RNA, 21 nt, Homo sapiens
cuaucucaugccagugccuua

SEQ ID NO: 1895798 - RNA, 23 nt, Homo sapiens
uggugagacccugucucuacuaa

SEQ ID NO: 1895799 - RNA, 16 nt, Homo sapiens
uugaaagaaccagaga

SEQ ID NO: 1895800 - RNA, 17 nt, Homo sapiens
uugcgcauucucaugga

SEQ ID NO: 1895801 - RNA, 16 nt, Homo sapiens
cagcaaggugugaaug

SEQ ID NO: 1895802 - RNA, 11 nt, Homo sapiens
uaaaagcacuu

SEQ ID NO: 1895803 - RNA, 11 nt, Homo sapiens
uuaaagcacau

SEQ ID NO: 1895804 - RNA, 14 nt, Homo sapiens
gagagcccuuccca

SEQ ID NO: 1895805 - RNA, 23 nt, Homo sapiens
aggucguuugauuucaaagcaag

SEQ ID NO: 1895806 - RNA, 19 nt, Homo sapiens
aaaauauucauguagauca

SEQ ID NO: 1895807 - RNA, 22 nt, Homo sapiens
uuaccacuugugauucaaacaa

SEQ ID NO: 1895808 - RNA, 12 nt, Homo sapiens
uaaauguugcuu

SEQ ID NO: 1895809 - RNA, 14 nt, Homo sapiens
aagcccuaagugac

SEQ ID NO: 1895810 - RNA, 14 nt, Homo sapiens
gggacagagccaug

SEQ ID NO: 1895811 - RNA, 18 nt, Homo sapiens
agacaaaucaacagaagc

SEQ ID NO: 1895812 - RNA, 14 nt, Homo sapiens
agucccagcacuuu

SEQ ID NO: 1895813 - RNA, 17 nt, Homo sapiens
uuuuauaaauaugugaa

SEQ ID NO: 1895814 - RNA, 21 nt, Homo sapiens
cagaauccauaaauguguucc

SEQ ID NO: 1895815 - RNA, 19 nt, Homo sapiens
aaccuacuuuuuaugugcu

SEQ ID NO: 1895816 - RNA, 16 nt, Homo sapiens
ccuuacuccagagggc

SEQ ID NO: 1895817 - RNA, 19 nt, Homo sapiens
cugcaaaaauuaauacaca

SEQ ID NO: 1895818 - RNA, 22 nt, Homo sapiens
agcucccggggacgacgcugac

SEQ ID NO: 1895819 - RNA, 13 nt, Homo sapiens
gacccagccugag

SEQ ID NO: 1895820 - RNA, 14 nt, Homo sapiens
guaaaacauuuuua

SEQ ID NO: 1895821 - RNA, 16 nt, Homo sapiens
aggagucauguagccc

SEQ ID NO: 1895822 - RNA, 15 nt, Homo sapiens
ugccagcgcaugugu

SEQ ID NO: 1895823 - RNA, 17 nt, Homo sapiens
uggaaacaguuggcacu

SEQ ID NO: 1895824 - RNA, 22 nt, Homo sapiens
caaaaauggcagugacucccca

SEQ ID NO: 1895825 - RNA, 12 nt, Homo sapiens
auauauaugcac

SEQ ID NO: 1895826 - RNA, 15 nt, Homo sapiens
gaaaguucauggaac

SEQ ID NO: 1895827 - RNA, 18 nt, Homo sapiens
gaaauguucuguucaccc

SEQ ID NO: 1895828 - RNA, 23 nt, Homo sapiens
gaauaauaaugcccuuaauguga

SEQ ID NO: 1895829 - RNA, 20 nt, Homo sapiens
aaauugcuucuuuaccaagg

SEQ ID NO: 1895830 - RNA, 21 nt, Homo sapiens
guucuuaacuuugaaccauaa

SEQ ID NO: 1895831 - RNA, 18 nt, Homo sapiens
uacaccuugcuaaccuaa

SEQ ID NO: 1895832 - RNA, 15 nt, Homo sapiens
aggaaaacagcuagu

SEQ ID NO: 1895833 - RNA, 18 nt, Homo sapiens
aaggcccugcccugccca

SEQ ID NO: 1895834 - RNA, 15 nt, Homo sapiens
ggcaaccuguugaau

SEQ ID NO: 1895835 - RNA, 16 nt, Homo sapiens
aaaaaguaaaugugau

SEQ ID NO: 1895836 - RNA, 18 nt, Homo sapiens
acuccugggacacuccgu

SEQ ID NO: 1895837 - RNA, 14 nt, Homo sapiens
caucuccaugugac

SEQ ID NO: 1895838 - RNA, 17 nt, Homo sapiens
ggaaucuaccaacuguu

SEQ ID NO: 1895839 - RNA, 17 nt, Homo sapiens
ggauucuuccaucugau

SEQ ID NO: 1895840 - RNA, 15 nt, Homo sapiens
cugaacaaagcaccu

SEQ ID NO: 1895841 - RNA, 13 nt, Homo sapiens
ucccuuucuggga

SEQ ID NO: 1895842 - RNA, 15 nt, Homo sapiens
aaggcuccugagaca

SEQ ID NO: 1895843 - RNA, 18 nt, Homo sapiens
ugcugaugaaauggguuu

SEQ ID NO: 1895844 - RNA, 18 nt, Homo sapiens
cucucccacccaaggaga

SEQ ID NO: 1895845 - RNA, 17 nt, Homo sapiens
gauggucauucauauca

SEQ ID NO: 1895846 - RNA, 15 nt, Homo sapiens
aguggaucuccaagg

SEQ ID NO: 1895847 - RNA, 20 nt, Homo sapiens
uagcucacacucauccacac

SEQ ID NO: 1895848 - RNA, 16 nt, Homo sapiens
agaccaggugcucagc

SEQ ID NO: 1895849 - RNA, 15 nt, Homo sapiens
auaaacacagauuau

SEQ ID NO: 1895850 - RNA, 21 nt, Homo sapiens
uuucauaauaaauagacacuu

SEQ ID NO: 1895851 - RNA, 17 nt, Homo sapiens
ugucuagacugccaggg

SEQ ID NO: 1895852 - RNA, 20 nt, Homo sapiens
cuuuucacaugcuaaugugc

SEQ ID NO: 1895853 - RNA, 22 nt, Homo sapiens
acacauuucuuaaaacacauga

SEQ ID NO: 1895854 - RNA, 20 nt, Homo sapiens
ucccaaaugaaaaccccagu

SEQ ID NO: 1895855 - RNA, 23 nt, Homo sapiens
gcagcuguugcagugagccaaga

SEQ ID NO: 1895856 - RNA, 21 nt, Homo sapiens
uguggcuccugccuugaugaa

SEQ ID NO: 1895857 - RNA, 19 nt, Homo sapiens
caauucaaaacauugugcc

SEQ ID NO: 1895858 - RNA, 16 nt, Homo sapiens
guuguggaugcuccag

SEQ ID NO: 1895859 - RNA, 15 nt, Homo sapiens
aagaaauaacaaauu

SEQ ID NO: 1895860 - RNA, 13 nt, Homo sapiens
gacucagccuucc

SEQ ID NO: 1895861 - RNA, 15 nt, Homo sapiens
ccuguguacugccuu

SEQ ID NO: 1895862 - RNA, 14 nt, Homo sapiens
caucugcugcaguu

SEQ ID NO: 1895863 - RNA, 21 nt, Homo sapiens
cgugcuuuuccugugugugcu

SEQ ID NO: 1895864 - RNA, 19 nt, Homo sapiens
auuucaauaucaagacuga

SEQ ID NO: 1895865 - RNA, 17 nt, Homo sapiens
guauauacacauauacc

SEQ ID NO: 1895866 - RNA, 19 nt, Homo sapiens
agaggaaagaaugaaagag

SEQ ID NO: 1895867 - RNA, 16 nt, Homo sapiens
ugguggacaugcacag

SEQ ID NO: 1895868 - RNA, 13 nt, Homo sapiens
cugcugcugccac

SEQ ID NO: 1895869 - RNA, 17 nt, Homo sapiens
cccucucccaugcacac

SEQ ID NO: 1895870 - RNA, 23 nt, Homo sapiens
aaaucacaacacagagcugcuau

SEQ ID NO: 1895871 - RNA, 21 nt, Homo sapiens
cagugcaauauuuagcugcua

SEQ ID NO: 1895872 - RNA, 21 nt, Homo sapiens
uuauagcaauguaacauuaau

SEQ ID NO: 1895873 - RNA, 15 nt, Homo sapiens
ggucauagcauucac

SEQ ID NO: 1895874 - RNA, 12 nt, Homo sapiens
guccuggucaag

SEQ ID NO: 1895875 - RNA, 17 nt, Homo sapiens
ccccuggucucuggucc

SEQ ID NO: 1895876 - RNA, 12 nt, Homo sapiens
cugccagccuug

SEQ ID NO: 1895877 - RNA, 18 nt, Homo sapiens
cagagacaggcccaagag

SEQ ID NO: 1895878 - RNA, 16 nt, Homo sapiens
cauaaaguaugugcau

SEQ ID NO: 1895879 - RNA, 21 nt, Homo sapiens
uuaagaaagcuauauaugaau

SEQ ID NO: 1895880 - RNA, 23 nt, Homo sapiens
uacccuugagcugugugccacag

SEQ ID NO: 1895881 - RNA, 19 nt, Homo sapiens
uacugauccucgcaugaug

SEQ ID NO: 1895882 - RNA, 16 nt, Homo sapiens
agggcagucugcucaa

SEQ ID NO: 1895883 - RNA, 20 nt, Homo sapiens
cuuccacgccaguugccucu

SEQ ID NO: 1895884 - RNA, 16 nt, Homo sapiens
ugugagauccuucaca

SEQ ID NO: 1895885 - RNA, 21 nt, Homo sapiens
caaugcugcaggucaacagcu

SEQ ID NO: 1895886 - RNA, 22 nt, Homo sapiens
gcugagucccuccaugcaaaag

SEQ ID NO: 1895887 - RNA, 16 nt, Homo sapiens
agacuuggggaccaga

SEQ ID NO: 1895888 - RNA, 14 nt, Homo sapiens
uuuaaucuucacaa

SEQ ID NO: 1895889 - RNA, 14 nt, Homo sapiens
uccaguuucccaaa

SEQ ID NO: 1895890 - RNA, 17 nt, Homo sapiens
agccguugaaucuggga

SEQ ID NO: 1895891 - RNA, 13 nt, Homo sapiens
accgagacaccac

SEQ ID NO: 1895892 - RNA, 16 nt, Homo sapiens
cuaauucaagauuaca

SEQ ID NO: 1895893 - RNA, 16 nt, Homo sapiens
uuaagggcagauuaca

SEQ ID NO: 1895894 - RNA, 22 nt, Homo sapiens
cuuguacaaccgacagcucuua

SEQ ID NO: 1895895 - RNA, 11 nt, Homo sapiens
cucaaaaccug

SEQ ID NO: 1895896 - RNA, 19 nt, Homo sapiens
cucuggaauggcucaggga

SEQ ID NO: 1895897 - RNA, 21 nt, Homo sapiens
gcuguuuuuaauccaguuuag

SEQ ID NO: 1895898 - RNA, 19 nt, Homo sapiens
ccccuuuucaguuucuuau

SEQ ID NO: 1895899 - RNA, 12 nt, Homo sapiens
aauaaacccuca

SEQ ID NO: 1895900 - RNA, 17 nt, Homo sapiens
uuagaaauuaauaccac

SEQ ID NO: 1895901 - RNA, 18 nt, Homo sapiens
uuaaacuugaugccagug

SEQ ID NO: 1895902 - RNA, 21 nt, Homo sapiens
uucucuagacaucuagucuca

SEQ ID NO: 1895903 - RNA, 23 nt, Homo sapiens
caccucggagcaugguguuuuca

SEQ ID NO: 1895904 - RNA, 11 nt, Homo sapiens
ucaugaugaug

SEQ ID NO: 1895905 - RNA, 18 nt, Homo sapiens
uacccccguggucuuuga

SEQ ID NO: 1895906 - RNA, 18 nt, Homo sapiens
uaauacagacuaugucac

SEQ ID NO: 1895907 - RNA, 23 nt, Homo sapiens
cucaguaaggcagugcaguacuc

SEQ ID NO: 1895908 - RNA, 20 nt, Homo sapiens
cugugcaacaaacucaaaau

SEQ ID NO: 1895909 - RNA, 13 nt, Homo sapiens
auagaacacugcc

SEQ ID NO: 1895910 - RNA, 17 nt, Homo sapiens
auuuuccauaagcuauu

SEQ ID NO: 1895911 - RNA, 12 nt, Homo sapiens
cauggaugccaa

SEQ ID NO: 1895912 - RNA, 20 nt, Homo sapiens
ccuagggaucugaaauccau

SEQ ID NO: 1895913 - RNA, 14 nt, Homo sapiens
agacuguugcucaa

SEQ ID NO: 1895914 - RNA, 14 nt, Homo sapiens
ccauacaccagcaa

SEQ ID NO: 1895915 - RNA, 21 nt, Homo sapiens
gcacaaaauucuagaagcaga

SEQ ID NO: 1895916 - RNA, 17 nt, Homo sapiens
gaaaaaggccucugucc

SEQ ID NO: 1895917 - RNA, 17 nt, Homo sapiens
aguuuccucaucugcaa

SEQ ID NO: 1895918 - RNA, 22 nt, Homo sapiens
ucaaggugaaauaaacagucua

SEQ ID NO: 1895919 - RNA, 21 nt, Homo sapiens
cuucugagaucuguugauuga

SEQ ID NO: 1895920 - RNA, 18 nt, Homo sapiens
agacuggaacacaaccau

SEQ ID NO: 1895921 - RNA, 17 nt, Homo sapiens
ggccccagggggucuca

SEQ ID NO: 1895922 - RNA, 14 nt, Homo sapiens
gccggccguggaag

SEQ ID NO: 1895923 - RNA, 13 nt, Homo sapiens
gguggagggccac

SEQ ID NO: 1895924 - RNA, 18 nt, Homo sapiens
cuucaguuuuacucugcu

SEQ ID NO: 1895925 - RNA, 12 nt, Homo sapiens
auuugccuguuu

SEQ ID NO: 1895926 - RNA, 17 nt, Homo sapiens
gccuucauugaggaagg

SEQ ID NO: 1895927 - RNA, 13 nt, Homo sapiens
ccugggaggcaga

SEQ ID NO: 1895928 - RNA, 14 nt, Homo sapiens
aaugucccauuuca

SEQ ID NO: 1895929 - RNA, 12 nt, Homo sapiens
aaauauuucaau

SEQ ID NO: 1895930 - RNA, 19 nt, Homo sapiens
ucuccaaauacugauggug

SEQ ID NO: 1895931 - RNA, 17 nt, Homo sapiens
acugagcgcaagccaca

SEQ ID NO: 1895932 - RNA, 15 nt, Homo sapiens
uaugucuucaugcaa

SEQ ID NO: 1895933 - RNA, 16 nt, Homo sapiens
aacugaggcagagcaa

SEQ ID NO: 1895934 - RNA, 17 nt, Homo sapiens
ugggccugucucagauu

SEQ ID NO: 1895935 - RNA, 17 nt, Homo sapiens
uagcuuuaaaaccacag

SEQ ID NO: 1895936 - RNA, 14 nt, Homo sapiens
aaaucaaagauuug

SEQ ID NO: 1895937 - RNA, 18 nt, Homo sapiens
acuguugcccauugcacu

SEQ ID NO: 1895938 - RNA, 20 nt, Homo sapiens
auagaauugugcuggucaua

SEQ ID NO: 1895939 - RNA, 20 nt, Homo sapiens
cgagaucacgccacugcacu

SEQ ID NO: 1895940 - RNA, 16 nt, Homo sapiens
uaaagcucuucauuuc

SEQ ID NO: 1895941 - RNA, 20 nt, Homo sapiens
auaacaagaucuuucaggaa

SEQ ID NO: 1895942 - RNA, 20 nt, Homo sapiens
acagauuuuagacuuaccuu

SEQ ID NO: 1895943 - RNA, 20 nt, Homo sapiens
uaggcaagcaggaccuggca

SEQ ID NO: 1895944 - RNA, 18 nt, Homo sapiens
gcugcucucuccgagggg

SEQ ID NO: 1895945 - RNA, 21 nt, Homo sapiens
acgccauuuaaaagucugccu

SEQ ID NO: 1895946 - RNA, 23 nt, Homo sapiens
agcaggaaggugacucugaccuu

SEQ ID NO: 1895947 - RNA, 15 nt, Homo sapiens
ccacaugcuggugca

SEQ ID NO: 1895948 - RNA, 12 nt, Homo sapiens
ugaucuauugca

SEQ ID NO: 1895949 - RNA, 22 nt, Homo sapiens
uggccagccagugccauuccac

SEQ ID NO: 1895950 - RNA, 20 nt, Homo sapiens
caguuauuugcacaaguuca

SEQ ID NO: 1895951 - RNA, 19 nt, Homo sapiens
gccaguggcuucuucauga

SEQ ID NO: 1895952 - RNA, 14 nt, Homo sapiens
cugcuccugauaua

SEQ ID NO: 1895953 - RNA, 18 nt, Homo sapiens
cuuuaugcuguaaauaau

SEQ ID NO: 1895954 - RNA, 18 nt, Homo sapiens
acgcacuaacccagccuc

SEQ ID NO: 1895955 - RNA, 13 nt, Homo sapiens
aagaauauuguau

SEQ ID NO: 1895956 - RNA, 20 nt, Homo sapiens
auuugugguccacugagcua

SEQ ID NO: 1895957 - RNA, 21 nt, Homo sapiens
gaauauaauacuguauuugag

SEQ ID NO: 1895958 - RNA, 18 nt, Homo sapiens
caguagacagauguuggu

SEQ ID NO: 1895959 - RNA, 20 nt, Homo sapiens
aaagagugcaggugcaguuu

SEQ ID NO: 1895960 - RNA, 13 nt, Homo sapiens
auguacacuacca

SEQ ID NO: 1895961 - RNA, 16 nt, Homo sapiens
gaucugccuaaggacu

SEQ ID NO: 1895962 - RNA, 16 nt, Homo sapiens
aagcacucuagaauaa

SEQ ID NO: 1895963 - RNA, 14 nt, Homo sapiens
gagguuacagugau

SEQ ID NO: 1895964 - RNA, 18 nt, Homo sapiens
uuaaaaucugucacguag

SEQ ID NO: 1895965 - RNA, 15 nt, Homo sapiens
ugagucccugugaug

SEQ ID NO: 1895966 - RNA, 13 nt, Homo sapiens
agaauacuuucau

SEQ ID NO: 1895967 - RNA, 19 nt, Homo sapiens
uugagcaucagugagguua

SEQ ID NO: 1895968 - RNA, 17 nt, Homo sapiens
auaaacguccuacugua

SEQ ID NO: 1895969 - RNA, 22 nt, Homo sapiens
agccaccucccaaggacuuucc

SEQ ID NO: 1895970 - RNA, 22 nt, Homo sapiens
aaguuuaucuuugcacaaucaa

SEQ ID NO: 1895971 - RNA, 19 nt, Homo sapiens
aagagccauauaaguuuga

SEQ ID NO: 1895972 - RNA, 18 nt, Homo sapiens
gaucauugguaucugaua

SEQ ID NO: 1895973 - RNA, 17 nt, Homo sapiens
guucuucccuauacuuc

SEQ ID NO: 1895974 - RNA, 22 nt, Homo sapiens
acugaggcuccagcaucuagug

SEQ ID NO: 1895975 - RNA, 14 nt, Homo sapiens
cuagcaucccugag

SEQ ID NO: 1895976 - RNA, 22 nt, Homo sapiens
ggacccacacugcuacacuucu

SEQ ID NO: 1895977 - RNA, 21 nt, Homo sapiens
cuaugcauaaaaaaaugaugc

SEQ ID NO: 1895978 - RNA, 22 nt, Homo sapiens
uaucagugaugaaaauuugccu

SEQ ID NO: 1895979 - RNA, 16 nt, Homo sapiens
aacauuaggcuguggu

SEQ ID NO: 1895980 - RNA, 15 nt, Homo sapiens
uaucgcaaaucacaa

SEQ ID NO: 1895981 - RNA, 17 nt, Homo sapiens
guugggcuuccaugccu

SEQ ID NO: 1895982 - RNA, 18 nt, Homo sapiens
cacaucuuccauuuccau

SEQ ID NO: 1895983 - RNA, 22 nt, Homo sapiens
caagaauugaguaucacuuuaa

SEQ ID NO: 1895984 - RNA, 14 nt, Homo sapiens
uacuaucauucuca

SEQ ID NO: 1895985 - RNA, 14 nt, Homo sapiens
augaaucaaagaca

SEQ ID NO: 1895986 - RNA, 21 nt, Homo sapiens
uuaaaaaauacucugcuauuu

SEQ ID NO: 1895987 - RNA, 14 nt, Homo sapiens
agccugugcaaaaa

SEQ ID NO: 1895988 - RNA, 12 nt, Homo sapiens
uaacagcuuucu

SEQ ID NO: 1895989 - RNA, 20 nt, Homo sapiens
gagaagagaguauggugcug

SEQ ID NO: 1895990 - RNA, 15 nt, Homo sapiens
ccuucauaugcagua

SEQ ID NO: 1895991 - RNA, 22 nt, Homo sapiens
augcuagacagaaaccaagcca

SEQ ID NO: 1895992 - RNA, 22 nt, Homo sapiens
aauuuuuuuguauuuucacugg

SEQ ID NO: 1895993 - RNA, 16 nt, Homo sapiens
cuugccacaucuugaa

SEQ ID NO: 1895994 - RNA, 14 nt, Homo sapiens
cuccucauucacau

SEQ ID NO: 1895995 - RNA, 19 nt, Homo sapiens
cauugguguugacauacau

SEQ ID NO: 1895996 - RNA, 18 nt, Homo sapiens
ccauaugucugcuucugu

SEQ ID NO: 1895997 - RNA, 24 nt, Homo sapiens
auuagcaucccauacuagacucau

SEQ ID NO: 1895998 - RNA, 16 nt, Homo sapiens
aggucaggaguugaag

SEQ ID NO: 1895999 - RNA, 19 nt, Homo sapiens
uggaaugccaaugucagca

SEQ ID NO: 1896000 - RNA, 14 nt, Homo sapiens
acacuuagggaaaa

SEQ ID NO: 1896001 - RNA, 14 nt, Homo sapiens
uccuuuucuucacc

SEQ ID NO: 1896002 - RNA, 16 nt, Homo sapiens
cagggcuccugcacuu

SEQ ID NO: 1896003 - RNA, 15 nt, Homo sapiens
caaagaugaccugcu

SEQ ID NO: 1896004 - RNA, 16 nt, Homo sapiens
auaccaccuuuacugu

SEQ ID NO: 1896005 - RNA, 15 nt, Homo sapiens
ucguucuaaaaucaa

SEQ ID NO: 1896006 - RNA, 19 nt, Homo sapiens
guucccccucccuguguga

SEQ ID NO: 1896007 - RNA, 23 nt, Homo sapiens
ggaauacaagacaaaacuuccuc

SEQ ID NO: 1896008 - RNA, 20 nt, Homo sapiens
gccuucacguguguguaugc

SEQ ID NO: 1896009 - RNA, 18 nt, Homo sapiens
ugauucgaaggaugaaga

SEQ ID NO: 1896010 - RNA, 18 nt, Homo sapiens
cuaaugagagugcacugc

SEQ ID NO: 1896011 - RNA, 23 nt, Homo sapiens
cugggaggagagguccacuuccc

SEQ ID NO: 1896012 - RNA, 22 nt, Homo sapiens
cccagaaucccucuaaccccuu

SEQ ID NO: 1896013 - RNA, 15 nt, Homo sapiens
gcggcuggugcaggg

SEQ ID NO: 1896014 - RNA, 19 nt, Homo sapiens
ugggaaacacuccuugcau

SEQ ID NO: 1896015 - RNA, 20 nt, Homo sapiens
acccccucuucaaagcagag

SEQ ID NO: 1896016 - RNA, 22 nt, Homo sapiens
aaaagaugcauuaucuaugaua

SEQ ID NO: 1896017 - RNA, 14 nt, Homo sapiens
uagccuggucugug

SEQ ID NO: 1896018 - RNA, 16 nt, Homo sapiens
ccuagacuuguguguu

SEQ ID NO: 1896019 - RNA, 12 nt, Homo sapiens
gcugcugugaac

SEQ ID NO: 1896020 - RNA, 20 nt, Homo sapiens
auggaaacagaagacaaaau

SEQ ID NO: 1896021 - RNA, 23 nt, Homo sapiens
ugauuaggaauaugaccauuuga

SEQ ID NO: 1896022 - RNA, 21 nt, Homo sapiens
ccuccaggaagaagcaggggg

SEQ ID NO: 1896023 - RNA, 13 nt, Homo sapiens
auuuuauuccagc

SEQ ID NO: 1896024 - RNA, 18 nt, Homo sapiens
cuccagaagcugcuccuu

SEQ ID NO: 1896025 - RNA, 14 nt, Homo sapiens
caaacaaugugcug

SEQ ID NO: 1896026 - RNA, 13 nt, Homo sapiens
aggcuacacugac

SEQ ID NO: 1896027 - RNA, 18 nt, Homo sapiens
ugucucuuaaaucucuua

SEQ ID NO: 1896028 - RNA, 18 nt, Homo sapiens
gcagagucucauucuguu

SEQ ID NO: 1896029 - RNA, 22 nt, Homo sapiens
guaguaucugcuuaggugccag

SEQ ID NO: 1896030 - RNA, 15 nt, Homo sapiens
agaucaugggucaag

SEQ ID NO: 1896031 - RNA, 20 nt, Homo sapiens
agccuugcauguacuugaag

SEQ ID NO: 1896032 - RNA, 16 nt, Homo sapiens
gcaaccccugcagcuc

SEQ ID NO: 1896033 - RNA, 22 nt, Homo sapiens
ggauuagguguucaggccagua

SEQ ID NO: 1896034 - RNA, 13 nt, Homo sapiens
ucaggagucccaa

SEQ ID NO: 1896035 - RNA, 15 nt, Homo sapiens
aucaaugaaggauuu

SEQ ID NO: 1896036 - RNA, 17 nt, Homo sapiens
gaccucacacaccucug

SEQ ID NO: 1896037 - RNA, 13 nt, Homo sapiens
gcuaaagacugau

SEQ ID NO: 1896038 - RNA, 13 nt, Homo sapiens
ccuacuccugacu

SEQ ID NO: 1896039 - RNA, 13 nt, Homo sapiens
aucuguaaggaac

SEQ ID NO: 1896040 - RNA, 21 nt, Homo sapiens
auguuacagguuacaugagag

SEQ ID NO: 1896041 - RNA, 15 nt, Homo sapiens
aggaaauaccaguuc

SEQ ID NO: 1896042 - RNA, 14 nt, Homo sapiens
ugcaaauacuguau

SEQ ID NO: 1896043 - RNA, 12 nt, Homo sapiens
acagucacugga

SEQ ID NO: 1896044 - RNA, 18 nt, Homo sapiens
ccaacagccacucagaaa

SEQ ID NO: 1896045 - RNA, 14 nt, Homo sapiens
cuuagauauuaaaa

SEQ ID NO: 1896046 - RNA, 22 nt, Homo sapiens
aaagugcugauaaguagcauga

SEQ ID NO: 1896047 - RNA, 17 nt, Homo sapiens
uaccaacauaaguguug

SEQ ID NO: 1896048 - RNA, 22 nt, Homo sapiens
uaauaacuuuucuaaagccuua

SEQ ID NO: 1896049 - RNA, 18 nt, Homo sapiens
gagacugcguucugcaag

SEQ ID NO: 1896050 - RNA, 17 nt, Homo sapiens
uuccaaaagccagucaa

SEQ ID NO: 1896051 - RNA, 13 nt, Homo sapiens
cucucacccucau

SEQ ID NO: 1896052 - RNA, 23 nt, Homo sapiens
augaugagucgguccucuuucca

SEQ ID NO: 1896053 - RNA, 17 nt, Homo sapiens
ugaggcuucuccuucuc

SEQ ID NO: 1896054 - RNA, 12 nt, Homo sapiens
acuuuucacagu

SEQ ID NO: 1896055 - RNA, 18 nt, Homo sapiens
agugucaaauaaacacug

SEQ ID NO: 1896056 - RNA, 15 nt, Homo sapiens
uauauuaaaguguua

SEQ ID NO: 1896057 - RNA, 15 nt, Homo sapiens
auucacuucacugug

SEQ ID NO: 1896058 - RNA, 23 nt, Homo sapiens
cucuuccccucucagagcuacuu

SEQ ID NO: 1896059 - RNA, 14 nt, Homo sapiens
cuuuaccuuccuca

SEQ ID NO: 1896060 - RNA, 13 nt, Homo sapiens
ucuacauauaugu

SEQ ID NO: 1896061 - RNA, 20 nt, Homo sapiens
cuuggcaccagacacccagg

SEQ ID NO: 1896062 - RNA, 16 nt, Homo sapiens
cccagaccgccaguga

SEQ ID NO: 1896063 - RNA, 14 nt, Homo sapiens
gccugccucugcca

SEQ ID NO: 1896064 - RNA, 17 nt, Homo sapiens
ccguugccucucugcca

SEQ ID NO: 1896065 - RNA, 22 nt, Homo sapiens
acuugugugugggcugugagug

SEQ ID NO: 1896066 - RNA, 14 nt, Homo sapiens
aacucgcugaugag

SEQ ID NO: 1896067 - RNA, 23 nt, Homo sapiens
uggcucugccccucagggggcca

SEQ ID NO: 1896068 - RNA, 13 nt, Homo sapiens
aggcuaagcacuu

SEQ ID NO: 1896069 - RNA, 21 nt, Homo sapiens
aacaucaacuggggaauugaa

SEQ ID NO: 1896070 - RNA, 20 nt, Homo sapiens
ucuaucgugacucaauucaa

SEQ ID NO: 1896071 - RNA, 11 nt, Homo sapiens
ggguggcugca

SEQ ID NO: 1896072 - RNA, 17 nt, Homo sapiens
uggcuuucauaaaucau

SEQ ID NO: 1896073 - RNA, 18 nt, Homo sapiens
cugcagagagacaacaga

SEQ ID NO: 1896074 - RNA, 21 nt, Homo sapiens
aauugucauugauacaugcau

SEQ ID NO: 1896075 - RNA, 22 nt, Homo sapiens
caguguguguuuaacauucaca

SEQ ID NO: 1896076 - RNA, 20 nt, Homo sapiens
ugucagugugaaaauucagc

SEQ ID NO: 1896077 - RNA, 15 nt, Homo sapiens
guaauuuaaugcugc

SEQ ID NO: 1896078 - RNA, 22 nt, Homo sapiens
cucuuucaauugcagaugccaa

SEQ ID NO: 1896079 - RNA, 15 nt, Homo sapiens
cacuuucugccaaug

SEQ ID NO: 1896080 - RNA, 14 nt, Homo sapiens
ucuccagugcaccu

SEQ ID NO: 1896081 - RNA, 16 nt, Homo sapiens
uauacauugugauaua

SEQ ID NO: 1896082 - RNA, 12 nt, Homo sapiens
uucucucugccc

SEQ ID NO: 1896083 - RNA, 13 nt, Homo sapiens
cuguucccauaac

SEQ ID NO: 1896084 - RNA, 20 nt, Homo sapiens
ucaaauggaagacacauuga

SEQ ID NO: 1896085 - RNA, 14 nt, Homo sapiens
uggucuucagcaaa

SEQ ID NO: 1896086 - RNA, 18 nt, Homo sapiens
aagucuaguuaccuacuu

SEQ ID NO: 1896087 - RNA, 20 nt, Homo sapiens
guuugaagacacagccuccc

SEQ ID NO: 1896088 - RNA, 14 nt, Homo sapiens
gagugcagggugga

SEQ ID NO: 1896089 - RNA, 23 nt, Homo sapiens
aggcugcuggagugcaguggcac

SEQ ID NO: 1896090 - RNA, 23 nt, Homo sapiens
guaaauccuuuuggaacauauag

SEQ ID NO: 1896091 - RNA, 16 nt, Homo sapiens
caaaacaucucugcag

SEQ ID NO: 1896092 - RNA, 21 nt, Homo sapiens
ugugaaaaaccugaugcagug

SEQ ID NO: 1896093 - RNA, 13 nt, Homo sapiens
uacuauaaaagcu

SEQ ID NO: 1896094 - RNA, 22 nt, Homo sapiens
gaggagaaauuugauaaugaca

SEQ ID NO: 1896095 - RNA, 15 nt, Homo sapiens
ccccagcuuggcuca

SEQ ID NO: 1896096 - RNA, 20 nt, Homo sapiens
aguugaucuacaaaggccau

SEQ ID NO: 1896097 - RNA, 15 nt, Homo sapiens
agaaaauaaaauuaa

SEQ ID NO: 1896098 - RNA, 17 nt, Homo sapiens
gauguugguaucugcag

SEQ ID NO: 1896099 - RNA, 15 nt, Homo sapiens
auggugccuggagcu

SEQ ID NO: 1896100 - RNA, 13 nt, Homo sapiens
ggaagaucuuaaa

SEQ ID NO: 1896101 - RNA, 13 nt, Homo sapiens
uguuugaguuaaa

SEQ ID NO: 1896102 - RNA, 14 nt, Homo sapiens
uauauugcaaaaac

SEQ ID NO: 1896103 - RNA, 19 nt, Homo sapiens
agaaguuggucuuacuuug

SEQ ID NO: 1896104 - RNA, 17 nt, Homo sapiens
caucuaaauugaucauu

SEQ ID NO: 1896105 - RNA, 22 nt, Homo sapiens
aguucacucuccgaagucugau

SEQ ID NO: 1896106 - RNA, 15 nt, Homo sapiens
cagggaaggcugugc

SEQ ID NO: 1896107 - RNA, 21 nt, Homo sapiens
aauacucuugaaauguagaau

SEQ ID NO: 1896108 - RNA, 13 nt, Homo sapiens
ugcacucuagccu

SEQ ID NO: 1896109 - RNA, 22 nt, Homo sapiens
cccaagaguggccgcggcuuug

SEQ ID NO: 1896110 - RNA, 18 nt, Homo sapiens
uguauaacccauaucugu

SEQ ID NO: 1896111 - RNA, 21 nt, Homo sapiens
uaucgaguuccggaaagccuu

SEQ ID NO: 1896112 - RNA, 22 nt, Homo sapiens
auaaaauuuuuaugaaaaucuc

SEQ ID NO: 1896113 - RNA, 15 nt, Homo sapiens
augaacacaaaugug

SEQ ID NO: 1896114 - RNA, 13 nt, Homo sapiens
cucacucuugcca

SEQ ID NO: 1896115 - RNA, 19 nt, Homo sapiens
uauaaaccagcuacuugau

SEQ ID NO: 1896116 - RNA, 18 nt, Homo sapiens
cuguuaauuccuggaacu

SEQ ID NO: 1896117 - RNA, 15 nt, Homo sapiens
ugcugcgucagacca

SEQ ID NO: 1896118 - RNA, 19 nt, Homo sapiens
ccacacuccuauggucaca

SEQ ID NO: 1896119 - RNA, 20 nt, Homo sapiens
uccucgacacgcaacuggcu

SEQ ID NO: 1896120 - RNA, 16 nt, Homo sapiens
acugaugaugacaggu

SEQ ID NO: 1896121 - RNA, 18 nt, Homo sapiens
cguugaauugaugaugca

SEQ ID NO: 1896122 - RNA, 20 nt, Homo sapiens
uaaugcuuuucccacucuca

SEQ ID NO: 1896123 - RNA, 17 nt, Homo sapiens
ccugggcaacaugauga

SEQ ID NO: 1896124 - RNA, 15 nt, Homo sapiens
uccugucaucugaga

SEQ ID NO: 1896125 - RNA, 20 nt, Homo sapiens
ucuuaguuacuuuggaacac

SEQ ID NO: 1896126 - RNA, 20 nt, Homo sapiens
uguccaauuuguaaguaaca

SEQ ID NO: 1896127 - RNA, 22 nt, Homo sapiens
guaaauagggaaaauaaucuca

SEQ ID NO: 1896128 - RNA, 13 nt, Homo sapiens
aguccucauuuac

SEQ ID NO: 1896129 - RNA, 22 nt, Homo sapiens
guucuaaaaugaaauaugagaa

SEQ ID NO: 1896130 - RNA, 20 nt, Homo sapiens
agaaugccgguuaaauucca

SEQ ID NO: 1896131 - RNA, 21 nt, Homo sapiens
cuagccccucuggauucccuu

SEQ ID NO: 1896132 - RNA, 22 nt, Homo sapiens
uugucaauaaaccugucaugug

SEQ ID NO: 1896133 - RNA, 20 nt, Homo sapiens
ggccacccgcccacagccag

SEQ ID NO: 1896134 - RNA, 21 nt, Homo sapiens
aauggauuugaugcuguuuga

SEQ ID NO: 1896135 - RNA, 23 nt, Homo sapiens
cacuugucuccuuucugacuguc

SEQ ID NO: 1896136 - RNA, 12 nt, Homo sapiens
guuuuggcagcc

SEQ ID NO: 1896137 - RNA, 13 nt, Homo sapiens
ugugggcugcaga

SEQ ID NO: 1896138 - RNA, 20 nt, Homo sapiens
guuugagaagaaaacaucua

SEQ ID NO: 1896139 - RNA, 22 nt, Homo sapiens
aguugcugggauuacaggugug

SEQ ID NO: 1896140 - RNA, 19 nt, Homo sapiens
cauagauauaaagccauuu

SEQ ID NO: 1896141 - RNA, 20 nt, Homo sapiens
agucugauccauccaucucu

SEQ ID NO: 1896142 - RNA, 22 nt, Homo sapiens
uccccuagcuuuccccagacac

SEQ ID NO: 1896143 - RNA, 12 nt, Homo sapiens
uaacacauucaa

SEQ ID NO: 1896144 - RNA, 21 nt, Homo sapiens
ccaugucccuacaaaggauau

SEQ ID NO: 1896145 - RNA, 22 nt, Homo sapiens
agaucuaauauugacugccucu

SEQ ID NO: 1896146 - RNA, 20 nt, Homo sapiens
gaacagcagcagugccauag

SEQ ID NO: 1896147 - RNA, 17 nt, Homo sapiens
guaaggcagcucugucg

SEQ ID NO: 1896148 - RNA, 19 nt, Homo sapiens
agauacauuucaucugcug

SEQ ID NO: 1896149 - RNA, 16 nt, Homo sapiens
aauaugacacuuguaa

SEQ ID NO: 1896150 - RNA, 12 nt, Homo sapiens
augaucaugcca

SEQ ID NO: 1896151 - RNA, 16 nt, Homo sapiens
aucucaagcaaguuuc

SEQ ID NO: 1896152 - RNA, 21 nt, Homo sapiens
agacauacuugaagggccaga

SEQ ID NO: 1896153 - RNA, 23 nt, Homo sapiens
aaaagugaaucuugcuguuuuca

SEQ ID NO: 1896154 - RNA, 17 nt, Homo sapiens
agccccagacucuucau

SEQ ID NO: 1896155 - RNA, 14 nt, Homo sapiens
aagauggcacuguc

SEQ ID NO: 1896156 - RNA, 14 nt, Homo sapiens
aaaacagaaaaaac

SEQ ID NO: 1896157 - RNA, 18 nt, Homo sapiens
ucuuuggguccauucaga

SEQ ID NO: 1896158 - RNA, 14 nt, Homo sapiens
cacuaugagcugcu

SEQ ID NO: 1896159 - RNA, 12 nt, Homo sapiens
ucccauucuugg

SEQ ID NO: 1896160 - RNA, 14 nt, Homo sapiens
gacugauggugaaa

SEQ ID NO: 1896161 - RNA, 22 nt, Homo sapiens
ggacaggauguguuugcuuucu

SEQ ID NO: 1896162 - RNA, 14 nt, Homo sapiens
auagaagcaaauua

SEQ ID NO: 1896163 - RNA, 22 nt, Homo sapiens
gggccaggcugguccgagcuga

SEQ ID NO: 1896164 - RNA, 19 nt, Homo sapiens
uuguauauagaguggaauc

SEQ ID NO: 1896165 - RNA, 17 nt, Homo sapiens
ucuauaaacaaauaucg

SEQ ID NO: 1896166 - RNA, 13 nt, Homo sapiens
cccaaagugcuga

SEQ ID NO: 1896167 - RNA, 17 nt, Homo sapiens
ccccagcugaccuggua

SEQ ID NO: 1896168 - RNA, 16 nt, Homo sapiens
cauguuaacaugacau

SEQ ID NO: 1896169 - RNA, 15 nt, Homo sapiens
cucgccccaccggcg

SEQ ID NO: 1896170 - RNA, 16 nt, Homo sapiens
ugugaaagaaccaaaa

SEQ ID NO: 1896171 - RNA, 18 nt, Homo sapiens
ccggcccccugugcaggg

SEQ ID NO: 1896172 - RNA, 13 nt, Homo sapiens
cacucuguuaaua

SEQ ID NO: 1896173 - RNA, 13 nt, Homo sapiens
cacacuguuaaaa

SEQ ID NO: 1896174 - RNA, 17 nt, Homo sapiens
cagagcuccaugcaugg

SEQ ID NO: 1896175 - RNA, 14 nt, Homo sapiens
cuucagugcugcuc

SEQ ID NO: 1896176 - RNA, 14 nt, Homo sapiens
gcgcuguggcucac

SEQ ID NO: 1896177 - RNA, 17 nt, Homo sapiens
cuacugacagggagcag

SEQ ID NO: 1896178 - RNA, 14 nt, Homo sapiens
uuggugcuuuucac

SEQ ID NO: 1896179 - RNA, 14 nt, Homo sapiens
gagguccugaucag

SEQ ID NO: 1896180 - RNA, 15 nt, Homo sapiens
auggaaccauuuuag

SEQ ID NO: 1896181 - RNA, 19 nt, Homo sapiens
augcacaccuaagcccaaa

SEQ ID NO: 1896182 - RNA, 15 nt, Homo sapiens
ugaucauuacucugc

SEQ ID NO: 1896183 - RNA, 20 nt, Homo sapiens
ccaacuccgcccagccucuc

SEQ ID NO: 1896184 - RNA, 14 nt, Homo sapiens
auauuugcuucacu

SEQ ID NO: 1896185 - RNA, 18 nt, Homo sapiens
cagcuccgcaagcaucau

SEQ ID NO: 1896186 - RNA, 13 nt, Homo sapiens
caaguauccaauu

SEQ ID NO: 1896187 - RNA, 16 nt, Homo sapiens
uauauauauguguaua

SEQ ID NO: 1896188 - RNA, 17 nt, Homo sapiens
agguguugucaagugau

SEQ ID NO: 1896189 - RNA, 23 nt, Homo sapiens
caaccuuuguguggcuccuggua

SEQ ID NO: 1896190 - RNA, 23 nt, Homo sapiens
cauauguuuccccaucucugucu

SEQ ID NO: 1896191 - RNA, 21 nt, Homo sapiens
guaucucuuuugaauccaugc

SEQ ID NO: 1896192 - RNA, 16 nt, Homo sapiens
agcccuaagacguccc

SEQ ID NO: 1896193 - RNA, 14 nt, Homo sapiens
ggagaggggacgca

SEQ ID NO: 1896194 - RNA, 13 nt, Homo sapiens
ccaaaacauuccg

SEQ ID NO: 1896195 - RNA, 16 nt, Homo sapiens
aagagucuggggacca

SEQ ID NO: 1896196 - RNA, 19 nt, Homo sapiens
guuuaaagcaacugucuau

SEQ ID NO: 1896197 - RNA, 14 nt, Homo sapiens
guuaaauaagcaaa

SEQ ID NO: 1896198 - RNA, 10 nt, Homo sapiens
caggacaucu

SEQ ID NO: 1896199 - RNA, 13 nt, Homo sapiens
guuuuguauauua

SEQ ID NO: 1896200 - RNA, 13 nt, Homo sapiens
uccagauucuucc

SEQ ID NO: 1896201 - RNA, 18 nt, Homo sapiens
gaauugugacucggcuag

SEQ ID NO: 1896202 - RNA, 15 nt, Homo sapiens
caagcauuuguucca

SEQ ID NO: 1896203 - RNA, 20 nt, Homo sapiens
uauucaauuguaaugcaugc

SEQ ID NO: 1896204 - RNA, 16 nt, Homo sapiens
gcuuauaagacaauga

SEQ ID NO: 1896205 - RNA, 13 nt, Homo sapiens
uuggaauggcaau

SEQ ID NO: 1896206 - RNA, 22 nt, Homo sapiens
uauuguggauguguucauucaa

SEQ ID NO: 1896207 - RNA, 20 nt, Homo sapiens
ggauaacacuggcuucaggc

SEQ ID NO: 1896208 - RNA, 22 nt, Homo sapiens
aacagaucacaugccccucuua

SEQ ID NO: 1896209 - RNA, 17 nt, Homo sapiens
cauaaguauuuaauuca

SEQ ID NO: 1896210 - RNA, 15 nt, Homo sapiens
aagggacuaccucug

SEQ ID NO: 1896211 - RNA, 22 nt, Homo sapiens
ucagccgcagacaaguaaucac

SEQ ID NO: 1896212 - RNA, 17 nt, Homo sapiens
uucuggugucugcucag

SEQ ID NO: 1896213 - RNA, 15 nt, Homo sapiens
ugagacagucuugcu

SEQ ID NO: 1896214 - RNA, 17 nt, Homo sapiens
agaucagccacaccuuu

SEQ ID NO: 1896215 - RNA, 17 nt, Homo sapiens
uggaacugcaccaccga

SEQ ID NO: 1896216 - RNA, 13 nt, Homo sapiens
cucacaaccugaa

SEQ ID NO: 1896217 - RNA, 20 nt, Homo sapiens
uuggaagguuuuaacauuga

SEQ ID NO: 1896218 - RNA, 19 nt, Homo sapiens
gagaacaguuguccaggau

SEQ ID NO: 1896219 - RNA, 16 nt, Homo sapiens
uauuagcuuauauauu

SEQ ID NO: 1896220 - RNA, 22 nt, Homo sapiens
aggcgcugguguuuugcucuga

SEQ ID NO: 1896221 - RNA, 23 nt, Homo sapiens
caccuucugacgcagccugagaa

SEQ ID NO: 1896222 - RNA, 21 nt, Homo sapiens
gccaaaauaaugcaccacuuu

SEQ ID NO: 1896223 - RNA, 21 nt, Homo sapiens
cccagggcugcgucugcaaag

SEQ ID NO: 1896224 - RNA, 17 nt, Homo sapiens
aauucuuuuucucagca

SEQ ID NO: 1896225 - RNA, 18 nt, Homo sapiens
gaaacagagaacccugug

SEQ ID NO: 1896226 - RNA, 15 nt, Homo sapiens
ugccugcagcacaug

SEQ ID NO: 1896227 - RNA, 20 nt, Homo sapiens
ccuguggcugcgcuuccuau

SEQ ID NO: 1896228 - RNA, 15 nt, Homo sapiens
caggugggaaauggu

SEQ ID NO: 1896229 - RNA, 13 nt, Homo sapiens
uuuucauacugua

SEQ ID NO: 1896230 - RNA, 22 nt, Homo sapiens
cuggccggacacccgacuccag

SEQ ID NO: 1896231 - RNA, 13 nt, Homo sapiens
caguccaaucuca

SEQ ID NO: 1896232 - RNA, 16 nt, Homo sapiens
aaaaauugagacauuu

SEQ ID NO: 1896233 - RNA, 17 nt, Homo sapiens
aggauucccccaacaca

SEQ ID NO: 1896234 - RNA, 20 nt, Homo sapiens
gaguuccugugggugugucu

SEQ ID NO: 1896235 - RNA, 21 nt, Homo sapiens
uuaguagagaagggguuucac

SEQ ID NO: 1896236 - RNA, 18 nt, Homo sapiens
aggcugcaaaguaugcca

SEQ ID NO: 1896237 - RNA, 18 nt, Homo sapiens
augaaacauccuaugaaa

SEQ ID NO: 1896238 - RNA, 21 nt, Homo sapiens
caaaugacaguagcauugaag

SEQ ID NO: 1896239 - RNA, 14 nt, Homo sapiens
accuuacuuuccca

SEQ ID NO: 1896240 - RNA, 22 nt, Homo sapiens
cuccuccaagccuucacccugu

SEQ ID NO: 1896241 - RNA, 10 nt, Homo sapiens
aguguucucc

SEQ ID NO: 1896242 - RNA, 13 nt, Homo sapiens
ugaggcaugacua

SEQ ID NO: 1896243 - RNA, 22 nt, Homo sapiens
accacugcccccugcugccaug

SEQ ID NO: 1896244 - RNA, 17 nt, Homo sapiens
ccacuucgggagaagaa

SEQ ID NO: 1896245 - RNA, 13 nt, Homo sapiens
uccaccuaccugc

SEQ ID NO: 1896246 - RNA, 21 nt, Homo sapiens
ccuacucagacuguugcacuc

SEQ ID NO: 1896247 - RNA, 20 nt, Homo sapiens
uucaccuuuauauauguacu

SEQ ID NO: 1896248 - RNA, 22 nt, Homo sapiens
gcuggaucacuugaguucagga

SEQ ID NO: 1896249 - RNA, 18 nt, Homo sapiens
ggagaugacagugaugcu

SEQ ID NO: 1896250 - RNA, 13 nt, Homo sapiens
aaaacaaacauuu

SEQ ID NO: 1896251 - RNA, 15 nt, Homo sapiens
uuuuaccagucucac

SEQ ID NO: 1896252 - RNA, 15 nt, Homo sapiens
ggacuccauagcucc

SEQ ID NO: 1896253 - RNA, 12 nt, Homo sapiens
cagagcugagga

SEQ ID NO: 1896254 - RNA, 18 nt, Homo sapiens
caauaaaucaacuccagc

SEQ ID NO: 1896255 - RNA, 18 nt, Homo sapiens
ugguggcauuguuuacag

SEQ ID NO: 1896256 - RNA, 20 nt, Homo sapiens
aacauucacacagggcucuu

SEQ ID NO: 1896257 - RNA, 19 nt, Homo sapiens
uaggguaauugcugaggug

SEQ ID NO: 1896258 - RNA, 21 nt, Homo sapiens
gagaagaggcugcugcagaca

SEQ ID NO: 1896259 - RNA, 17 nt, Homo sapiens
uacuugaaaccaguauu

SEQ ID NO: 1896260 - RNA, 12 nt, Homo sapiens
aacaaagacagg

SEQ ID NO: 1896261 - RNA, 13 nt, Homo sapiens
acuucucuuacau

SEQ ID NO: 1896262 - RNA, 17 nt, Homo sapiens
uggggcagcagcugccu

SEQ ID NO: 1896263 - RNA, 17 nt, Homo sapiens
aaucucagcgugggcca

SEQ ID NO: 1896264 - RNA, 23 nt, Homo sapiens
uugaggauaggaguucacuucau

SEQ ID NO: 1896265 - RNA, 19 nt, Homo sapiens
uguuuuaaaauacucucau

SEQ ID NO: 1896266 - RNA, 16 nt, Homo sapiens
acugcccuggcagcag

SEQ ID NO: 1896267 - RNA, 19 nt, Homo sapiens
uacagaguuuaugauuuaa

SEQ ID NO: 1896268 - RNA, 22 nt, Homo sapiens
gguuuccacguaagucacugaa

SEQ ID NO: 1896269 - RNA, 22 nt, Homo sapiens
ugccugaaggcucacaccucau

SEQ ID NO: 1896270 - RNA, 14 nt, Homo sapiens
gaugcugcugagca

SEQ ID NO: 1896271 - RNA, 17 nt, Homo sapiens
ugaccuuaaaugcaacc

SEQ ID NO: 1896272 - RNA, 14 nt, Homo sapiens
augcaaccauaaga

SEQ ID NO: 1896273 - RNA, 16 nt, Homo sapiens
ccgcugcgggcccacg

SEQ ID NO: 1896274 - RNA, 17 nt, Homo sapiens
uuaaaauaaauucucuc

SEQ ID NO: 1896275 - RNA, 18 nt, Homo sapiens
uuuaagacagagucucac

SEQ ID NO: 1896276 - RNA, 20 nt, Homo sapiens
auguagacuuuugcuuuaug

SEQ ID NO: 1896277 - RNA, 17 nt, Homo sapiens
acgcauucucguaucca

SEQ ID NO: 1896278 - RNA, 17 nt, Homo sapiens
caauaucccaacauucu

SEQ ID NO: 1896279 - RNA, 17 nt, Homo sapiens
ucucgaucucuugaccu

SEQ ID NO: 1896280 - RNA, 15 nt, Homo sapiens
ucagcauuauuccuc

SEQ ID NO: 1896281 - RNA, 20 nt, Homo sapiens
cucuucagcacugucuuguc

SEQ ID NO: 1896282 - RNA, 17 nt, Homo sapiens
ugccugcccugccucag

SEQ ID NO: 1896283 - RNA, 21 nt, Homo sapiens
uuuguccccagagacauucau

SEQ ID NO: 1896284 - RNA, 17 nt, Homo sapiens
gcaggagaauagccuga

SEQ ID NO: 1896285 - RNA, 14 nt, Homo sapiens
cagcgcgugcacag

SEQ ID NO: 1896286 - RNA, 18 nt, Homo sapiens
aguuuguuuuuaaacuaa

SEQ ID NO: 1896287 - RNA, 18 nt, Homo sapiens
auuuaauuuguaugcuaa

SEQ ID NO: 1896288 - RNA, 21 nt, Homo sapiens
cuaccucaaccaaugccaaaa

SEQ ID NO: 1896289 - RNA, 11 nt, Homo sapiens
caugaguccau

SEQ ID NO: 1896290 - RNA, 18 nt, Homo sapiens
cuacaagguugugcccuc

SEQ ID NO: 1896291 - RNA, 18 nt, Homo sapiens
uguguuuuuaacauguca

SEQ ID NO: 1896292 - RNA, 19 nt, Homo sapiens
gggucagagaggagucaga

SEQ ID NO: 1896293 - RNA, 21 nt, Homo sapiens
aggugggaaaaucacuugaac

SEQ ID NO: 1896294 - RNA, 19 nt, Homo sapiens
cagcugccuuggacugugu

SEQ ID NO: 1896295 - RNA, 22 nt, Homo sapiens
acaggcgugauccaccacaccu

SEQ ID NO: 1896296 - RNA, 19 nt, Homo sapiens
ggaccccugagcuugcaga

SEQ ID NO: 1896297 - RNA, 22 nt, Homo sapiens
ugcaaagccaccaacagccacu

SEQ ID NO: 1896298 - RNA, 20 nt, Homo sapiens
aguucaucggaauucagcca

SEQ ID NO: 1896299 - RNA, 22 nt, Homo sapiens
agucucacuuuuauugauaaaa

SEQ ID NO: 1896300 - RNA, 16 nt, Homo sapiens
uuuguaaugcaaaagg

SEQ ID NO: 1896301 - RNA, 14 nt, Homo sapiens
cccucccagugaga

SEQ ID NO: 1896302 - RNA, 12 nt, Homo sapiens
aggagauuacaa

SEQ ID NO: 1896303 - RNA, 15 nt, Homo sapiens
uccuccaugccugac

SEQ ID NO: 1896304 - RNA, 12 nt, Homo sapiens
uugaauugucaa

SEQ ID NO: 1896305 - RNA, 23 nt, Homo sapiens
cagaaauacaacagaaguuauau

SEQ ID NO: 1896306 - RNA, 12 nt, Homo sapiens
cuguauugccau

SEQ ID NO: 1896307 - RNA, 11 nt, Homo sapiens
cccuacaugga

SEQ ID NO: 1896308 - RNA, 15 nt, Homo sapiens
caugaacaccauacc

SEQ ID NO: 1896309 - RNA, 16 nt, Homo sapiens
aacaauuccuuacauu

SEQ ID NO: 1896310 - RNA, 21 nt, Homo sapiens
gaaaaguuagucaauccuguc

SEQ ID NO: 1896311 - RNA, 19 nt, Homo sapiens
aagacagauuaccaaagaa

SEQ ID NO: 1896312 - RNA, 20 nt, Homo sapiens
caaaguuaagaaucuuuaua

SEQ ID NO: 1896313 - RNA, 16 nt, Homo sapiens
aggcaaauaucuugaa

SEQ ID NO: 1896314 - RNA, 17 nt, Homo sapiens
ccuuuuggaacauuucu

SEQ ID NO: 1896315 - RNA, 20 nt, Homo sapiens
ugacagugaagcagcacugu

SEQ ID NO: 1896316 - RNA, 21 nt, Homo sapiens
ggacagcugcuucugugcauu

SEQ ID NO: 1896317 - RNA, 17 nt, Homo sapiens
uuccagugcagagaucc

SEQ ID NO: 1896318 - RNA, 13 nt, Homo sapiens
agugagacuccac

SEQ ID NO: 1896319 - RNA, 15 nt, Homo sapiens
auauuugauacauau

SEQ ID NO: 1896320 - RNA, 14 nt, Homo sapiens
aaauuuaagcuuaa

SEQ ID NO: 1896321 - RNA, 14 nt, Homo sapiens
auugaaaauaugau

SEQ ID NO: 1896322 - RNA, 19 nt, Homo sapiens
uucccuguguacccuccau

SEQ ID NO: 1896323 - RNA, 17 nt, Homo sapiens
uacaaucagcccagugc

SEQ ID NO: 1896324 - RNA, 20 nt, Homo sapiens
agacgcucaagaauccucug

SEQ ID NO: 1896325 - RNA, 16 nt, Homo sapiens
uuuguauuuauuucca

SEQ ID NO: 1896326 - RNA, 13 nt, Homo sapiens
cccugagguccug

SEQ ID NO: 1896327 - RNA, 19 nt, Homo sapiens
ccaacaagaaugcauugau

SEQ ID NO: 1896328 - RNA, 14 nt, Homo sapiens
auaaauacauucga

SEQ ID NO: 1896329 - RNA, 22 nt, Homo sapiens
aauuuuucugugcucaaugugu

SEQ ID NO: 1896330 - RNA, 17 nt, Homo sapiens
aggcugcugcugcugca

SEQ ID NO: 1896331 - RNA, 18 nt, Homo sapiens
aacauauauguauauaca

SEQ ID NO: 1896332 - RNA, 21 nt, Homo sapiens
gaaauuauggaauacaaaagu

SEQ ID NO: 1896333 - RNA, 18 nt, Homo sapiens
gcagcggaggcgugcguu

SEQ ID NO: 1896334 - RNA, 22 nt, Homo sapiens
cacuaaaacaccucagcugccu

SEQ ID NO: 1896335 - RNA, 17 nt, Homo sapiens
caacuacagaaaaacca

SEQ ID NO: 1896336 - RNA, 19 nt, Homo sapiens
cuuauuucguuucugggga

SEQ ID NO: 1896337 - RNA, 13 nt, Homo sapiens
cacaucucacuuc

SEQ ID NO: 1896338 - RNA, 23 nt, Homo sapiens
acauauccacaaaugacugcaaa

SEQ ID NO: 1896339 - RNA, 17 nt, Homo sapiens
uauuuagucugcauugc

SEQ ID NO: 1896340 - RNA, 14 nt, Homo sapiens
caagcacugcucac

SEQ ID NO: 1896341 - RNA, 22 nt, Homo sapiens
gguaaaugccacacaccuuuaa

SEQ ID NO: 1896342 - RNA, 14 nt, Homo sapiens
uccauccucacugc

SEQ ID NO: 1896343 - RNA, 18 nt, Homo sapiens
gaaaguuggaauaugugg

SEQ ID NO: 1896344 - RNA, 13 nt, Homo sapiens
uucuuguauugua

SEQ ID NO: 1896345 - RNA, 17 nt, Homo sapiens
ccaguuuuugcagagaa

SEQ ID NO: 1896346 - RNA, 17 nt, Homo sapiens
cuacuugagaaaaugca

SEQ ID NO: 1896347 - RNA, 21 nt, Homo sapiens
aucauggaaauauuaugcaaa

SEQ ID NO: 1896348 - RNA, 18 nt, Homo sapiens
ggccagcaaauguuccuu

SEQ ID NO: 1896349 - RNA, 19 nt, Homo sapiens
agcccccaccuucccucca

SEQ ID NO: 1896350 - RNA, 16 nt, Homo sapiens
accuccagaggugaug

SEQ ID NO: 1896351 - RNA, 18 nt, Homo sapiens
guagugauggaguuccuu

SEQ ID NO: 1896352 - RNA, 18 nt, Homo sapiens
gacaaaucaaguuuccaa

SEQ ID NO: 1896353 - RNA, 12 nt, Homo sapiens
gaaaagccagag

SEQ ID NO: 1896354 - RNA, 17 nt, Homo sapiens
gcugacgcgacuaucau

SEQ ID NO: 1896355 - RNA, 21 nt, Homo sapiens
gcacacuagccucuccaggaa

SEQ ID NO: 1896356 - RNA, 13 nt, Homo sapiens
aagcagaauuuaa

SEQ ID NO: 1896357 - RNA, 14 nt, Homo sapiens
aaagucaucaaaga

SEQ ID NO: 1896358 - RNA, 22 nt, Homo sapiens
auuagcaugcugcuuuuuguac

SEQ ID NO: 1896359 - RNA, 15 nt, Homo sapiens
uguugggaaaguauu

SEQ ID NO: 1896360 - RNA, 22 nt, Homo sapiens
aucaccuauuacauuuuacuga

SEQ ID NO: 1896361 - RNA, 15 nt, Homo sapiens
aucauucccauuuug

SEQ ID NO: 1896362 - RNA, 20 nt, Homo sapiens
ugaacaacucgaaucacuca

SEQ ID NO: 1896363 - RNA, 19 nt, Homo sapiens
ucaucuugggaagggccau

SEQ ID NO: 1896364 - RNA, 18 nt, Homo sapiens
uaguugccaauaugccag

SEQ ID NO: 1896365 - RNA, 15 nt, Homo sapiens
cugucaugcccagcu

SEQ ID NO: 1896366 - RNA, 22 nt, Homo sapiens
ucuuguuuccuuauauuaugga

SEQ ID NO: 1896367 - RNA, 14 nt, Homo sapiens
caagaaaaccuaga

SEQ ID NO: 1896368 - RNA, 16 nt, Homo sapiens
ugggcauuccuuggga

SEQ ID NO: 1896369 - RNA, 14 nt, Homo sapiens
cauggaaaccaaaa

SEQ ID NO: 1896370 - RNA, 22 nt, Homo sapiens
cugagauuacaggugugagcca

SEQ ID NO: 1896371 - RNA, 22 nt, Homo sapiens
acugaaccuuguugaugccagc

SEQ ID NO: 1896372 - RNA, 23 nt, Homo sapiens
cauaauacauuccaucacagcca

SEQ ID NO: 1896373 - RNA, 17 nt, Homo sapiens
cacacuugguccaucca

SEQ ID NO: 1896374 - RNA, 19 nt, Homo sapiens
ugcuuuccauauugugaua

SEQ ID NO: 1896375 - RNA, 21 nt, Homo sapiens
gacuagagacgcaccuugcug

SEQ ID NO: 1896376 - RNA, 19 nt, Homo sapiens
agaguguuuaccuggugcu

SEQ ID NO: 1896377 - RNA, 22 nt, Homo sapiens
caagucacccagccagaaggaa

SEQ ID NO: 1896378 - RNA, 13 nt, Homo sapiens
uaucaacuuccua

SEQ ID NO: 1896379 - RNA, 13 nt, Homo sapiens
uuaauuuaauuca

SEQ ID NO: 1896380 - RNA, 13 nt, Homo sapiens
aagucuccaguca

SEQ ID NO: 1896381 - RNA, 16 nt, Homo sapiens
caaagacuauucccuu

SEQ ID NO: 1896382 - RNA, 22 nt, Homo sapiens
ggcuggaaugcaguggugugcu

SEQ ID NO: 1896383 - RNA, 17 nt, Homo sapiens
agcaaaacuccgucuca

SEQ ID NO: 1896384 - RNA, 17 nt, Homo sapiens
ucaaagauguacugaga

SEQ ID NO: 1896385 - RNA, 19 nt, Homo sapiens
aauagcagguaguccagga

SEQ ID NO: 1896386 - RNA, 18 nt, Homo sapiens
uuccuuuuguuuuccacu

SEQ ID NO: 1896387 - RNA, 12 nt, Homo sapiens
cauguacaugaa

SEQ ID NO: 1896388 - RNA, 17 nt, Homo sapiens
aauaaaaccaagccucu

SEQ ID NO: 1896389 - RNA, 13 nt, Homo sapiens
uccuccacugacu

SEQ ID NO: 1896390 - RNA, 15 nt, Homo sapiens
aggaagagagacaga

SEQ ID NO: 1896391 - RNA, 16 nt, Homo sapiens
ugaaggaacauuccuu

SEQ ID NO: 1896392 - RNA, 14 nt, Homo sapiens
ucucucucuguccu

SEQ ID NO: 1896393 - RNA, 12 nt, Homo sapiens
uuuccuccugag

SEQ ID NO: 1896394 - RNA, 17 nt, Homo sapiens
uaauuuagaacugucaa

SEQ ID NO: 1896395 - RNA, 14 nt, Homo sapiens
augccacuggaaac

SEQ ID NO: 1896396 - RNA, 14 nt, Homo sapiens
agccugaguuugcu

SEQ ID NO: 1896397 - RNA, 12 nt, Homo sapiens
aauaaaugacaa

SEQ ID NO: 1896398 - RNA, 18 nt, Homo sapiens
cuauuuuuuaaagacugu

SEQ ID NO: 1896399 - RNA, 14 nt, Homo sapiens
auuaaaaaauuauu

SEQ ID NO: 1896400 - RNA, 12 nt, Homo sapiens
cagagucugccc

SEQ ID NO: 1896401 - RNA, 13 nt, Homo sapiens
augagacagacau

SEQ ID NO: 1896402 - RNA, 20 nt, Homo sapiens
gaacacucuuuugcuuuauu

SEQ ID NO: 1896403 - RNA, 15 nt, Homo sapiens
uuuauugaaugcuua

SEQ ID NO: 1896404 - RNA, 18 nt, Homo sapiens
gccagcuuuuccagaaau

SEQ ID NO: 1896405 - RNA, 21 nt, Homo sapiens
gcagcucccauuucaucagca

SEQ ID NO: 1896406 - RNA, 22 nt, Homo sapiens
uggaaaaggaagguaguucaag

SEQ ID NO: 1896407 - RNA, 21 nt, Homo sapiens
cugcaggcagccugccuuuaa

SEQ ID NO: 1896408 - RNA, 14 nt, Homo sapiens
aagaaauacuguac

SEQ ID NO: 1896409 - RNA, 19 nt, Homo sapiens
aaagauuaucucagaaagu

SEQ ID NO: 1896410 - RNA, 16 nt, Homo sapiens
cugcucaaugccauug

SEQ ID NO: 1896411 - RNA, 23 nt, Homo sapiens
uguuuccaaagugcaugucacau

SEQ ID NO: 1896412 - RNA, 21 nt, Homo sapiens
ucuaugaacuagagacucugu

SEQ ID NO: 1896413 - RNA, 17 nt, Homo sapiens
augacuguaucuugaua

SEQ ID NO: 1896414 - RNA, 16 nt, Homo sapiens
accuaucccaaaugug

SEQ ID NO: 1896415 - RNA, 16 nt, Homo sapiens
acggcccaucuuggca

SEQ ID NO: 1896416 - RNA, 17 nt, Homo sapiens
ccaucauacacuuccuu

SEQ ID NO: 1896417 - RNA, 21 nt, Homo sapiens
acucaagaagcacaccuacag

SEQ ID NO: 1896418 - RNA, 19 nt, Homo sapiens
ugaaaagauacugaugcau

SEQ ID NO: 1896419 - RNA, 19 nt, Homo sapiens
aggggugguccugacucaa

SEQ ID NO: 1896420 - RNA, 20 nt, Homo sapiens
gaguuagauaugugccaaag

SEQ ID NO: 1896421 - RNA, 20 nt, Homo sapiens
gccuguuccgcauccuggag

SEQ ID NO: 1896422 - RNA, 17 nt, Homo sapiens
uauguauauagaugugc

SEQ ID NO: 1896423 - RNA, 23 nt, Homo sapiens
uugcccccagauacauggugaug

SEQ ID NO: 1896424 - RNA, 19 nt, Homo sapiens
uaccaagugcuuugcucua

SEQ ID NO: 1896425 - RNA, 21 nt, Homo sapiens
cucgauguccuccucugugaa

SEQ ID NO: 1896426 - RNA, 18 nt, Homo sapiens
gaauucuaacaagucaua

SEQ ID NO: 1896427 - RNA, 18 nt, Homo sapiens
gugucaacuuucauuuga

SEQ ID NO: 1896428 - RNA, 19 nt, Homo sapiens
cacuuugggaggcugaggu

SEQ ID NO: 1896429 - RNA, 23 nt, Homo sapiens
auagccaacugcuguucauguua

SEQ ID NO: 1896430 - RNA, 12 nt, Homo sapiens
uauucugcaagc

SEQ ID NO: 1896431 - RNA, 17 nt, Homo sapiens
uuuguauccuugaugaa

SEQ ID NO: 1896432 - RNA, 23 nt, Homo sapiens
ugaggacacauugccccaugaga

SEQ ID NO: 1896433 - RNA, 23 nt, Homo sapiens
ucagccccucagagaaugaucac

SEQ ID NO: 1896434 - RNA, 21 nt, Homo sapiens
aaucaagacccuuuucuguau

SEQ ID NO: 1896435 - RNA, 21 nt, Homo sapiens
accaaagugcaggacaucaaa

SEQ ID NO: 1896436 - RNA, 21 nt, Homo sapiens
uuucuuccuuuuuuaguucuu

SEQ ID NO: 1896437 - RNA, 23 nt, Homo sapiens
aauucucucacaaaguccacuuu

SEQ ID NO: 1896438 - RNA, 20 nt, Homo sapiens
uaagccauugcuucucccuc

SEQ ID NO: 1896439 - RNA, 21 nt, Homo sapiens
augagcugcuccaucaccugg

SEQ ID NO: 1896440 - RNA, 14 nt, Homo sapiens
agcaggucaguaca

SEQ ID NO: 1896441 - RNA, 18 nt, Homo sapiens
uuuccuuuuugacacuga

SEQ ID NO: 1896442 - RNA, 15 nt, Homo sapiens
ccagcuauuuacaca

SEQ ID NO: 1896443 - RNA, 14 nt, Homo sapiens
uccuuccuugacug

SEQ ID NO: 1896444 - RNA, 23 nt, Homo sapiens
aucuuucaaaagccuuaccuuga

SEQ ID NO: 1896445 - RNA, 15 nt, Homo sapiens
aagagugagagggca

SEQ ID NO: 1896446 - RNA, 22 nt, Homo sapiens
auuugauucgcccuccucccug

SEQ ID NO: 1896447 - RNA, 17 nt, Homo sapiens
acugggcuggcugccuu

SEQ ID NO: 1896448 - RNA, 14 nt, Homo sapiens
gguaggauuacuuu

SEQ ID NO: 1896449 - RNA, 13 nt, Homo sapiens
acacuuggugcug

SEQ ID NO: 1896450 - RNA, 20 nt, Homo sapiens
cugaggauuucugaucugau

SEQ ID NO: 1896451 - RNA, 18 nt, Homo sapiens
gcccuccucugcacuccc

SEQ ID NO: 1896452 - RNA, 18 nt, Homo sapiens
cccggggugguccaaugg

SEQ ID NO: 1896453 - RNA, 23 nt, Homo sapiens
accauguuggccaggcuggucuc

SEQ ID NO: 1896454 - RNA, 15 nt, Homo sapiens
uacauauuacuguug

SEQ ID NO: 1896455 - RNA, 13 nt, Homo sapiens
cuaaaaaguauca

SEQ ID NO: 1896456 - RNA, 20 nt, Homo sapiens
ucucuugcuaccugugagca

SEQ ID NO: 1896457 - RNA, 21 nt, Homo sapiens
aagagaagcugugucuuuaga

SEQ ID NO: 1896458 - RNA, 19 nt, Homo sapiens
ccaagccaagagugccaca

SEQ ID NO: 1896459 - RNA, 15 nt, Homo sapiens
cugcagacgucugcc

SEQ ID NO: 1896460 - RNA, 19 nt, Homo sapiens
aaaaggcccuuuucagggc

SEQ ID NO: 1896461 - RNA, 19 nt, Homo sapiens
gacucacccuccacaaagc

SEQ ID NO: 1896462 - RNA, 18 nt, Homo sapiens
uuacuauugcaaaaggga

SEQ ID NO: 1896463 - RNA, 16 nt, Homo sapiens
ccaggucccuccucag

SEQ ID NO: 1896464 - RNA, 15 nt, Homo sapiens
cccacagggaccaag

SEQ ID NO: 1896465 - RNA, 15 nt, Homo sapiens
aagcugguccuggga

SEQ ID NO: 1896466 - RNA, 16 nt, Homo sapiens
cuucaaucaacaucuc

SEQ ID NO: 1896467 - RNA, 16 nt, Homo sapiens
caggaguuuugggaau

SEQ ID NO: 1896468 - RNA, 18 nt, Homo sapiens
aagcauguacaguguucu

SEQ ID NO: 1896469 - RNA, 10 nt, Homo sapiens
cuucauucua

SEQ ID NO: 1896470 - RNA, 18 nt, Homo sapiens
agguagaguuugaucaua

SEQ ID NO: 1896471 - RNA, 14 nt, Homo sapiens
ccaugugugugcaa

SEQ ID NO: 1896472 - RNA, 13 nt, Homo sapiens
gggguuucaccug

SEQ ID NO: 1896473 - RNA, 14 nt, Homo sapiens
uuaagaauuucaca

SEQ ID NO: 1896474 - RNA, 14 nt, Homo sapiens
ccuuggaccucucc

SEQ ID NO: 1896475 - RNA, 14 nt, Homo sapiens
uucaccaaagagca

SEQ ID NO: 1896476 - RNA, 16 nt, Homo sapiens
uauaaauugggauaaa

SEQ ID NO: 1896477 - RNA, 20 nt, Homo sapiens
guuucauggguuauguguau

SEQ ID NO: 1896478 - RNA, 16 nt, Homo sapiens
caggacccgccugcuc

SEQ ID NO: 1896479 - RNA, 16 nt, Homo sapiens
uucuucccuuaggcaa

SEQ ID NO: 1896480 - RNA, 23 nt, Homo sapiens
accuuuuuuccuucuugacauuu

SEQ ID NO: 1896481 - RNA, 23 nt, Homo sapiens
aauauaaagccucaaaucuuccu

SEQ ID NO: 1896482 - RNA, 16 nt, Homo sapiens
aucaaagaacugaaag

SEQ ID NO: 1896483 - RNA, 20 nt, Homo sapiens
cugcucucggaggaugccua

SEQ ID NO: 1896484 - RNA, 12 nt, Homo sapiens
gcgugcacacac

SEQ ID NO: 1896485 - RNA, 12 nt, Homo sapiens
uguuacaauggu

SEQ ID NO: 1896486 - RNA, 20 nt, Homo sapiens
acuuggggauuucuggucaa

SEQ ID NO: 1896487 - RNA, 11 nt, Homo sapiens
ccagcugccag

SEQ ID NO: 1896488 - RNA, 11 nt, Homo sapiens
ccuaucugacu

SEQ ID NO: 1896489 - RNA, 15 nt, Homo sapiens
agcuuucucuaguuc

SEQ ID NO: 1896490 - RNA, 21 nt, Homo sapiens
acuuggacccaaaaaaucauc

SEQ ID NO: 1896491 - RNA, 15 nt, Homo sapiens
uucucucuucuccac

SEQ ID NO: 1896492 - RNA, 20 nt, Homo sapiens
ccuccagcucaugacacugu

SEQ ID NO: 1896493 - RNA, 14 nt, Homo sapiens
aaaauaauuguucc

SEQ ID NO: 1896494 - RNA, 20 nt, Homo sapiens
agaguaauccaagcaaaugu

SEQ ID NO: 1896495 - RNA, 20 nt, Homo sapiens
aaaugcugcuucuccuccca

SEQ ID NO: 1896496 - RNA, 20 nt, Homo sapiens
cuucccaggaguacacccca

SEQ ID NO: 1896497 - RNA, 15 nt, Homo sapiens
cuaugcugaguauuu

SEQ ID NO: 1896498 - RNA, 13 nt, Homo sapiens
cagggauggagau

SEQ ID NO: 1896499 - RNA, 21 nt, Homo sapiens
gagucaggaguuuuacugccu

SEQ ID NO: 1896500 - RNA, 17 nt, Homo sapiens
uagauccccccacugag

SEQ ID NO: 1896501 - RNA, 14 nt, Homo sapiens
ccuucuguuuucca

SEQ ID NO: 1896502 - RNA, 18 nt, Homo sapiens
augcuggggucauauaaa

SEQ ID NO: 1896503 - RNA, 18 nt, Homo sapiens
acuccuccuuuuacagaa

SEQ ID NO: 1896504 - RNA, 15 nt, Homo sapiens
cugaggaauaaagcu

SEQ ID NO: 1896505 - RNA, 15 nt, Homo sapiens
aaaccucaucucuac

SEQ ID NO: 1896506 - RNA, 13 nt, Homo sapiens
ccaguacugggaa

SEQ ID NO: 1896507 - RNA, 18 nt, Homo sapiens
aucaucuuaccugugcuu

SEQ ID NO: 1896508 - RNA, 14 nt, Homo sapiens
uuaucaucacaaau

SEQ ID NO: 1896509 - RNA, 12 nt, Homo sapiens
gagggugacaug

SEQ ID NO: 1896510 - RNA, 13 nt, Homo sapiens
agaaacugugguc

SEQ ID NO: 1896511 - RNA, 17 nt, Homo sapiens
gaucuuccguggucaga

SEQ ID NO: 1896512 - RNA, 19 nt, Homo sapiens
ggcagguaagggacuacca

SEQ ID NO: 1896513 - RNA, 13 nt, Homo sapiens
aagaaucuguuuc

SEQ ID NO: 1896514 - RNA, 14 nt, Homo sapiens
ucauugacugaugg

SEQ ID NO: 1896515 - RNA, 19 nt, Homo sapiens
aaaaauaaaaugcauuuaa

SEQ ID NO: 1896516 - RNA, 18 nt, Homo sapiens
guaguugcagcugaugcc

SEQ ID NO: 1896517 - RNA, 17 nt, Homo sapiens
ugguaucuacuucuaca

SEQ ID NO: 1896518 - RNA, 23 nt, Homo sapiens
uguuuaugguaauacacauauuu

SEQ ID NO: 1896519 - RNA, 15 nt, Homo sapiens
uaugcauuauaucaa

SEQ ID NO: 1896520 - RNA, 14 nt, Homo sapiens
ucagacaucuccag

SEQ ID NO: 1896521 - RNA, 11 nt, Homo sapiens
accuccucaug

SEQ ID NO: 1896522 - RNA, 19 nt, Homo sapiens
uaugccucucuacagucuc

SEQ ID NO: 1896523 - RNA, 22 nt, Homo sapiens
ugagaacagacguuaccaauua

SEQ ID NO: 1896524 - RNA, 17 nt, Homo sapiens
uuuggcuuacauuugaa

SEQ ID NO: 1896525 - RNA, 12 nt, Homo sapiens
uagcacagagag

SEQ ID NO: 1896526 - RNA, 10 nt, Homo sapiens
agggccaguc

SEQ ID NO: 1896527 - RNA, 13 nt, Homo sapiens
aagcugcuuuaaa

SEQ ID NO: 1896528 - RNA, 15 nt, Homo sapiens
cccuuggcugugagg

SEQ ID NO: 1896529 - RNA, 12 nt, Homo sapiens
aaaccucugccu

SEQ ID NO: 1896530 - RNA, 22 nt, Homo sapiens
aauuuauuuuuaccuucacugu

SEQ ID NO: 1896531 - RNA, 18 nt, Homo sapiens
ccauaucuuccaaccccc

SEQ ID NO: 1896532 - RNA, 14 nt, Homo sapiens
ugcaaauauuugau

SEQ ID NO: 1896533 - RNA, 20 nt, Homo sapiens
auugugaaugauucauguua

SEQ ID NO: 1896534 - RNA, 16 nt, Homo sapiens
cacgcucgcugccauc

SEQ ID NO: 1896535 - RNA, 19 nt, Homo sapiens
ugaaaguugucacccugga

SEQ ID NO: 1896536 - RNA, 20 nt, Homo sapiens
cugguuucccuuacagggcc

SEQ ID NO: 1896537 - RNA, 11 nt, Homo sapiens
uuuacauuuaa

SEQ ID NO: 1896538 - RNA, 18 nt, Homo sapiens
cuguccacuagaccagug

SEQ ID NO: 1896539 - RNA, 12 nt, Homo sapiens
cauccacuagcu

SEQ ID NO: 1896540 - RNA, 16 nt, Homo sapiens
ugcaagaagcuuuauu

SEQ ID NO: 1896541 - RNA, 21 nt, Homo sapiens
agaaaacauuguuccagauuc

SEQ ID NO: 1896542 - RNA, 19 nt, Homo sapiens
cagaagagaaaggacucag

SEQ ID NO: 1896543 - RNA, 13 nt, Homo sapiens
uauggcaaccauu

SEQ ID NO: 1896544 - RNA, 23 nt, Homo sapiens
cccagagguaacagaacagcuuc

SEQ ID NO: 1896545 - RNA, 22 nt, Homo sapiens
agccgccaggaccgccaaagaa

SEQ ID NO: 1896546 - RNA, 20 nt, Homo sapiens
ucauuaucucaaaacugcac

SEQ ID NO: 1896547 - RNA, 15 nt, Homo sapiens
auuuuacuaguccaa

SEQ ID NO: 1896548 - RNA, 23 nt, Homo sapiens
agggugcugacugucaagcaucc

SEQ ID NO: 1896549 - RNA, 23 nt, Homo sapiens
agggucuuccuccuaaauuucca

SEQ ID NO: 1896550 - RNA, 20 nt, Homo sapiens
uugaaggaguccuugcauca

SEQ ID NO: 1896551 - RNA, 17 nt, Homo sapiens
ugagcaaugugcacuuc

SEQ ID NO: 1896552 - RNA, 20 nt, Homo sapiens
uggucauccuuguuuucuaa

SEQ ID NO: 1896553 - RNA, 18 nt, Homo sapiens
uccuucugagccugccuu

SEQ ID NO: 1896554 - RNA, 23 nt, Homo sapiens
ggguaccuucaggcagccagugu

SEQ ID NO: 1896555 - RNA, 17 nt, Homo sapiens
uuaacuuacacugauca

SEQ ID NO: 1896556 - RNA, 15 nt, Homo sapiens
gaugaacgugccuga

SEQ ID NO: 1896557 - RNA, 15 nt, Homo sapiens
cugagucaucuguua

SEQ ID NO: 1896558 - RNA, 22 nt, Homo sapiens
uagaaauaucuaaggucauuaa

SEQ ID NO: 1896559 - RNA, 21 nt, Homo sapiens
aaucaugggauuuuacuagaa

SEQ ID NO: 1896560 - RNA, 19 nt, Homo sapiens
aaacaaggcgagcuugagu

SEQ ID NO: 1896561 - RNA, 16 nt, Homo sapiens
augaugaaaucccauc

SEQ ID NO: 1896562 - RNA, 15 nt, Homo sapiens
uagccuuugucccag

SEQ ID NO: 1896563 - RNA, 17 nt, Homo sapiens
acaugaggccacuggag

SEQ ID NO: 1896564 - RNA, 20 nt, Homo sapiens
cuagggcacuuuaagucagu

SEQ ID NO: 1896565 - RNA, 16 nt, Homo sapiens
acucaccaacuugcca

SEQ ID NO: 1896566 - RNA, 15 nt, Homo sapiens
aauaaaggcaccucc

SEQ ID NO: 1896567 - RNA, 18 nt, Homo sapiens
agccuuggcucuacccug

SEQ ID NO: 1896568 - RNA, 16 nt, Homo sapiens
aggggcugacucucca

SEQ ID NO: 1896569 - RNA, 17 nt, Homo sapiens
gagaccucuacugccuu

SEQ ID NO: 1896570 - RNA, 13 nt, Homo sapiens
uguggaauguugg

SEQ ID NO: 1896571 - RNA, 13 nt, Homo sapiens
gucauaauugcau

SEQ ID NO: 1896572 - RNA, 20 nt, Homo sapiens
agcugaaugccuccuguggg

SEQ ID NO: 1896573 - RNA, 19 nt, Homo sapiens
gaagaucaggccaacccca

SEQ ID NO: 1896574 - RNA, 21 nt, Homo sapiens
ucaaaccugcaaggcaaagua

SEQ ID NO: 1896575 - RNA, 16 nt, Homo sapiens
cagcgcgugcacagcg

SEQ ID NO: 1896576 - RNA, 21 nt, Homo sapiens
auguuccucccaggguuucca

SEQ ID NO: 1896577 - RNA, 19 nt, Homo sapiens
gccuguguacagaccuccg

SEQ ID NO: 1896578 - RNA, 14 nt, Homo sapiens
aauggucauccaaa

SEQ ID NO: 1896579 - RNA, 13 nt, Homo sapiens
cagguuucuuaaa

SEQ ID NO: 1896580 - RNA, 14 nt, Homo sapiens
aacaaauuagcaau

SEQ ID NO: 1896581 - RNA, 19 nt, Homo sapiens
auuuuaccaaagcaucaau

SEQ ID NO: 1896582 - RNA, 18 nt, Homo sapiens
caaaaaccauguugcguu

SEQ ID NO: 1896583 - RNA, 15 nt, Homo sapiens
ucauuaauucaauga

SEQ ID NO: 1896584 - RNA, 19 nt, Homo sapiens
cugucuccuuaacacugag

SEQ ID NO: 1896585 - RNA, 22 nt, Homo sapiens
gcagacagccguuuguucuaca

SEQ ID NO: 1896586 - RNA, 16 nt, Homo sapiens
uuuuaauaacauaucu

SEQ ID NO: 1896587 - RNA, 14 nt, Homo sapiens
ucacucacaaaagg

SEQ ID NO: 1896588 - RNA, 12 nt, Homo sapiens
ccucuucaaaau

SEQ ID NO: 1896589 - RNA, 16 nt, Homo sapiens
gacaagccuaacuuca

SEQ ID NO: 1896590 - RNA, 12 nt, Homo sapiens
ucucagcucacu

SEQ ID NO: 1896591 - RNA, 11 nt, Homo sapiens
ggcauaugcaa

SEQ ID NO: 1896592 - RNA, 15 nt, Homo sapiens
acacuuugagcauuu

SEQ ID NO: 1896593 - RNA, 15 nt, Homo sapiens
cuugugacauucacu

SEQ ID NO: 1896594 - RNA, 15 nt, Homo sapiens
gccccuagcuuuaua

SEQ ID NO: 1896595 - RNA, 16 nt, Homo sapiens
cagagccaauggugca

SEQ ID NO: 1896596 - RNA, 21 nt, Homo sapiens
uuaugaaaugccacugggaca

SEQ ID NO: 1896597 - RNA, 15 nt, Homo sapiens
ugucaugugagguua

SEQ ID NO: 1896598 - RNA, 22 nt, Homo sapiens
cagaaggugccacuuuacccac

SEQ ID NO: 1896599 - RNA, 15 nt, Homo sapiens
cuaauguuuugcuua

SEQ ID NO: 1896600 - RNA, 15 nt, Homo sapiens
gcuggccuugccaca

SEQ ID NO: 1896601 - RNA, 19 nt, Homo sapiens
aaauacuuagacaguaugc

SEQ ID NO: 1896602 - RNA, 14 nt, Homo sapiens
cuccauucugacca

SEQ ID NO: 1896603 - RNA, 16 nt, Homo sapiens
aacacugaaacuguau

SEQ ID NO: 1896604 - RNA, 20 nt, Homo sapiens
aaccugggaaccaugaagcu

SEQ ID NO: 1896605 - RNA, 17 nt, Homo sapiens
gcauauguuaguaggcu

SEQ ID NO: 1896606 - RNA, 21 nt, Homo sapiens
acccuguuucuggagucacau

SEQ ID NO: 1896607 - RNA, 14 nt, Homo sapiens
agacacgaaauugg

SEQ ID NO: 1896608 - RNA, 17 nt, Homo sapiens
uugaucuuugagcccau

SEQ ID NO: 1896609 - RNA, 17 nt, Homo sapiens
uccaucguccauccucu

SEQ ID NO: 1896610 - RNA, 14 nt, Homo sapiens
uagcuccuguuguc

SEQ ID NO: 1896611 - RNA, 17 nt, Homo sapiens
uuauccccguuucuugc

SEQ ID NO: 1896612 - RNA, 14 nt, Homo sapiens
aagguuaugcacug

SEQ ID NO: 1896613 - RNA, 15 nt, Homo sapiens
uacauucaacagaga

SEQ ID NO: 1896614 - RNA, 21 nt, Homo sapiens
ucaaugacuuaacagaacuca

SEQ ID NO: 1896615 - RNA, 21 nt, Homo sapiens
ugcaucccagcccacaucuca

SEQ ID NO: 1896616 - RNA, 18 nt, Homo sapiens
aagaaauggcauaaucuu

SEQ ID NO: 1896617 - RNA, 20 nt, Homo sapiens
aaguaaaaacacuaccucuu

SEQ ID NO: 1896618 - RNA, 13 nt, Homo sapiens
uauuuucuucacc

SEQ ID NO: 1896619 - RNA, 18 nt, Homo sapiens
ucaauacuuacauaucug

SEQ ID NO: 1896620 - RNA, 17 nt, Homo sapiens
cuaagagaaacugugua

SEQ ID NO: 1896621 - RNA, 13 nt, Homo sapiens
ccaucaggucacc

SEQ ID NO: 1896622 - RNA, 17 nt, Homo sapiens
gagcaggcuacugucag

SEQ ID NO: 1896623 - RNA, 14 nt, Homo sapiens
ccauaaugauggau

SEQ ID NO: 1896624 - RNA, 13 nt, Homo sapiens
cuccccacugccu

SEQ ID NO: 1896625 - RNA, 13 nt, Homo sapiens
caucuacuggaua

SEQ ID NO: 1896626 - RNA, 22 nt, Homo sapiens
ucuuccguggucagagugccac

SEQ ID NO: 1896627 - RNA, 18 nt, Homo sapiens
gacguugccaucaaaaca

SEQ ID NO: 1896628 - RNA, 14 nt, Homo sapiens
caccacucaaaaau

SEQ ID NO: 1896629 - RNA, 14 nt, Homo sapiens
ccacauucaccaac

SEQ ID NO: 1896630 - RNA, 21 nt, Homo sapiens
cuggcuaauuuuuuguacuuu

SEQ ID NO: 1896631 - RNA, 20 nt, Homo sapiens
acuguuuuguaagugcugcu

SEQ ID NO: 1896632 - RNA, 20 nt, Homo sapiens
ucgggacuugaaaaccacua

SEQ ID NO: 1896633 - RNA, 20 nt, Homo sapiens
uacaggaugaugacuaugga

SEQ ID NO: 1896634 - RNA, 22 nt, Homo sapiens
ugcauaggaauugcacaaucca

SEQ ID NO: 1896635 - RNA, 21 nt, Homo sapiens
cucugagcccgggucucuuca

SEQ ID NO: 1896636 - RNA, 16 nt, Homo sapiens
caaaugcuaaaugcaa

SEQ ID NO: 1896637 - RNA, 20 nt, Homo sapiens
ucaaaagaucuccugugcac

SEQ ID NO: 1896638 - RNA, 22 nt, Homo sapiens
agagcacacuuggcccaagugg

SEQ ID NO: 1896639 - RNA, 22 nt, Homo sapiens
agggguacauuucccugugcug

SEQ ID NO: 1896640 - RNA, 14 nt, Homo sapiens
auuacauaguuuga

SEQ ID NO: 1896641 - RNA, 23 nt, Homo sapiens
gucagggagccuggaagccaaac

SEQ ID NO: 1896642 - RNA, 13 nt, Homo sapiens
aaucucggcucau

SEQ ID NO: 1896643 - RNA, 15 nt, Homo sapiens
ccccuaccucuagua

SEQ ID NO: 1896644 - RNA, 15 nt, Homo sapiens
cuggcugcaauugca

SEQ ID NO: 1896645 - RNA, 16 nt, Homo sapiens
gauggccagagaugcu

SEQ ID NO: 1896646 - RNA, 23 nt, Homo sapiens
auucuucuucucaagcacugaca

SEQ ID NO: 1896647 - RNA, 22 nt, Homo sapiens
aagaaaugagaaauugugccaa

SEQ ID NO: 1896648 - RNA, 20 nt, Homo sapiens
gaggcaggggacaagggagg

SEQ ID NO: 1896649 - RNA, 13 nt, Homo sapiens
uauccaaucucau

SEQ ID NO: 1896650 - RNA, 22 nt, Homo sapiens
uaaggcuguccacguacuuaau

SEQ ID NO: 1896651 - RNA, 14 nt, Homo sapiens
ugucaagaggcaaa

SEQ ID NO: 1896652 - RNA, 13 nt, Homo sapiens
uugggucuuugaa

SEQ ID NO: 1896653 - RNA, 13 nt, Homo sapiens
uugagucuuugga

SEQ ID NO: 1896654 - RNA, 13 nt, Homo sapiens
cagagucucagga

SEQ ID NO: 1896655 - RNA, 20 nt, Homo sapiens
auguccccaaaguaccacac

SEQ ID NO: 1896656 - RNA, 15 nt, Homo sapiens
aaaagaagacauucu

SEQ ID NO: 1896657 - RNA, 19 nt, Homo sapiens
aacacagcaacaaugacuu

SEQ ID NO: 1896658 - RNA, 23 nt, Homo sapiens
aagacguaauaaaauuaacuggu

SEQ ID NO: 1896659 - RNA, 20 nt, Homo sapiens
cccuaggauaaaaagccagg

SEQ ID NO: 1896660 - RNA, 13 nt, Homo sapiens
cgagucuggagac

SEQ ID NO: 1896661 - RNA, 14 nt, Homo sapiens
aggggacgugggcc

SEQ ID NO: 1896662 - RNA, 17 nt, Homo sapiens
uauuauauuuauguugu

SEQ ID NO: 1896663 - RNA, 12 nt, Homo sapiens
cucaagugcccu

SEQ ID NO: 1896664 - RNA, 20 nt, Homo sapiens
acuucaguauguuuacuauu

SEQ ID NO: 1896665 - RNA, 18 nt, Homo sapiens
auuccgagugcagaaaag

SEQ ID NO: 1896666 - RNA, 16 nt, Homo sapiens
aguuccugugcacagc

SEQ ID NO: 1896667 - RNA, 16 nt, Homo sapiens
auguacuauguguuaa

SEQ ID NO: 1896668 - RNA, 17 nt, Homo sapiens
auucucacaucccucua

SEQ ID NO: 1896669 - RNA, 23 nt, Homo sapiens
ucaaagcccccacuucucuccag

SEQ ID NO: 1896670 - RNA, 14 nt, Homo sapiens
agucagccacuggg

SEQ ID NO: 1896671 - RNA, 20 nt, Homo sapiens
cuuggugcauaagcacagaa

SEQ ID NO: 1896672 - RNA, 17 nt, Homo sapiens
caggcccagcugcuccc

SEQ ID NO: 1896673 - RNA, 23 nt, Homo sapiens
aaacuuuaggguaaaaauugcca

SEQ ID NO: 1896674 - RNA, 21 nt, Homo sapiens
uugcuuccuuugggagcucau

SEQ ID NO: 1896675 - RNA, 16 nt, Homo sapiens
ucuagauaacauucau

SEQ ID NO: 1896676 - RNA, 13 nt, Homo sapiens
ccagggguucuga

SEQ ID NO: 1896677 - RNA, 22 nt, Homo sapiens
guauuuggcuugucacaggaau

SEQ ID NO: 1896678 - RNA, 19 nt, Homo sapiens
caggccagcaauaaaaacu

SEQ ID NO: 1896679 - RNA, 12 nt, Homo sapiens
aagugcauucaa

SEQ ID NO: 1896680 - RNA, 21 nt, Homo sapiens
ugagaagcucagcugccuucc

SEQ ID NO: 1896681 - RNA, 20 nt, Homo sapiens
ucagguacagcgggcugugc

SEQ ID NO: 1896682 - RNA, 16 nt, Homo sapiens
ugaacuaaacuuucac

SEQ ID NO: 1896683 - RNA, 15 nt, Homo sapiens
agccaaggccgcugu

SEQ ID NO: 1896684 - RNA, 14 nt, Homo sapiens
agaucuacacaugu

SEQ ID NO: 1896685 - RNA, 19 nt, Homo sapiens
gcccucccagcccauugcu

SEQ ID NO: 1896686 - RNA, 20 nt, Homo sapiens
acauagaauuaacacaugau

SEQ ID NO: 1896687 - RNA, 18 nt, Homo sapiens
caagaccucugugcacuu

SEQ ID NO: 1896688 - RNA, 18 nt, Homo sapiens
gguuccuggugacuccug

SEQ ID NO: 1896689 - RNA, 13 nt, Homo sapiens
uguuaagugcagg

SEQ ID NO: 1896690 - RNA, 15 nt, Homo sapiens
caacaaaagaagccc

SEQ ID NO: 1896691 - RNA, 17 nt, Homo sapiens
ucgaugcguauucugug

SEQ ID NO: 1896692 - RNA, 23 nt, Homo sapiens
ugguugaggggccacaccaccua

SEQ ID NO: 1896693 - RNA, 13 nt, Homo sapiens
aggcaaaaagaca

SEQ ID NO: 1896694 - RNA, 20 nt, Homo sapiens
acugaggcagacagcagcuc

SEQ ID NO: 1896695 - RNA, 17 nt, Homo sapiens
uagaaaguaauacaaua

SEQ ID NO: 1896696 - RNA, 23 nt, Homo sapiens
uaggaacaaucuuugcuguauac

SEQ ID NO: 1896697 - RNA, 23 nt, Homo sapiens
ccugagucccaucccugcgugau

SEQ ID NO: 1896698 - RNA, 19 nt, Homo sapiens
agugggaggugagaccacc

SEQ ID NO: 1896699 - RNA, 16 nt, Homo sapiens
ucguuuugaugccauu

SEQ ID NO: 1896700 - RNA, 14 nt, Homo sapiens
agacagaacuugaa

SEQ ID NO: 1896701 - RNA, 13 nt, Homo sapiens
uguagggaacucu

SEQ ID NO: 1896702 - RNA, 15 nt, Homo sapiens
aauuuacacugccau

SEQ ID NO: 1896703 - RNA, 19 nt, Homo sapiens
uaaaaaguuugaauagaaa

SEQ ID NO: 1896704 - RNA, 20 nt, Homo sapiens
cuaucaaagcuucaaaaacu

SEQ ID NO: 1896705 - RNA, 23 nt, Homo sapiens
ggacugccucugccacacucuga

SEQ ID NO: 1896706 - RNA, 15 nt, Homo sapiens
gcuuugucauugggc

SEQ ID NO: 1896707 - RNA, 19 nt, Homo sapiens
cuguauuucgaaugagucu

SEQ ID NO: 1896708 - RNA, 22 nt, Homo sapiens
uuuuuaucauaaaugcagaaua

SEQ ID NO: 1896709 - RNA, 20 nt, Homo sapiens
aauaaugaaugaaccaucuu

SEQ ID NO: 1896710 - RNA, 22 nt, Homo sapiens
aaacuuucucuuugccauuucu

SEQ ID NO: 1896711 - RNA, 16 nt, Homo sapiens
auucuggaccucuggg

SEQ ID NO: 1896712 - RNA, 20 nt, Homo sapiens
gaaaauauguaacuggaauc

SEQ ID NO: 1896713 - RNA, 14 nt, Homo sapiens
aaagagaacuucca

SEQ ID NO: 1896714 - RNA, 19 nt, Homo sapiens
aaacaaaaccaacucagac

SEQ ID NO: 1896715 - RNA, 14 nt, Homo sapiens
ucugugugugaugu

SEQ ID NO: 1896716 - RNA, 21 nt, Homo sapiens
aaaauccuucuaaucugcuau

SEQ ID NO: 1896717 - RNA, 20 nt, Homo sapiens
guggcugccugcaccccagg

SEQ ID NO: 1896718 - RNA, 13 nt, Homo sapiens
agccagucaggca

SEQ ID NO: 1896719 - RNA, 16 nt, Homo sapiens
aagacagcagaacugc

SEQ ID NO: 1896720 - RNA, 20 nt, Homo sapiens
ucauuagcaguugcucacau

SEQ ID NO: 1896721 - RNA, 15 nt, Homo sapiens
uacaggacauucuca

SEQ ID NO: 1896722 - RNA, 17 nt, Homo sapiens
agcccuguugaccugcc

SEQ ID NO: 1896723 - RNA, 22 nt, Homo sapiens
gucacagacgugaaagccagaa

SEQ ID NO: 1896724 - RNA, 16 nt, Homo sapiens
ucuuaugcaggacuga

SEQ ID NO: 1896725 - RNA, 20 nt, Homo sapiens
gcuggagaaaccuucacucc

SEQ ID NO: 1896726 - RNA, 14 nt, Homo sapiens
cgugccaguguccc

SEQ ID NO: 1896727 - RNA, 13 nt, Homo sapiens
gcugugcuguauu

SEQ ID NO: 1896728 - RNA, 13 nt, Homo sapiens
ggcagaagggaac

SEQ ID NO: 1896729 - RNA, 17 nt, Homo sapiens
aaaauuauaguagcuua

SEQ ID NO: 1896730 - RNA, 18 nt, Homo sapiens
acugaccuuguagcuaua

SEQ ID NO: 1896731 - RNA, 20 nt, Homo sapiens
aucauguggcccaacucucc

SEQ ID NO: 1896732 - RNA, 17 nt, Homo sapiens
cgaaagaggugaaagag

SEQ ID NO: 1896733 - RNA, 20 nt, Homo sapiens
aguaaaaucaaaugugcauc

SEQ ID NO: 1896734 - RNA, 23 nt, Homo sapiens
aucuugcauccaaaccuguaacc

SEQ ID NO: 1896735 - RNA, 15 nt, Homo sapiens
gccauugcacuccag

SEQ ID NO: 1896736 - RNA, 19 nt, Homo sapiens
ucaaugugcuguugauucu

SEQ ID NO: 1896737 - RNA, 19 nt, Homo sapiens
uauaacuucuguacaguaa

SEQ ID NO: 1896738 - RNA, 12 nt, Homo sapiens
ccaccaccccua

SEQ ID NO: 1896739 - RNA, 18 nt, Homo sapiens
cuugagauaguaacaaca

SEQ ID NO: 1896740 - RNA, 17 nt, Homo sapiens
gcccauauggucaucca

SEQ ID NO: 1896741 - RNA, 13 nt, Homo sapiens
gagcccucaggag

SEQ ID NO: 1896742 - RNA, 15 nt, Homo sapiens
uaacagccucuugcc

SEQ ID NO: 1896743 - RNA, 20 nt, Homo sapiens
gaugccaaaaaagaugccaa

SEQ ID NO: 1896744 - RNA, 15 nt, Homo sapiens
gaggcugugucagaa

SEQ ID NO: 1896745 - RNA, 22 nt, Homo sapiens
aauaaucauucuuuccccucag

SEQ ID NO: 1896746 - RNA, 17 nt, Homo sapiens
gaagauagaacaaugcu

SEQ ID NO: 1896747 - RNA, 16 nt, Homo sapiens
gaaauuuuaagccaaa

SEQ ID NO: 1896748 - RNA, 19 nt, Homo sapiens
aggauuuuugagcacaaaa

SEQ ID NO: 1896749 - RNA, 15 nt, Homo sapiens
gaaaggcacauguca

SEQ ID NO: 1896750 - RNA, 17 nt, Homo sapiens
cugaaucugaccacaga

SEQ ID NO: 1896751 - RNA, 14 nt, Homo sapiens
gguuuagaucaaau

SEQ ID NO: 1896752 - RNA, 23 nt, Homo sapiens
aggaaaugaugagaaauauuaaa

SEQ ID NO: 1896753 - RNA, 20 nt, Homo sapiens
gccagcaucugcagccacuu

SEQ ID NO: 1896754 - RNA, 13 nt, Homo sapiens
accacagcugcag

SEQ ID NO: 1896755 - RNA, 13 nt, Homo sapiens
ugaugagcacauc

SEQ ID NO: 1896756 - RNA, 17 nt, Homo sapiens
augaugguggucaucca

SEQ ID NO: 1896757 - RNA, 12 nt, Homo sapiens
ugcucuguggcu

SEQ ID NO: 1896758 - RNA, 12 nt, Homo sapiens
ugaacuguggaa

SEQ ID NO: 1896759 - RNA, 18 nt, Homo sapiens
uuagucgucuaaacauaa

SEQ ID NO: 1896760 - RNA, 15 nt, Homo sapiens
aaggccacaggcagu

SEQ ID NO: 1896761 - RNA, 12 nt, Homo sapiens
cugugaugacau

SEQ ID NO: 1896762 - RNA, 12 nt, Homo sapiens
ugucucagugaa

SEQ ID NO: 1896763 - RNA, 16 nt, Homo sapiens
aauguuuguaagcaau

SEQ ID NO: 1896764 - RNA, 14 nt, Homo sapiens
uaagucauguauau

SEQ ID NO: 1896765 - RNA, 14 nt, Homo sapiens
gaagauauuuauuc

SEQ ID NO: 1896766 - RNA, 18 nt, Homo sapiens
caaguuccagugcagaga

SEQ ID NO: 1896767 - RNA, 23 nt, Homo sapiens
accuucacgauuaacugugaaau

SEQ ID NO: 1896768 - RNA, 17 nt, Homo sapiens
ccuaggucaugccuccu

SEQ ID NO: 1896769 - RNA, 23 nt, Homo sapiens
ugagacucugucuggauuugccu

SEQ ID NO: 1896770 - RNA, 22 nt, Homo sapiens
ucuuagaguccagacacaaaga

SEQ ID NO: 1896771 - RNA, 15 nt, Homo sapiens
uacagagaagccauc

SEQ ID NO: 1896772 - RNA, 12 nt, Homo sapiens
acgaaagcacag

SEQ ID NO: 1896773 - RNA, 20 nt, Homo sapiens
uccaacguggggcagcacag

SEQ ID NO: 1896774 - RNA, 22 nt, Homo sapiens
ccagcugugcacuuucuucucu

SEQ ID NO: 1896775 - RNA, 17 nt, Homo sapiens
uucccugggccucagcc

SEQ ID NO: 1896776 - RNA, 15 nt, Homo sapiens
guaaggugagggaau

SEQ ID NO: 1896777 - RNA, 21 nt, Homo sapiens
ugcccagcccggaccuuggca

SEQ ID NO: 1896778 - RNA, 23 nt, Homo sapiens
ugcuuuuuuuuuuugguccaaaa

SEQ ID NO: 1896779 - RNA, 21 nt, Homo sapiens
cguguguugcaccaggcacug

SEQ ID NO: 1896780 - RNA, 20 nt, Homo sapiens
gauggagucuugcucuguca

SEQ ID NO: 1896781 - RNA, 19 nt, Homo sapiens
acccuguggggccugaugg

SEQ ID NO: 1896782 - RNA, 14 nt, Homo sapiens
agaagccuugccau

SEQ ID NO: 1896783 - RNA, 14 nt, Homo sapiens
cccaggcagcaccu

SEQ ID NO: 1896784 - RNA, 13 nt, Homo sapiens
uuagugacuucaa

SEQ ID NO: 1896785 - RNA, 23 nt, Homo sapiens
cagcacuuugggaggucaagaug

SEQ ID NO: 1896786 - RNA, 19 nt, Homo sapiens
uaaaaacagacucuucuug

SEQ ID NO: 1896787 - RNA, 14 nt, Homo sapiens
gcauggggugggcc

SEQ ID NO: 1896788 - RNA, 12 nt, Homo sapiens
gcagcaaggccc

SEQ ID NO: 1896789 - RNA, 13 nt, Homo sapiens
ugaucugcacauu

SEQ ID NO: 1896790 - RNA, 13 nt, Homo sapiens
agcccugcucccu

SEQ ID NO: 1896791 - RNA, 20 nt, Homo sapiens
ucccgggcacugucaugccc

SEQ ID NO: 1896792 - RNA, 15 nt, Homo sapiens
gcagacucgggacca

SEQ ID NO: 1896793 - RNA, 15 nt, Homo sapiens
aagaagcugugaaua

SEQ ID NO: 1896794 - RNA, 17 nt, Homo sapiens
ucccacuucagugcacc

SEQ ID NO: 1896795 - RNA, 14 nt, Homo sapiens
uccuggaauugcca

SEQ ID NO: 1896796 - RNA, 15 nt, Homo sapiens
cucuaaacauuucau

SEQ ID NO: 1896797 - RNA, 15 nt, Homo sapiens
auuuaauccucucaa

SEQ ID NO: 1896798 - RNA, 22 nt, Homo sapiens
gcugcuucuuauuaaucauaca

SEQ ID NO: 1896799 - RNA, 14 nt, Homo sapiens
acauaugugcagaa

SEQ ID NO: 1896800 - RNA, 15 nt, Homo sapiens
cacauugugccuuuu

SEQ ID NO: 1896801 - RNA, 15 nt, Homo sapiens
cacucuuugccacug

SEQ ID NO: 1896802 - RNA, 20 nt, Homo sapiens
ucccucucccggcaacaucu

SEQ ID NO: 1896803 - RNA, 16 nt, Homo sapiens
acauauaaaugaaucu

SEQ ID NO: 1896804 - RNA, 22 nt, Homo sapiens
acaagaguggagagaagcucuu

SEQ ID NO: 1896805 - RNA, 19 nt, Homo sapiens
guacucaggcagugcagua

SEQ ID NO: 1896806 - RNA, 14 nt, Homo sapiens
aaaagucagcauuu

SEQ ID NO: 1896807 - RNA, 22 nt, Homo sapiens
ucauuuucuguuauacacaguu

SEQ ID NO: 1896808 - RNA, 22 nt, Homo sapiens
gcccucagggcagggauacaaa

SEQ ID NO: 1896809 - RNA, 17 nt, Homo sapiens
accaggagugccuucau

SEQ ID NO: 1896810 - RNA, 21 nt, Homo sapiens
uuccugggcaagaaccuaaag

SEQ ID NO: 1896811 - RNA, 15 nt, Homo sapiens
cagccaaaccuuucc

SEQ ID NO: 1896812 - RNA, 14 nt, Homo sapiens
cccugcaauuacuu

SEQ ID NO: 1896813 - RNA, 16 nt, Homo sapiens
acuuuggcaauuuccu

SEQ ID NO: 1896814 - RNA, 19 nt, Homo sapiens
uggaagugacauuguguca

SEQ ID NO: 1896815 - RNA, 14 nt, Homo sapiens
uuguccuccuaaua

SEQ ID NO: 1896816 - RNA, 21 nt, Homo sapiens
uggccaccccuccccaguaca

SEQ ID NO: 1896817 - RNA, 12 nt, Homo sapiens
uauuaagcacuu

SEQ ID NO: 1896818 - RNA, 23 nt, Homo sapiens
cuuaaugguaggucaaguaauaa

SEQ ID NO: 1896819 - RNA, 20 nt, Homo sapiens
agcaaaggaaaccaaaggaa

SEQ ID NO: 1896820 - RNA, 16 nt, Homo sapiens
ucauaagggcacugag

SEQ ID NO: 1896821 - RNA, 20 nt, Homo sapiens
auuugugcuaccccuuugau

SEQ ID NO: 1896822 - RNA, 14 nt, Homo sapiens
aguucaugcauugg

SEQ ID NO: 1896823 - RNA, 21 nt, Homo sapiens
uguaucuugcauucacacuca

SEQ ID NO: 1896824 - RNA, 17 nt, Homo sapiens
gaacagccacuccccuc

SEQ ID NO: 1896825 - RNA, 18 nt, Homo sapiens
aauuuucgacuugacuuu

SEQ ID NO: 1896826 - RNA, 23 nt, Homo sapiens
aggaaggaaauaaucaucuaaga

SEQ ID NO: 1896827 - RNA, 15 nt, Homo sapiens
ugccuucucuucuau

SEQ ID NO: 1896828 - RNA, 18 nt, Homo sapiens
aggagaaguauuccuguu

SEQ ID NO: 1896829 - RNA, 11 nt, Homo sapiens
agacuugccuu

SEQ ID NO: 1896830 - RNA, 23 nt, Homo sapiens
ugugugcaucaugucucuuugcc

SEQ ID NO: 1896831 - RNA, 18 nt, Homo sapiens
gugagaagggcucagaga

SEQ ID NO: 1896832 - RNA, 17 nt, Homo sapiens
caaagcuuuauuucaaa

SEQ ID NO: 1896833 - RNA, 13 nt, Homo sapiens
ugcauguaugugu

SEQ ID NO: 1896834 - RNA, 15 nt, Homo sapiens
ccauaaugagaugug

SEQ ID NO: 1896835 - RNA, 19 nt, Homo sapiens
aaacugaggcccuugggca

SEQ ID NO: 1896836 - RNA, 17 nt, Homo sapiens
agacacauuuacacuag

SEQ ID NO: 1896837 - RNA, 17 nt, Homo sapiens
cauucucaauacuugaa

SEQ ID NO: 1896838 - RNA, 17 nt, Homo sapiens
acucaggaggcugagac

SEQ ID NO: 1896839 - RNA, 14 nt, Homo sapiens
caggacaaugucug

SEQ ID NO: 1896840 - RNA, 14 nt, Homo sapiens
gccuaccccaguuc

SEQ ID NO: 1896841 - RNA, 14 nt, Homo sapiens
caauuccguggcaa

SEQ ID NO: 1896842 - RNA, 14 nt, Homo sapiens
acagaaacacugcc

SEQ ID NO: 1896843 - RNA, 14 nt, Homo sapiens
cuuucaaccuauac

SEQ ID NO: 1896844 - RNA, 15 nt, Homo sapiens
cccaaagcucugaau

SEQ ID NO: 1896845 - RNA, 23 nt, Homo sapiens
uaaaaauuguagcuuuuuauuaa

SEQ ID NO: 1896846 - RNA, 22 nt, Homo sapiens
guuuuuaaauagaguuugcuau

SEQ ID NO: 1896847 - RNA, 18 nt, Homo sapiens
aauaagaaaaaccaaaau

SEQ ID NO: 1896848 - RNA, 19 nt, Homo sapiens
cagauuuaagcaagaccau

SEQ ID NO: 1896849 - RNA, 22 nt, Homo sapiens
auuaaaagaauggacugugcag

SEQ ID NO: 1896850 - RNA, 21 nt, Homo sapiens
uccggcaaugcccugugcaug

SEQ ID NO: 1896851 - RNA, 19 nt, Homo sapiens
acaguuuugguugcuuuaa

SEQ ID NO: 1896852 - RNA, 17 nt, Homo sapiens
aaggaacacuggcuuga

SEQ ID NO: 1896853 - RNA, 16 nt, Homo sapiens
auguguguguguugug

SEQ ID NO: 1896854 - RNA, 12 nt, Homo sapiens
ugaacacucccc

SEQ ID NO: 1896855 - RNA, 22 nt, Homo sapiens
aucagagcccagggaagacaca

SEQ ID NO: 1896856 - RNA, 23 nt, Homo sapiens
acauaccucucaacuuacauaug

SEQ ID NO: 1896857 - RNA, 19 nt, Homo sapiens
ggaagacaacccaggcagu

SEQ ID NO: 1896858 - RNA, 16 nt, Homo sapiens
uucucaaagucucaua

SEQ ID NO: 1896859 - RNA, 23 nt, Homo sapiens
cucugaccuccuccuucauggca

SEQ ID NO: 1896860 - RNA, 24 nt, Homo sapiens
cacccugcauuugugucauugaca

SEQ ID NO: 1896861 - RNA, 20 nt, Homo sapiens
uuaaguuauugauguuuuaa

SEQ ID NO: 1896862 - RNA, 16 nt, Homo sapiens
auguaaccuacaauuc

SEQ ID NO: 1896863 - RNA, 16 nt, Homo sapiens
ugcaugagaacuaaau

SEQ ID NO: 1896864 - RNA, 21 nt, Homo sapiens
gaauauuaauaaaacuuuaug

SEQ ID NO: 1896865 - RNA, 23 nt, Homo sapiens
accuuccugggcagcccagagag

SEQ ID NO: 1896866 - RNA, 12 nt, Homo sapiens
cuaagugacaca

SEQ ID NO: 1896867 - RNA, 21 nt, Homo sapiens
caguauguuuguuucauugug

SEQ ID NO: 1896868 - RNA, 22 nt, Homo sapiens
gccaugaggccuuuccccagug

SEQ ID NO: 1896869 - RNA, 13 nt, Homo sapiens
aaaaaguccagau

SEQ ID NO: 1896870 - RNA, 15 nt, Homo sapiens
ccaacuccauucucu

SEQ ID NO: 1896871 - RNA, 17 nt, Homo sapiens
gacauuuuaagcauuuu

SEQ ID NO: 1896872 - RNA, 14 nt, Homo sapiens
ccugauacugggua

SEQ ID NO: 1896873 - RNA, 13 nt, Homo sapiens
aacauacaagaga

SEQ ID NO: 1896874 - RNA, 19 nt, Homo sapiens
ucauuaguugaaagggaua

SEQ ID NO: 1896875 - RNA, 21 nt, Homo sapiens
gcucuguauucugcaacagcc

SEQ ID NO: 1896876 - RNA, 22 nt, Homo sapiens
cuguaaauaugucacuagagaa

SEQ ID NO: 1896877 - RNA, 22 nt, Homo sapiens
aacccucuugccauccugaugg

SEQ ID NO: 1896878 - RNA, 16 nt, Homo sapiens
agcugaaagauugauu

SEQ ID NO: 1896879 - RNA, 15 nt, Homo sapiens
uccuuucacucugca

SEQ ID NO: 1896880 - RNA, 14 nt, Homo sapiens
aacccgacaugugu

SEQ ID NO: 1896881 - RNA, 16 nt, Homo sapiens
uuacacugccuguaua

SEQ ID NO: 1896882 - RNA, 20 nt, Homo sapiens
guauucaaauuugugucaua

SEQ ID NO: 1896883 - RNA, 20 nt, Homo sapiens
augugagagauucugugauc

SEQ ID NO: 1896884 - RNA, 11 nt, Homo sapiens
aucauguuugu

SEQ ID NO: 1896885 - RNA, 24 nt, Homo sapiens
ggguaccucuggcacccaucugca

SEQ ID NO: 1896886 - RNA, 21 nt, Homo sapiens
aggcuucaguuuuacucugcu

SEQ ID NO: 1896887 - RNA, 20 nt, Homo sapiens
cagagcugggggcugaggga

SEQ ID NO: 1896888 - RNA, 17 nt, Homo sapiens
ucuuucuggaaaggaaa

SEQ ID NO: 1896889 - RNA, 19 nt, Homo sapiens
uaguccggacccaccucac

SEQ ID NO: 1896890 - RNA, 15 nt, Homo sapiens
caaggggacaucuua

SEQ ID NO: 1896891 - RNA, 15 nt, Homo sapiens
aucuaguugucaaua

SEQ ID NO: 1896892 - RNA, 20 nt, Homo sapiens
cucuuuugagacuuugccca

SEQ ID NO: 1896893 - RNA, 14 nt, Homo sapiens
acuugcguccugca

SEQ ID NO: 1896894 - RNA, 15 nt, Homo sapiens
ugauccagcucagaa

SEQ ID NO: 1896895 - RNA, 21 nt, Homo sapiens
agggaauaguauagacaauaa

SEQ ID NO: 1896896 - RNA, 20 nt, Homo sapiens
cuuccagccugggacacaca

SEQ ID NO: 1896897 - RNA, 15 nt, Homo sapiens
caugauaaacauuca

SEQ ID NO: 1896898 - RNA, 16 nt, Homo sapiens
uguuguuggguggcag

SEQ ID NO: 1896899 - RNA, 16 nt, Homo sapiens
gcugggauugugggca

SEQ ID NO: 1896900 - RNA, 23 nt, Homo sapiens
acauggacucagagaaaagagau

SEQ ID NO: 1896901 - RNA, 22 nt, Homo sapiens
acggggcuugcaacuuagcuca

SEQ ID NO: 1896902 - RNA, 19 nt, Homo sapiens
gauuuuuuuaauagugcuu

SEQ ID NO: 1896903 - RNA, 16 nt, Homo sapiens
auuucuuauagucaau

SEQ ID NO: 1896904 - RNA, 20 nt, Homo sapiens
uaugugacugugacuuucaa

SEQ ID NO: 1896905 - RNA, 18 nt, Homo sapiens
ccguccuggcacagaaga

SEQ ID NO: 1896906 - RNA, 17 nt, Homo sapiens
accuaaacccucuguga

SEQ ID NO: 1896907 - RNA, 16 nt, Homo sapiens
guuaaaucuuuuggca

SEQ ID NO: 1896908 - RNA, 20 nt, Homo sapiens
cuauguaaacaaaaagggaa

SEQ ID NO: 1896909 - RNA, 17 nt, Homo sapiens
ucucaggugccagucuu

SEQ ID NO: 1896910 - RNA, 16 nt, Homo sapiens
cuguuuaaauugcuca

SEQ ID NO: 1896911 - RNA, 18 nt, Homo sapiens
ugugucagggaacauauu

SEQ ID NO: 1896912 - RNA, 21 nt, Homo sapiens
acucauuuccaaucauacaaa

SEQ ID NO: 1896913 - RNA, 16 nt, Homo sapiens
ucugugggaaaaaaga

SEQ ID NO: 1896914 - RNA, 14 nt, Homo sapiens
gggcugcccugcca

SEQ ID NO: 1896915 - RNA, 18 nt, Homo sapiens
auguguccccucacucug

SEQ ID NO: 1896916 - RNA, 17 nt, Homo sapiens
augacccuuugccuguu

SEQ ID NO: 1896917 - RNA, 21 nt, Homo sapiens
cuuccuucuuuauugccccuu

SEQ ID NO: 1896918 - RNA, 16 nt, Homo sapiens
agagggauauagugaa

SEQ ID NO: 1896919 - RNA, 16 nt, Homo sapiens
aauuauguguugccaa

SEQ ID NO: 1896920 - RNA, 14 nt, Homo sapiens
caaaggagcuuucu

SEQ ID NO: 1896921 - RNA, 14 nt, Homo sapiens
uucauaguaguuac

SEQ ID NO: 1896922 - RNA, 15 nt, Homo sapiens
agguguguugaauug

SEQ ID NO: 1896923 - RNA, 17 nt, Homo sapiens
uaucuccuccccuugaa

SEQ ID NO: 1896924 - RNA, 17 nt, Homo sapiens
gacuuccuuacuaagca

SEQ ID NO: 1896925 - RNA, 16 nt, Homo sapiens
auagguaugagccagg

SEQ ID NO: 1896926 - RNA, 14 nt, Homo sapiens
auugugccaagccu

SEQ ID NO: 1896927 - RNA, 17 nt, Homo sapiens
ugauaggaggacaacca

SEQ ID NO: 1896928 - RNA, 22 nt, Homo sapiens
aggugggugugggacaccuggg

SEQ ID NO: 1896929 - RNA, 17 nt, Homo sapiens
gaauuuuuuucugcaca

SEQ ID NO: 1896930 - RNA, 17 nt, Homo sapiens
ggaaaagaaacacgcac

SEQ ID NO: 1896931 - RNA, 20 nt, Homo sapiens
cauugggaaaggacagcuuu

SEQ ID NO: 1896932 - RNA, 14 nt, Homo sapiens
guacaauaaucucu

SEQ ID NO: 1896933 - RNA, 15 nt, Homo sapiens
uccugaccucaggug

SEQ ID NO: 1896934 - RNA, 12 nt, Homo sapiens
cccucacuggcu

SEQ ID NO: 1896935 - RNA, 15 nt, Homo sapiens
guguaccauucucag

SEQ ID NO: 1896936 - RNA, 12 nt, Homo sapiens
ucuuuugccuuu

SEQ ID NO: 1896937 - RNA, 16 nt, Homo sapiens
agcccccuacugagaa

SEQ ID NO: 1896938 - RNA, 22 nt, Homo sapiens
uccagagaccccaggaacaaua

SEQ ID NO: 1896939 - RNA, 23 nt, Homo sapiens
uagcuauauuuuuucuuuugaca

SEQ ID NO: 1896940 - RNA, 15 nt, Homo sapiens
cccaggguacacucu

SEQ ID NO: 1896941 - RNA, 21 nt, Homo sapiens
cagccucuaagcgugcugaca

SEQ ID NO: 1896942 - RNA, 19 nt, Homo sapiens
ggacuguguuuuuccuaug

SEQ ID NO: 1896943 - RNA, 17 nt, Homo sapiens
agugcugggauuacaau

SEQ ID NO: 1896944 - RNA, 21 nt, Homo sapiens
caccuagcugugcaagaccua

SEQ ID NO: 1896945 - RNA, 22 nt, Homo sapiens
auuuacuacuauuaagguaaau

SEQ ID NO: 1896946 - RNA, 18 nt, Homo sapiens
auauuguugaacacuuga

SEQ ID NO: 1896947 - RNA, 18 nt, Homo sapiens
guauuguggaacacugaa

SEQ ID NO: 1896948 - RNA, 15 nt, Homo sapiens
uggcuccugccuuga

SEQ ID NO: 1896949 - RNA, 20 nt, Homo sapiens
gaaaucaacuugcuuaucaa

SEQ ID NO: 1896950 - RNA, 17 nt, Homo sapiens
gaaaaaugaaaagcaau

SEQ ID NO: 1896951 - RNA, 18 nt, Homo sapiens
auccuauaagaugacaau

SEQ ID NO: 1896952 - RNA, 22 nt, Homo sapiens
gccuuuucuggucccucuucuc

SEQ ID NO: 1896953 - RNA, 20 nt, Homo sapiens
gggggucucaccauguugcc

SEQ ID NO: 1896954 - RNA, 19 nt, Homo sapiens
caccguggggaaggggugc

SEQ ID NO: 1896955 - RNA, 17 nt, Homo sapiens
guggaaaguggugcaug

SEQ ID NO: 1896956 - RNA, 21 nt, Homo sapiens
gcgccaggauggaacacggcc

SEQ ID NO: 1896957 - RNA, 13 nt, Homo sapiens
ugucccuaaacau

SEQ ID NO: 1896958 - RNA, 16 nt, Homo sapiens
caguaaucccagugac

SEQ ID NO: 1896959 - RNA, 19 nt, Homo sapiens
guauauuuaauuuugacau

SEQ ID NO: 1896960 - RNA, 14 nt, Homo sapiens
agcccuggugcugu

SEQ ID NO: 1896961 - RNA, 22 nt, Homo sapiens
uacugcaagguucaacuuauua

SEQ ID NO: 1896962 - RNA, 22 nt, Homo sapiens
agggguauuaaaacagaacugu

SEQ ID NO: 1896963 - RNA, 13 nt, Homo sapiens
ugauucccagaaa

SEQ ID NO: 1896964 - RNA, 20 nt, Homo sapiens
acccuguaccauccauggag

SEQ ID NO: 1896965 - RNA, 18 nt, Homo sapiens
uaacaggcauugcacuaa

SEQ ID NO: 1896966 - RNA, 14 nt, Homo sapiens
gugccgacacuguu

SEQ ID NO: 1896967 - RNA, 21 nt, Homo sapiens
acaugcauggcauuuguucca

SEQ ID NO: 1896968 - RNA, 23 nt, Homo sapiens
aaucaagaaauaugaagcacuuu

SEQ ID NO: 1896969 - RNA, 15 nt, Homo sapiens
accuccucagggaug

SEQ ID NO: 1896970 - RNA, 16 nt, Homo sapiens
acauccaacuccagca

SEQ ID NO: 1896971 - RNA, 14 nt, Homo sapiens
uaaaauagccauaa

SEQ ID NO: 1896972 - RNA, 14 nt, Homo sapiens
ccuaaaaguauuau

SEQ ID NO: 1896973 - RNA, 15 nt, Homo sapiens
cccagaaggaccucc

SEQ ID NO: 1896974 - RNA, 19 nt, Homo sapiens
uaacuagacuaagaagauu

SEQ ID NO: 1896975 - RNA, 19 nt, Homo sapiens
guuuaaaguggcaaucuca

SEQ ID NO: 1896976 - RNA, 14 nt, Homo sapiens
ucuggagccagaga

SEQ ID NO: 1896977 - RNA, 17 nt, Homo sapiens
cuuugcagccccacaga

SEQ ID NO: 1896978 - RNA, 19 nt, Homo sapiens
auagaagaugggaaaacca

SEQ ID NO: 1896979 - RNA, 20 nt, Homo sapiens
gcuaacuguguguacauaua

SEQ ID NO: 1896980 - RNA, 21 nt, Homo sapiens
agaccuuuacugauacuacaa

SEQ ID NO: 1896981 - RNA, 15 nt, Homo sapiens
uuggcaugccuucca

SEQ ID NO: 1896982 - RNA, 15 nt, Homo sapiens
ccuacucugagacaa

SEQ ID NO: 1896983 - RNA, 23 nt, Homo sapiens
cagucuugcugaauuaagcagaa

SEQ ID NO: 1896984 - RNA, 16 nt, Homo sapiens
gauuccucacuuugaa

SEQ ID NO: 1896985 - RNA, 16 nt, Homo sapiens
uugcuccgccuggccu

SEQ ID NO: 1896986 - RNA, 14 nt, Homo sapiens
aucuguuuugugac

SEQ ID NO: 1896987 - RNA, 15 nt, Homo sapiens
agccacgcagugccu

SEQ ID NO: 1896988 - RNA, 14 nt, Homo sapiens
gaucugaacacagu

SEQ ID NO: 1896989 - RNA, 22 nt, Homo sapiens
caaaaaaucucaauucuucccu

SEQ ID NO: 1896990 - RNA, 16 nt, Homo sapiens
caucaacugaucucau

SEQ ID NO: 1896991 - RNA, 19 nt, Homo sapiens
caaauguuuauaacucuag

SEQ ID NO: 1896992 - RNA, 15 nt, Homo sapiens
aaaccugcuuuucaa

SEQ ID NO: 1896993 - RNA, 17 nt, Homo sapiens
auagaaaauucuugaga

SEQ ID NO: 1896994 - RNA, 17 nt, Homo sapiens
auuucuaauguuuacua

SEQ ID NO: 1896995 - RNA, 15 nt, Homo sapiens
acagauuugugaacu

SEQ ID NO: 1896996 - RNA, 22 nt, Homo sapiens
aauuauacagaccuaauaucau

SEQ ID NO: 1896997 - RNA, 16 nt, Homo sapiens
ccuggggcacagucca

SEQ ID NO: 1896998 - RNA, 16 nt, Homo sapiens
gcuggcugaagaauga

SEQ ID NO: 1896999 - RNA, 18 nt, Homo sapiens
cauacuaucuacucuccu

SEQ ID NO: 1897000 - RNA, 17 nt, Homo sapiens
ucggcuucuuggaccuu

SEQ ID NO: 1897001 - RNA, 22 nt, Homo sapiens
gcccuguguguuugacauguga

SEQ ID NO: 1897002 - RNA, 14 nt, Homo sapiens
ggcgugugagucag

SEQ ID NO: 1897003 - RNA, 17 nt, Homo sapiens
acagagguccugccaug

SEQ ID NO: 1897004 - RNA, 21 nt, Homo sapiens
gugugaacucaccaaacacaa

SEQ ID NO: 1897005 - RNA, 17 nt, Homo sapiens
ccuggcagcacaggaaa

SEQ ID NO: 1897006 - RNA, 21 nt, Homo sapiens
caagguggaguggaugccuca

SEQ ID NO: 1897007 - RNA, 13 nt, Homo sapiens
gcuccaaauccaa

SEQ ID NO: 1897008 - RNA, 21 nt, Homo sapiens
cagaggcuucuccaaagggag

SEQ ID NO: 1897009 - RNA, 21 nt, Homo sapiens
ucugggcuagguagaaaaagg

SEQ ID NO: 1897010 - RNA, 18 nt, Homo sapiens
cauguaaauguaaacuca

SEQ ID NO: 1897011 - RNA, 14 nt, Homo sapiens
uuuguagucuuguc

SEQ ID NO: 1897012 - RNA, 11 nt, Homo sapiens
cagcugggcuc

SEQ ID NO: 1897013 - RNA, 23 nt, Homo sapiens
cagucucuaauccaccccaaucc

SEQ ID NO: 1897014 - RNA, 21 nt, Homo sapiens
agcagcuucugggaccauaag

SEQ ID NO: 1897015 - RNA, 23 nt, Homo sapiens
ugguauccuacugagcauuugca

SEQ ID NO: 1897016 - RNA, 22 nt, Homo sapiens
gcuguccagugcccauuccuca

SEQ ID NO: 1897017 - RNA, 12 nt, Homo sapiens
uuacauugccuu

SEQ ID NO: 1897018 - RNA, 18 nt, Homo sapiens
cuuauauucauccaugcc

SEQ ID NO: 1897019 - RNA, 11 nt, Homo sapiens
agcacauucca

SEQ ID NO: 1897020 - RNA, 18 nt, Homo sapiens
uugcuuuguuucucugau

SEQ ID NO: 1897021 - RNA, 18 nt, Homo sapiens
cagcuaucugcacucuaa

SEQ ID NO: 1897022 - RNA, 14 nt, Homo sapiens
gcgcaucaggccug

SEQ ID NO: 1897023 - RNA, 19 nt, Homo sapiens
ggcuuagaaggcacuggga

SEQ ID NO: 1897024 - RNA, 22 nt, Homo sapiens
uucuuccccccaaaacugauua

SEQ ID NO: 1897025 - RNA, 15 nt, Homo sapiens
aguugcuuccagucc

SEQ ID NO: 1897026 - RNA, 16 nt, Homo sapiens
uaaccuugaaauggaa

SEQ ID NO: 1897027 - RNA, 14 nt, Homo sapiens
agguugaaaauguu

SEQ ID NO: 1897028 - RNA, 17 nt, Homo sapiens
ucugaagagccugaagc

SEQ ID NO: 1897029 - RNA, 17 nt, Homo sapiens
gugaggcccauucuuca

SEQ ID NO: 1897030 - RNA, 13 nt, Homo sapiens
uuuuccaucaugu

SEQ ID NO: 1897031 - RNA, 13 nt, Homo sapiens
gaagaacaguaac

SEQ ID NO: 1897032 - RNA, 19 nt, Homo sapiens
ggagguaucuagcaaugga

SEQ ID NO: 1897033 - RNA, 15 nt, Homo sapiens
ucaaaucguccagcg

SEQ ID NO: 1897034 - RNA, 13 nt, Homo sapiens
ucccaucuucacu

SEQ ID NO: 1897035 - RNA, 11 nt, Homo sapiens
uaaauacaggu

SEQ ID NO: 1897036 - RNA, 20 nt, Homo sapiens
aacauacuauauaagccagu

SEQ ID NO: 1897037 - RNA, 13 nt, Homo sapiens
aauggaaaacagg

SEQ ID NO: 1897038 - RNA, 13 nt, Homo sapiens
cauaaaaaccaaa

SEQ ID NO: 1897039 - RNA, 17 nt, Homo sapiens
accaaacacccagaggu

SEQ ID NO: 1897040 - RNA, 14 nt, Homo sapiens
cuaaagagagccug

SEQ ID NO: 1897041 - RNA, 18 nt, Homo sapiens
ucuuucucucucacucuc

SEQ ID NO: 1897042 - RNA, 23 nt, Homo sapiens
aucugcuuccauuaaaagcauaa

SEQ ID NO: 1897043 - RNA, 18 nt, Homo sapiens
auuaggucccucacucca

SEQ ID NO: 1897044 - RNA, 18 nt, Homo sapiens
aacucaaggacuuugcag

SEQ ID NO: 1897045 - RNA, 22 nt, Homo sapiens
gcaauuaaaacuaugugcuauc

SEQ ID NO: 1897046 - RNA, 12 nt, Homo sapiens
ucagaaggugac

SEQ ID NO: 1897047 - RNA, 19 nt, Homo sapiens
cagugaagaugcaaucaga

SEQ ID NO: 1897048 - RNA, 15 nt, Homo sapiens
auucauacacucccu

SEQ ID NO: 1897049 - RNA, 19 nt, Homo sapiens
uaauaccucuuacuuugcu

SEQ ID NO: 1897050 - RNA, 15 nt, Homo sapiens
guagauguaugcaca

SEQ ID NO: 1897051 - RNA, 13 nt, Homo sapiens
cuuccccagagag

SEQ ID NO: 1897052 - RNA, 15 nt, Homo sapiens
ccagacugucucaaa

SEQ ID NO: 1897053 - RNA, 18 nt, Homo sapiens
uaccagaaccaguaccuc

SEQ ID NO: 1897054 - RNA, 13 nt, Homo sapiens
caggcccuguggc

SEQ ID NO: 1897055 - RNA, 23 nt, Homo sapiens
ugaagcuuaaccgaagaacuaau

SEQ ID NO: 1897056 - RNA, 15 nt, Homo sapiens
aagacaaugcuuucc

SEQ ID NO: 1897057 - RNA, 13 nt, Homo sapiens
cuuuggugcacaa

SEQ ID NO: 1897058 - RNA, 16 nt, Homo sapiens
cgcaucccaucucucc

SEQ ID NO: 1897059 - RNA, 22 nt, Homo sapiens
cagagaggcugcucugccauac

SEQ ID NO: 1897060 - RNA, 22 nt, Homo sapiens
ggcagagcugggggcugaggga

SEQ ID NO: 1897061 - RNA, 21 nt, Homo sapiens
gcagucaucagucaucaggug

SEQ ID NO: 1897062 - RNA, 18 nt, Homo sapiens
aacgcugcuccaugcaca

SEQ ID NO: 1897063 - RNA, 11 nt, Homo sapiens
cugucuuucau

SEQ ID NO: 1897064 - RNA, 19 nt, Homo sapiens
agcaguaaauuugcuagca

SEQ ID NO: 1897065 - RNA, 21 nt, Homo sapiens
aaaugggggaaaaguuaguca

SEQ ID NO: 1897066 - RNA, 20 nt, Homo sapiens
ucucgggugcccugcauuca

SEQ ID NO: 1897067 - RNA, 16 nt, Homo sapiens
cuauauggcagugucu

SEQ ID NO: 1897068 - RNA, 20 nt, Homo sapiens
acuggaacguuucacugcaa

SEQ ID NO: 1897069 - RNA, 16 nt, Homo sapiens
agauaaauguccauuc

SEQ ID NO: 1897070 - RNA, 20 nt, Homo sapiens
acucaggugauuccaggaug

SEQ ID NO: 1897071 - RNA, 17 nt, Homo sapiens
aaaccccuucucuguga

SEQ ID NO: 1897072 - RNA, 18 nt, Homo sapiens
acagccaaaaaggaccaa

SEQ ID NO: 1897073 - RNA, 18 nt, Homo sapiens
aagucuggcccacugugc

SEQ ID NO: 1897074 - RNA, 17 nt, Homo sapiens
uaaagggucuuaugaaa

SEQ ID NO: 1897075 - RNA, 14 nt, Homo sapiens
guaaugucacuguu

SEQ ID NO: 1897076 - RNA, 21 nt, Homo sapiens
uacucaggguucaucugucca

SEQ ID NO: 1897077 - RNA, 18 nt, Homo sapiens
caaucuccaggcucccuc

SEQ ID NO: 1897078 - RNA, 11 nt, Homo sapiens
auaaucucauc

SEQ ID NO: 1897079 - RNA, 13 nt, Homo sapiens
gcauguacuguac

SEQ ID NO: 1897080 - RNA, 20 nt, Homo sapiens
gaugucuccuaagcaccugu

SEQ ID NO: 1897081 - RNA, 20 nt, Homo sapiens
acagcaucugccucuauuca

SEQ ID NO: 1897082 - RNA, 15 nt, Homo sapiens
cuugcccgcgcucuu

SEQ ID NO: 1897083 - RNA, 19 nt, Homo sapiens
uugauaucacuaauaaagu

SEQ ID NO: 1897084 - RNA, 18 nt, Homo sapiens
cuaugcgcuaguuaggaa

SEQ ID NO: 1897085 - RNA, 20 nt, Homo sapiens
aauagcuuaucuuucaaggu

SEQ ID NO: 1897086 - RNA, 22 nt, Homo sapiens
auacaccagcaauuuagacaaa

SEQ ID NO: 1897087 - RNA, 15 nt, Homo sapiens
ugggggaucuguugu

SEQ ID NO: 1897088 - RNA, 15 nt, Homo sapiens
agaaaguacaaccac

SEQ ID NO: 1897089 - RNA, 20 nt, Homo sapiens
ugcccacuccgccagccaca

SEQ ID NO: 1897090 - RNA, 21 nt, Homo sapiens
ccagagggccccucacuggcu

SEQ ID NO: 1897091 - RNA, 15 nt, Homo sapiens
aggaucucugagacc

SEQ ID NO: 1897092 - RNA, 17 nt, Homo sapiens
gaggaacuguccagaga

SEQ ID NO: 1897093 - RNA, 14 nt, Homo sapiens
accuccaacuggau

SEQ ID NO: 1897094 - RNA, 16 nt, Homo sapiens
acaccuagaucagaac

SEQ ID NO: 1897095 - RNA, 19 nt, Homo sapiens
ugcgcucuggggacugagc

SEQ ID NO: 1897096 - RNA, 15 nt, Homo sapiens
auuaagacaugcacu

SEQ ID NO: 1897097 - RNA, 20 nt, Homo sapiens
gaaauguguggucgagcuuu

SEQ ID NO: 1897098 - RNA, 14 nt, Homo sapiens
aaaagauuccugaa

SEQ ID NO: 1897099 - RNA, 18 nt, Homo sapiens
cuggaaggcacacgccug

SEQ ID NO: 1897100 - RNA, 16 nt, Homo sapiens
ugaugcuuuuagcuca

SEQ ID NO: 1897101 - RNA, 13 nt, Homo sapiens
aagaguaguuaua

SEQ ID NO: 1897102 - RNA, 22 nt, Homo sapiens
ccuggggugggaucugagcucc

SEQ ID NO: 1897103 - RNA, 15 nt, Homo sapiens
uacuugagccuuuaa

SEQ ID NO: 1897104 - RNA, 12 nt, Homo sapiens
cauccuggcacg

SEQ ID NO: 1897105 - RNA, 21 nt, Homo sapiens
agucagggcccagaguuggga

SEQ ID NO: 1897106 - RNA, 20 nt, Homo sapiens
aggaggaagggacuggucca

SEQ ID NO: 1897107 - RNA, 16 nt, Homo sapiens
aggcccagcaugcagg

SEQ ID NO: 1897108 - RNA, 20 nt, Homo sapiens
gauguuuuacgucugggaga

SEQ ID NO: 1897109 - RNA, 13 nt, Homo sapiens
cuguauuacauaa

SEQ ID NO: 1897110 - RNA, 13 nt, Homo sapiens
cauaguuacugug

SEQ ID NO: 1897111 - RNA, 13 nt, Homo sapiens
gaacucauuucaa

SEQ ID NO: 1897112 - RNA, 16 nt, Homo sapiens
acuccagacucucugu

SEQ ID NO: 1897113 - RNA, 20 nt, Homo sapiens
guauacugggggcaaaauca

SEQ ID NO: 1897114 - RNA, 22 nt, Homo sapiens
uagagugcccuuaaaauaauga

SEQ ID NO: 1897115 - RNA, 19 nt, Homo sapiens
guuaauacuuaacauugau

SEQ ID NO: 1897116 - RNA, 20 nt, Homo sapiens
caguaugaaaagcuaucuua

SEQ ID NO: 1897117 - RNA, 12 nt, Homo sapiens
agugaaguaauc

SEQ ID NO: 1897118 - RNA, 13 nt, Homo sapiens
uaaauucuaccuc

SEQ ID NO: 1897119 - RNA, 15 nt, Homo sapiens
uguuacacauugagg

SEQ ID NO: 1897120 - RNA, 20 nt, Homo sapiens
aagugcugccccugccugug

SEQ ID NO: 1897121 - RNA, 20 nt, Homo sapiens
gauguauguugaagccuuug

SEQ ID NO: 1897122 - RNA, 12 nt, Homo sapiens
cccgugccaaau

SEQ ID NO: 1897123 - RNA, 17 nt, Homo sapiens
gcaucuccccucagauu

SEQ ID NO: 1897124 - RNA, 21 nt, Homo sapiens
gaagaaaucacuuaaauaccu

SEQ ID NO: 1897125 - RNA, 19 nt, Homo sapiens
uaaauaaagccacuuuccu

SEQ ID NO: 1897126 - RNA, 12 nt, Homo sapiens
uuagccaggugu

SEQ ID NO: 1897127 - RNA, 16 nt, Homo sapiens
auuccuaccauacaau

SEQ ID NO: 1897128 - RNA, 13 nt, Homo sapiens
aaaguguggaagc

SEQ ID NO: 1897129 - RNA, 21 nt, Homo sapiens
uaccucugagaagacacaagg

SEQ ID NO: 1897130 - RNA, 17 nt, Homo sapiens
ucagcacugucuugucu

SEQ ID NO: 1897131 - RNA, 19 nt, Homo sapiens
aggacguggugacuuccug

SEQ ID NO: 1897132 - RNA, 21 nt, Homo sapiens
gccccaggguuuacaugaagc

SEQ ID NO: 1897133 - RNA, 19 nt, Homo sapiens
ugaaugugccuaauggaga

SEQ ID NO: 1897134 - RNA, 22 nt, Homo sapiens
auacagccaaagauaaucucuc

SEQ ID NO: 1897135 - RNA, 21 nt, Homo sapiens
ucauugcgauuuaucuugcuu

SEQ ID NO: 1897136 - RNA, 14 nt, Homo sapiens
uggagggaugccac

SEQ ID NO: 1897137 - RNA, 16 nt, Homo sapiens
aauuucugccauuuca

SEQ ID NO: 1897138 - RNA, 15 nt, Homo sapiens
gagcagcuucuggga

SEQ ID NO: 1897139 - RNA, 13 nt, Homo sapiens
auauuaacacgcu

SEQ ID NO: 1897140 - RNA, 21 nt, Homo sapiens
cucccaaagugcugagauuac

SEQ ID NO: 1897141 - RNA, 15 nt, Homo sapiens
ugacuaucacauaca

SEQ ID NO: 1897142 - RNA, 19 nt, Homo sapiens
cuguuugagaauaugauca

SEQ ID NO: 1897143 - RNA, 14 nt, Homo sapiens
auugauacauucag

SEQ ID NO: 1897144 - RNA, 18 nt, Homo sapiens
cgcucccagguuccccca

SEQ ID NO: 1897145 - RNA, 22 nt, Homo sapiens
cuuuaguggugguauguaaugg

SEQ ID NO: 1897146 - RNA, 18 nt, Homo sapiens
uaaaaccugugugccauu

SEQ ID NO: 1897147 - RNA, 17 nt, Homo sapiens
acaugguucaccaugca

SEQ ID NO: 1897148 - RNA, 19 nt, Homo sapiens
ugcaugauuagugcaauaa

SEQ ID NO: 1897149 - RNA, 21 nt, Homo sapiens
ugagcgucacugcccaccaaa

SEQ ID NO: 1897150 - RNA, 16 nt, Homo sapiens
acagcgacauagccca

SEQ ID NO: 1897151 - RNA, 14 nt, Homo sapiens
uugugauguggcaa

SEQ ID NO: 1897152 - RNA, 18 nt, Homo sapiens
ucuuuaaaaccauaaacu

SEQ ID NO: 1897153 - RNA, 20 nt, Homo sapiens
caucucaagugccauauucu

SEQ ID NO: 1897154 - RNA, 20 nt, Homo sapiens
gcugcuggaugacuugagau

SEQ ID NO: 1897155 - RNA, 19 nt, Homo sapiens
uguaacggccaacacuuug

SEQ ID NO: 1897156 - RNA, 22 nt, Homo sapiens
aaugguuucccgggcccagaaa

SEQ ID NO: 1897157 - RNA, 20 nt, Homo sapiens
agaguacacucagccacugu

SEQ ID NO: 1897158 - RNA, 19 nt, Homo sapiens
gcuggcaccauggugacug

SEQ ID NO: 1897159 - RNA, 14 nt, Homo sapiens
aaggaacugcauca

SEQ ID NO: 1897160 - RNA, 16 nt, Homo sapiens
gaagccccaacgggaa

SEQ ID NO: 1897161 - RNA, 15 nt, Homo sapiens
aaugggcacagcaca

SEQ ID NO: 1897162 - RNA, 20 nt, Homo sapiens
cuggggcugaucucagggaa

SEQ ID NO: 1897163 - RNA, 22 nt, Homo sapiens
agagccagugugccaccaggcu

SEQ ID NO: 1897164 - RNA, 19 nt, Homo sapiens
cuauuuuguuaguuauaca

SEQ ID NO: 1897165 - RNA, 15 nt, Homo sapiens
aaugugaugcuuuca

SEQ ID NO: 1897166 - RNA, 15 nt, Homo sapiens
gcuuucuuaaugugu

SEQ ID NO: 1897167 - RNA, 21 nt, Homo sapiens
caugcagcaaggggacaucuu

SEQ ID NO: 1897168 - RNA, 15 nt, Homo sapiens
auucacacauggcau

SEQ ID NO: 1897169 - RNA, 20 nt, Homo sapiens
cccagugcaaaugcaugcuu

SEQ ID NO: 1897170 - RNA, 23 nt, Homo sapiens
augcucccuccccugcccugguc

SEQ ID NO: 1897171 - RNA, 17 nt, Homo sapiens
ggcuuauucacauggaa

SEQ ID NO: 1897172 - RNA, 21 nt, Homo sapiens
ucacccagguuggagugcagu

SEQ ID NO: 1897173 - RNA, 15 nt, Homo sapiens
cuuuauuauggaaaa

SEQ ID NO: 1897174 - RNA, 16 nt, Homo sapiens
aaucccaacacuuuug

SEQ ID NO: 1897175 - RNA, 17 nt, Homo sapiens
ugcauuuuuaaauacaa

SEQ ID NO: 1897176 - RNA, 19 nt, Homo sapiens
aauucuuccuaaugucaga

SEQ ID NO: 1897177 - RNA, 20 nt, Homo sapiens
cucaaauccuugagcacuca

SEQ ID NO: 1897178 - RNA, 18 nt, Homo sapiens
cagucuaaggucucaugc

SEQ ID NO: 1897179 - RNA, 21 nt, Homo sapiens
cugugacuuuauuagcagcug

SEQ ID NO: 1897180 - RNA, 17 nt, Homo sapiens
auuuuuauagacaaaua

SEQ ID NO: 1897181 - RNA, 14 nt, Homo sapiens
caaaauucaucugu

SEQ ID NO: 1897182 - RNA, 18 nt, Homo sapiens
uuagaaacaacauagcaa

SEQ ID NO: 1897183 - RNA, 12 nt, Homo sapiens
ucuuucuaccuc

SEQ ID NO: 1897184 - RNA, 23 nt, Homo sapiens
augagaacauuuacacauucuca

SEQ ID NO: 1897185 - RNA, 18 nt, Homo sapiens
uauuucccccuccuccca

SEQ ID NO: 1897186 - RNA, 22 nt, Homo sapiens
aaucuacugaauuggcuuccag

SEQ ID NO: 1897187 - RNA, 17 nt, Homo sapiens
gcaucaugaguugcaag

SEQ ID NO: 1897188 - RNA, 18 nt, Homo sapiens
auaucagaguaugucagu

SEQ ID NO: 1897189 - RNA, 14 nt, Homo sapiens
uucacacccugcaa

SEQ ID NO: 1897190 - RNA, 14 nt, Homo sapiens
uccccaccccgaaa

SEQ ID NO: 1897191 - RNA, 16 nt, Homo sapiens
cagauuauuuaaaugg

SEQ ID NO: 1897192 - RNA, 22 nt, Homo sapiens
auuaaguguguguauacuguaa

SEQ ID NO: 1897193 - RNA, 21 nt, Homo sapiens
agaccaagcugugcccugacc

SEQ ID NO: 1897194 - RNA, 18 nt, Homo sapiens
uccugaccccguuuucca

SEQ ID NO: 1897195 - RNA, 16 nt, Homo sapiens
acagcacuacugggug

SEQ ID NO: 1897196 - RNA, 19 nt, Homo sapiens
agcccgugcccuaccacac

SEQ ID NO: 1897197 - RNA, 16 nt, Homo sapiens
cuaaccccuuccagau

SEQ ID NO: 1897198 - RNA, 19 nt, Homo sapiens
accuuaucuuaaagcacuu

SEQ ID NO: 1897199 - RNA, 22 nt, Homo sapiens
agaugcauggcuggcacauugu

SEQ ID NO: 1897200 - RNA, 13 nt, Homo sapiens
ugcaccaaagaca

SEQ ID NO: 1897201 - RNA, 16 nt, Homo sapiens
auggaaguuggcugca

SEQ ID NO: 1897202 - RNA, 18 nt, Homo sapiens
uauugggccauagccuau

SEQ ID NO: 1897203 - RNA, 23 nt, Homo sapiens
uaaaaauacaaaaaucagccaga

SEQ ID NO: 1897204 - RNA, 16 nt, Homo sapiens
uccaaagaacagccug

SEQ ID NO: 1897205 - RNA, 21 nt, Homo sapiens
uuguaagaaauauauuugaua

SEQ ID NO: 1897206 - RNA, 11 nt, Homo sapiens
uucaagacaga

SEQ ID NO: 1897207 - RNA, 21 nt, Homo sapiens
gacuauuuacaagacugcuga

SEQ ID NO: 1897208 - RNA, 20 nt, Homo sapiens
gaggagauucccaccuucca

SEQ ID NO: 1897209 - RNA, 10 nt, Homo sapiens
aaugcugcuu

SEQ ID NO: 1897210 - RNA, 13 nt, Homo sapiens
caaacacacugua

SEQ ID NO: 1897211 - RNA, 17 nt, Homo sapiens
aaagaucucaacaugga

SEQ ID NO: 1897212 - RNA, 18 nt, Homo sapiens
gaugguucauaucaugaa

SEQ ID NO: 1897213 - RNA, 16 nt, Homo sapiens
cuagugguauggggcu

SEQ ID NO: 1897214 - RNA, 23 nt, Homo sapiens
gucuggagggcuggucauucaca

SEQ ID NO: 1897215 - RNA, 17 nt, Homo sapiens
acugucuguguccuucc

SEQ ID NO: 1897216 - RNA, 16 nt, Homo sapiens
aauaguucuguauaua

SEQ ID NO: 1897217 - RNA, 12 nt, Homo sapiens
gccuccauggcu

SEQ ID NO: 1897218 - RNA, 19 nt, Homo sapiens
cugcuccaggccugcauua

SEQ ID NO: 1897219 - RNA, 21 nt, Homo sapiens
gaacccauuuugagugacucg

SEQ ID NO: 1897220 - RNA, 16 nt, Homo sapiens
ucucaauugucauuga

SEQ ID NO: 1897221 - RNA, 15 nt, Homo sapiens
uccuaccagaaggaa

SEQ ID NO: 1897222 - RNA, 16 nt, Homo sapiens
augacacucuucugaa

SEQ ID NO: 1897223 - RNA, 14 nt, Homo sapiens
uccagaagaugaga

SEQ ID NO: 1897224 - RNA, 21 nt, Homo sapiens
cagcaaugaagggaagugcau

SEQ ID NO: 1897225 - RNA, 15 nt, Homo sapiens
ccaccccacacugcc

SEQ ID NO: 1897226 - RNA, 15 nt, Homo sapiens
caugaacccaaaaag

SEQ ID NO: 1897227 - RNA, 18 nt, Homo sapiens
auuccuuucucaucccac

SEQ ID NO: 1897228 - RNA, 12 nt, Homo sapiens
uguauuugccag

SEQ ID NO: 1897229 - RNA, 15 nt, Homo sapiens
ucucaaauuguaauu

SEQ ID NO: 1897230 - RNA, 15 nt, Homo sapiens
uaucgcugggcucaa

SEQ ID NO: 1897231 - RNA, 21 nt, Homo sapiens
agcacaaccggucccuuccau

SEQ ID NO: 1897232 - RNA, 22 nt, Homo sapiens
caggaauuucuguuagcaauau

SEQ ID NO: 1897233 - RNA, 20 nt, Homo sapiens
ugcccuuugggguugcccag

SEQ ID NO: 1897234 - RNA, 15 nt, Homo sapiens
gaacaugaccaaaaa

SEQ ID NO: 1897235 - RNA, 22 nt, Homo sapiens
gaaaauucaagcauuuaggaau

SEQ ID NO: 1897236 - RNA, 13 nt, Homo sapiens
agcucucuugccg

SEQ ID NO: 1897237 - RNA, 21 nt, Homo sapiens
cucuguccuucccccagcaca

SEQ ID NO: 1897238 - RNA, 16 nt, Homo sapiens
aaucagauuauggaag

SEQ ID NO: 1897239 - RNA, 13 nt, Homo sapiens
caugucucacaga

SEQ ID NO: 1897240 - RNA, 15 nt, Homo sapiens
ucaaggguauuuuaa

SEQ ID NO: 1897241 - RNA, 19 nt, Homo sapiens
cucauggaauuggagcucg

SEQ ID NO: 1897242 - RNA, 15 nt, Homo sapiens
ccucuccaauuguaa

SEQ ID NO: 1897243 - RNA, 21 nt, Homo sapiens
aggaggagcauuguccaggca

SEQ ID NO: 1897244 - RNA, 20 nt, Homo sapiens
cugccugugugggacugaga

SEQ ID NO: 1897245 - RNA, 20 nt, Homo sapiens
uucaucagacuccugugcaa

SEQ ID NO: 1897246 - RNA, 19 nt, Homo sapiens
ugagaaccgugacaucagc

SEQ ID NO: 1897247 - RNA, 21 nt, Homo sapiens
cacugauauuuuagucauucu

SEQ ID NO: 1897248 - RNA, 20 nt, Homo sapiens
caguauuuucagauuacaug

SEQ ID NO: 1897249 - RNA, 20 nt, Homo sapiens
gaagaaguuggucaguauug

SEQ ID NO: 1897250 - RNA, 23 nt, Homo sapiens
uucagaggguaaguaaacagauu

SEQ ID NO: 1897251 - RNA, 17 nt, Homo sapiens
gagauaauaucugugag

SEQ ID NO: 1897252 - RNA, 11 nt, Homo sapiens
aaugcagagau

SEQ ID NO: 1897253 - RNA, 15 nt, Homo sapiens
aaggaaaaaaccauc

SEQ ID NO: 1897254 - RNA, 15 nt, Homo sapiens
ccagccagauccucu

SEQ ID NO: 1897255 - RNA, 22 nt, Homo sapiens
uccucagaaccauucacuggca

SEQ ID NO: 1897256 - RNA, 22 nt, Homo sapiens
cagagaccagcacucagccuca

SEQ ID NO: 1897257 - RNA, 24 nt, Homo sapiens
ccuugugaccuucucuauaucaug

SEQ ID NO: 1897258 - RNA, 21 nt, Homo sapiens
ucauccugcuucucuuuuccu

SEQ ID NO: 1897259 - RNA, 20 nt, Homo sapiens
gacggaggccuacucuucca

SEQ ID NO: 1897260 - RNA, 17 nt, Homo sapiens
acaaaaaaugugcuguu

SEQ ID NO: 1897261 - RNA, 16 nt, Homo sapiens
gcugggauuacaggug

SEQ ID NO: 1897262 - RNA, 18 nt, Homo sapiens
cguuaauaucgcugauau

SEQ ID NO: 1897263 - RNA, 18 nt, Homo sapiens
aauuuacagucaaucuau

SEQ ID NO: 1897264 - RNA, 18 nt, Homo sapiens
caaugggccuccagagac

SEQ ID NO: 1897265 - RNA, 22 nt, Homo sapiens
uuucuaugacaauaugacacuu

SEQ ID NO: 1897266 - RNA, 12 nt, Homo sapiens
uucaaauuugau

SEQ ID NO: 1897267 - RNA, 14 nt, Homo sapiens
uaaaacuuuccaaa

SEQ ID NO: 1897268 - RNA, 21 nt, Homo sapiens
uaugcaugcagucuuguacug

SEQ ID NO: 1897269 - RNA, 23 nt, Homo sapiens
gagaucggcccagcucugacuga

SEQ ID NO: 1897270 - RNA, 17 nt, Homo sapiens
augcugggcccucuuau

SEQ ID NO: 1897271 - RNA, 16 nt, Homo sapiens
ccuuaacacauucaau

SEQ ID NO: 1897272 - RNA, 22 nt, Homo sapiens
cacggacgacgcgagggcccca

SEQ ID NO: 1897273 - RNA, 13 nt, Homo sapiens
ucucacugcaagu

SEQ ID NO: 1897274 - RNA, 22 nt, Homo sapiens
agacucagaggacccaccuggg

SEQ ID NO: 1897275 - RNA, 17 nt, Homo sapiens
ggaguauccucuugcca

SEQ ID NO: 1897276 - RNA, 21 nt, Homo sapiens
auccucccuggcagacacaac

SEQ ID NO: 1897277 - RNA, 15 nt, Homo sapiens
cuggaaaacugccac

SEQ ID NO: 1897278 - RNA, 17 nt, Homo sapiens
uucccccagcccugugg

SEQ ID NO: 1897279 - RNA, 16 nt, Homo sapiens
ucuaucaaaauuaccc

SEQ ID NO: 1897280 - RNA, 20 nt, Homo sapiens
aaugauuauuuuuuucugua

SEQ ID NO: 1897281 - RNA, 12 nt, Homo sapiens
agaaauguccuc

SEQ ID NO: 1897282 - RNA, 23 nt, Homo sapiens
ggagaaccucaggcuuccuuggc

SEQ ID NO: 1897283 - RNA, 19 nt, Homo sapiens
gcuugaaaaaugugcaaaa

SEQ ID NO: 1897284 - RNA, 18 nt, Homo sapiens
ggccucuucugcuuucuc

SEQ ID NO: 1897285 - RNA, 22 nt, Homo sapiens
gacagugaaauacauccuucaa

SEQ ID NO: 1897286 - RNA, 18 nt, Homo sapiens
uuuaguucucagcucuuc

SEQ ID NO: 1897287 - RNA, 20 nt, Homo sapiens
ugggcucuggguucgggaag

SEQ ID NO: 1897288 - RNA, 23 nt, Homo sapiens
acacuuuccagccuauagcagaa

SEQ ID NO: 1897289 - RNA, 15 nt, Homo sapiens
aaccaccugaugaca

SEQ ID NO: 1897290 - RNA, 15 nt, Homo sapiens
guggguuccacagac

SEQ ID NO: 1897291 - RNA, 19 nt, Homo sapiens
guaggauuuggggugaaug

SEQ ID NO: 1897292 - RNA, 18 nt, Homo sapiens
uacccucacuuaaacuuu

SEQ ID NO: 1897293 - RNA, 15 nt, Homo sapiens
cagcugaggacacac

SEQ ID NO: 1897294 - RNA, 12 nt, Homo sapiens
uaaugacacucc

SEQ ID NO: 1897295 - RNA, 13 nt, Homo sapiens
uggucugacccac

SEQ ID NO: 1897296 - RNA, 20 nt, Homo sapiens
aucauucagcgcaugcaccu

SEQ ID NO: 1897297 - RNA, 21 nt, Homo sapiens
ugucucaaaauaaaaccagaa

SEQ ID NO: 1897298 - RNA, 13 nt, Homo sapiens
cuugaucuguaua

SEQ ID NO: 1897299 - RNA, 14 nt, Homo sapiens
agacagauugcuga

SEQ ID NO: 1897300 - RNA, 17 nt, Homo sapiens
acugcucguggccaaaa

SEQ ID NO: 1897301 - RNA, 17 nt, Homo sapiens
aagguggccugcgggga

SEQ ID NO: 1897302 - RNA, 17 nt, Homo sapiens
agagaggggacauuucc

SEQ ID NO: 1897303 - RNA, 11 nt, Homo sapiens
cacucugccag

SEQ ID NO: 1897304 - RNA, 14 nt, Homo sapiens
aauuauaaaaugca

SEQ ID NO: 1897305 - RNA, 20 nt, Homo sapiens
acaggccgagugaaggugcu

SEQ ID NO: 1897306 - RNA, 15 nt, Homo sapiens
accucaagcugcauc

SEQ ID NO: 1897307 - RNA, 18 nt, Homo sapiens
auaaaaguguucauuguu

SEQ ID NO: 1897308 - RNA, 13 nt, Homo sapiens
gacucaugaacua

SEQ ID NO: 1897309 - RNA, 17 nt, Homo sapiens
augcuccgucauuugac

SEQ ID NO: 1897310 - RNA, 15 nt, Homo sapiens
gacuaccaagcuggc

SEQ ID NO: 1897311 - RNA, 19 nt, Homo sapiens
gagaaacuguagucucagg

SEQ ID NO: 1897312 - RNA, 19 nt, Homo sapiens
caggcaaucugcccgccug

SEQ ID NO: 1897313 - RNA, 18 nt, Homo sapiens
uccugaugcuuuugucua

SEQ ID NO: 1897314 - RNA, 17 nt, Homo sapiens
caacugcugcugugcac

SEQ ID NO: 1897315 - RNA, 21 nt, Homo sapiens
cagaugaaauguucuguucac

SEQ ID NO: 1897316 - RNA, 22 nt, Homo sapiens
ccacauagacuuuaugcaauaa

SEQ ID NO: 1897317 - RNA, 15 nt, Homo sapiens
gcugcaauacauuaa

SEQ ID NO: 1897318 - RNA, 17 nt, Homo sapiens
ccuuucacuaaaacaca

SEQ ID NO: 1897319 - RNA, 16 nt, Homo sapiens
aauugagaaacaugaa

SEQ ID NO: 1897320 - RNA, 11 nt, Homo sapiens
uaccaaaagau

SEQ ID NO: 1897321 - RNA, 23 nt, Homo sapiens
uaggcagggagggggcugggaaa

SEQ ID NO: 1897322 - RNA, 16 nt, Homo sapiens
cuaugaacucuugaua

SEQ ID NO: 1897323 - RNA, 20 nt, Homo sapiens
uugacguggcacuuacccac

SEQ ID NO: 1897324 - RNA, 12 nt, Homo sapiens
aguggcucucuu

SEQ ID NO: 1897325 - RNA, 12 nt, Homo sapiens
cacuuaccuuau

SEQ ID NO: 1897326 - RNA, 16 nt, Homo sapiens
ucuccuccucugugcu

SEQ ID NO: 1897327 - RNA, 20 nt, Homo sapiens
ccagcaggagcucugacuaa

SEQ ID NO: 1897328 - RNA, 15 nt, Homo sapiens
gcagcuuagggcccu

SEQ ID NO: 1897329 - RNA, 15 nt, Homo sapiens
agguaugcaaauauc

SEQ ID NO: 1897330 - RNA, 17 nt, Homo sapiens
ccaucccucuacuuucc

SEQ ID NO: 1897331 - RNA, 15 nt, Homo sapiens
uguaaggcucuagau

SEQ ID NO: 1897332 - RNA, 20 nt, Homo sapiens
uacuucuuaaaaugugcuau

SEQ ID NO: 1897333 - RNA, 13 nt, Homo sapiens
aggccaacagcac

SEQ ID NO: 1897334 - RNA, 13 nt, Homo sapiens
aagaaaacaacca

SEQ ID NO: 1897335 - RNA, 15 nt, Homo sapiens
gaaaugcacaauguc

SEQ ID NO: 1897336 - RNA, 16 nt, Homo sapiens
ccuccaugaacaucau

SEQ ID NO: 1897337 - RNA, 14 nt, Homo sapiens
gacaaaucaaagca

SEQ ID NO: 1897338 - RNA, 23 nt, Homo sapiens
gaaaaaggaugucuuucaggauu

SEQ ID NO: 1897339 - RNA, 11 nt, Homo sapiens
uuaaugcucua

SEQ ID NO: 1897340 - RNA, 18 nt, Homo sapiens
gugucugucagcugugaa

SEQ ID NO: 1897341 - RNA, 17 nt, Homo sapiens
gucuacguuaccaggca

SEQ ID NO: 1897342 - RNA, 19 nt, Homo sapiens
uaaaaucuggccaccccag

SEQ ID NO: 1897343 - RNA, 12 nt, Homo sapiens
gacugggcugcu

SEQ ID NO: 1897344 - RNA, 16 nt, Homo sapiens
auauuguaacuugcau

SEQ ID NO: 1897345 - RNA, 20 nt, Homo sapiens
ccacccuuggucucaugccc

SEQ ID NO: 1897346 - RNA, 17 nt, Homo sapiens
aaauauaauaugcacac

SEQ ID NO: 1897347 - RNA, 19 nt, Homo sapiens
aguggcacgaucucagcuc

SEQ ID NO: 1897348 - RNA, 16 nt, Homo sapiens
ccccauucauuccuga

SEQ ID NO: 1897349 - RNA, 12 nt, Homo sapiens
cucggcacgugg

SEQ ID NO: 1897350 - RNA, 17 nt, Homo sapiens
uccauugguucuuccuu

SEQ ID NO: 1897351 - RNA, 12 nt, Homo sapiens
acugcucauuuc

SEQ ID NO: 1897352 - RNA, 19 nt, Homo sapiens
acccagggacacuccaacu

SEQ ID NO: 1897353 - RNA, 16 nt, Homo sapiens
aucauaauucagcucu

SEQ ID NO: 1897354 - RNA, 21 nt, Homo sapiens
ccuuguaccucaaucuauucu

SEQ ID NO: 1897355 - RNA, 18 nt, Homo sapiens
uuaauaaauuaaaacaug

SEQ ID NO: 1897356 - RNA, 23 nt, Homo sapiens
acccccaggucuuccugcuuucc

SEQ ID NO: 1897357 - RNA, 18 nt, Homo sapiens
agccagagagcaucuuuc

SEQ ID NO: 1897358 - RNA, 12 nt, Homo sapiens
agccaguggcag

SEQ ID NO: 1897359 - RNA, 21 nt, Homo sapiens
ucugagucacaggugugggau

SEQ ID NO: 1897360 - RNA, 13 nt, Homo sapiens
agccagcaagagg

SEQ ID NO: 1897361 - RNA, 16 nt, Homo sapiens
uauuguucucauguaa

SEQ ID NO: 1897362 - RNA, 23 nt, Homo sapiens
uugaacuccucucagcugaacac

SEQ ID NO: 1897363 - RNA, 16 nt, Homo sapiens
aaaucagcaaacuuug

SEQ ID NO: 1897364 - RNA, 21 nt, Homo sapiens
gaaacugcucccaucauuccu

SEQ ID NO: 1897365 - RNA, 20 nt, Homo sapiens
cucuaacaccacacugacca

SEQ ID NO: 1897366 - RNA, 17 nt, Homo sapiens
cacuggaguucacuuuc

SEQ ID NO: 1897367 - RNA, 17 nt, Homo sapiens
cauaaauuggcuuuuca

SEQ ID NO: 1897368 - RNA, 17 nt, Homo sapiens
gaaaaaucaguguauua

SEQ ID NO: 1897369 - RNA, 21 nt, Homo sapiens
aaaauaggauugcuucaauua

SEQ ID NO: 1897370 - RNA, 16 nt, Homo sapiens
aagcaauacuguuucc

SEQ ID NO: 1897371 - RNA, 15 nt, Homo sapiens
uuuucuguaauguaa

SEQ ID NO: 1897372 - RNA, 20 nt, Homo sapiens
ggcuccagcaccauccgcca

SEQ ID NO: 1897373 - RNA, 12 nt, Homo sapiens
acacuccucuau

SEQ ID NO: 1897374 - RNA, 17 nt, Homo sapiens
cuuaaauuucaaaccau

SEQ ID NO: 1897375 - RNA, 17 nt, Homo sapiens
uccacccuccucuagcc

SEQ ID NO: 1897376 - RNA, 14 nt, Homo sapiens
aauuuguaaugucu

SEQ ID NO: 1897377 - RNA, 18 nt, Homo sapiens
cuuccauuugcaagggaa

SEQ ID NO: 1897378 - RNA, 17 nt, Homo sapiens
aacucuagacugcaaga

SEQ ID NO: 1897379 - RNA, 18 nt, Homo sapiens
aagacagcugcuggguca

SEQ ID NO: 1897380 - RNA, 19 nt, Homo sapiens
gagcguguggcugugcccc

SEQ ID NO: 1897381 - RNA, 14 nt, Homo sapiens
aucacccuuaccau

SEQ ID NO: 1897382 - RNA, 14 nt, Homo sapiens
uaaauaaauaccaa

SEQ ID NO: 1897383 - RNA, 14 nt, Homo sapiens
ccccuaaaccaaaa

SEQ ID NO: 1897384 - RNA, 21 nt, Homo sapiens
auaugggguugguguucucau

SEQ ID NO: 1897385 - RNA, 21 nt, Homo sapiens
cguccuuucccuacuccaugg

SEQ ID NO: 1897386 - RNA, 22 nt, Homo sapiens
guuuuuguauuuauuaauuuga

SEQ ID NO: 1897387 - RNA, 22 nt, Homo sapiens
aucccuuccugucugaacaaaa

SEQ ID NO: 1897388 - RNA, 23 nt, Homo sapiens
uucaagaagugccaguugaucaa

SEQ ID NO: 1897389 - RNA, 23 nt, Homo sapiens
acauacauugauucaugucucac

SEQ ID NO: 1897390 - RNA, 14 nt, Homo sapiens
aagggggugacugg

SEQ ID NO: 1897391 - RNA, 14 nt, Homo sapiens
ugcaacaggcacuc

SEQ ID NO: 1897392 - RNA, 20 nt, Homo sapiens
cuuguaaaggugcugcacug

SEQ ID NO: 1897393 - RNA, 21 nt, Homo sapiens
agcccgggacagggucuugca

SEQ ID NO: 1897394 - RNA, 14 nt, Homo sapiens
caguuacaagugca

SEQ ID NO: 1897395 - RNA, 17 nt, Homo sapiens
aauaaaaguacaaagca

SEQ ID NO: 1897396 - RNA, 15 nt, Homo sapiens
gacuuucccugacag

SEQ ID NO: 1897397 - RNA, 19 nt, Homo sapiens
aagccuggacgcagccaca

SEQ ID NO: 1897398 - RNA, 22 nt, Homo sapiens
gacuucaugacaagcauuuugu

SEQ ID NO: 1897399 - RNA, 19 nt, Homo sapiens
guauccccccaucuugcuu

SEQ ID NO: 1897400 - RNA, 13 nt, Homo sapiens
caugauacauuuu

SEQ ID NO: 1897401 - RNA, 15 nt, Homo sapiens
cacagcuacacagau

SEQ ID NO: 1897402 - RNA, 15 nt, Homo sapiens
ccaggcaaccaggaa

SEQ ID NO: 1897403 - RNA, 19 nt, Homo sapiens
cugauuuuuagcuuuacaa

SEQ ID NO: 1897404 - RNA, 21 nt, Homo sapiens
ccccaagguuuuggagucagu

SEQ ID NO: 1897405 - RNA, 22 nt, Homo sapiens
ugccacuuucccacgucacuug

SEQ ID NO: 1897406 - RNA, 17 nt, Homo sapiens
cauccucaugcugcuca

SEQ ID NO: 1897407 - RNA, 22 nt, Homo sapiens
ugcauuccuuuuucuucacuua

SEQ ID NO: 1897408 - RNA, 14 nt, Homo sapiens
gguuugggagccag

SEQ ID NO: 1897409 - RNA, 14 nt, Homo sapiens
ggaccucaaaauaa

SEQ ID NO: 1897410 - RNA, 14 nt, Homo sapiens
uaauauuuggagcu

SEQ ID NO: 1897411 - RNA, 19 nt, Homo sapiens
aagauuguacuuagccagu

SEQ ID NO: 1897412 - RNA, 15 nt, Homo sapiens
uaauuguacuuugaa

SEQ ID NO: 1897413 - RNA, 15 nt, Homo sapiens
aguuuaauaccacag

SEQ ID NO: 1897414 - RNA, 9 nt, Homo sapiens
gagucucca

SEQ ID NO: 1897415 - RNA, 15 nt, Homo sapiens
gcuggagagcacugc

SEQ ID NO: 1897416 - RNA, 18 nt, Homo sapiens
agggaugugugagaauaa

SEQ ID NO: 1897417 - RNA, 18 nt, Homo sapiens
aaauaucccucauuucau

SEQ ID NO: 1897418 - RNA, 18 nt, Homo sapiens
caaauccucccuacuucc

SEQ ID NO: 1897419 - RNA, 13 nt, Homo sapiens
gccccugcccuga

SEQ ID NO: 1897420 - RNA, 14 nt, Homo sapiens
gucuuugcaaagga

SEQ ID NO: 1897421 - RNA, 14 nt, Homo sapiens
accuagggauguuc

SEQ ID NO: 1897422 - RNA, 14 nt, Homo sapiens
auaugcaugcacag

SEQ ID NO: 1897423 - RNA, 18 nt, Homo sapiens
ucccugacagagguacaa

SEQ ID NO: 1897424 - RNA, 20 nt, Homo sapiens
augacagcaguguuaagugu

SEQ ID NO: 1897425 - RNA, 16 nt, Homo sapiens
cccugcgccuccagag

SEQ ID NO: 1897426 - RNA, 16 nt, Homo sapiens
uagcucugaaugcuau

SEQ ID NO: 1897427 - RNA, 16 nt, Homo sapiens
ugaaagcaacagcugg

SEQ ID NO: 1897428 - RNA, 19 nt, Homo sapiens
ugccggguucuagucuccu

SEQ ID NO: 1897429 - RNA, 11 nt, Homo sapiens
aaaacauuucu

SEQ ID NO: 1897430 - RNA, 13 nt, Homo sapiens
cucagauucuuca

SEQ ID NO: 1897431 - RNA, 21 nt, Homo sapiens
uggucccggggccagcacuuc

SEQ ID NO: 1897432 - RNA, 23 nt, Homo sapiens
uuacauagaugauaaaagagaag

SEQ ID NO: 1897433 - RNA, 15 nt, Homo sapiens
aaaugguuucacuug

SEQ ID NO: 1897434 - RNA, 17 nt, Homo sapiens
caacugcuacugaccau

SEQ ID NO: 1897435 - RNA, 20 nt, Homo sapiens
aauugggaguccaggcacag

SEQ ID NO: 1897436 - RNA, 16 nt, Homo sapiens
cauguugaccaugucu

SEQ ID NO: 1897437 - RNA, 14 nt, Homo sapiens
cauuuaggaaugaa

SEQ ID NO: 1897438 - RNA, 21 nt, Homo sapiens
ggaggccauucugagccacac

SEQ ID NO: 1897439 - RNA, 23 nt, Homo sapiens
uacugacaacauuauaacuguau

SEQ ID NO: 1897440 - RNA, 11 nt, Homo sapiens
ccaugccaucu

SEQ ID NO: 1897441 - RNA, 24 nt, Homo sapiens
uacauuaaaauaacuaagcaagua

SEQ ID NO: 1897442 - RNA, 12 nt, Homo sapiens
uuuguugcccag

SEQ ID NO: 1897443 - RNA, 20 nt, Homo sapiens
ugccuggccucugccuccac

SEQ ID NO: 1897444 - RNA, 23 nt, Homo sapiens
ucaaggguagggugggccuucag

SEQ ID NO: 1897445 - RNA, 12 nt, Homo sapiens
aaauaaugagga

SEQ ID NO: 1897446 - RNA, 19 nt, Homo sapiens
auuauuuuaaacauuauga

SEQ ID NO: 1897447 - RNA, 18 nt, Homo sapiens
aaacaugggcugugauua

SEQ ID NO: 1897448 - RNA, 17 nt, Homo sapiens
gccugcuggcuggcagu

SEQ ID NO: 1897449 - RNA, 18 nt, Homo sapiens
cagugcgugaagaccaac

SEQ ID NO: 1897450 - RNA, 19 nt, Homo sapiens
uggaucuccauucucucag

SEQ ID NO: 1897451 - RNA, 22 nt, Homo sapiens
agcugaucgacgaggaggagug

SEQ ID NO: 1897452 - RNA, 21 nt, Homo sapiens
aaaauaugggaaagacaugca

SEQ ID NO: 1897453 - RNA, 16 nt, Homo sapiens
cacguuucaaccucuc

SEQ ID NO: 1897454 - RNA, 17 nt, Homo sapiens
uuuggggacucauuuca

SEQ ID NO: 1897455 - RNA, 15 nt, Homo sapiens
aguguugaaauugga

SEQ ID NO: 1897456 - RNA, 14 nt, Homo sapiens
gccuguugcccuuu

SEQ ID NO: 1897457 - RNA, 23 nt, Homo sapiens
ugcaaggaccuaaaacaucucau

SEQ ID NO: 1897458 - RNA, 15 nt, Homo sapiens
uguguauggugaccu

SEQ ID NO: 1897459 - RNA, 17 nt, Homo sapiens
cacugugcuugcuccua

SEQ ID NO: 1897460 - RNA, 19 nt, Homo sapiens
cuuuuaucuacuucucucu

SEQ ID NO: 1897461 - RNA, 13 nt, Homo sapiens
aauuguacaagca

SEQ ID NO: 1897462 - RNA, 22 nt, Homo sapiens
uaaaguuucuguugauaaucau

SEQ ID NO: 1897463 - RNA, 16 nt, Homo sapiens
ucucuaacuccugcca

SEQ ID NO: 1897464 - RNA, 11 nt, Homo sapiens
ugauagcuuua

SEQ ID NO: 1897465 - RNA, 17 nt, Homo sapiens
aggaaaacauugcaaua

SEQ ID NO: 1897466 - RNA, 14 nt, Homo sapiens
cauuuuuaaccacu

SEQ ID NO: 1897467 - RNA, 18 nt, Homo sapiens
gaaauugcauacuuugua

SEQ ID NO: 1897468 - RNA, 19 nt, Homo sapiens
uggagcccacuguacuugc

SEQ ID NO: 1897469 - RNA, 18 nt, Homo sapiens
aagggaaguugcuggaaa

SEQ ID NO: 1897470 - RNA, 19 nt, Homo sapiens
guucaccuaucccauuuua

SEQ ID NO: 1897471 - RNA, 23 nt, Homo sapiens
ccacucccuccuaaccuagagau

SEQ ID NO: 1897472 - RNA, 23 nt, Homo sapiens
uuauaagcagguguauacuuuua

SEQ ID NO: 1897473 - RNA, 17 nt, Homo sapiens
aaaauaugaaagacuua

SEQ ID NO: 1897474 - RNA, 15 nt, Homo sapiens
acggguaccaugcug

SEQ ID NO: 1897475 - RNA, 13 nt, Homo sapiens
ucuuuguauuuca

SEQ ID NO: 1897476 - RNA, 13 nt, Homo sapiens
cuccacaacucaa

SEQ ID NO: 1897477 - RNA, 20 nt, Homo sapiens
cauguguccccccugugguc

SEQ ID NO: 1897478 - RNA, 21 nt, Homo sapiens
gcaaaccuguucaucuugcca

SEQ ID NO: 1897479 - RNA, 14 nt, Homo sapiens
ucaaaccuguagau

SEQ ID NO: 1897480 - RNA, 17 nt, Homo sapiens
ucuugaucuguguuuua

SEQ ID NO: 1897481 - RNA, 21 nt, Homo sapiens
agucaucucaaacacugcuua

SEQ ID NO: 1897482 - RNA, 19 nt, Homo sapiens
auuuauggccgggcagggu

SEQ ID NO: 1897483 - RNA, 23 nt, Homo sapiens
auuauaguuuaaauucaauuaca

SEQ ID NO: 1897484 - RNA, 18 nt, Homo sapiens
acaguauaauuugacaaa

SEQ ID NO: 1897485 - RNA, 22 nt, Homo sapiens
augccaaaaggauaaaugucuu

SEQ ID NO: 1897486 - RNA, 23 nt, Homo sapiens
gaggacuuuauucggaccaagca

SEQ ID NO: 1897487 - RNA, 15 nt, Homo sapiens
acuucaucuucucag

SEQ ID NO: 1897488 - RNA, 12 nt, Homo sapiens
uggccaagccua

SEQ ID NO: 1897489 - RNA, 17 nt, Homo sapiens
gcucaguucugccuuau

SEQ ID NO: 1897490 - RNA, 22 nt, Homo sapiens
auagauuaccugaucaugguca

SEQ ID NO: 1897491 - RNA, 16 nt, Homo sapiens
uuuuccagcauguguu

SEQ ID NO: 1897492 - RNA, 20 nt, Homo sapiens
gcugagaucgugccacugca

SEQ ID NO: 1897493 - RNA, 15 nt, Homo sapiens
gcagugcaugugaag

SEQ ID NO: 1897494 - RNA, 18 nt, Homo sapiens
ggucucaagguucucauu

SEQ ID NO: 1897495 - RNA, 15 nt, Homo sapiens
aggugccacuggagu

SEQ ID NO: 1897496 - RNA, 16 nt, Homo sapiens
aggaaggaagcacaaa

SEQ ID NO: 1897497 - RNA, 20 nt, Homo sapiens
aaugaugucaugucagcucc

SEQ ID NO: 1897498 - RNA, 20 nt, Homo sapiens
auuuuuuuuuuuuacuugaa

SEQ ID NO: 1897499 - RNA, 16 nt, Homo sapiens
gggacaucucuuugaa

SEQ ID NO: 1897500 - RNA, 18 nt, Homo sapiens
caucuaauguauuaugag

SEQ ID NO: 1897501 - RNA, 16 nt, Homo sapiens
acguccugccuggcac

SEQ ID NO: 1897502 - RNA, 23 nt, Homo sapiens
uccuggaaccaaucccgugaaag

SEQ ID NO: 1897503 - RNA, 13 nt, Homo sapiens
aaaaucuccaucu

SEQ ID NO: 1897504 - RNA, 19 nt, Homo sapiens
cugcccaaggaugcuguca

SEQ ID NO: 1897505 - RNA, 13 nt, Homo sapiens
caccacgaauuug

SEQ ID NO: 1897506 - RNA, 19 nt, Homo sapiens
cuugguugugaaccaacug

SEQ ID NO: 1897507 - RNA, 15 nt, Homo sapiens
aaaaccuuuccccag

SEQ ID NO: 1897508 - RNA, 13 nt, Homo sapiens
uggaaaccacagu

SEQ ID NO: 1897509 - RNA, 18 nt, Homo sapiens
acacucuagugacuuccu

SEQ ID NO: 1897510 - RNA, 19 nt, Homo sapiens
gaaguacucauacauguua

SEQ ID NO: 1897511 - RNA, 20 nt, Homo sapiens
cauuggccggcuucccaugc

SEQ ID NO: 1897512 - RNA, 17 nt, Homo sapiens
agacuuccaucuaguca

SEQ ID NO: 1897513 - RNA, 12 nt, Homo sapiens
gcuccagaauua

SEQ ID NO: 1897514 - RNA, 22 nt, Homo sapiens
ugaauguuugaacugccaagaa

SEQ ID NO: 1897515 - RNA, 17 nt, Homo sapiens
gcuggccucucugacau

SEQ ID NO: 1897516 - RNA, 19 nt, Homo sapiens
cucugaaacauggccuguu

SEQ ID NO: 1897517 - RNA, 23 nt, Homo sapiens
ugacucuccagaaagcucaucuc

SEQ ID NO: 1897518 - RNA, 19 nt, Homo sapiens
cacuucccccauuggacac

SEQ ID NO: 1897519 - RNA, 17 nt, Homo sapiens
acauuccagaugcauga

SEQ ID NO: 1897520 - RNA, 22 nt, Homo sapiens
uuccccaccaaccccuccaaug

SEQ ID NO: 1897521 - RNA, 14 nt, Homo sapiens
acccccagcauuac

SEQ ID NO: 1897522 - RNA, 23 nt, Homo sapiens
uguaccuuucuucacugcagauu

SEQ ID NO: 1897523 - RNA, 23 nt, Homo sapiens
aauuguaacgacuucuccaucuc

SEQ ID NO: 1897524 - RNA, 17 nt, Homo sapiens
guaaauauucuugucca

SEQ ID NO: 1897525 - RNA, 16 nt, Homo sapiens
cuaaauccaaaugagg

SEQ ID NO: 1897526 - RNA, 18 nt, Homo sapiens
aacucucgagacuucucu

SEQ ID NO: 1897527 - RNA, 14 nt, Homo sapiens
agcuaggaugguuc

SEQ ID NO: 1897528 - RNA, 13 nt, Homo sapiens
cugcuccaugcag

SEQ ID NO: 1897529 - RNA, 15 nt, Homo sapiens
cuuuauaaaugcauu

SEQ ID NO: 1897530 - RNA, 23 nt, Homo sapiens
gagccaagggguagaaguggcau

SEQ ID NO: 1897531 - RNA, 20 nt, Homo sapiens
uucuuuuuccacaaggaaua

SEQ ID NO: 1897532 - RNA, 14 nt, Homo sapiens
aaggaaggcauuug

SEQ ID NO: 1897533 - RNA, 21 nt, Homo sapiens
gaacaaacacugcaguuuccu

SEQ ID NO: 1897534 - RNA, 18 nt, Homo sapiens
aguguauuuuaaauguga

SEQ ID NO: 1897535 - RNA, 21 nt, Homo sapiens
augccuuccgacaccacuggg

SEQ ID NO: 1897536 - RNA, 14 nt, Homo sapiens
cuuagcuugcacau

SEQ ID NO: 1897537 - RNA, 17 nt, Homo sapiens
ugcucaaaaucuuucca

SEQ ID NO: 1897538 - RNA, 15 nt, Homo sapiens
gccauaaaugaccua

SEQ ID NO: 1897539 - RNA, 16 nt, Homo sapiens
uaauagucuuugccag

SEQ ID NO: 1897540 - RNA, 17 nt, Homo sapiens
ugccgcuuucucugagg

SEQ ID NO: 1897541 - RNA, 17 nt, Homo sapiens
cuguuccagauuccuau

SEQ ID NO: 1897542 - RNA, 14 nt, Homo sapiens
ucaaauuuagcaac

SEQ ID NO: 1897543 - RNA, 18 nt, Homo sapiens
auagcgagaagaugcucu

SEQ ID NO: 1897544 - RNA, 13 nt, Homo sapiens
cuuucaaagccau

SEQ ID NO: 1897545 - RNA, 16 nt, Homo sapiens
ccuaaacuuacauuua

SEQ ID NO: 1897546 - RNA, 23 nt, Homo sapiens
cuucagcuauacuuacacuguau

SEQ ID NO: 1897547 - RNA, 14 nt, Homo sapiens
auacaaguuacaua

SEQ ID NO: 1897548 - RNA, 16 nt, Homo sapiens
aaaguuuaagcaauuc

SEQ ID NO: 1897549 - RNA, 17 nt, Homo sapiens
gcuuaaaacacuucuaa

SEQ ID NO: 1897550 - RNA, 13 nt, Homo sapiens
cuacuugcugucc

SEQ ID NO: 1897551 - RNA, 23 nt, Homo sapiens
cccaaacauguuguacauuucac

SEQ ID NO: 1897552 - RNA, 23 nt, Homo sapiens
ugcagcuugugcugagccugccc

SEQ ID NO: 1897553 - RNA, 14 nt, Homo sapiens
ucuuaauucuuagc

SEQ ID NO: 1897554 - RNA, 22 nt, Homo sapiens
ucccaaaagcccauucauucca

SEQ ID NO: 1897555 - RNA, 19 nt, Homo sapiens
cuuaagucauaaugaauaa

SEQ ID NO: 1897556 - RNA, 15 nt, Homo sapiens
ucagacugucagaaa

SEQ ID NO: 1897557 - RNA, 19 nt, Homo sapiens
aggcucugagggucugaaa

SEQ ID NO: 1897558 - RNA, 18 nt, Homo sapiens
cagccucccgaguagcug

SEQ ID NO: 1897559 - RNA, 17 nt, Homo sapiens
agucaacaguaucugug

SEQ ID NO: 1897560 - RNA, 18 nt, Homo sapiens
guuugacuagccaucuca

SEQ ID NO: 1897561 - RNA, 14 nt, Homo sapiens
aauguuaagcuuua

SEQ ID NO: 1897562 - RNA, 16 nt, Homo sapiens
aggcaggugacaguga

SEQ ID NO: 1897563 - RNA, 20 nt, Homo sapiens
aaggagcacauacuaccuag

SEQ ID NO: 1897564 - RNA, 21 nt, Homo sapiens
cuggacaguaucccacaucca

SEQ ID NO: 1897565 - RNA, 18 nt, Homo sapiens
cugccuuuuuacuauaca

SEQ ID NO: 1897566 - RNA, 22 nt, Homo sapiens
gaacuuuagcaugguauugaag

SEQ ID NO: 1897567 - RNA, 17 nt, Homo sapiens
gaagauggcacugucca

SEQ ID NO: 1897568 - RNA, 22 nt, Homo sapiens
caaucuggggauacuggcaaag

SEQ ID NO: 1897569 - RNA, 13 nt, Homo sapiens
ggugacacaucca

SEQ ID NO: 1897570 - RNA, 18 nt, Homo sapiens
cacacaccuguagcacuu

SEQ ID NO: 1897571 - RNA, 21 nt, Homo sapiens
uuuccacaauucuucugucaa

SEQ ID NO: 1897572 - RNA, 20 nt, Homo sapiens
uucuccuucgcuuuccugag

SEQ ID NO: 1897573 - RNA, 11 nt, Homo sapiens
agccagaaagg

SEQ ID NO: 1897574 - RNA, 15 nt, Homo sapiens
caauccuuaguccua

SEQ ID NO: 1897575 - RNA, 13 nt, Homo sapiens
acagaugugucag

SEQ ID NO: 1897576 - RNA, 19 nt, Homo sapiens
aacucagugugacuccuca

SEQ ID NO: 1897577 - RNA, 21 nt, Homo sapiens
gucuuugcaccaaagaugucc

SEQ ID NO: 1897578 - RNA, 15 nt, Homo sapiens
caguagcacaaguua

SEQ ID NO: 1897579 - RNA, 17 nt, Homo sapiens
uuccaacugccagaaca

SEQ ID NO: 1897580 - RNA, 17 nt, Homo sapiens
gugcagcuucgaggaca

SEQ ID NO: 1897581 - RNA, 18 nt, Homo sapiens
caacccugccccuuucug

SEQ ID NO: 1897582 - RNA, 18 nt, Homo sapiens
ucucauuuaaaaugagau

SEQ ID NO: 1897583 - RNA, 12 nt, Homo sapiens
aaacauugaaga

SEQ ID NO: 1897584 - RNA, 20 nt, Homo sapiens
ggugggagugggcccaaugc

SEQ ID NO: 1897585 - RNA, 21 nt, Homo sapiens
uaucuaccugcccucucucag

SEQ ID NO: 1897586 - RNA, 19 nt, Homo sapiens
aaauuuaacaguuaccuga

SEQ ID NO: 1897587 - RNA, 18 nt, Homo sapiens
agcccauccagucuccca

SEQ ID NO: 1897588 - RNA, 15 nt, Homo sapiens
acaucauaacccaug

SEQ ID NO: 1897589 - RNA, 13 nt, Homo sapiens
uugauuggauaaa

SEQ ID NO: 1897590 - RNA, 13 nt, Homo sapiens
ugcacaugaaucc

SEQ ID NO: 1897591 - RNA, 13 nt, Homo sapiens
ugcaaaugaauca

SEQ ID NO: 1897592 - RNA, 12 nt, Homo sapiens
aaaugugacuug

SEQ ID NO: 1897593 - RNA, 13 nt, Homo sapiens
cuacccaguacuc

SEQ ID NO: 1897594 - RNA, 13 nt, Homo sapiens
uccagagggcacu

SEQ ID NO: 1897595 - RNA, 17 nt, Homo sapiens
gaaucaugaaguaaauu

SEQ ID NO: 1897596 - RNA, 14 nt, Homo sapiens
uuauuccucccuca

SEQ ID NO: 1897597 - RNA, 13 nt, Homo sapiens
cauuaacuucucu

SEQ ID NO: 1897598 - RNA, 14 nt, Homo sapiens
gcucugcugcugau

SEQ ID NO: 1897599 - RNA, 19 nt, Homo sapiens
uugugggcaacacaugcag

SEQ ID NO: 1897600 - RNA, 19 nt, Homo sapiens
ccugaggcaagccauggag

SEQ ID NO: 1897601 - RNA, 17 nt, Homo sapiens
gccccucacauccucuc

SEQ ID NO: 1897602 - RNA, 15 nt, Homo sapiens
accuaccacaguguc

SEQ ID NO: 1897603 - RNA, 16 nt, Homo sapiens
agguauaacagcacaa

SEQ ID NO: 1897604 - RNA, 20 nt, Homo sapiens
gggugaggggccaggccaug

SEQ ID NO: 1897605 - RNA, 18 nt, Homo sapiens
ccuggcaaaaaugcaaca

SEQ ID NO: 1897606 - RNA, 16 nt, Homo sapiens
ggacuccaucgcuaaa

SEQ ID NO: 1897607 - RNA, 18 nt, Homo sapiens
uucucacuagaugacugu

SEQ ID NO: 1897608 - RNA, 22 nt, Homo sapiens
uggucuccgcucugaauuggau

SEQ ID NO: 1897609 - RNA, 17 nt, Homo sapiens
cugaggaguguccuguc

SEQ ID NO: 1897610 - RNA, 11 nt, Homo sapiens
caagagccaug

SEQ ID NO: 1897611 - RNA, 21 nt, Homo sapiens
caggaaaagguagcuuaccug

SEQ ID NO: 1897612 - RNA, 18 nt, Homo sapiens
ccauucuggcacuuuaau

SEQ ID NO: 1897613 - RNA, 15 nt, Homo sapiens
ugauacaugccgaau

SEQ ID NO: 1897614 - RNA, 15 nt, Homo sapiens
ccagugagaagcuga

SEQ ID NO: 1897615 - RNA, 21 nt, Homo sapiens
gauccaccugucucagccucc

SEQ ID NO: 1897616 - RNA, 19 nt, Homo sapiens
aucaagaaauaaccaugaa

SEQ ID NO: 1897617 - RNA, 13 nt, Homo sapiens
ccuuuccuuccag

SEQ ID NO: 1897618 - RNA, 19 nt, Homo sapiens
ucucuggagcauucugaaa

SEQ ID NO: 1897619 - RNA, 20 nt, Homo sapiens
uuucaauuucuagaggaacu

SEQ ID NO: 1897620 - RNA, 16 nt, Homo sapiens
aauuauuuugguacuu

SEQ ID NO: 1897621 - RNA, 14 nt, Homo sapiens
gaagaaaugggaga

SEQ ID NO: 1897622 - RNA, 13 nt, Homo sapiens
ggaguguacuggc

SEQ ID NO: 1897623 - RNA, 16 nt, Homo sapiens
ccacuccacuacucuc

SEQ ID NO: 1897624 - RNA, 23 nt, Homo sapiens
gaaagcuugcccuggugccucac

SEQ ID NO: 1897625 - RNA, 23 nt, Homo sapiens
ugaacaccacgcuugacaggaca

SEQ ID NO: 1897626 - RNA, 15 nt, Homo sapiens
aggaagcucucuuaa

SEQ ID NO: 1897627 - RNA, 14 nt, Homo sapiens
agucauggccaaau

SEQ ID NO: 1897628 - RNA, 19 nt, Homo sapiens
auguggagugagaacagca

SEQ ID NO: 1897629 - RNA, 17 nt, Homo sapiens
ccugguccucacacuca

SEQ ID NO: 1897630 - RNA, 12 nt, Homo sapiens
augaaccuggac

SEQ ID NO: 1897631 - RNA, 20 nt, Homo sapiens
ccauggcuucccagagcucc

SEQ ID NO: 1897632 - RNA, 19 nt, Homo sapiens
caaccugugaucaagcaau

SEQ ID NO: 1897633 - RNA, 21 nt, Homo sapiens
uucaucaauuuuuauacauau

SEQ ID NO: 1897634 - RNA, 17 nt, Homo sapiens
cucuaugguguggcaaa

SEQ ID NO: 1897635 - RNA, 15 nt, Homo sapiens
gccaacuuguaaaua

SEQ ID NO: 1897636 - RNA, 20 nt, Homo sapiens
ucucauuuuucuaaaauaca

SEQ ID NO: 1897637 - RNA, 21 nt, Homo sapiens
gguccugggggcugcugcacu

SEQ ID NO: 1897638 - RNA, 15 nt, Homo sapiens
cauugccuuccuacc

SEQ ID NO: 1897639 - RNA, 15 nt, Homo sapiens
gucacucuggcagcu

SEQ ID NO: 1897640 - RNA, 21 nt, Homo sapiens
uagcacccugcccucauggga

SEQ ID NO: 1897641 - RNA, 23 nt, Homo sapiens
ccaaguagcugggauuacaggca

SEQ ID NO: 1897642 - RNA, 12 nt, Homo sapiens
cugacauucacu

SEQ ID NO: 1897643 - RNA, 15 nt, Homo sapiens
uagaaaaauggacua

SEQ ID NO: 1897644 - RNA, 14 nt, Homo sapiens
uugauucugauaau

SEQ ID NO: 1897645 - RNA, 21 nt, Homo sapiens
augcaauaaaauuauuugcag

SEQ ID NO: 1897646 - RNA, 17 nt, Homo sapiens
caggcuuugucugcucc

SEQ ID NO: 1897647 - RNA, 22 nt, Homo sapiens
agaccuuccagaaauacuacug

SEQ ID NO: 1897648 - RNA, 22 nt, Homo sapiens
uuccccucuacuccaugcacau

SEQ ID NO: 1897649 - RNA, 21 nt, Homo sapiens
cauggccacauccaacauuuc

SEQ ID NO: 1897650 - RNA, 13 nt, Homo sapiens
aggcaaaugaugc

SEQ ID NO: 1897651 - RNA, 19 nt, Homo sapiens
uuugaggccuuuuuugcca

SEQ ID NO: 1897652 - RNA, 14 nt, Homo sapiens
aaccaguuacccaa

SEQ ID NO: 1897653 - RNA, 14 nt, Homo sapiens
gcccuguugaccua

SEQ ID NO: 1897654 - RNA, 20 nt, Homo sapiens
ucuuugccucaacuccagga

SEQ ID NO: 1897655 - RNA, 19 nt, Homo sapiens
cugaaauaaaaggugcugu

SEQ ID NO: 1897656 - RNA, 16 nt, Homo sapiens
gacuugagccacuccu

SEQ ID NO: 1897657 - RNA, 21 nt, Homo sapiens
auugucuaaucuguagaagcu

SEQ ID NO: 1897658 - RNA, 17 nt, Homo sapiens
auggaaguggcagugaa

SEQ ID NO: 1897659 - RNA, 21 nt, Homo sapiens
cccacauccuucucacugcca

SEQ ID NO: 1897660 - RNA, 16 nt, Homo sapiens
gccaggcacacacugu

SEQ ID NO: 1897661 - RNA, 18 nt, Homo sapiens
uacauaugaucaaauacu

SEQ ID NO: 1897662 - RNA, 15 nt, Homo sapiens
uacuugcuaucuaua

SEQ ID NO: 1897663 - RNA, 19 nt, Homo sapiens
auccuguucucauggauuu

SEQ ID NO: 1897664 - RNA, 13 nt, Homo sapiens
acaugaacauaug

SEQ ID NO: 1897665 - RNA, 14 nt, Homo sapiens
ggcuggugggauag

SEQ ID NO: 1897666 - RNA, 18 nt, Homo sapiens
auguugcuuuugcaccua

SEQ ID NO: 1897667 - RNA, 13 nt, Homo sapiens
gaccgaggccaga

SEQ ID NO: 1897668 - RNA, 17 nt, Homo sapiens
cauccugaccuugcaca

SEQ ID NO: 1897669 - RNA, 18 nt, Homo sapiens
ugcuuccaacucauccac

SEQ ID NO: 1897670 - RNA, 18 nt, Homo sapiens
uaaugagugaguucucac

SEQ ID NO: 1897671 - RNA, 15 nt, Homo sapiens
uuucauaccaaauau

SEQ ID NO: 1897672 - RNA, 22 nt, Homo sapiens
acauauaggagcaauacuauua

SEQ ID NO: 1897673 - RNA, 15 nt, Homo sapiens
agagugauugcagcu

SEQ ID NO: 1897674 - RNA, 23 nt, Homo sapiens
gcccccucccuggaugacauuaa

SEQ ID NO: 1897675 - RNA, 22 nt, Homo sapiens
caugguucauuuucugaugccc

SEQ ID NO: 1897676 - RNA, 18 nt, Homo sapiens
cauuacuauucacugaug

SEQ ID NO: 1897677 - RNA, 18 nt, Homo sapiens
gcccugucaugugccuug

SEQ ID NO: 1897678 - RNA, 22 nt, Homo sapiens
acagaugugaaaugaauguaau

SEQ ID NO: 1897679 - RNA, 18 nt, Homo sapiens
aaaaugucuuaaugcaaa

SEQ ID NO: 1897680 - RNA, 13 nt, Homo sapiens
caauuacugugag

SEQ ID NO: 1897681 - RNA, 16 nt, Homo sapiens
acucagacacaaauaa

SEQ ID NO: 1897682 - RNA, 19 nt, Homo sapiens
gaaauagucggugaagaaa

SEQ ID NO: 1897683 - RNA, 18 nt, Homo sapiens
uguucuagaaacauguaa

SEQ ID NO: 1897684 - RNA, 20 nt, Homo sapiens
ucaacagccauuuaggcaaa

SEQ ID NO: 1897685 - RNA, 13 nt, Homo sapiens
ucucucacuggcu

SEQ ID NO: 1897686 - RNA, 15 nt, Homo sapiens
acaccaccacugugu

SEQ ID NO: 1897687 - RNA, 16 nt, Homo sapiens
uuaauaguguuuacau

SEQ ID NO: 1897688 - RNA, 22 nt, Homo sapiens
cuuagcuauugcucugagaaag

SEQ ID NO: 1897689 - RNA, 21 nt, Homo sapiens
ucccaagggaggcccauguga

SEQ ID NO: 1897690 - RNA, 21 nt, Homo sapiens
uuuagaugugcugcuuugaua

SEQ ID NO: 1897691 - RNA, 23 nt, Homo sapiens
uacccuuggaaagaaauguagau

SEQ ID NO: 1897692 - RNA, 19 nt, Homo sapiens
caccaguguguggcuuuca

SEQ ID NO: 1897693 - RNA, 23 nt, Homo sapiens
uuagaaauaaaccuuaauauuuc

SEQ ID NO: 1897694 - RNA, 15 nt, Homo sapiens
uuuccuuuuaugaga

SEQ ID NO: 1897695 - RNA, 14 nt, Homo sapiens
cagaguaacaggau

SEQ ID NO: 1897696 - RNA, 14 nt, Homo sapiens
ccaaagaaccaggg

SEQ ID NO: 1897697 - RNA, 21 nt, Homo sapiens
auguaguauuaaaaguugcau

SEQ ID NO: 1897698 - RNA, 14 nt, Homo sapiens
uugaaagcuguaua

SEQ ID NO: 1897699 - RNA, 13 nt, Homo sapiens
gcuguuguccaac

SEQ ID NO: 1897700 - RNA, 18 nt, Homo sapiens
ugacugccggucauuuga

SEQ ID NO: 1897701 - RNA, 18 nt, Homo sapiens
uugugcaaaauauuugac

SEQ ID NO: 1897702 - RNA, 23 nt, Homo sapiens
cugucugcccugaacccacugcu

SEQ ID NO: 1897703 - RNA, 13 nt, Homo sapiens
acaaaacgagaua

SEQ ID NO: 1897704 - RNA, 13 nt, Homo sapiens
ugcugacguccag

SEQ ID NO: 1897705 - RNA, 13 nt, Homo sapiens
cuuucgaggccug

SEQ ID NO: 1897706 - RNA, 22 nt, Homo sapiens
guauauugguuuuaugaugacg

SEQ ID NO: 1897707 - RNA, 19 nt, Homo sapiens
cuucuggggguagaucuca

SEQ ID NO: 1897708 - RNA, 22 nt, Homo sapiens
cccuguggccaacugcaaaaaa

SEQ ID NO: 1897709 - RNA, 15 nt, Homo sapiens
uucacagcaccaaaa

SEQ ID NO: 1897710 - RNA, 22 nt, Homo sapiens
ucaaaauaaaaauuaaauguga

SEQ ID NO: 1897711 - RNA, 20 nt, Homo sapiens
uucuaaagagucuggaacaa

SEQ ID NO: 1897712 - RNA, 18 nt, Homo sapiens
acuaaauuugaacuuaaa

SEQ ID NO: 1897713 - RNA, 23 nt, Homo sapiens
ugucgauuauauuccuuugccaa

SEQ ID NO: 1897714 - RNA, 22 nt, Homo sapiens
acuaaugaucacauucuuucca

SEQ ID NO: 1897715 - RNA, 12 nt, Homo sapiens
uaaucagcaaaa

SEQ ID NO: 1897716 - RNA, 22 nt, Homo sapiens
uaagcugggaaaaaaguuuuga

SEQ ID NO: 1897717 - RNA, 15 nt, Homo sapiens
cccacuucugccaua

SEQ ID NO: 1897718 - RNA, 19 nt, Homo sapiens
auugauaacagcacugacu

SEQ ID NO: 1897719 - RNA, 17 nt, Homo sapiens
cuggcuuugcacuugac

SEQ ID NO: 1897720 - RNA, 17 nt, Homo sapiens
aauguuucccucaagaa

SEQ ID NO: 1897721 - RNA, 16 nt, Homo sapiens
uucacuguacugcaug

SEQ ID NO: 1897722 - RNA, 20 nt, Homo sapiens
ucuggaggacggucagucca

SEQ ID NO: 1897723 - RNA, 23 nt, Homo sapiens
gaucaccugaacuuucucuagca

SEQ ID NO: 1897724 - RNA, 18 nt, Homo sapiens
cagaguauuaucacugcu

SEQ ID NO: 1897725 - RNA, 23 nt, Homo sapiens
caagcugcucuccuucacucuga

SEQ ID NO: 1897726 - RNA, 13 nt, Homo sapiens
guuuaacucagau

SEQ ID NO: 1897727 - RNA, 15 nt, Homo sapiens
gcccuaaaaugacaa

SEQ ID NO: 1897728 - RNA, 22 nt, Homo sapiens
ucaggcuaucauauauacugua

SEQ ID NO: 1897729 - RNA, 19 nt, Homo sapiens
gucccaggccaggcuuugu

SEQ ID NO: 1897730 - RNA, 16 nt, Homo sapiens
ugcugagucagacugu

SEQ ID NO: 1897731 - RNA, 13 nt, Homo sapiens
ggcauaccaaaau

SEQ ID NO: 1897732 - RNA, 17 nt, Homo sapiens
ugauccagucacagcca

SEQ ID NO: 1897733 - RNA, 21 nt, Homo sapiens
cuuuacaaaccauuaccugua

SEQ ID NO: 1897734 - RNA, 21 nt, Homo sapiens
uucagauggcaauuucacuga

SEQ ID NO: 1897735 - RNA, 14 nt, Homo sapiens
agauucagugcaau

SEQ ID NO: 1897736 - RNA, 15 nt, Homo sapiens
uauuaacuugcuaca

SEQ ID NO: 1897737 - RNA, 12 nt, Homo sapiens
caccugcagugc

SEQ ID NO: 1897738 - RNA, 22 nt, Homo sapiens
caaguguuuauuaaaauacugu

SEQ ID NO: 1897739 - RNA, 19 nt, Homo sapiens
aaacgugagcuacaugugu

SEQ ID NO: 1897740 - RNA, 22 nt, Homo sapiens
aaugacacuagcuaauaucaau

SEQ ID NO: 1897741 - RNA, 23 nt, Homo sapiens
cuugacugaagcgaacaucuuca

SEQ ID NO: 1897742 - RNA, 19 nt, Homo sapiens
uguugucaccagaucugau

SEQ ID NO: 1897743 - RNA, 18 nt, Homo sapiens
uucugaaaauuuauauaa

SEQ ID NO: 1897744 - RNA, 19 nt, Homo sapiens
agauaaauaaauauaugau

SEQ ID NO: 1897745 - RNA, 17 nt, Homo sapiens
uggaaaguuuucuccac

SEQ ID NO: 1897746 - RNA, 14 nt, Homo sapiens
gaaucuaaaugaag

SEQ ID NO: 1897747 - RNA, 15 nt, Homo sapiens
cuaauuuacaagcac

SEQ ID NO: 1897748 - RNA, 18 nt, Homo sapiens
aaacccacauucuuacca

SEQ ID NO: 1897749 - RNA, 16 nt, Homo sapiens
cuccuagcucccugcc

SEQ ID NO: 1897750 - RNA, 20 nt, Homo sapiens
agacaccaauggauccuugu

SEQ ID NO: 1897751 - RNA, 22 nt, Homo sapiens
uuuuguaaauguucuugguguu

SEQ ID NO: 1897752 - RNA, 15 nt, Homo sapiens
ccucauuaguaauaa

SEQ ID NO: 1897753 - RNA, 16 nt, Homo sapiens
uaaaaagaaaaaccac

SEQ ID NO: 1897754 - RNA, 16 nt, Homo sapiens
uaaacacuuaucuucu

SEQ ID NO: 1897755 - RNA, 21 nt, Homo sapiens
ucugcucucuuggaaacauuu

SEQ ID NO: 1897756 - RNA, 22 nt, Homo sapiens
ucugcacccucgacaagaccac

SEQ ID NO: 1897757 - RNA, 22 nt, Homo sapiens
uccaauuuaacuuaacucuuac

SEQ ID NO: 1897758 - RNA, 19 nt, Homo sapiens
uaguguuggaaaaugugca

SEQ ID NO: 1897759 - RNA, 19 nt, Homo sapiens
ucaagcuggaguacgugaa

SEQ ID NO: 1897760 - RNA, 15 nt, Homo sapiens
aaagaaaauugccaa

SEQ ID NO: 1897761 - RNA, 15 nt, Homo sapiens
cugugcaugaccuga

SEQ ID NO: 1897762 - RNA, 20 nt, Homo sapiens
guaaaugggggugcauuuga

SEQ ID NO: 1897763 - RNA, 14 nt, Homo sapiens
cugggcgagacaca

SEQ ID NO: 1897764 - RNA, 21 nt, Homo sapiens
ucacuugguucaguaccacau

SEQ ID NO: 1897765 - RNA, 17 nt, Homo sapiens
cauaaagccauguuucc

SEQ ID NO: 1897766 - RNA, 20 nt, Homo sapiens
aagggugccuggcugggcuu

SEQ ID NO: 1897767 - RNA, 17 nt, Homo sapiens
uuccauucagugcagca

SEQ ID NO: 1897768 - RNA, 19 nt, Homo sapiens
auggucccuugucaccagg

SEQ ID NO: 1897769 - RNA, 17 nt, Homo sapiens
cccccgagcuugccuca

SEQ ID NO: 1897770 - RNA, 19 nt, Homo sapiens
aggacaaagugccaaagaa

SEQ ID NO: 1897771 - RNA, 18 nt, Homo sapiens
ggaaagcauuuucucuca

SEQ ID NO: 1897772 - RNA, 23 nt, Homo sapiens
ucacaccaggcuugccugcaggc

SEQ ID NO: 1897773 - RNA, 19 nt, Homo sapiens
cuucugcaucuuacaguca

SEQ ID NO: 1897774 - RNA, 17 nt, Homo sapiens
uggagaaaucacagaga

SEQ ID NO: 1897775 - RNA, 16 nt, Homo sapiens
uuuuaacuuauugaca

SEQ ID NO: 1897776 - RNA, 21 nt, Homo sapiens
ucaagaaccgguuuccaaaga

SEQ ID NO: 1897777 - RNA, 11 nt, Homo sapiens
gcugcaucucc

SEQ ID NO: 1897778 - RNA, 11 nt, Homo sapiens
ggugcaucugc

SEQ ID NO: 1897779 - RNA, 14 nt, Homo sapiens
gagaggugauucuc

SEQ ID NO: 1897780 - RNA, 13 nt, Homo sapiens
aaaauacuaccua

SEQ ID NO: 1897781 - RNA, 13 nt, Homo sapiens
acuccaccucaaa

SEQ ID NO: 1897782 - RNA, 14 nt, Homo sapiens
ugcgcgucaucucu

SEQ ID NO: 1897783 - RNA, 17 nt, Homo sapiens
cugccuuuucaucuaau

SEQ ID NO: 1897784 - RNA, 15 nt, Homo sapiens
aaggugggcacugga

SEQ ID NO: 1897785 - RNA, 13 nt, Homo sapiens
ucuggcucuuguc

SEQ ID NO: 1897786 - RNA, 16 nt, Homo sapiens
aaagggugacuuacau

SEQ ID NO: 1897787 - RNA, 15 nt, Homo sapiens
agucuguguucaaaa

SEQ ID NO: 1897788 - RNA, 22 nt, Homo sapiens
gcaagagaaaauaagcaggaca

SEQ ID NO: 1897789 - RNA, 16 nt, Homo sapiens
aacaugaauauuuagu

SEQ ID NO: 1897790 - RNA, 20 nt, Homo sapiens
augucgauguucgaugcuga

SEQ ID NO: 1897791 - RNA, 19 nt, Homo sapiens
gaaucacuugacuuugcca

SEQ ID NO: 1897792 - RNA, 22 nt, Homo sapiens
ccauauagcucgagcaaaauuc

SEQ ID NO: 1897793 - RNA, 15 nt, Homo sapiens
agcgaggagugacug

SEQ ID NO: 1897794 - RNA, 15 nt, Homo sapiens
uggaugucacugccu

SEQ ID NO: 1897795 - RNA, 12 nt, Homo sapiens
aauguuucacua

SEQ ID NO: 1897796 - RNA, 14 nt, Homo sapiens
aacuguaugaaugu

SEQ ID NO: 1897797 - RNA, 14 nt, Homo sapiens
uuuggggcugcgaa

SEQ ID NO: 1897798 - RNA, 16 nt, Homo sapiens
gcccuacuucuuugcu

SEQ ID NO: 1897799 - RNA, 14 nt, Homo sapiens
auaaaauacuucuu

SEQ ID NO: 1897800 - RNA, 14 nt, Homo sapiens
cauauuuaaaacaa

SEQ ID NO: 1897801 - RNA, 12 nt, Homo sapiens
aaucaacuuuac

SEQ ID NO: 1897802 - RNA, 15 nt, Homo sapiens
cuguuaccauucuga

SEQ ID NO: 1897803 - RNA, 17 nt, Homo sapiens
cacaaaaugcaagguga

SEQ ID NO: 1897804 - RNA, 12 nt, Homo sapiens
uauguauacaca

SEQ ID NO: 1897805 - RNA, 15 nt, Homo sapiens
guaugacugcacaug

SEQ ID NO: 1897806 - RNA, 22 nt, Homo sapiens
aaaucugccacaaaaacaggua

SEQ ID NO: 1897807 - RNA, 21 nt, Homo sapiens
uucagugcaaauuguaucuua

SEQ ID NO: 1897808 - RNA, 15 nt, Homo sapiens
cuggaaguccuggcc

SEQ ID NO: 1897809 - RNA, 23 nt, Homo sapiens
ccucugcuguauugauaucacua

SEQ ID NO: 1897810 - RNA, 21 nt, Homo sapiens
cccauuucuauacaacaggca

SEQ ID NO: 1897811 - RNA, 14 nt, Homo sapiens
caaauucacuuuau

SEQ ID NO: 1897812 - RNA, 12 nt, Homo sapiens
uaucuacugugg

SEQ ID NO: 1897813 - RNA, 22 nt, Homo sapiens
ugaauuuugggacuucuaccca

SEQ ID NO: 1897814 - RNA, 20 nt, Homo sapiens
caucccggagcgcaccugcu

SEQ ID NO: 1897815 - RNA, 23 nt, Homo sapiens
agaagcuccugaaucccuuucag

SEQ ID NO: 1897816 - RNA, 14 nt, Homo sapiens
aguggcuucacucc

SEQ ID NO: 1897817 - RNA, 16 nt, Homo sapiens
ucgauguaagggauuc

SEQ ID NO: 1897818 - RNA, 14 nt, Homo sapiens
cugacagagguaca

SEQ ID NO: 1897819 - RNA, 16 nt, Homo sapiens
uuaauaccagcuuaaa

SEQ ID NO: 1897820 - RNA, 19 nt, Homo sapiens
ucaagauuaaacugaguga

SEQ ID NO: 1897821 - RNA, 16 nt, Homo sapiens
cuaugagagauagcuu

SEQ ID NO: 1897822 - RNA, 14 nt, Homo sapiens
aguugcagccaggg

SEQ ID NO: 1897823 - RNA, 15 nt, Homo sapiens
aacaaauugaugcaa

SEQ ID NO: 1897824 - RNA, 15 nt, Homo sapiens
gccugcauggagaag

SEQ ID NO: 1897825 - RNA, 19 nt, Homo sapiens
aguguaaccuugcaucuca

SEQ ID NO: 1897826 - RNA, 21 nt, Homo sapiens
augagaguucuuuauauucaa

SEQ ID NO: 1897827 - RNA, 14 nt, Homo sapiens
cagagacagcuuga

SEQ ID NO: 1897828 - RNA, 14 nt, Homo sapiens
ucaucaggaccaaa

SEQ ID NO: 1897829 - RNA, 16 nt, Homo sapiens
ugauugaaucauugcc

SEQ ID NO: 1897830 - RNA, 15 nt, Homo sapiens
uguuuauagugcucu

SEQ ID NO: 1897831 - RNA, 23 nt, Homo sapiens
cucugugucagcaucuuugcccu

SEQ ID NO: 1897832 - RNA, 17 nt, Homo sapiens
uaguugguuuccuucac

SEQ ID NO: 1897833 - RNA, 20 nt, Homo sapiens
aauaaagcuucucucugagc

SEQ ID NO: 1897834 - RNA, 16 nt, Homo sapiens
cgugacacaaacacac

SEQ ID NO: 1897835 - RNA, 14 nt, Homo sapiens
uaaaaacacuacag

SEQ ID NO: 1897836 - RNA, 15 nt, Homo sapiens
cuugacaacaucuga

SEQ ID NO: 1897837 - RNA, 12 nt, Homo sapiens
augaucuagguu

SEQ ID NO: 1897838 - RNA, 17 nt, Homo sapiens
ccuggguggggcugcuc

SEQ ID NO: 1897839 - RNA, 14 nt, Homo sapiens
ccagaugaagcuuu

SEQ ID NO: 1897840 - RNA, 14 nt, Homo sapiens
ugaaaaaaaaaugg

SEQ ID NO: 1897841 - RNA, 14 nt, Homo sapiens
acagcauacuucaa

SEQ ID NO: 1897842 - RNA, 17 nt, Homo sapiens
auuuuuccaggacucuu

SEQ ID NO: 1897843 - RNA, 14 nt, Homo sapiens
guaacuacaaugau

SEQ ID NO: 1897844 - RNA, 17 nt, Homo sapiens
uaaaacucaagugacac

SEQ ID NO: 1897845 - RNA, 22 nt, Homo sapiens
uaauuucuuuuauugcauuaua

SEQ ID NO: 1897846 - RNA, 15 nt, Homo sapiens
ugauguaacauugua

SEQ ID NO: 1897847 - RNA, 13 nt, Homo sapiens
auugcugccagag

SEQ ID NO: 1897848 - RNA, 14 nt, Homo sapiens
ugauuucucaaaaa

SEQ ID NO: 1897849 - RNA, 12 nt, Homo sapiens
caguucaucacc

SEQ ID NO: 1897850 - RNA, 17 nt, Homo sapiens
cccugcccucucccaaa

SEQ ID NO: 1897851 - RNA, 21 nt, Homo sapiens
guggcacuuacccacgugcug

SEQ ID NO: 1897852 - RNA, 21 nt, Homo sapiens
cagguuugguuuuuuuguaca

SEQ ID NO: 1897853 - RNA, 17 nt, Homo sapiens
cucucccugacccugua

SEQ ID NO: 1897854 - RNA, 16 nt, Homo sapiens
cuguuuccuaacuuca

SEQ ID NO: 1897855 - RNA, 20 nt, Homo sapiens
uaaugaguuuuucuguuauc

SEQ ID NO: 1897856 - RNA, 18 nt, Homo sapiens
caucugaccaucugugac

SEQ ID NO: 1897857 - RNA, 21 nt, Homo sapiens
aauuacauagacuuaggcauu

SEQ ID NO: 1897858 - RNA, 18 nt, Homo sapiens
uuacucacucacucugau

SEQ ID NO: 1897859 - RNA, 22 nt, Homo sapiens
cauuuccucaggcaauuccuuu

SEQ ID NO: 1897860 - RNA, 19 nt, Homo sapiens
auuacacggagugugcuaa

SEQ ID NO: 1897861 - RNA, 16 nt, Homo sapiens
aaaauugaacuacagc

SEQ ID NO: 1897862 - RNA, 13 nt, Homo sapiens
aucaucauucuca

SEQ ID NO: 1897863 - RNA, 23 nt, Homo sapiens
augcuggggacacacauucugcc

SEQ ID NO: 1897864 - RNA, 16 nt, Homo sapiens
uugauacguguuccua

SEQ ID NO: 1897865 - RNA, 18 nt, Homo sapiens
cuauaauuaguuaugaca

SEQ ID NO: 1897866 - RNA, 19 nt, Homo sapiens
acuagaagcugaucugauu

SEQ ID NO: 1897867 - RNA, 19 nt, Homo sapiens
uaggauuucuguauuugcc

SEQ ID NO: 1897868 - RNA, 20 nt, Homo sapiens
gauguuuccugggugcccug

SEQ ID NO: 1897869 - RNA, 13 nt, Homo sapiens
cucuugucaaaag

SEQ ID NO: 1897870 - RNA, 20 nt, Homo sapiens
uuguuaggaaaugucaucaa

SEQ ID NO: 1897871 - RNA, 13 nt, Homo sapiens
cuguuuugccagc

SEQ ID NO: 1897872 - RNA, 14 nt, Homo sapiens
ccuuccacagugaa

SEQ ID NO: 1897873 - RNA, 13 nt, Homo sapiens
cucuugaauuccu

SEQ ID NO: 1897874 - RNA, 21 nt, Homo sapiens
ugacauuuaauaacuuugcug

SEQ ID NO: 1897875 - RNA, 17 nt, Homo sapiens
aagaacaguccauugaa

SEQ ID NO: 1897876 - RNA, 22 nt, Homo sapiens
ugggggaagacuuuaaaccacc

SEQ ID NO: 1897877 - RNA, 14 nt, Homo sapiens
aaauuauccaugcc

SEQ ID NO: 1897878 - RNA, 21 nt, Homo sapiens
uacuccuagaagaaccaaaua

SEQ ID NO: 1897879 - RNA, 17 nt, Homo sapiens
acaccugacaaauggaa

SEQ ID NO: 1897880 - RNA, 13 nt, Homo sapiens
aauuuuaaccuau

SEQ ID NO: 1897881 - RNA, 13 nt, Homo sapiens
cugcacacugccu

SEQ ID NO: 1897882 - RNA, 15 nt, Homo sapiens
ucauaugaccauuga

SEQ ID NO: 1897883 - RNA, 19 nt, Homo sapiens
ccagccccugccucgagga

SEQ ID NO: 1897884 - RNA, 14 nt, Homo sapiens
ucuucuuucccaaa

SEQ ID NO: 1897885 - RNA, 23 nt, Homo sapiens
aauauagcuuucauaacaucgaa

SEQ ID NO: 1897886 - RNA, 22 nt, Homo sapiens
agggcucugcaggccacuguga

SEQ ID NO: 1897887 - RNA, 21 nt, Homo sapiens
agccgguaaguaaacagucag

SEQ ID NO: 1897888 - RNA, 15 nt, Homo sapiens
auaaucccacccacc

SEQ ID NO: 1897889 - RNA, 17 nt, Homo sapiens
caccuggacacacacuc

SEQ ID NO: 1897890 - RNA, 22 nt, Homo sapiens
cugaugaccuaaccuaagcaaa

SEQ ID NO: 1897891 - RNA, 17 nt, Homo sapiens
cauaguuuaaacugcau

SEQ ID NO: 1897892 - RNA, 17 nt, Homo sapiens
cauugaccuuuuauuua

SEQ ID NO: 1897893 - RNA, 17 nt, Homo sapiens
uuaauuggaauucugga

SEQ ID NO: 1897894 - RNA, 13 nt, Homo sapiens
ccaguauuagcaa

SEQ ID NO: 1897895 - RNA, 14 nt, Homo sapiens
cuacccagguauua

SEQ ID NO: 1897896 - RNA, 18 nt, Homo sapiens
gaaaccuccggugugaga

SEQ ID NO: 1897897 - RNA, 12 nt, Homo sapiens
agcuccuuggcu

SEQ ID NO: 1897898 - RNA, 20 nt, Homo sapiens
uaauauuccuggcauaccuu

SEQ ID NO: 1897899 - RNA, 14 nt, Homo sapiens
caugugacuguauu

SEQ ID NO: 1897900 - RNA, 14 nt, Homo sapiens
cuccgugcuuccuc

SEQ ID NO: 1897901 - RNA, 20 nt, Homo sapiens
uaaguuacaucuacaaacag

SEQ ID NO: 1897902 - RNA, 17 nt, Homo sapiens
gcgggauuuaugugcac

SEQ ID NO: 1897903 - RNA, 15 nt, Homo sapiens
uauuacuccuugcca

SEQ ID NO: 1897904 - RNA, 19 nt, Homo sapiens
ggcuggagugcaauggcgc

SEQ ID NO: 1897905 - RNA, 22 nt, Homo sapiens
guuucucggcaccagugccuca

SEQ ID NO: 1897906 - RNA, 22 nt, Homo sapiens
auaaaauguucagugcaaucag

SEQ ID NO: 1897907 - RNA, 14 nt, Homo sapiens
uuagagaaacauuu

SEQ ID NO: 1897908 - RNA, 19 nt, Homo sapiens
ccccauaaucucauucaaa

SEQ ID NO: 1897909 - RNA, 18 nt, Homo sapiens
agaacugaauaaacagga

SEQ ID NO: 1897910 - RNA, 18 nt, Homo sapiens
gacucugauucuacagug

SEQ ID NO: 1897911 - RNA, 12 nt, Homo sapiens
aucgugcuaaau

SEQ ID NO: 1897912 - RNA, 14 nt, Homo sapiens
cuaggaaccucauu

SEQ ID NO: 1897913 - RNA, 12 nt, Homo sapiens
cucuugcucaag

SEQ ID NO: 1897914 - RNA, 13 nt, Homo sapiens
cugagugagcuga

SEQ ID NO: 1897915 - RNA, 19 nt, Homo sapiens
aggagcuagaacauuccau

SEQ ID NO: 1897916 - RNA, 22 nt, Homo sapiens
cuguuuaaaucuucugcuaaau

SEQ ID NO: 1897917 - RNA, 16 nt, Homo sapiens
guucuauagcagucau

SEQ ID NO: 1897918 - RNA, 19 nt, Homo sapiens
auaggagacuuguacaguu

SEQ ID NO: 1897919 - RNA, 20 nt, Homo sapiens
guccacaggcucaacauuuc

SEQ ID NO: 1897920 - RNA, 16 nt, Homo sapiens
auugcuguuguugcag

SEQ ID NO: 1897921 - RNA, 14 nt, Homo sapiens
aucuuugugacagg

SEQ ID NO: 1897922 - RNA, 20 nt, Homo sapiens
caaguuguucgggccaagga

SEQ ID NO: 1897923 - RNA, 14 nt, Homo sapiens
cacauuguacuuaa

SEQ ID NO: 1897924 - RNA, 20 nt, Homo sapiens
uucuuucaacauuucuugaa

SEQ ID NO: 1897925 - RNA, 20 nt, Homo sapiens
augggcacagcaacucuaag

SEQ ID NO: 1897926 - RNA, 15 nt, Homo sapiens
ucucucaccauguga

SEQ ID NO: 1897927 - RNA, 12 nt, Homo sapiens
ggacagaugacc

SEQ ID NO: 1897928 - RNA, 13 nt, Homo sapiens
aaaggcuuuuuau

SEQ ID NO: 1897929 - RNA, 18 nt, Homo sapiens
accaguguaaauucaguc

SEQ ID NO: 1897930 - RNA, 14 nt, Homo sapiens
cggccacgcacugg

SEQ ID NO: 1897931 - RNA, 22 nt, Homo sapiens
ggcaggaguauaugagcauccu

SEQ ID NO: 1897932 - RNA, 22 nt, Homo sapiens
ucauauuaguaaaagaugccau

SEQ ID NO: 1897933 - RNA, 14 nt, Homo sapiens
uccacgcaguucuu

SEQ ID NO: 1897934 - RNA, 14 nt, Homo sapiens
ggcagcucagagag

SEQ ID NO: 1897935 - RNA, 23 nt, Homo sapiens
gaguuccagcaaacaaaauggac

SEQ ID NO: 1897936 - RNA, 20 nt, Homo sapiens
auccuggaaggacacaguga

SEQ ID NO: 1897937 - RNA, 20 nt, Homo sapiens
uccuacagcuacauugagau

SEQ ID NO: 1897938 - RNA, 16 nt, Homo sapiens
accugcgaaggaugau

SEQ ID NO: 1897939 - RNA, 18 nt, Homo sapiens
ccagggaacccaacaguc

SEQ ID NO: 1897940 - RNA, 23 nt, Homo sapiens
gacaggcacagaugaaugggagu

SEQ ID NO: 1897941 - RNA, 19 nt, Homo sapiens
ggaacuuuccccagaucaa

SEQ ID NO: 1897942 - RNA, 21 nt, Homo sapiens
gcaucuuuucuguugccccau

SEQ ID NO: 1897943 - RNA, 16 nt, Homo sapiens
cuaccccuugugggca

SEQ ID NO: 1897944 - RNA, 21 nt, Homo sapiens
ccugucaguaguggacauugu

SEQ ID NO: 1897945 - RNA, 16 nt, Homo sapiens
acaguuaucacacuuu

SEQ ID NO: 1897946 - RNA, 21 nt, Homo sapiens
ucucccuucuugggucugccc

SEQ ID NO: 1897947 - RNA, 12 nt, Homo sapiens
cugggcucucca

SEQ ID NO: 1897948 - RNA, 11 nt, Homo sapiens
agugcugcuau

SEQ ID NO: 1897949 - RNA, 22 nt, Homo sapiens
ccccucagagcucuuaugugga

SEQ ID NO: 1897950 - RNA, 22 nt, Homo sapiens
aaagauuauuuucauuuaucca

SEQ ID NO: 1897951 - RNA, 21 nt, Homo sapiens
agggcuucugccuaagccucu

SEQ ID NO: 1897952 - RNA, 17 nt, Homo sapiens
ccaaguuguggugcuga

SEQ ID NO: 1897953 - RNA, 20 nt, Homo sapiens
gucugaacccuuccaccaaa

SEQ ID NO: 1897954 - RNA, 19 nt, Homo sapiens
gcauaagaaaacuaagaaa

SEQ ID NO: 1897955 - RNA, 15 nt, Homo sapiens
agauuuaauucccaa

SEQ ID NO: 1897956 - RNA, 14 nt, Homo sapiens
cuuuguuuaugcau

SEQ ID NO: 1897957 - RNA, 15 nt, Homo sapiens
ugauccuuccaccuc

SEQ ID NO: 1897958 - RNA, 22 nt, Homo sapiens
gguuugagauggacacacuggu

SEQ ID NO: 1897959 - RNA, 22 nt, Homo sapiens
auggguuaagagcucaccccag

SEQ ID NO: 1897960 - RNA, 15 nt, Homo sapiens
ugcccucccucagcc

SEQ ID NO: 1897961 - RNA, 15 nt, Homo sapiens
ggccccugcaucccc

SEQ ID NO: 1897962 - RNA, 22 nt, Homo sapiens
auauuuuaagacgaaacauuug

SEQ ID NO: 1897963 - RNA, 14 nt, Homo sapiens
uccuaacaaaagau

SEQ ID NO: 1897964 - RNA, 18 nt, Homo sapiens
cuccaaauuuuuuuuacu

SEQ ID NO: 1897965 - RNA, 20 nt, Homo sapiens
aaugcauuuggaaccaaagu

SEQ ID NO: 1897966 - RNA, 23 nt, Homo sapiens
cugguuuguggggcacagaugcc

SEQ ID NO: 1897967 - RNA, 15 nt, Homo sapiens
aacuguucuuugcag

SEQ ID NO: 1897968 - RNA, 16 nt, Homo sapiens
ugcagcacaguacuca

SEQ ID NO: 1897969 - RNA, 15 nt, Homo sapiens
cugccacugacugca

SEQ ID NO: 1897970 - RNA, 15 nt, Homo sapiens
ucucaucacuaccuu

SEQ ID NO: 1897971 - RNA, 21 nt, Homo sapiens
cuauauggcaaauagccacaa

SEQ ID NO: 1897972 - RNA, 22 nt, Homo sapiens
auuuuauagaugggcaacuggc

SEQ ID NO: 1897973 - RNA, 19 nt, Homo sapiens
gcuuccuugcucagugcaa

SEQ ID NO: 1897974 - RNA, 18 nt, Homo sapiens
uucagcagcacccaugua

SEQ ID NO: 1897975 - RNA, 15 nt, Homo sapiens
uuccaugacaacaga

SEQ ID NO: 1897976 - RNA, 22 nt, Homo sapiens
aacacccuuucaucucagaguc

SEQ ID NO: 1897977 - RNA, 13 nt, Homo sapiens
ugcuuucaucuaa

SEQ ID NO: 1897978 - RNA, 18 nt, Homo sapiens
accuguccauaaaguaau

SEQ ID NO: 1897979 - RNA, 21 nt, Homo sapiens
guggagaagacauucugguga

SEQ ID NO: 1897980 - RNA, 14 nt, Homo sapiens
gaaguuuguguucu

SEQ ID NO: 1897981 - RNA, 21 nt, Homo sapiens
agagguggagugucacaucuc

SEQ ID NO: 1897982 - RNA, 21 nt, Homo sapiens
uggccucugugccuucuuuug

SEQ ID NO: 1897983 - RNA, 17 nt, Homo sapiens
acugccucaguguuuca

SEQ ID NO: 1897984 - RNA, 11 nt, Homo sapiens
caaagaucuca

SEQ ID NO: 1897985 - RNA, 15 nt, Homo sapiens
aggcacucccaucca

SEQ ID NO: 1897986 - RNA, 23 nt, Homo sapiens
gcauuuauuuaagacacuguuac

SEQ ID NO: 1897987 - RNA, 17 nt, Homo sapiens
auacucauuuggauaua

SEQ ID NO: 1897988 - RNA, 16 nt, Homo sapiens
ugaacugcaacacugg

SEQ ID NO: 1897989 - RNA, 20 nt, Homo sapiens
uggaguacaccaaccagacc

SEQ ID NO: 1897990 - RNA, 23 nt, Homo sapiens
ccucagggucccugguggcagcu

SEQ ID NO: 1897991 - RNA, 19 nt, Homo sapiens
cauuuuauucacauauguc

SEQ ID NO: 1897992 - RNA, 23 nt, Homo sapiens
uaauaagucacugacaucagcac

SEQ ID NO: 1897993 - RNA, 20 nt, Homo sapiens
cuuccucggccucccaaagu

SEQ ID NO: 1897994 - RNA, 17 nt, Homo sapiens
aucuuuguauauuacau

SEQ ID NO: 1897995 - RNA, 13 nt, Homo sapiens
ugagugacggcaa

SEQ ID NO: 1897996 - RNA, 16 nt, Homo sapiens
cuuaaucuuuucacaa

SEQ ID NO: 1897997 - RNA, 18 nt, Homo sapiens
ucacccuaccaacuuuac

SEQ ID NO: 1897998 - RNA, 19 nt, Homo sapiens
acuucaucuucucagcucc

SEQ ID NO: 1897999 - RNA, 20 nt, Homo sapiens
gaccccuuguuacucaggaa

SEQ ID NO: 1898000 - RNA, 16 nt, Homo sapiens
guuugcuucuugccau

SEQ ID NO: 1898001 - RNA, 22 nt, Homo sapiens
cagggcaccguauuccucuccc

SEQ ID NO: 1898002 - RNA, 14 nt, Homo sapiens
ugggaaaaacugca

SEQ ID NO: 1898003 - RNA, 17 nt, Homo sapiens
gcaccuguaaagugccu

SEQ ID NO: 1898004 - RNA, 14 nt, Homo sapiens
cacugauuacuuuu

SEQ ID NO: 1898005 - RNA, 15 nt, Homo sapiens
ucauugccacacuug

SEQ ID NO: 1898006 - RNA, 20 nt, Homo sapiens
ucaagagggggcaagucaca

SEQ ID NO: 1898007 - RNA, 13 nt, Homo sapiens
ugucacauugcau

SEQ ID NO: 1898008 - RNA, 14 nt, Homo sapiens
aguaagacgugaaa

SEQ ID NO: 1898009 - RNA, 19 nt, Homo sapiens
ugauagauguagucuugac

SEQ ID NO: 1898010 - RNA, 20 nt, Homo sapiens
uaaaccugucuccacugugc

SEQ ID NO: 1898011 - RNA, 20 nt, Homo sapiens
caguugccacauuuaguccu

SEQ ID NO: 1898012 - RNA, 20 nt, Homo sapiens
acaauuacuuugaacauuaa

SEQ ID NO: 1898013 - RNA, 23 nt, Homo sapiens
ucucugcaauuuuacugugaaaa

SEQ ID NO: 1898014 - RNA, 21 nt, Homo sapiens
aaaauugugcuggaaauggac

SEQ ID NO: 1898015 - RNA, 17 nt, Homo sapiens
ugcugaaaacucuaugu

SEQ ID NO: 1898016 - RNA, 19 nt, Homo sapiens
cugaacauuaguugcacua

SEQ ID NO: 1898017 - RNA, 17 nt, Homo sapiens
aauucugccuuuauuga

SEQ ID NO: 1898018 - RNA, 12 nt, Homo sapiens
guguaccacugg

SEQ ID NO: 1898019 - RNA, 19 nt, Homo sapiens
caaauuucuagucaaugug

SEQ ID NO: 1898020 - RNA, 12 nt, Homo sapiens
gcaaaagcgcag

SEQ ID NO: 1898021 - RNA, 13 nt, Homo sapiens
aaacaaccugcca

SEQ ID NO: 1898022 - RNA, 16 nt, Homo sapiens
uuuaggugaaagccag

SEQ ID NO: 1898023 - RNA, 14 nt, Homo sapiens
cuagauagucaaua

SEQ ID NO: 1898024 - RNA, 21 nt, Homo sapiens
aucaacugcaucaagauguga

SEQ ID NO: 1898025 - RNA, 20 nt, Homo sapiens
uuaauagcaacagagcacuu

SEQ ID NO: 1898026 - RNA, 13 nt, Homo sapiens
ccuggcacagugu

SEQ ID NO: 1898027 - RNA, 22 nt, Homo sapiens
caaaugucuagguccccacugc

SEQ ID NO: 1898028 - RNA, 18 nt, Homo sapiens
guuuagaaucaagucugu

SEQ ID NO: 1898029 - RNA, 23 nt, Homo sapiens
uuuugcacaccuguuauugccaa

SEQ ID NO: 1898030 - RNA, 14 nt, Homo sapiens
gcccagggcugaua

SEQ ID NO: 1898031 - RNA, 20 nt, Homo sapiens
caacgaacauggcaugugaa

SEQ ID NO: 1898032 - RNA, 16 nt, Homo sapiens
acuaaauaauacuuua

SEQ ID NO: 1898033 - RNA, 13 nt, Homo sapiens
gcccucuauuuau

SEQ ID NO: 1898034 - RNA, 20 nt, Homo sapiens
aaaucauaaaauccaaugcu

SEQ ID NO: 1898035 - RNA, 12 nt, Homo sapiens
agguucccaaga

SEQ ID NO: 1898036 - RNA, 19 nt, Homo sapiens
uagaagaaccaaauaccuc

SEQ ID NO: 1898037 - RNA, 13 nt, Homo sapiens
ggcauuugcuaag

SEQ ID NO: 1898038 - RNA, 16 nt, Homo sapiens
aggggagugcauuuag

SEQ ID NO: 1898039 - RNA, 19 nt, Homo sapiens
ccuccagcuccaguuucca

SEQ ID NO: 1898040 - RNA, 20 nt, Homo sapiens
aaaauucucuuaaaccacag

SEQ ID NO: 1898041 - RNA, 14 nt, Homo sapiens
uuugcuuucaggga

SEQ ID NO: 1898042 - RNA, 16 nt, Homo sapiens
guugggccccugagga

SEQ ID NO: 1898043 - RNA, 16 nt, Homo sapiens
caguaaucagaguuac

SEQ ID NO: 1898044 - RNA, 14 nt, Homo sapiens
aggugaagggaugg

SEQ ID NO: 1898045 - RNA, 23 nt, Homo sapiens
aaaugucaaauugaugugcccua

SEQ ID NO: 1898046 - RNA, 18 nt, Homo sapiens
ucuacaggaaucaaaaga

SEQ ID NO: 1898047 - RNA, 19 nt, Homo sapiens
uugaaaagcaguaacuugg

SEQ ID NO: 1898048 - RNA, 18 nt, Homo sapiens
caggacacacauggugag

SEQ ID NO: 1898049 - RNA, 19 nt, Homo sapiens
ugcauuccuuacuugcacu

SEQ ID NO: 1898050 - RNA, 12 nt, Homo sapiens
uuguaaauauuc

SEQ ID NO: 1898051 - RNA, 15 nt, Homo sapiens
caccccaaguccaga

SEQ ID NO: 1898052 - RNA, 13 nt, Homo sapiens
acuagcacaguaa

SEQ ID NO: 1898053 - RNA, 18 nt, Homo sapiens
aacccguugggucccuug

SEQ ID NO: 1898054 - RNA, 13 nt, Homo sapiens
ggagaacuugaac

SEQ ID NO: 1898055 - RNA, 18 nt, Homo sapiens
auggagggaaugcucaga

SEQ ID NO: 1898056 - RNA, 19 nt, Homo sapiens
uccuuugagaaugugauuc

SEQ ID NO: 1898057 - RNA, 15 nt, Homo sapiens
cacaguuuucuggcu

SEQ ID NO: 1898058 - RNA, 15 nt, Homo sapiens
agaauauaaugugca

SEQ ID NO: 1898059 - RNA, 22 nt, Homo sapiens
cugacaucacagcagccuccaa

SEQ ID NO: 1898060 - RNA, 12 nt, Homo sapiens
uuucaagucaaa

SEQ ID NO: 1898061 - RNA, 22 nt, Homo sapiens
acugggauguaaguuuguguaa

SEQ ID NO: 1898062 - RNA, 21 nt, Homo sapiens
ugggcagagcagagaccaucc

SEQ ID NO: 1898063 - RNA, 22 nt, Homo sapiens
auggugcuagaagaauuugaga

SEQ ID NO: 1898064 - RNA, 20 nt, Homo sapiens
ccaagaaguggcugccaaag

SEQ ID NO: 1898065 - RNA, 16 nt, Homo sapiens
agcugagaucaugcca

SEQ ID NO: 1898066 - RNA, 15 nt, Homo sapiens
uuucaugagcccaaa

SEQ ID NO: 1898067 - RNA, 17 nt, Homo sapiens
accagaacuggaacuac

SEQ ID NO: 1898068 - RNA, 14 nt, Homo sapiens
acagaauuuccacu

SEQ ID NO: 1898069 - RNA, 13 nt, Homo sapiens
gaugcuaaaaccu

SEQ ID NO: 1898070 - RNA, 14 nt, Homo sapiens
ugugucuagguaga

SEQ ID NO: 1898071 - RNA, 23 nt, Homo sapiens
caugacugauguuggggaaaaag

SEQ ID NO: 1898072 - RNA, 21 nt, Homo sapiens
guaaaauagaauguuacuuug

SEQ ID NO: 1898073 - RNA, 18 nt, Homo sapiens
caugugugcaucaugucu

SEQ ID NO: 1898074 - RNA, 16 nt, Homo sapiens
gcaggggccgagccau

SEQ ID NO: 1898075 - RNA, 21 nt, Homo sapiens
acugucagcugagcuugagcu

SEQ ID NO: 1898076 - RNA, 22 nt, Homo sapiens
aaccuugcugggguuggagguu

SEQ ID NO: 1898077 - RNA, 16 nt, Homo sapiens
uguccucaccacaugc

SEQ ID NO: 1898078 - RNA, 15 nt, Homo sapiens
aacuucaacaugcau

SEQ ID NO: 1898079 - RNA, 17 nt, Homo sapiens
aggaucccgucuuccag

SEQ ID NO: 1898080 - RNA, 22 nt, Homo sapiens
gaccuccaagccacugagcaau

SEQ ID NO: 1898081 - RNA, 19 nt, Homo sapiens
ggcaaucaauacagcuuca

SEQ ID NO: 1898082 - RNA, 20 nt, Homo sapiens
aucaucuuuauuaaguagau

SEQ ID NO: 1898083 - RNA, 20 nt, Homo sapiens
uugcuucuucccaauugcuu

SEQ ID NO: 1898084 - RNA, 20 nt, Homo sapiens
ugggucucauuuagaacuug

SEQ ID NO: 1898085 - RNA, 18 nt, Homo sapiens
ccuacaccucuugaaaau

SEQ ID NO: 1898086 - RNA, 23 nt, Homo sapiens
cuugccauggagguuaagcacuu

SEQ ID NO: 1898087 - RNA, 17 nt, Homo sapiens
gaguugauucaugugcu

SEQ ID NO: 1898088 - RNA, 13 nt, Homo sapiens
accuuuguuccca

SEQ ID NO: 1898089 - RNA, 23 nt, Homo sapiens
aaacaacaaacuuggucuuacau

SEQ ID NO: 1898090 - RNA, 19 nt, Homo sapiens
ugcaagacaaaguugaaug

SEQ ID NO: 1898091 - RNA, 22 nt, Homo sapiens
gucaguguugccucuugcaaug

SEQ ID NO: 1898092 - RNA, 21 nt, Homo sapiens
agaugaggugguaucuucacg

SEQ ID NO: 1898093 - RNA, 19 nt, Homo sapiens
aucaaaguuccuguucacc

SEQ ID NO: 1898094 - RNA, 15 nt, Homo sapiens
ucuaggugcuuuaac

SEQ ID NO: 1898095 - RNA, 13 nt, Homo sapiens
acaagacagcaga

SEQ ID NO: 1898096 - RNA, 22 nt, Homo sapiens
aguauauuccucugcugaacaa

SEQ ID NO: 1898097 - RNA, 22 nt, Homo sapiens
aggggcuuugugaccagaaagc

SEQ ID NO: 1898098 - RNA, 19 nt, Homo sapiens
gauagguaccugagugacg

SEQ ID NO: 1898099 - RNA, 16 nt, Homo sapiens
cuaccugagcuaaaua

SEQ ID NO: 1898100 - RNA, 14 nt, Homo sapiens
agaaaacaugacuu

SEQ ID NO: 1898101 - RNA, 14 nt, Homo sapiens
gggagaaacccaga

SEQ ID NO: 1898102 - RNA, 15 nt, Homo sapiens
aaugaugaucuucag

SEQ ID NO: 1898103 - RNA, 21 nt, Homo sapiens
gccaugucaccuggcugcuag

SEQ ID NO: 1898104 - RNA, 13 nt, Homo sapiens
cuccacccaugac

SEQ ID NO: 1898105 - RNA, 13 nt, Homo sapiens
uggggaagacagu

SEQ ID NO: 1898106 - RNA, 12 nt, Homo sapiens
cccucggagccc

SEQ ID NO: 1898107 - RNA, 19 nt, Homo sapiens
cgcugaaauuaaaugccac

SEQ ID NO: 1898108 - RNA, 13 nt, Homo sapiens
cucuuacaucucc

SEQ ID NO: 1898109 - RNA, 16 nt, Homo sapiens
guccugcccuguggaa

SEQ ID NO: 1898110 - RNA, 20 nt, Homo sapiens
ucucccagggagcaugagag

SEQ ID NO: 1898111 - RNA, 15 nt, Homo sapiens
uugagggacugccuc

SEQ ID NO: 1898112 - RNA, 20 nt, Homo sapiens
uauggacaggaugggguucu

SEQ ID NO: 1898113 - RNA, 14 nt, Homo sapiens
aauuuugcuuuaau

SEQ ID NO: 1898114 - RNA, 15 nt, Homo sapiens
cagauaaccuaauaa

SEQ ID NO: 1898115 - RNA, 13 nt, Homo sapiens
gugucucugccau

SEQ ID NO: 1898116 - RNA, 19 nt, Homo sapiens
uaguccugauguacuuuaa

SEQ ID NO: 1898117 - RNA, 24 nt, Homo sapiens
cauguuggccaggccggucucaaa

SEQ ID NO: 1898118 - RNA, 15 nt, Homo sapiens
gacuuagaacaccgc

SEQ ID NO: 1898119 - RNA, 21 nt, Homo sapiens
uuaugagaaaugccagugugc

SEQ ID NO: 1898120 - RNA, 19 nt, Homo sapiens
agacuuucuucuagugcuu

SEQ ID NO: 1898121 - RNA, 16 nt, Homo sapiens
aucucuuagaagccau

SEQ ID NO: 1898122 - RNA, 12 nt, Homo sapiens
aucaagcuccug

SEQ ID NO: 1898123 - RNA, 20 nt, Homo sapiens
gaacagguuuaaaaaucccc

SEQ ID NO: 1898124 - RNA, 18 nt, Homo sapiens
acuguuuugggccuccau

SEQ ID NO: 1898125 - RNA, 14 nt, Homo sapiens
ggcggccugcagug

SEQ ID NO: 1898126 - RNA, 13 nt, Homo sapiens
cuagucuacuuga

SEQ ID NO: 1898127 - RNA, 15 nt, Homo sapiens
auaggagugaauaca

SEQ ID NO: 1898128 - RNA, 22 nt, Homo sapiens
auucaaucuuaacaaaagugaa

SEQ ID NO: 1898129 - RNA, 12 nt, Homo sapiens
uuugcuacaaau

SEQ ID NO: 1898130 - RNA, 19 nt, Homo sapiens
uuuuaacacuucuagaucu

SEQ ID NO: 1898131 - RNA, 20 nt, Homo sapiens
aaauccacagccaacaaaca

SEQ ID NO: 1898132 - RNA, 16 nt, Homo sapiens
caacccugugaucuau

SEQ ID NO: 1898133 - RNA, 22 nt, Homo sapiens
agaggacagagcaggggcucca

SEQ ID NO: 1898134 - RNA, 17 nt, Homo sapiens
uuuauucuugaagugaa

SEQ ID NO: 1898135 - RNA, 19 nt, Homo sapiens
cagaugcaagacacugugc

SEQ ID NO: 1898136 - RNA, 20 nt, Homo sapiens
gguaucuguuuaacauuucc

SEQ ID NO: 1898137 - RNA, 13 nt, Homo sapiens
gcagugagcagaa

SEQ ID NO: 1898138 - RNA, 13 nt, Homo sapiens
caggugaggcaaa

SEQ ID NO: 1898139 - RNA, 23 nt, Homo sapiens
auccuauauuccuaucaguauaa

SEQ ID NO: 1898140 - RNA, 22 nt, Homo sapiens
acauaaaggugacccugaugaa

SEQ ID NO: 1898141 - RNA, 19 nt, Homo sapiens
cuugcaagauaauuuucag

SEQ ID NO: 1898142 - RNA, 16 nt, Homo sapiens
aggcauuacccaaaag

SEQ ID NO: 1898143 - RNA, 21 nt, Homo sapiens
acucaguaaaucagugcagua

SEQ ID NO: 1898144 - RNA, 21 nt, Homo sapiens
uauuuugucacccaaccuggc

SEQ ID NO: 1898145 - RNA, 17 nt, Homo sapiens
cugaaaaaucacauccu

SEQ ID NO: 1898146 - RNA, 23 nt, Homo sapiens
auaaaguuaaauugcacgugcaa

SEQ ID NO: 1898147 - RNA, 13 nt, Homo sapiens
gaccccaauccaa

SEQ ID NO: 1898148 - RNA, 12 nt, Homo sapiens
agcgccaaagga

SEQ ID NO: 1898149 - RNA, 19 nt, Homo sapiens
gauaugcuuaguaaugcua

SEQ ID NO: 1898150 - RNA, 18 nt, Homo sapiens
uguuauguaaaaggccaa

SEQ ID NO: 1898151 - RNA, 16 nt, Homo sapiens
caaacuacauguaauc

SEQ ID NO: 1898152 - RNA, 14 nt, Homo sapiens
auccuuuaucaaga

SEQ ID NO: 1898153 - RNA, 19 nt, Homo sapiens
cuuaacugaugacauucca

SEQ ID NO: 1898154 - RNA, 19 nt, Homo sapiens
cgugaaaguguuacauauu

SEQ ID NO: 1898155 - RNA, 14 nt, Homo sapiens
acugagcauuugca

SEQ ID NO: 1898156 - RNA, 20 nt, Homo sapiens
ccugggcuugugaacaccuc

SEQ ID NO: 1898157 - RNA, 23 nt, Homo sapiens
auaagcaaagggagcacuggguu

SEQ ID NO: 1898158 - RNA, 12 nt, Homo sapiens
acaaaugugcuc

SEQ ID NO: 1898159 - RNA, 21 nt, Homo sapiens
caccaagcucuguccaaucag

SEQ ID NO: 1898160 - RNA, 18 nt, Homo sapiens
ugcagggcuggucagggu

SEQ ID NO: 1898161 - RNA, 15 nt, Homo sapiens
gcgucaccguccacu

SEQ ID NO: 1898162 - RNA, 14 nt, Homo sapiens
uccauucagcauca

SEQ ID NO: 1898163 - RNA, 17 nt, Homo sapiens
auuugugccgacacugu

SEQ ID NO: 1898164 - RNA, 13 nt, Homo sapiens
ucaccuucucaac

SEQ ID NO: 1898165 - RNA, 19 nt, Homo sapiens
gaacauuucuuucuugcug

SEQ ID NO: 1898166 - RNA, 17 nt, Homo sapiens
uaugaagggaagcgaga

SEQ ID NO: 1898167 - RNA, 19 nt, Homo sapiens
augaacucuugaagucaca

SEQ ID NO: 1898168 - RNA, 11 nt, Homo sapiens
cagaauggagg

SEQ ID NO: 1898169 - RNA, 16 nt, Homo sapiens
gugcaaaccuguucau

SEQ ID NO: 1898170 - RNA, 18 nt, Homo sapiens
aguuacaaaauacaaaag

SEQ ID NO: 1898171 - RNA, 13 nt, Homo sapiens
uggccuuccugcc

SEQ ID NO: 1898172 - RNA, 21 nt, Homo sapiens
cuaauguuggacagacacugu

SEQ ID NO: 1898173 - RNA, 22 nt, Homo sapiens
aggaguggaguucucuguucua

SEQ ID NO: 1898174 - RNA, 15 nt, Homo sapiens
uguuuccuguuggag

SEQ ID NO: 1898175 - RNA, 21 nt, Homo sapiens
gagggaugccacccagcaaca

SEQ ID NO: 1898176 - RNA, 15 nt, Homo sapiens
cuucauccaacuucc

SEQ ID NO: 1898177 - RNA, 20 nt, Homo sapiens
aacucagggacagagccaug

SEQ ID NO: 1898178 - RNA, 19 nt, Homo sapiens
uucaagccauucugccuca

SEQ ID NO: 1898179 - RNA, 18 nt, Homo sapiens
cuucucugcccauucccc

SEQ ID NO: 1898180 - RNA, 15 nt, Homo sapiens
cuuugugguagcuua

SEQ ID NO: 1898181 - RNA, 18 nt, Homo sapiens
acugaauaaauaccucuu

SEQ ID NO: 1898182 - RNA, 20 nt, Homo sapiens
gcugauuuccaggccccuga

SEQ ID NO: 1898183 - RNA, 23 nt, Homo sapiens
accauaaucccugucuucuuucc

SEQ ID NO: 1898184 - RNA, 18 nt, Homo sapiens
cugcaaauucaguaguaa

SEQ ID NO: 1898185 - RNA, 19 nt, Homo sapiens
gaagaaugucuguaccuug

SEQ ID NO: 1898186 - RNA, 21 nt, Homo sapiens
acgccuuugugagcugugagu

SEQ ID NO: 1898187 - RNA, 20 nt, Homo sapiens
ucaaucucagcuaacauucc

SEQ ID NO: 1898188 - RNA, 17 nt, Homo sapiens
gcaaagcucuguggcca

SEQ ID NO: 1898189 - RNA, 22 nt, Homo sapiens
aacccuauaugcuuacugugca

SEQ ID NO: 1898190 - RNA, 17 nt, Homo sapiens
ggucucccgauucccaa

SEQ ID NO: 1898191 - RNA, 15 nt, Homo sapiens
gugacaucacagggc

SEQ ID NO: 1898192 - RNA, 21 nt, Homo sapiens
gcagacagcuccacccuggcc

SEQ ID NO: 1898193 - RNA, 17 nt, Homo sapiens
uugugccacugcucucc

SEQ ID NO: 1898194 - RNA, 15 nt, Homo sapiens
agggggugcccuccc

SEQ ID NO: 1898195 - RNA, 11 nt, Homo sapiens
gagugaccuca

SEQ ID NO: 1898196 - RNA, 21 nt, Homo sapiens
caaauuccugcaaaauuaccu

SEQ ID NO: 1898197 - RNA, 17 nt, Homo sapiens
ugagcaguagaagccug

SEQ ID NO: 1898198 - RNA, 19 nt, Homo sapiens
cagugauucucucuucucu

SEQ ID NO: 1898199 - RNA, 17 nt, Homo sapiens
ccuggccuuguccucag

SEQ ID NO: 1898200 - RNA, 21 nt, Homo sapiens
cugagguauaaagacaaguau

SEQ ID NO: 1898201 - RNA, 15 nt, Homo sapiens
uaauacauguaaaua

SEQ ID NO: 1898202 - RNA, 20 nt, Homo sapiens
cccagcccuuagcacagaga

SEQ ID NO: 1898203 - RNA, 16 nt, Homo sapiens
ucauaagugacaguuu

SEQ ID NO: 1898204 - RNA, 17 nt, Homo sapiens
acucagucagcccagug

SEQ ID NO: 1898205 - RNA, 15 nt, Homo sapiens
aggaauaaaaccauc

SEQ ID NO: 1898206 - RNA, 22 nt, Homo sapiens
uauuuuaagcauuacucuugua

SEQ ID NO: 1898207 - RNA, 14 nt, Homo sapiens
uggacucagccuug

SEQ ID NO: 1898208 - RNA, 20 nt, Homo sapiens
gagccacugggagggggacc

SEQ ID NO: 1898209 - RNA, 19 nt, Homo sapiens
caacuacccgggccugacc

SEQ ID NO: 1898210 - RNA, 14 nt, Homo sapiens
aguaagaacacuga

SEQ ID NO: 1898211 - RNA, 19 nt, Homo sapiens
acugaacauguacacuggu

SEQ ID NO: 1898212 - RNA, 18 nt, Homo sapiens
gacagaacuggugcucuc

SEQ ID NO: 1898213 - RNA, 14 nt, Homo sapiens
ccuguggugacuga

SEQ ID NO: 1898214 - RNA, 13 nt, Homo sapiens
uugccuguagucu

SEQ ID NO: 1898215 - RNA, 21 nt, Homo sapiens
gcccauggaggcagaugcccu

SEQ ID NO: 1898216 - RNA, 13 nt, Homo sapiens
caggcccagagaa

SEQ ID NO: 1898217 - RNA, 13 nt, Homo sapiens
cuggaccagugac

SEQ ID NO: 1898218 - RNA, 21 nt, Homo sapiens
aauuauauguuguaagcaaca

SEQ ID NO: 1898219 - RNA, 22 nt, Homo sapiens
cccacacccuggaggauuucau

SEQ ID NO: 1898220 - RNA, 17 nt, Homo sapiens
aauucucauuugucaca

SEQ ID NO: 1898221 - RNA, 17 nt, Homo sapiens
auccuuaaaacaauucu

SEQ ID NO: 1898222 - RNA, 13 nt, Homo sapiens
gcuguagaugaca

SEQ ID NO: 1898223 - RNA, 15 nt, Homo sapiens
uuaauaaacugcaaa

SEQ ID NO: 1898224 - RNA, 14 nt, Homo sapiens
aucugagaggcucu

SEQ ID NO: 1898225 - RNA, 15 nt, Homo sapiens
gaaauaaaaauggau

SEQ ID NO: 1898226 - RNA, 12 nt, Homo sapiens
gggcaugccugg

SEQ ID NO: 1898227 - RNA, 19 nt, Homo sapiens
cugaucacucccagcacuc

SEQ ID NO: 1898228 - RNA, 15 nt, Homo sapiens
agccccaaaucucuc

SEQ ID NO: 1898229 - RNA, 23 nt, Homo sapiens
auggaaaagcccagugaccugac

SEQ ID NO: 1898230 - RNA, 15 nt, Homo sapiens
augggaggcugugau

SEQ ID NO: 1898231 - RNA, 21 nt, Homo sapiens
aggugucuggccugaggucaa

SEQ ID NO: 1898232 - RNA, 17 nt, Homo sapiens
gcguucccaaagaucca

SEQ ID NO: 1898233 - RNA, 13 nt, Homo sapiens
uguguugcaugca

SEQ ID NO: 1898234 - RNA, 14 nt, Homo sapiens
aggacacauggauu

SEQ ID NO: 1898235 - RNA, 18 nt, Homo sapiens
cugaacuaggugaucuca

SEQ ID NO: 1898236 - RNA, 20 nt, Homo sapiens
ccaccagcauccacacugcc

SEQ ID NO: 1898237 - RNA, 21 nt, Homo sapiens
ccuggcgggcagccccugcug

SEQ ID NO: 1898238 - RNA, 11 nt, Homo sapiens
agaaacaaaug

SEQ ID NO: 1898239 - RNA, 23 nt, Homo sapiens
gaaaaggagcuucaguauugugg

SEQ ID NO: 1898240 - RNA, 19 nt, Homo sapiens
aagucucagcagcucuucu

SEQ ID NO: 1898241 - RNA, 13 nt, Homo sapiens
ucccagugccuuc

SEQ ID NO: 1898242 - RNA, 17 nt, Homo sapiens
uguggcugcuagcacuu

SEQ ID NO: 1898243 - RNA, 13 nt, Homo sapiens
uacagcucucccc

SEQ ID NO: 1898244 - RNA, 17 nt, Homo sapiens
uuagauuaaagauugcu

SEQ ID NO: 1898245 - RNA, 22 nt, Homo sapiens
gaagauauuaagucccuuucaa

SEQ ID NO: 1898246 - RNA, 22 nt, Homo sapiens
auuaagucccuuuuaguuugau

SEQ ID NO: 1898247 - RNA, 23 nt, Homo sapiens
uagacaacauggccgugaacuuu

SEQ ID NO: 1898248 - RNA, 16 nt, Homo sapiens
caugugccugaaggcu

SEQ ID NO: 1898249 - RNA, 21 nt, Homo sapiens
cauuucaugcucugcaaaagg

SEQ ID NO: 1898250 - RNA, 17 nt, Homo sapiens
auuuaauuugaagauag

SEQ ID NO: 1898251 - RNA, 19 nt, Homo sapiens
agaacguuuuuuccucagu

SEQ ID NO: 1898252 - RNA, 17 nt, Homo sapiens
ucaggagaaugugcagu

SEQ ID NO: 1898253 - RNA, 15 nt, Homo sapiens
ccacgugguguguuu

SEQ ID NO: 1898254 - RNA, 19 nt, Homo sapiens
auaaacacuagacuguauc

SEQ ID NO: 1898255 - RNA, 17 nt, Homo sapiens
caaaucaaaacucacaa

SEQ ID NO: 1898256 - RNA, 11 nt, Homo sapiens
cuauagcucuu

SEQ ID NO: 1898257 - RNA, 16 nt, Homo sapiens
uggaacaagcacagau

SEQ ID NO: 1898258 - RNA, 15 nt, Homo sapiens
gccaaccagacaccu

SEQ ID NO: 1898259 - RNA, 22 nt, Homo sapiens
aaagccucuggaaaacucagga

SEQ ID NO: 1898260 - RNA, 21 nt, Homo sapiens
augauuguuugacacaccauu

SEQ ID NO: 1898261 - RNA, 17 nt, Homo sapiens
ccaaugcacacacacag

SEQ ID NO: 1898262 - RNA, 13 nt, Homo sapiens
ccauaaaggcaua

SEQ ID NO: 1898263 - RNA, 19 nt, Homo sapiens
augucuucuguauucacuu

SEQ ID NO: 1898264 - RNA, 17 nt, Homo sapiens
cuguacauacugcagug

SEQ ID NO: 1898265 - RNA, 19 nt, Homo sapiens
aaguagaugaaacauuaac

SEQ ID NO: 1898266 - RNA, 22 nt, Homo sapiens
uauuuagaagccaacuaugauu

SEQ ID NO: 1898267 - RNA, 16 nt, Homo sapiens
acuuauguacuugaua

SEQ ID NO: 1898268 - RNA, 18 nt, Homo sapiens
ugcuguucguucaaaagu

SEQ ID NO: 1898269 - RNA, 14 nt, Homo sapiens
aggaagaaagggaa

SEQ ID NO: 1898270 - RNA, 17 nt, Homo sapiens
cagaggaacuccagaga

SEQ ID NO: 1898271 - RNA, 19 nt, Homo sapiens
cuuccuccccacacuccac

SEQ ID NO: 1898272 - RNA, 14 nt, Homo sapiens
gaagccaaugcugu

SEQ ID NO: 1898273 - RNA, 13 nt, Homo sapiens
gggacuuuuguaa

SEQ ID NO: 1898274 - RNA, 15 nt, Homo sapiens
acguagcugcaaagg

SEQ ID NO: 1898275 - RNA, 20 nt, Homo sapiens
aacuugaaaagaaaaccaca

SEQ ID NO: 1898276 - RNA, 15 nt, Homo sapiens
gugucaggcacuggg

SEQ ID NO: 1898277 - RNA, 19 nt, Homo sapiens
uugugcacauguacccuaa

SEQ ID NO: 1898278 - RNA, 14 nt, Homo sapiens
agucucucuuccaa

SEQ ID NO: 1898279 - RNA, 20 nt, Homo sapiens
auuaucuaaaagaaaccuuc

SEQ ID NO: 1898280 - RNA, 16 nt, Homo sapiens
acaucaguuacucuga

SEQ ID NO: 1898281 - RNA, 13 nt, Homo sapiens
ugaaaagaacaaa

SEQ ID NO: 1898282 - RNA, 20 nt, Homo sapiens
caccauccagagaccaaaua

SEQ ID NO: 1898283 - RNA, 13 nt, Homo sapiens
gucaucaccaccc

SEQ ID NO: 1898284 - RNA, 14 nt, Homo sapiens
uaugacaauccuga

SEQ ID NO: 1898285 - RNA, 13 nt, Homo sapiens
gucccaacucgau

SEQ ID NO: 1898286 - RNA, 21 nt, Homo sapiens
aaagucacccagggacacucc

SEQ ID NO: 1898287 - RNA, 17 nt, Homo sapiens
ugcgcccaguccuucca

SEQ ID NO: 1898288 - RNA, 17 nt, Homo sapiens
gcugucauccacuuuau

SEQ ID NO: 1898289 - RNA, 19 nt, Homo sapiens
acugcugcaaauacuguau

SEQ ID NO: 1898290 - RNA, 17 nt, Homo sapiens
cacugggccagcccugc

SEQ ID NO: 1898291 - RNA, 18 nt, Homo sapiens
accagccaccccaaagcc

SEQ ID NO: 1898292 - RNA, 20 nt, Homo sapiens
cagugaaguacucaguaaua

SEQ ID NO: 1898293 - RNA, 22 nt, Homo sapiens
ggguacuucuugaaggugcuga

SEQ ID NO: 1898294 - RNA, 14 nt, Homo sapiens
cccuaggaacucag

SEQ ID NO: 1898295 - RNA, 15 nt, Homo sapiens
cuggugacaccagcc

SEQ ID NO: 1898296 - RNA, 13 nt, Homo sapiens
cugucacccuggc

SEQ ID NO: 1898297 - RNA, 15 nt, Homo sapiens
caauguucaucccau

SEQ ID NO: 1898298 - RNA, 14 nt, Homo sapiens
ugcuguugggauau

SEQ ID NO: 1898299 - RNA, 17 nt, Homo sapiens
uaaccucucugugccau

SEQ ID NO: 1898300 - RNA, 18 nt, Homo sapiens
gugaagcagcacugugag

SEQ ID NO: 1898301 - RNA, 19 nt, Homo sapiens
ggggccaggccauggccaa

SEQ ID NO: 1898302 - RNA, 22 nt, Homo sapiens
uccggggcauuugggcacugua

SEQ ID NO: 1898303 - RNA, 14 nt, Homo sapiens
aacagcucugagau

SEQ ID NO: 1898304 - RNA, 15 nt, Homo sapiens
uuguaaagauccuau

SEQ ID NO: 1898305 - RNA, 15 nt, Homo sapiens
uggauucacucacuc

SEQ ID NO: 1898306 - RNA, 22 nt, Homo sapiens
guaaaauucuacuguauggaau

SEQ ID NO: 1898307 - RNA, 13 nt, Homo sapiens
agaagaggcugcu

SEQ ID NO: 1898308 - RNA, 20 nt, Homo sapiens
caugucaucaaaaucugcac

SEQ ID NO: 1898309 - RNA, 18 nt, Homo sapiens
uucuccugugauguccca

SEQ ID NO: 1898310 - RNA, 19 nt, Homo sapiens
gugcgugaaguaggcauau

SEQ ID NO: 1898311 - RNA, 14 nt, Homo sapiens
ugccuguaaucuca

SEQ ID NO: 1898312 - RNA, 21 nt, Homo sapiens
cuuaauaaauauuacagugaa

SEQ ID NO: 1898313 - RNA, 14 nt, Homo sapiens
ugcaacaacaugua

SEQ ID NO: 1898314 - RNA, 22 nt, Homo sapiens
caccgcgcccagccucaucucu

SEQ ID NO: 1898315 - RNA, 23 nt, Homo sapiens
uucagaguugcuuuaaaguaccu

SEQ ID NO: 1898316 - RNA, 14 nt, Homo sapiens
auugcuaaaacagc

SEQ ID NO: 1898317 - RNA, 20 nt, Homo sapiens
ucuagcaaguguaagcagaa

SEQ ID NO: 1898318 - RNA, 19 nt, Homo sapiens
ccuuucauaaaaaccaaac

SEQ ID NO: 1898319 - RNA, 14 nt, Homo sapiens
aauaaaauguuccg

SEQ ID NO: 1898320 - RNA, 15 nt, Homo sapiens
cugaaauaaaagccu

SEQ ID NO: 1898321 - RNA, 14 nt, Homo sapiens
ucaugcugaucuuc

SEQ ID NO: 1898322 - RNA, 17 nt, Homo sapiens
aaagccauaacuugaaa

SEQ ID NO: 1898323 - RNA, 20 nt, Homo sapiens
uuaaauauauaauguugcca

SEQ ID NO: 1898324 - RNA, 23 nt, Homo sapiens
uaggggauuuuuuugaugugccu

SEQ ID NO: 1898325 - RNA, 12 nt, Homo sapiens
gaucaguugcca

SEQ ID NO: 1898326 - RNA, 12 nt, Homo sapiens
uugagacauuua

SEQ ID NO: 1898327 - RNA, 18 nt, Homo sapiens
ucucauguuuuccauugu

SEQ ID NO: 1898328 - RNA, 22 nt, Homo sapiens
caauccuuaacauauuugcaca

SEQ ID NO: 1898329 - RNA, 13 nt, Homo sapiens
agcuggaaccaug

SEQ ID NO: 1898330 - RNA, 19 nt, Homo sapiens
uggaaaucaauacugcaca

SEQ ID NO: 1898331 - RNA, 15 nt, Homo sapiens
uggagguuacaguga

SEQ ID NO: 1898332 - RNA, 22 nt, Homo sapiens
acagcuaauuguaccauagugu

SEQ ID NO: 1898333 - RNA, 14 nt, Homo sapiens
aaaauacauacuau

SEQ ID NO: 1898334 - RNA, 14 nt, Homo sapiens
uaauuacaaacaau

SEQ ID NO: 1898335 - RNA, 15 nt, Homo sapiens
auccagcaguauuuu

SEQ ID NO: 1898336 - RNA, 16 nt, Homo sapiens
aaaauguaucaacaca

SEQ ID NO: 1898337 - RNA, 21 nt, Homo sapiens
auuuccuuggcuucgugaaug

SEQ ID NO: 1898338 - RNA, 12 nt, Homo sapiens
cauucacuuguu

SEQ ID NO: 1898339 - RNA, 17 nt, Homo sapiens
caagcccaggcuuccug

SEQ ID NO: 1898340 - RNA, 15 nt, Homo sapiens
aagugucucauucuc

SEQ ID NO: 1898341 - RNA, 14 nt, Homo sapiens
guuugagcuuucau

SEQ ID NO: 1898342 - RNA, 16 nt, Homo sapiens
uuagaccucauuaaau

SEQ ID NO: 1898343 - RNA, 19 nt, Homo sapiens
ggucugauuuugagguuua

SEQ ID NO: 1898344 - RNA, 20 nt, Homo sapiens
ucuuuaccaaaaccauccau

SEQ ID NO: 1898345 - RNA, 15 nt, Homo sapiens
gaagucagagagaaa

SEQ ID NO: 1898346 - RNA, 22 nt, Homo sapiens
ucacaucuuccaccagcaccuu

SEQ ID NO: 1898347 - RNA, 16 nt, Homo sapiens
aacaacuuacacuuau

SEQ ID NO: 1898348 - RNA, 21 nt, Homo sapiens
ccaggaggaguuagccaaaca

SEQ ID NO: 1898349 - RNA, 16 nt, Homo sapiens
agagucuuaauauaua

SEQ ID NO: 1898350 - RNA, 13 nt, Homo sapiens
uugacaacaguua

SEQ ID NO: 1898351 - RNA, 17 nt, Homo sapiens
agccggagucacugccu

SEQ ID NO: 1898352 - RNA, 17 nt, Homo sapiens
uuacaggauuaauauau

SEQ ID NO: 1898353 - RNA, 16 nt, Homo sapiens
aacagcagaaacccau

SEQ ID NO: 1898354 - RNA, 16 nt, Homo sapiens
agcuagaacauuccau

SEQ ID NO: 1898355 - RNA, 20 nt, Homo sapiens
cauaaagauguuaaauggaa

SEQ ID NO: 1898356 - RNA, 21 nt, Homo sapiens
aacugccauuauuuucuguca

SEQ ID NO: 1898357 - RNA, 16 nt, Homo sapiens
gaagcuuucaguauua

SEQ ID NO: 1898358 - RNA, 20 nt, Homo sapiens
augugcugacaaggcacuuc

SEQ ID NO: 1898359 - RNA, 22 nt, Homo sapiens
ugcauggcagggccucaucuca

SEQ ID NO: 1898360 - RNA, 17 nt, Homo sapiens
acccacuccuuuacaac

SEQ ID NO: 1898361 - RNA, 13 nt, Homo sapiens
ucuuugguuuugg

SEQ ID NO: 1898362 - RNA, 17 nt, Homo sapiens
cauuuaaauguguacaa

SEQ ID NO: 1898363 - RNA, 22 nt, Homo sapiens
auaugcacacacacggaugcac

SEQ ID NO: 1898364 - RNA, 16 nt, Homo sapiens
gcgcaggcccagugac

SEQ ID NO: 1898365 - RNA, 22 nt, Homo sapiens
gaaugagcagcuuuagcaaaga

SEQ ID NO: 1898366 - RNA, 18 nt, Homo sapiens
augcaccuguagucucac

SEQ ID NO: 1898367 - RNA, 22 nt, Homo sapiens
uuagagacaguugggugagaac

SEQ ID NO: 1898368 - RNA, 21 nt, Homo sapiens
ucgcggcucuccagggcuccc

SEQ ID NO: 1898369 - RNA, 18 nt, Homo sapiens
uucacaacaggcauucca

SEQ ID NO: 1898370 - RNA, 18 nt, Homo sapiens
aaggaacacauaccuuug

SEQ ID NO: 1898371 - RNA, 18 nt, Homo sapiens
auuuuuuaaacagauauu

SEQ ID NO: 1898372 - RNA, 17 nt, Homo sapiens
gaaaagccagaguucca

SEQ ID NO: 1898373 - RNA, 15 nt, Homo sapiens
ucaauacagauauau

SEQ ID NO: 1898374 - RNA, 14 nt, Homo sapiens
guguuagcacugau

SEQ ID NO: 1898375 - RNA, 12 nt, Homo sapiens
cuacucacuucu

SEQ ID NO: 1898376 - RNA, 18 nt, Homo sapiens
augcaagaaguacugcca

SEQ ID NO: 1898377 - RNA, 18 nt, Homo sapiens
cgaaauaacaauguuaag

SEQ ID NO: 1898378 - RNA, 21 nt, Homo sapiens
gcuccccacgucagcugggac

SEQ ID NO: 1898379 - RNA, 20 nt, Homo sapiens
agccugugccucccagcuua

SEQ ID NO: 1898380 - RNA, 13 nt, Homo sapiens
agcuucaaaacag

SEQ ID NO: 1898381 - RNA, 13 nt, Homo sapiens
agaagcaaaaauu

SEQ ID NO: 1898382 - RNA, 15 nt, Homo sapiens
auccuagacuugaaa

SEQ ID NO: 1898383 - RNA, 20 nt, Homo sapiens
auucaccucucucacugacu

SEQ ID NO: 1898384 - RNA, 18 nt, Homo sapiens
gucucccuaaaauaaaaa

SEQ ID NO: 1898385 - RNA, 22 nt, Homo sapiens
aaaauaguugcaaagcauuuga

SEQ ID NO: 1898386 - RNA, 22 nt, Homo sapiens
cauguauuagccagucauugua

SEQ ID NO: 1898387 - RNA, 18 nt, Homo sapiens
uugccuuuccaggguuau

SEQ ID NO: 1898388 - RNA, 23 nt, Homo sapiens
ccuggcggguggcugcaagccca

SEQ ID NO: 1898389 - RNA, 20 nt, Homo sapiens
gucuuugaacguacccaagg

SEQ ID NO: 1898390 - RNA, 21 nt, Homo sapiens
gacgcucagccccaggccagc

SEQ ID NO: 1898391 - RNA, 16 nt, Homo sapiens
aagugguuucagcaau

SEQ ID NO: 1898392 - RNA, 20 nt, Homo sapiens
gaaaggauugauuugaacuu

SEQ ID NO: 1898393 - RNA, 20 nt, Homo sapiens
uucaagcaaaaugcuuacag

SEQ ID NO: 1898394 - RNA, 12 nt, Homo sapiens
cuuuaucaaaga

SEQ ID NO: 1898395 - RNA, 17 nt, Homo sapiens
acaaauuaaaagcuaua

SEQ ID NO: 1898396 - RNA, 12 nt, Homo sapiens
agaaagaauuag

SEQ ID NO: 1898397 - RNA, 20 nt, Homo sapiens
cacagaauuuguauguauuu

SEQ ID NO: 1898398 - RNA, 14 nt, Homo sapiens
aagcccucuuccau

SEQ ID NO: 1898399 - RNA, 14 nt, Homo sapiens
aaauaugauuugug

SEQ ID NO: 1898400 - RNA, 15 nt, Homo sapiens
uccaggauugagcag

SEQ ID NO: 1898401 - RNA, 19 nt, Homo sapiens
uccagccccuccucccuca

SEQ ID NO: 1898402 - RNA, 14 nt, Homo sapiens
cggccucccaaagu

SEQ ID NO: 1898403 - RNA, 19 nt, Homo sapiens
ugugccaucauaagaauag

SEQ ID NO: 1898404 - RNA, 19 nt, Homo sapiens
agccucgaacuccugggcu

SEQ ID NO: 1898405 - RNA, 18 nt, Homo sapiens
cuuucuucaauacaaaaa

SEQ ID NO: 1898406 - RNA, 14 nt, Homo sapiens
uagccuccaaacau

SEQ ID NO: 1898407 - RNA, 17 nt, Homo sapiens
ccuucuggggcuuugcc

SEQ ID NO: 1898408 - RNA, 13 nt, Homo sapiens
acagcuguguacu

SEQ ID NO: 1898409 - RNA, 20 nt, Homo sapiens
aaggugggcggaucacuuga

SEQ ID NO: 1898410 - RNA, 14 nt, Homo sapiens
gaaucuucaccuca

SEQ ID NO: 1898411 - RNA, 21 nt, Homo sapiens
cugcccccacuguccugugag

SEQ ID NO: 1898412 - RNA, 17 nt, Homo sapiens
cacuuaaaaaaaugccu

SEQ ID NO: 1898413 - RNA, 15 nt, Homo sapiens
gugcggcugccauug

SEQ ID NO: 1898414 - RNA, 15 nt, Homo sapiens
uuccuugcucugcac

SEQ ID NO: 1898415 - RNA, 22 nt, Homo sapiens
uuuacaaaagggacucuaugga

SEQ ID NO: 1898416 - RNA, 13 nt, Homo sapiens
ucagucuacaggc

SEQ ID NO: 1898417 - RNA, 22 nt, Homo sapiens
acaugaagcuguugugugaggu

SEQ ID NO: 1898418 - RNA, 16 nt, Homo sapiens
aaacaugaaaacauug

SEQ ID NO: 1898419 - RNA, 16 nt, Homo sapiens
cucagggacucaggug

SEQ ID NO: 1898420 - RNA, 18 nt, Homo sapiens
aaccagcccgucuucucu

SEQ ID NO: 1898421 - RNA, 15 nt, Homo sapiens
aagccagugacucca

SEQ ID NO: 1898422 - RNA, 17 nt, Homo sapiens
aauggugguggaagggu

SEQ ID NO: 1898423 - RNA, 17 nt, Homo sapiens
cugaauaaaugaaugca

SEQ ID NO: 1898424 - RNA, 22 nt, Homo sapiens
agggaaagugcauaugaaaucc

SEQ ID NO: 1898425 - RNA, 19 nt, Homo sapiens
aucuuagguaagacauaua

SEQ ID NO: 1898426 - RNA, 20 nt, Homo sapiens
agucauauacauuaguuuua

SEQ ID NO: 1898427 - RNA, 20 nt, Homo sapiens
cuuuugaaagucccuaauaa

SEQ ID NO: 1898428 - RNA, 13 nt, Homo sapiens
caggcucugcuga

SEQ ID NO: 1898429 - RNA, 23 nt, Homo sapiens
ccaggcuggcagauuuccaaaag

SEQ ID NO: 1898430 - RNA, 18 nt, Homo sapiens
uguggaguccgacaaagc

SEQ ID NO: 1898431 - RNA, 14 nt, Homo sapiens
ccuccugagccuca

SEQ ID NO: 1898432 - RNA, 15 nt, Homo sapiens
uauuuuaagcauucu

SEQ ID NO: 1898433 - RNA, 16 nt, Homo sapiens
ucugguaauauugacu

SEQ ID NO: 1898434 - RNA, 23 nt, Homo sapiens
augacuucuuuacuaacacuggc

SEQ ID NO: 1898435 - RNA, 19 nt, Homo sapiens
cuuuacaaacccugcaauu

SEQ ID NO: 1898436 - RNA, 15 nt, Homo sapiens
aacacacuggccauu

SEQ ID NO: 1898437 - RNA, 14 nt, Homo sapiens
cuggauauggugca

SEQ ID NO: 1898438 - RNA, 16 nt, Homo sapiens
ucuguguuuacuuaag

SEQ ID NO: 1898439 - RNA, 13 nt, Homo sapiens
gacuucaucccaa

SEQ ID NO: 1898440 - RNA, 13 nt, Homo sapiens
gugagcugucacu

SEQ ID NO: 1898441 - RNA, 15 nt, Homo sapiens
auuuuaaaaaaucaa

SEQ ID NO: 1898442 - RNA, 14 nt, Homo sapiens
uacgggcugcucua

SEQ ID NO: 1898443 - RNA, 17 nt, Homo sapiens
agaaaaugaauuugacu

SEQ ID NO: 1898444 - RNA, 20 nt, Homo sapiens
ugcugacucuggccuuacaa

SEQ ID NO: 1898445 - RNA, 17 nt, Homo sapiens
ucagucaaaacuuuaaa

SEQ ID NO: 1898446 - RNA, 13 nt, Homo sapiens
uaagacuucuggu

SEQ ID NO: 1898447 - RNA, 16 nt, Homo sapiens
agauggauguuuguca

SEQ ID NO: 1898448 - RNA, 19 nt, Homo sapiens
agcugggauuacaggcgug

SEQ ID NO: 1898449 - RNA, 22 nt, Homo sapiens
gaaugauuaaucaaaggcauau

SEQ ID NO: 1898450 - RNA, 16 nt, Homo sapiens
ccuccugcucugccca

SEQ ID NO: 1898451 - RNA, 14 nt, Homo sapiens
cccagcuuaucucc

SEQ ID NO: 1898452 - RNA, 12 nt, Homo sapiens
guuuuugccaaa

SEQ ID NO: 1898453 - RNA, 12 nt, Homo sapiens
guuauugccaau

SEQ ID NO: 1898454 - RNA, 20 nt, Homo sapiens
ggucucaucuccuuugcuag

SEQ ID NO: 1898455 - RNA, 21 nt, Homo sapiens
uuucaggcucgccaaggccua

SEQ ID NO: 1898456 - RNA, 12 nt, Homo sapiens
auugcaugacuu

SEQ ID NO: 1898457 - RNA, 23 nt, Homo sapiens
uacugcacagagucaggaucuca

SEQ ID NO: 1898458 - RNA, 23 nt, Homo sapiens
aguauuagaagcagaucauuucc

SEQ ID NO: 1898459 - RNA, 14 nt, Homo sapiens
aguaaaacagucau

SEQ ID NO: 1898460 - RNA, 14 nt, Homo sapiens
aaucaaacaauaau

SEQ ID NO: 1898461 - RNA, 13 nt, Homo sapiens
cccucccagagaa

SEQ ID NO: 1898462 - RNA, 17 nt, Homo sapiens
uaacacuguuaagagag

SEQ ID NO: 1898463 - RNA, 14 nt, Homo sapiens
cuucucuucucugc

SEQ ID NO: 1898464 - RNA, 19 nt, Homo sapiens
ggaggcggagcuugcagug

SEQ ID NO: 1898465 - RNA, 15 nt, Homo sapiens
ucugcccacagucuu

SEQ ID NO: 1898466 - RNA, 18 nt, Homo sapiens
agaucacgucacugcacu

SEQ ID NO: 1898467 - RNA, 20 nt, Homo sapiens
uggggaguuauaaaaauaca

SEQ ID NO: 1898468 - RNA, 23 nt, Homo sapiens
aucucaucccaauaaaaugauau

SEQ ID NO: 1898469 - RNA, 12 nt, Homo sapiens
caggacagugcu

SEQ ID NO: 1898470 - RNA, 16 nt, Homo sapiens
ucaagagcaugcacau

SEQ ID NO: 1898471 - RNA, 13 nt, Homo sapiens
agcuacuguagaa

SEQ ID NO: 1898472 - RNA, 14 nt, Homo sapiens
gcucugugccuugg

SEQ ID NO: 1898473 - RNA, 14 nt, Homo sapiens
cagugguggagcug

SEQ ID NO: 1898474 - RNA, 16 nt, Homo sapiens
uggaucagaugaacuc

SEQ ID NO: 1898475 - RNA, 14 nt, Homo sapiens
agcccuggcucuca

SEQ ID NO: 1898476 - RNA, 13 nt, Homo sapiens
gcccacugugcag

SEQ ID NO: 1898477 - RNA, 20 nt, Homo sapiens
uaauccugguggucuugccu

SEQ ID NO: 1898478 - RNA, 20 nt, Homo sapiens
agacaucaagcucaaggcaa

SEQ ID NO: 1898479 - RNA, 16 nt, Homo sapiens
auaaaccaaaggaaaa

SEQ ID NO: 1898480 - RNA, 21 nt, Homo sapiens
gguggaucacgaggucaggag

SEQ ID NO: 1898481 - RNA, 21 nt, Homo sapiens
ugggcccaagaacugcagaua

SEQ ID NO: 1898482 - RNA, 15 nt, Homo sapiens
aaaaugucagaaaau

SEQ ID NO: 1898483 - RNA, 21 nt, Homo sapiens
uccuacugagcauuugcaccu

SEQ ID NO: 1898484 - RNA, 11 nt, Homo sapiens
ccaacuauuaa

SEQ ID NO: 1898485 - RNA, 18 nt, Homo sapiens
gcauuuguucuuugccag

SEQ ID NO: 1898486 - RNA, 18 nt, Homo sapiens
acaugaaucccacccaca

SEQ ID NO: 1898487 - RNA, 14 nt, Homo sapiens
cuguguauucucau

SEQ ID NO: 1898488 - RNA, 18 nt, Homo sapiens
cacaaacucuuuccuuca

SEQ ID NO: 1898489 - RNA, 21 nt, Homo sapiens
cuccaucaauaaauguugcaa

SEQ ID NO: 1898490 - RNA, 20 nt, Homo sapiens
aaagauguuaguaguuucuc

SEQ ID NO: 1898491 - RNA, 17 nt, Homo sapiens
aauuaguggcacuugcu

SEQ ID NO: 1898492 - RNA, 12 nt, Homo sapiens
augucaucaaaa

SEQ ID NO: 1898493 - RNA, 17 nt, Homo sapiens
uguacauauguuucaca

SEQ ID NO: 1898494 - RNA, 19 nt, Homo sapiens
uggcccccuauuuugccau

SEQ ID NO: 1898495 - RNA, 23 nt, Homo sapiens
gcuuuaucuuuggagaaggcaag

SEQ ID NO: 1898496 - RNA, 23 nt, Homo sapiens
gcaucuggaaauuuuuacuuuaa

SEQ ID NO: 1898497 - RNA, 17 nt, Homo sapiens
agaauccuguaagcccc

SEQ ID NO: 1898498 - RNA, 12 nt, Homo sapiens
gggaaugagcau

SEQ ID NO: 1898499 - RNA, 20 nt, Homo sapiens
aacucugugucccagcaccu

SEQ ID NO: 1898500 - RNA, 14 nt, Homo sapiens
gcaacaugcuucau

SEQ ID NO: 1898501 - RNA, 15 nt, Homo sapiens
cucccguccauucca

SEQ ID NO: 1898502 - RNA, 11 nt, Homo sapiens
aauauucaaua

SEQ ID NO: 1898503 - RNA, 11 nt, Homo sapiens
uaaauucauuu

SEQ ID NO: 1898504 - RNA, 15 nt, Homo sapiens
uagcuguacuguaau

SEQ ID NO: 1898505 - RNA, 15 nt, Homo sapiens
aaguuaaagugaaua

SEQ ID NO: 1898506 - RNA, 23 nt, Homo sapiens
uuaugagucucuaugaucuuggc

SEQ ID NO: 1898507 - RNA, 16 nt, Homo sapiens
aaauuuuacaguagaa

SEQ ID NO: 1898508 - RNA, 17 nt, Homo sapiens
uuccccucuucugcuaa

SEQ ID NO: 1898509 - RNA, 23 nt, Homo sapiens
aguaacagugcaguacucaguaa

SEQ ID NO: 1898510 - RNA, 15 nt, Homo sapiens
cccauggucaaugca

SEQ ID NO: 1898511 - RNA, 15 nt, Homo sapiens
auauaguagccauga

SEQ ID NO: 1898512 - RNA, 23 nt, Homo sapiens
aacauuguuuuguguaacauauu

SEQ ID NO: 1898513 - RNA, 21 nt, Homo sapiens
uuuuccaucauuuuacaguga

SEQ ID NO: 1898514 - RNA, 19 nt, Homo sapiens
cccgaggaggggcccggug

SEQ ID NO: 1898515 - RNA, 14 nt, Homo sapiens
caguuacucaggag

SEQ ID NO: 1898516 - RNA, 21 nt, Homo sapiens
aagugaauugucuuuguuaua

SEQ ID NO: 1898517 - RNA, 12 nt, Homo sapiens
gaagugcucuaa

SEQ ID NO: 1898518 - RNA, 13 nt, Homo sapiens
auacccaucccau

SEQ ID NO: 1898519 - RNA, 15 nt, Homo sapiens
aaguugcuccauaca

SEQ ID NO: 1898520 - RNA, 15 nt, Homo sapiens
augacuuacuuagaa

SEQ ID NO: 1898521 - RNA, 11 nt, Homo sapiens
uuaaaccugga

SEQ ID NO: 1898522 - RNA, 22 nt, Homo sapiens
uugcaggauuuuuagagcauua

SEQ ID NO: 1898523 - RNA, 15 nt, Homo sapiens
aucuuuguuccucug

SEQ ID NO: 1898524 - RNA, 22 nt, Homo sapiens
acuugucaggguauaaaaugac

SEQ ID NO: 1898525 - RNA, 21 nt, Homo sapiens
agaggcucagacucacuguua

SEQ ID NO: 1898526 - RNA, 21 nt, Homo sapiens
ucaguuacugaugcuccugaa

SEQ ID NO: 1898527 - RNA, 23 nt, Homo sapiens
ccugccagggugggcagacagac

SEQ ID NO: 1898528 - RNA, 17 nt, Homo sapiens
uacagguaccaguucuu

SEQ ID NO: 1898529 - RNA, 11 nt, Homo sapiens
ucuauaugauu

SEQ ID NO: 1898530 - RNA, 20 nt, Homo sapiens
aagauccaccuccccacugc

SEQ ID NO: 1898531 - RNA, 20 nt, Homo sapiens
caaccuuuauucuuuuccaa

SEQ ID NO: 1898532 - RNA, 16 nt, Homo sapiens
gaaagguuauguuagc

SEQ ID NO: 1898533 - RNA, 13 nt, Homo sapiens
ggagugcauuuag

SEQ ID NO: 1898534 - RNA, 13 nt, Homo sapiens
aacugauuacugu

SEQ ID NO: 1898535 - RNA, 11 nt, Homo sapiens
gucagccagcu

SEQ ID NO: 1898536 - RNA, 15 nt, Homo sapiens
ucaguuuuuacugag

SEQ ID NO: 1898537 - RNA, 14 nt, Homo sapiens
aauguuuacacucu

SEQ ID NO: 1898538 - RNA, 22 nt, Homo sapiens
gcaguuugccaccccuguccag

SEQ ID NO: 1898539 - RNA, 20 nt, Homo sapiens
agagaaugcacaaacagagg

SEQ ID NO: 1898540 - RNA, 19 nt, Homo sapiens
gucaggaaucaugaucuga

SEQ ID NO: 1898541 - RNA, 18 nt, Homo sapiens
caguagguagacacaaac

SEQ ID NO: 1898542 - RNA, 12 nt, Homo sapiens
ucucuacugcuu

SEQ ID NO: 1898543 - RNA, 19 nt, Homo sapiens
uguuccucuuggugucaua

SEQ ID NO: 1898544 - RNA, 15 nt, Homo sapiens
auauuuuguuuacaa

SEQ ID NO: 1898545 - RNA, 20 nt, Homo sapiens
gauucauuuuaacaucugag

SEQ ID NO: 1898546 - RNA, 21 nt, Homo sapiens
agccaugucuucucccuggaa

SEQ ID NO: 1898547 - RNA, 17 nt, Homo sapiens
ucaggcacacagcuacu

SEQ ID NO: 1898548 - RNA, 15 nt, Homo sapiens
uguauuauguaugcg

SEQ ID NO: 1898549 - RNA, 18 nt, Homo sapiens
accccgccucugggcuca

SEQ ID NO: 1898550 - RNA, 17 nt, Homo sapiens
uaauugguuaguuaaca

SEQ ID NO: 1898551 - RNA, 17 nt, Homo sapiens
ggugucaucugcuccuu

SEQ ID NO: 1898552 - RNA, 10 nt, Homo sapiens
aguuugauau

SEQ ID NO: 1898553 - RNA, 12 nt, Homo sapiens
gccccugccuga

SEQ ID NO: 1898554 - RNA, 20 nt, Homo sapiens
aaccucccccccaaauacuc

SEQ ID NO: 1898555 - RNA, 19 nt, Homo sapiens
cagagacuggcauuuuccu

SEQ ID NO: 1898556 - RNA, 19 nt, Homo sapiens
uaaucuuccauacuucuuc

SEQ ID NO: 1898557 - RNA, 19 nt, Homo sapiens
aaauacuuauggcucaaaa

SEQ ID NO: 1898558 - RNA, 16 nt, Homo sapiens
guucccucuugcucag

SEQ ID NO: 1898559 - RNA, 12 nt, Homo sapiens
ccucucucagga

SEQ ID NO: 1898560 - RNA, 20 nt, Homo sapiens
gguauuuugguacugugaug

SEQ ID NO: 1898561 - RNA, 19 nt, Homo sapiens
ucaguuguuuaauaauuua

SEQ ID NO: 1898562 - RNA, 18 nt, Homo sapiens
aauuccaaccguccugac

SEQ ID NO: 1898563 - RNA, 13 nt, Homo sapiens
ugaaauugaguca

SEQ ID NO: 1898564 - RNA, 13 nt, Homo sapiens
acuaauugucaca

SEQ ID NO: 1898565 - RNA, 23 nt, Homo sapiens
aaagcuuucugccaccccuaaac

SEQ ID NO: 1898566 - RNA, 23 nt, Homo sapiens
ccaaaacagcuuugucuccaaag

SEQ ID NO: 1898567 - RNA, 21 nt, Homo sapiens
cuauacaugguagccaguuga

SEQ ID NO: 1898568 - RNA, 14 nt, Homo sapiens
auugcuacugaugc

SEQ ID NO: 1898569 - RNA, 12 nt, Homo sapiens
agaaaucugcca

SEQ ID NO: 1898570 - RNA, 12 nt, Homo sapiens
agacaucugccc

SEQ ID NO: 1898571 - RNA, 15 nt, Homo sapiens
uaaauggcaugacaa

SEQ ID NO: 1898572 - RNA, 17 nt, Homo sapiens
accuaagcaaaaccacu

SEQ ID NO: 1898573 - RNA, 22 nt, Homo sapiens
ggauagaagggcaauauuuuau

SEQ ID NO: 1898574 - RNA, 22 nt, Homo sapiens
uuuuuggaaaauaaaaagugcc

SEQ ID NO: 1898575 - RNA, 20 nt, Homo sapiens
uaauugagaucacauuucag

SEQ ID NO: 1898576 - RNA, 15 nt, Homo sapiens
auuaacaaaauauuc

SEQ ID NO: 1898577 - RNA, 19 nt, Homo sapiens
agauucuuuaaacuacuga

SEQ ID NO: 1898578 - RNA, 20 nt, Homo sapiens
aaguuauuccccaucuucca

SEQ ID NO: 1898579 - RNA, 19 nt, Homo sapiens
ucaucauggaggucauaca

SEQ ID NO: 1898580 - RNA, 19 nt, Homo sapiens
uaaaguguuguggccuuaa

SEQ ID NO: 1898581 - RNA, 14 nt, Homo sapiens
uccuucaccaaaga

SEQ ID NO: 1898582 - RNA, 15 nt, Homo sapiens
auguguuuuucacau

SEQ ID NO: 1898583 - RNA, 21 nt, Homo sapiens
ucgcccaggcuggagugcagu

SEQ ID NO: 1898584 - RNA, 19 nt, Homo sapiens
augcuucuguugaucucag

SEQ ID NO: 1898585 - RNA, 16 nt, Homo sapiens
cuuccucugcaaaaag

SEQ ID NO: 1898586 - RNA, 16 nt, Homo sapiens
uacauacagaauuacu

SEQ ID NO: 1898587 - RNA, 19 nt, Homo sapiens
uguccacauuuuacaggca

SEQ ID NO: 1898588 - RNA, 12 nt, Homo sapiens
uauauacauaua

SEQ ID NO: 1898589 - RNA, 12 nt, Homo sapiens
acaauacaacaa

SEQ ID NO: 1898590 - RNA, 12 nt, Homo sapiens
uacauacauaca

SEQ ID NO: 1898591 - RNA, 16 nt, Homo sapiens
aguuccugcucucugc

SEQ ID NO: 1898592 - RNA, 16 nt, Homo sapiens
accuuggagcauuuau

SEQ ID NO: 1898593 - RNA, 16 nt, Homo sapiens
uuaagaaccugaauau

SEQ ID NO: 1898594 - RNA, 23 nt, Homo sapiens
agaugacucugucucauugaccu

SEQ ID NO: 1898595 - RNA, 14 nt, Homo sapiens
agaaaucugcugca

SEQ ID NO: 1898596 - RNA, 19 nt, Homo sapiens
ggccacgcuccucuguuca

SEQ ID NO: 1898597 - RNA, 14 nt, Homo sapiens
ugugcuggguccca

SEQ ID NO: 1898598 - RNA, 14 nt, Homo sapiens
guugaaggugccau

SEQ ID NO: 1898599 - RNA, 18 nt, Homo sapiens
acagggaaggaugacaaa

SEQ ID NO: 1898600 - RNA, 20 nt, Homo sapiens
agcacacuuggcccaagugg

SEQ ID NO: 1898601 - RNA, 15 nt, Homo sapiens
guuucucugcuguca

SEQ ID NO: 1898602 - RNA, 23 nt, Homo sapiens
gauacaguuuugaguaaaaagac

SEQ ID NO: 1898603 - RNA, 19 nt, Homo sapiens
ucacuuuuuacagugcuau

SEQ ID NO: 1898604 - RNA, 16 nt, Homo sapiens
uggcucacacugagaa

SEQ ID NO: 1898605 - RNA, 21 nt, Homo sapiens
auuuuccugagaugacugagu

SEQ ID NO: 1898606 - RNA, 17 nt, Homo sapiens
cagugagggcucuggau

SEQ ID NO: 1898607 - RNA, 20 nt, Homo sapiens
ugaacugggcagacugcaaa

SEQ ID NO: 1898608 - RNA, 14 nt, Homo sapiens
aggaguuggaguua

SEQ ID NO: 1898609 - RNA, 11 nt, Homo sapiens
cgcaggaccau

SEQ ID NO: 1898610 - RNA, 18 nt, Homo sapiens
uuuauauaaggcauucca

SEQ ID NO: 1898611 - RNA, 13 nt, Homo sapiens
ccucaucuagucu

SEQ ID NO: 1898612 - RNA, 19 nt, Homo sapiens
gucaaggguggacacugca

SEQ ID NO: 1898613 - RNA, 14 nt, Homo sapiens
ggguugauccugca

SEQ ID NO: 1898614 - RNA, 12 nt, Homo sapiens
cggauccugcug

SEQ ID NO: 1898615 - RNA, 15 nt, Homo sapiens
cacacccugacuuca

SEQ ID NO: 1898616 - RNA, 17 nt, Homo sapiens
ugcuucaucugugggau

SEQ ID NO: 1898617 - RNA, 14 nt, Homo sapiens
ccugccucacuccu

SEQ ID NO: 1898618 - RNA, 23 nt, Homo sapiens
ggagcuagccagaggacugugau

SEQ ID NO: 1898619 - RNA, 23 nt, Homo sapiens
uccuuuaaaaaacuuagugacaa

SEQ ID NO: 1898620 - RNA, 13 nt, Homo sapiens
gaacucuucaucu

SEQ ID NO: 1898621 - RNA, 22 nt, Homo sapiens
ucauuuuuacagaguuugugaa

SEQ ID NO: 1898622 - RNA, 18 nt, Homo sapiens
uucuaguauguacuuuga

SEQ ID NO: 1898623 - RNA, 16 nt, Homo sapiens
uagaauaagaauuugc

SEQ ID NO: 1898624 - RNA, 16 nt, Homo sapiens
gaaaagggcaucucaa

SEQ ID NO: 1898625 - RNA, 13 nt, Homo sapiens
aaauccaaaaaga

SEQ ID NO: 1898626 - RNA, 22 nt, Homo sapiens
uaaagauaggaauucacugaua

SEQ ID NO: 1898627 - RNA, 19 nt, Homo sapiens
uccaauuuuguugcaucau

SEQ ID NO: 1898628 - RNA, 13 nt, Homo sapiens
aaugaacuuugaa

SEQ ID NO: 1898629 - RNA, 13 nt, Homo sapiens
gaugugagggcac

SEQ ID NO: 1898630 - RNA, 20 nt, Homo sapiens
ccuccaggcuccagcacauc

SEQ ID NO: 1898631 - RNA, 17 nt, Homo sapiens
cauagucauugugguuu

SEQ ID NO: 1898632 - RNA, 23 nt, Homo sapiens
cggccgaagcccaccacuggcca

SEQ ID NO: 1898633 - RNA, 16 nt, Homo sapiens
ucaugaaaacacacau

SEQ ID NO: 1898634 - RNA, 12 nt, Homo sapiens
ccaguacuugag

SEQ ID NO: 1898635 - RNA, 19 nt, Homo sapiens
ugguguucaaaaaaacacu

SEQ ID NO: 1898636 - RNA, 13 nt, Homo sapiens
cgcaccugccuca

SEQ ID NO: 1898637 - RNA, 15 nt, Homo sapiens
ucacuuaagcccagg

SEQ ID NO: 1898638 - RNA, 14 nt, Homo sapiens
ucaaacuacuggca

SEQ ID NO: 1898639 - RNA, 14 nt, Homo sapiens
gaauagacuaucua

SEQ ID NO: 1898640 - RNA, 16 nt, Homo sapiens
ugcgaauaacaguccc

SEQ ID NO: 1898641 - RNA, 16 nt, Homo sapiens
aaucaauggugcaaaa

SEQ ID NO: 1898642 - RNA, 20 nt, Homo sapiens
aaugcuccuccuccaugcuc

SEQ ID NO: 1898643 - RNA, 13 nt, Homo sapiens
uggauguucugac

SEQ ID NO: 1898644 - RNA, 16 nt, Homo sapiens
acuccaucacugagag

SEQ ID NO: 1898645 - RNA, 13 nt, Homo sapiens
cccccagugcuca

SEQ ID NO: 1898646 - RNA, 13 nt, Homo sapiens
cauacagugacaa

SEQ ID NO: 1898647 - RNA, 21 nt, Homo sapiens
cagcuugagcugccucugaga

SEQ ID NO: 1898648 - RNA, 14 nt, Homo sapiens
ccuuccccauggga

SEQ ID NO: 1898649 - RNA, 19 nt, Homo sapiens
acucauuagugacuucaaa

SEQ ID NO: 1898650 - RNA, 17 nt, Homo sapiens
gaacuguuaaaggucau

SEQ ID NO: 1898651 - RNA, 17 nt, Homo sapiens
cccacaguaggcacuca

SEQ ID NO: 1898652 - RNA, 16 nt, Homo sapiens
ccagggagugguuugg

SEQ ID NO: 1898653 - RNA, 11 nt, Homo sapiens
cuucauugaaa

SEQ ID NO: 1898654 - RNA, 21 nt, Homo sapiens
auagcgugagcuaacugagag

SEQ ID NO: 1898655 - RNA, 17 nt, Homo sapiens
ccccgagaccucacuuu

SEQ ID NO: 1898656 - RNA, 17 nt, Homo sapiens
gaaacuguagucucagg

SEQ ID NO: 1898657 - RNA, 16 nt, Homo sapiens
cuacuucuauaucauu

SEQ ID NO: 1898658 - RNA, 15 nt, Homo sapiens
ugaaucacaauguaa

SEQ ID NO: 1898659 - RNA, 13 nt, Homo sapiens
augaacaaccucg

SEQ ID NO: 1898660 - RNA, 21 nt, Homo sapiens
cucuucccaccucagugccca

SEQ ID NO: 1898661 - RNA, 16 nt, Homo sapiens
ccucucucacacauca

SEQ ID NO: 1898662 - RNA, 13 nt, Homo sapiens
caagcuaaccuua

SEQ ID NO: 1898663 - RNA, 15 nt, Homo sapiens
cauugaauuugccuu

SEQ ID NO: 1898664 - RNA, 15 nt, Homo sapiens
agacuccucuuccca

SEQ ID NO: 1898665 - RNA, 17 nt, Homo sapiens
uuuguugccagauuuca

SEQ ID NO: 1898666 - RNA, 18 nt, Homo sapiens
aggugugaauaaaagcau

SEQ ID NO: 1898667 - RNA, 12 nt, Homo sapiens
gauagcaaguga

SEQ ID NO: 1898668 - RNA, 20 nt, Homo sapiens
gcauuccagccccucugguc

SEQ ID NO: 1898669 - RNA, 20 nt, Homo sapiens
ggaacucuggcuuccaggua

SEQ ID NO: 1898670 - RNA, 17 nt, Homo sapiens
caaugcuggacacuaca

SEQ ID NO: 1898671 - RNA, 14 nt, Homo sapiens
aucagcagcucuuu

SEQ ID NO: 1898672 - RNA, 21 nt, Homo sapiens
gccuggcccgcuaaggugaaa

SEQ ID NO: 1898673 - RNA, 12 nt, Homo sapiens
cugcacacuguc

SEQ ID NO: 1898674 - RNA, 14 nt, Homo sapiens
auuucuccaaagcc

SEQ ID NO: 1898675 - RNA, 13 nt, Homo sapiens
cacucuuccugag

SEQ ID NO: 1898676 - RNA, 17 nt, Homo sapiens
acauuguggcacauucu

SEQ ID NO: 1898677 - RNA, 13 nt, Homo sapiens
cauugcaagcuca

SEQ ID NO: 1898678 - RNA, 22 nt, Homo sapiens
cuuuugaacacguucgacaaaa

SEQ ID NO: 1898679 - RNA, 22 nt, Homo sapiens
gcaaccaggauugacaggccau

SEQ ID NO: 1898680 - RNA, 18 nt, Homo sapiens
gcuuucagaaaacgggaa

SEQ ID NO: 1898681 - RNA, 18 nt, Homo sapiens
acagaauuuuauggugca

SEQ ID NO: 1898682 - RNA, 18 nt, Homo sapiens
auuuuaaaaacuaaaaag

SEQ ID NO: 1898683 - RNA, 12 nt, Homo sapiens
auugcagacuca

SEQ ID NO: 1898684 - RNA, 13 nt, Homo sapiens
augaacagacuuu

SEQ ID NO: 1898685 - RNA, 17 nt, Homo sapiens
uaaccuggaccuggaac

SEQ ID NO: 1898686 - RNA, 14 nt, Homo sapiens
acaaagcaccucaa

SEQ ID NO: 1898687 - RNA, 19 nt, Homo sapiens
cuguugauucgucugcgau

SEQ ID NO: 1898688 - RNA, 20 nt, Homo sapiens
uccuugaccaauaaccuaau

SEQ ID NO: 1898689 - RNA, 17 nt, Homo sapiens
accugccagaggaugcu

SEQ ID NO: 1898690 - RNA, 15 nt, Homo sapiens
uaaaguaauuguaau

SEQ ID NO: 1898691 - RNA, 17 nt, Homo sapiens
caggacuugaacccagg

SEQ ID NO: 1898692 - RNA, 14 nt, Homo sapiens
ugaaguauugcuaa

SEQ ID NO: 1898693 - RNA, 18 nt, Homo sapiens
guacuuuuauaaugaaaa

SEQ ID NO: 1898694 - RNA, 16 nt, Homo sapiens
aaagauaucagagcuc

SEQ ID NO: 1898695 - RNA, 23 nt, Homo sapiens
ucaugccuguaaucucagcacuu

SEQ ID NO: 1898696 - RNA, 15 nt, Homo sapiens
uucucuaaugcagcu

SEQ ID NO: 1898697 - RNA, 18 nt, Homo sapiens
gggugcaaagauguucau

SEQ ID NO: 1898698 - RNA, 16 nt, Homo sapiens
gcauggaacacuucga

SEQ ID NO: 1898699 - RNA, 20 nt, Homo sapiens
cacccugcaccucauuccaa

SEQ ID NO: 1898700 - RNA, 16 nt, Homo sapiens
cugaaucucaccugcu

SEQ ID NO: 1898701 - RNA, 16 nt, Homo sapiens
gagauuaaguccagaa

SEQ ID NO: 1898702 - RNA, 20 nt, Homo sapiens
aagagggcauauacagugaa

SEQ ID NO: 1898703 - RNA, 23 nt, Homo sapiens
uggacgagugcucucggcccaac

SEQ ID NO: 1898704 - RNA, 15 nt, Homo sapiens
accuuuuacauauuu

SEQ ID NO: 1898705 - RNA, 13 nt, Homo sapiens
caacugccaagaa

SEQ ID NO: 1898706 - RNA, 18 nt, Homo sapiens
ugcauccagcaguacaau

SEQ ID NO: 1898707 - RNA, 22 nt, Homo sapiens
uugaggagccggccaccagaug

SEQ ID NO: 1898708 - RNA, 19 nt, Homo sapiens
uagaagauccacauccucu

SEQ ID NO: 1898709 - RNA, 17 nt, Homo sapiens
aauucauguuuucacuu

SEQ ID NO: 1898710 - RNA, 13 nt, Homo sapiens
gaacugggccuug

SEQ ID NO: 1898711 - RNA, 22 nt, Homo sapiens
acaccugggagaaggucuccaa

SEQ ID NO: 1898712 - RNA, 17 nt, Homo sapiens
auguccuccucugugaa

SEQ ID NO: 1898713 - RNA, 14 nt, Homo sapiens
uaaaauaacuugca

SEQ ID NO: 1898714 - RNA, 17 nt, Homo sapiens
ccucauuuaucccucaa

SEQ ID NO: 1898715 - RNA, 15 nt, Homo sapiens
caguucacaugccac

SEQ ID NO: 1898716 - RNA, 22 nt, Homo sapiens
ggugcuuauuaagaccaaagac

SEQ ID NO: 1898717 - RNA, 11 nt, Homo sapiens
agccagacucu

SEQ ID NO: 1898718 - RNA, 22 nt, Homo sapiens
ugccugugcagcgggugcugcu

SEQ ID NO: 1898719 - RNA, 17 nt, Homo sapiens
auacauaugaggacaag

SEQ ID NO: 1898720 - RNA, 15 nt, Homo sapiens
aggccgugugucugu

SEQ ID NO: 1898721 - RNA, 12 nt, Homo sapiens
agauagcucucu

SEQ ID NO: 1898722 - RNA, 22 nt, Homo sapiens
accgcccaucaggguucucuua

SEQ ID NO: 1898723 - RNA, 13 nt, Homo sapiens
uccuccacuggaa

SEQ ID NO: 1898724 - RNA, 15 nt, Homo sapiens
augaucagacauaca

SEQ ID NO: 1898725 - RNA, 17 nt, Homo sapiens
augugaaaauguauucu

SEQ ID NO: 1898726 - RNA, 18 nt, Homo sapiens
ugucauguaacacgacau

SEQ ID NO: 1898727 - RNA, 14 nt, Homo sapiens
ucuacuguuauuau

SEQ ID NO: 1898728 - RNA, 15 nt, Homo sapiens
caauugacuuccucc

SEQ ID NO: 1898729 - RNA, 15 nt, Homo sapiens
cugccauuacucugc

SEQ ID NO: 1898730 - RNA, 16 nt, Homo sapiens
caacauuguagccuca

SEQ ID NO: 1898731 - RNA, 19 nt, Homo sapiens
uagaaugagugaaucaccu

SEQ ID NO: 1898732 - RNA, 19 nt, Homo sapiens
uaucaaggugcuuuuggca

SEQ ID NO: 1898733 - RNA, 13 nt, Homo sapiens
uaguaacugcugu

SEQ ID NO: 1898734 - RNA, 22 nt, Homo sapiens
ccuuuucucacaaaaaggcaaa

SEQ ID NO: 1898735 - RNA, 22 nt, Homo sapiens
cacaagauggaaaucacauuua

SEQ ID NO: 1898736 - RNA, 13 nt, Homo sapiens
acugaaaaugcau

SEQ ID NO: 1898737 - RNA, 19 nt, Homo sapiens
auucuuccucaaagcauuu

SEQ ID NO: 1898738 - RNA, 19 nt, Homo sapiens
gagcucacccaugugcaca

SEQ ID NO: 1898739 - RNA, 19 nt, Homo sapiens
gccauagcuugauugcuca

SEQ ID NO: 1898740 - RNA, 19 nt, Homo sapiens
aggaagccaggcugaguga

SEQ ID NO: 1898741 - RNA, 14 nt, Homo sapiens
acugccugcuccca

SEQ ID NO: 1898742 - RNA, 13 nt, Homo sapiens
cagaggcuuccag

SEQ ID NO: 1898743 - RNA, 20 nt, Homo sapiens
uccugcugccucccuuucau

SEQ ID NO: 1898744 - RNA, 15 nt, Homo sapiens
agaauauucuucuaa

SEQ ID NO: 1898745 - RNA, 15 nt, Homo sapiens
cucucuccacccuau

SEQ ID NO: 1898746 - RNA, 20 nt, Homo sapiens
guuaauuuuuccaacuacua

SEQ ID NO: 1898747 - RNA, 22 nt, Homo sapiens
caguacauucccaucuacuaaa

SEQ ID NO: 1898748 - RNA, 13 nt, Homo sapiens
gaccugcccuccc

SEQ ID NO: 1898749 - RNA, 21 nt, Homo sapiens
cugaagcccucccagguguua

SEQ ID NO: 1898750 - RNA, 20 nt, Homo sapiens
gccccaacaagcaccccgcu

SEQ ID NO: 1898751 - RNA, 21 nt, Homo sapiens
auauuaagcaaacacuugaag

SEQ ID NO: 1898752 - RNA, 12 nt, Homo sapiens
aaaaaaccacaa

SEQ ID NO: 1898753 - RNA, 12 nt, Homo sapiens
aaugaaccacug

SEQ ID NO: 1898754 - RNA, 18 nt, Homo sapiens
gugcauuuguuuguauac

SEQ ID NO: 1898755 - RNA, 20 nt, Homo sapiens
cuccuaaguuuaauuacaac

SEQ ID NO: 1898756 - RNA, 14 nt, Homo sapiens
gcaagaugaaacag

SEQ ID NO: 1898757 - RNA, 17 nt, Homo sapiens
gugcuuguuagcuguuu

SEQ ID NO: 1898758 - RNA, 23 nt, Homo sapiens
ggcacgaggccaggcagauccca

SEQ ID NO: 1898759 - RNA, 15 nt, Homo sapiens
uucucacacacuggc

SEQ ID NO: 1898760 - RNA, 15 nt, Homo sapiens
cacaguuucuuccau

SEQ ID NO: 1898761 - RNA, 23 nt, Homo sapiens
agcacuuuaacccucucuucccu

SEQ ID NO: 1898762 - RNA, 22 nt, Homo sapiens
cccacgucccgggcacugucau

SEQ ID NO: 1898763 - RNA, 22 nt, Homo sapiens
gcucacugcccaugaugcagag

SEQ ID NO: 1898764 - RNA, 15 nt, Homo sapiens
agagggaugagacag

SEQ ID NO: 1898765 - RNA, 16 nt, Homo sapiens
accucaggccacaucu

SEQ ID NO: 1898766 - RNA, 15 nt, Homo sapiens
agucagccuacauaa

SEQ ID NO: 1898767 - RNA, 17 nt, Homo sapiens
agugccuuuugguggag

SEQ ID NO: 1898768 - RNA, 22 nt, Homo sapiens
gugguuuuguuuguuucuuuga

SEQ ID NO: 1898769 - RNA, 17 nt, Homo sapiens
uucuggaagucaucuca

SEQ ID NO: 1898770 - RNA, 19 nt, Homo sapiens
auaaaguacuaaaucucac

SEQ ID NO: 1898771 - RNA, 16 nt, Homo sapiens
aggucuaaucagugau

SEQ ID NO: 1898772 - RNA, 21 nt, Homo sapiens
caggaucaaugaccccuguaa

SEQ ID NO: 1898773 - RNA, 12 nt, Homo sapiens
aauuauaacuua

SEQ ID NO: 1898774 - RNA, 19 nt, Homo sapiens
ugucccaccaacucugcac

SEQ ID NO: 1898775 - RNA, 16 nt, Homo sapiens
cccugcagucacagcu

SEQ ID NO: 1898776 - RNA, 11 nt, Homo sapiens
agaagcaaaau

SEQ ID NO: 1898777 - RNA, 14 nt, Homo sapiens
ucgauguggucaca

SEQ ID NO: 1898778 - RNA, 17 nt, Homo sapiens
gaaauuaagacuuuaug

SEQ ID NO: 1898779 - RNA, 17 nt, Homo sapiens
cacuuucugaaauucac

SEQ ID NO: 1898780 - RNA, 18 nt, Homo sapiens
ugcucucugugucugaga

SEQ ID NO: 1898781 - RNA, 15 nt, Homo sapiens
ggugucaaccagaga

SEQ ID NO: 1898782 - RNA, 12 nt, Homo sapiens
ccagcacuucca

SEQ ID NO: 1898783 - RNA, 23 nt, Homo sapiens
cauugaugagcaagacauacuua

SEQ ID NO: 1898784 - RNA, 22 nt, Homo sapiens
aagagcagccuggggccaagca

SEQ ID NO: 1898785 - RNA, 14 nt, Homo sapiens
acuacaaugauggu

SEQ ID NO: 1898786 - RNA, 12 nt, Homo sapiens
ucucgagugagu

SEQ ID NO: 1898787 - RNA, 17 nt, Homo sapiens
ucaggcaaagugcugcu

SEQ ID NO: 1898788 - RNA, 19 nt, Homo sapiens
uuaucagaguaacgagaag

SEQ ID NO: 1898789 - RNA, 20 nt, Homo sapiens
aauccuguccucagcuucuu

SEQ ID NO: 1898790 - RNA, 17 nt, Homo sapiens
uaaucacaaauuucacu

SEQ ID NO: 1898791 - RNA, 17 nt, Homo sapiens
uuucauauaaaaaagac

SEQ ID NO: 1898792 - RNA, 19 nt, Homo sapiens
auugaagaugugaucaaua

SEQ ID NO: 1898793 - RNA, 14 nt, Homo sapiens
gcaaaaagaccaag

SEQ ID NO: 1898794 - RNA, 21 nt, Homo sapiens
cuuugagcacacuuuacacaa

SEQ ID NO: 1898795 - RNA, 15 nt, Homo sapiens
agcaagccagaccua

SEQ ID NO: 1898796 - RNA, 18 nt, Homo sapiens
gguucugggacccacucc

SEQ ID NO: 1898797 - RNA, 20 nt, Homo sapiens
uaaucuuauuuuggcauucu

SEQ ID NO: 1898798 - RNA, 16 nt, Homo sapiens
aauauucauugguuaa

SEQ ID NO: 1898799 - RNA, 17 nt, Homo sapiens
gcccccgcucaugggcc

SEQ ID NO: 1898800 - RNA, 16 nt, Homo sapiens
ucauugcuguaccaca

SEQ ID NO: 1898801 - RNA, 18 nt, Homo sapiens
auuagaacuucaagcucu

SEQ ID NO: 1898802 - RNA, 12 nt, Homo sapiens
aauggcaucucg

SEQ ID NO: 1898803 - RNA, 20 nt, Homo sapiens
aggacucuggacaaucucac

SEQ ID NO: 1898804 - RNA, 12 nt, Homo sapiens
gacaacugugaa

SEQ ID NO: 1898805 - RNA, 12 nt, Homo sapiens
ugccacuggaac

SEQ ID NO: 1898806 - RNA, 15 nt, Homo sapiens
ugaaugcacaugacu

SEQ ID NO: 1898807 - RNA, 17 nt, Homo sapiens
cugagggucuggugcca

SEQ ID NO: 1898808 - RNA, 15 nt, Homo sapiens
gaggacuaugccaug

SEQ ID NO: 1898809 - RNA, 14 nt, Homo sapiens
aagcacaugaucau

SEQ ID NO: 1898810 - RNA, 13 nt, Homo sapiens
ccguugcugccag

SEQ ID NO: 1898811 - RNA, 16 nt, Homo sapiens
gcagaguucuauaaug

SEQ ID NO: 1898812 - RNA, 15 nt, Homo sapiens
gauggcuuaagccug

SEQ ID NO: 1898813 - RNA, 23 nt, Homo sapiens
gauaagcacuagaucucccuuaa

SEQ ID NO: 1898814 - RNA, 14 nt, Homo sapiens
aauguaaaaauugg

SEQ ID NO: 1898815 - RNA, 12 nt, Homo sapiens
guaccuggugac

SEQ ID NO: 1898816 - RNA, 21 nt, Homo sapiens
gcauuugucaaugacaguuuc

SEQ ID NO: 1898817 - RNA, 23 nt, Homo sapiens
acggccugccugcaaaccugcug

SEQ ID NO: 1898818 - RNA, 21 nt, Homo sapiens
uaagaagcugugaauauuccu

SEQ ID NO: 1898819 - RNA, 17 nt, Homo sapiens
cagccccagcaccucau

SEQ ID NO: 1898820 - RNA, 20 nt, Homo sapiens
gcauacuuucccucauccau

SEQ ID NO: 1898821 - RNA, 21 nt, Homo sapiens
cagccuggcuaacauggugaa

SEQ ID NO: 1898822 - RNA, 19 nt, Homo sapiens
uacaaaaugaauugccuuu

SEQ ID NO: 1898823 - RNA, 21 nt, Homo sapiens
auagauaaauuuugacuugaa

SEQ ID NO: 1898824 - RNA, 23 nt, Homo sapiens
agucuaucaaccccagacacugg

SEQ ID NO: 1898825 - RNA, 15 nt, Homo sapiens
uugagcgugauucug

SEQ ID NO: 1898826 - RNA, 19 nt, Homo sapiens
gagugacggaccagcucac

SEQ ID NO: 1898827 - RNA, 20 nt, Homo sapiens
cuuaagcuuccgccgucuca

SEQ ID NO: 1898828 - RNA, 22 nt, Homo sapiens
cgauguucuguacaacuuaacu

SEQ ID NO: 1898829 - RNA, 20 nt, Homo sapiens
uucugccuuugccaggugac

SEQ ID NO: 1898830 - RNA, 20 nt, Homo sapiens
aucuauaacaaaugcuuuau

SEQ ID NO: 1898831 - RNA, 20 nt, Homo sapiens
agcuacucaggagguugagg

SEQ ID NO: 1898832 - RNA, 14 nt, Homo sapiens
cccauguacauaau

SEQ ID NO: 1898833 - RNA, 18 nt, Homo sapiens
cagggccuggagccccau

SEQ ID NO: 1898834 - RNA, 16 nt, Homo sapiens
uacaauuuagcuuaau

SEQ ID NO: 1898835 - RNA, 15 nt, Homo sapiens
aaauuuaaaugacau

SEQ ID NO: 1898836 - RNA, 22 nt, Homo sapiens
auaucuagcccaaagccuucau

SEQ ID NO: 1898837 - RNA, 22 nt, Homo sapiens
aagaugagggugucggcuguga

SEQ ID NO: 1898838 - RNA, 22 nt, Homo sapiens
gaucacgccauuguacuccagc

SEQ ID NO: 1898839 - RNA, 17 nt, Homo sapiens
gaccuuucagcugugaa

SEQ ID NO: 1898840 - RNA, 20 nt, Homo sapiens
cauuagacacacauauacau

SEQ ID NO: 1898841 - RNA, 14 nt, Homo sapiens
aacuaccaucugau

SEQ ID NO: 1898842 - RNA, 12 nt, Homo sapiens
cuuguugacuca

SEQ ID NO: 1898843 - RNA, 20 nt, Homo sapiens
guucugaguaaguguguuca

SEQ ID NO: 1898844 - RNA, 15 nt, Homo sapiens
aaguagaauaguggu

SEQ ID NO: 1898845 - RNA, 21 nt, Homo sapiens
ccuauuagggaguuaugcaaa

SEQ ID NO: 1898846 - RNA, 21 nt, Homo sapiens
accuugacuugaaaugcucuu

SEQ ID NO: 1898847 - RNA, 14 nt, Homo sapiens
gcaugaacauguac

SEQ ID NO: 1898848 - RNA, 13 nt, Homo sapiens
cggucggggacuu

SEQ ID NO: 1898849 - RNA, 13 nt, Homo sapiens
ccacguucaggga

SEQ ID NO: 1898850 - RNA, 13 nt, Homo sapiens
gagcccacuucca

SEQ ID NO: 1898851 - RNA, 21 nt, Homo sapiens
ugcuuccgugcugaacuuuag

SEQ ID NO: 1898852 - RNA, 21 nt, Homo sapiens
uuguuaauacuauauugcugu

SEQ ID NO: 1898853 - RNA, 18 nt, Homo sapiens
ucuccccagagcauuuga

SEQ ID NO: 1898854 - RNA, 19 nt, Homo sapiens
uauugccuguguuugccac

SEQ ID NO: 1898855 - RNA, 19 nt, Homo sapiens
cugaaggagccccauuccu

SEQ ID NO: 1898856 - RNA, 19 nt, Homo sapiens
ugucuccuuucugacuguc

SEQ ID NO: 1898857 - RNA, 15 nt, Homo sapiens
agaaaaauauuauaa

SEQ ID NO: 1898858 - RNA, 21 nt, Homo sapiens
cucucuugccccuuguccuga

SEQ ID NO: 1898859 - RNA, 16 nt, Homo sapiens
gcacugagcagggauc

SEQ ID NO: 1898860 - RNA, 22 nt, Homo sapiens
gcacaagcuuguauauacauau

SEQ ID NO: 1898861 - RNA, 19 nt, Homo sapiens
aacccucagaaacacuggg

SEQ ID NO: 1898862 - RNA, 14 nt, Homo sapiens
uuaaaacaugauga

SEQ ID NO: 1898863 - RNA, 16 nt, Homo sapiens
ucagugccccauucuc

SEQ ID NO: 1898864 - RNA, 19 nt, Homo sapiens
uaaaaauaagccacauauc

SEQ ID NO: 1898865 - RNA, 21 nt, Homo sapiens
auguauucuaauuggcagauu

SEQ ID NO: 1898866 - RNA, 14 nt, Homo sapiens
aggacuaaggccuc

SEQ ID NO: 1898867 - RNA, 20 nt, Homo sapiens
uguaaauguguuagcacuga

SEQ ID NO: 1898868 - RNA, 14 nt, Homo sapiens
agcugcuacaaaga

SEQ ID NO: 1898869 - RNA, 14 nt, Homo sapiens
cgggaccccgagcc

SEQ ID NO: 1898870 - RNA, 17 nt, Homo sapiens
caucauucucugucuca

SEQ ID NO: 1898871 - RNA, 13 nt, Homo sapiens
cucucuaauucag

SEQ ID NO: 1898872 - RNA, 13 nt, Homo sapiens
cacaguaauacuc

SEQ ID NO: 1898873 - RNA, 16 nt, Homo sapiens
cagauggcagcaguga

SEQ ID NO: 1898874 - RNA, 16 nt, Homo sapiens
cagaucaagcugugag

SEQ ID NO: 1898875 - RNA, 22 nt, Homo sapiens
caggugaggucagcacaucuca

SEQ ID NO: 1898876 - RNA, 14 nt, Homo sapiens
aaacaaggaagcca

SEQ ID NO: 1898877 - RNA, 13 nt, Homo sapiens
auuaaaacaaauc

SEQ ID NO: 1898878 - RNA, 17 nt, Homo sapiens
ccuaagucucugugaau

SEQ ID NO: 1898879 - RNA, 14 nt, Homo sapiens
ccaauauuguaauc

SEQ ID NO: 1898880 - RNA, 13 nt, Homo sapiens
agaaacaguucca

SEQ ID NO: 1898881 - RNA, 22 nt, Homo sapiens
caggcuggagugcaguggcaca

SEQ ID NO: 1898882 - RNA, 18 nt, Homo sapiens
ccaagacaugacauucuu

SEQ ID NO: 1898883 - RNA, 21 nt, Homo sapiens
uuaugaaaauauagacauucu

SEQ ID NO: 1898884 - RNA, 13 nt, Homo sapiens
ucugaacagcuau

SEQ ID NO: 1898885 - RNA, 22 nt, Homo sapiens
aaugagucugcuuucacuguga

SEQ ID NO: 1898886 - RNA, 17 nt, Homo sapiens
cauugcuugugccacac

SEQ ID NO: 1898887 - RNA, 18 nt, Homo sapiens
acuagguuguccauuuau

SEQ ID NO: 1898888 - RNA, 24 nt, Homo sapiens
ucauaccguguaccucaguucccu

SEQ ID NO: 1898889 - RNA, 18 nt, Homo sapiens
aacccuggugguugcugu

SEQ ID NO: 1898890 - RNA, 14 nt, Homo sapiens
gccucagcuucuca

SEQ ID NO: 1898891 - RNA, 18 nt, Homo sapiens
aauauuuuaagaauuuca

SEQ ID NO: 1898892 - RNA, 20 nt, Homo sapiens
gcucugggggacccaggugg

SEQ ID NO: 1898893 - RNA, 17 nt, Homo sapiens
acauuucagaaauucca

SEQ ID NO: 1898894 - RNA, 17 nt, Homo sapiens
ucuaagguaaaaccauc

SEQ ID NO: 1898895 - RNA, 19 nt, Homo sapiens
cagcccuuccucccauuuc

SEQ ID NO: 1898896 - RNA, 15 nt, Homo sapiens
aauccaagccuaaaa

SEQ ID NO: 1898897 - RNA, 16 nt, Homo sapiens
cuggcgagaauacagc

SEQ ID NO: 1898898 - RNA, 12 nt, Homo sapiens
aauaauccauuu

SEQ ID NO: 1898899 - RNA, 23 nt, Homo sapiens
auucagcguuauuuaagcacaua

SEQ ID NO: 1898900 - RNA, 15 nt, Homo sapiens
cagacagauugcuga

SEQ ID NO: 1898901 - RNA, 19 nt, Homo sapiens
aaccgaacaugaccaaaaa

SEQ ID NO: 1898902 - RNA, 22 nt, Homo sapiens
caacuaaacaaggcauucagca

SEQ ID NO: 1898903 - RNA, 18 nt, Homo sapiens
ccguuaaauaauucccua

SEQ ID NO: 1898904 - RNA, 13 nt, Homo sapiens
aauguaaaaugca

SEQ ID NO: 1898905 - RNA, 22 nt, Homo sapiens
ucagacaauuuauccaaagcau

SEQ ID NO: 1898906 - RNA, 13 nt, Homo sapiens
uuccgagugcaga

SEQ ID NO: 1898907 - RNA, 13 nt, Homo sapiens
gugggaccccagg

SEQ ID NO: 1898908 - RNA, 21 nt, Homo sapiens
cuaagcacagaucuaccuugg

SEQ ID NO: 1898909 - RNA, 13 nt, Homo sapiens
ugugucccaaaaa

SEQ ID NO: 1898910 - RNA, 19 nt, Homo sapiens
ucaguacgagcugcucuaa

SEQ ID NO: 1898911 - RNA, 21 nt, Homo sapiens
uucauaaaaauaaccaaaaaa

SEQ ID NO: 1898912 - RNA, 16 nt, Homo sapiens
gccuugguauagcaua

SEQ ID NO: 1898913 - RNA, 15 nt, Homo sapiens
aacuauuaaggccuu

SEQ ID NO: 1898914 - RNA, 21 nt, Homo sapiens
acuaaaaaaccaacaauguga

SEQ ID NO: 1898915 - RNA, 13 nt, Homo sapiens
uuaucuuuaccaa

SEQ ID NO: 1898916 - RNA, 14 nt, Homo sapiens
aucugggacugugc

SEQ ID NO: 1898917 - RNA, 15 nt, Homo sapiens
acugaaacagccaga

SEQ ID NO: 1898918 - RNA, 14 nt, Homo sapiens
agaccuggacacag

SEQ ID NO: 1898919 - RNA, 15 nt, Homo sapiens
agcagcaucuucaaa

SEQ ID NO: 1898920 - RNA, 21 nt, Homo sapiens
ccagcuccaaccugcaaagau

SEQ ID NO: 1898921 - RNA, 13 nt, Homo sapiens
aggucagcacaag

SEQ ID NO: 1898922 - RNA, 23 nt, Homo sapiens
aggaugaucaaaaauaaugcauc

SEQ ID NO: 1898923 - RNA, 22 nt, Homo sapiens
aggguggcacucaacucugagc

SEQ ID NO: 1898924 - RNA, 21 nt, Homo sapiens
auucucuaggagaaacuuaga

SEQ ID NO: 1898925 - RNA, 23 nt, Homo sapiens
caaccuguuuuggucacaucacu

SEQ ID NO: 1898926 - RNA, 19 nt, Homo sapiens
aucuucuuuggacuucuga

SEQ ID NO: 1898927 - RNA, 18 nt, Homo sapiens
guacaggaaggugccugg

SEQ ID NO: 1898928 - RNA, 17 nt, Homo sapiens
aguccauaacuuaccuc

SEQ ID NO: 1898929 - RNA, 14 nt, Homo sapiens
cuuuuccaaugaug

SEQ ID NO: 1898930 - RNA, 19 nt, Homo sapiens
ccuuauaagagauucacuc

SEQ ID NO: 1898931 - RNA, 19 nt, Homo sapiens
cauucuuuuaaaagacaag

SEQ ID NO: 1898932 - RNA, 16 nt, Homo sapiens
ugaccuguuauuacca

SEQ ID NO: 1898933 - RNA, 13 nt, Homo sapiens
ccugcucugccca

SEQ ID NO: 1898934 - RNA, 16 nt, Homo sapiens
caucccuuguuuauaa

SEQ ID NO: 1898935 - RNA, 14 nt, Homo sapiens
uuucuuuaucauug

SEQ ID NO: 1898936 - RNA, 15 nt, Homo sapiens
acaguaaccuuucaa

SEQ ID NO: 1898937 - RNA, 15 nt, Homo sapiens
agagaaaagaaacca

SEQ ID NO: 1898938 - RNA, 20 nt, Homo sapiens
cuuccaucagcucucugcaa

SEQ ID NO: 1898939 - RNA, 18 nt, Homo sapiens
ugcugcccagcgcugggg

SEQ ID NO: 1898940 - RNA, 21 nt, Homo sapiens
agcccugggaaccacucccac

SEQ ID NO: 1898941 - RNA, 19 nt, Homo sapiens
ugcugagugaaugaacaaa

SEQ ID NO: 1898942 - RNA, 18 nt, Homo sapiens
gauuacaggugugcacca

SEQ ID NO: 1898943 - RNA, 23 nt, Homo sapiens
ugcacaggcagauguuugccuca

SEQ ID NO: 1898944 - RNA, 17 nt, Homo sapiens
gaaaauaaaagcacuua

SEQ ID NO: 1898945 - RNA, 16 nt, Homo sapiens
uggaguauuggggucu

SEQ ID NO: 1898946 - RNA, 22 nt, Homo sapiens
cauccugaaaaggguguugcua

SEQ ID NO: 1898947 - RNA, 23 nt, Homo sapiens
uuguauaagaagauacacugcag

SEQ ID NO: 1898948 - RNA, 17 nt, Homo sapiens
gguguaaacacugaugg

SEQ ID NO: 1898949 - RNA, 16 nt, Homo sapiens
ccacaagccugaauuu

SEQ ID NO: 1898950 - RNA, 15 nt, Homo sapiens
cacucaccccagcga

SEQ ID NO: 1898951 - RNA, 21 nt, Homo sapiens
ggaguuaccuuaaacugugua

SEQ ID NO: 1898952 - RNA, 13 nt, Homo sapiens
uguauaugcauuc

SEQ ID NO: 1898953 - RNA, 14 nt, Homo sapiens
ucucuuacaaucug

SEQ ID NO: 1898954 - RNA, 23 nt, Homo sapiens
cagaaacacacagucacauucga

SEQ ID NO: 1898955 - RNA, 20 nt, Homo sapiens
caaauauauuucaagcuaua

SEQ ID NO: 1898956 - RNA, 21 nt, Homo sapiens
agaaaugauguugucacuggu

SEQ ID NO: 1898957 - RNA, 18 nt, Homo sapiens
acgcuuuaugcccuugcc

SEQ ID NO: 1898958 - RNA, 16 nt, Homo sapiens
acugccacagaacugg

SEQ ID NO: 1898959 - RNA, 19 nt, Homo sapiens
gaauuuucagucaucucau

SEQ ID NO: 1898960 - RNA, 14 nt, Homo sapiens
acacugugcuauaa

SEQ ID NO: 1898961 - RNA, 16 nt, Homo sapiens
agagcccaaagagcuc

SEQ ID NO: 1898962 - RNA, 15 nt, Homo sapiens
cacagagcacuguag

SEQ ID NO: 1898963 - RNA, 19 nt, Homo sapiens
uugcacauaacaugcuuua

SEQ ID NO: 1898964 - RNA, 21 nt, Homo sapiens
gucaccuuccucugccuuugu

SEQ ID NO: 1898965 - RNA, 14 nt, Homo sapiens
cuaauaaaauauca

SEQ ID NO: 1898966 - RNA, 18 nt, Homo sapiens
ucaccucuccaggugcuc

SEQ ID NO: 1898967 - RNA, 18 nt, Homo sapiens
uggacaguuuuaagcaga

SEQ ID NO: 1898968 - RNA, 16 nt, Homo sapiens
uccugauuaggaauau

SEQ ID NO: 1898969 - RNA, 15 nt, Homo sapiens
cucaggcagaucuca

SEQ ID NO: 1898970 - RNA, 19 nt, Homo sapiens
ugccacacccuccccauuc

SEQ ID NO: 1898971 - RNA, 18 nt, Homo sapiens
gaaagcaaguguucacaa

SEQ ID NO: 1898972 - RNA, 16 nt, Homo sapiens
caggcucagaucucau

SEQ ID NO: 1898973 - RNA, 13 nt, Homo sapiens
ugaacguggaauu

SEQ ID NO: 1898974 - RNA, 18 nt, Homo sapiens
agugcagcaaggagaagg

SEQ ID NO: 1898975 - RNA, 20 nt, Homo sapiens
auguggaccucuacuuucca

SEQ ID NO: 1898976 - RNA, 16 nt, Homo sapiens
acucaucacacuucau

SEQ ID NO: 1898977 - RNA, 16 nt, Homo sapiens
gaaaacagaugaccau

SEQ ID NO: 1898978 - RNA, 11 nt, Homo sapiens
acagaagggac

SEQ ID NO: 1898979 - RNA, 14 nt, Homo sapiens
agacauugcucuca

SEQ ID NO: 1898980 - RNA, 18 nt, Homo sapiens
accgugaagauacuuugu

SEQ ID NO: 1898981 - RNA, 13 nt, Homo sapiens
acauaucaaauag

SEQ ID NO: 1898982 - RNA, 14 nt, Homo sapiens
uucccaaauguauu

SEQ ID NO: 1898983 - RNA, 14 nt, Homo sapiens
agccuaaaauuacu

SEQ ID NO: 1898984 - RNA, 18 nt, Homo sapiens
ucuaaaucugagaucucc

SEQ ID NO: 1898985 - RNA, 18 nt, Homo sapiens
gcauagcagaggggccag

SEQ ID NO: 1898986 - RNA, 16 nt, Homo sapiens
aaaaucaaacagagac

SEQ ID NO: 1898987 - RNA, 17 nt, Homo sapiens
ucuuuuuguacuuugga

SEQ ID NO: 1898988 - RNA, 21 nt, Homo sapiens
guccacacugaagaacauguc

SEQ ID NO: 1898989 - RNA, 20 nt, Homo sapiens
ucugagacuccucauaccuc

SEQ ID NO: 1898990 - RNA, 20 nt, Homo sapiens
uggccaggccaggggacccc

SEQ ID NO: 1898991 - RNA, 15 nt, Homo sapiens
uaagagcaauucaaa

SEQ ID NO: 1898992 - RNA, 15 nt, Homo sapiens
aaacugaauuuguac

SEQ ID NO: 1898993 - RNA, 11 nt, Homo sapiens
uggcucuguca

SEQ ID NO: 1898994 - RNA, 19 nt, Homo sapiens
uaaucuucuuaugcaauuu

SEQ ID NO: 1898995 - RNA, 17 nt, Homo sapiens
cagaguccucuaugaac

SEQ ID NO: 1898996 - RNA, 22 nt, Homo sapiens
ucuuacaauaauucuaugagau

SEQ ID NO: 1898997 - RNA, 16 nt, Homo sapiens
uuauaaauccaaagua

SEQ ID NO: 1898998 - RNA, 20 nt, Homo sapiens
uguaaaauaaguauuuccau

SEQ ID NO: 1898999 - RNA, 15 nt, Homo sapiens
aguuuucaugugcuc

SEQ ID NO: 1899000 - RNA, 15 nt, Homo sapiens
aauggcacugagaaa

SEQ ID NO: 1899001 - RNA, 23 nt, Homo sapiens
augacgccugauggugcugcuca

SEQ ID NO: 1899002 - RNA, 15 nt, Homo sapiens
acagcugacauggag

SEQ ID NO: 1899003 - RNA, 15 nt, Homo sapiens
acagcuaacauggaa

SEQ ID NO: 1899004 - RNA, 15 nt, Homo sapiens
acaucugcauuuuca

SEQ ID NO: 1899005 - RNA, 21 nt, Homo sapiens
accaauaauggggcagacaca

SEQ ID NO: 1899006 - RNA, 20 nt, Homo sapiens
aagcccuccaaaagcacuua

SEQ ID NO: 1899007 - RNA, 16 nt, Homo sapiens
uaggcuuaucagggag

SEQ ID NO: 1899008 - RNA, 22 nt, Homo sapiens
gcccguuuuaccaauaaacuga

SEQ ID NO: 1899009 - RNA, 16 nt, Homo sapiens
caccugccgcaugcuc

SEQ ID NO: 1899010 - RNA, 16 nt, Homo sapiens
uuuguagccagguacu

SEQ ID NO: 1899011 - RNA, 18 nt, Homo sapiens
ucacugacucugacucau

SEQ ID NO: 1899012 - RNA, 14 nt, Homo sapiens
cugcaguaaucucc

SEQ ID NO: 1899013 - RNA, 21 nt, Homo sapiens
cauaauggacucuguggugcc

SEQ ID NO: 1899014 - RNA, 12 nt, Homo sapiens
accugcaaaaaa

SEQ ID NO: 1899015 - RNA, 14 nt, Homo sapiens
aguauauauagaau

SEQ ID NO: 1899016 - RNA, 14 nt, Homo sapiens
uaccugccucagcc

SEQ ID NO: 1899017 - RNA, 15 nt, Homo sapiens
caugaaaaauaaucc

SEQ ID NO: 1899018 - RNA, 15 nt, Homo sapiens
aucaaggagugaagu

SEQ ID NO: 1899019 - RNA, 22 nt, Homo sapiens
gaaacagcggcuccacuaaaga

SEQ ID NO: 1899020 - RNA, 12 nt, Homo sapiens
cacaguguccca

SEQ ID NO: 1899021 - RNA, 13 nt, Homo sapiens
uauagcugcauuu

SEQ ID NO: 1899022 - RNA, 19 nt, Homo sapiens
guucaccuauuucaaaaau

SEQ ID NO: 1899023 - RNA, 17 nt, Homo sapiens
uaggaguugaguacagu

SEQ ID NO: 1899024 - RNA, 11 nt, Homo sapiens
gcccucaggag

SEQ ID NO: 1899025 - RNA, 15 nt, Homo sapiens
aguagccaacagcga

SEQ ID NO: 1899026 - RNA, 16 nt, Homo sapiens
cuaaaccaaguuauuu

SEQ ID NO: 1899027 - RNA, 15 nt, Homo sapiens
gaaaugcauuuugcu

SEQ ID NO: 1899028 - RNA, 15 nt, Homo sapiens
uaaaggcaguuuucu

SEQ ID NO: 1899029 - RNA, 20 nt, Homo sapiens
ugcacagauaaguaggccau

SEQ ID NO: 1899030 - RNA, 13 nt, Homo sapiens
ugggaagucucag

SEQ ID NO: 1899031 - RNA, 15 nt, Homo sapiens
ccaaguugaaaucag

SEQ ID NO: 1899032 - RNA, 18 nt, Homo sapiens
acuauaauguaagcucua

SEQ ID NO: 1899033 - RNA, 16 nt, Homo sapiens
auuacuacacuggugu

SEQ ID NO: 1899034 - RNA, 18 nt, Homo sapiens
auaaaaucaaacagagac

SEQ ID NO: 1899035 - RNA, 18 nt, Homo sapiens
gaauuguucuaaauggaa

SEQ ID NO: 1899036 - RNA, 21 nt, Homo sapiens
gagguaccuuuccacccagac

SEQ ID NO: 1899037 - RNA, 18 nt, Homo sapiens
ucuguuauguacuguacu

SEQ ID NO: 1899038 - RNA, 15 nt, Homo sapiens
aguauucaucugugu

SEQ ID NO: 1899039 - RNA, 15 nt, Homo sapiens
aggauuaaaagccau

SEQ ID NO: 1899040 - RNA, 16 nt, Homo sapiens
cacgaacugaaaugag

SEQ ID NO: 1899041 - RNA, 15 nt, Homo sapiens
ucuaauuggcagauu

SEQ ID NO: 1899042 - RNA, 15 nt, Homo sapiens
uguagcaacaugaga

SEQ ID NO: 1899043 - RNA, 16 nt, Homo sapiens
uggagaggacagagca

SEQ ID NO: 1899044 - RNA, 18 nt, Homo sapiens
cuacuguaauuugugaua

SEQ ID NO: 1899045 - RNA, 17 nt, Homo sapiens
uucugaggucccugugu

SEQ ID NO: 1899046 - RNA, 13 nt, Homo sapiens
agggagcuuccug

SEQ ID NO: 1899047 - RNA, 15 nt, Homo sapiens
cuggaaggacaucua

SEQ ID NO: 1899048 - RNA, 19 nt, Homo sapiens
uauuugcuuaaaauuguga

SEQ ID NO: 1899049 - RNA, 20 nt, Homo sapiens
caaagcaguguugguugcuu

SEQ ID NO: 1899050 - RNA, 18 nt, Homo sapiens
cuaaugagggugugagaa

SEQ ID NO: 1899051 - RNA, 16 nt, Homo sapiens
guucauuaaguucuga

SEQ ID NO: 1899052 - RNA, 16 nt, Homo sapiens
gauauuaauaauucca

SEQ ID NO: 1899053 - RNA, 17 nt, Homo sapiens
caggggaccagagggau

SEQ ID NO: 1899054 - RNA, 13 nt, Homo sapiens
uaguauagcuuua

SEQ ID NO: 1899055 - RNA, 22 nt, Homo sapiens
agguucucuuccuggcaucaua

SEQ ID NO: 1899056 - RNA, 16 nt, Homo sapiens
uaugcauucauccaac

SEQ ID NO: 1899057 - RNA, 15 nt, Homo sapiens
cuggcucacagccac

SEQ ID NO: 1899058 - RNA, 15 nt, Homo sapiens
cuucuauacauguuu

SEQ ID NO: 1899059 - RNA, 21 nt, Homo sapiens
gaaagcaaguguucacaacag

SEQ ID NO: 1899060 - RNA, 12 nt, Homo sapiens
uuuuaucucaca

SEQ ID NO: 1899061 - RNA, 21 nt, Homo sapiens
ucugcuuuaauggcuuuacaa

SEQ ID NO: 1899062 - RNA, 17 nt, Homo sapiens
acagcuuauuauccaau

SEQ ID NO: 1899063 - RNA, 18 nt, Homo sapiens
gguggcuaagggggacca

SEQ ID NO: 1899064 - RNA, 14 nt, Homo sapiens
ggagauaccagaga

SEQ ID NO: 1899065 - RNA, 14 nt, Homo sapiens
aggccucaguggac

SEQ ID NO: 1899066 - RNA, 19 nt, Homo sapiens
agcugcccuggcugugaug

SEQ ID NO: 1899067 - RNA, 13 nt, Homo sapiens
aaauuacugauau

SEQ ID NO: 1899068 - RNA, 19 nt, Homo sapiens
aaagacccaacuugccaaa

SEQ ID NO: 1899069 - RNA, 13 nt, Homo sapiens
guggcucuugccu

SEQ ID NO: 1899070 - RNA, 22 nt, Homo sapiens
ccagguugggggcaguguugug

SEQ ID NO: 1899071 - RNA, 14 nt, Homo sapiens
augcaaccucugcc

SEQ ID NO: 1899072 - RNA, 18 nt, Homo sapiens
ucuaauggcuguggcauu

SEQ ID NO: 1899073 - RNA, 21 nt, Homo sapiens
cugccuguuccucccaagagg

SEQ ID NO: 1899074 - RNA, 23 nt, Homo sapiens
uccugccugggugggacagccuc

SEQ ID NO: 1899075 - RNA, 18 nt, Homo sapiens
ggacaauggguggugaau

SEQ ID NO: 1899076 - RNA, 20 nt, Homo sapiens
gcuucuucaauggcaccuuc

SEQ ID NO: 1899077 - RNA, 21 nt, Homo sapiens
cuuucccggacugcaagcagg

SEQ ID NO: 1899078 - RNA, 14 nt, Homo sapiens
caccaacacacagg

SEQ ID NO: 1899079 - RNA, 14 nt, Homo sapiens
cagaugcaccagcc

SEQ ID NO: 1899080 - RNA, 17 nt, Homo sapiens
cacagaagcacaugcac

SEQ ID NO: 1899081 - RNA, 21 nt, Homo sapiens
gugucaugaauguugcaugac

SEQ ID NO: 1899082 - RNA, 23 nt, Homo sapiens
uuggagcuaaaacuggcccuguu

SEQ ID NO: 1899083 - RNA, 22 nt, Homo sapiens
ccugaccaaagacgauacagcu

SEQ ID NO: 1899084 - RNA, 15 nt, Homo sapiens
uccuuccaccucagu

SEQ ID NO: 1899085 - RNA, 17 nt, Homo sapiens
agauguguuauuacuuc

SEQ ID NO: 1899086 - RNA, 12 nt, Homo sapiens
agccugccuccc

SEQ ID NO: 1899087 - RNA, 20 nt, Homo sapiens
gcgccaccgagugccuucaa

SEQ ID NO: 1899088 - RNA, 21 nt, Homo sapiens
gcuauccaaugauauaggaaa

SEQ ID NO: 1899089 - RNA, 17 nt, Homo sapiens
ugaaggcaaugccaucc

SEQ ID NO: 1899090 - RNA, 15 nt, Homo sapiens
gucugggcacuggau

SEQ ID NO: 1899091 - RNA, 14 nt, Homo sapiens
ucaaaugaacuuuu

SEQ ID NO: 1899092 - RNA, 13 nt, Homo sapiens
aauuaaacagauu

SEQ ID NO: 1899093 - RNA, 11 nt, Homo sapiens
aaucaguguga

SEQ ID NO: 1899094 - RNA, 13 nt, Homo sapiens
ucagaaaaguaau

SEQ ID NO: 1899095 - RNA, 15 nt, Homo sapiens
cugaacccugugcug

SEQ ID NO: 1899096 - RNA, 14 nt, Homo sapiens
gaguccucacuccc

SEQ ID NO: 1899097 - RNA, 20 nt, Homo sapiens
uauacugccaaagaauguga

SEQ ID NO: 1899098 - RNA, 18 nt, Homo sapiens
guagaaucucagcacuuu

SEQ ID NO: 1899099 - RNA, 17 nt, Homo sapiens
uguaugaaaaguaacug

SEQ ID NO: 1899100 - RNA, 20 nt, Homo sapiens
uggaauaaagucacagaauu

SEQ ID NO: 1899101 - RNA, 14 nt, Homo sapiens
cagcggauguugua

SEQ ID NO: 1899102 - RNA, 20 nt, Homo sapiens
cuggaggccggaaucucagc

SEQ ID NO: 1899103 - RNA, 18 nt, Homo sapiens
agaaauaaaccucauccu

SEQ ID NO: 1899104 - RNA, 22 nt, Homo sapiens
cuuaugcuguaacaguuagcau

SEQ ID NO: 1899105 - RNA, 13 nt, Homo sapiens
acccccugcccug

SEQ ID NO: 1899106 - RNA, 20 nt, Homo sapiens
aguuuaacuuugggcccaga

SEQ ID NO: 1899107 - RNA, 12 nt, Homo sapiens
agucugcugcug

SEQ ID NO: 1899108 - RNA, 21 nt, Homo sapiens
auaauuucaauguggaccaga

SEQ ID NO: 1899109 - RNA, 14 nt, Homo sapiens
ccaccaggcccaca

SEQ ID NO: 1899110 - RNA, 14 nt, Homo sapiens
gccacugggcaccu

SEQ ID NO: 1899111 - RNA, 16 nt, Homo sapiens
uguuucugaaugacau

SEQ ID NO: 1899112 - RNA, 14 nt, Homo sapiens
ugccccaccuuuau

SEQ ID NO: 1899113 - RNA, 11 nt, Homo sapiens
uccacuuagaa

SEQ ID NO: 1899114 - RNA, 16 nt, Homo sapiens
ucccagauacacuaaa

SEQ ID NO: 1899115 - RNA, 16 nt, Homo sapiens
gcaaaaucaucuuaca

SEQ ID NO: 1899116 - RNA, 16 nt, Homo sapiens
uaaaaauaaacauguu

SEQ ID NO: 1899117 - RNA, 16 nt, Homo sapiens
uaaaugccaacauacc

SEQ ID NO: 1899118 - RNA, 19 nt, Homo sapiens
caccuugccagggcagggu

SEQ ID NO: 1899119 - RNA, 16 nt, Homo sapiens
uguaccugacuuccac

SEQ ID NO: 1899120 - RNA, 15 nt, Homo sapiens
acuaaaaauaucaca

SEQ ID NO: 1899121 - RNA, 20 nt, Homo sapiens
ugccaccuuccggggcauuu

SEQ ID NO: 1899122 - RNA, 20 nt, Homo sapiens
cagagagagagaaggcagca

SEQ ID NO: 1899123 - RNA, 23 nt, Homo sapiens
uucugcaacaucuuaagauccac

SEQ ID NO: 1899124 - RNA, 16 nt, Homo sapiens
cucaaaguuaaccuac

SEQ ID NO: 1899125 - RNA, 19 nt, Homo sapiens
aauaugcaccaaaucaucu

SEQ ID NO: 1899126 - RNA, 14 nt, Homo sapiens
uuacuuccacagaa

SEQ ID NO: 1899127 - RNA, 21 nt, Homo sapiens
acuguguauagcuuaccugaa

SEQ ID NO: 1899128 - RNA, 17 nt, Homo sapiens
agacucacugugggaag

SEQ ID NO: 1899129 - RNA, 18 nt, Homo sapiens
gaacucugggcagcugga

SEQ ID NO: 1899130 - RNA, 17 nt, Homo sapiens
aucuuuguuggcucaga

SEQ ID NO: 1899131 - RNA, 10 nt, Homo sapiens
aaaacaugca

SEQ ID NO: 1899132 - RNA, 14 nt, Homo sapiens
agcugauuugguca

SEQ ID NO: 1899133 - RNA, 17 nt, Homo sapiens
aucuucuuuggggcccu

SEQ ID NO: 1899134 - RNA, 22 nt, Homo sapiens
uguguuccuuuuugcagcaauu

SEQ ID NO: 1899135 - RNA, 19 nt, Homo sapiens
ggugaagggagagccagcu

SEQ ID NO: 1899136 - RNA, 14 nt, Homo sapiens
gaccuuaaaugcaa

SEQ ID NO: 1899137 - RNA, 18 nt, Homo sapiens
auacaaauuuggccuuaa

SEQ ID NO: 1899138 - RNA, 17 nt, Homo sapiens
cuuauuuuugacagugu

SEQ ID NO: 1899139 - RNA, 18 nt, Homo sapiens
acaccaugaagaugccau

SEQ ID NO: 1899140 - RNA, 19 nt, Homo sapiens
guccuccacgccauuuccu

SEQ ID NO: 1899141 - RNA, 13 nt, Homo sapiens
acauuccagagaa

SEQ ID NO: 1899142 - RNA, 11 nt, Homo sapiens
agcucuuccau

SEQ ID NO: 1899143 - RNA, 16 nt, Homo sapiens
caggcugcagugcaau

SEQ ID NO: 1899144 - RNA, 20 nt, Homo sapiens
cacuugauguuuguuugcau

SEQ ID NO: 1899145 - RNA, 17 nt, Homo sapiens
cuccauagcgacacccu

SEQ ID NO: 1899146 - RNA, 20 nt, Homo sapiens
uuauuauguccauuauucaa

SEQ ID NO: 1899147 - RNA, 14 nt, Homo sapiens
ccuugaguaaaaag

SEQ ID NO: 1899148 - RNA, 21 nt, Homo sapiens
augggagccuuuaccuuuuau

SEQ ID NO: 1899149 - RNA, 18 nt, Homo sapiens
uccuggguggacuuuuga

SEQ ID NO: 1899150 - RNA, 13 nt, Homo sapiens
cuguugacaucca

SEQ ID NO: 1899151 - RNA, 23 nt, Homo sapiens
ccuuccaagaagaccaugaucuc

SEQ ID NO: 1899152 - RNA, 20 nt, Homo sapiens
uguuucguguauaugccuca

SEQ ID NO: 1899153 - RNA, 19 nt, Homo sapiens
ugacaucucuuugauguca

SEQ ID NO: 1899154 - RNA, 18 nt, Homo sapiens
auguguuuucagucuuuc

SEQ ID NO: 1899155 - RNA, 18 nt, Homo sapiens
cauugcacauaagcuucc

SEQ ID NO: 1899156 - RNA, 21 nt, Homo sapiens
gguuggucccauggguuaaga

SEQ ID NO: 1899157 - RNA, 17 nt, Homo sapiens
aauggugcucauuucau

SEQ ID NO: 1899158 - RNA, 22 nt, Homo sapiens
aggcugggaacucaucugguug

SEQ ID NO: 1899159 - RNA, 20 nt, Homo sapiens
gguccuugucccaagcccag

SEQ ID NO: 1899160 - RNA, 21 nt, Homo sapiens
uuccuggaaaacucaugaaua

SEQ ID NO: 1899161 - RNA, 19 nt, Homo sapiens
augcaugcagccacugugc

SEQ ID NO: 1899162 - RNA, 14 nt, Homo sapiens
gcacaaacaauaug

SEQ ID NO: 1899163 - RNA, 16 nt, Homo sapiens
uagccagaauguuucc

SEQ ID NO: 1899164 - RNA, 15 nt, Homo sapiens
ucaguuccauggcaa

SEQ ID NO: 1899165 - RNA, 14 nt, Homo sapiens
ucaaguuaaugcaa

SEQ ID NO: 1899166 - RNA, 17 nt, Homo sapiens
aaaaucuuuccaucuca

SEQ ID NO: 1899167 - RNA, 18 nt, Homo sapiens
uugaggaguuguaccucc

SEQ ID NO: 1899168 - RNA, 21 nt, Homo sapiens
cugggauuacaggcgugaucc

SEQ ID NO: 1899169 - RNA, 18 nt, Homo sapiens
ggacaugcuuuggcaauu

SEQ ID NO: 1899170 - RNA, 20 nt, Homo sapiens
cuuuaagagagaaaucugaa

SEQ ID NO: 1899171 - RNA, 14 nt, Homo sapiens
uucccagcucuccc

SEQ ID NO: 1899172 - RNA, 11 nt, Homo sapiens
uaagcaccugu

SEQ ID NO: 1899173 - RNA, 20 nt, Homo sapiens
aauaacauguuucucuauaa

SEQ ID NO: 1899174 - RNA, 18 nt, Homo sapiens
uaauagcaagucuuagua

SEQ ID NO: 1899175 - RNA, 23 nt, Homo sapiens
agguuuuauucucuaaauaccau

SEQ ID NO: 1899176 - RNA, 15 nt, Homo sapiens
agucaacacucuucu

SEQ ID NO: 1899177 - RNA, 13 nt, Homo sapiens
aauuuuaagacca

SEQ ID NO: 1899178 - RNA, 19 nt, Homo sapiens
gccucuuguguaacuaauu

SEQ ID NO: 1899179 - RNA, 22 nt, Homo sapiens
aggcugcuggaaggcagcuugu

SEQ ID NO: 1899180 - RNA, 15 nt, Homo sapiens
auccgucagaucucu

SEQ ID NO: 1899181 - RNA, 15 nt, Homo sapiens
agcucguuacuucag

SEQ ID NO: 1899182 - RNA, 15 nt, Homo sapiens
uggcgugaucucagc

SEQ ID NO: 1899183 - RNA, 16 nt, Homo sapiens
uuccaguuuuuugcca

SEQ ID NO: 1899184 - RNA, 17 nt, Homo sapiens
uaggaauuuucuugaaa

SEQ ID NO: 1899185 - RNA, 23 nt, Homo sapiens
agauggggucucgcucugucacc

SEQ ID NO: 1899186 - RNA, 13 nt, Homo sapiens
aaauaaacugugu

SEQ ID NO: 1899187 - RNA, 21 nt, Homo sapiens
augcuccaucccaaccaggca

SEQ ID NO: 1899188 - RNA, 16 nt, Homo sapiens
uacagggcccagguga

SEQ ID NO: 1899189 - RNA, 12 nt, Homo sapiens
acaagcaaugga

SEQ ID NO: 1899190 - RNA, 13 nt, Homo sapiens
aucauuacagauu

SEQ ID NO: 1899191 - RNA, 22 nt, Homo sapiens
uuauuugugaugacaacuggaa

SEQ ID NO: 1899192 - RNA, 21 nt, Homo sapiens
cauagaaauuacacccaaaga

SEQ ID NO: 1899193 - RNA, 18 nt, Homo sapiens
acuuuugaggacgcuggg

SEQ ID NO: 1899194 - RNA, 22 nt, Homo sapiens
aucaauucuauuacgugcaaua

SEQ ID NO: 1899195 - RNA, 14 nt, Homo sapiens
gacuucacagcagc

SEQ ID NO: 1899196 - RNA, 15 nt, Homo sapiens
uuacuguuacuugau

SEQ ID NO: 1899197 - RNA, 13 nt, Homo sapiens
uggcaaacauuua

SEQ ID NO: 1899198 - RNA, 14 nt, Homo sapiens
uucuuacauaugau

SEQ ID NO: 1899199 - RNA, 21 nt, Homo sapiens
agagcauggaaaaauacugcc

SEQ ID NO: 1899200 - RNA, 14 nt, Homo sapiens
uuccauuugcaaca

SEQ ID NO: 1899201 - RNA, 19 nt, Homo sapiens
ccgaggcagacgucuguca

SEQ ID NO: 1899202 - RNA, 19 nt, Homo sapiens
aacagagggugaaagggac

SEQ ID NO: 1899203 - RNA, 15 nt, Homo sapiens
acaccaaccagacag

SEQ ID NO: 1899204 - RNA, 21 nt, Homo sapiens
uuaugaugaaaaccuacauau

SEQ ID NO: 1899205 - RNA, 17 nt, Homo sapiens
gucagggggcacugucu

SEQ ID NO: 1899206 - RNA, 21 nt, Homo sapiens
uuucaaaaccagcucccaugu

SEQ ID NO: 1899207 - RNA, 23 nt, Homo sapiens
ucauucuagacccuauacauuuu

SEQ ID NO: 1899208 - RNA, 20 nt, Homo sapiens
ucaauaguguccuaugcaau

SEQ ID NO: 1899209 - RNA, 21 nt, Homo sapiens
uaugcggaggaaagcaagugu

SEQ ID NO: 1899210 - RNA, 17 nt, Homo sapiens
aauaguucuaaacuauc

SEQ ID NO: 1899211 - RNA, 20 nt, Homo sapiens
gucagugccaugacugagaa

SEQ ID NO: 1899212 - RNA, 15 nt, Homo sapiens
aaaauuuaaauggag

SEQ ID NO: 1899213 - RNA, 16 nt, Homo sapiens
gacacaguuguuucag

SEQ ID NO: 1899214 - RNA, 20 nt, Homo sapiens
gcagccuggcugguccuccc

SEQ ID NO: 1899215 - RNA, 18 nt, Homo sapiens
gaaacgcuagaagccuaa

SEQ ID NO: 1899216 - RNA, 15 nt, Homo sapiens
ggaccugcucaucau

SEQ ID NO: 1899217 - RNA, 15 nt, Homo sapiens
guggccccaacacaa

SEQ ID NO: 1899218 - RNA, 14 nt, Homo sapiens
uuguuguugccaaa

SEQ ID NO: 1899219 - RNA, 16 nt, Homo sapiens
gaccccaucccuaucc

SEQ ID NO: 1899220 - RNA, 20 nt, Homo sapiens
caaugggauguaugaauaca

SEQ ID NO: 1899221 - RNA, 18 nt, Homo sapiens
acccaucacugugucuca

SEQ ID NO: 1899222 - RNA, 16 nt, Homo sapiens
ggagggacagucucac

SEQ ID NO: 1899223 - RNA, 13 nt, Homo sapiens
agggguccaggcc

SEQ ID NO: 1899224 - RNA, 16 nt, Homo sapiens
aggugaggaagcaaaa

SEQ ID NO: 1899225 - RNA, 18 nt, Homo sapiens
ccacaaauagugcucgcu

SEQ ID NO: 1899226 - RNA, 22 nt, Homo sapiens
augagcaauguggauaugacca

SEQ ID NO: 1899227 - RNA, 18 nt, Homo sapiens
cccaccauucccugccuu

SEQ ID NO: 1899228 - RNA, 23 nt, Homo sapiens
gcuccccugggggcuagcagaag

SEQ ID NO: 1899229 - RNA, 13 nt, Homo sapiens
ccaaagauuugag

SEQ ID NO: 1899230 - RNA, 21 nt, Homo sapiens
cuguugccuuuuuacagccaa

SEQ ID NO: 1899231 - RNA, 20 nt, Homo sapiens
uacacuguguaaauacccau

SEQ ID NO: 1899232 - RNA, 14 nt, Homo sapiens
cuauggccagucug

SEQ ID NO: 1899233 - RNA, 19 nt, Homo sapiens
aagcuuaauggauuguuaa

SEQ ID NO: 1899234 - RNA, 14 nt, Homo sapiens
gcuacgaccugguc

SEQ ID NO: 1899235 - RNA, 21 nt, Homo sapiens
aggugagaugggacauuccaa

SEQ ID NO: 1899236 - RNA, 17 nt, Homo sapiens
ccaggcugcacugcagu

SEQ ID NO: 1899237 - RNA, 16 nt, Homo sapiens
cuccuuuaauauacuc

SEQ ID NO: 1899238 - RNA, 21 nt, Homo sapiens
gugaacaguacaauauuucag

SEQ ID NO: 1899239 - RNA, 19 nt, Homo sapiens
cugagucuuuucauugcua

SEQ ID NO: 1899240 - RNA, 10 nt, Homo sapiens
acgugcaaua

SEQ ID NO: 1899241 - RNA, 23 nt, Homo sapiens
aguugcgacggagagaaaaaaga

SEQ ID NO: 1899242 - RNA, 21 nt, Homo sapiens
ugguuucucggugacuuggag

SEQ ID NO: 1899243 - RNA, 17 nt, Homo sapiens
agaguggaccccgucau

SEQ ID NO: 1899244 - RNA, 18 nt, Homo sapiens
gaccuugcuuccuucuca

SEQ ID NO: 1899245 - RNA, 17 nt, Homo sapiens
ucuucagaggagaaaga

SEQ ID NO: 1899246 - RNA, 19 nt, Homo sapiens
ucucugagcaauuguaggg

SEQ ID NO: 1899247 - RNA, 19 nt, Homo sapiens
ucccaagggagacugacca

SEQ ID NO: 1899248 - RNA, 15 nt, Homo sapiens
uauggauaugcugcu

SEQ ID NO: 1899249 - RNA, 12 nt, Homo sapiens
aaggcaucucag

SEQ ID NO: 1899250 - RNA, 20 nt, Homo sapiens
uaaucaucaccacaccguga

SEQ ID NO: 1899251 - RNA, 18 nt, Homo sapiens
auuauuguagacaugccc

SEQ ID NO: 1899252 - RNA, 15 nt, Homo sapiens
ugugccacacaguga

SEQ ID NO: 1899253 - RNA, 20 nt, Homo sapiens
cuugaugaauaaacacuuuu

SEQ ID NO: 1899254 - RNA, 16 nt, Homo sapiens
aggcccucuguggccu

SEQ ID NO: 1899255 - RNA, 17 nt, Homo sapiens
acaacucugaaagagaa

SEQ ID NO: 1899256 - RNA, 14 nt, Homo sapiens
acaugcauugcucu

SEQ ID NO: 1899257 - RNA, 20 nt, Homo sapiens
uuauaauucugggaagcaaa

SEQ ID NO: 1899258 - RNA, 13 nt, Homo sapiens
augcccugugugg

SEQ ID NO: 1899259 - RNA, 13 nt, Homo sapiens
uuagacacuuugg

SEQ ID NO: 1899260 - RNA, 13 nt, Homo sapiens
uuaagcacuuuaa

SEQ ID NO: 1899261 - RNA, 21 nt, Homo sapiens
ggaagcugggugagccaagga

SEQ ID NO: 1899262 - RNA, 19 nt, Homo sapiens
ggacauggggcuccuggaa

SEQ ID NO: 1899263 - RNA, 19 nt, Homo sapiens
aauucuuaccucauuugca

SEQ ID NO: 1899264 - RNA, 19 nt, Homo sapiens
caaaugcgcacgaccuaca

SEQ ID NO: 1899265 - RNA, 18 nt, Homo sapiens
acugcagauuucucaccu

SEQ ID NO: 1899266 - RNA, 12 nt, Homo sapiens
gcccacauauaa

SEQ ID NO: 1899267 - RNA, 22 nt, Homo sapiens
cagcagcuucaccagagcauuu

SEQ ID NO: 1899268 - RNA, 17 nt, Homo sapiens
cccugcaggaaaacuga

SEQ ID NO: 1899269 - RNA, 12 nt, Homo sapiens
uuuucugauuug

SEQ ID NO: 1899270 - RNA, 13 nt, Homo sapiens
ggccgagaagcca

SEQ ID NO: 1899271 - RNA, 13 nt, Homo sapiens
uggaccagacaau

SEQ ID NO: 1899272 - RNA, 14 nt, Homo sapiens
cagaaauugcaaua

SEQ ID NO: 1899273 - RNA, 17 nt, Homo sapiens
gaaacugugaagaucuc

SEQ ID NO: 1899274 - RNA, 16 nt, Homo sapiens
gauggggcgagccagg

SEQ ID NO: 1899275 - RNA, 14 nt, Homo sapiens
cagagccucaguga

SEQ ID NO: 1899276 - RNA, 15 nt, Homo sapiens
gcacuuggacucucc

SEQ ID NO: 1899277 - RNA, 17 nt, Homo sapiens
acaggaggcaggcaugg

SEQ ID NO: 1899278 - RNA, 17 nt, Homo sapiens
ucuuauucaucagggag

SEQ ID NO: 1899279 - RNA, 16 nt, Homo sapiens
gugaauguacauuucu

SEQ ID NO: 1899280 - RNA, 12 nt, Homo sapiens
acgguccaugaa

SEQ ID NO: 1899281 - RNA, 19 nt, Homo sapiens
acaggccagccuuggcacg

SEQ ID NO: 1899282 - RNA, 20 nt, Homo sapiens
gaauguuuucaaaaccaagu

SEQ ID NO: 1899283 - RNA, 21 nt, Homo sapiens
acgaggcugggccaagccagg

SEQ ID NO: 1899284 - RNA, 20 nt, Homo sapiens
ggaucugcugcauccaggac

SEQ ID NO: 1899285 - RNA, 17 nt, Homo sapiens
cugcguacuccacuggu

SEQ ID NO: 1899286 - RNA, 16 nt, Homo sapiens
uuccaagaacuauaaa

SEQ ID NO: 1899287 - RNA, 14 nt, Homo sapiens
uuaaucggugcauu

SEQ ID NO: 1899288 - RNA, 14 nt, Homo sapiens
ggacuuggguccuc

SEQ ID NO: 1899289 - RNA, 23 nt, Homo sapiens
ugaucuuuuguucccauccucuu

SEQ ID NO: 1899290 - RNA, 21 nt, Homo sapiens
ucaccaagcaggaaagggagg

SEQ ID NO: 1899291 - RNA, 18 nt, Homo sapiens
aaguuuaucacacagugu

SEQ ID NO: 1899292 - RNA, 23 nt, Homo sapiens
aagauucuuuauaucugaaccaa

SEQ ID NO: 1899293 - RNA, 16 nt, Homo sapiens
acuaguuuaaugugga

SEQ ID NO: 1899294 - RNA, 18 nt, Homo sapiens
uguuauuuuuuauuucca

SEQ ID NO: 1899295 - RNA, 21 nt, Homo sapiens
gcuugggaaaaaaacuuggca

SEQ ID NO: 1899296 - RNA, 13 nt, Homo sapiens
aguaauaagcaug

SEQ ID NO: 1899297 - RNA, 14 nt, Homo sapiens
uccacuacugcuac

SEQ ID NO: 1899298 - RNA, 18 nt, Homo sapiens
agacagagcccugugagg

SEQ ID NO: 1899299 - RNA, 16 nt, Homo sapiens
aaagacuacacuguug

SEQ ID NO: 1899300 - RNA, 18 nt, Homo sapiens
uaaacaaucuuagacauu

SEQ ID NO: 1899301 - RNA, 13 nt, Homo sapiens
gcaagcuguguua

SEQ ID NO: 1899302 - RNA, 13 nt, Homo sapiens
uggaaugcuucug

SEQ ID NO: 1899303 - RNA, 21 nt, Homo sapiens
aauaauuuuauuccagacagu

SEQ ID NO: 1899304 - RNA, 17 nt, Homo sapiens
agacgggguuucacugu

SEQ ID NO: 1899305 - RNA, 11 nt, Homo sapiens
auuuacuacag

SEQ ID NO: 1899306 - RNA, 21 nt, Homo sapiens
caucucaauaaagugcuuuaa

SEQ ID NO: 1899307 - RNA, 22 nt, Homo sapiens
auaacaaagaaccuaacauuua

SEQ ID NO: 1899308 - RNA, 15 nt, Homo sapiens
ucuaauagucaauga

SEQ ID NO: 1899309 - RNA, 13 nt, Homo sapiens
ucagagugccacu

SEQ ID NO: 1899310 - RNA, 16 nt, Homo sapiens
cuuucgccgaaugggg

SEQ ID NO: 1899311 - RNA, 15 nt, Homo sapiens
guacaucuguuugua

SEQ ID NO: 1899312 - RNA, 20 nt, Homo sapiens
accucaggggagacuuaggc

SEQ ID NO: 1899313 - RNA, 19 nt, Homo sapiens
cuggaaguucauaccuaag

SEQ ID NO: 1899314 - RNA, 18 nt, Homo sapiens
gaugcacccauugugauu

SEQ ID NO: 1899315 - RNA, 18 nt, Homo sapiens
aaucccaguuacucagga

SEQ ID NO: 1899316 - RNA, 13 nt, Homo sapiens
ugagaauuggaga

SEQ ID NO: 1899317 - RNA, 13 nt, Homo sapiens
ggaauauuugaau

SEQ ID NO: 1899318 - RNA, 15 nt, Homo sapiens
uugacugacugagca

SEQ ID NO: 1899319 - RNA, 13 nt, Homo sapiens
uuggugcucuugc

SEQ ID NO: 1899320 - RNA, 12 nt, Homo sapiens
acuucacacagc

SEQ ID NO: 1899321 - RNA, 18 nt, Homo sapiens
cucuccaucuuccacgaa

SEQ ID NO: 1899322 - RNA, 18 nt, Homo sapiens
gggguuuugacuugccac

SEQ ID NO: 1899323 - RNA, 23 nt, Homo sapiens
ggccuaacacugggcugcagaga

SEQ ID NO: 1899324 - RNA, 23 nt, Homo sapiens
gagcaaacuaacuugacuuuuaa

SEQ ID NO: 1899325 - RNA, 16 nt, Homo sapiens
aaaggaagucaguaca

SEQ ID NO: 1899326 - RNA, 17 nt, Homo sapiens
acuucuuucacuacuca

SEQ ID NO: 1899327 - RNA, 17 nt, Homo sapiens
uuuccuuuaugugaauu

SEQ ID NO: 1899328 - RNA, 20 nt, Homo sapiens
agguccuucuguagugccau

SEQ ID NO: 1899329 - RNA, 15 nt, Homo sapiens
uaaucccuuccucuc

SEQ ID NO: 1899330 - RNA, 13 nt, Homo sapiens
accaugcaauucc

SEQ ID NO: 1899331 - RNA, 23 nt, Homo sapiens
uuggcgggugggagacuccgggu

SEQ ID NO: 1899332 - RNA, 23 nt, Homo sapiens
acccacgugacaccaccgaauau

SEQ ID NO: 1899333 - RNA, 22 nt, Homo sapiens
cuacuucuccccuccucuugcc

SEQ ID NO: 1899334 - RNA, 12 nt, Homo sapiens
gcauuuacuuuu

SEQ ID NO: 1899335 - RNA, 21 nt, Homo sapiens
uguguauuccacuuaggaaga

SEQ ID NO: 1899336 - RNA, 20 nt, Homo sapiens
uaauuaaaugaaauacuuga

SEQ ID NO: 1899337 - RNA, 18 nt, Homo sapiens
cugcuaaaugcacugacc

SEQ ID NO: 1899338 - RNA, 14 nt, Homo sapiens
aguguuaaaguggu

SEQ ID NO: 1899339 - RNA, 20 nt, Homo sapiens
ugacauggucagucuacuaa

SEQ ID NO: 1899340 - RNA, 13 nt, Homo sapiens
caauaaagugacc

SEQ ID NO: 1899341 - RNA, 13 nt, Homo sapiens
cacucaagugcca

SEQ ID NO: 1899342 - RNA, 14 nt, Homo sapiens
uguuuaaaaguaau

SEQ ID NO: 1899343 - RNA, 18 nt, Homo sapiens
ccgggacugggggcggga

SEQ ID NO: 1899344 - RNA, 17 nt, Homo sapiens
uucauuuugagaucaag

SEQ ID NO: 1899345 - RNA, 23 nt, Homo sapiens
ucucaucaguguccucuugcuca

SEQ ID NO: 1899346 - RNA, 16 nt, Homo sapiens
uugacuacccuguacc

SEQ ID NO: 1899347 - RNA, 14 nt, Homo sapiens
uugcaccaaaagaa

SEQ ID NO: 1899348 - RNA, 17 nt, Homo sapiens
acaccguggacagcgcu

SEQ ID NO: 1899349 - RNA, 22 nt, Homo sapiens
uccucgggccgaggcccagcgg

SEQ ID NO: 1899350 - RNA, 22 nt, Homo sapiens
aauaaaggccuuauucauuuca

SEQ ID NO: 1899351 - RNA, 12 nt, Homo sapiens
ccuuaauaugau

SEQ ID NO: 1899352 - RNA, 16 nt, Homo sapiens
ucgguggcauuugcug

SEQ ID NO: 1899353 - RNA, 16 nt, Homo sapiens
gacggguuucaccaug

SEQ ID NO: 1899354 - RNA, 17 nt, Homo sapiens
uugucaaagcauugaga

SEQ ID NO: 1899355 - RNA, 18 nt, Homo sapiens
auggacaaaauugcagau

SEQ ID NO: 1899356 - RNA, 19 nt, Homo sapiens
ugucauugcgaccauuucu

SEQ ID NO: 1899357 - RNA, 17 nt, Homo sapiens
caaaaaacuaaagcagu

SEQ ID NO: 1899358 - RNA, 16 nt, Homo sapiens
ugauguacauguacug

SEQ ID NO: 1899359 - RNA, 18 nt, Homo sapiens
aguuauucauauucuguu

SEQ ID NO: 1899360 - RNA, 12 nt, Homo sapiens
ugcaaucuucua

SEQ ID NO: 1899361 - RNA, 18 nt, Homo sapiens
accacaugccccauccca

SEQ ID NO: 1899362 - RNA, 20 nt, Homo sapiens
cuaauuuuucagcuccuuca

SEQ ID NO: 1899363 - RNA, 15 nt, Homo sapiens
uacuuaauuuacuua

SEQ ID NO: 1899364 - RNA, 19 nt, Homo sapiens
agcugggaaccagcaucuc

SEQ ID NO: 1899365 - RNA, 23 nt, Homo sapiens
cucagaagagucccggagcucaa

SEQ ID NO: 1899366 - RNA, 21 nt, Homo sapiens
augcaaaauucuuucagauga

SEQ ID NO: 1899367 - RNA, 16 nt, Homo sapiens
aaagaaaaaguacaag

SEQ ID NO: 1899368 - RNA, 19 nt, Homo sapiens
gagaacgugcccagccaca

SEQ ID NO: 1899369 - RNA, 14 nt, Homo sapiens
agagcucaagggac

SEQ ID NO: 1899370 - RNA, 16 nt, Homo sapiens
acaggguguugucagc

SEQ ID NO: 1899371 - RNA, 14 nt, Homo sapiens
gauaacugauuucu

SEQ ID NO: 1899372 - RNA, 20 nt, Homo sapiens
uugagaaaguacagcaguag

SEQ ID NO: 1899373 - RNA, 13 nt, Homo sapiens
aaauuguauagag

SEQ ID NO: 1899374 - RNA, 12 nt, Homo sapiens
auccuauuugau

SEQ ID NO: 1899375 - RNA, 14 nt, Homo sapiens
aaaaagacagggcu

SEQ ID NO: 1899376 - RNA, 12 nt, Homo sapiens
aagagacucagc

SEQ ID NO: 1899377 - RNA, 16 nt, Homo sapiens
aaaguuuuuacagugu

SEQ ID NO: 1899378 - RNA, 18 nt, Homo sapiens
agcaguggugucucugaa

SEQ ID NO: 1899379 - RNA, 14 nt, Homo sapiens
caccccucaagcca

SEQ ID NO: 1899380 - RNA, 15 nt, Homo sapiens
auuuuauuacuaaua

SEQ ID NO: 1899381 - RNA, 23 nt, Homo sapiens
cucuagcugggggugggccaggc

SEQ ID NO: 1899382 - RNA, 19 nt, Homo sapiens
cgacuuuucuuaacaaccu

SEQ ID NO: 1899383 - RNA, 20 nt, Homo sapiens
guccucccaggaaccaaaaa

SEQ ID NO: 1899384 - RNA, 13 nt, Homo sapiens
caucccaucccau

SEQ ID NO: 1899385 - RNA, 15 nt, Homo sapiens
cuagauuuaugaaua

SEQ ID NO: 1899386 - RNA, 19 nt, Homo sapiens
acaagcauaacauggagcu

SEQ ID NO: 1899387 - RNA, 12 nt, Homo sapiens
ccucucuacuuc

SEQ ID NO: 1899388 - RNA, 17 nt, Homo sapiens
auuuuccuccaggcaaa

SEQ ID NO: 1899389 - RNA, 18 nt, Homo sapiens
accccaucaccuacucac

SEQ ID NO: 1899390 - RNA, 18 nt, Homo sapiens
uuccucucgcagcuugau

SEQ ID NO: 1899391 - RNA, 22 nt, Homo sapiens
ggcaugguauaaggaaauauca

SEQ ID NO: 1899392 - RNA, 16 nt, Homo sapiens
aaacaauuuagccaga

SEQ ID NO: 1899393 - RNA, 14 nt, Homo sapiens
ugaaaauugcaaua

SEQ ID NO: 1899394 - RNA, 14 nt, Homo sapiens
gcaugagccagcuc

SEQ ID NO: 1899395 - RNA, 16 nt, Homo sapiens
cuuggcugauguugca

SEQ ID NO: 1899396 - RNA, 15 nt, Homo sapiens
ccuccugagcucuga

SEQ ID NO: 1899397 - RNA, 18 nt, Homo sapiens
guauuuccaacuugucac

SEQ ID NO: 1899398 - RNA, 22 nt, Homo sapiens
uuuuuccugaugaugguggcug

SEQ ID NO: 1899399 - RNA, 15 nt, Homo sapiens
acacaucuuaccucu

SEQ ID NO: 1899400 - RNA, 21 nt, Homo sapiens
ucaaaucugcuuucauccagc

SEQ ID NO: 1899401 - RNA, 19 nt, Homo sapiens
aggcaggagaaucacuuga

SEQ ID NO: 1899402 - RNA, 19 nt, Homo sapiens
cuggagcagagaacaucug

SEQ ID NO: 1899403 - RNA, 14 nt, Homo sapiens
ccucggucauuccu

SEQ ID NO: 1899404 - RNA, 15 nt, Homo sapiens
cuugaaggcccaggu

SEQ ID NO: 1899405 - RNA, 22 nt, Homo sapiens
cacccuguuuaaagauuucaag

SEQ ID NO: 1899406 - RNA, 19 nt, Homo sapiens
acuacuugccacacacugu

SEQ ID NO: 1899407 - RNA, 21 nt, Homo sapiens
cuucaccccaguggccacuca

SEQ ID NO: 1899408 - RNA, 14 nt, Homo sapiens
ccuggaaggugcug

SEQ ID NO: 1899409 - RNA, 12 nt, Homo sapiens
gauuagacugga

SEQ ID NO: 1899410 - RNA, 17 nt, Homo sapiens
uacgauuauaguaccac

SEQ ID NO: 1899411 - RNA, 20 nt, Homo sapiens
gcugggaugcugguggcucu

SEQ ID NO: 1899412 - RNA, 15 nt, Homo sapiens
acccccuauucccug

SEQ ID NO: 1899413 - RNA, 16 nt, Homo sapiens
acuucaacauuuacau

SEQ ID NO: 1899414 - RNA, 21 nt, Homo sapiens
ggcucaggggagcaagcuuac

SEQ ID NO: 1899415 - RNA, 12 nt, Homo sapiens
aggccagugcua

SEQ ID NO: 1899416 - RNA, 23 nt, Homo sapiens
ucacauacccacccuuacuuccu

SEQ ID NO: 1899417 - RNA, 12 nt, Homo sapiens
aggacacagcac

SEQ ID NO: 1899418 - RNA, 13 nt, Homo sapiens
uggucucugccau

SEQ ID NO: 1899419 - RNA, 18 nt, Homo sapiens
aucuguugggaaccagag

SEQ ID NO: 1899420 - RNA, 17 nt, Homo sapiens
caaauuuaugcauuuca

SEQ ID NO: 1899421 - RNA, 17 nt, Homo sapiens
auauuuugcuaacuggu

SEQ ID NO: 1899422 - RNA, 20 nt, Homo sapiens
caagaagcccuccuugccac

SEQ ID NO: 1899423 - RNA, 19 nt, Homo sapiens
uguagaucaagugugcaua

SEQ ID NO: 1899424 - RNA, 15 nt, Homo sapiens
aauggaauacugaaa

SEQ ID NO: 1899425 - RNA, 17 nt, Homo sapiens
gcccuuccuugccagug

SEQ ID NO: 1899426 - RNA, 21 nt, Homo sapiens
gggaccacagacucacauccu

SEQ ID NO: 1899427 - RNA, 20 nt, Homo sapiens
aacugccuuuggcagaguuc

SEQ ID NO: 1899428 - RNA, 18 nt, Homo sapiens
caugucagccacugugau

SEQ ID NO: 1899429 - RNA, 16 nt, Homo sapiens
ugggauuaggcccuca

SEQ ID NO: 1899430 - RNA, 16 nt, Homo sapiens
aaggccugugauccag

SEQ ID NO: 1899431 - RNA, 20 nt, Homo sapiens
aucucagaaccuugucccag

SEQ ID NO: 1899432 - RNA, 22 nt, Homo sapiens
ccauguguaagaacaaugccag

SEQ ID NO: 1899433 - RNA, 17 nt, Homo sapiens
caaccugacucaggcca

SEQ ID NO: 1899434 - RNA, 16 nt, Homo sapiens
acuauuaaaacagcca

SEQ ID NO: 1899435 - RNA, 20 nt, Homo sapiens
acauuuuguuuuuacuguau

SEQ ID NO: 1899436 - RNA, 15 nt, Homo sapiens
uguccaggugagaac

SEQ ID NO: 1899437 - RNA, 18 nt, Homo sapiens
aguguccucuugcucaaa

SEQ ID NO: 1899438 - RNA, 14 nt, Homo sapiens
ugaagcugagcuuu

SEQ ID NO: 1899439 - RNA, 20 nt, Homo sapiens
ggcugagccgaucuggucuc

SEQ ID NO: 1899440 - RNA, 20 nt, Homo sapiens
gaagauggauguuugucaaa

SEQ ID NO: 1899441 - RNA, 23 nt, Homo sapiens
acgcagccugcagacucacugug

SEQ ID NO: 1899442 - RNA, 15 nt, Homo sapiens
ugcauauaucuuuca

SEQ ID NO: 1899443 - RNA, 17 nt, Homo sapiens
aucuugcucuaucucac

SEQ ID NO: 1899444 - RNA, 12 nt, Homo sapiens
uaugggugcugg

SEQ ID NO: 1899445 - RNA, 13 nt, Homo sapiens
auucucugaguca

SEQ ID NO: 1899446 - RNA, 15 nt, Homo sapiens
auggaacagcauuac

SEQ ID NO: 1899447 - RNA, 21 nt, Homo sapiens
ugugugcauguaugugcacau

SEQ ID NO: 1899448 - RNA, 13 nt, Homo sapiens
ggacuuccauuug

SEQ ID NO: 1899449 - RNA, 18 nt, Homo sapiens
agcaaagggagcacuggg

SEQ ID NO: 1899450 - RNA, 19 nt, Homo sapiens
aagcaccaccaaacacagu

SEQ ID NO: 1899451 - RNA, 13 nt, Homo sapiens
uaacugacagcuu

SEQ ID NO: 1899452 - RNA, 13 nt, Homo sapiens
ggagauugaacca

SEQ ID NO: 1899453 - RNA, 17 nt, Homo sapiens
aacagcuguuccugugu

SEQ ID NO: 1899454 - RNA, 15 nt, Homo sapiens
uuaaauugcauuucu

SEQ ID NO: 1899455 - RNA, 21 nt, Homo sapiens
agauuuauuuuugaaacaaac

SEQ ID NO: 1899456 - RNA, 18 nt, Homo sapiens
cagugaaagucaauucag

SEQ ID NO: 1899457 - RNA, 15 nt, Homo sapiens
gauucaugucucacg

SEQ ID NO: 1899458 - RNA, 16 nt, Homo sapiens
guaccgauuucugcua

SEQ ID NO: 1899459 - RNA, 16 nt, Homo sapiens
aggaucacugacaaaa

SEQ ID NO: 1899460 - RNA, 14 nt, Homo sapiens
auacacacacacac

SEQ ID NO: 1899461 - RNA, 14 nt, Homo sapiens
acacacacauacac

SEQ ID NO: 1899462 - RNA, 14 nt, Homo sapiens
acuauaacauuaua

SEQ ID NO: 1899463 - RNA, 13 nt, Homo sapiens
aauugaugaugca

SEQ ID NO: 1899464 - RNA, 23 nt, Homo sapiens
cuaaguagcuggguuuacaggca

SEQ ID NO: 1899465 - RNA, 13 nt, Homo sapiens
aacuugcaccucu

SEQ ID NO: 1899466 - RNA, 22 nt, Homo sapiens
agaaacauuuuuuaaguaggca

SEQ ID NO: 1899467 - RNA, 13 nt, Homo sapiens
uuuaagucuucca

SEQ ID NO: 1899468 - RNA, 15 nt, Homo sapiens
uccuacguauccugc

SEQ ID NO: 1899469 - RNA, 22 nt, Homo sapiens
ugcgccgccgccggaguccacu

SEQ ID NO: 1899470 - RNA, 20 nt, Homo sapiens
ugacagggacaugcccugug

SEQ ID NO: 1899471 - RNA, 23 nt, Homo sapiens
gguauuaacuuuauacacuugga

SEQ ID NO: 1899472 - RNA, 14 nt, Homo sapiens
caaaugcacaucuc

SEQ ID NO: 1899473 - RNA, 17 nt, Homo sapiens
ugaauauuauacuucuu

SEQ ID NO: 1899474 - RNA, 14 nt, Homo sapiens
auuacuuaauguga

SEQ ID NO: 1899475 - RNA, 16 nt, Homo sapiens
gacaguauuaagggua

SEQ ID NO: 1899476 - RNA, 20 nt, Homo sapiens
uuacuacuauucuguuaaaa

SEQ ID NO: 1899477 - RNA, 20 nt, Homo sapiens
agagcuuuuuaauagcacua

SEQ ID NO: 1899478 - RNA, 21 nt, Homo sapiens
uguuuaauuccuggaaaacug

SEQ ID NO: 1899479 - RNA, 14 nt, Homo sapiens
cugauuucagggaa

SEQ ID NO: 1899480 - RNA, 21 nt, Homo sapiens
ccuggggcuggguguguuuca

SEQ ID NO: 1899481 - RNA, 13 nt, Homo sapiens
acugaacauccaa

SEQ ID NO: 1899482 - RNA, 20 nt, Homo sapiens
gucaaugucauuacauagaa

SEQ ID NO: 1899483 - RNA, 12 nt, Homo sapiens
cugaguuugugg

SEQ ID NO: 1899484 - RNA, 13 nt, Homo sapiens
augaggugggggu

SEQ ID NO: 1899485 - RNA, 22 nt, Homo sapiens
uuuggacucagcccaccugcac

SEQ ID NO: 1899486 - RNA, 18 nt, Homo sapiens
acaaauuaagauguucag

SEQ ID NO: 1899487 - RNA, 12 nt, Homo sapiens
agcgucaaggug

SEQ ID NO: 1899488 - RNA, 19 nt, Homo sapiens
ccucucuccuuccugcugu

SEQ ID NO: 1899489 - RNA, 20 nt, Homo sapiens
gccucgguggccaugcuucu

SEQ ID NO: 1899490 - RNA, 18 nt, Homo sapiens
gcaguaauuuguggcacu

SEQ ID NO: 1899491 - RNA, 19 nt, Homo sapiens
cuaugaacaacaguaguuu

SEQ ID NO: 1899492 - RNA, 20 nt, Homo sapiens
uucauguuugcuucauaaau

SEQ ID NO: 1899493 - RNA, 20 nt, Homo sapiens
aguuucuccuuuugaccaaa

SEQ ID NO: 1899494 - RNA, 21 nt, Homo sapiens
gacuucagacucucuccucuc

SEQ ID NO: 1899495 - RNA, 17 nt, Homo sapiens
ugugccucuuacuaugu

SEQ ID NO: 1899496 - RNA, 14 nt, Homo sapiens
aguuacccacugaa

SEQ ID NO: 1899497 - RNA, 13 nt, Homo sapiens
gaccccaaaaaga

SEQ ID NO: 1899498 - RNA, 13 nt, Homo sapiens
gacgccaaaaaca

SEQ ID NO: 1899499 - RNA, 20 nt, Homo sapiens
gcugucuuccuguguaccuc

SEQ ID NO: 1899500 - RNA, 14 nt, Homo sapiens
acuuaucacaugga

SEQ ID NO: 1899501 - RNA, 18 nt, Homo sapiens
uuaaacccuuuggugcua

SEQ ID NO: 1899502 - RNA, 17 nt, Homo sapiens
uguaucuuaaaaaucua

SEQ ID NO: 1899503 - RNA, 11 nt, Homo sapiens
ucccacuauau

SEQ ID NO: 1899504 - RNA, 15 nt, Homo sapiens
auccuuccauuccac

SEQ ID NO: 1899505 - RNA, 21 nt, Homo sapiens
augccugggucucugggcaca

SEQ ID NO: 1899506 - RNA, 17 nt, Homo sapiens
cagcauugcacagugaa

SEQ ID NO: 1899507 - RNA, 18 nt, Homo sapiens
ugcuggugagaggugcaa

SEQ ID NO: 1899508 - RNA, 10 nt, Homo sapiens
gugcccucca

SEQ ID NO: 1899509 - RNA, 23 nt, Homo sapiens
uucagcuccugaccaguugcagu

SEQ ID NO: 1899510 - RNA, 14 nt, Homo sapiens
agacccaccauccu

SEQ ID NO: 1899511 - RNA, 22 nt, Homo sapiens
gaugcuuuaugcaacuaacugu

SEQ ID NO: 1899512 - RNA, 12 nt, Homo sapiens
gaccccauacau

SEQ ID NO: 1899513 - RNA, 19 nt, Homo sapiens
acaauaacgauaaaagaca

SEQ ID NO: 1899514 - RNA, 19 nt, Homo sapiens
ccgcaagaaagcaugacuu

SEQ ID NO: 1899515 - RNA, 15 nt, Homo sapiens
caggguuucucugca

SEQ ID NO: 1899516 - RNA, 14 nt, Homo sapiens
caguugcagaauug

SEQ ID NO: 1899517 - RNA, 22 nt, Homo sapiens
uccuugggcccugaggcugcug

SEQ ID NO: 1899518 - RNA, 13 nt, Homo sapiens
cucuggauuuuau

SEQ ID NO: 1899519 - RNA, 12 nt, Homo sapiens
agaccucuacaa

SEQ ID NO: 1899520 - RNA, 13 nt, Homo sapiens
acucagcacucca

SEQ ID NO: 1899521 - RNA, 19 nt, Homo sapiens
caguguuugcaaugguguu

SEQ ID NO: 1899522 - RNA, 15 nt, Homo sapiens
auuuuauaagcauuu

SEQ ID NO: 1899523 - RNA, 19 nt, Homo sapiens
aggaaccucgaguacugug

SEQ ID NO: 1899524 - RNA, 14 nt, Homo sapiens
ugacaucacagcag

SEQ ID NO: 1899525 - RNA, 14 nt, Homo sapiens
uaaggaaagcaaua

SEQ ID NO: 1899526 - RNA, 20 nt, Homo sapiens
agcucaggccuaggugcgca

SEQ ID NO: 1899527 - RNA, 13 nt, Homo sapiens
uuuuaguugucaa

SEQ ID NO: 1899528 - RNA, 13 nt, Homo sapiens
gcuuuguuuccau

SEQ ID NO: 1899529 - RNA, 16 nt, Homo sapiens
acagcagcaauaugcu

SEQ ID NO: 1899530 - RNA, 23 nt, Homo sapiens
uccugaugaugguggcuguaaua

SEQ ID NO: 1899531 - RNA, 18 nt, Homo sapiens
uaaauauagaaccaugaa

SEQ ID NO: 1899532 - RNA, 14 nt, Homo sapiens
uauuagaaugcaug

SEQ ID NO: 1899533 - RNA, 21 nt, Homo sapiens
ugcuuuugguugggggcagau

SEQ ID NO: 1899534 - RNA, 18 nt, Homo sapiens
acugugauuuuuaucaca

SEQ ID NO: 1899535 - RNA, 14 nt, Homo sapiens
ccucagcuucucaa

SEQ ID NO: 1899536 - RNA, 14 nt, Homo sapiens
ugggggcucgggga

SEQ ID NO: 1899537 - RNA, 19 nt, Homo sapiens
uccaguauucuugucaaaa

SEQ ID NO: 1899538 - RNA, 22 nt, Homo sapiens
uaggauaagcacuagaucuccc

SEQ ID NO: 1899539 - RNA, 14 nt, Homo sapiens
ccuggaaauucugc

SEQ ID NO: 1899540 - RNA, 20 nt, Homo sapiens
uagaaauguaacauacucau

SEQ ID NO: 1899541 - RNA, 22 nt, Homo sapiens
ugagcucugcucucagcagauu

SEQ ID NO: 1899542 - RNA, 17 nt, Homo sapiens
cuuuguuuugcacugac

SEQ ID NO: 1899543 - RNA, 19 nt, Homo sapiens
aaauuaagagauacauucc

SEQ ID NO: 1899544 - RNA, 16 nt, Homo sapiens
aagcucuuguguauac

SEQ ID NO: 1899545 - RNA, 20 nt, Homo sapiens
ccuuguaaccagugcagaaa

SEQ ID NO: 1899546 - RNA, 19 nt, Homo sapiens
cuguaggaagguacuguau

SEQ ID NO: 1899547 - RNA, 21 nt, Homo sapiens
gauguguaaauggagcuugua

SEQ ID NO: 1899548 - RNA, 15 nt, Homo sapiens
aucuacuucuacauc

SEQ ID NO: 1899549 - RNA, 16 nt, Homo sapiens
ucuaaauagcgauuau

SEQ ID NO: 1899550 - RNA, 14 nt, Homo sapiens
ugauucagucuucu

SEQ ID NO: 1899551 - RNA, 15 nt, Homo sapiens
acugaaccacuugua

SEQ ID NO: 1899552 - RNA, 16 nt, Homo sapiens
aacuugaacuccagga

SEQ ID NO: 1899553 - RNA, 14 nt, Homo sapiens
auccugcaauucca

SEQ ID NO: 1899554 - RNA, 14 nt, Homo sapiens
ugcgugcaugugca

SEQ ID NO: 1899555 - RNA, 14 nt, Homo sapiens
cacacgcacauaua

SEQ ID NO: 1899556 - RNA, 18 nt, Homo sapiens
cugggggcacagcugucu

SEQ ID NO: 1899557 - RNA, 13 nt, Homo sapiens
acugccacuuugc

SEQ ID NO: 1899558 - RNA, 13 nt, Homo sapiens
acuuucacuuuuu

SEQ ID NO: 1899559 - RNA, 15 nt, Homo sapiens
guuggcucacagggc

SEQ ID NO: 1899560 - RNA, 14 nt, Homo sapiens
aaaaagaaccaaaa

SEQ ID NO: 1899561 - RNA, 14 nt, Homo sapiens
accugaaacacugg

SEQ ID NO: 1899562 - RNA, 21 nt, Homo sapiens
aggaccaguucacuugcccug

SEQ ID NO: 1899563 - RNA, 16 nt, Homo sapiens
cugcuucugauaugca

SEQ ID NO: 1899564 - RNA, 16 nt, Homo sapiens
guuauuaacagcugau

SEQ ID NO: 1899565 - RNA, 23 nt, Homo sapiens
aagcucacuggccacaauaccca

SEQ ID NO: 1899566 - RNA, 18 nt, Homo sapiens
ugaagucucugaagugaa

SEQ ID NO: 1899567 - RNA, 15 nt, Homo sapiens
aaguucaauacucau

SEQ ID NO: 1899568 - RNA, 18 nt, Homo sapiens
cugcucagcagaggauau

SEQ ID NO: 1899569 - RNA, 22 nt, Homo sapiens
acaauugcauucguaaacacca

SEQ ID NO: 1899570 - RNA, 21 nt, Homo sapiens
gaagaucaacgccucacugaa

SEQ ID NO: 1899571 - RNA, 17 nt, Homo sapiens
cagaauaacuaccuccu

SEQ ID NO: 1899572 - RNA, 15 nt, Homo sapiens
uucuuuccacugaau

SEQ ID NO: 1899573 - RNA, 15 nt, Homo sapiens
auugacauguacaga

SEQ ID NO: 1899574 - RNA, 22 nt, Homo sapiens
caaaaaguuuaucacacagugu

SEQ ID NO: 1899575 - RNA, 19 nt, Homo sapiens
aucuuauaugggaaaccau

SEQ ID NO: 1899576 - RNA, 20 nt, Homo sapiens
ggcugccgugcacggggcca

SEQ ID NO: 1899577 - RNA, 14 nt, Homo sapiens
ucuugacuagugca

SEQ ID NO: 1899578 - RNA, 21 nt, Homo sapiens
ugccaagaauauauuauauaa

SEQ ID NO: 1899579 - RNA, 11 nt, Homo sapiens
caaacauauuc

SEQ ID NO: 1899580 - RNA, 14 nt, Homo sapiens
aaucuaaacuuuau

SEQ ID NO: 1899581 - RNA, 18 nt, Homo sapiens
agccacuggacugacgac

SEQ ID NO: 1899582 - RNA, 22 nt, Homo sapiens
uguguaaccagcagucacaggu

SEQ ID NO: 1899583 - RNA, 23 nt, Homo sapiens
acagcucugacuuuacacucggc

SEQ ID NO: 1899584 - RNA, 15 nt, Homo sapiens
auucacuuuaccuuc

SEQ ID NO: 1899585 - RNA, 12 nt, Homo sapiens
ccccaacuugag

SEQ ID NO: 1899586 - RNA, 17 nt, Homo sapiens
agggggaagaagaagag

SEQ ID NO: 1899587 - RNA, 21 nt, Homo sapiens
auccuuuuagucugcauauau

SEQ ID NO: 1899588 - RNA, 16 nt, Homo sapiens
acuguauaacauuaag

SEQ ID NO: 1899589 - RNA, 23 nt, Homo sapiens
ccagccugugcgccgggggaccu

SEQ ID NO: 1899590 - RNA, 22 nt, Homo sapiens
augacguccucucaacucucuu

SEQ ID NO: 1899591 - RNA, 14 nt, Homo sapiens
accaaaagugcucc

SEQ ID NO: 1899592 - RNA, 15 nt, Homo sapiens
uaaagagaacucugg

SEQ ID NO: 1899593 - RNA, 19 nt, Homo sapiens
agacagcagggacaagaua

SEQ ID NO: 1899594 - RNA, 24 nt, Homo sapiens
cuaaucaagaaaaacaucuuuggc

SEQ ID NO: 1899595 - RNA, 22 nt, Homo sapiens
uguggccaggccuuacaucugg

SEQ ID NO: 1899596 - RNA, 18 nt, Homo sapiens
cugaaaaucgaguuuuuc

SEQ ID NO: 1899597 - RNA, 13 nt, Homo sapiens
guuuuuacuguga

SEQ ID NO: 1899598 - RNA, 19 nt, Homo sapiens
uucccaacgugcaaagcca

SEQ ID NO: 1899599 - RNA, 21 nt, Homo sapiens
ucauccuagucuagcauucug

SEQ ID NO: 1899600 - RNA, 18 nt, Homo sapiens
acaaaacaucuuaggcac

SEQ ID NO: 1899601 - RNA, 17 nt, Homo sapiens
ggcagagguuguaguga

SEQ ID NO: 1899602 - RNA, 12 nt, Homo sapiens
aaguccacuuua

SEQ ID NO: 1899603 - RNA, 18 nt, Homo sapiens
agacccugaugcagguca

SEQ ID NO: 1899604 - RNA, 20 nt, Homo sapiens
aggaagggaagagcauguaa

SEQ ID NO: 1899605 - RNA, 11 nt, Homo sapiens
uuaaaaccauu

SEQ ID NO: 1899606 - RNA, 14 nt, Homo sapiens
aggugugggccaga

SEQ ID NO: 1899607 - RNA, 24 nt, Homo sapiens
ugcacuuuguucuggcucuuccag

SEQ ID NO: 1899608 - RNA, 13 nt, Homo sapiens
gauuauagauucu

SEQ ID NO: 1899609 - RNA, 17 nt, Homo sapiens
acuugauguguuaucuc

SEQ ID NO: 1899610 - RNA, 13 nt, Homo sapiens
ucccacacaggcu

SEQ ID NO: 1899611 - RNA, 20 nt, Homo sapiens
cugcccaaacauaaagagaa

SEQ ID NO: 1899612 - RNA, 11 nt, Homo sapiens
aaaagcacaug

SEQ ID NO: 1899613 - RNA, 22 nt, Homo sapiens
ggacugcagaacacccucacca

SEQ ID NO: 1899614 - RNA, 21 nt, Homo sapiens
gcuguccucucagaacuccug

SEQ ID NO: 1899615 - RNA, 18 nt, Homo sapiens
cuuuuguuaaugcauugu

SEQ ID NO: 1899616 - RNA, 17 nt, Homo sapiens
uauuacauuuucaguga

SEQ ID NO: 1899617 - RNA, 13 nt, Homo sapiens
gggccacuggcau

SEQ ID NO: 1899618 - RNA, 21 nt, Homo sapiens
gucuuucaccgggcaauccaa

SEQ ID NO: 1899619 - RNA, 13 nt, Homo sapiens
cagccuccagggc

SEQ ID NO: 1899620 - RNA, 19 nt, Homo sapiens
ucaaaguuaaccuaccugu

SEQ ID NO: 1899621 - RNA, 13 nt, Homo sapiens
agggccucagucu

SEQ ID NO: 1899622 - RNA, 14 nt, Homo sapiens
agaugaugcucagu

SEQ ID NO: 1899623 - RNA, 22 nt, Homo sapiens
cgcuauuccucacucagaggaa

SEQ ID NO: 1899624 - RNA, 21 nt, Homo sapiens
agcaaacguacgggaaugugc

SEQ ID NO: 1899625 - RNA, 14 nt, Homo sapiens
ccucuacuugggag

SEQ ID NO: 1899626 - RNA, 18 nt, Homo sapiens
ugcacucuagccuggcaa

SEQ ID NO: 1899627 - RNA, 15 nt, Homo sapiens
gaucacuccagugca

SEQ ID NO: 1899628 - RNA, 18 nt, Homo sapiens
gucaugcugucaguuccc

SEQ ID NO: 1899629 - RNA, 23 nt, Homo sapiens
auuuacuguggcuucuuaaucuu

SEQ ID NO: 1899630 - RNA, 15 nt, Homo sapiens
auguccaccacugac

SEQ ID NO: 1899631 - RNA, 13 nt, Homo sapiens
cuucuagaucugg

SEQ ID NO: 1899632 - RNA, 19 nt, Homo sapiens
cucucacuccccagccugg

SEQ ID NO: 1899633 - RNA, 19 nt, Homo sapiens
caugguaauuaugugauau

SEQ ID NO: 1899634 - RNA, 15 nt, Homo sapiens
agugagaucuuacag

SEQ ID NO: 1899635 - RNA, 17 nt, Homo sapiens
auucuuuaaacaaauau

SEQ ID NO: 1899636 - RNA, 15 nt, Homo sapiens
uuagaauuauaucac

SEQ ID NO: 1899637 - RNA, 19 nt, Homo sapiens
acuuggcacuccuggacaa

SEQ ID NO: 1899638 - RNA, 22 nt, Homo sapiens
gagaaaauauuugcgagucaua

SEQ ID NO: 1899639 - RNA, 21 nt, Homo sapiens
aaugcccucaggggacuugaa

SEQ ID NO: 1899640 - RNA, 14 nt, Homo sapiens
aggauugcuacugu

SEQ ID NO: 1899641 - RNA, 21 nt, Homo sapiens
uaaaacauguuugcacuuguc

SEQ ID NO: 1899642 - RNA, 16 nt, Homo sapiens
aguuguugacugugau

SEQ ID NO: 1899643 - RNA, 13 nt, Homo sapiens
cacguguguauug

SEQ ID NO: 1899644 - RNA, 14 nt, Homo sapiens
auugaaauuuugca

SEQ ID NO: 1899645 - RNA, 16 nt, Homo sapiens
ccuaaauuucugccaa

SEQ ID NO: 1899646 - RNA, 19 nt, Homo sapiens
agaaguugcuaagugugcu

SEQ ID NO: 1899647 - RNA, 22 nt, Homo sapiens
caggugaggguuacacugaaga

SEQ ID NO: 1899648 - RNA, 18 nt, Homo sapiens
caauaugagucucaauaa

SEQ ID NO: 1899649 - RNA, 14 nt, Homo sapiens
gagggagaggugga

SEQ ID NO: 1899650 - RNA, 17 nt, Homo sapiens
aauugugcgacuucaca

SEQ ID NO: 1899651 - RNA, 20 nt, Homo sapiens
ugacagagcgagacuccauc

SEQ ID NO: 1899652 - RNA, 15 nt, Homo sapiens
agagggcagggucca

SEQ ID NO: 1899653 - RNA, 21 nt, Homo sapiens
aguguauuuuauguguggccc

SEQ ID NO: 1899654 - RNA, 14 nt, Homo sapiens
auaaggauucugaa

SEQ ID NO: 1899655 - RNA, 18 nt, Homo sapiens
gcacaugacauagcacuu

SEQ ID NO: 1899656 - RNA, 14 nt, Homo sapiens
acagcacagccaac

SEQ ID NO: 1899657 - RNA, 14 nt, Homo sapiens
agcacggacaauaa

SEQ ID NO: 1899658 - RNA, 12 nt, Homo sapiens
ucuuuauacuua

SEQ ID NO: 1899659 - RNA, 13 nt, Homo sapiens
ucuucaaggugua

SEQ ID NO: 1899660 - RNA, 19 nt, Homo sapiens
gaagaccccuuccucuuca

SEQ ID NO: 1899661 - RNA, 20 nt, Homo sapiens
uugugauauauuagggacac

SEQ ID NO: 1899662 - RNA, 21 nt, Homo sapiens
ccuugugaggguugcuucaau

SEQ ID NO: 1899663 - RNA, 14 nt, Homo sapiens
auauucucuaguca

SEQ ID NO: 1899664 - RNA, 22 nt, Homo sapiens
gaaagagauuuucacccaucca

SEQ ID NO: 1899665 - RNA, 22 nt, Homo sapiens
aacuguuuaacgugagguuuca

SEQ ID NO: 1899666 - RNA, 16 nt, Homo sapiens
uaagaggacgccuuca

SEQ ID NO: 1899667 - RNA, 17 nt, Homo sapiens
cagacgggucugagacu

SEQ ID NO: 1899668 - RNA, 16 nt, Homo sapiens
auugccuccauucucc

SEQ ID NO: 1899669 - RNA, 19 nt, Homo sapiens
gcccaguuagaagcgacuu

SEQ ID NO: 1899670 - RNA, 18 nt, Homo sapiens
gccccucuuccaaaggca

SEQ ID NO: 1899671 - RNA, 15 nt, Homo sapiens
caaaaugauuuugaa

SEQ ID NO: 1899672 - RNA, 14 nt, Homo sapiens
cagaccaccugcca

SEQ ID NO: 1899673 - RNA, 20 nt, Homo sapiens
auguguguguguuguguuaa

SEQ ID NO: 1899674 - RNA, 22 nt, Homo sapiens
cuguauaaguuauuuuuguaca

SEQ ID NO: 1899675 - RNA, 19 nt, Homo sapiens
ugccauugacuucuuccca

SEQ ID NO: 1899676 - RNA, 16 nt, Homo sapiens
gcugaggccacacuca

SEQ ID NO: 1899677 - RNA, 21 nt, Homo sapiens
cccagcuucauuaugcagcug

SEQ ID NO: 1899678 - RNA, 11 nt, Homo sapiens
gaacucuccau

SEQ ID NO: 1899679 - RNA, 14 nt, Homo sapiens
ugguguacuguguu

SEQ ID NO: 1899680 - RNA, 14 nt, Homo sapiens
uuaagagacacucc

SEQ ID NO: 1899681 - RNA, 18 nt, Homo sapiens
acaugaagacaccaucuc

SEQ ID NO: 1899682 - RNA, 16 nt, Homo sapiens
ucaccacaugugcaca

SEQ ID NO: 1899683 - RNA, 20 nt, Homo sapiens
aucucuaaacugcuguuaau

SEQ ID NO: 1899684 - RNA, 16 nt, Homo sapiens
ccccagcucgcuggcu

SEQ ID NO: 1899685 - RNA, 22 nt, Homo sapiens
uuuccucagugcauuugugcua

SEQ ID NO: 1899686 - RNA, 17 nt, Homo sapiens
cccagacccccauucug

SEQ ID NO: 1899687 - RNA, 23 nt, Homo sapiens
ggaggcaccacgaagcugugaac

SEQ ID NO: 1899688 - RNA, 14 nt, Homo sapiens
ccagaaaaucugaa

SEQ ID NO: 1899689 - RNA, 14 nt, Homo sapiens
uaaauaaacauaua

SEQ ID NO: 1899690 - RNA, 14 nt, Homo sapiens
caugagaauaagag

SEQ ID NO: 1899691 - RNA, 14 nt, Homo sapiens
uuuagaaacuaaga

SEQ ID NO: 1899692 - RNA, 20 nt, Homo sapiens
acauccuuauucagccuuau

SEQ ID NO: 1899693 - RNA, 14 nt, Homo sapiens
ugccgcuaccuccc

SEQ ID NO: 1899694 - RNA, 17 nt, Homo sapiens
ucuucaucccacuccaa

SEQ ID NO: 1899695 - RNA, 19 nt, Homo sapiens
gcguguguagaguuaagaa

SEQ ID NO: 1899696 - RNA, 16 nt, Homo sapiens
agaggcccggugcagc

SEQ ID NO: 1899697 - RNA, 14 nt, Homo sapiens
auaacgucugccuu

SEQ ID NO: 1899698 - RNA, 22 nt, Homo sapiens
cccaugcacagaacaagccaca

SEQ ID NO: 1899699 - RNA, 18 nt, Homo sapiens
aagacuggauuugcagaa

SEQ ID NO: 1899700 - RNA, 12 nt, Homo sapiens
gaaaagcacuua

SEQ ID NO: 1899701 - RNA, 18 nt, Homo sapiens
ugguuauccaauugcucu

SEQ ID NO: 1899702 - RNA, 22 nt, Homo sapiens
uacaguuaauuaugugcauauu

SEQ ID NO: 1899703 - RNA, 23 nt, Homo sapiens
aaucugaaauaaaaggugcuguu

SEQ ID NO: 1899704 - RNA, 12 nt, Homo sapiens
cacuuaauaauu

SEQ ID NO: 1899705 - RNA, 23 nt, Homo sapiens
caagccccgcccccucugcccca

SEQ ID NO: 1899706 - RNA, 23 nt, Homo sapiens
gagggcuuccucuagaagccaag

SEQ ID NO: 1899707 - RNA, 19 nt, Homo sapiens
ucuuuguaaugucaccacc

SEQ ID NO: 1899708 - RNA, 24 nt, Homo sapiens
auaccacccaaaaucauaaugcca

SEQ ID NO: 1899709 - RNA, 14 nt, Homo sapiens
aaaauacauaguga

SEQ ID NO: 1899710 - RNA, 23 nt, Homo sapiens
agucagaggacaccauccaagaa

SEQ ID NO: 1899711 - RNA, 23 nt, Homo sapiens
cugcaugaagguuuucuuuagaa

SEQ ID NO: 1899712 - RNA, 17 nt, Homo sapiens
uguccggaggauauuaa

SEQ ID NO: 1899713 - RNA, 12 nt, Homo sapiens
cuccacucugag

SEQ ID NO: 1899714 - RNA, 16 nt, Homo sapiens
cagcuguggcuucuag

SEQ ID NO: 1899715 - RNA, 20 nt, Homo sapiens
agacuucaauauuaaaugac

SEQ ID NO: 1899716 - RNA, 22 nt, Homo sapiens
ucagaggcguuugaaucagagu

SEQ ID NO: 1899717 - RNA, 14 nt, Homo sapiens
uuuaaaagucacau

SEQ ID NO: 1899718 - RNA, 12 nt, Homo sapiens
aaagaagcuuua

SEQ ID NO: 1899719 - RNA, 12 nt, Homo sapiens
auaaaagcuaug

SEQ ID NO: 1899720 - RNA, 16 nt, Homo sapiens
agcucccucgucuuca

SEQ ID NO: 1899721 - RNA, 20 nt, Homo sapiens
uggauuuaauaccauuuuca

SEQ ID NO: 1899722 - RNA, 19 nt, Homo sapiens
cuuaaccuuugcuauguaa

SEQ ID NO: 1899723 - RNA, 16 nt, Homo sapiens
auuguuaaccacagcu

SEQ ID NO: 1899724 - RNA, 15 nt, Homo sapiens
gugcugcacaaaagc

SEQ ID NO: 1899725 - RNA, 19 nt, Homo sapiens
caacgggccagcucuagua

SEQ ID NO: 1899726 - RNA, 13 nt, Homo sapiens
caaugcauaaugu

SEQ ID NO: 1899727 - RNA, 19 nt, Homo sapiens
aaaugugugugaugugaca

SEQ ID NO: 1899728 - RNA, 15 nt, Homo sapiens
guggaaccuagggaa

SEQ ID NO: 1899729 - RNA, 11 nt, Homo sapiens
gagacuugccu

SEQ ID NO: 1899730 - RNA, 14 nt, Homo sapiens
ggcacuugcugagg

SEQ ID NO: 1899731 - RNA, 12 nt, Homo sapiens
acagcagcucca

SEQ ID NO: 1899732 - RNA, 16 nt, Homo sapiens
ugguaauuaaggcauc

SEQ ID NO: 1899733 - RNA, 13 nt, Homo sapiens
cucagugcuguaa

SEQ ID NO: 1899734 - RNA, 13 nt, Homo sapiens
gaaaacaugacuu

SEQ ID NO: 1899735 - RNA, 13 nt, Homo sapiens
uaauacauuacau

SEQ ID NO: 1899736 - RNA, 18 nt, Homo sapiens
gugcagaugccugcagug

SEQ ID NO: 1899737 - RNA, 23 nt, Homo sapiens
caguauuguuuugguuugcuacu

SEQ ID NO: 1899738 - RNA, 23 nt, Homo sapiens
gcccuuccucuucccccuuccac

SEQ ID NO: 1899739 - RNA, 19 nt, Homo sapiens
uuuggacauggcucacaaa

SEQ ID NO: 1899740 - RNA, 17 nt, Homo sapiens
auuucuucuacugcuau

SEQ ID NO: 1899741 - RNA, 22 nt, Homo sapiens
ucccaaagccaacgaagugcca

SEQ ID NO: 1899742 - RNA, 17 nt, Homo sapiens
uaaacuaugaggacugc

SEQ ID NO: 1899743 - RNA, 13 nt, Homo sapiens
uagagauggagga

SEQ ID NO: 1899744 - RNA, 18 nt, Homo sapiens
uggucaauauagcaagac

SEQ ID NO: 1899745 - RNA, 22 nt, Homo sapiens
gagagagcuuccuguuucuaag

SEQ ID NO: 1899746 - RNA, 16 nt, Homo sapiens
acugcaaaccauggug

SEQ ID NO: 1899747 - RNA, 13 nt, Homo sapiens
aagcagccuccac

SEQ ID NO: 1899748 - RNA, 20 nt, Homo sapiens
uaguuaccaagccugccaug

SEQ ID NO: 1899749 - RNA, 14 nt, Homo sapiens
auuuuaugauagau

SEQ ID NO: 1899750 - RNA, 16 nt, Homo sapiens
auuggacuuccauuug

SEQ ID NO: 1899751 - RNA, 18 nt, Homo sapiens
uuucuguucccuugccau

SEQ ID NO: 1899752 - RNA, 17 nt, Homo sapiens
cugucucugucauggua

SEQ ID NO: 1899753 - RNA, 20 nt, Homo sapiens
gcugaaaggggaagaccuga

SEQ ID NO: 1899754 - RNA, 12 nt, Homo sapiens
agaugggggccu

SEQ ID NO: 1899755 - RNA, 12 nt, Homo sapiens
aauuucucuuaa

SEQ ID NO: 1899756 - RNA, 19 nt, Homo sapiens
ugagucagugccaugacug

SEQ ID NO: 1899757 - RNA, 14 nt, Homo sapiens
caccaacgagguga

SEQ ID NO: 1899758 - RNA, 13 nt, Homo sapiens
uauuaccauguaa

SEQ ID NO: 1899759 - RNA, 22 nt, Homo sapiens
cgcuccuuugugugugugucag

SEQ ID NO: 1899760 - RNA, 22 nt, Homo sapiens
aggguaagugcuugcuguuccc

SEQ ID NO: 1899761 - RNA, 18 nt, Homo sapiens
cucccugcuagcacagag

SEQ ID NO: 1899762 - RNA, 15 nt, Homo sapiens
cucgcagcaaagugu

SEQ ID NO: 1899763 - RNA, 12 nt, Homo sapiens
agcugauucacu

SEQ ID NO: 1899764 - RNA, 22 nt, Homo sapiens
uauaacuggaguaauaaaacau

SEQ ID NO: 1899765 - RNA, 14 nt, Homo sapiens
ggcgucccuaccuc

SEQ ID NO: 1899766 - RNA, 22 nt, Homo sapiens
gucacuaucuucacaagugugu

SEQ ID NO: 1899767 - RNA, 20 nt, Homo sapiens
cccucccuguuccccagaga

SEQ ID NO: 1899768 - RNA, 15 nt, Homo sapiens
cauucuuuugccaau

SEQ ID NO: 1899769 - RNA, 14 nt, Homo sapiens
uuuaucugcugaaa

SEQ ID NO: 1899770 - RNA, 16 nt, Homo sapiens
uagcucgugugcuuag

SEQ ID NO: 1899771 - RNA, 13 nt, Homo sapiens
cuccugacagcaa

SEQ ID NO: 1899772 - RNA, 14 nt, Homo sapiens
uaucagugugcaau

SEQ ID NO: 1899773 - RNA, 13 nt, Homo sapiens
gcuucuagcagcu

SEQ ID NO: 1899774 - RNA, 19 nt, Homo sapiens
uaucaagaggcugagacag

SEQ ID NO: 1899775 - RNA, 23 nt, Homo sapiens
aauauucagaaaaugaagcacga

SEQ ID NO: 1899776 - RNA, 18 nt, Homo sapiens
uauuucugauguguucuc

SEQ ID NO: 1899777 - RNA, 17 nt, Homo sapiens
ugcaguagcacgaucuc

SEQ ID NO: 1899778 - RNA, 13 nt, Homo sapiens
acaggcacuuggc

SEQ ID NO: 1899779 - RNA, 17 nt, Homo sapiens
gaucgguucugugccuu

SEQ ID NO: 1899780 - RNA, 16 nt, Homo sapiens
cuucuccaaugcucug

SEQ ID NO: 1899781 - RNA, 18 nt, Homo sapiens
cacaguccccagacucag

SEQ ID NO: 1899782 - RNA, 21 nt, Homo sapiens
acagcuacucuccccacgagg

SEQ ID NO: 1899783 - RNA, 16 nt, Homo sapiens
augcguuuaaucacau

SEQ ID NO: 1899784 - RNA, 14 nt, Homo sapiens
cccacuagcauuuu

SEQ ID NO: 1899785 - RNA, 12 nt, Homo sapiens
ccuggaccccag

SEQ ID NO: 1899786 - RNA, 15 nt, Homo sapiens
caccauguuggccag

SEQ ID NO: 1899787 - RNA, 13 nt, Homo sapiens
gucccgcacagug

SEQ ID NO: 1899788 - RNA, 12 nt, Homo sapiens
gucuggcccaaa

SEQ ID NO: 1899789 - RNA, 17 nt, Homo sapiens
uauucuguauccgugaa

SEQ ID NO: 1899790 - RNA, 22 nt, Homo sapiens
caugauuuuuuuuuuucagucc

SEQ ID NO: 1899791 - RNA, 19 nt, Homo sapiens
uucccugggguacuacucu

SEQ ID NO: 1899792 - RNA, 13 nt, Homo sapiens
caaaagucucaau

SEQ ID NO: 1899793 - RNA, 19 nt, Homo sapiens
gagacuccaucucaaaaaa

SEQ ID NO: 1899794 - RNA, 17 nt, Homo sapiens
uccugggaauaugcuag

SEQ ID NO: 1899795 - RNA, 13 nt, Homo sapiens
aaagccuauucac

SEQ ID NO: 1899796 - RNA, 20 nt, Homo sapiens
uuucaccucccaaacccagc

SEQ ID NO: 1899797 - RNA, 20 nt, Homo sapiens
uucacuucuaccuacauauu

SEQ ID NO: 1899798 - RNA, 14 nt, Homo sapiens
cgggguguggaauc

SEQ ID NO: 1899799 - RNA, 22 nt, Homo sapiens
auaccuguguuucuugccucau

SEQ ID NO: 1899800 - RNA, 14 nt, Homo sapiens
gaaggaacuuccag

SEQ ID NO: 1899801 - RNA, 13 nt, Homo sapiens
cuuucacuuugaa

SEQ ID NO: 1899802 - RNA, 21 nt, Homo sapiens
ucuuggauggcguucuccuau

SEQ ID NO: 1899803 - RNA, 19 nt, Homo sapiens
uccauauuuuauuaucuua

SEQ ID NO: 1899804 - RNA, 18 nt, Homo sapiens
gaacaguauuacaguguc

SEQ ID NO: 1899805 - RNA, 21 nt, Homo sapiens
uguaaacagcuaauaaugaag

SEQ ID NO: 1899806 - RNA, 21 nt, Homo sapiens
aaacaauuuuuuuuuuccucu

SEQ ID NO: 1899807 - RNA, 14 nt, Homo sapiens
aguaccacacauau

SEQ ID NO: 1899808 - RNA, 19 nt, Homo sapiens
uauguaugacuuugugcca

SEQ ID NO: 1899809 - RNA, 15 nt, Homo sapiens
cccuuaucugaccuc

SEQ ID NO: 1899810 - RNA, 14 nt, Homo sapiens
cugacagaaaugca

SEQ ID NO: 1899811 - RNA, 17 nt, Homo sapiens
uuacugugaaacuggca

SEQ ID NO: 1899812 - RNA, 19 nt, Homo sapiens
ucuuugaacuguguggucu

SEQ ID NO: 1899813 - RNA, 16 nt, Homo sapiens
ucaacugagaagccaa

SEQ ID NO: 1899814 - RNA, 18 nt, Homo sapiens
cuuagccuaaacaaccug

SEQ ID NO: 1899815 - RNA, 17 nt, Homo sapiens
cucccuuaaucugccag

SEQ ID NO: 1899816 - RNA, 22 nt, Homo sapiens
cugggauuucucccucucagug

SEQ ID NO: 1899817 - RNA, 22 nt, Homo sapiens
uuuaaauguaaaauauuugaga

SEQ ID NO: 1899818 - RNA, 19 nt, Homo sapiens
ggaacagcaggugccagag

SEQ ID NO: 1899819 - RNA, 19 nt, Homo sapiens
uggcacuuugaaggggccu

SEQ ID NO: 1899820 - RNA, 15 nt, Homo sapiens
cccuaauccaucuuc

SEQ ID NO: 1899821 - RNA, 22 nt, Homo sapiens
aaggggcaaagaaaagccagag

SEQ ID NO: 1899822 - RNA, 23 nt, Homo sapiens
uuaaguuacaauuacaucucuaa

SEQ ID NO: 1899823 - RNA, 17 nt, Homo sapiens
uaggaaggcagcauucc

SEQ ID NO: 1899824 - RNA, 23 nt, Homo sapiens
ucgccaucuucuucccuuaacuc

SEQ ID NO: 1899825 - RNA, 12 nt, Homo sapiens
ugugagcaccug

SEQ ID NO: 1899826 - RNA, 21 nt, Homo sapiens
ccuggacacgcugguggugcu

SEQ ID NO: 1899827 - RNA, 13 nt, Homo sapiens
cauguagcauaua

SEQ ID NO: 1899828 - RNA, 13 nt, Homo sapiens
ucgccggccuugu

SEQ ID NO: 1899829 - RNA, 13 nt, Homo sapiens
cccccacugccac

SEQ ID NO: 1899830 - RNA, 17 nt, Homo sapiens
cuggagacuaaccccac

SEQ ID NO: 1899831 - RNA, 21 nt, Homo sapiens
ugauaggagacuuguacaguu

SEQ ID NO: 1899832 - RNA, 23 nt, Homo sapiens
caaaaguucuuugggacaaaaca

SEQ ID NO: 1899833 - RNA, 18 nt, Homo sapiens
ucagggaacugacccuca

SEQ ID NO: 1899834 - RNA, 20 nt, Homo sapiens
gagccaggagaccugcucuc

SEQ ID NO: 1899835 - RNA, 18 nt, Homo sapiens
cuuugggauucuuuccau

SEQ ID NO: 1899836 - RNA, 23 nt, Homo sapiens
cuggucugugcugcccugcucug

SEQ ID NO: 1899837 - RNA, 13 nt, Homo sapiens
aaaaguuagucaa

SEQ ID NO: 1899838 - RNA, 24 nt, Homo sapiens
cacauucuuauuaggauuccaccu

SEQ ID NO: 1899839 - RNA, 21 nt, Homo sapiens
gacuggauggaaacuuccugc

SEQ ID NO: 1899840 - RNA, 16 nt, Homo sapiens
gacuccaggaacaaaa

SEQ ID NO: 1899841 - RNA, 14 nt, Homo sapiens
aguaauugcaagag

SEQ ID NO: 1899842 - RNA, 16 nt, Homo sapiens
agacuacauuugugaa

SEQ ID NO: 1899843 - RNA, 16 nt, Homo sapiens
cauuuccuggucagug

SEQ ID NO: 1899844 - RNA, 17 nt, Homo sapiens
uaauaggcguaacuaau

SEQ ID NO: 1899845 - RNA, 12 nt, Homo sapiens
gacacugugcua

SEQ ID NO: 1899846 - RNA, 18 nt, Homo sapiens
ugagacaacaaauggguc

SEQ ID NO: 1899847 - RNA, 13 nt, Homo sapiens
ucuuuacuagaua

SEQ ID NO: 1899848 - RNA, 22 nt, Homo sapiens
cugggauuacaggcaugagcca

SEQ ID NO: 1899849 - RNA, 15 nt, Homo sapiens
cggccugcucgccca

SEQ ID NO: 1899850 - RNA, 19 nt, Homo sapiens
ugcccuucacuguugcuua

SEQ ID NO: 1899851 - RNA, 18 nt, Homo sapiens
ugcugcaucuuauagcac

SEQ ID NO: 1899852 - RNA, 18 nt, Homo sapiens
auguuuucuaccagugug

SEQ ID NO: 1899853 - RNA, 13 nt, Homo sapiens
uuuaguuauauuc

SEQ ID NO: 1899854 - RNA, 23 nt, Homo sapiens
uccuuggggcacagucauucaca

SEQ ID NO: 1899855 - RNA, 21 nt, Homo sapiens
aaauagaagaguuuaaaagca

SEQ ID NO: 1899856 - RNA, 22 nt, Homo sapiens
ggacacccaacacuuuuuccau

SEQ ID NO: 1899857 - RNA, 23 nt, Homo sapiens
ccugaucccugugccucuuccca

SEQ ID NO: 1899858 - RNA, 18 nt, Homo sapiens
ugaagauuucauggacau

SEQ ID NO: 1899859 - RNA, 16 nt, Homo sapiens
agaaauauauccugug

SEQ ID NO: 1899860 - RNA, 19 nt, Homo sapiens
cagccuugggcaacugcag

SEQ ID NO: 1899861 - RNA, 22 nt, Homo sapiens
agaagagcagcuucggugugca

SEQ ID NO: 1899862 - RNA, 12 nt, Homo sapiens
ggagaaucucag

SEQ ID NO: 1899863 - RNA, 22 nt, Homo sapiens
gaaaacuagauugcuaguuuau

SEQ ID NO: 1899864 - RNA, 15 nt, Homo sapiens
auacacuuacacuuu

SEQ ID NO: 1899865 - RNA, 21 nt, Homo sapiens
uccacuggcuuuugccuguaa

SEQ ID NO: 1899866 - RNA, 23 nt, Homo sapiens
ucagccuacuuucacacuaagaa

SEQ ID NO: 1899867 - RNA, 15 nt, Homo sapiens
agagaggccaggugc

SEQ ID NO: 1899868 - RNA, 15 nt, Homo sapiens
ugaaaugacugucua

SEQ ID NO: 1899869 - RNA, 20 nt, Homo sapiens
cuacaaaaaauaaaaacacu

SEQ ID NO: 1899870 - RNA, 14 nt, Homo sapiens
uuaugcacccaaga

SEQ ID NO: 1899871 - RNA, 20 nt, Homo sapiens
uauaaaaccauguaaaguca

SEQ ID NO: 1899872 - RNA, 18 nt, Homo sapiens
guuuauccuuagcucaca

SEQ ID NO: 1899873 - RNA, 16 nt, Homo sapiens
cuacaguaaugaaaug

SEQ ID NO: 1899874 - RNA, 13 nt, Homo sapiens
uuagaagacauuu

SEQ ID NO: 1899875 - RNA, 21 nt, Homo sapiens
gacaacauugcauugugacua

SEQ ID NO: 1899876 - RNA, 17 nt, Homo sapiens
aagaaaguuaacugacu

SEQ ID NO: 1899877 - RNA, 18 nt, Homo sapiens
cagggggccagucccuga

SEQ ID NO: 1899878 - RNA, 21 nt, Homo sapiens
uauggcugaauaauauugcau

SEQ ID NO: 1899879 - RNA, 16 nt, Homo sapiens
ggaugggaugcacucu

SEQ ID NO: 1899880 - RNA, 19 nt, Homo sapiens
gccacaaaacugacaguaa

SEQ ID NO: 1899881 - RNA, 23 nt, Homo sapiens
aaacuuguuauugugaaugauuc

SEQ ID NO: 1899882 - RNA, 15 nt, Homo sapiens
acagacacuuuucaa

SEQ ID NO: 1899883 - RNA, 18 nt, Homo sapiens
uucucauaccuuccccac

SEQ ID NO: 1899884 - RNA, 22 nt, Homo sapiens
aauauuagacaaaguucauuca

SEQ ID NO: 1899885 - RNA, 14 nt, Homo sapiens
cugcacccaugaga

SEQ ID NO: 1899886 - RNA, 23 nt, Homo sapiens
gagguuugucaacaaaaagacau

SEQ ID NO: 1899887 - RNA, 13 nt, Homo sapiens
gcaaaguacuugu

SEQ ID NO: 1899888 - RNA, 23 nt, Homo sapiens
caaagcuuggugucuuggcacug

SEQ ID NO: 1899889 - RNA, 20 nt, Homo sapiens
cacggccucuggggagaccg

SEQ ID NO: 1899890 - RNA, 23 nt, Homo sapiens
gcuuuacagcacuguauguguug

SEQ ID NO: 1899891 - RNA, 13 nt, Homo sapiens
cugcauggcacau

SEQ ID NO: 1899892 - RNA, 22 nt, Homo sapiens
aacacacuuuggucauuucuca

SEQ ID NO: 1899893 - RNA, 20 nt, Homo sapiens
gacuauggauguguucucua

SEQ ID NO: 1899894 - RNA, 19 nt, Homo sapiens
gcauuuauuuauacagugc

SEQ ID NO: 1899895 - RNA, 23 nt, Homo sapiens
aauggggguguaguauuuuugcc

SEQ ID NO: 1899896 - RNA, 22 nt, Homo sapiens
uuuuaagaacaauguugcaaca

SEQ ID NO: 1899897 - RNA, 15 nt, Homo sapiens
cugucugugcacaug

SEQ ID NO: 1899898 - RNA, 15 nt, Homo sapiens
ggcuccugaauguga

SEQ ID NO: 1899899 - RNA, 20 nt, Homo sapiens
uucgagagcagccuggccaa

SEQ ID NO: 1899900 - RNA, 13 nt, Homo sapiens
acugacuugcuca

SEQ ID NO: 1899901 - RNA, 19 nt, Homo sapiens
aagcacuuuuccugucuca

SEQ ID NO: 1899902 - RNA, 20 nt, Homo sapiens
gacagccaagggcagaucac

SEQ ID NO: 1899903 - RNA, 15 nt, Homo sapiens
aaaugaaagcaugug

SEQ ID NO: 1899904 - RNA, 15 nt, Homo sapiens
guauuguugaaaaag

SEQ ID NO: 1899905 - RNA, 18 nt, Homo sapiens
gaaucauuaauacaaaga

SEQ ID NO: 1899906 - RNA, 22 nt, Homo sapiens
uguuuuagcuccuugacuccuu

SEQ ID NO: 1899907 - RNA, 13 nt, Homo sapiens
ccauacauaauaa

SEQ ID NO: 1899908 - RNA, 15 nt, Homo sapiens
cuucucaacccaaga

SEQ ID NO: 1899909 - RNA, 22 nt, Homo sapiens
aagauagaugcacuuaugcagu

SEQ ID NO: 1899910 - RNA, 16 nt, Homo sapiens
agucuucuguaauuca

SEQ ID NO: 1899911 - RNA, 18 nt, Homo sapiens
gugguauacauguguaca

SEQ ID NO: 1899912 - RNA, 22 nt, Homo sapiens
cucauuacuggguauauaccca

SEQ ID NO: 1899913 - RNA, 22 nt, Homo sapiens
uaccucaaccaaugccaaaaaa

SEQ ID NO: 1899914 - RNA, 17 nt, Homo sapiens
cacgcaagugugugagu

SEQ ID NO: 1899915 - RNA, 13 nt, Homo sapiens
uuauguucaguca

SEQ ID NO: 1899916 - RNA, 14 nt, Homo sapiens
cugaagcugagcua

SEQ ID NO: 1899917 - RNA, 14 nt, Homo sapiens
gcugcucacucccg

SEQ ID NO: 1899918 - RNA, 22 nt, Homo sapiens
gacuuucccaaauguauugauu

SEQ ID NO: 1899919 - RNA, 15 nt, Homo sapiens
aaacacaaccuacuc

SEQ ID NO: 1899920 - RNA, 17 nt, Homo sapiens
acagugacuucugagau

SEQ ID NO: 1899921 - RNA, 17 nt, Homo sapiens
ucaauguuuagcagauu

SEQ ID NO: 1899922 - RNA, 19 nt, Homo sapiens
agaagauuuuaugcugcug

SEQ ID NO: 1899923 - RNA, 17 nt, Homo sapiens
cauauuuacaaccuaga

SEQ ID NO: 1899924 - RNA, 14 nt, Homo sapiens
acccccucccauuu

SEQ ID NO: 1899925 - RNA, 18 nt, Homo sapiens
ugagcagagagcagcagc

SEQ ID NO: 1899926 - RNA, 16 nt, Homo sapiens
acuacugaacuguuac

SEQ ID NO: 1899927 - RNA, 18 nt, Homo sapiens
gcacagagagggggccac

SEQ ID NO: 1899928 - RNA, 11 nt, Homo sapiens
uucacucagcu

SEQ ID NO: 1899929 - RNA, 12 nt, Homo sapiens
guaaauucugua

SEQ ID NO: 1899930 - RNA, 20 nt, Homo sapiens
uguccaggcuggagugcaau

SEQ ID NO: 1899931 - RNA, 18 nt, Homo sapiens
caucucagucauccugca

SEQ ID NO: 1899932 - RNA, 23 nt, Homo sapiens
aacacgaauugcucaaugcauga

SEQ ID NO: 1899933 - RNA, 15 nt, Homo sapiens
gaaguggacauucua

SEQ ID NO: 1899934 - RNA, 22 nt, Homo sapiens
ugugaaggccucgcaggaagac

SEQ ID NO: 1899935 - RNA, 15 nt, Homo sapiens
ugccugagaauguua

SEQ ID NO: 1899936 - RNA, 13 nt, Homo sapiens
gaaucuacuuuaa

SEQ ID NO: 1899937 - RNA, 19 nt, Homo sapiens
uuuagccccugaaagccau

SEQ ID NO: 1899938 - RNA, 20 nt, Homo sapiens
gccacagacaacauggaaau

SEQ ID NO: 1899939 - RNA, 21 nt, Homo sapiens
uaaauacaguggaucucaauc

SEQ ID NO: 1899940 - RNA, 10 nt, Homo sapiens
agcuuuccau

SEQ ID NO: 1899941 - RNA, 18 nt, Homo sapiens
cacagacuucacacagca

SEQ ID NO: 1899942 - RNA, 16 nt, Homo sapiens
gauugcauuguaugaa

SEQ ID NO: 1899943 - RNA, 11 nt, Homo sapiens
uaguuagcuuu

SEQ ID NO: 1899944 - RNA, 13 nt, Homo sapiens
augggggccucag

SEQ ID NO: 1899945 - RNA, 19 nt, Homo sapiens
acugugaaaauaguguaag

SEQ ID NO: 1899946 - RNA, 19 nt, Homo sapiens
ggcuuucagggcagccccu

SEQ ID NO: 1899947 - RNA, 13 nt, Homo sapiens
acccaagacauca

SEQ ID NO: 1899948 - RNA, 22 nt, Homo sapiens
agccacuuagcaggaaguacuc

SEQ ID NO: 1899949 - RNA, 19 nt, Homo sapiens
gcaguaucaugcccugugc

SEQ ID NO: 1899950 - RNA, 17 nt, Homo sapiens
aaaugaccuguuuucac

SEQ ID NO: 1899951 - RNA, 18 nt, Homo sapiens
aaagugaccuccagagcu

SEQ ID NO: 1899952 - RNA, 14 nt, Homo sapiens
uaauucauguugcc

SEQ ID NO: 1899953 - RNA, 12 nt, Homo sapiens
gcagcuccagug

SEQ ID NO: 1899954 - RNA, 11 nt, Homo sapiens
auaaaccacaa

SEQ ID NO: 1899955 - RNA, 15 nt, Homo sapiens
gacaggguucauuga

SEQ ID NO: 1899956 - RNA, 14 nt, Homo sapiens
uuugaauuaaucua

SEQ ID NO: 1899957 - RNA, 21 nt, Homo sapiens
guaauuugggaaaagaagcug

SEQ ID NO: 1899958 - RNA, 17 nt, Homo sapiens
cuacugcuaauguugau

SEQ ID NO: 1899959 - RNA, 16 nt, Homo sapiens
auuuuacaugacagau

SEQ ID NO: 1899960 - RNA, 13 nt, Homo sapiens
auauuuuacauac

SEQ ID NO: 1899961 - RNA, 15 nt, Homo sapiens
aguccaaccugccug

SEQ ID NO: 1899962 - RNA, 17 nt, Homo sapiens
cuguggccaacugcaaa

SEQ ID NO: 1899963 - RNA, 16 nt, Homo sapiens
ggaaaucuuuacuccu

SEQ ID NO: 1899964 - RNA, 16 nt, Homo sapiens
aguggggcugcaggca

SEQ ID NO: 1899965 - RNA, 15 nt, Homo sapiens
uuucucugcacacaa

SEQ ID NO: 1899966 - RNA, 19 nt, Homo sapiens
aggaaggaggaagcuuauu

SEQ ID NO: 1899967 - RNA, 19 nt, Homo sapiens
uauaaucucaccugcuucc

SEQ ID NO: 1899968 - RNA, 21 nt, Homo sapiens
uauaaguagaauucuuaccau

SEQ ID NO: 1899969 - RNA, 20 nt, Homo sapiens
caaggagggugagugcaagg

SEQ ID NO: 1899970 - RNA, 20 nt, Homo sapiens
uuuauggaagaugugugaua

SEQ ID NO: 1899971 - RNA, 23 nt, Homo sapiens
agucauuuaaaaagauauuguac

SEQ ID NO: 1899972 - RNA, 13 nt, Homo sapiens
gacuagagugaug

SEQ ID NO: 1899973 - RNA, 21 nt, Homo sapiens
accugaaaguuuuuuugguuu

SEQ ID NO: 1899974 - RNA, 13 nt, Homo sapiens
aaugagugacaau

SEQ ID NO: 1899975 - RNA, 14 nt, Homo sapiens
uggcauuugcugaa

SEQ ID NO: 1899976 - RNA, 17 nt, Homo sapiens
gccuacaaauguuuuca

SEQ ID NO: 1899977 - RNA, 13 nt, Homo sapiens
ucagccugugaac

SEQ ID NO: 1899978 - RNA, 16 nt, Homo sapiens
ccauagcuuccaugag

SEQ ID NO: 1899979 - RNA, 12 nt, Homo sapiens
cccaugcugucc

SEQ ID NO: 1899980 - RNA, 22 nt, Homo sapiens
acuguccagagagcaacucuga

SEQ ID NO: 1899981 - RNA, 18 nt, Homo sapiens
aauuccaucccaucaucu

SEQ ID NO: 1899982 - RNA, 21 nt, Homo sapiens
uguaggaauggaagcuucagg

SEQ ID NO: 1899983 - RNA, 15 nt, Homo sapiens
gaacuaacaugcaaa

SEQ ID NO: 1899984 - RNA, 14 nt, Homo sapiens
cauuuaaaagacag

SEQ ID NO: 1899985 - RNA, 20 nt, Homo sapiens
gguagggaauaaaauccuaa

SEQ ID NO: 1899986 - RNA, 16 nt, Homo sapiens
uguggaacaagcagcu

SEQ ID NO: 1899987 - RNA, 16 nt, Homo sapiens
auauuccaauacccua

SEQ ID NO: 1899988 - RNA, 14 nt, Homo sapiens
aaagccaugugcua

SEQ ID NO: 1899989 - RNA, 14 nt, Homo sapiens
agccccuccaucug

SEQ ID NO: 1899990 - RNA, 18 nt, Homo sapiens
aguucauagggucucuuc

SEQ ID NO: 1899991 - RNA, 20 nt, Homo sapiens
ugugacaccccccuucugaa

SEQ ID NO: 1899992 - RNA, 16 nt, Homo sapiens
uggaaaauacaucugu

SEQ ID NO: 1899993 - RNA, 14 nt, Homo sapiens
cuccuugcacuuuc

SEQ ID NO: 1899994 - RNA, 22 nt, Homo sapiens
guuuuuuaaaaaaaaauugaac

SEQ ID NO: 1899995 - RNA, 23 nt, Homo sapiens
uucuaaaaagucaauucaucuag

SEQ ID NO: 1899996 - RNA, 18 nt, Homo sapiens
gagacccuagaugugcuc

SEQ ID NO: 1899997 - RNA, 16 nt, Homo sapiens
uccaaucguucucugu

SEQ ID NO: 1899998 - RNA, 20 nt, Homo sapiens
cccuaagagagcaccuggug

SEQ ID NO: 1899999 - RNA, 17 nt, Homo sapiens
ugcaauacggaacacug

SEQ ID NO: 1900000 - RNA, 20 nt, Homo sapiens
cagcggauugcucuggagca

SEQ ID NO: 1900001 - RNA, 20 nt, Homo sapiens
uaaaaugaaggaaaagcaug

SEQ ID NO: 1900002 - RNA, 20 nt, Homo sapiens
gaugugucucaggcaccuca

SEQ ID NO: 1900003 - RNA, 23 nt, Homo sapiens
ccagaaggcauaucagucucuga

SEQ ID NO: 1900004 - RNA, 21 nt, Homo sapiens
cagaagcuccgugagccucag

SEQ ID NO: 1900005 - RNA, 14 nt, Homo sapiens
augcagcucugcag

SEQ ID NO: 1900006 - RNA, 17 nt, Homo sapiens
gcaguuauuagaacuua

SEQ ID NO: 1900007 - RNA, 21 nt, Homo sapiens
uaccagagccuucaagugcca

SEQ ID NO: 1900008 - RNA, 20 nt, Homo sapiens
gcaggauauuugcacuauuu

SEQ ID NO: 1900009 - RNA, 22 nt, Homo sapiens
agcauugucucguguacagcuc

SEQ ID NO: 1900010 - RNA, 23 nt, Homo sapiens
aauucauuucacuguagcucuaa

SEQ ID NO: 1900011 - RNA, 11 nt, Homo sapiens
aacaaaaccac

SEQ ID NO: 1900012 - RNA, 17 nt, Homo sapiens
ucaagauuaaacugagu

SEQ ID NO: 1900013 - RNA, 15 nt, Homo sapiens
agcuaagcagucuuc

SEQ ID NO: 1900014 - RNA, 21 nt, Homo sapiens
augcaaaaaaaaaaaugucaa

SEQ ID NO: 1900015 - RNA, 17 nt, Homo sapiens
agggccccacucaggga

SEQ ID NO: 1900016 - RNA, 20 nt, Homo sapiens
guucauguuuguaaauuaau

SEQ ID NO: 1900017 - RNA, 15 nt, Homo sapiens
auaguaaacacaggg

SEQ ID NO: 1900018 - RNA, 12 nt, Homo sapiens
caguuacuguga

SEQ ID NO: 1900019 - RNA, 14 nt, Homo sapiens
uuagauuaguauuu

SEQ ID NO: 1900020 - RNA, 16 nt, Homo sapiens
aaguaauucuucugcc

SEQ ID NO: 1900021 - RNA, 15 nt, Homo sapiens
ccagaagauucuauc

SEQ ID NO: 1900022 - RNA, 18 nt, Homo sapiens
uauuuaauucauguugcc

SEQ ID NO: 1900023 - RNA, 16 nt, Homo sapiens
ugagugccuguaauca

SEQ ID NO: 1900024 - RNA, 19 nt, Homo sapiens
ucacucagugauugcaauu

SEQ ID NO: 1900025 - RNA, 21 nt, Homo sapiens
ucauaaguagcauucauguaa

SEQ ID NO: 1900026 - RNA, 13 nt, Homo sapiens
aagccaugcugcu

SEQ ID NO: 1900027 - RNA, 19 nt, Homo sapiens
accauagggcaugauuaac

SEQ ID NO: 1900028 - RNA, 19 nt, Homo sapiens
uguuccacauccacacagc

SEQ ID NO: 1900029 - RNA, 14 nt, Homo sapiens
ugaaauaaagccau

SEQ ID NO: 1900030 - RNA, 17 nt, Homo sapiens
cacucagaaguugugcu

SEQ ID NO: 1900031 - RNA, 21 nt, Homo sapiens
ccugaugccccuuccccaaga

SEQ ID NO: 1900032 - RNA, 18 nt, Homo sapiens
caccaaaucuauuugaaa

SEQ ID NO: 1900033 - RNA, 22 nt, Homo sapiens
acuagcacugacugaacuguaa

SEQ ID NO: 1900034 - RNA, 21 nt, Homo sapiens
uucuguugaucccacuucacu

SEQ ID NO: 1900035 - RNA, 17 nt, Homo sapiens
caggagucucugccacc

SEQ ID NO: 1900036 - RNA, 13 nt, Homo sapiens
cuaaggcagcuaa

SEQ ID NO: 1900037 - RNA, 15 nt, Homo sapiens
aaaauauugaacuca

SEQ ID NO: 1900038 - RNA, 16 nt, Homo sapiens
ugagugucuagcaaag

SEQ ID NO: 1900039 - RNA, 16 nt, Homo sapiens
acaggucacacgaggg

SEQ ID NO: 1900040 - RNA, 22 nt, Homo sapiens
ccaacaggagcugggauccuaa

SEQ ID NO: 1900041 - RNA, 22 nt, Homo sapiens
caucugaagaguggaaaugggg

SEQ ID NO: 1900042 - RNA, 15 nt, Homo sapiens
auucuugaguucugg

SEQ ID NO: 1900043 - RNA, 21 nt, Homo sapiens
uuccuaacauaccuaagcaaa

SEQ ID NO: 1900044 - RNA, 13 nt, Homo sapiens
agaugcugauguu

SEQ ID NO: 1900045 - RNA, 17 nt, Homo sapiens
gagauagucucauucug

SEQ ID NO: 1900046 - RNA, 13 nt, Homo sapiens
uccaaugugacua

SEQ ID NO: 1900047 - RNA, 22 nt, Homo sapiens
ccagugcuggccacacagcagc

SEQ ID NO: 1900048 - RNA, 21 nt, Homo sapiens
ccuuuggcuaucuacugagac

SEQ ID NO: 1900049 - RNA, 20 nt, Homo sapiens
aggugcgcgccaccgugccu

SEQ ID NO: 1900050 - RNA, 19 nt, Homo sapiens
caaauuauucuccuauguu

SEQ ID NO: 1900051 - RNA, 23 nt, Homo sapiens
agacaaauacuuagacaguaugc

SEQ ID NO: 1900052 - RNA, 15 nt, Homo sapiens
gugugaagaucacgu

SEQ ID NO: 1900053 - RNA, 15 nt, Homo sapiens
guagucgcuuugccu

SEQ ID NO: 1900054 - RNA, 23 nt, Homo sapiens
ucacagccauacagcuguccaca

SEQ ID NO: 1900055 - RNA, 17 nt, Homo sapiens
aaaaagagccuuacuuu

SEQ ID NO: 1900056 - RNA, 15 nt, Homo sapiens
cuauuuaacaacugg

SEQ ID NO: 1900057 - RNA, 21 nt, Homo sapiens
ucucccaccuuucgggccaug

SEQ ID NO: 1900058 - RNA, 16 nt, Homo sapiens
gugucugaacagcuau

SEQ ID NO: 1900059 - RNA, 18 nt, Homo sapiens
cuucucaccagcugcaaa

SEQ ID NO: 1900060 - RNA, 20 nt, Homo sapiens
cugaagaauuuugagugaau

SEQ ID NO: 1900061 - RNA, 18 nt, Homo sapiens
aguuugauaccugcacug

SEQ ID NO: 1900062 - RNA, 20 nt, Homo sapiens
ccugcuccuccaggaauucc

SEQ ID NO: 1900063 - RNA, 16 nt, Homo sapiens
aucuauuuguacaauu

SEQ ID NO: 1900064 - RNA, 19 nt, Homo sapiens
acugaacaaaaccuacaca

SEQ ID NO: 1900065 - RNA, 20 nt, Homo sapiens
uuaaagauauuuuuauucaa

SEQ ID NO: 1900066 - RNA, 18 nt, Homo sapiens
ugacugauguuacaucac

SEQ ID NO: 1900067 - RNA, 20 nt, Homo sapiens
caaaauaaugcaccacuuuu

SEQ ID NO: 1900068 - RNA, 19 nt, Homo sapiens
ucguguucacucagcacuu

SEQ ID NO: 1900069 - RNA, 14 nt, Homo sapiens
caacaguuccuuca

SEQ ID NO: 1900070 - RNA, 17 nt, Homo sapiens
cagccuugcaucaaggg

SEQ ID NO: 1900071 - RNA, 13 nt, Homo sapiens
gggcaggguucua

SEQ ID NO: 1900072 - RNA, 13 nt, Homo sapiens
aaagcuguucuca

SEQ ID NO: 1900073 - RNA, 13 nt, Homo sapiens
uucauguugccuu

SEQ ID NO: 1900074 - RNA, 17 nt, Homo sapiens
cuuuaauuaagcucuca

SEQ ID NO: 1900075 - RNA, 17 nt, Homo sapiens
agcuagaauaccaccua

SEQ ID NO: 1900076 - RNA, 13 nt, Homo sapiens
auugcugcucucu

SEQ ID NO: 1900077 - RNA, 14 nt, Homo sapiens
gcuccagaaauguc

SEQ ID NO: 1900078 - RNA, 15 nt, Homo sapiens
aggacaggucucuga

SEQ ID NO: 1900079 - RNA, 14 nt, Homo sapiens
aucugacacugaca

SEQ ID NO: 1900080 - RNA, 20 nt, Homo sapiens
caauauaaaccguggucuca

SEQ ID NO: 1900081 - RNA, 19 nt, Homo sapiens
uugaccaugucuaugauuc

SEQ ID NO: 1900082 - RNA, 12 nt, Homo sapiens
aaagacaugggg

SEQ ID NO: 1900083 - RNA, 18 nt, Homo sapiens
ugagagggcaguguuucc

SEQ ID NO: 1900084 - RNA, 15 nt, Homo sapiens
aaguacuacagcaaa

SEQ ID NO: 1900085 - RNA, 15 nt, Homo sapiens
uuuuacauucauauc

SEQ ID NO: 1900086 - RNA, 14 nt, Homo sapiens
cacuugccauugcc

SEQ ID NO: 1900087 - RNA, 20 nt, Homo sapiens
uucucacgcuuuguuuacuc

SEQ ID NO: 1900088 - RNA, 22 nt, Homo sapiens
gacuuauuaugcauaaagccaa

SEQ ID NO: 1900089 - RNA, 21 nt, Homo sapiens
uccaggagcaauuugcacaug

SEQ ID NO: 1900090 - RNA, 12 nt, Homo sapiens
gagucugucaca

SEQ ID NO: 1900091 - RNA, 21 nt, Homo sapiens
agccuggccaacauagugaaa

SEQ ID NO: 1900092 - RNA, 18 nt, Homo sapiens
aucuucaguuuaaugcaa

SEQ ID NO: 1900093 - RNA, 16 nt, Homo sapiens
auccaggcagauccag

SEQ ID NO: 1900094 - RNA, 19 nt, Homo sapiens
ggcagcaccaccacacagu

SEQ ID NO: 1900095 - RNA, 18 nt, Homo sapiens
uaccuuuugcuguggcaa

SEQ ID NO: 1900096 - RNA, 21 nt, Homo sapiens
acaccugcauucuucccuuau

SEQ ID NO: 1900097 - RNA, 11 nt, Homo sapiens
aggacaaugcc

SEQ ID NO: 1900098 - RNA, 14 nt, Homo sapiens
gagaacucugagca

SEQ ID NO: 1900099 - RNA, 19 nt, Homo sapiens
gccagcucccucgucuuca

SEQ ID NO: 1900100 - RNA, 20 nt, Homo sapiens
ugcugaaaguucauaucugg

SEQ ID NO: 1900101 - RNA, 13 nt, Homo sapiens
ucugcacaguguu

SEQ ID NO: 1900102 - RNA, 15 nt, Homo sapiens
ggaggacgggacccu

SEQ ID NO: 1900103 - RNA, 19 nt, Homo sapiens
cagcaugaaggaugccaua

SEQ ID NO: 1900104 - RNA, 19 nt, Homo sapiens
uaccuugucauauguguug

SEQ ID NO: 1900105 - RNA, 16 nt, Homo sapiens
gcaagcucccaaggga

SEQ ID NO: 1900106 - RNA, 16 nt, Homo sapiens
acugagugacucuaua

SEQ ID NO: 1900107 - RNA, 16 nt, Homo sapiens
cuggcccuuggcuuua

SEQ ID NO: 1900108 - RNA, 18 nt, Homo sapiens
ugggucuuggggacuaac

SEQ ID NO: 1900109 - RNA, 18 nt, Homo sapiens
uguaaagaaaaccauaau

SEQ ID NO: 1900110 - RNA, 13 nt, Homo sapiens
uuuaaaauaucac

SEQ ID NO: 1900111 - RNA, 14 nt, Homo sapiens
agccaacagcuaca

SEQ ID NO: 1900112 - RNA, 15 nt, Homo sapiens
aguacuuguaguucc

SEQ ID NO: 1900113 - RNA, 14 nt, Homo sapiens
gaugcaaaucaacu

SEQ ID NO: 1900114 - RNA, 14 nt, Homo sapiens
aauacaauucaaac

SEQ ID NO: 1900115 - RNA, 15 nt, Homo sapiens
gccccaguggugcgg

SEQ ID NO: 1900116 - RNA, 22 nt, Homo sapiens
uguggcaggccuaggaccucag

SEQ ID NO: 1900117 - RNA, 14 nt, Homo sapiens
ugauccuugcacag

SEQ ID NO: 1900118 - RNA, 20 nt, Homo sapiens
auaaaggcauuucaaagucu

SEQ ID NO: 1900119 - RNA, 15 nt, Homo sapiens
uagaagcaugaaguc

SEQ ID NO: 1900120 - RNA, 20 nt, Homo sapiens
ggugauuggccacacacuga

SEQ ID NO: 1900121 - RNA, 15 nt, Homo sapiens
aaacuacaacgaaca

SEQ ID NO: 1900122 - RNA, 18 nt, Homo sapiens
uuaauggcucaucaacaa

SEQ ID NO: 1900123 - RNA, 22 nt, Homo sapiens
guagagaaagaaaugucugcca

SEQ ID NO: 1900124 - RNA, 16 nt, Homo sapiens
ccuuuugcugcgcacc

SEQ ID NO: 1900125 - RNA, 18 nt, Homo sapiens
ugauuuuuuuuauugccu

SEQ ID NO: 1900126 - RNA, 15 nt, Homo sapiens
gaauguaaugguggc

SEQ ID NO: 1900127 - RNA, 14 nt, Homo sapiens
gaauaaaugaaucu

SEQ ID NO: 1900128 - RNA, 14 nt, Homo sapiens
gcacaaaugcaccu

SEQ ID NO: 1900129 - RNA, 13 nt, Homo sapiens
ucucucuucucca

SEQ ID NO: 1900130 - RNA, 13 nt, Homo sapiens
uuuuucuucccua

SEQ ID NO: 1900131 - RNA, 21 nt, Homo sapiens
ucacauacccacacauuccag

SEQ ID NO: 1900132 - RNA, 15 nt, Homo sapiens
guccaugccuuccau

SEQ ID NO: 1900133 - RNA, 17 nt, Homo sapiens
ggugauccauguaacug

SEQ ID NO: 1900134 - RNA, 20 nt, Homo sapiens
agcucuuacacuacauuaga

SEQ ID NO: 1900135 - RNA, 16 nt, Homo sapiens
augauguauacugcca

SEQ ID NO: 1900136 - RNA, 16 nt, Homo sapiens
uauagacaauuugccc

SEQ ID NO: 1900137 - RNA, 15 nt, Homo sapiens
ccuucccaaauagca

SEQ ID NO: 1900138 - RNA, 22 nt, Homo sapiens
acucuugaaguacuuaacauac

SEQ ID NO: 1900139 - RNA, 16 nt, Homo sapiens
uacccuuccugccaag

SEQ ID NO: 1900140 - RNA, 15 nt, Homo sapiens
uuucuuugauuuucg

SEQ ID NO: 1900141 - RNA, 16 nt, Homo sapiens
cugaggauucaggggc

SEQ ID NO: 1900142 - RNA, 13 nt, Homo sapiens
ugauaaaguaaua

SEQ ID NO: 1900143 - RNA, 21 nt, Homo sapiens
aacugcuuuugcccauauaaa

SEQ ID NO: 1900144 - RNA, 13 nt, Homo sapiens
ugagacuaggaua

SEQ ID NO: 1900145 - RNA, 23 nt, Homo sapiens
gcaaaggcugagaacacugugaa

SEQ ID NO: 1900146 - RNA, 17 nt, Homo sapiens
cuugggagggugccauc

SEQ ID NO: 1900147 - RNA, 15 nt, Homo sapiens
acugcacaauaacuc

SEQ ID NO: 1900148 - RNA, 15 nt, Homo sapiens
aauagcacaggugac

SEQ ID NO: 1900149 - RNA, 21 nt, Homo sapiens
accuugaugguaggugugaca

SEQ ID NO: 1900150 - RNA, 21 nt, Homo sapiens
agcuuuguacacgaagaccau

SEQ ID NO: 1900151 - RNA, 15 nt, Homo sapiens
agccuuauuucucau

SEQ ID NO: 1900152 - RNA, 13 nt, Homo sapiens
cuggcugggcaug

SEQ ID NO: 1900153 - RNA, 17 nt, Homo sapiens
ugaggauguauguguau

SEQ ID NO: 1900154 - RNA, 15 nt, Homo sapiens
ucucauuugccagga

SEQ ID NO: 1900155 - RNA, 22 nt, Homo sapiens
agcugagugcuagaguaggugc

SEQ ID NO: 1900156 - RNA, 13 nt, Homo sapiens
auugcaauaacug

SEQ ID NO: 1900157 - RNA, 13 nt, Homo sapiens
guuuaaugcaaau

SEQ ID NO: 1900158 - RNA, 13 nt, Homo sapiens
guuaaaugcaauu

SEQ ID NO: 1900159 - RNA, 21 nt, Homo sapiens
ugcuguggagcuccacugcca

SEQ ID NO: 1900160 - RNA, 21 nt, Homo sapiens
augcacacacacacaucucau

SEQ ID NO: 1900161 - RNA, 22 nt, Homo sapiens
agagcugacccccugcugccau

SEQ ID NO: 1900162 - RNA, 19 nt, Homo sapiens
ccugcccuugucccacuca

SEQ ID NO: 1900163 - RNA, 19 nt, Homo sapiens
ggucaugugggucuuccag

SEQ ID NO: 1900164 - RNA, 11 nt, Homo sapiens
cugccauuaca

SEQ ID NO: 1900165 - RNA, 20 nt, Homo sapiens
ccuugugaaguaggugaucu

SEQ ID NO: 1900166 - RNA, 20 nt, Homo sapiens
gagugcuuucauauuuucca

SEQ ID NO: 1900167 - RNA, 17 nt, Homo sapiens
agccacauuuugcauua

SEQ ID NO: 1900168 - RNA, 22 nt, Homo sapiens
ccagggaggggggaugcugcuu

SEQ ID NO: 1900169 - RNA, 15 nt, Homo sapiens
aagaugcacugaaaa

SEQ ID NO: 1900170 - RNA, 23 nt, Homo sapiens
gaugguucucagaaccauuucac

SEQ ID NO: 1900171 - RNA, 19 nt, Homo sapiens
ggaacugccugggccaugc

SEQ ID NO: 1900172 - RNA, 23 nt, Homo sapiens
gaauucuuacauguuuucuuugc

SEQ ID NO: 1900173 - RNA, 16 nt, Homo sapiens
uccccuucaguaccac

SEQ ID NO: 1900174 - RNA, 17 nt, Homo sapiens
cucggcacacacugugc

SEQ ID NO: 1900175 - RNA, 17 nt, Homo sapiens
agcuggaguucaugucg

SEQ ID NO: 1900176 - RNA, 16 nt, Homo sapiens
cugucuguuugccaca

SEQ ID NO: 1900177 - RNA, 16 nt, Homo sapiens
uggagugcaccaaaga

SEQ ID NO: 1900178 - RNA, 20 nt, Homo sapiens
uguguacuuuuggguucaca

SEQ ID NO: 1900179 - RNA, 17 nt, Homo sapiens
uacauuugagccauguc

SEQ ID NO: 1900180 - RNA, 18 nt, Homo sapiens
cacacugaggcagggaag

SEQ ID NO: 1900181 - RNA, 15 nt, Homo sapiens
agcccagauggaaag

SEQ ID NO: 1900182 - RNA, 17 nt, Homo sapiens
aacuccccauuggugcu

SEQ ID NO: 1900183 - RNA, 19 nt, Homo sapiens
aacuggccacgcacaggcu

SEQ ID NO: 1900184 - RNA, 17 nt, Homo sapiens
auauaacuuauuugccc

SEQ ID NO: 1900185 - RNA, 22 nt, Homo sapiens
uggaacuguacaaauugugaug

SEQ ID NO: 1900186 - RNA, 14 nt, Homo sapiens
cuuuuugcauauaa

SEQ ID NO: 1900187 - RNA, 17 nt, Homo sapiens
uccccaucuguguguga

SEQ ID NO: 1900188 - RNA, 18 nt, Homo sapiens
aucagugcccuccaggau

SEQ ID NO: 1900189 - RNA, 21 nt, Homo sapiens
ucucaccgggcuacuaccugg

SEQ ID NO: 1900190 - RNA, 11 nt, Homo sapiens
aauucugugac

SEQ ID NO: 1900191 - RNA, 22 nt, Homo sapiens
uagaaccucucguaguccauca

SEQ ID NO: 1900192 - RNA, 15 nt, Homo sapiens
caucugcgugacaau

SEQ ID NO: 1900193 - RNA, 13 nt, Homo sapiens
ugaucuauacaaa

SEQ ID NO: 1900194 - RNA, 13 nt, Homo sapiens
ccccaacaacuuu

SEQ ID NO: 1900195 - RNA, 15 nt, Homo sapiens
ccaggagcagccaca

SEQ ID NO: 1900196 - RNA, 22 nt, Homo sapiens
guaaccgauucaucucucagaa

SEQ ID NO: 1900197 - RNA, 12 nt, Homo sapiens
ucuaacucuccc

SEQ ID NO: 1900198 - RNA, 13 nt, Homo sapiens
aucauaaugccau

SEQ ID NO: 1900199 - RNA, 16 nt, Homo sapiens
uucaugaagcaagaau

SEQ ID NO: 1900200 - RNA, 15 nt, Homo sapiens
cacaguucauugcag

SEQ ID NO: 1900201 - RNA, 17 nt, Homo sapiens
caaacaauaugcuccug

SEQ ID NO: 1900202 - RNA, 17 nt, Homo sapiens
uaauuuaccuguuguug

SEQ ID NO: 1900203 - RNA, 16 nt, Homo sapiens
cuaacaggcuguagau

SEQ ID NO: 1900204 - RNA, 22 nt, Homo sapiens
ccggcugacucagugcagggac

SEQ ID NO: 1900205 - RNA, 18 nt, Homo sapiens
ugcauuuuauagaauagu

SEQ ID NO: 1900206 - RNA, 19 nt, Homo sapiens
caugaccaaaaaccaaaag

SEQ ID NO: 1900207 - RNA, 14 nt, Homo sapiens
uauaucaguaucug

SEQ ID NO: 1900208 - RNA, 22 nt, Homo sapiens
acuguccuggaaccugucucca

SEQ ID NO: 1900209 - RNA, 18 nt, Homo sapiens
caagacccauaaccauua

SEQ ID NO: 1900210 - RNA, 13 nt, Homo sapiens
agcaacugugcaa

SEQ ID NO: 1900211 - RNA, 14 nt, Homo sapiens
ugagcacugccagg

SEQ ID NO: 1900212 - RNA, 9 nt, Homo sapiens
acccagugc

SEQ ID NO: 1900213 - RNA, 16 nt, Homo sapiens
agucaccacugugcuc

SEQ ID NO: 1900214 - RNA, 24 nt, Homo sapiens
augaaaacacucaaaaugaugcaa

SEQ ID NO: 1900215 - RNA, 16 nt, Homo sapiens
caaaugcagcaauccc

SEQ ID NO: 1900216 - RNA, 23 nt, Homo sapiens
ccuagggaauggucccagcacga

SEQ ID NO: 1900217 - RNA, 13 nt, Homo sapiens
uugacaugcuguu

SEQ ID NO: 1900218 - RNA, 18 nt, Homo sapiens
uuucaaauuggagcuuca

SEQ ID NO: 1900219 - RNA, 21 nt, Homo sapiens
accaaacaucuuucagcugcu

SEQ ID NO: 1900220 - RNA, 20 nt, Homo sapiens
aacuagagcacagaaggaau

SEQ ID NO: 1900221 - RNA, 23 nt, Homo sapiens
gguguacuuauauccacacugca

SEQ ID NO: 1900222 - RNA, 20 nt, Homo sapiens
gaaagggucuuccuucucau

SEQ ID NO: 1900223 - RNA, 17 nt, Homo sapiens
caggaucaagcaugaaa

SEQ ID NO: 1900224 - RNA, 22 nt, Homo sapiens
uacguuuuacaauguaacuaua

SEQ ID NO: 1900225 - RNA, 21 nt, Homo sapiens
ccgggagaggagaucagggcg

SEQ ID NO: 1900226 - RNA, 17 nt, Homo sapiens
caacaccccacugagcc

SEQ ID NO: 1900227 - RNA, 17 nt, Homo sapiens
ggccucagugugcccau

SEQ ID NO: 1900228 - RNA, 22 nt, Homo sapiens
ugaaguugccauuuugucucau

SEQ ID NO: 1900229 - RNA, 16 nt, Homo sapiens
auuucaacaguuauug

SEQ ID NO: 1900230 - RNA, 23 nt, Homo sapiens
gucccccagauuccaacauuucu

SEQ ID NO: 1900231 - RNA, 15 nt, Homo sapiens
ucuuggaugcagcuu

SEQ ID NO: 1900232 - RNA, 16 nt, Homo sapiens
auccauauuuuacuga

SEQ ID NO: 1900233 - RNA, 15 nt, Homo sapiens
acuccucuucaccca

SEQ ID NO: 1900234 - RNA, 16 nt, Homo sapiens
gaggaaaggccagcug

SEQ ID NO: 1900235 - RNA, 11 nt, Homo sapiens
ugcacauauau

SEQ ID NO: 1900236 - RNA, 17 nt, Homo sapiens
uaccuauugaacaugug

SEQ ID NO: 1900237 - RNA, 23 nt, Homo sapiens
uuaagcgggaucccagcaucuca

SEQ ID NO: 1900238 - RNA, 14 nt, Homo sapiens
agccuuuugcucuc

SEQ ID NO: 1900239 - RNA, 15 nt, Homo sapiens
gccaggagauggaau

SEQ ID NO: 1900240 - RNA, 20 nt, Homo sapiens
cuuaagauucuuugugauga

SEQ ID NO: 1900241 - RNA, 22 nt, Homo sapiens
cuuuaaaauaaaauaauuuuau

SEQ ID NO: 1900242 - RNA, 22 nt, Homo sapiens
cccaaggccaagauuguccuuu

SEQ ID NO: 1900243 - RNA, 19 nt, Homo sapiens
cggaggccggccaccugca

SEQ ID NO: 1900244 - RNA, 18 nt, Homo sapiens
gucacuauaggucauaca

SEQ ID NO: 1900245 - RNA, 21 nt, Homo sapiens
ccagccuuccucugcagcuga

SEQ ID NO: 1900246 - RNA, 14 nt, Homo sapiens
aaguuucuuaagga

SEQ ID NO: 1900247 - RNA, 23 nt, Homo sapiens
acauuugacuugaaccacaagug

SEQ ID NO: 1900248 - RNA, 14 nt, Homo sapiens
aauugccuaaagag

SEQ ID NO: 1900249 - RNA, 13 nt, Homo sapiens
gagacucauuuca

SEQ ID NO: 1900250 - RNA, 21 nt, Homo sapiens
ugcccuuggaggccagccagu

SEQ ID NO: 1900251 - RNA, 21 nt, Homo sapiens
ucugugucagcgggugcacca

SEQ ID NO: 1900252 - RNA, 18 nt, Homo sapiens
aacugaggguuaucuuug

SEQ ID NO: 1900253 - RNA, 20 nt, Homo sapiens
uuguuucaccuuccauguca

SEQ ID NO: 1900254 - RNA, 20 nt, Homo sapiens
augaaguguguuuccuucag

SEQ ID NO: 1900255 - RNA, 18 nt, Homo sapiens
uguuuauuuaaugcugug

SEQ ID NO: 1900256 - RNA, 22 nt, Homo sapiens
gaagcucacgccuuaguuugaa

SEQ ID NO: 1900257 - RNA, 20 nt, Homo sapiens
aaguuacuuuccauugcuau

SEQ ID NO: 1900258 - RNA, 23 nt, Homo sapiens
gagacacaaguggccuuaagucu

SEQ ID NO: 1900259 - RNA, 18 nt, Homo sapiens
uaagcugggauaaucaca

SEQ ID NO: 1900260 - RNA, 14 nt, Homo sapiens
ucccaggacccuga

SEQ ID NO: 1900261 - RNA, 16 nt, Homo sapiens
aaaaggcccuuuucag

SEQ ID NO: 1900262 - RNA, 15 nt, Homo sapiens
cacugcacaucaugu

SEQ ID NO: 1900263 - RNA, 14 nt, Homo sapiens
accaucaccucucu

SEQ ID NO: 1900264 - RNA, 19 nt, Homo sapiens
ucaugugagguuaaaccag

SEQ ID NO: 1900265 - RNA, 19 nt, Homo sapiens
cuccccaguagcugggauu

SEQ ID NO: 1900266 - RNA, 12 nt, Homo sapiens
gugccuccagau

SEQ ID NO: 1900267 - RNA, 14 nt, Homo sapiens
aucagacagagauu

SEQ ID NO: 1900268 - RNA, 19 nt, Homo sapiens
uuugaaaccaggacauuaa

SEQ ID NO: 1900269 - RNA, 18 nt, Homo sapiens
ucugcagguugaagccau

SEQ ID NO: 1900270 - RNA, 20 nt, Homo sapiens
cccaauugggaaugcaauau

SEQ ID NO: 1900271 - RNA, 18 nt, Homo sapiens
cugagccgucagagcagu

SEQ ID NO: 1900272 - RNA, 22 nt, Homo sapiens
gaaauaagucagguucuuuaca

SEQ ID NO: 1900273 - RNA, 14 nt, Homo sapiens
uuucauuaacuccu

SEQ ID NO: 1900274 - RNA, 17 nt, Homo sapiens
ccacagguccuccauca

SEQ ID NO: 1900275 - RNA, 14 nt, Homo sapiens
uaagucaagcacau

SEQ ID NO: 1900276 - RNA, 16 nt, Homo sapiens
cagacucacuguggga

SEQ ID NO: 1900277 - RNA, 18 nt, Homo sapiens
gcagaaacaaaaugacug

SEQ ID NO: 1900278 - RNA, 23 nt, Homo sapiens
aaaaauggaucccaaucugagaa

SEQ ID NO: 1900279 - RNA, 15 nt, Homo sapiens
aauuuaccacaggau

SEQ ID NO: 1900280 - RNA, 19 nt, Homo sapiens
aaacgccgcugacugccac

SEQ ID NO: 1900281 - RNA, 23 nt, Homo sapiens
cuggcaggagccggcugccuacc

SEQ ID NO: 1900282 - RNA, 23 nt, Homo sapiens
gaaaggaaagccaaacacuguuu

SEQ ID NO: 1900283 - RNA, 12 nt, Homo sapiens
agggaagugcau

SEQ ID NO: 1900284 - RNA, 22 nt, Homo sapiens
ggaugaaaaaauaacacuguac

SEQ ID NO: 1900285 - RNA, 15 nt, Homo sapiens
gcccuggaugugaau

SEQ ID NO: 1900286 - RNA, 23 nt, Homo sapiens
ucauguccuccccuccacccgca

SEQ ID NO: 1900287 - RNA, 19 nt, Homo sapiens
ugcuauuguagagccagag

SEQ ID NO: 1900288 - RNA, 18 nt, Homo sapiens
agacuucucccauagcaa

SEQ ID NO: 1900289 - RNA, 23 nt, Homo sapiens
ucauuuuaacuuuaucacauuau

SEQ ID NO: 1900290 - RNA, 20 nt, Homo sapiens
uuugaauguugaauguuuga

SEQ ID NO: 1900291 - RNA, 17 nt, Homo sapiens
gugccuggguggccauc

SEQ ID NO: 1900292 - RNA, 18 nt, Homo sapiens
ggguccugggaggcugca

SEQ ID NO: 1900293 - RNA, 11 nt, Homo sapiens
uuauccaaauu

SEQ ID NO: 1900294 - RNA, 9 nt, Homo sapiens
caagggaau

SEQ ID NO: 1900295 - RNA, 15 nt, Homo sapiens
cuuguauuuucuuaa

SEQ ID NO: 1900296 - RNA, 15 nt, Homo sapiens
uuuaagaauuucaca

SEQ ID NO: 1900297 - RNA, 13 nt, Homo sapiens
ucuuugcagugaa

SEQ ID NO: 1900298 - RNA, 16 nt, Homo sapiens
uccagacaccaucacc

SEQ ID NO: 1900299 - RNA, 20 nt, Homo sapiens
accaucucuuuaccuccuaa

SEQ ID NO: 1900300 - RNA, 21 nt, Homo sapiens
ucccuacccuggcccagauga

SEQ ID NO: 1900301 - RNA, 11 nt, Homo sapiens
agcucacucau

SEQ ID NO: 1900302 - RNA, 15 nt, Homo sapiens
accugucgcuuccua

SEQ ID NO: 1900303 - RNA, 20 nt, Homo sapiens
gagauuuacacuacauugua

SEQ ID NO: 1900304 - RNA, 17 nt, Homo sapiens
ugcugcaaacccaugaa

SEQ ID NO: 1900305 - RNA, 17 nt, Homo sapiens
uuuacuuugugcaauau

SEQ ID NO: 1900306 - RNA, 18 nt, Homo sapiens
cagugugcuaaccucacu

SEQ ID NO: 1900307 - RNA, 16 nt, Homo sapiens
auuuaauuucauguau

SEQ ID NO: 1900308 - RNA, 13 nt, Homo sapiens
uguccauaagaga

SEQ ID NO: 1900309 - RNA, 13 nt, Homo sapiens
agguuugcaaauu

SEQ ID NO: 1900310 - RNA, 22 nt, Homo sapiens
ugaauacauuuucagagccaaa

SEQ ID NO: 1900311 - RNA, 11 nt, Homo sapiens
uccaaugcaca

SEQ ID NO: 1900312 - RNA, 13 nt, Homo sapiens
gugaauacuuuga

SEQ ID NO: 1900313 - RNA, 16 nt, Homo sapiens
cuccuugggucauuga

SEQ ID NO: 1900314 - RNA, 14 nt, Homo sapiens
aggagcgaucucag

SEQ ID NO: 1900315 - RNA, 20 nt, Homo sapiens
ucuguggcaacuuguacuga

SEQ ID NO: 1900316 - RNA, 15 nt, Homo sapiens
gugucauggacuguu

SEQ ID NO: 1900317 - RNA, 15 nt, Homo sapiens
cucacaugcagaguu

SEQ ID NO: 1900318 - RNA, 19 nt, Homo sapiens
auucacucaagaguucagu

SEQ ID NO: 1900319 - RNA, 14 nt, Homo sapiens
auagaccugacaau

SEQ ID NO: 1900320 - RNA, 16 nt, Homo sapiens
guucugguaugaacuu

SEQ ID NO: 1900321 - RNA, 22 nt, Homo sapiens
aauguugucaagaccaaaagca

SEQ ID NO: 1900322 - RNA, 13 nt, Homo sapiens
auuaauaguucag

SEQ ID NO: 1900323 - RNA, 15 nt, Homo sapiens
gauggugaaaccaaa

SEQ ID NO: 1900324 - RNA, 16 nt, Homo sapiens
ugaaguuugaacuuca

SEQ ID NO: 1900325 - RNA, 14 nt, Homo sapiens
cugccugcccugaa

SEQ ID NO: 1900326 - RNA, 20 nt, Homo sapiens
uauuuuccucugaagggaaa

SEQ ID NO: 1900327 - RNA, 20 nt, Homo sapiens
ucagcucccacaaaugacag

SEQ ID NO: 1900328 - RNA, 14 nt, Homo sapiens
uaacuauacuugau

SEQ ID NO: 1900329 - RNA, 14 nt, Homo sapiens
uuucauuacaagua

SEQ ID NO: 1900330 - RNA, 19 nt, Homo sapiens
uaaacuaucaauaauacaa

SEQ ID NO: 1900331 - RNA, 18 nt, Homo sapiens
aucuagaggcuuccuuca

SEQ ID NO: 1900332 - RNA, 16 nt, Homo sapiens
aguagcuggauuacag

SEQ ID NO: 1900333 - RNA, 22 nt, Homo sapiens
ugccuugucucuaguagugugg

SEQ ID NO: 1900334 - RNA, 14 nt, Homo sapiens
agagacagggucuc

SEQ ID NO: 1900335 - RNA, 19 nt, Homo sapiens
gaagggguuuucuugauaa

SEQ ID NO: 1900336 - RNA, 13 nt, Homo sapiens
auuuaguccugua

SEQ ID NO: 1900337 - RNA, 13 nt, Homo sapiens
cuguagucauuua

SEQ ID NO: 1900338 - RNA, 18 nt, Homo sapiens
aacaagcaaguucugaga

SEQ ID NO: 1900339 - RNA, 12 nt, Homo sapiens
agucuccagugg

SEQ ID NO: 1900340 - RNA, 17 nt, Homo sapiens
cucuccuccauguugcc

SEQ ID NO: 1900341 - RNA, 21 nt, Homo sapiens
gcuuugucacuuuuccuuuuc

SEQ ID NO: 1900342 - RNA, 23 nt, Homo sapiens
caaaaagaaaucuugucuuacca

SEQ ID NO: 1900343 - RNA, 23 nt, Homo sapiens
agaaccauuugcaauauggauuu

SEQ ID NO: 1900344 - RNA, 16 nt, Homo sapiens
uuaauacacacaguua

SEQ ID NO: 1900345 - RNA, 12 nt, Homo sapiens
uggaaaccacag

SEQ ID NO: 1900346 - RNA, 15 nt, Homo sapiens
agucuagcaccucua

SEQ ID NO: 1900347 - RNA, 17 nt, Homo sapiens
aggcuuggaaacagaac

SEQ ID NO: 1900348 - RNA, 17 nt, Homo sapiens
uaagaaaucuggcccag

SEQ ID NO: 1900349 - RNA, 21 nt, Homo sapiens
cagugauucuguuugccuuuu

SEQ ID NO: 1900350 - RNA, 21 nt, Homo sapiens
ucucuuugauuauuugcaugu

SEQ ID NO: 1900351 - RNA, 14 nt, Homo sapiens
aucucaaaacugca

SEQ ID NO: 1900352 - RNA, 17 nt, Homo sapiens
augcuaaauaacuauau

SEQ ID NO: 1900353 - RNA, 23 nt, Homo sapiens
cucaccucuacccaaacccuagg

SEQ ID NO: 1900354 - RNA, 13 nt, Homo sapiens
gugaaagcccagg

SEQ ID NO: 1900355 - RNA, 20 nt, Homo sapiens
aucuuccaugcuacauguac

SEQ ID NO: 1900356 - RNA, 17 nt, Homo sapiens
uuccggaaagccuuccu

SEQ ID NO: 1900357 - RNA, 17 nt, Homo sapiens
ugguggcauuguuuaca

SEQ ID NO: 1900358 - RNA, 18 nt, Homo sapiens
aaagcuaucuucauguaa

SEQ ID NO: 1900359 - RNA, 22 nt, Homo sapiens
cacacaaaggcaugcuggagua

SEQ ID NO: 1900360 - RNA, 16 nt, Homo sapiens
aaugacuuaagcacac

SEQ ID NO: 1900361 - RNA, 17 nt, Homo sapiens
gggauugcuuugcauua

SEQ ID NO: 1900362 - RNA, 14 nt, Homo sapiens
guuguaauugcauu

SEQ ID NO: 1900363 - RNA, 18 nt, Homo sapiens
aagagccuggaacuuccu

SEQ ID NO: 1900364 - RNA, 23 nt, Homo sapiens
ucugagcccccugaccuuccaaa

SEQ ID NO: 1900365 - RNA, 20 nt, Homo sapiens
gaaaugguuuuuaaacaacc

SEQ ID NO: 1900366 - RNA, 19 nt, Homo sapiens
ugcacucuaacccuaggca

SEQ ID NO: 1900367 - RNA, 12 nt, Homo sapiens
auuuaucaagga

SEQ ID NO: 1900368 - RNA, 15 nt, Homo sapiens
caauaaaacugaugu

SEQ ID NO: 1900369 - RNA, 22 nt, Homo sapiens
gucacuggagucuccuccccau

SEQ ID NO: 1900370 - RNA, 23 nt, Homo sapiens
gugaaaaggguacagaugugcug

SEQ ID NO: 1900371 - RNA, 23 nt, Homo sapiens
guuuccuaggaggaaaauuccau

SEQ ID NO: 1900372 - RNA, 21 nt, Homo sapiens
cauuauuacuccuugccauuu

SEQ ID NO: 1900373 - RNA, 18 nt, Homo sapiens
uuccuuaauccagcugau

SEQ ID NO: 1900374 - RNA, 19 nt, Homo sapiens
aacgcccuuuccuccucag

SEQ ID NO: 1900375 - RNA, 14 nt, Homo sapiens
acacuaguccauaa

SEQ ID NO: 1900376 - RNA, 13 nt, Homo sapiens
gaugucaucuucc

SEQ ID NO: 1900377 - RNA, 17 nt, Homo sapiens
auuugaaaccaggacau

SEQ ID NO: 1900378 - RNA, 15 nt, Homo sapiens
auaaggauguuaacu

SEQ ID NO: 1900379 - RNA, 15 nt, Homo sapiens
aaucccagcuacuug

SEQ ID NO: 1900380 - RNA, 15 nt, Homo sapiens
cuguuaacuaugaca

SEQ ID NO: 1900381 - RNA, 14 nt, Homo sapiens
agaauagaaaacug

SEQ ID NO: 1900382 - RNA, 18 nt, Homo sapiens
aaaacugcuuugugcaua

SEQ ID NO: 1900383 - RNA, 15 nt, Homo sapiens
uuaagucccauucag

SEQ ID NO: 1900384 - RNA, 18 nt, Homo sapiens
agaagacaacauuucuca

SEQ ID NO: 1900385 - RNA, 15 nt, Homo sapiens
uugugucugacucag

SEQ ID NO: 1900386 - RNA, 14 nt, Homo sapiens
aguuggugcucaau

SEQ ID NO: 1900387 - RNA, 15 nt, Homo sapiens
acauuuuacuacuga

SEQ ID NO: 1900388 - RNA, 23 nt, Homo sapiens
ucucaauaaaauuauagcucuaa

SEQ ID NO: 1900389 - RNA, 15 nt, Homo sapiens
auuuuaauacauuga

SEQ ID NO: 1900390 - RNA, 13 nt, Homo sapiens
aaguaucaugcau

SEQ ID NO: 1900391 - RNA, 18 nt, Homo sapiens
caugaaacauguucucaa

SEQ ID NO: 1900392 - RNA, 15 nt, Homo sapiens
agaacaggauucuag

SEQ ID NO: 1900393 - RNA, 14 nt, Homo sapiens
caucaccuucucaa

SEQ ID NO: 1900394 - RNA, 15 nt, Homo sapiens
guucacaaacuguga

SEQ ID NO: 1900395 - RNA, 17 nt, Homo sapiens
acuuugaaaacaauuca

SEQ ID NO: 1900396 - RNA, 21 nt, Homo sapiens
aaaccuguugaauaauuugau

SEQ ID NO: 1900397 - RNA, 14 nt, Homo sapiens
aucccaguccugau

SEQ ID NO: 1900398 - RNA, 16 nt, Homo sapiens
guucauauaugcaaaa

SEQ ID NO: 1900399 - RNA, 20 nt, Homo sapiens
caaugagccaagauugcgcc

SEQ ID NO: 1900400 - RNA, 15 nt, Homo sapiens
cugggccauguccaa

SEQ ID NO: 1900401 - RNA, 15 nt, Homo sapiens
aucacuuuaccugca

SEQ ID NO: 1900402 - RNA, 17 nt, Homo sapiens
gauaaagcuuaggucaa

SEQ ID NO: 1900403 - RNA, 17 nt, Homo sapiens
uagccauuuuuuugcag

SEQ ID NO: 1900404 - RNA, 21 nt, Homo sapiens
uuauguggaagaacugugaua

SEQ ID NO: 1900405 - RNA, 20 nt, Homo sapiens
uacauucugcucccagcucu

SEQ ID NO: 1900406 - RNA, 19 nt, Homo sapiens
ugcaggaucucaccaggca

SEQ ID NO: 1900407 - RNA, 13 nt, Homo sapiens
uucagacuuuaaa

SEQ ID NO: 1900408 - RNA, 13 nt, Homo sapiens
uccagacuucaaa

SEQ ID NO: 1900409 - RNA, 13 nt, Homo sapiens
uuauccugugcua

SEQ ID NO: 1900410 - RNA, 20 nt, Homo sapiens
guugcugcuugugaucucac

SEQ ID NO: 1900411 - RNA, 15 nt, Homo sapiens
aggugaagaugaaga

SEQ ID NO: 1900412 - RNA, 21 nt, Homo sapiens
ucacugcuuuuuccuuagcuu

SEQ ID NO: 1900413 - RNA, 16 nt, Homo sapiens
caguaaucccauuucc

SEQ ID NO: 1900414 - RNA, 23 nt, Homo sapiens
uuauaugaacauagacuagagaa

SEQ ID NO: 1900415 - RNA, 23 nt, Homo sapiens
auaauuauuuuuuucacuuguua

SEQ ID NO: 1900416 - RNA, 17 nt, Homo sapiens
uugcuaagugugcuuag

SEQ ID NO: 1900417 - RNA, 11 nt, Homo sapiens
cccugccuuua

SEQ ID NO: 1900418 - RNA, 21 nt, Homo sapiens
ucaaucucagcuaacauucca

SEQ ID NO: 1900419 - RNA, 10 nt, Homo sapiens
ucaaagggaa

SEQ ID NO: 1900420 - RNA, 14 nt, Homo sapiens
uccuacucugggaa

SEQ ID NO: 1900421 - RNA, 21 nt, Homo sapiens
uuaccuauuauaaaaucuuac

SEQ ID NO: 1900422 - RNA, 19 nt, Homo sapiens
aaggucauggccacacugu

SEQ ID NO: 1900423 - RNA, 23 nt, Homo sapiens
cucagcuucccaaguagcugaga

SEQ ID NO: 1900424 - RNA, 20 nt, Homo sapiens
uuugauuuuccucucucaca

SEQ ID NO: 1900425 - RNA, 22 nt, Homo sapiens
guuucuuguaagccaucagaag

SEQ ID NO: 1900426 - RNA, 19 nt, Homo sapiens
gcuaaacucuuucaucccc

SEQ ID NO: 1900427 - RNA, 23 nt, Homo sapiens
uaguuacaguaaauacacuguga

SEQ ID NO: 1900428 - RNA, 18 nt, Homo sapiens
ucaccugggccuuuccug

SEQ ID NO: 1900429 - RNA, 14 nt, Homo sapiens
guaaccagugcaga

SEQ ID NO: 1900430 - RNA, 21 nt, Homo sapiens
aauuauucagauguacaccca

SEQ ID NO: 1900431 - RNA, 23 nt, Homo sapiens
accaguuucuugaaguccagugu

SEQ ID NO: 1900432 - RNA, 17 nt, Homo sapiens
agagauaagucuuucau

SEQ ID NO: 1900433 - RNA, 22 nt, Homo sapiens
caaacucuuaguuacucauuca

SEQ ID NO: 1900434 - RNA, 13 nt, Homo sapiens
auaucucuugccc

SEQ ID NO: 1900435 - RNA, 20 nt, Homo sapiens
cuggacagaugaauaccuuu

SEQ ID NO: 1900436 - RNA, 16 nt, Homo sapiens
auuccuaggucacuug

SEQ ID NO: 1900437 - RNA, 21 nt, Homo sapiens
ccagcuucccgaguaccagug

SEQ ID NO: 1900438 - RNA, 22 nt, Homo sapiens
cagagcugcagagagcaccugg

SEQ ID NO: 1900439 - RNA, 13 nt, Homo sapiens
uaauaaaccugua

SEQ ID NO: 1900440 - RNA, 15 nt, Homo sapiens
agugggaaggggugc

SEQ ID NO: 1900441 - RNA, 12 nt, Homo sapiens
gauaagcauuuu

SEQ ID NO: 1900442 - RNA, 22 nt, Homo sapiens
guguucaacugugaguuucauc

SEQ ID NO: 1900443 - RNA, 20 nt, Homo sapiens
ucaccaugaacaaagauaua

SEQ ID NO: 1900444 - RNA, 12 nt, Homo sapiens
agcucacacuca

SEQ ID NO: 1900445 - RNA, 22 nt, Homo sapiens
cugauuuaacacuauccaauga

SEQ ID NO: 1900446 - RNA, 13 nt, Homo sapiens
aggagugcugaua

SEQ ID NO: 1900447 - RNA, 15 nt, Homo sapiens
uauguacuauucaau

SEQ ID NO: 1900448 - RNA, 22 nt, Homo sapiens
cagcuuuuuuaugucacucaaa

SEQ ID NO: 1900449 - RNA, 15 nt, Homo sapiens
agauagcuacagugu

SEQ ID NO: 1900450 - RNA, 12 nt, Homo sapiens
aacaaaccaagc

SEQ ID NO: 1900451 - RNA, 22 nt, Homo sapiens
caagugugcauuaccacacuca

SEQ ID NO: 1900452 - RNA, 19 nt, Homo sapiens
aucagcacuuuaaccaaug

SEQ ID NO: 1900453 - RNA, 16 nt, Homo sapiens
gauacuuuuacagguu

SEQ ID NO: 1900454 - RNA, 15 nt, Homo sapiens
aguacuuugucuuga

SEQ ID NO: 1900455 - RNA, 14 nt, Homo sapiens
aaggaagcacaugc

SEQ ID NO: 1900456 - RNA, 20 nt, Homo sapiens
agucccauccucuugucagg

SEQ ID NO: 1900457 - RNA, 21 nt, Homo sapiens
uauuucaaccgcuugccauau

SEQ ID NO: 1900458 - RNA, 16 nt, Homo sapiens
aacuguagucucagga

SEQ ID NO: 1900459 - RNA, 16 nt, Homo sapiens
ucccauggaauuggaa

SEQ ID NO: 1900460 - RNA, 15 nt, Homo sapiens
accuugaacacuggg

SEQ ID NO: 1900461 - RNA, 18 nt, Homo sapiens
ccaaaacaagccaaagag

SEQ ID NO: 1900462 - RNA, 12 nt, Homo sapiens
gacaccaccauc

SEQ ID NO: 1900463 - RNA, 13 nt, Homo sapiens
uuguugguggaga

SEQ ID NO: 1900464 - RNA, 16 nt, Homo sapiens
uagguuaauaaaucaa

SEQ ID NO: 1900465 - RNA, 16 nt, Homo sapiens
guuugguucaugguga

SEQ ID NO: 1900466 - RNA, 17 nt, Homo sapiens
ugaauaaauaaguaaau

SEQ ID NO: 1900467 - RNA, 18 nt, Homo sapiens
cuuuuuccagguuccuga

SEQ ID NO: 1900468 - RNA, 21 nt, Homo sapiens
caacuuuagaauuucuacaaa

SEQ ID NO: 1900469 - RNA, 20 nt, Homo sapiens
guauuaagcuccagugcuuu

SEQ ID NO: 1900470 - RNA, 22 nt, Homo sapiens
accaucugguaucaucuucuca

SEQ ID NO: 1900471 - RNA, 16 nt, Homo sapiens
uuccucuggccaggua

SEQ ID NO: 1900472 - RNA, 22 nt, Homo sapiens
uaaacuaccacccucgcugcca

SEQ ID NO: 1900473 - RNA, 21 nt, Homo sapiens
aacagaaaccagaaaagcaau

SEQ ID NO: 1900474 - RNA, 14 nt, Homo sapiens
uaaauggaacaaac

SEQ ID NO: 1900475 - RNA, 12 nt, Homo sapiens
aaauguguaaua

SEQ ID NO: 1900476 - RNA, 21 nt, Homo sapiens
gagaaaacaggcucacagaga

SEQ ID NO: 1900477 - RNA, 17 nt, Homo sapiens
caacuaaauaacuguau

SEQ ID NO: 1900478 - RNA, 14 nt, Homo sapiens
uuaaccuguuuuca

SEQ ID NO: 1900479 - RNA, 18 nt, Homo sapiens
ugaagucuugcucugcca

SEQ ID NO: 1900480 - RNA, 23 nt, Homo sapiens
ugccacccucacacacacagcug

SEQ ID NO: 1900481 - RNA, 19 nt, Homo sapiens
cuccugcucauauugugau

SEQ ID NO: 1900482 - RNA, 19 nt, Homo sapiens
aguagagacgggguuucau

SEQ ID NO: 1900483 - RNA, 15 nt, Homo sapiens
accaguuaugugaau

SEQ ID NO: 1900484 - RNA, 14 nt, Homo sapiens
aggugauggccagu

SEQ ID NO: 1900485 - RNA, 12 nt, Homo sapiens
uaucacagucag

SEQ ID NO: 1900486 - RNA, 23 nt, Homo sapiens
cacacgaggucacguguggaauu

SEQ ID NO: 1900487 - RNA, 19 nt, Homo sapiens
ccucuacuuugauucugau

SEQ ID NO: 1900488 - RNA, 12 nt, Homo sapiens
ugacugagggcc

SEQ ID NO: 1900489 - RNA, 18 nt, Homo sapiens
uccacaauaaccaagaua

SEQ ID NO: 1900490 - RNA, 20 nt, Homo sapiens
ccaaaguucacauuaacuca

SEQ ID NO: 1900491 - RNA, 16 nt, Homo sapiens
cucuucaaucucuugc

SEQ ID NO: 1900492 - RNA, 20 nt, Homo sapiens
acucugccuuuaugaugcua

SEQ ID NO: 1900493 - RNA, 16 nt, Homo sapiens
gaagcagucucuuccu

SEQ ID NO: 1900494 - RNA, 16 nt, Homo sapiens
acuuaaugcacagugc

SEQ ID NO: 1900495 - RNA, 22 nt, Homo sapiens
ucucugccauggccuuggcagg

SEQ ID NO: 1900496 - RNA, 19 nt, Homo sapiens
accucuaacaucagaacau

SEQ ID NO: 1900497 - RNA, 16 nt, Homo sapiens
auccauggccagcagc

SEQ ID NO: 1900498 - RNA, 13 nt, Homo sapiens
ucaagaugugaca

SEQ ID NO: 1900499 - RNA, 21 nt, Homo sapiens
caaccuucugcccuccugcca

SEQ ID NO: 1900500 - RNA, 21 nt, Homo sapiens
caguccugguugucugaaccc

SEQ ID NO: 1900501 - RNA, 19 nt, Homo sapiens
gaauuuacagaacaguuua

SEQ ID NO: 1900502 - RNA, 19 nt, Homo sapiens
ggcaugaacacacauggau

SEQ ID NO: 1900503 - RNA, 22 nt, Homo sapiens
aacucuagcauucuaguuucau

SEQ ID NO: 1900504 - RNA, 22 nt, Homo sapiens
acccaccaucuacccacuuacu

SEQ ID NO: 1900505 - RNA, 19 nt, Homo sapiens
ugcacaacucuccaaaaca

SEQ ID NO: 1900506 - RNA, 22 nt, Homo sapiens
ccaaaugcugugcaaacagugu

SEQ ID NO: 1900507 - RNA, 15 nt, Homo sapiens
cccugacuguauaca

SEQ ID NO: 1900508 - RNA, 19 nt, Homo sapiens
uccuuuuccuaauucacac

SEQ ID NO: 1900509 - RNA, 16 nt, Homo sapiens
ugagucuucagaagaa

SEQ ID NO: 1900510 - RNA, 15 nt, Homo sapiens
caggcagauccagga

SEQ ID NO: 1900511 - RNA, 18 nt, Homo sapiens
uauguaugggagauggca

SEQ ID NO: 1900512 - RNA, 17 nt, Homo sapiens
aaauuagcugugugaaa

SEQ ID NO: 1900513 - RNA, 16 nt, Homo sapiens
aaccauugugcauucu

SEQ ID NO: 1900514 - RNA, 18 nt, Homo sapiens
uacaguauugcuauuuau

SEQ ID NO: 1900515 - RNA, 17 nt, Homo sapiens
guccugaaaaaugcuca

SEQ ID NO: 1900516 - RNA, 17 nt, Homo sapiens
acuuuugggaacucucc

SEQ ID NO: 1900517 - RNA, 20 nt, Homo sapiens
augcuugcuucaaccccaug

SEQ ID NO: 1900518 - RNA, 19 nt, Homo sapiens
uggcaaacccucccagaaa

SEQ ID NO: 1900519 - RNA, 18 nt, Homo sapiens
aaagaaauauuaauaugu

SEQ ID NO: 1900520 - RNA, 16 nt, Homo sapiens
gaucuuaaagcauucc

SEQ ID NO: 1900521 - RNA, 22 nt, Homo sapiens
ucccggguucaagugauucucc

SEQ ID NO: 1900522 - RNA, 14 nt, Homo sapiens
ucaauccugccaau

SEQ ID NO: 1900523 - RNA, 13 nt, Homo sapiens
agcagaugaugcc

SEQ ID NO: 1900524 - RNA, 16 nt, Homo sapiens
ucagcaauauugccug

SEQ ID NO: 1900525 - RNA, 19 nt, Homo sapiens
cucgguauuaauccaaagc

SEQ ID NO: 1900526 - RNA, 19 nt, Homo sapiens
aucucaggccaccugcccc

SEQ ID NO: 1900527 - RNA, 15 nt, Homo sapiens
uucagauauacugga

SEQ ID NO: 1900528 - RNA, 23 nt, Homo sapiens
gcaaacauuucuaacucuauuaa

SEQ ID NO: 1900529 - RNA, 22 nt, Homo sapiens
auaucuuguaaauaaagacauu

SEQ ID NO: 1900530 - RNA, 22 nt, Homo sapiens
guccccuaacccccaguccuca

SEQ ID NO: 1900531 - RNA, 15 nt, Homo sapiens
aaagucgccagucac

SEQ ID NO: 1900532 - RNA, 11 nt, Homo sapiens
uggccugagag

SEQ ID NO: 1900533 - RNA, 20 nt, Homo sapiens
cagagaugccaugauaucac

SEQ ID NO: 1900534 - RNA, 17 nt, Homo sapiens
uuggcagagcuuuugca

SEQ ID NO: 1900535 - RNA, 15 nt, Homo sapiens
uaaacuaguuuccag

SEQ ID NO: 1900536 - RNA, 19 nt, Homo sapiens
ggaggaagauugauuuucu

SEQ ID NO: 1900537 - RNA, 21 nt, Homo sapiens
uaaugaaguagaaguuacuua

SEQ ID NO: 1900538 - RNA, 22 nt, Homo sapiens
acccaggccgccugccauaccg

SEQ ID NO: 1900539 - RNA, 19 nt, Homo sapiens
agcacugagcaaagcauug

SEQ ID NO: 1900540 - RNA, 21 nt, Homo sapiens
caagcccuggcaacauaguga

SEQ ID NO: 1900541 - RNA, 14 nt, Homo sapiens
cauuccaguaggaa

SEQ ID NO: 1900542 - RNA, 14 nt, Homo sapiens
uugugaucauccca

SEQ ID NO: 1900543 - RNA, 19 nt, Homo sapiens
ucaaaagaaaauauaguca

SEQ ID NO: 1900544 - RNA, 19 nt, Homo sapiens
gcauggcucccgaguacag

SEQ ID NO: 1900545 - RNA, 18 nt, Homo sapiens
cuacaguggcacaucaac

SEQ ID NO: 1900546 - RNA, 21 nt, Homo sapiens
aacuaugaucacagugacuuu

SEQ ID NO: 1900547 - RNA, 16 nt, Homo sapiens
uguuuugugacuuuua

SEQ ID NO: 1900548 - RNA, 14 nt, Homo sapiens
ucugucaccagcua

SEQ ID NO: 1900549 - RNA, 14 nt, Homo sapiens
caagcagauguccu

SEQ ID NO: 1900550 - RNA, 14 nt, Homo sapiens
uaguuauaaaccaa

SEQ ID NO: 1900551 - RNA, 15 nt, Homo sapiens
agagcuuucaaguac

SEQ ID NO: 1900552 - RNA, 18 nt, Homo sapiens
uuuguaauaacauuuaau

SEQ ID NO: 1900553 - RNA, 17 nt, Homo sapiens
agaaacagccugugucu

SEQ ID NO: 1900554 - RNA, 14 nt, Homo sapiens
uccccuucccugac

SEQ ID NO: 1900555 - RNA, 17 nt, Homo sapiens
caaguagcugagauuac

SEQ ID NO: 1900556 - RNA, 18 nt, Homo sapiens
gguuggggugacagucau

SEQ ID NO: 1900557 - RNA, 16 nt, Homo sapiens
uggguacuuucugaaa

SEQ ID NO: 1900558 - RNA, 22 nt, Homo sapiens
guaaaaugaguuuguauuauua

SEQ ID NO: 1900559 - RNA, 22 nt, Homo sapiens
ugcauaaacuguuguaugccug

SEQ ID NO: 1900560 - RNA, 24 nt, Homo sapiens
cuccuagggcuaugguguggacug

SEQ ID NO: 1900561 - RNA, 23 nt, Homo sapiens
uucaugggcccacaggguaccag

SEQ ID NO: 1900562 - RNA, 23 nt, Homo sapiens
guuuucugugcacuguagccuua

SEQ ID NO: 1900563 - RNA, 18 nt, Homo sapiens
ccaaacggaacucuucau

SEQ ID NO: 1900564 - RNA, 22 nt, Homo sapiens
accagccugagcaacaugguga

SEQ ID NO: 1900565 - RNA, 19 nt, Homo sapiens
caggccaggagacuguuaa

SEQ ID NO: 1900566 - RNA, 13 nt, Homo sapiens
cuccuguuugcag

SEQ ID NO: 1900567 - RNA, 22 nt, Homo sapiens
auaaaagcucagaugacauuuc

SEQ ID NO: 1900568 - RNA, 15 nt, Homo sapiens
uggggauacuggcaa

SEQ ID NO: 1900569 - RNA, 15 nt, Homo sapiens
cauauuuauauugua

SEQ ID NO: 1900570 - RNA, 22 nt, Homo sapiens
ccaaaugcuuugggaacugugu

SEQ ID NO: 1900571 - RNA, 18 nt, Homo sapiens
aacagaacaucauuagaa

SEQ ID NO: 1900572 - RNA, 12 nt, Homo sapiens
ucaacacaaaga

SEQ ID NO: 1900573 - RNA, 15 nt, Homo sapiens
aggacucugcuuaaa

SEQ ID NO: 1900574 - RNA, 18 nt, Homo sapiens
auccaugcguuucuucca

SEQ ID NO: 1900575 - RNA, 21 nt, Homo sapiens
aguggggauuuguaagacuua

SEQ ID NO: 1900576 - RNA, 19 nt, Homo sapiens
ccugcucccagcagcccua

SEQ ID NO: 1900577 - RNA, 14 nt, Homo sapiens
aaaaagauccaggg

SEQ ID NO: 1900578 - RNA, 16 nt, Homo sapiens
cacacuggccauucuu

SEQ ID NO: 1900579 - RNA, 13 nt, Homo sapiens
ugcaaugucacaa

SEQ ID NO: 1900580 - RNA, 13 nt, Homo sapiens
aacuuuucaucca

SEQ ID NO: 1900581 - RNA, 19 nt, Homo sapiens
uaauauuuuccuaguagau

SEQ ID NO: 1900582 - RNA, 13 nt, Homo sapiens
uaacagcugucaa

SEQ ID NO: 1900583 - RNA, 20 nt, Homo sapiens
ggcucaugauuuuuuacaaa

SEQ ID NO: 1900584 - RNA, 20 nt, Homo sapiens
gcaggcucugccagcccugg

SEQ ID NO: 1900585 - RNA, 14 nt, Homo sapiens
augaacccaaaaag

SEQ ID NO: 1900586 - RNA, 14 nt, Homo sapiens
ggcccugucuggag

SEQ ID NO: 1900587 - RNA, 12 nt, Homo sapiens
cuauaacauauu

SEQ ID NO: 1900588 - RNA, 20 nt, Homo sapiens
cuacucaugaggcugaggca

SEQ ID NO: 1900589 - RNA, 18 nt, Homo sapiens
aaggcugugcaggcacau

SEQ ID NO: 1900590 - RNA, 21 nt, Homo sapiens
ccauucauaaggauucaggga

SEQ ID NO: 1900591 - RNA, 21 nt, Homo sapiens
uucccgcccagccucacuucc

SEQ ID NO: 1900592 - RNA, 16 nt, Homo sapiens
uaaacgugaugugcuc

SEQ ID NO: 1900593 - RNA, 18 nt, Homo sapiens
ugcuuucuugucuuuaga

SEQ ID NO: 1900594 - RNA, 16 nt, Homo sapiens
caaccagagcagcuca

SEQ ID NO: 1900595 - RNA, 12 nt, Homo sapiens
cucucugcccaa

SEQ ID NO: 1900596 - RNA, 16 nt, Homo sapiens
auaagugcuguauaaa

SEQ ID NO: 1900597 - RNA, 17 nt, Homo sapiens
agaauugucuugcaagu

SEQ ID NO: 1900598 - RNA, 16 nt, Homo sapiens
ucacacauuacaaagu

SEQ ID NO: 1900599 - RNA, 22 nt, Homo sapiens
cccugagcaggucaggacucag

SEQ ID NO: 1900600 - RNA, 15 nt, Homo sapiens
cacugccugaaagac

SEQ ID NO: 1900601 - RNA, 16 nt, Homo sapiens
gccacugcccaaagcc

SEQ ID NO: 1900602 - RNA, 21 nt, Homo sapiens
cuuaaguaucucaacaacaug

SEQ ID NO: 1900603 - RNA, 12 nt, Homo sapiens
gcagagugaaug

SEQ ID NO: 1900604 - RNA, 12 nt, Homo sapiens
gauaagugacaa

SEQ ID NO: 1900605 - RNA, 21 nt, Homo sapiens
ccacacccucuccuugucaca

SEQ ID NO: 1900606 - RNA, 22 nt, Homo sapiens
ggcaaccacaggcagcauuuag

SEQ ID NO: 1900607 - RNA, 21 nt, Homo sapiens
ugaggaaacugaggugcaaag

SEQ ID NO: 1900608 - RNA, 13 nt, Homo sapiens
cuacgugcuccuc

SEQ ID NO: 1900609 - RNA, 19 nt, Homo sapiens
agaucaagaaaucccugag

SEQ ID NO: 1900610 - RNA, 12 nt, Homo sapiens
ugccauaugccu

SEQ ID NO: 1900611 - RNA, 22 nt, Homo sapiens
augacggcugcucgaagaacaa

SEQ ID NO: 1900612 - RNA, 21 nt, Homo sapiens
cuuucugcaugaccaaaguga

SEQ ID NO: 1900613 - RNA, 21 nt, Homo sapiens
ggauauuuccauauggcaaua

SEQ ID NO: 1900614 - RNA, 14 nt, Homo sapiens
guaucuaauucucc

SEQ ID NO: 1900615 - RNA, 14 nt, Homo sapiens
uuaaacaagucaau

SEQ ID NO: 1900616 - RNA, 13 nt, Homo sapiens
gcgcaccaucucu

SEQ ID NO: 1900617 - RNA, 16 nt, Homo sapiens
caaaguuaauucaccu

SEQ ID NO: 1900618 - RNA, 17 nt, Homo sapiens
uugcaucugaaagagaa

SEQ ID NO: 1900619 - RNA, 20 nt, Homo sapiens
ugaagacugggugaggauaa

SEQ ID NO: 1900620 - RNA, 15 nt, Homo sapiens
aucugaggcaaucua

SEQ ID NO: 1900621 - RNA, 23 nt, Homo sapiens
gaaauacccauguuacuucucug

SEQ ID NO: 1900622 - RNA, 18 nt, Homo sapiens
aaaaugaugggacaauaa

SEQ ID NO: 1900623 - RNA, 18 nt, Homo sapiens
aggaaccgcccagugcag

SEQ ID NO: 1900624 - RNA, 16 nt, Homo sapiens
cugggagcacuggugu

SEQ ID NO: 1900625 - RNA, 17 nt, Homo sapiens
ugauugcuuaccuacau

SEQ ID NO: 1900626 - RNA, 23 nt, Homo sapiens
cucauugcccccaccucuggucc

SEQ ID NO: 1900627 - RNA, 17 nt, Homo sapiens
acccucuccuccagugu

SEQ ID NO: 1900628 - RNA, 18 nt, Homo sapiens
agguauaucucccagugc

SEQ ID NO: 1900629 - RNA, 15 nt, Homo sapiens
uccaaugacauaucc

SEQ ID NO: 1900630 - RNA, 21 nt, Homo sapiens
gcgcaggaaccgaggacucca

SEQ ID NO: 1900631 - RNA, 13 nt, Homo sapiens
ucuaagugauaua

SEQ ID NO: 1900632 - RNA, 16 nt, Homo sapiens
ucagaacaaucugagu

SEQ ID NO: 1900633 - RNA, 15 nt, Homo sapiens
uucuggcacugguug

SEQ ID NO: 1900634 - RNA, 15 nt, Homo sapiens
uguauaaacugucaa

SEQ ID NO: 1900635 - RNA, 17 nt, Homo sapiens
uaaagauguuuauuuca

SEQ ID NO: 1900636 - RNA, 20 nt, Homo sapiens
uuaauaaauuaaaacaugca

SEQ ID NO: 1900637 - RNA, 18 nt, Homo sapiens
uaucuaaacccagcaaaa

SEQ ID NO: 1900638 - RNA, 18 nt, Homo sapiens
uacauuaaacaugacucc

SEQ ID NO: 1900639 - RNA, 11 nt, Homo sapiens
aaguucaggga

SEQ ID NO: 1900640 - RNA, 14 nt, Homo sapiens
cuguccagugccua

SEQ ID NO: 1900641 - RNA, 13 nt, Homo sapiens
uguggucugggga

SEQ ID NO: 1900642 - RNA, 16 nt, Homo sapiens
gaaaacucaaccagag

SEQ ID NO: 1900643 - RNA, 18 nt, Homo sapiens
cuacaaagcuuugcuaca

SEQ ID NO: 1900644 - RNA, 15 nt, Homo sapiens
uaaaaaccuguucaa

SEQ ID NO: 1900645 - RNA, 14 nt, Homo sapiens
ggaggccgggcaug

SEQ ID NO: 1900646 - RNA, 18 nt, Homo sapiens
accuaguaugcucaguaa

SEQ ID NO: 1900647 - RNA, 16 nt, Homo sapiens
aaaucuagaagacugu

SEQ ID NO: 1900648 - RNA, 13 nt, Homo sapiens
uggagaaggugac

SEQ ID NO: 1900649 - RNA, 16 nt, Homo sapiens
auuugaguauugcuga

SEQ ID NO: 1900650 - RNA, 13 nt, Homo sapiens
guacaaaggggaa

SEQ ID NO: 1900651 - RNA, 20 nt, Homo sapiens
uuccugagaggaagccugag

SEQ ID NO: 1900652 - RNA, 18 nt, Homo sapiens
cccuuguacaaccgacag

SEQ ID NO: 1900653 - RNA, 16 nt, Homo sapiens
aaugguuagcuuaaua

SEQ ID NO: 1900654 - RNA, 16 nt, Homo sapiens
cugaagauacaugucu

SEQ ID NO: 1900655 - RNA, 14 nt, Homo sapiens
agcaaaauaaugca

SEQ ID NO: 1900656 - RNA, 23 nt, Homo sapiens
aguucagaguuguacacugugua

SEQ ID NO: 1900657 - RNA, 22 nt, Homo sapiens
uuagcaaacuguuuugacaaau

SEQ ID NO: 1900658 - RNA, 20 nt, Homo sapiens
uaccuacauacguguuccua

SEQ ID NO: 1900659 - RNA, 15 nt, Homo sapiens
ugauguauacccaua

SEQ ID NO: 1900660 - RNA, 19 nt, Homo sapiens
ucucugugcuuugacucac

SEQ ID NO: 1900661 - RNA, 17 nt, Homo sapiens
ccuguggcccuggcauc

SEQ ID NO: 1900662 - RNA, 15 nt, Homo sapiens
uaaauguaagaauca

SEQ ID NO: 1900663 - RNA, 23 nt, Homo sapiens
agagaugcgaaccacccaaaaca

SEQ ID NO: 1900664 - RNA, 14 nt, Homo sapiens
cagcucacugcaac

SEQ ID NO: 1900665 - RNA, 14 nt, Homo sapiens
cagaucacugccac

SEQ ID NO: 1900666 - RNA, 18 nt, Homo sapiens
acuggaaguucauaccua

SEQ ID NO: 1900667 - RNA, 17 nt, Homo sapiens
acucuuaaguuucucag

SEQ ID NO: 1900668 - RNA, 23 nt, Homo sapiens
ccuuuaaaauaauaauaguacua

SEQ ID NO: 1900669 - RNA, 22 nt, Homo sapiens
ggguaccuuaagagacacucca

SEQ ID NO: 1900670 - RNA, 19 nt, Homo sapiens
cccaugggcugccuugaaa

SEQ ID NO: 1900671 - RNA, 16 nt, Homo sapiens
caguaacugugacuga

SEQ ID NO: 1900672 - RNA, 18 nt, Homo sapiens
ccuguauucucagcacuu

SEQ ID NO: 1900673 - RNA, 23 nt, Homo sapiens
aggaguucacuucaucuucucag

SEQ ID NO: 1900674 - RNA, 13 nt, Homo sapiens
acugugaccaaag

SEQ ID NO: 1900675 - RNA, 13 nt, Homo sapiens
aagagcacacaga

SEQ ID NO: 1900676 - RNA, 19 nt, Homo sapiens
uggccucagcccugcuccc

SEQ ID NO: 1900677 - RNA, 16 nt, Homo sapiens
agccccacaacuuuaa

SEQ ID NO: 1900678 - RNA, 14 nt, Homo sapiens
uggggcaagccuga

SEQ ID NO: 1900679 - RNA, 20 nt, Homo sapiens
cuuagugaaaggucaucuca

SEQ ID NO: 1900680 - RNA, 22 nt, Homo sapiens
cauaguaacucuuauggagacc

SEQ ID NO: 1900681 - RNA, 15 nt, Homo sapiens
uggaccacugcauga

SEQ ID NO: 1900682 - RNA, 15 nt, Homo sapiens
aucccaccacugcac

SEQ ID NO: 1900683 - RNA, 22 nt, Homo sapiens
uugcugcauuuucuucacuugc

SEQ ID NO: 1900684 - RNA, 18 nt, Homo sapiens
gucucuacuaaaaauaca

SEQ ID NO: 1900685 - RNA, 21 nt, Homo sapiens
cuaaauaaacaucugaucugu

SEQ ID NO: 1900686 - RNA, 20 nt, Homo sapiens
uaucauggaauuuccauuga

SEQ ID NO: 1900687 - RNA, 18 nt, Homo sapiens
cucugccuuugacauuua

SEQ ID NO: 1900688 - RNA, 21 nt, Homo sapiens
gcaccucauggacuccaggau

SEQ ID NO: 1900689 - RNA, 21 nt, Homo sapiens
aacaacuauccugacuucuaa

SEQ ID NO: 1900690 - RNA, 21 nt, Homo sapiens
gaagacucuaccagacugugu

SEQ ID NO: 1900691 - RNA, 21 nt, Homo sapiens
uuauaaaaucuuuccaucuca

SEQ ID NO: 1900692 - RNA, 22 nt, Homo sapiens
aauaaaaugaaguggugagcuu

SEQ ID NO: 1900693 - RNA, 13 nt, Homo sapiens
agaacaguuugua

SEQ ID NO: 1900694 - RNA, 13 nt, Homo sapiens
aagccuggcaagg

SEQ ID NO: 1900695 - RNA, 19 nt, Homo sapiens
agcauccugcaaggugaaa

SEQ ID NO: 1900696 - RNA, 20 nt, Homo sapiens
accucaagugcaaggaccaa

SEQ ID NO: 1900697 - RNA, 17 nt, Homo sapiens
ucucguacuuucacauc

SEQ ID NO: 1900698 - RNA, 20 nt, Homo sapiens
aacacauuuuguauaauugu

SEQ ID NO: 1900699 - RNA, 13 nt, Homo sapiens
caagucuacuuca

SEQ ID NO: 1900700 - RNA, 17 nt, Homo sapiens
cagauauuacagcuuau

SEQ ID NO: 1900701 - RNA, 14 nt, Homo sapiens
agcaguguuuuaga

SEQ ID NO: 1900702 - RNA, 17 nt, Homo sapiens
agcgagagaauauguca

SEQ ID NO: 1900703 - RNA, 17 nt, Homo sapiens
uuaucugucucuucuac

SEQ ID NO: 1900704 - RNA, 15 nt, Homo sapiens
uaacugagugccuuu

SEQ ID NO: 1900705 - RNA, 15 nt, Homo sapiens
ugauuuaguacuugu

SEQ ID NO: 1900706 - RNA, 21 nt, Homo sapiens
ugaauuuguauuaaaaagccu

SEQ ID NO: 1900707 - RNA, 15 nt, Homo sapiens
gccgaagcucuggcu

SEQ ID NO: 1900708 - RNA, 14 nt, Homo sapiens
acagauaucuucag

SEQ ID NO: 1900709 - RNA, 16 nt, Homo sapiens
ccauuuagagggugaa

SEQ ID NO: 1900710 - RNA, 17 nt, Homo sapiens
aggccaguaugauuuau

SEQ ID NO: 1900711 - RNA, 15 nt, Homo sapiens
uccuuccccacccca

SEQ ID NO: 1900712 - RNA, 22 nt, Homo sapiens
aaaauguauuuuagacuuccug

SEQ ID NO: 1900713 - RNA, 18 nt, Homo sapiens
ucugucuguuaccauaag

SEQ ID NO: 1900714 - RNA, 13 nt, Homo sapiens
uccucuggaucac

SEQ ID NO: 1900715 - RNA, 23 nt, Homo sapiens
acuucgacagcaucaugcauuac

SEQ ID NO: 1900716 - RNA, 15 nt, Homo sapiens
uuaauaaacuacucu

SEQ ID NO: 1900717 - RNA, 18 nt, Homo sapiens
cuuauguguuuugcuaaa

SEQ ID NO: 1900718 - RNA, 21 nt, Homo sapiens
gaagcuggugcccuuccucac

SEQ ID NO: 1900719 - RNA, 15 nt, Homo sapiens
auggugaugucacuc

SEQ ID NO: 1900720 - RNA, 14 nt, Homo sapiens
gcuugcucauuaau

SEQ ID NO: 1900721 - RNA, 23 nt, Homo sapiens
guuugugauguuuccaaugcuga

SEQ ID NO: 1900722 - RNA, 17 nt, Homo sapiens
agaaaugcaaauucuca

SEQ ID NO: 1900723 - RNA, 14 nt, Homo sapiens
gaacugcaacacug

SEQ ID NO: 1900724 - RNA, 17 nt, Homo sapiens
aaagacuggauuugcag

SEQ ID NO: 1900725 - RNA, 15 nt, Homo sapiens
ugccaagcuccucaa

SEQ ID NO: 1900726 - RNA, 19 nt, Homo sapiens
cacaaaguagaggaaucca

SEQ ID NO: 1900727 - RNA, 20 nt, Homo sapiens
cuaugaaaaugagcccuggc

SEQ ID NO: 1900728 - RNA, 18 nt, Homo sapiens
auguuagcagacccagcu

SEQ ID NO: 1900729 - RNA, 18 nt, Homo sapiens
guggcuuggccucaagag

SEQ ID NO: 1900730 - RNA, 20 nt, Homo sapiens
caaacuaggcaccacacuaa

SEQ ID NO: 1900731 - RNA, 20 nt, Homo sapiens
uaaauuuaaaacacaguauu

SEQ ID NO: 1900732 - RNA, 15 nt, Homo sapiens
uuagggacugaccag

SEQ ID NO: 1900733 - RNA, 19 nt, Homo sapiens
guuccccuguuuauucaua

SEQ ID NO: 1900734 - RNA, 20 nt, Homo sapiens
acagcucuagacacugccac

SEQ ID NO: 1900735 - RNA, 13 nt, Homo sapiens
gagcgacagugag

SEQ ID NO: 1900736 - RNA, 13 nt, Homo sapiens
uuccaacauacaa

SEQ ID NO: 1900737 - RNA, 16 nt, Homo sapiens
aauauuuccaauguga

SEQ ID NO: 1900738 - RNA, 13 nt, Homo sapiens
uugaaaacucaua

SEQ ID NO: 1900739 - RNA, 17 nt, Homo sapiens
caucacuuuggacagaa

SEQ ID NO: 1900740 - RNA, 14 nt, Homo sapiens
aaagucuacacugc

SEQ ID NO: 1900741 - RNA, 23 nt, Homo sapiens
uuuggggaggaguugucuguccu

SEQ ID NO: 1900742 - RNA, 14 nt, Homo sapiens
ucacuaguggcaaa

SEQ ID NO: 1900743 - RNA, 23 nt, Homo sapiens
ucuguauuauaauaagcaaaaag

SEQ ID NO: 1900744 - RNA, 16 nt, Homo sapiens
uacugauaaaccuaau

SEQ ID NO: 1900745 - RNA, 18 nt, Homo sapiens
cacucaggcccaaagccu

SEQ ID NO: 1900746 - RNA, 22 nt, Homo sapiens
uccacacccucuccuugucaca

SEQ ID NO: 1900747 - RNA, 21 nt, Homo sapiens
caagucauuugaggaucucac

SEQ ID NO: 1900748 - RNA, 19 nt, Homo sapiens
cgaagcccaccacuggcca

SEQ ID NO: 1900749 - RNA, 20 nt, Homo sapiens
ccuugacaaagucaagccac

SEQ ID NO: 1900750 - RNA, 21 nt, Homo sapiens
ccugagcgaguguccagccaa

SEQ ID NO: 1900751 - RNA, 17 nt, Homo sapiens
ucgcccaggagacaucc

SEQ ID NO: 1900752 - RNA, 14 nt, Homo sapiens
augcaugucuuaaa

SEQ ID NO: 1900753 - RNA, 21 nt, Homo sapiens
uuccuuaggaggacuuuggua

SEQ ID NO: 1900754 - RNA, 17 nt, Homo sapiens
gaggacugagacuggca

SEQ ID NO: 1900755 - RNA, 18 nt, Homo sapiens
uaaagauuguuaaauuca

SEQ ID NO: 1900756 - RNA, 14 nt, Homo sapiens
cucauguccacuca

SEQ ID NO: 1900757 - RNA, 22 nt, Homo sapiens
ccagcugucgucugacucuggg

SEQ ID NO: 1900758 - RNA, 23 nt, Homo sapiens
ccucugaauuuacuuccuugcau

SEQ ID NO: 1900759 - RNA, 21 nt, Homo sapiens
cuucucuacagacuccaaaag

SEQ ID NO: 1900760 - RNA, 15 nt, Homo sapiens
cuugugaauuuuucu

SEQ ID NO: 1900761 - RNA, 18 nt, Homo sapiens
gaaacaaaaggauaauga

SEQ ID NO: 1900762 - RNA, 13 nt, Homo sapiens
accugagcugcug

SEQ ID NO: 1900763 - RNA, 19 nt, Homo sapiens
uuaguguuaagugugcagu

SEQ ID NO: 1900764 - RNA, 18 nt, Homo sapiens
ccauuccauauauaucug

SEQ ID NO: 1900765 - RNA, 14 nt, Homo sapiens
uagcccagugcuuc

SEQ ID NO: 1900766 - RNA, 18 nt, Homo sapiens
augcuagggugagguuua

SEQ ID NO: 1900767 - RNA, 14 nt, Homo sapiens
uaaaagagccuagu

SEQ ID NO: 1900768 - RNA, 20 nt, Homo sapiens
augaacccauccaauggauu

SEQ ID NO: 1900769 - RNA, 19 nt, Homo sapiens
aguucuccuuguacuugaa

SEQ ID NO: 1900770 - RNA, 19 nt, Homo sapiens
cccugggguuugaagcuga

SEQ ID NO: 1900771 - RNA, 14 nt, Homo sapiens
ugcagugagccaag

SEQ ID NO: 1900772 - RNA, 14 nt, Homo sapiens
aagaagaugacuuc

SEQ ID NO: 1900773 - RNA, 13 nt, Homo sapiens
uguagaugugcau

SEQ ID NO: 1900774 - RNA, 18 nt, Homo sapiens
ugucagcuguagaaaggu

SEQ ID NO: 1900775 - RNA, 17 nt, Homo sapiens
gaaacgagacuuuccau

SEQ ID NO: 1900776 - RNA, 22 nt, Homo sapiens
cgggggaaagcacaccucaugc

SEQ ID NO: 1900777 - RNA, 19 nt, Homo sapiens
ggccacucccugccaacuc

SEQ ID NO: 1900778 - RNA, 17 nt, Homo sapiens
uucauuaaaaacacuac

SEQ ID NO: 1900779 - RNA, 18 nt, Homo sapiens
auucugaggccugaguga

SEQ ID NO: 1900780 - RNA, 19 nt, Homo sapiens
aaagaggaaaagugcaaug

SEQ ID NO: 1900781 - RNA, 22 nt, Homo sapiens
aauccuugaagauuuaccacuu

SEQ ID NO: 1900782 - RNA, 14 nt, Homo sapiens
cuauucuugauuua

SEQ ID NO: 1900783 - RNA, 17 nt, Homo sapiens
cuaauucugauguuugg

SEQ ID NO: 1900784 - RNA, 14 nt, Homo sapiens
uucuuuucuugauu

SEQ ID NO: 1900785 - RNA, 23 nt, Homo sapiens
caccaaaucagcugcuacuacuc

SEQ ID NO: 1900786 - RNA, 13 nt, Homo sapiens
aucugcccuagcc

SEQ ID NO: 1900787 - RNA, 13 nt, Homo sapiens
auucaggacacag

SEQ ID NO: 1900788 - RNA, 17 nt, Homo sapiens
uuaaacauuaugaugug

SEQ ID NO: 1900789 - RNA, 20 nt, Homo sapiens
auauauuauucucauuuagu

SEQ ID NO: 1900790 - RNA, 11 nt, Homo sapiens
uuccccaguga

SEQ ID NO: 1900791 - RNA, 19 nt, Homo sapiens
agccaagaucgugccauug

SEQ ID NO: 1900792 - RNA, 17 nt, Homo sapiens
ucucuagcuuugucaua

SEQ ID NO: 1900793 - RNA, 21 nt, Homo sapiens
agaagaguagauaagugcuca

SEQ ID NO: 1900794 - RNA, 12 nt, Homo sapiens
ccugcccgggga

SEQ ID NO: 1900795 - RNA, 17 nt, Homo sapiens
cagaucucccaguaauu

SEQ ID NO: 1900796 - RNA, 14 nt, Homo sapiens
aguaacaguuguga

SEQ ID NO: 1900797 - RNA, 17 nt, Homo sapiens
ggccuggggaggcccua

SEQ ID NO: 1900798 - RNA, 16 nt, Homo sapiens
uucugacagcauuuca

SEQ ID NO: 1900799 - RNA, 16 nt, Homo sapiens
uucuuucugcaugacu

SEQ ID NO: 1900800 - RNA, 20 nt, Homo sapiens
caagucggggccugggacac

SEQ ID NO: 1900801 - RNA, 12 nt, Homo sapiens
aaaaauugauua

SEQ ID NO: 1900802 - RNA, 20 nt, Homo sapiens
aauguaucuauuuguacaau

SEQ ID NO: 1900803 - RNA, 20 nt, Homo sapiens
gucaacagauccgacuuugg

SEQ ID NO: 1900804 - RNA, 18 nt, Homo sapiens
guccuuggggacaucuca

SEQ ID NO: 1900805 - RNA, 14 nt, Homo sapiens
agcccuugacaaaa

SEQ ID NO: 1900806 - RNA, 13 nt, Homo sapiens
uaauaauuauuca

SEQ ID NO: 1900807 - RNA, 15 nt, Homo sapiens
aaaaauguccugccu

SEQ ID NO: 1900808 - RNA, 20 nt, Homo sapiens
ucuggacccuccacuucaau

SEQ ID NO: 1900809 - RNA, 19 nt, Homo sapiens
aaggaauuuccucccaauu

SEQ ID NO: 1900810 - RNA, 14 nt, Homo sapiens
caaguacacugaga

SEQ ID NO: 1900811 - RNA, 13 nt, Homo sapiens
agacuugggaugg

SEQ ID NO: 1900812 - RNA, 18 nt, Homo sapiens
uugaugccauaugccuug

SEQ ID NO: 1900813 - RNA, 21 nt, Homo sapiens
cagacuccagccugaauguua

SEQ ID NO: 1900814 - RNA, 16 nt, Homo sapiens
ucagaaaauccugaca

SEQ ID NO: 1900815 - RNA, 15 nt, Homo sapiens
uggcacugcagguga

SEQ ID NO: 1900816 - RNA, 17 nt, Homo sapiens
ugcaaacucuauaaaga

SEQ ID NO: 1900817 - RNA, 19 nt, Homo sapiens
caguacaggggugcugcag

SEQ ID NO: 1900818 - RNA, 17 nt, Homo sapiens
auaauaaagguugugaa

SEQ ID NO: 1900819 - RNA, 17 nt, Homo sapiens
agucagucauucagaua

SEQ ID NO: 1900820 - RNA, 20 nt, Homo sapiens
ccaguguauaaauccaauau

SEQ ID NO: 1900821 - RNA, 13 nt, Homo sapiens
uguccacaucuaa

SEQ ID NO: 1900822 - RNA, 13 nt, Homo sapiens
agccaacaaccac

SEQ ID NO: 1900823 - RNA, 22 nt, Homo sapiens
uuuucgaugaugaugaugauca

SEQ ID NO: 1900824 - RNA, 21 nt, Homo sapiens
auuuguguagcugagcacagc

SEQ ID NO: 1900825 - RNA, 15 nt, Homo sapiens
agugaauugucuuug

SEQ ID NO: 1900826 - RNA, 14 nt, Homo sapiens
auaugauaaaacac

SEQ ID NO: 1900827 - RNA, 14 nt, Homo sapiens
ugaaagacaucaau

SEQ ID NO: 1900828 - RNA, 18 nt, Homo sapiens
acaaaucugccaaaauau

SEQ ID NO: 1900829 - RNA, 18 nt, Homo sapiens
aucccuauagaccacugg

SEQ ID NO: 1900830 - RNA, 14 nt, Homo sapiens
augggccuccagag

SEQ ID NO: 1900831 - RNA, 19 nt, Homo sapiens
gcaccauugcugcuccuua

SEQ ID NO: 1900832 - RNA, 13 nt, Homo sapiens
gaccuugcugaua

SEQ ID NO: 1900833 - RNA, 18 nt, Homo sapiens
cuuacaaugugcacugaa

SEQ ID NO: 1900834 - RNA, 20 nt, Homo sapiens
cucccuaugugcguauuuuc

SEQ ID NO: 1900835 - RNA, 14 nt, Homo sapiens
aaaggacccuguga

SEQ ID NO: 1900836 - RNA, 18 nt, Homo sapiens
auucuuuauucuuuacua

SEQ ID NO: 1900837 - RNA, 17 nt, Homo sapiens
ccggugcaugaugcugc

SEQ ID NO: 1900838 - RNA, 15 nt, Homo sapiens
acugaguccaugaaa

SEQ ID NO: 1900839 - RNA, 15 nt, Homo sapiens
agagacuccgucuca

SEQ ID NO: 1900840 - RNA, 13 nt, Homo sapiens
aguccaucucaag

SEQ ID NO: 1900841 - RNA, 15 nt, Homo sapiens
gaauaggcuguguau

SEQ ID NO: 1900842 - RNA, 13 nt, Homo sapiens
auuuaaagcacau

SEQ ID NO: 1900843 - RNA, 16 nt, Homo sapiens
gucaaaacuacugaca

SEQ ID NO: 1900844 - RNA, 20 nt, Homo sapiens
cucccugacccacugugcug

SEQ ID NO: 1900845 - RNA, 18 nt, Homo sapiens
gagaauucacagaaccua

SEQ ID NO: 1900846 - RNA, 22 nt, Homo sapiens
acaagagugagacuccaccuca

SEQ ID NO: 1900847 - RNA, 16 nt, Homo sapiens
cuauucucugccuuuu

SEQ ID NO: 1900848 - RNA, 20 nt, Homo sapiens
cuggccaagcaggcugguuu

SEQ ID NO: 1900849 - RNA, 16 nt, Homo sapiens
cacuaguggcaaauga

SEQ ID NO: 1900850 - RNA, 13 nt, Homo sapiens
gaaacuguagaga

SEQ ID NO: 1900851 - RNA, 19 nt, Homo sapiens
acaucuugaauccuuccau

SEQ ID NO: 1900852 - RNA, 18 nt, Homo sapiens
uacugaaggaaaaacaca

SEQ ID NO: 1900853 - RNA, 21 nt, Homo sapiens
aagccaagucagcuuugccuu

SEQ ID NO: 1900854 - RNA, 19 nt, Homo sapiens
auaacacuguacugcaaua

SEQ ID NO: 1900855 - RNA, 21 nt, Homo sapiens
uguuggucaaaugaccuagaa

SEQ ID NO: 1900856 - RNA, 15 nt, Homo sapiens
uuccuggaaacagca

SEQ ID NO: 1900857 - RNA, 16 nt, Homo sapiens
aaccaagaggauuucu

SEQ ID NO: 1900858 - RNA, 13 nt, Homo sapiens
aaguauccagacc

SEQ ID NO: 1900859 - RNA, 15 nt, Homo sapiens
ugugcucccaccagg

SEQ ID NO: 1900860 - RNA, 22 nt, Homo sapiens
cucauccagaccccaugccugu

SEQ ID NO: 1900861 - RNA, 18 nt, Homo sapiens
ugaagaggguugguauaa

SEQ ID NO: 1900862 - RNA, 13 nt, Homo sapiens
aucugaaccacuu

SEQ ID NO: 1900863 - RNA, 16 nt, Homo sapiens
cuucaugcccuucuga

SEQ ID NO: 1900864 - RNA, 15 nt, Homo sapiens
aaaaauguccaagau

SEQ ID NO: 1900865 - RNA, 16 nt, Homo sapiens
aagugacaugcauuca

SEQ ID NO: 1900866 - RNA, 18 nt, Homo sapiens
cuaaaagcacacucaucc

SEQ ID NO: 1900867 - RNA, 13 nt, Homo sapiens
uccugcugccuaa

SEQ ID NO: 1900868 - RNA, 14 nt, Homo sapiens
gaggcccucauucc

SEQ ID NO: 1900869 - RNA, 12 nt, Homo sapiens
gaaaaugcuucu

SEQ ID NO: 1900870 - RNA, 17 nt, Homo sapiens
uucaaggaagugauaac

SEQ ID NO: 1900871 - RNA, 22 nt, Homo sapiens
acguauuaguugccaauaugcc

SEQ ID NO: 1900872 - RNA, 19 nt, Homo sapiens
aauaguaggaccaauguug

SEQ ID NO: 1900873 - RNA, 17 nt, Homo sapiens
aauguacaaagauacuu

SEQ ID NO: 1900874 - RNA, 17 nt, Homo sapiens
acagccauguaccacau

SEQ ID NO: 1900875 - RNA, 21 nt, Homo sapiens
agugcaggcuggccagccgcu

SEQ ID NO: 1900876 - RNA, 23 nt, Homo sapiens
auaaauauuaggagacacaggga

SEQ ID NO: 1900877 - RNA, 22 nt, Homo sapiens
acuucucuaaaacccuguguuc

SEQ ID NO: 1900878 - RNA, 23 nt, Homo sapiens
caauaaaggacaggcuggugcua

SEQ ID NO: 1900879 - RNA, 19 nt, Homo sapiens
guguguccguggaaccagu

SEQ ID NO: 1900880 - RNA, 14 nt, Homo sapiens
cacucugggcacac

SEQ ID NO: 1900881 - RNA, 16 nt, Homo sapiens
caagcuucaguuuccu

SEQ ID NO: 1900882 - RNA, 16 nt, Homo sapiens
guucaagaggcgugug

SEQ ID NO: 1900883 - RNA, 16 nt, Homo sapiens
cagccaaucacaagca

SEQ ID NO: 1900884 - RNA, 19 nt, Homo sapiens
gcacaagaccccugcuccu

SEQ ID NO: 1900885 - RNA, 23 nt, Homo sapiens
cuccagccucccugucuccagcu

SEQ ID NO: 1900886 - RNA, 22 nt, Homo sapiens
uggaagcucugaagucacauca

SEQ ID NO: 1900887 - RNA, 14 nt, Homo sapiens
cuuugauaaccaaa

SEQ ID NO: 1900888 - RNA, 16 nt, Homo sapiens
ugugucauagaauuaa

SEQ ID NO: 1900889 - RNA, 21 nt, Homo sapiens
ggggcucagccaggugcugug

SEQ ID NO: 1900890 - RNA, 16 nt, Homo sapiens
ugugaauuaacacagu

SEQ ID NO: 1900891 - RNA, 19 nt, Homo sapiens
cgagauagcaccauugcac

SEQ ID NO: 1900892 - RNA, 15 nt, Homo sapiens
caccauggcuuuaaa

SEQ ID NO: 1900893 - RNA, 15 nt, Homo sapiens
ugacuccuuggugcu

SEQ ID NO: 1900894 - RNA, 17 nt, Homo sapiens
gaaauccauaucuuaaa

SEQ ID NO: 1900895 - RNA, 13 nt, Homo sapiens
ccaagauuucaga

SEQ ID NO: 1900896 - RNA, 13 nt, Homo sapiens
agaaagcuaaaau

SEQ ID NO: 1900897 - RNA, 14 nt, Homo sapiens
cuugucaaugugau

SEQ ID NO: 1900898 - RNA, 11 nt, Homo sapiens
cuguugagaug

SEQ ID NO: 1900899 - RNA, 14 nt, Homo sapiens
uccuccugugcuau

SEQ ID NO: 1900900 - RNA, 16 nt, Homo sapiens
auaugaucuaauacaa

SEQ ID NO: 1900901 - RNA, 13 nt, Homo sapiens
gacacugaauaaa

SEQ ID NO: 1900902 - RNA, 19 nt, Homo sapiens
cucucaccuuaucuggaag

SEQ ID NO: 1900903 - RNA, 14 nt, Homo sapiens
cacaugaauccaua

SEQ ID NO: 1900904 - RNA, 16 nt, Homo sapiens
uaaugagggugugaga

SEQ ID NO: 1900905 - RNA, 13 nt, Homo sapiens
auacaggugcuca

SEQ ID NO: 1900906 - RNA, 15 nt, Homo sapiens
auuucuuugauuuaa

SEQ ID NO: 1900907 - RNA, 18 nt, Homo sapiens
auuuucaagucuguguuc

SEQ ID NO: 1900908 - RNA, 23 nt, Homo sapiens
aacccaaauugggacaacagugc

SEQ ID NO: 1900909 - RNA, 12 nt, Homo sapiens
uggcagcaacuc

SEQ ID NO: 1900910 - RNA, 12 nt, Homo sapiens
gcuaagagccag

SEQ ID NO: 1900911 - RNA, 13 nt, Homo sapiens
ggugucacugggc

SEQ ID NO: 1900912 - RNA, 18 nt, Homo sapiens
caguuaccugcacaacag

SEQ ID NO: 1900913 - RNA, 12 nt, Homo sapiens
gccuguggaaug

SEQ ID NO: 1900914 - RNA, 22 nt, Homo sapiens
gcacuaaucaauacuuugaaca

SEQ ID NO: 1900915 - RNA, 13 nt, Homo sapiens
caaaaccaagaug

SEQ ID NO: 1900916 - RNA, 12 nt, Homo sapiens
ggcaccagacac

SEQ ID NO: 1900917 - RNA, 14 nt, Homo sapiens
gagagaugguguuu

SEQ ID NO: 1900918 - RNA, 19 nt, Homo sapiens
uggcuuggggcaacagauu

SEQ ID NO: 1900919 - RNA, 21 nt, Homo sapiens
auuuuuuccuuaagagcuauu

SEQ ID NO: 1900920 - RNA, 18 nt, Homo sapiens
uccuuaggaacagcucuu

SEQ ID NO: 1900921 - RNA, 18 nt, Homo sapiens
cacacgcacuggugccaa

SEQ ID NO: 1900922 - RNA, 20 nt, Homo sapiens
ugaguucccuuagugaauuu

SEQ ID NO: 1900923 - RNA, 18 nt, Homo sapiens
auuuuagugaacuugaaa

SEQ ID NO: 1900924 - RNA, 18 nt, Homo sapiens
acucgugugcaugagaau

SEQ ID NO: 1900925 - RNA, 16 nt, Homo sapiens
uggugacauuucccaa

SEQ ID NO: 1900926 - RNA, 14 nt, Homo sapiens
aaccuacauauucc

SEQ ID NO: 1900927 - RNA, 14 nt, Homo sapiens
aauaaacucacaac

SEQ ID NO: 1900928 - RNA, 18 nt, Homo sapiens
gagcuguaaaaauguuac

SEQ ID NO: 1900929 - RNA, 17 nt, Homo sapiens
aaccaacccccaucucc

SEQ ID NO: 1900930 - RNA, 17 nt, Homo sapiens
aauagcaccccuacuca

SEQ ID NO: 1900931 - RNA, 16 nt, Homo sapiens
cauagaaacauacaca

SEQ ID NO: 1900932 - RNA, 20 nt, Homo sapiens
cagaauaaaagaugauuucu

SEQ ID NO: 1900933 - RNA, 15 nt, Homo sapiens
uuaggaaucaccaau

SEQ ID NO: 1900934 - RNA, 20 nt, Homo sapiens
ugugggucuguguggcagga

SEQ ID NO: 1900935 - RNA, 15 nt, Homo sapiens
caugagaaaucaugc

SEQ ID NO: 1900936 - RNA, 17 nt, Homo sapiens
gagaagaaguuugacca

SEQ ID NO: 1900937 - RNA, 22 nt, Homo sapiens
uauauauaaaauacacguguau

SEQ ID NO: 1900938 - RNA, 13 nt, Homo sapiens
ucaaagacuucca

SEQ ID NO: 1900939 - RNA, 18 nt, Homo sapiens
caucuguaaagaaaacca

SEQ ID NO: 1900940 - RNA, 15 nt, Homo sapiens
agcccuccugagggg

SEQ ID NO: 1900941 - RNA, 12 nt, Homo sapiens
caaggaagguga

SEQ ID NO: 1900942 - RNA, 20 nt, Homo sapiens
aacacauucuuauugacaau

SEQ ID NO: 1900943 - RNA, 22 nt, Homo sapiens
acagcugguccuccacuuugcu

SEQ ID NO: 1900944 - RNA, 14 nt, Homo sapiens
cccuuugcuucaaa

SEQ ID NO: 1900945 - RNA, 15 nt, Homo sapiens
gaccauaaagggugu

SEQ ID NO: 1900946 - RNA, 15 nt, Homo sapiens
gcuaggaugugcauu

SEQ ID NO: 1900947 - RNA, 24 nt, Homo sapiens
cucugacccgguugcagucacugu

SEQ ID NO: 1900948 - RNA, 18 nt, Homo sapiens
gugauccgcccaccucag

SEQ ID NO: 1900949 - RNA, 16 nt, Homo sapiens
ucuuuagcaagauauu

SEQ ID NO: 1900950 - RNA, 18 nt, Homo sapiens
ggacuuccugucauuuuc

SEQ ID NO: 1900951 - RNA, 15 nt, Homo sapiens
aaguguuucuguuau

SEQ ID NO: 1900952 - RNA, 17 nt, Homo sapiens
auggcgaccaccaaagu

SEQ ID NO: 1900953 - RNA, 15 nt, Homo sapiens
gcuuuggaguuuuaa

SEQ ID NO: 1900954 - RNA, 14 nt, Homo sapiens
aauaaaauuuugca

SEQ ID NO: 1900955 - RNA, 18 nt, Homo sapiens
ucaagucuacccugauca

SEQ ID NO: 1900956 - RNA, 23 nt, Homo sapiens
cucauucauucauucaguauuua

SEQ ID NO: 1900957 - RNA, 21 nt, Homo sapiens
ucuuugauuuaacugacuuaa

SEQ ID NO: 1900958 - RNA, 14 nt, Homo sapiens
aaucuggauuucac

SEQ ID NO: 1900959 - RNA, 13 nt, Homo sapiens
ccuuuuuaaggaa

SEQ ID NO: 1900960 - RNA, 16 nt, Homo sapiens
accagggccaucuccu

SEQ ID NO: 1900961 - RNA, 15 nt, Homo sapiens
ucgcuugaaccuggg

SEQ ID NO: 1900962 - RNA, 16 nt, Homo sapiens
cugauggccaggcaag

SEQ ID NO: 1900963 - RNA, 15 nt, Homo sapiens
ccgaggggagggcag

SEQ ID NO: 1900964 - RNA, 13 nt, Homo sapiens
augucauugcuaa

SEQ ID NO: 1900965 - RNA, 14 nt, Homo sapiens
gacucauuacuacu

SEQ ID NO: 1900966 - RNA, 19 nt, Homo sapiens
aguauuuuagaaacuccaa

SEQ ID NO: 1900967 - RNA, 19 nt, Homo sapiens
gaggaaggaacagcaaugg

SEQ ID NO: 1900968 - RNA, 11 nt, Homo sapiens
acaaaccacac

SEQ ID NO: 1900969 - RNA, 21 nt, Homo sapiens
aucuguauguuaggugacauu

SEQ ID NO: 1900970 - RNA, 20 nt, Homo sapiens
ucuuccuacccuccuuccac

SEQ ID NO: 1900971 - RNA, 10 nt, Homo sapiens
gagcagagua

SEQ ID NO: 1900972 - RNA, 23 nt, Homo sapiens
aaccuaccuuauagagcacaaua

SEQ ID NO: 1900973 - RNA, 16 nt, Homo sapiens
caucaaugcaauaaga

SEQ ID NO: 1900974 - RNA, 22 nt, Homo sapiens
acugcagcuaacuuaucaucac

SEQ ID NO: 1900975 - RNA, 12 nt, Homo sapiens
aauggaaaccaa

SEQ ID NO: 1900976 - RNA, 14 nt, Homo sapiens
agaccacugauaaa

SEQ ID NO: 1900977 - RNA, 18 nt, Homo sapiens
aacucauugcaaccucca

SEQ ID NO: 1900978 - RNA, 19 nt, Homo sapiens
cauuaaaucaaucaggaau

SEQ ID NO: 1900979 - RNA, 21 nt, Homo sapiens
cucaaguuguuuaacugugca

SEQ ID NO: 1900980 - RNA, 14 nt, Homo sapiens
aaauuaauagaauu

SEQ ID NO: 1900981 - RNA, 14 nt, Homo sapiens
aucaugagacauua

SEQ ID NO: 1900982 - RNA, 14 nt, Homo sapiens
gugcaaugaaugau

SEQ ID NO: 1900983 - RNA, 19 nt, Homo sapiens
uuaaaauauauguauuuaa

SEQ ID NO: 1900984 - RNA, 15 nt, Homo sapiens
aaaaugccuuugaga

SEQ ID NO: 1900985 - RNA, 13 nt, Homo sapiens
aaucuauucugug

SEQ ID NO: 1900986 - RNA, 20 nt, Homo sapiens
auaccaagggccauucagua

SEQ ID NO: 1900987 - RNA, 19 nt, Homo sapiens
cuccagaccccaugccuua

SEQ ID NO: 1900988 - RNA, 14 nt, Homo sapiens
acacaagugcacag

SEQ ID NO: 1900989 - RNA, 14 nt, Homo sapiens
agugcaguggugcg

SEQ ID NO: 1900990 - RNA, 19 nt, Homo sapiens
uugcuuucucguggguccu

SEQ ID NO: 1900991 - RNA, 16 nt, Homo sapiens
agccacgaguuuggau

SEQ ID NO: 1900992 - RNA, 14 nt, Homo sapiens
gugaauugacccau

SEQ ID NO: 1900993 - RNA, 17 nt, Homo sapiens
aaggagauuccacacag

SEQ ID NO: 1900994 - RNA, 16 nt, Homo sapiens
ggcaggugucauauga

SEQ ID NO: 1900995 - RNA, 22 nt, Homo sapiens
cuacucccuuauguguugugua

SEQ ID NO: 1900996 - RNA, 13 nt, Homo sapiens
acucuucccacau

SEQ ID NO: 1900997 - RNA, 12 nt, Homo sapiens
gcgucaguuuuu

SEQ ID NO: 1900998 - RNA, 17 nt, Homo sapiens
uggggucuuugagcucc

SEQ ID NO: 1900999 - RNA, 19 nt, Homo sapiens
uauaccagcuuguaugcaa

SEQ ID NO: 1901000 - RNA, 22 nt, Homo sapiens
cccaaugagguggcucaugccu

SEQ ID NO: 1901001 - RNA, 14 nt, Homo sapiens
auacagauuuuacc

SEQ ID NO: 1901002 - RNA, 13 nt, Homo sapiens
gguccucauucuu

SEQ ID NO: 1901003 - RNA, 20 nt, Homo sapiens
aguguccauguuggccucca

SEQ ID NO: 1901004 - RNA, 14 nt, Homo sapiens
acuccaaccucucg

SEQ ID NO: 1901005 - RNA, 18 nt, Homo sapiens
caucaagaaugaggauau

SEQ ID NO: 1901006 - RNA, 19 nt, Homo sapiens
cuggucuuccaggcacuca

SEQ ID NO: 1901007 - RNA, 15 nt, Homo sapiens
aauggagguacagga

SEQ ID NO: 1901008 - RNA, 13 nt, Homo sapiens
ucugcaagcauca

SEQ ID NO: 1901009 - RNA, 18 nt, Homo sapiens
uuguaaugagcaccugga

SEQ ID NO: 1901010 - RNA, 13 nt, Homo sapiens
auauagacaccaa

SEQ ID NO: 1901011 - RNA, 13 nt, Homo sapiens
augcacagauuaa

SEQ ID NO: 1901012 - RNA, 20 nt, Homo sapiens
agccuccuaauuugaucaca

SEQ ID NO: 1901013 - RNA, 12 nt, Homo sapiens
ucacccugugac

SEQ ID NO: 1901014 - RNA, 14 nt, Homo sapiens
aagucaaaugucac

SEQ ID NO: 1901015 - RNA, 16 nt, Homo sapiens
aucugggaacucccaa

SEQ ID NO: 1901016 - RNA, 13 nt, Homo sapiens
cagcuuucuggga

SEQ ID NO: 1901017 - RNA, 21 nt, Homo sapiens
uucagauacuggauuguacuu

SEQ ID NO: 1901018 - RNA, 19 nt, Homo sapiens
cacaaacaauauguuugca

SEQ ID NO: 1901019 - RNA, 19 nt, Homo sapiens
acacgcaccugccucagga

SEQ ID NO: 1901020 - RNA, 18 nt, Homo sapiens
gguauuucuuaacauauu

SEQ ID NO: 1901021 - RNA, 14 nt, Homo sapiens
uaaaaaucugagaa

SEQ ID NO: 1901022 - RNA, 15 nt, Homo sapiens
aaaaacguauugcau

SEQ ID NO: 1901023 - RNA, 22 nt, Homo sapiens
ccucuguccaaacauuucaucc

SEQ ID NO: 1901024 - RNA, 19 nt, Homo sapiens
uaucugguaucugcaugua

SEQ ID NO: 1901025 - RNA, 15 nt, Homo sapiens
uuuaguuaacuauga

SEQ ID NO: 1901026 - RNA, 13 nt, Homo sapiens
auucugguaggga

SEQ ID NO: 1901027 - RNA, 16 nt, Homo sapiens
uggguguacaaacuca

SEQ ID NO: 1901028 - RNA, 17 nt, Homo sapiens
uaaauuuguaaacaauc

SEQ ID NO: 1901029 - RNA, 21 nt, Homo sapiens
acugacuggauucauucucau

SEQ ID NO: 1901030 - RNA, 20 nt, Homo sapiens
ugccuauagucccacuacuu

SEQ ID NO: 1901031 - RNA, 15 nt, Homo sapiens
aauaugcaugcuucu

SEQ ID NO: 1901032 - RNA, 18 nt, Homo sapiens
cuuucccaaccccaggaa

SEQ ID NO: 1901033 - RNA, 18 nt, Homo sapiens
ccacagggcagggccuca

SEQ ID NO: 1901034 - RNA, 16 nt, Homo sapiens
caaaaugcauguaauc

SEQ ID NO: 1901035 - RNA, 11 nt, Homo sapiens
gaacuccacuc

SEQ ID NO: 1901036 - RNA, 16 nt, Homo sapiens
cuuuaaaggcaucuac

SEQ ID NO: 1901037 - RNA, 23 nt, Homo sapiens
uugucaacacaaagacauggaag

SEQ ID NO: 1901038 - RNA, 16 nt, Homo sapiens
ggccacucuguuggug

SEQ ID NO: 1901039 - RNA, 23 nt, Homo sapiens
ugugaguggcauuugucagggau

SEQ ID NO: 1901040 - RNA, 18 nt, Homo sapiens
guccccucuuccuacccu

SEQ ID NO: 1901041 - RNA, 17 nt, Homo sapiens
cgauagugguggugaac

SEQ ID NO: 1901042 - RNA, 15 nt, Homo sapiens
uuuccccuuuccuag

SEQ ID NO: 1901043 - RNA, 23 nt, Homo sapiens
auucccaucuuuacucccaagac

SEQ ID NO: 1901044 - RNA, 20 nt, Homo sapiens
cuugcuuuauuuuucauuac

SEQ ID NO: 1901045 - RNA, 21 nt, Homo sapiens
cccagggcuaguauaaacaug

SEQ ID NO: 1901046 - RNA, 23 nt, Homo sapiens
uagcuggccacagugagcugaug

SEQ ID NO: 1901047 - RNA, 22 nt, Homo sapiens
uugcacauucccuggccgcuuc

SEQ ID NO: 1901048 - RNA, 19 nt, Homo sapiens
aaacuuuaaaaugcgaaau

SEQ ID NO: 1901049 - RNA, 15 nt, Homo sapiens
uuucauaauuguuga

SEQ ID NO: 1901050 - RNA, 15 nt, Homo sapiens
cugauuacacaaaac

SEQ ID NO: 1901051 - RNA, 18 nt, Homo sapiens
cuauccagcagaucauuu

SEQ ID NO: 1901052 - RNA, 16 nt, Homo sapiens
uugguugcaguuucca

SEQ ID NO: 1901053 - RNA, 13 nt, Homo sapiens
acgcucgcugcca

SEQ ID NO: 1901054 - RNA, 21 nt, Homo sapiens
guaauaacauuuuauacaauu

SEQ ID NO: 1901055 - RNA, 18 nt, Homo sapiens
cuugcugacucucugagc

SEQ ID NO: 1901056 - RNA, 15 nt, Homo sapiens
uguuccuuuugacaa

SEQ ID NO: 1901057 - RNA, 15 nt, Homo sapiens
guuacuguugcacug

SEQ ID NO: 1901058 - RNA, 15 nt, Homo sapiens
uuucagguggccagg

SEQ ID NO: 1901059 - RNA, 15 nt, Homo sapiens
gaaggagcucaguua

SEQ ID NO: 1901060 - RNA, 13 nt, Homo sapiens
agucacagagaua

SEQ ID NO: 1901061 - RNA, 22 nt, Homo sapiens
uauuuugcugcacacaaucuag

SEQ ID NO: 1901062 - RNA, 22 nt, Homo sapiens
aguucuggauucaaaugucagu

SEQ ID NO: 1901063 - RNA, 19 nt, Homo sapiens
cugcaaggauucagcauua

SEQ ID NO: 1901064 - RNA, 14 nt, Homo sapiens
aguuaucaguauuu

SEQ ID NO: 1901065 - RNA, 12 nt, Homo sapiens
ggaacauaugca

SEQ ID NO: 1901066 - RNA, 21 nt, Homo sapiens
uagccccaacccaaaccugga

SEQ ID NO: 1901067 - RNA, 23 nt, Homo sapiens
gaacaccuccucaaaccuaccac

SEQ ID NO: 1901068 - RNA, 18 nt, Homo sapiens
gccugcgcccugguaaag

SEQ ID NO: 1901069 - RNA, 14 nt, Homo sapiens
caaaacuagacuuu

SEQ ID NO: 1901070 - RNA, 17 nt, Homo sapiens
acagauuuguucauucc

SEQ ID NO: 1901071 - RNA, 13 nt, Homo sapiens
cugaaagccucac

SEQ ID NO: 1901072 - RNA, 19 nt, Homo sapiens
uacauaucaaaacauccca

SEQ ID NO: 1901073 - RNA, 16 nt, Homo sapiens
accacccacaaucaca

SEQ ID NO: 1901074 - RNA, 15 nt, Homo sapiens
agggcagagaacugu

SEQ ID NO: 1901075 - RNA, 12 nt, Homo sapiens
acaugaaaguuu

SEQ ID NO: 1901076 - RNA, 16 nt, Homo sapiens
auaaagauaauacugu

SEQ ID NO: 1901077 - RNA, 20 nt, Homo sapiens
cugcaaugcuggacacuaca

SEQ ID NO: 1901078 - RNA, 16 nt, Homo sapiens
uaccucucagccuuag

SEQ ID NO: 1901079 - RNA, 15 nt, Homo sapiens
acucauucaguccca

SEQ ID NO: 1901080 - RNA, 13 nt, Homo sapiens
ugcccauaauccc

SEQ ID NO: 1901081 - RNA, 19 nt, Homo sapiens
gaaaacagggucugggaca

SEQ ID NO: 1901082 - RNA, 17 nt, Homo sapiens
ugguuaauuuugcauau

SEQ ID NO: 1901083 - RNA, 17 nt, Homo sapiens
gcuauuugagcaugcac

SEQ ID NO: 1901084 - RNA, 13 nt, Homo sapiens
uugagacagaguu

SEQ ID NO: 1901085 - RNA, 17 nt, Homo sapiens
gagcaagugacaugcca

SEQ ID NO: 1901086 - RNA, 18 nt, Homo sapiens
uguugcccacagcuguau

SEQ ID NO: 1901087 - RNA, 19 nt, Homo sapiens
acacugggugcgucuccag

SEQ ID NO: 1901088 - RNA, 14 nt, Homo sapiens
gauaguuucuuccc

SEQ ID NO: 1901089 - RNA, 21 nt, Homo sapiens
auguuuggaaaccacagucag

SEQ ID NO: 1901090 - RNA, 23 nt, Homo sapiens
uaauuuguguaaauuauugauga

SEQ ID NO: 1901091 - RNA, 20 nt, Homo sapiens
ucgcuagaguucuccagaca

SEQ ID NO: 1901092 - RNA, 15 nt, Homo sapiens
agagauuuccuccau

SEQ ID NO: 1901093 - RNA, 19 nt, Homo sapiens
aggagucugaggacugucc

SEQ ID NO: 1901094 - RNA, 23 nt, Homo sapiens
agacauuccugcgcauggugcag

SEQ ID NO: 1901095 - RNA, 18 nt, Homo sapiens
cugaguauguaacuugca

SEQ ID NO: 1901096 - RNA, 14 nt, Homo sapiens
cuuuguuuccucuu

SEQ ID NO: 1901097 - RNA, 18 nt, Homo sapiens
ugcaacagcuacagucua

SEQ ID NO: 1901098 - RNA, 14 nt, Homo sapiens
cccuuuccccauaa

SEQ ID NO: 1901099 - RNA, 14 nt, Homo sapiens
aucagaaacagggu

SEQ ID NO: 1901100 - RNA, 18 nt, Homo sapiens
cucugcucagugaucuca

SEQ ID NO: 1901101 - RNA, 15 nt, Homo sapiens
aaugauuuuacuuaa

SEQ ID NO: 1901102 - RNA, 14 nt, Homo sapiens
aauaaaaaccuucc

SEQ ID NO: 1901103 - RNA, 15 nt, Homo sapiens
cgugaacugcaguga

SEQ ID NO: 1901104 - RNA, 14 nt, Homo sapiens
gaaaacaucuggaa

SEQ ID NO: 1901105 - RNA, 14 nt, Homo sapiens
ucagcuauaccugc

SEQ ID NO: 1901106 - RNA, 18 nt, Homo sapiens
gagauaagaucuauagcc

SEQ ID NO: 1901107 - RNA, 18 nt, Homo sapiens
aacugugcuguacugagc

SEQ ID NO: 1901108 - RNA, 13 nt, Homo sapiens
uugaaucuaugaa

SEQ ID NO: 1901109 - RNA, 13 nt, Homo sapiens
agcccucuugccc

SEQ ID NO: 1901110 - RNA, 18 nt, Homo sapiens
uucugagacagcuugucu

SEQ ID NO: 1901111 - RNA, 13 nt, Homo sapiens
auguuuccauuug

SEQ ID NO: 1901112 - RNA, 14 nt, Homo sapiens
uugccuccaggugc

SEQ ID NO: 1901113 - RNA, 13 nt, Homo sapiens
caguguuuugcau

SEQ ID NO: 1901114 - RNA, 17 nt, Homo sapiens
auacagaauuacuguaa

SEQ ID NO: 1901115 - RNA, 22 nt, Homo sapiens
gggccccucaacagccaagugu

SEQ ID NO: 1901116 - RNA, 23 nt, Homo sapiens
agaaaauacgagaaaaucugcau

SEQ ID NO: 1901117 - RNA, 13 nt, Homo sapiens
uugagcaagccga

SEQ ID NO: 1901118 - RNA, 13 nt, Homo sapiens
uugggcaagccaa

SEQ ID NO: 1901119 - RNA, 18 nt, Homo sapiens
acaagcccccccuuccac

SEQ ID NO: 1901120 - RNA, 14 nt, Homo sapiens
cucuuauaauucca

SEQ ID NO: 1901121 - RNA, 19 nt, Homo sapiens
guaccuguucuucuaucca

SEQ ID NO: 1901122 - RNA, 19 nt, Homo sapiens
guauauauuuacaugucuu

SEQ ID NO: 1901123 - RNA, 14 nt, Homo sapiens
ucugcccaccgacc

SEQ ID NO: 1901124 - RNA, 21 nt, Homo sapiens
ucuguuggcagagcuuuugca

SEQ ID NO: 1901125 - RNA, 23 nt, Homo sapiens
agccucacguauuucacagagca

SEQ ID NO: 1901126 - RNA, 14 nt, Homo sapiens
ugggaaucauucca

SEQ ID NO: 1901127 - RNA, 19 nt, Homo sapiens
cccacuuaugcugcuguga

SEQ ID NO: 1901128 - RNA, 16 nt, Homo sapiens
gacagacccagugagu

SEQ ID NO: 1901129 - RNA, 17 nt, Homo sapiens
uguaaaaaaaagucuua

SEQ ID NO: 1901130 - RNA, 11 nt, Homo sapiens
gacugucuucc

SEQ ID NO: 1901131 - RNA, 17 nt, Homo sapiens
ccucuaaauucuuucau

SEQ ID NO: 1901132 - RNA, 18 nt, Homo sapiens
uuaaaaugauuuuuaaca

SEQ ID NO: 1901133 - RNA, 21 nt, Homo sapiens
acagccccuggcccacccacu

SEQ ID NO: 1901134 - RNA, 16 nt, Homo sapiens
gccagagaacccagcc

SEQ ID NO: 1901135 - RNA, 23 nt, Homo sapiens
ucuuaaauguagcaauggcacug

SEQ ID NO: 1901136 - RNA, 15 nt, Homo sapiens
aaagucagcuacaaa

SEQ ID NO: 1901137 - RNA, 15 nt, Homo sapiens
cauccauagacacag

SEQ ID NO: 1901138 - RNA, 17 nt, Homo sapiens
aauaaucuaugaugaag

SEQ ID NO: 1901139 - RNA, 23 nt, Homo sapiens
auuugguuuguugagccuaauau

SEQ ID NO: 1901140 - RNA, 19 nt, Homo sapiens
gcaaauggcuuagcuacuu

SEQ ID NO: 1901141 - RNA, 13 nt, Homo sapiens
auuacaaaugcaa

SEQ ID NO: 1901142 - RNA, 13 nt, Homo sapiens
auuccaaaugcca

SEQ ID NO: 1901143 - RNA, 21 nt, Homo sapiens
aaacaagauuaauuucaucac

SEQ ID NO: 1901144 - RNA, 23 nt, Homo sapiens
agggaccccagauaccugugagg

SEQ ID NO: 1901145 - RNA, 16 nt, Homo sapiens
aauugucacaucaagc

SEQ ID NO: 1901146 - RNA, 15 nt, Homo sapiens
cauuucuagauacuu

SEQ ID NO: 1901147 - RNA, 15 nt, Homo sapiens
acuccacccuguuag

SEQ ID NO: 1901148 - RNA, 18 nt, Homo sapiens
uuuaagucaacacuauau

SEQ ID NO: 1901149 - RNA, 15 nt, Homo sapiens
aguguuuugcaaggg

SEQ ID NO: 1901150 - RNA, 20 nt, Homo sapiens
gauggcagugcagcaaggag

SEQ ID NO: 1901151 - RNA, 18 nt, Homo sapiens
aaauuauguuuucaucca

SEQ ID NO: 1901152 - RNA, 13 nt, Homo sapiens
auguauuaugcaa

SEQ ID NO: 1901153 - RNA, 23 nt, Homo sapiens
uccuuuccaagcuccucgugaua

SEQ ID NO: 1901154 - RNA, 23 nt, Homo sapiens
agugauauuucucuaguaguuaa

SEQ ID NO: 1901155 - RNA, 18 nt, Homo sapiens
agacagacaacacuggga

SEQ ID NO: 1901156 - RNA, 17 nt, Homo sapiens
auuaaagagccaguuua

SEQ ID NO: 1901157 - RNA, 16 nt, Homo sapiens
gcaaggaaacauuaau

SEQ ID NO: 1901158 - RNA, 14 nt, Homo sapiens
acauugccaucacu

SEQ ID NO: 1901159 - RNA, 17 nt, Homo sapiens
uauccuugcaccucagc

SEQ ID NO: 1901160 - RNA, 22 nt, Homo sapiens
gccuggcccccacccucugcca

SEQ ID NO: 1901161 - RNA, 16 nt, Homo sapiens
uucauuaugcuuugaa

SEQ ID NO: 1901162 - RNA, 17 nt, Homo sapiens
gaacagcgggagaccug

SEQ ID NO: 1901163 - RNA, 21 nt, Homo sapiens
cuucugaacguggcacucuuc

SEQ ID NO: 1901164 - RNA, 15 nt, Homo sapiens
ugggagucacacagu

SEQ ID NO: 1901165 - RNA, 17 nt, Homo sapiens
auuuacuguggcuucuu

SEQ ID NO: 1901166 - RNA, 14 nt, Homo sapiens
uuucaugugugauu

SEQ ID NO: 1901167 - RNA, 19 nt, Homo sapiens
guugugagagccugugauc

SEQ ID NO: 1901168 - RNA, 21 nt, Homo sapiens
ugauggcuuaaaaauacuuaa

SEQ ID NO: 1901169 - RNA, 14 nt, Homo sapiens
gcaucugcucugag

SEQ ID NO: 1901170 - RNA, 17 nt, Homo sapiens
cuacaaaacaauucaau

SEQ ID NO: 1901171 - RNA, 18 nt, Homo sapiens
uggcuacaauuacuuuga

SEQ ID NO: 1901172 - RNA, 14 nt, Homo sapiens
cauguauguggaag

SEQ ID NO: 1901173 - RNA, 16 nt, Homo sapiens
caacaugcacugaugu

SEQ ID NO: 1901174 - RNA, 15 nt, Homo sapiens
aggagcagaaaaccc

SEQ ID NO: 1901175 - RNA, 19 nt, Homo sapiens
cuuuccaugggaccacaac

SEQ ID NO: 1901176 - RNA, 22 nt, Homo sapiens
uuauaugaccauauuuacucuu

SEQ ID NO: 1901177 - RNA, 19 nt, Homo sapiens
cuugucucucacugcauuu

SEQ ID NO: 1901178 - RNA, 17 nt, Homo sapiens
agauggagacacccucu

SEQ ID NO: 1901179 - RNA, 19 nt, Homo sapiens
auagagucaagcucuguca

SEQ ID NO: 1901180 - RNA, 23 nt, Homo sapiens
uuggcugggaagacuauggugcu

SEQ ID NO: 1901181 - RNA, 18 nt, Homo sapiens
gccucccagcuucuuaua

SEQ ID NO: 1901182 - RNA, 12 nt, Homo sapiens
gaagacucugac

SEQ ID NO: 1901183 - RNA, 12 nt, Homo sapiens
gauuggcuguga

SEQ ID NO: 1901184 - RNA, 17 nt, Homo sapiens
guggagaugcagaggua

SEQ ID NO: 1901185 - RNA, 17 nt, Homo sapiens
ucaucugcaugucuacu

SEQ ID NO: 1901186 - RNA, 23 nt, Homo sapiens
acuggccagagagggcccagcug

SEQ ID NO: 1901187 - RNA, 16 nt, Homo sapiens
guccacauacacugca

SEQ ID NO: 1901188 - RNA, 11 nt, Homo sapiens
aggacagccac

SEQ ID NO: 1901189 - RNA, 16 nt, Homo sapiens
uuuagaccccauacaa

SEQ ID NO: 1901190 - RNA, 22 nt, Homo sapiens
caugugauauuuucacaucuua

SEQ ID NO: 1901191 - RNA, 14 nt, Homo sapiens
cuaaugcuaugcaa

SEQ ID NO: 1901192 - RNA, 20 nt, Homo sapiens
guguaaagacuaugaucuca

SEQ ID NO: 1901193 - RNA, 14 nt, Homo sapiens
gaucuaauuuacau

SEQ ID NO: 1901194 - RNA, 22 nt, Homo sapiens
auggcacagcccaaagaaggaa

SEQ ID NO: 1901195 - RNA, 21 nt, Homo sapiens
ccaucuaugcagaacaggcag

SEQ ID NO: 1901196 - RNA, 17 nt, Homo sapiens
augugaagacaccugca

SEQ ID NO: 1901197 - RNA, 18 nt, Homo sapiens
uuagcucacugaaucuuc

SEQ ID NO: 1901198 - RNA, 16 nt, Homo sapiens
aagcauucugugcaua

SEQ ID NO: 1901199 - RNA, 14 nt, Homo sapiens
auccaggcauuucu

SEQ ID NO: 1901200 - RNA, 19 nt, Homo sapiens
guucuccuagacugacccu

SEQ ID NO: 1901201 - RNA, 16 nt, Homo sapiens
auacauuuuugucaga

SEQ ID NO: 1901202 - RNA, 18 nt, Homo sapiens
uugaaagaacaucaguuc

SEQ ID NO: 1901203 - RNA, 14 nt, Homo sapiens
aaacaugauuaucu

SEQ ID NO: 1901204 - RNA, 12 nt, Homo sapiens
gaaaccaugaca

SEQ ID NO: 1901205 - RNA, 21 nt, Homo sapiens
uagaggaauaaagcugugagc

SEQ ID NO: 1901206 - RNA, 23 nt, Homo sapiens
ucaaaugcuggcaaauccaggcu

SEQ ID NO: 1901207 - RNA, 20 nt, Homo sapiens
cagcuaacacacagcuccca

SEQ ID NO: 1901208 - RNA, 19 nt, Homo sapiens
gaccuggccagagccaaga

SEQ ID NO: 1901209 - RNA, 16 nt, Homo sapiens
aaaggaagugccuugg

SEQ ID NO: 1901210 - RNA, 19 nt, Homo sapiens
auguacauuuucuaacaaa

SEQ ID NO: 1901211 - RNA, 14 nt, Homo sapiens
auccuagcaaauuc

SEQ ID NO: 1901212 - RNA, 19 nt, Homo sapiens
gauuuucuucuuugugguc

SEQ ID NO: 1901213 - RNA, 17 nt, Homo sapiens
aaaaauuaccuguauaa

SEQ ID NO: 1901214 - RNA, 18 nt, Homo sapiens
cuaggaaauccauucaca

SEQ ID NO: 1901215 - RNA, 20 nt, Homo sapiens
aaauugcugcaccaaugcac

SEQ ID NO: 1901216 - RNA, 22 nt, Homo sapiens
auugacagcuucaacagaaagg

SEQ ID NO: 1901217 - RNA, 13 nt, Homo sapiens
augacauguuccu

SEQ ID NO: 1901218 - RNA, 14 nt, Homo sapiens
ucgggacucagauu

SEQ ID NO: 1901219 - RNA, 14 nt, Homo sapiens
ccuuccucugcucc

SEQ ID NO: 1901220 - RNA, 15 nt, Homo sapiens
aguaaucuguugaca

SEQ ID NO: 1901221 - RNA, 16 nt, Homo sapiens
ucuagagcagggauua

SEQ ID NO: 1901222 - RNA, 22 nt, Homo sapiens
uacauaauuuaaaagcacacuc

SEQ ID NO: 1901223 - RNA, 19 nt, Homo sapiens
auauuguguugacuuuaua

SEQ ID NO: 1901224 - RNA, 19 nt, Homo sapiens
ggugucuuggcacuguuag

SEQ ID NO: 1901225 - RNA, 16 nt, Homo sapiens
uagagacaguguuucg

SEQ ID NO: 1901226 - RNA, 11 nt, Homo sapiens
auuacugugag

SEQ ID NO: 1901227 - RNA, 20 nt, Homo sapiens
agagcaauuugucuggacua

SEQ ID NO: 1901228 - RNA, 13 nt, Homo sapiens
cuaaaaauuuaca

SEQ ID NO: 1901229 - RNA, 16 nt, Homo sapiens
aauccugaugguauca

SEQ ID NO: 1901230 - RNA, 12 nt, Homo sapiens
agccucccugac

SEQ ID NO: 1901231 - RNA, 21 nt, Homo sapiens
gcccauccaaacacugaggca

SEQ ID NO: 1901232 - RNA, 13 nt, Homo sapiens
gaccagccagggc

SEQ ID NO: 1901233 - RNA, 20 nt, Homo sapiens
uauuucacuuaaacuuuguc

SEQ ID NO: 1901234 - RNA, 20 nt, Homo sapiens
aacauaccuaagaaguacau

SEQ ID NO: 1901235 - RNA, 17 nt, Homo sapiens
acagagcaagacuccau

SEQ ID NO: 1901236 - RNA, 20 nt, Homo sapiens
ggccuccggcgucuugccca

SEQ ID NO: 1901237 - RNA, 16 nt, Homo sapiens
aagauuucauggacau

SEQ ID NO: 1901238 - RNA, 18 nt, Homo sapiens
gcuguuaccaaaucucag

SEQ ID NO: 1901239 - RNA, 21 nt, Homo sapiens
aauucucuuaaucacuacugu

SEQ ID NO: 1901240 - RNA, 20 nt, Homo sapiens
gggucucgcuuuguugccca

SEQ ID NO: 1901241 - RNA, 14 nt, Homo sapiens
ucagaaaugcuguc

SEQ ID NO: 1901242 - RNA, 16 nt, Homo sapiens
ccagucccucagccac

SEQ ID NO: 1901243 - RNA, 13 nt, Homo sapiens
auuucaaguuuac

SEQ ID NO: 1901244 - RNA, 13 nt, Homo sapiens
gacauaacauuuu

SEQ ID NO: 1901245 - RNA, 19 nt, Homo sapiens
ugcuuuucccuaagccaag

SEQ ID NO: 1901246 - RNA, 14 nt, Homo sapiens
caucacucuuuaca

SEQ ID NO: 1901247 - RNA, 15 nt, Homo sapiens
cgcggcuuugggaca

SEQ ID NO: 1901248 - RNA, 18 nt, Homo sapiens
gauaauguccuugcuuua

SEQ ID NO: 1901249 - RNA, 21 nt, Homo sapiens
ucacccuuuccggcacacugc

SEQ ID NO: 1901250 - RNA, 18 nt, Homo sapiens
gcagcucacggaacugga

SEQ ID NO: 1901251 - RNA, 18 nt, Homo sapiens
uccaccccgcaagcacca

SEQ ID NO: 1901252 - RNA, 22 nt, Homo sapiens
guguucacacuguaaacauuca

SEQ ID NO: 1901253 - RNA, 12 nt, Homo sapiens
aaguguuuucuc

SEQ ID NO: 1901254 - RNA, 19 nt, Homo sapiens
gccacuccccagugcuccu

SEQ ID NO: 1901255 - RNA, 19 nt, Homo sapiens
uugucaguuuacaccaaua

SEQ ID NO: 1901256 - RNA, 16 nt, Homo sapiens
cauucauugacuucag

SEQ ID NO: 1901257 - RNA, 12 nt, Homo sapiens
gcccacagccaa

SEQ ID NO: 1901258 - RNA, 17 nt, Homo sapiens
ccugguggcaccagaug

SEQ ID NO: 1901259 - RNA, 17 nt, Homo sapiens
agccuggaacaucauca

SEQ ID NO: 1901260 - RNA, 18 nt, Homo sapiens
uucagauggugaagcauu

SEQ ID NO: 1901261 - RNA, 20 nt, Homo sapiens
acguuucucauuaaaaucca

SEQ ID NO: 1901262 - RNA, 13 nt, Homo sapiens
auuuugucacugc

SEQ ID NO: 1901263 - RNA, 16 nt, Homo sapiens
ggaucuguccaaggaa

SEQ ID NO: 1901264 - RNA, 18 nt, Homo sapiens
auauccagccaguacagu

SEQ ID NO: 1901265 - RNA, 13 nt, Homo sapiens
aagaucacaaaua

SEQ ID NO: 1901266 - RNA, 14 nt, Homo sapiens
auucaaaaguauug

SEQ ID NO: 1901267 - RNA, 18 nt, Homo sapiens
accccauuucucuccuca

SEQ ID NO: 1901268 - RNA, 20 nt, Homo sapiens
gggcgaggcgggggagccug

SEQ ID NO: 1901269 - RNA, 19 nt, Homo sapiens
caggacauuuggcugugau

SEQ ID NO: 1901270 - RNA, 15 nt, Homo sapiens
gaggccuauuguuga

SEQ ID NO: 1901271 - RNA, 18 nt, Homo sapiens
aaauguauaaauauacag

SEQ ID NO: 1901272 - RNA, 19 nt, Homo sapiens
ccagguccaaacccuucaa

SEQ ID NO: 1901273 - RNA, 15 nt, Homo sapiens
uuguuucuuuucaca

SEQ ID NO: 1901274 - RNA, 18 nt, Homo sapiens
ccaguacuuccugcagua

SEQ ID NO: 1901275 - RNA, 20 nt, Homo sapiens
ugaaagcuaugaauguuacu

SEQ ID NO: 1901276 - RNA, 16 nt, Homo sapiens
aacuaacaaccaaaga

SEQ ID NO: 1901277 - RNA, 16 nt, Homo sapiens
cacagcacuagaguca

SEQ ID NO: 1901278 - RNA, 21 nt, Homo sapiens
agaauggggcuuccauggugg

SEQ ID NO: 1901279 - RNA, 15 nt, Homo sapiens
agacagugcacauga

SEQ ID NO: 1901280 - RNA, 12 nt, Homo sapiens
cccaggaucucc

SEQ ID NO: 1901281 - RNA, 21 nt, Homo sapiens
auuugggaugaaauacuuaau

SEQ ID NO: 1901282 - RNA, 18 nt, Homo sapiens
uuucaaggacuauuuuag

SEQ ID NO: 1901283 - RNA, 19 nt, Homo sapiens
acuguauuuuugaagacua

SEQ ID NO: 1901284 - RNA, 16 nt, Homo sapiens
aaauuccacagauuau

SEQ ID NO: 1901285 - RNA, 16 nt, Homo sapiens
uucaauagaacaugca

SEQ ID NO: 1901286 - RNA, 22 nt, Homo sapiens
auuuuccccccacucuccccac

SEQ ID NO: 1901287 - RNA, 13 nt, Homo sapiens
gagaaaugagcug

SEQ ID NO: 1901288 - RNA, 13 nt, Homo sapiens
agcagauggagua

SEQ ID NO: 1901289 - RNA, 15 nt, Homo sapiens
auuauaaaggccagc

SEQ ID NO: 1901290 - RNA, 21 nt, Homo sapiens
accaaaggacauuaugugugc

SEQ ID NO: 1901291 - RNA, 20 nt, Homo sapiens
cacccuguagguucuugaua

SEQ ID NO: 1901292 - RNA, 15 nt, Homo sapiens
agauaaaauguguaa

SEQ ID NO: 1901293 - RNA, 18 nt, Homo sapiens
ucccagccacagcauuua

SEQ ID NO: 1901294 - RNA, 21 nt, Homo sapiens
aagauuuccacaauucuucug

SEQ ID NO: 1901295 - RNA, 18 nt, Homo sapiens
gcccagcucgucccggcc

SEQ ID NO: 1901296 - RNA, 18 nt, Homo sapiens
auagaggggggcugccug

SEQ ID NO: 1901297 - RNA, 14 nt, Homo sapiens
ucagcccugccagg

SEQ ID NO: 1901298 - RNA, 16 nt, Homo sapiens
ucaccagggcuggaau

SEQ ID NO: 1901299 - RNA, 17 nt, Homo sapiens
gauggaauaaagcccuu

SEQ ID NO: 1901300 - RNA, 22 nt, Homo sapiens
ggaugcaaauagauucagagaa

SEQ ID NO: 1901301 - RNA, 21 nt, Homo sapiens
cugcuguggcgugagggugag

SEQ ID NO: 1901302 - RNA, 17 nt, Homo sapiens
agccugcucccuagcca

SEQ ID NO: 1901303 - RNA, 19 nt, Homo sapiens
cagcugcgguccacccagg

SEQ ID NO: 1901304 - RNA, 19 nt, Homo sapiens
ugcccagugaccagucacu

SEQ ID NO: 1901305 - RNA, 20 nt, Homo sapiens
uuuguaacaccguccaacau

SEQ ID NO: 1901306 - RNA, 20 nt, Homo sapiens
ugguuuccuggugcuuccca

SEQ ID NO: 1901307 - RNA, 13 nt, Homo sapiens
uuaauuacuacua

SEQ ID NO: 1901308 - RNA, 18 nt, Homo sapiens
cagcgacugccacaucau

SEQ ID NO: 1901309 - RNA, 20 nt, Homo sapiens
agcugguaggcauuccagcu

SEQ ID NO: 1901310 - RNA, 11 nt, Homo sapiens
ccugugacugu

SEQ ID NO: 1901311 - RNA, 11 nt, Homo sapiens
cccgugacugc

SEQ ID NO: 1901312 - RNA, 16 nt, Homo sapiens
uccucugugaccaaug

SEQ ID NO: 1901313 - RNA, 20 nt, Homo sapiens
ucugauaaugaaaauuauga

SEQ ID NO: 1901314 - RNA, 14 nt, Homo sapiens
caagugugugcaca

SEQ ID NO: 1901315 - RNA, 21 nt, Homo sapiens
gacccucugaaugguccaggg

SEQ ID NO: 1901316 - RNA, 14 nt, Homo sapiens
cugguucagccucu

SEQ ID NO: 1901317 - RNA, 15 nt, Homo sapiens
uggcuguacugcuca

SEQ ID NO: 1901318 - RNA, 23 nt, Homo sapiens
agaaucccuuugcaccugagacc

SEQ ID NO: 1901319 - RNA, 14 nt, Homo sapiens
aaaaaggcugugcu

SEQ ID NO: 1901320 - RNA, 13 nt, Homo sapiens
ugaugcuaugaaa

SEQ ID NO: 1901321 - RNA, 15 nt, Homo sapiens
caggcuccaaacugg

SEQ ID NO: 1901322 - RNA, 16 nt, Homo sapiens
ugcagcuuuauguuca

SEQ ID NO: 1901323 - RNA, 19 nt, Homo sapiens
gccaucaacuaaaguugua

SEQ ID NO: 1901324 - RNA, 21 nt, Homo sapiens
cacgucaggagaggccagcug

SEQ ID NO: 1901325 - RNA, 14 nt, Homo sapiens
agcggacaguggca

SEQ ID NO: 1901326 - RNA, 17 nt, Homo sapiens
agcacaggaagcugccc

SEQ ID NO: 1901327 - RNA, 17 nt, Homo sapiens
ugccuccagacuaugca

SEQ ID NO: 1901328 - RNA, 17 nt, Homo sapiens
guacaauccacaauuca

SEQ ID NO: 1901329 - RNA, 14 nt, Homo sapiens
aaagggagucugcc

SEQ ID NO: 1901330 - RNA, 19 nt, Homo sapiens
uugccacggaaacauacag

SEQ ID NO: 1901331 - RNA, 19 nt, Homo sapiens
gggagagcgaaggggguca

SEQ ID NO: 1901332 - RNA, 18 nt, Homo sapiens
uaacugugaaauaccaca

SEQ ID NO: 1901333 - RNA, 18 nt, Homo sapiens
gccaggaggaacaaagag

SEQ ID NO: 1901334 - RNA, 22 nt, Homo sapiens
caggguucuccauuacagugua

SEQ ID NO: 1901335 - RNA, 12 nt, Homo sapiens
gagccugaguga

SEQ ID NO: 1901336 - RNA, 23 nt, Homo sapiens
cagcaaugaauugugccuagugg

SEQ ID NO: 1901337 - RNA, 22 nt, Homo sapiens
gcuguggccaucaaccucugua

SEQ ID NO: 1901338 - RNA, 14 nt, Homo sapiens
ucucagguggugau

SEQ ID NO: 1901339 - RNA, 21 nt, Homo sapiens
uaauauuauacuguccuaggc

SEQ ID NO: 1901340 - RNA, 17 nt, Homo sapiens
ucccuugaggaaacaac

SEQ ID NO: 1901341 - RNA, 17 nt, Homo sapiens
ccuuuuacauacugcug

SEQ ID NO: 1901342 - RNA, 13 nt, Homo sapiens
ucuacagccucag

SEQ ID NO: 1901343 - RNA, 15 nt, Homo sapiens
ccaucagaaaaccaa

SEQ ID NO: 1901344 - RNA, 20 nt, Homo sapiens
agcugagauugcaccacugc

SEQ ID NO: 1901345 - RNA, 22 nt, Homo sapiens
uuagcauaaaauuuucuacucu

SEQ ID NO: 1901346 - RNA, 22 nt, Homo sapiens
ucaugacccugagucuuugccu

SEQ ID NO: 1901347 - RNA, 21 nt, Homo sapiens
auguguaagacacugugcaaa

SEQ ID NO: 1901348 - RNA, 16 nt, Homo sapiens
cugucuugcugaggga

SEQ ID NO: 1901349 - RNA, 23 nt, Homo sapiens
gggaucagccuccgccauuccaa

SEQ ID NO: 1901350 - RNA, 21 nt, Homo sapiens
gcagggaagccccacuugaag

SEQ ID NO: 1901351 - RNA, 17 nt, Homo sapiens
ucagagccuuuccucaa

SEQ ID NO: 1901352 - RNA, 12 nt, Homo sapiens
ugagaccuggaa

SEQ ID NO: 1901353 - RNA, 14 nt, Homo sapiens
aggcugcucccuga

SEQ ID NO: 1901354 - RNA, 14 nt, Homo sapiens
uacuuagcaugcac

SEQ ID NO: 1901355 - RNA, 15 nt, Homo sapiens
uacuacauuccaaag

SEQ ID NO: 1901356 - RNA, 17 nt, Homo sapiens
uaguaagccucccuccu

SEQ ID NO: 1901357 - RNA, 13 nt, Homo sapiens
ucugccugggcuu

SEQ ID NO: 1901358 - RNA, 18 nt, Homo sapiens
uguaagagcaaaagccuc

SEQ ID NO: 1901359 - RNA, 17 nt, Homo sapiens
uccaacaaacuuacugu

SEQ ID NO: 1901360 - RNA, 22 nt, Homo sapiens
ccaaaaugagaguuuugcuaaa

SEQ ID NO: 1901361 - RNA, 13 nt, Homo sapiens
uauuuuaucucuu

SEQ ID NO: 1901362 - RNA, 14 nt, Homo sapiens
ucgugucagcucag

SEQ ID NO: 1901363 - RNA, 22 nt, Homo sapiens
uucacccagcaccuugcagauu

SEQ ID NO: 1901364 - RNA, 19 nt, Homo sapiens
acagauugucuuauuacag

SEQ ID NO: 1901365 - RNA, 14 nt, Homo sapiens
ucuuugguuccuca

SEQ ID NO: 1901366 - RNA, 19 nt, Homo sapiens
ugauuuuaaagaacaguga

SEQ ID NO: 1901367 - RNA, 15 nt, Homo sapiens
caguggaauugugaa

SEQ ID NO: 1901368 - RNA, 15 nt, Homo sapiens
cuuagugugaaguug

SEQ ID NO: 1901369 - RNA, 14 nt, Homo sapiens
agaacagacuggcc

SEQ ID NO: 1901370 - RNA, 20 nt, Homo sapiens
auugucagcucaaugaccug

SEQ ID NO: 1901371 - RNA, 20 nt, Homo sapiens
ugcucaccuuuaucaccuca

SEQ ID NO: 1901372 - RNA, 17 nt, Homo sapiens
accaguggugcguuuau

SEQ ID NO: 1901373 - RNA, 19 nt, Homo sapiens
ccuccccuguacuuaccug

SEQ ID NO: 1901374 - RNA, 19 nt, Homo sapiens
aaaguuacauuauguguaa

SEQ ID NO: 1901375 - RNA, 17 nt, Homo sapiens
auuuuuaaaaguauaca

SEQ ID NO: 1901376 - RNA, 14 nt, Homo sapiens
acaucauggacuga

SEQ ID NO: 1901377 - RNA, 20 nt, Homo sapiens
ugaagaaacuacuaaucuca

SEQ ID NO: 1901378 - RNA, 12 nt, Homo sapiens
gaaagauuacuu

SEQ ID NO: 1901379 - RNA, 21 nt, Homo sapiens
uccaaggagcaugucacucca

SEQ ID NO: 1901380 - RNA, 17 nt, Homo sapiens
ugugaucccuaggucuu

SEQ ID NO: 1901381 - RNA, 14 nt, Homo sapiens
gggcugagcuggga

SEQ ID NO: 1901382 - RNA, 14 nt, Homo sapiens
cggguggaucacaa

SEQ ID NO: 1901383 - RNA, 16 nt, Homo sapiens
cuaaaccccuguccca

SEQ ID NO: 1901384 - RNA, 13 nt, Homo sapiens
cuguuccuugaaa

SEQ ID NO: 1901385 - RNA, 11 nt, Homo sapiens
auaaaugggcc

SEQ ID NO: 1901386 - RNA, 17 nt, Homo sapiens
auauugaucaccaugaa

SEQ ID NO: 1901387 - RNA, 20 nt, Homo sapiens
cuugaugccagagggccagc

SEQ ID NO: 1901388 - RNA, 17 nt, Homo sapiens
uugacaaaguuacugau

SEQ ID NO: 1901389 - RNA, 17 nt, Homo sapiens
uuagcucauuugagaua

SEQ ID NO: 1901390 - RNA, 16 nt, Homo sapiens
cagucuuccacaaaga

SEQ ID NO: 1901391 - RNA, 17 nt, Homo sapiens
gccaccacccucaggug

SEQ ID NO: 1901392 - RNA, 12 nt, Homo sapiens
aauuacuugaag

SEQ ID NO: 1901393 - RNA, 18 nt, Homo sapiens
ucagccuaagaaacacuc

SEQ ID NO: 1901394 - RNA, 15 nt, Homo sapiens
guauuuacagggugg

SEQ ID NO: 1901395 - RNA, 14 nt, Homo sapiens
uuaauauaaaccca

SEQ ID NO: 1901396 - RNA, 16 nt, Homo sapiens
cuugaugccauaugcc

SEQ ID NO: 1901397 - RNA, 17 nt, Homo sapiens
aaaucccaucaggucac

SEQ ID NO: 1901398 - RNA, 18 nt, Homo sapiens
cucugcaagaagaaauca

SEQ ID NO: 1901399 - RNA, 19 nt, Homo sapiens
cauauaggacacacauaga

SEQ ID NO: 1901400 - RNA, 19 nt, Homo sapiens
ggcuuugagaagcucagcu

SEQ ID NO: 1901401 - RNA, 11 nt, Homo sapiens
cuccgaauaaa

SEQ ID NO: 1901402 - RNA, 17 nt, Homo sapiens
uugacaacaucccacag

SEQ ID NO: 1901403 - RNA, 14 nt, Homo sapiens
ugucaaaagccaga

SEQ ID NO: 1901404 - RNA, 15 nt, Homo sapiens
guuggaauuccacgc

SEQ ID NO: 1901405 - RNA, 13 nt, Homo sapiens
aagcaacaucuag

SEQ ID NO: 1901406 - RNA, 17 nt, Homo sapiens
cuaggcucccugaggua

SEQ ID NO: 1901407 - RNA, 16 nt, Homo sapiens
gauguuuccuugccuu

SEQ ID NO: 1901408 - RNA, 15 nt, Homo sapiens
aauauauccacacau

SEQ ID NO: 1901409 - RNA, 16 nt, Homo sapiens
agggcaucuccaggaa

SEQ ID NO: 1901410 - RNA, 20 nt, Homo sapiens
gaaccuggaagaucauggac

SEQ ID NO: 1901411 - RNA, 16 nt, Homo sapiens
ugcuugcucuaaguca

SEQ ID NO: 1901412 - RNA, 17 nt, Homo sapiens
ggagguucaaaaguaag

SEQ ID NO: 1901413 - RNA, 14 nt, Homo sapiens
uggggaaaauccua

SEQ ID NO: 1901414 - RNA, 16 nt, Homo sapiens
aauaaaacaguaucuc

SEQ ID NO: 1901415 - RNA, 13 nt, Homo sapiens
auguaugagacag

SEQ ID NO: 1901416 - RNA, 13 nt, Homo sapiens
guuauuugcacac

SEQ ID NO: 1901417 - RNA, 19 nt, Homo sapiens
aaaugucuggucuguccac

SEQ ID NO: 1901418 - RNA, 11 nt, Homo sapiens
aggcucagucu

SEQ ID NO: 1901419 - RNA, 16 nt, Homo sapiens
uggcuuaaauccaguu

SEQ ID NO: 1901420 - RNA, 23 nt, Homo sapiens
auuucccuuccaaagagggaugu

SEQ ID NO: 1901421 - RNA, 19 nt, Homo sapiens
acauguguagccugugcau

SEQ ID NO: 1901422 - RNA, 15 nt, Homo sapiens
aauguaaagaacuua

SEQ ID NO: 1901423 - RNA, 13 nt, Homo sapiens
uacagugcuauuu

SEQ ID NO: 1901424 - RNA, 13 nt, Homo sapiens
aucagugcauuuu

SEQ ID NO: 1901425 - RNA, 17 nt, Homo sapiens
ucuuuguauuaccaaag

SEQ ID NO: 1901426 - RNA, 22 nt, Homo sapiens
uuccucuauccuguacauuuca

SEQ ID NO: 1901427 - RNA, 18 nt, Homo sapiens
uuaagauaguuuugccag

SEQ ID NO: 1901428 - RNA, 12 nt, Homo sapiens
gcacacauaaca

SEQ ID NO: 1901429 - RNA, 22 nt, Homo sapiens
agggaaguuuccagaaagaaga

SEQ ID NO: 1901430 - RNA, 21 nt, Homo sapiens
uuccaagacagagucuugcuc

SEQ ID NO: 1901431 - RNA, 12 nt, Homo sapiens
uuccacauguac

SEQ ID NO: 1901432 - RNA, 18 nt, Homo sapiens
gacauggaacugaaagac

SEQ ID NO: 1901433 - RNA, 16 nt, Homo sapiens
cucagugcaccugggg

SEQ ID NO: 1901434 - RNA, 18 nt, Homo sapiens
ugaccacauaagaaggca

SEQ ID NO: 1901435 - RNA, 14 nt, Homo sapiens
auuuggaccacagc

SEQ ID NO: 1901436 - RNA, 16 nt, Homo sapiens
cagccugcuuucacac

SEQ ID NO: 1901437 - RNA, 15 nt, Homo sapiens
agucucucucugcca

SEQ ID NO: 1901438 - RNA, 15 nt, Homo sapiens
acagccucugacuca

SEQ ID NO: 1901439 - RNA, 22 nt, Homo sapiens
gcauagcaguuuguaaaagugu

SEQ ID NO: 1901440 - RNA, 16 nt, Homo sapiens
agaugggcagcagcuu

SEQ ID NO: 1901441 - RNA, 22 nt, Homo sapiens
augcuucccuuguauccaguga

SEQ ID NO: 1901442 - RNA, 22 nt, Homo sapiens
cucugguaaaugaucacuccag

SEQ ID NO: 1901443 - RNA, 14 nt, Homo sapiens
gccuuggaagcaaa

SEQ ID NO: 1901444 - RNA, 12 nt, Homo sapiens
auaaacacuguu

SEQ ID NO: 1901445 - RNA, 18 nt, Homo sapiens
auauuuaauuaaagcaca

SEQ ID NO: 1901446 - RNA, 18 nt, Homo sapiens
uacauaaucacaauaaua

SEQ ID NO: 1901447 - RNA, 18 nt, Homo sapiens
cacgugcacagcuuccug

SEQ ID NO: 1901448 - RNA, 13 nt, Homo sapiens
auaaaauguugaa

SEQ ID NO: 1901449 - RNA, 16 nt, Homo sapiens
aucacuuggagccagg

SEQ ID NO: 1901450 - RNA, 19 nt, Homo sapiens
uccauuguuuaaaaauaca

SEQ ID NO: 1901451 - RNA, 21 nt, Homo sapiens
ugcccagccucgcaugccaga

SEQ ID NO: 1901452 - RNA, 20 nt, Homo sapiens
uuuuggaggugcuugaucua

SEQ ID NO: 1901453 - RNA, 18 nt, Homo sapiens
agaaucacuugaacccgg

SEQ ID NO: 1901454 - RNA, 12 nt, Homo sapiens
aggucaccagca

SEQ ID NO: 1901455 - RNA, 15 nt, Homo sapiens
cugcaucaagaugug

SEQ ID NO: 1901456 - RNA, 23 nt, Homo sapiens
aauccacagccaacaaacauaga

SEQ ID NO: 1901457 - RNA, 14 nt, Homo sapiens
ugauaaacuuugaa

SEQ ID NO: 1901458 - RNA, 20 nt, Homo sapiens
uccaagaauaaagucuuucc

SEQ ID NO: 1901459 - RNA, 16 nt, Homo sapiens
ugcaugcagcaucuaa

SEQ ID NO: 1901460 - RNA, 16 nt, Homo sapiens
gcuaccugcaccucug

SEQ ID NO: 1901461 - RNA, 19 nt, Homo sapiens
acugaagauuucacuacuu

SEQ ID NO: 1901462 - RNA, 21 nt, Homo sapiens
gaacuguggugccacaugacc

SEQ ID NO: 1901463 - RNA, 22 nt, Homo sapiens
ucaggugagcgcggggcuggga

SEQ ID NO: 1901464 - RNA, 22 nt, Homo sapiens
uuucacuuaaguugagauuuuu

SEQ ID NO: 1901465 - RNA, 15 nt, Homo sapiens
ugugguuuacgugua

SEQ ID NO: 1901466 - RNA, 21 nt, Homo sapiens
caagguucuucccuuuuacau

SEQ ID NO: 1901467 - RNA, 18 nt, Homo sapiens
accuuccugggcagccca

SEQ ID NO: 1901468 - RNA, 15 nt, Homo sapiens
uguagauacuagcua

SEQ ID NO: 1901469 - RNA, 20 nt, Homo sapiens
aaauuucucaucacagggau

SEQ ID NO: 1901470 - RNA, 16 nt, Homo sapiens
agucugcuucauuucc

SEQ ID NO: 1901471 - RNA, 16 nt, Homo sapiens
acaugagaagugauaa

SEQ ID NO: 1901472 - RNA, 22 nt, Homo sapiens
ccaggauugcacugacauggcg

SEQ ID NO: 1901473 - RNA, 18 nt, Homo sapiens
auuggcucuagucacugg

SEQ ID NO: 1901474 - RNA, 21 nt, Homo sapiens
cugaaaacuaauguacuguac

SEQ ID NO: 1901475 - RNA, 18 nt, Homo sapiens
uacucuggagagacugug

SEQ ID NO: 1901476 - RNA, 23 nt, Homo sapiens
cccagcccugggaaccacuccca

SEQ ID NO: 1901477 - RNA, 20 nt, Homo sapiens
ggcaaaguacuugucauaga

SEQ ID NO: 1901478 - RNA, 22 nt, Homo sapiens
guuuuugucuacguuauacuga

SEQ ID NO: 1901479 - RNA, 15 nt, Homo sapiens
cucugggcacagccu

SEQ ID NO: 1901480 - RNA, 20 nt, Homo sapiens
auucuucccucugaguuuga

SEQ ID NO: 1901481 - RNA, 21 nt, Homo sapiens
cuuucaauuacaaagcaguua

SEQ ID NO: 1901482 - RNA, 16 nt, Homo sapiens
auuuaaaugcuuuuaa

SEQ ID NO: 1901483 - RNA, 18 nt, Homo sapiens
gccuccaugugggugcua

SEQ ID NO: 1901484 - RNA, 13 nt, Homo sapiens
gcacaaccagaaa

SEQ ID NO: 1901485 - RNA, 14 nt, Homo sapiens
ugcuauaauucuua

SEQ ID NO: 1901486 - RNA, 17 nt, Homo sapiens
ucaccagguccugugag

SEQ ID NO: 1901487 - RNA, 22 nt, Homo sapiens
agauucauuauuuuuccacuuu

SEQ ID NO: 1901488 - RNA, 12 nt, Homo sapiens
uauccuguucuc

SEQ ID NO: 1901489 - RNA, 21 nt, Homo sapiens
aauauauuuauauguacauac

SEQ ID NO: 1901490 - RNA, 13 nt, Homo sapiens
uuuaaggcaaaaa

SEQ ID NO: 1901491 - RNA, 15 nt, Homo sapiens
ucuaacacauuucau

SEQ ID NO: 1901492 - RNA, 19 nt, Homo sapiens
uagcaaauuaacuuuacau

SEQ ID NO: 1901493 - RNA, 15 nt, Homo sapiens
cggaggccacaugag

SEQ ID NO: 1901494 - RNA, 19 nt, Homo sapiens
caugcaggggccacaucca

SEQ ID NO: 1901495 - RNA, 16 nt, Homo sapiens
cacaaagguuaaguua

SEQ ID NO: 1901496 - RNA, 15 nt, Homo sapiens
aaggagccuacucca

SEQ ID NO: 1901497 - RNA, 17 nt, Homo sapiens
gaauuagucgguuagaa

SEQ ID NO: 1901498 - RNA, 20 nt, Homo sapiens
aauauauuuauauguacaua

SEQ ID NO: 1901499 - RNA, 20 nt, Homo sapiens
agccuaguggcuuguccuca

SEQ ID NO: 1901500 - RNA, 16 nt, Homo sapiens
aacuauuuaaaggaaa

SEQ ID NO: 1901501 - RNA, 16 nt, Homo sapiens
gagauuggcuuugccu

SEQ ID NO: 1901502 - RNA, 19 nt, Homo sapiens
augcugaauccaccucgga

SEQ ID NO: 1901503 - RNA, 11 nt, Homo sapiens
agacagaggaa

SEQ ID NO: 1901504 - RNA, 20 nt, Homo sapiens
uaaaacaagagaccacuucc

SEQ ID NO: 1901505 - RNA, 23 nt, Homo sapiens
uugugauuuuuuuaauagugcuu

SEQ ID NO: 1901506 - RNA, 13 nt, Homo sapiens
caggguuuuuaga

SEQ ID NO: 1901507 - RNA, 18 nt, Homo sapiens
cagaaaaauuaaauugua

SEQ ID NO: 1901508 - RNA, 14 nt, Homo sapiens
acaucuggagagag

SEQ ID NO: 1901509 - RNA, 17 nt, Homo sapiens
uggucacccaacucaag

SEQ ID NO: 1901510 - RNA, 23 nt, Homo sapiens
uguguaaauacaguggaucucaa

SEQ ID NO: 1901511 - RNA, 16 nt, Homo sapiens
acaagaaugugcacuc

SEQ ID NO: 1901512 - RNA, 22 nt, Homo sapiens
guaugaagacacugucaaugag

SEQ ID NO: 1901513 - RNA, 22 nt, Homo sapiens
cuaauuccacagcugcucaaua

SEQ ID NO: 1901514 - RNA, 21 nt, Homo sapiens
uucaaccaacuguaaugcagg

SEQ ID NO: 1901515 - RNA, 15 nt, Homo sapiens
gaaaagggcuuucuc

SEQ ID NO: 1901516 - RNA, 21 nt, Homo sapiens
ccaggagcugcucacuaccuc

SEQ ID NO: 1901517 - RNA, 12 nt, Homo sapiens
cccacagaguug

SEQ ID NO: 1901518 - RNA, 21 nt, Homo sapiens
guccccuccccggcccuacca

SEQ ID NO: 1901519 - RNA, 21 nt, Homo sapiens
acauggcguaccguacacaga

SEQ ID NO: 1901520 - RNA, 15 nt, Homo sapiens
acuugguucugaaua

SEQ ID NO: 1901521 - RNA, 14 nt, Homo sapiens
caugaaucaaagac

SEQ ID NO: 1901522 - RNA, 16 nt, Homo sapiens
aaugaggcacuuauca

SEQ ID NO: 1901523 - RNA, 23 nt, Homo sapiens
cuagcuaaggaagggaaagggaa

SEQ ID NO: 1901524 - RNA, 22 nt, Homo sapiens
uuucucaauauuaagucauugu

SEQ ID NO: 1901525 - RNA, 17 nt, Homo sapiens
uugaauauuuaagcaau

SEQ ID NO: 1901526 - RNA, 21 nt, Homo sapiens
agcacuugaagaauauuccca

SEQ ID NO: 1901527 - RNA, 20 nt, Homo sapiens
ucugacuuuagccuaccuaa

SEQ ID NO: 1901528 - RNA, 22 nt, Homo sapiens
cuggauuucauccuugaccuca

SEQ ID NO: 1901529 - RNA, 16 nt, Homo sapiens
gcccagccucaucucu

SEQ ID NO: 1901530 - RNA, 22 nt, Homo sapiens
ccaauaccguguggcccaagac

SEQ ID NO: 1901531 - RNA, 21 nt, Homo sapiens
cuuuguuucauauucucagau

SEQ ID NO: 1901532 - RNA, 18 nt, Homo sapiens
ucucccagcuuucaggga

SEQ ID NO: 1901533 - RNA, 16 nt, Homo sapiens
acuuguccugacucaa

SEQ ID NO: 1901534 - RNA, 17 nt, Homo sapiens
ggugucagucagggaca

SEQ ID NO: 1901535 - RNA, 22 nt, Homo sapiens
gcaccggcugcccacagggaac

SEQ ID NO: 1901536 - RNA, 16 nt, Homo sapiens
uacauguguagccugu

SEQ ID NO: 1901537 - RNA, 11 nt, Homo sapiens
gaaaagccaga

SEQ ID NO: 1901538 - RNA, 12 nt, Homo sapiens
aggugaucucag

SEQ ID NO: 1901539 - RNA, 22 nt, Homo sapiens
aauugaaagggacaaguaucau

SEQ ID NO: 1901540 - RNA, 15 nt, Homo sapiens
ccaaagcaaugugag

SEQ ID NO: 1901541 - RNA, 13 nt, Homo sapiens
gagagucacuuga

SEQ ID NO: 1901542 - RNA, 23 nt, Homo sapiens
gauaggauggggugucuguguua

SEQ ID NO: 1901543 - RNA, 20 nt, Homo sapiens
cccaagauuuuuuauuugag

SEQ ID NO: 1901544 - RNA, 18 nt, Homo sapiens
agacauuuuaagcauuuu

SEQ ID NO: 1901545 - RNA, 16 nt, Homo sapiens
aacaggguaccucaag

SEQ ID NO: 1901546 - RNA, 21 nt, Homo sapiens
cagcauuguuggcuguuccug

SEQ ID NO: 1901547 - RNA, 23 nt, Homo sapiens
ugggaguccauggugucaugcca

SEQ ID NO: 1901548 - RNA, 19 nt, Homo sapiens
aggaagucccagagccugu

SEQ ID NO: 1901549 - RNA, 17 nt, Homo sapiens
aagacuguguuuuugcc

SEQ ID NO: 1901550 - RNA, 14 nt, Homo sapiens
auucugguuuauuu

SEQ ID NO: 1901551 - RNA, 15 nt, Homo sapiens
cccuacaaugcucau

SEQ ID NO: 1901552 - RNA, 15 nt, Homo sapiens
augcauucaccugcc

SEQ ID NO: 1901553 - RNA, 16 nt, Homo sapiens
uagcgaagaccaguau

SEQ ID NO: 1901554 - RNA, 19 nt, Homo sapiens
aacccagaagaggagacag

SEQ ID NO: 1901555 - RNA, 16 nt, Homo sapiens
aauucagggcuuuaaa

SEQ ID NO: 1901556 - RNA, 13 nt, Homo sapiens
ugccuguggugag

SEQ ID NO: 1901557 - RNA, 17 nt, Homo sapiens
accacgcccccagcugu

SEQ ID NO: 1901558 - RNA, 21 nt, Homo sapiens
aaaagggucaaaccuguagau

SEQ ID NO: 1901559 - RNA, 23 nt, Homo sapiens
ccauggaccuaugacaggcugaa

SEQ ID NO: 1901560 - RNA, 16 nt, Homo sapiens
aaaugcauagagcaau

SEQ ID NO: 1901561 - RNA, 22 nt, Homo sapiens
ccuggagacuuaauagacauuu

SEQ ID NO: 1901562 - RNA, 22 nt, Homo sapiens
cugggcuggccagccaccacug

SEQ ID NO: 1901563 - RNA, 22 nt, Homo sapiens
guauuugcuaauguugauugaa

SEQ ID NO: 1901564 - RNA, 22 nt, Homo sapiens
gccacagaacguaggugugaca

SEQ ID NO: 1901565 - RNA, 16 nt, Homo sapiens
ucaaaugugucucaca

SEQ ID NO: 1901566 - RNA, 22 nt, Homo sapiens
ucccaccucuucucuuccugua

SEQ ID NO: 1901567 - RNA, 19 nt, Homo sapiens
caggaaccauggaccugca

SEQ ID NO: 1901568 - RNA, 13 nt, Homo sapiens
ugagucuccugca

SEQ ID NO: 1901569 - RNA, 21 nt, Homo sapiens
auuuucuggccuuucauggca

SEQ ID NO: 1901570 - RNA, 23 nt, Homo sapiens
acauuuuuuuuaacuacuauauu

SEQ ID NO: 1901571 - RNA, 17 nt, Homo sapiens
aggcgaaauccugucug

SEQ ID NO: 1901572 - RNA, 20 nt, Homo sapiens
auaaaauguuucauuaugca

SEQ ID NO: 1901573 - RNA, 18 nt, Homo sapiens
agucuguaauacacucca

SEQ ID NO: 1901574 - RNA, 16 nt, Homo sapiens
acaguaaaaacuugua

SEQ ID NO: 1901575 - RNA, 18 nt, Homo sapiens
gcaggccuaggaccucag

SEQ ID NO: 1901576 - RNA, 12 nt, Homo sapiens
cuuugucugugg

SEQ ID NO: 1901577 - RNA, 15 nt, Homo sapiens
ccagacacauucucc

SEQ ID NO: 1901578 - RNA, 13 nt, Homo sapiens
auuaauccaaagc

SEQ ID NO: 1901579 - RNA, 15 nt, Homo sapiens
cucaaugcaugauga

SEQ ID NO: 1901580 - RNA, 22 nt, Homo sapiens
ugcucccaccccagaaaucacu

SEQ ID NO: 1901581 - RNA, 21 nt, Homo sapiens
auaugugacugugacuuucaa

SEQ ID NO: 1901582 - RNA, 14 nt, Homo sapiens
cuggaccagugguc

SEQ ID NO: 1901583 - RNA, 14 nt, Homo sapiens
agccuaguacaaua

SEQ ID NO: 1901584 - RNA, 16 nt, Homo sapiens
cacccagaggucuccc

SEQ ID NO: 1901585 - RNA, 22 nt, Homo sapiens
agauucccaucauacacuuccu

SEQ ID NO: 1901586 - RNA, 15 nt, Homo sapiens
ucccugccacugggc

SEQ ID NO: 1901587 - RNA, 22 nt, Homo sapiens
ucuaagccaaaaggauuccucu

SEQ ID NO: 1901588 - RNA, 12 nt, Homo sapiens
cuauucauuaca

SEQ ID NO: 1901589 - RNA, 12 nt, Homo sapiens
caauucauuuca

SEQ ID NO: 1901590 - RNA, 11 nt, Homo sapiens
guccucaaaac

SEQ ID NO: 1901591 - RNA, 18 nt, Homo sapiens
cucuguccacucugaaua

SEQ ID NO: 1901592 - RNA, 21 nt, Homo sapiens
aacuguuccuuggucuauuua

SEQ ID NO: 1901593 - RNA, 18 nt, Homo sapiens
gacagaugccuggugagc

SEQ ID NO: 1901594 - RNA, 19 nt, Homo sapiens
ccaaugacacccaugccag

SEQ ID NO: 1901595 - RNA, 21 nt, Homo sapiens
auucucccugguuuuacccca

SEQ ID NO: 1901596 - RNA, 17 nt, Homo sapiens
gaccaaaaaaccucacu

SEQ ID NO: 1901597 - RNA, 23 nt, Homo sapiens
ccuauauuuuacaaagcauguga

SEQ ID NO: 1901598 - RNA, 18 nt, Homo sapiens
cagcccuggcccaggugc

SEQ ID NO: 1901599 - RNA, 20 nt, Homo sapiens
cugcaccuacccacaugcac

SEQ ID NO: 1901600 - RNA, 14 nt, Homo sapiens
ccaccugacaggcc

SEQ ID NO: 1901601 - RNA, 16 nt, Homo sapiens
aagugacccuguucuc

SEQ ID NO: 1901602 - RNA, 15 nt, Homo sapiens
ugcaaaccaaaccau

SEQ ID NO: 1901603 - RNA, 14 nt, Homo sapiens
gaacuugccuuaaa

SEQ ID NO: 1901604 - RNA, 22 nt, Homo sapiens
cagaaggcaauaccaaccugaa

SEQ ID NO: 1901605 - RNA, 22 nt, Homo sapiens
uguaguccagucucuccagcau

SEQ ID NO: 1901606 - RNA, 22 nt, Homo sapiens
guugggggaggggccuagacaa

SEQ ID NO: 1901607 - RNA, 19 nt, Homo sapiens
ugggauuaucgucuucuaa

SEQ ID NO: 1901608 - RNA, 22 nt, Homo sapiens
aggacugagcacccucuggauu

SEQ ID NO: 1901609 - RNA, 20 nt, Homo sapiens
ccaccaggccagcucaggaa

SEQ ID NO: 1901610 - RNA, 15 nt, Homo sapiens
gcagaacuccuccaa

SEQ ID NO: 1901611 - RNA, 17 nt, Homo sapiens
agacuucagcuguuccu

SEQ ID NO: 1901612 - RNA, 17 nt, Homo sapiens
acucuuccugaguucag

SEQ ID NO: 1901613 - RNA, 15 nt, Homo sapiens
ucacaugucccuguc

SEQ ID NO: 1901614 - RNA, 11 nt, Homo sapiens
ucucugggcug

SEQ ID NO: 1901615 - RNA, 18 nt, Homo sapiens
ugccaccacgcccggcua

SEQ ID NO: 1901616 - RNA, 19 nt, Homo sapiens
gucccucacguuucuuccc

SEQ ID NO: 1901617 - RNA, 14 nt, Homo sapiens
ugguagguuacuca

SEQ ID NO: 1901618 - RNA, 14 nt, Homo sapiens
gguuaaauuugaau

SEQ ID NO: 1901619 - RNA, 14 nt, Homo sapiens
auaggaauugcaca

SEQ ID NO: 1901620 - RNA, 22 nt, Homo sapiens
gguauauacuuugccacugcug

SEQ ID NO: 1901621 - RNA, 13 nt, Homo sapiens
cuaggggagacac

SEQ ID NO: 1901622 - RNA, 16 nt, Homo sapiens
uaaccuuugcuaugua

SEQ ID NO: 1901623 - RNA, 13 nt, Homo sapiens
ucuggacacugag

SEQ ID NO: 1901624 - RNA, 20 nt, Homo sapiens
gcuugugcacuggauguggc

SEQ ID NO: 1901625 - RNA, 16 nt, Homo sapiens
ugcagcuccucugccu

SEQ ID NO: 1901626 - RNA, 13 nt, Homo sapiens
agagugaccagaa

SEQ ID NO: 1901627 - RNA, 21 nt, Homo sapiens
ugguaauugaauggaagcaaa

SEQ ID NO: 1901628 - RNA, 15 nt, Homo sapiens
gggggccgugcccag

SEQ ID NO: 1901629 - RNA, 15 nt, Homo sapiens
aaugcucucagggaa

SEQ ID NO: 1901630 - RNA, 21 nt, Homo sapiens
ccauugauucuucagaacuuu

SEQ ID NO: 1901631 - RNA, 11 nt, Homo sapiens
cgucagucucu

SEQ ID NO: 1901632 - RNA, 17 nt, Homo sapiens
agucacugccaagucau

SEQ ID NO: 1901633 - RNA, 19 nt, Homo sapiens
uuguauuuuauuguuucuu

SEQ ID NO: 1901634 - RNA, 15 nt, Homo sapiens
ucuucuaccagaccc

SEQ ID NO: 1901635 - RNA, 19 nt, Homo sapiens
aauaucuuuauugcaugag

SEQ ID NO: 1901636 - RNA, 15 nt, Homo sapiens
uguuauuuucaguga

SEQ ID NO: 1901637 - RNA, 21 nt, Homo sapiens
cuuuuagaaauacugcaagaa

SEQ ID NO: 1901638 - RNA, 10 nt, Homo sapiens
caucucaggu

SEQ ID NO: 1901639 - RNA, 13 nt, Homo sapiens
gcacggacucucc

SEQ ID NO: 1901640 - RNA, 21 nt, Homo sapiens
gaaaauuauggcauauauuaa

SEQ ID NO: 1901641 - RNA, 17 nt, Homo sapiens
gagucagaaaccaaagu

SEQ ID NO: 1901642 - RNA, 19 nt, Homo sapiens
ugaacauucgaccuccauu

SEQ ID NO: 1901643 - RNA, 20 nt, Homo sapiens
ugguccuuagccccaucugc

SEQ ID NO: 1901644 - RNA, 17 nt, Homo sapiens
ucugggagcucaaguga

SEQ ID NO: 1901645 - RNA, 20 nt, Homo sapiens
gaaugagacugaacugugug

SEQ ID NO: 1901646 - RNA, 20 nt, Homo sapiens
gcacagcguccuguccacac

SEQ ID NO: 1901647 - RNA, 19 nt, Homo sapiens
agcugccuucccuagcuuu

SEQ ID NO: 1901648 - RNA, 24 nt, Homo sapiens
cuccacaucugcaucacucaugga

SEQ ID NO: 1901649 - RNA, 20 nt, Homo sapiens
uaaugacuaaagaccugcug

SEQ ID NO: 1901650 - RNA, 21 nt, Homo sapiens
cucuggcauuccuuuucccaa

SEQ ID NO: 1901651 - RNA, 20 nt, Homo sapiens
agcaccuacuuacaugcauu

SEQ ID NO: 1901652 - RNA, 19 nt, Homo sapiens
aagucccaguauaccucau

SEQ ID NO: 1901653 - RNA, 13 nt, Homo sapiens
uugggaaguuugc

SEQ ID NO: 1901654 - RNA, 17 nt, Homo sapiens
aagaaugaguaauguga

SEQ ID NO: 1901655 - RNA, 13 nt, Homo sapiens
uuuuaacuccuca

SEQ ID NO: 1901656 - RNA, 16 nt, Homo sapiens
ucaguagcuuaucuca

SEQ ID NO: 1901657 - RNA, 19 nt, Homo sapiens
auuguauuauuagucuguu

SEQ ID NO: 1901658 - RNA, 19 nt, Homo sapiens
acaucuuuguugauguuua

SEQ ID NO: 1901659 - RNA, 20 nt, Homo sapiens
cuuauaacuucugaaguaau

SEQ ID NO: 1901660 - RNA, 13 nt, Homo sapiens
accaaacaaggaa

SEQ ID NO: 1901661 - RNA, 23 nt, Homo sapiens
auuuuccuccaucgcaguguuca

SEQ ID NO: 1901662 - RNA, 23 nt, Homo sapiens
agcucaccaucuucacuacaaac

SEQ ID NO: 1901663 - RNA, 18 nt, Homo sapiens
guaaagacugguuuucug

SEQ ID NO: 1901664 - RNA, 18 nt, Homo sapiens
ucauaaggcauauacaaa

SEQ ID NO: 1901665 - RNA, 13 nt, Homo sapiens
ccgucugcacuuc

SEQ ID NO: 1901666 - RNA, 21 nt, Homo sapiens
cuuaaacuaaauaaugaauaa

SEQ ID NO: 1901667 - RNA, 22 nt, Homo sapiens
auauuuuuaguagagacagggu

SEQ ID NO: 1901668 - RNA, 15 nt, Homo sapiens
acccuggaaaacaga

SEQ ID NO: 1901669 - RNA, 21 nt, Homo sapiens
caggccuuaauuuucaguaua

SEQ ID NO: 1901670 - RNA, 15 nt, Homo sapiens
gugcuggaaauggac

SEQ ID NO: 1901671 - RNA, 13 nt, Homo sapiens
ugcccagugccau

SEQ ID NO: 1901672 - RNA, 21 nt, Homo sapiens
aucuccccucagauuccaccu

SEQ ID NO: 1901673 - RNA, 20 nt, Homo sapiens
cgcaaucucggcucacugca

SEQ ID NO: 1901674 - RNA, 22 nt, Homo sapiens
acucugcuuugacugagcagac

SEQ ID NO: 1901675 - RNA, 21 nt, Homo sapiens
acaaacucaccaucugugcac

SEQ ID NO: 1901676 - RNA, 13 nt, Homo sapiens
ccacagcacuaau

SEQ ID NO: 1901677 - RNA, 16 nt, Homo sapiens
cacauugucaucagag

SEQ ID NO: 1901678 - RNA, 13 nt, Homo sapiens
cuuugauuuccaa

SEQ ID NO: 1901679 - RNA, 22 nt, Homo sapiens
auaaagguuggugaaguguaau

SEQ ID NO: 1901680 - RNA, 23 nt, Homo sapiens
augucuuaaaaccugcuuuucaa

SEQ ID NO: 1901681 - RNA, 18 nt, Homo sapiens
augacauaucacauguca

SEQ ID NO: 1901682 - RNA, 13 nt, Homo sapiens
cagacuggcaaua

SEQ ID NO: 1901683 - RNA, 12 nt, Homo sapiens
cuccaacaugaa

SEQ ID NO: 1901684 - RNA, 20 nt, Homo sapiens
cccugcacccaucugcucac

SEQ ID NO: 1901685 - RNA, 22 nt, Homo sapiens
ugcccacgcugcagugugagua

SEQ ID NO: 1901686 - RNA, 20 nt, Homo sapiens
aagugcggguccggcagcuu

SEQ ID NO: 1901687 - RNA, 19 nt, Homo sapiens
ccaguucauugcacuuuga

SEQ ID NO: 1901688 - RNA, 20 nt, Homo sapiens
aaggcaggcagaucacuuga

SEQ ID NO: 1901689 - RNA, 19 nt, Homo sapiens
cuugauuuacaagcaucau

SEQ ID NO: 1901690 - RNA, 14 nt, Homo sapiens
ugucuuggggccac

SEQ ID NO: 1901691 - RNA, 19 nt, Homo sapiens
gaccuucuccagggacaga

SEQ ID NO: 1901692 - RNA, 11 nt, Homo sapiens
ucacagugcau

SEQ ID NO: 1901693 - RNA, 16 nt, Homo sapiens
uguacguuuugcacau

SEQ ID NO: 1901694 - RNA, 17 nt, Homo sapiens
uaaacuguuagcacugu

SEQ ID NO: 1901695 - RNA, 16 nt, Homo sapiens
auuaauuuaauucaug

SEQ ID NO: 1901696 - RNA, 18 nt, Homo sapiens
cugugccaggacugugac

SEQ ID NO: 1901697 - RNA, 22 nt, Homo sapiens
uuaaauguagcaauggcacugu

SEQ ID NO: 1901698 - RNA, 15 nt, Homo sapiens
aaguccuaaagugaa

SEQ ID NO: 1901699 - RNA, 14 nt, Homo sapiens
ucaggccaucauca

SEQ ID NO: 1901700 - RNA, 22 nt, Homo sapiens
gaaaacugccacaagcacaauu

SEQ ID NO: 1901701 - RNA, 17 nt, Homo sapiens
cauaauuuaauuccuuc

SEQ ID NO: 1901702 - RNA, 15 nt, Homo sapiens
uucauuguaaaucac

SEQ ID NO: 1901703 - RNA, 13 nt, Homo sapiens
gguaaaacaaaac

SEQ ID NO: 1901704 - RNA, 13 nt, Homo sapiens
uugcaguucugua

SEQ ID NO: 1901705 - RNA, 22 nt, Homo sapiens
augaaccaugcuuacaaagaaa

SEQ ID NO: 1901706 - RNA, 20 nt, Homo sapiens
cugcuauuugaaguguaauu

SEQ ID NO: 1901707 - RNA, 17 nt, Homo sapiens
uuaaacuuuagaauucc

SEQ ID NO: 1901708 - RNA, 16 nt, Homo sapiens
gccuccaccaccacug

SEQ ID NO: 1901709 - RNA, 17 nt, Homo sapiens
cucugauggcugcucca

SEQ ID NO: 1901710 - RNA, 17 nt, Homo sapiens
aaugacaacagaaaaac

SEQ ID NO: 1901711 - RNA, 17 nt, Homo sapiens
uuaucaccaugcaaugc

SEQ ID NO: 1901712 - RNA, 13 nt, Homo sapiens
cucauaagcauau

SEQ ID NO: 1901713 - RNA, 17 nt, Homo sapiens
uaccacugcucugauga

SEQ ID NO: 1901714 - RNA, 15 nt, Homo sapiens
acaaagaacaagcau

SEQ ID NO: 1901715 - RNA, 12 nt, Homo sapiens
uugaaaacugcu

SEQ ID NO: 1901716 - RNA, 18 nt, Homo sapiens
cuuacucauuacugcaaa

SEQ ID NO: 1901717 - RNA, 19 nt, Homo sapiens
uguacuaaaaaccaaugaa

SEQ ID NO: 1901718 - RNA, 13 nt, Homo sapiens
uauccauucucuc

SEQ ID NO: 1901719 - RNA, 15 nt, Homo sapiens
cuucaugccagugca

SEQ ID NO: 1901720 - RNA, 19 nt, Homo sapiens
aacauucauucaacagcug

SEQ ID NO: 1901721 - RNA, 16 nt, Homo sapiens
uguaaacuacaaagua

SEQ ID NO: 1901722 - RNA, 17 nt, Homo sapiens
aggcauauauguacuag

SEQ ID NO: 1901723 - RNA, 22 nt, Homo sapiens
ugcucagaaucugauaccaaag

SEQ ID NO: 1901724 - RNA, 20 nt, Homo sapiens
agggcagggcuggcaccucu

SEQ ID NO: 1901725 - RNA, 21 nt, Homo sapiens
cagugaauuagugucauguca

SEQ ID NO: 1901726 - RNA, 13 nt, Homo sapiens
cauccccuacacu

SEQ ID NO: 1901727 - RNA, 16 nt, Homo sapiens
gucuggagcacccuga

SEQ ID NO: 1901728 - RNA, 14 nt, Homo sapiens
aagucuccaugaag

SEQ ID NO: 1901729 - RNA, 18 nt, Homo sapiens
gaaagcauaaagcucaaa

SEQ ID NO: 1901730 - RNA, 20 nt, Homo sapiens
cuggcagagucagcugcuga

SEQ ID NO: 1901731 - RNA, 15 nt, Homo sapiens
ccagacucagagggc

SEQ ID NO: 1901732 - RNA, 18 nt, Homo sapiens
ccacugaagcaccacagg

SEQ ID NO: 1901733 - RNA, 12 nt, Homo sapiens
ccugcauuugau

SEQ ID NO: 1901734 - RNA, 21 nt, Homo sapiens
uauucuucuuugauaguguaa

SEQ ID NO: 1901735 - RNA, 14 nt, Homo sapiens
cacugcacugucug

SEQ ID NO: 1901736 - RNA, 20 nt, Homo sapiens
uuccugucuuauccuccacc

SEQ ID NO: 1901737 - RNA, 16 nt, Homo sapiens
auacacacacacaaaa

SEQ ID NO: 1901738 - RNA, 14 nt, Homo sapiens
cuuuuuuucuuggc

SEQ ID NO: 1901739 - RNA, 16 nt, Homo sapiens
uuagccccgaguuuaa

SEQ ID NO: 1901740 - RNA, 23 nt, Homo sapiens
uagucucuacccaguagaugcca

SEQ ID NO: 1901741 - RNA, 18 nt, Homo sapiens
auaagauauauaugugcu

SEQ ID NO: 1901742 - RNA, 23 nt, Homo sapiens
aaaaggagguaucuagcaaugga

SEQ ID NO: 1901743 - RNA, 14 nt, Homo sapiens
cugaaaacuacaca

SEQ ID NO: 1901744 - RNA, 18 nt, Homo sapiens
gcaguucuuguggaagac

SEQ ID NO: 1901745 - RNA, 15 nt, Homo sapiens
gacacuaccacuccc

SEQ ID NO: 1901746 - RNA, 23 nt, Homo sapiens
acacgcccccacaggcucugacc

SEQ ID NO: 1901747 - RNA, 22 nt, Homo sapiens
uguuaaugcuuuucccacucuc

SEQ ID NO: 1901748 - RNA, 11 nt, Homo sapiens
ggaaauaugca

SEQ ID NO: 1901749 - RNA, 19 nt, Homo sapiens
agauguuaguaguuucuca

SEQ ID NO: 1901750 - RNA, 23 nt, Homo sapiens
auugaaaacagauauuacagcuu

SEQ ID NO: 1901751 - RNA, 17 nt, Homo sapiens
caacaauacaugcugcu

SEQ ID NO: 1901752 - RNA, 11 nt, Homo sapiens
ggaaaccacaa

SEQ ID NO: 1901753 - RNA, 20 nt, Homo sapiens
cacugugcucuauuaccauu

SEQ ID NO: 1901754 - RNA, 14 nt, Homo sapiens
aggaaaggcaguau

SEQ ID NO: 1901755 - RNA, 15 nt, Homo sapiens
agaggaggaggagaa

SEQ ID NO: 1901756 - RNA, 13 nt, Homo sapiens
aaagcccuuccau

SEQ ID NO: 1901757 - RNA, 14 nt, Homo sapiens
cauagucaaugaug

SEQ ID NO: 1901758 - RNA, 15 nt, Homo sapiens
ggagguaaugaauua

SEQ ID NO: 1901759 - RNA, 14 nt, Homo sapiens
accucuggcaccca

SEQ ID NO: 1901760 - RNA, 15 nt, Homo sapiens
uauauguaaaggaca

SEQ ID NO: 1901761 - RNA, 22 nt, Homo sapiens
cuuuuaaagaaauaaccacugc

SEQ ID NO: 1901762 - RNA, 20 nt, Homo sapiens
uccugucaccaaggacguua

SEQ ID NO: 1901763 - RNA, 23 nt, Homo sapiens
gccuccaucuuuuucuuggguga

SEQ ID NO: 1901764 - RNA, 12 nt, Homo sapiens
ccuggcuggcau

SEQ ID NO: 1901765 - RNA, 18 nt, Homo sapiens
guuuuuaaaaguuucaau

SEQ ID NO: 1901766 - RNA, 15 nt, Homo sapiens
cucgaggcuggugcc

SEQ ID NO: 1901767 - RNA, 22 nt, Homo sapiens
ucuccaccgucacccaacauca

SEQ ID NO: 1901768 - RNA, 17 nt, Homo sapiens
acaucgugaaacccugu

SEQ ID NO: 1901769 - RNA, 22 nt, Homo sapiens
gaggaagggacugguccaggca

SEQ ID NO: 1901770 - RNA, 14 nt, Homo sapiens
gguugaucuugcaa

SEQ ID NO: 1901771 - RNA, 13 nt, Homo sapiens
uaaaagacaguga

SEQ ID NO: 1901772 - RNA, 21 nt, Homo sapiens
auaagucaugugucccagcau

SEQ ID NO: 1901773 - RNA, 17 nt, Homo sapiens
cugcuuuuuuucaggga

SEQ ID NO: 1901774 - RNA, 18 nt, Homo sapiens
ccuuugcaauagcaguua

SEQ ID NO: 1901775 - RNA, 20 nt, Homo sapiens
agcguuaccgccacacuuga

SEQ ID NO: 1901776 - RNA, 23 nt, Homo sapiens
uauuuuaaauuauggaacugcua

SEQ ID NO: 1901777 - RNA, 23 nt, Homo sapiens
acacgaagggugaggcugacaca

SEQ ID NO: 1901778 - RNA, 16 nt, Homo sapiens
aacaauguuugauacu

SEQ ID NO: 1901779 - RNA, 15 nt, Homo sapiens
gauuacuggugugag

SEQ ID NO: 1901780 - RNA, 13 nt, Homo sapiens
gucaguauuccaa

SEQ ID NO: 1901781 - RNA, 20 nt, Homo sapiens
ugccccacgcuguggcccug

SEQ ID NO: 1901782 - RNA, 15 nt, Homo sapiens
gugauuuccagugag

SEQ ID NO: 1901783 - RNA, 22 nt, Homo sapiens
auuugccuaaggucacagcuaa

SEQ ID NO: 1901784 - RNA, 15 nt, Homo sapiens
auuaucuucaggaca

SEQ ID NO: 1901785 - RNA, 14 nt, Homo sapiens
acuccuagggccac

SEQ ID NO: 1901786 - RNA, 23 nt, Homo sapiens
ugaaaauaaaaugacgucacaag

SEQ ID NO: 1901787 - RNA, 17 nt, Homo sapiens
ucuacaagcaaauggag

SEQ ID NO: 1901788 - RNA, 17 nt, Homo sapiens
gcuuauguuagaaauaa

SEQ ID NO: 1901789 - RNA, 16 nt, Homo sapiens
aaucuuagacauuuau

SEQ ID NO: 1901790 - RNA, 14 nt, Homo sapiens
cagagaaaggagag

SEQ ID NO: 1901791 - RNA, 19 nt, Homo sapiens
guuuuguggaggagcucag

SEQ ID NO: 1901792 - RNA, 15 nt, Homo sapiens
aguccucaguucucu

SEQ ID NO: 1901793 - RNA, 18 nt, Homo sapiens
ucagcuuuagaaauuaau

SEQ ID NO: 1901794 - RNA, 15 nt, Homo sapiens
caaaacccauauccc

SEQ ID NO: 1901795 - RNA, 23 nt, Homo sapiens
uggaacguuucacugcaaacaca

SEQ ID NO: 1901796 - RNA, 20 nt, Homo sapiens
acugcacucuagccugggug

SEQ ID NO: 1901797 - RNA, 15 nt, Homo sapiens
caccuggguguuaca

SEQ ID NO: 1901798 - RNA, 12 nt, Homo sapiens
cauuacuuugag

SEQ ID NO: 1901799 - RNA, 18 nt, Homo sapiens
caggcuccaugcaccucc

SEQ ID NO: 1901800 - RNA, 22 nt, Homo sapiens
uaauguguauuuacuguacuaa

SEQ ID NO: 1901801 - RNA, 18 nt, Homo sapiens
guuuucagcccaucuccu

SEQ ID NO: 1901802 - RNA, 13 nt, Homo sapiens
guccccagacuca

SEQ ID NO: 1901803 - RNA, 22 nt, Homo sapiens
ucagucugaugagaacucugag

SEQ ID NO: 1901804 - RNA, 17 nt, Homo sapiens
aaagugugguuugcaga

SEQ ID NO: 1901805 - RNA, 15 nt, Homo sapiens
ccuacccaauuugau

SEQ ID NO: 1901806 - RNA, 20 nt, Homo sapiens
cuuucauccacuagugcaaa

SEQ ID NO: 1901807 - RNA, 13 nt, Homo sapiens
cuuguuuugccag

SEQ ID NO: 1901808 - RNA, 21 nt, Homo sapiens
uggaagaaggaagaagccaga

SEQ ID NO: 1901809 - RNA, 15 nt, Homo sapiens
aacuguuguugauaa

SEQ ID NO: 1901810 - RNA, 16 nt, Homo sapiens
cagcgcuccuggaaaa

SEQ ID NO: 1901811 - RNA, 20 nt, Homo sapiens
acggaaaauccgacaagccu

SEQ ID NO: 1901812 - RNA, 23 nt, Homo sapiens
cagcaagacuucucuuugccuca

SEQ ID NO: 1901813 - RNA, 20 nt, Homo sapiens
cacugguuaguacugguccc

SEQ ID NO: 1901814 - RNA, 22 nt, Homo sapiens
uaggaguuuuguuuagagcagu

SEQ ID NO: 1901815 - RNA, 11 nt, Homo sapiens
aaaaagcacaa

SEQ ID NO: 1901816 - RNA, 19 nt, Homo sapiens
ccauagggacccauucuac

SEQ ID NO: 1901817 - RNA, 17 nt, Homo sapiens
uugagaccaaaucuugc

SEQ ID NO: 1901818 - RNA, 21 nt, Homo sapiens
gguucucauaacucugugauc

SEQ ID NO: 1901819 - RNA, 14 nt, Homo sapiens
auaaauagaugaag

SEQ ID NO: 1901820 - RNA, 15 nt, Homo sapiens
auauauucuuacaag

SEQ ID NO: 1901821 - RNA, 19 nt, Homo sapiens
accuuuccucaaauguuga

SEQ ID NO: 1901822 - RNA, 11 nt, Homo sapiens
gaugcccugug

SEQ ID NO: 1901823 - RNA, 21 nt, Homo sapiens
aacagcuccccauuacccuca

SEQ ID NO: 1901824 - RNA, 21 nt, Homo sapiens
uguccagcgcggcucccgcca

SEQ ID NO: 1901825 - RNA, 14 nt, Homo sapiens
caggagcacacggc

SEQ ID NO: 1901826 - RNA, 14 nt, Homo sapiens
cccagccaccgaag

SEQ ID NO: 1901827 - RNA, 21 nt, Homo sapiens
uguacauaaacugucacucua

SEQ ID NO: 1901828 - RNA, 20 nt, Homo sapiens
ugcagucacagcuacacaga

SEQ ID NO: 1901829 - RNA, 21 nt, Homo sapiens
uuguagagauggggucucaca

SEQ ID NO: 1901830 - RNA, 18 nt, Homo sapiens
gucucuaugaucuuggca

SEQ ID NO: 1901831 - RNA, 14 nt, Homo sapiens
uugguggggggcca

SEQ ID NO: 1901832 - RNA, 15 nt, Homo sapiens
cccacccggacaggu

SEQ ID NO: 1901833 - RNA, 20 nt, Homo sapiens
ucaguagccccuaaucacau

SEQ ID NO: 1901834 - RNA, 17 nt, Homo sapiens
aucacuuucauucaauu

SEQ ID NO: 1901835 - RNA, 16 nt, Homo sapiens
ucaaauuucagaccag

SEQ ID NO: 1901836 - RNA, 15 nt, Homo sapiens
cauagcuuugcacuu

SEQ ID NO: 1901837 - RNA, 19 nt, Homo sapiens
caagagaucuuucuuucca

SEQ ID NO: 1901838 - RNA, 23 nt, Homo sapiens
aggagaaucacuggaaccuggga

SEQ ID NO: 1901839 - RNA, 12 nt, Homo sapiens
gcacagacucac

SEQ ID NO: 1901840 - RNA, 14 nt, Homo sapiens
uuaauaucugaggu

SEQ ID NO: 1901841 - RNA, 21 nt, Homo sapiens
aaauuguaggcauguuugaua

SEQ ID NO: 1901842 - RNA, 13 nt, Homo sapiens
cgcauucccugag

SEQ ID NO: 1901843 - RNA, 13 nt, Homo sapiens
aacccuaccuguc

SEQ ID NO: 1901844 - RNA, 17 nt, Homo sapiens
caccugagcuuuggacg

SEQ ID NO: 1901845 - RNA, 21 nt, Homo sapiens
aguguagaccgagauggugca

SEQ ID NO: 1901846 - RNA, 18 nt, Homo sapiens
uuagcuacacagugcaga

SEQ ID NO: 1901847 - RNA, 12 nt, Homo sapiens
cuucacucucca

SEQ ID NO: 1901848 - RNA, 15 nt, Homo sapiens
gagacauacaccuau

SEQ ID NO: 1901849 - RNA, 21 nt, Homo sapiens
ugggacccccaacauucugcc

SEQ ID NO: 1901850 - RNA, 19 nt, Homo sapiens
auauuuauaaaauugcuau

SEQ ID NO: 1901851 - RNA, 21 nt, Homo sapiens
ggguggcuccugccacugacc

SEQ ID NO: 1901852 - RNA, 11 nt, Homo sapiens
uagcuaggcau

SEQ ID NO: 1901853 - RNA, 21 nt, Homo sapiens
acgagcuagcuucugcaaugu

SEQ ID NO: 1901854 - RNA, 13 nt, Homo sapiens
ucccccaagcaga

SEQ ID NO: 1901855 - RNA, 22 nt, Homo sapiens
agacaacuucuguuucuucucu

SEQ ID NO: 1901856 - RNA, 20 nt, Homo sapiens
aaccucaaguaaacuccccu

SEQ ID NO: 1901857 - RNA, 13 nt, Homo sapiens
caauaaagaccac

SEQ ID NO: 1901858 - RNA, 21 nt, Homo sapiens
agggcaagaaggaaauagcca

SEQ ID NO: 1901859 - RNA, 22 nt, Homo sapiens
agauggacacgagccacaagcu

SEQ ID NO: 1901860 - RNA, 16 nt, Homo sapiens
aaguagcauuuacugu

SEQ ID NO: 1901861 - RNA, 22 nt, Homo sapiens
ccaucugagccgucagagcagu

SEQ ID NO: 1901862 - RNA, 21 nt, Homo sapiens
aagaguguguccacugagaag

SEQ ID NO: 1901863 - RNA, 21 nt, Homo sapiens
gacaauucccgggcccuucag

SEQ ID NO: 1901864 - RNA, 18 nt, Homo sapiens
ucuccugggccguuacau

SEQ ID NO: 1901865 - RNA, 21 nt, Homo sapiens
cauaacuaaauuugauacuua

SEQ ID NO: 1901866 - RNA, 15 nt, Homo sapiens
agagcgucauguccu

SEQ ID NO: 1901867 - RNA, 18 nt, Homo sapiens
gccccuggucaagugcug

SEQ ID NO: 1901868 - RNA, 20 nt, Homo sapiens
acugggguuggaagugcaga

SEQ ID NO: 1901869 - RNA, 13 nt, Homo sapiens
acagugacaguca

SEQ ID NO: 1901870 - RNA, 15 nt, Homo sapiens
acagugucugggcug

SEQ ID NO: 1901871 - RNA, 17 nt, Homo sapiens
agucagguucuuuacaa

SEQ ID NO: 1901872 - RNA, 20 nt, Homo sapiens
aaccagaccaaccgccugca

SEQ ID NO: 1901873 - RNA, 16 nt, Homo sapiens
augagcacaucucucu

SEQ ID NO: 1901874 - RNA, 18 nt, Homo sapiens
aaacagauuuaagcaaga

SEQ ID NO: 1901875 - RNA, 23 nt, Homo sapiens
gguuuagggaagacauugcaaug

SEQ ID NO: 1901876 - RNA, 15 nt, Homo sapiens
ucaaagggacugccg

SEQ ID NO: 1901877 - RNA, 19 nt, Homo sapiens
caauaaauaagugcauuug

SEQ ID NO: 1901878 - RNA, 19 nt, Homo sapiens
aaccuaaauugaacugcca

SEQ ID NO: 1901879 - RNA, 21 nt, Homo sapiens
uugcuuuccucugagauucua

SEQ ID NO: 1901880 - RNA, 23 nt, Homo sapiens
cacugggcucugaggaguggagu

SEQ ID NO: 1901881 - RNA, 18 nt, Homo sapiens
ugccagagagaccugcug

SEQ ID NO: 1901882 - RNA, 16 nt, Homo sapiens
cuugccaaucuuccag

SEQ ID NO: 1901883 - RNA, 18 nt, Homo sapiens
agacucaccaccuauucu

SEQ ID NO: 1901884 - RNA, 19 nt, Homo sapiens
gugacuuacagugccaaca

SEQ ID NO: 1901885 - RNA, 19 nt, Homo sapiens
uucagacuuuaaaauucua

SEQ ID NO: 1901886 - RNA, 22 nt, Homo sapiens
cccagccggccaauggaaaccu

SEQ ID NO: 1901887 - RNA, 18 nt, Homo sapiens
aauccccucccugugacc

SEQ ID NO: 1901888 - RNA, 21 nt, Homo sapiens
auccuuuagugcacccaguga

SEQ ID NO: 1901889 - RNA, 17 nt, Homo sapiens
uuccugauuccuuuaaa

SEQ ID NO: 1901890 - RNA, 11 nt, Homo sapiens
acucacugugu

SEQ ID NO: 1901891 - RNA, 21 nt, Homo sapiens
ucggccaggcuggagugcagu

SEQ ID NO: 1901892 - RNA, 21 nt, Homo sapiens
ucccaaacccagccucuagaa

SEQ ID NO: 1901893 - RNA, 18 nt, Homo sapiens
auaaacauuccuguugau

SEQ ID NO: 1901894 - RNA, 17 nt, Homo sapiens
ucaaaguucuaaugaca

SEQ ID NO: 1901895 - RNA, 12 nt, Homo sapiens
cuugccagagau

SEQ ID NO: 1901896 - RNA, 15 nt, Homo sapiens
aaagacaguauuuau

SEQ ID NO: 1901897 - RNA, 14 nt, Homo sapiens
uacauaaagacugu

SEQ ID NO: 1901898 - RNA, 16 nt, Homo sapiens
ccauccccaggcaccu

SEQ ID NO: 1901899 - RNA, 14 nt, Homo sapiens
ugggugcugucaug

SEQ ID NO: 1901900 - RNA, 19 nt, Homo sapiens
cagccccacuccacaguua

SEQ ID NO: 1901901 - RNA, 18 nt, Homo sapiens
uucuuccucuuaccugua

SEQ ID NO: 1901902 - RNA, 21 nt, Homo sapiens
cagaaaauaaaauauucacuc

SEQ ID NO: 1901903 - RNA, 15 nt, Homo sapiens
ucuaggaugugauga

SEQ ID NO: 1901904 - RNA, 21 nt, Homo sapiens
caucuaaaguaaaaagggaau

SEQ ID NO: 1901905 - RNA, 16 nt, Homo sapiens
aaugaccaauauuaua

SEQ ID NO: 1901906 - RNA, 19 nt, Homo sapiens
ucauuggaaauuuagcauu

SEQ ID NO: 1901907 - RNA, 15 nt, Homo sapiens
gcaacagaagcaaaa

SEQ ID NO: 1901908 - RNA, 12 nt, Homo sapiens
agguugcacagc

SEQ ID NO: 1901909 - RNA, 17 nt, Homo sapiens
aucucaaugaaccauaa

SEQ ID NO: 1901910 - RNA, 21 nt, Homo sapiens
cauucuauuccauguuugcac

SEQ ID NO: 1901911 - RNA, 20 nt, Homo sapiens
uaacagggagacugcaucuc

SEQ ID NO: 1901912 - RNA, 21 nt, Homo sapiens
aagcaacaguaaucuaugugu

SEQ ID NO: 1901913 - RNA, 20 nt, Homo sapiens
ugcuguuguugaaauugaug

SEQ ID NO: 1901914 - RNA, 14 nt, Homo sapiens
cagauuuguguuau

SEQ ID NO: 1901915 - RNA, 18 nt, Homo sapiens
gcagagggccuuugcuac

SEQ ID NO: 1901916 - RNA, 18 nt, Homo sapiens
gaugauggccauuucuaa

SEQ ID NO: 1901917 - RNA, 21 nt, Homo sapiens
auuagugccguuaucauggag

SEQ ID NO: 1901918 - RNA, 21 nt, Homo sapiens
uaaguuuuuccaaaaccucag

SEQ ID NO: 1901919 - RNA, 17 nt, Homo sapiens
gcaugaccuaucaguau

SEQ ID NO: 1901920 - RNA, 21 nt, Homo sapiens
uaccucaaccaaugccaaaaa

SEQ ID NO: 1901921 - RNA, 14 nt, Homo sapiens
cacaugaggccauc

SEQ ID NO: 1901922 - RNA, 16 nt, Homo sapiens
uuuguggucacagcca

SEQ ID NO: 1901923 - RNA, 14 nt, Homo sapiens
gaucucagccucug

SEQ ID NO: 1901924 - RNA, 22 nt, Homo sapiens
caaaugaccuuccaaguaagca

SEQ ID NO: 1901925 - RNA, 18 nt, Homo sapiens
auguccaaauacucugaa

SEQ ID NO: 1901926 - RNA, 22 nt, Homo sapiens
cucaacaagggagagaccucau

SEQ ID NO: 1901927 - RNA, 14 nt, Homo sapiens
auuuaaaacaauga

SEQ ID NO: 1901928 - RNA, 14 nt, Homo sapiens
aaaggaaacuugaa

SEQ ID NO: 1901929 - RNA, 19 nt, Homo sapiens
auaaacugcaaaugugcag

SEQ ID NO: 1901930 - RNA, 23 nt, Homo sapiens
gaauacucauucgucuacucuga

SEQ ID NO: 1901931 - RNA, 18 nt, Homo sapiens
uccaggaauuuuguguga

SEQ ID NO: 1901932 - RNA, 20 nt, Homo sapiens
ugaguuuuuccucccaguga

SEQ ID NO: 1901933 - RNA, 19 nt, Homo sapiens
cgcgcucgcccagcaggag

SEQ ID NO: 1901934 - RNA, 18 nt, Homo sapiens
gcugaacugacaaugaag

SEQ ID NO: 1901935 - RNA, 14 nt, Homo sapiens
cuuccuguuggaag

SEQ ID NO: 1901936 - RNA, 15 nt, Homo sapiens
uugaauuucagaaaa

SEQ ID NO: 1901937 - RNA, 21 nt, Homo sapiens
agacaccucccccuacccaua

SEQ ID NO: 1901938 - RNA, 13 nt, Homo sapiens
gcugaaaacuaca

SEQ ID NO: 1901939 - RNA, 21 nt, Homo sapiens
gaagguuagagguuugucaac

SEQ ID NO: 1901940 - RNA, 23 nt, Homo sapiens
gaccgccccucaccaacccagag

SEQ ID NO: 1901941 - RNA, 19 nt, Homo sapiens
ccagcagggaaaaugcagc

SEQ ID NO: 1901942 - RNA, 16 nt, Homo sapiens
aguucauauguaccau

SEQ ID NO: 1901943 - RNA, 16 nt, Homo sapiens
cauuugaaugcuuaau

SEQ ID NO: 1901944 - RNA, 22 nt, Homo sapiens
auucacagccaggagaugcugg

SEQ ID NO: 1901945 - RNA, 15 nt, Homo sapiens
aggaaagaugcauuu

SEQ ID NO: 1901946 - RNA, 20 nt, Homo sapiens
aaccaucucccuggugcuua

SEQ ID NO: 1901947 - RNA, 21 nt, Homo sapiens
uuuucaauaaugugaaugcua

SEQ ID NO: 1901948 - RNA, 22 nt, Homo sapiens
ucuuuauucuuagggcagucag

SEQ ID NO: 1901949 - RNA, 12 nt, Homo sapiens
ugguggggccaa

SEQ ID NO: 1901950 - RNA, 17 nt, Homo sapiens
gcaaucuucuacuuuaa

SEQ ID NO: 1901951 - RNA, 14 nt, Homo sapiens
auaaguguucagug

SEQ ID NO: 1901952 - RNA, 15 nt, Homo sapiens
uacaagguuauguag

SEQ ID NO: 1901953 - RNA, 13 nt, Homo sapiens
auauauggauaau

SEQ ID NO: 1901954 - RNA, 13 nt, Homo sapiens
cucaccaacccag

SEQ ID NO: 1901955 - RNA, 19 nt, Homo sapiens
ccuacccuuggugccuaau

SEQ ID NO: 1901956 - RNA, 20 nt, Homo sapiens
cacagccuucuaaauuccca

SEQ ID NO: 1901957 - RNA, 14 nt, Homo sapiens
auaccuaucaucuu

SEQ ID NO: 1901958 - RNA, 19 nt, Homo sapiens
cuuuaacugacuucugucc

SEQ ID NO: 1901959 - RNA, 15 nt, Homo sapiens
agggaaggcaaaggc

SEQ ID NO: 1901960 - RNA, 19 nt, Homo sapiens
cugcuucuacggccaugag

SEQ ID NO: 1901961 - RNA, 15 nt, Homo sapiens
uaagcaagagacaau

SEQ ID NO: 1901962 - RNA, 20 nt, Homo sapiens
gagaugcuggagaagagagg

SEQ ID NO: 1901963 - RNA, 15 nt, Homo sapiens
caagcauuuaaugua

SEQ ID NO: 1901964 - RNA, 22 nt, Homo sapiens
gaacucuucaucuuaaacuaca

SEQ ID NO: 1901965 - RNA, 16 nt, Homo sapiens
cgagagaggagccaga

SEQ ID NO: 1901966 - RNA, 15 nt, Homo sapiens
ugaaagcaguagcau

SEQ ID NO: 1901967 - RNA, 14 nt, Homo sapiens
ugugugaugucucc

SEQ ID NO: 1901968 - RNA, 19 nt, Homo sapiens
caucacagcaugugcaaua

SEQ ID NO: 1901969 - RNA, 20 nt, Homo sapiens
uuuggauauuuuuuggugug

SEQ ID NO: 1901970 - RNA, 17 nt, Homo sapiens
ugaaagccacagacaau

SEQ ID NO: 1901971 - RNA, 13 nt, Homo sapiens
uguuuucuuaugc

SEQ ID NO: 1901972 - RNA, 18 nt, Homo sapiens
augccuauaaaaugccca

SEQ ID NO: 1901973 - RNA, 15 nt, Homo sapiens
cacugaagagcucuu

SEQ ID NO: 1901974 - RNA, 21 nt, Homo sapiens
cagaugcugauguucagugua

SEQ ID NO: 1901975 - RNA, 15 nt, Homo sapiens
gaucugcaaacaaug

SEQ ID NO: 1901976 - RNA, 21 nt, Homo sapiens
guucucuucuuuaaagggaug

SEQ ID NO: 1901977 - RNA, 11 nt, Homo sapiens
auuuccauguu

SEQ ID NO: 1901978 - RNA, 12 nt, Homo sapiens
ugaccacagcag

SEQ ID NO: 1901979 - RNA, 20 nt, Homo sapiens
aaugccaaguaacaaugcau

SEQ ID NO: 1901980 - RNA, 17 nt, Homo sapiens
agcauugagcaaagggg

SEQ ID NO: 1901981 - RNA, 19 nt, Homo sapiens
aauaguauuuuauuucuca

SEQ ID NO: 1901982 - RNA, 13 nt, Homo sapiens
ucuuuaugaucug

SEQ ID NO: 1901983 - RNA, 16 nt, Homo sapiens
ggcagcuauccaguga

SEQ ID NO: 1901984 - RNA, 16 nt, Homo sapiens
aauguacucuugaacu

SEQ ID NO: 1901985 - RNA, 17 nt, Homo sapiens
ggaggaguuagccaaac

SEQ ID NO: 1901986 - RNA, 12 nt, Homo sapiens
augcauguugcc

SEQ ID NO: 1901987 - RNA, 16 nt, Homo sapiens
augaauguaugugcac

SEQ ID NO: 1901988 - RNA, 23 nt, Homo sapiens
ucauaccauccaucccuggugaa

SEQ ID NO: 1901989 - RNA, 16 nt, Homo sapiens
uuccaguuccacgaaa

SEQ ID NO: 1901990 - RNA, 16 nt, Homo sapiens
auaauucuacuuugag

SEQ ID NO: 1901991 - RNA, 19 nt, Homo sapiens
caaucugucagaacggugu

SEQ ID NO: 1901992 - RNA, 13 nt, Homo sapiens
aaguguacaguau

SEQ ID NO: 1901993 - RNA, 13 nt, Homo sapiens
uggauuacuauug

SEQ ID NO: 1901994 - RNA, 18 nt, Homo sapiens
cuggccccuucuccagca

SEQ ID NO: 1901995 - RNA, 13 nt, Homo sapiens
uugcauccauugu

SEQ ID NO: 1901996 - RNA, 15 nt, Homo sapiens
cagauuuucagcaaa

SEQ ID NO: 1901997 - RNA, 16 nt, Homo sapiens
auuuauuucauccagu

SEQ ID NO: 1901998 - RNA, 13 nt, Homo sapiens
ccaggcacucuca

SEQ ID NO: 1901999 - RNA, 14 nt, Homo sapiens
uuuaauuuauacug

SEQ ID NO: 1902000 - RNA, 14 nt, Homo sapiens
aguauuuuugacag

SEQ ID NO: 1902001 - RNA, 21 nt, Homo sapiens
uuuauucaggggaaacuugau

SEQ ID NO: 1902002 - RNA, 16 nt, Homo sapiens
gcugcggcacugugcc

SEQ ID NO: 1902003 - RNA, 10 nt, Homo sapiens
ugcacuccau

SEQ ID NO: 1902004 - RNA, 16 nt, Homo sapiens
uaugaacagaaaugca

SEQ ID NO: 1902005 - RNA, 17 nt, Homo sapiens
ugaguuuuauugacuca

SEQ ID NO: 1902006 - RNA, 13 nt, Homo sapiens
guaagaagagcca

SEQ ID NO: 1902007 - RNA, 22 nt, Homo sapiens
gcaucacuuaacggaccaaagc

SEQ ID NO: 1902008 - RNA, 19 nt, Homo sapiens
uaauauccaauugcugcuu

SEQ ID NO: 1902009 - RNA, 16 nt, Homo sapiens
aagccuccaccugcag

SEQ ID NO: 1902010 - RNA, 11 nt, Homo sapiens
aagaaccaaaa

SEQ ID NO: 1902011 - RNA, 11 nt, Homo sapiens
cagaaccacaa

SEQ ID NO: 1902012 - RNA, 12 nt, Homo sapiens
caugguacaaac

SEQ ID NO: 1902013 - RNA, 14 nt, Homo sapiens
ugauaacaccagug

SEQ ID NO: 1902014 - RNA, 16 nt, Homo sapiens
ccagcccccugaccac

SEQ ID NO: 1902015 - RNA, 23 nt, Homo sapiens
auuuggaagccacucaccacugu

SEQ ID NO: 1902016 - RNA, 19 nt, Homo sapiens
gccugcccugcuauuucag

SEQ ID NO: 1902017 - RNA, 18 nt, Homo sapiens
uaaauccuuugcuucauu

SEQ ID NO: 1902018 - RNA, 15 nt, Homo sapiens
agcugauaacauuuu

SEQ ID NO: 1902019 - RNA, 19 nt, Homo sapiens
ccuuaauuauuaacaaagu

SEQ ID NO: 1902020 - RNA, 12 nt, Homo sapiens
caacgugaugcu

SEQ ID NO: 1902021 - RNA, 13 nt, Homo sapiens
gcagugguuugaa

SEQ ID NO: 1902022 - RNA, 20 nt, Homo sapiens
ggccuugaagaggcaggucu

SEQ ID NO: 1902023 - RNA, 11 nt, Homo sapiens
cugacaugucc

SEQ ID NO: 1902024 - RNA, 21 nt, Homo sapiens
ucuuggccaucuaaacaucau

SEQ ID NO: 1902025 - RNA, 22 nt, Homo sapiens
cuaacgauaaaagguaauaaca

SEQ ID NO: 1902026 - RNA, 22 nt, Homo sapiens
uaaaacucucaagcagacguga

SEQ ID NO: 1902027 - RNA, 17 nt, Homo sapiens
cauauugugauucugcc

SEQ ID NO: 1902028 - RNA, 14 nt, Homo sapiens
uaauaaaacaaugu

SEQ ID NO: 1902029 - RNA, 20 nt, Homo sapiens
uccuguccuuuuaacaccuu

SEQ ID NO: 1902030 - RNA, 17 nt, Homo sapiens
cauugcaaacagaaggu

SEQ ID NO: 1902031 - RNA, 15 nt, Homo sapiens
gcaacuuccuuugac

SEQ ID NO: 1902032 - RNA, 17 nt, Homo sapiens
cccagccuucuccagga

SEQ ID NO: 1902033 - RNA, 22 nt, Homo sapiens
cuagccaugauaacugcaauuu

SEQ ID NO: 1902034 - RNA, 21 nt, Homo sapiens
aauuacuggcaaaaacaaaac

SEQ ID NO: 1902035 - RNA, 21 nt, Homo sapiens
ucaucuauuuuuggcagucug

SEQ ID NO: 1902036 - RNA, 23 nt, Homo sapiens
cagguguaguuacaucucagugc

SEQ ID NO: 1902037 - RNA, 21 nt, Homo sapiens
agugcugggauuauaggcaug

SEQ ID NO: 1902038 - RNA, 17 nt, Homo sapiens
accaugcgcugcucaac

SEQ ID NO: 1902039 - RNA, 21 nt, Homo sapiens
uuuaaaagccaucaaacacaa

SEQ ID NO: 1902040 - RNA, 16 nt, Homo sapiens
gugggguccccuccag

SEQ ID NO: 1902041 - RNA, 20 nt, Homo sapiens
agaacagggcuauuugaaga

SEQ ID NO: 1902042 - RNA, 19 nt, Homo sapiens
gcuaacacacagcucccau

SEQ ID NO: 1902043 - RNA, 21 nt, Homo sapiens
ucccagggcuggcccuaggca

SEQ ID NO: 1902044 - RNA, 17 nt, Homo sapiens
caaaaucagccaaagca

SEQ ID NO: 1902045 - RNA, 12 nt, Homo sapiens
gagucacugccu

SEQ ID NO: 1902046 - RNA, 14 nt, Homo sapiens
caauuucuauuaaa

SEQ ID NO: 1902047 - RNA, 21 nt, Homo sapiens
ucucaaagcauaaaauggaau

SEQ ID NO: 1902048 - RNA, 17 nt, Homo sapiens
gcuccagcaacugcccu

SEQ ID NO: 1902049 - RNA, 20 nt, Homo sapiens
ugccccuccaagucacaaag

SEQ ID NO: 1902050 - RNA, 18 nt, Homo sapiens
aggccgggcacaguggcu

SEQ ID NO: 1902051 - RNA, 17 nt, Homo sapiens
uaguuaggauauugauu

SEQ ID NO: 1902052 - RNA, 14 nt, Homo sapiens
cugauaggacuuaa

SEQ ID NO: 1902053 - RNA, 17 nt, Homo sapiens
ccacgauucucccaaag

SEQ ID NO: 1902054 - RNA, 12 nt, Homo sapiens
guuccucaaaag

SEQ ID NO: 1902055 - RNA, 17 nt, Homo sapiens
ccuuuuuuuaaguagua

SEQ ID NO: 1902056 - RNA, 20 nt, Homo sapiens
aagugagacccugucucaaa

SEQ ID NO: 1902057 - RNA, 21 nt, Homo sapiens
auuaaaggggcugucucccaa

SEQ ID NO: 1902058 - RNA, 15 nt, Homo sapiens
gccuaaaugccuuag

SEQ ID NO: 1902059 - RNA, 22 nt, Homo sapiens
ccuguguaaaacuauauucuca

SEQ ID NO: 1902060 - RNA, 14 nt, Homo sapiens
gacaugcauucaca

SEQ ID NO: 1902061 - RNA, 18 nt, Homo sapiens
caucugaguuagguucca

SEQ ID NO: 1902062 - RNA, 19 nt, Homo sapiens
ccuuggcuuuaugcaaaua

SEQ ID NO: 1902063 - RNA, 19 nt, Homo sapiens
caucucaaacacugcuuaa

SEQ ID NO: 1902064 - RNA, 22 nt, Homo sapiens
aucccgacucugauaccuucug

SEQ ID NO: 1902065 - RNA, 21 nt, Homo sapiens
cagcccauggcccugugcuaa

SEQ ID NO: 1902066 - RNA, 15 nt, Homo sapiens
aaacuguacuuugau

SEQ ID NO: 1902067 - RNA, 16 nt, Homo sapiens
caagggagguaaggga

SEQ ID NO: 1902068 - RNA, 20 nt, Homo sapiens
cuaacaacaaaguuccacuu

SEQ ID NO: 1902069 - RNA, 21 nt, Homo sapiens
ucaaauuugccaugacauuuc

SEQ ID NO: 1902070 - RNA, 15 nt, Homo sapiens
uccucaaguacucaa

SEQ ID NO: 1902071 - RNA, 15 nt, Homo sapiens
uucaauaaagcauuu

SEQ ID NO: 1902072 - RNA, 16 nt, Homo sapiens
uccgagucaagugauu

SEQ ID NO: 1902073 - RNA, 22 nt, Homo sapiens
uagaacagucucuugaggcaca

SEQ ID NO: 1902074 - RNA, 21 nt, Homo sapiens
guuuacaaaauauucguggua

SEQ ID NO: 1902075 - RNA, 19 nt, Homo sapiens
cacaauaaauggcuguaaa

SEQ ID NO: 1902076 - RNA, 19 nt, Homo sapiens
aaucucuuuucuacauaca

SEQ ID NO: 1902077 - RNA, 12 nt, Homo sapiens
auguccaaagag

SEQ ID NO: 1902078 - RNA, 14 nt, Homo sapiens
gaacuugaagcuaa

SEQ ID NO: 1902079 - RNA, 14 nt, Homo sapiens
gaauuagaagccau

SEQ ID NO: 1902080 - RNA, 13 nt, Homo sapiens
cagguauaccuca

SEQ ID NO: 1902081 - RNA, 20 nt, Homo sapiens
acuaauuuaaguacuugaga

SEQ ID NO: 1902082 - RNA, 17 nt, Homo sapiens
aggcagugggucuuccc

SEQ ID NO: 1902083 - RNA, 19 nt, Homo sapiens
gaagugguuuaaaccaaac

SEQ ID NO: 1902084 - RNA, 15 nt, Homo sapiens
agacagaaucucagu

SEQ ID NO: 1902085 - RNA, 16 nt, Homo sapiens
agccugccucuuccag

SEQ ID NO: 1902086 - RNA, 17 nt, Homo sapiens
aaacuaaggaacccugg

SEQ ID NO: 1902087 - RNA, 20 nt, Homo sapiens
ggaggagaagaaaauguucu

SEQ ID NO: 1902088 - RNA, 14 nt, Homo sapiens
aagccugugcaggu

SEQ ID NO: 1902089 - RNA, 13 nt, Homo sapiens
ccauccaccaccu

SEQ ID NO: 1902090 - RNA, 17 nt, Homo sapiens
aguaaaugguaucauuu

SEQ ID NO: 1902091 - RNA, 18 nt, Homo sapiens
aaacaaugaaaacucuuu

SEQ ID NO: 1902092 - RNA, 17 nt, Homo sapiens
uaaaaaccugaacuuuc

SEQ ID NO: 1902093 - RNA, 20 nt, Homo sapiens
ugaagacuuuuaaguuuccu

SEQ ID NO: 1902094 - RNA, 13 nt, Homo sapiens
ucaaaugugcauu

SEQ ID NO: 1902095 - RNA, 20 nt, Homo sapiens
acuaugguuuucauuuacuc

SEQ ID NO: 1902096 - RNA, 15 nt, Homo sapiens
ucaccucugccuugg

SEQ ID NO: 1902097 - RNA, 19 nt, Homo sapiens
gaucagccugggcaaugug

SEQ ID NO: 1902098 - RNA, 22 nt, Homo sapiens
cuggaauuauucuaugucaaug

SEQ ID NO: 1902099 - RNA, 22 nt, Homo sapiens
agcccagggcuccugcacuuac

SEQ ID NO: 1902100 - RNA, 16 nt, Homo sapiens
ugcuugggaagacucc

SEQ ID NO: 1902101 - RNA, 18 nt, Homo sapiens
cagcuggggccggagccu

SEQ ID NO: 1902102 - RNA, 13 nt, Homo sapiens
ucugucuggcuga

SEQ ID NO: 1902103 - RNA, 16 nt, Homo sapiens
uugugagccuaugaua

SEQ ID NO: 1902104 - RNA, 22 nt, Homo sapiens
aauugauuuuccuuugugcaug

SEQ ID NO: 1902105 - RNA, 19 nt, Homo sapiens
acuacucucuacucuguua

SEQ ID NO: 1902106 - RNA, 12 nt, Homo sapiens
ccagggacuaag

SEQ ID NO: 1902107 - RNA, 12 nt, Homo sapiens
ucagggaccaag

SEQ ID NO: 1902108 - RNA, 15 nt, Homo sapiens
ggaauugcaugccau

SEQ ID NO: 1902109 - RNA, 16 nt, Homo sapiens
uuugauucagcaaaaa

SEQ ID NO: 1902110 - RNA, 15 nt, Homo sapiens
aacuuguauuuccaa

SEQ ID NO: 1902111 - RNA, 13 nt, Homo sapiens
ccucacuuuacau

SEQ ID NO: 1902112 - RNA, 15 nt, Homo sapiens
ucacuuccccacagg

SEQ ID NO: 1902113 - RNA, 17 nt, Homo sapiens
guccaggaauggugcuu

SEQ ID NO: 1902114 - RNA, 16 nt, Homo sapiens
gaggcuaccucaccug

SEQ ID NO: 1902115 - RNA, 23 nt, Homo sapiens
cucgguggccaugcuucuugccc

SEQ ID NO: 1902116 - RNA, 16 nt, Homo sapiens
agggugccuucuagcu

SEQ ID NO: 1902117 - RNA, 18 nt, Homo sapiens
guggcugcacaggcacug

SEQ ID NO: 1902118 - RNA, 22 nt, Homo sapiens
cacauuaucaguugacagugua

SEQ ID NO: 1902119 - RNA, 13 nt, Homo sapiens
cuagcugugucag

SEQ ID NO: 1902120 - RNA, 12 nt, Homo sapiens
uuacuacuguac

SEQ ID NO: 1902121 - RNA, 15 nt, Homo sapiens
uauucccaugcauuu

SEQ ID NO: 1902122 - RNA, 19 nt, Homo sapiens
aagagggaaacucuggaga

SEQ ID NO: 1902123 - RNA, 21 nt, Homo sapiens
aguacguguuauuuuuuucaa

SEQ ID NO: 1902124 - RNA, 17 nt, Homo sapiens
agacacagcuaccucug

SEQ ID NO: 1902125 - RNA, 21 nt, Homo sapiens
aaguccucuggauugagauac

SEQ ID NO: 1902126 - RNA, 19 nt, Homo sapiens
uaaaaauauagcaaaugca

SEQ ID NO: 1902127 - RNA, 18 nt, Homo sapiens
uccucaccuuaauuuauu

SEQ ID NO: 1902128 - RNA, 23 nt, Homo sapiens
gucaagugaggugacacuccagu

SEQ ID NO: 1902129 - RNA, 20 nt, Homo sapiens
ccaauuagacaaacagcauc

SEQ ID NO: 1902130 - RNA, 18 nt, Homo sapiens
cauguucagucacaugug

SEQ ID NO: 1902131 - RNA, 13 nt, Homo sapiens
caauuagcuccuc

SEQ ID NO: 1902132 - RNA, 15 nt, Homo sapiens
uucugcaaugacugc

SEQ ID NO: 1902133 - RNA, 23 nt, Homo sapiens
aauauguuucucccccuuuccaa

SEQ ID NO: 1902134 - RNA, 15 nt, Homo sapiens
auaaccaaaaggagc

SEQ ID NO: 1902135 - RNA, 20 nt, Homo sapiens
ggcacccagccucuagggac

SEQ ID NO: 1902136 - RNA, 22 nt, Homo sapiens
caggauacaggugacagugaag

SEQ ID NO: 1902137 - RNA, 21 nt, Homo sapiens
gcgauuucacaguuggcacuu

SEQ ID NO: 1902138 - RNA, 23 nt, Homo sapiens
ggcugcccaccuggcugccaaca

SEQ ID NO: 1902139 - RNA, 21 nt, Homo sapiens
aggauucugggaaucaugucc

SEQ ID NO: 1902140 - RNA, 16 nt, Homo sapiens
ucucuuugcuucacag

SEQ ID NO: 1902141 - RNA, 20 nt, Homo sapiens
cuucagcacaaagacacaga

SEQ ID NO: 1902142 - RNA, 20 nt, Homo sapiens
uggaagaaggaaacaccgag

SEQ ID NO: 1902143 - RNA, 21 nt, Homo sapiens
ugauaagaguguaacauccag

SEQ ID NO: 1902144 - RNA, 15 nt, Homo sapiens
uauggcucaccuuau

SEQ ID NO: 1902145 - RNA, 22 nt, Homo sapiens
gaacuuguuucucaccucccac

SEQ ID NO: 1902146 - RNA, 20 nt, Homo sapiens
uuaucaaaaaguacaauaau

SEQ ID NO: 1902147 - RNA, 13 nt, Homo sapiens
ugggagagccaga

SEQ ID NO: 1902148 - RNA, 17 nt, Homo sapiens
aucucucccacucugcc

SEQ ID NO: 1902149 - RNA, 19 nt, Homo sapiens
aauauuuguauacacauaa

SEQ ID NO: 1902150 - RNA, 23 nt, Homo sapiens
ucugaagucacaucacaggacac

SEQ ID NO: 1902151 - RNA, 18 nt, Homo sapiens
gauccuaguaauugccua

SEQ ID NO: 1902152 - RNA, 16 nt, Homo sapiens
uauauuuuuacuucuu

SEQ ID NO: 1902153 - RNA, 23 nt, Homo sapiens
gacagcuuccucgaugggacccg

SEQ ID NO: 1902154 - RNA, 17 nt, Homo sapiens
uucucagccacaaaaua

SEQ ID NO: 1902155 - RNA, 21 nt, Homo sapiens
uagcugggccaacuccaguga

SEQ ID NO: 1902156 - RNA, 14 nt, Homo sapiens
cagugugcaaggca

SEQ ID NO: 1902157 - RNA, 12 nt, Homo sapiens
aaagacugccug

SEQ ID NO: 1902158 - RNA, 12 nt, Homo sapiens
cauaacugacaa

SEQ ID NO: 1902159 - RNA, 22 nt, Homo sapiens
cuugucauuuuuaauauuacug

SEQ ID NO: 1902160 - RNA, 14 nt, Homo sapiens
caaacauuuaccaa

SEQ ID NO: 1902161 - RNA, 14 nt, Homo sapiens
uggcccuguuuacg

SEQ ID NO: 1902162 - RNA, 13 nt, Homo sapiens
gccgaccuuagau

SEQ ID NO: 1902163 - RNA, 18 nt, Homo sapiens
ugaaggcagcagaauauu

SEQ ID NO: 1902164 - RNA, 21 nt, Homo sapiens
caucuggucuuguuuccagga

SEQ ID NO: 1902165 - RNA, 21 nt, Homo sapiens
auuuuuuuuuuuaagcucaaa

SEQ ID NO: 1902166 - RNA, 23 nt, Homo sapiens
cguguggcucacgugugugacuc

SEQ ID NO: 1902167 - RNA, 23 nt, Homo sapiens
uuacaaaacaaacucauucauua

SEQ ID NO: 1902168 - RNA, 14 nt, Homo sapiens
uggaaucacagcca

SEQ ID NO: 1902169 - RNA, 20 nt, Homo sapiens
ucaucaucccaggggagaac

SEQ ID NO: 1902170 - RNA, 18 nt, Homo sapiens
aucuauaguucacugaca

SEQ ID NO: 1902171 - RNA, 15 nt, Homo sapiens
uuuaaaugauguuga

SEQ ID NO: 1902172 - RNA, 22 nt, Homo sapiens
ugaagggggccacagccugggu

SEQ ID NO: 1902173 - RNA, 16 nt, Homo sapiens
uguggccugccuucac

SEQ ID NO: 1902174 - RNA, 14 nt, Homo sapiens
caccacgcccagcu

SEQ ID NO: 1902175 - RNA, 18 nt, Homo sapiens
uacgcuauccaguugcag

SEQ ID NO: 1902176 - RNA, 23 nt, Homo sapiens
cacuugcuccccgugagcacugc

SEQ ID NO: 1902177 - RNA, 20 nt, Homo sapiens
agccaaguucacaccacugc

SEQ ID NO: 1902178 - RNA, 18 nt, Homo sapiens
aaggcaaagagaccacuc

SEQ ID NO: 1902179 - RNA, 18 nt, Homo sapiens
acuaaucuuaacccugug

SEQ ID NO: 1902180 - RNA, 21 nt, Homo sapiens
cuuuggagcagcuucugggac

SEQ ID NO: 1902181 - RNA, 20 nt, Homo sapiens
auaacuggguuggcucucaa

SEQ ID NO: 1902182 - RNA, 21 nt, Homo sapiens
caauguucuuugucucaaaau

SEQ ID NO: 1902183 - RNA, 18 nt, Homo sapiens
agaaguuaacuacagugu

SEQ ID NO: 1902184 - RNA, 20 nt, Homo sapiens
uaacagaugcaaugugcuac

SEQ ID NO: 1902185 - RNA, 16 nt, Homo sapiens
cucccgccacauuuua

SEQ ID NO: 1902186 - RNA, 18 nt, Homo sapiens
ccucaguggcucugggua

SEQ ID NO: 1902187 - RNA, 20 nt, Homo sapiens
cuauggcacccaugcaccuu

SEQ ID NO: 1902188 - RNA, 20 nt, Homo sapiens
uuauuuauccuaguauuccu

SEQ ID NO: 1902189 - RNA, 14 nt, Homo sapiens
gcaggaacacugga

SEQ ID NO: 1902190 - RNA, 14 nt, Homo sapiens
guauauacauuuau

SEQ ID NO: 1902191 - RNA, 14 nt, Homo sapiens
gcuugcacacaugc

SEQ ID NO: 1902192 - RNA, 17 nt, Homo sapiens
uuagaagaaaaaucugc

SEQ ID NO: 1902193 - RNA, 16 nt, Homo sapiens
acccugcgauuuugcc

SEQ ID NO: 1902194 - RNA, 18 nt, Homo sapiens
uaggaggaacagguuuaa

SEQ ID NO: 1902195 - RNA, 24 nt, Homo sapiens
agacaggaaaguuccagaaacuuu

SEQ ID NO: 1902196 - RNA, 22 nt, Homo sapiens
acaggagaaugggguuccugcu

SEQ ID NO: 1902197 - RNA, 14 nt, Homo sapiens
ucuaaauaugaagg

SEQ ID NO: 1902198 - RNA, 17 nt, Homo sapiens
ggaucuuuuggaccugg

SEQ ID NO: 1902199 - RNA, 15 nt, Homo sapiens
ucucaacaguucauu

SEQ ID NO: 1902200 - RNA, 14 nt, Homo sapiens
accggcgcgcucuu

SEQ ID NO: 1902201 - RNA, 19 nt, Homo sapiens
uuuaauuuugugaaucuau

SEQ ID NO: 1902202 - RNA, 20 nt, Homo sapiens
ucugcccuuauggagcucac

SEQ ID NO: 1902203 - RNA, 18 nt, Homo sapiens
cugagacuggaaauauga

SEQ ID NO: 1902204 - RNA, 16 nt, Homo sapiens
augagaagaagcacga

SEQ ID NO: 1902205 - RNA, 20 nt, Homo sapiens
cuuggucuaugugcucugua

SEQ ID NO: 1902206 - RNA, 21 nt, Homo sapiens
agaugaguaauuucuuuggca

SEQ ID NO: 1902207 - RNA, 20 nt, Homo sapiens
aagucccugucauuugaacc

SEQ ID NO: 1902208 - RNA, 14 nt, Homo sapiens
aauaacaguauuuu

SEQ ID NO: 1902209 - RNA, 22 nt, Homo sapiens
agagaccugagucugcaugugc

SEQ ID NO: 1902210 - RNA, 20 nt, Homo sapiens
acaguauguuacaugcauuc

SEQ ID NO: 1902211 - RNA, 20 nt, Homo sapiens
acuccaagugccccaccacu

SEQ ID NO: 1902212 - RNA, 14 nt, Homo sapiens
ugcaugaugacucu

SEQ ID NO: 1902213 - RNA, 13 nt, Homo sapiens
ugagauacuuugc

SEQ ID NO: 1902214 - RNA, 18 nt, Homo sapiens
cuaaaagcuuucaugucc

SEQ ID NO: 1902215 - RNA, 17 nt, Homo sapiens
aucucuccuccaagaca

SEQ ID NO: 1902216 - RNA, 23 nt, Homo sapiens
cacuguaaauaugaaucugcuca

SEQ ID NO: 1902217 - RNA, 22 nt, Homo sapiens
gcccuuguugucucugucucuc

SEQ ID NO: 1902218 - RNA, 13 nt, Homo sapiens
uuaaagcuguuau

SEQ ID NO: 1902219 - RNA, 11 nt, Homo sapiens
augugaugaau

SEQ ID NO: 1902220 - RNA, 15 nt, Homo sapiens
ccaucuuuugugaga

SEQ ID NO: 1902221 - RNA, 21 nt, Homo sapiens
gaagcuuacaugccuaccaau

SEQ ID NO: 1902222 - RNA, 20 nt, Homo sapiens
aaguuccccuuauguggguu

SEQ ID NO: 1902223 - RNA, 10 nt, Homo sapiens
uccggcucua

SEQ ID NO: 1902224 - RNA, 15 nt, Homo sapiens
cagccucaguccucc

SEQ ID NO: 1902225 - RNA, 15 nt, Homo sapiens
gaccucuacugccuu

SEQ ID NO: 1902226 - RNA, 16 nt, Homo sapiens
uuagaaaaguggugua

SEQ ID NO: 1902227 - RNA, 17 nt, Homo sapiens
ccaacgagcuguacaug

SEQ ID NO: 1902228 - RNA, 18 nt, Homo sapiens
cccauuucuuaaucagug

SEQ ID NO: 1902229 - RNA, 14 nt, Homo sapiens
cucuuuaacaucuu

SEQ ID NO: 1902230 - RNA, 23 nt, Homo sapiens
cuuaaggcuugaaguaaccuuau

SEQ ID NO: 1902231 - RNA, 19 nt, Homo sapiens
agaauuaaaacuaugaaau

SEQ ID NO: 1902232 - RNA, 20 nt, Homo sapiens
ggaacacuggaacauuccag

SEQ ID NO: 1902233 - RNA, 19 nt, Homo sapiens
gccuugggaagaagugauu

SEQ ID NO: 1902234 - RNA, 20 nt, Homo sapiens
aaugcuuuaacagcugauaa

SEQ ID NO: 1902235 - RNA, 17 nt, Homo sapiens
auauguaaguacuucca

SEQ ID NO: 1902236 - RNA, 20 nt, Homo sapiens
guuuauuauaaacaaaaagc

SEQ ID NO: 1902237 - RNA, 21 nt, Homo sapiens
ucauauugcuucucccuuuag

SEQ ID NO: 1902238 - RNA, 15 nt, Homo sapiens
ugcacuguaauaugu

SEQ ID NO: 1902239 - RNA, 16 nt, Homo sapiens
ggcuuccagaaggcag

SEQ ID NO: 1902240 - RNA, 20 nt, Homo sapiens
cacauauauaccaagccccu

SEQ ID NO: 1902241 - RNA, 19 nt, Homo sapiens
ugugcauuucugugauguu

SEQ ID NO: 1902242 - RNA, 17 nt, Homo sapiens
cauguugcuaaugacag

SEQ ID NO: 1902243 - RNA, 14 nt, Homo sapiens
ugggaaaacccagg

SEQ ID NO: 1902244 - RNA, 18 nt, Homo sapiens
agggggccuccaggagac

SEQ ID NO: 1902245 - RNA, 15 nt, Homo sapiens
cacauggccuaugca

SEQ ID NO: 1902246 - RNA, 20 nt, Homo sapiens
auggaaagaaucuaauagag

SEQ ID NO: 1902247 - RNA, 16 nt, Homo sapiens
cauuugcucauggaau

SEQ ID NO: 1902248 - RNA, 23 nt, Homo sapiens
gacucuccagaaagcucaucuca

SEQ ID NO: 1902249 - RNA, 18 nt, Homo sapiens
uuacacuugguuacucaa

SEQ ID NO: 1902250 - RNA, 22 nt, Homo sapiens
cggccccaccugccucugccca

SEQ ID NO: 1902251 - RNA, 15 nt, Homo sapiens
ccugguggucaggga

SEQ ID NO: 1902252 - RNA, 19 nt, Homo sapiens
aucaggagcugcucaggcu

SEQ ID NO: 1902253 - RNA, 22 nt, Homo sapiens
ccuagacucuguaaccaccucu

SEQ ID NO: 1902254 - RNA, 17 nt, Homo sapiens
gagaacaacaugggagc

SEQ ID NO: 1902255 - RNA, 20 nt, Homo sapiens
uuaccuguuuucgcaccuac

SEQ ID NO: 1902256 - RNA, 19 nt, Homo sapiens
ggcugaauagcacagguga

SEQ ID NO: 1902257 - RNA, 12 nt, Homo sapiens
agaacacccacu

SEQ ID NO: 1902258 - RNA, 23 nt, Homo sapiens
caaucuuaaaacagaaaggugca

SEQ ID NO: 1902259 - RNA, 21 nt, Homo sapiens
gcuugagcaaccuggcuaaga

SEQ ID NO: 1902260 - RNA, 17 nt, Homo sapiens
caauugucgaaaagagu

SEQ ID NO: 1902261 - RNA, 19 nt, Homo sapiens
uccccauuagcuuucaauu

SEQ ID NO: 1902262 - RNA, 18 nt, Homo sapiens
gcuaccaacuuguaucca

SEQ ID NO: 1902263 - RNA, 16 nt, Homo sapiens
acucaauggaguaugu

SEQ ID NO: 1902264 - RNA, 16 nt, Homo sapiens
aagaaaaaucucauua

SEQ ID NO: 1902265 - RNA, 20 nt, Homo sapiens
cuuaauucuguuacacaaua

SEQ ID NO: 1902266 - RNA, 20 nt, Homo sapiens
cuggguugaagggcaguguu

SEQ ID NO: 1902267 - RNA, 21 nt, Homo sapiens
cauugcugugugaauccagga

SEQ ID NO: 1902268 - RNA, 17 nt, Homo sapiens
gugggagagacugugag

SEQ ID NO: 1902269 - RNA, 23 nt, Homo sapiens
gaguauggauugaaggauuguga

SEQ ID NO: 1902270 - RNA, 19 nt, Homo sapiens
acccaaguuggagugcagu

SEQ ID NO: 1902271 - RNA, 15 nt, Homo sapiens
aucuaagcagcauuu

SEQ ID NO: 1902272 - RNA, 12 nt, Homo sapiens
gaaaauccagaa

SEQ ID NO: 1902273 - RNA, 13 nt, Homo sapiens
aaucauaaauauu

SEQ ID NO: 1902274 - RNA, 22 nt, Homo sapiens
cuuuauccuaaagauuauuacc

SEQ ID NO: 1902275 - RNA, 18 nt, Homo sapiens
cuaggaggucaucaaccg

SEQ ID NO: 1902276 - RNA, 23 nt, Homo sapiens
ucucaagaagaacaucuuuaugg

SEQ ID NO: 1902277 - RNA, 13 nt, Homo sapiens
cugccaaggccag

SEQ ID NO: 1902278 - RNA, 19 nt, Homo sapiens
ggcucaaacaacauuccac

SEQ ID NO: 1902279 - RNA, 15 nt, Homo sapiens
aucugacucucgcug

SEQ ID NO: 1902280 - RNA, 23 nt, Homo sapiens
ugcucuuugauucaaagcacugu

SEQ ID NO: 1902281 - RNA, 14 nt, Homo sapiens
gccucccaccacuc

SEQ ID NO: 1902282 - RNA, 21 nt, Homo sapiens
uaauugggaaaaaagcaacug

SEQ ID NO: 1902283 - RNA, 15 nt, Homo sapiens
ucucucaugccuccu

SEQ ID NO: 1902284 - RNA, 16 nt, Homo sapiens
cucaauuuuugucuca

SEQ ID NO: 1902285 - RNA, 18 nt, Homo sapiens
acucugucuggccaggga

SEQ ID NO: 1902286 - RNA, 19 nt, Homo sapiens
ucccugacgguggaauuua

SEQ ID NO: 1902287 - RNA, 21 nt, Homo sapiens
acuauguuaaugaguauguaa

SEQ ID NO: 1902288 - RNA, 16 nt, Homo sapiens
ugcugugaaauuccca

SEQ ID NO: 1902289 - RNA, 21 nt, Homo sapiens
uaguaccugaaaaaaugccaa

SEQ ID NO: 1902290 - RNA, 22 nt, Homo sapiens
uaucuucagcccaggcuuuugc

SEQ ID NO: 1902291 - RNA, 14 nt, Homo sapiens
ccugcaccaugcug

SEQ ID NO: 1902292 - RNA, 21 nt, Homo sapiens
cgcugugugguaacucagugu

SEQ ID NO: 1902293 - RNA, 17 nt, Homo sapiens
aaugcacaguacuguuu

SEQ ID NO: 1902294 - RNA, 17 nt, Homo sapiens
ugaccuuccaaaccuca

SEQ ID NO: 1902295 - RNA, 13 nt, Homo sapiens
guaguacuugaaa

SEQ ID NO: 1902296 - RNA, 17 nt, Homo sapiens
caggggacgugggcccu

SEQ ID NO: 1902297 - RNA, 21 nt, Homo sapiens
agaagugggugggcacacuga

SEQ ID NO: 1902298 - RNA, 17 nt, Homo sapiens
aggcacaagaaucacuu

SEQ ID NO: 1902299 - RNA, 16 nt, Homo sapiens
uauugcauacuauuaa

SEQ ID NO: 1902300 - RNA, 13 nt, Homo sapiens
acuugacauuccu

SEQ ID NO: 1902301 - RNA, 18 nt, Homo sapiens
auuuuauuuaauccccac

SEQ ID NO: 1902302 - RNA, 21 nt, Homo sapiens
auaaaguaugguauugaaacu

SEQ ID NO: 1902303 - RNA, 22 nt, Homo sapiens
guugcccuagcccagacucuga

SEQ ID NO: 1902304 - RNA, 23 nt, Homo sapiens
ggaaaauauuuugaucuucaaca

SEQ ID NO: 1902305 - RNA, 23 nt, Homo sapiens
uucccucgggacccucccaguga

SEQ ID NO: 1902306 - RNA, 18 nt, Homo sapiens
aaguacauguuaaacuua

SEQ ID NO: 1902307 - RNA, 16 nt, Homo sapiens
gccaucucuuccucau

SEQ ID NO: 1902308 - RNA, 19 nt, Homo sapiens
cuugucacugacacaaagg

SEQ ID NO: 1902309 - RNA, 17 nt, Homo sapiens
ggaaugcaauccuuccc

SEQ ID NO: 1902310 - RNA, 22 nt, Homo sapiens
cauguggaaaaaaaaaagaugu

SEQ ID NO: 1902311 - RNA, 19 nt, Homo sapiens
guuauauuaaaaacauaga

SEQ ID NO: 1902312 - RNA, 18 nt, Homo sapiens
cacuagggcagccgagug

SEQ ID NO: 1902313 - RNA, 14 nt, Homo sapiens
ccuggugagacugu

SEQ ID NO: 1902314 - RNA, 18 nt, Homo sapiens
uguugacuggccaaaaau

SEQ ID NO: 1902315 - RNA, 18 nt, Homo sapiens
ucucaacaaccugaaugu

SEQ ID NO: 1902316 - RNA, 22 nt, Homo sapiens
cucagguccgcccgaccaggau

SEQ ID NO: 1902317 - RNA, 17 nt, Homo sapiens
cuaucguuauuauaaau

SEQ ID NO: 1902318 - RNA, 17 nt, Homo sapiens
acccugggagacagacc

SEQ ID NO: 1902319 - RNA, 13 nt, Homo sapiens
cgcacacacagau

SEQ ID NO: 1902320 - RNA, 20 nt, Homo sapiens
uguggaccucuacuuuccag

SEQ ID NO: 1902321 - RNA, 16 nt, Homo sapiens
gaccuguguuucacuu

SEQ ID NO: 1902322 - RNA, 15 nt, Homo sapiens
uguuagcacuguuga

SEQ ID NO: 1902323 - RNA, 17 nt, Homo sapiens
cugaggccaucagggcc

SEQ ID NO: 1902324 - RNA, 15 nt, Homo sapiens
uuuuagaaaugagau

SEQ ID NO: 1902325 - RNA, 21 nt, Homo sapiens
uugaucuuuugcuaaugcaau

SEQ ID NO: 1902326 - RNA, 17 nt, Homo sapiens
acuuaagccaauuucaa

SEQ ID NO: 1902327 - RNA, 21 nt, Homo sapiens
ggccuugguggagcagccaga

SEQ ID NO: 1902328 - RNA, 14 nt, Homo sapiens
ugcuucgaaguauu

SEQ ID NO: 1902329 - RNA, 22 nt, Homo sapiens
aacuaaaauagauuaaaggaau

SEQ ID NO: 1902330 - RNA, 23 nt, Homo sapiens
acuuauuuuauuuuuuaccauaa

SEQ ID NO: 1902331 - RNA, 18 nt, Homo sapiens
aggugggggaacacugag

SEQ ID NO: 1902332 - RNA, 15 nt, Homo sapiens
agaaucaacagcucc

SEQ ID NO: 1902333 - RNA, 21 nt, Homo sapiens
agaaccucaaacuaggaggaa

SEQ ID NO: 1902334 - RNA, 19 nt, Homo sapiens
aagaccagcuuugcaguga

SEQ ID NO: 1902335 - RNA, 18 nt, Homo sapiens
gugcauaguauuggcaau

SEQ ID NO: 1902336 - RNA, 20 nt, Homo sapiens
gauacagugucugacuauaa

SEQ ID NO: 1902337 - RNA, 21 nt, Homo sapiens
aagcauuccuucuuugauaau

SEQ ID NO: 1902338 - RNA, 19 nt, Homo sapiens
cauuugcacagguuuucag

SEQ ID NO: 1902339 - RNA, 11 nt, Homo sapiens
ugacacuccag

SEQ ID NO: 1902340 - RNA, 20 nt, Homo sapiens
cuggccuuccccuccaaaac

SEQ ID NO: 1902341 - RNA, 17 nt, Homo sapiens
aauucagacaagcugca

SEQ ID NO: 1902342 - RNA, 23 nt, Homo sapiens
augaacuguuagguucugaugac

SEQ ID NO: 1902343 - RNA, 23 nt, Homo sapiens
uggggaccaaaucaaaugaauga

SEQ ID NO: 1902344 - RNA, 20 nt, Homo sapiens
aucuuugcucccugcaagaa

SEQ ID NO: 1902345 - RNA, 22 nt, Homo sapiens
gcuguggagauagugccagggu

SEQ ID NO: 1902346 - RNA, 22 nt, Homo sapiens
gccuaaauaaaaaguauacuuu

SEQ ID NO: 1902347 - RNA, 16 nt, Homo sapiens
gucuucuguauucacu

SEQ ID NO: 1902348 - RNA, 12 nt, Homo sapiens
aucuaguuuacu

SEQ ID NO: 1902349 - RNA, 22 nt, Homo sapiens
uggacaggaggcccccaucuau

SEQ ID NO: 1902350 - RNA, 23 nt, Homo sapiens
cuccugaaguugcugcugugaau

SEQ ID NO: 1902351 - RNA, 12 nt, Homo sapiens
gcuggugcugug

SEQ ID NO: 1902352 - RNA, 12 nt, Homo sapiens
gcuagugcugua

SEQ ID NO: 1902353 - RNA, 18 nt, Homo sapiens
uucuuuuauuaucaguua

SEQ ID NO: 1902354 - RNA, 22 nt, Homo sapiens
uccuacccaccgcccuugccga

SEQ ID NO: 1902355 - RNA, 12 nt, Homo sapiens
uaaacacugugu

SEQ ID NO: 1902356 - RNA, 18 nt, Homo sapiens
aauugaaucacugcucac

SEQ ID NO: 1902357 - RNA, 14 nt, Homo sapiens
cagcugcugaagag

SEQ ID NO: 1902358 - RNA, 17 nt, Homo sapiens
gaccuguaucaaacugc

SEQ ID NO: 1902359 - RNA, 18 nt, Homo sapiens
augucuuaaccuaccugg

SEQ ID NO: 1902360 - RNA, 18 nt, Homo sapiens
cggagggucucccugggc

SEQ ID NO: 1902361 - RNA, 21 nt, Homo sapiens
agaacugccauaaaaucucac

SEQ ID NO: 1902362 - RNA, 21 nt, Homo sapiens
uuucgaugaugaugaugauca

SEQ ID NO: 1902363 - RNA, 16 nt, Homo sapiens
uauauguugaaugaca

SEQ ID NO: 1902364 - RNA, 21 nt, Homo sapiens
agcccaggagccucacugggg

SEQ ID NO: 1902365 - RNA, 16 nt, Homo sapiens
caccacuaaaaaacca

SEQ ID NO: 1902366 - RNA, 20 nt, Homo sapiens
cagaaaagugauuaguacua

SEQ ID NO: 1902367 - RNA, 17 nt, Homo sapiens
agacuuaaaucacagau

SEQ ID NO: 1902368 - RNA, 21 nt, Homo sapiens
ucccagcacgaguggccaguu

SEQ ID NO: 1902369 - RNA, 14 nt, Homo sapiens
uacagauguacaau

SEQ ID NO: 1902370 - RNA, 19 nt, Homo sapiens
accuacuuuucuuuccuca

SEQ ID NO: 1902371 - RNA, 13 nt, Homo sapiens
ucucaaacuauga

SEQ ID NO: 1902372 - RNA, 17 nt, Homo sapiens
aauacggcaaaaccuca

SEQ ID NO: 1902373 - RNA, 17 nt, Homo sapiens
acuugggcacaugcuca

SEQ ID NO: 1902374 - RNA, 19 nt, Homo sapiens
gaugccaaagauguuugaa

SEQ ID NO: 1902375 - RNA, 17 nt, Homo sapiens
cugcuucuuuucacuuc

SEQ ID NO: 1902376 - RNA, 15 nt, Homo sapiens
gguggcgggcaccug

SEQ ID NO: 1902377 - RNA, 18 nt, Homo sapiens
ugccaaccuuauagggau

SEQ ID NO: 1902378 - RNA, 18 nt, Homo sapiens
aucaguauaauucuguac

SEQ ID NO: 1902379 - RNA, 19 nt, Homo sapiens
uuaagccuuacaaagggaa

SEQ ID NO: 1902380 - RNA, 17 nt, Homo sapiens
cagcugguccuguggau

SEQ ID NO: 1902381 - RNA, 22 nt, Homo sapiens
aucccaucuauucucugccuuu

SEQ ID NO: 1902382 - RNA, 23 nt, Homo sapiens
ugcaucugauaaaguugagagac

SEQ ID NO: 1902383 - RNA, 19 nt, Homo sapiens
gcgccaccucacugcagua

SEQ ID NO: 1902384 - RNA, 17 nt, Homo sapiens
cuccccagcccagagac

SEQ ID NO: 1902385 - RNA, 19 nt, Homo sapiens
gagucagucaugucacuga

SEQ ID NO: 1902386 - RNA, 21 nt, Homo sapiens
acuccugucccuguagcucag

SEQ ID NO: 1902387 - RNA, 22 nt, Homo sapiens
cuacacagugggaacucugaca

SEQ ID NO: 1902388 - RNA, 16 nt, Homo sapiens
aaauaaauaaaagccu

SEQ ID NO: 1902389 - RNA, 16 nt, Homo sapiens
auuaaaauauuugccu

SEQ ID NO: 1902390 - RNA, 16 nt, Homo sapiens
agguggagaacuggga

SEQ ID NO: 1902391 - RNA, 12 nt, Homo sapiens
cuguuguccuga

SEQ ID NO: 1902392 - RNA, 19 nt, Homo sapiens
aucaucaaaaacuuuggag

SEQ ID NO: 1902393 - RNA, 18 nt, Homo sapiens
cauccuaaaaaguuccau

SEQ ID NO: 1902394 - RNA, 18 nt, Homo sapiens
ucccgugagccaggcaaa

SEQ ID NO: 1902395 - RNA, 17 nt, Homo sapiens
cucuugaccaaguauga

SEQ ID NO: 1902396 - RNA, 15 nt, Homo sapiens
cuggcugccccucac

SEQ ID NO: 1902397 - RNA, 13 nt, Homo sapiens
augacuugcuacu

SEQ ID NO: 1902398 - RNA, 20 nt, Homo sapiens
cacagcggaggagaccagcu

SEQ ID NO: 1902399 - RNA, 18 nt, Homo sapiens
cccagacuggagugcagu

SEQ ID NO: 1902400 - RNA, 20 nt, Homo sapiens
cugacagaaaugcaaucucc

SEQ ID NO: 1902401 - RNA, 17 nt, Homo sapiens
ugauacuuugacagugu

SEQ ID NO: 1902402 - RNA, 20 nt, Homo sapiens
guguaaucccccaggagaac

SEQ ID NO: 1902403 - RNA, 18 nt, Homo sapiens
guacaccagagccucagu

SEQ ID NO: 1902404 - RNA, 16 nt, Homo sapiens
gccacucaguucuucc

SEQ ID NO: 1902405 - RNA, 23 nt, Homo sapiens
cuuuaaaauuuguccuacauucg

SEQ ID NO: 1902406 - RNA, 13 nt, Homo sapiens
ucaauccaagagu

SEQ ID NO: 1902407 - RNA, 17 nt, Homo sapiens
uguuucuuuuugccagc

SEQ ID NO: 1902408 - RNA, 15 nt, Homo sapiens
acaucaagugccaga

SEQ ID NO: 1902409 - RNA, 21 nt, Homo sapiens
uguacucauccugaauccuua

SEQ ID NO: 1902410 - RNA, 15 nt, Homo sapiens
aucaguauuuacaua

SEQ ID NO: 1902411 - RNA, 15 nt, Homo sapiens
ugccuggaguuggaa

SEQ ID NO: 1902412 - RNA, 20 nt, Homo sapiens
cccuccacgucagugccauc

SEQ ID NO: 1902413 - RNA, 18 nt, Homo sapiens
acuccacccccuccagcu

SEQ ID NO: 1902414 - RNA, 15 nt, Homo sapiens
gaauauuauacuucu

SEQ ID NO: 1902415 - RNA, 14 nt, Homo sapiens
auugaaaacacuua

SEQ ID NO: 1902416 - RNA, 19 nt, Homo sapiens
aucaauucaacacauuacu

SEQ ID NO: 1902417 - RNA, 17 nt, Homo sapiens
cauggcuguuaacccac

SEQ ID NO: 1902418 - RNA, 18 nt, Homo sapiens
guauucugcugaugcuac

SEQ ID NO: 1902419 - RNA, 20 nt, Homo sapiens
gaggcugguccuauggccuc

SEQ ID NO: 1902420 - RNA, 15 nt, Homo sapiens
cucaaguaaaacaaa

SEQ ID NO: 1902421 - RNA, 15 nt, Homo sapiens
ggccgcugggguccg

SEQ ID NO: 1902422 - RNA, 16 nt, Homo sapiens
ucccaccucaaauggg

SEQ ID NO: 1902423 - RNA, 23 nt, Homo sapiens
ugcaucuaccgcucuugggaaau

SEQ ID NO: 1902424 - RNA, 22 nt, Homo sapiens
ucaacccuucuggaaacuguga

SEQ ID NO: 1902425 - RNA, 15 nt, Homo sapiens
ccuggaagagggcaa

SEQ ID NO: 1902426 - RNA, 18 nt, Homo sapiens
cccacuguaucuaggcaa

SEQ ID NO: 1902427 - RNA, 14 nt, Homo sapiens
cuucuccuacauau

SEQ ID NO: 1902428 - RNA, 12 nt, Homo sapiens
cagcugcacuga

SEQ ID NO: 1902429 - RNA, 23 nt, Homo sapiens
ucccuuauuacugcuugcaguaa

SEQ ID NO: 1902430 - RNA, 15 nt, Homo sapiens
auuguucacuucuuu

SEQ ID NO: 1902431 - RNA, 17 nt, Homo sapiens
auuuuccauuaauuuca

SEQ ID NO: 1902432 - RNA, 19 nt, Homo sapiens
agcucuugugaacugucuu

SEQ ID NO: 1902433 - RNA, 18 nt, Homo sapiens
acaugcauacacucucaa

SEQ ID NO: 1902434 - RNA, 15 nt, Homo sapiens
uccuuggccacagac

SEQ ID NO: 1902435 - RNA, 23 nt, Homo sapiens
caacaauauuacaggggcuugaa

SEQ ID NO: 1902436 - RNA, 15 nt, Homo sapiens
ugcuaaaugggaccc

SEQ ID NO: 1902437 - RNA, 22 nt, Homo sapiens
gcacaggguccccgagugccua

SEQ ID NO: 1902438 - RNA, 18 nt, Homo sapiens
gggcucugugaccaggaa

SEQ ID NO: 1902439 - RNA, 12 nt, Homo sapiens
aggcaguggcaa

SEQ ID NO: 1902440 - RNA, 13 nt, Homo sapiens
aagaaaguacaga

SEQ ID NO: 1902441 - RNA, 22 nt, Homo sapiens
auacugaauuucuuugauuuaa

SEQ ID NO: 1902442 - RNA, 12 nt, Homo sapiens
cccauagcuauu

SEQ ID NO: 1902443 - RNA, 24 nt, Homo sapiens
gacaagagggaauaguauagacaa

SEQ ID NO: 1902444 - RNA, 19 nt, Homo sapiens
aaauaugcuauauauuagg

SEQ ID NO: 1902445 - RNA, 22 nt, Homo sapiens
aggggaagggccagucugggcu

SEQ ID NO: 1902446 - RNA, 20 nt, Homo sapiens
cgcagcgcgugcacagcgcg

SEQ ID NO: 1902447 - RNA, 21 nt, Homo sapiens
uucguuugcaaucuacagcua

SEQ ID NO: 1902448 - RNA, 18 nt, Homo sapiens
gggaucuggcacacuccc

SEQ ID NO: 1902449 - RNA, 16 nt, Homo sapiens
ucugauauaacaaacu

SEQ ID NO: 1902450 - RNA, 16 nt, Homo sapiens
aagacccaguguaaag

SEQ ID NO: 1902451 - RNA, 16 nt, Homo sapiens
ccagugaaccaaagag

SEQ ID NO: 1902452 - RNA, 16 nt, Homo sapiens
gugacagucacuuccu

SEQ ID NO: 1902453 - RNA, 13 nt, Homo sapiens
auuucucauucau

SEQ ID NO: 1902454 - RNA, 22 nt, Homo sapiens
aaaggccauuaaagcucaaggu

SEQ ID NO: 1902455 - RNA, 18 nt, Homo sapiens
acuuccaccagccugcac

SEQ ID NO: 1902456 - RNA, 21 nt, Homo sapiens
gauauuuuuauccuguucuca

SEQ ID NO: 1902457 - RNA, 18 nt, Homo sapiens
aauagccuaaaugauggu

SEQ ID NO: 1902458 - RNA, 21 nt, Homo sapiens
cuucaaucucuugcacucaaa

SEQ ID NO: 1902459 - RNA, 19 nt, Homo sapiens
caaaaauguuaagcaucua

SEQ ID NO: 1902460 - RNA, 15 nt, Homo sapiens
ccacuccaaccagaa

SEQ ID NO: 1902461 - RNA, 15 nt, Homo sapiens
aucuggaauuccagu

SEQ ID NO: 1902462 - RNA, 16 nt, Homo sapiens
aaguguuccuucauua

SEQ ID NO: 1902463 - RNA, 18 nt, Homo sapiens
aucuugcauucacacuca

SEQ ID NO: 1902464 - RNA, 20 nt, Homo sapiens
cccuugaggaaaaaugucca

SEQ ID NO: 1902465 - RNA, 21 nt, Homo sapiens
ucccaaguagcugggaccaca

SEQ ID NO: 1902466 - RNA, 17 nt, Homo sapiens
ugcauagugcuaagaaa

SEQ ID NO: 1902467 - RNA, 15 nt, Homo sapiens
ucuugccacauuucu

SEQ ID NO: 1902468 - RNA, 17 nt, Homo sapiens
cuuaauuucuaaagaua

SEQ ID NO: 1902469 - RNA, 16 nt, Homo sapiens
cacuccgucugcucca

SEQ ID NO: 1902470 - RNA, 17 nt, Homo sapiens
ucacagcaugugcaaua

SEQ ID NO: 1902471 - RNA, 14 nt, Homo sapiens
accuacaugucuuu

SEQ ID NO: 1902472 - RNA, 16 nt, Homo sapiens
acaggccacaccacag

SEQ ID NO: 1902473 - RNA, 13 nt, Homo sapiens
uccucuccgugcu

SEQ ID NO: 1902474 - RNA, 14 nt, Homo sapiens
aaaguaaugaugaa

SEQ ID NO: 1902475 - RNA, 14 nt, Homo sapiens
ccaucuucuuugca

SEQ ID NO: 1902476 - RNA, 23 nt, Homo sapiens
ucacaccuaugacauacauggaa

SEQ ID NO: 1902477 - RNA, 16 nt, Homo sapiens
gagaauguuguauuca

SEQ ID NO: 1902478 - RNA, 22 nt, Homo sapiens
ugacuguggccaugguccccaa

SEQ ID NO: 1902479 - RNA, 14 nt, Homo sapiens
auggggaacauuuu

SEQ ID NO: 1902480 - RNA, 15 nt, Homo sapiens
augcuguacaugaca

SEQ ID NO: 1902481 - RNA, 16 nt, Homo sapiens
gcucaugccuguaauc

SEQ ID NO: 1902482 - RNA, 13 nt, Homo sapiens
aggggcgcugucc

SEQ ID NO: 1902483 - RNA, 21 nt, Homo sapiens
ccuguggggcaggagugccag

SEQ ID NO: 1902484 - RNA, 14 nt, Homo sapiens
uacccacacaaaua

SEQ ID NO: 1902485 - RNA, 18 nt, Homo sapiens
aagaugaauccuagcuuc

SEQ ID NO: 1902486 - RNA, 14 nt, Homo sapiens
aucuagagaaggca

SEQ ID NO: 1902487 - RNA, 18 nt, Homo sapiens
aguuguguuaagcuugcg

SEQ ID NO: 1902488 - RNA, 21 nt, Homo sapiens
auagauauccuuggcacaucc

SEQ ID NO: 1902489 - RNA, 16 nt, Homo sapiens
gcaacaucucugggaa

SEQ ID NO: 1902490 - RNA, 15 nt, Homo sapiens
ugucaaccugaauua

SEQ ID NO: 1902491 - RNA, 14 nt, Homo sapiens
cacaacccaaaagg

SEQ ID NO: 1902492 - RNA, 23 nt, Homo sapiens
aagcuguguccuugcaccugcau

SEQ ID NO: 1902493 - RNA, 21 nt, Homo sapiens
auuauggaaaacuguguugcc

SEQ ID NO: 1902494 - RNA, 14 nt, Homo sapiens
ucccccuagccauu

SEQ ID NO: 1902495 - RNA, 16 nt, Homo sapiens
aaagccauaacuugaa

SEQ ID NO: 1902496 - RNA, 17 nt, Homo sapiens
gaccucugacagcagca

SEQ ID NO: 1902497 - RNA, 19 nt, Homo sapiens
caccgauauuaguccuaca

SEQ ID NO: 1902498 - RNA, 14 nt, Homo sapiens
ucauacuacauuga

SEQ ID NO: 1902499 - RNA, 17 nt, Homo sapiens
ggauggaugcagaucca

SEQ ID NO: 1902500 - RNA, 17 nt, Homo sapiens
acuugguguuugguucc

SEQ ID NO: 1902501 - RNA, 21 nt, Homo sapiens
uagccugugcuggaccagcug

SEQ ID NO: 1902502 - RNA, 14 nt, Homo sapiens
cuguuugcuugugu

SEQ ID NO: 1902503 - RNA, 15 nt, Homo sapiens
ccugaguuguauaaa

SEQ ID NO: 1902504 - RNA, 17 nt, Homo sapiens
acauauggacucugcac

SEQ ID NO: 1902505 - RNA, 14 nt, Homo sapiens
ccugguggguggug

SEQ ID NO: 1902506 - RNA, 22 nt, Homo sapiens
agaacaaaacuguaacugcauu

SEQ ID NO: 1902507 - RNA, 14 nt, Homo sapiens
aacaguguucucag

SEQ ID NO: 1902508 - RNA, 20 nt, Homo sapiens
uccuguaaucacaacucagc

SEQ ID NO: 1902509 - RNA, 13 nt, Homo sapiens
aagcccucugagc

SEQ ID NO: 1902510 - RNA, 11 nt, Homo sapiens
cauaugaacug

SEQ ID NO: 1902511 - RNA, 19 nt, Homo sapiens
gaaaaauguguauuuuaag

SEQ ID NO: 1902512 - RNA, 14 nt, Homo sapiens
agucugaagcacuc

SEQ ID NO: 1902513 - RNA, 20 nt, Homo sapiens
ucuccagagggaauugcaga

SEQ ID NO: 1902514 - RNA, 18 nt, Homo sapiens
auacaguacaggcagcac

SEQ ID NO: 1902515 - RNA, 17 nt, Homo sapiens
ccaaucacccuguaaua

SEQ ID NO: 1902516 - RNA, 17 nt, Homo sapiens
aaaaucuuaauguauca

SEQ ID NO: 1902517 - RNA, 17 nt, Homo sapiens
aucccuuaacaguugua

SEQ ID NO: 1902518 - RNA, 18 nt, Homo sapiens
gagcccagggaagacaca

SEQ ID NO: 1902519 - RNA, 13 nt, Homo sapiens
aaaugaccaaaga

SEQ ID NO: 1902520 - RNA, 18 nt, Homo sapiens
ucuagauuuucuacuuua

SEQ ID NO: 1902521 - RNA, 19 nt, Homo sapiens
guauagagaaaaguguauu

SEQ ID NO: 1902522 - RNA, 17 nt, Homo sapiens
aaugcugaacauugcau

SEQ ID NO: 1902523 - RNA, 13 nt, Homo sapiens
gguaaacaaagac

SEQ ID NO: 1902524 - RNA, 23 nt, Homo sapiens
uugucuugcgggucugucagggu

SEQ ID NO: 1902525 - RNA, 16 nt, Homo sapiens
aaaauuuuacauuuga

SEQ ID NO: 1902526 - RNA, 12 nt, Homo sapiens
agccugguggga

SEQ ID NO: 1902527 - RNA, 18 nt, Homo sapiens
gaauccuugacucuuaca

SEQ ID NO: 1902528 - RNA, 19 nt, Homo sapiens
gcugugccaggacugugac

SEQ ID NO: 1902529 - RNA, 15 nt, Homo sapiens
ugggguuccucugua

SEQ ID NO: 1902530 - RNA, 13 nt, Homo sapiens
auauaagccauag

SEQ ID NO: 1902531 - RNA, 21 nt, Homo sapiens
agccugucucuccuuguugcc

SEQ ID NO: 1902532 - RNA, 13 nt, Homo sapiens
aggcagccagacc

SEQ ID NO: 1902533 - RNA, 16 nt, Homo sapiens
accauuuuuuaaggaa

SEQ ID NO: 1902534 - RNA, 18 nt, Homo sapiens
ccucacguccaucacugg

SEQ ID NO: 1902535 - RNA, 15 nt, Homo sapiens
gagugauugcagcuu

SEQ ID NO: 1902536 - RNA, 14 nt, Homo sapiens
guggagacaguccu

SEQ ID NO: 1902537 - RNA, 13 nt, Homo sapiens
auucagcacuuaa

SEQ ID NO: 1902538 - RNA, 16 nt, Homo sapiens
ccauccuggggcagca

SEQ ID NO: 1902539 - RNA, 14 nt, Homo sapiens
auagaauacaugga

SEQ ID NO: 1902540 - RNA, 19 nt, Homo sapiens
accagucuauuuccacuga

SEQ ID NO: 1902541 - RNA, 22 nt, Homo sapiens
ucagaaaauaaaauauucacuc

SEQ ID NO: 1902542 - RNA, 21 nt, Homo sapiens
ugcuauuguagagccagaggu

SEQ ID NO: 1902543 - RNA, 15 nt, Homo sapiens
cucagaaacagaaga

SEQ ID NO: 1902544 - RNA, 14 nt, Homo sapiens
uccgaccucucuca

SEQ ID NO: 1902545 - RNA, 15 nt, Homo sapiens
cuaggcuauuaauuu

SEQ ID NO: 1902546 - RNA, 13 nt, Homo sapiens
ggugagguugcag

SEQ ID NO: 1902547 - RNA, 15 nt, Homo sapiens
agcagcagcagcagc

SEQ ID NO: 1902548 - RNA, 19 nt, Homo sapiens
uagaacuuugccagucuuu

SEQ ID NO: 1902549 - RNA, 20 nt, Homo sapiens
ccaaagauccacccaaauau

SEQ ID NO: 1902550 - RNA, 10 nt, Homo sapiens
gaaaccagug

SEQ ID NO: 1902551 - RNA, 11 nt, Homo sapiens
ccuuuuugccc

SEQ ID NO: 1902552 - RNA, 10 nt, Homo sapiens
uuaaugucaa

SEQ ID NO: 1902553 - RNA, 22 nt, Homo sapiens
cucucaggcgcaugugccaguu

SEQ ID NO: 1902554 - RNA, 22 nt, Homo sapiens
gccuucucuguucauuuccuca

SEQ ID NO: 1902555 - RNA, 13 nt, Homo sapiens
uuagacagaugac

SEQ ID NO: 1902556 - RNA, 16 nt, Homo sapiens
caguaaaauacuauug

SEQ ID NO: 1902557 - RNA, 17 nt, Homo sapiens
ccaucagcacaaagaca

SEQ ID NO: 1902558 - RNA, 14 nt, Homo sapiens
gcauuuggaaccaa

SEQ ID NO: 1902559 - RNA, 21 nt, Homo sapiens
acuaucauucucucacaagaa

SEQ ID NO: 1902560 - RNA, 21 nt, Homo sapiens
cucucuaccagucuauuucca

SEQ ID NO: 1902561 - RNA, 13 nt, Homo sapiens
gaacaaccaagca

SEQ ID NO: 1902562 - RNA, 15 nt, Homo sapiens
ucaggauaccauaua

SEQ ID NO: 1902563 - RNA, 20 nt, Homo sapiens
ugugugcagggggugggugu

SEQ ID NO: 1902564 - RNA, 17 nt, Homo sapiens
aguccugauguacuuua

SEQ ID NO: 1902565 - RNA, 15 nt, Homo sapiens
ucuuagcucaaugag

SEQ ID NO: 1902566 - RNA, 20 nt, Homo sapiens
uccuucccccagcacaaagc

SEQ ID NO: 1902567 - RNA, 15 nt, Homo sapiens
uauuaguauucuaau

SEQ ID NO: 1902568 - RNA, 19 nt, Homo sapiens
cuuguggaugacucuguaa

SEQ ID NO: 1902569 - RNA, 20 nt, Homo sapiens
uacuaaggaguaaucugugu

SEQ ID NO: 1902570 - RNA, 15 nt, Homo sapiens
aggacaaagugccca

SEQ ID NO: 1902571 - RNA, 20 nt, Homo sapiens
ggagcuggcccagggggccu

SEQ ID NO: 1902572 - RNA, 20 nt, Homo sapiens
aagguuucacuguucaugaa

SEQ ID NO: 1902573 - RNA, 23 nt, Homo sapiens
ugacugccugcagaagucccaag

SEQ ID NO: 1902574 - RNA, 15 nt, Homo sapiens
gcugguaagggccaa

SEQ ID NO: 1902575 - RNA, 16 nt, Homo sapiens
guggaccucaccagag

SEQ ID NO: 1902576 - RNA, 14 nt, Homo sapiens
guuauccugugcua

SEQ ID NO: 1902577 - RNA, 14 nt, Homo sapiens
cuucaccucugaaa

SEQ ID NO: 1902578 - RNA, 13 nt, Homo sapiens
gucuauuguauau

SEQ ID NO: 1902579 - RNA, 12 nt, Homo sapiens
ugccuccagcua

SEQ ID NO: 1902580 - RNA, 17 nt, Homo sapiens
agaagaccccacuucag

SEQ ID NO: 1902581 - RNA, 14 nt, Homo sapiens
caugguuugacuca

SEQ ID NO: 1902582 - RNA, 13 nt, Homo sapiens
uacuucaugagga

SEQ ID NO: 1902583 - RNA, 13 nt, Homo sapiens
ugcuacauggggu

SEQ ID NO: 1902584 - RNA, 15 nt, Homo sapiens
acuuuuucauuucca

SEQ ID NO: 1902585 - RNA, 20 nt, Homo sapiens
cuugauuacuuccacugagg

SEQ ID NO: 1902586 - RNA, 22 nt, Homo sapiens
aaauacaguuugucacaugaaa

SEQ ID NO: 1902587 - RNA, 19 nt, Homo sapiens
uaagagcgaacuucacaua

SEQ ID NO: 1902588 - RNA, 14 nt, Homo sapiens
uguugaaauaugca

SEQ ID NO: 1902589 - RNA, 19 nt, Homo sapiens
uuucaccaaugagccuuag

SEQ ID NO: 1902590 - RNA, 14 nt, Homo sapiens
cuuccuauucucaa

SEQ ID NO: 1902591 - RNA, 22 nt, Homo sapiens
ugcacagguuuucagcaacuca

SEQ ID NO: 1902592 - RNA, 20 nt, Homo sapiens
accuuugcccacacacacuc

SEQ ID NO: 1902593 - RNA, 20 nt, Homo sapiens
aagaguugagauuuugcaau

SEQ ID NO: 1902594 - RNA, 23 nt, Homo sapiens
ucuugaagaauaaauucuaccuc

SEQ ID NO: 1902595 - RNA, 14 nt, Homo sapiens
agguggauuuacug

SEQ ID NO: 1902596 - RNA, 18 nt, Homo sapiens
aguggcagcaacaaagga

SEQ ID NO: 1902597 - RNA, 17 nt, Homo sapiens
ucugcccgcuccaugga

SEQ ID NO: 1902598 - RNA, 17 nt, Homo sapiens
guuagugggaagagcug

SEQ ID NO: 1902599 - RNA, 20 nt, Homo sapiens
ugugcuggugaacacuguga

SEQ ID NO: 1902600 - RNA, 13 nt, Homo sapiens
cuggaaauggacu

SEQ ID NO: 1902601 - RNA, 19 nt, Homo sapiens
aaccacaagcaaaaucugg

SEQ ID NO: 1902602 - RNA, 17 nt, Homo sapiens
uucaaaauuggacuuaa

SEQ ID NO: 1902603 - RNA, 15 nt, Homo sapiens
aguuugcacaacaag

SEQ ID NO: 1902604 - RNA, 13 nt, Homo sapiens
cuuaaagaucuca

SEQ ID NO: 1902605 - RNA, 18 nt, Homo sapiens
cauuugauaaaauccaaa

SEQ ID NO: 1902606 - RNA, 15 nt, Homo sapiens
auccucauuacccag

SEQ ID NO: 1902607 - RNA, 15 nt, Homo sapiens
cagcaucugcuaaua

SEQ ID NO: 1902608 - RNA, 17 nt, Homo sapiens
aaggccgagaagcaaga

SEQ ID NO: 1902609 - RNA, 22 nt, Homo sapiens
ugaggcgaaauauaaaacugag

SEQ ID NO: 1902610 - RNA, 23 nt, Homo sapiens
acaaaaccuacgcacauaccuuc

SEQ ID NO: 1902611 - RNA, 18 nt, Homo sapiens
cuucacugcuacaugugc

SEQ ID NO: 1902612 - RNA, 21 nt, Homo sapiens
ggcaggaagggacugccaaag

SEQ ID NO: 1902613 - RNA, 24 nt, Homo sapiens
uuuaugaaaacugaagcaucaaua

SEQ ID NO: 1902614 - RNA, 12 nt, Homo sapiens
cuaguagcuuuc

SEQ ID NO: 1902615 - RNA, 13 nt, Homo sapiens
uaagcaucuucaa

SEQ ID NO: 1902616 - RNA, 19 nt, Homo sapiens
cagaaaccgugccaaaaga

SEQ ID NO: 1902617 - RNA, 18 nt, Homo sapiens
caacacucaguccuucca

SEQ ID NO: 1902618 - RNA, 16 nt, Homo sapiens
augugugaugcaaaug

SEQ ID NO: 1902619 - RNA, 19 nt, Homo sapiens
ccaacuugguuuugcuaca

SEQ ID NO: 1902620 - RNA, 14 nt, Homo sapiens
acgcacacugucug

SEQ ID NO: 1902621 - RNA, 23 nt, Homo sapiens
cuugcccgccagccucagugcca

SEQ ID NO: 1902622 - RNA, 15 nt, Homo sapiens
uaaaucguccuccca

SEQ ID NO: 1902623 - RNA, 21 nt, Homo sapiens
agaaaaagaaucggcaguauu

SEQ ID NO: 1902624 - RNA, 15 nt, Homo sapiens
uucagcuugagcuga

SEQ ID NO: 1902625 - RNA, 19 nt, Homo sapiens
accauaagggacugugcca

SEQ ID NO: 1902626 - RNA, 19 nt, Homo sapiens
ccugcuccacgaagccuua

SEQ ID NO: 1902627 - RNA, 19 nt, Homo sapiens
agggucacugaaccacugc

SEQ ID NO: 1902628 - RNA, 12 nt, Homo sapiens
caggacucugaa

SEQ ID NO: 1902629 - RNA, 21 nt, Homo sapiens
ugccacaucuugaucugcuca

SEQ ID NO: 1902630 - RNA, 13 nt, Homo sapiens
ugcaccaggccau

SEQ ID NO: 1902631 - RNA, 12 nt, Homo sapiens
uaauucugcaga

SEQ ID NO: 1902632 - RNA, 14 nt, Homo sapiens
gccaggaagccaga

SEQ ID NO: 1902633 - RNA, 14 nt, Homo sapiens
ccaauaaaccaaug

SEQ ID NO: 1902634 - RNA, 14 nt, Homo sapiens
cauaugaacauaua

SEQ ID NO: 1902635 - RNA, 13 nt, Homo sapiens
agcauauacuggu

SEQ ID NO: 1902636 - RNA, 15 nt, Homo sapiens
gagcaccuacugugu

SEQ ID NO: 1902637 - RNA, 17 nt, Homo sapiens
gccaaauuuugauccua

SEQ ID NO: 1902638 - RNA, 13 nt, Homo sapiens
uucgauguacuug

SEQ ID NO: 1902639 - RNA, 22 nt, Homo sapiens
ucuucuagugcuuuucagugau

SEQ ID NO: 1902640 - RNA, 21 nt, Homo sapiens
caaucagcacucuguaaaaug

SEQ ID NO: 1902641 - RNA, 19 nt, Homo sapiens
ucccaacuucauacuggca

SEQ ID NO: 1902642 - RNA, 21 nt, Homo sapiens
ucucauagguugagcaauuuc

SEQ ID NO: 1902643 - RNA, 21 nt, Homo sapiens
uucacagagauggaugcaugu

SEQ ID NO: 1902644 - RNA, 21 nt, Homo sapiens
aggccuuugugucuguguccu

SEQ ID NO: 1902645 - RNA, 20 nt, Homo sapiens
aagaugagccuugcagauau

SEQ ID NO: 1902646 - RNA, 14 nt, Homo sapiens
ugcaaccccaggua

SEQ ID NO: 1902647 - RNA, 19 nt, Homo sapiens
gcucaggcuuuuccaggaa

SEQ ID NO: 1902648 - RNA, 20 nt, Homo sapiens
aacaucauauaccucuugaa

SEQ ID NO: 1902649 - RNA, 12 nt, Homo sapiens
uuucuaugcaaa

SEQ ID NO: 1902650 - RNA, 17 nt, Homo sapiens
gaauuauaagucacaaa

SEQ ID NO: 1902651 - RNA, 14 nt, Homo sapiens
acccuggcauuugg

SEQ ID NO: 1902652 - RNA, 16 nt, Homo sapiens
ggagcagcagccacug

SEQ ID NO: 1902653 - RNA, 22 nt, Homo sapiens
ucaaaccccuacugaccuggcu

SEQ ID NO: 1902654 - RNA, 18 nt, Homo sapiens
cuucugccuucucaggaa

SEQ ID NO: 1902655 - RNA, 16 nt, Homo sapiens
cccauugguguuguca

SEQ ID NO: 1902656 - RNA, 19 nt, Homo sapiens
ccccaccacuguuggucca

SEQ ID NO: 1902657 - RNA, 16 nt, Homo sapiens
uaccuguuaguauuau

SEQ ID NO: 1902658 - RNA, 22 nt, Homo sapiens
uguuuucgaauacgucagauug

SEQ ID NO: 1902659 - RNA, 17 nt, Homo sapiens
cucuacagacuccaaaa

SEQ ID NO: 1902660 - RNA, 21 nt, Homo sapiens
aacuacagaguuuaugauuua

SEQ ID NO: 1902661 - RNA, 13 nt, Homo sapiens
ugagccugagaug

SEQ ID NO: 1902662 - RNA, 16 nt, Homo sapiens
ugaaaugaaagggaaa

SEQ ID NO: 1902663 - RNA, 23 nt, Homo sapiens
uuaacucuaacugugacaaagaa

SEQ ID NO: 1902664 - RNA, 12 nt, Homo sapiens
ggccuccaggag

SEQ ID NO: 1902665 - RNA, 23 nt, Homo sapiens
caaaagucaccacuccauuccca

SEQ ID NO: 1902666 - RNA, 20 nt, Homo sapiens
aaagcagugggcuccuggca

SEQ ID NO: 1902667 - RNA, 19 nt, Homo sapiens
ccaggccagagugcagugg

SEQ ID NO: 1902668 - RNA, 16 nt, Homo sapiens
uuccagucuacuugag

SEQ ID NO: 1902669 - RNA, 13 nt, Homo sapiens
ggccuccaugacc

SEQ ID NO: 1902670 - RNA, 14 nt, Homo sapiens
ccugcgauuuugcc

SEQ ID NO: 1902671 - RNA, 19 nt, Homo sapiens
gaaugccuaaauauaauua

SEQ ID NO: 1902672 - RNA, 16 nt, Homo sapiens
aguagaucaccuccuc

SEQ ID NO: 1902673 - RNA, 16 nt, Homo sapiens
aaaacuucaguaagua

SEQ ID NO: 1902674 - RNA, 12 nt, Homo sapiens
agccagccugac

SEQ ID NO: 1902675 - RNA, 10 nt, Homo sapiens
guguguuuca

SEQ ID NO: 1902676 - RNA, 12 nt, Homo sapiens
ccaugccucaag

SEQ ID NO: 1902677 - RNA, 23 nt, Homo sapiens
cauauucacugguuuauuugcag

SEQ ID NO: 1902678 - RNA, 20 nt, Homo sapiens
ucacucuugccaaccuguaa

SEQ ID NO: 1902679 - RNA, 20 nt, Homo sapiens
acucuguguaaucucugauu

SEQ ID NO: 1902680 - RNA, 14 nt, Homo sapiens
aguauguaugugua

SEQ ID NO: 1902681 - RNA, 19 nt, Homo sapiens
cugaauggcuuugucuuga

SEQ ID NO: 1902682 - RNA, 23 nt, Homo sapiens
ucugugcccggugccaucuucca

SEQ ID NO: 1902683 - RNA, 16 nt, Homo sapiens
caaaaaaagaaaaaga

SEQ ID NO: 1902684 - RNA, 19 nt, Homo sapiens
ccagauuuucacuguucca

SEQ ID NO: 1902685 - RNA, 16 nt, Homo sapiens
caaacuucuuguucaa

SEQ ID NO: 1902686 - RNA, 21 nt, Homo sapiens
cugacaccugccgcugcuuga

SEQ ID NO: 1902687 - RNA, 17 nt, Homo sapiens
cagaggguggguguuca

SEQ ID NO: 1902688 - RNA, 20 nt, Homo sapiens
auuggccugguauggcugca

SEQ ID NO: 1902689 - RNA, 23 nt, Homo sapiens
cuauguuccaagugcuacucuca

SEQ ID NO: 1902690 - RNA, 16 nt, Homo sapiens
agcccauggcacucua

SEQ ID NO: 1902691 - RNA, 18 nt, Homo sapiens
uuucagugagaaaauccu

SEQ ID NO: 1902692 - RNA, 22 nt, Homo sapiens
ccuuacgcuuugucacacaaaa

SEQ ID NO: 1902693 - RNA, 20 nt, Homo sapiens
uaacagcugguauggccuua

SEQ ID NO: 1902694 - RNA, 18 nt, Homo sapiens
augaaccauuaagaacaa

SEQ ID NO: 1902695 - RNA, 16 nt, Homo sapiens
aaucauacaaauacua

SEQ ID NO: 1902696 - RNA, 17 nt, Homo sapiens
ugcuacagaaagcacaa

SEQ ID NO: 1902697 - RNA, 18 nt, Homo sapiens
gacaucagcaucaccuag

SEQ ID NO: 1902698 - RNA, 13 nt, Homo sapiens
uuauuacauguaa

SEQ ID NO: 1902699 - RNA, 16 nt, Homo sapiens
acaucaguauaguguu

SEQ ID NO: 1902700 - RNA, 18 nt, Homo sapiens
gucacaucagcaauuuca

SEQ ID NO: 1902701 - RNA, 22 nt, Homo sapiens
ggaccagucccgucgugcaguc

SEQ ID NO: 1902702 - RNA, 24 nt, Homo sapiens
cuguauuuccuucucauaaccuca

SEQ ID NO: 1902703 - RNA, 22 nt, Homo sapiens
uucccccccaagauagagucaa

SEQ ID NO: 1902704 - RNA, 18 nt, Homo sapiens
acaccaagugucugcaag

SEQ ID NO: 1902705 - RNA, 13 nt, Homo sapiens
ccucuuuccccac

SEQ ID NO: 1902706 - RNA, 17 nt, Homo sapiens
uguaggcaucaugcaug

SEQ ID NO: 1902707 - RNA, 13 nt, Homo sapiens
ccuguaucucuca

SEQ ID NO: 1902708 - RNA, 17 nt, Homo sapiens
gaugugaucauagcuca

SEQ ID NO: 1902709 - RNA, 17 nt, Homo sapiens
augccaugaccuuccuc

SEQ ID NO: 1902710 - RNA, 17 nt, Homo sapiens
aggguaguaagaauuag

SEQ ID NO: 1902711 - RNA, 18 nt, Homo sapiens
gcacagccucagaauaaa

SEQ ID NO: 1902712 - RNA, 22 nt, Homo sapiens
auugggacccuccagugcugga

SEQ ID NO: 1902713 - RNA, 20 nt, Homo sapiens
cccaggugggaccugacaua

SEQ ID NO: 1902714 - RNA, 21 nt, Homo sapiens
ucguccaaggcaguucugugu

SEQ ID NO: 1902715 - RNA, 12 nt, Homo sapiens
agccaccacuga

SEQ ID NO: 1902716 - RNA, 19 nt, Homo sapiens
ccucaagccccuucucuca

SEQ ID NO: 1902717 - RNA, 14 nt, Homo sapiens
caacauccaaaaua

SEQ ID NO: 1902718 - RNA, 21 nt, Homo sapiens
ggaaaauaauaaaagaaucau

SEQ ID NO: 1902719 - RNA, 22 nt, Homo sapiens
cagcuguggcuucuaggugccc

SEQ ID NO: 1902720 - RNA, 22 nt, Homo sapiens
gguauauuuccauucaugccaa

SEQ ID NO: 1902721 - RNA, 16 nt, Homo sapiens
uugauguaacugagaa

SEQ ID NO: 1902722 - RNA, 16 nt, Homo sapiens
gcccgcugaguggacu

SEQ ID NO: 1902723 - RNA, 21 nt, Homo sapiens
gccagcccacugccuccugcc

SEQ ID NO: 1902724 - RNA, 13 nt, Homo sapiens
ucccaucacucuu

SEQ ID NO: 1902725 - RNA, 22 nt, Homo sapiens
cacaagccacaagucuuccaga

SEQ ID NO: 1902726 - RNA, 13 nt, Homo sapiens
cugcucacuggcu

SEQ ID NO: 1902727 - RNA, 14 nt, Homo sapiens
uguggcaacugaga

SEQ ID NO: 1902728 - RNA, 15 nt, Homo sapiens
guccuguuccugcca

SEQ ID NO: 1902729 - RNA, 16 nt, Homo sapiens
gccccaguccaugcuu

SEQ ID NO: 1902730 - RNA, 21 nt, Homo sapiens
cuuuauauuuuuaacuuuaag

SEQ ID NO: 1902731 - RNA, 16 nt, Homo sapiens
uuuauuaauauuugca

SEQ ID NO: 1902732 - RNA, 16 nt, Homo sapiens
cacuggaccucagucc

SEQ ID NO: 1902733 - RNA, 19 nt, Homo sapiens
uuauaagauuuaauuguaa

SEQ ID NO: 1902734 - RNA, 13 nt, Homo sapiens
uaugaauuuccac

SEQ ID NO: 1902735 - RNA, 19 nt, Homo sapiens
augucaaacugucuuggcu

SEQ ID NO: 1902736 - RNA, 19 nt, Homo sapiens
aguaacgagaagugcuuua

SEQ ID NO: 1902737 - RNA, 22 nt, Homo sapiens
ccauagcaacuccccuacauca

SEQ ID NO: 1902738 - RNA, 21 nt, Homo sapiens
aagauuucucuuuuucauuca

SEQ ID NO: 1902739 - RNA, 18 nt, Homo sapiens
aacacuguggaacuaaua

SEQ ID NO: 1902740 - RNA, 15 nt, Homo sapiens
agccuauuuaccugc

SEQ ID NO: 1902741 - RNA, 21 nt, Homo sapiens
aacuuuauucuugaaagaaga

SEQ ID NO: 1902742 - RNA, 21 nt, Homo sapiens
cuguuuuuucuguacacagaa

SEQ ID NO: 1902743 - RNA, 14 nt, Homo sapiens
aguguauuagucau

SEQ ID NO: 1902744 - RNA, 19 nt, Homo sapiens
agcagccauuggcacugug

SEQ ID NO: 1902745 - RNA, 20 nt, Homo sapiens
aaccaauucaugaagugaau

SEQ ID NO: 1902746 - RNA, 17 nt, Homo sapiens
ugucuuuucuuugccau

SEQ ID NO: 1902747 - RNA, 22 nt, Homo sapiens
acggaguccuguguuugugagu

SEQ ID NO: 1902748 - RNA, 12 nt, Homo sapiens
aguccaaaaagc

SEQ ID NO: 1902749 - RNA, 20 nt, Homo sapiens
caagacagcucuucuugaaa

SEQ ID NO: 1902750 - RNA, 23 nt, Homo sapiens
uuucccugggguacuacucucca

SEQ ID NO: 1902751 - RNA, 18 nt, Homo sapiens
agggaaaauuauuugcau

SEQ ID NO: 1902752 - RNA, 21 nt, Homo sapiens
acauuuuagaaugucaauaaa

SEQ ID NO: 1902753 - RNA, 12 nt, Homo sapiens
aacuuggcugca

SEQ ID NO: 1902754 - RNA, 19 nt, Homo sapiens
uggagaaaaaacacacucc

SEQ ID NO: 1902755 - RNA, 17 nt, Homo sapiens
ugugcuauacacacaca

SEQ ID NO: 1902756 - RNA, 13 nt, Homo sapiens
uaauaucagugaa

SEQ ID NO: 1902757 - RNA, 17 nt, Homo sapiens
caauauuccuaugcugc

SEQ ID NO: 1902758 - RNA, 21 nt, Homo sapiens
acaaauuauucagauguacac

SEQ ID NO: 1902759 - RNA, 16 nt, Homo sapiens
acagagcugacugcau

SEQ ID NO: 1902760 - RNA, 20 nt, Homo sapiens
uucucucauagaacauugau

SEQ ID NO: 1902761 - RNA, 12 nt, Homo sapiens
augccauguaug

SEQ ID NO: 1902762 - RNA, 15 nt, Homo sapiens
ggcucaggcugccca

SEQ ID NO: 1902763 - RNA, 21 nt, Homo sapiens
uaaauggcaucagcacuuuaa

SEQ ID NO: 1902764 - RNA, 15 nt, Homo sapiens
uagccacuugcucag

SEQ ID NO: 1902765 - RNA, 12 nt, Homo sapiens
uaguuacugugg

SEQ ID NO: 1902766 - RNA, 18 nt, Homo sapiens
caguucauugcacuuuga

SEQ ID NO: 1902767 - RNA, 15 nt, Homo sapiens
ugcaggccccagcaa

SEQ ID NO: 1902768 - RNA, 22 nt, Homo sapiens
uugaagacuucuagcagaaaaa

SEQ ID NO: 1902769 - RNA, 17 nt, Homo sapiens
acugaugaaaucugcua

SEQ ID NO: 1902770 - RNA, 24 nt, Homo sapiens
ccacucuuguggucaucauggcca

SEQ ID NO: 1902771 - RNA, 20 nt, Homo sapiens
cuccauuuaccaguaacuua

SEQ ID NO: 1902772 - RNA, 13 nt, Homo sapiens
cuaauacauuaaa

SEQ ID NO: 1902773 - RNA, 19 nt, Homo sapiens
guaaaauacuuuuacucug

SEQ ID NO: 1902774 - RNA, 16 nt, Homo sapiens
ugacuuguuacaugaa

SEQ ID NO: 1902775 - RNA, 23 nt, Homo sapiens
ugcagguuucuccuugaagcaaa

SEQ ID NO: 1902776 - RNA, 12 nt, Homo sapiens
uuugaccaaaua

SEQ ID NO: 1902777 - RNA, 19 nt, Homo sapiens
acuguccaguccagugaug

SEQ ID NO: 1902778 - RNA, 20 nt, Homo sapiens
aauguuugguuucagguauu

SEQ ID NO: 1902779 - RNA, 14 nt, Homo sapiens
caagcauugaauaa

SEQ ID NO: 1902780 - RNA, 21 nt, Homo sapiens
caguggacccuggaccauucc

SEQ ID NO: 1902781 - RNA, 19 nt, Homo sapiens
cuuccagcacccugcaaaa

SEQ ID NO: 1902782 - RNA, 20 nt, Homo sapiens
cuuagaccaagggaugggac

SEQ ID NO: 1902783 - RNA, 19 nt, Homo sapiens
uaguaacuuuccauagggc

SEQ ID NO: 1902784 - RNA, 15 nt, Homo sapiens
gcaauaaaagacaaa

SEQ ID NO: 1902785 - RNA, 15 nt, Homo sapiens
ccaucaucugcugca

SEQ ID NO: 1902786 - RNA, 12 nt, Homo sapiens
uucuuaaugugu

SEQ ID NO: 1902787 - RNA, 19 nt, Homo sapiens
agacaagaacuuggaggca

SEQ ID NO: 1902788 - RNA, 18 nt, Homo sapiens
uuauauagguugugcaaa

SEQ ID NO: 1902789 - RNA, 17 nt, Homo sapiens
ugucagccacugugaua

SEQ ID NO: 1902790 - RNA, 14 nt, Homo sapiens
ccaguaaagccuua

SEQ ID NO: 1902791 - RNA, 19 nt, Homo sapiens
augucauuguucuugugaa

SEQ ID NO: 1902792 - RNA, 21 nt, Homo sapiens
aauaccuuagcucccuugagc

SEQ ID NO: 1902793 - RNA, 16 nt, Homo sapiens
cuucuuacuggugcua

SEQ ID NO: 1902794 - RNA, 14 nt, Homo sapiens
ggugucugcagcuc

SEQ ID NO: 1902795 - RNA, 14 nt, Homo sapiens
ccuaaaaaaagaga

SEQ ID NO: 1902796 - RNA, 13 nt, Homo sapiens
agugcuacagggu

SEQ ID NO: 1902797 - RNA, 14 nt, Homo sapiens
gagcgagacuuggu

SEQ ID NO: 1902798 - RNA, 14 nt, Homo sapiens
acucugcaucagca

SEQ ID NO: 1902799 - RNA, 18 nt, Homo sapiens
ugccuuuaagccaaagaa

SEQ ID NO: 1902800 - RNA, 23 nt, Homo sapiens
gccugggguggggucaugcccuc

SEQ ID NO: 1902801 - RNA, 17 nt, Homo sapiens
cuaaaccgauaaugcau

SEQ ID NO: 1902802 - RNA, 19 nt, Homo sapiens
augaugaucuuuaaaauac

SEQ ID NO: 1902803 - RNA, 14 nt, Homo sapiens
auuagcacuaccau

SEQ ID NO: 1902804 - RNA, 22 nt, Homo sapiens
aaaacccuugauuauacucugu

SEQ ID NO: 1902805 - RNA, 21 nt, Homo sapiens
cacuuugggaggccaaggugg

SEQ ID NO: 1902806 - RNA, 15 nt, Homo sapiens
aucacuuucaggugg

SEQ ID NO: 1902807 - RNA, 18 nt, Homo sapiens
uaaaauauauuucagaua

SEQ ID NO: 1902808 - RNA, 23 nt, Homo sapiens
aacucugggcacuuuugaacuca

SEQ ID NO: 1902809 - RNA, 15 nt, Homo sapiens
ugaaagggauggcca

SEQ ID NO: 1902810 - RNA, 21 nt, Homo sapiens
uccuggaaggacacagugaug

SEQ ID NO: 1902811 - RNA, 22 nt, Homo sapiens
ucgugcaaacccagugagacag

SEQ ID NO: 1902812 - RNA, 19 nt, Homo sapiens
uuuggaguccccucaccuc

SEQ ID NO: 1902813 - RNA, 14 nt, Homo sapiens
gacucacauugccu

SEQ ID NO: 1902814 - RNA, 13 nt, Homo sapiens
acuguaaagaauu

SEQ ID NO: 1902815 - RNA, 12 nt, Homo sapiens
auuaaaacauua

SEQ ID NO: 1902816 - RNA, 18 nt, Homo sapiens
agaauuaguggcacuugc

SEQ ID NO: 1902817 - RNA, 13 nt, Homo sapiens
ucaacaguucaaa

SEQ ID NO: 1902818 - RNA, 14 nt, Homo sapiens
uggcugcauuugcc

SEQ ID NO: 1902819 - RNA, 13 nt, Homo sapiens
agcccaguagcca

SEQ ID NO: 1902820 - RNA, 21 nt, Homo sapiens
uuauacuaaauaugugacuga

SEQ ID NO: 1902821 - RNA, 13 nt, Homo sapiens
ucuauuuugugaa

SEQ ID NO: 1902822 - RNA, 18 nt, Homo sapiens
cuacugcuaaauccucau

SEQ ID NO: 1902823 - RNA, 20 nt, Homo sapiens
cauucuguuuuuucuguaca

SEQ ID NO: 1902824 - RNA, 21 nt, Homo sapiens
uuaacugccuuacagacagaa

SEQ ID NO: 1902825 - RNA, 15 nt, Homo sapiens
aggccucucucagga

SEQ ID NO: 1902826 - RNA, 17 nt, Homo sapiens
uguguucaaucugugaa

SEQ ID NO: 1902827 - RNA, 15 nt, Homo sapiens
aaucugaguauauau

SEQ ID NO: 1902828 - RNA, 14 nt, Homo sapiens
uagcagaaaccaag

SEQ ID NO: 1902829 - RNA, 18 nt, Homo sapiens
auuuucaguaacccagcu

SEQ ID NO: 1902830 - RNA, 20 nt, Homo sapiens
cagcacuuugcucuuuuaau

SEQ ID NO: 1902831 - RNA, 15 nt, Homo sapiens
aaucuaccacuguau

SEQ ID NO: 1902832 - RNA, 12 nt, Homo sapiens
cgcuaguggagg

SEQ ID NO: 1902833 - RNA, 23 nt, Homo sapiens
ugccauugacuucuucccaagau

SEQ ID NO: 1902834 - RNA, 18 nt, Homo sapiens
gacuugcucccucuccaa

SEQ ID NO: 1902835 - RNA, 21 nt, Homo sapiens
guguuuuuuuucuucugcuau

SEQ ID NO: 1902836 - RNA, 20 nt, Homo sapiens
uucuggacccguucaacuuu

SEQ ID NO: 1902837 - RNA, 22 nt, Homo sapiens
uggcgagucugcuuucuucuac

SEQ ID NO: 1902838 - RNA, 21 nt, Homo sapiens
guaucaaaugugacauuauau

SEQ ID NO: 1902839 - RNA, 21 nt, Homo sapiens
ccaguggagacggaaucugcc

SEQ ID NO: 1902840 - RNA, 18 nt, Homo sapiens
agugccuccugggaccau

SEQ ID NO: 1902841 - RNA, 15 nt, Homo sapiens
aucaacgugcaaugu

SEQ ID NO: 1902842 - RNA, 20 nt, Homo sapiens
uucauggcuaccucagaaag

SEQ ID NO: 1902843 - RNA, 20 nt, Homo sapiens
acuuauguauuuaugaccuu

SEQ ID NO: 1902844 - RNA, 16 nt, Homo sapiens
ugaaugugagguguug

SEQ ID NO: 1902845 - RNA, 13 nt, Homo sapiens
ucccagcuacuca

SEQ ID NO: 1902846 - RNA, 20 nt, Homo sapiens
gugccacaaauaaaauggau

SEQ ID NO: 1902847 - RNA, 18 nt, Homo sapiens
uugauuaaaaucuggcaa

SEQ ID NO: 1902848 - RNA, 16 nt, Homo sapiens
auaaauauauauucua

SEQ ID NO: 1902849 - RNA, 16 nt, Homo sapiens
cccucauucaucuugc

SEQ ID NO: 1902850 - RNA, 17 nt, Homo sapiens
acauucugaugagcaac

SEQ ID NO: 1902851 - RNA, 22 nt, Homo sapiens
ccaugaagcgaaacacagagaa

SEQ ID NO: 1902852 - RNA, 16 nt, Homo sapiens
augcaagaaucucaga

SEQ ID NO: 1902853 - RNA, 19 nt, Homo sapiens
ugaguuuaaaucaagauua

SEQ ID NO: 1902854 - RNA, 21 nt, Homo sapiens
cuccuguggucucugaccagg

SEQ ID NO: 1902855 - RNA, 14 nt, Homo sapiens
uauuaauugagauu

SEQ ID NO: 1902856 - RNA, 20 nt, Homo sapiens
cagcugcagaccaugccaga

SEQ ID NO: 1902857 - RNA, 13 nt, Homo sapiens
ggaggcugcagcc

SEQ ID NO: 1902858 - RNA, 17 nt, Homo sapiens
aguagccuuacugugaa

SEQ ID NO: 1902859 - RNA, 17 nt, Homo sapiens
cuuguacccagcgcuaa

SEQ ID NO: 1902860 - RNA, 20 nt, Homo sapiens
acccuguccugcagucccac

SEQ ID NO: 1902861 - RNA, 17 nt, Homo sapiens
aagacugugcugagaag

SEQ ID NO: 1902862 - RNA, 22 nt, Homo sapiens
auccuucuccaccaaagacagu

SEQ ID NO: 1902863 - RNA, 17 nt, Homo sapiens
gcccaucugcacagugg

SEQ ID NO: 1902864 - RNA, 17 nt, Homo sapiens
cuagcaucucaugagug

SEQ ID NO: 1902865 - RNA, 15 nt, Homo sapiens
uuccuuggcuuuaug

SEQ ID NO: 1902866 - RNA, 20 nt, Homo sapiens
ucucagugcuuugcauguau

SEQ ID NO: 1902867 - RNA, 15 nt, Homo sapiens
cuacugagacaugac

SEQ ID NO: 1902868 - RNA, 17 nt, Homo sapiens
uacaggaggcagacaau

SEQ ID NO: 1902869 - RNA, 19 nt, Homo sapiens
uuaauauccaauugcugcu

SEQ ID NO: 1902870 - RNA, 21 nt, Homo sapiens
aaggcaguguuccucaccaau

SEQ ID NO: 1902871 - RNA, 15 nt, Homo sapiens
cuuucccuccuuugg

SEQ ID NO: 1902872 - RNA, 15 nt, Homo sapiens
uuggagcaaaccauu

SEQ ID NO: 1902873 - RNA, 15 nt, Homo sapiens
gcuccaguguccuga

SEQ ID NO: 1902874 - RNA, 20 nt, Homo sapiens
guuucugaaccauuacugua

SEQ ID NO: 1902875 - RNA, 15 nt, Homo sapiens
acaguccuauuuaga

SEQ ID NO: 1902876 - RNA, 17 nt, Homo sapiens
ccuaaggugcuuaccuc

SEQ ID NO: 1902877 - RNA, 18 nt, Homo sapiens
uaauguguuaagugcagg

SEQ ID NO: 1902878 - RNA, 21 nt, Homo sapiens
auagaugucuguguauacaua

SEQ ID NO: 1902879 - RNA, 19 nt, Homo sapiens
caucuuugucaguuuacac

SEQ ID NO: 1902880 - RNA, 20 nt, Homo sapiens
cagcagugagcuucuauuaa

SEQ ID NO: 1902881 - RNA, 13 nt, Homo sapiens
ccuauguucacuc

SEQ ID NO: 1902882 - RNA, 15 nt, Homo sapiens
ggcaguccagccagc

SEQ ID NO: 1902883 - RNA, 17 nt, Homo sapiens
auuucuagaacccguga

SEQ ID NO: 1902884 - RNA, 13 nt, Homo sapiens
ugaaaauguguuc

SEQ ID NO: 1902885 - RNA, 21 nt, Homo sapiens
aagaacccaagugccucaccu

SEQ ID NO: 1902886 - RNA, 18 nt, Homo sapiens
gugccauuguacuccagc

SEQ ID NO: 1902887 - RNA, 22 nt, Homo sapiens
gucauucaguuaucacuacaga

SEQ ID NO: 1902888 - RNA, 22 nt, Homo sapiens
ccauuuacacuuuugagacuuu

SEQ ID NO: 1902889 - RNA, 19 nt, Homo sapiens
uuaaaaguauacaugucaa

SEQ ID NO: 1902890 - RNA, 21 nt, Homo sapiens
caaacucacugcucaagaaga

SEQ ID NO: 1902891 - RNA, 22 nt, Homo sapiens
ugaacguccuuccuugacuguc

SEQ ID NO: 1902892 - RNA, 13 nt, Homo sapiens
ugaagauacugaa

SEQ ID NO: 1902893 - RNA, 20 nt, Homo sapiens
cugccaacacgcccggcuaa

SEQ ID NO: 1902894 - RNA, 19 nt, Homo sapiens
gaccuuggaggaaugacaa

SEQ ID NO: 1902895 - RNA, 21 nt, Homo sapiens
agaugguggccacagacugac

SEQ ID NO: 1902896 - RNA, 22 nt, Homo sapiens
cacauauuuugacccaagugga

SEQ ID NO: 1902897 - RNA, 16 nt, Homo sapiens
auuucugugaagcaaa

SEQ ID NO: 1902898 - RNA, 15 nt, Homo sapiens
uaagacacaccucug

SEQ ID NO: 1902899 - RNA, 15 nt, Homo sapiens
guccuuaccucgggg

SEQ ID NO: 1902900 - RNA, 21 nt, Homo sapiens
accuuuauagcucucaucacu

SEQ ID NO: 1902901 - RNA, 15 nt, Homo sapiens
aauuuccagaacugc

SEQ ID NO: 1902902 - RNA, 14 nt, Homo sapiens
augguaaaccagau

SEQ ID NO: 1902903 - RNA, 14 nt, Homo sapiens
gagggaaagugcau

SEQ ID NO: 1902904 - RNA, 21 nt, Homo sapiens
aguccaggcacaggaugcugu

SEQ ID NO: 1902905 - RNA, 23 nt, Homo sapiens
acugcuguaacugguaguguuca

SEQ ID NO: 1902906 - RNA, 22 nt, Homo sapiens
auuuuccauuaaaagccauauu

SEQ ID NO: 1902907 - RNA, 15 nt, Homo sapiens
gaacacucaugcuga

SEQ ID NO: 1902908 - RNA, 12 nt, Homo sapiens
ggucacugccca

SEQ ID NO: 1902909 - RNA, 22 nt, Homo sapiens
ccucaugagggcuggaugcucu

SEQ ID NO: 1902910 - RNA, 15 nt, Homo sapiens
auucuguuaucucag

SEQ ID NO: 1902911 - RNA, 17 nt, Homo sapiens
cuccuccccuccuugca

SEQ ID NO: 1902912 - RNA, 18 nt, Homo sapiens
ugaccccugcccaccucu

SEQ ID NO: 1902913 - RNA, 11 nt, Homo sapiens
gaaggcugugc

SEQ ID NO: 1902914 - RNA, 16 nt, Homo sapiens
cuuuuaacuucaccuu

SEQ ID NO: 1902915 - RNA, 12 nt, Homo sapiens
cuaagcuccuag

SEQ ID NO: 1902916 - RNA, 22 nt, Homo sapiens
cagugccccauucucacugcua

SEQ ID NO: 1902917 - RNA, 13 nt, Homo sapiens
guucacugcagua

SEQ ID NO: 1902918 - RNA, 23 nt, Homo sapiens
acucucauuccccagguggcuga

SEQ ID NO: 1902919 - RNA, 19 nt, Homo sapiens
agaaccucuaagugcugcu

SEQ ID NO: 1902920 - RNA, 16 nt, Homo sapiens
aggaaaacuacugaua

SEQ ID NO: 1902921 - RNA, 18 nt, Homo sapiens
cuggagucuggcuuuacc

SEQ ID NO: 1902922 - RNA, 16 nt, Homo sapiens
acccacugcccauggc

SEQ ID NO: 1902923 - RNA, 22 nt, Homo sapiens
cacgucuccuccucgaagccau

SEQ ID NO: 1902924 - RNA, 21 nt, Homo sapiens
uuagaagauaaaaguacauaa

SEQ ID NO: 1902925 - RNA, 23 nt, Homo sapiens
acuuggggagauggaguucuugu

SEQ ID NO: 1902926 - RNA, 22 nt, Homo sapiens
uugguaauugguuuuaugcauu

SEQ ID NO: 1902927 - RNA, 17 nt, Homo sapiens
ugagucauauugaggca

SEQ ID NO: 1902928 - RNA, 14 nt, Homo sapiens
gcugcugcugcacc

SEQ ID NO: 1902929 - RNA, 20 nt, Homo sapiens
uucaacgaggcagucaccgc

SEQ ID NO: 1902930 - RNA, 22 nt, Homo sapiens
ccaaaaccucaguuaaacugug

SEQ ID NO: 1902931 - RNA, 19 nt, Homo sapiens
uaaaacuuuucugcugaua

SEQ ID NO: 1902932 - RNA, 16 nt, Homo sapiens
cuuaaaugaucaagga

SEQ ID NO: 1902933 - RNA, 16 nt, Homo sapiens
aaccccaagaguuucu

SEQ ID NO: 1902934 - RNA, 13 nt, Homo sapiens
uaugcacaaacuu

SEQ ID NO: 1902935 - RNA, 22 nt, Homo sapiens
ugaaacccuuguauaaguaaua

SEQ ID NO: 1902936 - RNA, 15 nt, Homo sapiens
ucuaucaaagcacau

SEQ ID NO: 1902937 - RNA, 13 nt, Homo sapiens
acagucaucauuu

SEQ ID NO: 1902938 - RNA, 14 nt, Homo sapiens
ucagacaagcacua

SEQ ID NO: 1902939 - RNA, 15 nt, Homo sapiens
acuuccgagcuaugu

SEQ ID NO: 1902940 - RNA, 12 nt, Homo sapiens
cagagcaauggu

SEQ ID NO: 1902941 - RNA, 16 nt, Homo sapiens
aauccagacccggcug

SEQ ID NO: 1902942 - RNA, 15 nt, Homo sapiens
guaaaacauuacuua

SEQ ID NO: 1902943 - RNA, 15 nt, Homo sapiens
uuaauuaaguacaac

SEQ ID NO: 1902944 - RNA, 17 nt, Homo sapiens
aaugagaccaaagucca

SEQ ID NO: 1902945 - RNA, 23 nt, Homo sapiens
gcagcugucauggaaaagcccag

SEQ ID NO: 1902946 - RNA, 17 nt, Homo sapiens
ccaagccugauacuuua

SEQ ID NO: 1902947 - RNA, 15 nt, Homo sapiens
guuaucccugcacac

SEQ ID NO: 1902948 - RNA, 20 nt, Homo sapiens
gcacaaagauggauguaaug

SEQ ID NO: 1902949 - RNA, 17 nt, Homo sapiens
ggccuuugggauuugcc

SEQ ID NO: 1902950 - RNA, 20 nt, Homo sapiens
gcacccauccgcuccgugac

SEQ ID NO: 1902951 - RNA, 21 nt, Homo sapiens
agaggagcccagcggcccaag

SEQ ID NO: 1902952 - RNA, 17 nt, Homo sapiens
agguguaacacuuguca

SEQ ID NO: 1902953 - RNA, 21 nt, Homo sapiens
acuacaccuggcugagguucc

SEQ ID NO: 1902954 - RNA, 12 nt, Homo sapiens
ccauaauuguuc

SEQ ID NO: 1902955 - RNA, 15 nt, Homo sapiens
aagaauuuaucucuu

SEQ ID NO: 1902956 - RNA, 20 nt, Homo sapiens
uuagaauaaaucaaauauuc

SEQ ID NO: 1902957 - RNA, 21 nt, Homo sapiens
aaucagcuuaaaauccaaagu

SEQ ID NO: 1902958 - RNA, 17 nt, Homo sapiens
cucaucucuacuaaaau

SEQ ID NO: 1902959 - RNA, 19 nt, Homo sapiens
cagauuaugaguuacuguu

SEQ ID NO: 1902960 - RNA, 22 nt, Homo sapiens
cagcucuucagguuugcaaggg

SEQ ID NO: 1902961 - RNA, 18 nt, Homo sapiens
cuauuacuuuucaucuaa

SEQ ID NO: 1902962 - RNA, 19 nt, Homo sapiens
acuuuacuaaguaaucuca

SEQ ID NO: 1902963 - RNA, 13 nt, Homo sapiens
ccuuucuccagug

SEQ ID NO: 1902964 - RNA, 21 nt, Homo sapiens
ucccauggaucaucaagguga

SEQ ID NO: 1902965 - RNA, 20 nt, Homo sapiens
uugucacaaauaaacauaau

SEQ ID NO: 1902966 - RNA, 20 nt, Homo sapiens
uuguauguuuuucuguauaa

SEQ ID NO: 1902967 - RNA, 14 nt, Homo sapiens
ccugccuggucucu

SEQ ID NO: 1902968 - RNA, 16 nt, Homo sapiens
aauauugaaaggcaaa

SEQ ID NO: 1902969 - RNA, 14 nt, Homo sapiens
ccuccuccaugcug

SEQ ID NO: 1902970 - RNA, 16 nt, Homo sapiens
auaaauauugcuccag

SEQ ID NO: 1902971 - RNA, 17 nt, Homo sapiens
auagaaccaacccaaac

SEQ ID NO: 1902972 - RNA, 15 nt, Homo sapiens
cuucucaagcacuga

SEQ ID NO: 1902973 - RNA, 17 nt, Homo sapiens
cugacgcagcacaagcu

SEQ ID NO: 1902974 - RNA, 16 nt, Homo sapiens
uucucacuccaccacc

SEQ ID NO: 1902975 - RNA, 23 nt, Homo sapiens
ugcauuuuguuucacucuuucca

SEQ ID NO: 1902976 - RNA, 21 nt, Homo sapiens
agagaaaaaaaauuaagacaa

SEQ ID NO: 1902977 - RNA, 17 nt, Homo sapiens
agacccgauuccaccaa

SEQ ID NO: 1902978 - RNA, 16 nt, Homo sapiens
ucuaaagccaagcacu

SEQ ID NO: 1902979 - RNA, 16 nt, Homo sapiens
cauccauccauugugu

SEQ ID NO: 1902980 - RNA, 15 nt, Homo sapiens
cucaaagaucugaau

SEQ ID NO: 1902981 - RNA, 16 nt, Homo sapiens
uguuucuuuugguucc

SEQ ID NO: 1902982 - RNA, 17 nt, Homo sapiens
ccucagaacaaugaaaa

SEQ ID NO: 1902983 - RNA, 21 nt, Homo sapiens
cccaaggaaagggucagguua

SEQ ID NO: 1902984 - RNA, 19 nt, Homo sapiens
ucugaaaggguuuuuaauc

SEQ ID NO: 1902985 - RNA, 15 nt, Homo sapiens
cugaacaugccugcc

SEQ ID NO: 1902986 - RNA, 18 nt, Homo sapiens
auuuauuuacaugugauu

SEQ ID NO: 1902987 - RNA, 17 nt, Homo sapiens
uagagauaugcacacac

SEQ ID NO: 1902988 - RNA, 22 nt, Homo sapiens
gugcucuuguuuugucuugaaa

SEQ ID NO: 1902989 - RNA, 16 nt, Homo sapiens
ugaaauuaaaugccac

SEQ ID NO: 1902990 - RNA, 20 nt, Homo sapiens
uguaugagagggcccugccu

SEQ ID NO: 1902991 - RNA, 16 nt, Homo sapiens
aaaguguucauuguuu

SEQ ID NO: 1902992 - RNA, 18 nt, Homo sapiens
uagucucuaucauuaaag

SEQ ID NO: 1902993 - RNA, 18 nt, Homo sapiens
uccaagcaaguagcuuuc

SEQ ID NO: 1902994 - RNA, 23 nt, Homo sapiens
uuuauuuaaggggaauuaacaau

SEQ ID NO: 1902995 - RNA, 12 nt, Homo sapiens
aaaggugguggu

SEQ ID NO: 1902996 - RNA, 19 nt, Homo sapiens
gaguacaaaguaagccaug

SEQ ID NO: 1902997 - RNA, 16 nt, Homo sapiens
caacaacaaaaaaccu

SEQ ID NO: 1902998 - RNA, 20 nt, Homo sapiens
gauugcgccauugcacucca

SEQ ID NO: 1902999 - RNA, 13 nt, Homo sapiens
aaacaauuucacc

SEQ ID NO: 1903000 - RNA, 19 nt, Homo sapiens
auaaauucuacuaaguuau

SEQ ID NO: 1903001 - RNA, 22 nt, Homo sapiens
uguaauuaauaacuuucucugu

SEQ ID NO: 1903002 - RNA, 14 nt, Homo sapiens
auggucacccucag

SEQ ID NO: 1903003 - RNA, 13 nt, Homo sapiens
uaauauaccccaa

SEQ ID NO: 1903004 - RNA, 20 nt, Homo sapiens
cuggcucacuggcaggugug

SEQ ID NO: 1903005 - RNA, 17 nt, Homo sapiens
cacagcccugcucauuc

SEQ ID NO: 1903006 - RNA, 14 nt, Homo sapiens
ucuuguuuugccaa

SEQ ID NO: 1903007 - RNA, 20 nt, Homo sapiens
uugaagaaaggaacugaggc

SEQ ID NO: 1903008 - RNA, 21 nt, Homo sapiens
gucccugagaacccaaacuuc

SEQ ID NO: 1903009 - RNA, 13 nt, Homo sapiens
cacugugaccucc

SEQ ID NO: 1903010 - RNA, 16 nt, Homo sapiens
ccuuuaaaauuuacca

SEQ ID NO: 1903011 - RNA, 12 nt, Homo sapiens
acauuacaauca

SEQ ID NO: 1903012 - RNA, 23 nt, Homo sapiens
caauggaaacuguaccauacaca

SEQ ID NO: 1903013 - RNA, 19 nt, Homo sapiens
auaaauugcauaaagcaua

SEQ ID NO: 1903014 - RNA, 16 nt, Homo sapiens
gugaauaauggcacug

SEQ ID NO: 1903015 - RNA, 19 nt, Homo sapiens
agaaaucauuauugaguca

SEQ ID NO: 1903016 - RNA, 18 nt, Homo sapiens
aaugcaaccaagucacac

SEQ ID NO: 1903017 - RNA, 18 nt, Homo sapiens
gcgaagggugguuugcag

SEQ ID NO: 1903018 - RNA, 18 nt, Homo sapiens
ggcugcuguggggaccac

SEQ ID NO: 1903019 - RNA, 17 nt, Homo sapiens
cucccuacaggcccacc

SEQ ID NO: 1903020 - RNA, 16 nt, Homo sapiens
aagauucuacuuggug

SEQ ID NO: 1903021 - RNA, 22 nt, Homo sapiens
gggauuacccaagcaaaaucau

SEQ ID NO: 1903022 - RNA, 18 nt, Homo sapiens
ggacaccugccauggaca

SEQ ID NO: 1903023 - RNA, 14 nt, Homo sapiens
ucccgucugucugu

SEQ ID NO: 1903024 - RNA, 22 nt, Homo sapiens
uaauggggugagcucacaacca

SEQ ID NO: 1903025 - RNA, 12 nt, Homo sapiens
ccuagacuguua

SEQ ID NO: 1903026 - RNA, 18 nt, Homo sapiens
auagaggauggucuuaca

SEQ ID NO: 1903027 - RNA, 16 nt, Homo sapiens
agaaaggcauugcaca

SEQ ID NO: 1903028 - RNA, 15 nt, Homo sapiens
cuaaagcagacuuuu

SEQ ID NO: 1903029 - RNA, 14 nt, Homo sapiens
augauauacuauga

SEQ ID NO: 1903030 - RNA, 18 nt, Homo sapiens
uugucagcugcagccacu

SEQ ID NO: 1903031 - RNA, 11 nt, Homo sapiens
cacaguggaua

SEQ ID NO: 1903032 - RNA, 18 nt, Homo sapiens
gaagauuauaaaagccaa

SEQ ID NO: 1903033 - RNA, 16 nt, Homo sapiens
acagugccaccaagcu

SEQ ID NO: 1903034 - RNA, 13 nt, Homo sapiens
auagauccagugc

SEQ ID NO: 1903035 - RNA, 21 nt, Homo sapiens
uggcuuuuuuccuccugugua

SEQ ID NO: 1903036 - RNA, 17 nt, Homo sapiens
ugaauaauguagugcag

SEQ ID NO: 1903037 - RNA, 13 nt, Homo sapiens
gaagcugcucaac

SEQ ID NO: 1903038 - RNA, 22 nt, Homo sapiens
ccucccuccuuuccuuugcccu

SEQ ID NO: 1903039 - RNA, 19 nt, Homo sapiens
uccauaaacacccaugaau

SEQ ID NO: 1903040 - RNA, 16 nt, Homo sapiens
cucaaaacugagccau

SEQ ID NO: 1903041 - RNA, 21 nt, Homo sapiens
uccugguuugaagaaauaaca

SEQ ID NO: 1903042 - RNA, 17 nt, Homo sapiens
uuauuuuugaaacaaac

SEQ ID NO: 1903043 - RNA, 16 nt, Homo sapiens
cuuggcggcucuagcc

SEQ ID NO: 1903044 - RNA, 16 nt, Homo sapiens
gagcccccugugccca

SEQ ID NO: 1903045 - RNA, 14 nt, Homo sapiens
cgguuaaauacugu

SEQ ID NO: 1903046 - RNA, 12 nt, Homo sapiens
ugugaauacugc

SEQ ID NO: 1903047 - RNA, 18 nt, Homo sapiens
ucuaauccuugcuauuaa

SEQ ID NO: 1903048 - RNA, 13 nt, Homo sapiens
cacagucacuggc

SEQ ID NO: 1903049 - RNA, 17 nt, Homo sapiens
gccuugaucagugacag

SEQ ID NO: 1903050 - RNA, 21 nt, Homo sapiens
cucugauugggucagcuggcu

SEQ ID NO: 1903051 - RNA, 15 nt, Homo sapiens
gaaggguaaacaaua

SEQ ID NO: 1903052 - RNA, 16 nt, Homo sapiens
ccauggccacaauccc

SEQ ID NO: 1903053 - RNA, 17 nt, Homo sapiens
gcaccaaauucauguac

SEQ ID NO: 1903054 - RNA, 15 nt, Homo sapiens
gggcugccagcccag

SEQ ID NO: 1903055 - RNA, 17 nt, Homo sapiens
cccuucuuugcacuuuu

SEQ ID NO: 1903056 - RNA, 17 nt, Homo sapiens
agcucuuccccaucuca

SEQ ID NO: 1903057 - RNA, 18 nt, Homo sapiens
uucacagcgugcuaaaau

SEQ ID NO: 1903058 - RNA, 12 nt, Homo sapiens
aagagugcuaca

SEQ ID NO: 1903059 - RNA, 21 nt, Homo sapiens
accuuucagauaacuguuauu

SEQ ID NO: 1903060 - RNA, 19 nt, Homo sapiens
cuugcuggaccugaauucu

SEQ ID NO: 1903061 - RNA, 16 nt, Homo sapiens
uggcgcgaucucagcu

SEQ ID NO: 1903062 - RNA, 16 nt, Homo sapiens
aucuguaacccuugaa

SEQ ID NO: 1903063 - RNA, 21 nt, Homo sapiens
guacaaaauacguuuuguaaa

SEQ ID NO: 1903064 - RNA, 17 nt, Homo sapiens
aauucaugaagugaauu

SEQ ID NO: 1903065 - RNA, 12 nt, Homo sapiens
aucucauuacag

SEQ ID NO: 1903066 - RNA, 15 nt, Homo sapiens
agaauuauuugcacu

SEQ ID NO: 1903067 - RNA, 24 nt, Homo sapiens
ccuucuggggguguaucacaguca

SEQ ID NO: 1903068 - RNA, 17 nt, Homo sapiens
guaagacagugcccuga

SEQ ID NO: 1903069 - RNA, 17 nt, Homo sapiens
caguguuaccuggugua

SEQ ID NO: 1903070 - RNA, 13 nt, Homo sapiens
cauaaauuacuuu

SEQ ID NO: 1903071 - RNA, 17 nt, Homo sapiens
uuuuuaaucugcauuua

SEQ ID NO: 1903072 - RNA, 17 nt, Homo sapiens
agugcccucgagcacug

SEQ ID NO: 1903073 - RNA, 16 nt, Homo sapiens
acaagagcgagacucc

SEQ ID NO: 1903074 - RNA, 18 nt, Homo sapiens
caugccucagccucucaa

SEQ ID NO: 1903075 - RNA, 17 nt, Homo sapiens
uaauauaguuauugcac

SEQ ID NO: 1903076 - RNA, 23 nt, Homo sapiens
aaagauaaucucucagcuuuuaa

SEQ ID NO: 1903077 - RNA, 22 nt, Homo sapiens
gcaaaugacuaguaaacaugug

SEQ ID NO: 1903078 - RNA, 23 nt, Homo sapiens
uccuuaauaacaacagaucugca

SEQ ID NO: 1903079 - RNA, 17 nt, Homo sapiens
gcaaggggacauuccag

SEQ ID NO: 1903080 - RNA, 21 nt, Homo sapiens
ucaagggaauguaacugcuga

SEQ ID NO: 1903081 - RNA, 19 nt, Homo sapiens
cugagacacaugggugcua

SEQ ID NO: 1903082 - RNA, 15 nt, Homo sapiens
aggcaaccagaggaa

SEQ ID NO: 1903083 - RNA, 13 nt, Homo sapiens
acuuccugcagua

SEQ ID NO: 1903084 - RNA, 20 nt, Homo sapiens
gagugcagaucugugcucau

SEQ ID NO: 1903085 - RNA, 19 nt, Homo sapiens
gcuuucuaggccacuggga

SEQ ID NO: 1903086 - RNA, 17 nt, Homo sapiens
cggagccuccucucuca

SEQ ID NO: 1903087 - RNA, 19 nt, Homo sapiens
gaguuucacaaauccuuca

SEQ ID NO: 1903088 - RNA, 13 nt, Homo sapiens
aauuuuaauugau

SEQ ID NO: 1903089 - RNA, 19 nt, Homo sapiens
ccugcuagucacuggaaau

SEQ ID NO: 1903090 - RNA, 16 nt, Homo sapiens
ggacuagaugacucuc

SEQ ID NO: 1903091 - RNA, 14 nt, Homo sapiens
gacacuuaagccau

SEQ ID NO: 1903092 - RNA, 15 nt, Homo sapiens
cugaaaaaaugccaa

SEQ ID NO: 1903093 - RNA, 18 nt, Homo sapiens
uagcuuaaaccaacaaua

SEQ ID NO: 1903094 - RNA, 17 nt, Homo sapiens
gcaggagaauuacuuga

SEQ ID NO: 1903095 - RNA, 12 nt, Homo sapiens
aaauaaauuucc

SEQ ID NO: 1903096 - RNA, 21 nt, Homo sapiens
guauucagguaacucauuuac

SEQ ID NO: 1903097 - RNA, 17 nt, Homo sapiens
caccaagcuaggugcua

SEQ ID NO: 1903098 - RNA, 18 nt, Homo sapiens
cuggucuugaacuccuaa

SEQ ID NO: 1903099 - RNA, 20 nt, Homo sapiens
cauuagcauucugguuuuga

SEQ ID NO: 1903100 - RNA, 20 nt, Homo sapiens
aaugcaagauaguuuaucua

SEQ ID NO: 1903101 - RNA, 18 nt, Homo sapiens
uaaauucaaauuauucua

SEQ ID NO: 1903102 - RNA, 19 nt, Homo sapiens
agaaaguuggugcugcuca

SEQ ID NO: 1903103 - RNA, 14 nt, Homo sapiens
aucucucuacucag

SEQ ID NO: 1903104 - RNA, 15 nt, Homo sapiens
cauauuuuguuauag

SEQ ID NO: 1903105 - RNA, 18 nt, Homo sapiens
agaaguggggcucuggga

SEQ ID NO: 1903106 - RNA, 13 nt, Homo sapiens
ggaagcuagcucc

SEQ ID NO: 1903107 - RNA, 17 nt, Homo sapiens
ugcugucacaaccaaga

SEQ ID NO: 1903108 - RNA, 12 nt, Homo sapiens
aauagcaauaac

SEQ ID NO: 1903109 - RNA, 16 nt, Homo sapiens
acuuacuuauucuucc

SEQ ID NO: 1903110 - RNA, 17 nt, Homo sapiens
ccuuugaaagacugugc

SEQ ID NO: 1903111 - RNA, 21 nt, Homo sapiens
acuuuugaagucuucccucag

SEQ ID NO: 1903112 - RNA, 22 nt, Homo sapiens
ccccacacugaccuguguuccc

SEQ ID NO: 1903113 - RNA, 21 nt, Homo sapiens
gugccugaaauuucaccauug

SEQ ID NO: 1903114 - RNA, 23 nt, Homo sapiens
ugagaaaagcuagguguuuaaua

SEQ ID NO: 1903115 - RNA, 11 nt, Homo sapiens
aaguuucacau

SEQ ID NO: 1903116 - RNA, 17 nt, Homo sapiens
agguugagacuacuuaa

SEQ ID NO: 1903117 - RNA, 22 nt, Homo sapiens
augacgccugucugugugcauc

SEQ ID NO: 1903118 - RNA, 21 nt, Homo sapiens
auugacugggcaacacugcag

SEQ ID NO: 1903119 - RNA, 12 nt, Homo sapiens
cugauccugcug

SEQ ID NO: 1903120 - RNA, 16 nt, Homo sapiens
caagaaaucagccaua

SEQ ID NO: 1903121 - RNA, 23 nt, Homo sapiens
aaggguuucgacugguccagcuc

SEQ ID NO: 1903122 - RNA, 14 nt, Homo sapiens
aggguaaauucucu

SEQ ID NO: 1903123 - RNA, 19 nt, Homo sapiens
cagcgucccgcguagcugg

SEQ ID NO: 1903124 - RNA, 14 nt, Homo sapiens
acuucuaccugccc

SEQ ID NO: 1903125 - RNA, 20 nt, Homo sapiens
cucucgccucauuacuguga

SEQ ID NO: 1903126 - RNA, 22 nt, Homo sapiens
cuacaugcaauuuagaacuaga

SEQ ID NO: 1903127 - RNA, 17 nt, Homo sapiens
acaccguguccaaaaag

SEQ ID NO: 1903128 - RNA, 20 nt, Homo sapiens
uucccaauaaaagugacucu

SEQ ID NO: 1903129 - RNA, 21 nt, Homo sapiens
aaugcaggauuggaccaugaa

SEQ ID NO: 1903130 - RNA, 15 nt, Homo sapiens
auugcuugagcucag

SEQ ID NO: 1903131 - RNA, 13 nt, Homo sapiens
agcgaccacugca

SEQ ID NO: 1903132 - RNA, 16 nt, Homo sapiens
acaaacaaacauuguu

SEQ ID NO: 1903133 - RNA, 13 nt, Homo sapiens
agcauaacuggag

SEQ ID NO: 1903134 - RNA, 17 nt, Homo sapiens
aggcgugggacgugguc

SEQ ID NO: 1903135 - RNA, 18 nt, Homo sapiens
ucuggccaaaagcaguaa

SEQ ID NO: 1903136 - RNA, 18 nt, Homo sapiens
ucaggccaggugcagugg

SEQ ID NO: 1903137 - RNA, 12 nt, Homo sapiens
auuuucaugaaa

SEQ ID NO: 1903138 - RNA, 15 nt, Homo sapiens
ucuggagcuugucac

SEQ ID NO: 1903139 - RNA, 19 nt, Homo sapiens
agaaucugcauuuagcaca

SEQ ID NO: 1903140 - RNA, 12 nt, Homo sapiens
gcuccacucuga

SEQ ID NO: 1903141 - RNA, 15 nt, Homo sapiens
auucuguuguguuca

SEQ ID NO: 1903142 - RNA, 16 nt, Homo sapiens
cucccuccaccucccu

SEQ ID NO: 1903143 - RNA, 22 nt, Homo sapiens
ccuuuacgguccaugccuuuaa

SEQ ID NO: 1903144 - RNA, 22 nt, Homo sapiens
aaaguuuaacaaaugacuguau

SEQ ID NO: 1903145 - RNA, 19 nt, Homo sapiens
cgugcugcaugccuggucu

SEQ ID NO: 1903146 - RNA, 14 nt, Homo sapiens
uuuauaaucuauau

SEQ ID NO: 1903147 - RNA, 20 nt, Homo sapiens
uguauuuggacuaugcaugu

SEQ ID NO: 1903148 - RNA, 19 nt, Homo sapiens
acugcgcacugaguacaaa

SEQ ID NO: 1903149 - RNA, 21 nt, Homo sapiens
ucugcaggcuucagccaucca

SEQ ID NO: 1903150 - RNA, 20 nt, Homo sapiens
cucuggacacucuauaugua

SEQ ID NO: 1903151 - RNA, 11 nt, Homo sapiens
gccuggugggc

SEQ ID NO: 1903152 - RNA, 19 nt, Homo sapiens
aaaugcuuuaacagcugau

SEQ ID NO: 1903153 - RNA, 17 nt, Homo sapiens
uguugguuuuguuucca

SEQ ID NO: 1903154 - RNA, 21 nt, Homo sapiens
acauuugauuauauacuaugu

SEQ ID NO: 1903155 - RNA, 22 nt, Homo sapiens
uuaaugaagacccaguguaaag

SEQ ID NO: 1903156 - RNA, 13 nt, Homo sapiens
agcaggagcaaaa

SEQ ID NO: 1903157 - RNA, 14 nt, Homo sapiens
gcuugccucagggc

SEQ ID NO: 1903158 - RNA, 12 nt, Homo sapiens
ugaggcuucuaa

SEQ ID NO: 1903159 - RNA, 17 nt, Homo sapiens
cuccauacaguguacuc

SEQ ID NO: 1903160 - RNA, 16 nt, Homo sapiens
uuauaaauaauguuca

SEQ ID NO: 1903161 - RNA, 13 nt, Homo sapiens
aggcuaaaugcac

SEQ ID NO: 1903162 - RNA, 20 nt, Homo sapiens
uucuuuaacccucacuggga

SEQ ID NO: 1903163 - RNA, 20 nt, Homo sapiens
cuauuaaaacagccaaaacu

SEQ ID NO: 1903164 - RNA, 14 nt, Homo sapiens
cucaaaauauguca

SEQ ID NO: 1903165 - RNA, 18 nt, Homo sapiens
uuaacagcaggugugacc

SEQ ID NO: 1903166 - RNA, 21 nt, Homo sapiens
ucauuuagugcccucuuuagc

SEQ ID NO: 1903167 - RNA, 13 nt, Homo sapiens
cuccuuccagacc

SEQ ID NO: 1903168 - RNA, 22 nt, Homo sapiens
ucucacuaguugucagcuucuc

SEQ ID NO: 1903169 - RNA, 22 nt, Homo sapiens
aucagggggcaugaagcacauu

SEQ ID NO: 1903170 - RNA, 16 nt, Homo sapiens
gccagacucugucuca

SEQ ID NO: 1903171 - RNA, 13 nt, Homo sapiens
uuaguuuugcaua

SEQ ID NO: 1903172 - RNA, 18 nt, Homo sapiens
uccccauauuuguguuca

SEQ ID NO: 1903173 - RNA, 23 nt, Homo sapiens
ucagcugggaugacuggcuuuga

SEQ ID NO: 1903174 - RNA, 17 nt, Homo sapiens
ggcaggggugcugugga

SEQ ID NO: 1903175 - RNA, 22 nt, Homo sapiens
gcagagccuacagaagggcagu

SEQ ID NO: 1903176 - RNA, 16 nt, Homo sapiens
uaaauggugggaaccc

SEQ ID NO: 1903177 - RNA, 16 nt, Homo sapiens
aagaauauaaagccuc

SEQ ID NO: 1903178 - RNA, 17 nt, Homo sapiens
cauuggccgacaucaca

SEQ ID NO: 1903179 - RNA, 17 nt, Homo sapiens
gcaaaugaauggcucac

SEQ ID NO: 1903180 - RNA, 14 nt, Homo sapiens
acaggcaguguucu

SEQ ID NO: 1903181 - RNA, 18 nt, Homo sapiens
cuauuuuuagcaauguuu

SEQ ID NO: 1903182 - RNA, 15 nt, Homo sapiens
cacuaucauggacua

SEQ ID NO: 1903183 - RNA, 15 nt, Homo sapiens
uuuaaauuguuucau

SEQ ID NO: 1903184 - RNA, 15 nt, Homo sapiens
uucaaaaugucucaa

SEQ ID NO: 1903185 - RNA, 13 nt, Homo sapiens
ggugucugcagcu

SEQ ID NO: 1903186 - RNA, 20 nt, Homo sapiens
ccucauggaauuggagcucg

SEQ ID NO: 1903187 - RNA, 22 nt, Homo sapiens
gaggccguggcucugaugcuga

SEQ ID NO: 1903188 - RNA, 18 nt, Homo sapiens
acucacauauaacaugca

SEQ ID NO: 1903189 - RNA, 22 nt, Homo sapiens
uacuucugucuuccuucauuau

SEQ ID NO: 1903190 - RNA, 17 nt, Homo sapiens
cagcagaugccagugaa

SEQ ID NO: 1903191 - RNA, 16 nt, Homo sapiens
ccugguaauagcugua

SEQ ID NO: 1903192 - RNA, 13 nt, Homo sapiens
acacacacaucca

SEQ ID NO: 1903193 - RNA, 22 nt, Homo sapiens
cccacugaguuugcuguuugca

SEQ ID NO: 1903194 - RNA, 20 nt, Homo sapiens
ucuaccuaggaugcaugaca

SEQ ID NO: 1903195 - RNA, 12 nt, Homo sapiens
ccuagagugcag

SEQ ID NO: 1903196 - RNA, 16 nt, Homo sapiens
auucacucauacaucu

SEQ ID NO: 1903197 - RNA, 15 nt, Homo sapiens
uacggagaaacucau

SEQ ID NO: 1903198 - RNA, 14 nt, Homo sapiens
aacaaagacauuua

SEQ ID NO: 1903199 - RNA, 13 nt, Homo sapiens
ucuuuaaacuaua

SEQ ID NO: 1903200 - RNA, 18 nt, Homo sapiens
uuaauuacccuacuuuca

SEQ ID NO: 1903201 - RNA, 16 nt, Homo sapiens
cuggucuucacugcca

SEQ ID NO: 1903202 - RNA, 18 nt, Homo sapiens
acauggucaaaauuucac

SEQ ID NO: 1903203 - RNA, 20 nt, Homo sapiens
ccugccugagaauguuacca

SEQ ID NO: 1903204 - RNA, 13 nt, Homo sapiens
cauuuaucauaua

SEQ ID NO: 1903205 - RNA, 18 nt, Homo sapiens
agauagguggugccagug

SEQ ID NO: 1903206 - RNA, 15 nt, Homo sapiens
uccacugugccaugu

SEQ ID NO: 1903207 - RNA, 23 nt, Homo sapiens
uaugggcagcccagugcugccac

SEQ ID NO: 1903208 - RNA, 17 nt, Homo sapiens
ggccgaaggcagugcaa

SEQ ID NO: 1903209 - RNA, 23 nt, Homo sapiens
ugcuuagcuugagggugacuaug

SEQ ID NO: 1903210 - RNA, 11 nt, Homo sapiens
guaacugcuga

SEQ ID NO: 1903211 - RNA, 19 nt, Homo sapiens
uguauagcuggcaccuuag

SEQ ID NO: 1903212 - RNA, 17 nt, Homo sapiens
uugacuuguauaccuug

SEQ ID NO: 1903213 - RNA, 23 nt, Homo sapiens
uggguuuugaacauaaagccuug

SEQ ID NO: 1903214 - RNA, 23 nt, Homo sapiens
ccaaagcuuuaucugucuugacu

SEQ ID NO: 1903215 - RNA, 19 nt, Homo sapiens
gcagaaaacagaggccaca

SEQ ID NO: 1903216 - RNA, 19 nt, Homo sapiens
gaaaaagauuguauuacuu

SEQ ID NO: 1903217 - RNA, 15 nt, Homo sapiens
cuuggggaccugaac

SEQ ID NO: 1903218 - RNA, 19 nt, Homo sapiens
aagacugucaaaugaacuu

SEQ ID NO: 1903219 - RNA, 15 nt, Homo sapiens
aaauccagugguggg

SEQ ID NO: 1903220 - RNA, 19 nt, Homo sapiens
uuaaccuaauaucacuuaa

SEQ ID NO: 1903221 - RNA, 15 nt, Homo sapiens
cgaaaaggauaugca

SEQ ID NO: 1903222 - RNA, 20 nt, Homo sapiens
ugguuucucguacuuucaca

SEQ ID NO: 1903223 - RNA, 21 nt, Homo sapiens
gagaucuuucuuuccaaaaca

SEQ ID NO: 1903224 - RNA, 19 nt, Homo sapiens
gugcacaggccucugccug

SEQ ID NO: 1903225 - RNA, 16 nt, Homo sapiens
agucugucacacucuc

SEQ ID NO: 1903226 - RNA, 12 nt, Homo sapiens
cuugaaaacugg

SEQ ID NO: 1903227 - RNA, 18 nt, Homo sapiens
uccuuaucuaguguuuga

SEQ ID NO: 1903228 - RNA, 14 nt, Homo sapiens
guaauuuaugcaag

SEQ ID NO: 1903229 - RNA, 16 nt, Homo sapiens
gcugagucaaucaaua

SEQ ID NO: 1903230 - RNA, 22 nt, Homo sapiens
aggugaaaagggcagaggcaag

SEQ ID NO: 1903231 - RNA, 23 nt, Homo sapiens
cugccuccuggguucaagcgauu

SEQ ID NO: 1903232 - RNA, 21 nt, Homo sapiens
uaauuaucggaagcagugccu

SEQ ID NO: 1903233 - RNA, 19 nt, Homo sapiens
ccauggucuucagcagaca

SEQ ID NO: 1903234 - RNA, 20 nt, Homo sapiens
augaucucaauagucaguua

SEQ ID NO: 1903235 - RNA, 16 nt, Homo sapiens
cugguugacuuucuaa

SEQ ID NO: 1903236 - RNA, 23 nt, Homo sapiens
uucugcacaauaauaaguccauc

SEQ ID NO: 1903237 - RNA, 21 nt, Homo sapiens
uucuccagggguuuacaguga

SEQ ID NO: 1903238 - RNA, 14 nt, Homo sapiens
caagauucuucagu

SEQ ID NO: 1903239 - RNA, 17 nt, Homo sapiens
auccgggucaagugaag

SEQ ID NO: 1903240 - RNA, 19 nt, Homo sapiens
ucaauaccaauuacaugga

SEQ ID NO: 1903241 - RNA, 15 nt, Homo sapiens
aggaaaagcuguucc

SEQ ID NO: 1903242 - RNA, 21 nt, Homo sapiens
aauguaaaauccuacagugaa

SEQ ID NO: 1903243 - RNA, 18 nt, Homo sapiens
uaggugcccgaguagcau

SEQ ID NO: 1903244 - RNA, 21 nt, Homo sapiens
cagcauggguccuugaugcca

SEQ ID NO: 1903245 - RNA, 21 nt, Homo sapiens
caacagaaguugaagcacaac

SEQ ID NO: 1903246 - RNA, 16 nt, Homo sapiens
cucagccuuccaaagu

SEQ ID NO: 1903247 - RNA, 22 nt, Homo sapiens
ggaaaaauaaucaaaagcuauu

SEQ ID NO: 1903248 - RNA, 15 nt, Homo sapiens
gauuuguauguuaaa

SEQ ID NO: 1903249 - RNA, 17 nt, Homo sapiens
auugaugaacugccaaa

SEQ ID NO: 1903250 - RNA, 22 nt, Homo sapiens
aaugugguaguacccagggcca

SEQ ID NO: 1903251 - RNA, 22 nt, Homo sapiens
aaauaugugcuugaaaugagaa

SEQ ID NO: 1903252 - RNA, 16 nt, Homo sapiens
uaaaaaucaaucacuu

SEQ ID NO: 1903253 - RNA, 20 nt, Homo sapiens
uuucauccaggcucccaaaa

SEQ ID NO: 1903254 - RNA, 13 nt, Homo sapiens
uaaagugaaggaa

SEQ ID NO: 1903255 - RNA, 20 nt, Homo sapiens
acugccaagccccugcccug

SEQ ID NO: 1903256 - RNA, 21 nt, Homo sapiens
ccuccacaaagcaaaggcagu

SEQ ID NO: 1903257 - RNA, 13 nt, Homo sapiens
caagcgugcugcc

SEQ ID NO: 1903258 - RNA, 20 nt, Homo sapiens
uauaguuaucaaucucuagu

SEQ ID NO: 1903259 - RNA, 21 nt, Homo sapiens
agguuuccuuuuggaacauuu

SEQ ID NO: 1903260 - RNA, 15 nt, Homo sapiens
uguaagcuguuuauu

SEQ ID NO: 1903261 - RNA, 23 nt, Homo sapiens
uucacggaaagugccugcaaaaa

SEQ ID NO: 1903262 - RNA, 21 nt, Homo sapiens
cuaguuuucagcugcucagaa

SEQ ID NO: 1903263 - RNA, 16 nt, Homo sapiens
aauggcccuguagcuc

SEQ ID NO: 1903264 - RNA, 15 nt, Homo sapiens
uaagagacacuccaa

SEQ ID NO: 1903265 - RNA, 21 nt, Homo sapiens
cucucccugggucuggggaca

SEQ ID NO: 1903266 - RNA, 21 nt, Homo sapiens
aaucauuuugauguauuauua

SEQ ID NO: 1903267 - RNA, 17 nt, Homo sapiens
ucagugucugccuuuaa

SEQ ID NO: 1903268 - RNA, 22 nt, Homo sapiens
uacuuuuggcauuuuacuguac

SEQ ID NO: 1903269 - RNA, 23 nt, Homo sapiens
agaggagccagacagacccugaa

SEQ ID NO: 1903270 - RNA, 21 nt, Homo sapiens
uaacauuuaaauuccacagau

SEQ ID NO: 1903271 - RNA, 13 nt, Homo sapiens
agaccacugccau

SEQ ID NO: 1903272 - RNA, 21 nt, Homo sapiens
uguuacccaggguggagugca

SEQ ID NO: 1903273 - RNA, 15 nt, Homo sapiens
cuggaaacauucagg

SEQ ID NO: 1903274 - RNA, 18 nt, Homo sapiens
acugccaaauaaacagcu

SEQ ID NO: 1903275 - RNA, 16 nt, Homo sapiens
cagugcuaaacuacug

SEQ ID NO: 1903276 - RNA, 14 nt, Homo sapiens
gccugaggcuguaa

SEQ ID NO: 1903277 - RNA, 15 nt, Homo sapiens
aagagaaacugugua

SEQ ID NO: 1903278 - RNA, 16 nt, Homo sapiens
gccacaaguucuuucc

SEQ ID NO: 1903279 - RNA, 16 nt, Homo sapiens
aauuuuuuaguuuccc

SEQ ID NO: 1903280 - RNA, 20 nt, Homo sapiens
ccuuacugagcgcaagccac

SEQ ID NO: 1903281 - RNA, 22 nt, Homo sapiens
uagcaucccccuggggcacuug

SEQ ID NO: 1903282 - RNA, 15 nt, Homo sapiens
cauccccaccuucca

SEQ ID NO: 1903283 - RNA, 23 nt, Homo sapiens
uggaccauaaccccggaagccaa

SEQ ID NO: 1903284 - RNA, 14 nt, Homo sapiens
uuaguuuucuagua

SEQ ID NO: 1903285 - RNA, 14 nt, Homo sapiens
uuggaauucuggau

SEQ ID NO: 1903286 - RNA, 22 nt, Homo sapiens
aacugcauugguuuuccaugac

SEQ ID NO: 1903287 - RNA, 20 nt, Homo sapiens
aauccacaguauuguucuug

SEQ ID NO: 1903288 - RNA, 11 nt, Homo sapiens
gcgaguguuuc

SEQ ID NO: 1903289 - RNA, 16 nt, Homo sapiens
uaaaagugacucucag

SEQ ID NO: 1903290 - RNA, 18 nt, Homo sapiens
acaucagaccugucuucc

SEQ ID NO: 1903291 - RNA, 16 nt, Homo sapiens
gucucaagccuaucua

SEQ ID NO: 1903292 - RNA, 15 nt, Homo sapiens
uaucacacuugcaaa

SEQ ID NO: 1903293 - RNA, 16 nt, Homo sapiens
aaagucuguggcccaa

SEQ ID NO: 1903294 - RNA, 14 nt, Homo sapiens
aguuaucagggaac

SEQ ID NO: 1903295 - RNA, 20 nt, Homo sapiens
uuuauugaguaccuacugug

SEQ ID NO: 1903296 - RNA, 16 nt, Homo sapiens
caucuuucacuaucug

SEQ ID NO: 1903297 - RNA, 19 nt, Homo sapiens
ucaaagaaaacuuccaaaa

SEQ ID NO: 1903298 - RNA, 14 nt, Homo sapiens
uuuuccuaugcucu

SEQ ID NO: 1903299 - RNA, 16 nt, Homo sapiens
accuaauaucacuuaa

SEQ ID NO: 1903300 - RNA, 19 nt, Homo sapiens
cuccccacacagacuccac

SEQ ID NO: 1903301 - RNA, 17 nt, Homo sapiens
agcagagauguucaccu

SEQ ID NO: 1903302 - RNA, 20 nt, Homo sapiens
ugauaaauggaacuauucca

SEQ ID NO: 1903303 - RNA, 20 nt, Homo sapiens
ucaaaaucuucacugaauau

SEQ ID NO: 1903304 - RNA, 22 nt, Homo sapiens
agggcagcuggcccccagcccu

SEQ ID NO: 1903305 - RNA, 19 nt, Homo sapiens
uguaguuaauuuaauuugc

SEQ ID NO: 1903306 - RNA, 13 nt, Homo sapiens
guucagugaccug

SEQ ID NO: 1903307 - RNA, 13 nt, Homo sapiens
agagguaccacag

SEQ ID NO: 1903308 - RNA, 20 nt, Homo sapiens
cccugggggcugugauauua

SEQ ID NO: 1903309 - RNA, 14 nt, Homo sapiens
gcuagggagugguc

SEQ ID NO: 1903310 - RNA, 23 nt, Homo sapiens
aaagguacgauuauacuugagau

SEQ ID NO: 1903311 - RNA, 18 nt, Homo sapiens
augauuuagguacgucaa

SEQ ID NO: 1903312 - RNA, 12 nt, Homo sapiens
aaucaguauaau

SEQ ID NO: 1903313 - RNA, 17 nt, Homo sapiens
auccucugguucuucau

SEQ ID NO: 1903314 - RNA, 17 nt, Homo sapiens
aacuuaaauagcuuuga

SEQ ID NO: 1903315 - RNA, 14 nt, Homo sapiens
ccagaauccucuca

SEQ ID NO: 1903316 - RNA, 19 nt, Homo sapiens
ggaugcgugggaggcagaa

SEQ ID NO: 1903317 - RNA, 23 nt, Homo sapiens
caccgcgaggccuauuguugaau

SEQ ID NO: 1903318 - RNA, 18 nt, Homo sapiens
aagaccagagcaguuuca

SEQ ID NO: 1903319 - RNA, 20 nt, Homo sapiens
gccacacacugaguugcaca

SEQ ID NO: 1903320 - RNA, 18 nt, Homo sapiens
uggugguuaugucccaug

SEQ ID NO: 1903321 - RNA, 18 nt, Homo sapiens
auucuauaagcuauuuau

SEQ ID NO: 1903322 - RNA, 19 nt, Homo sapiens
auguguuuuucuccagugc

SEQ ID NO: 1903323 - RNA, 17 nt, Homo sapiens
gacuguaguuuaauacu

SEQ ID NO: 1903324 - RNA, 19 nt, Homo sapiens
aggcacuguaguucuaaga

SEQ ID NO: 1903325 - RNA, 19 nt, Homo sapiens
auguuggacucugagcuca

SEQ ID NO: 1903326 - RNA, 15 nt, Homo sapiens
ugcagaaacagugca

SEQ ID NO: 1903327 - RNA, 18 nt, Homo sapiens
ugaugauuuucauuucau

SEQ ID NO: 1903328 - RNA, 17 nt, Homo sapiens
gccccuugcaagccaua

SEQ ID NO: 1903329 - RNA, 17 nt, Homo sapiens
cucuagggcaguggagu

SEQ ID NO: 1903330 - RNA, 15 nt, Homo sapiens
cagugucagcacuca

SEQ ID NO: 1903331 - RNA, 13 nt, Homo sapiens
agggcuccaugcu

SEQ ID NO: 1903332 - RNA, 21 nt, Homo sapiens
uaaauccuuugcuucauucca

SEQ ID NO: 1903333 - RNA, 15 nt, Homo sapiens
aaaccagcgcaagga

SEQ ID NO: 1903334 - RNA, 12 nt, Homo sapiens
aacacgugugug

SEQ ID NO: 1903335 - RNA, 16 nt, Homo sapiens
cagagccagucucacc

SEQ ID NO: 1903336 - RNA, 22 nt, Homo sapiens
uugaacuucauaagguaauuca

SEQ ID NO: 1903337 - RNA, 18 nt, Homo sapiens
ggcaagagccacaguaua

SEQ ID NO: 1903338 - RNA, 16 nt, Homo sapiens
agagacagauaccucc

SEQ ID NO: 1903339 - RNA, 18 nt, Homo sapiens
aguucauggugaucagug

SEQ ID NO: 1903340 - RNA, 19 nt, Homo sapiens
agauucccucuuccugcca

SEQ ID NO: 1903341 - RNA, 20 nt, Homo sapiens
uuuuaaaaugaaaugcauuu

SEQ ID NO: 1903342 - RNA, 22 nt, Homo sapiens
acuguggcugcuagcacuugga

SEQ ID NO: 1903343 - RNA, 17 nt, Homo sapiens
uagagaaauuugccaau

SEQ ID NO: 1903344 - RNA, 22 nt, Homo sapiens
aucauuucuauuucuccuccau

SEQ ID NO: 1903345 - RNA, 20 nt, Homo sapiens
ucccuuuuuaaacaaauggc

SEQ ID NO: 1903346 - RNA, 15 nt, Homo sapiens
caggugaacagccuc

SEQ ID NO: 1903347 - RNA, 14 nt, Homo sapiens
ugaacucagcuauu

SEQ ID NO: 1903348 - RNA, 22 nt, Homo sapiens
gagagcccggcgccccugccac

SEQ ID NO: 1903349 - RNA, 19 nt, Homo sapiens
ggaaacuguacuacaucua

SEQ ID NO: 1903350 - RNA, 22 nt, Homo sapiens
aaauauuuuaggaaacucucca

SEQ ID NO: 1903351 - RNA, 15 nt, Homo sapiens
ccugugccaugccca

SEQ ID NO: 1903352 - RNA, 18 nt, Homo sapiens
guuacuacuuacagguga

SEQ ID NO: 1903353 - RNA, 15 nt, Homo sapiens
ugacaugcacucagc

SEQ ID NO: 1903354 - RNA, 15 nt, Homo sapiens
acugagccugagaug

SEQ ID NO: 1903355 - RNA, 22 nt, Homo sapiens
cuaguuauuggaucagugaaaa

SEQ ID NO: 1903356 - RNA, 19 nt, Homo sapiens
ugguuuucucuuacugcag

SEQ ID NO: 1903357 - RNA, 19 nt, Homo sapiens
cagcagucaacuccagggu

SEQ ID NO: 1903358 - RNA, 19 nt, Homo sapiens
aaggaucccaugagcuccu

SEQ ID NO: 1903359 - RNA, 13 nt, Homo sapiens
uaauugcuuugcc

SEQ ID NO: 1903360 - RNA, 19 nt, Homo sapiens
ucguugguagagcccucag

SEQ ID NO: 1903361 - RNA, 15 nt, Homo sapiens
gaacucgaacuugaa

SEQ ID NO: 1903362 - RNA, 17 nt, Homo sapiens
cuaauuauuaagauaug

SEQ ID NO: 1903363 - RNA, 14 nt, Homo sapiens
uuaacuacugaaua

SEQ ID NO: 1903364 - RNA, 22 nt, Homo sapiens
gcaugggcuuugucuuggacuc

SEQ ID NO: 1903365 - RNA, 15 nt, Homo sapiens
uguagagucaaucau

SEQ ID NO: 1903366 - RNA, 21 nt, Homo sapiens
gacccgcccuuagaccaggca

SEQ ID NO: 1903367 - RNA, 19 nt, Homo sapiens
uggcgcugucgguguuugg

SEQ ID NO: 1903368 - RNA, 17 nt, Homo sapiens
aaagagaaaaagcccuc

SEQ ID NO: 1903369 - RNA, 15 nt, Homo sapiens
uauaaagauuguacu

SEQ ID NO: 1903370 - RNA, 16 nt, Homo sapiens
uccucgcugugccacc

SEQ ID NO: 1903371 - RNA, 23 nt, Homo sapiens
cugggcugcuguagaugacuacu

SEQ ID NO: 1903372 - RNA, 20 nt, Homo sapiens
ugaaugccuccuguggggaa

SEQ ID NO: 1903373 - RNA, 12 nt, Homo sapiens
aaggagggaugc

SEQ ID NO: 1903374 - RNA, 13 nt, Homo sapiens
auuuaaugcauua

SEQ ID NO: 1903375 - RNA, 22 nt, Homo sapiens
ccuauuucccuaccaaccaagg

SEQ ID NO: 1903376 - RNA, 22 nt, Homo sapiens
cuggagccggggugggugugcu

SEQ ID NO: 1903377 - RNA, 17 nt, Homo sapiens
cugguacgaaucucauc

SEQ ID NO: 1903378 - RNA, 18 nt, Homo sapiens
cauguguugcaccguucu

SEQ ID NO: 1903379 - RNA, 20 nt, Homo sapiens
cuucucccuccuccuccuuu

SEQ ID NO: 1903380 - RNA, 14 nt, Homo sapiens
ggcacagugggccu

SEQ ID NO: 1903381 - RNA, 20 nt, Homo sapiens
acaggcauauucccugcaca

SEQ ID NO: 1903382 - RNA, 20 nt, Homo sapiens
uucacuccagccugggugac

SEQ ID NO: 1903383 - RNA, 15 nt, Homo sapiens
ccugcuuaggccacu

SEQ ID NO: 1903384 - RNA, 12 nt, Homo sapiens
agaccuacccuc

SEQ ID NO: 1903385 - RNA, 13 nt, Homo sapiens
auucccucuacug

SEQ ID NO: 1903386 - RNA, 17 nt, Homo sapiens
cuuccucccucauggaa

SEQ ID NO: 1903387 - RNA, 22 nt, Homo sapiens
aggacuugugccucuugggaga

SEQ ID NO: 1903388 - RNA, 20 nt, Homo sapiens
caugguacuuccucugugaa

SEQ ID NO: 1903389 - RNA, 19 nt, Homo sapiens
auugccuccuuauuuauca

SEQ ID NO: 1903390 - RNA, 21 nt, Homo sapiens
uccaguaagcagguacuacau

SEQ ID NO: 1903391 - RNA, 15 nt, Homo sapiens
uauccaaucugugau

SEQ ID NO: 1903392 - RNA, 19 nt, Homo sapiens
caugaagaaugcauucaaa

SEQ ID NO: 1903393 - RNA, 22 nt, Homo sapiens
agcagaccacacagaagggugu

SEQ ID NO: 1903394 - RNA, 13 nt, Homo sapiens
agaaguugacaug

SEQ ID NO: 1903395 - RNA, 14 nt, Homo sapiens
uccaucucagucac

SEQ ID NO: 1903396 - RNA, 17 nt, Homo sapiens
aacaaugaauucuucaa

SEQ ID NO: 1903397 - RNA, 17 nt, Homo sapiens
auuccaccuagagcuag

SEQ ID NO: 1903398 - RNA, 16 nt, Homo sapiens
uaggaagaccaagaca

SEQ ID NO: 1903399 - RNA, 18 nt, Homo sapiens
aucuacuuuuuguauuua

SEQ ID NO: 1903400 - RNA, 13 nt, Homo sapiens
ccuuagucuuucc

SEQ ID NO: 1903401 - RNA, 14 nt, Homo sapiens
cuguggaugccagg

SEQ ID NO: 1903402 - RNA, 17 nt, Homo sapiens
ccaaaucugacauauua

SEQ ID NO: 1903403 - RNA, 20 nt, Homo sapiens
ggcaagucuagagucucaga

SEQ ID NO: 1903404 - RNA, 15 nt, Homo sapiens
cucuuguagcucucu

SEQ ID NO: 1903405 - RNA, 22 nt, Homo sapiens
gaaacaauguggagucucccuc

SEQ ID NO: 1903406 - RNA, 16 nt, Homo sapiens
uuauaguaacaucaaa

SEQ ID NO: 1903407 - RNA, 22 nt, Homo sapiens
augaaaccuuauuuuuucccaa

SEQ ID NO: 1903408 - RNA, 21 nt, Homo sapiens
aggcucaaaggcauaagucau

SEQ ID NO: 1903409 - RNA, 21 nt, Homo sapiens
aaagacauuuuuuaaaagccu

SEQ ID NO: 1903410 - RNA, 14 nt, Homo sapiens
uuccugagacagaa

SEQ ID NO: 1903411 - RNA, 12 nt, Homo sapiens
aucagauuuauu

SEQ ID NO: 1903412 - RNA, 18 nt, Homo sapiens
uggaggcugucuucucag

SEQ ID NO: 1903413 - RNA, 16 nt, Homo sapiens
cucgacggcacgcacu

SEQ ID NO: 1903414 - RNA, 21 nt, Homo sapiens
accugagcugaaauaaaguga

SEQ ID NO: 1903415 - RNA, 15 nt, Homo sapiens
ugguggagcagagug

SEQ ID NO: 1903416 - RNA, 18 nt, Homo sapiens
cagagcagccucauccca

SEQ ID NO: 1903417 - RNA, 21 nt, Homo sapiens
uucugcuguagccugggacca

SEQ ID NO: 1903418 - RNA, 14 nt, Homo sapiens
cucccuuccaggaa

SEQ ID NO: 1903419 - RNA, 22 nt, Homo sapiens
cagauagagaguuguuguguac

SEQ ID NO: 1903420 - RNA, 18 nt, Homo sapiens
aaaucaaucaauggugca

SEQ ID NO: 1903421 - RNA, 21 nt, Homo sapiens
ccugggagcccccaccacaaa

SEQ ID NO: 1903422 - RNA, 12 nt, Homo sapiens
ccuacucugcaa

SEQ ID NO: 1903423 - RNA, 22 nt, Homo sapiens
augaucgcgccacuacacucca

SEQ ID NO: 1903424 - RNA, 14 nt, Homo sapiens
cccuagugagggca

SEQ ID NO: 1903425 - RNA, 22 nt, Homo sapiens
aucccuuccagauggucaucca

SEQ ID NO: 1903426 - RNA, 21 nt, Homo sapiens
uucgcacacugugauuuugcc

SEQ ID NO: 1903427 - RNA, 20 nt, Homo sapiens
gaccuggguggggucaggga

SEQ ID NO: 1903428 - RNA, 17 nt, Homo sapiens
gagacaccaguggugcg

SEQ ID NO: 1903429 - RNA, 17 nt, Homo sapiens
acaccuguguccaagaa

SEQ ID NO: 1903430 - RNA, 19 nt, Homo sapiens
cccucaaagaagucggaau

SEQ ID NO: 1903431 - RNA, 18 nt, Homo sapiens
gacucaacgagagcacuu
